United States Patent 8,461,315 (MICRORNAS AND USES THEREOF) - sequence listing, part 7

SEQ ID NO: 161762 - RNA, 64 nt, Homo Sapiens
uauacuauaaauauuaauaauuuauuuucagcaacauauagaaauuuucuuaaagaaaggauga

SEQ ID NO: 161763 - RNA, 64 nt, Homo Sapiens
cuguauuucugauagaccauugacuugaagcuaucauauagaucuuugugacguguauuuuuug

SEQ ID NO: 161764 - RNA, 64 nt, Homo Sapiens
uggauggaaagacaaacugcacaggcagauguuugccucauaauagucguaaguggaguccugg

SEQ ID NO: 161765 - RNA, 64 nt, Homo Sapiens
aacccagucacacuguggccaguaaaauacuauugccucauauuguccucugcaagcuucuugc

SEQ ID NO: 161766 - RNA, 64 nt, Homo Sapiens
ucuagaauuuaauuuucacaucacuguacauaauguaucauacuauagucuugaacacuguuaa

SEQ ID NO: 161767 - RNA, 64 nt, Homo Sapiens
ugauaucaagucaaaaucaguuugaaaagaagguguaucauauuuuauauugucacuagaaucu

SEQ ID NO: 161768 - RNA, 64 nt, Homo Sapiens
uuauuuuuuaaaacucaaagagggaaagagccuuguaucauaugugaacauuguaucauaggua

SEQ ID NO: 161769 - RNA, 64 nt, Homo Sapiens
agagggaaagagccuuguaucauaugugaacauuguaucauagguaauguuguacagacccuuu

SEQ ID NO: 161770 - RNA, 64 nt, Homo Sapiens
aaucauuuuacccuuggcucaagaacucugggcugcuacccagauugccuaauaaacauccuuc

SEQ ID NO: 161771 - RNA, 64 nt, Homo Sapiens
ucuaaauagcaauuucgccgaucagagagcgagcgcuacccacucucuaugccagcucaguccc

SEQ ID NO: 161772 - RNA, 64 nt, Homo Sapiens; identical to SEQ ID NO: 156330

SEQ ID NO: 161773 - RNA, 64 nt, Homo Sapiens; identical to SEQ ID NO: 156331

SEQ ID NO: 161774 - RNA, 64 nt, Homo Sapiens; identical to SEQ ID NO: 156332

SEQ ID NO: 161775 - RNA, 64 nt, Homo Sapiens; identical to SEQ ID NO: 156333

SEQ ID NO: 161776 - RNA, 64 nt, Homo Sapiens; identical to SEQ ID NO: 156334

SEQ ID NO: 161777 - RNA, 64 nt, Homo Sapiens; identical to SEQ ID NO: 156335

SEQ ID NO: 161778 - RNA, 64 nt, Homo Sapiens; identical to SEQ ID NO: 156336

SEQ ID NO: 161779 - RNA, 64 nt, Homo Sapiens; identical to SEQ ID NO: 156337

SEQ ID NO: 161780 - RNA, 64 nt, Homo Sapiens; identical to SEQ ID NO: 156338

SEQ ID NO: 161781 - RNA, 64 nt, Homo Sapiens; identical to SEQ ID NO: 156339

SEQ ID NO: 161782 - RNA, 64 nt, Homo Sapiens; identical to SEQ ID NO: 156340

SEQ ID NO: 161783 - RNA, 64 nt, Homo Sapiens; identical to SEQ ID NO: 156341

SEQ ID NO: 161784 - RNA, 64 nt, Homo Sapiens
gauucaaauaggcaguucucuuauuuggucgacuuuugugaaugugugacauaaacagauguaa

SEQ ID NO: 161785 - RNA, 64 nt, Homo Sapiens
ggaaaauguauucuguauguaguguagauaauacuuugugaauggacaacaguuacauaguguc

SEQ ID NO: 161786 - RNA, 64 nt, Homo Sapiens
aacaguaggggaggaaauaaaccauacaguuuccuuugugaaagcaaauaucucaguuacauuu

SEQ ID NO: 161787 - RNA, 64 nt, Homo Sapiens
agaagccuaaauucagcaucuagaugugaggcuuuuugugaaaguuaagauaauaucaagaguc

SEQ ID NO: 161788 - RNA, 64 nt, Homo Sapiens
aaaauaacgugcuucauuugaauuuuguacagucuuugugaaaucuaccccauguuuuauaagg

SEQ ID NO: 161789 - RNA, 64 nt, Homo Sapiens
cagacuaugagcucaccuaccugaaaauauucuguuugugaauugacacauacagaccucaagc

SEQ ID NO: 161790 - RNA, 64 nt, Homo Sapiens
uuuccugacaacgaaagugaagaguaucacagaauuugugaauuacuuucugacuacaaagaaa

SEQ ID NO: 161791 - RNA, 64 nt, Homo Sapiens
ucuagugacgaacaaaaugauacucagaagcaauuuugugaagaacagaacacuggaauauuac

SEQ ID NO: 161792 - RNA, 64 nt, Homo Sapiens
cauaauccuacuaauuucuuugcagcuuauuaauuuugugaaauuuguauauaugaagaauuug

SEQ ID NO: 161793 - RNA, 64 nt, Homo Sapiens
ccccauuuuuugaaauagagaauauuuuauuauuuuugugaaaauagaguuuugguaaucacuu

SEQ ID NO: 161794 - RNA, 64 nt, Homo Sapiens
caguggaguucacaagacuacaccagcugcugaguuugugaagaucaguucuucagagagcuuc

SEQ ID NO: 161795 - RNA, 64 nt, Homo Sapiens
accucugcaagcaccucuucccgagacccugaucuuugugaaauagcagaagucaacuuuuggg

SEQ ID NO: 161796 - RNA, 64 nt, Homo Sapiens
aagaacuuguggaugacuuuugucccauguggcuuuugugaaguauggcaaagguuuuucauga

SEQ ID NO: 161797 - RNA, 64 nt, Homo Sapiens
aggagugcacagcuccugcugauguauuuuucuuuuugugaaggcaaagggacaauuaucacug

SEQ ID NO: 161798 - RNA, 64 nt, Homo Sapiens
gagugacauguucgaaaccuguccauaaaguaauuuugugaaagaaggagcaagagaacauucc

SEQ ID NO: 161799 - RNA, 64 nt, Homo Sapiens
uaugcuaagcaguagucgucaaguugcagaucuuuuugugaaauucaaccugugucuuauaggu

SEQ ID NO: 161800 - RNA, 64 nt, Homo Sapiens
aaaagucagucuuacuccaacauuugugaacugauuugugaagguuugagaucgccaccagaac

SEQ ID NO: 161801 - RNA, 64 nt, Homo Sapiens
gauuugugaaggaaaagucacgccaccagaaccauuugugaacucauguuugucucuuugagau

SEQ ID NO: 161802 - RNA, 64 nt, Homo Sapiens
auauuuauacaugagaaacagccuucaacaaguauuugugaagugacugagaaucuagcacuuc

SEQ ID NO: 161803 - RNA, 64 nt, Homo Sapiens
uaguucuuaucaaccuugaaugacuacagauuauuuugugaaggaggaugaaguaauguguguu

SEQ ID NO: 161804 - RNA, 64 nt, Homo Sapiens
caucugugggaggaguaaagcaccaguuuuuguauuugugaacuuguacuugaguauaaaugua

SEQ ID NO: 161805 - RNA, 64 nt, Homo Sapiens
gcaucuucuuacugcaucagaacuuguguaaagguuugugaaauucuuuaguugacaguucaca

SEQ ID NO: 161806 - RNA, 64 nt, Homo Sapiens
aaauauacauaucgaagacauacaaggcuauucauuugugaaacgauccauaugcauaagauug

SEQ ID NO: 161807 - RNA, 64 nt, Homo Sapiens
uugaauaauaauguuuaaauauuugucucuuaguuuugugaauuuugaaaguuuaauucuuuaa

SEQ ID NO: 161808 - RNA, 64 nt, Homo Sapiens
uuauacaauugaaagucuuuuuauacuuuacugguuugugaauuaccauuucuccauggugucu

SEQ ID NO: 161809 - RNA, 64 nt, Homo Sapiens
auugagaaauguaacauucacauauaauauauuguuugugaauuaauauuuaauauaaauauac

SEQ ID NO: 161810 - RNA, 64 nt, Homo Sapiens
auuuguaaagaaaacaacagaaaucuuuaugcaauuugugaauuuuguauauuagggaggaaaa

SEQ ID NO: 161811 - RNA, 64 nt, Homo Sapiens
uagaaaguauuuggcucuaggaaacauuuacuuguuugugaaaacaauaccccaagguaauagg

SEQ ID NO: 161812 - RNA, 64 nt, Homo Sapiens
uccagcuccccuaacagacagcugcugcuucuauuuugugaagggacuauauuuuuugagaaag

SEQ ID NO: 161813 - RNA, 64 nt, Homo Sapiens
uuuuuugagaaaggaaaaucucaguuagauauauuuugugaacccuugauuagacauauuaaaa

SEQ ID NO: 161814 - RNA, 64 nt, Homo Sapiens
cagucuuaaguugauauuuauagaaaugaauaccuuugugaaccuagacuuagaacaaauccug

SEQ ID NO: 161815 - RNA, 64 nt, Homo Sapiens
uacuuccuuuacauuauucuccuauuuuagacauuuugugaaagagaacaaauuguccaguggc

SEQ ID NO: 161816 - RNA, 64 nt, Homo Sapiens
gaaagaguccugggauuuguacuucaugaagacuuuugugaaagaauagguguccuuaugaaca

SEQ ID NO: 161817 - RNA, 64 nt, Homo Sapiens
cucugaacauauuuuauuuuuuaaaaaaacuauguuugugaauuuugcguauacuggcaagcuu

SEQ ID NO: 161818 - RNA, 64 nt, Homo Sapiens
uacuagggcaugauacaguaugugaauaucuaaguuugugaaacaauauauuccaaaacauuuu

SEQ ID NO: 161819 - RNA, 64 nt, Homo Sapiens
ucuaaguuugugaaacuacuuauuccaaaacauuuuugugaauacuucacauucccaaggaaua

SEQ ID NO: 161820 - RNA, 64 nt, Homo Sapiens
uuguguuguguuguccauugaagaaacuaguacauuugugaaaacuacccccuuuuuuaacaaa

SEQ ID NO: 161821 - RNA, 64 nt, Homo Sapiens
aacucugagaauuagcuaaaacuguucuaauugguuugugaaaguugucugccauuguugauaa

SEQ ID NO: 161822 - RNA, 64 nt, Homo Sapiens
gcauuguuucuaaaggaaguaguaaagcuccauuuuugugaauuuuggaaauguaaaagaaaaa

SEQ ID NO: 161823 - RNA, 64 nt, Homo Sapiens
ugcaacaguaaucagaguuagcaccugaaauuaauuugugaauuauaaaccaguaucguuacug

SEQ ID NO: 161824 - RNA, 64 nt, Homo Sapiens
auuauucagugaauuuguccaaccgaacauaucauuugugaagaguauucuccauccucccagg

SEQ ID NO: 161825 - RNA, 64 nt, Homo Sapiens
uuauuuuuuuuugguauuuguuuauugguugguuuuugugaaguguuugcuuucuguuguuuug

SEQ ID NO: 161826 - RNA, 64 nt, Homo Sapiens
auuuauucuacugaaggcacgacauccugcacaauuugugaagcggagaccacagccuuaguau

SEQ ID NO: 161827 - RNA, 64 nt, Homo Sapiens
auugcauccuugauuucuugacuguuugcaacacuuugugaacuggaccaugcaacauuuguga

SEQ ID NO: 161828 - RNA, 64 nt, Homo Sapiens
guuugcaacacuuugugaacuggaccaugcaacauuugugaacugacaggugaacucugggaau

SEQ ID NO: 161829 - RNA, 64 nt, Homo Sapiens
cagucucuguuucauggcaacacuggauaauggcuuugugaaauuuaaaaaauuuuuguagcga

SEQ ID NO: 161830 - RNA, 64 nt, Homo Sapiens
aacaaccauugcauguuugcuuuugauguaucccuuugugaaauuagcacuuuuggggccaaug

SEQ ID NO: 161831 - RNA, 64 nt, Homo Sapiens
auugaacuagaauaaugaaacucuguacaguauguuugugaaaguuguuuuauaccauauaaga

SEQ ID NO: 161832 - RNA, 64 nt, Homo Sapiens
uuaagguuuugaaagaaucuucuuauaguugucuuuugugaacuaaaagaaacaaaaaggaacu

SEQ ID NO: 161833 - RNA, 64 nt, Homo Sapiens
guauuugcauugugucuucaguauuuucuuaagguuugugaagaugaaaauaauguauuuauaa

SEQ ID NO: 161834 - RNA, 64 nt, Homo Sapiens
aguguauuguguuuuguaaaacaguguuuugcaauuugugaaacuuuuuauugguaguaacuga

SEQ ID NO: 161835 - RNA, 56 nt, Homo Sapiens
uggacacguuugauaguuaacauuucuuugugaaagguaauggacucacaagggga

SEQ ID NO: 161836 - RNA, 64 nt, Homo Sapiens
acaugcugagaauggaaagucuaccggcccuuucuuugugaacgucacauuggccgagccgugu

SEQ ID NO: 161837 - RNA, 64 nt, Homo Sapiens
cucccuuuuuucaaaauugaaguuggguuggcucuuugugaaccucucauccccacagcagaau

SEQ ID NO: 161838 - RNA, 64 nt, Homo Sapiens
ggggguggauguagcugcagaaagcaugcacaacuuugugaaagaggcccugccuugugcaugu

SEQ ID NO: 161839 - RNA, 64 nt, Homo Sapiens
gauugcuauacauacucauuagguaaguauuuuauuugugaaaucaauucaggaugagauguuu

SEQ ID NO: 161840 - RNA, 64 nt, Homo Sapiens
cuaaaguuacauuuguaagauucuacuuaucuauuuugugaauuguuuuuuuccuuuugguccu

SEQ ID NO: 161841 - RNA, 64 nt, Homo Sapiens
ugguuuauuccacuggagaaacauagggcagcucuuugugaaaggcuagaaaucuguggguuau

SEQ ID NO: 161842 - RNA, 64 nt, Homo Sapiens
uuaauuucucucuauagcacuuugcuuuuauacuuuugugaaauguuacagauuuuagccaguc

SEQ ID NO: 161843 - RNA, 64 nt, Homo Sapiens
acuucguuucuccaggauuccuuuucugaaaaccuuugugaauuccuaagacgauuggcgaaaa

SEQ ID NO: 161844 - RNA, 51 nt, Homo Sapiens
aaugcaauaagcccggggguguuugugaaaaggcugcggaaaaugagauga

SEQ ID NO: 161845 - RNA, 64 nt, Homo Sapiens
uauugccaccaagacuuuccaggcucuucgcauauuugugaacaaugagcucaaugaacucuac

SEQ ID NO: 161846 - RNA, 64 nt, Homo Sapiens
cauuguauaaauuucucuuugcauauaauacauauuugugaaugagacauauucccaaaaaauu

SEQ ID NO: 161847 - RNA, 64 nt, Homo Sapiens
uucauguacuucccuaggacuagaugcauaccguuuugugaaaaccagccauaggaaaacaugu

SEQ ID NO: 161848 - RNA, 64 nt, Homo Sapiens
ggggguaaacaggccagaagagugugccaaguuguuugugaaucauuccaagcaccucagauga

SEQ ID NO: 161849 - RNA, 64 nt, Homo Sapiens
uaagagugauaaaagugggaagacauaaagagccuuugugaauuaaaguggaagagaauaacac

SEQ ID NO: 161850 - RNA, 64 nt, Homo Sapiens
acuaugucuguguuucuuaggaauguugaagcuuuuugugaaaacuguacuguauacauauaua

SEQ ID NO: 161851 - RNA, 64 nt, Homo Sapiens
gaacuuguuuacuauuggagauuuaguaacagccuuugugaaaugauaacaucauacauaaguc

SEQ ID NO: 161852 - RNA, 64 nt, Homo Sapiens
aggguggaugaaaaugcauuugagcucuccugacuuugugaaaaauuuuugacuuuauauuucc

SEQ ID NO: 161853 - RNA, 64 nt, Homo Sapiens
uugaguuuuuccaaugugcuuugugaauguaaaauuugugaaacgagcaaaaagugacuucuuu

SEQ ID NO: 161854 - RNA, 64 nt, Homo Sapiens
uaaaauuugugaaacuugagaaaagugacuucuuuuugugaauguccgugugugacuuugagca

SEQ ID NO: 161855 - RNA, 64 nt, Homo Sapiens
uguguauuguauauauucugccuauaguguuugcuuugugaacauuuuucaaaucuguucugag

SEQ ID NO: 161856 - RNA, 64 nt, Homo Sapiens
ucucaagggaaggugaugcacugggcacuggcauuuugugaaacuuauagcauugugauucuuu

SEQ ID NO: 161857 - RNA, 64 nt, Homo Sapiens
aacuuuuagaacagaccuuuuuuaaauauauauauuugugaaagcuagguagccuauuuuaaua

SEQ ID NO: 161858 - RNA, 64 nt, Homo Sapiens
auuucaaaaucaucucaugacccuugugugccucuuugugaagcccuauuuagcaauuucaggg

SEQ ID NO: 161859 - RNA, 64 nt, Homo Sapiens
cuuuaauagaaagcugcuauuauguauauugucauuugugaaggaaguuggagagucacagcuu

SEQ ID NO: 161860 - RNA, 64 nt, Homo Sapiens
auaccaauuuaaaaauauaaauuuuugccacuguuuugugaacggaggauuuguacgcuaaauu

SEQ ID NO: 161861 - RNA, 64 nt, Homo Sapiens
cuagugauugccuacuuucacauuuauuuaaauuuuugugaaagaaaauacaguuuuaaaggcu

SEQ ID NO: 161862 - RNA, 64 nt, Homo Sapiens
ugugucuaaauuaaagcauuacaagaauuacaguuuugugaaguuuuuugcauguacaguuuuu

SEQ ID NO: 161863 - RNA, 64 nt, Homo Sapiens
aaccuacuccuauauacugauagugcacaacacauuugugaaauauauauacaacuaugugacu

SEQ ID NO: 161864 - RNA, 64 nt, Homo Sapiens
ucccaguuaaauauauacaacaggcuggaagucuuuugugaaauacguugccacacaaggugca

SEQ ID NO: 161865 - RNA, 64 nt, Homo Sapiens
uacuuguuaacacaucuaaauuuugucuuuugaauuugugaauacugaaggaaacucuguauca

SEQ ID NO: 161866 - RNA, 64 nt, Homo Sapiens
cuuaaaaguccuuucuuuuuagaucuuuaaaauuuuugugaauaaaucuuuccuuauuucaaca

SEQ ID NO: 161867 - RNA, 64 nt, Homo Sapiens
uauuaaauacuugaguuaaguuuauuaggaauuuuuugugaagcuaauuaugcagaauaagcuc

SEQ ID NO: 161868 - RNA, 64 nt, Homo Sapiens
gugcaaaugauaucaccuauuuguacaugauugcuuugugaaauuaaugaguauauaucaguua

SEQ ID NO: 161869 - RNA, 64 nt, Homo Sapiens
uacacuggaagcguggggggaacacaugacaugauuugugaauaucaucaucuuugccagacaa

SEQ ID NO: 161870 - RNA, 64 nt, Homo Sapiens
agucacuucaccucccugagccccaauucccaaguuugugaaauggcaacaauaccuauguguc

SEQ ID NO: 161871 - RNA, 64 nt, Homo Sapiens
gccugauguuugggaccuuuuacuguggguuauuuuugugaacagauuuguuuucuaaaguuga

SEQ ID NO: 161872 - RNA, 64 nt, Homo Sapiens
agaguuggcaugucaaaugcuguaacaauguauuuuugugaaugguggggcaguucaacacaaa

SEQ ID NO: 161873 - RNA, 64 nt, Homo Sapiens
aaaaacagauuaucuaaagcuaagggaacauugguuugugaagggacauuaucauggcaugacu

SEQ ID NO: 161874 - RNA, 64 nt, Homo Sapiens
gagaguagaaggggagaagucacuuaagcuuagauuugugaagguucugcuuuuuagaagccug

SEQ ID NO: 161875 - RNA, 64 nt, Homo Sapiens
ucuugagguggggaaggaggugaugaaacauuaguuugugaaauccaaggcccuggcuugcuuu

SEQ ID NO: 161876 - RNA, 64 nt, Homo Sapiens
uuuuuuaaaaggagcaguguggauuuucgcacccuuugugaacuaaguucaaugcgcucuaucc

SEQ ID NO: 161877 - RNA, 64 nt, Homo Sapiens
ccaaucaauuacuagaugaguucuuucccuacccuuugugaaaacgaauucaccaaccaggggu

SEQ ID NO: 161878 - RNA, 64 nt, Homo Sapiens
ccugauuuaaaaagaaaaaaaugcacaagaucuguuugugaaagugccuccacccaggagacug

SEQ ID NO: 161879 - RNA, 64 nt, Homo Sapiens
aaaauuauaacauuuacuuuugguaaagcagacuuuugugaacaaucuauaccuuacugcaauu

SEQ ID NO: 161880 - RNA, 64 nt, Homo Sapiens
ugcccaccaaaacacagaagaacaggcugauaccuuugugaaguggacugucuaugaacuugca

SEQ ID NO: 161881 - RNA, 64 nt, Homo Sapiens
gaaugacaucuuaaagccaccauugcguuccucauuugugaacugucuucucauauuuuaaguc

SEQ ID NO: 161882 - RNA, 64 nt, Homo Sapiens
auguuuucuuggauuguugucuuuaaaaaggauuuuugugaagcaauugauuuaucaaagcaaa

SEQ ID NO: 161883 - RNA, 64 nt, Homo Sapiens
ucuucuaaaaguguuccaaugaauugaaaaauucuuugugaagguaaaucuguaauagauuuua

SEQ ID NO: 161884 - RNA, 64 nt, Homo Sapiens
cuggaaguaacguggaaaucaugaaagcaaaaaauuugugaauaaaacauuagguuaguuugua

SEQ ID NO: 161885 - RNA, 64 nt, Homo Sapiens
ugucugaugaucucuucccaagaaauaaugguuauuugugaacucaacuucaacugaauucugc

SEQ ID NO: 161886 - RNA, 64 nt, Homo Sapiens
aaugugcuuugauucgaaggucugugguuuaagcuuugugaaaguuccauuucuggacaugacg

SEQ ID NO: 161887 - RNA, 64 nt, Homo Sapiens
gguacuacagcuuauugacauucuaauaaagucauuugugaaaguuagauaucuagacaauuuc

SEQ ID NO: 161888 - RNA, 64 nt, Homo Sapiens
aaaugcuguugcuguauuguuaguaauaaaauguuuugugaaaauauaaguaaaauaucaauua

SEQ ID NO: 161889 - RNA, 64 nt, Homo Sapiens
uccuugucuauuuugcucgcuuuuguuauugcccuuugugaauuugaauaugucaagauuacua

SEQ ID NO: 161890 - RNA, 64 nt, Homo Sapiens
caaacucucuagugcaggaaaaggcugcagcuaauuugugaaaguggcaagcucuucauugcac

SEQ ID NO: 161891 - RNA, 64 nt, Homo Sapiens
uucuguaauucuucuccuuugucaaaugguauuuuuugugaaugguugcaaaguguugucuuau

SEQ ID NO: 161892 - RNA, 50 nt, Homo Sapiens
cuuacuguuccucuccuugauuugugaaguugugccuaauuauguaaaaa

SEQ ID NO: 161893 - RNA, 64 nt, Homo Sapiens
cuccucccaaccccugauuggggaaaagguugaauuugugaaacaaucugcuccaaccuucuau

SEQ ID NO: 161894 - RNA, 64 nt, Homo Sapiens
auauauuguauuucuuuugaacagugaugagaaauuugugaaaaguugauuuuaaagugaauuu

SEQ ID NO: 161895 - RNA, 64 nt, Homo Sapiens
uauuuuuugcuuuuuaaauacaucuucaguuguguuugugaaggauucuccuagguagagccuc

SEQ ID NO: 161896 - RNA, 64 nt, Homo Sapiens
cuguaaaccuugugaucuucucaaaaucuggccauuugugaaucguugaggaauagguuuuuac

SEQ ID NO: 161897 - RNA, 64 nt, Homo Sapiens
uuaaucaucuuuuaaaauguuuaugcuauuuaauuuugugaaacccaauguuaauaugauuaau

SEQ ID NO: 161898 - RNA, 64 nt, Homo Sapiens
ccuuuuuugugcgggagagcagguguugcucuucaguauguagccuaaaaaaaucuuaauuauu

SEQ ID NO: 161899 - RNA, 64 nt, Homo Sapiens
agcugaugcuugaucuugcacaauuuuuaugucuaguauguaugcuugagugaaugugcgagua

SEQ ID NO: 161900 - RNA, 64 nt, Homo Sapiens
uuugucuuuggaaaauuacaaacauacuuggagaaguauguaauuuuuaucaaaaugucaaaau

SEQ ID NO: 161901 - RNA, 64 nt, Homo Sapiens
cuaaaagggggaauauaugcuaagcauaagcuacaguauguaaauagaguaugcuacagucacu

SEQ ID NO: 161902 - RNA, 64 nt, Homo Sapiens
acugauaaugacaauaaaugauucaguuauguacaguauguaauguuguauaaaaguacagcac

SEQ ID NO: 161903 - RNA, 64 nt, Homo Sapiens
cagcucuuguaauacucauaaauauaaacuugaaaguauguaguggucauauccuuugucagga

SEQ ID NO: 161904 - RNA, 64 nt, Homo Sapiens
ucacuuuaugacugacaauuuuaauauauauuuuaguauguauuaaugcagauuuggugaauau

SEQ ID NO: 161905 - RNA, 64 nt, Homo Sapiens
gcugguaacaccucgguuucacaaauggcagaacaguauguaaaauguugugguugcaccccuc

SEQ ID NO: 161906 - RNA, 64 nt, Homo Sapiens
ucuugcagauaugaaguauucuuggaaugcaauaaguauguauugaacuguacuguaaaguagc

SEQ ID NO: 161907 - RNA, 64 nt, Homo Sapiens
ucuguuggagugggaugcuuuuagacauauauuaaguauguacauguuuaauauguauauuuaa

SEQ ID NO: 161908 - RNA, 64 nt, Homo Sapiens
cagucauaaugaugugacugucucaacaaggagcaguauguacaagagcauaauacacuguuuu

SEQ ID NO: 161909 - RNA, 64 nt, Homo Sapiens
uucuuuuuuuuuuagacagccaauucgauguuuaaguauguaagugaaugccaaacacuuaaag

SEQ ID NO: 161910 - RNA, 64 nt, Homo Sapiens
uuuacauuagaaaagguuuucucccucugaaaaaaguauguauuucuaguuuaaguuguucccc

SEQ ID NO: 161911 - RNA, 64 nt, Homo Sapiens
caggagacaggaagguggugacuaaaguauguaaaguauguaaauuuacucaaucuccccuugc

SEQ ID NO: 161912 - RNA, 64 nt, Homo Sapiens
guauguaaacaggagacagguccccuugcacuaaaguauguaaacagguuuaguuuacucaauc

SEQ ID NO: 161913 - RNA, 64 nt, Homo Sapiens
auccauuguagaauucauguaaauagaauacuguaguauguacuuugccuucuuccucucugca

SEQ ID NO: 161914 - RNA, 64 nt, Homo Sapiens
ggcaccaggugugaucuaccacaccugucuaaaaaguauguauuuuuaaauuuuuuuguagaga

SEQ ID NO: 161915 - RNA, 64 nt, Homo Sapiens
gugcuguuuauuaacaaaagauguaguauguaaaaguauguaacuucacagaugcauuuuugaa

SEQ ID NO: 161916 - RNA, 64 nt, Homo Sapiens
aguauguaacgugcuguuuacauuuuugaaauguaguauguaaauaucauauuauucacagaug

SEQ ID NO: 161917 - RNA, 64 nt, Homo Sapiens
aaaaaaauaauuaaauccucauggccucuaaauuaguauguagaacacugaaaaguucuuaaca

SEQ ID NO: 161918 - RNA, 64 nt, Homo Sapiens
auaaaaguucuaagaaaacauuuuugcuauuuuaaguauguaagggaagagaggaguguuuuua

SEQ ID NO: 161919 - RNA, 64 nt, Homo Sapiens
uacugauuuguuuccaugcugauuguguggaaccaguauguagcaaauggaaagccuagaaaua

SEQ ID NO: 161920 - RNA, 64 nt, Homo Sapiens
uuucuagcuaugguauuacuauaucacacuugugaguauguauucaaauacuaaguaucuuaua

SEQ ID NO: 161921 - RNA, 64 nt, Homo Sapiens
ggcaaaacacuauguauagucugagccagaucaaaguauguauguuuuuaauaugcauagaaca

SEQ ID NO: 161922 - RNA, 64 nt, Homo Sapiens
cuuuuuucauuuuguucuguucgaauuuuuuauaaguauguauuacuuuuguaaucagaauuuu

SEQ ID NO: 161923 - RNA, 64 nt, Homo Sapiens
aaaaauuaaauaaugacugcccuguuucuguuuuaguauguaaauccucaguucuucaccuuug

SEQ ID NO: 161924 - RNA, 64 nt, Homo Sapiens; identical to SEQ ID NO: 161919

SEQ ID NO: 161925 - RNA, 64 nt, Homo Sapiens; identical to SEQ ID NO: 161920

SEQ ID NO: 161926 - RNA, 63 nt, Homo Sapiens
augauguaccgggagccagcacgaugguccuacacauuccagacauuuuccuuuuugagccgc

SEQ ID NO: 161927 - RNA, 63 nt, Homo Sapiens
cuucuuauaggcuccacuuugaggcucugaugaacauuccagugcugguguuggaugucaaug

SEQ ID NO: 161928 - RNA, 63 nt, Homo Sapiens
aagacagaggauuguccuuaagucccugcuaaaacauuccauuguuaaaauuugcacuuugaa

SEQ ID NO: 161929 - RNA, 63 nt, Homo Sapiens
aguuuuguacaaugaaaauuacuaauuuguuugacauuccauguuaaacuacggucauguuca

SEQ ID NO: 161930 - RNA, 63 nt, Homo Sapiens
ucaaggucaaagugcauggccagcuccauugagacauuccauuucaaagcaccgugcugacag

SEQ ID NO: 161931 - RNA, 63 nt, Homo Sapiens
cuuugacugucuuauuuauuauaaccuuucagcacauuccaagguuuuaguuacucaggaagg

SEQ ID NO: 161932 - RNA, 63 nt, Homo Sapiens
aaagcaccuuuaaaaaaaauacauuuuaaaaaaacauuccaagccaauuggaagacaucauug

SEQ ID NO: 161933 - RNA, 63 nt, Homo Sapiens
gcuaccuagaaaucuuuuccauuccucuuucauacauuccaacccacuggaagucuuuagagg

SEQ ID NO: 161934 - RNA, 63 nt, Homo Sapiens
aguugccaguggcacauuacaccaguacagagcacauuccaaaggagacauuggaccaguuaa

SEQ ID NO: 161935 - RNA, 63 nt, Homo Sapiens
ugucauucacaucucacaaaaucuugacaucuuacauuccaauacauuaucaagcaagcacaa

SEQ ID NO: 161936 - RNA, 63 nt, Homo Sapiens
gcccugguuuuccugcuugacaggcuuauuucaacauuccaauccacugaaucaaguguauuu

SEQ ID NO: 161937 - RNA, 63 nt, Homo Sapiens
cccaugaggggaaagaggauacuaguaaaccugacauuccagggggcccccacuuuuuaccaa

SEQ ID NO: 161938 - RNA, 63 nt, Homo Sapiens
uaaguccagagaguaaacuugaauggaauaacgacauuccagaaguuaaucauuugaauucug

SEQ ID NO: 161939 - RNA, 63 nt, Homo Sapiens
uuuguaaacuaauaaagguaaucacagccaccaacauuccaagcuacccuggguaccuuugug

SEQ ID NO: 161940 - RNA, 63 nt, Homo Sapiens
uugaaccuagccgacgguuauggaaacccauugacauuccaaaacaauauauacacauaacua

SEQ ID NO: 161941 - RNA, 63 nt, Homo Sapiens
caaaagucuagaagauggguaucaaaacagaagacauuccaggagcuagcaauuuuaagaggu

SEQ ID NO: 161942 - RNA, 63 nt, Homo Sapiens
auuuaauuugugauaccuuuguauguaugagacacauuccaaagagcucuaacuaugauaggu

SEQ ID NO: 161943 - RNA, 63 nt, Homo Sapiens
uacccaucuucagugucuuacuuguacuguaucacauuccauacccucauuuaauucuuaaua

SEQ ID NO: 161944 - RNA, 63 nt, Homo Sapiens
aagaacucaauuugucucccccagcgauaggccacauuccaguuuccauuucagauuugucaa

SEQ ID NO: 161945 - RNA, 63 nt, Homo Sapiens
ucagauuugucaaccagcgacugccauuuggagacauuccauuggagggcggaaagggaggca

SEQ ID NO: 161946 - RNA, 63 nt, Homo Sapiens
ucugaacccgcagcgcccccaucugucuucagcacauuccacggcaucgcauccguccugggc

SEQ ID NO: 161947 - RNA, 63 nt, Homo Sapiens
cacauccuccugcccagcuccucacauacccacacauuccagggcuggggugagccugacugc

SEQ ID NO: 161948 - RNA, 63 nt, Homo Sapiens
uuuuggucuuuuugucuuuugaucucggaggcuacauuccauugguaaauuuuuagagaccca

SEQ ID NO: 161949 - RNA, 63 nt, Homo Sapiens
uauguaugcauauauguauuuccacauauguauacauuccaugcauuccacguguguauauau

SEQ ID NO: 161950 - RNA, 63 nt, Homo Sapiens
uguguauauauuccacauauuccccauauguauacauuccacgcauuccacguguguauauag

SEQ ID NO: 161951 - RNA, 63 nt, Homo Sapiens
uguguauauaguccccauauuccacauauguauacauuccacguguauuccacauguauauau

SEQ ID NO: 161952 - RNA, 64 nt, Homo Sapiens
cuugccacugaggaccgagggaaaggccccacuuucaagucacccuccuuggcucuggagcuau

SEQ ID NO: 161953 - RNA, 64 nt, Homo Sapiens
aaucaguucacucccuggaaccaauuuaaacaacucaagucagaauugcugaugaggccucuuc

SEQ ID NO: 161954 - RNA, 64 nt, Homo Sapiens
gguguuuagauuuaugguuguuaaaaaugucaucucaagucaagucacuggucuguuugcauuu

SEQ ID NO: 161955 - RNA, 64 nt, Homo Sapiens
uuagauuuaugguuguuaaaaaugucaucucaagucaagucacuggucuguuugcauuugauac

SEQ ID NO: 161956 - RNA, 64 nt, Homo Sapiens
ccuuuuuuccuugacauuaauuuuagagaagucaucaagucaugugauuuguuuagcacauagg

SEQ ID NO: 161957 - RNA, 64 nt, Homo Sapiens
ucuucuagaaguuguacagaaggacuaaagcuuaucaagucaacaaagaacuuaccuuggagga

SEQ ID NO: 161958 - RNA, 64 nt, Homo Sapiens
aaaaacacaguaacaggaugaauauuaucugauaucaagucaaaaucaguuugaaaagaaggug

SEQ ID NO: 161959 - RNA, 64 nt, Homo Sapiens
aacaacuuugaaggcaacagaagacacuguuuauucaagucaguucuuugucagguuccugcug

SEQ ID NO: 161960 - RNA, 64 nt, Homo Sapiens
ucagaucguuggcaacucguugucuguuuguuuuucaagucauaccuuuuuagugaugcagauu

SEQ ID NO: 161961 - RNA, 64 nt, Homo Sapiens
uuucuugcuggguuuuaauguagaaaugcuauucucaagucaucauuuuccaauaggauuuaaa

SEQ ID NO: 161962 - RNA, 64 nt, Homo Sapiens; identical to SEQ ID NO: 57312

SEQ ID NO: 161963 - RNA, 64 nt, Homo Sapiens; identical to SEQ ID NO: 57313

SEQ ID NO: 161964 - RNA, 64 nt, Homo Sapiens; identical to SEQ ID NO: 57330

SEQ ID NO: 161965 - RNA, 64 nt, Homo Sapiens; identical to SEQ ID NO: 57331

SEQ ID NO: 161966 - RNA, 64 nt, Homo Sapiens; identical to SEQ ID NO: 57340

SEQ ID NO: 161967 - RNA, 64 nt, Homo Sapiens; identical to SEQ ID NO: 57341

SEQ ID NO: 161968 - RNA, 64 nt, Homo Sapiens; identical to SEQ ID NO: 57362

SEQ ID NO: 161969 - RNA, 64 nt, Homo Sapiens; identical to SEQ ID NO: 57363

SEQ ID NO: 161970 - RNA, 64 nt, Homo Sapiens; identical to SEQ ID NO: 57401

SEQ ID NO: 161971 - RNA, 64 nt, Homo Sapiens; identical to SEQ ID NO: 57402

SEQ ID NO: 161972 - RNA, 64 nt, Homo Sapiens; identical to SEQ ID NO: 57403

SEQ ID NO: 161973 - RNA, 64 nt, Homo Sapiens; identical to SEQ ID NO: 57404

SEQ ID NO: 161974 - RNA, 64 nt, Homo Sapiens; identical to SEQ ID NO: 57405

SEQ ID NO: 161975 - RNA, 64 nt, Homo Sapiens; identical to SEQ ID NO: 57406

SEQ ID NO: 161976 - RNA, 64 nt, Homo Sapiens
cacagucgcccaucgaauaagcaaauuuguuuuugagaauaaacugguaaccaguuugugauga

SEQ ID NO: 161977 - RNA, 64 nt, Homo Sapiens
aaaauucaaaguauguuauuaugauugguuacaagagaauaauguuacauguuuaauuguaaua

SEQ ID NO: 161978 - RNA, 64 nt, Homo Sapiens
cauaauggauaaaaaucguuaacgaaguauuguagagaauaaauugcaaaucauugaacacuuu

SEQ ID NO: 161979 - RNA, 64 nt, Homo Sapiens
gucuuguuaaaaacguggcagauuuccugcugcugagaauaaauagauggaggggucguuucgu

SEQ ID NO: 161980 - RNA, 64 nt, Homo Sapiens
uaauaaacuuguaucgaggauaaacuuguauauggagaauaaacuugcugcuauucugggagaa

SEQ ID NO: 161981 - RNA, 64 nt, Homo Sapiens
uuguauauggagaauaaacuugcugcuauucugggagaauaaaccauccaauucaaguuuuauu

SEQ ID NO: 161982 - RNA, 64 nt, Homo Sapiens
augggccaucccagcacuuacagcuccuaaacaagagaauaaaaggaauaaaacaaucucagag

SEQ ID NO: 161983 - RNA, 64 nt, Homo Sapiens
uuugugcuucucuuuuuaauggagauugaaaagggagaauaaugugaauaucacggcuuauauu

SEQ ID NO: 161984 - RNA, 64 nt, Homo Sapiens
acacauauaagcaaguggccgugcuaccuuuuuagagaauaaagaaacagacuuuugaguuuau

SEQ ID NO: 161985 - RNA, 64 nt, Homo Sapiens
uuguuuugcugaagauuucuccauuccuggugcugagaauaaaggcaaccaguagccaaugucc

SEQ ID NO: 161986 - RNA, 64 nt, Homo Sapiens
cucuuuccuaaaacauggcaaaugaauagauguagagaauaacaauauuacuuacaagaugaaa

SEQ ID NO: 161987 - RNA, 64 nt, Homo Sapiens
guaagggaguauucuaggcacaagaagggugagggagaauaaggugugagcuuggcucuagucc

SEQ ID NO: 161988 - RNA, 64 nt, Homo Sapiens
ccagagacaaagaacccucggggaaagccaagcugagaauaaacuaacccacaccaucagcagg

SEQ ID NO: 161989 - RNA, 64 nt, Homo Sapiens
auuuuggccucucauaguuuucucucucuuuaaagagaauaaauagagggccaggugugguggc

SEQ ID NO: 161990 - RNA, 64 nt, Homo Sapiens
uaaaaaaaaaaaaaaaaaaaaaaaaagagagagagagaauaaauagaaaagaauguggcuggga

SEQ ID NO: 161991 - RNA, 64 nt, Homo Sapiens
cuuuuuauacaacuuuccaucccccacacaguuggagaauaauuuguagaccauggcaguuaaa

SEQ ID NO: 161992 - RNA, 64 nt, Homo Sapiens
gugcucugcugcauuuauaggguuuugggcugcugagaauaauugaugcugauuaaggugcaaa

SEQ ID NO: 161993 - RNA, 64 nt, Homo Sapiens
auuugguucagggcaacuaccugagugcaacauugagaauaaugagguaguaggucucuuucaa

SEQ ID NO: 161994 - RNA, 64 nt, Homo Sapiens
uuuuauuauuauauccuauuaaaauauacacauugagaauaauugacacugucaggcaaauuug

SEQ ID NO: 161995 - RNA, 64 nt, Homo Sapiens
aaguuuuccagaucauuccuacaaaguaaacugggagaauaauaagucugaaagaguguggagu

SEQ ID NO: 161996 - RNA, 64 nt, Homo Sapiens
cacauuaugaucuugacaggugcacuuuacuggggagaauaaaaaggaccauacgguaaagcug

SEQ ID NO: 161997 - RNA, 64 nt, Homo Sapiens
ggcagagcaagagcuagagaauugggggguggaggagaauaagauaaaaaauauucagaaaugu

SEQ ID NO: 161998 - RNA, 64 nt, Homo Sapiens
uguucuaugaaauucagaacguaaagaugaggcagagaauaaaguccccccgaaaaauugaaau

SEQ ID NO: 161999 - RNA, 64 nt, Homo Sapiens
ugauuuccaccaucaggauuaauaaccuguguaugagaauaaaaucucuuccuaauugugcugu

SEQ ID NO: 162000 - RNA, 64 nt, Homo Sapiens
ccuacagagguucauacugacucacuguacacuugagaauaauaaagauuucaagaaaggacaa

SEQ ID NO: 162001 - RNA, 64 nt, Homo Sapiens
uuguucauugcauuucugagcugucuaauuuuuagagaauaagacuacacuuaagaagucuuag

SEQ ID NO: 162002 - RNA, 64 nt, Homo Sapiens
aguugucucuagauacagauauccuuacuggagcgagaauaaaauuucucuucaaggcgagaug

SEQ ID NO: 162003 - RNA, 64 nt, Homo Sapiens
uuucuaaaauuacauguuucuaaauuuuuuuauugagaauaaauguauuaaccauuauugagaa

SEQ ID NO: 162004 - RNA, 64 nt, Homo Sapiens
uuuuuuauugagaauaaauuuauuaaccauuauugagaauaaauaugcuguuucugaguuauug

SEQ ID NO: 162005 - RNA, 64 nt, Homo Sapiens
gaagucuguuuuucugggucaguuuuuuuugccugagaauaacaaauugcugcugucuaccuuu

SEQ ID NO: 162006 - RNA, 64 nt, Homo Sapiens
acgcccuccaucucacagucaagauaaaggccucgagaauaaagagccagcccccuuccauuua

SEQ ID NO: 162007 - RNA, 64 nt, Homo Sapiens
acaaucuaaauccagaaaauuaauauaaauaugugagaauaaaauauguaaaauauuaaagcau

SEQ ID NO: 162008 - RNA, 64 nt, Homo Sapiens
caggagaacaaaaggaaacacuagaugaggacaugagaauaauugauucguguagguggcaaag

SEQ ID NO: 162009 - RNA, 64 nt, Homo Sapiens; identical to SEQ ID NO: 21544

SEQ ID NO: 162010 - RNA, 55 nt, Homo Sapiens; identical to SEQ ID NO: 21545

SEQ ID NO: 162011 - RNA, 64 nt, Homo Sapiens; identical to SEQ ID NO: 21546

SEQ ID NO: 162012 - RNA, 64 nt, Homo Sapiens; identical to SEQ ID NO: 21547

SEQ ID NO: 162013 - RNA, 64 nt, Homo Sapiens; identical to SEQ ID NO: 21548

SEQ ID NO: 162014 - RNA, 64 nt, Homo Sapiens; identical to SEQ ID NO: 21549

SEQ ID NO: 162015 - RNA, 64 nt, Homo Sapiens; identical to SEQ ID NO: 21550

SEQ ID NO: 162016 - RNA, 64 nt, Homo Sapiens; identical to SEQ ID NO: 21551

SEQ ID NO: 162017 - RNA, 64 nt, Homo Sapiens; identical to SEQ ID NO: 21552

SEQ ID NO: 162018 - RNA, 64 nt, Homo Sapiens; identical to SEQ ID NO: 21553

SEQ ID NO: 162019 - RNA, 64 nt, Homo Sapiens; identical to SEQ ID NO: 21554

SEQ ID NO: 162020 - RNA, 64 nt, Homo Sapiens; identical to SEQ ID NO: 21555

SEQ ID NO: 162021 - RNA, 64 nt, Homo Sapiens; identical to SEQ ID NO: 21556

SEQ ID NO: 162022 - RNA, 64 nt, Homo Sapiens; identical to SEQ ID NO: 21557

SEQ ID NO: 162023 - RNA, 64 nt, Homo Sapiens; identical to SEQ ID NO: 21558

SEQ ID NO: 162024 - RNA, 64 nt, Homo Sapiens; identical to SEQ ID NO: 21559

SEQ ID NO: 162025 - RNA, 64 nt, Homo Sapiens
uuacaggaagaccgucucuuucgaaugaaucaagcagcagaauuguacuugauucaaauuauug

SEQ ID NO: 162026 - RNA, 64 nt, Homo Sapiens
cccauaaaaacauaaauggccuuauugaugcuuucagcagaauuucaucuagaaguggcagcau

SEQ ID NO: 162027 - RNA, 64 nt, Homo Sapiens
ugcggcuauagcagauggccauggcagucaguggcagcagaaagaggcagcagaaggugaagag

SEQ ID NO: 162028 - RNA, 64 nt, Homo Sapiens
gauggccauggcagucaguggcagcagaaagaggcagcagaaggugaagagguuauaggugguc

SEQ ID NO: 162029 - RNA, 64 nt, Homo Sapiens
uuaagaaauaaagcaugaucuuucuauaauccuucagcagaauaggguccuagaauuuuucuga

SEQ ID NO: 162030 - RNA, 64 nt, Homo Sapiens
uagaagucauaugaaugaggcaugucuguccucacagcagaaugucaugcugaaagcacucaga

SEQ ID NO: 162031 - RNA, 64 nt, Homo Sapiens
cauggcacagacuuguauagagcagaagaaaugacagcagaagcgaaauccuggugaagagcaa

SEQ ID NO: 162032 - RNA, 64 nt, Homo Sapiens
cacggcagggaggaaaggagagaaaggaggggagcagcagaagccagagaagagaggcucugaa

SEQ ID NO: 162033 - RNA, 64 nt, Homo Sapiens
gaggcagaauuaaagcuaaucuagggacucaaaucagcagaaugggggagacaaagcccggucu

SEQ ID NO: 162034 - RNA, 64 nt, Homo Sapiens
acauuacuuuuuaaagacauuuuacauuauuguccagcagaaaaaggcugucuuggaccaugaa

SEQ ID NO: 162035 - RNA, 64 nt, Homo Sapiens
guggccuuuccugcugacacuccacgagcugacccagcagaauucucuguguaggaagcaucgg

SEQ ID NO: 162036 - RNA, 64 nt, Homo Sapiens
ucucuccuucccugacucaugacacucuuccugacagcagaaugacugugugaccuugaacuuc

SEQ ID NO: 162037 - RNA, 64 nt, Homo Sapiens
uuauaacgcaaguucaugugagggcagaucuggacagcagaaugagaccgaccaccagcacagu

SEQ ID NO: 162038 - RNA, 64 nt, Homo Sapiens
ucagagaaaagcuguuugcauaagucucaauuaacagcagaaucucagagacacaaaaauacug

SEQ ID NO: 162039 - RNA, 64 nt, Homo Sapiens
cagcauucacucucccugucuuuuccccuucccucagcagaaacguguuuaucagcaagucgug

SEQ ID NO: 162040 - RNA, 64 nt, Homo Sapiens
caaaaaaaaaaaacagccucuucuuggaaagugacagcagaagguggcauggagcuuguguccu

SEQ ID NO: 162041 - RNA, 64 nt, Homo Sapiens
gaagugugcugugacaagccgcguuucauguagccagcagaacuaagaauagaaaacuggguau

SEQ ID NO: 162042 - RNA, 64 nt, Homo Sapiens
ccuguucaggcaggcuuucucacccuagcuauaccagcagaaaauagacaguuagagacucugu

SEQ ID NO: 162043 - RNA, 64 nt, Homo Sapiens
gcucugaagguccaaagaguuauaugugacacugcagcagaaaggccucuuguucaugucagcu

SEQ ID NO: 162044 - RNA, 64 nt, Homo Sapiens
ucccaggccucugccuugguagagagaguccauucagcagaaagaacuagaggcuggcuucacu

SEQ ID NO: 162045 - RNA, 64 nt, Homo Sapiens
uuugcuggcgagaguccuguauccauuaugaauacagcagaacaauugcagugggggcuaaggc

SEQ ID NO: 162046 - RNA, 64 nt, Homo Sapiens
cacugcagcucgaagacagcuuaaugcccccuuacagcagaagaacaacccugugagggcagua

SEQ ID NO: 162047 - RNA, 64 nt, Homo Sapiens
aggccaaaugcagagaugagguacugagaagcagcagcagaauguagaacccaaggacuucugg

SEQ ID NO: 162048 - RNA, 64 nt, Homo Sapiens
uggaguuuguucagugguacgguguccaagcaaacagcagaaugcaacuuucuaaacagcccca

SEQ ID NO: 162049 - RNA, 64 nt, Homo Sapiens
gcagaaugcaacuuucuaaacagccccaagcaaacagcagaauucaacuuuuuaaacaauaaac

SEQ ID NO: 162050 - RNA, 64 nt, Homo Sapiens
uucccugaggucccagagccugggguggcccaggcagcagaaggcuggcucugcccaggugggg

SEQ ID NO: 162051 - RNA, 64 nt, Homo Sapiens
acaugccccaagaccccaggguguccaugugugacagcagaaccaccaggacucccaggaggcc

SEQ ID NO: 162052 - RNA, 64 nt, Homo Sapiens
ccaacagcccaggagcuuuucagaauagcgucugcagcagaaccaguuuccauucagagcgcgu

SEQ ID NO: 162053 - RNA, 64 nt, Homo Sapiens
ucucucugguuguuucuguuucugaguggaccaacagcagaacccacgaggauuuguuuugagu

SEQ ID NO: 162054 - RNA, 64 nt, Homo Sapiens
gauacucaggucaguuaacucaugggagugggaccagcagaaaauuguuguggggucugaggca

SEQ ID NO: 162055 - RNA, 64 nt, Homo Sapiens
gggugcauuucugcaaaggauaguggggugggcucagcagaagucuggcagugagggacagagc

SEQ ID NO: 162056 - RNA, 64 nt, Homo Sapiens
ucacacauggcuguucuggaaauagaaaugaccacagcagaaugaaaauauguauauuauugua

SEQ ID NO: 162057 - RNA, 64 nt, Homo Sapiens
auauguauauuauuguaaaucuguugcacgcaugcagcagaaaaggguugggucugauuguaca

SEQ ID NO: 162058 - RNA, 64 nt, Homo Sapiens
cuuuucucuccucaugauguaccuuauuuucuuagguaaauaauuccaaacucucaucggguca

SEQ ID NO: 162059 - RNA, 64 nt, Homo Sapiens
uuuaacuggucagucauucacaauaagcuaugaggguaaauaaauauguguuauaacaaguaaa

SEQ ID NO: 162060 - RNA, 64 nt, Homo Sapiens
aaguacccucuugagguaggaaaugcucugugaugguaaauaaaauuggagcagacagaaaaga

SEQ ID NO: 162061 - RNA, 64 nt, Homo Sapiens
aguucugcugcuguuauuuauaugcaauucuucugguaaauagcaauagaauaaaacauauuuc

SEQ ID NO: 162062 - RNA, 64 nt, Homo Sapiens
ggaaaugaguagugauaugaaucaaagaugaauugguaaauaaucuuaauuguuuccaaguugc

SEQ ID NO: 162063 - RNA, 64 nt, Homo Sapiens
auuuuaaaauuguuuuuaauuucaaucaauaauugguaaauaauuacguaccccaguaaaacca

SEQ ID NO: 162064 - RNA, 64 nt, Homo Sapiens
aggaaccuucauuugaagguguguuagaggaugggguaaauacccgauagcugucuuuuuggug

SEQ ID NO: 162065 - RNA, 64 nt, Homo Sapiens
aggcugcuuguucagcuuuccuuuaacaccuguugguaaauacuaaugggaguagacagaguug

SEQ ID NO: 162066 - RNA, 64 nt, Homo Sapiens
cuuucaaaaauaucaggcguugcacaccuccuaagguaaauaguggcauuuuuaaaauucuaaa

SEQ ID NO: 162067 - RNA, 64 nt, Homo Sapiens
uuucagaauucuuuuuuaaagaaaaguuggccaugguaaauaauugagagauucaaaaauauca

SEQ ID NO: 162068 - RNA, 64 nt, Homo Sapiens
gugauuuauaccaauaauuauguguaauuauauagguaaauauaucagaggcauuauagaauaa

SEQ ID NO: 162069 - RNA, 64 nt, Homo Sapiens
guuuuaauucagaucuagaacauggaugaauugggguaaauaagucacugaacguaucagaaua

SEQ ID NO: 162070 - RNA, 64 nt, Homo Sapiens
uaugaaaaauggucuguucauuaugccacauagugguaaauaauuggguuauaugccuaaaccc

SEQ ID NO: 162071 - RNA, 64 nt, Homo Sapiens
aaauuuccaacagggucagcaaaaaccuugcagugguaaauaaacuggugugacacuuuggagc

SEQ ID NO: 162072 - RNA, 64 nt, Homo Sapiens
cagcagcuagguuuugaauuuuuucacuugaauggguaaauaacacugugccucccucugucug

SEQ ID NO: 162073 - RNA, 64 nt, Homo Sapiens
uacauugauugguaaauuauauaaauacaagauugguaaauaaauuauaaucguuuaugccaug

SEQ ID NO: 162074 - RNA, 64 nt, Homo Sapiens
uauacuuacguguauaucaguauuuguagaugcagguaaauauauuuuaaccccuagaauuuaa

SEQ ID NO: 162075 - RNA, 64 nt, Homo Sapiens
agaugccaauguugaaugaagucugaaacucuaguaugugcauaguuugacgugcagcaugcac

SEQ ID NO: 162076 - RNA, 64 nt, Homo Sapiens
acuaguuaaaaugccacaagcaugagugugauuguaugugcacuguguguauauauauaaauau

SEQ ID NO: 162077 - RNA, 64 nt, Homo Sapiens
auccucucuuggagcuuuuuaacuccaguguugcuaugugcaaguaaccauucuaaauaaagag

SEQ ID NO: 162078 - RNA, 64 nt, Homo Sapiens
cguaugagauaggcacaugcuggauguguguuuguaugugcauaauucguuuuuuaccuguuug

SEQ ID NO: 162079 - RNA, 64 nt, Homo Sapiens
gcuuuuuagcuguuucagucaccagugaagagccuaugugcauuuuguaguagauaauguaaaa

SEQ ID NO: 162080 - RNA, 64 nt, Homo Sapiens
ugaguuugagagagaaaauuguuuuuuaaaaauauaugugcauugaaaugauggcaaugcuuau

SEQ ID NO: 162081 - RNA, 64 nt, Homo Sapiens
gacuguggcugaaagaauugcauuuaaaaauauuuaugugcaccuuguuacuuucuacucugca

SEQ ID NO: 162082 - RNA, 64 nt, Homo Sapiens
aacaguauuuaucauguguuaaagucaugggucuuaugugcagauuuuuuuaaugccucuaaaa

SEQ ID NO: 162083 - RNA, 64 nt, Homo Sapiens
uuagucuggcuauaaaugcuuuguuugauauauauaugugcacauauauauauuacuuaaccau

SEQ ID NO: 162084 - RNA, 64 nt, Homo Sapiens
caagaagcacagagauuuauaguauucuuaauaguaugugcagaaguuacaucauuuaaaaaac

SEQ ID NO: 162085 - RNA, 64 nt, Homo Sapiens
auuuuccuccauuaucagccagaagugcaacauguaugugcaaaagcuaaaauggcuuaacauc

SEQ ID NO: 162086 - RNA, 64 nt, Homo Sapiens
uugccuuuccauaucugcuggggguggagacccuuaugugcagcacucaaucccacuggaagcc

SEQ ID NO: 162087 - RNA, 64 nt, Homo Sapiens
aaaaauauauuuuucuugaguuuaggcuuuuccauaugugcagcuguguuuaccuaacccagcc

SEQ ID NO: 162088 - RNA, 64 nt, Homo Sapiens
cggagacgguaguuuaguauuugagccacgaguuuaugugcacaaguguuuuggguuguggacu

SEQ ID NO: 162089 - RNA, 64 nt, Homo Sapiens
auuuuaaauuguugccuaguccugccaagguuauuaugugcaucuguuauuuuuccaauacaug

SEQ ID NO: 162090 - RNA, 64 nt, Homo Sapiens
ggggaacuggaguuugugagugagcagagcagguuaugugcagacagggaaacgagaacuuugg

SEQ ID NO: 162091 - RNA, 64 nt, Homo Sapiens
ccuucuuguauccucuuaacuggccauuaucuuguaugugcacauuuuauaaauguacagaaac

SEQ ID NO: 162092 - RNA, 64 nt, Homo Sapiens
gaaacaguaacaaaaaaaucugcucagaaaaauguaugugcacaaauaaaaaaaauuaauggca

SEQ ID NO: 162093 - RNA, 64 nt, Homo Sapiens
ccuucuuuuauccucuuaacuggccauuaucuuguaugugcacauuuuauaaauguacagaaac

SEQ ID NO: 162094 - RNA, 64 nt, Homo Sapiens; identical to SEQ ID NO: 162092

SEQ ID NO: 162095 - RNA, 64 nt, Homo Sapiens
cucaucuuuuuaaggucagguccugcccagccggcugugucacaguccuguggcaccuccaucc

SEQ ID NO: 162096 - RNA, 64 nt, Homo Sapiens
gaugagccuggcuugggggucugcaguggauucacugugucaggcacagaguuucccacggggg

SEQ ID NO: 162097 - RNA, 64 nt, Homo Sapiens
uguucuaguuccuacauaauuguaggaaaaugagcugugucaucucugagucccuugguaauuc

SEQ ID NO: 162098 - RNA, 64 nt, Homo Sapiens
gauucccugugagcacgaugcugaugcaauaguccugugucaucacugcagcgguccucaggag

SEQ ID NO: 162099 - RNA, 64 nt, Homo Sapiens
uuacaacaagaggguaaaguucauacauggcgaccugugucaaauccguccauugaucugcccu

SEQ ID NO: 162100 - RNA, 64 nt, Homo Sapiens
aagacagaaauauguacagggcagagaggcugcacugugucauuuaaucacgaagacucuguua

SEQ ID NO: 162101 - RNA, 64 nt, Homo Sapiens
caacaagaaggaaagcagggaggaagggagaccacugugucaccuggaggagaagucaucucau

SEQ ID NO: 162102 - RNA, 64 nt, Homo Sapiens
aggggacugucauugaaaaggaaacguuugaugucugugucagcugucuuuguaguuaggaaau

SEQ ID NO: 162103 - RNA, 61 nt, Homo Sapiens
uacagcaggacuuuguaugaccagaaaugaacugugucaaguauaagguuuuucagcagga

SEQ ID NO: 162104 - RNA, 64 nt, Homo Sapiens
uauaauacagauuaacauuauauauaauauguaccugugucacuucugacaugagccuguaaac

SEQ ID NO: 162105 - RNA, 64 nt, Homo Sapiens
cuuccaaguggacggcagaccugggaggggacgccugugucacgagcccuuuuagaugcuuagg

SEQ ID NO: 162106 - RNA, 64 nt, Homo Sapiens
ugaacugacuuuuuuuuuuuuuuuuuugccaacccugugucacuuagugaggaccugacacaau

SEQ ID NO: 162107 - RNA, 64 nt, Homo Sapiens
ccaggaggguggcggaggaacuccugccacgccacugugucaugaaggaaagugaaagggaacg

SEQ ID NO: 162108 - RNA, 64 nt, Homo Sapiens
caagcccuauuaaguaguaauguggggaaacccacugugucagugcaggaagcccuagacaaau

SEQ ID NO: 162109 - RNA, 64 nt, Homo Sapiens; identical to SEQ ID NO: 162075

SEQ ID NO: 162110 - RNA, 64 nt, Homo Sapiens; identical to SEQ ID NO: 162076

SEQ ID NO: 162111 - RNA, 64 nt, Homo Sapiens; identical to SEQ ID NO: 162077

SEQ ID NO: 162112 - RNA, 64 nt, Homo Sapiens; identical to SEQ ID NO: 162078

SEQ ID NO: 162113 - RNA, 64 nt, Homo Sapiens; identical to SEQ ID NO: 162079

SEQ ID NO: 162114 - RNA, 64 nt, Homo Sapiens; identical to SEQ ID NO: 162080

SEQ ID NO: 162115 - RNA, 64 nt, Homo Sapiens; identical to SEQ ID NO: 162081

SEQ ID NO: 162116 - RNA, 64 nt, Homo Sapiens; identical to SEQ ID NO: 162082

SEQ ID NO: 162117 - RNA, 64 nt, Homo Sapiens; identical to SEQ ID NO: 162083

SEQ ID NO: 162118 - RNA, 64 nt, Homo Sapiens; identical to SEQ ID NO: 162084

SEQ ID NO: 162119 - RNA, 64 nt, Homo Sapiens; identical to SEQ ID NO: 162085

SEQ ID NO: 162120 - RNA, 64 nt, Homo Sapiens; identical to SEQ ID NO: 162086

SEQ ID NO: 162121 - RNA, 64 nt, Homo Sapiens; identical to SEQ ID NO: 162087

SEQ ID NO: 162122 - RNA, 64 nt, Homo Sapiens; identical to SEQ ID NO: 162088

SEQ ID NO: 162123 - RNA, 64 nt, Homo Sapiens; identical to SEQ ID NO: 162089

SEQ ID NO: 162124 - RNA, 64 nt, Homo Sapiens; identical to SEQ ID NO: 162090

SEQ ID NO: 162125 - RNA, 64 nt, Homo Sapiens; identical to SEQ ID NO: 162091

SEQ ID NO: 162126 - RNA, 64 nt, Homo Sapiens; identical to SEQ ID NO: 162092

SEQ ID NO: 162127 - RNA, 64 nt, Homo Sapiens; identical to SEQ ID NO: 162093

SEQ ID NO: 162128 - RNA, 64 nt, Homo Sapiens; identical to SEQ ID NO: 162092

SEQ ID NO: 162129 - RNA, 64 nt, Homo Sapiens; identical to SEQ ID NO: 162095

SEQ ID NO: 162130 - RNA, 64 nt, Homo Sapiens; identical to SEQ ID NO: 162096

SEQ ID NO: 162131 - RNA, 64 nt, Homo Sapiens; identical to SEQ ID NO: 162097

SEQ ID NO: 162132 - RNA, 64 nt, Homo Sapiens; identical to SEQ ID NO: 162098

SEQ ID NO: 162133 - RNA, 64 nt, Homo Sapiens; identical to SEQ ID NO: 162099

SEQ ID NO: 162134 - RNA, 64 nt, Homo Sapiens; identical to SEQ ID NO: 162100

SEQ ID NO: 162135 - RNA, 64 nt, Homo Sapiens; identical to SEQ ID NO: 162101

SEQ ID NO: 162136 - RNA, 64 nt, Homo Sapiens; identical to SEQ ID NO: 162102

SEQ ID NO: 162137 - RNA, 61 nt, Homo Sapiens; identical to SEQ ID NO: 162103

SEQ ID NO: 162138 - RNA, 64 nt, Homo Sapiens; identical to SEQ ID NO: 162104

SEQ ID NO: 162139 - RNA, 64 nt, Homo Sapiens; identical to SEQ ID NO: 162105

SEQ ID NO: 162140 - RNA, 64 nt, Homo Sapiens; identical to SEQ ID NO: 162106

SEQ ID NO: 162141 - RNA, 64 nt, Homo Sapiens; identical to SEQ ID NO: 162107

SEQ ID NO: 162142 - RNA, 64 nt, Homo Sapiens; identical to SEQ ID NO: 162108

SEQ ID NO: 162143 - RNA, 64 nt, Homo Sapiens
gcccuggucccagucccugccuggggccauguguccccccuauuccugugggcuuuucauacuu

SEQ ID NO: 162144 - RNA, 64 nt, Homo Sapiens
augggacccugagagagccagggguccccugaggccccccuaggggcuuucugucugccccagg

SEQ ID NO: 162145 - RNA, 64 nt, Homo Sapiens
agaagugagccccccccuuaaagggaauucgaugccccccuagaauaaucucauccccccaccc

SEQ ID NO: 162146 - RNA, 64 nt, Homo Sapiens
ugcuccugccaaccacaauucaaugaauccccgaccccccuaccccaugcuguacuugugguuc

SEQ ID NO: 162147 - RNA, 64 nt, Homo Sapiens; identical to SEQ ID NO: 93643

SEQ ID NO: 162148 - RNA, 64 nt, Homo Sapiens; identical to SEQ ID NO: 93644

SEQ ID NO: 162149 - RNA, 64 nt, Homo Sapiens; identical to SEQ ID NO: 93645

SEQ ID NO: 162150 - RNA, 64 nt, Homo Sapiens; identical to SEQ ID NO: 93646

SEQ ID NO: 162151 - RNA, 64 nt, Homo Sapiens; identical to SEQ ID NO: 93647

SEQ ID NO: 162152 - RNA, 64 nt, Homo Sapiens; identical to SEQ ID NO: 93648

SEQ ID NO: 162153 - RNA, 64 nt, Homo Sapiens; identical to SEQ ID NO: 93649

SEQ ID NO: 162154 - RNA, 64 nt, Homo Sapiens; identical to SEQ ID NO: 93650

SEQ ID NO: 162155 - RNA, 64 nt, Homo Sapiens; identical to SEQ ID NO: 93651

SEQ ID NO: 162156 - RNA, 64 nt, Homo Sapiens; identical to SEQ ID NO: 93652

SEQ ID NO: 162157 - RNA, 64 nt, Homo Sapiens; identical to SEQ ID NO: 93653

SEQ ID NO: 162158 - RNA, 64 nt, Homo Sapiens; identical to SEQ ID NO: 93654

SEQ ID NO: 162159 - RNA, 64 nt, Homo Sapiens; identical to SEQ ID NO: 93655

SEQ ID NO: 162160 - RNA, 64 nt, Homo Sapiens; identical to SEQ ID NO: 93656

SEQ ID NO: 162161 - RNA, 64 nt, Homo Sapiens; identical to SEQ ID NO: 93657

SEQ ID NO: 162162 - RNA, 64 nt, Homo Sapiens; identical to SEQ ID NO: 93658

SEQ ID NO: 162163 - RNA, 64 nt, Homo Sapiens; identical to SEQ ID NO: 93659

SEQ ID NO: 162164 - RNA, 64 nt, Homo Sapiens; identical to SEQ ID NO: 93660

SEQ ID NO: 162165 - RNA, 64 nt, Homo Sapiens; identical to SEQ ID NO: 93661

SEQ ID NO: 162166 - RNA, 64 nt, Homo Sapiens; identical to SEQ ID NO: 93662

SEQ ID NO: 162167 - RNA, 64 nt, Homo Sapiens; identical to SEQ ID NO: 93663

SEQ ID NO: 162168 - RNA, 64 nt, Homo Sapiens; identical to SEQ ID NO: 93664

SEQ ID NO: 162169 - RNA, 64 nt, Homo Sapiens; identical to SEQ ID NO: 126281

SEQ ID NO: 162170 - RNA, 64 nt, Homo Sapiens; identical to SEQ ID NO: 126282

SEQ ID NO: 162171 - RNA, 64 nt, Homo Sapiens; identical to SEQ ID NO: 126283

SEQ ID NO: 162172 - RNA, 64 nt, Homo Sapiens; identical to SEQ ID NO: 126284

SEQ ID NO: 162173 - RNA, 64 nt, Homo Sapiens; identical to SEQ ID NO: 126285

SEQ ID NO: 162174 - RNA, 64 nt, Homo Sapiens; identical to SEQ ID NO: 126286

SEQ ID NO: 162175 - RNA, 64 nt, Homo Sapiens; identical to SEQ ID NO: 126287

SEQ ID NO: 162176 - RNA, 64 nt, Homo Sapiens; identical to SEQ ID NO: 126288

SEQ ID NO: 162177 - RNA, 64 nt, Homo Sapiens; identical to SEQ ID NO: 126289

SEQ ID NO: 162178 - RNA, 64 nt, Homo Sapiens; identical to SEQ ID NO: 126290

SEQ ID NO: 162179 - RNA, 64 nt, Homo Sapiens; identical to SEQ ID NO: 126291

SEQ ID NO: 162180 - RNA, 64 nt, Homo Sapiens; identical to SEQ ID NO: 126292

SEQ ID NO: 162181 - RNA, 64 nt, Homo Sapiens; identical to SEQ ID NO: 126293

SEQ ID NO: 162182 - RNA, 64 nt, Homo Sapiens; identical to SEQ ID NO: 126294

SEQ ID NO: 162183 - RNA, 64 nt, Homo Sapiens; identical to SEQ ID NO: 126295

SEQ ID NO: 162184 - RNA, 64 nt, Homo Sapiens; identical to SEQ ID NO: 126296

SEQ ID NO: 162185 - RNA, 64 nt, Homo Sapiens; identical to SEQ ID NO: 126297

SEQ ID NO: 162186 - RNA, 64 nt, Homo Sapiens; identical to SEQ ID NO: 126298

SEQ ID NO: 162187 - RNA, 64 nt, Homo Sapiens; identical to SEQ ID NO: 126299

SEQ ID NO: 162188 - RNA, 64 nt, Homo Sapiens; identical to SEQ ID NO: 126300

SEQ ID NO: 162189 - RNA, 64 nt, Homo Sapiens; identical to SEQ ID NO: 126301

SEQ ID NO: 162190 - RNA, 64 nt, Homo Sapiens; identical to SEQ ID NO: 126302

SEQ ID NO: 162191 - RNA, 64 nt, Homo Sapiens; identical to SEQ ID NO: 126303

SEQ ID NO: 162192 - RNA, 64 nt, Homo Sapiens; identical to SEQ ID NO: 126304

SEQ ID NO: 162193 - RNA, 64 nt, Homo Sapiens; identical to SEQ ID NO: 126305

SEQ ID NO: 162194 - RNA, 64 nt, Homo Sapiens; identical to SEQ ID NO: 126306

SEQ ID NO: 162195 - RNA, 64 nt, Homo Sapiens; identical to SEQ ID NO: 126307

SEQ ID NO: 162196 - RNA, 64 nt, Homo Sapiens; identical to SEQ ID NO: 126308

SEQ ID NO: 162197 - RNA, 64 nt, Homo Sapiens; identical to SEQ ID NO: 126309

SEQ ID NO: 162198 - RNA, 64 nt, Homo Sapiens; identical to SEQ ID NO: 126310

SEQ ID NO: 162199 - RNA, 64 nt, Homo Sapiens; identical to SEQ ID NO: 126311

SEQ ID NO: 162200 - RNA, 64 nt, Homo Sapiens; identical to SEQ ID NO: 126312

SEQ ID NO: 162201 - RNA, 64 nt, Homo Sapiens; identical to SEQ ID NO: 126313

SEQ ID NO: 162202 - RNA, 64 nt, Homo Sapiens; identical to SEQ ID NO: 126314

SEQ ID NO: 162203 - RNA, 64 nt, Homo Sapiens; identical to SEQ ID NO: 126315

SEQ ID NO: 162204 - RNA, 64 nt, Homo Sapiens; identical to SEQ ID NO: 126316

SEQ ID NO: 162205 - RNA, 64 nt, Homo Sapiens; identical to SEQ ID NO: 126317

SEQ ID NO: 162206 - RNA, 64 nt, Homo Sapiens; identical to SEQ ID NO: 126318

SEQ ID NO: 162207 - RNA, 64 nt, Homo Sapiens; identical to SEQ ID NO: 126319

SEQ ID NO: 162208 - RNA, 64 nt, Homo Sapiens; identical to SEQ ID NO: 126320

SEQ ID NO: 162209 - RNA, 64 nt, Homo Sapiens; identical to SEQ ID NO: 126321

SEQ ID NO: 162210 - RNA, 64 nt, Homo Sapiens; identical to SEQ ID NO: 126322

SEQ ID NO: 162211 - RNA, 64 nt, Homo Sapiens; identical to SEQ ID NO: 126323

SEQ ID NO: 162212 - RNA, 64 nt, Homo Sapiens; identical to SEQ ID NO: 126324

SEQ ID NO: 162213 - RNA, 64 nt, Homo Sapiens; identical to SEQ ID NO: 126325

SEQ ID NO: 162214 - RNA, 64 nt, Homo Sapiens; identical to SEQ ID NO: 126326

SEQ ID NO: 162215 - RNA, 64 nt, Homo Sapiens; identical to SEQ ID NO: 126327

SEQ ID NO: 162216 - RNA, 64 nt, Homo Sapiens; identical to SEQ ID NO: 126328

SEQ ID NO: 162217 - RNA, 64 nt, Homo Sapiens; identical to SEQ ID NO: 126329

SEQ ID NO: 162218 - RNA, 64 nt, Homo Sapiens; identical to SEQ ID NO: 126330

SEQ ID NO: 162219 - RNA, 64 nt, Homo Sapiens; identical to SEQ ID NO: 126331

SEQ ID NO: 162220 - RNA, 64 nt, Homo Sapiens; identical to SEQ ID NO: 126332

SEQ ID NO: 162221 - RNA, 64 nt, Homo Sapiens; identical to SEQ ID NO: 126333

SEQ ID NO: 162222 - RNA, 64 nt, Homo Sapiens; identical to SEQ ID NO: 126334

SEQ ID NO: 162223 - RNA, 64 nt, Homo Sapiens; identical to SEQ ID NO: 126335

SEQ ID NO: 162224 - RNA, 64 nt, Homo Sapiens; identical to SEQ ID NO: 126336

SEQ ID NO: 162225 - RNA, 64 nt, Homo Sapiens; identical to SEQ ID NO: 126337

SEQ ID NO: 162226 - RNA, 64 nt, Homo Sapiens; identical to SEQ ID NO: 126338

SEQ ID NO: 162227 - RNA, 64 nt, Homo Sapiens; identical to SEQ ID NO: 126339

SEQ ID NO: 162228 - RNA, 64 nt, Homo Sapiens; identical to SEQ ID NO: 126340

SEQ ID NO: 162229 - RNA, 64 nt, Homo Sapiens; identical to SEQ ID NO: 126341

SEQ ID NO: 162230 - RNA, 64 nt, Homo Sapiens; identical to SEQ ID NO: 126342

SEQ ID NO: 162231 - RNA, 64 nt, Homo Sapiens; identical to SEQ ID NO: 126343

SEQ ID NO: 162232 - RNA, 64 nt, Homo Sapiens; identical to SEQ ID NO: 126344

SEQ ID NO: 162233 - RNA, 64 nt, Homo Sapiens; identical to SEQ ID NO: 126345

SEQ ID NO: 162234 - RNA, 64 nt, Homo Sapiens; identical to SEQ ID NO: 126346

SEQ ID NO: 162235 - RNA, 64 nt, Homo Sapiens; identical to SEQ ID NO: 126347

SEQ ID NO: 162236 - RNA, 64 nt, Homo Sapiens; identical to SEQ ID NO: 126348

SEQ ID NO: 162237 - RNA, 64 nt, Homo Sapiens; identical to SEQ ID NO: 126349

SEQ ID NO: 162238 - RNA, 64 nt, Homo Sapiens; identical to SEQ ID NO: 126350

SEQ ID NO: 162239 - RNA, 64 nt, Homo Sapiens; identical to SEQ ID NO: 126351

SEQ ID NO: 162240 - RNA, 64 nt, Homo Sapiens; identical to SEQ ID NO: 126352

SEQ ID NO: 162241 - RNA, 64 nt, Homo Sapiens; identical to SEQ ID NO: 126353

SEQ ID NO: 162242 - RNA, 64 nt, Homo Sapiens; identical to SEQ ID NO: 126354

SEQ ID NO: 162243 - RNA, 64 nt, Homo Sapiens; identical to SEQ ID NO: 126355

SEQ ID NO: 162244 - RNA, 64 nt, Homo Sapiens; identical to SEQ ID NO: 126356

SEQ ID NO: 162245 - RNA, 64 nt, Homo Sapiens; identical to SEQ ID NO: 126357

SEQ ID NO: 162246 - RNA, 64 nt, Homo Sapiens; identical to SEQ ID NO: 126358

SEQ ID NO: 162247 - RNA, 64 nt, Homo Sapiens; identical to SEQ ID NO: 126359

SEQ ID NO: 162248 - RNA, 64 nt, Homo Sapiens; identical to SEQ ID NO: 126360

SEQ ID NO: 162249 - RNA, 64 nt, Homo Sapiens; identical to SEQ ID NO: 126361

SEQ ID NO: 162250 - RNA, 64 nt, Homo Sapiens; identical to SEQ ID NO: 126362

SEQ ID NO: 162251 - RNA, 64 nt, Homo Sapiens; identical to SEQ ID NO: 126363

SEQ ID NO: 162252 - RNA, 64 nt, Homo Sapiens; identical to SEQ ID NO: 126364

SEQ ID NO: 162253 - RNA, 64 nt, Homo Sapiens; identical to SEQ ID NO: 126365

SEQ ID NO: 162254 - RNA, 64 nt, Homo Sapiens; identical to SEQ ID NO: 126366

SEQ ID NO: 162255 - RNA, 64 nt, Homo Sapiens; identical to SEQ ID NO: 126367

SEQ ID NO: 162256 - RNA, 64 nt, Homo Sapiens; identical to SEQ ID NO: 126368

SEQ ID NO: 162257 - RNA, 64 nt, Homo Sapiens; identical to SEQ ID NO: 126369

SEQ ID NO: 162258 - RNA, 64 nt, Homo Sapiens; identical to SEQ ID NO: 126370

SEQ ID NO: 162259 - RNA, 64 nt, Homo Sapiens; identical to SEQ ID NO: 126371

SEQ ID NO: 162260 - RNA, 64 nt, Homo Sapiens; identical to SEQ ID NO: 126372

SEQ ID NO: 162261 - RNA, 64 nt, Homo Sapiens; identical to SEQ ID NO: 126373

SEQ ID NO: 162262 - RNA, 64 nt, Homo Sapiens; identical to SEQ ID NO: 126374

SEQ ID NO: 162263 - RNA, 64 nt, Homo Sapiens; identical to SEQ ID NO: 126375

SEQ ID NO: 162264 - RNA, 64 nt, Homo Sapiens; identical to SEQ ID NO: 126376

SEQ ID NO: 162265 - RNA, 64 nt, Homo Sapiens; identical to SEQ ID NO: 126377

SEQ ID NO: 162266 - RNA, 64 nt, Homo Sapiens; identical to SEQ ID NO: 126378

SEQ ID NO: 162267 - RNA, 64 nt, Homo Sapiens; identical to SEQ ID NO: 126379

SEQ ID NO: 162268 - RNA, 64 nt, Homo Sapiens; identical to SEQ ID NO: 126380

SEQ ID NO: 162269 - RNA, 64 nt, Homo Sapiens; identical to SEQ ID NO: 126381

SEQ ID NO: 162270 - RNA, 64 nt, Homo Sapiens; identical to SEQ ID NO: 126382

SEQ ID NO: 162271 - RNA, 64 nt, Homo Sapiens; identical to SEQ ID NO: 126383

SEQ ID NO: 162272 - RNA, 64 nt, Homo Sapiens; identical to SEQ ID NO: 126384

SEQ ID NO: 162273 - RNA, 64 nt, Homo Sapiens; identical to SEQ ID NO: 126385

SEQ ID NO: 162274 - RNA, 64 nt, Homo Sapiens; identical to SEQ ID NO: 126386

SEQ ID NO: 162275 - RNA, 64 nt, Homo Sapiens; identical to SEQ ID NO: 126387

SEQ ID NO: 162276 - RNA, 64 nt, Homo Sapiens; identical to SEQ ID NO: 126388

SEQ ID NO: 162277 - RNA, 64 nt, Homo Sapiens; identical to SEQ ID NO: 126389

SEQ ID NO: 162278 - RNA, 64 nt, Homo Sapiens; identical to SEQ ID NO: 126390

SEQ ID NO: 162279 - RNA, 64 nt, Homo Sapiens; identical to SEQ ID NO: 126391

SEQ ID NO: 162280 - RNA, 64 nt, Homo Sapiens; identical to SEQ ID NO: 126392

SEQ ID NO: 162281 - RNA, 64 nt, Homo Sapiens; identical to SEQ ID NO: 38325

SEQ ID NO: 162282 - RNA, 64 nt, Homo Sapiens; identical to SEQ ID NO: 38326

SEQ ID NO: 162283 - RNA, 64 nt, Homo Sapiens; identical to SEQ ID NO: 38327

SEQ ID NO: 162284 - RNA, 64 nt, Homo Sapiens; identical to SEQ ID NO: 38328

SEQ ID NO: 162285 - RNA, 64 nt, Homo Sapiens; identical to SEQ ID NO: 38329

SEQ ID NO: 162286 - RNA, 64 nt, Homo Sapiens; identical to SEQ ID NO: 38330

SEQ ID NO: 162287 - RNA, 64 nt, Homo Sapiens; identical to SEQ ID NO: 38331

SEQ ID NO: 162288 - RNA, 64 nt, Homo Sapiens; identical to SEQ ID NO: 38332

SEQ ID NO: 162289 - RNA, 64 nt, Homo Sapiens; identical to SEQ ID NO: 38333

SEQ ID NO: 162290 - RNA, 64 nt, Homo Sapiens; identical to SEQ ID NO: 38334

SEQ ID NO: 162291 - RNA, 64 nt, Homo Sapiens; identical to SEQ ID NO: 38335

SEQ ID NO: 162292 - RNA, 64 nt, Homo Sapiens; identical to SEQ ID NO: 38336

SEQ ID NO: 162293 - RNA, 64 nt, Homo Sapiens; identical to SEQ ID NO: 38337

SEQ ID NO: 162294 - RNA, 64 nt, Homo Sapiens; identical to SEQ ID NO: 38338

SEQ ID NO: 162295 - RNA, 64 nt, Homo Sapiens; identical to SEQ ID NO: 38339

SEQ ID NO: 162296 - RNA, 64 nt, Homo Sapiens; identical to SEQ ID NO: 38340

SEQ ID NO: 162297 - RNA, 64 nt, Homo Sapiens; identical to SEQ ID NO: 38341

SEQ ID NO: 162298 - RNA, 64 nt, Homo Sapiens; identical to SEQ ID NO: 38342

SEQ ID NO: 162299 - RNA, 64 nt, Homo Sapiens; identical to SEQ ID NO: 38343

SEQ ID NO: 162300 - RNA, 64 nt, Homo Sapiens; identical to SEQ ID NO: 38344

SEQ ID NO: 162301 - RNA, 64 nt, Homo Sapiens; identical to SEQ ID NO: 38345

SEQ ID NO: 162302 - RNA, 64 nt, Homo Sapiens; identical to SEQ ID NO: 38346

SEQ ID NO: 162303 - RNA, 64 nt, Homo Sapiens; identical to SEQ ID NO: 38347

SEQ ID NO: 162304 - RNA, 64 nt, Homo Sapiens; identical to SEQ ID NO: 38348

SEQ ID NO: 162305 - RNA, 64 nt, Homo Sapiens; identical to SEQ ID NO: 38349

SEQ ID NO: 162306 - RNA, 64 nt, Homo Sapiens; identical to SEQ ID NO: 38350

SEQ ID NO: 162307 - RNA, 64 nt, Homo Sapiens; identical to SEQ ID NO: 38351

SEQ ID NO: 162308 - RNA, 64 nt, Homo Sapiens; identical to SEQ ID NO: 38352

SEQ ID NO: 162309 - RNA, 64 nt, Homo Sapiens; identical to SEQ ID NO: 38353

SEQ ID NO: 162310 - RNA, 64 nt, Homo Sapiens; identical to SEQ ID NO: 38354

SEQ ID NO: 162311 - RNA, 64 nt, Homo Sapiens; identical to SEQ ID NO: 38355

SEQ ID NO: 162312 - RNA, 64 nt, Homo Sapiens; identical to SEQ ID NO: 38356

SEQ ID NO: 162313 - RNA, 64 nt, Homo Sapiens; identical to SEQ ID NO: 38357

SEQ ID NO: 162314 - RNA, 64 nt, Homo Sapiens; identical to SEQ ID NO: 38358

SEQ ID NO: 162315 - RNA, 64 nt, Homo Sapiens; identical to SEQ ID NO: 38359

SEQ ID NO: 162316 - RNA, 64 nt, Homo Sapiens; identical to SEQ ID NO: 38360

SEQ ID NO: 162317 - RNA, 64 nt, Homo Sapiens; identical to SEQ ID NO: 38361

SEQ ID NO: 162318 - RNA, 64 nt, Homo Sapiens; identical to SEQ ID NO: 38362

SEQ ID NO: 162319 - RNA, 64 nt, Homo Sapiens; identical to SEQ ID NO: 38363

SEQ ID NO: 162320 - RNA, 64 nt, Homo Sapiens; identical to SEQ ID NO: 38364

SEQ ID NO: 162321 - RNA, 64 nt, Homo Sapiens; identical to SEQ ID NO: 38365

SEQ ID NO: 162322 - RNA, 64 nt, Homo Sapiens; identical to SEQ ID NO: 38366

SEQ ID NO: 162323 - RNA, 64 nt, Homo Sapiens; identical to SEQ ID NO: 38367

SEQ ID NO: 162324 - RNA, 64 nt, Homo Sapiens; identical to SEQ ID NO: 38368

SEQ ID NO: 162325 - RNA, 64 nt, Homo Sapiens; identical to SEQ ID NO: 38369

SEQ ID NO: 162326 - RNA, 64 nt, Homo Sapiens; identical to SEQ ID NO: 38370

SEQ ID NO: 162327 - RNA, 64 nt, Homo Sapiens; identical to SEQ ID NO: 38371

SEQ ID NO: 162328 - RNA, 64 nt, Homo Sapiens; identical to SEQ ID NO: 38372

SEQ ID NO: 162329 - RNA, 64 nt, Homo Sapiens; identical to SEQ ID NO: 38373

SEQ ID NO: 162330 - RNA, 64 nt, Homo Sapiens; identical to SEQ ID NO: 38374

SEQ ID NO: 162331 - RNA, 64 nt, Homo Sapiens; identical to SEQ ID NO: 38375

SEQ ID NO: 162332 - RNA, 64 nt, Homo Sapiens; identical to SEQ ID NO: 38376

SEQ ID NO: 162333 - RNA, 64 nt, Homo Sapiens; identical to SEQ ID NO: 38377

SEQ ID NO: 162334 - RNA, 64 nt, Homo Sapiens; identical to SEQ ID NO: 38378

SEQ ID NO: 162335 - RNA, 64 nt, Homo Sapiens; identical to SEQ ID NO: 38379

SEQ ID NO: 162336 - RNA, 64 nt, Homo Sapiens; identical to SEQ ID NO: 38380

SEQ ID NO: 162337 - RNA, 64 nt, Homo Sapiens; identical to SEQ ID NO: 38381

SEQ ID NO: 162338 - RNA, 64 nt, Homo Sapiens; identical to SEQ ID NO: 38382

SEQ ID NO: 162339 - RNA, 64 nt, Homo Sapiens; identical to SEQ ID NO: 38383

SEQ ID NO: 162340 - RNA, 64 nt, Homo Sapiens; identical to SEQ ID NO: 38384

SEQ ID NO: 162341 - RNA, 64 nt, Homo Sapiens
caaaaagacaucaagucuucuuaauucaacccauaaucauuaaguacuuaacaaagaauauuuu

SEQ ID NO: 162342 - RNA, 64 nt, Homo Sapiens
aauuaauauuuuugauacagugauuucauauuggaaucauuauuugugcaaagggacagacaga

SEQ ID NO: 162343 - RNA, 64 nt, Homo Sapiens
uuuaaaauauaccuuacagcaaccauuaauagaaaaucauuacauucuuuaaauuuccuuauag

SEQ ID NO: 162344 - RNA, 64 nt, Homo Sapiens
cuuuauuucgggugguuuacguguuagaguuauaaaucauuaauuugaacaaaauuuguuuugu

SEQ ID NO: 162345 - RNA, 64 nt, Homo Sapiens
aaauuagcccauuauauuuugugaauauauucuuaaucauuaaucaaauccaugaaaacgcuua

SEQ ID NO: 162346 - RNA, 64 nt, Homo Sapiens
uuauuugguuugguggaguguugcaauuuuucuaaaucauuaaauaguuuagugauacaaauga

SEQ ID NO: 162347 - RNA, 64 nt, Homo Sapiens
accagguauggaagccuacgugucugcauuucaaaaucauuaaauugcccaagugccauuggcu

SEQ ID NO: 162348 - RNA, 64 nt, Homo Sapiens
cuugacuugaagugaacaaauuuaaauuugucugaaucauuagucaugaaaccguuuggguuca

SEQ ID NO: 162349 - RNA, 64 nt, Homo Sapiens
aagcuuugcucuuuaggcaggaaugaucuuuucaaaucauuagcacaauauuuaaauaucuaaa

SEQ ID NO: 162350 - RNA, 64 nt, Homo Sapiens
uguaguccugucauuuaaguuauguaaaaaauuuaaucauuauuuugaugcuuuaaacauucuc

SEQ ID NO: 162351 - RNA, 64 nt, Homo Sapiens
uaagauaacgcugaccauaguaaaauuguuaguaaaucauuagguaacaucuugugguaggaaa

SEQ ID NO: 162352 - RNA, 64 nt, Homo Sapiens
uuaguaaaucauuagguaacaucuugugguaggaaaucauuagguaacaucaauccuaacuaga

SEQ ID NO: 162353 - RNA, 64 nt, Homo Sapiens
uucaauucaugacugcuuuagugacaggacaaauaaucauuacuagaaaagacuuaaaacugga

SEQ ID NO: 162354 - RNA, 64 nt, Homo Sapiens
uaucagguauuaucuuuaugaacuccuaauauugaaucauuaccaauuauuuggacuacacaua

SEQ ID NO: 162355 - RNA, 64 nt, Homo Sapiens
uauaaaaaauaaucaucaacuuuacuauugggugaaucauuagggaccuuagcugugggguucc

SEQ ID NO: 162356 - RNA, 64 nt, Homo Sapiens
cacacauugugggugaugggaacucuguauauaaaaucauuaacuuuuagucagcaguuuugua

SEQ ID NO: 162357 - RNA, 64 nt, Homo Sapiens
acaugugacaauuuagagauaaaaugcuugugagaaucauuaaauaguguucuuuuucuccaga

SEQ ID NO: 162358 - RNA, 64 nt, Homo Sapiens
cagaauguagucuggucuuugugugauacauaggaaucauuauuacuaauuuugaaaauuacca

SEQ ID NO: 162359 - RNA, 64 nt, Homo Sapiens
agaguuguuucugggagggaaggagugcuuucucaaucauuaauuuuauuucguauuuucuuua

SEQ ID NO: 162360 - RNA, 64 nt, Homo Sapiens
ucgggucacuuagaguaaggcacaacaauucagcaaucauuagcggcagauguagcaaaaacuu

SEQ ID NO: 162361 - RNA, 64 nt, Homo Sapiens
uuuagaggucuaaugcuauguuguagaugaaaaaaaucauuauguucuaguauaacagaaauuu

SEQ ID NO: 162362 - RNA, 64 nt, Homo Sapiens
agguuauuuccuaauguaagaguuaugucaauuaaaucauuaucuucuaauaccuauauuuuca

SEQ ID NO: 162363 - RNA, 64 nt, Homo Sapiens
aaacacugauuaacugcaaguugaacauuguuuuaaucauuaggugaaguaacuuuguaauuau

SEQ ID NO: 162364 - RNA, 64 nt, Homo Sapiens
aauacuguguucuguguuauguuaaaugugcuauaaucauuaagcccaguggauggcugaaggu

SEQ ID NO: 162365 - RNA, 64 nt, Homo Sapiens
auuuacugccaguugugaguuuaagcauuuuaucaaucauuaaauucugauacauaaaauuauu

SEQ ID NO: 162366 - RNA, 64 nt, Homo Sapiens
uguccugaccuuuucaguccgcauuuagaacaagaaucauuauuuuccaaaauaacuaggaucu

SEQ ID NO: 162367 - RNA, 64 nt, Homo Sapiens
cacacaaauauuauuagacaaauuagaugacaaaaaucauuaagaaguccaaacuuuuuuuuua

SEQ ID NO: 162368 - RNA, 64 nt, Homo Sapiens
uacagcuuauuaccuucaucauguccgugagucuaaucauuaguacguguggcagaaguuuauu

SEQ ID NO: 162369 - RNA, 64 nt, Homo Sapiens
uuuaauuggauauuggacucugcucauauaagcuacagacaaaagccaaaagacucucgcuguc

SEQ ID NO: 162370 - RNA, 64 nt, Homo Sapiens
gccugggcaacauggugaaacccgucucuaccaaacagacaaaaagcagccaggcgugguggca

SEQ ID NO: 162371 - RNA, 64 nt, Homo Sapiens
gaaugugggaguaugucugccgguuucaacacacacagacaaacacagccacacgcgcacacaa

SEQ ID NO: 162372 - RNA, 64 nt, Homo Sapiens
cauacuuucuuuuuucuuuuccuuuuuucccuccacagacaauguccucuguucaauuccuaac

SEQ ID NO: 162373 - RNA, 64 nt, Homo Sapiens
aaaagaguuaucggcccauagcuaauaaguagugacagacaaccaagcuucaauauuuuucuaa

SEQ ID NO: 162374 - RNA, 64 nt, Homo Sapiens
auuuuucuuuuccgcacuaccugaacauuguaauacagacaaacuugauuucuucuagaagaua

SEQ ID NO: 162375 - RNA, 64 nt, Homo Sapiens
uggaaaaacaacagcgacaauuguucuauuuuguacagacaaguuuuucucugcccuuuuuuug

SEQ ID NO: 162376 - RNA, 64 nt, Homo Sapiens
caauccccaucagguagcuguaaaaaacagaaaaacagacaaaaaaaaauauauauuuuaaguu

SEQ ID NO: 162377 - RNA, 64 nt, Homo Sapiens
uauuacaacauuuaugugagguaauuauugcucaacagacaauuagaaaaaaguccacacuuga

SEQ ID NO: 162378 - RNA, 64 nt, Homo Sapiens
guccuggcccuggcccuuacuauuaggaaaauaaacagacaaaaacaaguaaauauauaugguc

SEQ ID NO: 162379 - RNA, 64 nt, Homo Sapiens
uaauuaaaacacaacaucuuuuucuacucgaguuacagacaaagcgugguggacaugcacagcu

SEQ ID NO: 162380 - RNA, 64 nt, Homo Sapiens
cauggaaguacuauaauuuaccugaagucuuuguacagacaacaaaccuguuucugcagccacu

SEQ ID NO: 162381 - RNA, 64 nt, Homo Sapiens
ucugaaagauucugagacccgauuuuacaaaaccacagacaaccuagaauucugccaauaggug

SEQ ID NO: 162382 - RNA, 64 nt, Homo Sapiens
aaagaaaaaacuugaaugaaagauagaacaaauuacagacaaggguuaaaauucacaauaaugu

SEQ ID NO: 162383 - RNA, 64 nt, Homo Sapiens
guugucaaacaucuucagggaaaucaacaagccaacagacaagaaggagcgaaagugaguaucu

SEQ ID NO: 162384 - RNA, 64 nt, Homo Sapiens
ucugagagucuuccacgaccggcugaucagugaaacagacaagcagcuggucaguacauccaau

SEQ ID NO: 162385 - RNA, 64 nt, Homo Sapiens
acagcugauauuuauuggacuguucauuuauucaacagacaaugcccagccccaccaacccacc

SEQ ID NO: 162386 - RNA, 64 nt, Homo Sapiens
acgcugaggccugcagcagccaccaucccauuuuacagacaaggcggcaugcaccaguuccaca

SEQ ID NO: 162387 - RNA, 64 nt, Homo Sapiens
cuguaguauuuaugauguuaagauaaugcggguaacagacaauauaauagccccgaccuuaaac

SEQ ID NO: 162388 - RNA, 64 nt, Homo Sapiens
uguggucuguagcccaauaacuggggaacgaguuacagacaaacaucaccguaaaugacucaca

SEQ ID NO: 162389 - RNA, 64 nt, Homo Sapiens
uuaucaaacaauauaaaagcgaagucuggggggcacagacaacccuuuguggcaacugaagaug

SEQ ID NO: 162390 - RNA, 64 nt, Homo Sapiens
uacaacaugguugcagaauaaauuaaaaugcaugacagacaaggaguguaaugauauuugagug

SEQ ID NO: 162391 - RNA, 64 nt, Homo Sapiens
acaugaaaauagcaauauucuuggagauugauaaccauagcauuaauacgcccauuauggucau

SEQ ID NO: 162392 - RNA, 64 nt, Homo Sapiens
cugcuguuggaugcagcaauaauuucuguaugguccauagcacuguauauuauggaucgauauu

SEQ ID NO: 162393 - RNA, 64 nt, Homo Sapiens
uccccuacaucaaaugcucaaacaccgagugaggccauagcaacagaaagucaccugcccaaga

SEQ ID NO: 162394 - RNA, 64 nt, Homo Sapiens
uccccuacaucaaaugcucaaacaccaagugaggccauagcaauauuaagaaaaagucgcccga

SEQ ID NO: 162395 - RNA, 64 nt, Homo Sapiens
uuuguuuuguguuuuucuguaauaauuuaauguuacuuauuaucagaauuucugaaaccuuuac

SEQ ID NO: 162396 - RNA, 64 nt, Homo Sapiens
auuuauaaaugugaagcuuuuugaugccaucaaaacuuauuaaaaaauaggauuuacuuuuuuc

SEQ ID NO: 162397 - RNA, 64 nt, Homo Sapiens
uaacuuaagggaaacuguaaauuuuucuaagucuacuuauuaaaaaaauguuaguuuacuagua

SEQ ID NO: 162398 - RNA, 64 nt, Homo Sapiens
aaguuacuauuuuguuuuuuagcauuaagucauuacuuauuagcaauuuguugauguuuuuuga

SEQ ID NO: 162399 - RNA, 64 nt, Homo Sapiens
uccacaagcuuaccuaauuguuuauauacuuuauacuuauuaaaguauacauuuuuaaauguua

SEQ ID NO: 162400 - RNA, 64 nt, Homo Sapiens
uaaugucugagagccucauaaaaucaacauauuuacuuauuaagcaguuuaugaaacuuuaaug

SEQ ID NO: 162401 - RNA, 64 nt, Homo Sapiens
caaguugaaacugcacucuauuucacacacauauacuuauuauuacacacacacagaaugcaca

SEQ ID NO: 162402 - RNA, 64 nt, Homo Sapiens
aauuaaagggaggaaaagaagaucagaaaauaguacuuauuagcucaagauuauaaauacucau

SEQ ID NO: 162403 - RNA, 64 nt, Homo Sapiens
acuguauaacauaugcuaguuuauuguauuuuccacuuauuauuuugaguuugcuuucucaaca

SEQ ID NO: 162404 - RNA, 64 nt, Homo Sapiens
uaagccuuuuaauacuaaguaaacuaucuuauugacuuauuauucauuuguauugucucuucuu

SEQ ID NO: 162405 - RNA, 64 nt, Homo Sapiens
auuaaugcuaucaucucgaccaagcucaaagccuacuuauuagaaacaaugaaguucacaauag

SEQ ID NO: 162406 - RNA, 64 nt, Homo Sapiens
uuuuaacucaugauuuuuacacacacaauccagaacuuauuauauagccucuaagucuuuauuc

SEQ ID NO: 162407 - RNA, 64 nt, Homo Sapiens
cuuaccuuauaaguaaaaagguuaauaucaaguaacuuauuagcucuuaaaguaaaauugaacu

SEQ ID NO: 162408 - RNA, 64 nt, Homo Sapiens
ucaaguaacuuauuagcucuuaaaguaaaauugaacuuauuaaaagcuaucuaugauuuaauag

SEQ ID NO: 162409 - RNA, 64 nt, Homo Sapiens
uccauauucgacagcauuuuaguuuuuuaauaguacuuauuagcaucaaccaucuugauaauca

SEQ ID NO: 162410 - RNA, 64 nt, Homo Sapiens
cuguguuacaucaucuuuacgcuuugguauuugaacuuauuacagaauuuuuucucuaaauugg

SEQ ID NO: 162411 - RNA, 64 nt, Homo Sapiens
uuucaagaacuuugagacuauagugagaaaaaucacuuauuaauuuauuccagguaugguuaag

SEQ ID NO: 162412 - RNA, 64 nt, Homo Sapiens
ucccuauuuauguucaaccguaauugauagcauuacuuauuacaagcauugaggcaagaggaug

SEQ ID NO: 162413 - RNA, 64 nt, Homo Sapiens; identical to SEQ ID NO: 85676

SEQ ID NO: 162414 - RNA, 64 nt, Homo Sapiens; identical to SEQ ID NO: 85677

SEQ ID NO: 162415 - RNA, 64 nt, Homo Sapiens; identical to SEQ ID NO: 85678

SEQ ID NO: 162416 - RNA, 64 nt, Homo Sapiens; identical to SEQ ID NO: 85679

SEQ ID NO: 162417 - RNA, 64 nt, Homo Sapiens; identical to SEQ ID NO: 85680

SEQ ID NO: 162418 - RNA, 64 nt, Homo Sapiens; identical to SEQ ID NO: 85681

SEQ ID NO: 162419 - RNA, 64 nt, Homo Sapiens; identical to SEQ ID NO: 85682

SEQ ID NO: 162420 - RNA, 64 nt, Homo Sapiens; identical to SEQ ID NO: 85683

SEQ ID NO: 162421 - RNA, 64 nt, Homo Sapiens; identical to SEQ ID NO: 85684

SEQ ID NO: 162422 - RNA, 64 nt, Homo Sapiens; identical to SEQ ID NO: 85685

SEQ ID NO: 162423 - RNA, 64 nt, Homo Sapiens; identical to SEQ ID NO: 85686

SEQ ID NO: 162424 - RNA, 64 nt, Homo Sapiens; identical to SEQ ID NO: 85687

SEQ ID NO: 162425 - RNA, 64 nt, Homo Sapiens; identical to SEQ ID NO: 85688

SEQ ID NO: 162426 - RNA, 64 nt, Homo Sapiens; identical to SEQ ID NO: 85689

SEQ ID NO: 162427 - RNA, 64 nt, Homo Sapiens; identical to SEQ ID NO: 85690

SEQ ID NO: 162428 - RNA, 64 nt, Homo Sapiens; identical to SEQ ID NO: 85691

SEQ ID NO: 162429 - RNA, 64 nt, Homo Sapiens; identical to SEQ ID NO: 85692

SEQ ID NO: 162430 - RNA, 64 nt, Homo Sapiens; identical to SEQ ID NO: 85693

SEQ ID NO: 162431 - RNA, 64 nt, Homo Sapiens; identical to SEQ ID NO: 85694

SEQ ID NO: 162432 - RNA, 64 nt, Homo Sapiens; identical to SEQ ID NO: 85695

SEQ ID NO: 162433 - RNA, 64 nt, Homo Sapiens; identical to SEQ ID NO: 85696

SEQ ID NO: 162434 - RNA, 64 nt, Homo Sapiens; identical to SEQ ID NO: 85697

SEQ ID NO: 162435 - RNA, 64 nt, Homo Sapiens; identical to SEQ ID NO: 85698

SEQ ID NO: 162436 - RNA, 64 nt, Homo Sapiens; identical to SEQ ID NO: 85699

SEQ ID NO: 162437 - RNA, 64 nt, Homo Sapiens; identical to SEQ ID NO: 85700

SEQ ID NO: 162438 - RNA, 64 nt, Homo Sapiens; identical to SEQ ID NO: 85701

SEQ ID NO: 162439 - RNA, 64 nt, Homo Sapiens; identical to SEQ ID NO: 85702

SEQ ID NO: 162440 - RNA, 64 nt, Homo Sapiens; identical to SEQ ID NO: 85703

SEQ ID NO: 162441 - RNA, 64 nt, Homo Sapiens; identical to SEQ ID NO: 85704

SEQ ID NO: 162442 - RNA, 64 nt, Homo Sapiens; identical to SEQ ID NO: 85705

SEQ ID NO: 162443 - RNA, 64 nt, Homo Sapiens; identical to SEQ ID NO: 85706

SEQ ID NO: 162444 - RNA, 64 nt, Homo Sapiens; identical to SEQ ID NO: 85707

SEQ ID NO: 162445 - RNA, 64 nt, Homo Sapiens; identical to SEQ ID NO: 85708

SEQ ID NO: 162446 - RNA, 64 nt, Homo Sapiens; identical to SEQ ID NO: 85709

SEQ ID NO: 162447 - RNA, 64 nt, Homo Sapiens; identical to SEQ ID NO: 85710

SEQ ID NO: 162448 - RNA, 64 nt, Homo Sapiens; identical to SEQ ID NO: 85711

SEQ ID NO: 162449 - RNA, 64 nt, Homo Sapiens; identical to SEQ ID NO: 85712

SEQ ID NO: 162450 - RNA, 64 nt, Homo Sapiens; identical to SEQ ID NO: 85713

SEQ ID NO: 162451 - RNA, 64 nt, Homo Sapiens; identical to SEQ ID NO: 85714

SEQ ID NO: 162452 - RNA, 64 nt, Homo Sapiens; identical to SEQ ID NO: 85715

SEQ ID NO: 162453 - RNA, 64 nt, Homo Sapiens; identical to SEQ ID NO: 85716

SEQ ID NO: 162454 - RNA, 64 nt, Homo Sapiens; identical to SEQ ID NO: 85717

SEQ ID NO: 162455 - RNA, 64 nt, Homo Sapiens; identical to SEQ ID NO: 85718

SEQ ID NO: 162456 - RNA, 64 nt, Homo Sapiens; identical to SEQ ID NO: 85719

SEQ ID NO: 162457 - RNA, 64 nt, Homo Sapiens; identical to SEQ ID NO: 85720

SEQ ID NO: 162458 - RNA, 64 nt, Homo Sapiens; identical to SEQ ID NO: 85721

SEQ ID NO: 162459 - RNA, 64 nt, Homo Sapiens; identical to SEQ ID NO: 85722

SEQ ID NO: 162460 - RNA, 64 nt, Homo Sapiens; identical to SEQ ID NO: 85723

SEQ ID NO: 162461 - RNA, 64 nt, Homo Sapiens; identical to SEQ ID NO: 85724

SEQ ID NO: 162462 - RNA, 64 nt, Homo Sapiens; identical to SEQ ID NO: 85725

SEQ ID NO: 162463 - RNA, 64 nt, Homo Sapiens; identical to SEQ ID NO: 85726

SEQ ID NO: 162464 - RNA, 64 nt, Homo Sapiens; identical to SEQ ID NO: 85727

SEQ ID NO: 162465 - RNA, 64 nt, Homo Sapiens; identical to SEQ ID NO: 85728

SEQ ID NO: 162466 - RNA, 64 nt, Homo Sapiens; identical to SEQ ID NO: 85729

SEQ ID NO: 162467 - RNA, 64 nt, Homo Sapiens; identical to SEQ ID NO: 85730

SEQ ID NO: 162468 - RNA, 64 nt, Homo Sapiens; identical to SEQ ID NO: 85731

SEQ ID NO: 162469 - RNA, 64 nt, Homo Sapiens; identical to SEQ ID NO: 85732

SEQ ID NO: 162470 - RNA, 64 nt, Homo Sapiens; identical to SEQ ID NO: 85733

SEQ ID NO: 162471 - RNA, 64 nt, Homo Sapiens; identical to SEQ ID NO: 85734

SEQ ID NO: 162472 - RNA, 64 nt, Homo Sapiens; identical to SEQ ID NO: 85735

SEQ ID NO: 162473 - RNA, 64 nt, Homo Sapiens; identical to SEQ ID NO: 85736

SEQ ID NO: 162474 - RNA, 64 nt, Homo Sapiens; identical to SEQ ID NO: 85737

SEQ ID NO: 162475 - RNA, 64 nt, Homo Sapiens; identical to SEQ ID NO: 85738

SEQ ID NO: 162476 - RNA, 64 nt, Homo Sapiens; identical to SEQ ID NO: 85739

SEQ ID NO: 162477 - RNA, 64 nt, Homo Sapiens; identical to SEQ ID NO: 85740

SEQ ID NO: 162478 - RNA, 64 nt, Homo Sapiens; identical to SEQ ID NO: 85741

SEQ ID NO: 162479 - RNA, 64 nt, Homo Sapiens; identical to SEQ ID NO: 85742

SEQ ID NO: 162480 - RNA, 64 nt, Homo Sapiens; identical to SEQ ID NO: 85743

SEQ ID NO: 162481 - RNA, 60 nt, Homo Sapiens
cccuucagagcuccuuuccaacagcaucucucugucgaagaaagaagcucugucaaguua

SEQ ID NO: 162482 - RNA, 60 nt, Homo Sapiens
aguuaagcuaaaguuuuaaaguggcaguuuucugucgaugacuuuuucaagugcuaacac

SEQ ID NO: 162483 - RNA, 60 nt, Homo Sapiens
caucuccaaucauaugcauuaaugugaagaucugucgauuaaagauuuuccuucucuugg

SEQ ID NO: 162484 - RNA, 60 nt, Homo Sapiens
cuacucaacucugccguccuccgugaggucucugucgaaaaguacuuucaguuuggcgag

SEQ ID NO: 162485 - RNA, 60 nt, Homo Sapiens
uugaaugaaaugggcacuguugauuccacuucugucgaggagcuucggggcucagagagg

SEQ ID NO: 162486 - RNA, 60 nt, Homo Sapiens
ucaugggugugugugcacaucuugcccagcucugucgaauuuggccuuuucagcuuucuu

SEQ ID NO: 162487 - RNA, 60 nt, Homo Sapiens
uaucugaagcacaaggcccacccucaccuaucugucgaccccauuuccuaccaccuuugu

SEQ ID NO: 162488 - RNA, 60 nt, Homo Sapiens
caguuugccagccaggccccaccuacagcgucugucgaacaaacagaggucuggugguuu

SEQ ID NO: 162489 - RNA, 60 nt, Homo Sapiens
gcccccagcugcugucuaaauggugucuggucugucgacuuccacauccuccucccuguc

SEQ ID NO: 162490 - RNA, 60 nt, Homo Sapiens
uaugccucagccacuugccuucuuucccagucugucgauuaaaguuuaaucagaggaaau

SEQ ID NO: 162491 - RNA, 60 nt, Homo Sapiens
gaccugcagcgugagagccaauuuauggccucugucgaggggacgugcucggagggaaag

SEQ ID NO: 162492 - RNA, 50 nt, Homo Sapiens
ugaaggagauaacuuauuaaucugucgaaggcuuaugccgagccagaagc

SEQ ID NO: 162493 - RNA, 60 nt, Homo Sapiens
gccagcccggcgcccuagcagaugcacgugucugucgaaucgcugccuccgagcccaccc

SEQ ID NO: 162494 - RNA, 60 nt, Homo Sapiens
aguaaaggaaacuucaugaaggaacugucuucugucgagauagagaugauaggccuaaag

SEQ ID NO: 162495 - RNA, 60 nt, Homo Sapiens
gcuucucaggggcagaacccgcucgugccaucugucgauucagaggcacgcacacaugcu

SEQ ID NO: 162496 - RNA, 60 nt, Homo Sapiens
ucccugucccccaccuguggcaggcacagcucugucgaggagaugcucucgagcguugag

SEQ ID NO: 162497 - RNA, 60 nt, Homo Sapiens
gguaggauuugacacugguuaacacuagagucugucgagaaggucagagggucacauguu

SEQ ID NO: 162498 - RNA, 60 nt, Homo Sapiens
ccuggauaaaugcucuuaauuauaaaaaauucugucgaggaguguuccauaguuuauugu

SEQ ID NO: 162499 - RNA, 60 nt, Homo Sapiens
uuuggaguuugcaaccacaguauuccuuugucugucgaggcugggaggguagccgugagc

SEQ ID NO: 162500 - RNA, 60 nt, Homo Sapiens
caccugaacuugcuauuuuaaacaaauaguucugucgacaccuaaaauauaaucuggcuu

SEQ ID NO: 162501 - RNA, 60 nt, Homo Sapiens
ggaagaugagaaaguaauuugagauuuuacucugucgaauuuuagaguauuugaagugau

SEQ ID NO: 162502 - RNA, 60 nt, Homo Sapiens
uucaaugucuugaugguguccugccuuccuucugucgauugguucgauccucuccccuuc

SEQ ID NO: 162503 - RNA, 60 nt, Homo Sapiens
ggucacccagcgagugcugagaccccauuuucugucgaggcgggccgagucuucccuuau

SEQ ID NO: 162504 - RNA, 60 nt, Homo Sapiens
caagccaaaaagccgggaccuuugcgcagcucugucgacucugguggguccccacuccug

SEQ ID NO: 162505 - RNA, 60 nt, Homo Sapiens
uugcaggagaggguuggugccugcucaguuucugucgagggaaugggagucuccucggcu

SEQ ID NO: 162506 - RNA, 60 nt, Homo Sapiens
cugagacauagcagcaguauccucuccggaucugucgauuuggagaccuuccgagagaga

SEQ ID NO: 162507 - RNA, 60 nt, Homo Sapiens
agcaaggcuugccagcaaguaccccaaacuucugucgaggcuuggaguuuucugcccccc

SEQ ID NO: 162508 - RNA, 64 nt, Homo Sapiens
ugcauuauuuguugacuagauucaaauucacguucuagugaaaccugacaauuaugaaaaaaug

SEQ ID NO: 162509 - RNA, 64 nt, Homo Sapiens
gaacuaguuucuaggagcacuaucacagacucugcuagugaaaauggugacaguuuccagaugc

SEQ ID NO: 162510 - RNA, 64 nt, Homo Sapiens
gggcguuaggggccugucucauaaugcaguugcucuagugaaugcuuugcucucaacauuuaaa

SEQ ID NO: 162511 - RNA, 64 nt, Homo Sapiens
aaucugaaaggcacugugucgcucuccgccuacacuagugaauuccagcugcaaagacaauguu

SEQ ID NO: 162512 - RNA, 64 nt, Homo Sapiens
cuuggguaauauauguaagacugacauaaucucccuagugaaaauuggauaaaaaaaaaacucg

SEQ ID NO: 162513 - RNA, 64 nt, Homo Sapiens
acuaauuaucaaggacauuuaaaguuuuugagaacuagugaaguaaaauguuacacaaagcagu

SEQ ID NO: 162514 - RNA, 64 nt, Homo Sapiens
guuuuuguuuguuuauuuguuuuugagauggagucucuacuaaaaauacaaaaaauuagccagg

SEQ ID NO: 162515 - RNA, 64 nt, Homo Sapiens
caagaccagccuggccaauauggugaaaccccaucucuacuaagaauacaaaaaauuagcugag

SEQ ID NO: 162516 - RNA, 64 nt, Homo Sapiens
caagaccagccuggccaauaugaugaaaccccgucucuacuaaaaauacaaaauuagucgggua

SEQ ID NO: 162517 - RNA, 64 nt, Homo Sapiens
ugagaccagccuggccaacauggugaaaccccgucucuacuaaaaauacaaaaaguagccaggc

SEQ ID NO: 162518 - RNA, 64 nt, Homo Sapiens
caagaacauccuggcuaacacggugaaacuccaucucuacuaaaaauacaaaaaauuggccggg

SEQ ID NO: 162519 - RNA, 64 nt, Homo Sapiens
uaagaucauccuggccaacauggugacaccccgucucuacuaaaaauacaaaaauuacccaggc

SEQ ID NO: 162520 - RNA, 64 nt, Homo Sapiens
aauacaaaaaaaauuagccauggugaaacccugucucuacuaaacgagaccauccuggcuaaca

SEQ ID NO: 162521 - RNA, 64 nt, Homo Sapiens
aaaaauacaaaaaaauuagccggugaaaccccgucucuacuaaacgagaccauccuggcgaaca

SEQ ID NO: 162522 - RNA, 64 nt, Homo Sapiens
aauacaaaaauuagccuggcuggcgaaaccccaucucuacuaaacgagaccagccugaccaaca

SEQ ID NO: 162523 - RNA, 64 nt, Homo Sapiens
auacaaaaaauuauccaggccgaugaaacuccgucucuacuaaacaagaucagucugggcaaca

SEQ ID NO: 162524 - RNA, 64 nt, Homo Sapiens
aauacagaauuagucaggcgcggagaaaccccgucucuacuaaacaagaccagccugaccaaca

SEQ ID NO: 162525 - RNA, 64 nt, Homo Sapiens
aauaagaaaaauuagcuggguacugaaaccccgucucuacuaaacaagaucaaccuggccaaca

SEQ ID NO: 162526 - RNA, 64 nt, Homo Sapiens
aguacaaaaauuagccaggcuggcaaaaccccgucucuacuaaacgagaccaaccuggucagca

SEQ ID NO: 162527 - RNA, 64 nt, Homo Sapiens
aauacaaaaauuagccagguuggugaaacccugucucuacuaaacgagaccagccuggccaaca

SEQ ID NO: 162528 - RNA, 64 nt, Homo Sapiens
aauacaaaaaauuagccagguggugaaaccccgucucuacuaaaggagaccauccuggcuaaca

SEQ ID NO: 162529 - RNA, 64 nt, Homo Sapiens
ugagaccagccugacuaacauggugaaaucccgucucuacuaaaaauacaaaaaaaaaaaaaaa

SEQ ID NO: 162530 - RNA, 64 nt, Homo Sapiens
caagaccauccuggccaacauggugaaauccugccucuacuaaaaauacaaaaaaaaaaaaaaa

SEQ ID NO: 162531 - RNA, 64 nt, Homo Sapiens
cgagaccagccuggccaacauagcaaaacccugucucuacuaaaaauacaaaaauuagaugggu

SEQ ID NO: 162532 - RNA, 64 nt, Homo Sapiens
uuuggaguuaggugguuuuggguuugaauuccagcucuacuauuuuugguugugugauagaguu

SEQ ID NO: 162533 - RNA, 64 nt, Homo Sapiens
ugaaugauuuuggaauuuuauucaaauuuauuagcucuacuacuuuuuaacacuaaaaauacaa

SEQ ID NO: 162534 - RNA, 64 nt, Homo Sapiens
aauacaaaaaauuagcuggguggcgaaaccccaucucuacuaaacgaggcugguuuggccagca

SEQ ID NO: 162535 - RNA, 64 nt, Homo Sapiens
ugagaucagccuggccaacauggugaaaccccaucucuacuaaaaauacaaaaauuagccggac

SEQ ID NO: 162536 - RNA, 64 nt, Homo Sapiens
caagaucauccuggccaacauggugaaacccugucucuacuaaaaauacaaaaaugagcugggc

SEQ ID NO: 162537 - RNA, 64 nt, Homo Sapiens
aauacaaaaauauuagccgguggagaaaccccgucucuacuaaacgagaccagccugaccaaca

SEQ ID NO: 162538 - RNA, 64 nt, Homo Sapiens
aauacaaaaauuagcuggguuggugagaccccaacucuacuaaacgagaucacccuggcccaca

SEQ ID NO: 162539 - RNA, 64 nt, Homo Sapiens
uuugagaccagccuggccaacauggcaaaaccaucucuacuaaaaauagaaaaauuagccaggc

SEQ ID NO: 162540 - RNA, 64 nt, Homo Sapiens
ucaggaguuucagaccaauauggugaaaccccaucucuacuaaaauuacaaaaaaaauuaucca

SEQ ID NO: 162541 - RNA, 64 nt, Homo Sapiens
aaugucaugaacccgaaaaaagcuucagucuggacucuacuauugaugcagaucagagaguucu

SEQ ID NO: 162542 - RNA, 64 nt, Homo Sapiens
cgagaccauccuggccaacauggugaaaccccgucucuacuaaaaauacaaaaguuagccgggu

SEQ ID NO: 162543 - RNA, 64 nt, Homo Sapiens
aauacaaaaauuagccaggcuggugaaaccuugucucuacuaaacaagaccagccuggccaaca

SEQ ID NO: 162544 - RNA, 64 nt, Homo Sapiens
aauacaaaaguagccgggcgcggagaaacccuaucucuacuaaacgagaccagccugaccaaca

SEQ ID NO: 162545 - RNA, 64 nt, Homo Sapiens
aauacaaaaauuagccgggcuggugaaaccccgucucuacuaaacaagacuagccuggccaaca

SEQ ID NO: 162546 - RNA, 64 nt, Homo Sapiens
auucaaaaacaaaauuagccuagcaagaccucaucucuacuaaaugagaccaggcugggcauca

SEQ ID NO: 162547 - RNA, 64 nt, Homo Sapiens
aauaccaaaaauuagccgagggugaaacccccaucucuacuaaaaagaccagccuguccaacau

SEQ ID NO: 162548 - RNA, 64 nt, Homo Sapiens
aauacaaaaauuagcugggcuggugaaaccccgucucuacuaaacgagaccauccuggccaaca

SEQ ID NO: 162549 - RNA, 64 nt, Homo Sapiens
aauacaaaaauucacaggguuggcaaaaucccaucucuacuaaacaagaccagccuggccaaca

SEQ ID NO: 162550 - RNA, 64 nt, Homo Sapiens
aauagaaaaaucagcuggguuggugaaaccccaucucuacuaaacgagaccauccugaccaacg

SEQ ID NO: 162551 - RNA, 64 nt, Homo Sapiens
cgagaccagccuggucaagauggugaaaccccaucucuacuaaaauuacaaaaauuagccgggu

SEQ ID NO: 162552 - RNA, 64 nt, Homo Sapiens
ugaaaccagccuggccaacauggugaaaccccaucucuacuaaaaaaacaaaacuagcuggggg

SEQ ID NO: 162553 - RNA, 64 nt, Homo Sapiens
aaauacagaaauuagcuggguggcaaaaccccgucucuacuaaacgagaccagccuggccaaca

SEQ ID NO: 162554 - RNA, 64 nt, Homo Sapiens
aauacaaaaauuagcuuggcuggcgaaaccccaucucuacuaaacgagaccagccugaccaaca

SEQ ID NO: 162555 - RNA, 64 nt, Homo Sapiens
aauacaaaaugagcugggcguggagaaaccccaucucuacuaaaggagaccagccugacuaaca

SEQ ID NO: 162556 - RNA, 64 nt, Homo Sapiens
auacaaaaaauuagcuggguuggugaaaccccgucucuacuaaacgagaccauccuggccaaca

SEQ ID NO: 162557 - RNA, 64 nt, Homo Sapiens
cgagaccagucuggccaacauggggaaaccccgucucuacuaaaaauacaaaaauuagccgggc

SEQ ID NO: 162558 - RNA, 64 nt, Homo Sapiens
ugagaccagccuggccaauguggugaaaccccaucucuacuaaaaauacaaaaauuagcugggc

SEQ ID NO: 162559 - RNA, 64 nt, Homo Sapiens
cgagaccagccuggccaacacggugaaaccccgccucuacuaaaaauacaaaaaauagccgggu

SEQ ID NO: 162560 - RNA, 64 nt, Homo Sapiens
gagaccagccugacaaaacauagugaaaccccgucucuacuaaaaauacaaaaauuagcugggc

SEQ ID NO: 162561 - RNA, 64 nt, Homo Sapiens
ggagaccagccuggccaacauggcgaagccccgucucuacuaaaaauacaaaaauuagccgggu

SEQ ID NO: 162562 - RNA, 64 nt, Homo Sapiens
uaaugagaugcaaagucuuuuggaccgaugaugucucuacuacuggaucuaucuguauuaacag

SEQ ID NO: 162563 - RNA, 64 nt, Homo Sapiens
caugcaaaaauuaccugggcuggugaaaccccaucucuacuaaaugagaccagccuggccaaca

SEQ ID NO: 162564 - RNA, 64 nt, Homo Sapiens
auacaaaaaaauagggcugguggugaaacgcugucucuacuaaacgagaccagccuggccaacg

SEQ ID NO: 162565 - RNA, 64 nt, Homo Sapiens
uuugauaaaaauugugccuuuuuauguuugguuacucuacuagaaguugaaaguaauuaaugau

SEQ ID NO: 162566 - RNA, 64 nt, Homo Sapiens
caagaccauccuggccaacauggugaaacccugucucuacuaaaaauacaaaaauagcugggca

SEQ ID NO: 162567 - RNA, 64 nt, Homo Sapiens
caagaccagccuggguaauauggcaagagcccaacucuacuaaaaauacaaaaagaaaagaaaa

SEQ ID NO: 162568 - RNA, 64 nt, Homo Sapiens
aaaaaaaaauagacaaaaauuggugaaaccccgucucuacuaaacaagaccagacuggccaaca

SEQ ID NO: 162569 - RNA, 64 nt, Homo Sapiens
aauacaaaaaauuagccgggccgugaaaccccgucucuacuaaaugagacccuccuggcuaaca

SEQ ID NO: 162570 - RNA, 64 nt, Homo Sapiens
aaaaaauacaaaaauuagcccggugaaaccccaucucuacuaaacgagaccagccuggccaaca

SEQ ID NO: 162571 - RNA, 64 nt, Homo Sapiens
ggauuuacaacauuguauuaaauaaacugguuaucucuacuauuccuuucucuuugcuccccaa

SEQ ID NO: 162572 - RNA, 64 nt, Homo Sapiens
aaaaaaaaaaaaauuagucguggugaaaccccaucucuacuaaacaagaccagccuggccaaca

SEQ ID NO: 162573 - RNA, 64 nt, Homo Sapiens
uauuagcggggugugguggcuggugaaacccugucucuacuaaacaaaaccagccugaccaaca

SEQ ID NO: 162574 - RNA, 64 nt, Homo Sapiens
aauacaaaaaaaaaaaaaaauggugaaaccccgucucuacuaaaagagaccaucauugcuaaca

SEQ ID NO: 162575 - RNA, 64 nt, Homo Sapiens
aauacaaaauuagccaggcguggagaaacccugucucuacuaaacgagaccagccugaccaaca

SEQ ID NO: 162576 - RNA, 64 nt, Homo Sapiens
ucaagaccagcuuggccaaggugauaaaacccgucucuacuaauacaaaaaaaauuagcugggu

SEQ ID NO: 162577 - RNA, 64 nt, Homo Sapiens
ccagaccagccuggccaacauggcgaaaccccaucucuacuaaaaauacaaaaauuagccgggc

SEQ ID NO: 162578 - RNA, 64 nt, Homo Sapiens
cgagaccagccuggccaauauggugaaaccccaucucuacuaaaaauauaaaaaucagcaaaaa

SEQ ID NO: 162579 - RNA, 64 nt, Homo Sapiens
ugagacccuccuggccaacauggugaaaccccgucucuacuaaaauacaaaaaauuagcugggc

SEQ ID NO: 162580 - RNA, 64 nt, Homo Sapiens
caagaccacccugaccaacuuggugaaaucccaucucuacuaaaaauacaaaaauuagcugggu

SEQ ID NO: 162581 - RNA, 64 nt, Homo Sapiens
aauauaaucccacaaaaccaacaauuuuauuugccucuacuacgucaggcagaauucuucaauu

SEQ ID NO: 162582 - RNA, 64 nt, Homo Sapiens
cgagaccagccugaccaacauggagaaacuccaucucuacuaaaaauacaaaauuagccaggug

SEQ ID NO: 162583 - RNA, 64 nt, Homo Sapiens
cgagaccauccugucuaacacggugaaaccccaucucuacuaaaaauacaaaaaaauuagucgg

SEQ ID NO: 162584 - RNA, 64 nt, Homo Sapiens
caagaccagccuggccaacauggugaaaccccaucucuacuaaaaauacaaaaauuagcuaggc

SEQ ID NO: 162585 - RNA, 64 nt, Homo Sapiens
aaauacaaaaauuagccagguggugaaaccccaucucuacuaaacaagaccagccuggccaaca

SEQ ID NO: 162586 - RNA, 64 nt, Homo Sapiens
auacauaaauuagccggguggaugagaccuccgucucuacuaaaaagaccagccuggccaacau

SEQ ID NO: 162587 - RNA, 64 nt, Homo Sapiens
auuacaaaaauuagcugggcaagcgaaaacccaucucuacuaaagcaaacaccccaucucuacu

SEQ ID NO: 162588 - RNA, 64 nt, Homo Sapiens
cgaaaacccaucucuacuaaggcaaacaccccaucucuacuaagcaggaguucgggaccagccu

SEQ ID NO: 162589 - RNA, 64 nt, Homo Sapiens
acaaaaauuagccaggcauguggugaaaccccaucucuacuaaaugagaccacccuggccaaca

SEQ ID NO: 162590 - RNA, 64 nt, Homo Sapiens
aauacagaaauuagccgggcuagugaaaccccaucucuacuaaacgagaccagccuggccaaca

SEQ ID NO: 162591 - RNA, 64 nt, Homo Sapiens
aauauaaaauuagcugggcauggugaaauccugucucuacuaaauaagaccagccuggccaaca

SEQ ID NO: 162592 - RNA, 64 nt, Homo Sapiens
ggaagaagguggcugagauaauagcagggaauuccucuacuacacagauuuuugcacgauaaga

SEQ ID NO: 162593 - RNA, 64 nt, Homo Sapiens
aauacaaaaauuagccgggcugaugaaacccuaucucuacuaaacgagaccauccuggccaaca

SEQ ID NO: 162594 - RNA, 64 nt, Homo Sapiens
aauacaaaaaccaaaaaaaacggugaaaccccaucucuacuaaaugagaccauccuggcuaaca

SEQ ID NO: 162595 - RNA, 64 nt, Homo Sapiens
aauacaaaaguuagccgggguggugaaaccccaucucuacuaaacaagagcacccuggcuaaca

SEQ ID NO: 162596 - RNA, 64 nt, Homo Sapiens
aauauaaaauauuagccaggcggugaaaccccaucucuacuaaacgagaccguccuggcuaaca

SEQ ID NO: 162597 - RNA, 64 nt, Homo Sapiens
aauacaaaaauuagcugggcuggugaaaccccaucucuacuaaacaagaccagccuggccaaca

SEQ ID NO: 162598 - RNA, 64 nt, Homo Sapiens
auacaaaaauuagccgggcguagcaaaaccucaucucuacuaaagagaacuggccuggccaaca

SEQ ID NO: 162599 - RNA, 64 nt, Homo Sapiens
aauauaaaaauuagcuggguuggugaaaccccgucucuacuaaacgagaccauccuggccaaca

SEQ ID NO: 162600 - RNA, 64 nt, Homo Sapiens
aauaugaaaauuagcugggcaggcaaaaccccgucucuacuaaaagagaccagccuggccaaca

SEQ ID NO: 162601 - RNA, 64 nt, Homo Sapiens
caaacuccugaccucaggugauccgcccaccucagccucccaaagugcugggaugacaggugug

SEQ ID NO: 162602 - RNA, 64 nt, Homo Sapiens
ccgccucucagguucaagugguucuccuuccucagccucccaaguagcugggauuacaggcacc

SEQ ID NO: 162603 - RNA, 64 nt, Homo Sapiens
ugcaguggugcaaucuuggcucacuguaaccuccgccucccagguucaagugauucuucugccu

SEQ ID NO: 162604 - RNA, 64 nt, Homo Sapiens
cgaacuccugaccucaggugauccacccgccugagccucccaaagugcugggauuacaggcaug

SEQ ID NO: 162605 - RNA, 64 nt, Homo Sapiens
caaacuccugaccucaagugaucugcccgccucggccucccaaagugcuggaaccacaggccug

SEQ ID NO: 162606 - RNA, 64 nt, Homo Sapiens
ugcagugccgcaaucucggcucacugcaaccuccgccucccagguucaagcaauucuccugccu

SEQ ID NO: 162607 - RNA, 64 nt, Homo Sapiens
caggaucucuuggccucaugaucagccugccucggccucccaaagugcugggauuacaggugug

SEQ ID NO: 162608 - RNA, 64 nt, Homo Sapiens
ugcaguggcacaaucuuggcucagagcaaccucugccucccaggcucaagcaauccucccacuu

SEQ ID NO: 162609 - RNA, 64 nt, Homo Sapiens
ugaacaccggggcucaaggaaucugcccaucuucgccucccaaaguucugagauagcaggugug

SEQ ID NO: 162610 - RNA, 64 nt, Homo Sapiens
ccgccuccuggguucaagcaguucucuugccucagccucccaaguagcugggaugacaggcgca

SEQ ID NO: 162611 - RNA, 64 nt, Homo Sapiens
cgaacuccugaccucaggugauccacccaccuuggccucccaaagugcugggauuacaggugug

SEQ ID NO: 162612 - RNA, 64 nt, Homo Sapiens
ccucugccucccggguucaagccauucugccucagccucccaaguagcugggaguacaggcguc

SEQ ID NO: 162613 - RNA, 64 nt, Homo Sapiens
cucgauauccugaucucgugauccgccugccucugccucccaaagugcugggauuacaggugug

SEQ ID NO: 162614 - RNA, 64 nt, Homo Sapiens
ugaacuccuaaccucgggugauccacccaccuuggccucccaaaguguuaggauuacaggcaug

SEQ ID NO: 162615 - RNA, 64 nt, Homo Sapiens
cuugaucucuugaccucgugauccguccaccucagccucccaaagugcugggauuacaggugug

SEQ ID NO: 162616 - RNA, 64 nt, Homo Sapiens
uggacuccugaccucaggucauccuccugccucggccucccaaagugcugagacuacaggugug

SEQ ID NO: 162617 - RNA, 64 nt, Homo Sapiens
caaacuccuggccucaggugauccucuugucucagccucccaaagugcugggauuacaggcaug

SEQ ID NO: 162618 - RNA, 64 nt, Homo Sapiens
cugccucuuggguucaagcgauucuccugccucagccucccaaguagcugggauuacaggcaua

SEQ ID NO: 162619 - RNA, 64 nt, Homo Sapiens
ugaacuccugaccucaaguaaucugcccaccucggccucccaaagugcuaggauuacaggagug

SEQ ID NO: 162620 - RNA, 64 nt, Homo Sapiens
cugcccuccagguucaagugauucuccucccucagccucccaaguagcugggauuacaggcacc

SEQ ID NO: 162621 - RNA, 64 nt, Homo Sapiens
cgaauuccagaccucaggugauccacccgccucggccucccaaagugcugggauuacaggugcg

SEQ ID NO: 162622 - RNA, 64 nt, Homo Sapiens
gugcaguggugcuaucuuggcucacugcaaacccgccucccagguuuaagcgauucucaugccu

SEQ ID NO: 162623 - RNA, 64 nt, Homo Sapiens
ccgccucccagguuuaagcgauucucaugccucagccucccaguagcugggauuagaggcaugu

SEQ ID NO: 162624 - RNA, 64 nt, Homo Sapiens
cgaacuucuggccucuagcgaucugcccgccucggccucccaaagugcugggaugaccagcauc

SEQ ID NO: 162625 - RNA, 64 nt, Homo Sapiens
caaauuccuacuucgacauaugucuuuucaaaaagccucccagacacaagacaucuuaaccguc

SEQ ID NO: 162626 - RNA, 64 nt, Homo Sapiens
cuaccucccagguucaagcuauucuacugccucagccucccaaguagcugggguuacaggcauu

SEQ ID NO: 162627 - RNA, 64 nt, Homo Sapiens
cugccuccugggcucaagcaauccucccacuucagccucccaaauagcuggggcuaccauggua

SEQ ID NO: 162628 - RNA, 64 nt, Homo Sapiens
caaacuccuggccucaugugaucugcccaccucagccucccaaaguacagggauuagaguugug

SEQ ID NO: 162629 - RNA, 64 nt, Homo Sapiens
guguugagaugacaggcacggauccaccaccucggccucccaaauugaacuccugaccucaagu

SEQ ID NO: 162630 - RNA, 64 nt, Homo Sapiens
uucaagcgauucuucugccuucacugcaaccucugccucccaggugcaguggccugaucucggc

SEQ ID NO: 162631 - RNA, 64 nt, Homo Sapiens
gugcugggauuacaggcgugauccgcccgccucggccucccaaacgaacuccugaccucaggug

SEQ ID NO: 162632 - RNA, 64 nt, Homo Sapiens
uagcugggauuacaggcaccauucuccugccucagccucccaagccaccucccggguucaagug

SEQ ID NO: 162633 - RNA, 64 nt, Homo Sapiens
uucaccagagcagccucacuauggggcuauaggagccucccacucugcaguugcagggggcgcc

SEQ ID NO: 162634 - RNA, 64 nt, Homo Sapiens
caggagagugagcucucagacuucuacccucacugccucccaguauccccagucuaccuccuuc

SEQ ID NO: 162635 - RNA, 64 nt, Homo Sapiens
gugcugggauuaccggcaugaucugcccgucucggccucccaaaugaacuccugaccucaggug

SEQ ID NO: 162636 - RNA, 64 nt, Homo Sapiens
uucaagcgauuuuccugccucucacugcaccuccgccucccaggguaaaauggugcgaucucgg

SEQ ID NO: 162637 - RNA, 64 nt, Homo Sapiens
ucaaggaggggaagguuguaccugugguugcugggccucccaccucccaccccgcugccugggc

SEQ ID NO: 162638 - RNA, 64 nt, Homo Sapiens
ccgcugccugggcccuguggccaccaucuccugagccucccaccucgggaucggguccccagag

SEQ ID NO: 162639 - RNA, 64 nt, Homo Sapiens
agacuuggagauugaaguuccgaggcaagacaaagccucccaccaaacagaaccuccaggcuga

SEQ ID NO: 162640 - RNA, 64 nt, Homo Sapiens
gugcugggauuacaggugugauccacccaccucagccucccaaacucgaacuccugaccucaug

SEQ ID NO: 162641 - RNA, 64 nt, Homo Sapiens
gugcugggauuacagacacgaccuacccagcguggccucccaaaugaacuccuggacucaagca

SEQ ID NO: 162642 - RNA, 64 nt, Homo Sapiens
cuuacgugauccucucaccuucacugcaacuucugccucccaugugcaguggcgcauucuaggc

SEQ ID NO: 162643 - RNA, 64 nt, Homo Sapiens
guguggggauuacaggugcgguccuccugccucagccucccaaaugaacuccuggccucaagug

SEQ ID NO: 162644 - RNA, 64 nt, Homo Sapiens
gugcugggauuacaggugugauccacccgccucagccucccaaacgaacuccuaaccucaagug

SEQ ID NO: 162645 - RNA, 64 nt, Homo Sapiens
uucaagcaauuuuccugccuucacugcaaccuccgccucccaggugcuguggugugaucuuagc

SEQ ID NO: 162646 - RNA, 64 nt, Homo Sapiens
guucugggauuacaggugugaucugcccaccucggccucccaaacucgaacuccugaccucgua

SEQ ID NO: 162647 - RNA, 64 nt, Homo Sapiens
uucaagcgauucuccugcuuucacugcaaccuccgccucccaggugcagugacgcgaucucgac

SEQ ID NO: 162648 - RNA, 64 nt, Homo Sapiens
gugcugggauuacaggcgugauccgccugccucugccucccaaacucgaucuccugaccucgug

SEQ ID NO: 162649 - RNA, 64 nt, Homo Sapiens
uugacaccauucuccugccuucacugcaaccuccgccucccaggugcaguggcgcaaucucggc

SEQ ID NO: 162650 - RNA, 64 nt, Homo Sapiens
auggagaacaagcaaaguaugcaggcccccugcagccucccaggacaggcuggcaagggaggag

SEQ ID NO: 162651 - RNA, 64 nt, Homo Sapiens
ccugcuggaugcuguucgugccugucccugcucugccucccacccaguugccugaaucauccca

SEQ ID NO: 162652 - RNA, 64 nt, Homo Sapiens
ugcaauggcgcaaucucgacucaccacaaccuccgccucccagguucaagcaauucuccugccu

SEQ ID NO: 162653 - RNA, 64 nt, Homo Sapiens
ugaacuccugaccucaggugauccgccugccucggccucccaaagugcugggauuacaggcaua

SEQ ID NO: 162654 - RNA, 64 nt, Homo Sapiens
ugaacuccuggccucaagcaauccucucuccucagccucccaaagugcugggauuacaagugug

SEQ ID NO: 162655 - RNA, 64 nt, Homo Sapiens
caaacuccuggguucaagcaauccucccaccucggccucccaaagugcugggauugcaggcaug

SEQ ID NO: 162656 - RNA, 64 nt, Homo Sapiens
cucuucuaccuccugcaacccacccauccuauuagccucccacauucaaggcccgugauacagg

SEQ ID NO: 162657 - RNA, 64 nt, Homo Sapiens
cucgaucuccucaccucgugauccgcccgccucggccucccaaagugcugggauuacaggcaug

SEQ ID NO: 162658 - RNA, 64 nt, Homo Sapiens
cugcaacccccagagcucuuugacaggcucccaggccucccaguccuggacaagcaugugcagu

SEQ ID NO: 162659 - RNA, 64 nt, Homo Sapiens
agcucagcucaggccagggcugggcugugcaccugccucccacugacccagacccacuuccucc

SEQ ID NO: 162660 - RNA, 64 nt, Homo Sapiens
cugccucccggguucaagcgauucuccugccccagccucccauauagcugggauuauaggugcc

SEQ ID NO: 162661 - RNA, 64 nt, Homo Sapiens
caaacuccuaggcuuaagugauccucccgccuuagccucccaagugcuaggauuacaggcauca

SEQ ID NO: 162662 - RNA, 64 nt, Homo Sapiens
ugcaguggcgugaucuuggcucacugcaaccucugccucccagcuucaagcgauucuccuguau

SEQ ID NO: 162663 - RNA, 64 nt, Homo Sapiens
cugccucccagcuucaagcgauucuccuguaucagccucccaaguagcugggauuauaggcaug

SEQ ID NO: 162664 - RNA, 64 nt, Homo Sapiens
cugccucccggauucaagugauucuccugucucagccucccaaguagcugggauuacagugccu

SEQ ID NO: 162665 - RNA, 64 nt, Homo Sapiens
cucgaacuccugaccucaugagccgcccgccuuggccucccaaagugcugggacgugacaggag

SEQ ID NO: 162666 - RNA, 64 nt, Homo Sapiens
cuggugagauuacaggcaugaucccccugccuuggccucccaaauaaacuccugggcucaagug

SEQ ID NO: 162667 - RNA, 64 nt, Homo Sapiens
uaacuggggccacaggugugaccccgcugccucagccucccaaacauggcucacugaagucuug

SEQ ID NO: 162668 - RNA, 64 nt, Homo Sapiens
gugcugggauuacaggcaugauccucccgccucggccucccaaacgaacucgugaccgcaggug

SEQ ID NO: 162669 - RNA, 64 nt, Homo Sapiens
uucaagcgauucuccugccucacugcaaaucuccgccucccaggacaauggcgugaucucggcu

SEQ ID NO: 162670 - RNA, 64 nt, Homo Sapiens
gugcugggauuacaggugugauccgcccgccucagccucccaaacaaacucuugacuucaagug

SEQ ID NO: 162671 - RNA, 64 nt, Homo Sapiens
uagcugggauuaaaggcacgauucuugugccucagccucccaagccaccuccuggguucaagug

SEQ ID NO: 162672 - RNA, 64 nt, Homo Sapiens
gagcugagauuacaggcgugaucugucugccucggccucccaaacaaacuccugacuucaggug

SEQ ID NO: 162673 - RNA, 64 nt, Homo Sapiens
uagcugggacuaugggugcaauucuccuaccucagccucccaagucaccuccugaguucaagcc

SEQ ID NO: 162674 - RNA, 64 nt, Homo Sapiens
gugcugggauuacaggcaugaucugcccgccucggccucccaaacaaacucccgaucucaggug

SEQ ID NO: 162675 - RNA, 64 nt, Homo Sapiens
uucaagcaauucuccugcuuucaccgcaaccuccgccucccagggagacuggcgcaaucuuggc

SEQ ID NO: 162676 - RNA, 64 nt, Homo Sapiens
gugcugggauuacaggcgugauccacccaccucggccucccaaacgaacuccugaccucaagcg

SEQ ID NO: 162677 - RNA, 64 nt, Homo Sapiens
uucaagcgauucuccugccuucacugcaaccucugccucccaggugcaguggcgccaucuuggc

SEQ ID NO: 162678 - RNA, 64 nt, Homo Sapiens
ccucccccuggguugaagcaauucucaugccucagccucccaaguagccaggacuauaggcacc

SEQ ID NO: 162679 - RNA, 64 nt, Homo Sapiens
cucgaucucuugaccuugggauccacccgccuuggccucccaaagugcugggauuacaggugug

SEQ ID NO: 162680 - RNA, 64 nt, Homo Sapiens
ggaaacccuuggcucaagcaauuugccugccucagccucccaaagugcugggauuacaggcgug

SEQ ID NO: 162681 - RNA, 64 nt, Homo Sapiens
ccaccuccuggguucaugccauucuucugccucagccucccaaguagcugggacuacaggugcc

SEQ ID NO: 162682 - RNA, 64 nt, Homo Sapiens
cucgaucuccugaccuugugauccaccugucucggccucccaaagugcugggauuacaggccuc

SEQ ID NO: 162683 - RNA, 64 nt, Homo Sapiens
ugcaguggugugaucuugggucacugcaaacuccgccucccagguucacgccauucuccugccu

SEQ ID NO: 162684 - RNA, 64 nt, Homo Sapiens
cucgaucuccugaccucaugauccgcccgccucggccucccaaagugcugggauuacaggcgug

SEQ ID NO: 162685 - RNA, 64 nt, Homo Sapiens
caacuccuggacuuaacgccauccaccugccacagccucccaaagugcuaggaauacaggagug

SEQ ID NO: 162686 - RNA, 64 nt, Homo Sapiens
uccgccuccugggucaaaugauucuccugcuuuagccucccaaguagcugggacuacaggugua

SEQ ID NO: 162687 - RNA, 64 nt, Homo Sapiens
caaacuccugagcucaagugauccucccgucucagccucccaaagggcugagauuacaggugug

SEQ ID NO: 162688 - RNA, 64 nt, Homo Sapiens
ugcaguggcaugaucucggcucacugcaagcuccgccucccagguucaugccauucuccuaccu

SEQ ID NO: 162689 - RNA, 64 nt, Homo Sapiens
caaacuccugagcucaaaugauccuccugccuuggccucccaaagugcuggaauuacaggcaug

SEQ ID NO: 162690 - RNA, 64 nt, Homo Sapiens
ugcaauggcgcgaucucagcucacugcagccacugccucccagguucaagugauucuccugccu

SEQ ID NO: 162691 - RNA, 64 nt, Homo Sapiens
auguucgacaggcuggucucgaacucccaccucagccucccaaacugcugggauuacaggugug

SEQ ID NO: 162692 - RNA, 64 nt, Homo Sapiens
caaccuccccggcucaagugauccuccugccucagccucccaaguagcugggacuacaggcguu

SEQ ID NO: 162693 - RNA, 64 nt, Homo Sapiens
cgaacuccuggacucaaaguauccucccgccucggccucccaaaguguugggauuauaggagug

SEQ ID NO: 162694 - RNA, 64 nt, Homo Sapiens
ugcaguggcaugaucucggcuuacugcaaccuuugccucccagguucaagcgauucuucugccu

SEQ ID NO: 162695 - RNA, 64 nt, Homo Sapiens
ugcuaccucuaccaugagcaauucuccugccucagccucccaaguagcuggaacuacaggcuca

SEQ ID NO: 162696 - RNA, 64 nt, Homo Sapiens
uucaaacuccugacuuugugauccacccgccucggccucccaaagugcugggauuacaggcaug

SEQ ID NO: 162697 - RNA, 64 nt, Homo Sapiens
gugccgggauuacaggcgugauccacccgccucggccucccaaacucgaucuccugaccucgug

SEQ ID NO: 162698 - RNA, 64 nt, Homo Sapiens
uucaugccauucuccugccuucacugcaagcuccgccucccaggugcaguggcaugaucucggc

SEQ ID NO: 162699 - RNA, 64 nt, Homo Sapiens
augcugggauuacaggugugauccacccgccucggccucccaaacucgaucuccugacgucgug

SEQ ID NO: 162700 - RNA, 64 nt, Homo Sapiens
gugcugggauuacaggcgugauccacccaccucugccucccaaacaaacuccugggcucaagca

SEQ ID NO: 162701 - RNA, 64 nt, Homo Sapiens
gugcugggauuacagaugugauccuccugccucggccucccaaacaaccuccugggcucaagca

SEQ ID NO: 162702 - RNA, 64 nt, Homo Sapiens
uagcugggaucacuggcacaauucucccaccucagccucccaaacugccuccugggcucaagca

SEQ ID NO: 162703 - RNA, 64 nt, Homo Sapiens
uagcugggauuauaggugugguucuccugccucagccucccaagcugccucccagguucaagug

SEQ ID NO: 162704 - RNA, 64 nt, Homo Sapiens
uucaagugguucuccugccuuuacugcacccucugccucccaggugcgguggcgcgaucuuggc

SEQ ID NO: 162705 - RNA, 64 nt, Homo Sapiens
gugcugggauuacaggcuugaucugccugccucagccucccaaacuugaucuccugaccucaug

SEQ ID NO: 162706 - RNA, 64 nt, Homo Sapiens
uucacaccauucuccugccuucacugcaagcucugccucccagguggaguacaguggugcaauc

SEQ ID NO: 162707 - RNA, 64 nt, Homo Sapiens
gugcugggauuacaggugugaauccucccaccuugccucccaaacucgaacucuggguucaaga

SEQ ID NO: 162708 - RNA, 64 nt, Homo Sapiens
uagcugggauuacaggcgugauucuugugccuuagccucccaagcugccuucuggauucaagug

SEQ ID NO: 162709 - RNA, 64 nt, Homo Sapiens
uaggugggacuacaggugccauucuccugccucagccucccaagccgccucccagguucaagca

SEQ ID NO: 162710 - RNA, 64 nt, Homo Sapiens
uucaagcaauucuccugccuucaccgcaaccuccgccucccaggugcaauggcgugaucucggc

SEQ ID NO: 162711 - RNA, 64 nt, Homo Sapiens
gugcugggauuacaggcaugauccaccugccucagccucccaaaugaacuccugaccucaggug

SEQ ID NO: 162712 - RNA, 64 nt, Homo Sapiens
uagcugggacuacaggugcaauucuccugccucagccucccaagcugccucccgaguucaagca

SEQ ID NO: 162713 - RNA, 64 nt, Homo Sapiens
gugcugggauuacaggcgugaucccccugccucggccucccaaacucgaucuccugaccucgug

SEQ ID NO: 162714 - RNA, 64 nt, Homo Sapiens
aucccugcgagcguucauggggagcucccgguccgccucccagcccggcgggggccgcagacug

SEQ ID NO: 162715 - RNA, 64 nt, Homo Sapiens
gugcugggauuacaggcguaaucugcccgccuuggccucccaaaugaacuccuggccacaagug

SEQ ID NO: 162716 - RNA, 64 nt, Homo Sapiens
uucaagugauucucaugccuucacugcagccuccgccucccagggugcagugggccgucucagu

SEQ ID NO: 162717 - RNA, 64 nt, Homo Sapiens
cgaacuccugaccucaggugaucugcccaccuuggccucccaaagugcugggauuacaggcaug

SEQ ID NO: 162718 - RNA, 64 nt, Homo Sapiens
acccgaagcccagcuggggcccugguccagccucgccucccagacucugcaccugcuagcacag

SEQ ID NO: 162719 - RNA, 64 nt, Homo Sapiens
ugaacuccugaccucaacugauccgcccaccuuggccucccaagugcugggauuacaggcgcga

SEQ ID NO: 162720 - RNA, 64 nt, Homo Sapiens
ccaccuccuggguucaagcauuucuccugccucagccucccaaguagcugggauuacaggcagc

SEQ ID NO: 162721 - RNA, 64 nt, Homo Sapiens
caaacuccugaccucaagugauccgcccuccccagccucccaaagugcugggauuacaggugug

SEQ ID NO: 162722 - RNA, 64 nt, Homo Sapiens
ugcaguggcgcaaucucgggucacugcaagcucugccucccaaguucaugccauucuccugccu

SEQ ID NO: 162723 - RNA, 64 nt, Homo Sapiens
cugccucccaaguucaugccauucuccugccucagccucccaaguagcugggacuacaggcacc

SEQ ID NO: 162724 - RNA, 64 nt, Homo Sapiens
ggucuugaucugaccucgugauccgccgaccucggccucccaaagugcuggaauuacaggcgug

SEQ ID NO: 162725 - RNA, 64 nt, Homo Sapiens
uguucuaguuuugguuccuuuugcagagugaaaugccucccaggaaaaaaauacauauguauuu

SEQ ID NO: 162726 - RNA, 64 nt, Homo Sapiens
cgagcuccugggcucaagugauccucccaccucagccucccaaagugcugggauuacaggugug

SEQ ID NO: 162727 - RNA, 64 nt, Homo Sapiens
ugugguggcacagucucagcucacugcaaccucugccucccaguucaagcaauucuucugccuc

SEQ ID NO: 162728 - RNA, 64 nt, Homo Sapiens
ucugccucccaguucaagcaauucuucugccucagccucccaaguagcugggauuacaggcacc

SEQ ID NO: 162729 - RNA, 64 nt, Homo Sapiens
caaacuucugaccucaagugaucugcccaccuuggccucccaaagugcugggauuacaggugua

SEQ ID NO: 162730 - RNA, 64 nt, Homo Sapiens
ccaccucccagguucaagcaauucuucugccucagccucccaaguagcugggauuacaggugcc

SEQ ID NO: 162731 - RNA, 64 nt, Homo Sapiens
caaacuccugaccucaagugauccaccugccucagccucccaaagugcugggauuauagucgug

SEQ ID NO: 162732 - RNA, 64 nt, Homo Sapiens
cuugaucucuugaccucgugaucugccugccucggccucccaaagugcuggcauuacaggcaug

SEQ ID NO: 162733 - RNA, 64 nt, Homo Sapiens
ccaccucccggguucaagugauucucuggccucagccucccaaguagcugggacuacaggugug

SEQ ID NO: 162734 - RNA, 64 nt, Homo Sapiens
caaacuccugaccuccagugaucugcccaccucggccucccaaagugcugggauuacaggugug

SEQ ID NO: 162735 - RNA, 64 nt, Homo Sapiens
gugcugggauuacaggugugaaccacccgucucggccucccaaacucaaucuccugaccuugug

SEQ ID NO: 162736 - RNA, 64 nt, Homo Sapiens
uagcugggacuacaggcaccauucuccuggcucagccucccaagcugcuucccagguucacgcc

SEQ ID NO: 162737 - RNA, 64 nt, Homo Sapiens
gugcugggauuacaggugugaucugccugccuuggccucccaaacucaaucucuugaccucgug

SEQ ID NO: 162738 - RNA, 64 nt, Homo Sapiens
uucaagcgauucuccugccuucacugcaaccucugccucccagggcacaaucucggcucucggc

SEQ ID NO: 162739 - RNA, 64 nt, Homo Sapiens
auacugggauuacaggcuugaucuucccacaccagccucccaaagaaacccuugagcucaagug

SEQ ID NO: 162740 - RNA, 64 nt, Homo Sapiens
uagcuaggacuacagacaugauccucccaucucagccucccaagugaccuccuugacucaauug

SEQ ID NO: 162741 - RNA, 64 nt, Homo Sapiens
gugcugggauuacaggcaugauccacccuccucagccucccaaaugaacucccaaccucaggug

SEQ ID NO: 162742 - RNA, 64 nt, Homo Sapiens
cgauucuccugccucagccuucaccgcaaaguccgccucccaggugcauuggcgcgaucucggc

SEQ ID NO: 162743 - RNA, 64 nt, Homo Sapiens
gugcugggauuacaggcaugaucugccagccuccgccucccaacguuggccucgaacucaggug

SEQ ID NO: 162744 - RNA, 64 nt, Homo Sapiens
cagcugggacuacaggcaugauucucaugccucagccucccaagcugcuuccuggguucaaaca

SEQ ID NO: 162745 - RNA, 63 nt, Homo Sapiens
ucgaucuccugaccucaugauccacccgccucagccucccaaaguguugggauuacaggcgug

SEQ ID NO: 162746 - RNA, 64 nt, Homo Sapiens
cugccuccuggguucaagcgauucuccugccucugccucccaaguagcugggauuacaggcacc

SEQ ID NO: 162747 - RNA, 64 nt, Homo Sapiens
ccaccuuccugguucaagggauucuccugccucagccucccaaguagcugggauuacaggcaug

SEQ ID NO: 162748 - RNA, 64 nt, Homo Sapiens
cgaacuucugaccucaggugaucugcccaccucggccucccaaagugcugggauuacaggcgug

SEQ ID NO: 162749 - RNA, 64 nt, Homo Sapiens
ugcagugguaugaucucggcucacuguaaccuccgccucccagguucaggugauucuccugccu

SEQ ID NO: 162750 - RNA, 64 nt, Homo Sapiens
cucgaacuccugaccucgugauccgccugccucagccucccaaagugcugggauuacaggcaug

SEQ ID NO: 162751 - RNA, 64 nt, Homo Sapiens
ggaacuccugggcucaagugauccuccugccuuggccucccaaaaugcugggauuacaggcaug

SEQ ID NO: 162752 - RNA, 64 nt, Homo Sapiens
ccgccucccggguucaagcaauucuccugccucagccucccaaguagcugggauuacagguguc

SEQ ID NO: 162753 - RNA, 64 nt, Homo Sapiens
cgaacuccugaccucaggugauccacccgccucagccucccaaagugcugggauuacaggcaaa

SEQ ID NO: 162754 - RNA, 64 nt, Homo Sapiens
cucgaacuccugaccuugugaugcucccaccucggccucccaaagugcugggauuaaagcugug

SEQ ID NO: 162755 - RNA, 64 nt, Homo Sapiens
cucgaucuccugaccucaugauccucccgccucagccucccaaaaugcugggauuacaggcgug

SEQ ID NO: 162756 - RNA, 64 nt, Homo Sapiens
cugccuccugggcucaacggauccuuccaccucagccucccaaguagcuuggacuauaggugca

SEQ ID NO: 162757 - RNA, 64 nt, Homo Sapiens
ugaacuccugggcucaagccauccucccuccucagccucccaaaauucugggauuacaggcaua

SEQ ID NO: 162758 - RNA, 64 nt, Homo Sapiens
ugcaguggcgcgaucucagcucacugcaaccuccgccucccagguucaagcgauucuccugccu

SEQ ID NO: 162759 - RNA, 64 nt, Homo Sapiens
gucuaucucuugaccucgugauccaccccacucagccucccaaauugcugggauuuacaggcau

SEQ ID NO: 162760 - RNA, 64 nt, Homo Sapiens
uuuaaacucuugaccucauguuccacccgccacggccucccaaagugcugugauuaccggugug

SEQ ID NO: 162761 - RNA, 64 nt, Homo Sapiens
uuaacuucugagcucaagagaugcacuccccucagccucccaaagugcugggauuacaggcggc

SEQ ID NO: 162762 - RNA, 64 nt, Homo Sapiens
caacugauguuuguuuuuuaaaggguaagaugcugccucccaaugggugaugccaucugacugg

SEQ ID NO: 162763 - RNA, 64 nt, Homo Sapiens
ccaccucccagguucaagugauucuccugucucagccucccaaguagcugggacuacaggcaug

SEQ ID NO: 162764 - RNA, 64 nt, Homo Sapiens
gugcugggauuacagggacgauccucucaucuuggccucccaaauggacuccugguuucaagug

SEQ ID NO: 162765 - RNA, 64 nt, Homo Sapiens
gugcuaggauuacaggcguggauccgccgccucggccucccaaaggucucgaacucgaccucgu

SEQ ID NO: 162766 - RNA, 64 nt, Homo Sapiens
accccagcccagaacucuucuuuuccagccccuugccucccagaugaccaaucaguggcccaaa

SEQ ID NO: 162767 - RNA, 64 nt, Homo Sapiens
gugcugggauuacaggcaugauccaucugccuuggccucccaaacaaacuucugaucucaagug

SEQ ID NO: 162768 - RNA, 64 nt, Homo Sapiens
gugcugggacuacaggcaugaucuuccuaucucagccucccaaaugaacuccuggucucgagug

SEQ ID NO: 162769 - RNA, 64 nt, Homo Sapiens
uaacuaagacuacaggcaugauccugcugucucagccucccaagccaacuccugggcucaagca

SEQ ID NO: 162770 - RNA, 64 nt, Homo Sapiens
gugcuggauuacaggcgugaaucuuccggccucagccucccaaaugaacuccugaccucaagug

SEQ ID NO: 162771 - RNA, 64 nt, Homo Sapiens
uagcugggauuacaccaccaugccucccaggucagccucccaagucuuggcucauugcaaccuc

SEQ ID NO: 162772 - RNA, 64 nt, Homo Sapiens
ucagccucccaaguagcuggucauugcaaccucugccucccaggugcaguggcacuaucuuggc

SEQ ID NO: 162773 - RNA, 64 nt, Homo Sapiens
uuacugggauuacaggcaccauucuccugccucagccucccaauccgccucccagguucaagcg

SEQ ID NO: 162774 - RNA, 64 nt, Homo Sapiens
uucaagcgauucuccugccuucacuacaaccuccgccucccaggugcaguggcacgaucucggc

SEQ ID NO: 162775 - RNA, 64 nt, Homo Sapiens
gugcugggauuacaggcgugauucaccugccucggccucccaaaugaacuccugaccucaagug

SEQ ID NO: 162776 - RNA, 64 nt, Homo Sapiens
uagcugggauuacaggcaugagucuccugucucagccucccaagcuaccuccuggguucaagca

SEQ ID NO: 162777 - RNA, 64 nt, Homo Sapiens
gugcugggauuacaggugugauccacccaccucagccucccaaagaacuuccugaccucagguu

SEQ ID NO: 162778 - RNA, 64 nt, Homo Sapiens
uagcugggguuacaggcgccauucucgugccucagccucccaagccaccuccuggguucaagug

SEQ ID NO: 162779 - RNA, 64 nt, Homo Sapiens
gugcugggauuacaggcgugauccacccgccuuggccucccaaacucaaucuccugaccucgug

SEQ ID NO: 162780 - RNA, 64 nt, Homo Sapiens
uucacuccauucuccugccuucacugcaagcuccgccucccaaguacaguggcgcgaucucagc

SEQ ID NO: 162781 - RNA, 64 nt, Homo Sapiens
gugcugagauuacaagugugauccacuugccucggccucccaaacaaacuccugaccucaggug

SEQ ID NO: 162782 - RNA, 64 nt, Homo Sapiens
uagcuaggauuacaagugccauucuucugccucagccucccaagccaccuccuggguucaagcg

SEQ ID NO: 162783 - RNA, 64 nt, Homo Sapiens
augcugggaucacaggcgugauccacccaccccggccucccaaaugaacucccgaccucaggug

SEQ ID NO: 162784 - RNA, 64 nt, Homo Sapiens
caaacuccuaggcucaggcgauccucuugcccuggccucccauguagcugcaacuauaggugug

SEQ ID NO: 162785 - RNA, 64 nt, Homo Sapiens
gaacuccugggcucagaugauccuccuguccucagccucccaaaaugcugggagccaccaggca

SEQ ID NO: 162786 - RNA, 64 nt, Homo Sapiens
gugaugcgauugaucauggcucacuguaaccucugccucccaggcucgauccucccaugucagc

SEQ ID NO: 162787 - RNA, 64 nt, Homo Sapiens
accucugccucccaggcucgauccucccaugucagccucccaaguagcugggacuacaugcaca

SEQ ID NO: 162788 - RNA, 64 nt, Homo Sapiens
ugcagugaugcuaucucggcucacugcaaccuuugccucccagguucaagugauucuccugccu

SEQ ID NO: 162789 - RNA, 64 nt, Homo Sapiens
uugccucccagguucaagugauucuccugccucagccucccaaguagcugggauuacaggcgug

SEQ ID NO: 162790 - RNA, 64 nt, Homo Sapiens
cgaacucccgaccucaggugauccgccagccucagccucccaaagugcugggauuacaggcgug

SEQ ID NO: 162791 - RNA, 64 nt, Homo Sapiens
caaccuucccagcucaagugauccuccuaccucagccucccaaguaguugggaccacaggugug

SEQ ID NO: 162792 - RNA, 64 nt, Homo Sapiens
cagacugcugggcucaagcgauccucacaccucagccucccagagugcugggauuacaguugug

SEQ ID NO: 162793 - RNA, 64 nt, Homo Sapiens
caaauuccugaccucaagugauccaccugccuuagccucccaaagugcugggauuacaggcaug

SEQ ID NO: 162794 - RNA, 64 nt, Homo Sapiens
ugcaguggugcgaucuuggcucauggcaaccucugccucccagguucaagcgauuguccugccu

SEQ ID NO: 162795 - RNA, 64 nt, Homo Sapiens
cucgaucucuugaccuuguguuccacccgccuuggccucccaaagugcuggaauuacaggcaug

SEQ ID NO: 162796 - RNA, 64 nt, Homo Sapiens
cugccuccuggauucaagcgauucuccugucccagccucccagguagcugggacuauaggcacg

SEQ ID NO: 162797 - RNA, 64 nt, Homo Sapiens
cuagaucuccugaccuugugaucugccugccucggccucccaaagugcugggauuacaggcgug

SEQ ID NO: 162798 - RNA, 64 nt, Homo Sapiens
cugacuccaggguucaggugauuauuuugccucagccucccaagcagcugggauuauagacacc

SEQ ID NO: 162799 - RNA, 64 nt, Homo Sapiens
ugaacuccugaccucaggugauccgcccgccucggccucccaaagugcugggauuacagacgug

SEQ ID NO: 162800 - RNA, 64 nt, Homo Sapiens
gugcuaggauuacaggcauaauccgccuaccucagccucccaaaugaacuccuggccucaagcg

SEQ ID NO: 162801 - RNA, 64 nt, Homo Sapiens
uagcugagacuacaagcaccauucucuugcuucagccucccaagccuccuccuggauucaagca

SEQ ID NO: 162802 - RNA, 64 nt, Homo Sapiens
gugcugggauuacaggcuugauccacccgccucggccucccaaagucgaucuccugaccucgug

SEQ ID NO: 162803 - RNA, 64 nt, Homo Sapiens
guacuaggaguacaggcauaauccaccuuccucggccucccaaacaaacuccugaguucaagca

SEQ ID NO: 162804 - RNA, 64 nt, Homo Sapiens
uagcugggaccacaagugugguccuuccaccucagccucccaagcaacgucccccgcucaggug

SEQ ID NO: 162805 - RNA, 64 nt, Homo Sapiens
gugcugggauuacaggcgugaucuacccaccucggccucccaaacgagcuccugaccucaggug

SEQ ID NO: 162806 - RNA, 64 nt, Homo Sapiens
uucaggugauucuccugccuucacugcaaccucugccucccaggugcaauggugcaaucucagc

SEQ ID NO: 162807 - RNA, 64 nt, Homo Sapiens
guucagggauuacaggcaugaucugcccaccuuggccucccaaacucgaacuccugaccuugug

SEQ ID NO: 162808 - RNA, 64 nt, Homo Sapiens
uucaagugauucuccugucuucacugcaaccuccgccucccaggugcaauggcacgaucucggc

SEQ ID NO: 162809 - RNA, 64 nt, Homo Sapiens
gugcugggauuacaggcgugaucugcccgccucggccucccaaacucgaucuccugaccuugug

SEQ ID NO: 162810 - RNA, 64 nt, Homo Sapiens
guauugggauuacccgcgugauccgcccgccucggccucccaaacucgaucuccuaaccuggug

SEQ ID NO: 162811 - RNA, 64 nt, Homo Sapiens
uagcucggacuacaggcgucauucuccugccucagccucccaagccgccucucggguucacgcc

SEQ ID NO: 162812 - RNA, 64 nt, Homo Sapiens
gugcugggauuacaggcgugaucugcccaccucagccucccaaaugaauuccugaccucaggug

SEQ ID NO: 162813 - RNA, 64 nt, Homo Sapiens
acaucuggccugaggggauuccugcccaggcuuggccucccagggccaaccagccacuggcuuu

SEQ ID NO: 162814 - RNA, 62 nt, Homo Sapiens
ccgcacaccucucccauccaugacucggcucugccucccaguccaggaaagauuauaccuag

SEQ ID NO: 162815 - RNA, 64 nt, Homo Sapiens
uagacuugaucucaaagaagccucuaaggaagaagccucccauaagacuauuuuuaaacacaca

SEQ ID NO: 162816 - RNA, 64 nt, Homo Sapiens
gugcugggauuacaggcgugauccgcccaccuuggccucccagacucgaucuccugaccucgug

SEQ ID NO: 162817 - RNA, 64 nt, Homo Sapiens
gugcugggauuacaggcgugaucagcccgccucggccucccaaacgaacuccugaccacaggua

SEQ ID NO: 162818 - RNA, 64 nt, Homo Sapiens
augcugggauuacaggcuugauccaccugccucagccucccaaaggucuugaacugaccucaug

SEQ ID NO: 162819 - RNA, 64 nt, Homo Sapiens
gugcugggauuacaggcgugguccuucugccuuggccucccaaacaaacuccugaccucaggug

SEQ ID NO: 162820 - RNA, 64 nt, Homo Sapiens
gugcugggauuacaggagugaucugcccgccucagccucccaaacucgaucuccugaccucgug

SEQ ID NO: 162821 - RNA, 64 nt, Homo Sapiens
ugcaauggcgugaucucagcucaccgcaaccucugccucccagauucaagcaauucuccugccu

SEQ ID NO: 162822 - RNA, 64 nt, Homo Sapiens
caaacucccaaccucaggugauaugcccgccucggccucccaaaauguugggauuacaggcaug

SEQ ID NO: 162823 - RNA, 64 nt, Homo Sapiens
uuuuuuuuuuauuuugagcaauucuccugccucagccucccaaauagcugggauuacaggugca

SEQ ID NO: 162824 - RNA, 64 nt, Homo Sapiens
caaacuccugaccucagaugauccgccugccuuggccucccaaagugcugggauuacaggugug

SEQ ID NO: 162825 - RNA, 64 nt, Homo Sapiens
ucaggcggaggugaccaugcccuucaccaaagcugccucccaguggccacacagaacucucccu

SEQ ID NO: 162826 - RNA, 64 nt, Homo Sapiens
ggcagaugaaugucuugaaagcucccgggccucagccucccaucuccucuccuucccaggaauc

SEQ ID NO: 162827 - RNA, 64 nt, Homo Sapiens
ugaacuccugaccucaggugauacacccaucucggccucccaaagugcugggauuacaggcuug

SEQ ID NO: 162828 - RNA, 64 nt, Homo Sapiens
auacaggcuggccucaagugauccucuuaccuuggccucccaaacaccgggauuauaggcguga

SEQ ID NO: 162829 - RNA, 64 nt, Homo Sapiens
gugcugggauuacaggcgugaucuaccugccucggccucccaaaugaacucccgacgucaggug

SEQ ID NO: 162830 - RNA, 64 nt, Homo Sapiens
guucuaggauuacaggugugauccacccaccuuggccucccaaacuuggacuccugaccucgug

SEQ ID NO: 162831 - RNA, 64 nt, Homo Sapiens
gugcugggauuacaggcuugauccgccugccucagccucccaaacuugaucuccugaccuugug

SEQ ID NO: 162832 - RNA, 64 nt, Homo Sapiens
uucacgccauucuccugccuucacugcaagcucugccucccaggugcaguggcgcggucucggc

SEQ ID NO: 162833 - RNA, 64 nt, Homo Sapiens
gugcugggauuacaggcaugauccacccgccuuggccucccaaacuugaacuccugaccucgug

SEQ ID NO: 162834 - RNA, 64 nt, Homo Sapiens
uaguugggauuacaggcaccaauucucugccucagccucccaagucugccucccggguucaagc

SEQ ID NO: 162835 - RNA, 64 nt, Homo Sapiens
gugcugccauuacaggcgugauccacaugacucugccucccaaaugaacuccucaccucaggug

SEQ ID NO: 162836 - RNA, 64 nt, Homo Sapiens
uucaagcgauucuccugccuucacugcaaccucugccucccaggugcaguggcaugaucucggc

SEQ ID NO: 162837 - RNA, 64 nt, Homo Sapiens
ccccuuauuuuuaaaauacuuaggucagaucuuggccucccaaauaaggaguccuucuacagaa

SEQ ID NO: 162838 - RNA, 64 nt, Homo Sapiens
gugcuaggauuacagguaugaucugcccgccuuggccucccaaacaaacuccugagcucaggca

SEQ ID NO: 162839 - RNA, 64 nt, Homo Sapiens
gugcuaggauuacaggcccgauccacccaccucggccucccaaacgaacuccugaccucaagug

SEQ ID NO: 162840 - RNA, 64 nt, Homo Sapiens
uagcugggauuacaggcaccauucuuccaccucagccucccaggcugccucuuggguucaagug

SEQ ID NO: 162841 - RNA, 64 nt, Homo Sapiens
ucccauaaggguagcccccucccacaucagggcggccucccagggaccaccgggugacauccgu

SEQ ID NO: 162842 - RNA, 64 nt, Homo Sapiens
gugcugggauuaaggcgugaaugggcccgccucggccucccaaacucgaucuccugaccucgug

SEQ ID NO: 162843 - RNA, 64 nt, Homo Sapiens
gcugggacuacaggcgcccgauucuccugccucagccucccauaccgccucccggguucacgcc

SEQ ID NO: 162844 - RNA, 64 nt, Homo Sapiens
gcuuugaaugcuggaaauggcuucauagugaagugccucccacagggcgggugggucagcguug

SEQ ID NO: 162845 - RNA, 64 nt, Homo Sapiens
cugacuccugacuaaaagugaucugcccaccucggccucccaaaguucugggauuacgggcgug

SEQ ID NO: 162846 - RNA, 64 nt, Homo Sapiens
ccuccaccucccaggcucaagagauccucccacagccucccagguagcugggacuacaggcgug

SEQ ID NO: 162847 - RNA, 64 nt, Homo Sapiens
uacuccuagcuaguaaggaauggaucuacagccugccucccagguuucuggcuuguggggggca

SEQ ID NO: 162848 - RNA, 64 nt, Homo Sapiens
ugcaguggcgcaauuucagcucacugcaaccucugccucccagguucaagugauucuccugccu

SEQ ID NO: 162849 - RNA, 64 nt, Homo Sapiens
cuccaacuccugacuucaugauccacccaccucggccucccaaagugcugagauuacagacgug

SEQ ID NO: 162850 - RNA, 64 nt, Homo Sapiens
ugcaguagcacaaucacggcucacugcaaucucugccucccaguuucaagugauucugcugucu

SEQ ID NO: 162851 - RNA, 64 nt, Homo Sapiens
cugccucccaguuucaagugauucugcugucucagccucccaaguagcugggacuacaggcaug

SEQ ID NO: 162852 - RNA, 64 nt, Homo Sapiens
cuccaucucuugacauugugauccaccugccucggccucccaaagugcugggauuacaggcaug

SEQ ID NO: 162853 - RNA, 64 nt, Homo Sapiens
auuccugggcuccagggauccacagucccccuuggccucccaaaguguugggauuacaugcaug

SEQ ID NO: 162854 - RNA, 64 nt, Homo Sapiens
cuugaacuccugagcucaugauccacccgccucagccucccaaagugcugggauuacaggcccc

SEQ ID NO: 162855 - RNA, 64 nt, Homo Sapiens
ugcgguggcgcugucucagcucacugcaaccuccgccucccagguucaagugauucuccugccu

SEQ ID NO: 162856 - RNA, 64 nt, Homo Sapiens
caaacuccuaaccucaacugauccaccugccucagccucccaaagugccgccgggauuacaggc

SEQ ID NO: 162857 - RNA, 64 nt, Homo Sapiens
gccauuucccuguuguccugaggaggaacuccaggccucccaucgugugcccuaaggccuccug

SEQ ID NO: 162858 - RNA, 64 nt, Homo Sapiens
gugugcccuaaggccuccugcguccuggagcccugccucccacugccugacuuccugccacacg

SEQ ID NO: 162859 - RNA, 64 nt, Homo Sapiens
gugcugggauuacaggugugauccacucaccucggccucccaaacgaacuccugaccucaagug

SEQ ID NO: 162860 - RNA, 64 nt, Homo Sapiens
uucaagcgauuucgugccucucacugcaaccuccgccucccaggugcaguggugcaaucucagc

SEQ ID NO: 162861 - RNA, 64 nt, Homo Sapiens
gugcugggauuacaggcaugaugugcccaacucggccucccaaaggaaccccuaggcucaaaug

SEQ ID NO: 162862 - RNA, 64 nt, Homo Sapiens
uaccugggacuacaggcacgauccucacaccuuagccucccaagcccaggcucaggcucaggug

SEQ ID NO: 162863 - RNA, 64 nt, Homo Sapiens
cuggucccagguuccacaagugggggaccccccagccucccaccaguuucccgcaaagugccuc

SEQ ID NO: 162864 - RNA, 64 nt, Homo Sapiens
cuggucccaguuucccgcaaccgcaagccccccagccucccaccccaggauguccuggcucacu

SEQ ID NO: 162865 - RNA, 64 nt, Homo Sapiens
ugcaauggcgcgaucuuggcucaccauaaccuccgccucccagguucaagcaauucuccugccu

SEQ ID NO: 162866 - RNA, 64 nt, Homo Sapiens
caaacuccugaccucaggugaucugcccgccucagccucccaaagugcuggaauuacaggcgug

SEQ ID NO: 162867 - RNA, 64 nt, Homo Sapiens
ugcaguggugugaucucgucucacugcaaccuccgccucccagauucaagcgauucuccugucu

SEQ ID NO: 162868 - RNA, 64 nt, Homo Sapiens
ugaacuccugaccucaggugauccacccgccucagccucccaaagugcugggauuacagguggg

SEQ ID NO: 162869 - RNA, 64 nt, Homo Sapiens
cgaacuccugaccuuaggugauccgcccgccucagccucccaaaguguugggauuacaggcaug

SEQ ID NO: 162870 - RNA, 64 nt, Homo Sapiens
caaacuccugaccucaggugauccaccugccucagccucccagacuguugggauuacaggcaug

SEQ ID NO: 162871 - RNA, 64 nt, Homo Sapiens
gugcugggauuacaggcgugaucugcccgccucggccucccaaacucaaucuccugaccucgug

SEQ ID NO: 162872 - RNA, 64 nt, Homo Sapiens
uucaagcaguucuccugccuucacugcgaccucugccucccaggugcaauggugcaaucucggc

SEQ ID NO: 162873 - RNA, 64 nt, Homo Sapiens
gugcugagauuacaggugugauccgcccgccucagccucccaaacaaacuccugaccucaggug

SEQ ID NO: 162874 - RNA, 64 nt, Homo Sapiens
uagcugugauuacaggcgugauucuccugccucagccucccaaaccaccuccuggguuccagcg

SEQ ID NO: 162875 - RNA, 64 nt, Homo Sapiens
aagccagccuuuuuuguaaguggcccgccagguggccucccagcccccuccucugacacagggc

SEQ ID NO: 162876 - RNA, 64 nt, Homo Sapiens
gccgaccgcacagcucccuccuggugccuucggagccucccacugccagggcgucaagggaggg

SEQ ID NO: 162877 - RNA, 64 nt, Homo Sapiens
ccaccucccagguucaagcaauucuccugccucagccucccaaguagcugggauuacaggcacc

SEQ ID NO: 162878 - RNA, 64 nt, Homo Sapiens
cgaacuucugaccucaggugauccaccugccucagccucccaaauugcugggauuacaggcgug

SEQ ID NO: 162879 - RNA, 64 nt, Homo Sapiens
guaaccaguccugucccauuuccucagucccugggccucccagccuucaggcuguagggcugcc

SEQ ID NO: 162880 - RNA, 64 nt, Homo Sapiens
uucucaccaggccuccuuuccuaugggcauuggugccucccagagguuucuugggcugcuggcu

SEQ ID NO: 162881 - RNA, 64 nt, Homo Sapiens
cgaacuccugacuucaggugauccacccaucucagccucccaaagugcugggauuacaggcgug

SEQ ID NO: 162882 - RNA, 64 nt, Homo Sapiens
aacaugucuucuuucagaaugggaauauaugugugccucccaacauuuacuguuaaaguguguu

SEQ ID NO: 162883 - RNA, 64 nt, Homo Sapiens
gugcugggauuacaggcgugaucuacccgccucggccucccaaacucgaucuccugaccucaug

SEQ ID NO: 162884 - RNA, 64 nt, Homo Sapiens
gugcugggauuacaggcaugauccaccugccucagccucccaaacaaauuccuggccucaggug

SEQ ID NO: 162885 - RNA, 64 nt, Homo Sapiens
uagcugggauuacuggcgccauucuccugccucagccucccaagccaccucccagguucaagcg

SEQ ID NO: 162886 - RNA, 64 nt, Homo Sapiens
gugcuaggauuacuggcgugaucugcccaccucggccucccaaaggucucaaucugaccuugug

SEQ ID NO: 162887 - RNA, 64 nt, Homo Sapiens
agugcugggauuauaggcguauccgcccgccuuggccucccaaauuugaucuccugaccucgug

SEQ ID NO: 162888 - RNA, 64 nt, Homo Sapiens
agauuaauuguucauaucagacuuauugggaaaagccucccagucuuugugcaagaaauuugaa

SEQ ID NO: 162889 - RNA, 64 nt, Homo Sapiens
aggacagagaacuaaaaaaucaguggaggaaacagccucccaaaugaugacaaguagagacgag

SEQ ID NO: 162890 - RNA, 64 nt, Homo Sapiens
augauucugaggcuuucccaaagaagugccuuuugccucccaccuucuuuugcugcugccaugu

SEQ ID NO: 162891 - RNA, 64 nt, Homo Sapiens
gugcugggauuacagguguguuccucccacccuggccucccagacaaacuccuggccuuaugca

SEQ ID NO: 162892 - RNA, 64 nt, Homo Sapiens
auguugcaauuacaggcaugguccuccugccuuggccucccaaacaaacuccuggccucaagug

SEQ ID NO: 162893 - RNA, 64 nt, Homo Sapiens
gugcugauaguacaggcaugguuuugaacuccuggccucccaagcacuuugggaggccgaguug

SEQ ID NO: 162894 - RNA, 64 nt, Homo Sapiens
ccgccucccugguucaagugauucuccuaucucagccucccaaguagcugggacuauaggcaca

SEQ ID NO: 162895 - RNA, 64 nt, Homo Sapiens
caaacuccugaccucaggugauccaccugccucagccucccaaagugcugggauuacaggcgug

SEQ ID NO: 162896 - RNA, 64 nt, Homo Sapiens
cucaaacuucugaccucauaauccacccaccuuggccucccaaagugcuaggauuacaggcaug

SEQ ID NO: 162897 - RNA, 64 nt, Homo Sapiens
ugcuauggugacacagcguuucuaggacagaggggccucccagucuccccccaccacccgugca

SEQ ID NO: 162898 - RNA, 64 nt, Homo Sapiens
ggcuuccacccuuguuaaugaugcuccugccucugccucccagccccucacccagcacagcucu

SEQ ID NO: 162899 - RNA, 64 nt, Homo Sapiens
caggcaccaucuccuuguucccccucucucuuuugccucccacugacugcccuuuuccaugugu

SEQ ID NO: 162900 - RNA, 64 nt, Homo Sapiens
ggaggcggcagaggacugggccaagccccaaccugccucccagccaggcuccuccaggccucug

SEQ ID NO: 162901 - RNA, 64 nt, Homo Sapiens
uacaauaguaugaucucggcucacugcaacuucugccucccaguuucaagggauucucgugccu

SEQ ID NO: 162902 - RNA, 64 nt, Homo Sapiens
cugccucccaguuucaagggauucucgugccucagccucccagguagcugguacuacaggcacg

SEQ ID NO: 162903 - RNA, 64 nt, Homo Sapiens
ugaacuuuugagcucgagugauccacccaccucagccucccaaaaugcugggauuacagaugug

SEQ ID NO: 162904 - RNA, 64 nt, Homo Sapiens
gugcugggauuacaggcgugauccacccgccucggccucccaaaagaaccucugaccucaggug

SEQ ID NO: 162905 - RNA, 64 nt, Homo Sapiens
uagcugggauuacaggugccauucuccugccucagccucccaagccaccucucagauucaagca

SEQ ID NO: 162906 - RNA, 64 nt, Homo Sapiens
gugcugggauuacaggcgugauccguccgccuuggccucccaaacucaaacaccugaccuugug

SEQ ID NO: 162907 - RNA, 64 nt, Homo Sapiens
uagcugggauuacaggcgcagcaauucugacucagccucccaagccucugccucccaggaucaa

SEQ ID NO: 162908 - RNA, 64 nt, Homo Sapiens
aucaagcaauucugacucagucagugcaaccucugccucccaggugcaguggugugaucacugc

SEQ ID NO: 162909 - RNA, 64 nt, Homo Sapiens
gugcuggaauuacuggcgugauucgcccgccucggccucccaaacucgaucuccugaccucgug

SEQ ID NO: 162910 - RNA, 64 nt, Homo Sapiens
gcauuaggauuauaggcguguggcuuccaccucagccucccaaacacugcagccugaaacuccu

SEQ ID NO: 162911 - RNA, 64 nt, Homo Sapiens
guacugggauuacaggccugaucuacccuccucggccucccaaaucaacuccagaucucaggug

SEQ ID NO: 162912 - RNA, 64 nt, Homo Sapiens
uucaagcgauucuccucucuucacugcaaccuccgccucccaagugcaguggcacgaucucggc

SEQ ID NO: 162913 - RNA, 64 nt, Homo Sapiens
gugcugggauuacaggcuugauccacccgccucagccucccaaacucgaucuccugaccucgug

SEQ ID NO: 162914 - RNA, 64 nt, Homo Sapiens
uucaagcgauuccuuuuuuuucacugcaaccucugccucccaggugcaguggcgcaauuucagc

SEQ ID NO: 162915 - RNA, 64 nt, Homo Sapiens
guguugggauuacaggcgugauccaccugccuaggccucccaaacucgaucuccugaccucgug

SEQ ID NO: 162916 - RNA, 64 nt, Homo Sapiens
uucaugccguucuccugccuucacugcaagcucugccucccagguucaguggcacaaucucggc

SEQ ID NO: 162917 - RNA, 64 nt, Homo Sapiens
cucgaacuccugaccuugugaucugcccgccucagccucccaaaguacugggauuauaggcaug

SEQ ID NO: 162918 - RNA, 64 nt, Homo Sapiens
cagcuucccuaauagcuaggauuacagguguguggccucccaccccaccccacccuucacaccu

SEQ ID NO: 162919 - RNA, 64 nt, Homo Sapiens
cccgucuccaggggugccccagacccagagauuagccucccacuucggcgcagaaaacaaaagc

SEQ ID NO: 162920 - RNA, 64 nt, Homo Sapiens
guaucuuuaagcugugauguuguauauauacaaugccucccagcuagacuguaagcccuuuggg

SEQ ID NO: 162921 - RNA, 64 nt, Homo Sapiens
cuaccuccuggguucaagggauucuccugccucagccucccaaguagcugggauuacaggcgcc

SEQ ID NO: 162922 - RNA, 64 nt, Homo Sapiens
caaacuccugaccugaggcgaucugcccaccucggccucccaaagugcugggauuacaggcgug

SEQ ID NO: 162923 - RNA, 53 nt, Homo Sapiens
gcaggagugcccgcgacugagccgccucccaccacuccacuccuccagccacc

SEQ ID NO: 162924 - RNA, 64 nt, Homo Sapiens
caccacccacaaucacaagaagauucccaccccugccucccaugccuggucccaagacagugag

SEQ ID NO: 162925 - RNA, 64 nt, Homo Sapiens
cugccucccggguucgcaccauucuccugccucagccucccaauuagcuuggccuacagucauc

SEQ ID NO: 162926 - RNA, 64 nt, Homo Sapiens
cucgaucuccugaccucgugauccgcccaccucggccucccaaagugcugggauuacaggcaug

SEQ ID NO: 162927 - RNA, 64 nt, Homo Sapiens
cucgaucucuugaccucaugaucuacccgccuuggccucccaaagugcugagauuacaggcgug

SEQ ID NO: 162928 - RNA, 64 nt, Homo Sapiens
cagacuccuggguucaagcaauccuccugccucagccucccaaguagcugagacuacaggcacg

SEQ ID NO: 162929 - RNA, 64 nt, Homo Sapiens
ugaacucuuggccucaaguaauccuccugccucagccucccaaaguguugggauugcagauaug

SEQ ID NO: 162930 - RNA, 64 nt, Homo Sapiens
ccucaaccuggguucaagugauccucucaccucagccucccaaguaguugugccuccuaggcac

SEQ ID NO: 162931 - RNA, 64 nt, Homo Sapiens
cgaacaccugggcucaacugauccgccugccucggccucccaaagugcugggauuacaggugug

SEQ ID NO: 162932 - RNA, 64 nt, Homo Sapiens
ugcaguggugcaaucucugcucacugcaacaucugccucccagguccaagcgauucuccugccu

SEQ ID NO: 162933 - RNA, 64 nt, Homo Sapiens
ugaacuccuggccucaagugaucugcccaccucggccucccaaagugcugggauuacagacuug

SEQ ID NO: 162934 - RNA, 64 nt, Homo Sapiens
ccgccucccggguucaagugauucuccugccucagccucccaaguaggugggauuacaggcgcc

SEQ ID NO: 162935 - RNA, 64 nt, Homo Sapiens
cucgaacuccugaccucgugauuggcccaccucagccucccaaagugcugguauuacagaugug

SEQ ID NO: 162936 - RNA, 64 nt, Homo Sapiens
gugcugggauuacaggcgugauccacccgccuccgccucccaaacgaacuccugaccgcaagug

SEQ ID NO: 162937 - RNA, 64 nt, Homo Sapiens
uagcugggaauacaggcacgauuuuccugccucagccucccaagccaccuccuggguucaagug

SEQ ID NO: 162938 - RNA, 64 nt, Homo Sapiens
ugcugggauuacaggcgugaaucugccugccucggccucccaagcgaacuccugaccucaagug

SEQ ID NO: 162939 - RNA, 64 nt, Homo Sapiens
uagcugggauuacagucaggauucuccugccucagccucccaagccgcccccuggguucaagca

SEQ ID NO: 162940 - RNA, 64 nt, Homo Sapiens
gugcugggauuacagaugugaucugcccgccuuggccucccaaacuaacuccugggcuuaagug

SEQ ID NO: 162941 - RNA, 64 nt, Homo Sapiens
gugcugggauuacaggcgugaucuguccaccucggccucccagacgaacuccugaccucaagug

SEQ ID NO: 162942 - RNA, 64 nt, Homo Sapiens
gugcugggauuauaggcaugauccucacgccuuggccucccaaaucuugaacugggcucaagug

SEQ ID NO: 162943 - RNA, 64 nt, Homo Sapiens
gugcugggauuacgggugugauccaccuuucucggccucccaaauuaacuccugaccucaggug

SEQ ID NO: 162944 - RNA, 64 nt, Homo Sapiens
uagcugagauuacaggcgccguucuccugccucagccucccaagccaccuccuggguuccagca

SEQ ID NO: 162945 - RNA, 64 nt, Homo Sapiens
gugcugggauuacaggcaugauccacccaccucggccucccagacuugaacuccugaccuugug

SEQ ID NO: 162946 - RNA, 64 nt, Homo Sapiens
ggaggucaggagucuacacucccuuguccgaguugccucccacuagcggagaaggggccuccca

SEQ ID NO: 162947 - RNA, 64 nt, Homo Sapiens
cuuguccgaguugccucccaggagcggagaaggggccucccaccacucuugggcuuucuuggug

SEQ ID NO: 162948 - RNA, 64 nt, Homo Sapiens
gugcuuggauuacagguguaauccgccugccucggccucccaaaucuugaucuccugacuugug

SEQ ID NO: 162949 - RNA, 64 nt, Homo Sapiens
guggugggaucacaggcgugauccgccugccuuggccucccaaacgagcuccugaccucaggug

SEQ ID NO: 162950 - RNA, 64 nt, Homo Sapiens
gugcugggauuacaggcgugaucugccugucucagccucccaaacacucuccugaccucaagca

SEQ ID NO: 162951 - RNA, 64 nt, Homo Sapiens
uggcugggauuacaggugccacacuccugccucagccucccacgcagccuccuggauucaggca

SEQ ID NO: 162952 - RNA, 64 nt, Homo Sapiens
gugcugggauuacaggugugauccgcccacauuggccucccaaacgaacuccugaccucagaug

SEQ ID NO: 162953 - RNA, 64 nt, Homo Sapiens
uucaagccauucuccugccuucacugcaacuucugccucccaggugcaguggcaugaucucggc

SEQ ID NO: 162954 - RNA, 64 nt, Homo Sapiens
uagcugggauuacaggugcgauucuccugucucagccucccaagcugccuccuagauucaagca

SEQ ID NO: 162955 - RNA, 64 nt, Homo Sapiens
uagcugggauuacaggugccauuuuccugccucagccucccaagccgccucccagauucaagcg

SEQ ID NO: 162956 - RNA, 64 nt, Homo Sapiens
uucaagcgauuuuccugccuucacuacaaccuccgccucccagacgcaguggcaccaucucggc

SEQ ID NO: 162957 - RNA, 64 nt, Homo Sapiens
cgaacuucugaccucagaugaucugcccgccucagccucccaaagugcugggauuacaggcaug

SEQ ID NO: 162958 - RNA, 64 nt, Homo Sapiens
ugaacucccgaccucagguaauccgcccgccucggccucccaaaaugcugggauuagaggugug

SEQ ID NO: 162959 - RNA, 64 nt, Homo Sapiens
ccgccuccuggguucaagugauucuccugccacagccucccaaguagcugggauuacaggugcc

SEQ ID NO: 162960 - RNA, 64 nt, Homo Sapiens
cgaacuccugaccucaguugauccgccugccucagccucccaaagugcugggcuuacaggccug

SEQ ID NO: 162961 - RNA, 64 nt, Homo Sapiens
cuuccuccaggguucaagugauucucccaccucagccucccaaguagcugggacuacgggcaca

SEQ ID NO: 162962 - RNA, 64 nt, Homo Sapiens
caaacuccugaccucaagcgauccacccaccuaggccucccaaagugcugggauuacaggcaug

SEQ ID NO: 162963 - RNA, 64 nt, Homo Sapiens
caaacucccgaccucaggugauccgcccgccugggccucccaaagugcugggauuacaggcgug

SEQ ID NO: 162964 - RNA, 64 nt, Homo Sapiens
gugcugggauuauaggcaugauccgcccaccuuggccucccaaacuugaucuccugaccucaug

SEQ ID NO: 162965 - RNA, 64 nt, Homo Sapiens
uucaugccauucuccugccuucacugcaagcuccgccucccaggugcaauggcgcaaucucagc

SEQ ID NO: 162966 - RNA, 64 nt, Homo Sapiens
gugcuuggaugacaggugcgauccucccaccucagccucccaaauuaacuccuaggcucaagug

SEQ ID NO: 162967 - RNA, 64 nt, Homo Sapiens
uggcugggacuauaggugcaauccuuccaccucagccucccaugcaaucuccugggcucaaaug

SEQ ID NO: 162968 - RNA, 64 nt, Homo Sapiens
cagccuccuggauuuaagugauucuccugccucagccucccaaguagcugggauuacaggugug

SEQ ID NO: 162969 - RNA, 64 nt, Homo Sapiens
cucgaacuccugaccucgugauccgccugccucagccucccaaagugcugggauuacaggugug

SEQ ID NO: 162970 - RNA, 64 nt, Homo Sapiens
cugccuccuggguucaagcaauucucccaccucagccucccaaguagcugggauuacagacgug

SEQ ID NO: 162971 - RNA, 64 nt, Homo Sapiens
ugaacuccugaccucaggugauccuccugccucggccucccaaagugcugggauuacaggcaug

SEQ ID NO: 162972 - RNA, 64 nt, Homo Sapiens
ccgccuccuggguucaggcaauuuuccugccucagccucccaaguagcugggauuacaggcacc

SEQ ID NO: 162973 - RNA, 64 nt, Homo Sapiens
ugaacuccugaccucaggugauccuccugcauuggccucccaaagugcuggaauuccaggcaug

SEQ ID NO: 162974 - RNA, 64 nt, Homo Sapiens
ccaccucgcagguucaagcaauccucccacuucagccucccaagcaccugggauuacaagcaug

SEQ ID NO: 162975 - RNA, 64 nt, Homo Sapiens
ugcaguggcgcgaucucagcucacuacaaccuccgccucccauguucaagcgauucuccugccu

SEQ ID NO: 162976 - RNA, 64 nt, Homo Sapiens
cuccaucucuugaccucgugauccacccgccucagccucccaaagugcugggauuaacagguau

SEQ ID NO: 162977 - RNA, 64 nt, Homo Sapiens
ugcaguggcaucaucucagcucacugcaaccucugccucccagguucaagugcuucuccagccu

SEQ ID NO: 162978 - RNA, 64 nt, Homo Sapiens
cugccucccagguucaagugcuucuccagccucagccucccaaguagcugagacuacaggcaca

SEQ ID NO: 162979 - RNA, 64 nt, Homo Sapiens
uaaaggugcucagagccccauaggugcccagccagccucccagcagcggaaaaagcugagcuca

SEQ ID NO: 162980 - RNA, 64 nt, Homo Sapiens
aagagugcuguggagccacgaugguucagccagggccucccaggcugccuggggguuauucggg

SEQ ID NO: 162981 - RNA, 64 nt, Homo Sapiens
gugcugggauuacuggugugauccuccugccucagccucccaaaugaacuccugaacucaagca

SEQ ID NO: 162982 - RNA, 64 nt, Homo Sapiens
uagcugggacuacaggcaugauccuuccacuucagccucccaagcaacuuccugggcucaagug

SEQ ID NO: 162983 - RNA, 64 nt, Homo Sapiens
gugcugggauuauaggcaugauccacucgccucggccucccaaacgaacuccugaccucaggug

SEQ ID NO: 162984 - RNA, 64 nt, Homo Sapiens
uagcugggauuacaggcgucguucuccugccucagccucccaagcugccuccuggguucaagca

SEQ ID NO: 162985 - RNA, 64 nt, Homo Sapiens
gugcuaugauuacagacgugaucugcccaccucagccucccaaacucgaacuccugaccuugug

SEQ ID NO: 162986 - RNA, 64 nt, Homo Sapiens
uucaagcaauucuccugccuucacugcaaccuccgccucccagguccaguggcacuaucucagc

SEQ ID NO: 162987 - RNA, 64 nt, Homo Sapiens
ugcaguggcgcgaucuuagcucacugcaagcuccgccucccagguucacaccauucuccugccu

SEQ ID NO: 162988 - RNA, 64 nt, Homo Sapiens
caaacuccagggcucaagcaguccucccaccucagccucccaaagugcugggaucacaggcaug

SEQ ID NO: 162989 - RNA, 64 nt, Homo Sapiens
caaacucuugaccucaggugauccacccaccucagccucccaaagugcugggauuacaagcgug

SEQ ID NO: 162990 - RNA, 64 nt, Homo Sapiens
ugaacuccuggccucaagugauucuccugccucagccucccaaagugcugggauuacaggugug

SEQ ID NO: 162991 - RNA, 64 nt, Homo Sapiens
gcuccgccucccggguucacgccauucugcgucagccucccaaguagcugggacuacaggcacc

SEQ ID NO: 162992 - RNA, 64 nt, Homo Sapiens
cuugaucuccugaccgcauaauccacccaccucggccucccaaagugcugggauuacaggcgug

SEQ ID NO: 162993 - RNA, 64 nt, Homo Sapiens
ccaacucccagguucaagugagucucgugccucagccucccaaguagcugggauuacaggcacc

SEQ ID NO: 162994 - RNA, 64 nt, Homo Sapiens
caaacuccugaccucaggugcuccaccugccuuggccucccaaagugcugggauuacaggcgug

SEQ ID NO: 162995 - RNA, 64 nt, Homo Sapiens
accuccugggcucaaaugaucuccucccaccucagccucccaaguagcugagacuacagguuca

SEQ ID NO: 162996 - RNA, 64 nt, Homo Sapiens
ugcaguggcgugaucucagcucacugcaacccccgccucccagguucgagcacuuuucaugccu

SEQ ID NO: 162997 - RNA, 64 nt, Homo Sapiens
caaacuccugaccucaggugauccaccugccucggccucccagagugcugggauuacaggcaug

SEQ ID NO: 162998 - RNA, 64 nt, Homo Sapiens
cgaacuccuguccucagguaauccgcccaccucagccucccaaagugcugggauuacaggcgug

SEQ ID NO: 162999 - RNA, 64 nt, Homo Sapiens
cgaccuccuggguucaagcgauucucccaccccagccucccaaguagcugggauuacaggugug

SEQ ID NO: 163000 - RNA, 64 nt, Homo Sapiens
caaacuccugggcucaagcgauccuccuggcucagccucccaaagugcugggauuacaggcgug

SEQ ID NO: 163001 - RNA, 64 nt, Homo Sapiens
gaccauucuccaccugccagggacagaggggguggccucccaacucaccccagccccaaaacuc

SEQ ID NO: 163002 - RNA, 64 nt, Homo Sapiens
gcccaggcuuagucacugagacagcccgggcucugccucccaucacccgcuaagagggagggag

SEQ ID NO: 163003 - RNA, 64 nt, Homo Sapiens
uguccucccaggcucaagcuauccuugcaccucagccucccaaguagcugggaccacaggcaug

SEQ ID NO: 163004 - RNA, 64 nt, Homo Sapiens
caaacuccugggcucaagugauccucccaucuuggccucccagaguauugggauuacagacaug

SEQ ID NO: 163005 - RNA, 64 nt, Homo Sapiens
gugcagggauuacaggcaugaugcacccaccucagccucccaaacaaacuccugaccucaggug

SEQ ID NO: 163006 - RNA, 64 nt, Homo Sapiens
uucaagagauucuccugccuggcucgcaaccuccgccucccagggagugcaguggugcaaucuu

SEQ ID NO: 163007 - RNA, 64 nt, Homo Sapiens
gugcugggauuacaggcaugauccacccgccucagccucccaaacgaacuccugaccucaggug

SEQ ID NO: 163008 - RNA, 64 nt, Homo Sapiens
cccauccucaacagcuacccgggcugcggcucuggccucccaggcccugccugccccccgggug

SEQ ID NO: 163009 - RNA, 64 nt, Homo Sapiens
ugggcaguggagccauaaacggccuccuccgggagccucccaucuggcaggcucuggcacccug

SEQ ID NO: 163010 - RNA, 64 nt, Homo Sapiens
gugcugggauuacaggcgugauccgccuaccucagccucccaaacaaacuccugaccucaggug

SEQ ID NO: 163011 - RNA, 64 nt, Homo Sapiens
uuccagcaauucuccugccuucacugcaaccucugccucccaggugcaguggugugaucucggc

SEQ ID NO: 163012 - RNA, 64 nt, Homo Sapiens
gugcuggaauuacaggugugauccacccgccuuggccucccaaacgaaugccugaccucaggug

SEQ ID NO: 163013 - RNA, 64 nt, Homo Sapiens
uagcugggauuacaggcacaauucuccugccucagccucccaagcugccuccuggguucaaucc

SEQ ID NO: 163014 - RNA, 64 nt, Homo Sapiens
gugcugggacuacaggugcaauccuccugccuuggccucccaaacaaacuccuagccuugauug

SEQ ID NO: 163015 - RNA, 64 nt, Homo Sapiens
cuccgcagaugagguuccugccucaccucccccugccucccagcgaaggagccaccucucagug

SEQ ID NO: 163016 - RNA, 64 nt, Homo Sapiens
guccaccccagacccuggggagagacagcgugaugccucccacagacaaagagcucucgcaaga

SEQ ID NO: 163017 - RNA, 64 nt, Homo Sapiens
ugcaguggcuugaucuuggcucacugcaaccuccgccucccagguucaagcaauucuccugccu

SEQ ID NO: 163018 - RNA, 64 nt, Homo Sapiens
cgaacuccuggccucaagugaucugcccgccucggccucccaaagugcugggauuacaggcgug

SEQ ID NO: 163019 - RNA, 64 nt, Homo Sapiens
cagcaugccccuacggccaggggacugucugccagccucccaggcccaugcccuccuggugccc

SEQ ID NO: 163020 - RNA, 64 nt, Homo Sapiens
gccucuguuagcugggugggugucaucagccccugccucccaggccagaaccugagaacgggcc

SEQ ID NO: 163021 - RNA, 64 nt, Homo Sapiens
ugcaguggugugaucuuggcucacugcaaccucugccucccagguucaagcaauucuccugccu

SEQ ID NO: 163022 - RNA, 64 nt, Homo Sapiens
cugccucccagguucaagcaauucuccugccucagccucccaaguagcugggacuacaggcaca

SEQ ID NO: 163023 - RNA, 64 nt, Homo Sapiens
cuccaucucuugaccuugugauccacccaccucagccucccaaagugcugggauuacaggcaug

SEQ ID NO: 163024 - RNA, 64 nt, Homo Sapiens
ccaacuccugaccuaaagugaucugcccgccuuggccucccaaagugcugggauuacagacaug

SEQ ID NO: 163025 - RNA, 64 nt, Homo Sapiens
cgugcaauggcgcaguugacucacuacagccucugccucccagguucaagcgauucucaugccu

SEQ ID NO: 163026 - RNA, 64 nt, Homo Sapiens
cugccucccagguucaagcgauucucaugccuuagccucccaaguagcugggauuacaggugug

SEQ ID NO: 163027 - RNA, 64 nt, Homo Sapiens
ugcgaggugaugggggcuggggccccaggcgucagccucccagagggacagcugagcccccugc

SEQ ID NO: 163028 - RNA, 64 nt, Homo Sapiens
caugccugccacccuggcaucggcuuucugugccgccucccacacaaaucagccccagaaggcc

SEQ ID NO: 163029 - RNA, 64 nt, Homo Sapiens
gugcugggauuacaggugugaucugcccgccuuggccucccaaacgaacucuugaccucaggug

SEQ ID NO: 163030 - RNA, 64 nt, Homo Sapiens
gugcugggauuacaggugugauccgcccaccucggccucccaaacgaacuccugaccucaggug

SEQ ID NO: 163031 - RNA, 64 nt, Homo Sapiens
gugcugggauuacaauugugauccaccugucucagccucccagacaaacuccugggcucaggcg

SEQ ID NO: 163032 - RNA, 64 nt, Homo Sapiens
cccaucucucccuccccugcguuccccacugacagccucccaccacugacauucuccacuucuu

SEQ ID NO: 163033 - RNA, 64 nt, Homo Sapiens
gugcugggauuacaagcgugauccacccaccucagccucccaaacaaacuccugaccucaggug

SEQ ID NO: 163034 - RNA, 64 nt, Homo Sapiens
ccccuuguggacuuagacucuaggaggacagcuugccucccaggaaacuccuuggagagacgac

SEQ ID NO: 163035 - RNA, 64 nt, Homo Sapiens
ugaggccacaggacaagcacgccccagcgccagggccucccagcauggugccuugggccccuua

SEQ ID NO: 163036 - RNA, 64 nt, Homo Sapiens
ccaugcccgcuagaaaccugccaguccagcugcugccucccaaccacacuccgaguccuggguc

SEQ ID NO: 163037 - RNA, 64 nt, Homo Sapiens
gugcugggauuacaggugugagccuccugccuuggccucccaaacaaaccccugggcucaagca

SEQ ID NO: 163038 - RNA, 64 nt, Homo Sapiens
uagcugggaccacaggugggauccuccugccucugccucccaagggaccucccaagcucaagca

SEQ ID NO: 163039 - RNA, 64 nt, Homo Sapiens
gugcuaggauuacaggcgugauccaccugccucggccucccaaacgaacuccugaccucaggug

SEQ ID NO: 163040 - RNA, 64 nt, Homo Sapiens
gugcugggauuacacgcgugauccgcccaccuuggccucccaaacgaacuccugaccucaggug

SEQ ID NO: 163041 - RNA, 64 nt, Homo Sapiens
auuaaaccgcaugugaucucaaaugcugcucucagccucccacauuuuuacaccaauuugguaa

SEQ ID NO: 163042 - RNA, 64 nt, Homo Sapiens
gcaccucggggacaccagagcccacccacccgccgccucccacggauguagguguuaggcaugu

SEQ ID NO: 163043 - RNA, 64 nt, Homo Sapiens
ugaauaguuugguuauaguguuuaggcuagaaaugccucccacauugguaauaaacauuacaaa

SEQ ID NO: 163044 - RNA, 64 nt, Homo Sapiens
ggcugggcucaaacuccugaauccgccugccucggccucccaaagugcugggauuacaggugug

SEQ ID NO: 163045 - RNA, 64 nt, Homo Sapiens
ggaacuccuuggcucaagcaauccugcugccuuggccucccaaguauguaggacuacagguacu

SEQ ID NO: 163046 - RNA, 64 nt, Homo Sapiens
caaacuccugggcugaaacaauccucccgccuuggccucccaaagugcugggauuauaggcaca

SEQ ID NO: 163047 - RNA, 64 nt, Homo Sapiens; identical to SEQ ID NO: 162809

SEQ ID NO: 163048 - RNA, 64 nt, Homo Sapiens
uucacaccauucuccugccuucacugcaagcucugccucccaggugcaguggcgcgaucucggc

SEQ ID NO: 163049 - RNA, 64 nt, Homo Sapiens
cugccucccguguucaagcaguucuccugccucagccucccaaauagcugggauuacaguugcc

SEQ ID NO: 163050 - RNA, 64 nt, Homo Sapiens
cgaacuccugaccucaagugauccacccgccuuggccucccaaagugcugggauaauagguguc

SEQ ID NO: 163051 - RNA, 64 nt, Homo Sapiens
ccuagagcgugauucucccaucugaggcaaucuugccucccaggggaaauuuugcaauguuugg

SEQ ID NO: 163052 - RNA, 64 nt, Homo Sapiens
guuagagcagaggaggucccagauaccaaguggcgccucccaggaaaggcugggagaagaggug

SEQ ID NO: 163053 - RNA, 64 nt, Homo Sapiens
ccgccuccugcguucaagugauuguccugucucagccucccaaguagcugggauuacaggcacc

SEQ ID NO: 163054 - RNA, 64 nt, Homo Sapiens
ugaacuccuaaccucaggugauccacccgccucggccucccaaagugcugggauuacaggcccg

SEQ ID NO: 163055 - RNA, 64 nt, Homo Sapiens
gagugcaguggugugacggcucacugcagccugcgccucccagcguccagcaauucuuguuucu

SEQ ID NO: 163056 - RNA, 64 nt, Homo Sapiens
gcgccucccagcguccagcaauucuuguuucucggccucccaaguagcugggacuauaggugcg

SEQ ID NO: 163057 - RNA, 64 nt, Homo Sapiens
ucaccuaccgaguucaagugauuuuccugccuuggccucccaaguagcugggauuacaggugug

SEQ ID NO: 163058 - RNA, 64 nt, Homo Sapiens
aaaacuccugaccucaagugaucugcccaccucagccucccaaagugcugagauuacaggcaug

SEQ ID NO: 163059 - RNA, 64 nt, Homo Sapiens
ugcaguggcaugaucuuggcucacugcagccuccgccucccagguucaagcgauucuccugccu

SEQ ID NO: 163060 - RNA, 64 nt, Homo Sapiens
cucaaacuccugaccucaugauccgccuuccucggccucccaaagugcugggauuacagguguu

SEQ ID NO: 163061 - RNA, 64 nt, Homo Sapiens
ccaacuccugaccucaagugauauguucaccucagccucccaaagugcugggauuacaggcaug

SEQ ID NO: 163062 - RNA, 64 nt, Homo Sapiens
ccgccucccggguucaagcaauucuccugccucagccucccaaguagcugggauuacaggcgug

SEQ ID NO: 163063 - RNA, 64 nt, Homo Sapiens
gaaccucuuggguucaagugauucuugugccucagccucccaaguagcuggaauuacaggcaca

SEQ ID NO: 163064 - RNA, 64 nt, Homo Sapiens
cgaacuccugaccucaggugauccacccaccuuggccucccaaagugcugagauuauaggcaug

SEQ ID NO: 163065 - RNA, 64 nt, Homo Sapiens
ugcaguggcacaaucauggcucacugcagucucugccucccaggcucaagugauccucccaccu

SEQ ID NO: 163066 - RNA, 64 nt, Homo Sapiens
ugaccuccugagcucaagcaguccaucugccucagccucccaaagugcugggacuacagacaug

SEQ ID NO: 163067 - RNA, 64 nt, Homo Sapiens
ccgccucccggguucacgccauucuccugccucagccucccaaguagcugggacuacaggcacc

SEQ ID NO: 163068 - RNA, 64 nt, Homo Sapiens
cucgaucuccugaccucgugauccgcccgccucagccucccaaagugcugggauuacaggcgug

SEQ ID NO: 163069 - RNA, 64 nt, Homo Sapiens
cugccucccggguucaugccauucuccugccucagccucccaaguagcugggacuacaggcgcc

SEQ ID NO: 163070 - RNA, 64 nt, Homo Sapiens
cucgaucuccugaccucgugauccacccgccucggccucccaaagugcugggauuacaggcgug

SEQ ID NO: 163071 - RNA, 64 nt, Homo Sapiens
gugcugggauuacaggcgugauccaccagccucagccucccaaacuugaucuccugaccuugug

SEQ ID NO: 163072 - RNA, 64 nt, Homo Sapiens
uucacgccauucuccugccuucacugcaagcuccgccucccagaugcaguggugggaucucggc

SEQ ID NO: 163073 - RNA, 64 nt, Homo Sapiens
uagcugggauuacaggugugauucuccugcuucagccucccaagccaccuccuggguucaagug

SEQ ID NO: 163074 - RNA, 64 nt, Homo Sapiens
gugcuggaaucacaggggugauccuccauccucggccucccaaaugaacuccuggccuccagug

SEQ ID NO: 163075 - RNA, 64 nt, Homo Sapiens
gugcugggauuacaggugugaucugcccgccuuggccucccaaacuccaucuccugaguuugug

SEQ ID NO: 163076 - RNA, 64 nt, Homo Sapiens
gugcuaggauuccaggcgugacccgcccgccuuggccucccaaacuccugaccucaggugaucc

SEQ ID NO: 163077 - RNA, 64 nt, Homo Sapiens
gugcugggauuauaggcgugauccgcccuccucggccucccaaacuugaucuccugaccucgug

SEQ ID NO: 163078 - RNA, 64 nt, Homo Sapiens
gugcugggauuacaggcgugauccaccugccuuggccucccaaaugaacuccugaccucaggua

SEQ ID NO: 163079 - RNA, 64 nt, Homo Sapiens
ucaaagcaauccugccucagguggcgcaaccucugccucccagguugccuaggcuggagugaaa

SEQ ID NO: 163080 - RNA, 64 nt, Homo Sapiens
uuguucguuuuacuuuuuuuauccacccaccuuggccucccaaauaaacucuugaccucaaaug

SEQ ID NO: 163081 - RNA, 64 nt, Homo Sapiens
gugcugggauuacaggugugaucugccugccucggccucccaaacaaacuccugaccucaggug

SEQ ID NO: 163082 - RNA, 64 nt, Homo Sapiens
aagcugggauuacaggcaugauucuccugccgcagccucccaagccgccucccggauucaagca

SEQ ID NO: 163083 - RNA, 64 nt, Homo Sapiens
gugcuuggauuacaggcauaauccaccugccucagccucccaaacaaacuccugaccucauaug

SEQ ID NO: 163084 - RNA, 64 nt, Homo Sapiens
uagcugggauuacaggcaccauuauccugccucagccucccaagcugccuuccagguucaagca

SEQ ID NO: 163085 - RNA, 64 nt, Homo Sapiens
gugcugggauuacaggcaugauccacccaccucagccucccaaacgaaauccugaccucaaaug

SEQ ID NO: 163086 - RNA, 64 nt, Homo Sapiens
uagcugggacuacaaggugcauucuccuaccucagccucccaaaccgcccccugggaucaagcg

SEQ ID NO: 163087 - RNA, 64 nt, Homo Sapiens
gugcugggauuacaggcaugaucccccugccucggccucccaaacucgauuuccugaccuugug

SEQ ID NO: 163088 - RNA, 64 nt, Homo Sapiens
gugcugggauuacaggcaugauccacccgccucagccucccaaacaaacucccgaccucaggug

SEQ ID NO: 163089 - RNA, 64 nt, Homo Sapiens
uucaggcuauucuccugcucucaccucaaccucugccucccaggugcaguggcgcagucuuggc

SEQ ID NO: 163090 - RNA, 64 nt, Homo Sapiens
augcuggguuuauagaugugguccucccaccuuggccucccagaucaacuccugggcucaagca

SEQ ID NO: 163091 - RNA, 64 nt, Homo Sapiens
gugcugggauuaccggcgugaucugcccaccucggccucccacacucgaucuccugaccucgug

SEQ ID NO: 163092 - RNA, 64 nt, Homo Sapiens
gugcugggauuacuggcaugauccaccugucuuggccucccaaacucgaucuccugaccuuguc

SEQ ID NO: 163093 - RNA, 64 nt, Homo Sapiens
gugcugggauuacagacgugaucugcccgccucugccucccaaacagacuccugggcucaagca

SEQ ID NO: 163094 - RNA, 64 nt, Homo Sapiens
uagcugggacuacaauugugagccucccauuucagccucccaagcaaccugccagguugaagug

SEQ ID NO: 163095 - RNA, 64 nt, Homo Sapiens
ucagccucccaaguagcuggccagguugaagugagccucccauucucacuguagccucaaccug

SEQ ID NO: 163096 - RNA, 64 nt, Homo Sapiens
gugcugggauuacaggcaugauccacccaccuuggccucccaaaugaacgccugaccucagaug

SEQ ID NO: 163097 - RNA, 64 nt, Homo Sapiens
uaccugggacuacaggugugauucucgugcuucagccucccaagccgccuccuggguucaagug

SEQ ID NO: 163098 - RNA, 64 nt, Homo Sapiens
guguuaggauuaggggcaugauccgcccgccucagccucccaaacucgaacuccugaccucgug

SEQ ID NO: 163099 - RNA, 64 nt, Homo Sapiens
uagccaggauuacaggcacgauucuccugccucagccucccaagcugccucccagguucaagca

SEQ ID NO: 163100 - RNA, 64 nt, Homo Sapiens
uucaagcaauucuccugccuucacugcaaccucugccucccaggugcaguggggcaaucucggc

SEQ ID NO: 163101 - RNA, 64 nt, Homo Sapiens
gagcugagauuacgaguacaauucuccuaccucagccucccaaggggccucccagguucaagug

SEQ ID NO: 163102 - RNA, 64 nt, Homo Sapiens
uucaagugauucuccuaccuucacugcaacuugggccucccaggugcaguggugcaaucuuggc

SEQ ID NO: 163103 - RNA, 64 nt, Homo Sapiens
guguugggauuacaggcaugauccgcccaccucagccucccaaacuugaacuccugaccucaug

SEQ ID NO: 163104 - RNA, 64 nt, Homo Sapiens
uucaagcaguucuccugccuucacagcaaccucugccucccaggugcaguggcaugaucuccac

SEQ ID NO: 163105 - RNA, 64 nt, Homo Sapiens
gugcugggauuacaggggugauccacccgccucagccucccaaaccaacuccugagcucaagug

SEQ ID NO: 163106 - RNA, 64 nt, Homo Sapiens
gcagagcuggacgcuguggacugggcuguucccagccucccacacccaguccagggugguagug

SEQ ID NO: 163107 - RNA, 64 nt, Homo Sapiens
guguugggauuacaggugugauccucccgccucagccucccaaaugaacucuugggcucaagug

SEQ ID NO: 163108 - RNA, 64 nt, Homo Sapiens
uagcugggagccugggcaugauccuccugccucagccucccaagugaccucccaggcucaagcg

SEQ ID NO: 163109 - RNA, 64 nt, Homo Sapiens
gcguugggauuauaggcgugauccuccugccucagccucccaaaaaaacuccugggcucaagug

SEQ ID NO: 163110 - RNA, 64 nt, Homo Sapiens
cagcugggaugacagacuugauccucccaccucagccucccaagcgacuucuuaggcucaggug

SEQ ID NO: 163111 - RNA, 64 nt, Homo Sapiens
ggcugggguggacucagaugccaggaaagggacagccucccauugucaggcagaagcugcccaa

SEQ ID NO: 163112 - RNA, 64 nt, Homo Sapiens
uuuauggugcucuguauucuggcauuaugcagcagccucccagaagcucucuucugcuucaaaa

SEQ ID NO: 163113 - RNA, 64 nt, Homo Sapiens
ugcaacggcaugauuuuggcucacugcagccucugccucccaggcucaagcacuuuuccugucu

SEQ ID NO: 163114 - RNA, 64 nt, Homo Sapiens
ugaacuccugaccucaggugauccacccaccugggccucccauagugcugggauucaauuuuuu

SEQ ID NO: 163115 - RNA, 64 nt, Homo Sapiens
cgaacuccugacaucaggugauccaccugccucggccucccaaagugcugggauuacaggugug

SEQ ID NO: 163116 - RNA, 64 nt, Homo Sapiens
caucacucauaucccuuucagaauguuaggaacugccucccacauucuucccugucuuuuuggg

SEQ ID NO: 163117 - RNA, 64 nt, Homo Sapiens
ugcaaucgcgcaaucucggcucacgguaaccucugccucccagguucaagcgagucuccugccu

SEQ ID NO: 163118 - RNA, 64 nt, Homo Sapiens
caaaccccggaccucaggugauccccccaccuuggccucccaaagugccaggauuacaggcaug

SEQ ID NO: 163119 - RNA, 64 nt, Homo Sapiens
ugaacuccugaccucaggugauccacccgccucagccucccacacugcugggauuacaggcaug

SEQ ID NO: 163120 - RNA, 64 nt, Homo Sapiens
ugcaguggcgccaucucggcucacugcaaccuccgccucccagguucaagcaauucuccugccu

SEQ ID NO: 163121 - RNA, 64 nt, Homo Sapiens
ccgccucccagguucaagcaauucuccugccucagccucccagguagcugccacuacaggugcu

SEQ ID NO: 163122 - RNA, 64 nt, Homo Sapiens
cuugaacuccugaccuugugauccacccgccucggccucccaaagugcugggauuacaggcgug

SEQ ID NO: 163123 - RNA, 64 nt, Homo Sapiens
gugcugggauuacaggcaugauccaccugucuuggccucccaaaugaacucccgaccucaggug

SEQ ID NO: 163124 - RNA, 64 nt, Homo Sapiens
caugcuuccuguuaagccugguaaguuuccugaggccucccaguuuucuccuuccaccaugguu

SEQ ID NO: 163125 - RNA, 64 nt, Homo Sapiens
guguugggauuacaggcgugauccacccgccuaggccucccaaacuugaacuccugaccucgug

SEQ ID NO: 163126 - RNA, 64 nt, Homo Sapiens
uagcuggaauuacagggaccauucuccugucucagccucccaagccgccucugggguucaagug

SEQ ID NO: 163127 - RNA, 64 nt, Homo Sapiens
gaagcuggguggggugggugggcugugggcugaggccucccaggccacuuugauuuaauccuuu

SEQ ID NO: 163128 - RNA, 64 nt, Homo Sapiens
gugccugugcuggguggcggaagaguuucaggaggccucccacgccaguucacauucaccccac

SEQ ID NO: 163129 - RNA, 64 nt, Homo Sapiens
gugcuaggauuacaggcaugauuugccugccugggccucccaaacucgaacuccugaccucgug

SEQ ID NO: 163130 - RNA, 64 nt, Homo Sapiens
gugcugggauuacaggugugaucugcccgccucggccucccaaacuugaucuccugagcucgug

SEQ ID NO: 163131 - RNA, 64 nt, Homo Sapiens
uuucugugugcacaguuggccccagccugccccagccucccagccucgccucugcccagccugc

SEQ ID NO: 163132 - RNA, 64 nt, Homo Sapiens
gugcugggauuacaggugugaucugcccaccucagccucccaaaugaacuccugaccucaagug

SEQ ID NO: 163133 - RNA, 64 nt, Homo Sapiens
uucaagcgauucucaugccuucacugcaacguccgccucccaggugcaguggcgcuaucuuggc

SEQ ID NO: 163134 - RNA, 64 nt, Homo Sapiens
aaccucuccagauucaagugauccucccaucucagccucccaaguagcugggacuacaguugug

SEQ ID NO: 163135 - RNA, 64 nt, Homo Sapiens
caaacuccugggcuccaacgaucugcccaccuuggccucccaaagugcugagauuacaggcgug

SEQ ID NO: 163136 - RNA, 64 nt, Homo Sapiens
ccacuucuuggguucaagugauucuccugucucagccucccaaguagcugggauuacaggcaug

SEQ ID NO: 163137 - RNA, 64 nt, Homo Sapiens
ugaacuccugaccucaggugauccacccgccuuggccucccaaagugcugggauuacaggcgug

SEQ ID NO: 163138 - RNA, 64 nt, Homo Sapiens
ccgccuccuggguucaagugauucucccaccucagccucccaaguaggugggauuacagguacu

SEQ ID NO: 163139 - RNA, 64 nt, Homo Sapiens
cgaacuccugaccucagauggucugcccaccuccgccucccaaagugcugggauuacaggcgug

SEQ ID NO: 163140 - RNA, 64 nt, Homo Sapiens
ugccccagggcgaucucagcucacugcaaccuuugccucccaggcucaaucacuucugcugccu

SEQ ID NO: 163141 - RNA, 64 nt, Homo Sapiens
cgaacuguuggccucaagugauccgcccgccucagccucccaaagugcugggauuacaggcguc

SEQ ID NO: 163142 - RNA, 64 nt, Homo Sapiens
guccuccaacaccaagcacagcagccuggggcuggccucccaaaugagccaugagaugauacau

SEQ ID NO: 163143 - RNA, 64 nt, Homo Sapiens
gagauucaagggacccaugaguuggggucuggcagccucccauccagggcccccaucucaugcc

SEQ ID NO: 163144 - RNA, 64 nt, Homo Sapiens
augcugggauuauaggcaugauccuccugcuuuggccucccaaaugaaauccugggcucaagug

SEQ ID NO: 163145 - RNA, 64 nt, Homo Sapiens
uagcugggacuacaggcacaguucucaugccucagccucccaaaggucuuccucucucgcccaa

SEQ ID NO: 163146 - RNA, 64 nt, Homo Sapiens
gugcugagauuacaggugugauccuccugucuuggccucccaaaugaacuccuagacucaagug

SEQ ID NO: 163147 - RNA, 64 nt, Homo Sapiens
gugcugggauuacaggugugacccacccgccuuggccucccaaacuugaacuccugaccucgug

SEQ ID NO: 163148 - RNA, 64 nt, Homo Sapiens
gugcugggauuauaggcaugauccacccaccuuggccucccagccgaacuccugaccucaggug

SEQ ID NO: 163149 - RNA, 64 nt, Homo Sapiens
uagcugggauuacaggcacgauucuccugccucagccucccaaguccaccuccugguucaagcg

SEQ ID NO: 163150 - RNA, 64 nt, Homo Sapiens
ccgccuccugaguucaagcgauucuccugccucagccucccaaguagcugggacugcaggcgcg

SEQ ID NO: 163151 - RNA, 64 nt, Homo Sapiens
aaacuccugacuucaggugauccacccgccuucagccucccaacgugcugggauuacagccgug

SEQ ID NO: 163152 - RNA, 64 nt, Homo Sapiens
ugcaauggcguaaucucggcucagugcaaccucugccucccagguugaagcgauucuccugccu

SEQ ID NO: 163153 - RNA, 64 nt, Homo Sapiens
cugccucccagguugaagcgauucuccugccucagccucccaaguagcugggauuacaggcaug

SEQ ID NO: 163154 - RNA, 64 nt, Homo Sapiens
cucgaugaucugaccucgugaucugcccgccucggccucccaaagugcugggauuacaggccug

SEQ ID NO: 163155 - RNA, 64 nt, Homo Sapiens
ccaccuccugaguucaagcaauucuccugccucagccucccaaguagcugggacuacaggcaug

SEQ ID NO: 163156 - RNA, 64 nt, Homo Sapiens
ugcagugucacgaucucagcucacugcaaccuccgccucccagguacaagagauucuccugccu

SEQ ID NO: 163157 - RNA, 64 nt, Homo Sapiens
ugaacuccuggacucaaucgauccucccaccucugccucccaaguaacugggacuauagcaugc

SEQ ID NO: 163158 - RNA, 64 nt, Homo Sapiens
ugaacuccuggacucaauugauccucccacuucugccucccaaguaacugggacuauagcaugc

SEQ ID NO: 163159 - RNA, 64 nt, Homo Sapiens
gugaaagacugagaugaaugucuuuccucucccugccucccaccagacuuccuccuggaaaacg

SEQ ID NO: 163160 - RNA, 64 nt, Homo Sapiens
caaguucucgcuuccuccuuugggcaucucuucugccucccaaucaaggaagcuccaugcucag

SEQ ID NO: 163161 - RNA, 64 nt, Homo Sapiens
cugccucccguguucaagcgauucuccugccuuggccucccaaguagcugggacuacaggcgcc

SEQ ID NO: 163162 - RNA, 64 nt, Homo Sapiens
cucgaucuccugaccucuugaucugcccaccuuggccucccaaagugcugggauuacaggcgug

SEQ ID NO: 163163 - RNA, 64 nt, Homo Sapiens
ugaagcccccucuuacaacucaggccaagcccccgccucccacucuggccguuaacucagcacc

SEQ ID NO: 163164 - RNA, 64 nt, Homo Sapiens
ggcccaagggaguaggaagcggaugugaaguugggccucccaugcuuugguggguuuccuggau

SEQ ID NO: 163165 - RNA, 64 nt, Homo Sapiens
cuccuggcuccaccagccaaaggugugcacaggggccucccagguuuggggaggugaagcugcc

SEQ ID NO: 163166 - RNA, 64 nt, Homo Sapiens
uugguucugggcccccgccucaggacagccaguggccucccaacaccagacuucucugguccca

SEQ ID NO: 163167 - RNA, 64 nt, Homo Sapiens
gugcugggauuacaggcaugauccgcccgccucggccucccaaacucgaucuccucaccucgug

SEQ ID NO: 163168 - RNA, 64 nt, Homo Sapiens
uucuaggcccgugauacaggcacccauccuauuagccucccacacucuucuaccuccugcaacc

SEQ ID NO: 163169 - RNA, 64 nt, Homo Sapiens
cgaacucuugaccucaagugauccacucgcuucggccucccaaagugcugggauuauaggcgug

SEQ ID NO: 163170 - RNA, 64 nt, Homo Sapiens
cucgaacuccugaccucaugauccuccugccucggccucccaaagugcugggauuauaggcaug

SEQ ID NO: 163171 - RNA, 64 nt, Homo Sapiens
gcucaaaagaccuuaaaggucuguaggguucccugccucccaucuuuccacuguuguaaaaagu

SEQ ID NO: 163172 - RNA, 64 nt, Homo Sapiens
uaaacuccuaaccucaggugauccacccgccuuggccucccaaagugcugggauuacaggugug

SEQ ID NO: 163173 - RNA, 64 nt, Homo Sapiens
aagaccucuauauccuggugccuaagaaacuucugccucccacagacaacuaagugcuuauuca

SEQ ID NO: 163174 - RNA, 64 nt, Homo Sapiens
cgaacuccugaccucaagugauccgccugccucagccucccacagugcugggauuacaggcgug

SEQ ID NO: 163175 - RNA, 64 nt, Homo Sapiens
gugcugggauuacaggugugauucuccugccucagccucccaaacugccuccugacuucaagca

SEQ ID NO: 163176 - RNA, 64 nt, Homo Sapiens
gugcuaggauuacaggcaugauccacccgccucagccucccaaacaaacuccugaccucaguug

SEQ ID NO: 163177 - RNA, 64 nt, Homo Sapiens
guacugggauuacaggcgugaucugcccgccuuggccucccaaacuugaacuccugaccucgug

SEQ ID NO: 163178 - RNA, 64 nt, Homo Sapiens
uucaggcgauucuccugccuucacugcaaccuccgccucccaggugcaguggcgcaaucuuggc

SEQ ID NO: 163179 - RNA, 64 nt, Homo Sapiens
caccucccggguuccagcaaauucuccugccucagccucccaaguagcugggauugcaggcgcc

SEQ ID NO: 163180 - RNA, 64 nt, Homo Sapiens
cgaucuccugaccucaggugauccacccgccucggccucccaaagugcugggaugacaggcgug

SEQ ID NO: 163181 - RNA, 64 nt, Homo Sapiens
caggggccgggcucuccuccaccgcucccccggagccucccaggcagcaauaaggaaauaguuc

SEQ ID NO: 163182 - RNA, 64 nt, Homo Sapiens
cgaacuccugaccucaggugaucugcccgccucggccucccaacgugcccccaguuuuauaaac

SEQ ID NO: 163183 - RNA, 64 nt, Homo Sapiens
gugcugggauuacaggcuugauccaccugccucggccucccaaacgaacuccugaccucaggug

SEQ ID NO: 163184 - RNA, 64 nt, Homo Sapiens
uagcugggauuacaggcaccauucuccugccucagccucccaaguugccucccgggcucaagcg

SEQ ID NO: 163185 - RNA, 64 nt, Homo Sapiens
gggcugcccugccacuuugguacauggccagugugaucccaagugccagucuugugucugcguc

SEQ ID NO: 163186 - RNA, 64 nt, Homo Sapiens
cuguggggccuugguucccuuguguguguguguugaucccaagacaaugaaaguuugcacugua

SEQ ID NO: 163187 - RNA, 64 nt, Homo Sapiens
ucagaugggaguacugcaacgguguuacacgauggaucccaaagagauccuguggaaggcccuu

SEQ ID NO: 163188 - RNA, 64 nt, Homo Sapiens
ucaggugggaguacugcaacgguguuauacaacggaucccaaagggauuguucggcaggcccuu

SEQ ID NO: 163189 - RNA, 64 nt, Homo Sapiens
gcuuccaaaaagagauugcugaaaagaucgcaggaauguggagauuaugcuccaagcauguaaa

SEQ ID NO: 163190 - RNA, 64 nt, Homo Sapiens
cugaaucccuuuuucaacuuaacuaagaagagagaauguggacugaggacuguccugcugggac

SEQ ID NO: 163191 - RNA, 64 nt, Homo Sapiens
auucauacuggagaaaaacccuacaaauguaaagaauguggaaaagcuuuucaccgauacucaa

SEQ ID NO: 163192 - RNA, 64 nt, Homo Sapiens
cauaagaaaauucauacuggggagaaaccccacaaauguggagaaugcggaaaagccuuuaacu

SEQ ID NO: 163193 - RNA, 64 nt, Homo Sapiens
auucauuucagagaaaagcccuauacguguagugaauguggaaaagacuucagauugaauucac

SEQ ID NO: 163194 - RNA, 64 nt, Homo Sapiens
auucacacaggagagaaagcacaugaauguaaugaauguggaaaagcuuucagucaaaccucau

SEQ ID NO: 163195 - RNA, 64 nt, Homo Sapiens
guaagacuuaagcaaagccuuuuucauauuugaaaauguggaaagaaaagauguuccuaaaagg

SEQ ID NO: 163196 - RNA, 64 nt, Homo Sapiens
gaguuacuuuguggaucuuguccaaauuuagugaaauguggaagucaaccagaccaaugaugga

SEQ ID NO: 163197 - RNA, 64 nt, Homo Sapiens
acucauauaagacagaaacccuauggguguaaugaauguggaaaaucauucugugugaagucaa

SEQ ID NO: 163198 - RNA, 64 nt, Homo Sapiens
guguugaguugcaggauaucuagcaauuuaagaaaauguggaaaaaauauuuuuauugagaaau

SEQ ID NO: 163199 - RNA, 64 nt, Homo Sapiens
cuauauuccaguaguaccguuguguguuuucugcaauguggaguugacuuagcuuggcauuuua

SEQ ID NO: 163200 - RNA, 64 nt, Homo Sapiens
uucauaugcauggggucugaucgcaaauacacuaaauguggaguguaggaaccaaaaugaaacc

SEQ ID NO: 163201 - RNA, 64 nt, Homo Sapiens
gcacauggccaugucuugccgcaguuguugggugaauguggagacaaauguggaggcggccagg

SEQ ID NO: 163202 - RNA, 64 nt, Homo Sapiens
cggccagggcaguuguuggggucuucuuagagcaaauguggaggcugggggucauggagaccau

SEQ ID NO: 163203 - RNA, 64 nt, Homo Sapiens
agagugcccugcuuugcaaaauugguuuuggggaaauguggagacaauguggagucucccucug

SEQ ID NO: 163204 - RNA, 64 nt, Homo Sapiens
cucccucugauugguuuugggaggagauggaaacaauguggagucuuugauaauuguuugaggg

SEQ ID NO: 163205 - RNA, 64 nt, Homo Sapiens
aaugauaggugauaggcccacaaggaggacuuacaauguggaacuuagucucuuucccucacuc

SEQ ID NO: 163206 - RNA, 64 nt, Homo Sapiens
cuauugagaauuuacaauuuuuugucauuuuuuuaauguggaguucacguaacuuugaagauag

SEQ ID NO: 163207 - RNA, 64 nt, Homo Sapiens
ucaacuggggagcucacuugagcucuugauaagaaauguggagaaaaguaaaaaccaagcuuug

SEQ ID NO: 163208 - RNA, 64 nt, Homo Sapiens
uuuuggagagcuuaaugggauucugaauauuugcaauguggaguuuccgccccgaucucacguc

SEQ ID NO: 163209 - RNA, 64 nt, Homo Sapiens
caaaauaucacauaagacaugaacuuaaaaauagaauguggauggagacuucugaauuguaaau

SEQ ID NO: 163210 - RNA, 64 nt, Homo Sapiens
ggaguagugcucagcauuugggccaagauugaaaaauguggaucgaauagccauaagaaaacca

SEQ ID NO: 163211 - RNA, 64 nt, Homo Sapiens
guaaaacccaccucucucauacuaagaaaaggaaaauguggauaccuuugagauaauacguuac

SEQ ID NO: 163212 - RNA, 64 nt, Homo Sapiens
uaugaaaauucaagaaccuauaauagccaccaagaauguggacauugaauuuauuuuaaaauuu

SEQ ID NO: 163213 - RNA, 64 nt, Homo Sapiens
ugcuagaauuggauauguccacuaaguuauuaaaaauguggauggacaggggaccuugaaaauc

SEQ ID NO: 163214 - RNA, 64 nt, Homo Sapiens
ggggaccuugaaaaucacuauaacuuauuuuuuuaauguggacaaagccaguuugaauauuaug

SEQ ID NO: 163215 - RNA, 64 nt, Homo Sapiens
agucuaucaagaaggaaauggccgcauuccccccaauguggagauauuaugaccagugugucug

SEQ ID NO: 163216 - RNA, 64 nt, Homo Sapiens
uaauucuugauauugcuaaaacaacaacuaugcaaauguggaauagugccuggaggaccaaaca

SEQ ID NO: 163217 - RNA, 64 nt, Homo Sapiens
agcgccuuuuccagaaaguucccauugcucaauaaauguggaucaucagagacauuuaugaaca

SEQ ID NO: 163218 - RNA, 64 nt, Homo Sapiens
uaugaacaaugacagaagaaaaauuacccaaauaaauguggaagcaagcaaaagagaacagugu

SEQ ID NO: 163219 - RNA, 64 nt, Homo Sapiens
ugacuuugcugaauucucaaacccugcaucagggaauguggaaaaugaauucacaguggagaag

SEQ ID NO: 163220 - RNA, 64 nt, Homo Sapiens
caacuuuguaucucaggucuccuaugaauguaaaaauguggaagaaaacucacuggggagaaac

SEQ ID NO: 163221 - RNA, 64 nt, Homo Sapiens
acccuucaguuuccuuacagcuaugaauguaaagaauguggaaaauucauacuggagagaaacc

SEQ ID NO: 163222 - RNA, 64 nt, Homo Sapiens
agcauuuagauacuacuacucuuugaguguaaaaaauguggaaaacucacacuggagauaaacc

SEQ ID NO: 163223 - RNA, 64 nt, Homo Sapiens
aaccuacauaucuucuguagcuaugaauguaaacaauguggaaaaaucacacuguacagaaacg

SEQ ID NO: 163224 - RNA, 64 nt, Homo Sapiens
agcauuccgauaccaccaaucuuuaaguguaaagaauguggaaaacucacacuggagauaaacc

SEQ ID NO: 163225 - RNA, 64 nt, Homo Sapiens
cugggcacagagcugccaucacucugccuuauguaauguggauguguugcaggaggcaugguga

SEQ ID NO: 163226 - RNA, 64 nt, Homo Sapiens
ggcuuugagauacaguucagauuugaaugaagacaauguggaauuggauuuaucccacugaaca

SEQ ID NO: 163227 - RNA, 64 nt, Homo Sapiens
accuuuagcaaacuaucaaccaugcuaucaaauaaauguggaacgaaaguaaaauuguuccgaa

SEQ ID NO: 163228 - RNA, 64 nt, Homo Sapiens
uguuuugagcaauaauuucugaauaaacuauauuaauguggagaucugucaaugaaaauacguu

SEQ ID NO: 163229 - RNA, 64 nt, Homo Sapiens
aaaauucauuaccauaaucacaaucacugcgcaaaauguggaggguauggaugaucaugacaaa

SEQ ID NO: 163230 - RNA, 64 nt, Homo Sapiens
uguuuuagacaacucuauuuuguucagauggugaaauguggaaaaauaacucaguggaaaauga

SEQ ID NO: 163231 - RNA, 64 nt, Homo Sapiens
auaauccauuuaggugcugaguuacggucccaucucuucacaggcauggauucuaaucccacug

SEQ ID NO: 163232 - RNA, 64 nt, Homo Sapiens
gguuauugcaaugagggccuugaacaagucauuuucuucacauucucaucuguaaaauggagau

SEQ ID NO: 163233 - RNA, 64 nt, Homo Sapiens
uugcugucuagugcauucaaaggucacuuuuuguucuucacagaucuuuuuaauguucuuuccc

SEQ ID NO: 163234 - RNA, 64 nt, Homo Sapiens
ccugcugucggcguuugaccuuccacgugacaguucuucacaauuccuuucaucauuuuuuaaa

SEQ ID NO: 163235 - RNA, 64 nt, Homo Sapiens
uuaguucguaccuggcuugaaauuuuguaucaccucuucacaauucucucuuacugcuucaugu

SEQ ID NO: 163236 - RNA, 64 nt, Homo Sapiens
gaaggaagaaaagaaggaguguggguccacacggucuucacaaauccauguucaccaagauuug

SEQ ID NO: 163237 - RNA, 64 nt, Homo Sapiens
cugcacugcccagugggccacugccuucaggucuucuucacagcaauaagcacccccaccccau

SEQ ID NO: 163238 - RNA, 64 nt, Homo Sapiens
uucgcaacacaacaaucagauggccaagcccuugucuucacaaaacuucccaacagcagggcuu

SEQ ID NO: 163239 - RNA, 64 nt, Homo Sapiens
aauuuauaucuaauuauuuccacuugcccuguucucuucacaccaaggaagcuccagauccagu

SEQ ID NO: 163240 - RNA, 64 nt, Homo Sapiens
uuugacuuucaaaauauauuuuguauuguuaauaucuucacauugugugaauacuggaagcugc

SEQ ID NO: 163241 - RNA, 64 nt, Homo Sapiens
aaccaguuuuauccaucuuaaaacgccaggcaccucuucacaggugguaaacauuuaggggaag

SEQ ID NO: 163242 - RNA, 64 nt, Homo Sapiens
ccuuccaguagcaagcugguagagcuguacuuuuucuucacagcuuuuaccaugguuuauaauu

SEQ ID NO: 163243 - RNA, 64 nt, Homo Sapiens
cauauguguguauguguguauuauguguuuauguucuucacaugacuguacagagccuuuggcu

SEQ ID NO: 163244 - RNA, 64 nt, Homo Sapiens
gggcaccaggaacaccgucuagggugggcugcccucuucacaugaacggggcaggcccuaggug

SEQ ID NO: 163245 - RNA, 64 nt, Homo Sapiens
gcugccuugucccuggugagggcaagggucacugucuucacagaaaaaguuugcugacuuguga

SEQ ID NO: 163246 - RNA, 64 nt, Homo Sapiens
auauuuugaucagauggacucaugaucacagaugucuucacaugccuaugacuaauuuguacac

SEQ ID NO: 163247 - RNA, 64 nt, Homo Sapiens
aaagcaggaugaagaccuagacuuaccugaaggaucuucacaggaggauaaagacguagaauua

SEQ ID NO: 163248 - RNA, 64 nt, Homo Sapiens
acaggaggauaaagacguagaauuaccugaaggaucuucacaggaggaugaagaccuagagaaa

SEQ ID NO: 163249 - RNA, 64 nt, Homo Sapiens
aggaugaagaccuagacucagguuaucugaaggaucuucacaagacaggaggaugaagaccuag

SEQ ID NO: 163250 - RNA, 64 nt, Homo Sapiens
aggaugaagaccuaggguuaaauuaccugaaggaucuucacaggaaagcaggaugaagaccuac

SEQ ID NO: 163251 - RNA, 64 nt, Homo Sapiens; identical to SEQ ID NO: 84879

SEQ ID NO: 163252 - RNA, 56 nt, Homo Sapiens; identical to SEQ ID NO: 84880

SEQ ID NO: 163253 - RNA, 64 nt, Homo Sapiens; identical to SEQ ID NO: 84881

SEQ ID NO: 163254 - RNA, 64 nt, Homo Sapiens; identical to SEQ ID NO: 84882

SEQ ID NO: 163255 - RNA, 64 nt, Homo Sapiens; identical to SEQ ID NO: 84883

SEQ ID NO: 163256 - RNA, 64 nt, Homo Sapiens; identical to SEQ ID NO: 84884

SEQ ID NO: 163257 - RNA, 64 nt, Homo Sapiens; identical to SEQ ID NO: 84885

SEQ ID NO: 163258 - RNA, 64 nt, Homo Sapiens; identical to SEQ ID NO: 84886

SEQ ID NO: 163259 - RNA, 64 nt, Homo Sapiens; identical to SEQ ID NO: 84887

SEQ ID NO: 163260 - RNA, 64 nt, Homo Sapiens; identical to SEQ ID NO: 84888

SEQ ID NO: 163261 - RNA, 64 nt, Homo Sapiens; identical to SEQ ID NO: 84889

SEQ ID NO: 163262 - RNA, 64 nt, Homo Sapiens
auuaauuuuuaacuuauguguaucuuuguuaucacuaagugauauuuuuuccauguaaaucaac

SEQ ID NO: 163263 - RNA, 64 nt, Homo Sapiens
cugugggcauuuuagccuguaguuugcagugguucuaagugaauauuuuuuaauuucacugcca

SEQ ID NO: 163264 - RNA, 64 nt, Homo Sapiens
aaaagacuuggccaggagaacuaauauaaaaaugcuaagugaaagguggggaugauaagaaaug

SEQ ID NO: 163265 - RNA, 64 nt, Homo Sapiens
uugcucucuuccaaucuaaaaguuuuaguuuuuccuaagugauuuuuguaccagccuuuuaaaa

SEQ ID NO: 163266 - RNA, 64 nt, Homo Sapiens
caguuuucucaucuguaaaaucaggaagauuggacuaagugauccugaaauguauuuuuuagca

SEQ ID NO: 163267 - RNA, 64 nt, Homo Sapiens
ucugggcaaccugguuuuccaaauaucauuugaccuaagugaauguugauacuagcuaaagauu

SEQ ID NO: 163268 - RNA, 64 nt, Homo Sapiens
aacccuuauuguccuggguggaccaauccaaaggcuaagugauagugacucaucaauguugggu

SEQ ID NO: 163269 - RNA, 64 nt, Homo Sapiens
cacguccuggagcccgaguggaccaaucggaagccuaagugacgaugacccucgcauguccuag

SEQ ID NO: 163270 - RNA, 64 nt, Homo Sapiens
aagcugaugggcgaggaggcccuggcggggggcgacaagucagacccgaaccuuaauaaccccg

SEQ ID NO: 163271 - RNA, 64 nt, Homo Sapiens
uauuucuagauucuccuuuguacagagucacuucacaagucaagcuacuguuuuacaggugcuc

SEQ ID NO: 163272 - RNA, 64 nt, Homo Sapiens
agaaguccauauacugaagaagcuuuucuaugacacaagucauaagcaauaggcagaggaaaau

SEQ ID NO: 163273 - RNA, 64 nt, Homo Sapiens
aaugaagauuuugcagcacuagauaauuuaucucacaagucaaaaauaugaaaguauuguuuau

SEQ ID NO: 163274 - RNA, 64 nt, Homo Sapiens
uggaacagacucaaagaacauaagagguaucauuacaagucaccagugguggacuuuaaaaccg

SEQ ID NO: 163275 - RNA, 64 nt, Homo Sapiens
uuuuuuguuccccaaaucuuauagagagauuuuuacaagucagaaaugccacaaaauaagggcu

SEQ ID NO: 163276 - RNA, 64 nt, Homo Sapiens
cuggcucagugcaauacuccgacacguccccguucccccgaaaccugucccccuacgccauccc

SEQ ID NO: 163277 - RNA, 64 nt, Homo Sapiens
cgcugcccaccccgcugagguucugcuccggcugcccccgaagggacccagagccgagcuccac

SEQ ID NO: 163278 - RNA, 64 nt, Homo Sapiens
aaaggacuggccuuuccagaaaacgcuuuggaucugagcagaguagucaguuucucagacacuc

SEQ ID NO: 163279 - RNA, 64 nt, Homo Sapiens
agcugccccccaucaccacgccaucacaccccucugagcagaagcaaaucugaggcugaagaau

SEQ ID NO: 163280 - RNA, 64 nt, Homo Sapiens
aaauacucaacuaaaugcaccauauuggaaauuaugagcagaacaacacagggaaggucuggua

SEQ ID NO: 163281 - RNA, 64 nt, Homo Sapiens
cacagaggggaucacugugccuggcagccucggcugagcagaugagggagguuuauucagaucg

SEQ ID NO: 163282 - RNA, 64 nt, Homo Sapiens
caaaugacuaucaguggcaaaaaagaacaaaaucugagcagagaugauuuugaaccagauauuu

SEQ ID NO: 163283 - RNA, 64 nt, Homo Sapiens
agaaucgcuugaacccuggagauggagguugcagugagcagagaucgcaccacugcacuccagc

SEQ ID NO: 163284 - RNA, 64 nt, Homo Sapiens
ggcaacucgcaaagaugagauggaagaaggcacgugagcagaggaggcagcucccaaagagagg

SEQ ID NO: 163285 - RNA, 64 nt, Homo Sapiens
uugaaaacaacuuugguacacaaaggcagcuuugugagcagagcuccuuccccucuccccggga

SEQ ID NO: 163286 - RNA, 64 nt, Homo Sapiens
acacaccuucccugagcuuacaucacugcccuuuugagcagaaagucuaaauuccuuccaagac

SEQ ID NO: 163287 - RNA, 64 nt, Homo Sapiens
uuguggaacucacugccucaguuuggguaaaggaugagcagacaagucaacuaaagaaaaaaga

SEQ ID NO: 163288 - RNA, 64 nt, Homo Sapiens
agaagccccagggcggagcuggacucccccuaccugagcagagcgcggccacagcuccguggaa

SEQ ID NO: 163289 - RNA, 64 nt, Homo Sapiens
ccauccaggacacuccacacugccagcagggggcugagcagagcagugucuguggggguuucuc

SEQ ID NO: 163290 - RNA, 64 nt, Homo Sapiens
aauccaccagugcaaaacagucucccugugcgccugagcagauccggcggguccugcugugcca

SEQ ID NO: 163291 - RNA, 64 nt, Homo Sapiens
gcaccguggugguggcucuguccucccuccccagugagcagaaggccccgaccaguggggacac

SEQ ID NO: 163292 - RNA, 64 nt, Homo Sapiens
ucagagccaaauacucuuugugcaagugccuuccugagcagaagaacuggagaaagggaaccac

SEQ ID NO: 163293 - RNA, 64 nt, Homo Sapiens
ggagaaagggaaccacagagccaggaggaaugucugagcagagucaagcaacuggcuugaccac

SEQ ID NO: 163294 - RNA, 64 nt, Homo Sapiens
uuaaguggacaggcccacaagaugaccuugcaugugagcagauggcagagaugggugugugagg

SEQ ID NO: 163295 - RNA, 64 nt, Homo Sapiens
gggagagggguggggagcgagucacugccuccucugagcagagauucagaguaggaucacauga

SEQ ID NO: 163296 - RNA, 64 nt, Homo Sapiens
ggccuaaccaggaucaggcaacuggguguggagcugagcagagacucuucgcaggggcugaugc

SEQ ID NO: 163297 - RNA, 64 nt, Homo Sapiens
uaauuaaugucuguuauguuaggagaggugagaaugagcagauucccauuaaugauuuuguuuc

SEQ ID NO: 163298 - RNA, 64 nt, Homo Sapiens
ucaacuaucuagcuugugugccuuauaaaccugaugagcagauccugaggcauuugugagucuu

SEQ ID NO: 163299 - RNA, 64 nt, Homo Sapiens
cuagaaguaucaucuggauuacugucauaaagcaugagcagaggucuaugucuuguccugauuc

SEQ ID NO: 163300 - RNA, 64 nt, Homo Sapiens
gugcgagggccgggagacagauacuuggcugugaugagcagacauccucuguccccguggaggg

SEQ ID NO: 163301 - RNA, 64 nt, Homo Sapiens
ucacaccaaagaugaggguagcgagcaacuggcuugagcagacagaacggggaagacuccacuc

SEQ ID NO: 163302 - RNA, 64 nt, Homo Sapiens
uagaaguguuggcacgcacagccauggacccagcugagcagagcagacgcuuugcaggcugccc

SEQ ID NO: 163303 - RNA, 64 nt, Homo Sapiens
gagagagagucuaggagcaaacacaucaccacccugagcagauacaggaguggggagggggcug

SEQ ID NO: 163304 - RNA, 64 nt, Homo Sapiens
auuccccuaguugaguagccguaucagucuuucuugagcagaugcuuagacagcagggcucucu

SEQ ID NO: 163305 - RNA, 64 nt, Homo Sapiens
gcagcagcagcagguaccagucacuguaugccucugagcagagauaaaaggaacaaagggaugu

SEQ ID NO: 163306 - RNA, 64 nt, Homo Sapiens
uccugccuguacugaaguucacagcccaccugacugagcagacucuuccuguuccuuucucuac

SEQ ID NO: 163307 - RNA, 64 nt, Homo Sapiens
guuuaacacagcagaguacagaagggugaagaagugagcagaggcuuaugaagauauucagaua

SEQ ID NO: 163308 - RNA, 64 nt, Homo Sapiens
ggugggaucugugcccagagacugagcagacuggugagcagacuagugcacccacucugcuuug

SEQ ID NO: 163309 - RNA, 64 nt, Homo Sapiens
ggugagcagacuggugggaucacucugcuuugacugagcagacucacguccaccccagugcacc

SEQ ID NO: 163310 - RNA, 64 nt, Homo Sapiens
ggcuaaaaugugaacguggguuuuuuguuuguuuugagcagacaccacagccccucaaagacuu

SEQ ID NO: 163311 - RNA, 64 nt, Homo Sapiens
gggacucuguccaacaagccgcugggguaguuggugagcagagcuguucacagucucuggaaaa

SEQ ID NO: 163312 - RNA, 64 nt, Homo Sapiens
uggguagcugauaagccagugccagcauccagcaugagcagaugucggggagacugggaagucu

SEQ ID NO: 163313 - RNA, 64 nt, Homo Sapiens
ucccuucaugauaagccagugccagcauccagcgugagcagacgucggggagacugggaagucu

SEQ ID NO: 163314 - RNA, 64 nt, Homo Sapiens
aaaauauuauuaaugcucucagcucagccugucaugagcagaggcccaccccauuuacagggug

SEQ ID NO: 163315 - RNA, 64 nt, Homo Sapiens
acuccacaaauggaaauuuaaggccagaaacuucugagcagauauauuuuauggagggaaaaua

SEQ ID NO: 163316 - RNA, 64 nt, Homo Sapiens
gggcagcccucgcaugcuggggucgggccagcucuccccgaaaggucuugaccugaaugauggc

SEQ ID NO: 163317 - RNA, 64 nt, Homo Sapiens
uuauccugcagaaaaucaagcccugacucugcacuccccgaaguagugauguuaauuaacaacu

SEQ ID NO: 163318 - RNA, 64 nt, Homo Sapiens
cugagaggccccugccggugggugauggauaucauccccgaacaggugaagggacaacugacua

SEQ ID NO: 163319 - RNA, 64 nt, Homo Sapiens
gacagcauucggcguauaccuaaggagaguuuuuuccccgaacugacagcaacgauuccaacca

SEQ ID NO: 163320 - RNA, 64 nt, Homo Sapiens
ucugaaucccuccuauucaccuugcugcuguuauuccccgaaugcgcaacauaccccccaucaa

SEQ ID NO: 163321 - RNA, 64 nt, Homo Sapiens
uggggacugcaccagaaagugucuaaccuuguguuccccgaaauccuuucucugacuuaggaac

SEQ ID NO: 163322 - RNA, 64 nt, Homo Sapiens
gccccccugcggggaggagguggagcagcgggcguccccgaagugagggccaggcccuucccgg

SEQ ID NO: 163323 - RNA, 64 nt, Homo Sapiens
uaccagcucagcucgagucucccucgucaccuacuccccgaaguaccccaccugcccaggcagc

SEQ ID NO: 163324 - RNA, 64 nt, Homo Sapiens
ugugggcucuaggacugacuggguucuuccucccuccccgaagcccagacaguucaguugggcu

SEQ ID NO: 163325 - RNA, 64 nt, Homo Sapiens
gguggacuuagaaagcaggggcuacaagagggaauccccgaaggugcuggaggugggagcagga

SEQ ID NO: 163326 - RNA, 64 nt, Homo Sapiens
accuuuucuaugccaaaacaucuguuauuuccuauccccgaauugaauuaaaucaguaaagcaa

SEQ ID NO: 163327 - RNA, 64 nt, Homo Sapiens
gaaacugaccugugauauuuuacuugaauuugucuccccgaaagggacacaauguggcaugacu

SEQ ID NO: 163328 - RNA, 64 nt, Homo Sapiens
ccgcucucuucccucuucgccaucccaugguuucuccccgaaagaagagcucugcacagggacc

SEQ ID NO: 163329 - RNA, 64 nt, Homo Sapiens
acaaguuuuagaaaaucuuaaaaagaggucuuucuccccgaaauacuaauugggauuauuuuuu

SEQ ID NO: 163330 - RNA, 64 nt, Homo Sapiens
ugagggaaggugagggagugcucccaaccugauuuccccgaaucucugucaaugaugcacuaac

SEQ ID NO: 163331 - RNA, 64 nt, Homo Sapiens
ccagacauccccagacuccacagauguaaugaaguccccgaauguaucuguuucuaaggagccu

SEQ ID NO: 163332 - RNA, 64 nt, Homo Sapiens
ggauuggacaucaccgaggaacagcgggauugccuccccgaaugccucccugggaggcacacug

SEQ ID NO: 163333 - RNA, 64 nt, Homo Sapiens
agugacaucugaugcuugcugugaacuuuuaagauccccgaauccugagcaccucaaucuuuaa

SEQ ID NO: 163334 - RNA, 64 nt, Homo Sapiens
ucaauaaaccagugaacagucuuggggaaggaucuccccgaaucccuuucacacuguggugucu

SEQ ID NO: 163335 - RNA, 64 nt, Homo Sapiens
uggccugcccggccuuugggccagggccccagacuccccgaagugaggccaggugaaugggagg

SEQ ID NO: 163336 - RNA, 64 nt, Homo Sapiens
cccaagccugucaguggcccucccuggugcacuguccccgaaaccccugcuugggaagggaagc

SEQ ID NO: 163337 - RNA, 64 nt, Homo Sapiens
cacuccuuccccaaguaauugugucaguuuuuccuccccgaagaauuucgggagccuugucagu

SEQ ID NO: 163338 - RNA, 64 nt, Homo Sapiens
augugugaucucgucuuccagcgugccgcucaguuccccgaauccgugugcacacgugugaucu

SEQ ID NO: 163339 - RNA, 64 nt, Homo Sapiens
ucugggaccagguccaggugccaggcugagggcuuccccgaaagcaacgggggugccaggagcc

SEQ ID NO: 163340 - RNA, 64 nt, Homo Sapiens
uagcagcagugcaugggcgcuggucuagcugggguccccgaaguccuugcucccgcuccugcgg

SEQ ID NO: 163341 - RNA, 64 nt, Homo Sapiens
cuccuauaaagcuuagcugcacguucaaucagaauccccgaaaccauuuauacuauuauuuguu

SEQ ID NO: 163342 - RNA, 64 nt, Homo Sapiens
uucaugauaucuaguccauucuaaccaaaguaucuccccgaaguggacacuuaauggaaccaag

SEQ ID NO: 163343 - RNA, 64 nt, Homo Sapiens
aggcuacucuccucggccccccccgugccccgccuccccgaaacggggcuucuccugacccagu

SEQ ID NO: 163344 - RNA, 64 nt, Homo Sapiens
aacucugaugcucugcgugggaccaugccugaacuccccgaauaacugaaaaauggcugaauau

SEQ ID NO: 163345 - RNA, 64 nt, Homo Sapiens
cucuccuggaccuguggcgacaggucccucauuguccccgaagcaacaggguguucccagaagg

SEQ ID NO: 163346 - RNA, 64 nt, Homo Sapiens
guaugcauucacauugaguguggcucauuuucuuuccccgaacgccaugacuguucagaagcac

SEQ ID NO: 163347 - RNA, 64 nt, Homo Sapiens
gucagccccgacuuccugacuccugcugaacguuuccccgaagacgacacagacguuaggcauu

SEQ ID NO: 163348 - RNA, 64 nt, Homo Sapiens
cauccuucuuccacugucucauccacauaagcacuccccgaagaauuaaggggguucuguuuuc

SEQ ID NO: 163349 - RNA, 64 nt, Homo Sapiens
acacagacaguuucugacagauacuccauauucuuccccgaaucaauaauggaaugcuacuaag

SEQ ID NO: 163350 - RNA, 64 nt, Homo Sapiens
ugcagcacaggaggcuccgugagcccuugguuccuccccgaaaacccccagcauuacgaucccc

SEQ ID NO: 163351 - RNA, 64 nt, Homo Sapiens
ugcuacaaguguuuuagauguuacuaccuuauuuuccccgaauucuauuuuuguccuugcagac

SEQ ID NO: 163352 - RNA, 64 nt, Homo Sapiens
gcugcagaagaagcugaaggcugacuuuguccccuccccgaaaaaggguguuuugaugccucag

SEQ ID NO: 163353 - RNA, 64 nt, Homo Sapiens
ccagcggcgcggagcuguaaccccuaccccugccuccccgaagccucccuggggccccuucagg

SEQ ID NO: 163354 - RNA, 64 nt, Homo Sapiens
uaccagcccuacaccauucccauggcuucaccuguccccgaaacauugugggcucuggaaacca

SEQ ID NO: 163355 - RNA, 64 nt, Homo Sapiens
ugcccucggaggcagcaggugccugugaggauucuccccgaaggcuggccuggggagggcuugg

SEQ ID NO: 163356 - RNA, 64 nt, Homo Sapiens
aggccucuguggcggccaggucccugacucaacuuccccgaaggugccaaggaagcuggaggaa

SEQ ID NO: 163357 - RNA, 64 nt, Homo Sapiens
cauuguugccaggggugaggccgugccccaggccuccccgaaaccaaaggggaaggcaggggug

SEQ ID NO: 163358 - RNA, 64 nt, Homo Sapiens
uuuaucuugaccauaauuugucauucuuuuauaauccccgaaguuaaaucuugcuguuauggug

SEQ ID NO: 163359 - RNA, 64 nt, Homo Sapiens
ggccagccaagcccugccgaucagacaugugggcuccccgaagcccagccagagacugccgugc

SEQ ID NO: 163360 - RNA, 64 nt, Homo Sapiens
cccguguauggccccccugcaccuccuugucucauccccgaagauccgucccccuggccccuca

SEQ ID NO: 163361 - RNA, 64 nt, Homo Sapiens
gggaggcgucuccaaggaggugacacuuaagccauccccgaaagaggugaaagagaucacuuug

SEQ ID NO: 163362 - RNA, 64 nt, Homo Sapiens
ucagccaccgugucacucugccucgcucccccuguccccgaaucccuggccuaccacucacugg

SEQ ID NO: 163363 - RNA, 64 nt, Homo Sapiens
ugucgccagggugacccaaccauggagaucacccuccccgaagcucccuacccugacucaccgc

SEQ ID NO: 163364 - RNA, 64 nt, Homo Sapiens
gcuuggagacccacaaagagagugcgcccugcacuccccgaacccgaguccgcgcugggggagc

SEQ ID NO: 163365 - RNA, 64 nt, Homo Sapiens
guuuucauugagcauuucucuauuuuuccaguuauccccgaaauuucuauguauuauauuuuuu

SEQ ID NO: 163366 - RNA, 64 nt, Homo Sapiens
uggugggcuugaccuccugggugugcacagcagauccccgaaauagggauuaagaaggaacccg

SEQ ID NO: 163367 - RNA, 64 nt, Homo Sapiens
gggcgagggcuugcucuggacucagucugucaaguccccgaagcuuccugcagcuccaccuugu

SEQ ID NO: 163368 - RNA, 64 nt, Homo Sapiens
ugggguguccaggcggaacacggcacaccauugcuccccgaaaccgacguaccccagugcgccu

SEQ ID NO: 163369 - RNA, 64 nt, Homo Sapiens
ggcuguaggaucccccuugaugcaagagguaggcuccccgaaagacccuggaaagucccugcca

SEQ ID NO: 163370 - RNA, 64 nt, Homo Sapiens
ccuggcaacaggcucagugggggucagguccagguccccgaagaggugcuggagaggaaagcag

SEQ ID NO: 163371 - RNA, 64 nt, Homo Sapiens
gcccagaaacuucucugcagugaaucuagagucuuccccgaaaagcaucauaacuuuacagaau

SEQ ID NO: 163372 - RNA, 64 nt, Homo Sapiens
gaauuuucuuacaaaagccugaacaaagaaaauguccccgaaaccucagggccagagaaaguca

SEQ ID NO: 163373 - RNA, 64 nt, Homo Sapiens
cuuuuguucgcauggucacauuaaaaauagacacuccccgaagucucgaaacacagaaaccuuu

SEQ ID NO: 163374 - RNA, 64 nt, Homo Sapiens
guucccagugggcuuagagggaggaccugaugacugauuccaggauacuuguacuucuaauaac

SEQ ID NO: 163375 - RNA, 64 nt, Homo Sapiens
gagcauaacaacgaaaggcauccagcugacuuuuugauuccaagauuauugauuggauugacuu

SEQ ID NO: 163376 - RNA, 64 nt, Homo Sapiens
aaguaaauaaauaaauagcaaccaguacuccaggugauuccagcauaacuuauccaugguuugu

SEQ ID NO: 163377 - RNA, 64 nt, Homo Sapiens
ugacuuguccaggggcagacaccaaaugggaaucugauuccaguggaugucucuuuucagugca

SEQ ID NO: 163378 - RNA, 64 nt, Homo Sapiens
caaauuguuuucuuccuucuuguaaggaaguaacugauuccaggaugcagauuguugggaaauc

SEQ ID NO: 163379 - RNA, 64 nt, Homo Sapiens
cguaaauaaagcuuuuaauagcuuuuuuguugaaugauuccaauuuucaggcucauuugcuuuu

SEQ ID NO: 163380 - RNA, 64 nt, Homo Sapiens
cuggcggcuccagcgcaggcugucccugcugcuuugauuccaggugauuuuauuuuuuuuauuu

SEQ ID NO: 163381 - RNA, 64 nt, Homo Sapiens
gcugggauuauaggcgugagccaccgcccccagcugauuccaggcgaauucuucucugaugggc

SEQ ID NO: 163382 - RNA, 64 nt, Homo Sapiens
acaagcacucugaggcgggugggguuuuacacucugauuccagguuuggugucugcuucaagag

SEQ ID NO: 163383 - RNA, 64 nt, Homo Sapiens
gccagagccaugcagucccauccccacugcuucgugauuccaggcucagagcagagaagggcuc

SEQ ID NO: 163384 - RNA, 64 nt, Homo Sapiens
gucuccucaguaaucuaggauucaaugauagguaugauuccaguuuauuauccaucaaaggcuc

SEQ ID NO: 163385 - RNA, 64 nt, Homo Sapiens
aaagugauauaugaguuaaaugaccaagcagacuugauuccaggaauguuaaggaauguucauu

SEQ ID NO: 163386 - RNA, 64 nt, Homo Sapiens
cuaggacauugucauuauucuuccuccaucuaucugauuccauuccuuccacacccagcuaaag

SEQ ID NO: 163387 - RNA, 64 nt, Homo Sapiens
agcuccauggcucuucauucaaaagggaaaauaaugauuccacguugcuuuuuagaguucaaau

SEQ ID NO: 163388 - RNA, 64 nt, Homo Sapiens
cugucccagcaccgagacucacuccuaagucuucugauuccaugagcagucccccuucccccau

SEQ ID NO: 163389 - RNA, 64 nt, Homo Sapiens
cuauguguagaagcuaggguucaaggcagaucugugauuccagaagcuguucucuaaaccacua

SEQ ID NO: 163390 - RNA, 64 nt, Homo Sapiens
uaacccuaaaauuuuaaggccacggccuugugucugauuccauauggaggccugaaaauuguag

SEQ ID NO: 163391 - RNA, 64 nt, Homo Sapiens
gccacucuuccucuuggggacaacaggaagugucugauuccagucugccuaguacguugguaca

SEQ ID NO: 163392 - RNA, 64 nt, Homo Sapiens
uuaaaaauccauauucaaaaagcugcauugucggugauuccaaucugugcugcacuuuuuauag

SEQ ID NO: 163393 - RNA, 64 nt, Homo Sapiens
ugauugucagugugugugucgaucccauuucaaaugauuccauauuaaggaccauggugugaua

SEQ ID NO: 163394 - RNA, 64 nt, Homo Sapiens
uggccucuucacauaacaagaugagcuggaaugaugauuccaugacucccaccuaugcagccuu

SEQ ID NO: 163395 - RNA, 64 nt, Homo Sapiens
ucaggugugcccacagaugcggaggcgaggugagugauuccaucauuucaguucucaccugcag

SEQ ID NO: 163396 - RNA, 64 nt, Homo Sapiens
auauagauuuuauaccucaguggggaaaaauaacugauuccaaugacauucauuuuguuuucau

SEQ ID NO: 163397 - RNA, 64 nt, Homo Sapiens
uuuucacagcaauaaaucuucaguucuuuguuuaugauuccacuuaacaaaaggccugcagaag

SEQ ID NO: 163398 - RNA, 64 nt, Homo Sapiens
gcuuucacguugguuccuggcauggcuguugugcugauuccaaucuccccugccugccugauuc

SEQ ID NO: 163399 - RNA, 64 nt, Homo Sapiens
gcuguugugcugauuccaaucuccccugccugccugauuccaugucagaaggacacagcccguc

SEQ ID NO: 163400 - RNA, 64 nt, Homo Sapiens
uaauauguuuccuucccucaguauuauuguccuuugauuccaaauguagcauuuggugcuugac

SEQ ID NO: 163401 - RNA, 64 nt, Homo Sapiens
acaaccuucaagcugcuuuuggcacccuuccaucugauuccagcccaguagcaggcccgaaaga

SEQ ID NO: 163402 - RNA, 64 nt, Homo Sapiens
cggggggcccggcugacucggaaaccagaguugcugauuccaccgagaaagacaaacuugucug

SEQ ID NO: 163403 - RNA, 64 nt, Homo Sapiens
gggcugguucacacuguucugugccuuucugucuugauuccaggccaauuuguggagaggccgg

SEQ ID NO: 163404 - RNA, 64 nt, Homo Sapiens; identical to SEQ ID NO: 106196

SEQ ID NO: 163405 - RNA, 64 nt, Homo Sapiens; identical to SEQ ID NO: 106197

SEQ ID NO: 163406 - RNA, 64 nt, Homo Sapiens; identical to SEQ ID NO: 106198

SEQ ID NO: 163407 - RNA, 64 nt, Homo Sapiens; identical to SEQ ID NO: 106199

SEQ ID NO: 163408 - RNA, 64 nt, Homo Sapiens
gaacauauugcuuaguaacaaaugaaggacaagcauacuacauaauauaauccauacaauucuc

SEQ ID NO: 163409 - RNA, 64 nt, Homo Sapiens
ccauacaauucucuucaguuaguguaaacugcaaauacuacagauaauucugauaauaaaauga

SEQ ID NO: 163410 - RNA, 64 nt, Homo Sapiens
uuauucauucuugauggacaaguauuauauaaauauacuacaacuuucauuuuuauugcuauau

SEQ ID NO: 163411 - RNA, 64 nt, Homo Sapiens
aauacauaaacguauauauauaaugaaguauuucauacuacaaauuacauuuucacucuuuuuu

SEQ ID NO: 163412 - RNA, 64 nt, Homo Sapiens
uuauuuaaauuacuaaggucuagguuuacaaagcauacuacaggacccuuuucuaugcaauauc

SEQ ID NO: 163413 - RNA, 64 nt, Homo Sapiens
uuuuuuugugauuaugcuugugagaaauuuuguaauacuacauucuaguucuguuuucguuuau

SEQ ID NO: 163414 - RNA, 64 nt, Homo Sapiens
aacucuuguugucucuuccucuucagaacucuuguccccccaggcuccccaccucugcaagaug

SEQ ID NO: 163415 - RNA, 64 nt, Homo Sapiens
cacagaacuaguuuuuuaauccucaggcagugcauccccccacccuacaacugagcacaaccuc

SEQ ID NO: 163416 - RNA, 64 nt, Homo Sapiens
gcaccauacaucuguguccgcccccucuaccccuuccccccacguagggcacuguaguggacca

SEQ ID NO: 163417 - RNA, 64 nt, Homo Sapiens
accuuucccugacuccuggugcccucucccuuuguccccccagagagacauaugcccccagaga

SEQ ID NO: 163418 - RNA, 64 nt, Homo Sapiens
agggaccucaggggcaccuccggcugccuagcccuccccccagcucccugcaccgccgcagaag

SEQ ID NO: 163419 - RNA, 64 nt, Homo Sapiens
guggccaagccugcuguguccuuccuccacaagguccccccaccgcucagugucagcgggugac

SEQ ID NO: 163420 - RNA, 64 nt, Homo Sapiens
aguuauuuauuccuuuuuucgaagugaguuuuuuuccccccauaaucguaagagcuuugaauuu

SEQ ID NO: 163421 - RNA, 64 nt, Homo Sapiens
ugaauguguuuuaaaggcuaucuaauuuacuuuuuccccccacuaugauaaaggcuuucuacau

SEQ ID NO: 163422 - RNA, 64 nt, Homo Sapiens
ucccccccccaucaccuuaucauguuuucccuccuccccccaaucucagacaggacuuucuaug

SEQ ID NO: 163423 - RNA, 64 nt, Homo Sapiens
gucuccaaggcauuuccacagucaagagaugucauccccccagggagagaugaggcccgucaga

SEQ ID NO: 163424 - RNA, 64 nt, Homo Sapiens
gucagccugugcaaaggcccaugagccaggacgguccccccacauuaccugggaccugcccccc

SEQ ID NO: 163425 - RNA, 64 nt, Homo Sapiens
uuugggggacaaaauaaaaucuuuguuacuuuuguccccccagauuaauugugagcucauuuuu

SEQ ID NO: 163426 - RNA, 64 nt, Homo Sapiens
cauugcucacucugucuagauaucguaauuuauuuccccccagcaaaauaaagaaauguguuuu

SEQ ID NO: 163427 - RNA, 64 nt, Homo Sapiens
cuccucauauugccucugaaggaugccccugccauccccccaacggccugccccccaacccuga

SEQ ID NO: 163428 - RNA, 64 nt, Homo Sapiens
uacaugcaugcaaucagacauuguuugacuccccuccccccauuuguuuaugcauagccuugau

SEQ ID NO: 163429 - RNA, 64 nt, Homo Sapiens
cuacuccuaacagaugugacaucccaugcccaguuccccccaucugacauccugagggucauuc

SEQ ID NO: 163430 - RNA, 64 nt, Homo Sapiens
gccuaaugugggaacccaagguuugagcccugccuccccccacucuaggagacaggaguccugg

SEQ ID NO: 163431 - RNA, 64 nt, Homo Sapiens
uugcauuuugcucaaacuguagaaugcccuacauuccccccaccccaauuugcuauuuccuuau

SEQ ID NO: 163432 - RNA, 64 nt, Homo Sapiens
cauuaagcuauuucauaauaaauucuguacaguuuccccccaaaaaagagauuuauuuaugaaa

SEQ ID NO: 163433 - RNA, 64 nt, Homo Sapiens
ucuggcaacaaaagccagaguguugugggccaaguccccccacagggccucugcagggcauggc

SEQ ID NO: 163434 - RNA, 64 nt, Homo Sapiens
ccccgagguggggacagugagugaguucucuuaguccccccagagcugguuguuaaagagccug

SEQ ID NO: 163435 - RNA, 64 nt, Homo Sapiens
auugugucacaugggcugcccguaggggcucccauccccccaccguggcuggcaguguuggcca

SEQ ID NO: 163436 - RNA, 64 nt, Homo Sapiens
cuucuggggucggggguuccuccccccucuuucuuccccccacuugggcucugggcaucccugu

SEQ ID NO: 163437 - RNA, 64 nt, Homo Sapiens
ugcugacguagugcucucauaagggaaauacugcuccccccauuugugguucauucuuagaacc

SEQ ID NO: 163438 - RNA, 64 nt, Homo Sapiens
cccuucuuucagugguaugcuuaauguuacguccuccccccaccacacaaaauuucaaccauuc

SEQ ID NO: 163439 - RNA, 64 nt, Homo Sapiens
cuccuacccccuacucuggggcuugggggucaacuccccccaggacuuaccuuccaaaacaaac

SEQ ID NO: 163440 - RNA, 64 nt, Homo Sapiens
guuaauaucuugaauuuagucccuccauccuuaauccccccaucccuccccaucaugcaaccag

SEQ ID NO: 163441 - RNA, 64 nt, Homo Sapiens
ugggccugggaaaccacuuccccaggcuucucccuccccccacccccauaggaacaggauuugg

SEQ ID NO: 163442 - RNA, 64 nt, Homo Sapiens
aagccaggauuccauuuguguugcugcuguauuuuccccccacuucucuauguaacgauauaag

SEQ ID NO: 163443 - RNA, 64 nt, Homo Sapiens
ccgcugccccccacccacccugcaccccucgcccuccccccaccacagaaucuaagaccuuuca

SEQ ID NO: 163444 - RNA, 64 nt, Homo Sapiens
ccguggccucaagggcucccagggcaaaccuaauuccccccaaaacgugaagucggggaagcug

SEQ ID NO: 163445 - RNA, 64 nt, Homo Sapiens
cuugagcuugccccaggccuugggcauaauuauuuccccccaaaaaaggcacaaaaauagguuu

SEQ ID NO: 163446 - RNA, 64 nt, Homo Sapiens
aggauggcucuagaacacucuguccaugcgucacuccccccaguuuuauuuuuagcuuuggcuu

SEQ ID NO: 163447 - RNA, 64 nt, Homo Sapiens
cuaggagguccauccccagcaaauguuuuggagguccccccagagagcagagugggccauggca

SEQ ID NO: 163448 - RNA, 64 nt, Homo Sapiens
agaagggaccccuuggacuuuuucucgccaucccuccccccagcgcaggggcacaagcugagcu

SEQ ID NO: 163449 - RNA, 64 nt, Homo Sapiens
cuucugguuuucuguguggacccccaaacuuucuuccccccacauaaccugccacgggaggggg

SEQ ID NO: 163450 - RNA, 64 nt, Homo Sapiens
uccugccugaaaucucuggcggcagggcagagaauccccccaauacugccuuggggaggagugg

SEQ ID NO: 163451 - RNA, 64 nt, Homo Sapiens
auuagccaguggacaccccauuuccuucaccagguccccccacggccauagcccuugcagccaa

SEQ ID NO: 163452 - RNA, 64 nt, Homo Sapiens
aggcccagggcucaacuucauggccccagcuauauccccccaguuccacacuaaaccagggagg

SEQ ID NO: 163453 - RNA, 64 nt, Homo Sapiens
aauuccgccuagggccacaaggccuucccuguuuuccccccaagggaggcugcugcugcucuug

SEQ ID NO: 163454 - RNA, 64 nt, Homo Sapiens
ccaaaggacgcacugagcaacgcuauuccagcuguccccccacucccucacaaguggguacccc

SEQ ID NO: 163455 - RNA, 64 nt, Homo Sapiens
aaugcaggcuuuuuagccaacaacaaaaguguuuuccccccacccccacucgcccaccagggug

SEQ ID NO: 163456 - RNA, 64 nt, Homo Sapiens
gaaauccagagugugggagacaucacugcaucuguccccccagcuucugugaagggaagcugug

SEQ ID NO: 163457 - RNA, 64 nt, Homo Sapiens
cucuggcucccacaaggcccgacugggaccugccuccccccaaccacugacuguaauccagggg

SEQ ID NO: 163458 - RNA, 64 nt, Homo Sapiens
accccaucgcuggguuucggucccuggcuccccuuccccccacccuccgcaggggccccggccc

SEQ ID NO: 163459 - RNA, 64 nt, Homo Sapiens
ccacggcccgggguucaaggcagaagaggccaaguccccccaagggcaucccugcaaaagggaa

SEQ ID NO: 163460 - RNA, 64 nt, Homo Sapiens
uccuuaauuuuauucuccgccucccagcagcguuuccccccaacgccccaagcccaagucuuuc

SEQ ID NO: 163461 - RNA, 64 nt, Homo Sapiens
ccucaaauccauuuuaaagaccaccccucccauguccccccauuccucccuccuuccucuacuc

SEQ ID NO: 163462 - RNA, 64 nt, Homo Sapiens
ccucagggagcuccgcucagcagcucccagcccuuccccccagcgaggcugucagaggccgucu

SEQ ID NO: 163463 - RNA, 64 nt, Homo Sapiens
cucggccuccucuccugggacccuggucuccuuuuccccccagacggcugcaccugcucuugga

SEQ ID NO: 163464 - RNA, 64 nt, Homo Sapiens
cccucccuccuacgaucaagcugggcuucaaaucuccccccaaggaggggguguccccaagaca

SEQ ID NO: 163465 - RNA, 64 nt, Homo Sapiens
uuagcaauugggaauggcugucccccccgccccuuccccccaggagaccucgcgagacuuucgg

SEQ ID NO: 163466 - RNA, 64 nt, Homo Sapiens
ccccggccccacuccuggcuacauaccaccuucguccccccaggccugugugccaaccuuguuc

SEQ ID NO: 163467 - RNA, 64 nt, Homo Sapiens
uguggagacacagggcugcccaagguuccuuccauccccccagugaccuguggggugaggcagc

SEQ ID NO: 163468 - RNA, 64 nt, Homo Sapiens
uggaaauuguauuugccuucagucggucuccuuauccccccaaaaccuacuaauccucucugca

SEQ ID NO: 163469 - RNA, 64 nt, Homo Sapiens
aaguggaugccugcugcaucaguaagggcacagauccccccacaaucuuuaaugcuggggccca

SEQ ID NO: 163470 - RNA, 64 nt, Homo Sapiens
cccaaauuugucuaagcacuucaaaccaaaguguuccccccaacuggcaaacugcucugugcuu

SEQ ID NO: 163471 - RNA, 64 nt, Homo Sapiens
caucgugauuugucuuuucauuuuuuuuaauuuuuccccccaacuuuuuuccuuuuuucuuuuu

SEQ ID NO: 163472 - RNA, 64 nt, Homo Sapiens
uuggcaccuccccaagagcuuccacuugguuugguccccccacccgcugcucaguggcucugac

SEQ ID NO: 163473 - RNA, 64 nt, Homo Sapiens
uccgcugucaccacauccugagcacucggccccauccccccacaggagggaagcuguggucuga

SEQ ID NO: 163474 - RNA, 64 nt, Homo Sapiens
gcccgcugcacgccucugggcccuuccacccaccuccccccaugcccucacaccccgcacucac

SEQ ID NO: 163475 - RNA, 64 nt, Homo Sapiens
cuccccucacaccccgcacucuccuauccaccccuccccccaccucacccaucccaccccaccc

SEQ ID NO: 163476 - RNA, 64 nt, Homo Sapiens
ucuaccccucccggcccugcguaugucgucgagcuccccccaggccuccucuccugacaauacu

SEQ ID NO: 163477 - RNA, 64 nt, Homo Sapiens
ucccccacucccaaccacguacagcucccccagcuccccccaccgugccaucagugccccgucu

SEQ ID NO: 163478 - RNA, 64 nt, Homo Sapiens
gucccuacugugcgucagaauccaccuugcgugcugugcguaucugugaaccuggagcgguuac

SEQ ID NO: 163479 - RNA, 64 nt, Homo Sapiens
ugugcgaggcuguggagugcaggccagagcagggugugcguagcccccagcacccagguucuuc

SEQ ID NO: 163480 - RNA, 64 nt, Homo Sapiens
ucuugagcaacagugaagcugccauaaauauuucucaacugagguucuugggauacagaucuca

SEQ ID NO: 163481 - RNA, 64 nt, Homo Sapiens
ggacauuugaacauguuuaauggguaugcucaggucaacugaccugaccccauuccugauccca

SEQ ID NO: 163482 - RNA, 64 nt, Homo Sapiens
agcucuuucuuauucuacuacacaagccgccaacucaacugagagcuaaagagacuagaaaaga

SEQ ID NO: 163483 - RNA, 64 nt, Homo Sapiens
gcuaaagagacuagaaaagagauaagcugccaacucaacugagaacaagaaacuagaagagauu

SEQ ID NO: 163484 - RNA, 64 nt, Homo Sapiens
cccaaagaauuauagauauuaaauaguucacuccucaacugagagcuauuuaaggcaaaagcua

SEQ ID NO: 163485 - RNA, 64 nt, Homo Sapiens
aagaaacuagaaauguccuacaaagcuuuacauuucaacugaaaggugugccugucuuaaauuc

SEQ ID NO: 163486 - RNA, 64 nt, Homo Sapiens
aaucuauauucacccaaauacuagaaaguuauuuucaacugauaggaaccaugccuucauaauu

SEQ ID NO: 163487 - RNA, 64 nt, Homo Sapiens
aguuucacuaguggaaauacgauccacauacccuucaacugagcuaauauuuauuaaagaugaa

SEQ ID NO: 163488 - RNA, 64 nt, Homo Sapiens
agccuaaaacaaacaaaaaccucgauguuuucuuucaacugagacuggaaauucauuuuccuua

SEQ ID NO: 163489 - RNA, 64 nt, Homo Sapiens
gcaacauugagaauaaugauguaguaggucucuuucaacugagucucuaugauggucauucaag

SEQ ID NO: 163490 - RNA, 64 nt, Homo Sapiens
cucugcucugcucagcugcgcccccuucuuugcagcugcccagccccuccucccugcccucggg

SEQ ID NO: 163491 - RNA, 64 nt, Homo Sapiens
agggaaagguaggaagagagguccagccccccaggcugcccagagcugcuggucucauuugggg

SEQ ID NO: 163492 - RNA, 64 nt, Homo Sapiens
acgugcggcaccugaagggggaggaugacaagccgcugcccaccuccaagcccaggaaacagua

SEQ ID NO: 163493 - RNA, 64 nt, Homo Sapiens
ccugggcagcaagcgcagccuggaggaagagggugcugcccacagugggaagagacugcgggcc

SEQ ID NO: 163494 - RNA, 64 nt, Homo Sapiens
accccgucugggaagugaggagcgucucugccuggcugcccauugucugggacgugagcagccc

SEQ ID NO: 163495 - RNA, 64 nt, Homo Sapiens
ccauugucugggacgugagcagccccucugccuggcugcccagucuggaaagugaggagcgucu

SEQ ID NO: 163496 - RNA, 64 nt, Homo Sapiens
cccaugcucacacccacagacuccgaaucuaagugcugcccacuggacuccggacuauccaugg

SEQ ID NO: 163497 - RNA, 64 nt, Homo Sapiens
uucagccugcaaugagggacagacuaugugcuccgcugcccaccgccaugcuuuggaagggaca

SEQ ID NO: 163498 - RNA, 64 nt, Homo Sapiens
ugcucuguccccaggaaccaggcuuugcugaggugcugcccaaccugacaguccaggagaugga

SEQ ID NO: 163499 - RNA, 64 nt, Homo Sapiens
gugaucugugacccgguggugugcccaccgcccagcugcccacacccggugcaggcucccgacc

SEQ ID NO: 163500 - RNA, 64 nt, Homo Sapiens
gacgaccugcugccacuucuggccgggaguacaagcugcccauggcacggugucgaggguauug

SEQ ID NO: 163501 - RNA, 64 nt, Homo Sapiens
uucuacucagagcucuucacgugcugccccucaugcugcccagcaccuccaggugcauggauug

SEQ ID NO: 163502 - RNA, 64 nt, Homo Sapiens
gcgugucccagacaucacagguagagugacggcugcugcccagaagacuagggcuggcauugcu

SEQ ID NO: 163503 - RNA, 64 nt, Homo Sapiens
gggcuuccuacggaaguuucgugaugccgcccaagcugcccauggcagacacaccuguccccca

SEQ ID NO: 163504 - RNA, 64 nt, Homo Sapiens
cccaggggcaggcucuuggcuuggcagagaccuugcugcccagguccaucacuggccucugucc

SEQ ID NO: 163505 - RNA, 64 nt, Homo Sapiens
ccuccugguuuccaagcuggaggccaggagagaugcugcccaggacaggcaacgccaggucugc

SEQ ID NO: 163506 - RNA, 64 nt, Homo Sapiens
cccaggugagacaggcaacguuuucucaaguccugcugcccaggaccagcugucugcuggguuc

SEQ ID NO: 163507 - RNA, 64 nt, Homo Sapiens
uugugugugucacaugcugcaccauugucucagagcugcccacugccucaguggucacuugacc

SEQ ID NO: 163508 - RNA, 64 nt, Homo Sapiens
uucccuggcauuuuaaacagcacaaauccacucugcugcccaccaccccccagguuccuucuug

SEQ ID NO: 163509 - RNA, 64 nt, Homo Sapiens
aucaucaggggaagaucaaacacaggugcacucagcugcccagggccucugggacacuugccuu

SEQ ID NO: 163510 - RNA, 64 nt, Homo Sapiens
cagaggacuccaccuccuggcugguuuaccugcugcugcccauuuucucuggguacugcuggcc

SEQ ID NO: 163511 - RNA, 64 nt, Homo Sapiens
cccuugcuucucaacuaaagaauagugccucagcgcugcccacaccaccgcccuccucgcugug

SEQ ID NO: 163512 - RNA, 64 nt, Homo Sapiens
ccccuccagugcuuggcugccccacaggccacacgcugcccaggcucugcugacuucugagcag

SEQ ID NO: 163513 - RNA, 64 nt, Homo Sapiens
cccuggcacagccaacccuguugcccccagugccgcugcccagcuucggccauccagguggugg

SEQ ID NO: 163514 - RNA, 64 nt, Homo Sapiens
cagagccgggaggucacacauguacauccuggaagcugcccaagguguggccacuuguagggca

SEQ ID NO: 163515 - RNA, 64 nt, Homo Sapiens
ccucucggugcuccaucuccgcuccagcgauggugcugcccaggagggccccccaacuguggua

SEQ ID NO: 163516 - RNA, 64 nt, Homo Sapiens
agcaagccuagguacgaagaccaggcuggccagugcugcccaugcccgccucccuaguuagcau

SEQ ID NO: 163517 - RNA, 64 nt, Homo Sapiens
gagagagacccgggaugugugugcuguaccccaagcugcccacugucuugcccgggcugagguc

SEQ ID NO: 163518 - RNA, 64 nt, Homo Sapiens
accgugugcacauccugcaggugcuacugagacugcugcccaacaugagcagugaucuccaagg

SEQ ID NO: 163519 - RNA, 64 nt, Homo Sapiens
cugagcaaacaccagugaggagcuuugggcauaggcugcccaauaccagccuguuuagccaagu

SEQ ID NO: 163520 - RNA, 64 nt, Homo Sapiens
gauagguaugaccuaugucuugggagcucagcucgcugcccaggauccagcacaacucagucug

SEQ ID NO: 163521 - RNA, 64 nt, Homo Sapiens
ugcccaccuccuccaccugcuucaaccugcucaagcugcccaacuacagcaagaagagcguccu

SEQ ID NO: 163522 - RNA, 64 nt, Homo Sapiens
cacagcgccucuucccagacagccaggcccaucugcugcccagggaagcgcaggcgccugcuag

SEQ ID NO: 163523 - RNA, 64 nt, Homo Sapiens
cugagucugcaaaaucccaggaaacuugggucuugcugcccauccuuccucagcacagggaacc

SEQ ID NO: 163524 - RNA, 64 nt, Homo Sapiens
uuuuugcaaggcauuuuaauaagucagucaggaagcugcccauucuuggaaggguuccaacccc

SEQ ID NO: 163525 - RNA, 64 nt, Homo Sapiens
ccagauaucuguaaggcaucgauaguauagauuugcugcccacacucauacacucauguugaug

SEQ ID NO: 163526 - RNA, 64 nt, Homo Sapiens
cacaggccucaaccacugggugcgggcccugguggcugcccagagcuaccuguacagcggcucc

SEQ ID NO: 163527 - RNA, 64 nt, Homo Sapiens
cucggcgagccucccucuacucggcacuguccuugcugcccagccccucucugggugccaggua

SEQ ID NO: 163528 - RNA, 64 nt, Homo Sapiens
ccaggguccugugggcugagcggcuggggcuggggcugcccacguguggccuccgcuggcucug

SEQ ID NO: 163529 - RNA, 64 nt, Homo Sapiens
uuuuuuuuuuuuuuugagauggaguuucacucuugcugcccaggcuggagugcaguggcucaau

SEQ ID NO: 163530 - RNA, 64 nt, Homo Sapiens
cacaugggcuugugacauucacugaagccggacagcugcccagacauugcuaccacagacuugc

SEQ ID NO: 163531 - RNA, 64 nt, Homo Sapiens
ccagucccucgccgucccuccaacccacagcucagcugcccaucgaacccacuccgguuccccg

SEQ ID NO: 163532 - RNA, 64 nt, Homo Sapiens
gccuggguguggcuggaaugugucucggaggguggcugcccacggacccugcccccggcccagg

SEQ ID NO: 163533 - RNA, 64 nt, Homo Sapiens
gcgcuucugcugagacccugugccucggaugguggcugcccacgggccucaggaaaccaccaag

SEQ ID NO: 163534 - RNA, 64 nt, Homo Sapiens
uugugagucagucucaguagccaucagccuggcagcugcccaucccauaaccaaagagcucaau

SEQ ID NO: 163535 - RNA, 64 nt, Homo Sapiens
gcguugcggauagugccucaccauugcccacccugcugcccaacuccugugagagaaaaaccaa

SEQ ID NO: 163536 - RNA, 64 nt, Homo Sapiens
gccuggugggagaggccagcuugagccagacagcgcugcccagggguggccgccuaguacacac

SEQ ID NO: 163537 - RNA, 64 nt, Homo Sapiens
uccugcuggagggcccugaacccugcacugcguggcugcccagccagcugccuccuguccuggg

SEQ ID NO: 163538 - RNA, 64 nt, Homo Sapiens
ccuguccugaaaacagcacgccucauguccagacgcugcccagucccccccaaaacccgcaggu

SEQ ID NO: 163539 - RNA, 64 nt, Homo Sapiens
uucggacagcgggaacuccuaagccugcauucuggcugcccagcaccugguggggcccggggcc

SEQ ID NO: 163540 - RNA, 64 nt, Homo Sapiens
gcuccggaggugcagcuaaagcaccagaggugaagcugcccaggccgacgugcaucuuccgaag

SEQ ID NO: 163541 - RNA, 64 nt, Homo Sapiens
gucugugaaaugaaaguccccucccagaggugcagcugcccaaauggccgugcccgaugugcac

SEQ ID NO: 163542 - RNA, 64 nt, Homo Sapiens
gugucagagaugaaacuccccuuccagagguagagcugcccaaauggcugugccggaggugcgg

SEQ ID NO: 163543 - RNA, 64 nt, Homo Sapiens
aucaagaugcccucccuugggagagcaagcugaagcugcccaccccgcugcuccugaaguugua

SEQ ID NO: 163544 - RNA, 64 nt, Homo Sapiens
uugcuggagggguuuccuggguauaacccauugggcugcccaaggccagccagccugagcucuc

SEQ ID NO: 163545 - RNA, 64 nt, Homo Sapiens
aaggguacaguuugacacugaucugguccaugaggcugcccagagaaagcacugcuucuguaug

SEQ ID NO: 163546 - RNA, 64 nt, Homo Sapiens
cuguucacaugcuggggaccacaugacaccgacagcugcccagccagggacuuuugcccacagc

SEQ ID NO: 163547 - RNA, 64 nt, Homo Sapiens
cucaagacucaucugccuagagaugaaugagaaagcugcccauuuuaaaggucaccuuccugaa

SEQ ID NO: 163548 - RNA, 64 nt, Homo Sapiens
caaccuggucuucacaccaguggggcagccugcagcugcccaccugugcuccaaagcaacgggc

SEQ ID NO: 163549 - RNA, 64 nt, Homo Sapiens
ucccgggcacugucaugcccagugccacauggccgcugcccacgcacugucaugcccagcuugg

SEQ ID NO: 163550 - RNA, 64 nt, Homo Sapiens
ucccgggcacugucaugcccagugccacguggccgcugcccacgugcugucaugcccagcuugg

SEQ ID NO: 163551 - RNA, 64 nt, Homo Sapiens
ggcucuuccuggacagugagugccccaggcucaggcugcccagcacuucccugcaaggugcacc

SEQ ID NO: 163552 - RNA, 64 nt, Homo Sapiens
aguugaacucugaguucaucggucagcagaagaaggaacugagcuugugauuauaucuguauca

SEQ ID NO: 163553 - RNA, 64 nt, Homo Sapiens
acauuacccugaugucuaaaacauuuuaauuaaaggaacugaguccagagauggcuuuuccaac

SEQ ID NO: 163554 - RNA, 64 nt, Homo Sapiens
aagagcgaggauaugcaggccccaggaaggggguggaacugaggugccaggagccugugacacc

SEQ ID NO: 163555 - RNA, 64 nt, Homo Sapiens
cagccuggaauggcugcugagcaaaccaggagguggaacugaauccgcccggaguccuagcaca

SEQ ID NO: 163556 - RNA, 64 nt, Homo Sapiens
accgauucuuuccacaaccggcagagcuggaaugggaacugagaggucucccggugucuaaaua

SEQ ID NO: 163557 - RNA, 64 nt, Homo Sapiens
gcauguaggcacauggacccccaguuuggugggaggaacugaauacaggguuagcuaucacugu

SEQ ID NO: 163558 - RNA, 64 nt, Homo Sapiens
ugaacgugaauaugcugacuauccaucugugaauggaacugaagugcacccgguggaagcugaa

SEQ ID NO: 163559 - RNA, 64 nt, Homo Sapiens
gcaaccugcaaagaggaaaacagucaaguuccaaggaacugacagacggacaacuugagaaaag

SEQ ID NO: 163560 - RNA, 64 nt, Homo Sapiens
guugauauucugggggaggucacugcagaaggauggaacugaccuuuauuccccagugggcagu

SEQ ID NO: 163561 - RNA, 64 nt, Homo Sapiens
ugcacaaggaaugaggaagaucagggacaaccugggaacugaauaacuuucaaagccagugcuc

SEQ ID NO: 163562 - RNA, 64 nt, Homo Sapiens
accaucaccgcugcugcaaagaggcaauaauaaaggaacugaagacagcuguauuugggagaag

SEQ ID NO: 163563 - RNA, 64 nt, Homo Sapiens
gcauugaauugggauuaaauaaagauguugggcaggaacugaacacugcuaauaugaugauaaa

SEQ ID NO: 163564 - RNA, 64 nt, Homo Sapiens
cagggccccucucuccucccaccuggacuuggggggaacugagaaacacuuuccuggagcugcu

SEQ ID NO: 163565 - RNA, 64 nt, Homo Sapiens
gaaugcauguuuuuuuccugguuggaauugaguaggaacugaggcugugcuucagguaugguac

SEQ ID NO: 163566 - RNA, 64 nt, Homo Sapiens
uauuguaaucaaauaguuaaauuaguuuaggucgggaacugagagcuaugugaaaacagacaau

SEQ ID NO: 163567 - RNA, 64 nt, Homo Sapiens
cuuacaugguauacuuaguguguagcuguguucuggaacugaauuacugugauggacacagaaa

SEQ ID NO: 163568 - RNA, 64 nt, Homo Sapiens
aaaggccaaguauuuuauuaaauauaauuuuacuggaacugauugggugguggggaagcuuuca

SEQ ID NO: 163569 - RNA, 64 nt, Homo Sapiens
ugaggcuaaacuggauuagcuugagaaaagggauggaacugauuguuagacaucagaaaaggga

SEQ ID NO: 163570 - RNA, 64 nt, Homo Sapiens
gaucacaaagaacugaaucuuaccuguuuucugcggaacugacgaguuaaacuuuuguuuguac

SEQ ID NO: 163571 - RNA, 64 nt, Homo Sapiens
gaagcaguccaaagaugucuauugucugacagcaggaacugagauacacuuaaaaguacuucag

SEQ ID NO: 163572 - RNA, 64 nt, Homo Sapiens
cuucuuuggggcuugucuugcuggucuagccucaggaacugaaacaauuaagugaauugagucc

SEQ ID NO: 163573 - RNA, 64 nt, Homo Sapiens
caguggaaagagaaugcuucggucaguucuccuuggaacugaauaauuaacucuucgguuaaug

SEQ ID NO: 163574 - RNA, 64 nt, Homo Sapiens
ucuccucuacaauguuuccuuucucccaaaacagggaacugacugucugguagugaagacaagc

SEQ ID NO: 163575 - RNA, 64 nt, Homo Sapiens
acucgcuuaagaaauuuuaagcuauuuaaucuugggaacugaagccagucauguaaacauacua

SEQ ID NO: 163576 - RNA, 64 nt, Homo Sapiens
uguuccucacacuggagggugauagaccccaaggggaacugaagaguggagcucaguuuccucu

SEQ ID NO: 163577 - RNA, 64 nt, Homo Sapiens
gacuccacaauugggaugccgacacaccuugcuaggaacugacaacaacuucaguauggucugg

SEQ ID NO: 163578 - RNA, 64 nt, Homo Sapiens
agacacagucuucucaucacucuucuuuuagccauuuugcuaaggcaugcuguuccuuuucuuu

SEQ ID NO: 163579 - RNA, 64 nt, Homo Sapiens
agguuaaugaaguaccaagcgccugguacucagauuuugcuauguuuauccuugugcacugcag

SEQ ID NO: 163580 - RNA, 64 nt, Homo Sapiens
guaguauguaguguguuucuuagguaaagucucuuuuugcuacugaaagggaaauggucucuaa

SEQ ID NO: 163581 - RNA, 64 nt, Homo Sapiens
gagcuguuauuuaugcuguagaaaacgaaaaugguuuugcuaccugauaagcuucagauuagau

SEQ ID NO: 163582 - RNA, 64 nt, Homo Sapiens
ugcaggaggcccuuuauuauaaguuaagacagauuuuugcuaagaauggaagaaaugcacuaca

SEQ ID NO: 163583 - RNA, 64 nt, Homo Sapiens
gcucaaguaauagaaacuuauaccgaaccuuacauuuugcuagagacauuacacuaguugaggc

SEQ ID NO: 163584 - RNA, 64 nt, Homo Sapiens
ggcugcccccaggguggcaaacauuucaaaugaguuuugcuaugugagcucuuauaugcagaac

SEQ ID NO: 163585 - RNA, 64 nt, Homo Sapiens
aauuuggugaucuaauccuagaucccuuuuucuguuuugcuagguuuuuuucuguaaagcaaaa

SEQ ID NO: 163586 - RNA, 64 nt, Homo Sapiens
cacaguguaucccccugcuucuguuuuuguauauuuuugcuacuugguuuuucuugaucauagc

SEQ ID NO: 163587 - RNA, 64 nt, Homo Sapiens
aauaaaguguucuauuaaccugaucucuuugcccuuuugcuaugugaggagugaaugaguggcc

SEQ ID NO: 163588 - RNA, 64 nt, Homo Sapiens
uaugccaaaaacauuaaacagaagaaaucauuuuuuuugcuauguaauaccucgcaacuuugcu

SEQ ID NO: 163589 - RNA, 64 nt, Homo Sapiens
uaguauucaaauuauuaaugcucauguaccaagguuuugcuauaaaaguuuugucuguaugaau

SEQ ID NO: 163590 - RNA, 64 nt, Homo Sapiens
gguagugcaaauucaacuucaaauaugguguagguuuugcuagauuccauauuuuuuucuugga

SEQ ID NO: 163591 - RNA, 64 nt, Homo Sapiens
agguuuugcuagauuccauauuuuuuucuuggauuuuugcuaauuauuuuuagcaaaaaauuuu

SEQ ID NO: 163592 - RNA, 64 nt, Homo Sapiens
ccaugccuucccuauucauucucuguccagaguuuuuugcuaaagauagaauuauuaaugauac

SEQ ID NO: 163593 - RNA, 64 nt, Homo Sapiens
acugggauucuuuauuaauuauuugagaauguuauuuugcuaguucuuaagguuaaguuuuuca

SEQ ID NO: 163594 - RNA, 64 nt, Homo Sapiens
uguuuagcacuuugauauuaaaauuuugcuuauguuuugcuaaauucgaauaauguuugaagau

SEQ ID NO: 163595 - RNA, 64 nt, Homo Sapiens
uauacucuguaucaagucaaaauaucuuuggccauuuugcuaagaaacaaacuuugaaugucaa

SEQ ID NO: 163596 - RNA, 64 nt, Homo Sapiens
caaguuugcaaaucaguuuuuagcaagaaaacauuuuugcuauacaaacauuuugcuaagucug

SEQ ID NO: 163597 - RNA, 64 nt, Homo Sapiens
uuuuuagcaagaaaacauuuuugcuauacaaacauuuugcuaagucugcccaaagcccccccaa

SEQ ID NO: 163598 - RNA, 64 nt, Homo Sapiens
gacucauucauguuuuuuagcuucggcaaugccauuuugcuauaguaaggucuguaaaucaggg

SEQ ID NO: 163599 - RNA, 64 nt, Homo Sapiens
gaaggccagcuuugggaucuaggagcuuguuguuuuuugcuaugaggcuauaggcaaagcgucu

SEQ ID NO: 163600 - RNA, 64 nt, Homo Sapiens
ccccacaucgcuccccuuuuuuuaaaaaggacuguuuugcuagugugauaaugaauagguaaga

SEQ ID NO: 163601 - RNA, 64 nt, Homo Sapiens
gaauuguuaaaauucagaacauucaaaauaacuguuuugcuacaacccaugauuauuuuccugu

SEQ ID NO: 163602 - RNA, 54 nt, Homo Sapiens
ucaaaauaucaguuauauaaaacguuuugcuaagaguuuaaaaucuuaaaaccc

SEQ ID NO: 163603 - RNA, 64 nt, Homo Sapiens
ugacuuucagaggccuuuuuuuguuuguuuuaauuuuugcuagauugauauuaaaaacucaugu

SEQ ID NO: 163604 - RNA, 64 nt, Homo Sapiens
gugaauagugcugcaaugaagauugauuccauguuuuugcuauucuauuguugacucacauuua

SEQ ID NO: 163605 - RNA, 64 nt, Homo Sapiens
uuugccucauuuuuuaguguagcaauucacuaccuuuugcuacaccucuucccagaauuuacaa

SEQ ID NO: 163606 - RNA, 64 nt, Homo Sapiens
cacaacagaguaacuaucgaaaugacgguguuaauuuugcuaacuggguuaaauauuuugcuaa

SEQ ID NO: 163607 - RNA, 64 nt, Homo Sapiens
augacgguguuaauuuugcuaacuggguuaaauauuuugcuaacugguuaaacauuaauauuua

SEQ ID NO: 163608 - RNA, 64 nt, Homo Sapiens
aaauuauuucuagaguugugaauuuugaaguaguuuuugcuaaaaauguuuugcuauguaggga

SEQ ID NO: 163609 - RNA, 64 nt, Homo Sapiens
uagggaaauuuugaaguaguuuuccagaggaauguuuugcuaugccaaaagcauuaaaaaucua

SEQ ID NO: 163610 - RNA, 64 nt, Homo Sapiens
caugaaauacaguucggcccaaaaucugguuugauuuugcuaccugcuaguagcauuucaaguu

SEQ ID NO: 163611 - RNA, 64 nt, Homo Sapiens
agcauuucaaguuaaaaucuuuguuucugugaccuuuugcuaguuuacccaccucuaaagauau

SEQ ID NO: 163612 - RNA, 63 nt, Homo Sapiens
aauuuuguguugcguucacacauuaaaauugucuuuuugcuauaacccuuuuuucuacggcag

SEQ ID NO: 163613 - RNA, 64 nt, Homo Sapiens
caguacaucuauauugauagaguaugauaguuuguuuugcuauagaaacauuaucugaaagcaa

SEQ ID NO: 163614 - RNA, 64 nt, Homo Sapiens
agccauuuccugagggccaagauagaaaauuagauuuugcuaugugugccuggcccccucaucu

SEQ ID NO: 163615 - RNA, 64 nt, Homo Sapiens
gauaauugcaaggcacguggagggagcuaggcuguuuugcuagaccagacacacagugggguug

SEQ ID NO: 163616 - RNA, 64 nt, Homo Sapiens
uguuucuuguuauagaaucauuauccaugcucauuuuugcuaggggaaauauaugaagagggaa

SEQ ID NO: 163617 - RNA, 64 nt, Homo Sapiens
aguuugauuuggcuuuuauauuuuuuaaaaucccuuuugcuaccccaucugguuuuauaaacug

SEQ ID NO: 163618 - RNA, 64 nt, Homo Sapiens
guacgauauugcuuauugugacuuuggcauguauuuuugcuagcaaaaugcuguaagauuuaua

SEQ ID NO: 163619 - RNA, 64 nt, Homo Sapiens
agcaaaaugcuguaagauuuauaccauugaucuuuuuugcuauauuuguauacaguacaguaag

SEQ ID NO: 163620 - RNA, 64 nt, Homo Sapiens
guuguuucacauguagcauuugccacaauuuaaguuuugcuaauugcaucccuaugguaauguu

SEQ ID NO: 163621 - RNA, 64 nt, Homo Sapiens
cauuacuuccguuuuaaaaguuuuugccagagaguuuugcuaaauacucucuuauuugcucuag

SEQ ID NO: 163622 - RNA, 64 nt, Homo Sapiens
caccaccccucacccuaugcaaucaaucaaucaaucaucuuaaguuaaagauauuuguugucuu

SEQ ID NO: 163623 - RNA, 64 nt, Homo Sapiens
guugauucuguaguucuuuaaauaauaaugaagcucaucuuauacauuuugcuuucaccaauug

SEQ ID NO: 163624 - RNA, 64 nt, Homo Sapiens
cccgagccauggaucaacuaccucaucaucuuacucaucuuaagauuucugcuuggcacgcuac

SEQ ID NO: 163625 - RNA, 64 nt, Homo Sapiens
caucuuaagcccgagccauggcacgcuacccucaucaucuuacuucugaagugauuucugcuug

SEQ ID NO: 163626 - RNA, 64 nt, Homo Sapiens
gggccacauauuaaauuacuucugaauggugaauucaucuuacaaaauguuccaaguuuuggac

SEQ ID NO: 163627 - RNA, 64 nt, Homo Sapiens
aguuauaaucaggcuacauucacauuuucuuuucucaucuuaaaacccuuuauguucaaaauac

SEQ ID NO: 163628 - RNA, 64 nt, Homo Sapiens
agcugaacagaaaaauuaaaaaguggaaagccauucaucuuaaagguuucaacacagagguuuc

SEQ ID NO: 163629 - RNA, 64 nt, Homo Sapiens
auaucuuacuuuacacauacugaacaggaugacaucaucuuauuguuuugaccucccaggcauc

SEQ ID NO: 163630 - RNA, 64 nt, Homo Sapiens
aagucuucacaguuuuuccaaugaacacuccucuucaucuuauuauugagcugccuuauuucua

SEQ ID NO: 163631 - RNA, 64 nt, Homo Sapiens
uuggcuaacauagcacaguacuaggauaaaccaaucaucuuaacgacaauuugccauagcagug

SEQ ID NO: 163632 - RNA, 64 nt, Homo Sapiens
uauuauugcuaguggauguaguguugauuacuaaucaucuuagauucucucaucucaccucucu

SEQ ID NO: 163633 - RNA, 64 nt, Homo Sapiens
auauauuccuuccuauacaugcauaugugaugcaucaucuuaucgugaagguccuacauguaau

SEQ ID NO: 163634 - RNA, 64 nt, Homo Sapiens
aaauagcugagugcaguccuugcucauauuuccuucaucuuaaccccgcaaacaagaauuaaga

SEQ ID NO: 163635 - RNA, 64 nt, Homo Sapiens
guugcuuuuuaaaaugucagcaagaaggccugccucaucuuaacaaagcaaaaaaaaaugcuuu

SEQ ID NO: 163636 - RNA, 64 nt, Homo Sapiens
uggaagauugaaauccacagauaauucaugacccucaucuuaucacuuuacuccaucuuuuuau

SEQ ID NO: 163637 - RNA, 64 nt, Homo Sapiens
aggaaccaaaggcuuaugauguaggacaaagaaaucaucuuagaacugucaagcauauuuucac

SEQ ID NO: 163638 - RNA, 64 nt, Homo Sapiens
aaugacaauuucuaguuuaguuaauuucuacaaaucaucuuauguuauuagcaagguuaagaca

SEQ ID NO: 163639 - RNA, 64 nt, Homo Sapiens
agaaaacuuuauuugucaaagucagaaaacauuuucaucuuauugagagauauguuuuuaaacu

SEQ ID NO: 163640 - RNA, 64 nt, Homo Sapiens
gugguuuuaauuuuuuaaauggugauuaguguuaaaaaucaauuuaaaucaugacuaauauggu

SEQ ID NO: 163641 - RNA, 64 nt, Homo Sapiens
gaaaacaguuuguagacaaugauucuuuuuuaauaaaaucaaauaauucuaaaagugcuagaga

SEQ ID NO: 163642 - RNA, 64 nt, Homo Sapiens
cauaacuuagaaaccgauguaaaaaaaaaaaaaaaaaaucaacuacagagcgaaacuccgucuc

SEQ ID NO: 163643 - RNA, 64 nt, Homo Sapiens
cauugccuguaaucccagcaaaacccaguaguuaaaaaucaacuggccugggccugccuggccu

SEQ ID NO: 163644 - RNA, 64 nt, Homo Sapiens
uugauguucugguuacuucuaguaaauuccugucaaaaucaauucagaaauucuaacuuggaga

SEQ ID NO: 163645 - RNA, 64 nt, Homo Sapiens
gguauuuuuguaguuucuuuguagagagauaauaaaaaucaaaauauuuaaugaaaauggacuu

SEQ ID NO: 163646 - RNA, 64 nt, Homo Sapiens
auuacuauguggcuuagggauuuauuuguuuuuuaaaaucaaccauguuagcugggauuagacu

SEQ ID NO: 163647 - RNA, 64 nt, Homo Sapiens
caguaaaauuugacuguuuaaaauguuggccaaaaaaaucaagauuuaauuuuuuuauuuguac

SEQ ID NO: 163648 - RNA, 64 nt, Homo Sapiens
uugaaagaagaggcuuaauuugggggugguaacuaaaaucaaaagaaaugauugacuugagggu

SEQ ID NO: 163649 - RNA, 64 nt, Homo Sapiens
uugcucaaaaggguaaaugaaauuauaaaugaccaaaaucaagagucacuuuuucucauguucu

SEQ ID NO: 163650 - RNA, 64 nt, Homo Sapiens
uuguaauuuguuuagaagccucaaggauaaaggcaaaaucaauuuacauuuuucuguguuacac

SEQ ID NO: 163651 - RNA, 64 nt, Homo Sapiens
uauuauguugcacauuuuugcauguguucugauaaaaaucaauucuagcacugugaagcuucag

SEQ ID NO: 163652 - RNA, 64 nt, Homo Sapiens
gcaauaagauuugaugugugaguagcuuugauuuaaaaucaaugcaaaaagcacaacuaauaaa

SEQ ID NO: 163653 - RNA, 64 nt, Homo Sapiens
acaaauguccccggaucuuuccuaucugaagaaaaaaaucaaaauggggaaguuucacccucuc

SEQ ID NO: 163654 - RNA, 64 nt, Homo Sapiens
gcuuuaguauuccucaucuuuaaauccaaauaugaaaaucaaaaauuguggccuuggaguuugc

SEQ ID NO: 163655 - RNA, 64 nt, Homo Sapiens
uucuuuuaaaacaauauccauuucuaaagagauaaaaaucaaacgccccguuaguuucaaaccg

SEQ ID NO: 163656 - RNA, 64 nt, Homo Sapiens
aguggagucuucuuuagugcacacagugaaaaaaaaaaucaaacagugaauaggggaaaaauaa

SEQ ID NO: 163657 - RNA, 64 nt, Homo Sapiens
aaaauuucaaauguuuauuaggauuuuaaauuuaaaaaucaauaacaauuuugugguuaaaacu

SEQ ID NO: 163658 - RNA, 64 nt, Homo Sapiens
ugaucagaguauggguucucagcauuacacacaaaaaaucaaguggaaguuaccugguagauca

SEQ ID NO: 163659 - RNA, 64 nt, Homo Sapiens
aaauaaauaacauuuaauuugacggaaaauucuaaaaaucaacauuugguaacuuaaauauuca

SEQ ID NO: 163660 - RNA, 64 nt, Homo Sapiens
guuuuuggcaugaacaaaagaaacaagagagaaaaaaaucaaaauaauuaaaauaaauuguuag

SEQ ID NO: 163661 - RNA, 64 nt, Homo Sapiens
guuugaaaagucauacuuugcagauaugaaccugaaaaucaaagugccauuguuaaaucauccu

SEQ ID NO: 163662 - RNA, 62 nt, Homo Sapiens
aauugaaauuauauuaguaauaaauguaacuugaaaaaucaaguuuaggagccucuucauuu

SEQ ID NO: 163663 - RNA, 64 nt, Homo Sapiens
accuuagagauuaugaagucuucucucugguagaaaaaucaaauuguauucaauauugucacau

SEQ ID NO: 163664 - RNA, 64 nt, Homo Sapiens
gucauguuuaaagacguguuuaugagaagcaaauaaaaucaaaauuacuguucucuaaaauaau

SEQ ID NO: 163665 - RNA, 64 nt, Homo Sapiens
aguaguccacuuuaugcuuaaaauaaaaucauaaaaaaucaaguuuuaagguuauauuuuuuaa

SEQ ID NO: 163666 - RNA, 64 nt, Homo Sapiens
uaugacugaauugcaaucuauauuuuuaaaaagaaaaaucaaaauacauuaggguuuacuuggu

SEQ ID NO: 163667 - RNA, 64 nt, Homo Sapiens
aauaucuuuugaagaacuaugcuuuuucaaaagcaaaaucaacucuguauaauagcacauucuc

SEQ ID NO: 163668 - RNA, 64 nt, Homo Sapiens
uaaauauuaugugugugauaguauucaauaaaguaaaaucaaauugucuuuggguuguaugugu

SEQ ID NO: 163669 - RNA, 64 nt, Homo Sapiens
aaagaaaaagaaaagaagagaaaaaauuaagaaaaaaaucaaaaaaggaagaaaacuaaaaaaa

SEQ ID NO: 163670 - RNA, 64 nt, Homo Sapiens
aaaaaucaaaaaaggaagaaaacuaaaaaaaaaaaaaaucaaaucaccuugugauucaguguau

SEQ ID NO: 163671 - RNA, 64 nt, Homo Sapiens
uuaacuguagcauuccucuaauuauaaacagugaaaaaucaaaaucaguccagaguucuuuugu

SEQ ID NO: 163672 - RNA, 64 nt, Homo Sapiens
uggugaaaaauaguuuuugaaaacaucagauuauaaaaucaagauaguccggacgcgguggcac

SEQ ID NO: 163673 - RNA, 64 nt, Homo Sapiens
cugggcgacagagcgagacuccaccucaaaaaauaaaaucaagauaaccucuugaauguaauag

SEQ ID NO: 163674 - RNA, 64 nt, Homo Sapiens
auggccauguauaaccaauuaauucugaguuuccaaaaucaaagauuugaccuuaagagggaag

SEQ ID NO: 163675 - RNA, 64 nt, Homo Sapiens
uaauuuuacuauuucuuuuaaaaguauguuuuggaaaaucaaugauuuuaaugcauagcaguau

SEQ ID NO: 163676 - RNA, 64 nt, Homo Sapiens
cgagauuuaauguuugguacuuuuuuuucuauucaaaaucaaauuguuauuuucagaauggcuu

SEQ ID NO: 163677 - RNA, 64 nt, Homo Sapiens
ucaggaacccagcuucagggggguucccacgugcaaaaucaacauucagagcaguguccuccug

SEQ ID NO: 163678 - RNA, 64 nt, Homo Sapiens
auagcuacagcauaagagaagaacuuuuuaagguaaaaucaaauaagggggggaaaggaccuua

SEQ ID NO: 163679 - RNA, 64 nt, Homo Sapiens
accaugauuuaugaaacuaaagcucuguuuagaaaaaaucaaagaguuuguauuaauuuguaau

SEQ ID NO: 163680 - RNA, 64 nt, Homo Sapiens
aguaugagaguuuaguuauuaaccuuucaaccugaaaaucaagcugaaauauauagauuauugu

SEQ ID NO: 163681 - RNA, 64 nt, Homo Sapiens
gaggcaaaauuuugacagggauauauauauauugaaaaucaaagcaacagaguaagacaaaaaa

SEQ ID NO: 163682 - RNA, 64 nt, Homo Sapiens
cuuuucucuucugcccuccuugugggcagucaugaaaaucaauucagacuguguugauuagcag

SEQ ID NO: 163683 - RNA, 64 nt, Homo Sapiens
uuguacuuuucucauacaccaaaaacacaccaaaaaaaucaauaaaauaagcaaucuucuauuc

SEQ ID NO: 163684 - RNA, 64 nt, Homo Sapiens
cuuagcuguugugugaauuugccacaaauaaaagaaaaucaaauacagcuaucugucuuuuagu

SEQ ID NO: 163685 - RNA, 64 nt, Homo Sapiens
auuaccacccagaaaacagucaacuaagcuuuuaaaaaucaacugucacaguccaugaucugac

SEQ ID NO: 163686 - RNA, 64 nt, Homo Sapiens
gaggggcauagugaaaaaggaacagccaugccucaaaaucaaaucauuugcauucccacagcau

SEQ ID NO: 163687 - RNA, 64 nt, Homo Sapiens
ucuuuguuaauuguacacugaauaaugccuuuuaaaaaucaaaauaaaauuaacaaauaauggu

SEQ ID NO: 163688 - RNA, 64 nt, Homo Sapiens
ggcacugugaacuauuuugaaggccauauuuuaaaaaaucaaaacuucgguuccucugauuuca

SEQ ID NO: 163689 - RNA, 64 nt, Homo Sapiens
uuaugguuuccucauuuuacauuuaauauuuuucaaaaucaaaguuauagaauaauuucuccuc

SEQ ID NO: 163690 - RNA, 64 nt, Homo Sapiens
gguaaugcacauccucauucagcgauuauugaucaaaaucaaaauucaucaaguaaucauggcc

SEQ ID NO: 163691 - RNA, 64 nt, Homo Sapiens
aacaaguucugaguuacuuaaaaagucaaaaaucaaaaucaaacggacccacuggggcauauaa

SEQ ID NO: 163692 - RNA, 64 nt, Homo Sapiens
ucaaacaacaaguucugaguauauaaaaaagucaaaaaucaaaaagaccaggacccacuggggc

SEQ ID NO: 163693 - RNA, 64 nt, Homo Sapiens
uaaaugcaagcugagguuuucagugauaccuacgaaaaucaaaagcagcuuuccuucuuuucaa

SEQ ID NO: 163694 - RNA, 64 nt, Homo Sapiens
aggcuacuuaagucugcucugcugugacaaaucuaaaaucaaccgagcauccaagcaugauuuu

SEQ ID NO: 163695 - RNA, 64 nt, Homo Sapiens
agugcaccugauuuacuguuguuauguuaccugaaaaaucaagguagaauuguuuuuuucuaaa

SEQ ID NO: 163696 - RNA, 64 nt, Homo Sapiens
augaauuucuuucuuuuauaaauuuucucauuuaaaaaucaaaaaucuugcaaaacaaaaacca

SEQ ID NO: 163697 - RNA, 64 nt, Homo Sapiens
cuuaaugccagugugaauuugcagauguuuucagaaaaucaagucacaguaacaauuugccacu

SEQ ID NO: 163698 - RNA, 64 nt, Homo Sapiens
acagguguuauuugucugccgcucuaaaaggcuuaaaaucaaacauaaaauauaaaguaacaua

SEQ ID NO: 163699 - RNA, 64 nt, Homo Sapiens
uuuguuaguaacaaucuugaccagcacaguaauaaaaaucaagauuagugauuaaaaucuugcc

SEQ ID NO: 163700 - RNA, 64 nt, Homo Sapiens
gugcgcuugaaagaccucuucgcuguacuugcuaaaaaucaacuucaaaaugaaggucuucaua

SEQ ID NO: 163701 - RNA, 64 nt, Homo Sapiens
ugaaggucuucauacgcuguuagccuacuuuuauaaaaucaaaauuuuagauacucaugcaaca

SEQ ID NO: 163702 - RNA, 64 nt, Homo Sapiens
ucaaaaacuacucccuuggaaaaaauaucuuucgaaaaucaaauuuaaacauuucacucugugc

SEQ ID NO: 163703 - RNA, 64 nt, Homo Sapiens
cugugaaggugaucaguguagcaguaagacaucuaaaaucaagacaaugacaugggggcuuugu

SEQ ID NO: 163704 - RNA, 64 nt, Homo Sapiens
ugcugcucaaaugaauuuaauagaaucucuauucaaaaucaaaauggaaaguuuagacuacauu

SEQ ID NO: 163705 - RNA, 64 nt, Homo Sapiens
acugcuuuaugggcaggaacaaaaggugaacagcaaaaucaagcggccaagcccaucuauuuac

SEQ ID NO: 163706 - RNA, 64 nt, Homo Sapiens
ucugauaaacaacuucagcuaacuuucaggagacaaaaucaauauacaaaauaugguagcauuu

SEQ ID NO: 163707 - RNA, 64 nt, Homo Sapiens
auugaaacugaaccacuuccuuacaccauaugcaaaaaucaacucaagauggauuaaagacuua

SEQ ID NO: 163708 - RNA, 64 nt, Homo Sapiens
uuguaaaacuuuugauauuucuguauacauuuaaaaaaucaauugccacuacaguaguuccuua

SEQ ID NO: 163709 - RNA, 64 nt, Homo Sapiens
uuugaauuuuaaaacuaaucuauuuuauuuaaaaaaaaucaaguacuuuggaagugaauaaagu

SEQ ID NO: 163710 - RNA, 64 nt, Homo Sapiens
aaaagcaaaguucccaggccacucucggagaaauaaaaucaauaucaauucacuuuguaagaaa

SEQ ID NO: 163711 - RNA, 64 nt, Homo Sapiens
uagggauacagcaggggcuggcugcuucaaaaucaaaaucaauuaugaacccaugacagcaccu

SEQ ID NO: 163712 - RNA, 64 nt, Homo Sapiens
ucaauuuagggauacagcaggcaccugcugcuucaaaaucaaaaacaagaaugaacccaugaca

SEQ ID NO: 163713 - RNA, 64 nt, Homo Sapiens
uuaucccaggaauucaagguugguucaacaucuaaaaaucaaauaagcuaauauacagucaguu

SEQ ID NO: 163714 - RNA, 64 nt, Homo Sapiens
uuagguuaggaauucaagguuuguucaacaucuaaaaaucaaauaagcuaauaaagaaaagagg

SEQ ID NO: 163715 - RNA, 64 nt, Homo Sapiens
uuuugcugaaaugaguugaucaacaaauacugauaaaaucaauauuguggaugacaguaagaaa

SEQ ID NO: 163716 - RNA, 64 nt, Homo Sapiens
aaaucuauauuuaauggaugagaugacauuucagaaaaucaaacauaccaauggcuuugcaaga

SEQ ID NO: 163717 - RNA, 64 nt, Homo Sapiens
aaaacacaaagcacaggucaggauccucugagagaaaaucaacauugcaccacguagggguggg

SEQ ID NO: 163718 - RNA, 64 nt, Homo Sapiens
uuuuagaguuuaaaaaaaacaccucgacauuuaaaaaaucaaccaacacaagaucaaaaaggaa

SEQ ID NO: 163719 - RNA, 64 nt, Homo Sapiens
ucugaaaaucuauagacugaaugcaguuccaaacaaaaucaacuaagaauuuucuaggaucuuu

SEQ ID NO: 163720 - RNA, 64 nt, Homo Sapiens
gagaaaauaaaauuacaacauuacgacauacuaaaaaaucaauauucuuuuuuuuuuuuuuuuu

SEQ ID NO: 163721 - RNA, 64 nt, Homo Sapiens
guaacauggauaguuaaaacaauguugaaugaaaaaaaucaaaauacaaaugaaacauugugua

SEQ ID NO: 163722 - RNA, 64 nt, Homo Sapiens
auugaaacuggaccccuauccuucacgauauacaaaaaucaacucaagauggauuaaagacuua

SEQ ID NO: 163723 - RNA, 64 nt, Homo Sapiens
ucugaauggguauuaucagaauggguauuauuaaaaaaucaaaacauagaugcuagugaggcug

SEQ ID NO: 163724 - RNA, 64 nt, Homo Sapiens
auagaaaauauaaagaaucccucaaguugaaaaaaaaaucaauuuaaaggggagaaaacuucag

SEQ ID NO: 163725 - RNA, 64 nt, Homo Sapiens
uaauacaauuauuauuugucaaucaaauauuaauaaaaucaaagaugagcaggucucuuuguug

SEQ ID NO: 163726 - RNA, 64 nt, Homo Sapiens
uagaaacaauuuugaaagccccuugaggaaaauaaaaaucaagaagaacacuuuucucccuuuu

SEQ ID NO: 163727 - RNA, 64 nt, Homo Sapiens
cuauauaauggagaagaauuugaaaaugcacaaaaaaaucaaucuacauuaucagaaccugcag

SEQ ID NO: 163728 - RNA, 64 nt, Homo Sapiens
uaauuuauuuauguaagaaagcuguuaaauccuaaaaaucaauaaagcagaaaggguuuuuuca

SEQ ID NO: 163729 - RNA, 64 nt, Homo Sapiens
agauguaucuucaaaaagugaaucaugacugaaaaaaaucaauccaucucaaagaagucuguua

SEQ ID NO: 163730 - RNA, 64 nt, Homo Sapiens
aaaacuguucuaggucgacugcggggacagaacaaaaaucaaaacaaagaaccugcucugauga

SEQ ID NO: 163731 - RNA, 64 nt, Homo Sapiens
uuauaggaaugacucuggcugcuauguggggaauaaaaucaagacgugcaagaguggaagaaga

SEQ ID NO: 163732 - RNA, 64 nt, Homo Sapiens
gaaaaaaauaaacuuucaaaauucuggauguauaaaaaucaaugaacuguugguuauuuguguu

SEQ ID NO: 163733 - RNA, 64 nt, Homo Sapiens
uguaguuguuuuggcgauaguaauuguuucaaaaaaaaucaaacuuaccagcauauauaguauu

SEQ ID NO: 163734 - RNA, 64 nt, Homo Sapiens
ucuuuuuucuccugugguggauaaaucugccuuaaaaaucaauguaacuugggggcugggggcu

SEQ ID NO: 163735 - RNA, 64 nt, Homo Sapiens
ugggaauacagagaaacaggauuguuugagaaccaaaaucaagaggaacagaaaucuuaacuug

SEQ ID NO: 163736 - RNA, 64 nt, Homo Sapiens
aaauaauaaacuucauuuuaacaaaaaaaaucaaaaaaucaaaauuuauuuaaaaaaacaaaaa

SEQ ID NO: 163737 - RNA, 64 nt, Homo Sapiens
aaucaaaaaaauaauaaacuaacaaaaaacaaaaaaaaucaaaacaaacaguuuuauuuaaaaa

SEQ ID NO: 163738 - RNA, 64 nt, Homo Sapiens
gaugacccuccucuggggccuacacagcagcagcaaaaucaaggcucaaggaccccaucaagug

SEQ ID NO: 163739 - RNA, 64 nt, Homo Sapiens
auccauaacuacuauucuuuuuucacuguuuucuaaaaucaaaaaggguuuguaacuuuuuacu

SEQ ID NO: 163740 - RNA, 64 nt, Homo Sapiens
uuaauuguaaagauaaggaaugcauuaugggucaaaaaucaaacauuccucucauguuauguau

SEQ ID NO: 163741 - RNA, 64 nt, Homo Sapiens
aaauaaauuugcaguuaagaaaaucaaaaauguuaaaaucaauguuucuuguauuuauauguua

SEQ ID NO: 163742 - RNA, 64 nt, Homo Sapiens
auguuaaaaucaaugaaauauguauuuauauguuaaaaucaaaaucugauuuauuuaauuuucu

SEQ ID NO: 163743 - RNA, 64 nt, Homo Sapiens
cauuuuauucucggcaacauaugugagauguaugaaaaucaacuccaauuuuaccuuuuacaca

SEQ ID NO: 163744 - RNA, 62 nt, Homo Sapiens
caugaugcuugacagugugauuccuuucuucuaaaaucaaagacuuuauugagcaaauguga

SEQ ID NO: 163745 - RNA, 64 nt, Homo Sapiens
auuauaaacaagaaugaagggugguaauaagggaaaaaucaaguacuuaaauguuauguauaug

SEQ ID NO: 163746 - RNA, 64 nt, Homo Sapiens
aauaccuuagaagguauuaaguaauauaauacacaaaaucaaaucuugaaggaaaaauucaaua

SEQ ID NO: 163747 - RNA, 64 nt, Homo Sapiens; identical to SEQ ID NO: 85756

SEQ ID NO: 163748 - RNA, 64 nt, Homo Sapiens; identical to SEQ ID NO: 85757

SEQ ID NO: 163749 - RNA, 64 nt, Homo Sapiens; identical to SEQ ID NO: 85758

SEQ ID NO: 163750 - RNA, 64 nt, Homo Sapiens; identical to SEQ ID NO: 85759

SEQ ID NO: 163751 - RNA, 64 nt, Homo Sapiens; identical to SEQ ID NO: 85760

SEQ ID NO: 163752 - RNA, 64 nt, Homo Sapiens; identical to SEQ ID NO: 85761

SEQ ID NO: 163753 - RNA, 64 nt, Homo Sapiens; identical to SEQ ID NO: 85762

SEQ ID NO: 163754 - RNA, 64 nt, Homo Sapiens; identical to SEQ ID NO: 85763

SEQ ID NO: 163755 - RNA, 64 nt, Homo Sapiens; identical to SEQ ID NO: 85764

SEQ ID NO: 163756 - RNA, 64 nt, Homo Sapiens; identical to SEQ ID NO: 85765

SEQ ID NO: 163757 - RNA, 64 nt, Homo Sapiens; identical to SEQ ID NO: 85766

SEQ ID NO: 163758 - RNA, 64 nt, Homo Sapiens; identical to SEQ ID NO: 85767

SEQ ID NO: 163759 - RNA, 64 nt, Homo Sapiens; identical to SEQ ID NO: 85768

SEQ ID NO: 163760 - RNA, 64 nt, Homo Sapiens; identical to SEQ ID NO: 85769

SEQ ID NO: 163761 - RNA, 64 nt, Homo Sapiens; identical to SEQ ID NO: 106040

SEQ ID NO: 163762 - RNA, 64 nt, Homo Sapiens; identical to SEQ ID NO: 106041

SEQ ID NO: 163763 - RNA, 64 nt, Homo Sapiens; identical to SEQ ID NO: 106042

SEQ ID NO: 163764 - RNA, 64 nt, Homo Sapiens; identical to SEQ ID NO: 106043

SEQ ID NO: 163765 - RNA, 64 nt, Homo Sapiens; identical to SEQ ID NO: 106044

SEQ ID NO: 163766 - RNA, 64 nt, Homo Sapiens; identical to SEQ ID NO: 106045

SEQ ID NO: 163767 - RNA, 64 nt, Homo Sapiens; identical to SEQ ID NO: 106046

SEQ ID NO: 163768 - RNA, 64 nt, Homo Sapiens; identical to SEQ ID NO: 106047

SEQ ID NO: 163769 - RNA, 64 nt, Homo Sapiens; identical to SEQ ID NO: 106048

SEQ ID NO: 163770 - RNA, 64 nt, Homo Sapiens; identical to SEQ ID NO: 106049

SEQ ID NO: 163771 - RNA, 64 nt, Homo Sapiens; identical to SEQ ID NO: 106050

SEQ ID NO: 163772 - RNA, 64 nt, Homo Sapiens; identical to SEQ ID NO: 106051

SEQ ID NO: 163773 - RNA, 64 nt, Homo Sapiens; identical to SEQ ID NO: 106052

SEQ ID NO: 163774 - RNA, 64 nt, Homo Sapiens; identical to SEQ ID NO: 106053

SEQ ID NO: 163775 - RNA, 64 nt, Homo Sapiens; identical to SEQ ID NO: 106054

SEQ ID NO: 163776 - RNA, 64 nt, Homo Sapiens; identical to SEQ ID NO: 106055

SEQ ID NO: 163777 - RNA, 64 nt, Homo Sapiens; identical to SEQ ID NO: 106056

SEQ ID NO: 163778 - RNA, 64 nt, Homo Sapiens; identical to SEQ ID NO: 106057

SEQ ID NO: 163779 - RNA, 64 nt, Homo Sapiens; identical to SEQ ID NO: 106058

SEQ ID NO: 163780 - RNA, 64 nt, Homo Sapiens; identical to SEQ ID NO: 106059

SEQ ID NO: 163781 - RNA, 64 nt, Homo Sapiens; identical to SEQ ID NO: 106060

SEQ ID NO: 163782 - RNA, 64 nt, Homo Sapiens; identical to SEQ ID NO: 106061

SEQ ID NO: 163783 - RNA, 64 nt, Homo Sapiens; identical to SEQ ID NO: 106062

SEQ ID NO: 163784 - RNA, 64 nt, Homo Sapiens; identical to SEQ ID NO: 106063

SEQ ID NO: 163785 - RNA, 64 nt, Homo Sapiens; identical to SEQ ID NO: 106064

SEQ ID NO: 163786 - RNA, 64 nt, Homo Sapiens; identical to SEQ ID NO: 106065

SEQ ID NO: 163787 - RNA, 64 nt, Homo Sapiens; identical to SEQ ID NO: 106066

SEQ ID NO: 163788 - RNA, 64 nt, Homo Sapiens; identical to SEQ ID NO: 106067

SEQ ID NO: 163789 - RNA, 64 nt, Homo Sapiens; identical to SEQ ID NO: 106068

SEQ ID NO: 163790 - RNA, 64 nt, Homo Sapiens; identical to SEQ ID NO: 106069

SEQ ID NO: 163791 - RNA, 64 nt, Homo Sapiens; identical to SEQ ID NO: 106070

SEQ ID NO: 163792 - RNA, 64 nt, Homo Sapiens; identical to SEQ ID NO: 106071

SEQ ID NO: 163793 - RNA, 64 nt, Homo Sapiens; identical to SEQ ID NO: 106072

SEQ ID NO: 163794 - RNA, 64 nt, Homo Sapiens; identical to SEQ ID NO: 106073

SEQ ID NO: 163795 - RNA, 64 nt, Homo Sapiens; identical to SEQ ID NO: 106074

SEQ ID NO: 163796 - RNA, 64 nt, Homo Sapiens; identical to SEQ ID NO: 106075

SEQ ID NO: 163797 - RNA, 64 nt, Homo Sapiens; identical to SEQ ID NO: 106076

SEQ ID NO: 163798 - RNA, 64 nt, Homo Sapiens; identical to SEQ ID NO: 106077

SEQ ID NO: 163799 - RNA, 64 nt, Homo Sapiens; identical to SEQ ID NO: 106078

SEQ ID NO: 163800 - RNA, 64 nt, Homo Sapiens; identical to SEQ ID NO: 106079

SEQ ID NO: 163801 - RNA, 64 nt, Homo Sapiens; identical to SEQ ID NO: 106080

SEQ ID NO: 163802 - RNA, 64 nt, Homo Sapiens; identical to SEQ ID NO: 106081

SEQ ID NO: 163803 - RNA, 64 nt, Homo Sapiens; identical to SEQ ID NO: 106082

SEQ ID NO: 163804 - RNA, 64 nt, Homo Sapiens; identical to SEQ ID NO: 106083

SEQ ID NO: 163805 - RNA, 64 nt, Homo Sapiens; identical to SEQ ID NO: 106084

SEQ ID NO: 163806 - RNA, 64 nt, Homo Sapiens; identical to SEQ ID NO: 106085

SEQ ID NO: 163807 - RNA, 64 nt, Homo Sapiens; identical to SEQ ID NO: 106086

SEQ ID NO: 163808 - RNA, 64 nt, Homo Sapiens; identical to SEQ ID NO: 106087

SEQ ID NO: 163809 - RNA, 64 nt, Homo Sapiens; identical to SEQ ID NO: 106088

SEQ ID NO: 163810 - RNA, 64 nt, Homo Sapiens
uggagugggcagaggugcaagggggagggagccaacgccucaggggcauguggugagaggauga

SEQ ID NO: 163811 - RNA, 64 nt, Homo Sapiens
cauguggugagaggaugagggaugaggggagccuacgccucaggaaugccccaugcggugagag

SEQ ID NO: 163812 - RNA, 64 nt, Homo Sapiens; identical to SEQ ID NO: 85859

SEQ ID NO: 163813 - RNA, 64 nt, Homo Sapiens; identical to SEQ ID NO: 85860

SEQ ID NO: 163814 - RNA, 54 nt, Homo Sapiens; identical to SEQ ID NO: 85861

SEQ ID NO: 163815 - RNA, 64 nt, Homo Sapiens; identical to SEQ ID NO: 85862

SEQ ID NO: 163816 - RNA, 64 nt, Homo Sapiens; identical to SEQ ID NO: 85863

SEQ ID NO: 163817 - RNA, 64 nt, Homo Sapiens; identical to SEQ ID NO: 85864

SEQ ID NO: 163818 - RNA, 64 nt, Homo Sapiens; identical to SEQ ID NO: 85865

SEQ ID NO: 163819 - RNA, 64 nt, Homo Sapiens; identical to SEQ ID NO: 85866

SEQ ID NO: 163820 - RNA, 63 nt, Homo Sapiens; identical to SEQ ID NO: 85867

SEQ ID NO: 163821 - RNA, 64 nt, Homo Sapiens; identical to SEQ ID NO: 85868

SEQ ID NO: 163822 - RNA, 64 nt, Homo Sapiens; identical to SEQ ID NO: 85869

SEQ ID NO: 163823 - RNA, 64 nt, Homo Sapiens; identical to SEQ ID NO: 85870

SEQ ID NO: 163824 - RNA, 64 nt, Homo Sapiens; identical to SEQ ID NO: 85871

SEQ ID NO: 163825 - RNA, 64 nt, Homo Sapiens; identical to SEQ ID NO: 85872

SEQ ID NO: 163826 - RNA, 64 nt, Homo Sapiens
uugcuucuguugauuuuuuuaagcuggucaaauauuuucauaacauaagaaauaaccaaagaug

SEQ ID NO: 163827 - RNA, 64 nt, Homo Sapiens
uauaaaggagucuuaauguuuguugauuaaucuauuuucauauuccuauucaaagaccuuuucc

SEQ ID NO: 163828 - RNA, 64 nt, Homo Sapiens
guuacugaaccagcuaaaaauuuugcugauguauuuuucauauacuucucuccugacacgcaau

SEQ ID NO: 163829 - RNA, 64 nt, Homo Sapiens
uaacuauuugaacagucugcuuauaugagacaguuuuucauaguaucauuuguauaauuugauu

SEQ ID NO: 163830 - RNA, 64 nt, Homo Sapiens
uaaucccacugcauagaaauaacaagcguuaacauuuucauauuuuuuucuuucagucauuuuu

SEQ ID NO: 163831 - RNA, 64 nt, Homo Sapiens
uuaagccugucucuauuguuggaauuucaggucauuuucauaaauauuguugcaauaaauaucc

SEQ ID NO: 163832 - RNA, 64 nt, Homo Sapiens
uuuagugcuucaugaauauugguaucuuuguggcuuuucauauuuuaguguaucaugaauauuu

SEQ ID NO: 163833 - RNA, 64 nt, Homo Sapiens
aauguaugaaaaucaaccauaauaauaaggccgauuuucauauauuauggcaauacaacuguga

SEQ ID NO: 163834 - RNA, 64 nt, Homo Sapiens
ggaaugauuuaaauugaagucuucaauuaagaaauuuucauaauguuuugaagaaauagucucc

SEQ ID NO: 163835 - RNA, 64 nt, Homo Sapiens
gaagcacuuugcuauguagcaccuguuuucuucauuuucauaaucuaaaauauauuuuucucau

SEQ ID NO: 163836 - RNA, 64 nt, Homo Sapiens
augcacuauguaaacagacagaagaaaaacuuuuuuuucauaccuauagucaaggaccguagag

SEQ ID NO: 163837 - RNA, 64 nt, Homo Sapiens
guguuuauucuccaggcuaugaaaugcaccuagcuuuucauauugugugggugggaaucgguaa

SEQ ID NO: 163838 - RNA, 64 nt, Homo Sapiens
augcaaaacuauuuuuuacauaaaaggacaauuguuuucauaaauuauauaugugauuaauuuu

SEQ ID NO: 163839 - RNA, 64 nt, Homo Sapiens
uaggauaagaaucauuuuuauuauuugauauuuauuuucauauuauuagauguuauguuucaua

SEQ ID NO: 163840 - RNA, 64 nt, Homo Sapiens
auagguauaauugggucauaaugugaugccuugcuuuucauaaaaggauccuguaugguuauca

SEQ ID NO: 163841 - RNA, 64 nt, Homo Sapiens
ccuacagagcuaacuaauuaacauuaccaaaaguuuuucauauaaaacccauuccuauuuuugu

SEQ ID NO: 163842 - RNA, 64 nt, Homo Sapiens
auacucuuuguauacaaguguuuauuaguauugcuuuucauaauucugucucacugaaaaccuu

SEQ ID NO: 163843 - RNA, 64 nt, Homo Sapiens
ggauugggaauauguaaacucaacuggagauuuuuuuucauaaaaauuuauauaguuccagccc

SEQ ID NO: 163844 - RNA, 64 nt, Homo Sapiens
gcauauauauuuuuuugcaccugaaucacccagcuuuucauaagugguauguuuaauuggucau

SEQ ID NO: 163845 - RNA, 64 nt, Homo Sapiens
aaaguaacauaaagcuaguauucaauguagaguauuuucauauguuuuucacagcccguuacaa

SEQ ID NO: 163846 - RNA, 64 nt, Homo Sapiens
ggagaauaaauaacuguuuuguguugguuggugguuuucauaaucuuauuucuguacuggaacu

SEQ ID NO: 163847 - RNA, 64 nt, Homo Sapiens
aauuauucugcaauauuguaauucauaguuugacuuuucauaagcaaauaaaucccuaggaugu

SEQ ID NO: 163848 - RNA, 64 nt, Homo Sapiens
cuucugcaacugaaauuacauauugcaggagacauuuucauaucaucaaugugacauuuacacc

SEQ ID NO: 163849 - RNA, 64 nt, Homo Sapiens
cucaccauuccucuuggcuuggaaaggcuuuauuuuuucauauacauuucuagaaauauugcua

SEQ ID NO: 163850 - RNA, 64 nt, Homo Sapiens
ccuucuuucucuuucucucuuugaaaugugaugauuuucauauggacuggucagggcugcuuug

SEQ ID NO: 163851 - RNA, 64 nt, Homo Sapiens
gggguugaggccaccaguacaaugagaacauguguuuucauaaaaucagaauaguguaacacca

SEQ ID NO: 163852 - RNA, 64 nt, Homo Sapiens
gcuaaagaugguaaaaugacaguaaauaacuuauuuuucauauguaaaaaugaauguuuuuaua

SEQ ID NO: 163853 - RNA, 64 nt, Homo Sapiens
gcuaauacuucaguuggaaagcagccgaucccuguuuucauaaaguuguucuucaaagaagcaa

SEQ ID NO: 163854 - RNA, 64 nt, Homo Sapiens
uuagauauuuaauuucgcagauuuuuaaacuuuauuuucauaauuucugcuuaauguuuaaaau

SEQ ID NO: 163855 - RNA, 64 nt, Homo Sapiens
uuuauuuuaauaguaguaaaauacuuggaauaauuuuucauauucuugucauuaauauuauuuu

SEQ ID NO: 163856 - RNA, 64 nt, Homo Sapiens
auagauuugggucauuuagaagccugacaacucauuuucauauuguaaucuauguuuauaauac

SEQ ID NO: 163857 - RNA, 64 nt, Homo Sapiens
aucucaaugcaagccccaacuuucuuauccaacuuuuucauaguaagugcgaagacugagccag

SEQ ID NO: 163858 - RNA, 64 nt, Homo Sapiens
aguuugguuuaaaagaacuauaucuauauguauauuuucauauauaugacagaacaagaauaug

SEQ ID NO: 163859 - RNA, 64 nt, Homo Sapiens
uauaauuuaaaaauguauagccugccaaauguuguuuucauaaccaugauauuguuuugaaaaa

SEQ ID NO: 163860 - RNA, 64 nt, Homo Sapiens
gcagagggcaaagucauugaaucucuuaugccaguuuucauaaaacccaaaccacauaugaaaa

SEQ ID NO: 163861 - RNA, 64 nt, Homo Sapiens
uuguucagggaugggacaaagccuucuucaauccuuuucauacuacuuaaugauuuuggugcag

SEQ ID NO: 163862 - RNA, 64 nt, Homo Sapiens
ucuaccauuaguucauauguuuuuguagcacaucuuuucauaacauacugaaauuuuaauguuu

SEQ ID NO: 163863 - RNA, 64 nt, Homo Sapiens
accuaccucuuaggacucagcuucagugauucuguuuucauaggcuuuuuaaagcccuuuucag

SEQ ID NO: 163864 - RNA, 64 nt, Homo Sapiens
gaagcugcuauaucaucuuuauuuauucaggguauuuucauauuggaagccuuggcuagucugc

SEQ ID NO: 163865 - RNA, 64 nt, Homo Sapiens
aaauauuucugggcuuccagcuuugguuuuguuauuuucauaacuguacacaacuuagaacaga

SEQ ID NO: 163866 - RNA, 64 nt, Homo Sapiens
aagcuaaauauuuuauauguuuucaaagauuauuuuuucauauuaauagguuguuuaucuuuuu

SEQ ID NO: 163867 - RNA, 64 nt, Homo Sapiens
uuagaaacacuguuuuuuuuaaguaccguuuuuauuuucauaacacuaauaauacacugggauu

SEQ ID NO: 163868 - RNA, 64 nt, Homo Sapiens
augauaguuuccauaacagaaccuuuucauaaccuuuucauaaccauaacaugauaguuuccua

SEQ ID NO: 163869 - RNA, 64 nt, Homo Sapiens
cuuuucauaacaugauaguuauaguuuccuaaccuuuucauaacuauuagcuuuucauaacaug

SEQ ID NO: 163870 - RNA, 64 nt, Homo Sapiens
augauaguuuccuaaccuuugauucaauauuagcuuuucauaacaaguucaguuguuuuuaaaa

SEQ ID NO: 163871 - RNA, 64 nt, Homo Sapiens
auuucuuaacccaagugacgauucacuuugacacuuuucauaucaaagguuuaaaacuaguuag

SEQ ID NO: 163872 - RNA, 64 nt, Homo Sapiens
aagacacauuaucuucuggauuauuagcccugcauuuucauaggauucauucauacuuaaaaau

SEQ ID NO: 163873 - RNA, 64 nt, Homo Sapiens
ugggaauguaacaauaucuugaugcuuaucuagguuuucauaaauaccuaggauucucauuaua

SEQ ID NO: 163874 - RNA, 64 nt, Homo Sapiens
aagcuuucgaaaucugguguauuuuacauucucuuuuucauacuuaaaaauauauuagugagac

SEQ ID NO: 163875 - RNA, 64 nt, Homo Sapiens
aucuugguugaaaauaaaaagaucacuuucucaguuuucauaaguauuaugucucuucugagcu

SEQ ID NO: 163876 - RNA, 64 nt, Homo Sapiens
ggggacuuuucuuaaaccuucaguuaugauuuuuuuuucauacacuuauuggaacucugcuuga

SEQ ID NO: 163877 - RNA, 64 nt, Homo Sapiens
uuuuguuggggacagagcacugcuuuaaauuauauuuucauauguacugugucugugaaaacug

SEQ ID NO: 163878 - RNA, 64 nt, Homo Sapiens
uaaauaacauacguaaagguauaugcuaaaaauauuuucauauuaagaaagaauguuuaacaua

SEQ ID NO: 163879 - RNA, 64 nt, Homo Sapiens
ugaaauagaauaagaaguaaaauacaucagcagauuuucauacuaguauguuguaaugcugucu

SEQ ID NO: 163880 - RNA, 64 nt, Homo Sapiens
guuuacaauuuggggacaaaaaggcaggcuucauuuuucauauguuugaugaaaacuggcucaa

SEQ ID NO: 163881 - RNA, 64 nt, Homo Sapiens
ugugcugggucauguaaaauauuagacacuaauauuuucauagaaauuaggcuggagaaagaag

SEQ ID NO: 163882 - RNA, 64 nt, Homo Sapiens
gguauggaucguaaaauuuuaagcacuaaaaauuuuuucauaaccuuucauaauaaaguuuaau

SEQ ID NO: 163883 - RNA, 64 nt, Homo Sapiens
ucagcaaaauaguuuccuuauuucucauguaucauuuucauauaauuccaugguuucacuaaua

SEQ ID NO: 163884 - RNA, 64 nt, Homo Sapiens
uagaauaaaaaacugaaaccaagauucccaacguuuuucauagcagccgggcacacuuugguga

SEQ ID NO: 163885 - RNA, 64 nt, Homo Sapiens
gaaacguaggguguguauguacaggauaauagguuuuucauaaacuccugggaacccuaguucc

SEQ ID NO: 163886 - RNA, 64 nt, Homo Sapiens
aauauacugguauagcuucccugugguccuguuuuuuucauaacgguuuugugccugcuuuuug

SEQ ID NO: 163887 - RNA, 64 nt, Homo Sapiens
gcacugauuauuucagcaaaagaaaucuaguauguuuucauacaucugauguauaaauuugcug

SEQ ID NO: 163888 - RNA, 64 nt, Homo Sapiens
uugcugaacuuugaguuaguuuucuuaagauaauuuuucauauuaagaaaauuuuccuuuucua

SEQ ID NO: 163889 - RNA, 64 nt, Homo Sapiens
uguucagacagagccuauuaaucacuaucuacauuuuucauaugccagcccauauacagaaacu

SEQ ID NO: 163890 - RNA, 64 nt, Homo Sapiens
aaacugauaaauauauauguuuauggagaguauauuuucauaugauacgaacuauuguuaugcu

SEQ ID NO: 163891 - RNA, 64 nt, Homo Sapiens
uaguggaagguuucacuaagacaugauauuugacuuuucauaagaguugaucuggaugaguuau

SEQ ID NO: 163892 - RNA, 64 nt, Homo Sapiens
uaguggaagguuucacuaagaaaugguauuugacuuuucauaaggguugaucuagaugaguuau

SEQ ID NO: 163893 - RNA, 64 nt, Homo Sapiens
cagucaaaauaauaaaacuaaaacuuauugcauauuuucauaauuuucacucauuaccuagagu

SEQ ID NO: 163894 - RNA, 64 nt, Homo Sapiens
cuucuuaaaaugugaaaaucaguauuauugagucuuuucauacaagcauuuguuuuugucuggu

SEQ ID NO: 163895 - RNA, 64 nt, Homo Sapiens
aauuaaaugcuuuaagaaauaauuaugaacauuuuuuucauaaauguaagaacauacauuuuga

SEQ ID NO: 163896 - RNA, 64 nt, Homo Sapiens
gcagaauugauccuguggcuccucaggaauagauuuuucauaaaucagaaguacgugaguuguu

SEQ ID NO: 163897 - RNA, 64 nt, Homo Sapiens
gccauuggucauaaccagacagaauuuggaaacauuuucauaaagcuccauggagaguuuuaaa

SEQ ID NO: 163898 - RNA, 64 nt, Homo Sapiens
auuuaaaagaagaucgguuuuuaauaauuuuuuauuuucauaggaugaaguuagagaaaauauu

SEQ ID NO: 163899 - RNA, 64 nt, Homo Sapiens
aaaugucauuacaguaugaaauauauuguaauucuuuucauaggcuagugguggauuccaugac

SEQ ID NO: 163900 - RNA, 64 nt, Homo Sapiens
uguauaaucagaauuucaauaauacuuccaauuuuuuucauaguuagaauucacugagaauaau

SEQ ID NO: 163901 - RNA, 64 nt, Homo Sapiens
ccccgucccaaccaucucugucaaaaauauaccuuuuucauaugauauucugagcuaaucugau

SEQ ID NO: 163902 - RNA, 64 nt, Homo Sapiens
uuaauuucaagauagcagucaauucgauaaggcauuuucauagaggaaaguuuacagaaacagu

SEQ ID NO: 163903 - RNA, 64 nt, Homo Sapiens
uuucaaguaccaaaacguugaauugaugaugcaguuuucauauaucgagauguucgcucgugca

SEQ ID NO: 163904 - RNA, 64 nt, Homo Sapiens
uugugguaauauaguaaguuuuuuuagaagacaauuuucauaacuugauaaauuauaguuuugu

SEQ ID NO: 163905 - RNA, 64 nt, Homo Sapiens
aaaugugcugcauugccgaguucuuauuuucaccuuuucauaaucccaacuacaauaacaagaa

SEQ ID NO: 163906 - RNA, 64 nt, Homo Sapiens
guggcucccuugcuccaggaacugaacgaggcccuuuucauaccuuaaauauauucugcacaac

SEQ ID NO: 163907 - RNA, 64 nt, Homo Sapiens
uuuugaaaaggugcucaagcucugacauuuuugguuuucauagucgugaaguauuuaucauuug

SEQ ID NO: 163908 - RNA, 64 nt, Homo Sapiens
agagggugaaaaaaaaaaaaaagauugauaguauuuuucauaaugaaaaaacugaagagauacg

SEQ ID NO: 163909 - RNA, 64 nt, Homo Sapiens
uuugcaauuagguuuuugacuguuaaaauggauauuuucauaaaaaugguguucugaauuuugc

SEQ ID NO: 163910 - RNA, 64 nt, Homo Sapiens
uaacccuuuuggguuauccacuuaaauuuagguauuuucauauuacucagguaaagauggaaau

SEQ ID NO: 163911 - RNA, 64 nt, Homo Sapiens
uaacguuuuauuggagcauacagauguccaccuguuuucauaaauauccuccaugggcuaaauc

SEQ ID NO: 163912 - RNA, 64 nt, Homo Sapiens
uguaguccauucuaauaauugagauugguauuaguuuucauagcuuuuuguuuauugaauuuaa

SEQ ID NO: 163913 - RNA, 64 nt, Homo Sapiens
guugaauuugccuuuuaggacggcaaaauauauauuuucauaaugacauuucucaguaacuacc

SEQ ID NO: 163914 - RNA, 64 nt, Homo Sapiens
uuuuugcauuuuaccuuucauuuaaaggacuguauuuucauacuuguuaaacuuuauugccaca

SEQ ID NO: 163915 - RNA, 64 nt, Homo Sapiens
gcaaggacaucauauguuucagucaguaggaucauuuucauaaaaaugcauucuacugcgggac

SEQ ID NO: 163916 - RNA, 64 nt, Homo Sapiens
uuaguguaguuagaagaauuguauagucaucacuuuuucauauugcauauccuauugaccauug

SEQ ID NO: 163917 - RNA, 64 nt, Homo Sapiens
gcaacagaugguuaaacugauuaggaaauuaaguuuuucauaagaaauacauuuccuggguaac

SEQ ID NO: 163918 - RNA, 64 nt, Homo Sapiens
ggacuuuuguauuauacaagaaauagacuugacuuuuucauaauuuuuuauguaaccuguuaca

SEQ ID NO: 163919 - RNA, 64 nt, Homo Sapiens
guucaaaucuguauuuuuguacuugucuugaucuuuuucauaguaaggaccaguuuuucauggu

SEQ ID NO: 163920 - RNA, 64 nt, Homo Sapiens
ugccugaaaagagagauggucaggucagaguuucuuuucauaacuugcugaugggauuuagggc

SEQ ID NO: 163921 - RNA, 64 nt, Homo Sapiens
ugauuggcuggcuauaaccaccccaguuaaaccauuuucauaauuaguagugccagcaauagug

SEQ ID NO: 163922 - RNA, 64 nt, Homo Sapiens
uucucaaaaacaucaauguccaaacaucuaccuuuuuucauaggaguagacacuagcaagcugg

SEQ ID NO: 163923 - RNA, 64 nt, Homo Sapiens
aguaaauuauuaagcagacuggaaaagugauguauuuucauagugaccuguguuucacuuaaug

SEQ ID NO: 163924 - RNA, 64 nt, Homo Sapiens
uuuuuauuucugauuucauaauucagaacuaaauuuuucauagaaguguugagccaugcuacag

SEQ ID NO: 163925 - RNA, 64 nt, Homo Sapiens
auuuguauuuuuaaaugaaaaaaaauucuuaauauuuucauaaaacuuuuauaauucccauccu

SEQ ID NO: 163926 - RNA, 64 nt, Homo Sapiens
auuuuaagauacauacuaucagaauaaagaauauuuuucauaauucuuuccugacauuguuuuc

SEQ ID NO: 163927 - RNA, 64 nt, Homo Sapiens
cuagaauguuagacacauuuagcaaaauugaauuuuuucauaaauuuucauaucaccaauuugu

SEQ ID NO: 163928 - RNA, 64 nt, Homo Sapiens
accaauuuguagcaaaauuggcaaauaaagggaguuuucauaucuaaaacuuacucagcugguu

SEQ ID NO: 163929 - RNA, 64 nt, Homo Sapiens
uuugaagcugucuuugguaccgucuuuucauaaauuuucauauuggaaaauaaccacuccuggu

SEQ ID NO: 163930 - RNA, 64 nt, Homo Sapiens
uuuucauauuuuugaagcugcacuccuggucgucuuuucauaaauaguagaaauggaaaauaac

SEQ ID NO: 163931 - RNA, 64 nt, Homo Sapiens
uauaauuagucauuuacauaaaugucacugaauuuuuucauauuauggggaaauaguuauagaa

SEQ ID NO: 163932 - RNA, 64 nt, Homo Sapiens
ugccuagauaauggggaaaagcauuaucauaaaauuuucauauauuuuaacuuuauacucaguu

SEQ ID NO: 163933 - RNA, 64 nt, Homo Sapiens
ugucugacauuuccaugaaacaugcuuccuuagcuuuucauaguaagccagaccuucaguucaa

SEQ ID NO: 163934 - RNA, 64 nt, Homo Sapiens
uguucugccacacaaagaacaauauuuuauuauuuuuucauagaaguaaagggaaauaucagac

SEQ ID NO: 163935 - RNA, 64 nt, Homo Sapiens
aaaaauuaauaaacuuuaguaacaaucugaagucuuuucauaaagaaagggaucauuuaugaau

SEQ ID NO: 163936 - RNA, 64 nt, Homo Sapiens
uaaaaaaaaauucuuagcaaaauguuacuaauauuuuucauauccuucucauaguaaaaagcug

SEQ ID NO: 163937 - RNA, 64 nt, Homo Sapiens
uugagaacuagauaacaugguaacagagaauugauuuucauaugaaucuuaacuccacaguaaa

SEQ ID NO: 163938 - RNA, 64 nt, Homo Sapiens
aauucuugguuugccuaauucguuuuccuauuucuuuucauacaaauaaaggauaccuggauuu

SEQ ID NO: 163939 - RNA, 64 nt, Homo Sapiens
cugucaguuuuauuaccuuauauacaaaucuucauuuucauacauaguacaauguaaauauaua

SEQ ID NO: 163940 - RNA, 64 nt, Homo Sapiens
auaccacaauuaauauuuucaauguguaaauaucuuuucauaauuuuuccuacguauacacaaa

SEQ ID NO: 163941 - RNA, 64 nt, Homo Sapiens
ucagagucaucagcaaacuguccaaguaggcuaggcuccagauuuaugaggaaagaaagggaca

SEQ ID NO: 163942 - RNA, 64 nt, Homo Sapiens
uguuuuuccagggcugcugauccuuuuccagauagcuccagaguaugaugaccccagccccauc

SEQ ID NO: 163943 - RNA, 64 nt, Homo Sapiens
gauggggaugccgggcuccacuccuuccgcugcggcuccagauaccuccaccagaaagggggag

SEQ ID NO: 163944 - RNA, 64 nt, Homo Sapiens
uagggcccagcacuuucaucacaucgggucuggugcuccagacccguggcccgugggagcaguu

SEQ ID NO: 163945 - RNA, 64 nt, Homo Sapiens
gccaaguauucguguaaauuaaguaacuaaaguagcuccagaaugcagggcuuugaucauucaa

SEQ ID NO: 163946 - RNA, 64 nt, Homo Sapiens
gccugcauuugcaauggaaucaaauuuaaagacugcuccagauauuuuuuaaacaaugugaucu

SEQ ID NO: 163947 - RNA, 64 nt, Homo Sapiens
gagacucagugucuaagucucaacaucuucaucagcuccagacugauaaagcuggcuguuaucu

SEQ ID NO: 163948 - RNA, 64 nt, Homo Sapiens
acggcugaccauuucugcucgcuccgacaggccugcuccagagccuagucccggcauccugaug

SEQ ID NO: 163949 - RNA, 64 nt, Homo Sapiens
guaccguggcccagacugaucagugcaagcugcugcuccagagcccugggagguggucgcccug

SEQ ID NO: 163950 - RNA, 64 nt, Homo Sapiens
auaccguggcccaggugguacggugcaagcugcugcuccagagcgcagggaggcagucgcccug

SEQ ID NO: 163951 - RNA, 64 nt, Homo Sapiens
cugcagucacggcugccaguuauggcuaugacgagcuccagauguucugguucucacacagauc

SEQ ID NO: 163952 - RNA, 62 nt, Homo Sapiens
ccuguuccucacagucaagcucugguagccuugcuccagaaguuuugucugcuuagcauuga

SEQ ID NO: 163953 - RNA, 64 nt, Homo Sapiens
uuccuaaccuaguaaaauguuccucaagcuguaggcuccagagccugacuugaacgauggcuuc

SEQ ID NO: 163954 - RNA, 64 nt, Homo Sapiens
gugccgguacugaagaugcuuucuuccucccccugcuccagaagaguagcaaacuguacauucc

SEQ ID NO: 163955 - RNA, 64 nt, Homo Sapiens
ggggaugacaugcacucagcaagccacacucugggcuccagagucagcugccuccgcgugauca

SEQ ID NO: 163956 - RNA, 64 nt, Homo Sapiens
auagcuucaccccaaucccagagugcaagccccugcuccagaaggaaaagcagcucuccccuca

SEQ ID NO: 163957 - RNA, 64 nt, Homo Sapiens
agccagcuccacugcccaggcccccaagagggcagcuccagaagcugcccagggcuccgggacc

SEQ ID NO: 163958 - RNA, 64 nt, Homo Sapiens
aacgccaccuuacacucugcaggcugcagcggcagcuccagauggccuccugagcuggacgacc

SEQ ID NO: 163959 - RNA, 64 nt, Homo Sapiens
augcauaaucagcgcccuggcgugccuuucucuggcuccagaaucacuccagaauccacaaagc

SEQ ID NO: 163960 - RNA, 64 nt, Homo Sapiens
ugcacuggguguggccccgcgcuccuaaacccccgcuccagaucagaggaugcagaggggugcu

SEQ ID NO: 163961 - RNA, 64 nt, Homo Sapiens
gaggaugcagaggggugcuguguccugccucucugcuccagagagccccaccacacuccccgcc

SEQ ID NO: 163962 - RNA, 64 nt, Homo Sapiens
aaaaaaugcaauuuucuggccacaagggcauagugcaguucacuuacguguugauguaguuuau

SEQ ID NO: 163963 - RNA, 64 nt, Homo Sapiens
ugaauugcuuaaguauaauuuauagaauuucagugcaguucauucuuaauggaaaaucugaaac

SEQ ID NO: 163964 - RNA, 64 nt, Homo Sapiens
uagguguuuaauuuucacucuucauguucaauuagcaguucaaauuaaagaagaugguuauugg

SEQ ID NO: 163965 - RNA, 64 nt, Homo Sapiens
gccacuaccaugcuguccauggaaggaauaaucagcaguucaguugucacaagccgcccuugaa

SEQ ID NO: 163966 - RNA, 64 nt, Homo Sapiens
acaaaacaaaacaaaaagucagaauaucaccauugcaguucaaauaaacacaaauuugcugcac

SEQ ID NO: 163967 - RNA, 64 nt, Homo Sapiens
auuuucaccauuuaaacacaagcaugauaaaggggcaguucacaguuuuauauuauaacucuga

SEQ ID NO: 163968 - RNA, 64 nt, Homo Sapiens
uggugcaggggcaauuaccauggcagcugcucaagcaguucaggcuacagcucagguaaaaagu

SEQ ID NO: 163969 - RNA, 64 nt, Homo Sapiens
uuagucuuucuauguuucugcauccagauagagugcaguucaugagggagggggcgggggacug

SEQ ID NO: 163970 - RNA, 64 nt, Homo Sapiens
uaauugucacagcgucgccacauucccaugagcagcaguucauuagcuaccgaagucacccagc

SEQ ID NO: 163971 - RNA, 64 nt, Homo Sapiens
gagaauuuggggcucucuucaaugguuucucuuugcaguucacaucuucaucuauuccuguacu

SEQ ID NO: 163972 - RNA, 64 nt, Homo Sapiens
caauucuccugccucagccuuccgccaccucaaggcaguucaaggaucucggcucacuucagcc

SEQ ID NO: 163973 - RNA, 64 nt, Homo Sapiens
acacugucaauguuaacauccagucucaucuacggcaguucauuuuccaagaaauuaagcauaa

SEQ ID NO: 163974 - RNA, 64 nt, Homo Sapiens
guguauauuuguuugucaggcguuguguugaggagcaguucacgcacuggcugugucuauuccu

SEQ ID NO: 163975 - RNA, 64 nt, Homo Sapiens
ucugcccaggugucucuguuugcugcccaaggcagcaguucaugucucguccauguccauguuc

SEQ ID NO: 163976 - RNA, 64 nt, Homo Sapiens
aauaaacuguguuuacucaggugaaggugaaagugcaguucaguagcucuuugaaauagucugu

SEQ ID NO: 163977 - RNA, 64 nt, Homo Sapiens
accacccuagucccuucccccuaggguggcccuugcaguucagcggaagcaccccaugccaaag

SEQ ID NO: 163978 - RNA, 64 nt, Homo Sapiens; identical to SEQ ID NO: 81090

SEQ ID NO: 163979 - RNA, 64 nt, Homo Sapiens; identical to SEQ ID NO: 81091

SEQ ID NO: 163980 - RNA, 64 nt, Homo Sapiens; identical to SEQ ID NO: 81092

SEQ ID NO: 163981 - RNA, 64 nt, Homo Sapiens; identical to SEQ ID NO: 81093

SEQ ID NO: 163982 - RNA, 64 nt, Homo Sapiens; identical to SEQ ID NO: 81094

SEQ ID NO: 163983 - RNA, 64 nt, Homo Sapiens; identical to SEQ ID NO: 81095

SEQ ID NO: 163984 - RNA, 64 nt, Homo Sapiens; identical to SEQ ID NO: 81096

SEQ ID NO: 163985 - RNA, 64 nt, Homo Sapiens; identical to SEQ ID NO: 81097

SEQ ID NO: 163986 - RNA, 64 nt, Homo Sapiens; identical to SEQ ID NO: 81098

SEQ ID NO: 163987 - RNA, 64 nt, Homo Sapiens; identical to SEQ ID NO: 81099

SEQ ID NO: 163988 - RNA, 64 nt, Homo Sapiens; identical to SEQ ID NO: 81100

SEQ ID NO: 163989 - RNA, 64 nt, Homo Sapiens; identical to SEQ ID NO: 81101

SEQ ID NO: 163990 - RNA, 64 nt, Homo Sapiens; identical to SEQ ID NO: 81102

SEQ ID NO: 163991 - RNA, 64 nt, Homo Sapiens; identical to SEQ ID NO: 81103

SEQ ID NO: 163992 - RNA, 64 nt, Homo Sapiens; identical to SEQ ID NO: 81104

SEQ ID NO: 163993 - RNA, 64 nt, Homo Sapiens; identical to SEQ ID NO: 81105

SEQ ID NO: 163994 - RNA, 64 nt, Homo Sapiens; identical to SEQ ID NO: 81106

SEQ ID NO: 163995 - RNA, 64 nt, Homo Sapiens; identical to SEQ ID NO: 81107

SEQ ID NO: 163996 - RNA, 64 nt, Homo Sapiens; identical to SEQ ID NO: 81108

SEQ ID NO: 163997 - RNA, 64 nt, Homo Sapiens; identical to SEQ ID NO: 81109

SEQ ID NO: 163998 - RNA, 64 nt, Homo Sapiens; identical to SEQ ID NO: 81110

SEQ ID NO: 163999 - RNA, 64 nt, Homo Sapiens; identical to SEQ ID NO: 81111

SEQ ID NO: 164000 - RNA, 64 nt, Homo Sapiens; identical to SEQ ID NO: 81112

SEQ ID NO: 164001 - RNA, 64 nt, Homo Sapiens; identical to SEQ ID NO: 81113

SEQ ID NO: 164002 - RNA, 64 nt, Homo Sapiens; identical to SEQ ID NO: 81114

SEQ ID NO: 164003 - RNA, 64 nt, Homo Sapiens; identical to SEQ ID NO: 81115

SEQ ID NO: 164004 - RNA, 64 nt, Homo Sapiens; identical to SEQ ID NO: 81116

SEQ ID NO: 164005 - RNA, 64 nt, Homo Sapiens; identical to SEQ ID NO: 81117

SEQ ID NO: 164006 - RNA, 64 nt, Homo Sapiens; identical to SEQ ID NO: 81118

SEQ ID NO: 164007 - RNA, 64 nt, Homo Sapiens; identical to SEQ ID NO: 81119

SEQ ID NO: 164008 - RNA, 64 nt, Homo Sapiens; identical to SEQ ID NO: 81120

SEQ ID NO: 164009 - RNA, 64 nt, Homo Sapiens; identical to SEQ ID NO: 81121

SEQ ID NO: 164010 - RNA, 64 nt, Homo Sapiens; identical to SEQ ID NO: 81122

SEQ ID NO: 164011 - RNA, 64 nt, Homo Sapiens; identical to SEQ ID NO: 81123

SEQ ID NO: 164012 - RNA, 64 nt, Homo Sapiens; identical to SEQ ID NO: 81124

SEQ ID NO: 164013 - RNA, 64 nt, Homo Sapiens; identical to SEQ ID NO: 81125

SEQ ID NO: 164014 - RNA, 64 nt, Homo Sapiens; identical to SEQ ID NO: 81126

SEQ ID NO: 164015 - RNA, 64 nt, Homo Sapiens; identical to SEQ ID NO: 81127

SEQ ID NO: 164016 - RNA, 64 nt, Homo Sapiens; identical to SEQ ID NO: 81128

SEQ ID NO: 164017 - RNA, 64 nt, Homo Sapiens; identical to SEQ ID NO: 81129

SEQ ID NO: 164018 - RNA, 64 nt, Homo Sapiens; identical to SEQ ID NO: 81130

SEQ ID NO: 164019 - RNA, 64 nt, Homo Sapiens; identical to SEQ ID NO: 81131

SEQ ID NO: 164020 - RNA, 64 nt, Homo Sapiens; identical to SEQ ID NO: 81132

SEQ ID NO: 164021 - RNA, 64 nt, Homo Sapiens; identical to SEQ ID NO: 81133

SEQ ID NO: 164022 - RNA, 61 nt, Homo Sapiens
gcuggaaacccucccugacccccacccuggccccccguauccccagcccuuggcaacacug

SEQ ID NO: 164023 - RNA, 61 nt, Homo Sapiens
agauggaaggagaaaccucuucauuucauuucccccguagccuaaagagaauuacuuucau

SEQ ID NO: 164024 - RNA, 61 nt, Homo Sapiens
agcaggcaguucccaaguggaagaugcccaacccccguaguuguuauccaacauugcuuca

SEQ ID NO: 164025 - RNA, 61 nt, Homo Sapiens
cuuaaagagaaaaucuuuggacaaaguuaaacccccguaauucaucccaauucuaguuaga

SEQ ID NO: 164026 - RNA, 61 nt, Homo Sapiens
acuugcaacagucuuucaugauaugaggaugcccccguauuaccacucugauuauaguucu

SEQ ID NO: 164027 - RNA, 61 nt, Homo Sapiens
ccuugagagugcagcucggacccaccggcggcccccguagcagguggugugggugcucggg

SEQ ID NO: 164028 - RNA, 61 nt, Homo Sapiens
gugcuguguccacgcgcuaaggcgacccccucccccguacugacuucuccuauaagcgcuu

SEQ ID NO: 164029 - RNA, 61 nt, Homo Sapiens
gcaaugggguccacuucccccucuucagcaucccccguaccccacuuucugcugaaagaac

SEQ ID NO: 164030 - RNA, 61 nt, Homo Sapiens
cuagagcagugucacaagcuuccucagucaacccccguagcaaggaacagcauuucucugc

SEQ ID NO: 164031 - RNA, 61 nt, Homo Sapiens
ccuggcagcccuguugucuggcuggaucgggcccccguaguucuucucacugugaguggaa

SEQ ID NO: 164032 - RNA, 61 nt, Homo Sapiens
cugcugaacaaguagggcuggguccaccugacccccguaagucaggcuggugacuagcaga

SEQ ID NO: 164033 - RNA, 61 nt, Homo Sapiens
ccuggccugucugccccuuuuugcuuaauuucccccguauucuuuuaaauaaaaaguuaaa

SEQ ID NO: 164034 - RNA, 61 nt, Homo Sapiens
aggggcaugacuguuucccaacugccccagccccccguagcccuggcacagcggggcgugc

SEQ ID NO: 164035 - RNA, 61 nt, Homo Sapiens
uuguaaugaccaugagcaaucucacuuuccacccccguauuagagagcagaucucuuauuc

SEQ ID NO: 164036 - RNA, 61 nt, Homo Sapiens
ugccgccugucacuucgccagucuccuuccucccccguaucauguggaauuucccgugaac

SEQ ID NO: 164037 - RNA, 61 nt, Homo Sapiens
aacccuuggaucacaugggggcuucugggaacccccguauucuucccccucacccaagggc

SEQ ID NO: 164038 - RNA, 61 nt, Homo Sapiens
gauuuccacucugcugucacaaacauuuuuccccccguaaaaugucuuaaugcuguccuac

SEQ ID NO: 164039 - RNA, 61 nt, Homo Sapiens
uugcuccagccugacaacagccugagaaauccccccguaacuuauuaucacuuugggguuc

SEQ ID NO: 164040 - RNA, 61 nt, Homo Sapiens
gaggccauccugauaaaauucggcgcuauugcccccguagcucuggagcucuaaaccgucu

SEQ ID NO: 164041 - RNA, 61 nt, Homo Sapiens
aagacaugggguaaugugagagaguagaacacccccguaccuaauaaaaaucuuuauuuuu

SEQ ID NO: 164042 - RNA, 61 nt, Homo Sapiens
ccgcucccuuuuucuucugccucacuugaaucccccguaaacaccagacgauugagucuac

SEQ ID NO: 164043 - RNA, 61 nt, Homo Sapiens
uuuuaagaccuaauccccacuuuuaaacugccccccguaugggcaaguaaugguagugggc

SEQ ID NO: 164044 - RNA, 61 nt, Homo Sapiens
cuccccgcugaccgcuccuccagccccgccucccccguacaggcagagcgcccgcccaccu

SEQ ID NO: 164045 - RNA, 61 nt, Homo Sapiens
acacgcguccucgggcgccacgacgcgccaccccccguacggaggccauggccggggccua

SEQ ID NO: 164046 - RNA, 61 nt, Homo Sapiens
cacuccuucaguccucauuuucuccagguuccccccguauccuugaaggcugagccccaca

SEQ ID NO: 164047 - RNA, 51 nt, Homo Sapiens
gccgaggcaccaaguucugaucccccguagaaaucccccuuucucuaauag

SEQ ID NO: 164048 - RNA, 64 nt, Homo Sapiens; identical to SEQ ID NO: 92187

SEQ ID NO: 164049 - RNA, 64 nt, Homo Sapiens; identical to SEQ ID NO: 92188

SEQ ID NO: 164050 - RNA, 64 nt, Homo Sapiens; identical to SEQ ID NO: 92189

SEQ ID NO: 164051 - RNA, 64 nt, Homo Sapiens; identical to SEQ ID NO: 92190

SEQ ID NO: 164052 - RNA, 64 nt, Homo Sapiens; identical to SEQ ID NO: 92191

SEQ ID NO: 164053 - RNA, 64 nt, Homo Sapiens; identical to SEQ ID NO: 92192

SEQ ID NO: 164054 - RNA, 64 nt, Homo Sapiens; identical to SEQ ID NO: 92193

SEQ ID NO: 164055 - RNA, 64 nt, Homo Sapiens; identical to SEQ ID NO: 92194

SEQ ID NO: 164056 - RNA, 64 nt, Homo Sapiens; identical to SEQ ID NO: 92195

SEQ ID NO: 164057 - RNA, 64 nt, Homo Sapiens; identical to SEQ ID NO: 92196

SEQ ID NO: 164058 - RNA, 64 nt, Homo Sapiens; identical to SEQ ID NO: 92197

SEQ ID NO: 164059 - RNA, 64 nt, Homo Sapiens; identical to SEQ ID NO: 92198

SEQ ID NO: 164060 - RNA, 64 nt, Homo Sapiens; identical to SEQ ID NO: 92199

SEQ ID NO: 164061 - RNA, 64 nt, Homo Sapiens; identical to SEQ ID NO: 92200

SEQ ID NO: 164062 - RNA, 64 nt, Homo Sapiens; identical to SEQ ID NO: 92201

SEQ ID NO: 164063 - RNA, 64 nt, Homo Sapiens; identical to SEQ ID NO: 92202

SEQ ID NO: 164064 - RNA, 64 nt, Homo Sapiens; identical to SEQ ID NO: 92203

SEQ ID NO: 164065 - RNA, 64 nt, Homo Sapiens; identical to SEQ ID NO: 92204

SEQ ID NO: 164066 - RNA, 64 nt, Homo Sapiens; identical to SEQ ID NO: 92205

SEQ ID NO: 164067 - RNA, 64 nt, Homo Sapiens; identical to SEQ ID NO: 92206

SEQ ID NO: 164068 - RNA, 64 nt, Homo Sapiens; identical to SEQ ID NO: 92207

SEQ ID NO: 164069 - RNA, 64 nt, Homo Sapiens; identical to SEQ ID NO: 92208

SEQ ID NO: 164070 - RNA, 64 nt, Homo Sapiens; identical to SEQ ID NO: 92209

SEQ ID NO: 164071 - RNA, 64 nt, Homo Sapiens; identical to SEQ ID NO: 92210

SEQ ID NO: 164072 - RNA, 64 nt, Homo Sapiens
uaaaaggcagcucaccauuugcugguaacuuaaugugagagaauccauaucugcgugaaaacac

SEQ ID NO: 164073 - RNA, 64 nt, Homo Sapiens
cagaacuuggcauuuccaacuucuuccuuuccgggugagagaagaagcggagaaggguucagug

SEQ ID NO: 164074 - RNA, 64 nt, Homo Sapiens
uaguuugcagaggagcaaauugagguucagcaaggugagagagguacccaaggucacauagcua

SEQ ID NO: 164075 - RNA, 64 nt, Homo Sapiens
ccaggucagaaaccauuguucagaagaccucccugugagagaguugcuccucagggucccucag

SEQ ID NO: 164076 - RNA, 64 nt, Homo Sapiens
auguacuaagagggaaaauguauuuaaguuaagggugagagacuuaaguuauaggugaccuuag

SEQ ID NO: 164077 - RNA, 64 nt, Homo Sapiens
agacuuaaguuauaggugaccuuagagaccuaaggugagagacuugacacauggaaggaguaac

SEQ ID NO: 164078 - RNA, 64 nt, Homo Sapiens
aaagaaaucaaguauaugaggagagcgagcgagcgugagagaacacccgugagagagacuugaa

SEQ ID NO: 164079 - RNA, 64 nt, Homo Sapiens
uaugaggagagcgagcgagcgugagagaacacccgugagagagacuugaaacugcuguccuuua

SEQ ID NO: 164080 - RNA, 64 nt, Homo Sapiens
uaauugugggugagaaucuaaaaccuguucugcagugagagauucugucuuaucaggccccaaa

SEQ ID NO: 164081 - RNA, 64 nt, Homo Sapiens
uuucuacuaaugcucagcccgaaaugcacugagugugagagagccauacaagugggaaaccuua

SEQ ID NO: 164082 - RNA, 64 nt, Homo Sapiens
gcagauggacuuuuccaugggucaaauuuuuugugugagagauagagguacaugucuucugaug

SEQ ID NO: 164083 - RNA, 64 nt, Homo Sapiens
aaacaaaaacuaguuugaggcacccaagcauuuagugagagauugagaaugaugcuuaauggau

SEQ ID NO: 164084 - RNA, 64 nt, Homo Sapiens
gagccaacccauguaccugcauuuaggggcagaagugagagaauugaggaaggaaagguuucaa

SEQ ID NO: 164085 - RNA, 64 nt, Homo Sapiens
aucucccccugguccaugccgggacuucccugcagugagagagcuucagauuggagaccagccu

SEQ ID NO: 164086 - RNA, 64 nt, Homo Sapiens; identical to SEQ ID NO: 164080

SEQ ID NO: 164087 - RNA, 64 nt, Homo Sapiens; identical to SEQ ID NO: 164081

SEQ ID NO: 164088 - RNA, 64 nt, Homo Sapiens
gaguccaaaauagcaaggaaguggugggaagaaggugagagaaaagggugggagggugagagag

SEQ ID NO: 164089 - RNA, 64 nt, Homo Sapiens
uggugggaagaaggugagagaaaagggugggagggugagagaggggagggaggggaauaaggug

SEQ ID NO: 164090 - RNA, 64 nt, Homo Sapiens
gagagagagagagagagaccgugugugugugugugugagagagagccuguguguguguguuugu

SEQ ID NO: 164091 - RNA, 64 nt, Homo Sapiens
gaagugaggccauagaugcaacccauggucccaggugagagaaggaauauucccuuggguuugg

SEQ ID NO: 164092 - RNA, 64 nt, Homo Sapiens
gagagaaagagagagagagagagagagaaagagagugagagagauccagagagccagagaguga

SEQ ID NO: 164093 - RNA, 64 nt, Homo Sapiens
gaaagagagugagagagagacagagagccagagagugagagagaggaagagaguaaccaguuuc

SEQ ID NO: 164094 - RNA, 64 nt, Homo Sapiens
gugaacgccauucaaccgaacauucuucccaagcgugagagagugacugacacuugguuccauc

SEQ ID NO: 164095 - RNA, 64 nt, Homo Sapiens
gagccuucagugggugcaaggcgccauacuugcugugagagagcugaguagaguguugguuuuu

SEQ ID NO: 164096 - RNA, 64 nt, Homo Sapiens
ggaugcuaagcuuccuacuccugucacggggaaggugagagagagacagagugagagaagucag

SEQ ID NO: 164097 - RNA, 64 nt, Homo Sapiens
ucagcugucacggggaaggugauguuaggacagagugagagaagcucuccgcuuguccucuugu

SEQ ID NO: 164098 - RNA, 64 nt, Homo Sapiens
aggcccagcugccagggaagacagagcaggcuuugugagagaggaccuccaugcccccgccacc

SEQ ID NO: 164099 - RNA, 64 nt, Homo Sapiens
cuuccuugcgaccaccaacacacaggaacucugugugagagagagggcgcccagcccaggccug

SEQ ID NO: 164100 - RNA, 64 nt, Homo Sapiens
ccucuuuaacacuugaaauucacccucgagcagcgugagagauggccaguugacaagauuuuuc

SEQ ID NO: 164101 - RNA, 64 nt, Homo Sapiens
gucagguugcauguucacugaacacgauggauaagugagagagauaaggugugaaaugcuccuc

SEQ ID NO: 164102 - RNA, 64 nt, Homo Sapiens
auguaauaaguauauaauaugugagaauauuauauaugacuauuacuuauacaugcacaugcac

SEQ ID NO: 164103 - RNA, 64 nt, Homo Sapiens
uugugucuucaacugaaaaauacaaucuguggauuaugacuaccagcaauuuuuuucuaggaaa

SEQ ID NO: 164104 - RNA, 64 nt, Homo Sapiens
auuaaaugagaacauggaugaguggacuucauauuaugacuagcuuuacuauuuuaauucaccu

SEQ ID NO: 164105 - RNA, 64 nt, Homo Sapiens
auaagcuauguguucagacugaaacuggagaaauuaugacuauuuuauuuauaguaguaguuaa

SEQ ID NO: 164106 - RNA, 64 nt, Homo Sapiens
acauguuaaauaaaaauagcauauggaguugcuuuaugacuauuaggauaucagaaaacuaaau

SEQ ID NO: 164107 - RNA, 64 nt, Homo Sapiens
uguuacugauuuagagacuauguuuguaugguguuaugacuaaucuuuccugaauauuuaaaug

SEQ ID NO: 164108 - RNA, 64 nt, Homo Sapiens
gaaauacuugaaauagaccuaaguuuaaaucuaacagaacaacucauauuuaaacuuuauccua

SEQ ID NO: 164109 - RNA, 64 nt, Homo Sapiens
aguaauacccaaguaauauuuuuaucuuugucuacagaacaauuuuugcuaaugaucuucagau

SEQ ID NO: 164110 - RNA, 64 nt, Homo Sapiens
ccuuacugggaugggcucugucuacagcaaugugcagaacaagcauucccacuuuuccucaaga

SEQ ID NO: 164111 - RNA, 64 nt, Homo Sapiens
uuuccuguugaauguauuuuuaugagauuuuaaccagaacaaaggcagauaaacaggcauucca

SEQ ID NO: 164112 - RNA, 64 nt, Homo Sapiens
ugucuguucuuaaagauuucaugguuggcucagacagaacaaucaucuguuugacuucuuuggu

SEQ ID NO: 164113 - RNA, 64 nt, Homo Sapiens
agucagugccguugccuuuucuucauuagagacacagaacaauguauuagaauuuccagcugug

SEQ ID NO: 164114 - RNA, 64 nt, Homo Sapiens
uguuuacauaaguuccuauagaaagaaugcauuccagaacaaaucccaaauauaaccauuuaaa

SEQ ID NO: 164115 - RNA, 64 nt, Homo Sapiens
cauuauguuuccuaacugugccagcagcugauuccagaacaaauuuaaccacuugccucuuucu

SEQ ID NO: 164116 - RNA, 64 nt, Homo Sapiens
uccgaucaagcuuuuauuuuuuuaaaagucaaaacagaacaaaacaaaguaugcagagacagag

SEQ ID NO: 164117 - RNA, 64 nt, Homo Sapiens
gucacauguuuuucuuccuuguccccacggcccccagaacaacauucucccugcuggcagcccu

SEQ ID NO: 164118 - RNA, 64 nt, Homo Sapiens
uuggaccaguuaauucccauacaagucaagguaacagaacaaaagggaauccugaugcccuuuu

SEQ ID NO: 164119 - RNA, 64 nt, Homo Sapiens
uuaaaauggaaaaauacuuaauaucacuaaauaucagaacaauguaacauuuacaaaugacaua

SEQ ID NO: 164120 - RNA, 64 nt, Homo Sapiens
cccugucucuauuuuaaaauccagccuggguggacagaacaaggugugaucccacuacugcauu

SEQ ID NO: 164121 - RNA, 64 nt, Homo Sapiens
ggucugguuuccacuggaguauuaaaagugcgggcagaacaacuguuuugcaagccaaaucauu

SEQ ID NO: 164122 - RNA, 64 nt, Homo Sapiens
gagaaaagaaaaaaaaccuguaaaacauugaaaacagaacaaauuaccauccuuuaaucauaac

SEQ ID NO: 164123 - RNA, 64 nt, Homo Sapiens
guguuuccuuuuacuuguucauguugggcgaaaacagaacaacuuuuguuucaaagaggucugc

SEQ ID NO: 164124 - RNA, 64 nt, Homo Sapiens
gcaaaggaaaaugcuuuagaaaacuaaaacaaaacagaacaaaaaaaacuagacaaauaaagac

SEQ ID NO: 164125 - RNA, 64 nt, Homo Sapiens
cauuucauguggccauggguaccuagaaagacaucagaacaagucggucaaauuaaaaguagaa

SEQ ID NO: 164126 - RNA, 64 nt, Homo Sapiens
ccaucuuaguaaaaauuuugaaaggaugaccacucagaacaacucucuugaugaccauucuguc

SEQ ID NO: 164127 - RNA, 64 nt, Homo Sapiens
gaagagagaaggaaauuuuaacacaaaacaaaaacagaacaaaaaaacaaacaaaaaaaaaaac

SEQ ID NO: 164128 - RNA, 64 nt, Homo Sapiens
cgucaggugccuggagcaaaugcaucugacugagcagaacaaauguacuucggagacaccuguc

SEQ ID NO: 164129 - RNA, 64 nt, Homo Sapiens
cugaaccaggccugucaccuauuccauagaaucacagaacaaucccaagagugauguacagucu

SEQ ID NO: 164130 - RNA, 64 nt, Homo Sapiens
gagucucagggaaagagaaccccagaguuggagacagaacaacaccagagggcagcgucagaca

SEQ ID NO: 164131 - RNA, 64 nt, Homo Sapiens
cauuuaaucugugccucucaugaguuuggcauagauagugcacuacaguaaguuauagacuugc

SEQ ID NO: 164132 - RNA, 64 nt, Homo Sapiens
uucuguagacuauaggguuuuuaaugaguauuaaauagugcauacuucauugacuuuucuuuag

SEQ ID NO: 164133 - RNA, 64 nt, Homo Sapiens
gcuucauucuguggaauuuugugcuugcuacuguauagugcaugugguguagguuacucuaacu

SEQ ID NO: 164134 - RNA, 64 nt, Homo Sapiens
uugcaggaaaaugauuauaacuaaaagcucucugauagugcagagacuuaccagaagacacaag

SEQ ID NO: 164135 - RNA, 64 nt, Homo Sapiens
ugauaaugauaaaacaccucacaccucacucuuuauagugcacaaaaugaaugaggucugggcu

SEQ ID NO: 164136 - RNA, 64 nt, Homo Sapiens
ggauuaugggcuggaaagcauuuguuauaaaccuauagugcacauuuuaacugcccccuaaauu

SEQ ID NO: 164137 - RNA, 64 nt, Homo Sapiens
aucucugaauccuuuuaaucagaaauauagugcaauagugcaaccagaaacgagaucgggaagc

SEQ ID NO: 164138 - RNA, 64 nt, Homo Sapiens
agugcaacaucucugaaucccgggaagcagaaauauagugcaaucuaggacucagaaacgagau

SEQ ID NO: 164139 - RNA, 64 nt, Homo Sapiens
uugucgaguuaguaaacaugccugggaaaacaggacagcucagacaguuaaaugauauuuaaca

SEQ ID NO: 164140 - RNA, 64 nt, Homo Sapiens
acaauaaaauuguuggauuugaaauuuagaaaauacagcucauugaaaacaggaaaauaaaaga

SEQ ID NO: 164141 - RNA, 64 nt, Homo Sapiens
guuucugaaaauguauaaaaaauccauuuauaucacagcucacaaacucaaaggacugugauau

SEQ ID NO: 164142 - RNA, 64 nt, Homo Sapiens
ggacugugauauaauccauuaauacauuuacaucacagcucaaagguaugacagcauaccauua

SEQ ID NO: 164143 - RNA, 64 nt, Homo Sapiens
cacugugaugcagagccccacucacagaaauaccacagcucagcaaauaacgggcugcccucag

SEQ ID NO: 164144 - RNA, 64 nt, Homo Sapiens
acugugccuacauuuaaaaacuaacugaauuugaacagcucacccuaaugugugauguugacgc

SEQ ID NO: 164145 - RNA, 64 nt, Homo Sapiens
ggaccggcucuuccuggauggguccaagaauuggacagcucagauggagugagggccuauuuuc

SEQ ID NO: 164146 - RNA, 64 nt, Homo Sapiens
gaugcacccccaggcuucaaaccaccuggaaugcacagcucagggaagcugguggaugccuaga

SEQ ID NO: 164147 - RNA, 64 nt, Homo Sapiens
cagagcaccuaggauaaagugcagugaugcaaucacagcucaccucagugcggccuugaacucc

SEQ ID NO: 164148 - RNA, 64 nt, Homo Sapiens
uuuuguagagguggggaagugcagugaugcaaucacagcucaccucagugcggccuugaacucc

SEQ ID NO: 164149 - RNA, 64 nt, Homo Sapiens
auuuugucugaucuaccauuucuaugguuuaugguaauaguauucccuuuaucccucccuuuug

SEQ ID NO: 164150 - RNA, 64 nt, Homo Sapiens
cugugaagacagaagaguaucaagauuaauauauuaauaguauagcucugacugguaaauuucu

SEQ ID NO: 164151 - RNA, 64 nt, Homo Sapiens
auuggaaaaaaauguuaaagguuuaggacacaccuaauaguauguccuuugaaugggaaguguu

SEQ ID NO: 164152 - RNA, 64 nt, Homo Sapiens
aacucuaauugcuauuagucuacauguauuucuguaauaguauugugucauaucaauuuuuaag

SEQ ID NO: 164153 - RNA, 64 nt, Homo Sapiens
uggacuaauuucgguuuuuauacaaguaaagauuuaauaguauaaggauuuuuuugcauuucuu

SEQ ID NO: 164154 - RNA, 64 nt, Homo Sapiens
aaaagcauacuauaguuguaaaaacaaauaauuuuaauaguauauucaguggcugaagugauag

SEQ ID NO: 164155 - RNA, 64 nt, Homo Sapiens
auuaacaacccauaggcacuuacuaugacacuguuaauaguacuaguacuauuacuaguacuag

SEQ ID NO: 164156 - RNA, 64 nt, Homo Sapiens
auugcuaguacuaguacuauuaccuuuaaaauaauaauaguacuuuuuauuuuaaaauaaaauu

SEQ ID NO: 164157 - RNA, 64 nt, Homo Sapiens
auuacuauuacuauuuuuauauuauuaacacuaauaauaguacuuguuaguauuaacuauuagu

SEQ ID NO: 164158 - RNA, 64 nt, Homo Sapiens
uacauuugcguugcuuucuacauagagacuuguauaauaguauuaauaguagcucauucucucu

SEQ ID NO: 164159 - RNA, 64 nt, Homo Sapiens
guugcuuucuacauagagacuuguauaauaguauuaauaguagcucauucucucuaaaaauuua

SEQ ID NO: 164160 - RNA, 64 nt, Homo Sapiens
uuuaaaaaaauuaauauggcagaauacgagcuauuaauaguaucagauacagaacccucauaau

SEQ ID NO: 164161 - RNA, 64 nt, Homo Sapiens
ccacuuaauuguggccaaagcuauucagcugugauaauaguaucucacagggaaacauuuucuu

SEQ ID NO: 164162 - RNA, 64 nt, Homo Sapiens
cugaaauauauuauuaagggcaauggagauaaauuaauaguagaugugguucccagaaaauaua

SEQ ID NO: 164163 - RNA, 64 nt, Homo Sapiens
uguaacuggaacuaaaucaaaugauuacuaguguuaauaguagauaacuuguuuuuauuguugg

SEQ ID NO: 164164 - RNA, 64 nt, Homo Sapiens
aacacgauacagaucagugcauauaguauauuacuaauaguaugcuguuaauuguguaagaaag

SEQ ID NO: 164165 - RNA, 64 nt, Homo Sapiens
agcguuugcucuaaugugagcuauggacuuuaguuaauaguaacgugucaauauugguucauca

SEQ ID NO: 164166 - RNA, 64 nt, Homo Sapiens
uuuaacuagagcaugauauuuuaaauguuaagguguaacauauguuaaauaaaacuguuauuuu

SEQ ID NO: 164167 - RNA, 64 nt, Homo Sapiens
auucugccaaacuauuacuuauauguacuauuguguaacauacuuucuugaaauauuuuuguuu

SEQ ID NO: 164168 - RNA, 64 nt, Homo Sapiens
caaguauauaaaguuuugccccaugauaaaauaaguaacauauaaauuaauacauaaguuaaua

SEQ ID NO: 164169 - RNA, 64 nt, Homo Sapiens
acauauauuuuauuuucauacuuuugauaugauuguaacauauuucuugaguaauuuaaaugcu

SEQ ID NO: 164170 - RNA, 64 nt, Homo Sapiens
ggugaugguuggccauuugauuaagugaccucagguaacauaaucagaguugaaagccacagag

SEQ ID NO: 164171 - RNA, 64 nt, Homo Sapiens
ucccacauauucuaaugacacugcuuauuuauguguaacauaaaauguuaguccucuuagauga

SEQ ID NO: 164172 - RNA, 64 nt, Homo Sapiens
uugugguagcauuaucuuagacauuaaauuugaaguaacauauauccuguaguaacauagaccc

SEQ ID NO: 164173 - RNA, 64 nt, Homo Sapiens
uagacauuaaauuugaaguaacauauauccuguaguaacauagacccaaaguuacuauagucaa

SEQ ID NO: 164174 - RNA, 64 nt, Homo Sapiens
uuuauuaaaauauauacuuauuauuuuuuauuauguaacauacuguaagugaacaauuuuaaau

SEQ ID NO: 164175 - RNA, 64 nt, Homo Sapiens
ggauuaacaucucuaguaaucaguauacuauuugguaacauaauguguacguaaaacaugguaa

SEQ ID NO: 164176 - RNA, 64 nt, Homo Sapiens
acuuaaggagacggguaaaggaucuuaaauuuuuuucuaauagaaagaugugcuacacuguauu

SEQ ID NO: 164177 - RNA, 64 nt, Homo Sapiens
uaacuuccugauuggaguguguaagcugagcgauuucuaauaaaauuuuaguuguacacuuuua

SEQ ID NO: 164178 - RNA, 64 nt, Homo Sapiens
uaugaccaauguagccauugcuuuuuuuuaugguuucuaauaugauguacauuuuaguucuuaa

SEQ ID NO: 164179 - RNA, 64 nt, Homo Sapiens
uugcaaggauuagccaaaucggaaaagaguauuuuucuaauacggaggaggcuucuaauuagcu

SEQ ID NO: 164180 - RNA, 64 nt, Homo Sapiens
ugggaugucuaauaaauuauaaaagaacuuagaguucuaauaaauguuucauuuauauaaaagc

SEQ ID NO: 164181 - RNA, 64 nt, Homo Sapiens
uuuuaaacaagugaaguuaauacaauuuuuacauuucuaauauaaauauaaugugagccccaua

SEQ ID NO: 164182 - RNA, 64 nt, Homo Sapiens
cgaaacuaaauacuugauuuauuauguauauuauuucuaauaucacuaucaguauguugaauuu

SEQ ID NO: 164183 - RNA, 64 nt, Homo Sapiens
uuaucuauuuuguucauugauuuuucagugaagauucuaauauuaaagauggagaaacaugcca

SEQ ID NO: 164184 - RNA, 64 nt, Homo Sapiens
agacaucauguuggaaagauucacaaaaccauuuuucuaauaagucuuccuucacaguuuuauc

SEQ ID NO: 164185 - RNA, 64 nt, Homo Sapiens
acucauuccucaagugauauuauuauuuaauaauuucuaauaacucuaagaacuaagcuuugag

SEQ ID NO: 164186 - RNA, 64 nt, Homo Sapiens
gguuuaaaaugguacuauuauuuccauuguaucuuucuaauaagaauuauccagaagggguacu

SEQ ID NO: 164187 - RNA, 64 nt, Homo Sapiens
cuaauauugcugaggccuuaugcaaaccagccuuuucuaauaggccaagugacuccauuugacu

SEQ ID NO: 164188 - RNA, 64 nt, Homo Sapiens
ucaguugagcugcuguuuucuguuugauuuuuuuuucuaauauuauuuuaaaucuguauguauc

SEQ ID NO: 164189 - RNA, 64 nt, Homo Sapiens
auauacaccuuauacccaaguaagccucuucccuuucuaauaaauacugggauuccugaucaag

SEQ ID NO: 164190 - RNA, 64 nt, Homo Sapiens
ugcuuacuacaugcaaggcacucugcuaguuauauucuaauaaugcagagauaauuagacaugg

SEQ ID NO: 164191 - RNA, 64 nt, Homo Sapiens
guaauuacauuauuuaggucuuaauccaacuuuuuucuaauauaucuaaacaauugaaagggaa

SEQ ID NO: 164192 - RNA, 64 nt, Homo Sapiens
uuuucacuuuguguauuaaagaaaugcuuuuauauucuaauaguuuauuugucuuaaaaaaugu

SEQ ID NO: 164193 - RNA, 64 nt, Homo Sapiens
aguuggcuuucauaaaucauuuguguaucugugcuucuaauauuuccccuucucaucgaaggga

SEQ ID NO: 164194 - RNA, 64 nt, Homo Sapiens
uuguuuauuguaaaacagcucuaauauucacauguucuaauacuuuuccaguuagaaggagguu

SEQ ID NO: 164195 - RNA, 64 nt, Homo Sapiens
cacauguucuaauacuuugucaguuagaaggagguucuaauauugcuuacugaagaaaucuuuc

SEQ ID NO: 164196 - RNA, 64 nt, Homo Sapiens
ugagccgcguuugcuccucccucucuuuugcauauucuaauaaauguauuuguggaggaaaguc

SEQ ID NO: 164197 - RNA, 64 nt, Homo Sapiens
auuuaaaugucacaaacuguguuuggugcuuaucuucuaauaagucuauuuuuuauuuuaauag

SEQ ID NO: 164198 - RNA, 64 nt, Homo Sapiens
cuuuuguguuccagauugaauauguguauuuuuauucuaauaaauaauuuuaguguugauaccg

SEQ ID NO: 164199 - RNA, 64 nt, Homo Sapiens
gaauuuggguaauuuuuaauguaauugucucuuuuucuaauaagcagauccuaaguagaaccag

SEQ ID NO: 164200 - RNA, 64 nt, Homo Sapiens
uuugauuaucuauaaugugccauuuuaaauguguuucuaauauuauuuauacuaaacauaugga

SEQ ID NO: 164201 - RNA, 64 nt, Homo Sapiens
ucucugaaagccaguggcuuaagagaugaguguguucuaauaagcacuagcagaagcaugcaug

SEQ ID NO: 164202 - RNA, 64 nt, Homo Sapiens
uaaagaauaugacaaggucuucaaacacaaguuuuucuaauaacucauuagagaauuuauacug

SEQ ID NO: 164203 - RNA, 64 nt, Homo Sapiens
cuccucccuaucugauucuaugaggccagcaucauucuaauaccaaaaccugacaggcacaaug

SEQ ID NO: 164204 - RNA, 64 nt, Homo Sapiens
uuuucccuccucacagauaaaugaaaaguaaguauucuaauauaaaaguucuaauacaaaagag

SEQ ID NO: 164205 - RNA, 64 nt, Homo Sapiens
agauaaaugaaaaguaaguauucuaauauaaaaguucuaauacaaaagaguagagaagguucuu

SEQ ID NO: 164206 - RNA, 64 nt, Homo Sapiens
ccugcuugacccuuaucugauaugcuggaguauuuucuaauaauaaagaauggcuacuuuuuuc

SEQ ID NO: 164207 - RNA, 64 nt, Homo Sapiens
gcacucaguuuacucucuccuacaaacuuuguaauucuaauaauugguuaucugagauaggaga

SEQ ID NO: 164208 - RNA, 64 nt, Homo Sapiens; identical to SEQ ID NO: 46532

SEQ ID NO: 164209 - RNA, 64 nt, Homo Sapiens; identical to SEQ ID NO: 46533

SEQ ID NO: 164210 - RNA, 64 nt, Homo Sapiens; identical to SEQ ID NO: 46534

SEQ ID NO: 164211 - RNA, 64 nt, Homo Sapiens; identical to SEQ ID NO: 46535

SEQ ID NO: 164212 - RNA, 64 nt, Homo Sapiens; identical to SEQ ID NO: 46536

SEQ ID NO: 164213 - RNA, 64 nt, Homo Sapiens; identical to SEQ ID NO: 46537

SEQ ID NO: 164214 - RNA, 64 nt, Homo Sapiens; identical to SEQ ID NO: 46538

SEQ ID NO: 164215 - RNA, 64 nt, Homo Sapiens; identical to SEQ ID NO: 46539

SEQ ID NO: 164216 - RNA, 64 nt, Homo Sapiens; identical to SEQ ID NO: 46540

SEQ ID NO: 164217 - RNA, 64 nt, Homo Sapiens; identical to SEQ ID NO: 46541

SEQ ID NO: 164218 - RNA, 64 nt, Homo Sapiens; identical to SEQ ID NO: 46542

SEQ ID NO: 164219 - RNA, 64 nt, Homo Sapiens; identical to SEQ ID NO: 46543

SEQ ID NO: 164220 - RNA, 64 nt, Homo Sapiens; identical to SEQ ID NO: 46544

SEQ ID NO: 164221 - RNA, 64 nt, Homo Sapiens; identical to SEQ ID NO: 46545

SEQ ID NO: 164222 - RNA, 64 nt, Homo Sapiens; identical to SEQ ID NO: 46546

SEQ ID NO: 164223 - RNA, 64 nt, Homo Sapiens; identical to SEQ ID NO: 46547

SEQ ID NO: 164224 - RNA, 64 nt, Homo Sapiens; identical to SEQ ID NO: 46548

SEQ ID NO: 164225 - RNA, 64 nt, Homo Sapiens; identical to SEQ ID NO: 46549

SEQ ID NO: 164226 - RNA, 64 nt, Homo Sapiens; identical to SEQ ID NO: 46550

SEQ ID NO: 164227 - RNA, 64 nt, Homo Sapiens; identical to SEQ ID NO: 46551

SEQ ID NO: 164228 - RNA, 64 nt, Homo Sapiens; identical to SEQ ID NO: 46552

SEQ ID NO: 164229 - RNA, 64 nt, Homo Sapiens; identical to SEQ ID NO: 46553

SEQ ID NO: 164230 - RNA, 64 nt, Homo Sapiens; identical to SEQ ID NO: 46554

SEQ ID NO: 164231 - RNA, 64 nt, Homo Sapiens; identical to SEQ ID NO: 46555

SEQ ID NO: 164232 - RNA, 64 nt, Homo Sapiens; identical to SEQ ID NO: 46556

SEQ ID NO: 164233 - RNA, 64 nt, Homo Sapiens; identical to SEQ ID NO: 46557

SEQ ID NO: 164234 - RNA, 64 nt, Homo Sapiens; identical to SEQ ID NO: 46558

SEQ ID NO: 164235 - RNA, 64 nt, Homo Sapiens; identical to SEQ ID NO: 46559

SEQ ID NO: 164236 - RNA, 64 nt, Homo Sapiens; identical to SEQ ID NO: 46560

SEQ ID NO: 164237 - RNA, 64 nt, Homo Sapiens; identical to SEQ ID NO: 46561

SEQ ID NO: 164238 - RNA, 64 nt, Homo Sapiens; identical to SEQ ID NO: 46562

SEQ ID NO: 164239 - RNA, 64 nt, Homo Sapiens; identical to SEQ ID NO: 46563

SEQ ID NO: 164240 - RNA, 64 nt, Homo Sapiens; identical to SEQ ID NO: 46564

SEQ ID NO: 164241 - RNA, 64 nt, Homo Sapiens; identical to SEQ ID NO: 46565

SEQ ID NO: 164242 - RNA, 64 nt, Homo Sapiens; identical to SEQ ID NO: 46566

SEQ ID NO: 164243 - RNA, 64 nt, Homo Sapiens; identical to SEQ ID NO: 46567

SEQ ID NO: 164244 - RNA, 64 nt, Homo Sapiens; identical to SEQ ID NO: 46568

SEQ ID NO: 164245 - RNA, 64 nt, Homo Sapiens; identical to SEQ ID NO: 46569

SEQ ID NO: 164246 - RNA, 64 nt, Homo Sapiens; identical to SEQ ID NO: 46570

SEQ ID NO: 164247 - RNA, 64 nt, Homo Sapiens; identical to SEQ ID NO: 46571

SEQ ID NO: 164248 - RNA, 64 nt, Homo Sapiens; identical to SEQ ID NO: 46572

SEQ ID NO: 164249 - RNA, 64 nt, Homo Sapiens; identical to SEQ ID NO: 46573

SEQ ID NO: 164250 - RNA, 64 nt, Homo Sapiens; identical to SEQ ID NO: 46574

SEQ ID NO: 164251 - RNA, 64 nt, Homo Sapiens; identical to SEQ ID NO: 46575

SEQ ID NO: 164252 - RNA, 64 nt, Homo Sapiens; identical to SEQ ID NO: 46576

SEQ ID NO: 164253 - RNA, 64 nt, Homo Sapiens; identical to SEQ ID NO: 46577

SEQ ID NO: 164254 - RNA, 64 nt, Homo Sapiens; identical to SEQ ID NO: 46578

SEQ ID NO: 164255 - RNA, 64 nt, Homo Sapiens; identical to SEQ ID NO: 46579

SEQ ID NO: 164256 - RNA, 64 nt, Homo Sapiens; identical to SEQ ID NO: 46580

SEQ ID NO: 164257 - RNA, 64 nt, Homo Sapiens; identical to SEQ ID NO: 46581

SEQ ID NO: 164258 - RNA, 64 nt, Homo Sapiens; identical to SEQ ID NO: 46582

SEQ ID NO: 164259 - RNA, 64 nt, Homo Sapiens; identical to SEQ ID NO: 46583

SEQ ID NO: 164260 - RNA, 64 nt, Homo Sapiens; identical to SEQ ID NO: 46584

SEQ ID NO: 164261 - RNA, 64 nt, Homo Sapiens; identical to SEQ ID NO: 46585

SEQ ID NO: 164262 - RNA, 64 nt, Homo Sapiens; identical to SEQ ID NO: 46586

SEQ ID NO: 164263 - RNA, 64 nt, Homo Sapiens; identical to SEQ ID NO: 46587

SEQ ID NO: 164264 - RNA, 64 nt, Homo Sapiens; identical to SEQ ID NO: 46588

SEQ ID NO: 164265 - RNA, 64 nt, Homo Sapiens; identical to SEQ ID NO: 46589

SEQ ID NO: 164266 - RNA, 64 nt, Homo Sapiens; identical to SEQ ID NO: 46590

SEQ ID NO: 164267 - RNA, 64 nt, Homo Sapiens; identical to SEQ ID NO: 46591

SEQ ID NO: 164268 - RNA, 64 nt, Homo Sapiens; identical to SEQ ID NO: 46592

SEQ ID NO: 164269 - RNA, 64 nt, Homo Sapiens; identical to SEQ ID NO: 46593

SEQ ID NO: 164270 - RNA, 64 nt, Homo Sapiens; identical to SEQ ID NO: 46594

SEQ ID NO: 164271 - RNA, 64 nt, Homo Sapiens; identical to SEQ ID NO: 46595

SEQ ID NO: 164272 - RNA, 64 nt, Homo Sapiens; identical to SEQ ID NO: 46596

SEQ ID NO: 164273 - RNA, 64 nt, Homo Sapiens; identical to SEQ ID NO: 46597

SEQ ID NO: 164274 - RNA, 64 nt, Homo Sapiens; identical to SEQ ID NO: 46598

SEQ ID NO: 164275 - RNA, 64 nt, Homo Sapiens; identical to SEQ ID NO: 46599

SEQ ID NO: 164276 - RNA, 64 nt, Homo Sapiens; identical to SEQ ID NO: 46600

SEQ ID NO: 164277 - RNA, 64 nt, Homo Sapiens; identical to SEQ ID NO: 46601

SEQ ID NO: 164278 - RNA, 64 nt, Homo Sapiens; identical to SEQ ID NO: 46602

SEQ ID NO: 164279 - RNA, 64 nt, Homo Sapiens; identical to SEQ ID NO: 46603

SEQ ID NO: 164280 - RNA, 64 nt, Homo Sapiens; identical to SEQ ID NO: 46604

SEQ ID NO: 164281 - RNA, 64 nt, Homo Sapiens; identical to SEQ ID NO: 46605

SEQ ID NO: 164282 - RNA, 64 nt, Homo Sapiens; identical to SEQ ID NO: 46606

SEQ ID NO: 164283 - RNA, 64 nt, Homo Sapiens; identical to SEQ ID NO: 46607

SEQ ID NO: 164284 - RNA, 64 nt, Homo Sapiens; identical to SEQ ID NO: 46608

SEQ ID NO: 164285 - RNA, 64 nt, Homo Sapiens; identical to SEQ ID NO: 46609

SEQ ID NO: 164286 - RNA, 64 nt, Homo Sapiens; identical to SEQ ID NO: 46610

SEQ ID NO: 164287 - RNA, 64 nt, Homo Sapiens; identical to SEQ ID NO: 46611

SEQ ID NO: 164288 - RNA, 64 nt, Homo Sapiens; identical to SEQ ID NO: 46612

SEQ ID NO: 164289 - RNA, 64 nt, Homo Sapiens; identical to SEQ ID NO: 46613

SEQ ID NO: 164290 - RNA, 64 nt, Homo Sapiens; identical to SEQ ID NO: 46614

SEQ ID NO: 164291 - RNA, 64 nt, Homo Sapiens; identical to SEQ ID NO: 46615

SEQ ID NO: 164292 - RNA, 64 nt, Homo Sapiens; identical to SEQ ID NO: 46616

SEQ ID NO: 164293 - RNA, 64 nt, Homo Sapiens; identical to SEQ ID NO: 46617

SEQ ID NO: 164294 - RNA, 64 nt, Homo Sapiens; identical to SEQ ID NO: 46618

SEQ ID NO: 164295 - RNA, 64 nt, Homo Sapiens; identical to SEQ ID NO: 46619

SEQ ID NO: 164296 - RNA, 64 nt, Homo Sapiens; identical to SEQ ID NO: 46620

SEQ ID NO: 164297 - RNA, 64 nt, Homo Sapiens; identical to SEQ ID NO: 46621

SEQ ID NO: 164298 - RNA, 64 nt, Homo Sapiens; identical to SEQ ID NO: 46622

SEQ ID NO: 164299 - RNA, 64 nt, Homo Sapiens; identical to SEQ ID NO: 46623

SEQ ID NO: 164300 - RNA, 64 nt, Homo Sapiens; identical to SEQ ID NO: 46624

SEQ ID NO: 164301 - RNA, 64 nt, Homo Sapiens; identical to SEQ ID NO: 46625

SEQ ID NO: 164302 - RNA, 64 nt, Homo Sapiens; identical to SEQ ID NO: 46626

SEQ ID NO: 164303 - RNA, 64 nt, Homo Sapiens; identical to SEQ ID NO: 46627

SEQ ID NO: 164304 - RNA, 64 nt, Homo Sapiens; identical to SEQ ID NO: 46628

SEQ ID NO: 164305 - RNA, 64 nt, Homo Sapiens
acccuaacugaucaauguacuuuguaaucucccccacccuuaagaagguacuuuguaaucuucc

SEQ ID NO: 164306 - RNA, 64 nt, Homo Sapiens
ccccacccuuaagaagguacuuuguaaucuuccccacccuuaagaagguucuuuguaauucucc

SEQ ID NO: 164307 - RNA, 64 nt, Homo Sapiens
cagagauuucucauugacuuuuauaaagcauguucacccuuauagucuaagacuauauauauaa

SEQ ID NO: 164308 - RNA, 64 nt, Homo Sapiens
gugucucauggauuuggcacuagccaaagcgaggcacccuuacuggcuuaccuccucauggcag

SEQ ID NO: 164309 - RNA, 64 nt, Homo Sapiens
cagagaccaacucccugggcuucauacuggccuuccucuacaauggccuccucuccaucagugc

SEQ ID NO: 164310 - RNA, 64 nt, Homo Sapiens
gucuuguucauguagccgaggggcaggcgggggaccucuacaccucugcugugggcacggggcu

SEQ ID NO: 164311 - RNA, 64 nt, Homo Sapiens
gguggcccgucucaucugugaacuugacucugucccucuacaugucucuuuaauggggugaggg

SEQ ID NO: 164312 - RNA, 64 nt, Homo Sapiens
uucagcugggggcucucaccagcccuccuuucagccucuacaacagagcagcuucccagacuuc

SEQ ID NO: 164313 - RNA, 64 nt, Homo Sapiens
ucagaugcuggccccuuggucuugaauuuccuagccucuacaacuaagccaaauaaauuucugu

SEQ ID NO: 164314 - RNA, 64 nt, Homo Sapiens
ggaauggcuuagaauaaguauacacuugaaaucuccucuacaugaucuuuguucuuuaacagug

SEQ ID NO: 164315 - RNA, 64 nt, Homo Sapiens
cuggcuguaagggagacucagucccagccucuccccucuacaacuccugccacuguuggccaug

SEQ ID NO: 164316 - RNA, 64 nt, Homo Sapiens
aaauggacuuccauaguauugacuguagaaggagccucuacaauauugacuauauauuuuuaua

SEQ ID NO: 164317 - RNA, 64 nt, Homo Sapiens
gcuccacccugccauggccgggccaccuggccacccucuacacgcuggauggaauccgcgagcu

SEQ ID NO: 164318 - RNA, 64 nt, Homo Sapiens
ugauuuauauuauauguggcuuaaaaaccaaaguccucuacacuuccaauuauauuuuuaacau

SEQ ID NO: 164319 - RNA, 64 nt, Homo Sapiens
aaguacaaaaauuagucgggauggcaaaaacccaccucuacaaauugagaccagccugggcaac

SEQ ID NO: 164320 - RNA, 64 nt, Homo Sapiens
ugaagacaaaggcaaagucagacacaaauaggcuccucuacaccaagugacucucuaggcuucg

SEQ ID NO: 164321 - RNA, 64 nt, Homo Sapiens
uaauaggaaaaacggaagaacagugccuauacugccucuacaguucacaagaacaacggcaaga

SEQ ID NO: 164322 - RNA, 64 nt, Homo Sapiens
ucucuuaaagguagguuggcagcacaaaaaaccaccucuacauuauuguacuuguggaugguug

SEQ ID NO: 164323 - RNA, 64 nt, Homo Sapiens
uauuuauaucaauuccuacaugauuguucugcucccucuacagacuguccuuccuugaaauugc

SEQ ID NO: 164324 - RNA, 64 nt, Homo Sapiens
ggguagcuucugucagggaaaagaccuacuuuguccucuacauaaaaccaacuaauauuuauug

SEQ ID NO: 164325 - RNA, 64 nt, Homo Sapiens
cacaagagcuaauucauucuuugagauaugucagccucuacagucagcuugcugacugcagauc

SEQ ID NO: 164326 - RNA, 64 nt, Homo Sapiens
guugaugcgggcagugugggcgaccguccuggugccucuacaugcacuucuuccuaaugacacg

SEQ ID NO: 164327 - RNA, 64 nt, Homo Sapiens
ggcauauuccaugacauuaauuaggaguguucugccucuacaguuaaucuggugaauguuauua

SEQ ID NO: 164328 - RNA, 64 nt, Homo Sapiens
uauuguuauuuaauaaauauuucaggauauuuuuccucuacaauaaaguaacaauuaacuuaug

SEQ ID NO: 164329 - RNA, 64 nt, Homo Sapiens
aaaugugugccaagagggucuccuuuccugucuuccucuacagagaaugcugcucgguccuccu

SEQ ID NO: 164330 - RNA, 64 nt, Homo Sapiens
agggaagggcuuucuugguaauuuagaugugaaaccucuacagagcuaucauguaaaaacuaca

SEQ ID NO: 164331 - RNA, 64 nt, Homo Sapiens
ccgguggccuucaagguccuuuaugaguguuaccccucuacacguccacaccacucaccacaca

SEQ ID NO: 164332 - RNA, 64 nt, Homo Sapiens
aagagggggcagaaaugaaugaccagguuaaaucccucuacaugugguuucuguuugaaaaaaa

SEQ ID NO: 164333 - RNA, 64 nt, Homo Sapiens
cguaggaaacuugauuuuuuuguuuugaucauggccucuacaugcaccuuuccagaguggucuc

SEQ ID NO: 164334 - RNA, 64 nt, Homo Sapiens
gcuacccggucacggaggccggccaccugcagagccucuacacagguagugccccgaggggcug

SEQ ID NO: 164335 - RNA, 64 nt, Homo Sapiens
cucccuggcuacauggucaaauguuggggcucuuccucuacagcuggcgcuguuggggcugcuc

SEQ ID NO: 164336 - RNA, 64 nt, Homo Sapiens
ggacaugcacacacaaguaacccugcagccuuccccucuacacauggguggcacagcagugccc

SEQ ID NO: 164337 - RNA, 64 nt, Homo Sapiens
uaguuauugauaaacuucuucaguaugugaauauccucuacacugaccuuucccuaugacuugg

SEQ ID NO: 164338 - RNA, 64 nt, Homo Sapiens
uguuugcaucauacaucuucucuuuccuuguuuuccucuacaauuggaggagaaacaaauauau

SEQ ID NO: 164339 - RNA, 64 nt, Homo Sapiens
uuuuucagaaacuuuccaaacugcuuuacauagaccucuacaaguagggaauguuuucugaagc

SEQ ID NO: 164340 - RNA, 57 nt, Homo Sapiens; identical to SEQ ID NO: 159488

SEQ ID NO: 164341 - RNA, 64 nt, Homo Sapiens
cuaggaucacaggaagacuucguuuugcuuuuagccucuacaugccugguuuuuguuugguuuu

SEQ ID NO: 164342 - RNA, 64 nt, Homo Sapiens
gaccaaaacucauucucuuauuucuuuuuguguaccucuacagaucuaguaguuauuuuuccuu

SEQ ID NO: 164343 - RNA, 64 nt, Homo Sapiens
guaauuuuuagaagcaagaagaaagccauuguguccucuacaauuaacaaaacuuaucucugau

SEQ ID NO: 164344 - RNA, 64 nt, Homo Sapiens
ucuuucauuuacauaggguguaaccaucaagaaaccucuacaggguacuuaagccccagaagau

SEQ ID NO: 164345 - RNA, 64 nt, Homo Sapiens
ccacacuuaaaagauggugaauauugaggccuguccucuacauaaaaagauaugaagaacuauu

SEQ ID NO: 164346 - RNA, 64 nt, Homo Sapiens
ucuggcuguaguuaugaccuucauaggugucuagccucuacaguugaauagaauacauuauacc

SEQ ID NO: 164347 - RNA, 64 nt, Homo Sapiens
uuggaggugauggugcagcauugccuucaucucuccucuacagucuuggaaauuccuccaaagu

SEQ ID NO: 164348 - RNA, 64 nt, Homo Sapiens
uugaaccuaauacccugcccuugacaucuggaaaccucuacauauuuauauaacgugauacauu

SEQ ID NO: 164349 - RNA, 64 nt, Homo Sapiens
ucccaccuccuggugguaccauuauuauagaagcccucuacagccugacuuucucuccagcggu

SEQ ID NO: 164350 - RNA, 64 nt, Homo Sapiens
aguaugcgauguaauuaaagaaauuauuggauaaccucuacaaauaaagauaggggaacucuga

SEQ ID NO: 164351 - RNA, 64 nt, Homo Sapiens
guuuuaaaugucuuuauugacuuuaaauucauugccucuacauuauucauuaguucuucuuuuc

SEQ ID NO: 164352 - RNA, 64 nt, Homo Sapiens
gaacccaguugaauaggauccaaucccugguuagccucuacacaauaauagggagacaaggauu

SEQ ID NO: 164353 - RNA, 64 nt, Homo Sapiens
cauuugggcuaucagagguaccccugggcaggagccucuacauccccuucccccuccucucucc

SEQ ID NO: 164354 - RNA, 64 nt, Homo Sapiens
uuguaugauauguaaaacaggugagcugcacugaccucuacauuugacugaauagugugguuca

SEQ ID NO: 164355 - RNA, 64 nt, Homo Sapiens
agccugggccucggcgucaaucaucgauaagaagccucuacagcaccccugcccccuaauuuau

SEQ ID NO: 164356 - RNA, 64 nt, Homo Sapiens
guugguuccugagaggucugagggccagagcugcccucuacauuaacaugcugucucuaagggu

SEQ ID NO: 164357 - RNA, 64 nt, Homo Sapiens
guuuuauggaauaccugguacgaaauguaaauggccucuacagaagguguaauuacagaauuua

SEQ ID NO: 164358 - RNA, 55 nt, Homo Sapiens; identical to SEQ ID NO: 159506

SEQ ID NO: 164359 - RNA, 64 nt, Homo Sapiens
uauuucauuccccucaucuuagcauccuaggaugccucuacauguuaauucuuuuuagaacuga

SEQ ID NO: 164360 - RNA, 64 nt, Homo Sapiens
cuucaugccccaugcauuaguguggcucugccacccucuacagcgacauaggcuccaucuauuu

SEQ ID NO: 164361 - RNA, 64 nt, Homo Sapiens
aagagaacuauaacaugaacucuauaacagucuaccucuacacuauaagucaaguuucacuggc

SEQ ID NO: 164362 - RNA, 64 nt, Homo Sapiens
uuaggagacuucaucuaaagcaugaaaccuagcuccucuacacacaaauuccuauggaaauacc

SEQ ID NO: 164363 - RNA, 64 nt, Homo Sapiens
ccuaaguggucucuguucuacacuuuaaugucacccucuacaucaucuuaccuagcccacccaa

SEQ ID NO: 164364 - RNA, 64 nt, Homo Sapiens
caaauggagaaguucaggaagagcuugauccagaccucuacaagggaugaaggacgugucucag

SEQ ID NO: 164365 - RNA, 64 nt, Homo Sapiens
cuugugauuccuauucgauagccuuccuucauguccucuacacagcuugguagcucugggauuu

SEQ ID NO: 164366 - RNA, 64 nt, Homo Sapiens
ucauucugcacgcagaaguccuuccacucuugcuccucuacaauaagccuuccagcuguuccug

SEQ ID NO: 164367 - RNA, 64 nt, Homo Sapiens
gcuacucccuguuauuguguagguuugucguaauccucuacaaaauaccucauuuaaucuguaa

SEQ ID NO: 164368 - RNA, 64 nt, Homo Sapiens
agggcggcuggcuggaaagccacgcguaugcugcccucuacaggcugcucggccucccugcagc

SEQ ID NO: 164369 - RNA, 64 nt, Homo Sapiens
aguuguaaaagcugaugaaccugaaauuguguagccucuacaggcugcugagguucuaaauaaa

SEQ ID NO: 164370 - RNA, 64 nt, Homo Sapiens
gugaaguugcacuauguaccgaaugugugucgaaccucuacauuugcacagaaaaacacgcauu

SEQ ID NO: 164371 - RNA, 64 nt, Homo Sapiens
cuacuacucauuccagaauuugcugucuuuugugccucuacaaguugauagaaauugagauucu

SEQ ID NO: 164372 - RNA, 64 nt, Homo Sapiens
cacaauccucaaaccaacaauuucuuuuuuuuaaccucuacagaacugugccuucuuuucuuuc

SEQ ID NO: 164373 - RNA, 64 nt, Homo Sapiens
acucucaccuuccaaaucuuggacaagaggcuggccucuacaucguaaacagaagcaacagaag

SEQ ID NO: 164374 - RNA, 64 nt, Homo Sapiens
acgcaugcauuuagaagcuuccagaaaauauuagccucuacauuauuucaggaaccaaggacug

SEQ ID NO: 164375 - RNA, 64 nt, Homo Sapiens
auggacaggaugacagacagggacgaagcagagaccucuacagacccaagucaccaaguggagc

SEQ ID NO: 164376 - RNA, 64 nt, Homo Sapiens
auacuuuuuauugagcacuuuuuucuuguauuacccucuacaaucugcccucuucuuaccccaa

SEQ ID NO: 164377 - RNA, 64 nt, Homo Sapiens
gacagcauugaucuccuggaggcugguucugcugccucuacacaggggcccuguacagugaaug

SEQ ID NO: 164378 - RNA, 64 nt, Homo Sapiens
uggaugcccugcccuguauccacuugggagagagccucuacaacaugcuggcaacuucccccuc

SEQ ID NO: 164379 - RNA, 64 nt, Homo Sapiens
aguuggaccuccauggagccacuaggccuggccuccucuacacauccccagggcuaucugguua

SEQ ID NO: 164380 - RNA, 64 nt, Homo Sapiens
guucuguuugucaguucauuccuguguguucuuaccucuacaaaguaaauuacacauuuaguuu

SEQ ID NO: 164381 - RNA, 64 nt, Homo Sapiens
gaaaugcagaagaguucauuuuguaauauaucagccucuacaauauuguuugaaugauuccggc

SEQ ID NO: 164382 - RNA, 64 nt, Homo Sapiens
gcuucccugacucauucugaugagugcucugaucccucuacagauuuccagcuggaugagaauu

SEQ ID NO: 164383 - RNA, 55 nt, Homo Sapiens; identical to SEQ ID NO: 159531

SEQ ID NO: 164384 - RNA, 64 nt, Homo Sapiens
ucacucagacuaguacaucuuaaaaggcuuacugccucuacauuauauuuaagacuuuaagacu

SEQ ID NO: 164385 - RNA, 64 nt, Homo Sapiens
gccuuuuagggggaggggguugggcugggccuggccucuacagaauuugcccccccaguggccc

SEQ ID NO: 164386 - RNA, 64 nt, Homo Sapiens
ugugauuccaaugcaggugucuucauuaccauuaccucuacacugcagaagaagcaaaacuccu

SEQ ID NO: 164387 - RNA, 64 nt, Homo Sapiens
cuuggaagcaggcucccaauagggagggggcugcccucuacagucucuuugacuguaagacagg

SEQ ID NO: 164388 - RNA, 64 nt, Homo Sapiens
uucaggguucuaaccuuucuaacccacuaaguaaccucuacaggcauuuaacugccuuacagac

SEQ ID NO: 164389 - RNA, 64 nt, Homo Sapiens
ggguccauggucuauuuauucucgcccagcucacccucuacacagacacuguccugggugcaca

SEQ ID NO: 164390 - RNA, 64 nt, Homo Sapiens
acucccucucugcucuccugucccuugagcccuuccucuacagguggggcagagaggguggugg

SEQ ID NO: 164391 - RNA, 64 nt, Homo Sapiens
aagauggcaguguucuccucuggggccugauccaccucuacaccagcccaggaagccccaucug

SEQ ID NO: 164392 - RNA, 64 nt, Homo Sapiens
ccucacuuuaauaccucuuaggaaccaaagaaugccucuacaagcaaaaagauaguugaaaaua

SEQ ID NO: 164393 - RNA, 64 nt, Homo Sapiens
ugauaaccaaguagccauuuuccucuuaagguuuccucuacaaccccaaggacuuucaugauua

SEQ ID NO: 164394 - RNA, 64 nt, Homo Sapiens
uauauauacguacagagccuugcgcgugugugagccucuacacaugccgcucugcgugugcgug

SEQ ID NO: 164395 - RNA, 64 nt, Homo Sapiens
uguauuuuccacuugcauaaccuucuaucucgucccucuacagaacuuggaguuagaucuaggu

SEQ ID NO: 164396 - RNA, 64 nt, Homo Sapiens
ucaagaaauagcgcagugucgcacugauggaaucccucuacaggaauaaauaauuauaaauuga

SEQ ID NO: 164397 - RNA, 64 nt, Homo Sapiens
aaucuucaggaagccugcuagaaaacacugaaaaccucuacaacaagcugaaaaggggauccuu

SEQ ID NO: 164398 - RNA, 64 nt, Homo Sapiens
aaguuuugcauuguagaauuuauaaucagucuggccucuacaacguguucgagcacagaacgga

SEQ ID NO: 164399 - RNA, 64 nt, Homo Sapiens
gccugguagacaagugcuacuuccucaucacuccccucuacagucuccuaagcaguccuggcuu

SEQ ID NO: 164400 - RNA, 64 nt, Homo Sapiens
uuaauuuucuuuuuuggcccuaggcugguugggaccucuacagcuucauucuuucaccauuaaa

SEQ ID NO: 164401 - RNA, 64 nt, Homo Sapiens
agcagauccccagccucuggccuccuguucgccuccucuacaauuugccauuguuucuccuggg

SEQ ID NO: 164402 - RNA, 64 nt, Homo Sapiens
auggaccagugggaaggauaggauuagcacugcaccucuacauccaucaagagagacagagcgc

SEQ ID NO: 164403 - RNA, 51 nt, Homo Sapiens; identical to SEQ ID NO: 159551

SEQ ID NO: 164404 - RNA, 64 nt, Homo Sapiens
agagcaaagugaccugguuaaacaaaccagaaucccucuacauggacucagagaaaagagauug

SEQ ID NO: 164405 - RNA, 64 nt, Homo Sapiens
ucugcuugagauauuuccuccugugucuuucauaccucuacaugcaugccccggcaccucugcc

SEQ ID NO: 164406 - RNA, 64 nt, Homo Sapiens
uccaucuuguuucacccacccacugcucucuuuuccucuacagcccuaagggauuccugggugc

SEQ ID NO: 164407 - RNA, 64 nt, Homo Sapiens
ccuuuacuaacauucauguuauggcaagaguuguccucuacauuggaaagcuaauccuaccuug

SEQ ID NO: 164408 - RNA, 64 nt, Homo Sapiens
ccccccacucuacuuaucaucggaggagaccaggccucuacacacaguugggaggggcaccguc

SEQ ID NO: 164409 - RNA, 64 nt, Homo Sapiens
ggcuugcccuuguccgugugcccccaggacuuugccucuacagcauuuucuuacacccccuccc

SEQ ID NO: 164410 - RNA, 64 nt, Homo Sapiens
aacgccaagggcagcaccauuccucagacaacagccucuacaccaacugcagaccaacuacccc

SEQ ID NO: 164411 - RNA, 64 nt, Homo Sapiens
cucuuugccacacuagaggcgugagccuguggcuccucuacauaucgccacaacauggcucuuu

SEQ ID NO: 164412 - RNA, 64 nt, Homo Sapiens
aauuaacaucgugggucacucuuuugcaaacuguccucuacaucgauuaagggcaaaucuauua

SEQ ID NO: 164413 - RNA, 64 nt, Homo Sapiens
aggucgaauucaugaccugaugaaaaaaccuacaccucuacagcggguugcugaugagagaacc

SEQ ID NO: 164414 - RNA, 64 nt, Homo Sapiens
agaacauccuguuugugaauucugaguuugaaacccucuacaaugagcacaagguauugguggg

SEQ ID NO: 164415 - RNA, 64 nt, Homo Sapiens
aauaacugcugcaggugugacuguaccuucugaaccucuacaccauuauuucuguaguuggaau

SEQ ID NO: 164416 - RNA, 64 nt, Homo Sapiens
uacaccaaagaggaagaagagcuguggaggccacccucuacaaagcuuuauagaacuucuggau

SEQ ID NO: 164417 - RNA, 64 nt, Homo Sapiens
ugucucggcuguaggaaucaacagaaggagacguccucuacauaaaagcuccaugugaaaagcu

SEQ ID NO: 164418 - RNA, 64 nt, Homo Sapiens
ccguccuggaggaggugaugcuggucccuggccaccucuacagcccugaacucuugagacaacu

SEQ ID NO: 164419 - RNA, 64 nt, Homo Sapiens
uucugaggcugagaggacaccuauaugcguauuuccucuacacacaucaccccccuucuauaau

SEQ ID NO: 164420 - RNA, 64 nt, Homo Sapiens
cauaguguuacaggaagugauccugaaggcauuuccucuacagauuauggcacucuccgaaucc

SEQ ID NO: 164421 - RNA, 64 nt, Homo Sapiens
uuuguaauuaacucuggggguccgggccuauuuuccucuacauuuacuuuaaauugcaaagucu

SEQ ID NO: 164422 - RNA, 64 nt, Homo Sapiens
ggcagcagggcuccauucucuggccuggcccaggccucuacauacuuacuccagccauuugggg

SEQ ID NO: 164423 - RNA, 64 nt, Homo Sapiens
guggagaacauugcauaggaaugucuggaaaaagccucuacaacuuguuacagccuucacauuu

SEQ ID NO: 164424 - RNA, 64 nt, Homo Sapiens
agagcaugcucacccagcucugcuccaaggccuuccucuacaccuucugccaccaccugcaccu

SEQ ID NO: 164425 - RNA, 64 nt, Homo Sapiens
ccuucccucccgauuucccgauucccccacccucccucuacacuugaggaccacaguugggggu

SEQ ID NO: 164426 - RNA, 64 nt, Homo Sapiens
ugcugcaaggggaaucgucagaguccaaugugugccucuacaguaaugucggaaauaaauacca

SEQ ID NO: 164427 - RNA, 64 nt, Homo Sapiens
cguuguauguccuuuuuuaagccaagagcccagaccucuacaaaagaagagugaaagaacuccu

SEQ ID NO: 164428 - RNA, 64 nt, Homo Sapiens
uggccuauucugggcuagaccacaccucuuucugccucuacauaggcaaaagagguaagcagau

SEQ ID NO: 164429 - RNA, 64 nt, Homo Sapiens
gccccuuggggccugcgcccgaugcccaccccgcccucuacacgggcacugcaggccaggccag

SEQ ID NO: 164430 - RNA, 64 nt, Homo Sapiens
uaccucuucuauggacuggugaacaugcgugugaccucuacagcagcaggagccugagccuugg

SEQ ID NO: 164431 - RNA, 64 nt, Homo Sapiens
caggggcgcugcugcagauggugcgcuccucaccccucuacagacuugcccacccccgaucccc

SEQ ID NO: 164432 - RNA, 64 nt, Homo Sapiens
ucugcuuacuggugugggcacuauggauuucaggccucuacacuagaaaaaugcuaagucccag

SEQ ID NO: 164433 - RNA, 64 nt, Homo Sapiens
cuuccucaggccccugucucgaguuccgccccacccucuacagcgcaggaggcguucggaggag

SEQ ID NO: 164434 - RNA, 64 nt, Homo Sapiens
cacuaggagcaccuuucucaggacguagcguuucccucuacaagaagggagagccauacugcac

SEQ ID NO: 164435 - RNA, 64 nt, Homo Sapiens
uuuucugagaaagguuuggaugacugaaauauuuccucuacagucaaggacuuuggcauguggu

SEQ ID NO: 164436 - RNA, 64 nt, Homo Sapiens
gacauauuuucuucauagucccuaauauagucauccucuacagaguuggcgugcugugugcacu

SEQ ID NO: 164437 - RNA, 64 nt, Homo Sapiens
uuuaauugacacagaauacauuucacauauuuaaccucuacaauaaguucugacacauuuucca

SEQ ID NO: 164438 - RNA, 64 nt, Homo Sapiens
agcugucuaggacucacgggguucggaagccacaccucuacaugucuaaaacaaaaaacaacaa

SEQ ID NO: 164439 - RNA, 64 nt, Homo Sapiens
uuuuaguuugcuucaccuaaccguuguaguggaaccucuacauggccaacucuucaugccccug

SEQ ID NO: 164440 - RNA, 64 nt, Homo Sapiens
cugcauggcauccuccagccccuguagaacucaaccucuacaggguuagaguuuggagagagca

SEQ ID NO: 164441 - RNA, 64 nt, Homo Sapiens
aagggucgggggaggggggagccuuguagggaggccucuacacagaagaaagcagcccccaugu

SEQ ID NO: 164442 - RNA, 64 nt, Homo Sapiens
acaagagcaucaggcucagcuagaagauccacauccucuacaggucggggaccaaaggcugauu

SEQ ID NO: 164443 - RNA, 64 nt, Homo Sapiens
cccaagcguuccuggccuucugaacuccauacagccucuacagccgucccgcguucaagacuug

SEQ ID NO: 164444 - RNA, 64 nt, Homo Sapiens
cugauucugagauggcuuuugcugcucuguucucccucuacauuucucugcagaacucgcguua

SEQ ID NO: 164445 - RNA, 64 nt, Homo Sapiens
guccggcuucgggaagugcccccuccacgcucguccucuacagaggcugcccccacccgaaaga

SEQ ID NO: 164446 - RNA, 64 nt, Homo Sapiens
uuauggaaagaaaauauuuuaaagaaacaaaccaccucuacauaaaagaaaagaaaaaaaaaaa

SEQ ID NO: 164447 - RNA, 64 nt, Homo Sapiens
ccuauaagaagcagguacuuaugaucucgcuuuuccucuacaggcccuaguccuggccagaagg

SEQ ID NO: 164448 - RNA, 64 nt, Homo Sapiens
gacauccggguacuacauuuacuuccuucugaguccucuacaaaccacuuaagaccccuccucu

SEQ ID NO: 164449 - RNA, 64 nt, Homo Sapiens
caggaaugagucccuaggggacugcucccagcaaccucuacauccacgcccaguggaugauccu

SEQ ID NO: 164450 - RNA, 64 nt, Homo Sapiens
aaaaaaaaaaaauaauaauaacauagcgagacuaccucuacaaaguuugagaccacccugggca

SEQ ID NO: 164451 - RNA, 64 nt, Homo Sapiens
acccacgcgcaccaccucuccggucgcguggcugccucuacagccuaccuauacgucccuuuuu

SEQ ID NO: 164452 - RNA, 64 nt, Homo Sapiens
cagauaccccuucuccucacagucagaacagcagccucuacacauguuguccugccccuggcaa

SEQ ID NO: 164453 - RNA, 64 nt, Homo Sapiens
ggggaguggaaauucagccugcuuagaggacugaccucuacaguucauauuugcagugacauaa

SEQ ID NO: 164454 - RNA, 64 nt, Homo Sapiens
acguggcuauaacaucuauaacaaaacgacgauuccucuacaagaggcuguuucucacugcuaa

SEQ ID NO: 164455 - RNA, 64 nt, Homo Sapiens
agcuagauuguaagcuccuggaggacagggaccaccucuacaaaaaauaaaaaaaguaccuccc

SEQ ID NO: 164456 - RNA, 64 nt, Homo Sapiens
uuaaagggggagagggaaaacucuucuucuccuuccucuacauuuucacucacaaaccucuuau

SEQ ID NO: 164457 - RNA, 64 nt, Homo Sapiens
uaagcuaucucugggaugccucuaggcccccuucccucuacacaccucugggaaaagauuacac

SEQ ID NO: 164458 - RNA, 64 nt, Homo Sapiens
cugucuucuugcacacgcugagaagcuagccagcccucuacaaggauguggcuacaaagugagg

SEQ ID NO: 164459 - RNA, 64 nt, Homo Sapiens
gagucacaggaaggguauaagugaguuagucuucccucuacacgcuuuuggauucuuauggacu

SEQ ID NO: 164460 - RNA, 64 nt, Homo Sapiens
cuuccaagcuagcugcugccuccuuacuccuggcccucuacaugaagaagcucggauacugggu

SEQ ID NO: 164461 - RNA, 64 nt, Homo Sapiens
ucgagaccagccuggccaacauggugaaaccccaccucuacaaaaaauacaaaaauuagccggg

SEQ ID NO: 164462 - RNA, 64 nt, Homo Sapiens
auacuguaaacaucuuugcaugucaauaaauaugccucuacaacauauuuuugaaucacuuaau

SEQ ID NO: 164463 - RNA, 64 nt, Homo Sapiens
aaaugccaccuaggaggauccaaagucugaaucuccucuacaauguuuccuuucucccaaaaca

SEQ ID NO: 164464 - RNA, 64 nt, Homo Sapiens
auguucauuguuccugguuuuuuccagccagcagccucuacacuccaucauaggacaucgaguc

SEQ ID NO: 164465 - RNA, 64 nt, Homo Sapiens
uucgacgucgcauuugcgcauugaacuccauccaccucuacacccuaucgccuuuuaugaugcu

SEQ ID NO: 164466 - RNA, 64 nt, Homo Sapiens
aacugagauguguuaaauaaguucauaugucacuccucuacacuauaaccuuguggaaagacau

SEQ ID NO: 164467 - RNA, 64 nt, Homo Sapiens
auacagcccugucacauugacacuacagcauaccccucuacaaccagguuaggaaaggauucag

SEQ ID NO: 164468 - RNA, 64 nt, Homo Sapiens
cuuucaaacacauauuaguccuaccaccuuaguuccucuacagcaaaagaggcuuuucuucuua

SEQ ID NO: 164469 - RNA, 64 nt, Homo Sapiens; identical to SEQ ID NO: 144190

SEQ ID NO: 164470 - RNA, 64 nt, Homo Sapiens; identical to SEQ ID NO: 144191

SEQ ID NO: 164471 - RNA, 64 nt, Homo Sapiens; identical to SEQ ID NO: 144192

SEQ ID NO: 164472 - RNA, 64 nt, Homo Sapiens; identical to SEQ ID NO: 144193

SEQ ID NO: 164473 - RNA, 64 nt, Homo Sapiens; identical to SEQ ID NO: 144194

SEQ ID NO: 164474 - RNA, 64 nt, Homo Sapiens; identical to SEQ ID NO: 144195

SEQ ID NO: 164475 - RNA, 64 nt, Homo Sapiens; identical to SEQ ID NO: 144196

SEQ ID NO: 164476 - RNA, 64 nt, Homo Sapiens; identical to SEQ ID NO: 144197

SEQ ID NO: 164477 - RNA, 64 nt, Homo Sapiens; identical to SEQ ID NO: 144198

SEQ ID NO: 164478 - RNA, 64 nt, Homo Sapiens; identical to SEQ ID NO: 144199

SEQ ID NO: 164479 - RNA, 64 nt, Homo Sapiens; identical to SEQ ID NO: 144200

SEQ ID NO: 164480 - RNA, 64 nt, Homo Sapiens; identical to SEQ ID NO: 144201

SEQ ID NO: 164481 - RNA, 64 nt, Homo Sapiens; identical to SEQ ID NO: 144202

SEQ ID NO: 164482 - RNA, 64 nt, Homo Sapiens; identical to SEQ ID NO: 144203

SEQ ID NO: 164483 - RNA, 64 nt, Homo Sapiens; identical to SEQ ID NO: 144204

SEQ ID NO: 164484 - RNA, 64 nt, Homo Sapiens; identical to SEQ ID NO: 144205

SEQ ID NO: 164485 - RNA, 64 nt, Homo Sapiens; identical to SEQ ID NO: 144206

SEQ ID NO: 164486 - RNA, 64 nt, Homo Sapiens; identical to SEQ ID NO: 144207

SEQ ID NO: 164487 - RNA, 64 nt, Homo Sapiens; identical to SEQ ID NO: 144208

SEQ ID NO: 164488 - RNA, 64 nt, Homo Sapiens; identical to SEQ ID NO: 144209

SEQ ID NO: 164489 - RNA, 64 nt, Homo Sapiens; identical to SEQ ID NO: 144210

SEQ ID NO: 164490 - RNA, 64 nt, Homo Sapiens; identical to SEQ ID NO: 144211

SEQ ID NO: 164491 - RNA, 64 nt, Homo Sapiens; identical to SEQ ID NO: 144212

SEQ ID NO: 164492 - RNA, 64 nt, Homo Sapiens; identical to SEQ ID NO: 144213

SEQ ID NO: 164493 - RNA, 64 nt, Homo Sapiens; identical to SEQ ID NO: 144214

SEQ ID NO: 164494 - RNA, 64 nt, Homo Sapiens; identical to SEQ ID NO: 144215

SEQ ID NO: 164495 - RNA, 64 nt, Homo Sapiens; identical to SEQ ID NO: 144216

SEQ ID NO: 164496 - RNA, 64 nt, Homo Sapiens; identical to SEQ ID NO: 144217

SEQ ID NO: 164497 - RNA, 64 nt, Homo Sapiens; identical to SEQ ID NO: 144218

SEQ ID NO: 164498 - RNA, 64 nt, Homo Sapiens; identical to SEQ ID NO: 144219

SEQ ID NO: 164499 - RNA, 64 nt, Homo Sapiens; identical to SEQ ID NO: 144220

SEQ ID NO: 164500 - RNA, 64 nt, Homo Sapiens; identical to SEQ ID NO: 144221

SEQ ID NO: 164501 - RNA, 64 nt, Homo Sapiens; identical to SEQ ID NO: 144222

SEQ ID NO: 164502 - RNA, 64 nt, Homo Sapiens; identical to SEQ ID NO: 144223

SEQ ID NO: 164503 - RNA, 64 nt, Homo Sapiens; identical to SEQ ID NO: 144224

SEQ ID NO: 164504 - RNA, 64 nt, Homo Sapiens; identical to SEQ ID NO: 144225

SEQ ID NO: 164505 - RNA, 64 nt, Homo Sapiens; identical to SEQ ID NO: 144226

SEQ ID NO: 164506 - RNA, 64 nt, Homo Sapiens; identical to SEQ ID NO: 144227

SEQ ID NO: 164507 - RNA, 64 nt, Homo Sapiens; identical to SEQ ID NO: 144228

SEQ ID NO: 164508 - RNA, 64 nt, Homo Sapiens; identical to SEQ ID NO: 144229

SEQ ID NO: 164509 - RNA, 64 nt, Homo Sapiens; identical to SEQ ID NO: 144230

SEQ ID NO: 164510 - RNA, 64 nt, Homo Sapiens; identical to SEQ ID NO: 144231

SEQ ID NO: 164511 - RNA, 64 nt, Homo Sapiens; identical to SEQ ID NO: 144232

SEQ ID NO: 164512 - RNA, 64 nt, Homo Sapiens; identical to SEQ ID NO: 144233

SEQ ID NO: 164513 - RNA, 64 nt, Homo Sapiens; identical to SEQ ID NO: 144234

SEQ ID NO: 164514 - RNA, 64 nt, Homo Sapiens; identical to SEQ ID NO: 144235

SEQ ID NO: 164515 - RNA, 64 nt, Homo Sapiens; identical to SEQ ID NO: 144236

SEQ ID NO: 164516 - RNA, 64 nt, Homo Sapiens; identical to SEQ ID NO: 144237

SEQ ID NO: 164517 - RNA, 64 nt, Homo Sapiens; identical to SEQ ID NO: 144238

SEQ ID NO: 164518 - RNA, 64 nt, Homo Sapiens; identical to SEQ ID NO: 144239

SEQ ID NO: 164519 - RNA, 64 nt, Homo Sapiens; identical to SEQ ID NO: 144240

SEQ ID NO: 164520 - RNA, 64 nt, Homo Sapiens; identical to SEQ ID NO: 144241

SEQ ID NO: 164521 - RNA, 64 nt, Homo Sapiens; identical to SEQ ID NO: 144242

SEQ ID NO: 164522 - RNA, 64 nt, Homo Sapiens; identical to SEQ ID NO: 144243

SEQ ID NO: 164523 - RNA, 64 nt, Homo Sapiens; identical to SEQ ID NO: 144244

SEQ ID NO: 164524 - RNA, 64 nt, Homo Sapiens; identical to SEQ ID NO: 144245

SEQ ID NO: 164525 - RNA, 64 nt, Homo Sapiens; identical to SEQ ID NO: 144246

SEQ ID NO: 164526 - RNA, 64 nt, Homo Sapiens; identical to SEQ ID NO: 144247

SEQ ID NO: 164527 - RNA, 64 nt, Homo Sapiens; identical to SEQ ID NO: 144248

SEQ ID NO: 164528 - RNA, 64 nt, Homo Sapiens; identical to SEQ ID NO: 144249

SEQ ID NO: 164529 - RNA, 64 nt, Homo Sapiens; identical to SEQ ID NO: 144250

SEQ ID NO: 164530 - RNA, 64 nt, Homo Sapiens; identical to SEQ ID NO: 144251

SEQ ID NO: 164531 - RNA, 64 nt, Homo Sapiens; identical to SEQ ID NO: 144252

SEQ ID NO: 164532 - RNA, 64 nt, Homo Sapiens; identical to SEQ ID NO: 144253

SEQ ID NO: 164533 - RNA, 64 nt, Homo Sapiens; identical to SEQ ID NO: 144254

SEQ ID NO: 164534 - RNA, 64 nt, Homo Sapiens; identical to SEQ ID NO: 144255

SEQ ID NO: 164535 - RNA, 64 nt, Homo Sapiens
acuucaguguggaauuuccucuuugaggagccugggcuuggaucuauccugaucuggugaugaa

SEQ ID NO: 164536 - RNA, 64 nt, Homo Sapiens
gugaugaagccaugauuacuuuagaccuagcccaggcuuggaggccagcuggaggaagaagggu

SEQ ID NO: 164537 - RNA, 64 nt, Homo Sapiens
cccgaagagcucccaccuucucuggaugugccugggcuuggacuggcuagaaucuuucucugga

SEQ ID NO: 164538 - RNA, 64 nt, Homo Sapiens
accccagaguggaaaggugaacaccugcagcugaggcuuggaaacguuucuuguguugcccuga

SEQ ID NO: 164539 - RNA, 64 nt, Homo Sapiens
ugaacuagaauaggaaauagguuuucaauaacagggcuuggaaacucucucuucuagagaagag

SEQ ID NO: 164540 - RNA, 64 nt, Homo Sapiens
aauccugguagaaaggccagugcuuccuauccugggcuuggaagggaguacccauuccugccgu

SEQ ID NO: 164541 - RNA, 64 nt, Homo Sapiens
ggaggagugaaccugggcuaccccaccccugccaggcuuggaucgauaccuacacaccaugaug

SEQ ID NO: 164542 - RNA, 64 nt, Homo Sapiens
gauguuuauacccucugaauggaaagaggaacagggcuuggauucuccaagucccccccauguu

SEQ ID NO: 164543 - RNA, 64 nt, Homo Sapiens
accgagccacugacagguauccuggcccccauggggcuuggaggcagagaggcuuggaauuggg

SEQ ID NO: 164544 - RNA, 64 nt, Homo Sapiens
ugggccuggcccccauggggacccuaaccagagaggcuuggaauggaggacuaagaaagcuacc

SEQ ID NO: 164545 - RNA, 64 nt, Homo Sapiens
uugcaggucccuuucuacugugacacaugguacaggcuuggagcgggucauguuuuugcugugg

SEQ ID NO: 164546 - RNA, 64 nt, Homo Sapiens
gccuugugucuugggaacaaaagaaggaaggagaggcuuggaaagggcuuggguccaguggagg

SEQ ID NO: 164547 - RNA, 64 nt, Homo Sapiens
aagcugggcgaccaagcacaagcauacaggggaaggcuuggaccgccagccccaccuugaaagc

SEQ ID NO: 164548 - RNA, 64 nt, Homo Sapiens
ucgggugguggagaugacaagcagcaaggagcagggcuuggagcaaacugauggccaaccuaga

SEQ ID NO: 164549 - RNA, 64 nt, Homo Sapiens
acaacaauacccauagucaaugguuuauuccucuggcuuggauggcuuuugacuaucuuaugca

SEQ ID NO: 164550 - RNA, 64 nt, Homo Sapiens
gggaucugggaagccagguaaaaaacaucuuuuuggcuuggaaaaggcuuggcaaguuuugucu

SEQ ID NO: 164551 - RNA, 64 nt, Homo Sapiens
augugggucccuaugaguguaacacacagcuggaggcuuggaacgcugcugcuugaggaagcag

SEQ ID NO: 164552 - RNA, 64 nt, Homo Sapiens
gcuucuguguuuuuuuuguugagaguuucuuagaggcuuggacuuguuuaaggauuuagggugg

SEQ ID NO: 164553 - RNA, 64 nt, Homo Sapiens
ccucuaggcacaggcgggcccagaccggcuucucggcuuggauccugggcuggguggccccugu

SEQ ID NO: 164554 - RNA, 64 nt, Homo Sapiens
gcccaaggccacggagcaguucagaguggaggcgggcuuggaacccggugcucccucugucauc

SEQ ID NO: 164555 - RNA, 64 nt, Homo Sapiens
cuugccguggugccccuggcuugagugugcucugggcuuggacaaaggcguuugugggguggag

SEQ ID NO: 164556 - RNA, 64 nt, Homo Sapiens
ugcuguggagggugcccagcgggacagcucacgaggcuuggaccccagcagacguggugugaga

SEQ ID NO: 164557 - RNA, 64 nt, Homo Sapiens
ugccauggagggugcccagcgggacgguucacaaggcuuggaccugcccggcagacgugugaga

SEQ ID NO: 164558 - RNA, 64 nt, Homo Sapiens
ugguggagggugcccggcaggggauggcucacgaggcuuggaccccagcagacgugguaugaga

SEQ ID NO: 164559 - RNA, 64 nt, Homo Sapiens
ugccguggagggugcccagcgagauggcucaugaggcuuggaccccggcagauguggugggaga

SEQ ID NO: 164560 - RNA, 64 nt, Homo Sapiens
ugccauggagggugcccggcgggacggcucacagggcuuggaccccagcagacguggugugaga

SEQ ID NO: 164561 - RNA, 64 nt, Homo Sapiens
ugcuguggagggugcccagcgggacggcucacgaggcuuggaccccggcagacguggcgugaga

SEQ ID NO: 164562 - RNA, 64 nt, Homo Sapiens
agaagacacccuuguagacaacaacuguuuugggggcuuggagccccacuugaagcccccucuu

SEQ ID NO: 164563 - RNA, 64 nt, Homo Sapiens
gagaccagcaguuaacggugccuggggugaggacggcuuggagggccaggguguucuucugcac

SEQ ID NO: 164564 - RNA, 64 nt, Homo Sapiens
auuugggagacugagcuugauauggaaaggguguggcuuggaaccuuggauugguaccagagcc

SEQ ID NO: 164565 - RNA, 64 nt, Homo Sapiens
ggcgcugagggcaggguucugcauucugggguggggcuuggaagaaggagaggagugcgcuaga

SEQ ID NO: 164566 - RNA, 64 nt, Homo Sapiens; identical to SEQ ID NO: 60311

SEQ ID NO: 164567 - RNA, 64 nt, Homo Sapiens; identical to SEQ ID NO: 60312

SEQ ID NO: 164568 - RNA, 64 nt, Homo Sapiens; identical to SEQ ID NO: 60313

SEQ ID NO: 164569 - RNA, 64 nt, Homo Sapiens; identical to SEQ ID NO: 60314

SEQ ID NO: 164570 - RNA, 64 nt, Homo Sapiens; identical to SEQ ID NO: 60315

SEQ ID NO: 164571 - RNA, 64 nt, Homo Sapiens; identical to SEQ ID NO: 60316

SEQ ID NO: 164572 - RNA, 64 nt, Homo Sapiens; identical to SEQ ID NO: 60317

SEQ ID NO: 164573 - RNA, 64 nt, Homo Sapiens; identical to SEQ ID NO: 60318

SEQ ID NO: 164574 - RNA, 64 nt, Homo Sapiens; identical to SEQ ID NO: 60319

SEQ ID NO: 164575 - RNA, 64 nt, Homo Sapiens; identical to SEQ ID NO: 60320

SEQ ID NO: 164576 - RNA, 64 nt, Homo Sapiens; identical to SEQ ID NO: 60321

SEQ ID NO: 164577 - RNA, 64 nt, Homo Sapiens; identical to SEQ ID NO: 60322

SEQ ID NO: 164578 - RNA, 64 nt, Homo Sapiens; identical to SEQ ID NO: 60323

SEQ ID NO: 164579 - RNA, 64 nt, Homo Sapiens; identical to SEQ ID NO: 60324

SEQ ID NO: 164580 - RNA, 64 nt, Homo Sapiens; identical to SEQ ID NO: 60325

SEQ ID NO: 164581 - RNA, 64 nt, Homo Sapiens; identical to SEQ ID NO: 60326

SEQ ID NO: 164582 - RNA, 64 nt, Homo Sapiens; identical to SEQ ID NO: 60327

SEQ ID NO: 164583 - RNA, 64 nt, Homo Sapiens; identical to SEQ ID NO: 60328

SEQ ID NO: 164584 - RNA, 64 nt, Homo Sapiens; identical to SEQ ID NO: 60329

SEQ ID NO: 164585 - RNA, 64 nt, Homo Sapiens; identical to SEQ ID NO: 60330

SEQ ID NO: 164586 - RNA, 64 nt, Homo Sapiens; identical to SEQ ID NO: 92427

SEQ ID NO: 164587 - RNA, 64 nt, Homo Sapiens; identical to SEQ ID NO: 92428

SEQ ID NO: 164588 - RNA, 64 nt, Homo Sapiens; identical to SEQ ID NO: 92429

SEQ ID NO: 164589 - RNA, 64 nt, Homo Sapiens; identical to SEQ ID NO: 92430

SEQ ID NO: 164590 - RNA, 64 nt, Homo Sapiens; identical to SEQ ID NO: 92431

SEQ ID NO: 164591 - RNA, 64 nt, Homo Sapiens; identical to SEQ ID NO: 92432

SEQ ID NO: 164592 - RNA, 64 nt, Homo Sapiens; identical to SEQ ID NO: 92433

SEQ ID NO: 164593 - RNA, 64 nt, Homo Sapiens; identical to SEQ ID NO: 92434

SEQ ID NO: 164594 - RNA, 64 nt, Homo Sapiens; identical to SEQ ID NO: 92435

SEQ ID NO: 164595 - RNA, 64 nt, Homo Sapiens; identical to SEQ ID NO: 92436

SEQ ID NO: 164596 - RNA, 64 nt, Homo Sapiens; identical to SEQ ID NO: 92437

SEQ ID NO: 164597 - RNA, 64 nt, Homo Sapiens; identical to SEQ ID NO: 92438

SEQ ID NO: 164598 - RNA, 64 nt, Homo Sapiens; identical to SEQ ID NO: 92439

SEQ ID NO: 164599 - RNA, 64 nt, Homo Sapiens; identical to SEQ ID NO: 92440

SEQ ID NO: 164600 - RNA, 64 nt, Homo Sapiens; identical to SEQ ID NO: 92441

SEQ ID NO: 164601 - RNA, 64 nt, Homo Sapiens; identical to SEQ ID NO: 92442

SEQ ID NO: 164602 - RNA, 64 nt, Homo Sapiens; identical to SEQ ID NO: 92443

SEQ ID NO: 164603 - RNA, 64 nt, Homo Sapiens; identical to SEQ ID NO: 92444

SEQ ID NO: 164604 - RNA, 64 nt, Homo Sapiens; identical to SEQ ID NO: 92445

SEQ ID NO: 164605 - RNA, 64 nt, Homo Sapiens; identical to SEQ ID NO: 92446

SEQ ID NO: 164606 - RNA, 64 nt, Homo Sapiens; identical to SEQ ID NO: 92447

SEQ ID NO: 164607 - RNA, 64 nt, Homo Sapiens; identical to SEQ ID NO: 92448

SEQ ID NO: 164608 - RNA, 64 nt, Homo Sapiens; identical to SEQ ID NO: 92449

SEQ ID NO: 164609 - RNA, 64 nt, Homo Sapiens; identical to SEQ ID NO: 92450

SEQ ID NO: 164610 - RNA, 64 nt, Homo Sapiens; identical to SEQ ID NO: 92451

SEQ ID NO: 164611 - RNA, 64 nt, Homo Sapiens; identical to SEQ ID NO: 92452

SEQ ID NO: 164612 - RNA, 64 nt, Homo Sapiens; identical to SEQ ID NO: 92453

SEQ ID NO: 164613 - RNA, 64 nt, Homo Sapiens; identical to SEQ ID NO: 92454

SEQ ID NO: 164614 - RNA, 64 nt, Homo Sapiens; identical to SEQ ID NO: 92455

SEQ ID NO: 164615 - RNA, 64 nt, Homo Sapiens; identical to SEQ ID NO: 92456

SEQ ID NO: 164616 - RNA, 64 nt, Homo Sapiens; identical to SEQ ID NO: 92457

SEQ ID NO: 164617 - RNA, 64 nt, Homo Sapiens; identical to SEQ ID NO: 92458

SEQ ID NO: 164618 - RNA, 64 nt, Homo Sapiens; identical to SEQ ID NO: 92459

SEQ ID NO: 164619 - RNA, 64 nt, Homo Sapiens; identical to SEQ ID NO: 92460

SEQ ID NO: 164620 - RNA, 64 nt, Homo Sapiens; identical to SEQ ID NO: 92461

SEQ ID NO: 164621 - RNA, 64 nt, Homo Sapiens; identical to SEQ ID NO: 92462

SEQ ID NO: 164622 - RNA, 64 nt, Homo Sapiens; identical to SEQ ID NO: 92463

SEQ ID NO: 164623 - RNA, 64 nt, Homo Sapiens; identical to SEQ ID NO: 92464

SEQ ID NO: 164624 - RNA, 64 nt, Homo Sapiens; identical to SEQ ID NO: 92465

SEQ ID NO: 164625 - RNA, 64 nt, Homo Sapiens; identical to SEQ ID NO: 92466

SEQ ID NO: 164626 - RNA, 64 nt, Homo Sapiens; identical to SEQ ID NO: 92463

SEQ ID NO: 164627 - RNA, 64 nt, Homo Sapiens; identical to SEQ ID NO: 92464

SEQ ID NO: 164628 - RNA, 64 nt, Homo Sapiens
uuaucuaacacauuuuuuacauguacauuuuaauuugauucagcuggucugaaucucugaauuu

SEQ ID NO: 164629 - RNA, 64 nt, Homo Sapiens
cauaccauaaagcaucugcuaaugcuuuaauggauugauucaauuaagaccugagugacacuau

SEQ ID NO: 164630 - RNA, 64 nt, Homo Sapiens
caaggguuuccaaacuugucauucaagauguauuuugauucaucuuggcugucucugguccuug

SEQ ID NO: 164631 - RNA, 64 nt, Homo Sapiens
auguauuuugauucauccaagcugucucugguccuugauucaaguuucuuuucuuuuguuuuug

SEQ ID NO: 164632 - RNA, 64 nt, Homo Sapiens
uaugggugaaguaagguauggcuuuaccauaaccuugauucauucacccuugauucauuucucg

SEQ ID NO: 164633 - RNA, 64 nt, Homo Sapiens
guauggcuuuaccauaaccuugauucauucacccuugauucauuucucgcccccgucacugauu

SEQ ID NO: 164634 - RNA, 64 nt, Homo Sapiens
acacaucuguggggucuccuggguucagcggcuguugauucaaggucaacauugaccauuggag

SEQ ID NO: 164635 - RNA, 64 nt, Homo Sapiens
uuuaagcuguuuuaugaaaaagaccuagaaguucuugauucauuuuuaccauucuuuccauagg

SEQ ID NO: 164636 - RNA, 64 nt, Homo Sapiens
accugccuguuuuuguuggugcacagagauugacuugauucagagagacaauucacuccauccc

SEQ ID NO: 164637 - RNA, 64 nt, Homo Sapiens
ugcugcugagccucuauuuucuuucuuugauguuuugauucaguauucuuuuaucauaaauuuu

SEQ ID NO: 164638 - RNA, 64 nt, Homo Sapiens
auggcuggguuacuaaccuuguugagaaaaaccuuugauucaggcauccauacacuaaggccua

SEQ ID NO: 164639 - RNA, 64 nt, Homo Sapiens
ucaccuuccaugauugcuuugauaugaagauggauugauucagcccuuuagauuggaggaagug

SEQ ID NO: 164640 - RNA, 64 nt, Homo Sapiens
cuuaaaaauaaggucaucagauaucaccaccagcuugauucaacccauuuuccugcuaugaaau

SEQ ID NO: 164641 - RNA, 64 nt, Homo Sapiens
uccucugauuauggacauguugaagcuuucauccuugauucaaaccauguaauauuuuacauca

SEQ ID NO: 164642 - RNA, 64 nt, Homo Sapiens
auaauuguccuugacuaagaagauaguaaacagauugauucaugucucagaacuuguguuaagu

SEQ ID NO: 164643 - RNA, 64 nt, Homo Sapiens
ugguuuacauauuuaguggggccugaagauggacuugauucaaagccauuccuaacuuguuugu

SEQ ID NO: 164644 - RNA, 64 nt, Homo Sapiens
agaagagaguuuuaaaaaacaaaacaauguaaguaaaggauauuucugaaucuuaaaauucauc

SEQ ID NO: 164645 - RNA, 64 nt, Homo Sapiens
cauaaacucauaaaaauaauuuuaagaugucggaaaaggauacuuugauuaaauaaaaacacuc

SEQ ID NO: 164646 - RNA, 64 nt, Homo Sapiens
acguguacucacagagggagagaaagauguguacaaaggauauguauaaauauucuauuuaguc

SEQ ID NO: 164647 - RNA, 64 nt, Homo Sapiens
uaucaauuucuggauucauaauagcaagauuagcaaaggauaaaugccgaaggucacuucauuc

SEQ ID NO: 164648 - RNA, 64 nt, Homo Sapiens
cugaacauuaagcagauuggcucagacacaaugaaaaggauaauccaauguacgugcuggugca

SEQ ID NO: 164649 - RNA, 64 nt, Homo Sapiens
cuaaaguucucuccuuccugccuccccuaaagaaaaaggauauuagauugcacacuauaauuuu

SEQ ID NO: 164650 - RNA, 64 nt, Homo Sapiens
uauugauguauguauguucauucaaagaaugggaaaaggauaugacauauauuugccaguacuu

SEQ ID NO: 164651 - RNA, 64 nt, Homo Sapiens
aggugaggcccagcuaguaaucccuuuuagugggaaaggauauguucuaggagaaacaagcaau

SEQ ID NO: 164652 - RNA, 64 nt, Homo Sapiens
gcgauguuucaggaggcugguggaauugcuuaccaaaggauaguuccucccccagcuaucuaua

SEQ ID NO: 164653 - RNA, 64 nt, Homo Sapiens
uaagaaaauacaauaaacuaucugaaaauuccagaaaggauauuuaauuuuuuuauguuuuguu

SEQ ID NO: 164654 - RNA, 64 nt, Homo Sapiens
agugacuguuuuucaagaagaaauguguuucauaaaaggauauuuauaucucuguugcuuugac

SEQ ID NO: 164655 - RNA, 64 nt, Homo Sapiens
uuuuaugucucuuuuguuaacagaaaccacuuuuaaaggauaguaauuauucuuguuuauaaca

SEQ ID NO: 164656 - RNA, 64 nt, Homo Sapiens
aauguuaaaucuucuaggaaacuuaaaaagauuaaaaggauacuguauguaugcaguaugccuu

SEQ ID NO: 164657 - RNA, 64 nt, Homo Sapiens
uuucacuuaauaaacacguuccuuuuuuauuuuuaaaggauacguucauuuauauacaggcuuc

SEQ ID NO: 164658 - RNA, 64 nt, Homo Sapiens
aucauuuguuuuuccugaccaguauuuaaaaccaaaaggauauucugaaaaauggccaacaauu

SEQ ID NO: 164659 - RNA, 64 nt, Homo Sapiens
ggggcaucauuuuguuuugucuuucguagcagggaaaggauaugacaauggggaggacaguucu

SEQ ID NO: 164660 - RNA, 64 nt, Homo Sapiens
auacauuuacacucccaaauugcaggcuuuauuuaaaggauaaaauuuaaaggauaaaaaaaca

SEQ ID NO: 164661 - RNA, 64 nt, Homo Sapiens
ccaaauugcaggcuuuauuuaaaggauaaaauuuaaaggauaaaaaaacagucacucuguuaag

SEQ ID NO: 164662 - RNA, 64 nt, Homo Sapiens
uuaauaaguucuuucugcuucuaauuguguaaagaaaggauauuacaugaagcaaaauacuaau

SEQ ID NO: 164663 - RNA, 64 nt, Homo Sapiens
cccauuugauccuaaccuuuuauggauuucuuuaaaaggauaugauaugaacuuuaaaugauua

SEQ ID NO: 164664 - RNA, 64 nt, Homo Sapiens
ucaauuuuguaucuauuucucaagcaugguaguuaaaggauacuagguggaagggaaauguuac

SEQ ID NO: 164665 - RNA, 64 nt, Homo Sapiens
uauauacucaguucccaaaauaaagaauggauugaaaggauaugauggauaaauuauguaaaac

SEQ ID NO: 164666 - RNA, 64 nt, Homo Sapiens
guugaggugagggcugugguccugaaagggacgccuuugacaucguggcuguccaguugggcug

SEQ ID NO: 164667 - RNA, 64 nt, Homo Sapiens
agcugcccaucuccugugauugcacaaccaagcacuuugacauuugcaccuuaggagaggcaga

SEQ ID NO: 164668 - RNA, 64 nt, Homo Sapiens
uggucuucaguucugugcccacagagccauccuccuuugacaccgcacuggggacacaaagggg

SEQ ID NO: 164669 - RNA, 64 nt, Homo Sapiens
uaccaaucaccaagcaugcaucuuuuaucuuuuucuuugacauuccgcgcccggcuauauuuua

SEQ ID NO: 164670 - RNA, 64 nt, Homo Sapiens
gcagaggcagaguauuugucugacuucauuugcacuuugacagauauuuuaaacccugucucca

SEQ ID NO: 164671 - RNA, 64 nt, Homo Sapiens
uucggaaccguucacccaugggguuaaaggguuucuuugacacauucucgacauaucuagacag

SEQ ID NO: 164672 - RNA, 64 nt, Homo Sapiens
gucaucuagcccccaggagaagguccaugcagcucuuugacaaucacaggaugagaacaucaug

SEQ ID NO: 164673 - RNA, 64 nt, Homo Sapiens
aaccaugauggcucggucaguuucucuucaaugccuuugacaccacuccagcaccuaugccacu

SEQ ID NO: 164674 - RNA, 64 nt, Homo Sapiens
uugugagccaggcaggguagggauuagugucccccuuugacaaaugacagaacugaggguugca

SEQ ID NO: 164675 - RNA, 64 nt, Homo Sapiens
cgcauccguauagcacuuuaaaguuucugcaguccuuugacacauaggaucucauggagccuca

SEQ ID NO: 164676 - RNA, 64 nt, Homo Sapiens
guaauguaauuuuuaccuuaaugguuuuccuuuacuuugacaaaauguacugauaaaaacaaac

SEQ ID NO: 164677 - RNA, 64 nt, Homo Sapiens
uugcacagagcucuuuggcaaaauaaucugaacucuuugacaaauauuuuaauccuuuuacaua

SEQ ID NO: 164678 - RNA, 64 nt, Homo Sapiens
cuuuuacuguguugaagcuaaaaaaauaauggcucuuugacaaaacuuguuauguugaucgcgg

SEQ ID NO: 164679 - RNA, 64 nt, Homo Sapiens
aaagaagaacguaaguuguacaaagauauuuguacuuugacaaacugaauuuaaauaaacuuua

SEQ ID NO: 164680 - RNA, 64 nt, Homo Sapiens
aaguaggauguuguugccuuuaacuuuucuuauccaggggaaaauugccauuuuagggucagca

SEQ ID NO: 164681 - RNA, 64 nt, Homo Sapiens
cccuggaagcagcauugugugauauucucagaggcaggggaaaauagagggaaaaauagagacu

SEQ ID NO: 164682 - RNA, 64 nt, Homo Sapiens
acuggcucuggccucagguggggcgcaggagagccaggggaaaagugccucauaguuaggaaag

SEQ ID NO: 164683 - RNA, 64 nt, Homo Sapiens
aggcccacccaacugaaggcauggcggcggggugcaggggaaaguuaaaggugaugacgaucau

SEQ ID NO: 164684 - RNA, 64 nt, Homo Sapiens
gggcacugaguggccuggcucugaggaagggagucaggggaagccugucccgggaaggcccagg

SEQ ID NO: 164685 - RNA, 64 nt, Homo Sapiens
gcuccaaccacugccaagugaucacucuuaggcccaggggaacacaaugacuaucauuacugau

SEQ ID NO: 164686 - RNA, 64 nt, Homo Sapiens
acagccuauggggaacugcccugugagacaggagcaggggaaccuugcuggaagcugucuuagg

SEQ ID NO: 164687 - RNA, 64 nt, Homo Sapiens
cuccagaggaacaaggucaagaagccccagcccccaggggaaacgaccucaagauuccuggaaa

SEQ ID NO: 164688 - RNA, 64 nt, Homo Sapiens
ugcucauuuagucccgucuuccucaccgccccagcaggggaacgcucaagccugguugaaaugc

SEQ ID NO: 164689 - RNA, 64 nt, Homo Sapiens
acugccacacagaagcugaagacaacaccugcuucaggggaacacaggcgcuugaaaaagaaaa

SEQ ID NO: 164690 - RNA, 64 nt, Homo Sapiens
cagacuggucucaggagcgcgccuucauaaaaugcaggggaagcguucuuccuuccccaucugg

SEQ ID NO: 164691 - RNA, 64 nt, Homo Sapiens
cuuggaccaagcugggcgacuugaaagcagcauacaggggaaggaggcccccgccagccccacc

SEQ ID NO: 164692 - RNA, 64 nt, Homo Sapiens
acuuacaaaaugcuacagugaggaagaugauugucaggggaaaaugaaagcuuaagugggaaaa

SEQ ID NO: 164693 - RNA, 64 nt, Homo Sapiens
uuccugagugacagcuugguauaaaacugacaggcaggggaaucagacuugguuuuuagaauuc

SEQ ID NO: 164694 - RNA, 64 nt, Homo Sapiens
aaacuuucuuagacacacugugauuacaaggaaccaggggaaaacucuuccugccccuaguauu

SEQ ID NO: 164695 - RNA, 64 nt, Homo Sapiens
ucuguuguugcagcugcuucuuugaggguagaggcaggggaagauuccuaccuucucuggggga

SEQ ID NO: 164696 - RNA, 64 nt, Homo Sapiens
uguggcccgcuggcagccaguguuuccgugugaccaggggaaugcggaggaacaggccuugggc

SEQ ID NO: 164697 - RNA, 64 nt, Homo Sapiens
agagcccucaaaggccucuuccccauggcuggggcaggggaaagcccccagcaucuccuggggc

SEQ ID NO: 164698 - RNA, 64 nt, Homo Sapiens
gccagcucagaggguggucagaugguggugagaccaggggaaagcaccugugucccagcccucu

SEQ ID NO: 164699 - RNA, 64 nt, Homo Sapiens
ccucacuugauccuuuugccaaacuugucaaacucaggggaacuggcuucccaguugccccuuu

SEQ ID NO: 164700 - RNA, 64 nt, Homo Sapiens
ucccaggauccuggagagggagaacuccuggccccaggggaaagaggggggggucucccguuuc

SEQ ID NO: 164701 - RNA, 64 nt, Homo Sapiens
aggccacugugaggagagggguugccccagaaggcaggggaaggaccugaugagaacagaauag

SEQ ID NO: 164702 - RNA, 64 nt, Homo Sapiens
guuaagggaugaaggcaaggcugcaggucuggcccaggggaauuaaaagccagccacuccagug

SEQ ID NO: 164703 - RNA, 64 nt, Homo Sapiens
aauaaaaauuuuagaaaacuauugaaagaaaucacaggggaaacugcacuuagacugacagaau

SEQ ID NO: 164704 - RNA, 64 nt, Homo Sapiens
uuuguagcagggccacaaaacaaagugaaacguccaggggaacccaacaguccuaugucaucua

SEQ ID NO: 164705 - RNA, 64 nt, Homo Sapiens
guuuccccaccccagaaacauguaacgguugguaccaugcuaagcccuugccaugcuaagcccu

SEQ ID NO: 164706 - RNA, 64 nt, Homo Sapiens
aacauguaacgguugguaccaugcuaagcccuugccaugcuaagcccuuuacagucauauccua

SEQ ID NO: 164707 - RNA, 64 nt, Homo Sapiens
uaaugacuuuggggaaaagaugauucugggucuuucccuugacuucuuguuucaauuacaaacu

SEQ ID NO: 164708 - RNA, 64 nt, Homo Sapiens
uggcucagaaguagagggagaagaggaacccaguucccuugacuucccuuuugagagcacacgu

SEQ ID NO: 164709 - RNA, 64 nt, Homo Sapiens
agcaugugcguguucuguuggcaagccacagugcucccuugacugaagacauuuccagguagau

SEQ ID NO: 164710 - RNA, 64 nt, Homo Sapiens
uuuuucucugaacuugauauaaagauuuuauuugucccuugaaaaaguaacaaaugugcauaga

SEQ ID NO: 164711 - RNA, 64 nt, Homo Sapiens
gaggccagcgucacacucccucucugcucuccugucccuugagcccuuccucuacagguggggc

SEQ ID NO: 164712 - RNA, 64 nt, Homo Sapiens
ucacguccuuaacugugcucucccuccuuuccucucccuugagcuugguucugcccagcacucg

SEQ ID NO: 164713 - RNA, 64 nt, Homo Sapiens
caagaguacuugcuuucaaguuauuuggucagcaucccuugacuggcuaguuggccuccucauu

SEQ ID NO: 164714 - RNA, 64 nt, Homo Sapiens
ugaaguaaugguacagacugcugaaagaagacagucccuugacucucuacugaauauucugacu

SEQ ID NO: 164715 - RNA, 64 nt, Homo Sapiens
cugugguuuauuucuuuuuucuauugcuucuuucucccuugagucccuugaaggcagggaauag

SEQ ID NO: 164716 - RNA, 64 nt, Homo Sapiens
auuucuuuuuucuauugcuucuuucucccuugagucccuugaaggcagggaauagacuucuaga

SEQ ID NO: 164717 - RNA, 64 nt, Homo Sapiens
aacuacaguuuuuccaaacuugaaugugcuauucauaagcuagauagaugaagagccaacuuga

SEQ ID NO: 164718 - RNA, 64 nt, Homo Sapiens
cuaauuuuugagagaaacacuauauaauauccucauaagcuauuuguaauauaccaauuaguuu

SEQ ID NO: 164719 - RNA, 64 nt, Homo Sapiens
ggaauucaagguugguucaacaucuaaaaaucaaauaagcuaauauacagucaguucucauuau

SEQ ID NO: 164720 - RNA, 64 nt, Homo Sapiens
ggaauucaagguuuguucaacaucuaaaaaucaaauaagcuaauaaagaaaagagguuuauacu

SEQ ID NO: 164721 - RNA, 64 nt, Homo Sapiens
uuguauacacauuugcauauacccacauggggacauaagcuaauuuuuuuacaggacacagaau

SEQ ID NO: 164722 - RNA, 64 nt, Homo Sapiens
caaagcgaugucagagggcgguuuugagcuuucuauaagcuauagcuuuguuuauuucacccgu

SEQ ID NO: 164723 - RNA, 64 nt, Homo Sapiens
uuaaaaacaaacaaacaaaaaaaaaaucuguuagauaagcuaucaaaaugcagcuguuguuuug

SEQ ID NO: 164724 - RNA, 64 nt, Homo Sapiens
aaacagagucucaagacccccgcucuggacugucauaagcuagcacccgugguaagcgggacga

SEQ ID NO: 164725 - RNA, 64 nt, Homo Sapiens
uucuagugacccaugugucaugccuuuguuguauauaagcuaaauuggugaguuuaguugugca

SEQ ID NO: 164726 - RNA, 64 nt, Homo Sapiens
uaagggcgaugauuauuauuacaucuggagaagcauaagcuaauaacucauuuuauucucggca

SEQ ID NO: 164727 - RNA, 64 nt, Homo Sapiens
ucuguuauuucuucaucugcuggggggaaaaaguaaauuacaaacaaacaaacaaagcagaacu

SEQ ID NO: 164728 - RNA, 64 nt, Homo Sapiens
uuaaguuugcaauuucccaaacaauacaaaaagcaaauuacacacccucaccacuguucuuauc

SEQ ID NO: 164729 - RNA, 64 nt, Homo Sapiens
augaagauucagauuuuuuuaaaaaaauaaaauaaaauuacaacccaaaaacuuuuuaaaaggu

SEQ ID NO: 164730 - RNA, 64 nt, Homo Sapiens
cuuuauuuucuauuagcuguagagagaauuuaaaaaauuacauuaaccuugaugaauuguauaa

SEQ ID NO: 164731 - RNA, 64 nt, Homo Sapiens
ccugguacuuuggacuuccauggcuuguuauauaaaauuacauuuuuacauguaaaaauaaacu

SEQ ID NO: 164732 - RNA, 64 nt, Homo Sapiens
uguagaagcuaaauugaucuuuauaauuaagcagaaauuacaaaacuaggaauaaucaacauug

SEQ ID NO: 164733 - RNA, 64 nt, Homo Sapiens
auacuuucuuuuuucuuggagagaaccguuuaaaaaauuacaagauauauuuaaaaaguaacca

SEQ ID NO: 164734 - RNA, 64 nt, Homo Sapiens
auuuaagugccugggggaaggauacaauuuuuagaaauuacauauugggucaguuuuguuuugu

SEQ ID NO: 164735 - RNA, 64 nt, Homo Sapiens
acugccuuugcaacacugcaauuuugucuuuggaaaauuacaaccauacuuggagaaguaugua

SEQ ID NO: 164736 - RNA, 64 nt, Homo Sapiens
uauguuccuauauauuacaagcuagaaggagaucaaauuacauuaugauuuccagaguuuuuga

SEQ ID NO: 164737 - RNA, 64 nt, Homo Sapiens
uuuucugauugaacucaucuacaacccaucaucaaaauuacaaaaauauaaauccauucaggug

SEQ ID NO: 164738 - RNA, 64 nt, Homo Sapiens
caucugucuuucacuggaauuuuguuuguggcauaaauuacaguuggaauuacaaccauuguau

SEQ ID NO: 164739 - RNA, 64 nt, Homo Sapiens
uuuuuuuuguuaggcuguaaagaauuuaagcuguaaauuacauaaguuagaacaagcccaaauu

SEQ ID NO: 164740 - RNA, 64 nt, Homo Sapiens
ugacagacaaccaagcuucaauauuuuucuaaagaaauuacaggugggauaugcuagaaaaggc

SEQ ID NO: 164741 - RNA, 64 nt, Homo Sapiens
caguuucauuauucucauaauccuucugcaacugaaauuacauauugcaggagacauuuucaua

SEQ ID NO: 164742 - RNA, 64 nt, Homo Sapiens
auguuaguugcauuuagguugggcaaauagguuaaaauuacacugacagauaguuuuuacugug

SEQ ID NO: 164743 - RNA, 52 nt, Homo Sapiens
ugaacuuucuugcacuugcuacaaauuacaaaugcaaaagacagacaacuga

SEQ ID NO: 164744 - RNA, 64 nt, Homo Sapiens
uuuaaagccaugcuaaaauuaaaaagaaaauauuaaauuacacaauuacacuugucuuuacugg

SEQ ID NO: 164745 - RNA, 64 nt, Homo Sapiens
agaaguuauuuccaaguuuguguauauauuauaaaaauuacauauauaaaacuaaggcuuuuau

SEQ ID NO: 164746 - RNA, 64 nt, Homo Sapiens
uccaaaacucuaugaugauggaagaauucuauggaaauuacaaagcagaaacuauacaaugaag

SEQ ID NO: 164747 - RNA, 64 nt, Homo Sapiens
cauuuuuaaaaacuauucuuauuauuguauaugcaaauuacaugugagcuagaagaaauagcug

SEQ ID NO: 164748 - RNA, 64 nt, Homo Sapiens
auauuuacauucagaguacacuuuucuuuggaaaaaauuacagguuuuuugaaaagugaauaau

SEQ ID NO: 164749 - RNA, 64 nt, Homo Sapiens
auggacuacaggguuauuuuuauggucauaauaaaaauuacaaaaguaugaauaaaauacauac

SEQ ID NO: 164750 - RNA, 64 nt, Homo Sapiens
uauauaaaauauauaauuuaguucauucuaucuaaaauuacaugcacaagagcaauauugaauu

SEQ ID NO: 164751 - RNA, 64 nt, Homo Sapiens
uauuucagguuuccuguguuuaaucuuucaagccaaauuacagcaaugauuuugugugcaucuu

SEQ ID NO: 164752 - RNA, 64 nt, Homo Sapiens
auaccuagaucaggaauacucuuccaggaguacaaaauuacauuauugauaguuaagcucuuaa

SEQ ID NO: 164753 - RNA, 64 nt, Homo Sapiens
aucuagaugcaauuaauuuuauuccuuccaacuaaaauuacaauauuuuuagguuaaaauuauu

SEQ ID NO: 164754 - RNA, 64 nt, Homo Sapiens
aaaauaaugaauucucacuguaaauuucaaaaaaaaauuacaaaaguaugugaauuuaaaaaug

SEQ ID NO: 164755 - RNA, 64 nt, Homo Sapiens
aagaucaauuuagcuacuuuguauuuucagagucaaauuacagacgguuuccaaaggucuugag

SEQ ID NO: 164756 - RNA, 64 nt, Homo Sapiens
uuggaacucaauguggaacuuuaaacauuuugcaaaauuacauuuagagaaacccaauuuuuca

SEQ ID NO: 164757 - RNA, 64 nt, Homo Sapiens
uacagauaaucagaagaugauacugaauagauauaaauuacauguacacauguauucacuuuuu

SEQ ID NO: 164758 - RNA, 64 nt, Homo Sapiens
auauugucauaucuggcccuuugaugagaaaaggaaauuacaauaauaaaguuuuaugauuuua

SEQ ID NO: 164759 - RNA, 64 nt, Homo Sapiens
uauuucauguuuuggccaaaaauuuuuaaaaaauaaauuacaauuguucucuauuagucauuuu

SEQ ID NO: 164760 - RNA, 64 nt, Homo Sapiens
gugcuugaaguauuucuucucugguuguaauucuaaauuacagagucauuugagcuuucucccc

SEQ ID NO: 164761 - RNA, 64 nt, Homo Sapiens
gagcaguagaggauguauaauuuugggcgaaguuaaauuacaauuuauuugagguuauuccuaa

SEQ ID NO: 164762 - RNA, 64 nt, Homo Sapiens
guuuguaauaguaagaacugucccauauguuaguaaauuacauauguacaaauugaaacuguaa

SEQ ID NO: 164763 - RNA, 64 nt, Homo Sapiens
aguaauauauuaaagugaauguaaauggugguuaaaauuacauuacugugaaauucaucuucca

SEQ ID NO: 164764 - RNA, 64 nt, Homo Sapiens
gacuuaggcauuaacauguuuuuuaaaaaaagcuaaauuacauaaaaaauccuuguugaaguuu

SEQ ID NO: 164765 - RNA, 64 nt, Homo Sapiens
gcaauggaaacuauuauaagaaaaaaauggaaaaaaauuacaaguauauuuuuucuauaaaaag

SEQ ID NO: 164766 - RNA, 64 nt, Homo Sapiens
gugguaguggcauuuaaacauauuaaaaaaaaaaaaauuacacuccauuauuccagagauucag

SEQ ID NO: 164767 - RNA, 64 nt, Homo Sapiens
gcauuuauggugucugggggggcagauauuuucaaaauuacaauaaaauuuucaguguguaguu

SEQ ID NO: 164768 - RNA, 64 nt, Homo Sapiens
auauuuccucuugaacguuauguucagaaaaugcaaauuacacuauaauauaaaaccugauaua

SEQ ID NO: 164769 - RNA, 64 nt, Homo Sapiens
aggaggcuuuuucagugaucuucacuguauauguaaauuacaaauguggcuguaaaacuuauuc

SEQ ID NO: 164770 - RNA, 64 nt, Homo Sapiens
uuguugacaugcuucucuccacauuguugaaauuaaauuacacaaaaccuaauguuuaaauuac

SEQ ID NO: 164771 - RNA, 64 nt, Homo Sapiens
uuguugaaauuaaauuacaccaaaccuaauguuuaaauuacacaauuuguuaccaguuguuauc

SEQ ID NO: 164772 - RNA, 64 nt, Homo Sapiens
augcuucaguuucuguugcaaauuggugauugugaaauuacagaaagugauuuucuagucugcu

SEQ ID NO: 164773 - RNA, 64 nt, Homo Sapiens
gaugcuguuuggaggacaggaaaauuuaucgggaaaauuacauaaucccucugauuccacuauc

SEQ ID NO: 164774 - RNA, 64 nt, Homo Sapiens
aaaauacgggcaagcucuuaacuauuuaaaaaugaaauuacaggcccgggcacgguggcucaca

SEQ ID NO: 164775 - RNA, 64 nt, Homo Sapiens
aaaaauguaacuaggaagaaaaacccaauuuaagaaauuacauaaugcuuuccaaaggcaccua

SEQ ID NO: 164776 - RNA, 64 nt, Homo Sapiens
aaaaaguauauagugacauuuuuaguaugaaaccaaauuacacuaaggucuuuuguuggccaua

SEQ ID NO: 164777 - RNA, 64 nt, Homo Sapiens
agaaccagugaaacagaaaaguuaaucugcuuucaaauuacaauggugggaacaggcauaggau

SEQ ID NO: 164778 - RNA, 64 nt, Homo Sapiens
uuugcaguucuguuaggugcuuucuugaauuuagaaauuacaucuguuuuucauuuuguacaac

SEQ ID NO: 164779 - RNA, 64 nt, Homo Sapiens
aguuucauuuuuucuuugaaguuuuuugaaacugaaauuacauguaguuuaauuggcauugcuu

SEQ ID NO: 164780 - RNA, 64 nt, Homo Sapiens
cuccucuguggugucugccuguugcgugacacucuccuugcaguucuugaguugcggcagaaca

SEQ ID NO: 164781 - RNA, 64 nt, Homo Sapiens
ggcugcgcuuccuauuucuagggcugggaaacacuccuugcaucaaggggucacuuacagaaca

SEQ ID NO: 164782 - RNA, 64 nt, Homo Sapiens
aacgcacauagcucaaucacacuggaaauguuuguccuugcaccugagccuguucccacucagc

SEQ ID NO: 164783 - RNA, 64 nt, Homo Sapiens
gcccuucuauuuauuugacugauuauugcuucuuuccuugcauuaaaggagaucuuccccuaac

SEQ ID NO: 164784 - RNA, 64 nt, Homo Sapiens
aaaggcauuugccuucauaagcccaggccuccaguccuugcauguaaacaaauuaauucuaaag

SEQ ID NO: 164785 - RNA, 64 nt, Homo Sapiens
aucaaauuaauguuacuuauuacacaacauuaaauccuugcacaaggagauuuugaacuuaacu

SEQ ID NO: 164786 - RNA, 64 nt, Homo Sapiens
uaagaaaauaugaaagcuuacuuuuauauucauuuccuugcauugugaaccaggagauuuagug

SEQ ID NO: 164787 - RNA, 64 nt, Homo Sapiens
guaguguuagaauagauggcuuagauuuuauucuuccuugcagauagacacucuugagcuggac

SEQ ID NO: 164788 - RNA, 64 nt, Homo Sapiens
gaccugcuugacagacucacucggccucacuucauccuugcaaagagaauccuguacuucaucc

SEQ ID NO: 164789 - RNA, 64 nt, Homo Sapiens
cacuucauccuugcaaagagaauccuguacuucauccuugcaaagagaauccuguacuucacuc

SEQ ID NO: 164790 - RNA, 64 nt, Homo Sapiens
ugacugagaacuauuuaaagacgcaaucccagguuccuugcacaccauggcagccucuccuugc

SEQ ID NO: 164791 - RNA, 64 nt, Homo Sapiens
caaucccagguuccuugcacaccauggcagccucuccuugcaccuucuccugccucuccacacu

SEQ ID NO: 164792 - RNA, 64 nt, Homo Sapiens
ccgguuagucuccaguuuccuuuggaugugaauguccuugcagguguagaguguuguaaaauau

SEQ ID NO: 164793 - RNA, 64 nt, Homo Sapiens
ccuauuccuugucccccacccaugugacccucuuuccuugcaucuuuuggaaaucaguguuuuc

SEQ ID NO: 164794 - RNA, 64 nt, Homo Sapiens
gggguguguacagaugaagucaguggcuugucugugagcugaagagucuugagaggggcuguca

SEQ ID NO: 164795 - RNA, 64 nt, Homo Sapiens
ugccugguguccacgggggagggccaaggccugcugagcugauucuccagcugcugccccagcc

SEQ ID NO: 164796 - RNA, 64 nt, Homo Sapiens
aaccuugccuguggcacuuuugcuggcuccugggugagcugaagggccacacgccuggccagcc

SEQ ID NO: 164797 - RNA, 64 nt, Homo Sapiens
gacugaugucugaaguuugauguuggauggcuccugagcugacuuuaaaauaugaaguugguuu

SEQ ID NO: 164798 - RNA, 64 nt, Homo Sapiens
uccuuauaagaauuaaucuuuauaaaccugauguugagcugagugcugauacuaucucuuguca

SEQ ID NO: 164799 - RNA, 64 nt, Homo Sapiens
ugcccaccaccgugucaugauuagcuggccacagugagcugaugucaucuucaaccuuaaggac

SEQ ID NO: 164800 - RNA, 64 nt, Homo Sapiens
aggaagagugcaaaacauugaagagagagcugagugagcugaagagugaggauaugaguagccc

SEQ ID NO: 164801 - RNA, 64 nt, Homo Sapiens
agaaucgcuugaacccaggaggcagagguugcagugagcugagaucgugccacugcacucuagc

SEQ ID NO: 164802 - RNA, 64 nt, Homo Sapiens
agaauugcuuuaaccuuggaggcggagguugcauugagcugagaucaugcuagugcgcuccagc

SEQ ID NO: 164803 - RNA, 64 nt, Homo Sapiens
agaaucacuugaacccaggaggcagagguuggagugagcugagaucgcgccaccgcacuccagc

SEQ ID NO: 164804 - RNA, 64 nt, Homo Sapiens
gagugcaguuuccaaucccauagaugggucuggcugagcugaacccauuuugagugacucgagg

SEQ ID NO: 164805 - RNA, 64 nt, Homo Sapiens
gcauggugcaguugacagcaggugggaaaugguaugagcugaggggggccgugcccaggggccc

SEQ ID NO: 164806 - RNA, 64 nt, Homo Sapiens
cccaugaagaccaaaagcugcaagaggucaaauuugagcugauugugucagaggccuccuaccu

SEQ ID NO: 164807 - RNA, 64 nt, Homo Sapiens
cagcaagccuaagucuucucugagaggaguuucgugagcugaagaacaagcugcucauggcaag

SEQ ID NO: 164808 - RNA, 64 nt, Homo Sapiens
ucgugcuacugcacucccgcgaugaagguugcagugagcugaggagaaucacuugaacccggga

SEQ ID NO: 164809 - RNA, 64 nt, Homo Sapiens
cccagugacagugcagcaagaagagauguuccccugagcugauucuccagcguuuugggaagga

SEQ ID NO: 164810 - RNA, 64 nt, Homo Sapiens
gcagcuucaggucccuaugggcgcagcugcuccgugagcugagucucccacugcccugcacacc

SEQ ID NO: 164811 - RNA, 64 nt, Homo Sapiens
ccaccccgccucugcccagccugucuacaccgugugagcugaaucgugacuugcuucccaccuc

SEQ ID NO: 164812 - RNA, 64 nt, Homo Sapiens
ugaggauaucaaugguuaucgagaucguuuucuaugagcugaaccaauuaugggucuucauuuu

SEQ ID NO: 164813 - RNA, 64 nt, Homo Sapiens
aagcagagaaguggcguggggggaacacucaugcugagcugagaaaccgcccugacuuuacagg

SEQ ID NO: 164814 - RNA, 64 nt, Homo Sapiens
ucaccugaagugguuuacuuaauaauaaaauaagugagcugaaccugucucaaaaaaaaaaaau

SEQ ID NO: 164815 - RNA, 64 nt, Homo Sapiens
guagugucaagaaagucaaacagcacuuucgucaugagcugacauuuugagaaauagagcacaa

SEQ ID NO: 164816 - RNA, 64 nt, Homo Sapiens
uuuaaacgcaaagcuuuguaaaagccacaaggucugagcugaaccccuccuuuuugaacuuacu

SEQ ID NO: 164817 - RNA, 64 nt, Homo Sapiens
gggcugccagucacuggucugggggguggaggccugagcugagggcagggugccugaccugugu

SEQ ID NO: 164818 - RNA, 64 nt, Homo Sapiens
cugucaugugaggagaugcucacuguggucuuguugagcugauggccuugguugagcugaugga

SEQ ID NO: 164819 - RNA, 64 nt, Homo Sapiens
cucacuguggucuuguugagcugauggccuugguugagcugauggacaagugaaggaggccaug

SEQ ID NO: 164820 - RNA, 64 nt, Homo Sapiens
aggaaccuugccugcgaccaaucauggagccacgugagcugaucguggcugcaccuggggggag

SEQ ID NO: 164821 - RNA, 64 nt, Homo Sapiens
uguauuuagcagaguauuuucaacuugagugaucugagcugaauuugaagacuauuaauaaguu

SEQ ID NO: 164822 - RNA, 64 nt, Homo Sapiens
ucacgccacugcacuccagcggcggagcuugcagugagcugagaagaauggcgugaacccagga

SEQ ID NO: 164823 - RNA, 64 nt, Homo Sapiens
ucccgccacugcacuccagcggcagagguagcagugagcugaagagaaucgcuugaacccggga

SEQ ID NO: 164824 - RNA, 64 nt, Homo Sapiens
uucuggaaugaauugagaagguggcgugcuggccugagcugauggaccacuugguguuuugcgu

SEQ ID NO: 164825 - RNA, 64 nt, Homo Sapiens
agaauaacuuaaacccgggaggcggagguuacagugagcugagaucgugccacugcacuccagc

SEQ ID NO: 164826 - RNA, 64 nt, Homo Sapiens
auuuugguucuccucuguugcccuuccuaaaaaaugagcugaagaugacaguauuuuucuuuac

SEQ ID NO: 164827 - RNA, 64 nt, Homo Sapiens
gaccccugccugugacguggaggaucccagccucugagcugaguugguuuuaugaaaagcuagg

SEQ ID NO: 164828 - RNA, 64 nt, Homo Sapiens
agaaucacuugaacccaggaggcggagguugcggugagcugagauugcaccauuucauuccagc

SEQ ID NO: 164829 - RNA, 64 nt, Homo Sapiens; identical to SEQ ID NO: 97957

SEQ ID NO: 164830 - RNA, 64 nt, Homo Sapiens; identical to SEQ ID NO: 97958

SEQ ID NO: 164831 - RNA, 64 nt, Homo Sapiens; identical to SEQ ID NO: 97959

SEQ ID NO: 164832 - RNA, 64 nt, Homo Sapiens; identical to SEQ ID NO: 97960

SEQ ID NO: 164833 - RNA, 64 nt, Homo Sapiens; identical to SEQ ID NO: 97961

SEQ ID NO: 164834 - RNA, 64 nt, Homo Sapiens; identical to SEQ ID NO: 97962

SEQ ID NO: 164835 - RNA, 64 nt, Homo Sapiens; identical to SEQ ID NO: 97963

SEQ ID NO: 164836 - RNA, 64 nt, Homo Sapiens; identical to SEQ ID NO: 97964

SEQ ID NO: 164837 - RNA, 64 nt, Homo Sapiens; identical to SEQ ID NO: 97965

SEQ ID NO: 164838 - RNA, 64 nt, Homo Sapiens; identical to SEQ ID NO: 97966

SEQ ID NO: 164839 - RNA, 64 nt, Homo Sapiens; identical to SEQ ID NO: 97967

SEQ ID NO: 164840 - RNA, 64 nt, Homo Sapiens; identical to SEQ ID NO: 97968

SEQ ID NO: 164841 - RNA, 64 nt, Homo Sapiens; identical to SEQ ID NO: 97969

SEQ ID NO: 164842 - RNA, 64 nt, Homo Sapiens; identical to SEQ ID NO: 97970

SEQ ID NO: 164843 - RNA, 64 nt, Homo Sapiens; identical to SEQ ID NO: 97971

SEQ ID NO: 164844 - RNA, 64 nt, Homo Sapiens; identical to SEQ ID NO: 97972

SEQ ID NO: 164845 - RNA, 64 nt, Homo Sapiens; identical to SEQ ID NO: 97973

SEQ ID NO: 164846 - RNA, 64 nt, Homo Sapiens; identical to SEQ ID NO: 97974

SEQ ID NO: 164847 - RNA, 64 nt, Homo Sapiens; identical to SEQ ID NO: 97975

SEQ ID NO: 164848 - RNA, 64 nt, Homo Sapiens; identical to SEQ ID NO: 97976

SEQ ID NO: 164849 - RNA, 64 nt, Homo Sapiens; identical to SEQ ID NO: 97977

SEQ ID NO: 164850 - RNA, 64 nt, Homo Sapiens; identical to SEQ ID NO: 97978

SEQ ID NO: 164851 - RNA, 64 nt, Homo Sapiens; identical to SEQ ID NO: 97979

SEQ ID NO: 164852 - RNA, 64 nt, Homo Sapiens; identical to SEQ ID NO: 97980

SEQ ID NO: 164853 - RNA, 64 nt, Homo Sapiens; identical to SEQ ID NO: 97981

SEQ ID NO: 164854 - RNA, 64 nt, Homo Sapiens; identical to SEQ ID NO: 97982

SEQ ID NO: 164855 - RNA, 64 nt, Homo Sapiens; identical to SEQ ID NO: 97983

SEQ ID NO: 164856 - RNA, 64 nt, Homo Sapiens; identical to SEQ ID NO: 97984

SEQ ID NO: 164857 - RNA, 64 nt, Homo Sapiens; identical to SEQ ID NO: 97985

SEQ ID NO: 164858 - RNA, 64 nt, Homo Sapiens; identical to SEQ ID NO: 97986

SEQ ID NO: 164859 - RNA, 64 nt, Homo Sapiens
ugccuaaagagagugaugcuaacacuccaucugcccuguccauugccuucauauacagucuacu

SEQ ID NO: 164860 - RNA, 64 nt, Homo Sapiens
ugugaagucaggaggguuucuggcauuuuccacaccuguccacuccuuggagcugguuucucuc

SEQ ID NO: 164861 - RNA, 64 nt, Homo Sapiens
gaaacccaggauguagauagagggccacacccacccuguccagaguagagggcaccuguccacg

SEQ ID NO: 164862 - RNA, 64 nt, Homo Sapiens
agggccacacccacccuguccagaguagagggcaccuguccacguggccagggcccaugcugcc

SEQ ID NO: 164863 - RNA, 64 nt, Homo Sapiens
uccccaccucugaugcucaauguggccugccuuuccuguccacaccaaucuaaaggcauuguca

SEQ ID NO: 164864 - RNA, 64 nt, Homo Sapiens
aaguaguuggaccauucuggucucucuccuugucccuguccaccuccccaaugcacgaguccuc

SEQ ID NO: 164865 - RNA, 64 nt, Homo Sapiens
cagaacgguuuuugcugaggugccccugcccagcccuguccagccuuguccacacacacaucuc

SEQ ID NO: 164866 - RNA, 64 nt, Homo Sapiens
agagauugcagagguguguccugccuaccaucugccuguccagcuugguggggguccgggucac

SEQ ID NO: 164867 - RNA, 64 nt, Homo Sapiens
ucccucugcccauccgagaccgcgcgcccucgcgccuguccacaccagucccccgagucccugc

SEQ ID NO: 164868 - RNA, 64 nt, Homo Sapiens
ucccucugccccucccagaccgcggccccucgggccuguccacacgguaccccggaaucccugc

SEQ ID NO: 164869 - RNA, 64 nt, Homo Sapiens
auuuauguggggccgugcaggcaugggcccacugccuguccauccuguuucucuuauuuauuga

SEQ ID NO: 164870 - RNA, 64 nt, Homo Sapiens
gcccuucccagcuuauccgccuguuccacuuguaccuguccagcccugcccuguguugggcacc

SEQ ID NO: 164871 - RNA, 64 nt, Homo Sapiens
cugugccuggcugucccugccagggguccucaccccuguccaccgcugccaggugggccccugc

SEQ ID NO: 164872 - RNA, 64 nt, Homo Sapiens
gcccuggcaaaggcugacaacucaucuuccccgcccuguccagcauuucagcaggccaccuccc

SEQ ID NO: 164873 - RNA, 64 nt, Homo Sapiens
gaugucuaggaaugacugaaagaaaccaaaacagccuguccacugcugcugugggauggaggag

SEQ ID NO: 164874 - RNA, 64 nt, Homo Sapiens
ccaggagaugaaggaguucaguagcaaagucacaccuguccaauucccugagcuuugcucacuc

SEQ ID NO: 164875 - RNA, 64 nt, Homo Sapiens
uggcccgggcccuggccuggggccggugcuggagccuguccagcccgaggucugggcguguuug

SEQ ID NO: 164876 - RNA, 64 nt, Homo Sapiens
augggcuccagagccuuccugagaggaccggccaccuguccagcgggcaguuaucacuggggaa

SEQ ID NO: 164877 - RNA, 64 nt, Homo Sapiens
uucccuccccgccacagugacccgccugccgcccccuguccaggccugagugccagccccccac

SEQ ID NO: 164878 - RNA, 64 nt, Homo Sapiens
gcccucccuggucuggccccacucccccaggcucccuguccacuacccugcccugcgcucccca

SEQ ID NO: 164879 - RNA, 64 nt, Homo Sapiens
caaccccgagagcccuagcgucucucggagaaacccuguccacccucuggcugcugggagccca

SEQ ID NO: 164880 - RNA, 64 nt, Homo Sapiens
agggcacuguggguggcucaaguccgcauaccccccuguccagcugcugagggcccccccgugc

SEQ ID NO: 164881 - RNA, 64 nt, Homo Sapiens
aguugugucuuaaaauugaugauguguccacaaaccuguccaggaaggagguucauauucccca

SEQ ID NO: 164882 - RNA, 64 nt, Homo Sapiens
cguaaacccucuuggaaacugccagguucuaugcccuguccaagacccaaagugcaaucucacg

SEQ ID NO: 164883 - RNA, 64 nt, Homo Sapiens
acugcagccgggcccucugccuguccacacacucccuguccacaacucccuguccacacacucc

SEQ ID NO: 164884 - RNA, 64 nt, Homo Sapiens
cacucccuguccacaacugccuguccacacacucccuguccacagcucccuguccacacacucc

SEQ ID NO: 164885 - RNA, 64 nt, Homo Sapiens
cacucccuguccacacacuccuguccacacacucccuguccacaggaaaggccggccacgcucc

SEQ ID NO: 164886 - RNA, 64 nt, Homo Sapiens
cacucccuguccacacacucggccggccacgcucccuguccacauccuacagcugccuaggaaa

SEQ ID NO: 164887 - RNA, 64 nt, Homo Sapiens
uuucccauuguaaauaaacauuacauugacagguauugacuacuaacaccucuaaaaaguacuu

SEQ ID NO: 164888 - RNA, 64 nt, Homo Sapiens
aguuuuauugucacaugcuaaauauugcaugcauauugacuaauuggaauaaccauuuacucaa

SEQ ID NO: 164889 - RNA, 64 nt, Homo Sapiens
uguugagcuguagucuuguagccauaaugagcaaauugacuaagagaagcaaagguuucuuggg

SEQ ID NO: 164890 - RNA, 64 nt, Homo Sapiens
gaacauggcugaagauuuuucuaguauauuaauaauugacuaggaagaugaacuuuuuuucaga

SEQ ID NO: 164891 - RNA, 64 nt, Homo Sapiens
aauuuauuccucagguguggaaauuucuacugcaauugacuacguuugauuauuuugagcuugu

SEQ ID NO: 164892 - RNA, 64 nt, Homo Sapiens
caaaagggaagggaaggaaacuuagcagagugcuauugacuauagauucacauauuagcaacaa

SEQ ID NO: 164893 - RNA, 64 nt, Homo Sapiens
ccauaaagccacauugaguagucuaucccauaggauugacuacugcagagucuagugcagaccc

SEQ ID NO: 164894 - RNA, 64 nt, Homo Sapiens
ccauaguauugacuguagaaggagccucuacaauauugacuauauauuuuuauaaacuacuggc

SEQ ID NO: 164895 - RNA, 64 nt, Homo Sapiens
uucauauggggaauccugucagguguuugguuauauugacuauuuauuaauaguauuagaacuc

SEQ ID NO: 164896 - RNA, 64 nt, Homo Sapiens
cuguacccuuccuucuucccaugguugggaccagauugacuaccuuagggguagcggggguagg

SEQ ID NO: 164897 - RNA, 64 nt, Homo Sapiens
ugcccugcuguuuuacugguuacuauuuuuuuuaauugacuaauauuuuauuacacauaacaug

SEQ ID NO: 164898 - RNA, 64 nt, Homo Sapiens
caauaugucauuaaaauuaagauaagacuuguuuauugacuagcucagaaaagagaugagauga

SEQ ID NO: 164899 - RNA, 64 nt, Homo Sapiens
uauagcaccuauuaaaagaggggagcagcagagaauugacuagauuaacuuggggcaggaagaa

SEQ ID NO: 164900 - RNA, 64 nt, Homo Sapiens
uuuguuuuuauuaaaaggaauuuaaauagaugacauugacuauuucuauaacaaaggauacuua

SEQ ID NO: 164901 - RNA, 64 nt, Homo Sapiens
uuacugguuuuuauucccauaaugaaaacauaggauugacuagucaaguuuuuauacuuucuga

SEQ ID NO: 164902 - RNA, 64 nt, Homo Sapiens
cuuaguugagucacugaggucuguaacgcuagauauugacuaucauaaaaauuuuacuuaaaau

SEQ ID NO: 164903 - RNA, 64 nt, Homo Sapiens
uucuuaaauucuagucacuagucauuaugagaguauugacuaaauauuuucacaaucuaaauau

SEQ ID NO: 164904 - RNA, 64 nt, Homo Sapiens
aaauuacuuuugugggggaaugccuaauaaauacauugacuauauauaaaaugaauauauacau

SEQ ID NO: 164905 - RNA, 64 nt, Homo Sapiens
uuuauuuuuucuuuucuuuacaaaccauuuuguuauugacuaacaggccaaagagucuccaguu

SEQ ID NO: 164906 - RNA, 64 nt, Homo Sapiens
cugaaaaaauuaagucagcucagcacgaguugaaauugacuacauuaauuucuuuccaccuaga

SEQ ID NO: 164907 - RNA, 64 nt, Homo Sapiens
cucauuagguaaugauaaauauuucccuuaaauaauugacuauuuugcuguguuuuaaaaauga

SEQ ID NO: 164908 - RNA, 64 nt, Homo Sapiens
uuaauuguuuuaagaagaaaacagugucucauaaauugacuauccuggcaucacauuuaacaug

SEQ ID NO: 164909 - RNA, 64 nt, Homo Sapiens
ucaugaaaucucccuuuuacuggaaaacaggaauauugacuaccaaaucacaaugcaauugaag

SEQ ID NO: 164910 - RNA, 64 nt, Homo Sapiens
gaaauaaaauaugcauuuuauuugauugauggucauugacuacuaauuaguuuucuuuccuuua

SEQ ID NO: 164911 - RNA, 64 nt, Homo Sapiens
aagucuacuugagcauguuguggaauuugggugaauugacuagaauuuauaaaccaauuccugu

SEQ ID NO: 164912 - RNA, 64 nt, Homo Sapiens
ugagcuccuucacuuaaaaacaagaugguaggauauugacuaacuuacauuggaagggagcuuu

SEQ ID NO: 164913 - RNA, 64 nt, Homo Sapiens
uugaguucuccuagugaggacauggagacuaagcauugacuaccuucacaggacagagcagagc

SEQ ID NO: 164914 - RNA, 64 nt, Homo Sapiens
uuaguggauuuuuucugauaaauuagagcauuuaauugacuauuuuauucagguugaucuguug

SEQ ID NO: 164915 - RNA, 64 nt, Homo Sapiens
aggauaugaagauuugagaacuuuuuaacuauucauugacuaaaaaugaacauuaauguuaaag

SEQ ID NO: 164916 - RNA, 64 nt, Homo Sapiens
gaauucaucuguuuauacaagucuaccacugccgauugacuaaaaaauacauuaucccaugcau

SEQ ID NO: 164917 - RNA, 64 nt, Homo Sapiens
uuuugaggcuucuguuccucucuuuuccuguuguauugacuauuuucguucauuacuugauuaa

SEQ ID NO: 164918 - RNA, 64 nt, Homo Sapiens
guuuagagauuuuaaguuggaacaguauuuucccauugacuacuuuucauucuucacuguaguu

SEQ ID NO: 164919 - RNA, 64 nt, Homo Sapiens
acguagugaguacuagagaguucuguauuuuauuauugacuauaauaauuaguuuaauuagcuu

SEQ ID NO: 164920 - RNA, 64 nt, Homo Sapiens
auuaauuaccaguggauugguagaacugcuuuuuauugacuaguaaaaguuacugccuaugcuu

SEQ ID NO: 164921 - RNA, 64 nt, Homo Sapiens
uuacagagguauuaaaacuaaauuucacuacuagauugacuaacucaaauacacauuugcuacu

SEQ ID NO: 164922 - RNA, 64 nt, Homo Sapiens
uaugacacaggaugaggaagauuaaggauaaucaauugacuaauuucauuuagaauauuaucaa

SEQ ID NO: 164923 - RNA, 64 nt, Homo Sapiens
auguaauagaacaaacccugaugaaacauauguaauugacuaccaggagcuccuauugggagac

SEQ ID NO: 164924 - RNA, 64 nt, Homo Sapiens
ucuucaguuacaaaugggcauuuaguauaguuauauugacuauaacauguaaguaaauagcuuu

SEQ ID NO: 164925 - RNA, 64 nt, Homo Sapiens
caccaaauuaucgguauuuuaacugaauuuacccauugacuaagaaugaaccagauuugguggu

SEQ ID NO: 164926 - RNA, 64 nt, Homo Sapiens
aacuuauugcuauuuugguauauaauguuaauuuauugacuaguuugaaauaaugugaaguguu

SEQ ID NO: 164927 - RNA, 64 nt, Homo Sapiens
uacacuaaagaaaaugaacucuauuuaccugaagauugacuagcgcacaugcaaaaggacucgg

SEQ ID NO: 164928 - RNA, 64 nt, Homo Sapiens
gugugagccaggaaucacuguugaaguuuuggcaauugacuauauuauuuuaucugcuaugcua

SEQ ID NO: 164929 - RNA, 64 nt, Homo Sapiens
agcucaugcaucuuauuaaacagcccuaaaguucauugacuaauaaacacuucguugauccauc

SEQ ID NO: 164930 - RNA, 64 nt, Homo Sapiens
caguauuaguuuguggcuaugaugaaagugcuucauugacuaaaaaaaaucuguaauuuuugcu

SEQ ID NO: 164931 - RNA, 64 nt, Homo Sapiens
uaaaauagagaaugagacuauguuuuuguacuauauugacuacucuacuuguauguucggagag

SEQ ID NO: 164932 - RNA, 64 nt, Homo Sapiens
uguauuuguagcacuaagagaauuauuauuaaggauugacuagaaccuuaaaagauauaugugg

SEQ ID NO: 164933 - RNA, 64 nt, Homo Sapiens
uaugagcucggcaggaucuguucuugucauagccauugacuauacauuugcuacuggugauuca

SEQ ID NO: 164934 - RNA, 64 nt, Homo Sapiens
acacugggggaggggacauugaacaaguuguuucauugacuaucaaacugaagccagaaauaaa

SEQ ID NO: 164935 - RNA, 64 nt, Homo Sapiens
uaggacuggacacaaggaaaauaaucucuaaacuauugacuaaauuccagugagaguaugaaug

SEQ ID NO: 164936 - RNA, 64 nt, Homo Sapiens
agaaguuucuagguuugcacgaaaauuggaaacuauugacuaaguggagcaagaccucgucuca

SEQ ID NO: 164937 - RNA, 64 nt, Homo Sapiens
uucaucauaauuucaucauuugguuucugcuuucauugacuauuuuuaaugcuaguaguaaagu

SEQ ID NO: 164938 - RNA, 64 nt, Homo Sapiens
gcccuugagccaggaaaaaaacuuuucauaucuuauugacuaaaaaaagucuguuugggggcau

SEQ ID NO: 164939 - RNA, 64 nt, Homo Sapiens
cuguuacuuugggauagguugaagcauauaccucauugacuaggagagagaguuugccagaucu

SEQ ID NO: 164940 - RNA, 64 nt, Homo Sapiens
auacagauaaggaaacuggggugcagaaaagugaauugacuacaaaguagacaugacuaguuaa

SEQ ID NO: 164941 - RNA, 64 nt, Homo Sapiens
uugucucaaguucacacucuuagcauagaauauuauugacuaggcuguaugacauuuugagcuc

SEQ ID NO: 164942 - RNA, 64 nt, Homo Sapiens
guguucucuccuuguagaacaucagagaaggcacauugacuagcaaacagcacuuuaggaaaag

SEQ ID NO: 164943 - RNA, 64 nt, Homo Sapiens
ccauucagaaaugugugacccuucauuuauggauauugacuauauguaaugcagugcuauccca

SEQ ID NO: 164944 - RNA, 64 nt, Homo Sapiens
uuggacagaaagaaaagaaacuugguguuagguaauugacuaugcacuaguauuucagacuuuu

SEQ ID NO: 164945 - RNA, 64 nt, Homo Sapiens
aaaaucauuuuaauuucacuuaauuuauuuuuugauugacuagauacaguguuauuugauauuu

SEQ ID NO: 164946 - RNA, 64 nt, Homo Sapiens
gcauuccaguguccucuuucgcuugcaguuuguaauugacuaaagcuguaacuucacaucauca

SEQ ID NO: 164947 - RNA, 64 nt, Homo Sapiens
auugaauuuuauuuauuaauagaaacaucucaucauugacuaugauaucuucuccagaaguccu

SEQ ID NO: 164948 - RNA, 64 nt, Homo Sapiens
acuuaagugcugauugugaucucuuguuugcuggauugacuauaacucuuguauauuuuuuugu

SEQ ID NO: 164949 - RNA, 64 nt, Homo Sapiens
gaacuuaggaaauaaggagggaaguacaaagauuauugacuauacaaccuaccagcugaaagaa

SEQ ID NO: 164950 - RNA, 64 nt, Homo Sapiens
uuccuuagcaaaauguuggaaucccuguugcuacauugacuaaaaggucaugaugaauggaaua

SEQ ID NO: 164951 - RNA, 64 nt, Homo Sapiens
uauguuauaauuauuagacaguggaaaagccuuuauugacuaauugauuuaaccucaguccaaa

SEQ ID NO: 164952 - RNA, 64 nt, Homo Sapiens
cuuaccuagcccacccaaccuuauaaacaugauaauugacuacuuuccugagcuaaauuaacuu

SEQ ID NO: 164953 - RNA, 64 nt, Homo Sapiens
gagcaaggaauacaagacaaaacuuccucaaugcauugacuauuucuucagacucaaaacacuc

SEQ ID NO: 164954 - RNA, 64 nt, Homo Sapiens
uuugcuuuaccguauguuuauaucuaauugacauauugacuaauguuugaaagaauucaaccau

SEQ ID NO: 164955 - RNA, 64 nt, Homo Sapiens
uuguuggacuuaaacgacgagccagccgaccaagauugacuagugcgagauggguuuguucggu

SEQ ID NO: 164956 - RNA, 64 nt, Homo Sapiens
caggaguaacagguucacagcccccaggauuucuauugacuaguacugaagggcacuaauguuu

SEQ ID NO: 164957 - RNA, 64 nt, Homo Sapiens
cuguguguugagcuaaaaauauaauuuuuuaaaaauugacuagcaaaaucuauggccacacuga

SEQ ID NO: 164958 - RNA, 64 nt, Homo Sapiens
auaaauaauuacuguuuaugauauagacauugauauugacuauuuagagaaccguuguuaauuu

SEQ ID NO: 164959 - RNA, 64 nt, Homo Sapiens
cuuucuccugaaacaauuuagaaaauaguuauccauugacuagaaauuaguacaugcccacagc

SEQ ID NO: 164960 - RNA, 64 nt, Homo Sapiens
acacaguuucuuauuuaugugaacugucuugaccauugacuauguuggaaacacugcucuugcu

SEQ ID NO: 164961 - RNA, 64 nt, Homo Sapiens
gcaauuugauacauuuuuaagcuggaguguaggaauugacuauaugaaacaaagaaaacuacaa

SEQ ID NO: 164962 - RNA, 64 nt, Homo Sapiens
agucucaagcuaugccucuaauuucaccagggauauugacuaagaagacaauaaaaucuuuuuc

SEQ ID NO: 164963 - RNA, 64 nt, Homo Sapiens
uaaauaaguuuuacaaaauuuuccucuuuuguuuauugacuagauuguauauaauuuucuuuuu

SEQ ID NO: 164964 - RNA, 64 nt, Homo Sapiens
acaccaguccacacuucuauuggaaaugaucuguauugacuaaugaaugaaaccuguuucaaca

SEQ ID NO: 164965 - RNA, 64 nt, Homo Sapiens
acauuaucucacacuuucauuggaaaugauccugauugacuaaugauugaaaccugguucaaca

SEQ ID NO: 164966 - RNA, 64 nt, Homo Sapiens
gcaucaucucacacuuucauuggaaaugauucucauugacuaaugauugaaaacugguucauca

SEQ ID NO: 164967 - RNA, 64 nt, Homo Sapiens
acauuaucucacacuuucauuggcaaugauccugauugacuaaugauugaaaacugguucaaca

SEQ ID NO: 164968 - RNA, 64 nt, Homo Sapiens; identical to SEQ ID NO: 164967

SEQ ID NO: 164969 - RNA, 64 nt, Homo Sapiens
acaucaucucacacuuucauuggaaaugauucucauugacuaaugauugaaaacugguucauca

SEQ ID NO: 164970 - RNA, 64 nt, Homo Sapiens
gccauuugucuguguuuucuacuguauaguaaucauugacuaaaauguugcacaucauucauuc

SEQ ID NO: 164971 - RNA, 64 nt, Homo Sapiens
uagugucuaaugaucuugggggaauucacaguauauugacuauaccauucauuacauaguauaa

SEQ ID NO: 164972 - RNA, 64 nt, Homo Sapiens
uguaaaagagucuugaaagucuggcuuuucaggaauugacuaacaauucacaauuuugauuuuc

SEQ ID NO: 164973 - RNA, 64 nt, Homo Sapiens
auuguuuuuauuucuguaacaauugcuuccaaauauugacuacuaaaggcaguucugcaagaug

SEQ ID NO: 164974 - RNA, 64 nt, Homo Sapiens
uugucuuccuaauugggauaauuuaauuaacaagauugacuagaagugaaacugcaacacuaac

SEQ ID NO: 164975 - RNA, 64 nt, Homo Sapiens
cuugauaaucauauuauaauuuuuuaucaugauuauugacuauauuuuuggagucccauuguuu

SEQ ID NO: 164976 - RNA, 64 nt, Homo Sapiens
uguuggguacauuguuuugugugugucaggugacauugacuaauccuguugcucagagcuccug

SEQ ID NO: 164977 - RNA, 64 nt, Homo Sapiens
ucagaaacagacuuauuucauggaugggaagacuauugacuauuauucacauucucuuauaguu

SEQ ID NO: 164978 - RNA, 64 nt, Homo Sapiens
acuccaugauugauucagucuucaggaguuuacaauugacuaaccacauuuccuagucuuaacu

SEQ ID NO: 164979 - RNA, 64 nt, Homo Sapiens
ccaagcagaaucucucaaccccugaauuuuucagauugacuagagagaaaaggugucuuuccag

SEQ ID NO: 164980 - RNA, 64 nt, Homo Sapiens
ggaucugugccacaggggauuuaugcugcuuuacauugacuaugcaguugaagaguugcacauc

SEQ ID NO: 164981 - RNA, 64 nt, Homo Sapiens
gcugcuaugcugaaaugaacuuuuauaaaguauuauugacuauagccaacuacagauggcauau

SEQ ID NO: 164982 - RNA, 64 nt, Homo Sapiens
uccugccaacaugguuuggagucgacuuugguauauugacuagauuugaaaauacaagauugau

SEQ ID NO: 164983 - RNA, 64 nt, Homo Sapiens
aucucuuuuauuucacucaauuuauauuuucaucauugacuacauauuucuuauacacaacaca

SEQ ID NO: 164984 - RNA, 64 nt, Homo Sapiens
uaguguaaaauggaucuuuacauguugcaguaacauugacuauguuucaaaacucagaugcaua

SEQ ID NO: 164985 - RNA, 64 nt, Homo Sapiens
caacuugaacgcuagugguucucacagagaacuaauugacuaaagugauuccuaauauuuugua

SEQ ID NO: 164986 - RNA, 64 nt, Homo Sapiens
uucucaugcucugagguacugucaugucagccccauugacuaccccuggccagcauuguggcuu

SEQ ID NO: 164987 - RNA, 64 nt, Homo Sapiens
ucacagguugcucuccuugugaucuuggggacaaauugacuaugcuuaggcguucuaaucauga

SEQ ID NO: 164988 - RNA, 64 nt, Homo Sapiens
uauacaaaugggggcggcugaaaaaaaaaacuagauugacuauuaaagauugccucuugaauua

SEQ ID NO: 164989 - RNA, 64 nt, Homo Sapiens
auacacugaaauacuccugaagaugguggugcuuauugacuacaagaggaaauucuacaggauu

SEQ ID NO: 164990 - RNA, 64 nt, Homo Sapiens
ggaaguuuagguccuuuaaaaaaacauauuaaucauugacuacaucuaugauaaaagugcuuau

SEQ ID NO: 164991 - RNA, 64 nt, Homo Sapiens
ucauacaccuucuggguagggaaacaaccaacuaauugacuaacaccaccaacaacaaaaaaca

SEQ ID NO: 164992 - RNA, 64 nt, Homo Sapiens
cuaauuauuaaccuauauucuugccaagcuaacuauugacuauagguuugccuuuccuggagaa

SEQ ID NO: 164993 - RNA, 64 nt, Homo Sapiens
uaaacagaagcccuggccauccauguauuuugcaauugacuagaucaagaacuguuuauagcuu

SEQ ID NO: 164994 - RNA, 64 nt, Homo Sapiens
uugcaucuaauuccaggagcauuguuuuaaguugauugacuaguuauuauguacauuucagaau

SEQ ID NO: 164995 - RNA, 64 nt, Homo Sapiens
uaugugauacaaagcaaauauuuucuaaauauucauugacuaaacagccaucaagaugaaacag

SEQ ID NO: 164996 - RNA, 64 nt, Homo Sapiens
auagaauggaacucaaggaaaaacauguucacuuauugacuauuaaaccuuacaaauaauaagg

SEQ ID NO: 164997 - RNA, 64 nt, Homo Sapiens
agaaaggaugcaccuguacuuacucccagcauugauugacuauagugaagucacaucuaccuau

SEQ ID NO: 164998 - RNA, 64 nt, Homo Sapiens
aauggcuaccacgggaaagggaaggagugcugugauugacuaguuaaguggcccacaucauggg

SEQ ID NO: 164999 - RNA, 64 nt, Homo Sapiens
auuggguauaguaugguauuuuuauaauuuacaaauugacuaaacuguagcacaaauaauauaa

SEQ ID NO: 165000 - RNA, 64 nt, Homo Sapiens
cuguguguguuaauauguuuuucuuguagcauagauugacuauuugcaauaguauuaguauuua

SEQ ID NO: 165001 - RNA, 64 nt, Homo Sapiens
uguggucacaugcuuuagccauacacaugguaacauugacuauggagucuugugaaaguguaau

SEQ ID NO: 165002 - RNA, 64 nt, Homo Sapiens
acauuuuuuaaaaaaagaaaauggaugaccauuaauugacuagcauuuuagaauugaucagaca

SEQ ID NO: 165003 - RNA, 64 nt, Homo Sapiens
uuuucauaaucccaacuacaauaacaagaauuuuauugacuaauaagggaauauguauggaaga

SEQ ID NO: 165004 - RNA, 64 nt, Homo Sapiens
auuaugcaguacguucucagaaauuauugcaagcauugacuauaaacgugaugagacaaacuga

SEQ ID NO: 165005 - RNA, 64 nt, Homo Sapiens
cuuguccaucugucuguguuucuuuuugccagcuauugacuaaucuuugcugaagcugagcuag

SEQ ID NO: 165006 - RNA, 64 nt, Homo Sapiens
ccaaacauuauauuaaaaacggcagauuaagaagauugacuauaggguacucugccauagaaau

SEQ ID NO: 165007 - RNA, 64 nt, Homo Sapiens
aaggauguaguucuacacugcuccuaaagguguaauugacuagguuucugugccuauuuaaagu

SEQ ID NO: 165008 - RNA, 64 nt, Homo Sapiens
agggcuuauuucugaggaaugaaagguucccaucauugacuauggauguggaaaaccuuuccua

SEQ ID NO: 165009 - RNA, 64 nt, Homo Sapiens
gacuguuggcaagaguagcaagaugcugcagcacauugacuauagaaugagauguauccugcaa

SEQ ID NO: 165010 - RNA, 64 nt, Homo Sapiens
cacagggaccccagugcaucagcugaacgagaccauugacuacaacgagcaguucaccuggcgu

SEQ ID NO: 165011 - RNA, 64 nt, Homo Sapiens
uuuccaaaggauacuuccuuggcccuuuuucuuuauugacuagaccaccagaggaggaugugug

SEQ ID NO: 165012 - RNA, 64 nt, Homo Sapiens
guuguggaaaaccuuuccuagaaagguucccaucauugacuacgagggcuuauuucugaggaau

SEQ ID NO: 165013 - RNA, 64 nt, Homo Sapiens
uauuuuuaaaccuucaagucuaacuuugcccuggauugacuacauuacaaauaggcaaacaaca

SEQ ID NO: 165014 - RNA, 64 nt, Homo Sapiens
cccaucccuggggguaauuuacuguaggaaaaugauugacuaugaaagcuuguuuuauuucacc

SEQ ID NO: 165015 - RNA, 64 nt, Homo Sapiens
cgugugauggugagugcaaugaggaaggguggauauugacuaaagacugguuguuguuguuguu

SEQ ID NO: 165016 - RNA, 64 nt, Homo Sapiens
ugggugaaugagcuugucaaugugauuuuaaaaaauugacuaccuggaggaaugauuaggaauc

SEQ ID NO: 165017 - RNA, 64 nt, Homo Sapiens
auacagguaguuuuaaaaguacccuuuugugugaauugacuaccguuguuugcaaacccgaaaa

SEQ ID NO: 165018 - RNA, 64 nt, Homo Sapiens
aaauuuguaguuaaauuugauaaauuugaccucaauugacuacagacaaugcaaaauuuguagu

SEQ ID NO: 165019 - RNA, 64 nt, Homo Sapiens
gugcuguaaacuugcuguaauggacuaaauacuaauugacuagaaacuuuggucuucuguauuu

SEQ ID NO: 165020 - RNA, 64 nt, Homo Sapiens
guugggauuauuguuggcauuacagauguaaaagauugacuagcccauaggccaaaggccuguu

SEQ ID NO: 165021 - RNA, 64 nt, Homo Sapiens
agaaggucugauaaacugauuaauuuaaugugacauugacuauaaacauuauuuacucggauuc

SEQ ID NO: 165022 - RNA, 64 nt, Homo Sapiens
uaagaaaccagaauagucaacaguguucaaaagaauugacuaguuaucccugaggcccuuucaa

SEQ ID NO: 165023 - RNA, 64 nt, Homo Sapiens
acaauuucauuuugguggagauuucuagccaggcauugacuauuuuuucacugugcaaagggag

SEQ ID NO: 165024 - RNA, 64 nt, Homo Sapiens
auucaauaaccuuguccauuuucauauuuuuuuuauugacuauuugaugguaaguuacauuuuu

SEQ ID NO: 165025 - RNA, 64 nt, Homo Sapiens
acccugccaaguuauuuuaaaauguaccauuauuauugacuauagucaccugguuguguuauca

SEQ ID NO: 165026 - RNA, 64 nt, Homo Sapiens
uuaucaaaccacagccaugcuuacuuguuuagcuauugacuauggcugcuuuagacaacuguga

SEQ ID NO: 165027 - RNA, 64 nt, Homo Sapiens
cagucccucuggaugguggucuaaguagaacugcauugacuaacgauauauauuaaacagaaau

SEQ ID NO: 165028 - RNA, 64 nt, Homo Sapiens
acauccaucucggccuauagcauuucauuaagcuauugacuagccuaccuacauacugccacuc

SEQ ID NO: 165029 - RNA, 64 nt, Homo Sapiens
gaccggccguacaccuucuggcuggacccccgggauugacuagagcccccguggucgccuggug

SEQ ID NO: 165030 - RNA, 64 nt, Homo Sapiens
acuguguccuuagaaaaauguagguuaguuccuaauugacuaugaaucauguuaguuaauccau

SEQ ID NO: 165031 - RNA, 64 nt, Homo Sapiens
ucggccgcacacuuccagacagugugcuguuugaauugacuauuugcacucaaagucuggguau

SEQ ID NO: 165032 - RNA, 64 nt, Homo Sapiens
gucauuuauuaccuaggguacaguccuugacagaauugacuauaacguugaacaguccuguauc

SEQ ID NO: 165033 - RNA, 64 nt, Homo Sapiens
gcagauuuuggaaaucaguguccuauuuaauguuauugacuauacuauaauuacaagguuuuau

SEQ ID NO: 165034 - RNA, 64 nt, Homo Sapiens
ccaggacaguuucagugauggacauuuuuauuucauugacuaacuauccauguguaugugguua

SEQ ID NO: 165035 - RNA, 64 nt, Homo Sapiens
uaaaaaguacaaagggcacaggcacuaaacucagauugacuaaauuuaguuuaaacccaagaag

SEQ ID NO: 165036 - RNA, 64 nt, Homo Sapiens
gauggacaugaauugauaugguuggcaaaaugugauugacuagaaccauguaccauguguuaga

SEQ ID NO: 165037 - RNA, 64 nt, Homo Sapiens
gguauuuuguagaugugacagaaguccauucccaauugacuaaguaagugagauuaucucagau

SEQ ID NO: 165038 - RNA, 64 nt, Homo Sapiens
ggcccuacuagaugcagagaccccgcagagcugcauugacuaccagauuuauuuuuuaaaccag

SEQ ID NO: 165039 - RNA, 64 nt, Homo Sapiens
ugaaauacuguacguacgcuuaaucuaaauuugcauugacuauguuuuaguguauuuauaaaug

SEQ ID NO: 165040 - RNA, 64 nt, Homo Sapiens
uggaccauugugccaguugccuguguacucucccauugacuagaaauauuuuauuuuggagugg

SEQ ID NO: 165041 - RNA, 64 nt, Homo Sapiens
agccaaauuccauauguaaugccauugggagaguauugacuaaaauaucauucgucagggaaau

SEQ ID NO: 165042 - RNA, 64 nt, Homo Sapiens
ccuuuucccccgcuugcugugaaagcacagauucauugacuacaguacacuguuguucagaaaa

SEQ ID NO: 165043 - RNA, 64 nt, Homo Sapiens
aaaucugguuaaauaguucaauuauuauuaaucaauugacuauuccuuguuuaacuuggaaucu

SEQ ID NO: 165044 - RNA, 64 nt, Homo Sapiens
auaaaaauccagucuuaauuuauguaaaguugauauugacuacaagcacagcaaucugcaacaa

SEQ ID NO: 165045 - RNA, 64 nt, Homo Sapiens
cuuugauuuccuuuuuuuaaauuacugaguagaaauugacuaaaaugggucagcaugaccauua

SEQ ID NO: 165046 - RNA, 64 nt, Homo Sapiens
uacaucucuauuucucaaauggcauucuuuucccauugacuauauaacuugauaaucuuauuuu

SEQ ID NO: 165047 - RNA, 64 nt, Homo Sapiens
augaugagagauuucuuauuaacauacgaaaauucacuuggaacuugguuaguccaaacuugcu

SEQ ID NO: 165048 - RNA, 64 nt, Homo Sapiens
ugaggucucauacaaggauacugguugcauggcccacuuggagcugauuccccagcucaucucc

SEQ ID NO: 165049 - RNA, 64 nt, Homo Sapiens
gggcggaaacaucacacacaagguuuccacuucacacuuggaggguugcauggcggcugggcaa

SEQ ID NO: 165050 - RNA, 64 nt, Homo Sapiens
ccucucugcucauugggccuuacaugaugggugacacuuggaguggcacaaguugggggaaagc

SEQ ID NO: 165051 - RNA, 64 nt, Homo Sapiens
ugcucagucaaggggcugccaggcccccagaaaacacuuggagccaucggguagcgauggucua

SEQ ID NO: 165052 - RNA, 64 nt, Homo Sapiens
gccccaggccuccccagucccagugugcgagccccacuuggacacaaguguucagagagguccc

SEQ ID NO: 165053 - RNA, 64 nt, Homo Sapiens
cugaggguuggguguggaaguacacagagggucgcacuuggacuauggugacuggaacuaaggc

SEQ ID NO: 165054 - RNA, 64 nt, Homo Sapiens
uaaaugauguaaagcaaaacuuuccuuuuuuggacacuuggaucuuuguaauaaauguaauuuc

SEQ ID NO: 165055 - RNA, 64 nt, Homo Sapiens
ccagggcagggaggcuuccagccuguguuccccucacuuggaggaaccagcacucuccauccuu

SEQ ID NO: 165056 - RNA, 64 nt, Homo Sapiens
ggaagggcugggaagagacagccuccaaggucaacacuuggagaggguuucacuugcucugaag

SEQ ID NO: 165057 - RNA, 64 nt, Homo Sapiens
uaauaaucagcaagaauuugaucguuccaguucccacuuggaggccuuucaucccucgggugug

SEQ ID NO: 165058 - RNA, 64 nt, Homo Sapiens
auacuuuuuucccuuuauuacuguuguagucccucacuuggauauaccucuguuuucacgauag

SEQ ID NO: 165059 - RNA, 64 nt, Homo Sapiens
agggcauguguggggugugugcauguguucuggucacuuggagaguguacaccuggcaucugug

SEQ ID NO: 165060 - RNA, 64 nt, Homo Sapiens
agggugugugugggaugcguguguguguccuagucacuuggagaguggugugggcgcgucugug

SEQ ID NO: 165061 - RNA, 64 nt, Homo Sapiens
cugcugucaccacugugcgugagggcacgggggacacuuggaggagcuucugucccucaugccu

SEQ ID NO: 165062 - RNA, 64 nt, Homo Sapiens
ugacagcugugugaggccugguuacagcccuggucacuuggaaccccagggucagccaggaccu

SEQ ID NO: 165063 - RNA, 64 nt, Homo Sapiens
ggaaccaauuauguauuuguuuccuccuacaguggagcagcauucaaaucaaauauuuacauau

SEQ ID NO: 165064 - RNA, 64 nt, Homo Sapiens
gaaaaagugaaaaacuugaguuggcaaagaugcagagcagcagugcagauggcaaugaacucuc

SEQ ID NO: 165065 - RNA, 64 nt, Homo Sapiens
cccugggaccaagagcucucccgccuucucccucgagcagcagcaaggacccugacgcuguccc

SEQ ID NO: 165066 - RNA, 64 nt, Homo Sapiens
aagaggccaaagcaagagcagauucccuaggcaagagcagcagcacaacuaggaaaccccaaag

SEQ ID NO: 165067 - RNA, 64 nt, Homo Sapiens
cauggaugccaagcggaggccugcguggccuccugagcagcagcugaccgcccgucucaugcug

SEQ ID NO: 165068 - RNA, 64 nt, Homo Sapiens
cagggacgccgugcggaggccuacguggcugccugagcagcagcugaccgcccgucucacuguu

SEQ ID NO: 165069 - RNA, 64 nt, Homo Sapiens
gcuggugagcugcaggcugcgacgugcacaggccgagcagcacguacccuagggaagagccggu

SEQ ID NO: 165070 - RNA, 64 nt, Homo Sapiens
gacguaccuuaagauuucucugguaguggggcgggagcagcaggcccacuucccagcagcucug

SEQ ID NO: 165071 - RNA, 64 nt, Homo Sapiens
cucgucuuacagcgugacugagcauagggucauggagcagcagcuucgagaaccagaggagaag

SEQ ID NO: 165072 - RNA, 64 nt, Homo Sapiens
acuucccugugggcacagccaugaaauguugccagagcagcaacagcuguugagcaacaccuuu

SEQ ID NO: 165073 - RNA, 64 nt, Homo Sapiens
cauaucgccacagcuuugugcagaaaucuuaauugagcagcaguaaaaagcuuaaacauuucac

SEQ ID NO: 165074 - RNA, 64 nt, Homo Sapiens
caauggcgcugugcggccucaccaggcccacgaggagcagcagcgcucggcccggagcagcagg

SEQ ID NO: 165075 - RNA, 64 nt, Homo Sapiens
accaggcccacgaggagcagcagcgcucggcccggagcagcaggaaggccccucuguggagcgc

SEQ ID NO: 165076 - RNA, 64 nt, Homo Sapiens
uuggggagagggauuucccuaggccuggcuggaggagcagcagccaguugcccgaaacuaagcc

SEQ ID NO: 165077 - RNA, 64 nt, Homo Sapiens
ccgcaucaccucaccaaggaacgccugcaggagagagcagcacuaccugcucuguccccaaagg

SEQ ID NO: 165078 - RNA, 64 nt, Homo Sapiens
guagaaaagaccaagauuugguggcccaggcugagagcagcaggcuuaguguucuccaggcucu

SEQ ID NO: 165079 - RNA, 64 nt, Homo Sapiens
cuggcuuugguaggggcaccguccaggugccguggagcagcaggacuccucccucagugguagu

SEQ ID NO: 165080 - RNA, 64 nt, Homo Sapiens
gcccaggcagcacaugagcagcccuugguguucugagcagcagguccccaggcccucacuggga

SEQ ID NO: 165081 - RNA, 64 nt, Homo Sapiens
agucucugucaucccgucgcccuugcccgccugagagcagcagcacuggcgccaucagggccuc

SEQ ID NO: 165082 - RNA, 64 nt, Homo Sapiens
gaccucaucagcagaccaagccccuccagggagagagcagcagacucuugaccuuccacccacu

SEQ ID NO: 165083 - RNA, 64 nt, Homo Sapiens
caaggagccugggucuaggccgccugagggccaggagcagcagguccccucauccacuugaggg

SEQ ID NO: 165084 - RNA, 64 nt, Homo Sapiens
aggcaacuucgagaacggauaacagcagagcucugagcagcagcccggcugccgggggggacuc

SEQ ID NO: 165085 - RNA, 64 nt, Homo Sapiens
caagauuuuacuucaaauuacaccuucaaaacuggagcagcauauagccgaaaaggagcacaac

SEQ ID NO: 165086 - RNA, 64 nt, Homo Sapiens
auauaagaguacucauguuuauuuauuuccaacugagcagcaaccuccuuuguuucacuuaugu

SEQ ID NO: 165087 - RNA, 64 nt, Homo Sapiens
ggggucagaccccugcuccagccugcaccgccuggagcagcauguccagaccccccuccccgcu

SEQ ID NO: 165088 - RNA, 64 nt, Homo Sapiens
cggcgccagcagccucugcccaccguccccuccugagcagcacuagucuccagcccacccuccg

SEQ ID NO: 165089 - RNA, 64 nt, Homo Sapiens
caaaaugcgggcugggcaggcagcucggggcagggagcagcagugcaggccuggccuguguccc

SEQ ID NO: 165090 - RNA, 64 nt, Homo Sapiens
ccuggccuguguccccgugcccagcgggcucccggagcagcauuccagagccuccugcagagcc

SEQ ID NO: 165091 - RNA, 64 nt, Homo Sapiens
ggcccuucuacucccucuuguaagaaccuucccagagcagcagaguaauagcuuauuugcccua

SEQ ID NO: 165092 - RNA, 64 nt, Homo Sapiens
ucauuuuaucauuuuaucuugcugacuguugagagagcagcacauacccuccaauucagacuca

SEQ ID NO: 165093 - RNA, 64 nt, Homo Sapiens
agcaggauggugaaguaguaauggugcugaggaagagcagcagccagccagcagcacagucucu

SEQ ID NO: 165094 - RNA, 64 nt, Homo Sapiens
gcagaagggcccucccuccauccauguguaccaagagcagcaggaggccugugcccacugcugc

SEQ ID NO: 165095 - RNA, 64 nt, Homo Sapiens
auaaaugaggccacugugccuccugugagcagcagagcagcacagacuuugggggacaggcuuc

SEQ ID NO: 165096 - RNA, 64 nt, Homo Sapiens
gcagcacaauaaaugaggcccaggcuucuccugugagcagcagaaggaagaggacuuuggggga

SEQ ID NO: 165097 - RNA, 64 nt, Homo Sapiens
ucagaguggacagaaagcaugggccccacaucuggagcagcaccgucuccgaggcccucuggga

SEQ ID NO: 165098 - RNA, 64 nt, Homo Sapiens
gcugugucaggcccagggacugcauuuauuuauugagcagcaguuugcgucaggcaaggucacc

SEQ ID NO: 165099 - RNA, 64 nt, Homo Sapiens
aggaaggggacucugggggacuggcuuccccugugagcagcagagcagcacaauaaaugaggcc

SEQ ID NO: 165100 - RNA, 64 nt, Homo Sapiens
gacucugggggacuggcuuccccugugagcagcagagcagcacaauaaaugaggccacugugcc

SEQ ID NO: 165101 - RNA, 64 nt, Homo Sapiens
aggaaggggacucugggggaccggcuuccccugugagcagcagagcagcacaauaaaugaggcc

SEQ ID NO: 165102 - RNA, 64 nt, Homo Sapiens
gacucugggggaccggcuuccccugugagcagcagagcagcacaauaaaugaggccacugugcc

SEQ ID NO: 165103 - RNA, 64 nt, Homo Sapiens
auaaaugaggccacugugcccccugugagcagcagagcagcauagacuuugggggacgggcuuc

SEQ ID NO: 165104 - RNA, 64 nt, Homo Sapiens
gcagcauaauaaaugaggcccgggcuuccccugugagcagcagaaggaagaggacuuuggggga

SEQ ID NO: 165105 - RNA, 64 nt, Homo Sapiens
ugaggaauagguuuuuacucuagcuauacucagagagcagcagucauucuaucagugcugccuu

SEQ ID NO: 165106 - RNA, 64 nt, Homo Sapiens
cuaucagugcugccuuuagcuauaucuucccuuugagcagcauuaaacugccaaaguuuggguu

SEQ ID NO: 165107 - RNA, 64 nt, Homo Sapiens
uaauaggaaaauguauuucuguauaagaguucuuugcuuucauuaacuuggauucauuuaaaaa

SEQ ID NO: 165108 - RNA, 64 nt, Homo Sapiens
guaaguaaccagaagaccuuucagaugguuuauuugcuuucagcagagaauuuauuucauacag

SEQ ID NO: 165109 - RNA, 64 nt, Homo Sapiens
uggcuacgugauauuugaagggaaggauaaguguugcuuucaguaguuauugccaauauuguug

SEQ ID NO: 165110 - RNA, 64 nt, Homo Sapiens
ugugagccuaggguaggggcacugcugcaacuucugcuuucaucccaugccucaucaaugagga

SEQ ID NO: 165111 - RNA, 64 nt, Homo Sapiens
cuggaaugucuucacugcagcugcuggaaaucacugcuuucauucccacaaaaccaguauuacu

SEQ ID NO: 165112 - RNA, 64 nt, Homo Sapiens
uuguuuuccuguuuaggcuuugcacaaauacaauugcuuucaggaauccuaaagcagcauuuua

SEQ ID NO: 165113 - RNA, 64 nt, Homo Sapiens
acacagccacacucauucauuuauuuucugugguugcuuucaagcuacaauuguagaguugggu

SEQ ID NO: 165114 - RNA, 64 nt, Homo Sapiens
uaguuugagaucucucaaaaauaaaaauaaaaauugcuuucagagaguagcccaugaaauuucc

SEQ ID NO: 165115 - RNA, 64 nt, Homo Sapiens
agaacccuaaaauggucguuuuagaagccgaaggugcuuucauccuuguuucccagccugcacc

SEQ ID NO: 165116 - RNA, 64 nt, Homo Sapiens
uccucugcaacuccucccccgcuuugacaggugcugcuuucaaugagaaggaaggggauaggca

SEQ ID NO: 165117 - RNA, 64 nt, Homo Sapiens
uaaggaucauuguggaguuuaaaaguuacaugguugcuuucacuuuccauaauauaugucacuc

SEQ ID NO: 165118 - RNA, 64 nt, Homo Sapiens
cuuccaugugagcucgugcuguguuauuccgcagugcuuucagucugauaggagguguugggug

SEQ ID NO: 165119 - RNA, 64 nt, Homo Sapiens
guagagucucauuauaguccgauuagacagauuuugcuuucacaaauguaagugauaagaauaa

SEQ ID NO: 165120 - RNA, 64 nt, Homo Sapiens
aacauuuuaccccuacuccccaugcacuuagaguugcuuucagugauuaacguugauuucauuc

SEQ ID NO: 165121 - RNA, 64 nt, Homo Sapiens
guuggcuuccaaguuuuuuauuguguacaaaccaugcuuucaauauguccuuccaaaaauguug

SEQ ID NO: 165122 - RNA, 64 nt, Homo Sapiens
uuucacuuggagugacaaugcaagaaaagccccaugcuuucauugucucauacuaaccaagaag

SEQ ID NO: 165123 - RNA, 64 nt, Homo Sapiens
aaaccuugucaaagaccucauuuuuuuugaguugugcuuucacacacaugguuggauuuuuuuu

SEQ ID NO: 165124 - RNA, 64 nt, Homo Sapiens
ucuuuaaaaguuuuuuguuaguccaaggauuuucugcuuucauucuaggcaaagcaauacaucg

SEQ ID NO: 165125 - RNA, 64 nt, Homo Sapiens
uuucacucugggaggagaggguggagaaagcacuugcuuucauccucuggcaucggaaacuccc

SEQ ID NO: 165126 - RNA, 64 nt, Homo Sapiens
gaggcugguuguacaaugcccacgccugccuggcugcuuucaccugggagugcuuucgaugugg

SEQ ID NO: 165127 - RNA, 64 nt, Homo Sapiens
gacuggcuccguugaguuaaugacuagaauauagugcuuucacuacuugauuguuaaccuguuu

SEQ ID NO: 165128 - RNA, 64 nt, Homo Sapiens
guggccgcugccccagcuacagagacggccgaaaugcuuucacuccuuagcuuugccaacucca

SEQ ID NO: 165129 - RNA, 64 nt, Homo Sapiens
aaauguuaaaucaauauguuguugcaauuuagcuugcuuucaagcuucaccccuugcacuuaac

SEQ ID NO: 165130 - RNA, 64 nt, Homo Sapiens
uuuauuuauuuucaagagggaaaguggucuguacugcuuucauccuugccacugucuugcuuuu

SEQ ID NO: 165131 - RNA, 64 nt, Homo Sapiens
agcaaguacaucaaaauguauuaauuuguucuagugcuuucaagucagagagguuuuauuucaa

SEQ ID NO: 165132 - RNA, 64 nt, Homo Sapiens
uguagguccagaaaacuaauuaaaaagauaauuuugcuuucaacugaagcugauccuauuuagu

SEQ ID NO: 165133 - RNA, 64 nt, Homo Sapiens
aaauagggagguagauuugaauauuuaaugaauaugcuuucauuuuuaauguaugcauaguuuc

SEQ ID NO: 165134 - RNA, 64 nt, Homo Sapiens
auggauuuuuuuguguaacccugaacuuuuacccugcuuucaucugccacguuagccacuaaau

SEQ ID NO: 165135 - RNA, 64 nt, Homo Sapiens
auauacaaagcugucacucacaaaaggcuggaugugcuuucauccaacuggaaggcuuuauucu

SEQ ID NO: 165136 - RNA, 64 nt, Homo Sapiens
guuucugcaguauucuguagccaacuuaaaccugugcuuucauguuuaagaaaugagaaauugu

SEQ ID NO: 165137 - RNA, 64 nt, Homo Sapiens
gaagauugucaaaaccagaagcugugggaugaagugcuuucacaucuuguggaaggaccaguau

SEQ ID NO: 165138 - RNA, 64 nt, Homo Sapiens
cuucccuggcuacagcaaaggacgaugaucugccugcuuucacuguguuguucaugguggcuuu

SEQ ID NO: 165139 - RNA, 64 nt, Homo Sapiens
ugucugggauggggucagaaugcaucaugucuucugcuuucacgugugcuuucauuauuauaga

SEQ ID NO: 165140 - RNA, 64 nt, Homo Sapiens
auuauagaugcaucaugucuuacucuuuagauugugcuuucauuagcuguucacggugugauaa

SEQ ID NO: 165141 - RNA, 64 nt, Homo Sapiens
uaauucuggcaggaccucacucuuuuuaagggauugcuuucaucuaguuuuggggauacgucca

SEQ ID NO: 165142 - RNA, 64 nt, Homo Sapiens
gaaaaugguauaacguuaauuggaaaaauacuuuugcuuucagguaauuuucaccgagcagagg

SEQ ID NO: 165143 - RNA, 64 nt, Homo Sapiens
caacuugagauucuuccuagccuaguagcugcugugcuuucaugcuuuggauaucagauaucuu

SEQ ID NO: 165144 - RNA, 64 nt, Homo Sapiens
cauaucauauucacuuugagaaucgguuugacuuugcuuucaaacaaaacaaaaaccucuugcu

SEQ ID NO: 165145 - RNA, 64 nt, Homo Sapiens
cuugcuguauuucuuauaccauuuauuaaaaagcugcuuucacgguaaaauuauguugguuuga

SEQ ID NO: 165146 - RNA, 64 nt, Homo Sapiens
aguacaaacauugauguauaaugacaguauaaaaugcuuucauguuugugaugucuagugaugu

SEQ ID NO: 165147 - RNA, 64 nt, Homo Sapiens
cugcaaguaaaaguaaauccuguguugugacuggugcuuucauauauuugugacaauuuuugag

SEQ ID NO: 165148 - RNA, 64 nt, Homo Sapiens
uuucagucaaagagggccucucuuacaucuuguuugcuuucaaauccccaaauaucaucuccau

SEQ ID NO: 165149 - RNA, 64 nt, Homo Sapiens
ggaggagucagucgugguuggagguucauugccgugcuuucaugcagaguguuuugccuucaug

SEQ ID NO: 165150 - RNA, 64 nt, Homo Sapiens
caguuuuuuaaaaagagacuguauacacuugauuugcuuucaaaauaaauaaggucagcuaguc

SEQ ID NO: 165151 - RNA, 64 nt, Homo Sapiens
ccauguaaauaaauaauacagacucauuuuucuuugcuuucagcaucaucuguguaagugaagg

SEQ ID NO: 165152 - RNA, 64 nt, Homo Sapiens
uuacuaucagggauuucuuuuuagauuugaaguuugcuuucaguuuuggcuugcaggggugggu

SEQ ID NO: 165153 - RNA, 64 nt, Homo Sapiens
aucaugcuaaacaagaauuauuuuaaacagucauugcuuucaaggcaucuuuggcuucucauaa

SEQ ID NO: 165154 - RNA, 64 nt, Homo Sapiens
uauuucauuuccuccccauaguaaaauucuagacugcuuucacuauuguaugauuuuaucuaaa

SEQ ID NO: 165155 - RNA, 64 nt, Homo Sapiens
ccuuuuuuuagaccaaugccuaugccauccuccaugcuuucaguuugaguuuuauuauuuauua

SEQ ID NO: 165156 - RNA, 64 nt, Homo Sapiens
agaaagaggugauuauggagggaaucaaaaauacugcuuucaguuaguagcuagcuuuaaguca

SEQ ID NO: 165157 - RNA, 64 nt, Homo Sapiens
uaggguuguccugccccuugucgggagaggguggaguccacaucagcauccaaucgugaagaac

SEQ ID NO: 165158 - RNA, 64 nt, Homo Sapiens
uuauagucaugugccaccacgcaccugguaguugaguccacacagaugcuguggccuguggaag

SEQ ID NO: 165159 - RNA, 64 nt, Homo Sapiens
ggucacagguaguaccugguuuacccuugaccccaguccacaguccaagcuagugaugggccau

SEQ ID NO: 165160 - RNA, 64 nt, Homo Sapiens
aaaaacacacacagaaaucgcuugagugaggaaaaguccacauggcagagacagguauggucca

SEQ ID NO: 165161 - RNA, 64 nt, Homo Sapiens
guauaucgauuagcugugucacuuuuaaauaagaaguccacacaagcaagccaaauuuuuagau

SEQ ID NO: 165162 - RNA, 64 nt, Homo Sapiens
accaucuacaaagccuuauuguaaugcaauaggaaguccacacccagacaacacacuuccugac

SEQ ID NO: 165163 - RNA, 64 nt, Homo Sapiens
caagagaacgggaugauacauaaguuacuaggauaguccacacuucaccuucuacugguagaag

SEQ ID NO: 165164 - RNA, 64 nt, Homo Sapiens
ucaacccugcuguucagacuugauaagaucucagaguccacaggaaagaagucacuguugcaau

SEQ ID NO: 165165 - RNA, 64 nt, Homo Sapiens
ucugucuggaaacaggacacaucuugccaccacaaguccacaccuggccuuggcugcugcccgc

SEQ ID NO: 165166 - RNA, 64 nt, Homo Sapiens
gugggggauguucugcaccccuaguuccuugguuuucaggcacacccaacagcugucuccaguu

SEQ ID NO: 165167 - RNA, 64 nt, Homo Sapiens
ccaagugaaccaccccucuuggugaaggaucauguucaggcacuggccaaggcuucucccuguc

SEQ ID NO: 165168 - RNA, 64 nt, Homo Sapiens
gagaaugauaguaauaggauuaaacugauuaguauucaggcacuauauauagcuugaaagcagu

SEQ ID NO: 165169 - RNA, 64 nt, Homo Sapiens
acugacaauaguuaugccugagucuaccugagcauucaggcagcuuaaaaaugcacaccucaug

SEQ ID NO: 165170 - RNA, 64 nt, Homo Sapiens
uaagccaaaugcaggccugugucggcccuucuuuuucaggcacacagacauucuuuaucaagag

SEQ ID NO: 165171 - RNA, 64 nt, Homo Sapiens
uuuggccaauauuaucauugaaaauuguugacauuucaggcaaaacauaccuuaauaguuuuau

SEQ ID NO: 165172 - RNA, 64 nt, Homo Sapiens
caucugugcuuagucucugacauaggaagcuugcuucaggcaauggcuuuggauugaguuugag

SEQ ID NO: 165173 - RNA, 64 nt, Homo Sapiens
acuccuaagaaacgaaagauuccuucaaagccuuuucaggcacaugguuucaacaaagccuggc

SEQ ID NO: 165174 - RNA, 64 nt, Homo Sapiens
cauaaauaaugcuauuguuuaugauuugaaaacuuucaggcaaaauccaauuuacauuuuuccc

SEQ ID NO: 165175 - RNA, 64 nt, Homo Sapiens
uugauuuaaaugaugugugagauguuucaccauuuucaggcacuguguaauucuauuguaauaa

SEQ ID NO: 165176 - RNA, 64 nt, Homo Sapiens
aaggauuguuaagagaaaagaaaauggcuuauuuuucaggcacucuuuuuauacucuuguuauc

SEQ ID NO: 165177 - RNA, 64 nt, Homo Sapiens
acuccugccucagccucccauucagccuccuggauucaggcaaccgaucucggcucacugcaac

SEQ ID NO: 165178 - RNA, 64 nt, Homo Sapiens
cagauaaugacaaugcagguagccacuagaaaucuucaggcacaggcauauguaugcaauggaa

SEQ ID NO: 165179 - RNA, 64 nt, Homo Sapiens
uguaugcaauggaaagccacauuuuuuagguaaguucaggcauaccaguuuccauugguaggaa

SEQ ID NO: 165180 - RNA, 64 nt, Homo Sapiens
uccuccccaaaccuucagauugugggcgccucauuucaggcaagagugagggaaugggagcagc

SEQ ID NO: 165181 - RNA, 64 nt, Homo Sapiens
uacuccugccccagagaugaccugcggcaccggguucaggcagcaauuaccagcaagugucuuu

SEQ ID NO: 165182 - RNA, 64 nt, Homo Sapiens
auugacaagagggcuuuaaaaaagguaaagcccauucaggcauuagggaacaugggaaggaauc

SEQ ID NO: 165183 - RNA, 64 nt, Homo Sapiens
ugacagugacaacacagugaagucugcuugcuucuucaggcacgccugcaaucuggaaguaaac

SEQ ID NO: 165184 - RNA, 64 nt, Homo Sapiens
ggguuccuacaauuuuuaucauggugguuaugggaacuaccaauuugugggaauuaacacauca

SEQ ID NO: 165185 - RNA, 64 nt, Homo Sapiens
aaugucaaugcccaguuuuggggaaacaucaguaaacuaccauuagaaaauacgagauuugcag

SEQ ID NO: 165186 - RNA, 64 nt, Homo Sapiens
cguaucuagcauauccccacgcucacaggccccaaacuaccagccuuuugaaagcaaagcucug

SEQ ID NO: 165187 - RNA, 64 nt, Homo Sapiens
aucccucgggugcaaguguacccccuauucugguaacuaccaaaaccaggaggcuuccuuccag

SEQ ID NO: 165188 - RNA, 64 nt, Homo Sapiens
aggcuuccuuccagcccccucccccuauucugguaacuaccaggcccaggaggcuuccuuccag

SEQ ID NO: 165189 - RNA, 64 nt, Homo Sapiens
aagggaauaucaucacugaucccacagaaauacaaacuaccaucagagaauacuacaaacaccu

SEQ ID NO: 165190 - RNA, 64 nt, Homo Sapiens
uaauuaaacuaaagaccuucugcacagcaaaagaaacuaccaucagagucaacaggcaaccuac

SEQ ID NO: 165191 - RNA, 64 nt, Homo Sapiens
aaucccauucaugaguucuccacccacauuaccuaacuaccacccaaaggcuccaccuccuaau

SEQ ID NO: 165192 - RNA, 64 nt, Homo Sapiens
gaagguucugccauccaucccagccaucccaaacaacuaccagaauaauggauuaaaacguuaa

SEQ ID NO: 165193 - RNA, 64 nt, Homo Sapiens
aauccaagugcagagcucuuccacaugagccaugcaugcuuagccaucuucccacuccccugcu

SEQ ID NO: 165194 - RNA, 64 nt, Homo Sapiens
gccgggcuucuggagcaccaacauauacagugcgcaugcuuacaugauggcuuccuugcacacc

SEQ ID NO: 165195 - RNA, 64 nt, Homo Sapiens
aaaauggcaacaauuuacagaaaucccaccuuuccaugcuuaagacaaaaaugucuuaaauaua

SEQ ID NO: 165196 - RNA, 64 nt, Homo Sapiens
uauuuaagccaguuuaagugcuuuguguugaugccaugcuuaucaaauacaugcacaagcuaaa

SEQ ID NO: 165197 - RNA, 64 nt, Homo Sapiens
aauguucuaaucacuauggauugagcaccucaagcaugcuuagcucaguccaacauuauuugaa

SEQ ID NO: 165198 - RNA, 64 nt, Homo Sapiens
aaaaagaauaaugcaaauaguuauuuuuccacaucaugcuuacauuuauuuuagacacaaagcu

SEQ ID NO: 165199 - RNA, 64 nt, Homo Sapiens
gauuaguugaaaaacuguaugaaugugaagaucacaugcuuagucauuuuuauguucauuccac

SEQ ID NO: 165200 - RNA, 64 nt, Homo Sapiens
uaagauuugacuugagguuuuugacacuuaaguacaugcuuaaugauauauuuucaaaagucau

SEQ ID NO: 165201 - RNA, 64 nt, Homo Sapiens
auucuguacagauuuuucucuaaggagaauaugacaugcuuaugcuuaccaagaucaagugcau

SEQ ID NO: 165202 - RNA, 64 nt, Homo Sapiens
ugcagugaacugccagaagguaaccagucucaaacaugcuuaucccauuaucaacccugaaagu

SEQ ID NO: 165203 - RNA, 64 nt, Homo Sapiens; identical to SEQ ID NO: 154522

SEQ ID NO: 165204 - RNA, 64 nt, Homo Sapiens; identical to SEQ ID NO: 154523

SEQ ID NO: 165205 - RNA, 64 nt, Homo Sapiens; identical to SEQ ID NO: 154524

SEQ ID NO: 165206 - RNA, 64 nt, Homo Sapiens; identical to SEQ ID NO: 154525

SEQ ID NO: 165207 - RNA, 64 nt, Homo Sapiens; identical to SEQ ID NO: 154526

SEQ ID NO: 165208 - RNA, 64 nt, Homo Sapiens; identical to SEQ ID NO: 154527

SEQ ID NO: 165209 - RNA, 64 nt, Homo Sapiens; identical to SEQ ID NO: 154528

SEQ ID NO: 165210 - RNA, 64 nt, Homo Sapiens; identical to SEQ ID NO: 154529

SEQ ID NO: 165211 - RNA, 64 nt, Homo Sapiens; identical to SEQ ID NO: 154530

SEQ ID NO: 165212 - RNA, 64 nt, Homo Sapiens; identical to SEQ ID NO: 154531

SEQ ID NO: 165213 - RNA, 64 nt, Homo Sapiens; identical to SEQ ID NO: 154532

SEQ ID NO: 165214 - RNA, 64 nt, Homo Sapiens; identical to SEQ ID NO: 154533

SEQ ID NO: 165215 - RNA, 64 nt, Homo Sapiens; identical to SEQ ID NO: 154534

SEQ ID NO: 165216 - RNA, 64 nt, Homo Sapiens; identical to SEQ ID NO: 154535

SEQ ID NO: 165217 - RNA, 64 nt, Homo Sapiens; identical to SEQ ID NO: 154536

SEQ ID NO: 165218 - RNA, 64 nt, Homo Sapiens; identical to SEQ ID NO: 154537

SEQ ID NO: 165219 - RNA, 64 nt, Homo Sapiens; identical to SEQ ID NO: 154538

SEQ ID NO: 165220 - RNA, 64 nt, Homo Sapiens; identical to SEQ ID NO: 154539

SEQ ID NO: 165221 - RNA, 64 nt, Homo Sapiens; identical to SEQ ID NO: 154540

SEQ ID NO: 165222 - RNA, 64 nt, Homo Sapiens; identical to SEQ ID NO: 154541

SEQ ID NO: 165223 - RNA, 64 nt, Homo Sapiens; identical to SEQ ID NO: 154542

SEQ ID NO: 165224 - RNA, 64 nt, Homo Sapiens; identical to SEQ ID NO: 154543

SEQ ID NO: 165225 - RNA, 64 nt, Homo Sapiens; identical to SEQ ID NO: 154544

SEQ ID NO: 165226 - RNA, 64 nt, Homo Sapiens; identical to SEQ ID NO: 154545

SEQ ID NO: 165227 - RNA, 64 nt, Homo Sapiens; identical to SEQ ID NO: 154546

SEQ ID NO: 165228 - RNA, 64 nt, Homo Sapiens; identical to SEQ ID NO: 154547

SEQ ID NO: 165229 - RNA, 64 nt, Homo Sapiens; identical to SEQ ID NO: 154548

SEQ ID NO: 165230 - RNA, 64 nt, Homo Sapiens; identical to SEQ ID NO: 154549

SEQ ID NO: 165231 - RNA, 64 nt, Homo Sapiens; identical to SEQ ID NO: 154550

SEQ ID NO: 165232 - RNA, 64 nt, Homo Sapiens; identical to SEQ ID NO: 154551

SEQ ID NO: 165233 - RNA, 64 nt, Homo Sapiens; identical to SEQ ID NO: 154552

SEQ ID NO: 165234 - RNA, 64 nt, Homo Sapiens; identical to SEQ ID NO: 154553

SEQ ID NO: 165235 - RNA, 64 nt, Homo Sapiens; identical to SEQ ID NO: 154554

SEQ ID NO: 165236 - RNA, 64 nt, Homo Sapiens; identical to SEQ ID NO: 154555

SEQ ID NO: 165237 - RNA, 64 nt, Homo Sapiens; identical to SEQ ID NO: 154522

SEQ ID NO: 165238 - RNA, 64 nt, Homo Sapiens; identical to SEQ ID NO: 154523

SEQ ID NO: 165239 - RNA, 64 nt, Homo Sapiens; identical to SEQ ID NO: 154524

SEQ ID NO: 165240 - RNA, 64 nt, Homo Sapiens; identical to SEQ ID NO: 154525

SEQ ID NO: 165241 - RNA, 64 nt, Homo Sapiens; identical to SEQ ID NO: 154526

SEQ ID NO: 165242 - RNA, 64 nt, Homo Sapiens; identical to SEQ ID NO: 154527

SEQ ID NO: 165243 - RNA, 64 nt, Homo Sapiens; identical to SEQ ID NO: 154528

SEQ ID NO: 165244 - RNA, 64 nt, Homo Sapiens; identical to SEQ ID NO: 154529

SEQ ID NO: 165245 - RNA, 64 nt, Homo Sapiens; identical to SEQ ID NO: 154530

SEQ ID NO: 165246 - RNA, 64 nt, Homo Sapiens; identical to SEQ ID NO: 154531

SEQ ID NO: 165247 - RNA, 64 nt, Homo Sapiens; identical to SEQ ID NO: 154532

SEQ ID NO: 165248 - RNA, 64 nt, Homo Sapiens; identical to SEQ ID NO: 154533

SEQ ID NO: 165249 - RNA, 64 nt, Homo Sapiens; identical to SEQ ID NO: 154534

SEQ ID NO: 165250 - RNA, 64 nt, Homo Sapiens; identical to SEQ ID NO: 154535

SEQ ID NO: 165251 - RNA, 64 nt, Homo Sapiens; identical to SEQ ID NO: 154536

SEQ ID NO: 165252 - RNA, 64 nt, Homo Sapiens; identical to SEQ ID NO: 154537

SEQ ID NO: 165253 - RNA, 64 nt, Homo Sapiens; identical to SEQ ID NO: 154538

SEQ ID NO: 165254 - RNA, 64 nt, Homo Sapiens; identical to SEQ ID NO: 154539

SEQ ID NO: 165255 - RNA, 64 nt, Homo Sapiens; identical to SEQ ID NO: 154540

SEQ ID NO: 165256 - RNA, 64 nt, Homo Sapiens; identical to SEQ ID NO: 154541

SEQ ID NO: 165257 - RNA, 64 nt, Homo Sapiens; identical to SEQ ID NO: 154542

SEQ ID NO: 165258 - RNA, 64 nt, Homo Sapiens; identical to SEQ ID NO: 154543

SEQ ID NO: 165259 - RNA, 64 nt, Homo Sapiens; identical to SEQ ID NO: 154544

SEQ ID NO: 165260 - RNA, 64 nt, Homo Sapiens; identical to SEQ ID NO: 154545

SEQ ID NO: 165261 - RNA, 64 nt, Homo Sapiens; identical to SEQ ID NO: 154546

SEQ ID NO: 165262 - RNA, 64 nt, Homo Sapiens; identical to SEQ ID NO: 154547

SEQ ID NO: 165263 - RNA, 64 nt, Homo Sapiens; identical to SEQ ID NO: 154548

SEQ ID NO: 165264 - RNA, 64 nt, Homo Sapiens; identical to SEQ ID NO: 154549

SEQ ID NO: 165265 - RNA, 64 nt, Homo Sapiens; identical to SEQ ID NO: 154550

SEQ ID NO: 165266 - RNA, 64 nt, Homo Sapiens; identical to SEQ ID NO: 154551

SEQ ID NO: 165267 - RNA, 64 nt, Homo Sapiens
accccugugcaccacccaagaaagaggaaaacuuugccuacaacuuuggaaaugcugggguccc

SEQ ID NO: 165268 - RNA, 64 nt, Homo Sapiens
agguguaccuccaacccuagccuucucccacagcugccuacaacagagucucccagccuucuca

SEQ ID NO: 165269 - RNA, 64 nt, Homo Sapiens
ccuaggcuacgcuccaugcucccccagcaaucucugccuacaccuccugcggcgccuugcccuc

SEQ ID NO: 165270 - RNA, 64 nt, Homo Sapiens
gcauagcucaccccaccucaucaugagccucaacugccuacaucuggggcaagcagcacaccgg

SEQ ID NO: 165271 - RNA, 64 nt, Homo Sapiens
cacugaaaucagcuggggugggggguguggaaaaugccuacauccuggcuccaucucccgaagu

SEQ ID NO: 165272 - RNA, 64 nt, Homo Sapiens
agcgugggagccaggaucagcgcccccugccaugugccuacaaaugucaguugugauuuccacu

SEQ ID NO: 165273 - RNA, 64 nt, Homo Sapiens
ccccagcugccccagcacgcgggacccauagcacaccccuuagcgcuugccuagguugcugaaa

SEQ ID NO: 165274 - RNA, 64 nt, Homo Sapiens
aaucugcuuauucuucagcuucaccucugcacuaaccccuuacccuuaugguacgucaggauuu

SEQ ID NO: 165275 - RNA, 64 nt, Homo Sapiens
cccauauaaacuauuuucacagaucucaacuaaaaccccuuacuucacaaaugauuguguugug

SEQ ID NO: 165276 - RNA, 64 nt, Homo Sapiens
gugccugugcuugaagguugcuguagagcaucugaccccuuauuaccaccuuaagcaauguaua

SEQ ID NO: 165277 - RNA, 64 nt, Homo Sapiens
uuuccucuaguacuaccaguauucauaaauguauaccccuuacuguaauuuguuccucuuagaa

SEQ ID NO: 165278 - RNA, 64 nt, Homo Sapiens
uaauguaagucuagcuaccuauccaauacuaaauaccccuuaaaguauuaaaugcacuaucugc

SEQ ID NO: 165279 - RNA, 64 nt, Homo Sapiens
cucugaaacaagggucacacuacucagagggauaaccccuuacaguggucugaggaguaacuau

SEQ ID NO: 165280 - RNA, 64 nt, Homo Sapiens
aaauuguucccaaaugaaaacuuguuuuaaguccaccccuuaguuuccuuauuuuacaaggucu

SEQ ID NO: 165281 - RNA, 64 nt, Homo Sapiens
ccaucggccaugugggagguggaacauggccacuaccccuuaucguuugagaucgugcugggga

SEQ ID NO: 165282 - RNA, 64 nt, Homo Sapiens
gaauucaacucaagguuugaucaaaagccaaauaaccccuuaugggugcuuuucuuuacaggau

SEQ ID NO: 165283 - RNA, 64 nt, Homo Sapiens
cuuaagaauagugcuuguuuagaguaaaacccuuaccccuuauuccauaagagaagcaaaucug

SEQ ID NO: 165284 - RNA, 64 nt, Homo Sapiens
ucugucugagaauuaugguuaggcaugggcuccaaccccuuagcaaacagcagggugacuuuag

SEQ ID NO: 165285 - RNA, 64 nt, Homo Sapiens
gcaguugguagaaggaauggugcugccucuccccaccccuuaaagaacuccuuguucuccccuc

SEQ ID NO: 165286 - RNA, 64 nt, Homo Sapiens
ugagggagucagcacagucccaagcgguaguaccaccccuuaguacgucagcugcugagaggag

SEQ ID NO: 165287 - RNA, 64 nt, Homo Sapiens
aauaagcacuccuugcagagugaaauaauuaccaaccccuuagcuauuuccuacgucuguucac

SEQ ID NO: 165288 - RNA, 64 nt, Homo Sapiens
cugggaacccaccgcaggugacgcucuccgcuccaccccuuagcgcgcgcugcuacagagcuuc

SEQ ID NO: 165289 - RNA, 64 nt, Homo Sapiens
gcugugguuuacaacuuuuccuggugcccuguuaaccccuuaaaaccaagcuaggaacaucagc

SEQ ID NO: 165290 - RNA, 64 nt, Homo Sapiens
cagaugugguuucaaaguaaaggccuccucccccaccccuuaggccccguggugacauuuccca

SEQ ID NO: 165291 - RNA, 64 nt, Homo Sapiens
aaggcugacuuguugacugaagccuuuuucccagaccccuuauuucgaauccccaagcuucagu

SEQ ID NO: 165292 - RNA, 64 nt, Homo Sapiens
cagacccccgccagacagacucccaaccagacugaccccuuacuauucacacagccugccgagu

SEQ ID NO: 165293 - RNA, 64 nt, Homo Sapiens
cagugagaaaucuuuacaguugacaggaaccuggaccccuuaccccaacuuuaugaguaaugcu

SEQ ID NO: 165294 - RNA, 64 nt, Homo Sapiens
cuagauugagcuuagauugccucucuagacaacuaccccuuaguuauaauucuguguccccucu

SEQ ID NO: 165295 - RNA, 64 nt, Homo Sapiens
ucagcugcuuugcacaaagguccuucuuguccacaccccuuauccccaggcuggugccccggga

SEQ ID NO: 165296 - RNA, 64 nt, Homo Sapiens
aggagauggagaccauccuggcuaacacggugaaaccccuuaucuaugcgccuguagucccagc

SEQ ID NO: 165297 - RNA, 64 nt, Homo Sapiens
uccaccuuagugccagggccacucucccugcccuaccccuuaacgagaccuguugcugcauaga

SEQ ID NO: 165298 - RNA, 64 nt, Homo Sapiens
acucucccuacuagcuggaaucauugcuuuauaaaccccuuagaggagagccuucagccaaacc

SEQ ID NO: 165299 - RNA, 64 nt, Homo Sapiens
cuacacugaacacuaaagaaggaagauuaacccaaccccuuacacccagucacauccauuuugu

SEQ ID NO: 165300 - RNA, 64 nt, Homo Sapiens
uauacuguuauauccucaacuuggauuuaugguaaccccuuauaguucauggagaccaaaauuu

SEQ ID NO: 165301 - RNA, 64 nt, Homo Sapiens
cucuacucggucauucuccccauuuccauccauuaccccuuagccauugagacuaaaggaaaua

SEQ ID NO: 165302 - RNA, 64 nt, Homo Sapiens
acuacaacauaaauaauuugaguuuaggugauccaccccuuaauuguacccccgaugguauauu

SEQ ID NO: 165303 - RNA, 64 nt, Homo Sapiens
ccaaacuacuuacuugcucuaaacaguuacuuguaccccuuaaccugucuucaaaaguugcaua

SEQ ID NO: 165304 - RNA, 64 nt, Homo Sapiens
aaaaaucgucucucccucccuuugaaaugaauauaccccuuaguguuuggguauauucauuuca

SEQ ID NO: 165305 - RNA, 64 nt, Homo Sapiens
cccuuuugucucugggaccagacuuguuggugcuaccccuuacuccccucugcaacccccauuu

SEQ ID NO: 165306 - RNA, 64 nt, Homo Sapiens
cagcuccucugguggaauccucuaucaagcuccaaccccuuauaccagaaaaaccagcuuauca

SEQ ID NO: 165307 - RNA, 64 nt, Homo Sapiens
gagaagcauauauggccacauccagcccuuugaaaccccuuagacggcaugcauuuugcauugg

SEQ ID NO: 165308 - RNA, 64 nt, Homo Sapiens
uaucaugccuuuguucucuuaucuccaaccaaggaccccuuauucaaaauguucuggaugcauc

SEQ ID NO: 165309 - RNA, 64 nt, Homo Sapiens
cugcagcagcucacaggcuggcccaucuucaaugaccccuuaauugguuuucccuuggccacua

SEQ ID NO: 165310 - RNA, 64 nt, Homo Sapiens
ggugcuuaauucuguugaaaaggagcauuuuuacaccccuuaagguuuacacuguugggaguaa

SEQ ID NO: 165311 - RNA, 64 nt, Homo Sapiens
gauguauuucauggcacugccaaucacuuaagaaaccccuuauuaggaaaagcugacacccaga

SEQ ID NO: 165312 - RNA, 64 nt, Homo Sapiens
aagucuucugcaaacccauuacaauaaaacaaauaccccuuagaauuaccacauaaucuuuuaa

SEQ ID NO: 165313 - RNA, 64 nt, Homo Sapiens
cagaaggaugcccagacaucagccuccuucuuucaccccuuaccccaaagagaaagaguuugaa

SEQ ID NO: 165314 - RNA, 64 nt, Homo Sapiens
guuuucccucaugcgauuacucugugccuuugagaccccuuaaguugcccacuguuucuuccuu

SEQ ID NO: 165315 - RNA, 64 nt, Homo Sapiens
ccagcugugagguggcuucagcggaagucugcugaccccuuauauuccccgagaguauaaagag

SEQ ID NO: 165316 - RNA, 64 nt, Homo Sapiens
ugccuugaaaaucacaucaaguaguuaauuaucuaccccuuaccuguguuuauaacuuccaggu

SEQ ID NO: 165317 - RNA, 50 nt, Homo Sapiens
uuuuuuuucugauaaaguaaaccccuuaacauuggagccgacuuugucuu

SEQ ID NO: 165318 - RNA, 64 nt, Homo Sapiens
cacuuaucucaucacagagcaccccucuugguucaccccuuacuucaggcacuccaagugaacc

SEQ ID NO: 165319 - RNA, 64 nt, Homo Sapiens
gugcaaccacugaggcaaagcucaucuacccucuaccccuuacuuuucucaggguguucuuguc

SEQ ID NO: 165320 - RNA, 64 nt, Homo Sapiens
agugcaagcuuauuuaucucuaacuuaacaugccaccccuuagcgacagugcauuuucaauauc

SEQ ID NO: 165321 - RNA, 64 nt, Homo Sapiens
guuccuggggcaggcggaaacaaaacguuuucaaaccccuuacacccucccuucccgaccccaa

SEQ ID NO: 165322 - RNA, 64 nt, Homo Sapiens
cuuaugucaccucagcccucaucucaaugcccaaaccccuuacacacaccuucaguuagcuuca

SEQ ID NO: 165323 - RNA, 64 nt, Homo Sapiens
cagcccagauguucaguucucuuggccccucucuaccccuuacugggauccgguuuucauuuuc

SEQ ID NO: 165324 - RNA, 64 nt, Homo Sapiens
uauauuugggauaucuauugaagaaaaaaagaaaaccccuuaaagauaauguacaugcuucaug

SEQ ID NO: 165325 - RNA, 64 nt, Homo Sapiens
uuagccugguuuuaugugacacugauacacacacaccccuuauaugggacuaauuuuacacuuu

SEQ ID NO: 165326 - RNA, 64 nt, Homo Sapiens
auucccucuacuguguggaaucagccagaucaccaccccuuacaccauuccaccacagugcccc

SEQ ID NO: 165327 - RNA, 64 nt, Homo Sapiens
ugucuucauaauaguccuauaggguaguccagacaccccuuagaauagagaccuguugguugcu

SEQ ID NO: 165328 - RNA, 64 nt, Homo Sapiens
ggcaugucaacuccuguacuuguuuacuguuuacaccccuuauuugcagcgugaguagcucuuu

SEQ ID NO: 165329 - RNA, 64 nt, Homo Sapiens
gcauuuuucucaaugcagaacauacauuucucucaccccuuaauuauauaaaugcauuauuaca

SEQ ID NO: 165330 - RNA, 64 nt, Homo Sapiens
guaaaaaauguggcaacacuuuuaauaaaugcucaccccuuauugcacaggaaagcauuuauac

SEQ ID NO: 165331 - RNA, 64 nt, Homo Sapiens
agguaucuccaggauugaagagcauugcauggacaccccuuauccaggacucugucaauuuccc

SEQ ID NO: 165332 - RNA, 64 nt, Homo Sapiens
uuucuaaguacccauuucuucuccuauuuaaagaaccccuuagguuuuuauauauuuuuucuga

SEQ ID NO: 165333 - RNA, 64 nt, Homo Sapiens
cuagguaaauugacagaaaugguccagagccaggaccccuuaaucucccagccccuucucccag

SEQ ID NO: 165334 - RNA, 64 nt, Homo Sapiens
auuaccauguuuuuuuuuuuuaacuuauucacagaccccuuauaugugaaagcagcuuuuaguu

SEQ ID NO: 165335 - RNA, 64 nt, Homo Sapiens
uuuaaaauacuuugcgccuuucuuggccucccaaaccccuuauucuucuacagaauaggucaga

SEQ ID NO: 165336 - RNA, 64 nt, Homo Sapiens
auggcagcccuucccuagcacacugguggaagagaccccuuaagaaccugaccccagugaauga

SEQ ID NO: 165337 - RNA, 64 nt, Homo Sapiens
agccccuuccccagaccccucuccagucuccugcaccccuuagcccucccugcuuugccuggcc

SEQ ID NO: 165338 - RNA, 64 nt, Homo Sapiens
uagcaugcacaaaguguauugggagagagccuauaccccuuacuuugaaacauagagggagaga

SEQ ID NO: 165339 - RNA, 64 nt, Homo Sapiens
cguuuaaaauaaaauaugcauaccaguuuguccuaccccuuaagaauguauccagauuuaaacc

SEQ ID NO: 165340 - RNA, 64 nt, Homo Sapiens
uuuuuggauugucggauuuccucccucacaugauaccccuuaucuuuuauaaugucuuaugccu

SEQ ID NO: 165341 - RNA, 64 nt, Homo Sapiens
gacuuggaaggggccuggucugucaacuaguccaaccccuuaaaauucauagaggagcaaacug

SEQ ID NO: 165342 - RNA, 64 nt, Homo Sapiens
uacuaaaaauacaaaaauuagccaacauggcaaaaccccuuauuaggaguucgagagcagccug

SEQ ID NO: 165343 - RNA, 64 nt, Homo Sapiens
ugacucugcggcccuccaggacggacaccgggugaccccuuagggcacccaggcaagaucccua

SEQ ID NO: 165344 - RNA, 64 nt, Homo Sapiens
cuuuguugcacugaaauggaauucccaugccccuaccccuuaccccaguuuuuugaacauggaa

SEQ ID NO: 165345 - RNA, 64 nt, Homo Sapiens
aaaauacuaagugguuuucuugcucccacucccuaccccuuaguuaaauaggguuuauuuucca

SEQ ID NO: 165346 - RNA, 64 nt, Homo Sapiens
guauugaauacuuacauucucuaauaagaaaaccaccccuuagauugaaguaaacugcaguccu

SEQ ID NO: 165347 - RNA, 64 nt, Homo Sapiens
uaaggaguguaguuauaauaugaaaugcuaauuuaccccuuaccggucuggugucuucagcucc

SEQ ID NO: 165348 - RNA, 64 nt, Homo Sapiens
agagccaugacagccuacaggaggcccauccuauaccccuuauugagcaaggaucuggccugga

SEQ ID NO: 165349 - RNA, 64 nt, Homo Sapiens
acaccugcucgucccauuuaccagccaugcggccaccccuuagcccaaccccauugucagcacc

SEQ ID NO: 165350 - RNA, 64 nt, Homo Sapiens
auuucucacuuacaauuucuuugaauuuuuucucaccccuuauuuaguaucaauauuucuguca

SEQ ID NO: 165351 - RNA, 64 nt, Homo Sapiens
cucuuuggucuuacacauccaaugacaucuuuaaaccccuuacauucccucuacgucucucuag

SEQ ID NO: 165352 - RNA, 64 nt, Homo Sapiens
cucuugaacagguauuacaaaggaagaaaacuucaccccuuauccuuaacauauauaguauauu

SEQ ID NO: 165353 - RNA, 64 nt, Homo Sapiens
caaacagacacaucaacgcaccccacucacagacaccccuuaccccacccccacuguacagaga

SEQ ID NO: 165354 - RNA, 64 nt, Homo Sapiens
ugucaacaggaguuaacugacaacuuuuuauuguaccccuuaauucacagugaagcaaaggaca

SEQ ID NO: 165355 - RNA, 64 nt, Homo Sapiens
ccggacaggaugaauggaucgauacacugggaccaccccuuaccuccccuuuuuaugccccacc

SEQ ID NO: 165356 - RNA, 64 nt, Homo Sapiens
cuggugaucaggaaagcccggcagcggcugggucaccccuuacgcagcccccuucccuggcucu

SEQ ID NO: 165357 - RNA, 64 nt, Homo Sapiens
cuccaaggccugaugugagcccuucuguucagacaccccuuauguaggauuccgccgcuggaag

SEQ ID NO: 165358 - RNA, 64 nt, Homo Sapiens
ggaaacacgagaucaguaguaagaugccaagggcaccccuuaauccugguuacggcccaggggg

SEQ ID NO: 165359 - RNA, 64 nt, Homo Sapiens
ggaauuuguuuugugauuaguucgccccuuccccaccccuuaccagauguuaagcagcuaugaa

SEQ ID NO: 165360 - RNA, 61 nt, Homo Sapiens
accagagaguggccagcuaagagccugccucaccccuuaccaaugagggcaggggaagacc

SEQ ID NO: 165361 - RNA, 64 nt, Homo Sapiens
aacaaagcgaauaggcaguuagcacagcacagcuaccccuuaccaagcagucuauggaaacaac

SEQ ID NO: 165362 - RNA, 64 nt, Homo Sapiens
aucaggcacccggggccagagacauaugggccauaccccuuaaccccgggaugcaagguagcau

SEQ ID NO: 165363 - RNA, 64 nt, Homo Sapiens
ugaacuagugccuuuggguagcuuuuucagccacaccccuuauguuacacaauggcuuuguuuu

SEQ ID NO: 165364 - RNA, 64 nt, Homo Sapiens
acucccccgauuauucugccucugccaggaagccaccccuuagcgacggucuccagcuccccuu

SEQ ID NO: 165365 - RNA, 64 nt, Homo Sapiens
caccaugaccccaucagguuuccuccacugccccaccccuuagacccuugacugcagagcaggu

SEQ ID NO: 165366 - RNA, 64 nt, Homo Sapiens
ucuugauuucccuuaaacgaguggauuuggaucgaccccuuacaaucccucccucacuuucacu

SEQ ID NO: 165367 - RNA, 56 nt, Homo Sapiens
gaucugugcucuccuagcccggacggaccccuuacccaaauagguugcccaaguga

SEQ ID NO: 165368 - RNA, 64 nt, Homo Sapiens
ucuacuggccuugucaacauacagacuucaaaauaccccuuaugagaauccaaagaaugaugug

SEQ ID NO: 165369 - RNA, 64 nt, Homo Sapiens
uacacuguaugaucaacauauacugacuuguucaaccccuuagugauacagcaacaaucauugc

SEQ ID NO: 165370 - RNA, 64 nt, Homo Sapiens
uagcucccuccuugaaacaaaccgaaagggccugaccccuuacuaauaacugugagcucgcaca

SEQ ID NO: 165371 - RNA, 64 nt, Homo Sapiens
ccccaucaaaaaaaaaaaugaguagggaguguguaccccuuacugaaaaaguuugugacauugu

SEQ ID NO: 165372 - RNA, 64 nt, Homo Sapiens
ggccagcagcuuccuccuucagccaccuggccauaccccuuaaauaagccccucaccuugcugc

SEQ ID NO: 165373 - RNA, 64 nt, Homo Sapiens
guggucaaguaccuaagguaugaaaugccacaaaaccccuuaaagauaaagagauuuugauuuu

SEQ ID NO: 165374 - RNA, 64 nt, Homo Sapiens
cuugcuuucuuuagaauuuuuguuuucuuugaggaccccuuaauuccucuccauuuuagcccag

SEQ ID NO: 165375 - RNA, 64 nt, Homo Sapiens
caaaaagguguguuuucuuuucucuaacuuccucaccccuuaacgcucccuguuucucaugcuu

SEQ ID NO: 165376 - RNA, 64 nt, Homo Sapiens
cuccaagaggggcccagcauuguauuucccugugaccccuuacucuccuggccagaacuugagc

SEQ ID NO: 165377 - RNA, 64 nt, Homo Sapiens
ucgggcccagcucaagcccccuuccuugcucuggaccccuuagguauacccuggaagagcuggg

SEQ ID NO: 165378 - RNA, 64 nt, Homo Sapiens
cccccuguuuucagggaccucugccuucucccacaccccuuacacuagugaggacuccuucggc

SEQ ID NO: 165379 - RNA, 64 nt, Homo Sapiens
uugugcugcuugcacaacugagcugcugguguguaccccuuagcagggugucuggggacuuacg

SEQ ID NO: 165380 - RNA, 64 nt, Homo Sapiens
cccguccauccauccauccacucuuccacccucuaccccuuaccuuauucuaaaaagaacuuag

SEQ ID NO: 165381 - RNA, 64 nt, Homo Sapiens
agcgccuggaagcagaaccacauucucuuuccugaccccuuagguggcaacauccaugccuucu

SEQ ID NO: 165382 - RNA, 64 nt, Homo Sapiens
ccaacucagcuccucuuugccugcccuucccgggaccccuuauucaggcagcugugccccuggc

SEQ ID NO: 165383 - RNA, 64 nt, Homo Sapiens
ccuuuugguggagaggcccggccucucacaaaagaccccuuaccacugcucugaugaagaggag

SEQ ID NO: 165384 - RNA, 64 nt, Homo Sapiens
uuuaccaguaaauuauguuucuguauguaaaauaaccccuuauuagagagacaguguuauaugu

SEQ ID NO: 165385 - RNA, 64 nt, Homo Sapiens
ugacucugccccucagcagggcuuacuaagcacuaccccuuaacagggaugacuccgcacugcc

SEQ ID NO: 165386 - RNA, 64 nt, Homo Sapiens
cccagagaaccagccuaggaacacucgggaugacaccccuuaucacaccaaggacagcaaguuu

SEQ ID NO: 165387 - RNA, 64 nt, Homo Sapiens
uuccccgagaguguaaagaggcgaaagucugcuaaccccuuacaccagcucugagguggcuuca

SEQ ID NO: 165388 - RNA, 64 nt, Homo Sapiens
uucuccauuugagaggagagugcuuggggcuugaaccccuuaccccacugcugcugacugggca

SEQ ID NO: 165389 - RNA, 64 nt, Homo Sapiens
guggggacaagccccucuuggucucagccacagcaccccuuauuccagcugcccugcccaaccu

SEQ ID NO: 165390 - RNA, 64 nt, Homo Sapiens
cccuucuuucuaaacucaacccauuucccucccuaccccuuaucuucaggacucuucagagcua

SEQ ID NO: 165391 - RNA, 64 nt, Homo Sapiens
ggguccuugccucucguguacccccucaaggcugaccccuuagauggcccaggaauggcaggug

SEQ ID NO: 165392 - RNA, 64 nt, Homo Sapiens
gcugccaaaaccacaugggcggccauuaccccauaccccuuauuacaaaccauuuuauuuuuug

SEQ ID NO: 165393 - RNA, 64 nt, Homo Sapiens
uugccaaagacuugaggaccccuuggcugagccuaccccuuacugcuugggccuuuucucucaa

SEQ ID NO: 165394 - RNA, 64 nt, Homo Sapiens
uuuaacuuugugguaacugacuuucuucuuccccaccccuuaauaaagucuguuuuuuuuuuuu

SEQ ID NO: 165395 - RNA, 64 nt, Homo Sapiens
augaugacaucccacacacuauccacuugugguaaccccuuacgcuggaaguuaagagaguggc

SEQ ID NO: 165396 - RNA, 64 nt, Homo Sapiens
uuccucauacagacuggcaccucugcaggcccucaccccuuaacaaacgaugggugcugugguc

SEQ ID NO: 165397 - RNA, 64 nt, Homo Sapiens
caucucucuacugcuggacuugugggccgaucuaaccccuuaccaccuuagggacagguggagg

SEQ ID NO: 165398 - RNA, 64 nt, Homo Sapiens
acuaaucauaugugcucagacacagcucaagcacaccccuuaguuaagaaagaaccuccauaua

SEQ ID NO: 165399 - RNA, 64 nt, Homo Sapiens
cccugcauuccagauggggggccuccuggcccggaccccuuacagcuccagugccgaccgcuga

SEQ ID NO: 165400 - RNA, 64 nt, Homo Sapiens
auauuauuuuuucuucaauauaacacuggaggaaaccccuuaugaggaugccaucugccuaaau

SEQ ID NO: 165401 - RNA, 64 nt, Homo Sapiens
caggugugaccucaggugugugaguaucccucauaccccuuaucaucacugccuauucgcucuu

SEQ ID NO: 165402 - RNA, 64 nt, Homo Sapiens
cccuggcccccugaguuucccucgcaucuucccaaccccuuaagaaggaaccaaauuuaagacu

SEQ ID NO: 165403 - RNA, 64 nt, Homo Sapiens
uaauuccuuaacaucucuaugaauaauuucagaaaccccuuaaaccuacauuaacauggaugca

SEQ ID NO: 165404 - RNA, 64 nt, Homo Sapiens
uuggguaccccucuggcccuccaccuccacccccaccccuuaacgaacaacugaccuguuuccu

SEQ ID NO: 165405 - RNA, 64 nt, Homo Sapiens
ccggcauuguauuccaaagagggcaggagcacagaccccuuaaacucaagaccggaggcacaga

SEQ ID NO: 165406 - RNA, 64 nt, Homo Sapiens
cauaaguuuucaggaaauaaucagcaggcugggcaccccuuagcucuagcacugagucaagcaa

SEQ ID NO: 165407 - RNA, 64 nt, Homo Sapiens
cauguguuugcagaccggcugggauagccuccccaccccuuaucagagccaagacaccugcugc

SEQ ID NO: 165408 - RNA, 64 nt, Homo Sapiens
aucuuggauugugaugcuauugguacuugagaauaccccuuaucugaguauaaagaauccuuga

SEQ ID NO: 165409 - RNA, 64 nt, Homo Sapiens
cucccugaaaauguuuuucuuuggugcaacccuuaccccuuagcggcaggagggcccuaccuga

SEQ ID NO: 165410 - RNA, 64 nt, Homo Sapiens
aaugaaaaauuccacucaaacagagaaggaacauaccccuuacauguuugaggaaagcaagaau

SEQ ID NO: 165411 - RNA, 64 nt, Homo Sapiens
aaggccccagaugaucccagcaaggggcucuugaaccccuuauuggcccuucagucugcuccac

SEQ ID NO: 165412 - RNA, 64 nt, Homo Sapiens
gcucgcccaccggccugugaaguguguuucacucaccccuuaccagggcccugcaaagcaccca

SEQ ID NO: 165413 - RNA, 64 nt, Homo Sapiens
uaucugauauggucauuuguuuuaaauaacacccaccccuuauuuuccguaaauacacacacaa

SEQ ID NO: 165414 - RNA, 64 nt, Homo Sapiens
aggccggucuaaagugagcucuaugggcagaucuaccccuuacuuauuauuccagaucugcagu

SEQ ID NO: 165415 - RNA, 64 nt, Homo Sapiens
uccucauuuccuucuuuuauuccuccccaccccaaccccuuaaaaaaaaggucagaaggacaaa

SEQ ID NO: 165416 - RNA, 64 nt, Homo Sapiens
cucagggguaagggaaggaagccagccuuucagcaccccuuacccuccacaguucugugauuuc

SEQ ID NO: 165417 - RNA, 64 nt, Homo Sapiens
uuuuaugccuguuaagcuuuagcaguuggguuuuaccccuuaguguuuuucacucuuaugucag

SEQ ID NO: 165418 - RNA, 64 nt, Homo Sapiens
aaagugauggccccacagaaccaccuucuagaugaccccuuaaucccgcgguuugucagggggc

SEQ ID NO: 165419 - RNA, 64 nt, Homo Sapiens
auccuggaggguccccuagaggcaguauccccaguggaaagagcgugggccucaaggucagaca

SEQ ID NO: 165420 - RNA, 64 nt, Homo Sapiens
cuuuuuuuuucuucaccugggacccucuagagguuggaaagagaagagaggcugggagcggaug

SEQ ID NO: 165421 - RNA, 64 nt, Homo Sapiens
ccagggaagauuuuauauuuuuuuguagaguuuuuggaaagauauuuacucaaaauaacuaugc

SEQ ID NO: 165422 - RNA, 64 nt, Homo Sapiens
gaagaaaugcuaucagaaauagauuuccuuccaguggaaagaaaggaggaagggagaauugaga

SEQ ID NO: 165423 - RNA, 64 nt, Homo Sapiens
ugaaauaccuauuaauucuuaauauuaccucucuuggaaagacacaaaaaaagagcuguuauuu

SEQ ID NO: 165424 - RNA, 64 nt, Homo Sapiens
uuguugagagauggacuaggaaguggaagcaggcuggaaagacacauauggcgaaagucaagua

SEQ ID NO: 165425 - RNA, 64 nt, Homo Sapiens
acaaaaccagccuuuaaaauaucauguccaggccuggaaagaauacaaauccagugcaaaauua

SEQ ID NO: 165426 - RNA, 64 nt, Homo Sapiens
ccccaagguaguaaacccuggggagccccugguguggaaagaggaggagcaguccccaggguca

SEQ ID NO: 165427 - RNA, 64 nt, Homo Sapiens
agugaacauccagccccaauguuucauauuuuuuuggaaagagacugccauaccuagacugugu

SEQ ID NO: 165428 - RNA, 64 nt, Homo Sapiens
cagucuucuuagcauggugaaguaaaaucuugccuggaaagaggcccuccgguuauguugcucc

SEQ ID NO: 165429 - RNA, 64 nt, Homo Sapiens
gugggauuuggagucagacagcagcccaguggaauggaaagaauuuccuccuggcuuccagggg

SEQ ID NO: 165430 - RNA, 64 nt, Homo Sapiens
cauggcauuacugaggaguacccacuacagguuauggaaagaauuccccccaaaccccgcccgc

SEQ ID NO: 165431 - RNA, 64 nt, Homo Sapiens
gagaaagagaagcugaacagcccaguggugcccguggaaagagguguaugcuaucauugauauu

SEQ ID NO: 165432 - RNA, 64 nt, Homo Sapiens
ucaguacaacuggacuuggcccaauggaugagaguggaaagacacauguauccuggagacccuc

SEQ ID NO: 165433 - RNA, 64 nt, Homo Sapiens
caugugaguaagugagagaggugagcagucccucuggaaagaaaauaggcucuuuuugcugccu

SEQ ID NO: 165434 - RNA, 64 nt, Homo Sapiens
uucugaagagaguggaggagguauggcuuguuuuuggaaagaaauccacuguuugccuuggaua

SEQ ID NO: 165435 - RNA, 64 nt, Homo Sapiens
cuuuaaugucgguguggagauccaaaguggguuguggaaagagcguccauaggagaagugagaa

SEQ ID NO: 165436 - RNA, 64 nt, Homo Sapiens
ggcaguggcaaauaaauaaauacuuuuuuuuaaauggaaagacuugaucuaugguaauaaauga

SEQ ID NO: 165437 - RNA, 64 nt, Homo Sapiens
acccagagauguucagcaucggagaccauccccuuggaaagacacuacaugauacaguggaccu

SEQ ID NO: 165438 - RNA, 64 nt, Homo Sapiens
gggaaaguggauuuaaaauaugacacagggggccuggaaagaaaagccgccugguggauuccua

SEQ ID NO: 165439 - RNA, 64 nt, Homo Sapiens
ggccucuucuccguggggacaucccaaaacacuguggaaagaaggcccuggggaccccugaccc

SEQ ID NO: 165440 - RNA, 64 nt, Homo Sapiens
gagagagagagaaaagaggucgacugggagguucuggaaagaaaacucuccccauuuuccuguu

SEQ ID NO: 165441 - RNA, 64 nt, Homo Sapiens
agaugaugaugacagcagugaaacuccuccucacuggaaagaggaaaugcagagauuaagagca

SEQ ID NO: 165442 - RNA, 64 nt, Homo Sapiens
cagucagcccaggaaaaagagaagcagggccaaauggaaagaacacauaauaaacaagaaaaaa

SEQ ID NO: 165443 - RNA, 64 nt, Homo Sapiens
aggaaauuuaaacaaagaaacacuugaaagaaacuggaaagaaaaauaauuuuuuuaugugaac

SEQ ID NO: 165444 - RNA, 64 nt, Homo Sapiens
cuuccucuaaucuuggcaaaugaccuuuaccuuuuggaaagauuucauauugcuuccuccuccc

SEQ ID NO: 165445 - RNA, 64 nt, Homo Sapiens
uccuguguucauggaucagaaaggcuuaaauaaauggaaagacaaaauuggaaagaaauuaaag

SEQ ID NO: 165446 - RNA, 64 nt, Homo Sapiens
uuaaagaaggcuuaaauaaagaaaacuacaaaauuggaaagaaaaacaaaacaagugcaagacu

SEQ ID NO: 165447 - RNA, 64 nt, Homo Sapiens
uauugucagggaaucuuagaaagaagagcagguauggaaagaucaaugauucugggcauauacu

SEQ ID NO: 165448 - RNA, 64 nt, Homo Sapiens
uacaaauuuagacucucguugugagaaacuuagcuggaaagacauccugcuccuucguauguag

SEQ ID NO: 165449 - RNA, 64 nt, Homo Sapiens
uaauaagauugaaacuuuaguauuuaguggggaauggaaagaguugcccuuguugcaaguaaug

SEQ ID NO: 165450 - RNA, 64 nt, Homo Sapiens
agcuuauucugauacaagaaugcuugggugcauauggaaagauugugaaagagugugucuugca

SEQ ID NO: 165451 - RNA, 64 nt, Homo Sapiens
uuuaacagcaauggaggaaguuaacaauuuuuaauggaaagagcauguuagagcaaacaaaugc

SEQ ID NO: 165452 - RNA, 64 nt, Homo Sapiens
agugaaugaauuuagcauuuuaugagagugcuguuggaaagacuugauaauucaccccuuuugu

SEQ ID NO: 165453 - RNA, 64 nt, Homo Sapiens
aacuggcaggacuguuguuuaaaguauuugccucuggaaagaacaggaaaaacuaagagaauga

SEQ ID NO: 165454 - RNA, 64 nt, Homo Sapiens
uucauugaagauaaagcaaaagauuuggggcauuuggaaagaagaaaaauaauaacuuauugcc

SEQ ID NO: 165455 - RNA, 64 nt, Homo Sapiens
cuuaacccuuaacuguagauaagaaaauucauacuggaaagaaacccuacaaaugugaagucug

SEQ ID NO: 165456 - RNA, 64 nt, Homo Sapiens
ucucaacucuuacuacauguaagaguauuuauacuggaaagaaacccuacaaauguaaaaaacg

SEQ ID NO: 165457 - RNA, 64 nt, Homo Sapiens
uucacugauuugugaugucaauaggauggcaccuuggaaagaaaaaugaagaacaacuuuauca

SEQ ID NO: 165458 - RNA, 64 nt, Homo Sapiens
aaggguccgaugugccaagugaucaugauucugcuggaaagaggauuuuaaauauugugggagu

SEQ ID NO: 165459 - RNA, 64 nt, Homo Sapiens
gcuuuuccuacacugauaaaaugagugugggcuauggaaagacaagccuaguugaagugcuauu

SEQ ID NO: 165460 - RNA, 64 nt, Homo Sapiens
aacaaaauaugaugagagguugaaaugguaaaaauggaaagaaggugggcaauauugcaauauu

SEQ ID NO: 165461 - RNA, 64 nt, Homo Sapiens
uguguuuugguucaaagacacaacgcuccaagcuuggaaagagcaugggagaagagggcccucu

SEQ ID NO: 165462 - RNA, 64 nt, Homo Sapiens
accucuuccaucuuccaugcugguuccuuucaucuggaaagaagucuuccucauccaccacuuc

SEQ ID NO: 165463 - RNA, 64 nt, Homo Sapiens
gugaaauccuuuuaauuuuucgggcaguacacuuuggaaagaauaacaugcgugugccagacac

SEQ ID NO: 165464 - RNA, 64 nt, Homo Sapiens
uccuagcaucagaggauuaauggggacauuaugcuggaaagagccccuuggugcuggcaguguu

SEQ ID NO: 165465 - RNA, 63 nt, Homo Sapiens
ugaauaagauuuaccuaugaguagaagcuuaauuggaaagaagagaagaauuacugacguaau

SEQ ID NO: 165466 - RNA, 64 nt, Homo Sapiens
cacauaauccuuauguuauagagguucacagaaauggaaagauaccuguuucccuuuaaucaau

SEQ ID NO: 165467 - RNA, 64 nt, Homo Sapiens
uuacuccagcccuggcccaaggaggcccagaaguuggaaagagauggaauguggcugggaacau

SEQ ID NO: 165468 - RNA, 64 nt, Homo Sapiens
ggauccuccacuccuggggauuaugaagauauucuggaaagauuugugcuucagagguagacug

SEQ ID NO: 165469 - RNA, 64 nt, Homo Sapiens
gcaggacauggacaaggaugaucuaggaagacuuuggaaagaguaggaagacuuuggaaagacu

SEQ ID NO: 165470 - RNA, 64 nt, Homo Sapiens
aucuaggaagacuuuggaaagaguaggaagacuuuggaaagacuuuuccaacccucaucaccaa

SEQ ID NO: 165471 - RNA, 64 nt, Homo Sapiens
uaccggauuaaauuuaucugucuuuauuucuggguggaaagauagagcauuaagacaauguaau

SEQ ID NO: 165472 - RNA, 64 nt, Homo Sapiens
cugauuuucuaaaauaugcaucgagaggcagcauuggaaagagcacaacacacauuauugugug

SEQ ID NO: 165473 - RNA, 64 nt, Homo Sapiens
aaauugacguacuugcaguuuucuuuuuaaauuuuggaaagaguacuccucaaaucgaauuauu

SEQ ID NO: 165474 - RNA, 64 nt, Homo Sapiens
cccuaauaauacaccuauuuaucuaggagucaaauggaaagaucacuaggucauuucauuugaa

SEQ ID NO: 165475 - RNA, 64 nt, Homo Sapiens
cuguugguuuuuauuuugauucuaaggucaaaaguggaaagacauuuccauuagaauaacuuau

SEQ ID NO: 165476 - RNA, 64 nt, Homo Sapiens
uauauaguguauuugugaaacugaauuuaugaauuggaaagauaugucugcagccagaaagaau

SEQ ID NO: 165477 - RNA, 64 nt, Homo Sapiens
cacaagaaugacuuucacaagggcaggaacauuguggaaagacugcaucauucugaugaggcaa

SEQ ID NO: 165478 - RNA, 64 nt, Homo Sapiens
acagacgcgggcagugaugagcccuguucuggaguggaaagagcacgauagagcaccaggcuaa

SEQ ID NO: 165479 - RNA, 64 nt, Homo Sapiens
agaagaagcugcucuggggagacgaggguaugaguggaaagaggaugggcgaggaggccgggcu

SEQ ID NO: 165480 - RNA, 64 nt, Homo Sapiens
gagcagggagggguaggguggacaggcgaugccguggaaagacgucucgguggaaacugccaug

SEQ ID NO: 165481 - RNA, 64 nt, Homo Sapiens
uugugugaaaaaggaauaaauuguuccaugcugguggaaagauagagauuguuuuuagagguug

SEQ ID NO: 165482 - RNA, 64 nt, Homo Sapiens
ugauagaauacuaucgagccaacauguacugacauggaaagaugucaaagauauguuaagugua

SEQ ID NO: 165483 - RNA, 64 nt, Homo Sapiens
auguauguuuuuaauaugcauagaacaaaagauuuggaaagauauacaccaaacuguuaaaugu

SEQ ID NO: 165484 - RNA, 64 nt, Homo Sapiens
uguucauaugucacuccucuuuuuaauaaccuuguggaaagacaucugggagguaagauauucu

SEQ ID NO: 165485 - RNA, 64 nt, Homo Sapiens
uuuugguuauacauuuuaaauguuucugaauguauggaaagacaaaaauagaagacaaucugcu

SEQ ID NO: 165486 - RNA, 64 nt, Homo Sapiens
aagacagauaagcacgcugcugcuuuccaauccuuggugauauguguaugucaaggcuuacuac

SEQ ID NO: 165487 - RNA, 64 nt, Homo Sapiens
uuccuuacaagauggguaccuuaagauaucuagauggugauauuuauuggaugauagaagauau

SEQ ID NO: 165488 - RNA, 64 nt, Homo Sapiens
uuuacuuuggauacucuguguuuauuuuucagaguggugauacuagaguauuuuuuucaagaca

SEQ ID NO: 165489 - RNA, 64 nt, Homo Sapiens
uuauccccaagauaugacacggaggaucugagcuuggugauauugaacaaguagacacacugug

SEQ ID NO: 165490 - RNA, 53 nt, Homo Sapiens
caagaacuagaaauaaauaaggauggugauagagagguauaccuucauauuca

SEQ ID NO: 165491 - RNA, 64 nt, Homo Sapiens
uagaaaaccugacuaauggugucacugcuggcaauggugauaauggauuaauuccucaaaggaa

SEQ ID NO: 165492 - RNA, 64 nt, Homo Sapiens
agaaaagaucucaagaaccagaaauaaauaaggauggugauagagagguauaccuuuauauuca

SEQ ID NO: 165493 - RNA, 64 nt, Homo Sapiens
aagccaaggugucauuuaugugucaguucauuuguggugauauagaauuagcuuuuucaucccc

SEQ ID NO: 165494 - RNA, 64 nt, Homo Sapiens
ccccgucucuguuccaugucuccuuuaagagcucuggugauaaggacaugaugcuuuuacugaa

SEQ ID NO: 165495 - RNA, 64 nt, Homo Sapiens
cccugccauagccuugaugcacuuggccuuagaucucugcuauaaaagcgacagcucuacuucc

SEQ ID NO: 165496 - RNA, 64 nt, Homo Sapiens
cccguucuuccugcuuuccugcugucgucccugacucugcuacuuaaauucaaucaccaacugu

SEQ ID NO: 165497 - RNA, 64 nt, Homo Sapiens
caggauugauaaacagcuggggugggaggcagugcucugcuaguuggccaaggagaauuucugc

SEQ ID NO: 165498 - RNA, 64 nt, Homo Sapiens
aauacaaaaaauuagccagauggugaaaccccgucucugcuaaacgagaccauccuggcuaaca

SEQ ID NO: 165499 - RNA, 64 nt, Homo Sapiens
cuucugauuuuuuuuuacuuucugcuccuuacuucucugcuauuuucauugccacuuuuuaaug

SEQ ID NO: 165500 - RNA, 64 nt, Homo Sapiens
uaaucuaccaagugucccccuaaccuccuuuccucucugcuaauagauuuuuugugguuguugu

SEQ ID NO: 165501 - RNA, 64 nt, Homo Sapiens
gggcggggcgucaacggcacugcuucaggacgcgcuugcugaaacgacuccaacagcuaguuca

SEQ ID NO: 165502 - RNA, 64 nt, Homo Sapiens
uauuuacccaacucugaucuugcgugcagggaugcuugcugauggaugaaagaccacaauaaaa

SEQ ID NO: 165503 - RNA, 64 nt, Homo Sapiens
ccucggagcaagcgccgcacagccaucaguugcucuugcugaccucucggggccuggaaguggc

SEQ ID NO: 165504 - RNA, 64 nt, Homo Sapiens
uauuacugcuugaaucuggacaugaccaccuccucuugcugaaaccucugcugugcuggcuucc

SEQ ID NO: 165505 - RNA, 64 nt, Homo Sapiens
uuccccaucaugggcaaggagcgugggcccugcacuugcugagguccccuugcuggcgggcgcu

SEQ ID NO: 165506 - RNA, 64 nt, Homo Sapiens
ggugggagagccagcugugggguaacugcgagagcuugcugaggagaaacacgaaggaucaugu

SEQ ID NO: 165507 - RNA, 64 nt, Homo Sapiens
uggagggauugggcugaagcugcuccaccucauccuugcugagugggggagacauuuucccuga

SEQ ID NO: 165508 - RNA, 64 nt, Homo Sapiens
acugauggagcaucagcuguggcccacagagagccuugcugagaagggggcagguaaagcagag

SEQ ID NO: 165509 - RNA, 64 nt, Homo Sapiens
uucugguuggaguguuuuuucuuaaggucugagacuugcugauugcucugagacacuugcagau

SEQ ID NO: 165510 - RNA, 64 nt, Homo Sapiens
ucucccuauaaaaguaaagcagauuccuuucagccuugcugacuuguaacugccugcuagccau

SEQ ID NO: 165511 - RNA, 64 nt, Homo Sapiens
uggugggaggggaucaccuggguuccaggccauccuugcugagcaucuuugagccugccuuccg

SEQ ID NO: 165512 - RNA, 64 nt, Homo Sapiens
ugagccuugcagcucuuccagcuggggacuggugcuugcugaaacccaggagcugaacagugag

SEQ ID NO: 165513 - RNA, 64 nt, Homo Sapiens
uugaggaggcaccucugacucccacacucgcggucuugcugaucgcaccuggcuccuaccugga

SEQ ID NO: 165514 - RNA, 64 nt, Homo Sapiens
cuaggcugugcgugagccgggacuguacccacagcuugcugagggcugcucuucuugggccagg

SEQ ID NO: 165515 - RNA, 64 nt, Homo Sapiens
uaugucagcaccuuuucucacucuaaccagaaaucuugcugaagaaaaauccuuuagaguucag

SEQ ID NO: 165516 - RNA, 64 nt, Homo Sapiens
gaaugcagaaaucagcgguaugacaucauaaauacuugcugaaugugucuggcggggagccagg

SEQ ID NO: 165517 - RNA, 64 nt, Homo Sapiens
ucuccaacaaauggaguagcaucccccuggggcacuugcugaggccaagccacucacauccuca

SEQ ID NO: 165518 - RNA, 64 nt, Homo Sapiens
agccacucacauccucacuuugcugccccaccaucuugcugacaacuuccagagaagccauggu

SEQ ID NO: 165519 - RNA, 64 nt, Homo Sapiens
uguucaguguauuuuauuacguguacauuuaacucuugcugacaauauuccuuguucuuaccaa

SEQ ID NO: 165520 - RNA, 64 nt, Homo Sapiens
uuuuuuaacuucccuauuuuucaucuaaauuuuucuugcugauuauauucugaagcaaaaacug

SEQ ID NO: 165521 - RNA, 64 nt, Homo Sapiens
gucucuugaaguacaggcuggucgucgucaucaucuugcugaguucaucaucaucaucaucauu

SEQ ID NO: 165522 - RNA, 64 nt, Homo Sapiens
caucaucaucaucaucaucagucgucgucaucaucuugcugaguucauuaucaucaucaucauu

SEQ ID NO: 165523 - RNA, 64 nt, Homo Sapiens
gucuguaauguucaugucauuguuuacaaaaugcuagcuggaaagcugacuuacagacacaggc

SEQ ID NO: 165524 - RNA, 64 nt, Homo Sapiens
uuagccaccccagaaaggguugcugaugacacauuagcuggaucaaacacauauuagaggccuu

SEQ ID NO: 165525 - RNA, 64 nt, Homo Sapiens
guguuugagcuuucaugaguuucccagagagacauagcuggaaaauuccuauugauuuucucua

SEQ ID NO: 165526 - RNA, 64 nt, Homo Sapiens
accaugagcaauucuccugccucagccucccaaguagcuggaacuacaggcucaugccacugcg

SEQ ID NO: 165527 - RNA, 64 nt, Homo Sapiens
acaggcauacaccaccacgccucagccucccaaguagcuggauugguucaagcuauucuccugc

SEQ ID NO: 165528 - RNA, 64 nt, Homo Sapiens
uacaggcauauaccgccacacucaggcacccaaauagcuggaacggcucaagugauucucccac

SEQ ID NO: 165529 - RNA, 64 nt, Homo Sapiens
uuucacaggcaucuuugauuccauuagacaccacuagcuggauaguccaacucuuuccaacagc

SEQ ID NO: 165530 - RNA, 64 nt, Homo Sapiens
uacaggcacacacugccgcgcucagccucccgaguagcuggaacgguucaagcaauucuccugc

SEQ ID NO: 165531 - RNA, 64 nt, Homo Sapiens
accuacugaggaguacuuuucucuaguuguuaaauagcuggaguuuuucuuauucagguuuaau

SEQ ID NO: 165532 - RNA, 64 nt, Homo Sapiens
ucuugaucuucaaugaacuuuuaaauaaugcauuuagcuggaaaacaagacuuucccagcuugu

SEQ ID NO: 165533 - RNA, 64 nt, Homo Sapiens
cagcucucuacaccucuauauauuauauuacuauauagccgagcuguucuuccuuccuauggaa

SEQ ID NO: 165534 - RNA, 64 nt, Homo Sapiens
auaauggaaauaggaaaaauuugcaaaagaugguauagccgaauagaaaaggaacaaucagaag

SEQ ID NO: 165535 - RNA, 64 nt, Homo Sapiens
uuguacacaccuuauauuuacguaugagacguuuauagccgaaaugaucuuuucaaguuaaauu

SEQ ID NO: 165536 - RNA, 64 nt, Homo Sapiens
aacuuggggggauggcgaauggagagaagaagcaauagccgaggcccagccgguacccaccaaa

SEQ ID NO: 165537 - RNA, 64 nt, Homo Sapiens
gcucggggggaugguagagucccagacuaaauucauagccgagagccuauuacggagcccucuu

SEQ ID NO: 165538 - RNA, 64 nt, Homo Sapiens
uccaggcugggcugagccaacuucccucucugaaauagccgaacugcacccucuucuccucugg

SEQ ID NO: 165539 - RNA, 56 nt, Homo Sapiens
aaaugaaccguccuccugcccaaguuauagccgagcaugcugcaggguacccauag

SEQ ID NO: 165540 - RNA, 64 nt, Homo Sapiens
aacuuuacucuugguucugagucuccaaauaauaauagccgacguuuauugagcacuuacuaug

SEQ ID NO: 165541 - RNA, 64 nt, Homo Sapiens
cuguuacauuuaagaguagcgguacaucgucaacauagccgaucggggggagggccaugggagg

SEQ ID NO: 165542 - RNA, 64 nt, Homo Sapiens
gagagacuugcuaaaauauaaaaacuuggggaucauagccgauaaucauaguuucucuaaaaag

SEQ ID NO: 165543 - RNA, 64 nt, Homo Sapiens
acagccuuaaauaugcuuguagguugaacucuuuauagccgaauuagaaagaauauuaaagagu

SEQ ID NO: 165544 - RNA, 64 nt, Homo Sapiens
acuucaaauuacaccuucaaaacuggagcagcauauagccgaaaaggagcacaacugagcacuu

SEQ ID NO: 165545 - RNA, 64 nt, Homo Sapiens
acugcuggcagaaagggggcacccacacgcuuagauagccgaugucuuauuagagggcaguuug

SEQ ID NO: 165546 - RNA, 64 nt, Homo Sapiens
accaucagucugaauccaggucgugggggcugucauagccgaacuccuucugcacauccagagg

SEQ ID NO: 165547 - RNA, 64 nt, Homo Sapiens
gggcuucuagcugacuugcacagggauucucacaauagccgauaucagaauuuguguugaagga

SEQ ID NO: 165548 - RNA, 64 nt, Homo Sapiens
ucucugccgucucuccugcucucauaaugaagacauagccgauucucugcccgggccccuugcu

SEQ ID NO: 165549 - RNA, 64 nt, Homo Sapiens
auaugcauuuaauacaccuacccugcugaacaucauagccgaucuugccuucagaaugcucaga

SEQ ID NO: 165550 - RNA, 64 nt, Homo Sapiens
acugaggcacacggccuggccuggcuucacacacauagccgacucaggagagggaugcccaugg

SEQ ID NO: 165551 - RNA, 64 nt, Homo Sapiens
ucugccuuuccccuuuuucacccagaaaauggauauagccgaaaccaccagagucacuggugac

SEQ ID NO: 165552 - RNA, 64 nt, Homo Sapiens
ccccagcaacaaucugagccagaggcuggaggagauagccgagagcuccggcuaaugauucgac

SEQ ID NO: 165553 - RNA, 64 nt, Homo Sapiens
augguagcuucucaaguuauaugucuuuaaaagcauagccgacaaagcagcaagaauggaccug

SEQ ID NO: 165554 - RNA, 64 nt, Homo Sapiens
cacagcgccuaccaugugcagggcuggugguuucauagccgacaaugugaacagggcacgcggu

SEQ ID NO: 165555 - RNA, 64 nt, Homo Sapiens
guauacagagguucaucucaaaaaccuuagauacauagccgacuagaaauacaucuguguccug

SEQ ID NO: 165556 - RNA, 64 nt, Homo Sapiens
gagucuaaaaugauacccuggguggagugggggagcugagcaggaggccagguggcaaccagua

SEQ ID NO: 165557 - RNA, 64 nt, Homo Sapiens
caccaagagugguuuccaugccugcugggaauaggcugagcaugcaaugacaugagggccaagg

SEQ ID NO: 165558 - RNA, 64 nt, Homo Sapiens
gccugggugggcaggaacugcaguauggccaugggcugagcaggcugagcaccucagccuuuag

SEQ ID NO: 165559 - RNA, 64 nt, Homo Sapiens
ggcaggaacugcaguauggccaugggcugagcaggcugagcaccucagccuuuagggcuuaugg

SEQ ID NO: 165560 - RNA, 64 nt, Homo Sapiens
gccauccccucaauucagggcgucuucucccuuggcugagcaaacuccggauguccucuuugcc

SEQ ID NO: 165561 - RNA, 64 nt, Homo Sapiens
cagcagccucugcucugugguguggcuaaagucugcugagcaggcauuguccccuggaaaccug

SEQ ID NO: 165562 - RNA, 64 nt, Homo Sapiens
gcacugccagccugucccucggacagacugaagagcugagcaggcugguagccuggccuuuccu

SEQ ID NO: 165563 - RNA, 64 nt, Homo Sapiens
aggguuagaggguggggagggucagugugcagcugcugagcaaaaacaaugaaccagaggcuug

SEQ ID NO: 165564 - RNA, 64 nt, Homo Sapiens
uuuuuaaaagaagcuuuguaguuugaguuaaugugcugagcauuuccuaacguuugucauucca

SEQ ID NO: 165565 - RNA, 64 nt, Homo Sapiens
uuuucuccccucauaucugccaggcuguggggcagcugagcagcaaagcacaugagaaugcuag

SEQ ID NO: 165566 - RNA, 64 nt, Homo Sapiens
cccuccccacaucaucuucaaccuuccagccccagcugagcagcgccagcccagcccuguccuc

SEQ ID NO: 165567 - RNA, 64 nt, Homo Sapiens
gcgccucacuguauccuaaccgugccagaauggggcugagcacggcugguguuuaucgaugcua

SEQ ID NO: 165568 - RNA, 64 nt, Homo Sapiens
aaaggaauuucuaaggacauuguuuucauggacagcugagcacuacggaggaagccgcuuaucc

SEQ ID NO: 165569 - RNA, 64 nt, Homo Sapiens
gacggaggaagccgcuuauccuccacccugcccugcugagcacauccuggccugagcgcagcgc

SEQ ID NO: 165570 - RNA, 64 nt, Homo Sapiens
ugggguaguaguguguuguagucguacuuaccaagcugagcaaccucuucagcugggaaggccg

SEQ ID NO: 165571 - RNA, 64 nt, Homo Sapiens
cugggaguccugucagcuuccccaggagcucucugcugagcagcccagcacaacccccaggaaa

SEQ ID NO: 165572 - RNA, 64 nt, Homo Sapiens
ggcucagaucagagcuccgaagcggucaaagugagcugagcaggacaggcccagccuuucucca

SEQ ID NO: 165573 - RNA, 64 nt, Homo Sapiens
cgggcaaaauacgugcucuccucucuccuugucagcugagcaaacccagggaauagcccuccuc

SEQ ID NO: 165574 - RNA, 64 nt, Homo Sapiens
uggcuggagcuaguacugacgggauucuugaugggcugagcagcaugcuaacagaucccccuga

SEQ ID NO: 165575 - RNA, 64 nt, Homo Sapiens
gaagcucauuucaugugagugcccacagccaccggcugagcaaaccugaggaaguacugaccau

SEQ ID NO: 165576 - RNA, 64 nt, Homo Sapiens
gggaacagugaggugcccagggcccacagcaggugcugagcaaagccagggucacugaaggccu

SEQ ID NO: 165577 - RNA, 64 nt, Homo Sapiens
uucuggcucagggagguuaaagccagucuuuacagcugagcacacuuaaggggcagcuucuauu

SEQ ID NO: 165578 - RNA, 64 nt, Homo Sapiens
ccucuccagaauggcgacuguccccauccgccuggcugagcaggagagagggagcuggcggugc

SEQ ID NO: 165579 - RNA, 64 nt, Homo Sapiens
ggcugaggucaauaccgcagaccuuggggaggaagcugagcaucccccgggaugucuccagucc

SEQ ID NO: 165580 - RNA, 64 nt, Homo Sapiens
uggagggcccuacuccacacccuagagcugugaugcugagcaaggugccuguggcggaaggaac

SEQ ID NO: 165581 - RNA, 64 nt, Homo Sapiens
gcagccuuuccuguugucacauggguucagagcagcugagcagggaacacguccuaggcagguc

SEQ ID NO: 165582 - RNA, 64 nt, Homo Sapiens
uugaguucuucuuuucauggcuuuuauucacugugacuaauaagcuuccuaauaaauccuugcc

SEQ ID NO: 165583 - RNA, 64 nt, Homo Sapiens
gaagagguaacuaaaucucacaugcaggucuaaugacuaauaauuggaguacggcugcuagaca

SEQ ID NO: 165584 - RNA, 64 nt, Homo Sapiens
cgggaacuuauccccgacagugacugaacucacugacuaauaacuucauuuaugaaucuucuca

SEQ ID NO: 165585 - RNA, 64 nt, Homo Sapiens
uuggaauucacuauucuggcaauaaauuuugguagacuaauacaguacagcuagacccagaaau

SEQ ID NO: 165586 - RNA, 64 nt, Homo Sapiens
auggugauuaguguuaaaaaucaauuuaaaucaugacuaauaugguaaaaagauaaagcaucaa

SEQ ID NO: 165587 - RNA, 64 nt, Homo Sapiens
aauuguggucucucuuaacuugagguucucuuuugacuaauagagcuccauuuccccucuuaaa

SEQ ID NO: 165588 - RNA, 64 nt, Homo Sapiens
ugggugugcccuggcucccaagggaggcccaugugacuaauaaaaaacugugaacccuguggag

SEQ ID NO: 165589 - RNA, 64 nt, Homo Sapiens
aaucaagaaaauuuguuguuuccuuuauuuuuaugacuaauauaaaauacuugcaauauauuuu

SEQ ID NO: 165590 - RNA, 64 nt, Homo Sapiens
acaagcucuuguagggggaauuggaauaccaguugacuaauauuccuuuccccuuaagagacag

SEQ ID NO: 165591 - RNA, 64 nt, Homo Sapiens
aaagaauuuguaauuguggggugauugugauuuugacuaauaaagucccauccuuuuaaucaag

SEQ ID NO: 165592 - RNA, 64 nt, Homo Sapiens
uuguguuccgggaauaacaucacagcagccacuugacuaauaccgaaugugcauuucuugacuu

SEQ ID NO: 165593 - RNA, 64 nt, Homo Sapiens
uaugcucucauuccucagguguuuugagaaacaugacuaauaaccacacaauuaaguagaguca

SEQ ID NO: 165594 - RNA, 64 nt, Homo Sapiens
auaugcucauaucagaugucacugugcuugaauagacuaauaauagauguuugcuaacuucaaa

SEQ ID NO: 165595 - RNA, 64 nt, Homo Sapiens
ccauguuaaucuggcuagaucuuguaagaauacugacuaauaugacagcuacaccaaaacucuu

SEQ ID NO: 165596 - RNA, 64 nt, Homo Sapiens
gcuuaauauuuaauugauuucagaaucguugagagacuaauaagcucccuuuuuauuuugccug

SEQ ID NO: 165597 - RNA, 64 nt, Homo Sapiens
aaucacuccaaguugauguuuggacaacaaagaugacuaauaguacugauguaacuuucuagac

SEQ ID NO: 165598 - RNA, 64 nt, Homo Sapiens
ucaugacgugaaaauuaucagaaaagaaaucaaagacuaauaauccgcauuuuuaaaugguugg

SEQ ID NO: 165599 - RNA, 64 nt, Homo Sapiens
gaaaaggucuguccauagugaacuuacccauggggacuaauaugguguuuuggggcauuugugg

SEQ ID NO: 165600 - RNA, 54 nt, Homo Sapiens
uuuggcaaugcaaagaaugaagaugacuaauaguacuuguacuucccaccacug

SEQ ID NO: 165601 - RNA, 64 nt, Homo Sapiens
cugaacugcuaauguggcugcuuuguagggaauggacuaauaucaguguguuagaucuuaaggu

SEQ ID NO: 165602 - RNA, 64 nt, Homo Sapiens
uacgauucaguauguuccuguggaugucugcugugacuaauauaaauuucuugcagaaucagcu

SEQ ID NO: 165603 - RNA, 64 nt, Homo Sapiens
cugaccuguuuuugguccacuuuugcccuuccaugacuaauaaggaagauauguguguauuuca

SEQ ID NO: 165604 - RNA, 64 nt, Homo Sapiens
uauagcauugauacuaggugaacagaaauuaccugacuaauaauuugucuaacaucauauauca

SEQ ID NO: 165605 - RNA, 64 nt, Homo Sapiens
guaaguucggcauuuguuacauguauagagagaagacuaauaaucucuauuuauaacuaaauca

SEQ ID NO: 165606 - RNA, 64 nt, Homo Sapiens
guugguggcauaagagaaucgggaacccugcccagacuaauacuaaaaaaaaaguaaauaucca

SEQ ID NO: 165607 - RNA, 64 nt, Homo Sapiens
aaaguuggcauaaacuuucaauaacuuggagguugacuaauaaggcuuugauuucucccaaaga

SEQ ID NO: 165608 - RNA, 64 nt, Homo Sapiens
gauaauccagguaacuuugaaggucauuuucagugacuaauaggaccugcugggguccuuuguu

SEQ ID NO: 165609 - RNA, 64 nt, Homo Sapiens
cagaguuaaauauaaauacagacuggaagaggcggacuaauagcuccuuugcaaauggcucagu

SEQ ID NO: 165610 - RNA, 64 nt, Homo Sapiens
auuuucuuauuuaaaaaaaggguacaaauaacaagacuaauaauucaaauugauaaaauauuua

SEQ ID NO: 165611 - RNA, 64 nt, Homo Sapiens
gcuugucaugauuaacauaaauguuuauaugugugacuaauaagacaaaugauugcaugaggcc

SEQ ID NO: 165612 - RNA, 64 nt, Homo Sapiens
cuuuggcuguguuuuaucuuuaaugaacguuucugacuaauauuuuguuguaaaccauuaagua

SEQ ID NO: 165613 - RNA, 64 nt, Homo Sapiens
aaguaauuuuuaaauauuuguaauauuguugacugacuaauaaacuauuaaguuauuggcauag

SEQ ID NO: 165614 - RNA, 64 nt, Homo Sapiens
cugaacauuuuugcuuugcugccagaguaacccugacuaauaauacaauaacagcaauuuuuuu

SEQ ID NO: 165615 - RNA, 64 nt, Homo Sapiens
gaacuccugacuaccauucuaugacugaucaaaagacuaauaguuaaaaaccucagcaggccuu

SEQ ID NO: 165616 - RNA, 64 nt, Homo Sapiens
ugauagugguguucacuaggagacguggaauugagacuaauaacuuggauguuaacacuguuua

SEQ ID NO: 165617 - RNA, 64 nt, Homo Sapiens
augacccuuagggccaggaacccgugcguucagugacuaauaaaggcgcaggauccaggcgcug

SEQ ID NO: 165618 - RNA, 64 nt, Homo Sapiens
ugcuaauuugugauccaacagcuauguacagucugacuaauaaccauuaaauuugguuuguuuu

SEQ ID NO: 165619 - RNA, 64 nt, Homo Sapiens
ucaugcaucuuauuaaauggcccuaaaguucauugacuaauagccacuucguugauccauccag

SEQ ID NO: 165620 - RNA, 64 nt, Homo Sapiens
cauucaaaaagaguuugguuuuuccaccucauuagacuaauacuuuuauguauugauggggacu

SEQ ID NO: 165621 - RNA, 64 nt, Homo Sapiens
uauggauauaaauguaggcaaaaugaaagauuaugacuaauauucagauuccauuuucaauaag

SEQ ID NO: 165622 - RNA, 64 nt, Homo Sapiens
uauauuaagugcacuugaguggaauucaacauuugacuaauaaaaugaguucaucauguuggca

SEQ ID NO: 165623 - RNA, 64 nt, Homo Sapiens
uagauaaauucccagguguagcauuacagcuucugacuaauauagcugccauucagacaauuaa

SEQ ID NO: 165624 - RNA, 64 nt, Homo Sapiens
ugcuuauauuggccaaaauauggacacaaauauagacuaauauggguaauuacccuuugguuua

SEQ ID NO: 165625 - RNA, 64 nt, Homo Sapiens
aaagggaauuauuucucagucuuucaaggcuugagacuaauauaggccauugugauucaggaag

SEQ ID NO: 165626 - RNA, 64 nt, Homo Sapiens
guuaauuacaugucagacuccuagagggccuccagacuaauaggaagcauuucuguaaccaacc

SEQ ID NO: 165627 - RNA, 64 nt, Homo Sapiens
gcaaauuuuucuucugccaucuguaauuuucaaggacuaauauauuuuaaguuugauuuccugu

SEQ ID NO: 165628 - RNA, 64 nt, Homo Sapiens
acugucaauacuaaaauuuauuuuaacuuuauuugacuaauaugagaagauauguuuuaucuuu

SEQ ID NO: 165629 - RNA, 64 nt, Homo Sapiens
uguguuuucuuuucuuuuguuuugaauggaauuugacuaauaugugaaauagccaggaaacuuc

SEQ ID NO: 165630 - RNA, 64 nt, Homo Sapiens
accgaacgccuguuccccuuuacugcuguaacaugacuaauaaacugccauuaacacaucuggu

SEQ ID NO: 165631 - RNA, 64 nt, Homo Sapiens
auaucauauugauuuugucucucuggagaacccugacuaauaaaaugaggcaucuaaaauucua

SEQ ID NO: 165632 - RNA, 64 nt, Homo Sapiens
uauagaaaccaaauauuuuacuguuucuuuuaaggacuaauauugucaaaaacugcuguuauua

SEQ ID NO: 165633 - RNA, 64 nt, Homo Sapiens
gccuaguccagugguucucaaagugugauccauagacuaauagcauagcauuaccugagaacuu

SEQ ID NO: 165634 - RNA, 64 nt, Homo Sapiens
auaguguucaguaaaaugaagcagucuuaagagugacuaauaauuucaaagugauuuuucgucu

SEQ ID NO: 165635 - RNA, 64 nt, Homo Sapiens
uaaucaugugaaacuuuuccuagaugcaaaugcugacuaauaaagacaaagccacccugaaccu

SEQ ID NO: 165636 - RNA, 64 nt, Homo Sapiens
ggaucagcaggagcuuuauaaaugacuuuacagagacuaauaagggauuugaucuuucuuuuuu

SEQ ID NO: 165637 - RNA, 64 nt, Homo Sapiens
gacauuuuaaaaaaccaugcuuaguauaaucugugacuaauaaauacauauuccacauauguau

SEQ ID NO: 165638 - RNA, 64 nt, Homo Sapiens
uauaaauguuaaaugauauuaguaaagcuccagugacuaauauguuucguguggauguacucca

SEQ ID NO: 165639 - RNA, 64 nt, Homo Sapiens
aauuuagaaaucauuguguuaucuuuucauuaaagacuaauagaaaggcaacacaacuaauguc

SEQ ID NO: 165640 - RNA, 64 nt, Homo Sapiens
uuugacauuaugugaauauuuuacuggaaaauaagacuaauaaauuguuaaaaguuuuuaaaau

SEQ ID NO: 165641 - RNA, 64 nt, Homo Sapiens
uaucacuauguauuuuaugaacagaauugacugggacuaauaucacaggaucaaucaucucaga

SEQ ID NO: 165642 - RNA, 64 nt, Homo Sapiens
accuauuagaguaaucuacaucaaagaaaagcaugacuaauacggugcuucuugcagcaggugg

SEQ ID NO: 165643 - RNA, 64 nt, Homo Sapiens
caucaguuuuacaaacauaaacaagaaaugucuagacuaauauuuuuguuuuuguuguuggaua

SEQ ID NO: 165644 - RNA, 64 nt, Homo Sapiens
uaucuuucugugauuucaucuuggccacuaacuggacuaauauguggacucuaaagaccaaugu

SEQ ID NO: 165645 - RNA, 64 nt, Homo Sapiens
aauguaugucuagcaucaaaugaguauuguaaaagacuaauauaaaaugguuuauaagacugau

SEQ ID NO: 165646 - RNA, 64 nt, Homo Sapiens
auuuaggauuugccgcuuccauaaaucaaagcaugacuaauagggggucucugaaauguaaggg

SEQ ID NO: 165647 - RNA, 64 nt, Homo Sapiens
uggacacuuaauucaaaaauuauuuauuagagaagacuaauaaaggaucagaaaauauacacua

SEQ ID NO: 165648 - RNA, 64 nt, Homo Sapiens
acuugaaaauuuuuuauacuacaccaaguuauaugacuaauauauagcacuauuuaaaauaagc

SEQ ID NO: 165649 - RNA, 64 nt, Homo Sapiens
uuaauauauaucugcuguccaaccaaaaagaccagacuaauauaccaaguggugccuaaaguuu

SEQ ID NO: 165650 - RNA, 64 nt, Homo Sapiens
ugagaccugguacaacacggaaaugauucuuauagacuaauacagcagcucacacuucgacaag

SEQ ID NO: 165651 - RNA, 64 nt, Homo Sapiens
gucaugggcaguccuuuacagcagcaugagaauggacuaauacacuccucaaauguuuugaaga

SEQ ID NO: 165652 - RNA, 64 nt, Homo Sapiens
ucaaaaucaacacaauguguucugaaacuuucgugacuaauaccaugcaucugugaucaaugaa

SEQ ID NO: 165653 - RNA, 64 nt, Homo Sapiens
agaucuauauuuaaguuuuaugauccuguugugggacuaauacacuuuauuuuaauagugaucu

SEQ ID NO: 165654 - RNA, 64 nt, Homo Sapiens
ccaguccacacuucuaugacaaaugaucuguauugacuaauacaugaaaccuguuucaacaugg

SEQ ID NO: 165655 - RNA, 64 nt, Homo Sapiens
uuaucucacacuuucaugagaaaugauccugauugacuaauacaugaaaccugguucaacaugg

SEQ ID NO: 165656 - RNA, 64 nt, Homo Sapiens
uuaucucacacuuucaugagcaaugauccugauugacuaauacaugaaaacugguucaacaugg

SEQ ID NO: 165657 - RNA, 64 nt, Homo Sapiens; identical to SEQ ID NO: 165656

SEQ ID NO: 165658 - RNA, 64 nt, Homo Sapiens
ucaucucacacuuucaugagaaaugauucucauugacuaauacaugaaaacugguucaucaugg

SEQ ID NO: 165659 - RNA, 64 nt, Homo Sapiens
aguaaccaguaguucaucaaaaccaacuuguacagacuaauaaaucuuuuucacaguauucagu

SEQ ID NO: 165660 - RNA, 64 nt, Homo Sapiens
gauccccaguguuuggaacauaagucacuaugcagacuaauaaacaucaacuagagagaacucc

SEQ ID NO: 165661 - RNA, 64 nt, Homo Sapiens
uauuacugcuaccacuaacagguuguaaauagaagacuaauacuuaauuaaagucaccuuccua

SEQ ID NO: 165662 - RNA, 64 nt, Homo Sapiens
aaaaucagaaaauuuaaaugcuaacgcuaugucagacuaauauuguuucagugcagcaugguua

SEQ ID NO: 165663 - RNA, 64 nt, Homo Sapiens
gcugauacuugaauaaucaagauaacauuuuaaggacuaauauuauauuuugcacuacacaaac

SEQ ID NO: 165664 - RNA, 64 nt, Homo Sapiens
ugagaaguacuguauuaaaugugauucuuauccagacuaauauuauuuuaaacacuuuuccaaa

SEQ ID NO: 165665 - RNA, 64 nt, Homo Sapiens
ucacaaaauauauuuuaucugugauuagccauuugacuaauaauacuggcuaacagauguugaa

SEQ ID NO: 165666 - RNA, 64 nt, Homo Sapiens
aaauuaaagaauaaaguuagacaagcaacugguugacuaauacauuaagcguuugagucuaaga

SEQ ID NO: 165667 - RNA, 64 nt, Homo Sapiens
ggaguacccccagcccaagagaugaacaucuggggacuaauaucauagacccaucuggaggcuc

SEQ ID NO: 165668 - RNA, 64 nt, Homo Sapiens
cuguaaaugggggcuccauuaguucugcugccgagacuaauaaagauuugguuggcucuagcag

SEQ ID NO: 165669 - RNA, 64 nt, Homo Sapiens
cauuugauuauuuucacuauuaguuauuauguaugacuaauaaaagcucucggcuuaaaauuau

SEQ ID NO: 165670 - RNA, 64 nt, Homo Sapiens
aaggaggcuguggcuaaagcuuguucaucacauagacuaauagagcugaacuaguagccacauc

SEQ ID NO: 165671 - RNA, 64 nt, Homo Sapiens
aguuuuaaguauguuaaaaacacaauugaccuuugacuaauagguaaaauguuguagugaagcc

SEQ ID NO: 165672 - RNA, 64 nt, Homo Sapiens
agaaucguuccuuccuugcugcauuuccuccuuagacuaauagacguuuuggaaaguucggcua

SEQ ID NO: 165673 - RNA, 64 nt, Homo Sapiens
gaauuaacauuuggugauuaugccuagcuuuuuugacuaauauaaagaucauagcuccccuuca

SEQ ID NO: 165674 - RNA, 64 nt, Homo Sapiens
ccucagccucaaaaggcuuguugggacaucagcugacuaauagauaacuguuagucuuaaauag

SEQ ID NO: 165675 - RNA, 64 nt, Homo Sapiens
caggcagagaagcuccuggauuaauauccugggugacuaauaucauggaaaguaauugguauuc

SEQ ID NO: 165676 - RNA, 64 nt, Homo Sapiens
gggggugcucaauaugcauauucuuguuaaaaaugacuaauacuaucuuaaacccuacaaauug

SEQ ID NO: 165677 - RNA, 64 nt, Homo Sapiens
ucauaaucccaacuacaauaacaagaauuuuauugacuaauaagggaauauguauggaagaagg

SEQ ID NO: 165678 - RNA, 64 nt, Homo Sapiens
gagagagacucaaagagacuccaagauucaaagagacuaauagagacacagagauggaauagaa

SEQ ID NO: 165679 - RNA, 64 nt, Homo Sapiens
aaaguauguucuaaccuuuagucuguccuugaaggacuaauagauagaaucaaacauuuugaaa

SEQ ID NO: 165680 - RNA, 64 nt, Homo Sapiens
uuguuuuuuuuucuuuuguacugagcucagcauagacuaauacuaccuuaauguuaaaaucuga

SEQ ID NO: 165681 - RNA, 64 nt, Homo Sapiens
aaugcagccacauaaaggcaguuuucuaagcagagacuaauacaaaucaugucauacauuuuug

SEQ ID NO: 165682 - RNA, 56 nt, Homo Sapiens
caggacccacuaaaguagacggacuggacuaauauuccuuaagugcugggcaguaa

SEQ ID NO: 165683 - RNA, 64 nt, Homo Sapiens
gaacucuaccccaaagugaaaguauauuuaccuugacuaauacaugcauccccauccucaagac

SEQ ID NO: 165684 - RNA, 64 nt, Homo Sapiens
uuuugaaugcccaacuguugcauucaaguuuucugacuaauaagaaauuaagcauucauccuuc

SEQ ID NO: 165685 - RNA, 64 nt, Homo Sapiens
guuuucaugaccaauccuaugucauuucuacuuugacuaauacccaaacccuaaaccucuucac

SEQ ID NO: 165686 - RNA, 64 nt, Homo Sapiens
aauucauuagagaagaauuuuuaguagauacacagacuaauauuuguguggagguucuuuugac

SEQ ID NO: 165687 - RNA, 64 nt, Homo Sapiens
gccucaguucauuuucaguuguuugauuauaugugacuaauauguauuuuuuauucaaacaaga

SEQ ID NO: 165688 - RNA, 64 nt, Homo Sapiens
ggauggagaaucagcaagagaaaugcuguauuaggacuaauaauccaucuacgcugcuuaagca

SEQ ID NO: 165689 - RNA, 64 nt, Homo Sapiens
aaagaaccgacuucugaaucgcagcuccacucaugacuaauaccucauuauuucagcugucugc

SEQ ID NO: 165690 - RNA, 64 nt, Homo Sapiens
cuuuuugucgcauuauauacaaggacuuuauuccgacuaauacuuacugugaauaaugugugug

SEQ ID NO: 165691 - RNA, 64 nt, Homo Sapiens
augauugucacaaaguuuucguauagggaaacuugacuaauauaucaccaucaagcaauccaua

SEQ ID NO: 165692 - RNA, 64 nt, Homo Sapiens
gucccauuuuggaaauaaagccugacucaaagaugacuaauauccugggaacuugugggacuca

SEQ ID NO: 165693 - RNA, 64 nt, Homo Sapiens
cuugcauuuuugaaaugaagcugcagucaaagaugacuaauaucacucugggacucacuagauu

SEQ ID NO: 165694 - RNA, 64 nt, Homo Sapiens
cuugaacauguaacacacacuggaguccccuaaugacuaauaaaucugcacagccuugagugau

SEQ ID NO: 165695 - RNA, 64 nt, Homo Sapiens
uuaucuuuugaauccuuggugacuccucuucucagacuaauaaauauuacuggguauaguaugu

SEQ ID NO: 165696 - RNA, 64 nt, Homo Sapiens
aaguggggaagacagacuuuaggaucacgugugugacuaauacagaaaggaaacauggcgucgg

SEQ ID NO: 165697 - RNA, 64 nt, Homo Sapiens
agacaauuagaaacuauuuuucuuauuaacuggugacuaauauuaacaaaacuugagccaagag

SEQ ID NO: 165698 - RNA, 64 nt, Homo Sapiens
guauuaaugaagugauuaauuggcuccauauuuagacuaauaaaacauuaagaaucuuccauaa

SEQ ID NO: 165699 - RNA, 64 nt, Homo Sapiens
gagccccagucuauaaauacagucacacccaggagacuaauaauaguaaccccagccaccaugu

SEQ ID NO: 165700 - RNA, 64 nt, Homo Sapiens
auagaaguauucgaaguauaguuccauuuuuugagacuaauaaaacauauguuuaaaaggacac

SEQ ID NO: 165701 - RNA, 64 nt, Homo Sapiens
aauaaaauaagagugauacugaaagugcucagaugacuaauauuaugcuauaguuaaauggcuu

SEQ ID NO: 165702 - RNA, 64 nt, Homo Sapiens
ugccaagugaucaugagugucauuuuuguucuaagacuaauauuuuuagaucuuuuuacuucac

SEQ ID NO: 165703 - RNA, 64 nt, Homo Sapiens
uauucucacaguaaaagaggccacggggugccuggacuaauaacuugcaauagaugccacuggg

SEQ ID NO: 165704 - RNA, 64 nt, Homo Sapiens
uuuuugauuaaaaaugugaaacucaucuuuuuaugacuaauaguggagacacucagacacuuga

SEQ ID NO: 165705 - RNA, 64 nt, Homo Sapiens
cuuucauuuguagggauauuuguuuuucauaucagacuaauaaaaagaaauuagaaaccaagua

SEQ ID NO: 165706 - RNA, 61 nt, Homo Sapiens
aguggggaacagggccagcaagacagaccaccagccagaaaucucugauaucaaccucaug

SEQ ID NO: 165707 - RNA, 61 nt, Homo Sapiens
gggaagaaauaccccagacccaacaaaccuccagccagaaagccagcuauuuugcauuuga

SEQ ID NO: 165708 - RNA, 61 nt, Homo Sapiens
agacuggaugcuggaucucauagaaaauucacagccagacaaucuucuaaucuggagucuu

SEQ ID NO: 165709 - RNA, 61 nt, Homo Sapiens
cauggaccaacagugauugaggauuugugggcagccagagggagucugacugaaguuuacu

SEQ ID NO: 165710 - RNA, 61 nt, Homo Sapiens
uccaucugcuuguauuuuccauacacauccccagccagaaguuaguguccgaagaccgaau

SEQ ID NO: 165711 - RNA, 61 nt, Homo Sapiens
agggccuagcuuucauuugacacacagacuacagccagaagcccauggagcagggauguca

SEQ ID NO: 165712 - RNA, 61 nt, Homo Sapiens
gauacaguccacagguggacaaagggauccccagccagagagagagagaccagccaacagc

SEQ ID NO: 165713 - RNA, 61 nt, Homo Sapiens
agagaccagccaacagcuugauagaccagugcagccagagagaccaccaaacagagccccc

SEQ ID NO: 165714 - RNA, 61 nt, Homo Sapiens
ccagcaaaucaggaccuaucuaggcagaccccagccagacccccgccagacagacucccaa

SEQ ID NO: 165715 - RNA, 61 nt, Homo Sapiens
gagagugugucuccuuccuggcuggugugagcagccagaggggaugcucagggagggauau

SEQ ID NO: 165716 - RNA, 61 nt, Homo Sapiens
aggaggaggcacgggugagcuguucugcaggcagccagaaauuuuguuucuccuggggcug

SEQ ID NO: 165717 - RNA, 61 nt, Homo Sapiens
accacgcaagggcagagcugggcggcauccacagccagagaggcagaggcaagagcagagc

SEQ ID NO: 165718 - RNA, 61 nt, Homo Sapiens
cauggaugcaguugugacucuggggacaaugcagccagaagcugagggaccagcacuuggu

SEQ ID NO: 165719 - RNA, 61 nt, Homo Sapiens
gagaugugcccacugcccgugcagccuccuucagccagagcccagagcauagacaggagug

SEQ ID NO: 165720 - RNA, 61 nt, Homo Sapiens
uuuccuggagcucuuggcuucagccagcccccagccagaguccuggcuaggacagugaccu

SEQ ID NO: 165721 - RNA, 61 nt, Homo Sapiens
gaagcguccuugggaucccaacacuagaaaucagccagaagagcccuggcuagacugaauu

SEQ ID NO: 165722 - RNA, 61 nt, Homo Sapiens
ucuccacagcucaaagcauuagcccuucacucagccagaccgugauucuguccucaaauaa

SEQ ID NO: 165723 - RNA, 61 nt, Homo Sapiens
cugcaucuauucuuuguaccaucugucuugccagccagaagccucugccucccuagcuuuu

SEQ ID NO: 165724 - RNA, 61 nt, Homo Sapiens
agcuugagagggcaaacccaaaaccucaugacagccagagccugucuuucagcauucaguc

SEQ ID NO: 165725 - RNA, 61 nt, Homo Sapiens
gcucuuucagaagacccaggaagggcagcuccagccagaggaccuuccuggcuaugcaggu

SEQ ID NO: 165726 - RNA, 61 nt, Homo Sapiens
acuucagccgcccaauuccaucucuccucugcagccagauucacuggcugaugcucacugc

SEQ ID NO: 165727 - RNA, 61 nt, Homo Sapiens
gaacaauggucaucugagaacccacaucccacagccagaaagucucggggguggucacaac

SEQ ID NO: 165728 - RNA, 61 nt, Homo Sapiens
uugcccugacggaguggcccacugccagacccagccagacuucacauagucauugucccuu

SEQ ID NO: 165729 - RNA, 61 nt, Homo Sapiens
ucacuaauguuagccuuauuuaggacaaagucagccagacaccuuguacugggcacgcguc

SEQ ID NO: 165730 - RNA, 61 nt, Homo Sapiens
uuuucuacacaggauccaaggucacgagaagcagccagagugccccgccuccgccggcucu

SEQ ID NO: 165731 - RNA, 61 nt, Homo Sapiens
cgcgguggcugggucugcacacuggccucugcagccagauuucuauauugggaguuuuuua

SEQ ID NO: 165732 - RNA, 61 nt, Homo Sapiens
aauaagaaacaccgcaacaguaaucaggcuccagccagaaaguggugaggccauguucuca

SEQ ID NO: 165733 - RNA, 61 nt, Homo Sapiens
gccgauuccgggagcuuggggaccaggccugcagccagaacucacagaagcugcgacucua

SEQ ID NO: 165734 - RNA, 61 nt, Homo Sapiens
cucggagggagcugcucagggccggugagcgcagccagaagcccuggccagugaggagcuc

SEQ ID NO: 165735 - RNA, 61 nt, Homo Sapiens
auuggccccagccuucugaaagccggcgcugcagccagaggccgcacgcugcacugucgcg

SEQ ID NO: 165736 - RNA, 61 nt, Homo Sapiens
aggaacaccaggcccagcgcccucuuugguccagccagacccugggcccucucuccucacu

SEQ ID NO: 165737 - RNA, 61 nt, Homo Sapiens
cuggccugugcgucugcccccuucugagaugcagccagaagcucugugccugcugcaaaga

SEQ ID NO: 165738 - RNA, 61 nt, Homo Sapiens
ggcuguuguccaaagcaugggauucuggaggcagccagagcccugcugaguuccugcuuuc

SEQ ID NO: 165739 - RNA, 61 nt, Homo Sapiens
ggcuucuuccugagauauccucagguuuucucagccagagagcugccuuuagaguccaacu

SEQ ID NO: 165740 - RNA, 61 nt, Homo Sapiens
ccaccucccuuucuuagcagaaucuaaauuacagccagaccucuggcugcagaggagucug

SEQ ID NO: 165741 - RNA, 61 nt, Homo Sapiens
ccuuggugguaaaagaggguugcauuucuugcagccagaaggcagagaaagugaagaccaa

SEQ ID NO: 165742 - RNA, 61 nt, Homo Sapiens
aggcagcuggggcugaggcccaaaggcagaacagccagagggggcaggaggggaccaaaaa

SEQ ID NO: 165743 - RNA, 61 nt, Homo Sapiens
ugcccaggcagcguggaggggaaggguagggcagccagagaaaggagcagagaaggcacac

SEQ ID NO: 165744 - RNA, 58 nt, Homo Sapiens
aggauggcuccugugacuagaggguggucagccagagcucaugggacagcuagccagg

SEQ ID NO: 165745 - RNA, 61 nt, Homo Sapiens
auaggggcagggcacucauuaaagugcaucacagccagagccuguugugucucaguugggu

SEQ ID NO: 165746 - RNA, 61 nt, Homo Sapiens
gggugacugggacccagccuuugggccuccccagccagagcagcccagcaacagugugucc

SEQ ID NO: 165747 - RNA, 61 nt, Homo Sapiens
gaggucacagaugugggagaccaaagcucuccagccagacuguguccucugacguaugccc

SEQ ID NO: 165748 - RNA, 61 nt, Homo Sapiens
cuucagccaaaugccccaacgggaaguuccucagccagacuuccucccguccaccccagag

SEQ ID NO: 165749 - RNA, 61 nt, Homo Sapiens
cagaugaguugaguggggcagagggacagggcagccagaccaaggccaagccuucucaccc

SEQ ID NO: 165750 - RNA, 61 nt, Homo Sapiens
aggagacccuaaggccccgggagcccagugccagccagagguugugcaggcaaggagacca

SEQ ID NO: 165751 - RNA, 61 nt, Homo Sapiens
uauaauuguuuuuuaaauguacacucuggcccagccagagcuguugauuguuaugacuggu

SEQ ID NO: 165752 - RNA, 61 nt, Homo Sapiens
gagaaaauguaagcagacagaauaaugaucccagccagacuaaaccucagugaaaucaaga

SEQ ID NO: 165753 - RNA, 64 nt, Homo Sapiens
uuuuccaucccacuccacuauguugucuauuuuuucugaggaauuaaggguuaccccacccugc

SEQ ID NO: 165754 - RNA, 64 nt, Homo Sapiens
gagaccuagauaggucaugcaagugagaaagacaucugaggaaaauggaagaccuaaggcagac

SEQ ID NO: 165755 - RNA, 64 nt, Homo Sapiens
aaaacggcaccucuggccuuuuugcagcaucagaucugaggagucugcugaaaucgcagagacu

SEQ ID NO: 165756 - RNA, 64 nt, Homo Sapiens
gacagagaagcaagggggcuacagcacccaggacucugaggaggaucacugguggguugcagga

SEQ ID NO: 165757 - RNA, 64 nt, Homo Sapiens
cugcccacaccccugcgugcuggauguaagaugcucugaggaccccaacuguuacaacuuaguu

SEQ ID NO: 165758 - RNA, 64 nt, Homo Sapiens
gacuccugggcucuugucagcaauaaagcaguucucugaggaaucaagcccaggcucgcaguau

SEQ ID NO: 165759 - RNA, 64 nt, Homo Sapiens
gggaagaaggccugcugggggggcaccugacugcucugaggagaacauccucucagcuacucca

SEQ ID NO: 165760 - RNA, 64 nt, Homo Sapiens
ucuagguaguuuuccuuuuggauccugacuuuuaucugaggaaguuccuguuuuaauuccuaaa

SEQ ID NO: 165761 - RNA, 64 nt, Homo Sapiens
ugcuaacuuccacagcauugauuugugaauuacuucugaggaaauuagauaaggauaaaaauau

SEQ ID NO: 165762 - RNA, 64 nt, Homo Sapiens
ggcacugagccacugcgcccagccaacaauccgcucugaggaaagcguaagcaggaagaccucu

SEQ ID NO: 165763 - RNA, 64 nt, Homo Sapiens
uccuaguuguguuuggaaagggagagaagagaugucugaggaaggucauguucuuucagcuuau

SEQ ID NO: 165764 - RNA, 64 nt, Homo Sapiens
aaaucacugacaaauaguggauauagguuucauuucugaggaucaauaaacagcuuguaauguu

SEQ ID NO: 165765 - RNA, 64 nt, Homo Sapiens
uauugcugaagccaaccagagaucuugaucucucucugaggaaaaaaccuagaaaugaugguua

SEQ ID NO: 165766 - RNA, 64 nt, Homo Sapiens
uggauacugguacuacgggguagcauggaaucccucugaggaccgguaugcuuuggggcugggg

SEQ ID NO: 165767 - RNA, 64 nt, Homo Sapiens
ccgucgggguccagaucagggugccagacucugaucugaggaccggccggccagggcuggggca

SEQ ID NO: 165768 - RNA, 64 nt, Homo Sapiens
accugggcuuuucucuuuccguccaaaccauaaaucugaggauaaaauugcuauucuuccuguu

SEQ ID NO: 165769 - RNA, 64 nt, Homo Sapiens
aucuauauguuuaauacaccgacuauauucuucaucugaggagcuuguguauaaaaccagauua

SEQ ID NO: 165770 - RNA, 64 nt, Homo Sapiens
gaugaucccagcugugcucuggacaggcauguucucugaggacacuaaccacgcuggaccuuga

SEQ ID NO: 165771 - RNA, 64 nt, Homo Sapiens
cuccccagcaagugagagcugggugucaagagggucugaggaauccagacccggcugcgugguu

SEQ ID NO: 165772 - RNA, 64 nt, Homo Sapiens
cuguaaauuuaguuucuacuugggcagccaaaacucugaggaaggagauucugcuaguaaaaag

SEQ ID NO: 165773 - RNA, 64 nt, Homo Sapiens
aaucucucauuacuccuggucuugggaguugccuucugaggauacuccacuggggguaccugag

SEQ ID NO: 165774 - RNA, 64 nt, Homo Sapiens
cuauaauggcccugucgucagugcuaagaucuaaucugaggacaucaagcagguuaaagccauu

SEQ ID NO: 165775 - RNA, 64 nt, Homo Sapiens
ccagaguccucuguucauccacuuuuccauuacaucugaggauugaguacaauauggcucauug

SEQ ID NO: 165776 - RNA, 64 nt, Homo Sapiens
ucaguucugaagugaucuagguucaccuguuucaucugaggauuauguagcaggucacagaagu

SEQ ID NO: 165777 - RNA, 64 nt, Homo Sapiens
cuugagacaggguuauggauaguauuuuccugguucugaggagguuagucucuucaggaucuuu

SEQ ID NO: 165778 - RNA, 64 nt, Homo Sapiens
cugcacucuggagguggguggugcaggcgguggagggacacaggccagcucaagcccgcuggug

SEQ ID NO: 165779 - RNA, 64 nt, Homo Sapiens
acagggcggcgggcugcggucagcacgugugcucgggacacagcggagucagggccagagcccu

SEQ ID NO: 165780 - RNA, 64 nt, Homo Sapiens
aggauguauaaguacagauuuggggguggagggugggacacauggaagugugagugacacuugc

SEQ ID NO: 165781 - RNA, 64 nt, Homo Sapiens
gggagacuauggaccaaggugaguccaggagcuagggacacagacagagguacaggagcuggga

SEQ ID NO: 165782 - RNA, 64 nt, Homo Sapiens
gaacaggugggugcagcaggugucauccugugaagggacacagaaggcggugcucagcacgggg

SEQ ID NO: 165783 - RNA, 64 nt, Homo Sapiens
ggcagcugaagaacaucuggccacauccuaccuagggacacacacauguaugucuccccacuaa

SEQ ID NO: 165784 - RNA, 64 nt, Homo Sapiens
caaaccauaucagcauccuuuugagauuuguggggggacacaacucugggagauacaauucaag

SEQ ID NO: 165785 - RNA, 64 nt, Homo Sapiens
acaccaagucccuaggcugcuggcuggaguggcugggacacaagauguuggccccuuucagcca

SEQ ID NO: 165786 - RNA, 64 nt, Homo Sapiens
caguaugucucuuucaacucuaguuuuugagguggggacacaggagguccagugggacacagcc

SEQ ID NO: 165787 - RNA, 64 nt, Homo Sapiens
cuaguuuuugagguggggacacaggagguccagugggacacagccacuccccaaagaguaagga

SEQ ID NO: 165788 - RNA, 64 nt, Homo Sapiens
aaauauaaauguuuaaccaauaugccuuuuaucagggacacauuauuaucugucccaaacagua

SEQ ID NO: 165789 - RNA, 64 nt, Homo Sapiens
gucccuccagcuuaucucccccugaagcagggaugggacacaaaaaggugggaugggggaucug

SEQ ID NO: 165790 - RNA, 64 nt, Homo Sapiens
ggacagcuuccccaucgccuuugccuucuggggagggacacagacacagagagcggcuucccca

SEQ ID NO: 165791 - RNA, 64 nt, Homo Sapiens
ggacggcuuccccaucgccuuugccuucuggggagggacacagacacagaggauggcuucccca

SEQ ID NO: 165792 - RNA, 64 nt, Homo Sapiens
gagagaagccucccgacccugugcccuggcucccgggacacauagaaaccuguaggaacccagc

SEQ ID NO: 165793 - RNA, 64 nt, Homo Sapiens
caggaucggcccgagacccaggccaugcccacuggggacacacugugccgugcuccuucugccg

SEQ ID NO: 165794 - RNA, 64 nt, Homo Sapiens
cggccuaggugucccaggugccccgccuuucucugggacacaguugggggcuggcuucugaggg

SEQ ID NO: 165795 - RNA, 64 nt, Homo Sapiens
agcugcuggggacuccgccuacuccagcccucuugggacacacugugggauuuguggcccuucc

SEQ ID NO: 165796 - RNA, 64 nt, Homo Sapiens
agagucaucaccacucccuaaucucaaguacccagggacacaaacacugcggaaggcggcaggg

SEQ ID NO: 165797 - RNA, 64 nt, Homo Sapiens
gcauucauuaaagcugauugugugagagugaacugggacacaagcuagucuagcucacugcagc

SEQ ID NO: 165798 - RNA, 64 nt, Homo Sapiens
uaauucaucauuaagaagcauuccugcuucucaagggacacaguggccugcaugggccagcaug

SEQ ID NO: 165799 - RNA, 64 nt, Homo Sapiens
cccugggcugaucaugugcauuccugcuucucuggggacacagugggcccacaugggccagcau

SEQ ID NO: 165800 - RNA, 64 nt, Homo Sapiens; identical to SEQ ID NO: 159954

SEQ ID NO: 165801 - RNA, 64 nt, Homo Sapiens; identical to SEQ ID NO: 159955

SEQ ID NO: 165802 - RNA, 64 nt, Homo Sapiens; identical to SEQ ID NO: 159956

SEQ ID NO: 165803 - RNA, 64 nt, Homo Sapiens; identical to SEQ ID NO: 159957

SEQ ID NO: 165804 - RNA, 64 nt, Homo Sapiens; identical to SEQ ID NO: 159958

SEQ ID NO: 165805 - RNA, 64 nt, Homo Sapiens; identical to SEQ ID NO: 159959

SEQ ID NO: 165806 - RNA, 62 nt, Homo Sapiens
cuggaaauaauccaauuauuccugcuuggauucuuccacagggccuguguaagaauggguuc

SEQ ID NO: 165807 - RNA, 62 nt, Homo Sapiens
uuagacagccacaguccugucuggguuagggucuuccacauuugaggauccuuccuaucucu

SEQ ID NO: 165808 - RNA, 62 nt, Homo Sapiens
uguuguugguuccuuuuagaccacggcugccccuuccacaccccaucuugcucuaaugauca

SEQ ID NO: 165809 - RNA, 62 nt, Homo Sapiens
ucuguggcugucuuguuucugaaguacuuaaacuuccacaagagugaauuugaccuaggcaa

SEQ ID NO: 165810 - RNA, 62 nt, Homo Sapiens
cagauuaguauucggacauggauaauacauuucuuccacauuuuccagugugguuuuuaaca

SEQ ID NO: 165811 - RNA, 62 nt, Homo Sapiens
guacagaaugagcagucauguaaauaaccaggcuuccacauuuuaggaaacgaaauauuucc

SEQ ID NO: 165812 - RNA, 62 nt, Homo Sapiens
augcccacaggccaggcccagucacagcugggcuuccacaggucagaauaugggacaggaca

SEQ ID NO: 165813 - RNA, 62 nt, Homo Sapiens
gggugggagucuggagccagacagccaagccccuuccacaucuacagggucacugucauccu

SEQ ID NO: 165814 - RNA, 62 nt, Homo Sapiens
gggcaccauuucaguguaaaagcaguccuacucuuccacacuaggaaggcuuuacuuuuuuu

SEQ ID NO: 165815 - RNA, 62 nt, Homo Sapiens
cgaugaugguuacccuucauggacgucuuaaucuuccacacacauccccuuuuuuuggaaua

SEQ ID NO: 165816 - RNA, 62 nt, Homo Sapiens
aguugggugaccagcugucccucaauuccccucuuccacaagccagauauucaguacucgau

SEQ ID NO: 165817 - RNA, 62 nt, Homo Sapiens
aucgaugcguugcuuugguaaucucuaauugacuuccacaaaugucuccgauagcuccccac

SEQ ID NO: 165818 - RNA, 62 nt, Homo Sapiens
gggaucucugguaccgucacucuugcuugugccuuccacaccuucucggugcagaucccuau

SEQ ID NO: 165819 - RNA, 62 nt, Homo Sapiens
ccuggcaugcaugcuggcggcggcaugccucccuuccacaagcccaugcugcugcagaggga

SEQ ID NO: 165820 - RNA, 62 nt, Homo Sapiens
cuggagcugcccuacccccagcacaaccugggcuuccacaguguaaccccucucucaccccg

SEQ ID NO: 165821 - RNA, 62 nt, Homo Sapiens
gucuuccccagcgucccccgacccacgacucacuuccacacccuuuucuccccaacccccaa

SEQ ID NO: 165822 - RNA, 64 nt, Homo Sapiens
auucuauuaguccccacccaaacuuuauugauucaccuccuaaaacaacagauguacgacuugc

SEQ ID NO: 165823 - RNA, 64 nt, Homo Sapiens
uuaagacuuaaugagacuuuaaaagcauuuuuuaaccuccuaaguaucaaguauagaaaaucuu

SEQ ID NO: 165824 - RNA, 64 nt, Homo Sapiens; identical to SEQ ID NO: 111876

SEQ ID NO: 165825 - RNA, 64 nt, Homo Sapiens; identical to SEQ ID NO: 111877

SEQ ID NO: 165826 - RNA, 64 nt, Homo Sapiens; identical to SEQ ID NO: 111878

SEQ ID NO: 165827 - RNA, 64 nt, Homo Sapiens; identical to SEQ ID NO: 111879

SEQ ID NO: 165828 - RNA, 64 nt, Homo Sapiens; identical to SEQ ID NO: 111880

SEQ ID NO: 165829 - RNA, 64 nt, Homo Sapiens; identical to SEQ ID NO: 111881

SEQ ID NO: 165830 - RNA, 64 nt, Homo Sapiens; identical to SEQ ID NO: 147168

SEQ ID NO: 165831 - RNA, 64 nt, Homo Sapiens; identical to SEQ ID NO: 147169

SEQ ID NO: 165832 - RNA, 64 nt, Homo Sapiens; identical to SEQ ID NO: 147170

SEQ ID NO: 165833 - RNA, 64 nt, Homo Sapiens; identical to SEQ ID NO: 147171

SEQ ID NO: 165834 - RNA, 64 nt, Homo Sapiens; identical to SEQ ID NO: 147172

SEQ ID NO: 165835 - RNA, 64 nt, Homo Sapiens; identical to SEQ ID NO: 147173

SEQ ID NO: 165836 - RNA, 64 nt, Homo Sapiens; identical to SEQ ID NO: 147174

SEQ ID NO: 165837 - RNA, 64 nt, Homo Sapiens; identical to SEQ ID NO: 147175

SEQ ID NO: 165838 - RNA, 64 nt, Homo Sapiens; identical to SEQ ID NO: 147176

SEQ ID NO: 165839 - RNA, 64 nt, Homo Sapiens; identical to SEQ ID NO: 147177

SEQ ID NO: 165840 - RNA, 64 nt, Homo Sapiens; identical to SEQ ID NO: 147178

SEQ ID NO: 165841 - RNA, 64 nt, Homo Sapiens; identical to SEQ ID NO: 147179

SEQ ID NO: 165842 - RNA, 64 nt, Homo Sapiens
uguauuguacuaaccccucaugcugggaugagcgacugccuagcaagcaacccacugccuacua

SEQ ID NO: 165843 - RNA, 64 nt, Homo Sapiens
augcugggaugagcgacugccuagcaagcaacccacugccuacuaacaucaagaggggcuaaau

SEQ ID NO: 165844 - RNA, 64 nt, Homo Sapiens
uuggaagccucaaaaacaguccagacauuuguuucaucaggacaccaaacucuaaaaaagaagc

SEQ ID NO: 165845 - RNA, 64 nt, Homo Sapiens
ccuuauuugguaucuuacacauuaauguuacuagcaucaggagcuuacuguuuuauuaugauuc

SEQ ID NO: 165846 - RNA, 64 nt, Homo Sapiens
ugggaagcaagaaaacgguacaaauaggcucugccaucaggaaaugucugcagcaggacaugga

SEQ ID NO: 165847 - RNA, 64 nt, Homo Sapiens
uuggacacaccauuccggaacagggugucaguaacaucaggacauccucauccuggcacuccuc

SEQ ID NO: 165848 - RNA, 64 nt, Homo Sapiens
cacaugaagaaguagacugaaauaucagauuugucaucaggaauacucuuugucuacugugguc

SEQ ID NO: 165849 - RNA, 64 nt, Homo Sapiens
guuuucaaaaccauuauuccugugacuggagaggcaucaggagaggucucguucgucuccagcu

SEQ ID NO: 165850 - RNA, 64 nt, Homo Sapiens
guguccaagaacucuaaccaguguacaggucacccaucaggaccacucaguuaaggaagauccu

SEQ ID NO: 165851 - RNA, 64 nt, Homo Sapiens
guucagaaggaauaagcauuccuucuuucacaggcaucaggaauugucaaaugaugauuaugag

SEQ ID NO: 165852 - RNA, 64 nt, Homo Sapiens
ucugccagucgguucccacggagccauuuuuagcucugaucagcaugggaaugugccucggccu

SEQ ID NO: 165853 - RNA, 64 nt, Homo Sapiens
ucccccacucuauacuagggacuggaucucagccucugaucaguuucacaaaguuuguucccua

SEQ ID NO: 165854 - RNA, 64 nt, Homo Sapiens
aggcugcccaagggugcuguacggaggcuguggaucugaucaccacgugccucaucccagaaac

SEQ ID NO: 165855 - RNA, 64 nt, Homo Sapiens
cuuucagccccagggcccggcugagauggagcucucugaucaccuagccagugggaaagggaac

SEQ ID NO: 165856 - RNA, 64 nt, Homo Sapiens
gcaaccucugugcuuuuauauuaaccaguuugguucugaucauugaaaggaugcauuucggcuu

SEQ ID NO: 165857 - RNA, 64 nt, Homo Sapiens
uuuaugcuaccugucaccaaacagcugaaaccagucugaucaaucaauuugugaagcuuaugau

SEQ ID NO: 165858 - RNA, 64 nt, Homo Sapiens
ggaagaccuuuuaaagcauuguuuuagaaugucugaguauuaagauacagauuaauugggaaua

SEQ ID NO: 165859 - RNA, 64 nt, Homo Sapiens
ugaguauuaagauacagauuaauugggaauaucugaguauuaaguacuuucuucagaguauaag

SEQ ID NO: 165860 - RNA, 64 nt, Homo Sapiens
uuuauguacaaaguuauuuacaaugugaaagagggaguauuacuaauuugcugcuucugagagg

SEQ ID NO: 165861 - RNA, 64 nt, Homo Sapiens
uuggccuugggggacagaaauuugccaauauaaugaguauuacauucuauacugauguuuucgu

SEQ ID NO: 165862 - RNA, 64 nt, Homo Sapiens
aacgcugcuguaccucgaucuauuaacgcuccaagaguauuauugugccugccccuccccagag

SEQ ID NO: 165863 - RNA, 64 nt, Homo Sapiens
gcuccaagaguauuauuaacccugccccuccccagaguauuaacgcccuagggccccccaagug

SEQ ID NO: 165864 - RNA, 64 nt, Homo Sapiens
agccaggacgaucacacagagaugaauggcaucugaguauuacggcauccagagccacugcuga

SEQ ID NO: 165865 - RNA, 64 nt, Homo Sapiens
ucuccuccaagacuguguugucuuuucucaccaagaguauuaacacuacuaagucuuucaccuu

SEQ ID NO: 165866 - RNA, 64 nt, Homo Sapiens; identical to SEQ ID NO: 134055

SEQ ID NO: 165867 - RNA, 64 nt, Homo Sapiens; identical to SEQ ID NO: 134056

SEQ ID NO: 165868 - RNA, 64 nt, Homo Sapiens; identical to SEQ ID NO: 134057

SEQ ID NO: 165869 - RNA, 64 nt, Homo Sapiens; identical to SEQ ID NO: 134058

SEQ ID NO: 165870 - RNA, 64 nt, Homo Sapiens; identical to SEQ ID NO: 134059

SEQ ID NO: 165871 - RNA, 64 nt, Homo Sapiens; identical to SEQ ID NO: 134060

SEQ ID NO: 165872 - RNA, 64 nt, Homo Sapiens; identical to SEQ ID NO: 134061

SEQ ID NO: 165873 - RNA, 64 nt, Homo Sapiens; identical to SEQ ID NO: 134062

SEQ ID NO: 165874 - RNA, 64 nt, Homo Sapiens; identical to SEQ ID NO: 134063

SEQ ID NO: 165875 - RNA, 64 nt, Homo Sapiens; identical to SEQ ID NO: 134064

SEQ ID NO: 165876 - RNA, 64 nt, Homo Sapiens; identical to SEQ ID NO: 134065

SEQ ID NO: 165877 - RNA, 64 nt, Homo Sapiens; identical to SEQ ID NO: 134066

SEQ ID NO: 165878 - RNA, 64 nt, Homo Sapiens; identical to SEQ ID NO: 134067

SEQ ID NO: 165879 - RNA, 64 nt, Homo Sapiens; identical to SEQ ID NO: 134068

SEQ ID NO: 165880 - RNA, 64 nt, Homo Sapiens; identical to SEQ ID NO: 134069

SEQ ID NO: 165881 - RNA, 64 nt, Homo Sapiens; identical to SEQ ID NO: 134070

SEQ ID NO: 165882 - RNA, 64 nt, Homo Sapiens; identical to SEQ ID NO: 134071

SEQ ID NO: 165883 - RNA, 64 nt, Homo Sapiens; identical to SEQ ID NO: 134072

SEQ ID NO: 165884 - RNA, 64 nt, Homo Sapiens; identical to SEQ ID NO: 134073

SEQ ID NO: 165885 - RNA, 64 nt, Homo Sapiens; identical to SEQ ID NO: 134074

SEQ ID NO: 165886 - RNA, 64 nt, Homo Sapiens; identical to SEQ ID NO: 134075

SEQ ID NO: 165887 - RNA, 64 nt, Homo Sapiens; identical to SEQ ID NO: 134076

SEQ ID NO: 165888 - RNA, 64 nt, Homo Sapiens; identical to SEQ ID NO: 134077

SEQ ID NO: 165889 - RNA, 64 nt, Homo Sapiens; identical to SEQ ID NO: 134078

SEQ ID NO: 165890 - RNA, 64 nt, Homo Sapiens; identical to SEQ ID NO: 134079

SEQ ID NO: 165891 - RNA, 64 nt, Homo Sapiens; identical to SEQ ID NO: 134080

SEQ ID NO: 165892 - RNA, 64 nt, Homo Sapiens; identical to SEQ ID NO: 134081

SEQ ID NO: 165893 - RNA, 64 nt, Homo Sapiens; identical to SEQ ID NO: 134082

SEQ ID NO: 165894 - RNA, 64 nt, Homo Sapiens; identical to SEQ ID NO: 134083

SEQ ID NO: 165895 - RNA, 64 nt, Homo Sapiens; identical to SEQ ID NO: 134084

SEQ ID NO: 165896 - RNA, 64 nt, Homo Sapiens; identical to SEQ ID NO: 134085

SEQ ID NO: 165897 - RNA, 64 nt, Homo Sapiens; identical to SEQ ID NO: 134086

SEQ ID NO: 165898 - RNA, 64 nt, Homo Sapiens; identical to SEQ ID NO: 134087

SEQ ID NO: 165899 - RNA, 64 nt, Homo Sapiens; identical to SEQ ID NO: 134088

SEQ ID NO: 165900 - RNA, 64 nt, Homo Sapiens; identical to SEQ ID NO: 134089

SEQ ID NO: 165901 - RNA, 64 nt, Homo Sapiens; identical to SEQ ID NO: 134090

SEQ ID NO: 165902 - RNA, 64 nt, Homo Sapiens; identical to SEQ ID NO: 134091

SEQ ID NO: 165903 - RNA, 64 nt, Homo Sapiens; identical to SEQ ID NO: 134092

SEQ ID NO: 165904 - RNA, 64 nt, Homo Sapiens; identical to SEQ ID NO: 134093

SEQ ID NO: 165905 - RNA, 64 nt, Homo Sapiens; identical to SEQ ID NO: 134094

SEQ ID NO: 165906 - RNA, 64 nt, Homo Sapiens; identical to SEQ ID NO: 134095

SEQ ID NO: 165907 - RNA, 64 nt, Homo Sapiens; identical to SEQ ID NO: 134096

SEQ ID NO: 165908 - RNA, 64 nt, Homo Sapiens; identical to SEQ ID NO: 134097

SEQ ID NO: 165909 - RNA, 64 nt, Homo Sapiens; identical to SEQ ID NO: 134098

SEQ ID NO: 165910 - RNA, 64 nt, Homo Sapiens; identical to SEQ ID NO: 134099

SEQ ID NO: 165911 - RNA, 64 nt, Homo Sapiens; identical to SEQ ID NO: 134100

SEQ ID NO: 165912 - RNA, 64 nt, Homo Sapiens; identical to SEQ ID NO: 134101

SEQ ID NO: 165913 - RNA, 64 nt, Homo Sapiens; identical to SEQ ID NO: 134102

SEQ ID NO: 165914 - RNA, 64 nt, Homo Sapiens; identical to SEQ ID NO: 134103

SEQ ID NO: 165915 - RNA, 64 nt, Homo Sapiens; identical to SEQ ID NO: 134104

SEQ ID NO: 165916 - RNA, 64 nt, Homo Sapiens; identical to SEQ ID NO: 134105

SEQ ID NO: 165917 - RNA, 64 nt, Homo Sapiens; identical to SEQ ID NO: 134106

SEQ ID NO: 165918 - RNA, 64 nt, Homo Sapiens; identical to SEQ ID NO: 134107

SEQ ID NO: 165919 - RNA, 64 nt, Homo Sapiens; identical to SEQ ID NO: 134108

SEQ ID NO: 165920 - RNA, 64 nt, Homo Sapiens; identical to SEQ ID NO: 134109

SEQ ID NO: 165921 - RNA, 64 nt, Homo Sapiens; identical to SEQ ID NO: 134110

SEQ ID NO: 165922 - RNA, 64 nt, Homo Sapiens; identical to SEQ ID NO: 134111

SEQ ID NO: 165923 - RNA, 64 nt, Homo Sapiens; identical to SEQ ID NO: 134112

SEQ ID NO: 165924 - RNA, 64 nt, Homo Sapiens; identical to SEQ ID NO: 134113

SEQ ID NO: 165925 - RNA, 64 nt, Homo Sapiens; identical to SEQ ID NO: 134114

SEQ ID NO: 165926 - RNA, 64 nt, Homo Sapiens; identical to SEQ ID NO: 134115

SEQ ID NO: 165927 - RNA, 64 nt, Homo Sapiens; identical to SEQ ID NO: 134116

SEQ ID NO: 165928 - RNA, 64 nt, Homo Sapiens; identical to SEQ ID NO: 134117

SEQ ID NO: 165929 - RNA, 64 nt, Homo Sapiens; identical to SEQ ID NO: 134118

SEQ ID NO: 165930 - RNA, 64 nt, Homo Sapiens; identical to SEQ ID NO: 134119

SEQ ID NO: 165931 - RNA, 64 nt, Homo Sapiens; identical to SEQ ID NO: 134120

SEQ ID NO: 165932 - RNA, 64 nt, Homo Sapiens; identical to SEQ ID NO: 134121

SEQ ID NO: 165933 - RNA, 64 nt, Homo Sapiens; identical to SEQ ID NO: 134122

SEQ ID NO: 165934 - RNA, 64 nt, Homo Sapiens; identical to SEQ ID NO: 134123

SEQ ID NO: 165935 - RNA, 64 nt, Homo Sapiens; identical to SEQ ID NO: 134124

SEQ ID NO: 165936 - RNA, 64 nt, Homo Sapiens; identical to SEQ ID NO: 134125

SEQ ID NO: 165937 - RNA, 64 nt, Homo Sapiens
auuugaacuuagggcaaaucagagucuacacagacgccuacagaaaguuucaggaagaggcaag

SEQ ID NO: 165938 - RNA, 64 nt, Homo Sapiens
aucauuaucucagaaugcuuauuuccaauuaaaacgccuacagcugccuccuagaauauagacu

SEQ ID NO: 165939 - RNA, 64 nt, Homo Sapiens
cccucaggugcccccacacacagccuucccuugacgccuacauuucuaggcacaugugaggcau

SEQ ID NO: 165940 - RNA, 64 nt, Homo Sapiens
cuuccccagaagccugggcuuaggguggagaugccgccuacacacgauccuggcccuccaccug

SEQ ID NO: 165941 - RNA, 64 nt, Homo Sapiens
gcuuugaagguuuccucuccuccccgaccaaucacgccuacagucccucucccugccccagcuu

SEQ ID NO: 165942 - RNA, 64 nt, Homo Sapiens
ugcucccugcacggugcguccuggaguccggagccgccuacaacucccucuccugcgcuuccuc

SEQ ID NO: 165943 - RNA, 64 nt, Homo Sapiens
cccaacgacgagugcuucuucugcgugcgcaccgcgccuacacgugcgggaggugaggcgggcu

SEQ ID NO: 165944 - RNA, 64 nt, Homo Sapiens
agguaccuugcugucuugacaaauccuaaugucacgccuacagccccaacacaagcuccagucu

SEQ ID NO: 165945 - RNA, 64 nt, Homo Sapiens
aagcauugggccauaguuuguuaaucucaacuaacgccuacauuacauucuccuugaucguucu

SEQ ID NO: 165946 - RNA, 64 nt, Homo Sapiens
cgccucacccaguacaucgagacgcagcgugcaucgccuacaucacguccacgugauuggggag

SEQ ID NO: 165947 - RNA, 64 nt, Homo Sapiens
cccucucagccacugucuuccuggcuccuccuggcgccuacaccccuagagccugcuacuccau

SEQ ID NO: 165948 - RNA, 64 nt, Homo Sapiens
gagccuucggcaccuccccuccccaacgccucugcgccuacaccaaagggccccagguggccac

SEQ ID NO: 165949 - RNA, 64 nt, Homo Sapiens
ccuacguguccagggcuugggccuugccccugcccgccuacacuacaacuccaccccuuccuug

SEQ ID NO: 165950 - RNA, 64 nt, Homo Sapiens
ucccuggaggcccacacuucccaggagccaggagcgccuacaccaggccugggccaggagucug

SEQ ID NO: 165951 - RNA, 64 nt, Homo Sapiens
agccaggcaaucgggggccaaagaugggggugcucgccuacagucugcaucuguagugccuugu

SEQ ID NO: 165952 - RNA, 64 nt, Homo Sapiens
guaggggcaguagcccccaguauggggagcccaccgccuacacaggcagcagggcagaggagac

SEQ ID NO: 165953 - RNA, 64 nt, Homo Sapiens
uaauuccugguaagagcagucauucauuuuccaacgccuacauuuaugaucuggauauauuuug

SEQ ID NO: 165954 - RNA, 64 nt, Homo Sapiens
agugaauuaaucugaaaggcacaauguugcucuccgccuacacugcucuuccccagcugcaaag

SEQ ID NO: 165955 - RNA, 64 nt, Homo Sapiens
ccuccaugugguagcuccuuuuucuuguuugaaacgccuacaaaucgugucuuaaccuaagugc

SEQ ID NO: 165956 - RNA, 64 nt, Homo Sapiens
agggcagcucuggugccccuguauauguggaucucgccuacaucccgaaucauugcaguggcaa

SEQ ID NO: 165957 - RNA, 64 nt, Homo Sapiens
agacucuacagaggccaugggccuccugugugugcgccuacaggagugagcacuaaggugugcu

SEQ ID NO: 165958 - RNA, 64 nt, Homo Sapiens
uagaacccucaacccagggucccuuccucugcagcgccuacaugguugguugaauaaguggcug

SEQ ID NO: 165959 - RNA, 64 nt, Homo Sapiens
agggcaggccuucuauaagugcgggcaccaagggcgccuacauccccaggccuugcuggggugc

SEQ ID NO: 165960 - RNA, 64 nt, Homo Sapiens
ucauuguagguaagauaauucauacuggagaaaacgccuacaugugugaacaauauggcaaaac

SEQ ID NO: 165961 - RNA, 64 nt, Homo Sapiens
cgucuucuccacggcaucgcgugcuccgcggccccgccuacacguggaaccgcgcagccugcug

SEQ ID NO: 165962 - RNA, 64 nt, Homo Sapiens
cggaccugcaguccaaccucgccuggcccgcggccgccuacaccgaaccggaaccugagugaca

SEQ ID NO: 165963 - RNA, 64 nt, Homo Sapiens
ggaggagguguugagugagcaacacgcagaagcucgccuacaguuucguuuccauucacgacgc

SEQ ID NO: 165964 - RNA, 64 nt, Homo Sapiens
gucaagggaaauguaaucagauuuggccagaguucgccuacagauaagaaggcacugggccagg

SEQ ID NO: 165965 - RNA, 64 nt, Homo Sapiens; identical to SEQ ID NO: 84790

SEQ ID NO: 165966 - RNA, 64 nt, Homo Sapiens; identical to SEQ ID NO: 84791

SEQ ID NO: 165967 - RNA, 64 nt, Homo Sapiens; identical to SEQ ID NO: 84792

SEQ ID NO: 165968 - RNA, 64 nt, Homo Sapiens; identical to SEQ ID NO: 84793

SEQ ID NO: 165969 - RNA, 64 nt, Homo Sapiens; identical to SEQ ID NO: 84794

SEQ ID NO: 165970 - RNA, 64 nt, Homo Sapiens; identical to SEQ ID NO: 84795

SEQ ID NO: 165971 - RNA, 64 nt, Homo Sapiens; identical to SEQ ID NO: 84796

SEQ ID NO: 165972 - RNA, 64 nt, Homo Sapiens; identical to SEQ ID NO: 84797

SEQ ID NO: 165973 - RNA, 64 nt, Homo Sapiens; identical to SEQ ID NO: 84798

SEQ ID NO: 165974 - RNA, 64 nt, Homo Sapiens; identical to SEQ ID NO: 84799

SEQ ID NO: 165975 - RNA, 64 nt, Homo Sapiens; identical to SEQ ID NO: 84800

SEQ ID NO: 165976 - RNA, 64 nt, Homo Sapiens; identical to SEQ ID NO: 84801

SEQ ID NO: 165977 - RNA, 64 nt, Homo Sapiens; identical to SEQ ID NO: 84802

SEQ ID NO: 165978 - RNA, 64 nt, Homo Sapiens; identical to SEQ ID NO: 84803

SEQ ID NO: 165979 - RNA, 64 nt, Homo Sapiens; identical to SEQ ID NO: 84804

SEQ ID NO: 165980 - RNA, 64 nt, Homo Sapiens; identical to SEQ ID NO: 127496

SEQ ID NO: 165981 - RNA, 64 nt, Homo Sapiens; identical to SEQ ID NO: 127497

SEQ ID NO: 165982 - RNA, 64 nt, Homo Sapiens; identical to SEQ ID NO: 127498

SEQ ID NO: 165983 - RNA, 64 nt, Homo Sapiens; identical to SEQ ID NO: 127499

SEQ ID NO: 165984 - RNA, 64 nt, Homo Sapiens; identical to SEQ ID NO: 127500

SEQ ID NO: 165985 - RNA, 64 nt, Homo Sapiens; identical to SEQ ID NO: 127501

SEQ ID NO: 165986 - RNA, 64 nt, Homo Sapiens; identical to SEQ ID NO: 127502

SEQ ID NO: 165987 - RNA, 64 nt, Homo Sapiens; identical to SEQ ID NO: 127503

SEQ ID NO: 165988 - RNA, 64 nt, Homo Sapiens
gauuuuaaucauacaguuugacugggcaaacuuuacagcugauagugaauauuuugcuuuauac

SEQ ID NO: 165989 - RNA, 64 nt, Homo Sapiens
ccuaguagaucucaauguuuuauaauuccuuaaaacagcugaaaauugggacaacauacuuuac

SEQ ID NO: 165990 - RNA, 64 nt, Homo Sapiens
uaguuagguuuuccugucccugcaaccacagcugacagcugaguccauccacugccggccugcc

SEQ ID NO: 165991 - RNA, 64 nt, Homo Sapiens
gcugaguuaguuagguuuucgccugccugcaaccacagcugacagaaggaaccauccacugccg

SEQ ID NO: 165992 - RNA, 64 nt, Homo Sapiens
ugaucaaagucauaguagguaaaugcuuuaugggacagcugacaccuuuuagacccuaccaggu

SEQ ID NO: 165993 - RNA, 64 nt, Homo Sapiens
aaaagaucaggcugaaacugcagucagauuuaugacagcugacaguuuuucagaggucgcacac

SEQ ID NO: 165994 - RNA, 64 nt, Homo Sapiens
uaaugguaaccagucagagguugccagcaaugaaacagcugacagagagagaagguaaguggcu

SEQ ID NO: 165995 - RNA, 64 nt, Homo Sapiens
ugcuguggguauaauguaaaaaugaccuugaaagacagcugaguuagucuguugaagauugaac

SEQ ID NO: 165996 - RNA, 64 nt, Homo Sapiens
aggugaccucaggcccugggcggcuguagacaucacagcugaagggaucucugggagcagaggg

SEQ ID NO: 165997 - RNA, 64 nt, Homo Sapiens
ccgacaaccauuggggugggcacagaccucagacacagcugaguguucugagaggcugggaguu

SEQ ID NO: 165998 - RNA, 64 nt, Homo Sapiens
aauugagcaucccuaagaguagcugcuuggugggacagcugauuucuuugauucccuagcugca

SEQ ID NO: 165999 - RNA, 64 nt, Homo Sapiens
uaaauaaucacagaaaagaaugaucugaacaagaacagcugaggcuaaaacccaagacugccgu

SEQ ID NO: 166000 - RNA, 64 nt, Homo Sapiens
uggcuaaagaccuuaaccaauagcaaauugcacuacagcugaacuuuucaucaucucauucaca

SEQ ID NO: 166001 - RNA, 64 nt, Homo Sapiens
uaaccucaggacuugguuugcauauaaaagguagacagcugauauguuuucaugaauaaauauu

SEQ ID NO: 166002 - RNA, 64 nt, Homo Sapiens
uugcauuuccuguguuuguccuggguucuggggcaucagccagcuaccccuugugggcaaaggc

SEQ ID NO: 166003 - RNA, 64 nt, Homo Sapiens
gcaccaaagauguccugacuuugcccccuugcccaucagccauuugccaucaccccaaacaacu

SEQ ID NO: 166004 - RNA, 64 nt, Homo Sapiens
uugauugugcggguuagauaguuagauagaggucaucagccaggcagccugguagauugugugg

SEQ ID NO: 166005 - RNA, 64 nt, Homo Sapiens
uugauuguguggguuagauaguuagacagaggucaucagccaggcagccggguugauugugugg

SEQ ID NO: 166006 - RNA, 64 nt, Homo Sapiens
acugcacagacagcugcgacugguuagcguggacaucagccagcgaaguuucccugugaggccg

SEQ ID NO: 166007 - RNA, 64 nt, Homo Sapiens
guguugggaaaagagguuugcacuuuuagaagccaucagccaguucuuuguaggcgccaucagc

SEQ ID NO: 166008 - RNA, 64 nt, Homo Sapiens
uuuagaagccaucagccaguucuuuguaggcgccaucagccacuugaagaaaagaaugaaugau

SEQ ID NO: 166009 - RNA, 64 nt, Homo Sapiens
ggcagaacagagaaaagcuagacaaaaugauaagaucagccauauuucauuuugaaucugcagu

SEQ ID NO: 166010 - RNA, 64 nt, Homo Sapiens
aacucugugagacaagguccuuaggcacccagauaucagccacuuucacauuucauuucauuuu

SEQ ID NO: 166011 - RNA, 60 nt, Homo Sapiens
ucuacagggacauguacugaguuccuucagaucagccacaccuuuuccaggaguucugaa

SEQ ID NO: 166012 - RNA, 64 nt, Homo Sapiens
gagugcauuucuugcuugcuggguuucaacagacaucagccaaaagaacaaaagagaugucagg

SEQ ID NO: 166013 - RNA, 64 nt, Homo Sapiens
aaacaaacuaacaugacaagaaagcuauagaaaaaauaaacauugaacucaguucuucaagguu

SEQ ID NO: 166014 - RNA, 64 nt, Homo Sapiens
uguuuauaagaaauuguaaacaaauguaaaacuaaauaaacauuguuaugcaacauuaauaaug

SEQ ID NO: 166015 - RNA, 64 nt, Homo Sapiens
gugaucauguuuuuuuccccccuuuaaugaaaacaauaaacaucuauuugagacaauuaaaauc

SEQ ID NO: 166016 - RNA, 64 nt, Homo Sapiens
ucuaauauaccauuguauucacuaacuaacucaaaauaaacacauuuaaucuugacaucucaag

SEQ ID NO: 166017 - RNA, 64 nt, Homo Sapiens
auguuuuauugucuucucuaagcaaaaaguucuuaauaaacauaguauuucucucugcguccua

SEQ ID NO: 166018 - RNA, 64 nt, Homo Sapiens
uuuaaauguaaugucaacucuuuauaaacuuaaaaauaaacaaguaauuaaccacucuaauugu

SEQ ID NO: 166019 - RNA, 64 nt, Homo Sapiens
uugagagcuuuuacugugauucuucaauguaaaaaauaaacaacaaugucaaacuguguuuaua

SEQ ID NO: 166020 - RNA, 64 nt, Homo Sapiens
gauuuguauaaagccuuuuuaagauuacuauuuaaauaaacauuauaccagagauauuuuucug

SEQ ID NO: 166021 - RNA, 64 nt, Homo Sapiens
agacuguaucacacuucgaucugccauaacauaaaauaaacacuuuuuugaaauucaaguguac

SEQ ID NO: 166022 - RNA, 64 nt, Homo Sapiens
cuuagacauuuaucaacuguguacccugcuguauaauaaacaauuuggcauuagcacuaccauu

SEQ ID NO: 166023 - RNA, 64 nt, Homo Sapiens
uauucuugcuugcauccuaggcuuacucuauucaaauaaacauauuuggucauucuuugccaua

SEQ ID NO: 166024 - RNA, 64 nt, Homo Sapiens
cacacacacacacaccccuaauauguguguauaaaauaaacauauaauauauuagaauauacaa

SEQ ID NO: 166025 - RNA, 64 nt, Homo Sapiens
auccuaaggguccgaugugacagcaagcaagugaaauaaacaaugauuugcuuuucagugagaa

SEQ ID NO: 166026 - RNA, 64 nt, Homo Sapiens
uguugccucuuuuucaaguggaauuugaauuuuaaauaaacaacuuuuuuuggcaugauaaaca

SEQ ID NO: 166027 - RNA, 64 nt, Homo Sapiens
gcgaaaggaagcaagcaguucagaagagccaaggaauaaacaugcaaugaacccaaaaggguac

SEQ ID NO: 166028 - RNA, 64 nt, Homo Sapiens
aaaagagaagcagggccaaauggaaagaacacauaauaaacaagaaaaaaacagaggugaagaa

SEQ ID NO: 166029 - RNA, 64 nt, Homo Sapiens
acgcgcgcgcaagcacaguuaagccaccugcaggaauaaacacgcgagaacauccaccgcuucc

SEQ ID NO: 166030 - RNA, 64 nt, Homo Sapiens
ugcauuucuugaugacaguuuguguuccuacaaaaauaaacaaaaugaauaaaaagggaucacc

SEQ ID NO: 166031 - RNA, 64 nt, Homo Sapiens
uaaaauauguagcauguuugcacacaaaaaaugaaauaaacagguacauucauucagggguaga

SEQ ID NO: 166032 - RNA, 64 nt, Homo Sapiens
aaucuccagaaccucugaaauucuucaaugaguuaauaaacagauaagaauaaaacccauaauu

SEQ ID NO: 166033 - RNA, 64 nt, Homo Sapiens
gauaaaauuguucuuguuggcuuuguuguaauuaaauaaacauauccauuuggcauacaucguu

SEQ ID NO: 166034 - RNA, 64 nt, Homo Sapiens
ucuuaaaauauauucuggguaaauaugcacagaaaauaaacauugggauuuauaauuuuaaaac

SEQ ID NO: 166035 - RNA, 64 nt, Homo Sapiens
gugaagacuaauaaguaacuuauagauaacacauaauaaacauuuaaugacugauauuuuuucu

SEQ ID NO: 166036 - RNA, 64 nt, Homo Sapiens
augaauguggagaugcuugccagagaaucugcacaauaaacaugagccaggacugacugugcac

SEQ ID NO: 166037 - RNA, 64 nt, Homo Sapiens
cacuggaaagagugccagucuguuccugacacucaauaaacaguauuuuguauaaucacaguug

SEQ ID NO: 166038 - RNA, 64 nt, Homo Sapiens
uuuuuaguuuguucuucagaaguagcauucauguaauaaacaggccauauuuuaaauucucaua

SEQ ID NO: 166039 - RNA, 64 nt, Homo Sapiens
ucaaagacuuguggaaaauacuguuaauuuaguaaauaaacaagaaaaaacugcaucccacguu

SEQ ID NO: 166040 - RNA, 64 nt, Homo Sapiens
aacaaugccuacuuuccauucacuguuaacauggaauaaacacaauucccaacaucuuagauag

SEQ ID NO: 166041 - RNA, 64 nt, Homo Sapiens
gcuccuuaaacccucgcuuuguuguaaaagcuaaaauaaacagcaugcuauauuguaauuguau

SEQ ID NO: 166042 - RNA, 64 nt, Homo Sapiens
auccugcuuaauccuuccagcaugucucugcacuaauaaacagcuaaauucacauaaucauccu

SEQ ID NO: 166043 - RNA, 64 nt, Homo Sapiens
auuggucagugaggucaaaaggagccuugggauuaauaaacaugcacugagaagcaagaggagg

SEQ ID NO: 166044 - RNA, 64 nt, Homo Sapiens
cacauacguguucucuucuuguuccacaccuugaaauaaacagaccaucuggggaugugucugu

SEQ ID NO: 166045 - RNA, 64 nt, Homo Sapiens
auugcaauauuuuagguggguuuuacacuuuuuuaauaaacauaaccgaugcacagucuuccca

SEQ ID NO: 166046 - RNA, 64 nt, Homo Sapiens
ucuauucauaaauuuuuguuccuuuucacaguacaauaaacagaaauguuucauguaccaagac

SEQ ID NO: 166047 - RNA, 51 nt, Homo Sapiens
aaguccuugaagcuuuacagaaauaaacaaaagaagaaaacuaguauauaa

SEQ ID NO: 166048 - RNA, 64 nt, Homo Sapiens
auuuugcugccaaaaauauacagguuuuuuuuuuaauaaacacaauugaaguguguucauaguc

SEQ ID NO: 166049 - RNA, 64 nt, Homo Sapiens
uuuguaaauacauuguuugcuugcuguguaagcuaauaaacacacuuuacuaguuauugugaga

SEQ ID NO: 166050 - RNA, 64 nt, Homo Sapiens
uguuaacauccuuugaaugcguuggauuucagagaauaaacauuuuguaaaaaucacuugguaa

SEQ ID NO: 166051 - RNA, 64 nt, Homo Sapiens
uugaauauuauuucacauuccuuuuucuuuuuuaaauaaacagguuugcuuuggaaaggcuuaa

SEQ ID NO: 166052 - RNA, 64 nt, Homo Sapiens
ucaacauuacuguuaacugugcguuaaauaagcaaauaaacaguggcucauaaaaauaaaaguc

SEQ ID NO: 166053 - RNA, 64 nt, Homo Sapiens
uuucucuaguguauuaucacugucuguucugcacaauaaacauaacagccucugugauccccau

SEQ ID NO: 166054 - RNA, 64 nt, Homo Sapiens
uuucauauguaaaacaaugggaagguauguuuauaauaaacauucaaaaagaaugauacauucu

SEQ ID NO: 166055 - RNA, 64 nt, Homo Sapiens
gucacaaguacagaagagagagaaaaugccuccaaauaaacaguuuuguguuuaccuacuaaac

SEQ ID NO: 166056 - RNA, 64 nt, Homo Sapiens
uuugaggaauuaguuuaacuuuuuacagauuuaaaauaaacaggaauuuuuauuuucagaacca

SEQ ID NO: 166057 - RNA, 64 nt, Homo Sapiens
uuggaucaccuccaaagaauuuuuccuuugcuugaauaaacauucauuuacacaagagauggcu

SEQ ID NO: 166058 - RNA, 64 nt, Homo Sapiens
uucagcaaguuauuaaaucuaaucaauggaguuaaauaaacaaaacacucauggacauggucuu

SEQ ID NO: 166059 - RNA, 64 nt, Homo Sapiens
aaacccugcaaccuagaauuaaauuccuuaaugaaauaaacaacgacaauggaguauuaucucu

SEQ ID NO: 166060 - RNA, 64 nt, Homo Sapiens
auuuacaucacagcagugcaaugaccugaaguagaauaaacauacacauauucaagaagcucaa

SEQ ID NO: 166061 - RNA, 64 nt, Homo Sapiens
auccauuagauugcaugguaauuaaaauuggcauaauaaacacagauuauugggggaaaaggaa

SEQ ID NO: 166062 - RNA, 64 nt, Homo Sapiens
acagcaaaugauuaaaugucaguuccccuaaaccaauaaacauuuauacuagauuuuuuauuuc

SEQ ID NO: 166063 - RNA, 64 nt, Homo Sapiens
uuauuuuaaguugaauuugaauaaagauuccagaaauaaacauggagcucaguauucaggaagc

SEQ ID NO: 166064 - RNA, 64 nt, Homo Sapiens
uauuucuugucgcuuuuagcuauugucagaauccaauaaacagcuuacgcauucauuuugguaa

SEQ ID NO: 166065 - RNA, 64 nt, Homo Sapiens
aauccagacugcuuacaaguuaauuacuggcuucaauaaacacgcugggaaaaaaagaugucuc

SEQ ID NO: 166066 - RNA, 64 nt, Homo Sapiens
cuuuaguuuuuaaaguaaaaaccaaaggccaaauaauaaacagcugggguuuucaagcauugga

SEQ ID NO: 166067 - RNA, 64 nt, Homo Sapiens
agugagacuucauuguaugaucaauucauuguauaauaaacagguacuagaaguaauuguuuua

SEQ ID NO: 166068 - RNA, 64 nt, Homo Sapiens
auguagagaaaaauauguagaauuaguuugucucaauaaacaaagcccuauguuugugccuuuu

SEQ ID NO: 166069 - RNA, 64 nt, Homo Sapiens
guccagugggauuccuauuuacaggcaagcuccuaauaaacagaaggagaagucaagugugugg

SEQ ID NO: 166070 - RNA, 64 nt, Homo Sapiens
ucucuuaugaaaaaaauaagauguuaucccaucaaauaaacaaugucauggcuaucuugucuuu

SEQ ID NO: 166071 - RNA, 64 nt, Homo Sapiens
uuuaaggauugcauauuguuccuaaugaggauguaauaaacaggcauuaguaccccuuucuuuu

SEQ ID NO: 166072 - RNA, 64 nt, Homo Sapiens
auucucacugcaaaauggugaaugagccauucucaauaaacauuuuuauauauauuuuguuugu

SEQ ID NO: 166073 - RNA, 64 nt, Homo Sapiens
ugcccuagccccagagggauagcagugcucugggaauaaacagcugguaggccucguggcuggc

SEQ ID NO: 166074 - RNA, 64 nt, Homo Sapiens
agugguucucaacuagggccuugaugaugcacaaaauaaacagccuguaguagaaacuuuaguu

SEQ ID NO: 166075 - RNA, 64 nt, Homo Sapiens
gaggcuuacuguaguagaaagccuccuuuguaaaaauaaacaccuuugguucuacuugcuauau

SEQ ID NO: 166076 - RNA, 64 nt, Homo Sapiens
auuaccgagaaccccaucccuaauaaacauaaauaauaaacaaauaauuaaugauaaaacauaa

SEQ ID NO: 166077 - RNA, 64 nt, Homo Sapiens
aauaauaaacaaaauuaccgugauaaaacauaauaauaaacauaaaaauuuauugaauaauuaa

SEQ ID NO: 166078 - RNA, 64 nt, Homo Sapiens; identical to SEQ ID NO: 78620

SEQ ID NO: 166079 - RNA, 64 nt, Homo Sapiens; identical to SEQ ID NO: 78621

SEQ ID NO: 166080 - RNA, 64 nt, Homo Sapiens; identical to SEQ ID NO: 78622

SEQ ID NO: 166081 - RNA, 64 nt, Homo Sapiens; identical to SEQ ID NO: 78623

SEQ ID NO: 166082 - RNA, 64 nt, Homo Sapiens; identical to SEQ ID NO: 78624

SEQ ID NO: 166083 - RNA, 64 nt, Homo Sapiens; identical to SEQ ID NO: 78625

SEQ ID NO: 166084 - RNA, 64 nt, Homo Sapiens; identical to SEQ ID NO: 78626

SEQ ID NO: 166085 - RNA, 64 nt, Homo Sapiens; identical to SEQ ID NO: 78627

SEQ ID NO: 166086 - RNA, 64 nt, Homo Sapiens; identical to SEQ ID NO: 78628

SEQ ID NO: 166087 - RNA, 64 nt, Homo Sapiens; identical to SEQ ID NO: 78629

SEQ ID NO: 166088 - RNA, 64 nt, Homo Sapiens; identical to SEQ ID NO: 78630

SEQ ID NO: 166089 - RNA, 64 nt, Homo Sapiens; identical to SEQ ID NO: 78631

SEQ ID NO: 166090 - RNA, 64 nt, Homo Sapiens; identical to SEQ ID NO: 78632

SEQ ID NO: 166091 - RNA, 64 nt, Homo Sapiens; identical to SEQ ID NO: 78633

SEQ ID NO: 166092 - RNA, 64 nt, Homo Sapiens; identical to SEQ ID NO: 78634

SEQ ID NO: 166093 - RNA, 64 nt, Homo Sapiens; identical to SEQ ID NO: 78635

SEQ ID NO: 166094 - RNA, 64 nt, Homo Sapiens; identical to SEQ ID NO: 78636

SEQ ID NO: 166095 - RNA, 64 nt, Homo Sapiens; identical to SEQ ID NO: 78637

SEQ ID NO: 166096 - RNA, 64 nt, Homo Sapiens; identical to SEQ ID NO: 78638

SEQ ID NO: 166097 - RNA, 64 nt, Homo Sapiens; identical to SEQ ID NO: 78639

SEQ ID NO: 166098 - RNA, 64 nt, Homo Sapiens; identical to SEQ ID NO: 78640

SEQ ID NO: 166099 - RNA, 64 nt, Homo Sapiens; identical to SEQ ID NO: 78641

SEQ ID NO: 166100 - RNA, 64 nt, Homo Sapiens; identical to SEQ ID NO: 78642

SEQ ID NO: 166101 - RNA, 64 nt, Homo Sapiens; identical to SEQ ID NO: 78643

SEQ ID NO: 166102 - RNA, 64 nt, Homo Sapiens; identical to SEQ ID NO: 78644

SEQ ID NO: 166103 - RNA, 64 nt, Homo Sapiens; identical to SEQ ID NO: 78645

SEQ ID NO: 166104 - RNA, 64 nt, Homo Sapiens; identical to SEQ ID NO: 78646

SEQ ID NO: 166105 - RNA, 64 nt, Homo Sapiens; identical to SEQ ID NO: 78647

SEQ ID NO: 166106 - RNA, 64 nt, Homo Sapiens; identical to SEQ ID NO: 78648

SEQ ID NO: 166107 - RNA, 64 nt, Homo Sapiens; identical to SEQ ID NO: 78649

SEQ ID NO: 166108 - RNA, 64 nt, Homo Sapiens; identical to SEQ ID NO: 78650

SEQ ID NO: 166109 - RNA, 64 nt, Homo Sapiens; identical to SEQ ID NO: 78651

SEQ ID NO: 166110 - RNA, 64 nt, Homo Sapiens; identical to SEQ ID NO: 78652

SEQ ID NO: 166111 - RNA, 64 nt, Homo Sapiens; identical to SEQ ID NO: 78653

SEQ ID NO: 166112 - RNA, 64 nt, Homo Sapiens; identical to SEQ ID NO: 78654

SEQ ID NO: 166113 - RNA, 64 nt, Homo Sapiens; identical to SEQ ID NO: 78655

SEQ ID NO: 166114 - RNA, 64 nt, Homo Sapiens; identical to SEQ ID NO: 78656

SEQ ID NO: 166115 - RNA, 64 nt, Homo Sapiens; identical to SEQ ID NO: 78657

SEQ ID NO: 166116 - RNA, 64 nt, Homo Sapiens; identical to SEQ ID NO: 78658

SEQ ID NO: 166117 - RNA, 64 nt, Homo Sapiens; identical to SEQ ID NO: 78659

SEQ ID NO: 166118 - RNA, 64 nt, Homo Sapiens; identical to SEQ ID NO: 78660

SEQ ID NO: 166119 - RNA, 64 nt, Homo Sapiens; identical to SEQ ID NO: 78661

SEQ ID NO: 166120 - RNA, 64 nt, Homo Sapiens; identical to SEQ ID NO: 78662

SEQ ID NO: 166121 - RNA, 64 nt, Homo Sapiens; identical to SEQ ID NO: 78663

SEQ ID NO: 166122 - RNA, 64 nt, Homo Sapiens; identical to SEQ ID NO: 78664

SEQ ID NO: 166123 - RNA, 64 nt, Homo Sapiens
gccacccacccccuaccauugagccaccaugcccagccccaaagccucuuaauugcucuaacaa

SEQ ID NO: 166124 - RNA, 64 nt, Homo Sapiens
agugcugggauuacacacgugagucaccaugcccagccccaaagccauuucuugaagaauuucu

SEQ ID NO: 166125 - RNA, 64 nt, Homo Sapiens
ccuuuagacccagagcccaagacucaucugucagagccccaagcgccggggcaagauccuucca

SEQ ID NO: 166126 - RNA, 64 nt, Homo Sapiens
acagcagaugcuuccugggcccaccaggaacuagagccccaaccagagcccuucccauccuuac

SEQ ID NO: 166127 - RNA, 64 nt, Homo Sapiens
ccccacgguccccaggaggacgcuuccuggccaaagccccaagccuuuggugagaagccaauuc

SEQ ID NO: 166128 - RNA, 64 nt, Homo Sapiens
ccuuguggcuagaguacagugggguagacccuccagccccaauagcccuaguacccagcuggca

SEQ ID NO: 166129 - RNA, 64 nt, Homo Sapiens
acuuaaaacucccuugcuaccgaucuggaacucaagccccaagacauccccuuagaugaucuga

SEQ ID NO: 166130 - RNA, 64 nt, Homo Sapiens
aaucacaagaagcuggggcuuccuugagaaggccagccccaaagguaccuguguuuaaaagaug

SEQ ID NO: 166131 - RNA, 64 nt, Homo Sapiens
gucccugcuccucuuagaauaguggcuaccucucagccccaauaccccugccuagugggguggu

SEQ ID NO: 166132 - RNA, 64 nt, Homo Sapiens
ggggaauuugucauggggaaagguaugaaaauacagccccaaaguaguggcggcugaucuguag

SEQ ID NO: 166133 - RNA, 64 nt, Homo Sapiens
gugcuacaaaugaaguccuucuccaaaugcauugagccccaagaaaaaucgcugauucugagga

SEQ ID NO: 166134 - RNA, 64 nt, Homo Sapiens
ccgcgcagaaugugcucgcugccccgcggcuucgagccccaagcucccgaggacuuggcgcagc

SEQ ID NO: 166135 - RNA, 64 nt, Homo Sapiens
cagggacagaggggguggccucccaacucaccccagccccaaaacucuccucugcugcuggcug

SEQ ID NO: 166136 - RNA, 64 nt, Homo Sapiens
cuggcugguuagagguucccuuugacgccaucccagccccaaugaacaauuauuuauuaaaugc

SEQ ID NO: 166137 - RNA, 64 nt, Homo Sapiens
gcugggcuuccuggggccaccagagccccaacucagccccaaaauugccucuggcucugucggc

SEQ ID NO: 166138 - RNA, 64 nt, Homo Sapiens
cagccccaaaagcugggcuugcucugucggccagagccccaacucagcccuggccuugccucug

SEQ ID NO: 166139 - RNA, 64 nt, Homo Sapiens
ugagcgcugaaucgugucccucauucggcaaauuagccccaaaugaggucaggauggaacuacc

SEQ ID NO: 166140 - RNA, 64 nt, Homo Sapiens
cucuuccuccagcuggcuccgcuugugcccuggaagccccaagguguaggggucacugucacau

SEQ ID NO: 166141 - RNA, 64 nt, Homo Sapiens
ccuccauccccaacccauccucauccccaacuacagccccaaacccagccccagacuaauccac

SEQ ID NO: 166142 - RNA, 64 nt, Homo Sapiens
cagccauccccaacucauccucauccccaacugcagccccaaacccaacccagggccaucccca

SEQ ID NO: 166143 - RNA, 64 nt, Homo Sapiens
gcccuggccacauccccauccucccccaaccuccagccccaacacccaucaucccccugagcuc

SEQ ID NO: 166144 - RNA, 64 nt, Homo Sapiens
cccuucccacuuggcacccaaagguucccaagccagccccaacaguguuggaagggcagcgggu

SEQ ID NO: 166145 - RNA, 64 nt, Homo Sapiens
gggauuuugugggaccgcugaguccuccucagggagccccaaggugguggaagcggcagccaca

SEQ ID NO: 166146 - RNA, 64 nt, Homo Sapiens
cuggggcuucaggccagagcagccaccuacauccagccccaaaagccuugaaccuaggaccaag

SEQ ID NO: 166147 - RNA, 64 nt, Homo Sapiens
uaagauaucccucacacccaccuacccccacgccagccccaaacaacaggacaucugugaccgc

SEQ ID NO: 166148 - RNA, 64 nt, Homo Sapiens
ugucaccugcuucucugccccugggacagggagcagccccaaauccgaagcaugaacagugcac

SEQ ID NO: 166149 - RNA, 64 nt, Homo Sapiens
caaaacuggcaaggacgcuuucuggccccacaccagccccaauccccacccgugguggcucaag

SEQ ID NO: 166150 - RNA, 64 nt, Homo Sapiens; identical to SEQ ID NO: 155572

SEQ ID NO: 166151 - RNA, 64 nt, Homo Sapiens; identical to SEQ ID NO: 155573

SEQ ID NO: 166152 - RNA, 64 nt, Homo Sapiens
ggaugacuuaguggagaugguuaaaauaaaauaugcaacaaaauuuguccuaccccuuaagcgu

SEQ ID NO: 166153 - RNA, 64 nt, Homo Sapiens
cuauuaguaauagcuauuugucuuaauucuuuuggcaacaaaaauaauuuaaacaaucuuauuc

SEQ ID NO: 166154 - RNA, 64 nt, Homo Sapiens
cacuuugaaaaauauauaagagaaaaugaaacaugcaacaaaaguauuuauugccauguauagc

SEQ ID NO: 166155 - RNA, 64 nt, Homo Sapiens
uuuauugccauguauagcaguuguacagaccaaagcaacaaauaucuuaccuuccucacagacu

SEQ ID NO: 166156 - RNA, 64 nt, Homo Sapiens
accacuuuuacuguugccuagcgguuucaguggcgcaacaaagcggggaagacccacccaggga

SEQ ID NO: 166157 - RNA, 64 nt, Homo Sapiens
agcaacuauuuagaagugucugauaaugugguuggcaacaaaccuacuuaguaaccagugcuuu

SEQ ID NO: 166158 - RNA, 64 nt, Homo Sapiens
gcuccaaaacacacaugccuugauaagaacaacagcaacaaaagaccaccagauggcuaccaaa

SEQ ID NO: 166159 - RNA, 64 nt, Homo Sapiens
uagacugacuucuauauguguuuaaaagacaagugcaacaaaguaaucuuuuauguauucuaac

SEQ ID NO: 166160 - RNA, 64 nt, Homo Sapiens
aaauauaguauuagauuguuaaaacaacuuuguagcaacaaauuaaacuacuuuuuagagaaac

SEQ ID NO: 166161 - RNA, 61 nt, Homo Sapiens
ggacaauucauaugggauagaaacuacaaaugcaacaaaugcgucaaagaauuuagugugc

SEQ ID NO: 166162 - RNA, 64 nt, Homo Sapiens
gaaaagacuuaaugaugaacaccccaaagcaauugcaacaaaaacaaaaauugacaagugggac

SEQ ID NO: 166163 - RNA, 64 nt, Homo Sapiens
uuuuuguauaaaagucccgucauauguuuuguaagcaacaaauuguuuuuuuaagcuuuuuuug

SEQ ID NO: 166164 - RNA, 64 nt, Homo Sapiens
auacacuuugucagagaagaaaaccugaaagcaagcaacaaaacuuuuuuuuuuccaguaaaca

SEQ ID NO: 166165 - RNA, 64 nt, Homo Sapiens
caguaguuaaaccaaacuacauucgaggauuauugcaacaaagcaaaagcugccacuguguggu

SEQ ID NO: 166166 - RNA, 64 nt, Homo Sapiens
cugcaugguccagcgcuccaugucugaaguucuugcaacaaauuaucucuaguuuuuccacguc

SEQ ID NO: 166167 - RNA, 64 nt, Homo Sapiens
uauuuggguguguaauuugaaaguauagauuaaggcaacaaacauuaaaauguugccuuugucc

SEQ ID NO: 166168 - RNA, 64 nt, Homo Sapiens
cuugauagauuuauccuacugaauaaaaauagcagcaacaaauacauagauauaaagacuuagg

SEQ ID NO: 166169 - RNA, 64 nt, Homo Sapiens
auauccuauauuuaaguacccauaauaaaucauuucccucuauaaguguuauugauuauuuuaa

SEQ ID NO: 166170 - RNA, 64 nt, Homo Sapiens
auuaauauuuuucccuauuagaaaccacaauuacucccucuauuaacccuucacuuacuagacc

SEQ ID NO: 166171 - RNA, 64 nt, Homo Sapiens
uuuuuguggcugcuuuuucuacacauccagauggucccucuaacugggcuuucucuaauuuugu

SEQ ID NO: 166172 - RNA, 64 nt, Homo Sapiens
gucuuacccauccccuggauaugcucuuguuuuuucccucuaauagcuauggaaagaugcauag

SEQ ID NO: 166173 - RNA, 64 nt, Homo Sapiens
acuggaugaaaugucugcauagucacaaaacuucucccucuacugaucacuggaaaggugucuc

SEQ ID NO: 166174 - RNA, 64 nt, Homo Sapiens
gauccuccagccucaucuaaugaacugguuuuggucccucuaaucacucaucucugaggagcua

SEQ ID NO: 166175 - RNA, 64 nt, Homo Sapiens
uuuuuuuuaauuauuucucuuagcagaucagcaaucccucuagggaccuaaauacuaggucagc

SEQ ID NO: 166176 - RNA, 64 nt, Homo Sapiens
cucuucgucuuuucuuugcuuuucuucuaacuuuucccucuagccucuccucgccacaauuugc

SEQ ID NO: 166177 - RNA, 64 nt, Homo Sapiens
cagcaguucacccaguacuccucagagacugguuucccucuaaacccaucccgggcacauacca

SEQ ID NO: 166178 - RNA, 64 nt, Homo Sapiens
caugcaaacugccacuuucaaccuuugccaguauucccucuacccccgugagagcuaucugggg

SEQ ID NO: 166179 - RNA, 64 nt, Homo Sapiens
aaaguuugcuucucuuuucaacagugccucacccucccucuaggauuaaagugcuucugcccuu

SEQ ID NO: 166180 - RNA, 64 nt, Homo Sapiens
auuuuugguguuguucaagugaaggaagagauguucccucuaauuucucucuagcccauuauaa

SEQ ID NO: 166181 - RNA, 64 nt, Homo Sapiens
gugaaguaggcaagggaaucuguuuacucccucuucccucuacugaauaauuuucccucuacug

SEQ ID NO: 166182 - RNA, 64 nt, Homo Sapiens
cuguuuacucccucuucccucuacugaauaauuuucccucuacugaauaauuuucccucuaaga

SEQ ID NO: 166183 - RNA, 64 nt, Homo Sapiens
ucuacugaauaauuuucccucuacugaauaauuuucccucuaagaauugcuguggguaauacca

SEQ ID NO: 166184 - RNA, 64 nt, Homo Sapiens
guagugcugccaacccugauauaggggaguuguauggaaaaauaguagaauuacacagcaugaa

SEQ ID NO: 166185 - RNA, 64 nt, Homo Sapiens
ggccacauuuccuauauuuugacagagauacugcuggaaaaauuaaaauuaaaaugccauaaua

SEQ ID NO: 166186 - RNA, 64 nt, Homo Sapiens
uaugcaauaacauuuaggauaaucuuugacauuuuggaaaaauaagaauugaggaaaaaaagug

SEQ ID NO: 166187 - RNA, 64 nt, Homo Sapiens
cagccuggaugacauaaugagauucugucucuacuggaaaaaaaaaaaauuagcuggacauggu

SEQ ID NO: 166188 - RNA, 64 nt, Homo Sapiens
guacuugaaagauaacacaauuuuacaaauuuguuggaaaaacaugaauucauaaauucaggaa

SEQ ID NO: 166189 - RNA, 64 nt, Homo Sapiens
auguaaccaaaagggaagagugauucacuguauguggaaaaauaaaaacgaccccuuguuaccu

SEQ ID NO: 166190 - RNA, 64 nt, Homo Sapiens
accccuuguuaccuugauucuucagaaaacaaaauggaaaaacgucaaaaguguaaauaaccaa

SEQ ID NO: 166191 - RNA, 64 nt, Homo Sapiens
uuaucggcauuguccaaaauauuuuauucuuuaauggaaaaagccauuaauauucaaaugaagg

SEQ ID NO: 166192 - RNA, 64 nt, Homo Sapiens
agucaucugaguguagagaaugucccuucacugcuggaaaaauccacuggcucccaagaaaaga

SEQ ID NO: 166193 - RNA, 64 nt, Homo Sapiens
guuuccaggaauuuuuuucaaauggggcuguuucuggaaaaaugaaaaauucuauuggacaaug

SEQ ID NO: 166194 - RNA, 64 nt, Homo Sapiens
ccugcucagaaccauucacauuuaauucaauucuuggaaaaaauuaaagcuuuuugcccacaau

SEQ ID NO: 166195 - RNA, 64 nt, Homo Sapiens
ugcuuuuauuuuaugggccauuagguucuguaaguggaaaaaugaacucuuacuaaaaugaguu

SEQ ID NO: 166196 - RNA, 64 nt, Homo Sapiens
aucgugucaaucuggaugauaggcacugaagagguggaaaaauaaauguauguugcguauccca

SEQ ID NO: 166197 - RNA, 64 nt, Homo Sapiens
acugucuguguuuuuuuggcuuguuaaguucuauuggaaaaaccauuguauuuguuucuggucu

SEQ ID NO: 166198 - RNA, 64 nt, Homo Sapiens
aaagacaggcugccacaguaaccuuuuuugguaguggaaaaaaacucuuaaaagguaucaaugu

SEQ ID NO: 166199 - RNA, 64 nt, Homo Sapiens
accucaauugauuuuuccauaauuuuuuucaugauggaaaaauccagacagaugacuuuaaaga

SEQ ID NO: 166200 - RNA, 64 nt, Homo Sapiens
ugaauauauuguaggauuugguucaaaagauaauuggaaaaaauaauauauuuugcaaauuguu

SEQ ID NO: 166201 - RNA, 64 nt, Homo Sapiens
gggauuugaauauaggcaaaguauaccugguaaguggaaaaagaaagcaacuuugcuuaaaauu

SEQ ID NO: 166202 - RNA, 64 nt, Homo Sapiens
gugucucagugcuaauucuuuauuaaggauuaacuggaaaaaauuuaauuggauuuaauauuug

SEQ ID NO: 166203 - RNA, 64 nt, Homo Sapiens
aaacacuuaacuagaauucuuauuuacauguauguggaaaaacaugauccuauugaucuuaagg

SEQ ID NO: 166204 - RNA, 64 nt, Homo Sapiens
auuggaaaagaaaaacucagcuuauguugaggcauggaaaaaaaaaauuaacugauuaauuucc

SEQ ID NO: 166205 - RNA, 64 nt, Homo Sapiens
uuuuaggaaacucaccuuccuuuaaaagauuuguuggaaaaaauuuuggugaucuaauccuaaa

SEQ ID NO: 166206 - RNA, 64 nt, Homo Sapiens
auauucaauaagagauuaggaaaaguagcaauuauggaaaaaaacuacuuuggcaacccuuuug

SEQ ID NO: 166207 - RNA, 64 nt, Homo Sapiens
cauagagcccuauucucucagacgguggaauauuuggaaaaauuuuaaaacaauuaaaauuuua

SEQ ID NO: 166208 - RNA, 64 nt, Homo Sapiens
uuucguuaaucuugcugcuuaugugccaauuuaguggaaaaaaacaacccuugcugaaaaauuc

SEQ ID NO: 166209 - RNA, 64 nt, Homo Sapiens
aaucugaagauacaugucuuucuccagggacauguggaaaaaaaaaagauguuauacaaccauc

SEQ ID NO: 166210 - RNA, 64 nt, Homo Sapiens
guaaaaggguaucccaaaaauaaaacuauccuuuuggaaaaaaaaagauuuaaaauaauuccug

SEQ ID NO: 166211 - RNA, 64 nt, Homo Sapiens
gcagcuugacacccaccaagcaaaaguuucagccuggaaaaaaaaugggggggaaggguggaug

SEQ ID NO: 166212 - RNA, 64 nt, Homo Sapiens
guguggggugccagaaagugucugcugauauuuguggaaaaaaaaucuauuuuguuuaccuacu

SEQ ID NO: 166213 - RNA, 64 nt, Homo Sapiens
acuacuguauguaacggaauaaaaaaaauagcuuuggaaaaaaagcuuuauauuaacgauacua

SEQ ID NO: 166214 - RNA, 64 nt, Homo Sapiens
aaaaaaaaaaaaacacgucaccgagaaugaagauuggaaaaaggacuaucggggcgggccaacc

SEQ ID NO: 166215 - RNA, 64 nt, Homo Sapiens
uuucaaccugacuaaaauuuuaucuuucaguuaguggaaaaacauaauggcugcucauuuaucu

SEQ ID NO: 166216 - RNA, 64 nt, Homo Sapiens
aauucucauuauuugcaaagcauaggacaauuaauggaaaaaaaaggaaaauucuccuugauaa

SEQ ID NO: 166217 - RNA, 64 nt, Homo Sapiens
uccacugugccuugguuucuccuuuauuucuaaguggaaaaaguauuagccaccaucuuaccuc

SEQ ID NO: 166218 - RNA, 64 nt, Homo Sapiens
auuuauuuaagcaucaaauauuugugcaagaauuuggaaaaauagaagaugaaucauugauuga

SEQ ID NO: 166219 - RNA, 64 nt, Homo Sapiens
uuuuuaaaaccuucuuaacaaaacuucuuaaaacuggaaaaaauauauauuauguaucuaugua

SEQ ID NO: 166220 - RNA, 64 nt, Homo Sapiens
gaagagucucauuagacaaugauuuuuaaagcauuggaaaaauauuuugccuguaaaaguuagu

SEQ ID NO: 166221 - RNA, 64 nt, Homo Sapiens
uuguucuauuuuuacaucuugggcacauucagaguggaaaaaaucaaaaguacauugguaauuu

SEQ ID NO: 166222 - RNA, 64 nt, Homo Sapiens
aaaucuguauauuaaagagaagcaauaccauuacuggaaaaaggauagaacuaucauaugaucc

SEQ ID NO: 166223 - RNA, 64 nt, Homo Sapiens
uaccauauagcuuaauauguuuauuaguucucuuuggaaaaaaacuaccacuguggucuuaaaa

SEQ ID NO: 166224 - RNA, 64 nt, Homo Sapiens
aaauaauuauaucagaaacucacaaaccuagacauggaaaaacagauuacugucuauugucagc

SEQ ID NO: 166225 - RNA, 58 nt, Homo Sapiens; identical to SEQ ID NO: 96080

SEQ ID NO: 166226 - RNA, 64 nt, Homo Sapiens
augaggcuccaccuuguuaaauaaauuggauguauggaaaaauagacugcagaaaaggggaacu

SEQ ID NO: 166227 - RNA, 64 nt, Homo Sapiens
uacugguagagucauggaggaaguaaguuaaauguggaaaaaaugcuuuaaaaguacuuacuau

SEQ ID NO: 166228 - RNA, 64 nt, Homo Sapiens
aaaaguacuuacuauaaccacaucauaagaauucuggaaaaauagagaacaaaaggaaaagauu

SEQ ID NO: 166229 - RNA, 64 nt, Homo Sapiens
aagacuggguucgaucagcccuccuaaagcuggcuggaaaaagaagccccagcccagccugccu

SEQ ID NO: 166230 - RNA, 64 nt, Homo Sapiens
uuacaccaucugcaaccauaugcuauuaauaaaauggaaaaaaacaaaauggucauuuugcaua

SEQ ID NO: 166231 - RNA, 64 nt, Homo Sapiens
aaaaaaauuaaaaaguaaauuuugccauuuuagauggaaaaauagaucaaaaguaaauguucuc

SEQ ID NO: 166232 - RNA, 64 nt, Homo Sapiens
auugcccuguggacuccuuuagugagaccucugguggaaaaauucagugcuuuucagaauguag

SEQ ID NO: 166233 - RNA, 64 nt, Homo Sapiens
aacagaaaagagauauuaaaagucucuauuucuguggaaaaaacaacugugagauugaauaaac

SEQ ID NO: 166234 - RNA, 64 nt, Homo Sapiens
uaccuauucuugaaguaguuugaucaagguauaauggaaaaauaagaauugcaucuuuacauaa

SEQ ID NO: 166235 - RNA, 64 nt, Homo Sapiens
ugccuuaauguuugaaauguaaguacuguuuaguuggaaaaaguaagugacaucuauuuuuaua

SEQ ID NO: 166236 - RNA, 64 nt, Homo Sapiens
uaaauacuacuguaggaguaucugcuuguuaaaauggaaaaaugugucuuuagagcucaguauu

SEQ ID NO: 166237 - RNA, 64 nt, Homo Sapiens
auuacagucugucuguauuuagauauuuuauuucuggaaaaaaugaaauguacauaaaaauaaa

SEQ ID NO: 166238 - RNA, 64 nt, Homo Sapiens
ugguuuuuggauuaaauuaguuugugaaggauuauggaaaaauaaaacugucacuguuggacgu

SEQ ID NO: 166239 - RNA, 64 nt, Homo Sapiens
caaaacuuuaaaccuguagaaucaauuuaaguguuggaaaaaauuugucugaaacauuucauaa

SEQ ID NO: 166240 - RNA, 64 nt, Homo Sapiens
auauuggagaaaaacccuaugaguguaaugaauuuggaaaaauauuuuuuucaacaacagcuua

SEQ ID NO: 166241 - RNA, 64 nt, Homo Sapiens
agagguauauuuacauucagaguacacuuuucuuuggaaaaaauuacagguuuuuugaaaagug

SEQ ID NO: 166242 - RNA, 64 nt, Homo Sapiens
uuuagauuuuaagugccuuuucacugggagaaucuggaaaaaccuccauaagguauauagcaau

SEQ ID NO: 166243 - RNA, 64 nt, Homo Sapiens
uauuauaauaaauuauauuaguaaaagucuuaacuggaaaaaagaaucuaaaucagaauaguga

SEQ ID NO: 166244 - RNA, 64 nt, Homo Sapiens
aaagaaggcaggaaggaaaguagagaagaagaaauggaaaaaugccaguugcgcugauuacucu

SEQ ID NO: 166245 - RNA, 64 nt, Homo Sapiens
aguguuagggaaagaaaucaauaaauuaguagauuggaaaaacuuuacuuugcuuuguuuauaa

SEQ ID NO: 166246 - RNA, 64 nt, Homo Sapiens
caguggcuccucucugguugaggagagggaaaauuggaaaaacuggucgaguaauuaucaauaa

SEQ ID NO: 166247 - RNA, 64 nt, Homo Sapiens
auuauauuuuuauauacugaacugccauagaugcuggaaaaaaggaacugauguuuucagcaua

SEQ ID NO: 166248 - RNA, 64 nt, Homo Sapiens
accuaaaaccuuuuagugacaaaauccuaauauguggaaaaaagcauaugcauaaaggaauaau

SEQ ID NO: 166249 - RNA, 64 nt, Homo Sapiens
guaaguuaaauauaucaagaaagaagagacuguuuggaaaaaugugguucaaguuuuaugcuau

SEQ ID NO: 166250 - RNA, 64 nt, Homo Sapiens
uuugcacuuaaaguugcauugccuacuguuauacuggaaaaaauagaguucaagaauaauauga

SEQ ID NO: 166251 - RNA, 64 nt, Homo Sapiens
aaaaagugugauagcgauauuagugccaaucaaauggaaaaaagguaguuuuaauaaacaagac

SEQ ID NO: 166252 - RNA, 64 nt, Homo Sapiens
aguagcucucuguagcauuaguuaaccuacuuccuggaaaaaguuguccuuuuucuuucuagcu

SEQ ID NO: 166253 - RNA, 64 nt, Homo Sapiens
gauuuguaaaaucaccggaaguagacuuuacaccuggaaaaaaaucuaauuuuuuggaauuuuu

SEQ ID NO: 166254 - RNA, 64 nt, Homo Sapiens
uggacaaccucuugacuagguaguaaccaugcaauggaaaaaaaguuaguuucuggggaaagaa

SEQ ID NO: 166255 - RNA, 64 nt, Homo Sapiens
gaugauuccaaagcaagggcgaaccaaggcuacuuggaaaaaugauauaguuugccacuaaaag

SEQ ID NO: 166256 - RNA, 64 nt, Homo Sapiens
aauauacaaauaugaaaugacaggauguucacuauggaaaaacaauguugauguugaugggagu

SEQ ID NO: 166257 - RNA, 64 nt, Homo Sapiens
cuggaauaugugguguacaccauagaauguuacuuggaaaaaguuaguagcucuaaacuguuaa

SEQ ID NO: 166258 - RNA, 64 nt, Homo Sapiens
caugucuguaacuaacccauugugagauuauauuuggaaaaauucagagggauuaaauuagacc

SEQ ID NO: 166259 - RNA, 64 nt, Homo Sapiens
gagauaguagguugaaaugggagaauuucucuuuuggaaaaaaagguagauaacuguuuaaaaa

SEQ ID NO: 166260 - RNA, 64 nt, Homo Sapiens
acagguaauuauuaguuguaauagcuuuaaugcauggaaaaacuucaguuacugaccagucaag

SEQ ID NO: 166261 - RNA, 64 nt, Homo Sapiens
auuuggaccauacacuauguuacaaaacuaaaaguggaaaaaacuuauuggugaaugaauauag

SEQ ID NO: 166262 - RNA, 64 nt, Homo Sapiens
ugaguugcaggauaucuagcaauuuaagaaaauguggaaaaaauauuuuuauugagaaauagca

SEQ ID NO: 166263 - RNA, 64 nt, Homo Sapiens
ucaaucuaauagucaccuaaaauaucuuuuuuguuggaaaaaaguuuauaauaaaaaaguuugu

SEQ ID NO: 166264 - RNA, 64 nt, Homo Sapiens
ccaaauguuuauuaaguagcuagaaauaauuauguggaaaaaaaugaauaauggaaaauaguga

SEQ ID NO: 166265 - RNA, 64 nt, Homo Sapiens
agccauugggaaauugggagaaaugauaaacaaauggaaaaagaagaugucccuaaccuacacc

SEQ ID NO: 166266 - RNA, 64 nt, Homo Sapiens
gaucuuuaagcaagaaguuaaagagugaacaugguggaaaaaauauaauuauuuucaucagacu

SEQ ID NO: 166267 - RNA, 64 nt, Homo Sapiens
cccaggggacugccauuuuauaaaugucagcaguuggaaaaaucgucacgaauugacuuagagc

SEQ ID NO: 166268 - RNA, 64 nt, Homo Sapiens
cuauuagaguauuucccuuccaaagagggauguuuggaaaaaacucugaaggagaggaggaauu

SEQ ID NO: 166269 - RNA, 64 nt, Homo Sapiens
ccuacagccuagggcagacaauaguauagaagucuggaaaaaaacaaaaacagaauuugagaac

SEQ ID NO: 166270 - RNA, 64 nt, Homo Sapiens
ucccaaggagaacaaauauucagaauauucauauuggaaaaaucacaauuuuuaauggcagcag

SEQ ID NO: 166271 - RNA, 64 nt, Homo Sapiens
cuuauccauaaaaaaaaauagaugucuuuuauaguggaaaaacacauggggaaaaaaaucaucu

SEQ ID NO: 166272 - RNA, 64 nt, Homo Sapiens
cagaggccuaaaguuuaaaaugaacuguguuuacuggaaaaauucauugacuuugccacauagc

SEQ ID NO: 166273 - RNA, 64 nt, Homo Sapiens
gaugacuauaugaugaggagaugagccaucagacuggaaaaaagaaaaagagggccaaggaggu

SEQ ID NO: 166274 - RNA, 64 nt, Homo Sapiens
gggcccugagucaaaaggauagccaaggguggaguggaaaaagauauggugaaggcagaacugc

SEQ ID NO: 166275 - RNA, 64 nt, Homo Sapiens
uucaauuucuccuuggaacucuaacaggacuaacuggaaaaauacuuugaccauagcucuagua

SEQ ID NO: 166276 - RNA, 64 nt, Homo Sapiens
cugguacucaaagcugcuuauuccgaauguguccuggaaaaaaaucagauccccaccugcauca

SEQ ID NO: 166277 - RNA, 64 nt, Homo Sapiens
gucuccuaauuuggggagauuggacuuuuacucauggaaaaauugaaugacuccacuuuuaaug

SEQ ID NO: 166278 - RNA, 64 nt, Homo Sapiens
caauuuuuucaggaccuuaguuccagcagcagaauggaaaaauccuugaagcccaggcugaugc

SEQ ID NO: 166279 - RNA, 64 nt, Homo Sapiens
aucuuguuagagagcuuuucacugugaggaaguguggaaaaauagcucugugugugugugugug

SEQ ID NO: 166280 - RNA, 64 nt, Homo Sapiens
uccuugaggcauuuagcaacaaaguuugaugcauuggaaaaauuggaaaauaaaaaggauucua

SEQ ID NO: 166281 - RNA, 64 nt, Homo Sapiens
gucuuccacaaaacuggucccacccugcagucuguggaaaaauuuucauccugaaaccacccuu

SEQ ID NO: 166282 - RNA, 64 nt, Homo Sapiens
uauuauuugaagaaagaaaaaacagauuuuaggguggaaaaaacagucaacucacacaaagaau

SEQ ID NO: 166283 - RNA, 64 nt, Homo Sapiens
uaggguggaaaaaacagucaacucacacaaagaauggaaaaaaauacugaguuaaauuaagcaa

SEQ ID NO: 166284 - RNA, 64 nt, Homo Sapiens
uagacaagucuaguggaaccaaaaaauaugagauuggaaaaaauuuuucaccuaucuggaaaaa

SEQ ID NO: 166285 - RNA, 64 nt, Homo Sapiens
aaaauaugagauuggaaaaaaguuuucaccuaucuggaaaaaaauguggaaggcacacugagca

SEQ ID NO: 166286 - RNA, 64 nt, Homo Sapiens
ucaggguuaggguuuaaagaaaggagaaagccauuggaaaaaugaugggcuccauuaaggagac

SEQ ID NO: 166287 - RNA, 64 nt, Homo Sapiens
ucauaaagcuucaaugucuuuuuuuuuuuuuucauggaaaaacucaaaccucuguuauuuggga

SEQ ID NO: 166288 - RNA, 64 nt, Homo Sapiens
uguuugcauaggaauucaugaaggcgacccaaccuggaaaaagaacuauucacuuuggccaugg

SEQ ID NO: 166289 - RNA, 64 nt, Homo Sapiens
uauuaauaccagaccaaagacauuuucuguuuccuggaaaaaaaaaaugaaucauguuaggcuu

SEQ ID NO: 166290 - RNA, 64 nt, Homo Sapiens
uuaaaauuauuuucauugauggaacuggaguuguuggaaaaacauagauuuaaaaugauuuuug

SEQ ID NO: 166291 - RNA, 64 nt, Homo Sapiens
cugccaagugcucuugauaauuucuucagauuuuuggaaaaaaacacuauauaaaugcaaucca

SEQ ID NO: 166292 - RNA, 64 nt, Homo Sapiens
uauagaucacauacguuaucaaaaacuacucccuuggaaaaaauaucuuucgaaaaucaaauuu

SEQ ID NO: 166293 - RNA, 64 nt, Homo Sapiens
caugggaaagcaaagcagaaaacagugccccaaauggaaaaaagauacucacacagaacaaaac

SEQ ID NO: 166294 - RNA, 64 nt, Homo Sapiens
uacauuagcugugguuguaacugacugggaacaauggaaaaaauugcacacaauggguuuggag

SEQ ID NO: 166295 - RNA, 64 nt, Homo Sapiens
ugggcuuugcacacaaugggaucauuuagaugcauggaaaaaaagaauuucauagccuguaucu

SEQ ID NO: 166296 - RNA, 64 nt, Homo Sapiens
gaucagaguuugaaaugaaauguugucaggguguuggaaaaauuuuggugaguucugcacauuu

SEQ ID NO: 166297 - RNA, 64 nt, Homo Sapiens
acugacucacugaugaaucagcauuugcauuuuauggaaaaauauaaauccaaagaaauaauuu

SEQ ID NO: 166298 - RNA, 64 nt, Homo Sapiens
cuccuuggcgcugccaccugccccacccaguuucuggaaaaaguugaugcuaaugaggccaacc

SEQ ID NO: 166299 - RNA, 64 nt, Homo Sapiens
guggugcuggggcuggccugcaggcugcagucccuggaaaaacagucacugacucaagacacug

SEQ ID NO: 166300 - RNA, 64 nt, Homo Sapiens
aaagcuuuuaaacuggagaguuuuaaaaaaaaaauggaaaaaaagcacuacuaaguguguguuu

SEQ ID NO: 166301 - RNA, 64 nt, Homo Sapiens
cugagcucaguuacacuugaugauccauacuguuuggaaaaacagggcucagagggaauaucag

SEQ ID NO: 166302 - RNA, 64 nt, Homo Sapiens
ucuuggcauaagcucaaaaaagccaggaucuuuauggaaaaauuuuaauacuuuguuaaaaggu

SEQ ID NO: 166303 - RNA, 64 nt, Homo Sapiens
uggaauaaauggaaagaaauaccauauacauagauggaaaaacccaguauuauaaaaaccucaa

SEQ ID NO: 166304 - RNA, 64 nt, Homo Sapiens
guuucaaccucauucaacaccagaaaguucacaguggaaaaaaucuugaagguaacagauggaa

SEQ ID NO: 166305 - RNA, 64 nt, Homo Sapiens
uggacaguuuacaauguggacaauguagugaauauggaaaaagguuucagccaaaggccuaacc

SEQ ID NO: 166306 - RNA, 64 nt, Homo Sapiens
uauauaaaacaguaucagugggacuuuacuguuguggaaaaaucccgguucaugacagacccuu

SEQ ID NO: 166307 - RNA, 64 nt, Homo Sapiens
cauauuaugagaaaauugugcuucaggaaguucauggaaaaauaaguucgcuaguacaaggggu

SEQ ID NO: 166308 - RNA, 64 nt, Homo Sapiens
aaauuaaggaaugauugaauuuugugggucuugauggaaaaacgcuggucuucuuuuaaugugg

SEQ ID NO: 166309 - RNA, 64 nt, Homo Sapiens
gucuugauggaaaaacgcuggucuucuuuuaauguggaaaaacagcuagugcuucaguccuagg

SEQ ID NO: 166310 - RNA, 64 nt, Homo Sapiens
uauguacuguuauugaaaauauauuuaauaccuuuggaaaaaucuugggcaagaugaccuacua

SEQ ID NO: 166311 - RNA, 64 nt, Homo Sapiens
uacauaauugcaauauuucccccuuacuacuucuuggaaaaaaauuacaaaaugaaguuuuaua

SEQ ID NO: 166312 - RNA, 64 nt, Homo Sapiens
aaaugcaagguaauuuuguacggguguucugauguggaaaaaagacaauuuauagaaauaguau

SEQ ID NO: 166313 - RNA, 64 nt, Homo Sapiens
ucgaauuucaaaagaauccguacuaauuucaaucuggaaaaagagaagaaacuucuacagauau

SEQ ID NO: 166314 - RNA, 64 nt, Homo Sapiens
gucaacucauuuucaucuguuuuuugaagaaaaauggaaaaauguaaaaggcagccccucccca

SEQ ID NO: 166315 - RNA, 64 nt, Homo Sapiens
uuucuguugccauuuguguaaauacuagucuuuuuggaaaaaaaauaauguaaagauguuuugu

SEQ ID NO: 166316 - RNA, 64 nt, Homo Sapiens; identical to SEQ ID NO: 77858

SEQ ID NO: 166317 - RNA, 64 nt, Homo Sapiens; identical to SEQ ID NO: 77859

SEQ ID NO: 166318 - RNA, 64 nt, Homo Sapiens; identical to SEQ ID NO: 77860

SEQ ID NO: 166319 - RNA, 64 nt, Homo Sapiens; identical to SEQ ID NO: 77861

SEQ ID NO: 166320 - RNA, 64 nt, Homo Sapiens; identical to SEQ ID NO: 77862

SEQ ID NO: 166321 - RNA, 64 nt, Homo Sapiens; identical to SEQ ID NO: 77863

SEQ ID NO: 166322 - RNA, 64 nt, Homo Sapiens; identical to SEQ ID NO: 77864

SEQ ID NO: 166323 - RNA, 64 nt, Homo Sapiens; identical to SEQ ID NO: 77865

SEQ ID NO: 166324 - RNA, 64 nt, Homo Sapiens; identical to SEQ ID NO: 77866

SEQ ID NO: 166325 - RNA, 62 nt, Homo Sapiens; identical to SEQ ID NO: 77867

SEQ ID NO: 166326 - RNA, 64 nt, Homo Sapiens; identical to SEQ ID NO: 77868

SEQ ID NO: 166327 - RNA, 64 nt, Homo Sapiens; identical to SEQ ID NO: 77869

SEQ ID NO: 166328 - RNA, 64 nt, Homo Sapiens; identical to SEQ ID NO: 77870

SEQ ID NO: 166329 - RNA, 64 nt, Homo Sapiens; identical to SEQ ID NO: 77871

SEQ ID NO: 166330 - RNA, 64 nt, Homo Sapiens; identical to SEQ ID NO: 77872

SEQ ID NO: 166331 - RNA, 64 nt, Homo Sapiens; identical to SEQ ID NO: 77873

SEQ ID NO: 166332 - RNA, 64 nt, Homo Sapiens; identical to SEQ ID NO: 77874

SEQ ID NO: 166333 - RNA, 64 nt, Homo Sapiens; identical to SEQ ID NO: 77875

SEQ ID NO: 166334 - RNA, 64 nt, Homo Sapiens; identical to SEQ ID NO: 77876

SEQ ID NO: 166335 - RNA, 64 nt, Homo Sapiens
gcucuucacaccauucauucacacacagguggggacugggcacagaacacacacacacacacac

SEQ ID NO: 166336 - RNA, 64 nt, Homo Sapiens
cgcacaaacacacacacuauauucgacauaccccacugggcacaaggauggaaacuggacucac

SEQ ID NO: 166337 - RNA, 64 nt, Homo Sapiens
uuuuuccugguuugaaaggaccagauggaaagaaacugggcaagccaaugaaagucucugggga

SEQ ID NO: 166338 - RNA, 64 nt, Homo Sapiens
aucccaaucacauuuucucuuaaucguuuauuauacugggcauugggguugcaagauaaugcac

SEQ ID NO: 166339 - RNA, 64 nt, Homo Sapiens
gacugccggccccggagucuaagcagagggagggacugggcagggcauguggaagagugggagg

SEQ ID NO: 166340 - RNA, 64 nt, Homo Sapiens
gacucacugugcuuuucugagauugcuuccuggaacugggcaggugaccagaccagacuuuuca

SEQ ID NO: 166341 - RNA, 64 nt, Homo Sapiens
aagccaggacuuccccaugggaagugcaggggccacugggcagccugagggcugacccugcuca

SEQ ID NO: 166342 - RNA, 64 nt, Homo Sapiens
ccugugagaagcggaauggguacugucuaggaggacugggcagggugggggcaacccagaggac

SEQ ID NO: 166343 - RNA, 64 nt, Homo Sapiens
gcaaauauuuauugggggccagcccagggcugggacugggcaugagguggucaccaggauugag

SEQ ID NO: 166344 - RNA, 64 nt, Homo Sapiens
aguuucccucuuccuugccagcccugaccuggucacugggcaggcuggcccagcagccuggggg

SEQ ID NO: 166345 - RNA, 64 nt, Homo Sapiens
cggggcaugagccccugggugagcuccgucugccacugggcaccguggaucugcagcauguucu

SEQ ID NO: 166346 - RNA, 64 nt, Homo Sapiens
cugggugcccgggccucggggcagccccugcagcacugggcagacaugcuggcccacgcccggc

SEQ ID NO: 166347 - RNA, 64 nt, Homo Sapiens
uccuggacagccucuuggcuggccaugaggacccacugggcagcagcacuugagguaucccgca

SEQ ID NO: 166348 - RNA, 64 nt, Homo Sapiens
caccagcaaacagacccugugggguggcugggagacugggcagcucccugggcuggggacucca

SEQ ID NO: 166349 - RNA, 64 nt, Homo Sapiens
ccaggcucugcuuuggguugugaguggacacccaacugggcacaggcucaggcacccauccuuu

SEQ ID NO: 166350 - RNA, 64 nt, Homo Sapiens
cauaggucacuucagguagcaagaccccuggcaaacugggcacuuggccuauguacugauuugu

SEQ ID NO: 166351 - RNA, 64 nt, Homo Sapiens
ugugaaucaguagacauuggauuggguuggugaaagaguucaguucuguaguaucugaauuugu

SEQ ID NO: 166352 - RNA, 64 nt, Homo Sapiens
auauuuuccacaccuuuuuuuuuuuuucugaugcagaguucagguuaauauuuuacugcaucug

SEQ ID NO: 166353 - RNA, 64 nt, Homo Sapiens
gcugaacucccugauggcagucacaccagggguuagaguucacucucaggagccaggcuaguga

SEQ ID NO: 166354 - RNA, 64 nt, Homo Sapiens
cacgcauaauucuagauuucaugaugacuuccuaagaguucagcagucagcuguaauuagagaa

SEQ ID NO: 166355 - RNA, 64 nt, Homo Sapiens
auauuuaucaaauucaggcuucauucagcaucugagaguucacaccagggagaaaucauguaug

SEQ ID NO: 166356 - RNA, 64 nt, Homo Sapiens
gcucaaguucagggccaccaucauauaccuaacaagaguucaugauucuuuagguaaugucaaa

SEQ ID NO: 166357 - RNA, 64 nt, Homo Sapiens
cuaaaagauauuuugcaaaugcuuagaaaacacuagaguucauaacauuuguucaaaaaugaua

SEQ ID NO: 166358 - RNA, 64 nt, Homo Sapiens
cuuaauaaaguuaucauaaaucccacuuuacaucagaguucagagccguuaguaucugcucgca

SEQ ID NO: 166359 - RNA, 64 nt, Homo Sapiens
agauugguggaggagaguaaauaaucuagaggcaagaguucagugagggccaagggggaccccc

SEQ ID NO: 166360 - RNA, 64 nt, Homo Sapiens
ccccuuuccuuuuuuuggaaggggguuauauaugagaguucauugaagaaguccagugaggcug

SEQ ID NO: 166361 - RNA, 64 nt, Homo Sapiens
uagcuuagagcauuuguaucuauauuuuaaagucagaguucauguuaccuguuuuaaucacaug

SEQ ID NO: 166362 - RNA, 64 nt, Homo Sapiens
uuucaauuugcuuagaaggcaacauuggaagguuagaguucaucagaaacagaauucuaaaaug

SEQ ID NO: 166363 - RNA, 64 nt, Homo Sapiens
agaaacagaauucuaaaaugaacauuggaagguuagaguucaucuuucaauuugcuuagagggc

SEQ ID NO: 166364 - RNA, 64 nt, Homo Sapiens
ugucccuggaacaggcauacuaagaaauccuuuaagaguucaaaaauguauuuaguaaagauca

SEQ ID NO: 166365 - RNA, 64 nt, Homo Sapiens
ugggaggccaaggugggaagaucgcuugaggccaagaguucaagaccagccugggcaacauagc

SEQ ID NO: 166366 - RNA, 64 nt, Homo Sapiens
aaguaacuuccauauaaaaugguauuugaaagugagaguucaugacaacagaccguuuuccauu

SEQ ID NO: 166367 - RNA, 64 nt, Homo Sapiens
acaugugugcuagagcuuacucugagaaggugacagaguucauguugugugcugggcucuggac

SEQ ID NO: 166368 - RNA, 64 nt, Homo Sapiens
aauugaccugaaguccucagaccugagguucccuagaguucaaacagauacagcaugguccaga

SEQ ID NO: 166369 - RNA, 50 nt, Homo Sapiens
ucacacugaauagacaucagagaguucacucuggagagaggccuuaugaa

SEQ ID NO: 166370 - RNA, 64 nt, Homo Sapiens
cuuuguggacagcuguacacugaagagucaucagagaguucacacuggagaaagaccuuuugaa

SEQ ID NO: 166371 - RNA, 64 nt, Homo Sapiens
uuuuauggacagcuccacacucauuagucaugagagaguucauacuggagaaaagccuuaugag

SEQ ID NO: 166372 - RNA, 64 nt, Homo Sapiens
auuucgccgaagcucuucacucuugcagcaucagagaguucacacuagagaaaggccuuaugaa

SEQ ID NO: 166373 - RNA, 64 nt, Homo Sapiens
cuuuagccgaaaaucuagccuuauuauacaucugagaguucacacuggagaaaggccuuaugag

SEQ ID NO: 166374 - RNA, 64 nt, Homo Sapiens
cuuugcugaaaacuccagccuuauuaaacacuugagaguucacacuggagaaaggccauaugaa

SEQ ID NO: 166375 - RNA, 64 nt, Homo Sapiens
auuucgccacaguucuucguuccgucgccaucagagaguucauacuggaaugaggccuuauaag

SEQ ID NO: 166376 - RNA, 64 nt, Homo Sapiens
cucuugcccaggcuuuuugcuccuucaaggccagagaguucacaccagaucaagguguuaugag

SEQ ID NO: 166377 - RNA, 64 nt, Homo Sapiens
cuaaaacauauuuuugcagauuagaaaacaccagagaguucauaacuuuuucaaaaacuacagc

SEQ ID NO: 166378 - RNA, 64 nt, Homo Sapiens
cucaauaaaaacauaagugcuuacucaacaucagagaguucauacauuaauacaugcucacauc

SEQ ID NO: 166379 - RNA, 64 nt, Homo Sapiens
ggagagccaaaaaagaaaagucuuuagcucagcuagaguucacaugggccagagcuucagcccu

SEQ ID NO: 166380 - RNA, 64 nt, Homo Sapiens
gaggacacgugaccugcacagugagaaauggggaagaguucaggaccacagcugcaucuugcuu

SEQ ID NO: 166381 - RNA, 64 nt, Homo Sapiens
uugaaauacaugaagguuuuauggugcaaaaaguaaucacuagaugugguguaaaaaacaaauu

SEQ ID NO: 166382 - RNA, 64 nt, Homo Sapiens
auaucaugucuuuuacucuguuuuuuuuuuuaguaaucacuacuauagauuuaagcugcuaauu

SEQ ID NO: 166383 - RNA, 64 nt, Homo Sapiens
augauuugugagaaacuggccacuagauuuaaauaaucacuaaauuuuaaauaaucacuaaaau

SEQ ID NO: 166384 - RNA, 64 nt, Homo Sapiens
uuuaaauaaucacuaaaauguaaauaaucacuaaaaucacuagagcaagcuaggauagugauuu

SEQ ID NO: 166385 - RNA, 64 nt, Homo Sapiens
aucacuagauuuaaauaaucuagugauuuuaaauaaucacuaaaaugcuuaaugcaagcuagga

SEQ ID NO: 166386 - RNA, 64 nt, Homo Sapiens
uaguaaucauuuucuaggggaaaauaaaagaauaaaucacuauacugauauuuugauacaagca

SEQ ID NO: 166387 - RNA, 64 nt, Homo Sapiens
cugauauuuugauacaagcaagcacuuacaugguaaucacuauauagauccaaccuguggauuu

SEQ ID NO: 166388 - RNA, 64 nt, Homo Sapiens
cagaagcaauauccaaagaucagaaaggguggaaaaucacuauaguucuuuauauuucuuaaaa

SEQ ID NO: 166389 - RNA, 64 nt, Homo Sapiens
uauuggggauaucuuugcagucauauuuucuaccaaucacuaugaaccaucuuuuauccucuau

SEQ ID NO: 166390 - RNA, 64 nt, Homo Sapiens
ccugguuaucucaccaacgauuguuuacgcauggaaucacuauuuuauugguuuaguauucuug

SEQ ID NO: 166391 - RNA, 64 nt, Homo Sapiens
ucccuuaagguugaaacuguauugcagcacuuacaaucacuaauaagaagauaauagaccagca

SEQ ID NO: 166392 - RNA, 64 nt, Homo Sapiens
gucuccaaagcccuucuucuuuccaccacaaauuaaucacuauguuuauaagguaguaucagaa

SEQ ID NO: 166393 - RNA, 64 nt, Homo Sapiens
agguaguaucagaauuuuuuuaggauucacaacuaaucacuauagcacaugaccuugggauuac

SEQ ID NO: 166394 - RNA, 64 nt, Homo Sapiens
auuucugaauugcuaugugaaacuucuauguaaaaaucacuaugaacuaguucacagacaagga

SEQ ID NO: 166395 - RNA, 64 nt, Homo Sapiens
uuucaggugguggcugaugcaagggauuugaccuaaucacuaauagaaucugacagauaccaua

SEQ ID NO: 166396 - RNA, 64 nt, Homo Sapiens
aauuuaaucuccccauugagugugucaugguacaaaucacuauucguuuuugguguuuuuuagg

SEQ ID NO: 166397 - RNA, 64 nt, Homo Sapiens
gugaccaauggugugcccagagcacuacucucaaaaucacuaguguuagcaagucgucccgggc

SEQ ID NO: 166398 - RNA, 64 nt, Homo Sapiens
ggugggagggagugaacuacacauuuuacuuaaaugauuugaggaauuuauguuuauuggaaga

SEQ ID NO: 166399 - RNA, 64 nt, Homo Sapiens
cugugucugaucccauugcacuucugccccuggcugauuugaucacccguagggccaccaugcc

SEQ ID NO: 166400 - RNA, 64 nt, Homo Sapiens
aggaauauaagaugccucaagcauucauuauuuaugauuugaauacuguagcuauuuuuuguug

SEQ ID NO: 166401 - RNA, 64 nt, Homo Sapiens
acagagcuguuaauaaugguuauguggauuacugugauuugaaaacuaaauucacaauaacuua

SEQ ID NO: 166402 - RNA, 64 nt, Homo Sapiens
aauacacauuugcuacuguuguaagaauucugauugauuugauugggaugaaugccaucuaucu

SEQ ID NO: 166403 - RNA, 64 nt, Homo Sapiens
accuuucucucucuaagguuuacaauaggaguggugauuugaaaaauauaaaauuaugagauug

SEQ ID NO: 166404 - RNA, 64 nt, Homo Sapiens
agagaauaauuuacaaaaauugggguugugaaacugauuugacaagccuguaggacuggaugaa

SEQ ID NO: 166405 - RNA, 64 nt, Homo Sapiens
auuaagcacccauaccauuuaguaaaauugcaggugauuugauagguauccauugugacagaca

SEQ ID NO: 166406 - RNA, 64 nt, Homo Sapiens
accaaaguuguuuuacagcuccauuuuuuugcagugauuugaagggugugcuauuugucaguag

SEQ ID NO: 166407 - RNA, 64 nt, Homo Sapiens
gcaaaaaucuacaguguuucguauucccuuccucugauuugaaguagcuaugguuguaacauau

SEQ ID NO: 166408 - RNA, 64 nt, Homo Sapiens
uuuuuuuuuugaaaagauaaacuuguaaauagagugauuugaaauacuauauggcaaaguuuua

SEQ ID NO: 166409 - RNA, 64 nt, Homo Sapiens
cuuggaagcaugucccucccucuugaguuggcucugauuugaaaucgggagaaacagagcugcu

SEQ ID NO: 166410 - RNA, 64 nt, Homo Sapiens
acaauggaguaaccgacaauagcaauuagucagcugauuugauuucagauaacucaguacagau

SEQ ID NO: 166411 - RNA, 64 nt, Homo Sapiens
gcaguaggcuuuuuuguauauuuuuuuaaaauauugauuugaaucaauauucuuuuuuaaaguu

SEQ ID NO: 166412 - RNA, 64 nt, Homo Sapiens
cauaugauugagagccauuuacuuagcacugucuugauuugaagucacuguuuaugcugcugga

SEQ ID NO: 166413 - RNA, 64 nt, Homo Sapiens
agucaagcucuuaagaaauaaagaagauaaacugugauuugacaagacacaacuugguuucaga

SEQ ID NO: 166414 - RNA, 64 nt, Homo Sapiens
uauaggugaggauucaggaggauuuuaaccaaaaugauuugaaaacaaaacaaaaaaaccaaug

SEQ ID NO: 166415 - RNA, 64 nt, Homo Sapiens
guuuucuauuuaacacugguugucaauuuauagcugauuugaagauucagacuuugcuauuugu

SEQ ID NO: 166416 - RNA, 64 nt, Homo Sapiens
guuuuauuuuguuccauguuuaaaucauucacuuugauuugagugggaaaagccugaagccuuu

SEQ ID NO: 166417 - RNA, 64 nt, Homo Sapiens
ugucagugauuuagaugauuuaaaaaugcaugugugauuugaauuuuauaauuguuuugacaag

SEQ ID NO: 166418 - RNA, 64 nt, Homo Sapiens
cgauugaagccaaaucuguugucauguuaguaaaugauuugaaaacugaauguaauacuugagu

SEQ ID NO: 166419 - RNA, 64 nt, Homo Sapiens
uucuuugacuuauuauuagcuuggcaguugcuuuugauuugauuguuuuaugacaugguauacu

SEQ ID NO: 166420 - RNA, 64 nt, Homo Sapiens
ucuguggcuugauauuuugcugugggugaaauuuugauuugagguauuagaaaauauuuuugug

SEQ ID NO: 166421 - RNA, 64 nt, Homo Sapiens
cauagguuaggagacuaaaauauaaauuaaguugugauuugaauguagauugguaucaccucca

SEQ ID NO: 166422 - RNA, 64 nt, Homo Sapiens
uuggcacacacugcagagccacgucguuaugauuugauuugaccuuacagggaggugauugagg

SEQ ID NO: 166423 - RNA, 64 nt, Homo Sapiens
ugaccuuggcacacacugcaugaggacgucguuaugauuugauuccgguuuacagggaggugau

SEQ ID NO: 166424 - RNA, 64 nt, Homo Sapiens
cuuaaauuucaaaccauuuaccaucugaaaguuuugauuugaauguaaaacaggaaauuggaau

SEQ ID NO: 166425 - RNA, 64 nt, Homo Sapiens
cugcuuugcucuacaaauaccuggggcagaaauuugauuugaaaaguauuauucucucuucucu

SEQ ID NO: 166426 - RNA, 64 nt, Homo Sapiens
uauuuuguagagaaacucaggaagauuuaaauguugauuugacagcucaauaggcuguuaccaa

SEQ ID NO: 166427 - RNA, 64 nt, Homo Sapiens
caaaaaaugguucuguuuuaaaaaggauuuuguuugauuugaaauuaaaacuucaagcugaaug

SEQ ID NO: 166428 - RNA, 64 nt, Homo Sapiens; identical to SEQ ID NO: 166426

SEQ ID NO: 166429 - RNA, 64 nt, Homo Sapiens
cgaaaaaugguucuguuuuaaaaaggauuuuguuugauuugaaauuaaaacuucaaacugaaug

SEQ ID NO: 166430 - RNA, 64 nt, Homo Sapiens
cuccucugugggccuggcagacccuucaugagugggacccaagauaucacugacuucaacccag

SEQ ID NO: 166431 - RNA, 64 nt, Homo Sapiens
ucaggcccagcuguccuagguugggcagguggguggacccaagcuugucugcugccugaguucc

SEQ ID NO: 166432 - RNA, 64 nt, Homo Sapiens
gaagagauagaaucagggcugcccccacagagugggacccaaggggcuaauuggaggcacgagg

SEQ ID NO: 166433 - RNA, 64 nt, Homo Sapiens
uccucuccccgcucuagguuucuucucccaaaggggacccaaggcugugacacuuaccuccacc

SEQ ID NO: 166434 - RNA, 64 nt, Homo Sapiens
gccaguggccaccugugcucagucugaagacguuggacccaaguuaggugugacacguucacac

SEQ ID NO: 166435 - RNA, 64 nt, Homo Sapiens
ggggccuccucagccucugcaacugcaagaaaggggacccaagaaaccaaagucugccgcccac

SEQ ID NO: 166436 - RNA, 64 nt, Homo Sapiens
accaaagcauuucuagucccuucucucuuucuaaggacccaaauuucccugggggcauccugcu

SEQ ID NO: 166437 - RNA, 64 nt, Homo Sapiens
gggaagacagauaaugaaguaggcaaagagaaaaggacccaagauagagguuuauauucagaaa

SEQ ID NO: 166438 - RNA, 64 nt, Homo Sapiens
guggggauaugauuuaaaucagccguguaaccauggacccaauauuuaccagaccacaaaacuu

SEQ ID NO: 166439 - RNA, 64 nt, Homo Sapiens
cacacuagcagcccugacuccacacuccuccuggggacccaagaggcaguguugcugucugcau

SEQ ID NO: 166440 - RNA, 64 nt, Homo Sapiens
aaauaauuugggggugauuugcaaugaaauuuugggacccaaagaguauccacuggggauguuu

SEQ ID NO: 166441 - RNA, 64 nt, Homo Sapiens
aguucugcaaagauguugauaugccuugcagcuuggacccaaugggugguggucagggccuggg

SEQ ID NO: 166442 - RNA, 64 nt, Homo Sapiens
ccccacuggagcagucugucgucagaaggccugaggacccaaggaugucacucaagaccaagcg

SEQ ID NO: 166443 - RNA, 64 nt, Homo Sapiens
gaggcgacagcuguggcuggcccuccucucgccuggacccaagaaugaggugccuuucccggaa

SEQ ID NO: 166444 - RNA, 64 nt, Homo Sapiens
ggggcuuucaacccucuccccaauggacccucggggacccaaguggagcuggccugagagggcu

SEQ ID NO: 166445 - RNA, 64 nt, Homo Sapiens
acugggaggggcuguuggcuaguuguuguaauuaggacccaagcugcaggaggcuuccagaagc

SEQ ID NO: 166446 - RNA, 64 nt, Homo Sapiens
caggcuguuccuuggggcggccugcagggcaccaggacccaaggggucugggaaaaagcuuuaa

SEQ ID NO: 166447 - RNA, 64 nt, Homo Sapiens
gaggaaaaguuguagcuaaaaaucuuuugaugcuggacccaagagggcauguucaugaauauca

SEQ ID NO: 166448 - RNA, 64 nt, Homo Sapiens
aaugaauauuccuaacuuagugugcuuauggaaaggacccaauagcagagggaugguuuuuaaa

SEQ ID NO: 166449 - RNA, 64 nt, Homo Sapiens
caauauguuccuuugaaaaguccugugaauggaaggacccaagcagaagaucuguuucccugug

SEQ ID NO: 166450 - RNA, 64 nt, Homo Sapiens
uaaaagaauggccaaacccuucugucacucacauggacccaagacuuucccaggccgcaccauu

SEQ ID NO: 166451 - RNA, 64 nt, Homo Sapiens
gucacaugcuaacagagguuuguaauuaucuuuuggacccaaauuauagagacauucacgaguu

SEQ ID NO: 166452 - RNA, 64 nt, Homo Sapiens
gagcagaaugagacaauuccuugggcuguaguuuggacccaacugaauccugagugcucugugg

SEQ ID NO: 166453 - RNA, 64 nt, Homo Sapiens
auguaaauaauauucauaaaaauugugacugagcggacccaagagggacaugugguuauuugga

SEQ ID NO: 166454 - RNA, 64 nt, Homo Sapiens
cacccccugaagccagcgauaccagcuacugaagggacccaagggcuuccugcagcucacgccc

SEQ ID NO: 166455 - RNA, 64 nt, Homo Sapiens
gcaauagcuggguuuacagacauuuaccaccugcggacccaaaagagaaggccuaggagaguuu

SEQ ID NO: 166456 - RNA, 64 nt, Homo Sapiens
ugugucccuacucauugaaaccaaacucuggaaaggacccaauguaccaguauuuauaccucua

SEQ ID NO: 166457 - RNA, 64 nt, Homo Sapiens
gucacuuccucguuuuaacucagcugaaacaccaggacccaauagagagggcaagcugagcauc

SEQ ID NO: 166458 - RNA, 64 nt, Homo Sapiens
gggaaagaggauuucccggggacaacuuauaaugggacccaaagagcagucuguugcuuccuag

SEQ ID NO: 166459 - RNA, 64 nt, Homo Sapiens
cauugaacaguuugggguaguuugugucuaaauuggacccaaaacuaggauuauaaaacauuuu

SEQ ID NO: 166460 - RNA, 64 nt, Homo Sapiens
uauauucauagauccucucaacuaauuauaaacaggacccaauucuuaaaguucauuauguaaa

SEQ ID NO: 166461 - RNA, 64 nt, Homo Sapiens
cacacaaaacaacccuagagaggcacaaaaugauggacccaauguuuuuguuguuauuucuuac

SEQ ID NO: 166462 - RNA, 64 nt, Homo Sapiens
ucuccuuaccgagaaggaccaaucccaccagccaggacccaaacuacuucccugacuggagcua

SEQ ID NO: 166463 - RNA, 64 nt, Homo Sapiens
gccccaggcccugcaaggugucugccccugcacaggacccaaagguccccaaccugccuucugc

SEQ ID NO: 166464 - RNA, 64 nt, Homo Sapiens
cuaaguuauuuacauguccauuguuuauuagccaggacccaagacccuuuuuucaguaaguaau

SEQ ID NO: 166465 - RNA, 64 nt, Homo Sapiens
ucaggaccuucguggagcuggucccauguacaguggacccaagcgaccuuccucuuuuggagcu

SEQ ID NO: 166466 - RNA, 64 nt, Homo Sapiens
uuugggugugaaauguugccaugucagguuagcaggacccaaguccuaaagagcagugaaggaa

SEQ ID NO: 166467 - RNA, 64 nt, Homo Sapiens
uagaauuuaggaauuuuguguccaaucucuucaaggacccaagagggggccacccaagucauag

SEQ ID NO: 166468 - RNA, 64 nt, Homo Sapiens
cuuaaaaguaauguaugcuuaugacaucuuccuuggacccaaaggcuuuugaaggagguaggga

SEQ ID NO: 166469 - RNA, 64 nt, Homo Sapiens
uucuggacuacuucagaauaugauucuaaauguaggacccaaguggauuucugugcuauaaacc

SEQ ID NO: 166470 - RNA, 64 nt, Homo Sapiens
ucuggccccuuggucugucaggcccagauccaggggacccaacuacgaaguauagagaacaggu

SEQ ID NO: 166471 - RNA, 64 nt, Homo Sapiens
gacuuccccagggugcacagcgaguaacagaucaggacccaaacuugggcagucugggcuggga

SEQ ID NO: 166472 - RNA, 64 nt, Homo Sapiens
guuaauauuucuauuaagaacauguugggcauguggacccaagcaccugggaaggagguggcau

SEQ ID NO: 166473 - RNA, 64 nt, Homo Sapiens
aucucuuugcugaauuaaugaguucuuaacauguggacccaacugccugugugagaucuguguc

SEQ ID NO: 166474 - RNA, 64 nt, Homo Sapiens
acucagaaaucaagaaccucucugaucacacgcaggacccaaacccaacugggaaaggaggccc

SEQ ID NO: 166475 - RNA, 64 nt, Homo Sapiens
ugccgcagcugaguggcccccccagaguggccugggacccaagcccuggcccaauuccucagac

SEQ ID NO: 166476 - RNA, 64 nt, Homo Sapiens
cuaaagcugucuaaauguuaagacgauggcuauaggacccaaaugcaacaucaaguaaaauuuu

SEQ ID NO: 166477 - RNA, 64 nt, Homo Sapiens
gaagaaaaggaagaaagaaaacauaagaaacaauggacccaagaaaggaacuguacuggcuauu

SEQ ID NO: 166478 - RNA, 64 nt, Homo Sapiens
cugcuucugugauauuaucugacaaaguuaaucaggacccaaguaacagauccuagccaucagu

SEQ ID NO: 166479 - RNA, 64 nt, Homo Sapiens
gaaaggaagggaagagugcugcaaagagauaguaggacccaagguugaaacgacaaauccagaa

SEQ ID NO: 166480 - RNA, 64 nt, Homo Sapiens
aaaccuguuuuuaacauguguuccacacccagaaggacccaagaccuuaaguuucccuguguug

SEQ ID NO: 166481 - RNA, 64 nt, Homo Sapiens
gaaaauucauuuucuuugcacuuugacaauuacuggacccaaaguucugaaucugcaaucauuc

SEQ ID NO: 166482 - RNA, 64 nt, Homo Sapiens
aauuaugcaauuagccucauaguuauuauccagaggacccaacugaacugaacuaauccuucug

SEQ ID NO: 166483 - RNA, 64 nt, Homo Sapiens
gggcagagccagaagaaggcucauuagaccugggggacccaaagggucuggccucuuugggcag

SEQ ID NO: 166484 - RNA, 64 nt, Homo Sapiens
cgggauggccuuggguacaucacucagccuuucuggacccaauuuuuccccagugaaagccaag

SEQ ID NO: 166485 - RNA, 64 nt, Homo Sapiens
ggagaaaucauaugaaaagcugugaaaggucacaggacccaauuuaggaaauguucaacaauuc

SEQ ID NO: 166486 - RNA, 64 nt, Homo Sapiens
ugccgcccuggcugugcugcuacuugaagccagaggacccaaaugggaugccgaggcaaugcug

SEQ ID NO: 166487 - RNA, 64 nt, Homo Sapiens
auuugcauuucuaacacauuguagaccucaggugggacccaaaacacccccagaguuugauaca

SEQ ID NO: 166488 - RNA, 64 nt, Homo Sapiens
aauguauuuauuugggagaccgggguauccugggggacccaauguaggagcugccuuggcucag

SEQ ID NO: 166489 - RNA, 64 nt, Homo Sapiens
ucuuccucacccucauccuuugggaggcugacuuggacccaaacugggcgacuagggcuuugag

SEQ ID NO: 166490 - RNA, 64 nt, Homo Sapiens
cucgcaguagaggaacuccugguggugggaagagggacccaauggacaaaaccguuuuuguuuu

SEQ ID NO: 166491 - RNA, 64 nt, Homo Sapiens
uccaguggccuccagcagaucaugaugacaucauggacccaauagcucauucacugccuugauu

SEQ ID NO: 166492 - RNA, 64 nt, Homo Sapiens
ucuguccaggugccccucauuucucauugcccacggacccaaccaagagagggaguaacauguc

SEQ ID NO: 166493 - RNA, 64 nt, Homo Sapiens
ggcgcccugcacacccguuuugcagucauaccgcggacccaaugucgaucucccaggcucuuuc

SEQ ID NO: 166494 - RNA, 64 nt, Homo Sapiens
ggaggcccaucaucuuccugagcccugguaccuuggacccaagaguuugauagcgucggcucag

SEQ ID NO: 166495 - RNA, 64 nt, Homo Sapiens
ucccgaggaaucugccucccuagccucuggccagggacccaaugcagggaaaauggagcccaag

SEQ ID NO: 166496 - RNA, 64 nt, Homo Sapiens
caggguggcgcggcugcugcucacugugcugcugggacccaagaguggggcgucgccccugcug

SEQ ID NO: 166497 - RNA, 64 nt, Homo Sapiens
ccagggcagcuggagcuuuguuggggagacuucuggacccaaagggagcuuucccaagaagccu

SEQ ID NO: 166498 - RNA, 64 nt, Homo Sapiens
aaccccucccuagcaucccaggugcccugacccaggacccaacauggucuagggaugcaggauc

SEQ ID NO: 166499 - RNA, 64 nt, Homo Sapiens
ucauuucccaggcuggcggaaguggcagggcugaggacccaaagagcugaugaugacagcagag

SEQ ID NO: 166500 - RNA, 64 nt, Homo Sapiens
aaucaucucaccuugagcccucuugaguagacuuggacccaaaaaccgaagacugggaugccug

SEQ ID NO: 166501 - RNA, 64 nt, Homo Sapiens
accuugaccucucggugccuucuggaaauauuguggacccaagaaccugaaggguuguguggag

SEQ ID NO: 166502 - RNA, 50 nt, Homo Sapiens
uuggccuguuugcaacagcuggacccaauacccaaguuggccccaacuga

SEQ ID NO: 166503 - RNA, 64 nt, Homo Sapiens
ucuucccaucucaaaaaaaaggguggagcaaggaggacccaaguccauucucaccaugcagggu

SEQ ID NO: 166504 - RNA, 64 nt, Homo Sapiens
cgguuugaauacgucacuuaccagugccauugcaggacccaaauucacaguucauaaaagaugu

SEQ ID NO: 166505 - RNA, 64 nt, Homo Sapiens
auuuguccacuguuucuugucaucacgcagcccuggacccaaagggugaacuaaaguuuaagga

SEQ ID NO: 166506 - RNA, 64 nt, Homo Sapiens
aaccuuugggagugccuuuuuuguuuuucaagauggacccaaaaaaguggaggaagauauuguu

SEQ ID NO: 166507 - RNA, 64 nt, Homo Sapiens
uagaugaugagaaaaugccacuccucuagugcagggacccaagucuccgccaacccauuccuac

SEQ ID NO: 166508 - RNA, 64 nt, Homo Sapiens
cauacagauucacaaaauuacauccagguacuaaggacccaaggauuuuugauuuguaagaggc

SEQ ID NO: 166509 - RNA, 64 nt, Homo Sapiens
agucgaggucuuuaaugugcugaagcagccacagggacccaagcgaauaaccaggacagccaag

SEQ ID NO: 166510 - RNA, 64 nt, Homo Sapiens
agagaagcucucgggcuaggggcuuggaaccguaggacccaagcaugagaagaaaauggaacca

SEQ ID NO: 166511 - RNA, 64 nt, Homo Sapiens
accugcagccaccagugcuuguugccauggauggggacccaaagagcugaccacggagcugggg

SEQ ID NO: 166512 - RNA, 64 nt, Homo Sapiens
cgggcuuugggggcgucaggucuuuccaagguugggacccaaggaucggggggcccagcagccc

SEQ ID NO: 166513 - RNA, 64 nt, Homo Sapiens
cuaugcucaguuccacagaacauuuauauucuauggacccaaguccaaggcaucuccuacucuc

SEQ ID NO: 166514 - RNA, 64 nt, Homo Sapiens
ugucaggguauaaacacuaugccuuauuuuucuuggacccaaacuacuaaaucuacaacagcuc

SEQ ID NO: 166515 - RNA, 64 nt, Homo Sapiens
ggauggagacaggaccacagaagaaaaaucaagaggacccaaggggggaaagcuguuuggcaga

SEQ ID NO: 166516 - RNA, 64 nt, Homo Sapiens
cacugcugguuuucaauuuucagagguuucagggggacccaaaucugggcccaccuccgauuca

SEQ ID NO: 166517 - RNA, 64 nt, Homo Sapiens
cuugggauuuccuuuccaaagcacaaaaauacugggacccaagaagaacagcuagaggacaacu

SEQ ID NO: 166518 - RNA, 64 nt, Homo Sapiens
aagccugcaaaucucccucuuguggaauuccacuggacccaaucuguuuuccauuuccauugca

SEQ ID NO: 166519 - RNA, 64 nt, Homo Sapiens
gcugccagauccacucacucugcugccuccagcaggacccaaggccacuuucaacucuuauggg

SEQ ID NO: 166520 - RNA, 58 nt, Homo Sapiens
gccaauucaaaagcaauuaauuggcuuaggacccaauuuccauagaugcaaauggcag

SEQ ID NO: 166521 - RNA, 64 nt, Homo Sapiens
caugacuggagcacagccuccugccucccagcccggacccaaugcacuuucuugucuccucuaa

SEQ ID NO: 166522 - RNA, 64 nt, Homo Sapiens
ggcucuccagcccuuccgucuuauugaaucugcuggacccaagcggcaccccacacaaaccuau

SEQ ID NO: 166523 - RNA, 64 nt, Homo Sapiens
guguuugccuguugacgugcuugccacagugcauggacccaauuauuguaaggaaugaacaagg

SEQ ID NO: 166524 - RNA, 64 nt, Homo Sapiens
gcaauacuguaauguaaagaaagguugagugccuggacccaaagcugugacucaugccauagac

SEQ ID NO: 166525 - RNA, 64 nt, Homo Sapiens
aaaacugcauggagacgcauaggccuuaagcuuuggacccaagguuuucuuggcccccuuccca

SEQ ID NO: 166526 - RNA, 64 nt, Homo Sapiens
uugaaaacccaaggcagguucuuugccucaaguuggacccaagaguccuaaauacccuagaguu

SEQ ID NO: 166527 - RNA, 64 nt, Homo Sapiens
cccucucucuccucccuguuccgugguagagccgggacccaaucuccuggggaaagugacuggu

SEQ ID NO: 166528 - RNA, 64 nt, Homo Sapiens
ucccuugaguggaauucugcgcagcucggcuccuggacccaagaguccuucuccacugauacug

SEQ ID NO: 166529 - RNA, 64 nt, Homo Sapiens
gcaaaccuugaugaagcaccugcuggacacugagggacccaaagcucaaucagccauaaucccu

SEQ ID NO: 166530 - RNA, 64 nt, Homo Sapiens
accaccuggcaauaugacucacuugaccccuaugggacccaaaugggcacuuucuugucugaga

SEQ ID NO: 166531 - RNA, 64 nt, Homo Sapiens
aagccgugagugucauagaacucuacggcauccuggacccaaccacccgagacuggacagaugg

SEQ ID NO: 166532 - RNA, 64 nt, Homo Sapiens
cugaacguggaauucaccugagaccuuggggaugggacccaaguauauuuguauacacauaaug

SEQ ID NO: 166533 - RNA, 64 nt, Homo Sapiens
ugucuucugcuaagcucagacuagcaauauauaaggacccaaaaucaagaauuauacaauccua

SEQ ID NO: 166534 - RNA, 64 nt, Homo Sapiens
acuuuccaaucucagucacuguugcaaacccaaaggacccaaguacccagaaacaacacaaucc

SEQ ID NO: 166535 - RNA, 64 nt, Homo Sapiens
gcuugcuuaagccccagugcccugucuguggcagggacccaagcaugugugcagcaugacucuc

SEQ ID NO: 166536 - RNA, 64 nt, Homo Sapiens
ccugaccuaggcugcuauccccagcuguggcuucggacccaaggaggagcucagacucuuagag

SEQ ID NO: 166537 - RNA, 64 nt, Homo Sapiens
gcagcauguucuggaagccucaagucaaugccaaggacccaacucuccugaggagcuucaguug

SEQ ID NO: 166538 - RNA, 64 nt, Homo Sapiens
gugaacaacacucagcccgcacaacagcgauucaggacccaaguaaagugugucucuguaccuu

SEQ ID NO: 166539 - RNA, 64 nt, Homo Sapiens
gcccacgugcucagccacccaacucugcugauggggacccaagcaaacaccaaacacacuaugg

SEQ ID NO: 166540 - RNA, 64 nt, Homo Sapiens
caggaugaccacgcaccuccgccagggcggccagggacccaaagguggcagccacacgcaggcg

SEQ ID NO: 166541 - RNA, 64 nt, Homo Sapiens
caagugucuucacuaagcguauggccaauaaaugggacccaaacguucaaucuguucaguuuac

SEQ ID NO: 166542 - RNA, 64 nt, Homo Sapiens
cacaggaagucagucacguucaccaacacaguugggacccaaaacuauaccaaccaaaccaauu

SEQ ID NO: 166543 - RNA, 64 nt, Homo Sapiens
gaaaaugaugcaagaaaaucaaaugggaaucuggggacccaacacaacauccugaagauuauua

SEQ ID NO: 166544 - RNA, 64 nt, Homo Sapiens
uauuugcauagcauaaugagauaucuugggaaugggacccaaaucuaaacacaaaauucauuua

SEQ ID NO: 166545 - RNA, 64 nt, Homo Sapiens
ucacacagaccauuucauuuuuaccagggcuuggggacccaaugcaaagaugaugacuauuuaa

SEQ ID NO: 166546 - RNA, 64 nt, Homo Sapiens
uccaaggggaugcuucccucuaucuguucaccagggacccaaaagcuggagagacccaagaccc

SEQ ID NO: 166547 - RNA, 64 nt, Homo Sapiens
uuuaugggagaagggcaaagccaagguucuccugggacccaaagcugagccuagccuucagcaa

SEQ ID NO: 166548 - RNA, 64 nt, Homo Sapiens
gaagacugcagcagacuacaaggcagugccaguuggacccaagagggccucccaauagacuaac

SEQ ID NO: 166549 - RNA, 64 nt, Homo Sapiens
ccgcauugccucuugcagaucccacugauccuugggacccaacguugcucuuuugaacacccuc

SEQ ID NO: 166550 - RNA, 64 nt, Homo Sapiens
aacuucacagcacacuuacccccccaggagacugggacccaaagagucuccugagccuguagag

SEQ ID NO: 166551 - RNA, 64 nt, Homo Sapiens
cagccacugaagagagagucgggucugaaaaucaggacccaaccggggagugugggcaugggag

SEQ ID NO: 166552 - RNA, 64 nt, Homo Sapiens
acuaaccacguuuacacgacuuuuuggaaacugaggacccaacagccaucagaacugcccggcu

SEQ ID NO: 166553 - RNA, 64 nt, Homo Sapiens
acugaaaacauaaauacugaccacuccuauguucggacccaagcaaguuagcuaaaccaaacca

SEQ ID NO: 166554 - RNA, 64 nt, Homo Sapiens
agacuuaaaauguaucaccacuaaccugugagggggacccaaucuggacuccuuccccgccuug

SEQ ID NO: 166555 - RNA, 64 nt, Homo Sapiens
augcuguuaaaagaggaggaaacuacuugaggagggacccaacuuuccgcuaucuuuuggguuc

SEQ ID NO: 166556 - RNA, 64 nt, Homo Sapiens
aauaucaacaguggcaaucagcacacagaggaaaggacccaaaucacuauguagcuuaaagauu

SEQ ID NO: 166557 - RNA, 64 nt, Homo Sapiens
guuggcacugcggcccucaccagguccugggcucggacccaacuccuggaccuuuccagccugu

SEQ ID NO: 166558 - RNA, 64 nt, Homo Sapiens
cuggugccuggggcuaaggcgacggagguggaucggacccaagguucccgaaggagcagcugcg

SEQ ID NO: 166559 - RNA, 64 nt, Homo Sapiens
cuaggaaagggcugcuugaguccucaacuguccuggacccaaggaguuagaaucucugggccuc

SEQ ID NO: 166560 - RNA, 64 nt, Homo Sapiens
ugcggcacuguugaauaaagguugaaaaagcccuggacccaaacgaggcaaugccauuucuaga

SEQ ID NO: 166561 - RNA, 64 nt, Homo Sapiens
ucccugccuagacuguugacguccccugggaaggggacccaaggaugaauuggcugugaaggau

SEQ ID NO: 166562 - RNA, 64 nt, Homo Sapiens
cuguauuaggcggccgaggucacucugggccuggggacccaaacccccugcagcccaggccagu

SEQ ID NO: 166563 - RNA, 64 nt, Homo Sapiens
ggaggcugagcugcaucccugcuccccacauggaggacccaacaggaggccguggcucugaugc

SEQ ID NO: 166564 - RNA, 64 nt, Homo Sapiens
gagugccgugcugaggcugcgugagccuggaagaggacccaagaccucuccgcugucgcccagu

SEQ ID NO: 166565 - RNA, 64 nt, Homo Sapiens
ccggcccauugacguggcgcuccucgauuacuggggacccaauuuuccccacaggugaccgaga

SEQ ID NO: 166566 - RNA, 64 nt, Homo Sapiens
cagcucugacucucuagguuuccacaauaaaaauggacccaacugcuuauccucuaagcccuga

SEQ ID NO: 166567 - RNA, 64 nt, Homo Sapiens
caggaagccaaucagccaaagaaaauggugaucuggacccaagagaccaguagucacccugcuu

SEQ ID NO: 166568 - RNA, 64 nt, Homo Sapiens
uugaggccccaacaugacagccacugggccaccgggacccaagaagacagcccccugccccauc

SEQ ID NO: 166569 - RNA, 64 nt, Homo Sapiens
uugcgucuuuugcccaccccccuggcauucagcuggacccaacuaggccaucaugaguggcuuc

SEQ ID NO: 166570 - RNA, 64 nt, Homo Sapiens
cccccaucaaguuuggugggcagagcuacagaugggacccaagggaguggccgagccucacugc

SEQ ID NO: 166571 - RNA, 64 nt, Homo Sapiens
ucuucuuuagaucggucugauugauuuuaaaaguggacccaaacuuagggaauucuugauuuag

SEQ ID NO: 166572 - RNA, 64 nt, Homo Sapiens
ugacccugaucacccucuggguguacguguacguggacccaaacaaugugcuggacgccgagaa

SEQ ID NO: 166573 - RNA, 64 nt, Homo Sapiens
cuaguuccgucacuagagucuaguggugccccagggacccaagaaaccaccgaugccgagaggc

SEQ ID NO: 166574 - RNA, 64 nt, Homo Sapiens
ccaccccaccugucuucaucgccugggcagguggggacccaacuuagaccccuguggccccuga

SEQ ID NO: 166575 - RNA, 64 nt, Homo Sapiens
cggugucgcugcacccgcccugucgcgggcgcagggacccaaccccgcauuccaagaaguaguc

SEQ ID NO: 166576 - RNA, 64 nt, Homo Sapiens
gucuuggcaggggugcugugggcagaagagcccaggacccaagcugucuccuugcuccaaugga

SEQ ID NO: 166577 - RNA, 64 nt, Homo Sapiens
cucugaagucuacgauggagcuucucucacagggggacccaauugucaguugugcccagccuac

SEQ ID NO: 166578 - RNA, 64 nt, Homo Sapiens
cucagucccucugcucucaggaggaggggcugcuggacccaaggcggcaguucccugcaggaga

SEQ ID NO: 166579 - RNA, 64 nt, Homo Sapiens
gcuuccagaugacaauugcagccccuuccuccagggacccaagcacucccuuucccccucccuu

SEQ ID NO: 166580 - RNA, 64 nt, Homo Sapiens
gggccccagaagagccacaguugggaagggccauggacccaacucgagggccucccagcagagc

SEQ ID NO: 166581 - RNA, 64 nt, Homo Sapiens
gugcuggaaaaaguucaucuuuuugggauugcuaggacccaaugauucuuucuuucaggugaaa

SEQ ID NO: 166582 - RNA, 64 nt, Homo Sapiens
agagcaaauguguuaggagagaagguuucacaugggacccaacauccuucaucaauacuuuccu

SEQ ID NO: 166583 - RNA, 64 nt, Homo Sapiens
uuuggccuauagacacuuaucuugcugcuaaaugggacccaauuuuuccaaauaauuugaacag

SEQ ID NO: 166584 - RNA, 64 nt, Homo Sapiens
uccugcagccacacacccacccgggguguccuggggacccaaggggugggggggucacaccaga

SEQ ID NO: 166585 - RNA, 64 nt, Homo Sapiens
ucgcugaguggccucaggcagugaccacgcucccggacccaaccuucagcuugcccaaagcaau

SEQ ID NO: 166586 - RNA, 64 nt, Homo Sapiens
gagggcauagguuacacccuacagaauaaagaagggacccaaagccucuuuuugccucccggaa

SEQ ID NO: 166587 - RNA, 64 nt, Homo Sapiens
ugauuuuacuuuccuuaaagacucagaaagacuuggacccaaggaguggggauacagugagaau

SEQ ID NO: 166588 - RNA, 64 nt, Homo Sapiens
cuucucccaguccaagaccccaaaucaccacaaaggacccaauccccagacucaagauaugguc

SEQ ID NO: 166589 - RNA, 64 nt, Homo Sapiens
uuuguaggggcacuaauccaaccaugaucuugagggacccaacacuuucuuggccgugagccua

SEQ ID NO: 166590 - RNA, 64 nt, Homo Sapiens
aauucacaaugagaaauuacucugugacuuacagggacccaaucugaagggacucaggacaggc

SEQ ID NO: 166591 - RNA, 64 nt, Homo Sapiens
ggaacgugucucucuccaagugagugcugcuauuggacccaaaaguaucugaacucucagguug

SEQ ID NO: 166592 - RNA, 64 nt, Homo Sapiens
gugccguuuguccccucucuacccuccucuucacggacccaacugcucucuugugagcucuugg

SEQ ID NO: 166593 - RNA, 64 nt, Homo Sapiens
ccugcauccccacaugcgggagcaagugccggcuggacccaagcucagcacacgccuuguuacg

SEQ ID NO: 166594 - RNA, 64 nt, Homo Sapiens
gaaauagcaguggggaagcauagugguagcaccaggacccaaagacaucgggcuguuuugcauu

SEQ ID NO: 166595 - RNA, 64 nt, Homo Sapiens
auccaggaggcacuugugacaucguuuuccgccaggacccaaaguggcaauuugagagucuggc

SEQ ID NO: 166596 - RNA, 64 nt, Homo Sapiens
ugccaaaggcuccaggccucuccccugcaacucaggacccaagcccagcucacucugggaacug

SEQ ID NO: 166597 - RNA, 64 nt, Homo Sapiens
gcaucccaaagcuucgauggagagcagggaagggggacccaaggcaggagguacaccagcugga

SEQ ID NO: 166598 - RNA, 64 nt, Homo Sapiens
aaaaaaauaguuuuuucauuaguauuucucgggaggacccaaaaguuaaggucagcuuguucac

SEQ ID NO: 166599 - RNA, 64 nt, Homo Sapiens
uauaggagcaguggacugcuaaagaaggaagggaggacccaauccaggaagaaaggaaggaagg

SEQ ID NO: 166600 - RNA, 64 nt, Homo Sapiens
uguguguguguacauguguguuuaguuauaaggaggacccaaaaugcucacaaggacuuuugau

SEQ ID NO: 166601 - RNA, 62 nt, Homo Sapiens
ccuagaucccaccaacucggacaggcuggccaggacccaaccggccagggcaagccaacuag

SEQ ID NO: 166602 - RNA, 64 nt, Homo Sapiens
uccaaauuaucaguuaaucguauaucuuacaguuggacccaaauauuaauuucuccauucuguu

SEQ ID NO: 166603 - RNA, 64 nt, Homo Sapiens
ucuguuuuauauguucaugacacucaagguggcaggacccaauuuuuaggaccucagaauccug

SEQ ID NO: 166604 - RNA, 64 nt, Homo Sapiens
aggacugcgugggcgcgggagccucagcugcuucggacccaaccacacgcuguaccccaugguc

SEQ ID NO: 166605 - RNA, 64 nt, Homo Sapiens
agacccuccagcuaaaaacagagccugaguucagggacccaaguggugagcggcgucuuuuggg

SEQ ID NO: 166606 - RNA, 64 nt, Homo Sapiens
ccaaccugauucugaugacugcggaugcugugacggacccaaggggcaaauagggucccagggu

SEQ ID NO: 166607 - RNA, 64 nt, Homo Sapiens
gguggcaggcaguggacaggccucagaagccucaggacccaacacccauccuuguccuucucuc

SEQ ID NO: 166608 - RNA, 64 nt, Homo Sapiens
aggucccaagcuccauuggauuuugaaccucauuggacccaacccuccuaagcgacuggccccc

SEQ ID NO: 166609 - RNA, 64 nt, Homo Sapiens
uccccuguuugccucugaaacgucugguuaguggggacccaaagauucuagugagucaacaucc

SEQ ID NO: 166610 - RNA, 52 nt, Homo Sapiens
aagaucucugcucugcuuaaugggacccaaggucucagagcacaggcauauu

SEQ ID NO: 166611 - RNA, 64 nt, Homo Sapiens
gaggagagcuacuuguuuaaaaauccacauucuuggacccaauccucagaugcacggauucagu

SEQ ID NO: 166612 - RNA, 64 nt, Homo Sapiens
agcaaauacuucugagaagauuaauaagagaucuggacccaaaagggggagacaugccuggacc

SEQ ID NO: 166613 - RNA, 64 nt, Homo Sapiens
guggcugaagaccuuucuggcagggcauuugcaaggacccaaauccauucaacaagggugcagc

SEQ ID NO: 166614 - RNA, 64 nt, Homo Sapiens
gaaaagugagccaagcagaaggaggugggaaaacggacccaaaccccagugugcccugccccau

SEQ ID NO: 166615 - RNA, 64 nt, Homo Sapiens
uggucuuggagaggaggugugagaggacaguuuaggacccaagggauugggggggcuuggggua

SEQ ID NO: 166616 - RNA, 64 nt, Homo Sapiens
gucucaagccugcaaguccacagugcaggacgggggacccaaggccucccagucaggggucguc

SEQ ID NO: 166617 - RNA, 64 nt, Homo Sapiens
aggagagauauuuugauucucaacuaucauaccuggacccaaagucagauaccaugcaauaaua

SEQ ID NO: 166618 - RNA, 64 nt, Homo Sapiens; identical to SEQ ID NO: 164780

SEQ ID NO: 166619 - RNA, 64 nt, Homo Sapiens; identical to SEQ ID NO: 164781

SEQ ID NO: 166620 - RNA, 64 nt, Homo Sapiens; identical to SEQ ID NO: 164782

SEQ ID NO: 166621 - RNA, 64 nt, Homo Sapiens; identical to SEQ ID NO: 164783

SEQ ID NO: 166622 - RNA, 64 nt, Homo Sapiens; identical to SEQ ID NO: 164784

SEQ ID NO: 166623 - RNA, 64 nt, Homo Sapiens; identical to SEQ ID NO: 164785

SEQ ID NO: 166624 - RNA, 64 nt, Homo Sapiens; identical to SEQ ID NO: 164786

SEQ ID NO: 166625 - RNA, 64 nt, Homo Sapiens; identical to SEQ ID NO: 164787

SEQ ID NO: 166626 - RNA, 64 nt, Homo Sapiens; identical to SEQ ID NO: 164788

SEQ ID NO: 166627 - RNA, 64 nt, Homo Sapiens; identical to SEQ ID NO: 164789

SEQ ID NO: 166628 - RNA, 64 nt, Homo Sapiens; identical to SEQ ID NO: 164790

SEQ ID NO: 166629 - RNA, 64 nt, Homo Sapiens; identical to SEQ ID NO: 164791

SEQ ID NO: 166630 - RNA, 64 nt, Homo Sapiens; identical to SEQ ID NO: 164792

SEQ ID NO: 166631 - RNA, 64 nt, Homo Sapiens; identical to SEQ ID NO: 164793

SEQ ID NO: 166632 - RNA, 64 nt, Homo Sapiens
cuuugacauuuaaagagaaagcgguucuccuagcugcagcaauaauuuccucaaguuuccaugu

SEQ ID NO: 166633 - RNA, 64 nt, Homo Sapiens
ccuggauucagaguguuaaaaccuagcauaggguugcagcaagcagaggagagaggccugaguc

SEQ ID NO: 166634 - RNA, 64 nt, Homo Sapiens
agguuuuuccucccuguugauggaugccagcagcugcagcaagccacacccaaaaucaagggcc

SEQ ID NO: 166635 - RNA, 64 nt, Homo Sapiens
agaauacacaaucuuaaccaccuuucccucauucugcagcaaucuauaagaucgaauuuaauuu

SEQ ID NO: 166636 - RNA, 64 nt, Homo Sapiens
uugguuagcucacccaucagcuaugcccucacagugcagcaaccugggggcugaggggcagccc

SEQ ID NO: 166637 - RNA, 64 nt, Homo Sapiens
gcauuuagcugccuucccagcuuccuggcccccaugcagcaacucccagccacgucuccaaaug

SEQ ID NO: 166638 - RNA, 64 nt, Homo Sapiens
agcccagucccucggagcugcagacagcagguccugcagcaacaauaccugcacggcuuugcac

SEQ ID NO: 166639 - RNA, 64 nt, Homo Sapiens
ggaggccuccgugcacugagagauguacuaggauugcagcaaagguggucagggugaugggccg

SEQ ID NO: 166640 - RNA, 64 nt, Homo Sapiens
cuuuuuauauuaaugacuauugaaagugguaauaaaaauuuauauuauaggcuucaauguuuuc

SEQ ID NO: 166641 - RNA, 64 nt, Homo Sapiens
acccaaaaagcuguguuuucuuuggucagaggucaaaauuuaugaaaaacaaaaugcuguauga

SEQ ID NO: 166642 - RNA, 64 nt, Homo Sapiens
gggcccucagaaguucuccuuaaauuuuucaauaaaaauuuagcucuuaaaaaaauaacagugu

SEQ ID NO: 166643 - RNA, 64 nt, Homo Sapiens
aucugacaggagcauucugaagccccauuaggaaaaaauuuaaaugguuccucuucaucgccuu

SEQ ID NO: 166644 - RNA, 64 nt, Homo Sapiens
cugcuuauaauaauccaggaucguaaaaggacaaaaaauuuaaaggcagucuuaugugcaaaga

SEQ ID NO: 166645 - RNA, 64 nt, Homo Sapiens
acugcuauuuuucuuauagacauaaaagauauaaaaaauuuaaaauuuugcauuuaaaugauaa

SEQ ID NO: 166646 - RNA, 64 nt, Homo Sapiens
uucauuauauaaaugaaacucuguugauuguguaaaaauuuauuaaaaaaaucuugguguguuu

SEQ ID NO: 166647 - RNA, 64 nt, Homo Sapiens
uaaaaauauuuuucgcaaaagaauguaagaaaaaaaaauuuauucuuguuacauauguauauca

SEQ ID NO: 166648 - RNA, 64 nt, Homo Sapiens
gugaacuuuaucugugucuguuauaucauagauuaaaauuuauauuuuaucuuuagguaauauu

SEQ ID NO: 166649 - RNA, 64 nt, Homo Sapiens
ccuuuauuccgauaaucucaaauaauggaaauugaaaauuuaacaagucuaauuuuacagauag

SEQ ID NO: 166650 - RNA, 64 nt, Homo Sapiens
ugggauuauaugaauuuauagauuacuucuugauaaaauuuaaacacugcagaaauauuuaaca

SEQ ID NO: 166651 - RNA, 64 nt, Homo Sapiens
aaugcuuuuuaauguguuuuuggugucagugagaaaaauuuaucgaacaaauguugcucagggc

SEQ ID NO: 166652 - RNA, 64 nt, Homo Sapiens
ugcucacuugaauauuuauggaacuauuaaauagaaaauuuaaaaaucugacuucaagaauucu

SEQ ID NO: 166653 - RNA, 64 nt, Homo Sapiens
uuaacauauuuguguauauuaaauaugaauuuuuaaaauuuauaaauacuauuuuccaaaagua

SEQ ID NO: 166654 - RNA, 64 nt, Homo Sapiens
ccuuucagcauuuacagugaaaagugagaauuuuaaaauuuaugaaaucuauauuccagguauu

SEQ ID NO: 166655 - RNA, 64 nt, Homo Sapiens
aagacuugcuuuaaauagauuucagcuaugcagaaaaauuuagcuuaugcuuccauauuuuuaa

SEQ ID NO: 166656 - RNA, 64 nt, Homo Sapiens
cuuuugaauaaaagaucauucaacuaaaaauauuaaaauuuauuucacuggaugguaauguaac

SEQ ID NO: 166657 - RNA, 64 nt, Homo Sapiens
augaaaugcuaguucuuuuaaccccuuuagaaauaaaauuuaucuccaauaacagaacuguaug

SEQ ID NO: 166658 - RNA, 64 nt, Homo Sapiens
uucucauuauagucuaaaaguagcaauuguuaauaaaauuuaguuaaucuuucaggaacuaaaa

SEQ ID NO: 166659 - RNA, 64 nt, Homo Sapiens
gguucuugcucuggaugagcagcaugacaccaucaaaauuuaagaccaugaugaaauuucaguu

SEQ ID NO: 166660 - RNA, 64 nt, Homo Sapiens
augaugaaauuucaguuucauucaaauguuaccuaaaauuuauggugucagaauaaagggagau

SEQ ID NO: 166661 - RNA, 64 nt, Homo Sapiens
uuguuuuauacuucuaugcuauauuuugcuauucaaaauuuagugggcauuacuuaacauuguu

SEQ ID NO: 166662 - RNA, 64 nt, Homo Sapiens
aaaggcaauagccaauaaaacauuuuuaauuuuaaaaauuuacuguguuuggcuuucuguaaau

SEQ ID NO: 166663 - RNA, 64 nt, Homo Sapiens
cagccacugggcucuuucacuuuuuuaguucuuaaaaauuuauuuuuaaguucuaaaauaaaau

SEQ ID NO: 166664 - RNA, 64 nt, Homo Sapiens
uuuaaguucuaaaauaaaauaaaaauaaguucuuaaaauuuauuuuuuuccugaauaaauugua

SEQ ID NO: 166665 - RNA, 64 nt, Homo Sapiens
auuauaagaagaucuagauccuagauauuagaauaaaauuuauuuucuacuguauccauuucaa

SEQ ID NO: 166666 - RNA, 64 nt, Homo Sapiens
caaaaaaaucuucaaaacaaguauugacuuucacaaaauuuaaaucauaaacaggcaaaccaaa

SEQ ID NO: 166667 - RNA, 64 nt, Homo Sapiens
uauaggcagcagcaaaagagaagaaaauuaauaaaaaauuuauaauucaagaucuucccaauac

SEQ ID NO: 166668 - RNA, 64 nt, Homo Sapiens
acucuuaugucaagauguuguccccagaaauuaaaaaauuuaaauugggcagcagggaggaaag

SEQ ID NO: 166669 - RNA, 64 nt, Homo Sapiens
ucauguguauacaauuuuuuguuaaaauuuaaaaaaaauuuaaauauuaagauugccaaaaacu

SEQ ID NO: 166670 - RNA, 64 nt, Homo Sapiens
aaaaauuuaaaucauguguaugccaaaaacuguuaaaauuuaaaauauuguacuuuauuaagau

SEQ ID NO: 166671 - RNA, 64 nt, Homo Sapiens
aguucuaaaaagauguaauaaucauuuuagaauuaaaauuuauucuacuuuuaaauaaauuaug

SEQ ID NO: 166672 - RNA, 64 nt, Homo Sapiens
uuuuaaaauuuguagaauugaaaagacgcuaauaaaaauuuauuauuuauuugucaugacucaa

SEQ ID NO: 166673 - RNA, 64 nt, Homo Sapiens
aaccuaaauacugacugcuggacauaaaucacagaaaauuuaacuuaagaaaauuuacaaaauu

SEQ ID NO: 166674 - RNA, 64 nt, Homo Sapiens
ugcuggacauaaaucacagaaaauuuaacuuaagaaaauuuacaaaauuuauucucagguaauc

SEQ ID NO: 166675 - RNA, 64 nt, Homo Sapiens
uaaaucacagaaaauuuaacuuaagaaaauuuacaaaauuuauucucagguaaucauuuuaaua

SEQ ID NO: 166676 - RNA, 64 nt, Homo Sapiens
auauauauuaugcaagucaggaaucauuaauuucaaaauuuaaagccaugcuaaaauuaaaaag

SEQ ID NO: 166677 - RNA, 64 nt, Homo Sapiens
uuauaauucagucauucucuauauaggacuucuuaaaauuuagaagggaaaucuagcuacuuca

SEQ ID NO: 166678 - RNA, 64 nt, Homo Sapiens
gggggaaagugcugcugauaugauacaaguagacaaaauuuaaaugaaauuuugucacauucua

SEQ ID NO: 166679 - RNA, 64 nt, Homo Sapiens
agcauuuguauuauuuuuuaaaauuagauaaauaaaaauuuauaggagaaacaaaauccucagg

SEQ ID NO: 166680 - RNA, 64 nt, Homo Sapiens
uaggcauggcggcgcaugccuaaaaaugcaaaaaaaaauuuagcuggagaagccccgucucuac

SEQ ID NO: 166681 - RNA, 64 nt, Homo Sapiens
auuucacaaaacuaaggguacauuuaaaauuuuaaaaauuuaaauuaaaauuuaaauuuucagu

SEQ ID NO: 166682 - RNA, 64 nt, Homo Sapiens
uuuucagucauuuaaaauuuuguuucagucauuuaaaauuuaaagaauaauaauguuuaaauuu

SEQ ID NO: 166683 - RNA, 64 nt, Homo Sapiens
auuuaaaauuucuacuucccuuaggcauuuuauaaaaauuuaaaaauuauuuuucuauuuuguu

SEQ ID NO: 166684 - RNA, 64 nt, Homo Sapiens
uauuuucuuuauuguugguaaacuccauauuuuaaaaauuuaccuguauacauagugcuuaaug

SEQ ID NO: 166685 - RNA, 64 nt, Homo Sapiens
cuuuaauaaauauuaugaaaaaaaugaaauauagaaaauuuagauggacacuuguauuuccuaa

SEQ ID NO: 166686 - RNA, 64 nt, Homo Sapiens
cauaauuucacuuuacuuucuguuuaggcauggaaaaauuuaucagucagaauugcuguuuuag

SEQ ID NO: 166687 - RNA, 64 nt, Homo Sapiens
uuuucaaaucauuagcacaauauuuaaauaucuaaaaauuuaagagauccauacuuucuguagc

SEQ ID NO: 166688 - RNA, 64 nt, Homo Sapiens
ggcauauuguaguccugucauuuaaguuauguaaaaaauuuaaucauuauuuugaugcuuuaaa

SEQ ID NO: 166689 - RNA, 64 nt, Homo Sapiens
auacagcucuaccuaggauuguacaguuuaccauaaaauuuacuucaugaaagugggaaucacu

SEQ ID NO: 166690 - RNA, 64 nt, Homo Sapiens
ggacagacuuugaauauacucuaaaaguggacagaaaauuuacgaaaaucuuagauuuuguuua

SEQ ID NO: 166691 - RNA, 64 nt, Homo Sapiens
acuauuauuccuuccuuagaaguugauguaucagaaaauuuauaaguuauuuguauuuauauau

SEQ ID NO: 166692 - RNA, 64 nt, Homo Sapiens
uacacucagguuugaacagauuauucugaauauuaaaauuuaauccauucuuaauauuuuaaaa

SEQ ID NO: 166693 - RNA, 64 nt, Homo Sapiens
uaaguggguuaauugauacaaguuucugugguggaaaauuuaugcagguuuucacgaauccuuu

SEQ ID NO: 166694 - RNA, 64 nt, Homo Sapiens
aaacaguguaagcuguugaauaugaagaguuaaaaaaauuuaaacuagggaucagggaguuuag

SEQ ID NO: 166695 - RNA, 64 nt, Homo Sapiens
acaaucauguauuauaugugucaggugucucugaaaaauuuauauuaguuucuuaagugaguuu

SEQ ID NO: 166696 - RNA, 64 nt, Homo Sapiens
gaaccauaucaacacugacaaauuaaaaaaauuaaaaauuuauauuaaaaauuuuaaaaauuua

SEQ ID NO: 166697 - RNA, 64 nt, Homo Sapiens
uuaaaaaaauuaaaaauuuaaauuaaaaauuuuaaaaauuuaaaaaaaauuuuaaauuuuaaag

SEQ ID NO: 166698 - RNA, 64 nt, Homo Sapiens
auuuagauuuacuuaauuguuggauauauguguuaaaauuuaacauuguaauuguguacauaau

SEQ ID NO: 166699 - RNA, 64 nt, Homo Sapiens
cuaaucaaaguugugugaugacauuuaugguauaaaaauuuaaagucaauauuuugagcuuaga

SEQ ID NO: 166700 - RNA, 64 nt, Homo Sapiens
uuuaaaaaaaauguuguuucggcccacaauuagaaaaauuuacacaagcaauaacaagaaaaaa

SEQ ID NO: 166701 - RNA, 64 nt, Homo Sapiens
ucgauuuuuaagaacacacauguuuuacaccuggaaaauuuaccgaaaugggaaaagagaagac

SEQ ID NO: 166702 - RNA, 64 nt, Homo Sapiens
cauuuucagcuuugaaaucuccaaaugaaacuuuaaaauuuauuuugguuuaucccaaaauaau

SEQ ID NO: 166703 - RNA, 64 nt, Homo Sapiens
acaaacauauucaucacuuuaacaauaagggaacaaaauuuaguauucaagcugagugagaaua

SEQ ID NO: 166704 - RNA, 64 nt, Homo Sapiens
auuuuuauauagguccaauauugagcuuuuacuuaaaauuuagauagaacuuuuuuuuggauac

SEQ ID NO: 166705 - RNA, 64 nt, Homo Sapiens
acuuuaaagagacuucaaaauauugaguauuuuaaaaauuuaaaaguaggucaguuuauaacga

SEQ ID NO: 166706 - RNA, 64 nt, Homo Sapiens
gaagaugugauacaucuuuaaaugaaaauauaccaaaauuuaguaggcauguuuuucuaauaaa

SEQ ID NO: 166707 - RNA, 64 nt, Homo Sapiens
uuuguuguaaccugagguauccaaaugcuacagaaaaauuuaugacccaaauacaaaucucaau

SEQ ID NO: 166708 - RNA, 64 nt, Homo Sapiens
uuuuaggcuauagaauaguuaagaaauuuuaaacaaaauuuaguaucuuuuggucuuucacacc

SEQ ID NO: 166709 - RNA, 64 nt, Homo Sapiens
ucucaaaauauuaacucgaauuguaaauuaagcaaaaauuuaaaaaguauauguugaugggaca

SEQ ID NO: 166710 - RNA, 64 nt, Homo Sapiens
gauuagacauauuaaaauauaccaauguuguaguaaaauuuaauuuuuccuuuuguuacuuuuc

SEQ ID NO: 166711 - RNA, 64 nt, Homo Sapiens
agugccauccugcuaggugaguacagaccagaagaaaauuuaguugggaaaauacuuguuuuuc

SEQ ID NO: 166712 - RNA, 64 nt, Homo Sapiens
auacuuuaaguuauuuugacgaaaaguaauagagaaaauuuacuuagcauuuuagauucuagag

SEQ ID NO: 166713 - RNA, 64 nt, Homo Sapiens
agcacuaaauuuuuuauaaaauagaccagaugacaaaauuuauuuuauuuuuaaacagugguuu

SEQ ID NO: 166714 - RNA, 64 nt, Homo Sapiens
agaggaaaaaauacacauguucuuucauauaggcaaaauuuaaccacauaaauuugcacugcaa

SEQ ID NO: 166715 - RNA, 64 nt, Homo Sapiens
auugaaaauaaauaccauuaaacugugaucaguuaaaauuuaaaagaaaaaucagcacaaaagg

SEQ ID NO: 166716 - RNA, 64 nt, Homo Sapiens
uaauguggggcuuuuauguaccaauaaacuuuucaaaauuuauguucaccuguaacuguuuaag

SEQ ID NO: 166717 - RNA, 64 nt, Homo Sapiens
uuuuacuccuguuuaugggaaaucgucuuaaaggaaaauuuaaugacaagagaaauaauuguaa

SEQ ID NO: 166718 - RNA, 64 nt, Homo Sapiens
uguugaagcaccucagaauggauaaugucuccccaaaauuuacauuuugauucucuuguggguu

SEQ ID NO: 166719 - RNA, 64 nt, Homo Sapiens
uacaaggaggcugcucuuguauaagaacuaucauaaaauuuacuaaaaacuacggguagaaaac

SEQ ID NO: 166720 - RNA, 64 nt, Homo Sapiens
uugaucucuguuuuugaauucagagacugaaaaaaaaauuuacucauugauuugagcauagacg

SEQ ID NO: 166721 - RNA, 64 nt, Homo Sapiens
aaccaaggaauaguauuuaaaauacagcaaaauaaaaauuuaacauaacaaccuucauucuucu

SEQ ID NO: 166722 - RNA, 64 nt, Homo Sapiens
gcuguauauagcuugugagaaaccucuuuucuuuaaaauuuacauaaucacaagaaaggaaaga

SEQ ID NO: 166723 - RNA, 64 nt, Homo Sapiens
gaaucaucuugaaaauaagauuccaaccacaaaaaaaauuuagccauuucuuuacuaaaaaaaa

SEQ ID NO: 166724 - RNA, 64 nt, Homo Sapiens
gucaaaaugauaauuuuguuauguuagccucuagaaaauuuaaguucagaaaaaugcacuauga

SEQ ID NO: 166725 - RNA, 64 nt, Homo Sapiens
gccucuauuuccuugucuccaaaaugagaauaauaaaauuuaggucaggauuacuauauaaacu

SEQ ID NO: 166726 - RNA, 64 nt, Homo Sapiens
gucaaagcagauaaauucuuguugaaacuugacuaaaauuuauuugauuuguuguuuuacuccc

SEQ ID NO: 166727 - RNA, 64 nt, Homo Sapiens
gcuuucuagccagaaucuggaccuauaccaugggaaaauuuaggggugcugggaaucccaaagc

SEQ ID NO: 166728 - RNA, 64 nt, Homo Sapiens
auaggaaaauaaaucaaaccuuacauaaaaugcuaaaauuuauuuuaaccagaaaagaaacauu

SEQ ID NO: 166729 - RNA, 64 nt, Homo Sapiens
uuuauucagauaagucaccauaaauauuuuaagaaaaauuuaaguuguaaaaugaacaaauaca

SEQ ID NO: 166730 - RNA, 64 nt, Homo Sapiens
guagaaacguaauugcaauggauuguaacucaaaaaaauuuauaagauguucugauaacauugu

SEQ ID NO: 166731 - RNA, 64 nt, Homo Sapiens
gcacaacagugaguuggaucauuagaucugagacaaaauuuaauuuuacuuuacaccaaaguug

SEQ ID NO: 166732 - RNA, 64 nt, Homo Sapiens
cguguagccuguuaauuuucaaguugcauuugccaaaauuuaccgaugugugaacuucaauaua

SEQ ID NO: 166733 - RNA, 64 nt, Homo Sapiens
aagccacugaauuugaguuuaaaaaaaggcaaugaaaauuuagcgcaguggcaugcuuuaaaaa

SEQ ID NO: 166734 - RNA, 64 nt, Homo Sapiens
uaagcaggcuuccuuugcucacuccuuuguaaccaaaauuuaggacuccauuauaacauaugua

SEQ ID NO: 166735 - RNA, 64 nt, Homo Sapiens
aauaaauagaucuacauuuuguacauauuuauauaaaauuuaccuuuaaguauuuacuuuaaaa

SEQ ID NO: 166736 - RNA, 64 nt, Homo Sapiens
uuauauaaaauuuaccuuuaaguauuuacuuuaaaaaauuuaauggcuuaacucgaacuugaag

SEQ ID NO: 166737 - RNA, 64 nt, Homo Sapiens
gacccucagaaaaccaaugaagucuaagagaaauaaaauuuaguggacagguaugaaaagugua

SEQ ID NO: 166738 - RNA, 64 nt, Homo Sapiens
ggguucuuaugaagguaaauuuaccagauuaauaaaaauuuaugaauauuaaaauuaucauuaa

SEQ ID NO: 166739 - RNA, 64 nt, Homo Sapiens
uuuaaaauaauaauaguacuuuuuauuuuaaaauaaaauuuaccaguacuauuacuauuacuau

SEQ ID NO: 166740 - RNA, 64 nt, Homo Sapiens
ucugauuaauccauuuuaacaggacaugguguuuaaaauuuaaaaauuagcuuguuacaauucu

SEQ ID NO: 166741 - RNA, 64 nt, Homo Sapiens
ccucaauaaauauaauuucuauacaacuuguuauaaaauuuauuauuuuuagagauuugugaua

SEQ ID NO: 166742 - RNA, 64 nt, Homo Sapiens
aauaaucugagcaaaagguaaaaguaaaugagguaaaauuuaacauagagaaagagcaauugau

SEQ ID NO: 166743 - RNA, 64 nt, Homo Sapiens
ugaguuuuuaauguuuacauaucauaauaaagauaaaauuuaguaauaguuuaaaucagugacc

SEQ ID NO: 166744 - RNA, 64 nt, Homo Sapiens
agaguggcaaauacuauuuuauuuagacuauucaaaaauuuagauaucacaagcaguucccucc

SEQ ID NO: 166745 - RNA, 64 nt, Homo Sapiens
auaacaaaaauacuacuaauccaaguuuaaacacaaaauuuaucuggcagcuaaugggcucuua

SEQ ID NO: 166746 - RNA, 64 nt, Homo Sapiens
caguagaccauuugucauccgucugccucauucuaaaauuuacauaaccggccuuccaacuuuu

SEQ ID NO: 166747 - RNA, 64 nt, Homo Sapiens
uuuuuaauuuaagauuucugucaagauauauuauaaaauuuauuuaaagccuuuauuccaucuc

SEQ ID NO: 166748 - RNA, 64 nt, Homo Sapiens
auaacacuaaacacuccuuuuuuugaaagagacaaaaauuuauuguggagaagagguugggcuu

SEQ ID NO: 166749 - RNA, 64 nt, Homo Sapiens
uaacauaaaugugugaaaaaguaaagauaacuaaaaaauuuagaaaaauaaauccaguauuugu

SEQ ID NO: 166750 - RNA, 64 nt, Homo Sapiens
aaacguuuuuguuuuuuacugucacuagggcaauaaaauuuauacucaaccauauaauaacauu

SEQ ID NO: 166751 - RNA, 64 nt, Homo Sapiens
uauacauugugugugugugucuaccugaagaaaaaaaauuuauauacuuuccuggaauaauugu

SEQ ID NO: 166752 - RNA, 64 nt, Homo Sapiens
uucuuuuuuccaccuuuuugcugcuuuugugcagaaaauuuaggaaaguucagguuucagagaa

SEQ ID NO: 166753 - RNA, 64 nt, Homo Sapiens
auuuccuuuauauacuuguucuucugccaaaauaaaaauuuacuuuuuaaucugcacaguuuau

SEQ ID NO: 166754 - RNA, 64 nt, Homo Sapiens
ugauucaaaaccauuucuucuauuuuucuucuuaaaaauuuauagaaucccuuuggacagucuu

SEQ ID NO: 166755 - RNA, 64 nt, Homo Sapiens
aaauuugcaauaguguucuauuguauguaauuuuaaaauuuauaagauuauccacguuggccaa

SEQ ID NO: 166756 - RNA, 64 nt, Homo Sapiens
uguaucauugaaguucaguaggauguguggcuuaaaaauuuaucaggaccacaaaaaagaaaac

SEQ ID NO: 166757 - RNA, 64 nt, Homo Sapiens
cuaccccuuaccccaguuuuuugaacauggaaagaaaauuuaauaacuuuuuaaagugacauaa

SEQ ID NO: 166758 - RNA, 64 nt, Homo Sapiens
acauguauuaaaauguacaaaauguuuuguuaauaaaauuuaauaauguuuauaacuccgugcc

SEQ ID NO: 166759 - RNA, 64 nt, Homo Sapiens
ugugucaugagaauguaagucuuuuuucuacuuuaaaauuuaguagguucacugaguaacuaaa

SEQ ID NO: 166760 - RNA, 64 nt, Homo Sapiens
cuacuuuaaaauuuaguagguucacugaguaacuaaaauuuagcaaaccuguguuugcauauuu

SEQ ID NO: 166761 - RNA, 64 nt, Homo Sapiens
acuuuguaccaaguuauuaaguaacauaauuuuuaaaauuuaaagaaugugucuucaacuaaaa

SEQ ID NO: 166762 - RNA, 64 nt, Homo Sapiens
acauaaaauaucaaacacacaaagucauaaaaugaaaauuuacaguuuuaccuguucauaucua

SEQ ID NO: 166763 - RNA, 64 nt, Homo Sapiens
ucuugcaaaguuaaauguuuaaugaagaaaaauaaaaauuuauuauucuuaaaugcuguaugau

SEQ ID NO: 166764 - RNA, 64 nt, Homo Sapiens
ugcuuaacaaacuuagaauguaaaugauuacagaaaaauuuaucacagaaugugaauauguagg

SEQ ID NO: 166765 - RNA, 64 nt, Homo Sapiens
uauugaaauauacuuaaaaauuaaagcaugcauaaaaauuuauguuaaaaaaaauacuguuugu

SEQ ID NO: 166766 - RNA, 64 nt, Homo Sapiens
ugcuggugcuggucagacuuaauauuaaaaucagaaaauuuaaauacuaacgcuaugucagacu

SEQ ID NO: 166767 - RNA, 64 nt, Homo Sapiens
uuuaagucgagcucaguggcaaauaaaauaaaauaaaauuuagauuagagggagcauggccaua

SEQ ID NO: 166768 - RNA, 64 nt, Homo Sapiens
uuuauuagagggagcauggcggacuuauuuauuuaaaauuuagaacauaaacacaacaauacuu

SEQ ID NO: 166769 - RNA, 64 nt, Homo Sapiens
aaugcaucuugggagagaaagagagaagagaguuaaaauuuaaauaaagauuuuuaacauguca

SEQ ID NO: 166770 - RNA, 64 nt, Homo Sapiens
cuaucaugcacuguacacaugacaacaauaaagaaaaauuuaacucuccaaaggaccugcguug

SEQ ID NO: 166771 - RNA, 64 nt, Homo Sapiens
cuguacugucuaucugcaguaauugaggacccauaaaauuuagauaacuacaugucuuugcucu

SEQ ID NO: 166772 - RNA, 64 nt, Homo Sapiens
caguuauuuuuaaugcuuaauacauacauggugcaaaauuuaaaaagcgcaaauagguaucuag

SEQ ID NO: 166773 - RNA, 64 nt, Homo Sapiens
uuaauuuuaagaauaggauuucggaaggcgacagaaaauuuaguucuuagacauuuaaauagaa

SEQ ID NO: 166774 - RNA, 64 nt, Homo Sapiens
uuccgagaggcagggcaacuaauaacuggucagaaaaauuuagacggucuucauuuuaaaauug

SEQ ID NO: 166775 - RNA, 64 nt, Homo Sapiens
gaagcuuauauuaauuguugcuucaauaguuuaaaaaauuuauggagauagguaggucauuaug

SEQ ID NO: 166776 - RNA, 64 nt, Homo Sapiens
aaggaggaaacaggaaaaauugccguccauuuuaaaaauuuagguuuguuguuuuaaaccauaa

SEQ ID NO: 166777 - RNA, 64 nt, Homo Sapiens
gugauuuuaaaggauuuugccaacuugucuuccuaaaauuuauaaauuuguuucaagugaacua

SEQ ID NO: 166778 - RNA, 64 nt, Homo Sapiens
uguagauggcauuuagaugucaaacauauuaggcaaaauuuaacuaucuuuucacuuaguguuu

SEQ ID NO: 166779 - RNA, 64 nt, Homo Sapiens
agcaagaugaaaaaaaggaauuuuuuaaaagcugaaaauuuagaguauuuucauauaauuuaua

SEQ ID NO: 166780 - RNA, 64 nt, Homo Sapiens
uuauuaaauuuugugccaguaccguuguuguguuaaaauuuauuuucaguggggaggggccaaa

SEQ ID NO: 166781 - RNA, 64 nt, Homo Sapiens
auauuuuaaauauaauaguauuuuucuauuagauaaaauuuaagaucuuuggcaucuuaaugga

SEQ ID NO: 166782 - RNA, 64 nt, Homo Sapiens
ggucauuuagaaaaaaacaauguugggcacaaagaaaauuuagaucugacaaguauaauuuucu

SEQ ID NO: 166783 - RNA, 64 nt, Homo Sapiens
cagaaauuuaaauaagauuuaauucacaucaaauaaaauuuagaaaauaaaauuuaacucacac

SEQ ID NO: 166784 - RNA, 64 nt, Homo Sapiens
agauuuaauucacaucaaauaaaauuuagaaaauaaaauuuaacucacacugcccaggcuggag

SEQ ID NO: 166785 - RNA, 64 nt, Homo Sapiens
acuuuauauucaguucugugucuuacuuauuggaaaaauuuauuucuuagcuuucacaugaguu

SEQ ID NO: 166786 - RNA, 64 nt, Homo Sapiens
aauacacuugggagaacagaaauaagaauuaaugaaaauuuaaaagauuaaaugaaugagaaga

SEQ ID NO: 166787 - RNA, 64 nt, Homo Sapiens
ucacauuauucuauguaaguaauuuauuuuucaaaaaauuuacucuucaggauuguuccacuaa

SEQ ID NO: 166788 - RNA, 64 nt, Homo Sapiens
uuucaaaaaauuuacuucacaggauuguuccacuaaaauuuauuuucuucugguguuauccuuc

SEQ ID NO: 166789 - RNA, 64 nt, Homo Sapiens
aaauaaaaauuaaauauuagaccuagcagguaauaaaauuuaaaaaaaucauuuuacacaucau

SEQ ID NO: 166790 - RNA, 64 nt, Homo Sapiens
cgagaaagugguauauaaguauuguauuuuuugaaaaauuuauaucuuuauaaauuauauuauu

SEQ ID NO: 166791 - RNA, 64 nt, Homo Sapiens
aaauguuaucuuuuugcauugaauauucuuucuaaaaauuuagaacccaugacaaaaugaaugu

SEQ ID NO: 166792 - RNA, 64 nt, Homo Sapiens
aaaacaaauguauaaaauucgaagaauaucugucaaaauuuaaggaaggcaguuuuaacuuucu

SEQ ID NO: 166793 - RNA, 64 nt, Homo Sapiens
ugaguaauaauuauucacauuauuuuccuacaugaaaauuuaauuuuuucauuuaccaagauuu

SEQ ID NO: 166794 - RNA, 64 nt, Homo Sapiens
ugucacugcacucuagccugggcgacagaaaaagaaaauuuagguggggaaaaaaaucagaauu

SEQ ID NO: 166795 - RNA, 64 nt, Homo Sapiens
cccaucucuacuaaaaauauaaaaaucagcaaaaaaaauuuagccaggcuuggucaugcaugcc

SEQ ID NO: 166796 - RNA, 64 nt, Homo Sapiens
ucauauagguuauuuaacuuguauucagaaauggaaaauuuacacaauauauaauacugaaaaa

SEQ ID NO: 166797 - RNA, 64 nt, Homo Sapiens
auacaaauguuaaauuauccaaagaaauuuauauaaaauuuaaaugcuuuuuuaaacuuguuaa

SEQ ID NO: 166798 - RNA, 64 nt, Homo Sapiens
uuuuggaauccucuaaacauuuuguauuuaaacaaaaauuuaaauuuucauauuacagagugaa

SEQ ID NO: 166799 - RNA, 64 nt, Homo Sapiens
caucuguuauggguaagaucauaagugacccaacaaaauuuauuagcuaaaauguugcagagaa

SEQ ID NO: 166800 - RNA, 64 nt, Homo Sapiens
acagccuugucugauuuuaauuuuaauaauugaaaaaauuuacccuauuagaagaaauaauuuu

SEQ ID NO: 166801 - RNA, 64 nt, Homo Sapiens
guugaaaaagcaguugcuauuuaggggaauagucaaaauuuacuuuaagccacuagguagauau

SEQ ID NO: 166802 - RNA, 64 nt, Homo Sapiens
uuuagaguguaagaaguaauggguacagagaaaaaaaauuuaagaccaauauuuuaacaggaua

SEQ ID NO: 166803 - RNA, 64 nt, Homo Sapiens
uaaaccaugcuucucagcuuucaaauuucaagauaaaauuuaaguauucaguaaaaugaugguu

SEQ ID NO: 166804 - RNA, 64 nt, Homo Sapiens
uuccuccacauaguucucuuaggaaacaugaaauaaaauuuacuaaaucucuucuaacacaagu

SEQ ID NO: 166805 - RNA, 64 nt, Homo Sapiens
caguuuuuauaaugaauuaaaaaaaaguuaagccaaaauuuaaguuauucaaagacuggauuaa

SEQ ID NO: 166806 - RNA, 64 nt, Homo Sapiens
auuugauauugcuucagcauuucaaauauguugcaaaauuuaguauccauaugcauaagaaguu

SEQ ID NO: 166807 - RNA, 64 nt, Homo Sapiens
cuccccacuccccuugcuugagaagcacuacucaaaaauuuaccagaccuuacaacugugauaa

SEQ ID NO: 166808 - RNA, 64 nt, Homo Sapiens
guuuauuuuaaauaggaaagcaaagcucuauuuuaaaauuuaauaaaacugcuuacauaguaua

SEQ ID NO: 166809 - RNA, 64 nt, Homo Sapiens
ucuuuaucuacaaagccaaacacuauguugcacaaaaauuuaagauggaugugugcuuuaacac

SEQ ID NO: 166810 - RNA, 64 nt, Homo Sapiens
auuuuacggggaugggugggcggagggacacaacaaaauuuaagaaugacuauuugggcgggcu

SEQ ID NO: 166811 - RNA, 64 nt, Homo Sapiens
gaaauguagaagggauaacaguucacagccagguaaaauuuaacugguggcuuaaugacucugc

SEQ ID NO: 166812 - RNA, 64 nt, Homo Sapiens
aaaauaaaaagaauccaaccucaaaaaaaauuuaaaaauuuaaacgacagagcgagacucaguc

SEQ ID NO: 166813 - RNA, 64 nt, Homo Sapiens
aauuuaaaaaaauaaaaagaacucagucucaaaaaaaauuuaaaccacuggacgacagagcgag

SEQ ID NO: 166814 - RNA, 64 nt, Homo Sapiens
auuaaaaauauauccuauauuguuuuucaagaguaaaauuuaagugaguuuguugaagugcaca

SEQ ID NO: 166815 - RNA, 64 nt, Homo Sapiens
ucacaauaaguuaacuugcguugaagaaaauaauaaaauuuaucuauuggguuucuuaaaaauc

SEQ ID NO: 166816 - RNA, 64 nt, Homo Sapiens
ccuguuauguaugaaggaaucauuccagugcuagaaaauuuagcccuuuaaaacgucuuagagc

SEQ ID NO: 166817 - RNA, 64 nt, Homo Sapiens
guauauugagaaucccuuaaaauuaccagacaaaaaaauuuaaaauuacguuuguuauuccuag

SEQ ID NO: 166818 - RNA, 64 nt, Homo Sapiens
gaaaaauaaaauggcuuuccaagucuucuauuuuaaaauuuagaguacuaaauguuuuccauua

SEQ ID NO: 166819 - RNA, 64 nt, Homo Sapiens
uuuauaaaugaauuuuaaaauagggucucaaacuaaaauuuauuuuaagccacaauuugguacc

SEQ ID NO: 166820 - RNA, 64 nt, Homo Sapiens
cuuauuuccuuuuaccuaauuaaaccaucuuuuaaaaauuuaccacaaagucugaaaaccauuu

SEQ ID NO: 166821 - RNA, 64 nt, Homo Sapiens
auaugaaaugaugcagaauaucagaaaugaagacaaaauuuaaacagcacucaggucuuuuucu

SEQ ID NO: 166822 - RNA, 64 nt, Homo Sapiens
guguuuuugagugugaaaagaguuuuuagcuuuuaaaauuuaaaaaaauggauaauuuguaaau

SEQ ID NO: 166823 - RNA, 64 nt, Homo Sapiens
uuuugagucagguuuuguguauuaagucuacugaaaaauuuacaauuaaauaugcaaguuagaa

SEQ ID NO: 166824 - RNA, 64 nt, Homo Sapiens
cauuuaucuucagguuggggugccuugccuugugaaaauuuaucagauuuaaaaacgaaaagua

SEQ ID NO: 166825 - RNA, 64 nt, Homo Sapiens
cacuuuaaggagaacuaauaaaaauuaagucuuuaaaauuuagguggacaagauuuauauggac

SEQ ID NO: 166826 - RNA, 64 nt, Homo Sapiens
ugaucuuugugauuagaacacagagcacuccaucaaaauuuacccaguuugucugaaacaaaca

SEQ ID NO: 166827 - RNA, 64 nt, Homo Sapiens
aggugggaauuuccucuucccaacuggucugacuaaaauuuauuucaggagacgguuuugagau

SEQ ID NO: 166828 - RNA, 64 nt, Homo Sapiens
agaagccaagaugauguaggggcacauucaugucaaaauuuaccugguuaguggcugccagugu

SEQ ID NO: 166829 - RNA, 64 nt, Homo Sapiens
caggcaugguggcacacaccuguacuaaaaauacaaaauuuagcuaacauggugaaacccuguc

SEQ ID NO: 166830 - RNA, 64 nt, Homo Sapiens
uuguagugaauguaggaaguaauuuauucuagguaaaauuuagaucucagaaauuauuaaacau

SEQ ID NO: 166831 - RNA, 64 nt, Homo Sapiens
gguugcuguaguguuuagaagugggcuuauugagaaaauuuaaauaaauggaaugcuaacacua

SEQ ID NO: 166832 - RNA, 64 nt, Homo Sapiens
uuaagguaguacauguaguuuuucauucuuuuaaaaaauuuauucugggauuucuuccuuuuua

SEQ ID NO: 166833 - RNA, 64 nt, Homo Sapiens
aaaguggucuagguaaccuguaaagaaaggauuaaaaauuuaagauguucuaguucugcucucu

SEQ ID NO: 166834 - RNA, 64 nt, Homo Sapiens
auucuccugacuccaguuuauaacauccuuuuaaaaaauuuaaaaacaaacagccacaccccuc

SEQ ID NO: 166835 - RNA, 64 nt, Homo Sapiens
aaauuaaaaaacggguaacaaagaaaaacuauagaaaauuuaaaagagugugacccugucucua

SEQ ID NO: 166836 - RNA, 64 nt, Homo Sapiens
uggguguggugguacgugccaaaaaacuuuuuuaaaaauuuagcaaugagaccuguccucuaug

SEQ ID NO: 166837 - RNA, 64 nt, Homo Sapiens
aauuagccaaguguggugguucuuuucucuacaaaaaauuuaaagccugggcaguauagugaga

SEQ ID NO: 166838 - RNA, 64 nt, Homo Sapiens
gaagaguucuaaggcuuucaaaaacacucagucaaaaauuuaaaaucuuaaauguguaagucac

SEQ ID NO: 166839 - RNA, 64 nt, Homo Sapiens
cacucuuagcccaccagagucugcccuuuggcccaaaauuuaugucugucucauguguaaaaga

SEQ ID NO: 166840 - RNA, 64 nt, Homo Sapiens
aaaagaaccucuacuuaaaccucacaucuuauauaaaauuuaacucaaaauguauaacggacuu

SEQ ID NO: 166841 - RNA, 64 nt, Homo Sapiens
auaaaagacaaaaucugauauauuggacuucuucaaaauuuaaaaacuugugauuuaagaagag

SEQ ID NO: 166842 - RNA, 64 nt, Homo Sapiens
acuuuuuaaaaaauaacaugaugacaacauucacaaaauuuauuucuguauaggauuuuuaaaa

SEQ ID NO: 166843 - RNA, 64 nt, Homo Sapiens
agagaacauuuaagccacucucuugcacuuauuuaaaauuuaggaauuccugaguguagaaacu

SEQ ID NO: 166844 - RNA, 64 nt, Homo Sapiens
ugacuuugaauuuaagaaccugcaagcauaaacuaaaauuuauaaauuaacugagugaguuaag

SEQ ID NO: 166845 - RNA, 64 nt, Homo Sapiens
caaaguuucagagaacuaccuuacaguaauaaauaaaauuuauauuucaaugugauuuuaguau

SEQ ID NO: 166846 - RNA, 64 nt, Homo Sapiens
uuacagaauacuucugcauaacuuuucugucaggaaaauuuagucaucuguugaggauguggga

SEQ ID NO: 166847 - RNA, 64 nt, Homo Sapiens
ucuccaauaauuaauugcaugcuuggcauaguccaaaauuuaaguggagggagcaggggaugag

SEQ ID NO: 166848 - RNA, 64 nt, Homo Sapiens
aaaaaaaaaaaaaaaagcagaaaaacacaugaagaaaauuuaccggugauuuuucuuuugucua

SEQ ID NO: 166849 - RNA, 64 nt, Homo Sapiens
agauaucuauuucuguuacauuuauuaggcccccaaaauuuaauaguugaauaaucaaaaauau

SEQ ID NO: 166850 - RNA, 64 nt, Homo Sapiens
cuaaauguuuuuauggcuauuaguuucuaaguguaaaauuuauucucugauguauuucuuuuag

SEQ ID NO: 166851 - RNA, 64 nt, Homo Sapiens
aaucauuuuaguagaauucauaaauaaguucuagaaaauuuaaagguggcugagcuuaauugcu

SEQ ID NO: 166852 - RNA, 64 nt, Homo Sapiens
auauguacaguauucccacucaauuuucuucacuaaaauuuauuaaagaaacaaaacuucccua

SEQ ID NO: 166853 - RNA, 64 nt, Homo Sapiens
uauaucccauauauuuaauauugccuuacuucucuugccuuaaagaaaagggcacucauuugga

SEQ ID NO: 166854 - RNA, 64 nt, Homo Sapiens
ucucuugccuuaaauauaucggcacucauuuggauugccuuacucagugcugagauuggaaaag

SEQ ID NO: 166855 - RNA, 64 nt, Homo Sapiens
uuuuuaaugaaaugcaaauucuuacuuuuacuuuuugccuuaaauguuugaccuauguauggaa

SEQ ID NO: 166856 - RNA, 64 nt, Homo Sapiens
cccucuauuuccuaaaauauuccaaaugaaugucuugccuuaaagauagagagaaauuaacuuu

SEQ ID NO: 166857 - RNA, 64 nt, Homo Sapiens
guagguagggaacaagagaacccaucuauuaaaauugccuuagaucugggaaaguaaccauccu

SEQ ID NO: 166858 - RNA, 64 nt, Homo Sapiens
gccacagguuucuuuaaagcuguguuaacauaucuugccuuaaaauguguguguguguuuuugc

SEQ ID NO: 166859 - RNA, 64 nt, Homo Sapiens
agcuaauagaaaaacagguaagaauaaagcaauguugccuuaauuucaaaagcugcuauuuuag

SEQ ID NO: 166860 - RNA, 64 nt, Homo Sapiens
uaagguagauccccaauauuuuggaauaccaaaauugccuuaaaaauucccuucuguuucuuac

SEQ ID NO: 166861 - RNA, 64 nt, Homo Sapiens
auguuuuuauauuaaaucauaaggaaggaacuacuugccuuaaauguuaauaucaaaagaguuu

SEQ ID NO: 166862 - RNA, 64 nt, Homo Sapiens
aauuauuaguucacuucccugcugccaugaaacuuugccuuaagaaggugcuggauuccaaggu

SEQ ID NO: 166863 - RNA, 64 nt, Homo Sapiens
ucuguucauuuuuucaagucuaguccuaacgucuuugccuuaauucugccucagacugaaaagc

SEQ ID NO: 166864 - RNA, 64 nt, Homo Sapiens
gcuacuucaagcucuuuaaaaaugacauuuccauuugccuuauugauaucacaacucuauggaa

SEQ ID NO: 166865 - RNA, 64 nt, Homo Sapiens
guguuugcuaguuguguacaccccauugcaaugguugccuuaagauccgcccugcaaguuaacc

SEQ ID NO: 166866 - RNA, 64 nt, Homo Sapiens
ugguagaauauuuagaaauuuuaaugcaaacucuuugccuuaaaagccuauuuucugacguuuc

SEQ ID NO: 166867 - RNA, 64 nt, Homo Sapiens
uuuucauaauugcuuucuagcaaucagcuuuuauuugccuuaauauaagcuuuuaagcaguuau

SEQ ID NO: 166868 - RNA, 64 nt, Homo Sapiens
uguacccagauaacuaagauauuguuucauggccuugccuuagucagaggcccuuuucucuguc

SEQ ID NO: 166869 - RNA, 64 nt, Homo Sapiens
aagugcccuccccacaaugcuccugaauuuuacuuugccuuaagcaaaacugauuucaugcagg

SEQ ID NO: 166870 - RNA, 64 nt, Homo Sapiens
uuacuaaagugaaguuuuccuuuuauuuucuguuuugccuuaucggaguuugguuaaacgacuc

SEQ ID NO: 166871 - RNA, 64 nt, Homo Sapiens
auguuacugaaauaaacugucugaggauuaauuguugccuuacagucacugguuugcugacuua

SEQ ID NO: 166872 - RNA, 64 nt, Homo Sapiens
guuauuucccuguguaaaccugacuguuuucauauugccuuaggucuuuaucaguaauaaauua

SEQ ID NO: 166873 - RNA, 64 nt, Homo Sapiens
gauuuuuuuccaaaaaaaaauauuuucaguuuuuuugccuuauuaaacaaaacacaacuauaua

SEQ ID NO: 166874 - RNA, 64 nt, Homo Sapiens
ugauugaaacugaaaucgacuggugauuggcugguugccuuagcccagaaggagacaccagugg

SEQ ID NO: 166875 - RNA, 64 nt, Homo Sapiens
cagaaugagauugaauuguucagaagacaguguguugccuuacccacucugacugucuuuauug

SEQ ID NO: 166876 - RNA, 64 nt, Homo Sapiens
agaaugagugcuuggauuaccagaagacaguguguugccuuacccacacacacagucuuuauug

SEQ ID NO: 166877 - RNA, 64 nt, Homo Sapiens
ggcgugagacacacacacaccagaagacaguguguugccuuauacacacacagagucuuuauug

SEQ ID NO: 166878 - RNA, 64 nt, Homo Sapiens
cagaaugagugcuaggauuacagaagacaguguguugccuuacccacacacacacacacuauuu

SEQ ID NO: 166879 - RNA, 64 nt, Homo Sapiens
aguuuacuguuucuucuguuaggagaaagaugucuugccuuaaacuccuugcugcuagaguggg

SEQ ID NO: 166880 - RNA, 64 nt, Homo Sapiens
acaucaucuggucacguuagaaaauacuuugcuuuugccuuaacuccaaaaaccugagggggag

SEQ ID NO: 166881 - RNA, 64 nt, Homo Sapiens
aauuaucuuugaacaucccgucaaauugcaaaauuugccuuagcaucauuacaguuagguuuuc

SEQ ID NO: 166882 - RNA, 64 nt, Homo Sapiens
cucuacaacaguaucuuaauaauuuauaauaaaauugccuuaaucagggguggaauauaucagg

SEQ ID NO: 166883 - RNA, 64 nt, Homo Sapiens
gacuuuacaggcuuggcuuuugaugacaaagaucuugccuuacauauccgucucuucccguccc

SEQ ID NO: 166884 - RNA, 64 nt, Homo Sapiens
uuugaggcuguucugcccagcugagaagccacaguugccuuauuuuucugguggcagucucaaa

SEQ ID NO: 166885 - RNA, 64 nt, Homo Sapiens
acaaaguguuaccaguuuacaaaaauaagucuuuuugccuuaagucauuuuggaaauaaguaau

SEQ ID NO: 166886 - RNA, 64 nt, Homo Sapiens
ggcaccaccuuccuccuugagcuuugccugucucuugccuuaucaguucuuccuccaccacccu

SEQ ID NO: 166887 - RNA, 64 nt, Homo Sapiens
gcgggcgugucgccgccucuggcaucgccuccgguugccuuacaccacgccuucaccugcaguc

SEQ ID NO: 166888 - RNA, 64 nt, Homo Sapiens
ccgcggagccacaggggaccccacgcacauuccguugccuuacccgauggcuugugacgcggag

SEQ ID NO: 166889 - RNA, 64 nt, Homo Sapiens; identical to SEQ ID NO: 77572

SEQ ID NO: 166890 - RNA, 64 nt, Homo Sapiens; identical to SEQ ID NO: 77573

SEQ ID NO: 166891 - RNA, 64 nt, Homo Sapiens; identical to SEQ ID NO: 77574

SEQ ID NO: 166892 - RNA, 64 nt, Homo Sapiens; identical to SEQ ID NO: 77575

SEQ ID NO: 166893 - RNA, 64 nt, Homo Sapiens; identical to SEQ ID NO: 77576

SEQ ID NO: 166894 - RNA, 64 nt, Homo Sapiens; identical to SEQ ID NO: 77577

SEQ ID NO: 166895 - RNA, 64 nt, Homo Sapiens; identical to SEQ ID NO: 77578

SEQ ID NO: 166896 - RNA, 64 nt, Homo Sapiens; identical to SEQ ID NO: 77579

SEQ ID NO: 166897 - RNA, 64 nt, Homo Sapiens; identical to SEQ ID NO: 77580

SEQ ID NO: 166898 - RNA, 64 nt, Homo Sapiens; identical to SEQ ID NO: 77581

SEQ ID NO: 166899 - RNA, 64 nt, Homo Sapiens; identical to SEQ ID NO: 77582

SEQ ID NO: 166900 - RNA, 64 nt, Homo Sapiens; identical to SEQ ID NO: 77583

SEQ ID NO: 166901 - RNA, 64 nt, Homo Sapiens; identical to SEQ ID NO: 77584

SEQ ID NO: 166902 - RNA, 64 nt, Homo Sapiens; identical to SEQ ID NO: 77585

SEQ ID NO: 166903 - RNA, 64 nt, Homo Sapiens; identical to SEQ ID NO: 77586

SEQ ID NO: 166904 - RNA, 64 nt, Homo Sapiens; identical to SEQ ID NO: 77587

SEQ ID NO: 166905 - RNA, 64 nt, Homo Sapiens; identical to SEQ ID NO: 77588

SEQ ID NO: 166906 - RNA, 64 nt, Homo Sapiens; identical to SEQ ID NO: 77589

SEQ ID NO: 166907 - RNA, 56 nt, Homo Sapiens; identical to SEQ ID NO: 77590

SEQ ID NO: 166908 - RNA, 64 nt, Homo Sapiens; identical to SEQ ID NO: 77591

SEQ ID NO: 166909 - RNA, 64 nt, Homo Sapiens; identical to SEQ ID NO: 77592

SEQ ID NO: 166910 - RNA, 64 nt, Homo Sapiens; identical to SEQ ID NO: 77593

SEQ ID NO: 166911 - RNA, 64 nt, Homo Sapiens; identical to SEQ ID NO: 77594

SEQ ID NO: 166912 - RNA, 64 nt, Homo Sapiens; identical to SEQ ID NO: 77595

SEQ ID NO: 166913 - RNA, 64 nt, Homo Sapiens; identical to SEQ ID NO: 77596

SEQ ID NO: 166914 - RNA, 64 nt, Homo Sapiens; identical to SEQ ID NO: 77597

SEQ ID NO: 166915 - RNA, 64 nt, Homo Sapiens; identical to SEQ ID NO: 77598

SEQ ID NO: 166916 - RNA, 64 nt, Homo Sapiens; identical to SEQ ID NO: 77599

SEQ ID NO: 166917 - RNA, 64 nt, Homo Sapiens; identical to SEQ ID NO: 77600

SEQ ID NO: 166918 - RNA, 64 nt, Homo Sapiens; identical to SEQ ID NO: 77601

SEQ ID NO: 166919 - RNA, 64 nt, Homo Sapiens; identical to SEQ ID NO: 77602

SEQ ID NO: 166920 - RNA, 64 nt, Homo Sapiens; identical to SEQ ID NO: 77603

SEQ ID NO: 166921 - RNA, 64 nt, Homo Sapiens; identical to SEQ ID NO: 77604

SEQ ID NO: 166922 - RNA, 64 nt, Homo Sapiens; identical to SEQ ID NO: 77605

SEQ ID NO: 166923 - RNA, 64 nt, Homo Sapiens; identical to SEQ ID NO: 77606

SEQ ID NO: 166924 - RNA, 64 nt, Homo Sapiens; identical to SEQ ID NO: 77607

SEQ ID NO: 166925 - RNA, 64 nt, Homo Sapiens; identical to SEQ ID NO: 77608

SEQ ID NO: 166926 - RNA, 64 nt, Homo Sapiens; identical to SEQ ID NO: 77609

SEQ ID NO: 166927 - RNA, 64 nt, Homo Sapiens; identical to SEQ ID NO: 77610

SEQ ID NO: 166928 - RNA, 64 nt, Homo Sapiens; identical to SEQ ID NO: 77611

SEQ ID NO: 166929 - RNA, 64 nt, Homo Sapiens; identical to SEQ ID NO: 77612

SEQ ID NO: 166930 - RNA, 64 nt, Homo Sapiens; identical to SEQ ID NO: 77613

SEQ ID NO: 166931 - RNA, 64 nt, Homo Sapiens; identical to SEQ ID NO: 77614

SEQ ID NO: 166932 - RNA, 64 nt, Homo Sapiens; identical to SEQ ID NO: 77615

SEQ ID NO: 166933 - RNA, 64 nt, Homo Sapiens; identical to SEQ ID NO: 77616

SEQ ID NO: 166934 - RNA, 64 nt, Homo Sapiens; identical to SEQ ID NO: 77617

SEQ ID NO: 166935 - RNA, 64 nt, Homo Sapiens; identical to SEQ ID NO: 77618

SEQ ID NO: 166936 - RNA, 64 nt, Homo Sapiens; identical to SEQ ID NO: 77619

SEQ ID NO: 166937 - RNA, 64 nt, Homo Sapiens; identical to SEQ ID NO: 77620

SEQ ID NO: 166938 - RNA, 64 nt, Homo Sapiens; identical to SEQ ID NO: 77621

SEQ ID NO: 166939 - RNA, 64 nt, Homo Sapiens; identical to SEQ ID NO: 77622

SEQ ID NO: 166940 - RNA, 64 nt, Homo Sapiens; identical to SEQ ID NO: 77623

SEQ ID NO: 166941 - RNA, 64 nt, Homo Sapiens; identical to SEQ ID NO: 77624

SEQ ID NO: 166942 - RNA, 64 nt, Homo Sapiens; identical to SEQ ID NO: 77625

SEQ ID NO: 166943 - RNA, 64 nt, Homo Sapiens; identical to SEQ ID NO: 77626

SEQ ID NO: 166944 - RNA, 64 nt, Homo Sapiens; identical to SEQ ID NO: 77627

SEQ ID NO: 166945 - RNA, 64 nt, Homo Sapiens; identical to SEQ ID NO: 77628

SEQ ID NO: 166946 - RNA, 64 nt, Homo Sapiens; identical to SEQ ID NO: 77629

SEQ ID NO: 166947 - RNA, 64 nt, Homo Sapiens; identical to SEQ ID NO: 77630

SEQ ID NO: 166948 - RNA, 64 nt, Homo Sapiens; identical to SEQ ID NO: 77631

SEQ ID NO: 166949 - RNA, 64 nt, Homo Sapiens; identical to SEQ ID NO: 77632

SEQ ID NO: 166950 - RNA, 64 nt, Homo Sapiens; identical to SEQ ID NO: 77633

SEQ ID NO: 166951 - RNA, 64 nt, Homo Sapiens; identical to SEQ ID NO: 77634

SEQ ID NO: 166952 - RNA, 64 nt, Homo Sapiens; identical to SEQ ID NO: 77635

SEQ ID NO: 166953 - RNA, 64 nt, Homo Sapiens; identical to SEQ ID NO: 77636

SEQ ID NO: 166954 - RNA, 64 nt, Homo Sapiens; identical to SEQ ID NO: 77637

SEQ ID NO: 166955 - RNA, 64 nt, Homo Sapiens; identical to SEQ ID NO: 77638

SEQ ID NO: 166956 - RNA, 64 nt, Homo Sapiens; identical to SEQ ID NO: 77639

SEQ ID NO: 166957 - RNA, 64 nt, Homo Sapiens; identical to SEQ ID NO: 77640

SEQ ID NO: 166958 - RNA, 64 nt, Homo Sapiens; identical to SEQ ID NO: 77641

SEQ ID NO: 166959 - RNA, 64 nt, Homo Sapiens; identical to SEQ ID NO: 77642

SEQ ID NO: 166960 - RNA, 64 nt, Homo Sapiens; identical to SEQ ID NO: 77643

SEQ ID NO: 166961 - RNA, 64 nt, Homo Sapiens; identical to SEQ ID NO: 77644

SEQ ID NO: 166962 - RNA, 64 nt, Homo Sapiens; identical to SEQ ID NO: 77645

SEQ ID NO: 166963 - RNA, 64 nt, Homo Sapiens; identical to SEQ ID NO: 77646

SEQ ID NO: 166964 - RNA, 64 nt, Homo Sapiens; identical to SEQ ID NO: 77647

SEQ ID NO: 166965 - RNA, 64 nt, Homo Sapiens; identical to SEQ ID NO: 77648

SEQ ID NO: 166966 - RNA, 64 nt, Homo Sapiens; identical to SEQ ID NO: 77649

SEQ ID NO: 166967 - RNA, 64 nt, Homo Sapiens; identical to SEQ ID NO: 77650

SEQ ID NO: 166968 - RNA, 64 nt, Homo Sapiens; identical to SEQ ID NO: 77651

SEQ ID NO: 166969 - RNA, 64 nt, Homo Sapiens; identical to SEQ ID NO: 77652

SEQ ID NO: 166970 - RNA, 64 nt, Homo Sapiens; identical to SEQ ID NO: 77653

SEQ ID NO: 166971 - RNA, 64 nt, Homo Sapiens; identical to SEQ ID NO: 77654

SEQ ID NO: 166972 - RNA, 64 nt, Homo Sapiens; identical to SEQ ID NO: 77655

SEQ ID NO: 166973 - RNA, 64 nt, Homo Sapiens; identical to SEQ ID NO: 77656

SEQ ID NO: 166974 - RNA, 64 nt, Homo Sapiens; identical to SEQ ID NO: 77657

SEQ ID NO: 166975 - RNA, 64 nt, Homo Sapiens; identical to SEQ ID NO: 77658

SEQ ID NO: 166976 - RNA, 64 nt, Homo Sapiens; identical to SEQ ID NO: 77659

SEQ ID NO: 166977 - RNA, 64 nt, Homo Sapiens; identical to SEQ ID NO: 77660

SEQ ID NO: 166978 - RNA, 63 nt, Homo Sapiens; identical to SEQ ID NO: 77661

SEQ ID NO: 166979 - RNA, 64 nt, Homo Sapiens; identical to SEQ ID NO: 77662

SEQ ID NO: 166980 - RNA, 64 nt, Homo Sapiens; identical to SEQ ID NO: 77663

SEQ ID NO: 166981 - RNA, 64 nt, Homo Sapiens; identical to SEQ ID NO: 77664

SEQ ID NO: 166982 - RNA, 64 nt, Homo Sapiens; identical to SEQ ID NO: 77665

SEQ ID NO: 166983 - RNA, 64 nt, Homo Sapiens; identical to SEQ ID NO: 77666

SEQ ID NO: 166984 - RNA, 64 nt, Homo Sapiens; identical to SEQ ID NO: 77667

SEQ ID NO: 166985 - RNA, 64 nt, Homo Sapiens; identical to SEQ ID NO: 77668

SEQ ID NO: 166986 - RNA, 64 nt, Homo Sapiens; identical to SEQ ID NO: 77669

SEQ ID NO: 166987 - RNA, 64 nt, Homo Sapiens; identical to SEQ ID NO: 77670

SEQ ID NO: 166988 - RNA, 64 nt, Homo Sapiens; identical to SEQ ID NO: 77671

SEQ ID NO: 166989 - RNA, 64 nt, Homo Sapiens; identical to SEQ ID NO: 77672

SEQ ID NO: 166990 - RNA, 64 nt, Homo Sapiens; identical to SEQ ID NO: 77673

SEQ ID NO: 166991 - RNA, 64 nt, Homo Sapiens; identical to SEQ ID NO: 77674

SEQ ID NO: 166992 - RNA, 64 nt, Homo Sapiens; identical to SEQ ID NO: 77675

SEQ ID NO: 166993 - RNA, 64 nt, Homo Sapiens; identical to SEQ ID NO: 77676

SEQ ID NO: 166994 - RNA, 64 nt, Homo Sapiens; identical to SEQ ID NO: 77677

SEQ ID NO: 166995 - RNA, 64 nt, Homo Sapiens; identical to SEQ ID NO: 77678

SEQ ID NO: 166996 - RNA, 64 nt, Homo Sapiens; identical to SEQ ID NO: 77679

SEQ ID NO: 166997 - RNA, 64 nt, Homo Sapiens; identical to SEQ ID NO: 77680

SEQ ID NO: 166998 - RNA, 64 nt, Homo Sapiens; identical to SEQ ID NO: 77681

SEQ ID NO: 166999 - RNA, 64 nt, Homo Sapiens; identical to SEQ ID NO: 77682

SEQ ID NO: 167000 - RNA, 64 nt, Homo Sapiens; identical to SEQ ID NO: 77683

SEQ ID NO: 167001 - RNA, 57 nt, Homo Sapiens; identical to SEQ ID NO: 77684

SEQ ID NO: 167002 - RNA, 64 nt, Homo Sapiens; identical to SEQ ID NO: 77685

SEQ ID NO: 167003 - RNA, 64 nt, Homo Sapiens; identical to SEQ ID NO: 77686

SEQ ID NO: 167004 - RNA, 64 nt, Homo Sapiens; identical to SEQ ID NO: 77687

SEQ ID NO: 167005 - RNA, 64 nt, Homo Sapiens; identical to SEQ ID NO: 77688

SEQ ID NO: 167006 - RNA, 64 nt, Homo Sapiens; identical to SEQ ID NO: 77689

SEQ ID NO: 167007 - RNA, 64 nt, Homo Sapiens; identical to SEQ ID NO: 77690

SEQ ID NO: 167008 - RNA, 64 nt, Homo Sapiens; identical to SEQ ID NO: 77691

SEQ ID NO: 167009 - RNA, 64 nt, Homo Sapiens; identical to SEQ ID NO: 77692

SEQ ID NO: 167010 - RNA, 64 nt, Homo Sapiens; identical to SEQ ID NO: 77693

SEQ ID NO: 167011 - RNA, 64 nt, Homo Sapiens; identical to SEQ ID NO: 77694

SEQ ID NO: 167012 - RNA, 64 nt, Homo Sapiens; identical to SEQ ID NO: 77695

SEQ ID NO: 167013 - RNA, 64 nt, Homo Sapiens; identical to SEQ ID NO: 77696

SEQ ID NO: 167014 - RNA, 64 nt, Homo Sapiens; identical to SEQ ID NO: 77697

SEQ ID NO: 167015 - RNA, 64 nt, Homo Sapiens; identical to SEQ ID NO: 77698

SEQ ID NO: 167016 - RNA, 64 nt, Homo Sapiens; identical to SEQ ID NO: 77699

SEQ ID NO: 167017 - RNA, 64 nt, Homo Sapiens; identical to SEQ ID NO: 77700

SEQ ID NO: 167018 - RNA, 64 nt, Homo Sapiens; identical to SEQ ID NO: 77701

SEQ ID NO: 167019 - RNA, 64 nt, Homo Sapiens; identical to SEQ ID NO: 77702

SEQ ID NO: 167020 - RNA, 63 nt, Homo Sapiens; identical to SEQ ID NO: 77703

SEQ ID NO: 167021 - RNA, 64 nt, Homo Sapiens; identical to SEQ ID NO: 77704

SEQ ID NO: 167022 - RNA, 64 nt, Homo Sapiens; identical to SEQ ID NO: 77705

SEQ ID NO: 167023 - RNA, 64 nt, Homo Sapiens; identical to SEQ ID NO: 77706

SEQ ID NO: 167024 - RNA, 64 nt, Homo Sapiens; identical to SEQ ID NO: 77707

SEQ ID NO: 167025 - RNA, 64 nt, Homo Sapiens; identical to SEQ ID NO: 77708

SEQ ID NO: 167026 - RNA, 64 nt, Homo Sapiens; identical to SEQ ID NO: 77709

SEQ ID NO: 167027 - RNA, 64 nt, Homo Sapiens; identical to SEQ ID NO: 77710

SEQ ID NO: 167028 - RNA, 64 nt, Homo Sapiens; identical to SEQ ID NO: 77711

SEQ ID NO: 167029 - RNA, 64 nt, Homo Sapiens; identical to SEQ ID NO: 77712

SEQ ID NO: 167030 - RNA, 64 nt, Homo Sapiens; identical to SEQ ID NO: 77713

SEQ ID NO: 167031 - RNA, 64 nt, Homo Sapiens; identical to SEQ ID NO: 77714

SEQ ID NO: 167032 - RNA, 64 nt, Homo Sapiens; identical to SEQ ID NO: 77715

SEQ ID NO: 167033 - RNA, 64 nt, Homo Sapiens; identical to SEQ ID NO: 77716

SEQ ID NO: 167034 - RNA, 64 nt, Homo Sapiens; identical to SEQ ID NO: 77717

SEQ ID NO: 167035 - RNA, 64 nt, Homo Sapiens; identical to SEQ ID NO: 77718

SEQ ID NO: 167036 - RNA, 64 nt, Homo Sapiens; identical to SEQ ID NO: 77719

SEQ ID NO: 167037 - RNA, 64 nt, Homo Sapiens; identical to SEQ ID NO: 77720

SEQ ID NO: 167038 - RNA, 64 nt, Homo Sapiens; identical to SEQ ID NO: 77721

SEQ ID NO: 167039 - RNA, 64 nt, Homo Sapiens; identical to SEQ ID NO: 77722

SEQ ID NO: 167040 - RNA, 64 nt, Homo Sapiens; identical to SEQ ID NO: 77723

SEQ ID NO: 167041 - RNA, 64 nt, Homo Sapiens; identical to SEQ ID NO: 77724

SEQ ID NO: 167042 - RNA, 64 nt, Homo Sapiens; identical to SEQ ID NO: 77725

SEQ ID NO: 167043 - RNA, 64 nt, Homo Sapiens; identical to SEQ ID NO: 77726

SEQ ID NO: 167044 - RNA, 64 nt, Homo Sapiens; identical to SEQ ID NO: 77727

SEQ ID NO: 167045 - RNA, 64 nt, Homo Sapiens; identical to SEQ ID NO: 77728

SEQ ID NO: 167046 - RNA, 64 nt, Homo Sapiens; identical to SEQ ID NO: 77729

SEQ ID NO: 167047 - RNA, 64 nt, Homo Sapiens; identical to SEQ ID NO: 77730

SEQ ID NO: 167048 - RNA, 64 nt, Homo Sapiens; identical to SEQ ID NO: 77731

SEQ ID NO: 167049 - RNA, 64 nt, Homo Sapiens; identical to SEQ ID NO: 77732

SEQ ID NO: 167050 - RNA, 64 nt, Homo Sapiens; identical to SEQ ID NO: 77733

SEQ ID NO: 167051 - RNA, 64 nt, Homo Sapiens; identical to SEQ ID NO: 77734

SEQ ID NO: 167052 - RNA, 64 nt, Homo Sapiens; identical to SEQ ID NO: 77735

SEQ ID NO: 167053 - RNA, 50 nt, Homo Sapiens; identical to SEQ ID NO: 77736

SEQ ID NO: 167054 - RNA, 64 nt, Homo Sapiens; identical to SEQ ID NO: 77737

SEQ ID NO: 167055 - RNA, 64 nt, Homo Sapiens; identical to SEQ ID NO: 77738

SEQ ID NO: 167056 - RNA, 64 nt, Homo Sapiens; identical to SEQ ID NO: 77739

SEQ ID NO: 167057 - RNA, 64 nt, Homo Sapiens; identical to SEQ ID NO: 77740

SEQ ID NO: 167058 - RNA, 64 nt, Homo Sapiens; identical to SEQ ID NO: 77741

SEQ ID NO: 167059 - RNA, 64 nt, Homo Sapiens; identical to SEQ ID NO: 77742

SEQ ID NO: 167060 - RNA, 64 nt, Homo Sapiens; identical to SEQ ID NO: 77743

SEQ ID NO: 167061 - RNA, 64 nt, Homo Sapiens; identical to SEQ ID NO: 77744

SEQ ID NO: 167062 - RNA, 64 nt, Homo Sapiens
auacaagacaggaagcacggucuuaggcggauggaggccugacgucccuggaguugaaagccca

SEQ ID NO: 167063 - RNA, 64 nt, Homo Sapiens
gguauauuugucaccagauuagagaggcgugucaaggccugaaggagcccaugugguuggauaa

SEQ ID NO: 167064 - RNA, 64 nt, Homo Sapiens
ggcagauugguucaugccugggccagaggaagggaggccugaggcccaugccccacucugcuga

SEQ ID NO: 167065 - RNA, 64 nt, Homo Sapiens
uaggugcuggcaugucugggcugugcuggucucuaggccugaacauaugccagugacugcugcg

SEQ ID NO: 167066 - RNA, 64 nt, Homo Sapiens
cuccccggacauggcccugccccuaugggacaccaggccugacucaggcagguucugcccccca

SEQ ID NO: 167067 - RNA, 64 nt, Homo Sapiens
cacacggccgccccacgugcugucgcucagcccgaggccugacuucucugggcugaggcugguc

SEQ ID NO: 167068 - RNA, 64 nt, Homo Sapiens
gaguguccagccaagggcugugaguguccggcugaggccugagccugcauguccggcugaaggc

SEQ ID NO: 167069 - RNA, 64 nt, Homo Sapiens
gaguguuuggccgaggccugccgcugggagucugaggccugaguggcccacacccaggcccgca

SEQ ID NO: 167070 - RNA, 64 nt, Homo Sapiens
aaggaguggcucagccccaccucugcccaucuggaggccugaguagggcccucggugcccacgc

SEQ ID NO: 167071 - RNA, 64 nt, Homo Sapiens
augugcacccucccagggacauggguuugcaggaaggccugaaccagugaaccccaugaagcug

SEQ ID NO: 167072 - RNA, 64 nt, Homo Sapiens
aagggaggaaacucaaagccgaaagcaaaauuccaggccugauucuggcuuuugagguuccugg

SEQ ID NO: 167073 - RNA, 64 nt, Homo Sapiens
auucuggcuuuugagguuccugguucuugaagccaggccugacccgacucucagauggggucag

SEQ ID NO: 167074 - RNA, 64 nt, Homo Sapiens
gguugagaacagacagcuguaacucuaggucccaaggccugaagauagaaugccccugaauggg

SEQ ID NO: 167075 - RNA, 64 nt, Homo Sapiens
uccaggagggguaggggagacaaaucacaggcuaaggccugaucuggcaguuuauugauuaguc

SEQ ID NO: 167076 - RNA, 64 nt, Homo Sapiens
aaaacaggcuguuugcugugcuuuuccaggcuucaggccugaaccucuggcuaggcucggcggc

SEQ ID NO: 167077 - RNA, 64 nt, Homo Sapiens
cacgcugcuuccccccacagcuugcaccagggugaggccugacugagggagaccugcuggugcc

SEQ ID NO: 167078 - RNA, 64 nt, Homo Sapiens
agcuguagagaggccugccuccagggcuggacugaggccugagcgcuccugccgcagagcuggc

SEQ ID NO: 167079 - RNA, 64 nt, Homo Sapiens
uccaaccuggggggcagugguguggagaagccacaggccugagauuucaucugcucuccuuccu

SEQ ID NO: 167080 - RNA, 64 nt, Homo Sapiens
uuggauuuacacuguaauaaauggggcccaggggaggccugagcccccaacgccggggcuuugc

SEQ ID NO: 167081 - RNA, 64 nt, Homo Sapiens
gucucccuccucugccuccuggaguggucuucacaggccugaugggaaggacacgaggacguca

SEQ ID NO: 167082 - RNA, 64 nt, Homo Sapiens
ccugcgccaguccugcuaccucccuugccuuucgaggccugaagccagcugcccuaugggccug

SEQ ID NO: 167083 - RNA, 64 nt, Homo Sapiens
uuauuauccuugggggcucccagggcaaggguuaaggccugaaucaugagccugcuggaagccc

SEQ ID NO: 167084 - RNA, 64 nt, Homo Sapiens
uccuuuucucaucaaucacugaugcugaagcugcaggccugagcccuuugucucccuggaugcu

SEQ ID NO: 167085 - RNA, 64 nt, Homo Sapiens
gcguccaggguacaggugcgggugguggggaugaaggccugaccagggagggagaagcagguuu

SEQ ID NO: 167086 - RNA, 64 nt, Homo Sapiens
gccccggugggcugaggcaggggccgcugucgucaggccugagccagggugagcuggugccugc

SEQ ID NO: 167087 - RNA, 64 nt, Homo Sapiens
cagccucuggggugcuuggucucugcgaagucaaaggccugacagcucuguggccugggaaucc

SEQ ID NO: 167088 - RNA, 64 nt, Homo Sapiens
gggguaaagauggguuuuuaaugauacuaagauaacugaaaauaggcauauagauauauuccaa

SEQ ID NO: 167089 - RNA, 64 nt, Homo Sapiens
gaccaucuggccaacauggugaaacccugucucuacugaaaauaaaaaaaacuagcugggcaug

SEQ ID NO: 167090 - RNA, 64 nt, Homo Sapiens
aucucuuuuaaaaagaaauuuugaguaacuuagaacugaaaaugaguaauaauagaauaaaggg

SEQ ID NO: 167091 - RNA, 64 nt, Homo Sapiens
auucaauccacuuuugggguaauuccauuuguggacugaaaaguaugauuaaguggggucacug

SEQ ID NO: 167092 - RNA, 64 nt, Homo Sapiens
agaaaauccccaacuaugcauuuaaccccuugguacugaaaaugugggagaagagaugcugcca

SEQ ID NO: 167093 - RNA, 64 nt, Homo Sapiens
auuccuggacaucaccagucaucuucaauuuauuacugaaaaugcauucugcuacuucacuguc

SEQ ID NO: 167094 - RNA, 64 nt, Homo Sapiens
cucugggucggucagugacauguagguaggaagcacugaaaauaguguucccagagcacuuugc

SEQ ID NO: 167095 - RNA, 64 nt, Homo Sapiens
uaagggcauuuuacccuugcaguuuuacuaaaacacugaaaaauauuccaagcuucauauuaac

SEQ ID NO: 167096 - RNA, 64 nt, Homo Sapiens
uguacuucugauuaaugcaaggggaaauuuuuauacugaaaacaaacaaacaaacuagcagcua

SEQ ID NO: 167097 - RNA, 64 nt, Homo Sapiens
auuauuuuauaaaauguuuucuguauggcaauaaacugaaaacauggaucaacccuucuuuuga

SEQ ID NO: 167098 - RNA, 64 nt, Homo Sapiens
aauguuagcuacuaugaauggugccagugaagacacugaaaaauaagugauuucaguaaccuuc

SEQ ID NO: 167099 - RNA, 64 nt, Homo Sapiens
ucucaguugugggaauaauuaucagagacaugcaacugaaaaugucucaccuuucaucuuuuuu

SEQ ID NO: 167100 - RNA, 64 nt, Homo Sapiens
gcaaauugcaaucauauaaaggaugauguagauuacugaaaaauaggaaacuugaaaggucuga

SEQ ID NO: 167101 - RNA, 64 nt, Homo Sapiens
gcagacagaggggcacgucuaccugcaggcagagacugaaaauucugaaugccucccucaaagg

SEQ ID NO: 167102 - RNA, 64 nt, Homo Sapiens
uuaauauuuaauguuuuaauucuguauauguugcacugaaaagguagaacuccuuacucugaug

SEQ ID NO: 167103 - RNA, 64 nt, Homo Sapiens
caacuccucuucuuagucuugagagagagagaguacugaaaaagaagaucuagugguucacaca

SEQ ID NO: 167104 - RNA, 64 nt, Homo Sapiens
uauacugauuagaaaugucuuguauguguugcugacugaaaagcucagacuucuacauuaauga

SEQ ID NO: 167105 - RNA, 64 nt, Homo Sapiens
aacaacgcugaguuuaucaauauguuuucuugucacugaaaacaucuuggguccccuuuccaug

SEQ ID NO: 167106 - RNA, 64 nt, Homo Sapiens
gaacagcauggauuaacucaguugacuuggcuguacugaaaaguggcugcuucaagucugugca

SEQ ID NO: 167107 - RNA, 64 nt, Homo Sapiens
cauugcaauuagggaacgcaaacauuauuuaaagacugaaaauuaguguuuauuuugaaucguu

SEQ ID NO: 167108 - RNA, 64 nt, Homo Sapiens
cuggucacacaaaauguuuacgaugugaugcugcacugaaaaaagaaugguuggagauugcugg

SEQ ID NO: 167109 - RNA, 64 nt, Homo Sapiens
aaauucucaggcuuuacagcuugcagaagaaccaacugaaaaaaucuuugcagguaucacagcc

SEQ ID NO: 167110 - RNA, 64 nt, Homo Sapiens
aaaaaaaagcucauauuaaugaaacauaggcagcacugaaaaaaccacauucuaccagcacaag

SEQ ID NO: 167111 - RNA, 64 nt, Homo Sapiens
gacuauauauaaucaauucaucaagccaguuauuacugaaaaaucauugaaaugagacaguuua

SEQ ID NO: 167112 - RNA, 64 nt, Homo Sapiens
agcuguuggagaggggaaaaguugugcauaaagaacugaaaaggguucuggaguguucauucag

SEQ ID NO: 167113 - RNA, 64 nt, Homo Sapiens
aaucugcccugcucagcagucaccauagcagcugacugaaaaucagcacugccugaguaguuuu

SEQ ID NO: 167114 - RNA, 64 nt, Homo Sapiens
uaguuuugaucaguuuaacuugaaucacuaacugacugaaaauugaaugggcaaauaagugcuu

SEQ ID NO: 167115 - RNA, 64 nt, Homo Sapiens
caacauacugugaugauacgcccauuaacuucguacugaaaaaggcaguuaaacagcaggaaag

SEQ ID NO: 167116 - RNA, 64 nt, Homo Sapiens
uaguccuaacgucuuugccuccacucugccucagacugaaaagcccucuugcucugcuauaucu

SEQ ID NO: 167117 - RNA, 64 nt, Homo Sapiens
aaauuuauucuuucgaagauugaaaauacaguggacugaaaagcagcuuggugauaaucaauuu

SEQ ID NO: 167118 - RNA, 64 nt, Homo Sapiens
uaguugcucuccuuuuuucucauggaugugaugcacugaaaaguagugccauacauuuuauccu

SEQ ID NO: 167119 - RNA, 64 nt, Homo Sapiens
agggcaauguuggucgccuuaagagguaauuuuuacugaaaauugcagggggaaagguaggaag

SEQ ID NO: 167120 - RNA, 64 nt, Homo Sapiens
uugaugugauucuugaaagguauuggacugauggacugaaaacaaaauagaguugcuccauuca

SEQ ID NO: 167121 - RNA, 64 nt, Homo Sapiens
uguuaaggcuauaguuuagccuucccaggaucaaacugaaaacaucauucagggcauauuuuuu

SEQ ID NO: 167122 - RNA, 64 nt, Homo Sapiens
auuuagaaagaagcuauugguacuauuuuuuucuacugaaaacauuuacacuaaggucuccaua

SEQ ID NO: 167123 - RNA, 64 nt, Homo Sapiens
caaauuuuaacuagcaaauggagaaaacuagaggacugaaaaaacaaguagcugaugugcaguu

SEQ ID NO: 167124 - RNA, 64 nt, Homo Sapiens
cuaguuaccugauuauugcacauuacauuuuuuaacugaaaaacuaaucuagcuuauauaaggu

SEQ ID NO: 167125 - RNA, 64 nt, Homo Sapiens
cuauguguuuuuuuaauuggaucuaggccaaaauacugaaaagcuuggacucauuugaacaaaa

SEQ ID NO: 167126 - RNA, 64 nt, Homo Sapiens
augaauuucaagauucucaauauuguuuuauucuacugaaaaaacuuuacguuuucaugcugcu

SEQ ID NO: 167127 - RNA, 64 nt, Homo Sapiens
ggagcuauuuauagauggaguaaugugguaccaaacugaaaauacagaacauuuuggggcaguu

SEQ ID NO: 167128 - RNA, 64 nt, Homo Sapiens
uauccaucuacacagcacccaguauauacugugcacugaaaaaaaaaguuaacuccuggacaca

SEQ ID NO: 167129 - RNA, 64 nt, Homo Sapiens
aaauugcuaucaagaauaaauugcuuuugcuugcacugaaaauuguauuacagugggcagguau

SEQ ID NO: 167130 - RNA, 64 nt, Homo Sapiens
aaauugcuaucaagagcaaauugcuuuugcuugcacugaaaauuggcagugagcagguaugugu

SEQ ID NO: 167131 - RNA, 64 nt, Homo Sapiens
cuauguagugaaauguauuugccauuaaauaauaacugaaaagaauccacuggaggucauuacu

SEQ ID NO: 167132 - RNA, 64 nt, Homo Sapiens
gacauccucugaaaauuccaagaaaugcaaauauacugaaaauuaccaugcuucaaaagaucua

SEQ ID NO: 167133 - RNA, 64 nt, Homo Sapiens
uauuaaagcuccaaauuuuagaagauuuugcagcacugaaaaucuuaucucacaagucaaaaau

SEQ ID NO: 167134 - RNA, 64 nt, Homo Sapiens
uguugguucauccagaagugcugacauaccuuagacugaaaaaccauaaaaauugaauucguuu

SEQ ID NO: 167135 - RNA, 64 nt, Homo Sapiens
aauuccuuucagauugggguauauauuaucuuauacugaaaaaaauuaguuuucuguauaugau

SEQ ID NO: 167136 - RNA, 64 nt, Homo Sapiens
ugguguugguauccaacuauacgaacuucgaccuacugaaaaggcaagcucuuagcgguuaucc

SEQ ID NO: 167137 - RNA, 64 nt, Homo Sapiens
agucaggaaaacuacaggugacccucuccuguuuacugaaaagguguguuuccugcugacuaca

SEQ ID NO: 167138 - RNA, 64 nt, Homo Sapiens
cuggcuaaugcucuuguguauguuaccuguucucacugaaaaguaccaagugcuggugccagcc

SEQ ID NO: 167139 - RNA, 64 nt, Homo Sapiens
gugaaauguacuaaauaaaaaugagggacugaauacugaaaacugagaugacuauaaaauguuc

SEQ ID NO: 167140 - RNA, 64 nt, Homo Sapiens
uccugugucuugauagcaugccucucaugaggcaacugaaaaaauaacugccaagcccagguug

SEQ ID NO: 167141 - RNA, 64 nt, Homo Sapiens
uuguagugaugacuaccaaauauagguaaccaacacugaaaacucuucugucuaguacuugucu

SEQ ID NO: 167142 - RNA, 64 nt, Homo Sapiens
aauuuaucaguaauuuuuaagauauaaucagagaacugaaaaguacaagaauguguaucuguug

SEQ ID NO: 167143 - RNA, 64 nt, Homo Sapiens
uaguuugaccucacagugacccuucccaaucagcacugaaaauaccaucaggccuaaucucaua

SEQ ID NO: 167144 - RNA, 64 nt, Homo Sapiens
uaaucucauaccucugaccaacaggcuguucugcacugaaaagguucuucaucccuuuccaguu

SEQ ID NO: 167145 - RNA, 64 nt, Homo Sapiens
aaaauaaaaauauguauucuacuccaucucaaaaacugaaaauaagccugggugacagagugag

SEQ ID NO: 167146 - RNA, 64 nt, Homo Sapiens
ucuacaacaaucuucaggaaggauccuugaaaacacugaaaaccuuauuuuuaagcugaaaagg

SEQ ID NO: 167147 - RNA, 64 nt, Homo Sapiens
aucacugaauggaauguucauaacuuauuggaaaacugaaaagaaucuccccucccuucaggaa

SEQ ID NO: 167148 - RNA, 64 nt, Homo Sapiens
gacucucuuugugacaaagaauaaacauauggaaacugaaaauggaacuugagaaaauuacuuc

SEQ ID NO: 167149 - RNA, 64 nt, Homo Sapiens
cgcugacuucauggaauggacauccuguauaagcacugaaaaacaacaacacaauaacacuaaa

SEQ ID NO: 167150 - RNA, 64 nt, Homo Sapiens
ugaaguguaccuguguacauaacucuguaaaaacacugaaaaauuauacuaacuuauuuauguu

SEQ ID NO: 167151 - RNA, 64 nt, Homo Sapiens
aaucacuuccuugaaaauuuggauccaauggaauacugaaaagacacacacacauucacccuaa

SEQ ID NO: 167152 - RNA, 64 nt, Homo Sapiens
gguaucaagaaaguccacugguuuuauccauucaacugaaaauucccuagcucucugugaaugu

SEQ ID NO: 167153 - RNA, 64 nt, Homo Sapiens
ccauccauuugggaaagaagacaaggggaaggguacugaaaacaagccuggagccaaagaugac

SEQ ID NO: 167154 - RNA, 64 nt, Homo Sapiens
aucacggagcugaccaucuuuaccugguccuggaacugaaaaacuguagcuugugugaaaauga

SEQ ID NO: 167155 - RNA, 64 nt, Homo Sapiens
accagcccaaccaacauggugaaacccugucuccacugaaaauacauaaaauuagccgggugca

SEQ ID NO: 167156 - RNA, 64 nt, Homo Sapiens
ucacauucuauuuuggguaucaugauggccuuacacugaaaauggaguuagguugucuccaggc

SEQ ID NO: 167157 - RNA, 64 nt, Homo Sapiens
uagccagaguuagguugucucucuaguaagaugcacugaaaacuugagcccauacuuuuggcuc

SEQ ID NO: 167158 - RNA, 64 nt, Homo Sapiens
cuggaguacagcgggagaaacacaaaauaguauaacugaaaacauuaacauucagacacacucc

SEQ ID NO: 167159 - RNA, 64 nt, Homo Sapiens
uguuuuuuuaauguuaaauguguaacucaguauuacugaaaagguacccacauuuugaauagua

SEQ ID NO: 167160 - RNA, 64 nt, Homo Sapiens
accuuccaaauuugccaagacccaacaaaaugcaacugaaaaauucauuaccaaaauacuaaaa

SEQ ID NO: 167161 - RNA, 64 nt, Homo Sapiens
caacuggcuacaaagaaggaaaaaauaaagguaaacugaaaagauauaucaucaggucuuaaaa

SEQ ID NO: 167162 - RNA, 64 nt, Homo Sapiens
caacuccaggagcuauggcauuuucaaugaagucacugaaaaucaggccauagaaacguuuuaa

SEQ ID NO: 167163 - RNA, 64 nt, Homo Sapiens
uuuuuuuaauucuucccuuggauuaauauuuucuacugaaaagaaaugaaaucucaguuccacu

SEQ ID NO: 167164 - RNA, 64 nt, Homo Sapiens
uccuuuuaaguaaccacucaaaacuuuucauuucacugaaaaaauaugaaaaaccaugacaaua

SEQ ID NO: 167165 - RNA, 64 nt, Homo Sapiens
aauugacagcuaguguuuuuacugaaaaccaauuacugaaaaaacagauugaaaaaaaaaaagc

SEQ ID NO: 167166 - RNA, 64 nt, Homo Sapiens
aauuacugaaaaaaaauugagaaaaaaaaaaagcacugaaaacccaucaccuucucaucagauu

SEQ ID NO: 167167 - RNA, 64 nt, Homo Sapiens
acgagagaaaagagagugguccugagugagucugacugaaaaaugugaugauucauuucaaaau

SEQ ID NO: 167168 - RNA, 64 nt, Homo Sapiens
gacuacucagauauguuggacacguguuuaaaaaacugaaaaguuaauccaaaucuauuuuucu

SEQ ID NO: 167169 - RNA, 64 nt, Homo Sapiens; identical to SEQ ID NO: 102259

SEQ ID NO: 167170 - RNA, 64 nt, Homo Sapiens; identical to SEQ ID NO: 102260

SEQ ID NO: 167171 - RNA, 64 nt, Homo Sapiens; identical to SEQ ID NO: 102261

SEQ ID NO: 167172 - RNA, 64 nt, Homo Sapiens; identical to SEQ ID NO: 102262

SEQ ID NO: 167173 - RNA, 64 nt, Homo Sapiens; identical to SEQ ID NO: 102263

SEQ ID NO: 167174 - RNA, 64 nt, Homo Sapiens; identical to SEQ ID NO: 102264

SEQ ID NO: 167175 - RNA, 64 nt, Homo Sapiens; identical to SEQ ID NO: 102265

SEQ ID NO: 167176 - RNA, 64 nt, Homo Sapiens; identical to SEQ ID NO: 102266

SEQ ID NO: 167177 - RNA, 64 nt, Homo Sapiens; identical to SEQ ID NO: 102267

SEQ ID NO: 167178 - RNA, 64 nt, Homo Sapiens; identical to SEQ ID NO: 102268

SEQ ID NO: 167179 - RNA, 64 nt, Homo Sapiens
aaguaccacuaacacagaugauugaucguuuccaggacaauaaaaguuucggaguugaacuauu

SEQ ID NO: 167180 - RNA, 64 nt, Homo Sapiens
acuggacuaauugaauaguuaagguuucuauucgggacaauaaaauguauuuugaaagugcugc

SEQ ID NO: 167181 - RNA, 64 nt, Homo Sapiens
uguuuugcuuucagcauugugccaugagggauuuggacaauauuuaagaacuucuuguccuaga

SEQ ID NO: 167182 - RNA, 64 nt, Homo Sapiens
aucccaggaucagaagccagggcuaauugggguaggacaauauucccagccccuaagcucugua

SEQ ID NO: 167183 - RNA, 51 nt, Homo Sapiens
uugugcaggaucugccauaaaggacaauaugaacugaugccuggacuauca

SEQ ID NO: 167184 - RNA, 64 nt, Homo Sapiens
cuuuauucaaguaaaaaucaauacccuuugaauuggacaauaaucucacuaccuuauuaggauu

SEQ ID NO: 167185 - RNA, 64 nt, Homo Sapiens
uuguugaucuuguauucagucagguuaaaacaacggacaauaaaagaaugaacacauuccucgu

SEQ ID NO: 167186 - RNA, 64 nt, Homo Sapiens
gggguuggacuguaagggauuuggcgcuuagagaggacaauacucaagggauuugaggugaggg

SEQ ID NO: 167187 - RNA, 58 nt, Homo Sapiens
guauuugcuucauugugugguaagaaguggacaauacacuucugcacagggccaauaa

SEQ ID NO: 167188 - RNA, 64 nt, Homo Sapiens
uuuuuuacuuugacggugaguuugcccuugacauggacaauagguugaggaacagcacaucagc

SEQ ID NO: 167189 - RNA, 64 nt, Homo Sapiens
gaggggaagucuuggaaaaugagaggaacucggaggacaauagggcuacugauaggaccaggaa

SEQ ID NO: 167190 - RNA, 64 nt, Homo Sapiens
guuguuuaaagcuggcacaaauaugccgauucugggacaauaaaguuuacugguuuuuauuccc

SEQ ID NO: 167191 - RNA, 64 nt, Homo Sapiens
augguguguuuuacagucuaccuagaaaauagauggacaauauuuuucaacuguaugagcacgu

SEQ ID NO: 167192 - RNA, 64 nt, Homo Sapiens
gugcuccuggaacaauccuuccaagcuccucuaaggacaauauuuaauucagauacuaaaggua

SEQ ID NO: 167193 - RNA, 64 nt, Homo Sapiens
caggaccgucugggccgguccacuuacacauguaggacaauaaguucucuaucugaaguguuca

SEQ ID NO: 167194 - RNA, 64 nt, Homo Sapiens
agaagugaauuaucccugcucuacccucucaaauggacaauaccugccguaguccuuuuuguaa

SEQ ID NO: 167195 - RNA, 64 nt, Homo Sapiens
gucauuccauaugauaaaacuugggaucauaccaggacaauaggcucaguacugcaucacugug

SEQ ID NO: 167196 - RNA, 64 nt, Homo Sapiens
auuuuauacucauggaagagauaagcuaaagaggggacaauaaugagaaauguuggugugcuuu

SEQ ID NO: 167197 - RNA, 64 nt, Homo Sapiens
augucagcuaccucugacccugcccuccagccugggacaauaaaagccuuuuuucuagacuguc

SEQ ID NO: 167198 - RNA, 64 nt, Homo Sapiens
ugugcauuuuauuaauuccuuaggggcacaaggaggacaauaauagcugaucuuuugaaauuug

SEQ ID NO: 167199 - RNA, 64 nt, Homo Sapiens
uccuuaggaaaaugcuucuguuguaauaguccauggacaauauaaacugaaaaaugucagucug

SEQ ID NO: 167200 - RNA, 64 nt, Homo Sapiens
ccaguaaucccuugugucuguugcaugaggacauggacaauaaaguaguauaugauccucagau

SEQ ID NO: 167201 - RNA, 64 nt, Homo Sapiens
caguuuccuuucaguaaucuuucugaaggagccaggacaauagggccuguuguuuagugaauuu

SEQ ID NO: 167202 - RNA, 64 nt, Homo Sapiens
aucccugguuuuaaguaucaauccuuguucagcuggacaauaugaaucuuuuccacugaaguua

SEQ ID NO: 167203 - RNA, 64 nt, Homo Sapiens
ugcacccuuguuuguguuauauguaaauagguuuggacaauauuuguaauucuagaggguaaaa

SEQ ID NO: 167204 - RNA, 64 nt, Homo Sapiens
ugcaaagcaauaucuuguucagucuccuuaccauggacaauacacugggaagagaucaaaaugg

SEQ ID NO: 167205 - RNA, 64 nt, Homo Sapiens
aaugugauauuugaagcaucacauaaaaaugaugggacaauaaauuuugccauaaagucaaauu

SEQ ID NO: 167206 - RNA, 64 nt, Homo Sapiens
uuuuugccuuacaguggaucauucuaguaggaaaggacaauaagauuuuuuaucaaaauguguc

SEQ ID NO: 167207 - RNA, 64 nt, Homo Sapiens
guuuaaauauguuguauuguuuuguuuaguuacaggacaauaaugaaauggaguuuauauuugu

SEQ ID NO: 167208 - RNA, 64 nt, Homo Sapiens
ugauaaccauauccccccagugcucaucaaaguaggacaauaaaaauccauccaucucagucca

SEQ ID NO: 167209 - RNA, 64 nt, Homo Sapiens
ugcuuuuagaaacuguaaagguucuuccagcuuuggacaauaacgcucaucugagaagacuuaa

SEQ ID NO: 167210 - RNA, 64 nt, Homo Sapiens
auguuaaaaaggaggaaauauacauaagcuucaaggacaauaaguugguuuuuaacuuccucca

SEQ ID NO: 167211 - RNA, 64 nt, Homo Sapiens
uacaaaggcaacagcaacuuaaaaaagaaaaucuggacaauagauguggacuccaaggggccac

SEQ ID NO: 167212 - RNA, 64 nt, Homo Sapiens
auucuuaucuuccagaggcuacaauuauuauaauggacaauacuuuuaccuuugucucuaaaga

SEQ ID NO: 167213 - RNA, 64 nt, Homo Sapiens
aaagcuacugugauugauagcauuguaagaaucgggacaauauuguauucaacuguuuuauuuu

SEQ ID NO: 167214 - RNA, 64 nt, Homo Sapiens
ugcaugguagacuuuguggcauuugauacaacuuggacaauaccuaguuuggagggaggggaau

SEQ ID NO: 167215 - RNA, 64 nt, Homo Sapiens
acacuggcucuggaaucugggaagaaaagagcugggacaauaaaaauugauaaauccuaaagag

SEQ ID NO: 167216 - RNA, 64 nt, Homo Sapiens
ggaggaaaagugaagauuguugguaacuacucugggacaauauggacugcuuagccccuaaaua

SEQ ID NO: 167217 - RNA, 64 nt, Homo Sapiens
aaauuuacuuugugcccuacacagggaucagaugggacaauauccaucuuaauuagaugcaggg

SEQ ID NO: 167218 - RNA, 64 nt, Homo Sapiens
gacccuggagugugugugugugguguuucuacagggacaauacaagcaccuuugggcuuuguuu

SEQ ID NO: 167219 - RNA, 64 nt, Homo Sapiens
uauucaaaaugcaucccuaauauguuaaaaacaaggacaauaaaaauuauguaaauuugcaaau

SEQ ID NO: 167220 - RNA, 64 nt, Homo Sapiens
agguuaaauaucuccuaauuagaugugcucuaaaggacaauaaaaauaugguuaguccaaauug

SEQ ID NO: 167221 - RNA, 64 nt, Homo Sapiens
gaagacuauucuuauccucacuuaugaacuguacggacaauacaugacuaacaaugacaaaggc

SEQ ID NO: 167222 - RNA, 64 nt, Homo Sapiens
gaacauacaguuuuuuugugacuaugcaauuuuaggacaauaaaaagcgugcacaaucaaaagu

SEQ ID NO: 167223 - RNA, 64 nt, Homo Sapiens
uuagaucaaaaaggcaaaugauuuuauaaacaauggacaauauauacuuucuuaagaucuaagg

SEQ ID NO: 167224 - RNA, 64 nt, Homo Sapiens
caagggaggucaaaaggagaaaaguauaggcuguggacaauaacugaugaauauagggcccaga

SEQ ID NO: 167225 - RNA, 64 nt, Homo Sapiens
ugaaacacuacuugguauugaauacaccacuugaggacaauaucaugacucacgguuuaucaag

SEQ ID NO: 167226 - RNA, 64 nt, Homo Sapiens
ugugaugcuggugggaauuguuugcauagaggaaggacaauaacccugccaucgugaguuaaug

SEQ ID NO: 167227 - RNA, 64 nt, Homo Sapiens
ccagggauucauugacuucucuggaaggauucugggacaauauuuggccagucguauaccaucc

SEQ ID NO: 167228 - RNA, 64 nt, Homo Sapiens
uccuacuucucaagauuguuugucuugugaaagaggacaauaauacccuuggccucauuuuucc

SEQ ID NO: 167229 - RNA, 64 nt, Homo Sapiens
aaagcugcauguaaaagggguugugccauuguuuggacaauauugguugacuuuguuucuuuau

SEQ ID NO: 167230 - RNA, 64 nt, Homo Sapiens
guagguuauggauggaggugagggaguguuuaguggacaauagugauacggaauuuacacaggu

SEQ ID NO: 167231 - RNA, 64 nt, Homo Sapiens
aguuauggcaaaaagcaaaacacaguuuauuggaggacaauaaggagauggauaugauagauua

SEQ ID NO: 167232 - RNA, 64 nt, Homo Sapiens
guggaauuguugaaguguggcgagucugugcucgggacaauaaagcuugugacagguccaggac

SEQ ID NO: 167233 - RNA, 64 nt, Homo Sapiens
aguggggauuuuuuucuucuucccuuucucuuuuggacaauaguuaaauuagcaguauuaguua

SEQ ID NO: 167234 - RNA, 64 nt, Homo Sapiens
gcauuuucaaaauggagaguccaaauaaccaguuggacaauauucaugauuuuucauugucaca

SEQ ID NO: 167235 - RNA, 64 nt, Homo Sapiens
aaccugcaaaacacagauucacuccagucacuagggacaauagaguagcauuucacugaucuuc

SEQ ID NO: 167236 - RNA, 64 nt, Homo Sapiens
ugaugcccuuaaaaugcugaauaagucaccaccuggacaauaauggauggaaaaguuucauguc

SEQ ID NO: 167237 - RNA, 64 nt, Homo Sapiens
agauuuuaaagugauuuuugagaagacuugggggggacaauaauagacauucaugucagauccc

SEQ ID NO: 167238 - RNA, 64 nt, Homo Sapiens
auugccguggguugauagcuggaggaauuguuuuggacaauacuaacaugugaauuuaugucuu

SEQ ID NO: 167239 - RNA, 64 nt, Homo Sapiens
ugaaagauacaaagugauuauaaaagaauugacaggacaauaaauacuucaaauacuuuuagga

SEQ ID NO: 167240 - RNA, 64 nt, Homo Sapiens
gcuguaggaauaaccuugcugauaagaaaaaaagggacaauauuggagaaacuaccucuuguuu

SEQ ID NO: 167241 - RNA, 64 nt, Homo Sapiens
agagcuuuuaaaaaggaaggaucuuuugguuaggggacaauauuugucauucuaagauucccau

SEQ ID NO: 167242 - RNA, 64 nt, Homo Sapiens
ucugagcaugccccaaaaaacuuuaguccuaaagggacaauaacgggggggguggggggugcgu

SEQ ID NO: 167243 - RNA, 64 nt, Homo Sapiens
aauaagacauugaaggaccaugaacauuucacgaggacaauaaagggaacaucuuaacuguaua

SEQ ID NO: 167244 - RNA, 64 nt, Homo Sapiens
ugugugguagaaacaaacucgaacuguaguacauggacaauaagccauuuuuguaagccauaau

SEQ ID NO: 167245 - RNA, 64 nt, Homo Sapiens
ccugcuuucacuguguuguucaugguggcuuuuuggacaauaaagaaucuaaaaugggugggga

SEQ ID NO: 167246 - RNA, 64 nt, Homo Sapiens
ucaacuuuuuuuuuuuuuuuuuuuacuuuggaaaggacaauaacuauaaaccuauauccagauu

SEQ ID NO: 167247 - RNA, 64 nt, Homo Sapiens
ucagcaggaacuggucauacaggguaagcaccagggacaauaaggauuuuuauagauauaauuu

SEQ ID NO: 167248 - RNA, 64 nt, Homo Sapiens
cguugggucaaaauggagccgacauguuguaaaaggacaauaaacaguuucuaaaccaaaaaau

SEQ ID NO: 167249 - RNA, 64 nt, Homo Sapiens
uccaacucaauaacuucaacauuuuuacucccaaggacaauaaaccaauauucaaauccagaug

SEQ ID NO: 167250 - RNA, 64 nt, Homo Sapiens
uaaaugacaggaagguauauuuugaucacucugaggacaauauugacccacaggccaugaccuu

SEQ ID NO: 167251 - RNA, 64 nt, Homo Sapiens
aaaccauggcuccuccucagaagagacacucacuggacaauaucaguggcagcauucugaggcc

SEQ ID NO: 167252 - RNA, 64 nt, Homo Sapiens
caucugagcagugccucgugggagggagggcgguggacaauaaaccagcuuguucugggcucag

SEQ ID NO: 167253 - RNA, 64 nt, Homo Sapiens
auuccuggcccugagaauggagcuguagccucauggacaauaaauggaugugacaccaaauacu

SEQ ID NO: 167254 - RNA, 64 nt, Homo Sapiens
uauuuauacccauauucacaguugcaaauauaauggacaauauuagacgugauaccaaaauuuu

SEQ ID NO: 167255 - RNA, 64 nt, Homo Sapiens
acgggggccaccuacccccaaccagcaacacccgggacaauaauacuccucaacaggcauaauc

SEQ ID NO: 167256 - RNA, 64 nt, Homo Sapiens
cugagaacaugucuggagggaagccugugcauguggacaauacucaacaaggguuuuuagcuuu

SEQ ID NO: 167257 - RNA, 64 nt, Homo Sapiens
ggggugugggcuggaagcacuggcucccugguagggacaauaaagguuuugggucuuucugaga

SEQ ID NO: 167258 - RNA, 64 nt, Homo Sapiens
aguccuauuaagaaauauuugucuuaaauauauaggacaauacauuauauuaaaauggucucuc

SEQ ID NO: 167259 - RNA, 64 nt, Homo Sapiens
caaccucaaccuaucuuuauguuuuaaauguuagggacaauaaguugaaauagcuagaggagcu

SEQ ID NO: 167260 - RNA, 64 nt, Homo Sapiens
uguuuuaaggaugauaaaaaaaaauaacaacuagggacaauacagaacccauuccauuuaucuu

SEQ ID NO: 167261 - RNA, 64 nt, Homo Sapiens
gccugcuguccugcgucuauccauguggaaugcuggacaauaaagcgagugcugcccacccucc

SEQ ID NO: 167262 - RNA, 63 nt, Homo Sapiens
cuuucauauauauggcauaauuuugaauaucauggacaauauuuagaacccaaauuuuggagu

SEQ ID NO: 167263 - RNA, 64 nt, Homo Sapiens
agugggggagggcaccucagcaaccucugaguguggacaauagcugcuuucuucucuauccaag

SEQ ID NO: 167264 - RNA, 64 nt, Homo Sapiens
guccacuagaaaugcaccccgugguguuggagcaggacaauaaacuugcaggucccuuucuacu

SEQ ID NO: 167265 - RNA, 64 nt, Homo Sapiens
aaucucauuuugauucuacuuagaaaggaucaggggacaauaaucuuaaagaaguuaugaacuu

SEQ ID NO: 167266 - RNA, 64 nt, Homo Sapiens
acagauuuggaaugagcaguggccauaggaugcuggacaauaggccacugaacuuucuggaaug

SEQ ID NO: 167267 - RNA, 64 nt, Homo Sapiens
auuuuuuuaaauaacuggacauaugucauuuuaaggacaauagaaacacuuagacuuacuugaa

SEQ ID NO: 167268 - RNA, 64 nt, Homo Sapiens
gugcaauuuaauauagaaagauuucugccuguuuggacaauagguuuuggguaguacagauuag

SEQ ID NO: 167269 - RNA, 64 nt, Homo Sapiens
gaguugcuuaaaccaaugggacuaaaaccugaugggacaauaacgccuuuggaggaagcacuca

SEQ ID NO: 167270 - RNA, 64 nt, Homo Sapiens
uaaaaauguauauaaagcauaugagcacacaaauggacaauaaaugccacagcgcaaaagcgug

SEQ ID NO: 167271 - RNA, 64 nt, Homo Sapiens
cuguuggaagugacaacugauggagagccugaugggacaauaccacgcacacugccguccaaug

SEQ ID NO: 167272 - RNA, 64 nt, Homo Sapiens
ucuugguggacuccagcugcaaaagaucccugauggacaauacucagcaguuuagugccugcug

SEQ ID NO: 167273 - RNA, 64 nt, Homo Sapiens
agcugccuguucaugaauuuggauaagaauaguaggacaauauucaacacaauuuaauuuuugu

SEQ ID NO: 167274 - RNA, 64 nt, Homo Sapiens
ugccaaucaauagcaccccucuaaacuccaggggggacaauaugauaaaagcuuucugccaccc

SEQ ID NO: 167275 - RNA, 64 nt, Homo Sapiens
aaaucugugugauuguuugcaguauuaauuccauggacaauauauaaaaagaagaauuuuuuua

SEQ ID NO: 167276 - RNA, 64 nt, Homo Sapiens
acuggacugcucuccggcuucagaagcugcuacaggacaauaacgucauguuuaauacagagcc

SEQ ID NO: 167277 - RNA, 64 nt, Homo Sapiens
ccucuuuccaaguguguuagucaugugcaaggaaggacaauaguuuugguucauuugguuuuug

SEQ ID NO: 167278 - RNA, 64 nt, Homo Sapiens
gcaauguccuucaaaauuauguacauauugaagaggacaauaugucucauaacagcugacagaa

SEQ ID NO: 167279 - RNA, 64 nt, Homo Sapiens
cagcguccaguccuccugggcggccccagguccuggacaauaagcaacagaugauauugagugu

SEQ ID NO: 167280 - RNA, 64 nt, Homo Sapiens
gacuggaagucaucaugugcaugaaaaaagauugggacaauagauuuacccauaaauaacauga

SEQ ID NO: 167281 - RNA, 64 nt, Homo Sapiens
uggugcuaugacugccuuccgguguguguacuuuggacaauaaauguguggggaggggcccuca

SEQ ID NO: 167282 - RNA, 64 nt, Homo Sapiens
cccgccugacaaacaggcagggagccacagucagggacaauaaaaacuuggugcacucugaaag

SEQ ID NO: 167283 - RNA, 64 nt, Homo Sapiens
aauuuguauauuagaaacuuauucaucccacucaggacaauaaaaacgaauguacaaaaagccc

SEQ ID NO: 167284 - RNA, 64 nt, Homo Sapiens
ggacuugacuugcaauuucuaccuagaaauacauggacaauacccccaggccucagucucccuu

SEQ ID NO: 167285 - RNA, 64 nt, Homo Sapiens
gguguaaacacagguaccugguggugggaggagcggacaauaaagaacccaggaauccuugggg

SEQ ID NO: 167286 - RNA, 64 nt, Homo Sapiens
aauuccuuaaauacauacaguaggugaauuuucaggacaauauugccucacaacccugcuuaca

SEQ ID NO: 167287 - RNA, 64 nt, Homo Sapiens
agggagcaggaaaucagugcuggggguggugggcggacaauaggaucacugccugccagaucuu

SEQ ID NO: 167288 - RNA, 64 nt, Homo Sapiens
gggcugguuccugcugcagugaggggaacagaugggacaauaaagacuggagacucaguugaau

SEQ ID NO: 167289 - RNA, 64 nt, Homo Sapiens
ccuccuuccccaagcugagaagcugagagcuggaggacaauauccagggacauggcucuggaaa

SEQ ID NO: 167290 - RNA, 64 nt, Homo Sapiens
cagaagucagaaguuuggaauguggugggucaaaggacaauaugggugggcauucuggagaguu

SEQ ID NO: 167291 - RNA, 64 nt, Homo Sapiens
caguauuaucaaagagaacgaucgcucgguccguggacaauaaacuuuguaucauucuugagca

SEQ ID NO: 167292 - RNA, 64 nt, Homo Sapiens
gugcaugccacccgggguccgccucuccucccugggacaauagugcagcaccuggggagucccu

SEQ ID NO: 167293 - RNA, 64 nt, Homo Sapiens
ucaauauuuuuaaagugccaacacagucaugauaggacaauauuuuaugugugugugugcgccu

SEQ ID NO: 167294 - RNA, 64 nt, Homo Sapiens
auuuauuuuugcauccaaccaagaaggaugaggaggacaauaauagggcgggcuagaaggccaa

SEQ ID NO: 167295 - RNA, 64 nt, Homo Sapiens
aucuagaagaacuuggauggagagacuugcgauaggacaauaaacugcuuuuugaauugagaag

SEQ ID NO: 167296 - RNA, 64 nt, Homo Sapiens
ggaauaaaagcuggcgagcgcaggacaugggcggggacaauaagcuguaaaauggaccaaucag

SEQ ID NO: 167297 - RNA, 64 nt, Homo Sapiens
gugaaacccugucucuacuauucaagaccacccuggacaauaugguggcuuacaaggucaggag

SEQ ID NO: 167298 - RNA, 64 nt, Homo Sapiens
agugguucuuaggcagauacucuagaugcuuuauggacaauauuauuuucauuggaugauucug

SEQ ID NO: 167299 - RNA, 64 nt, Homo Sapiens
ccuccgccaaugcacggccucgccccugcagcacggacaauaaaaccggcgcgcucuucgcgcc

SEQ ID NO: 167300 - RNA, 64 nt, Homo Sapiens
uauuuuugcugaaacccaauaggcagggacaccuggacaauauuagcacaggggacgcaauggg

SEQ ID NO: 167301 - RNA, 64 nt, Homo Sapiens
caaguuuccuuccucuguaccacucugcuuccuuggacaauaucaguaauagcuuuguaaguga

SEQ ID NO: 167302 - RNA, 64 nt, Homo Sapiens
acuuaccuuaugcacaaagguauucccagguaggggacaauaguagcauucgcaguggugauaa

SEQ ID NO: 167303 - RNA, 64 nt, Homo Sapiens
caauucacaacuuagcauuuagaaacaacuagcuggacaauacuccagagucucuagggcaagg

SEQ ID NO: 167304 - RNA, 64 nt, Homo Sapiens
cuucauguuggauucuccaacuuagguucucaagggacaauaguuccccuccuuguacuuuugc

SEQ ID NO: 167305 - RNA, 64 nt, Homo Sapiens
uggaacuacauuagagcuggcagaagugccuucaggacaauaagggaugaaacuagaguggucu

SEQ ID NO: 167306 - RNA, 64 nt, Homo Sapiens
aagaggcuggacacccuacagugagauucaaguaggacaauaacgaucucuggggcuuccgggg

SEQ ID NO: 167307 - RNA, 64 nt, Homo Sapiens
uucaaacucuccuuuaaauuacagacaaucaaaacauugauauauugcacagacacaaaaauau

SEQ ID NO: 167308 - RNA, 64 nt, Homo Sapiens
cauccuuuauaggcuuccugagcagggcaaguuacauugauauuuaagcugugcagagguugac

SEQ ID NO: 167309 - RNA, 64 nt, Homo Sapiens
ugauuacacuguggcacgaaggagcuaauggucacauugauaguugucgaucuuuacuuguggc

SEQ ID NO: 167310 - RNA, 64 nt, Homo Sapiens
uauucuuucuguccccacgucucuagaaguuauacauugauauugguccuguuguuuauuauca

SEQ ID NO: 167311 - RNA, 64 nt, Homo Sapiens; identical to SEQ ID NO: 93343

SEQ ID NO: 167312 - RNA, 64 nt, Homo Sapiens; identical to SEQ ID NO: 93344

SEQ ID NO: 167313 - RNA, 64 nt, Homo Sapiens; identical to SEQ ID NO: 93345

SEQ ID NO: 167314 - RNA, 64 nt, Homo Sapiens; identical to SEQ ID NO: 93346

SEQ ID NO: 167315 - RNA, 64 nt, Homo Sapiens; identical to SEQ ID NO: 93347

SEQ ID NO: 167316 - RNA, 64 nt, Homo Sapiens; identical to SEQ ID NO: 93348

SEQ ID NO: 167317 - RNA, 64 nt, Homo Sapiens; identical to SEQ ID NO: 93349

SEQ ID NO: 167318 - RNA, 64 nt, Homo Sapiens; identical to SEQ ID NO: 93350

SEQ ID NO: 167319 - RNA, 64 nt, Homo Sapiens; identical to SEQ ID NO: 93351

SEQ ID NO: 167320 - RNA, 64 nt, Homo Sapiens; identical to SEQ ID NO: 93352

SEQ ID NO: 167321 - RNA, 64 nt, Homo Sapiens; identical to SEQ ID NO: 93353

SEQ ID NO: 167322 - RNA, 64 nt, Homo Sapiens; identical to SEQ ID NO: 93354

SEQ ID NO: 167323 - RNA, 64 nt, Homo Sapiens; identical to SEQ ID NO: 93355

SEQ ID NO: 167324 - RNA, 64 nt, Homo Sapiens; identical to SEQ ID NO: 93356

SEQ ID NO: 167325 - RNA, 64 nt, Homo Sapiens; identical to SEQ ID NO: 93357

SEQ ID NO: 167326 - RNA, 64 nt, Homo Sapiens; identical to SEQ ID NO: 93358

SEQ ID NO: 167327 - RNA, 64 nt, Homo Sapiens; identical to SEQ ID NO: 93359

SEQ ID NO: 167328 - RNA, 64 nt, Homo Sapiens; identical to SEQ ID NO: 93360

SEQ ID NO: 167329 - RNA, 64 nt, Homo Sapiens; identical to SEQ ID NO: 93361

SEQ ID NO: 167330 - RNA, 64 nt, Homo Sapiens; identical to SEQ ID NO: 93362

SEQ ID NO: 167331 - RNA, 64 nt, Homo Sapiens; identical to SEQ ID NO: 93363

SEQ ID NO: 167332 - RNA, 64 nt, Homo Sapiens; identical to SEQ ID NO: 93364

SEQ ID NO: 167333 - RNA, 64 nt, Homo Sapiens; identical to SEQ ID NO: 93365

SEQ ID NO: 167334 - RNA, 64 nt, Homo Sapiens; identical to SEQ ID NO: 93366

SEQ ID NO: 167335 - RNA, 64 nt, Homo Sapiens; identical to SEQ ID NO: 93367

SEQ ID NO: 167336 - RNA, 64 nt, Homo Sapiens; identical to SEQ ID NO: 93368

SEQ ID NO: 167337 - RNA, 64 nt, Homo Sapiens; identical to SEQ ID NO: 93369

SEQ ID NO: 167338 - RNA, 64 nt, Homo Sapiens; identical to SEQ ID NO: 93370

SEQ ID NO: 167339 - RNA, 64 nt, Homo Sapiens; identical to SEQ ID NO: 93371

SEQ ID NO: 167340 - RNA, 64 nt, Homo Sapiens; identical to SEQ ID NO: 93372

SEQ ID NO: 167341 - RNA, 64 nt, Homo Sapiens; identical to SEQ ID NO: 93373

SEQ ID NO: 167342 - RNA, 64 nt, Homo Sapiens; identical to SEQ ID NO: 93374

SEQ ID NO: 167343 - RNA, 64 nt, Homo Sapiens; identical to SEQ ID NO: 93375

SEQ ID NO: 167344 - RNA, 64 nt, Homo Sapiens; identical to SEQ ID NO: 93376

SEQ ID NO: 167345 - RNA, 64 nt, Homo Sapiens; identical to SEQ ID NO: 93377

SEQ ID NO: 167346 - RNA, 64 nt, Homo Sapiens; identical to SEQ ID NO: 93378

SEQ ID NO: 167347 - RNA, 64 nt, Homo Sapiens; identical to SEQ ID NO: 93379

SEQ ID NO: 167348 - RNA, 64 nt, Homo Sapiens; identical to SEQ ID NO: 93380

SEQ ID NO: 167349 - RNA, 64 nt, Homo Sapiens; identical to SEQ ID NO: 93381

SEQ ID NO: 167350 - RNA, 64 nt, Homo Sapiens; identical to SEQ ID NO: 93382

SEQ ID NO: 167351 - RNA, 64 nt, Homo Sapiens; identical to SEQ ID NO: 93383

SEQ ID NO: 167352 - RNA, 64 nt, Homo Sapiens; identical to SEQ ID NO: 93384

SEQ ID NO: 167353 - RNA, 64 nt, Homo Sapiens; identical to SEQ ID NO: 93385

SEQ ID NO: 167354 - RNA, 64 nt, Homo Sapiens; identical to SEQ ID NO: 93386

SEQ ID NO: 167355 - RNA, 64 nt, Homo Sapiens; identical to SEQ ID NO: 93387

SEQ ID NO: 167356 - RNA, 64 nt, Homo Sapiens; identical to SEQ ID NO: 93388

SEQ ID NO: 167357 - RNA, 64 nt, Homo Sapiens; identical to SEQ ID NO: 93389

SEQ ID NO: 167358 - RNA, 64 nt, Homo Sapiens; identical to SEQ ID NO: 93390

SEQ ID NO: 167359 - RNA, 64 nt, Homo Sapiens; identical to SEQ ID NO: 93391

SEQ ID NO: 167360 - RNA, 64 nt, Homo Sapiens; identical to SEQ ID NO: 93392

SEQ ID NO: 167361 - RNA, 64 nt, Homo Sapiens; identical to SEQ ID NO: 93393

SEQ ID NO: 167362 - RNA, 64 nt, Homo Sapiens; identical to SEQ ID NO: 93394

SEQ ID NO: 167363 - RNA, 64 nt, Homo Sapiens; identical to SEQ ID NO: 93395

SEQ ID NO: 167364 - RNA, 64 nt, Homo Sapiens; identical to SEQ ID NO: 93396

SEQ ID NO: 167365 - RNA, 64 nt, Homo Sapiens; identical to SEQ ID NO: 93397

SEQ ID NO: 167366 - RNA, 64 nt, Homo Sapiens; identical to SEQ ID NO: 93398

SEQ ID NO: 167367 - RNA, 64 nt, Homo Sapiens; identical to SEQ ID NO: 93399

SEQ ID NO: 167368 - RNA, 64 nt, Homo Sapiens; identical to SEQ ID NO: 93400

SEQ ID NO: 167369 - RNA, 64 nt, Homo Sapiens; identical to SEQ ID NO: 93401

SEQ ID NO: 167370 - RNA, 64 nt, Homo Sapiens; identical to SEQ ID NO: 93402

SEQ ID NO: 167371 - RNA, 64 nt, Homo Sapiens; identical to SEQ ID NO: 93403

SEQ ID NO: 167372 - RNA, 64 nt, Homo Sapiens; identical to SEQ ID NO: 93404

SEQ ID NO: 167373 - RNA, 64 nt, Homo Sapiens; identical to SEQ ID NO: 93405

SEQ ID NO: 167374 - RNA, 64 nt, Homo Sapiens; identical to SEQ ID NO: 93406

SEQ ID NO: 167375 - RNA, 64 nt, Homo Sapiens; identical to SEQ ID NO: 93407

SEQ ID NO: 167376 - RNA, 64 nt, Homo Sapiens; identical to SEQ ID NO: 93408

SEQ ID NO: 167377 - RNA, 64 nt, Homo Sapiens; identical to SEQ ID NO: 93409

SEQ ID NO: 167378 - RNA, 64 nt, Homo Sapiens; identical to SEQ ID NO: 93410

SEQ ID NO: 167379 - RNA, 64 nt, Homo Sapiens; identical to SEQ ID NO: 93411

SEQ ID NO: 167380 - RNA, 64 nt, Homo Sapiens; identical to SEQ ID NO: 93412

SEQ ID NO: 167381 - RNA, 64 nt, Homo Sapiens; identical to SEQ ID NO: 93413

SEQ ID NO: 167382 - RNA, 64 nt, Homo Sapiens; identical to SEQ ID NO: 93414

SEQ ID NO: 167383 - RNA, 64 nt, Homo Sapiens; identical to SEQ ID NO: 93415

SEQ ID NO: 167384 - RNA, 64 nt, Homo Sapiens; identical to SEQ ID NO: 93416

SEQ ID NO: 167385 - RNA, 64 nt, Homo Sapiens; identical to SEQ ID NO: 93417

SEQ ID NO: 167386 - RNA, 64 nt, Homo Sapiens; identical to SEQ ID NO: 93418

SEQ ID NO: 167387 - RNA, 64 nt, Homo Sapiens; identical to SEQ ID NO: 93419

SEQ ID NO: 167388 - RNA, 64 nt, Homo Sapiens; identical to SEQ ID NO: 93420

SEQ ID NO: 167389 - RNA, 64 nt, Homo Sapiens; identical to SEQ ID NO: 93421

SEQ ID NO: 167390 - RNA, 64 nt, Homo Sapiens; identical to SEQ ID NO: 93422

SEQ ID NO: 167391 - RNA, 64 nt, Homo Sapiens; identical to SEQ ID NO: 93423

SEQ ID NO: 167392 - RNA, 64 nt, Homo Sapiens; identical to SEQ ID NO: 93424

SEQ ID NO: 167393 - RNA, 64 nt, Homo Sapiens; identical to SEQ ID NO: 93425

SEQ ID NO: 167394 - RNA, 64 nt, Homo Sapiens; identical to SEQ ID NO: 93426

SEQ ID NO: 167395 - RNA, 64 nt, Homo Sapiens; identical to SEQ ID NO: 93427

SEQ ID NO: 167396 - RNA, 64 nt, Homo Sapiens; identical to SEQ ID NO: 93428

SEQ ID NO: 167397 - RNA, 64 nt, Homo Sapiens; identical to SEQ ID NO: 93429

SEQ ID NO: 167398 - RNA, 64 nt, Homo Sapiens; identical to SEQ ID NO: 93430

SEQ ID NO: 167399 - RNA, 64 nt, Homo Sapiens; identical to SEQ ID NO: 93431

SEQ ID NO: 167400 - RNA, 64 nt, Homo Sapiens; identical to SEQ ID NO: 93432

SEQ ID NO: 167401 - RNA, 64 nt, Homo Sapiens; identical to SEQ ID NO: 93433

SEQ ID NO: 167402 - RNA, 64 nt, Homo Sapiens; identical to SEQ ID NO: 93434

SEQ ID NO: 167403 - RNA, 64 nt, Homo Sapiens; identical to SEQ ID NO: 93435

SEQ ID NO: 167404 - RNA, 64 nt, Homo Sapiens; identical to SEQ ID NO: 93436

SEQ ID NO: 167405 - RNA, 64 nt, Homo Sapiens; identical to SEQ ID NO: 93437

SEQ ID NO: 167406 - RNA, 64 nt, Homo Sapiens; identical to SEQ ID NO: 93438

SEQ ID NO: 167407 - RNA, 64 nt, Homo Sapiens; identical to SEQ ID NO: 93439

SEQ ID NO: 167408 - RNA, 64 nt, Homo Sapiens; identical to SEQ ID NO: 93440

SEQ ID NO: 167409 - RNA, 64 nt, Homo Sapiens; identical to SEQ ID NO: 93441

SEQ ID NO: 167410 - RNA, 64 nt, Homo Sapiens; identical to SEQ ID NO: 93442

SEQ ID NO: 167411 - RNA, 64 nt, Homo Sapiens; identical to SEQ ID NO: 93443

SEQ ID NO: 167412 - RNA, 64 nt, Homo Sapiens; identical to SEQ ID NO: 93444

SEQ ID NO: 167413 - RNA, 64 nt, Homo Sapiens; identical to SEQ ID NO: 93445

SEQ ID NO: 167414 - RNA, 64 nt, Homo Sapiens; identical to SEQ ID NO: 93446

SEQ ID NO: 167415 - RNA, 64 nt, Homo Sapiens; identical to SEQ ID NO: 93447

SEQ ID NO: 167416 - RNA, 64 nt, Homo Sapiens; identical to SEQ ID NO: 93448

SEQ ID NO: 167417 - RNA, 64 nt, Homo Sapiens; identical to SEQ ID NO: 93449

SEQ ID NO: 167418 - RNA, 64 nt, Homo Sapiens; identical to SEQ ID NO: 93450

SEQ ID NO: 167419 - RNA, 64 nt, Homo Sapiens; identical to SEQ ID NO: 93451

SEQ ID NO: 167420 - RNA, 64 nt, Homo Sapiens; identical to SEQ ID NO: 93452

SEQ ID NO: 167421 - RNA, 64 nt, Homo Sapiens; identical to SEQ ID NO: 93453

SEQ ID NO: 167422 - RNA, 64 nt, Homo Sapiens; identical to SEQ ID NO: 93454

SEQ ID NO: 167423 - RNA, 64 nt, Homo Sapiens; identical to SEQ ID NO: 93455

SEQ ID NO: 167424 - RNA, 64 nt, Homo Sapiens; identical to SEQ ID NO: 93456

SEQ ID NO: 167425 - RNA, 64 nt, Homo Sapiens; identical to SEQ ID NO: 93457

SEQ ID NO: 167426 - RNA, 64 nt, Homo Sapiens; identical to SEQ ID NO: 93458

SEQ ID NO: 167427 - RNA, 64 nt, Homo Sapiens; identical to SEQ ID NO: 93459

SEQ ID NO: 167428 - RNA, 64 nt, Homo Sapiens; identical to SEQ ID NO: 93460

SEQ ID NO: 167429 - RNA, 63 nt, Homo Sapiens; identical to SEQ ID NO: 93461

SEQ ID NO: 167430 - RNA, 64 nt, Homo Sapiens; identical to SEQ ID NO: 93462

SEQ ID NO: 167431 - RNA, 64 nt, Homo Sapiens; identical to SEQ ID NO: 93463

SEQ ID NO: 167432 - RNA, 64 nt, Homo Sapiens; identical to SEQ ID NO: 93464

SEQ ID NO: 167433 - RNA, 64 nt, Homo Sapiens; identical to SEQ ID NO: 93465

SEQ ID NO: 167434 - RNA, 64 nt, Homo Sapiens; identical to SEQ ID NO: 93466

SEQ ID NO: 167435 - RNA, 64 nt, Homo Sapiens; identical to SEQ ID NO: 93467

SEQ ID NO: 167436 - RNA, 64 nt, Homo Sapiens; identical to SEQ ID NO: 93468

SEQ ID NO: 167437 - RNA, 64 nt, Homo Sapiens; identical to SEQ ID NO: 93469

SEQ ID NO: 167438 - RNA, 64 nt, Homo Sapiens; identical to SEQ ID NO: 93470

SEQ ID NO: 167439 - RNA, 64 nt, Homo Sapiens; identical to SEQ ID NO: 93471

SEQ ID NO: 167440 - RNA, 64 nt, Homo Sapiens; identical to SEQ ID NO: 93472

SEQ ID NO: 167441 - RNA, 64 nt, Homo Sapiens; identical to SEQ ID NO: 93473

SEQ ID NO: 167442 - RNA, 64 nt, Homo Sapiens; identical to SEQ ID NO: 93474

SEQ ID NO: 167443 - RNA, 64 nt, Homo Sapiens; identical to SEQ ID NO: 93475

SEQ ID NO: 167444 - RNA, 64 nt, Homo Sapiens; identical to SEQ ID NO: 93476

SEQ ID NO: 167445 - RNA, 64 nt, Homo Sapiens; identical to SEQ ID NO: 93477

SEQ ID NO: 167446 - RNA, 64 nt, Homo Sapiens; identical to SEQ ID NO: 93478

SEQ ID NO: 167447 - RNA, 64 nt, Homo Sapiens; identical to SEQ ID NO: 93479

SEQ ID NO: 167448 - RNA, 64 nt, Homo Sapiens; identical to SEQ ID NO: 93480

SEQ ID NO: 167449 - RNA, 64 nt, Homo Sapiens; identical to SEQ ID NO: 93481

SEQ ID NO: 167450 - RNA, 64 nt, Homo Sapiens; identical to SEQ ID NO: 93482

SEQ ID NO: 167451 - RNA, 64 nt, Homo Sapiens; identical to SEQ ID NO: 93483

SEQ ID NO: 167452 - RNA, 64 nt, Homo Sapiens; identical to SEQ ID NO: 93484

SEQ ID NO: 167453 - RNA, 64 nt, Homo Sapiens; identical to SEQ ID NO: 93485

SEQ ID NO: 167454 - RNA, 64 nt, Homo Sapiens; identical to SEQ ID NO: 93486

SEQ ID NO: 167455 - RNA, 64 nt, Homo Sapiens; identical to SEQ ID NO: 93487

SEQ ID NO: 167456 - RNA, 64 nt, Homo Sapiens; identical to SEQ ID NO: 93488

SEQ ID NO: 167457 - RNA, 64 nt, Homo Sapiens; identical to SEQ ID NO: 93489

SEQ ID NO: 167458 - RNA, 64 nt, Homo Sapiens; identical to SEQ ID NO: 93490

SEQ ID NO: 167459 - RNA, 64 nt, Homo Sapiens; identical to SEQ ID NO: 93491

SEQ ID NO: 167460 - RNA, 64 nt, Homo Sapiens; identical to SEQ ID NO: 93492

SEQ ID NO: 167461 - RNA, 64 nt, Homo Sapiens; identical to SEQ ID NO: 93493

SEQ ID NO: 167462 - RNA, 64 nt, Homo Sapiens; identical to SEQ ID NO: 93494

SEQ ID NO: 167463 - RNA, 64 nt, Homo Sapiens; identical to SEQ ID NO: 93495

SEQ ID NO: 167464 - RNA, 64 nt, Homo Sapiens; identical to SEQ ID NO: 93496

SEQ ID NO: 167465 - RNA, 64 nt, Homo Sapiens; identical to SEQ ID NO: 93497

SEQ ID NO: 167466 - RNA, 64 nt, Homo Sapiens; identical to SEQ ID NO: 93498

SEQ ID NO: 167467 - RNA, 64 nt, Homo Sapiens
aacccugccccaaugcaccuaggcugaaccuggcccaacagaaaucaacaacaaagugcaauac

SEQ ID NO: 167468 - RNA, 64 nt, Homo Sapiens
gagcaggcagaggguggggguggcacccccagagccaacagaggagcaggguggggaggugcag

SEQ ID NO: 167469 - RNA, 64 nt, Homo Sapiens
uucaagucucuuccagaguggggaaaguaccugaccaacagaacgggggcagggacuguguuca

SEQ ID NO: 167470 - RNA, 64 nt, Homo Sapiens
uaaaaacgaaaaacaaaaaaauuuugcuugggcaccaacagaauguccucuuuguagaugaugu

SEQ ID NO: 167471 - RNA, 64 nt, Homo Sapiens
ggucgggguagguucgugcaaacagguuucaguuccaacagaaacauggcuucucauuuacacc

SEQ ID NO: 167472 - RNA, 64 nt, Homo Sapiens
ucuuguccugccuucuagaugucuugcccuuuggccaacagauucaguuccacagagguggcag

SEQ ID NO: 167473 - RNA, 64 nt, Homo Sapiens
cucuuuuugccauggcuaaucccugcauuuccauucagggaaaaggugguagugagcauagaac

SEQ ID NO: 167474 - RNA, 64 nt, Homo Sapiens
gagauggcugccuggacuggaaucaaaucuaauuucagggaaaugaagauggaauuugaagguc

SEQ ID NO: 167475 - RNA, 64 nt, Homo Sapiens
cuagaaaccaguauggaagggagggguccugauuucagggaaauggaggguggggccgggugaa

SEQ ID NO: 167476 - RNA, 64 nt, Homo Sapiens
cucagcaaggugugaaugaccuuaguccgcaaguucagggaagcaggcagagcggggaggugcc

SEQ ID NO: 167477 - RNA, 64 nt, Homo Sapiens
gaagaacuggaaaugaaacaaaucugaaggcaggucagggaaaaaaggguagaaguuaaaggag

SEQ ID NO: 167478 - RNA, 61 nt, Homo Sapiens
ggagaagaugggagcuaagauaugauugggaucagggaaugaaaacuguaucauuucuuaa

SEQ ID NO: 167479 - RNA, 64 nt, Homo Sapiens
aaugcaggggagacuggggccuccuaucaaucaaucagggaagauucaguggcagcccagccac

SEQ ID NO: 167480 - RNA, 64 nt, Homo Sapiens
ucauaguuaauaacgucucuccaucccgguagcuucagggaagaaaggaagacacugaccuuuc

SEQ ID NO: 167481 - RNA, 64 nt, Homo Sapiens
uuuucuucacccucacucuuugguggaggugccuucagggaaagaaucuugaagaaaaaucuuu

SEQ ID NO: 167482 - RNA, 64 nt, Homo Sapiens
gaucucccuagcucagagaagagaacuccauucuucagggaaagagcagagccccucuuaucuu

SEQ ID NO: 167483 - RNA, 64 nt, Homo Sapiens
uaccugaccaacagaacuucggcagggacuguguucagggaaaggagggggacauuuuuugggg

SEQ ID NO: 167484 - RNA, 64 nt, Homo Sapiens
auuugcaagaaguugguuuacaggcuaucuguguucagggaaugcucuccaggagauuucaauc

SEQ ID NO: 167485 - RNA, 50 nt, Homo Sapiens
ugggggcauuuggccugaaaucagggaagucuauucaggagcaacuguga

SEQ ID NO: 167486 - RNA, 64 nt, Homo Sapiens
gcaggccaccuccaccacaaccgaaaguaucaucucagggaaacuuaauuccugcccguccugc

SEQ ID NO: 167487 - RNA, 64 nt, Homo Sapiens
cuugauuuuuuuaaccuucuuuuugcaaaugucuucagggaacugagcuaauacuuuuuuuuuu

SEQ ID NO: 167488 - RNA, 64 nt, Homo Sapiens
aaaugcuuuguuugcccuuugcuucugcuuuuuuucagggaagcugccaaagaaugucgacguc

SEQ ID NO: 167489 - RNA, 64 nt, Homo Sapiens
ucuauguuucaucuuguuuuuauaauaaaaagcuucagggaacaagcccaaagcccucaccaca

SEQ ID NO: 167490 - RNA, 64 nt, Homo Sapiens
cgagacuggacagaugggguguugucaaacaucuucagggaaaucaacaagccaacagacaaga

SEQ ID NO: 167491 - RNA, 64 nt, Homo Sapiens
ccgcggccacgcccugcuggucgggguagggggcucagggaagcagucucuuucgaggcuggcu

SEQ ID NO: 167492 - RNA, 64 nt, Homo Sapiens
cauauuuuguuauguguaggagaucguuacagcuucagggaauuggccauuccguucaaauccu

SEQ ID NO: 167493 - RNA, 64 nt, Homo Sapiens
ggaagcuaaagugacgaguggugugacaucaaacucagggaagauaaaaucugaguuuugccca

SEQ ID NO: 167494 - RNA, 64 nt, Homo Sapiens
ucaggguuucuugggggcuucaaaauaauuuccaucagggaacuugucagaaacucaaucucaa

SEQ ID NO: 167495 - RNA, 64 nt, Homo Sapiens
auacuguaaacugucuuccuguugccucaagaacucagggaacaaguucauaaauuuacuugag

SEQ ID NO: 167496 - RNA, 64 nt, Homo Sapiens
agaauggaauuuaaaacuucacugucuugagaauucagggaaauuauuaaaauuuacaucagca

SEQ ID NO: 167497 - RNA, 64 nt, Homo Sapiens
aaauggaaacaaaaagccaaacauugcccuuuucucagggaaggagcucuccagcuuggaccac

SEQ ID NO: 167498 - RNA, 64 nt, Homo Sapiens
caguaacugugcuguacugagcacugaaccacauucagggaaauggcuuauuaaacuuugaagc

SEQ ID NO: 167499 - RNA, 64 nt, Homo Sapiens
gccaugugucuuuacaccucgcuguugucacaucucagggaacugacccucaggcacaccuugc

SEQ ID NO: 167500 - RNA, 64 nt, Homo Sapiens
cuuucuccccauggcacuggggaaccauggaaguucagggaacuucagggaagaggcuugguca

SEQ ID NO: 167501 - RNA, 64 nt, Homo Sapiens
auggcacuggggaaccauggaaguucagggaacuucagggaagaggcuuggucaauuccugaga

SEQ ID NO: 167502 - RNA, 64 nt, Homo Sapiens
aauaccauaaucaugauaauuauauuauguacacucagggaaccuauuugguaaguuuuguaca

SEQ ID NO: 167503 - RNA, 64 nt, Homo Sapiens
cagaccucuccucucucuuuccacuccacugugcucagggaaggcucuccaaagagugugucca

SEQ ID NO: 167504 - RNA, 64 nt, Homo Sapiens
gggcuuccgagugcccucuggguggcagcaggggucagggaagugagcggguggagggcccuga

SEQ ID NO: 167505 - RNA, 64 nt, Homo Sapiens
ugguaacacuucccugucugcgggugcugaggucucagggaagcacguggcaagccaggcgagg

SEQ ID NO: 167506 - RNA, 64 nt, Homo Sapiens
cccaaugaaagaagaguuccauggucaacuaaguucagggaacccuguuacacuauuaaaggcu

SEQ ID NO: 167507 - RNA, 64 nt, Homo Sapiens
ugcacauagcaaucuggcuuccauucauaaggauucagggaauauuccagaagccauagcuucu

SEQ ID NO: 167508 - RNA, 62 nt, Homo Sapiens
uaggccuuacuggaagccacugauaggggacacuucacuaccagaugugugcagugcaacag

SEQ ID NO: 167509 - RNA, 62 nt, Homo Sapiens
gugaauauuuaaggucugugacuauaguuaaacuucacuaagaauuugcagaauuguuuuga

SEQ ID NO: 167510 - RNA, 62 nt, Homo Sapiens
gaucacauucuuuccaaaaguucacucucaaacuucacuaaucagcaagacaaauuagccau

SEQ ID NO: 167511 - RNA, 62 nt, Homo Sapiens
ggaucuucugugcccagcacugguuuuguuuucuucacuaugacacagauuguguuuuucuu

SEQ ID NO: 167512 - RNA, 62 nt, Homo Sapiens
cauugaaauaaaguuguaaacuguuugcagugcuucacuaaauaaaaugcauuccugcaauu

SEQ ID NO: 167513 - RNA, 62 nt, Homo Sapiens
cacuauaauuauuuuuggcuuuacaaauaucacuucacuaacucuguguauuaaacuacgaa

SEQ ID NO: 167514 - RNA, 62 nt, Homo Sapiens
uuggguagcuucaaacucaaauugaagagagucuucacuacaaucuucacuacaaccuuugg

SEQ ID NO: 167515 - RNA, 62 nt, Homo Sapiens
aaacucaaauugaagagagucuucacuacaaucuucacuacaaccuuuggccuuccucucua

SEQ ID NO: 167516 - RNA, 62 nt, Homo Sapiens
cuuguuuuccuuugauugauaaaauucauauucuucacuauuaugaguuaggacaaacucua

SEQ ID NO: 167517 - RNA, 62 nt, Homo Sapiens
aauacuauuuagaaauaagcgugcuuaacugucuucacuauuucucuuuuugaaaugaauuu

SEQ ID NO: 167518 - RNA, 62 nt, Homo Sapiens
ucagaucuaaucaauuagucaccuggcuccuucuucacuaccuaucccagcauacuuuguga

SEQ ID NO: 167519 - RNA, 64 nt, Homo Sapiens
agacacagucagacacuggacaauguaauguaugcaacugcaaacguuacaacugcagccagaa

SEQ ID NO: 167520 - RNA, 64 nt, Homo Sapiens
cuggacaauguaauguaugcaacugcaaacguuacaacugcagccagaacaauggcugggugga

SEQ ID NO: 167521 - RNA, 64 nt, Homo Sapiens
cuucauuugaagaaaauuuguugauaaaccauggcaacugcaagaauuggaaaaaugcugggac

SEQ ID NO: 167522 - RNA, 64 nt, Homo Sapiens
uuuuacaguaaaguuauuaagguugguuuaaaaacaacugcauuagaaauaaugcguguuuggg

SEQ ID NO: 167523 - RNA, 64 nt, Homo Sapiens
auguucuggcacuguauuuuauuacuagcauguucaacugcaccacaggugcuucaugacaaac

SEQ ID NO: 167524 - RNA, 64 nt, Homo Sapiens
uaacacuaauguccguguugcaguguaauuaauucaacugcacuaaguccuggaauacaguuuu

SEQ ID NO: 167525 - RNA, 53 nt, Homo Sapiens
gcaggugugugcugcuaugaacaucucuccagagcccuuucugcacagcuggu

SEQ ID NO: 167526 - RNA, 64 nt, Homo Sapiens
uuuaauaacauacuccuuuuugaaaguugccuuuucucuccacccuugaguagauccaguauuu

SEQ ID NO: 167527 - RNA, 64 nt, Homo Sapiens
gggccagauguggagucugugucugcccccgucuucucuccauccucaaagcccccacuucucu

SEQ ID NO: 167528 - RNA, 64 nt, Homo Sapiens
cccccgucuucucuccauccucaaagcccccacuucucuccaggcuguuucuuuuuuuaugacu

SEQ ID NO: 167529 - RNA, 64 nt, Homo Sapiens
guucugucugggccagagaaccuagccuuugaaaucucuccaucauaugaaacauaacgggaug

SEQ ID NO: 167530 - RNA, 64 nt, Homo Sapiens
aucaaaacugguacccacacuugcccuuucucccucucuccagcacacuccccucuaagaaagu

SEQ ID NO: 167531 - RNA, 64 nt, Homo Sapiens
cucugccuccuacgaggcugccacacaucauccaucucuccagauuuuuuucuguucucuccaa

SEQ ID NO: 167532 - RNA, 64 nt, Homo Sapiens
cacacaucauccaucucuccauuuuuuuuucuguucucuccaaccacaggaaacagccugcacc

SEQ ID NO: 167533 - RNA, 64 nt, Homo Sapiens
cuguagcuggcucccuagccuaccucucuggugaucucuccaucugaggcuccuucacuuucuc

SEQ ID NO: 167534 - RNA, 64 nt, Homo Sapiens
ucuggugaucucuccaucugaggcuccuucacuuucucuccaugggauagggguuggggguacu

SEQ ID NO: 167535 - RNA, 64 nt, Homo Sapiens
ccaggaacuccagguucugcuggccguggcauccucucuccaggucugcucccuuaccggagcu

SEQ ID NO: 167536 - RNA, 64 nt, Homo Sapiens
gagcugcguccacagggaacaaagcccugaccucucucuccacauuacccuuacaaaaacaggc

SEQ ID NO: 167537 - RNA, 64 nt, Homo Sapiens
aauccauuccauugucugugcccuaaauugacacucucuccaaacucacccuguauuucuuuag

SEQ ID NO: 167538 - RNA, 64 nt, Homo Sapiens
uuuaggucacuuaccaguuuuuucuccucaccugucucuccauaagccagcauuuacuauguau

SEQ ID NO: 167539 - RNA, 64 nt, Homo Sapiens
uuaaagaucauuuaucagagcuuagcuuccucagucucuccaucgcagugaacaugaacauuca

SEQ ID NO: 167540 - RNA, 64 nt, Homo Sapiens
cagauugucagcuccuugagggguguuuauccuaucucuccaacucaaugguuaacuaauucuu

SEQ ID NO: 167541 - RNA, 64 nt, Homo Sapiens
gcaccugucauaugcucugaugcagugccuuucuucucuccaguucuucuccauccuaccacaa

SEQ ID NO: 167542 - RNA, 64 nt, Homo Sapiens
auuuucccauuuuuauuacccuucuuuccauuucucucuccagucuuccaccuggaagcccucu

SEQ ID NO: 167543 - RNA, 64 nt, Homo Sapiens
aagcccucucuggcuaaggacaggcaggugccccucucuccaucagaggacaccuguacuggag

SEQ ID NO: 167544 - RNA, 64 nt, Homo Sapiens
caccauaacugcuggagugucugggauugguagcucucuccaacugccugcuugcucuuuacag

SEQ ID NO: 167545 - RNA, 64 nt, Homo Sapiens
gcuugcucuuuacagccucucucugugacuggaaucucuccaccucaucguaucuaaggauaac

SEQ ID NO: 167546 - RNA, 64 nt, Homo Sapiens
auccugcauugaauugaauaugaauuucucuaacucucuccagaaaauggauggagauaacuug

SEQ ID NO: 167547 - RNA, 64 nt, Homo Sapiens
aaugugagauucuuuagccacuuuggggagccugucucuccagaagccuuucuuaguggugccc

SEQ ID NO: 167548 - RNA, 64 nt, Homo Sapiens
cccagagugggacugugucuugcuucaugauuccucucuccauuacucucccugcccuucucug

SEQ ID NO: 167549 - RNA, 64 nt, Homo Sapiens
gaggcaugaugcuuccugcucaccugggccacccucucuccaggacuugucagcuggugguuca

SEQ ID NO: 167550 - RNA, 64 nt, Homo Sapiens
cugcugugagugacuuauuguacccaacucuauuucucuccauacugaaacaugucuuucauag

SEQ ID NO: 167551 - RNA, 64 nt, Homo Sapiens
aacuaugaaacagcuaaaagaaaacaucggggaaucucuccaggacauuggagugggcaaagau

SEQ ID NO: 167552 - RNA, 64 nt, Homo Sapiens
cccaaguugaugcgguuuguagcuuccucccuacucucuccaacaccugcaugcaaagacuacu

SEQ ID NO: 167553 - RNA, 64 nt, Homo Sapiens
aaggacucuggaagucucuuccuccuccuccucuucucuccaccccuagacccuggcugacuug

SEQ ID NO: 167554 - RNA, 64 nt, Homo Sapiens
gacuuucucacccgguucccggcaccagaacauuucucuccacuagccaggauagggcgggaga

SEQ ID NO: 167555 - RNA, 64 nt, Homo Sapiens
uuggaagccauccagcugaucacuuaucucugcaucucuccaauagagucccuaagugcucccc

SEQ ID NO: 167556 - RNA, 64 nt, Homo Sapiens
ggauaauucucuacccucaccccacagagccaucucucuccagaccaaaagcuggaaggagagu

SEQ ID NO: 167557 - RNA, 64 nt, Homo Sapiens
uuguuuuuacaacugcauguuuauuaugauacuuucucuccaaaggaaacuuuuaaaucaaugg

SEQ ID NO: 167558 - RNA, 64 nt, Homo Sapiens
gaauaaacuccggagggucggacgggaccugggcucucuccacgauucuggcuguuugcccagg

SEQ ID NO: 167559 - RNA, 64 nt, Homo Sapiens
ccugagcugaacauggagcaaggggagggugacuucucuccacauagggagggcuuagagcuca

SEQ ID NO: 167560 - RNA, 64 nt, Homo Sapiens
gcuagggaaaaccccugguucuccaugccacaccucucuccaggugcccucugccucuucaccc

SEQ ID NO: 167561 - RNA, 64 nt, Homo Sapiens
ucuucaccccacaagaagccuuauccuacguccuucucuccaucuaucggaccccaguuuccau

SEQ ID NO: 167562 - RNA, 64 nt, Homo Sapiens
acaggcccggggggaccaggaugacaccuccauuucucuccaggaaguuuugaguuucucucca

SEQ ID NO: 167563 - RNA, 64 nt, Homo Sapiens
gacaccuccauuucucuccaggaaguuuugaguuucucuccaccgugacacaauccucaaacau

SEQ ID NO: 167564 - RNA, 64 nt, Homo Sapiens
gccuuccucccccaaaugugcaaccuguaaaaggucucuccacaccaggggccaggauccaguu

SEQ ID NO: 167565 - RNA, 64 nt, Homo Sapiens
ggaccaaauccuuacucuggcucugcuuacacuuucucuccaucaccaaauccuuacuccaaau

SEQ ID NO: 167566 - RNA, 64 nt, Homo Sapiens
agugcagaggcucacagguggcacacaggcgcugucucuccagagccauccuucagaguggacc

SEQ ID NO: 167567 - RNA, 64 nt, Homo Sapiens
gacgaagcacagaucccagcacuuuucccagcuuucucuccagcaucagucccugcagcagcug

SEQ ID NO: 167568 - RNA, 64 nt, Homo Sapiens
gcggggcucggagcauggcacuguaccaugugggucucuccacagcuggaagcugcccuuuguu

SEQ ID NO: 167569 - RNA, 64 nt, Homo Sapiens
cuccuguucugucuguacccuuccuccccugcucucucuccaccaggcagggcuggggcuuuuc

SEQ ID NO: 167570 - RNA, 64 nt, Homo Sapiens
cucggacaaucaaagggagacagccuuccuuguaucucuccagaaggccaacuuccucccugcc

SEQ ID NO: 167571 - RNA, 64 nt, Homo Sapiens
ugccccucagccaugggcccggcuggugggccacucucuccagggggagacagauggaggcagu

SEQ ID NO: 167572 - RNA, 64 nt, Homo Sapiens
aguggcuggagacucuggcucagccagaguuguuucucuccacucugccucaucucuguacgaa

SEQ ID NO: 167573 - RNA, 64 nt, Homo Sapiens
agcugagagcccaggcguccgcggcgacuugccgucucuccauuccacugccuguugcagaguu

SEQ ID NO: 167574 - RNA, 64 nt, Homo Sapiens
cucuucccuuccuucuuuuuuuccucuacugacuucucuccauacucuuuccccucuauuucuu

SEQ ID NO: 167575 - RNA, 64 nt, Homo Sapiens
cagauggcucuuaagaaucaggcagucgcccacuucucuccagaugaagggaagacauucauag

SEQ ID NO: 167576 - RNA, 64 nt, Homo Sapiens; identical to SEQ ID NO: 139090

SEQ ID NO: 167577 - RNA, 64 nt, Homo Sapiens; identical to SEQ ID NO: 139091

SEQ ID NO: 167578 - RNA, 64 nt, Homo Sapiens; identical to SEQ ID NO: 139092

SEQ ID NO: 167579 - RNA, 64 nt, Homo Sapiens; identical to SEQ ID NO: 139093

SEQ ID NO: 167580 - RNA, 64 nt, Homo Sapiens; identical to SEQ ID NO: 139094

SEQ ID NO: 167581 - RNA, 64 nt, Homo Sapiens; identical to SEQ ID NO: 139095

SEQ ID NO: 167582 - RNA, 64 nt, Homo Sapiens; identical to SEQ ID NO: 139096

SEQ ID NO: 167583 - RNA, 64 nt, Homo Sapiens; identical to SEQ ID NO: 139097

SEQ ID NO: 167584 - RNA, 64 nt, Homo Sapiens; identical to SEQ ID NO: 139098

SEQ ID NO: 167585 - RNA, 64 nt, Homo Sapiens; identical to SEQ ID NO: 139099

SEQ ID NO: 167586 - RNA, 64 nt, Homo Sapiens; identical to SEQ ID NO: 139100

SEQ ID NO: 167587 - RNA, 64 nt, Homo Sapiens; identical to SEQ ID NO: 139101

SEQ ID NO: 167588 - RNA, 64 nt, Homo Sapiens; identical to SEQ ID NO: 139102

SEQ ID NO: 167589 - RNA, 64 nt, Homo Sapiens; identical to SEQ ID NO: 139103

SEQ ID NO: 167590 - RNA, 64 nt, Homo Sapiens; identical to SEQ ID NO: 139104

SEQ ID NO: 167591 - RNA, 64 nt, Homo Sapiens; identical to SEQ ID NO: 139105

SEQ ID NO: 167592 - RNA, 64 nt, Homo Sapiens; identical to SEQ ID NO: 139106

SEQ ID NO: 167593 - RNA, 64 nt, Homo Sapiens; identical to SEQ ID NO: 139107

SEQ ID NO: 167594 - RNA, 64 nt, Homo Sapiens; identical to SEQ ID NO: 139108

SEQ ID NO: 167595 - RNA, 64 nt, Homo Sapiens; identical to SEQ ID NO: 139109

SEQ ID NO: 167596 - RNA, 64 nt, Homo Sapiens; identical to SEQ ID NO: 139110

SEQ ID NO: 167597 - RNA, 64 nt, Homo Sapiens; identical to SEQ ID NO: 139111

SEQ ID NO: 167598 - RNA, 64 nt, Homo Sapiens; identical to SEQ ID NO: 139112

SEQ ID NO: 167599 - RNA, 64 nt, Homo Sapiens; identical to SEQ ID NO: 139113

SEQ ID NO: 167600 - RNA, 64 nt, Homo Sapiens; identical to SEQ ID NO: 139114

SEQ ID NO: 167601 - RNA, 64 nt, Homo Sapiens; identical to SEQ ID NO: 139115

SEQ ID NO: 167602 - RNA, 52 nt, Homo Sapiens; identical to SEQ ID NO: 112167

SEQ ID NO: 167603 - RNA, 64 nt, Homo Sapiens; identical to SEQ ID NO: 139117

SEQ ID NO: 167604 - RNA, 64 nt, Homo Sapiens; identical to SEQ ID NO: 139118

SEQ ID NO: 167605 - RNA, 64 nt, Homo Sapiens; identical to SEQ ID NO: 139119

SEQ ID NO: 167606 - RNA, 64 nt, Homo Sapiens; identical to SEQ ID NO: 139120

SEQ ID NO: 167607 - RNA, 64 nt, Homo Sapiens; identical to SEQ ID NO: 139121

SEQ ID NO: 167608 - RNA, 64 nt, Homo Sapiens; identical to SEQ ID NO: 139122

SEQ ID NO: 167609 - RNA, 64 nt, Homo Sapiens; identical to SEQ ID NO: 139123

SEQ ID NO: 167610 - RNA, 64 nt, Homo Sapiens; identical to SEQ ID NO: 139124

SEQ ID NO: 167611 - RNA, 64 nt, Homo Sapiens; identical to SEQ ID NO: 139125

SEQ ID NO: 167612 - RNA, 64 nt, Homo Sapiens; identical to SEQ ID NO: 139126

SEQ ID NO: 167613 - RNA, 64 nt, Homo Sapiens; identical to SEQ ID NO: 139127

SEQ ID NO: 167614 - RNA, 64 nt, Homo Sapiens; identical to SEQ ID NO: 139128

SEQ ID NO: 167615 - RNA, 64 nt, Homo Sapiens; identical to SEQ ID NO: 139129

SEQ ID NO: 167616 - RNA, 64 nt, Homo Sapiens; identical to SEQ ID NO: 139130

SEQ ID NO: 167617 - RNA, 64 nt, Homo Sapiens; identical to SEQ ID NO: 139131

SEQ ID NO: 167618 - RNA, 64 nt, Homo Sapiens; identical to SEQ ID NO: 59710

SEQ ID NO: 167619 - RNA, 64 nt, Homo Sapiens; identical to SEQ ID NO: 59711

SEQ ID NO: 167620 - RNA, 64 nt, Homo Sapiens; identical to SEQ ID NO: 59712

SEQ ID NO: 167621 - RNA, 64 nt, Homo Sapiens; identical to SEQ ID NO: 59713

SEQ ID NO: 167622 - RNA, 64 nt, Homo Sapiens; identical to SEQ ID NO: 59714

SEQ ID NO: 167623 - RNA, 64 nt, Homo Sapiens; identical to SEQ ID NO: 59715

SEQ ID NO: 167624 - RNA, 64 nt, Homo Sapiens; identical to SEQ ID NO: 59716

SEQ ID NO: 167625 - RNA, 64 nt, Homo Sapiens; identical to SEQ ID NO: 59717

SEQ ID NO: 167626 - RNA, 64 nt, Homo Sapiens; identical to SEQ ID NO: 59718

SEQ ID NO: 167627 - RNA, 64 nt, Homo Sapiens; identical to SEQ ID NO: 59719

SEQ ID NO: 167628 - RNA, 64 nt, Homo Sapiens; identical to SEQ ID NO: 59720

SEQ ID NO: 167629 - RNA, 64 nt, Homo Sapiens; identical to SEQ ID NO: 59721

SEQ ID NO: 167630 - RNA, 64 nt, Homo Sapiens; identical to SEQ ID NO: 59722

SEQ ID NO: 167631 - RNA, 64 nt, Homo Sapiens; identical to SEQ ID NO: 59723

SEQ ID NO: 167632 - RNA, 64 nt, Homo Sapiens; identical to SEQ ID NO: 59724

SEQ ID NO: 167633 - RNA, 64 nt, Homo Sapiens; identical to SEQ ID NO: 59725

SEQ ID NO: 167634 - RNA, 64 nt, Homo Sapiens; identical to SEQ ID NO: 59726

SEQ ID NO: 167635 - RNA, 64 nt, Homo Sapiens; identical to SEQ ID NO: 59727

SEQ ID NO: 167636 - RNA, 64 nt, Homo Sapiens; identical to SEQ ID NO: 59728

SEQ ID NO: 167637 - RNA, 64 nt, Homo Sapiens; identical to SEQ ID NO: 59729

SEQ ID NO: 167638 - RNA, 64 nt, Homo Sapiens; identical to SEQ ID NO: 59730

SEQ ID NO: 167639 - RNA, 64 nt, Homo Sapiens; identical to SEQ ID NO: 59731

SEQ ID NO: 167640 - RNA, 64 nt, Homo Sapiens; identical to SEQ ID NO: 59732

SEQ ID NO: 167641 - RNA, 64 nt, Homo Sapiens; identical to SEQ ID NO: 59733

SEQ ID NO: 167642 - RNA, 64 nt, Homo Sapiens; identical to SEQ ID NO: 59734

SEQ ID NO: 167643 - RNA, 64 nt, Homo Sapiens; identical to SEQ ID NO: 59735

SEQ ID NO: 167644 - RNA, 64 nt, Homo Sapiens; identical to SEQ ID NO: 59736

SEQ ID NO: 167645 - RNA, 64 nt, Homo Sapiens; identical to SEQ ID NO: 59737

SEQ ID NO: 167646 - RNA, 64 nt, Homo Sapiens; identical to SEQ ID NO: 59738

SEQ ID NO: 167647 - RNA, 64 nt, Homo Sapiens; identical to SEQ ID NO: 59739

SEQ ID NO: 167648 - RNA, 64 nt, Homo Sapiens; identical to SEQ ID NO: 59740

SEQ ID NO: 167649 - RNA, 64 nt, Homo Sapiens; identical to SEQ ID NO: 59741

SEQ ID NO: 167650 - RNA, 64 nt, Homo Sapiens; identical to SEQ ID NO: 59742

SEQ ID NO: 167651 - RNA, 64 nt, Homo Sapiens; identical to SEQ ID NO: 59743

SEQ ID NO: 167652 - RNA, 64 nt, Homo Sapiens; identical to SEQ ID NO: 59744

SEQ ID NO: 167653 - RNA, 64 nt, Homo Sapiens; identical to SEQ ID NO: 59745

SEQ ID NO: 167654 - RNA, 64 nt, Homo Sapiens; identical to SEQ ID NO: 59746

SEQ ID NO: 167655 - RNA, 64 nt, Homo Sapiens; identical to SEQ ID NO: 59747

SEQ ID NO: 167656 - RNA, 64 nt, Homo Sapiens; identical to SEQ ID NO: 59748

SEQ ID NO: 167657 - RNA, 64 nt, Homo Sapiens; identical to SEQ ID NO: 59749

SEQ ID NO: 167658 - RNA, 64 nt, Homo Sapiens; identical to SEQ ID NO: 59750

SEQ ID NO: 167659 - RNA, 64 nt, Homo Sapiens; identical to SEQ ID NO: 59751

SEQ ID NO: 167660 - RNA, 64 nt, Homo Sapiens; identical to SEQ ID NO: 59752

SEQ ID NO: 167661 - RNA, 64 nt, Homo Sapiens; identical to SEQ ID NO: 59753

SEQ ID NO: 167662 - RNA, 64 nt, Homo Sapiens; identical to SEQ ID NO: 59754

SEQ ID NO: 167663 - RNA, 64 nt, Homo Sapiens; identical to SEQ ID NO: 59755

SEQ ID NO: 167664 - RNA, 64 nt, Homo Sapiens; identical to SEQ ID NO: 59756

SEQ ID NO: 167665 - RNA, 64 nt, Homo Sapiens; identical to SEQ ID NO: 59757

SEQ ID NO: 167666 - RNA, 64 nt, Homo Sapiens; identical to SEQ ID NO: 59758

SEQ ID NO: 167667 - RNA, 64 nt, Homo Sapiens; identical to SEQ ID NO: 59759

SEQ ID NO: 167668 - RNA, 64 nt, Homo Sapiens; identical to SEQ ID NO: 59760

SEQ ID NO: 167669 - RNA, 64 nt, Homo Sapiens; identical to SEQ ID NO: 59761

SEQ ID NO: 167670 - RNA, 64 nt, Homo Sapiens; identical to SEQ ID NO: 59762

SEQ ID NO: 167671 - RNA, 64 nt, Homo Sapiens; identical to SEQ ID NO: 59763

SEQ ID NO: 167672 - RNA, 64 nt, Homo Sapiens; identical to SEQ ID NO: 59764

SEQ ID NO: 167673 - RNA, 64 nt, Homo Sapiens; identical to SEQ ID NO: 59765

SEQ ID NO: 167674 - RNA, 64 nt, Homo Sapiens; identical to SEQ ID NO: 59766

SEQ ID NO: 167675 - RNA, 64 nt, Homo Sapiens; identical to SEQ ID NO: 59767

SEQ ID NO: 167676 - RNA, 64 nt, Homo Sapiens; identical to SEQ ID NO: 59768

SEQ ID NO: 167677 - RNA, 64 nt, Homo Sapiens; identical to SEQ ID NO: 59769

SEQ ID NO: 167678 - RNA, 64 nt, Homo Sapiens; identical to SEQ ID NO: 59770

SEQ ID NO: 167679 - RNA, 64 nt, Homo Sapiens; identical to SEQ ID NO: 59771

SEQ ID NO: 167680 - RNA, 64 nt, Homo Sapiens; identical to SEQ ID NO: 59772

SEQ ID NO: 167681 - RNA, 64 nt, Homo Sapiens; identical to SEQ ID NO: 59773

SEQ ID NO: 167682 - RNA, 64 nt, Homo Sapiens; identical to SEQ ID NO: 59774

SEQ ID NO: 167683 - RNA, 64 nt, Homo Sapiens; identical to SEQ ID NO: 59775

SEQ ID NO: 167684 - RNA, 64 nt, Homo Sapiens; identical to SEQ ID NO: 59776

SEQ ID NO: 167685 - RNA, 64 nt, Homo Sapiens; identical to SEQ ID NO: 59777

SEQ ID NO: 167686 - RNA, 64 nt, Homo Sapiens; identical to SEQ ID NO: 59778

SEQ ID NO: 167687 - RNA, 64 nt, Homo Sapiens; identical to SEQ ID NO: 59779

SEQ ID NO: 167688 - RNA, 64 nt, Homo Sapiens; identical to SEQ ID NO: 59780

SEQ ID NO: 167689 - RNA, 64 nt, Homo Sapiens; identical to SEQ ID NO: 59781

SEQ ID NO: 167690 - RNA, 64 nt, Homo Sapiens; identical to SEQ ID NO: 59782

SEQ ID NO: 167691 - RNA, 64 nt, Homo Sapiens; identical to SEQ ID NO: 59783

SEQ ID NO: 167692 - RNA, 64 nt, Homo Sapiens; identical to SEQ ID NO: 59784

SEQ ID NO: 167693 - RNA, 64 nt, Homo Sapiens; identical to SEQ ID NO: 59785

SEQ ID NO: 167694 - RNA, 64 nt, Homo Sapiens; identical to SEQ ID NO: 59786

SEQ ID NO: 167695 - RNA, 64 nt, Homo Sapiens; identical to SEQ ID NO: 59787

SEQ ID NO: 167696 - RNA, 64 nt, Homo Sapiens; identical to SEQ ID NO: 59788

SEQ ID NO: 167697 - RNA, 64 nt, Homo Sapiens; identical to SEQ ID NO: 59789

SEQ ID NO: 167698 - RNA, 64 nt, Homo Sapiens; identical to SEQ ID NO: 59790

SEQ ID NO: 167699 - RNA, 64 nt, Homo Sapiens; identical to SEQ ID NO: 59791

SEQ ID NO: 167700 - RNA, 64 nt, Homo Sapiens; identical to SEQ ID NO: 59792

SEQ ID NO: 167701 - RNA, 64 nt, Homo Sapiens; identical to SEQ ID NO: 59793

SEQ ID NO: 167702 - RNA, 64 nt, Homo Sapiens; identical to SEQ ID NO: 59794

SEQ ID NO: 167703 - RNA, 64 nt, Homo Sapiens; identical to SEQ ID NO: 59795

SEQ ID NO: 167704 - RNA, 64 nt, Homo Sapiens; identical to SEQ ID NO: 59796

SEQ ID NO: 167705 - RNA, 64 nt, Homo Sapiens; identical to SEQ ID NO: 59797

SEQ ID NO: 167706 - RNA, 64 nt, Homo Sapiens; identical to SEQ ID NO: 59798

SEQ ID NO: 167707 - RNA, 64 nt, Homo Sapiens; identical to SEQ ID NO: 59799

SEQ ID NO: 167708 - RNA, 64 nt, Homo Sapiens; identical to SEQ ID NO: 59800

SEQ ID NO: 167709 - RNA, 64 nt, Homo Sapiens; identical to SEQ ID NO: 59801

SEQ ID NO: 167710 - RNA, 64 nt, Homo Sapiens; identical to SEQ ID NO: 59802

SEQ ID NO: 167711 - RNA, 64 nt, Homo Sapiens; identical to SEQ ID NO: 59803

SEQ ID NO: 167712 - RNA, 64 nt, Homo Sapiens; identical to SEQ ID NO: 59804

SEQ ID NO: 167713 - RNA, 64 nt, Homo Sapiens; identical to SEQ ID NO: 59805

SEQ ID NO: 167714 - RNA, 64 nt, Homo Sapiens; identical to SEQ ID NO: 59806

SEQ ID NO: 167715 - RNA, 64 nt, Homo Sapiens; identical to SEQ ID NO: 59807

SEQ ID NO: 167716 - RNA, 64 nt, Homo Sapiens; identical to SEQ ID NO: 59808

SEQ ID NO: 167717 - RNA, 64 nt, Homo Sapiens; identical to SEQ ID NO: 59809

SEQ ID NO: 167718 - RNA, 64 nt, Homo Sapiens; identical to SEQ ID NO: 59810

SEQ ID NO: 167719 - RNA, 64 nt, Homo Sapiens; identical to SEQ ID NO: 59811

SEQ ID NO: 167720 - RNA, 64 nt, Homo Sapiens; identical to SEQ ID NO: 59812

SEQ ID NO: 167721 - RNA, 64 nt, Homo Sapiens; identical to SEQ ID NO: 59813

SEQ ID NO: 167722 - RNA, 64 nt, Homo Sapiens; identical to SEQ ID NO: 59814

SEQ ID NO: 167723 - RNA, 64 nt, Homo Sapiens; identical to SEQ ID NO: 59815

SEQ ID NO: 167724 - RNA, 64 nt, Homo Sapiens; identical to SEQ ID NO: 59816

SEQ ID NO: 167725 - RNA, 64 nt, Homo Sapiens; identical to SEQ ID NO: 59817

SEQ ID NO: 167726 - RNA, 64 nt, Homo Sapiens; identical to SEQ ID NO: 59818

SEQ ID NO: 167727 - RNA, 64 nt, Homo Sapiens
cauuuauauacaaacaaauagguuuauucauucauuaaacuacuuuggaagcgucaguggauau

SEQ ID NO: 167728 - RNA, 64 nt, Homo Sapiens
ggauauauuugaaagugguaauccugaaucucuuuuaaacuauuauaugauucauaaugguucu

SEQ ID NO: 167729 - RNA, 64 nt, Homo Sapiens
ucuuuuacuacugaccuuucaaaacuccaugacuuuaaacuagcucgagacaugguuuuuggca

SEQ ID NO: 167730 - RNA, 64 nt, Homo Sapiens
acagcuuuuuuuuuucucuuacauaugccaauuuuuaaacuaugggaauuuaaucuggaagaga

SEQ ID NO: 167731 - RNA, 64 nt, Homo Sapiens
agaagcauaauagaaacauuuuucuguacagguauuaaacuacuggucuguuugacagacuuug

SEQ ID NO: 167732 - RNA, 64 nt, Homo Sapiens
ggcuauuuuuauauccuugguaugaaauauguauuuaaacuauuuaaauauuuauaaagaaaug

SEQ ID NO: 167733 - RNA, 64 nt, Homo Sapiens
cauaccuaaaggcaucagacuuaaaauaaaauucuuaaacuaaaguuaugccacagaaauuccu

SEQ ID NO: 167734 - RNA, 55 nt, Homo Sapiens
uugggcaugguggcucacacagaaauuaaacuagguuauaaaagaaucuuuauga

SEQ ID NO: 167735 - RNA, 64 nt, Homo Sapiens
uuauugacuuauuauuuaaguguauugucucuucuuaaacuaucaagaaugacauugaaacauu

SEQ ID NO: 167736 - RNA, 64 nt, Homo Sapiens
uuagauaacuauaagauacuuuauuggaaauuauuuaaacuaauaaauucauuucagcauguua

SEQ ID NO: 167737 - RNA, 64 nt, Homo Sapiens
ugggucugugaauuucuuuauaaaaauuaaauuuuuaaacuaugguguugugaaaauuuaaucu

SEQ ID NO: 167738 - RNA, 64 nt, Homo Sapiens
augcguauuuauuuuucugcccuuacuuuccuaauuaaacuaugagcuggguuugauucaaagc

SEQ ID NO: 167739 - RNA, 64 nt, Homo Sapiens
uguguauguauugauguuugauuugucugugauuuuaaacuaaccacuuuuacccucaaguccg

SEQ ID NO: 167740 - RNA, 64 nt, Homo Sapiens
cuuucaaaaaccuuagugaauaugguaucauauguuaaacuaagaaaagucagccuaaagaagu

SEQ ID NO: 167741 - RNA, 64 nt, Homo Sapiens
gagcugcacagcaaaagaaacaaaugggaucuaauuaaacuaaagcaacagaagcaaaaauuca

SEQ ID NO: 167742 - RNA, 64 nt, Homo Sapiens
acaguaaaaguaaagacuauacagaauggauuuguuaaacuagcggaauuaacaguauuucuuu

SEQ ID NO: 167743 - RNA, 64 nt, Homo Sapiens
auuuguuucaguauuuugucuguauaguuuguuuuuaaacuaauuguuacgguaugaagucuuc

SEQ ID NO: 167744 - RNA, 64 nt, Homo Sapiens
uuauuugccuugccauaacaaaauuuaauguuuuuuaaacuaguuugaauuucuacaaauggug

SEQ ID NO: 167745 - RNA, 64 nt, Homo Sapiens
guaaaaugauguguugacuauacugauacacauauuaaacuauaccuuauaguaaaccaguauc

SEQ ID NO: 167746 - RNA, 64 nt, Homo Sapiens
caucuuuuuagugauaauaaaagaaagcaugguauuaaacuaucauagaaguagacagaaaaag

SEQ ID NO: 167747 - RNA, 64 nt, Homo Sapiens
aaccacaccguuuuccaguaaauuaaaacaacuguuaaacuaaauaugauguuuuuaacaauaa

SEQ ID NO: 167748 - RNA, 64 nt, Homo Sapiens
acuuguaagacauuaugugauggacauugugcuuuuaaacuagauuuggcaggaauucccaaga

SEQ ID NO: 167749 - RNA, 64 nt, Homo Sapiens
gacuugguaagucuacuguaaguggcuugauugcuuaaacuauuguaaagaaacugaacaguga

SEQ ID NO: 167750 - RNA, 64 nt, Homo Sapiens; identical to SEQ ID NO: 167749

SEQ ID NO: 167751 - RNA, 64 nt, Homo Sapiens
cuuuuuucugucuaccuuuaauuugcguauaguauuaaacuauuuauuauuuucacaguggaaa

SEQ ID NO: 167752 - RNA, 64 nt, Homo Sapiens
ggaguguauuauaaaaucaaaccuaaguguuuuuuuaaacuauguauuauauauaaaauaauau

SEQ ID NO: 167753 - RNA, 64 nt, Homo Sapiens
cauauuuuuauauuauguuagucuuaaaaaaagaggauucaacagggugacagagcaagacccu

SEQ ID NO: 167754 - RNA, 64 nt, Homo Sapiens
cgccacguguaguggcucaucuuuguacagaagaggauucaaaaccuaaggacucagauuguau

SEQ ID NO: 167755 - RNA, 64 nt, Homo Sapiens
agcacauugguaauagguauucucauaacucccuggauucaagugacuuugaaacaucucucuc

SEQ ID NO: 167756 - RNA, 64 nt, Homo Sapiens
gccaaaauuuuuuaaagguucaaggagcacuacuggauucaacucaaaccuucauuccuugaau

SEQ ID NO: 167757 - RNA, 64 nt, Homo Sapiens
uauuuauaaaaacacugcccuccuucauuaugagggauucaaaguauauucauaaguucuaaaa

SEQ ID NO: 167758 - RNA, 64 nt, Homo Sapiens
uaugccuauugauaucugcgcugcuggguacaagggauucaauuaacacacauugauugagugc

SEQ ID NO: 167759 - RNA, 64 nt, Homo Sapiens
acccagcaucaccagcuagaaaguggcagagccaggauucaacccuggcuugucuaaccccagg

SEQ ID NO: 167760 - RNA, 64 nt, Homo Sapiens
ggugauccacccaccugggccucccauagugcugggauucaauuuuuuuuuuuuuuuuuucaaa

SEQ ID NO: 167761 - RNA, 64 nt, Homo Sapiens
uuaauuugaagauucuuuaauuaaaaaccaaacaucccuguaaucccauuuuacuguguuugag

SEQ ID NO: 167762 - RNA, 64 nt, Homo Sapiens
uuuaagacguuuccaaggaaugcccaccuugucuucccuguaaguuuuguagcucugcauauuu

SEQ ID NO: 167763 - RNA, 64 nt, Homo Sapiens
uauuggugaagaacgugcacacaaaagauagucuucccuguacguuggggagaggcugaaaagc

SEQ ID NO: 167764 - RNA, 64 nt, Homo Sapiens
ccuagaaggaucagugaaugguugguagaaauucucccuguaugaccauuuggguuguuuauau

SEQ ID NO: 167765 - RNA, 64 nt, Homo Sapiens
gcugaguccccacaucagcuuuaguucuuggacuucccuguauuaagcaagaauuaggagaaug

SEQ ID NO: 167766 - RNA, 64 nt, Homo Sapiens
uuuaauacuuucuuaauccaguuuuucaaacuucucccuguagaccguaaggaugaauuccaca

SEQ ID NO: 167767 - RNA, 64 nt, Homo Sapiens
acugcacagacagcugcgacgcugcgaccaggacgucagccagccagccagcacugcacagaca

SEQ ID NO: 167768 - RNA, 64 nt, Homo Sapiens
cccuggggaggauccacuggacaagcaaguuugugucagccacguccgguuuuccaguucuugc

SEQ ID NO: 167769 - RNA, 64 nt, Homo Sapiens
ugaccacagcuggcagucaagccacagcuggagggucagccaccaagcugggagcugagccaga

SEQ ID NO: 167770 - RNA, 64 nt, Homo Sapiens
gauuagagugagugugcucuguugcugugaugcugucagccacagcuuccugccguagagaaug

SEQ ID NO: 167771 - RNA, 64 nt, Homo Sapiens
auagcaccacugcacuccagaggcggagguugcagucagccaaggagaaucgcuagaaccuggg

SEQ ID NO: 167772 - RNA, 64 nt, Homo Sapiens
cuuuuauuguuccuuugcuaggggccacucaccagucagccaauugagcuaugcacucuaaugu

SEQ ID NO: 167773 - RNA, 64 nt, Homo Sapiens
ucuaucaaauuacugaagaucucaucaugcaugugucagccacagcgaaucccaugucuugguu

SEQ ID NO: 167774 - RNA, 64 nt, Homo Sapiens
caacaaccaaaauuauuaagcucugugcgaggcugucagccacacuagguaucagggaucccga

SEQ ID NO: 167775 - RNA, 64 nt, Homo Sapiens
cuugcuuugacugaggccgacugacauccuaugggucagccagguacauccacuccccaugcca

SEQ ID NO: 167776 - RNA, 64 nt, Homo Sapiens
cgcagggccggccacaagacugccuugcuggacugucagccagugugugaaguaccuaccuccu

SEQ ID NO: 167777 - RNA, 64 nt, Homo Sapiens; identical to SEQ ID NO: 115828

SEQ ID NO: 167778 - RNA, 64 nt, Homo Sapiens; identical to SEQ ID NO: 115829

SEQ ID NO: 167779 - RNA, 64 nt, Homo Sapiens; identical to SEQ ID NO: 115830

SEQ ID NO: 167780 - RNA, 64 nt, Homo Sapiens; identical to SEQ ID NO: 115831

SEQ ID NO: 167781 - RNA, 64 nt, Homo Sapiens; identical to SEQ ID NO: 115832

SEQ ID NO: 167782 - RNA, 64 nt, Homo Sapiens; identical to SEQ ID NO: 115833

SEQ ID NO: 167783 - RNA, 64 nt, Homo Sapiens; identical to SEQ ID NO: 115834

SEQ ID NO: 167784 - RNA, 64 nt, Homo Sapiens; identical to SEQ ID NO: 115835

SEQ ID NO: 167785 - RNA, 64 nt, Homo Sapiens; identical to SEQ ID NO: 115836

SEQ ID NO: 167786 - RNA, 64 nt, Homo Sapiens; identical to SEQ ID NO: 115837

SEQ ID NO: 167787 - RNA, 64 nt, Homo Sapiens; identical to SEQ ID NO: 115838

SEQ ID NO: 167788 - RNA, 64 nt, Homo Sapiens; identical to SEQ ID NO: 115839

SEQ ID NO: 167789 - RNA, 64 nt, Homo Sapiens; identical to SEQ ID NO: 115840

SEQ ID NO: 167790 - RNA, 64 nt, Homo Sapiens; identical to SEQ ID NO: 115841

SEQ ID NO: 167791 - RNA, 64 nt, Homo Sapiens; identical to SEQ ID NO: 115842

SEQ ID NO: 167792 - RNA, 64 nt, Homo Sapiens; identical to SEQ ID NO: 115843

SEQ ID NO: 167793 - RNA, 64 nt, Homo Sapiens; identical to SEQ ID NO: 115844

SEQ ID NO: 167794 - RNA, 64 nt, Homo Sapiens; identical to SEQ ID NO: 115845

SEQ ID NO: 167795 - RNA, 64 nt, Homo Sapiens; identical to SEQ ID NO: 115846

SEQ ID NO: 167796 - RNA, 64 nt, Homo Sapiens; identical to SEQ ID NO: 115847

SEQ ID NO: 167797 - RNA, 64 nt, Homo Sapiens; identical to SEQ ID NO: 115848

SEQ ID NO: 167798 - RNA, 64 nt, Homo Sapiens; identical to SEQ ID NO: 115849

SEQ ID NO: 167799 - RNA, 64 nt, Homo Sapiens; identical to SEQ ID NO: 115850

SEQ ID NO: 167800 - RNA, 64 nt, Homo Sapiens; identical to SEQ ID NO: 115851

SEQ ID NO: 167801 - RNA, 64 nt, Homo Sapiens; identical to SEQ ID NO: 115852

SEQ ID NO: 167802 - RNA, 61 nt, Homo Sapiens
accggagcccggaggcuuggggcuguccaccuggcggaaccgagcgacggcugcugaaaga

SEQ ID NO: 167803 - RNA, 61 nt, Homo Sapiens
ugucgcugaagcacuuaagaucaauuaguaauggcggaaacuuuuaaugaauaaaguuuaa

SEQ ID NO: 167804 - RNA, 61 nt, Homo Sapiens
gaaacugcauuaaaaaaagacgguacucacguggcggaaggcuaaacucuuggccaaaagg

SEQ ID NO: 167805 - RNA, 61 nt, Homo Sapiens
agagguucccugcgaagacuggcuggacagauggcggaagcuugcagaggcguaggaauga

SEQ ID NO: 167806 - RNA, 61 nt, Homo Sapiens
guggugcccacgggguugggccuccgaggccuggcggaaugucucuuaagcacccgguggc

SEQ ID NO: 167807 - RNA, 61 nt, Homo Sapiens
ugaaaggcaugucuuacgugcuucacaaucauggcggaagggguccgcguggcuggggagg

SEQ ID NO: 167808 - RNA, 61 nt, Homo Sapiens
cagagcccccaccccagcccccacacauggcuggcggaaccaugcagggauauucuugaag

SEQ ID NO: 167809 - RNA, 61 nt, Homo Sapiens
uguaacguuagaacuuaggcauuuuccuguguggcggaauaagaaaggauuaaacaguuac

SEQ ID NO: 167810 - RNA, 61 nt, Homo Sapiens
ccuggguguguucuggggaccugugguuugcuggcggaaacaagugaugaggcugguuagc

SEQ ID NO: 167811 - RNA, 61 nt, Homo Sapiens
ugcuuuuguuucucuucuguuucugccuuauuggcggaaacauaagcgugcaugccauguu

SEQ ID NO: 167812 - RNA, 61 nt, Homo Sapiens
gggucccuggaaacaacucuggggcccacuguggcggaagggcauagacgccccaggaugg

SEQ ID NO: 167813 - RNA, 61 nt, Homo Sapiens
ugaagucagaaagauuuguaauaucuacccauggcggaaaaauuagcuuagaauaugaagc

SEQ ID NO: 167814 - RNA, 61 nt, Homo Sapiens
accagggcagcguucagcacacuccugggcauggcggaagcaggaagcagacuccagaggg

SEQ ID NO: 167815 - RNA, 61 nt, Homo Sapiens
ggucaggaguucgagaccagccuggccaacauggcggaaccccaucuccacuaaaaguaca

SEQ ID NO: 167816 - RNA, 61 nt, Homo Sapiens
ucucccccagcugccacacacucaauuuucauggcggaaugucucuuuaccgggaccuucu

SEQ ID NO: 167817 - RNA, 61 nt, Homo Sapiens
gauccaggcccuccacuucuugugggcagccuggcggaaaagaaaacuucgauauccaccc

SEQ ID NO: 167818 - RNA, 61 nt, Homo Sapiens
gggucaggguuugagaccagccuggccaacauggcggaacccugucucuaccaaaauuaca

SEQ ID NO: 167819 - RNA, 61 nt, Homo Sapiens
agagagauaaagucccugccugcaugcauucuggcggaagagacaagcaagcaaugaacaa

SEQ ID NO: 167820 - RNA, 61 nt, Homo Sapiens
aagugcaucccuguguucaccucaauaaaaguggcggaauaucagguccccacggcuguug

SEQ ID NO: 167821 - RNA, 61 nt, Homo Sapiens
gcacugccccccucccuagccccuuauuugguggcggaaguggccuccaccccuucccugu

SEQ ID NO: 167822 - RNA, 61 nt, Homo Sapiens
uuccuaaauugcauugaauugauaggaaggauggcggaaucuuaaagugauacaugcuaac

SEQ ID NO: 167823 - RNA, 61 nt, Homo Sapiens
cccacggcggugagguccaugcggcccgagcuggcggaagcgugccccugagccccccgca

SEQ ID NO: 167824 - RNA, 61 nt, Homo Sapiens
aaaucuggaaggauucucacuaccucuggauuggcggaagugccccuugccuaaaagccug

SEQ ID NO: 167825 - RNA, 55 nt, Homo Sapiens
aacgaggcgccacaccccuggcuccuggcggaagggguccaacgaagccccauga

SEQ ID NO: 167826 - RNA, 61 nt, Homo Sapiens
gcaugugccacccccuuuccguuuuuccagauggcggaagagcccucccuuggaucuccau

SEQ ID NO: 167827 - RNA, 61 nt, Homo Sapiens
gacugcuugcugccuuuaauuccagcugugauggcggaacucugguucugagcgucaacuc

SEQ ID NO: 167828 - RNA, 61 nt, Homo Sapiens
acccacccugauacgugcaaucauguaguuuuggcggaaauuuccccaucauucuaggaug

SEQ ID NO: 167829 - RNA, 61 nt, Homo Sapiens
cacugggggugggggcgggguguucuaguccuggcggaacauucugucugaacacaaagcc

SEQ ID NO: 167830 - RNA, 61 nt, Homo Sapiens
gaggagggcgcauguguguaucacccucagcuggcggaaccuggcugcgaacugugcaguu

SEQ ID NO: 167831 - RNA, 61 nt, Homo Sapiens
gagugggcggagauauguaacgguaggugccuggcggaaggcgcuucuauuuugguuacua

SEQ ID NO: 167832 - RNA, 61 nt, Homo Sapiens
ucuagacugaguguguaugccuuugauauuguggcggaaagugauuugugaagaauuugua

SEQ ID NO: 167833 - RNA, 61 nt, Homo Sapiens
gggguccaggugggccacacaggggccaggauggcggaagauacggguggggagggaagau

SEQ ID NO: 167834 - RNA, 61 nt, Homo Sapiens
cuugauggaauuauaucacugccagugccuguggcggaagccaucuuauugcuaccagcug

SEQ ID NO: 167835 - RNA, 61 nt, Homo Sapiens
cggggcccagcggcucccccugcaugguuuguggcggaagauugagcucacguggcggcca

SEQ ID NO: 167836 - RNA, 61 nt, Homo Sapiens
gaaggggcgugguggcuagaugggggcaggauggcggaaaggagaggggcgcagcuaagac

SEQ ID NO: 167837 - RNA, 61 nt, Homo Sapiens
acagugcccgccagggaccauguauguaucauggcggaagaguuggcccugaccuggaaua

SEQ ID NO: 167838 - RNA, 61 nt, Homo Sapiens
cacuuugagcugagacuugaaaacgaugcuguggcggaagagcauguggggcuugguggag

SEQ ID NO: 167839 - RNA, 61 nt, Homo Sapiens
cgcagagccccagcagguggugcacgacuguuggcggaaggaacgcguguucauccucagu

SEQ ID NO: 167840 - RNA, 61 nt, Homo Sapiens
acagugagggcggcccuagccuggugcugccuggcggaaggccucucugggugguuugggg

SEQ ID NO: 167841 - RNA, 61 nt, Homo Sapiens
ucagggugucccagaccccgacaccggccaguggcggaagugaccgcaccucacacuccuu

SEQ ID NO: 167842 - RNA, 61 nt, Homo Sapiens
gugagcagggccguccgggcuuccuguggauuggcggaauguuuagaagcagaacaagcca

SEQ ID NO: 167843 - RNA, 61 nt, Homo Sapiens
ccuagagcugugaugcugagcaaggugccuguggcggaaggaacugcccaguccucccugg

SEQ ID NO: 167844 - RNA, 61 nt, Homo Sapiens
ucaccaggccguggccuuccaacccccaggauggcggaagcccccguccuaggugccgacc

SEQ ID NO: 167845 - RNA, 61 nt, Homo Sapiens
ugcuacucgugagcgccaguagcucgcuggauggcggaagcgccaacggccccagcuucuc

SEQ ID NO: 167846 - RNA, 64 nt, Homo Sapiens
ggugucagguccccucauugcucuucucagguggccacacuaugucaagaagccucuccacacu

SEQ ID NO: 167847 - RNA, 64 nt, Homo Sapiens
aaacaccagacacuucuucugccccaagcacaccccacacuaauuucugcugcagcaucacgau

SEQ ID NO: 167848 - RNA, 64 nt, Homo Sapiens
caugcaagauuguacuuauugggcuucagaauauccacacuagugaaagucuucugaguacagc

SEQ ID NO: 167849 - RNA, 64 nt, Homo Sapiens
uacagcaaaugugugacauuauuuugcuacuacuccacacuacuuagacaucauguaguucaca

SEQ ID NO: 167850 - RNA, 64 nt, Homo Sapiens
uauuuguaguggauuuccucuggagggcauguacccacacuaaauaccaacugcucuuccucag

SEQ ID NO: 167851 - RNA, 64 nt, Homo Sapiens
uuucaauugcuuaguguuucuaaucauacuuaauccacacuaaugugcgcaauuauaauaaaug

SEQ ID NO: 167852 - RNA, 64 nt, Homo Sapiens
caccaauccccuacuguuaaucagagaugucccacuggauaaaaaacauauaaauguaagaaau

SEQ ID NO: 167853 - RNA, 64 nt, Homo Sapiens
aauagaacauguuuuaagaaguggcuauauagcucuggauaaaacgaacaaaagaauuagaauu

SEQ ID NO: 167854 - RNA, 64 nt, Homo Sapiens
gaagaccuugccagaguucaucaaggauggcuccaguacguacagcaagauuccugcccacagg

SEQ ID NO: 167855 - RNA, 64 nt, Homo Sapiens
augaucgaucaucuauagcaaauaggcuauguugaguacguaggcugugggaagaugaagaugg

SEQ ID NO: 167856 - RNA, 64 nt, Homo Sapiens
uagggggucuuuagagugaaaugaguugcacuaaaguacguaguugaggcuccuuuuuucuuuc

SEQ ID NO: 167857 - RNA, 64 nt, Homo Sapiens
uauaucuaauuacaggagaauuuacaacaucucaaguacguaaauuaaguugucauugagugaa

SEQ ID NO: 167858 - RNA, 64 nt, Homo Sapiens
uagauaaucauacuuccucuuauuuaaaaaaaaaaguacguauuaguugagcaagcaauuccuu

SEQ ID NO: 167859 - RNA, 63 nt, Homo Sapiens
auugaaaaaugaggcauaaaaacuccaaacuagaguacguaacagaggaaaaguagaacuuaa

SEQ ID NO: 167860 - RNA, 64 nt, Homo Sapiens
uuuggcucauuacugguuuauguacauuugcaugaguacguauguaaaauaauuugcugucaau

SEQ ID NO: 167861 - RNA, 64 nt, Homo Sapiens
uucugauuuuuauuuuugagguuuugucaacuggaguacguagaggaacuuuauuuacaguacu

SEQ ID NO: 167862 - RNA, 64 nt, Homo Sapiens
ugugccaaauaauuacuuuuuauuuauuuuauuuaguacguaauuuugaaguacauuuuuuccu

SEQ ID NO: 167863 - RNA, 64 nt, Homo Sapiens
uuaccuugaguuuagauauccuaaaaaauucuguaguacguaguuuugucuuaccuguuaacuu

SEQ ID NO: 167864 - RNA, 64 nt, Homo Sapiens
cucacuccuguccuuugucauacuaauaauacuuaguacguaggaucuacuguauaggcucacg

SEQ ID NO: 167865 - RNA, 64 nt, Homo Sapiens
uaaauuaauuaaaacacauacaguuaauuaaaugaguacguaaauguuucacguauguggaugc

SEQ ID NO: 167866 - RNA, 64 nt, Homo Sapiens
gauucagggucucuugauagaaaaucauauuacaaguacguaaguuguacuagugucacagcau

SEQ ID NO: 167867 - RNA, 64 nt, Homo Sapiens
auuuugggacauuugcauucaauuuacagguaccaguacguacauauuuuaauagaaagauaca

SEQ ID NO: 167868 - RNA, 64 nt, Homo Sapiens
uucaaaagcuuguguguugacccuuuguagccuaaguacguaaacaaauuaauguuaucuaagu

SEQ ID NO: 167869 - RNA, 64 nt, Homo Sapiens
uaucugcucagauuuuacucaacauuagagaguuaguacguaauaaaagcauuauaaaugcaau

SEQ ID NO: 167870 - RNA, 64 nt, Homo Sapiens
auuguguuggguguggguggugacagcaaagcccaguacguacagaacucauuugcucacuccu

SEQ ID NO: 167871 - RNA, 61 nt, Homo Sapiens
ccagugucgucgugagggugggccugucuggaguacguagaaggacagcaagaagaacuga

SEQ ID NO: 167872 - RNA, 64 nt, Homo Sapiens
uuucuccucuccuucccauggccccuguuguugaaguacguaggaaacugaauacauaacugca

SEQ ID NO: 167873 - RNA, 64 nt, Homo Sapiens
gagccugacagcgcagcuccuagaaacauuuagcaguacguacaauaaauacuaugcaaaccaa

SEQ ID NO: 167874 - RNA, 64 nt, Homo Sapiens
uuaaaaaauaccaguucacccacacugucuucccaguacguaagaagguuuacgugucucaaag

SEQ ID NO: 167875 - RNA, 64 nt, Homo Sapiens
ccccuuguguuuggaauuauaaaauauagguaaaaguacguaauuaaauaauguuuuugguauu

SEQ ID NO: 167876 - RNA, 64 nt, Homo Sapiens
uacguugguuuuccuugucccuuugcaccuugacaguacguaguauacauugugguuuaugcag

SEQ ID NO: 167877 - RNA, 64 nt, Homo Sapiens
uaaagcagaaaaacuuuuaaccagcaacauuucaaguacguagugugaucaaacaugaucaucc

SEQ ID NO: 167878 - RNA, 64 nt, Homo Sapiens
ggaccagguaaauaauuucauagaaguucaguauaguacguaauucuuguaagaguaucguaug

SEQ ID NO: 167879 - RNA, 64 nt, Homo Sapiens
cagcauuaaagaugaaucucaaaaaagcaagucaaguacguauugcuagaaauucaacugaaga

SEQ ID NO: 167880 - RNA, 64 nt, Homo Sapiens
guuccaaucuaaauaaaaaacaucuucuuaaauaaguacguaauaguuaucuuuaaguuuaugc

SEQ ID NO: 167881 - RNA, 64 nt, Homo Sapiens
cagugucugucagaacuuggcauacuuucuccauaguacguagaccuucuaauacucugcuaaa

SEQ ID NO: 167882 - RNA, 64 nt, Homo Sapiens
gauguaacccauucuuuguauacuuuuccaggucaguacguaaacuuuucauaauaaucaugaa

SEQ ID NO: 167883 - RNA, 64 nt, Homo Sapiens
ccuguuguguggaacacuucacauauuggcgcacaguacguaaggaggucucaugugcuguagg

SEQ ID NO: 167884 - RNA, 64 nt, Homo Sapiens
caugguuuauauuucuuauugaauggaaauuaagaguacguauucuauagaacauuaaguugaa

SEQ ID NO: 167885 - RNA, 64 nt, Homo Sapiens
ugcuuuccugucuguauuugaugcaggauuaaacacuucccagagaggauucuagucugguaaa

SEQ ID NO: 167886 - RNA, 64 nt, Homo Sapiens
auuugagcccagcaccuaaaaguacaggaauuucacuucccaccaggacuugagcacauaacuc

SEQ ID NO: 167887 - RNA, 64 nt, Homo Sapiens
ggcucugaggcugcagggcuggaaguccuugcccacuucccacucuccugccccaaucuaucua

SEQ ID NO: 167888 - RNA, 64 nt, Homo Sapiens
ccacuucccacucuccugccccaaucuaucuaguacuucccaggcaaauaggccccuuugaggc

SEQ ID NO: 167889 - RNA, 64 nt, Homo Sapiens
aucccuuguaucuccuuucuacuguuuacuucccacuucccagaugauuuaaagagaucugugu

SEQ ID NO: 167890 - RNA, 64 nt, Homo Sapiens
ucccagaaucccuuguaucuucuguguacuguuuacuucccacuaugcuccugauuuaaagaga

SEQ ID NO: 167891 - RNA, 64 nt, Homo Sapiens
cucauuccacuagacugcccccugccacccuggcacuucccagggccuggcaguauggucugau

SEQ ID NO: 167892 - RNA, 64 nt, Homo Sapiens
ugaugguacaugcauuuucuagaauagagcugggacuucccauguggcccacaucugaccuggc

SEQ ID NO: 167893 - RNA, 64 nt, Homo Sapiens
aaacucagcuguuccagccggugccaaccugugaacuucccaccauaucccagaaucugcuauu

SEQ ID NO: 167894 - RNA, 64 nt, Homo Sapiens
ccaccauaucccagaaucugcuauuccccaaaccacuucccaguuuccuuucaguaaucuuucu

SEQ ID NO: 167895 - RNA, 64 nt, Homo Sapiens
uauuacgccucauacugaauggauguucaguggaacuucccaucuugccuaauaaauaugacau

SEQ ID NO: 167896 - RNA, 64 nt, Homo Sapiens
ucugacgaaaggucuccaugggacacacauugcaacuucccacucguagggaccuugauuuugg

SEQ ID NO: 167897 - RNA, 64 nt, Homo Sapiens
aggguugcauggcggcugggcaaaggugcuccccacuucccagauggugcggcggcuggccaga

SEQ ID NO: 167898 - RNA, 64 nt, Homo Sapiens
cagauggugcggcggcuggccagaggcacucuucacuucccagacagaggggcggccgggcaga

SEQ ID NO: 167899 - RNA, 64 nt, Homo Sapiens
cagacagaggggcggccgggcagaggugcuccucacuucccagagggugcaggagccagcucug

SEQ ID NO: 167900 - RNA, 64 nt, Homo Sapiens
auugcaggcagcugggcccaaccauugcaggcagacuucccacccccuccaguggucacuuccc

SEQ ID NO: 167901 - RNA, 64 nt, Homo Sapiens
auugcaggcagacuucccacucccuccaguggucacuucccaccgcauugccauagaggagccc

SEQ ID NO: 167902 - RNA, 64 nt, Homo Sapiens
uguagccuuucucaguguccguggcauuuuugugacuucccagcacuagaauaaguuuuccugc

SEQ ID NO: 167903 - RNA, 64 nt, Homo Sapiens
ugagugaggcgcuuggugcccucuggacuuucccacuucccaacaugggagaauugugaacuuu

SEQ ID NO: 167904 - RNA, 64 nt, Homo Sapiens
ccacccacagaccuucccuuuagcuguugacacaacuucccagcucugcaagugugcccccugg

SEQ ID NO: 167905 - RNA, 64 nt, Homo Sapiens
cucugcccugcccugccuagccucugcuacucccacuucccaacuccagggaaugcauuacuuu

SEQ ID NO: 167906 - RNA, 64 nt, Homo Sapiens
auccacaaagcuucgccuuucaucaccacggccuacuucccaaugucaucccugugugcugcag

SEQ ID NO: 167907 - RNA, 64 nt, Homo Sapiens
gccuggagagaaauaaaccuagcaccgauguagcacuucccacuuuagcaaauggaggaaauua

SEQ ID NO: 167908 - RNA, 64 nt, Homo Sapiens
gugccuauugauacuuggggaaaaaucccccagcacuucccacacuuuuuuucucugcauuuaa

SEQ ID NO: 167909 - RNA, 64 nt, Homo Sapiens
ccacaaaugggacacauggucaaugguugaugauacuucccacauucuuguugcuguacaaaag

SEQ ID NO: 167910 - RNA, 64 nt, Homo Sapiens
ucuaacuccugggcucagugauccucccguuucgacuucccaaagugcugggauuacaggugug

SEQ ID NO: 167911 - RNA, 64 nt, Homo Sapiens
ucacaagcaaaaucagccagcacuuugaucacggacuucccagccucuaggacugugagcaaua

SEQ ID NO: 167912 - RNA, 64 nt, Homo Sapiens
ccuaucuucucccccacgguauccuaaacuuuagacuucccacuguucugaaaggagacauugc

SEQ ID NO: 167913 - RNA, 64 nt, Homo Sapiens
ggggacucaagaggaaucuguuucucugcugucaacuucccaucuggcucagcauagggucacu

SEQ ID NO: 167914 - RNA, 64 nt, Homo Sapiens
aagauuguuaauccuaugaagagucauugcucccagccauuagaagugcugggauuacaggcau

SEQ ID NO: 167915 - RNA, 64 nt, Homo Sapiens
acaguaucauguuuaacaagggggggagaggaacagccauuaacuagaugggggagaaaugggu

SEQ ID NO: 167916 - RNA, 64 nt, Homo Sapiens
aagucucaugacgggauggguuuugccugaaauuggcuuaaagauaccaggaaagucuuauuua

SEQ ID NO: 167917 - RNA, 64 nt, Homo Sapiens
ggaccaaugagaggccacauguuccacggcccgaggcuuaaacaccuuuaccuaccaaagccac

SEQ ID NO: 167918 - RNA, 64 nt, Homo Sapiens
uuaaaaaagaaaaagaaaauguugaauaagaguuggcuuaaauuagcugcugugaagaagaaaa

SEQ ID NO: 167919 - RNA, 64 nt, Homo Sapiens
uaaggaacauaacacuugcaguuggcacauaugaggcuuaaauaaaaauaaaugaauuuucacu

SEQ ID NO: 167920 - RNA, 64 nt, Homo Sapiens
auagcugacuguguguacaucuaauuggaucaguggcuuaaauauaauacuauuuagaaauaag

SEQ ID NO: 167921 - RNA, 64 nt, Homo Sapiens
aaaaagucuaugaagagucuaauuaggaauugauggcuuaaaaaauauauucuacaguggauag

SEQ ID NO: 167922 - RNA, 64 nt, Homo Sapiens
gaucuuauguuuaaagagaugugguuauguaagaggcuuaaaauauuucaaaugaaaccagaag

SEQ ID NO: 167923 - RNA, 64 nt, Homo Sapiens
uacuuauacuuaugaaauaaacaguuuaguaaaaggcuuaaaauuuuuuaauggauugaaauuu

SEQ ID NO: 167924 - RNA, 64 nt, Homo Sapiens
uaaacgucuuccauuugacuucucuacucggugucucagacagugucuucccagaaaaccacca

SEQ ID NO: 167925 - RNA, 64 nt, Homo Sapiens
uuccccacguguaucugaacauuaagcagauuggcucagacacaaugaaaaggauaauccaaug

SEQ ID NO: 167926 - RNA, 64 nt, Homo Sapiens
ucuuaaccgucacuagcccaaguguuuuguauuacucagacaccaucaugaaauaauucuguga

SEQ ID NO: 167927 - RNA, 64 nt, Homo Sapiens
acacugccaggggagccucacugugaagucuaggcucagacaggcaucaacaaaccuauucacc

SEQ ID NO: 167928 - RNA, 64 nt, Homo Sapiens
cgggagccaggagagcacccgcccucaggcuuuucucagacaugaggcacgcccucccccagcg

SEQ ID NO: 167929 - RNA, 64 nt, Homo Sapiens
cacggccucgagaaaagagcggucccugguuggccucagacaaggcaccaggacgcugccuccu

SEQ ID NO: 167930 - RNA, 64 nt, Homo Sapiens
accgcuuccuagagccaaauagggaaguaucacacucagacaccaaacaaaaacaaaccucgua

SEQ ID NO: 167931 - RNA, 64 nt, Homo Sapiens
acuccagggagcacccgcaguggauggccgucaccucagacauccaccaugaagaucaccagcu

SEQ ID NO: 167932 - RNA, 64 nt, Homo Sapiens
agggacuguggucgcuccucaaccugacgcgaugcucagacagagcgucaggugggaguacugc

SEQ ID NO: 167933 - RNA, 64 nt, Homo Sapiens
gaagggacugcagucgugccaaccugacacgaugcucagacacaaagucagaugggaguacugc

SEQ ID NO: 167934 - RNA, 64 nt, Homo Sapiens
aauagggcuguggccgcgccaaccugacaggaugcucagacaagaagucaggugggaguacugc

SEQ ID NO: 167935 - RNA, 64 nt, Homo Sapiens
cagauucccuccauggccuccaccaaacugggaacucagacaccgcaagauggaggcagccaga

SEQ ID NO: 167936 - RNA, 64 nt, Homo Sapiens
cggggugggggaaguggggaaccccugagaguuucucagacaccuuucaaacuguucuuugagg

SEQ ID NO: 167937 - RNA, 64 nt, Homo Sapiens
ggcaggaugcucucucuaagccagaccagagggacucagacaccaccgaucacaggcuggccca

SEQ ID NO: 167938 - RNA, 64 nt, Homo Sapiens
ggcccaccugccagcagagggugugguuggaggccucagacaggucccugaaggagucugaggc

SEQ ID NO: 167939 - RNA, 64 nt, Homo Sapiens
acacuucuuuucucccaucccgguugcaaucucacucagacaucacaguaccaccccaggggug

SEQ ID NO: 167940 - RNA, 64 nt, Homo Sapiens
uuuuguggggugggaguggggagcaggaauugcacucagacaugacauuucaauucaucucugc

SEQ ID NO: 167941 - RNA, 64 nt, Homo Sapiens
cacugauucacacccagucccugccacagaccgucucagacacgcacagugggccugcugcaug

SEQ ID NO: 167942 - RNA, 64 nt, Homo Sapiens
gcaugauucacacccagucccugccacagaccgucucagacacgcacagugggccugcugcaug

SEQ ID NO: 167943 - RNA, 64 nt, Homo Sapiens; identical to SEQ ID NO: 167942

SEQ ID NO: 167944 - RNA, 64 nt, Homo Sapiens
uggacacacauaccuggccacgaacccacaccuccucagacacucagacaccacuccaggcuca

SEQ ID NO: 167945 - RNA, 64 nt, Homo Sapiens
cauaccuggccacgaacccacaccuccucagacacucagacaccacuccaggcucauagccccg

SEQ ID NO: 167946 - RNA, 64 nt, Homo Sapiens
agcagucagcuugaggaggaugaaggaaggcagccucagacaggaauuaaggcaaugcccaggc

SEQ ID NO: 167947 - RNA, 64 nt, Homo Sapiens
gaggacucagaaguggccuuuccuccaaagccugcucagacacaggucuguagggccagggugu

SEQ ID NO: 167948 - RNA, 64 nt, Homo Sapiens
ggaagcccugcagaaaguucgccagugcuccgagcucagacagacacuucauccugcccggaau

SEQ ID NO: 167949 - RNA, 64 nt, Homo Sapiens
cugccuguggccccgccuccgagccagggcaggccucagacaccuucaaggacaaccugucuuu

SEQ ID NO: 167950 - RNA, 64 nt, Homo Sapiens
uuuauguaaagccuugacccaauguuuaaaaauauaauuguauuuagaucuuguuauugcucca

SEQ ID NO: 167951 - RNA, 64 nt, Homo Sapiens
gcugacugacaaaacuaagcagggagaauaaagauaauuguauuuuauguuuugcacacaaacg

SEQ ID NO: 167952 - RNA, 64 nt, Homo Sapiens
uaguuacuauuguagauaacgaaauauaauaauauaauuguauuaauacaucucuuaguaaagu

SEQ ID NO: 167953 - RNA, 64 nt, Homo Sapiens
aauugguuuacacagaacuuuuaaauauaugauuuaauuguaggauaauguccguccuaaugcu

SEQ ID NO: 167954 - RNA, 64 nt, Homo Sapiens
ucuguguacuuuuuuuggaucuguuuuacuguuuuaauuguaguacaguacuuuauuguacaga

SEQ ID NO: 167955 - RNA, 64 nt, Homo Sapiens
agucaagcacauguaauaaaccuuaggguggcuuuaauuguauauuguuuuuuaaagcaaguca

SEQ ID NO: 167956 - RNA, 64 nt, Homo Sapiens
uguguuuuuuuguuuuuaguucugcucuagaucauaauuguaaaaaauauuaagucauaaucug

SEQ ID NO: 167957 - RNA, 64 nt, Homo Sapiens
uguuaaaaggcuuuuuuccccuuccuaaauguuuuaauuguaccauaguguuuugcucacugaa

SEQ ID NO: 167958 - RNA, 64 nt, Homo Sapiens
aauauacaagcaagcaaaauuauuuuaaaugacuuaauuguaugcuaauacucaucugauaaua

SEQ ID NO: 167959 - RNA, 64 nt, Homo Sapiens
acuugauuugaauuacguuuagacaaaaaugauuuaauuguaaauucuuaaaacuuucuaaaug

SEQ ID NO: 167960 - RNA, 64 nt, Homo Sapiens
accauauaacuugagauuuagcuucaguaagacuuaauuguaaauaagaaaggaaaucugugcu

SEQ ID NO: 167961 - RNA, 64 nt, Homo Sapiens
aaugggcaagacuggugcugagaaggucaaauuuuaauuguaucaacuugugaacuaagaacug

SEQ ID NO: 167962 - RNA, 64 nt, Homo Sapiens
uagucauuuaagauaaucauaaguuguaugaugauaauuguauaaaaauuuguaugaugauaau

SEQ ID NO: 167963 - RNA, 64 nt, Homo Sapiens
uaugaugauaauuguauaaaaauuuguaugaugauaauuguauaauaauuauacaugaaagugc

SEQ ID NO: 167964 - RNA, 64 nt, Homo Sapiens
uaaguuucagauaauuauuaggacccuaaauguuuaauuguaaagcacugaguuuuguaaauca

SEQ ID NO: 167965 - RNA, 64 nt, Homo Sapiens
auacuugcauuccagaguuauguaaauguacugguaauuguacaaccuacugucuaagcaguuu

SEQ ID NO: 167966 - RNA, 64 nt, Homo Sapiens
gugcucuuugaugauaaaacuuguaauagagcaauaauuguaaaugguuaccauacuguaagau

SEQ ID NO: 167967 - RNA, 64 nt, Homo Sapiens
uauuuuuaccauauuuuaagaacuuuaagacgauuaauuguaaauaauuuauuugauuggugca

SEQ ID NO: 167968 - RNA, 64 nt, Homo Sapiens
gcaaaaggcuauguaaaaacaaaugaaauuuuuauaauuguaugacaaaaaaauuucacuuuug

SEQ ID NO: 167969 - RNA, 64 nt, Homo Sapiens
uguuaauucccucuugcaagcaugauuuucauguuaauuguaaaucuccugcagaagucugaua

SEQ ID NO: 167970 - RNA, 64 nt, Homo Sapiens
uuuaguucuaacauugaguuuggacaauuuuaucuaauuguaauucucuagggugccagagaua

SEQ ID NO: 167971 - RNA, 64 nt, Homo Sapiens
ucucauugguuugcuuucccaaauccuguuugguuaauuguagccuccauacaguggggucuuc

SEQ ID NO: 167972 - RNA, 64 nt, Homo Sapiens
gacacauaauguaacauuguucuuuaaggacaauuaauuguacaaaaagcugauucugguuauc

SEQ ID NO: 167973 - RNA, 64 nt, Homo Sapiens
gaaucuuacagcaucuuugaagcugaguauuuccuaauuguauaagauaagaaaauacucuuaa

SEQ ID NO: 167974 - RNA, 64 nt, Homo Sapiens
auugauuauugggcuagcuguggauagcuugcauuaauuguauauuuuggauucuguuuguguu

SEQ ID NO: 167975 - RNA, 64 nt, Homo Sapiens
acaaagaagucccccauguggauauuucuuauacuaauuguaucauaaagccguuuauucuucc

SEQ ID NO: 167976 - RNA, 64 nt, Homo Sapiens
uccugaauaaauguauguuuaucaaggauucuaguaauuguauuuguggaaugaucauugaaau

SEQ ID NO: 167977 - RNA, 64 nt, Homo Sapiens
auuauuagagguauuuguugguauggacuuaauuuaauuguaaagagaccaaaguaguauagaa

SEQ ID NO: 167978 - RNA, 64 nt, Homo Sapiens
uauuugucgacgccaggucagucauuuuugcacuuaauuguauaugagauaacuagauguccug

SEQ ID NO: 167979 - RNA, 64 nt, Homo Sapiens
ucuuaccagugguuaauaauuugaaguuugacuuuaauuguaaaagccguuaauguagaaaacu

SEQ ID NO: 167980 - RNA, 64 nt, Homo Sapiens
ugaauguugaaggugcaauuaucacauuguuuauuaauuguauaacagauuauuacuagaaagg

SEQ ID NO: 167981 - RNA, 64 nt, Homo Sapiens
aaaauguaaauguuuuacaaauuugaaacuuucauaauuguauuaaucagaaaacaagcacauu

SEQ ID NO: 167982 - RNA, 64 nt, Homo Sapiens
gcaaagagguccucaacaggauguaaagcaaacuuaauuguaauuaauuuauucagcccauuaa

SEQ ID NO: 167983 - RNA, 64 nt, Homo Sapiens
auagggaacauacauacagcuauguaacugugaauaauuguauauaucucuaguuaagaaugag

SEQ ID NO: 167984 - RNA, 64 nt, Homo Sapiens
cauccugaaauaaaaaagcaagucuuccuggaaguaauuguaagaaccugaggucuauaaacaa

SEQ ID NO: 167985 - RNA, 64 nt, Homo Sapiens
gaauugcaaauugauaguugaaucuaagcccaccuaauuguacuuugaacuaguagucaguaga

SEQ ID NO: 167986 - RNA, 64 nt, Homo Sapiens
uuaguagauauggaguuucaccaccaugcccagcuaauuguauugcugggauuacaggcaugcg

SEQ ID NO: 167987 - RNA, 64 nt, Homo Sapiens
auuacuucaauaucuuuucuacuauucaguuuuuuaauuguaauuuuguauuauugcucuuuug

SEQ ID NO: 167988 - RNA, 64 nt, Homo Sapiens
uguuguuuuucugucccuuuaaagucuuuacauguaauuguagcuguauaaucguuauuuuucu

SEQ ID NO: 167989 - RNA, 64 nt, Homo Sapiens
guuccaauggauuauuugcuuucgguuguaaauuuaauuguacauaugguugauuuauuauuuu

SEQ ID NO: 167990 - RNA, 64 nt, Homo Sapiens
acaguguuaaucuguaguugaaagaaagcuuaguagaugagagaguucuaggcuacuguggcuu

SEQ ID NO: 167991 - RNA, 64 nt, Homo Sapiens
guucuaggcuacuguggcuuuuuccaguagauuuagaugagauuauguguuuugaaauguuuug

SEQ ID NO: 167992 - RNA, 64 nt, Homo Sapiens
agacuuguuuauugacuagcucagaaaagagaugagaugagauaaacacaucggguguuuguua

SEQ ID NO: 167993 - RNA, 64 nt, Homo Sapiens
agauaagacuuguuuauugauguuaucagaaaagagaugagaugaauugaacacaucggguguu

SEQ ID NO: 167994 - RNA, 64 nt, Homo Sapiens
gggaaauuaagggaacagugucuguuugcauguaagaugagaugagaucaauacuacugaucca

SEQ ID NO: 167995 - RNA, 64 nt, Homo Sapiens
auuaagggaacagugucuguuugcauguaagaugagaugagaucaauacuacugauccaucugu

SEQ ID NO: 167996 - RNA, 64 nt, Homo Sapiens
aggacaggaguugaacaauuagguuagcagauggagaugagaggacuggguagaguaccauggc

SEQ ID NO: 167997 - RNA, 64 nt, Homo Sapiens
agcagaaaauucauaaaaauguaucaucagcaggagaugagacuaugaauuggcauccagaaca

SEQ ID NO: 167998 - RNA, 64 nt, Homo Sapiens
augcacacuuguuaaauaguguuaagagauguggagaugagauauaccccuuugauguagaauu

SEQ ID NO: 167999 - RNA, 64 nt, Homo Sapiens
aaccaaaaauguucuucauccaggccugccguggagaugagacugaucgugggguugaccaaca

SEQ ID NO: 168000 - RNA, 64 nt, Homo Sapiens
gaggagagugaugccgguaaagaaaaguugccgaagaugagacugcccacgcgcucagacauga

SEQ ID NO: 168001 - RNA, 64 nt, Homo Sapiens
aggcccugugcauuucuuuugagcucaucucaccagaugagaagcaacauccccugagcagugu

SEQ ID NO: 168002 - RNA, 64 nt, Homo Sapiens
ggccaggacgcccagccacauccccaccagccucagaugagacgugggccgauguggugugaca

SEQ ID NO: 168003 - RNA, 64 nt, Homo Sapiens
cacauccuaaaaauaccaugguggcagguccuagagaugagaucgggcacaugacauauacaug

SEQ ID NO: 168004 - RNA, 64 nt, Homo Sapiens
ggcuuucaggaaggaagucccaguggaauguggcagaugagacgaccccacgcagugucucaua

SEQ ID NO: 168005 - RNA, 64 nt, Homo Sapiens
uuuagcauauuuccuuucacacuuaaaguucuuaagaugagacuguguaaaugagagaaagacu

SEQ ID NO: 168006 - RNA, 64 nt, Homo Sapiens
gaggcacuagucuaaaaggcugcauugcggggagagaugagacaggcagaggagggugggguaa

SEQ ID NO: 168007 - RNA, 64 nt, Homo Sapiens
aaguauacacugaaguugugucguuuuugccacuagaugagauuaaaagaagacaauuauucaa

SEQ ID NO: 168008 - RNA, 64 nt, Homo Sapiens
ugggaaggcugaauugagugacuccccagaaugaagaugagaaggugaauauaaucaaugccaa

SEQ ID NO: 168009 - RNA, 64 nt, Homo Sapiens
uaacugauuugcacagcugaaucaggagacacaaagaugagacuguguuugguuacauuuucca

SEQ ID NO: 168010 - RNA, 64 nt, Homo Sapiens
auaugcagauuuuauucucaccugggccauuugcagaugagacuguaguuugcagaugagacug

SEQ ID NO: 168011 - RNA, 64 nt, Homo Sapiens
accugggccauuugcagaugagacuguaguuugcagaugagacuguaguuugcagauggcgugg

SEQ ID NO: 168012 - RNA, 64 nt, Homo Sapiens
caggaguaagggaagagguccucuggcccccugaagaugagaaucaccccucucagugcaccug

SEQ ID NO: 168013 - RNA, 64 nt, Homo Sapiens
aucccaggcccugugcggagcaucgggaauacaaagaugagauaaaacauugucccugcccccg

SEQ ID NO: 168014 - RNA, 64 nt, Homo Sapiens
auuccugggugagcccuugggcaggcauguuuggagaugagagaggcuucgagagggugggugc

SEQ ID NO: 168015 - RNA, 64 nt, Homo Sapiens
uauuuccaguacacgucacauuauuuuaccggugagaugagaaugucacaaacauuaaaagccu

SEQ ID NO: 168016 - RNA, 64 nt, Homo Sapiens
ggaggcuggaguggaaacaaagggugggcaucaaagaugagaagccaaagccccuacaacucca

SEQ ID NO: 168017 - RNA, 64 nt, Homo Sapiens
ucuggauuggggauggggacaaagaaauagcaagagaugagaaacaacagaaacuuuuuucucu

SEQ ID NO: 168018 - RNA, 64 nt, Homo Sapiens
acaccccaacagcacccucuacagcacccucuccagaugagaguccagaugagaguacacccca

SEQ ID NO: 168019 - RNA, 64 nt, Homo Sapiens; identical to SEQ ID NO: 168018

SEQ ID NO: 168020 - RNA, 64 nt, Homo Sapiens
acaccccaacagcacccucuacagcacccucuccagaugagaguuccagaugggagugccccca

SEQ ID NO: 168021 - RNA, 64 nt, Homo Sapiens
ugauuuccuagagauguaaagcuucgcucagaugagaugagauaaucguuuugcacaaagucuu

SEQ ID NO: 168022 - RNA, 64 nt, Homo Sapiens
agauaugauuuccuagagaugucuugcuucgcucagaugagaugcuuaaaucguuuugcacaaa

SEQ ID NO: 168023 - RNA, 64 nt, Homo Sapiens
ucugacguccaagccuuguucuuugucacagugaagaugagaccucaaccccaaguccuuuaug

SEQ ID NO: 168024 - RNA, 64 nt, Homo Sapiens
agccaccccaucuggcaccaaauaauaaucuuaaagaugagaaaagacuccaucucaaaaaaau

SEQ ID NO: 168025 - RNA, 64 nt, Homo Sapiens
uagcaucaggaaagccugaaaggauuucauacucagaugagaaugguugucuguuuuauuaucc

SEQ ID NO: 168026 - RNA, 64 nt, Homo Sapiens
aucacuugagccuggggagguacucaggaggcugagaugagaggcacgugaguguagucucagc

SEQ ID NO: 168027 - RNA, 64 nt, Homo Sapiens
cuaugcuaagagaagugaauucaccuacucuccacuaauagaugguaccaacaaguuaauaacg

SEQ ID NO: 168028 - RNA, 64 nt, Homo Sapiens
aggcaacuuaccacuuggagagugagucaaagcacuaauagaccccucuguguaggugguaggg

SEQ ID NO: 168029 - RNA, 64 nt, Homo Sapiens
gagugcccucuacuguccgacuccagcacugcaacagcuucaaguucaaaaccaagaggcguuu

SEQ ID NO: 168030 - RNA, 64 nt, Homo Sapiens
aaugacaugagggccaaggcuugugggaaaaugacagcuucacagccccuugaggagugaccaa

SEQ ID NO: 168031 - RNA, 64 nt, Homo Sapiens
ugugugugucugguguuuggaaacugggauauuucagcuucauuauuuccacuugcaggccagc

SEQ ID NO: 168032 - RNA, 64 nt, Homo Sapiens
uugccuuaaguguguuguuaaaugaaaguacagacagcuucauuguuguauuguuaauaauugu

SEQ ID NO: 168033 - RNA, 64 nt, Homo Sapiens
agaaagcccucccucccugaacuugcaguaaggucagcuucaggaccuguuccagugggcacug

SEQ ID NO: 168034 - RNA, 64 nt, Homo Sapiens
caacuagcuccauuuacagccauuucuaaaauggcagcuucaguucuagagaagaaagaacaac

SEQ ID NO: 168035 - RNA, 64 nt, Homo Sapiens
cuagggauaccugaagcuguugccuguuugguggcagcuucagccugaggaggaggaggccggg

SEQ ID NO: 168036 - RNA, 64 nt, Homo Sapiens
uuuccuucaggaucauccuugacgccguuaaaaccagcuucaucugcagggaaagcagcucaca

SEQ ID NO: 168037 - RNA, 64 nt, Homo Sapiens
cucacuacuucugacacucugugucuggcaaacacagcuucagucgagcuggcuauggacuugg

SEQ ID NO: 168038 - RNA, 64 nt, Homo Sapiens
gacuccucuguaucacugcccuccccuaagacuccagcuucauagcugcagaaggacucaacca

SEQ ID NO: 168039 - RNA, 64 nt, Homo Sapiens
gugaucuguauuugaugaggaggagccgaggccccagcuucauccagcuucaaccaaugccugg

SEQ ID NO: 168040 - RNA, 64 nt, Homo Sapiens
uuugaugaggaggagccgaggccccagcuucauccagcuucaaccaaugccuggaccuguccac

SEQ ID NO: 168041 - RNA, 64 nt, Homo Sapiens
ccuauccugaaggcuguccuuucagcgagguguccagcuucaugagguggcgggcuguagcagc

SEQ ID NO: 168042 - RNA, 64 nt, Homo Sapiens
gagguguccagcuucaugccguggcgggcuguagcagcuucagcgccuugcagugcaugcccag

SEQ ID NO: 168043 - RNA, 64 nt, Homo Sapiens
accugccaccugagaagauggagaacucagccugcagcuucagcugcucccccaggaguuccag

SEQ ID NO: 168044 - RNA, 64 nt, Homo Sapiens
agcgaucugacaugaaagucgacugaggcauagccagcuucaaacuggcuaagagugcagcaga

SEQ ID NO: 168045 - RNA, 64 nt, Homo Sapiens
cauggggaaacaggccagagaccucagaaauccucagcuucaaaaaacgagcuuguuucccuga

SEQ ID NO: 168046 - RNA, 64 nt, Homo Sapiens
uugggagaaugagcugcagaagaugacccgggggcagcuucaggaugaguuagagaaaggugaa

SEQ ID NO: 168047 - RNA, 64 nt, Homo Sapiens
uccugacaucugcauguaccucguggaauucagccagcuucauguugcaaaucagaaagcugac

SEQ ID NO: 168048 - RNA, 64 nt, Homo Sapiens
uguucgaauuuuaugaaccagcaauuaacaaaaacagcuucaacggauuucugguuguggccca

SEQ ID NO: 168049 - RNA, 64 nt, Homo Sapiens
uuugcaagugguaaauuggauccuuaccuuuuuccagcuucauaaaaauguuuucaacucuggg

SEQ ID NO: 168050 - RNA, 64 nt, Homo Sapiens
augaccagaguuuccagaugauacacguucuuuucagcuucauuaaauaggcaacuauguuucu

SEQ ID NO: 168051 - RNA, 64 nt, Homo Sapiens
cuuuacaaaauuaucuuaauaaguucuauauggucagcuucaucuuccuuuuuuuuuuuuuuga

SEQ ID NO: 168052 - RNA, 64 nt, Homo Sapiens
cugggcuuacaggccugagccaccacgcucagcucagcuucacccugucugcaaagaaaaguuu

SEQ ID NO: 168053 - RNA, 64 nt, Homo Sapiens
ccugcaaggcuggauuugggggccauuaucugagcagcuucaaagaccccugagcugccaacca

SEQ ID NO: 168054 - RNA, 64 nt, Homo Sapiens
cuucugcaugcaguuugucuuucuguucugcaggcagcuucagaauugaggucauuugugagca

SEQ ID NO: 168055 - RNA, 64 nt, Homo Sapiens
gcugcugugugccugguuuccucacauccugccucagcuucaccacccuggcuuauguggaaca

SEQ ID NO: 168056 - RNA, 64 nt, Homo Sapiens
ccucugcugcagguaagucagagcagcuuuaccacagcuucaggccacgagagccccuucaccc

SEQ ID NO: 168057 - RNA, 64 nt, Homo Sapiens
gaccuugccaggcccaggcuuggggcaaggccaucagcuucagaaaugauuuagaucuuggugc

SEQ ID NO: 168058 - RNA, 64 nt, Homo Sapiens
aggcuggccggccagcuccaccacuugaggauagcagcuucacugggcuucggccaggggcuuu

SEQ ID NO: 168059 - RNA, 64 nt, Homo Sapiens
gagacagcagcagccgaugcagggaggaaggcaucagcuucaguuccagcgcugccggaaccac

SEQ ID NO: 168060 - RNA, 64 nt, Homo Sapiens
aggggcuuuucaggugugcuagacaccuccagcacagcuucaccccagcgccuaccaccucaac

SEQ ID NO: 168061 - RNA, 64 nt, Homo Sapiens
ucuggcuuggggaggagucccucuagguagaacacagcuucagaaacuagcuuuaagaaauaau

SEQ ID NO: 168062 - RNA, 64 nt, Homo Sapiens
acugcuuauuagaggacaagaucaggacugcuuucagcuucagaacacuuuugguucagaacag

SEQ ID NO: 168063 - RNA, 64 nt, Homo Sapiens
acaguccuguaucaaaacugaagaugguuugaaacagcuucacaagguaauaugucuuucaaga

SEQ ID NO: 168064 - RNA, 64 nt, Homo Sapiens
uguuaauuaacacauuuagaugggccaguuaaaacagcuucauaaguuuuaaauuaauuguaaa

SEQ ID NO: 168065 - RNA, 64 nt, Homo Sapiens
ccugaagagcagagaagcccuccuguggacaucacagcuucagggggugugcgugguuccuagg

SEQ ID NO: 168066 - RNA, 64 nt, Homo Sapiens
gggugugcgugguuccuaggcaugccugguguuccagcuucaggccagccacccaggacucacc

SEQ ID NO: 168067 - RNA, 64 nt, Homo Sapiens
gcguagcuauguguuggcccuggggcggcccaccccugccaagcuugccaacuucccugaggug

SEQ ID NO: 168068 - RNA, 64 nt, Homo Sapiens
accuuuagugcucccugcaccaaccucccaucccccugccaagauccuugaaggacccuggaag

SEQ ID NO: 168069 - RNA, 64 nt, Homo Sapiens
gcuaccgagaagguuggagguugguaacugauuaccugccaauuaacauuggagcugacuguuc

SEQ ID NO: 168070 - RNA, 64 nt, Homo Sapiens
cucagaagagguugggcuucccccguguccucucccugccaaguuguaacagauaucagugucu

SEQ ID NO: 168071 - RNA, 64 nt, Homo Sapiens
ccaugaccaggccaccaucuagccccggccacucccugccaacugcucuuugucucaccagcuc

SEQ ID NO: 168072 - RNA, 64 nt, Homo Sapiens
ccacagccaagcccacccugcccuaggacucaggccugccaaugccccgggccaagcucugagc

SEQ ID NO: 168073 - RNA, 64 nt, Homo Sapiens
uauucaccauaauuuuuuuaaacuucaaaucuuaccugccaacaccguuuaucuucucugaaag

SEQ ID NO: 168074 - RNA, 64 nt, Homo Sapiens
guucucuugccccaugccuguuuggccaccgugaccugccaaaaucuuccaggaaaaaaucccg

SEQ ID NO: 168075 - RNA, 64 nt, Homo Sapiens
aggagcugcaagaaguccauauuguuccuuaucaccugccaacaggaagcgaaaggggauggag

SEQ ID NO: 168076 - RNA, 64 nt, Homo Sapiens
uccugcugggcccccuacccugccccaauucaauccugccaauaaauccugucuuauuuguuca

SEQ ID NO: 168077 - RNA, 64 nt, Homo Sapiens
augaucauggcucacugcagccuugaccuuccagccugccaaguagcugggauuacagacaggc

SEQ ID NO: 168078 - RNA, 64 nt, Homo Sapiens
ggcucgucuugagcuccuggccucaaucgaucuuccugccaagguuuuggaauuacagguguga

SEQ ID NO: 168079 - RNA, 64 nt, Homo Sapiens
cugaccguuuucacuugucuccuuucugacugucccugccaaugcuccagcugucgucugacuc

SEQ ID NO: 168080 - RNA, 64 nt, Homo Sapiens
gggugcgagugugagagugugagcagggcuugcuccugccaaccacaauucaaugaauccccga

SEQ ID NO: 168081 - RNA, 64 nt, Homo Sapiens
cccauccccuuggccacagagccauugugauaugaggagauacuggcucuucuggaaaagagag

SEQ ID NO: 168082 - RNA, 64 nt, Homo Sapiens
aaaagagaggcuuuucuucaucgagagcuaccagaggagauauuaucuguccucuguguggcac

SEQ ID NO: 168083 - RNA, 64 nt, Homo Sapiens
gcgagugaaccaagaagaggaugacauuagauccaggagauacaacagaggagauaaucuccag

SEQ ID NO: 168084 - RNA, 64 nt, Homo Sapiens
aagaggaugacauuagauccaggagauacaacagaggagauaaucuccaggaugccugugaaga

SEQ ID NO: 168085 - RNA, 64 nt, Homo Sapiens
cuccaggaugccugugaagaaggagauacaacagaggagauaauaagaggaugacauuagaucc

SEQ ID NO: 168086 - RNA, 64 nt, Homo Sapiens
acagaggagauaaucuccagaugacauuagauccaggagauacagcgagugaaccaagaagagg

SEQ ID NO: 168087 - RNA, 64 nt, Homo Sapiens
ccagauggggacguuugacuuggugggaggugucaggagauaggaguugguuaagaugauagau

SEQ ID NO: 168088 - RNA, 64 nt, Homo Sapiens
ggccauucacaggggcccugcaaccucacgagaaaggagauaguggaagagucaggacagguug

SEQ ID NO: 168089 - RNA, 64 nt, Homo Sapiens
caucuucuaaagauuuuuuuuucacugacucauuaggagauaggaaaauggacuuuucccacca

SEQ ID NO: 168090 - RNA, 64 nt, Homo Sapiens
gaguagaaugaugguuaccaaauaaucaaacuuaaggagauagauugugggagcuaaaaauuac

SEQ ID NO: 168091 - RNA, 64 nt, Homo Sapiens
caguggagccucugcccuucacuaucaggccuguaggagauacuuaaauguccuagguaauacc

SEQ ID NO: 168092 - RNA, 64 nt, Homo Sapiens
caggguacuguacuggagaauuacuugucuaugaaggagauaaauacacuaacccuuaauuauc

SEQ ID NO: 168093 - RNA, 64 nt, Homo Sapiens
aaacaccuaccuugcaguaguccacaucuguaaaaggagauaauuucaccucugagccuaaguu

SEQ ID NO: 168094 - RNA, 64 nt, Homo Sapiens
guggguucaugaaugacuaucuacccuccuaguaaggagauacaaguugaaucagacaugaucu

SEQ ID NO: 168095 - RNA, 64 nt, Homo Sapiens
aacagauggcugaggcugcagacucaggcccaggacacucaaccccaggaggggagccgcucgg

SEQ ID NO: 168096 - RNA, 64 nt, Homo Sapiens
cacuucugggugcaagaggcuuucuagaccuuagacacucaagauuacggucccgggccaguaa

SEQ ID NO: 168097 - RNA, 64 nt, Homo Sapiens
aauagggauuccuaauaaugaugucauguagcugacacucaagaaugcaggugaauuguggaaa

SEQ ID NO: 168098 - RNA, 64 nt, Homo Sapiens
cagguaaauaggccaccaguaaucuccacgcuagacacucaauagaggacacccacgaauggca

SEQ ID NO: 168099 - RNA, 64 nt, Homo Sapiens
cugaagaugaauuuuauuuuuaaaaaauacaugcacacucaaaacuuuuagcuuugaucacaag

SEQ ID NO: 168100 - RNA, 64 nt, Homo Sapiens
gguaugcguaaguguguaugcuuguuuuaaacaaacacucaacguacauauguacauaaucuac

SEQ ID NO: 168101 - RNA, 64 nt, Homo Sapiens
uagccuuagugauucuauggucagccaugcuaaaucacuuuaauuuuuagcaucucuggucuua

SEQ ID NO: 168102 - RNA, 64 nt, Homo Sapiens
aauguuaucaaaauuacuuuaacaaacuugcuaaucacuuuaccuaagagaauccaguugagaa

SEQ ID NO: 168103 - RNA, 64 nt, Homo Sapiens
caggucaccaagcaguggccuuuuucugagaugcucacuuuauuaucccuauuuuuaaaguaca

SEQ ID NO: 168104 - RNA, 64 nt, Homo Sapiens
acuuagaaacggaaauggaauccugcucacaaaaucacuuuaagaucuuuucgaagcuguuaau

SEQ ID NO: 168105 - RNA, 64 nt, Homo Sapiens
auaaaucuguauucagauuucauucuuuguuagcucacuuuauaauuuguauuuuuuuacugua

SEQ ID NO: 168106 - RNA, 64 nt, Homo Sapiens
uuugauaguaaaggguuuuguuucuugaauaucuucacuuuaaacaaaaaaaaaaaacaacuuu

SEQ ID NO: 168107 - RNA, 64 nt, Homo Sapiens
agaaauuuuaaacuggugauuuugguugcacugcucacuuuaagaguuaacaugcucacuuguu

SEQ ID NO: 168108 - RNA, 64 nt, Homo Sapiens
uuggcucuaauaugcuacaacuguaggccaauuaucacuuuaccaauuaagaguuaggccagau

SEQ ID NO: 168109 - RNA, 64 nt, Homo Sapiens
aggccccguuccugggaggggcaccccucaacugucacuuuauggacugucugugcaauuacgu

SEQ ID NO: 168110 - RNA, 64 nt, Homo Sapiens
gaggcccugggggacccucugaagcauuucugccucacuuuaugucaucugcuucuccccuguu

SEQ ID NO: 168111 - RNA, 64 nt, Homo Sapiens
ccacaauuaauauauucaauuucccaucaguauaucacuuuaaauuuuauguuuuucuaaggaa

SEQ ID NO: 168112 - RNA, 64 nt, Homo Sapiens
ucugaagauguggauacagaauuagucacucuugucacuuuauuuauuuauugguuuuuuuuua

SEQ ID NO: 168113 - RNA, 64 nt, Homo Sapiens
ccuugaauauaaacagguuauaauacuacccuguucacuuuacuaaauauaaguacaguaauga

SEQ ID NO: 168114 - RNA, 64 nt, Homo Sapiens
ucagucuacuuacauaaacuuuaccuaauuuuuuucacuuuaacaaaaacauaacuaugcccuu

SEQ ID NO: 168115 - RNA, 64 nt, Homo Sapiens
aaaacuugcuuauuugcuaaugccuaaaggggucucacuuuaccaauuguuacuuucaauguga

SEQ ID NO: 168116 - RNA, 64 nt, Homo Sapiens
aaguuagaaagcauucagauuguuucuuuuaaacucacuuuaaaauuuuggcaaggaauucaug

SEQ ID NO: 168117 - RNA, 64 nt, Homo Sapiens
uucugcucuguccaauuccagagcugucuggugaucacuuuaugucucacagggacccacaucc

SEQ ID NO: 168118 - RNA, 64 nt, Homo Sapiens
aucaugggguggaauaaaggcugaguuuaguuuuucacuuuagcaaaggggcaauggggugccu

SEQ ID NO: 168119 - RNA, 64 nt, Homo Sapiens
guuuuacuugaaguuuuacugaugggacagauguucacuuuaauacuguuagucuuuugggaca

SEQ ID NO: 168120 - RNA, 64 nt, Homo Sapiens
augcgcauuacaaacuucuucgacauuaggaauuucacuuuaaauagagagagagauuagaaaa

SEQ ID NO: 168121 - RNA, 64 nt, Homo Sapiens
ucuguggaccuguuuucucuuggccuggggcaggucacuuuaccccagccccgaagucgccacg

SEQ ID NO: 168122 - RNA, 64 nt, Homo Sapiens
cagcuguaacagcggcagggaugucugggugaccucacuuuagggucccaaaccagacaccugg

SEQ ID NO: 168123 - RNA, 64 nt, Homo Sapiens
uguuagcucaaauuuacagagcauucucacaaaaaugguacauuuuuaucugaguuauaucauu

SEQ ID NO: 168124 - RNA, 64 nt, Homo Sapiens
ggggaaaacugaggcacagacagcuacuauucucaugguacaguacaacccuaggagaaaggua

SEQ ID NO: 168125 - RNA, 64 nt, Homo Sapiens
auagucaguuuucuagaaccuacuuuuaggguaaaugguacauuauuuaauauuauauuaaacc

SEQ ID NO: 168126 - RNA, 64 nt, Homo Sapiens
aaccuccuauagcguggauuguagaccaaaggaaaugguacaauuucugagaauauauguugau

SEQ ID NO: 168127 - RNA, 64 nt, Homo Sapiens
gagcugucccacaucaacgcgcggcugaacaugggcauccuaggcugugaguauggacccgccg

SEQ ID NO: 168128 - RNA, 64 nt, Homo Sapiens
caucucgacgccagaccagaccaaagucuucagugcauccuacgaccggucccucagggugcgu

SEQ ID NO: 168129 - RNA, 64 nt, Homo Sapiens
gaacaaaagcaaagcauuaguggcuauggucuguaaaaugaaacaaaaaaacuuuauuucacua

SEQ ID NO: 168130 - RNA, 64 nt, Homo Sapiens
aaaucagaaaauauaauaaaauugcacaaaaaaaaaaaugaaaaagaugcagacuggucuuuua

SEQ ID NO: 168131 - RNA, 64 nt, Homo Sapiens
ucugaaugcuuuauauucuuucugcuguaaauuaaaaaugaagaaaauuuccccauacuacgug

SEQ ID NO: 168132 - RNA, 64 nt, Homo Sapiens
ugcuaugugucacacuuugccaaacaggauguggaaaaugaauaagcgguuuucuuaggcacuu

SEQ ID NO: 168133 - RNA, 64 nt, Homo Sapiens
guuuucuuaggcacuucuuaacagacaauuggucaaaaugaacuccauugcuuaagaaacacau

SEQ ID NO: 168134 - RNA, 64 nt, Homo Sapiens
agguucuuuuuguuuacauaauacuugaaaaauaaaaaugaacaagcuaacaaacuaccaaguu

SEQ ID NO: 168135 - RNA, 64 nt, Homo Sapiens
uggacuaaaagguuuuauugaaauaaagccucuuaaaaugaaaaaucauauacuuuuaacauca

SEQ ID NO: 168136 - RNA, 64 nt, Homo Sapiens
gauauuuggaaauaccuggauauuugcuagaggaaaaaugaaagcaaaacuucguacacagugc

SEQ ID NO: 168137 - RNA, 64 nt, Homo Sapiens
uuaaucagaaaaggacuagauuuguuuaagaagaaaaaugaaaccagacccagaucaauauuuu

SEQ ID NO: 168138 - RNA, 64 nt, Homo Sapiens
ggaauuuugcugcucccuauugcuucuguuuacaaaaaugaauuuuuccugguuucccacuagg

SEQ ID NO: 168139 - RNA, 64 nt, Homo Sapiens
aucucuguucuuucauacuacauuugaacagggcaaaaugaacuaacugccauguaggcuaaga

SEQ ID NO: 168140 - RNA, 64 nt, Homo Sapiens
ccuuucuggcuuuuaagccaauauaaugggcugcaaaaugaagacaccagaguguaugcauaca

SEQ ID NO: 168141 - RNA, 64 nt, Homo Sapiens
gcugccaugaugccuauuugguguguuucugauuaaaaugaaaucacaagcugccuuguuuagc

SEQ ID NO: 168142 - RNA, 64 nt, Homo Sapiens
caagaaccauacuucgacauuuccucugccacaaaaaaugaacgcauuuuaaguuaggagucau

SEQ ID NO: 168143 - RNA, 64 nt, Homo Sapiens
aaauaaugauuaacuggaaugcuauaauaaaaacaaaaugaagggcuguaaauuaagcaaacau

SEQ ID NO: 168144 - RNA, 64 nt, Homo Sapiens
aauacccuuaaaccauuuauguaguaccugacuaaaaaugaaguuugagcuuucgauuaucagu

SEQ ID NO: 168145 - RNA, 64 nt, Homo Sapiens
uguugaucauuaggggugugauauacuaaauaaaaaaaugaauauugauaaauugcugcgugac

SEQ ID NO: 168146 - RNA, 64 nt, Homo Sapiens
gaaagaaaaauuggaaggcgaagaacaaaacaucaaaaugaauaaugagagaaaauguuuugaa

SEQ ID NO: 168147 - RNA, 64 nt, Homo Sapiens
aaaguaauuagaauauuuucgagagaagaaaagaaaaaugaagagagagggaggaagaaaggga

SEQ ID NO: 168148 - RNA, 64 nt, Homo Sapiens
aaaaagaagagagggaggaaaaauaaaugggaaaaaaaugaaauaaucaccuggcuucuauaac

SEQ ID NO: 168149 - RNA, 64 nt, Homo Sapiens
agaucuuauuauucuguuacuaaauaaauaaaauaaaaugaaauugagacucugucucaaaaaa

SEQ ID NO: 168150 - RNA, 64 nt, Homo Sapiens
uucuaggcugggcaugguggagaccacucuuucuaaaaugaauccuccuaagagaaaccuuccc

SEQ ID NO: 168151 - RNA, 64 nt, Homo Sapiens
aauauugaggguuuccugucaagccuugacuagaaaaaugaauauuuuauuuuaucauccuaga

SEQ ID NO: 168152 - RNA, 64 nt, Homo Sapiens
uguugcuccauuggaguaguaaauccaaucauguaaaaugaaacuuuaaaauuuguaaauuucu

SEQ ID NO: 168153 - RNA, 64 nt, Homo Sapiens
uauuucuuaauacaaaauaaauuuagaaaugaagaaaaugaauauuagucgaaaauaaagguug

SEQ ID NO: 168154 - RNA, 64 nt, Homo Sapiens
ugaagguauuccagaucuacauaagaugauaaauaaaaugaaggguaauuaaaaugagaaauac

SEQ ID NO: 168155 - RNA, 64 nt, Homo Sapiens
gccccaggagaagauacuucuuagaccaaaaggaaaaaugaaguaauagcuuccaauaaguaac

SEQ ID NO: 168156 - RNA, 64 nt, Homo Sapiens
gcuugcccucuccaggccucagggccucuucuggaaaaugaagaaauucaacuaguagauuccu

SEQ ID NO: 168157 - RNA, 64 nt, Homo Sapiens
cuucuacuugcucuuggccuugagaucguguaacaaaaugaaggagggcucucuucuuucuucc

SEQ ID NO: 168158 - RNA, 64 nt, Homo Sapiens
ucaaauuguggagcaaaauaguaaauaaaauauaaaaaugaaaaugaagauacgugaaauucaa

SEQ ID NO: 168159 - RNA, 64 nt, Homo Sapiens
uguggagcaaaauaguaaauaaaauauaaaaaugaaaaugaagauacgugaaauucaaauguca

SEQ ID NO: 168160 - RNA, 64 nt, Homo Sapiens
caugccuuccuuucaucuugaauaacuuuguccuaaaaugaauuuuuuuuccccuugauuuaac

SEQ ID NO: 168161 - RNA, 64 nt, Homo Sapiens
ccugaaacaaaaaauacauuugcugugaagauugaaaaugaacaaaguuagaaaaaaaaacagc

SEQ ID NO: 168162 - RNA, 64 nt, Homo Sapiens
gcugaauaaauuuagagcuuucaaacuggaaaaaaaaaugaaacaaaacaaauacaccaagacc

SEQ ID NO: 168163 - RNA, 64 nt, Homo Sapiens
aaacuugcaccucuucuucucuuagcuaagccccaaaaugaagauuuccuucagaagucuuguu

SEQ ID NO: 168164 - RNA, 64 nt, Homo Sapiens
aguaaagaaauuuaaaagacacuguuuacaagaaaaaaugaauuuuguuuggacuucuuuuacu

SEQ ID NO: 168165 - RNA, 64 nt, Homo Sapiens
ugaaauacuacuuaccauaugugcuugccucaguaaaaugaaccccacugggugggcagagguu

SEQ ID NO: 168166 - RNA, 64 nt, Homo Sapiens
guauauuucuuuuuaaagaaucuuuuuaagauuaaaaaugaauaccuuaaaucucccaaaagag

SEQ ID NO: 168167 - RNA, 64 nt, Homo Sapiens
aauagauuauucugccauuuuuuaaaggaaagggaaaaugaaaacagcaugucuuuuuaaacau

SEQ ID NO: 168168 - RNA, 64 nt, Homo Sapiens
auaguuuuguauaauagcauagauuuuccuucaaaaaaugaacauuuauauaucuacaaaaaua

SEQ ID NO: 168169 - RNA, 64 nt, Homo Sapiens
auaucuuuguggucacccacauugggugagacagaaaaugaaucuguucuaaaauuuguaauuu

SEQ ID NO: 168170 - RNA, 64 nt, Homo Sapiens
uuuuguuaaaaauaaaguuaaaaguuaaaguuaaaaaaugaaguuaaaaguuucaucagaaacu

SEQ ID NO: 168171 - RNA, 64 nt, Homo Sapiens
uguuuuggaaaugcacaguugacauguugaaauaaaaaugaauaccauuuuuaaauguuucuua

SEQ ID NO: 168172 - RNA, 64 nt, Homo Sapiens
agugucuucuuuauauauuuauuuuuuauuagaaaaaaugaaguuugguuggugaugcaugaaa

SEQ ID NO: 168173 - RNA, 64 nt, Homo Sapiens
ccuuauccuuucucccauaaccuuuguacacuaaaaaaugaaagaauuuagaauguauuugaug

SEQ ID NO: 168174 - RNA, 64 nt, Homo Sapiens
augugugaauaacauuguauuauguauaaauuagaaaaugaaaaaacuucacuucuuuguauau

SEQ ID NO: 168175 - RNA, 64 nt, Homo Sapiens
ugcuauucugucagcugaaucagugcugaaaacuaaaaugaacauauguugacccacuuauguu

SEQ ID NO: 168176 - RNA, 64 nt, Homo Sapiens
ggacagaauauucaauuuucgguaagauaauuguaaaaugaaauuacaugguacaaaaauaagu

SEQ ID NO: 168177 - RNA, 64 nt, Homo Sapiens
gguuuuuuuaauuuuuauuucuaaacacaagccaaaaaugaauaauuuaaugauaaaauuuaag

SEQ ID NO: 168178 - RNA, 64 nt, Homo Sapiens
ccucuaucucuaaagaaaaugagcuuaacccuggaaaaugaauccuaaaauaaaaugaaguggu

SEQ ID NO: 168179 - RNA, 64 nt, Homo Sapiens
ggugagcuuaacccuggaaauauagaccuaaaauaaaaugaaguuauaaucaagccuaaaauug

SEQ ID NO: 168180 - RNA, 64 nt, Homo Sapiens
cuuuaauuuuuaccauccauaugcuuuuccuuaaaaaaugaaaaaauguuugacaaaaaugaau

SEQ ID NO: 168181 - RNA, 64 nt, Homo Sapiens
ugcuuuuccuuaaaaaaugaguaaauguuugacaaaaaugaauagcuuuuuaacccggauuacu

SEQ ID NO: 168182 - RNA, 64 nt, Homo Sapiens
uaaaaauaaaauuaccuaggaaaguaaaaauuaaaaaaugaaaugcaaaaucucaucucuacaa

SEQ ID NO: 168183 - RNA, 64 nt, Homo Sapiens
uuguaugcugaauuucuaagauaauaggugggggaaaaugaauuuuggguaaaaucuguaauug

SEQ ID NO: 168184 - RNA, 64 nt, Homo Sapiens
aaacuucauauuuguugauuggaauuuuaagggaaaaaugaacuacaaccuuuugaucuuuguu

SEQ ID NO: 168185 - RNA, 64 nt, Homo Sapiens
caucauuauauucuuucguggaguuaaauauagaaaaaugaaacgauaucauuaggaucacaca

SEQ ID NO: 168186 - RNA, 64 nt, Homo Sapiens
aguucuggagaucaguugugaguuucaguuuugcaaaaugaaaagaguucuuuaaugggugaag

SEQ ID NO: 168187 - RNA, 64 nt, Homo Sapiens
caauuuuaaaaauguaaaacagugcaaauaagcaaaaaugaaaaucaugauagaaaauuuggaa

SEQ ID NO: 168188 - RNA, 64 nt, Homo Sapiens
aggcgcuggcuuuccacagugguuccuugccugaaaaaugaaagaguccaccuuucuaggccuu

SEQ ID NO: 168189 - RNA, 64 nt, Homo Sapiens
guagcuacugggaaguuaaaaggaaggggcuuagaaaaugaaugggaccaaaggcaucacuucu

SEQ ID NO: 168190 - RNA, 64 nt, Homo Sapiens
acaccagagaucagaaauucaaaaacucagaauaaaaaugaaaaagcuacaagcauauaugaga

SEQ ID NO: 168191 - RNA, 64 nt, Homo Sapiens
aaaugaguaaaagguccaauuuugugaaagauugaaaaugaauugaaugccuaguagaguauag

SEQ ID NO: 168192 - RNA, 64 nt, Homo Sapiens
agagcuaguauguuguaaaaccugccaccugaauaaaaugaaaaaaaaaguguuuuuuugagac

SEQ ID NO: 168193 - RNA, 64 nt, Homo Sapiens
gggauuacaggcgugagccaccgugcccggcccuaaaaugaaauuauuaauguugguucugaaa

SEQ ID NO: 168194 - RNA, 64 nt, Homo Sapiens
gauucagacucugacacagacaguagucaagaagaaaaugaagugacagaacauaccccuuuac

SEQ ID NO: 168195 - RNA, 64 nt, Homo Sapiens
gacgacaaugaagauacugacaguagugaugcagaaaaugaaauuaaugaacaugaugucgugg

SEQ ID NO: 168196 - RNA, 64 nt, Homo Sapiens
uuguuucuguuggaaacacugaagcagggacucuaaaaugaaagcaucucacauugguuuucuu

SEQ ID NO: 168197 - RNA, 64 nt, Homo Sapiens
ucgaaauugccugugugcacauauuuuuagaugaaaaaugaaacuaccuuacaauauuauuuuu

SEQ ID NO: 168198 - RNA, 64 nt, Homo Sapiens
aucugguuuuugcugaaugcuacaaagcaaggaaaaaaugaaauggucaaaggagugacgaaaa

SEQ ID NO: 168199 - RNA, 64 nt, Homo Sapiens
ugaacuggcauggcccgaucagucaacuccugucaaaaugaaggucacaaagauauucucacuu

SEQ ID NO: 168200 - RNA, 64 nt, Homo Sapiens
uuuaaauuacaacccuagaccuguguauguaaaaaaaaugaauaauuuugcuuuuacgucucaa

SEQ ID NO: 168201 - RNA, 64 nt, Homo Sapiens
ccuugugucguuguuaacccuccccuaaaaccaaaaaaugaaccuaacuuuugaugcuuucugu

SEQ ID NO: 168202 - RNA, 64 nt, Homo Sapiens
uaugagaaacuuuauaucaauuugcuguugaaauaaaaugaauuagagggauggagcuaaucuu

SEQ ID NO: 168203 - RNA, 64 nt, Homo Sapiens
ugcugccucaaucgacccaggguaaaccaugaagaaaaugaagcuuugguuccacaucugucug

SEQ ID NO: 168204 - RNA, 64 nt, Homo Sapiens
guuguuucucaguuguuuuuuguaagucagcauaaaaaugaaaaaaguuuuuaugugaggacuu

SEQ ID NO: 168205 - RNA, 64 nt, Homo Sapiens
gauuauauauuggaauuguuuacagauuuaauauaaaaugaacuuugaacugcucugcauuaau

SEQ ID NO: 168206 - RNA, 64 nt, Homo Sapiens
uuuucacugaaugagcauggcagugccacucaagaaaaugaaucuccaaaguaucuucaaagaa

SEQ ID NO: 168207 - RNA, 64 nt, Homo Sapiens
auauuuuuuuacauccuuugaagggagugcuucaaaaaugaaagcaucagaagauaaaauauuu

SEQ ID NO: 168208 - RNA, 64 nt, Homo Sapiens
caauuuuuaaaacuuuuuuuuaauuacuguaaagaaaaugaauuuuuuccugcagcaggaaaca

SEQ ID NO: 168209 - RNA, 64 nt, Homo Sapiens
gaaauguauugacugcugacuauauuuuaaaaacaaaaugaaauaauuugaguuguauuacaga

SEQ ID NO: 168210 - RNA, 64 nt, Homo Sapiens
cacucacagauuagugauacguuuuauuuuuaacaaaaugaaaugauguguuaaguuuuuauuu

SEQ ID NO: 168211 - RNA, 64 nt, Homo Sapiens
uguuguauuguccuacagugucauaaagaaccugaaaaugaacuuuuguuucuaaaguuggacc

SEQ ID NO: 168212 - RNA, 64 nt, Homo Sapiens
uuuugagaaauuauucagaagccuuguuauuuuaaaaaugaaauauuucaaagacugaauauuu

SEQ ID NO: 168213 - RNA, 64 nt, Homo Sapiens
aaugaaauauuucaaagacugaauauuuucaaagaaaaugaauaauucauugcccuugugauuu

SEQ ID NO: 168214 - RNA, 51 nt, Homo Sapiens
agagucagaaagcuaaauaaaaaaaugaaacuuuuuugaguaauaaaaaug

SEQ ID NO: 168215 - RNA, 64 nt, Homo Sapiens
gcuaaauaaaaaaaugaaacuuuuuugaguaauaaaaaugaaaagacgcuguauguaugacuuu

SEQ ID NO: 168216 - RNA, 64 nt, Homo Sapiens
uaaaauaaggaucguauuccgugagguauauacuaaaaugaaugcagaggucugugcuaccucu

SEQ ID NO: 168217 - RNA, 64 nt, Homo Sapiens
cuggcuuuuguucacuuugccuauggugggggacaaaaugaacagggucaggcucuuaauuuca

SEQ ID NO: 168218 - RNA, 64 nt, Homo Sapiens
ucacuucagaacacacacucaugucccugaacagaaaaugaagcgcaaaaacuuggauucacaa

SEQ ID NO: 168219 - RNA, 64 nt, Homo Sapiens
ccaaacagaagcaggcuccaauuugcaaagggagaaaaugaagguaacccuaagguaaaaaugc

SEQ ID NO: 168220 - RNA, 64 nt, Homo Sapiens
uucaaaauugaugaaaaacuugggauguuggaaaaaaaugaaacuucaugucuacagcuguuug

SEQ ID NO: 168221 - RNA, 64 nt, Homo Sapiens
ccgccauccgaccuuccaucuagcuacacuaaagaaaaugaacucuauuuaccugaagauugac

SEQ ID NO: 168222 - RNA, 64 nt, Homo Sapiens
uaacauuuuacuucugcgcuaucaagaauacagaaaaaugaaaauaugaauucuagaaacuaaa

SEQ ID NO: 168223 - RNA, 64 nt, Homo Sapiens
augaaaaaucuauaguagcagagaggaaaugcauaaaaugaaaguaacaggaaauuacaugguu

SEQ ID NO: 168224 - RNA, 64 nt, Homo Sapiens
acuauaucuagugguauuuccaagcucucuaaauaaaaugaaggcuacauaaaaucagaaacuu

SEQ ID NO: 168225 - RNA, 64 nt, Homo Sapiens
aaaagaaccaaaaugacuuuaggugacuuuaaggaaaaugaagaaaacagagaaauaccuuuag

SEQ ID NO: 168226 - RNA, 64 nt, Homo Sapiens
augaaaugcaguagcaaccauauaugaucuaacaaaaaugaaacuguaucauucuuuucuaaug

SEQ ID NO: 168227 - RNA, 64 nt, Homo Sapiens
uuuucauaaugcaauguaacaagagacagcuacaaaaaugaaggugugacauguugggcagauc

SEQ ID NO: 168228 - RNA, 64 nt, Homo Sapiens
uaaucaaucuaaauaauagacuuuuuuuacaggcaaaaugaaagaggaggaagucuggguuuua

SEQ ID NO: 168229 - RNA, 64 nt, Homo Sapiens
uacucaacaaagguuugugggacaaagggugaauaaaaugaaugaauuacaaugaacaaagaaa

SEQ ID NO: 168230 - RNA, 64 nt, Homo Sapiens
uguauauuaaacaccuuuaauaaauauuaugaaaaaaaugaaauauagaaaauuuagauggaca

SEQ ID NO: 168231 - RNA, 64 nt, Homo Sapiens
aagucaaaaaguguaaaauggaaaauaagagaucaaaaugaauauagcauaggaauaaagauuu

SEQ ID NO: 168232 - RNA, 64 nt, Homo Sapiens
auugagcagcuucuggaauauaaugugcauguccaaaaugaacucagcgcuucaaaaggacaaa

SEQ ID NO: 168233 - RNA, 64 nt, Homo Sapiens
uauagugugagugaaauuugauuaaagauguuggaaaaugaaguuggauuuuuguauucaugua

SEQ ID NO: 168234 - RNA, 64 nt, Homo Sapiens
gagacuuuuugaagggaaaauagagcaacagggaaaaaugaaagaaaugucuugguuacugagc

SEQ ID NO: 168235 - RNA, 64 nt, Homo Sapiens
gcucuauauguaaaugauggguuuguugguauuuaaaaugaauacaacuugaauguaauuaaag

SEQ ID NO: 168236 - RNA, 64 nt, Homo Sapiens
uuuuuggaagcgauaaacuuuaaauauacuuauuaaaaugaaauucuauuaaguuuuucagauc

SEQ ID NO: 168237 - RNA, 64 nt, Homo Sapiens
cuguuuuuauuucuagucucuuccacuuuaaaacaaaaugaacacugcuugucuucuuccauug

SEQ ID NO: 168238 - RNA, 64 nt, Homo Sapiens
uagagaucugauaacuugaauucagaauauuaagaaaaugaaguaacugauuuucuaaaaaaaa

SEQ ID NO: 168239 - RNA, 64 nt, Homo Sapiens
aaaagaaauauuucucuacuacuaugcucaugacaaaaugaaacaaagcauauugugagcaaua

SEQ ID NO: 168240 - RNA, 64 nt, Homo Sapiens
gccuuauaauugaaauaaaauuauaaucugccugaaaaugaauaaaaauaaaacauuuugaaau

SEQ ID NO: 168241 - RNA, 64 nt, Homo Sapiens
gaaguuucacaugagcuauuugcccuuaaggacaaaaaugaacuacucucugaagaugaucauu

SEQ ID NO: 168242 - RNA, 64 nt, Homo Sapiens
uucacaaaacacuucgagcauucuagcagugaugaaaaugaaucucaucuucuaggccaagcau

SEQ ID NO: 168243 - RNA, 64 nt, Homo Sapiens
guguagguaaccuauuuauaugggacaaaauuauaaaaugaaauaugaaacagaucuauaguuu

SEQ ID NO: 168244 - RNA, 64 nt, Homo Sapiens
agaucuauaguuuugggacaauugauaugucaugaaaaugaaacuuuauuaauguugggcaaaa

SEQ ID NO: 168245 - RNA, 64 nt, Homo Sapiens
gaacauuaauguacuuuuaugagacugauagcuaaaaaugaaugguaaaaucuaaugcguauag

SEQ ID NO: 168246 - RNA, 64 nt, Homo Sapiens
uaauugaccgauauuuucugaauauuuugcauuuaaaaugaauuuuuaacagugaaauuguguc

SEQ ID NO: 168247 - RNA, 64 nt, Homo Sapiens
uucagaaauucuuuuuuuccacuuucauucaugaaaaaugaaaaaaauuuucucucugauuuuu

SEQ ID NO: 168248 - RNA, 64 nt, Homo Sapiens
agcaucugauuuuaugacugaaaugacacagcugaaaaugaauauucuugaaaguaaugaguca

SEQ ID NO: 168249 - RNA, 64 nt, Homo Sapiens
gaauaaguuggaccaagggaagucggggacguaaaaaaugaagcaaaacaaugccagggugucu

SEQ ID NO: 168250 - RNA, 64 nt, Homo Sapiens
uuuuucauaauguaaugccguauuuauuguuuuuaaaaugaaaggaauacuaauaagucuuaaa

SEQ ID NO: 168251 - RNA, 64 nt, Homo Sapiens
cguggaauuguacuuguauaugauuaccuuaucuaaaaugaauaagaggugauggaccaguuua

SEQ ID NO: 168252 - RNA, 64 nt, Homo Sapiens
uuuuaaaaguucugaaauuugggguugguauugcaaaaugaauugaacggauggugcuuuaaug

SEQ ID NO: 168253 - RNA, 64 nt, Homo Sapiens
gcauuuugcuagacaguuaacaauauccaauuuuaaaaugaaauacagcauuugccaagucucc

SEQ ID NO: 168254 - RNA, 64 nt, Homo Sapiens
gugauaaguauacugggggcgugauucuuagcaaaaaaugaacagugauuuaggucaguagacu

SEQ ID NO: 168255 - RNA, 64 nt, Homo Sapiens
uaugcccaccagagcagacauuaguuucucuccuaaaaugaaugcaaaaugaaggguugugagu

SEQ ID NO: 168256 - RNA, 64 nt, Homo Sapiens
guugugaguuuaguuucucuaagauggaucccccaaaaugaagguggaaggccuuccugguuuu

SEQ ID NO: 168257 - RNA, 64 nt, Homo Sapiens
cacgcccgacucucuccaucuuuccagaacuaccaaaaugaagaagaaucuuuaaagaggagcc

SEQ ID NO: 168258 - RNA, 64 nt, Homo Sapiens
gcaguggguucuccaaacuaagguguuucucuguaaaaugaacuccaugaagaugccauugaca

SEQ ID NO: 168259 - RNA, 64 nt, Homo Sapiens
caaaagauugguccuuggugaaauaaacuuuucaaaaaugaauguucuuuucaaaaaauaaagu

SEQ ID NO: 168260 - RNA, 64 nt, Homo Sapiens
aaguagaaaaaugcacuuacuaagaacaugaaaaaaaaugaaguaggaaaauaagaugaagacu

SEQ ID NO: 168261 - RNA, 64 nt, Homo Sapiens
accaaaaagcaaaccaaaagcccccaugucuacaaaaaugaaaaccugggcaacauagcaacac

SEQ ID NO: 168262 - RNA, 64 nt, Homo Sapiens
aguccgcuauauugugauuuuucaggggccauggaaaaugaaaaaaagagaugacaaaacuaag

SEQ ID NO: 168263 - RNA, 64 nt, Homo Sapiens
gucaacuuuaagguauguuuagcuguaacccuuuaaaaugaaauuagcucagucccuaugaggu

SEQ ID NO: 168264 - RNA, 64 nt, Homo Sapiens
aaccuuucagcuauguuuguggacuacugcccuuaaaaugaaaaguuacauuaacuauuucaaa

SEQ ID NO: 168265 - RNA, 64 nt, Homo Sapiens
ugcaagccuucuaaaugaguacaucuuaaagcuaaaaaugaacccuuggauuaaaacgggaauc

SEQ ID NO: 168266 - RNA, 64 nt, Homo Sapiens
ugaagagcuauuuaaugacauugugacucuucuaaaaaugaagagacaaaaucaaauuguccua

SEQ ID NO: 168267 - RNA, 64 nt, Homo Sapiens
gaccuggccgggcgcgguggagcuguuguccuuaaaaaugaauuuuaagcaugaaacaaacagc

SEQ ID NO: 168268 - RNA, 64 nt, Homo Sapiens
aauacauaaauauuuuaagaugcaauuucauuguaaaaugaacauuaaagugcucauaaucacu

SEQ ID NO: 168269 - RNA, 64 nt, Homo Sapiens
uuuugcagcacugaaaaucuuaucucacaagucaaaaaugaagaaguauuguuuauagauaauu

SEQ ID NO: 168270 - RNA, 64 nt, Homo Sapiens
guaggcugaccucaacccuguaacguaacccauuaaaaugaauuucuuuuuuuuuaagacagag

SEQ ID NO: 168271 - RNA, 64 nt, Homo Sapiens
ugagauuacagacgugagccacugcguccugccuaaaaugaauuuucuagaugauugaauaaca

SEQ ID NO: 168272 - RNA, 64 nt, Homo Sapiens
gaaaaaagcauaugcauaaaggaauaauauugugaaaaugaaucuguuaugauaaagaaaaaau

SEQ ID NO: 168273 - RNA, 64 nt, Homo Sapiens
guuuaaaauauguauuaauguguaaaucacaaguaaaaugaauucuaauguacaaguuuguuuu

SEQ ID NO: 168274 - RNA, 64 nt, Homo Sapiens
uuuuaacauuaaaucguagguagggcaauguaguaaaaugaaagagaauuaagaaagguuuuga

SEQ ID NO: 168275 - RNA, 64 nt, Homo Sapiens
ucacugguagguaagcaugaguuaaggaaagucaaaaaugaaaauauauuuugcuguguauaaa

SEQ ID NO: 168276 - RNA, 64 nt, Homo Sapiens
uaaauauguaaauacaugcuuuaauuugcaauuuaaaaugaagggguuaaauaaguuagacauu

SEQ ID NO: 168277 - RNA, 64 nt, Homo Sapiens
uaguauuugagaugaguuguugggacaugcaaauaaaaugaagaaugaacuuucgugucuuuuu

SEQ ID NO: 168278 - RNA, 64 nt, Homo Sapiens
acagccauuugauuuauguuaugaauaacagccaaaaaugaauaauauuaacugguauucaaaa

SEQ ID NO: 168279 - RNA, 64 nt, Homo Sapiens
acagccaaaaaugaauaacauuaacugguauucaaaaaugaauacaacuuugaaagcaguaaua

SEQ ID NO: 168280 - RNA, 64 nt, Homo Sapiens
gcagugcuuaguuaaauaaaguaucauuuccuucaaaaugaaggggaaguuccgauuugaaauu

SEQ ID NO: 168281 - RNA, 64 nt, Homo Sapiens
acauucuagcccuggucuggcacuuugauuguuaaaaaugaaccgaucaccaaacagaucuugc

SEQ ID NO: 168282 - RNA, 64 nt, Homo Sapiens
gucaaaaugcuacaauaaaacaaaaaagagaaagaaaaugaagagcauuugacucccgcacuua

SEQ ID NO: 168283 - RNA, 64 nt, Homo Sapiens
gaaagaaaaugaagagcauuugacucccgcacuuaaaaugaaguacacauaaaguuuaaacugg

SEQ ID NO: 168284 - RNA, 64 nt, Homo Sapiens
uuauguagaccagaagcugcaauauacaaugaugaaaaugaaacgaaaaggaaguccccccauc

SEQ ID NO: 168285 - RNA, 64 nt, Homo Sapiens
guguugcauuaacuccauuuucuccagcagccauaaaaugaauggcguuucucuccauauuugc

SEQ ID NO: 168286 - RNA, 64 nt, Homo Sapiens
guaaaauuagcucuuucaaaucuucuugucauguaaaaugaagcuagucuguuuuaaaauuuuu

SEQ ID NO: 168287 - RNA, 64 nt, Homo Sapiens
aaaucuuauauaguacauuuuacaaaaauuauaaaaaaugaauuaguacuggcgaggacuaaau

SEQ ID NO: 168288 - RNA, 64 nt, Homo Sapiens
cacagauagccuaagacugcccaccgugugaagaaaaaugaaagggcugggcaguguagaccug

SEQ ID NO: 168289 - RNA, 64 nt, Homo Sapiens
gcagcugaaauuauguugaaguuuccucaacuagaaaaugaacacuugcuuucucucgucuuca

SEQ ID NO: 168290 - RNA, 64 nt, Homo Sapiens
uacuuuuuacuuuuuaugauuucaaaggaaaaauaaaaugaaaguguuugccacuaaaaacauu

SEQ ID NO: 168291 - RNA, 64 nt, Homo Sapiens
aaggaaaacaaguaguccugcuacuaugcuuauaaaaaugaaguuuaaguaaauugacauauaa

SEQ ID NO: 168292 - RNA, 64 nt, Homo Sapiens
ucacuuuugcagauauucuucgguuugaauaauuaaaaugaaccagauaucagggugguuaauu

SEQ ID NO: 168293 - RNA, 64 nt, Homo Sapiens
aauuaaaaugaaccagauaucagggugguuaauuaaaaugaaccagauaucagggugguuuaua

SEQ ID NO: 168294 - RNA, 64 nt, Homo Sapiens
uuuuugagaccucuuaagaaaaaauaaaaaguaaaaaaugaaaggaaucuuuuuuagaaauaga

SEQ ID NO: 168295 - RNA, 64 nt, Homo Sapiens
cugcuguauuaaugacaauuauucaugaaaauaaaaaaugaaauauuuuguauacuacuaccuu

SEQ ID NO: 168296 - RNA, 64 nt, Homo Sapiens
ucaauauuaaaauaguuuuauauuugggaaggcaaaaaugaaucuauuguuuugcaauauaggu

SEQ ID NO: 168297 - RNA, 64 nt, Homo Sapiens
gugaaaagcacuucguacauggugguggcaagagaaaaugaagaagaagcaaaaguggaaaccc

SEQ ID NO: 168298 - RNA, 64 nt, Homo Sapiens
gcguguuucugcuagaauuaaaaaguuaaauuuaaaaaugaaaaugaaagacagcuucccagga

SEQ ID NO: 168299 - RNA, 64 nt, Homo Sapiens
uucugcuagaauuaaaaaguuaaauuuaaaaaugaaaaugaaagacagcuucccaggaguuuug

SEQ ID NO: 168300 - RNA, 64 nt, Homo Sapiens
uauagggcaguuuggugcaaaauuaauucaguccaaaaugaaaucagcccccuacugagaaguu

SEQ ID NO: 168301 - RNA, 64 nt, Homo Sapiens
cuugaccaaaaaaccacauucauuauuacaaaacaaaaugaacacucuauuuggaucagaacua

SEQ ID NO: 168302 - RNA, 64 nt, Homo Sapiens
aaagugucccauuuuuaauaaauacaagauaccaaaaaugaaaaugaagaggauggaaaaacug

SEQ ID NO: 168303 - RNA, 64 nt, Homo Sapiens
aauaguuuaaaacaaguagcuaauuuggucaccaaaaaugaaauucuuuaauuauggucaaaua

SEQ ID NO: 168304 - RNA, 64 nt, Homo Sapiens
uauuuauuuuaaaaauugaaaaaguagacaucggaaaaugaaaaugugacacucugaagacaug

SEQ ID NO: 168305 - RNA, 64 nt, Homo Sapiens
auaaaauaaagcauauagcuuuuggaaacucuguaaaaugaacacuuacaugucacauaaaagc

SEQ ID NO: 168306 - RNA, 64 nt, Homo Sapiens
ggucaacaguaggacuggggcagaagcucugccuaaaaugaagugaaagcugcacuuaacccuu

SEQ ID NO: 168307 - RNA, 64 nt, Homo Sapiens
agcugcacuuaacccuuugugauaaugaugacacaaaaugaauauuaauggaggauauuccucg

SEQ ID NO: 168308 - RNA, 64 nt, Homo Sapiens
caucucauguuuuaucauuuggauggaguaauuuaaaaugaauuaaauuccagagaacaaugga

SEQ ID NO: 168309 - RNA, 64 nt, Homo Sapiens
cuagguuauagauaaacaauuagguauaauagcaaaaaugaaaauuggaagaaugcaaaaugga

SEQ ID NO: 168310 - RNA, 64 nt, Homo Sapiens
gauuuuuugcaaaguuagacaauggcacaaagucaaaaugaaaucaauguuuaguucacaagua

SEQ ID NO: 168311 - RNA, 64 nt, Homo Sapiens
uuuuuuuuaaauauggcuggaaagcuuguuuugaaaaaugaagcuuauauuaauuguugcuuca

SEQ ID NO: 168312 - RNA, 64 nt, Homo Sapiens
aaguaauuuaacaacagauuugcuaauuuaaaaaaaaaugaaaaaaaaaaucuuaccagcaguu

SEQ ID NO: 168313 - RNA, 64 nt, Homo Sapiens
cuuuauaaauuuuuuuaaagcuacaguuuaauacaaaaugaauugcgguuuuauuacauuaaua

SEQ ID NO: 168314 - RNA, 64 nt, Homo Sapiens
gucuaaaauggcuacugguauuuuaguuaauucaaaaaugaaacuuuucagugauucacuuuac

SEQ ID NO: 168315 - RNA, 64 nt, Homo Sapiens
auauaaaauagguguugccuauugcugugcuuauaaaaugaaaaaggaaauugaggacacuuuu

SEQ ID NO: 168316 - RNA, 64 nt, Homo Sapiens
guuuuguguauuggcuuugcuggaguaugauagcaaaaugaagacucuuuuacucagcucuggu

SEQ ID NO: 168317 - RNA, 64 nt, Homo Sapiens
cuaacugcucaacaggaaaugaaccuagaaacagaaaaugaaaagguugauugaaauaaaacuu

SEQ ID NO: 168318 - RNA, 64 nt, Homo Sapiens
accacauaguaugucccuuuaaauucuuacuuugaaaaugaaucguuuguuucucauuuucugc

SEQ ID NO: 168319 - RNA, 64 nt, Homo Sapiens
uuacaauguucucaccaaauaauauauaguuuacaaaaugaaaaguguuauuacuugaauauag

SEQ ID NO: 168320 - RNA, 64 nt, Homo Sapiens
ucuuuguuuucuucuuuuguuuucagcaagcagaaaaaugaaacagcuaaguuuacccaaguac

SEQ ID NO: 168321 - RNA, 64 nt, Homo Sapiens
ugaucaaaucugcuuuucaacuucaaaaccaagcaaaaugaaguaggaaaucuaagauaaauca

SEQ ID NO: 168322 - RNA, 64 nt, Homo Sapiens
ucugggaacuuuuuugggggaugaauuuaagcagaaaaugaauuaggaaugagaaacaauuuug

SEQ ID NO: 168323 - RNA, 64 nt, Homo Sapiens
auaacaagugggugaaugugaugaugcuuuucugaaaaugaaauggacaaaccgagugcaauga

SEQ ID NO: 168324 - RNA, 64 nt, Homo Sapiens
aacggcucauucauaguuacacaaaaaugaagcuaaaaugaaucuguguuucagugacugauaa

SEQ ID NO: 168325 - RNA, 64 nt, Homo Sapiens
uaaaaugaaucaacggcucagugacugauaaacaaaaaugaagcugguuuaguucuguguuuca

SEQ ID NO: 168326 - RNA, 64 nt, Homo Sapiens
agauaucacaccaaaagcucaggcaagaaaagcaaaaaugaacaagugggacuacauuaaaccc

SEQ ID NO: 168327 - RNA, 64 nt, Homo Sapiens
ccaaaacuccugcacaacaaaggaaacgaucaccaaaaugaaaagguggacuguagauugggag

SEQ ID NO: 168328 - RNA, 64 nt, Homo Sapiens
uagaucagcuuuacagauacaucgaucagaggcuaaaaugaaaccucagccuaaaacucauagg

SEQ ID NO: 168329 - RNA, 64 nt, Homo Sapiens
cuuuauuuccucaaagucaagcagcuuucucuggaaaaugaaugcuaauuagugugaaccaaaa

SEQ ID NO: 168330 - RNA, 64 nt, Homo Sapiens
aaaaaaaccaucaccuuuugcacccugguguuuuaaaaugaagauuguuugcaucccuccccca

SEQ ID NO: 168331 - RNA, 64 nt, Homo Sapiens
uauuucaucuuuggacuuuuagccuuaggaaaagaaaaugaaaccaggcagggggccuuuuaua

SEQ ID NO: 168332 - RNA, 64 nt, Homo Sapiens
gucaagacaaaggcaaaaccgaaaccaagauuuuaaaaugaaguuuuuugaaaacacaucagua

SEQ ID NO: 168333 - RNA, 64 nt, Homo Sapiens
uugagaaauauaagaugaaauagacagggauaguaaaaugaaaauuuagccauagggucuuuua

SEQ ID NO: 168334 - RNA, 64 nt, Homo Sapiens
gcaaucaucaaaugguguuuucuucaugccagagaaaaugaauuguguuacaagagugauuguu

SEQ ID NO: 168335 - RNA, 64 nt, Homo Sapiens
uauuuacuuuguagaauaugaaaauaagugauucaaaaugaaaauaauauaacauaaauuagaa

SEQ ID NO: 168336 - RNA, 64 nt, Homo Sapiens
uaugauauucuaaacaucugauauuuuguauccuaaaaugaaugauugccuaaaaugugaaagc

SEQ ID NO: 168337 - RNA, 64 nt, Homo Sapiens
ugaauauucuuucuaaaaaugugaaacccaugacaaaaugaaugaauauauuuagaagagccac

SEQ ID NO: 168338 - RNA, 64 nt, Homo Sapiens
ucagagagaauaauugcccuauguuuuuuuaaugaaaaugaaggcugaaagcauagauuuugaa

SEQ ID NO: 168339 - RNA, 64 nt, Homo Sapiens
caucgagagagauaaauggcaaguaugaauggucaaaaugaauaucuucuuagaaagaaagaaa

SEQ ID NO: 168340 - RNA, 64 nt, Homo Sapiens
gcuuccugccauuguggggcacuguuuuuagaaaaaaaugaaugaggccaccccacuugugucc

SEQ ID NO: 168341 - RNA, 64 nt, Homo Sapiens
caaaucaagugaauuaaauuuuuaacagaucaagaaaaugaagcgggggcuaugggaggauuau

SEQ ID NO: 168342 - RNA, 64 nt, Homo Sapiens
caaaauaaagacuguuucugcaaaaacguuuucaaaaaugaaggaccuagaauucuguuacugu

SEQ ID NO: 168343 - RNA, 64 nt, Homo Sapiens
ggcaugaagaaguauuugaacagaaggagaggagaaaaugaagauauauguuuaacuggagucc

SEQ ID NO: 168344 - RNA, 64 nt, Homo Sapiens
uaaauagcacuaaacguuuuuagagcagaguuuuaaaaugaaugugaucagaauuaaauuugua

SEQ ID NO: 168345 - RNA, 64 nt, Homo Sapiens
ugcaggcugacauuacauucguuuagccuuuauaaaaaugaaguacaauauuccauauaaauaa

SEQ ID NO: 168346 - RNA, 64 nt, Homo Sapiens
uauuuuuuucuccaaagaaccaauauacuugaaaaaaaugaaugcagagcaucuuuguauauug

SEQ ID NO: 168347 - RNA, 64 nt, Homo Sapiens
uaguucaugcuuucagauaaauaaauauauauauaaaaugaacauuuguuguugcuauguacau

SEQ ID NO: 168348 - RNA, 64 nt, Homo Sapiens
ccgugaagucacauuccacagcaguuagccccagaaaaugaaauaucugcuuuaguuucacauu

SEQ ID NO: 168349 - RNA, 64 nt, Homo Sapiens
auuuuuacuaauauauauuuaacacaagggauauaaaaugaaaguauuuauaauagguauauag

SEQ ID NO: 168350 - RNA, 64 nt, Homo Sapiens
uguauucuguauagcuuacucuaccugcagacagaaaaugaaagaaaaaaauggacuugccuag

SEQ ID NO: 168351 - RNA, 64 nt, Homo Sapiens
aagucuagucauucugcaacgugacauaucccccaaaaugaaguuaccuuccaaguuggacacg

SEQ ID NO: 168352 - RNA, 64 nt, Homo Sapiens
uugguuuccaauaaaaggaaccaggacuccuuagaaaaugaacugauucuagaacugggauaug

SEQ ID NO: 168353 - RNA, 64 nt, Homo Sapiens
uacaagaugagccuagaguaucuugugccacagaaaaaugaaguacugaaauuaaaaaaaaaaa

SEQ ID NO: 168354 - RNA, 64 nt, Homo Sapiens
aucaaauugaaucuuuuacuuaccucuugcaaaaaaaaugaaaaaugaaaaaacaaauucaaaa

SEQ ID NO: 168355 - RNA, 64 nt, Homo Sapiens
ugaaucuuuuacuuaccucuugcaaaaaaaaugaaaaaugaaaaaacaaauucaaaaccuauuc

SEQ ID NO: 168356 - RNA, 64 nt, Homo Sapiens
auagauuaguuuaaaugugaccauuaauguaaucaaaaugaaaugguuucauuccuucagagcu

SEQ ID NO: 168357 - RNA, 64 nt, Homo Sapiens
ccggauuucaaauaaccagaaaccaaaacuauucaaaaugaaaauucugccaugacauacacuu

SEQ ID NO: 168358 - RNA, 64 nt, Homo Sapiens
ugaggcugcaacaacaguaacagaauuucuucacaaaaugaaaauuaaaauggaaauaacaaag

SEQ ID NO: 168359 - RNA, 64 nt, Homo Sapiens
uauuuagaacggggcaggcacauaaaaguaauaaaaaaugaaauuacugccaauuaacuaucac

SEQ ID NO: 168360 - RNA, 64 nt, Homo Sapiens
cuaaaggaaugcuucagaaaaccuaaagugcuguaaaaugaaaucauucuacuuuguccuuucu

SEQ ID NO: 168361 - RNA, 64 nt, Homo Sapiens
gccauuuuauuaaaauagcuuaaaaguuuguaaaaaaaugaaucuuuguaauuacuuaauaugu

SEQ ID NO: 168362 - RNA, 64 nt, Homo Sapiens
ggaccgaugcagauuuuagagagugacgacauggaaaaugaauuuaaccacuuucuuauugggu

SEQ ID NO: 168363 - RNA, 64 nt, Homo Sapiens
acaaauguagcaucaagccagacucacagguagcaaaaugaauuacacaccuacuuuuacugac

SEQ ID NO: 168364 - RNA, 64 nt, Homo Sapiens
uuuuucuaugcauaguuaugcauuuauauucucaaaaaugaaaucauaauguacauugcuuugu

SEQ ID NO: 168365 - RNA, 64 nt, Homo Sapiens
agaaaaugacuuauuuccagaagauaccgcucuaaaaaugaaauuguuaggugaaaguguuuuu

SEQ ID NO: 168366 - RNA, 64 nt, Homo Sapiens
accagaaggccauuugguguaggauauuuaaaccaaaaugaaaauauuacuugaaugcauccag

SEQ ID NO: 168367 - RNA, 64 nt, Homo Sapiens
aagccuuuuuacuuguggguauugcagcauccccaaaaugaauaaauguuuauauaaauaccaa

SEQ ID NO: 168368 - RNA, 64 nt, Homo Sapiens
gauaauaguccuuuacaaacauacaguccauaagaaaaugaauuuggcauauagaauuauuaca

SEQ ID NO: 168369 - RNA, 64 nt, Homo Sapiens
uuuagggcuagcccugccuccaucucccuuggguaaaaugaagggugugggguaaaagaugcau

SEQ ID NO: 168370 - RNA, 64 nt, Homo Sapiens
ccauaacugugcauagaaaaauaauuaucuguaaaaaaugaaggggauaauauaugauaaauua

SEQ ID NO: 168371 - RNA, 64 nt, Homo Sapiens
agccuuaggcuuuacaggguuguaucauugacuuaaaaugaagaauuaacuuguguuacaucua

SEQ ID NO: 168372 - RNA, 64 nt, Homo Sapiens
aaugacaugguuaaucuggaaaaaauccauggugaaaaugaaacuuucaaaggaguuugugaaa

SEQ ID NO: 168373 - RNA, 64 nt, Homo Sapiens
cuaucaugugcaaucuuuuauuccccuuacagacaaaaugaagaggguuuuuuuguuguuguug

SEQ ID NO: 168374 - RNA, 64 nt, Homo Sapiens
agcauucacugcgucauuguaacaugaagggauaaaaaugaaggagaaggaggguuugggaugg

SEQ ID NO: 168375 - RNA, 64 nt, Homo Sapiens
cugagcugcccuugcguucaguuggaagccacgcaaaaugaacugaaccaggagugagcuucgu

SEQ ID NO: 168376 - RNA, 64 nt, Homo Sapiens
accaggagugagcuucguguacauuaucuauuagaaaaugaaguaccuucugguucagcuaguc

SEQ ID NO: 168377 - RNA, 64 nt, Homo Sapiens
uuacaggugacggacgccucaagagagagaagagaaaaugaaagcagcugguuuugcagaagug

SEQ ID NO: 168378 - RNA, 64 nt, Homo Sapiens
cccuggggucuuaccucacugggaauguguuuugaaaaugaauuugaagacaagccaacaaacc

SEQ ID NO: 168379 - RNA, 64 nt, Homo Sapiens
uccucaagcuucucagacuucucuuauucuuuacaaaaugaaugcauuggcccugacaaaaagg

SEQ ID NO: 168380 - RNA, 64 nt, Homo Sapiens
agccuuacuauucauagaagggcuagaauaggagaaaaugaaagguagugaguaauucuuugau

SEQ ID NO: 168381 - RNA, 64 nt, Homo Sapiens
ucguuuucucuuaggaaaaucaugcagugaguggaaaaugaaguuuagugauguggaguuccua

SEQ ID NO: 168382 - RNA, 64 nt, Homo Sapiens
aaagugagugcucgucacugcuuaaagauaauuaaaaaugaaacggauaaucgguacaguuauu

SEQ ID NO: 168383 - RNA, 64 nt, Homo Sapiens
caucuguguaagugaagggauaacuagcacuggaaaaaugaaaucagaagcaucacuucuugga

SEQ ID NO: 168384 - RNA, 64 nt, Homo Sapiens
caaaaaauaaaauauuuguuacucuaaagguuauaaaaugaaaaugcccuaguugaauuaagaa

SEQ ID NO: 168385 - RNA, 64 nt, Homo Sapiens
cuuucaauugagauuaaguccucugugguaagaaaaaaugaacugcacuuuucuaacuaaugag

SEQ ID NO: 168386 - RNA, 64 nt, Homo Sapiens
guauuucaauaagcaguguagguagucuguuucuaaaaugaaauguuuuuguauagacuucuuu

SEQ ID NO: 168387 - RNA, 64 nt, Homo Sapiens
uucuacccugcaaaauaauccagaucugcuuucuaaaaugaaucaguuucuaaagugaaacaug

SEQ ID NO: 168388 - RNA, 64 nt, Homo Sapiens
auaaacuaccucacuugccuuucuugggaaaaaaaaaaugaauggacuuuaacaauuguuguua

SEQ ID NO: 168389 - RNA, 64 nt, Homo Sapiens
caauguauuauuuuuguagauagaagcuuuggagaaaaugaaugaagaucacguucagaagaau

SEQ ID NO: 168390 - RNA, 64 nt, Homo Sapiens
acauaagucauguaauuuuuguugauauaucaugaaaaugaacagaauucuuuuuccauacuua

SEQ ID NO: 168391 - RNA, 64 nt, Homo Sapiens
augacacuugcuguuuuucucauuuuuagcagcaaaaaugaaguuccaauucuuuccuaaagaa

SEQ ID NO: 168392 - RNA, 64 nt, Homo Sapiens
aacaugagacuguaagaaacuucacugcuuuguaaaaaugaacaauaaaaacagguuccaaaua

SEQ ID NO: 168393 - RNA, 64 nt, Homo Sapiens
agaaaaugaguuacacugagaagaagaguuacagaaaaugaaaaaguauguggaguaauaggga

SEQ ID NO: 168394 - RNA, 64 nt, Homo Sapiens
aaauucaugugaauguaggucccucuguaauuucaaaaugaaugcccauaucucucaugauugu

SEQ ID NO: 168395 - RNA, 64 nt, Homo Sapiens
gguauaaaaagagaauauggaaaaugaaaaaauaaaaaugaacaugucucugauaaaaagaaaa

SEQ ID NO: 168396 - RNA, 64 nt, Homo Sapiens
aauaaaaaugaacagguauaugauaaaaagaaaaaaaaugaaaaaacaaagaggccccugucuc

SEQ ID NO: 168397 - RNA, 64 nt, Homo Sapiens
ggcugggagugguggcucagacauuagggauacaaaaaugaacagguagacauuucaaacuguc

SEQ ID NO: 168398 - RNA, 64 nt, Homo Sapiens
ugaaacuuaaaguggcggugaauccagaaggcuaaaaaugaagcuuaaaaaaguaauuuccuua

SEQ ID NO: 168399 - RNA, 64 nt, Homo Sapiens
ggcucuugcagcuagaguugggagcuuuuaggggaaaaugaagugacacggcuccugccuucau

SEQ ID NO: 168400 - RNA, 64 nt, Homo Sapiens
aggaaaacgagccuaagaggcuccuccaaaucuuaaaaugaagcgccucuccuuccuacaaaga

SEQ ID NO: 168401 - RNA, 64 nt, Homo Sapiens
acacuuuuuuguuuuuaaaaaaauaaaauacauuaaaaugaauauauuuuagauauauugguuc

SEQ ID NO: 168402 - RNA, 64 nt, Homo Sapiens
auuuuaaaaaaaauuucuggauuauagccaguuuaaaaugaauuaagaucaaauuauccaugaa

SEQ ID NO: 168403 - RNA, 64 nt, Homo Sapiens
aaauacuuguuguaaaaauggcaaauaugugagcaaaaugaaacaaugaaaaccuaggaaagua

SEQ ID NO: 168404 - RNA, 64 nt, Homo Sapiens
ccuaggaaaguagcaaauauuuugagauccaaaaaaaaugaaaaaagugaucccagauuagauu

SEQ ID NO: 168405 - RNA, 64 nt, Homo Sapiens
gucugcuuaacuccaauuucagggucaugaucaaaaaaugaaaagucaaauauauuucucuuuc

SEQ ID NO: 168406 - RNA, 64 nt, Homo Sapiens
agaauacagcauggaaaauaaaccagcauuuuaaaaaaugaaauaaaccaguuuaaugggauac

SEQ ID NO: 168407 - RNA, 64 nt, Homo Sapiens
guguagcccuaccaaaaauagccaguaguaucugaaaaugaaaaauaaaugaaguaucucuagg

SEQ ID NO: 168408 - RNA, 64 nt, Homo Sapiens
uaugcaaagcagcuuauauuccuuuguuucugauaaaaugaagacuuuaaaucagucaguagua

SEQ ID NO: 168409 - RNA, 64 nt, Homo Sapiens
uuuucuucucuaaaacauuaguuuaauuuucuucaaaaugaaaauacugcuuuguaauuacaaa

SEQ ID NO: 168410 - RNA, 64 nt, Homo Sapiens
auuaaaaugauugacauaaacucuuugugccuugaaaaugaaacaaauuauaaaaauguuuaaa

SEQ ID NO: 168411 - RNA, 64 nt, Homo Sapiens
uucaaauuuucuuuagugcuuaaaauuaaguuuuaaaaugaaaucagacacugcagguuuguau

SEQ ID NO: 168412 - RNA, 64 nt, Homo Sapiens
uuaaaaugaaaucagacacugcagguuuguauauaaaaugaaaagcuauacuacuuuuuacaaa

SEQ ID NO: 168413 - RNA, 64 nt, Homo Sapiens
cuuuaaucagcauuguaaaguuauaaugaagauuaaaaugaagguagggauuaauguccuccau

SEQ ID NO: 168414 - RNA, 64 nt, Homo Sapiens
gccaguccauuacacugaauauaugguuuuauuuaaaaugaaauucucacauagagacaugcuu

SEQ ID NO: 168415 - RNA, 64 nt, Homo Sapiens
gugauaauauaaucucuauuuuuuuaggaaaacaaaaaugaaaaacuacuccauuugaggauug

SEQ ID NO: 168416 - RNA, 64 nt, Homo Sapiens
uaggcuguaauauguguacauuguguuuaagagaaaaaugaaacccacaugccgccauuuuccu

SEQ ID NO: 168417 - RNA, 64 nt, Homo Sapiens
gagaucugcccuguguuauccaguuaugagauaaaaaaugaauauaagagugcuugucauuaua

SEQ ID NO: 168418 - RNA, 64 nt, Homo Sapiens
cuacggggaauucuuaaaacugugcucaacuauuaaaaugaaugagcuuucuuugugucugugu

SEQ ID NO: 168419 - RNA, 64 nt, Homo Sapiens
uucuccuagaaucucaaguggaauuggaaucauaaaaaugaaugagauuugaaaacuuucacaa

SEQ ID NO: 168420 - RNA, 64 nt, Homo Sapiens
uaaauguaguuaguuugauacuccuuagaauaaaaaaaugaaacaguaacaacuuuuauguaaa

SEQ ID NO: 168421 - RNA, 64 nt, Homo Sapiens
auuauguaaaaagaauauaauaccuguggaaauaaaaaugaauuccaaguguauacuugcucgg

SEQ ID NO: 168422 - RNA, 64 nt, Homo Sapiens
aaaaaacaaaaauaaaaagcaaaacaaaaaucccaaaaugaauuccauucacaaacagaauuuu

SEQ ID NO: 168423 - RNA, 64 nt, Homo Sapiens
accaauguaaagaucuaauuaacaccuuuuuuucaaaaugaaauguguaucucacauuaaacaa

SEQ ID NO: 168424 - RNA, 64 nt, Homo Sapiens
auaaaaccuuuuauuuucuuaacauaaagcaacuaaaaugaaaccaggggugagaauaaguaua

SEQ ID NO: 168425 - RNA, 64 nt, Homo Sapiens
ccaccucagccuggacuuugcaaguuccucaucuucaucugaggaccuuuacuccaguucccaa

SEQ ID NO: 168426 - RNA, 64 nt, Homo Sapiens
caaggcaagucccuuccacccacaguccaaagucucaucugagaucagcauuaacgcaaaaauc

SEQ ID NO: 168427 - RNA, 64 nt, Homo Sapiens
gggagggagauggaugcucaacaugcugaagaaaucaucugaggaaccauuccucacugcucua

SEQ ID NO: 168428 - RNA, 64 nt, Homo Sapiens
agacuuaaguucuuccagcuauucauucacaugcucaucugagauuuuuuguuuaccucccucc

SEQ ID NO: 168429 - RNA, 64 nt, Homo Sapiens
gguagcacaguuuaucacauagaaacuccauuaaucaucugauuuuccgaaucugaaaauugag

SEQ ID NO: 168430 - RNA, 64 nt, Homo Sapiens
agucuuucacagauuuguauuaugcugaagaguuucaucugacaaucugcuucaagaaaucuca

SEQ ID NO: 168431 - RNA, 64 nt, Homo Sapiens
ugcuuaaugguauugcuguugcuccuaauacuucucaucugagcugauuuauuuuucucuguua

SEQ ID NO: 168432 - RNA, 64 nt, Homo Sapiens
accauacuguuagucacacacgcccacaugacaaucaucugaaaguccccaacuauacacauuc

SEQ ID NO: 168433 - RNA, 64 nt, Homo Sapiens
ucagcauuaacccaaaaguccgcaguccaaaguuucaucugagacaaggcaagucccuuccacu

SEQ ID NO: 168434 - RNA, 64 nt, Homo Sapiens
cccacucauucacucuuucagaacaaaaagacagucaucugauaagaguaugacauggaugaaa

SEQ ID NO: 168435 - RNA, 64 nt, Homo Sapiens
gacauugauucagccuguuuggcguuucccagagucaucugauuggacaggcaugggugcaagg

SEQ ID NO: 168436 - RNA, 64 nt, Homo Sapiens
ucuucucuucccugcgccugugaugcugggcacuucaucugaucgggggcguagcaucauagua

SEQ ID NO: 168437 - RNA, 64 nt, Homo Sapiens
ucuggugucagaguucucuggcauuuccuuggccucaucugagaccucucuguaugugccccgc

SEQ ID NO: 168438 - RNA, 64 nt, Homo Sapiens
uaguuucuccuccaucaccuguaucguaucgcagucaucugagugacuucuuauaaggaaagau

SEQ ID NO: 168439 - RNA, 64 nt, Homo Sapiens
agcgccgccuuuccauggagacucguaagcagcuucaucugacacgggcaucccuggcuugcuu

SEQ ID NO: 168440 - RNA, 64 nt, Homo Sapiens
gucaccgauggcugacugaugaaauggacacgucucaucugacccacucuuccuuccacugaag

SEQ ID NO: 168441 - RNA, 64 nt, Homo Sapiens
ggugagcugaagucuguccucaaccccaaaaccuucaucugauucaucguugucugaaaaaacc

SEQ ID NO: 168442 - RNA, 64 nt, Homo Sapiens
aucauuuuaugguucucaauuuuucucuagacauucaucugaaacagcucuauuuuuguuuuca

SEQ ID NO: 168443 - RNA, 64 nt, Homo Sapiens
cacagaaugucagagcuggaagggacuauagagaucaucugaucugauccucuuguacggauga

SEQ ID NO: 168444 - RNA, 64 nt, Homo Sapiens
aucgauggauguauugauaaauagauagaaccagucaucugaagcaacuuaagaauuguagccu

SEQ ID NO: 168445 - RNA, 64 nt, Homo Sapiens
gaucgucagaggagggugagaagaagacccagacucaucugaagugaaggaucuuugauggagg

SEQ ID NO: 168446 - RNA, 64 nt, Homo Sapiens
gaucuuugauggaggaagaaaugaagaccuagacucaucugaagugaaggaucuucacaagagg

SEQ ID NO: 168447 - RNA, 62 nt, Homo Sapiens
uuuguaaagaaaguggcuugaaaucuuuuuuguucaaagauuaaugccaacucuuaagauua

SEQ ID NO: 168448 - RNA, 62 nt, Homo Sapiens
ccucuacugagucccuuagccaagcaguuucuuucaaagaagccagcaggcgaaaagcaggg

SEQ ID NO: 168449 - RNA, 62 nt, Homo Sapiens
uauuuuuauuaacuuuuuucaguuucuuuuuauucaaagaaacaaaauucaaucucugauaa

SEQ ID NO: 168450 - RNA, 62 nt, Homo Sapiens
uccaagugacucuauugauguauguauguucauucaaagaaugggaaaaggauaugacauau

SEQ ID NO: 168451 - RNA, 62 nt, Homo Sapiens
aucaaccucugugguggucacaaccuugagaguucaaagaaacauucuccuucacugguugg

SEQ ID NO: 168452 - RNA, 62 nt, Homo Sapiens
ggauccucuuucaaaggcuagcauucugucaauucaaagaaguuggcagugcuuuuucuuua

SEQ ID NO: 168453 - RNA, 62 nt, Homo Sapiens
gagauacaauuuuuuaguuugauggagauauguucaaagaauccaaccaacugaaaaccuga

SEQ ID NO: 168454 - RNA, 62 nt, Homo Sapiens
guugucuuguucuugugguguuuuauguugcauucaaagacuguuugcugugcuuuucugaa

SEQ ID NO: 168455 - RNA, 62 nt, Homo Sapiens
ggcuuucucuugaucuuugugucauuucagaauucaaagacugugcuacgggaguucugaac

SEQ ID NO: 168456 - RNA, 62 nt, Homo Sapiens
gauauguugaaggguauuuguuaauuuuacuuuucaaagauacuuuaaaacaguagagcuag

SEQ ID NO: 168457 - RNA, 62 nt, Homo Sapiens
gaauauuugaagcauguuuugcauggugucuuuucaaagauacagaggaaagcuuauuuucu

SEQ ID NO: 168458 - RNA, 62 nt, Homo Sapiens
ucagcagcaaaccaaaacaguacauaauucucuucaaagacugggcaaagagcuacuuugaa

SEQ ID NO: 168459 - RNA, 62 nt, Homo Sapiens
agugagucuaauguagugaacagcugucacacuucaaagagcgucucucauagaguauaaag

SEQ ID NO: 168460 - RNA, 62 nt, Homo Sapiens
gagagccaugagacuuucccuacaauugcaacuucaaagacaggaagaagaggaccucaaau

SEQ ID NO: 168461 - RNA, 62 nt, Homo Sapiens
ucagaagccuuguuauuuuaaaaaugaaauauuucaaagacugaauauuuucaaagaaaaug

SEQ ID NO: 168462 - RNA, 62 nt, Homo Sapiens
uuaaaaaugaaauauuucaaagacugaauauuuucaaagaaaaugaauaauucauugcccuu

SEQ ID NO: 168463 - RNA, 62 nt, Homo Sapiens
gaaacuuaagaugugcaaggagauuuaaugauuucaaagaaaauaaugguucuuuguuuuua

SEQ ID NO: 168464 - RNA, 62 nt, Homo Sapiens
auuuggaaaaaugaaauuuaguaguuccaaguuucaaagaaaugucaacauuuuauuccauu

SEQ ID NO: 168465 - RNA, 62 nt, Homo Sapiens
uugugcugggacaggggauuacaccaucucuguucaaagagggggaaaugugccuaugccuu

SEQ ID NO: 168466 - RNA, 62 nt, Homo Sapiens
gacaagccaaauggcuggcagaugauguggauuucaaagagcccagaaugaacucaucacug

SEQ ID NO: 168467 - RNA, 62 nt, Homo Sapiens
guuuaaguaaaaagugauacuccaccuuguguuucaaagaauuuaguuccaccucuucauac

SEQ ID NO: 168468 - RNA, 62 nt, Homo Sapiens
auacaucuuagauuccuuauaucuaauaagaguucaaagaguuaugaguugaagucuugaau

SEQ ID NO: 168469 - RNA, 53 nt, Homo Sapiens
uauggaagauuaagucaugacaauucaaagaaaagaagauguagccucuuuuc

SEQ ID NO: 168470 - RNA, 62 nt, Homo Sapiens
uuguaaaauaucacauaauauagaaauggcaguucaaagagaauuguggcagauguugugug

SEQ ID NO: 168471 - RNA, 62 nt, Homo Sapiens
aauuccaauuucuauuuacuucuuucaaugcuuucaaagauagucauugugcauguuaaauu

SEQ ID NO: 168472 - RNA, 62 nt, Homo Sapiens
aacacuuuuguuaagaccccuucuaagcacguuucaaagaugguugcaaaucagaacuaaaa

SEQ ID NO: 168473 - RNA, 62 nt, Homo Sapiens
aauuuguccauguaaagcuuaaaaaucauuuuuucaaagaaauuuauuaaugggccaaugca

SEQ ID NO: 168474 - RNA, 62 nt, Homo Sapiens
uuagagcauuuguuucaucuuauaacuugaccuucaaagagagcuucaucauaagaauaauu

SEQ ID NO: 168475 - RNA, 62 nt, Homo Sapiens
uugagggaaauaugucccuagcaggaaaagaauucaaagagguucaaagaauaugucacuua

SEQ ID NO: 168476 - RNA, 62 nt, Homo Sapiens
uaugucccuagcaggaaaagaauucaaagagguucaaagaauaugucacuuacuccuacuug

SEQ ID NO: 168477 - RNA, 62 nt, Homo Sapiens
uugaaaagauugaagagggcauugguuauaaauucaaagagcuucuuucuuaacuuaaaggc

SEQ ID NO: 168478 - RNA, 62 nt, Homo Sapiens
aaacauaaaaagugggaagguugguguaagccuucaaagaaaguuaaauauuucaguguugu

SEQ ID NO: 168479 - RNA, 62 nt, Homo Sapiens
cagacacaccuggguuuggagguuauguaauguucaaagauucccaacccuguggugaucag

SEQ ID NO: 168480 - RNA, 62 nt, Homo Sapiens
aaacuagaacuuuaaaaguuacuuuguuuugauucaaagaccggcuuuuauaaacaucuuuu

SEQ ID NO: 168481 - RNA, 62 nt, Homo Sapiens
ggggagaaccacgagagaagcauuaagugacuuucaaagacuuucagaguacagccacuugg

SEQ ID NO: 168482 - RNA, 62 nt, Homo Sapiens
aaugacguuuguggcucuuucccaaguuggccuucaaagagccugccugcuguugagccaga

SEQ ID NO: 168483 - RNA, 62 nt, Homo Sapiens
aaguggagaggaccuaacauaaugaugucaguuucaaagagauguaauuuuacauuucauga

SEQ ID NO: 168484 - RNA, 62 nt, Homo Sapiens
auuucuucuuuuagcuuuggaauuccaugggcuucaaagaacaagacuccaccugugcuugg

SEQ ID NO: 168485 - RNA, 62 nt, Homo Sapiens
gacuagaagaaaaaggagacaauaccauguuguucaaagaaacauugaaggaaauugggaug

SEQ ID NO: 168486 - RNA, 62 nt, Homo Sapiens
gcagaggggauucaaaugugugagaggcuagauucaaagacccucaguguucuauguuaucu

SEQ ID NO: 168487 - RNA, 62 nt, Homo Sapiens
uuagcaagcuucauuaaagaaaaacagaauauuucaaagaaaaauauugaaugcuuucuaac

SEQ ID NO: 168488 - RNA, 62 nt, Homo Sapiens
cuuuugccaguuacaugcauguauuuuuucuauucaaagaugaccauuuucauuugugcagu

SEQ ID NO: 168489 - RNA, 62 nt, Homo Sapiens
ccaccuugggaccuguuuagagaagccggcucuucaaagacaauggaaacuguaccauacac

SEQ ID NO: 168490 - RNA, 62 nt, Homo Sapiens
uuuagaaauaauugaaaggaaauguuugaguuuucaaagaucccgugaaauugaugccagug

SEQ ID NO: 168491 - RNA, 62 nt, Homo Sapiens
aaggaaaaaagauuauuguacauauucuuguauucaaagaaauccacugaaaacauuuuugu

SEQ ID NO: 168492 - RNA, 62 nt, Homo Sapiens
ucugcauguugggcgaaaacacccccauuuguuucaaagagggacagauuuaaagugccccc

SEQ ID NO: 168493 - RNA, 62 nt, Homo Sapiens
gugaacagcuugcugucacuucugagucuauguucaaagacuauagauuagguuugcggggg

SEQ ID NO: 168494 - RNA, 62 nt, Homo Sapiens
auagauuagguuugcgggggauuuccacuauuuucaaagaaaauuuucaaggccuucaguuu

SEQ ID NO: 168495 - RNA, 62 nt, Homo Sapiens
ugaaaggacucacacuagggauuucauuggauuucaaagacaaugugggaaagccuuuguuu

SEQ ID NO: 168496 - RNA, 62 nt, Homo Sapiens
ugaaaccacucacagugcagcuuccacuucccuucaaagacgaugugggaaagccuucagug

SEQ ID NO: 168497 - RNA, 62 nt, Homo Sapiens
cauggcagugcagcauggagcuuugggaaaccuucaaagacaauguaggaaguccuucaauu

SEQ ID NO: 168498 - RNA, 62 nt, Homo Sapiens
uaacauuaugagccuuuucugcucaaaaaauuuucaaagauuaaaacuauuauacauauaca

SEQ ID NO: 168499 - RNA, 62 nt, Homo Sapiens
agucuuuuuugcaaucuugaacuuucauuagcuucaaagagaagcuguauuuacaggagaaa

SEQ ID NO: 168500 - RNA, 62 nt, Homo Sapiens
uaaacuuaaauauccaaagaugccuuuugaauuucaaagauuaaaacacagcuagaguagua

SEQ ID NO: 168501 - RNA, 62 nt, Homo Sapiens
gauuugguguggauugcaauuggaggaauguuuucaaagauuuacuguauguaugaaccgaa

SEQ ID NO: 168502 - RNA, 62 nt, Homo Sapiens
ggucuagugagcuaaguuucguguugaggcuuuucaaagaagacauauuacauggguguagu

SEQ ID NO: 168503 - RNA, 62 nt, Homo Sapiens
acauaugauucuuuccaagagcuaccaacccauucaaagagggaaagccaguuaccucagug

SEQ ID NO: 168504 - RNA, 62 nt, Homo Sapiens
acauaugacucuuuccaagagcaguuaccucauucaaagaagauuucacaagcaauggaaaa

SEQ ID NO: 168505 - RNA, 62 nt, Homo Sapiens
cagguucuggugacauuauugccguuuugauuuucaaagaagucauuuugauuuucaaagaa

SEQ ID NO: 168506 - RNA, 62 nt, Homo Sapiens
ccguuuugauuuucaaagaagucauuuugauuuucaaagaaguuuuucagaccauacaagaa

SEQ ID NO: 168507 - RNA, 64 nt, Homo Sapiens
cacugggagcguuucugauucccggccacacuuugcauuucaacacucagcccggaaagaugcu

SEQ ID NO: 168508 - RNA, 64 nt, Homo Sapiens
gugcagaggugccagcugccauuugccaaacucugcauuucauuucaucuaaggcuuaaccccu

SEQ ID NO: 168509 - RNA, 64 nt, Homo Sapiens
cuuuuauguauccaucccauuuccacuuuguuuagcauuucaagucucauuugaaaggagaaaa

SEQ ID NO: 168510 - RNA, 64 nt, Homo Sapiens
uuuaaccuccggcuggaaaucugucuucauauuugcauuucaugggaaagagaaccaccccacu

SEQ ID NO: 168511 - RNA, 64 nt, Homo Sapiens
guguaagauauauguacuaaggguauaagauguagcauuucaauucucuacacauggcauuuca

SEQ ID NO: 168512 - RNA, 64 nt, Homo Sapiens
guauaagauguagcauuucagcucucuacacauggcauuucagggccuaaauuuacucugcuug

SEQ ID NO: 168513 - RNA, 64 nt, Homo Sapiens
ugagugaggcaucuuuuuuaaaauaaauauuucugcauuucaggaaaaacaaugaaggaaacca

SEQ ID NO: 168514 - RNA, 64 nt, Homo Sapiens
aaagaguuaccuggaucagcuauagugaagacaagcauuucaaguaaaaaucugccuuagauuc

SEQ ID NO: 168515 - RNA, 64 nt, Homo Sapiens
auguaccuugggaagucagggcauggaggcaacagcauuucaagauucacccucaccucucccu

SEQ ID NO: 168516 - RNA, 64 nt, Homo Sapiens
ccaccagagugucccauugcgauacauuucaagugcauuucaagggcuucagagucgaaguuug

SEQ ID NO: 168517 - RNA, 64 nt, Homo Sapiens
uucuuuccaaaacuuauuaccucuccuccagguugcauuucaguggaaaauguggcuuguccaa

SEQ ID NO: 168518 - RNA, 64 nt, Homo Sapiens
cagaugacaccuccccaaagcuucccuagccccagcauuucaccucaccaaggaauucgggcuc

SEQ ID NO: 168519 - RNA, 64 nt, Homo Sapiens
augguuccucaggauccuuuaaccuccaaaaccagcauuucagaugucaucaaauaugaggaga

SEQ ID NO: 168520 - RNA, 64 nt, Homo Sapiens
agcccccugcucuuggacugauacuuuaauuugugcauuucauauuuaauuauuuuaauucuua

SEQ ID NO: 168521 - RNA, 64 nt, Homo Sapiens
aaugaugaaggaagugaaaguuuuugaaaaacaagcauuucaaagaugcaaagaagaauuuggc

SEQ ID NO: 168522 - RNA, 64 nt, Homo Sapiens
gguuuaugaagcucgaguuucuccauagggguaggcauuucacuucccaugaccagcuccccau

SEQ ID NO: 168523 - RNA, 64 nt, Homo Sapiens
uaggcugccccgccacagagccccauaaaggugugcauuucagugugagguguccguccacuuc

SEQ ID NO: 168524 - RNA, 64 nt, Homo Sapiens
auauuagccaguaccagcuuuaaagcacagauuugcauuucagagucauugagcaguauauaua

SEQ ID NO: 168525 - RNA, 64 nt, Homo Sapiens
uucucccugauuccucaucccagcugacucucgugcauuucaacaugauuucaaaauucuccaa

SEQ ID NO: 168526 - RNA, 64 nt, Homo Sapiens
uuaauucucagaagugaaaaugcuggcauuugcugcauuucaaguuuugaaauauucacaaggu

SEQ ID NO: 168527 - RNA, 64 nt, Homo Sapiens
ugugagcuuucugauacuuaaaaauguucugacagcauuucagcgcuacaaaaugugugcuugg

SEQ ID NO: 168528 - RNA, 64 nt, Homo Sapiens
uuugcaaaguaccuguguacaaaggaggccuugugcauuucaaguguaaguaucaaacuauaua

SEQ ID NO: 168529 - RNA, 64 nt, Homo Sapiens
caacaaaagcaggguauaagcucaugagauaacugcauuucaccaaaaaaaaaaugaaaaaaca

SEQ ID NO: 168530 - RNA, 64 nt, Homo Sapiens
ugcagaagcagcuucugaggggcuucccaggccugcauuucacagauggggagcucagcccucg

SEQ ID NO: 168531 - RNA, 64 nt, Homo Sapiens
ggcggccuuggaucagaggcucaccacaagccuggcauuucagccagggcuggagaaggcaggg

SEQ ID NO: 168532 - RNA, 64 nt, Homo Sapiens
auauguaaaaaaaaaaaaaacaaagacuagugcagcauuucagcgaaaccugguuuuaugaaac

SEQ ID NO: 168533 - RNA, 64 nt, Homo Sapiens
cacuguagauggucacucccgaugacuucuuguggcauuucacacauaacucuccucccuuguu

SEQ ID NO: 168534 - RNA, 64 nt, Homo Sapiens
uucccucacccccagaaacaccaguggucagguuuccccugaccuguaccugccucacuccugu

SEQ ID NO: 168535 - RNA, 64 nt, Homo Sapiens
aagguccauuucuucccaggcagaggucaaggcuuccccugagucucacaggcucagacuaaau

SEQ ID NO: 168536 - RNA, 64 nt, Homo Sapiens
uuugcuauaacuaagcaaccagucagaggaugcuuccccugaggcugguuguugugcugaggcc

SEQ ID NO: 168537 - RNA, 64 nt, Homo Sapiens
cugagcugagcccaguauccgccacugacagguauccccugaaacauggggcuuggaggaccga

SEQ ID NO: 168538 - RNA, 64 nt, Homo Sapiens
uccccuggcucaguccuaaccucuuccccugagguccccugauacuucccccacugucccgguc

SEQ ID NO: 168539 - RNA, 64 nt, Homo Sapiens
uccccugauauccccuggcuugucccgguccucuuccccugaggcacuggccaccuucccccac

SEQ ID NO: 168540 - RNA, 64 nt, Homo Sapiens
cuccugccccggcauugcaucuucccuagauagguccccugagggcugagugggagggcggccc

SEQ ID NO: 168541 - RNA, 64 nt, Homo Sapiens
uaaaggucaaauggggucaucugcuccuuuuccauccccugacauaccuuaaccucugaacucu

SEQ ID NO: 168542 - RNA, 64 nt, Homo Sapiens
agcugugagagcuauccacucuccugccugcauauccccugagaguuauaggaagugcccacug

SEQ ID NO: 168543 - RNA, 64 nt, Homo Sapiens
aacaucggcuggcuuugggacuauuccaccuccuuccccugagcccagaucugcccccaccauc

SEQ ID NO: 168544 - RNA, 64 nt, Homo Sapiens
acuaccugggucucauuccagccaacaccagaaauccccugagccuacugguugcuuguccaug

SEQ ID NO: 168545 - RNA, 64 nt, Homo Sapiens
cuuuccccacauugguaagacugcagagguucauuccccugaccguuugggaauucaaauuguc

SEQ ID NO: 168546 - RNA, 64 nt, Homo Sapiens
agagccacugagccugaguuuaaguucuuuugauaccuuugagaaaaguaccaccuuugagacc

SEQ ID NO: 168547 - RNA, 64 nt, Homo Sapiens
ccuaaguucuuuugauaccuuuggccaaaguaccaccuuugagaucguuugauuaggaaacagu

SEQ ID NO: 168548 - RNA, 64 nt, Homo Sapiens
caucaaacacuucuuuaagcguaaugaaaucauuaccuuugaaauuuaaucuuaugaguagauu

SEQ ID NO: 168549 - RNA, 64 nt, Homo Sapiens
uuuucuaaaucaggaaaaaauacuaagguuuagcaccuuugaucuagggauaaauguacaguuu

SEQ ID NO: 168550 - RNA, 64 nt, Homo Sapiens
uucugaccucacaucauauuugguucuccuacugaccuuugaucuaguuugaccuuugaaauuu

SEQ ID NO: 168551 - RNA, 64 nt, Homo Sapiens
auuugguucuccuacugaccuuugaucuaguuugaccuuugaaauuugcaugugaccucaucua

SEQ ID NO: 168552 - RNA, 64 nt, Homo Sapiens
auuaaacuaaagaaaaaacuaagaagaacaaugaaccuuugacuuugagaaauuugguuauuca

SEQ ID NO: 168553 - RNA, 64 nt, Homo Sapiens
cugauauucaugguuguuuagcacacaguucaggaccuuugagaucauguuuguauaagcacuc

SEQ ID NO: 168554 - RNA, 64 nt, Homo Sapiens
cugauguguauuuuuauuauuugaccuuguguugaccuuugaugugaugcuugaacucucaccu

SEQ ID NO: 168555 - RNA, 64 nt, Homo Sapiens
uuguguugaccuuugaugcuaugcuugaacucucaccuuugacccugucucuucagcuucucug

SEQ ID NO: 168556 - RNA, 64 nt, Homo Sapiens
ccuguaaaguggauuguaaugggccacagaaugaaccuuugaggccuuccccuccaugggcuuu

SEQ ID NO: 168557 - RNA, 64 nt, Homo Sapiens
ugaacuauuccacugucuugauguuaucuuguaaaccuuugaggcugucacucaagucuuacaa

SEQ ID NO: 168558 - RNA, 64 nt, Homo Sapiens
ccagucucuucaugccuaaaagacacuaccagucaccuuugauucgcgacuuuuaauuuaugau

SEQ ID NO: 168559 - RNA, 64 nt, Homo Sapiens
cucuuagugguccugcagcguauccuaaaagacuaccuuugaaacaggauucuuguauggccag

SEQ ID NO: 168560 - RNA, 64 nt, Homo Sapiens
uugccucaccuuucacccccccgagcugcaguucaccuuugaccuuuauauuggaccccucccu

SEQ ID NO: 168561 - RNA, 64 nt, Homo Sapiens
ucugccccccaugaaucccacugacuucugcuucaccuuugaccuugcagaccuuccuucaccc

SEQ ID NO: 168562 - RNA, 64 nt, Homo Sapiens
cgcuaggccccccaucucugccucgaggcuucugaccuuugaucccaucgcuucccaccugucc

SEQ ID NO: 168563 - RNA, 64 nt, Homo Sapiens
aauugccaagaauggcgaguguuuggucucaaaaaccuuugagguuaauuuggggaguaaagau

SEQ ID NO: 168564 - RNA, 64 nt, Homo Sapiens
agaucucugcugcauuaagucucaaggaagcaguaccuuugaaguuugugcccccuuuguguuc

SEQ ID NO: 168565 - RNA, 64 nt, Homo Sapiens
gggugaauacagcaguuaggacauacacaccaucaccuuugaaagugcuuguuugggggaggga

SEQ ID NO: 168566 - RNA, 64 nt, Homo Sapiens
aucaguccaaggagcccucguguuugccaccuuuaccuuugaaccucccccugccucccugccu

SEQ ID NO: 168567 - RNA, 64 nt, Homo Sapiens
uguucuuagaucagcacaaaccaugucaaaaaaaauuggagauuuuuuuccaauuuuccuucca

SEQ ID NO: 168568 - RNA, 64 nt, Homo Sapiens
agaacccagccuacucuagaauuucagcagugacauuggagaauauuuuuaauuugcugcagua

SEQ ID NO: 168569 - RNA, 64 nt, Homo Sapiens
gaaguggagagagggagaaguuggggagauguccauuggagacauuagagucucaaaguaagau

SEQ ID NO: 168570 - RNA, 64 nt, Homo Sapiens
gaguuaaacuauguugcccagcaguggaucuugcauuggagauguuucaaaugaaacaaaauaa

SEQ ID NO: 168571 - RNA, 64 nt, Homo Sapiens
guugucacgcuugauuguagguaagauaauuuauauuggagaaaaauccuccaaguaugaagaa

SEQ ID NO: 168572 - RNA, 64 nt, Homo Sapiens
uugcucaaacuuuguucgacaucagggaauuuguauuggagaaaaacccugcaaauguaauaaa

SEQ ID NO: 168573 - RNA, 64 nt, Homo Sapiens
augccauuacuuguauaucuaaaaauuaugaauuauuggagaaauccaaaauagcagaaauugu

SEQ ID NO: 168574 - RNA, 64 nt, Homo Sapiens
aacacugacuuuugcauauguuuuaaguaucuucauuggagaugcagguccuuauugccauuau

SEQ ID NO: 168575 - RNA, 64 nt, Homo Sapiens
ccccgcuuuuucuggaacagauuccuuggacaccauuggagaagggugcuuuugcaagacugga

SEQ ID NO: 168576 - RNA, 64 nt, Homo Sapiens
uguaugucaaacgcauuuuuugcauacagcuuacauuggagauguagcauuccacugcaccugc

SEQ ID NO: 168577 - RNA, 64 nt, Homo Sapiens
guauuuaauaaaaccuguuauuauguguuacaaaauuggagaaagaaugcagauuacacugauc

SEQ ID NO: 168578 - RNA, 64 nt, Homo Sapiens
auuuaugucagcacacacuuuuaauuuuguaauaauuggagaagcgugcguucugccuuccuug

SEQ ID NO: 168579 - RNA, 64 nt, Homo Sapiens
ucaguuuuuuaaaaauagacuguaguauccuuucauuggagaauuuacaaaaauaucaucuaca

SEQ ID NO: 168580 - RNA, 64 nt, Homo Sapiens
acaaugcauauucuaaugaagcuacuuuauauaaauuggagagcuuauaaaaugcagaacauuu

SEQ ID NO: 168581 - RNA, 64 nt, Homo Sapiens
caaaucuaggucauggcaguugaaaaagggccucauuggagauaaagucguaggauaaaauugg

SEQ ID NO: 168582 - RNA, 64 nt, Homo Sapiens
cucacagaaacacugggccaaacaguggggagagauuggagagcggguguggcugcccaacccc

SEQ ID NO: 168583 - RNA, 64 nt, Homo Sapiens
ggcgaagagcacuggcauuuggcauguccaugacauuggagacuccccuagcagggugccugac

SEQ ID NO: 168584 - RNA, 64 nt, Homo Sapiens
caguuuuagaagugcuuucugggaaaaagucuaaauuggagaucuccuuccuuuggacccaucg

SEQ ID NO: 168585 - RNA, 64 nt, Homo Sapiens
agagaaucuggacauggcuuuccuuuuuucuuggauuggagaggagaggauaccccuguuaauc

SEQ ID NO: 168586 - RNA, 64 nt, Homo Sapiens
auucucauaccuuacuaaauauaagauaauucauauuggagagaaauucuacagaugugaagaa

SEQ ID NO: 168587 - RNA, 64 nt, Homo Sapiens
ucacucaaacuuuguucaacaucagggaauuuauauuggagagcugucuugcaaauguaauaaa

SEQ ID NO: 168588 - RNA, 64 nt, Homo Sapiens
ccauaaugagagaucuuacaaaccauugcaaaucauuggagaauaaaguuuucaguaaugcuac

SEQ ID NO: 168589 - RNA, 64 nt, Homo Sapiens
aacccuacaaguguaaugaaaaaaggcaauucguauuggagagaaaauucauaccuuguaauuc

SEQ ID NO: 168590 - RNA, 64 nt, Homo Sapiens
ucacacuagagaagaguccuugcucuccuuggauauuggagaguaaaauguuuacccaaagguc

SEQ ID NO: 168591 - RNA, 64 nt, Homo Sapiens
acacaccugaguaagauccucagucucauuaaauauuggagaaugcuuaugagugcagugaguc

SEQ ID NO: 168592 - RNA, 64 nt, Homo Sapiens
uucuuuuauaacuuuguuagguuuuugaagcugcaaacacuacaaugcuuugagggggucugug

SEQ ID NO: 168593 - RNA, 64 nt, Homo Sapiens
guuuucuuuagcuuacauuuuaaacauacacaauaaacacuaauccuccaaacuuucacuguuu

SEQ ID NO: 168594 - RNA, 64 nt, Homo Sapiens
gcuauguuugugaaaaacauaucauguaauucaaaaacacuauugauauugaauaccagauacc

SEQ ID NO: 168595 - RNA, 64 nt, Homo Sapiens
uucaguguuaacaacaaucaugauaauuaaauuaaaacacuaguuuguucacuuguaggacugc

SEQ ID NO: 168596 - RNA, 64 nt, Homo Sapiens
gaauguugaauucucaugcucaaaacugaagaugaaacacuaauugcaagcaucaagugucaau

SEQ ID NO: 168597 - RNA, 64 nt, Homo Sapiens
uuguagauuuacuguagguucaguggucaaauguaaacacuauagacuucuacauaacacaaac

SEQ ID NO: 168598 - RNA, 64 nt, Homo Sapiens
ugaguguguucaaagaucaacauauuuaacuuuuaaacacuaucucaaagccagcauaauuaac

SEQ ID NO: 168599 - RNA, 64 nt, Homo Sapiens
cagguguucccuggaaaggucaagugagucugggaaacacuaugucuguacaccucuugaaggu

SEQ ID NO: 168600 - RNA, 64 nt, Homo Sapiens
auguaccauacaaaucccuuagauguuaucaaucaaacacuaaaaauuuuuuucuggaaacacu

SEQ ID NO: 168601 - RNA, 64 nt, Homo Sapiens
uguuaucaaucaaacacuaagaauuuuuuucuggaaacacuagaaucuucauuaugaacaagau

SEQ ID NO: 168602 - RNA, 64 nt, Homo Sapiens
uucauacccuacuuuuucuguaaugccagaaggaaaacacuauuaccuuaauguaauuuacuua

SEQ ID NO: 168603 - RNA, 64 nt, Homo Sapiens
uucugucuguggauucuguauaaggugaaauacuaaacacuacuuauauauauauauauauuuu

SEQ ID NO: 168604 - RNA, 64 nt, Homo Sapiens
gaaauaauuuuccacaguuccaaacgauaggcucaaacacuagagcugcuaguaaaaagaagac

SEQ ID NO: 168605 - RNA, 64 nt, Homo Sapiens
aaauaaaagcagaauguauaucaucccaucugaaaaacacuaauuauugacaugugcaucugua

SEQ ID NO: 168606 - RNA, 64 nt, Homo Sapiens
aucuuucuaaaauggaacuuguuaaaaaguguucaaacacuaucccuaaugccugcggcagaau

SEQ ID NO: 168607 - RNA, 64 nt, Homo Sapiens
uagaaauuauuuaaauuacuuuauaguaauuauuaaacacuaauuuuuguacugucauugaagg

SEQ ID NO: 168608 - RNA, 64 nt, Homo Sapiens
uuaaaugacaaguguuuaugaaagaaacuauaucaaacacuaugccaaaaguauuugcaguaca

SEQ ID NO: 168609 - RNA, 64 nt, Homo Sapiens
ugcuuuugaauuuuuuucacgagauaaacaagauaaacacuaggauacacacacguauuuccuu

SEQ ID NO: 168610 - RNA, 64 nt, Homo Sapiens
guauacugcaacacaaaagauuuuccaauuuugcaaacacuacacaccuuauuuugauuaaauc

SEQ ID NO: 168611 - RNA, 64 nt, Homo Sapiens
uguuucuuuuuuaaaacaucaacugucaggguauaaacacuauuccuuauuuuucuuggaccca

SEQ ID NO: 168612 - RNA, 64 nt, Homo Sapiens
auuacuaaaucuacaacagcaucaaaucacagagaaacacuaaaggacagaaggagauggaaug

SEQ ID NO: 168613 - RNA, 64 nt, Homo Sapiens
accaacaagaggauuuuuuaagaaugcaugcccaaaacacuacuuuuuugcuuuuaugcuuuaa

SEQ ID NO: 168614 - RNA, 64 nt, Homo Sapiens
aaaaaaacaguuuauauuuuauacugcucguuauaaacacuacuagaaauauuuagcuucagga

SEQ ID NO: 168615 - RNA, 64 nt, Homo Sapiens
uuauuguuaauuguauucacccuaauaaucuaugaaacacuaggucuuacuucuucuaucuaac

SEQ ID NO: 168616 - RNA, 64 nt, Homo Sapiens
auuucccaauguuuugucauggcuauuucuacucaaacacuaaucccccauucucuaaucacca

SEQ ID NO: 168617 - RNA, 64 nt, Homo Sapiens
aaaaacuuguuuaaauuguagacaaauuguguacaaacacuaaaaaauugaauauugaaaaauu

SEQ ID NO: 168618 - RNA, 64 nt, Homo Sapiens
auuuuuuguaccaaaaauacauaaccauugacaaaaacacuauuaauuuacagcaaaauauuga

SEQ ID NO: 168619 - RNA, 64 nt, Homo Sapiens
cagaauacauuuuaccagcaaaccuaaggaugacaaacacuauccacaucugaaaacuaccaca

SEQ ID NO: 168620 - RNA, 64 nt, Homo Sapiens
agcuucuuaguucaaaaagaauucugaguuuuucaaacacuagucuagagguggacauugucag

SEQ ID NO: 168621 - RNA, 64 nt, Homo Sapiens
ucuuggaccuuggucaguugugcuauucauuauuaaacacuaaaacuuuggcgguucuugcaua

SEQ ID NO: 168622 - RNA, 64 nt, Homo Sapiens
gaucaacgacuuguaguagacucaaguuuuuaaaaaacacuauuuuacuuaaacuguuucuuau

SEQ ID NO: 168623 - RNA, 64 nt, Homo Sapiens
augaauuuaauguauaaaaucagcauuuaaaugcaaacacuaccacuuuuaauuuuauauauga

SEQ ID NO: 168624 - RNA, 64 nt, Homo Sapiens
caaaaugggaauuaggcuuaagcauuuccaaacaaaacacuaagguugaagaaucauuguuaga

SEQ ID NO: 168625 - RNA, 64 nt, Homo Sapiens
ccuggaaagauguuuucaaggaauuugaaccauaaaacacuaucugaugcacagaacaccucua

SEQ ID NO: 168626 - RNA, 64 nt, Homo Sapiens
auuuauucauccauccauucaacaaguauuugcuaaacacuaacuuaagcuaaugcuaggguag

SEQ ID NO: 168627 - RNA, 64 nt, Homo Sapiens
uuuucaguaacugaauuugugcacaaaacauucuaaacacuagugaagccuguuucguugaacu

SEQ ID NO: 168628 - RNA, 64 nt, Homo Sapiens
uauuuaugguuuuuuuuuuuuuuuucauuuccagaaacacuauuuuaaacacaaaaauaaauuu

SEQ ID NO: 168629 - RNA, 64 nt, Homo Sapiens
cccaggauugaaaaagcaaacacaccaguucagaaaacacuagacguugaucuuuagccugucu

SEQ ID NO: 168630 - RNA, 60 nt, Homo Sapiens
uuuguagauggaguuucacuuuuguugcccaggcuggaguguaguggcgcgaucucggcu

SEQ ID NO: 168631 - RNA, 60 nt, Homo Sapiens
uguuugagacagggucucacucugucgcucaggcuggagugcagugaugcaaucuuggcu

SEQ ID NO: 168632 - RNA, 60 nt, Homo Sapiens
ugcauguuaugagcgugugcuuauccguuaaggcuggaggcacaugugggugauggugga

SEQ ID NO: 168633 - RNA, 60 nt, Homo Sapiens
aggcucaccccuacguccccccacaccuggaggcuggagccaggggccacuucugaacug

SEQ ID NO: 168634 - RNA, 60 nt, Homo Sapiens
uuuuugagacagagucucgcuuuguuucccaggcuggagugcaguggcacgaucucggcu

SEQ ID NO: 168635 - RNA, 60 nt, Homo Sapiens
cgcuuguaaucccagcuacuugggaggcugaggcuggagaaucgcuugaacccaggaggu

SEQ ID NO: 168636 - RNA, 60 nt, Homo Sapiens
uuuuuugagauggagucucgcucuguagccaggcuggagugcaguggcauaaucucagcu

SEQ ID NO: 168637 - RNA, 60 nt, Homo Sapiens
guauuagauggaauuucacucuugucgcccaggcuggaguguaguggcgcagucucagcu

SEQ ID NO: 168638 - RNA, 60 nt, Homo Sapiens
cuguucucuucggaagaccucguuuucuaaaggcuggacuaaauggcugcagaacucccu

SEQ ID NO: 168639 - RNA, 60 nt, Homo Sapiens
uuuuugagacagagucuggcucugucgcccaggcuggagugcaggggcgcaaucucggcu

SEQ ID NO: 168640 - RNA, 60 nt, Homo Sapiens
gcaauggugcgaucucggcuccugucacccaggcuggaguguuuugagauggagucuugc

SEQ ID NO: 168641 - RNA, 60 nt, Homo Sapiens
caagauccugccugauauccaaccaacucgaggcuggagcgugaagacagaagcuccgug

SEQ ID NO: 168642 - RNA, 60 nt, Homo Sapiens
gaggcuguagccaacacaaucgcccacgggaggcuggacagccguggcuugucuggucuu

SEQ ID NO: 168643 - RNA, 60 nt, Homo Sapiens
uucccugcccccuaugauugccccaggggcaggcuggacuuuuuuugcaaacuuggcuuc

SEQ ID NO: 168644 - RNA, 60 nt, Homo Sapiens
ccgccagguguuugcucucucuuccugccaaggcuggaggccuggcugacauuuccccuc

SEQ ID NO: 168645 - RNA, 60 nt, Homo Sapiens
aaaauaacugcaaggaggggaaggacugucaggcuggacacccagacugcuggaacagcc

SEQ ID NO: 168646 - RNA, 60 nt, Homo Sapiens
auagugucugccucgcuuccccacgccaagaggcuggaacacugacuggcugcagccuuc

SEQ ID NO: 168647 - RNA, 60 nt, Homo Sapiens
acaguggugccaucauugcuucugucacucaggcuggaguugugagagacggugucuugu

SEQ ID NO: 168648 - RNA, 60 nt, Homo Sapiens
ugucacugcuuuuggccuggcccaaguaagaggcuggaguucccucagucccaaauccuu

SEQ ID NO: 168649 - RNA, 60 nt, Homo Sapiens
gcagugguacgaucuuggcucacugcacucaggcuggaguuguuuuuugagaugaagucu

SEQ ID NO: 168650 - RNA, 60 nt, Homo Sapiens
gcuguggugugaucuuagcuucugucacccaggcuggaguuuuuuaagacagagauucag

SEQ ID NO: 168651 - RNA, 60 nt, Homo Sapiens
ggagaaucuggauucucuccggggggagggaggcuggaauagaaggaaugguauuuguau

SEQ ID NO: 168652 - RNA, 60 nt, Homo Sapiens
cagggguuugaggugggggcugggaaucugaggcuggagauuugggccgggaaggcagcc

SEQ ID NO: 168653 - RNA, 60 nt, Homo Sapiens
guaguggcaugaucucgacucccugucgccaggcuggaguuuuuuggagacggagucucg

SEQ ID NO: 168654 - RNA, 60 nt, Homo Sapiens
ggaguggugauuauuccccuggucaguaggaggcuggauuuugccccaugauuuuucuuu

SEQ ID NO: 168655 - RNA, 60 nt, Homo Sapiens
cuuaugugccccauugagcuucacagugucaggcuggacgccgugauuucagggaccuau

SEQ ID NO: 168656 - RNA, 60 nt, Homo Sapiens
ugauccgcagauguaggggccucuuggcagaggcuggaggacucugggggcuagggaaga

SEQ ID NO: 168657 - RNA, 60 nt, Homo Sapiens
caauauuccaaaggaacauuuuaacuguaaaggcuggagacaagaaaaaauaaguagauc

SEQ ID NO: 168658 - RNA, 60 nt, Homo Sapiens
uuuuugagauggacucuagcucugucacccaggcuggagugcaguggugcgaucucggcu

SEQ ID NO: 168659 - RNA, 60 nt, Homo Sapiens
uucggagacggaguuucacucuugcugcccaggcuggagugcaauggugcaaugaccucg

SEQ ID NO: 168660 - RNA, 60 nt, Homo Sapiens
guuuugagacagggucucgcucugucacccaggcuggaguguaguggugcagucuuggcu

SEQ ID NO: 168661 - RNA, 60 nt, Homo Sapiens
uuguagagacgggguuuugccauguugcccaggcuggaagugucuauguuuaacugcauc

SEQ ID NO: 168662 - RNA, 60 nt, Homo Sapiens
uuuuuagauggaguuuggcucuugucacccaggcuggagugcaauggcgcaaucucagcu

SEQ ID NO: 168663 - RNA, 60 nt, Homo Sapiens
auuugagacagaguuuugcucuuauugcccaggcuggagugcaguggcgugaucuuggcu

SEQ ID NO: 168664 - RNA, 60 nt, Homo Sapiens
uuuuugagacggagucuugcucugucacccaggcuggagagcaguggcgugaucucggcu

SEQ ID NO: 168665 - RNA, 60 nt, Homo Sapiens
uuuuugaaacggaguuuugcucugucacccaggcuggaaugcaauggcaccaucuuggcu

SEQ ID NO: 168666 - RNA, 60 nt, Homo Sapiens
ugaagcuacauuaccauguguguacuucccaggcuggaugaugagcauccuugacgccug

SEQ ID NO: 168667 - RNA, 60 nt, Homo Sapiens
agugcagucguacagucaugacucuuguccaggcuggagguaaauggagauagggucuua

SEQ ID NO: 168668 - RNA, 60 nt, Homo Sapiens
cuguggcucacaccuguaauauuuauauuaaggcuggaagauaaagaaugcugagucaag

SEQ ID NO: 168669 - RNA, 60 nt, Homo Sapiens
gcaauggcgugaucuuggcucaggagucagaggcuggaaugugggaggauggguugagca

SEQ ID NO: 168670 - RNA, 60 nt, Homo Sapiens
guacgggccccaccuucgcuacccucugccaggcuggauuuucugcucuaagggggccag

SEQ ID NO: 168671 - RNA, 60 nt, Homo Sapiens
uuggggggcugugagggaaagagcagggugaggcuggacucucacuucaggaggggccug

SEQ ID NO: 168672 - RNA, 60 nt, Homo Sapiens
acagggucuugcucuauugcucugucacccaggcuggaaugcaguggcgagaucuccgcu

SEQ ID NO: 168673 - RNA, 60 nt, Homo Sapiens
uuuugagacggagucucacucuuguugcccaggcuggacaacaauggcgcgaucucggcu

SEQ ID NO: 168674 - RNA, 60 nt, Homo Sapiens
uauuagaaacagaguuucaccauguuggccaggcuggagaauugcuguaauaguuuucca

SEQ ID NO: 168675 - RNA, 60 nt, Homo Sapiens
uuuuugaaacuagcucucauucugucacccaggcuggaauacagugguacagucacggcu

SEQ ID NO: 168676 - RNA, 60 nt, Homo Sapiens
uuguuuuuuguagacagcacucugucacccaggcuggagugcaguggcaccaucuuggcu

SEQ ID NO: 168677 - RNA, 60 nt, Homo Sapiens
uauuugagauggagucucacucugucacccaggcuggaaugcaguggugugaucuuggcu

SEQ ID NO: 168678 - RNA, 60 nt, Homo Sapiens
guuuugagacagggucucacugugucccccaggcuggagugcaguggcacaaugacgacu

SEQ ID NO: 168679 - RNA, 60 nt, Homo Sapiens
gcaguggcaugaucucagcuucugucacccaggcuggaguucguugagauacaguuucac

SEQ ID NO: 168680 - RNA, 60 nt, Homo Sapiens
gcaguggcaugaucucaguuacugucacccaggcuggaguuuuuuuggagacagagucuc

SEQ ID NO: 168681 - RNA, 60 nt, Homo Sapiens
cagcaggucacucucccuggcacaccuuccaggcuggauuuuuaaugaaacagacucagg

SEQ ID NO: 168682 - RNA, 60 nt, Homo Sapiens
cuggggugagaggucagugcaccacagccgaggcuggagcacagggagcuucuguuguuc

SEQ ID NO: 168683 - RNA, 60 nt, Homo Sapiens
uuuuugagauguagucucacccugucgcccaggcuggagugcaaugccgugaucuccgcu

SEQ ID NO: 168684 - RNA, 60 nt, Homo Sapiens
gguuaagauucuccuuuuguacugggaaacaggcuggaggacuaugguccucaaguuuag

SEQ ID NO: 168685 - RNA, 60 nt, Homo Sapiens
gggggggauggaguuucgcuguuguugcccaggcuggagugcaauagcacgaucuuggcu

SEQ ID NO: 168686 - RNA, 60 nt, Homo Sapiens
uuuuugaaacagggucucacucuauugcccaggcuggagugcacuggcgugaucucggcu

SEQ ID NO: 168687 - RNA, 60 nt, Homo Sapiens
uuuuugaaaccgugucucacucugucgcccaggcuggaggagugcaguggugugaucuca

SEQ ID NO: 168688 - RNA, 60 nt, Homo Sapiens
uguuugagauggagucuugcucugucgcccaggcuggaacgcaguggugacaucucggcu

SEQ ID NO: 168689 - RNA, 60 nt, Homo Sapiens
uggagauggggucaggaacagugaggcuggaggcuggaggugggucacagggaacugcca

SEQ ID NO: 168690 - RNA, 60 nt, Homo Sapiens
cuggagguggagauggggucacugccagugaggcuggaggaacaggcugggucacaggga

SEQ ID NO: 168691 - RNA, 60 nt, Homo Sapiens
uuuugaaaagacaggguuuugccaucguccaggcuggagugcgcuggcuugaucuuggcu

SEQ ID NO: 168692 - RNA, 60 nt, Homo Sapiens
uuuuugagacaaggucucacucugucacccaggcuggaguacaguggguugaucauggcu

SEQ ID NO: 168693 - RNA, 60 nt, Homo Sapiens
uuucugagacggagucguuuucugccacccaggcuggaguacaguggcaugaucuuggcu

SEQ ID NO: 168694 - RNA, 60 nt, Homo Sapiens
uuuuugagucagagucucgcucuguugcccaggcuggagugcaguggugccaucuuggcu

SEQ ID NO: 168695 - RNA, 60 nt, Homo Sapiens
ggcugggugaagaaauuggcgcugagauccaggcuggauccauugcuuuuguuuacaaua

SEQ ID NO: 168696 - RNA, 60 nt, Homo Sapiens
cucugaaaaagggaauuugcuggugaaaagaggcuggaucuuguggaagacugucuugga

SEQ ID NO: 168697 - RNA, 60 nt, Homo Sapiens
uuuuugagauggagucucacucuguggcccaggcuggagugcaguggcgcaaucuuggcu

SEQ ID NO: 168698 - RNA, 60 nt, Homo Sapiens
aaggucccgaagggcaggucagagggagagaggcuggagaccugggcuggggccuuccuc

SEQ ID NO: 168699 - RNA, 60 nt, Homo Sapiens
ucucggagcuggauccccgucagcucauccaggcuggacaaaccaguuccuggguccccc

SEQ ID NO: 168700 - RNA, 60 nt, Homo Sapiens
aaaacaaaagugauuaugucacgagaggagaggcuggagggccaugggaguucccagcug

SEQ ID NO: 168701 - RNA, 60 nt, Homo Sapiens
gcaguggugugaucucggcuucugucacccaggcuggaguuuuuugagauggagucucgc

SEQ ID NO: 168702 - RNA, 60 nt, Homo Sapiens
agcuggcucuuuuagacucaugaauccuggaggcuggaacuugaaauaggaaguucucac

SEQ ID NO: 168703 - RNA, 60 nt, Homo Sapiens
gcaguggcacgaucucggcucuugucacccaggcuggaguucuugagacggagucuuggu

SEQ ID NO: 168704 - RNA, 60 nt, Homo Sapiens
gcaguagcgcagucucggcucuuguugcccaggcuggaguuuuugagacagaguuucacu

SEQ ID NO: 168705 - RNA, 60 nt, Homo Sapiens
gcagugaugccaucucagcuucugucacacaggcuggaauuuuuugagauggagucucac

SEQ ID NO: 168706 - RNA, 60 nt, Homo Sapiens
acaguggcgcgaucucagcuucuguugcccaggcuggaguuuuuuuuuuuuuugucucgc

SEQ ID NO: 168707 - RNA, 60 nt, Homo Sapiens
acggggauacggggucuugcucugucucccaggcuggagugcagugacacaaucucagcu

SEQ ID NO: 168708 - RNA, 60 nt, Homo Sapiens
acacuaaaggaggaggagccggggacucccaggcuggagagcacugccaggacccaccac

SEQ ID NO: 168709 - RNA, 60 nt, Homo Sapiens
uagggccuucaagggcuggcagucuuacagaggcuggagcggugagaaugagaggccaga

SEQ ID NO: 168710 - RNA, 60 nt, Homo Sapiens
cauuuggaaggcuaaauggggccaugaagaaggcuggaagggacagggggugauggcagc

SEQ ID NO: 168711 - RNA, 60 nt, Homo Sapiens
gggccugggccgggagcccaggggaaggccaggcuggaccccggcuccacacccacaucc

SEQ ID NO: 168712 - RNA, 60 nt, Homo Sapiens
ccugcccucccagucucccaccccggccccaggcuggaagcccucccuccacuuaaguua

SEQ ID NO: 168713 - RNA, 60 nt, Homo Sapiens
guaguggcaugaucugggcuucugucacccaggcuggaguuuuuugagacagugccucac

SEQ ID NO: 168714 - RNA, 60 nt, Homo Sapiens
gcaguggcucgaucucggcuucugucgcccaggcuggaguucugagacgcagucuggcuc

SEQ ID NO: 168715 - RNA, 60 nt, Homo Sapiens
gcaguggcacgaucucggcuucuguugcccaggcuggaguuuucugagacagagucucgc

SEQ ID NO: 168716 - RNA, 60 nt, Homo Sapiens
gcaguggcgcgaucucggcuucugucgcccaggcuggaguuuuuugagacggagucucgc

SEQ ID NO: 168717 - RNA, 60 nt, Homo Sapiens
augcagccuggauuccccuaccagcaaugaaggcuggagaccagagcacuggcuuggcgu

SEQ ID NO: 168718 - RNA, 60 nt, Homo Sapiens
uggggcucucucccccagcuugaagugcagaggcuggacugggucagccucucccaagac

SEQ ID NO: 168719 - RNA, 60 nt, Homo Sapiens
gagacacaggccccacccagguccagcuggaggcuggagguucccacccaaaccuucuca

SEQ ID NO: 168720 - RNA, 60 nt, Homo Sapiens
uuugccuugagagcuccgugagaggaaggcaggcuggaucgaggaguaagagcccagacg

SEQ ID NO: 168721 - RNA, 60 nt, Homo Sapiens
gcaauggcgugaucgcugcucuuguugcccaggcuggaguuuuuuugagauaauuucacu

SEQ ID NO: 168722 - RNA, 60 nt, Homo Sapiens
gcaguggugcgaucucggcuugugucgccaaggcuggaguuuuuugagacauggucacgc

SEQ ID NO: 168723 - RNA, 60 nt, Homo Sapiens
acuacuaaccaauaaaaucaggugcagaugaggcuggacaggcuugagcucagucaaucu

SEQ ID NO: 168724 - RNA, 60 nt, Homo Sapiens
ugcaagauguggcuugaauuagaucuugacaggcuggaccaaccaaaaucucguauuggc

SEQ ID NO: 168725 - RNA, 60 nt, Homo Sapiens
uuuuagugauagagucucacucugucacccaggcuggagggcagugguacagucuuggcu

SEQ ID NO: 168726 - RNA, 60 nt, Homo Sapiens
guuuuuggacggagucuuagucugucacugaggcuggaguacaguggcacgaucuuggcu

SEQ ID NO: 168727 - RNA, 60 nt, Homo Sapiens
cccccccccaacuccaggaacccccuccccaggcuggagagacagaggaaagggcuggcu

SEQ ID NO: 168728 - RNA, 60 nt, Homo Sapiens
gcaguggcaugaucauagcuucugucccccaggcuggaguuuuaugagacagggucuugc

SEQ ID NO: 168729 - RNA, 60 nt, Homo Sapiens
gcaacgguacgaucuuggcuucucucgcccaggcuggaguuuuuugagacagaaucucac

SEQ ID NO: 168730 - RNA, 60 nt, Homo Sapiens
gcaauggugcaaucuuggcuucugucucccaggcuggagugggggugcggggcaguucac

SEQ ID NO: 168731 - RNA, 54 nt, Homo Sapiens
ucuacgacgggcugguauagucccaggcuggagcugggugagugcagacucggg

SEQ ID NO: 168732 - RNA, 60 nt, Homo Sapiens
gcaaccccaccggacgggugguccggagggaggcuggagcggggaggcgaggagggggcu

SEQ ID NO: 168733 - RNA, 60 nt, Homo Sapiens
gcaguggcgcaaucucaccuucugucaccuaggcuggaguauuuugagacagagucucgc

SEQ ID NO: 168734 - RNA, 60 nt, Homo Sapiens
gcaauggugcaaucucggcuucugucacccaggcuggaguauuuuuuuuuuucgagacac

SEQ ID NO: 168735 - RNA, 60 nt, Homo Sapiens
ucgacacagacucugcugauagcuuacgggaggcuggaccaaugaccugccucugugcga

SEQ ID NO: 168736 - RNA, 60 nt, Homo Sapiens
cagggaggccuuccacucugggggaaacuuaggcuggagaucuacguaucauuuacuuag

SEQ ID NO: 168737 - RNA, 60 nt, Homo Sapiens
gagcaggaaaaggaggcucagcacugucucaggcuggaggucagcgaaccucgugggcug

SEQ ID NO: 168738 - RNA, 60 nt, Homo Sapiens
gucucucagacaggcguccuaaagaccucuaggcuggaagcuugggcuugcaaguggauc

SEQ ID NO: 168739 - RNA, 60 nt, Homo Sapiens
uuuguuuuugagauagggucuuuguugcucaggcuggaguacaguggcauaaucacagcu

SEQ ID NO: 168740 - RNA, 60 nt, Homo Sapiens
uuuuuuugagacagucucgcucugucccccaggcuggagugcaguggcucgaucucugcu

SEQ ID NO: 168741 - RNA, 60 nt, Homo Sapiens
gcgguggcgcgaucuaggcuucugucgcccaggcuggaguuuuuugagauggagucuugc

SEQ ID NO: 168742 - RNA, 60 nt, Homo Sapiens
gcaauggcgugaucucggcucuugucacccaggcuggaguuuuugagacggaguuucccu

SEQ ID NO: 168743 - RNA, 60 nt, Homo Sapiens
ccugccagcucuucugccggcccuggggcuaggcuggagcccagggagcggaaagcagcu

SEQ ID NO: 168744 - RNA, 60 nt, Homo Sapiens
gggagucugaagcagaugcaaagaggcaagaggcuggauuuugaauuuucuuuuuaauaa

SEQ ID NO: 168745 - RNA, 60 nt, Homo Sapiens
aacaacugggcccuggaccaccauccccagaggcuggaggcccggcccccagaugucccc

SEQ ID NO: 168746 - RNA, 60 nt, Homo Sapiens
ggccccuggacuucuacgagucccgcccugaggcuggaccucccuggugaguguaaaccg

SEQ ID NO: 168747 - RNA, 60 nt, Homo Sapiens
cugaggaagggccccucuccgcagaaugggaggcuggaccugcuugguaaacguggcaga

SEQ ID NO: 168748 - RNA, 60 nt, Homo Sapiens
caugaggguagugggcuaaggacuaaagucaggcuggaguagacccccucaauagacacu

SEQ ID NO: 168749 - RNA, 60 nt, Homo Sapiens
gcaguggcgcgaucuuggccucugucccccaggcuggaguuuuuugagacagagucucac

SEQ ID NO: 168750 - RNA, 60 nt, Homo Sapiens
gcaguggcgcaauuucagcuucugucacugaggcuggaguuuuuuuuuuuugagucuugc

SEQ ID NO: 168751 - RNA, 60 nt, Homo Sapiens
uuuuuuuuuuugagacucgcuuugucacccaggcuggagugcaauggcacaaucucaacu

SEQ ID NO: 168752 - RNA, 60 nt, Homo Sapiens
uuuuugagacagcaucucacacugucgcccaggcuggagugcaguggugcaaucucagcu

SEQ ID NO: 168753 - RNA, 60 nt, Homo Sapiens
uuuuuggagacagagucuugcuuuguugccaggcuggagugcaguggcgcgaucucggcu

SEQ ID NO: 168754 - RNA, 60 nt, Homo Sapiens
uaauggagacagggucuugcacuaucacccaggcuggagugcaguggcauaaucauaccu

SEQ ID NO: 168755 - RNA, 60 nt, Homo Sapiens
gcaacggcacgaucucggcucuuguugcccaggcuggaguuuuugagacagaguuucgcu

SEQ ID NO: 168756 - RNA, 60 nt, Homo Sapiens
gcaguggcacaaucucgacuuuuguuacccaggcuggaguuuuuugagauagggucucac

SEQ ID NO: 168757 - RNA, 60 nt, Homo Sapiens
uuuugagacagaguuucacucuuguugcccaggcuggagggcaauggcgcgaucucagcu

SEQ ID NO: 168758 - RNA, 60 nt, Homo Sapiens
uuuugagacagaguuucgcacuucuugcccaggcuggaguacaauggugcgaucuuggcu

SEQ ID NO: 168759 - RNA, 60 nt, Homo Sapiens
gcaguggugugaucuuggcuucugucgcccaggcuggaguuuuuugagacagagucucau

SEQ ID NO: 168760 - RNA, 60 nt, Homo Sapiens
cugcaggguuaggcccgagaagcuguacggaggcuggaagcauccugcugcagggaaggg

SEQ ID NO: 168761 - RNA, 60 nt, Homo Sapiens
caggcuauagcagcugagggggacccggggaggcuggacagggcgcggaacccugucaug

SEQ ID NO: 168762 - RNA, 60 nt, Homo Sapiens
ugucauggaugacaaggcaagggcagcaauaggcuggagcccgaagguauuucuccagau

SEQ ID NO: 168763 - RNA, 60 nt, Homo Sapiens
uuuuugagacagagucuugcucugucacccaggcuggagugcaguggugcgaucgcucac

SEQ ID NO: 168764 - RNA, 60 nt, Homo Sapiens
uuuuugagauggagucucacucugucacccaggcuggagugcaguggcgugaucuuggcu

SEQ ID NO: 168765 - RNA, 60 nt, Homo Sapiens
uggaaaaggguggagaacaggggaguagccaggcuggauggcucaaauauaaaugaauga

SEQ ID NO: 168766 - RNA, 60 nt, Homo Sapiens
ugaaagcuuuguagugaggagcuauggagaaggcuggagaaacucucugcccuccacaga

SEQ ID NO: 168767 - RNA, 60 nt, Homo Sapiens
uucaggcacugcaggcugauagaggugcacaggcuggagugcaguguggggcauccugcc

SEQ ID NO: 168768 - RNA, 60 nt, Homo Sapiens
uuuuugacacagagucucgcucugucgcccaggcuggaaugcaguugugagaucucggcu

SEQ ID NO: 168769 - RNA, 60 nt, Homo Sapiens
uuuuugagacagagacucgcucugucacccaggcuggagugcaguggcaugauuucggcu

SEQ ID NO: 168770 - RNA, 60 nt, Homo Sapiens
gggcugccccuuaagugucggugaauagugaggcuggaggccggaaucucagccagccuc

SEQ ID NO: 168771 - RNA, 60 nt, Homo Sapiens
cuuuugagacagaguuucgcuuugucgcccaggcuggagugcaaugcacgaucucaguuc

SEQ ID NO: 168772 - RNA, 60 nt, Homo Sapiens
uuuacuguacucucuaucacugacaaaugcaggcuggauucuuauuauauacagagaugg

SEQ ID NO: 168773 - RNA, 60 nt, Homo Sapiens
cucaguauuuuucuuggaugggaugacgcuaggcuggaaaguuuuuuucaucacuaugau

SEQ ID NO: 168774 - RNA, 60 nt, Homo Sapiens
aaugcugaggaguucaguugugaggaaagaaggcuggagcugugagauucgcuuuucccu

SEQ ID NO: 168775 - RNA, 60 nt, Homo Sapiens
uuuuuagacggaguuuugcucuuguugcccaggcuggagugcagugacacaaucucuacu

SEQ ID NO: 168776 - RNA, 60 nt, Homo Sapiens
gcaguggugcaaucuuggcucuugucacccaggcuggaguuuuugagacaaaguuuugcu

SEQ ID NO: 168777 - RNA, 60 nt, Homo Sapiens
gcaguggcacgaucucagcuucuguggcccaggcuggaguuuuuugagaccaaaucuugc

SEQ ID NO: 168778 - RNA, 60 nt, Homo Sapiens
uuguuccugccccaggaauaauguggaggaaggcuggagcgggugcugauuaccucagcc

SEQ ID NO: 168779 - RNA, 60 nt, Homo Sapiens
gaggcaaagggcuggccacacccaaggaugaggcuggacucaagcugcccccuccuugcc

SEQ ID NO: 168780 - RNA, 60 nt, Homo Sapiens
gcgucccgccacagcuacuacacguuuuuuaggcuggacaugaagaugaauuggaauggu

SEQ ID NO: 168781 - RNA, 60 nt, Homo Sapiens
ugccggugggccuguguugccccgcaaggcaggcuggagguauauucgccugaagaucau

SEQ ID NO: 168782 - RNA, 60 nt, Homo Sapiens
gacuuccagguagggccagcucacaagcccaggcuggagauccuaacugagaauuuucua

SEQ ID NO: 168783 - RNA, 60 nt, Homo Sapiens
ucuuuuuuugagacggcgcaccuaucacccaggcuggaguggaguggcacgaucuuggcu

SEQ ID NO: 168784 - RNA, 60 nt, Homo Sapiens
gcaguggugugaucuuggcucuuguugcccaggcuggagucugugagacagaguuucacu

SEQ ID NO: 168785 - RNA, 60 nt, Homo Sapiens
gcaguggcacaauuuuggcucuucucacccaggcuggaauuuuugagacagaauuucacu

SEQ ID NO: 168786 - RNA, 60 nt, Homo Sapiens
uaggauuuugaacccaaauuuauguugccuaggcuggaaaucguggagacggggccucac

SEQ ID NO: 168787 - RNA, 60 nt, Homo Sapiens
gcaguggugccaucaccacguuugacacccaggcuggaguuuguuaagacagagucucac

SEQ ID NO: 168788 - RNA, 60 nt, Homo Sapiens
gcaguggugccaucaugacuacugucacccaggcuggaguuguuuuugagacgaggucuc

SEQ ID NO: 168789 - RNA, 60 nt, Homo Sapiens
gcaguggcgugaucuuggcuucugucucccaggcuggaguuguuugagauggagucucac

SEQ ID NO: 168790 - RNA, 60 nt, Homo Sapiens
gcugccaccccgggugcuccgucauuggagaggcuggacucugggugggggaggcuggag

SEQ ID NO: 168791 - RNA, 60 nt, Homo Sapiens
ucauuggagaggcuggacugugggugggggaggcuggagggcacagcccucccuccugcc

SEQ ID NO: 168792 - RNA, 60 nt, Homo Sapiens
cgagggcacacagggccggggaggaggauuaggcuggacugaucgcgggucgcaggugac

SEQ ID NO: 168793 - RNA, 60 nt, Homo Sapiens
acugccgugcccgggggacauccugcgcccaggcuggaggcccugccucgcugcuugcca

SEQ ID NO: 168794 - RNA, 60 nt, Homo Sapiens
uguuuaagacagcaucuugcucugucucccaggcuggagcguaguaaugcaaucauagcu

SEQ ID NO: 168795 - RNA, 60 nt, Homo Sapiens
uuuuugagacagauucuugcucugucacccaggcuggagugcaguagcaugaucagggau

SEQ ID NO: 168796 - RNA, 60 nt, Homo Sapiens
uaguagagaugagguuuugccauuuuggucaggcuggaauuuuuuuuuuuuuaauuuuga

SEQ ID NO: 168797 - RNA, 60 nt, Homo Sapiens
gacgaagugaaguagugcaaucugucacccaggcuggaauuguaugggacagggucucac

SEQ ID NO: 168798 - RNA, 60 nt, Homo Sapiens
gcaguggcgugaucucggcuucuguugcccaggcuggaguguuuugagacagggucucac

SEQ ID NO: 168799 - RNA, 60 nt, Homo Sapiens
uuuuugagauggagucucgcucugucgcccaggcuggagugcaguggcgcaaucucagcu

SEQ ID NO: 168800 - RNA, 60 nt, Homo Sapiens
uuuuaaggacagagucucucucugucacccaggcuggagugcaauggcgcgaucuuggcu

SEQ ID NO: 168801 - RNA, 60 nt, Homo Sapiens
cagcucauacgggcagacugcucaggcgugaggcuggaucguaggguucgaggcugcuug

SEQ ID NO: 168802 - RNA, 60 nt, Homo Sapiens
cucugcaacugagcgaagcugcgggcuaggaggcuggaaagccauuuauccuaggacaua

SEQ ID NO: 168803 - RNA, 60 nt, Homo Sapiens
cccuacccuucccuccucugucuauugcccaggcuggagugcaguggugcgaccuuggcu

SEQ ID NO: 168804 - RNA, 60 nt, Homo Sapiens
uuuuugagacagagucucgcucugucacccaggcuggaguucaguggugcgaccucggcu

SEQ ID NO: 168805 - RNA, 60 nt, Homo Sapiens
uuuuugagacagagucucacacuguugcccaggcuggagugcaguggcgugaucucggcu

SEQ ID NO: 168806 - RNA, 60 nt, Homo Sapiens
uuuuugaaacuaagccuugcucugucucccaggcuggagugcuauggugcaauuuuuguu

SEQ ID NO: 168807 - RNA, 60 nt, Homo Sapiens
gcaguggugggaucucggcucggccuaaccaggcuggagucaggcaugagcuacugcacc

SEQ ID NO: 168808 - RNA, 60 nt, Homo Sapiens
gcuuccagggucacuccuugacuuuccaggaggcuggauguguguuuuuaaaccacuucc

SEQ ID NO: 168809 - RNA, 60 nt, Homo Sapiens
gcaguggcgcgaucuaggcucucugucgccaggcuggaguuuuuuaaagauggggucuug

SEQ ID NO: 168810 - RNA, 60 nt, Homo Sapiens
gccauggcgcgaucuuggcucuugucgcucaggcuggaguuuucgagauggaguuucacu

SEQ ID NO: 168811 - RNA, 60 nt, Homo Sapiens
caccagggaauuaauucccccucauuuugcaggcuggaagggacuuacugguugcaagag

SEQ ID NO: 168812 - RNA, 60 nt, Homo Sapiens
ucugagaucagagugccagcacauaucuggaggcuggaagaaacacaaauuuauauucuc

SEQ ID NO: 168813 - RNA, 60 nt, Homo Sapiens
gcaaugguaugaucuuggcucuuguugcccaggcuggaguuuuugagauggaguuuugcu

SEQ ID NO: 168814 - RNA, 60 nt, Homo Sapiens
gcaguggcacaaucuuggcucacuguugccaggcuggaguuuuuuuuugagauggauucu

SEQ ID NO: 168815 - RNA, 60 nt, Homo Sapiens
gcaguggcgcgaucucagcuguccuugcccaggcuggaguuuuuuuuuuuuugagacgga

SEQ ID NO: 168816 - RNA, 60 nt, Homo Sapiens
gaaaguggcgcaaccucugcucuguugccuaggcuggaguuuuuugagcuggagucuuac

SEQ ID NO: 168817 - RNA, 60 nt, Homo Sapiens
gcaguggugugauccuggcucuguugccccaggcuggaguccccaagauggugucucacu

SEQ ID NO: 168818 - RNA, 60 nt, Homo Sapiens
gcaguggugcgaucgcggcucuuguugcccaggcuggaguuguugagauguaauuuugcu

SEQ ID NO: 168819 - RNA, 60 nt, Homo Sapiens
gcaguggugugaucucagcuucugucaucuaggcuggaguuuuuugagauggagucucgc

SEQ ID NO: 168820 - RNA, 60 nt, Homo Sapiens
gcaguggugcgaucucagcuucuguuacccaggcuggaguuuucaagacagggucucaac

SEQ ID NO: 168821 - RNA, 60 nt, Homo Sapiens
gcaauggcgugaucuuggcucuuguugcccaggcuggaguuuuugagacagaauuuugcu

SEQ ID NO: 168822 - RNA, 60 nt, Homo Sapiens
gcaguguugcaguccggcucacugucacccaggcuggaguuuuuugagacagggucucac

SEQ ID NO: 168823 - RNA, 60 nt, Homo Sapiens
uuuuuagauggaguuuuacucuuguugcccaggcuggagugcaacggcaugauuuuggcu

SEQ ID NO: 168824 - RNA, 60 nt, Homo Sapiens
uuuuugaggcagagucucauucuguugcccaggcuggagugcaguggcgugaucuuggcu

SEQ ID NO: 168825 - RNA, 60 nt, Homo Sapiens
gagucagcagacuguccaaugugcucagccaggcuggaggcggcaggcggcaggcagcag

SEQ ID NO: 168826 - RNA, 60 nt, Homo Sapiens
uuugagacgggaguuucucucuugucucccaggcuggagugcaaucgcgcaaucucggcu

SEQ ID NO: 168827 - RNA, 60 nt, Homo Sapiens
cuuugagauggauuuucgcucuugucgcccaggcuggaguacaauggcacgaucuuggcu

SEQ ID NO: 168828 - RNA, 60 nt, Homo Sapiens
uuuuugagacagagucucacucuguugcccaggcuggagugcaguggcgccaucucggcu

SEQ ID NO: 168829 - RNA, 60 nt, Homo Sapiens
gggccuggggcccgggaccggaggcugacgaggcuggacuuccucgaguggccacuguga

SEQ ID NO: 168830 - RNA, 60 nt, Homo Sapiens
uuuugagacggaguuucacucuuguugcccaggcuggagugcaauggcaugaucucggcu

SEQ ID NO: 168831 - RNA, 60 nt, Homo Sapiens
gcaguggugggaucucagcuucuguuucccaggcuggaguuuuuugagacagagucuggu

SEQ ID NO: 168832 - RNA, 60 nt, Homo Sapiens
gacuucaacuuggaguugagaacgugcacaaggcuggaugcccuguacguauuggugaag

SEQ ID NO: 168833 - RNA, 60 nt, Homo Sapiens
agauagccgagaccccagcagauucgacagaggcuggagguacaccgugcuccggcuaau

SEQ ID NO: 168834 - RNA, 60 nt, Homo Sapiens
acaguuuuuaugcuguuuuauuugacuuaaaggcuggaagacagaaacgaagugaguuca

SEQ ID NO: 168835 - RNA, 60 nt, Homo Sapiens
uuuuugagacagggucuugcuuuguugcccaggcuggagugcagugacguggucauagcu

SEQ ID NO: 168836 - RNA, 60 nt, Homo Sapiens
gcaauggcaguuguuucaccucuguuguccaggcuggaguuuuuugagauggaguuucgc

SEQ ID NO: 168837 - RNA, 60 nt, Homo Sapiens
gcaguggcacagucuuggcuccuguugugcaggcuggaguuuuugagauggagucuugcu

SEQ ID NO: 168838 - RNA, 60 nt, Homo Sapiens
gcaguggcgcaaucuuggcucucuguugccaggcuggaguuuuucugauacagagucuca

SEQ ID NO: 168839 - RNA, 60 nt, Homo Sapiens
gggguccaggagacugugugugaugcugcaaggcuggaacuccuuaacccaaugacccag

SEQ ID NO: 168840 - RNA, 60 nt, Homo Sapiens
acugagcugucaaaagaauccccacuuuguaggcuggaaacaguagcaggaauaauaaau

SEQ ID NO: 168841 - RNA, 60 nt, Homo Sapiens
gauggacagaggcccaaugguuggguccccaggcuggaaaugggccuuguggggcaaaua

SEQ ID NO: 168842 - RNA, 60 nt, Homo Sapiens
gaagccacaucaggaggacgggggugguagaggcuggaagcuccuuggaggaggccccca

SEQ ID NO: 168843 - RNA, 64 nt, Homo Sapiens
ugagcacucuucugugcacugucaaauaggaaacaucacaaaacauccuggggaaaaagcaucu

SEQ ID NO: 168844 - RNA, 64 nt, Homo Sapiens
aaaaaagguuugccaagcucaugaaagcauuuuuaucacaaaauguaguuaagaugaaauuuau

SEQ ID NO: 168845 - RNA, 56 nt, Homo Sapiens
ucauagugauugaggcauaacuaucaaucacaaaaguauauucaaaaauuauauuu

SEQ ID NO: 168846 - RNA, 64 nt, Homo Sapiens
acaacucgaaucacucauuuauuuccauauuaaaaucacaaacucauccauuaauguagauaaa

SEQ ID NO: 168847 - RNA, 64 nt, Homo Sapiens
aaagccagugccuauugaguacaaaaaaagccacaucacaaaaaauaguguggaaagccacauc

SEQ ID NO: 168848 - RNA, 64 nt, Homo Sapiens
aagccacaucacaaaaaaaaguguggaaagccacaucacaaaaagauucuggacuucuacaaua

SEQ ID NO: 168849 - RNA, 64 nt, Homo Sapiens
gacaaagcacaauuccauaugguauguaacuuuuaucacaaaucaaauagugacaucacaaaca

SEQ ID NO: 168850 - RNA, 64 nt, Homo Sapiens
gguauguaacuuuuaucacaaaucaaauagugacaucacaaacauaauguccucuuuugcacaa

SEQ ID NO: 168851 - RNA, 64 nt, Homo Sapiens
ggcaauggaauauaauggaauauucuugagacugaucacaaaaaaaaaaaccuuuuuaauauuu

SEQ ID NO: 168852 - RNA, 64 nt, Homo Sapiens
ucuucuaagacggacacauuugaaccucagguucaucacaaaccugguaccuguugcuucccag

SEQ ID NO: 168853 - RNA, 64 nt, Homo Sapiens
acuccaaccacauuccaagcugagauaaaaucaaaucacaaauguuuaaccacuuugcugcuga

SEQ ID NO: 168854 - RNA, 64 nt, Homo Sapiens
acuccacaggaaaauguaagcuacuuugucauagaucacaaaagaaucauaaugcuaacaaacu

SEQ ID NO: 168855 - RNA, 64 nt, Homo Sapiens
uuuauugguauuauuuuauaauagaaauaugucuaucacaaaucuaauguuaaguuuguaccua

SEQ ID NO: 168856 - RNA, 64 nt, Homo Sapiens
uuugcccaaaguguauggcuucauauuuauagccaucacaaaauuucugauuuuuuaaguguuu

SEQ ID NO: 168857 - RNA, 64 nt, Homo Sapiens
aaguguguuccuguuucuucacgagcagacucgcaucacaaagcaugaauguuaacccacagaa

SEQ ID NO: 168858 - RNA, 64 nt, Homo Sapiens
caaucugugugcugguuuuguugguuauguggaaaucacaaacuccagaggagcaaagggguuu

SEQ ID NO: 168859 - RNA, 64 nt, Homo Sapiens
aaaaggagaucuguauucggaucaucauacaaaaaucacaaacaguagaggcagaggcaaaguu

SEQ ID NO: 168860 - RNA, 64 nt, Homo Sapiens
cccaaguuucaauucuaacuuuccuuccauuuauaucacaaauaugucacugcucaucaguuac

SEQ ID NO: 168861 - RNA, 64 nt, Homo Sapiens; identical to SEQ ID NO: 52915

SEQ ID NO: 168862 - RNA, 64 nt, Homo Sapiens; identical to SEQ ID NO: 52916

SEQ ID NO: 168863 - RNA, 64 nt, Homo Sapiens
gaccauacaaguggauuaugguugucuggauggcagauaccaauagcaacauugucauaugcag

SEQ ID NO: 168864 - RNA, 64 nt, Homo Sapiens
auccaggccuagacucaagguauuguaaaugacaagauaccaaauacaagauuuuaaaagcaac

SEQ ID NO: 168865 - RNA, 64 nt, Homo Sapiens
ugaggaaugaggugugauuucccugaguguguccagauaccaaggcagauugcuucccagggcu

SEQ ID NO: 168866 - RNA, 64 nt, Homo Sapiens
uuuucuuccuauugaaaacacugguuuuaaaaccagauaccacaagucuuuggugguuguaggg

SEQ ID NO: 168867 - RNA, 64 nt, Homo Sapiens
guuguuacuauuguguuauucaugucuuuaaaucagauaccaaauauuuuuuaggaaagaaaaa

SEQ ID NO: 168868 - RNA, 64 nt, Homo Sapiens
aucuauaaaaacaagguuagcauauucucaacacagauaccaccacuuucuuuuucccauuaua

SEQ ID NO: 168869 - RNA, 64 nt, Homo Sapiens
gugucugugggggauugguuccaguuaccccuauagauaccaaaaucugcagaugcucaagucc

SEQ ID NO: 168870 - RNA, 64 nt, Homo Sapiens
caacccagcaaucucauuacggggauaaagacagagauaccauugccauuguggaagacagugu

SEQ ID NO: 168871 - RNA, 64 nt, Homo Sapiens
ucacaccaguccaaauggcuucgaaacaacaacgagauaccaucgaucauuagagaaaugcaaa

SEQ ID NO: 168872 - RNA, 64 nt, Homo Sapiens
uagagggcacuagaacuuugugccagcgcuggcgagauaccauggugccauccuccuuucuaua

SEQ ID NO: 168873 - RNA, 64 nt, Homo Sapiens
ucucaugcucucugaacagaagguauaccugggaagauaccagcuuuuucucucaggguucuga

SEQ ID NO: 168874 - RNA, 64 nt, Homo Sapiens
uagaggcccauuccugcauuuaugaucauccucuagauaccagaucuguccucauuuuguuucc

SEQ ID NO: 168875 - RNA, 64 nt, Homo Sapiens
ugccucuguccucauuuuguguaccacuuuuagaagauaccagaacaugacaggcgggaguuuu

SEQ ID NO: 168876 - RNA, 64 nt, Homo Sapiens; identical to SEQ ID NO: 60066

SEQ ID NO: 168877 - RNA, 64 nt, Homo Sapiens; identical to SEQ ID NO: 60067

SEQ ID NO: 168878 - RNA, 64 nt, Homo Sapiens; identical to SEQ ID NO: 60068

SEQ ID NO: 168879 - RNA, 64 nt, Homo Sapiens; identical to SEQ ID NO: 60069

SEQ ID NO: 168880 - RNA, 64 nt, Homo Sapiens; identical to SEQ ID NO: 60070

SEQ ID NO: 168881 - RNA, 64 nt, Homo Sapiens; identical to SEQ ID NO: 60071

SEQ ID NO: 168882 - RNA, 64 nt, Homo Sapiens; identical to SEQ ID NO: 60072

SEQ ID NO: 168883 - RNA, 64 nt, Homo Sapiens; identical to SEQ ID NO: 60073

SEQ ID NO: 168884 - RNA, 64 nt, Homo Sapiens; identical to SEQ ID NO: 60074

SEQ ID NO: 168885 - RNA, 64 nt, Homo Sapiens; identical to SEQ ID NO: 60075

SEQ ID NO: 168886 - RNA, 64 nt, Homo Sapiens; identical to SEQ ID NO: 60076

SEQ ID NO: 168887 - RNA, 64 nt, Homo Sapiens
auucaacccuauagaaggagccuggacucugaucccucuguacaggcuggauggaaggggcccu

SEQ ID NO: 168888 - RNA, 64 nt, Homo Sapiens
acuuguugagagaugugacaugguucuuggauuuccucuguagcagccuccuggacuuccugag

SEQ ID NO: 168889 - RNA, 64 nt, Homo Sapiens
gaaacuaaauaaaaauguuuaaaagucuauuuaaccucuguaauauauuuuguauggaugucau

SEQ ID NO: 168890 - RNA, 64 nt, Homo Sapiens
ccaacauccagugugauuuuaugagagaauccugccucuguagaauuucaagagucauccagca

SEQ ID NO: 168891 - RNA, 64 nt, Homo Sapiens
acaccaaaaaaguaaugaucguaaagacacaaauccucuguaugccaucuugcauuggcacuga

SEQ ID NO: 168892 - RNA, 64 nt, Homo Sapiens
gccaagcaccaguccaucaccccucccaggccagccucuguaaguuggccacacuuggggagug

SEQ ID NO: 168893 - RNA, 64 nt, Homo Sapiens
cauuucucuuucugcugugucuucacaucacccuccucuguauaccuaaucugccucugccucu

SEQ ID NO: 168894 - RNA, 64 nt, Homo Sapiens
cacuucuuccucuguucccacacuugggccucugccucuguaccugcagcucugcucucgggau

SEQ ID NO: 168895 - RNA, 64 nt, Homo Sapiens
uauuuuuaaaaacaacuuaaccuuccuaaguuuaagggaaaagugguaaauuagcgaaaucaac

SEQ ID NO: 168896 - RNA, 64 nt, Homo Sapiens
ggagccuaccacaaggcuccuccugaagauacuuagggaaaacauaauacagggacaggguguc

SEQ ID NO: 168897 - RNA, 64 nt, Homo Sapiens
ccuaaauuuaccuuaaauaauugaugacauuuaaagggaaaaguuuaccucuugagauauauua

SEQ ID NO: 168898 - RNA, 64 nt, Homo Sapiens
auuaccucuugagauauauuaccugaaaaucaugagggaaaaugguaaaacuuuuaaauucaac

SEQ ID NO: 168899 - RNA, 64 nt, Homo Sapiens
aaaaaccuggaacuccauaauaaaaaaaaaauucagggaaaauuuucuugccaauuuuguuguu

SEQ ID NO: 168900 - RNA, 64 nt, Homo Sapiens
cccacagggaccagaauguuguuuguugggggugagggaaaaaaagguugggguggccauaaug

SEQ ID NO: 168901 - RNA, 64 nt, Homo Sapiens
uccaugucaguuucuuucacauacaucucuugaaagggaaaauaucacaguggguaaauauauc

SEQ ID NO: 168902 - RNA, 64 nt, Homo Sapiens
cagggaaggggagaagaaagcggggaugggagaaagggaaaaguuccauugugggguagguggu

SEQ ID NO: 168903 - RNA, 64 nt, Homo Sapiens
uuuuguagaguauaggggagcaaggccuagucccagggaaaacacuaauauguaguggccuuuu

SEQ ID NO: 168904 - RNA, 64 nt, Homo Sapiens
caaccuacucugaaagccuuagacaaacagaaggagggaaaaacgagcuguaagaagaaaaugg

SEQ ID NO: 168905 - RNA, 64 nt, Homo Sapiens
auaaugugugauuaaaugcuuuuuuaaauugcuaagggaaaauaacaaaguguuaguaaucauu

SEQ ID NO: 168906 - RNA, 64 nt, Homo Sapiens
uuucaauagauuauucugccauuuuuuaaaggaaagggaaaaugaaaacagcaugucuuuuuaa

SEQ ID NO: 168907 - RNA, 64 nt, Homo Sapiens
caguggaaugaagucuuugauggguaggagagagagggaaaaccucaaacuacaucauagaagu

SEQ ID NO: 168908 - RNA, 64 nt, Homo Sapiens
aacauggcgagacccuguuucuacaaaaagaaaaagggaaaaaaaaagcagggacugucauucu

SEQ ID NO: 168909 - RNA, 64 nt, Homo Sapiens
caaugaaaaaaggucaguugauuccagugcuaaaagggaaaaaccugugguccgcccagaagag

SEQ ID NO: 168910 - RNA, 64 nt, Homo Sapiens
gcagaaaagaaaaaaagguuaagcauaaaaagaaagggaaaaagcagaaacacugcagaagaca

SEQ ID NO: 168911 - RNA, 64 nt, Homo Sapiens
gagaacacaccaaaaaagugaaagagaaauugaaagggaaaaaagacaaaaagcauaaggcucc

SEQ ID NO: 168912 - RNA, 64 nt, Homo Sapiens
aaaagucuguaauuucaguuuuugugucggggagagggaaaaacuauuugucuguaguugcuuu

SEQ ID NO: 168913 - RNA, 64 nt, Homo Sapiens
auucuucuguaaugagaauagacuggaacaugugagggaaaaauauuuaaaaaaagauggcagu

SEQ ID NO: 168914 - RNA, 64 nt, Homo Sapiens
ucgcuugaaaccuucccacacucccugcuccaggagggaaaaacagauguuguugacagauaga

SEQ ID NO: 168915 - RNA, 64 nt, Homo Sapiens
aggccaggauuaaggggaggcaaucaaugcaccuagggaaaaaauuuaaggagguauucacacu

SEQ ID NO: 168916 - RNA, 64 nt, Homo Sapiens
cacucuaaggccuuugacugcagaggcaccuguuagggaaaaucagaugucucauauaauaagg

SEQ ID NO: 168917 - RNA, 64 nt, Homo Sapiens
aguguagggcuaucuuuuuaaaaaaugucaacaaagggaaaauaaacuaucagcuuggaugguc

SEQ ID NO: 168918 - RNA, 64 nt, Homo Sapiens
ggguccuugaaacagaaaaaguaggaaauccaguagggaaaauacugaauacuugaaguaggaa

SEQ ID NO: 168919 - RNA, 64 nt, Homo Sapiens
accaaauuuugaggucuuuuuuaaagcacaugccagggaaaaaguauguggauacagucauuau

SEQ ID NO: 168920 - RNA, 64 nt, Homo Sapiens
agaacuggaaaugaaacagaucugaaggcaggucagggaaaagaggguagaaguuaaaggagaa

SEQ ID NO: 168921 - RNA, 64 nt, Homo Sapiens
cugucaguagauggaggcaauuaugggggagaaaagggaaaaugaaagcgcuuuuggggguggc

SEQ ID NO: 168922 - RNA, 64 nt, Homo Sapiens
cugaaaaggguucuggaguguucauucagagugaagggaaaacuuuauccuucuauuucuuaua

SEQ ID NO: 168923 - RNA, 64 nt, Homo Sapiens
aggaaugagaacuuugcaguuggaugaauagagaagggaaaaguugcuggagcacggagugaag

SEQ ID NO: 168924 - RNA, 64 nt, Homo Sapiens
auuccauguaaacauuucaaacaggucuuucuguagggaaaauuucuuugaauuuaaagggugu

SEQ ID NO: 168925 - RNA, 64 nt, Homo Sapiens
ugcguuguaaacaugaggauagaauggaaauacaagggaaaaccucaccacugagcuuuaaaua

SEQ ID NO: 168926 - RNA, 64 nt, Homo Sapiens
ucugccacuugcacugugcuugcuccuaagcaaaagggaaaaggagcgcgcgugauagaagaaa

SEQ ID NO: 168927 - RNA, 64 nt, Homo Sapiens
gauuuuaauuugggcaucucuagagaacgcuuucagggaaaaauacuuuaauaguaaaaagauu

SEQ ID NO: 168928 - RNA, 64 nt, Homo Sapiens
cauuucuagauuauaaacugacuaaacuuacaucagggaaaaauugguauuuaugcaaaaaaaa

SEQ ID NO: 168929 - RNA, 64 nt, Homo Sapiens
uuagugauaagauucauacacucuguauuuggggagggaaaaccuuuuuaagcaugguggggca

SEQ ID NO: 168930 - RNA, 64 nt, Homo Sapiens
cacuguuuauaaaauuuccuuagagacuuuuugaagggaaaauagagcaacagggaaaaaugaa

SEQ ID NO: 168931 - RNA, 64 nt, Homo Sapiens
ccuuagagacuuuuugaagggaaaauagagcaacagggaaaaaugaaagaaaugucuugguuac

SEQ ID NO: 168932 - RNA, 64 nt, Homo Sapiens
uucaaagcauguuucuuuccacauucuguugacaagggaaaacccaauacacagcuacagacac

SEQ ID NO: 168933 - RNA, 64 nt, Homo Sapiens
ccaaaccaguugggagacuuugaaaaaccucagaagggaaaacuagggucuacgaagaauaggg

SEQ ID NO: 168934 - RNA, 64 nt, Homo Sapiens
gaagugcauuugauugguguuggcaggagcucccagggaaaaacugcccugcagggcugagaug

SEQ ID NO: 168935 - RNA, 64 nt, Homo Sapiens
gggugcugaggugaaagcauacuucagauaaacuagggaaaacugcacaucauauguccaugaa

SEQ ID NO: 168936 - RNA, 64 nt, Homo Sapiens
cccucagacaaggaacucucuccucucuuuuuggagggaaaaaaaaaauaucacuacacaaacc

SEQ ID NO: 168937 - RNA, 64 nt, Homo Sapiens
caauggaacuggucagugauucucuaccccaaguagggaaaaccuccaucuuuucccugucuuc

SEQ ID NO: 168938 - RNA, 64 nt, Homo Sapiens
cgcaucaggacugcuucaucgucuuggcugagaaagggaaaagacacacaagucgcguggguug

SEQ ID NO: 168939 - RNA, 64 nt, Homo Sapiens
agcgaggcccucugcaagaagcucaaggaagcucagggaaaauggacguauucagagaguguuu

SEQ ID NO: 168940 - RNA, 64 nt, Homo Sapiens
guuuccaaaaucaaagauuugaccuuaagagggaagggaaaaaagugugaaaggaugaugaaga

SEQ ID NO: 168941 - RNA, 64 nt, Homo Sapiens
ucuuuugccuuuaagacgauucauucuugucuagagggaaaaucuggcugauuugggaauaaaa

SEQ ID NO: 168942 - RNA, 64 nt, Homo Sapiens
aacugacuuuuauaaugaauuacgaaacacagaaagggaaaauauuacugacaaaaagggaaaa

SEQ ID NO: 168943 - RNA, 64 nt, Homo Sapiens
cgaaacacagaaagggaaaaauuuacugacaaaaagggaaaauauuccaaucaguguauugcuc

SEQ ID NO: 168944 - RNA, 64 nt, Homo Sapiens
aaaaaaguuguuugcuuaaaaaaaauuucaugugagggaaaaaaaaaaaaccuauuccagaaua

SEQ ID NO: 168945 - RNA, 64 nt, Homo Sapiens
gaaaacagaaaacaauuccacgaggccaaucuaaagggaaaaaauccuacacuacuuuuacuac

SEQ ID NO: 168946 - RNA, 64 nt, Homo Sapiens
ucuucaguuuuaacgaguaauuggauaaacccugagggaaaacggagguagauucagcaccuaa

SEQ ID NO: 168947 - RNA, 64 nt, Homo Sapiens
uagcugaugagguuacauggcaggaaaagucaaaagggaaaaggucagacugaacugugugcaa

SEQ ID NO: 168948 - RNA, 64 nt, Homo Sapiens
acauugcgauccauucaguguuuaugggaaaccaagggaaaagccaagguguuucauuuucguu

SEQ ID NO: 168949 - RNA, 64 nt, Homo Sapiens
cucuuguaauccgaaucucugucuuccauuugcaagggaaaagugcaauaugcauuuaaauaca

SEQ ID NO: 168950 - RNA, 64 nt, Homo Sapiens
auuugcauaacaauuccucuagaguagaaacugcagggaaaauuuccaugggagaaaauagaua

SEQ ID NO: 168951 - RNA, 64 nt, Homo Sapiens
cauguugcugcagaaguagguuuuaacucuucccagggaaaauuucacuuuguaagacccauau

SEQ ID NO: 168952 - RNA, 64 nt, Homo Sapiens
ucccuggacucccuccugccaauugagaugggcaagggaaaagggcagauucuucacugacuug

SEQ ID NO: 168953 - RNA, 64 nt, Homo Sapiens
caacuugaggcaaccuguccuauuuuuaauaaaaagggaaaaagauacauaaagugcuugaguc

SEQ ID NO: 168954 - RNA, 64 nt, Homo Sapiens
caaaucccaggcccugggaaaaggacuugagugcagggaaaacucuaccccuauuuguagggaa

SEQ ID NO: 168955 - RNA, 64 nt, Homo Sapiens
acuugagugcagggaaaacucuaccccuauuuguagggaaaagggucucugaggaugaaguuuc

SEQ ID NO: 168956 - RNA, 64 nt, Homo Sapiens
ucuccuaucuugauuucacucuaccuuaaacuuaagggaaaaguucuccuauuuuuuuuuuuaa

SEQ ID NO: 168957 - RNA, 61 nt, Homo Sapiens; identical to SEQ ID NO: 108347

SEQ ID NO: 168958 - RNA, 64 nt, Homo Sapiens
gcaagggccaaacauucuuuaucccucccaccccagggaaaacauuuggaaaauaguccuuuuu

SEQ ID NO: 168959 - RNA, 64 nt, Homo Sapiens
caccaaagacagagggagcuucacugagacucagagggaaaaggaaaagagccucaaacauuuu

SEQ ID NO: 168960 - RNA, 64 nt, Homo Sapiens
uuuaauuuuuaagucaaaaauuuaaaaauguaauagggaaaauaauuuuuggagauaguaaaaa

SEQ ID NO: 168961 - RNA, 64 nt, Homo Sapiens
cccaauaggauaacucaagugagguggaucugugagggaaaagaugcugaacagaagggcaaga

SEQ ID NO: 168962 - RNA, 64 nt, Homo Sapiens
ccaauggaugauuuucugggaaaaucaagugccuagggaaaauuccucuggcuauuuaagguuc

SEQ ID NO: 168963 - RNA, 64 nt, Homo Sapiens
gugcaaacugaguguuaguaacaaaugguuagcuagggaaaacagaauuacuuguuuacaucca

SEQ ID NO: 168964 - RNA, 64 nt, Homo Sapiens
cauuaaagcagcucccugcuaaaacuugcaauagagggaaaagcguugacuguccuuucaagga

SEQ ID NO: 168965 - RNA, 64 nt, Homo Sapiens
aaaauucuguagauagcaaauaauagagguuaaaagggaaaaaauccaccuccuuccugaacuc

SEQ ID NO: 168966 - RNA, 64 nt, Homo Sapiens
gggacaagcagguuuauguguuuaaacagaaagaagggaaaagguacuaugugauaugguacug

SEQ ID NO: 168967 - RNA, 64 nt, Homo Sapiens
uuuucaugaauuuugugaacuugccaaaaggggaagggaaaaaucuuuguguuacuucacucaa

SEQ ID NO: 168968 - RNA, 64 nt, Homo Sapiens
uagauacauaaagacuugagaagggaauuguuuaagggaaaagaaaagaguaauaauuuuuuuu

SEQ ID NO: 168969 - RNA, 64 nt, Homo Sapiens
caaauauuaaaauuaggaauuuaggcauuaccucagggaaaagccuugacagugaaaagaaacu

SEQ ID NO: 168970 - RNA, 64 nt, Homo Sapiens
agaaaagcugaugcuggcaagagaagguacccaaagggaaaaagaggccccugcaaagaaggga

SEQ ID NO: 168971 - RNA, 64 nt, Homo Sapiens
auuuuugaaaguagggugauaaauauuuucucucagggaaaauauuuauuggauaaauaugaau

SEQ ID NO: 168972 - RNA, 64 nt, Homo Sapiens
uuuauuguuaugaaacuguaaggucuacauauaaagggaaaaaguuaauguggaaagcugaucu

SEQ ID NO: 168973 - RNA, 64 nt, Homo Sapiens
auucccggcauaccuauuagugucuuaaaaaggaagggaaaagucuuuuguugcccucuccuau

SEQ ID NO: 168974 - RNA, 64 nt, Homo Sapiens
aaagaagaaaagauuuuugcugaguuuuaacagaagggaaaaggaaaaaaaaaagaaaggacau

SEQ ID NO: 168975 - RNA, 64 nt, Homo Sapiens
aaaugaaaacccuguugcugggggaaacggggggagggaaaaugaaacagcacuaaauaacuug

SEQ ID NO: 168976 - RNA, 64 nt, Homo Sapiens
cuuaugcagagaaaaguuuuggugugaauugcuaagggaaaaacgcucucaccaauuguagauu

SEQ ID NO: 168977 - RNA, 64 nt, Homo Sapiens
uuucagcaguuauuuagcccugaaggaaaagaauagggaaaagcucaucuuagaagaaacccca

SEQ ID NO: 168978 - RNA, 64 nt, Homo Sapiens
gcugcgacguacugucacugaugagagacugggaagggaaaagcauauauauauagauauauag

SEQ ID NO: 168979 - RNA, 64 nt, Homo Sapiens
cuacuucucugagcucagaaagugccccuugaugagggaaaaugucccacugcacugcgaauuu

SEQ ID NO: 168980 - RNA, 64 nt, Homo Sapiens
ggcuuuuaucuugcggggucagagcgcccucuagagggaaaagcuagaggcacaggguuucugc

SEQ ID NO: 168981 - RNA, 64 nt, Homo Sapiens
gaacaaccaccccguggcuuguguggggucucgcagggaaaagggcuggcuucuagguccccga

SEQ ID NO: 168982 - RNA, 64 nt, Homo Sapiens
guuuuguaaucaagauuuuauguaacauuuguaaagggaaaauuagcacuuuugugguucuuaa

SEQ ID NO: 168983 - RNA, 64 nt, Homo Sapiens
uguaaagggaaaauuagcacuuuugugguucuuaagggaaaagaaacagaccuuguggagauua

SEQ ID NO: 168984 - RNA, 64 nt, Homo Sapiens
ucucucagauccauaauccauacucagugaaagcagggaaaaaauauuuucacuuauuuuauuu

SEQ ID NO: 168985 - RNA, 64 nt, Homo Sapiens
accuguguaaguauugugaaaacccuuuucuuccagggaaaaauuauuggaaauuccuuaacug

SEQ ID NO: 168986 - RNA, 64 nt, Homo Sapiens
cauagaacacgguuacagcugguucuguagaaagagggaaaagaugauugugacaauucagagc

SEQ ID NO: 168987 - RNA, 64 nt, Homo Sapiens
agauucucuggcucagccccagccuuucugaagaagggaaaacuagggacccagaugguuuaag

SEQ ID NO: 168988 - RNA, 64 nt, Homo Sapiens
aauugcaguuauugauucuuaaauuugauggagaagggaaaauauuaacuuccuauucuuucuu

SEQ ID NO: 168989 - RNA, 64 nt, Homo Sapiens
uuuacuugugggggugggagcaauguguuucaaaagggaaaacuucaguaggauauccaaaguu

SEQ ID NO: 168990 - RNA, 64 nt, Homo Sapiens
uucccauccucuucuuuuagcaguaaaauagcugagggaaaagggagggaaaaggaaguuaugg

SEQ ID NO: 168991 - RNA, 64 nt, Homo Sapiens
uucuuuuagcaguaaaauagcugagggaaaagggagggaaaaggaaguuaugggaauaccugug

SEQ ID NO: 168992 - RNA, 64 nt, Homo Sapiens
caccauacaaguauuuguuuaucauuauuuugauauccauuacccucaccucucccuaguucau

SEQ ID NO: 168993 - RNA, 64 nt, Homo Sapiens
agacauuugccuuaggaacuuaacucuuguuuguauccauuagucuaugguaaaauugguuuug

SEQ ID NO: 168994 - RNA, 64 nt, Homo Sapiens
uaauuauguuuggucuauuguaucagagaaguugauccauuaaguucucuuccugccuuuccuc

SEQ ID NO: 168995 - RNA, 64 nt, Homo Sapiens
caagucccaaggugaccucuagccagucugaaguauccauuacuccaggguuuagagugaaaac

SEQ ID NO: 168996 - RNA, 64 nt, Homo Sapiens
cauaagaacagcuaccuucuccacuugguggcacaagagguagggaggggaguauggguucauu

SEQ ID NO: 168997 - RNA, 64 nt, Homo Sapiens
aaguuaaaggaaacaaaauuuguaccauugucccaagagguauuuuacuguauauauuguggua

SEQ ID NO: 168998 - RNA, 64 nt, Homo Sapiens
auuuguagaaaaaauuugauuuuaacuuuuuggaaagagguaucacaguauucugugaugucuu

SEQ ID NO: 168999 - RNA, 64 nt, Homo Sapiens
uuuuacugaaaauuagggcaggaaagguaggaagaagagguaauagguaccauucaaagcaggg

SEQ ID NO: 169000 - RNA, 64 nt, Homo Sapiens
aguuuuauuauaaaccaagaauuuuggacuugcaaagagguauuauugcaauaaugcacuuuuc

SEQ ID NO: 169001 - RNA, 64 nt, Homo Sapiens
aaugggaaugauuucuguauguucccuugguaccaagagguacuaugcaaaguaaccuauuaca

SEQ ID NO: 169002 - RNA, 64 nt, Homo Sapiens
uauaucuaauuaugucuaugugguaauaccuaaaaagagguagagagacucuauguucacaaaa

SEQ ID NO: 169003 - RNA, 64 nt, Homo Sapiens
agaauaccccugcuauuuaaauaaagcucauaccaagagguaacauuuugccccgggccaaauu

SEQ ID NO: 169004 - RNA, 64 nt, Homo Sapiens
caccagaagugccaugcucagaaauguugguuacaugaaugaaugaaccaugaaugaaugaaau

SEQ ID NO: 169005 - RNA, 64 nt, Homo Sapiens
agaagugccaugcucagaaauguugguuacaugaaugaaugaaccaugaaugaaugaaaucucu

SEQ ID NO: 169006 - RNA, 64 nt, Homo Sapiens
gcucagaaauguugguuacaugaaugaaugaaccaugaaugaaugaaaucucuguccgugugcu

SEQ ID NO: 169007 - RNA, 64 nt, Homo Sapiens
aauauacagcuacuucccagcuaaucuccacccaaugaaugaugaugguauaguaugugcauaa

SEQ ID NO: 169008 - RNA, 64 nt, Homo Sapiens
gguaaaaaaaaaaacuaaggcauuugauuaaauuaugaaugaguuuuacaaauuccuuucagag

SEQ ID NO: 169009 - RNA, 64 nt, Homo Sapiens
aagaaaacuguggguaaucagacugaaugaaugaaugaaugaggcaauuacuauuugacugacu

SEQ ID NO: 169010 - RNA, 64 nt, Homo Sapiens
gaggaagaaaacuguggguagacugacugaaugaaugaaugaauugcucaauuacuauuugacu

SEQ ID NO: 169011 - RNA, 64 nt, Homo Sapiens
gaaugaggaagaaaacuguggacugacugacugaaugaaugaaugaggugcucaauuacuauuu

SEQ ID NO: 169012 - RNA, 64 nt, Homo Sapiens
auaguguucuuugaauuaguugaauaaaauugauaugaaugaauauuuuauuguucauaauuaa

SEQ ID NO: 169013 - RNA, 64 nt, Homo Sapiens
uuugcauuuaaguuguuugaagguauuauuaagaaugaaugauugaagcaaggcaugaacugcu

SEQ ID NO: 169014 - RNA, 64 nt, Homo Sapiens
ugugguaggugcucaguaaauguguguugaauaaaugaaugaaugaaugaacaaaugaaugaau

SEQ ID NO: 169015 - RNA, 64 nt, Homo Sapiens
guaggugcucaguaaauguguguugaauaaaugaaugaaugaaugaacaaaugaaugaauuugc

SEQ ID NO: 169016 - RNA, 64 nt, Homo Sapiens
gugcucaguaaauguguguugaauaaaugaaugaaugaaugaacaaaugaaugaauuugcuuac

SEQ ID NO: 169017 - RNA, 64 nt, Homo Sapiens
uguguguugaauaaaugaaugaaugaaugaacaaaugaaugaauuugcuuacuucaaggcaaaa

SEQ ID NO: 169018 - RNA, 64 nt, Homo Sapiens
gagacuagaaauguaucuaaauugggggaacagaaugaaugaauuaaugaaugagaguuccuuu

SEQ ID NO: 169019 - RNA, 64 nt, Homo Sapiens
guaucuaaauugggggaacagaaugaaugaauuaaugaaugagaguuccuuugcuuuaaccauu

SEQ ID NO: 169020 - RNA, 64 nt, Homo Sapiens
cggagacucugucucaaaaaaaaaaaaaaaaaagaugaaugaaaauaugaaauauauaaacuag

SEQ ID NO: 169021 - RNA, 64 nt, Homo Sapiens
acagauuauaccuggaugauucaggagaguguauaugaaugaauaaagcauccaaguauauaug

SEQ ID NO: 169022 - RNA, 64 nt, Homo Sapiens
aguguauaugaaugaauaaagcauccaaguauauaugaaugaauaaaguauguaaguaucacca

SEQ ID NO: 169023 - RNA, 64 nt, Homo Sapiens
aaaggaaaaaaaaggcgcaguggugaugacccucaugaaugagccacgcuucugcauucuucuu

SEQ ID NO: 169024 - RNA, 64 nt, Homo Sapiens
uuauucaaaaaaauguacuggugugauaucuuguaugaaugaucauuuaaauacaguacauuac

SEQ ID NO: 169025 - RNA, 64 nt, Homo Sapiens
acccaaaaggcagaagcaacccaaauguucaucaaugaaugaaugaauggcuaagcaaaaugug

SEQ ID NO: 169026 - RNA, 64 nt, Homo Sapiens
aaaaggcagaagcaacccaaauguucaucaaugaaugaaugaauggcuaagcaaaaugugauau

SEQ ID NO: 169027 - RNA, 64 nt, Homo Sapiens
gccuagcacacaguaggcgcucaauaaauguugaaugaaugaaugauuuaaucaagacuugauc

SEQ ID NO: 169028 - RNA, 64 nt, Homo Sapiens
agcacacaguaggcgcucaauaaauguugaaugaaugaaugauuuaaucaagacuugaucaccc

SEQ ID NO: 169029 - RNA, 64 nt, Homo Sapiens
uuagccagugcagggggaaaauugccucugaauaaugaaugaugaaagccugacgccgugcccc

SEQ ID NO: 169030 - RNA, 64 nt, Homo Sapiens
ccccacugcccccaccuuaaugugaauuugacugaugaaugaagagcguuucuaauaaaguuug

SEQ ID NO: 169031 - RNA, 64 nt, Homo Sapiens
cuuuguaggcgccaucagccuggugaagaaaagaaugaaugauuaagccaagaacagccuuuau

SEQ ID NO: 169032 - RNA, 64 nt, Homo Sapiens
caacaaggaagagagaccaucauuauuuuagagaaugaaugaaguucaucugccuaggccuacu

SEQ ID NO: 169033 - RNA, 64 nt, Homo Sapiens
uucccagccaagggccucggggagcguucuaaauaugaaugaaugggauauuuugaaaugaacu

SEQ ID NO: 169034 - RNA, 64 nt, Homo Sapiens
auucuuugcaauacugcuuaauugcugauaccauaugaaugaaacaugggcugugauuacugca

SEQ ID NO: 169035 - RNA, 64 nt, Homo Sapiens
auggauugcuguuaacuagaaaaauagggaaugaaugaaugaauugcuaugauauauuuauuau

SEQ ID NO: 169036 - RNA, 64 nt, Homo Sapiens
gaauauggauugcuguuaacuuauaaaauagggaaugaaugaauucacugcuaugauauauuua

SEQ ID NO: 169037 - RNA, 64 nt, Homo Sapiens
uguucuguaaaagauuuguccaauaaacgacuuaaugaaugauacaucagucagauuuuaggaa

SEQ ID NO: 169038 - RNA, 64 nt, Homo Sapiens
aucucuaaacuauugacuaaauuccagugagaguaugaaugaagaacaacuagauauuaauguc

SEQ ID NO: 169039 - RNA, 64 nt, Homo Sapiens
gggcuguaguugggccuaaauguccguccaugccaugaaugaguuacuuuagacuaauuguguu

SEQ ID NO: 169040 - RNA, 64 nt, Homo Sapiens
aaaccugugaucuaguccuucacaugguuuaaauaugaaugaacgggauuuuuggugcaaguag

SEQ ID NO: 169041 - RNA, 59 nt, Homo Sapiens
ugaaguuaggaaauccuugaaagaaaaucaugaaugaacaaagguaauaugucuagcac

SEQ ID NO: 169042 - RNA, 64 nt, Homo Sapiens
uucuaagugaacauuccuuauagaaaccuuucacaugaaugacuauaaacugaagcuuuaaaug

SEQ ID NO: 169043 - RNA, 64 nt, Homo Sapiens
uugagccuuuuuuuuuaagcuuucaguuguugcuaugaaugauuaaacaaccaauuuuuuuguu

SEQ ID NO: 169044 - RNA, 64 nt, Homo Sapiens
gccagaucuccacugugugaagaaaugcuuugguaugaaugagaaaauauggaggucauuacca

SEQ ID NO: 169045 - RNA, 64 nt, Homo Sapiens
guauagcgugaaagcagcuauacacaauacagaaaugaaugagugugguuauguucuaauaaaa

SEQ ID NO: 169046 - RNA, 64 nt, Homo Sapiens
ugggcuauuagaguucauggaacauagaacaaccaugaaugaguggcaugauccgugcuuaaug

SEQ ID NO: 169047 - RNA, 64 nt, Homo Sapiens
aaggaauacuuuuaguuugacagccuuauaugacaugaaugaaaacugcuguuuuaaagugguu

SEQ ID NO: 169048 - RNA, 64 nt, Homo Sapiens
guuuuauuacagauuuaaucacaaaucauuuuuuaugaaugauugagugaaaauaguguuuaua

SEQ ID NO: 169049 - RNA, 64 nt, Homo Sapiens
cccugaauuuggccugcacuucuuugggauugcuaugaaugauaggccucuuuaagaguuaguu

SEQ ID NO: 169050 - RNA, 64 nt, Homo Sapiens
ucccaggcagagaaucauacucaggaacagaaggaugaaugagggccaaacccaugaggcaaug

SEQ ID NO: 169051 - RNA, 64 nt, Homo Sapiens
aaggggugccaggagacugcuagguacugaaugaaugaaugaacccucaaagccuagcacauag

SEQ ID NO: 169052 - RNA, 64 nt, Homo Sapiens
gaacaaggggugccaggagaauaguagguacugaaugaaugaauauauccucaaagccuagcac

SEQ ID NO: 169053 - RNA, 64 nt, Homo Sapiens
ggcucagcugaggaauguaagaaugacugaaugaaugaaugaaucuuucaguaagugggugaau

SEQ ID NO: 169054 - RNA, 64 nt, Homo Sapiens
gaauggcucagcugaggaaugaaugaaugacugaaugaaugaaugcagcuuucaguaagugggu

SEQ ID NO: 169055 - RNA, 64 nt, Homo Sapiens
gaaugaaugaaugaauggcucaguaagugggugaaugaaugacuccuggcacuuaggcagcuuu

SEQ ID NO: 169056 - RNA, 64 nt, Homo Sapiens
agagcucggccaucacgucaagcuuuggauaacgaugaaugagccguauacaaggaauaugaca

SEQ ID NO: 169057 - RNA, 64 nt, Homo Sapiens
ucugauuauacaccauuuuugagcagaucuuggaaugaaugacaugaccuuucccuagagaaua

SEQ ID NO: 169058 - RNA, 64 nt, Homo Sapiens
aaaaaggcuagaguacgaauaaagacuucuaucuaugaaugauugaaacauaaggaguggguac

SEQ ID NO: 169059 - RNA, 64 nt, Homo Sapiens
agaaacauaaggaguggguauuauacaccuguuuaugaaugaaauguuuauaagacauuguucc

SEQ ID NO: 169060 - RNA, 64 nt, Homo Sapiens
aagauccucucugauccuguauguggauauggccaugaaugagcucuacugaguggccaugggc

SEQ ID NO: 169061 - RNA, 64 nt, Homo Sapiens
uauugcucucuuuauaaugauuaaucacuuuauuaugaaugaaugaaugaauuugauggauuua

SEQ ID NO: 169062 - RNA, 64 nt, Homo Sapiens
gcucucuuuauaaugauuaaucacuuuauuaugaaugaaugaaugaauuugauggauuuaaaau

SEQ ID NO: 169063 - RNA, 64 nt, Homo Sapiens
ucuuuauaaugauuaaucacuuuauuaugaaugaaugaaugaauuugauggauuuaaaauggcu

SEQ ID NO: 169064 - RNA, 64 nt, Homo Sapiens
uugugcaguauuuaugugauugugccuaugcaugaugaaugaaugaauuucaguuguacauugc

SEQ ID NO: 169065 - RNA, 64 nt, Homo Sapiens
gcaguauuuaugugauugugccuaugcaugaugaaugaaugaauuucaguuguacauugccuaa

SEQ ID NO: 169066 - RNA, 64 nt, Homo Sapiens
gcacuugacuagucuuaaaacaaagaaagaacgaaugaaugaaugaaucuguggcuggaugcag

SEQ ID NO: 169067 - RNA, 64 nt, Homo Sapiens
uugacuagucuuaaaacaaagaaagaacgaaugaaugaaugaaucuguggcuggaugcaguggc

SEQ ID NO: 169068 - RNA, 64 nt, Homo Sapiens
gcuugccacagagcggggacucgguaagcacuuaaugaaugaaugaauucuaagucaauccaag

SEQ ID NO: 169069 - RNA, 64 nt, Homo Sapiens
gccacagagcggggacucgguaagcacuuaaugaaugaaugaauucuaagucaauccaagaguc

SEQ ID NO: 169070 - RNA, 64 nt, Homo Sapiens
uucaguuguacauugccuaaccuaugcaugaugaaugaaugaaugcaguauuuaugugauugug

SEQ ID NO: 169071 - RNA, 64 nt, Homo Sapiens
gaauuucaguuguacauugcugugccuaugcaugaugaaugaauuugugcaguauuuaugugau

SEQ ID NO: 169072 - RNA, 64 nt, Homo Sapiens
aaacauauuugaaaguuaacgggcauguauauguaugaaugagcccugcauauauauguaugaa

SEQ ID NO: 169073 - RNA, 64 nt, Homo Sapiens
auacauuuccugcauauauagaguguauauguguaugaaugaacaagaguauaaauagaaggga

SEQ ID NO: 169074 - RNA, 64 nt, Homo Sapiens
ucaagcgaugaaacuggaaaacuacaagccacgaaugaaugaauuaggaaagaaaaaaaguagg

SEQ ID NO: 169075 - RNA, 64 nt, Homo Sapiens
gaaugaaugaauuaggaaagaaaaaaaguaggaaaugaaugaucuuggcuuuccuauaagaaau

SEQ ID NO: 169076 - RNA, 64 nt, Homo Sapiens
auggcuauguuuuaauaaaaauagacaaucauaaaugaaugaucauugugauaugaaaacagcu

SEQ ID NO: 169077 - RNA, 64 nt, Homo Sapiens
auggcuauguuuuaauaaaaauagacaaucauaaaugaaugaucacugugguaugaaaacagcu

SEQ ID NO: 169078 - RNA, 64 nt, Homo Sapiens
uguauauugacuuucaugucgucaugcaucugucaugaaugaaugauacuuugcacugggcugu

SEQ ID NO: 169079 - RNA, 64 nt, Homo Sapiens
uauugacuuucaugucgucaugcaucugucaugaaugaaugauacuuugcacugggcuguacga

SEQ ID NO: 169080 - RNA, 64 nt, Homo Sapiens
uauguauaaguguguacaagcauucaagaaacugaugaaugaugaaugaaugaaugagccaaag

SEQ ID NO: 169081 - RNA, 64 nt, Homo Sapiens
aaguguguacaagcauucaagaaacugaugaaugaugaaugaaugaaugagccaaagaacaaau

SEQ ID NO: 169082 - RNA, 64 nt, Homo Sapiens
guguacaagcauucaagaaacugaugaaugaugaaugaaugaaugagccaaagaacaaauaaau

SEQ ID NO: 169083 - RNA, 64 nt, Homo Sapiens
acaagcauucaagaaacugaugaaugaugaaugaaugaaugagccaaagaacaaauaaaugagc

SEQ ID NO: 169084 - RNA, 64 nt, Homo Sapiens
ggcagagagcggauacucaaguaaguuuuguuaaaugaaugaaugaauuuagaaccacacaaug

SEQ ID NO: 169085 - RNA, 64 nt, Homo Sapiens
gagagcggauacucaaguaaguuuuguuaaaugaaugaaugaauuuagaaccacacaaugccaa

SEQ ID NO: 169086 - RNA, 64 nt, Homo Sapiens
cggggaauucuuaaaacugugcucaacuauuaaaaugaaugagcuuucuuugugucuguguuac

SEQ ID NO: 169087 - RNA, 64 nt, Homo Sapiens
uccuagaaucucaaguggaauuggaaucauaaaaaugaaugagauuugaaaacuuucacaaaga

SEQ ID NO: 169088 - RNA, 64 nt, Homo Sapiens
aauuuacaauuuaugugcuuauaaaauuaguuuuaugaaugaacaauaaacugaugcauauaau

SEQ ID NO: 169089 - RNA, 64 nt, Homo Sapiens; identical to SEQ ID NO: 72083

SEQ ID NO: 169090 - RNA, 64 nt, Homo Sapiens; identical to SEQ ID NO: 72084

SEQ ID NO: 169091 - RNA, 64 nt, Homo Sapiens; identical to SEQ ID NO: 72085

SEQ ID NO: 169092 - RNA, 64 nt, Homo Sapiens; identical to SEQ ID NO: 72086

SEQ ID NO: 169093 - RNA, 64 nt, Homo Sapiens; identical to SEQ ID NO: 72087

SEQ ID NO: 169094 - RNA, 64 nt, Homo Sapiens; identical to SEQ ID NO: 72088

SEQ ID NO: 169095 - RNA, 64 nt, Homo Sapiens; identical to SEQ ID NO: 72089

SEQ ID NO: 169096 - RNA, 64 nt, Homo Sapiens; identical to SEQ ID NO: 72090

SEQ ID NO: 169097 - RNA, 64 nt, Homo Sapiens; identical to SEQ ID NO: 72091

SEQ ID NO: 169098 - RNA, 64 nt, Homo Sapiens; identical to SEQ ID NO: 72092

SEQ ID NO: 169099 - RNA, 64 nt, Homo Sapiens; identical to SEQ ID NO: 72093

SEQ ID NO: 169100 - RNA, 64 nt, Homo Sapiens; identical to SEQ ID NO: 72094

SEQ ID NO: 169101 - RNA, 64 nt, Homo Sapiens; identical to SEQ ID NO: 72095

SEQ ID NO: 169102 - RNA, 64 nt, Homo Sapiens; identical to SEQ ID NO: 72096

SEQ ID NO: 169103 - RNA, 64 nt, Homo Sapiens; identical to SEQ ID NO: 72097

SEQ ID NO: 169104 - RNA, 64 nt, Homo Sapiens; identical to SEQ ID NO: 72098

SEQ ID NO: 169105 - RNA, 64 nt, Homo Sapiens; identical to SEQ ID NO: 72099

SEQ ID NO: 169106 - RNA, 64 nt, Homo Sapiens; identical to SEQ ID NO: 72100

SEQ ID NO: 169107 - RNA, 64 nt, Homo Sapiens; identical to SEQ ID NO: 72101

SEQ ID NO: 169108 - RNA, 64 nt, Homo Sapiens; identical to SEQ ID NO: 72102

SEQ ID NO: 169109 - RNA, 64 nt, Homo Sapiens; identical to SEQ ID NO: 72103

SEQ ID NO: 169110 - RNA, 64 nt, Homo Sapiens; identical to SEQ ID NO: 72104

SEQ ID NO: 169111 - RNA, 64 nt, Homo Sapiens; identical to SEQ ID NO: 72105

SEQ ID NO: 169112 - RNA, 64 nt, Homo Sapiens; identical to SEQ ID NO: 72106

SEQ ID NO: 169113 - RNA, 64 nt, Homo Sapiens; identical to SEQ ID NO: 72107

SEQ ID NO: 169114 - RNA, 64 nt, Homo Sapiens; identical to SEQ ID NO: 72108

SEQ ID NO: 169115 - RNA, 64 nt, Homo Sapiens; identical to SEQ ID NO: 72109

SEQ ID NO: 169116 - RNA, 64 nt, Homo Sapiens
gcccacaaggcuaaaauauuuacauucucacccauuacagaaaaaguuugauaauuccugcuuu

SEQ ID NO: 169117 - RNA, 64 nt, Homo Sapiens
guuuauuauaaauaacccagucucagauauucuguuacagaaacacaaaauggacuaagacacc

SEQ ID NO: 169118 - RNA, 64 nt, Homo Sapiens
uucuaucaaaagcuaaauauggcacacuuguucuuuacagaaaaauaaagauauuuuaaacaaa

SEQ ID NO: 169119 - RNA, 64 nt, Homo Sapiens
aggugagcuguguuaaaccuaugcucacuuaaauuuacagaaagaguuuccuuuguauaggagu

SEQ ID NO: 169120 - RNA, 64 nt, Homo Sapiens
ucuauuucuuugaaacgaagaauuguauauauuuuuacagaaagcuuguaaauguauuuguaaa

SEQ ID NO: 169121 - RNA, 64 nt, Homo Sapiens
agaaugggacccauucaggucauuuucuguuggauuacagaaaagugguuuuuguuuuuuuuuu

SEQ ID NO: 169122 - RNA, 64 nt, Homo Sapiens
uguguauuguaauuuauugagguauaaaagacucuuacagaauaagaccaaaaacaagcuucuu

SEQ ID NO: 169123 - RNA, 64 nt, Homo Sapiens
cguuugcugacccccacuuuaaauaucuggaccuuuacagaagagaaaaaugacacacaaaaca

SEQ ID NO: 169124 - RNA, 64 nt, Homo Sapiens
gcuaaauaauuuuuuaaaaaaauggaguaacaaauuacagaauauuacuucuauuuuuuaaaau

SEQ ID NO: 169125 - RNA, 64 nt, Homo Sapiens
gauugucucuugguucucagaagaggagcuggaguuacagaaaucaguaacauuuugugggaga

SEQ ID NO: 169126 - RNA, 64 nt, Homo Sapiens
aauguaaacucagagugaucccuugggaccacaguuacagaaaacacuuugcacgccggaacug

SEQ ID NO: 169127 - RNA, 64 nt, Homo Sapiens
gugacuucauuugugcuaacucugcuaaucauuguuacagaaugagguacugucucgguaucau

SEQ ID NO: 169128 - RNA, 64 nt, Homo Sapiens
acugaaaauuugaaagaaaacuguugccuuuuucuuacagaaugaaucuucauacugaauucuu

SEQ ID NO: 169129 - RNA, 64 nt, Homo Sapiens
auaauuauaucugacugauucuaacaagacuaacuuacagaaaauuuuagugcuaucaucauuc

SEQ ID NO: 169130 - RNA, 64 nt, Homo Sapiens
cuaugauauagaauucauauuuaacagauaaaacuuacagaaacaaagaacaaccuuaaaacuu

SEQ ID NO: 169131 - RNA, 64 nt, Homo Sapiens
ucugaccaccaggcuaugacguuccugcugcgcauuacagaaagcuuuuaacugugaucaggca

SEQ ID NO: 169132 - RNA, 64 nt, Homo Sapiens
uuaauaggcuuuauuuguaagagcaguuuuauguuuacagaaaaauuaggcacaaagggauucc

SEQ ID NO: 169133 - RNA, 64 nt, Homo Sapiens
aucuggcuucauucuucuugauucacauugggucuuacagaaccaauuccuguuguauaugucu

SEQ ID NO: 169134 - RNA, 64 nt, Homo Sapiens
augaagagguaucuguuuaauuaaaagcaaacacuuacagaauugauaugacauuuauucaaag

SEQ ID NO: 169135 - RNA, 64 nt, Homo Sapiens
ggagaaaauuguugcaaacuaguaaacagacagcuuacagaauggcaaaagaaacuaucaagag

SEQ ID NO: 169136 - RNA, 64 nt, Homo Sapiens
gauuuguuaaacuagcacaguuaacaguauuucuuuacagaaugaguuuuaaacucuaggggaa

SEQ ID NO: 169137 - RNA, 64 nt, Homo Sapiens
gaacaauuaaauaugguuaguuccagagugcaaauuacagaaggaagcuacuuguuuaaaauuc

SEQ ID NO: 169138 - RNA, 64 nt, Homo Sapiens
uagaauuaacuaagaagccaaaaauggcaacaauuuacagaaaucccaccuuuccaugcuuaag

SEQ ID NO: 169139 - RNA, 64 nt, Homo Sapiens
uuucuuauagguuaugccuuaugaaucuaaaccuuuacagaaaccaagauauagcacuuucaaa

SEQ ID NO: 169140 - RNA, 64 nt, Homo Sapiens
guauguguagcugugcccuagggacauggauucauuacagaaauaagcuuuucaguaggauucu

SEQ ID NO: 169141 - RNA, 64 nt, Homo Sapiens
augaucacacugccgcacuggccaggaguuuaaguuacagaacuaggcaggaggauugcuugag

SEQ ID NO: 169142 - RNA, 64 nt, Homo Sapiens
aaaucugaacugagaaaggauaucaaaccuuuuauuacagaaaacauauuagaauugugucauu

SEQ ID NO: 169143 - RNA, 64 nt, Homo Sapiens
ucuuccccauauucacuccuaaacauccaguggauuacagaauuaaaaagccagagaaccuaga

SEQ ID NO: 169144 - RNA, 64 nt, Homo Sapiens
ucuguagaggcugaacuguuuaaaaggcaguauauuacagaaacaauuuacaaacuccaagcac

SEQ ID NO: 169145 - RNA, 64 nt, Homo Sapiens
gauggcaaguguacaaccaaaccaauccacuugcuuacagaaagaauguuuaguguaguuaaga

SEQ ID NO: 169146 - RNA, 64 nt, Homo Sapiens
acaauugagaugcuaacagggaggauuacaguguuuacagaacaaccuucagcgccgaccugga

SEQ ID NO: 169147 - RNA, 64 nt, Homo Sapiens
acccuuuuuaggaucaucuugaaauaauuuccgguuacagaauuuuuaaaugucuggacauucu

SEQ ID NO: 169148 - RNA, 64 nt, Homo Sapiens
uuuaguuacaaucugaguaacccuuaaccccuuuuuacagaaauugaaucucccaucaucccau

SEQ ID NO: 169149 - RNA, 64 nt, Homo Sapiens
uacuacccaacagauuucaguugcugcuuucuuuuuacagaaauucgacacccagcuucuggaa

SEQ ID NO: 169150 - RNA, 64 nt, Homo Sapiens
agaugugacucuacagauacuucccaaacacuguuuacagaauguaauuuucagaugaagaugu

SEQ ID NO: 169151 - RNA, 64 nt, Homo Sapiens
guaaacuggugagaguauauuucucugcugcaucuuacagaagauagcauucauuaccuguuua

SEQ ID NO: 169152 - RNA, 64 nt, Homo Sapiens
agaaaaguuaacauuuaucuuaauacuccuccuuuuacagaauuuuuuaacuacuuuacuaaau

SEQ ID NO: 169153 - RNA, 64 nt, Homo Sapiens
uaguauuuugauaucauuaaaguacacagaauuuuuacagaauguuuuauuaauuuuuugaaga

SEQ ID NO: 169154 - RNA, 64 nt, Homo Sapiens
auaacgccaugcaauagaaaacccacacuggacuuuacagaaagaccuuggccucuaaggcuuc

SEQ ID NO: 169155 - RNA, 64 nt, Homo Sapiens
aacuuaugcacugcuacuguucuuucagaucuuuuuacagaaugauugagucucuugaaaauca

SEQ ID NO: 169156 - RNA, 64 nt, Homo Sapiens
gguugugguccagacaccaaauuaaucuugugaauuacagaacacagaagagaggacauauuua

SEQ ID NO: 169157 - RNA, 64 nt, Homo Sapiens; identical to SEQ ID NO: 98813

SEQ ID NO: 169158 - RNA, 64 nt, Homo Sapiens; identical to SEQ ID NO: 98814

SEQ ID NO: 169159 - RNA, 64 nt, Homo Sapiens; identical to SEQ ID NO: 98815

SEQ ID NO: 169160 - RNA, 64 nt, Homo Sapiens; identical to SEQ ID NO: 98816

SEQ ID NO: 169161 - RNA, 64 nt, Homo Sapiens; identical to SEQ ID NO: 98817

SEQ ID NO: 169162 - RNA, 64 nt, Homo Sapiens; identical to SEQ ID NO: 98818

SEQ ID NO: 169163 - RNA, 64 nt, Homo Sapiens; identical to SEQ ID NO: 98819

SEQ ID NO: 169164 - RNA, 64 nt, Homo Sapiens; identical to SEQ ID NO: 98820

SEQ ID NO: 169165 - RNA, 64 nt, Homo Sapiens; identical to SEQ ID NO: 98821

SEQ ID NO: 169166 - RNA, 64 nt, Homo Sapiens; identical to SEQ ID NO: 98822

SEQ ID NO: 169167 - RNA, 64 nt, Homo Sapiens; identical to SEQ ID NO: 98823

SEQ ID NO: 169168 - RNA, 64 nt, Homo Sapiens; identical to SEQ ID NO: 98824

SEQ ID NO: 169169 - RNA, 64 nt, Homo Sapiens; identical to SEQ ID NO: 98825

SEQ ID NO: 169170 - RNA, 64 nt, Homo Sapiens; identical to SEQ ID NO: 98826

SEQ ID NO: 169171 - RNA, 64 nt, Homo Sapiens; identical to SEQ ID NO: 98827

SEQ ID NO: 169172 - RNA, 64 nt, Homo Sapiens; identical to SEQ ID NO: 98828

SEQ ID NO: 169173 - RNA, 64 nt, Homo Sapiens; identical to SEQ ID NO: 98829

SEQ ID NO: 169174 - RNA, 64 nt, Homo Sapiens; identical to SEQ ID NO: 98830

SEQ ID NO: 169175 - RNA, 64 nt, Homo Sapiens; identical to SEQ ID NO: 98831

SEQ ID NO: 169176 - RNA, 64 nt, Homo Sapiens; identical to SEQ ID NO: 98832

SEQ ID NO: 169177 - RNA, 64 nt, Homo Sapiens; identical to SEQ ID NO: 98833

SEQ ID NO: 169178 - RNA, 64 nt, Homo Sapiens; identical to SEQ ID NO: 98834

SEQ ID NO: 169179 - RNA, 64 nt, Homo Sapiens; identical to SEQ ID NO: 98835

SEQ ID NO: 169180 - RNA, 64 nt, Homo Sapiens; identical to SEQ ID NO: 98836

SEQ ID NO: 169181 - RNA, 64 nt, Homo Sapiens; identical to SEQ ID NO: 98837

SEQ ID NO: 169182 - RNA, 64 nt, Homo Sapiens; identical to SEQ ID NO: 98838

SEQ ID NO: 169183 - RNA, 64 nt, Homo Sapiens; identical to SEQ ID NO: 98839

SEQ ID NO: 169184 - RNA, 64 nt, Homo Sapiens; identical to SEQ ID NO: 98840

SEQ ID NO: 169185 - RNA, 64 nt, Homo Sapiens; identical to SEQ ID NO: 98841

SEQ ID NO: 169186 - RNA, 64 nt, Homo Sapiens; identical to SEQ ID NO: 98842

SEQ ID NO: 169187 - RNA, 64 nt, Homo Sapiens; identical to SEQ ID NO: 98843

SEQ ID NO: 169188 - RNA, 64 nt, Homo Sapiens; identical to SEQ ID NO: 98844

SEQ ID NO: 169189 - RNA, 64 nt, Homo Sapiens; identical to SEQ ID NO: 98845

SEQ ID NO: 169190 - RNA, 64 nt, Homo Sapiens; identical to SEQ ID NO: 98846

SEQ ID NO: 169191 - RNA, 64 nt, Homo Sapiens; identical to SEQ ID NO: 98847

SEQ ID NO: 169192 - RNA, 64 nt, Homo Sapiens; identical to SEQ ID NO: 98848

SEQ ID NO: 169193 - RNA, 64 nt, Homo Sapiens; identical to SEQ ID NO: 98849

SEQ ID NO: 169194 - RNA, 64 nt, Homo Sapiens; identical to SEQ ID NO: 98850

SEQ ID NO: 169195 - RNA, 64 nt, Homo Sapiens; identical to SEQ ID NO: 98851

SEQ ID NO: 169196 - RNA, 64 nt, Homo Sapiens; identical to SEQ ID NO: 98852

SEQ ID NO: 169197 - RNA, 64 nt, Homo Sapiens; identical to SEQ ID NO: 98853

SEQ ID NO: 169198 - RNA, 64 nt, Homo Sapiens; identical to SEQ ID NO: 98854

SEQ ID NO: 169199 - RNA, 64 nt, Homo Sapiens; identical to SEQ ID NO: 98855

SEQ ID NO: 169200 - RNA, 64 nt, Homo Sapiens; identical to SEQ ID NO: 98856

SEQ ID NO: 169201 - RNA, 64 nt, Homo Sapiens; identical to SEQ ID NO: 98857

SEQ ID NO: 169202 - RNA, 64 nt, Homo Sapiens; identical to SEQ ID NO: 98858

SEQ ID NO: 169203 - RNA, 64 nt, Homo Sapiens; identical to SEQ ID NO: 98859

SEQ ID NO: 169204 - RNA, 64 nt, Homo Sapiens; identical to SEQ ID NO: 98860

SEQ ID NO: 169205 - RNA, 64 nt, Homo Sapiens; identical to SEQ ID NO: 98861

SEQ ID NO: 169206 - RNA, 64 nt, Homo Sapiens; identical to SEQ ID NO: 98862

SEQ ID NO: 169207 - RNA, 64 nt, Homo Sapiens; identical to SEQ ID NO: 98863

SEQ ID NO: 169208 - RNA, 64 nt, Homo Sapiens; identical to SEQ ID NO: 98864

SEQ ID NO: 169209 - RNA, 64 nt, Homo Sapiens; identical to SEQ ID NO: 98865

SEQ ID NO: 169210 - RNA, 64 nt, Homo Sapiens; identical to SEQ ID NO: 98866

SEQ ID NO: 169211 - RNA, 64 nt, Homo Sapiens; identical to SEQ ID NO: 98867

SEQ ID NO: 169212 - RNA, 64 nt, Homo Sapiens; identical to SEQ ID NO: 98868

SEQ ID NO: 169213 - RNA, 64 nt, Homo Sapiens; identical to SEQ ID NO: 98869

SEQ ID NO: 169214 - RNA, 64 nt, Homo Sapiens; identical to SEQ ID NO: 98870

SEQ ID NO: 169215 - RNA, 64 nt, Homo Sapiens; identical to SEQ ID NO: 98871

SEQ ID NO: 169216 - RNA, 64 nt, Homo Sapiens; identical to SEQ ID NO: 98872

SEQ ID NO: 169217 - RNA, 64 nt, Homo Sapiens; identical to SEQ ID NO: 98873

SEQ ID NO: 169218 - RNA, 64 nt, Homo Sapiens; identical to SEQ ID NO: 98874

SEQ ID NO: 169219 - RNA, 64 nt, Homo Sapiens; identical to SEQ ID NO: 98875

SEQ ID NO: 169220 - RNA, 64 nt, Homo Sapiens; identical to SEQ ID NO: 98876

SEQ ID NO: 169221 - RNA, 64 nt, Homo Sapiens; identical to SEQ ID NO: 98877

SEQ ID NO: 169222 - RNA, 64 nt, Homo Sapiens; identical to SEQ ID NO: 98878

SEQ ID NO: 169223 - RNA, 64 nt, Homo Sapiens; identical to SEQ ID NO: 98879

SEQ ID NO: 169224 - RNA, 64 nt, Homo Sapiens; identical to SEQ ID NO: 98880

SEQ ID NO: 169225 - RNA, 64 nt, Homo Sapiens; identical to SEQ ID NO: 98881

SEQ ID NO: 169226 - RNA, 64 nt, Homo Sapiens; identical to SEQ ID NO: 98882

SEQ ID NO: 169227 - RNA, 64 nt, Homo Sapiens; identical to SEQ ID NO: 98883

SEQ ID NO: 169228 - RNA, 64 nt, Homo Sapiens; identical to SEQ ID NO: 98884

SEQ ID NO: 169229 - RNA, 64 nt, Homo Sapiens; identical to SEQ ID NO: 98885

SEQ ID NO: 169230 - RNA, 64 nt, Homo Sapiens; identical to SEQ ID NO: 98886

SEQ ID NO: 169231 - RNA, 64 nt, Homo Sapiens; identical to SEQ ID NO: 98887

SEQ ID NO: 169232 - RNA, 64 nt, Homo Sapiens; identical to SEQ ID NO: 98888

SEQ ID NO: 169233 - RNA, 64 nt, Homo Sapiens; identical to SEQ ID NO: 98889

SEQ ID NO: 169234 - RNA, 64 nt, Homo Sapiens; identical to SEQ ID NO: 98890

SEQ ID NO: 169235 - RNA, 64 nt, Homo Sapiens; identical to SEQ ID NO: 98891

SEQ ID NO: 169236 - RNA, 64 nt, Homo Sapiens; identical to SEQ ID NO: 98892

SEQ ID NO: 169237 - RNA, 64 nt, Homo Sapiens; identical to SEQ ID NO: 98893

SEQ ID NO: 169238 - RNA, 64 nt, Homo Sapiens; identical to SEQ ID NO: 98894

SEQ ID NO: 169239 - RNA, 64 nt, Homo Sapiens; identical to SEQ ID NO: 98895

SEQ ID NO: 169240 - RNA, 64 nt, Homo Sapiens; identical to SEQ ID NO: 98896

SEQ ID NO: 169241 - RNA, 64 nt, Homo Sapiens; identical to SEQ ID NO: 98897

SEQ ID NO: 169242 - RNA, 64 nt, Homo Sapiens; identical to SEQ ID NO: 98898

SEQ ID NO: 169243 - RNA, 64 nt, Homo Sapiens; identical to SEQ ID NO: 98899

SEQ ID NO: 169244 - RNA, 64 nt, Homo Sapiens; identical to SEQ ID NO: 98900

SEQ ID NO: 169245 - RNA, 64 nt, Homo Sapiens; identical to SEQ ID NO: 98901

SEQ ID NO: 169246 - RNA, 64 nt, Homo Sapiens; identical to SEQ ID NO: 98902

SEQ ID NO: 169247 - RNA, 64 nt, Homo Sapiens; identical to SEQ ID NO: 98903

SEQ ID NO: 169248 - RNA, 64 nt, Homo Sapiens; identical to SEQ ID NO: 98904

SEQ ID NO: 169249 - RNA, 64 nt, Homo Sapiens; identical to SEQ ID NO: 98905

SEQ ID NO: 169250 - RNA, 64 nt, Homo Sapiens; identical to SEQ ID NO: 98906

SEQ ID NO: 169251 - RNA, 64 nt, Homo Sapiens; identical to SEQ ID NO: 98907

SEQ ID NO: 169252 - RNA, 64 nt, Homo Sapiens; identical to SEQ ID NO: 98908

SEQ ID NO: 169253 - RNA, 64 nt, Homo Sapiens; identical to SEQ ID NO: 98909

SEQ ID NO: 169254 - RNA, 64 nt, Homo Sapiens; identical to SEQ ID NO: 98910

SEQ ID NO: 169255 - RNA, 64 nt, Homo Sapiens; identical to SEQ ID NO: 98911

SEQ ID NO: 169256 - RNA, 64 nt, Homo Sapiens; identical to SEQ ID NO: 98912

SEQ ID NO: 169257 - RNA, 64 nt, Homo Sapiens
gauucuaaucugagugaguuacugagcuuugguccacuaaaacaagcugagcuuugguccacua

SEQ ID NO: 169258 - RNA, 64 nt, Homo Sapiens
gcuuugguccacuaaaacaagcugagcuuugguccacuaaaacaagaugaaaaauacaagagug

SEQ ID NO: 169259 - RNA, 64 nt, Homo Sapiens
ucaaaucaaggugcuugguuggcaaaguugugcacacuaaaauaggcucaccaggaccucaacg

SEQ ID NO: 169260 - RNA, 64 nt, Homo Sapiens
uccacgggauuaacagaacgacaaacggaagauccacuaaaacgcaacguuugccaucuggaug

SEQ ID NO: 169261 - RNA, 64 nt, Homo Sapiens
auaaaaauuagccaggcaugugaaaugccaucuccacuaaaaaugaucagccugaccaacaugg

SEQ ID NO: 169262 - RNA, 64 nt, Homo Sapiens
acaauauuuuuagaaaacguucaucauugagaaacacuaaaauauuucuacauuugacauguau

SEQ ID NO: 169263 - RNA, 64 nt, Homo Sapiens
uggaucuuaaccaaaaaugauucaauacuguuaucacuaaaacagcaccaagaccugaagccau

SEQ ID NO: 169264 - RNA, 64 nt, Homo Sapiens
ccuuagacccuauaguguuaagagguauuuuaaacacuaaaaggacaaagcucuucccaauccu

SEQ ID NO: 169265 - RNA, 64 nt, Homo Sapiens
augcgaaaaccugaugagggacugcacuaaaacccacuaaaaagucuaaauuguggcuugaagg

SEQ ID NO: 169266 - RNA, 64 nt, Homo Sapiens
cacuaaaaagaugcgaaaacggcuugaaggacugcacuaaaacccgaagggcaaucuaaauugu

SEQ ID NO: 169267 - RNA, 64 nt, Homo Sapiens
cuuuaaaacacaaaucuucaaaaguauuuuuccccacuaaaaaaucugaagcaauuagugguaa

SEQ ID NO: 169268 - RNA, 64 nt, Homo Sapiens
aaauggccuucuugacugugacuuuugccagcuacacuaaaagaaauuauaaggaugaucagag

SEQ ID NO: 169269 - RNA, 64 nt, Homo Sapiens
auuugugagaaacuggcacuuagauuuaaauaaucacuaaaauguaaauaaucacuaaaaucac

SEQ ID NO: 169270 - RNA, 64 nt, Homo Sapiens
acuagauuuaaauaaucacuugauuuuaaauaaucacuaaaauccuuaaugcaagcuaggauag

SEQ ID NO: 169271 - RNA, 64 nt, Homo Sapiens
agugacucacuuccaaagagcccuugugagucuucacuaaaaucgagguagaacucaguccucu

SEQ ID NO: 169272 - RNA, 64 nt, Homo Sapiens
cuggauugaaagugaaaauucauaugacuaaguucacuaaaaccaauuuugaaaguuguauucu

SEQ ID NO: 169273 - RNA, 64 nt, Homo Sapiens
gguuuuuuaaaaaagcaauaauuaacucagaccucacuaaaaaucauuuuuguuuuuauauugu

SEQ ID NO: 169274 - RNA, 64 nt, Homo Sapiens
acacacauauauauauauaaaguguaacaaggaacacuaaaacaguguugauucuugucucuga

SEQ ID NO: 169275 - RNA, 64 nt, Homo Sapiens
aacauuuggguuucacuccaaaugucauaaagggcacuaaaaguaaaacucagguuagaacaaa

SEQ ID NO: 169276 - RNA, 64 nt, Homo Sapiens
aggccaagguuuaggagguguccuuuauugugaucacuaaaaugugaguaugcaccuaccauuu

SEQ ID NO: 169277 - RNA, 64 nt, Homo Sapiens
auuauaguaacguauuguccaacaaaaguuauuacacuaaaaguucaaauuuuuucauaauuca

SEQ ID NO: 169278 - RNA, 64 nt, Homo Sapiens
aagcuaaaauggcuuaacaucaugcuacacuuuacacuaaaaaucuauuacugugaguggucug

SEQ ID NO: 169279 - RNA, 64 nt, Homo Sapiens
aaucugagggaaaacauguucagggcuucuagaacacuaaaaaauuuggcuuaaaccaguguuc

SEQ ID NO: 169280 - RNA, 64 nt, Homo Sapiens
ucagguguuucuagacccccgacuccgcaagagugaggaugaugggagcuggucaugggagcua

SEQ ID NO: 169281 - RNA, 64 nt, Homo Sapiens
gaugggguauucuuucacuaguugaggaguagaagaggaugaccagcuagacucccauggaauu

SEQ ID NO: 169282 - RNA, 64 nt, Homo Sapiens
acacagagacaaggugacuggccaggcccuggaggaggaugaagaguugccuuagagcgcaagg

SEQ ID NO: 169283 - RNA, 64 nt, Homo Sapiens
ccugcaggccauguccacagcuucugugguuugagaggaugaaccuggagcuccaaccuucuaa

SEQ ID NO: 169284 - RNA, 64 nt, Homo Sapiens
cagaaacaccguaagugucuucuaaaagacacaggaggaugacagcaguccucacccccaccuc

SEQ ID NO: 169285 - RNA, 64 nt, Homo Sapiens
caggaggaucucuugagcccucccagcuguucaggaggaugagggugguggcucaugcuugugg

SEQ ID NO: 169286 - RNA, 64 nt, Homo Sapiens
gagugggaaugagccacucccaguucuggagagugaggaugaccaucuccacuuucuggaacca

SEQ ID NO: 169287 - RNA, 64 nt, Homo Sapiens
cucacugccuaaaaugguaaucccuccagccuaagaggaugauucuguuuuguugacucuugaa

SEQ ID NO: 169288 - RNA, 64 nt, Homo Sapiens
caaaaccaccugcguggcuaggaugauuaauuaugaggaugaugauuuuuuuugugauaacagu

SEQ ID NO: 169289 - RNA, 64 nt, Homo Sapiens
ccuuguucuccccuggguccguaacauuuuuuccgaggaugaacaggggacaucuuuagguuuc

SEQ ID NO: 169290 - RNA, 64 nt, Homo Sapiens
ggggcagggaacgaacaugguggcuuugggcugagaggaugagggaggucuuucccaggucaaa

SEQ ID NO: 169291 - RNA, 64 nt, Homo Sapiens
ugcacacgaugacucauuggaugggacagaagaagaggaugaggaugagauggaagaggaggag

SEQ ID NO: 169292 - RNA, 64 nt, Homo Sapiens
cgaugacucauuggaugggacagaagaagaggaugaggaugagauggaagaggaggaggaggag

SEQ ID NO: 169293 - RNA, 64 nt, Homo Sapiens
uggaaggagugagaggggacgccgcuagaggccugaggaugagcccgggcccguugaggaugag

SEQ ID NO: 169294 - RNA, 64 nt, Homo Sapiens
ccgcuagaggccugaggauggucccgggcccguugaggaugaggugccacccuaccuguucagu

SEQ ID NO: 169295 - RNA, 64 nt, Homo Sapiens
ccggggaggagaggcugccccaggggaugaggaugaggaugaauccuguuuaucuugccuucag

SEQ ID NO: 169296 - RNA, 64 nt, Homo Sapiens
augaauccggggaggagagggugcagcaggggaugaggaugaggcauggaggccaucaccguca

SEQ ID NO: 169297 - RNA, 64 nt, Homo Sapiens
ccugccugugagccacaccucuuggaggaaagcagaggaugaucuugguccuucugguccaggc

SEQ ID NO: 169298 - RNA, 64 nt, Homo Sapiens
ggaggagagagcuuuugcuccacauggugagaaggaggaugaagugaaaggacuugucugaaau

SEQ ID NO: 169299 - RNA, 64 nt, Homo Sapiens
gggagggagccaacgccucacaggcauguggugagaggaugagggaugaggggagccuacgccu

SEQ ID NO: 169300 - RNA, 64 nt, Homo Sapiens
ggagccuacgccucaggcaugccccaugcggugagaggaugaggaguagaggcugggagcaaau

SEQ ID NO: 169301 - RNA, 64 nt, Homo Sapiens
agagggucuucagaagccccccugggagggaggggaggaugagcacgcccagcuccccuccagg

SEQ ID NO: 169302 - RNA, 64 nt, Homo Sapiens
uuuuuuuuuuuuuaagucguuuuccugcguugacgaggaugaucugggguuuuuauuuguuucg

SEQ ID NO: 169303 - RNA, 64 nt, Homo Sapiens
gaaggggcuauccugggaccaacauguagggcaagaggaugaagguaccucaguauucuuuuuc

SEQ ID NO: 169304 - RNA, 64 nt, Homo Sapiens
cccagccccuuccccugggacaaggaacagaagugaggaugagaccugcccugcucugcccagg

SEQ ID NO: 169305 - RNA, 64 nt, Homo Sapiens
accuagacucaucugaaggaaaggaucuucacaagaggaugaagugaagaccuaggguuaucug

SEQ ID NO: 169306 - RNA, 64 nt, Homo Sapiens
accuaggguuaucugaaggaaaggaucuucacaggaggaugaagugaagaccuacaauuaccug

SEQ ID NO: 169307 - RNA, 64 nt, Homo Sapiens
accuagacucaucugcagaaaaggauccucacaggaggaugaagaguccaagaggaggaggacg

SEQ ID NO: 169308 - RNA, 64 nt, Homo Sapiens
guuauaauucauugugguaagaaugauugaaaugcagauuuaacaaucuuauaaucuauugaau

SEQ ID NO: 169309 - RNA, 64 nt, Homo Sapiens
guugugaagaaaguauuuaaauccaacuuuugaacagauuuaacaaacaugaggaacuuuuuua

SEQ ID NO: 169310 - RNA, 64 nt, Homo Sapiens
cccuuuuguuuuuugauuuauauacucuguuuuacagauuuagcuagaaaaaaaaugucagugu

SEQ ID NO: 169311 - RNA, 64 nt, Homo Sapiens
aaagcuagcuuucuuauguuuuccuuuaaauuuucagauuuaccuucauucuguuuucacugau

SEQ ID NO: 169312 - RNA, 64 nt, Homo Sapiens
ccuuuaccaucuauguugauagguuguaaugucucagauuuaguuguacaguauuuuuuuuuag

SEQ ID NO: 169313 - RNA, 64 nt, Homo Sapiens
ucuggaauguuuagaaucagaacauaacuauugccagauuuagcauucuucuucagaaauuaaa

SEQ ID NO: 169314 - RNA, 64 nt, Homo Sapiens
aaaucucaugaauauaauguaagaaaacauuugucagauuuaaaugauaucacagaauuaaugu

SEQ ID NO: 169315 - RNA, 64 nt, Homo Sapiens
uuuuuauuaauccgucuuaaauguguauauagcucagauuuauuuuaaugucugauauuggaag

SEQ ID NO: 169316 - RNA, 64 nt, Homo Sapiens
gccacguaaucauuuucuuagacguuugcuccaccagauuuaaccaaauguaacucccacauug

SEQ ID NO: 169317 - RNA, 64 nt, Homo Sapiens
guacuuauuuacuaacguauuaucuuuuucaaaccagauuuaugugcaaagguuaaacauguaa

SEQ ID NO: 169318 - RNA, 64 nt, Homo Sapiens
agagauuugcugccaggaaucaauuuugaggguucagauuuagcuuggaagaaaaaaaagaaac

SEQ ID NO: 169319 - RNA, 64 nt, Homo Sapiens
ucacaguauguauuuagcauuuauuuuauuacagcagauuuaaaguuuguaucuaaauaaugcc

SEQ ID NO: 169320 - RNA, 64 nt, Homo Sapiens
aacuuacucuggccccaguguuaaaacgaucuuucagauuuagagugacuauguaagaauuuag

SEQ ID NO: 169321 - RNA, 64 nt, Homo Sapiens
ucauuugcuuagaugguguuugugggaucaccugcagauuuaaagccuacucugccacagacuc

SEQ ID NO: 169322 - RNA, 64 nt, Homo Sapiens
uggcaugaucauauugcuguaaccaacaagcuuucagauuuauggagaaugaccauguuauaga

SEQ ID NO: 169323 - RNA, 64 nt, Homo Sapiens
ggagaaugaccauguuauagacuuucacuuaugucagauuuaugauaggaaaaauuccaucuuc

SEQ ID NO: 169324 - RNA, 64 nt, Homo Sapiens
uucuauagugauaaacccuucauaauuuaagaaccagauuuauuguuuuaauguuugcuuugaa

SEQ ID NO: 169325 - RNA, 64 nt, Homo Sapiens
auguuuugaauuuaacuuguuugaaaaaauauaacagauuuaaagcuuucauuuguacaucccu

SEQ ID NO: 169326 - RNA, 64 nt, Homo Sapiens
uauuaauuucaauuagcuagauuguacauacuugcagauuuaacaaaauuuuagggaaauugaa

SEQ ID NO: 169327 - RNA, 64 nt, Homo Sapiens
cacagguggauuucucuauuuuugaauacuacaucagauuuagaugcacgacuaccuguugacu

SEQ ID NO: 169328 - RNA, 64 nt, Homo Sapiens
uuccaguaacauacuucuagugcugcaguguggccagauuuaccgcugcccucugccguccaga

SEQ ID NO: 169329 - RNA, 64 nt, Homo Sapiens
auuuucuguuaaaggaaaguuuaugcugcuauuacagauuuaacagcuuuuuucuauauauaaa

SEQ ID NO: 169330 - RNA, 64 nt, Homo Sapiens
cggcaggggugucugaggccgcccugucagcuggccgguccaagccuguggcuggagcuggugu

SEQ ID NO: 169331 - RNA, 64 nt, Homo Sapiens
uggcgggggugucugaggccgcacugucagcuggccgguccaagccuguggcuggagcuggggu

SEQ ID NO: 169332 - RNA, 64 nt, Homo Sapiens
uccugcggguccucggcuccaugugccagaggcuccgguccaugcaguacaauggcagcuacuu

SEQ ID NO: 169333 - RNA, 64 nt, Homo Sapiens
acaucaggaaaaggccacggggcucugaacagccccgguccagacagcagccuguacauccauc

SEQ ID NO: 169334 - RNA, 64 nt, Homo Sapiens
caggugagcagcuuggcaggucuccaaguggaacccgguccagacagggcugccucgacuucac

SEQ ID NO: 169335 - RNA, 64 nt, Homo Sapiens
cgucgaccaucgagcugcuuuaaagcccacagaaccgguccaguuccccagaagcagaagcaug

SEQ ID NO: 169336 - RNA, 64 nt, Homo Sapiens
ggagagucacuaguuguaccucuccuuccauuccccgguccaggaguggauaucagaugggaua

SEQ ID NO: 169337 - RNA, 64 nt, Homo Sapiens
uuauggcuaaauuaaaaaaagcucauagcucgagccgguccaaugacaggaagaaaauagaaca

SEQ ID NO: 169338 - RNA, 64 nt, Homo Sapiens
ccugccuuuucacucacacaccgcgcucacacaaccgguccacuuuccacaacucaaacuccca

SEQ ID NO: 169339 - RNA, 64 nt, Homo Sapiens
ggccaucucccacugggaauauggcguaguaucuccgguccauuccuuggaugcuaaggacugc

SEQ ID NO: 169340 - RNA, 64 nt, Homo Sapiens
cagccuuagaggcaccugagcaacucaaagguuuccgguccauuucugggguucccgaugggaa

SEQ ID NO: 169341 - RNA, 64 nt, Homo Sapiens
uuucgaccuaacauuuuggguuuuaaccaaauaaccgguccaggagugagcagcuccguucugu

SEQ ID NO: 169342 - RNA, 64 nt, Homo Sapiens
gaagagugggcucccgugggcccagagcugcacgccgguccacagacacacucacgcccgccac

SEQ ID NO: 169343 - RNA, 64 nt, Homo Sapiens
ggcugccucccggccuccuccaagucggccucccccgguccagucuccaggcccagaacuuccu

SEQ ID NO: 169344 - RNA, 64 nt, Homo Sapiens
ugcagaauauuaauacaucgauucucaacuagaaccgguccaaaacuguccccuuaggauugga

SEQ ID NO: 169345 - RNA, 64 nt, Homo Sapiens
aaucuucaaaguuggaaggaacuuuaaaaaucauccgguccaaucucuuuccucuuucugccac

SEQ ID NO: 169346 - RNA, 64 nt, Homo Sapiens
acuuaggagaaaauggugcuucacuaacccgcuuccgguccagucacaaucaucaugucacugu

SEQ ID NO: 169347 - RNA, 64 nt, Homo Sapiens
gcugcgccugcccgcccgccgguuggccggcuggccgguccaccccgucccggccccgcgcgug

SEQ ID NO: 169348 - RNA, 64 nt, Homo Sapiens
cugaccugggugguugaggcucaagacagcucacccgguccagaagcuccaugcuggucacuag

SEQ ID NO: 169349 - RNA, 64 nt, Homo Sapiens
caggggguucagccgagcccggguacuguuagccccgguccaugagaccugugggagucguaga

SEQ ID NO: 169350 - RNA, 64 nt, Homo Sapiens
cgggcagggagcagccccaggccagagaggccucccgguccagcucagggaugcuccugccagc

SEQ ID NO: 169351 - RNA, 64 nt, Homo Sapiens
agggcuggcagaucgcuucccucauccaccuccaccgguccaggucuuugcugcuguccccaga

SEQ ID NO: 169352 - RNA, 64 nt, Homo Sapiens
caucacaagaaacgagccugaaaaucagguccagccgguccaagcacauggccucccaucuggg

SEQ ID NO: 169353 - RNA, 64 nt, Homo Sapiens
uggccuggacaguaucccaccuccccuucccccaccgguccagcgccacccuagccaaugucuc

SEQ ID NO: 169354 - RNA, 64 nt, Homo Sapiens
cccuauacucaugacauuaacuguauugcuucuuccgguccacacccagcacaacugugaaacu

SEQ ID NO: 169355 - RNA, 64 nt, Homo Sapiens
gccaugagccaagagcccucacccgcacggcucgccgguccagaaggagccggcgcccaucucc

SEQ ID NO: 169356 - RNA, 64 nt, Homo Sapiens
aggauuaagcgauuaaagaaaauauucucuuaucccgguccaaaugcuuuaauaagaaauuuca

SEQ ID NO: 169357 - RNA, 64 nt, Homo Sapiens
cagguauguaacaacaaaagaaguugccugcaugccgguccaaauuguucuguauaaagaugcu

SEQ ID NO: 169358 - RNA, 64 nt, Homo Sapiens
acugggagauacagccauccgucuuuucagcaacccgguccaguggcuucuuauucggguguga

SEQ ID NO: 169359 - RNA, 64 nt, Homo Sapiens
uggccuucagccccaccuuucucugaaaugggagccgguccaggcuuggacaggacaagcugaa

SEQ ID NO: 169360 - RNA, 64 nt, Homo Sapiens
aucacugcuuuuuugccacaucacauaguaacugccgguccagaaugugacggauucgacucua

SEQ ID NO: 169361 - RNA, 64 nt, Homo Sapiens
aagagccugcugucuguauggaggaggugcuagcccgguccaccgggcugcugcccaccccugc

SEQ ID NO: 169362 - RNA, 64 nt, Homo Sapiens
cacauccagugauucagcagaaggcucuggacagccgguccagcgggaguggaggagaggagac

SEQ ID NO: 169363 - RNA, 64 nt, Homo Sapiens
cacgucuggagucuggggagcaagagcccccagcccgguccauccugcuuccuccucacaaccc

SEQ ID NO: 169364 - RNA, 64 nt, Homo Sapiens
caaagccaaaguugacuguguucuugucccgcagccgguccacacugugaggccaggccucaac

SEQ ID NO: 169365 - RNA, 64 nt, Homo Sapiens
aagagaaaagcccaagccuuguugguuacgucagccgguccauggcgguguccugcggacccca

SEQ ID NO: 169366 - RNA, 64 nt, Homo Sapiens
gacagcauuaccucacccggccccaucuguugccccgguccagcccugauggcgcgcgccuggu

SEQ ID NO: 169367 - RNA, 64 nt, Homo Sapiens
uggaggcugcaggacuggcuagaccaggucccugccgguccaccaggcggaggugggacaaagg

SEQ ID NO: 169368 - RNA, 64 nt, Homo Sapiens
cccagacccuggcacccuccugagccggcgugugccgguccagcccuccgagaugccacaauuc

SEQ ID NO: 169369 - RNA, 64 nt, Homo Sapiens
gugggcagcccuggccucuuccuuaacgcuggccccgguccagggccggccccugugccuggcu

SEQ ID NO: 169370 - RNA, 64 nt, Homo Sapiens
cgccucggccucccaaagugcugggauuacaggcccgguccaguuugauaguuuguuaucaugu

SEQ ID NO: 169371 - RNA, 64 nt, Homo Sapiens
cugggccuaggaugggacguuuuucuucuugggcccgguccacagguccaaggacacccucccu

SEQ ID NO: 169372 - RNA, 64 nt, Homo Sapiens
uagacccccacguuuggagaccccccacccccgcccgguccaccgggaccaccccucagggcgc

SEQ ID NO: 169373 - RNA, 64 nt, Homo Sapiens
cccuucauccccagcugcucuccccaccccagcaccgguccaacgccugcuaucccucucccac

SEQ ID NO: 169374 - RNA, 64 nt, Homo Sapiens
caauucuuuauccugugaaccuguagcguguggaccgguccacggcggacacuccucucuuuuc

SEQ ID NO: 169375 - RNA, 64 nt, Homo Sapiens
gucugaccccucacuuaggcuuuccucugccaccccgguccagggaagaggcucgcucccgccc

SEQ ID NO: 169376 - RNA, 64 nt, Homo Sapiens
cggaggcuuucagugauuuagggcuuccggagagccgguccaagaucccagguuuuauguugcu

SEQ ID NO: 169377 - RNA, 64 nt, Homo Sapiens
ccuuuaaugagcauuaauuuuugaaaguuuuacagaguuuuauuaguuuuacuacuuuaucuua

SEQ ID NO: 169378 - RNA, 64 nt, Homo Sapiens
cgccaccuguguuugcugagacuggucucugagagaguuuuaugucgaucgaggccuguugcuc

SEQ ID NO: 169379 - RNA, 64 nt, Homo Sapiens
aaaaaaaacuaaggcauuugauuaaauuaugaaugaguuuuacaaauuccuuucagaguuuuac

SEQ ID NO: 169380 - RNA, 64 nt, Homo Sapiens
uuaaauuaugaaugaguuuuacaaauuccuuucagaguuuuacuaagaucacacaaauaacagc

SEQ ID NO: 169381 - RNA, 64 nt, Homo Sapiens
gaaaggguuugggugccccauucugcaguguucagaguuuuaggccaaguguucucaaccucca

SEQ ID NO: 169382 - RNA, 64 nt, Homo Sapiens
agggagguuguucuaguuuuuguuuguccucccugaguuuuagcuuauuucagguugaguuguu

SEQ ID NO: 169383 - RNA, 64 nt, Homo Sapiens
uucaugaaaaaauuagggauacauaaaugacuuggaguuuuauggcuacauugagauauaguuc

SEQ ID NO: 169384 - RNA, 64 nt, Homo Sapiens
aaugagaucuagagaacacgaugagaaaaauacagaguuuuagauggauacuuaaguuuuagaa

SEQ ID NO: 169385 - RNA, 64 nt, Homo Sapiens
aacacuuccagcauuuagcuggccacauggcggagaguuuuaauuuuuaacuuauugacaaccg

SEQ ID NO: 169386 - RNA, 64 nt, Homo Sapiens
uuguagacuuaacacuucuuacgcaaugcuucuagaguuuuauagccuggacugcuaccuuuca

SEQ ID NO: 169387 - RNA, 64 nt, Homo Sapiens
uuaugcauuuauuuacugauuguguugugaacaugaguuuuaugguauuuugugagggaugcau

SEQ ID NO: 169388 - RNA, 64 nt, Homo Sapiens
accaagaauuuguaaacacaacucuaauaaaugugaguuuuaaaggauuguuauuuacuacuuu

SEQ ID NO: 169389 - RNA, 64 nt, Homo Sapiens
cuuuuuaccuccuuuaaacacaucaucugagguugaguuuuaugacaguauguaguugagugga

SEQ ID NO: 169390 - RNA, 64 nt, Homo Sapiens
guuuuaugacaguauguaguugaguggaggcugggaguuuuaagcauaaaucccuguuuagugu

SEQ ID NO: 169391 - RNA, 64 nt, Homo Sapiens
aaaagccuuugaaaauacuuuggauaauaaauuggaguuuuaaaaaugcaaauuugcuuaguau

SEQ ID NO: 169392 - RNA, 64 nt, Homo Sapiens
uuaaccuauaggauaagauuccaguauuguauaugaguuuuaacaaauuaaaaaaucaaaucau

SEQ ID NO: 169393 - RNA, 64 nt, Homo Sapiens
ggaaaagucaacaucuaacuggaaucugaaaauggaguuuuagacuuucugcugguugugaggg

SEQ ID NO: 169394 - RNA, 64 nt, Homo Sapiens
agugauggaaauuaagagagaguuuagacuugcugaguuuuagaagacacgaccuaaguugaag

SEQ ID NO: 169395 - RNA, 64 nt, Homo Sapiens
uuguauuuagaauuucaaccuacaacuauuuaaagaguuuuaugacagauuuugcauuuuuguu

SEQ ID NO: 169396 - RNA, 64 nt, Homo Sapiens
uaaaauagaaauuuguuagaacaauccauaauuugaguuuuacacaugacagauacauucaugc

SEQ ID NO: 169397 - RNA, 64 nt, Homo Sapiens
aaagaugguauaguuuuuauucuuaauuuguuuagaguuuuauguuuuuguucuacaucacagu

SEQ ID NO: 169398 - RNA, 64 nt, Homo Sapiens
accgcuacauaaugaaaaguuuggauuaaaagaugaguuuuacaucguuuuaaaagaaagauua

SEQ ID NO: 169399 - RNA, 64 nt, Homo Sapiens
aaauagaagcuucaucagaaauguaucccacauagaguuuuaagacuuggauucucuucugccc

SEQ ID NO: 169400 - RNA, 64 nt, Homo Sapiens
cacuggccuuggaucaucuccucaugcacacccggaguuuuaccugcuugcuugcuuuccugga

SEQ ID NO: 169401 - RNA, 64 nt, Homo Sapiens
cccugauuucccgcucuggagauuugaagggagaguagaagagauagggggucuuuagagugaa

SEQ ID NO: 169402 - RNA, 64 nt, Homo Sapiens
auucacaugcucauauguuuauaaacuguguuuuguagaagaaaaagaaucauaacaauacaaa

SEQ ID NO: 169403 - RNA, 64 nt, Homo Sapiens
gacagagaaguggacuccaaaccucauuuuaguuguagaagaaaauuucuuacaaaacaaauuc

SEQ ID NO: 169404 - RNA, 64 nt, Homo Sapiens
cuauaccccaugaaauguaaauacuguaucauaaguagaagaaaauaauuuuuguuuucuaaaa

SEQ ID NO: 169405 - RNA, 64 nt, Homo Sapiens
ugugcaaggugauaggaaaacugaauccaucuuuguagaagagcacugggcuaauuuguauguu

SEQ ID NO: 169406 - RNA, 64 nt, Homo Sapiens
acuacugcaaaaaguacauagugaauuuuaaaauguagaagaaagcaaaaaauaaaauaagucc

SEQ ID NO: 169407 - RNA, 64 nt, Homo Sapiens
ccccaaccuuuucucucugccugaacucaucaaaguagaagagcaaccauuuaaaaauauucuu

SEQ ID NO: 169408 - RNA, 64 nt, Homo Sapiens
uuaaguccauacgcauuucauaaacaucauguauguagaagaucccucccacccugcccaugau

SEQ ID NO: 169409 - RNA, 64 nt, Homo Sapiens
uucugccuccuccauucuuccugggugcagaacuguagaagacccugaggacuccugggcuagu

SEQ ID NO: 169410 - RNA, 64 nt, Homo Sapiens
auuugacaucucucuagcccauccauugcuuacaguagaagaguggggcuguaugcuugauaau

SEQ ID NO: 169411 - RNA, 64 nt, Homo Sapiens
gguaugugugcaggauuacccaagaauaacuuaaguagaagaaacaagaaagggaaucuuguau

SEQ ID NO: 169412 - RNA, 64 nt, Homo Sapiens
uugacauuuuguucacaucaacuaauguucaccuguagaagagaacaaauuucgaauaauccag

SEQ ID NO: 169413 - RNA, 64 nt, Homo Sapiens
aaauacuguaauagguaauagaacugagaaguguguagaagagugaaagcucccguauauacau

SEQ ID NO: 169414 - RNA, 64 nt, Homo Sapiens
uguugagccuuaaggaauaaagugacugagagcaguagaagacuacaucugacucccaggauaa

SEQ ID NO: 169415 - RNA, 64 nt, Homo Sapiens
uuagacagcugucuuccugcaguguccucacgugguagaagaggaaggcagcucuccggggucc

SEQ ID NO: 169416 - RNA, 64 nt, Homo Sapiens
cugucuggaaagggagggacaaaaggacccagaaguagaagaauggggauggaguggugagaau

SEQ ID NO: 169417 - RNA, 64 nt, Homo Sapiens
gguaagaaugugcuucuuccagagucacagucuaguagaagaaaugucuuuacugggaagcugg

SEQ ID NO: 169418 - RNA, 64 nt, Homo Sapiens
agucacuaagcccuaacagcuuuaaaagcucaaaguagaagaggucauuaugaauagucaguau

SEQ ID NO: 169419 - RNA, 64 nt, Homo Sapiens
aauuagguggaauaaugacucgagcaggaaagcaguagaagaggauuccuucaccacaguuuca

SEQ ID NO: 169420 - RNA, 64 nt, Homo Sapiens
uaaaaguaauaaugaagauuaugcaauucuaacuguagaagagauagcuauuaaaauaaucagu

SEQ ID NO: 169421 - RNA, 64 nt, Homo Sapiens
accguauuuucuaggacaagaguucucagucacugugcaauaugcccccugggucccaggaggg

SEQ ID NO: 169422 - RNA, 64 nt, Homo Sapiens
cugucucaguacaauccaaauuugucguagacuugugcaauauauacuguuguggguuggagaa

SEQ ID NO: 169423 - RNA, 64 nt, Homo Sapiens
uacucaguaagacagugcagugcucaguaaggcagugcaauacucaguaacaguguaguacuca

SEQ ID NO: 169424 - RNA, 64 nt, Homo Sapiens
gcaguacucaggaaugcagcacaguacucaggcagugcaauacucagugcgguacucaguaaca

SEQ ID NO: 169425 - RNA, 64 nt, Homo Sapiens
caccaguuuugcccucugcccccugcaauucacggugcaauauucacggggugggggugagggc

SEQ ID NO: 169426 - RNA, 64 nt, Homo Sapiens
uccccaccccucaguugacgcucuaagauauacagugcaauagccccucccuuccccaguuuuu

SEQ ID NO: 169427 - RNA, 64 nt, Homo Sapiens
ggcccuguuggcaagaugagugcaauauuaggcggugcaauagaagauggugucuaacgagcag

SEQ ID NO: 169428 - RNA, 64 nt, Homo Sapiens
aggcggugcaauagaggcccgugucuaacgagcagugcaauauuugacauggauaagugagaug

SEQ ID NO: 169429 - RNA, 64 nt, Homo Sapiens
aacuaugagauuuuuaaaaaauggggccgcugaugugcaauaucaaagugaacuugugaguauu

SEQ ID NO: 169430 - RNA, 64 nt, Homo Sapiens
guaccucucuuuugugacucuuguacagcuuaaugugcaauaaaggaaaaguuauaucugucuu

SEQ ID NO: 169431 - RNA, 64 nt, Homo Sapiens
uuguggccacuggaaaucccgaacagaccucucugugcaauaacagcuguaagagucuggcuua

SEQ ID NO: 169432 - RNA, 64 nt, Homo Sapiens
aaagguguauguauguuuuguuugugugaaagaugugcaauaacguauauuauacauacacaag

SEQ ID NO: 169433 - RNA, 64 nt, Homo Sapiens
uacacaugucaacuugauggucuaggggauauuugugcaauaaauauuauaauaaccucccagu

SEQ ID NO: 169434 - RNA, 64 nt, Homo Sapiens
aacauacuaguacagauuuuuuugaaaauguuaagugcaauaaauaauaugucuuaauuuugag

SEQ ID NO: 169435 - RNA, 64 nt, Homo Sapiens
auguauuuguuuguauuuuguaaaauauuuuuaugugcaauaaacaauacuucaauacuucauu

SEQ ID NO: 169436 - RNA, 64 nt, Homo Sapiens
ucaauacuucauuuaaaauaaucaauucuauuacgugcaauacuuagguuugugacuuuccuaa

SEQ ID NO: 169437 - RNA, 64 nt, Homo Sapiens
ugauguggcaaaucucuauuuaguguuggaaaaugugcaauaugaauauuugcaagacauagaa

SEQ ID NO: 169438 - RNA, 64 nt, Homo Sapiens
aucacaguguuuuuauugcucgcccagacaccaugugcaauaagauugguguucguuuccauca

SEQ ID NO: 169439 - RNA, 64 nt, Homo Sapiens
gggagacaaaggaggaauuuacuuucuucaccaagugcaauagauuacugaugugauauucugu

SEQ ID NO: 169440 - RNA, 64 nt, Homo Sapiens
cccacaacaaaaacccaaguuuucugugcuacaugugcaauauuuguuaugaauguuaucacaa

SEQ ID NO: 169441 - RNA, 64 nt, Homo Sapiens
uguuucauguccauucaagugacuuuuauucugagugcaauauuucaauagccuuguagugaua

SEQ ID NO: 169442 - RNA, 64 nt, Homo Sapiens
gauguacaguauuuuuuguuguuuuuaucaucaugugcaauauuacugauuuguuuccaugcug

SEQ ID NO: 169443 - RNA, 64 nt, Homo Sapiens
uucucuacucuuuaguagaguucgagacacagaagugcaauaacugcccuaauuaagcaacuau

SEQ ID NO: 169444 - RNA, 64 nt, Homo Sapiens; identical to SEQ ID NO: 169442

SEQ ID NO: 169445 - RNA, 64 nt, Homo Sapiens; identical to SEQ ID NO: 169443

SEQ ID NO: 169446 - RNA, 64 nt, Homo Sapiens
ugaaggaccaaaaggccaaaaaacagugaaauaugaucaucaucuccuugcggacuucucugcc

SEQ ID NO: 169447 - RNA, 64 nt, Homo Sapiens
ucucuuccuuuagggcuacugagucuugauuccugaucaucagaaauuucaccagaaacaacuu

SEQ ID NO: 169448 - RNA, 64 nt, Homo Sapiens
cggguugauucuacagguuagcggguuagauagagaucaucagcucaucagccagguugauugu

SEQ ID NO: 169449 - RNA, 64 nt, Homo Sapiens
cugguagauuguguggguuaguggguuagauagagaucaucagcucaucagccagguugauugu

SEQ ID NO: 169450 - RNA, 64 nt, Homo Sapiens
auucuguggauugauuuaauggaguugucagcaugaucaucaucuucuagccaggggcauaguu

SEQ ID NO: 169451 - RNA, 64 nt, Homo Sapiens
uggagaugggugaggaacagcacagagcagcagggaucaucacaugcagccaaacuuggccucu

SEQ ID NO: 169452 - RNA, 64 nt, Homo Sapiens
aagacauauguccacuaagugagcaaagcaaugagaucaucaugugguagugcaaaucagauca

SEQ ID NO: 169453 - RNA, 64 nt, Homo Sapiens
gucucuggagaagcauggauucaaucuuugauaugaucaucaaggucuuucaacuuuaaaauua

SEQ ID NO: 169454 - RNA, 64 nt, Homo Sapiens
aaauacuuucgaaauuucauauaaccauagccucgaucaucaagagguauauguuuuauaauuc

SEQ ID NO: 169455 - RNA, 64 nt, Homo Sapiens
uagaauauggcuaugaaucaaguggacagucuuugaucaucaugaaaaugaugguagguagcac

SEQ ID NO: 169456 - RNA, 64 nt, Homo Sapiens
uaaguaugugaaugugcgcauuuugcauuccauaugaaaaaaaugccacgucuguuuaaauuau

SEQ ID NO: 169457 - RNA, 64 nt, Homo Sapiens
augauuuaugguguuuuuugaaauuugucuuaauugaaaaaagaccaaauauuucaaaugagcu

SEQ ID NO: 169458 - RNA, 64 nt, Homo Sapiens
uuaacaaauaaaaggcauuuaaguaaaacuaaaaugaaaaaaguaggccuucugacauugugua

SEQ ID NO: 169459 - RNA, 64 nt, Homo Sapiens
auaaacacuaacauuuuccccuucuguaguuguaugaaaaaacaaauauuguuagcauaguaga

SEQ ID NO: 169460 - RNA, 64 nt, Homo Sapiens
augaaccugggcuaaugggagacuguagagaaaaugaaaaaagauccaccagaggacaucuugg

SEQ ID NO: 169461 - RNA, 64 nt, Homo Sapiens
guugcuacucccauggcaaagaaaaaaaaaagaaugaaaaaaagaaaaaaauuuggaaaaaaaa

SEQ ID NO: 169462 - RNA, 64 nt, Homo Sapiens
ugggcuugucauuuuuucccaaaaauauuucccuugaaaaaaaccuacugaccuuucacagaga

SEQ ID NO: 169463 - RNA, 64 nt, Homo Sapiens
caaaggguuauagggguacacugaagucuuucucugaaaaaagcgagugaaagggacaauuugg

SEQ ID NO: 169464 - RNA, 64 nt, Homo Sapiens
aaaguaccacaauagcuguauagcuuaaauacauugaaaaaacucuaaugcucaggugagauca

SEQ ID NO: 169465 - RNA, 64 nt, Homo Sapiens
gaaaaagucugaagcucugagccagaagacaugaugaaaaaagauccuucaacacccagaauga

SEQ ID NO: 169466 - RNA, 64 nt, Homo Sapiens
agcaguaguaaucuggugaaguauuuucuuagucugaaaaaaacaaaaaaauccaauuuuguca

SEQ ID NO: 169467 - RNA, 64 nt, Homo Sapiens
accauuucugaagcccgauuagacaugcucgucaugaaaaaagaaacaugauugauagcuggac

SEQ ID NO: 169468 - RNA, 64 nt, Homo Sapiens
aaauggcuaauaaacuguauugauauacauugugugaaaaaagaucaguauuuuuuuuuaauuu

SEQ ID NO: 169469 - RNA, 64 nt, Homo Sapiens
ugaaccuauuuucauuuguauuuccauuuauuuaugaaaaaauaaagcuggaacauuugauauu

SEQ ID NO: 169470 - RNA, 64 nt, Homo Sapiens
uucugauucaugaagaaaagcagauagaagugguugaaaaaaugaauucugagguauuuucuuu

SEQ ID NO: 169471 - RNA, 64 nt, Homo Sapiens
agagaaaagaaauauuuggaggauauugaaagugugaaaaaaaagaaugauaaucuuuuaaagg

SEQ ID NO: 169472 - RNA, 64 nt, Homo Sapiens
auaaagcugaucauguuuugcuacaguuugcaggugaaaaaaaauaaauauuauaaaauaugcu

SEQ ID NO: 169473 - RNA, 64 nt, Homo Sapiens
ccuggggauagagugagaucccaucucuaaaaaaugaaaaaaagaagagagguagcuuuaaagu

SEQ ID NO: 169474 - RNA, 64 nt, Homo Sapiens
aaaaaaauuaaaguacacauuuuugucccuuuauugaaaaaauauuaaccuguucauacaccca

SEQ ID NO: 169475 - RNA, 64 nt, Homo Sapiens
uugaacacaaucucauugagaguugcaagaaugcugaaaaaaaaaggucuauacuuaagggaaa

SEQ ID NO: 169476 - RNA, 64 nt, Homo Sapiens
ucucuaugagcuaaaugucuagaauagauagcacugaaaaaaaauggauuaacccucuauagac

SEQ ID NO: 169477 - RNA, 64 nt, Homo Sapiens
auauuuuucccuguuugccucauucaguacuuuaugaaaaaaauaaacagaugaaaaaaguuaa

SEQ ID NO: 169478 - RNA, 64 nt, Homo Sapiens
uaacauucaguacuuuaugauuuuuacaaacagaugaaaaaaguacacacuuuugcacauauau

SEQ ID NO: 169479 - RNA, 64 nt, Homo Sapiens
aauuacugucaccacuaguuuuaauauaguacaaugaaaaaauaauauauauauauauaguaca

SEQ ID NO: 169480 - RNA, 64 nt, Homo Sapiens
gaaaucaugaguaaaauuggaaaacacuuuuaacugaaaaaaacaaaagcacaacaaaccaaaa

SEQ ID NO: 169481 - RNA, 64 nt, Homo Sapiens
uuucccucuauaaguguuauugauuauuuuaaauugaaaaaaguuucacuuggaugaaaaaagu

SEQ ID NO: 169482 - RNA, 64 nt, Homo Sapiens
ugauuauuuuaaauugaaaaaaguuucacuuggaugaaaaaaguagaaaaguaggucauucuug

SEQ ID NO: 169483 - RNA, 64 nt, Homo Sapiens
uucaccguuugucuucuuaccugaaaaaaugaucugaaaaaagucaucagcaaggcauugacuu

SEQ ID NO: 169484 - RNA, 64 nt, Homo Sapiens
aucugaaaaaaguuucaccgaaggcauugacuucugaaaaaaugauguugcgcuuugcaucagc

SEQ ID NO: 169485 - RNA, 64 nt, Homo Sapiens
auucucaggcuuuacagcaagcagaagaaccaacugaaaaaaaauuugcagguaucacagccuu

SEQ ID NO: 169486 - RNA, 64 nt, Homo Sapiens
aaaaaagcucauauuaauuaaacauaggcagcacugaaaaaaaaacauucuaccagcacaagga

SEQ ID NO: 169487 - RNA, 64 nt, Homo Sapiens
aauuuguacucugugcauuguuucuacuuuuuguugaaaaaaggauuugggaguauuuuugauu

SEQ ID NO: 169488 - RNA, 64 nt, Homo Sapiens
aaagcauuuguacuaagcucuaaauuucucuuuuugaaaaaaagauugaagaccagcuuucuca

SEQ ID NO: 169489 - RNA, 64 nt, Homo Sapiens
aauauguauacacaaauauaaagacagcucuucuugaaaaaaaaagaaaacugagcauacuagc

SEQ ID NO: 169490 - RNA, 64 nt, Homo Sapiens
aagauugaaauuugaacuauucugaucuggggcaugaaaaaagccaguguuucuucacuucuuu

SEQ ID NO: 169491 - RNA, 64 nt, Homo Sapiens
cuccagagcagacuucugacacuguccuugcagaugaaaaaaguaguuagucauggaauaaagc

SEQ ID NO: 169492 - RNA, 64 nt, Homo Sapiens
uaagaaagaaagaguuggauaacuguagguaaacugaaaaaaaacaagaaaggauugguacugc

SEQ ID NO: 169493 - RNA, 64 nt, Homo Sapiens
gcgcagcugggaaguucacauuaaaaaacuaagaugaaaaaagugaaagaagagguauacuuau

SEQ ID NO: 169494 - RNA, 64 nt, Homo Sapiens
agcaaacaaaaaaaucgaaaaaucuuguuaacaaugaaaaaauggacucuugcauagaaaaaaa

SEQ ID NO: 169495 - RNA, 64 nt, Homo Sapiens
uaauuuuugcuccaauauccauucuguagacuuuugaaaaaaaaguuuuuaauuugaugcccaa

SEQ ID NO: 169496 - RNA, 64 nt, Homo Sapiens
auauuauuaauuuuuauuuauuuuucuugggaauugaaaaaaauugaaauaaauaaaaaugcau

SEQ ID NO: 169497 - RNA, 64 nt, Homo Sapiens
uaacaugauuauuugaacuuauuuacacauaguuugaaaaaaaaaagacaaaaauaguauucag

SEQ ID NO: 169498 - RNA, 64 nt, Homo Sapiens
ugucuuuuuuucaagaugcuuuguuucuuucauaugaaaaaaaugcauuuuauaaauucagaaa

SEQ ID NO: 169499 - RNA, 64 nt, Homo Sapiens
cguaucuuaacagugaacaaggccacuaaguauaugaaaaaaguacagaagagagaaugcaaau

SEQ ID NO: 169500 - RNA, 64 nt, Homo Sapiens
acacuaaaaaugaagaaaugcuguuuaacccacuugaaaaaaaacucucaagguacucacagau

SEQ ID NO: 169501 - RNA, 64 nt, Homo Sapiens
aucuauuguuccuaguaaucuuaggggaguggucugaaaaaacaucaagcauaguaauugucug

SEQ ID NO: 169502 - RNA, 64 nt, Homo Sapiens
caaaaugagucccggaaggucaguaagugcaacaugaaaaaaaucuaugaaaagauuauuugac

SEQ ID NO: 169503 - RNA, 64 nt, Homo Sapiens
cccaguauaugcuauucaaugaucuuagaaguacugaaaaaaaaagacguuuuuaaaacguaga

SEQ ID NO: 169504 - RNA, 64 nt, Homo Sapiens
uuucaugucauuugacauuuuuuguuugcugaagugaaaaaaaaagauaaagguuguacggugg

SEQ ID NO: 169505 - RNA, 64 nt, Homo Sapiens
auuuuuaauggcuaauagcccagugccauccaguugaaaaaacaacagcaaucacaaaguagag

SEQ ID NO: 169506 - RNA, 64 nt, Homo Sapiens
aaauaacuuaaaaagaacuuugaauaaaauucuaugaaaaaagacacuagaaugcuguucuuaa

SEQ ID NO: 169507 - RNA, 64 nt, Homo Sapiens
uggguauccuguaauuuaguuguaacauagaaaaugaaaaaacaguuaaaaaaagugaaguagu

SEQ ID NO: 169508 - RNA, 64 nt, Homo Sapiens
uuuaagaaauagucuauguaaagucacaaauuaaugaaaaaaauucgcaugaaaaugacagaua

SEQ ID NO: 169509 - RNA, 64 nt, Homo Sapiens
auggucaguaaauguucuauugauuaucaaucagugaaaaaagaaaucuguuuaaaauacugaa

SEQ ID NO: 169510 - RNA, 64 nt, Homo Sapiens
ugaaguguagaucauuguauucagagauuguaaaugaaaaaaauauagaaacuauuuaguuuug

SEQ ID NO: 169511 - RNA, 64 nt, Homo Sapiens
cacugacauuuuuuuuuauuaaaaaacuuuaacaugaaaaaacgaggaacaaaacaaagcuuug

SEQ ID NO: 169512 - RNA, 64 nt, Homo Sapiens
uuaacaugaaaaaacgcacuacaaaacaaagcuuugaaaaaacuuguggucagcacaacaagga

SEQ ID NO: 169513 - RNA, 64 nt, Homo Sapiens
caaaauuuuuugccuuccaugcauacuuuccaguugaaaaaaaugcauagccaaggcuagcgag

SEQ ID NO: 169514 - RNA, 64 nt, Homo Sapiens
guaaaauuauagcacuaacuauuguuccacauauugaaaaaacucacagaacuuuuccauaaac

SEQ ID NO: 169515 - RNA, 64 nt, Homo Sapiens
cacuuuccaacuauuauauauuacaaaggaaccaugaaaaaaaauaacacugauucuuauugua

SEQ ID NO: 169516 - RNA, 64 nt, Homo Sapiens
uuuagaagauauuuuggagauuuacauuaauaugugaaaaaagauuaauguacuaaauccuaug

SEQ ID NO: 169517 - RNA, 64 nt, Homo Sapiens
uaaggaguuuacgaaaucugcuguuuuaucaaagugaaaaaaaauugcuuauuacucuucauuu

SEQ ID NO: 169518 - RNA, 64 nt, Homo Sapiens
uucaugucuguacagauuauuuaaaucauggaaaugaaaaaaauguucucugcuugcuaccaaa

SEQ ID NO: 169519 - RNA, 64 nt, Homo Sapiens
gggccgggggggguaggagaggagaaaaaaaaagugaaaaaaagaaacgaaaaggacagacgaa

SEQ ID NO: 169520 - RNA, 64 nt, Homo Sapiens
uguguucagguuuauagcuguuguguuuaaaaauugaaaaaaguggaaaacaucuuuguacauu

SEQ ID NO: 169521 - RNA, 64 nt, Homo Sapiens
gauucuuacggaaauuuuuuuaccugacuugcuaugaaaaaacucaucacacaagaagagaaac

SEQ ID NO: 169522 - RNA, 64 nt, Homo Sapiens
aagaaucuuguaacuuuauucuuuuuucuccugcugaaaaaaaaaauuaaaccaaucguaugaa

SEQ ID NO: 169523 - RNA, 64 nt, Homo Sapiens
agaccccuuggucaaugguguucuggcuuacuuaugaaaaaaucagagagaugaguggagucag

SEQ ID NO: 169524 - RNA, 64 nt, Homo Sapiens
ugacuuccucugacagccacacaccgaaucuugaugaaaaaagagaagagcauuugccuuguua

SEQ ID NO: 169525 - RNA, 64 nt, Homo Sapiens
cugcccccucuuucacuaaggaaggcaaaugaagugaaaaaaaaaaaugccauuuucaauccuu

SEQ ID NO: 169526 - RNA, 64 nt, Homo Sapiens
uccaaacacaaaagacucuacuggaaaguguaggugaaaaaacuuguaacuguauugaaaauaa

SEQ ID NO: 169527 - RNA, 64 nt, Homo Sapiens
uuucaaaagaagaccuacaauuggccaacaaacaugaaaaaaugcucaguaucacuaaucauca

SEQ ID NO: 169528 - RNA, 64 nt, Homo Sapiens
aaucaaucuaagugcccaacaacaguaaauucaaugaaaaaaaaugugguacauagauacgaug

SEQ ID NO: 169529 - RNA, 64 nt, Homo Sapiens
uauccauuuccuaugcguuuuacuccucagagaaugaaaaaaacugcaucccaucacccaaagu

SEQ ID NO: 169530 - RNA, 64 nt, Homo Sapiens
aaaaugguuaccaguacagucaaaaaagagaaaaugaaaaaaauacaacuaaaaggaagaaaca

SEQ ID NO: 169531 - RNA, 64 nt, Homo Sapiens
cauacuuaccuugagucugaggaacucacauaggugaaaaaacccaacucuugugguacaucag

SEQ ID NO: 169532 - RNA, 64 nt, Homo Sapiens
uucuaacaaaacucugacuuagccccagcaagugugaaaaaagcgaaaacccacccuggggaga

SEQ ID NO: 169533 - RNA, 64 nt, Homo Sapiens
gaauuucaagauucucaacuuuguuuuauucuacugaaaaaaauuuacguuuucaugcugcuua

SEQ ID NO: 169534 - RNA, 64 nt, Homo Sapiens
auacguaaucuguuucaccuuaaaauagcaugcuugaaaaaaaaugaugagauaucaagguaau

SEQ ID NO: 169535 - RNA, 64 nt, Homo Sapiens
acauagcaugacuguuuuuugaauagguuggaauugaaaaaacaauuaucaaacguuaagaaca

SEQ ID NO: 169536 - RNA, 64 nt, Homo Sapiens
uuuguugacuuaaaaauaugagauacauaggaugugaaaaaaaauguuugcaguacucagcaaa

SEQ ID NO: 169537 - RNA, 64 nt, Homo Sapiens
augaacucaaucuaaauuaaaaaagaaagaaauuugaaaaaacuuucucuuugccauuucuucu

SEQ ID NO: 169538 - RNA, 64 nt, Homo Sapiens
cuauuuuguauaugugagauguuuaaauaaauugugaaaaaaaugaaauaaagcauguuugguu

SEQ ID NO: 169539 - RNA, 64 nt, Homo Sapiens
guaauauguaaauuaaaauauuucuacauuuuauugaaaaaaaaaccuuuuuuuuugccuaaau

SEQ ID NO: 169540 - RNA, 64 nt, Homo Sapiens
acacauuaauguugaauuuuacagacaguauauuugaaaaaaauugauuccauguagucuucaa

SEQ ID NO: 169541 - RNA, 64 nt, Homo Sapiens
uuguauccuuauuuuguaaucuucgaaucauguuugaaaaaacguuacaggaauuguauguuca

SEQ ID NO: 169542 - RNA, 64 nt, Homo Sapiens
aaaagaaauagaagauuccuuacaauagcaaacuugaaaaaaaaacuaaaagauauguuucuga

SEQ ID NO: 169543 - RNA, 64 nt, Homo Sapiens
uugaaauaaacuauaucauaaaggaaguaugaguugaaaaaaaauuuuggucagugcuauuuua

SEQ ID NO: 169544 - RNA, 64 nt, Homo Sapiens
ggggaggauuguucacucacuguauuaagugguaugaaaaaaaguaaauaagaaaauuaauaau

SEQ ID NO: 169545 - RNA, 63 nt, Homo Sapiens
acagucuguauucaugaauuauuaaaauucucuuugaaaaaauaaucucugcuaauuuuucag

SEQ ID NO: 169546 - RNA, 64 nt, Homo Sapiens
ccacaucgucuguuuucacucuauaugagauggcugaaaaaauaaauuguaacucggggccuaa

SEQ ID NO: 169547 - RNA, 64 nt, Homo Sapiens
auuuguagauaggauaaucuccacagugauuagaugaaaaaauuuuuaaauaacacaaaauuga

SEQ ID NO: 169548 - RNA, 64 nt, Homo Sapiens
ucaaaaaacaauuagcauuguaugucacuacauaugaaaaaacauaucagugcuaaaugcucug

SEQ ID NO: 169549 - RNA, 64 nt, Homo Sapiens
aaaugacuuuucaaauuauaaugcauuuuuauuaugaaaaaauaugaauugcaucagaucaugg

SEQ ID NO: 169550 - RNA, 64 nt, Homo Sapiens
aaggaaaaaagaauaagaauuugcaaugaaaaaaugaaaaaaagauaacucugguguguuaaca

SEQ ID NO: 169551 - RNA, 64 nt, Homo Sapiens
aaaaaaagaaggaaaaaagauguuaacauugcaaugaaaaaaugaaaaucacauaacucuggug

SEQ ID NO: 169552 - RNA, 64 nt, Homo Sapiens
uacugcaacuuaacuuaaaagcuaauauuuuauuugaaaaaaguauuauuuuaucugguauggu

SEQ ID NO: 169553 - RNA, 64 nt, Homo Sapiens
uuucuauuuaguuauuuaaguaauauuugugcuuugaaaaaaagguagaacugauuuuacaaau

SEQ ID NO: 169554 - RNA, 64 nt, Homo Sapiens
uaaggugacucgaguguuuaaaaugacuugcagaugaaaaaaacuuuaaaugcuuuuuaucgcu

SEQ ID NO: 169555 - RNA, 64 nt, Homo Sapiens
uagcuuuuaugugauauguuauacacauuaucacugaaaaaaugaguuuuucugucauuguuaa

SEQ ID NO: 169556 - RNA, 64 nt, Homo Sapiens
uucaaauucacguucuagugcugccugacaauuaugaaaaaaugacugcuuuauuuuuauaaaa

SEQ ID NO: 169557 - RNA, 64 nt, Homo Sapiens
acuuggccaggagaaauaauauaaaaaugcuaagugaaaaaaagggaugauaagaaaugcuaau

SEQ ID NO: 169558 - RNA, 64 nt, Homo Sapiens
acaguuuaaaaagggaaacaacugcuccauggauugaaaaaauaagaugcauacccguuucuca

SEQ ID NO: 169559 - RNA, 64 nt, Homo Sapiens
uaauuccagucauuuugggaauuccugcuuaacuugaaaaaaauaugggaaagacaugcagcuu

SEQ ID NO: 169560 - RNA, 64 nt, Homo Sapiens
guccuaaaaagacacgguugcucuauauaugaagugaaaaaaggauaugguagcauuuuauagu

SEQ ID NO: 169561 - RNA, 64 nt, Homo Sapiens
aagauggugggggcauuuuuagagcggcaauaauugaaaaaaaaggcgaacucugccuuggaga

SEQ ID NO: 169562 - RNA, 64 nt, Homo Sapiens
ccaacuaaagaauggauuuaauuaaacuauguauugaaaaaaaaguagccuaaguguuagagau

SEQ ID NO: 169563 - RNA, 64 nt, Homo Sapiens
aaagaaaaaaauauucugaaucaguaaaacuuaaugaaaaaagcucuuuuuuccaccuuuuugg

SEQ ID NO: 169564 - RNA, 64 nt, Homo Sapiens
acguagaaaaauguuuagaugcuguuuuaacaaaugaaaaaaagcugaaaauguauuuaacaua

SEQ ID NO: 169565 - RNA, 64 nt, Homo Sapiens
uccuguggauguuuuguguaaaaaaaaaaaaagaugaaaaaagugaaauguuuguguacaauuc

SEQ ID NO: 169566 - RNA, 64 nt, Homo Sapiens
gauuauuuuuauuagauaaugaagugacuaaugcugaaaaaauucagaauaacacuugguuaug

SEQ ID NO: 169567 - RNA, 64 nt, Homo Sapiens; identical to SEQ ID NO: 169531

SEQ ID NO: 169568 - RNA, 64 nt, Homo Sapiens; identical to SEQ ID NO: 169532

SEQ ID NO: 169569 - RNA, 64 nt, Homo Sapiens
uugguugaaacuauguuuaacuaucuuggauauuugaaaaaaaauuuuuaagaauuaguaucua

SEQ ID NO: 169570 - RNA, 64 nt, Homo Sapiens
gacuucauaacccaauguuacaggucucguuugaugaaaaaaccccuugagacuuucaagaaug

SEQ ID NO: 169571 - RNA, 64 nt, Homo Sapiens
uaugggauuaaagaaagucaaaaaaaaaaaauuaugaaaaaagugagugagacucugucucaaa

SEQ ID NO: 169572 - RNA, 64 nt, Homo Sapiens
ccaggugcaguggcucacgcugguauaaaaguuaugaaaaaaggaaaagguuauggguaacuua

SEQ ID NO: 169573 - RNA, 64 nt, Homo Sapiens
ggaccagaaaccagaagaacaaucaagacugcaaugaaaaaaauggauacauuaggagcuucaa

SEQ ID NO: 169574 - RNA, 64 nt, Homo Sapiens
aagucucauagauuuagaugcaaaauccuaaaauugaaaaaaacaucuagccauauccauaaac

SEQ ID NO: 169575 - RNA, 64 nt, Homo Sapiens
uauaugcacuuauaauuuucugaagucauaccaaugaaaaaaugagaaacaacaauuucuacuu

SEQ ID NO: 169576 - RNA, 64 nt, Homo Sapiens
gagccugagggaucuuuacucagcuauguuauauugaaaaaauaaaaaauuaaaauccucaauc

SEQ ID NO: 169577 - RNA, 64 nt, Homo Sapiens
cugugucuugauagcaugggucucaugaggcaacugaaaaaaucacugccaagcccagguugcc

SEQ ID NO: 169578 - RNA, 64 nt, Homo Sapiens
aagucuuguuggauaauaguaagaguuaacagaaugaaaaaaaauugccuucgaaugcauauuu

SEQ ID NO: 169579 - RNA, 64 nt, Homo Sapiens
auuaacauuucacaaauguuuagugaaacauuugugaaaaaagaagacuaaauuaagaccugag

SEQ ID NO: 169580 - RNA, 64 nt, Homo Sapiens
uuuuagccuaaguauaagaguccuacagauggacugaaaaaaaucagucugagaguauuaguca

SEQ ID NO: 169581 - RNA, 64 nt, Homo Sapiens
agagccugcccaagacuuugucuuauguguguccugaaaaaauaccuugcaguuagcccccaug

SEQ ID NO: 169582 - RNA, 64 nt, Homo Sapiens
cccuugauuauacucuguuguucuugauuaauguugaaaaaaaaacuuuugcagauggaggaau

SEQ ID NO: 169583 - RNA, 64 nt, Homo Sapiens
uucccucugcccugccauuccuauuacaaugcugugaaaaaaguucugcuucuuaggugaaugg

SEQ ID NO: 169584 - RNA, 64 nt, Homo Sapiens
ugcuguauuggugcaauaaugguaauuaaaaauaugaaaaaagugucucuuuuaucuuuuaauu

SEQ ID NO: 169585 - RNA, 64 nt, Homo Sapiens
gaaauugaugacuuuauaaugcaaccaggaguauugaaaaaaaaguaagcaaugagcucaaaua

SEQ ID NO: 169586 - RNA, 64 nt, Homo Sapiens
aaaugcugaaaagaagagaaauaccccaaguucuugaaaaaaaauuuuuugauaugacuacucu

SEQ ID NO: 169587 - RNA, 64 nt, Homo Sapiens
uccacauuuguucuuccuuccucaggguuagugaugaaaaaaaguaaauaucuuuuucauaugu

SEQ ID NO: 169588 - RNA, 64 nt, Homo Sapiens
guaaauaucuuuuucauauguccauuagaauguaugaaaaaaaucauuuuaacuaaaagcaaaa

SEQ ID NO: 169589 - RNA, 64 nt, Homo Sapiens
ugcauaccuaaugaaguauuugaaaagaaaauuaugaaaaaauacuauucucuuaaaaaguaug

SEQ ID NO: 169590 - RNA, 64 nt, Homo Sapiens
ccuagcuuuauucuucagauaaaugucuaaaugcugaaaaaacauaccauuugcauggcuccag

SEQ ID NO: 169591 - RNA, 64 nt, Homo Sapiens
aguguuuguauuuguauucucugcaauuuuacugugaaaaaaaauuuguuuucaacaauuggug

SEQ ID NO: 169592 - RNA, 64 nt, Homo Sapiens
aguguuuuguauuuuauagugaguugcauguuuuugaaaaaaagugcugaaaaugggaugugcu

SEQ ID NO: 169593 - RNA, 64 nt, Homo Sapiens
auuuuagugauuauuaagcacuucugucagucuuugaaaaaagaacguauuuuuugugcuuuga

SEQ ID NO: 169594 - RNA, 64 nt, Homo Sapiens
aaaauuguauaaggcugaaugaacuucauacaaaugaaaaaaaucucauaaaaauacauaaacu

SEQ ID NO: 169595 - RNA, 64 nt, Homo Sapiens
uauuuauauaacugcauuuaagcaguaccaagacugaaaaaaaagguaauaaaugaaauguuuu

SEQ ID NO: 169596 - RNA, 64 nt, Homo Sapiens
gcuugauuagcaaagguuuuugacaaacaguuuaugaaaaaauaaaacuuaaauacauuacacg

SEQ ID NO: 169597 - RNA, 64 nt, Homo Sapiens
caaguguuuaauaacuggcauuaagcuuagagggugaaaaaaaaaaaaaagauugauaguauuu

SEQ ID NO: 169598 - RNA, 64 nt, Homo Sapiens
aaaaaaaaaaaaagauugauaguauuuuucauaaugaaaaaacugaagagauacgugaaugaaa

SEQ ID NO: 169599 - RNA, 64 nt, Homo Sapiens
gaauaaaaaguagcaguaaaauaguuguacaauaugaaaaaaaagucgcuuaauaccuaauauc

SEQ ID NO: 169600 - RNA, 64 nt, Homo Sapiens
aaaugugccuguuuaaagcauucacugcaacaaaugaaaaaacacuaaacugagugugacuauu

SEQ ID NO: 169601 - RNA, 64 nt, Homo Sapiens
ggucuuaaguuggaaaaacugggcaccagugaguugaaaaaacuuagcaaaaucagaaacguua

SEQ ID NO: 169602 - RNA, 64 nt, Homo Sapiens
aagauauggaugaagugaacaauaaagaguauucugaaaaaaagaggauuugaaauaagacagg

SEQ ID NO: 169603 - RNA, 64 nt, Homo Sapiens
agaauaacaaauagaagggacaagaaauucaccaugaaaaaacacuaaauauuuuucagugagc

SEQ ID NO: 169604 - RNA, 64 nt, Homo Sapiens
aagagugaccagagggcaaauaaaaauugacaguugaaaaaaaagcugcuaugauaccacgccu

SEQ ID NO: 169605 - RNA, 64 nt, Homo Sapiens
gcuacauaaaacacuucuuaaguaaauguaaauaugaaaaaaguauuuuugaagccauauggug

SEQ ID NO: 169606 - RNA, 64 nt, Homo Sapiens
uuguaauacuacaaguauaacauaaauacuggacugaaaaaacaugcugcagccgagugaccuc

SEQ ID NO: 169607 - RNA, 64 nt, Homo Sapiens
uacaccucuacagcaggucgcugaugagagaaccugaaaaaaccacuuaccuuccgguggguug

SEQ ID NO: 169608 - RNA, 64 nt, Homo Sapiens
aaaaaaacuagaaagcuacgcuauuugauccaagugaaaaaaaaucuuuuucugucuaucaaaa

SEQ ID NO: 169609 - RNA, 64 nt, Homo Sapiens
ugaaucccucagugcugacuuauaucuuguucuuugaaaaaaugcauugacucuuuaagacauc

SEQ ID NO: 169610 - RNA, 64 nt, Homo Sapiens
cuccugauaaagaauauaaagugagccugauucuugaaaaaaucagaaccagagccuguuuugu

SEQ ID NO: 169611 - RNA, 64 nt, Homo Sapiens
uagccuuauucucuugcgugugaaucucuuacccugaaaaaaagccauaaugaauuaagccaga

SEQ ID NO: 169612 - RNA, 64 nt, Homo Sapiens
aagccagacugaccacuugcuuggagugugugcuugaaaaaaccagagcaauacuguuggguau

SEQ ID NO: 169613 - RNA, 64 nt, Homo Sapiens
acuauuguggcagaagcgagaaaacuuuguuuauugaaaaaaaaagaaaaagaaagcaagaaaa

SEQ ID NO: 169614 - RNA, 64 nt, Homo Sapiens
acaaacuaaagacuaaucgcucaauaugaaaacaugaaaaaauuuuugcuuaaaguauuaagau

SEQ ID NO: 169615 - RNA, 64 nt, Homo Sapiens
uucccauacauugcguguggggcaaagagacuacugaaaaaacaaaaaaauaagacccaauauu

SEQ ID NO: 169616 - RNA, 64 nt, Homo Sapiens
uaugcuucauuaguaauuaaaauggauaaaaccaugaaaaaaagaaauucauaaaagaaaucug

SEQ ID NO: 169617 - RNA, 64 nt, Homo Sapiens
aaaaaaaaaaguuacagaauaaagaaggaaaaauugaaaaaaaugacuagugcuuaaaaaaaaa

SEQ ID NO: 169618 - RNA, 64 nt, Homo Sapiens
aacaaaaacaaaaaauggaaaacccuuuuagcauugaaaaaaaauaagguugaaaauucugaau

SEQ ID NO: 169619 - RNA, 64 nt, Homo Sapiens
ucuccgaaaaucaugguaaagaauacugagacaaugaaaaaaaaucaacaaaauaugcuuucug

SEQ ID NO: 169620 - RNA, 64 nt, Homo Sapiens
ugcuuuuauuuuccuuggggugcugaaauugagcugaaaaaaaaaggcucuuugaauauaguuu

SEQ ID NO: 169621 - RNA, 64 nt, Homo Sapiens
uaugauucgguuuauacauauuaccuuguuauaaugaaaaaacucauucugagaacacugaaau

SEQ ID NO: 169622 - RNA, 64 nt, Homo Sapiens
uuacuagaaacuauggaaaacuggaaaauaacuuugaaaaaauuggauaaaguauaggaggguu

SEQ ID NO: 169623 - RNA, 64 nt, Homo Sapiens
uuuuuuuacaacacuggugacagucauaugguuuugaaaaaaaaaagaaauuuugcuucuuccc

SEQ ID NO: 169624 - RNA, 64 nt, Homo Sapiens
ggaagagagaggaagaagucaaaccauaugaaacugaaaaaauaugacguacgaaauggacaaa

SEQ ID NO: 169625 - RNA, 64 nt, Homo Sapiens
ugaggacuguaauugcauuucugugccuuucacuugaaaaaaaaaaaagaagaaaaaaaggcuu

SEQ ID NO: 169626 - RNA, 64 nt, Homo Sapiens
agcugaccuuucuauagcgugcugcauugguaaaugaaaaaaaauggggcaaacguuggagucc

SEQ ID NO: 169627 - RNA, 64 nt, Homo Sapiens
uugacagcuaguguuuuuuaugaaaaccaauuacugaaaaaaaagauugaaaaaaaaaaagcac

SEQ ID NO: 169628 - RNA, 64 nt, Homo Sapiens
aaagcacugaaaaccaauuaccuucucaucagauugaaaaaaaaacuccuuucuaauugcauca

SEQ ID NO: 169629 - RNA, 64 nt, Homo Sapiens
ucuuacuaccugauaucaagauaugacuguucucugaaaaaaggggcuuuguccaguuaucuuc

SEQ ID NO: 169630 - RNA, 64 nt, Homo Sapiens
ucacuaaauuuacaucacuaauuuuuuauuugcaugaaaaaaacuuuauuggacuuuuauagac

SEQ ID NO: 169631 - RNA, 64 nt, Homo Sapiens
agauuacaagggggaauaauaaaacacuucucagugaaaaaacaaauauuuuuuuaugaaaaaa

SEQ ID NO: 169632 - RNA, 64 nt, Homo Sapiens
aacacuucucagugaaaaaagaaauauuuuuuuaugaaaaaaaacuaucauaaaauuaucauuu

SEQ ID NO: 169633 - RNA, 64 nt, Homo Sapiens
uucagcuucuuacaaauacauaagagacucacacugaaaaaaguuguaugaauauaaaaaugua

SEQ ID NO: 169634 - RNA, 64 nt, Homo Sapiens
uucaaaaauauauauauaaugaaugugaggaauaugaaaaaacuuucuuugucuagcaaacuuu

SEQ ID NO: 169635 - RNA, 64 nt, Homo Sapiens
aaggccuuuauucugccaagucauuucgaagacaugaaaaaacucacacuggagagaaacccua

SEQ ID NO: 169636 - RNA, 64 nt, Homo Sapiens
aaggcuuuuauucucccacgucauuucaaagacaugaaaaaacucacacugcagagaaacccua

SEQ ID NO: 169637 - RNA, 64 nt, Homo Sapiens
aagcuuucagucagagacaaaaucuucuugagcaugaaaaaauucauacuggagagaaaccauu

SEQ ID NO: 169638 - RNA, 64 nt, Homo Sapiens
auuguguaacauggauaguuaaaacaauguugaaugaaaaaaaucaaaauacaaaugaaacauu

SEQ ID NO: 169639 - RNA, 64 nt, Homo Sapiens
gcaucauucuaauaccaaaaccugacaggcacaaugaaaaaagaaaacuucaggcugguacucc

SEQ ID NO: 169640 - RNA, 64 nt, Homo Sapiens
cucaaaagaauacauacauguggcaauaagcauaugaaaaaaaugguuaauaucgcuaaucauu

SEQ ID NO: 169641 - RNA, 64 nt, Homo Sapiens
auguacacauacuccuugaaccuaaaauaaaacaugaaaaaaagcaaauuucacaccuuguaaa

SEQ ID NO: 169642 - RNA, 64 nt, Homo Sapiens
ucucuagauuccuccucucugggcagcgcaucuuugaaaaaagugcagauaaaacccucaucuc

SEQ ID NO: 169643 - RNA, 64 nt, Homo Sapiens
auguucuaacccaaugcaaggaagcuaagaaccuugaaaaaagguuagaggaauugcuaacuag

SEQ ID NO: 169644 - RNA, 64 nt, Homo Sapiens
aaacacaaaaaaagacaaaagggauucuugaacuugaaaaaaaacucguggagaauuuuuacug

SEQ ID NO: 169645 - RNA, 64 nt, Homo Sapiens
aggggggugggaggggaagaaagcagaaacaaaaugaaaaaaaaggagcaggcaguggggcugg

SEQ ID NO: 169646 - RNA, 64 nt, Homo Sapiens
agauuuuuugaaaagugaguuaugcuuaacuuuuugaaaaaauuugcaguuauugcauucaaag

SEQ ID NO: 169647 - RNA, 64 nt, Homo Sapiens
ugugcgaauguaauaaaguucagggaauuuauauugaaaaaaacgcucaaacuuuguucaauau

SEQ ID NO: 169648 - RNA, 64 nt, Homo Sapiens
uagauacuguagugauucaaauaaguuuucuauuugaaaaaaaaaaucacuugauuguauccuu

SEQ ID NO: 169649 - RNA, 64 nt, Homo Sapiens
agguaaaacugaucaaaagcauaauugaaaguucugaaaaaagaaaaauaauaauauguagaaa

SEQ ID NO: 169650 - RNA, 64 nt, Homo Sapiens
cccaauauauauuuuuuggaacaggacagcccuaugaaaaaauacugucuaccuuuagccaggc

SEQ ID NO: 169651 - RNA, 64 nt, Homo Sapiens
aaccaaaauaugcucuugcguuaccccuagucuaugaaaaaacauuucuuaguagugcagaccu

SEQ ID NO: 169652 - RNA, 64 nt, Homo Sapiens
gcaacagacucaugacaaaggauucaagauuguuugaaaaaaaaaaaaggggagcagggaggca

SEQ ID NO: 169653 - RNA, 64 nt, Homo Sapiens
uuuacaucccagauagaaaacccuaaauuaaaggugaaaaaaccagacaccaaguggcauuuaa

SEQ ID NO: 169654 - RNA, 64 nt, Homo Sapiens
cauuuucgcuauaaauaaaauguuacucuguaaaugaaaaaaccuuuauuuaaagaaaaaucuu

SEQ ID NO: 169655 - RNA, 64 nt, Homo Sapiens
ugaauuauuggacagucucauugggucuaugccuugaaaaaagcuucuugagguugucugaguc

SEQ ID NO: 169656 - RNA, 64 nt, Homo Sapiens
agaugcuggaccugugcuaaauucuucagugauaugaaaaaaucauugagcauucauuauugcg

SEQ ID NO: 169657 - RNA, 64 nt, Homo Sapiens
uaagaguuucagcaugagcuuaauuaaauucuugugaaaaaaccuguguuuuuaguuacacaca

SEQ ID NO: 169658 - RNA, 64 nt, Homo Sapiens
aguucaugaaguaccaaugcaacaaauauuugcuugaaaaaaaacugucagaauuguuaacuga

SEQ ID NO: 169659 - RNA, 64 nt, Homo Sapiens
aaaacccugaccuguaaccugauucauacagccuugaaaaaaguaaaucucaagaagugaagca

SEQ ID NO: 169660 - RNA, 64 nt, Homo Sapiens; identical to SEQ ID NO: 125921

SEQ ID NO: 169661 - RNA, 64 nt, Homo Sapiens; identical to SEQ ID NO: 125922

SEQ ID NO: 169662 - RNA, 64 nt, Homo Sapiens; identical to SEQ ID NO: 125923

SEQ ID NO: 169663 - RNA, 64 nt, Homo Sapiens; identical to SEQ ID NO: 125924

SEQ ID NO: 169664 - RNA, 64 nt, Homo Sapiens; identical to SEQ ID NO: 125925

SEQ ID NO: 169665 - RNA, 64 nt, Homo Sapiens; identical to SEQ ID NO: 125926

SEQ ID NO: 169666 - RNA, 64 nt, Homo Sapiens; identical to SEQ ID NO: 125927

SEQ ID NO: 169667 - RNA, 64 nt, Homo Sapiens; identical to SEQ ID NO: 125928

SEQ ID NO: 169668 - RNA, 64 nt, Homo Sapiens; identical to SEQ ID NO: 125929

SEQ ID NO: 169669 - RNA, 64 nt, Homo Sapiens; identical to SEQ ID NO: 125930

SEQ ID NO: 169670 - RNA, 64 nt, Homo Sapiens; identical to SEQ ID NO: 125931

SEQ ID NO: 169671 - RNA, 64 nt, Homo Sapiens; identical to SEQ ID NO: 125932

SEQ ID NO: 169672 - RNA, 64 nt, Homo Sapiens
uugugaggugaaugucuuccuuuucuuucucccuaaccacuaauguuagaauugauuuccaaga

SEQ ID NO: 169673 - RNA, 64 nt, Homo Sapiens
aagucucuuaauucugaugcuagguuguuuuuaaaaccacuaugcaaagaacucaccacaagcc

SEQ ID NO: 169674 - RNA, 64 nt, Homo Sapiens
gcacccggcuugcaauuuagaaagggcacuuggcaaccacuaugugaagggugauuggagaagg

SEQ ID NO: 169675 - RNA, 64 nt, Homo Sapiens
cuucaaagucuuauugacacaguaaagggaggccaaccacuacuaacaaguucuagaagauaua

SEQ ID NO: 169676 - RNA, 64 nt, Homo Sapiens
uaaaaaucagaaaauacaagauuuacauaaaggucauuucaacuuuuaagguuaccagugauug

SEQ ID NO: 169677 - RNA, 64 nt, Homo Sapiens
auaguguaugagacuuaagccaugaguuuuguaucauuucaauuagaagacuacuagcugugag

SEQ ID NO: 169678 - RNA, 64 nt, Homo Sapiens
ugcuaucuccaucugggcuguaagggaucgaagacauuucaaauuagacauuucgucauuuaag

SEQ ID NO: 169679 - RNA, 64 nt, Homo Sapiens
ugcucuaucugggcugauaguaagggaucgaaaacauuucaaauuauacauuucaucauuuaag

SEQ ID NO: 169680 - RNA, 64 nt, Homo Sapiens
aaggagcuccgaugugagggaagccaaaccagcucauuucaacauccagaccuggaauccacaa

SEQ ID NO: 169681 - RNA, 64 nt, Homo Sapiens
gguaauguugccuggggcuucacuuaauucuucccauuucaaaauuuauaguuuggcuggggag

SEQ ID NO: 169682 - RNA, 64 nt, Homo Sapiens
gaguuuugcuaugggcugccuuauaugcagaacacauuucaaauccuugauuuguaaugagcuc

SEQ ID NO: 169683 - RNA, 64 nt, Homo Sapiens
ugauuuccucuguaaucuaugcagagauuuucaacauuucaaaaucaaugaaugaaacuagaaa

SEQ ID NO: 169684 - RNA, 64 nt, Homo Sapiens
uuuaauaucacuuaucuacuucauugccuaaguucauuucaaagaauuuguauuuagaaaaggu

SEQ ID NO: 169685 - RNA, 64 nt, Homo Sapiens
cuuuuggaaaauaccaaaugaacguacaguacaacauuucaaggaaaugaauauauuguuagac

SEQ ID NO: 169686 - RNA, 64 nt, Homo Sapiens
ugacuaaaauuuggaauuguaguuaguggaaaaacauuucaaccgcucauuuaucuuaucuuuc

SEQ ID NO: 169687 - RNA, 64 nt, Homo Sapiens
ggaugcauagguauauuacgauucuaauauaaagcauuucaauaguuuauggauuaaaaagaaa

SEQ ID NO: 169688 - RNA, 64 nt, Homo Sapiens
aggcucuuuugugcauaauauucuaaaaugaagacauuucaagcuauacaaauuacuuccaagu

SEQ ID NO: 169689 - RNA, 64 nt, Homo Sapiens
cuauuuuuaaggauagguuaaauuugugaaugaucauuucaaauauauugaauaaaauaagcaa

SEQ ID NO: 169690 - RNA, 64 nt, Homo Sapiens
gucuauaucuauuuucacggagcugcaaaggaaacauuucaagaacaaaguaugccaucaugca

SEQ ID NO: 169691 - RNA, 64 nt, Homo Sapiens
aacucagagauauuacucuuuucuauugcuaaaacauuucaaaaaacaguuuagcaguacaagc

SEQ ID NO: 169692 - RNA, 64 nt, Homo Sapiens
cuguaugaaaauguuaaauauuauuccauguaaacauuucaacuaggucuuucuguagggaaaa

SEQ ID NO: 169693 - RNA, 64 nt, Homo Sapiens
uuugcagucccuguauuaguaaaaaacauugaaucauuucaauuuauaaaacuuucucaaaaua

SEQ ID NO: 169694 - RNA, 64 nt, Homo Sapiens
uguaccuugggaagucaggacauggaggcaacagcauuucaagauucacccucaccucucccug

SEQ ID NO: 169695 - RNA, 64 nt, Homo Sapiens
caccagagugucccauugcuauacauuucaagugcauuucaagcgcuucagagucgaaguuugg

SEQ ID NO: 169696 - RNA, 64 nt, Homo Sapiens
gcauuucaagccaccagaguucgaaguuuggauacauuucaaguauguuucugaggcuucagag

SEQ ID NO: 169697 - RNA, 64 nt, Homo Sapiens
acucccuuuugacaaaaaaauugaauauuugcuucauuucaaauauaauuucuguuuaaaaaua

SEQ ID NO: 169698 - RNA, 64 nt, Homo Sapiens
uuaaucucugccaucucgcuuaguuucauuuaaucauuucaaagguacaauguuuucacauaua

SEQ ID NO: 169699 - RNA, 64 nt, Homo Sapiens
uggccugcugggaaacagcaaucuuccuuaauagcauuucaagccgugccuucuccgcagaaug

SEQ ID NO: 169700 - RNA, 64 nt, Homo Sapiens
gcugccauuuaagcauuccuguggcacccaucaccauuucaauuuaauuguuuacuuugaagcg

SEQ ID NO: 169701 - RNA, 64 nt, Homo Sapiens
guuuauuuggaaacaacagcucccaucuuuaugacauuucaaaucuccuccucaccuacuccac

SEQ ID NO: 169702 - RNA, 64 nt, Homo Sapiens
cuccugcucaugcaaaaucaggaaaucuuugaaccauuucaaguggccauggaacacauaugcu

SEQ ID NO: 169703 - RNA, 64 nt, Homo Sapiens
augcuagacuaaaauacagagucuuccaggugggcauuucaaccaacucagucaaggaacccau

SEQ ID NO: 169704 - RNA, 64 nt, Homo Sapiens
ccaacucagucaaggaacccaugacaaagaaagucauuucaacucuuaccucaucaaguugaau

SEQ ID NO: 169705 - RNA, 64 nt, Homo Sapiens
auguaacuuuuauaugaaaacaucuuccugcagacauuucaaacgcuaaccugucugauggugg

SEQ ID NO: 169706 - RNA, 64 nt, Homo Sapiens
cuugacucucucuccccuucuuuugaagucccuucauuucaaucguuuuuaguuuguuccuucu

SEQ ID NO: 169707 - RNA, 64 nt, Homo Sapiens
gcaucacuauuuuuaaauguacauuuuccccuuacauuucaaaguaaauuauaauguaaaguug

SEQ ID NO: 169708 - RNA, 64 nt, Homo Sapiens
ucugggauauaaauuacguagacaauuaccuuuacauuucaagcgaucuaaagauaaugucuua

SEQ ID NO: 169709 - RNA, 64 nt, Homo Sapiens
aaugacauuaaaaaucuaaaucuguuaugauugccauuucaauacuagaaggcucucauaaguu

SEQ ID NO: 169710 - RNA, 64 nt, Homo Sapiens
uggaugaauuguuauuauguaaggagaaguuacucauuucaaaauuuauacuagcaacacuaca

SEQ ID NO: 169711 - RNA, 64 nt, Homo Sapiens
uggugguugggauaucugcuuuucuuuguucagccauuucaagucuuugaaguaauugguuagu

SEQ ID NO: 169712 - RNA, 64 nt, Homo Sapiens
gccacauaugugacuuuaaauuuucugacagucacauuucaaaaaguaaaaagaagcaggugaa

SEQ ID NO: 169713 - RNA, 64 nt, Homo Sapiens
auuuuuuuuuaacccagucuauccaaaauauuuucauuucaauauaaaaucaguauaaaaagug

SEQ ID NO: 169714 - RNA, 64 nt, Homo Sapiens
auaaguacugagcaugaaguacuugucugccccucauuucaaggccagaguuauuuucuauuua

SEQ ID NO: 169715 - RNA, 64 nt, Homo Sapiens
ccuaucugucuccaauucaucuccccuuuucagccauuucaacaaacuacucuuuggagcucug

SEQ ID NO: 169716 - RNA, 64 nt, Homo Sapiens
auggguaagaguagaaccaggguaagucuuuccacauuucaauaaauaauaccuuagauuucua

SEQ ID NO: 169717 - RNA, 64 nt, Homo Sapiens
aaaugugacuuggcugucuuggaaauuaagagagcauuucaauaugcugaguuuuagaagugau

SEQ ID NO: 169718 - RNA, 64 nt, Homo Sapiens
uguaauuucaguuuggagcuugcagccaaguuuucauuucaaaaggauuuuaaaaauauuuuac

SEQ ID NO: 169719 - RNA, 64 nt, Homo Sapiens
guccaagaauuucuaguauagcuagcuuuccuuucauuucaaaaaagggcaugaaaaacuaacu

SEQ ID NO: 169720 - RNA, 64 nt, Homo Sapiens
uccaccaugggagagccuaaauguaagauggucccauuucaauugacuuaggagaaaaugcuga

SEQ ID NO: 169721 - RNA, 62 nt, Homo Sapiens
aaauauauauuucuuucuguauagcaguaauugacauuucaaaaaugucagcuuuugauagc

SEQ ID NO: 169722 - RNA, 64 nt, Homo Sapiens
auuuucuauauuuggagaaaaaaaugaauugaaccauuucaacucuauguauuuucucccggua

SEQ ID NO: 169723 - RNA, 64 nt, Homo Sapiens
cauuguacaugaaaaaaugagauugaguuuaguucauuucaauaugucuuuuuauauuauaagu

SEQ ID NO: 169724 - RNA, 64 nt, Homo Sapiens
uauuuauuuuuaaauuuucucgcucucuaaucagcauuucaaugaaagcaaccuaaauuacuuu

SEQ ID NO: 169725 - RNA, 64 nt, Homo Sapiens
aaaaauauuugaaagagaauuuuuauuuuauugucauuucaauauaaagugaucacuguucuuu

SEQ ID NO: 169726 - RNA, 64 nt, Homo Sapiens
aguuugcuuuuguucaaaucgguuaaacuggacucauuucaagcuauacaucacugauuauuug

SEQ ID NO: 169727 - RNA, 64 nt, Homo Sapiens
aauguuaugugcaaugaacaagccugugaaaauacauuucaaaacuuugcaaaugacuaccuau

SEQ ID NO: 169728 - RNA, 64 nt, Homo Sapiens
guuugcacaauauaccacuuaugguuugcaccgucauuucaaauaggguacaaaucucccaaag

SEQ ID NO: 169729 - RNA, 64 nt, Homo Sapiens
aagacaugugggaaaggcuuuuauucucccacgucauuucaaagacaugaaaaaacucacacug

SEQ ID NO: 169730 - RNA, 64 nt, Homo Sapiens
aagauaugugggaaaggcuuuuauucugccaagucauuucaaauaccugaaaaaucuuacacug

SEQ ID NO: 169731 - RNA, 64 nt, Homo Sapiens
agaacagcagcagcgcuacagcccagagguuauacauuucaacagaacagggauccuuggcuac

SEQ ID NO: 169732 - RNA, 64 nt, Homo Sapiens
ccagccacccccugccccacugcugaaugaaggccauuucaagcgcugcuucucacuccauucc

SEQ ID NO: 169733 - RNA, 64 nt, Homo Sapiens
gugcguggccuugugcuaaccauuagcacugcaucauuucaauucuuuuauaagggcauucaau

SEQ ID NO: 169734 - RNA, 64 nt, Homo Sapiens
uggccaugaugauauuauuaaacaccauuauucacauuucaaauaauaacaauacuuuuuguuu

SEQ ID NO: 169735 - RNA, 63 nt, Homo Sapiens
guuuggagguuucaucaggauuuuggguuuuucacauuucacgcuaaggaguaguggcccuga

SEQ ID NO: 169736 - RNA, 63 nt, Homo Sapiens
uucaaacuucugcugagaccuuggggucaaggaacauuucauugguuuuuuuuguccaccccc

SEQ ID NO: 169737 - RNA, 63 nt, Homo Sapiens
cccaaaagaaaacuuacacacccacacacauacacauuucaugcuuggagugucuccacaacu

SEQ ID NO: 169738 - RNA, 63 nt, Homo Sapiens
uggcuuucccaguccuugcaucaacgggaugccacauuucauaacuguuuuuaaugguaaaaa

SEQ ID NO: 169739 - RNA, 63 nt, Homo Sapiens
uaaaguuguaguugcagaaucccaaacuaggcuacauuucaaaauucagggcuguuuaagauu

SEQ ID NO: 169740 - RNA, 63 nt, Homo Sapiens
aauucaaaggagacgagucagccaaccacagcuacauuucaggcuuucuccccugacacuuuu

SEQ ID NO: 169741 - RNA, 63 nt, Homo Sapiens
aauaucaugaauuuaauuugcuuaagauuuaguacauuucagaacuuuugaacuuuugacaaa

SEQ ID NO: 169742 - RNA, 63 nt, Homo Sapiens
uuauagaauguuuuggaaacuggaaguaaugauacauuucacuucagaagcacuuguaggucu

SEQ ID NO: 169743 - RNA, 63 nt, Homo Sapiens
auuacagcauaauucauuuugagcuccacuaugacauuucaaagacugcccaguuuggaaguc

SEQ ID NO: 169744 - RNA, 63 nt, Homo Sapiens
aagcugugaaaaauagaaguauaauuugaaaaaacauuucacuuaucagagauuuuuauauuu

SEQ ID NO: 169745 - RNA, 63 nt, Homo Sapiens
aauuagguauuuguuucauuggaguugaaauuaacauuucaaaaguuuuucguauuuuuuuau

SEQ ID NO: 169746 - RNA, 63 nt, Homo Sapiens
agcugauagauggacuuuccacuguaggaguggacauuucaagccaacugagccuuuuccuca

SEQ ID NO: 169747 - RNA, 63 nt, Homo Sapiens
gucuuuuaauacuucuucugucucauuaacauuacauuucaaggcugagcuuuaaugucagug

SEQ ID NO: 169748 - RNA, 63 nt, Homo Sapiens
cuuaucauucauggcagauuguuugugcuuucaacauuucauuugaaaugggagaagauaaaa

SEQ ID NO: 169749 - RNA, 63 nt, Homo Sapiens
ucaagagaaucauauaaauuaagcuuuauaaugacauuucaaccaucaacauaauauagugag

SEQ ID NO: 169750 - RNA, 63 nt, Homo Sapiens
caugaaauguaaaagggagcccagaaauggaggacauuucauucuuuuuccugaggggaagga

SEQ ID NO: 169751 - RNA, 63 nt, Homo Sapiens
ugaagacccuguuaacuuugugaaauaacuuccacauuucaacacacuucacaguacaggaaa

SEQ ID NO: 169752 - RNA, 63 nt, Homo Sapiens
uaaagugcccagcacaaagcagauccucaauaaacauuucauuucccacccacacucgccagc

SEQ ID NO: 169753 - RNA, 63 nt, Homo Sapiens
aucugacacaaaaaaaguugaaggccuuauucuacauuucaccuacuuuguaagugagagaga

SEQ ID NO: 169754 - RNA, 63 nt, Homo Sapiens
gagaacgugcuuaagaauccacuaugaugggaaacauuucauucucaaaaaaaaaaaaaaaaa

SEQ ID NO: 169755 - RNA, 63 nt, Homo Sapiens
acuauuagaaguuaaguauguuguuguuauuucacauuucauuuaauuguggauaaauguuag

SEQ ID NO: 169756 - RNA, 63 nt, Homo Sapiens
guuuuauagagugcagcgcagcuuggacaaaacacauuucaagugcccaguagucagugucua

SEQ ID NO: 169757 - RNA, 63 nt, Homo Sapiens
accuuaaaaagccagucucucacugcucaaauuacauuucauuuugcccacccaguguaaugu

SEQ ID NO: 169758 - RNA, 63 nt, Homo Sapiens
gcugaguuacuugucugaggcuccccacugaaaacauuucaaaccugggagggggcuauuucu

SEQ ID NO: 169759 - RNA, 63 nt, Homo Sapiens
agcaccaacaucugcugcuaucuggaucuuuccacauuucagcuauagcuccuggugccaaag

SEQ ID NO: 169760 - RNA, 63 nt, Homo Sapiens
agugaacuugauucaaccugcugauguggcuuuacauuucaaaaguuucuuaaaacguauuuu

SEQ ID NO: 169761 - RNA, 63 nt, Homo Sapiens
cuuuaaaaaguuguugagaguacauguuucuacacauuucauccuaaagcagguuguguuguu

SEQ ID NO: 169762 - RNA, 63 nt, Homo Sapiens
guuuggauuguaucaaguggacugagaagucaaacauuucaaagcaguggagagggacagccc

SEQ ID NO: 169763 - RNA, 63 nt, Homo Sapiens
guaacauauuagcagaaagcuuuauaaccaaauacauuucaguacaauuagguuuuugagauu

SEQ ID NO: 169764 - RNA, 63 nt, Homo Sapiens
agguaucaguuauaugauauuuaaaagcaugaaacauuucagaauaaguguaaauagaagagu

SEQ ID NO: 169765 - RNA, 63 nt, Homo Sapiens
gugugaaauuacuuuauuuuuauuuccauucuaacauuucaguuuuguuauucagcaugacau

SEQ ID NO: 169766 - RNA, 63 nt, Homo Sapiens
auauugauguaauaacauuacacagaugaagaaacauuucaaguauuuucaacuacuuuauua

SEQ ID NO: 169767 - RNA, 63 nt, Homo Sapiens
uugcauucggaaauccauguaugaauguauccaacauuucaauuaaucagaaauagcaacgag

SEQ ID NO: 169768 - RNA, 63 nt, Homo Sapiens
gaguuuggauguauuuuccaaacuauauaucaaacauuucauucucuaugaaacauauaagcu

SEQ ID NO: 169769 - RNA, 63 nt, Homo Sapiens
guaaaccauuuaugaauugggacaaauagggauacauuucaauucucuguuacaaaggaugaa

SEQ ID NO: 169770 - RNA, 63 nt, Homo Sapiens
gcagcaucucuugaguugccacuaccucuaaggacauuucauauuuguuuagcuaucaggucu

SEQ ID NO: 169771 - RNA, 63 nt, Homo Sapiens
aggccugcccucccauguugggggucuguauauacauuucauagccggggccccucaccccaa

SEQ ID NO: 169772 - RNA, 63 nt, Homo Sapiens
guuacagauuaaaucuacuugcugcuaaccuagacauuucauagucucugggcauccauaauu

SEQ ID NO: 169773 - RNA, 63 nt, Homo Sapiens
aaggcuguggggagcagggcgucgucaggccagacauuucaaccacuaugcuggguucccuga

SEQ ID NO: 169774 - RNA, 63 nt, Homo Sapiens
gcugaaguguauaguguauaguuuuuuggguccacauuucaaguugauuacugaaaauugaau

SEQ ID NO: 169775 - RNA, 63 nt, Homo Sapiens
ugaagccaagucucacugagaauuuuaauggaaacauuucauauuguuuuaaggcaaacuuaa

SEQ ID NO: 169776 - RNA, 63 nt, Homo Sapiens
uugcuaucuccaucugggcuuaagggaucgaagacauuucaaauagacauuucgucauuuaag

SEQ ID NO: 169777 - RNA, 63 nt, Homo Sapiens
uugcucuaucugggcugauauaagggaucgaaaacauuucaaauauacauuucaucauuuaag

SEQ ID NO: 169778 - RNA, 63 nt, Homo Sapiens
auuuaaguaagggaucgaaagauaguaugauauacauuucaucaauggaauauccaauuuaca

SEQ ID NO: 169779 - RNA, 63 nt, Homo Sapiens
uggaaacuacuguucuauuuucuucaaccuagcacauuucaaaaauaucagagaauacugaca

SEQ ID NO: 169780 - RNA, 63 nt, Homo Sapiens
uuugaacuuaccucuacuguccuugaacaaaucacauuucaucgccucugauuagccgcacag

SEQ ID NO: 169781 - RNA, 63 nt, Homo Sapiens
ggauaauuuauuuuaaaaaaauaucauauuaauacauuucaguaaacaucaguuuccaaguuu

SEQ ID NO: 169782 - RNA, 63 nt, Homo Sapiens
uauacggauggaaaagcucagaacucaggugaaacauuucaacaucacaucacucaccauuuu

SEQ ID NO: 169783 - RNA, 63 nt, Homo Sapiens
aggucaugugcuggaaugcuguauuuggaccacacauuucaaaguugcccuauggaaaugaau

SEQ ID NO: 169784 - RNA, 63 nt, Homo Sapiens
cacucccucuugguuuuuaucaaauuugccaugacauuucaucuggguggucugaauauuaaa

SEQ ID NO: 169785 - RNA, 63 nt, Homo Sapiens
augaugaaaagaauugagaaguucuaaauuaagacauuucaguuaagcucauaaaauuucauu

SEQ ID NO: 169786 - RNA, 63 nt, Homo Sapiens
uacucuaaauguuagauaauaguagucuuguucacauuucaugaaaccuaugaaacuauauuu

SEQ ID NO: 169787 - RNA, 63 nt, Homo Sapiens
agaaagaaaauaaucauaaaucauauuugauuaacauuucauuuaagcuuuuaaaauaucaau

SEQ ID NO: 169788 - RNA, 63 nt, Homo Sapiens
ucagucggcccaagaaaucaaaauaaaggaaacacauuucauauacugcagguaacaaaaguc

SEQ ID NO: 169789 - RNA, 63 nt, Homo Sapiens
ucagugcugcccagauucagaagaauauugcccacauuucacuguauuuggugcugggucauu

SEQ ID NO: 169790 - RNA, 63 nt, Homo Sapiens
uaaaaaaaaaaaaguuuuuguuauaucucuagaacauuucaagucuuuuccuuuuuuucuguu

SEQ ID NO: 169791 - RNA, 63 nt, Homo Sapiens
aauuaaguacucguuuaaguaugguucuuaauuacauuucauucauuuauauuagaguaaaug

SEQ ID NO: 169792 - RNA, 63 nt, Homo Sapiens
auaagguacacuugaaacuagugaguguuugucacauuucacuuucaugguauauaaaaugca

SEQ ID NO: 169793 - RNA, 63 nt, Homo Sapiens
guauucacauuuuuuccccauuuuucagaagcgacauuucauauauaggugccaaaagugaau

SEQ ID NO: 169794 - RNA, 63 nt, Homo Sapiens
acacacugccugaguugaagagacacaggccacacauuucaggcugguugccagcggacguca

SEQ ID NO: 169795 - RNA, 63 nt, Homo Sapiens
auuucaaagaagagacucuuugcaaaguugauaacauuucaaacccugaaggacagugacuua

SEQ ID NO: 169796 - RNA, 63 nt, Homo Sapiens
uauaaggacaguuuagggaacaaguuaccuaccacauuucacuuuaguguaccuauuuacaga

SEQ ID NO: 169797 - RNA, 63 nt, Homo Sapiens
agaaauccuuuggaaauaaaaaguuaaauguuuacauuucaugugguauuucaggucuucagg

SEQ ID NO: 169798 - RNA, 63 nt, Homo Sapiens
ugcuguugcuuucuacauacaccuuauaaagugacauuucaaaagaaauaaggugccacaguu

SEQ ID NO: 169799 - RNA, 50 nt, Homo Sapiens; identical to SEQ ID NO: 47113

SEQ ID NO: 169800 - RNA, 63 nt, Homo Sapiens
uucuuaaauuugccagcguuaaaguagaaaauaacauuucagaagagcacaauaugcauaaaa

SEQ ID NO: 169801 - RNA, 63 nt, Homo Sapiens
agcuuaggaauucgcuuccaggccgugggggccacauuucaccuccuuagucccccuggucug

SEQ ID NO: 169802 - RNA, 63 nt, Homo Sapiens
uguuuaaaaaaaaaauucaauauugggguuggaacauuucaguugccauugacagaacaccca

SEQ ID NO: 169803 - RNA, 63 nt, Homo Sapiens
cuggcacuugggacaaaaacaaacaaacgaaaaacauuucaaaagguauuuauugagcaccug

SEQ ID NO: 169804 - RNA, 63 nt, Homo Sapiens
uuuuuuuuuuuuuguacagguucugauucuaauacauuucaacaugcuuuuguccccccucgu

SEQ ID NO: 169805 - RNA, 63 nt, Homo Sapiens
uaauauaaaccgugugucaugucaaagugaaagacauuucaaaucuguagcauaggcuagugg

SEQ ID NO: 169806 - RNA, 63 nt, Homo Sapiens
auaaaacaauugggcaaaacaaaucugaaaaucacauuucagaguuggcaugaaauuuuggua

SEQ ID NO: 169807 - RNA, 63 nt, Homo Sapiens
uggggaaauccacaagguucuaguaucacuuagacauuucacuauucgucagcucuguaauua

SEQ ID NO: 169808 - RNA, 63 nt, Homo Sapiens
uccagcagccagcuauuuaaaguacuucuuuuuacauuucagcgcaaauuaaagaaugaaaga

SEQ ID NO: 169809 - RNA, 63 nt, Homo Sapiens
ugaucacacugaagaacugugaguccucacuaaacauuucauaaauuaauuagcauuauuaaa

SEQ ID NO: 169810 - RNA, 63 nt, Homo Sapiens
cuauuugcuuagugaaacauaacaucugaaagcacauuucagccuuauuuauaauuuaaggua

SEQ ID NO: 169811 - RNA, 63 nt, Homo Sapiens
uaauuuaauauuccuggcauacagugcuucuacacauuucaucggguaugucacaaagagcug

SEQ ID NO: 169812 - RNA, 63 nt, Homo Sapiens
aaugcaucugugguagaggugcuucauugaucaacauuucauacucuaaaaccauuugaaaua

SEQ ID NO: 169813 - RNA, 63 nt, Homo Sapiens
ugauuuaguuagcauccacaaauuuuaaagaaaacauuucaucaaauucuuaaauauauacag

SEQ ID NO: 169814 - RNA, 63 nt, Homo Sapiens
ggcaacaccaagaggguuuuugacaacguuucgacauuucaccgucugaguuauuacgcuaca

SEQ ID NO: 169815 - RNA, 63 nt, Homo Sapiens
uaucuggaaucaugugauauuaaccuacucuggacauuucauaaucuacuuucuauguaagau

SEQ ID NO: 169816 - RNA, 63 nt, Homo Sapiens
auuuuuuauaacuugaaaaacuccugacacuauacauuucaaauuauguuuguguauugguug

SEQ ID NO: 169817 - RNA, 63 nt, Homo Sapiens
uaaauuaagcuacugauuuguuuuccuuuaaaaacauuucaguagcaaccccuccuuuuuauu

SEQ ID NO: 169818 - RNA, 63 nt, Homo Sapiens
acucaaaugccuucgcaaauagguuuugugcuuacauuucacuauacacacucuggguucagg

SEQ ID NO: 169819 - RNA, 63 nt, Homo Sapiens
uuaaguacuaaggcacaaaguuuuacacuaaggacauuucaaauuuuauuuacuuugguauau

SEQ ID NO: 169820 - RNA, 63 nt, Homo Sapiens
auucuuguauauugacauauaacaaaaaauaaaacauuucauuuuaguaauuguuuucaagac

SEQ ID NO: 169821 - RNA, 63 nt, Homo Sapiens
guuuugcuuuuuaaaaaauguuguggcaccucaacauuucagucuuuuuccaucucaaaagua

SEQ ID NO: 169822 - RNA, 63 nt, Homo Sapiens
uaagauucuuguuaacccauggcagggagaagaacauuucaaauaaccccaggaagauuucaa

SEQ ID NO: 169823 - RNA, 63 nt, Homo Sapiens
uugaauuugcacgguuuguguuauaccagaugaacauuucaaauuccucuugacagcugaaua

SEQ ID NO: 169824 - RNA, 63 nt, Homo Sapiens
ucagcaaaauuagaagucauuacgaauguuaaaacauuucaggaguauuuugcauucuguaaa

SEQ ID NO: 169825 - RNA, 63 nt, Homo Sapiens
uaccauuauauuaaaauauuaaauauaugaauaacauuucagauaauacuaugacaguacuaa

SEQ ID NO: 169826 - RNA, 63 nt, Homo Sapiens
ugcugcugaaacuguguacggcauuuucaagauacauuucaucagaauggguuuacucucaau

SEQ ID NO: 169827 - RNA, 63 nt, Homo Sapiens
ugaguuuugcuaugggcugcuuauaugcagaacacauuucaaaccuugauuuguaaugagcuc

SEQ ID NO: 169828 - RNA, 63 nt, Homo Sapiens
augauuuccucuguaaucuagcagagauuuucaacauuucaaaucaaugaaugaaacuagaaa

SEQ ID NO: 169829 - RNA, 63 nt, Homo Sapiens
ggcaauaccguguugguuuuauccgucuaguuaacauuucaagguccuguggucuccuuggaa

SEQ ID NO: 169830 - RNA, 63 nt, Homo Sapiens
aauuuggguuuuuuggaggggaagaauguguguacauuucaagagacuuuucuauguuugaaa

SEQ ID NO: 169831 - RNA, 63 nt, Homo Sapiens
auauguauuguaauuagaauuguuggcaugaugacauuucauuugugccaaaaauauuaaaaa

SEQ ID NO: 169832 - RNA, 63 nt, Homo Sapiens
ggaagggcagagaacauaauuacaucuuaggccacauuucauucuuugcagcuuugcuaaucc

SEQ ID NO: 169833 - RNA, 63 nt, Homo Sapiens
cuaugucaccaguaccaaucagucagugucaucacauuucaggccccaagcaaucucugugca

SEQ ID NO: 169834 - RNA, 63 nt, Homo Sapiens
cauauaaacuguggguguggcaagaccccgaagacauuucacaucuuuaucgccucgaucaag

SEQ ID NO: 169835 - RNA, 63 nt, Homo Sapiens
acuucacagacacgucugcagcagcuggacaucacauuucauguccugcauggaaccaguggc

SEQ ID NO: 169836 - RNA, 63 nt, Homo Sapiens
uaaaauagaaccaggaaaggcucaggauuucagacauuucaucagccuuuucacuuucccagc

SEQ ID NO: 169837 - RNA, 63 nt, Homo Sapiens
agcaccaaaggaauccuccuguccccucugggaacauuucaugcuucagagggagagguuuuu

SEQ ID NO: 169838 - RNA, 63 nt, Homo Sapiens
ugaauauugugauagaaauucuuugguauucauacauuucagcugcaagucagcaauuuccca

SEQ ID NO: 169839 - RNA, 63 nt, Homo Sapiens
cccacuaauacuacugcacagagucaggaucucacauuucaccccaggcucaacugaggaugu

SEQ ID NO: 169840 - RNA, 63 nt, Homo Sapiens
uugugugaaauaguuuuuauugaaagucaagugacauuucaaaagaaguucuauaacaauuau

SEQ ID NO: 169841 - RNA, 63 nt, Homo Sapiens
ugcagcagacagaccaggaacacaaugagacugacauuucaaaaaaacaaaacuggcuagccu

SEQ ID NO: 169842 - RNA, 63 nt, Homo Sapiens
caggguagggagggauuuuccuucauccuugugacauuucauuucaguaaggaaaagauaaca

SEQ ID NO: 169843 - RNA, 63 nt, Homo Sapiens
ucccaccaggccccaccuccaguauuggggauuacauuucaacuugagguuugggcgggaaca

SEQ ID NO: 169844 - RNA, 63 nt, Homo Sapiens
uugcuuugccgauugucacucuucaucacaggcacauuucaaaaagagguuagacuuucagac

SEQ ID NO: 169845 - RNA, 63 nt, Homo Sapiens
uuagaaggaucaaugggaaggcaaugauugaaaacauuucaaugaaccuuaauaguguuccuu

SEQ ID NO: 169846 - RNA, 63 nt, Homo Sapiens
aaaaauaacuuuaaaaggaacaaagaaacuccaacauuucacauuaugcauaguuauguagcc

SEQ ID NO: 169847 - RNA, 63 nt, Homo Sapiens
uaacuagauaacacauguaauacauaguagaauacauuucagaggcagaguuccucggauuau

SEQ ID NO: 169848 - RNA, 63 nt, Homo Sapiens
cuuuuggaaaauaccaaaugaacguacaguacaacauuucaaggaaaugaauauauuguuaga

SEQ ID NO: 169849 - RNA, 63 nt, Homo Sapiens
aaauaauauccaaaugaaauuaagucucacugaacauuucaaucaagaauggcagggaucuau

SEQ ID NO: 169850 - RNA, 63 nt, Homo Sapiens
augagauuuuuuuuaaaaguuguuaccaaauacacauuucacauugaaucauguaggaucuug

SEQ ID NO: 169851 - RNA, 63 nt, Homo Sapiens
ucaauugacuaauuucauuuagaauauuaucaaacauuucaacuagguaucagaaaaaggcuu

SEQ ID NO: 169852 - RNA, 63 nt, Homo Sapiens
cagguaccagcuuugcagagucuaaaaauacugacauuucacacugccucuaaaacaucucuc

SEQ ID NO: 169853 - RNA, 63 nt, Homo Sapiens
ccauuggaugaaguggugccgauuccaucauuaacauuucagcccauccuaauaagagcccug

SEQ ID NO: 169854 - RNA, 63 nt, Homo Sapiens
gagaaagcccccucccugcuagcagaaaaccaaacauuucacugggccuggggcagaggaggc

SEQ ID NO: 169855 - RNA, 63 nt, Homo Sapiens
cccacuguacugggcuuccaccuugccccgcacacauuucacugaggaaagaaaagcccuucu

SEQ ID NO: 169856 - RNA, 63 nt, Homo Sapiens
ucuccaacaaguaccugugaggucugaauacaaacauuucacuugaaaggucagaauuuuguu

SEQ ID NO: 169857 - RNA, 63 nt, Homo Sapiens
gcuucucuauuuguguuucagggaaaaaugguaacauuucaggggagucuauaccagugcugu

SEQ ID NO: 169858 - RNA, 63 nt, Homo Sapiens
gauuggaauguggaaauggaucccugucaugccacauuucacuugaacauaccucacagaucc

SEQ ID NO: 169859 - RNA, 63 nt, Homo Sapiens
auaauaaauguuuucugauuuaguaggauguacacauuucaguuuguuacuuuguuuuuuuaa

SEQ ID NO: 169860 - RNA, 63 nt, Homo Sapiens
aggcccagaugugggcaggcaaggcccaugaugacauuucaugauaacacccugggcugugac

SEQ ID NO: 169861 - RNA, 63 nt, Homo Sapiens
gucacuggaaacagugaaguccacuuacguaaaacauuucagguuuucuuuaaagcccaggcc

SEQ ID NO: 169862 - RNA, 63 nt, Homo Sapiens
auccaaaugcugugcaaacacugggacucauucacauuucaagugcaggucuccaugaagaag

SEQ ID NO: 169863 - RNA, 63 nt, Homo Sapiens
auauauuucauauaacauauauauuaaaaauauacauuucauuaugauuugacacuccuggca

SEQ ID NO: 169864 - RNA, 63 nt, Homo Sapiens
uuggaaacacaguagacucugaauauuauuugcacauuucacugucacaguucuuggcauguu

SEQ ID NO: 169865 - RNA, 63 nt, Homo Sapiens
cuuuugcuugcuuacguggacugaaaucucuacacauuucaucgauuauuugccucgcuuguu

SEQ ID NO: 169866 - RNA, 63 nt, Homo Sapiens
caguugcacuuagucguaugauuuaaaaaaaaaacauuucacuaccuuuagggaaugauuaaa

SEQ ID NO: 169867 - RNA, 63 nt, Homo Sapiens
cugacuaaaauuuggaauugaguuaguggaaaaacauuucaacgcucauuuaucuuaucuuuc

SEQ ID NO: 169868 - RNA, 63 nt, Homo Sapiens
agagaagaaauagaaucuucaucaaugagcacaacauuucaguugagaauaccugucccagcu

SEQ ID NO: 169869 - RNA, 63 nt, Homo Sapiens
aauuaccauaaauuguaguuuaaaaauggaaaaacauuucacagagauagagacucuuacauu

SEQ ID NO: 169870 - RNA, 63 nt, Homo Sapiens
ucaauucauaugccauuuguaucuaucuuggagacauuucauacuugcuuuuuucccuuaaca

SEQ ID NO: 169871 - RNA, 63 nt, Homo Sapiens
aauuuauuaacagguugaauuuuuuaucuguauacauuucacccauuguacagugauaagcca

SEQ ID NO: 169872 - RNA, 63 nt, Homo Sapiens
aauaaggugagauuuuguaaucauagcuagggaacauuucacagucacaucaagggcaggauc

SEQ ID NO: 169873 - RNA, 63 nt, Homo Sapiens
aucaaacuagugaauacaguaaauuugaucucuacauuucaaacuuagcugcuggguugauug

SEQ ID NO: 169874 - RNA, 63 nt, Homo Sapiens
gccuacauuuuaguuucuaauccugaaucuaacacauuucauaguguuucauuggucucuauc

SEQ ID NO: 169875 - RNA, 63 nt, Homo Sapiens
uaggaauaccacugauuuagugcaguauucuaaacauuucagcaaguacugcugaacugugag

SEQ ID NO: 169876 - RNA, 63 nt, Homo Sapiens
cugaccaugaagacggcggauaaccagacugugacauuucagcgcaauccguguccugcugga

SEQ ID NO: 169877 - RNA, 63 nt, Homo Sapiens
ugucacuugcaaauaacaaagggacuuugagggacauuucauuaaauauaauuacugauacuu

SEQ ID NO: 169878 - RNA, 63 nt, Homo Sapiens
auugacugugaauucauuuacauguaacuucugacauuucacucugugcaaauaaagaacaug

SEQ ID NO: 169879 - RNA, 63 nt, Homo Sapiens
cuuguacauagucagacuauuuguauuaaauuuacauuucauucuaaguucaaaaguuugaaa

SEQ ID NO: 169880 - RNA, 63 nt, Homo Sapiens
uucugggaagcuaauaauugaauuauuagaaaaacauuucagaauaggaaguaaaugauaaac

SEQ ID NO: 169881 - RNA, 63 nt, Homo Sapiens
cauuuuccuugcuuaugggaaaauagcaaaacaacauuucauuuauacuuuuguuuaccccuc

SEQ ID NO: 169882 - RNA, 63 nt, Homo Sapiens
uggguuguuuuguuagggguuacuuucaggggaacauuucauuuguguuauuucuuaaacuuc

SEQ ID NO: 169883 - RNA, 63 nt, Homo Sapiens
gaccacaacaugacccguaagucaagaagguagacauuucauauccagcuuccuugcuuaguc

SEQ ID NO: 169884 - RNA, 63 nt, Homo Sapiens
acuaucuccaaagcauuugcaucaugaccuuauacauuucaaucccuuuuaugcuggauuccg

SEQ ID NO: 169885 - RNA, 63 nt, Homo Sapiens
uuaaagcuuucaauaucuuaaaauauuuauaaaacauuucacuguugcaaaaucacuuccaaa

SEQ ID NO: 169886 - RNA, 63 nt, Homo Sapiens
aggcucuuuugugcauaauauucuaaaaugaagacauuucaagcuauacaaauuacuuccaag

SEQ ID NO: 169887 - RNA, 63 nt, Homo Sapiens
aaaacuaguugauuuaaagaguuuuuuugcacaacauuucaauuauauuugugaacuuagaaa

SEQ ID NO: 169888 - RNA, 63 nt, Homo Sapiens
aaauaugugauuauauauguuaaaguauagauaacauuucacacuuggauacauaugugcauu

SEQ ID NO: 169889 - RNA, 63 nt, Homo Sapiens
cagacuagagaauaauuuuuguggcauguuguaacauuucacaguauuuacaagcuauuuuug

SEQ ID NO: 169890 - RNA, 63 nt, Homo Sapiens
cgcugaaggaaaggcaagaguauuuagcccgucacauuucauucggcgcaugagugacuggcg

SEQ ID NO: 169891 - RNA, 63 nt, Homo Sapiens
caaaaaauauauauauuucaggguucuuaaccuacauuucauguauucgaaaucuugacucag

SEQ ID NO: 169892 - RNA, 63 nt, Homo Sapiens
ugaaaaagaaacuagaaaugauuccaaagcuuuacauuucaacugcaggugugccugucuuaa

SEQ ID NO: 169893 - RNA, 63 nt, Homo Sapiens
gaugcacuuacauauuuugacauaagaaauuugacauuucacacauuagucccaaaacaccgg

SEQ ID NO: 169894 - RNA, 63 nt, Homo Sapiens
agucuauaucuauuuucacgagcugcaaaggaaacauuucaagacaaaguaugccaucaugca

SEQ ID NO: 169895 - RNA, 63 nt, Homo Sapiens
aaacucagagauauuacucuuucuauugcuaaaacauuucaaaaacaguuuagcaguacaagc

SEQ ID NO: 169896 - RNA, 63 nt, Homo Sapiens
ucuguaugaaaauguuaaauuuauuccauguaaacauuucaacaggucuuucuguagggaaaa

SEQ ID NO: 169897 - RNA, 63 nt, Homo Sapiens
uuuggcgggcaugugagugcagggagaaggcgaacauuucaugucaacaaccaucacauugga

SEQ ID NO: 169898 - RNA, 63 nt, Homo Sapiens
uauacauuaagaacuacgaauaaaugaaaaaauacauuucaguuaaagauaacuuauacuuua

SEQ ID NO: 169899 - RNA, 63 nt, Homo Sapiens
caaacauuuccuauauaacaaaaugaaaauggaacauuucaauagguugcuauaagcuuggug

SEQ ID NO: 169900 - RNA, 63 nt, Homo Sapiens
auaaaaaaccuaauuuauuucuuuacuagaagaacauuucaguauguaacuauuuucuaaaca

SEQ ID NO: 169901 - RNA, 63 nt, Homo Sapiens
uuuguuccuaaauauauaauauuugaggagauaacauuucaacgaguuauuuaaaaauuguuu

SEQ ID NO: 169902 - RNA, 63 nt, Homo Sapiens
ucuuccaagagcuucuuagaaucuuucaacugaacauuucaguauaauuuuuacuuauauacc

SEQ ID NO: 169903 - RNA, 63 nt, Homo Sapiens
ggagauuucuuguugcucaaggcugucaguaugacauuucacgucacugcaccaagucucacu

SEQ ID NO: 169904 - RNA, 63 nt, Homo Sapiens
guagucauucauuucuagcuacauuuuguuaguacauuucaguucuuuuuccacugaagugug

SEQ ID NO: 169905 - RNA, 63 nt, Homo Sapiens
ugauuguacuauauugcagguauuauauuuuauacauuucaauaacauccuaaauuuauauuu

SEQ ID NO: 169906 - RNA, 63 nt, Homo Sapiens
cuccaugucaggucagccaacugcccuaacuguacauuucacaggcuaaugggauaaaggacu

SEQ ID NO: 169907 - RNA, 63 nt, Homo Sapiens
aaacacuuuuuugguuuaauauauauuuuuaaaacauuucacuagugauugaauucuacuuuu

SEQ ID NO: 169908 - RNA, 63 nt, Homo Sapiens
ucuguggaaaauguuuuguccuucaccugaauuacauuucaauuuugugaaacacucuuuugu

SEQ ID NO: 169909 - RNA, 63 nt, Homo Sapiens
cacuuucucuuuuauguauugagcccuguguuaacauuucacuuaagaagagcaccagugcuu

SEQ ID NO: 169910 - RNA, 63 nt, Homo Sapiens
ugcaaagucuagguugguagaguuuagcccugaacauuucaugguguucaucaacagugagag

SEQ ID NO: 169911 - RNA, 63 nt, Homo Sapiens
gacaugaauugugucucaacagaaacuaaaugaacauuucagaauaaauuauugcuguaugua

SEQ ID NO: 169912 - RNA, 63 nt, Homo Sapiens
aaguuaaggucugagugcaugugugcauuaaaaacauuucacuaccuauucucucauggacuu

SEQ ID NO: 169913 - RNA, 63 nt, Homo Sapiens
gcaguuuauuuuaaacaaacaauuugaaguuaaacauuucauuuuuaaaaacacugaauuaca

SEQ ID NO: 169914 - RNA, 63 nt, Homo Sapiens
uucauuuauaauucaaggaaggauuuccugaaaacauuucaagggauuuaugucuacauauuu

SEQ ID NO: 169915 - RNA, 63 nt, Homo Sapiens
caccagcagccuuuccaaaggggaacuccagagacauuucauaaugcaaacagcacuguugcu

SEQ ID NO: 169916 - RNA, 63 nt, Homo Sapiens
aggaugaagaaacauuuaccccauguacucaagacauuucaguuuuaaaagucacuuuccuau

SEQ ID NO: 169917 - RNA, 63 nt, Homo Sapiens
auguacagaaaauagcuuuuauugaguaauauuacauuucauuuauacuguagcaauauauuu

SEQ ID NO: 169918 - RNA, 63 nt, Homo Sapiens
ucacaagcuaggccaaugaaggcugaaucaaagacauuucauccaccaauaucauguguagau

SEQ ID NO: 169919 - RNA, 63 nt, Homo Sapiens
aaauuuuaaguuaugagguuuaugucaaaagcaacauuucacaaauguacuuuuaaggcauaa

SEQ ID NO: 169920 - RNA, 63 nt, Homo Sapiens
aauguacaauucagucacucauucucaucaaccacauuucaagugcucaaagccacgugcugg

SEQ ID NO: 169921 - RNA, 63 nt, Homo Sapiens
uguguuucuuucgaacuuuucggaaugucuggaacauuucauuuccuguuuuguuaccugugc

SEQ ID NO: 169922 - RNA, 63 nt, Homo Sapiens
auaaauuuuauuuucuuauauucugcuuuuuauacauuucagugcucugcauacauuuuaaau

SEQ ID NO: 169923 - RNA, 63 nt, Homo Sapiens
cuggaaccaagcauccacggauacugaggggugacauuucaugaaguguagaucauuguauuc

SEQ ID NO: 169924 - RNA, 63 nt, Homo Sapiens
agcugaggcgugggccaggggcucggcagguccacauuucaugccucgugugggagccucugg

SEQ ID NO: 169925 - RNA, 63 nt, Homo Sapiens
ugcauuucaagccaccagagucgaaguuuggauacauuucaagauguuucugaggcuucagag

SEQ ID NO: 169926 - RNA, 63 nt, Homo Sapiens
gcagucuuguuuauuugauuugaguauacugugacauuucaugaguuuuuuuacuuugauuug

SEQ ID NO: 169927 - RNA, 63 nt, Homo Sapiens
agucuaaagguggccggguggugagucagcguaacauuucaaguugaacucaugggaauaauu

SEQ ID NO: 169928 - RNA, 63 nt, Homo Sapiens
cacauauacuuauuauucaaacacacagaaugcacauuucacacacauacacacauuacacac

SEQ ID NO: 169929 - RNA, 63 nt, Homo Sapiens
cucauuuuuauuguuuuuacucuaauaauccacacauuucaugauaauccacacauuucaugc

SEQ ID NO: 169930 - RNA, 63 nt, Homo Sapiens
cucuaauaauccacacauuuucuaauaauccacacauuucaugauuucacaagugcaugucuu

SEQ ID NO: 169931 - RNA, 63 nt, Homo Sapiens
uuaauaaaugagauugaaauaauaauuuuuuuaacauuucauguaggaaacaguuuucaaguc

SEQ ID NO: 169932 - RNA, 59 nt, Homo Sapiens
acccucuucccuauuucccuggggaggcuacauuucacagcugcacagaggaggaauga

SEQ ID NO: 169933 - RNA, 63 nt, Homo Sapiens
ucaccagacacaccaggcaacucauuugugacaacauuucauaguagaucgaagccaaagcag

SEQ ID NO: 169934 - RNA, 63 nt, Homo Sapiens
gcaguguugcuccauuccuagagcuugguggacacauuucauuaagcgcccgggaggaacaau

SEQ ID NO: 169935 - RNA, 63 nt, Homo Sapiens
uaauuuccuucagucuccagcaucaugcaguguacauuucagaguaucauuuuuauuugaauc

SEQ ID NO: 169936 - RNA, 63 nt, Homo Sapiens
cgugugugcaaugccuuuuuguucuaguacuucacauuucaccuaguuugauaauaaauagca

SEQ ID NO: 169937 - RNA, 63 nt, Homo Sapiens
aggagugguagaaaaaaacauggauguucuugaacauuucagaccacaguugugacggaugua

SEQ ID NO: 169938 - RNA, 63 nt, Homo Sapiens
cgauuagauaacauuuucucugaggggcaacaaacauuucaaaaaggagccaugcauauuaaa

SEQ ID NO: 169939 - RNA, 63 nt, Homo Sapiens
ugcuugagagccaugcaugaaaucacacuagcaacauuucaagcauucaaaacgcagcucccc

SEQ ID NO: 169940 - RNA, 63 nt, Homo Sapiens
cauguccacugagcagacgcucaucgaucaaugacauuucaucacgccacuccuucucagucu

SEQ ID NO: 169941 - RNA, 63 nt, Homo Sapiens
guguccacaagaagggguguuuauucuuccaacacauuucacuuuucuguaaauauacauaaa

SEQ ID NO: 169942 - RNA, 63 nt, Homo Sapiens
ggagcuccacugccauguacccaguaggguuugacauuucauuagccaugcaacauggauaug

SEQ ID NO: 169943 - RNA, 63 nt, Homo Sapiens
agggaguguuugugucugacucaggcgccuggcacauuucagggagaaacuccaaaguccaca

SEQ ID NO: 169944 - RNA, 63 nt, Homo Sapiens
ggggggugagaagacaagaugaagaaaagccuuacauuucaguuucuucaucgguuggauugg

SEQ ID NO: 169945 - RNA, 63 nt, Homo Sapiens
aagaauguuacauauuguauagauaaaugagugacauuucauaccauguauauauagagaugu

SEQ ID NO: 169946 - RNA, 63 nt, Homo Sapiens
accuguaaaaaucaaaauacuacucuuuauaagacauuucacaaauauucacuuacauuacag

SEQ ID NO: 169947 - RNA, 63 nt, Homo Sapiens
gccagauuucuauauugggaguuuuuuaaaaagacauuucauagccaacaagaaucaguagaa

SEQ ID NO: 169948 - RNA, 63 nt, Homo Sapiens
gucaggaccuauuucagacuguugaugacauugacauuucauggauucggaugaugcaaggag

SEQ ID NO: 169949 - RNA, 63 nt, Homo Sapiens
gauuuauuuugcuaaacaguuuacuaacacauuacauuucaaaaacuauuuugguaccuuuca

SEQ ID NO: 169950 - RNA, 63 nt, Homo Sapiens
guauaguuuuuccuuuuuuguauguaacagaacacauuucagauuguauuuaauuuaaauauu

SEQ ID NO: 169951 - RNA, 63 nt, Homo Sapiens
ucaaauaaaaccagugaagaucugaagaugcaaacauuucaacuaugaagauuuacauuucac

SEQ ID NO: 169952 - RNA, 63 nt, Homo Sapiens
cugaagaugcaaacauuucaacuaugaagauuuacauuucacuuucuaauuuauuaaacaucu

SEQ ID NO: 169953 - RNA, 63 nt, Homo Sapiens
guauuuguguugaugauggaccacuugaccaucacauuucaguauucauagaugacugucaca

SEQ ID NO: 169954 - RNA, 63 nt, Homo Sapiens
caccaccgccaccccaacuugacuuucaagaacacauuucaagcucuggccagagucccguuc

SEQ ID NO: 169955 - RNA, 63 nt, Homo Sapiens
ugcaucuagguugguguuugaucaucugaaaaaacauuucagugggaagaaaugcauaaaaug

SEQ ID NO: 169956 - RNA, 63 nt, Homo Sapiens
ugugaaugcaguaccauauucucauuuucaaugacauuucaaccacaggcagaaaagacuguu

SEQ ID NO: 169957 - RNA, 63 nt, Homo Sapiens
aaagccuggugauuauucauuuaaaugaagaucacauuucauaucaacuuuuguauccacagu

SEQ ID NO: 169958 - RNA, 63 nt, Homo Sapiens
gagguucaguuugguuggguaaaucuguuguguacauuucaacaaauacuuuuacauuugaca

SEQ ID NO: 169959 - RNA, 63 nt, Homo Sapiens
ugcacucaggugcccuuuguuucaugaacaaauacauuucauuguacauguuuucuguuuaaa

SEQ ID NO: 169960 - RNA, 63 nt, Homo Sapiens
caaaaugaccucauuugaaaaaauuguugguauacauuucaacuuuucuuccucugacuucga

SEQ ID NO: 169961 - RNA, 63 nt, Homo Sapiens
agaaaucuuaauugagcagcagaaaaagcuuaaacauuucaccuugaugcuggaagcucuugg

SEQ ID NO: 169962 - RNA, 63 nt, Homo Sapiens
gaggugagagugaacacauuuggagcagagaucacauuucagaaaaaaaaagccagcuguccu

SEQ ID NO: 169963 - RNA, 63 nt, Homo Sapiens
uuuuuaaaaccaaauguucaacgcuaaguggagacauuucacaauggcugacuugauugaucu

SEQ ID NO: 169964 - RNA, 63 nt, Homo Sapiens
ucugcagaauugcugaagagcaacacuguaacuacauuucagccuaaguugcuuucuuuuuuu

SEQ ID NO: 169965 - RNA, 63 nt, Homo Sapiens
aggguucaagguggucccaauugaagaacuauaacauuucagucuuuaugaaauuuagaauug

SEQ ID NO: 169966 - RNA, 63 nt, Homo Sapiens
cauacauaaaagagaagagccuuuucuuguagaacauuucaaaauuccuuuucuuuuaaacuu

SEQ ID NO: 169967 - RNA, 63 nt, Homo Sapiens
agugaaggcuuuugagguuuuuuuuggaaaaaaacauuucagaauccucaaagagccguaagc

SEQ ID NO: 169968 - RNA, 63 nt, Homo Sapiens
ucaguguaugaccaaaagcagaauuuaugcuguacauuucaguauucaggagaggaaaaaaag

SEQ ID NO: 169969 - RNA, 63 nt, Homo Sapiens
auuaauagcuuuugauuagucagacauacauagacauuucaaaguucuaaggggaccuacaga

SEQ ID NO: 169970 - RNA, 63 nt, Homo Sapiens
ucuugugagcuagcuggcugauauuugugcauuacauuucauuugggauuuuaccagucaaac

SEQ ID NO: 169971 - RNA, 63 nt, Homo Sapiens
gaaccaaauuuuuuuuuucuuuuuuauucaaacacauuucaaauucuuuccugaagaucaguu

SEQ ID NO: 169972 - RNA, 63 nt, Homo Sapiens
cuaaauguuuuacaguggcuaaaauauuagcauacauuucaaaauaacuuuugauuucuaagg

SEQ ID NO: 169973 - RNA, 63 nt, Homo Sapiens
ccacauaaauuauauuuaauuauuaaagcaucaacauuucaugugaauuaguuuuuauuacua

SEQ ID NO: 169974 - RNA, 63 nt, Homo Sapiens
ucuuuccauuauuugaacacucuuaacauacccacauuucaauuaaaaccuuagugcuuucuu

SEQ ID NO: 169975 - RNA, 63 nt, Homo Sapiens
uguuaauuuaguuguguguguauaaaaguagacacauuucauugugucugcuuuaugggcaua

SEQ ID NO: 169976 - RNA, 63 nt, Homo Sapiens
ugaucgugcaccacuggaaccaaaacggauguaacauuucaugagccaaauguuuauuucaca

SEQ ID NO: 169977 - RNA, 63 nt, Homo Sapiens
gauuuuuauuuuguuucuguucgucaguggcaaacauuucacaugauaauaggguguggaaug

SEQ ID NO: 169978 - RNA, 63 nt, Homo Sapiens
ccaauugacaaguuuugccauuuuaacagcauuacauuucauguaaccauaagagaaaguaua

SEQ ID NO: 169979 - RNA, 63 nt, Homo Sapiens
aagguuccaguuauaaauaucugauuugaugauacauuucauuugcggacaaguugcuuuuac

SEQ ID NO: 169980 - RNA, 63 nt, Homo Sapiens
agccgucuggugugucagggucacgaacccguuacauuucaggacgauccuuuuuccuucagc

SEQ ID NO: 169981 - RNA, 63 nt, Homo Sapiens
cgggugugccgcagucaccacaggguucugagaacauuucacagaagugccugagacgcggag

SEQ ID NO: 169982 - RNA, 63 nt, Homo Sapiens
cacauauagagguacacaaacacaccgucaugcacauuucagcuugcgucuaucaugauuccu

SEQ ID NO: 169983 - RNA, 63 nt, Homo Sapiens
agggugcugccacggaguggugagguaccgucuacauuucacauuauucugggcaccacaaaa

SEQ ID NO: 169984 - RNA, 63 nt, Homo Sapiens
aucaauuuaaguguuggaaaaaauuugucugaaacauuucauaauuuguuuccagcaugaggu

SEQ ID NO: 169985 - RNA, 63 nt, Homo Sapiens
uucaaguuaaauugaaaauuuuccugaaaccauacauuucaagugaaauaaguaauucuagau

SEQ ID NO: 169986 - RNA, 63 nt, Homo Sapiens
gagggaugcagacucagguuuugcuaugugcucacauuucaacuuuaugcuuaacaugaaugg

SEQ ID NO: 169987 - RNA, 63 nt, Homo Sapiens
ucauuuuaugaauugugcuuuucauaaugcaguacauuucaaaauuuuuagauuauguaugaa

SEQ ID NO: 169988 - RNA, 63 nt, Homo Sapiens
acgucuagacauguuuucugaaccuuuuucaggacauuucaaccucgggacuauucauauuag

SEQ ID NO: 169989 - RNA, 63 nt, Homo Sapiens
auuuuuguucaauauugauauauuuuaucaccaacauuucaaguuuguauuuguuaauaaaau

SEQ ID NO: 169990 - RNA, 63 nt, Homo Sapiens
aacguuaagaacaaagacagggauaaauugcuuacauuucaaccucuggagauugagguaacu

SEQ ID NO: 169991 - RNA, 63 nt, Homo Sapiens
uuugauguaacgcaaauggaaaaacucgacaccacauuucaggcuuuacccaacaucgaaaua

SEQ ID NO: 169992 - RNA, 63 nt, Homo Sapiens
aaauuccauuugguuaaugacauuaaauuugguacauuucaaaacuucuagguccuccaaaga

SEQ ID NO: 169993 - RNA, 63 nt, Homo Sapiens
cucuauuuaauaaagaagauugaguacucugacacauuucauuuaaauuaggaaauuuuuaau

SEQ ID NO: 169994 - RNA, 63 nt, Homo Sapiens
agcucauauccuuuugaagguaguugcaaagagacauuucaaaacugcccuaggccauugcag

SEQ ID NO: 169995 - RNA, 53 nt, Homo Sapiens
acuugcagaaagaaauauaaaugacauuucaaggauagaaguauaccugauuu

SEQ ID NO: 169996 - RNA, 63 nt, Homo Sapiens
gagaacacuuagucuugccugucaaaaaguccaacauuucauagguaguaggggccacauauu

SEQ ID NO: 169997 - RNA, 63 nt, Homo Sapiens
gcaaauggugcugaauacuuuuuuuuuaaagccacauuucauugucuuagucaaagcaggauu

SEQ ID NO: 169998 - RNA, 63 nt, Homo Sapiens
uaaaaauaaaugagcuaguucuuuaguaguuaaacauuucaaauuggcuuuucuccuucugua

SEQ ID NO: 169999 - RNA, 63 nt, Homo Sapiens
aauguguaaaucuuauuucuaauguauacaaccacauuucacauaaaaauaugcaauuuauau

SEQ ID NO: 170000 - RNA, 63 nt, Homo Sapiens
cucggauuuacaucggaacugcucaggauugauacauuucaagucuguaaauacggacaccaa

SEQ ID NO: 170001 - RNA, 63 nt, Homo Sapiens
uguuuauuuggaaacaacagucccaucuuuaugacauuucaaacuccuccucaccuacuccac

SEQ ID NO: 170002 - RNA, 63 nt, Homo Sapiens
ucaaaaauaagcccuguagcgaaagacccugugacauuucacuaucuuccuuugaaagagaau

SEQ ID NO: 170003 - RNA, 63 nt, Homo Sapiens
aaggugcuuuuuugguacucaaucuucacaguaacauuucagaaaaaaaaauauguugucaug

SEQ ID NO: 170004 - RNA, 63 nt, Homo Sapiens
gaauacagguuuucaagcaaauggcaggauuccacauuucauauguuauaccugcguggcacc

SEQ ID NO: 170005 - RNA, 63 nt, Homo Sapiens
aggggaaagggagaagggugcuaugaaguuggcacauuucauggggcuacaauuuguuaauuc

SEQ ID NO: 170006 - RNA, 63 nt, Homo Sapiens
gcugucgaagucucugggauauucaugagcaagacauuucacugugggggcaaguacagggua

SEQ ID NO: 170007 - RNA, 63 nt, Homo Sapiens
auauuuucucccagauuuucuuaugcacuacuaacauuucaauaaaaaguauaaaaauuaaag

SEQ ID NO: 170008 - RNA, 63 nt, Homo Sapiens
gauaaacuguaacaggugaagauauauaaauauacauuucacaccuagaaaacaagauggaaa

SEQ ID NO: 170009 - RNA, 63 nt, Homo Sapiens
cucaaugcucugaucucuagcucuagcauuuugacauuucagauaaaaauuacucccucuuuu

SEQ ID NO: 170010 - RNA, 63 nt, Homo Sapiens
aggaacagugaggcuaguuguagcuggagcgugacauuucauuuagucucaguuaauacguga

SEQ ID NO: 170011 - RNA, 63 nt, Homo Sapiens
aucuaagaaaucaggcaaguaauuguuauggauacauuucagacauuaaacaacguguaugca

SEQ ID NO: 170012 - RNA, 63 nt, Homo Sapiens
cuacuauuguuuugcaaagaugaagacuuuaaaacauuucauaaaaaacuaauuuuagaaguu

SEQ ID NO: 170013 - RNA, 63 nt, Homo Sapiens
uugcugagaguuuuguuauaaggaaacucagggacauuucaagggcuuuccccuguauaucau

SEQ ID NO: 170014 - RNA, 63 nt, Homo Sapiens
caaccuugcuggcuuuccacguucugacaacagacauuucagagacagagaaggggaagcccu

SEQ ID NO: 170015 - RNA, 63 nt, Homo Sapiens
caaauuuggccaauauuaucuauaaaauuguugacauuucagguauacauaccuuaauaguuu

SEQ ID NO: 170016 - RNA, 63 nt, Homo Sapiens
gaucauuacuagugccauaacccugcuucuucaacauuucacagaacuucucuuuuauauaaa

SEQ ID NO: 170017 - RNA, 63 nt, Homo Sapiens
ugcacccacaacauacuucuguuacacacaagaacauuucaggaaacucagccagcuuauuuu

SEQ ID NO: 170018 - RNA, 63 nt, Homo Sapiens
caaaagagaauuggugugcaucugagaggucugacauuucauuauuuacuuauuuccuagcuu

SEQ ID NO: 170019 - RNA, 63 nt, Homo Sapiens
gcacuuuaaugauaaaaucccauuguauuuaaaacauuucauguauuucuuuagaacaacaua

SEQ ID NO: 170020 - RNA, 63 nt, Homo Sapiens
guacucacagguuugcaaaugggaaaaaaguuuacauuucaguuuaggggcauaucuaagcua

SEQ ID NO: 170021 - RNA, 63 nt, Homo Sapiens
gcuauuauauuuggcaggaacccagaguccagaacauuucaucuaugauggguuagauaaugu

SEQ ID NO: 170022 - RNA, 63 nt, Homo Sapiens
uuuuaauugguaauuacagccccuaaaaaaaacacauuucaaauaggcuucccacuaaacucu

SEQ ID NO: 170023 - RNA, 63 nt, Homo Sapiens
guaaugagucagugaagucuagaaucauacuuaacauuucauuguacaaguauuacaaccaua

SEQ ID NO: 170024 - RNA, 63 nt, Homo Sapiens
gcacagagcugggaaggccuuacagaagaggugacauuucagcugggccagagaucaguagag

SEQ ID NO: 170025 - RNA, 63 nt, Homo Sapiens
caaagccauagaagaaaaagucaaucagcauauacauuucagcacuaaucaaauaauaaucaa

SEQ ID NO: 170026 - RNA, 63 nt, Homo Sapiens
ugcuccuuugucauauuguaaaauucuucaccaacauuucauucuugauauugugaaaaggug

SEQ ID NO: 170027 - RNA, 63 nt, Homo Sapiens
gugauguauauuguguugcauugcaaggauuacacauuucacuuaauucuuucaacuugcaau

SEQ ID NO: 170028 - RNA, 63 nt, Homo Sapiens
guggcuguuucuguauagccgugccugaucugcacauuucaucuugguuccuugguauucacc

SEQ ID NO: 170029 - RNA, 63 nt, Homo Sapiens
ugcagacgugccucuguguauuggugugcacacacauuucaugcaaccagcuaaacugccuuu

SEQ ID NO: 170030 - RNA, 63 nt, Homo Sapiens
ccauauucuucucuguucacuauccugaaguguacauuucaacuauuuuauucugcaaaucug

SEQ ID NO: 170031 - RNA, 63 nt, Homo Sapiens
aggacaauaaaaauaagacauaacuguauaugaacauuucacgaaauccuuuugggaacaucu

SEQ ID NO: 170032 - RNA, 63 nt, Homo Sapiens
auaaauuaacagaggagagguucuaagcugugaacauuucaagcuuccccagcaggcuguagu

SEQ ID NO: 170033 - RNA, 63 nt, Homo Sapiens
aauuauuuugauaaguguuguguuucauaugaaacauuucagaucuuuuuauugcuuugucua

SEQ ID NO: 170034 - RNA, 63 nt, Homo Sapiens
uaauggugccugacauauugauauuaauguauuacauuucaaaaaaacuuauuuuucuaguaa

SEQ ID NO: 170035 - RNA, 63 nt, Homo Sapiens
cuugggauuuuuccaaauuauucccugauaguuacauuucaaccaugaaagcauuuuucguug

SEQ ID NO: 170036 - RNA, 63 nt, Homo Sapiens
uaucuuagguaagacauauaacgcagucuaauuacauuucacuucaaggcucaaugcuauucu

SEQ ID NO: 170037 - RNA, 63 nt, Homo Sapiens
uggcugugggcagagacuaggacccuuauggguacauuucaguaaucucucacugccuaaaau

SEQ ID NO: 170038 - RNA, 63 nt, Homo Sapiens
cucaauucgcugaaaaaggaacuaccuauccuuacauuucaccuacuaaugucucuucuaaca

SEQ ID NO: 170039 - RNA, 63 nt, Homo Sapiens
aauguaccuggggaaaucaacugaccucccugaacauuucacgcagucagggaacaggugagg

SEQ ID NO: 170040 - RNA, 63 nt, Homo Sapiens
uucucuuccuacuauauuucauaucuaccuacuacauuucauaucauuccuacuacauuucau

SEQ ID NO: 170041 - RNA, 63 nt, Homo Sapiens
uaucuaccuacuacauuucauaucauuccuacuacauuucauaucuaccuacauuuacaugua

SEQ ID NO: 170042 - RNA, 63 nt, Homo Sapiens
cauaauaaauauuauuaaauaucaggaaagcuaacauuucauacaagauagcuucagaccaaa

SEQ ID NO: 170043 - RNA, 63 nt, Homo Sapiens
caccacugaaauaguuuucuacugaaauacaaaacauuucauuaacugcuauaggaucugucu

SEQ ID NO: 170044 - RNA, 63 nt, Homo Sapiens
caccauugaaauaguuuucuacugaaauacaaaacauuucauuaacugcucuaagaugugucu

SEQ ID NO: 170045 - RNA, 63 nt, Homo Sapiens
gaugcuucuaucaggucccacauauucuuaaugacauuucacucaucucguauaauauucaca

SEQ ID NO: 170046 - RNA, 63 nt, Homo Sapiens
gaugcuucugucaggucccacauagucuugaugacauuucacucaucuugucuaauuuucaca

SEQ ID NO: 170047 - RNA, 63 nt, Homo Sapiens
gucuuguuuuaggauaacuagaacagcacugauacauuucaagccuucauugcuagauccuuc

SEQ ID NO: 170048 - RNA, 63 nt, Homo Sapiens
gaaaaaaguacaauugguuacuacauaauacuaacauuucaguacagggagucguggcugucu

SEQ ID NO: 170049 - RNA, 63 nt, Homo Sapiens
gcacccuauuucacguagcacuuaccaaugccaacauuucaaaacaaaagggcccacaggaau

SEQ ID NO: 170050 - RNA, 63 nt, Homo Sapiens
augagguuuagggaaacaaaaacacuggugaucacauuucaacucccauugggccccacuucc

SEQ ID NO: 170051 - RNA, 63 nt, Homo Sapiens
caacagaaaccagaaaagcacaucccuuuuuuuacauuucauauuaaaugugucauuggaagc

SEQ ID NO: 170052 - RNA, 62 nt, Homo Sapiens
aaaggaucauuugacaacuggcacaaaggaaaacauuucaauuuucuuucccacagaguuaa

SEQ ID NO: 170053 - RNA, 63 nt, Homo Sapiens
cauguaacuuuuauaugaaacaucuuccugcagacauuucaaagcuaaccugucugauggugg

SEQ ID NO: 170054 - RNA, 63 nt, Homo Sapiens
agagaaaaugaauauuuaaauuuuaaaguuugcacauuucaucuuuguccuaacaugagugcu

SEQ ID NO: 170055 - RNA, 63 nt, Homo Sapiens
uuugucuucaaguaaaaugucugguugugccagacauuucacaagugugaaaggagauaggag

SEQ ID NO: 170056 - RNA, 63 nt, Homo Sapiens
cuuucccagccuuuuugguuuuuuuaauugaacacauuucaucuaaguaaagcucaguucuuu

SEQ ID NO: 170057 - RNA, 63 nt, Homo Sapiens
cagaguuaauccuggcugcucaggagaggcgacacauuucaaaucuccacgagauauucucca

SEQ ID NO: 170058 - RNA, 63 nt, Homo Sapiens
guuuuauauguauauguuuuauacauaaauaaaacauuucaucuaauauauauaugugugugu

SEQ ID NO: 170059 - RNA, 63 nt, Homo Sapiens
auguucccuuuugaacuuuuacauuuuggcaugacauuucagaguauugugggaccaugagac

SEQ ID NO: 170060 - RNA, 63 nt, Homo Sapiens
uguuucauguuuguaugggaaaauuguagcuaaacauuucauuguccccagucugcaaaagaa

SEQ ID NO: 170061 - RNA, 63 nt, Homo Sapiens
uaauuuaauuacauuuuacuuuaaaaacuuuacacauuucaguuucuaaaauuuuaaauuaac

SEQ ID NO: 170062 - RNA, 63 nt, Homo Sapiens
uuuauuuagaacugugagaccgguauuuuggaaacauuucaaaggaaacauaugaauuuguuu

SEQ ID NO: 170063 - RNA, 63 nt, Homo Sapiens
gugccacuuaaaugccaauuaaacaagaauauaacauuucaauagaaauuuuuauuucauuuu

SEQ ID NO: 170064 - RNA, 63 nt, Homo Sapiens
ccaaaucuuagcagguaaaagcaauauucuuauacauuucauaauaaaauuagcucuauguau

SEQ ID NO: 170065 - RNA, 63 nt, Homo Sapiens
agguccuuaggcacccagauaucagccacuuucacauuucauuucauuuuaugcuaacauuua

SEQ ID NO: 170066 - RNA, 63 nt, Homo Sapiens
auuauacuguucugcagcauuuagacauuugucacauuucauuagcuuugacaaccauacugu

SEQ ID NO: 170067 - RNA, 63 nt, Homo Sapiens
aggcaaagggguaccccaaauccagaggugccuacauuucaggcagccuuggaguauuuuaaa

SEQ ID NO: 170068 - RNA, 63 nt, Homo Sapiens
ugacauucuuauacugcugucucaaauccaaaaacauuucagagcucuugucucagagaugug

SEQ ID NO: 170069 - RNA, 63 nt, Homo Sapiens
cuuucauuggauugacccuacaacugcccugggacauuucacuguaccaguauuaacugcaaa

SEQ ID NO: 170070 - RNA, 63 nt, Homo Sapiens
aggggcagcuguguucaugcccugugcuacuggacauuucacaauucuggcaccuugcgauug

SEQ ID NO: 170071 - RNA, 63 nt, Homo Sapiens
cuuuccuccagaacaaaauguuaacuuucuaacacauuucaugcauagcuuggcucagaaggu

SEQ ID NO: 170072 - RNA, 63 nt, Homo Sapiens
gucuuggaccugucuguuggguuuaguccguggacauuucagagggagaucccccucccauuu

SEQ ID NO: 170073 - RNA, 63 nt, Homo Sapiens
acagcagcccugccugugaagcucuuguuucugacauuucacaggcagagaggugccaucagu

SEQ ID NO: 170074 - RNA, 63 nt, Homo Sapiens
uacauacaaccuaguacacuugaagucagacagacauuucaguugcuuaccuccaguacugag

SEQ ID NO: 170075 - RNA, 63 nt, Homo Sapiens
agcaacugugauuuuuguuuuuaagacucauggacauuucauaccugugcaauacugaagacc

SEQ ID NO: 170076 - RNA, 63 nt, Homo Sapiens
ucuaccccuggcaccuccaaaucucauguccucacauuucaaaaccaaucaugccuucccaac

SEQ ID NO: 170077 - RNA, 63 nt, Homo Sapiens
uccaugcugaagaaaagugacagucuccaggggacauuucagccaugcugaaagggaggcugg

SEQ ID NO: 170078 - RNA, 63 nt, Homo Sapiens
uaagccacuuaacaccguguaaaaaaaaaaaagacauuucauccaaaggguuaucugauaacc

SEQ ID NO: 170079 - RNA, 63 nt, Homo Sapiens
uggaaaugcugcccaaucuuuuguaaaguuguaacauuucacaauuuaaauaaaaaacaaaac

SEQ ID NO: 170080 - RNA, 63 nt, Homo Sapiens
caggcaggccauuuucuuuuuaaguauauauuuacauuucaccccugcucaauuuuauuuuac

SEQ ID NO: 170081 - RNA, 63 nt, Homo Sapiens
cuuaugggggagaagacacucuguuuuccaugaacauuucaaggugcauaucugguuauuugc

SEQ ID NO: 170082 - RNA, 63 nt, Homo Sapiens
cacugcauucuuagguauucguuuuuagaacagacauuucaguugauaucaaaaaauguuuau

SEQ ID NO: 170083 - RNA, 63 nt, Homo Sapiens
auuaccuuugcuguuuuacuuaauuauuuugcuacauuucacuacucagcacucaucacuucc

SEQ ID NO: 170084 - RNA, 63 nt, Homo Sapiens
cagacuaguacaucucaauggcuuacugccucuacauuucacuaagacuuuaagacuuaaaag

SEQ ID NO: 170085 - RNA, 63 nt, Homo Sapiens
ggcaucacuauuuuuaaaugacauuuuccccuuacauuucaaauaaauuauaauguaaaguug

SEQ ID NO: 170086 - RNA, 63 nt, Homo Sapiens
cucugggauauaaauuacgugacaauuaccuuuacauuucaaggaucuaaagauaaugucuua

SEQ ID NO: 170087 - RNA, 63 nt, Homo Sapiens
uuacuagcgagaaaucuuugaauacuguuccuaacauuucauuugggguaggaccuauauuuu

SEQ ID NO: 170088 - RNA, 63 nt, Homo Sapiens
aaaugaugucaguuucaaaguuuguguaauuuuacauuucaugaacauauggguauuuuuuau

SEQ ID NO: 170089 - RNA, 63 nt, Homo Sapiens
acuucugcuuauugaguacuaaauggugucaggacauuucaguuuaagcagagaaagacaucu

SEQ ID NO: 170090 - RNA, 63 nt, Homo Sapiens
ggggacccuccagaagcccauuuucaauuguugacauuucagacugucaccuuuggguugugu

SEQ ID NO: 170091 - RNA, 63 nt, Homo Sapiens
agucucuuuuuuucauccuuucuggggaagcaaacauuucacuggagucuuggguguuccuua

SEQ ID NO: 170092 - RNA, 63 nt, Homo Sapiens
caaguaaguuaacggcauuuccucaaaggaaaaacauuucauccuuuaccaccucuuccuccc

SEQ ID NO: 170093 - RNA, 63 nt, Homo Sapiens
uauuaucucugccucauuucaacacagguugaaacauuucaucauuuuuuuuuuuuuuuuuuu

SEQ ID NO: 170094 - RNA, 63 nt, Homo Sapiens
cuuuuucauuuucauggaggucgggaaaucuuuacauuucaguaauuuaacaccauuucuacg

SEQ ID NO: 170095 - RNA, 63 nt, Homo Sapiens
uguacuucaaaaaauaugcuaaccagugucuuuacauuucauuugaucuguuucguuaagcug

SEQ ID NO: 170096 - RNA, 63 nt, Homo Sapiens
ccucaggcucgugguggugccagugccccggacacauuucacaagccuggcuggcggugccca

SEQ ID NO: 170097 - RNA, 63 nt, Homo Sapiens
uuccuggaaagcucauuaucucuguuugaauuaacauuucagcauggaacuaacugggcggag

SEQ ID NO: 170098 - RNA, 63 nt, Homo Sapiens
augcuguucuguaaauuuauugaaaccucuggaacauuucaccuuuagagauggaggauggaa

SEQ ID NO: 170099 - RNA, 63 nt, Homo Sapiens
uccauccauuuaccuaauaguaugaaacaguucacauuucaauaaaaucaaacuuuucaugua

SEQ ID NO: 170100 - RNA, 63 nt, Homo Sapiens
aagaggauaaaagaagcaugaaugaaaagaaugacauuucaaaaaaaugguucaaugaaaaac

SEQ ID NO: 170101 - RNA, 63 nt, Homo Sapiens
ccuuccagggagcucuuuuaaucuuaaaguucuacauuucaugcucuuagucaaauucuguua

SEQ ID NO: 170102 - RNA, 63 nt, Homo Sapiens
uuaaaaacagggaaauuauaagugcagagauuaacauuucacaaauguuuagugaaacauuug

SEQ ID NO: 170103 - RNA, 63 nt, Homo Sapiens
uucuccauucccgugcgcuucuauuuauccuggacauuucaaaccuccucugugccuuggcuc

SEQ ID NO: 170104 - RNA, 63 nt, Homo Sapiens
ggauugugccgggagagugccucugacuuugggacauuucauccacagaaauuuccaagccaa

SEQ ID NO: 170105 - RNA, 63 nt, Homo Sapiens
aaaauuuaccuuguuaacaagcaucaccaaugaacauuucagagcaaucugcauauuuaacag

SEQ ID NO: 170106 - RNA, 63 nt, Homo Sapiens
gccacauaugugacuuuaaauuuucugacagucacauuucaaaaaguaaaaagaagcagguga

SEQ ID NO: 170107 - RNA, 63 nt, Homo Sapiens
cagcacacuugccuucuauuuauuuaaguguaaacauuucaaagcaggccguacuccuucuga

SEQ ID NO: 170108 - RNA, 63 nt, Homo Sapiens
cuugauuuugccccaagauucugacuucuggcuacauuucaccugcaguuaccugggcuaucg

SEQ ID NO: 170109 - RNA, 63 nt, Homo Sapiens
aauucugugaauuaagauguaauuuauaaaauaacauuucaauggggguaaacaggccagaag

SEQ ID NO: 170110 - RNA, 63 nt, Homo Sapiens
ugauagagaugaaucaugucaguaguuagaauaacauuucaacuguuuucuuugcuaaaauca

SEQ ID NO: 170111 - RNA, 63 nt, Homo Sapiens
gucucucccuggcauggagagggcagacugugcacauuucacuaggguccaaauacagaaggg

SEQ ID NO: 170112 - RNA, 63 nt, Homo Sapiens
guccaccuucccaaccccaaugcgugauacucaacauuucaucuugauaccucaaauguaaga

SEQ ID NO: 170113 - RNA, 63 nt, Homo Sapiens
gucagccuuuguuaaccuuaugccuaucuuuaaacauuucaauuuuuuuuuaaugugaauuuu

SEQ ID NO: 170114 - RNA, 63 nt, Homo Sapiens
ccccuccccaacaaagaguuuuaaaguacucugacauuucaccaggaguuuuuguuugcugaa

SEQ ID NO: 170115 - RNA, 63 nt, Homo Sapiens
auaaauuauagcuuccugguuaaguauguaucaacauuucauugcuacagcugcaguagcuuu

SEQ ID NO: 170116 - RNA, 51 nt, Homo Sapiens; identical to SEQ ID NO: 47156

SEQ ID NO: 170117 - RNA, 63 nt, Homo Sapiens
aggccaccuccccucaucuugaaauaaguagaaacauuucagcggcccuccaacucagcacag

SEQ ID NO: 170118 - RNA, 63 nt, Homo Sapiens
gaccuugucucucauacuucuaugcuucuaagcacauuucauucaccagaaucugacucccau

SEQ ID NO: 170119 - RNA, 63 nt, Homo Sapiens
aauuccaacuccugaugcccgugagauaaaugcacauuucagacucauugugccaagccuucu

SEQ ID NO: 170120 - RNA, 63 nt, Homo Sapiens
ggagagaaaaaaaguaauauaucuucaccggacacauuucagacaaacuuaccuuagugggac

SEQ ID NO: 170121 - RNA, 63 nt, Homo Sapiens
acaaacccuaauaaauccacggccguacaaauuacauuucaaacaucaaaggaauaaaaagcu

SEQ ID NO: 170122 - RNA, 63 nt, Homo Sapiens
auuuaaauuaguaccauaucucagcuacauaaaacauuucaggucuuaagcuuuauccaaauu

SEQ ID NO: 170123 - RNA, 63 nt, Homo Sapiens
ugguagaauccauguagaagcacuauuaagcagacauuucaguccugcuaauagcaccaucgu

SEQ ID NO: 170124 - RNA, 63 nt, Homo Sapiens
ucuuggaaaaggccuccuucuuucauuucugucacauuucauucaagucugugguccaugggc

SEQ ID NO: 170125 - RNA, 63 nt, Homo Sapiens
aaccaaagaaagugggucacccuggagacaguaacauuucauucuguucaugacagcuacuaa

SEQ ID NO: 170126 - RNA, 63 nt, Homo Sapiens
guccugacucucaaggaaccguuauccacacucacauuucagaauacagcagcuuuuuuugca

SEQ ID NO: 170127 - RNA, 63 nt, Homo Sapiens
aauggguaagaguagaaccagguaagucuuuccacauuucaauaauaauaccuuagauuucua

SEQ ID NO: 170128 - RNA, 63 nt, Homo Sapiens
auguaaaauuccuguuauucccgacagaaauagacauuucaucguuuuuaucauugauuugua

SEQ ID NO: 170129 - RNA, 63 nt, Homo Sapiens
ugauaccacucauccacguguuccugauuguccacauuucaugauaaaaugagagcuccgcag

SEQ ID NO: 170130 - RNA, 63 nt, Homo Sapiens
uuagaggauccuguacacaguuccacuauuaaaacauuucagguugaauucugcaguauuuuc

SEQ ID NO: 170131 - RNA, 63 nt, Homo Sapiens
gggaguggggagcaggaauugcacucagacaugacauuucaauucaucucugcuaaugaaaag

SEQ ID NO: 170132 - RNA, 63 nt, Homo Sapiens
uuagcuguuaaaugguaucucauuuuuuaaaacacauuucacauuuaaagucauacaugcuua

SEQ ID NO: 170133 - RNA, 63 nt, Homo Sapiens
auagaaggcugucuuagugcaaaaaacauacuuacauuucagacauauccaaagggaauacuc

SEQ ID NO: 170134 - RNA, 63 nt, Homo Sapiens
gauaggaccaaauauguaagugcagggggaaacacauuucagaccaggaauccacauugaaaa

SEQ ID NO: 170135 - RNA, 63 nt, Homo Sapiens
agaugugacagcuuuagugguagauguagggaaacauuucaacagccauaguacuauuuguuu

SEQ ID NO: 170136 - RNA, 63 nt, Homo Sapiens
gccauaguccuccaagaagaaagcaccaagacaacauuucauaugacuauaaugcauguacua

SEQ ID NO: 170137 - RNA, 63 nt, Homo Sapiens
gucaggugauauucuugauugaaaaguugcuuaacauuucaguaauauaauuuuaauucuaag

SEQ ID NO: 170138 - RNA, 63 nt, Homo Sapiens
uccacuuacacagugggggacucaaagucagccacauuucacauacuguuacugaagaaagca

SEQ ID NO: 170139 - RNA, 63 nt, Homo Sapiens
ccucacugcccacuggguagagacaccuggaugacauuucaguacccgcuggcagcuccuccc

SEQ ID NO: 170140 - RNA, 63 nt, Homo Sapiens
gaggaugccuaauccuacaaagugacccuuuauacauuucauuuuuuauuugauauuaaagua

SEQ ID NO: 170141 - RNA, 63 nt, Homo Sapiens
acugccuuuaauagaaaaccuaaaugcuggggcacauuucacauaucgacuaccugagaaauu

SEQ ID NO: 170142 - RNA, 63 nt, Homo Sapiens
cuguguaucccagacuguuaauacagaaaagagacauuucagcugugauuaugaccauuguuu

SEQ ID NO: 170143 - RNA, 63 nt, Homo Sapiens
accaauaacaauuagguguacuucuauuuuaaaacauuucagaaaaaaauauauguuauagca

SEQ ID NO: 170144 - RNA, 63 nt, Homo Sapiens
cauuguuuuaaguugauugacuaguuauuauguacauuucagaauguacacauaaauacugug

SEQ ID NO: 170145 - RNA, 63 nt, Homo Sapiens
gaaugaguaaagcagaaaaacuuuuaaccagcaacauuucaaguacguagugugaucaaacau

SEQ ID NO: 170146 - RNA, 63 nt, Homo Sapiens
ccaccaaucugcuguguauuucaucuauugccaacauuucauauaaauggcaucauacaauau

SEQ ID NO: 170147 - RNA, 63 nt, Homo Sapiens
ugugcacugaaguaaaugggguugggggaggggacauuucauauuuauaaugugcugaaggua

SEQ ID NO: 170148 - RNA, 63 nt, Homo Sapiens
ucuauaguugcaaaacacauaaaaggggacuuaacauuucacguuguaucuuacuugcaguga

SEQ ID NO: 170149 - RNA, 63 nt, Homo Sapiens
acuguacauugcucauuucacacucuucagaagacauuucauaccugcccugguccugcuuga

SEQ ID NO: 170150 - RNA, 63 nt, Homo Sapiens
cuuuuaauguguaaagaucuacaugaaugcaaaacauuucauuaugaggucagacuaggauaa

SEQ ID NO: 170151 - RNA, 63 nt, Homo Sapiens
caccaggacagucacccccaaacuugacccccaacauuucaaugcacagaagggacuggaaag

SEQ ID NO: 170152 - RNA, 63 nt, Homo Sapiens
ccgagcuugucagcuuuuuuuuuuucaguuucuacauuucagacauguucucuuccuuucacu

SEQ ID NO: 170153 - RNA, 63 nt, Homo Sapiens
ucaacuauuaaaaauuuucuugagugaaugaauacauuucaaaauuucugcaacacaauguaa

SEQ ID NO: 170154 - RNA, 63 nt, Homo Sapiens
uacauauuuaaaacuguaucucaagaaaaugccacauuucaauccaagaaauguauugaauac

SEQ ID NO: 170155 - RNA, 63 nt, Homo Sapiens
gugugaagcacucauuucuauuaucggaaaugcacauuucauacuuuaugcugcauaaaucac

SEQ ID NO: 170156 - RNA, 63 nt, Homo Sapiens
gaagacuccauggcugcuccagugaaccuuuguacauuucaaauuggacaggucuugcuauuc

SEQ ID NO: 170157 - RNA, 63 nt, Homo Sapiens
gcaccuccuuaagccagccacaccacccacaugacauuucaaaagaaacaguucagcagugac

SEQ ID NO: 170158 - RNA, 63 nt, Homo Sapiens
cggacaaagcacaaguggcgucuuccccgacccacauuucaaggcugacaaagauguucuucc

SEQ ID NO: 170159 - RNA, 63 nt, Homo Sapiens
guaacugguguucuauacacauauuuauugauaacauuucauugguagacuuucuaagcauag

SEQ ID NO: 170160 - RNA, 63 nt, Homo Sapiens
gcgcaugcacaaccuugaugggaccuuuugugaacauuucaagauuauaaaucccuguaucgu

SEQ ID NO: 170161 - RNA, 63 nt, Homo Sapiens
uucuaucuuauuugacuaagaaucaguaaguuuacauuucaauaguggggaaaaucccacaga

SEQ ID NO: 170162 - RNA, 63 nt, Homo Sapiens
ggccuuuuuuuuuuuuuaagcagaccauuuuauacauuucaguuuugauaccaccaucauguu

SEQ ID NO: 170163 - RNA, 63 nt, Homo Sapiens
uaccuauauuuaucugagugagauaauugcuuuacauuucacaaccauaauuaaaguugcaua

SEQ ID NO: 170164 - RNA, 63 nt, Homo Sapiens
gagcuuuaaaguacuuuggaguaagaauuaaauacauuucauucuaaugaaguauugguuuua

SEQ ID NO: 170165 - RNA, 63 nt, Homo Sapiens
augguaacagccccaugaagccacaauuggaauacauuucaagcaucagucuguucucuuuga

SEQ ID NO: 170166 - RNA, 63 nt, Homo Sapiens
uucuuuacucaguucugcauguuuuuuuaaaagacauuucagcuuaaauaaauucauggcaau

SEQ ID NO: 170167 - RNA, 63 nt, Homo Sapiens
cgagguccaaggcaggaggcaugaagcccagccacauuucagcccucuuuccucccuccgcgg

SEQ ID NO: 170168 - RNA, 63 nt, Homo Sapiens
ccacucuguacagcugcucuugcacccuguuuaacauuucaccgguucuuagcccuugggcac

SEQ ID NO: 170169 - RNA, 63 nt, Homo Sapiens
ugcugcuucaaaaaguacuugcugguaguaaacacauuucaucugccauguucuuugauuuag

SEQ ID NO: 170170 - RNA, 63 nt, Homo Sapiens
gauagucaugcugcuagaucuuuauuauggaaaacauuucaaguuuacuccuucuguuuugag

SEQ ID NO: 170171 - RNA, 63 nt, Homo Sapiens
acauacacaauuacaacaaacuuuuuuuaaaagacauuucauuguacugcaaaaaucugaaua

SEQ ID NO: 170172 - RNA, 63 nt, Homo Sapiens
accaaaacaaauggagaagaaacauccaaaagcacauuucauuucuccaaacuuuguguuuua

SEQ ID NO: 170173 - RNA, 63 nt, Homo Sapiens
ccaucuuaggggauuaucuuacguuuaagcuuaacauuucauguaguaagauuuggagagcca

SEQ ID NO: 170174 - RNA, 63 nt, Homo Sapiens
uguaaauacaucuugucuuguuuucauucaaaaacauuucacuuuugggguugcgugucagau

SEQ ID NO: 170175 - RNA, 63 nt, Homo Sapiens
aagucgaaauuaauguaguuuucugccuugauaacauuucauaugugguauuaguuuuaaagg

SEQ ID NO: 170176 - RNA, 63 nt, Homo Sapiens
uaucaguugguauaaagagagagaaagagaaaaacauuucagcccuuagaugaggucuuacac

SEQ ID NO: 170177 - RNA, 63 nt, Homo Sapiens
uuaagagacuaacucuccacuuguaugggaacuacauuucacucuugguuuucaggauauaac

SEQ ID NO: 170178 - RNA, 63 nt, Homo Sapiens
uuguuuuguaacaaugucaguuguuaaaccuugacauuucaauuaaaacaugaauuguaguua

SEQ ID NO: 170179 - RNA, 63 nt, Homo Sapiens
uauuugacauagccuuaaugguccuuaaagaagacauuucagugugagauucagacuucagac

SEQ ID NO: 170180 - RNA, 50 nt, Homo Sapiens
guaaaauguagcugcgucauacauuucaagucacagguuucccaagcuaa

SEQ ID NO: 170181 - RNA, 63 nt, Homo Sapiens
acucugggaugauuuuaaucuuaacuaaugaagacauuucagagaaauaaauuguauaguuac

SEQ ID NO: 170182 - RNA, 63 nt, Homo Sapiens
acuucauacuguuuauaaacuuuauuggugccaacauuucaaagcacccggccguucccauuu

SEQ ID NO: 170183 - RNA, 63 nt, Homo Sapiens
auguuauuaaaugucauucuaguuuuuauaaauacauuucauaggagccccuguguugucuca

SEQ ID NO: 170184 - RNA, 63 nt, Homo Sapiens
ucauuugaaacuaaaauuuuaugcuucagugucacauuucauucagucuucaguuguguucuu

SEQ ID NO: 170185 - RNA, 63 nt, Homo Sapiens
aucuagaaguuuuacuuuuaacucuacuguaguacauuucaggauuaaaaguguaaacuauag

SEQ ID NO: 170186 - RNA, 63 nt, Homo Sapiens
gacagcauuaacaagaaugaggaacugauacuuacauuucauguauaaagcacuagcugagaa

SEQ ID NO: 170187 - RNA, 63 nt, Homo Sapiens
caauauuagaauaaaguuccuucuacuucaaaaacauuucauguuuuuuugucagauaaucau

SEQ ID NO: 170188 - RNA, 63 nt, Homo Sapiens
aaaaggcauaugcaauauuuuccucuauccuguacauuucacagaugauaauaugcuaaauuu

SEQ ID NO: 170189 - RNA, 63 nt, Homo Sapiens
aaaagucuccaaaacauuucuaggccugaaaugacauuucacuggagggcagauucggaccac

SEQ ID NO: 170190 - RNA, 63 nt, Homo Sapiens
uuaguuauuauguguauuuauguaguauuucaaacauuucaaaaugcuuucaucuauguuuau

SEQ ID NO: 170191 - RNA, 63 nt, Homo Sapiens
ucacacccagcucggaauagaucuucccugaugacauuucaugcccucuaaggcaguuuuuaa

SEQ ID NO: 170192 - RNA, 63 nt, Homo Sapiens
aauuauauacuuaauauguauugauuaaaagaaacauuucagaaauaaaauuucaacauuguu

SEQ ID NO: 170193 - RNA, 63 nt, Homo Sapiens
uuacugacugcuuauaaacauuuaaagacaaagacauuucaaauaacugcagaaaaaauauug

SEQ ID NO: 170194 - RNA, 63 nt, Homo Sapiens
ugucuuuuagaauacacaaaauauaguauaaagacauuucacaauuuccaaacaaaucuuucu

SEQ ID NO: 170195 - RNA, 63 nt, Homo Sapiens
guuacaugcauuacugugagggguugaggccugacauuucauuaguggaucaggaaguaagua

SEQ ID NO: 170196 - RNA, 63 nt, Homo Sapiens
ugugcugacccugugguugucgcugauguacacacauuucauuauuugccaauggugcaauaa

SEQ ID NO: 170197 - RNA, 63 nt, Homo Sapiens
guguggugccuauacuuaauaaugggguauuauacauuucaaaauugauguucucaucacaga

SEQ ID NO: 170198 - RNA, 63 nt, Homo Sapiens
uuggaaaaaauaucuuucgaaaaucaaauuuaaacauuucacucugugcugcauauuucuuuu

SEQ ID NO: 170199 - RNA, 63 nt, Homo Sapiens
agguucucaacuuaaaauuacugaaauagaugaacauuucaguacucauauuugugcacuuua

SEQ ID NO: 170200 - RNA, 63 nt, Homo Sapiens
ucagugcucauauacaguaaauuaugccauuugacauuucaaauucuugagaaauuuguuuuu

SEQ ID NO: 170201 - RNA, 63 nt, Homo Sapiens
aaagauauuuuaaacucuuuuggggaaauaguuacauuucacaaaaauaauucaggaaaacua

SEQ ID NO: 170202 - RNA, 63 nt, Homo Sapiens
cacccuccaccccugcuauuucccaaugaagauacauuucacuaacuugcucucuuucaauac

SEQ ID NO: 170203 - RNA, 63 nt, Homo Sapiens
ucaggauugcaagcauuagcuaaaacuucauggacauuucauggccaugucucacuguuuaaa

SEQ ID NO: 170204 - RNA, 63 nt, Homo Sapiens
uaauuauccaauaauccuacgagugccauacauacauuucauucaugugccaggcacugugcu

SEQ ID NO: 170205 - RNA, 63 nt, Homo Sapiens
aggaggcuuuucauuagggguacacuuagccuuacauuucaggagacgccuugguucuguuug

SEQ ID NO: 170206 - RNA, 63 nt, Homo Sapiens
acaagaugugucaugaaaacacauuucacaugcacauuucaaacuuuacagagguucggacua

SEQ ID NO: 170207 - RNA, 63 nt, Homo Sapiens
ugcacauuucaaaacaagaugagguucggacuaacauuucacaacgcaaaaacuuccuuuaca

SEQ ID NO: 170208 - RNA, 63 nt, Homo Sapiens
aaaagauugcugcauuuaaacuaugugaugaaaacauuucauuauucauacagaaaacaagua

SEQ ID NO: 170209 - RNA, 62 nt, Homo Sapiens; identical to SEQ ID NO: 169721

SEQ ID NO: 170210 - RNA, 63 nt, Homo Sapiens
uaaagaaggcuguacucaagaggaggagcugacacauuucacuuggcugcgucuuaauaaaca

SEQ ID NO: 170211 - RNA, 63 nt, Homo Sapiens
ggugacagagugagaccauguuucaaacaagaaacauuucagaggguaaguaaacagauuuga

SEQ ID NO: 170212 - RNA, 63 nt, Homo Sapiens
auacccugcaauguaauugucccucuguggcucacauuucauuagugagccaugaaaucaacu

SEQ ID NO: 170213 - RNA, 63 nt, Homo Sapiens
aaguggcccaaggucacgcaacucugagaugccacauuucauuugaucuuguacacauuuucu

SEQ ID NO: 170214 - RNA, 63 nt, Homo Sapiens
uacuuucugugucuauggauuugccuucucuaaacauuucauauaaauggaauuacacaauga

SEQ ID NO: 170215 - RNA, 63 nt, Homo Sapiens
guuuuauguuuuguuuugugggucauagggagcacauuucaccugugcaggaaaagaguuuuc

SEQ ID NO: 170216 - RNA, 63 nt, Homo Sapiens
guaaggucuguucccgacagaacuagaaagagaacauuucagucuuccugccaccaagcagga

SEQ ID NO: 170217 - RNA, 63 nt, Homo Sapiens
cacugaaaaugugcucuacacguuuggccagugacauuucaaucaugugcgaacacagugaca

SEQ ID NO: 170218 - RNA, 63 nt, Homo Sapiens
ugaaagcauaauuuuguccauuugauuuauuuuacauuucauacagcacauagcccuguuaua

SEQ ID NO: 170219 - RNA, 63 nt, Homo Sapiens
ugaauauuauuugggggauuuacuauuuaacacacauuucaaauaacaugguuaaugguuaau

SEQ ID NO: 170220 - RNA, 63 nt, Homo Sapiens
uaaaaggcacacuacagucauuuauuuuuauauacauuucagucauucuauaaagauuggggu

SEQ ID NO: 170221 - RNA, 63 nt, Homo Sapiens
cuugaacgcagcaucugacaacaguuuugaggaacauuucauuuagcuacuacauuugauaga

SEQ ID NO: 170222 - RNA, 63 nt, Homo Sapiens
agcaggguuggccaggcgcgggaaaagauuuagacauuucaagugaauuguauaugcuaguga

SEQ ID NO: 170223 - RNA, 63 nt, Homo Sapiens
auaacgugaucacuuugacuuguuacaaauggaacauuucauuggagucuaaaaauuauuagc

SEQ ID NO: 170224 - RNA, 63 nt, Homo Sapiens
uucacccuacauuccucuccgacucuauuaaucacauuucaaauuucuagcaugugcugcauu

SEQ ID NO: 170225 - RNA, 63 nt, Homo Sapiens
auaaauaaagauauuuucuuauugauuauuggaacauuucagagccacuaccacaguuuuuac

SEQ ID NO: 170226 - RNA, 63 nt, Homo Sapiens
cuuacaaagcaacuguuagauuaucaguaaaagacauuucaauugccuuccccuaucgaacag

SEQ ID NO: 170227 - RNA, 63 nt, Homo Sapiens
aauucugucuguaauugauuuuaaaaacaauuuacauuucaggucugugugcucuuaaauaua

SEQ ID NO: 170228 - RNA, 63 nt, Homo Sapiens
uuuuaauccgaauuuagcuacaacuccauaaaaacauuucagagguacauuccagccuguugg

SEQ ID NO: 170229 - RNA, 63 nt, Homo Sapiens
auuugagggaaaauuucuaaagcauggagagcuacauuucauauauuauaacaaucauuggaa

SEQ ID NO: 170230 - RNA, 63 nt, Homo Sapiens
acauucacauuucucucacauuuuuucuggcagacauuucaguuuuugagggguuggauuuuc

SEQ ID NO: 170231 - RNA, 63 nt, Homo Sapiens
aagauauagugugguguuucaaucuguauacuuacauuucaaauauucuuaaaaauaaauuaa

SEQ ID NO: 170232 - RNA, 63 nt, Homo Sapiens
cgugcccugcacaaaaaccaccaccagcagcucacauuucacgucucggcuuuucggccaucg

SEQ ID NO: 170233 - RNA, 63 nt, Homo Sapiens
uuucacauuaagucaacaccaaacgugguugccacauuucaucagacagacaccucccucugg

SEQ ID NO: 170234 - RNA, 63 nt, Homo Sapiens
gaaaaauuuuacaucagaaaaugggauaaacauacauuucacagaaaauaaucaagacuugcu

SEQ ID NO: 170235 - RNA, 63 nt, Homo Sapiens
cuccacagccugucuccaaggccuccccuauguacauuucagugagcucacuuugauuuuuaa

SEQ ID NO: 170236 - RNA, 63 nt, Homo Sapiens
uggaaggucauagccuggaacccaaguuugaaaacauuucauuguguucaguagugaauuucu

SEQ ID NO: 170237 - RNA, 63 nt, Homo Sapiens
cuuugaaagucuaggaguagguggucaucuuguacauuucagcaaagcauccacuaggaaacc

SEQ ID NO: 170238 - RNA, 63 nt, Homo Sapiens
uuuggcaggguuuaaaauauuugugagaagcccacauuucaguauacauccucacuggcuucc

SEQ ID NO: 170239 - RNA, 63 nt, Homo Sapiens
agcaaggcccccaaagggcccugguuuuacauuacauuucaaacuuuauuugcuuugggguuu

SEQ ID NO: 170240 - RNA, 63 nt, Homo Sapiens
aauuauuaacaacaacaaaaaacagauuauaaaacauuucauacaacacgauuguauuuuggc

SEQ ID NO: 170241 - RNA, 63 nt, Homo Sapiens
caguguugagugcaucaauaacuuacugaccgaacauuucaguuauuuguuuagaagugcaaa

SEQ ID NO: 170242 - RNA, 63 nt, Homo Sapiens
aauuaaaagcucaguuucucaguugcgcuaaucacauuucaagugcucagcagccacccgugu

SEQ ID NO: 170243 - RNA, 63 nt, Homo Sapiens
aaugguaggaugcuucuguaguucacaaauguuacauuucagagacuuuagaggaaaaauuau

SEQ ID NO: 170244 - RNA, 63 nt, Homo Sapiens
ggcuauaccucagcaucuagcacagggaagaaaacauuucaagccucaaauugcuagaaaauu

SEQ ID NO: 170245 - RNA, 63 nt, Homo Sapiens
ggggucaggagaguuaaggaccuggugguuugcacauuucagggggacuuugccaccggcuug

SEQ ID NO: 170246 - RNA, 63 nt, Homo Sapiens
uguucacuuuugcaauuuguagcuacaguggccacauuucagaaugauugcuuuugagggaaa

SEQ ID NO: 170247 - RNA, 63 nt, Homo Sapiens
gauagaaaauacuucacugcgaauuugucuaacacauuucaagugugugggguuuccccucag

SEQ ID NO: 170248 - RNA, 63 nt, Homo Sapiens
acaucuucuuuuuaugcauucugacugcaacucacauuucaaaccuguuccuuucuuuccagc

SEQ ID NO: 170249 - RNA, 63 nt, Homo Sapiens
aauuccuuucccgaguauaauuugaauacuugcacauuucaauuggagaaauguuucaauuuc

SEQ ID NO: 170250 - RNA, 63 nt, Homo Sapiens
cuuuaugauugucauccuuacgugccuggggcgacauuucaggugaucacggcagcccuacgc

SEQ ID NO: 170251 - RNA, 63 nt, Homo Sapiens
gcuuuuucccuaagcuguuuauugacgacaucuacauuucaguaucaauaaugccugaggcug

SEQ ID NO: 170252 - RNA, 63 nt, Homo Sapiens
aaugauacaguccugucauuacaccugagacagacauuucaacggcuuaucgcuagcggauuc

SEQ ID NO: 170253 - RNA, 63 nt, Homo Sapiens
aaaauuaggggggaaaugggagaaaauaaugugacauuucaaaaacagcaccaaagcagucag

SEQ ID NO: 170254 - RNA, 63 nt, Homo Sapiens
uuacaauaaauauaaaaugaaauguuuauguugacauuucagugugaacuguggauugucaau

SEQ ID NO: 170255 - RNA, 63 nt, Homo Sapiens
agaaaugaccacgugaaauuugccucuguccaaacauuucauccguguguauguguaugugug

SEQ ID NO: 170256 - RNA, 63 nt, Homo Sapiens
guuuucugaagcaaacaucuggugccaagaucuacauuucaacccugccuuacacccagagcg

SEQ ID NO: 170257 - RNA, 63 nt, Homo Sapiens
gaagccuuggaaugggcauaaguuguauguccuacauuucaucauugucccgggccugcauug

SEQ ID NO: 170258 - RNA, 63 nt, Homo Sapiens
auucuaaacagcaauucuuuuguacguaauaggacauuucauccuagaaaaauaaaguaaugu

SEQ ID NO: 170259 - RNA, 63 nt, Homo Sapiens
uccuaagaauucuaagaacagugacucauucugacauuucagaguauggagcaugaccagcgu

SEQ ID NO: 170260 - RNA, 63 nt, Homo Sapiens
ugagaaugaaaauuacuacacaauacggaaaagacauuucaguuaacacaggguuuuaacuug

SEQ ID NO: 170261 - RNA, 63 nt, Homo Sapiens
ugcucaguagauacguguggggcugaacuagccacauuucaacaacacaaaauucaauuccuc

SEQ ID NO: 170262 - RNA, 63 nt, Homo Sapiens
uugauuucuccacugaaauuaugaaacaaugcaacauuucacuuuugagagucucacuucuaa

SEQ ID NO: 170263 - RNA, 63 nt, Homo Sapiens
accuucacagaucaaacucaaaacaucagggccacauuucacuguuaccaaaucaggguuaag

SEQ ID NO: 170264 - RNA, 63 nt, Homo Sapiens
aaaaauucuucuauugcaagggggccuuuuuugacauuucauuuaauuuuuguuuuuauuuug

SEQ ID NO: 170265 - RNA, 63 nt, Homo Sapiens
uauacuaaaccucacaaaguugaaaauugcaauacauuucaaucaauuuguagguaauguucc

SEQ ID NO: 170266 - RNA, 63 nt, Homo Sapiens
uauuaaaguaucacaggcaaaucagaaaacaacacauuucauuucaugauuugaaaggggcau

SEQ ID NO: 170267 - RNA, 63 nt, Homo Sapiens
cauuuuaggauugucaaaagaggauuguggagcacauuucaauauuaagaaugcuuuggauua

SEQ ID NO: 170268 - RNA, 63 nt, Homo Sapiens
uugauugaauacaugaucuugucgguacaagucacauuucauuacaucaagacaacuucagca

SEQ ID NO: 170269 - RNA, 63 nt, Homo Sapiens
ccuaaagcuggcaaucaggauuaauccuguuuuacauuucagaugaguuguucggaaccucaa

SEQ ID NO: 170270 - RNA, 63 nt, Homo Sapiens
aaacacauguguugaccaccccauccuaaggugacauuucaagauucagggaggccugcaacu

SEQ ID NO: 170271 - RNA, 63 nt, Homo Sapiens
aauuuauaauaaagagcacuauucagaaaagaaacauuucaguuugcacauauuuauauuuau

SEQ ID NO: 170272 - RNA, 63 nt, Homo Sapiens
uuccuccuuaaaaaaucaaacguaauauguauuacauuucaugguacauuaguaguucuuugu

SEQ ID NO: 170273 - RNA, 63 nt, Homo Sapiens
aauucugccuuucagcagcaucaauugcuaggaacauuucauucauuucccuguaauauuaau

SEQ ID NO: 170274 - RNA, 63 nt, Homo Sapiens
uuuauuuuuguuuuuguuggauagcuuuuaauuacauuucagagagguguaauuuuggguaga

SEQ ID NO: 170275 - RNA, 63 nt, Homo Sapiens
cuaacagauccagaaaugacgcugucugggucaacauuucagggaggagucugccaccagugu

SEQ ID NO: 170276 - RNA, 63 nt, Homo Sapiens
caaauuaucaacugguugauguguacacuaauuacauuucaggaggacuuaaugcuauuuaug

SEQ ID NO: 170277 - RNA, 63 nt, Homo Sapiens
uuaugcacuccauccaucauaacuguaugaaacacauuucauauguaaauaaacgugggacau

SEQ ID NO: 170278 - RNA, 63 nt, Homo Sapiens
cuaauuugaagaacacuuuaauugacacagaauacauuucacauauuuaaccucuacaauaag

SEQ ID NO: 170279 - RNA, 63 nt, Homo Sapiens
ugcuauccacugugauuuuuaugcauuaaaagcacauuucauguguauucaacccuaaguaaa

SEQ ID NO: 170280 - RNA, 63 nt, Homo Sapiens
guaggaguauuuuuaggagcagaaacugcaaacacauuucauugugagguuuuacccucugua

SEQ ID NO: 170281 - RNA, 63 nt, Homo Sapiens
aaauguuaugugcaaugaacagccugugaaaauacauuucaaacuuugcaaaugacuaccuau

SEQ ID NO: 170282 - RNA, 63 nt, Homo Sapiens
cucagaaaauccaaccauaucauaaaguauaaaacauuucauucuuugucugguuggguuccu

SEQ ID NO: 170283 - RNA, 63 nt, Homo Sapiens
uguggaugucuauaacuucaaaaauauacucguacauuucaccucacaaggaaagauuuauuu

SEQ ID NO: 170284 - RNA, 63 nt, Homo Sapiens
aaaucaaacaaaucuauauuuugcaagaagaugacauuucagacuuauuacauaccaauggcu

SEQ ID NO: 170285 - RNA, 63 nt, Homo Sapiens
auuuuacucacuuuauccaauguaguuagggauacauuucagcgaaaauaccuggcaugaaac

SEQ ID NO: 170286 - RNA, 63 nt, Homo Sapiens
gagacaaagugcauguuuuuacaauauuuaaggacauuucagcuugcagaauuuggugcucag

SEQ ID NO: 170287 - RNA, 63 nt, Homo Sapiens
aauuccugcuguaaaauaauuuuuaaaaccuugacauuucaaagacugccuugaaaggucgca

SEQ ID NO: 170288 - RNA, 63 nt, Homo Sapiens
agaugacaaauuuggaaaaaccacucaucacuuacauuucaugaaguacuucuuugauaaaau

SEQ ID NO: 170289 - RNA, 63 nt, Homo Sapiens
gucacugccaauuucugaggcugaagccauuucacauuucaccccuaccaccuggcaggugca

SEQ ID NO: 170290 - RNA, 63 nt, Homo Sapiens
cugucacauuagggauacaaucagaauugguagacauuucaaaguguuuugaagggaagaaua

SEQ ID NO: 170291 - RNA, 63 nt, Homo Sapiens
uccgauucagcccccuuuuaucacucagcuguuacauuucacauugaaaaaucgaaauugaca

SEQ ID NO: 170292 - RNA, 63 nt, Homo Sapiens
aagagaaagcgcugagagcuaggcuuuaaagccacauuucagcgccagugagcucagccucca

SEQ ID NO: 170293 - RNA, 63 nt, Homo Sapiens
cauaucuuuaaagcacaugaauuucauccacagacauuucauaaaguaaauaccagauauauu

SEQ ID NO: 170294 - RNA, 63 nt, Homo Sapiens
aaaauuguuuggaaaauaaaauguacucuuggcacauuucaauuucauacauuugugcugccc

SEQ ID NO: 170295 - RNA, 63 nt, Homo Sapiens
acgcaauguaggugcucagucuacaaaacuaggacauuucauaggacuuuguucauugcuagu

SEQ ID NO: 170296 - RNA, 63 nt, Homo Sapiens
aaagaaagagaaaguacucagaggcugacacugacauuucacuuccucgcucuccuaaguuua

SEQ ID NO: 170297 - RNA, 63 nt, Homo Sapiens
cuacaaaagauuugguuuuuaaauuaugguuacacauuucaguaacucauagcugcugugcaa

SEQ ID NO: 170298 - RNA, 63 nt, Homo Sapiens
cuagaguauauauuguucaguauuucuuuggaaacauuucauuaauguacuugucuuacagaa

SEQ ID NO: 170299 - RNA, 63 nt, Homo Sapiens
ucuccacgcaccuguguaugugaaagucauuuuacauuucaaagcaguguguguuucuuauuu

SEQ ID NO: 170300 - RNA, 63 nt, Homo Sapiens
uaaaugccuuaagaguauuuaaaauaugcuuccacauuucaaaauauaaaauguaacaugaca

SEQ ID NO: 170301 - RNA, 63 nt, Homo Sapiens
gucacgagggccucugcccaggaccuucuauucacauuucaagaaucccuuucugaaauucuc

SEQ ID NO: 170302 - RNA, 63 nt, Homo Sapiens
agccucauagcucauguaucagggacuuuugccacauuucagaggcauagcaugaacaaguaa

SEQ ID NO: 170303 - RNA, 63 nt, Homo Sapiens
ugucccccccgcuccgucccccaaacauguuguacauuucaccauggcccccucaucauagca

SEQ ID NO: 170304 - RNA, 63 nt, Homo Sapiens
aaagaauuacuuguguuacuugccaagcagugcacauuucauaguuucaaaucuguaaucagc

SEQ ID NO: 170305 - RNA, 63 nt, Homo Sapiens
gauuauuaagcugacuaagcaaugaucuaauacacauuucauauuuucuuuauaauaauuucu

SEQ ID NO: 170306 - RNA, 63 nt, Homo Sapiens
cuugcaaaaguauggucaaaggaaaaaaaucccacauuucaauuaacaaguagcauggacauu

SEQ ID NO: 170307 - RNA, 63 nt, Homo Sapiens
aggauguaauucuaauuaacuguugauugccaaacauuucacucugcugugccgucucuucau

SEQ ID NO: 170308 - RNA, 63 nt, Homo Sapiens
aaacauuuuaaugauuuuaugaguuaacuucaaacauuucagaccaaauccuagaaauaaaau

SEQ ID NO: 170309 - RNA, 63 nt, Homo Sapiens
aauguugauauuuggcugaugugguuacauuucacauuucacugaagccuaacuuuuuacaca

SEQ ID NO: 170310 - RNA, 63 nt, Homo Sapiens
uuucacuaauguugauauuuuuacacagugguuacauuucacauguuucagaagccuaacuuu

SEQ ID NO: 170311 - RNA, 63 nt, Homo Sapiens
caguaaacuggccucuacuaacuccauaauauaacauuucaucaguccauccuucaaaugacc

SEQ ID NO: 170312 - RNA, 63 nt, Homo Sapiens
caguccuuagaacccccaggcacuuuccauaggacauuucacaaugccagggaucaugcuugg

SEQ ID NO: 170313 - RNA, 63 nt, Homo Sapiens
gaaagguauguugucuaacauauuugacauuuuacauuucaaaucuaaaguugugugauuaua

SEQ ID NO: 170314 - RNA, 63 nt, Homo Sapiens
aucggcaaugccuggcccacguucuuccuuuucacauuucagagcagggcauucaucuuugau

SEQ ID NO: 170315 - RNA, 63 nt, Homo Sapiens
augaaugaccuacaacagcucaagaauaaguuuacauuucacacuguuugaaucuuuaauucc

SEQ ID NO: 170316 - RNA, 63 nt, Homo Sapiens
ggagauuaugugguuggccaauaaagauagaugacauuucaaucucagugauuuaugcuugcu

SEQ ID NO: 170317 - RNA, 63 nt, Homo Sapiens
ccuuuucuuuuagaaaauggaagcuaugaagcaacauuucaaaugucucuccacaaaccaaac

SEQ ID NO: 170318 - RNA, 63 nt, Homo Sapiens
aacgccuucccaaaauggcaacuucccacagccacauuucagaccugcugagacugcugagug

SEQ ID NO: 170319 - RNA, 63 nt, Homo Sapiens
aggucgggaaauuuuuaaacucgugguccccagacauuucaggauaauacagugagcccaccc

SEQ ID NO: 170320 - RNA, 63 nt, Homo Sapiens
aacccuauaagucauucaguauggcuauguagaacauuucauucauuucagaaacuggccuaa

SEQ ID NO: 170321 - RNA, 63 nt, Homo Sapiens
uaaauggaaucacacaauuguucccuguucuggacauuucauaucuguugucuaaaauagguu

SEQ ID NO: 170322 - RNA, 63 nt, Homo Sapiens
ccaguucacggauggggaaacaggccugaggucacauuucacuuagugguuguguugggacca

SEQ ID NO: 170323 - RNA, 63 nt, Homo Sapiens
agaacagcagcagcgcuacagcccagagguuauacauuucaacagaacagggauccuuggcua

SEQ ID NO: 170324 - RNA, 63 nt, Homo Sapiens
cauccuuuguguacucaggaagcaacaaaacccacauuucauaugcaauacccuguuauccuc

SEQ ID NO: 170325 - RNA, 63 nt, Homo Sapiens
ugaguuuaaaagugccucaaaauaauugagaucacauuucaggacauuuggaaaucaggucga

SEQ ID NO: 170326 - RNA, 63 nt, Homo Sapiens
uaagauuuuaagauccucuaacacuguacuaaaacauuucaauaaaaucauucugacugcguu

SEQ ID NO: 170327 - RNA, 63 nt, Homo Sapiens
uggccaugaugauauuauuaaacaccauuauucacauuucaaauaauaacaauacuuuuuguu

SEQ ID NO: 170328 - RNA, 63 nt, Homo Sapiens
aauucuaaccuuugauaguaaucagaauguauuacauuucauuucugaauagcuuuugaauuu

SEQ ID NO: 170329 - RNA, 63 nt, Homo Sapiens
acccugugaaguaguuuuggcaaugucuguguuacauuucauguaauuuagccaacucccauu

SEQ ID NO: 170330 - RNA, 63 nt, Homo Sapiens
uuuucugagcuucuaaauguagccuuucauugcacauuucagugaucagaauagauauccuuu

SEQ ID NO: 170331 - RNA, 63 nt, Homo Sapiens
uggccacagugugcagguuauaaaagcauuaauacauuucaagguaagagccuuaaaaguuaa

SEQ ID NO: 170332 - RNA, 63 nt, Homo Sapiens
auuagccuguaauuucuaaauuggagauucucuacauuucacuugcaguuuccuguucuccuc

SEQ ID NO: 170333 - RNA, 63 nt, Homo Sapiens
cauuccaguggguaggguuuagcugggggaaggacauuucauaaggguuaguuggacugagca

SEQ ID NO: 170334 - RNA, 63 nt, Homo Sapiens
auuugaaggucuugauuuguuuuagaaugaugcacauuucauguauuccaguuuguuuauuac

SEQ ID NO: 170335 - RNA, 63 nt, Homo Sapiens
guaguuuuuauuuucuuccuucuacuucucuauacauuucagauucucuacaguaagcaugug

SEQ ID NO: 170336 - RNA, 63 nt, Homo Sapiens
ugauauuuuguuauuuuuguuguuauauuauuuacauuucaguaguuguuuuuuguguuucca

SEQ ID NO: 170337 - RNA, 63 nt, Homo Sapiens
gcaggcgccagggcugucaucaacauggauaugacauuucacaacagugacuaguugaauccc

SEQ ID NO: 170338 - RNA, 63 nt, Homo Sapiens
auuugaagugacacaagcuauggaccaucacacacauuucagcugauggugugaaacccacuu

SEQ ID NO: 170339 - RNA, 63 nt, Homo Sapiens
ccccuuuuaguuaagucuuuauccuuauuaggaacauuucaaauugagcagugccucaaguac

SEQ ID NO: 170340 - RNA, 63 nt, Homo Sapiens
ugcaguguacuccaaaaagccuguagaguuuccacauuucacagagaagcugugguguguaug

SEQ ID NO: 170341 - RNA, 63 nt, Homo Sapiens
ggaaauaaaucaguguccguguuuaaaugggacacauuucaaaauaaugaacuuguauagugu

SEQ ID NO: 170342 - RNA, 63 nt, Homo Sapiens
cccugcccuuguuuggagcuuucucucccacucacauuucaacacagugugucugaugauccc

SEQ ID NO: 170343 - RNA, 63 nt, Homo Sapiens
uuggccaauaaacagaaauaugaugcucugcaaacauuucauaggcagggcuauguuuguuua

SEQ ID NO: 170344 - RNA, 63 nt, Homo Sapiens
ccaucuggcuaaaguuaagaggaugaaaauuuuacauuucaacauuuuuucaaugcaagauga

SEQ ID NO: 170345 - RNA, 63 nt, Homo Sapiens
uacuuuucaguuaauuauucccauuuucuuauaacauuucaguaguaguagugaaauuguagg

SEQ ID NO: 170346 - RNA, 63 nt, Homo Sapiens
caacuuuuuacaccaaauucuagcucagggucuacauuucauuauugaaacauaauuacuuga

SEQ ID NO: 170347 - RNA, 63 nt, Homo Sapiens
gucugucugguccauagcuggccagaacaccacacauuucacuuugcucgaugcagacagggg

SEQ ID NO: 170348 - RNA, 63 nt, Homo Sapiens
uuaagccucauacguuuaaaauuuaugauguuaacauuucagggaugaaacuuugaaaaagau

SEQ ID NO: 170349 - RNA, 63 nt, Homo Sapiens
aaaugaacacccuugugauacacaguuauuagcacauuucagaauggaaaggaaggcaaucga

SEQ ID NO: 170350 - RNA, 63 nt, Homo Sapiens
ugauggugugaaacccacuuuugaccgucacacacauuucagcauuugaagagacacaggcua

SEQ ID NO: 170351 - RNA, 63 nt, Homo Sapiens
acucuacugccuuccacauauugguuccuugauacauuucauaugauaucagccaagaguuuu

SEQ ID NO: 170352 - RNA, 64 nt, Homo Sapiens
ucuacagacauuaaacaauuguuguguucuuuuuaccuuuuauuuuucuauuaccuugcuacca

SEQ ID NO: 170353 - RNA, 64 nt, Homo Sapiens
gaaguuuucugaauuaauaaugacuuagauugugaccuuuuagauucgguguugagcucugugu

SEQ ID NO: 170354 - RNA, 64 nt, Homo Sapiens
aaguuggcaugaaauuuuggccaccccaauuuuuaccuuuuagucagucugccauuuugggugc

SEQ ID NO: 170355 - RNA, 64 nt, Homo Sapiens
acagauuaacaaucaacugcuuccuuugcgugaaaccuuuuauagaauuauaguccuuauuuuu

SEQ ID NO: 170356 - RNA, 64 nt, Homo Sapiens
aaugcauuuuugcaaaacaaaggugacuuuggaaaccuuuuaaaagugagcacuaugauuauca

SEQ ID NO: 170357 - RNA, 64 nt, Homo Sapiens
aguaagugucaagugagugaaaagaugcauaacaaccuuuuagcuugaaccucaaccagguaua

SEQ ID NO: 170358 - RNA, 64 nt, Homo Sapiens
gauacugaaagugccuccuuuuuuaggauuaaauaccuuuuacauuauucucuagguaaguaug

SEQ ID NO: 170359 - RNA, 64 nt, Homo Sapiens
caaaaaauucuuuaaaauauuuuauauuuuuuucaccuuuuaaagggagugaaucaguuucuug

SEQ ID NO: 170360 - RNA, 64 nt, Homo Sapiens
cucuugcugugaaauugaagugcauguagaaaaaaccuuuuacuauaugaaacuuuacaacacu

SEQ ID NO: 170361 - RNA, 64 nt, Homo Sapiens
aaaugacuaguaauauaggcuuucaagaguugguaccuuuuagcuauauuugcagauucucugg

SEQ ID NO: 170362 - RNA, 64 nt, Homo Sapiens
uuauuuuggucauauuuuuacuuuagugucacucaccuuuuacaaagugacuuuguacucauuu

SEQ ID NO: 170363 - RNA, 64 nt, Homo Sapiens
caagaaugauacaggccauaauugaaaugggaauaccuuuuaaguuucauuagggguggggugg

SEQ ID NO: 170364 - RNA, 64 nt, Homo Sapiens
ggagaaaaaucaaaaccccacugucuaaauaaguaccuuuuauuauugucacuaaaaaauuuua

SEQ ID NO: 170365 - RNA, 64 nt, Homo Sapiens
caagaaaacguuaaauaacugugccaaugggcccaccuuuuaaauuucugauuuauuuucuuaa

SEQ ID NO: 170366 - RNA, 64 nt, Homo Sapiens
aggaaagcucuuauaaagucuuuuuauaacagcaaccuuuuaaauagaguaauagagucauacu

SEQ ID NO: 170367 - RNA, 64 nt, Homo Sapiens
uguugaugacucacucauaauacugaugugugcaaccuuuuaugguuaccuucacauguccuau

SEQ ID NO: 170368 - RNA, 64 nt, Homo Sapiens
aagaguuuguaaauucuagcgaaagcuuaaauacaccuuuuauuauuuguugucccauaauuga

SEQ ID NO: 170369 - RNA, 64 nt, Homo Sapiens
uuaaaauuacuuugaaagauaaauaaauguuuaaaccuuuuacgaaaugaaaaauauauuggca

SEQ ID NO: 170370 - RNA, 64 nt, Homo Sapiens
aaaguuucaguguauuuaucuucuauauacccugaccuuuuaauuugcaaacaugccuuuuguu

SEQ ID NO: 170371 - RNA, 64 nt, Homo Sapiens
gacauuaaauguaaacuuaaauagcuuuuaaaagaccuuuuaaaggcaauuuauaauagaacuu

SEQ ID NO: 170372 - RNA, 64 nt, Homo Sapiens
aaaaaucaacaaaauaugcuuucuggagaacuguaccuuuuaugguuugcuugcacaucaguag

SEQ ID NO: 170373 - RNA, 64 nt, Homo Sapiens
ugagugucaauugaaaguugucaauuaaaagguaaccuuuuaaucucguaggaggaaucucauu

SEQ ID NO: 170374 - RNA, 64 nt, Homo Sapiens
ggcauuuuuuucuggauucaaacaggcaacaaugaccuuuuauuuucuguuuguccccaccucc

SEQ ID NO: 170375 - RNA, 64 nt, Homo Sapiens
uuuguauuuggagagagugacuauugaacuugaaaccuuuuauuccgggcgucuugguaguuuc

SEQ ID NO: 170376 - RNA, 64 nt, Homo Sapiens
gaggcuaaguuaucuuugaugugaacuuucagcuaccuuuuaaaaaagaaaacaaaaaaaggua

SEQ ID NO: 170377 - RNA, 64 nt, Homo Sapiens
caaugugagauguaugaaaaaaauguccaauuuuaccuuuuacagcaugaugcuugacagugug

SEQ ID NO: 170378 - RNA, 64 nt, Homo Sapiens
uaguaauugacaugugccagugacauugcguuugaccuuuuauguccuccugaggcuuuggauu

SEQ ID NO: 170379 - RNA, 64 nt, Homo Sapiens
gacacagaaaauguugagaaucuacuaauuccacaccuuuuauuaaaaacaggucuucaucgaa

SEQ ID NO: 170380 - RNA, 64 nt, Homo Sapiens
aucagggaaguuagucaaaugaaauggaaauugguaaauggacaaaagcuagcuaguaaaaagg

SEQ ID NO: 170381 - RNA, 64 nt, Homo Sapiens
acaauuaagagauuucugacauuuauucuuacacuaaauggaucaacucuaggauuuaggcaug

SEQ ID NO: 170382 - RNA, 64 nt, Homo Sapiens
gucaaaguggcacagcaaaucauauaaaucgaauuaaauggacaacaccguuagauguguaugu

SEQ ID NO: 170383 - RNA, 64 nt, Homo Sapiens
cauuuuaaggaaaccuacuaaauccaguuaauauuaaauggacaccacucauuaagaaauuucu

SEQ ID NO: 170384 - RNA, 64 nt, Homo Sapiens
aguagaauuaaugguugaggcaauuauuccuaaauaaauggauaguuuagaggggaaaaaaaaa

SEQ ID NO: 170385 - RNA, 64 nt, Homo Sapiens
aaggacccucaagacaaaugaaggaccauaaauuuaaauggagagaagcucaacaagagacugg

SEQ ID NO: 170386 - RNA, 64 nt, Homo Sapiens
cugcuguuuuauacauuugcaacaauuucucuuguaaauggaaugguuugggguuuuuaaauaa

SEQ ID NO: 170387 - RNA, 64 nt, Homo Sapiens
uaaugcuuuuauguauuucaaaacuuucauauguuaaauggaaauuguuuuaaauguguuugag

SEQ ID NO: 170388 - RNA, 64 nt, Homo Sapiens
aaagcuguacuugcauuucaaagcuuauaagauauaaauggagauuuuaaaguagaaauaaaua

SEQ ID NO: 170389 - RNA, 64 nt, Homo Sapiens
uuauuccauauuuucuuuucagugaaaaauuuuuuaaauggaagacuguucuaaaaucacuuuu

SEQ ID NO: 170390 - RNA, 64 nt, Homo Sapiens
gccauuaguguagaugucugauuugugaggauaauaaauggaauuccaaaguauaacacuauca

SEQ ID NO: 170391 - RNA, 64 nt, Homo Sapiens
cuugagacaaaaccuuaacagugcuauccaguuauaaauggaauuugccauuaauccuaauuca

SEQ ID NO: 170392 - RNA, 64 nt, Homo Sapiens
gaugcugcgcacaugagcugucuguguauuguacuaaauggacuaauuauaucauuacugugua

SEQ ID NO: 170393 - RNA, 64 nt, Homo Sapiens
uaggaagacuguuuuucuuuucucuguuuuaugcuaaauggauucaguguuuccaucucuggaa

SEQ ID NO: 170394 - RNA, 64 nt, Homo Sapiens
uaauccuugaaaauaguuuuaaaaaccuauuagguaaauggaaaauuuuauaacuuuuaaaugg

SEQ ID NO: 170395 - RNA, 64 nt, Homo Sapiens
aaccuauuagguaaauggaauauuuuauaacuuuuaaauggaaauucuguuuucucuuuuuaaa

SEQ ID NO: 170396 - RNA, 64 nt, Homo Sapiens
auuuuagaaggaacuuugcuggggcuuggaauucuaaauggaaggacagaaauaugaaugucga

SEQ ID NO: 170397 - RNA, 64 nt, Homo Sapiens
cuuaucaaaaaagaauauagguuaccaguguuaauaaauggauaguucugugugcccugaaaau

SEQ ID NO: 170398 - RNA, 64 nt, Homo Sapiens
aagcugugcagaggaaacuuucaucaucacaaccuaaauggagaagaggggguaacagucugca

SEQ ID NO: 170399 - RNA, 64 nt, Homo Sapiens
aauuagcuuguuacaauucuuuuguuaugcacuuuaaauggaauccacuuaacaggaaguuuag

SEQ ID NO: 170400 - RNA, 64 nt, Homo Sapiens
uuucuaauauaaugacuuaucuucuauagguuuuuaaauggaaucuauauuuaaaucauuuuaa

SEQ ID NO: 170401 - RNA, 64 nt, Homo Sapiens
ugagaaacuuuauacuucagguuuguugacaagguaaauggaaaugcugaaauguuugggauau

SEQ ID NO: 170402 - RNA, 64 nt, Homo Sapiens
agaugaauguacuucuuuuuuuugcaacauuugcuaaauggauuguuuuauugguggaagcuga

SEQ ID NO: 170403 - RNA, 64 nt, Homo Sapiens
auccuuacagcuugcaugcaaucaaccucuuuuguaaauggaaaauaaagucuguuacccaaag

SEQ ID NO: 170404 - RNA, 64 nt, Homo Sapiens
ggcccugagaauggagcuguagccucauggacaauaaauggaugugacaccaaauacucugcag

SEQ ID NO: 170405 - RNA, 64 nt, Homo Sapiens
auauuggcuuuuguuuucaaugugaaagauacauuaaauggacacauaucuugcaaaauuuugu

SEQ ID NO: 170406 - RNA, 64 nt, Homo Sapiens
auugcuaaguaaucuguuugcacucuaggaaaaguaaauggagagguaaaagaaaggcauuggg

SEQ ID NO: 170407 - RNA, 64 nt, Homo Sapiens
ugaauauauguggaaaacuaccccugacuucuuuuaaauggauguccuuaacugucugcagugc

SEQ ID NO: 170408 - RNA, 64 nt, Homo Sapiens
cuuucauuauuuucagauagaaaccacauuaauuuaaauggagcaaaaugaacacuugaccaaa

SEQ ID NO: 170409 - RNA, 64 nt, Homo Sapiens
uaucuaugggaugugugguuauauaaaccucaguuaaauggaaucuaugguaaugcucuuacgg

SEQ ID NO: 170410 - RNA, 64 nt, Homo Sapiens
uuuguguaaauucacaaaaacaguuuuaaagcuauaaauggaauuaguaauguguuauguagua

SEQ ID NO: 170411 - RNA, 64 nt, Homo Sapiens
auuauuagaguugcagaauagaaacuugaagugcuaaauggaauaauccaaaggaaauuuuuua

SEQ ID NO: 170412 - RNA, 64 nt, Homo Sapiens
cagguuauauauagaauuucuauuaaggauuuuuuaaauggacaagcaauaggggguugaagug

SEQ ID NO: 170413 - RNA, 64 nt, Homo Sapiens
caaauaauggcuucacugaauacaauuuauaugguaaauggaaccuagcaugcaugcacaacaa

SEQ ID NO: 170414 - RNA, 64 nt, Homo Sapiens
uuugggggaauucccucccaaccaaccaacuaucuaaauggacaccuuuuuuuuucuauaaauc

SEQ ID NO: 170415 - RNA, 64 nt, Homo Sapiens
aacaauaagucugagcccaucucaacccacuuuucuccgguagucuuuauguaucuguuagcac

SEQ ID NO: 170416 - RNA, 64 nt, Homo Sapiens
uauugaaugcugucuugacaucucuugccuuguccuccgguauguucuaaagcugugucugaga

SEQ ID NO: 170417 - RNA, 64 nt, Homo Sapiens
auguaaaccuaggaagguaacaccaggcugcuggcuccgguaccucugcaggcuccugcgggcu

SEQ ID NO: 170418 - RNA, 64 nt, Homo Sapiens
cuauccccgccccacagagcucaggguggcagaucuccgguauccucagcacuacccacccccg

SEQ ID NO: 170419 - RNA, 64 nt, Homo Sapiens
uggguggccacguggaugcccuuacccagcaccccuccgguaggcagaacaauggaucggcuuc

SEQ ID NO: 170420 - RNA, 64 nt, Homo Sapiens
ugguauuucaccuuccuguccaucuguccccucccuccgguauaccuuuaucccuuugaaaggg

SEQ ID NO: 170421 - RNA, 64 nt, Homo Sapiens
cucgacccuccuggguguuggggauuggaggaggcuccgguaccgaggaagagccacgucccca

SEQ ID NO: 170422 - RNA, 54 nt, Homo Sapiens
accugggcaccugccgcuggggggcuccgguagccccugccccuaccccuauga

SEQ ID NO: 170423 - RNA, 64 nt, Homo Sapiens
uuuggugaguugagagcuuuuuugacaugcuccacuccgguaacucaugaauucuucucaaaga

SEQ ID NO: 170424 - RNA, 64 nt, Homo Sapiens
agcacacuuugcucaggucuuaacuugagggccucuccgguacuaacauccugcgauagcuugu

SEQ ID NO: 170425 - RNA, 64 nt, Homo Sapiens
uggauuccagauccaccuuacguagccgugugagcuccgguaaauuacauaacccaucaaauuu

SEQ ID NO: 170426 - RNA, 64 nt, Homo Sapiens
uauaaauauuuacuuauaaaaaacagaaauugaccuccgguauacuguagggcaguuaccacag

SEQ ID NO: 170427 - RNA, 64 nt, Homo Sapiens
cccaugaugugacccugaugggcuggacuugccccuccgguagccuuccuuggcccucccagcg

SEQ ID NO: 170428 - RNA, 64 nt, Homo Sapiens
acagcccgagcaggucggggagcugugcuucucucuccgguacgugcccagcucaggccggcug

SEQ ID NO: 170429 - RNA, 64 nt, Homo Sapiens
guucgggccuuccggaugcgguccgccguccgcccuccgguaggucggccucgggcccugcccu

SEQ ID NO: 170430 - RNA, 64 nt, Homo Sapiens
ucucuuucucccuccccuaccagccucauucuuccuccgguagccucucccaccuaaccucugc

SEQ ID NO: 170431 - RNA, 64 nt, Homo Sapiens
uugugaagcugcauucuccugcccagggcuucugcuccgguacccugcucgggcagaggcugcu

SEQ ID NO: 170432 - RNA, 64 nt, Homo Sapiens
caucuaugcacgaccuugggaaaugaguugaugucuccgguaaaacaccggagacuaauuccug

SEQ ID NO: 170433 - RNA, 64 nt, Homo Sapiens
ggggugggucagaaaaagucgagcccagccaucccuccgguaucuucugucuguauccaaacca

SEQ ID NO: 170434 - RNA, 64 nt, Homo Sapiens
ggggugaauucuuaggucgagcugaugcaagaaacuccgguagccagccucugugaccuuguac

SEQ ID NO: 170435 - RNA, 64 nt, Homo Sapiens
gaauagguuuuuuuucuucucaugguuauuuaaucuccgguacuauuuauuucaagagacuaca

SEQ ID NO: 170436 - RNA, 64 nt, Homo Sapiens
caaaauuucauuuuucucauaguuaauuucaucucuccgguaagauuuuauugguguuucuuuu

SEQ ID NO: 170437 - RNA, 64 nt, Homo Sapiens
aguuuuuaauggauugaaauauaccucaaaacugcuccgguaguucuauacuaaauuaacagua

SEQ ID NO: 170438 - RNA, 64 nt, Homo Sapiens
ucaguguuuucucucucucucuuucgagcuugcacuccgguacccgacccggcgcccuggccca

SEQ ID NO: 170439 - RNA, 64 nt, Homo Sapiens
ccguccaccuggccgaggcaacagugcaauaaaucuccgguaacagccccaugccucuuccaaa

SEQ ID NO: 170440 - RNA, 64 nt, Homo Sapiens; identical to SEQ ID NO: 84086

SEQ ID NO: 170441 - RNA, 64 nt, Homo Sapiens; identical to SEQ ID NO: 84087

SEQ ID NO: 170442 - RNA, 64 nt, Homo Sapiens; identical to SEQ ID NO: 84088

SEQ ID NO: 170443 - RNA, 64 nt, Homo Sapiens; identical to SEQ ID NO: 84089

SEQ ID NO: 170444 - RNA, 64 nt, Homo Sapiens; identical to SEQ ID NO: 84090

SEQ ID NO: 170445 - RNA, 64 nt, Homo Sapiens; identical to SEQ ID NO: 84091

SEQ ID NO: 170446 - RNA, 64 nt, Homo Sapiens; identical to SEQ ID NO: 84092

SEQ ID NO: 170447 - RNA, 64 nt, Homo Sapiens; identical to SEQ ID NO: 84093

SEQ ID NO: 170448 - RNA, 64 nt, Homo Sapiens; identical to SEQ ID NO: 84094

SEQ ID NO: 170449 - RNA, 64 nt, Homo Sapiens; identical to SEQ ID NO: 84095

SEQ ID NO: 170450 - RNA, 64 nt, Homo Sapiens; identical to SEQ ID NO: 84096

SEQ ID NO: 170451 - RNA, 64 nt, Homo Sapiens; identical to SEQ ID NO: 84097

SEQ ID NO: 170452 - RNA, 64 nt, Homo Sapiens; identical to SEQ ID NO: 84098

SEQ ID NO: 170453 - RNA, 64 nt, Homo Sapiens; identical to SEQ ID NO: 84099

SEQ ID NO: 170454 - RNA, 64 nt, Homo Sapiens; identical to SEQ ID NO: 84100

SEQ ID NO: 170455 - RNA, 64 nt, Homo Sapiens; identical to SEQ ID NO: 84101

SEQ ID NO: 170456 - RNA, 64 nt, Homo Sapiens; identical to SEQ ID NO: 84102

SEQ ID NO: 170457 - RNA, 64 nt, Homo Sapiens; identical to SEQ ID NO: 84103

SEQ ID NO: 170458 - RNA, 64 nt, Homo Sapiens; identical to SEQ ID NO: 84104

SEQ ID NO: 170459 - RNA, 64 nt, Homo Sapiens; identical to SEQ ID NO: 84105

SEQ ID NO: 170460 - RNA, 64 nt, Homo Sapiens; identical to SEQ ID NO: 84106

SEQ ID NO: 170461 - RNA, 64 nt, Homo Sapiens; identical to SEQ ID NO: 84107

SEQ ID NO: 170462 - RNA, 64 nt, Homo Sapiens; identical to SEQ ID NO: 84108

SEQ ID NO: 170463 - RNA, 64 nt, Homo Sapiens; identical to SEQ ID NO: 84109

SEQ ID NO: 170464 - RNA, 64 nt, Homo Sapiens; identical to SEQ ID NO: 84110

SEQ ID NO: 170465 - RNA, 64 nt, Homo Sapiens; identical to SEQ ID NO: 84111

SEQ ID NO: 170466 - RNA, 64 nt, Homo Sapiens; identical to SEQ ID NO: 84112

SEQ ID NO: 170467 - RNA, 64 nt, Homo Sapiens; identical to SEQ ID NO: 84113

SEQ ID NO: 170468 - RNA, 64 nt, Homo Sapiens; identical to SEQ ID NO: 84114

SEQ ID NO: 170469 - RNA, 64 nt, Homo Sapiens; identical to SEQ ID NO: 84115

SEQ ID NO: 170470 - RNA, 64 nt, Homo Sapiens; identical to SEQ ID NO: 84116

SEQ ID NO: 170471 - RNA, 64 nt, Homo Sapiens; identical to SEQ ID NO: 84117

SEQ ID NO: 170472 - RNA, 64 nt, Homo Sapiens; identical to SEQ ID NO: 84118

SEQ ID NO: 170473 - RNA, 64 nt, Homo Sapiens; identical to SEQ ID NO: 84119

SEQ ID NO: 170474 - RNA, 64 nt, Homo Sapiens; identical to SEQ ID NO: 84120

SEQ ID NO: 170475 - RNA, 64 nt, Homo Sapiens; identical to SEQ ID NO: 84121

SEQ ID NO: 170476 - RNA, 64 nt, Homo Sapiens; identical to SEQ ID NO: 84122

SEQ ID NO: 170477 - RNA, 64 nt, Homo Sapiens; identical to SEQ ID NO: 84123

SEQ ID NO: 170478 - RNA, 64 nt, Homo Sapiens; identical to SEQ ID NO: 84124

SEQ ID NO: 170479 - RNA, 64 nt, Homo Sapiens; identical to SEQ ID NO: 84125

SEQ ID NO: 170480 - RNA, 64 nt, Homo Sapiens; identical to SEQ ID NO: 84126

SEQ ID NO: 170481 - RNA, 64 nt, Homo Sapiens; identical to SEQ ID NO: 84127

SEQ ID NO: 170482 - RNA, 64 nt, Homo Sapiens; identical to SEQ ID NO: 84128

SEQ ID NO: 170483 - RNA, 64 nt, Homo Sapiens; identical to SEQ ID NO: 84129

SEQ ID NO: 170484 - RNA, 64 nt, Homo Sapiens; identical to SEQ ID NO: 84130

SEQ ID NO: 170485 - RNA, 64 nt, Homo Sapiens; identical to SEQ ID NO: 84131

SEQ ID NO: 170486 - RNA, 64 nt, Homo Sapiens
acaaggugaugcagaugugaccuaggacgauggaccgccggacucuuuucugcagcacacgccu

SEQ ID NO: 170487 - RNA, 64 nt, Homo Sapiens
cugcacccagcgacugggccaagggcccgacugcccgccggaccccggcgugccggagaggaga

SEQ ID NO: 170488 - RNA, 64 nt, Homo Sapiens
cagcggagugcgcuggggcgcgccagggcuaggcccgccggaggagcgcguccccagccuuccg

SEQ ID NO: 170489 - RNA, 64 nt, Homo Sapiens
ugcacugccaacugggauugaguguuucucguccccgccggauccaggggucacauauaagguc

SEQ ID NO: 170490 - RNA, 64 nt, Homo Sapiens
uucuccugcagucuguggagcguccuuguccccgccgccggaaugaaugagcauucugcagccc

SEQ ID NO: 170491 - RNA, 64 nt, Homo Sapiens
cucggccggugugcuucgugcgcgggugccuuucccgccggagaguccguccuguguccgcgcg

SEQ ID NO: 170492 - RNA, 64 nt, Homo Sapiens
gcaggacacuagggaggacccuggccaaucccccccgccggagaauggcucagccuaaccucuc

SEQ ID NO: 170493 - RNA, 64 nt, Homo Sapiens
ucuagcugugggcggccaaggacugcgugccucuccgccggaggugacuugugccagcagcaug

SEQ ID NO: 170494 - RNA, 64 nt, Homo Sapiens
cccgccgcggccucaacccggguccgcggggcacccgccggaugcgcagccuggccucuacuac

SEQ ID NO: 170495 - RNA, 60 nt, Homo Sapiens
ccccagccaucaucucuuaacuacggaggcccgccggaggccacaccaucccuuaguuuc

SEQ ID NO: 170496 - RNA, 64 nt, Homo Sapiens
agcugggggggccucaccuguuccccugaggaccccgccggacccggaggcucacagggaacaa

SEQ ID NO: 170497 - RNA, 64 nt, Homo Sapiens
agcaguuuucuaauuuugacuuuaaauuuuucauccgccggagacacugcucccauuugugggg

SEQ ID NO: 170498 - RNA, 64 nt, Homo Sapiens
cugccguccgucucuccugcgccggguccuucgcccgccggaggccagccagcgggcaucugaa

SEQ ID NO: 170499 - RNA, 64 nt, Homo Sapiens
uggcuccguggccccgcccuuuuuccgcccacagccgccggaaggucccaucggaaguuuuggg

SEQ ID NO: 170500 - RNA, 64 nt, Homo Sapiens
ccagcuaucugccugacagggggaaauggccuucccgccggaggucuuccucugcaagugcuca

SEQ ID NO: 170501 - RNA, 64 nt, Homo Sapiens
agugagccccuccccagccagcccuucccuggccccgccggauguauaaauguaaaaaugaagg

SEQ ID NO: 170502 - RNA, 64 nt, Homo Sapiens
ggaccuccuuuggcacagacgaacagaaaccuggccgccggauguuggcauugcuccccagacu

SEQ ID NO: 170503 - RNA, 64 nt, Homo Sapiens
ccggucuccacccugagggagcaccgacccggugccgccggagcuggcccugugcgcaugcuca

SEQ ID NO: 170504 - RNA, 64 nt, Homo Sapiens
cacuuuccuccgcguugcuuccggacggcgccgaccgccggagcccaagugacgcggagcucgu

SEQ ID NO: 170505 - RNA, 64 nt, Homo Sapiens
ugcacauuuugaaaagagcagcugcugcuuagggccgccggaagcugguguccugucauuuucu

SEQ ID NO: 170506 - RNA, 64 nt, Homo Sapiens
gggggagcgcuagagguaguuuagugagcuuaccccgccggagcggcccucaggggcgauuagc

SEQ ID NO: 170507 - RNA, 64 nt, Homo Sapiens
cuuguucuuguuuuacuguauugagcggcggcacccgccggacccgcauuauggcugggggcgc

SEQ ID NO: 170508 - RNA, 64 nt, Homo Sapiens
ccugacaccccugggcuaggaaguggaguuccacccgccggacuaaccgagcuuggaguucucc

SEQ ID NO: 170509 - RNA, 64 nt, Homo Sapiens
cugccguaguaauccaccccaacggccggaggagccgccggagcccgccugcccgcccgccgcc

SEQ ID NO: 170510 - RNA, 64 nt, Homo Sapiens
cauucugggguguggcuccagccuucccuggcccccgccggaggccgggagggagcagggucuc

SEQ ID NO: 170511 - RNA, 64 nt, Homo Sapiens
aaugacaggcccgaggucaguugcccaccgggucccgccggauauugccaccacacucgcccac

SEQ ID NO: 170512 - RNA, 64 nt, Homo Sapiens
gggcagauccucaagcagaccuggaagacggcagccgccggacucuuccuucacuuugcagagg

SEQ ID NO: 170513 - RNA, 64 nt, Homo Sapiens
gcccgaggacgcucccugcuccacgucugcgccgccgccggaguccacucccagugcuugcaag

SEQ ID NO: 170514 - RNA, 64 nt, Homo Sapiens
cugguggggcagacccgaaaauccagcgugcaccccgccggaggaaggucccauggccugcugg

SEQ ID NO: 170515 - RNA, 64 nt, Homo Sapiens
agaucugguaccgcagguagcgccgccgccgccgccgccggagccugucgccguccugucccca

SEQ ID NO: 170516 - RNA, 64 nt, Homo Sapiens
acagccacccucaccgcggcaccagggugaggacccgccggaugcagcugcggcaagccuaggg

SEQ ID NO: 170517 - RNA, 64 nt, Homo Sapiens
ucugggaccacucagggcauguggucuggagguaccgccggagagccaaucggagcgcgaggac

SEQ ID NO: 170518 - RNA, 64 nt, Homo Sapiens
gugccauuccccagccacugccuucaugcugcccccgccggacuggcagagccaggggucagcc

SEQ ID NO: 170519 - RNA, 64 nt, Homo Sapiens
gcccgacuagcaggcaugccgcgguagguaagggccgccggaccgcguagagagccgggccccg

SEQ ID NO: 170520 - RNA, 64 nt, Homo Sapiens
uacaggggcauuuucuuccccguuuugggguuccccgccggagcuguggccugccuuugcugac

SEQ ID NO: 170521 - RNA, 64 nt, Homo Sapiens
gugagagcuguguggccccccgaugccacucugcccgccggagggaugugccugcugagccuuu

SEQ ID NO: 170522 - RNA, 64 nt, Homo Sapiens
cgauccaguacaacgugguggauggccugagggaccgccggagcuuccacgggccguacacagu

SEQ ID NO: 170523 - RNA, 64 nt, Homo Sapiens
uccagaugccccgcuugucucgcagccaguguguccgccggaugguuaacuacccucaccagga

SEQ ID NO: 170524 - RNA, 64 nt, Homo Sapiens
cggguggcaggccgggcuccgccacugcaugcucccgccggaccgagccccagcaagggcuccu

SEQ ID NO: 170525 - RNA, 64 nt, Homo Sapiens
cuggggcucuuugugagugaggguggccaaacuaccgccggaggagauggggucucagagcgag

SEQ ID NO: 170526 - RNA, 64 nt, Homo Sapiens
cacucccugccuugugaguggccugcugccucaccucccgcaggccgccacacuuauugcaggu

SEQ ID NO: 170527 - RNA, 64 nt, Homo Sapiens
ggcugcccguuaagaugguggcggcacacgcucccucccgcagcaccacgccagcuggugcggc

SEQ ID NO: 170528 - RNA, 64 nt, Homo Sapiens
cccaccuggagcccgcuucaagcucucuguugcgcucccgcauuucucaugcuucuucucaugg

SEQ ID NO: 170529 - RNA, 64 nt, Homo Sapiens
ggacccuuaccgguggcucuuccugccugggacccucccgcagagucccacuagccagcggccu

SEQ ID NO: 170530 - RNA, 64 nt, Homo Sapiens
auaagguaccaggacucaggcuucucauccccuccucccgcaaagcgguuuucugacccucagg

SEQ ID NO: 170531 - RNA, 64 nt, Homo Sapiens
aaaagguucuuuacaagaugauaccuuaauuacacucccgcaacacagccauuauuuuauuguc

SEQ ID NO: 170532 - RNA, 64 nt, Homo Sapiens
gagggaaugacggagguagggugcagggucagggcucccgcaggggccugcaucuggccagcag

SEQ ID NO: 170533 - RNA, 64 nt, Homo Sapiens
uuguuccuucuuuuuaccuuuuuaaccacgauuucucccgcaaugaaaacuugaucaaugagcu

SEQ ID NO: 170534 - RNA, 64 nt, Homo Sapiens
uacugagacucuguuuaucacuagccuucugucccucccgcagaagacuguuggauugaacaaa

SEQ ID NO: 170535 - RNA, 64 nt, Homo Sapiens
cucacggugacucagcagugcccaacugaccaaucucccgcagcucuccugccccugggggccc

SEQ ID NO: 170536 - RNA, 64 nt, Homo Sapiens
aauugguauucagcacuauaaauguguuuuuaaccucccgcauucugugcuuauuuaaaacaag

SEQ ID NO: 170537 - RNA, 64 nt, Homo Sapiens
ucgucacuggaaacuuccucauaccacauggcuucucccgcauauucccuaacauggaggcaaa

SEQ ID NO: 170538 - RNA, 64 nt, Homo Sapiens
ugucacgucugugauuuauugcugauucaugcuccucccgcaauuuucuccucccgaaggaaca

SEQ ID NO: 170539 - RNA, 64 nt, Homo Sapiens
ccaggauaacccccgcaaacuuauuggaaggcagcucccgcauacaggcuuggguuccccagcc

SEQ ID NO: 170540 - RNA, 64 nt, Homo Sapiens
gcaugccagccccacacucccugggucuggcuuccucccgcaaccucacucuaguagagccugu

SEQ ID NO: 170541 - RNA, 64 nt, Homo Sapiens
uuccagugccaaaguacaaaucacaaaccccugacucccgcacugcgacaaccaacacgugcuc

SEQ ID NO: 170542 - RNA, 64 nt, Homo Sapiens
ugugggagggagggagggcuggcucaggcaucgucucccgcaaugggcagagagagcagagaca

SEQ ID NO: 170543 - RNA, 64 nt, Homo Sapiens
cugcguuuaggaguucagucccucuccugcccagcucccgcaccaggaacacaguuggagguca

SEQ ID NO: 170544 - RNA, 64 nt, Homo Sapiens
acggccucuauuaccucuacccgaggggcuggcgcucccgcaggcgggacgcaguucucggacg

SEQ ID NO: 170545 - RNA, 64 nt, Homo Sapiens
uaaauguauuggugauuuggagauuugaccucaucucccgcaaacaguuuuaaaguucauggua

SEQ ID NO: 170546 - RNA, 64 nt, Homo Sapiens
aagggccaaccccuugcaacagggcagcucucgccucccgcacacggcucuccugaucacagcu

SEQ ID NO: 170547 - RNA, 64 nt, Homo Sapiens
aaccuaccuuccacaagccagccccgcaucccugcucccgcaguguaagugcagagccugccuc

SEQ ID NO: 170548 - RNA, 64 nt, Homo Sapiens
cccgagccgccacucccagucuuccaccaaucgccucccgcagcgccccucccagaccucuguc

SEQ ID NO: 170549 - RNA, 64 nt, Homo Sapiens
aaaacccuuaagagucccggacuugcaaaugagacucccgcacgaagagcacauuccaaaucaa

SEQ ID NO: 170550 - RNA, 64 nt, Homo Sapiens
uccucccuggggcagcugcuccccuccauguuaccucccgcaccccugcuccucagacucacag

SEQ ID NO: 170551 - RNA, 53 nt, Homo Sapiens
acuaugacguggugaacuaaccgcucccgcaccugucgguggcugccuuugau

SEQ ID NO: 170552 - RNA, 64 nt, Homo Sapiens
aacaaaaaagagaaagaaaaugaagagcauuugacucccgcacuuaaaaugaaguacacauaaa

SEQ ID NO: 170553 - RNA, 64 nt, Homo Sapiens
uccagcucuacuaccuacguuugcaccgccugcccucccgcaccuuccuccuccccgcuccguc

SEQ ID NO: 170554 - RNA, 64 nt, Homo Sapiens
ccucccuggcucagcccagugcggccuggcgcuccucccgcaggcucugcccccgggcuccggu

SEQ ID NO: 170555 - RNA, 64 nt, Homo Sapiens
ccuaccccguggcagcagcaugaggccaggccgccucccgcaccuggggcacggucugcggcca

SEQ ID NO: 170556 - RNA, 64 nt, Homo Sapiens
ccuccuguccacaccagcgcccagccuguguccccucccgcaggcacccagcggggcuuccagg

SEQ ID NO: 170557 - RNA, 64 nt, Homo Sapiens
ccugaaucucgagcuaccuaguaagucaaagucacucccgcaaaacacaaaggcuggccugugu

SEQ ID NO: 170558 - RNA, 64 nt, Homo Sapiens
cucgggaaaccucccccgacgcucucucucggaacucccgcacccuccuuucucaccagcccgc

SEQ ID NO: 170559 - RNA, 64 nt, Homo Sapiens
cccaccaccagucacugccucgcagagcccuacacucccgcagccgcuccucagaggccugugc

SEQ ID NO: 170560 - RNA, 64 nt, Homo Sapiens
ccuggaggcagcugucucgcagacucagcuuggucucccgcaggcuucagaaaaacccaauugc

SEQ ID NO: 170561 - RNA, 64 nt, Homo Sapiens
aggacggagaacacaaacucgcacuggccuugcucucccgcacgccuugucaucaucacccacu

SEQ ID NO: 170562 - RNA, 64 nt, Homo Sapiens
gucuggaugccugggcuucacacaagaaccaccucucccgcaguucccaaggacuugucauuuc

SEQ ID NO: 170563 - RNA, 64 nt, Homo Sapiens
ugcuucugaacucaagcugcguuuauuaaugccucucccgcaccaggccgggcuugggcccugc

SEQ ID NO: 170564 - RNA, 64 nt, Homo Sapiens
gcugggauuacaggcaugagccgcccaucuccaccucccgcagugacagaucugaccucgugau

SEQ ID NO: 170565 - RNA, 64 nt, Homo Sapiens
cugccugccuccggcccugcagaucuagccaggccucccgcauguggauggaucugcuccaugc

SEQ ID NO: 170566 - RNA, 52 nt, Homo Sapiens
ccacccugaccgggacugguggcucccgcagcuccucugccuuccagccuga

SEQ ID NO: 170567 - RNA, 64 nt, Homo Sapiens
ccgauguggaccucuacuuuaaaaccuuagcucccucccgcaccccccagagauucccaagcca

SEQ ID NO: 170568 - RNA, 64 nt, Homo Sapiens
cuuugcucugccugucagugggcagcagaggcaacucccgcaucugccuacguccccuuagaug

SEQ ID NO: 170569 - RNA, 64 nt, Homo Sapiens
ggcccgaggcagaagggcccaccccgucccuccucucccgcaggucugaaguuggccccccagc

SEQ ID NO: 170570 - RNA, 64 nt, Homo Sapiens
ggaucuguccagcucauacuuuccuucgcugucccucccgcacuccuuaggcaagauuucccag

SEQ ID NO: 170571 - RNA, 64 nt, Homo Sapiens
caaguagguucauccuuguugucaguuggccaaccucccgcagccauaguguagaacagucccg

SEQ ID NO: 170572 - RNA, 64 nt, Homo Sapiens
ggaucccaacaggcagcaccgcaccucugcccgccucccgcacugcagcuccgcccgccgggcu

SEQ ID NO: 170573 - RNA, 64 nt, Homo Sapiens
ccaggugagcaggggagcaagggcgcacccaugccucccgcagucuccucagcauggccucagu

SEQ ID NO: 170574 - RNA, 64 nt, Homo Sapiens
acucucacacugucuccugcaugacggguggcgccucccgcagcuucccuucucucuccagugc

SEQ ID NO: 170575 - RNA, 64 nt, Homo Sapiens
ccccucugaccccggccugggcuucagccgcuuccucccgcaagcagcccggguccgcacugcg

SEQ ID NO: 170576 - RNA, 64 nt, Homo Sapiens
cuuauuccuccuccccucuuucccucauuucagucucccgcacacuggcgacacaacugcaccu

SEQ ID NO: 170577 - RNA, 64 nt, Homo Sapiens
ugagaacccuguggagaugaacuccuccauuuuccucccgcagggacaguuucugacaggcgca

SEQ ID NO: 170578 - RNA, 64 nt, Homo Sapiens
ugaccccucccucagcuguccugugccccgcccucucccgcacacucagucccccugccuggcg

SEQ ID NO: 170579 - RNA, 64 nt, Homo Sapiens
ggguggaaacuaagacaccugaacccuccagggccucccgcaucaaggucagcaugaggacaga

SEQ ID NO: 170580 - RNA, 64 nt, Homo Sapiens
agcucaaagcugaucuugccggcgugaugcacggcucccgcaucggucguaggugaugccacug

SEQ ID NO: 170581 - RNA, 64 nt, Homo Sapiens
gggacaagguuccucccucugaagagaccagcgacucccgcaaacuuccuucuuccccacaaca

SEQ ID NO: 170582 - RNA, 64 nt, Homo Sapiens
cgaacgguggguggggggcucacccuggugcugccucccgcacaaggagaccuggacacaacag

SEQ ID NO: 170583 - RNA, 64 nt, Homo Sapiens
acaaauguguacuuuauugauuuucuuucuaauucucccgcauugguggcuugggacuugggag

SEQ ID NO: 170584 - RNA, 64 nt, Homo Sapiens
cccugacuuuagggaaggugaauguguucccguccucccgcagucagaaaggagacucugccuc

SEQ ID NO: 170585 - RNA, 64 nt, Homo Sapiens
gccuucaugcacuagccacuuccgcaggugcugacucccgcacucccuggcauuuuuugcagac

SEQ ID NO: 170586 - RNA, 64 nt, Homo Sapiens
ccgcccagguccccgcuuucuuuggaggcagcagcucccgcagggcugaagucuggcguaagau

SEQ ID NO: 170587 - RNA, 64 nt, Homo Sapiens
uggccuccuugaugggcaggcuuggaagggacuucucccgcaccccacucugucccaggacaua

SEQ ID NO: 170588 - RNA, 64 nt, Homo Sapiens
guauuccguuuucuuccugcaugaucccugggcccucccgcaggcugagcaagucuguaaacug

SEQ ID NO: 170589 - RNA, 64 nt, Homo Sapiens
gcucagcugcugaauuuuucgcuugagcccaggccucccgcacgacgggccaaggagacuccgg

SEQ ID NO: 170590 - RNA, 64 nt, Homo Sapiens
ccugaguuccuaaggaaaccagcuggaaccauuucucccgcaggacccccacccagccuccaga

SEQ ID NO: 170591 - RNA, 64 nt, Homo Sapiens
cacucccaccccagggaggcggaacaucauuccucucccgcaacugggccccagaagagccaca

SEQ ID NO: 170592 - RNA, 64 nt, Homo Sapiens
uccauggaugcacugcugccgagcuccugcucuucucccgcaccguuggucugcgggggccuug

SEQ ID NO: 170593 - RNA, 64 nt, Homo Sapiens
ggggggugcagaucaggcgcucugcaaugcaucacucccgcagagcacgguacccggccgccgu

SEQ ID NO: 170594 - RNA, 64 nt, Homo Sapiens
ugguuguguagcuucuguugucauugaauacggccucccgcagcaucccacccccaaaccaccg

SEQ ID NO: 170595 - RNA, 64 nt, Homo Sapiens
uacaggagucuggaguccguugaaggguaaaggccucccgcaagcugccagucggcucuuuuuc

SEQ ID NO: 170596 - RNA, 64 nt, Homo Sapiens
gucacugaacagaacgucgcugauggagaaagggcucccgcagaaggaacggccuguaccgugc

SEQ ID NO: 170597 - RNA, 64 nt, Homo Sapiens
aggcgguuucggggcucccccuuccucucccucccucccgcagaaggggguuuuaggggccugg

SEQ ID NO: 170598 - RNA, 64 nt, Homo Sapiens
ccuuuacuccgcacuccccaagagcggacaucuccucccgcagggaggggcuuccgagccccug

SEQ ID NO: 170599 - RNA, 64 nt, Homo Sapiens
gccaccaaggagcuggaccucaacacgccugucccucccgcauguccggcaccccccaaucccc

SEQ ID NO: 170600 - RNA, 64 nt, Homo Sapiens
ccucccaugccguuccacucccccccugccgugccucccgcagccuccugccacuugccccuga

SEQ ID NO: 170601 - RNA, 64 nt, Homo Sapiens
gcccugggccccagcaccuccaggaucccauccccucccgcacacacacgggccaagguaccca

SEQ ID NO: 170602 - RNA, 64 nt, Homo Sapiens
gggcgcgggacaggacuugucccagcagucuccgcucccgcagcggacggggcccgccccaggc

SEQ ID NO: 170603 - RNA, 64 nt, Homo Sapiens
gucggccacgcccgcugcgggguggauccggggccucccgcacauggggccuggccucgcccac

SEQ ID NO: 170604 - RNA, 64 nt, Homo Sapiens
caggccggggaucuggggagggcuagcccaaaaccucccgcaucgggcaggcacccccugaagu

SEQ ID NO: 170605 - RNA, 64 nt, Homo Sapiens
guuuguuagagugcacaucccuuauggcaaagagcucccgcaguuggccaaggaccagugccac

SEQ ID NO: 170606 - RNA, 64 nt, Homo Sapiens
ccccgcgaccgauccgaccgcccugcagcgcuuccucccgcagcgccgccggcgccgcccgggu

SEQ ID NO: 170607 - RNA, 64 nt, Homo Sapiens
cgagauuaacggugcuaaccccgucugcuccucccucccgcagagacuggggccuggacuggac

SEQ ID NO: 170608 - RNA, 64 nt, Homo Sapiens
aagacuccugagaacaggcagcccaguccugcgacucccgcauccccaggaccagacaccuggg

SEQ ID NO: 170609 - RNA, 64 nt, Homo Sapiens
cuugccucaguucuucccucugagcccccaggcccucccgcaucucagguuggggauggggaca

SEQ ID NO: 170610 - RNA, 64 nt, Homo Sapiens
cuggugcgcacagcccuugucggugccccggccccucccgcagcguuacugccuguguauagua

SEQ ID NO: 170611 - RNA, 64 nt, Homo Sapiens
ggccugcagcagaagugugcccagcguuucucggcucccgcaccccuuuucccuuauggcucug

SEQ ID NO: 170612 - RNA, 64 nt, Homo Sapiens
aggaccagccgcgugcacuggauugcggaggagccucccgcagcacugguccgggacaagauga

SEQ ID NO: 170613 - RNA, 64 nt, Homo Sapiens
acuccucugaggcagggccugggccgguccuggacucccgcagggcuggccauccguggaggag

SEQ ID NO: 170614 - RNA, 64 nt, Homo Sapiens
accaacuacccuuaggucuacagcucucaugagucucccgcacucagccuuuagcaauucauua

SEQ ID NO: 170615 - RNA, 64 nt, Homo Sapiens
uccuagaaauacagaaaauuaaaagaaugcccaccagauugaaauccagauugaccuuauaaau

SEQ ID NO: 170616 - RNA, 64 nt, Homo Sapiens
uuauaaauaaaagaaugcccgguaacacauacuccagauugaccuaacucacucagagacacau

SEQ ID NO: 170617 - RNA, 64 nt, Homo Sapiens
uuaauguuuaauuuaaucuuaauaccaaaacgaccagauugaaguuugacuuuuauugucacaa

SEQ ID NO: 170618 - RNA, 64 nt, Homo Sapiens
uuccuucccgucuuagccucacccccuugucaaccagauugaguugcuauagcuugaugcaggg

SEQ ID NO: 170619 - RNA, 64 nt, Homo Sapiens
gguugccacauguuauguuuggcuuuuugugacccagauugauuggcuuuacaauauacggauu

SEQ ID NO: 170620 - RNA, 64 nt, Homo Sapiens
aaacccuaugaguauuccagccuuuccaaguaaucagauugagaaagccauagcacacaucuua

SEQ ID NO: 170621 - RNA, 64 nt, Homo Sapiens
agagaccgaaugugcagauuaacaucucuaaacucagauugaaaguguguuacacaccugacuu

SEQ ID NO: 170622 - RNA, 64 nt, Homo Sapiens
uugaaaucguauauaugagcuguauuaaaauuuuugacuuaauucaauaacacucaaugaagga

SEQ ID NO: 170623 - RNA, 64 nt, Homo Sapiens
uuaauucaaggauugaaaaauaauacacauuuguugacuuaaauccuagcauagagaaaauacu

SEQ ID NO: 170624 - RNA, 64 nt, Homo Sapiens
ggaucaucuugugaauuugugcgugccaagcaguugacuuaauauuguuaacuguagcuucagc

SEQ ID NO: 170625 - RNA, 64 nt, Homo Sapiens
uuggaccaagacuaugaggccacugaagaacaguugacuuaaaaugguggaaauucaaaguuau

SEQ ID NO: 170626 - RNA, 64 nt, Homo Sapiens
aaaaaucuccaagcuugugcuuacacaugaagccugacuuaacuguaugugcaacagcaaugaa

SEQ ID NO: 170627 - RNA, 64 nt, Homo Sapiens
cucuuuucuugaccuaguauaaugacaacugcagugacuuaaguuuuugcuguuuucguuuucc

SEQ ID NO: 170628 - RNA, 64 nt, Homo Sapiens
ccaucuucccacacaucucauugaauuugaugguugacuuaauuggcaccauaacuuuguauga

SEQ ID NO: 170629 - RNA, 64 nt, Homo Sapiens
aaugagguuguuaauuagaguuuuaaaauugcaaugacuuaaauaaucagaagacugcuuaugg

SEQ ID NO: 170630 - RNA, 64 nt, Homo Sapiens
uauugaguuaccuggucagcuucaaugguuaccuugacuuaaccccucccuaauccuauuaucu

SEQ ID NO: 170631 - RNA, 64 nt, Homo Sapiens
ugccagcucaaaucuacaguagccaccaaaaccaugacuuaauauuuugagcccuagaagaaag

SEQ ID NO: 170632 - RNA, 64 nt, Homo Sapiens
gacuuagugcagagaagcuuggcaguacguucuuugacuuaaggauggcauaaaauaaucauuu

SEQ ID NO: 170633 - RNA, 64 nt, Homo Sapiens
uugcaauucuuucuggggauauauugguacaacaugacuuaaaacuuuuuuuuuucuauuaaaa

SEQ ID NO: 170634 - RNA, 64 nt, Homo Sapiens
gaacuauaguaaaaugauaaacacuaaauauacuugacuuaauaugccaaugagguaggccuga

SEQ ID NO: 170635 - RNA, 64 nt, Homo Sapiens
uguuuuuuccuuugcucuuucccccuuccaucucugacuuaagcaaaagaaaaagauuacccaa

SEQ ID NO: 170636 - RNA, 64 nt, Homo Sapiens
uuuguaguuuuuuuuuuuuuuaugugaucaauuuugacuuaaugugauuacugcucuauuccaa

SEQ ID NO: 170637 - RNA, 64 nt, Homo Sapiens
aauagagagagaauuuguuuucauuguuuccuucugacuuaagcguggugaccccucagggguu

SEQ ID NO: 170638 - RNA, 64 nt, Homo Sapiens
cuuucuaaagaugaaaugggaagaaaucauuuagugacuuaauuagcaaauggcaacaacuuag

SEQ ID NO: 170639 - RNA, 64 nt, Homo Sapiens
gcuguuggcugucaucuugaacucuauuugaaugugacuuaaaucacaaguaacguguuuuguu

SEQ ID NO: 170640 - RNA, 64 nt, Homo Sapiens
cauucagcuguuuuaacacagaaauucaaaauagugacuuaacauggaagcuauuucucucuua

SEQ ID NO: 170641 - RNA, 64 nt, Homo Sapiens
gauuuuggucguucuucagauguuuggcucugaaugacuuaagcugaaguaacuggcuccuuac

SEQ ID NO: 170642 - RNA, 64 nt, Homo Sapiens
gagguuugcuuucuaaacaagugcauucugaaauugacuuaaaaauuuuuaguguggguccuaa

SEQ ID NO: 170643 - RNA, 64 nt, Homo Sapiens
agugaauuuuguccuuaacaauauaaguccuguaugacuuaaauuuuagaguucacacaauagg

SEQ ID NO: 170644 - RNA, 64 nt, Homo Sapiens
uuuuccggggaacuacuaaauauaaccaaaaucuugacuuaaaauguuuuuacugccauaguuu

SEQ ID NO: 170645 - RNA, 64 nt, Homo Sapiens
uuagagcaagcacaacauccucuguuucccuaagugacuuaaccagccauuggauaauacugaa

SEQ ID NO: 170646 - RNA, 64 nt, Homo Sapiens
uuugauggagagaaagcuguguccuaucuuacugugacuuaaaggcugugccugugacuccaga

SEQ ID NO: 170647 - RNA, 64 nt, Homo Sapiens
cuucaucacaucuuauagguaguguguggccaauugacuuaaaaaauacaaauaacauuuagga

SEQ ID NO: 170648 - RNA, 64 nt, Homo Sapiens
augcucccauggaauuuauaccaguuauaugaauugacuuaaguaucuugaaaaagaaacuuua

SEQ ID NO: 170649 - RNA, 64 nt, Homo Sapiens
cuguauuuuaaauucuguuuuaaaaaaagucaaaugacuuaauuaauaugugagacuuuucauu

SEQ ID NO: 170650 - RNA, 64 nt, Homo Sapiens
uugauuucaagcauuaaucgaccugaguuugaguugacuuaacaucagagucaaaucagcauug

SEQ ID NO: 170651 - RNA, 64 nt, Homo Sapiens
ccuguugcaggcacacugcagugguuuuccugcagcucuccaacaaacgccugagucacaggcc

SEQ ID NO: 170652 - RNA, 64 nt, Homo Sapiens
cgaggcaugaagcaaagagcugagugaguccucugcucuccagaggaccaagaaauaccugugu

SEQ ID NO: 170653 - RNA, 64 nt, Homo Sapiens
cuggacgacagagcaagacugagauggcgccacugcucuccagcaggcggagguugcaugagcc

SEQ ID NO: 170654 - RNA, 64 nt, Homo Sapiens
agccuggccugucagccuggaaggaaaaaagccugcucuccaguccacuccaggcaaaguagug

SEQ ID NO: 170655 - RNA, 64 nt, Homo Sapiens
acuccuuagccggaggauaccagugggcaucacggcucuccagcgacaagcccgggacaacagc

SEQ ID NO: 170656 - RNA, 64 nt, Homo Sapiens
gggcuucugcccugacugggaggucaggagcccagcucuccaggucaggagguggaggccggug

SEQ ID NO: 170657 - RNA, 64 nt, Homo Sapiens
guuauuuuguuguccuuuaugguucuuuaggaaagcucuccaagcuuggcauuugucagggugg

SEQ ID NO: 170658 - RNA, 64 nt, Homo Sapiens
ugggcugacugguguagguuugguaggccucacugcucuccagaggcuaguguuccuaucccag

SEQ ID NO: 170659 - RNA, 64 nt, Homo Sapiens
aggcccuggucuccuccgagucguaccugcagcggcucuccauggccuccagcggcucccucug

SEQ ID NO: 170660 - RNA, 64 nt, Homo Sapiens
aggaaauccccguggugcgcaacagcaccgugcugcucuccaugacccaugaagaccaaaagcu

SEQ ID NO: 170661 - RNA, 64 nt, Homo Sapiens
ccgagcagcgcuuggugacagccuguccucuccugcucuccaaaggcccugcucccuguccucu

SEQ ID NO: 170662 - RNA, 64 nt, Homo Sapiens
guccucuuuucggcaaaguuggagcgagugccaagcucuccaucugugguccuuucugccaaga

SEQ ID NO: 170663 - RNA, 64 nt, Homo Sapiens
cuaguucagaauccggagcaguaaguggagaagagcucuccacgagugcucagucuuagaacua

SEQ ID NO: 170664 - RNA, 64 nt, Homo Sapiens
accaaauucaacagaacaccaggaaggucaagacgcucuccaaagggcaggaaguacagcacuu

SEQ ID NO: 170665 - RNA, 64 nt, Homo Sapiens
ucacugcugcacuuuccaaggugcuaagauugcugcucuccaaugcuaacuuucugacacagug

SEQ ID NO: 170666 - RNA, 64 nt, Homo Sapiens
uuucaaagauuaaguaggaggagagggguuucuugcucuccagagcccaaagggacaaauaggg

SEQ ID NO: 170667 - RNA, 64 nt, Homo Sapiens
gagcauggagauuuuucuuaaauaauaauauugugcucuccaccucacccuuguguaaacccuc

SEQ ID NO: 170668 - RNA, 64 nt, Homo Sapiens
uaaaauaggguuugaaacaugccacaggaagguugcucuccaaaaauacacagugcagugcaag

SEQ ID NO: 170669 - RNA, 64 nt, Homo Sapiens
gggucaccagccaggcaccugugacacgagugcugcucuccaggaucuccacuacauguuccag

SEQ ID NO: 170670 - RNA, 64 nt, Homo Sapiens
ugagcagaaagaccaaauauuuugcaaucuucuagcucuccaggacugcuaaacaucccagaga

SEQ ID NO: 170671 - RNA, 64 nt, Homo Sapiens
gcugcggcgcugucuuugcacccaggcuggcucagcucuccagugcauuccugucccccucggc

SEQ ID NO: 170672 - RNA, 64 nt, Homo Sapiens; identical to SEQ ID NO: 85985

SEQ ID NO: 170673 - RNA, 64 nt, Homo Sapiens; identical to SEQ ID NO: 85986

SEQ ID NO: 170674 - RNA, 64 nt, Homo Sapiens; identical to SEQ ID NO: 85987

SEQ ID NO: 170675 - RNA, 64 nt, Homo Sapiens; identical to SEQ ID NO: 85988

SEQ ID NO: 170676 - RNA, 64 nt, Homo Sapiens; identical to SEQ ID NO: 85989

SEQ ID NO: 170677 - RNA, 64 nt, Homo Sapiens; identical to SEQ ID NO: 85990

SEQ ID NO: 170678 - RNA, 64 nt, Homo Sapiens
uaccugagacgggcaucgcagcuugugggcuggugccccacagcuccuaggagagccaaccucg

SEQ ID NO: 170679 - RNA, 60 nt, Homo Sapiens
gacucccgggccacgccccagcaccugccugccccacacgcacgccccugccccucguag

SEQ ID NO: 170680 - RNA, 64 nt, Homo Sapiens
gggucauauuggcuuuaguuaagcuaagcgccacgccccacaagcugaaaaaaggagcccaaug

SEQ ID NO: 170681 - RNA, 64 nt, Homo Sapiens
acuuuugcaaucuuuaaacugacucuaccuccuugccccacaccuuuucacaguuucauugauu

SEQ ID NO: 170682 - RNA, 64 nt, Homo Sapiens
ccuaauauauguccggacagugccaugccugugugccccacagagucacugccacauggagucu

SEQ ID NO: 170683 - RNA, 64 nt, Homo Sapiens
gucacagugugucuggacaguaucagaucugagugccccacagaagccacugucaugcagguca

SEQ ID NO: 170684 - RNA, 64 nt, Homo Sapiens
ugggggaagguuucagccucuccccacuccccuugccccacacccuuuacuccccagcccagag

SEQ ID NO: 170685 - RNA, 64 nt, Homo Sapiens
uauccgaggccuuucccugcccagucuggugccugccccacauuguaccggacacuggauuccu

SEQ ID NO: 170686 - RNA, 64 nt, Homo Sapiens
agaggugcucugacccuagguuacacgggaaagugccccacaugcaagucucccugaggguucu

SEQ ID NO: 170687 - RNA, 64 nt, Homo Sapiens
cagguuucuacagugaggaacaggcguuucccaggccccacacccagauuucucuaucuuugcu

SEQ ID NO: 170688 - RNA, 64 nt, Homo Sapiens
uguugggagcagaggaguccuacuccuugccucagccccacacgguuccuuagcugccgugugg

SEQ ID NO: 170689 - RNA, 64 nt, Homo Sapiens
uuggcuacccuggccgugccuggcagccccucaggccccacagguggguccugguugugaagug

SEQ ID NO: 170690 - RNA, 64 nt, Homo Sapiens
gcuuguagguggguggugugcauaggccacgugugccccacauaugcagggggugccccacaca

SEQ ID NO: 170691 - RNA, 64 nt, Homo Sapiens
cauaggccacgugugccccacauaugcagggggugccccacacagcuagagcggccaggagagc

SEQ ID NO: 170692 - RNA, 64 nt, Homo Sapiens
cuggcacgaaggccccgccuggcuuaaagcagaagccccacagcgucuguggccccacaacgug

SEQ ID NO: 170693 - RNA, 64 nt, Homo Sapiens
gugggcuuaaagcagaagccacugcaagucuguggccccacaacggugauguaaaaaugcuucc

SEQ ID NO: 170694 - RNA, 64 nt, Homo Sapiens
gaccaggccuuaaaugucggaaccccugccccuugccccacacaaaccucaugaggcuguggcc

SEQ ID NO: 170695 - RNA, 64 nt, Homo Sapiens
uuuuauuuuugcacauaagccccacacccugccagccccacagaccacucugacaagucuucag

SEQ ID NO: 170696 - RNA, 64 nt, Homo Sapiens
agaacccgcccaagcgccaccugcuagacggccagccccacacuucgcuucagccuccggacca

SEQ ID NO: 170697 - RNA, 64 nt, Homo Sapiens
aacacacauggccucgccaucguggguaaaaucggccccacagcacgucugcaccagcgggccg

SEQ ID NO: 170698 - RNA, 64 nt, Homo Sapiens
ggccagggcacauucuuggaugagccaggccugagccccacacaggugucuucacaccugacga

SEQ ID NO: 170699 - RNA, 64 nt, Homo Sapiens
ucgugcacacacugcuuccccuaaucuauagacggccccacagcauuguuugcuugcuugaaac

SEQ ID NO: 170700 - RNA, 64 nt, Homo Sapiens
gacuggccaugcaaccaggugucacugggaacgugccccacagugccgucuaggagaaccugug

SEQ ID NO: 170701 - RNA, 64 nt, Homo Sapiens
augugguuugcugaccuauuauggggaagcaguugccccacaaauggagccgagucaggccacu

SEQ ID NO: 170702 - RNA, 64 nt, Homo Sapiens
ggcaaugaugccacaccuugucgggcacccucuggccccacacuggcuggccgcgcaccggggc

SEQ ID NO: 170703 - RNA, 64 nt, Homo Sapiens
ccugagagaugguguugcuagcagaaagcccccagccccacagcaaaucagcuuuaaggagcug

SEQ ID NO: 170704 - RNA, 64 nt, Homo Sapiens
uuaggacccccagagccaagguggcugggaucuggccccacagauggggaaagauggggaaggg

SEQ ID NO: 170705 - RNA, 64 nt, Homo Sapiens
gcgacuccauaugcaaucaguagcgagcagccgggccccacagacccucaugcacucucuuacg

SEQ ID NO: 170706 - RNA, 64 nt, Homo Sapiens
cuccccaggaggcucgugucacaggagggagggggccccacaggacaccccagacgagagccuc

SEQ ID NO: 170707 - RNA, 64 nt, Homo Sapiens
cucacaggagcaguuuguggggagaaaugggcuggccccacagcggagucucaccuguuugcau

SEQ ID NO: 170708 - RNA, 64 nt, Homo Sapiens
gaccaucaccuggcucaucguuuccaccaagagugccccacaggagugccccacagacccgcug

SEQ ID NO: 170709 - RNA, 64 nt, Homo Sapiens
cucaucguuuccaccaagagugccccacaggagugccccacagacccgcuggaccagccugcug

SEQ ID NO: 170710 - RNA, 64 nt, Homo Sapiens
agccacagcgcgggccuuguuccguucccucugggccccacacuugguccucaucucucccacc

SEQ ID NO: 170711 - RNA, 64 nt, Homo Sapiens
acccaccagucuuucugggaacaguaugcacucagccccacagaccucagggaccacccucccc

SEQ ID NO: 170712 - RNA, 64 nt, Homo Sapiens
cgcagacccuccuucccaucugcugccuggccaagccccacacccagcuugaggccccuccuuc

SEQ ID NO: 170713 - RNA, 64 nt, Homo Sapiens
cagcuugaggccccuccuucagcagccugcagaggccccacagauccaggcuuugcuguucccc

SEQ ID NO: 170714 - RNA, 64 nt, Homo Sapiens
ugaguguaagcaaugugggaaagccuucagaugugccccacaccuucgaaggcaugguaggacu

SEQ ID NO: 170715 - RNA, 64 nt, Homo Sapiens
cgaguguaagcaaugugggaaagccuucagaucugccccacaccuucgaauccaugguagaacu

SEQ ID NO: 170716 - RNA, 50 nt, Homo Sapiens
ccucccagggccuggucugagccccacacggccaucugcccaguccuuga

SEQ ID NO: 170717 - RNA, 64 nt, Homo Sapiens
gggggcagcagcccuucccgggggccuacccagugccccacagcagaacccgugggcgcucgug

SEQ ID NO: 170718 - RNA, 64 nt, Homo Sapiens
ggcacuagaaaaggcccccacuggcugccugggagccccacaccaccgggccagugcaggcacu

SEQ ID NO: 170719 - RNA, 64 nt, Homo Sapiens
cucauccacaggguuuucucacugcuaugaaccagccccacagccccaggccccugucaccugg

SEQ ID NO: 170720 - RNA, 64 nt, Homo Sapiens
augccccauccaccgcaugcggugcccguggcccgccccacaccaccgccgccugcagaccucu

SEQ ID NO: 170721 - RNA, 64 nt, Homo Sapiens
ccuguacuaccuccugggccaagaaacuggcacagccccacacugucagugccaagaggcugcg

SEQ ID NO: 170722 - RNA, 64 nt, Homo Sapiens; identical to SEQ ID NO: 89720

SEQ ID NO: 170723 - RNA, 64 nt, Homo Sapiens; identical to SEQ ID NO: 89721

SEQ ID NO: 170724 - RNA, 64 nt, Homo Sapiens; identical to SEQ ID NO: 89722

SEQ ID NO: 170725 - RNA, 64 nt, Homo Sapiens; identical to SEQ ID NO: 89723

SEQ ID NO: 170726 - RNA, 64 nt, Homo Sapiens; identical to SEQ ID NO: 89724

SEQ ID NO: 170727 - RNA, 64 nt, Homo Sapiens; identical to SEQ ID NO: 89725

SEQ ID NO: 170728 - RNA, 64 nt, Homo Sapiens; identical to SEQ ID NO: 89726

SEQ ID NO: 170729 - RNA, 64 nt, Homo Sapiens; identical to SEQ ID NO: 89727

SEQ ID NO: 170730 - RNA, 64 nt, Homo Sapiens; identical to SEQ ID NO: 89728

SEQ ID NO: 170731 - RNA, 64 nt, Homo Sapiens; identical to SEQ ID NO: 89729

SEQ ID NO: 170732 - RNA, 64 nt, Homo Sapiens; identical to SEQ ID NO: 89730

SEQ ID NO: 170733 - RNA, 64 nt, Homo Sapiens; identical to SEQ ID NO: 89731

SEQ ID NO: 170734 - RNA, 64 nt, Homo Sapiens
gccauucugaaacccuacagaagucuugcuuucccaaacagaaauacuguagccuuuuaacagc

SEQ ID NO: 170735 - RNA, 64 nt, Homo Sapiens
cuuuucugagacuauuuaucuuaggcgggaacugcaaacagacuuuguuuguuuguuuguuuuc

SEQ ID NO: 170736 - RNA, 64 nt, Homo Sapiens
aagcaccacuguuacagaauuugcucauggaacucaaacagauguuacuucuacggaauaguuu

SEQ ID NO: 170737 - RNA, 64 nt, Homo Sapiens
aucuuguaacugaagacacaaaauguauauaauucaaacagagccaucuguacauaguuuucua

SEQ ID NO: 170738 - RNA, 64 nt, Homo Sapiens
cauguuaggacauuucugaacacaauuauuaaaacaaacagaucgaugauaagccuaaaaaaag

SEQ ID NO: 170739 - RNA, 64 nt, Homo Sapiens
gaagaacaaucaucuauuuugaacacagagccaacaaacagaauaaggaaucugaagcacagga

SEQ ID NO: 170740 - RNA, 64 nt, Homo Sapiens
agcucgaggcucccaccccguugguuucauguuacaaacagaaaucuucuuacugucccacagc

SEQ ID NO: 170741 - RNA, 64 nt, Homo Sapiens
gauaaacuggcuugccugugaacaacaacaacaacaaacagaagauuaaaacaacaacaacaac

SEQ ID NO: 170742 - RNA, 64 nt, Homo Sapiens
augcaggggcaggguguggucugaaacuuugugucaaacagacauggggcuuuuuuucaggguc

SEQ ID NO: 170743 - RNA, 64 nt, Homo Sapiens
aaaggaaaaauauagaaagcuacuuagcccaguucaaacagaaccagcagggucuaacugugcu

SEQ ID NO: 170744 - RNA, 64 nt, Homo Sapiens
cugcccugugccgccugguuuguggggcgcuugacaaacagaauuugacaaucugggcaaggcu

SEQ ID NO: 170745 - RNA, 64 nt, Homo Sapiens
aagagaggcuguucauugaucaguggaauuucuucaaacagagaaaucuggaauuaacuuuagc

SEQ ID NO: 170746 - RNA, 64 nt, Homo Sapiens
ucauaacacuuggcacuugucaaucaccaacuugcaaacagaauugcucugauuaacuaguauu

SEQ ID NO: 170747 - RNA, 64 nt, Homo Sapiens
uccuggaugaugguccauaaacuggauauuucuucaaacagauguaaccuuugaaaauauuaua

SEQ ID NO: 170748 - RNA, 64 nt, Homo Sapiens
aucuguauuuaaauguauagcaaacuggaauuuucaaacagauugcagauguuuuuucuuuuaa

SEQ ID NO: 170749 - RNA, 64 nt, Homo Sapiens
gaccagugacaauggauagaaugggcuguguuuccaaacagauugacuugucaaagacucucuu

SEQ ID NO: 170750 - RNA, 64 nt, Homo Sapiens
gaauagcuguagcaaaugacugaauacaugugaacaaacagaaggaaguucacucuggaguguc

SEQ ID NO: 170751 - RNA, 64 nt, Homo Sapiens
acauguauuucuuaaaagacuagauucuauggaucaaacagagguugaugcaaaaacaccacug

SEQ ID NO: 170752 - RNA, 64 nt, Homo Sapiens
augaaacuuuuucuaagcacuauucuauugcacacaaacagaaaaccaaagccuuauuagaccu

SEQ ID NO: 170753 - RNA, 64 nt, Homo Sapiens
cggacagacagacacagccugaaacagacccagacaaacagacagacagacacagccugaaaca

SEQ ID NO: 170754 - RNA, 64 nt, Homo Sapiens
uagacagacagacacagauugaaacagacccagacaaacagacagacacagccugaaacagacc

SEQ ID NO: 170755 - RNA, 64 nt, Homo Sapiens
gagucuccacagcuccccguuauggaaaugggaccaaacagaggaugcagcaggugcucagcaa

SEQ ID NO: 170756 - RNA, 64 nt, Homo Sapiens
ggauauaaguuagggacugacacacuagguauuucaaacagaggucaagucaggaaauagaaac

SEQ ID NO: 170757 - RNA, 64 nt, Homo Sapiens
cuuucacauaaaaucacaaaacuacaggacaguacaaacagauugccagagaaaucugggucaa

SEQ ID NO: 170758 - RNA, 64 nt, Homo Sapiens
gacauuacaguuaaauuucccaauugaaaacaagcaaacagacacucaaacugguccuguaauu

SEQ ID NO: 170759 - RNA, 61 nt, Homo Sapiens
aaguggauuuuuaaaaaguguuuuagcaauacuccuuaaccaaauaaaccuucggagaacg

SEQ ID NO: 170760 - RNA, 61 nt, Homo Sapiens
accaauuaugaggacugacauccuggccacucuccuuaaaauaaacacugacauuuuucuu

SEQ ID NO: 170761 - RNA, 61 nt, Homo Sapiens
aagaucccuggaaaggaugcgagcuguuucucuccuuaaagaugggcacagagcaucacau

SEQ ID NO: 170762 - RNA, 61 nt, Homo Sapiens
aauuauauuucaccuuuuagcaucaauaucucuccuuaaacuaggccauaucaacuuuggc

SEQ ID NO: 170763 - RNA, 61 nt, Homo Sapiens
gaaucugaaagagcauuauuccuggucaaagcuccuuaaaguucugggcagcuaaaagcau

SEQ ID NO: 170764 - RNA, 61 nt, Homo Sapiens
caagaaaaaaaaaaaaucucuccccaaugcucuccuuaaccuuuaagucuuacaggaagcc

SEQ ID NO: 170765 - RNA, 61 nt, Homo Sapiens
auuauugugaaaauauuauuaacacuggggacuccuuaagaguacaucagaguucucucua

SEQ ID NO: 170766 - RNA, 61 nt, Homo Sapiens
uuucuuagccuccauaaucacaugagccaaucuccuuaauaaaugccugcucauagaucug

SEQ ID NO: 170767 - RNA, 61 nt, Homo Sapiens
gcgccaugggugcuuguuggccggucucaugcuccuuaaugagcugcuuucuucuuacacc

SEQ ID NO: 170768 - RNA, 61 nt, Homo Sapiens
gauuggaucaaguauuacuaucaccccaucccuccuuaagaacuccaaccauucaaaaauu

SEQ ID NO: 170769 - RNA, 61 nt, Homo Sapiens
agguuaagauauagcuagugucugaacgacacuccuuaaaguaaguuccaaauguaaaaca

SEQ ID NO: 170770 - RNA, 61 nt, Homo Sapiens
acuccuuaaaguaaguuccaaauguaaaacacuccuuaaguuccaaauguuuuccgcuaau

SEQ ID NO: 170771 - RNA, 61 nt, Homo Sapiens
gaacuuuugaauuauaaaaaguucuuuaguucuccuuaaaaucuuuauaaaugaauuuugu

SEQ ID NO: 170772 - RNA, 61 nt, Homo Sapiens
uuguuuaucuggagcccacagcacacugaugcuccuuaagauagggcugccauggucacaa

SEQ ID NO: 170773 - RNA, 61 nt, Homo Sapiens
aggaccugugacaugcccaggggaccugugacuccuuaauaauaugucacacuccuuaaua

SEQ ID NO: 170774 - RNA, 61 nt, Homo Sapiens
gggaccugugacuccuuaauaauaugucacacuccuuaauaucuaccaagacacucaaugg

SEQ ID NO: 170775 - RNA, 64 nt, Homo Sapiens
gcaaacuuacauaccauaaauaauaaaaucucguguauuccacaucugagaauucuaggaagaa

SEQ ID NO: 170776 - RNA, 64 nt, Homo Sapiens
gaaaauauuaaggucuccccuuuuucccaccaagguauuccaaauaaaaugauauucuuaaaau

SEQ ID NO: 170777 - RNA, 64 nt, Homo Sapiens
cuucuuauguucuuucccuuccuucuugucuucuguauuccacucagaucuuuauuuuauccca

SEQ ID NO: 170778 - RNA, 64 nt, Homo Sapiens
aaaguaguugggaaaauuauuucuuucuuuugagguauuccauaucuauaauguaaaagaaauu

SEQ ID NO: 170779 - RNA, 64 nt, Homo Sapiens
ugcucauguggagacuggcuauaaacugaaaaguguauuccaaauugcagaacacaucacacau

SEQ ID NO: 170780 - RNA, 64 nt, Homo Sapiens
augugaguuggcaaguuccucacauagagucauuguauuccaccuguccuucaauuuaguuuuu

SEQ ID NO: 170781 - RNA, 64 nt, Homo Sapiens
uauauauuccauauguauauuauauuccacauauguauuccauauuccauauaccauauaugua

SEQ ID NO: 170782 - RNA, 64 nt, Homo Sapiens
uauguauauauuccauauacauguaugcauauauguauuccauacauauguauacauuccaugu

SEQ ID NO: 170783 - RNA, 64 nt, Homo Sapiens
uguauauauuccacauauguuauuccacguguauguauuccacaauauauuccacauguguaua

SEQ ID NO: 170784 - RNA, 63 nt, Homo Sapiens
acggccccugccguggggcucacucugcagcuggagagacagcauaccugaaaccugcaagga

SEQ ID NO: 170785 - RNA, 63 nt, Homo Sapiens
aaaacaacagaacagccaggaaaauggugcuaggagagacaguggagaggccagagaagcaaa

SEQ ID NO: 170786 - RNA, 63 nt, Homo Sapiens
gaaauuucuaccaagcguuuucauggaugcuaugagagacaauccugaagcugcuguacauau

SEQ ID NO: 170787 - RNA, 63 nt, Homo Sapiens
ggcgaccuuggcuaucagacuugaaauauucacgagagacaauaaacgcugaaaggccagugc

SEQ ID NO: 170788 - RNA, 63 nt, Homo Sapiens
auacuuauuaaguucgaacauguuucacuuaaggagagacaccuagcuuagucauggcaaguu

SEQ ID NO: 170789 - RNA, 63 nt, Homo Sapiens
ggaauauaaauauuugguaauucuguguaacaagagagacauggaaaaggaaaaaaauccacu

SEQ ID NO: 170790 - RNA, 63 nt, Homo Sapiens
agccaacgaaggaggucauucgugauagauguugagagacagaguugagagacacagcugcua

SEQ ID NO: 170791 - RNA, 63 nt, Homo Sapiens
gcugcuacgugauagauguugggugccuggguugagagacacacucacugccuccagagaggu

SEQ ID NO: 170792 - RNA, 63 nt, Homo Sapiens
ucucagucagcacuuccuguggugcaugucacagagagacaguaagguuuauggauuugacag

SEQ ID NO: 170793 - RNA, 63 nt, Homo Sapiens
ggcuccccucgagggagacuccaagcuguccgugagagacacguuccaagaaugugaaucuug

SEQ ID NO: 170794 - RNA, 63 nt, Homo Sapiens
ccuugcugcaggccggguggccaauccaggugggagagacacucccagggacaagggaaggaa

SEQ ID NO: 170795 - RNA, 63 nt, Homo Sapiens
uuaccugccacuuccaggagcccagagggccaagagagacauugccuccaccucuccuuggaa

SEQ ID NO: 170796 - RNA, 63 nt, Homo Sapiens
ucucaaauaggcuugguggccuguggaaaagaagagagacagagagacagugucugaaacagg

SEQ ID NO: 170797 - RNA, 63 nt, Homo Sapiens
aggcuugguggccuguggaaaagaagagagacagagagacagugucugaaacaggauggcaga

SEQ ID NO: 170798 - RNA, 63 nt, Homo Sapiens
uguguguguguguguguguaugagagagagagagagagacaacagagacagagagaggcagag

SEQ ID NO: 170799 - RNA, 63 nt, Homo Sapiens
gacaacagagacagagagaggcagagaggcauagagagacagagagagagacaagaaacagag

SEQ ID NO: 170800 - RNA, 63 nt, Homo Sapiens
agagagaggcagagaggcauagagagacagagagagagacaagaaacagagauagacagaaaa

SEQ ID NO: 170801 - RNA, 63 nt, Homo Sapiens
cuccggagugagaagcuuugcccuccuaagagagagagacagagagacagagagagagaaaga

SEQ ID NO: 170802 - RNA, 63 nt, Homo Sapiens
ugagaagcuuugcccuccuaagagagagagacagagagacagagagagagaaagagagagugu

SEQ ID NO: 170803 - RNA, 63 nt, Homo Sapiens
gagggagagagggacagagaagggagagaggcagagagacagaagagagggagagaggcagag

SEQ ID NO: 170804 - RNA, 63 nt, Homo Sapiens
ggggaagagaggcagagaggagacagagggagagagagacagaggagacagagagggagagag

SEQ ID NO: 170805 - RNA, 63 nt, Homo Sapiens
gggagagagagacagaggggacagagagggagagagagacagagagggagagaaacagaggag

SEQ ID NO: 170806 - RNA, 63 nt, Homo Sapiens
ggaggcagagagggagagaaagauaugaggagagagagacagagagguggggagaggggagag

SEQ ID NO: 170807 - RNA, 63 nt, Homo Sapiens
cuuguuccagugacaguuggaaggccucugcuggagagacaccagcucucagggcagagauug

SEQ ID NO: 170808 - RNA, 63 nt, Homo Sapiens
auauguccucaggccagauacugauugcuaguagagagacacccggcacccaguccgaagccc

SEQ ID NO: 170809 - RNA, 64 nt, Homo Sapiens
uacacaaugccuuguacaugauauagaggcaucaagcaaguaaaauuugacagaaauuuuaaaa

SEQ ID NO: 170810 - RNA, 64 nt, Homo Sapiens
uuuaaauggucacccauguauuuauuuguugccaagcaaguaaaaaaauacccuaacaaaccug

SEQ ID NO: 170811 - RNA, 64 nt, Homo Sapiens
uauaguagugacuauauuuauuauguaacauaaaagcaaguacauuaaguuauauauuaaaagc

SEQ ID NO: 170812 - RNA, 64 nt, Homo Sapiens
auuauuucugauuuuauaauuuccguuuauuacaagcaaguacuaaucuuaugaauguuaaccu

SEQ ID NO: 170813 - RNA, 64 nt, Homo Sapiens
ggguacaaaaagcaauguguacaagaagacuuucagcaaguauacagagaguucaccucuacuc

SEQ ID NO: 170814 - RNA, 64 nt, Homo Sapiens
caccucuacucugcccuccucauagucauaauguagcaaguaaagaaugagaauggauucugua

SEQ ID NO: 170815 - RNA, 64 nt, Homo Sapiens
aagaaguuauguauucauccaauaauucaagccaagcaaguauauagguguuuuaauaguuuuu

SEQ ID NO: 170816 - RNA, 64 nt, Homo Sapiens
gaauuuaggguugggguacaauuuguuucuauuaagcaaguaccaguuuaccaauacaugagua

SEQ ID NO: 170817 - RNA, 64 nt, Homo Sapiens
ucuaagcuuugucuuguauccugaguaacuuuugagcaaguaauuugaacaauuuuguuccauu

SEQ ID NO: 170818 - RNA, 64 nt, Homo Sapiens
acagccugugcuaauugggaaauguccauugaaaagcaaguaaugaucuuaauguaaaauagua

SEQ ID NO: 170819 - RNA, 64 nt, Homo Sapiens
aaaagauguaaacauauauuaagcuauauuaaaucucacauacaguucuucugugcucuauuau

SEQ ID NO: 170820 - RNA, 64 nt, Homo Sapiens
ugggcuggcugggaugccucuggcuggugaaguucucacauaggcugauuuaaauccagcaaag

SEQ ID NO: 170821 - RNA, 64 nt, Homo Sapiens
cagaucuuucccuuuccuuauauuccccaacaugcucacauacauagcuuuuucuuucuagaug

SEQ ID NO: 170822 - RNA, 64 nt, Homo Sapiens
auaucauggugauuaugauguuuacauauacauacucacauauuuuauguucaauggguauuuu

SEQ ID NO: 170823 - RNA, 64 nt, Homo Sapiens
ucucugugcuggccugaaaccagugacucaucuucucacauagguguugucaagugauauuuga

SEQ ID NO: 170824 - RNA, 64 nt, Homo Sapiens
uagcuuuuaaaaacugaaaaaaaaaaaugaaugacucacauagagguugagccaaugacugugg

SEQ ID NO: 170825 - RNA, 64 nt, Homo Sapiens
ugauaauauuaaguuccaaaaaaauauaugaaaucucacauagauugucucuaguaaaaauaca

SEQ ID NO: 170826 - RNA, 64 nt, Homo Sapiens
gguaggcccuagguaaaucaggugggguggccagcucacauaggcauuugcauaauaagauuag

SEQ ID NO: 170827 - RNA, 64 nt, Homo Sapiens
auguaauuucccuaaaugaauguuucucacauaucucacauauaaaagaaaaaaaauuauuaaa

SEQ ID NO: 170828 - RNA, 64 nt, Homo Sapiens
ucacauauaauguaauuuccauuauuaaauguuucucacauaucuuucuuaaaaaagaaaaaaa

SEQ ID NO: 170829 - RNA, 64 nt, Homo Sapiens
ugauccuuuguaaauaacuuuguuuuuaaaauguguuuaauaaagaacaacuaucuuuguauuu

SEQ ID NO: 170830 - RNA, 64 nt, Homo Sapiens
auuaaauccaggcauuucgaacuauggcagugauguuuaauauuaucguuuacacagagagaug

SEQ ID NO: 170831 - RNA, 64 nt, Homo Sapiens
auaaauaaguuuaaauaucaauuuggggaguaagguuuaauauugccaucggguauugagacag

SEQ ID NO: 170832 - RNA, 64 nt, Homo Sapiens
uuuugauaugcaucaaguggcauuuuguuccuguguuuaauagugaucuguauacagcugugca

SEQ ID NO: 170833 - RNA, 64 nt, Homo Sapiens
agaugcauacaaagaauuauauauaaagaaggguguuuaauaaugauaguuauaauaauaaaua

SEQ ID NO: 170834 - RNA, 64 nt, Homo Sapiens
uggguuugcaacagcuuucugagaaaagcuagguguuuaauaguuuaacugaaaguuuaacuau

SEQ ID NO: 170835 - RNA, 64 nt, Homo Sapiens
uaaacuguacauacugugcaccagcuagauugcaguuuaauaauucugaauauacuaaaaaaau

SEQ ID NO: 170836 - RNA, 64 nt, Homo Sapiens
aucugagggauuugguggcuuaacuaauguggggguuuaauaguagucgauuuggcuaaacuac

SEQ ID NO: 170837 - RNA, 64 nt, Homo Sapiens
auagcaauuagcagaagugaaccuaaaauuucaaguuuaauaaaugguuucccuuugcuuccca

SEQ ID NO: 170838 - RNA, 64 nt, Homo Sapiens
cagaggggguuggguuugggacaaugccacuauaguuuaauacuggcagaggggagcuugaggg

SEQ ID NO: 170839 - RNA, 64 nt, Homo Sapiens
uuaguuuucauauacauaaucuuuguguacagagguuuaauaaaugcuauacagguauguucau

SEQ ID NO: 170840 - RNA, 64 nt, Homo Sapiens
ucacuuuuuaaaagaaaaaauauccuguauauaaguuuaauauaccuuucuacauuuugcuaau

SEQ ID NO: 170841 - RNA, 64 nt, Homo Sapiens
uuguggguuugguagugaucugugguucuauaggguuuaauaggaauugcuuuugauuuguuuc

SEQ ID NO: 170842 - RNA, 64 nt, Homo Sapiens
guugcuugagacuuaagaggucauguugcuuuagguuuaauaaauagccuuaacuauuuggagg

SEQ ID NO: 170843 - RNA, 64 nt, Homo Sapiens
agacugcaaacuggauuaguucuuuuacuucaguguuuaauaagcagauguauguaugcauggu

SEQ ID NO: 170844 - RNA, 64 nt, Homo Sapiens
ugcuuuaucaaaaaccagauauugcuuuuacaugguuuaauagaauauaaaccucuugauaaaa

SEQ ID NO: 170845 - RNA, 64 nt, Homo Sapiens
guuuaaagcaauaacuuucauaguuucuuucaaaguuuaauacauccaauaugucaaguuaaac

SEQ ID NO: 170846 - RNA, 64 nt, Homo Sapiens
auaugucaaguuaaaccauucugggauuugcaaaguuuaauacauccaauaugucaaguuaaac

SEQ ID NO: 170847 - RNA, 64 nt, Homo Sapiens; identical to SEQ ID NO: 170846

SEQ ID NO: 170848 - RNA, 64 nt, Homo Sapiens
cuacuauuacaguguaaauauauaacuuaugacaguuuaauaaguuaucagcaauuuagcacuu

SEQ ID NO: 170849 - RNA, 64 nt, Homo Sapiens
uucagagauguaucucucuguucuguacauuauuguuuaauauaagaaaccuacuagcauucaa

SEQ ID NO: 170850 - RNA, 64 nt, Homo Sapiens
auucacuuuucuccaaagacaaguguucuugacaguuuaauauggagcagucaucauuggggug

SEQ ID NO: 170851 - RNA, 64 nt, Homo Sapiens
aaaugggccaaacucgcaggucuuaggaauggaaguuuaauaacuuuugugucucaggugucag

SEQ ID NO: 170852 - RNA, 64 nt, Homo Sapiens
caggaagaaaaaaaguacucugaacugcuccaaguaacgcuaauuaaaaacuugcuuuaaagau

SEQ ID NO: 170853 - RNA, 64 nt, Homo Sapiens
ugaugcucuuaguugagucuugaaaaguaaauauuaacgcuacagaaaugcaugaguuucaaua

SEQ ID NO: 170854 - RNA, 64 nt, Homo Sapiens
cagauuuucccaaagaucuuuugaaucuaaugguuaacgcuauugaaaagaaaccauuugagau

SEQ ID NO: 170855 - RNA, 64 nt, Homo Sapiens
gccccaggucacugcgaggcugugcuuuaaaugguaacgcuacgaauuucugcauuuaaugguc

SEQ ID NO: 170856 - RNA, 64 nt, Homo Sapiens
uauugacuauccuuaguugauuacuuaaaaucuguaacgcuagaucuguuucuucauaaaaauu

SEQ ID NO: 170857 - RNA, 64 nt, Homo Sapiens
agcaauguccaucuguaauucuaauacccagaaauaacgcuauuuagcuuuauaauuuucgaau

SEQ ID NO: 170858 - RNA, 64 nt, Homo Sapiens
cuaugcuaagccuuuuaauguaaacaagcaccucuaacgcuaaaagcacccuugcaagaaaggu

SEQ ID NO: 170859 - RNA, 50 nt, Homo Sapiens
uuagcgcgcucgaggaagaauaacgcuaugcuaggauuuccaauuguuaa

SEQ ID NO: 170860 - RNA, 64 nt, Homo Sapiens
ugacugauaagccauuagcuagacccugacuauguaacgcuaaagauuuuaccaugccuggaaa

SEQ ID NO: 170861 - RNA, 64 nt, Homo Sapiens
gauugcuacaaaucuucugaauuggauuuuuccuuaacgcuagauuaaauauuuuucaucaaac

SEQ ID NO: 170862 - RNA, 64 nt, Homo Sapiens
acacaaaagauuuuuguuauccuuauuagucaaauaacgcuauucuuuugugguucuagacccu

SEQ ID NO: 170863 - RNA, 64 nt, Homo Sapiens
augaucauaauugcagauuggaagcacuaaucaguaacgcuacaagugugauuccaauuauuac

SEQ ID NO: 170864 - RNA, 64 nt, Homo Sapiens
ggcacagcccccgggaaucucuauguguuuccucuaacgcuaaauuccauuaacaguuccagcu

SEQ ID NO: 170865 - RNA, 64 nt, Homo Sapiens
gguguaagacuucagauuuccagaauuugaauauuaacgcuaaacuaacuucuuccacuuuuuc

SEQ ID NO: 170866 - RNA, 64 nt, Homo Sapiens
ucagacuaauauuaaaaucaugcagcaugguuacuaacgcuauguguaccauuacauguuucag

SEQ ID NO: 170867 - RNA, 64 nt, Homo Sapiens
gguauuuauccguuuccacucauacuucugcuauuaacgcuauaacccugugcaaaaccuugga

SEQ ID NO: 170868 - RNA, 64 nt, Homo Sapiens
guugugacucacacugauccuccauccccuucauuaacgcuacacuguaguuucuuaauuuaag

SEQ ID NO: 170869 - RNA, 64 nt, Homo Sapiens
aaauguucaccagugcucuuuaagaagcacauucuaacgcuacugagauaguuuauuacaugcg

SEQ ID NO: 170870 - RNA, 64 nt, Homo Sapiens
uucccaggugacaguagcagccugaaaggcaagcuaacgcuaacugaacuauguaaugcuucac

SEQ ID NO: 170871 - RNA, 64 nt, Homo Sapiens
uuuguacggacgaugucucauucauuuuuaaaaguaacgcuaacuaccaguuuauaucacgguc

SEQ ID NO: 170872 - RNA, 64 nt, Homo Sapiens
uugacuaauguaaugauugucacaaagucuucaguaacgcuacaacgauugcaaaucauuggag

SEQ ID NO: 170873 - RNA, 64 nt, Homo Sapiens
aauugaauugucuguucuagcaguaauuuuaugguaacgcuaugacuucaguucguuuuuuuga

SEQ ID NO: 170874 - RNA, 64 nt, Homo Sapiens
accauugcaaaucauuggagcacaaagucuucaguaacgcuacauugacuaauguaaugauugu

SEQ ID NO: 170875 - RNA, 64 nt, Homo Sapiens
guguguggauuuuuaaagaaauucuuuaaagguuuaacgcuagauugugaggaaugacacacca

SEQ ID NO: 170876 - RNA, 57 nt, Homo Sapiens; identical to SEQ ID NO: 130560

SEQ ID NO: 170877 - RNA, 64 nt, Homo Sapiens; identical to SEQ ID NO: 130561

SEQ ID NO: 170878 - RNA, 64 nt, Homo Sapiens; identical to SEQ ID NO: 130562

SEQ ID NO: 170879 - RNA, 64 nt, Homo Sapiens; identical to SEQ ID NO: 130563

SEQ ID NO: 170880 - RNA, 64 nt, Homo Sapiens; identical to SEQ ID NO: 130564

SEQ ID NO: 170881 - RNA, 64 nt, Homo Sapiens; identical to SEQ ID NO: 130565

SEQ ID NO: 170882 - RNA, 64 nt, Homo Sapiens; identical to SEQ ID NO: 130566

SEQ ID NO: 170883 - RNA, 64 nt, Homo Sapiens; identical to SEQ ID NO: 130567

SEQ ID NO: 170884 - RNA, 64 nt, Homo Sapiens; identical to SEQ ID NO: 130568

SEQ ID NO: 170885 - RNA, 64 nt, Homo Sapiens; identical to SEQ ID NO: 130569

SEQ ID NO: 170886 - RNA, 64 nt, Homo Sapiens; identical to SEQ ID NO: 130570

SEQ ID NO: 170887 - RNA, 64 nt, Homo Sapiens; identical to SEQ ID NO: 130571

SEQ ID NO: 170888 - RNA, 64 nt, Homo Sapiens; identical to SEQ ID NO: 130572

SEQ ID NO: 170889 - RNA, 64 nt, Homo Sapiens; identical to SEQ ID NO: 130573

SEQ ID NO: 170890 - RNA, 64 nt, Homo Sapiens; identical to SEQ ID NO: 130574

SEQ ID NO: 170891 - RNA, 64 nt, Homo Sapiens; identical to SEQ ID NO: 130575

SEQ ID NO: 170892 - RNA, 64 nt, Homo Sapiens; identical to SEQ ID NO: 130576

SEQ ID NO: 170893 - RNA, 64 nt, Homo Sapiens; identical to SEQ ID NO: 130577

SEQ ID NO: 170894 - RNA, 64 nt, Homo Sapiens; identical to SEQ ID NO: 130578

SEQ ID NO: 170895 - RNA, 64 nt, Homo Sapiens; identical to SEQ ID NO: 130579

SEQ ID NO: 170896 - RNA, 64 nt, Homo Sapiens; identical to SEQ ID NO: 130580

SEQ ID NO: 170897 - RNA, 64 nt, Homo Sapiens; identical to SEQ ID NO: 130581

SEQ ID NO: 170898 - RNA, 64 nt, Homo Sapiens; identical to SEQ ID NO: 130582

SEQ ID NO: 170899 - RNA, 64 nt, Homo Sapiens; identical to SEQ ID NO: 130583

SEQ ID NO: 170900 - RNA, 64 nt, Homo Sapiens; identical to SEQ ID NO: 130584

SEQ ID NO: 170901 - RNA, 64 nt, Homo Sapiens; identical to SEQ ID NO: 130585

SEQ ID NO: 170902 - RNA, 64 nt, Homo Sapiens; identical to SEQ ID NO: 130586

SEQ ID NO: 170903 - RNA, 64 nt, Homo Sapiens; identical to SEQ ID NO: 130587

SEQ ID NO: 170904 - RNA, 64 nt, Homo Sapiens; identical to SEQ ID NO: 130588

SEQ ID NO: 170905 - RNA, 64 nt, Homo Sapiens; identical to SEQ ID NO: 130589

SEQ ID NO: 170906 - RNA, 64 nt, Homo Sapiens; identical to SEQ ID NO: 130590

SEQ ID NO: 170907 - RNA, 64 nt, Homo Sapiens; identical to SEQ ID NO: 130591

SEQ ID NO: 170908 - RNA, 64 nt, Homo Sapiens; identical to SEQ ID NO: 130592

SEQ ID NO: 170909 - RNA, 64 nt, Homo Sapiens; identical to SEQ ID NO: 130593

SEQ ID NO: 170910 - RNA, 64 nt, Homo Sapiens; identical to SEQ ID NO: 130594

SEQ ID NO: 170911 - RNA, 64 nt, Homo Sapiens; identical to SEQ ID NO: 130595

SEQ ID NO: 170912 - RNA, 64 nt, Homo Sapiens; identical to SEQ ID NO: 130596

SEQ ID NO: 170913 - RNA, 64 nt, Homo Sapiens; identical to SEQ ID NO: 130597

SEQ ID NO: 170914 - RNA, 64 nt, Homo Sapiens; identical to SEQ ID NO: 130598

SEQ ID NO: 170915 - RNA, 64 nt, Homo Sapiens; identical to SEQ ID NO: 130599

SEQ ID NO: 170916 - RNA, 64 nt, Homo Sapiens; identical to SEQ ID NO: 130600

SEQ ID NO: 170917 - RNA, 64 nt, Homo Sapiens; identical to SEQ ID NO: 130601

SEQ ID NO: 170918 - RNA, 64 nt, Homo Sapiens; identical to SEQ ID NO: 130602

SEQ ID NO: 170919 - RNA, 64 nt, Homo Sapiens; identical to SEQ ID NO: 130603

SEQ ID NO: 170920 - RNA, 64 nt, Homo Sapiens; identical to SEQ ID NO: 130604

SEQ ID NO: 170921 - RNA, 64 nt, Homo Sapiens; identical to SEQ ID NO: 130605

SEQ ID NO: 170922 - RNA, 64 nt, Homo Sapiens; identical to SEQ ID NO: 130606

SEQ ID NO: 170923 - RNA, 64 nt, Homo Sapiens; identical to SEQ ID NO: 130607

SEQ ID NO: 170924 - RNA, 64 nt, Homo Sapiens; identical to SEQ ID NO: 130608

SEQ ID NO: 170925 - RNA, 64 nt, Homo Sapiens; identical to SEQ ID NO: 130609

SEQ ID NO: 170926 - RNA, 64 nt, Homo Sapiens; identical to SEQ ID NO: 130610

SEQ ID NO: 170927 - RNA, 64 nt, Homo Sapiens; identical to SEQ ID NO: 130611

SEQ ID NO: 170928 - RNA, 64 nt, Homo Sapiens
ucucuaaucucaggugggacuuggcgcucucucuuuucugcaugucaaguucugagcgcggaca

SEQ ID NO: 170929 - RNA, 64 nt, Homo Sapiens
aggacgaggccuuguuggcacuagauuuggguauuuucugcaugucauaacauauccuaacugc

SEQ ID NO: 170930 - RNA, 64 nt, Homo Sapiens
ggaccuacacuuaaucuauaugcuuuacacuagcuuucugcauuuaauagguuagaauguaaau

SEQ ID NO: 170931 - RNA, 64 nt, Homo Sapiens
auuuuauauuuaugcaguuguacaauuuuauuuuuuucugcaagaaaaaguguaauguaugaaa

SEQ ID NO: 170932 - RNA, 64 nt, Homo Sapiens
augcuuuuaacugauguaggccuuguuaggcuauuuucugcaggaguuauugucaguuuuuauu

SEQ ID NO: 170933 - RNA, 56 nt, Homo Sapiens
acaccagacccuaacguuacggcuuguuucugcaagauugggauucaauuguguag

SEQ ID NO: 170934 - RNA, 64 nt, Homo Sapiens
auuugacugggaguugugauagugaccuaaggauuuucugcaaauaauuuugauaaacgaaucc

SEQ ID NO: 170935 - RNA, 64 nt, Homo Sapiens
aaagucauacauaugaagcauguaaauagaaacauuucugcauaugcuaacuuuuuucuaccuu

SEQ ID NO: 170936 - RNA, 64 nt, Homo Sapiens
auucguuauuuaugaaaaagacuuuuaaaugcccuuucugcaguuggaagguuuucuuuauaua

SEQ ID NO: 170937 - RNA, 64 nt, Homo Sapiens
uuagaguuuucuuguauaguggcagagaugucuauuucugcauucaaaaguguaaugauguacu

SEQ ID NO: 170938 - RNA, 64 nt, Homo Sapiens
ucccccuuuuuguucuuuuuaugcccccaagcacuuucugcaguagcuagagggacagguuucc

SEQ ID NO: 170939 - RNA, 64 nt, Homo Sapiens
uccauuccucauuucuacuuggcucaagaaaacauuucugcagucaggugagacuuuuacaaaa

SEQ ID NO: 170940 - RNA, 64 nt, Homo Sapiens
guuuuguugaacuuuguggaggguaaguaacuuauuucugcacucuuugccuuauucugugcau

SEQ ID NO: 170941 - RNA, 64 nt, Homo Sapiens
uuuuaguuuggaaaaaauauauuuaagaacuaauuuucugcagcucaagaguuuucaguagaau

SEQ ID NO: 170942 - RNA, 64 nt, Homo Sapiens
uagcuacuucuuuguuagaggauugagaaugaaauuucugcaaaagggcccaugguucauuugg

SEQ ID NO: 170943 - RNA, 64 nt, Homo Sapiens
uguggaacucccugauucuauacccucuuccuucuuucugcaaggcagaggaauaauauuuuua

SEQ ID NO: 170944 - RNA, 64 nt, Homo Sapiens
auuuuucuuauguccacccuuauuuacaauuugguuucugcaauuuccuauauaacaauuauua

SEQ ID NO: 170945 - RNA, 64 nt, Homo Sapiens
ggucugcaaaaacaaaaauuauuaagacuuacauuuucugcacacacauauauuuacuaagaug

SEQ ID NO: 170946 - RNA, 64 nt, Homo Sapiens
cauugcgguuaaaaaauauagggcuaguuucgguuuucugcagcgcaucugcuuuauugccaaa

SEQ ID NO: 170947 - RNA, 64 nt, Homo Sapiens
cuacacaacaugugggcuucggagaagaacagaauuucugcacagcacugacaguuuacaggaa

SEQ ID NO: 170948 - RNA, 64 nt, Homo Sapiens
ugauguaaaaugacauuaauuuuuaagcuacaccuuucugcaccgaacaaaaaccaacacauag

SEQ ID NO: 170949 - RNA, 64 nt, Homo Sapiens
aagcucucagaccaucagcagcaccugcagacacuuucugcaaucagccugacacauacuaagg

SEQ ID NO: 170950 - RNA, 64 nt, Homo Sapiens
ucacucucagaccaucagcagcacaugcacacauuuucugcaaucagccucacccaugcuaagg

SEQ ID NO: 170951 - RNA, 64 nt, Homo Sapiens
cccuuccaaagugaccacaagaggcuuucugcacuuucugcaccgugcacagcccaaggaccac

SEQ ID NO: 170952 - RNA, 64 nt, Homo Sapiens
uucugcacccccuuccaaagaaggaccacgaggcuuucugcacuuaauuuugugugcacagccc

SEQ ID NO: 170953 - RNA, 64 nt, Homo Sapiens
augugaguaggcugguauuuguaauuuugcuuucuuucugcauaauguugauuauaaauccucu

SEQ ID NO: 170954 - RNA, 64 nt, Homo Sapiens
aguuuugcuauauuccaguaguaccguuguguguuuucugcaauguggaguugacuuagcuugg

SEQ ID NO: 170955 - RNA, 64 nt, Homo Sapiens
aauuagaauaucauuaauuuaaguugcccugggguuucugcaucuauaugaaauuauaaaaaaa

SEQ ID NO: 170956 - RNA, 64 nt, Homo Sapiens
cuguaucccaagugcacugugacuacuuuucuuguuucugcaaggaguuauuggcuccagaugu

SEQ ID NO: 170957 - RNA, 64 nt, Homo Sapiens
uaauauuuugaauauuuuagcuauauuuaguggcuuucugcaagcaacuagaacagagaaguaa

SEQ ID NO: 170958 - RNA, 64 nt, Homo Sapiens
cuaccuucauucucuuaggguuaaggagccuuucuuucugcagcuaagggcagaggcugugccu

SEQ ID NO: 170959 - RNA, 64 nt, Homo Sapiens
uggcccuguuuccuuuuuugcaaaacaaggacauuuucugcagccccuuccucucagugagcua

SEQ ID NO: 170960 - RNA, 64 nt, Homo Sapiens
gggugagagcagcuuccgauaggaccugcccagauuucugcaugugcacuuuuguuuacugaaa

SEQ ID NO: 170961 - RNA, 64 nt, Homo Sapiens
ucacacgacuuuaguuuggcaagccuaguguaaauuucugcaucaaaaaaggcuuuggcuuauc

SEQ ID NO: 170962 - RNA, 64 nt, Homo Sapiens
cugacuuacuuuguuccagcuucuuacccuguguuuucugcaaaucucuggaaaauggauuugc

SEQ ID NO: 170963 - RNA, 64 nt, Homo Sapiens
gaagaaaaaccacaccccccgcaccccuccguucuuucugcauagacucacuuguuaaauagca

SEQ ID NO: 170964 - RNA, 64 nt, Homo Sapiens
aaaagguuguauguuuuguguugguguuuccuauuuucugcacuggaggggaggggacuguuga

SEQ ID NO: 170965 - RNA, 64 nt, Homo Sapiens
uagggagucuugagucgagacugacaacauugguuuucugcagcaauauauuaaccuguuacaa

SEQ ID NO: 170966 - RNA, 64 nt, Homo Sapiens
aaucuucuccacgggcacgggccauauugaaccguuucugcacucccgcucaugucccacaccu

SEQ ID NO: 170967 - RNA, 64 nt, Homo Sapiens
guguuuucauaaagauaauaaguggcuguggacuuuucugcacagcuggcuuuacucuagggua

SEQ ID NO: 170968 - RNA, 64 nt, Homo Sapiens
guggaagcauuugacccagauuuuuaaaaaaagguuucugcaucguagguauuagacuugcacu

SEQ ID NO: 170969 - RNA, 64 nt, Homo Sapiens
ugacgccagcuaagcauaguguucugcacggggcuuucugcaugcucaaagacugacagccauc

SEQ ID NO: 170970 - RNA, 64 nt, Homo Sapiens
uuccacgccucugcacucccgacauggcccuuguuuucugcagcgucccuuucaucuugagagg

SEQ ID NO: 170971 - RNA, 64 nt, Homo Sapiens
gggcagcacagguucugggacaggacaugcaggauuucugcagggcuggggugguggcugcccc

SEQ ID NO: 170972 - RNA, 64 nt, Homo Sapiens
gccggacaccugugcacucggcagcgggaaugccuuucugcagagccguguaccugaggcccag

SEQ ID NO: 170973 - RNA, 64 nt, Homo Sapiens
uuaaacugauacugcagucaagcccaugcugaauuuucugcauucugaggguaaagugucucac

SEQ ID NO: 170974 - RNA, 64 nt, Homo Sapiens
ucucauuaugcuggcuagagguacaaacauguauuuucugcaaaguguguguguguguguaugu

SEQ ID NO: 170975 - RNA, 64 nt, Homo Sapiens
aagccuagagccuggcacuccccgccccgggugcuuucugcacauuugcucucccuuaccgccc

SEQ ID NO: 170976 - RNA, 64 nt, Homo Sapiens
ggagaugaguuuuauccugugucuuuagcaaucauuucugcaccuucggguugacaugagaaag

SEQ ID NO: 170977 - RNA, 64 nt, Homo Sapiens
ucccaguuuuaaaacagauaugcaaaguauuucuaaccuuuaauaaaugauuuggauaccacuc

SEQ ID NO: 170978 - RNA, 64 nt, Homo Sapiens
cuuauaccucaacuaccuuugugaaacccaggaaaaccuuuaguaaaaggaacuugggaaacuu

SEQ ID NO: 170979 - RNA, 64 nt, Homo Sapiens
gaggagcaacucauuccagcaucaacaauaagauaaccuuuaaguauggcacacuuguauuuuu

SEQ ID NO: 170980 - RNA, 64 nt, Homo Sapiens
guaagauaccaucuuuucaaagagaaacguuuaaaaccuuuauugucucuccuuagucuaauuu

SEQ ID NO: 170981 - RNA, 64 nt, Homo Sapiens
uagaaauaaugucaaaaauauuuaggaauuuaauaaccuuuaagucagaaacuaaaacaaauac

SEQ ID NO: 170982 - RNA, 64 nt, Homo Sapiens
auaaaagcuaagaugccuucuaacuucauaagcaaaccuuuaacuaauuauguaucugaaaguc

SEQ ID NO: 170983 - RNA, 64 nt, Homo Sapiens
gagauaaacccugcaaauguaaagaguguaacaaaaccuuuaaacagcccucaccggugaauaa

SEQ ID NO: 170984 - RNA, 64 nt, Homo Sapiens
ugaaaaacguggcagagccuucagaccauccacaaaccuuuaugaaaauucauauuugagagua

SEQ ID NO: 170985 - RNA, 64 nt, Homo Sapiens
auauaaaaccauagaaauguaaaagaugugacaaaaccuuuaagccauacuccaggcuucuuaa

SEQ ID NO: 170986 - RNA, 64 nt, Homo Sapiens
uaggccuucugugugacguaggacucuuaugaaaaaccuuuauuauggccaauuugcaacaaug

SEQ ID NO: 170987 - RNA, 64 nt, Homo Sapiens
agucuaagcaagauuaacaaaauucugcaguuuuaaccuuuagaucuuucuccaaggaaauaaa

SEQ ID NO: 170988 - RNA, 64 nt, Homo Sapiens
ggacaauguuuuuagguuuagcauuuuguuuaaaaaccuuuaaagaaaccuuuagaaggacuua

SEQ ID NO: 170989 - RNA, 64 nt, Homo Sapiens
uagguuuagcauuuuguuuaaaaaccuuuaaagaaaccuuuagaaggacuuagaccucacauau

SEQ ID NO: 170990 - RNA, 64 nt, Homo Sapiens
ggauguaguugcauuuuugcuaaaaaaaaaaaaaaaccuuuaaaaauuguuggauguguacaaa

SEQ ID NO: 170991 - RNA, 64 nt, Homo Sapiens
uaccuucuuugccaugagcauucaagggacggcuaaccuuuauugacaaucuauaucgcaaaag

SEQ ID NO: 170992 - RNA, 64 nt, Homo Sapiens
ccuguaaauauuucugugaagguacuuuuguuucaaccuuuauuauggauggagaugaucauua

SEQ ID NO: 170993 - RNA, 64 nt, Homo Sapiens
ugcauguguuauguccauuugaauuaaaaagucaaaccuuuauaugcgaucaggcaaaaaagug

SEQ ID NO: 170994 - RNA, 64 nt, Homo Sapiens
agauuaccaaaauaauuucagagguugaugugguaaccuuuaagcgaaguuucuagaggugaaa

SEQ ID NO: 170995 - RNA, 64 nt, Homo Sapiens
uuaguacuaguuuacacguauaaauacagucuuaaaccuuuaugucugagucugaaaugaaccu

SEQ ID NO: 170996 - RNA, 64 nt, Homo Sapiens
ugcuccccaaacccagguucccacagccuugggcccuagguaccccagcugaucagugccagga

SEQ ID NO: 170997 - RNA, 64 nt, Homo Sapiens
ugagugaacaagccauaaccuccccuaaacaccaccuagguauuuguuagaagucacacuauua

SEQ ID NO: 170998 - RNA, 64 nt, Homo Sapiens
auggacacauguuuucauuucccuuggauaaauaccuagguaggggauugcugggccauaugau

SEQ ID NO: 170999 - RNA, 64 nt, Homo Sapiens
uagccaagaacucaugaaaguaaguguaaacuauccuagguaauuucagguacuuucucuuaug

SEQ ID NO: 171000 - RNA, 64 nt, Homo Sapiens
aagagacauggcauguucucugggacccuggaauccuagguacccacaugugugccaaagccua

SEQ ID NO: 171001 - RNA, 64 nt, Homo Sapiens
cgguacuguaauacgugcaccaaacugccucaauccuagguaacgagggcaacagggagcaccu

SEQ ID NO: 171002 - RNA, 64 nt, Homo Sapiens
auagugagacccugucucauuugcuugagacuagccuagguaacgggaggcugaggcaggaggg

SEQ ID NO: 171003 - RNA, 64 nt, Homo Sapiens
ugguugacauuucuuacagccaauugucaaacauccuagguaagaguauauguagacuucaucc

SEQ ID NO: 171004 - RNA, 64 nt, Homo Sapiens
aggguaauguauauacauauuagauauauuuuggccuagguaucaaaucaagaaaauuuguugu

SEQ ID NO: 171005 - RNA, 64 nt, Homo Sapiens
cccgcuguuacacagguguuggcaguuauuauuaccuagguaccaaaguuugaucacugaauuu

SEQ ID NO: 171006 - RNA, 64 nt, Homo Sapiens
cugcugagcccugccccccgacucuggaggguacccuagguaugccgccccccuucccaaggca

SEQ ID NO: 171007 - RNA, 64 nt, Homo Sapiens
cuuacaaagcuaguaguagaauuuuauugaaaggccuagguauuaauuuuuuaaaugagugcuu

SEQ ID NO: 171008 - RNA, 64 nt, Homo Sapiens
ugggguacuuaggagccucuuuguagggacugugccuagguagcauguccuaacauuuguucug

SEQ ID NO: 171009 - RNA, 64 nt, Homo Sapiens
gaagagguccuucacaucccuuguaaguuggauuccuagguauuuuauucucuuugaagcaauu

SEQ ID NO: 171010 - RNA, 64 nt, Homo Sapiens
cuacccuuaccuugaggaauagaugcaauaaguuccuagguagucacuaagccagcuggccuaa

SEQ ID NO: 171011 - RNA, 64 nt, Homo Sapiens
uuaaauagcuugcccaaggcgaugaagacugaagccuagguauauaguauuaucucauuuuacu

SEQ ID NO: 171012 - RNA, 64 nt, Homo Sapiens
cagaaaccuggaucucuuaagagauugguaccuaccuagguacgaaaguucuacccuuggcaua

SEQ ID NO: 171013 - RNA, 64 nt, Homo Sapiens
aauucacuuacgaauguuuauaagcuuuccauuuccuagguaauuuuuuaaaagccagucaaaa

SEQ ID NO: 171014 - RNA, 64 nt, Homo Sapiens
auuacaguuuugugagacuuaagggucuuuuuaaccuagguaaguuuauaugaccuaacuuaau

SEQ ID NO: 171015 - RNA, 64 nt, Homo Sapiens
ucuuacuggauuuuucaauuuucaaaccauauggccuagguaacuuuaauugaaauaauauaga

SEQ ID NO: 171016 - RNA, 64 nt, Homo Sapiens
auguuucuucuucauuuuguuuaaagauugcguaccuagguaagucacacuguauagauaaaaa

SEQ ID NO: 171017 - RNA, 64 nt, Homo Sapiens
aacuggacccuguugcuaagccccagcaagcaauccuagguaggguuuaauccccaguaaaauu

SEQ ID NO: 171018 - RNA, 64 nt, Homo Sapiens
gcuuuagugcugagcuuuuaacaggaaauguggcccuagguauuagucuuaguuuaaaauguug

SEQ ID NO: 171019 - RNA, 64 nt, Homo Sapiens
uacccaagagaaaugaaaacccaggaaugccacuccuagguauuacguagagugaccauaugac

SEQ ID NO: 171020 - RNA, 64 nt, Homo Sapiens
agcccuggauguccccaugguucaucgcccucauccuagguacuugcagucccucgggcaggug

SEQ ID NO: 171021 - RNA, 64 nt, Homo Sapiens
caccacagagaagaccuucucuugaucacagcucccuagguaggcgccuugcacggcugcucgg

SEQ ID NO: 171022 - RNA, 64 nt, Homo Sapiens
cuuccucuuuuuugauuuguuuguuagauuuauuccuagguaucaaagaaaccuugcacugauu

SEQ ID NO: 171023 - RNA, 64 nt, Homo Sapiens
uuuguguuuuuuguuuaaguacuucacacagaagccuagguagauuuaaaauggggugcucagg

SEQ ID NO: 171024 - RNA, 64 nt, Homo Sapiens
ucuuugcccguuccuguaacagacaaucccauguccuagguaugguuuuuuauucuguuagugc

SEQ ID NO: 171025 - RNA, 64 nt, Homo Sapiens
guagaauaaaauugaauaagaaaaagaucuauaaccuagguaaagcauaaucugucagagaagc

SEQ ID NO: 171026 - RNA, 64 nt, Homo Sapiens
uaaugguugugaauuucuaucuuuaaaugacaaaccuagguaaucucccuuuuuuucuuuaaac

SEQ ID NO: 171027 - RNA, 64 nt, Homo Sapiens
aguaaaugagaaauauuacgaauuaaagcuuaacccuagguaagaggauuaaguaggugaguuu

SEQ ID NO: 171028 - RNA, 64 nt, Homo Sapiens
ugacuauaugcauccucauuuauucccuuuagaaccuagguaaaaaauguugcgaaaacauggg

SEQ ID NO: 171029 - RNA, 64 nt, Homo Sapiens
aguggugugcagcauuuuugcuucaugaguaugaccuagguauagagaucugauaacuugaauu

SEQ ID NO: 171030 - RNA, 64 nt, Homo Sapiens
cagagguuuucaaaagcccuuauggugacaucuaccuagguaaaagccugacauguggcuuuau

SEQ ID NO: 171031 - RNA, 64 nt, Homo Sapiens
acgaaagccgucaggggcagugugccaagggcaaccuagguaaaacaugccuacaggccagcuc

SEQ ID NO: 171032 - RNA, 64 nt, Homo Sapiens
aacuuccacagcagucucgucccuguagcauaccccuagguaccuucaguuccagcucaugacg

SEQ ID NO: 171033 - RNA, 64 nt, Homo Sapiens
ucguaucuaaggauaacccagaaacaugggguguccuagguauguuuaucucgacacugaaccc

SEQ ID NO: 171034 - RNA, 64 nt, Homo Sapiens
agaaaaaggugaaaaagcacuauuaucaguucugccuagguaaauguaagauagaauuaaaugg

SEQ ID NO: 171035 - RNA, 64 nt, Homo Sapiens
guaaacugcaacuagugauguaaaugugcuauuaccuagguaacugcauauauauaaggaaugu

SEQ ID NO: 171036 - RNA, 64 nt, Homo Sapiens
uuugcauuuuguauaugggaagaaauaugacaauccuagguaauuaaaccauagacccaaagcc

SEQ ID NO: 171037 - RNA, 64 nt, Homo Sapiens
aaaccacugagaaaacguuauuaaaauuguaauaccuagguaguugguugaucacaguuuguua

SEQ ID NO: 171038 - RNA, 64 nt, Homo Sapiens
ucagguggugcugggugauuuauuauaaucugaaccuagguauauccuuuggucuuccacaguc

SEQ ID NO: 171039 - RNA, 64 nt, Homo Sapiens
ugacauuuuucccucuuuuacauugagaucauacccuagguacuguuuaguaugcaauauuuuc

SEQ ID NO: 171040 - RNA, 64 nt, Homo Sapiens
uuugaauugaaugggagcuaagaaaugucauagaccuagguaacccccaucaaaagguauuccu

SEQ ID NO: 171041 - RNA, 64 nt, Homo Sapiens
aagaggggugguggggggcaugcccaugagcaagccuagguacggcauccaggcuggccagugc

SEQ ID NO: 171042 - RNA, 64 nt, Homo Sapiens
uuacuaauaacccagcuugcuaaauuaggcuauaccuagguaaucucuagaagacaacucugac

SEQ ID NO: 171043 - RNA, 64 nt, Homo Sapiens
uuaucuaguuuaauuucuucuuuggacaaggaguccuagguauuauauuuugaguuugauuuca

SEQ ID NO: 171044 - RNA, 64 nt, Homo Sapiens
ggcuuagcuuugugugaaaaccagucaccuuucuccuagguaaugaguagugcuguucauauua

SEQ ID NO: 171045 - RNA, 64 nt, Homo Sapiens
cugccuggcccuacgaugaggccacucaugugggccuagguaggggaggauggugccuggagca

SEQ ID NO: 171046 - RNA, 64 nt, Homo Sapiens
acuggaauuuucauguuugaucauuugacaaauaccuagguauaauaagacaaacauuugauua

SEQ ID NO: 171047 - RNA, 64 nt, Homo Sapiens
gaucacacugaagucuucaaagcucugucccuccccuagguaaacccaugggcuccaccagccc

SEQ ID NO: 171048 - RNA, 64 nt, Homo Sapiens
aagcaggcagaacucaucuagguaaauuacaguuccuagguauaauucacauuguauucagagu

SEQ ID NO: 171049 - RNA, 64 nt, Homo Sapiens
ccacauccaucccaaaggaauagcgugaucuuagccuagguagguccaaagagacuaaauguca

SEQ ID NO: 171050 - RNA, 64 nt, Homo Sapiens
gaggcccaaagccuguuagccaccauccaugcuaccuagguaguccauaggaaccacccccaug

SEQ ID NO: 171051 - RNA, 64 nt, Homo Sapiens
aggggaaauucugauuaagcgaaagugguaucauccuagguaagcuuauuucagaacaagucua

SEQ ID NO: 171052 - RNA, 64 nt, Homo Sapiens
cuauuuuaauauuuaaauaucauuuuauaaaaauccuagguagcucuacuaucuuuucaaaagc

SEQ ID NO: 171053 - RNA, 64 nt, Homo Sapiens
ggagucauuaacaacuaggggguuggguaggauuccuagguauggggaagaguuuuggaagggg

SEQ ID NO: 171054 - RNA, 64 nt, Homo Sapiens
gcgguauccaugauuuggccuuguggaggguguuccuagguagaggugagaauggggaggcaag

SEQ ID NO: 171055 - RNA, 64 nt, Homo Sapiens
uagggcugauggugcgcacuaggugauaccggguccuagguaggggcaaccucguacugagagg

SEQ ID NO: 171056 - RNA, 64 nt, Homo Sapiens
agcugcuaguauucuuuuaacaagcauuuaggagccuagguaaauccagucagucucagauuua

SEQ ID NO: 171057 - RNA, 64 nt, Homo Sapiens
ucaauccauuguaucauucagaccugagaacuuuccuagguagacaauacuaggcugaaggaga

SEQ ID NO: 171058 - RNA, 64 nt, Homo Sapiens
aguauuuuuaguaguggaucaaguuuaagguccuccuagguaugcuuacugaaccagcauucag

SEQ ID NO: 171059 - RNA, 64 nt, Homo Sapiens
cucaaagguagacccguuuccaacccaggcaccuccuagguagggacucuuaggcccgccucaa

SEQ ID NO: 171060 - RNA, 64 nt, Homo Sapiens
uuuucaagcuccucauuuacggcucugugcuaccccuagguagcaagagagaggcugggaaaag

SEQ ID NO: 171061 - RNA, 64 nt, Homo Sapiens
guuuuaccaagaccagaaguuaaauaugacauuuccuagguaguuguaacucuaacauaguuua

SEQ ID NO: 171062 - RNA, 64 nt, Homo Sapiens
gaauuaauagcccuuagcaauggcagaauguuugccuagguacauaucguuagcauuuauuugg

SEQ ID NO: 171063 - RNA, 64 nt, Homo Sapiens
aucauuuauccaaguacuugggguccagucauauccuagguaucgaaacuguaauguaaaucua

SEQ ID NO: 171064 - RNA, 64 nt, Homo Sapiens
uaaaacaauaaaaagaaaaccaguuucuuagaauccuagguaaaaagggaaagcuaugacuucu

SEQ ID NO: 171065 - RNA, 64 nt, Homo Sapiens
gggugugagauauucaaagacauaaaaauaguuuccuagguaagaguaucaauauacuuuuggg

SEQ ID NO: 171066 - RNA, 64 nt, Homo Sapiens
cuguaugaccuugggccugccacuucucacagacccuagguauccacagcugugacaugggggc

SEQ ID NO: 171067 - RNA, 64 nt, Homo Sapiens
ucuagauuaggccaguucagaaaacuuacuaaaaccuagguaacuaagcuuguuuuuguggaaa

SEQ ID NO: 171068 - RNA, 64 nt, Homo Sapiens
agcagagcugcggcucggugguguauaaauggcaccuagguaaguuguuccagccaaauuagca

SEQ ID NO: 171069 - RNA, 64 nt, Homo Sapiens
cccugcccaguuuccaguugcccuguccacuuacccuagguagccccccaccccaucagugccg

SEQ ID NO: 171070 - RNA, 64 nt, Homo Sapiens
agcaggacuuugggacaaauaauagacuuaauugccuagguacauauuuugggggcauuagguu

SEQ ID NO: 171071 - RNA, 64 nt, Homo Sapiens
gccaggggaggagacccauauugggggaugggauccuagguaggccccagccauggcacgugag

SEQ ID NO: 171072 - RNA, 64 nt, Homo Sapiens
uauagcaugaguggccuuagucuuuaauugcaauccuagguaucgauuuauugcauaauacuau

SEQ ID NO: 171073 - RNA, 64 nt, Homo Sapiens
aacaaaccccacacgagggcucucaccuccuucuccuagguaguauuuauuuucagcaccuguu

SEQ ID NO: 171074 - RNA, 64 nt, Homo Sapiens
ccccuccaauaucccagaaugaauaagaacaaucccuagguauuuuuauuuacccaaguguuca

SEQ ID NO: 171075 - RNA, 64 nt, Homo Sapiens
ugccaguccgugauuuuaauacugcucccaggggccuagguagccccaaaccccagacugagau

SEQ ID NO: 171076 - RNA, 64 nt, Homo Sapiens
accacuaucaggccuguaggagcagaguaaauguccuagguaaucuuccacuacccaucuugug

SEQ ID NO: 171077 - RNA, 64 nt, Homo Sapiens
uccccuucacaaugagaaguguuuucuggcaggcccuagguaaagggucgggggaggggggagc

SEQ ID NO: 171078 - RNA, 64 nt, Homo Sapiens
gcacacucuguccugaagcugaccagacuacccaccuagguaggcgguugucaccugauaauca

SEQ ID NO: 171079 - RNA, 64 nt, Homo Sapiens
ucagacaccgccuucucaagacauagggguaggcccuagguaaauagggugggguggccagcuc

SEQ ID NO: 171080 - RNA, 64 nt, Homo Sapiens
gacagacuugagacaucaguaauaagguggaacuccuagguauuaauaaaauggcauuuuaaga

SEQ ID NO: 171081 - RNA, 64 nt, Homo Sapiens
ugcacugcucaccugcgccccauagacaguauuaccuagguagaauuacauaguauuaccuaga

SEQ ID NO: 171082 - RNA, 64 nt, Homo Sapiens
ccugcgguguguacacgaacucggcuucuuuuguccuagguacgccaagggcagguuucuggag

SEQ ID NO: 171083 - RNA, 64 nt, Homo Sapiens
gggaggaucaauugaggccagaguuugaaaccagccuagguaacauagugagacccccuaucuc

SEQ ID NO: 171084 - RNA, 64 nt, Homo Sapiens
gaccccugaagcccagaacucugaucuucacagcccuagguauggccccagcaccccacugccc

SEQ ID NO: 171085 - RNA, 63 nt, Homo Sapiens
agucugggggguugccucucgucauuaaagaacaccuagguacuuuaauuggccccuugaacu

SEQ ID NO: 171086 - RNA, 64 nt, Homo Sapiens
gggaaauauaguuguaauauuuuuacaggauauuccuagguaaaugaaggagccuucaguugua

SEQ ID NO: 171087 - RNA, 64 nt, Homo Sapiens
aguaaaggggcaggugcuugggcuccagagagacccuagguacugccuucuaacuccugcaucc

SEQ ID NO: 171088 - RNA, 64 nt, Homo Sapiens
gccuccaucuucaguuguguguuguaugcauucuccuagguagaacuacuaguacuuuguuccu

SEQ ID NO: 171089 - RNA, 64 nt, Homo Sapiens
agagagacaccucugucucuccacugcacuccaaccuagguaacugcagugagcugugaugaca

SEQ ID NO: 171090 - RNA, 64 nt, Homo Sapiens
ccccucuucccugguaagaacaaggucuugcucuccuagguagcugugaagagcaagagagcag

SEQ ID NO: 171091 - RNA, 64 nt, Homo Sapiens; identical to SEQ ID NO: 170977

SEQ ID NO: 171092 - RNA, 64 nt, Homo Sapiens; identical to SEQ ID NO: 170978

SEQ ID NO: 171093 - RNA, 64 nt, Homo Sapiens; identical to SEQ ID NO: 170979

SEQ ID NO: 171094 - RNA, 64 nt, Homo Sapiens; identical to SEQ ID NO: 170980

SEQ ID NO: 171095 - RNA, 64 nt, Homo Sapiens; identical to SEQ ID NO: 170981

SEQ ID NO: 171096 - RNA, 64 nt, Homo Sapiens; identical to SEQ ID NO: 170982

SEQ ID NO: 171097 - RNA, 64 nt, Homo Sapiens; identical to SEQ ID NO: 170983

SEQ ID NO: 171098 - RNA, 64 nt, Homo Sapiens; identical to SEQ ID NO: 170984

SEQ ID NO: 171099 - RNA, 64 nt, Homo Sapiens; identical to SEQ ID NO: 170985

SEQ ID NO: 171100 - RNA, 64 nt, Homo Sapiens; identical to SEQ ID NO: 170986

SEQ ID NO: 171101 - RNA, 64 nt, Homo Sapiens; identical to SEQ ID NO: 170987

SEQ ID NO: 171102 - RNA, 64 nt, Homo Sapiens; identical to SEQ ID NO: 170988

SEQ ID NO: 171103 - RNA, 64 nt, Homo Sapiens; identical to SEQ ID NO: 170989

SEQ ID NO: 171104 - RNA, 64 nt, Homo Sapiens; identical to SEQ ID NO: 170990

SEQ ID NO: 171105 - RNA, 64 nt, Homo Sapiens; identical to SEQ ID NO: 170991

SEQ ID NO: 171106 - RNA, 64 nt, Homo Sapiens; identical to SEQ ID NO: 170992

SEQ ID NO: 171107 - RNA, 64 nt, Homo Sapiens; identical to SEQ ID NO: 170993

SEQ ID NO: 171108 - RNA, 64 nt, Homo Sapiens; identical to SEQ ID NO: 170994

SEQ ID NO: 171109 - RNA, 64 nt, Homo Sapiens; identical to SEQ ID NO: 170995

SEQ ID NO: 171110 - RNA, 64 nt, Homo Sapiens; identical to SEQ ID NO: 170996

SEQ ID NO: 171111 - RNA, 64 nt, Homo Sapiens; identical to SEQ ID NO: 170997

SEQ ID NO: 171112 - RNA, 64 nt, Homo Sapiens; identical to SEQ ID NO: 170998

SEQ ID NO: 171113 - RNA, 64 nt, Homo Sapiens; identical to SEQ ID NO: 170999

SEQ ID NO: 171114 - RNA, 64 nt, Homo Sapiens; identical to SEQ ID NO: 171000

SEQ ID NO: 171115 - RNA, 64 nt, Homo Sapiens; identical to SEQ ID NO: 171001

SEQ ID NO: 171116 - RNA, 64 nt, Homo Sapiens; identical to SEQ ID NO: 171002

SEQ ID NO: 171117 - RNA, 64 nt, Homo Sapiens; identical to SEQ ID NO: 171003

SEQ ID NO: 171118 - RNA, 64 nt, Homo Sapiens; identical to SEQ ID NO: 171004

SEQ ID NO: 171119 - RNA, 64 nt, Homo Sapiens; identical to SEQ ID NO: 171005

SEQ ID NO: 171120 - RNA, 64 nt, Homo Sapiens; identical to SEQ ID NO: 171006

SEQ ID NO: 171121 - RNA, 64 nt, Homo Sapiens; identical to SEQ ID NO: 171007

SEQ ID NO: 171122 - RNA, 64 nt, Homo Sapiens; identical to SEQ ID NO: 171008

SEQ ID NO: 171123 - RNA, 64 nt, Homo Sapiens; identical to SEQ ID NO: 171009

SEQ ID NO: 171124 - RNA, 64 nt, Homo Sapiens; identical to SEQ ID NO: 171010

SEQ ID NO: 171125 - RNA, 64 nt, Homo Sapiens; identical to SEQ ID NO: 171011

SEQ ID NO: 171126 - RNA, 64 nt, Homo Sapiens; identical to SEQ ID NO: 171012

SEQ ID NO: 171127 - RNA, 64 nt, Homo Sapiens; identical to SEQ ID NO: 171013

SEQ ID NO: 171128 - RNA, 64 nt, Homo Sapiens; identical to SEQ ID NO: 171014

SEQ ID NO: 171129 - RNA, 64 nt, Homo Sapiens; identical to SEQ ID NO: 171015

SEQ ID NO: 171130 - RNA, 64 nt, Homo Sapiens; identical to SEQ ID NO: 171016

SEQ ID NO: 171131 - RNA, 64 nt, Homo Sapiens; identical to SEQ ID NO: 171017

SEQ ID NO: 171132 - RNA, 64 nt, Homo Sapiens; identical to SEQ ID NO: 171018

SEQ ID NO: 171133 - RNA, 64 nt, Homo Sapiens; identical to SEQ ID NO: 171019

SEQ ID NO: 171134 - RNA, 64 nt, Homo Sapiens; identical to SEQ ID NO: 171020

SEQ ID NO: 171135 - RNA, 64 nt, Homo Sapiens; identical to SEQ ID NO: 171021

SEQ ID NO: 171136 - RNA, 64 nt, Homo Sapiens; identical to SEQ ID NO: 171022

SEQ ID NO: 171137 - RNA, 64 nt, Homo Sapiens; identical to SEQ ID NO: 171023

SEQ ID NO: 171138 - RNA, 64 nt, Homo Sapiens; identical to SEQ ID NO: 171024

SEQ ID NO: 171139 - RNA, 64 nt, Homo Sapiens; identical to SEQ ID NO: 171025

SEQ ID NO: 171140 - RNA, 64 nt, Homo Sapiens; identical to SEQ ID NO: 171026

SEQ ID NO: 171141 - RNA, 64 nt, Homo Sapiens; identical to SEQ ID NO: 171027

SEQ ID NO: 171142 - RNA, 64 nt, Homo Sapiens; identical to SEQ ID NO: 171028

SEQ ID NO: 171143 - RNA, 64 nt, Homo Sapiens; identical to SEQ ID NO: 171029

SEQ ID NO: 171144 - RNA, 64 nt, Homo Sapiens; identical to SEQ ID NO: 171030

SEQ ID NO: 171145 - RNA, 64 nt, Homo Sapiens; identical to SEQ ID NO: 171031

SEQ ID NO: 171146 - RNA, 64 nt, Homo Sapiens; identical to SEQ ID NO: 171032

SEQ ID NO: 171147 - RNA, 64 nt, Homo Sapiens; identical to SEQ ID NO: 171033

SEQ ID NO: 171148 - RNA, 64 nt, Homo Sapiens; identical to SEQ ID NO: 171034

SEQ ID NO: 171149 - RNA, 64 nt, Homo Sapiens; identical to SEQ ID NO: 171035

SEQ ID NO: 171150 - RNA, 64 nt, Homo Sapiens; identical to SEQ ID NO: 171036

SEQ ID NO: 171151 - RNA, 64 nt, Homo Sapiens; identical to SEQ ID NO: 171037

SEQ ID NO: 171152 - RNA, 64 nt, Homo Sapiens; identical to SEQ ID NO: 171038

SEQ ID NO: 171153 - RNA, 64 nt, Homo Sapiens; identical to SEQ ID NO: 171039

SEQ ID NO: 171154 - RNA, 64 nt, Homo Sapiens; identical to SEQ ID NO: 171040

SEQ ID NO: 171155 - RNA, 64 nt, Homo Sapiens; identical to SEQ ID NO: 171041

SEQ ID NO: 171156 - RNA, 64 nt, Homo Sapiens; identical to SEQ ID NO: 171042

SEQ ID NO: 171157 - RNA, 64 nt, Homo Sapiens; identical to SEQ ID NO: 171043

SEQ ID NO: 171158 - RNA, 64 nt, Homo Sapiens; identical to SEQ ID NO: 171044

SEQ ID NO: 171159 - RNA, 64 nt, Homo Sapiens; identical to SEQ ID NO: 171045

SEQ ID NO: 171160 - RNA, 64 nt, Homo Sapiens; identical to SEQ ID NO: 171046

SEQ ID NO: 171161 - RNA, 64 nt, Homo Sapiens; identical to SEQ ID NO: 171047

SEQ ID NO: 171162 - RNA, 64 nt, Homo Sapiens; identical to SEQ ID NO: 171048

SEQ ID NO: 171163 - RNA, 64 nt, Homo Sapiens; identical to SEQ ID NO: 171049

SEQ ID NO: 171164 - RNA, 64 nt, Homo Sapiens; identical to SEQ ID NO: 171050

SEQ ID NO: 171165 - RNA, 64 nt, Homo Sapiens; identical to SEQ ID NO: 171051

SEQ ID NO: 171166 - RNA, 64 nt, Homo Sapiens; identical to SEQ ID NO: 171052

SEQ ID NO: 171167 - RNA, 64 nt, Homo Sapiens; identical to SEQ ID NO: 171053

SEQ ID NO: 171168 - RNA, 64 nt, Homo Sapiens; identical to SEQ ID NO: 171054

SEQ ID NO: 171169 - RNA, 64 nt, Homo Sapiens; identical to SEQ ID NO: 171055

SEQ ID NO: 171170 - RNA, 64 nt, Homo Sapiens; identical to SEQ ID NO: 171056

SEQ ID NO: 171171 - RNA, 64 nt, Homo Sapiens; identical to SEQ ID NO: 171057

SEQ ID NO: 171172 - RNA, 64 nt, Homo Sapiens; identical to SEQ ID NO: 171058

SEQ ID NO: 171173 - RNA, 64 nt, Homo Sapiens; identical to SEQ ID NO: 171059

SEQ ID NO: 171174 - RNA, 64 nt, Homo Sapiens; identical to SEQ ID NO: 171060

SEQ ID NO: 171175 - RNA, 64 nt, Homo Sapiens; identical to SEQ ID NO: 171061

SEQ ID NO: 171176 - RNA, 64 nt, Homo Sapiens; identical to SEQ ID NO: 171062

SEQ ID NO: 171177 - RNA, 64 nt, Homo Sapiens; identical to SEQ ID NO: 171063

SEQ ID NO: 171178 - RNA, 64 nt, Homo Sapiens; identical to SEQ ID NO: 171064

SEQ ID NO: 171179 - RNA, 64 nt, Homo Sapiens; identical to SEQ ID NO: 171065

SEQ ID NO: 171180 - RNA, 64 nt, Homo Sapiens; identical to SEQ ID NO: 171066

SEQ ID NO: 171181 - RNA, 64 nt, Homo Sapiens; identical to SEQ ID NO: 171067

SEQ ID NO: 171182 - RNA, 64 nt, Homo Sapiens; identical to SEQ ID NO: 171068

SEQ ID NO: 171183 - RNA, 64 nt, Homo Sapiens; identical to SEQ ID NO: 171069

SEQ ID NO: 171184 - RNA, 64 nt, Homo Sapiens; identical to SEQ ID NO: 171070

SEQ ID NO: 171185 - RNA, 64 nt, Homo Sapiens; identical to SEQ ID NO: 171071

SEQ ID NO: 171186 - RNA, 64 nt, Homo Sapiens; identical to SEQ ID NO: 171072

SEQ ID NO: 171187 - RNA, 64 nt, Homo Sapiens; identical to SEQ ID NO: 171073

SEQ ID NO: 171188 - RNA, 64 nt, Homo Sapiens; identical to SEQ ID NO: 171074

SEQ ID NO: 171189 - RNA, 64 nt, Homo Sapiens; identical to SEQ ID NO: 171075

SEQ ID NO: 171190 - RNA, 64 nt, Homo Sapiens; identical to SEQ ID NO: 171076

SEQ ID NO: 171191 - RNA, 64 nt, Homo Sapiens; identical to SEQ ID NO: 171077

SEQ ID NO: 171192 - RNA, 64 nt, Homo Sapiens; identical to SEQ ID NO: 171078

SEQ ID NO: 171193 - RNA, 64 nt, Homo Sapiens; identical to SEQ ID NO: 171079

SEQ ID NO: 171194 - RNA, 64 nt, Homo Sapiens; identical to SEQ ID NO: 171080

SEQ ID NO: 171195 - RNA, 64 nt, Homo Sapiens; identical to SEQ ID NO: 171081

SEQ ID NO: 171196 - RNA, 64 nt, Homo Sapiens; identical to SEQ ID NO: 171082

SEQ ID NO: 171197 - RNA, 64 nt, Homo Sapiens; identical to SEQ ID NO: 171083

SEQ ID NO: 171198 - RNA, 64 nt, Homo Sapiens; identical to SEQ ID NO: 171084

SEQ ID NO: 171199 - RNA, 63 nt, Homo Sapiens; identical to SEQ ID NO: 171085

SEQ ID NO: 171200 - RNA, 64 nt, Homo Sapiens; identical to SEQ ID NO: 171086

SEQ ID NO: 171201 - RNA, 64 nt, Homo Sapiens; identical to SEQ ID NO: 171087

SEQ ID NO: 171202 - RNA, 64 nt, Homo Sapiens; identical to SEQ ID NO: 171088

SEQ ID NO: 171203 - RNA, 64 nt, Homo Sapiens; identical to SEQ ID NO: 171089

SEQ ID NO: 171204 - RNA, 64 nt, Homo Sapiens; identical to SEQ ID NO: 171090

SEQ ID NO: 171205 - RNA, 64 nt, Homo Sapiens
cgucugcaccugaaaagugacccgcggaaacucuauggcggauuuuuuuuuuaacuuucuucuu

SEQ ID NO: 171206 - RNA, 64 nt, Homo Sapiens
cugucgcugaagcacuuaaguuaaucaauuaguaauggcggaaagaaguuuuaaugaauaaagu

SEQ ID NO: 171207 - RNA, 64 nt, Homo Sapiens
ccagggugagcagggcccucagaggaaaggcaguauggcggaggccaugggggccccucggcau

SEQ ID NO: 171208 - RNA, 64 nt, Homo Sapiens
gccagcucgggugaggggugaguggaggagacccauggcggacaaucacucucucugcucucag

SEQ ID NO: 171209 - RNA, 64 nt, Homo Sapiens
cagagguucccugcgaagacaugaggcuggacagauggcggaaggacuuugcagaggcguagga

SEQ ID NO: 171210 - RNA, 64 nt, Homo Sapiens
gugaaaggcaugucuuacgugaggcuucacaaucauggcggaagcacagguccgcguggcuggg

SEQ ID NO: 171211 - RNA, 64 nt, Homo Sapiens
aggaguaaggauggagaugcucagaaucaagagcauggcggaguaggagaagaagcccugcaca

SEQ ID NO: 171212 - RNA, 64 nt, Homo Sapiens
cacaccccaacacuuccagcauuuagcuggccacauggcggagaguuuuaauuuuuaacuuauu

SEQ ID NO: 171213 - RNA, 64 nt, Homo Sapiens
ccuggcccccgagguccccccuuaaaguaaccggauggcggacacgggacgauggcuuugccag

SEQ ID NO: 171214 - RNA, 64 nt, Homo Sapiens
cucccuugaaauuucacauuaguggguuccuuccauggcggauagugcccuggaggggccugac

SEQ ID NO: 171215 - RNA, 64 nt, Homo Sapiens
cugaggccacagcuggugaacaccuaggacugccauggcggaugcagcgguggagucuguguug

SEQ ID NO: 171216 - RNA, 64 nt, Homo Sapiens
ccuguagucccagcuacucgauuagccgggcgugauggcggacgucucuacuaaaaauacaaaa

SEQ ID NO: 171217 - RNA, 64 nt, Homo Sapiens
augaagucagaaagauuuguaagcauaucuacccauggcggaaaagucauuagcuuagaauaug

SEQ ID NO: 171218 - RNA, 64 nt, Homo Sapiens
uguacgguuuuggaccuauauuguucacguuuugauggcggagaggggugguccuggaggccca

SEQ ID NO: 171219 - RNA, 64 nt, Homo Sapiens
ugagaccagggcagcguucagcacacuccugggcauggcggaagcaggaagcagacuccagagg

SEQ ID NO: 171220 - RNA, 64 nt, Homo Sapiens
cucagcauuuguugauugaaaagaguaucuggccauggcggacagugugcugugacgacuguca

SEQ ID NO: 171221 - RNA, 64 nt, Homo Sapiens
auuuuauucugcuuuguccaauuaaauuauuccaauggcggaugguaauauucaccaucucuaa

SEQ ID NO: 171222 - RNA, 64 nt, Homo Sapiens
caaacgccgcugacugccacagcccagcuugccaauggcggacucccugccugccccgacaccc

SEQ ID NO: 171223 - RNA, 64 nt, Homo Sapiens
cugaggucaggaguucgagaccagccuggccaacauggcggaaccccaucuccacuaaaaguac

SEQ ID NO: 171224 - RNA, 64 nt, Homo Sapiens
gucucccccagcugccacacuucucucaauuuucauggcggaaucaaaucucuuuaccgggacc

SEQ ID NO: 171225 - RNA, 64 nt, Homo Sapiens
cuuggggucaggguuugagaccagccuggccaacauggcggaacccugucucuaccaaaauuac

SEQ ID NO: 171226 - RNA, 64 nt, Homo Sapiens
uucuuuccuaaauugcauugaauugauaggaaggauggcggaaucuuaaagugauacaugcuaa

SEQ ID NO: 171227 - RNA, 64 nt, Homo Sapiens
uuuuuguuuguuuauuuuaggcaaaaaaauucuuauggcggaguauguuuuuuuaaaaaaaaau

SEQ ID NO: 171228 - RNA, 64 nt, Homo Sapiens
agcaugugccacccccuuucccauguuuuuccagauggcggaaguuccgcccucccuuggaucu

SEQ ID NO: 171229 - RNA, 64 nt, Homo Sapiens
acauaagcguuaaaaauuguacauugauguuuugauggcggacuugcugcuuaaaaucuucagu

SEQ ID NO: 171230 - RNA, 64 nt, Homo Sapiens
ugacugcuugcugccuuuaaacucuccagcugugauggcggaacauuucugguucugagcguca

SEQ ID NO: 171231 - RNA, 64 nt, Homo Sapiens
gaguccugcacuaccaaaauggccuggccauuugauggcggagcuccaggggccuuggcuuucu

SEQ ID NO: 171232 - RNA, 64 nt, Homo Sapiens
guccaaauggauccuuuauuggcagacaugagacauggcggaguucccugaagugacucagcca

SEQ ID NO: 171233 - RNA, 64 nt, Homo Sapiens
gcaggggguccaggugggccacacaggggccaggauggcggaagauacggguggggagggaaga

SEQ ID NO: 171234 - RNA, 64 nt, Homo Sapiens
cuuccccagcuccaauauguagcagucucucuggauggcggagagugaaggagacggagaaacg

SEQ ID NO: 171235 - RNA, 64 nt, Homo Sapiens
gagggaccacuuggggccagccagacuggccucaauggcggacucagucacauugacugacggg

SEQ ID NO: 171236 - RNA, 64 nt, Homo Sapiens
gcgcaaggaggagcugcguggcggcgguggcgacauggcggagcccuccgaggcgggugacgcg

SEQ ID NO: 171237 - RNA, 64 nt, Homo Sapiens
agguuucagccagauugcaauaaagaagguagucauggcggagaguagagagacucugugaaag

SEQ ID NO: 171238 - RNA, 64 nt, Homo Sapiens
ggaaggggcgugguggcuagagacugggggcaggauggcggaaauugggagaggggcgcagcua

SEQ ID NO: 171239 - RNA, 64 nt, Homo Sapiens
aaggacagugcccgccagggaccauguauguaucauggcggaagaguuggcccugaccuggaau

SEQ ID NO: 171240 - RNA, 64 nt, Homo Sapiens
auuaauauauaauguauaaauucugcacugagccauggcggagcugggcagccccuagguuaga

SEQ ID NO: 171241 - RNA, 64 nt, Homo Sapiens
cucaccaggccguggccuucgaccaacccccaggauggcggaagcugcccccguccuaggugcc

SEQ ID NO: 171242 - RNA, 64 nt, Homo Sapiens
cugcuacucgugagcgccagucucagcucgcuggauggcggaagacuagccaacggccccagcu

SEQ ID NO: 171243 - RNA, 64 nt, Homo Sapiens
ccuauucucuaucuauuuugaaagauuuuggcacuauauuuaauuggaagguaaaauauuguac

SEQ ID NO: 171244 - RNA, 64 nt, Homo Sapiens
ccuuuagugaauuagaggauuuggcuacccugaguauauuuauauucauuucuucuguucuccu

SEQ ID NO: 171245 - RNA, 64 nt, Homo Sapiens
agcagauaacuuuuuugagucauugacuucauuuuauauuuaaaaaauuauggaauaucaucug

SEQ ID NO: 171246 - RNA, 64 nt, Homo Sapiens
cucuaggaacagaccucgcacuuucuguucuaaauauauuuauuccuacuauacaguaaaauac

SEQ ID NO: 171247 - RNA, 64 nt, Homo Sapiens
gggucucauuuaauggcccuguuuuuuucauuauuauauuuaaugauagggcaggauuucguau

SEQ ID NO: 171248 - RNA, 64 nt, Homo Sapiens
accacuuuuccuucuuguagacucagcucaccuguauauuuaaacuguucuuggcaucuugaaa

SEQ ID NO: 171249 - RNA, 64 nt, Homo Sapiens
ggauagugagaugcacacuuauauauauacuguauauauuuauauauuuauauauauauuucau

SEQ ID NO: 171250 - RNA, 64 nt, Homo Sapiens
agaugcacacuuauauauauacuguauauauuuauauauuuauauauauauuucauauauauau

SEQ ID NO: 171251 - RNA, 64 nt, Homo Sapiens
cgugcuuucucagguuacuguauaacuguuauaauauauuuaauauauaaaauuaagacuuuug

SEQ ID NO: 171252 - RNA, 64 nt, Homo Sapiens
ucauaaauucaggaagcacaauauauaccaaacauauauuuaaauaaaauccaggccuagacuc

SEQ ID NO: 171253 - RNA, 64 nt, Homo Sapiens
cuuccugaaacaaguucucaagaagucuuuacauuauauuuauaacucauauaaaaauuauauu

SEQ ID NO: 171254 - RNA, 64 nt, Homo Sapiens
gucuuuacauuauauuuauaacucauauaaaaauuauauuuagaauuuuuaaacauguacaaag

SEQ ID NO: 171255 - RNA, 64 nt, Homo Sapiens
aaugcugucaauauuuuacuguaauuuauguucuuauauuuauguauauuuguuaaaacuguaa

SEQ ID NO: 171256 - RNA, 64 nt, Homo Sapiens
uauaagauuuuuguaauaucuuucugcuauuggauauauuuauuaguuaauauauuuauuuauu

SEQ ID NO: 171257 - RNA, 64 nt, Homo Sapiens
uaucuuucugcuauuggauauauuuauuaguuaauauauuuauuuauuuuuugcuauuuaaugu

SEQ ID NO: 171258 - RNA, 64 nt, Homo Sapiens
acuuggacaugaaacuuuaaaaaaauucacagauuauauuuauaaccugacuagagcaggugau

SEQ ID NO: 171259 - RNA, 64 nt, Homo Sapiens
ucauagaaagucuccugcgggaugcccucuuuucuauauuuauucuugugcuguggggcugggg

SEQ ID NO: 171260 - RNA, 64 nt, Homo Sapiens
uuuuuaccauaccaacuucuaaaccgaacucaaauauauuuauugaaaaccuucaccucaucuu

SEQ ID NO: 171261 - RNA, 64 nt, Homo Sapiens
cacauacgugcuacccagaggucuaauauaauuuuauauuuacauguucugcacuggugcuaau

SEQ ID NO: 171262 - RNA, 64 nt, Homo Sapiens
uuuuaaaugcuugaguuuccuuuacauuuucagcuauauuuacuuagguucaaauuauaacuga

SEQ ID NO: 171263 - RNA, 64 nt, Homo Sapiens
uugaguggaauuugucagcagaauguaucaaggauauauuuaguaauuuacaaaaugucuuuuu

SEQ ID NO: 171264 - RNA, 64 nt, Homo Sapiens
uuuaaauacuuaccauaaagauaccacagguugguauauuuaguaauauauuaaaauguguaau

SEQ ID NO: 171265 - RNA, 64 nt, Homo Sapiens
ugaaaggcccaauuuguaaaauacauuagauaccuauauuuaaauaguaguauguauuacucuu

SEQ ID NO: 171266 - RNA, 64 nt, Homo Sapiens
ucagugggcacuuuuccauuggaagugaugaaauuauauuuauucagugguggaauuucugaag

SEQ ID NO: 171267 - RNA, 64 nt, Homo Sapiens
uuucuuguuuuauauauuuuuaugccaguuccuuuauauuuaaauauuucgggugguuuacguu

SEQ ID NO: 171268 - RNA, 64 nt, Homo Sapiens
ccauagaugugcuccuagucggaguaguuuugucuauauuuaaugucuauauuuaagguuucug

SEQ ID NO: 171269 - RNA, 64 nt, Homo Sapiens
guuucugggaguaguuuuguuaauaaagucugucuauauuuaaguuuuggcuuccuacauaaau

SEQ ID NO: 171270 - RNA, 64 nt, Homo Sapiens
ccaaagguuacuuugaauugcuggaaaguuuuaauauauuuagcauagaaguauagauuaauga

SEQ ID NO: 171271 - RNA, 64 nt, Homo Sapiens
uucuuugaagaggguucuguauuuuaacaucuaauauauuuaauaagcugcaucuuucuaccac

SEQ ID NO: 171272 - RNA, 64 nt, Homo Sapiens
acuguguuaaugaguagugaggguuuuuugccuauauauuuaugugauuuaaguuguuucuuag

SEQ ID NO: 171273 - RNA, 64 nt, Homo Sapiens
aaaaagcaaaagaaauucaaugugcaaaucagaauauauuuaaauaagugugcauuauuuuaca

SEQ ID NO: 171274 - RNA, 64 nt, Homo Sapiens
aauagaaaauagaauuaaauuuauauuuaguuauuauauuuaggauucauuguugagcagugau

SEQ ID NO: 171275 - RNA, 64 nt, Homo Sapiens
uauuauauuuaggaauagaaguugagcagugauuuauauuuagugaguuccaccuuuauucauu

SEQ ID NO: 171276 - RNA, 64 nt, Homo Sapiens
uaaacuguuauguuaauuaauuuagugcagaguuuauauuuagcguauugugccacugcagaac

SEQ ID NO: 171277 - RNA, 64 nt, Homo Sapiens
uuucuuuuauuauucagauguugcugaccagcauuauauuuauuuacugcuucuuaaaccagca

SEQ ID NO: 171278 - RNA, 64 nt, Homo Sapiens
cauaaugaauuauaacaguugccaguucaaaguguauauuuauuauguauaaagauuguacuua

SEQ ID NO: 171279 - RNA, 64 nt, Homo Sapiens
aauuguuucuugacaagcuggacaagcacuauuuuauauuuaaaaguggcacaaaaaaauauca

SEQ ID NO: 171280 - RNA, 64 nt, Homo Sapiens
acuagucaccugccauaagucauggaauaguuuuuauauuuacagcuuuuauauuuaaaacuug

SEQ ID NO: 171281 - RNA, 64 nt, Homo Sapiens
uaagucauggaauaguuuuuauauuuacagcuuuuauauuuaaaacuuguaagaguuuuuuuaa

SEQ ID NO: 171282 - RNA, 64 nt, Homo Sapiens
aauaaaaaaaaaaaaacuucaguuuucuaaaaauuauauuuaaaauuguaaucaaaauguaccu

SEQ ID NO: 171283 - RNA, 64 nt, Homo Sapiens
cagaauccuguaagauugcuguaacuggucuuuuuauauuuaagauaauuaaccacauguugua

SEQ ID NO: 171284 - RNA, 64 nt, Homo Sapiens
auauugaaccacacaagugcuuaagugguauggauauauuuagcaagauggggaaaauuuuguu

SEQ ID NO: 171285 - RNA, 64 nt, Homo Sapiens
guauucuaauauaauugaaaucaguuauuuauuguauauuuauucuuacauacccaaaagaaau

SEQ ID NO: 171286 - RNA, 64 nt, Homo Sapiens
aaauaaaggguuaccagaagauggaggaccuggauauauuuaucggauugggaaguggugggug

SEQ ID NO: 171287 - RNA, 64 nt, Homo Sapiens
cuuuucuggcuguaaaugguaacaaugaaaagaguauauuuaacaccuuuauacauuuucugaa

SEQ ID NO: 171288 - RNA, 64 nt, Homo Sapiens
uuacuguggagcgcuaacauuuuuucuguguaaauauauuuauucccauaaguuauuuauuccu

SEQ ID NO: 171289 - RNA, 64 nt, Homo Sapiens
uaaaaauuuuuaaauuaugguuaggaauaacuuuuauauuuauuuuguuaugcagauggcuucu

SEQ ID NO: 171290 - RNA, 64 nt, Homo Sapiens
ggaaccccuucauccucugauaauuauaauauacuauauuuaugauuuauaaauauauuuaaga

SEQ ID NO: 171291 - RNA, 64 nt, Homo Sapiens
auaauuauaauauacuauauuauguauuuauaaauauauuuaaguuuuuuaauuauuauuuaua

SEQ ID NO: 171292 - RNA, 64 nt, Homo Sapiens
uuugcaaacuuuucacuugucaugaauacaaguauauauuuaauguuaguuuguacuuauugau

SEQ ID NO: 171293 - RNA, 64 nt, Homo Sapiens
agcagccauggaauuccuauauuucuuugagaucuauauuuauauuuacaggcauugcccaaac

SEQ ID NO: 171294 - RNA, 64 nt, Homo Sapiens
caagugucuauugcuuaauuuaaguaauacaugcuauauuuauuuaaguguaaggcuuaacaaa

SEQ ID NO: 171295 - RNA, 64 nt, Homo Sapiens
ucuaguauauaugugguaaguuagagaagauccuuauauuuacaggauuaaggaauacagacua

SEQ ID NO: 171296 - RNA, 64 nt, Homo Sapiens
gaagaauuggagugacguauucaaggaggaaguuuauauuuaaguccuaagggguuaauauaaa

SEQ ID NO: 171297 - RNA, 64 nt, Homo Sapiens
uuuacauauguccuuauaugcauauuuuuuauuauauauuuaguguuuuauagaauuuuuuaaa

SEQ ID NO: 171298 - RNA, 64 nt, Homo Sapiens
gcuuacaaauaauauaacuuuucaaccuucuaguuauauuuauccaauaaagucauaaucggga

SEQ ID NO: 171299 - RNA, 64 nt, Homo Sapiens
guuguuggaggaaacugguugcuagucaauguucuauauuuaaugaaugugugauaaaucaucc

SEQ ID NO: 171300 - RNA, 64 nt, Homo Sapiens
guguguguguguguguguguguguguaugaaugguauauuuauuacauuauuuugaaagagaau

SEQ ID NO: 171301 - RNA, 64 nt, Homo Sapiens
aaaguauuuuuuguuuauucucuuaaaagaucacuauauuuaaauaaaagugaaggucagcaac

SEQ ID NO: 171302 - RNA, 64 nt, Homo Sapiens
uaacuugguaaucaugaaagcaucugagcuaacuuauauuuauuuauguuauauuuauuaaauu

SEQ ID NO: 171303 - RNA, 64 nt, Homo Sapiens
gaaagcaucugagcuaacuuauauuuauuuauguuauauuuauuaaauuauuuaucaaguguau

SEQ ID NO: 171304 - RNA, 64 nt, Homo Sapiens
guuugucuccugaaguuuguauuuaguuuuuggauauauuuaauuguaagcaaaguccaggucc

SEQ ID NO: 171305 - RNA, 64 nt, Homo Sapiens
auuuuauuuuuuuaagguacuaauccaccaaguuuauauuuagagauuacuguuuacugagccu

SEQ ID NO: 171306 - RNA, 64 nt, Homo Sapiens
aauggaauaucugcauuaauugaguauuccaaaauauauuuaauacauauguuugaaaaauccg

SEQ ID NO: 171307 - RNA, 64 nt, Homo Sapiens
auauuaauuacuaaaaaggcaacucagacaagauuauauuuaauagaaaaacagaccauuuaaa

SEQ ID NO: 171308 - RNA, 64 nt, Homo Sapiens
cuucaauuuuuuagcaacagaaacuucaauuuuuuauauuuaaagaauuuucacauuuauauuu

SEQ ID NO: 171309 - RNA, 64 nt, Homo Sapiens
cuucaauuuuuuauauuuaacgaauuuucacauuuauauuuaaaauaucuggggaaaaaagguc

SEQ ID NO: 171310 - RNA, 64 nt, Homo Sapiens
ucucccccugacacagagaaggggccuugguauuuauauuuaagaaaugaagauaauauuaaua

SEQ ID NO: 171311 - RNA, 64 nt, Homo Sapiens
uguaauuuuauguagaguuugagcugaagccccguauauuuaauuuauuuuguuaaacaugaaa

SEQ ID NO: 171312 - RNA, 64 nt, Homo Sapiens
augucaguguguguauucuguauguaaauauguuuauauuuauagagcaucaaucaauauaagc

SEQ ID NO: 171313 - RNA, 64 nt, Homo Sapiens
auuaagauucauccuuaugcuccugcaaguuucuuauauuuauguauuucuauucugauuucug

SEQ ID NO: 171314 - RNA, 64 nt, Homo Sapiens
cuacaaguucuauauauguagaaaugaauaaauauauauuuaaguacaguuuucaugaggaagu

SEQ ID NO: 171315 - RNA, 64 nt, Homo Sapiens
cauuucagaaaauucuucauagugguauuggccuuauauuuaacuuuuuuuuuauuuuuuuuuu

SEQ ID NO: 171316 - RNA, 64 nt, Homo Sapiens
ugauuaauccacauuuuaaaacuagguauaaacauauauuuacauucaauuuccuccaggcaug

SEQ ID NO: 171317 - RNA, 64 nt, Homo Sapiens
aaagaguacuuguacaaaaaccuguauauauguauauauuuaauuaaaauuagguccaguaaca

SEQ ID NO: 171318 - RNA, 64 nt, Homo Sapiens
gaaagaauacauuguaaaaaaucuugucaguuuuuauauuuaaagaaguugaaacacuauauuu

SEQ ID NO: 171319 - RNA, 64 nt, Homo Sapiens
uugucaguuuuuauauuuaaagaaguugaaacacuauauuuaucgaaaaaucacaaauaggcua

SEQ ID NO: 171320 - RNA, 64 nt, Homo Sapiens
auugcugagcuuuuuagauguauaauauauauuauauauuuagcuuauauauuauauauuuaua

SEQ ID NO: 171321 - RNA, 64 nt, Homo Sapiens
uauaauauauauuauauauuguauuuauauauuauauauuuauaauuucuugguaaaaacguau

SEQ ID NO: 171322 - RNA, 64 nt, Homo Sapiens
uuauuuuuguuuuuauagaugccuuguaaugauguauauuuaagaaaguugucuacaaaucuga

SEQ ID NO: 171323 - RNA, 64 nt, Homo Sapiens
auaaaauagggaaugaaugauuucacugcuaugauauauuuauuagaaaguuauccucucauuu

SEQ ID NO: 171324 - RNA, 64 nt, Homo Sapiens
uucggggagaggaucuuguuacuaauauguuuguuauauuuauuguguuuguuuagcuaugguu

SEQ ID NO: 171325 - RNA, 64 nt, Homo Sapiens
gaaguagaaaaaauguucuguuuucaauuucuuuuauauuuacguuuuuuuucuagguggugau

SEQ ID NO: 171326 - RNA, 64 nt, Homo Sapiens
auuugguuucugcaauauuuuauauaacaauuauuauauuuacacauuucaaucaaacauuucc

SEQ ID NO: 171327 - RNA, 64 nt, Homo Sapiens
aagaugauuaagacuuacauuucaacuucccacauauauuuacuccuguauaucuauuaaaaau

SEQ ID NO: 171328 - RNA, 64 nt, Homo Sapiens
aguuaauaaauuugugauuuaaaggacugauugauauauuuaagauauuucuugccauaauggu

SEQ ID NO: 171329 - RNA, 64 nt, Homo Sapiens
auaaauauauacaguaaauauuuaaaacaacauauauauuuaaauucugauaauuauuacacaa

SEQ ID NO: 171330 - RNA, 64 nt, Homo Sapiens
cagcuucacuugcagaucaccugaacaaagagaauauauuuauucuaauguugaguuuccauga

SEQ ID NO: 171331 - RNA, 64 nt, Homo Sapiens
uuagaaaugguuuggucugcaauaagcaagaagauauauuuagacuuuguaugugugucauuuu

SEQ ID NO: 171332 - RNA, 64 nt, Homo Sapiens
aguaugaucaaguaugaaaggaacuuuaaauucuuauauuuacuuuucucucaguaaauuguua

SEQ ID NO: 171333 - RNA, 64 nt, Homo Sapiens
cacucagcaaaagauuggcauuuguuaaguguucuauauuuaguacuaaaaucacagucaugaa

SEQ ID NO: 171334 - RNA, 64 nt, Homo Sapiens
uaauguugcauguuucaguggguuggaaguuuuguauauuuauuguauuaacacagagugucau

SEQ ID NO: 171335 - RNA, 64 nt, Homo Sapiens
aaaaaaggaacaguauucuuuauuuucuggguguuauauuuaaaaaagcaaguuuggauuuuua

SEQ ID NO: 171336 - RNA, 64 nt, Homo Sapiens
uaccuuuuuaaccccucugauuggcuauuauuacuauauuuauuauuauuuauugaaaccuuag

SEQ ID NO: 171337 - RNA, 64 nt, Homo Sapiens
cgucauucuuuaaacaaaaauacucaagaucauuuauauuuauuuggagagaaaacuguccuaa

SEQ ID NO: 171338 - RNA, 64 nt, Homo Sapiens
gguguauauuuuuuuucaaaaauucuguaacaaauauauuuaauguguugccauaaugucauuu

SEQ ID NO: 171339 - RNA, 64 nt, Homo Sapiens
gaaccuucuuggucaaauuguaauuagcuagcauuauauuuauauacagggucuuuuuucuuua

SEQ ID NO: 171340 - RNA, 64 nt, Homo Sapiens
uauauaauuucagcuuccuuuauuuugaccagaguauauuuaaguaauauuugugguucaugua

SEQ ID NO: 171341 - RNA, 64 nt, Homo Sapiens
guacacagggcuuugaaauaauuuuuggcuauuuuauauuuaguauaggucucaggcuuacuug

SEQ ID NO: 171342 - RNA, 64 nt, Homo Sapiens
cauaacauacugugauucauuaaaaaagaguggauauauuuaacucauccuggugccaggaaua

SEQ ID NO: 171343 - RNA, 64 nt, Homo Sapiens
gauuuuuuuuuucauccuggaccuacauaagagguauauuuaaaagauaugcaaagaagcuauu

SEQ ID NO: 171344 - RNA, 64 nt, Homo Sapiens
cuauauuaagggaccuugguaauaagccacacauuauauuuagaguugcuaaagauuucucuau

SEQ ID NO: 171345 - RNA, 64 nt, Homo Sapiens
aaugcuauauauaguauauguaauuauauauaaauauauuuaaauucuaaauuucaugugcaaa

SEQ ID NO: 171346 - RNA, 64 nt, Homo Sapiens
uguuugaaaaguucauuauaagguuuuccugauuuauauuuacauggcccaauuauuacauauc

SEQ ID NO: 171347 - RNA, 64 nt, Homo Sapiens
uggaaaauuauguauuuuaacauaaaagugguaguauauuuaagauagguuaaaagaaaaacac

SEQ ID NO: 171348 - RNA, 64 nt, Homo Sapiens
aaauaaaaauauguugaauuuuuaauuauauucauauauuuaaccaguuuacugaaggaauaua

SEQ ID NO: 171349 - RNA, 64 nt, Homo Sapiens
uauauucauauauuuaacaaguuuacugaaggaauauauuuaaucucuaguuuuguccaguuca

SEQ ID NO: 171350 - RNA, 64 nt, Homo Sapiens
uauaguuucagauauauaucuucuaauauauuuuuauauuuaguuaauauuaaaaauauggaac

SEQ ID NO: 171351 - RNA, 64 nt, Homo Sapiens
gaacuacgcuugcucauuuuuuaacaauuuccuuuauauuuaguauagcuauuacugucugguu

SEQ ID NO: 171352 - RNA, 64 nt, Homo Sapiens
uuguauauuagggaggaaaagcuuccuauauuuuuauauuuaccuuuaauuaguuuguaucuca

SEQ ID NO: 171353 - RNA, 64 nt, Homo Sapiens
uaauaugaagaaacuagguugugacagacuagauuauauuuaguaggggaaaaauugggcucaa

SEQ ID NO: 171354 - RNA, 64 nt, Homo Sapiens
agguguaacaguuucccaguuaacuuugaauuuauauauuuagauuuaaaggauuaaaaaaaag

SEQ ID NO: 171355 - RNA, 64 nt, Homo Sapiens
uuaaaaacauuucuauaaauauaaagcuuuucuuuauauuuaagacaaaauauaaaggcuagaa

SEQ ID NO: 171356 - RNA, 64 nt, Homo Sapiens
ugugcuuuagaaaaaaaauucaaauuuauaguaguauauuuacauuuuuguuguuguuguuguu

SEQ ID NO: 171357 - RNA, 64 nt, Homo Sapiens
gcugggauuacaggcaugagccacugcaccuggcuauauuuacauuuaauagaaacauaucuag

SEQ ID NO: 171358 - RNA, 64 nt, Homo Sapiens
aagaaaacugucaaaaucaguauauacuauuaguuauauuuaaaaauauuuuuuuaaauucuuu

SEQ ID NO: 171359 - RNA, 64 nt, Homo Sapiens
ugugcuaccuaaagcacuuagcacacaguuaaauuauauuuacauccuagacccaaauaaauag

SEQ ID NO: 171360 - RNA, 64 nt, Homo Sapiens
uuuucauaucauuuuuaaguggccugccucaauguauauuuauuucuuuugaaacaaaaagguu

SEQ ID NO: 171361 - RNA, 64 nt, Homo Sapiens
gcuuguggggaaaauaaaaacgcagagauccuuauauauuuauguuaaaguaauauuuuauuau

SEQ ID NO: 171362 - RNA, 64 nt, Homo Sapiens
cauguugguguucaaaguguagcaaaaaaugauguauauuuauaaaucuauuuauaccacuaua

SEQ ID NO: 171363 - RNA, 64 nt, Homo Sapiens
auaaaucuauuuauaccacuauaucauauguauauauauuuauaaccacuuaaauugugagcca

SEQ ID NO: 171364 - RNA, 64 nt, Homo Sapiens
cuagcugggaucauuuuugauccauugucauauuuauauuuaauuauuaaauguaucugaugau

SEQ ID NO: 171365 - RNA, 64 nt, Homo Sapiens
gacuuaauuccugaucaguauagacaggacuauauauauuuaaucagagaauuacauuauaucu

SEQ ID NO: 171366 - RNA, 64 nt, Homo Sapiens
gguuacuuacauuccuuuuuuggagaaagcacauuauauuuauucaaguguaaauaugucuaua

SEQ ID NO: 171367 - RNA, 64 nt, Homo Sapiens
aagaaccagauugaaaugagcaugccacauaaauuauauuuaauauauuaaagcaucaacauuu

SEQ ID NO: 171368 - RNA, 64 nt, Homo Sapiens
gaaauggagaguguuuauuuuuggaugaaaaacauauauuuaaaugggaggugcugugugaucc

SEQ ID NO: 171369 - RNA, 64 nt, Homo Sapiens
gaaguucaaauuacuaguguguuuguuauuuaaauauauuuauaugugcuaugugaauagcuau

SEQ ID NO: 171370 - RNA, 64 nt, Homo Sapiens
gacacaaauuaaaaagacaaauuaaaccugaaauuauauuuaaaauauauuugagacaugaaau

SEQ ID NO: 171371 - RNA, 64 nt, Homo Sapiens
acagaauaauuuugaaguuuuagaauaaauguaauauauuuacuauaauucuaaauguuuaaau

SEQ ID NO: 171372 - RNA, 64 nt, Homo Sapiens
uugaauuguaaaauauuuaaaaguaugaauaaaauauauuuauagguauuuaucagagaugauu

SEQ ID NO: 171373 - RNA, 64 nt, Homo Sapiens
auuucacuuuaaacaauuugauauagcuauuaaauauauuuaaggguuuuuuuuuuuugacaaa

SEQ ID NO: 171374 - RNA, 64 nt, Homo Sapiens
uaauuugaaacuuaagaaaaugaauuuauucuguuauauuuauguaacuuauuuccuggaaguu

SEQ ID NO: 171375 - RNA, 64 nt, Homo Sapiens
aauauaucagggcagugcauguaaaucauccugauauauuuaauauauuuauuauauugucccc

SEQ ID NO: 171376 - RNA, 64 nt, Homo Sapiens
gggcagugcauguaaaucauccugauauauuuaauauauuuauuauauugucccccgagguggg

SEQ ID NO: 171377 - RNA, 64 nt, Homo Sapiens
uucaauaucccaguaaacccauguauauuaucacuauauuuaauaaucacagucuagagauguu

SEQ ID NO: 171378 - RNA, 64 nt, Homo Sapiens
uaaugguagaaugcuuuuuuaugugcuagacuauuauauuuaguaguaugucauuguaacuagc

SEQ ID NO: 171379 - RNA, 64 nt, Homo Sapiens
uacuggggaaauugcuucacacugguuaugugaauauauuuaaauuuauauuuagauuuauaua

SEQ ID NO: 171380 - RNA, 64 nt, Homo Sapiens
uuuauauaacugguuaugugcuggagauugguuuuauauuuagagagugccaucuuaaaacuua

SEQ ID NO: 171381 - RNA, 64 nt, Homo Sapiens
cuuauaaguuugcauuaugagguagcaucauguauauauuuauguagugguuacauugccauuu

SEQ ID NO: 171382 - RNA, 64 nt, Homo Sapiens
gaaguccagaaaucauacuguguauauauguauguauauuuaagguacuguauaucuguauaua

SEQ ID NO: 171383 - RNA, 64 nt, Homo Sapiens
uuuuuaaggugguaccaaaaaugaaugucugucauauauuuauauuacaaauacauuauauuua

SEQ ID NO: 171384 - RNA, 64 nt, Homo Sapiens
gaaugucugucauauauuuauauuacaaauacauuauauuuauguucuauucaucuuuugaaug

SEQ ID NO: 171385 - RNA, 64 nt, Homo Sapiens
ugauuggauacuauucaucauauugccuauaauauauauuuaccgauaagcagugaguguaaaa

SEQ ID NO: 171386 - RNA, 64 nt, Homo Sapiens
auucauuuuuagugaacccuguaauuuauucguguauauuuacuaaacagcuguaucuuugaaa

SEQ ID NO: 171387 - RNA, 64 nt, Homo Sapiens
uuucuucacugagauuccaguguacaugagaacauauauuuauugcaugauuuucuagauacac

SEQ ID NO: 171388 - RNA, 64 nt, Homo Sapiens
uggguaguauuugggagagggaaaggcuguacuauauauuuauuucuaaauguuuugacugggc

SEQ ID NO: 171389 - RNA, 64 nt, Homo Sapiens
aaacuuucuaaccuauguauucaacuucuguauuuauauuuaaucagugguucauguuauauaa

SEQ ID NO: 171390 - RNA, 64 nt, Homo Sapiens
ucauuucacucuguacuauaauaugugccuaaauuauauuuaaaauaaucuauuuucauaauca

SEQ ID NO: 171391 - RNA, 64 nt, Homo Sapiens
gaauuccuagaugcaguaugacaacauaugcaauuauauuuauugauuuuaauuuauggaaagc

SEQ ID NO: 171392 - RNA, 64 nt, Homo Sapiens
uuuuugcuuauuuuacaaauauuuauauuuaaauuauauuuaccaauugauauuucuguguagu

SEQ ID NO: 171393 - RNA, 64 nt, Homo Sapiens
uuauauuuaccuuuuugcuuuucuguguaguauuuauauuuaaaagcucuaugucaauugauau

SEQ ID NO: 171394 - RNA, 64 nt, Homo Sapiens
auuuacuuuuuuuuacuuuuaaaccacuauuauuuauauuuauaaaaaaaucuguuaauuaggu

SEQ ID NO: 171395 - RNA, 64 nt, Homo Sapiens
caagugaugcacuuuaugaugauuuucuuuuuaauauauuuagcuguuauacuguauuauggcu

SEQ ID NO: 171396 - RNA, 64 nt, Homo Sapiens
ugucuguauucuaccccuuucaucaagucuuuuuuauauuuaugaaauacuuuuuaaaguuuac

SEQ ID NO: 171397 - RNA, 64 nt, Homo Sapiens
gccugaguaaaguuaaaagagaaugauauauaaauauauuuauaauuuacucuaaaaacugauu

SEQ ID NO: 171398 - RNA, 64 nt, Homo Sapiens
uuagcacauuuauuaugugugacugcaucugauuuauauuuaaauuggcagguuuugagggauu

SEQ ID NO: 171399 - RNA, 64 nt, Homo Sapiens
agccuugaaaauggaguguuguuguuucuaaacauauauuuaugucauuuauuaaguacaguuc

SEQ ID NO: 171400 - RNA, 64 nt, Homo Sapiens
aaaacuugcagaguauuguguugggguuguguuuuauauuuaggcauugggggaugggguggga

SEQ ID NO: 171401 - RNA, 64 nt, Homo Sapiens
uauauauauauauaaauauagcagguuacauauauauauuuauaaugugucuuuuuauuaacca

SEQ ID NO: 171402 - RNA, 64 nt, Homo Sapiens
aagcuuagugaaacacaaaauuaaauagaagaaauauauuuauacugaaaagagacguaguaaa

SEQ ID NO: 171403 - RNA, 64 nt, Homo Sapiens
uuuuaaagcauguuuacuuuacuaauacaagaucuauauuuaaggaucuugauccuguuguggg

SEQ ID NO: 171404 - RNA, 64 nt, Homo Sapiens
guguauuuauuguuacaaguucaauguguauauuuauauuuaaaacuuuuauaugugugggaua

SEQ ID NO: 171405 - RNA, 64 nt, Homo Sapiens
uuuaaaguguauuuauuguugggauaucaauguguauauuuauaagcaugacuuuuauaugugu

SEQ ID NO: 171406 - RNA, 64 nt, Homo Sapiens
ggugccucgacacucacgaaggacggcagacagcuauauuuagugaagagcccgcauaaugagu

SEQ ID NO: 171407 - RNA, 64 nt, Homo Sapiens
uuauaagauuaaacugacuuaggugacuaaaugauauauuuauaacaccucuggggauaagcug

SEQ ID NO: 171408 - RNA, 64 nt, Homo Sapiens
cuaggaugcugaguaucuacauggauacauuaaauauauuuaugcgaguugcaacuaugcuggc

SEQ ID NO: 171409 - RNA, 64 nt, Homo Sapiens
ugagacauuuguaaguucuuugauacagaagaguuauauuuagaagucuuuaaugaagggaaag

SEQ ID NO: 171410 - RNA, 64 nt, Homo Sapiens
uacaggauguaauaggucagguauuugguuuacuuauauuuaacaaugucuuaugaauuuuuuu

SEQ ID NO: 171411 - RNA, 64 nt, Homo Sapiens
uuuguaaacauuuuguggguacauaguacauguauauauuuacgggguaugugagauguuuuga

SEQ ID NO: 171412 - RNA, 64 nt, Homo Sapiens
augaauuuaaucgggcccuugguggaaacauuuauauauuuaaugcagaugcauaguguuuuuc

SEQ ID NO: 171413 - RNA, 64 nt, Homo Sapiens
auauaauaucaacuauucuaaauacagguaaugguauauuuaaggcuaccauaacauccuauuu

SEQ ID NO: 171414 - RNA, 64 nt, Homo Sapiens
uguuaagagccugagcuuaguuuauuuugugcauuauauuuauagggugguuuuuugcaguaua

SEQ ID NO: 171415 - RNA, 64 nt, Homo Sapiens
uugugcauuauauuuauauggugguuuuuugcaguauauuuauuauacagcaauuuguaggugg

SEQ ID NO: 171416 - RNA, 64 nt, Homo Sapiens
cuauuuugcuaugaguggccuucucugcaguauuuauauuuauagaauaccauauaagaauauu

SEQ ID NO: 171417 - RNA, 64 nt, Homo Sapiens
ugaaguaaaucacuugacaauaagaucaagaaauuauauuuauacauaauaauuuuaugaaagu

SEQ ID NO: 171418 - RNA, 64 nt, Homo Sapiens
aacuguucaaaagcaaaagagacuuagcuauuaguauauuuaaaccgggaccuggcuggcaaau

SEQ ID NO: 171419 - RNA, 64 nt, Homo Sapiens
aaguagcgcugcggcuaagauuucaaaguauaaauauauuuauuggaaaaaucgguuaucauaa

SEQ ID NO: 171420 - RNA, 64 nt, Homo Sapiens
ggguauuugaaagauagaaggaucuagaaaugcauauauuuagcagguacaaaaaaaugcugca

SEQ ID NO: 171421 - RNA, 64 nt, Homo Sapiens
aagagguauagaagcucuucgaagcauuuucugauauauuuaauuagcuaauuaaucugcauau

SEQ ID NO: 171422 - RNA, 64 nt, Homo Sapiens
acuagaucuauuaauacauuucugagacaaguauuauauuuaaaucaaaauuuuuaucuuuaaa

SEQ ID NO: 171423 - RNA, 64 nt, Homo Sapiens
gaaugaauauaauuauuuauuuguauuuauaauuuauauuuacaaguugucacaaaaauagauu

SEQ ID NO: 171424 - RNA, 64 nt, Homo Sapiens
ucugacuuguaaauguagcugcuaaaguaugagguauauuuaagaagaauagauuaguuucauu

SEQ ID NO: 171425 - RNA, 64 nt, Homo Sapiens
ccugauaguccaaggaaccaccuuucucccuugauauauuuaacuccgucuuuggccugacaac

SEQ ID NO: 171426 - RNA, 64 nt, Homo Sapiens
ugcugcuauacaacugcuuugcaacaguugcugguauauuuaaaucauuaaauuucagcauuua

SEQ ID NO: 171427 - RNA, 64 nt, Homo Sapiens
agaagagaagaucuugagugcuccaucccuuuucuauauuuauaugauuuuacuugaaaacaag

SEQ ID NO: 171428 - RNA, 64 nt, Homo Sapiens
cucucuauuauacaccaguggccaagugaaauaauauauuuacuagguucuuugccagcaccau

SEQ ID NO: 171429 - RNA, 64 nt, Homo Sapiens
guggaaugucaaugccaggaguaaaguauagaaauauauuuaauguggucaguugaaccuuaca

SEQ ID NO: 171430 - RNA, 50 nt, Homo Sapiens
ggcacugagaaacaugcaaguauauuuaauuaagaagaaauagaagauaa

SEQ ID NO: 171431 - RNA, 64 nt, Homo Sapiens
caaauaguaauguauuuuucugcauucacuuggauauauuuagaaucacuuuuuuccuccugua

SEQ ID NO: 171432 - RNA, 64 nt, Homo Sapiens
ugcauuuucaaaagaagauuuguaagaauuaaacuauauuuaugaguaaacuuuugagguuucu

SEQ ID NO: 171433 - RNA, 64 nt, Homo Sapiens
aacuucuguguuaauacuggcuuaaagcugaauuuauauuuaguuuuuagaacccagcaguuac

SEQ ID NO: 171434 - RNA, 64 nt, Homo Sapiens
ugcuacuaaauuuuuauaauaaccauuuuggggcuauauuuacagaaauggggauuauuauagc

SEQ ID NO: 171435 - RNA, 64 nt, Homo Sapiens
aaggauucugggagauggucuuacauauguauaauauauuuauaucagugcuaaucuagccaaa

SEQ ID NO: 171436 - RNA, 64 nt, Homo Sapiens
uauuuaaacaaacugggggguuuucagcugcucauauauuuaguaugcuucugauguggaauaa

SEQ ID NO: 171437 - RNA, 64 nt, Homo Sapiens
uuuucacucaucuaaaaaguuagcaucuuuaggauauauuuacauuugaaaaaaaucugccaaa

SEQ ID NO: 171438 - RNA, 64 nt, Homo Sapiens
uguuaaaacacuaaauauagaauguuaaaacaucuauauuuaaaauauucaauagauuuuugua

SEQ ID NO: 171439 - RNA, 64 nt, Homo Sapiens
agagccacgugaaacccaugauuaauaugauuaauauauuuagauuguauaggaccagugucuu

SEQ ID NO: 171440 - RNA, 64 nt, Homo Sapiens
uuacuuuuuguuacucuuuauugugugaguuuaguauauuuaauguuucauuuuauucuaccug

SEQ ID NO: 171441 - RNA, 64 nt, Homo Sapiens
caauaauacuaucuuuuauauuauauagcuauaguauauuuaaauucuguguguuacuuucuuu

SEQ ID NO: 171442 - RNA, 64 nt, Homo Sapiens
aaauauauucuucaaaaauguuuuaggcauuauguauauuuaaaauguaauuucaguuuggagc

SEQ ID NO: 171443 - RNA, 64 nt, Homo Sapiens
uuugcuuauuuuaucccagauugagaugaaaauauauauuuaucuuaacuguguuauuucugcu

SEQ ID NO: 171444 - RNA, 64 nt, Homo Sapiens
cucaaggaaauacagaucggaagugcugaugaguuauauuuauugaaaacccaacuuuuaagga

SEQ ID NO: 171445 - RNA, 64 nt, Homo Sapiens
aaauaaauuuauguuguccugugccauaaagugauauauuuaauauuuuuauucuuugguuuug

SEQ ID NO: 171446 - RNA, 64 nt, Homo Sapiens
uauguauacacauauauauacacacacacauauauauauuuagaaacgugaguguuaaagauag

SEQ ID NO: 171447 - RNA, 64 nt, Homo Sapiens
aagagaucuugcaggaagagauuguauuagauauuauauuuauuucauuuaagauaauuuucaa

SEQ ID NO: 171448 - RNA, 64 nt, Homo Sapiens
cagcuuuaacauauaauauuuugaauauuuuagcuauauuuaguggcuuucugcaagcaacuag

SEQ ID NO: 171449 - RNA, 64 nt, Homo Sapiens
uauuaauguauuaaaaagaaaauacaacaaaauguauauuuagacacgagcuuacauggcauac

SEQ ID NO: 171450 - RNA, 64 nt, Homo Sapiens
uaacuuuguaauauaacaugagcuuugcaaccuauauauuuauaauuuuaaucauuauuuuaaa

SEQ ID NO: 171451 - RNA, 64 nt, Homo Sapiens
uauuuguuuugguaggacagucuuaaaccguaacuauauuuaauagacgaguuccaaauuacgu

SEQ ID NO: 171452 - RNA, 64 nt, Homo Sapiens
cggugccuaagaaguuauuuucuuguuuaacauauauauuuauuaauuuauuugucguguugga

SEQ ID NO: 171453 - RNA, 64 nt, Homo Sapiens
gggaacaucacccuauauauaauuugaguguauauauauuuauauauaugauguggacauaugu

SEQ ID NO: 171454 - RNA, 64 nt, Homo Sapiens
cucaagacaaugcaccuagccuggugugccucaguauauuuaaaguuuugaauccuuugccugc

SEQ ID NO: 171455 - RNA, 64 nt, Homo Sapiens
gcauuaaaccugucuccacuugaaugauucauguuauauuuaauaaacacgaaacuuguuauug

SEQ ID NO: 171456 - RNA, 64 nt, Homo Sapiens
aaacagauuuuuacaaaugaguacuuuuaugauguauauuuauuuauuguugguaauuauuuug

SEQ ID NO: 171457 - RNA, 64 nt, Homo Sapiens
gugcuucgagugacugacccgaaggaccacauuuuauauuuauuagguuaucaaaaauuucaug

SEQ ID NO: 171458 - RNA, 64 nt, Homo Sapiens
cauaccuugcauugaaaauuugcuaaauaaacuuuauauuuauaacuuauuuuucuaaacacua

SEQ ID NO: 171459 - RNA, 64 nt, Homo Sapiens
guaaugaaaagacuuuuuaacuuuauaucucauguauauuuauaagagcaccuguguuguacug

SEQ ID NO: 171460 - RNA, 64 nt, Homo Sapiens
uccaacuaaaagggauuaauuuuuggcauuuuuguauauuuaugcauuaggugaugggacuuuu

SEQ ID NO: 171461 - RNA, 64 nt, Homo Sapiens
uugaaagcaguuuuauguauaaauaacaaauguuuauauuuaacuaaauguaagguacgaauua

SEQ ID NO: 171462 - RNA, 64 nt, Homo Sapiens
ucugucuguaaaauacuuuuuuuaagaaagcauuuauauuuauaugacagcuugaacugacaac

SEQ ID NO: 171463 - RNA, 64 nt, Homo Sapiens
uauagaugucaaaacauuaaccagauuaaaguaauauauuuaagaguaaauuuugcuugcaugu

SEQ ID NO: 171464 - RNA, 64 nt, Homo Sapiens
cuacuggugguuuugauauuguuuguuuaagauguauauuuagaaugacaucaucuaagaagcu

SEQ ID NO: 171465 - RNA, 64 nt, Homo Sapiens
aaauuauaucauacugauacuugacaaugucccauauauuuaaguuucauaugaaucacagcug

SEQ ID NO: 171466 - RNA, 64 nt, Homo Sapiens
uaaagccuuacugaagaauaaaggucaauaggcuuauauuuaauaauauuaaaauugugaagca

SEQ ID NO: 171467 - RNA, 64 nt, Homo Sapiens
uuaauuuuaugaaaauuaugcucaauaagaguuguauauuuaauauauuugcagugaacacaga

SEQ ID NO: 171468 - RNA, 64 nt, Homo Sapiens
ucugacaagguagagguccagguucaccuuuauauauauuuaaaacaauuaguacugaauugga

SEQ ID NO: 171469 - RNA, 64 nt, Homo Sapiens
ugcaaguguacagaucuguguagaggaauguguguauauuuaccucuucguuugcucaaacaug

SEQ ID NO: 171470 - RNA, 64 nt, Homo Sapiens
gucauaaggagacuauaacucuacagauugugaauauauuuauuuucaaguugcauucuuuguc

SEQ ID NO: 171471 - RNA, 64 nt, Homo Sapiens
acagaaagcacacaccuaugcaauauggcuuaucuauauuuauuuguaaaaauccaagcauagu

SEQ ID NO: 171472 - RNA, 64 nt, Homo Sapiens
cuuagauaguauuaauauacugagccuuggauuauauauuuaauauaggaccuauuuugaauau

SEQ ID NO: 171473 - RNA, 64 nt, Homo Sapiens
uuucugaucuguacuuuguguuuagcuaccuuuuuauauuuaaaaaauuaaaaaugaaaauuac

SEQ ID NO: 171474 - RNA, 64 nt, Homo Sapiens
ugcaguuucauguauguauauaaucaugcucauguauauuuaguuacguauaaugcuuucugag

SEQ ID NO: 171475 - RNA, 64 nt, Homo Sapiens
auuaaaacaguauuugaguuuaaaagaguuuguauauauuuaaaugaauaacuuuuuauacucu

SEQ ID NO: 171476 - RNA, 64 nt, Homo Sapiens
agccacccggguuuaguucagccauuucaagaaguauauuuaacgucgguaguucugcuuuauu

SEQ ID NO: 171477 - RNA, 64 nt, Homo Sapiens
uguuaacauuuagggcauaggcuuauuuugaagguauauuuaucuggaaacauuuuuauugcuu

SEQ ID NO: 171478 - RNA, 64 nt, Homo Sapiens
ggauggacucuucaaaacuuaaaucaaacaaaucuauauuuaaucaagaagaugacauuucaga

SEQ ID NO: 171479 - RNA, 64 nt, Homo Sapiens
ugagcuuuucuuuccugggguauauuaauuuaguuauauuuagcagaagaggaauauaaccaaa

SEQ ID NO: 171480 - RNA, 64 nt, Homo Sapiens
uacagcaaggugcucuaaguaauauucgauaaaauauauuuaauagaaauuugcguuugauauu

SEQ ID NO: 171481 - RNA, 64 nt, Homo Sapiens
ucuauuuuauucuaacauaaaaaaacuuccauuauauauuuacuaaguauauuuaauucacuua

SEQ ID NO: 171482 - RNA, 64 nt, Homo Sapiens
aacauaaaaaaacuuccauuauauauuuacuaaguauauuuaauucacuuaacucugucuuuau

SEQ ID NO: 171483 - RNA, 64 nt, Homo Sapiens
auuuacuucucccccaauuuuaaagaaguauguguauauuuaauaggggaagguaguuuaugga

SEQ ID NO: 171484 - RNA, 64 nt, Homo Sapiens
gguuuugugguccugaugggcccacaaguuuuucuauauuuaacuggaaauaugcuuugauuuu

SEQ ID NO: 171485 - RNA, 64 nt, Homo Sapiens
auuauguggcuaaagugcucuauuuauuaagaacuauauuuaauaccaccaacaaauauagggg

SEQ ID NO: 171486 - RNA, 64 nt, Homo Sapiens
uugaaaugggaacaauaucaauauggugucuugauauauuuauaaauaugugauuaucauuuau

SEQ ID NO: 171487 - RNA, 64 nt, Homo Sapiens
gaaaggagaaauguuagauucuuuauuauuuuauuauauuuauauggaaagcucgacucucccu

SEQ ID NO: 171488 - RNA, 64 nt, Homo Sapiens
auuuuaauuguaugauuuggucauaaguaaggacuauauuuaugucaccauuauuagauauaug

SEQ ID NO: 171489 - RNA, 64 nt, Homo Sapiens
uguugauagaauaucauaugcacugggaguuaaauauauuuaauuuaaugaucauuauauaugu

SEQ ID NO: 171490 - RNA, 64 nt, Homo Sapiens
uucuacucccaggaugaaauuauccaacuacauauauauuuagaggaagaaagugaaggggaaa

SEQ ID NO: 171491 - RNA, 64 nt, Homo Sapiens
gaugcaguguccugcccaguuagaucucucgaauuauauuuauagaaguacuaugugugaguua

SEQ ID NO: 171492 - RNA, 64 nt, Homo Sapiens
aauaaauaugaaaaaccccuguuuaauuucuuuguauauuuaaaagaaaauauuucuauuaaug

SEQ ID NO: 171493 - RNA, 64 nt, Homo Sapiens
uaucagguaucuugcaguuggaauaguaaguugauauauuuauuaccagcuccauucuuuucau

SEQ ID NO: 171494 - RNA, 64 nt, Homo Sapiens
uuuuucuaugaaaaguuauguacaauucagggaauauauuuauauuaaaauuauuuuuuugucu

SEQ ID NO: 171495 - RNA, 64 nt, Homo Sapiens
acuugccugguuucuaaaccauauugugcaaacuuauauuuaaaaugauguauauuuaauguua

SEQ ID NO: 171496 - RNA, 64 nt, Homo Sapiens
guuaauauugugcaaacuuaccuuauuuaugauguauauuuaauaucaguuuuauauuuauaag

SEQ ID NO: 171497 - RNA, 64 nt, Homo Sapiens
agccuuauuuaugauguauaauuuuuaucaguuuuauauuuauauaauuuaucgauuuuuauca

SEQ ID NO: 171498 - RNA, 64 nt, Homo Sapiens
ucauaaaauaguauguuaauauguuuuuacuuuauauauuuauauauuaaaauauauuuaauau

SEQ ID NO: 171499 - RNA, 64 nt, Homo Sapiens
auauguuuuuacuuuauauauuuauauauuaaaauauauuuaauauguuuugccuuuguggccc

SEQ ID NO: 171500 - RNA, 64 nt, Homo Sapiens
aagccucaggcaucaugucaauggguguuucccucaagcuuaguuggcagcacucuccacacuu

SEQ ID NO: 171501 - RNA, 64 nt, Homo Sapiens
uuuacugugacugcacgugguggaaagggacuagcaagcuuaccccauucaugagggcucuccc

SEQ ID NO: 171502 - RNA, 64 nt, Homo Sapiens; identical to SEQ ID NO: 117373

SEQ ID NO: 171503 - RNA, 64 nt, Homo Sapiens; identical to SEQ ID NO: 117374

SEQ ID NO: 171504 - RNA, 64 nt, Homo Sapiens; identical to SEQ ID NO: 117375

SEQ ID NO: 171505 - RNA, 64 nt, Homo Sapiens; identical to SEQ ID NO: 117376

SEQ ID NO: 171506 - RNA, 64 nt, Homo Sapiens; identical to SEQ ID NO: 117377

SEQ ID NO: 171507 - RNA, 64 nt, Homo Sapiens; identical to SEQ ID NO: 117378

SEQ ID NO: 171508 - RNA, 64 nt, Homo Sapiens; identical to SEQ ID NO: 117379

SEQ ID NO: 171509 - RNA, 64 nt, Homo Sapiens; identical to SEQ ID NO: 117380

SEQ ID NO: 171510 - RNA, 64 nt, Homo Sapiens; identical to SEQ ID NO: 117381

SEQ ID NO: 171511 - RNA, 64 nt, Homo Sapiens; identical to SEQ ID NO: 117382

SEQ ID NO: 171512 - RNA, 64 nt, Homo Sapiens; identical to SEQ ID NO: 117383

SEQ ID NO: 171513 - RNA, 64 nt, Homo Sapiens; identical to SEQ ID NO: 117384

SEQ ID NO: 171514 - RNA, 64 nt, Homo Sapiens; identical to SEQ ID NO: 117385

SEQ ID NO: 171515 - RNA, 64 nt, Homo Sapiens; identical to SEQ ID NO: 117386

SEQ ID NO: 171516 - RNA, 64 nt, Homo Sapiens; identical to SEQ ID NO: 117387

SEQ ID NO: 171517 - RNA, 64 nt, Homo Sapiens; identical to SEQ ID NO: 117388

SEQ ID NO: 171518 - RNA, 64 nt, Homo Sapiens; identical to SEQ ID NO: 117389

SEQ ID NO: 171519 - RNA, 64 nt, Homo Sapiens; identical to SEQ ID NO: 117390

SEQ ID NO: 171520 - RNA, 64 nt, Homo Sapiens; identical to SEQ ID NO: 117391

SEQ ID NO: 171521 - RNA, 64 nt, Homo Sapiens; identical to SEQ ID NO: 117392

SEQ ID NO: 171522 - RNA, 64 nt, Homo Sapiens; identical to SEQ ID NO: 117393

SEQ ID NO: 171523 - RNA, 64 nt, Homo Sapiens; identical to SEQ ID NO: 117394

SEQ ID NO: 171524 - RNA, 64 nt, Homo Sapiens
aaguauucuucagucaguggauuuuagcaaggggagguaggaguggaagagaggugugaagaaa

SEQ ID NO: 171525 - RNA, 64 nt, Homo Sapiens
cagcccaucaugagauuuugguggauuuaauggcagguaggaacuuauuuauaguggauugaua

SEQ ID NO: 171526 - RNA, 64 nt, Homo Sapiens
uacagccaaaguggauguuucuauuuggcaaggaagguaggauuucugaaacucaggccuuaac

SEQ ID NO: 171527 - RNA, 64 nt, Homo Sapiens
gaggcuagaccuuuaacuuccagcuauuaaaacaagguaggaauuuagcuauuuauauuaggua

SEQ ID NO: 171528 - RNA, 64 nt, Homo Sapiens
aauugaucauuauaaagauucugcauguaaaaggagguaggaugccuagccugucauuuuucag

SEQ ID NO: 171529 - RNA, 64 nt, Homo Sapiens
ccuugguuucuaggaugguuuuguguggagggggagguaggacugggcuggaugagagagcaca

SEQ ID NO: 171530 - RNA, 64 nt, Homo Sapiens
ggguaagguugcgauuauggguaagauuggccagagguaggaauguggggagaaggagaggcug

SEQ ID NO: 171531 - RNA, 64 nt, Homo Sapiens
gggggcccccuuccaugacucuguccccugggggagguaggacagggcugggcuucccucucau

SEQ ID NO: 171532 - RNA, 64 nt, Homo Sapiens
uuucucuguacauaguuuucuggcgggauaggggagguaggauggaugggguuuggggugggua

SEQ ID NO: 171533 - RNA, 64 nt, Homo Sapiens
agggcucaaaguaaaacuuuccugcuagcuuguaagguaggaaugguuggcuugcccaagguca

SEQ ID NO: 171534 - RNA, 64 nt, Homo Sapiens
gguuaugaugucuucacugugaagcuugugaaguagguaggacagaucuaguugaucgguagag

SEQ ID NO: 171535 - RNA, 64 nt, Homo Sapiens
cugcaguguggaguucaccuuggaagggcguucuagguaggaagagcccgcagggccaugcaga

SEQ ID NO: 171536 - RNA, 64 nt, Homo Sapiens
ccugugccucugaaguucuagccaugagguuuccagguaggacagcugcuccccaagccuccug

SEQ ID NO: 171537 - RNA, 64 nt, Homo Sapiens
ucaaggaaagccucuaaggaagaugggaugcuucagguaggacaguacuguacuggagaauaac

SEQ ID NO: 171538 - RNA, 64 nt, Homo Sapiens
agcagauaugggccaucugugaaaagugaugcugagguaggaucuuguuucugcaaaauaccua

SEQ ID NO: 171539 - RNA, 64 nt, Homo Sapiens
aauaagguugaggacagugacaguuuauguuauuagguaggaaauagugaugugggauaaccuu

SEQ ID NO: 171540 - RNA, 64 nt, Homo Sapiens
uuuccuagaccauuuggggucgugggcagguaggagguaggaugauauaacagugguaacagug

SEQ ID NO: 171541 - RNA, 64 nt, Homo Sapiens
uaggauguuuccuagaccauaacagugcgugggcagguaggaggaccauagauauaacaguggu

SEQ ID NO: 171542 - RNA, 64 nt, Homo Sapiens
uugaacagcauggcucagaggugauacugauugccacauuaagguucuucaguucacugcccau

SEQ ID NO: 171543 - RNA, 64 nt, Homo Sapiens
uugaacaacauggcucagaggugauacugauucccacauuaagguucuucaguucacuacucau

SEQ ID NO: 171544 - RNA, 64 nt, Homo Sapiens
guacuuugcaggaaauccuugcugcugauuuaaacacauuaaagaauagcauguccuaaugcuu

SEQ ID NO: 171545 - RNA, 64 nt, Homo Sapiens
gacucuucccucaaauguguguuuugccaauuugcacauuaaauguccccucuccuccacauuu

SEQ ID NO: 171546 - RNA, 64 nt, Homo Sapiens
aaagggcuauucgaaaucuuauuuuuuuuuuuuacacauuaacuucuuaggaauugccucaggc

SEQ ID NO: 171547 - RNA, 64 nt, Homo Sapiens
aguaugguuuccaaaauaugcaccuacugauauucacauuaaaugcagcccauggcacaacuaa

SEQ ID NO: 171548 - RNA, 64 nt, Homo Sapiens
acauuuucccaccauaaacucuguuugcuuauuccacauuaauuuacuuuucucuauaccaaau

SEQ ID NO: 171549 - RNA, 64 nt, Homo Sapiens
guuuaauauuuaaauaucaaccaguguaauucagcacauuaauaaaguaaaaaagaaaaccaua

SEQ ID NO: 171550 - RNA, 64 nt, Homo Sapiens
auuuguuuauuucccauuagguuuaguggagcuacacauuaauauguaucgccuuagagcaaga

SEQ ID NO: 171551 - RNA, 64 nt, Homo Sapiens
acuggauuuuugcugcagaaauauaucaguggcccacauuaaacauaccaguuggaucaugaua

SEQ ID NO: 171552 - RNA, 64 nt, Homo Sapiens
ucccucgauauuuuuaaagaucuguaaguaacuucacauuaaaaaaugaaauauuuuuuaauuu

SEQ ID NO: 171553 - RNA, 64 nt, Homo Sapiens
uuguaaugugugaaaaagaugccaauuauuguuacacauuaaguaaucaauaaagaaaacuucc

SEQ ID NO: 171554 - RNA, 64 nt, Homo Sapiens
gaagguuuaaaaaucuauuuuaaagagaaaauuucacauuaaagugauagaauucauaacacau

SEQ ID NO: 171555 - RNA, 64 nt, Homo Sapiens
agaaaauuucacauuaaagggauagaauucauaacacauuaaagaauccuaaaugguuauauuu

SEQ ID NO: 171556 - RNA, 64 nt, Homo Sapiens
ggcuacaggauggugggcaggaucucaagccagcccccuccagcucaugacacuguuuggccuu

SEQ ID NO: 171557 - RNA, 64 nt, Homo Sapiens
gggugacgcccagcuccgccugcugggaagagcuccccuccacagcugcagcugauccauagga

SEQ ID NO: 171558 - RNA, 64 nt, Homo Sapiens
uguccaggguaaaguguaacggccuugaucccugccccuccaggcaccacucacagaggcuccu

SEQ ID NO: 171559 - RNA, 64 nt, Homo Sapiens
ccuucuucaugcacagcugcagaccccacuccagccccuccaccgguggccgaccucacugcac

SEQ ID NO: 171560 - RNA, 64 nt, Homo Sapiens
gcccugaguuucuuggcugccagaguaaggcucuccccuccagagcagugcauguggaaaguau

SEQ ID NO: 171561 - RNA, 64 nt, Homo Sapiens
acucccacccugacagcccacuuucaaagagaaaccccuccagagcugcuuuccuagauccaca

SEQ ID NO: 171562 - RNA, 64 nt, Homo Sapiens
caccgggugccacuuaaugcuccucccugggagaccccuccagcagaguguggggcaggcuccg

SEQ ID NO: 171563 - RNA, 64 nt, Homo Sapiens
ccacugaguguuuuggccacuguugccucuccugccccuccagggggcccuccuggaggagucc

SEQ ID NO: 171564 - RNA, 64 nt, Homo Sapiens
aaaagcacaaacccuggggacucugcuuggcuguccccuccaucuggggauggagaaugccagc

SEQ ID NO: 171565 - RNA, 64 nt, Homo Sapiens
ucacccagaaggaacccggucccaggccgcauggccccuccaggaacauucccacauaauacau

SEQ ID NO: 171566 - RNA, 64 nt, Homo Sapiens
ugaagugacugaggcuggggugccucucccuggcccccuccaacugccaaauucugcuucccuc

SEQ ID NO: 171567 - RNA, 64 nt, Homo Sapiens
auuguucagguggcuccaucgucuauucugugguccccuccaugagccuuugccccaggguggg

SEQ ID NO: 171568 - RNA, 64 nt, Homo Sapiens
gccuggcucagcgggccggaucacccucccggggccccuccacuccagggugcucccccgccca

SEQ ID NO: 171569 - RNA, 64 nt, Homo Sapiens
ccacagcccccaucccguagagccucagucccugccccuccagccgugggggcgguguggcugc

SEQ ID NO: 171570 - RNA, 64 nt, Homo Sapiens
aacccugggggcggccauguuguccaggcccaggccccuccaggacuguggcugccuccccucc

SEQ ID NO: 171571 - RNA, 64 nt, Homo Sapiens
ccaggcccaggccccuccaggacuguggcugccuccccuccacggccuccagggcggcuggcug

SEQ ID NO: 171572 - RNA, 64 nt, Homo Sapiens
cucccccaucccgggggccaggcgcagaggcgccccccuccauccaccccggcccggccuccag

SEQ ID NO: 171573 - RNA, 64 nt, Homo Sapiens
ucagaggcccccuggccgcgaguagcacagaagcccccuccacgggacacacuuaaaccuucca

SEQ ID NO: 171574 - RNA, 64 nt, Homo Sapiens
uuaccucccgcaccuccuccccucagacucacagccccuccauggaccccacauccucccugcu

SEQ ID NO: 171575 - RNA, 64 nt, Homo Sapiens
gggcuuuuucucucaugcauucuggccacugcagccccuccaaucagccccucugcagaucucc

SEQ ID NO: 171576 - RNA, 64 nt, Homo Sapiens
uaggacccagcccauccccagggcacugcuguccccccuccagcguuucuccagguuggguugg

SEQ ID NO: 171577 - RNA, 64 nt, Homo Sapiens
ccagcccacuggaccagaacgcaggaagacauccccccuccaucggggcugcauggccagggug

SEQ ID NO: 171578 - RNA, 64 nt, Homo Sapiens
ccgcuucagccugggcaucauccagcuccuugaaccccuccagcggugggcaaagagcgcucaa

SEQ ID NO: 171579 - RNA, 64 nt, Homo Sapiens
caccccucucccaaccucucccccuguauccccaccccuccacccacaaccccuguaccuccca

SEQ ID NO: 171580 - RNA, 64 nt, Homo Sapiens
cuccuccaccccugccucuccuccaccccugccuccccuccaccccugccucuccuccacccgc

SEQ ID NO: 171581 - RNA, 64 nt, Homo Sapiens
cuccuccaccccugccucuccuccaccccugccuccccuccaccugccccagugcccagaccaa

SEQ ID NO: 171582 - RNA, 64 nt, Homo Sapiens
aaggacacugccacagggacgccuucccuccccuccccuccagcccaccccugcacagccccuc

SEQ ID NO: 171583 - RNA, 64 nt, Homo Sapiens
ugguccccagcaggagagccuaguccucccccagccccuccagccaccaggguguccucuagga

SEQ ID NO: 171584 - RNA, 64 nt, Homo Sapiens
cucucccccagccgcacgggcuacaucuaaguggccccuccaccgcgcccgguggugaugacuc

SEQ ID NO: 171585 - RNA, 64 nt, Homo Sapiens
gguaagccccccuccacagguccgaacaggagccccccuccacacagucauugagauacaaguu

SEQ ID NO: 171586 - RNA, 64 nt, Homo Sapiens
ccccaaugcuuguagaccuuccuucuuuccuccaccccuccauccugccugugcagaccuccac

SEQ ID NO: 171587 - RNA, 64 nt, Homo Sapiens
ggcccgccaggugggcaugggccagacaggcagaccccuccagagggagcucgagagccagacg

SEQ ID NO: 171588 - RNA, 64 nt, Homo Sapiens
acucuccucuucaucucagcauucuccaucacuuccccuccagaaaaacggauggaaggaagcc

SEQ ID NO: 171589 - RNA, 64 nt, Homo Sapiens
aacucagugcagguugcccuuaauuuuccccaaaccccuccaucggcaagucuaguugcccuuu

SEQ ID NO: 171590 - RNA, 64 nt, Homo Sapiens
uccuuaugcggagugcccgcaaggcugggguagcccccuccaguacaccccaaagugaaaggga

SEQ ID NO: 171591 - RNA, 64 nt, Homo Sapiens
cuggcccugcccccggccccugccccugcccgccccccuccaguccaggcagucgagcuccacc

SEQ ID NO: 171592 - RNA, 64 nt, Homo Sapiens
cauccccuucuguacauagcaauggaaucaguucccccuccaccaaaacagauaccauuuucuc

SEQ ID NO: 171593 - RNA, 64 nt, Homo Sapiens
guucccuccuugagagcugaauugacuccacauuccccuccaguccaaaaccccaccucccuuu

SEQ ID NO: 171594 - RNA, 64 nt, Homo Sapiens
ggcuuugggccacagaaugaccuuuagaucccuuccccuccaugaaaauaacuugacaugagca

SEQ ID NO: 171595 - RNA, 64 nt, Homo Sapiens
aguagcugggugagaccugugcccucccauucucccccuccaguaccuuuguccccuggcugcu

SEQ ID NO: 171596 - RNA, 64 nt, Homo Sapiens
uaaaggaaagaguuguuggugccauugcaggugcccccuccaggccugacuggcuccgccaggc

SEQ ID NO: 171597 - RNA, 64 nt, Homo Sapiens
cugcuccuccccacacugagcuccuuuguuccucccccuccagccuuugccugggaacuggucc

SEQ ID NO: 171598 - RNA, 64 nt, Homo Sapiens
gggcuggccugugagccuugcucugcccggcccaccccuccaagggcgagcauccugcugggcu

SEQ ID NO: 171599 - RNA, 64 nt, Homo Sapiens
guccagagccaggaaggggcgggcccaagcccugccccuccagacugggaagcaccgucugccc

SEQ ID NO: 171600 - RNA, 64 nt, Homo Sapiens
gagugcccggugcuugggggucccugggccauguccccuccaucgcccuugcagcugcagccca

SEQ ID NO: 171601 - RNA, 64 nt, Homo Sapiens
ggugguggauuuguuccaaagccucaaucccuacccccuccaaggggcagguuuccaguccagc

SEQ ID NO: 171602 - RNA, 64 nt, Homo Sapiens
uggaggggccaggcuggacgcuuccugugggaguccccuccagaccuggcuggccccugcagcc

SEQ ID NO: 171603 - RNA, 64 nt, Homo Sapiens
aaccuugugucccagcccugcaguugggcuuuggccccuccagccucccuguucuuggugaccc

SEQ ID NO: 171604 - RNA, 64 nt, Homo Sapiens
gagccuuggcuacaucuguggguucugucaugccccccuccacuccguaggaggugagacaugg

SEQ ID NO: 171605 - RNA, 64 nt, Homo Sapiens
guaaagaugaugggguuuagaucccucaggcucuccccuccagacuccgcccuucccucccucc

SEQ ID NO: 171606 - RNA, 64 nt, Homo Sapiens
ccugggagggaggggaggaugagcacgcccagcuccccuccagggugugacuuggccccucugg

SEQ ID NO: 171607 - RNA, 64 nt, Homo Sapiens
cucccaggagucgcugaucagagaccugcgcccaccccuccacuccaguguccaggggcuugga

SEQ ID NO: 171608 - RNA, 64 nt, Homo Sapiens
gagugaggagggggccugagaagacaccccugccccccuccagaccagccgugggcaaacccug

SEQ ID NO: 171609 - RNA, 64 nt, Homo Sapiens
cugcccaggagaggggccgacuccacgagagcagccccuccacuguccccagcgaggacacaca

SEQ ID NO: 171610 - RNA, 64 nt, Homo Sapiens
uggagacauggccuaggggggucaggcuccccgcccccuccacgagaccagcucagggcggaag

SEQ ID NO: 171611 - RNA, 64 nt, Homo Sapiens
ccgagcugggggggaaucugccagcacugcccuaccccuccacugucugccggugcccugcccc

SEQ ID NO: 171612 - RNA, 64 nt, Homo Sapiens
gugggucuggggaggggacaacauagugagacccccccuccagggcauccgccccuuccaguuc

SEQ ID NO: 171613 - RNA, 64 nt, Homo Sapiens
ucugcuccucuagggccgccggccgccccuccacccccuccaaccggccacgcuccccguccuu

SEQ ID NO: 171614 - RNA, 64 nt, Homo Sapiens
cccuccaacucugcuccucucccguccuuggccgccccuccacccgaauaccccggccacgcuc

SEQ ID NO: 171615 - RNA, 64 nt, Homo Sapiens
ccauuuucugccgugaaacccagucuacaacugcccccuccagcauccuuccccugcaaccaga

SEQ ID NO: 171616 - RNA, 64 nt, Homo Sapiens
uuuccgaccccacaccgacaccucgcucucacacccccuccagcauagacccuuccacugacac

SEQ ID NO: 171617 - RNA, 64 nt, Homo Sapiens
gagcgcuggaggaaaccagcccuuuagccagcagccccuccaccacaggcacugcuguguggaa

SEQ ID NO: 171618 - RNA, 64 nt, Homo Sapiens
ugacaaggauuucacaugcagaagagaaaaggccccccuccaccccccgcauucccugccgagu

SEQ ID NO: 171619 - RNA, 64 nt, Homo Sapiens
ccaguggccucgugguuauuagagaggaggcagcccccuccacaauaaggagacugaggcuuag

SEQ ID NO: 171620 - RNA, 64 nt, Homo Sapiens
ucccagcagcccaagcuuaagauaggcccaagguccccuccacacagagcuggguggggacagu

SEQ ID NO: 171621 - RNA, 64 nt, Homo Sapiens
uaucuuuccuaggcagaucaacccccuaccccgaccccuccacgccccuccugcaaggggcuca

SEQ ID NO: 171622 - RNA, 64 nt, Homo Sapiens
ggaggggucuccucugcagcggaccucccacugcccccuccacucccugaugcugccaggccug

SEQ ID NO: 171623 - RNA, 64 nt, Homo Sapiens
acaaucccacuggaagaaaaaauagauugcccagccccuccagucuuuccauuucgagaacaua

SEQ ID NO: 171624 - RNA, 64 nt, Homo Sapiens
uugccugccccugaagaccucuucaguguucuucccccuccaugcucagggcaucugacucccu

SEQ ID NO: 171625 - RNA, 64 nt, Homo Sapiens
gcugcccugugcuccuccccgcaggacauggcucccccuccaccugcucugugcccacccucca

SEQ ID NO: 171626 - RNA, 64 nt, Homo Sapiens
ccaggcccccaaccccccauuucuuccccaccaaccccuccaaugcuguuaucccugccugguc

SEQ ID NO: 171627 - RNA, 64 nt, Homo Sapiens
uagccauagcagccccugcuucagccccaccgcaccccuccagggggccugccuuucccugaca

SEQ ID NO: 171628 - RNA, 64 nt, Homo Sapiens
aaauaucacaacccaccaaaaauagaugccucucccccuccagcccuagccgagcugguccuag

SEQ ID NO: 171629 - RNA, 61 nt, Homo Sapiens
gggacuuggccaaggcaaaagcuggggagaugccagugacaacauacaguucaugacuagg

SEQ ID NO: 171630 - RNA, 61 nt, Homo Sapiens
uuuuuccaaaguagaaaggaagcacuucugagccagugaccacugaaagguaugugcuaug

SEQ ID NO: 171631 - RNA, 61 nt, Homo Sapiens
cccccaaaccaaaguugucccaacagaggaggccagugaggcagagacagagcucucccac

SEQ ID NO: 171632 - RNA, 61 nt, Homo Sapiens
ggggaggccuacaacaggacgaccauucugagccagugagucuauugcaugguguuuugag

SEQ ID NO: 171633 - RNA, 61 nt, Homo Sapiens
aaaguggcuaauguuagcuacuaugaauggugccagugaagacacugaaaaauaagugauu

SEQ ID NO: 171634 - RNA, 61 nt, Homo Sapiens
augaaaaucuuugcacucacagagcuuacaugccagugagugaagaucgaugauaaauaaa

SEQ ID NO: 171635 - RNA, 61 nt, Homo Sapiens
auuuccuucuguucuccuuguucuguucugggccagugaagguccuuguucugauuuugaa

SEQ ID NO: 171636 - RNA, 61 nt, Homo Sapiens
uguucugauuuugaaacgaucugcaggucuugccagugaaccccuggacaacugaccacac

SEQ ID NO: 171637 - RNA, 61 nt, Homo Sapiens
agccuaaugaaagggaaagucagcuuucagagccagugaaggagccacgugaauggcccua

SEQ ID NO: 171638 - RNA, 61 nt, Homo Sapiens
aagcuuaaauugcuuuuguugugacuuuuuagccagugacuuuuucugagcuuuucaugga

SEQ ID NO: 171639 - RNA, 61 nt, Homo Sapiens
uccuagccguuccccuucugccccagucugagccagugagggguagcuuuuuaaaaccauu

SEQ ID NO: 171640 - RNA, 61 nt, Homo Sapiens
ucccugguggguaacacccucaagucucuuugccagugaggccccaccacaucggugugag

SEQ ID NO: 171641 - RNA, 61 nt, Homo Sapiens
agagagagguuucauucauguucaaacuaaugccagugacuaaauguggguagcuuauacu

SEQ ID NO: 171642 - RNA, 61 nt, Homo Sapiens
cccuaaggucucagugcauauauucuuacgugccagugaggacuggucaucacauucagcu

SEQ ID NO: 171643 - RNA, 61 nt, Homo Sapiens
ccggcagcggcgaugagggcacguggauggcgccagugacuucucaacgcgcccacccugg

SEQ ID NO: 171644 - RNA, 61 nt, Homo Sapiens
acuucucccuggugaguguaugacagcaggugccagugacuguucuacacccuccaggaaa

SEQ ID NO: 171645 - RNA, 61 nt, Homo Sapiens
cuacuaaccgugccaucuugaacagaugaaagccagugagcagacugcacccuccagcaac

SEQ ID NO: 171646 - RNA, 61 nt, Homo Sapiens
gaugcaguggucuccuuucccucuuacuugugccagugacaggcauuguaauugugaacag

SEQ ID NO: 171647 - RNA, 61 nt, Homo Sapiens
gguuuuguguguuuaggccuggucagcagaugccagugaagccagcccugguucuggcugu

SEQ ID NO: 171648 - RNA, 61 nt, Homo Sapiens
auguuuugauauuuauuuccuuguauugagggccagugauguuuuggguggcauagagguu

SEQ ID NO: 171649 - RNA, 61 nt, Homo Sapiens
acugcagggaagcuaccggaccugccugggagccagugaagggcgagucagggcacgcguc

SEQ ID NO: 171650 - RNA, 61 nt, Homo Sapiens
auugucagccuuggccugggguuuugaccuugccagugaaguuucgguuuugaagugauua

SEQ ID NO: 171651 - RNA, 61 nt, Homo Sapiens
acuuuagggaaaccuuugcuuaccuuguuuugccagugauaagagcaguggguuggagggc

SEQ ID NO: 171652 - RNA, 61 nt, Homo Sapiens
cucuaaaagccuuggagauuagcccuuccuugccagugagaacggugaccgccuccugcuc

SEQ ID NO: 171653 - RNA, 61 nt, Homo Sapiens
gacucugccuagaaacaguguuugcccuuuggccagugacgugguucaucccggcccaugu

SEQ ID NO: 171654 - RNA, 64 nt, Homo Sapiens
ucugcugagacaguccuuuuugugcccagccaagggugagcaucgggcacagcauccucaguuc

SEQ ID NO: 171655 - RNA, 64 nt, Homo Sapiens
cacuuugacaugaaggacaacaaagaucagagcaggugagcaucugaagaugucuugagcucug

SEQ ID NO: 171656 - RNA, 63 nt, Homo Sapiens
cagggauaugcuguauuuuauaaaauuggcaaaauuagagaaauauaguucacaaugaaauua

SEQ ID NO: 171657 - RNA, 63 nt, Homo Sapiens
uucacauuugauuuuuucaaauuuaauauuuauauuagagaucuauauauguauaaauaugua

SEQ ID NO: 171658 - RNA, 63 nt, Homo Sapiens
uugagucuuaucaaauaaaagaucugaaaacucauuagagaugaacaucucuuucucauuaga

SEQ ID NO: 171659 - RNA, 63 nt, Homo Sapiens
ugaaaacucauuagagauguacaucucuuucucauuagagaucuuuuucugaauuuuuuuuua

SEQ ID NO: 171660 - RNA, 63 nt, Homo Sapiens
auuuauuccuaauaagucagcauuagagaguucauuagagaguuccagaaagggugagaggau

SEQ ID NO: 171661 - RNA, 63 nt, Homo Sapiens
ucauuagagaguauuuauucgggugagaggaucauuagagaguugccucucacuuuccagaaa

SEQ ID NO: 171662 - RNA, 63 nt, Homo Sapiens
guucauuuuucaacuaaucuuauguggaauugaauuagagaacaaggcauuauucuuuuaggg

SEQ ID NO: 171663 - RNA, 63 nt, Homo Sapiens
agggaaugggcugguagacuuuuucgaaaacaaauuagagaaaguaacuuacaaccacccauu

SEQ ID NO: 171664 - RNA, 63 nt, Homo Sapiens
ggaagggaaccuuauguguauuuuauuuuccauauuagagaugcugaguauucauauuaagug

SEQ ID NO: 171665 - RNA, 63 nt, Homo Sapiens
ugauuuuagauaacagauuucugcaaaauuagcauuagagaauuaaugugaaauacaguuuuc

SEQ ID NO: 171666 - RNA, 63 nt, Homo Sapiens
ucuacaaauguaugucauaauuugauuuaaaggauuagagaaauuauugguguucauuuuucu

SEQ ID NO: 171667 - RNA, 63 nt, Homo Sapiens
ccauuuguaaaacucaaaugauuuuggcauaccauuagagaaacuggagagaacacauaaaug

SEQ ID NO: 171668 - RNA, 63 nt, Homo Sapiens
agaacucauuauucuggguacccuccaaugagaauuagagagguuaaauaccuuuuccuagau

SEQ ID NO: 171669 - RNA, 63 nt, Homo Sapiens
auuugugccagcuaacacuacaaaauagacuuaauuagagaaauuuagacccagaauugcagc

SEQ ID NO: 171670 - RNA, 64 nt, Homo Sapiens
guuuggcuccacugguggcacacguggccuccgugguauggaccugguggcuucuccaucccac

SEQ ID NO: 171671 - RNA, 64 nt, Homo Sapiens
ccugguggcuucuccaucccacuguggccucugugguauggaccugguggcuucuccauccuac

SEQ ID NO: 171672 - RNA, 64 nt, Homo Sapiens
uacuuuguauucuaaaaacugugguauggaagaagguauggaaauagaauuuccaucauggaag

SEQ ID NO: 171673 - RNA, 64 nt, Homo Sapiens
aagguauggaaauacuuuguccaucauggaaggugguauggaagaaauuguccuguuagaauuu

SEQ ID NO: 171674 - RNA, 64 nt, Homo Sapiens
uuuucccuucagugacugaguuucucucuucuuugguauggaaucuguucuuugguauggaauu

SEQ ID NO: 171675 - RNA, 64 nt, Homo Sapiens
uuuucucucuucuuugguaugaagucuguucuuugguauggaauaggacggagguucccugggg

SEQ ID NO: 171676 - RNA, 64 nt, Homo Sapiens
ggucccuuugcaagugaacccugcagcucacccauucauucacccaacuuccuucauucagcag

SEQ ID NO: 171677 - RNA, 64 nt, Homo Sapiens
cccugcagcucacccauucauucacccaacuuccuucauucagcaggagguccuauuacccucu

SEQ ID NO: 171678 - RNA, 64 nt, Homo Sapiens
aagagcugugguuuccugugcucucauuuguccauucauucauucauucauucauucagcaaau

SEQ ID NO: 171679 - RNA, 64 nt, Homo Sapiens
gcugugguuuccugugcucucauuuguccauucauucauucauucauucauucagcaaauaauc

SEQ ID NO: 171680 - RNA, 64 nt, Homo Sapiens
ugguuuccugugcucucauuuguccauucauucauucauucauucauucagcaaauaaucugaa

SEQ ID NO: 171681 - RNA, 64 nt, Homo Sapiens
uuccugugcucucauuuguccauucauucauucauucauucauucagcaaauaaucugaaaucc

SEQ ID NO: 171682 - RNA, 64 nt, Homo Sapiens
ugugcucucauuuguccauucauucauucauucauucauucagcaaauaaucugaaauccaguc

SEQ ID NO: 171683 - RNA, 64 nt, Homo Sapiens
uugggaacauuugccucauucuccugcuauccucuucauucaccccugccacuguaauaucuau

SEQ ID NO: 171684 - RNA, 64 nt, Homo Sapiens
aaaaaaaaauguguagccccuuuuuaaccuaguguucauucaaaaaaaaauugaugcaaaucuu

SEQ ID NO: 171685 - RNA, 64 nt, Homo Sapiens
ucauuucccccguagcagauuaaagagaauuacuuucauucauuuauuccuuauguuggugacc

SEQ ID NO: 171686 - RNA, 64 nt, Homo Sapiens
acccccacccucccuccccucuaaguugaauugcuucauucaaccuuguuuacaaaauuugauu

SEQ ID NO: 171687 - RNA, 64 nt, Homo Sapiens
uuugccaguauugcucacuugcuaguggugugaauucauucauauggguguucugccaacaauu

SEQ ID NO: 171688 - RNA, 64 nt, Homo Sapiens
cacucucaguuucucauauuuucuguugcucucuuucauucacaucuagucuuguauuuccucc

SEQ ID NO: 171689 - RNA, 64 nt, Homo Sapiens
auuuauugagcaucuaguauaggaaucucauucauucauucaguaaaacauauauagggguucc

SEQ ID NO: 171690 - RNA, 64 nt, Homo Sapiens
caguauuuauugagcaucuauuccaggaaucucauucauucauugcccaaaacauauauagggg

SEQ ID NO: 171691 - RNA, 64 nt, Homo Sapiens
uggucaauaacuugaaauuuaucaucauuagcaauucauucagauguagugugauucuagauaa

SEQ ID NO: 171692 - RNA, 64 nt, Homo Sapiens
caauacuaaagagaaauaaguaguuuaagcuuuauucauucauguauguaacuuuuucagggaa

SEQ ID NO: 171693 - RNA, 64 nt, Homo Sapiens
cccuguccucugucccucacaccccuuugcuccguucauucauucaaaaaaacauuucuugagc

SEQ ID NO: 171694 - RNA, 64 nt, Homo Sapiens
guccucugucccucacaccccuuugcuccguucauucauucaaaaaaacauuucuugagcaccu

SEQ ID NO: 171695 - RNA, 64 nt, Homo Sapiens
uucuaaugugcuuauucuagcauucauucauucauucauucauaacuuuacaauaauuuguauu

SEQ ID NO: 171696 - RNA, 64 nt, Homo Sapiens
cauauucuaaugugcuuauuuauucauucauucauucauucauuuuuuacuuuacaauaauuug

SEQ ID NO: 171697 - RNA, 64 nt, Homo Sapiens
cauucauauucuaaugugcuuuuguauucauucauucauucauugaauuuuuacuuuacaauaa

SEQ ID NO: 171698 - RNA, 64 nt, Homo Sapiens
cauucauucauauucuaaugauaauuuguauucauucauucauuuuaugaauuuuuacuuuaca

SEQ ID NO: 171699 - RNA, 64 nt, Homo Sapiens
cauucauucauucauauucuuacaauaauuuguauucauucauuugccuuaugaauuuuuacuu

SEQ ID NO: 171700 - RNA, 64 nt, Homo Sapiens
ucaguguggaaaagacuacagauuacacacucuuuucauucacacuuguacauauagacagcaa

SEQ ID NO: 171701 - RNA, 64 nt, Homo Sapiens
gcaugaaauggccaacuguggcuguuacaguucuuucauucaauuauaacuuguaaaccaguga

SEQ ID NO: 171702 - RNA, 64 nt, Homo Sapiens
aauugcuugaagcaauuguucugaaugauacuuuuucauucacauucaagaauuaauuuuuuga

SEQ ID NO: 171703 - RNA, 64 nt, Homo Sapiens
ucccucuuuacaucacuuaucuuucucacugagguucauucacuggaauuuacucacgcaaucu

SEQ ID NO: 171704 - RNA, 64 nt, Homo Sapiens
ugauuauuauuuaguuggaggccuuuagauauuauucauucauuuacucauucauuuauucauu

SEQ ID NO: 171705 - RNA, 64 nt, Homo Sapiens
uuagauauuauucauucauuuacucauucauuuauucauucauucaucgaguaacuuuaaaaaa

SEQ ID NO: 171706 - RNA, 64 nt, Homo Sapiens
auauuauucauucauuuacucauucauuuauucauucauucaucgaguaacuuuaaaaaaauca

SEQ ID NO: 171707 - RNA, 64 nt, Homo Sapiens
caaaagaauuauuaacucugauuuuuggacuucauucauucaagguguaaaacacucaugugau

SEQ ID NO: 171708 - RNA, 61 nt, Homo Sapiens
caagcaaaagaauuauuaacuauuuuuggacuucauucauuaguguaaaacacucauguga

SEQ ID NO: 171709 - RNA, 64 nt, Homo Sapiens
uccuccauaaacaccaacuucugugagguggguguucauucauuuuuuggaaucuuccuccuga

SEQ ID NO: 171710 - RNA, 64 nt, Homo Sapiens
ucccuuccugucucggucugcaguucaggguucuuucauucacggacaugacuguggagucuua

SEQ ID NO: 171711 - RNA, 64 nt, Homo Sapiens
gauuuuuauuuuggucauuaugaauuucaucaaauucauucaguuguuguuugcuuuccuuaac

SEQ ID NO: 171712 - RNA, 64 nt, Homo Sapiens
uauguguuuauuuacuacaucuuuuucaugguaguucauucaguuuuaacucauuguaugaauu

SEQ ID NO: 171713 - RNA, 64 nt, Homo Sapiens
gaacuuugugcucaaaaugcuucauucaguaugcuucauucaccguuaaugcuacuggucuaac

SEQ ID NO: 171714 - RNA, 64 nt, Homo Sapiens
augcuucauucaccgaacuugcuacuggucuaacuucauucaguucucugcaucacuuguuaau

SEQ ID NO: 171715 - RNA, 64 nt, Homo Sapiens
uguguuauuuuguaaaaauagaauuaacacaguauucauucaucucauuuggagauugaacucu

SEQ ID NO: 171716 - RNA, 64 nt, Homo Sapiens
aucuguuuguugaucaagugcauugccaguuuucuucauucagagggggcagguuaauuccugg

SEQ ID NO: 171717 - RNA, 64 nt, Homo Sapiens
uaaacuugaauaaaggggacaaagcuagaacuuauucauucauucauucacuuauggaguuguu

SEQ ID NO: 171718 - RNA, 64 nt, Homo Sapiens
cuugaauaaaggggacaaagcuagaacuuauucauucauucauucacuuauggaguuguuacug

SEQ ID NO: 171719 - RNA, 64 nt, Homo Sapiens
aauaaaggggacaaagcuagaacuuauucauucauucauucacuuauggaguuguuacugauuu

SEQ ID NO: 171720 - RNA, 64 nt, Homo Sapiens
ucccagucucgacucuacauuuguuugugcagcauucauucagcaaagacuuuugggguuugug

SEQ ID NO: 171721 - RNA, 64 nt, Homo Sapiens
uuugaugaugacacuggcacauuauucuaaacuauucauucagcaugccuauaauuacauaaau

SEQ ID NO: 171722 - RNA, 64 nt, Homo Sapiens
gagacuuuuuguugcaaaggacacauuuaucauauucauucacacauauuauaugugauagcug

SEQ ID NO: 171723 - RNA, 64 nt, Homo Sapiens
aaguuuguguggggauuaaaugagcuaaugcagauucauucauucagaaaaauuuuugaauggc

SEQ ID NO: 171724 - RNA, 64 nt, Homo Sapiens
uuguguggggauuaaaugagcuaaugcagauucauucauucagaaaaauuuuugaauggcacgu

SEQ ID NO: 171725 - RNA, 64 nt, Homo Sapiens
gguagacacacaaaaaaugaucaugaagcauacauucauucaggacagacaaaagccuuugccu

SEQ ID NO: 171726 - RNA, 64 nt, Homo Sapiens
aaauaauuucugaguguguaccagcuuucauaucuucauucaaccugaaacacauucuugaagc

SEQ ID NO: 171727 - RNA, 64 nt, Homo Sapiens
aaauauuuaugauguauuuacauucauucauucauucauucacaauccuuuuauuaaucauggu

SEQ ID NO: 171728 - RNA, 64 nt, Homo Sapiens
cacaaaauauuuaugauguauggucauucauucauucauucauucuauauccuuuuauuaauca

SEQ ID NO: 171729 - RNA, 64 nt, Homo Sapiens
cauucacaaaauauuuaugaaucauggucauucauucauucauugcagcuauauccuuuuauua

SEQ ID NO: 171730 - RNA, 64 nt, Homo Sapiens
cauucauucacaaaauauuuauuaaucauggucauucauucauucugagcagcuauauccuuuu

SEQ ID NO: 171731 - RNA, 64 nt, Homo Sapiens
caucucuguuauuuaucccucauucauccauccguucauucauucagccuucaaucaacaucuc

SEQ ID NO: 171732 - RNA, 64 nt, Homo Sapiens
ucuguuauuuaucccucauucauccauccguucauucauucagccuucaaucaacaucucuuga

SEQ ID NO: 171733 - RNA, 64 nt, Homo Sapiens
uccagccauucugguauuccuuuauguaucuaauuucauucaaaccucacaacagucuugugag

SEQ ID NO: 171734 - RNA, 64 nt, Homo Sapiens
aagcuuuuacugcauaaacuuauccuaugauucauucauucaauaaauuacuaguuguauuauu

SEQ ID NO: 171735 - RNA, 64 nt, Homo Sapiens
caauaagcuuuuacugcauauauuuauccuaugauucauucauuuaagaaauuacuaguuguau

SEQ ID NO: 171736 - RNA, 64 nt, Homo Sapiens
cauugcuucacuuacacuucacccacagcuggaguucauucaacucuugcuuuucacaaaauag

SEQ ID NO: 171737 - RNA, 64 nt, Homo Sapiens
ugucuucuuguucuacucagggccuuuagguguguucauucacgguauggaaauacaguaaaug

SEQ ID NO: 171738 - RNA, 64 nt, Homo Sapiens
uaagaugucugagagaccaucuccuaucuuuuauuucauucauauccuccgcccuuuuuguccu

SEQ ID NO: 171739 - RNA, 64 nt, Homo Sapiens
gaaacguccaucucucucccuuacuauucccacuuucauucaaucaaccugcacuucauaucua

SEQ ID NO: 171740 - RNA, 64 nt, Homo Sapiens
uggcccucacgucucugguuuuaccuuuccuuacuucauucauucacucacccaguccuuacga

SEQ ID NO: 171741 - RNA, 64 nt, Homo Sapiens
ccucacgucucugguuuuaccuuuccuuacuucauucauucacucacccaguccuuacgaauca

SEQ ID NO: 171742 - RNA, 64 nt, Homo Sapiens
uaaggaauauuaguugaguaauacucuucauucauucauucauuaauagccuggaaagcuagaa

SEQ ID NO: 171743 - RNA, 64 nt, Homo Sapiens
cauuuaaggaauauuaguugagaaauacucuucauucauucauucuugaauagccuggaaagcu

SEQ ID NO: 171744 - RNA, 64 nt, Homo Sapiens
cauucauuuaaggaauauuaagcuagaaauacucuucauucauuagcccuugaauagccuggaa

SEQ ID NO: 171745 - RNA, 64 nt, Homo Sapiens
uagaaauaacagauucucugcacaaaaccacccauucauucauuuauucauucacagcacuagc

SEQ ID NO: 171746 - RNA, 64 nt, Homo Sapiens
auucucugcacaaaaccacccauucauucauuuauucauucacagcacuagcaagugcugccua

SEQ ID NO: 171747 - RNA, 64 nt, Homo Sapiens
cauuuauugucaacauuuauuaaaauaauuuucauucauucacuaaccaaagcucaaauaaaaa

SEQ ID NO: 171748 - RNA, 64 nt, Homo Sapiens
cacucauuuauugucaacauaaaauaaaauaauuuucauucauugcagaaccaaagcucaaaua

SEQ ID NO: 171749 - RNA, 64 nt, Homo Sapiens
uuuauaaagcuaguaguguaguguaaaugucauauucauucagauccguguacuucauucaaau

SEQ ID NO: 171750 - RNA, 64 nt, Homo Sapiens
uguguaaaugucauauucauacccauccguguacuucauucaaaguaauaagcaucuggaaugg

SEQ ID NO: 171751 - RNA, 64 nt, Homo Sapiens
ucuuuucuaagcucaguguggaugauugcauuacuucauucacugaaguuuuugcccaaaaauu

SEQ ID NO: 171752 - RNA, 64 nt, Homo Sapiens
agucuugauguacggacauuaaaagccagauuucuucauucaauucuguuaucucuguuuuacu

SEQ ID NO: 171753 - RNA, 64 nt, Homo Sapiens
ggucaaccccuaugcaaauuaccacagcaaagguuucauucaggagauucuuccaucugggcaa

SEQ ID NO: 171754 - RNA, 64 nt, Homo Sapiens
uugaggacacuuuugcaaaugccagaauguaagauucauucagugugcucccugggccuuuaug

SEQ ID NO: 171755 - RNA, 64 nt, Homo Sapiens
gguugacaggauuuguuuauuuucuaaaauuagcuucauucaauauuuaucauccuccuuuccc

SEQ ID NO: 171756 - RNA, 64 nt, Homo Sapiens
ggauuguauaucauuguugcagaacauccauucauucauucauuaagaaauagaaacuucaggc

SEQ ID NO: 171757 - RNA, 64 nt, Homo Sapiens
cauuggauuguauaucauugaggcagaacauccauucauucauuaagaaagaaauagaaacuuc

SEQ ID NO: 171758 - RNA, 64 nt, Homo Sapiens
aaucauauacugauuagcuaaauugguuuauucauucauucaacgugaguuuguuuaguucauu

SEQ ID NO: 171759 - RNA, 64 nt, Homo Sapiens
caacaaucauauacugauuacauuaauugguuuauucauucauuuauugugaguuuguuuaguu

SEQ ID NO: 171760 - RNA, 64 nt, Homo Sapiens
cauacauccaccugccucugcauuguucuguucauucauucaucaucgcuucccuucaugcauc

SEQ ID NO: 171761 - RNA, 64 nt, Homo Sapiens
cauccauacauccaccugcccauccauuguucuguucauucauuccccaucgcuucccuucaug

SEQ ID NO: 171762 - RNA, 64 nt, Homo Sapiens
uauuucuaaaugagacgaaaugcugauguauccuuucauucagcuaacaaacuagaaaagguua

SEQ ID NO: 171763 - RNA, 64 nt, Homo Sapiens
aaggugcuuuucuucggcuugaguucaccaucucuucauucaaacugcacuuuuagccagagau

SEQ ID NO: 171764 - RNA, 64 nt, Homo Sapiens
uauuuuuugguuuugggggauauuuuuuauuuguuucauucauucuguucuguuucucuacugg

SEQ ID NO: 171765 - RNA, 64 nt, Homo Sapiens
aauaccuauuagucauaccuaaauuuuucagcacuucauucaauuaaaauacaugaauuuuaaa

SEQ ID NO: 171766 - RNA, 64 nt, Homo Sapiens
aaauauuuaccaaguuccuaccauagauaguucauucauucaacuuaaaguaguaaauucauau

SEQ ID NO: 171767 - RNA, 64 nt, Homo Sapiens
caacaaauauuuaccaaguuauauccauagauaguucauucauucaaauuaaaguaguaaauuc

SEQ ID NO: 171768 - RNA, 64 nt, Homo Sapiens
uguucuggcagcugugucauaaaaugcugcuggguucauucauucauuccauaagaaacuuaau

SEQ ID NO: 171769 - RNA, 64 nt, Homo Sapiens
cuggcagcugugucauaaaaugcugcuggguucauucauucauuccauaagaaacuuaauacca

SEQ ID NO: 171770 - RNA, 64 nt, Homo Sapiens
aacuauugccuacacuuugaaggcaagauauucauucauucauagacacuaugaauuuauauau

SEQ ID NO: 171771 - RNA, 64 nt, Homo Sapiens
cauaaacuauugccuacacuauauaggcaagauauucauucauuuuuagacacuaugaauuuau

SEQ ID NO: 171772 - RNA, 64 nt, Homo Sapiens
gguuuuccucauuuuuauauucauuuauucaucauucauucauucaccuaacuuucauuaaaua

SEQ ID NO: 171773 - RNA, 64 nt, Homo Sapiens
uuccucauuuuuauauucauuuauucaucauucauucauucaccuaacuuucauuaaauagcug

SEQ ID NO: 171774 - RNA, 64 nt, Homo Sapiens
acacacacccacuaaggagaaagaaguugauuccuucauucacuucgccauucauucauacuuc

SEQ ID NO: 171775 - RNA, 64 nt, Homo Sapiens
gagaaagaaguugauuccuucauucacuucgccauucauucauacuuccguccauccauucaga

SEQ ID NO: 171776 - RNA, 64 nt, Homo Sapiens
gcauguugucaacuaaagacaacaaacuaucagauucauucauucagugaagcagccucugauu

SEQ ID NO: 171777 - RNA, 64 nt, Homo Sapiens
guugucaacuaaagacaacaaacuaucagauucauucauucagugaagcagccucugauucucu

SEQ ID NO: 171778 - RNA, 64 nt, Homo Sapiens
gaaugcucaagacaagccagcugauuaaucugcauucauucagcucagagguaagucuguuguu

SEQ ID NO: 171779 - RNA, 64 nt, Homo Sapiens
aagcagguuaaagccauuguucuucccucuguuauucauucauccuucacguacuuccuuucuu

SEQ ID NO: 171780 - RNA, 64 nt, Homo Sapiens
aucauuaagaguaugagaauuaccauuuucaguuuucauucagcaaacaaauuuaccaagugcc

SEQ ID NO: 171781 - RNA, 64 nt, Homo Sapiens
gaaugaauaaugcauucuuuuuuauucaauuuauuucauucaguuuauucuuggcaaucaaaca

SEQ ID NO: 171782 - RNA, 64 nt, Homo Sapiens
ggacagugggaauuaacucuauauuugaaaggcauucauucaguauacuguaauauauuuauua

SEQ ID NO: 171783 - RNA, 64 nt, Homo Sapiens
uucacaaagcaaacaucuagcccaaaauaagacuuucauucacaaaaacauaagaaacuacacc

SEQ ID NO: 171784 - RNA, 64 nt, Homo Sapiens
uaaaaauccagauggcaaauuuaaacccaugagauucauucaguaggauuacaugcauguuugg

SEQ ID NO: 171785 - RNA, 64 nt, Homo Sapiens
ugcauuucuuugcccuggggcuggggagaagguguucauucacuggcuuucuggcugcuggagg

SEQ ID NO: 171786 - RNA, 64 nt, Homo Sapiens
agagguuuauguagggcacuaggguauuuauucauucauucaacaaggugugggacaagaagaa

SEQ ID NO: 171787 - RNA, 64 nt, Homo Sapiens
caacagagguuuauguagggagaaaggguauuuauucauucauugaagaaggugugggacaaga

SEQ ID NO: 171788 - RNA, 64 nt, Homo Sapiens
aaaauuuggcuggaaucuggcucuuguuucuucauucauucaaccagcccuuccccagccccuc

SEQ ID NO: 171789 - RNA, 64 nt, Homo Sapiens
caacaaaauuuggcuggaauccuccucuuguuucuucauucauucuuccagcccuuccccagcc

SEQ ID NO: 171790 - RNA, 64 nt, Homo Sapiens
aaacauuuauugggaaccugccuucuuccauuuauucauucaauuguucauuacuuuguucacu

SEQ ID NO: 171791 - RNA, 64 nt, Homo Sapiens
gagaaacucaugggauuugucuggaagcaagagguucauucaaagggagaugcguuguauggga

SEQ ID NO: 171792 - RNA, 64 nt, Homo Sapiens
acagucagcaugccccaaguaguacccugucuguuucauucacccauucuauaauaguaggacc

SEQ ID NO: 171793 - RNA, 64 nt, Homo Sapiens
ucaaaguauuuucuaauuucuuuguguuuuuguuuucauucauccacacucucaguuuugguau

SEQ ID NO: 171794 - RNA, 64 nt, Homo Sapiens
cuggcacaaaugaaaaguaggacggaaagcuccuuucauucaguuuaucuuuccaggauauaug

SEQ ID NO: 171795 - RNA, 64 nt, Homo Sapiens
gacuagccucacucuguccucgaaagccugagcuuucauucaacucccuauuuccaugcaaaga

SEQ ID NO: 171796 - RNA, 64 nt, Homo Sapiens
gccguccagacaauucucccaguccauucauuucuucauucauuuguucauucaguaguuauug

SEQ ID NO: 171797 - RNA, 64 nt, Homo Sapiens
auucucccaguccauucauuucuucauucauuuguucauucaguaguuauugagugcuuauuuc

SEQ ID NO: 171798 - RNA, 64 nt, Homo Sapiens
uauguauucaucagacacaucacucauuuguguauucauucauuuaccugaaacugccuucauu

SEQ ID NO: 171799 - RNA, 64 nt, Homo Sapiens
cauuuguguauucauucauuuaccugaaacugccuucauucacuucauaggagucuuaggcagu

SEQ ID NO: 171800 - RNA, 64 nt, Homo Sapiens
ucagcacccugggugccauugcagaaaagaggagacccuggaaucuggggcaugugugccugug

SEQ ID NO: 171801 - RNA, 64 nt, Homo Sapiens
ggggaguugagucacaagagggaauguucccugcacccuggaaaagcuggaaggcagggcagag

SEQ ID NO: 171802 - RNA, 64 nt, Homo Sapiens
uuauagagaaaauaaacauauaaaauuuuggaaaacccuggaaaaaaauuauagauguuuguug

SEQ ID NO: 171803 - RNA, 64 nt, Homo Sapiens
uggaguaggagacccggaugggagagcgggaugaacccuggaccgggguccugaguggcuucca

SEQ ID NO: 171804 - RNA, 64 nt, Homo Sapiens
gagcacuggacauagaccuaagaagcaaccuguuacccuggaaauuuaguccuuuaaaaugagu

SEQ ID NO: 171805 - RNA, 64 nt, Homo Sapiens
gagcggggcuauucccauuugaacucauuggaugacccuggacaucacaaauguagaccuccau

SEQ ID NO: 171806 - RNA, 64 nt, Homo Sapiens
uggcauuguguaaccucaucucauccucauggccacccuggagggcagcuuuaccuuugucauu

SEQ ID NO: 171807 - RNA, 64 nt, Homo Sapiens
ggagggaggaggaagggaagaccccaguggugggacccuggaccaggccauggaugaaggacaa

SEQ ID NO: 171808 - RNA, 64 nt, Homo Sapiens
acucucagucuggccccugugcuccccuguguguacccuggaguuucuguguccaauuguuggc

SEQ ID NO: 171809 - RNA, 64 nt, Homo Sapiens
ccuuuccucagccccuuguucuucccuguccuccacccuggaccccagccggcugcuggagccc

SEQ ID NO: 171810 - RNA, 64 nt, Homo Sapiens
cuacucgggagguuuaggcaggagaaucgcuugaacccuggagguggagguggagguugcagug

SEQ ID NO: 171811 - RNA, 64 nt, Homo Sapiens
gggcccuagaaauuccacagcucccguccuggccacccuggaagcucaucaggccaagacccgg

SEQ ID NO: 171812 - RNA, 64 nt, Homo Sapiens
agugggggugcuccugucuguccuuuucccccacacccuggacugugcuuggcuguuggugcac

SEQ ID NO: 171813 - RNA, 64 nt, Homo Sapiens
uuuucccaugugcagggugagguuuuuuuuugccacccuggacacauguuggcccccucaaaga

SEQ ID NO: 171814 - RNA, 64 nt, Homo Sapiens
ucucccaccuccuccccucucccucccccuggagacccuggaagugguguguucacauacagug

SEQ ID NO: 171815 - RNA, 64 nt, Homo Sapiens
cagacuuaggcgcgcccgguagccccggcugcccacccuggagggcugcgcccgcgccaggcgc

SEQ ID NO: 171816 - RNA, 64 nt, Homo Sapiens
ccaggcauagggggcaagcucuuggggcaucaggacccuggagcaccagguccuuccuggaaua

SEQ ID NO: 171817 - RNA, 64 nt, Homo Sapiens
aacgaauuaauuaccuggcaacaccccgucguauacccuggaugugccccagacacagugccca

SEQ ID NO: 171818 - RNA, 64 nt, Homo Sapiens
ccgaggcccaggcagcagcccugauggggaguaaacccuggaguucacagacccacaagagaag

SEQ ID NO: 171819 - RNA, 64 nt, Homo Sapiens
accaccccugggugcucaguuucuaccaacaugagccagcaaguccuugugguagcccuggggu

SEQ ID NO: 171820 - RNA, 64 nt, Homo Sapiens
guaguagacucggguccuguccacagcccuagcugccagcaaugcuguccucacagaggcauag

SEQ ID NO: 171821 - RNA, 64 nt, Homo Sapiens
aggccaaugcaagaggccaaggcuggagaggcgugccagcaaggccagggauggccggagggcu

SEQ ID NO: 171822 - RNA, 64 nt, Homo Sapiens
agggaagcucuuagaaucccgucaccugauuuaggccagcaaccuggucagaaacaaagggcug

SEQ ID NO: 171823 - RNA, 64 nt, Homo Sapiens
auccuugccagaguuuuuucgagcacauuuucaggccagcaacuugagucacugcuaagagaca

SEQ ID NO: 171824 - RNA, 64 nt, Homo Sapiens
gccaucagacaaccagaagcccagcuggguagcagccagcaaaguuaaauaacucgaucuguac

SEQ ID NO: 171825 - RNA, 64 nt, Homo Sapiens
gcugaagguggcgaugaacagggaacugagaggugccagcaauuccaacacacucagcaucccu

SEQ ID NO: 171826 - RNA, 64 nt, Homo Sapiens
aggggccacugagcaccaggagcagaggcagccagccagcaaaggagugugugggguauggggc

SEQ ID NO: 171827 - RNA, 64 nt, Homo Sapiens
ccccuggcccagugagcccacucccguccacacugccagcaaugaggaggcagcgcccugcagc

SEQ ID NO: 171828 - RNA, 64 nt, Homo Sapiens
guuaggggccuuagggcacuggggucaagaaacagccagcaagaaggacucccaacccuggcuu

SEQ ID NO: 171829 - RNA, 64 nt, Homo Sapiens
cuuguagaacucacucugggagcccauccauuaggccagcaacgcugucccacccccuuccccc

SEQ ID NO: 171830 - RNA, 64 nt, Homo Sapiens
gugggaaguaguacugcuagucauggucucaccccgagcugaccccucugccugggcuuugugc

SEQ ID NO: 171831 - RNA, 64 nt, Homo Sapiens
aaggaguugggggguagaggcaggaaaugggaaccgagcugaagcagaggcugaguuagggggc

SEQ ID NO: 171832 - RNA, 64 nt, Homo Sapiens
acuuucagcauccaguagaugggaccucgaggcucgagcugaagcaggcgagagagaaacagcu

SEQ ID NO: 171833 - RNA, 64 nt, Homo Sapiens
uggggagugguagaagcaacugaacggaugcgugcgagcugaggacagggcgggaggagggggc

SEQ ID NO: 171834 - RNA, 64 nt, Homo Sapiens
acgcggagccagcgccgucggagaccgcgccggccgagcugaggacugcacgccgcugugcgga

SEQ ID NO: 171835 - RNA, 64 nt, Homo Sapiens
gacaucacuguuuguaccaaucagacuuccagcacgagcugacuacuccaaacacggaacgaau

SEQ ID NO: 171836 - RNA, 64 nt, Homo Sapiens
uagaaaaacgucuccgagaaagcggguugaugaccgagcugagggcgaggacaccguguacagg

SEQ ID NO: 171837 - RNA, 64 nt, Homo Sapiens
guuugcaaguguguuuguuccuuuuaacacuccccgagcugauuauucugaauuuuuugagggc

SEQ ID NO: 171838 - RNA, 64 nt, Homo Sapiens
uuccuccacuguguccaguuuuauuuacacaaagcgagcugagaccacagguucuugcucugga

SEQ ID NO: 171839 - RNA, 64 nt, Homo Sapiens
acaauuuuaacuuggaaaagacucagaggacagucgagcugaagugaugagaagaauacagaca

SEQ ID NO: 171840 - RNA, 64 nt, Homo Sapiens
gcaucccuggguggccuuuccugcugacacuccacgagcugacccagcagaauucucuguguag

SEQ ID NO: 171841 - RNA, 61 nt, Homo Sapiens
ucgaguccuccaagaucugaggccagcagagcgagcugacagcagcaacacugucagaagg

SEQ ID NO: 171842 - RNA, 64 nt, Homo Sapiens
auuacagacaagagaugcgggguagagguagccacgagcugauagacaagagguagaggggaga

SEQ ID NO: 171843 - RNA, 54 nt, Homo Sapiens
gcagagcugcgaaggggaacugggcgagcugagcgagaggcaguggcacacuga

SEQ ID NO: 171844 - RNA, 64 nt, Homo Sapiens
ggaggggcccgguggcggcagggccaggcugguccgagcugaggacucugcaagugucuggagc

SEQ ID NO: 171845 - RNA, 64 nt, Homo Sapiens
aucagcuuccagguguagggaccccuugaggggccgagcugacauccaaggcugaggaccccag

SEQ ID NO: 171846 - RNA, 64 nt, Homo Sapiens
auugcacagagcuagacucgggcagccagagcggcgagcugaguaacagggguaacaccucccu

SEQ ID NO: 171847 - RNA, 64 nt, Homo Sapiens
aauuucuuuuuuaugaaaagggauauaaaggcaccgagcugaugcaguauuuguaauauuaagu

SEQ ID NO: 171848 - RNA, 64 nt, Homo Sapiens
cacagcuuggccauuugaggcaaaggcagcuucccgagcugaugcuaaagaagacagacuuucc

SEQ ID NO: 171849 - RNA, 64 nt, Homo Sapiens
gccggguuucccuauuccaaccgccggcuugcgccgagcugaguggcucucuagucugaaggca

SEQ ID NO: 171850 - RNA, 64 nt, Homo Sapiens
ggccaucacuucugaggagcagaguugagggagccgagcugagccacgcugggaggccagagcc

SEQ ID NO: 171851 - RNA, 64 nt, Homo Sapiens
augaaaagucagaaaugcuaagacaauacaccuccgagcugaaucucgacugcacaggagcccg

SEQ ID NO: 171852 - RNA, 64 nt, Homo Sapiens
gcacacucccaggagaaauggugcacuaugaaaacgagcugacaagcagaauguuucccuucau

SEQ ID NO: 171853 - RNA, 64 nt, Homo Sapiens
agaaucacuugaacgugggaggcggagguugcagcgagcugagaucaugccguuguacuccagc

SEQ ID NO: 171854 - RNA, 64 nt, Homo Sapiens
ucacaccacugcacuccagcggucaagccugcagcgagcugagaaggaucacuugggcccagga

SEQ ID NO: 171855 - RNA, 64 nt, Homo Sapiens
aucaggaccuugccucgaauuggcaaacaaaacccgagcugagcggagucuccaaagcacagag

SEQ ID NO: 171856 - RNA, 64 nt, Homo Sapiens
aaaauccugggcacuucugcagggcugcugguuccgagcugacacccgucuuaacaaaaggccc

SEQ ID NO: 171857 - RNA, 64 nt, Homo Sapiens
ucuuuuucagaacuguuaaaguuuugauguacaucgagcugaauucuguuuuuaccaguuucaa

SEQ ID NO: 171858 - RNA, 64 nt, Homo Sapiens
acuugaaggagcaggucaagagaaccucauggcccgagcugaauuaucuuuccuuggcagguuc

SEQ ID NO: 171859 - RNA, 64 nt, Homo Sapiens
agcagccaaggcccuguccuuucuugaaugguggcgagcugaaucuggucgguuuccuagcuuu

SEQ ID NO: 171860 - RNA, 64 nt, Homo Sapiens
ggccggacgaaggaugcuuucuuccuagaggcuccgagcugagcugcgaacucgccccccgccc

SEQ ID NO: 171861 - RNA, 64 nt, Homo Sapiens
uccccgcucacaacuuggguucuucucagcggggcgagcugagaagcggucaugagcaccuggg

SEQ ID NO: 171862 - RNA, 64 nt, Homo Sapiens
agaauugcuugaacacaggaggcagagguugcagcgagcugagaucacgccacugugcuccagc

SEQ ID NO: 171863 - RNA, 64 nt, Homo Sapiens
acccucuaguggaggcgggggugaauucuuaggucgagcugaugcaagaaacuccgguagccag

SEQ ID NO: 171864 - RNA, 64 nt, Homo Sapiens
accagugggugaccggggagucucuggugcccagcgagcugagccucaggggccagucccugug

SEQ ID NO: 171865 - RNA, 64 nt, Homo Sapiens
gacuucuccuuuuucucucccuccagagcucccacgagcugaugcacccccaggcuucaaacca

SEQ ID NO: 171866 - RNA, 64 nt, Homo Sapiens
ucacaccacugcacuccagcgguggagguuucagcgagcugagaagaaucacuugagcccagga

SEQ ID NO: 171867 - RNA, 64 nt, Homo Sapiens
aacuggguaugaggcuggggcaguuaccgcuggccgagcugaaguccaggauucugggaggcuu

SEQ ID NO: 171868 - RNA, 64 nt, Homo Sapiens
uugagcugcuucagugaauguacagugcccggcacgagcugaaccucauguguuccacucccaa

SEQ ID NO: 171869 - RNA, 64 nt, Homo Sapiens
auaggcagggaaccgagcagcaggucagagcaggcgagcugacauucugcagccuggacggcca

SEQ ID NO: 171870 - RNA, 64 nt, Homo Sapiens
ccaguggaagaaacaggccaggagaagugcgugccgagcugaggcagauguucccacagugacc

SEQ ID NO: 171871 - RNA, 64 nt, Homo Sapiens
acuggaugcucuaugaaugcuccacgcccccuuccgagcugaccacuggaccauuccauguggu

SEQ ID NO: 171872 - RNA, 64 nt, Homo Sapiens
gggccacagacaucauugcuguuccccguuaccucgagcugacucuagaggggaaggcagagcu

SEQ ID NO: 171873 - RNA, 64 nt, Homo Sapiens
acacauggacuagcugagugguccugugggagggcgagcugagaugagggcaccgccuauuggu

SEQ ID NO: 171874 - RNA, 64 nt, Homo Sapiens
ggaggcuuuugaacccaggaggcagagguugcagcgagcugagaucgcgccacugcacuccagc

SEQ ID NO: 171875 - RNA, 64 nt, Homo Sapiens
uuucccuuuucucugguggccuguuguggugcaacgagcugauggcauuugaucuugccccauu

SEQ ID NO: 171876 - RNA, 64 nt, Homo Sapiens; identical to SEQ ID NO: 153609

SEQ ID NO: 171877 - RNA, 64 nt, Homo Sapiens; identical to SEQ ID NO: 153610

SEQ ID NO: 171878 - RNA, 64 nt, Homo Sapiens; identical to SEQ ID NO: 153611

SEQ ID NO: 171879 - RNA, 64 nt, Homo Sapiens; identical to SEQ ID NO: 153612

SEQ ID NO: 171880 - RNA, 64 nt, Homo Sapiens; identical to SEQ ID NO: 153613

SEQ ID NO: 171881 - RNA, 64 nt, Homo Sapiens; identical to SEQ ID NO: 153614

SEQ ID NO: 171882 - RNA, 64 nt, Homo Sapiens; identical to SEQ ID NO: 153615

SEQ ID NO: 171883 - RNA, 64 nt, Homo Sapiens; identical to SEQ ID NO: 153616

SEQ ID NO: 171884 - RNA, 64 nt, Homo Sapiens; identical to SEQ ID NO: 153617

SEQ ID NO: 171885 - RNA, 64 nt, Homo Sapiens; identical to SEQ ID NO: 153618

SEQ ID NO: 171886 - RNA, 64 nt, Homo Sapiens; identical to SEQ ID NO: 153619

SEQ ID NO: 171887 - RNA, 64 nt, Homo Sapiens; identical to SEQ ID NO: 153620

SEQ ID NO: 171888 - RNA, 64 nt, Homo Sapiens; identical to SEQ ID NO: 153621

SEQ ID NO: 171889 - RNA, 64 nt, Homo Sapiens; identical to SEQ ID NO: 153622

SEQ ID NO: 171890 - RNA, 64 nt, Homo Sapiens; identical to SEQ ID NO: 153623

SEQ ID NO: 171891 - RNA, 64 nt, Homo Sapiens; identical to SEQ ID NO: 153624

SEQ ID NO: 171892 - RNA, 64 nt, Homo Sapiens; identical to SEQ ID NO: 153625

SEQ ID NO: 171893 - RNA, 64 nt, Homo Sapiens; identical to SEQ ID NO: 153626

SEQ ID NO: 171894 - RNA, 64 nt, Homo Sapiens; identical to SEQ ID NO: 153627

SEQ ID NO: 171895 - RNA, 64 nt, Homo Sapiens
ggccuuaagguagcagucaucacccaaagucagaaucccucauugaaaaacccaaguucauucc

SEQ ID NO: 171896 - RNA, 64 nt, Homo Sapiens
gcaucagacaugggaaaauuuuuucguaucuucuaucccucaaaagaaggagcagaaauaguua

SEQ ID NO: 171897 - RNA, 64 nt, Homo Sapiens
aaauucuauagggagacagcuaaaaaaagguggaaucccucaaaggaacaggaaggaugugcuu

SEQ ID NO: 171898 - RNA, 64 nt, Homo Sapiens
ugaaaugcuuaggaccaggaaguacugguugaguaucccucaucuauauguagauggauauagc

SEQ ID NO: 171899 - RNA, 64 nt, Homo Sapiens
ccaucccccaucuaagaauccuaagaggcaggcgaucccucaccugcuuacucacucagcaguu

SEQ ID NO: 171900 - RNA, 64 nt, Homo Sapiens
caggaauggggggugcugagucaucucacgaagaaucccucacucuucccggguucagcccaga

SEQ ID NO: 171901 - RNA, 64 nt, Homo Sapiens; identical to SEQ ID NO: 72506

SEQ ID NO: 171902 - RNA, 64 nt, Homo Sapiens; identical to SEQ ID NO: 72507

SEQ ID NO: 171903 - RNA, 64 nt, Homo Sapiens; identical to SEQ ID NO: 72508

SEQ ID NO: 171904 - RNA, 64 nt, Homo Sapiens; identical to SEQ ID NO: 72509

SEQ ID NO: 171905 - RNA, 64 nt, Homo Sapiens; identical to SEQ ID NO: 72510

SEQ ID NO: 171906 - RNA, 64 nt, Homo Sapiens; identical to SEQ ID NO: 72511

SEQ ID NO: 171907 - RNA, 64 nt, Homo Sapiens; identical to SEQ ID NO: 72512

SEQ ID NO: 171908 - RNA, 64 nt, Homo Sapiens; identical to SEQ ID NO: 72513

SEQ ID NO: 171909 - RNA, 64 nt, Homo Sapiens; identical to SEQ ID NO: 72514

SEQ ID NO: 171910 - RNA, 64 nt, Homo Sapiens; identical to SEQ ID NO: 72515

SEQ ID NO: 171911 - RNA, 64 nt, Homo Sapiens; identical to SEQ ID NO: 72516

SEQ ID NO: 171912 - RNA, 64 nt, Homo Sapiens; identical to SEQ ID NO: 72517

SEQ ID NO: 171913 - RNA, 64 nt, Homo Sapiens; identical to SEQ ID NO: 72518

SEQ ID NO: 171914 - RNA, 64 nt, Homo Sapiens; identical to SEQ ID NO: 72519

SEQ ID NO: 171915 - RNA, 64 nt, Homo Sapiens; identical to SEQ ID NO: 72520

SEQ ID NO: 171916 - RNA, 64 nt, Homo Sapiens; identical to SEQ ID NO: 72521

SEQ ID NO: 171917 - RNA, 64 nt, Homo Sapiens; identical to SEQ ID NO: 72522

SEQ ID NO: 171918 - RNA, 64 nt, Homo Sapiens; identical to SEQ ID NO: 72523

SEQ ID NO: 171919 - RNA, 64 nt, Homo Sapiens; identical to SEQ ID NO: 72524

SEQ ID NO: 171920 - RNA, 64 nt, Homo Sapiens; identical to SEQ ID NO: 72525

SEQ ID NO: 171921 - RNA, 64 nt, Homo Sapiens; identical to SEQ ID NO: 72526

SEQ ID NO: 171922 - RNA, 64 nt, Homo Sapiens; identical to SEQ ID NO: 72527

SEQ ID NO: 171923 - RNA, 64 nt, Homo Sapiens; identical to SEQ ID NO: 72528

SEQ ID NO: 171924 - RNA, 64 nt, Homo Sapiens; identical to SEQ ID NO: 72529

SEQ ID NO: 171925 - RNA, 64 nt, Homo Sapiens; identical to SEQ ID NO: 72530

SEQ ID NO: 171926 - RNA, 64 nt, Homo Sapiens; identical to SEQ ID NO: 72531

SEQ ID NO: 171927 - RNA, 64 nt, Homo Sapiens; identical to SEQ ID NO: 72532

SEQ ID NO: 171928 - RNA, 64 nt, Homo Sapiens; identical to SEQ ID NO: 72533

SEQ ID NO: 171929 - RNA, 64 nt, Homo Sapiens; identical to SEQ ID NO: 72534

SEQ ID NO: 171930 - RNA, 64 nt, Homo Sapiens; identical to SEQ ID NO: 72535

SEQ ID NO: 171931 - RNA, 64 nt, Homo Sapiens; identical to SEQ ID NO: 72536

SEQ ID NO: 171932 - RNA, 64 nt, Homo Sapiens; identical to SEQ ID NO: 72537

SEQ ID NO: 171933 - RNA, 64 nt, Homo Sapiens; identical to SEQ ID NO: 72538

SEQ ID NO: 171934 - RNA, 64 nt, Homo Sapiens; identical to SEQ ID NO: 72539

SEQ ID NO: 171935 - RNA, 64 nt, Homo Sapiens; identical to SEQ ID NO: 72540

SEQ ID NO: 171936 - RNA, 64 nt, Homo Sapiens; identical to SEQ ID NO: 72541

SEQ ID NO: 171937 - RNA, 64 nt, Homo Sapiens; identical to SEQ ID NO: 72542

SEQ ID NO: 171938 - RNA, 64 nt, Homo Sapiens; identical to SEQ ID NO: 72543

SEQ ID NO: 171939 - RNA, 64 nt, Homo Sapiens; identical to SEQ ID NO: 72544

SEQ ID NO: 171940 - RNA, 64 nt, Homo Sapiens; identical to SEQ ID NO: 72545

SEQ ID NO: 171941 - RNA, 64 nt, Homo Sapiens; identical to SEQ ID NO: 72546

SEQ ID NO: 171942 - RNA, 64 nt, Homo Sapiens; identical to SEQ ID NO: 72547

SEQ ID NO: 171943 - RNA, 64 nt, Homo Sapiens; identical to SEQ ID NO: 72548

SEQ ID NO: 171944 - RNA, 64 nt, Homo Sapiens; identical to SEQ ID NO: 72549

SEQ ID NO: 171945 - RNA, 64 nt, Homo Sapiens; identical to SEQ ID NO: 72550

SEQ ID NO: 171946 - RNA, 64 nt, Homo Sapiens; identical to SEQ ID NO: 72551

SEQ ID NO: 171947 - RNA, 64 nt, Homo Sapiens; identical to SEQ ID NO: 72552

SEQ ID NO: 171948 - RNA, 64 nt, Homo Sapiens; identical to SEQ ID NO: 72553

SEQ ID NO: 171949 - RNA, 64 nt, Homo Sapiens; identical to SEQ ID NO: 72554

SEQ ID NO: 171950 - RNA, 64 nt, Homo Sapiens; identical to SEQ ID NO: 72555

SEQ ID NO: 171951 - RNA, 64 nt, Homo Sapiens; identical to SEQ ID NO: 72556

SEQ ID NO: 171952 - RNA, 64 nt, Homo Sapiens; identical to SEQ ID NO: 72557

SEQ ID NO: 171953 - RNA, 64 nt, Homo Sapiens; identical to SEQ ID NO: 72558

SEQ ID NO: 171954 - RNA, 64 nt, Homo Sapiens; identical to SEQ ID NO: 72559

SEQ ID NO: 171955 - RNA, 64 nt, Homo Sapiens; identical to SEQ ID NO: 72560

SEQ ID NO: 171956 - RNA, 64 nt, Homo Sapiens; identical to SEQ ID NO: 72561

SEQ ID NO: 171957 - RNA, 64 nt, Homo Sapiens; identical to SEQ ID NO: 72562

SEQ ID NO: 171958 - RNA, 64 nt, Homo Sapiens; identical to SEQ ID NO: 72563

SEQ ID NO: 171959 - RNA, 64 nt, Homo Sapiens; identical to SEQ ID NO: 72564

SEQ ID NO: 171960 - RNA, 64 nt, Homo Sapiens; identical to SEQ ID NO: 72565

SEQ ID NO: 171961 - RNA, 64 nt, Homo Sapiens; identical to SEQ ID NO: 72566

SEQ ID NO: 171962 - RNA, 64 nt, Homo Sapiens; identical to SEQ ID NO: 72567

SEQ ID NO: 171963 - RNA, 64 nt, Homo Sapiens; identical to SEQ ID NO: 72568

SEQ ID NO: 171964 - RNA, 64 nt, Homo Sapiens; identical to SEQ ID NO: 72569

SEQ ID NO: 171965 - RNA, 64 nt, Homo Sapiens; identical to SEQ ID NO: 72570

SEQ ID NO: 171966 - RNA, 64 nt, Homo Sapiens; identical to SEQ ID NO: 72571

SEQ ID NO: 171967 - RNA, 64 nt, Homo Sapiens; identical to SEQ ID NO: 72572

SEQ ID NO: 171968 - RNA, 64 nt, Homo Sapiens; identical to SEQ ID NO: 72573

SEQ ID NO: 171969 - RNA, 64 nt, Homo Sapiens; identical to SEQ ID NO: 72574

SEQ ID NO: 171970 - RNA, 64 nt, Homo Sapiens; identical to SEQ ID NO: 72575

SEQ ID NO: 171971 - RNA, 64 nt, Homo Sapiens; identical to SEQ ID NO: 72576

SEQ ID NO: 171972 - RNA, 64 nt, Homo Sapiens; identical to SEQ ID NO: 72577

SEQ ID NO: 171973 - RNA, 64 nt, Homo Sapiens; identical to SEQ ID NO: 72578

SEQ ID NO: 171974 - RNA, 64 nt, Homo Sapiens; identical to SEQ ID NO: 72579

SEQ ID NO: 171975 - RNA, 64 nt, Homo Sapiens; identical to SEQ ID NO: 72580

SEQ ID NO: 171976 - RNA, 64 nt, Homo Sapiens; identical to SEQ ID NO: 72581

SEQ ID NO: 171977 - RNA, 64 nt, Homo Sapiens; identical to SEQ ID NO: 72582

SEQ ID NO: 171978 - RNA, 64 nt, Homo Sapiens; identical to SEQ ID NO: 72583

SEQ ID NO: 171979 - RNA, 64 nt, Homo Sapiens; identical to SEQ ID NO: 72584

SEQ ID NO: 171980 - RNA, 64 nt, Homo Sapiens; identical to SEQ ID NO: 72585

SEQ ID NO: 171981 - RNA, 64 nt, Homo Sapiens; identical to SEQ ID NO: 72586

SEQ ID NO: 171982 - RNA, 64 nt, Homo Sapiens; identical to SEQ ID NO: 72587

SEQ ID NO: 171983 - RNA, 64 nt, Homo Sapiens; identical to SEQ ID NO: 72588

SEQ ID NO: 171984 - RNA, 64 nt, Homo Sapiens; identical to SEQ ID NO: 72589

SEQ ID NO: 171985 - RNA, 64 nt, Homo Sapiens; identical to SEQ ID NO: 72590

SEQ ID NO: 171986 - RNA, 64 nt, Homo Sapiens; identical to SEQ ID NO: 72591

SEQ ID NO: 171987 - RNA, 64 nt, Homo Sapiens; identical to SEQ ID NO: 72592

SEQ ID NO: 171988 - RNA, 64 nt, Homo Sapiens; identical to SEQ ID NO: 72593

SEQ ID NO: 171989 - RNA, 64 nt, Homo Sapiens; identical to SEQ ID NO: 72594

SEQ ID NO: 171990 - RNA, 64 nt, Homo Sapiens; identical to SEQ ID NO: 72595

SEQ ID NO: 171991 - RNA, 64 nt, Homo Sapiens; identical to SEQ ID NO: 72596

SEQ ID NO: 171992 - RNA, 64 nt, Homo Sapiens; identical to SEQ ID NO: 72597

SEQ ID NO: 171993 - RNA, 64 nt, Homo Sapiens; identical to SEQ ID NO: 72598

SEQ ID NO: 171994 - RNA, 64 nt, Homo Sapiens; identical to SEQ ID NO: 72599

SEQ ID NO: 171995 - RNA, 64 nt, Homo Sapiens; identical to SEQ ID NO: 72600

SEQ ID NO: 171996 - RNA, 64 nt, Homo Sapiens; identical to SEQ ID NO: 72601

SEQ ID NO: 171997 - RNA, 64 nt, Homo Sapiens
ucagacguccugggauugaaagaaugugugugaagggguagaauuugugcgguaaagacuuaaa

SEQ ID NO: 171998 - RNA, 64 nt, Homo Sapiens
aagugaggaaacaggaagaaguauggugggggcugggguagacuccccuggagccaagccuauc

SEQ ID NO: 171999 - RNA, 64 nt, Homo Sapiens
gaggguagaaaguaagaagcacuuuugaauuugugggguagaacuucaacaauaagucaguucu

SEQ ID NO: 172000 - RNA, 64 nt, Homo Sapiens
uuagcagauuggaugggcagguggagaaugccuggggguagaaauguuagaucuugcaacauca

SEQ ID NO: 172001 - RNA, 64 nt, Homo Sapiens
agcuucaaucaggguucccacuacccccucuuuggggguagaguggcucauggaacucagagaa

SEQ ID NO: 172002 - RNA, 64 nt, Homo Sapiens
uuagaaaggcaagggaagauuagaguccugcuuugggguagaugaaaggaaaggagagagauuc

SEQ ID NO: 172003 - RNA, 64 nt, Homo Sapiens
cacugcccaucucuucuccacuuugagccuagcugggguagagggagcuccugauagcaggcgu

SEQ ID NO: 172004 - RNA, 64 nt, Homo Sapiens
caauaagcccacguauuuuugauaaaccauccgugggguagaugaagucugauggaaagaaaaa

SEQ ID NO: 172005 - RNA, 64 nt, Homo Sapiens
accacaccucuacggcuggggagaucaggcccagccccauaaaggagaaucuacgcugguccuc

SEQ ID NO: 172006 - RNA, 64 nt, Homo Sapiens
caggacaggcaggagagauucuuccuaaagccucccccauaaaaagggagcuguggauccacuu

SEQ ID NO: 172007 - RNA, 64 nt, Homo Sapiens
uaucugcaugauagcuuuauucucaguuaucuuuccccauaauaaaaaauaucugccaccuucu

SEQ ID NO: 172008 - RNA, 64 nt, Homo Sapiens
cuacucucuguucuugucccugccaacccccaccccccauaaucugacucacaacuucaccauc

SEQ ID NO: 172009 - RNA, 64 nt, Homo Sapiens
uuuaccagccaucagcucuaaaugggcucaaguaccccauaagaacuucacuccucauuugccc

SEQ ID NO: 172010 - RNA, 64 nt, Homo Sapiens
cuuucaaccuugugguuggggucuuaauguucugccccauaagaauuuucauauuuauaaagga

SEQ ID NO: 172011 - RNA, 64 nt, Homo Sapiens
auggaaauggcccuaauuucgcucacacguccuuccccauaacuagcugagcaccucccauccu

SEQ ID NO: 172012 - RNA, 64 nt, Homo Sapiens
gguggccucagccacacaguaggcccaggccccaccccauaacaggcagccugcagcugugucc

SEQ ID NO: 172013 - RNA, 64 nt, Homo Sapiens
aucagcccuguagagugaggaaucgacauaguagccccauaagcuuagcugguaaaugaauuug

SEQ ID NO: 172014 - RNA, 64 nt, Homo Sapiens
uuuggagguggggugggagagaacugcacaccuuccccauaaaauuuaaaauuaacacacacau

SEQ ID NO: 172015 - RNA, 64 nt, Homo Sapiens
cucacggcucuuaaguucuuccuggauguuccaaccccauaaauuggugguagauggaaggauc

SEQ ID NO: 172016 - RNA, 64 nt, Homo Sapiens
gagggaaaggacauuugagggaaacaucaaauuuccccauaaauaaaugaauggaguuugcagg

SEQ ID NO: 172017 - RNA, 64 nt, Homo Sapiens
aaugguccugacauaauaaggaucuuugauuaacccccauaaggcauguguguguauacaaaua

SEQ ID NO: 172018 - RNA, 64 nt, Homo Sapiens
cucacuucaggagcuuuuaaaaauacugagacccccccauaaccagagauucagauucaaagac

SEQ ID NO: 172019 - RNA, 64 nt, Homo Sapiens
cuuguaaaaauuaaaaguuaugguacuauguuagccccauaauuuuuuuuuuccuuuuaaaaca

SEQ ID NO: 172020 - RNA, 64 nt, Homo Sapiens
acaugcaugcugcuaaacuagaacuuuaauuuuuccccauaacuuuuauaagucccauuuauaa

SEQ ID NO: 172021 - RNA, 64 nt, Homo Sapiens
ucugucaucuccagagauaaucuggcuugguuuaccccauaaucuaauuucagaaaagaaagcu

SEQ ID NO: 172022 - RNA, 64 nt, Homo Sapiens
accauauaaccuucgauugugcuucucaacuccaccccauaauuucucccagagaccaucuauc

SEQ ID NO: 172023 - RNA, 64 nt, Homo Sapiens
uugggaucaggagcccccaacacaggcaaguccaccccauaauaacccugccagugccagggug

SEQ ID NO: 172024 - RNA, 64 nt, Homo Sapiens
cuuuuugagacgaggugagaucauuggcgcauuaccccauaaaacacuaauacuacuguaccuu

SEQ ID NO: 172025 - RNA, 64 nt, Homo Sapiens
uauuuauuccuuuuuucugugugaguuuuuuuccccccauaaguguaagagcuuugaauuugaa

SEQ ID NO: 172026 - RNA, 64 nt, Homo Sapiens
ccuaacuggacaaaugagguauacguaacccaagccccauaaccaguggauuuaaaauauauau

SEQ ID NO: 172027 - RNA, 64 nt, Homo Sapiens
gaugcaaauucugguaauaauucuugcauuuuuuccccauaaccugguuaaaauaaauacgcca

SEQ ID NO: 172028 - RNA, 64 nt, Homo Sapiens
ggucauuuguauucagaguaaaucagugguccacccccauaaaacuguaagacaagccuccugu

SEQ ID NO: 172029 - RNA, 64 nt, Homo Sapiens
cuuuuccugucccucuuccauccccaagaugugaccccauaaaaauuuuuccugaguuggccag

SEQ ID NO: 172030 - RNA, 64 nt, Homo Sapiens
cucugguaagcuuucaucucccaugaacucauuuccccauaaaugaaauggguaaauaaugccc

SEQ ID NO: 172031 - RNA, 64 nt, Homo Sapiens
uggaggauaaaauggguaucuuuacuuucccuucccccauaaguuggcucuucccucccucacu

SEQ ID NO: 172032 - RNA, 64 nt, Homo Sapiens
gugcacguaccugugucuuauucugauaguuaacccccauaaauaaccucaaaguggauucacu

SEQ ID NO: 172033 - RNA, 64 nt, Homo Sapiens
acaggcaacucagagaagagcugcaagacugccuccccauaacaucugagggagagacagugag

SEQ ID NO: 172034 - RNA, 64 nt, Homo Sapiens
cuccauuuaguucuuuguuauccucugucccuucccccauaagcagacuuaguauauuuucuuu

SEQ ID NO: 172035 - RNA, 64 nt, Homo Sapiens
ugagguaccuuuccacccagacccuccuuccccaccccauaagcccugagacucccgccuuuga

SEQ ID NO: 172036 - RNA, 64 nt, Homo Sapiens
ccauaucugcaauguguaccaaaguuauaucaugccccauaaugcuacugucaaguguuacaac

SEQ ID NO: 172037 - RNA, 64 nt, Homo Sapiens
gcccacacaggguccguugcuggcaacuggacuuccccauaagccuuggguauccugugauggg

SEQ ID NO: 172038 - RNA, 64 nt, Homo Sapiens
auauacaccuaauacccacaaaacaucucauguaccccauaaaucacauugcaugccuauauca

SEQ ID NO: 172039 - RNA, 64 nt, Homo Sapiens
ugaguauuugcuaauguugauugaaccucccuuuccccauaaugugggcagauuuggcucagcu

SEQ ID NO: 172040 - RNA, 64 nt, Homo Sapiens
aauaaggguuaacauucuaggcaguauaaacacaccccauaaugcaaguaauagguaaucuaga

SEQ ID NO: 172041 - RNA, 64 nt, Homo Sapiens
ccuguauacaucaaagagaaauguucuuuuuagaccccauaaauuaugaacacuuuauaauugu

SEQ ID NO: 172042 - RNA, 64 nt, Homo Sapiens
uggggauugggcaguguggauccccucagucaacccccauaacccugguuugcgggagauuucc

SEQ ID NO: 172043 - RNA, 64 nt, Homo Sapiens
accuuuuaaacuuuucacuuugugagcaaaguaaccccauaaguuuauuucccuauuucauggu

SEQ ID NO: 172044 - RNA, 64 nt, Homo Sapiens
gacauucuauuuauuuucgcaguaauucucauguccccauaagcagagcugucacagugugcac

SEQ ID NO: 172045 - RNA, 64 nt, Homo Sapiens
agaauuggaagccugcuuaaaaaauguaguugagccccauaauuuuacaaaugggcgaacuuuu

SEQ ID NO: 172046 - RNA, 64 nt, Homo Sapiens
auaaaugggcccauauuuaaagucucacacccuuccccauaaguccaaacucauccuuguguau

SEQ ID NO: 172047 - RNA, 64 nt, Homo Sapiens
gagguaucuuuuugucacacaucuuccucaauuuccccauaaauguuggggugcuuguauaugu

SEQ ID NO: 172048 - RNA, 64 nt, Homo Sapiens
acuggcuguaaccuuaagccgucagccuucucucccccauaagggcauuuuucuacaagaagca

SEQ ID NO: 172049 - RNA, 64 nt, Homo Sapiens
aaaggaucaggaugaugguaacuugaguuuauugccccauaacugcuggcacuuuacucauugc

SEQ ID NO: 172050 - RNA, 64 nt, Homo Sapiens
agauccauuaauuuaaaugacacucauuaauuaaccccauaauugaauuaccauuuguuaauau

SEQ ID NO: 172051 - RNA, 64 nt, Homo Sapiens
cucaaaaauagucacaaauaauagcaguuuagguccccauaaucaguaauauuuuguauaaaac

SEQ ID NO: 172052 - RNA, 64 nt, Homo Sapiens
aaguggaaaauuucaggauacaaagcacauaacaccccauaagagaugauuauguuuuuagaag

SEQ ID NO: 172053 - RNA, 64 nt, Homo Sapiens
gaugcgcaggauuuaggauaagcugucacccaguccccauaacaaaaccacuguccaacacugg

SEQ ID NO: 172054 - RNA, 64 nt, Homo Sapiens
cugagaacaaaccucaagacuaucagugugaccuccccauaacaagagaaccccauauauaguu

SEQ ID NO: 172055 - RNA, 64 nt, Homo Sapiens
ccagaaauuggcuuaaugauucuucuuaauauucccccauaaugaguauaacagauauucuaau

SEQ ID NO: 172056 - RNA, 64 nt, Homo Sapiens
aaacauaagcuagcuagucucccccacucccuugccccauaaccccagaaaggacagaaucucu

SEQ ID NO: 172057 - RNA, 64 nt, Homo Sapiens
cguccucuuugggugcacggugcugugcuuggcuccccauaagacccggccaccacgcauggca

SEQ ID NO: 172058 - RNA, 64 nt, Homo Sapiens
cagugaacacagagcagcuaguccugcugaaaacccccauaagcaucuuugcuugcagcccucc

SEQ ID NO: 172059 - RNA, 64 nt, Homo Sapiens
uaaaccuuccugaaaagacuagcacaaaaaaaucccccauaaaaaugugauuuugggguacuaa

SEQ ID NO: 172060 - RNA, 64 nt, Homo Sapiens
uuauugccugagaacuuaguagccugucauguuuccccauaaauuacacauagcuuuaaugagg

SEQ ID NO: 172061 - RNA, 64 nt, Homo Sapiens
uuuggaaacauuuaggaauauuuuucucccccuaccccauaaauuguguagcacuuuuuauucc

SEQ ID NO: 172062 - RNA, 64 nt, Homo Sapiens
agaggcaaaguggaccuggcaaccacaagacccuccccauaagcaggggaccagcauacccggg

SEQ ID NO: 172063 - RNA, 64 nt, Homo Sapiens
uuuccuugggauugccccuaucacugugugcauaccccauaaccuaauuuagugauucugugag

SEQ ID NO: 172064 - RNA, 64 nt, Homo Sapiens
caucgguuugaccccugaccuauaagccaagauaccccauaaacacacucagaaagcagagaaa

SEQ ID NO: 172065 - RNA, 64 nt, Homo Sapiens
ccccauggccccucuccacaccucaaaacuccugccccauaacguccuccgcauccacuuucca

SEQ ID NO: 172066 - RNA, 64 nt, Homo Sapiens
ucauucaaagaauacuagaaccucucugccaccaccccauaaucagugcgcucauuuuaggccu

SEQ ID NO: 172067 - RNA, 64 nt, Homo Sapiens
acugaccagccuugacacucgggcccugacucuuccccauaaucagccacuucauuccccugau

SEQ ID NO: 172068 - RNA, 64 nt, Homo Sapiens
aaggcgaggaaaacccaugggaaaggugcauuuuccccauaaaauccaauuaucuucuaggauu

SEQ ID NO: 172069 - RNA, 64 nt, Homo Sapiens
gggauuuaucauuuuggaggcauuaugaccuagcccccauaauuauauaaagauuuuaaaacug

SEQ ID NO: 172070 - RNA, 64 nt, Homo Sapiens
aauggcugcuuugaacuuacucaggaaagccagcccccauaauauuguauuaccaaacaguauc

SEQ ID NO: 172071 - RNA, 64 nt, Homo Sapiens
accaaauucgcccuuuaacagcuugcucuggcaaccccauaaaugacaccugagguccguagaa

SEQ ID NO: 172072 - RNA, 64 nt, Homo Sapiens
guugacuuuccucccauuuuaccacuuuaaacacccccauaacaauucccccauccuucaguga

SEQ ID NO: 172073 - RNA, 64 nt, Homo Sapiens
ccugagugccucccuugccucacucugauccuggccccauaauguccucaguggaaggugaugg

SEQ ID NO: 172074 - RNA, 64 nt, Homo Sapiens
gcuggcggcuuccuccgacggggcuuggagcuggccccauaaggaccaaugccgcgguggaaac

SEQ ID NO: 172075 - RNA, 64 nt, Homo Sapiens
guuccuaagccuucaccggauccuccuccucccaccccauaacuccgcuucugugugcuugucc

SEQ ID NO: 172076 - RNA, 64 nt, Homo Sapiens
gugugcauuucaguuaggcuuguccguccacuucccccauaaaggaaacaugagggaggugagg

SEQ ID NO: 172077 - RNA, 64 nt, Homo Sapiens
auaccucgaauuuccaaaagccggagucccuccaccccauaacaagccccgccccuuucuuucc

SEQ ID NO: 172078 - RNA, 64 nt, Homo Sapiens
gauauguugaaguucuaaccgguugaauugugucccccauaaaauguagaugauauguuucgug

SEQ ID NO: 172079 - RNA, 64 nt, Homo Sapiens
acagagucugacaggaagacgcugacugggaacaccccauaacucugcacuuggugcugcuuug

SEQ ID NO: 172080 - RNA, 64 nt, Homo Sapiens
uuuauuuguuuuucauucaucccauuaaucauuuccccauaacucaauggccuaaaacuggccu

SEQ ID NO: 172081 - RNA, 64 nt, Homo Sapiens
aguugaauuguuuucugccuacaccguucaucagccccauaacccaggaaggaacaggcauugu

SEQ ID NO: 172082 - RNA, 64 nt, Homo Sapiens
uacacguuagauuugccguaccaaucucugaaugccccauaauuauuauuuccaguguuuggga

SEQ ID NO: 172083 - RNA, 64 nt, Homo Sapiens
caggcaaagacacccuuagcucaccuuuaauagaccccauaacccacuaugccuuccuguccuu

SEQ ID NO: 172084 - RNA, 64 nt, Homo Sapiens
cuuuaaaucucuuuaaugagugaauccaugcaagccccauaaaacaguuccuagcaugcagaaa

SEQ ID NO: 172085 - RNA, 64 nt, Homo Sapiens
acauguaauaaauaaaacaauaugagcauaauugccccauaaagaacucauguccugaauuaau

SEQ ID NO: 172086 - RNA, 64 nt, Homo Sapiens
uauccuauuauuucugaauauauguccucaaaauccccauaaauauccaucccuuccuagaugg

SEQ ID NO: 172087 - RNA, 64 nt, Homo Sapiens
uuaggcaugaggaggagcacccaacucuuguuucccccauaaaguaagauccaaguuauuuucc

SEQ ID NO: 172088 - RNA, 64 nt, Homo Sapiens
acugaaacucagucuaggucaaaaugaccuauauccccauaagaucugccauaauucugagaag

SEQ ID NO: 172089 - RNA, 64 nt, Homo Sapiens
ugauccugccaaucuaauguuguaccuguuccucccccauaaaauacucugccccuaagcuggc

SEQ ID NO: 172090 - RNA, 64 nt, Homo Sapiens
ccauggucaaugcuggugccaugaggaaggaaucccccauaacccuacaacaagcucucccuca

SEQ ID NO: 172091 - RNA, 64 nt, Homo Sapiens
uccaguaucauuuuccaauuacucugcaccuaauccccauaacucugcuguauaagguaauaaa

SEQ ID NO: 172092 - RNA, 64 nt, Homo Sapiens
guucuaguuagaaaggguucgaaacauuuggaagccccauaauuggguccacgcccauguaccu

SEQ ID NO: 172093 - RNA, 64 nt, Homo Sapiens
aaauucauauuuagccauaguauaugauagauugccccauaacauaguuuuucaucaagaguuu

SEQ ID NO: 172094 - RNA, 64 nt, Homo Sapiens
caccuucuaugcaugcaacaaaaugccacguguaccccauaaauauguagaaauauuauaugua

SEQ ID NO: 172095 - RNA, 64 nt, Homo Sapiens
uaauucuaaauaaaccucuucccauacaccuuucccccauaagaugugucuucaacacuauaaa

SEQ ID NO: 172096 - RNA, 64 nt, Homo Sapiens
ucuuuuuuuaaaggaaauuauauaaaccuuuugcccccauaauuuauaagcaugacauguuuac

SEQ ID NO: 172097 - RNA, 64 nt, Homo Sapiens
uuaugaaccuuuuugcaacuguuaguuccaucagccccauaaaagcagaggaugagaggaaggu

SEQ ID NO: 172098 - RNA, 64 nt, Homo Sapiens
aaagauccccuucagcccccugccagagucacugccccauaaucaccaugucagaagggacccu

SEQ ID NO: 172099 - RNA, 64 nt, Homo Sapiens
aauccauucuugacauucaguuaguccagaucugccccauaauuugcuuuaguaaagucacuuu

SEQ ID NO: 172100 - RNA, 64 nt, Homo Sapiens
cagguuguuuucuacuuugccccuuucaguauguccccauaagacaaacacugccauauugugu

SEQ ID NO: 172101 - RNA, 64 nt, Homo Sapiens
gccccuuggaugugaugguacacagugggugggcccccauaauaaguuccuaaagcaugggauc

SEQ ID NO: 172102 - RNA, 64 nt, Homo Sapiens
gcauacacauacaugcacacucccagcuccccauccccauaaaucuuccuuuuccucacugaau

SEQ ID NO: 172103 - RNA, 64 nt, Homo Sapiens
guuuauuugguuggucuggacacccuucugucucccccauaauaacuuugccacugacuucucc

SEQ ID NO: 172104 - RNA, 64 nt, Homo Sapiens
cccaugugucuagggagagaucucgaauuguaauccccauaaucguguccucacccaaauuuca

SEQ ID NO: 172105 - RNA, 64 nt, Homo Sapiens
cacacacaugagcagggugauaccgggugauaggccccauaagaccagcauccuaggcucagcu

SEQ ID NO: 172106 - RNA, 64 nt, Homo Sapiens
gguauuggcauuugaggucggaaacccucuacugccccauaagccaggaaaagugaaaagagaa

SEQ ID NO: 172107 - RNA, 64 nt, Homo Sapiens
auaguggcauacugucacuuagguuuagacgaaaccccauaauucuguaccugcaguguaguaa

SEQ ID NO: 172108 - RNA, 64 nt, Homo Sapiens
ccuggacuuggggagaaugacuuucccuuuuuugccccauaagggcuagcauaagcugagguag

SEQ ID NO: 172109 - RNA, 64 nt, Homo Sapiens
guccagcccugaugauuggccccaccuccugcugccccauaacccucucuucauuucggcuuuu

SEQ ID NO: 172110 - RNA, 64 nt, Homo Sapiens
caaggagguagaauuacuaaacuaggacuuuuccccccauaagcuaaaaugccagcaauuuaaa

SEQ ID NO: 172111 - RNA, 64 nt, Homo Sapiens
uugggaguaucugcuuuuguccuccguuagcuuuccccauaagggccacggugcugugaguauu

SEQ ID NO: 172112 - RNA, 64 nt, Homo Sapiens
agauaucauccuuuucuucugccucgccugaaucccccauaaacaccagaugauugagucuacc

SEQ ID NO: 172113 - RNA, 64 nt, Homo Sapiens
cccagcgauuuuuccuuggaggucagcccguuacccccauaacugauuuaccuacuuaccauac

SEQ ID NO: 172114 - RNA, 64 nt, Homo Sapiens
cuugccaucccuacaaggccggacaucgucuuauccccauaaucgcugcccccccacguagccu

SEQ ID NO: 172115 - RNA, 64 nt, Homo Sapiens
uugggagcgagggcccagccuugaggcccgccacccccauaacuuccccacccccgguccccca

SEQ ID NO: 172116 - RNA, 64 nt, Homo Sapiens
uccacgcuucaggaaguuguuagugucucacuggccccauaaauaugugagaguugugaaauuu

SEQ ID NO: 172117 - RNA, 64 nt, Homo Sapiens
agugucauguuagcugagucgcacaucacuccagccccauaaagagucaucccccguggugucu

SEQ ID NO: 172118 - RNA, 64 nt, Homo Sapiens
acagcggcugccugucccuucuucacccccucacccccauaauuugucuagaucuauuuccaua

SEQ ID NO: 172119 - RNA, 64 nt, Homo Sapiens
ugugcuuguuagcagguuuuucuguuaguuuuucccccauaacauuuaauuauuacuaaaauug

SEQ ID NO: 172120 - RNA, 64 nt, Homo Sapiens
ggaaaagcaugcuaaaaauagucuuauauuuucaccccauaaaugcagaaucaguaauuccuug

SEQ ID NO: 172121 - RNA, 64 nt, Homo Sapiens
uggcucgaugauguuaacaguauuaaaaauuaaaccccauaaaccaacuaagccuuauggaauu

SEQ ID NO: 172122 - RNA, 64 nt, Homo Sapiens
gcaguagcuuuugaaacucauacucuacagauugccccauaagacacaaauuuugugaguuuag

SEQ ID NO: 172123 - RNA, 64 nt, Homo Sapiens
ccacccccucggggcagaguuugcacaaagucccccccauaauacagggggagccacuugggca

SEQ ID NO: 172124 - RNA, 64 nt, Homo Sapiens
uauuaccuggaggccuguccagcacccacccuacccccauaaagcauuguuuacaccugugucu

SEQ ID NO: 172125 - RNA, 64 nt, Homo Sapiens
ucuuuaacccaacuuuuuauacgaugccccaguuccccauaacuuugcacacaagcuucugugu

SEQ ID NO: 172126 - RNA, 64 nt, Homo Sapiens
acugaguuuauccaccgccauccaccucuauccaccccauaaggucccuacagcaagugggaca

SEQ ID NO: 172127 - RNA, 64 nt, Homo Sapiens
uaaaggcucuaauaauagaauauuuacuuacagaccccauaauguauucgaugagguuuccaug

SEQ ID NO: 172128 - RNA, 64 nt, Homo Sapiens
uucugcuucccacagguuuugaugacccaacuacccccauaacucccacuccuugggccccuag

SEQ ID NO: 172129 - RNA, 64 nt, Homo Sapiens
auguacaauucuguauacauaauauugcuguccaccccauaaauacguuguauacauguacugc

SEQ ID NO: 172130 - RNA, 64 nt, Homo Sapiens
ugucauucuuagcccccuacuguggcccccauagccccauaacccagagagggagcuggacuuc

SEQ ID NO: 172131 - RNA, 64 nt, Homo Sapiens
aagcuagauccaaauaaaagaaaguucaguuuucccccauaacuauucuugggucaugaacuuu

SEQ ID NO: 172132 - RNA, 64 nt, Homo Sapiens
uagagcuaaaauaugaucuuuuuuaauuucucaaccccauaauuugagccauugccuugcuuaa

SEQ ID NO: 172133 - RNA, 64 nt, Homo Sapiens
cuucuuuccucuuaaugucuaagcccucuucaauccccauaauggcagcagcuagaaagagaaa

SEQ ID NO: 172134 - RNA, 64 nt, Homo Sapiens
ccagaccaaagagguucucucucuuccccauagaccccauaaccguguccccuccccuccaucu

SEQ ID NO: 172135 - RNA, 64 nt, Homo Sapiens
aggacaggguaccaugcccauggagagccucaguccccauaaugggucugagggcccuagguca

SEQ ID NO: 172136 - RNA, 64 nt, Homo Sapiens
uuuuagcucucuuuuaaaaagaaauaaggagaaaccccauaacugcuccuugaguuuucaagau

SEQ ID NO: 172137 - RNA, 64 nt, Homo Sapiens
aauuguaauuuuauacugcugugaaucccccuggccccauaauauaauguuuuuaaggaugguu

SEQ ID NO: 172138 - RNA, 64 nt, Homo Sapiens
gacacccccuucucucuagaccacagucagggacccccauaaagcuccagcugggcucgguccc

SEQ ID NO: 172139 - RNA, 64 nt, Homo Sapiens
guuuagggauaaauguuucuggaacccuguggucccccauaauguugauagaauaucauaugca

SEQ ID NO: 172140 - RNA, 64 nt, Homo Sapiens
ccacggacagcgucugugugcagcccucaucauuccccauaaaauugucaugaggagaacugac

SEQ ID NO: 172141 - RNA, 64 nt, Homo Sapiens
guuuaggccacuuugcagagaccaggagugggcaccccauaaggcacucauccaccugcccucc

SEQ ID NO: 172142 - RNA, 64 nt, Homo Sapiens
gcauuucuccuuucugugcagucggcacacacauccccauaauguuucacccugcuggucccag

SEQ ID NO: 172143 - RNA, 64 nt, Homo Sapiens
agagcuuucacacagugagaaauagagcaggcugccccauaaauggguaacauauuccuaaucu

SEQ ID NO: 172144 - RNA, 64 nt, Homo Sapiens
agcacuacaacuuaauugcucuaugccucaguuuccccauaauacccuuuuccaaccuaccuca

SEQ ID NO: 172145 - RNA, 64 nt, Homo Sapiens
auuguggggcagaggccucucugcucuuguuuaaccccauaaagaaauaaaugguaagacuuga

SEQ ID NO: 172146 - RNA, 64 nt, Homo Sapiens
auagcaggcacugucacagaguaauggcauuaauccccauaauaauccugugaaggugauauuc

SEQ ID NO: 172147 - RNA, 64 nt, Homo Sapiens
auuguccagcugccuggcuccuaaaguggacauuccccauaaaauccagucuuaaaucucuccg

SEQ ID NO: 172148 - RNA, 64 nt, Homo Sapiens
aguauuugccaaauuacaugguuuuuucccuuugccccauaaucauauucaaauuauagaacau

SEQ ID NO: 172149 - RNA, 64 nt, Homo Sapiens
ggcagcauucccagacccagaacuggccagcugcccccauaacugcugggcuggaagguuccau

SEQ ID NO: 172150 - RNA, 64 nt, Homo Sapiens
uugugaaggguuuacugcucuucuugcccuccacccccauaagaaccacacaauaggauccccc

SEQ ID NO: 172151 - RNA, 64 nt, Homo Sapiens
uccaauguuaaaugccucuacuaaaguggggauuccccauaaaaauuguccagcuaccugacuc

SEQ ID NO: 172152 - RNA, 64 nt, Homo Sapiens
uugaugauguggcuucgccccccucugcugcuuggucccucaccacagcuggcccuacuuuccu

SEQ ID NO: 172153 - RNA, 64 nt, Homo Sapiens
ccuccccugucccuuccaaggccaggaggccgaggucccucaguaggguggcagagccugcuua

SEQ ID NO: 172154 - RNA, 64 nt, Homo Sapiens
cuucccuugugucucccuggcaaggggagucagggucccucaggugcuguauggagaaauucuu

SEQ ID NO: 172155 - RNA, 64 nt, Homo Sapiens
ccagacucagucagacauguaaaugcagagccaggucccucagccugcuaguaucuauuuuaca

SEQ ID NO: 172156 - RNA, 64 nt, Homo Sapiens
aguugcuauuuaggaugaguuaagugccuggggagucccucaaaagguuaaagggauucccauc

SEQ ID NO: 172157 - RNA, 64 nt, Homo Sapiens
aauuaaauacuuuuuucccuuuauuacuguuguagucccucacuuggauauaccucuguuuuca

SEQ ID NO: 172158 - RNA, 64 nt, Homo Sapiens
cugaugugagcaauuuacacacuugucucagaaagucccucaggguuuguagaggacugcaggg

SEQ ID NO: 172159 - RNA, 64 nt, Homo Sapiens
gagcugggcgugaggugcuugggguccauucuuugucccucagcuucucagaguccggccagcc

SEQ ID NO: 172160 - RNA, 64 nt, Homo Sapiens
cuuguugcccucugcaguugggugggaagaacuugucccucaggcgauaggagccacaacuugg

SEQ ID NO: 172161 - RNA, 64 nt, Homo Sapiens
cacugaagucccccuuucucagcucucugagccagucccucagcggcugcaggaacuaggcaca

SEQ ID NO: 172162 - RNA, 64 nt, Homo Sapiens
cuguuuguuuuaggaauccuuugcgugucuaaaggucccucaucccugcuagaggcaugucucc

SEQ ID NO: 172163 - RNA, 64 nt, Homo Sapiens
uuugacauggaguugaccucggagggcaguuugagucccucaccaaggugcugaacccucagca

SEQ ID NO: 172164 - RNA, 64 nt, Homo Sapiens
ggcuagaaugugcagcucuuagugaaaagggugggucccucauaaauccagccccggagaagca

SEQ ID NO: 172165 - RNA, 64 nt, Homo Sapiens
accucccuuccccaacucccagaugcucacagaggucccucaugguguggaaguguaaggccua

SEQ ID NO: 172166 - RNA, 62 nt, Homo Sapiens
cugcccccugccccagggcuagcuccgaugugaggggcaaggccagcucauuucaacaaagg

SEQ ID NO: 172167 - RNA, 62 nt, Homo Sapiens
acuguuggaggagaguuagcaucugggcagucaggggcaaggggcaagguugggacaaagcc

SEQ ID NO: 172168 - RNA, 62 nt, Homo Sapiens
uggaugaaguuaucuggcuucaaauauuaugcaggggcaaacaccugcugauguggcaacug

SEQ ID NO: 172169 - RNA, 62 nt, Homo Sapiens
ccuagccaaguuuaagaggcaaguaaaaauauaggggcaaugucagaugaagucuuguucag

SEQ ID NO: 172170 - RNA, 62 nt, Homo Sapiens
uuugagcagaggacccuccaacuuauggcaucaggggcaaaaagucacagcuuaucccaggc

SEQ ID NO: 172171 - RNA, 62 nt, Homo Sapiens
ccugcagccucauauggcucaauaaaacagaaaggggcaaguauagaagauuaggaugacua

SEQ ID NO: 172172 - RNA, 62 nt, Homo Sapiens
cugagcagcaggugugccccagagagcuggaaaggggcaaccgggacuuugggggcagugag

SEQ ID NO: 172173 - RNA, 62 nt, Homo Sapiens
acccuccccaggaaggaggagcacaaccucagaggggcaaaaaaacuguucuucugguuccu

SEQ ID NO: 172174 - RNA, 62 nt, Homo Sapiens
uuggggauccaggugucagagguaggggaaccaggggcaagcuggggcugagcuggaggugg

SEQ ID NO: 172175 - RNA, 62 nt, Homo Sapiens
gccgcuugggggagggaagaggcagcccggcgaggggcaagcgggggacccagccgggcugg

SEQ ID NO: 172176 - RNA, 62 nt, Homo Sapiens
gcucugagcccaucuguucucccccugcaagaaggggcaaugcucuuguguugucccucugu

SEQ ID NO: 172177 - RNA, 62 nt, Homo Sapiens
ccagagcgaaugagggcagagaugcccggggcaggggcaaacgcccuccgcucccucugcuc

SEQ ID NO: 172178 - RNA, 62 nt, Homo Sapiens
cuggggcuccaacuggguacucccggcaagagaggggcaagugcugcuugucaagaagcauu

SEQ ID NO: 172179 - RNA, 62 nt, Homo Sapiens
agagcccagagagaagcgccagcucucuacccaggggcaaggauguccugggcuccuucagg

SEQ ID NO: 172180 - RNA, 62 nt, Homo Sapiens
aggcgggcaggccuucacuguggcugcggggaaggggcaagauccggcugugucuggugguc

SEQ ID NO: 172181 - RNA, 62 nt, Homo Sapiens
uacggccugggcuaggugagcagggcugugggaggggcaagcggagcugaugaagcaggugc

SEQ ID NO: 172182 - RNA, 62 nt, Homo Sapiens
gggaagaagccaggaaaaccucugaguguugaaggggcaacccaaggcaucacaguucacag

SEQ ID NO: 172183 - RNA, 62 nt, Homo Sapiens
ucuugccuugaggcucugcaguggcaaaugguaggggcaauagcgcucccuuuucaccugaa

SEQ ID NO: 172184 - RNA, 64 nt, Homo Sapiens
agaugagaaaacccaacagauccaucccuugagcuguaaacacucagaacuccuuucauaucaa

SEQ ID NO: 172185 - RNA, 64 nt, Homo Sapiens
uuuaaaaaagguagcauuuuguugacaguuauuuuguaaacauaagcaaauaagggcuuggagg

SEQ ID NO: 172186 - RNA, 64 nt, Homo Sapiens
gaacugaacaaauuaccuauuuuuccauaagaauuguaaacauuaaauguguguguugcuaauu

SEQ ID NO: 172187 - RNA, 64 nt, Homo Sapiens
agaauaauuuaaggauucuauaaagaaucacaacuguaaacaugagcugcauaauaguauuuau

SEQ ID NO: 172188 - RNA, 64 nt, Homo Sapiens
acccacuuauauuuaucacauucuaagggaauacuguaaacaugaguuaugaaaaguugaaggc

SEQ ID NO: 172189 - RNA, 64 nt, Homo Sapiens
aacaacuuuaugauuugaaauaugcuccucaauguguaaacaggaucccuucauguccuuuaag

SEQ ID NO: 172190 - RNA, 64 nt, Homo Sapiens
uguuauguguuuagaaucagaucuuaauccugaauguaaacaauucguuucaacucuuaaagac

SEQ ID NO: 172191 - RNA, 64 nt, Homo Sapiens
auauacagacuauacaagaaguguuuguaguccuuguaaacaauagccuccgauuugugaugca

SEQ ID NO: 172192 - RNA, 64 nt, Homo Sapiens
ucaacucuguaugaaaauguggaaaauuauuccauguaaacauuguguacaggucuuucuguag

SEQ ID NO: 172193 - RNA, 64 nt, Homo Sapiens
aggauuugggaacagaucuagggaaaaccugcguuguaaacaugaaauaagaauggaaauacaa

SEQ ID NO: 172194 - RNA, 64 nt, Homo Sapiens
cuuuauaugagcugucccaccagcaacuuauauauguaaacauacauauauacacauaugcaug

SEQ ID NO: 172195 - RNA, 64 nt, Homo Sapiens
uaaacauacauauauacacauaugcauguguguguguaaacauaaaaguccuuuauuauuaaaa

SEQ ID NO: 172196 - RNA, 64 nt, Homo Sapiens
aucccaaaauaauggaaaauguccaguuguguuuuguaaacaccuauguaacucaucuuuuagu

SEQ ID NO: 172197 - RNA, 64 nt, Homo Sapiens
acuucuuugcaguucauuauaguaaggcuuaaccuguaaacaguaucugauggcccaccuauaa

SEQ ID NO: 172198 - RNA, 64 nt, Homo Sapiens
auuucaguuguuuguaauaaguagaauacacuacuguaaacauacgaccuuuguuuuugucuua

SEQ ID NO: 172199 - RNA, 64 nt, Homo Sapiens
ugccuuacuguauccugugucauguccaaucaguuguaaacaauggcaucuuugaacaguguga

SEQ ID NO: 172200 - RNA, 64 nt, Homo Sapiens
ccucagcuacuacucacauucauuuaaugguuucuguaaacauuuuuaagacaguugggauguc

SEQ ID NO: 172201 - RNA, 64 nt, Homo Sapiens
aaucauugaugcuugaaugauagaauuuuaguacuguaaacaggcuuuagucauuaaugugaga

SEQ ID NO: 172202 - RNA, 64 nt, Homo Sapiens
gggaaaugcugaauuaaagugaauuguugacaaauguaaacauuuucagaaauauucaugaagc

SEQ ID NO: 172203 - RNA, 64 nt, Homo Sapiens
aaaaaaaaaaaaaaaaaaaaggaaagaacugucauguaaacauaccaacauguuuaaaccugac

SEQ ID NO: 172204 - RNA, 64 nt, Homo Sapiens
gcaaauuugacugugacuuuaaucuaaauuacuauguaaacaaaaaguagauaguuucacuuuu

SEQ ID NO: 172205 - RNA, 64 nt, Homo Sapiens
cacuuaaagaauucccucauucauuaccuuacaguguaaacaggagucuaauuuguaucaauac

SEQ ID NO: 172206 - RNA, 64 nt, Homo Sapiens
auucauguguacaccacaaaugaguucccagacguguaaacacacgugcacacaucguacacau

SEQ ID NO: 172207 - RNA, 64 nt, Homo Sapiens
acacacguguacaccacaaacgagcucccagacauguaaacacacgucucccacacgugagcuc

SEQ ID NO: 172208 - RNA, 64 nt, Homo Sapiens
acaucuggugaccaggcugcuucauucaacacuguguaaacaccaaagccuuaacuuagcaaac

SEQ ID NO: 172209 - RNA, 64 nt, Homo Sapiens
uuuuucaaugaaguacaauaaugugaacugcauguguaaacagcaucacauuauuaccaccucu

SEQ ID NO: 172210 - RNA, 64 nt, Homo Sapiens
cuguccagugaaaaggugccacaaugcccaguauuguaaacaacagguuugcauucaugaagcu

SEQ ID NO: 172211 - RNA, 64 nt, Homo Sapiens
uuugauauucacuuuaauaauuagaaauggaucuuguaaacagggcauauaucaaagaugaccu

SEQ ID NO: 172212 - RNA, 64 nt, Homo Sapiens
cugucaaguuguaaagauugagagggcaaacagauguaaacaucacuuguaggugauuaaaaag

SEQ ID NO: 172213 - RNA, 64 nt, Homo Sapiens
gaaaaugacaggacugggcaaauuaacaaauguuuguaaacaugaauguucaggaacuacugau

SEQ ID NO: 172214 - RNA, 64 nt, Homo Sapiens
ucuguccugugaaagacucaaugagcuguuauguuguaaacaggaagcauuucacauccaaacg

SEQ ID NO: 172215 - RNA, 64 nt, Homo Sapiens
acaggaagcauuucacauccaaacgagaaaaucauguaaacaugugucuuuucuguagagcaua

SEQ ID NO: 172216 - RNA, 64 nt, Homo Sapiens
caggggugugccaggcccacggaccagaugcuccuguaaacauccacagccauaagacaggacu

SEQ ID NO: 172217 - RNA, 64 nt, Homo Sapiens
ugcuucugagagcaaagaaaaagccaaugguguuuguaaacaaauuuucucugaauugaaggga

SEQ ID NO: 172218 - RNA, 64 nt, Homo Sapiens
ucacacucaugugacaugaccaaagaugauacucuguaaacaaggcccuucugaccggacucag

SEQ ID NO: 172219 - RNA, 64 nt, Homo Sapiens
cacaaauaacccuccauuuuucaauaucugcuacuguaaacaugaauauugaauacugacaaga

SEQ ID NO: 172220 - RNA, 64 nt, Homo Sapiens
uacaugggaugcauuagaauaggaauaaaauggauguaaacauuauaagucuuagaggcgagug

SEQ ID NO: 172221 - RNA, 64 nt, Homo Sapiens
ggacagauggaguuaaaaagcuugcgaguuuauuuguaaacacuuuaccaagaacuggucagac

SEQ ID NO: 172222 - RNA, 64 nt, Homo Sapiens
gcaacucauuuauuucauuuuggucuuaaugcuuuguaaacaggucaaaaaauacugucauacu

SEQ ID NO: 172223 - RNA, 64 nt, Homo Sapiens
cuugcguugacaaaggaggaggaaacgauuacucuguaaacaaaguuauccuuacuugggagau

SEQ ID NO: 172224 - RNA, 64 nt, Homo Sapiens
aaaaugaguaaaaucuauuugaagguaucuuguuuguaaacauuugucagauucuaauuuuuuu

SEQ ID NO: 172225 - RNA, 64 nt, Homo Sapiens
gguuuguuuguuucuuccacguaaggaaaaguaguguaaacaguagcgagaaaauggaaaccac

SEQ ID NO: 172226 - RNA, 64 nt, Homo Sapiens
cccuauguuugugccuuuuauguuauaauguccauguaaacaugacacuuuuaauguauauguu

SEQ ID NO: 172227 - RNA, 64 nt, Homo Sapiens
agcagaacucuucucccuauaggaaucacuuuauuguaaacacucauuacuauuucuaauccca

SEQ ID NO: 172228 - RNA, 64 nt, Homo Sapiens
auauuguguggcugaucugaagucagucggaauuuguaaacaggguagcaaacaagauauuuuu

SEQ ID NO: 172229 - RNA, 64 nt, Homo Sapiens
uugcauaagauuuaacagcauuuuuuauaaugaauguaaacauuuuaacuuaaugguacuuaaa

SEQ ID NO: 172230 - RNA, 64 nt, Homo Sapiens
cuaacggauagcauuuguaaauacucuagguaucuguaaacacucugaugaagucuguauagug

SEQ ID NO: 172231 - RNA, 64 nt, Homo Sapiens
gugguaaagccuucaguaguagaaaccuuaugaauguaaacaguugaaagaacccacacuggag

SEQ ID NO: 172232 - RNA, 64 nt, Homo Sapiens
guggaaaaaccuacauaucuagaaacgcuaugaauguaaacaauugaaaggaaucacacuguac

SEQ ID NO: 172233 - RNA, 64 nt, Homo Sapiens
ccaguaauaaaauuuuacaagaaagaaaguaucauguaaacagcugucagguuauauuuaauaa

SEQ ID NO: 172234 - RNA, 64 nt, Homo Sapiens
gugauuaagccuucaguugaagaaacaguaugaauguaaacauucgaaagaauucccacuggug

SEQ ID NO: 172235 - RNA, 64 nt, Homo Sapiens
caauuuuuuuucugaacaaaagcagguuuuuauauguaaacagugagaaaagaaaggcuaaaca

SEQ ID NO: 172236 - RNA, 64 nt, Homo Sapiens
uacuacacaguuugguuacaggacuucugugcauuguaaacauaaacagcauggaaaagguuaa

SEQ ID NO: 172237 - RNA, 64 nt, Homo Sapiens
augauuuucuauuggucagacauugauguggagauguaaacacauguaggguuggugagaagga

SEQ ID NO: 172238 - RNA, 64 nt, Homo Sapiens
uaagcuauuuaaucuugggaacugaagccagucauguaaacauacuauaccaaucuagucccua

SEQ ID NO: 172239 - RNA, 64 nt, Homo Sapiens
uuuagaugcuuugugacuuauucuguuuuuucuguacacagaagugaguugucaagacugauca

SEQ ID NO: 172240 - RNA, 64 nt, Homo Sapiens
agggagcuaaauugaauacaagcauucaggguuauacacagaaaaucaaagaaaacauagcacu

SEQ ID NO: 172241 - RNA, 64 nt, Homo Sapiens
cacacagaaagacacacacagacacaccauuacauacacagacacagccccuccccgccacaga

SEQ ID NO: 172242 - RNA, 64 nt, Homo Sapiens
gacacacacagacacacaauccauuacacacacauacacagaaacuuccggccacagaaacaca

SEQ ID NO: 172243 - RNA, 64 nt, Homo Sapiens
cgcaaucgcagauacgcccugacacaccauuacauacacagacacacacccuccccgccacaga

SEQ ID NO: 172244 - RNA, 64 nt, Homo Sapiens
cacacagaaagacacagacagagacaccauuacauacacagacacacacacccuccccgccaca

SEQ ID NO: 172245 - RNA, 64 nt, Homo Sapiens
cacacagaaagacacacacagagacaccauuacauacacagacacacacccccuccccaccaca

SEQ ID NO: 172246 - RNA, 64 nt, Homo Sapiens
acccagaggccacccagaagcccucagauguacauacacagaugccagucagcuccugggguug

SEQ ID NO: 172247 - RNA, 64 nt, Homo Sapiens
aggcugugauucugccuuuggauggauguugcuguacacagaugcuacagacuuguacuaacac

SEQ ID NO: 172248 - RNA, 64 nt, Homo Sapiens
cuaaguagaaccagguaauuaaagacuuagaacauacacagaucucuuuuuuucuaaaggagag

SEQ ID NO: 172249 - RNA, 64 nt, Homo Sapiens
caaaauagaaucagauuaucaaagacuuagaauguacacagaucuguuuuucucuaaaugagag

SEQ ID NO: 172250 - RNA, 64 nt, Homo Sapiens
aggaacuaaaugacugcgaacacuuccaaaaagauacacagaagacaguccagccaguaaaaaa

SEQ ID NO: 172251 - RNA, 64 nt, Homo Sapiens
ugaacuguucuuaaacagaaccgaagacaauuaguacacagacacaucaacaucuguuuuauua

SEQ ID NO: 172252 - RNA, 64 nt, Homo Sapiens
uucuguacauauccugugaaauuaaagucagugguacacagacaaaacuuuauagaaguacagu

SEQ ID NO: 172253 - RNA, 64 nt, Homo Sapiens
uuuuacagaauguaguauuuauuuuuugaagaaguacacagaauaacugaucccgcuuuuauua

SEQ ID NO: 172254 - RNA, 64 nt, Homo Sapiens
aaggauccuaaggaugugacacagggagaguggccaguuggaagaggcacugcuaaaaugauuc

SEQ ID NO: 172255 - RNA, 64 nt, Homo Sapiens
uucuggcacucuuccugcauccucaucccacucucaguuggauuuaggccgugaagauuuucau

SEQ ID NO: 172256 - RNA, 64 nt, Homo Sapiens
gcccauugauacaaggcugcugaggccuggucuccaguuggaaauauaauuaaggguggcaagg

SEQ ID NO: 172257 - RNA, 64 nt, Homo Sapiens
uggaaauauaauuaaggguggcaaggacuggagucaguuggagagugcauagccagucugugaa

SEQ ID NO: 172258 - RNA, 64 nt, Homo Sapiens
uucuuucaugcuuaacacagugcuguaucuaacccaguuggauuuuaagacauuuaggagaacc

SEQ ID NO: 172259 - RNA, 64 nt, Homo Sapiens
agaaucauaguuaagugguagauaugauucugaacaguuggaaucuguguacaagucauuuugu

SEQ ID NO: 172260 - RNA, 64 nt, Homo Sapiens
cagagccagucuuccuccucccaguuauaggacacaguuggaaguucuaucaaagcacauaaaa

SEQ ID NO: 172261 - RNA, 64 nt, Homo Sapiens
ugaagacacguucuugccaggcugcuggaggaaucaguuggaauguauuauuauuugaauggau

SEQ ID NO: 172262 - RNA, 64 nt, Homo Sapiens
aacccauuccacuguaugagguguuuucagaccucaguuggauggauggagaaguuaucaacug

SEQ ID NO: 172263 - RNA, 64 nt, Homo Sapiens
cuccagauagccacugccuucagaagaaaaccuucaguuggaucuggaggccacuggguaacaa

SEQ ID NO: 172264 - RNA, 64 nt, Homo Sapiens
uauggacagcuaaaaugugauuauuuuccaagcucaguuggaccuccagacccaucacugacca

SEQ ID NO: 172265 - RNA, 64 nt, Homo Sapiens
aaaacaccuuggggggugaagcugucaaugccaccaguuggaccuccauacauucugagcuaac

SEQ ID NO: 172266 - RNA, 64 nt, Homo Sapiens
gcccuuauuuccagagaaccagacguuuguuucccaguuggaaagaagacaguugagcacuuca

SEQ ID NO: 172267 - RNA, 64 nt, Homo Sapiens
gacugggcaaacuuuacagcugauagugaauauuuugcuuuauacaggaauugacacugauuug

SEQ ID NO: 172268 - RNA, 64 nt, Homo Sapiens
agugaauccuuugcauuugaagccuuaacaugcauugcuuuaauuuugcccagggacaaauuuu

SEQ ID NO: 172269 - RNA, 64 nt, Homo Sapiens
caaauaagcaugagagagaaaaaaacaugauauauugcuuuacuuaauagguugaauaugguag

SEQ ID NO: 172270 - RNA, 64 nt, Homo Sapiens
ugaaaauaugaugauucaauuuucucaauuuucuuugcuuuaaccaaaauucuaaaugcaguuu

SEQ ID NO: 172271 - RNA, 64 nt, Homo Sapiens
uaaacaacagaacaacuuguaaaacaaauuguguuugcuuuaagaaaaauguuuauugcacuca

SEQ ID NO: 172272 - RNA, 64 nt, Homo Sapiens
gccuuauaaaaucuucauuaugaaauauuaucaguugcuuuauaaacucacucuuuuuauggau

SEQ ID NO: 172273 - RNA, 64 nt, Homo Sapiens
cuagaucaucuuagacuuguacuucagcacuuuuuugcuuuaaauuuuaaaaguaacuaaauau

SEQ ID NO: 172274 - RNA, 64 nt, Homo Sapiens
gauaguaccugcagaauaguaaugauuuuaugucuugcuuuaaauuaugcuuacaagacuucau

SEQ ID NO: 172275 - RNA, 64 nt, Homo Sapiens
uucuggucagcacugauuaauagccuaaaagaaauugcuuuagccuaugauuuuuugccaaucu

SEQ ID NO: 172276 - RNA, 64 nt, Homo Sapiens
acuguuguaaguacaguuggucugaaaguaucaauugcuuuaaaccaauuaagcuugagauugu

SEQ ID NO: 172277 - RNA, 64 nt, Homo Sapiens
cuuccacauaacuagagcacacagauuccccaaauugcuuuauguggacuguuuagggcauagg

SEQ ID NO: 172278 - RNA, 64 nt, Homo Sapiens
cuaaauuuuguaccaaagcauggugcugccaguuuugcuuuauuugaaaggaucacauuuguug

SEQ ID NO: 172279 - RNA, 64 nt, Homo Sapiens
ugaaugucugugcuuaugagccguaaaaccuuuguugcuuuaauuuuguucuuccaacugaaag

SEQ ID NO: 172280 - RNA, 64 nt, Homo Sapiens
uccaugcaacaugucauuuucugugaguuuccacuugcuuuacacagcguguuuccugagccuc

SEQ ID NO: 172281 - RNA, 64 nt, Homo Sapiens
agauauccacagcuuggaggagcccagagaccguuugcuuuauacccacacagcaacuggucca

SEQ ID NO: 172282 - RNA, 64 nt, Homo Sapiens
uuuauucuucccacacacuuaccuuacuaagucuuugcuuuaauaaaugagcaacccuggguau

SEQ ID NO: 172283 - RNA, 64 nt, Homo Sapiens
cacacuccuucaguucagcaagacauaaagccuuuugcuuuaugcuugagggauauuuagaacu

SEQ ID NO: 172284 - RNA, 64 nt, Homo Sapiens
uuaccaaaauugaacuagcuaccauauaagcagauugcuuuaauuugaugggaaaauaguacac

SEQ ID NO: 172285 - RNA, 64 nt, Homo Sapiens
uguuuuauuaauguuaauuuaaaucuguaaauaauugcuuuauugugaugugauacagaacaaa

SEQ ID NO: 172286 - RNA, 64 nt, Homo Sapiens
ucuuauggacagucugugguaaagaagcaacucuuugcuuuagaguuaaauauuccuaucuuaa

SEQ ID NO: 172287 - RNA, 64 nt, Homo Sapiens
aagcuaauaaugaauguuaaugagccagagccgauugcuuuauuaccauauacugacugaaaca

SEQ ID NO: 172288 - RNA, 64 nt, Homo Sapiens
caccauauaaaaggaaaaaaauuaguguucaauauugcuuuaauccuaaaucuuuaguugaaug

SEQ ID NO: 172289 - RNA, 64 nt, Homo Sapiens
aaucuacacucuugcauucuacuugcuagugagcuugcuuuaaauuuaauccugacauuagcug

SEQ ID NO: 172290 - RNA, 64 nt, Homo Sapiens
uggucacuuggaacuuuggaucuuguguaccucauugcuuuagcgagucagcugggaauauugu

SEQ ID NO: 172291 - RNA, 64 nt, Homo Sapiens
acuauuuuagagucuuaaugccaagucagcagauuugcuuuaugaauuacagggacuagaaaug

SEQ ID NO: 172292 - RNA, 64 nt, Homo Sapiens
accucgcucuguauuuaauuaauugugcuauauguugcuuuaacaacccauugagcagucaggg

SEQ ID NO: 172293 - RNA, 64 nt, Homo Sapiens
ugaaaaacaaauaaaugcuuuggaaauguuucaguugcuuuagaaacauuagugccugccugga

SEQ ID NO: 172294 - RNA, 64 nt, Homo Sapiens
aacaucacuccuaaauuaauaaaguauuccucuguugcuuuaguauuuauuacaauaaaaaggg

SEQ ID NO: 172295 - RNA, 64 nt, Homo Sapiens
guggcaggacccuuaggaaucuaguacaaccuuguugcuuuaggugagucacacucagaaaaug

SEQ ID NO: 172296 - RNA, 64 nt, Homo Sapiens
cugaaauuggugggaagcaagcaggggucguaccuugcuuuagaguagauguuuggaaaagcua

SEQ ID NO: 172297 - RNA, 64 nt, Homo Sapiens
auuucuacccauguugggaagaaaaugccacauuuugcuuuauacagaacugcuaccaugaagu

SEQ ID NO: 172298 - RNA, 64 nt, Homo Sapiens
gacagggacuguauaaacaagcacaguuugcuauuugcuuuagacaaagucaguaggagaggau

SEQ ID NO: 172299 - RNA, 64 nt, Homo Sapiens
uaccaaaaugugugaucguagaucucaaaggaucuugcuuuaacuuucaacacuuagaaaaucu

SEQ ID NO: 172300 - RNA, 64 nt, Homo Sapiens
gaugaagauuguauuuuugcaccuuaacuccacauugcuuuauugguuaauuuauauucuuucc

SEQ ID NO: 172301 - RNA, 64 nt, Homo Sapiens
ggaaagguuccacgauacauaaaucauuucucauuugcuuuaaaaaauuuaaaaguguaaaaau

SEQ ID NO: 172302 - RNA, 64 nt, Homo Sapiens
uuuguuguuuucuuuugcuuaagcacuucaucaauugcuuuauucuguaucugcgaaguaaucu

SEQ ID NO: 172303 - RNA, 64 nt, Homo Sapiens
ugggaucuauucuucagauauucaaaaacauuuuuugcuuuaaaaugcauaucuuuaauugggu

SEQ ID NO: 172304 - RNA, 64 nt, Homo Sapiens
ugaccaggauaaaugagguauguugaucauggcuuugcuuuauaucuugauauuaaagcugguu

SEQ ID NO: 172305 - RNA, 64 nt, Homo Sapiens
uuuaacucauaugaucucccuucagcaacuuauuuugcuuuaauugcuuuaaaucuuaagcaau

SEQ ID NO: 172306 - RNA, 64 nt, Homo Sapiens
uaugaucucccuucagcaacuuauuuugcuuuaauugcuuuaaaucuuaagcaauauuuuuuau

SEQ ID NO: 172307 - RNA, 64 nt, Homo Sapiens
aacuguuuaacccugaaaucuuuucaguguuuuauugcuuuaugaccccuuuuucuugcuuuau

SEQ ID NO: 172308 - RNA, 64 nt, Homo Sapiens
uuucaguguuuuauugcuuucaaaccccuuuuucuugcuuuauuuuuuugguaaaauauuacuu

SEQ ID NO: 172309 - RNA, 64 nt, Homo Sapiens
uccaugaauguuccugccucaacacuugugacuuuugcuuuaauauauguacauuucuaaguca

SEQ ID NO: 172310 - RNA, 64 nt, Homo Sapiens
uuuagcaaagcggguuauaagaaagccuuucauuuugcuuuaaugaucaguaguuugcauuuca

SEQ ID NO: 172311 - RNA, 64 nt, Homo Sapiens
uugugauuucacaagauucucuacuuaugugauaggaggguauggccaguuauucaucuaacug

SEQ ID NO: 172312 - RNA, 64 nt, Homo Sapiens
caacaguugaucuuuuggcuaugacaauuuguauggaggguacgaucuaaguuaagugugucaa

SEQ ID NO: 172313 - RNA, 64 nt, Homo Sapiens
guuuugcaaaagaaaaagaaaugcugaaggagaaggaggguagugggcagaauauacacaacag

SEQ ID NO: 172314 - RNA, 64 nt, Homo Sapiens
gagugggugggggggagggguauuuuuuugcgggggaggguagguuuguuuuuuuuucuccuuu

SEQ ID NO: 172315 - RNA, 64 nt, Homo Sapiens
gcggagaaaggaagggcugcgcccucucagcaggggaggguagacccaugagaugaugccaugg

SEQ ID NO: 172316 - RNA, 64 nt, Homo Sapiens
gcugugggucgcgugaugcguuaagguggguacgggaggguaagugagugagggaacagagagg

SEQ ID NO: 172317 - RNA, 64 nt, Homo Sapiens
uucauaugaaacaaucugcauaaagaggucacguggaggguacgacggaguuugccaagugcau

SEQ ID NO: 172318 - RNA, 64 nt, Homo Sapiens
auuguaugccucaaaugucugacgaaaguagacuggaggguagcagugaguagguuugguuucu

SEQ ID NO: 172319 - RNA, 64 nt, Homo Sapiens; identical to SEQ ID NO: 123248

SEQ ID NO: 172320 - RNA, 64 nt, Homo Sapiens; identical to SEQ ID NO: 123249

SEQ ID NO: 172321 - RNA, 64 nt, Homo Sapiens; identical to SEQ ID NO: 123250

SEQ ID NO: 172322 - RNA, 64 nt, Homo Sapiens; identical to SEQ ID NO: 123251

SEQ ID NO: 172323 - RNA, 64 nt, Homo Sapiens; identical to SEQ ID NO: 123252

SEQ ID NO: 172324 - RNA, 64 nt, Homo Sapiens; identical to SEQ ID NO: 123253

SEQ ID NO: 172325 - RNA, 64 nt, Homo Sapiens; identical to SEQ ID NO: 123254

SEQ ID NO: 172326 - RNA, 64 nt, Homo Sapiens; identical to SEQ ID NO: 123255

SEQ ID NO: 172327 - RNA, 64 nt, Homo Sapiens; identical to SEQ ID NO: 123256

SEQ ID NO: 172328 - RNA, 64 nt, Homo Sapiens; identical to SEQ ID NO: 123257

SEQ ID NO: 172329 - RNA, 64 nt, Homo Sapiens; identical to SEQ ID NO: 123258

SEQ ID NO: 172330 - RNA, 64 nt, Homo Sapiens; identical to SEQ ID NO: 123259

SEQ ID NO: 172331 - RNA, 64 nt, Homo Sapiens; identical to SEQ ID NO: 123260

SEQ ID NO: 172332 - RNA, 64 nt, Homo Sapiens; identical to SEQ ID NO: 123261

SEQ ID NO: 172333 - RNA, 64 nt, Homo Sapiens; identical to SEQ ID NO: 123262

SEQ ID NO: 172334 - RNA, 64 nt, Homo Sapiens; identical to SEQ ID NO: 123263

SEQ ID NO: 172335 - RNA, 64 nt, Homo Sapiens; identical to SEQ ID NO: 123264

SEQ ID NO: 172336 - RNA, 64 nt, Homo Sapiens; identical to SEQ ID NO: 123265

SEQ ID NO: 172337 - RNA, 64 nt, Homo Sapiens; identical to SEQ ID NO: 123266

SEQ ID NO: 172338 - RNA, 64 nt, Homo Sapiens; identical to SEQ ID NO: 123267

SEQ ID NO: 172339 - RNA, 64 nt, Homo Sapiens; identical to SEQ ID NO: 123268

SEQ ID NO: 172340 - RNA, 64 nt, Homo Sapiens; identical to SEQ ID NO: 123269

SEQ ID NO: 172341 - RNA, 64 nt, Homo Sapiens; identical to SEQ ID NO: 123270

SEQ ID NO: 172342 - RNA, 64 nt, Homo Sapiens; identical to SEQ ID NO: 123271

SEQ ID NO: 172343 - RNA, 64 nt, Homo Sapiens; identical to SEQ ID NO: 123272

SEQ ID NO: 172344 - RNA, 64 nt, Homo Sapiens; identical to SEQ ID NO: 123273

SEQ ID NO: 172345 - RNA, 64 nt, Homo Sapiens; identical to SEQ ID NO: 123274

SEQ ID NO: 172346 - RNA, 64 nt, Homo Sapiens; identical to SEQ ID NO: 123275

SEQ ID NO: 172347 - RNA, 64 nt, Homo Sapiens; identical to SEQ ID NO: 123276

SEQ ID NO: 172348 - RNA, 64 nt, Homo Sapiens; identical to SEQ ID NO: 123277

SEQ ID NO: 172349 - RNA, 64 nt, Homo Sapiens; identical to SEQ ID NO: 123278

SEQ ID NO: 172350 - RNA, 64 nt, Homo Sapiens; identical to SEQ ID NO: 123279

SEQ ID NO: 172351 - RNA, 64 nt, Homo Sapiens; identical to SEQ ID NO: 123280

SEQ ID NO: 172352 - RNA, 64 nt, Homo Sapiens; identical to SEQ ID NO: 123281

SEQ ID NO: 172353 - RNA, 64 nt, Homo Sapiens; identical to SEQ ID NO: 123282

SEQ ID NO: 172354 - RNA, 64 nt, Homo Sapiens; identical to SEQ ID NO: 123283

SEQ ID NO: 172355 - RNA, 64 nt, Homo Sapiens; identical to SEQ ID NO: 123284

SEQ ID NO: 172356 - RNA, 64 nt, Homo Sapiens; identical to SEQ ID NO: 123285

SEQ ID NO: 172357 - RNA, 64 nt, Homo Sapiens; identical to SEQ ID NO: 123286

SEQ ID NO: 172358 - RNA, 64 nt, Homo Sapiens; identical to SEQ ID NO: 123287

SEQ ID NO: 172359 - RNA, 64 nt, Homo Sapiens; identical to SEQ ID NO: 123288

SEQ ID NO: 172360 - RNA, 64 nt, Homo Sapiens; identical to SEQ ID NO: 123289

SEQ ID NO: 172361 - RNA, 64 nt, Homo Sapiens; identical to SEQ ID NO: 123290

SEQ ID NO: 172362 - RNA, 64 nt, Homo Sapiens; identical to SEQ ID NO: 123291

SEQ ID NO: 172363 - RNA, 64 nt, Homo Sapiens
cagaugggcaaaaagauuuucaugcuaaucuucaaagguucaugcucaauauugugaaaagcuu

SEQ ID NO: 172364 - RNA, 64 nt, Homo Sapiens
gugauuggucuaaaauauuuguaauguauauuaaaagguucaaaaauauuuguauaaaucuaag

SEQ ID NO: 172365 - RNA, 64 nt, Homo Sapiens
ugaaaccugaguacauuuaccuuccaaguuuucuaagguucauggagaucuggggacacagugg

SEQ ID NO: 172366 - RNA, 64 nt, Homo Sapiens
augagggauguguuuuauuaucaaaagcuaagugaagguucaauaaagucaaugcacuuuuucu

SEQ ID NO: 172367 - RNA, 64 nt, Homo Sapiens
auuuguagacuuguauguacauuuuucuggggagaagguucaagagauucauaagauugucaaa

SEQ ID NO: 172368 - RNA, 64 nt, Homo Sapiens
guucaagagauucauaagauugucaaacuccuugaagguucagaaccucugcagggaaggggga

SEQ ID NO: 172369 - RNA, 64 nt, Homo Sapiens
cagagacacaugguaacacaccuucauuuauccuauaacucacuagguaucgaaugugagaaug

SEQ ID NO: 172370 - RNA, 64 nt, Homo Sapiens
cuagagaaaaacuuuaugaauuugaugguauaacauaacucauucugcaguuguuccaguggua

SEQ ID NO: 172371 - RNA, 64 nt, Homo Sapiens
aaaauauaaacuuauauaauuaucaaaguacuuuauaacucacauuacagauuuaaugagaaua

SEQ ID NO: 172372 - RNA, 64 nt, Homo Sapiens
uuuugucauguaaaaaagguugaggacaauuuauauaacucacuuuuuuuuccuaugugaaagu

SEQ ID NO: 172373 - RNA, 64 nt, Homo Sapiens
aaagcucaacgcugccccugauugaaagaaagcaauaacucaccucucgaaggcaucaagacaa

SEQ ID NO: 172374 - RNA, 64 nt, Homo Sapiens
aagauggcagaggcaaaucccaaaccauuagaaaauaacucaaacauggcuacuuucuaagcua

SEQ ID NO: 172375 - RNA, 64 nt, Homo Sapiens
uuuuucucaagcugcuuucaggagcuagcagaaaauaacucaaaguugaagacucuggaagauu

SEQ ID NO: 172376 - RNA, 64 nt, Homo Sapiens
acaguucugcaguuccaucacaguauuuuuuuaaauaacucagguguaugagaagaaauuagaa

SEQ ID NO: 172377 - RNA, 64 nt, Homo Sapiens
aaacuggaaauucauauccaucugguaugaauauauaacucagcuggcaaaugaauguguuugu

SEQ ID NO: 172378 - RNA, 64 nt, Homo Sapiens
ccuugacauuucaauuaaaacaugaauuguaguuauaacucaaugcaaauucaacaguuguauu

SEQ ID NO: 172379 - RNA, 64 nt, Homo Sapiens
gcauaaacugaggguguggguucuggcuuuguacauaacucauuuucucccuugcuuuuucucu

SEQ ID NO: 172380 - RNA, 64 nt, Homo Sapiens
uaguagguucagcagaauaaacucuuuacaauuaauaacucaguggaaaaugauguucagaugg

SEQ ID NO: 172381 - RNA, 64 nt, Homo Sapiens; identical to SEQ ID NO: 78937

SEQ ID NO: 172382 - RNA, 64 nt, Homo Sapiens; identical to SEQ ID NO: 78938

SEQ ID NO: 172383 - RNA, 64 nt, Homo Sapiens; identical to SEQ ID NO: 78939

SEQ ID NO: 172384 - RNA, 64 nt, Homo Sapiens; identical to SEQ ID NO: 78940

SEQ ID NO: 172385 - RNA, 64 nt, Homo Sapiens; identical to SEQ ID NO: 78941

SEQ ID NO: 172386 - RNA, 64 nt, Homo Sapiens; identical to SEQ ID NO: 78942

SEQ ID NO: 172387 - RNA, 64 nt, Homo Sapiens; identical to SEQ ID NO: 78943

SEQ ID NO: 172388 - RNA, 64 nt, Homo Sapiens; identical to SEQ ID NO: 78944

SEQ ID NO: 172389 - RNA, 64 nt, Homo Sapiens; identical to SEQ ID NO: 78945

SEQ ID NO: 172390 - RNA, 64 nt, Homo Sapiens; identical to SEQ ID NO: 78946

SEQ ID NO: 172391 - RNA, 64 nt, Homo Sapiens; identical to SEQ ID NO: 78947

SEQ ID NO: 172392 - RNA, 64 nt, Homo Sapiens; identical to SEQ ID NO: 78948

SEQ ID NO: 172393 - RNA, 64 nt, Homo Sapiens; identical to SEQ ID NO: 78949

SEQ ID NO: 172394 - RNA, 64 nt, Homo Sapiens; identical to SEQ ID NO: 78950

SEQ ID NO: 172395 - RNA, 64 nt, Homo Sapiens; identical to SEQ ID NO: 78951

SEQ ID NO: 172396 - RNA, 64 nt, Homo Sapiens; identical to SEQ ID NO: 78952

SEQ ID NO: 172397 - RNA, 64 nt, Homo Sapiens; identical to SEQ ID NO: 78953

SEQ ID NO: 172398 - RNA, 64 nt, Homo Sapiens; identical to SEQ ID NO: 78954

SEQ ID NO: 172399 - RNA, 64 nt, Homo Sapiens; identical to SEQ ID NO: 78955

SEQ ID NO: 172400 - RNA, 64 nt, Homo Sapiens; identical to SEQ ID NO: 78956

SEQ ID NO: 172401 - RNA, 64 nt, Homo Sapiens; identical to SEQ ID NO: 78957

SEQ ID NO: 172402 - RNA, 64 nt, Homo Sapiens; identical to SEQ ID NO: 78958

SEQ ID NO: 172403 - RNA, 64 nt, Homo Sapiens; identical to SEQ ID NO: 78959

SEQ ID NO: 172404 - RNA, 64 nt, Homo Sapiens; identical to SEQ ID NO: 78960

SEQ ID NO: 172405 - RNA, 64 nt, Homo Sapiens; identical to SEQ ID NO: 78961

SEQ ID NO: 172406 - RNA, 64 nt, Homo Sapiens; identical to SEQ ID NO: 78962

SEQ ID NO: 172407 - RNA, 64 nt, Homo Sapiens; identical to SEQ ID NO: 78963

SEQ ID NO: 172408 - RNA, 64 nt, Homo Sapiens; identical to SEQ ID NO: 78964

SEQ ID NO: 172409 - RNA, 64 nt, Homo Sapiens; identical to SEQ ID NO: 78965

SEQ ID NO: 172410 - RNA, 64 nt, Homo Sapiens; identical to SEQ ID NO: 78966

SEQ ID NO: 172411 - RNA, 64 nt, Homo Sapiens; identical to SEQ ID NO: 78967

SEQ ID NO: 172412 - RNA, 64 nt, Homo Sapiens; identical to SEQ ID NO: 78968

SEQ ID NO: 172413 - RNA, 64 nt, Homo Sapiens; identical to SEQ ID NO: 78969

SEQ ID NO: 172414 - RNA, 64 nt, Homo Sapiens; identical to SEQ ID NO: 78970

SEQ ID NO: 172415 - RNA, 64 nt, Homo Sapiens; identical to SEQ ID NO: 78971

SEQ ID NO: 172416 - RNA, 64 nt, Homo Sapiens; identical to SEQ ID NO: 78972

SEQ ID NO: 172417 - RNA, 64 nt, Homo Sapiens; identical to SEQ ID NO: 78973

SEQ ID NO: 172418 - RNA, 64 nt, Homo Sapiens; identical to SEQ ID NO: 78974

SEQ ID NO: 172419 - RNA, 64 nt, Homo Sapiens; identical to SEQ ID NO: 78975

SEQ ID NO: 172420 - RNA, 64 nt, Homo Sapiens; identical to SEQ ID NO: 78976

SEQ ID NO: 172421 - RNA, 64 nt, Homo Sapiens; identical to SEQ ID NO: 78977

SEQ ID NO: 172422 - RNA, 64 nt, Homo Sapiens; identical to SEQ ID NO: 78978

SEQ ID NO: 172423 - RNA, 64 nt, Homo Sapiens; identical to SEQ ID NO: 78979

SEQ ID NO: 172424 - RNA, 64 nt, Homo Sapiens; identical to SEQ ID NO: 78980

SEQ ID NO: 172425 - RNA, 64 nt, Homo Sapiens; identical to SEQ ID NO: 78981

SEQ ID NO: 172426 - RNA, 64 nt, Homo Sapiens; identical to SEQ ID NO: 78982

SEQ ID NO: 172427 - RNA, 64 nt, Homo Sapiens; identical to SEQ ID NO: 78983

SEQ ID NO: 172428 - RNA, 64 nt, Homo Sapiens; identical to SEQ ID NO: 78984

SEQ ID NO: 172429 - RNA, 64 nt, Homo Sapiens; identical to SEQ ID NO: 78985

SEQ ID NO: 172430 - RNA, 64 nt, Homo Sapiens; identical to SEQ ID NO: 78986

SEQ ID NO: 172431 - RNA, 64 nt, Homo Sapiens; identical to SEQ ID NO: 78987

SEQ ID NO: 172432 - RNA, 64 nt, Homo Sapiens; identical to SEQ ID NO: 78988

SEQ ID NO: 172433 - RNA, 64 nt, Homo Sapiens; identical to SEQ ID NO: 78989

SEQ ID NO: 172434 - RNA, 64 nt, Homo Sapiens; identical to SEQ ID NO: 78990

SEQ ID NO: 172435 - RNA, 64 nt, Homo Sapiens; identical to SEQ ID NO: 78991

SEQ ID NO: 172436 - RNA, 64 nt, Homo Sapiens; identical to SEQ ID NO: 78992

SEQ ID NO: 172437 - RNA, 64 nt, Homo Sapiens; identical to SEQ ID NO: 78993

SEQ ID NO: 172438 - RNA, 64 nt, Homo Sapiens; identical to SEQ ID NO: 78994

SEQ ID NO: 172439 - RNA, 64 nt, Homo Sapiens; identical to SEQ ID NO: 78995

SEQ ID NO: 172440 - RNA, 64 nt, Homo Sapiens; identical to SEQ ID NO: 78996

SEQ ID NO: 172441 - RNA, 64 nt, Homo Sapiens; identical to SEQ ID NO: 78997

SEQ ID NO: 172442 - RNA, 64 nt, Homo Sapiens; identical to SEQ ID NO: 78998

SEQ ID NO: 172443 - RNA, 64 nt, Homo Sapiens; identical to SEQ ID NO: 78999

SEQ ID NO: 172444 - RNA, 64 nt, Homo Sapiens; identical to SEQ ID NO: 79000

SEQ ID NO: 172445 - RNA, 64 nt, Homo Sapiens; identical to SEQ ID NO: 79001

SEQ ID NO: 172446 - RNA, 64 nt, Homo Sapiens; identical to SEQ ID NO: 79002

SEQ ID NO: 172447 - RNA, 64 nt, Homo Sapiens; identical to SEQ ID NO: 79003

SEQ ID NO: 172448 - RNA, 64 nt, Homo Sapiens; identical to SEQ ID NO: 79004

SEQ ID NO: 172449 - RNA, 64 nt, Homo Sapiens; identical to SEQ ID NO: 79005

SEQ ID NO: 172450 - RNA, 64 nt, Homo Sapiens; identical to SEQ ID NO: 79006

SEQ ID NO: 172451 - RNA, 64 nt, Homo Sapiens; identical to SEQ ID NO: 79007

SEQ ID NO: 172452 - RNA, 64 nt, Homo Sapiens; identical to SEQ ID NO: 79008

SEQ ID NO: 172453 - RNA, 64 nt, Homo Sapiens; identical to SEQ ID NO: 79009

SEQ ID NO: 172454 - RNA, 64 nt, Homo Sapiens; identical to SEQ ID NO: 79010

SEQ ID NO: 172455 - RNA, 64 nt, Homo Sapiens; identical to SEQ ID NO: 79011

SEQ ID NO: 172456 - RNA, 64 nt, Homo Sapiens; identical to SEQ ID NO: 79012

SEQ ID NO: 172457 - RNA, 64 nt, Homo Sapiens; identical to SEQ ID NO: 79013

SEQ ID NO: 172458 - RNA, 64 nt, Homo Sapiens; identical to SEQ ID NO: 79014

SEQ ID NO: 172459 - RNA, 64 nt, Homo Sapiens; identical to SEQ ID NO: 79015

SEQ ID NO: 172460 - RNA, 64 nt, Homo Sapiens; identical to SEQ ID NO: 79016

SEQ ID NO: 172461 - RNA, 64 nt, Homo Sapiens; identical to SEQ ID NO: 79017

SEQ ID NO: 172462 - RNA, 64 nt, Homo Sapiens; identical to SEQ ID NO: 79018

SEQ ID NO: 172463 - RNA, 64 nt, Homo Sapiens; identical to SEQ ID NO: 79019

SEQ ID NO: 172464 - RNA, 64 nt, Homo Sapiens; identical to SEQ ID NO: 79020

SEQ ID NO: 172465 - RNA, 64 nt, Homo Sapiens; identical to SEQ ID NO: 79021

SEQ ID NO: 172466 - RNA, 64 nt, Homo Sapiens; identical to SEQ ID NO: 79022

SEQ ID NO: 172467 - RNA, 64 nt, Homo Sapiens; identical to SEQ ID NO: 79023

SEQ ID NO: 172468 - RNA, 64 nt, Homo Sapiens; identical to SEQ ID NO: 79024

SEQ ID NO: 172469 - RNA, 64 nt, Homo Sapiens; identical to SEQ ID NO: 79025

SEQ ID NO: 172470 - RNA, 64 nt, Homo Sapiens; identical to SEQ ID NO: 79026

SEQ ID NO: 172471 - RNA, 64 nt, Homo Sapiens; identical to SEQ ID NO: 79027

SEQ ID NO: 172472 - RNA, 64 nt, Homo Sapiens; identical to SEQ ID NO: 79028

SEQ ID NO: 172473 - RNA, 64 nt, Homo Sapiens; identical to SEQ ID NO: 79029

SEQ ID NO: 172474 - RNA, 64 nt, Homo Sapiens; identical to SEQ ID NO: 79030

SEQ ID NO: 172475 - RNA, 64 nt, Homo Sapiens; identical to SEQ ID NO: 79031

SEQ ID NO: 172476 - RNA, 64 nt, Homo Sapiens; identical to SEQ ID NO: 79032

SEQ ID NO: 172477 - RNA, 64 nt, Homo Sapiens; identical to SEQ ID NO: 79033

SEQ ID NO: 172478 - RNA, 64 nt, Homo Sapiens; identical to SEQ ID NO: 79034

SEQ ID NO: 172479 - RNA, 64 nt, Homo Sapiens; identical to SEQ ID NO: 79035

SEQ ID NO: 172480 - RNA, 64 nt, Homo Sapiens; identical to SEQ ID NO: 79036

SEQ ID NO: 172481 - RNA, 64 nt, Homo Sapiens; identical to SEQ ID NO: 79037

SEQ ID NO: 172482 - RNA, 64 nt, Homo Sapiens; identical to SEQ ID NO: 79038

SEQ ID NO: 172483 - RNA, 64 nt, Homo Sapiens; identical to SEQ ID NO: 79039

SEQ ID NO: 172484 - RNA, 64 nt, Homo Sapiens; identical to SEQ ID NO: 79040

SEQ ID NO: 172485 - RNA, 64 nt, Homo Sapiens; identical to SEQ ID NO: 79041

SEQ ID NO: 172486 - RNA, 64 nt, Homo Sapiens; identical to SEQ ID NO: 79042

SEQ ID NO: 172487 - RNA, 64 nt, Homo Sapiens; identical to SEQ ID NO: 79043

SEQ ID NO: 172488 - RNA, 64 nt, Homo Sapiens; identical to SEQ ID NO: 79044

SEQ ID NO: 172489 - RNA, 64 nt, Homo Sapiens; identical to SEQ ID NO: 79045

SEQ ID NO: 172490 - RNA, 64 nt, Homo Sapiens; identical to SEQ ID NO: 79046

SEQ ID NO: 172491 - RNA, 64 nt, Homo Sapiens; identical to SEQ ID NO: 79047

SEQ ID NO: 172492 - RNA, 64 nt, Homo Sapiens; identical to SEQ ID NO: 79048

SEQ ID NO: 172493 - RNA, 64 nt, Homo Sapiens; identical to SEQ ID NO: 79049

SEQ ID NO: 172494 - RNA, 64 nt, Homo Sapiens; identical to SEQ ID NO: 79050

SEQ ID NO: 172495 - RNA, 64 nt, Homo Sapiens
uuaguuaauucaaccuuauagaucauacuuaugaaggugauaacugacacguguucacugaauu

SEQ ID NO: 172496 - RNA, 64 nt, Homo Sapiens
ggcccuaaguugaugaagaaaaagucaaggaaggaggugauacaauuggaaauauucccaucaa

SEQ ID NO: 172497 - RNA, 64 nt, Homo Sapiens
cagcggcuguuacacuguucuuugccacugugccuaugcucagaauaugcucacugcuaagcua

SEQ ID NO: 172498 - RNA, 64 nt, Homo Sapiens
acacuguucuuugccacugugccuaugcucagaauaugcucacugcuaagcuacaaacucggac

SEQ ID NO: 172499 - RNA, 63 nt, Homo Sapiens
ccagggauuaggaauuaagaucgugcacaaaaguuuccuuaaaauuccuggauggcugcagau

SEQ ID NO: 172500 - RNA, 63 nt, Homo Sapiens
acauucaacuguaguauccauauguugcuuaaauuuccuuaugagccccaugauggaaagacu

SEQ ID NO: 172501 - RNA, 63 nt, Homo Sapiens
aauuccagcaugugacuuuggcaaacaaccucguuuccuuacauuuagcuccagccacuugug

SEQ ID NO: 172502 - RNA, 63 nt, Homo Sapiens
cuaaagaaugaucuguuguuugcuuguaugguguuuccuuagcgaaucauaaaaugaaguugg

SEQ ID NO: 172503 - RNA, 63 nt, Homo Sapiens
cacaaugucagaccaaauuguuauauccucccuuuuccuuaagugauccagccacuggauauu

SEQ ID NO: 172504 - RNA, 63 nt, Homo Sapiens
ccaagggacccagugacaguuuuaggacugaacuuuccuuagccaaauguuguacccuugcca

SEQ ID NO: 172505 - RNA, 63 nt, Homo Sapiens
aguaacuggaguucuccugcgcauugguagugcuuuccuuaucuuugcaaaauauguuugaaa

SEQ ID NO: 172506 - RNA, 63 nt, Homo Sapiens
ugacuucucauuuuguaucaauacacucgugcuuuuccuuauccaguccaacacuguguuuac

SEQ ID NO: 172507 - RNA, 63 nt, Homo Sapiens
ugucaaauuagauuacacuauucuacaagcuuguuuccuuauuacuugaacaagucacuuaac

SEQ ID NO: 172508 - RNA, 63 nt, Homo Sapiens
uguaagaaacaaugcuucaacuaauuuuggauuuuuccuuaagaaagcaaacuauaggggucc

SEQ ID NO: 172509 - RNA, 63 nt, Homo Sapiens
ucagcuucuacccccuccugccuuuccuuccucuuuccuuacuuccuucccuucccucggcuu

SEQ ID NO: 172510 - RNA, 63 nt, Homo Sapiens
ggacucagcugagaaaggacaacuggguuccgcuuuccuuaacccuacacccuuuagcuggau

SEQ ID NO: 172511 - RNA, 63 nt, Homo Sapiens
ugaacuuuccaagguuauuucugaauguaacaauuuccuuaaaaaugacuuauccaauuucug

SEQ ID NO: 172512 - RNA, 63 nt, Homo Sapiens
acuuuagucuccagaacuaaacaagucccuaaguuuccuuauuuuaauuuacugugacuagau

SEQ ID NO: 172513 - RNA, 63 nt, Homo Sapiens
cagaauuucuaaaaguuuaauauguagaauauauuuccuuauuugaguguuucacaccuuauc

SEQ ID NO: 172514 - RNA, 63 nt, Homo Sapiens
cuugauugugggauacuauuauauguuagagaauuuccuuacuauuuuaauguuucuugggga

SEQ ID NO: 172515 - RNA, 63 nt, Homo Sapiens
aagggagcuaacauuaauuaugcauguacuauauuuccuuaauaugagagauaauuuuuuaau

SEQ ID NO: 172516 - RNA, 63 nt, Homo Sapiens
aucuauuuggagauucagugcauaacuaaguauuuuccuuaauacuaaagauuuuaaauaaua

SEQ ID NO: 172517 - RNA, 63 nt, Homo Sapiens
acagcuagagaaaacaucucgauuaauguuuccuuuccuuacauuaugcagguuaggggaucu

SEQ ID NO: 172518 - RNA, 63 nt, Homo Sapiens
aggaaaacugaaacccagucaaaagcuuacauuuuuccuuaaagcaacucuucaagauguugc

SEQ ID NO: 172519 - RNA, 63 nt, Homo Sapiens
ucuuaaugucucaguuuuugguuaagguuaggauuuccuuagucaggucuaaauuacaaugaa

SEQ ID NO: 172520 - RNA, 63 nt, Homo Sapiens
uuuuauuagguacguaacuaugguaguagaugauuuccuuaaucacuuauacugacuuucauc

SEQ ID NO: 172521 - RNA, 63 nt, Homo Sapiens
aguaaaggguacauaugcauacauaugcaaagcuuuccuuaacuagcuuauucuucuauaucu

SEQ ID NO: 172522 - RNA, 63 nt, Homo Sapiens
acuuuucuuucuccacccacaagaugaaaauguuuuccuuaucggggcuggaggaagauguaa

SEQ ID NO: 172523 - RNA, 63 nt, Homo Sapiens
gacuuuuuguuugccuuacccuuuuuuuccagauuuccuuauuuuguguauaacugcaauggc

SEQ ID NO: 172524 - RNA, 63 nt, Homo Sapiens
ucuagccagucacuuccuuuuagagaaaaucuauuuccuuacccacacguaggccaguuaacu

SEQ ID NO: 172525 - RNA, 63 nt, Homo Sapiens
ucuaauauauaucugggagaaaauuggacucgauuuccuuauagcuguuuuaaaauucauuuc

SEQ ID NO: 172526 - RNA, 63 nt, Homo Sapiens
auauaaacuuuauauacuauauauuauuauaaauuuccuuauuuaccccacuauauaaaaguc

SEQ ID NO: 172527 - RNA, 63 nt, Homo Sapiens
uugaaaacaucuuucugagauauggugcuuuuauuuccuuaacuaggucauuuaauauugguu

SEQ ID NO: 172528 - RNA, 63 nt, Homo Sapiens
gagacaguuugggcucucccaauggaauugcccuuuccuuaaggugcuaagaaagugcauuag

SEQ ID NO: 172529 - RNA, 63 nt, Homo Sapiens
uguuacccagaugguucuggaagagagggaacauuuccuuagagggguugggaggaagcaugu

SEQ ID NO: 172530 - RNA, 63 nt, Homo Sapiens
agucauccagaugcuucugguguggaaggagcauuuccuuagaguggguggagaggaagcaua

SEQ ID NO: 172531 - RNA, 63 nt, Homo Sapiens
uuuaccguguagguuguauacuuacauuuuuucuuuccuuaauuuauacaugauccuuuuucc

SEQ ID NO: 172532 - RNA, 63 nt, Homo Sapiens
auuuuuucuuuccuuaauuuauacaugauccuuuuuccuuaauuuauacaugauccaggcaca

SEQ ID NO: 172533 - RNA, 63 nt, Homo Sapiens
uuaucucagcuuuuaacuucauuugaagaucauuuuccuuaaauaaaccuguugguuaugaaa

SEQ ID NO: 172534 - RNA, 63 nt, Homo Sapiens
agaagguuuucguagagaauagcuggcauuuauuuuccuuacguguaaacaggguacgugaag

SEQ ID NO: 172535 - RNA, 63 nt, Homo Sapiens
cagaauuaauuguuauuauuuuccuaggcgcaauuuccuuaaacguacaguuuaaauucaagg

SEQ ID NO: 172536 - RNA, 63 nt, Homo Sapiens
guguguguguauguguguguguguguguguguguuuccuuauugucauuccauuauauaucca

SEQ ID NO: 172537 - RNA, 63 nt, Homo Sapiens
cuuguucugcauuuuauuuucaagaaccuuugcuuuccuuagauccaaaagucacaauuugua

SEQ ID NO: 172538 - RNA, 63 nt, Homo Sapiens
acauaugaguauauagaaagacugucauuucuuuuuccuuaaaauguauauccagugcaauca

SEQ ID NO: 172539 - RNA, 63 nt, Homo Sapiens
agaaaagccaaauuagaaaauccuauguccuaguuuccuuaccaaggauaauuaaauauauca

SEQ ID NO: 172540 - RNA, 63 nt, Homo Sapiens
agaauagauggcuaacaagagguuagaaauacuuuuccuuaauuuuaauccacaguauguuac

SEQ ID NO: 172541 - RNA, 63 nt, Homo Sapiens
agauuuauucuauucuuacuguuguguauuuuguuuccuuauagccauuaaagaaagcacuaa

SEQ ID NO: 172542 - RNA, 63 nt, Homo Sapiens
aacaaacaaaaauccuuugcccucagaagugcauuuccuuauucuuuaguguaauuguaauuu

SEQ ID NO: 172543 - RNA, 63 nt, Homo Sapiens
cuugggccucacacuagcucggaagaauccagauuuccuuaugugguaaagagcaggaccaga

SEQ ID NO: 172544 - RNA, 63 nt, Homo Sapiens
ucuuuguaauugugcagauagcagauaugaagauuuccuuauucaauucuguguuugcuuuua

SEQ ID NO: 172545 - RNA, 64 nt, Homo Sapiens
gaaagggcagaguaggccgacagcugaccccuuucccgcgcacugggaguggucugaaugaaca

SEQ ID NO: 172546 - RNA, 64 nt, Homo Sapiens
cacauacacacacacauauacacaugcgugugcacccgcgcacgcgcacacacacacacacgca

SEQ ID NO: 172547 - RNA, 64 nt, Homo Sapiens
agaaagcaaacccggggagcaggcggcugccgcacccgcgcaccccgggcccucaccacgcccu

SEQ ID NO: 172548 - RNA, 64 nt, Homo Sapiens
acacuacuccaaaucaaaaccacuaagaguuccucccgcgcagacugcugccccuucagcugcc

SEQ ID NO: 172549 - RNA, 64 nt, Homo Sapiens
guuaggacgaacaucugccccuucagggaggacccccgcgcacaccagaaccucuggcaagccg

SEQ ID NO: 172550 - RNA, 64 nt, Homo Sapiens
aagcaguguuucuucgccacgcuacaucaaagggcccgcgcacagcgccccgcaucucgcgccu

SEQ ID NO: 172551 - RNA, 64 nt, Homo Sapiens
uuccuuuaggugcuauacauuauucaaaaagucucccgcgcauuugcacuaaugauggcugcau

SEQ ID NO: 172552 - RNA, 64 nt, Homo Sapiens
uuccacggcuccggccgcuaggacccugccaggucccgcgcaccaucccugcccugcccacgug

SEQ ID NO: 172553 - RNA, 64 nt, Homo Sapiens
cagcccucccucgauggccucuagcccagagaagcccgcgcaucuuggacccaccaagcaggcc

SEQ ID NO: 172554 - RNA, 64 nt, Homo Sapiens
gggaagccuccugucuccccaagaaccgacccaccccgcgcaaggaggcgcgagugcgugugag

SEQ ID NO: 172555 - RNA, 64 nt, Homo Sapiens
gaaaagaccgagcaggccacagaggcucggucuccccgcgcacagcguaggcacccgguguacu

SEQ ID NO: 172556 - RNA, 64 nt, Homo Sapiens
gcagagggaaggcagcggaagcgcacugaauguccccgcgcagaccaucaccgaggccucccca

SEQ ID NO: 172557 - RNA, 64 nt, Homo Sapiens
ccacugagacggugggacaccucccccuccccaccccgcgcagggcucgggucaguccucaucg

SEQ ID NO: 172558 - RNA, 64 nt, Homo Sapiens
ugguguggagccccuuggccagggccaugggagucccgcgcagucagcuccacauuggccucug

SEQ ID NO: 172559 - RNA, 64 nt, Homo Sapiens
agguuuccacaccccuccccugggccgcugaggccccgcgcaccugugccuuaaucuucccucc

SEQ ID NO: 172560 - RNA, 64 nt, Homo Sapiens
gcuugcagaagggggagaucccaguucgaagacucccgcgcagagccuguggcccucucugcca

SEQ ID NO: 172561 - RNA, 64 nt, Homo Sapiens
gaacgaccccugaauauauaaaacacacacacaccccgcgcacucucacuccuuuuccagguuu

SEQ ID NO: 172562 - RNA, 64 nt, Homo Sapiens
uccuuggccucaucugagaucucucuguaugugccccgcgcauuuuggagggcugcaggucguc

SEQ ID NO: 172563 - RNA, 64 nt, Homo Sapiens
cacaccuggcaacagcaguguccccgaggagugucccgcgcagcgcucuggacugcugcccuug

SEQ ID NO: 172564 - RNA, 64 nt, Homo Sapiens
ugccuaggauguucugggcuugccgcacccgcggcccgcgcagccugggugcugcccugcgccc

SEQ ID NO: 172565 - RNA, 64 nt, Homo Sapiens
ggaagccgagugcccgccgccgcgccagccucagcccgcgcagaaugugcucgcugccccgcgg

SEQ ID NO: 172566 - RNA, 64 nt, Homo Sapiens
gggggcucgggcgcggacuaagcaggggggaucucccgcgcaggggcggcggcggcggggaccg

SEQ ID NO: 172567 - RNA, 64 nt, Homo Sapiens
ugagugagcugugcugccagccaucgcagaggagcccgcgcacgacugugguggggccgucggu

SEQ ID NO: 172568 - RNA, 64 nt, Homo Sapiens
aggggagccggggccgagccaggaggagccugcacccgcgcagaccucaccggacugagcucac

SEQ ID NO: 172569 - RNA, 64 nt, Homo Sapiens
gccauugugggugagggucgagggccaccgaggucccgcgcaccgcugccugcccugcaguggc

SEQ ID NO: 172570 - RNA, 64 nt, Homo Sapiens
uccagccuagcucgggccaaacgccauucgccaucccgcgcacccgcccccugaggacgccucc

SEQ ID NO: 172571 - RNA, 64 nt, Homo Sapiens
cuugcccuauuaaaggcagccccacaaauggcaucccgcgcaugccucuuccccuauaccuguu

SEQ ID NO: 172572 - RNA, 64 nt, Homo Sapiens
gggccccucggaggccgaggcuggcaccccaucucccgcgcagccugcccccuccuggacgugc

SEQ ID NO: 172573 - RNA, 64 nt, Homo Sapiens
auuaacaaaaggacguaugccauggagaaacacacccgcgcacacagcugcucucuacagaggc

SEQ ID NO: 172574 - RNA, 64 nt, Homo Sapiens
cuccugcgcccagaagcccacgcuguaggucaggcccgcgcagcgcgcccgacggccaggaucu

SEQ ID NO: 172575 - RNA, 64 nt, Homo Sapiens
gcggccgugguggaggccuccaccccaggagcaccccgcgcacccucggaggacgggcuucggc

SEQ ID NO: 172576 - RNA, 53 nt, Homo Sapiens
ccguuguuucccccaaggccucucccgcgcagagauucuucagccaucgcuga

SEQ ID NO: 172577 - RNA, 64 nt, Homo Sapiens
ccacgcccuguucacgcucaacacggccacccgccccgcgcaccucugagggccgggcacgguc

SEQ ID NO: 172578 - RNA, 64 nt, Homo Sapiens
ucccggaggagguugggagguggaggcccagcaucccgcgcagaugacaccaucaaccgccaga

SEQ ID NO: 172579 - RNA, 64 nt, Homo Sapiens
cuccaucugguguggaaacacugcccagggagaaaggaggaagcucacuguggacagucuucuu

SEQ ID NO: 172580 - RNA, 64 nt, Homo Sapiens
ucccagcuucgcuccuuaucacugcauugugaagaggaggaaaagugaaucacggagagagaaa

SEQ ID NO: 172581 - RNA, 64 nt, Homo Sapiens
gagaugggcgcucccgacacagcgcagacccaccaggaggaaagaggcccagcucucagcugac

SEQ ID NO: 172582 - RNA, 64 nt, Homo Sapiens
guuagcugcgggcugcccugugggcuggugcuucaggaggaauccagagaaguguucagaugcc

SEQ ID NO: 172583 - RNA, 64 nt, Homo Sapiens
acuuggauaggcaguagauauuuuugcccaccugaggaggaacucagucaagcuguugcuuaac

SEQ ID NO: 172584 - RNA, 64 nt, Homo Sapiens
auuuguucuuuccagagcuaacugauaagaguggaggaggaaugccuucuccuaagagucaguu

SEQ ID NO: 172585 - RNA, 64 nt, Homo Sapiens
ugccucagaggcaguaagaaagagaggccgacccaggaggaaacaaagggugaaugaagaagaa

SEQ ID NO: 172586 - RNA, 64 nt, Homo Sapiens
ggugaaugaagaagaacaaucaugaaauggaagaaggaggaagagcaugaaggaucuuauaaga

SEQ ID NO: 172587 - RNA, 64 nt, Homo Sapiens
cuguauguccagcaaacucuugcauguggccacuaggaggaauguguaagaauguucauaguua

SEQ ID NO: 172588 - RNA, 64 nt, Homo Sapiens
uaaaccaaaauugagcauaguaauuacccacagaaggaggaaguggaagggacaggagcacaua

SEQ ID NO: 172589 - RNA, 64 nt, Homo Sapiens
cgaggacaguggcacuucagggaggaggaggaggaggaggaagggagcaggaggaggaagagga

SEQ ID NO: 172590 - RNA, 64 nt, Homo Sapiens
ggaggaggaggaggaggaggggaggaugagcaggaggaggaagacugcagagccuggaagagga

SEQ ID NO: 172591 - RNA, 64 nt, Homo Sapiens
acccucuguuuggagcauuacaugcccuaaggacaggaggaaaggccguguagacacuaaaccu

SEQ ID NO: 172592 - RNA, 64 nt, Homo Sapiens
agacuuagacgaaagaaaggagucaagugacaacaggaggaaauaaguuggguggacauaaaug

SEQ ID NO: 172593 - RNA, 64 nt, Homo Sapiens
ggcaaggaggcugcaggcagggggucuuggaggaaggaggaaaaaccaugaagaggagaagaug

SEQ ID NO: 172594 - RNA, 64 nt, Homo Sapiens
agcuacagcaucugaaaggaaaggaggcagaaagaggaggaagacccaaaaaaaagaaaaagaa

SEQ ID NO: 172595 - RNA, 64 nt, Homo Sapiens
ccagaggaucaugaagacugggcuuccaauggggaggaggaaagaugcaauaugucucuuacac

SEQ ID NO: 172596 - RNA, 64 nt, Homo Sapiens
uuuaauaugaaucaaagcuuauauguaaacuucaaggaggaaugguaaaauguucagcccuccu

SEQ ID NO: 172597 - RNA, 64 nt, Homo Sapiens
aaagaaucacaaggaaccucaggaggaagaggagaggaggaagcggagaaguuccuuagcaggg

SEQ ID NO: 172598 - RNA, 64 nt, Homo Sapiens
ggagaggaggaagcaaagaaguuccuuagcagggaggaggaagaacauuuguaccccuggagaa

SEQ ID NO: 172599 - RNA, 64 nt, Homo Sapiens
acugugcgcuagacacugccaggcccgggccucgaggaggaaaagacaguagggaagacauuau

SEQ ID NO: 172600 - RNA, 64 nt, Homo Sapiens
uccccacuuuacagauguggauauuuaggccaaaaggaggaagugacuuguccaggggcagaca

SEQ ID NO: 172601 - RNA, 64 nt, Homo Sapiens
ccagacuggccugcccuuucggagaaggaggaagaggaggaaggguggggagucagggguggga

SEQ ID NO: 172602 - RNA, 64 nt, Homo Sapiens
ggaggaaggccagacuggccggggugggaggagaaggaggaagaguugguuggguggggaguca

SEQ ID NO: 172603 - RNA, 64 nt, Homo Sapiens
gucccaccaacuaccagaccaucucugagccuaaaggaggaaaacagccccugacagaaaaagg

SEQ ID NO: 172604 - RNA, 64 nt, Homo Sapiens
uccuagccacgucccuugggaccggugggacuggaggaggaacggucacccuccucccccaugg

SEQ ID NO: 172605 - RNA, 64 nt, Homo Sapiens
aucaggggagagccugcagcugaguucagcagaaaggaggaauccuggcccucaggaagaagau

SEQ ID NO: 172606 - RNA, 64 nt, Homo Sapiens
gagcaggcaagggaaacuggggagauggggauggaggaggaaggcugauauccucuggggagca

SEQ ID NO: 172607 - RNA, 64 nt, Homo Sapiens
uauccucuggggagcacaucaccugaaggugccaaggaggaaggcugagaggggggccacccca

SEQ ID NO: 172608 - RNA, 64 nt, Homo Sapiens
aaagaacucucccaacccuggggccuagcuguauaggaggaauugccuaaggguggcccacucu

SEQ ID NO: 172609 - RNA, 64 nt, Homo Sapiens
uucauaaacacucaccuggcuggcuuugccuuccaggaggaagcuggcugaagcaagggugugg

SEQ ID NO: 172610 - RNA, 64 nt, Homo Sapiens
aagggaagaauuagguuugagcggguugggugggaggaggaagaaggcucaucuugagaagcag

SEQ ID NO: 172611 - RNA, 64 nt, Homo Sapiens
aagggaagaauuagguuugagcggguugggugggaggaggaagauuguugccacugagaagcag

SEQ ID NO: 172612 - RNA, 64 nt, Homo Sapiens
aagaugaggauugcauacauaaugaaugacagagaggaggaaaacaacuaaauuuuaaugaacg

SEQ ID NO: 172613 - RNA, 64 nt, Homo Sapiens
gcuagagaacagcaggucuacugagucuacauggaggaggaaauuauuuaaguggauugaauaa

SEQ ID NO: 172614 - RNA, 64 nt, Homo Sapiens
caaagagggauguuuggaaaaaacucugaaggagaggaggaauuaguugggaugccaauuuccu

SEQ ID NO: 172615 - RNA, 64 nt, Homo Sapiens
ugcucucagcuggcagugcaaugcuuguagaaguaggaggaaacaguucucacugggaagaagc

SEQ ID NO: 172616 - RNA, 64 nt, Homo Sapiens
aagagaacucuccauagaaucccuggccaaagauaggaggaagacucucaggagaagccagagg

SEQ ID NO: 172617 - RNA, 64 nt, Homo Sapiens
ggagcaagaugaacaggcagccaucccuccagcuaggaggaaauccaagagcccuccccuuucu

SEQ ID NO: 172618 - RNA, 64 nt, Homo Sapiens
agagggagauggaggauguguagaaugagugucaaggaggaaagucuucuuggaugguucugcu

SEQ ID NO: 172619 - RNA, 64 nt, Homo Sapiens
cuugccuugcgccuuaggugauguuuauuuggguaggaggaagcagaaauagagaaaagagacc

SEQ ID NO: 172620 - RNA, 64 nt, Homo Sapiens
gaguaugcagaaguuggguagagagguuaagaagaggaggaagugagacggggaagggaggagc

SEQ ID NO: 172621 - RNA, 64 nt, Homo Sapiens
ugaaguuugggauuuggaacuuucuguaucucuuaggaggaacaaguaaaaaccaaaugguuac

SEQ ID NO: 172622 - RNA, 64 nt, Homo Sapiens
gacugguccaggcaugggucccagcaggggcagaaggaggaaggcaggccucauccuccuggac

SEQ ID NO: 172623 - RNA, 64 nt, Homo Sapiens
gguccaggccaggccucaucguuucagguggaacaggaggaacucugguucuccauccccaugu

SEQ ID NO: 172624 - RNA, 64 nt, Homo Sapiens
gacagagccuccacuuaguugagaaccucaaacuaggaggaaaacauuuuagacacugggagaa

SEQ ID NO: 172625 - RNA, 64 nt, Homo Sapiens
cucuggagccaaggcagaggcagucuggaagaagaggaggaagaauaacaacagccacccugcc

SEQ ID NO: 172626 - RNA, 64 nt, Homo Sapiens
gccggacgaguucauggggaucugggggguggggaggaggaagccguugaaucugggagggaag

SEQ ID NO: 172627 - RNA, 64 nt, Homo Sapiens
uauuuagcucuguggaauucagugacaaaaugggaggaggaaagagaguuuguaaggucaugcu

SEQ ID NO: 172628 - RNA, 64 nt, Homo Sapiens
agcugcuuucacgguaaaauuauguugguuugaaaggaggaaauagcaagguuaagauguguga

SEQ ID NO: 172629 - RNA, 64 nt, Homo Sapiens
uagaagcgcaaugagagaagcagcaguggguacaaggaggaagaaaaagggcuugcagagagug

SEQ ID NO: 172630 - RNA, 64 nt, Homo Sapiens
gaagaagugaccaugggcugggaggagguggaggaggaggaagaggagaaggaaaagugacgaa

SEQ ID NO: 172631 - RNA, 64 nt, Homo Sapiens
ccgagcuuuuuugugaaacucagaucagccacccaggaggaagagcgggcugaggaaacccaga

SEQ ID NO: 172632 - RNA, 64 nt, Homo Sapiens
gaugccgagguaggaaaggcugggguucaugugaaggaggaagcuauugggugaggggacgaga

SEQ ID NO: 172633 - RNA, 64 nt, Homo Sapiens
ccucgucccccuaggagcagagcaauugaggaggaggaggaacccacugagugaaggcacauaa

SEQ ID NO: 172634 - RNA, 64 nt, Homo Sapiens
cuugcacuuuggggagaaggggugccaacuacugaggaggaauaauucccagugaccccuucug

SEQ ID NO: 172635 - RNA, 64 nt, Homo Sapiens
ugaaaccuguucugguggaaggcaaaagagggacaggaggaaaagaacaaggagcaagugaucu

SEQ ID NO: 172636 - RNA, 64 nt, Homo Sapiens
ccuggcuuucuugguuugucugacccauggaggcaggaggaagacccuggugaagggcuggacc

SEQ ID NO: 172637 - RNA, 64 nt, Homo Sapiens
ggaggaagucuacacagaggacuggcugcccuggaggaggaaagguggcccaccuguggagagg

SEQ ID NO: 172638 - RNA, 64 nt, Homo Sapiens
gauauugaacaauaaaggagaaugguaccgaugcaggaggaagcaagcgugucuuccccugcag

SEQ ID NO: 172639 - RNA, 64 nt, Homo Sapiens
cccugcagcacacagcgacuugcguugacaaaggaggaggaaacgauuacucuguaaacaaagu

SEQ ID NO: 172640 - RNA, 64 nt, Homo Sapiens
aaaacaggccgagugaaggugcucagugccgaggaggaggaagaaaacugcucagcgcgucuca

SEQ ID NO: 172641 - RNA, 64 nt, Homo Sapiens
aggggaaggaagagagaggguagucagaggagggaggaggaauaaggcaccaggaaaggggugg

SEQ ID NO: 172642 - RNA, 64 nt, Homo Sapiens
accggaagaccuugccucugugccgcggagguccaggaggaaacggggcggccgcuaggccuca

SEQ ID NO: 172643 - RNA, 64 nt, Homo Sapiens
aaggcacacgcucaaugccccacgugccuucuccaggaggaacgaagcaggguuugaggguugg

SEQ ID NO: 172644 - RNA, 64 nt, Homo Sapiens
uuuccacgugagaaauggggagaacgcugcuguuaggaggaaguuguguccaguucagggugcc

SEQ ID NO: 172645 - RNA, 64 nt, Homo Sapiens
caccauggugcccaucguguuacuccauugucagaggaggaaacggggucaggcaggaaagcaa

SEQ ID NO: 172646 - RNA, 64 nt, Homo Sapiens
ccaagggaaggccccauuccggggcuguuccccgaggaggaagggaaggggcucugugugcccc

SEQ ID NO: 172647 - RNA, 64 nt, Homo Sapiens
cgaggaggaagggaaggggcucugugugccccccaggaggaagaggcccugaguccugggauca

SEQ ID NO: 172648 - RNA, 64 nt, Homo Sapiens
gucuaggccaugguacaggagaacuguggcguguaggaggaauacuucaggaugagugaaggcu

SEQ ID NO: 172649 - RNA, 64 nt, Homo Sapiens
ugaggggcuucacuguuaccaggcauguaacagaaggaggaagacuaacacacacccccugccc

SEQ ID NO: 172650 - RNA, 64 nt, Homo Sapiens
cuccucauccggacugaggaagacgaggacagggaggaggaaaaggaggaagaggaggacaaaa

SEQ ID NO: 172651 - RNA, 64 nt, Homo Sapiens
cggacugaggaagacgaggacagggaggaggaaaaggaggaagaggaggacaaaaagggggagg

SEQ ID NO: 172652 - RNA, 64 nt, Homo Sapiens
gacaaaaagggggaggagaagguucuucguccaaaggaggaaggagaagaaguagaaagugcga

SEQ ID NO: 172653 - RNA, 50 nt, Homo Sapiens
acagauucucccgacgauaaacugaggacuugccuuggaaauggaaucug

SEQ ID NO: 172654 - RNA, 64 nt, Homo Sapiens
cuuuagaauucugaagaugugaagccucugucucacugaggauuuuaaaggucaauuauacuuu

SEQ ID NO: 172655 - RNA, 64 nt, Homo Sapiens
cuaagaaguccccaggucaugcugcuguugcuggacugaggaccacacuuugagaaccugugcu

SEQ ID NO: 172656 - RNA, 64 nt, Homo Sapiens
acuuggaagucguuucaggacauggggcauagaaacugaggaguagcugagaggaagaugaaga

SEQ ID NO: 172657 - RNA, 64 nt, Homo Sapiens
aaaggugguucauguucauucucaucagugugaaacugaggagucugcaauuuggaauauggag

SEQ ID NO: 172658 - RNA, 64 nt, Homo Sapiens
gcugauuucaauuaggcagcacuucccaaagugcacugaggaagguggccccaagagaagcucu

SEQ ID NO: 172659 - RNA, 64 nt, Homo Sapiens
cuuugugguagaggggcccuggaauugcagcuguacugaggaugauguuauucacagccccugg

SEQ ID NO: 172660 - RNA, 64 nt, Homo Sapiens
cagagucaggaucucacauuucaccccaggcucaacugaggauguggcuuauuaaacacggaag

SEQ ID NO: 172661 - RNA, 64 nt, Homo Sapiens
caaggacagggccucaggucgauguguggguuacacugaggagcgcgagaggaacagagccaau

SEQ ID NO: 172662 - RNA, 64 nt, Homo Sapiens
acaagccaagcugaugaggcguaaugcaagacucacugaggaaugaguacagauguaaucacaa

SEQ ID NO: 172663 - RNA, 64 nt, Homo Sapiens
ugaaaaucugaacauaggggagugagguauggccacugaggauuuuugcuugcuuaagaaugau

SEQ ID NO: 172664 - RNA, 64 nt, Homo Sapiens
gugaaggugagcuggagcugguuggacuaaugagacugaggaagcagcuuuuccuacgaucugc

SEQ ID NO: 172665 - RNA, 64 nt, Homo Sapiens
auuguugaaagguaauuugagagaaauaugaagaacugaggaggaaaaaaaaaaaaaagaaaag

SEQ ID NO: 172666 - RNA, 64 nt, Homo Sapiens
uugcuggaauaaguucaaauucuucugaacucaaacugaggaauuucaccuguaaaccugaguc

SEQ ID NO: 172667 - RNA, 64 nt, Homo Sapiens
aauagcaucugacuuugagucacagaaaccuuaaacugaggagacaauaguucagaaccuuuuu

SEQ ID NO: 172668 - RNA, 64 nt, Homo Sapiens
gagccauuugcucuugccaaagugagauagauguacugaggagauaauugaaaagucagacucu

SEQ ID NO: 172669 - RNA, 64 nt, Homo Sapiens
cuucugguugcaggugcaaaauuaugguuggaaaacugaggaaugaaaguaguagucagaauga

SEQ ID NO: 172670 - RNA, 64 nt, Homo Sapiens
aagcuaacggaacacauccacucccucagaaaguacugaggagaugaugaagagaaaaaaaagu

SEQ ID NO: 172671 - RNA, 64 nt, Homo Sapiens
cucuuggaugguuaccuuauuucuaagaaacgccacugaggaacaggauccacuuugaacaguc

SEQ ID NO: 172672 - RNA, 64 nt, Homo Sapiens
aagacucagguaccuauuauuguucccuggugaaacugaggagaaaaguuaaucaaccagguua

SEQ ID NO: 172673 - RNA, 64 nt, Homo Sapiens
gauucccgcggguuccgcaguuugcucuuacuacacugaggagacuuugcacaggaugcuggcc

SEQ ID NO: 172674 - RNA, 64 nt, Homo Sapiens
aaguggaggagggccgagguaggaaaaccugaagacugaggacacuuaggcccuagcggcagaa

SEQ ID NO: 172675 - RNA, 64 nt, Homo Sapiens
auacaaaugcacagacugucuggcuuaucacagcacugaggaaaauagacuggagacagguuuu

SEQ ID NO: 172676 - RNA, 64 nt, Homo Sapiens
gacugaguauagacuggagauugauguccacguuacugaggauuggcuugcagauuugcuuucg

SEQ ID NO: 172677 - RNA, 64 nt, Homo Sapiens
gacagugacacaagguggacacucucuacagaucacugaggauaagcuggagccacaaugcaug

SEQ ID NO: 172678 - RNA, 64 nt, Homo Sapiens
aaggauguaugauaauauguacaaaguaauuccaacugaggaagcucaccugauccuuaguguc

SEQ ID NO: 172679 - RNA, 64 nt, Homo Sapiens
guggaaagcucagguggcagcggacucugacuccacugaggaacugccucagaagcugcgauca

SEQ ID NO: 172680 - RNA, 64 nt, Homo Sapiens
uggcugggggaugacagugugggagcugugggguacugaggaagacaccauuccuugacggugu

SEQ ID NO: 172681 - RNA, 64 nt, Homo Sapiens; identical to SEQ ID NO: 55647

SEQ ID NO: 172682 - RNA, 64 nt, Homo Sapiens; identical to SEQ ID NO: 55648

SEQ ID NO: 172683 - RNA, 64 nt, Homo Sapiens; identical to SEQ ID NO: 55649

SEQ ID NO: 172684 - RNA, 64 nt, Homo Sapiens; identical to SEQ ID NO: 55650

SEQ ID NO: 172685 - RNA, 64 nt, Homo Sapiens; identical to SEQ ID NO: 55651

SEQ ID NO: 172686 - RNA, 64 nt, Homo Sapiens; identical to SEQ ID NO: 55652

SEQ ID NO: 172687 - RNA, 64 nt, Homo Sapiens; identical to SEQ ID NO: 55653

SEQ ID NO: 172688 - RNA, 64 nt, Homo Sapiens; identical to SEQ ID NO: 55654

SEQ ID NO: 172689 - RNA, 64 nt, Homo Sapiens; identical to SEQ ID NO: 55655

SEQ ID NO: 172690 - RNA, 64 nt, Homo Sapiens; identical to SEQ ID NO: 55656

SEQ ID NO: 172691 - RNA, 64 nt, Homo Sapiens; identical to SEQ ID NO: 55657

SEQ ID NO: 172692 - RNA, 64 nt, Homo Sapiens; identical to SEQ ID NO: 55658

SEQ ID NO: 172693 - RNA, 64 nt, Homo Sapiens; identical to SEQ ID NO: 55659

SEQ ID NO: 172694 - RNA, 64 nt, Homo Sapiens; identical to SEQ ID NO: 55660

SEQ ID NO: 172695 - RNA, 64 nt, Homo Sapiens; identical to SEQ ID NO: 55661

SEQ ID NO: 172696 - RNA, 64 nt, Homo Sapiens; identical to SEQ ID NO: 55662

SEQ ID NO: 172697 - RNA, 64 nt, Homo Sapiens; identical to SEQ ID NO: 55663

SEQ ID NO: 172698 - RNA, 64 nt, Homo Sapiens; identical to SEQ ID NO: 55664

SEQ ID NO: 172699 - RNA, 64 nt, Homo Sapiens; identical to SEQ ID NO: 55665

SEQ ID NO: 172700 - RNA, 64 nt, Homo Sapiens; identical to SEQ ID NO: 55666

SEQ ID NO: 172701 - RNA, 50 nt, Homo Sapiens; identical to SEQ ID NO: 172653

SEQ ID NO: 172702 - RNA, 64 nt, Homo Sapiens; identical to SEQ ID NO: 172654

SEQ ID NO: 172703 - RNA, 64 nt, Homo Sapiens; identical to SEQ ID NO: 172655

SEQ ID NO: 172704 - RNA, 64 nt, Homo Sapiens; identical to SEQ ID NO: 172656

SEQ ID NO: 172705 - RNA, 64 nt, Homo Sapiens; identical to SEQ ID NO: 172657

SEQ ID NO: 172706 - RNA, 64 nt, Homo Sapiens; identical to SEQ ID NO: 172658

SEQ ID NO: 172707 - RNA, 64 nt, Homo Sapiens; identical to SEQ ID NO: 172659

SEQ ID NO: 172708 - RNA, 64 nt, Homo Sapiens; identical to SEQ ID NO: 172660

SEQ ID NO: 172709 - RNA, 64 nt, Homo Sapiens; identical to SEQ ID NO: 172661

SEQ ID NO: 172710 - RNA, 64 nt, Homo Sapiens; identical to SEQ ID NO: 172662

SEQ ID NO: 172711 - RNA, 64 nt, Homo Sapiens; identical to SEQ ID NO: 172663

SEQ ID NO: 172712 - RNA, 64 nt, Homo Sapiens; identical to SEQ ID NO: 172664

SEQ ID NO: 172713 - RNA, 64 nt, Homo Sapiens; identical to SEQ ID NO: 172665

SEQ ID NO: 172714 - RNA, 64 nt, Homo Sapiens; identical to SEQ ID NO: 172666

SEQ ID NO: 172715 - RNA, 64 nt, Homo Sapiens; identical to SEQ ID NO: 172667

SEQ ID NO: 172716 - RNA, 64 nt, Homo Sapiens; identical to SEQ ID NO: 172668

SEQ ID NO: 172717 - RNA, 64 nt, Homo Sapiens; identical to SEQ ID NO: 172669

SEQ ID NO: 172718 - RNA, 64 nt, Homo Sapiens; identical to SEQ ID NO: 172670

SEQ ID NO: 172719 - RNA, 64 nt, Homo Sapiens; identical to SEQ ID NO: 172671

SEQ ID NO: 172720 - RNA, 64 nt, Homo Sapiens; identical to SEQ ID NO: 172672

SEQ ID NO: 172721 - RNA, 64 nt, Homo Sapiens; identical to SEQ ID NO: 172673

SEQ ID NO: 172722 - RNA, 64 nt, Homo Sapiens; identical to SEQ ID NO: 172674

SEQ ID NO: 172723 - RNA, 64 nt, Homo Sapiens; identical to SEQ ID NO: 172675

SEQ ID NO: 172724 - RNA, 64 nt, Homo Sapiens; identical to SEQ ID NO: 172676

SEQ ID NO: 172725 - RNA, 64 nt, Homo Sapiens; identical to SEQ ID NO: 172677

SEQ ID NO: 172726 - RNA, 64 nt, Homo Sapiens; identical to SEQ ID NO: 172678

SEQ ID NO: 172727 - RNA, 64 nt, Homo Sapiens; identical to SEQ ID NO: 172679

SEQ ID NO: 172728 - RNA, 64 nt, Homo Sapiens; identical to SEQ ID NO: 172680

SEQ ID NO: 172729 - RNA, 64 nt, Homo Sapiens; identical to SEQ ID NO: 55647

SEQ ID NO: 172730 - RNA, 64 nt, Homo Sapiens; identical to SEQ ID NO: 55648

SEQ ID NO: 172731 - RNA, 64 nt, Homo Sapiens; identical to SEQ ID NO: 55649

SEQ ID NO: 172732 - RNA, 64 nt, Homo Sapiens; identical to SEQ ID NO: 55650

SEQ ID NO: 172733 - RNA, 64 nt, Homo Sapiens; identical to SEQ ID NO: 55651

SEQ ID NO: 172734 - RNA, 64 nt, Homo Sapiens; identical to SEQ ID NO: 55652

SEQ ID NO: 172735 - RNA, 64 nt, Homo Sapiens; identical to SEQ ID NO: 55653

SEQ ID NO: 172736 - RNA, 64 nt, Homo Sapiens; identical to SEQ ID NO: 55654

SEQ ID NO: 172737 - RNA, 64 nt, Homo Sapiens; identical to SEQ ID NO: 55655

SEQ ID NO: 172738 - RNA, 64 nt, Homo Sapiens; identical to SEQ ID NO: 55656

SEQ ID NO: 172739 - RNA, 64 nt, Homo Sapiens; identical to SEQ ID NO: 55657

SEQ ID NO: 172740 - RNA, 64 nt, Homo Sapiens; identical to SEQ ID NO: 55658

SEQ ID NO: 172741 - RNA, 64 nt, Homo Sapiens; identical to SEQ ID NO: 55659

SEQ ID NO: 172742 - RNA, 64 nt, Homo Sapiens; identical to SEQ ID NO: 55660

SEQ ID NO: 172743 - RNA, 64 nt, Homo Sapiens; identical to SEQ ID NO: 55661

SEQ ID NO: 172744 - RNA, 64 nt, Homo Sapiens; identical to SEQ ID NO: 55662

SEQ ID NO: 172745 - RNA, 64 nt, Homo Sapiens; identical to SEQ ID NO: 55663

SEQ ID NO: 172746 - RNA, 64 nt, Homo Sapiens; identical to SEQ ID NO: 55664

SEQ ID NO: 172747 - RNA, 64 nt, Homo Sapiens; identical to SEQ ID NO: 55665

SEQ ID NO: 172748 - RNA, 64 nt, Homo Sapiens; identical to SEQ ID NO: 55666

SEQ ID NO: 172749 - RNA, 64 nt, Homo Sapiens
gaugccagggguacugaaucugcaaagcaaaugagcagccaaggaccagcaucuguccgcauuu

SEQ ID NO: 172750 - RNA, 64 nt, Homo Sapiens
ucuacuuccugucugcaugcccaaggcuucugaagcagccaaugucgaugcaacaacauuugua

SEQ ID NO: 172751 - RNA, 64 nt, Homo Sapiens
guuaacacaucuuugucagagaagacuggcgucagcagccaaaacaccaggaaacacauuucug

SEQ ID NO: 172752 - RNA, 64 nt, Homo Sapiens
cuggccacaccacucagugcauggcggccgaugggcagccaacccaaacccgcgccuuuccuug

SEQ ID NO: 172753 - RNA, 64 nt, Homo Sapiens
acccacaccaugaagacaggugacaguucuguuggcagccaagaccuuccuucuuaauaaaggc

SEQ ID NO: 172754 - RNA, 64 nt, Homo Sapiens
gugcaauuacuugaccugcauccacacccucacugcagccaaagugcaacagaaaccaccugcg

SEQ ID NO: 172755 - RNA, 64 nt, Homo Sapiens
cguggcaaccauagagaucgagcuucaggacagagcagccaaugaaaacggccgccugaaccca

SEQ ID NO: 172756 - RNA, 64 nt, Homo Sapiens
uguguggccaauggagacagaggcuuagugcagagcagccaauggguacugagcuggcugagcc

SEQ ID NO: 172757 - RNA, 64 nt, Homo Sapiens
ggguucuguggcaguugcagggcaauguuauggagcagccaacggccuggcagaggagcccaag

SEQ ID NO: 172758 - RNA, 64 nt, Homo Sapiens; identical to SEQ ID NO: 109624

SEQ ID NO: 172759 - RNA, 64 nt, Homo Sapiens; identical to SEQ ID NO: 109625

SEQ ID NO: 172760 - RNA, 64 nt, Homo Sapiens; identical to SEQ ID NO: 109626

SEQ ID NO: 172761 - RNA, 64 nt, Homo Sapiens; identical to SEQ ID NO: 109627

SEQ ID NO: 172762 - RNA, 64 nt, Homo Sapiens; identical to SEQ ID NO: 109628

SEQ ID NO: 172763 - RNA, 64 nt, Homo Sapiens; identical to SEQ ID NO: 109629

SEQ ID NO: 172764 - RNA, 64 nt, Homo Sapiens; identical to SEQ ID NO: 109630

SEQ ID NO: 172765 - RNA, 64 nt, Homo Sapiens; identical to SEQ ID NO: 109631

SEQ ID NO: 172766 - RNA, 64 nt, Homo Sapiens; identical to SEQ ID NO: 109632

SEQ ID NO: 172767 - RNA, 64 nt, Homo Sapiens; identical to SEQ ID NO: 109633

SEQ ID NO: 172768 - RNA, 64 nt, Homo Sapiens; identical to SEQ ID NO: 109634

SEQ ID NO: 172769 - RNA, 64 nt, Homo Sapiens; identical to SEQ ID NO: 109635

SEQ ID NO: 172770 - RNA, 64 nt, Homo Sapiens; identical to SEQ ID NO: 109636

SEQ ID NO: 172771 - RNA, 64 nt, Homo Sapiens; identical to SEQ ID NO: 109637

SEQ ID NO: 172772 - RNA, 64 nt, Homo Sapiens
aggaaauguuuaauuaaugcuuuuuaguuuaaauaaauugaaucauuuauaauaaucaguguua

SEQ ID NO: 172773 - RNA, 64 nt, Homo Sapiens
ucugucaagaaacagcaguaauuauuacugaguuaaauugaaaaguccaguggaccaggcauuu

SEQ ID NO: 172774 - RNA, 64 nt, Homo Sapiens
cauaccccugcgugucugucuugccugagaaaugaaauugaaaaagguuuuuguagcuauuugc

SEQ ID NO: 172775 - RNA, 64 nt, Homo Sapiens
uucuucagacaaaacugcucuucaaaacuauggaaaauugaauuaugugggaaccauucugaag

SEQ ID NO: 172776 - RNA, 64 nt, Homo Sapiens
gaaggggaaggggaagaaaaucuugacgugggagaaauugaaaagaaaaacauguuggcuuuuc

SEQ ID NO: 172777 - RNA, 64 nt, Homo Sapiens
guaccaagaaguggaagaaguguugacauggaugaaauugaaaacaacagcguauuggcuuggc

SEQ ID NO: 172778 - RNA, 64 nt, Homo Sapiens
auuuaucaagugcaggaaugagcacuuaaucuguaaauugaauauuuuuuagcagauagcaguu

SEQ ID NO: 172779 - RNA, 64 nt, Homo Sapiens
uaggaauuugaauuuacaaguauacaaauuuuuaaaauugaaauccuaagauucaauauuacgu

SEQ ID NO: 172780 - RNA, 64 nt, Homo Sapiens
uuauuuuauaauacuuuugguauaauuucaagacaaauugaaucaaaaauaucuguuacaaauu

SEQ ID NO: 172781 - RNA, 64 nt, Homo Sapiens
uuuaacccuuuauuccgauaagauagaauaauggaaauugaaaaacuuuuaagucuaauuuuac

SEQ ID NO: 172782 - RNA, 64 nt, Homo Sapiens
auucgauaauauaguaacucagaauuuucauauaaaauugaauucuacucauuagaguacuuuu

SEQ ID NO: 172783 - RNA, 64 nt, Homo Sapiens
gaaaagcuacaguaugaaaucugaaaagcaacagaaauugaaagugaccuuaaagaauaaauuu

SEQ ID NO: 172784 - RNA, 62 nt, Homo Sapiens
cccaugaaaauucuauuuaguauuuucagagaaaauugaagguuuuuuuaaacaucacugga

SEQ ID NO: 172785 - RNA, 64 nt, Homo Sapiens
auauucuggugaaacauguaaaauacuuuaaguaaaauugaacauuuuuauuugaauuuuugcu

SEQ ID NO: 172786 - RNA, 64 nt, Homo Sapiens
uaaauaacuuuggaaaacagccacagaaacuguuaaauugaacgguugagcaaggggagugaaa

SEQ ID NO: 172787 - RNA, 64 nt, Homo Sapiens
uuuugguaaggaauucauuugguggaaucuucuuaaauugaaauuacucagucccuuuaccuua

SEQ ID NO: 172788 - RNA, 64 nt, Homo Sapiens
caaucucauugaggagcauuagaaugcugaaaaaaaauugaacauacuuaagggaaaaguugca

SEQ ID NO: 172789 - RNA, 64 nt, Homo Sapiens
uguaaugugcaaaagcccuguuuaaacaaugauuaaauugaauguugcccaaaguuuuauuuuu

SEQ ID NO: 172790 - RNA, 64 nt, Homo Sapiens
agaucuugccgugcucuguauuacuuaaagcuauaaauugaacuaauuguccgauuuaugugua

SEQ ID NO: 172791 - RNA, 64 nt, Homo Sapiens
caagaaaacuuguuuuuagaggcaaaaugugaguaaauugaaacggagggauuuacuuuuaaga

SEQ ID NO: 172792 - RNA, 64 nt, Homo Sapiens
uauaaaugaaugggccaugaggaggaagucgggcaaauugaaagaaauugggaugagcccuaau

SEQ ID NO: 172793 - RNA, 64 nt, Homo Sapiens
ggacugguuauuucugguuuugaaguaaucgaacaaauugaaaaucugaagaccgaugcugcaa

SEQ ID NO: 172794 - RNA, 64 nt, Homo Sapiens
ucuuaaaagagaacacaccaaaaaagugaaagagaaauugaaagggaaaaaagacaaaaagcau

SEQ ID NO: 172795 - RNA, 64 nt, Homo Sapiens
cuguuuuauguguaaaaucauguacuuaggcuucaaauugaagcuuuacuuuuuguauguuacc

SEQ ID NO: 172796 - RNA, 64 nt, Homo Sapiens
aaauauauauuuuuaacauaguugaagcaucuaaaaauugaaauaaucaugauggccuguaaca

SEQ ID NO: 172797 - RNA, 64 nt, Homo Sapiens
ugguauauaagauuucaggaucaaauaaaaauugaaauugaagaugaucagcuuuuaauaucug

SEQ ID NO: 172798 - RNA, 64 nt, Homo Sapiens
ugaagaugguauauaagauuuaucugucaaauaaaaauugaaauuuuuccugaucagcuuuuaa

SEQ ID NO: 172799 - RNA, 64 nt, Homo Sapiens
uuuccaaauuauaaacuauguuuuuguaaccaugaaauugaacaacauucuguuugcaggauuu

SEQ ID NO: 172800 - RNA, 64 nt, Homo Sapiens
aaagcuugcuuguugcaauguguguaggacaagaaaauugaacccugcacucaaaaucuuccuu

SEQ ID NO: 172801 - RNA, 64 nt, Homo Sapiens
uuuuggugcacaaauacaaaguggaaacuuaccaaaauugaacuagcuaccauauaagcagauu

SEQ ID NO: 172802 - RNA, 64 nt, Homo Sapiens
uaauguuuaaauagcauaaaaugaaaugcuacaaaaauugaacuaauuuauacuuuaaaguauu

SEQ ID NO: 172803 - RNA, 64 nt, Homo Sapiens
gagaaucuguggauaaguguaacugauaagaagaaaauugaaauauucaacuugcaaaagagac

SEQ ID NO: 172804 - RNA, 64 nt, Homo Sapiens
cugagauuuuucuguauauaggcaaagaaccuucaaauugaagaucuacaacauauguuagcac

SEQ ID NO: 172805 - RNA, 64 nt, Homo Sapiens
ggucuguuaguguuugccaagaaccauugcaaauaaauugaacaucaaagauccaaguuuguac

SEQ ID NO: 172806 - RNA, 64 nt, Homo Sapiens
auaauugaaaaugaaacauguucuuauuuuccuuaaauugaagaaaacccuuuaguugucuaca

SEQ ID NO: 172807 - RNA, 64 nt, Homo Sapiens
caagaauuguuacuuuacaauguucccuuaagcaaaauugaauuugcuuugaacuuuuaguuau

SEQ ID NO: 172808 - RNA, 64 nt, Homo Sapiens
uuuuuuuaaauuuaaauacagaaacaacuggcaaaaauugaacuaagauuuacuuuuuuuucca

SEQ ID NO: 172809 - RNA, 64 nt, Homo Sapiens
uguagagugcugcccgaaauuuuuuuuuuuuuggaaauugaagccucacuggucguguaaacuu

SEQ ID NO: 172810 - RNA, 64 nt, Homo Sapiens
aaagcaauaacucaccaaaggaaggcaucaagacaaauugaaagcaaaugaccuccagccucuc

SEQ ID NO: 172811 - RNA, 64 nt, Homo Sapiens
guaaagaugaggcagagaauacauuccccccgaaaaauugaaauuuguaaacuauauuugaacg

SEQ ID NO: 172812 - RNA, 64 nt, Homo Sapiens
ucuaacaccacacuccagcuucacagagcgguugaaauugaagccaaaagguuuaugaaggggc

SEQ ID NO: 172813 - RNA, 64 nt, Homo Sapiens
aauguucauaauguuucugcauucaucuguucuuaaauugaaaaacauauaauuuacuucuuau

SEQ ID NO: 172814 - RNA, 64 nt, Homo Sapiens
ucuuaaauugaaaaacauauaauuuacuucuuauaaauugaagucuuaaaugugaaaccaagaa

SEQ ID NO: 172815 - RNA, 64 nt, Homo Sapiens
guuugcuuacccuuaaccuucauguacacauuacaaauugaauuaugaaacccaaaacucucug

SEQ ID NO: 172816 - RNA, 64 nt, Homo Sapiens
gcuggaaagaacucaaaugauguuucaccaaaaaaaauugaaaauacaacaaaguuuacaucau

SEQ ID NO: 172817 - RNA, 64 nt, Homo Sapiens
guuuccagcaggagaaugaacagcauugguugacaaauugaagcugccaagguggacaacaaca

SEQ ID NO: 172818 - RNA, 64 nt, Homo Sapiens
cagaagaacaaaaaagaagaaugcuuuaaaugaaaaauugaaauugaucugaagagugaaaaug

SEQ ID NO: 172819 - RNA, 64 nt, Homo Sapiens
uagccacucagagaaacuugaaccucuaaguuggaaauugaagcaacuuaaaugcugcgcauga

SEQ ID NO: 172820 - RNA, 64 nt, Homo Sapiens
uaauauuugugcaacuucauauuugauuuaaauaaaauugaaagcuucauaucaucacaacauu

SEQ ID NO: 172821 - RNA, 64 nt, Homo Sapiens
aaagcuacugggccuccucuacuaugggaugagaaaauugaaauuuuuuauuaaaacaugaguc

SEQ ID NO: 172822 - RNA, 64 nt, Homo Sapiens
gggggagucauggucaggggaaaaaaaaaaaaagaaauugaauuagacuccgucucaaaaaaaa

SEQ ID NO: 172823 - RNA, 64 nt, Homo Sapiens
ggggaggcccaaugagguggcagucaugucacugaaauugaaugggcauggguggguggggagu

SEQ ID NO: 172824 - RNA, 64 nt, Homo Sapiens
ccacuugacuaugaaguuuuuuuaaagcacagauaaauugaauaaucagggcaauagcauuaag

SEQ ID NO: 172825 - RNA, 64 nt, Homo Sapiens
guaaccugaaaaaacauuagaguaaaaaucauugaaauugaaaagagaaaaucgauaaaaccca

SEQ ID NO: 172826 - RNA, 64 nt, Homo Sapiens
aguaauuaauaaccuuccaauauaucuauuaaauaaauugaagcgguagaucucaguaggcaua

SEQ ID NO: 172827 - RNA, 64 nt, Homo Sapiens
gagaaaaucaauaaaacccaaguaaaaaucagugaaauugaaaaguaaccuggaaaaaaauuag

SEQ ID NO: 172828 - RNA, 64 nt, Homo Sapiens
aucagggcaacagcauuaaguguaaagcauagauaaauugaauacacuugacuaugaagcuuuu

SEQ ID NO: 172829 - RNA, 64 nt, Homo Sapiens
caguuugauacucaaggaaaggggguuauucaagaaauugaaaauuucaucuuggaccucagug

SEQ ID NO: 172830 - RNA, 64 nt, Homo Sapiens
aacugucccauauguuaguaaauuacauauguacaaauugaaacuguaaauugugaacacugga

SEQ ID NO: 172831 - RNA, 64 nt, Homo Sapiens
gcaagagguggauuuugccacuucaccaucugacaaauugaaugauggaacauucuuucuuggu

SEQ ID NO: 172832 - RNA, 64 nt, Homo Sapiens
ugauggaacauucuuucuugacaaucguauuuuaaaauugaaacuauuucauuuucccaauuug

SEQ ID NO: 172833 - RNA, 64 nt, Homo Sapiens
uugcuguagcagagcuuuauugcaggcauuuuaaaaauugaauaaccaugugaaauaauuuggg

SEQ ID NO: 172834 - RNA, 64 nt, Homo Sapiens
uuaauuguugcgcucuaauacaacugaccauuuaaaauugaacaaguuuauuguuuuguaacaa

SEQ ID NO: 172835 - RNA, 64 nt, Homo Sapiens
uugaauauugcaggguucagucuagauugucauuaaauugaagagucuacauucagaacauaaa

SEQ ID NO: 172836 - RNA, 64 nt, Homo Sapiens
uuguuucaaacugaaguuuacugagagauccaucaaauugaacaaucuguuguaauuuaaaauu

SEQ ID NO: 172837 - RNA, 64 nt, Homo Sapiens
aauuacacaccuacuuuuacugacuauucaacauaaauugaaucuuuaacaugacuuuaaaggc

SEQ ID NO: 172838 - RNA, 64 nt, Homo Sapiens
aaacacauggaaucuguuuaagauagcccuuguaaaauugaacauuuaccuguauuguaaguac

SEQ ID NO: 172839 - RNA, 64 nt, Homo Sapiens
aauguuugauaaggaaagcauuuuuuuuuuguuaaaauugaauugucaguacuuuacuuuuuuc

SEQ ID NO: 172840 - RNA, 64 nt, Homo Sapiens
cucagaauugaaaauuacuacuuaaaaucuuugcaaauugaauaauuacagaaaagggcuacau

SEQ ID NO: 172841 - RNA, 64 nt, Homo Sapiens
agagaugggguuuggccaugauggccaggcuggaaaauugaaacauaauuucacaauuauuccu

SEQ ID NO: 172842 - RNA, 64 nt, Homo Sapiens
uuuuucugagaaaaaaaaguucuuaaauacaauaaaauugaaauguugaaauauaucucucaaa

SEQ ID NO: 172843 - RNA, 64 nt, Homo Sapiens
accuuuauuagauaaaucaugaagugucccugugaaauugaagugaaacuaucucuguaggacu

SEQ ID NO: 172844 - RNA, 64 nt, Homo Sapiens
gccuuggaauuuucauuuugaugcagaaauuuugaaauugaaaaugugcauguuuuggugcaca

SEQ ID NO: 172845 - RNA, 64 nt, Homo Sapiens
ggggagggaaaauuggaaugguucccuuuuuuagaaauugaaguggucuucauaugucaacuac

SEQ ID NO: 172846 - RNA, 64 nt, Homo Sapiens
uucauaugucaacuacagaaaaggaaaaaaauagaaauugaaggauuuuuaugaaauuauauug

SEQ ID NO: 172847 - RNA, 64 nt, Homo Sapiens
cuucauuucaauuuuauuaugucugccaaauauuaaauugaaauuaauaaccugcauuguugcu

SEQ ID NO: 172848 - RNA, 64 nt, Homo Sapiens
gccaaaacauuugacuccagcccauacauuuagcaaauugaaugacuauucauuggagaguuua

SEQ ID NO: 172849 - RNA, 64 nt, Homo Sapiens
auguauuucagguucugaauaacaauauuuuuccaaauugaaaguaaauauuccagaaguugau

SEQ ID NO: 172850 - RNA, 64 nt, Homo Sapiens
guugucccuauuaacaaaaaaguauuuuaauaaaaaauugaaaugagugagucauauuuuuugu

SEQ ID NO: 172851 - RNA, 64 nt, Homo Sapiens
cgucaaagagccaguuaucuuuagcagauauuaaaaauugaaaacuuuggagaacucauuucaa

SEQ ID NO: 172852 - RNA, 64 nt, Homo Sapiens
aauauugauuucugcccucagcuucaaauaaaguaaauugaaaugggaacaauaucaauauggu

SEQ ID NO: 172853 - RNA, 64 nt, Homo Sapiens
uuaaacuaaaggcuaagaauauaggcuugaugggaaauugaagguaggcugaguauugggaauc

SEQ ID NO: 172854 - RNA, 64 nt, Homo Sapiens
gggaaauugaagguaggcugaguauugggaauccaaauugaauuuugauucuccuuggcaguga

SEQ ID NO: 172855 - RNA, 64 nt, Homo Sapiens
aguacauuacuuaaauguugcuuuuagcuuugauaaauugaaaauauuuuaauguguuguauuu

SEQ ID NO: 172856 - RNA, 64 nt, Homo Sapiens
uaaauugaaaauauuuuaauguguuguauuuuugaaauugaaaacacuguaaaauagauugaug

SEQ ID NO: 172857 - RNA, 64 nt, Homo Sapiens
gcuucucacaaugauugugcaaaaagucacguguaaauugaacuuuuguaaaucaaauuguauu

SEQ ID NO: 172858 - RNA, 64 nt, Homo Sapiens
ccugaacagucugagcagccaacccauuucaacaaaauugaacacaggacucuucugcucagca

SEQ ID NO: 172859 - RNA, 64 nt, Homo Sapiens
agaauguuaagauuuaucugcaaggauuuuuaaaaaauugaaacuugcauuuuaaguguuuaaa

SEQ ID NO: 172860 - RNA, 64 nt, Homo Sapiens
uuagaauucccaagaaggcuuuauuacaccucagaaauugaaagcaccaugacuuuguccauua

SEQ ID NO: 172861 - RNA, 64 nt, Homo Sapiens; identical to SEQ ID NO: 172859

SEQ ID NO: 172862 - RNA, 64 nt, Homo Sapiens; identical to SEQ ID NO: 172860

SEQ ID NO: 172863 - RNA, 64 nt, Homo Sapiens
ugguccaugcagauaaggauguagaaaaagcauucccaaagacuagagcguguauuauuaucua

SEQ ID NO: 172864 - RNA, 64 nt, Homo Sapiens
ugaaaucuuaaaucuauuuacuucccugucuucccccaaagagugucugaguuguuuguuugga

SEQ ID NO: 172865 - RNA, 64 nt, Homo Sapiens
agugagccucuugcuaagugucacacacacucuucccaaagacgugaugaguuaaaguuguauu

SEQ ID NO: 172866 - RNA, 64 nt, Homo Sapiens
uaugaucugacuggaaaacaauccuguauccccucccaaagaaucaugggcuuuuuuuuugaau

SEQ ID NO: 172867 - RNA, 64 nt, Homo Sapiens
ggccuggcugccuggccguggcuucucuuuggcucccaaagagaaggacaguguugggaguauc

SEQ ID NO: 172868 - RNA, 64 nt, Homo Sapiens
uguugggaguaucugccguggcuucucuuuggcucccaaagagaaggacaguguugggaguauc

SEQ ID NO: 172869 - RNA, 64 nt, Homo Sapiens
ucuuucaagcaucuacaaucuggcaaacccuuggcccaaagacucaccaggugggacguggcag

SEQ ID NO: 172870 - RNA, 64 nt, Homo Sapiens
uggccucaccccacccauggaauaccugccucaucccaaagaucagguaugggcugaaugcagc

SEQ ID NO: 172871 - RNA, 64 nt, Homo Sapiens
gugaggcauugucaccuuguccgaacugccucuccccaaagaaugauugugcgcacacucguuu

SEQ ID NO: 172872 - RNA, 64 nt, Homo Sapiens
agacgugaccuggcagauuaauucagucccucuccccaaagacugaaauguucucaauugagca

SEQ ID NO: 172873 - RNA, 64 nt, Homo Sapiens
ucaacauggcaaagcaaauguccuuuugaaccaccccaaagaacuucuacgaugguuuguuugg

SEQ ID NO: 172874 - RNA, 64 nt, Homo Sapiens
cuguucuacaaaaaguagggaugauguaaauccacccaaagauaauggugaaaggauaaccucg

SEQ ID NO: 172875 - RNA, 64 nt, Homo Sapiens
gcaaaaagauaagauuuacuggcagccuauagggcccaaagaagucaggucauuaucaggcaua

SEQ ID NO: 172876 - RNA, 64 nt, Homo Sapiens
uacaaccuaauccccaaccuuacuuugcagcucgcccaaagagacuuugguagucagguuuggc

SEQ ID NO: 172877 - RNA, 64 nt, Homo Sapiens
ccucuuccugcaugggagaguggcugcuccuugccccaaagaacccugcaccaccgugacuccc

SEQ ID NO: 172878 - RNA, 64 nt, Homo Sapiens
ugcccaccuccugggcucucccaggucucuaucucccaaagaccccuacuguucuuugccucgu

SEQ ID NO: 172879 - RNA, 64 nt, Homo Sapiens
ccagaauuuuuuaucuagagaccagcauguucuccccaaagaccaagauauucugccaaaauau

SEQ ID NO: 172880 - RNA, 64 nt, Homo Sapiens
ccagaauuuuuugucuagagaccagcauguucuccccaaagaccagaauauucuaccuaaauau

SEQ ID NO: 172881 - RNA, 64 nt, Homo Sapiens
ccaggacuuuuuaucuagagaccagcauguucuccccaaagacuggaauauucuacccaaaugu

SEQ ID NO: 172882 - RNA, 64 nt, Homo Sapiens
ccaggauuuucuacccagagaccaagguguucuucccaaagaccaaaauauucuacccauaugu

SEQ ID NO: 172883 - RNA, 64 nt, Homo Sapiens
uguucuuuuuaaagcuguuugcaccacacaugaacccaaagacauaguuuacacccgggcagca

SEQ ID NO: 172884 - RNA, 64 nt, Homo Sapiens
auggcuggacccugcaugcauucugccuguuucccccaaagacaccagcuccauccuccacuua

SEQ ID NO: 172885 - RNA, 64 nt, Homo Sapiens
cccuaaaucugcuuccgcaccaccuggucuuagccccaaagaugggccuucucucucccagaua

SEQ ID NO: 172886 - RNA, 64 nt, Homo Sapiens
aaguugguccucccucugccuuuccucucaagcccccaaagagcaaaggcaacagcaagaccag

SEQ ID NO: 172887 - RNA, 64 nt, Homo Sapiens
aacugcaugaaaaggguacaagaagucaacccaucccaaagacauuccccuccuugagaagacc

SEQ ID NO: 172888 - RNA, 64 nt, Homo Sapiens
ugaaucaaagacagcuuggccaaguccagguguucccaaagagcucaggagccaaggcccuuuc

SEQ ID NO: 172889 - RNA, 64 nt, Homo Sapiens
guccaggccccgcccccaaaggaccaggacucgccccaaagaucccgagggcauaggccacccc

SEQ ID NO: 172890 - RNA, 64 nt, Homo Sapiens
ucagacccuuguaagccccuuccuuccucccuugcccaaagauccuuugcugaguguucuguuu

SEQ ID NO: 172891 - RNA, 64 nt, Homo Sapiens
uggaggcaugccugcagaaggacuguugaugcgacccaaagauacagcggugggaucucugcug

SEQ ID NO: 172892 - RNA, 64 nt, Homo Sapiens
guccuugcagaccugcugccucccccacgacaggcccaaagauggacccccccuggccuuguga

SEQ ID NO: 172893 - RNA, 64 nt, Homo Sapiens
guaccugcacucaaaccaggcugaggugcccucccccaaagaauaaggguauaaaugcauguuc

SEQ ID NO: 172894 - RNA, 64 nt, Homo Sapiens
acuagagaugccgagcggccgagagcccucugcacccaaagaggucgccccccacccaucucug

SEQ ID NO: 172895 - RNA, 64 nt, Homo Sapiens
agcaucauuuuaaacaaaguaccggaauuccuuugggaugaaucagccaagauagcucccaugc

SEQ ID NO: 172896 - RNA, 64 nt, Homo Sapiens
cuuggccgagacuaaugugucauguugggcauaagggaugaaaagugccaggcugucuucuguc

SEQ ID NO: 172897 - RNA, 64 nt, Homo Sapiens
agauguuauauuguguuugaagcugagaaguauagggaugaaaauuaagaauacuuuuuuuuua

SEQ ID NO: 172898 - RNA, 64 nt, Homo Sapiens
auguuuuggggggggaugcaaaaaagaggugggugggaugaaacuuuuuaggucugggagggca

SEQ ID NO: 172899 - RNA, 64 nt, Homo Sapiens
ugggagcccaagagccagugccccagcuccuugagggaugaaccugggcccugagcccucaggu

SEQ ID NO: 172900 - RNA, 64 nt, Homo Sapiens
ccagcaucagagagguuuucugcuggugugugcagggaugaaaccccacgccuguaucuggcac

SEQ ID NO: 172901 - RNA, 64 nt, Homo Sapiens
cacaggcgucuccaaccucaaggaagcauggauggggaugaagguagucagaggccccaccccc

SEQ ID NO: 172902 - RNA, 64 nt, Homo Sapiens
acucagcagagaaauucgaggggauccaagcagggggaugaaaauuucaagagguaacagcacu

SEQ ID NO: 172903 - RNA, 60 nt, Homo Sapiens
cacacuaaacuauaaaugucuccaaagucacacauucagaacugucucuggcagucgaau

SEQ ID NO: 172904 - RNA, 60 nt, Homo Sapiens
ggcuucuuuccaucacaaaacggguagaaacacauucacugcuucaggguucuaaucugu

SEQ ID NO: 172905 - RNA, 60 nt, Homo Sapiens
cugccugccgccccgcgggaccugugcaagcacauucaccaagugcaucgguagcccugc

SEQ ID NO: 172906 - RNA, 60 nt, Homo Sapiens
uuuuuuucuuuuaugugaucuuugggaaaacacauucagaauuauaucucguuucuacuu

SEQ ID NO: 172907 - RNA, 60 nt, Homo Sapiens
caauaaagaaucugccuuuaucuacuacagcacauucagcuguuugugauauuuuaaaua

SEQ ID NO: 172908 - RNA, 60 nt, Homo Sapiens
gcugacuggcuucacuggaagcacuugccccacauucacugagcuguagaccagccgcau

SEQ ID NO: 172909 - RNA, 60 nt, Homo Sapiens
gaaaguaggcucaaaagagaauauaucuuucacauucacauucagaacccagcaaccugg

SEQ ID NO: 172910 - RNA, 60 nt, Homo Sapiens
aggcucaaaagagaauauaucuuucacauucacauucagaacccagcaaccuggagucca

SEQ ID NO: 172911 - RNA, 60 nt, Homo Sapiens
gguuugauugguugagauuaaaauugaagacacauucagauuccgaagcacugaugauca

SEQ ID NO: 172912 - RNA, 60 nt, Homo Sapiens
ugcuuccaagggugaaucucucagaguuuacacauucaauugcauugucagugucugcuc

SEQ ID NO: 172913 - RNA, 60 nt, Homo Sapiens
cgacagagugaccagaaacccuuuuacagucacauucagagucgcugcuggccucaggca

SEQ ID NO: 172914 - RNA, 60 nt, Homo Sapiens
uacuuugagccucuuaggcagaaaaccuaccacauucacuacugcaaaauguguccuguc

SEQ ID NO: 172915 - RNA, 60 nt, Homo Sapiens
uuuucugugaacaggcagccugcuggacaacacauucacccuagacucgcgcuaauacag

SEQ ID NO: 172916 - RNA, 60 nt, Homo Sapiens
acagaaacauacaguuuccuuuugcuuuaccacauucaagccugauaauuugaaaauuca

SEQ ID NO: 172917 - RNA, 64 nt, Homo Sapiens
agagaggauuuuagcuaggauuugaacacuuggugcugggaaccucaggguauugcuugccacu

SEQ ID NO: 172918 - RNA, 64 nt, Homo Sapiens
ccccaugccuguggcugcgcuuccuauuucuagggcugggaaacacuccuugcaucaagggguc

SEQ ID NO: 172919 - RNA, 64 nt, Homo Sapiens
ccgcagcccgugaagcagugcaggcaccuggccugcugggaacccagugcugccaugccacugc

SEQ ID NO: 172920 - RNA, 64 nt, Homo Sapiens
uguacucagagcagagcaaaagaucugauggugagcugggaagccaaaugcacaagcucagaau

SEQ ID NO: 172921 - RNA, 64 nt, Homo Sapiens
acugauguugauuuggaaacauuggaugcaggaagcugggaaagccucugcccugacccucugc

SEQ ID NO: 172922 - RNA, 64 nt, Homo Sapiens
uugcuugucauauccagacugccuuuuaacaaacgcugggaauugcaagaacagucugaagaug

SEQ ID NO: 172923 - RNA, 64 nt, Homo Sapiens
uauggcuagugaccagcacugaccaccaucccaagcugggaagagcaauuggugaagagugugu

SEQ ID NO: 172924 - RNA, 64 nt, Homo Sapiens
gucuggauggaggcugcccuggaagcagccccgggcugggaaagggcugagugucaacaggccu

SEQ ID NO: 172925 - RNA, 64 nt, Homo Sapiens
caggccaaagugggggcaacgagcugggaagauggcugggaagcuaguuccuaugaaagaacca

SEQ ID NO: 172926 - RNA, 64 nt, Homo Sapiens
uggcugggaagccaggccaaaugaaagaaccagagcugggaagaggaagcaauaacuaguuccu

SEQ ID NO: 172927 - RNA, 64 nt, Homo Sapiens
agaagaugggguaggaggagacagagcaccccuggcugggaagagaggcagggccugugagugg

SEQ ID NO: 172928 - RNA, 64 nt, Homo Sapiens
ugaggauuugggauuucugucaggucaacccuaugcugggaaaggcaaacuucgagcccaucag

SEQ ID NO: 172929 - RNA, 64 nt, Homo Sapiens
uuuuugauaccuguaguggaauccaagacuuagagcugggaauccucaguggagccuuauuaau

SEQ ID NO: 172930 - RNA, 64 nt, Homo Sapiens
gagcgcucucuugauucuggauuuuggaggcagggcugggaaggaaaaacuuccuucaaucuuc

SEQ ID NO: 172931 - RNA, 64 nt, Homo Sapiens
acaugcuauccaaucucaucgguccccauccccagcugggaagaaggggacucaggaagcaggg

SEQ ID NO: 172932 - RNA, 64 nt, Homo Sapiens
uuccuugcuuaugagaccaagggcugcugcugcugcugggaaucgcauuuucuaugguuacaag

SEQ ID NO: 172933 - RNA, 64 nt, Homo Sapiens
agcacaggugagggggugccugcuguggcacagagcugggaaggccuuacagaagaggugacau

SEQ ID NO: 172934 - RNA, 64 nt, Homo Sapiens
aaacaacagaaauuuauguuuuacaguucuggaggcugggaaguccaagaugagggugucaaca

SEQ ID NO: 172935 - RNA, 64 nt, Homo Sapiens
ugacugcuggagccugagagaacaagagaacggagcugggaauguucugggccuaccaagguuc

SEQ ID NO: 172936 - RNA, 64 nt, Homo Sapiens
agggaugugcagugacguggaaugucagcuuguggcugggaaagcuugcuucucggugcggacu

SEQ ID NO: 172937 - RNA, 64 nt, Homo Sapiens
gcaaacgauuuuacuagacuugcagcuuuaaccugcugggaaugcauuguccaggaaagaaacu

SEQ ID NO: 172938 - RNA, 64 nt, Homo Sapiens
guguugaugaccacugagcccuuucacuauacaggcugggaaguugagcuggggagcuguugau

SEQ ID NO: 172939 - RNA, 64 nt, Homo Sapiens
gaaguucgguaaggaaaugucaaauaggauucuugcugggaaaguuuuuuuaaaagucccccaa

SEQ ID NO: 172940 - RNA, 64 nt, Homo Sapiens
caaggucgguuuccgcccuccagcuguggggccugcugggaaacuccagccuccagagaccgag

SEQ ID NO: 172941 - RNA, 64 nt, Homo Sapiens
agcaugucuggaaucccgaggguuauauuuaggagcugggaagauuacccccaaagauguucuc

SEQ ID NO: 172942 - RNA, 64 nt, Homo Sapiens
agcaaaugaaaauaccagaccaagaaaugagugagcugggaaguguuuccaaauacaguuagug

SEQ ID NO: 172943 - RNA, 64 nt, Homo Sapiens
gagcggagaaugcccauggcggggaggagggcaggcugggaacaugggauaagcccaggugcaa

SEQ ID NO: 172944 - RNA, 64 nt, Homo Sapiens
uggcagcucacucaguacugggagcuagggaggggcugggaagaagaaaaccuggccacuggua

SEQ ID NO: 172945 - RNA, 64 nt, Homo Sapiens
aggaggcccagaaguuggaaagagauggaauguggcugggaacauugcaucccaaagagcuucu

SEQ ID NO: 172946 - RNA, 64 nt, Homo Sapiens
ucuugauggccuacgagaggccaaguuccacugggcugggaaaagucacuuugucugucuuguu

SEQ ID NO: 172947 - RNA, 64 nt, Homo Sapiens
cauccauucagaaguuuuguuguuuuacucuaaagcugggaaaggaaaugagagggaaaagacc

SEQ ID NO: 172948 - RNA, 64 nt, Homo Sapiens
gucaccaagcaggagaguuaaggauucaccaugagcugggaaaugcuuuugccaugaguaugag

SEQ ID NO: 172949 - RNA, 64 nt, Homo Sapiens
uagagggguuaaacaacuugucuuaggcuccacagcugggaacaaguggggcugggaagcugac

SEQ ID NO: 172950 - RNA, 64 nt, Homo Sapiens
cuugucuuaggcuccacagcugggaacaaguggggcugggaagcugacuucgugcucuucacca

SEQ ID NO: 172951 - RNA, 64 nt, Homo Sapiens
aucguaucaaggucacuggguuuuacuggcuggugcugggaaaaugaagcuaagugaggagcuu

SEQ ID NO: 172952 - RNA, 64 nt, Homo Sapiens
ccugccuccugggcuauuccucuccacccagaaggcugggaaucccagcugauucccugacagg

SEQ ID NO: 172953 - RNA, 64 nt, Homo Sapiens
ggcuccuagaauccuuagagucugaauuccuuuagcugggaacagcugucauggucaccccugg

SEQ ID NO: 172954 - RNA, 64 nt, Homo Sapiens
gacccugggcugugucuccuuccuuggaggcagggcugggaaggagaacagaggggacaugaac

SEQ ID NO: 172955 - RNA, 64 nt, Homo Sapiens
uuccccuuuguucaaggccucuaagagcagcugggcugggaaucgcaaugaaaccuguucaugu

SEQ ID NO: 172956 - RNA, 64 nt, Homo Sapiens
cccaggccgcaggagugggacccccaccccaucagcugggaaaggggacuaaagaaaugggugu

SEQ ID NO: 172957 - RNA, 64 nt, Homo Sapiens
ucuagagcccccuuuggcccuucugucauuccaggcugggaaaguaaccccgccuuccagcacu

SEQ ID NO: 172958 - RNA, 64 nt, Homo Sapiens
cuugucuccugccugccugcuccugugagugaccgcugggaaggccugggcgucaucuccuaca

SEQ ID NO: 172959 - RNA, 64 nt, Homo Sapiens
ugcuaggcaccgccugugggucuccaaaauccaggcugggaacacauggucucugacuuuggac

SEQ ID NO: 172960 - RNA, 64 nt, Homo Sapiens
ggauucuucggaugcguaaauuggucugauauaaagccccuauuuaaggugaaauacgaagucc

SEQ ID NO: 172961 - RNA, 64 nt, Homo Sapiens
ccaggaaccaucaggggggccccucugccaugacagccccuaggcaauggcaccuugguggcuu

SEQ ID NO: 172962 - RNA, 64 nt, Homo Sapiens
aguauauuuccgcacuucaggccuaggaccacucagccccuagggucccaccuccagcccggga

SEQ ID NO: 172963 - RNA, 64 nt, Homo Sapiens
aacccaagcuccuccucggagucuuuaaaggcccagccccuagaacgcuggguccuaauuacca

SEQ ID NO: 172964 - RNA, 64 nt, Homo Sapiens
gaaacucccaacuguccuuacccaccgacaucacagccccuaugaagaaaguagccacaaucuc

SEQ ID NO: 172965 - RNA, 64 nt, Homo Sapiens
ccaguaauuuuuuauaaaucuucagauuauaaacagccccuaaaaacuuuacaacguuuacaca

SEQ ID NO: 172966 - RNA, 64 nt, Homo Sapiens
auaauugucuugccauuacuuuugacuuucuuuugagcaauaaacaaagggaauauggaauuuu

SEQ ID NO: 172967 - RNA, 64 nt, Homo Sapiens
gugauuucuggacauugcccgcuacaaggucuaugagcaauaaucaguucuccauuauaucaag

SEQ ID NO: 172968 - RNA, 64 nt, Homo Sapiens
gguuuacucucguauccuuaggccuggcugcaaggagcaauauuuaccaacugcauguacuuuu

SEQ ID NO: 172969 - RNA, 64 nt, Homo Sapiens
uauugagugccuacuaugugcugaaacauucuuugagcaauauucuccugcagacaagcauggu

SEQ ID NO: 172970 - RNA, 64 nt, Homo Sapiens
gccuccccuuccccucccugccccaggacuuaaagagcaauaguuugccccuuuuggaaugauc

SEQ ID NO: 172971 - RNA, 64 nt, Homo Sapiens
aaugaucucugaauauauaaaacacacacacaaagagcaauaguuugccccuuuuggaacgacc

SEQ ID NO: 172972 - RNA, 64 nt, Homo Sapiens
uaaaguacuggugucacccuuugccuauaugguagagcaauaaugcuuuuuaaaaauaaacuuc

SEQ ID NO: 172973 - RNA, 64 nt, Homo Sapiens
ucuaauauauggaguuucgaagaauaaaauaugagagcaauauuuaaauucucaggaauugacu

SEQ ID NO: 172974 - RNA, 64 nt, Homo Sapiens
gggagagaggguggaggguuuuauaaacaaacuuaacagcaauauugaaaggaggugggggauu

SEQ ID NO: 172975 - RNA, 64 nt, Homo Sapiens
guguuggagggccagagacuaguccugagauggaaacagcaacuuguacaguggcugagaaaau

SEQ ID NO: 172976 - RNA, 64 nt, Homo Sapiens
gagaaaaaccgauucaaaucaacuuguacauggaaacagcaagcauuauggucaaacagcaaag

SEQ ID NO: 172977 - RNA, 64 nt, Homo Sapiens
aacuuguacauggaaacagcaagcauuauggucaaacagcaaaggccauaaccuuuugggauuu

SEQ ID NO: 172978 - RNA, 64 nt, Homo Sapiens
augggcagucguggaguugguccccugagggauuaacagcaaugucauaaacagcugugaaccc

SEQ ID NO: 172979 - RNA, 64 nt, Homo Sapiens
augcaguuccagagacacauacacauacagacucaacagcaauccauauccauacacaggugaa

SEQ ID NO: 172980 - RNA, 64 nt, Homo Sapiens
uaaaugcaauaauaugcauguuaacaacauuaaaaacagcaaacagcaaucuaaguacagaaaa

SEQ ID NO: 172981 - RNA, 64 nt, Homo Sapiens
aauaauaugcauguuaacaacauuaaaaacagcaaacagcaaucuaaguacagaaaagcuuuuu

SEQ ID NO: 172982 - RNA, 64 nt, Homo Sapiens
agcagccugugaagauuuugauauaauuaaaagcaacagcaagcaaaauuucaaaguuuaauua

SEQ ID NO: 172983 - RNA, 64 nt, Homo Sapiens
acacgaagaugauaccaaaagaggaaaaagcaacaacagcaacaguuuguuugaauguguagaa

SEQ ID NO: 172984 - RNA, 64 nt, Homo Sapiens
aaaccaauuucuacuucauacugauguuuuuggaaacagcaauuaaaguuuuucuuccaugagu

SEQ ID NO: 172985 - RNA, 64 nt, Homo Sapiens
uugcagauucucugggauuuuaaggaacugagaaaacagcaaaguugacuaaauuuuauauuuc

SEQ ID NO: 172986 - RNA, 64 nt, Homo Sapiens
ucaggaacgcaccuuccagagccugaugaauagcaacagcaauuuccgggaggucuuggagaag

SEQ ID NO: 172987 - RNA, 64 nt, Homo Sapiens
caucgagucaagacugccaaacuacagcugguggaacagcaagccuaagucuucucugagagga

SEQ ID NO: 172988 - RNA, 64 nt, Homo Sapiens
gucaucuacauccuagccuugcaaaaaggcguuaaacagcaaguacuucuguauagaacuaaca

SEQ ID NO: 172989 - RNA, 54 nt, Homo Sapiens
aggcguuaaacagcaaguguaacuaacagcaaaacacuucguacuucuguauag

SEQ ID NO: 172990 - RNA, 64 nt, Homo Sapiens
aauaaaucagagagcaaggccauuuacuaacagcaacagcaagaguaaacuuugucaugguuuc

SEQ ID NO: 172991 - RNA, 64 nt, Homo Sapiens
gcaagaaauaaaucagagaggguuuccauuuacuaacagcaacagcuaauguaaacuuugucau

SEQ ID NO: 172992 - RNA, 64 nt, Homo Sapiens
caaaaagcaaacaaaaaaaagaguauaaaggaaaaacagcaaaaaguugaaagcaagagucccu

SEQ ID NO: 172993 - RNA, 64 nt, Homo Sapiens
ccuauuugaccacucucuucaccuaauuuuugagaacagcaagcauuaaugcuuuugccauuau

SEQ ID NO: 172994 - RNA, 64 nt, Homo Sapiens
aaaggcuccaaaacacacaucaaaugauaagaacaacagcaacaaagcaccaccagauggcuac

SEQ ID NO: 172995 - RNA, 64 nt, Homo Sapiens
ucuucaaugucuaagaaaacauuuauuaccacaaaacagcaaaaaauuguaugaucguaacauu

SEQ ID NO: 172996 - RNA, 64 nt, Homo Sapiens
caaaacaccagaaauauuuuauggauuguggcugaacagcaaaucccaagcugcacuauuggga

SEQ ID NO: 172997 - RNA, 64 nt, Homo Sapiens
auaguaauauauccccuccuuagauucgaaaauuaacagcaauugagaagaaaaaaggcuuauc

SEQ ID NO: 172998 - RNA, 64 nt, Homo Sapiens
uuuaaagaggacauauuuaauacagucuagcauaaacagcaaauucauaaagggagcaccauug

SEQ ID NO: 172999 - RNA, 64 nt, Homo Sapiens
cagguaagacuuauaacaguaagucucuucugaaaacagcaauccaaagaaaaacagauacuaa

SEQ ID NO: 173000 - RNA, 64 nt, Homo Sapiens
ggugaaauucuuaaucaagauguacaugagcaaaaacagcaagucucacaccacuguuacuugg

SEQ ID NO: 173001 - RNA, 64 nt, Homo Sapiens
ucuccagcccaucaucuucguuucggacagagcaaacagcaacaaggagcuggguguggaccag

SEQ ID NO: 173002 - RNA, 64 nt, Homo Sapiens
ccacagccuggcagcucugaucaggaaagugaggaacagcaacaauuccggaacauuuucaagc

SEQ ID NO: 173003 - RNA, 64 nt, Homo Sapiens
ucaagcaucacgccuagcaguuucugguuccuuuaacagcaaaaggaaagagagguucugauuc

SEQ ID NO: 173004 - RNA, 64 nt, Homo Sapiens
cuugccuguuuucuuuauuaguccaaaggaaaacaacagcaacaaaaucuguuuuuaaaauguc

SEQ ID NO: 173005 - RNA, 61 nt, Homo Sapiens
ccaucuaugaauuccggugacaacgguucagaacagcaaccaaauaaaacugaacuuggca

SEQ ID NO: 173006 - RNA, 64 nt, Homo Sapiens
auucagaauuacauuuuaucguuuucacauugaaaacagcaaauguugacuuaguaauuuuuau

SEQ ID NO: 173007 - RNA, 64 nt, Homo Sapiens
uuuagcauuugugccgccuccuuuugcuacucaaaacagcaaugcuuggcggcagccuuccaug

SEQ ID NO: 173008 - RNA, 64 nt, Homo Sapiens
gauaaaaaaacagaugguagaaacacuagagaggaacagcaaugucuucacaucuuguuuucau

SEQ ID NO: 173009 - RNA, 64 nt, Homo Sapiens
gcaucauaggggcuggcacagcugcauauuauuuaacagcaaaggccaccacgucuuguccccc

SEQ ID NO: 173010 - RNA, 64 nt, Homo Sapiens
uuucagauauuucauaauuucuaaccucuguucucucaguaaacagaaugucugaucgaucaug

SEQ ID NO: 173011 - RNA, 64 nt, Homo Sapiens
auuacauauuugaaacagaagauauuauguuaugcucaguaaauaauuaagagauggcauugug

SEQ ID NO: 173012 - RNA, 64 nt, Homo Sapiens
caggcagugcagcauuuaggaaagcagugcaguacucaguaaggcagugcaguacucaguaaca

SEQ ID NO: 173013 - RNA, 64 nt, Homo Sapiens
aaagcagugcaguacucaguaaggcagugcaguacucaguaacacaauacaguacucaggcagu

SEQ ID NO: 173014 - RNA, 64 nt, Homo Sapiens
caguaacacaauacaguacucaggcagugcaguacucaguaagacagugcagugcucaguaagg

SEQ ID NO: 173015 - RNA, 64 nt, Homo Sapiens
caggcagugcaguacucaguaagacagugcagugcucaguaaggcagugcaauacucaguaaca

SEQ ID NO: 173016 - RNA, 64 nt, Homo Sapiens
aagacagugcagugcucaguaaggcagugcaauacucaguaacaguguaguacucaguaacagu

SEQ ID NO: 173017 - RNA, 64 nt, Homo Sapiens
guaaggcagugcaauacucaguaacaguguaguacucaguaacagugaaguacucaguaauaca

SEQ ID NO: 173018 - RNA, 64 nt, Homo Sapiens
caguaacaguguaguacucaguaacagugaaguacucaguaauacaguacaguauucaguaagg

SEQ ID NO: 173019 - RNA, 64 nt, Homo Sapiens
aauacaguacaguauucaguaaggcagugaaguacucaguaauacaauacaguacucaguuagg

SEQ ID NO: 173020 - RNA, 64 nt, Homo Sapiens
acaguacucaggcagugcaauacucagugcgguacucaguaacacagugcaguacucaguaaca

SEQ ID NO: 173021 - RNA, 64 nt, Homo Sapiens
uacucagugcgguacucaguaacacagugcaguacucaguaacagugcaguacucaguaacagu

SEQ ID NO: 173022 - RNA, 64 nt, Homo Sapiens
guaacacagugcaguacucaguaacagugcaguacucaguaacagugcaguacucaguaaggca

SEQ ID NO: 173023 - RNA, 64 nt, Homo Sapiens
caguaacagugcaguacucaguaacagugcaguacucaguaaggcagugcaguacucaguaaca

SEQ ID NO: 173024 - RNA, 64 nt, Homo Sapiens
guaacagugcaguacucaguaaggcagugcaguacucaguaacacagugcaguacucaguaaua

SEQ ID NO: 173025 - RNA, 64 nt, Homo Sapiens
aaggcagugcaguacucaguaacacagugcaguacucaguaauacaguacaguacucaguaagg

SEQ ID NO: 173026 - RNA, 64 nt, Homo Sapiens
aacacagugcaguacucaguaauacaguacaguacucaguaaggcaguaugguacucaguaaag

SEQ ID NO: 173027 - RNA, 64 nt, Homo Sapiens
aauacaguacaguacucaguaaggcaguaugguacucaguaaagcaaugcaaugcucaguaaca

SEQ ID NO: 173028 - RNA, 64 nt, Homo Sapiens
aaggcaguaugguacucaguaaagcaaugcaaugcucaguaacacagugcagugcucaauaagg

SEQ ID NO: 173029 - RNA, 64 nt, Homo Sapiens
aacacagugcagugcucaauaaggcagugcagugcucaguaaggcagugaauugcuuaguaaca

SEQ ID NO: 173030 - RNA, 64 nt, Homo Sapiens
aacacaguguagugcucaguaggacagcauaguacucaguaacacagggcagcuaguacucagu

SEQ ID NO: 173031 - RNA, 64 nt, Homo Sapiens
auaaguacugaguacuuauauaggcaauguaguacucaguaaaucagugcaguacucaguaaug

SEQ ID NO: 173032 - RNA, 64 nt, Homo Sapiens
uaggcaauguaguacucaguaaaucagugcaguacucaguaaugcaagggcauuucaggcuccu

SEQ ID NO: 173033 - RNA, 64 nt, Homo Sapiens
uggacggcucuaaggcuggauuuccuacagggagcucaguaacccuuggcuuucaggccuggcc

SEQ ID NO: 173034 - RNA, 64 nt, Homo Sapiens
ccuccuggcaccaggccuucucuaagugcuuccucucaguaaaggugugucuauaauuguuaaa

SEQ ID NO: 173035 - RNA, 64 nt, Homo Sapiens
gcacagcugcucaaaguaaagccugagcaguguucucaguaauguauuugaaggaaaaauaccc

SEQ ID NO: 173036 - RNA, 64 nt, Homo Sapiens
gaauaguaacauuaugaaugccagggacagugugcucaguaaagucuuccauccaaaaggggca

SEQ ID NO: 173037 - RNA, 64 nt, Homo Sapiens
gcugaagaaggugacugaauuuugaaacuacacccucaguaaagcaaacaggaguuguagauaa

SEQ ID NO: 173038 - RNA, 64 nt, Homo Sapiens
ggucauacuggacuggcuucguucucuuaauauacucaguaaugacucaagccucuggcuauua

SEQ ID NO: 173039 - RNA, 64 nt, Homo Sapiens
augugguacacuguuaauuucuuauuauuuuauacucaguaauaauuauugugauuaguuguug

SEQ ID NO: 173040 - RNA, 64 nt, Homo Sapiens
cagaacgaaauuaccuuugugucacauagguauccucaguaacaacuuuuuuguuugaaugaau

SEQ ID NO: 173041 - RNA, 64 nt, Homo Sapiens
ucuaacauguggguacugugucaucacaaaaucucucaguaaggcuauaugugauccucauuuu

SEQ ID NO: 173042 - RNA, 64 nt, Homo Sapiens
uuguuuccucaugaaacauugcagaguuugaauccucaguaacucucauugacuggauuagagg

SEQ ID NO: 173043 - RNA, 64 nt, Homo Sapiens
guuuaagaucacacagcuagugcaguuacccccucucaguaauuauguuuggcaaauaugaaau

SEQ ID NO: 173044 - RNA, 64 nt, Homo Sapiens
auuagggacauggaugaaauuggaaaucuucauucucaguaaacuaucgcaaggacaaaaaacc

SEQ ID NO: 173045 - RNA, 64 nt, Homo Sapiens
aucaggguagcugaccauguuuggcagauacuauaauggagacacagaagugugcauggcccaa

SEQ ID NO: 173046 - RNA, 64 nt, Homo Sapiens
gcugcuuuugauauguucccugacacauaucuugaauggagaccucccuaccaagugaugaaag

SEQ ID NO: 173047 - RNA, 64 nt, Homo Sapiens
uuccuuucaccaucauuuagaaaugguuugccuuaauggagacaauagcagauccuguaguauu

SEQ ID NO: 173048 - RNA, 64 nt, Homo Sapiens
aagcugggcagcgucugcucuguguucuguguggaauggagaaaaaaacgccugcccugcugcc

SEQ ID NO: 173049 - RNA, 64 nt, Homo Sapiens
aguccaaaugaugaaggaaauguuuuaauucacaaauggagauuuguauguguuaucagguuca

SEQ ID NO: 173050 - RNA, 64 nt, Homo Sapiens
uucgcuauuaaauaaagaaaauuggaugcaagacaauggagaaacuuuaaaacuaaacaggacc

SEQ ID NO: 173051 - RNA, 64 nt, Homo Sapiens
cuagagacagaggaggccuggcaggggugauaaaaauggagauugaaaugaagagaaauagcca

SEQ ID NO: 173052 - RNA, 64 nt, Homo Sapiens
uuuaaagacuacaagauuugcuagauaaacuggaaauggagaaguuauugcagacagucaugaa

SEQ ID NO: 173053 - RNA, 64 nt, Homo Sapiens
auucaccaauuuccuuuaaaacauaagcuaccugaauggagaauacaucuuguuucugaguuuc

SEQ ID NO: 173054 - RNA, 64 nt, Homo Sapiens
ucuuccauuaagaacacuaaaaaguccuugcaagaauggagauaugcauucaagagaggugcua

SEQ ID NO: 173055 - RNA, 64 nt, Homo Sapiens
gaccccucucuccccaguauuaucuuacuugcaaaauggagaccaaauucuauccugugaggcu

SEQ ID NO: 173056 - RNA, 64 nt, Homo Sapiens
uaaagucacugguacuauggacaacuccauagugaauggagauacuugcagagcuugucaugca

SEQ ID NO: 173057 - RNA, 64 nt, Homo Sapiens
ugucacauagcagcauuccgauucuauguaacugaauggagaugauaagugcuuuccccucuuu

SEQ ID NO: 173058 - RNA, 64 nt, Homo Sapiens
ugagaugcuuaaauauuguaauagucaacucuuaaauggagacuuuuauaacagucauucuuug

SEQ ID NO: 173059 - RNA, 59 nt, Homo Sapiens
ugacauaucacgugaaugaagaccuacaaaauggagaauuucaggaaaauucaaacuga

SEQ ID NO: 173060 - RNA, 64 nt, Homo Sapiens
accagcaccagcucccugucucuucuagccacuuaauggagacacaauggagagguaagacaga

SEQ ID NO: 173061 - RNA, 64 nt, Homo Sapiens
cucccugucucuucuagccacuuaauggagacacaauggagagguaagacagaccacaaacuag

SEQ ID NO: 173062 - RNA, 64 nt, Homo Sapiens
guuuaugguuucaggaaaaguucacauuccagacaauggagagucaggguuauaggccucuccu

SEQ ID NO: 173063 - RNA, 64 nt, Homo Sapiens
uuuucaguuuuauaaagggaggucuacuuaggacaauggagacuuaagaauguuaucagaaucu

SEQ ID NO: 173064 - RNA, 53 nt, Homo Sapiens
cagacaaagcggagcucuagaguaauggagagugauggaaacaaaguguacuu

SEQ ID NO: 173065 - RNA, 64 nt, Homo Sapiens
uugacuagaucaagaacuguuuauagcuuuagcaaauggagacagcuuugugaaacuucuucac

SEQ ID NO: 173066 - RNA, 64 nt, Homo Sapiens
gagccaccgugccuggccaggccccuucucuuuuaauggagacagggucuugcacuaucaccca

SEQ ID NO: 173067 - RNA, 64 nt, Homo Sapiens
agaaacauuuucucugaaauauauuauuaagggcaauggagauaaauuaauaguagaugugguu

SEQ ID NO: 173068 - RNA, 64 nt, Homo Sapiens
cccgcacaguaauguagaaacuugaaugggcaugaauggagauggugggaucaacaaugauuuu

SEQ ID NO: 173069 - RNA, 64 nt, Homo Sapiens
augaauggacaaagcucagggcuguggaagggccaauggagaaacaagaauuucuggaagaaag

SEQ ID NO: 173070 - RNA, 64 nt, Homo Sapiens
ugaagcagaggaaggaaacaccugagguuagcccaauggagaaauaugugugcagacaauucuc

SEQ ID NO: 173071 - RNA, 64 nt, Homo Sapiens
gcugagcugaggccugacuuaccaagcugagccgaauggagacauacuaugggcagggcccccc

SEQ ID NO: 173072 - RNA, 64 nt, Homo Sapiens
gaucccaggucuugugggacggccugggccucaaaauggagaugcuaggucuccuuggaaacca

SEQ ID NO: 173073 - RNA, 64 nt, Homo Sapiens
gaagccaaagcugggcucaguggggaaggucaggaauggagaaauugccuuuucucguuagccu

SEQ ID NO: 173074 - RNA, 64 nt, Homo Sapiens
uuggagaucauuauucuaagugaaauaacucaggaauggagaaccaaauauuguacauccucac

SEQ ID NO: 173075 - RNA, 64 nt, Homo Sapiens
ugccaagauccuuugaauacaugcaagaacacacaauggagagaaacccuaugaauguaaagaa

SEQ ID NO: 173076 - RNA, 64 nt, Homo Sapiens
gggaggccgaggcgggcggaucacuaggucaggaaauggagaccauccuggccaacacagugaa

SEQ ID NO: 173077 - RNA, 64 nt, Homo Sapiens
ugagguuugugaaacaguaggauucucuuuuggcaauggagaauugcaucugaugguucaagug

SEQ ID NO: 173078 - RNA, 64 nt, Homo Sapiens
uguggcuuuuguugaguuaaauaagaugcuauauaauggagaagaauuugaaaaugcacaaaaa

SEQ ID NO: 173079 - RNA, 64 nt, Homo Sapiens; identical to SEQ ID NO: 106228

SEQ ID NO: 173080 - RNA, 64 nt, Homo Sapiens; identical to SEQ ID NO: 106229

SEQ ID NO: 173081 - RNA, 64 nt, Homo Sapiens; identical to SEQ ID NO: 106230

SEQ ID NO: 173082 - RNA, 64 nt, Homo Sapiens; identical to SEQ ID NO: 106231

SEQ ID NO: 173083 - RNA, 64 nt, Homo Sapiens; identical to SEQ ID NO: 106232

SEQ ID NO: 173084 - RNA, 64 nt, Homo Sapiens; identical to SEQ ID NO: 106233

SEQ ID NO: 173085 - RNA, 64 nt, Homo Sapiens; identical to SEQ ID NO: 106234

SEQ ID NO: 173086 - RNA, 64 nt, Homo Sapiens; identical to SEQ ID NO: 106235

SEQ ID NO: 173087 - RNA, 64 nt, Homo Sapiens; identical to SEQ ID NO: 106236

SEQ ID NO: 173088 - RNA, 64 nt, Homo Sapiens; identical to SEQ ID NO: 106237

SEQ ID NO: 173089 - RNA, 64 nt, Homo Sapiens; identical to SEQ ID NO: 106238

SEQ ID NO: 173090 - RNA, 64 nt, Homo Sapiens; identical to SEQ ID NO: 106239

SEQ ID NO: 173091 - RNA, 64 nt, Homo Sapiens; identical to SEQ ID NO: 106240

SEQ ID NO: 173092 - RNA, 64 nt, Homo Sapiens; identical to SEQ ID NO: 106241

SEQ ID NO: 173093 - RNA, 64 nt, Homo Sapiens; identical to SEQ ID NO: 106242

SEQ ID NO: 173094 - RNA, 64 nt, Homo Sapiens; identical to SEQ ID NO: 106243

SEQ ID NO: 173095 - RNA, 64 nt, Homo Sapiens; identical to SEQ ID NO: 106244

SEQ ID NO: 173096 - RNA, 64 nt, Homo Sapiens; identical to SEQ ID NO: 106245

SEQ ID NO: 173097 - RNA, 64 nt, Homo Sapiens; identical to SEQ ID NO: 106246

SEQ ID NO: 173098 - RNA, 64 nt, Homo Sapiens; identical to SEQ ID NO: 106247

SEQ ID NO: 173099 - RNA, 64 nt, Homo Sapiens; identical to SEQ ID NO: 106248

SEQ ID NO: 173100 - RNA, 64 nt, Homo Sapiens; identical to SEQ ID NO: 106249

SEQ ID NO: 173101 - RNA, 64 nt, Homo Sapiens; identical to SEQ ID NO: 106250

SEQ ID NO: 173102 - RNA, 64 nt, Homo Sapiens; identical to SEQ ID NO: 106251

SEQ ID NO: 173103 - RNA, 64 nt, Homo Sapiens; identical to SEQ ID NO: 106252

SEQ ID NO: 173104 - RNA, 64 nt, Homo Sapiens; identical to SEQ ID NO: 106253

SEQ ID NO: 173105 - RNA, 64 nt, Homo Sapiens; identical to SEQ ID NO: 106254

SEQ ID NO: 173106 - RNA, 64 nt, Homo Sapiens; identical to SEQ ID NO: 106255

SEQ ID NO: 173107 - RNA, 64 nt, Homo Sapiens; identical to SEQ ID NO: 106256

SEQ ID NO: 173108 - RNA, 64 nt, Homo Sapiens; identical to SEQ ID NO: 106257

SEQ ID NO: 173109 - RNA, 64 nt, Homo Sapiens; identical to SEQ ID NO: 106258

SEQ ID NO: 173110 - RNA, 64 nt, Homo Sapiens; identical to SEQ ID NO: 106259

SEQ ID NO: 173111 - RNA, 64 nt, Homo Sapiens; identical to SEQ ID NO: 106260

SEQ ID NO: 173112 - RNA, 64 nt, Homo Sapiens; identical to SEQ ID NO: 106261

SEQ ID NO: 173113 - RNA, 64 nt, Homo Sapiens; identical to SEQ ID NO: 106262

SEQ ID NO: 173114 - RNA, 64 nt, Homo Sapiens; identical to SEQ ID NO: 106263

SEQ ID NO: 173115 - RNA, 64 nt, Homo Sapiens; identical to SEQ ID NO: 106264

SEQ ID NO: 173116 - RNA, 64 nt, Homo Sapiens; identical to SEQ ID NO: 106265

SEQ ID NO: 173117 - RNA, 64 nt, Homo Sapiens; identical to SEQ ID NO: 106266

SEQ ID NO: 173118 - RNA, 64 nt, Homo Sapiens; identical to SEQ ID NO: 106267

SEQ ID NO: 173119 - RNA, 64 nt, Homo Sapiens; identical to SEQ ID NO: 106268

SEQ ID NO: 173120 - RNA, 64 nt, Homo Sapiens; identical to SEQ ID NO: 106269

SEQ ID NO: 173121 - RNA, 64 nt, Homo Sapiens; identical to SEQ ID NO: 106270

SEQ ID NO: 173122 - RNA, 64 nt, Homo Sapiens; identical to SEQ ID NO: 106271

SEQ ID NO: 173123 - RNA, 64 nt, Homo Sapiens; identical to SEQ ID NO: 106272

SEQ ID NO: 173124 - RNA, 64 nt, Homo Sapiens; identical to SEQ ID NO: 106273

SEQ ID NO: 173125 - RNA, 64 nt, Homo Sapiens; identical to SEQ ID NO: 106274

SEQ ID NO: 173126 - RNA, 64 nt, Homo Sapiens; identical to SEQ ID NO: 106275

SEQ ID NO: 173127 - RNA, 64 nt, Homo Sapiens; identical to SEQ ID NO: 106276

SEQ ID NO: 173128 - RNA, 64 nt, Homo Sapiens; identical to SEQ ID NO: 106277

SEQ ID NO: 173129 - RNA, 64 nt, Homo Sapiens; identical to SEQ ID NO: 106278

SEQ ID NO: 173130 - RNA, 64 nt, Homo Sapiens; identical to SEQ ID NO: 106279

SEQ ID NO: 173131 - RNA, 64 nt, Homo Sapiens; identical to SEQ ID NO: 106280

SEQ ID NO: 173132 - RNA, 64 nt, Homo Sapiens; identical to SEQ ID NO: 106281

SEQ ID NO: 173133 - RNA, 64 nt, Homo Sapiens; identical to SEQ ID NO: 106282

SEQ ID NO: 173134 - RNA, 64 nt, Homo Sapiens; identical to SEQ ID NO: 106283

SEQ ID NO: 173135 - RNA, 64 nt, Homo Sapiens; identical to SEQ ID NO: 106284

SEQ ID NO: 173136 - RNA, 64 nt, Homo Sapiens; identical to SEQ ID NO: 106285

SEQ ID NO: 173137 - RNA, 64 nt, Homo Sapiens; identical to SEQ ID NO: 106286

SEQ ID NO: 173138 - RNA, 64 nt, Homo Sapiens; identical to SEQ ID NO: 106287

SEQ ID NO: 173139 - RNA, 64 nt, Homo Sapiens; identical to SEQ ID NO: 106288

SEQ ID NO: 173140 - RNA, 64 nt, Homo Sapiens; identical to SEQ ID NO: 106289

SEQ ID NO: 173141 - RNA, 64 nt, Homo Sapiens; identical to SEQ ID NO: 106290

SEQ ID NO: 173142 - RNA, 64 nt, Homo Sapiens; identical to SEQ ID NO: 106291

SEQ ID NO: 173143 - RNA, 64 nt, Homo Sapiens; identical to SEQ ID NO: 106292

SEQ ID NO: 173144 - RNA, 64 nt, Homo Sapiens; identical to SEQ ID NO: 106293

SEQ ID NO: 173145 - RNA, 64 nt, Homo Sapiens; identical to SEQ ID NO: 106294

SEQ ID NO: 173146 - RNA, 64 nt, Homo Sapiens; identical to SEQ ID NO: 106295

SEQ ID NO: 173147 - RNA, 64 nt, Homo Sapiens; identical to SEQ ID NO: 106296

SEQ ID NO: 173148 - RNA, 64 nt, Homo Sapiens; identical to SEQ ID NO: 106297

SEQ ID NO: 173149 - RNA, 64 nt, Homo Sapiens; identical to SEQ ID NO: 106298

SEQ ID NO: 173150 - RNA, 64 nt, Homo Sapiens; identical to SEQ ID NO: 106299

SEQ ID NO: 173151 - RNA, 64 nt, Homo Sapiens; identical to SEQ ID NO: 106300

SEQ ID NO: 173152 - RNA, 64 nt, Homo Sapiens; identical to SEQ ID NO: 106301

SEQ ID NO: 173153 - RNA, 64 nt, Homo Sapiens; identical to SEQ ID NO: 106302

SEQ ID NO: 173154 - RNA, 64 nt, Homo Sapiens; identical to SEQ ID NO: 106303

SEQ ID NO: 173155 - RNA, 64 nt, Homo Sapiens; identical to SEQ ID NO: 106304

SEQ ID NO: 173156 - RNA, 64 nt, Homo Sapiens; identical to SEQ ID NO: 106305

SEQ ID NO: 173157 - RNA, 64 nt, Homo Sapiens; identical to SEQ ID NO: 106306

SEQ ID NO: 173158 - RNA, 64 nt, Homo Sapiens; identical to SEQ ID NO: 106307

SEQ ID NO: 173159 - RNA, 64 nt, Homo Sapiens; identical to SEQ ID NO: 106308

SEQ ID NO: 173160 - RNA, 64 nt, Homo Sapiens; identical to SEQ ID NO: 106309

SEQ ID NO: 173161 - RNA, 64 nt, Homo Sapiens; identical to SEQ ID NO: 106310

SEQ ID NO: 173162 - RNA, 64 nt, Homo Sapiens; identical to SEQ ID NO: 106311

SEQ ID NO: 173163 - RNA, 64 nt, Homo Sapiens; identical to SEQ ID NO: 106312

SEQ ID NO: 173164 - RNA, 64 nt, Homo Sapiens; identical to SEQ ID NO: 106313

SEQ ID NO: 173165 - RNA, 64 nt, Homo Sapiens; identical to SEQ ID NO: 106314

SEQ ID NO: 173166 - RNA, 64 nt, Homo Sapiens; identical to SEQ ID NO: 106315

SEQ ID NO: 173167 - RNA, 64 nt, Homo Sapiens; identical to SEQ ID NO: 106316

SEQ ID NO: 173168 - RNA, 55 nt, Homo Sapiens; identical to SEQ ID NO: 106317

SEQ ID NO: 173169 - RNA, 64 nt, Homo Sapiens; identical to SEQ ID NO: 106318

SEQ ID NO: 173170 - RNA, 64 nt, Homo Sapiens; identical to SEQ ID NO: 106319

SEQ ID NO: 173171 - RNA, 64 nt, Homo Sapiens; identical to SEQ ID NO: 106320

SEQ ID NO: 173172 - RNA, 64 nt, Homo Sapiens; identical to SEQ ID NO: 106321

SEQ ID NO: 173173 - RNA, 64 nt, Homo Sapiens; identical to SEQ ID NO: 106322

SEQ ID NO: 173174 - RNA, 64 nt, Homo Sapiens; identical to SEQ ID NO: 106323

SEQ ID NO: 173175 - RNA, 64 nt, Homo Sapiens; identical to SEQ ID NO: 106324

SEQ ID NO: 173176 - RNA, 64 nt, Homo Sapiens; identical to SEQ ID NO: 106325

SEQ ID NO: 173177 - RNA, 64 nt, Homo Sapiens; identical to SEQ ID NO: 106326

SEQ ID NO: 173178 - RNA, 64 nt, Homo Sapiens; identical to SEQ ID NO: 106327

SEQ ID NO: 173179 - RNA, 64 nt, Homo Sapiens; identical to SEQ ID NO: 106328

SEQ ID NO: 173180 - RNA, 64 nt, Homo Sapiens; identical to SEQ ID NO: 106329

SEQ ID NO: 173181 - RNA, 64 nt, Homo Sapiens; identical to SEQ ID NO: 106330

SEQ ID NO: 173182 - RNA, 64 nt, Homo Sapiens; identical to SEQ ID NO: 106331

SEQ ID NO: 173183 - RNA, 64 nt, Homo Sapiens; identical to SEQ ID NO: 106332

SEQ ID NO: 173184 - RNA, 64 nt, Homo Sapiens; identical to SEQ ID NO: 106333

SEQ ID NO: 173185 - RNA, 64 nt, Homo Sapiens; identical to SEQ ID NO: 106334

SEQ ID NO: 173186 - RNA, 64 nt, Homo Sapiens; identical to SEQ ID NO: 106335

SEQ ID NO: 173187 - RNA, 64 nt, Homo Sapiens; identical to SEQ ID NO: 106336

SEQ ID NO: 173188 - RNA, 64 nt, Homo Sapiens; identical to SEQ ID NO: 106337

SEQ ID NO: 173189 - RNA, 64 nt, Homo Sapiens; identical to SEQ ID NO: 106338

SEQ ID NO: 173190 - RNA, 64 nt, Homo Sapiens; identical to SEQ ID NO: 106339

SEQ ID NO: 173191 - RNA, 64 nt, Homo Sapiens; identical to SEQ ID NO: 106340

SEQ ID NO: 173192 - RNA, 64 nt, Homo Sapiens; identical to SEQ ID NO: 106341

SEQ ID NO: 173193 - RNA, 64 nt, Homo Sapiens; identical to SEQ ID NO: 106342

SEQ ID NO: 173194 - RNA, 64 nt, Homo Sapiens; identical to SEQ ID NO: 106343

SEQ ID NO: 173195 - RNA, 64 nt, Homo Sapiens; identical to SEQ ID NO: 106344

SEQ ID NO: 173196 - RNA, 64 nt, Homo Sapiens; identical to SEQ ID NO: 106345

SEQ ID NO: 173197 - RNA, 64 nt, Homo Sapiens; identical to SEQ ID NO: 106346

SEQ ID NO: 173198 - RNA, 64 nt, Homo Sapiens; identical to SEQ ID NO: 106347

SEQ ID NO: 173199 - RNA, 64 nt, Homo Sapiens; identical to SEQ ID NO: 106348

SEQ ID NO: 173200 - RNA, 64 nt, Homo Sapiens; identical to SEQ ID NO: 106349

SEQ ID NO: 173201 - RNA, 64 nt, Homo Sapiens; identical to SEQ ID NO: 106350

SEQ ID NO: 173202 - RNA, 64 nt, Homo Sapiens; identical to SEQ ID NO: 106351

SEQ ID NO: 173203 - RNA, 64 nt, Homo Sapiens; identical to SEQ ID NO: 106352

SEQ ID NO: 173204 - RNA, 64 nt, Homo Sapiens; identical to SEQ ID NO: 106353

SEQ ID NO: 173205 - RNA, 64 nt, Homo Sapiens; identical to SEQ ID NO: 106354

SEQ ID NO: 173206 - RNA, 64 nt, Homo Sapiens; identical to SEQ ID NO: 106355

SEQ ID NO: 173207 - RNA, 64 nt, Homo Sapiens; identical to SEQ ID NO: 106356

SEQ ID NO: 173208 - RNA, 64 nt, Homo Sapiens; identical to SEQ ID NO: 106357

SEQ ID NO: 173209 - RNA, 64 nt, Homo Sapiens; identical to SEQ ID NO: 106358

SEQ ID NO: 173210 - RNA, 64 nt, Homo Sapiens; identical to SEQ ID NO: 106359

SEQ ID NO: 173211 - RNA, 64 nt, Homo Sapiens; identical to SEQ ID NO: 106360

SEQ ID NO: 173212 - RNA, 64 nt, Homo Sapiens; identical to SEQ ID NO: 106361

SEQ ID NO: 173213 - RNA, 64 nt, Homo Sapiens; identical to SEQ ID NO: 106362

SEQ ID NO: 173214 - RNA, 64 nt, Homo Sapiens; identical to SEQ ID NO: 106363

SEQ ID NO: 173215 - RNA, 64 nt, Homo Sapiens; identical to SEQ ID NO: 106364

SEQ ID NO: 173216 - RNA, 64 nt, Homo Sapiens; identical to SEQ ID NO: 106365

SEQ ID NO: 173217 - RNA, 64 nt, Homo Sapiens; identical to SEQ ID NO: 106366

SEQ ID NO: 173218 - RNA, 64 nt, Homo Sapiens; identical to SEQ ID NO: 106367

SEQ ID NO: 173219 - RNA, 64 nt, Homo Sapiens; identical to SEQ ID NO: 106368

SEQ ID NO: 173220 - RNA, 64 nt, Homo Sapiens; identical to SEQ ID NO: 106369

SEQ ID NO: 173221 - RNA, 64 nt, Homo Sapiens; identical to SEQ ID NO: 106370

SEQ ID NO: 173222 - RNA, 64 nt, Homo Sapiens; identical to SEQ ID NO: 106371

SEQ ID NO: 173223 - RNA, 64 nt, Homo Sapiens; identical to SEQ ID NO: 106372

SEQ ID NO: 173224 - RNA, 64 nt, Homo Sapiens; identical to SEQ ID NO: 106373

SEQ ID NO: 173225 - RNA, 64 nt, Homo Sapiens; identical to SEQ ID NO: 106374

SEQ ID NO: 173226 - RNA, 64 nt, Homo Sapiens; identical to SEQ ID NO: 106375

SEQ ID NO: 173227 - RNA, 61 nt, Homo Sapiens; identical to SEQ ID NO: 106376

SEQ ID NO: 173228 - RNA, 64 nt, Homo Sapiens; identical to SEQ ID NO: 106377

SEQ ID NO: 173229 - RNA, 64 nt, Homo Sapiens; identical to SEQ ID NO: 106378

SEQ ID NO: 173230 - RNA, 64 nt, Homo Sapiens; identical to SEQ ID NO: 106379

SEQ ID NO: 173231 - RNA, 64 nt, Homo Sapiens; identical to SEQ ID NO: 106380

SEQ ID NO: 173232 - RNA, 64 nt, Homo Sapiens; identical to SEQ ID NO: 106381

SEQ ID NO: 173233 - RNA, 64 nt, Homo Sapiens; identical to SEQ ID NO: 106382

SEQ ID NO: 173234 - RNA, 64 nt, Homo Sapiens; identical to SEQ ID NO: 106383

SEQ ID NO: 173235 - RNA, 64 nt, Homo Sapiens; identical to SEQ ID NO: 106384

SEQ ID NO: 173236 - RNA, 64 nt, Homo Sapiens; identical to SEQ ID NO: 106385

SEQ ID NO: 173237 - RNA, 64 nt, Homo Sapiens; identical to SEQ ID NO: 106386

SEQ ID NO: 173238 - RNA, 64 nt, Homo Sapiens; identical to SEQ ID NO: 106387

SEQ ID NO: 173239 - RNA, 64 nt, Homo Sapiens; identical to SEQ ID NO: 106388

SEQ ID NO: 173240 - RNA, 64 nt, Homo Sapiens; identical to SEQ ID NO: 106389

SEQ ID NO: 173241 - RNA, 64 nt, Homo Sapiens; identical to SEQ ID NO: 106390

SEQ ID NO: 173242 - RNA, 64 nt, Homo Sapiens; identical to SEQ ID NO: 106391

SEQ ID NO: 173243 - RNA, 64 nt, Homo Sapiens; identical to SEQ ID NO: 106392

SEQ ID NO: 173244 - RNA, 64 nt, Homo Sapiens; identical to SEQ ID NO: 106393

SEQ ID NO: 173245 - RNA, 64 nt, Homo Sapiens; identical to SEQ ID NO: 106394

SEQ ID NO: 173246 - RNA, 64 nt, Homo Sapiens; identical to SEQ ID NO: 106395

SEQ ID NO: 173247 - RNA, 64 nt, Homo Sapiens; identical to SEQ ID NO: 106396

SEQ ID NO: 173248 - RNA, 64 nt, Homo Sapiens; identical to SEQ ID NO: 106397

SEQ ID NO: 173249 - RNA, 64 nt, Homo Sapiens; identical to SEQ ID NO: 106398

SEQ ID NO: 173250 - RNA, 64 nt, Homo Sapiens; identical to SEQ ID NO: 106399

SEQ ID NO: 173251 - RNA, 64 nt, Homo Sapiens; identical to SEQ ID NO: 106400

SEQ ID NO: 173252 - RNA, 64 nt, Homo Sapiens; identical to SEQ ID NO: 106401

SEQ ID NO: 173253 - RNA, 64 nt, Homo Sapiens; identical to SEQ ID NO: 106402

SEQ ID NO: 173254 - RNA, 64 nt, Homo Sapiens; identical to SEQ ID NO: 106403

SEQ ID NO: 173255 - RNA, 64 nt, Homo Sapiens; identical to SEQ ID NO: 106404

SEQ ID NO: 173256 - RNA, 64 nt, Homo Sapiens; identical to SEQ ID NO: 106405

SEQ ID NO: 173257 - RNA, 64 nt, Homo Sapiens; identical to SEQ ID NO: 106406

SEQ ID NO: 173258 - RNA, 64 nt, Homo Sapiens; identical to SEQ ID NO: 106407

SEQ ID NO: 173259 - RNA, 64 nt, Homo Sapiens; identical to SEQ ID NO: 106408

SEQ ID NO: 173260 - RNA, 64 nt, Homo Sapiens; identical to SEQ ID NO: 106409

SEQ ID NO: 173261 - RNA, 64 nt, Homo Sapiens; identical to SEQ ID NO: 106410

SEQ ID NO: 173262 - RNA, 64 nt, Homo Sapiens; identical to SEQ ID NO: 106411

SEQ ID NO: 173263 - RNA, 64 nt, Homo Sapiens; identical to SEQ ID NO: 106412

SEQ ID NO: 173264 - RNA, 64 nt, Homo Sapiens; identical to SEQ ID NO: 106413

SEQ ID NO: 173265 - RNA, 64 nt, Homo Sapiens; identical to SEQ ID NO: 106414

SEQ ID NO: 173266 - RNA, 64 nt, Homo Sapiens; identical to SEQ ID NO: 106415

SEQ ID NO: 173267 - RNA, 64 nt, Homo Sapiens; identical to SEQ ID NO: 106416

SEQ ID NO: 173268 - RNA, 64 nt, Homo Sapiens; identical to SEQ ID NO: 106417

SEQ ID NO: 173269 - RNA, 64 nt, Homo Sapiens; identical to SEQ ID NO: 106418

SEQ ID NO: 173270 - RNA, 64 nt, Homo Sapiens; identical to SEQ ID NO: 106419

SEQ ID NO: 173271 - RNA, 64 nt, Homo Sapiens; identical to SEQ ID NO: 106420

SEQ ID NO: 173272 - RNA, 64 nt, Homo Sapiens; identical to SEQ ID NO: 106421

SEQ ID NO: 173273 - RNA, 64 nt, Homo Sapiens; identical to SEQ ID NO: 106422

SEQ ID NO: 173274 - RNA, 64 nt, Homo Sapiens; identical to SEQ ID NO: 106423

SEQ ID NO: 173275 - RNA, 64 nt, Homo Sapiens; identical to SEQ ID NO: 106424

SEQ ID NO: 173276 - RNA, 64 nt, Homo Sapiens; identical to SEQ ID NO: 106425

SEQ ID NO: 173277 - RNA, 64 nt, Homo Sapiens; identical to SEQ ID NO: 106426

SEQ ID NO: 173278 - RNA, 64 nt, Homo Sapiens; identical to SEQ ID NO: 106427

SEQ ID NO: 173279 - RNA, 64 nt, Homo Sapiens; identical to SEQ ID NO: 106428

SEQ ID NO: 173280 - RNA, 64 nt, Homo Sapiens; identical to SEQ ID NO: 106429

SEQ ID NO: 173281 - RNA, 64 nt, Homo Sapiens; identical to SEQ ID NO: 106430

SEQ ID NO: 173282 - RNA, 64 nt, Homo Sapiens; identical to SEQ ID NO: 106431

SEQ ID NO: 173283 - RNA, 64 nt, Homo Sapiens; identical to SEQ ID NO: 106432

SEQ ID NO: 173284 - RNA, 64 nt, Homo Sapiens; identical to SEQ ID NO: 106433

SEQ ID NO: 173285 - RNA, 64 nt, Homo Sapiens; identical to SEQ ID NO: 106434

SEQ ID NO: 173286 - RNA, 64 nt, Homo Sapiens; identical to SEQ ID NO: 106435

SEQ ID NO: 173287 - RNA, 64 nt, Homo Sapiens; identical to SEQ ID NO: 106436

SEQ ID NO: 173288 - RNA, 64 nt, Homo Sapiens; identical to SEQ ID NO: 106437

SEQ ID NO: 173289 - RNA, 64 nt, Homo Sapiens; identical to SEQ ID NO: 106438

SEQ ID NO: 173290 - RNA, 64 nt, Homo Sapiens; identical to SEQ ID NO: 106439

SEQ ID NO: 173291 - RNA, 64 nt, Homo Sapiens; identical to SEQ ID NO: 106440

SEQ ID NO: 173292 - RNA, 64 nt, Homo Sapiens; identical to SEQ ID NO: 106441

SEQ ID NO: 173293 - RNA, 64 nt, Homo Sapiens; identical to SEQ ID NO: 106442

SEQ ID NO: 173294 - RNA, 64 nt, Homo Sapiens; identical to SEQ ID NO: 106443

SEQ ID NO: 173295 - RNA, 64 nt, Homo Sapiens; identical to SEQ ID NO: 106444

SEQ ID NO: 173296 - RNA, 64 nt, Homo Sapiens; identical to SEQ ID NO: 106445

SEQ ID NO: 173297 - RNA, 64 nt, Homo Sapiens; identical to SEQ ID NO: 106446

SEQ ID NO: 173298 - RNA, 64 nt, Homo Sapiens; identical to SEQ ID NO: 106447

SEQ ID NO: 173299 - RNA, 64 nt, Homo Sapiens; identical to SEQ ID NO: 106448

SEQ ID NO: 173300 - RNA, 64 nt, Homo Sapiens
ucaaaucuuuccuccccauuuaaacauaugcucuggcaccaaguuagacacuuauugccagggu

SEQ ID NO: 173301 - RNA, 64 nt, Homo Sapiens
cuuaucuggaaauaaauuguugauuuccuuuaaaggcaccaaauagccuuugguccauuucuua

SEQ ID NO: 173302 - RNA, 64 nt, Homo Sapiens
gugcucauagugaucagcugugcaggagccaugaggcaccaaccucuccccgcagggcaaagcc

SEQ ID NO: 173303 - RNA, 64 nt, Homo Sapiens
uuugaacccugugagccugagacagagagggccaggcaccaaccacaaggcgggaaaguccaug

SEQ ID NO: 173304 - RNA, 64 nt, Homo Sapiens
gaaguguccuccuguucucuccagccccucucauggcaccaauggaaguaaaacuuggccuccu

SEQ ID NO: 173305 - RNA, 64 nt, Homo Sapiens
uaggucucagaggaaagaaucaggcucaaguauuggcaccaagugcgguaagaggagggggagc

SEQ ID NO: 173306 - RNA, 64 nt, Homo Sapiens
gaggccucugggccuccucuaacaggggcuggugggcaccaagagccaauggaguagaccccug

SEQ ID NO: 173307 - RNA, 64 nt, Homo Sapiens
ggagcacaaaagccucucaucccccauuaaccagggcaccaagcccacagguguccccagccca

SEQ ID NO: 173308 - RNA, 65 nt, Homo Sapiens
augaaugaauaaaagucaaucagauaucauuucaggugacuuaacuaaugagcauuuaaaugcaa

SEQ ID NO: 173309 - RNA, 65 nt, Homo Sapiens
uaugugggauauugaguaucugaggcuguguugaagugacuuaucuuuuggugugggaguuguca

SEQ ID NO: 173310 - RNA, 65 nt, Homo Sapiens
uggcuguuggcugucaucuugaacucuauuugaaugugacuuaaaucacaaguaacguguuuugu

SEQ ID NO: 173311 - RNA, 65 nt, Homo Sapiens
cccauucagcuguuuuaacacagaaauucaaaauagugacuuaacauggaagcuauuucucucuu

SEQ ID NO: 173312 - RNA, 65 nt, Homo Sapiens
cuuagagcaagcacaacaucaaucuguuucccuaagugacuuaacuaagccauuggauaauacug

SEQ ID NO: 173313 - RNA, 65 nt, Homo Sapiens
guuugauggagagaaagcuggaguccuaucuuacugugacuuaaauggcugugccugugacucca

SEQ ID NO: 173314 - RNA, 64 nt, Homo Sapiens
auuuuucuaaauacagccuuuuucuccauuucauaauucucaagauuguuaucaauuaacuguu

SEQ ID NO: 173315 - RNA, 64 nt, Homo Sapiens
uaaaaagaaguguauccuuacuuuuauguuucuaaauucucaauuugacacggauuauuuguug

SEQ ID NO: 173316 - RNA, 64 nt, Homo Sapiens
gagaaugcaaugaaacagucuuggcacugguacgaauucucaguuaaguagaacuguaacuacg

SEQ ID NO: 173317 - RNA, 64 nt, Homo Sapiens
aagaaugcaguggaacaguuuaggcacugguacgaauucucaauguaugaaaguuguuaccaca

SEQ ID NO: 173318 - RNA, 64 nt, Homo Sapiens
aaauugcuccuaagcuucaaacugauaguguccaaauucucaccaguucuucuccaauccuauc

SEQ ID NO: 173319 - RNA, 64 nt, Homo Sapiens
agaaaaggcaaaaccugggauuagagcccauuucaauucucaaacacuacauuagaacacugca

SEQ ID NO: 173320 - RNA, 64 nt, Homo Sapiens
guuuguucagucugucuucauuuuuuuuuuaauuaauucucacuguuuuuaagcuacacgagaa

SEQ ID NO: 173321 - RNA, 64 nt, Homo Sapiens
uacugauaaacaccuguuguuuaaacuagaugauaauucucaggcuccugauaccuuugcuuaa

SEQ ID NO: 173322 - RNA, 64 nt, Homo Sapiens
uuuauaugguugagucuccugaauauuuugaaugaauucucaacaaaaugugcuagccacuggg

SEQ ID NO: 173323 - RNA, 64 nt, Homo Sapiens
auuuuauagugagggagguuggcauggagacuaaaauucucaggaaaaugagauccguguuaga

SEQ ID NO: 173324 - RNA, 64 nt, Homo Sapiens
guauuuucaagaaaaggcagaacaaauaaugcaaaauucucaguaauagugauacauggauaua

SEQ ID NO: 173325 - RNA, 64 nt, Homo Sapiens
caguaauagugauacauggauauacuuccuuuuaaauucucagcugcaaaauaauuguagacaa

SEQ ID NO: 173326 - RNA, 64 nt, Homo Sapiens
aacuuaauuggauacuuuuagcaaauaggaacuuaauucucagcacugaacaugaauuacuucc

SEQ ID NO: 173327 - RNA, 64 nt, Homo Sapiens
gaguagccacugguugcauaauaauagagaccuaaauucucaaauagggaaagagguuuuaaaa

SEQ ID NO: 173328 - RNA, 64 nt, Homo Sapiens
acuguggucuugguguuuuacauagacugucucuaauucucacaacucugcaaaauauauauau

SEQ ID NO: 173329 - RNA, 64 nt, Homo Sapiens
aauguggacuuuauugagaagcauggauguuagugaaaguuacuacaguguggaguguugagac

SEQ ID NO: 173330 - RNA, 64 nt, Homo Sapiens
gauucauuuugcagauuuacauuuugcuuguguggaaaguuacguucacuucaaccuacagacc

SEQ ID NO: 173331 - RNA, 64 nt, Homo Sapiens
uuuugauggccuuuuaaacaagacuccaguaugugaaaguuaauugcugugcuccacagaucuu

SEQ ID NO: 173332 - RNA, 64 nt, Homo Sapiens
ugugcuccacagaucuugucuauuggccccuguagaaaguuaaccuuuguuguuuuccuuuuau

SEQ ID NO: 173333 - RNA, 64 nt, Homo Sapiens
ugggagcuuugacucuuacuuaucuauauaccuagaaaguuaacuuuagaguagucuucacugu

SEQ ID NO: 173334 - RNA, 64 nt, Homo Sapiens
aaaggggaaugguguugaaaagggcauacaaauagaaaguuaauggaagauuacucuuugguca

SEQ ID NO: 173335 - RNA, 64 nt, Homo Sapiens
uuuuaaacaaguucucugauuuuguauguuucuagaaaguuauaaguagcugcucaugugcauc

SEQ ID NO: 173336 - RNA, 64 nt, Homo Sapiens
gcuaaaguagcugcucaugucuugaagagaacaugaaaguuauuuaaaaaucggcgauuuugua

SEQ ID NO: 173337 - RNA, 64 nt, Homo Sapiens
uaaauuuauaaauuuaauaauccaagaagaucuggaaaguuaaauucuacuaccugacauuuau

SEQ ID NO: 173338 - RNA, 64 nt, Homo Sapiens
ugagaaucagagcauauguuaacauauuacuggggaaaguuagucaauuccuauucccaaaaug

SEQ ID NO: 173339 - RNA, 64 nt, Homo Sapiens
accuaaugaggcaucucggaagucaaagaagagggaaaguuaaccuuuucuacugauuucguag

SEQ ID NO: 173340 - RNA, 64 nt, Homo Sapiens
uaggauuagagcuagaauuggguuaggugagaaagaaaguuaagguuaaggcuagaguugucuu

SEQ ID NO: 173341 - RNA, 64 nt, Homo Sapiens
cugugaauugaaaguuuaacaaauaugaaccuuugaaaguuaauaaaaaaaaaaagaacguggg

SEQ ID NO: 173342 - RNA, 64 nt, Homo Sapiens
cuuuucuguuguucuagagcucccuaagcuguuugaaaguuacgaucuacauuucagugcuuuu

SEQ ID NO: 173343 - RNA, 64 nt, Homo Sapiens
acuuuuccuuuaaaaaugguguguuacuccccgugaaaguuauucauaguaaucccaaaggauu

SEQ ID NO: 173344 - RNA, 64 nt, Homo Sapiens
gauuuuagcacuagguaaaacagccuucagaaaugaaaguuaaguugggggagcaaauguuuuu

SEQ ID NO: 173345 - RNA, 64 nt, Homo Sapiens; identical to SEQ ID NO: 109624

SEQ ID NO: 173346 - RNA, 64 nt, Homo Sapiens; identical to SEQ ID NO: 109625

SEQ ID NO: 173347 - RNA, 64 nt, Homo Sapiens; identical to SEQ ID NO: 109626

SEQ ID NO: 173348 - RNA, 64 nt, Homo Sapiens; identical to SEQ ID NO: 109627

SEQ ID NO: 173349 - RNA, 64 nt, Homo Sapiens; identical to SEQ ID NO: 109628

SEQ ID NO: 173350 - RNA, 64 nt, Homo Sapiens; identical to SEQ ID NO: 109629

SEQ ID NO: 173351 - RNA, 64 nt, Homo Sapiens; identical to SEQ ID NO: 109630

SEQ ID NO: 173352 - RNA, 64 nt, Homo Sapiens; identical to SEQ ID NO: 109631

SEQ ID NO: 173353 - RNA, 64 nt, Homo Sapiens; identical to SEQ ID NO: 109632

SEQ ID NO: 173354 - RNA, 64 nt, Homo Sapiens; identical to SEQ ID NO: 109633

SEQ ID NO: 173355 - RNA, 64 nt, Homo Sapiens; identical to SEQ ID NO: 109634

SEQ ID NO: 173356 - RNA, 64 nt, Homo Sapiens; identical to SEQ ID NO: 109635

SEQ ID NO: 173357 - RNA, 64 nt, Homo Sapiens; identical to SEQ ID NO: 109636

SEQ ID NO: 173358 - RNA, 64 nt, Homo Sapiens; identical to SEQ ID NO: 109637

SEQ ID NO: 173359 - RNA, 64 nt, Homo Sapiens
guagauuuuacuuucaacuuucugaauguucaguucuagccaaguuuuccucuggagagacaga

SEQ ID NO: 173360 - RNA, 64 nt, Homo Sapiens
caauugaugaauuguguacaguuaugguuucauuucuagccauagcccugugugucuugguuua

SEQ ID NO: 173361 - RNA, 64 nt, Homo Sapiens
aaagguuuguuucccagauuuguaaugguccugcucuagccauuugcaguuuuguuuuagauga

SEQ ID NO: 173362 - RNA, 64 nt, Homo Sapiens
ggaauggagucuccugucccaaucauuuucaaaaucuagccaggcaaauuucuguuauauuuca

SEQ ID NO: 173363 - RNA, 64 nt, Homo Sapiens
ccuccucugggagggggucccccugccuggccucgcccccgagucucccugcugcuguagagcc

SEQ ID NO: 173364 - RNA, 64 nt, Homo Sapiens
ucccccucguggguggcaggagagcggacuuagagcccccgagggccccucagcagaggaaggg

SEQ ID NO: 173365 - RNA, 64 nt, Homo Sapiens
cagcgcucaaagggaacggaagccuuccccucccgcccccgaucuuguccucuuucccccuucu

SEQ ID NO: 173366 - RNA, 64 nt, Homo Sapiens
uggcaaggacucaggucuaggucccuucccagaagcccccgagccucauuugacuguguggcuc

SEQ ID NO: 173367 - RNA, 54 nt, Homo Sapiens
aaugcugcuccaucaugugagccggcccccgagaccccggcccccaccccacac

SEQ ID NO: 173368 - RNA, 64 nt, Homo Sapiens
gcuauaacccccucugcuucuggugugugacgaggcccccgauguucuugauuuucccagagaa

SEQ ID NO: 173369 - RNA, 64 nt, Homo Sapiens
gucuccggcuuccacccagacggcacucaagccugcccccgaggcgugcuuccuuccugauugu

SEQ ID NO: 173370 - RNA, 64 nt, Homo Sapiens
ucagcuagcuuagagugcguggcacgggccccccgcccccgagaucuggagcccagggacuuuc

SEQ ID NO: 173371 - RNA, 64 nt, Homo Sapiens
gcgcugcccaccccgcugagcuucugcuccggcugcccccgaagcgacccagagccgagcucca

SEQ ID NO: 173372 - RNA, 60 nt, Homo Sapiens
cagagccgagcuccacuucuuuucuaugcagcccccgaccuccucuugcucuugcaguaa

SEQ ID NO: 173373 - RNA, 64 nt, Homo Sapiens; identical to SEQ ID NO: 153164

SEQ ID NO: 173374 - RNA, 64 nt, Homo Sapiens; identical to SEQ ID NO: 153165

SEQ ID NO: 173375 - RNA, 64 nt, Homo Sapiens; identical to SEQ ID NO: 153166

SEQ ID NO: 173376 - RNA, 64 nt, Homo Sapiens; identical to SEQ ID NO: 153167

SEQ ID NO: 173377 - RNA, 63 nt, Homo Sapiens; identical to SEQ ID NO: 153168

SEQ ID NO: 173378 - RNA, 64 nt, Homo Sapiens; identical to SEQ ID NO: 153169

SEQ ID NO: 173379 - RNA, 64 nt, Homo Sapiens; identical to SEQ ID NO: 153170

SEQ ID NO: 173380 - RNA, 64 nt, Homo Sapiens; identical to SEQ ID NO: 153171

SEQ ID NO: 173381 - RNA, 64 nt, Homo Sapiens; identical to SEQ ID NO: 153172

SEQ ID NO: 173382 - RNA, 64 nt, Homo Sapiens; identical to SEQ ID NO: 153173

SEQ ID NO: 173383 - RNA, 64 nt, Homo Sapiens; identical to SEQ ID NO: 153174

SEQ ID NO: 173384 - RNA, 64 nt, Homo Sapiens; identical to SEQ ID NO: 153175

SEQ ID NO: 173385 - RNA, 64 nt, Homo Sapiens; identical to SEQ ID NO: 153176

SEQ ID NO: 173386 - RNA, 64 nt, Homo Sapiens; identical to SEQ ID NO: 153177

SEQ ID NO: 173387 - RNA, 64 nt, Homo Sapiens; identical to SEQ ID NO: 153178

SEQ ID NO: 173388 - RNA, 64 nt, Homo Sapiens; identical to SEQ ID NO: 153179

SEQ ID NO: 173389 - RNA, 64 nt, Homo Sapiens; identical to SEQ ID NO: 153180

SEQ ID NO: 173390 - RNA, 64 nt, Homo Sapiens; identical to SEQ ID NO: 153181

SEQ ID NO: 173391 - RNA, 64 nt, Homo Sapiens; identical to SEQ ID NO: 153182

SEQ ID NO: 173392 - RNA, 64 nt, Homo Sapiens; identical to SEQ ID NO: 153183

SEQ ID NO: 173393 - RNA, 64 nt, Homo Sapiens; identical to SEQ ID NO: 153184

SEQ ID NO: 173394 - RNA, 64 nt, Homo Sapiens; identical to SEQ ID NO: 153185

SEQ ID NO: 173395 - RNA, 64 nt, Homo Sapiens; identical to SEQ ID NO: 153186

SEQ ID NO: 173396 - RNA, 64 nt, Homo Sapiens; identical to SEQ ID NO: 153187

SEQ ID NO: 173397 - RNA, 64 nt, Homo Sapiens; identical to SEQ ID NO: 153188

SEQ ID NO: 173398 - RNA, 64 nt, Homo Sapiens; identical to SEQ ID NO: 153189

SEQ ID NO: 173399 - RNA, 64 nt, Homo Sapiens; identical to SEQ ID NO: 153190

SEQ ID NO: 173400 - RNA, 64 nt, Homo Sapiens; identical to SEQ ID NO: 153191

SEQ ID NO: 173401 - RNA, 64 nt, Homo Sapiens
ucauggagcuuacauucuacagggagaaagagauagccaauacauaggaauaaauauauacaag

SEQ ID NO: 173402 - RNA, 64 nt, Homo Sapiens
gcaguggucaaauaucuagauuuauuuugaaaagagccaauaggauuugcugagaguuugaaug

SEQ ID NO: 173403 - RNA, 64 nt, Homo Sapiens
cuuccaggugcuaccauauggagccuaaggauaaagccaauaccaaagaaaacagugacuaaac

SEQ ID NO: 173404 - RNA, 64 nt, Homo Sapiens
aagcagagcuaccucagaacuuuucagcuaugugagccaauaaacaucugucaaacgaguuaga

SEQ ID NO: 173405 - RNA, 64 nt, Homo Sapiens
acugguaaguuucuuaugcuucacacaacgggugaucucacaaacacaggcagaguaguugauc

SEQ ID NO: 173406 - RNA, 64 nt, Homo Sapiens
acgggugaucucacaaaacuaggcagaguaguugaucucacacaggauuggcauacguguucac

SEQ ID NO: 173407 - RNA, 64 nt, Homo Sapiens
cuccacuucucaaacuuuauuugagauuuauuuuaucucacagguuuguguaauuguuggaaaa

SEQ ID NO: 173408 - RNA, 64 nt, Homo Sapiens
ugcacacagauaacaugcaugcuauuuaugucacaucucacauuaaauuauuuuaaaauaagca

SEQ ID NO: 173409 - RNA, 64 nt, Homo Sapiens
ugauaugguauccuuuugagugagguauauacucaucucacaagugaagugccuacugauauua

SEQ ID NO: 173410 - RNA, 64 nt, Homo Sapiens
gaguucuguuaggaauaaaagaugaaacuauuguaucucacaaaaaaucuuauuucagaaugga

SEQ ID NO: 173411 - RNA, 64 nt, Homo Sapiens; identical to SEQ ID NO: 124393

SEQ ID NO: 173412 - RNA, 64 nt, Homo Sapiens; identical to SEQ ID NO: 124394

SEQ ID NO: 173413 - RNA, 64 nt, Homo Sapiens; identical to SEQ ID NO: 124395

SEQ ID NO: 173414 - RNA, 54 nt, Homo Sapiens; identical to SEQ ID NO: 124396

SEQ ID NO: 173415 - RNA, 64 nt, Homo Sapiens; identical to SEQ ID NO: 124397

SEQ ID NO: 173416 - RNA, 64 nt, Homo Sapiens; identical to SEQ ID NO: 124398

SEQ ID NO: 173417 - RNA, 64 nt, Homo Sapiens; identical to SEQ ID NO: 124399

SEQ ID NO: 173418 - RNA, 64 nt, Homo Sapiens; identical to SEQ ID NO: 124400

SEQ ID NO: 173419 - RNA, 64 nt, Homo Sapiens; identical to SEQ ID NO: 124401

SEQ ID NO: 173420 - RNA, 64 nt, Homo Sapiens
aguuccgauggugcccguggucaaaagcgaaaaacauggacaauuccuauucauucuuagcacu

SEQ ID NO: 173421 - RNA, 64 nt, Homo Sapiens
ugugucaagcccucguuagcugaugagguaaaugcauggacaacuuccuaggacuucucggcuc

SEQ ID NO: 173422 - RNA, 64 nt, Homo Sapiens
cauuuuuuaaaguaccaaagaaaaaguauuauaucauggacauaaugggucagacuuuuggauu

SEQ ID NO: 173423 - RNA, 64 nt, Homo Sapiens
guacugcauugcaccaugaggcacaacuauacuacauggacagaccuguguuaccacgaaugag

SEQ ID NO: 173424 - RNA, 64 nt, Homo Sapiens
caugaguaugagcaaauucccucuuucccugaaucauggacauucuagauuaaaagaacauuuu

SEQ ID NO: 173425 - RNA, 64 nt, Homo Sapiens
aaaaccugaaugugaugugcacauuuucaucccacauggacaauguauguguuuuaauaaaugg

SEQ ID NO: 173426 - RNA, 64 nt, Homo Sapiens
gaucacuuccccaaucaauaaauugugaagauuucauggacacuuaccgcaaucucuaaacaca

SEQ ID NO: 173427 - RNA, 64 nt, Homo Sapiens
uauuaguuccccaaauuaaugauugugaagauuucauggacauuagccauggcagaagaacgug

SEQ ID NO: 173428 - RNA, 64 nt, Homo Sapiens
cuccuccaugccgucuuuccccuuggaggagagccauggacaggaccacacagcccugaccggg

SEQ ID NO: 173429 - RNA, 64 nt, Homo Sapiens
gaaaagcuacgccggcuggcgccccaccuggcggcauggacacagaggagacugagcgucccca

SEQ ID NO: 173430 - RNA, 64 nt, Homo Sapiens
acuaccacaccaggccaauuuuuguuuuuuuuuuuugguagaaacgggucuguuuugcccaggc

SEQ ID NO: 173431 - RNA, 64 nt, Homo Sapiens
gccaccaugcuugacuaauuuuugugauuuuuuuuugguagagaccagggguuucacuauguug

SEQ ID NO: 173432 - RNA, 64 nt, Homo Sapiens
gcaucacagggcuucacugcacacacuguguucagggcaagauuucaucauuuacugacugcau

SEQ ID NO: 173433 - RNA, 64 nt, Homo Sapiens
gagcacaggaguuugaggcugcagugagcagccugggcaagagagugagacuccguuuugugcc

SEQ ID NO: 173434 - RNA, 64 nt, Homo Sapiens
ugucaggauuauaccaagagucuugcuaccaggagggcaagaagaccaaaacagacagacaagu

SEQ ID NO: 173435 - RNA, 64 nt, Homo Sapiens
aaaguguugaaaaacuuaauaacaaaugcuuguugggcaagaaugggauugaggauuaucuucu

SEQ ID NO: 173436 - RNA, 64 nt, Homo Sapiens
auuggaaauccagcugccuaguggccaguggguggggcaagacugucaacgagauuuacagcug

SEQ ID NO: 173437 - RNA, 64 nt, Homo Sapiens
uccucuucccagccucaucccuguuuuucuguuagggcaagacucuuccauaagccugcuaaaa

SEQ ID NO: 173438 - RNA, 64 nt, Homo Sapiens
uuggcauguggauuacaaguccugcuuugacacugggcaagaauuuaagauuguucuaucucua

SEQ ID NO: 173439 - RNA, 64 nt, Homo Sapiens
gccaaacacauuuacccuuuggccccacuuugaagggcaagaaauggcgucugcucugguggcu

SEQ ID NO: 173440 - RNA, 64 nt, Homo Sapiens
auauuaaaacacuuuuuuaaaggacaguugaaaagggcaagaggaaaccagggcaguucuagag

SEQ ID NO: 173441 - RNA, 64 nt, Homo Sapiens
ccccuuauucuuccuugaagugcccgagcauguagggcaagaaggaaggcugaagcgcuguccc

SEQ ID NO: 173442 - RNA, 64 nt, Homo Sapiens
aagaucacacuauugcacuccagccugggcgacagggcaagacucugucucaaaaaaaauaaaa

SEQ ID NO: 173443 - RNA, 64 nt, Homo Sapiens
gggagccucgccuuacaacuaauuccugccuuucguccaguaccaagucccccguugcuucugg

SEQ ID NO: 173444 - RNA, 64 nt, Homo Sapiens
cgacacguccacauauguauuuguguauguuaauguccaguaucacaucacccaugaaagucgu

SEQ ID NO: 173445 - RNA, 64 nt, Homo Sapiens
augaacaccgcgaacagccuucaggcgccagccuguccaguagcccgucucaaguuccgcaucc

SEQ ID NO: 173446 - RNA, 64 nt, Homo Sapiens
aaugucuuccucuuaugaccacugaauucugcuaguccaguagcugcagucugacaagcucauc

SEQ ID NO: 173447 - RNA, 64 nt, Homo Sapiens
ucuucagcgugucugguaccuuggauguucaaacagggaacacugucagggcugaggagaacag

SEQ ID NO: 173448 - RNA, 64 nt, Homo Sapiens
gauccagaacaugacaacagagagcugcguccacagggaacaaagcccugaccucucucuccac

SEQ ID NO: 173449 - RNA, 64 nt, Homo Sapiens
ccaugugauuaauguuuucaggcgugcaguacuaagggaacaauugaaaaaguuccauagaaaa

SEQ ID NO: 173450 - RNA, 64 nt, Homo Sapiens
acuguucuuuugcauuuugccaucagccagcaagagggaacaaacuuugacuucuugcuucagu

SEQ ID NO: 173451 - RNA, 64 nt, Homo Sapiens
gcccuugcaauuuuuaauuaacaagcaaggcccaagggaacacauguccucaaaaguuuuucug

SEQ ID NO: 173452 - RNA, 64 nt, Homo Sapiens
uucuguucacucaacaaugccagaugaauggaagagggaacacacugagaugacuuagacucug

SEQ ID NO: 173453 - RNA, 64 nt, Homo Sapiens
gguuugugaaggaaaaacagcauggcaugacuuaagggaacauuucuuaauggggagacauuau

SEQ ID NO: 173454 - RNA, 64 nt, Homo Sapiens
acuguaaacugucuuccugaugccucaagaacucagggaacaauuucauaaauuuacuugaggu

SEQ ID NO: 173455 - RNA, 64 nt, Homo Sapiens
uauuagguuugaagcaaccuucuuuuagugucacagggaacaguauuauucauaacaaugagug

SEQ ID NO: 173456 - RNA, 64 nt, Homo Sapiens
uccucccaagggccucugccccgccugccaggcaagggaacagggccuguccccagggucugcu

SEQ ID NO: 173457 - RNA, 64 nt, Homo Sapiens
uucauuuuaaaaacccucaacaaauuacacauugagggaacauacuucaauaagaaccaucuau

SEQ ID NO: 173458 - RNA, 64 nt, Homo Sapiens
ggagcuaaacauugauuacacauggacucaaagaagggaacaguagacacgggcuuaugggugg

SEQ ID NO: 173459 - RNA, 64 nt, Homo Sapiens
uguuaaauuauuuuuucuauauagaaauauugugcuuacucaagcuguagaagucugucuuucu

SEQ ID NO: 173460 - RNA, 64 nt, Homo Sapiens
acuaccaccuuuuccuuauauauucuaauaacugcuuacucaacgcauagaggccaagguauuc

SEQ ID NO: 173461 - RNA, 64 nt, Homo Sapiens
uugauaaagaacuacuacaaggaauacaggagaacuuacucaauuaaaaccucucaacacagaa

SEQ ID NO: 173462 - RNA, 64 nt, Homo Sapiens
uuuugcuaugguuugcgugccuaguagaugcagacuuacucagaaagaaaucgauguuaccuug

SEQ ID NO: 173463 - RNA, 64 nt, Homo Sapiens
gguguacguaaaacaugguauuaaccuauuccaccuuacucaagguguuauuaugccacagaca

SEQ ID NO: 173464 - RNA, 64 nt, Homo Sapiens
aucagagaguucauacucaaauacaugcucacaucuuacucaacagacugugaaaaagccauua

SEQ ID NO: 173465 - RNA, 64 nt, Homo Sapiens
aucaaagaauuccuacugguggcagagggcgcaucuuacucaacggaauguaggaaggccuuua

SEQ ID NO: 173466 - RNA, 64 nt, Homo Sapiens
aucaaagaauucauaccaguauaauuauccaacucuuacucaacagaaugugggaagguuuuua

SEQ ID NO: 173467 - RNA, 64 nt, Homo Sapiens
gggagaccagcugggccuccaaguaggauaaccccucacugagcaccacauucucuagcuucuu

SEQ ID NO: 173468 - RNA, 64 nt, Homo Sapiens
cucacucaucccuccuguacccuggccagaacaucucacugauacucgaauucuuuuggcaaac

SEQ ID NO: 173469 - RNA, 64 nt, Homo Sapiens
ccucugccuuccagguucaaugacacaaucucggcucacugaaaucacccagacuggaaugcag

SEQ ID NO: 173470 - RNA, 64 nt, Homo Sapiens
cuuaacuuuucaccagggguuuggcguauuuauacucacugagugaaagaagccacagcucuuc

SEQ ID NO: 173471 - RNA, 64 nt, Homo Sapiens
aaagcugggacuccauccugagaucauaauaauucucacugaccuuaugggauucagaacaaug

SEQ ID NO: 173472 - RNA, 64 nt, Homo Sapiens
aaugagacaauguugaggaccagcccaccauuaacucacugaaccacucauacagccagcccac

SEQ ID NO: 173473 - RNA, 64 nt, Homo Sapiens
uaaagucaugcuuaaguacaaauuccaugaaaagcucacugauccuaauucuuucccuuugagg

SEQ ID NO: 173474 - RNA, 64 nt, Homo Sapiens
uucaagagucagagcagugagcucagaggcccuucucacugagacagcaacauuuaaaccaaac

SEQ ID NO: 173475 - RNA, 64 nt, Homo Sapiens
gcucccccuuacuagauauuaaaguagcuguacacucacugaaucacugaaauugaagaugagg

SEQ ID NO: 173476 - RNA, 64 nt, Homo Sapiens
uugaagaugaggaaaguagcccagugccuguguacucacugaaacccuguuuugaguauggaag

SEQ ID NO: 173477 - RNA, 64 nt, Homo Sapiens
uucugaaaagaugccauuuguuuccuucugaucucucacugaauaauguuuacuguacagucuu

SEQ ID NO: 173478 - RNA, 64 nt, Homo Sapiens
uugaauuucuuugggaagaaaguaaaucugauggcucacugauuuuugaaaagccugaauaaaa

SEQ ID NO: 173479 - RNA, 64 nt, Homo Sapiens
ucauccaugcacagccacuaucauacccuuuauucucacugaaaggcagaacucagaaccuguu

SEQ ID NO: 173480 - RNA, 64 nt, Homo Sapiens
aagugaggggcccuuugcauagcucuccuucccccucacugaagcuggguagccuauugggguu

SEQ ID NO: 173481 - RNA, 64 nt, Homo Sapiens
ucccuugagacuuugggguaguuuggcugccauucucacugacaaaauguauaucagcccccac

SEQ ID NO: 173482 - RNA, 64 nt, Homo Sapiens
cugguggguauuaaauaugcacaauauuccauagcucacugaggauuuuaaaauuauaagcaua

SEQ ID NO: 173483 - RNA, 64 nt, Homo Sapiens
aaccuuucucugccucucccacacucucccagagcucacugauuagacagcacaagggucucag

SEQ ID NO: 173484 - RNA, 64 nt, Homo Sapiens
aagcuacugccuucuagagacaaccggcagugaccucacugaagacaaaaacugcccuagccag

SEQ ID NO: 173485 - RNA, 64 nt, Homo Sapiens
agccacuuuccacaucugcugugggggcugaguccucacugagcugugacccucagucagguug

SEQ ID NO: 173486 - RNA, 64 nt, Homo Sapiens
cugcccugccuccgggccggagcgcucggcccagcucacugaaguccugcccucagcugcgcga

SEQ ID NO: 173487 - RNA, 64 nt, Homo Sapiens
ucccaggguucaagugugugcugauaccaccuaccucacugaagugcccaccugugaaaugggg

SEQ ID NO: 173488 - RNA, 64 nt, Homo Sapiens
cagaggaguugcucagaggcaucucucagaccagcucacugaggugacggcguguguugguccc

SEQ ID NO: 173489 - RNA, 64 nt, Homo Sapiens
ggaagaaccaagcggugccagccacgagacgucaccaagaaaacaugcaacucaaacgacggaa

SEQ ID NO: 173490 - RNA, 64 nt, Homo Sapiens
uccaacucccucugggaaggugaccuggccagagccaagaaacacuuucagaaaaacaaaugug

SEQ ID NO: 173491 - RNA, 64 nt, Homo Sapiens
ucuucagacacauuugguacauccagaaauagauccaagaaauggggugguugaguggguccgc

SEQ ID NO: 173492 - RNA, 64 nt, Homo Sapiens
guuuuaaaggaagaaauauuuucaaauucuuaauccaagaaaauacugaguuggaaucuuagac

SEQ ID NO: 173493 - RNA, 64 nt, Homo Sapiens
ccaggauccugggccacaggcugggaugguccuuccaagaaagggucauuucagacgcagcccu

SEQ ID NO: 173494 - RNA, 64 nt, Homo Sapiens
ggauacagguccugauuugguaggaauauuauucccaagaaauacccgcuccucaccuacuccc

SEQ ID NO: 173495 - RNA, 64 nt, Homo Sapiens
aaacgggagcuauuucacagaacuaaguagggucccaagaaaaacucccaaugggagcccacgg

SEQ ID NO: 173496 - RNA, 64 nt, Homo Sapiens
caacuaaggacucucaaaccuuacuaccuaacgcccaagaaaacugggguuccugguggauuuc

SEQ ID NO: 173497 - RNA, 64 nt, Homo Sapiens
ccacccauagagcucauccuagaacccaggagcuccaagaaaggcauuucaugggggcugaggc

SEQ ID NO: 173498 - RNA, 64 nt, Homo Sapiens
uaggggaagaagccagaaccucuuauaacaccucccaagaaagaguguuacguugaagccagag

SEQ ID NO: 173499 - RNA, 64 nt, Homo Sapiens
caggugcuuuccagacuccauccaggcuccucucccaagaaaucagcccuccucucccaagaaa

SEQ ID NO: 173500 - RNA, 64 nt, Homo Sapiens
caggcuccucucccaagaaaacagcccuccucucccaagaaaucaagaacugauuggggcuucc

SEQ ID NO: 173501 - RNA, 64 nt, Homo Sapiens
cccgggacuuuaccccagcacaucucaaccucacccaagaaaccggguccuacagacaaggugg

SEQ ID NO: 173502 - RNA, 64 nt, Homo Sapiens
augucugcgccucugccaccauacauguaaaauaccaagaaauauaaaguaauauuuuuuagaa

SEQ ID NO: 173503 - RNA, 64 nt, Homo Sapiens
ccaaaggagugcauggccacagccaccuccacccccaagaaaccuccauccugccaggagcagc

SEQ ID NO: 173504 - RNA, 64 nt, Homo Sapiens
ccccaagaaaccuccauccugccaggagcagccuccaagaaacuuuuaaaaaauagauuugcaa

SEQ ID NO: 173505 - RNA, 64 nt, Homo Sapiens
caagucugggcaccgaaagagagcaucaaaaucaccaagaaaaacagcuucucaguuaagugaa

SEQ ID NO: 173506 - RNA, 64 nt, Homo Sapiens
ugaaguaagaaagacagcacgcuuaaaccguagaccaagaaaucaggagaguucaagugaugag

SEQ ID NO: 173507 - RNA, 64 nt, Homo Sapiens
ggugacucacucucaagucauucccaccugcccuccaagaaaauaaaugugauaaugacaugau

SEQ ID NO: 173508 - RNA, 64 nt, Homo Sapiens
uuccucuguggaaaucugucaaaauugguuuauaccaagaaagccucaaagcaucagacauggg

SEQ ID NO: 173509 - RNA, 64 nt, Homo Sapiens
uaagcaaguauuuccugcuguugucuguccgcgcccaagaaagaucccuccccaccucaguguu

SEQ ID NO: 173510 - RNA, 64 nt, Homo Sapiens
augagagagagagaaauuauccuuguauuagcauccaagaaauguuuguuggcauucacugaga

SEQ ID NO: 173511 - RNA, 64 nt, Homo Sapiens
gaguagggaaauauuuguuuaccuugauuuagcuccaagaaauuuuuuacuggaaacauagcaa

SEQ ID NO: 173512 - RNA, 64 nt, Homo Sapiens
cuggguauuguccaagguuugcagggaccucugcccaagaaagcacaaugcacagcagaaagcu

SEQ ID NO: 173513 - RNA, 64 nt, Homo Sapiens
acuuuguaggggaacuuuaguuacaaaacacuuaccaagaaagcaucgagacggccauucuugu

SEQ ID NO: 173514 - RNA, 64 nt, Homo Sapiens
guccuuggcucagagguguugagaauucuuuaggccaagaaacugugcgcaugauucuacauau

SEQ ID NO: 173515 - RNA, 64 nt, Homo Sapiens
aauccuguguuuaucuaacuuuuugauuuguaaaccaagaaauuaugcuuuaauaucacaauaa

SEQ ID NO: 173516 - RNA, 64 nt, Homo Sapiens
gaggaauguuuaauaugaaauuuuucuuuccuucccaagaaacuauguaccucuuuucaugauc

SEQ ID NO: 173517 - RNA, 64 nt, Homo Sapiens
gacaaggaaaacauucguuuuccucaugggucuuccaagaaaugagcuauuuuauugaugccau

SEQ ID NO: 173518 - RNA, 64 nt, Homo Sapiens
uauaugaacacucaaaucuuuuacuguaacgaaaccaagaaacuuguuuagaaugugauaggca

SEQ ID NO: 173519 - RNA, 64 nt, Homo Sapiens
uucaacccaggaagcgucuuuggugcuugggagaccaagaaaccaagaaauuaacaacugaaag

SEQ ID NO: 173520 - RNA, 64 nt, Homo Sapiens
aggaagcgucuuuggugcuugggagaccaagaaaccaagaaauuaacaacugaaagcauuuuaa

SEQ ID NO: 173521 - RNA, 64 nt, Homo Sapiens
gaagggagaggcugugauuuaacuguaaucuuaaccaagaaauuaauguuuagagagcuuggcc

SEQ ID NO: 173522 - RNA, 64 nt, Homo Sapiens
ccaucuccaaauuguguaugagaaccacagcuacccaagaaaacauuuuaacagauuucagauc

SEQ ID NO: 173523 - RNA, 64 nt, Homo Sapiens
auauauuaaaaagauauuuguuauuauugucaucccaagaaaaauuaauacuaucauaguaaua

SEQ ID NO: 173524 - RNA, 64 nt, Homo Sapiens
agauauuuuaaaaauuuauucuauuauugucaucccaagaaaaauuaauacuaucauguuaaua

SEQ ID NO: 173525 - RNA, 64 nt, Homo Sapiens
uuccauuggggggugggggugagagcugaggcauccaagaaauggcugcuggcuggcccaagca

SEQ ID NO: 173526 - RNA, 64 nt, Homo Sapiens
cucuguacugugugcggaccgugaaugugugaaaccaagaaacauaacaauagcaauaguucua

SEQ ID NO: 173527 - RNA, 64 nt, Homo Sapiens
cuaacuuucagguaaccagacccaucucaaagaaccaagaaaaggcuuuagcaugaaauaucuu

SEQ ID NO: 173528 - RNA, 64 nt, Homo Sapiens
acuguuguauaucauauuguaaaguaucauacugccaagaaaauaacuccuagaaaggcauuau

SEQ ID NO: 173529 - RNA, 64 nt, Homo Sapiens
acuucugucuugauggucuaggaaaacaaagucuccaagaaaacaccauuauuuacagaugcau

SEQ ID NO: 173530 - RNA, 64 nt, Homo Sapiens
cuacuauuaaacugcaucaagguugaaucagaaaccaagaaacagguagaguucuuucaucuau

SEQ ID NO: 173531 - RNA, 64 nt, Homo Sapiens
uccaugagaucagugcuucaugggucgauucuaaccaagaaaagggcuuuugaucuuaagcuua

SEQ ID NO: 173532 - RNA, 64 nt, Homo Sapiens
ugaauuauuugacugugagaccuguucuuucuuuccaagaaauguuugauggacacaacugaua

SEQ ID NO: 173533 - RNA, 64 nt, Homo Sapiens; identical to SEQ ID NO: 95336

SEQ ID NO: 173534 - RNA, 64 nt, Homo Sapiens; identical to SEQ ID NO: 95337

SEQ ID NO: 173535 - RNA, 64 nt, Homo Sapiens; identical to SEQ ID NO: 95338

SEQ ID NO: 173536 - RNA, 64 nt, Homo Sapiens; identical to SEQ ID NO: 95339

SEQ ID NO: 173537 - RNA, 64 nt, Homo Sapiens; identical to SEQ ID NO: 95340

SEQ ID NO: 173538 - RNA, 64 nt, Homo Sapiens; identical to SEQ ID NO: 95341

SEQ ID NO: 173539 - RNA, 64 nt, Homo Sapiens; identical to SEQ ID NO: 95342

SEQ ID NO: 173540 - RNA, 64 nt, Homo Sapiens; identical to SEQ ID NO: 95343

SEQ ID NO: 173541 - RNA, 64 nt, Homo Sapiens; identical to SEQ ID NO: 95344

SEQ ID NO: 173542 - RNA, 64 nt, Homo Sapiens; identical to SEQ ID NO: 95345

SEQ ID NO: 173543 - RNA, 64 nt, Homo Sapiens; identical to SEQ ID NO: 95346

SEQ ID NO: 173544 - RNA, 64 nt, Homo Sapiens; identical to SEQ ID NO: 95347

SEQ ID NO: 173545 - RNA, 64 nt, Homo Sapiens; identical to SEQ ID NO: 95348

SEQ ID NO: 173546 - RNA, 64 nt, Homo Sapiens; identical to SEQ ID NO: 95349

SEQ ID NO: 173547 - RNA, 64 nt, Homo Sapiens; identical to SEQ ID NO: 95350

SEQ ID NO: 173548 - RNA, 64 nt, Homo Sapiens; identical to SEQ ID NO: 95351

SEQ ID NO: 173549 - RNA, 64 nt, Homo Sapiens; identical to SEQ ID NO: 95352

SEQ ID NO: 173550 - RNA, 64 nt, Homo Sapiens; identical to SEQ ID NO: 95353

SEQ ID NO: 173551 - RNA, 64 nt, Homo Sapiens; identical to SEQ ID NO: 95354

SEQ ID NO: 173552 - RNA, 64 nt, Homo Sapiens; identical to SEQ ID NO: 95355

SEQ ID NO: 173553 - RNA, 64 nt, Homo Sapiens; identical to SEQ ID NO: 95356

SEQ ID NO: 173554 - RNA, 64 nt, Homo Sapiens; identical to SEQ ID NO: 95357

SEQ ID NO: 173555 - RNA, 64 nt, Homo Sapiens; identical to SEQ ID NO: 95358

SEQ ID NO: 173556 - RNA, 64 nt, Homo Sapiens; identical to SEQ ID NO: 95359

SEQ ID NO: 173557 - RNA, 64 nt, Homo Sapiens; identical to SEQ ID NO: 95360

SEQ ID NO: 173558 - RNA, 64 nt, Homo Sapiens; identical to SEQ ID NO: 95361

SEQ ID NO: 173559 - RNA, 64 nt, Homo Sapiens; identical to SEQ ID NO: 95362

SEQ ID NO: 173560 - RNA, 64 nt, Homo Sapiens; identical to SEQ ID NO: 95363

SEQ ID NO: 173561 - RNA, 64 nt, Homo Sapiens; identical to SEQ ID NO: 95364

SEQ ID NO: 173562 - RNA, 64 nt, Homo Sapiens; identical to SEQ ID NO: 95365

SEQ ID NO: 173563 - RNA, 64 nt, Homo Sapiens; identical to SEQ ID NO: 95366

SEQ ID NO: 173564 - RNA, 64 nt, Homo Sapiens; identical to SEQ ID NO: 95367

SEQ ID NO: 173565 - RNA, 64 nt, Homo Sapiens; identical to SEQ ID NO: 95368

SEQ ID NO: 173566 - RNA, 64 nt, Homo Sapiens; identical to SEQ ID NO: 95369

SEQ ID NO: 173567 - RNA, 64 nt, Homo Sapiens; identical to SEQ ID NO: 95370

SEQ ID NO: 173568 - RNA, 64 nt, Homo Sapiens; identical to SEQ ID NO: 95371

SEQ ID NO: 173569 - RNA, 64 nt, Homo Sapiens; identical to SEQ ID NO: 95372

SEQ ID NO: 173570 - RNA, 64 nt, Homo Sapiens; identical to SEQ ID NO: 95373

SEQ ID NO: 173571 - RNA, 64 nt, Homo Sapiens; identical to SEQ ID NO: 95374

SEQ ID NO: 173572 - RNA, 64 nt, Homo Sapiens; identical to SEQ ID NO: 95375

SEQ ID NO: 173573 - RNA, 64 nt, Homo Sapiens; identical to SEQ ID NO: 95376

SEQ ID NO: 173574 - RNA, 64 nt, Homo Sapiens; identical to SEQ ID NO: 95377

SEQ ID NO: 173575 - RNA, 64 nt, Homo Sapiens; identical to SEQ ID NO: 95378

SEQ ID NO: 173576 - RNA, 64 nt, Homo Sapiens; identical to SEQ ID NO: 95379

SEQ ID NO: 173577 - RNA, 64 nt, Homo Sapiens; identical to SEQ ID NO: 95380

SEQ ID NO: 173578 - RNA, 64 nt, Homo Sapiens; identical to SEQ ID NO: 95381

SEQ ID NO: 173579 - RNA, 64 nt, Homo Sapiens; identical to SEQ ID NO: 95382

SEQ ID NO: 173580 - RNA, 64 nt, Homo Sapiens; identical to SEQ ID NO: 95383

SEQ ID NO: 173581 - RNA, 64 nt, Homo Sapiens; identical to SEQ ID NO: 95384

SEQ ID NO: 173582 - RNA, 64 nt, Homo Sapiens; identical to SEQ ID NO: 95385

SEQ ID NO: 173583 - RNA, 64 nt, Homo Sapiens; identical to SEQ ID NO: 95386

SEQ ID NO: 173584 - RNA, 64 nt, Homo Sapiens; identical to SEQ ID NO: 95387

SEQ ID NO: 173585 - RNA, 64 nt, Homo Sapiens; identical to SEQ ID NO: 95388

SEQ ID NO: 173586 - RNA, 64 nt, Homo Sapiens; identical to SEQ ID NO: 95389

SEQ ID NO: 173587 - RNA, 64 nt, Homo Sapiens; identical to SEQ ID NO: 95390

SEQ ID NO: 173588 - RNA, 64 nt, Homo Sapiens; identical to SEQ ID NO: 95391

SEQ ID NO: 173589 - RNA, 64 nt, Homo Sapiens; identical to SEQ ID NO: 95392

SEQ ID NO: 173590 - RNA, 64 nt, Homo Sapiens; identical to SEQ ID NO: 95393

SEQ ID NO: 173591 - RNA, 64 nt, Homo Sapiens; identical to SEQ ID NO: 95394

SEQ ID NO: 173592 - RNA, 64 nt, Homo Sapiens; identical to SEQ ID NO: 95395

SEQ ID NO: 173593 - RNA, 64 nt, Homo Sapiens; identical to SEQ ID NO: 95396

SEQ ID NO: 173594 - RNA, 64 nt, Homo Sapiens; identical to SEQ ID NO: 95397

SEQ ID NO: 173595 - RNA, 64 nt, Homo Sapiens; identical to SEQ ID NO: 95398

SEQ ID NO: 173596 - RNA, 64 nt, Homo Sapiens; identical to SEQ ID NO: 95399

SEQ ID NO: 173597 - RNA, 64 nt, Homo Sapiens; identical to SEQ ID NO: 95400

SEQ ID NO: 173598 - RNA, 64 nt, Homo Sapiens; identical to SEQ ID NO: 95401

SEQ ID NO: 173599 - RNA, 64 nt, Homo Sapiens; identical to SEQ ID NO: 95402

SEQ ID NO: 173600 - RNA, 64 nt, Homo Sapiens; identical to SEQ ID NO: 95403

SEQ ID NO: 173601 - RNA, 64 nt, Homo Sapiens; identical to SEQ ID NO: 95404

SEQ ID NO: 173602 - RNA, 64 nt, Homo Sapiens; identical to SEQ ID NO: 95405

SEQ ID NO: 173603 - RNA, 64 nt, Homo Sapiens; identical to SEQ ID NO: 95406

SEQ ID NO: 173604 - RNA, 64 nt, Homo Sapiens; identical to SEQ ID NO: 95407

SEQ ID NO: 173605 - RNA, 64 nt, Homo Sapiens; identical to SEQ ID NO: 95408

SEQ ID NO: 173606 - RNA, 64 nt, Homo Sapiens; identical to SEQ ID NO: 95409

SEQ ID NO: 173607 - RNA, 64 nt, Homo Sapiens; identical to SEQ ID NO: 95410

SEQ ID NO: 173608 - RNA, 64 nt, Homo Sapiens; identical to SEQ ID NO: 95411

SEQ ID NO: 173609 - RNA, 64 nt, Homo Sapiens; identical to SEQ ID NO: 95412

SEQ ID NO: 173610 - RNA, 64 nt, Homo Sapiens; identical to SEQ ID NO: 95413

SEQ ID NO: 173611 - RNA, 64 nt, Homo Sapiens; identical to SEQ ID NO: 95414

SEQ ID NO: 173612 - RNA, 64 nt, Homo Sapiens; identical to SEQ ID NO: 95415

SEQ ID NO: 173613 - RNA, 64 nt, Homo Sapiens; identical to SEQ ID NO: 95416

SEQ ID NO: 173614 - RNA, 64 nt, Homo Sapiens; identical to SEQ ID NO: 95417

SEQ ID NO: 173615 - RNA, 64 nt, Homo Sapiens; identical to SEQ ID NO: 95418

SEQ ID NO: 173616 - RNA, 64 nt, Homo Sapiens; identical to SEQ ID NO: 95419

SEQ ID NO: 173617 - RNA, 64 nt, Homo Sapiens; identical to SEQ ID NO: 95420

SEQ ID NO: 173618 - RNA, 64 nt, Homo Sapiens; identical to SEQ ID NO: 95421

SEQ ID NO: 173619 - RNA, 64 nt, Homo Sapiens; identical to SEQ ID NO: 95422

SEQ ID NO: 173620 - RNA, 64 nt, Homo Sapiens; identical to SEQ ID NO: 95423

SEQ ID NO: 173621 - RNA, 64 nt, Homo Sapiens; identical to SEQ ID NO: 95424

SEQ ID NO: 173622 - RNA, 64 nt, Homo Sapiens; identical to SEQ ID NO: 95425

SEQ ID NO: 173623 - RNA, 64 nt, Homo Sapiens; identical to SEQ ID NO: 95426

SEQ ID NO: 173624 - RNA, 64 nt, Homo Sapiens; identical to SEQ ID NO: 95427

SEQ ID NO: 173625 - RNA, 64 nt, Homo Sapiens; identical to SEQ ID NO: 95428

SEQ ID NO: 173626 - RNA, 64 nt, Homo Sapiens; identical to SEQ ID NO: 95429

SEQ ID NO: 173627 - RNA, 64 nt, Homo Sapiens; identical to SEQ ID NO: 95430

SEQ ID NO: 173628 - RNA, 64 nt, Homo Sapiens; identical to SEQ ID NO: 95431

SEQ ID NO: 173629 - RNA, 64 nt, Homo Sapiens; identical to SEQ ID NO: 95432

SEQ ID NO: 173630 - RNA, 64 nt, Homo Sapiens; identical to SEQ ID NO: 95433

SEQ ID NO: 173631 - RNA, 64 nt, Homo Sapiens; identical to SEQ ID NO: 95434

SEQ ID NO: 173632 - RNA, 64 nt, Homo Sapiens; identical to SEQ ID NO: 95435

SEQ ID NO: 173633 - RNA, 64 nt, Homo Sapiens; identical to SEQ ID NO: 95436

SEQ ID NO: 173634 - RNA, 64 nt, Homo Sapiens; identical to SEQ ID NO: 95437

SEQ ID NO: 173635 - RNA, 64 nt, Homo Sapiens; identical to SEQ ID NO: 95438

SEQ ID NO: 173636 - RNA, 64 nt, Homo Sapiens; identical to SEQ ID NO: 95439

SEQ ID NO: 173637 - RNA, 64 nt, Homo Sapiens; identical to SEQ ID NO: 95440

SEQ ID NO: 173638 - RNA, 63 nt, Homo Sapiens
ccaccuaccaccagaggccugcagccucccacaugccuuaaggggaccguggcccccaccagg

SEQ ID NO: 173639 - RNA, 63 nt, Homo Sapiens
cagagguggcagggauggcuccgaagccagaaaugccuuaaacugcaacgucccgucccuucc

SEQ ID NO: 173640 - RNA, 63 nt, Homo Sapiens
ggacagagucucucauggaugccggcacaaaacugccuuaaaauauucauaguuaauacaggu

SEQ ID NO: 173641 - RNA, 63 nt, Homo Sapiens
caucuuugcuacuuuccuagagaacccggcuguugccuuaaaugugugagagggacuuggcca

SEQ ID NO: 173642 - RNA, 63 nt, Homo Sapiens
agaaucacaaaagaagugaaaagggccgguuccugccuuaacugaugacauuccaccauugug

SEQ ID NO: 173643 - RNA, 63 nt, Homo Sapiens
cacuuaccuuauuuaaaauaaaucaauaaagcuugccuuaaauuauuuuuauaugacuguugg

SEQ ID NO: 173644 - RNA, 63 nt, Homo Sapiens
gguuauuauggaugauaguuauagcccuuauaaugccuuaacuaaggaagaaaagauguuauu

SEQ ID NO: 173645 - RNA, 63 nt, Homo Sapiens
ggcuucaccauacuguaagcauuuuagguagauugccuuaaagguuaugggagggcaugaggg

SEQ ID NO: 173646 - RNA, 63 nt, Homo Sapiens
uuucuucugguguauuuugcacagacaagcaucugccuuaaaauauauacacuuguacaaaaa

SEQ ID NO: 173647 - RNA, 63 nt, Homo Sapiens
uuuuuuuuuuccuuucaacuuaguugacauacgugccuuaaaaaggaaaacuaguguugcuau

SEQ ID NO: 173648 - RNA, 63 nt, Homo Sapiens
cugacaaauaaauaugucauccugaauuaauaaugccuuaauaaaaguacauccuccugcuaa

SEQ ID NO: 173649 - RNA, 63 nt, Homo Sapiens
acuggaaguuuuucaugauaacuuauuuuaagaugccuuaaaaaucuuaaagucacaaaagga

SEQ ID NO: 173650 - RNA, 63 nt, Homo Sapiens
uuucucucauuucccauggaaggacuucggaaaugccuuaaguuccccucuuuauccugccca

SEQ ID NO: 173651 - RNA, 63 nt, Homo Sapiens
aauuuuggagguuggggugcaaucuuuagaauaugccuuaaaaggccgggcgcgguggcucac

SEQ ID NO: 173652 - RNA, 63 nt, Homo Sapiens
gauaugaauaugccuuauaugcugauaugaauaugccuuaaaauaaaguguuccccaccccug

SEQ ID NO: 173653 - RNA, 63 nt, Homo Sapiens
uuccuuuucccugcuuccaggaaacuccacaucugccuuaaaaccaaagagggcuuccucuag

SEQ ID NO: 173654 - RNA, 63 nt, Homo Sapiens
ugcccugccccucuggccacugcugcagacaccugccuuaacacacacaccucuaggacucca

SEQ ID NO: 173655 - RNA, 63 nt, Homo Sapiens
cuuaacacacacaccucuaggacuccacaguuuugccuuaaaggaccuucccaagucucccuu

SEQ ID NO: 173656 - RNA, 63 nt, Homo Sapiens
aaacauuccuuucaccaucauuuagaaaugguuugccuuaauggagacaauagcagauccugu

SEQ ID NO: 173657 - RNA, 63 nt, Homo Sapiens
ugaguucuaaaaggcaugcccacaucucuuucgugccuuaaggauagugagaugcacacuuau

SEQ ID NO: 173658 - RNA, 63 nt, Homo Sapiens
aguucccugcugaagccccuagcacacacugcaugccuuaacaagugugugcaagccccucag

SEQ ID NO: 173659 - RNA, 63 nt, Homo Sapiens
ucaaaaacagagcccauucuuaagaucacuuggugccuuaaagacacgcauuccaaaguggaa

SEQ ID NO: 173660 - RNA, 63 nt, Homo Sapiens
aagaauguggauacucuuaggcgugaauguaaaugccuuaauauugaagguccugguuagaag

SEQ ID NO: 173661 - RNA, 63 nt, Homo Sapiens
ggaccuuuuauaugugccuucacuuuagcuguuugccuuaaucucuacagccuugcucuccgg

SEQ ID NO: 173662 - RNA, 63 nt, Homo Sapiens
aggcuguguguccaaggauggugcugaaaucacugccuuaaggucucugcugugcagaaugag

SEQ ID NO: 173663 - RNA, 63 nt, Homo Sapiens
auuuaaauuggaucuugaaagaugaauaaggccugccuuaaguucugcuaaaggccauguugu

SEQ ID NO: 173664 - RNA, 63 nt, Homo Sapiens
agcccccgcccagcucaucagucugaauggaguugccuuaaauuggcaggugguaccguacuc

SEQ ID NO: 173665 - RNA, 63 nt, Homo Sapiens
cucugauuuugugcuacuccuuuguaaagucacugccuuaagggggcugauggcgccaccugu

SEQ ID NO: 173666 - RNA, 63 nt, Homo Sapiens
ucuugaugauccucaaggaaauacaaccuagggugccuuaaaaauaacaacaacaaaaaaccu

SEQ ID NO: 173667 - RNA, 63 nt, Homo Sapiens
aaccaagucauuacaugucaaauucaauuuuucugccuuaagaaugaauguccuucauaaaau

SEQ ID NO: 173668 - RNA, 63 nt, Homo Sapiens
ugucccaggaccccugacaguggcguggcugguugccuuaauaagucccuugugcuggccaga

SEQ ID NO: 173669 - RNA, 63 nt, Homo Sapiens
uuaguuuguucacagggaggcucauuccauuucugccuuaacuuuuuuuucuuucauuuuucu

SEQ ID NO: 173670 - RNA, 63 nt, Homo Sapiens
ucucucuaccacacugccuucaaauuuaaaucuugccuuaaauaaagguucaagcaccuuuuc

SEQ ID NO: 173671 - RNA, 63 nt, Homo Sapiens
cuuuccucuguugcugaccauaaugccucuuacugccuuaagucagcacuauggugcucucug

SEQ ID NO: 173672 - RNA, 63 nt, Homo Sapiens
uaauuaugugaggccacuugucagcucaagagaugccuuaagaaauuaccagccccaccuguu

SEQ ID NO: 173673 - RNA, 63 nt, Homo Sapiens
cuugggagaggagcacucagauuucccccucccugccuuaaaagcuaaaagggcuguacaguu

SEQ ID NO: 173674 - RNA, 63 nt, Homo Sapiens
auuauccccaauugcuucagucagauuugguuuugccuuaaauuaaaauauguguauauuuua

SEQ ID NO: 173675 - RNA, 63 nt, Homo Sapiens
auaucccauauauuuaauaugccuuacuucucuugccuuaaauaaagggcacucauuuggauu

SEQ ID NO: 173676 - RNA, 63 nt, Homo Sapiens
accuauagcaagcuguuucugacuccuggcauuugccuuaagggacuguucuacaguuucuuu

SEQ ID NO: 173677 - RNA, 63 nt, Homo Sapiens
uuuagucuuuagaacucuagagauuauaauaugugccuuaaguagcuuuuaauagugucauaa

SEQ ID NO: 173678 - RNA, 63 nt, Homo Sapiens
cgccccucggggcucccccacuuccagccaagcugccuuaacuggacucccacuccccgcucc

SEQ ID NO: 173679 - RNA, 63 nt, Homo Sapiens
uauuugugaaguuaaaauuuuuagaggugaccuugccuuaauacaggaauacauauucacugc

SEQ ID NO: 173680 - RNA, 63 nt, Homo Sapiens
cuuaaagauuguaugcauauaaaauugggagcaugccuuaaaagaauuuauaacagguuagcu

SEQ ID NO: 173681 - RNA, 63 nt, Homo Sapiens
agagucaggagaccccaagggaugccucuucugugccuuaagcccacuccacuuuccuccaca

SEQ ID NO: 173682 - RNA, 63 nt, Homo Sapiens
uauguuuuauggagauuauaauguugcuuuacaugccuuaauauuucauaaagcuggcucuuu

SEQ ID NO: 173683 - RNA, 63 nt, Homo Sapiens
auauuacuauauauuuucccaaaguuugccaugugccuuaaacuuucuugcaauuuaaugcca

SEQ ID NO: 173684 - RNA, 63 nt, Homo Sapiens
uauaccaaagauuacuaauugauuuuuuugaugugccuuaaauucagauauuugagaauaggg

SEQ ID NO: 173685 - RNA, 63 nt, Homo Sapiens
uuuguaccaaaacaguccuucaacuuugcacugugccuuaaguaauuacuaacaaaagguacu

SEQ ID NO: 173686 - RNA, 63 nt, Homo Sapiens
cccaguuuuuguggcucaaggcuggaauauuuaugccuuaauauaucuauggcagacauuuaa

SEQ ID NO: 173687 - RNA, 63 nt, Homo Sapiens
augucaaaaaaaaaaaaaaaaaaaaaaaaguccugccuuaacuaacuccucugcgcuuguuca

SEQ ID NO: 173688 - RNA, 63 nt, Homo Sapiens
auaaauguacuacauuugcaugccuuuuggguuugccuuaauucuuaccucauuugcauccua

SEQ ID NO: 173689 - RNA, 63 nt, Homo Sapiens
auguuugagucucuuaacugauggaugcccacuugccuuaaagcagcauacuuauuuuuuguu

SEQ ID NO: 173690 - RNA, 63 nt, Homo Sapiens
acaguauuacagcuuugcauuuggggguuuuacugccuuaacuuucaaugcuuguuaugggaa

SEQ ID NO: 173691 - RNA, 63 nt, Homo Sapiens
cugcucaucugacuguuuuguacaugugacaauugccuuaaaaccuagcacaguccucagaaa

SEQ ID NO: 173692 - RNA, 63 nt, Homo Sapiens
cccgcagaccugccuccagagcaaggagaauucugccuuaaucuguugggcuccagucuccgg

SEQ ID NO: 173693 - RNA, 63 nt, Homo Sapiens
cagccaagguggacguaccucuccaggagccuuugccuuaauguaucucugccuggacaacuu

SEQ ID NO: 173694 - RNA, 63 nt, Homo Sapiens
cucgggagacuuuucugugcuccuuucuacacaugccuuaaaccuuccuuccuguggggugcc

SEQ ID NO: 173695 - RNA, 63 nt, Homo Sapiens
uuaguguuuuaaaacaccucugcuuucugauguugccuuaauauucugcuauugcagcaauua

SEQ ID NO: 173696 - RNA, 63 nt, Homo Sapiens
ggugguuugcuuucuuuaccauaagcaaucccuugccuuaacucaucacccuuuuucacuaug

SEQ ID NO: 173697 - RNA, 63 nt, Homo Sapiens
aaguaaugcuuuuccugagcuggaucccaguguugccuuaacagggugucugucgugccgcag

SEQ ID NO: 173698 - RNA, 63 nt, Homo Sapiens
gaaggcuaugacucccaagaggcagugaaccauugccuuaaauuaauagcagccucucaaguc

SEQ ID NO: 173699 - RNA, 63 nt, Homo Sapiens
cuauauggcaccuaauuauuuuuucuuuuaaaaugccuuaaguugcagucucauuuugauaau

SEQ ID NO: 173700 - RNA, 63 nt, Homo Sapiens
ucagaaccuguuccaucuguaugccauuguucaugccuuaagaaaugcaaagauguacaauaa

SEQ ID NO: 173701 - RNA, 63 nt, Homo Sapiens
aguuaauaauuuuuaaauuuuuuucuaauuuuaugccuuaaaauagguuucugauuacauaaa

SEQ ID NO: 173702 - RNA, 63 nt, Homo Sapiens
gauaacuaaacuucauuucaguuuacuuuguuaugccuuaauauucugugucuuuugcaauua

SEQ ID NO: 173703 - RNA, 63 nt, Homo Sapiens
cccugcaucauccaagcaaugaccucagacuucugccuuaaccagccccggggcuuggcuccc

SEQ ID NO: 173704 - RNA, 63 nt, Homo Sapiens
ggccccagcagcccuauggugaccgccacacugugccuuaaugucugccgggggcccaggcug

SEQ ID NO: 173705 - RNA, 63 nt, Homo Sapiens
uuauacucauggcuuggaguaaaauaaaguaacugccuuaauccuuaugccacuuccuuguuc

SEQ ID NO: 173706 - RNA, 63 nt, Homo Sapiens
uuuuaaugaaaugcaaauuuuacuuuuacuuuuugccuuaaauuuugaccuauguauggaacu

SEQ ID NO: 173707 - RNA, 63 nt, Homo Sapiens
ccucuauuuccuaaaauauucaaaugaaugucuugccuuaaacuagagagaaauuaacuuuuc

SEQ ID NO: 173708 - RNA, 63 nt, Homo Sapiens
uaauuuuuuucaaagucucauacccauuuugaaugccuuaauuugcuucaugauaggcaacuu

SEQ ID NO: 173709 - RNA, 63 nt, Homo Sapiens
gucccagguauugagaauaaauucauuauugaaugccuuaaaucaaaauaaggcacagcuuua

SEQ ID NO: 173710 - RNA, 63 nt, Homo Sapiens
ggaaugcauauggauaaaguuggacaaugaaaaugccuuaaaagauguacauguugagauauu

SEQ ID NO: 173711 - RNA, 63 nt, Homo Sapiens
cccugacaguucaucuuccuagguggcacuguuugccuuaauauugaauaaagcuucgcuucu

SEQ ID NO: 173712 - RNA, 63 nt, Homo Sapiens
gaugacauuccaccauugugaauagccaguuccugccuuaacuagauccacaaaagaagugaa

SEQ ID NO: 173713 - RNA, 63 nt, Homo Sapiens
agcuauucacuaauaacauaaauguuucuucucugccuuaaagcaacagcaccggauccacag

SEQ ID NO: 173714 - RNA, 63 nt, Homo Sapiens
gagccauuuauuuuuagagauuugauggcaugcugccuuaaaaucccauuagagguacuuuuu

SEQ ID NO: 173715 - RNA, 63 nt, Homo Sapiens
cuuuugaugcuguagcuguuaugaauuccaauuugccuuaacugaagugucuuauccuuuucu

SEQ ID NO: 173716 - RNA, 63 nt, Homo Sapiens
guugaauaugcugcuuuagauugaucuuuuuuuugccuuaagauuauaauuuauaguaauuuu

SEQ ID NO: 173717 - RNA, 63 nt, Homo Sapiens
cauacucugccgaucuaauuagaaagcuagauaugccuuaaaagagagguuucugguauucac

SEQ ID NO: 173718 - RNA, 63 nt, Homo Sapiens
guuuauaugcacuuucauggcaagaugguacuuugccuuaaccaguuugcaacaugucuguac

SEQ ID NO: 173719 - RNA, 63 nt, Homo Sapiens
gagcuccaguccuacucuuguuuucugaaagauugccuuaagaaucacagaagaugcaacauc

SEQ ID NO: 173720 - RNA, 63 nt, Homo Sapiens
aaagaauuuaaaaaaguuguccguugggaccaaugccuuaauuaaucccuuaaucuaugugca

SEQ ID NO: 173721 - RNA, 63 nt, Homo Sapiens
aaaaacaaacagcaggaaucgucugaggaacaaugccuuaagauuguggcuggguuuucugaa

SEQ ID NO: 173722 - RNA, 63 nt, Homo Sapiens
agucucacaagaccuauaggaaaguuuaccaucugccuuaaauauuaaaauauccaucuguua

SEQ ID NO: 173723 - RNA, 63 nt, Homo Sapiens
uuccacaggcuacaagcccugggaccaucuuucugccuuaagggcaggagcccacuucugugg

SEQ ID NO: 173724 - RNA, 63 nt, Homo Sapiens
aauauguagguaagguuuaucuugaaucuuaauugccuuaauuuuaaggacgucaaaggcucu

SEQ ID NO: 173725 - RNA, 63 nt, Homo Sapiens
aucccuucuacuucacuccucaggggagugaagugccuuaagaaacaaagcccuguccuaauu

SEQ ID NO: 173726 - RNA, 63 nt, Homo Sapiens
uuauuuggaaaaguagucauuaaaugaacccacugccuuaaaugucuugaauguugcagucaa

SEQ ID NO: 173727 - RNA, 63 nt, Homo Sapiens
caauguccuaacugaaagaugaucauuuguaguugccuuaaaauaaugaauacauuuccaaaa

SEQ ID NO: 173728 - RNA, 63 nt, Homo Sapiens
caagugaagaguuugccuguacucuuaucugggugccuuaaggagagagauuguguucuuccu

SEQ ID NO: 173729 - RNA, 63 nt, Homo Sapiens
ggccuguggucagcagcuacugaugguuuuuucugccuuaaaccguguguguguccaucauca

SEQ ID NO: 173730 - RNA, 63 nt, Homo Sapiens
uuccauuuuauaaauguauugauucauugguacugccuuaaagauacaguaccccucuagcuu

SEQ ID NO: 173731 - RNA, 63 nt, Homo Sapiens
aaguggcauaaagcauauccauucagaaugaagugccuuaaauauagcaguagucuuuuuugg

SEQ ID NO: 173732 - RNA, 63 nt, Homo Sapiens
aaguccaauaagacacucaaauaugaguacaaaugccuuaaaauggaauugaaaaacucuuua

SEQ ID NO: 173733 - RNA, 63 nt, Homo Sapiens
cagcucaacaacuagaaaaauaaacuguuuaccugccuuaauuauuuaucuuuaguuccuuau

SEQ ID NO: 173734 - RNA, 63 nt, Homo Sapiens
ggcuuggagggaaauacauuuuaggaggaguuuugccuuaauuuuuuaaguacugcaccaaaa

SEQ ID NO: 173735 - RNA, 63 nt, Homo Sapiens
uucuacagaugaaucuguaagccaguuacaguuugccuuaacucauagacaucaaucagagag

SEQ ID NO: 173736 - RNA, 63 nt, Homo Sapiens
cacagguuucuuuaaagcuguguuaacauaucuugccuuaaaauguguguguguguuuuugcu

SEQ ID NO: 173737 - RNA, 63 nt, Homo Sapiens
uuuggguggaugaguuuuauuuucuuuuaaagcugccuuaauuccauuuuuauuuugcauuuu

SEQ ID NO: 173738 - RNA, 63 nt, Homo Sapiens
cuuaacuucuccccauuucccccaucuuuugguugccuuaaaagaaaucucuagcucagauaa

SEQ ID NO: 173739 - RNA, 63 nt, Homo Sapiens
uuaagcuuuagaauaaugcgcaauuucauguuaugccuuaaguccaaaaagguaaacuuugaa

SEQ ID NO: 173740 - RNA, 63 nt, Homo Sapiens
agaagaaaaguauuuaaaagaaauaccagugagugccuuaaaguuggagaaguaacugcccau

SEQ ID NO: 173741 - RNA, 63 nt, Homo Sapiens
ugaucggagaugcuuuguaacagauugaucaucugccuuaacgaggaguuacagaugcagcca

SEQ ID NO: 173742 - RNA, 63 nt, Homo Sapiens
aaguguauguaagcaguaguuuuuaaauaaaguugccuuaaauaauuuacuacauauauugau

SEQ ID NO: 173743 - RNA, 63 nt, Homo Sapiens
uacccccuuuuuuguuugugauauauauggcuuugccuuaauauugucuauacauauauauau

SEQ ID NO: 173744 - RNA, 63 nt, Homo Sapiens
ugagcucguauuuaccccugcaagccacaaaaaugccuuaauuuagaaugccauuccagagga

SEQ ID NO: 173745 - RNA, 63 nt, Homo Sapiens
cuaccucccacacucccaagccugggacuuccaugccuuaaacugugacauuuggagaggggg

SEQ ID NO: 173746 - RNA, 63 nt, Homo Sapiens
acauccugcaccguguauaauuggugagacuguugccuuaauguccgagcccugugcauggac

SEQ ID NO: 173747 - RNA, 63 nt, Homo Sapiens
cuucauaugaggaggaugucacaguacagcaugugccuuaaugaggucagggagugcuggcuc

SEQ ID NO: 173748 - RNA, 63 nt, Homo Sapiens
cauggcuggaauuuauagaggaaauaguucuggugccuuaacguuaauuuuggaggggguggg

SEQ ID NO: 173749 - RNA, 63 nt, Homo Sapiens
uugaauauacuguuuaccucuguuuuuaccauuugccuuaauagcauuaauauaccauccaug

SEQ ID NO: 173750 - RNA, 63 nt, Homo Sapiens
ggcuguuucuuaaagguguuguuacacaguguaugccuuaaaauauagcaggaaauacgaaga

SEQ ID NO: 173751 - RNA, 63 nt, Homo Sapiens
agucucucaagugaugagacgaaauggguuucuugccuuaaccgaaaacaaaaaaaauguuaa

SEQ ID NO: 173752 - RNA, 63 nt, Homo Sapiens
augaucaugguucagaauauaauguauuugaagugccuuaaagacuuaaauuuaguggucaga

SEQ ID NO: 173753 - RNA, 63 nt, Homo Sapiens
cuaauagaaaaacagguaagaauaaagcaauguugccuuaauuucaaaagcugcuauuuuaga

SEQ ID NO: 173754 - RNA, 63 nt, Homo Sapiens
agguagauccccaauauuuuggaauaccaaaauugccuuaaaaauucccuucuguuucuuaca

SEQ ID NO: 173755 - RNA, 63 nt, Homo Sapiens
ugacuaacuuaaaaaaauagauuguaauugaugugccuuaauuugcauaaaucauaaauguau

SEQ ID NO: 173756 - RNA, 63 nt, Homo Sapiens
uuguagaacuuucuuuuuaaggugaauaagucaugccuuaacauccaaauaagaguucaucuu

SEQ ID NO: 173757 - RNA, 63 nt, Homo Sapiens
uugucuauuucuuaauuuuaaaauaugcugauaugccuuaaacuguaguuguagauccuuguc

SEQ ID NO: 173758 - RNA, 63 nt, Homo Sapiens
aguuaugaguaaaucugcaaaaggcaaugaaaaugccuuaaauuuuaucaauaacagaauuau

SEQ ID NO: 173759 - RNA, 63 nt, Homo Sapiens
gcugaguaauucuaaucucuucuguguuuuccuugccuuaaccacaaauuguggugcuuuuug

SEQ ID NO: 173760 - RNA, 63 nt, Homo Sapiens
acaauguauguccucagugguaccuauuauugaugccuuaaauguauugauaaggugacuagu

SEQ ID NO: 173761 - RNA, 63 nt, Homo Sapiens
uucauuuguugguacauauuacacaaaacauugugccuuaaaaugagucauacaucuuuuaaa

SEQ ID NO: 173762 - RNA, 63 nt, Homo Sapiens
uaccacauauuauuuuuauauuaauucaacauuugccuuaaguguguuguuaaaugaaaguac

SEQ ID NO: 173763 - RNA, 63 nt, Homo Sapiens
guuuuuauauuaaaucauaaggaaggaacuacuugccuuaaauguuaauaucaaaagaguuuu

SEQ ID NO: 173764 - RNA, 63 nt, Homo Sapiens
uuauuaguucacuucccugcugccaugaaacuuugccuuaagaaggugcuggauuccaagguu

SEQ ID NO: 173765 - RNA, 63 nt, Homo Sapiens
uguucuggagagcgugcucaagaauaauuucacugccuuaauguuuuuuaaaucuguauguuc

SEQ ID NO: 173766 - RNA, 63 nt, Homo Sapiens
ccuuuugugguauaagcaaaccuugaauuaaacugccuuaacucauagacguaguuuucgcau

SEQ ID NO: 173767 - RNA, 63 nt, Homo Sapiens
auaaauaguaccuuuggaauucacuuuuaaaacugccuuaaguaaggcuuuuugguuaagacc

SEQ ID NO: 173768 - RNA, 63 nt, Homo Sapiens
uauguauucuauaaugauuuuuuugagacuuagugccuuaaaaaguauaacaggugccuucac

SEQ ID NO: 173769 - RNA, 63 nt, Homo Sapiens
aaaaaaaaaaaaaguucaugccuagcagagaacugccuuaaaaaaauguuuuaaaguuuaaug

SEQ ID NO: 173770 - RNA, 63 nt, Homo Sapiens
uucccuguguuguuccacaccccagaagaacuuugccuuaaguccggaagugacugcccgcug

SEQ ID NO: 173771 - RNA, 63 nt, Homo Sapiens
uaagaaacguuuauuguaacaguaauuaaaugcugccuuaauugaagggguuuggguggauuu

SEQ ID NO: 173772 - RNA, 63 nt, Homo Sapiens
ugauuguagaggguccaccacagaauuaugggaugccuuaagugcuguuacuagguugcucac

SEQ ID NO: 173773 - RNA, 63 nt, Homo Sapiens
aauguuuuauuucuguuaguaugaacaauagacugccuuaacaaaguuuuuuuuuaaacaaaa

SEQ ID NO: 173774 - RNA, 63 nt, Homo Sapiens
ucaaaucacugcagucaugaaauacugaacaauugccuuaagucuuugcuugacucacuggga

SEQ ID NO: 173775 - RNA, 63 nt, Homo Sapiens
uuauuuuauggagcuuugcccuugaugcacugaugccuuaaaaauuaacaaggucauucagaa

SEQ ID NO: 173776 - RNA, 63 nt, Homo Sapiens
augccucaccagcagaagaacagaauaucaggaugccuuaaauuuauaguaguagacuguaaa

SEQ ID NO: 173777 - RNA, 63 nt, Homo Sapiens
ccaucucuguucaaagagggggaaaugugccuaugccuuaagucaaugcacucagcaaggaga

SEQ ID NO: 173778 - RNA, 63 nt, Homo Sapiens
acuuuucuugacuugccuguuuuggccauuagcugccuuaaacguuaacagcacauuugaaug

SEQ ID NO: 173779 - RNA, 63 nt, Homo Sapiens
uguggaaccaacacuaaucgaagcagccggaagugccuuaacugaggaaccacgcugccacca

SEQ ID NO: 173780 - RNA, 63 nt, Homo Sapiens
aaggaggggaggaaccacgccuuagaggacacaugccuuaaaaguuuccaaagcuuuacuacu

SEQ ID NO: 173781 - RNA, 63 nt, Homo Sapiens
guuacuagcgaggucaguguguuccgucuugauugccuuaagacaucugggggccaaacacau

SEQ ID NO: 173782 - RNA, 63 nt, Homo Sapiens
uauaguuauguauagauaccagcacuucaguccugccuuaaguucuauauuucuaucuuuaac

SEQ ID NO: 173783 - RNA, 63 nt, Homo Sapiens
uauaaaggagggaagagguagaguaaauggacuugccuuaauugccuauguagcaggcacuua

SEQ ID NO: 173784 - RNA, 63 nt, Homo Sapiens
uuaaccaauauuuucuucugggucccagggcugugccuuaacuaaacauagcugcaggucuuu

SEQ ID NO: 173785 - RNA, 63 nt, Homo Sapiens
cuguucauuuuuucaaguccguccuaacgucuuugccuuaauuugccucagacugaaaagcua

SEQ ID NO: 173786 - RNA, 63 nt, Homo Sapiens
uguuugcuaguuguguacauccauugcaaugguugccuuaaggccgcccugcaaguuaacccc

SEQ ID NO: 173787 - RNA, 63 nt, Homo Sapiens
gguagaauauuuagaaauuuaaugcaaacucuuugccuuaaauccuauuuucugacguuucuu

SEQ ID NO: 173788 - RNA, 63 nt, Homo Sapiens
gagaauuucuaaaugauuuucuaauucugugggugccuuaaguaauugaguauuguggguccc

SEQ ID NO: 173789 - RNA, 63 nt, Homo Sapiens
aauuuggcaaucagaauuaaccuuuuuuauaccugccuuaaauaaauguauauugaaugcuuu

SEQ ID NO: 173790 - RNA, 63 nt, Homo Sapiens
gcaggcaaaaaccagucauuuguuaauuugaaaugccuuaauguacagacaucaguuccaugg

SEQ ID NO: 173791 - RNA, 63 nt, Homo Sapiens
cugucuccucucuguuacucgguccauguuugcugccuuaacccuguuguauuaccaaagcag

SEQ ID NO: 173792 - RNA, 63 nt, Homo Sapiens
aaagucgaauuaauagcuuuuaauaagaaugguugccuuaaaguucaucaaaagugacugccu

SEQ ID NO: 173793 - RNA, 51 nt, Homo Sapiens
agaaugguugccuuaaagaacugccuuaauauucuguuucaucaaaaguga

SEQ ID NO: 173794 - RNA, 63 nt, Homo Sapiens
ccuccucccacugccccugacauuccugcucccugccuuaacucacccacuuaguuucuuuuu

SEQ ID NO: 173795 - RNA, 63 nt, Homo Sapiens
acacauugcagcuucaacuuaucugcugggcucugccuuaaacuggcacauggguggacacgg

SEQ ID NO: 173796 - RNA, 63 nt, Homo Sapiens
cuggcuccuggcccgagccuggcuggcaaugguugccuuaaccggcccugcauuucuggguag

SEQ ID NO: 173797 - RNA, 63 nt, Homo Sapiens
aaucccugaaagaaauaaaaacacugugcucaaugccuuaauaauuucacuuggcuagaaauu

SEQ ID NO: 173798 - RNA, 63 nt, Homo Sapiens
aggaagaugaauuuuuaaaaucuccaucaaacgugccuuaaagcuaaagcauuuugacaggag

SEQ ID NO: 173799 - RNA, 63 nt, Homo Sapiens
ugcgcgggaggccacagcccgugccgauuccagugccuuaacuacuuaccggaucccuccaua

SEQ ID NO: 173800 - RNA, 63 nt, Homo Sapiens
cacacauucugccuuggauuccuagauuacaucugccuuaaaaaaacacggaagcacaguugg

SEQ ID NO: 173801 - RNA, 63 nt, Homo Sapiens
cuuuacugagauuucugaguauacuuuucauauugccuuaauguagcaguaauguguuuaugc

SEQ ID NO: 173802 - RNA, 63 nt, Homo Sapiens
caaauccuuuggccugagaacuaauauguuaauugccuuaaauaaauuaauagaaaucuaguc

SEQ ID NO: 173803 - RNA, 63 nt, Homo Sapiens
uugacaguauauuugaaacuguaaauauguuugugccuuaaaaggagagaagaaaguguagau

SEQ ID NO: 173804 - RNA, 63 nt, Homo Sapiens
auaaguauuugccuaaaaccauaaaauaggaauugccuuaaggaucuaguaguuuauaaugcc

SEQ ID NO: 173805 - RNA, 63 nt, Homo Sapiens
cugucuuugcuuucuuuuuuuuuuucuuuuugaugccuuaauguagauaucuuuaucauucug

SEQ ID NO: 173806 - RNA, 59 nt, Homo Sapiens
aggugugggcauuugauugaaauucagacugccuuaaaauauaacauuaaaaagacugg

SEQ ID NO: 173807 - RNA, 63 nt, Homo Sapiens
uuuggcaaacagaauguucauacugauguguugugccuuaaagacaagacagcauuugugugu

SEQ ID NO: 173808 - RNA, 63 nt, Homo Sapiens
gggagacagaaacugugguugauagccagucacugccuuaagaacauuugaugcaagauggcc

SEQ ID NO: 173809 - RNA, 63 nt, Homo Sapiens
gaccgcugcugcugcugccgcuacugcugcugcugccuuaaguaggaagagagggaaggacac

SEQ ID NO: 173810 - RNA, 63 nt, Homo Sapiens
uucauaauugcuuucuagcaaucagcuuuuauuugccuuaauauaagcuuuuaagcaguuauc

SEQ ID NO: 173811 - RNA, 63 nt, Homo Sapiens
ugucccuuuuuaagccuuaccugagaggaacaaugccuuaaaauaaaaaagcauuaaugagau

SEQ ID NO: 173812 - RNA, 63 nt, Homo Sapiens
caugacauauugugguuaauuuuaaaacuacugugccuuaacguguuucuuaaacuuuuguag

SEQ ID NO: 173813 - RNA, 63 nt, Homo Sapiens
gaaaucuuuauuaaucacgucucgaccagccucugccuuaaaggcagaagauaacagcagcau

SEQ ID NO: 173814 - RNA, 63 nt, Homo Sapiens
ugaaguaaauuugguucuuuucuguguggaauuugccuuaaacugcccgucucugagacaguc

SEQ ID NO: 173815 - RNA, 63 nt, Homo Sapiens
uuguuugaaaugcagcgugaauuuggaugggccugccuuaacauguucaucucuuaggcuucc

SEQ ID NO: 173816 - RNA, 63 nt, Homo Sapiens
cacccaucuuccaguaagcacagccuucccuuuugccuuaaguggauuggggagcccaggagg

SEQ ID NO: 173817 - RNA, 63 nt, Homo Sapiens
uuaaaucaugugauuuauagcaaguccaacaccugccuuaaauuuagugcuggaguaaaaggu

SEQ ID NO: 173818 - RNA, 63 nt, Homo Sapiens
gcaagagggaaggucaccauccucacuuaugguugccuuaaagaucucuauaugguacauuug

SEQ ID NO: 173819 - RNA, 63 nt, Homo Sapiens
uuuaaaaagcagggcccaaaagagaaacacacaugccuuaaaauuguacaauguuguuauggu

SEQ ID NO: 173820 - RNA, 63 nt, Homo Sapiens
cuccuuguuuuagacacacuuacaguuccauauugccuuaaacaaguuagugcaucaacggga

SEQ ID NO: 173821 - RNA, 63 nt, Homo Sapiens
guuuaaaaucucuggcuucauaauguuuucaagugccuuaauuugcacauuuguacauauacu

SEQ ID NO: 173822 - RNA, 63 nt, Homo Sapiens
uauauuuguuuuagucaugaacuucauaugguuugccuuaauauuuuaaucugacaagcagua

SEQ ID NO: 173823 - RNA, 63 nt, Homo Sapiens
uuugaaaugugugaaauuuuaguuggaaaaaguugccuuaaugauuuuuauaaaguacuguuu

SEQ ID NO: 173824 - RNA, 63 nt, Homo Sapiens
acuacacugcaccauguuaguaauaaacagaucugccuuaaagaaaagaaaauuuuagaaaga

SEQ ID NO: 173825 - RNA, 63 nt, Homo Sapiens
ugguguaaacuuguacauggaauuuuuugaauaugccuuaauuuagaaacugaaaaauaucug

SEQ ID NO: 173826 - RNA, 63 nt, Homo Sapiens
acauaugguuuauuuugaaacuucaaguauuauugccuuaaugucucuuaacccuguuacacg

SEQ ID NO: 173827 - RNA, 63 nt, Homo Sapiens
aggcauucuagaaaauaugaauuaguuuccaaaugccuuaauuuuaaacuuuggccugaacag

SEQ ID NO: 173828 - RNA, 63 nt, Homo Sapiens
uuggcagcuuauuccaguugaucucuucacaucugccuuaaaagugcuauguagagauacauu

SEQ ID NO: 173829 - RNA, 63 nt, Homo Sapiens
ucucccugaggacugagggugaacuucgcucuuugccuuaaaccucuuuauuucauugcagua

SEQ ID NO: 173830 - RNA, 63 nt, Homo Sapiens
cuggagagaggaaucuaguagcccccucuuacuugccuuaaaacgugaggcuccccagccaca

SEQ ID NO: 173831 - RNA, 63 nt, Homo Sapiens
auaucuauaguauuuaacagagggcuggaauuaugccuuaacuuugaccaaauaaguuuccug

SEQ ID NO: 173832 - RNA, 63 nt, Homo Sapiens
uaaugaaaaagaaaaguauaauuuuaucaaauuugccuuaaaaauacuuccucaccacugacu

SEQ ID NO: 173833 - RNA, 63 nt, Homo Sapiens
acugcuugcauacugauuuaauucuuaaagcuuugccuuaaauuuacaaaugaaauuuaaagu

SEQ ID NO: 173834 - RNA, 63 nt, Homo Sapiens
gguuaucuaguauccuucauaauaaauacauguugccuuaaaggagcaguucuaauaaugcag

SEQ ID NO: 173835 - RNA, 63 nt, Homo Sapiens
uaucugccugagguuggccuucuugccuauccuugccuuaaccauaggguuaaaauagaccuu

SEQ ID NO: 173836 - RNA, 63 nt, Homo Sapiens
guacuauuuucucgccaccaacgggguaagauuugccuuaacacuguccugcugguaacugcu

SEQ ID NO: 173837 - RNA, 63 nt, Homo Sapiens
augcacucuacuggggauuuagcucuagccuucugccuuaagagggugcugagauaagcaauu

SEQ ID NO: 173838 - RNA, 63 nt, Homo Sapiens
auguuguggccaagccacauagucagagaagggugccuuaaaaugggaauaaaaauuugugca

SEQ ID NO: 173839 - RNA, 63 nt, Homo Sapiens
uaggaagguguuuccaaguuuauccugauccugugccuuaaagagcucguacauguggguucu

SEQ ID NO: 173840 - RNA, 63 nt, Homo Sapiens
uguuugauucgccuuccuuuuuugacauauguaugccuuaauucuuaaaucugagggaccaug

SEQ ID NO: 173841 - RNA, 63 nt, Homo Sapiens
gaggagcccuccuggagcucaggaggccgaggcugccuuaagcugugaucaugccacugcauu

SEQ ID NO: 173842 - RNA, 63 nt, Homo Sapiens
aacaaaagcucagguuuguccuggucaugcacaugccuuaagccaguuccgucuucccuagac

SEQ ID NO: 173843 - RNA, 63 nt, Homo Sapiens
cugcagugagcuaugauugcaccacuguacuccugccuuaaaaaaaaaaaaaaaaucccaaua

SEQ ID NO: 173844 - RNA, 63 nt, Homo Sapiens
uuaaaggauaguaauuauucuuguuuauaacagugccuuaagguaugauguauuucugaugga

SEQ ID NO: 173845 - RNA, 63 nt, Homo Sapiens
acaccuccaguuaucaggaauacauuuuuuuacugccuuaaccuguagugcguagaauaugca

SEQ ID NO: 173846 - RNA, 63 nt, Homo Sapiens
agugcccuccccacaaugcacugaauuuuacuuugccuuaagaaaacugauuucaugcagguc

SEQ ID NO: 173847 - RNA, 63 nt, Homo Sapiens
guucccuguaugugaaacggcauuuucuccucuugccuuaaaagaucccccguuacuuccuag

SEQ ID NO: 173848 - RNA, 63 nt, Homo Sapiens
uuugaacauaauagcuauucuuauuuucuagguugccuuaauagacuagagccuucuugaggu

SEQ ID NO: 173849 - RNA, 63 nt, Homo Sapiens
aguauuccaaguuuacuccaacgcgaacucaggugccuuaaaacauaggaagagaucugccag

SEQ ID NO: 173850 - RNA, 63 nt, Homo Sapiens
ugaagcuuauuuauaauagcagguaaugacagaugccuuaaugugaauccaaaucuuuuucau

SEQ ID NO: 173851 - RNA, 63 nt, Homo Sapiens
guuuccuccauuugagaaaaacuugauccacuaugccuuaauguaccaguuucaaacuuggug

SEQ ID NO: 173852 - RNA, 63 nt, Homo Sapiens
cucccgguucuggggacgcacccgcaauaaagaugccuuaaguccaggaggccgugugaggau

SEQ ID NO: 173853 - RNA, 63 nt, Homo Sapiens
cuauguacugccuuagugcugaugccuguguacugccuuaaauguaccuauggcaauuuagcu

SEQ ID NO: 173854 - RNA, 63 nt, Homo Sapiens
aacuccauaccaucggccgggugugguggcucaugccuuaaucccagcacuuugggaggucaa

SEQ ID NO: 173855 - RNA, 63 nt, Homo Sapiens
uuucuucccuucucuaucuguugccccugauuuugccuuaaguucuugccugagugaucuccc

SEQ ID NO: 173856 - RNA, 63 nt, Homo Sapiens
auugcagcauuucacuuggcuacuucauacccaugccuuaaagaggggcaguuucucaaaagc

SEQ ID NO: 173857 - RNA, 63 nt, Homo Sapiens
auagccuaagugcuauaucgaucgucccggaugugccuuaagaaccgugaccucaucagucgc

SEQ ID NO: 173858 - RNA, 63 nt, Homo Sapiens
aaaaaaaagauacaaagucugcauuugauauaaugccuuaauuacugggucuacaauuaaugu

SEQ ID NO: 173859 - RNA, 63 nt, Homo Sapiens
agguuaggaaaaauuccacacaaccaaacagucugccuuaaaagugacccacauuuuuccaua

SEQ ID NO: 173860 - RNA, 63 nt, Homo Sapiens
ggucccucgcauucuuuuacuguaaacaaacaaugccuuaaauugugucuuguuuucuguucc

SEQ ID NO: 173861 - RNA, 63 nt, Homo Sapiens
guagccauagaugugauuauguccacaccgggcugccuuaaucuguccugcuuggagagugac

SEQ ID NO: 173862 - RNA, 63 nt, Homo Sapiens
uuucaucaaugucuuuguaaagcacaaauuaucugccuuaaaggggcucugggucggggaauc

SEQ ID NO: 173863 - RNA, 63 nt, Homo Sapiens
uuugcaugauaagcuaguuucugacuuucuagaugccuuaauaucuaugacaauauauuuuaa

SEQ ID NO: 173864 - RNA, 63 nt, Homo Sapiens
gaaaucagacaaaugcccuggacuuuuccaaagugccuuaaaaucuuucuguccgcagauccu

SEQ ID NO: 173865 - RNA, 63 nt, Homo Sapiens
cucccuccucucucagcugucccuuguagauacugccuuaacauugcccuccugccacccuuc

SEQ ID NO: 173866 - RNA, 63 nt, Homo Sapiens
guuguauuuuuauagacaugugcauuuccaaacugccuuaaacacguuguagaaauguacaaa

SEQ ID NO: 173867 - RNA, 63 nt, Homo Sapiens
uacugaaauacaucauuuuacaucuaucuccuuugccuuaauuuuuugcaccacuggucauag

SEQ ID NO: 173868 - RNA, 63 nt, Homo Sapiens
gcacagagguacugcccccauucaacguaagugugccuuaauuggugagcagccacugugcag

SEQ ID NO: 173869 - RNA, 63 nt, Homo Sapiens
cuauaguccuauacaaaaauaagguuauaaacuugccuuaaaaugugaggcucaaaugagcca

SEQ ID NO: 173870 - RNA, 63 nt, Homo Sapiens
gguuuucauaguuuaaguguuugaaugauacugugccuuaauuugcucuucugucuauaaauu

SEQ ID NO: 173871 - RNA, 63 nt, Homo Sapiens
aauauguaauauaaauuuaacuauauaguuccuugccuuaauaagcagaacaaauguguuuuu

SEQ ID NO: 173872 - RNA, 63 nt, Homo Sapiens
agaacaaauguguuuuucuauuauucccaaguaugccuuaagcgcaauaauuuguacaauggu

SEQ ID NO: 173873 - RNA, 63 nt, Homo Sapiens
augcucagaacacuuacauugcuuagccuagccugccuuaaaccuaaccuaccaaacaucaua

SEQ ID NO: 173874 - RNA, 63 nt, Homo Sapiens
uuugcaacaggguggaaguuagauuccuuucacugccuuaaucuaauagauccaguguuuuuc

SEQ ID NO: 173875 - RNA, 63 nt, Homo Sapiens
gcagagaagcgaggcggaugccccccuugcuugugccuuaaaggagccacugagggauguuuu

SEQ ID NO: 173876 - RNA, 63 nt, Homo Sapiens
uccaucucaugucccuccccaucgcucgcugugugccuuaaacggccagcaccucccuccucc

SEQ ID NO: 173877 - RNA, 63 nt, Homo Sapiens
ccucggggucugcccggcccccuugcccugcuuugccuuaaagccggcccgggcugcguacac

SEQ ID NO: 173878 - RNA, 63 nt, Homo Sapiens
cgagcuaagucugugugcagcauuaguacccgcugccuuaaaacucaaguuuacauuauucau

SEQ ID NO: 173879 - RNA, 63 nt, Homo Sapiens
ucuuauaauuuaucuuuauuuaaaagcuuagccugccuuaaaacuagagaucaacuuucucag

SEQ ID NO: 173880 - RNA, 63 nt, Homo Sapiens
aauggaagagcccagaugggugaagauugauuuugccuuaacucaagagaauuccuguucucc

SEQ ID NO: 173881 - RNA, 63 nt, Homo Sapiens
guucuacuuaaaaugugaauuguacuucugagcugccuuaaugcaaggucauuuauauuuguu

SEQ ID NO: 173882 - RNA, 63 nt, Homo Sapiens
aauaugaacauguacagcgugcauagggacucuugccuuaaggaguguaaacuugaucugcau

SEQ ID NO: 173883 - RNA, 57 nt, Homo Sapiens
auuaugcuaauuucaaaugaagauuccugccuuaaaauauuuuuuaauuuaaugguc

SEQ ID NO: 173884 - RNA, 63 nt, Homo Sapiens
aucuucccuaauuucuuuguauauauuuuguuaugccuuaaaggccaccugcuauacaguugu

SEQ ID NO: 173885 - RNA, 63 nt, Homo Sapiens
aaaagguuaagaugagaggguggacaaaccugaugccuuaaggggggcuuugguuccaaaacu

SEQ ID NO: 173886 - RNA, 63 nt, Homo Sapiens
guuaaaaugaaaacuuugugcaugagugggaguugccuuaaauuggauauuaugcuuugaagu

SEQ ID NO: 173887 - RNA, 63 nt, Homo Sapiens
aaacaaacaagaaaugucuuaugaccaggcaaaugccuuaagugcacgguuuggguauucuua

SEQ ID NO: 173888 - RNA, 63 nt, Homo Sapiens
cggguuacugcacaacuuuagugucugcauucaugccuuaacuugcugugugugugcaugugu

SEQ ID NO: 173889 - RNA, 63 nt, Homo Sapiens
ggagccccaucagcuccagcgcaaagccuucauugccuuaacucuugagcccucuauggugug

SEQ ID NO: 173890 - RNA, 63 nt, Homo Sapiens
cuaauuuuauuuuguucucucacauguuguuauugccuuaauuaggguaaugugcuugguuug

SEQ ID NO: 173891 - RNA, 63 nt, Homo Sapiens
cugaaugucuguagccaaaaaauuugugguaugugccuuaaacucagugacagggcuucuugu

SEQ ID NO: 173892 - RNA, 63 nt, Homo Sapiens
agcucucuagucuaacggucguuuucauguccuugccuuaaaggcgagguauaaaaguacgca

SEQ ID NO: 173893 - RNA, 59 nt, Homo Sapiens
uacucaaggaaaaaaauccucaugagaauugccuuaaaaggaacuuguaggugacauga

SEQ ID NO: 173894 - RNA, 63 nt, Homo Sapiens
cauuccuugaggacagaccuuccucuuaaaagaugccuuaauccaagauaaaugguaccagcg

SEQ ID NO: 173895 - RNA, 63 nt, Homo Sapiens
auugcuauuaauugaaauauuuaguacagaaauugccuuaaaaauuacuacucauuucagugu

SEQ ID NO: 173896 - RNA, 63 nt, Homo Sapiens
gugaacuucuuuaaagaaccuuaacuuuucugaugccuuaaaauaauuaaaauguuugccaca

SEQ ID NO: 173897 - RNA, 63 nt, Homo Sapiens
ccuccccugggccgcugaggccccgcgcaccugugccuuaaucuucccuccccugugcugccc

SEQ ID NO: 173898 - RNA, 63 nt, Homo Sapiens
caccagucauacuggcucagggcccaccgcuaaugccuuaaugaaaucauuuuaacauuauau

SEQ ID NO: 173899 - RNA, 63 nt, Homo Sapiens
uuuugguugaaauugaacauacucuagugaaugugccuuaaaaaucaagacacuaguucagag

SEQ ID NO: 173900 - RNA, 63 nt, Homo Sapiens
guaguuguucauuucagccucuggauggcuggcugccuuaaacacaaucaauuucaaagcucc

SEQ ID NO: 173901 - RNA, 63 nt, Homo Sapiens
gugcaauucuggaacauauuaauuaaaauaauaugccuuaacauauagugaauuucuaauucu

SEQ ID NO: 173902 - RNA, 63 nt, Homo Sapiens
cacuuccgaaaaguuuacauucacuuggaaggcugccuuaaaguauaucucuuaucuaugacc

SEQ ID NO: 173903 - RNA, 63 nt, Homo Sapiens
uauuauugacuauagccaacuacagauggcauaugccuuaaagaugcauuuuucuauguauuu

SEQ ID NO: 173904 - RNA, 63 nt, Homo Sapiens
uggaaaaauugucccgucugucacuuguuuuguugccuuaauaagcaucugaauguuugguug

SEQ ID NO: 173905 - RNA, 63 nt, Homo Sapiens
cuucagcuucuuacguuuucugagcauccauugugccuuaacauuuucugcuuguccuuuggg

SEQ ID NO: 173906 - RNA, 63 nt, Homo Sapiens
cugaacuccggccugggugacagaaggaggcucugccuuaaaaaaaaaaaaaaaaaaaaccuc

SEQ ID NO: 173907 - RNA, 63 nt, Homo Sapiens
acacuugccaaaacauuaagagaacuuugauucugccuuaagaggguauaaaacuaaaccauu

SEQ ID NO: 173908 - RNA, 63 nt, Homo Sapiens
acuaauucuggcaccccuuuuccgccucagcugugccuuaaggaguugugccuuggugccuug

SEQ ID NO: 173909 - RNA, 63 nt, Homo Sapiens
acucaaugagaaucaugguaucaauuauuugggugccuuaaaagucuuaauauaucuuaggcu

SEQ ID NO: 173910 - RNA, 63 nt, Homo Sapiens
uuucauauauauauauuuuuagucaacaguauuugccuuaagauucguccagcccaugugcaa

SEQ ID NO: 173911 - RNA, 63 nt, Homo Sapiens
gcccccuacaaggggccccaagcccugaaugugugccuuaaagggugcugguucacucugccc

SEQ ID NO: 173912 - RNA, 63 nt, Homo Sapiens
aaauaggaagggaagcuuuuauuuauuaauucaugccuuaaaaacugcuuugcaaugacauuu

SEQ ID NO: 173913 - RNA, 63 nt, Homo Sapiens
uacaggacaaauaggcucuaguccucuuccuugugccuuaacagaaccccuuuaucccaggaa

SEQ ID NO: 173914 - RNA, 63 nt, Homo Sapiens
uucugggggagggggauuagguugugaaccaacugccuuaacccaaggucaccaaacaacuug

SEQ ID NO: 173915 - RNA, 63 nt, Homo Sapiens
uggggguggggagggguaagcuuaagccaaaucugccuuaaauugaggggccagcuugccagg

SEQ ID NO: 173916 - RNA, 63 nt, Homo Sapiens
guuuucuuccccauuccuucuuuauauuauuuaugccuuaaauuaucuuaaaacgugugcccu

SEQ ID NO: 173917 - RNA, 63 nt, Homo Sapiens
uuuguugguuuuggcuuuagauuuucccagagaugccuuaaccucuagcugggugaaacccuu

SEQ ID NO: 173918 - RNA, 63 nt, Homo Sapiens
aagcucucaaaauauuuuaguuuuggaugcaggugccuuaaugccagcuguauuauuuugauc

SEQ ID NO: 173919 - RNA, 63 nt, Homo Sapiens
auuggaugaaauuagcugcugagauugaguuucugccuuaaaaucugaaacaaaaaaagggac

SEQ ID NO: 173920 - RNA, 63 nt, Homo Sapiens
cccuuuccuaaucuggcuuuuacauuuauuuugugccuuaaagauuaacuacaaagauaaaca

SEQ ID NO: 173921 - RNA, 63 nt, Homo Sapiens
gggcuauuuggacucaggugggcccucugaacuugccuuaaacacucaccuucuagucuuggc

SEQ ID NO: 173922 - RNA, 63 nt, Homo Sapiens
ccccugaagccuaacacaguuccuaauguguuuugccuuaaccucuuuucucuucccacauug

SEQ ID NO: 173923 - RNA, 63 nt, Homo Sapiens
uccauuucuuuuuucccaaacccucaaacagagugccuuaaaaaauuguuuuaucaggauaau

SEQ ID NO: 173924 - RNA, 63 nt, Homo Sapiens
aaagaaggaacauuuccuauggugcugucucacugccuuaaaacagauuucuaugacaguuua

SEQ ID NO: 173925 - RNA, 63 nt, Homo Sapiens
auaagccaaagccauguggaauuuuuguuuagaugccuuaacugugccacaccccacaacccc

SEQ ID NO: 173926 - RNA, 63 nt, Homo Sapiens
ugucuugagggaaggaagaggucuguucuguauugccuuaaguugauugagguuuguaggaga

SEQ ID NO: 173927 - RNA, 63 nt, Homo Sapiens
ccagugaagcaacugaguacaauacacaaagcaugccuuaaacaguuuuauuuuugcaaacua

SEQ ID NO: 173928 - RNA, 63 nt, Homo Sapiens
uuguuuaauuaaauuuaacuuguuuuaaacacaugccuuaaauaauguaaagaacuuaaauua

SEQ ID NO: 173929 - RNA, 63 nt, Homo Sapiens
caguaccccccuaccacacaucagaauauugucugccuuaaagagcaauugacagagaauaac

SEQ ID NO: 173930 - RNA, 63 nt, Homo Sapiens
uagagggucggggaggaggugccuccccggaagugccuuaaccuaacaggaccccaaggaccu

SEQ ID NO: 173931 - RNA, 63 nt, Homo Sapiens
aaggcucauacuguccugucccuuuccccuaccugccuuaaccuacuacauuucuuccacucc

SEQ ID NO: 173932 - RNA, 63 nt, Homo Sapiens
acauuccccucccaccucucgagauuacuuugcugccuuaauguccuccuccaucuuucuaca

SEQ ID NO: 173933 - RNA, 63 nt, Homo Sapiens
guggccucccugggguggguaccucagcaucacugccuuaaucgccucccaaaaaggagcccc

SEQ ID NO: 173934 - RNA, 63 nt, Homo Sapiens
agaccgauuuccugcccacccuaccuugcucacugccuuaaucgaaucuguuucagagcucuc

SEQ ID NO: 173935 - RNA, 63 nt, Homo Sapiens
ugccuucauaaauaaccauuacuuugcaugauaugccuuaauagacuuucuuuggcuaauuuu

SEQ ID NO: 173936 - RNA, 63 nt, Homo Sapiens
gcuccuggccacuuggaaguuuaaagcaggaccugccuuaacucuacuuggcagcuaguaagu

SEQ ID NO: 173937 - RNA, 63 nt, Homo Sapiens
uuaacuguucuuccuggcgcgaaaacgccucacugccuuaacccuucagcugcuaagauccaa

SEQ ID NO: 173938 - RNA, 63 nt, Homo Sapiens
acccuaacuugacaaaacaguuacaugucagaaugccuuaacucuauuuugaaucaccuuuaa

SEQ ID NO: 173939 - RNA, 63 nt, Homo Sapiens
aacuggaagcuauacaauacagauuuccucuccugccuuaaacgugauggaauaacaaggguc

SEQ ID NO: 173940 - RNA, 63 nt, Homo Sapiens
uagcaacuuagauaagugaaaguuuuucuaacaugccuuaaaaauauuaugguuugauccaaa

SEQ ID NO: 173941 - RNA, 63 nt, Homo Sapiens
caauuuuccaccucgcaguaguuaguauuuacuugccuuaaacuaacuuugaagcaaguaaug

SEQ ID NO: 173942 - RNA, 63 nt, Homo Sapiens
ucuguuacacuuuuuggaagacaaaguuaccagugccuuaaacguuuuaaucucuaacagugg

SEQ ID NO: 173943 - RNA, 63 nt, Homo Sapiens
uuaagaggaaaauacaaaaaguagccauuucauugccuuaauuuaaaaauaaccuuaggaacu

SEQ ID NO: 173944 - RNA, 63 nt, Homo Sapiens
uuaaguguccauuugugcagcagagcagaaugaugccuuaaucgauucacagaagcacuacuc

SEQ ID NO: 173945 - RNA, 63 nt, Homo Sapiens
guauauacgugaaauacucaccaaaaauuuagaugccuuaauaaaaauuauauacugaaaaca

SEQ ID NO: 173946 - RNA, 63 nt, Homo Sapiens
auuuacaugauucucaauauaauuuuuaucuauugccuuaaacaaauuucacuggauuguaua

SEQ ID NO: 173947 - RNA, 63 nt, Homo Sapiens
guuuacuguuucuucuguucgagaaagaugucuugccuuaaaaccuugcugcuagagugggag

SEQ ID NO: 173948 - RNA, 63 nt, Homo Sapiens
caucaucuggucacguuagaaauacuuugcuuuugccuuaacacaaaaaccugagggggagaa

SEQ ID NO: 173949 - RNA, 63 nt, Homo Sapiens
uauauuauagaaacaguuuuuugauccccacacugccuuaaggccauaucuccagggauguug

SEQ ID NO: 173950 - RNA, 63 nt, Homo Sapiens
aaaaaugaaaagagaaugaugaaagaauguuacugccuuaauaccccccuccgccuccaggaa

SEQ ID NO: 173951 - RNA, 63 nt, Homo Sapiens
cauuuuacuuggcuuauucauuugggauaggguugccuuaaaaauuaauaucuucaggaauau

SEQ ID NO: 173952 - RNA, 63 nt, Homo Sapiens
auggaacaaaauagaagcaugauaugcuaucauugccuuaauaccauuucuuuuuuaagaucu

SEQ ID NO: 173953 - RNA, 63 nt, Homo Sapiens
gacuacagagucaaagcucacuaucagguuuugugccuuaagaggccaccaguuaaaugccgu

SEQ ID NO: 173954 - RNA, 56 nt, Homo Sapiens
ugggauucaauaauauguaaagaaaaugccuuaauauaaacugacucaguugaaua

SEQ ID NO: 173955 - RNA, 63 nt, Homo Sapiens
aaaaaggauuaccuuuccuuguaaagaggaugcugccuuaagaauugcauguuguaaaaaauc

SEQ ID NO: 173956 - RNA, 63 nt, Homo Sapiens
agaugaauacuaaaugguugucugggucaauacugccuuaaugagaacauuuacacauucuca

SEQ ID NO: 173957 - RNA, 63 nt, Homo Sapiens
gguuauaaaaauguuaauucagaauuaguuuaaugccuuaauuaaacuaauuaauagcuuugg

SEQ ID NO: 173958 - RNA, 63 nt, Homo Sapiens
uccauggcucuaaaauuuggaauuaacuucucuugccuuaagagcugcuuguacauaugugga

SEQ ID NO: 173959 - RNA, 63 nt, Homo Sapiens
ugggaaaaaauccuaaaaggugacuuaauuugaugccuuaaauucacaagugaggaagcuaag

SEQ ID NO: 173960 - RNA, 63 nt, Homo Sapiens
uuguagacuaaaccaaguaugcauuaguauguuugccuuaaacauuucugaagaaaagcaaau

SEQ ID NO: 173961 - RNA, 63 nt, Homo Sapiens
agcagagcuaccuuacgugcaagacagcagucaugccuuaagaaggguggggcccacuccaug

SEQ ID NO: 173962 - RNA, 63 nt, Homo Sapiens
agacuuuuuaguccaaaauuacacugagacaugugccuuaaacuguguguguuuuuaauauuc

SEQ ID NO: 173963 - RNA, 63 nt, Homo Sapiens
gugaaaccuucauggauaguaaaaaaggguucuugccuuaaaagaugccacauagucuugcau

SEQ ID NO: 173964 - RNA, 63 nt, Homo Sapiens
cagcugauucugagacaggccccugcagagggaugccuuaaagcugucccuggcuggaggagc

SEQ ID NO: 173965 - RNA, 63 nt, Homo Sapiens
ggcuguuccgucugauagauggaaggguaacauugccuuaaaacagaaauaugcaggcguugg

SEQ ID NO: 173966 - RNA, 63 nt, Homo Sapiens
cgacacuuugucgacacugaaauaucgauuaagugccuuaaaaccucuuuagacauagcuaug

SEQ ID NO: 173967 - RNA, 63 nt, Homo Sapiens
auuagacauacuguuuuuauaauguuuuacuucugccuuaagauuuagguuuuuuaaauguau

SEQ ID NO: 173968 - RNA, 63 nt, Homo Sapiens
gugaacagaaguccuuaagcagaggaauuggugugccuuaaagauacaaucugggauaguuug

SEQ ID NO: 173969 - RNA, 63 nt, Homo Sapiens
auuuuccauuauucuggacaugaauuucuaaaaugccuuaauagguuuauguaguugaguaaa

SEQ ID NO: 173970 - RNA, 63 nt, Homo Sapiens
aacaguaugguacugcuucugugacaaauaucgugccuuaacaauguggcuguccuuuuccac

SEQ ID NO: 173971 - RNA, 63 nt, Homo Sapiens
auaguuaauccguaaagguuuccaguuaauucaugccuuaaaaggcacugcaauuuuauuuuu

SEQ ID NO: 173972 - RNA, 63 nt, Homo Sapiens
acuuacuuuagauucuuauuuuuuauagcuauuugccuuaagaagagacuaaggauucuucuc

SEQ ID NO: 173973 - RNA, 63 nt, Homo Sapiens
uagguaggcccagagucuuaggguacugucaccugccuuaauguuauuauguagaaugaauga

SEQ ID NO: 173974 - RNA, 63 nt, Homo Sapiens
uuucugagucucaauuaaaacaccuaccauugaugccuuaagucaggguauuaaucccuuugu

SEQ ID NO: 173975 - RNA, 63 nt, Homo Sapiens
auacaaaaacagaaaugcaguacgagauuuggcugccuuaagaguuuuguggggucugagguu

SEQ ID NO: 173976 - RNA, 63 nt, Homo Sapiens
caccuccccaggacuuacggccacacuggucauugccuuaagcggauggucugcucaaguggc

SEQ ID NO: 173977 - RNA, 63 nt, Homo Sapiens
ucuacaacaguaucuuaauuuuuauaauaaaauugccuuaaucgggguggaauauaucaggaa

SEQ ID NO: 173978 - RNA, 60 nt, Homo Sapiens
agaaaacuuuuguuaaaguaaucaggaucaugccuuaaaaagauauugaagaaaaaauga

SEQ ID NO: 173979 - RNA, 63 nt, Homo Sapiens
aauaugauaugccagagaugcagaaaauacuucugccuuaaaaacacucuguaguaaccauua

SEQ ID NO: 173980 - RNA, 63 nt, Homo Sapiens
aauuuguuuucauuuagauucucagaucaaaugugccuuaauauuauaccagaaaguuaaauu

SEQ ID NO: 173981 - RNA, 63 nt, Homo Sapiens
uuuuucgaccucgucuuucugggaaguaacauuugccuuaaauuugaucaauucccuugaaua

SEQ ID NO: 173982 - RNA, 63 nt, Homo Sapiens
gggugugaauagccguaacuugccugcaccugcugccuuaacaguggaguuggccaggcgcag

SEQ ID NO: 173983 - RNA, 63 nt, Homo Sapiens
aacuuugagccaugcuaggagguaacuagucuaugccuuaacuccugaccuuuccugcauuag

SEQ ID NO: 173984 - RNA, 63 nt, Homo Sapiens
aucaucuuuucuaaauucaucuccauuaaaacuugccuuaagcuaccagauugcuuuugccac

SEQ ID NO: 173985 - RNA, 63 nt, Homo Sapiens
cuaaguucagaagguacuuuguuuuuccucccuugccuuaaguccuugguauuuauaaucaau

SEQ ID NO: 173986 - RNA, 63 nt, Homo Sapiens
acuuagaauuucauuauguuuuagaaucaucacugccuuaauauucaagcaucuauuuaaguc

SEQ ID NO: 173987 - RNA, 63 nt, Homo Sapiens
cuugaacguacucauaaauaugacuuauuguauugccuuaaguuuucacucauugucuuuuga

SEQ ID NO: 173988 - RNA, 56 nt, Homo Sapiens
gauggcccaggggugcuugggauggaugccuuaagcucuuaaagccccaggauuaa

SEQ ID NO: 173989 - RNA, 63 nt, Homo Sapiens
cuuaccuggcaguggcuuugaagagauaaaauuugccuuaaaauccggcucagacugaauaag

SEQ ID NO: 173990 - RNA, 63 nt, Homo Sapiens
uugccugguuuguacauuuuccucguggggccuugccuuaaacgccagaaagccaacagcucc

SEQ ID NO: 173991 - RNA, 63 nt, Homo Sapiens
aguacuagacuggaccuucuacugacacaacuuugccuuaaagaaaaugucaaaauaaugaga

SEQ ID NO: 173992 - RNA, 63 nt, Homo Sapiens
cugcacuccagccugggcaaccaagcgagacucugccuuaaaaaaaaaaaaaagaaaaugugg

SEQ ID NO: 173993 - RNA, 63 nt, Homo Sapiens
uaacagaaacauuugaaauagaauuugcaugucugccuuaauuaacuuaaagacugauuuuaa

SEQ ID NO: 173994 - RNA, 63 nt, Homo Sapiens
uuuuuuuuuuacucccccucuaaacacugcugcugccuuaauuuuagaaagcagcuuacuagu

SEQ ID NO: 173995 - RNA, 63 nt, Homo Sapiens
acauaacuguggucaucucuguaguuuacuaacugccuuaaaauugcaugguucuuaauggca

SEQ ID NO: 173996 - RNA, 63 nt, Homo Sapiens
auaaugaauuuuguuuguugaugugaaacauuaugccuuaaguaauguuaauucuuauuuaag

SEQ ID NO: 173997 - RNA, 63 nt, Homo Sapiens
cuggugguugugccuuuuguaggcuguucccuuugccuuaaaccugaagaugucuccucaagc

SEQ ID NO: 173998 - RNA, 63 nt, Homo Sapiens
ccucccaggucugggcugugcaguuccucccccugccuuaaaacaccccacuaucucuguaaa

SEQ ID NO: 173999 - RNA, 63 nt, Homo Sapiens
uuuuaaacugcagaaauuggaguggauggguucugccuuaaauugggaggacuccaagccggg

SEQ ID NO: 174000 - RNA, 63 nt, Homo Sapiens
auaaagguaacuuuaccuuucuuaaauauuuccugccuuaaagagagcauuuccaugacuuua

SEQ ID NO: 174001 - RNA, 63 nt, Homo Sapiens
agaaacgcauguggaccagaagacuuucccugcugccuuaaaaccaauaaaagguuaacuuua

SEQ ID NO: 174002 - RNA, 63 nt, Homo Sapiens
cagcugagcugcgcuggcucugggcagggagugugccuuaaugggaagcacacgggcuuugga

SEQ ID NO: 174003 - RNA, 63 nt, Homo Sapiens
gauguuuuuaauggcauaacaaaggcaagacucugccuuaauuuuugaaaagcugcuaacuac

SEQ ID NO: 174004 - RNA, 63 nt, Homo Sapiens
uaauuccucaggcuuugcgauuuaaggaggagcugccuuaaaaaaaaauaaaggccuuauuuu

SEQ ID NO: 174005 - RNA, 63 nt, Homo Sapiens
acaaagacaagaaaaaucagggcauuuugugagugccuuaagaucaaacuaacaagaucugac

SEQ ID NO: 174006 - RNA, 63 nt, Homo Sapiens
acaggggaggcagguccuuggcgagguagccccugccuuaauccacggggcuccuuucccucc

SEQ ID NO: 174007 - RNA, 63 nt, Homo Sapiens
auguccuuuuaggcugggcagcccccuucuuucugccuuaagaggcugagaccacccuugccu

SEQ ID NO: 174008 - RNA, 63 nt, Homo Sapiens
aaaacacaccucucugcuguuuccagagucuugugccuuaaauaauaaauacaaagcccauuc

SEQ ID NO: 174009 - RNA, 63 nt, Homo Sapiens
acuuucuuuggaagaucauucagaaguuacagaugccuuaaaggauaaaaacccugaaauucc

SEQ ID NO: 174010 - RNA, 63 nt, Homo Sapiens
gcuuuuaauuuuguuuuguuuuagggggagguuugccuuaaagauaacaaaugacuuuuuucc

SEQ ID NO: 174011 - RNA, 63 nt, Homo Sapiens
ucacucuccucccuucuccaauuuggggggaaaugccuuaauucggugccuugguuucagcug

SEQ ID NO: 174012 - RNA, 63 nt, Homo Sapiens
aaugugcuuuauuuucucuuccagcuuggccuuugccuuaauacuuggccauguucugagcgg

SEQ ID NO: 174013 - RNA, 63 nt, Homo Sapiens
auggccacaucugggcugcucucgaugcuucuuugccuuaaugacccggggaguggugggcau

SEQ ID NO: 174014 - RNA, 63 nt, Homo Sapiens
uguggaguguaccguggggccgucuaaccaugaugccuuaacaccccuugucgcugucggucc

SEQ ID NO: 174015 - RNA, 63 nt, Homo Sapiens
gcauauuucaacuguucuucauaaauguuuaugugccuuaaaagacuuuauguuaaaggauua

SEQ ID NO: 174016 - RNA, 63 nt, Homo Sapiens
aaaguguuaccaguuuacaaaaauaagucuuuuugccuuaagucauuuuggaaauaaguaaua

SEQ ID NO: 174017 - RNA, 63 nt, Homo Sapiens
ccgaggagcgagaggaauguccauuucuuaaacugccuuaauaacuagccuuuaaccuguggg

SEQ ID NO: 174018 - RNA, 63 nt, Homo Sapiens
gcuguacauacccuccuuuccuucuaccuaucuugccuuaauuaacauucccugugaccuagu

SEQ ID NO: 174019 - RNA, 63 nt, Homo Sapiens
ucaguuaauauuuuccugucaucaaauaaauguugccuuaacugauaauaugauuauaaggaa

SEQ ID NO: 174020 - RNA, 63 nt, Homo Sapiens
gauuugaaguaagaacauaaguaaaaauagaauugccuuaaaggcauagaaauugaagaauuu

SEQ ID NO: 174021 - RNA, 63 nt, Homo Sapiens
cuuuaaucccacuugccccuuucuuaauauaacugccuuaaaauccggaauccuguccucagc

SEQ ID NO: 174022 - RNA, 63 nt, Homo Sapiens
ggugggcgccccgaccacgacuuggcuuccuugugccuuaaaaaaccugccuuccugcagcca

SEQ ID NO: 174023 - RNA, 63 nt, Homo Sapiens
cgccccacuucuagcugcuucuccucuuguuucugccuuaauaauucccacggccacaggcaa

SEQ ID NO: 174024 - RNA, 63 nt, Homo Sapiens
ggacucgcugccaggggcugccacacuccugaaugccuuaacauuucuuccauggccccacac

SEQ ID NO: 174025 - RNA, 63 nt, Homo Sapiens
agggccccggccugggacucagcauuucugauaugccuuaagaauucauucuguuuuguacaa

SEQ ID NO: 174026 - RNA, 63 nt, Homo Sapiens
auuuuguaaaauuauccugcacaucaagcugcaugccuuaaagcggaaacucuaggacugugu

SEQ ID NO: 174027 - RNA, 63 nt, Homo Sapiens
uaguugggucuauuagcucagauugagagguguugccuuaaaacugaguugggugacuuggua

SEQ ID NO: 174028 - RNA, 63 nt, Homo Sapiens
agucacccacacguaguggcguucauccguugcugccuuaacaauaaguaguaucugcagugu

SEQ ID NO: 174029 - RNA, 63 nt, Homo Sapiens
auaaaaagcggagaaauggagagaagaaaaaaaugccuuaacuacaaaacauacacuuuguca

SEQ ID NO: 174030 - RNA, 63 nt, Homo Sapiens
aacuucacccacaacugcauugguauucaguauugccuuaauauaagccuuguugaaaugcuc

SEQ ID NO: 174031 - RNA, 63 nt, Homo Sapiens
ucugagagucugcgcuuggcggccaagggcagcugccuuaaccuggaaggugagccuuuuccu

SEQ ID NO: 174032 - RNA, 63 nt, Homo Sapiens
agcucaggccacuaucacaauuuguuuuuaaucugccuuaaugauuuuuaguuuuuuuguuug

SEQ ID NO: 174033 - RNA, 63 nt, Homo Sapiens
gcugggccccaggcccugcuccuccccuucugaugccuuaaaacggggucccugccgcagccc

SEQ ID NO: 174034 - RNA, 63 nt, Homo Sapiens
gcucugugacacagucuaccgaccuugauugugugccuuaacccauccccuuccuagcuguau

SEQ ID NO: 174035 - RNA, 63 nt, Homo Sapiens
aacccgccgcgugcccaggugacacaaaagacgugccuuaagggagccgcagcugcaaacucu

SEQ ID NO: 174036 - RNA, 63 nt, Homo Sapiens
ggaaauauaaacaaaauuuauaaaauauauauuugccuuaaauuauguauaugugugugugua

SEQ ID NO: 174037 - RNA, 63 nt, Homo Sapiens
acauguuccugcugcagauacauaagugaucugugccuuaacguccugaaccacaaaccauag

SEQ ID NO: 174038 - RNA, 63 nt, Homo Sapiens
agacucuguuucugggagucuaucuauuccaaaugccuuaacgugggucuuccugaauuaauu

SEQ ID NO: 174039 - RNA, 63 nt, Homo Sapiens
ccccuaugcccuggaggugaaugcuucuuuugcugccuuaagccugugugccccgcacccccc

SEQ ID NO: 174040 - RNA, 63 nt, Homo Sapiens
agaaauaaaagaugugaacuccugcgggugcuuugccuuaaaaggggacggggcggggcuuga

SEQ ID NO: 174041 - RNA, 63 nt, Homo Sapiens
ggcccucguccacccaagguccaccuccacaggugccuuaaagcagcucccgccccucgcccc

SEQ ID NO: 174042 - RNA, 63 nt, Homo Sapiens
gacaaguagcaacauggcuuuuugugcgcuuccugccuuaaguaauaaccuuucaucacuucc

SEQ ID NO: 174043 - RNA, 63 nt, Homo Sapiens
ccuagguuuccucuccagccaacggggcgucgcugccuuaaugggaggagcacucggaagggu

SEQ ID NO: 174044 - RNA, 63 nt, Homo Sapiens
gaccaaaagucucagcacacuuaccuccgauuaugccuuaaagaguugauugugaagaaccag

SEQ ID NO: 174045 - RNA, 63 nt, Homo Sapiens
aaugugaaaucagagaauguuguaauaaguaaaugccuuaagaguauuuaaaauaugcuucca

SEQ ID NO: 174046 - RNA, 63 nt, Homo Sapiens
cacaugaacucacaaaggagaggcccucauucuugccuuaaaacugccccuaaagccaagccu

SEQ ID NO: 174047 - RNA, 63 nt, Homo Sapiens
acugccuaaagucacagcacagauacugcccagugccuuaagaggagacaugaucucuaccag

SEQ ID NO: 174048 - RNA, 63 nt, Homo Sapiens
uauguuagagagguagcgagcugcucugcuauaugccuuaagccaauauuuacucaucagguc

SEQ ID NO: 174049 - RNA, 63 nt, Homo Sapiens
gaggaaaucaaagugcuauuagaguacacugccugccuuaaguucacuguuuagauuugccau

SEQ ID NO: 174050 - RNA, 63 nt, Homo Sapiens
uuccucuguuuuucacauucuagaguuaccaucugccuuaaauaauacucgugugacucuucu

SEQ ID NO: 174051 - RNA, 63 nt, Homo Sapiens
aaaacugcauugcugauucacuuucccuaauucugccuuaaauggggaguggaggggcauagc

SEQ ID NO: 174052 - RNA, 63 nt, Homo Sapiens
aagugcucugugggguccgaugaaggcuucaguugccuuaauaagaccccccauuuauuugua

SEQ ID NO: 174053 - RNA, 63 nt, Homo Sapiens
ccacacuggcaucucccugacaaguguuagaauugccuuaaggcuguuacaaaacgagauaag

SEQ ID NO: 174054 - RNA, 63 nt, Homo Sapiens
cuuuaaauuguauauauuuauaucaucugguuuugccuuaacuggcuucuguuguauuugaag

SEQ ID NO: 174055 - RNA, 63 nt, Homo Sapiens
ucccuauucagaaagcuccauacucagcaggugugccuuaaccuacacaagaaauauuuguuu

SEQ ID NO: 174056 - RNA, 63 nt, Homo Sapiens
guauuuaacaggugccucguguugagauuacgcugccuuaauguaacacagucuggcaguugc

SEQ ID NO: 174057 - RNA, 63 nt, Homo Sapiens
uuuaaccaguuuccaauaaaauaaagcuuggagugccuuaauuacuguaaccucaaggaaacc

SEQ ID NO: 174058 - RNA, 63 nt, Homo Sapiens
aacagacauugauucccuuauuuuaugagcaucugccuuaauaaaaauguuacugaaagucac

SEQ ID NO: 174059 - RNA, 63 nt, Homo Sapiens
ugggauucuuuuuucuccugugguggauaaaucugccuuaaaaaucaauguaacuugggggcu

SEQ ID NO: 174060 - RNA, 63 nt, Homo Sapiens
gagcuggcacugaaccaggcugcaagauuugacugccuuaaaaacacaaggcccucuaggccu

SEQ ID NO: 174061 - RNA, 63 nt, Homo Sapiens
ccagguggcccaggaguaccgucucaucuccauugccuuaaugccgguguuggcucuagacug

SEQ ID NO: 174062 - RNA, 61 nt, Homo Sapiens
cugaggcucgacuccuucgucuaaauucccuccugccuuaauucuuccuuccccagcucca

SEQ ID NO: 174063 - RNA, 63 nt, Homo Sapiens
uuccuaccuagcuccuuguuggugagcuucuugugccuuaauccugugacccagccccuuaca

SEQ ID NO: 174064 - RNA, 63 nt, Homo Sapiens
aaaccuggaauuguggggcaaucuauuaauagcugccuuaaagucaguaacuuacccuuaggg

SEQ ID NO: 174065 - RNA, 63 nt, Homo Sapiens
guguuugaaaaagaagggggggagaauuccaggugccuuaauauaaaguuugaagcuucaucc

SEQ ID NO: 174066 - RNA, 63 nt, Homo Sapiens
caguucuugagguauauuauuuuaaucauuccaugccuuaauaugcuugcaauacaagaauau

SEQ ID NO: 174067 - RNA, 63 nt, Homo Sapiens
acuaauauucugcaaaugucucuuggaacacacugccuuaaacagauauuucuauagcuguca

SEQ ID NO: 174068 - RNA, 63 nt, Homo Sapiens
uuggauuuuuuuucccucaggucugaguagcauugccuuaaaucuuauccaguuagaacauug

SEQ ID NO: 174069 - RNA, 63 nt, Homo Sapiens
agcuuucagugacccauuuuccugucuagacucugccuuaagcuaguggcaacugcuggggcc

SEQ ID NO: 174070 - RNA, 63 nt, Homo Sapiens
aggcccggcuguggcuccaccuccagcucuccgugccuuaagggaaaagcgggacagcuccca

SEQ ID NO: 174071 - RNA, 63 nt, Homo Sapiens
gugaacugauaugcaggaaaggaaagccugaaaugccuuaauuucagaugagaauuagcauca

SEQ ID NO: 174072 - RNA, 63 nt, Homo Sapiens
aaugauagaagauauauauguuguuuuuuauuuugccuuaaguuggguuauuauuuugcaguu

SEQ ID NO: 174073 - RNA, 63 nt, Homo Sapiens
aguauuugcuuuaaauuucugaaaugucagcuuugccuuaaugccaauuuucauuauucuuga

SEQ ID NO: 174074 - RNA, 63 nt, Homo Sapiens
ugggaccaaccugaccuaacacuuaagcuccccugccuuaaccacacugcagggaggaguggu

SEQ ID NO: 174075 - RNA, 63 nt, Homo Sapiens
agacucuucauuuacuuuuccuuucauaugaagugccuuaaguuugugaaaauuuugaauuag

SEQ ID NO: 174076 - RNA, 63 nt, Homo Sapiens
agcaauccucugucaaaaucagaagauguguagugccuuaacaauaguuaaucauuuaaccaa

SEQ ID NO: 174077 - RNA, 63 nt, Homo Sapiens
ugacaugaggcccauucuuccacuaguuuccccugccuuaauggcaccuuccagggcuccguc

SEQ ID NO: 174078 - RNA, 63 nt, Homo Sapiens
ucagaugagcauuagcaucaggaaagccugaaaugccuuaauugugaacugauacgcaggaaa

SEQ ID NO: 174079 - RNA, 64 nt, Homo Sapiens
cccaccuaccaccagaggccugcagccucccacaugccuuaaggggaccguggcccccaccagg

SEQ ID NO: 174080 - RNA, 64 nt, Homo Sapiens
gcagagguggcagggauggcuccgaagccagaaaugccuuaaacugcaacgucccgucccuucc

SEQ ID NO: 174081 - RNA, 64 nt, Homo Sapiens
uggacagagucucucauggaugccggcacaaaacugccuuaaaauauucauaguuaauacaggu

SEQ ID NO: 174082 - RNA, 64 nt, Homo Sapiens
ccaucuuugcuacuuuccuagagaacccggcuguugccuuaaaugugugagagggacuuggcca

SEQ ID NO: 174083 - RNA, 64 nt, Homo Sapiens
aagaaucacaaaagaagugaaaagggccgguuccugccuuaacugaugacauuccaccauugug

SEQ ID NO: 174084 - RNA, 64 nt, Homo Sapiens
ucacuuaccuuauuuaaaauaaaucaauaaagcuugccuuaaauuauuuuuauaugacuguugg

SEQ ID NO: 174085 - RNA, 64 nt, Homo Sapiens
ugguuauuauggaugauaguuauagcccuuauaaugccuuaacuaaggaagaaaagauguuauu

SEQ ID NO: 174086 - RNA, 64 nt, Homo Sapiens
aggcuucaccauacuguaagcauuuuagguagauugccuuaaagguuaugggagggcaugaggg

SEQ ID NO: 174087 - RNA, 64 nt, Homo Sapiens
uuuucuucugguguauuuugcacagacaagcaucugccuuaaaauauauacacuuguacaaaaa

SEQ ID NO: 174088 - RNA, 64 nt, Homo Sapiens
uuuuuuuuuuuccuuucaacuuaguugacauacgugccuuaaaaaggaaaacuaguguugcuau

SEQ ID NO: 174089 - RNA, 64 nt, Homo Sapiens
ucugacaaauaaauaugucauccugaauuaauaaugccuuaauaaaaguacauccuccugcuaa

SEQ ID NO: 174090 - RNA, 64 nt, Homo Sapiens
cacuggaaguuuuucaugauaacuuauuuuaagaugccuuaaaaaucuuaaagucacaaaagga

SEQ ID NO: 174091 - RNA, 64 nt, Homo Sapiens
uuuucucucauuucccauggaaggacuucggaaaugccuuaaguuccccucuuuauccugccca

SEQ ID NO: 174092 - RNA, 64 nt, Homo Sapiens
uaauuuuggagguuggggugcaaucuuuagaauaugccuuaaaaggccgggcgcgguggcucac

SEQ ID NO: 174093 - RNA, 64 nt, Homo Sapiens
ugauaugaauaugccuuauaugcugauaugaauaugccuuaaaauaaaguguuccccaccccug

SEQ ID NO: 174094 - RNA, 64 nt, Homo Sapiens
cuuccuuuucccugcuuccaggaaacuccacaucugccuuaaaaccaaagagggcuuccucuag

SEQ ID NO: 174095 - RNA, 64 nt, Homo Sapiens
gugcccugccccucuggccacugcugcagacaccugccuuaacacacacaccucuaggacucca

SEQ ID NO: 174096 - RNA, 64 nt, Homo Sapiens
ccuuaacacacacaccucuaggacuccacaguuuugccuuaaaggaccuucccaagucucccuu

SEQ ID NO: 174097 - RNA, 64 nt, Homo Sapiens
gaaacauuccuuucaccaucauuuagaaaugguuugccuuaauggagacaauagcagauccugu

SEQ ID NO: 174098 - RNA, 64 nt, Homo Sapiens
gugaguucuaaaaggcaugcccacaucucuuucgugccuuaaggauagugagaugcacacuuau

SEQ ID NO: 174099 - RNA, 64 nt, Homo Sapiens
gaguucccugcugaagccccuagcacacacugcaugccuuaacaagugugugcaagccccucag

SEQ ID NO: 174100 - RNA, 64 nt, Homo Sapiens
uucaaaaacagagcccauucuuaagaucacuuggugccuuaaagacacgcauuccaaaguggaa

SEQ ID NO: 174101 - RNA, 64 nt, Homo Sapiens
gaagaauguggauacucuuaggcgugaauguaaaugccuuaauauugaagguccugguuagaag

SEQ ID NO: 174102 - RNA, 64 nt, Homo Sapiens
uggaccuuuuauaugugccuucacuuuagcuguuugccuuaaucucuacagccuugcucuccgg

SEQ ID NO: 174103 - RNA, 64 nt, Homo Sapiens
gaggcuguguguccaaggauggugcugaaaucacugccuuaaggucucugcugugcagaaugag

SEQ ID NO: 174104 - RNA, 64 nt, Homo Sapiens
uauuuaaauuggaucuugaaagaugaauaaggccugccuuaaguucugcuaaaggccauguugu

SEQ ID NO: 174105 - RNA, 64 nt, Homo Sapiens
cagcccccgcccagcucaucagucugaauggaguugccuuaaauuggcaggugguaccguacuc

SEQ ID NO: 174106 - RNA, 64 nt, Homo Sapiens
ucucugauuuugugcuacuccuuuguaaagucacugccuuaagggggcugauggcgccaccugu

SEQ ID NO: 174107 - RNA, 64 nt, Homo Sapiens
uucuugaugauccucaaggaaauacaaccuagggugccuuaaaaauaacaacaacaaaaaaccu

SEQ ID NO: 174108 - RNA, 64 nt, Homo Sapiens
gaaccaagucauuacaugucaaauucaauuuuucugccuuaagaaugaauguccuucauaaaau

SEQ ID NO: 174109 - RNA, 64 nt, Homo Sapiens
ugucccaggaccccugacagauggcguggcugguugccuuaauaaagucccuugugcuggccag

SEQ ID NO: 174110 - RNA, 64 nt, Homo Sapiens
uuaguuuguucacagggaggucucauuccauuucugccuuaacuuuuuuuuucuuucauuuuuc

SEQ ID NO: 174111 - RNA, 64 nt, Homo Sapiens
ucucucuaccacacugccuuccaaauuuaaaucuugccuuaaauaaaagguucaagcaccuuuu

SEQ ID NO: 174112 - RNA, 64 nt, Homo Sapiens
cuuuccucuguugcugaccaguaaugccucuuacugccuuaaguccagcacuauggugcucucu

SEQ ID NO: 174113 - RNA, 64 nt, Homo Sapiens
uaauuaugugaggccacuuguucagcucaagagaugccuuaagacaauuaccagccccaccugu

SEQ ID NO: 174114 - RNA, 64 nt, Homo Sapiens
cuugggagaggagcacucaguauuucccccucccugccuuaaaaggcuaaaagggcuguacagu

SEQ ID NO: 174115 - RNA, 64 nt, Homo Sapiens
auuauccccaauugcuucagaucagauuugguuuugccuuaaauuuaaaauauguguauauuuu

SEQ ID NO: 174116 - RNA, 64 nt, Homo Sapiens
auaucccauauauuuaauauugccuuacuucucuugccuuaaauaaaagggcacucauuuggau

SEQ ID NO: 174117 - RNA, 64 nt, Homo Sapiens
accuauagcaagcuguuucuugacuccuggcauuugccuuaaggagacuguucuacaguuucuu

SEQ ID NO: 174118 - RNA, 64 nt, Homo Sapiens
uuuagucuuuagaacucuagaagauuauaauaugugccuuaaguuagcuuuuaauagugucaua

SEQ ID NO: 174119 - RNA, 64 nt, Homo Sapiens
cgccccucggggcucccccaccuuccagccaagcugccuuaacucggacucccacuccccgcuc

SEQ ID NO: 174120 - RNA, 64 nt, Homo Sapiens
uauuugugaaguuaaaauuucuuagaggugaccuugccuuaauaucaggaauacauauucacug

SEQ ID NO: 174121 - RNA, 64 nt, Homo Sapiens
cuuaaagauuguaugcauauuaaaauugggagcaugccuuaaaaagaauuuauaacagguuagc

SEQ ID NO: 174122 - RNA, 64 nt, Homo Sapiens
agagucaggagaccccaaggagaugccucuucugugccuuaagccccacuccacuuuccuccac

SEQ ID NO: 174123 - RNA, 64 nt, Homo Sapiens
uauguuuuauggagauuauauauguugcuuuacaugccuuaauaauuucauaaagcuggcucuu

SEQ ID NO: 174124 - RNA, 64 nt, Homo Sapiens
auauuacuauauauuuucccaaaaguuugccaugugccuuaaacuuuucuugcaauuuaaugcc

SEQ ID NO: 174125 - RNA, 64 nt, Homo Sapiens
uauaccaaagauuacuaauuggauuuuuuugaugugccuuaaaugucagauauuugagaauagg

SEQ ID NO: 174126 - RNA, 64 nt, Homo Sapiens
guuuguaccaaaacaguccuucaacuuugcacugugccuuaaguaauuacuaacaaaagguacu

SEQ ID NO: 174127 - RNA, 64 nt, Homo Sapiens
ccccaguuuuuguggcucaaggcuggaauauuuaugccuuaauauaucuauggcagacauuuaa

SEQ ID NO: 174128 - RNA, 64 nt, Homo Sapiens
caugucaaaaaaaaaaaaaaaaaaaaaaaaguccugccuuaacuaacuccucugcgcuuguuca

SEQ ID NO: 174129 - RNA, 64 nt, Homo Sapiens
uauaaauguacuacauuugcaugccuuuuggguuugccuuaauucuuaccucauuugcauccua

SEQ ID NO: 174130 - RNA, 64 nt, Homo Sapiens
cauguuugagucucuuaacugauggaugcccacuugccuuaaagcagcauacuuauuuuuuguu

SEQ ID NO: 174131 - RNA, 64 nt, Homo Sapiens
uacaguauuacagcuuugcauuuggggguuuuacugccuuaacuuucaaugcuuguuaugggaa

SEQ ID NO: 174132 - RNA, 64 nt, Homo Sapiens
acugcucaucugacuguuuuguacaugugacaauugccuuaaaaccuagcacaguccucagaaa

SEQ ID NO: 174133 - RNA, 64 nt, Homo Sapiens
ucccgcagaccugccuccagagcaaggagaauucugccuuaaucuguugggcuccagucuccgg

SEQ ID NO: 174134 - RNA, 64 nt, Homo Sapiens
acagccaagguggacguaccucuccaggagccuuugccuuaauguaucucugccuggacaacuu

SEQ ID NO: 174135 - RNA, 64 nt, Homo Sapiens
gcucgggagacuuuucugugcuccuuucuacacaugccuuaaaccuuccuuccuguggggugcc

SEQ ID NO: 174136 - RNA, 64 nt, Homo Sapiens
cuuaguguuuuaaaacaccucugcuuucugauguugccuuaauauucugcuauugcagcaauua

SEQ ID NO: 174137 - RNA, 64 nt, Homo Sapiens
uggugguuugcuuucuuuaccauaagcaaucccuugccuuaacucaucacccuuuuucacuaug

SEQ ID NO: 174138 - RNA, 64 nt, Homo Sapiens
aaaguaaugcuuuuccugagcuggaucccaguguugccuuaacagggugucugucgugccgcag

SEQ ID NO: 174139 - RNA, 64 nt, Homo Sapiens
agaaggcuaugacucccaagaggcagugaaccauugccuuaaauuaauagcagccucucaaguc

SEQ ID NO: 174140 - RNA, 64 nt, Homo Sapiens
gcuauauggcaccuaauuauuuuuucuuuuaaaaugccuuaaguugcagucucauuuugauaau

SEQ ID NO: 174141 - RNA, 64 nt, Homo Sapiens
cucagaaccuguuccaucuguaugccauuguucaugccuuaagaaaugcaaagauguacaauaa

SEQ ID NO: 174142 - RNA, 64 nt, Homo Sapiens
aaguuaauaauuuuuaaauuuuuuucuaauuuuaugccuuaaaauagguuucugauuacauaaa

SEQ ID NO: 174143 - RNA, 64 nt, Homo Sapiens
ugauaacuaaacuucauuucaguuuacuuuguuaugccuuaauauucugugucuuuugcaauua

SEQ ID NO: 174144 - RNA, 64 nt, Homo Sapiens
ucccugcaucauccaagcaaugaccucagacuucugccuuaaccagccccggggcuuggcuccc

SEQ ID NO: 174145 - RNA, 64 nt, Homo Sapiens
gggccccagcagcccuauggugaccgccacacugugccuuaaugucugccgggggcccaggcug

SEQ ID NO: 174146 - RNA, 64 nt, Homo Sapiens
uuauacucauggcuuggagucaaaauaaaguaacugccuuaaucgcuuaugccacuuccuuguu

SEQ ID NO: 174147 - RNA, 64 nt, Homo Sapiens
uuuuaaugaaaugcaaauuuuuacuuuuacuuuuugccuuaaauguuugaccuauguauggaac

SEQ ID NO: 174148 - RNA, 64 nt, Homo Sapiens
ccucuauuuccuaaaauauuccaaaugaaugucuugccuuaaacauagagagaaauuaacuuuu

SEQ ID NO: 174149 - RNA, 64 nt, Homo Sapiens
uaauuuuuuucaaagucucauuacccauuuugaaugccuuaauuaugcuucaugauaggcaacu

SEQ ID NO: 174150 - RNA, 64 nt, Homo Sapiens
gucccagguauugagaauaaaauucauuauugaaugccuuaaauccaaaauaaggcacagcuuu

SEQ ID NO: 174151 - RNA, 64 nt, Homo Sapiens
ggaaugcauauggauaaaguuuggacaaugaaaaugccuuaaaaugauguacauguugagauau

SEQ ID NO: 174152 - RNA, 64 nt, Homo Sapiens
cccugacaguucaucuuccuuagguggcacuguuugccuuaauauuugaauaaagcuucgcuuc

SEQ ID NO: 174153 - RNA, 64 nt, Homo Sapiens
gaugacauuccaccauugugaaauagccaguuccugccuuaacuaagauccacaaaagaaguga

SEQ ID NO: 174154 - RNA, 64 nt, Homo Sapiens
agcuauucacuaauaacauagaauguuucuucucugccuuaaagccaacagcaccggauccaca

SEQ ID NO: 174155 - RNA, 64 nt, Homo Sapiens
gagccauuuauuuuuagagauuuugauggcaugcugccuuaaaaaucccauuagagguacuuuu

SEQ ID NO: 174156 - RNA, 64 nt, Homo Sapiens
cuuuugaugcuguagcuguuuaugaauuccaauuugccuuaacuugaagugucuuauccuuuuc

SEQ ID NO: 174157 - RNA, 64 nt, Homo Sapiens
guugaauaugcugcuuuagauuugaucuuuuuuuugccuuaagauuuauaauuuauaguaauuu

SEQ ID NO: 174158 - RNA, 64 nt, Homo Sapiens
cauacucugccgaucuaauucagaaagcuagauaugccuuaaaaagagagguuucugguauuca

SEQ ID NO: 174159 - RNA, 64 nt, Homo Sapiens
guuuauaugcacuuucauggccaagaugguacuuugccuuaacccaguuugcaacaugucugua

SEQ ID NO: 174160 - RNA, 64 nt, Homo Sapiens
gagcuccaguccuacucuugcuuuucugaaagauugccuuaagacaucacagaagaugcaacau

SEQ ID NO: 174161 - RNA, 64 nt, Homo Sapiens
aaagaauuuaaaaaaguuguaccguugggaccaaugccuuaauuaaaucccuuaaucuaugugc

SEQ ID NO: 174162 - RNA, 64 nt, Homo Sapiens
aaaaacaaacagcaggaaucagucugaggaacaaugccuuaagauuuguggcuggguuuucuga

SEQ ID NO: 174163 - RNA, 64 nt, Homo Sapiens
aagucucacaagaccuauaggaaaguuuaccaucugccuuaaauauuaaaauauccaucuguua

SEQ ID NO: 174164 - RNA, 64 nt, Homo Sapiens
cuuccacaggcuacaagcccugggaccaucuuucugccuuaagggcaggagcccacuucugugg

SEQ ID NO: 174165 - RNA, 64 nt, Homo Sapiens
aaauauguagguaagguuuaucuugaaucuuaauugccuuaauuuuaaggacgucaaaggcucu

SEQ ID NO: 174166 - RNA, 64 nt, Homo Sapiens
aaucccuucuacuucacuccucaggggagugaagugccuuaagaaacaaagcccuguccuaauu

SEQ ID NO: 174167 - RNA, 64 nt, Homo Sapiens
uuuauuuggaaaaguagucauuaaaugaacccacugccuuaaaugucuugaauguugcagucaa

SEQ ID NO: 174168 - RNA, 64 nt, Homo Sapiens
acaauguccuaacugaaagaugaucauuuguaguugccuuaaaauaaugaauacauuuccaaaa

SEQ ID NO: 174169 - RNA, 64 nt, Homo Sapiens
gcaagugaagaguuugccuguacucuuaucugggugccuuaaggagagagauuguguucuuccu

SEQ ID NO: 174170 - RNA, 64 nt, Homo Sapiens
aggccuguggucagcagcuacugaugguuuuuucugccuuaaaccguguguguguccaucauca

SEQ ID NO: 174171 - RNA, 64 nt, Homo Sapiens
uuuccauuuuauaaauguauugauucauugguacugccuuaaagauacaguaccccucuagcuu

SEQ ID NO: 174172 - RNA, 64 nt, Homo Sapiens
caaguggcauaaagcauauccauucagaaugaagugccuuaaauauagcaguagucuuuuuugg

SEQ ID NO: 174173 - RNA, 64 nt, Homo Sapiens
caaguccaauaagacacucaaauaugaguacaaaugccuuaaaauggaauugaaaaacucuuua

SEQ ID NO: 174174 - RNA, 64 nt, Homo Sapiens
acagcucaacaacuagaaaaauaaacuguuuaccugccuuaauuauuuaucuuuaguuccuuau

SEQ ID NO: 174175 - RNA, 64 nt, Homo Sapiens
gggcuuggagggaaauacauuuuaggaggaguuuugccuuaauuuuuuaaguacugcaccaaaa

SEQ ID NO: 174176 - RNA, 64 nt, Homo Sapiens
guucuacagaugaaucuguaagccaguuacaguuugccuuaacucauagacaucaaucagagag

SEQ ID NO: 174177 - RNA, 64 nt, Homo Sapiens
ccacagguuucuuuaaagcuguguuaacauaucuugccuuaaaauguguguguguguuuuugcu

SEQ ID NO: 174178 - RNA, 64 nt, Homo Sapiens
uuuuggguggaugaguuuuauuuucuuuuaaagcugccuuaauuccauuuuuauuuugcauuuu

SEQ ID NO: 174179 - RNA, 64 nt, Homo Sapiens
ucuuaacuucuccccauuucccccaucuuuugguugccuuaaaagaaaucucuagcucagauaa

SEQ ID NO: 174180 - RNA, 64 nt, Homo Sapiens
auuaagcuuuagaauaaugcgcaauuucauguuaugccuuaaguccaaaaagguaaacuuugaa

SEQ ID NO: 174181 - RNA, 64 nt, Homo Sapiens
aagaagaaaaguauuuaaaagaaauaccagugagugccuuaaaguuggagaaguaacugcccau

SEQ ID NO: 174182 - RNA, 64 nt, Homo Sapiens
ugaucggagaugcuuuguaaacagauugaucaucugccuuaacggaggaguuacagaugcagcc

SEQ ID NO: 174183 - RNA, 64 nt, Homo Sapiens
aaguguauguaagcaguaguuuuuuaaauaaaguugccuuaaauuaauuuacuacauauauuga

SEQ ID NO: 174184 - RNA, 64 nt, Homo Sapiens
uacccccuuuuuuguuuguguauauauauggcuuugccuuaauauuugucuauacauauauaua

SEQ ID NO: 174185 - RNA, 64 nt, Homo Sapiens
ugagcucguauuuaccccugacaagccacaaaaaugccuuaauuguagaaugccauuccagagg

SEQ ID NO: 174186 - RNA, 64 nt, Homo Sapiens
cuaccucccacacucccaaggccugggacuuccaugccuuaaacgugugacauuuggagagggg

SEQ ID NO: 174187 - RNA, 64 nt, Homo Sapiens
acauccugcaccguguauaacuuggugagacuguugccuuaaugauccgagcccugugcaugga

SEQ ID NO: 174188 - RNA, 64 nt, Homo Sapiens
cuucauaugaggaggauguccacaguacagcaugugccuuaauggaggucagggagugcuggcu

SEQ ID NO: 174189 - RNA, 64 nt, Homo Sapiens
cauggcuggaauuuauagagggaaauaguucuggugccuuaacguuuaauuuuggagggggugg

SEQ ID NO: 174190 - RNA, 64 nt, Homo Sapiens
uugaauauacuguuuaccucguguuuuuaccauuugccuuaauaugcauuaauauaccauccau

SEQ ID NO: 174191 - RNA, 64 nt, Homo Sapiens
ggcuguuucuuaaagguguuaguuacacaguguaugccuuaaaaguauagcaggaaauacgaag

SEQ ID NO: 174192 - RNA, 64 nt, Homo Sapiens
agucucucaagugaugagacagaaauggguuucuugccuuaaccugaaaacaaaaaaaauguua

SEQ ID NO: 174193 - RNA, 64 nt, Homo Sapiens
augaucaugguucagaauauaaauguauuugaagugccuuaaaguacuuaaauuuaguggucag

SEQ ID NO: 174194 - RNA, 64 nt, Homo Sapiens
gcuaauagaaaaacagguaagaauaaagcaauguugccuuaauuucaaaagcugcuauuuuaga

SEQ ID NO: 174195 - RNA, 64 nt, Homo Sapiens
aagguagauccccaauauuuuggaauaccaaaauugccuuaaaaauucccuucuguuucuuaca

SEQ ID NO: 174196 - RNA, 64 nt, Homo Sapiens
cugacuaacuuaaaaaaauagauuguaauugaugugccuuaauuugcauaaaucauaaauguau

SEQ ID NO: 174197 - RNA, 64 nt, Homo Sapiens
guuguagaacuuucuuuuuaaggugaauaagucaugccuuaacauccaaauaagaguucaucuu

SEQ ID NO: 174198 - RNA, 64 nt, Homo Sapiens
uuugucuauuucuuaauuuuaaaauaugcugauaugccuuaaacuguaguuguagauccuuguc

SEQ ID NO: 174199 - RNA, 64 nt, Homo Sapiens
uaguuaugaguaaaucugcaaaaggcaaugaaaaugccuuaaauuuuaucaauaacagaauuau

SEQ ID NO: 174200 - RNA, 64 nt, Homo Sapiens
agcugaguaauucuaaucucuucuguguuuuccuugccuuaaccacaaauuguggugcuuuuug

SEQ ID NO: 174201 - RNA, 64 nt, Homo Sapiens
cacaauguauguccucagugguaccuauuauugaugccuuaaauguauugauaaggugacuagu

SEQ ID NO: 174202 - RNA, 64 nt, Homo Sapiens
uuucauuuguugguacauauuacacaaaacauugugccuuaaaaugagucauacaucuuuuaaa

SEQ ID NO: 174203 - RNA, 64 nt, Homo Sapiens
uuaccacauauuauuuuuauauuaauucaacauuugccuuaaguguguuguuaaaugaaaguac

SEQ ID NO: 174204 - RNA, 64 nt, Homo Sapiens
uguuuuuauauuaaaucauaaggaaggaacuacuugccuuaaauguuaauaucaaaagaguuuu

SEQ ID NO: 174205 - RNA, 64 nt, Homo Sapiens
auuauuaguucacuucccugcugccaugaaacuuugccuuaagaaggugcuggauuccaagguu

SEQ ID NO: 174206 - RNA, 64 nt, Homo Sapiens
uguucuggagagcgugcucacagaauaauuucacugccuuaauguuuuuuuaaaucuguauguu

SEQ ID NO: 174207 - RNA, 64 nt, Homo Sapiens
ccuuuugugguauaagcaaauccuugaauuaaacugccuuaacuucauagacguaguuuucgca

SEQ ID NO: 174208 - RNA, 64 nt, Homo Sapiens
auaaauaguaccuuuggaaucucacuuuuaaaacugccuuaaguaaaggcuuuuugguuaagac

SEQ ID NO: 174209 - RNA, 64 nt, Homo Sapiens
uauguauucuauaaugauuucuuuugagacuuagugccuuaaaaaaguauaacaggugccuuca

SEQ ID NO: 174210 - RNA, 64 nt, Homo Sapiens
aaaaaaaaaaaaaguucauggccuagcagagaacugccuuaaaacaaauguuuuaaaguuuaau

SEQ ID NO: 174211 - RNA, 64 nt, Homo Sapiens
uucccuguguuguuccacacgcccagaagaacuuugccuuaaguaccggaagugacugcccgcu

SEQ ID NO: 174212 - RNA, 64 nt, Homo Sapiens
uuaagaaacguuuauuguaacaguaauuaaaugcugccuuaauugaagggguuuggguggauuu

SEQ ID NO: 174213 - RNA, 64 nt, Homo Sapiens
uugauuguagaggguccaccacagaauuaugggaugccuuaagugcuguuacuagguugcucac

SEQ ID NO: 174214 - RNA, 64 nt, Homo Sapiens
aaauguuuuauuucuguuaguaugaacaauagacugccuuaacaaaguuuuuuuuuaaacaaaa

SEQ ID NO: 174215 - RNA, 64 nt, Homo Sapiens
gucaaaucacugcagucaugaaauacugaacaauugccuuaagucuuugcuugacucacuggga

SEQ ID NO: 174216 - RNA, 64 nt, Homo Sapiens
uuuauuuuauggagcuuugcccuugaugcacugaugccuuaaaaauuaacaaggucauucagaa

SEQ ID NO: 174217 - RNA, 64 nt, Homo Sapiens
aaugccucaccagcagaagaacagaauaucaggaugccuuaaauuuauaguaguagacuguaaa

SEQ ID NO: 174218 - RNA, 64 nt, Homo Sapiens
accaucucuguucaaagagggggaaaugugccuaugccuuaagucaaugcacucagcaaggaga

SEQ ID NO: 174219 - RNA, 64 nt, Homo Sapiens
cacuuuucuugacuugccuguuuuggccauuagcugccuuaaacguuaacagcacauuugaaug

SEQ ID NO: 174220 - RNA, 64 nt, Homo Sapiens
uguggaaccaacacuaaucgaaagcagccggaagugccuuaacuggaggaaccacgcugccacc

SEQ ID NO: 174221 - RNA, 64 nt, Homo Sapiens
aaggaggggaggaaccacgcucuuagaggacacaugccuuaaaaaguuuccaaagcuuuacuac

SEQ ID NO: 174222 - RNA, 64 nt, Homo Sapiens
guuacuagcgaggucaguguuguuccgucuugauugccuuaagagcaucugggggccaaacaca

SEQ ID NO: 174223 - RNA, 64 nt, Homo Sapiens
uauaguuauguauagauacccagcacuucaguccugccuuaagugucuauauuucuaucuuuaa

SEQ ID NO: 174224 - RNA, 64 nt, Homo Sapiens
uauaaaggagggaagagguaagaguaaauggacuugccuuaauuugccuauguagcaggcacuu

SEQ ID NO: 174225 - RNA, 64 nt, Homo Sapiens
uuaaccaauauuuucuucuguggucccagggcugugccuuaacuaaaacauagcugcaggucuu

SEQ ID NO: 174226 - RNA, 64 nt, Homo Sapiens
cuguucauuuuuucaaguccaguccuaacgucuuugccuuaauucugccucagacugaaaagcu

SEQ ID NO: 174227 - RNA, 64 nt, Homo Sapiens
uguuugcuaguuguguacaucccauugcaaugguugccuuaagguccgcccugcaaguuaaccc

SEQ ID NO: 174228 - RNA, 64 nt, Homo Sapiens
gguagaauauuuagaaauuuuaaugcaaacucuuugccuuaaaugccuauuuucugacguuucu

SEQ ID NO: 174229 - RNA, 64 nt, Homo Sapiens
gagaauuucuaaaugauuuuccuaauucugugggugccuuaagugaauugaguauugugggucc

SEQ ID NO: 174230 - RNA, 64 nt, Homo Sapiens
aauuuggcaaucagaauuaauccuuuuuuauaccugccuuaaauaaaauguauauugaaugcuu

SEQ ID NO: 174231 - RNA, 64 nt, Homo Sapiens
gcaggcaaaaaccagucauuguguuaauuugaaaugccuuaaugauacagacaucaguuccaug

SEQ ID NO: 174232 - RNA, 64 nt, Homo Sapiens
cugucuccucucuguuacucggguccauguuugcugccuuaaccgcuguuguauuaccaaagca

SEQ ID NO: 174233 - RNA, 64 nt, Homo Sapiens
aaagucgaauuaauagcuuuuuaauaagaaugguugccuuaaaguuucaucaaaagugacugcc

SEQ ID NO: 174234 - RNA, 51 nt, Homo Sapiens; identical to SEQ ID NO: 173793

SEQ ID NO: 174235 - RNA, 64 nt, Homo Sapiens
ccuccucccacugccccugaucauuccugcucccugccuuaacuucacccacuuaguuucuuuu

SEQ ID NO: 174236 - RNA, 64 nt, Homo Sapiens
acacauugcagcuucaacuugaucugcugggcucugccuuaaacuuggcacauggguggacacg

SEQ ID NO: 174237 - RNA, 64 nt, Homo Sapiens
cuggcuccuggcccgagccugggcuggcaaugguugccuuaaccuggcccugcauuucugggua

SEQ ID NO: 174238 - RNA, 64 nt, Homo Sapiens
aaucccugaaagaaauaaaauacacugugcucaaugccuuaauacauuucacuuggcuagaaau

SEQ ID NO: 174239 - RNA, 64 nt, Homo Sapiens
gaggaagaugaauuuuuaaaaucuccaucaaacgugccuuaaagcuaaagcauuuugacaggag

SEQ ID NO: 174240 - RNA, 64 nt, Homo Sapiens
cugcgcgggaggccacagcccgugccgauuccagugccuuaacuacuuaccggaucccuccaua

SEQ ID NO: 174241 - RNA, 64 nt, Homo Sapiens
acacacauucugccuuggauuccuagauuacaucugccuuaaaaaaacacggaagcacaguugg

SEQ ID NO: 174242 - RNA, 64 nt, Homo Sapiens
acuuuacugagauuucugaguauacuuuucauauugccuuaauguagcaguaauguguuuaugc

SEQ ID NO: 174243 - RNA, 64 nt, Homo Sapiens
acaaauccuuuggccugagaacuaauauguuaauugccuuaaauaaauuaauagaaaucuaguc

SEQ ID NO: 174244 - RNA, 64 nt, Homo Sapiens
cuugacaguauauuugaaacuguaaauauguuugugccuuaaaaggagagaagaaaguguagau

SEQ ID NO: 174245 - RNA, 64 nt, Homo Sapiens
uauaaguauuugccuaaaaccauaaaauaggaauugccuuaaggaucuaguaguuuauaaugcc

SEQ ID NO: 174246 - RNA, 64 nt, Homo Sapiens
ccugucuuugcuuucuuuuuuuuuuucuuuuugaugccuuaauguagauaucuuuaucauucug

SEQ ID NO: 174247 - RNA, 59 nt, Homo Sapiens; identical to SEQ ID NO: 173806

SEQ ID NO: 174248 - RNA, 64 nt, Homo Sapiens
guuuggcaaacagaauguucauacugauguguugugccuuaaagacaagacagcauuugugugu

SEQ ID NO: 174249 - RNA, 64 nt, Homo Sapiens
ggggagacagaaacugugguugauagccagucacugccuuaagaacauuugaugcaagauggcc

SEQ ID NO: 174250 - RNA, 64 nt, Homo Sapiens
agaccgcugcugcugcugccgcuacugcugcugcugccuuaaguaggaagagagggaaggacac

SEQ ID NO: 174251 - RNA, 64 nt, Homo Sapiens
uuucauaauugcuuucuagcaaucagcuuuuauuugccuuaauauaagcuuuuaagcaguuauc

SEQ ID NO: 174252 - RNA, 64 nt, Homo Sapiens
augucccuuuuuaagccuuaccugagaggaacaaugccuuaaaauaaaaaagcauuaaugagau

SEQ ID NO: 174253 - RNA, 64 nt, Homo Sapiens
acaugacauauugugguuaauuuuaaaacuacugugccuuaacguguuucuuaaacuuuuguag

SEQ ID NO: 174254 - RNA, 64 nt, Homo Sapiens
gaaaucuuuauuaaucacguucucgaccagccucugccuuaaagggcagaagauaacagcagca

SEQ ID NO: 174255 - RNA, 64 nt, Homo Sapiens
ugaaguaaauuugguucuuucucuguguggaauuugccuuaaacgugcccgucucugagacagu

SEQ ID NO: 174256 - RNA, 64 nt, Homo Sapiens
uuguuugaaaugcagcgugacauuuggaugggccugccuuaacauuguucaucucuuaggcuuc

SEQ ID NO: 174257 - RNA, 64 nt, Homo Sapiens
cacccaucuuccaguaagcagcagccuucccuuuugccuuaagugggauuggggagcccaggag

SEQ ID NO: 174258 - RNA, 64 nt, Homo Sapiens
uuaaaucaugugauuuauagucaaguccaacaccugccuuaaaucuuagugcuggaguaaaagg

SEQ ID NO: 174259 - RNA, 64 nt, Homo Sapiens
gcaagagggaaggucaccaugccucacuuaugguugccuuaaagcaucucuauaugguacauuu

SEQ ID NO: 174260 - RNA, 64 nt, Homo Sapiens
uuuaaaaagcagggcccaaauagagaaacacacaugccuuaaaauuuguacaauguuguuaugg

SEQ ID NO: 174261 - RNA, 64 nt, Homo Sapiens
cuccuuguuuuagacacacuauacaguuccauauugccuuaaacgaaguuagugcaucaacggg

SEQ ID NO: 174262 - RNA, 64 nt, Homo Sapiens
guuuaaaaucucuggcuucauuaauguuuucaagugccuuaauuuugcacauuuguacauauac

SEQ ID NO: 174263 - RNA, 64 nt, Homo Sapiens
uauauuuguuuuagucaugaaacuucauaugguuugccuuaauauuuuuaaucugacaagcagu

SEQ ID NO: 174264 - RNA, 64 nt, Homo Sapiens
uuugaaaugugugaaauuuuuaguuggaaaaaguugccuuaauguauuuuuauaaaguacuguu

SEQ ID NO: 174265 - RNA, 64 nt, Homo Sapiens
aacuacacugcaccauguuaguaauaaacagaucugccuuaaagaaaagaaaauuuuagaaaga

SEQ ID NO: 174266 - RNA, 64 nt, Homo Sapiens
gugguguaaacuuguacauggaauuuuuugaauaugccuuaauuuagaaacugaaaaauaucug

SEQ ID NO: 174267 - RNA, 64 nt, Homo Sapiens
uacauaugguuuauuuugaaacuucaaguauuauugccuuaaugucucuuaacccuguuacacg

SEQ ID NO: 174268 - RNA, 64 nt, Homo Sapiens
gaggcauucuagaaaauaugaauuaguuuccaaaugccuuaauuuuaaacuuuggccugaacag

SEQ ID NO: 174269 - RNA, 64 nt, Homo Sapiens
guuggcagcuuauuccaguugaucucuucacaucugccuuaaaagugcuauguagagauacauu

SEQ ID NO: 174270 - RNA, 64 nt, Homo Sapiens
gucucccugaggacugagggugaacuucgcucuuugccuuaaaccucuuuauuucauugcagua

SEQ ID NO: 174271 - RNA, 64 nt, Homo Sapiens
cuggagagaggaaucuaguaagcccccucuuacuugccuuaaaagcgugaggcuccccagccac

SEQ ID NO: 174272 - RNA, 64 nt, Homo Sapiens
auaucuauaguauuuaacaggagggcuggaauuaugccuuaacucuugaccaaauaaguuuccu

SEQ ID NO: 174273 - RNA, 64 nt, Homo Sapiens
uaaugaaaaagaaaaguauauauuuuaucaaauuugccuuaaaauauacuuccucaccacugac

SEQ ID NO: 174274 - RNA, 64 nt, Homo Sapiens
acugcuugcauacugauuuauauucuuaaagcuuugccuuaaauuuuacaaaugaaauuuaaag

SEQ ID NO: 174275 - RNA, 64 nt, Homo Sapiens
gguuaucuaguauccuucaugaauaaauacauguugccuuaaagugagcaguucuaauaaugca

SEQ ID NO: 174276 - RNA, 64 nt, Homo Sapiens
uaucugccugagguuggccuuucuugccuauccuugccuuaaccgauaggguuaaaauagaccu

SEQ ID NO: 174277 - RNA, 64 nt, Homo Sapiens
guacuauuuucucgccaccauacgggguaagauuugccuuaacaccuguccugcugguaacugc

SEQ ID NO: 174278 - RNA, 64 nt, Homo Sapiens
augcacucuacuggggauuuuagcucuagccuucugccuuaagaagggugcugagauaagcaau

SEQ ID NO: 174279 - RNA, 64 nt, Homo Sapiens
auguuguggccaagccacauaagucagagaagggugccuuaaaaaugggaauaaaaauuugugc

SEQ ID NO: 174280 - RNA, 64 nt, Homo Sapiens
uaggaagguguuuccaaguuuuauccugauccugugccuuaaaguagcucguacauguggguuc

SEQ ID NO: 174281 - RNA, 64 nt, Homo Sapiens
uuguuugauucgccuuccuuuuuugacauauguaugccuuaauucuuaaaucugagggaccaug

SEQ ID NO: 174282 - RNA, 64 nt, Homo Sapiens
ugaggagcccuccuggagcucaggaggccgaggcugccuuaagcugugaucaugccacugcauu

SEQ ID NO: 174283 - RNA, 64 nt, Homo Sapiens
gaacaaaagcucagguuuguccuggucaugcacaugccuuaagccaguuccgucuucccuagac

SEQ ID NO: 174284 - RNA, 64 nt, Homo Sapiens
gcugcagugagcuaugauugcaccacuguacuccugccuuaaaaaaaaaaaaaaaaucccaaua

SEQ ID NO: 174285 - RNA, 64 nt, Homo Sapiens
uuuaaaggauaguaauuauucuuguuuauaacagugccuuaagguaugauguauuucugaugga

SEQ ID NO: 174286 - RNA, 64 nt, Homo Sapiens
aacaccuccaguuaucaggaauacauuuuuuuacugccuuaaccuguagugcguagaauaugca

SEQ ID NO: 174287 - RNA, 64 nt, Homo Sapiens
agugcccuccccacaaugcaccugaauuuuacuuugccuuaagaaaaacugauuucaugcaggu

SEQ ID NO: 174288 - RNA, 64 nt, Homo Sapiens
guucccuguaugugaaacgggcauuuucuccucuugccuuaaaaugaucccccguuacuuccua

SEQ ID NO: 174289 - RNA, 64 nt, Homo Sapiens
uuugaacauaauagcuauucuuuauuuucuagguugccuuaauaagacuagagccuucuugagg

SEQ ID NO: 174290 - RNA, 64 nt, Homo Sapiens
aguauuccaaguuuacuccagacgcgaacucaggugccuuaaaaccauaggaagagaucugcca

SEQ ID NO: 174291 - RNA, 64 nt, Homo Sapiens
ugaagcuuauuuauaauagcuagguaaugacagaugccuuaauguugaauccaaaucuuuuuca

SEQ ID NO: 174292 - RNA, 64 nt, Homo Sapiens
guuuccuccauuugagaaaagacuugauccacuaugccuuaaugauaccaguuucaaacuuggu

SEQ ID NO: 174293 - RNA, 64 nt, Homo Sapiens
cucccgguucuggggacgcaucccgcaauaaagaugccuuaagucccaggaggccgugugagga

SEQ ID NO: 174294 - RNA, 64 nt, Homo Sapiens
acuauguacugccuuagugcugaugccuguguacugccuuaaauguaccuauggcaauuuagcu

SEQ ID NO: 174295 - RNA, 64 nt, Homo Sapiens
gaacuccauaccaucggccgggugugguggcucaugccuuaaucccagcacuuugggaggucaa

SEQ ID NO: 174296 - RNA, 64 nt, Homo Sapiens
auuucuucccuucucuaucuguugccccugauuuugccuuaaguucuugccugagugaucuccc

SEQ ID NO: 174297 - RNA, 64 nt, Homo Sapiens
gauugcagcauuucacuuggcuacuucauacccaugccuuaaagaggggcaguuucucaaaagc

SEQ ID NO: 174298 - RNA, 64 nt, Homo Sapiens
cauagccuaagugcuauaucgaucgucccggaugugccuuaagaaccgugaccucaucagucgc

SEQ ID NO: 174299 - RNA, 64 nt, Homo Sapiens
aaaaaaaaagauacaaagucugcauuugauauaaugccuuaauuacugggucuacaauuaaugu

SEQ ID NO: 174300 - RNA, 64 nt, Homo Sapiens
uagguuaggaaaaauuccacacaaccaaacagucugccuuaaaagugacccacauuuuuccaua

SEQ ID NO: 174301 - RNA, 64 nt, Homo Sapiens
gggucccucgcauucuuuuacuguaaacaaacaaugccuuaaauugugucuuguuuucuguucc

SEQ ID NO: 174302 - RNA, 64 nt, Homo Sapiens
uguagccauagaugugauuauguccacaccgggcugccuuaaucuguccugcuuggagagugac

SEQ ID NO: 174303 - RNA, 64 nt, Homo Sapiens
uuuucaucaaugucuuuguaaagcacaaauuaucugccuuaaaggggcucugggucggggaauc

SEQ ID NO: 174304 - RNA, 64 nt, Homo Sapiens
uuugcaugauaagcuaguuuacugacuuucuagaugccuuaauacucuaugacaauauauuuua

SEQ ID NO: 174305 - RNA, 64 nt, Homo Sapiens
gaaaucagacaaaugcccugugacuuuuccaaagugccuuaaaacucuuucuguccgcagaucc

SEQ ID NO: 174306 - RNA, 64 nt, Homo Sapiens
cucccuccucucucagcuguccccuuguagauacugccuuaacacuugcccuccugccacccuu

SEQ ID NO: 174307 - RNA, 64 nt, Homo Sapiens
guuguauuuuuauagacaugaugcauuuccaaacugccuuaaacgacguuguagaaauguacaa

SEQ ID NO: 174308 - RNA, 64 nt, Homo Sapiens
uacugaaauacaucauuuuagcaucuaucuccuuugccuuaauuauuuugcaccacuggucaua

SEQ ID NO: 174309 - RNA, 64 nt, Homo Sapiens
gcacagagguacugcccccaguucaacguaagugugccuuaauuuggugagcagccacugugca

SEQ ID NO: 174310 - RNA, 64 nt, Homo Sapiens
cuauaguccuauacaaaaauaaagguuauaaacuugccuuaaaacugugaggcucaaaugagcc

SEQ ID NO: 174311 - RNA, 64 nt, Homo Sapiens
gguuuucauaguuuaaguguuuugaaugauacugugccuuaauuuugcucuucugucuauaaau

SEQ ID NO: 174312 - RNA, 64 nt, Homo Sapiens
aauauguaauauaaauuuaaucuauauaguuccuugccuuaauaaagcagaacaaauguguuuu

SEQ ID NO: 174313 - RNA, 64 nt, Homo Sapiens
agaacaaauguguuuuucuauuuauucccaaguaugccuuaagcugcaauaauuuguacaaugg

SEQ ID NO: 174314 - RNA, 64 nt, Homo Sapiens
augcucagaacacuuacauuagcuuagccuagccugccuuaaacccuaaccuaccaaacaucau

SEQ ID NO: 174315 - RNA, 64 nt, Homo Sapiens
uuugcaacaggguggaaguucagauuccuuucacugccuuaaucauaauagauccaguguuuuu

SEQ ID NO: 174316 - RNA, 64 nt, Homo Sapiens
gcagagaagcgaggcggauguccccccuugcuugugccuuaaagggagccacugagggauguuu

SEQ ID NO: 174317 - RNA, 64 nt, Homo Sapiens
uccaucucaugucccucccccaucgcucgcugugugccuuaaacaggccagcaccucccuccuc

SEQ ID NO: 174318 - RNA, 64 nt, Homo Sapiens
ccucggggucugcccggccccccuugcccugcuuugccuuaaagcccggcccgggcugcguaca

SEQ ID NO: 174319 - RNA, 64 nt, Homo Sapiens
ccgagcuaagucugugugcagcauuaguacccgcugccuuaaaacucaaguuuacauuauucau

SEQ ID NO: 174320 - RNA, 64 nt, Homo Sapiens
uucuuauaauuuaucuuuauuuaaaagcuuagccugccuuaaaacuagagaucaacuuucucag

SEQ ID NO: 174321 - RNA, 64 nt, Homo Sapiens
caauggaagagcccagaugggugaagauugauuuugccuuaacucaagagaauuccuguucucc

SEQ ID NO: 174322 - RNA, 64 nt, Homo Sapiens
uguucuacuuaaaaugugaauuguacuucugagcugccuuaaugcaaggucauuuauauuuguu

SEQ ID NO: 174323 - RNA, 64 nt, Homo Sapiens
uaauaugaacauguacagcgugcauagggacucuugccuuaaggaguguaaacuugaucugcau

SEQ ID NO: 174324 - RNA, 57 nt, Homo Sapiens; identical to SEQ ID NO: 173883

SEQ ID NO: 174325 - RNA, 64 nt, Homo Sapiens
uaucuucccuaauuucuuuguauauauuuuguuaugccuuaaaggccaccugcuauacaguugu

SEQ ID NO: 174326 - RNA, 64 nt, Homo Sapiens
aaaagguuaagaugagaggguuggacaaaccugaugccuuaaggaggggcuuugguuccaaaac

SEQ ID NO: 174327 - RNA, 64 nt, Homo Sapiens
guuaaaaugaaaacuuugugucaugagugggaguugccuuaaauauggauauuaugcuuugaag

SEQ ID NO: 174328 - RNA, 64 nt, Homo Sapiens
aaacaaacaagaaaugucuuaaugaccaggcaaaugccuuaaguugcacgguuuggguauucuu

SEQ ID NO: 174329 - RNA, 64 nt, Homo Sapiens
cggguuacugcacaacuuuaugugucugcauucaugccuuaacugugcugugugugugcaugug

SEQ ID NO: 174330 - RNA, 64 nt, Homo Sapiens
ggagccccaucagcuccagcggcaaagccuucauugccuuaacuccuugagcccucuauggugu

SEQ ID NO: 174331 - RNA, 64 nt, Homo Sapiens
cuaauuuuauuuuguucucugcacauguuguuauugccuuaauucaggguaaugugcuugguuu

SEQ ID NO: 174332 - RNA, 64 nt, Homo Sapiens
cugaaugucuguagccaaaauaauuugugguaugugccuuaaacgucagugacagggcuucuug

SEQ ID NO: 174333 - RNA, 64 nt, Homo Sapiens
agcucucuagucuaacggucaguuuucauguccuugccuuaaagagcgagguauaaaaguacgc

SEQ ID NO: 174334 - RNA, 59 nt, Homo Sapiens; identical to SEQ ID NO: 173893

SEQ ID NO: 174335 - RNA, 64 nt, Homo Sapiens
cauuccuugaggacagaccuguccucuuaaaagaugccuuaaucccaagauaaaugguaccagc

SEQ ID NO: 174336 - RNA, 64 nt, Homo Sapiens
auugcuauuaauugaaauauuuuaguacagaaauugccuuaaaauauuacuacucauuucagug

SEQ ID NO: 174337 - RNA, 64 nt, Homo Sapiens
gugaacuucuuuaaagaaccauuaacuuuucugaugccuuaaaauuaauuaaaauguuugccac

SEQ ID NO: 174338 - RNA, 64 nt, Homo Sapiens
cccuccccugggccgcugaggccccgcgcaccugugccuuaaucuucccuccccugugcugccc

SEQ ID NO: 174339 - RNA, 64 nt, Homo Sapiens
acaccagucauacuggcucagggcccaccgcuaaugccuuaaugaaaucauuuuaacauuauau

SEQ ID NO: 174340 - RNA, 64 nt, Homo Sapiens
cuuuugguugaaauugaacauacucuagugaaugugccuuaaaaaucaagacacuaguucagag

SEQ ID NO: 174341 - RNA, 64 nt, Homo Sapiens
gguaguuguucauuucagccucuggauggcuggcugccuuaaacacaaucaauuucaaagcucc

SEQ ID NO: 174342 - RNA, 64 nt, Homo Sapiens
ugugcaauucuggaacauauuaauuaaaauaauaugccuuaacauauagugaauuucuaauucu

SEQ ID NO: 174343 - RNA, 64 nt, Homo Sapiens
ccacuuccgaaaaguuuacauucacuuggaaggcugccuuaaaguauaucucuuaucuaugacc

SEQ ID NO: 174344 - RNA, 64 nt, Homo Sapiens
guauuauugacuauagccaacuacagauggcauaugccuuaaagaugcauuuuucuauguauuu

SEQ ID NO: 174345 - RNA, 64 nt, Homo Sapiens
uuggaaaaauugucccgucugucacuuguuuuguugccuuaauaagcaucugaauguuugguug

SEQ ID NO: 174346 - RNA, 64 nt, Homo Sapiens
ccuucagcuucuuacguuuucugagcauccauugugccuuaacauuuucugcuuguccuuuggg

SEQ ID NO: 174347 - RNA, 64 nt, Homo Sapiens
acugaacuccggccugggugacagaaggaggcucugccuuaaaaaaaaaaaaaaaaaaaaccuc

SEQ ID NO: 174348 - RNA, 64 nt, Homo Sapiens
aacacuugccaaaacauuaagagaacuuugauucugccuuaagaggguauaaaacuaaaccauu

SEQ ID NO: 174349 - RNA, 64 nt, Homo Sapiens
acuaauucuggcaccccuuuguccgccucagcugugccuuaaggcaguugugccuuggugccuu

SEQ ID NO: 174350 - RNA, 64 nt, Homo Sapiens
acucaaugagaaucaugguauucaauuauuugggugccuuaaaaugucuuaauauaucuuaggc

SEQ ID NO: 174351 - RNA, 64 nt, Homo Sapiens
uuucauauauauauauuuuuaagucaacaguauuugccuuaagaguucguccagcccaugugca

SEQ ID NO: 174352 - RNA, 64 nt, Homo Sapiens
gcccccuacaaggggccccacagcccugaaugugugccuuaaaggggugcugguucacucugcc

SEQ ID NO: 174353 - RNA, 64 nt, Homo Sapiens
aaauaggaagggaagcuuuuuauuuauuaauucaugccuuaaaaaacugcuuugcaaugacauu

SEQ ID NO: 174354 - RNA, 64 nt, Homo Sapiens
uacaggacaaauaggcucuaaguccucuuccuugugccuuaacaggaaccccuuuaucccagga

SEQ ID NO: 174355 - RNA, 64 nt, Homo Sapiens
uucugggggagggggauuaggguugugaaccaacugccuuaaccccaaggucaccaaacaacuu

SEQ ID NO: 174356 - RNA, 64 nt, Homo Sapiens
uggggguggggagggguaaggcuuaagccaaaucugccuuaaaucugaggggccagcuugccag

SEQ ID NO: 174357 - RNA, 64 nt, Homo Sapiens
guuuucuuccccauuccuucuuuuauauuauuuaugccuuaaauguaucuuaaaacgugugccc

SEQ ID NO: 174358 - RNA, 64 nt, Homo Sapiens
uuuguugguuuuggcuuuaguauuuucccagagaugccuuaaccgucuagcugggugaaacccu

SEQ ID NO: 174359 - RNA, 64 nt, Homo Sapiens
aagcucucaaaauauuuuagcuuuuggaugcaggugccuuaaugcccagcuguauuauuuugau

SEQ ID NO: 174360 - RNA, 64 nt, Homo Sapiens
aauuggaugaaauuagcugcugagauugaguuucugccuuaaaaucugaaacaaaaaaagggac

SEQ ID NO: 174361 - RNA, 64 nt, Homo Sapiens
ucccuuuccuaaucuggcuuuuacauuuauuuugugccuuaaagauuaacuacaaagauaaaca

SEQ ID NO: 174362 - RNA, 64 nt, Homo Sapiens
ugggcuauuuggacucaggugggcccucugaacuugccuuaaacacucaccuucuagucuuggc

SEQ ID NO: 174363 - RNA, 64 nt, Homo Sapiens
uccccugaagccuaacacaguuccuaauguguuuugccuuaaccucuuuucucuucccacauug

SEQ ID NO: 174364 - RNA, 64 nt, Homo Sapiens
uuccauuucuuuuuucccaaacccucaaacagagugccuuaaaaaauuguuuuaucaggauaau

SEQ ID NO: 174365 - RNA, 64 nt, Homo Sapiens
gaaagaaggaacauuuccuauggugcugucucacugccuuaaaacagauuucuaugacaguuua

SEQ ID NO: 174366 - RNA, 64 nt, Homo Sapiens
aauaagccaaagccauguggaauuuuuguuuagaugccuuaacugugccacaccccacaacccc

SEQ ID NO: 174367 - RNA, 64 nt, Homo Sapiens
cugucuugagggaaggaagaggucuguucuguauugccuuaaguugauugagguuuguaggaga

SEQ ID NO: 174368 - RNA, 64 nt, Homo Sapiens
ccagugaagcaacugaguacaaauacacaaagcaugccuuaaacaaguuuuauuuuugcaaacu

SEQ ID NO: 174369 - RNA, 64 nt, Homo Sapiens
uuguuuaauuaaauuuaacuauguuuuaaacacaugccuuaaauuaauguaaagaacuuaaauu

SEQ ID NO: 174370 - RNA, 64 nt, Homo Sapiens
caguaccccccuaccacacacucagaauauugucugccuuaaaguagcaauugacagagaauaa

SEQ ID NO: 174371 - RNA, 64 nt, Homo Sapiens
uagagggucggggaggagguugccuccccggaagugccuuaaccguaacaggaccccaaggacc

SEQ ID NO: 174372 - RNA, 64 nt, Homo Sapiens
aaggcucauacuguccuguccccuuuccccuaccugccuuaaccuuacuacauuucuuccacuc

SEQ ID NO: 174373 - RNA, 64 nt, Homo Sapiens
acauuccccucccaccucucagagauuacuuugcugccuuaaugguccuccuccaucuuucuac

SEQ ID NO: 174374 - RNA, 64 nt, Homo Sapiens
guggccucccuggggugggucaccucagcaucacugccuuaaucggccucccaaaaaggagccc

SEQ ID NO: 174375 - RNA, 64 nt, Homo Sapiens
agaccgauuuccugcccaccccuaccuugcucacugccuuaauccgaaucuguuucagagcucu

SEQ ID NO: 174376 - RNA, 64 nt, Homo Sapiens
ugccuucauaaauaaccauuuacuuugcaugauaugccuuaauaugacuuucuuuggcuaauuu

SEQ ID NO: 174377 - RNA, 64 nt, Homo Sapiens
gcuccuggccacuuggaaguuuuaaagcaggaccugccuuaacugcuacuuggcagcuaguaag

SEQ ID NO: 174378 - RNA, 64 nt, Homo Sapiens
uuaacuguucuuccuggcgcagaaaacgccucacugccuuaaccccuucagcugcuaagaucca

SEQ ID NO: 174379 - RNA, 64 nt, Homo Sapiens
acccuaacuugacaaaacagauuacaugucagaaugccuuaacuucuauuuugaaucaccuuua

SEQ ID NO: 174380 - RNA, 64 nt, Homo Sapiens
aacuggaagcuauacaauaccagauuuccucuccugccuuaaacugugauggaauaacaagggu

SEQ ID NO: 174381 - RNA, 64 nt, Homo Sapiens
cuagcaacuuagauaagugaaaguuuuucuaacaugccuuaaaaauauuaugguuugauccaaa

SEQ ID NO: 174382 - RNA, 64 nt, Homo Sapiens
gcaauuuuccaccucgcaguaguuaguauuuacuugccuuaaacuaacuuugaagcaaguaaug

SEQ ID NO: 174383 - RNA, 64 nt, Homo Sapiens
ucuguuacacuuuuuggaaggacaaaguuaccagugccuuaaacaguuuuaaucucuaacagug

SEQ ID NO: 174384 - RNA, 64 nt, Homo Sapiens
uuaagaggaaaauacaaaaauguagccauuucauugccuuaauuguaaaaauaaccuuaggaac

SEQ ID NO: 174385 - RNA, 64 nt, Homo Sapiens
uuaaguguccauuugugcagccagagcagaaugaugccuuaaucggauucacagaagcacuacu

SEQ ID NO: 174386 - RNA, 64 nt, Homo Sapiens
guauauacgugaaauacucaaccaaaaauuuagaugccuuaauauaaaauuauauacugaaaac

SEQ ID NO: 174387 - RNA, 64 nt, Homo Sapiens
auuuacaugauucucaauauaaauuuuuaucuauugccuuaaacuaaauuucacuggauuguau

SEQ ID NO: 174388 - RNA, 64 nt, Homo Sapiens
guuuacuguuucuucuguucggagaaagaugucuugccuuaaaauccuugcugcuagaguggga

SEQ ID NO: 174389 - RNA, 64 nt, Homo Sapiens
caucaucuggucacguuagaaaauacuuugcuuuugccuuaacaccaaaaaccugagggggaga

SEQ ID NO: 174390 - RNA, 64 nt, Homo Sapiens
uauauuauagaaacaguuuuguugauccccacacugccuuaaggaccauaucuccagggauguu

SEQ ID NO: 174391 - RNA, 64 nt, Homo Sapiens
aaaaaugaaaagagaaugauagaaagaauguuacugccuuaauauccccccuccgccuccagga

SEQ ID NO: 174392 - RNA, 64 nt, Homo Sapiens
cauuuuacuuggcuuauucauuuugggauaggguugccuuaaaaaauuaauaucuucaggaaua

SEQ ID NO: 174393 - RNA, 64 nt, Homo Sapiens
auggaacaaaauagaagcauugauaugcuaucauugccuuaauaaccauuucuuuuuuaagauc

SEQ ID NO: 174394 - RNA, 64 nt, Homo Sapiens
gacuacagagucaaagcucaucuaucagguuuugugccuuaagaaggccaccaguuaaaugccg

SEQ ID NO: 174395 - RNA, 56 nt, Homo Sapiens; identical to SEQ ID NO: 173954

SEQ ID NO: 174396 - RNA, 64 nt, Homo Sapiens
aaaaaaggauuaccuuuccuuguaaagaggaugcugccuuaagaauugcauguuguaaaaaauc

SEQ ID NO: 174397 - RNA, 64 nt, Homo Sapiens
uagaugaauacuaaaugguugucugggucaauacugccuuaaugagaacauuuacacauucuca

SEQ ID NO: 174398 - RNA, 64 nt, Homo Sapiens
ugguuauaaaaauguuaauucagaauuaguuuaaugccuuaauuaaacuaauuaauagcuuugg

SEQ ID NO: 174399 - RNA, 64 nt, Homo Sapiens
cuccauggcucuaaaauuuggaauuaacuucucuugccuuaagagcugcuuguacauaugugga

SEQ ID NO: 174400 - RNA, 64 nt, Homo Sapiens
uugggaaaaaauccuaaaaggugacuuaauuugaugccuuaaauucacaagugaggaagcuaag

SEQ ID NO: 174401 - RNA, 64 nt, Homo Sapiens
uuguagacuaaaccaaguauugcauuaguauguuugccuuaaacgauuucugaagaaaagcaaa

SEQ ID NO: 174402 - RNA, 64 nt, Homo Sapiens
agcagagcuaccuuacgugcgaagacagcagucaugccuuaagacaggguggggcccacuccau

SEQ ID NO: 174403 - RNA, 64 nt, Homo Sapiens
agacuuuuuaguccaaaauucacacugagacaugugccuuaaacguguguguguuuuuaauauu

SEQ ID NO: 174404 - RNA, 64 nt, Homo Sapiens
gugaaaccuucauggauaguuaaaaaaggguucuugccuuaaaaugaugccacauagucuugca

SEQ ID NO: 174405 - RNA, 64 nt, Homo Sapiens
gcagcugauucugagacaggccccugcagagggaugccuuaaagcugucccuggcuggaggagc

SEQ ID NO: 174406 - RNA, 64 nt, Homo Sapiens
gggcuguuccgucugauagauggaaggguaacauugccuuaaaacagaaauaugcaggcguugg

SEQ ID NO: 174407 - RNA, 64 nt, Homo Sapiens
ccgacacuuugucgacacugaaauaucgauuaagugccuuaaaaccucuuuagacauagcuaug

SEQ ID NO: 174408 - RNA, 64 nt, Homo Sapiens
uauuagacauacuguuuuuauaauguuuuacuucugccuuaagauuuagguuuuuuaaauguau

SEQ ID NO: 174409 - RNA, 64 nt, Homo Sapiens
ugugaacagaaguccuuaagcagaggaauuggugugccuuaaagauacaaucugggauaguuug

SEQ ID NO: 174410 - RNA, 64 nt, Homo Sapiens
aauuuuccauuauucuggacaugaauuucuaaaaugccuuaauagguuuauguaguugaguaaa

SEQ ID NO: 174411 - RNA, 64 nt, Homo Sapiens
uaacaguaugguacugcuucugugacaaauaucgugccuuaacaauguggcuguccuuuuccac

SEQ ID NO: 174412 - RNA, 64 nt, Homo Sapiens
uauaguuaauccguaaagguuuccaguuaauucaugccuuaaaaggcacugcaauuuuauuuuu

SEQ ID NO: 174413 - RNA, 64 nt, Homo Sapiens
acuuacuuuagauucuuauucuuuuauagcuauuugccuuaagagagagacuaaggauucuucu

SEQ ID NO: 174414 - RNA, 64 nt, Homo Sapiens
uagguaggcccagagucuuaaggguacugucaccugccuuaauguuuauuauguagaaugaaug

SEQ ID NO: 174415 - RNA, 64 nt, Homo Sapiens
uuucugagucucaauuaaaaucaccuaccauugaugccuuaaguacaggguauuaaucccuuug

SEQ ID NO: 174416 - RNA, 64 nt, Homo Sapiens
auacaaaaacagaaaugcaguuacgagauuuggcugccuuaagauguuuuguggggucugaggu

SEQ ID NO: 174417 - RNA, 64 nt, Homo Sapiens
caccuccccaggacuuacggcccacacuggucauugccuuaagcgggauggucugcucaagugg

SEQ ID NO: 174418 - RNA, 64 nt, Homo Sapiens
ucuacaacaguaucuuaauuauuuauaauaaaauugccuuaaucagggguggaauauaucagga

SEQ ID NO: 174419 - RNA, 60 nt, Homo Sapiens; identical to SEQ ID NO: 173978

SEQ ID NO: 174420 - RNA, 64 nt, Homo Sapiens
aauaugauaugccagagaugacagaaaauacuucugccuuaaaaaacacucuguaguaaccauu

SEQ ID NO: 174421 - RNA, 64 nt, Homo Sapiens
aauuuguuuucauuuagauuucucagaucaaaugugccuuaauaauuauaccagaaaguuaaau

SEQ ID NO: 174422 - RNA, 64 nt, Homo Sapiens
uuuuucgaccucgucuuucuagggaaguaacauuugccuuaaaucuugaucaauucccuugaau

SEQ ID NO: 174423 - RNA, 64 nt, Homo Sapiens
ggggugugaauagccguaacuugccugcaccugcugccuuaacaguggaguuggccaggcgcag

SEQ ID NO: 174424 - RNA, 64 nt, Homo Sapiens
aaacuuugagccaugcuaggagguaacuagucuaugccuuaacuccugaccuuuccugcauuag

SEQ ID NO: 174425 - RNA, 64 nt, Homo Sapiens
caucaucuuuucuaaauucaucuccauuaaaacuugccuuaagcuaccagauugcuuuugccac

SEQ ID NO: 174426 - RNA, 64 nt, Homo Sapiens
gcuaaguucagaagguacuuuguuuuuccucccuugccuuaaguccuugguauuuauaaucaau

SEQ ID NO: 174427 - RNA, 64 nt, Homo Sapiens
aacuuagaauuucauuauguuuuagaaucaucacugccuuaauauucaagcaucuauuuaaguc

SEQ ID NO: 174428 - RNA, 64 nt, Homo Sapiens
ucuugaacguacucauaaauaugacuuauuguauugccuuaaguuuucacucauugucuuuuga

SEQ ID NO: 174429 - RNA, 56 nt, Homo Sapiens; identical to SEQ ID NO: 173988

SEQ ID NO: 174430 - RNA, 64 nt, Homo Sapiens
cuuaccuggcaguggcuuuggaagagauaaaauuugccuuaaaaguccggcucagacugaauaa

SEQ ID NO: 174431 - RNA, 64 nt, Homo Sapiens
uugccugguuuguacauuuucccucguggggccuugccuuaaacugccagaaagccaacagcuc

SEQ ID NO: 174432 - RNA, 64 nt, Homo Sapiens
aguacuagacuggaccuucuaacugacacaacuuugccuuaaagcaaaaugucaaaauaaugag

SEQ ID NO: 174433 - RNA, 64 nt, Homo Sapiens
acugcacuccagccugggcaaccaagcgagacucugccuuaaaaaaaaaaaaaagaaaaugugg

SEQ ID NO: 174434 - RNA, 64 nt, Homo Sapiens
uuaacagaaacauuugaaauagaauuugcaugucugccuuaauuaacuuaaagacugauuuuaa

SEQ ID NO: 174435 - RNA, 64 nt, Homo Sapiens
uuuuuuuuuuuacucccccucuaaacacugcugcugccuuaauuuuagaaagcagcuuacuagu

SEQ ID NO: 174436 - RNA, 64 nt, Homo Sapiens
cacauaacuguggucaucucuguaguuuacuaacugccuuaaaauugcaugguucuuaauggca

SEQ ID NO: 174437 - RNA, 64 nt, Homo Sapiens
uauaaugaauuuuguuuguugaugugaaacauuaugccuuaaguaauguuaauucuuauuuaag

SEQ ID NO: 174438 - RNA, 64 nt, Homo Sapiens
gcuggugguugugccuuuuguaggcuguucccuuugccuuaaaccugaagaugucuccucaagc

SEQ ID NO: 174439 - RNA, 64 nt, Homo Sapiens
cccucccaggucugggcugugcaguuccucccccugccuuaaaacaccccacuaucucuguaaa

SEQ ID NO: 174440 - RNA, 64 nt, Homo Sapiens
guuuuaaacugcagaaauuggaguggauggguucugccuuaaauugggaggacuccaagccggg

SEQ ID NO: 174441 - RNA, 64 nt, Homo Sapiens
aauaaagguaacuuuaccuuucuuaaauauuuccugccuuaaagagagcauuuccaugacuuua

SEQ ID NO: 174442 - RNA, 64 nt, Homo Sapiens
aagaaacgcauguggaccagaagacuuucccugcugccuuaaaaccaauaaaagguuaacuuua

SEQ ID NO: 174443 - RNA, 64 nt, Homo Sapiens
gcagcugagcugcgcuggcucugggcagggagugugccuuaaugggaagcacacgggcuuugga

SEQ ID NO: 174444 - RNA, 64 nt, Homo Sapiens
ggauguuuuuaauggcauaacaaaggcaagacucugccuuaauuuuugaaaagcugcuaacuac

SEQ ID NO: 174445 - RNA, 64 nt, Homo Sapiens
uuaauuccucaggcuuugcgauuuaaggaggagcugccuuaaaaaaaaauaaaggccuuauuuu

SEQ ID NO: 174446 - RNA, 64 nt, Homo Sapiens
cacaaagacaagaaaaaucagggcauuuugugagugccuuaagaucaaacuaacaagaucugac

SEQ ID NO: 174447 - RNA, 64 nt, Homo Sapiens
cacaggggaggcagguccuuggcgagguagccccugccuuaauccacggggcuccuuucccucc

SEQ ID NO: 174448 - RNA, 64 nt, Homo Sapiens
auguccuuuuaggcugggcaugcccccuucuuucugccuuaagagggcugagaccacccuugcc

SEQ ID NO: 174449 - RNA, 64 nt, Homo Sapiens
aaaacacaccucucugcugucuuccagagucuugugccuuaaauaaauaaauacaaagcccauu

SEQ ID NO: 174450 - RNA, 64 nt, Homo Sapiens
acuuucuuuggaagaucauuccagaaguuacagaugccuuaaagagauaaaaacccugaaauuc

SEQ ID NO: 174451 - RNA, 64 nt, Homo Sapiens
gcuuuuaauuuuguuuuguucuuagggggagguuugccuuaaaguauaacaaaugacuuuuuuc

SEQ ID NO: 174452 - RNA, 64 nt, Homo Sapiens
ucacucuccucccuucuccagauuuggggggaaaugccuuaauuucggugccuugguuucagcu

SEQ ID NO: 174453 - RNA, 64 nt, Homo Sapiens
aaugugcuuuauuuucucuugccagcuuggccuuugccuuaauaccuuggccauguucugagcg

SEQ ID NO: 174454 - RNA, 64 nt, Homo Sapiens
auggccacaucugggcugcuucucgaugcuucuuugccuuaauguacccggggaguggugggca

SEQ ID NO: 174455 - RNA, 64 nt, Homo Sapiens
uguggaguguaccguggggcccgucuaaccaugaugccuuaacacccccuugucgcugucgguc

SEQ ID NO: 174456 - RNA, 64 nt, Homo Sapiens
agcauauuucaacuguucuucauaaauguuuaugugccuuaaaagacuuuauguuaaaggauua

SEQ ID NO: 174457 - RNA, 64 nt, Homo Sapiens
caaaguguuaccaguuuacaaaaauaagucuuuuugccuuaagucauuuuggaaauaaguaaua

SEQ ID NO: 174458 - RNA, 64 nt, Homo Sapiens
uccgaggagcgagaggaauguccauuucuuaaacugccuuaauaacuagccuuuaaccuguggg

SEQ ID NO: 174459 - RNA, 64 nt, Homo Sapiens
ugcuguacauacccuccuuuccuucuaccuaucuugccuuaauuaacauucccugugaccuagu

SEQ ID NO: 174460 - RNA, 64 nt, Homo Sapiens
ucaguuaauauuuuccugucaaucaaauaaauguugccuuaacuagauaauaugauuauaagga

SEQ ID NO: 174461 - RNA, 64 nt, Homo Sapiens
gauuugaaguaagaacauaauguaaaaauagaauugccuuaaagggcauagaaauugaagaauu

SEQ ID NO: 174462 - RNA, 64 nt, Homo Sapiens
cuuuaaucccacuugccccucuucuuaauauaacugccuuaaaauuccggaauccuguccucag

SEQ ID NO: 174463 - RNA, 64 nt, Homo Sapiens
aggugggcgccccgaccacgacuuggcuuccuugugccuuaaaaaaccugccuuccugcagcca

SEQ ID NO: 174464 - RNA, 64 nt, Homo Sapiens
ccgccccacuucuagcugcuucuccucuuguuucugccuuaauaauucccacggccacaggcaa

SEQ ID NO: 174465 - RNA, 64 nt, Homo Sapiens
gggacucgcugccaggggcugccacacuccugaaugccuuaacauuucuuccauggccccacac

SEQ ID NO: 174466 - RNA, 64 nt, Homo Sapiens
cagggccccggccugggacucagcauuucugauaugccuuaagaauucauucuguuuuguacaa

SEQ ID NO: 174467 - RNA, 64 nt, Homo Sapiens
cauuuuguaaaauuauccugcacaucaagcugcaugccuuaaagcggaaacucuaggacugugu

SEQ ID NO: 174468 - RNA, 64 nt, Homo Sapiens
uuaguugggucuauuagcucagauugagagguguugccuuaaaacugaguugggugacuuggua

SEQ ID NO: 174469 - RNA, 64 nt, Homo Sapiens
agucacccacacguaguggcuguucauccguugcugccuuaacacauaaguaguaucugcagug

SEQ ID NO: 174470 - RNA, 64 nt, Homo Sapiens
auaaaaagcggagaaauggaagagaagaaaaaaaugccuuaacuaacaaaacauacacuuuguc

SEQ ID NO: 174471 - RNA, 64 nt, Homo Sapiens
aacuucacccacaacugcaucugguauucaguauugccuuaauaguaagccuuguugaaaugcu

SEQ ID NO: 174472 - RNA, 64 nt, Homo Sapiens
ucugagagucugcgcuuggcuggccaagggcagcugccuuaacccuggaaggugagccuuuucc

SEQ ID NO: 174473 - RNA, 64 nt, Homo Sapiens
agcucaggccacuaucacaaguuuguuuuuaaucugccuuaaugcauuuuuaguuuuuuuguuu

SEQ ID NO: 174474 - RNA, 64 nt, Homo Sapiens
gcugggccccaggcccugcucccuccccuucugaugccuuaaaaccggggucccugccgcagcc

SEQ ID NO: 174475 - RNA, 64 nt, Homo Sapiens
gcucugugacacagucuaccugaccuugauugugugccuuaaccucauccccuuccuagcugua

SEQ ID NO: 174476 - RNA, 64 nt, Homo Sapiens
aacccgccgcgugcccagguugacacaaaagacgugccuuaaggggagccgcagcugcaaacuc

SEQ ID NO: 174477 - RNA, 64 nt, Homo Sapiens
ggaaauauaaacaaaauuuaauaaaauauauauuugccuuaaauauauguauaugugugugugu

SEQ ID NO: 174478 - RNA, 64 nt, Homo Sapiens
acauguuccugcugcagauagcauaagugaucugugccuuaacguuccugaaccacaaaccaua

SEQ ID NO: 174479 - RNA, 64 nt, Homo Sapiens
agacucuguuucugggagucuuaucuauuccaaaugccuuaacggugggucuuccugaauuaau

SEQ ID NO: 174480 - RNA, 64 nt, Homo Sapiens
ccccuaugcccuggaggugacaugcuucuuuugcugccuuaagcccugugugccccgcaccccc

SEQ ID NO: 174481 - RNA, 64 nt, Homo Sapiens
agaaauaaaagaugugaacuaccugcgggugcuuugccuuaaaagggggacggggcggggcuug

SEQ ID NO: 174482 - RNA, 64 nt, Homo Sapiens
ggcccucguccacccaaggucccaccuccacaggugccuuaaagccagcucccgccccucgccc

SEQ ID NO: 174483 - RNA, 64 nt, Homo Sapiens
gacaaguagcaacauggcuucuuugugcgcuuccugccuuaaguuaauaaccuuucaucacuuc

SEQ ID NO: 174484 - RNA, 64 nt, Homo Sapiens
cccuagguuuccucuccagccaacggggcgucgcugccuuaaugggaggagcacucggaagggu

SEQ ID NO: 174485 - RNA, 64 nt, Homo Sapiens
ggaccaaaagucucagcacacuuaccuccgauuaugccuuaaagaguugauugugaagaaccag

SEQ ID NO: 174486 - RNA, 64 nt, Homo Sapiens
uaaugugaaaucagagaauguuguaauaaguaaaugccuuaagaguauuuaaaauaugcuucca

SEQ ID NO: 174487 - RNA, 64 nt, Homo Sapiens
ccacaugaacucacaaaggagaggcccucauucuugccuuaaaacugccccuaaagccaagccu

SEQ ID NO: 174488 - RNA, 64 nt, Homo Sapiens
aacugccuaaagucacagcacagauacugcccagugccuuaagaggagacaugaucucuaccag

SEQ ID NO: 174489 - RNA, 64 nt, Homo Sapiens
uuauguuagagagguagcgagcugcucugcuauaugccuuaagccaauauuuacucaucagguc

SEQ ID NO: 174490 - RNA, 64 nt, Homo Sapiens
gaggaaaucaaagugcuauuuagaguacacugccugccuuaaguaucacuguuuagauuugcca

SEQ ID NO: 174491 - RNA, 64 nt, Homo Sapiens
uuccucuguuuuucacauucuuagaguuaccaucugccuuaaauuaauacucgugugacucuuc

SEQ ID NO: 174492 - RNA, 64 nt, Homo Sapiens
aaaacugcauugcugauucaccuuucccuaauucugccuuaaaugggggaguggaggggcauag

SEQ ID NO: 174493 - RNA, 64 nt, Homo Sapiens
aagugcucugugggguccgaaugaaggcuucaguugccuuaauacagaccccccauuuauuugu

SEQ ID NO: 174494 - RNA, 64 nt, Homo Sapiens
ccacacuggcaucucccugagcaaguguuagaauugccuuaaggucuguuacaaaacgagauaa

SEQ ID NO: 174495 - RNA, 64 nt, Homo Sapiens
cuuuaaauuguauauauuuaguaucaucugguuuugccuuaacuaggcuucuguuguauuugaa

SEQ ID NO: 174496 - RNA, 64 nt, Homo Sapiens
ucccuauucagaaagcuccauuacucagcaggugugccuuaacccuacacaagaaauauuuguu

SEQ ID NO: 174497 - RNA, 64 nt, Homo Sapiens
gguauuuaacaggugccucguguugagauuacgcugccuuaauguaacacagucuggcaguugc

SEQ ID NO: 174498 - RNA, 64 nt, Homo Sapiens
uuuaaccaguuuccaauaaacauaaagcuuggagugccuuaauuaacuguaaccucaaggaaac

SEQ ID NO: 174499 - RNA, 64 nt, Homo Sapiens
aacagacauugauucccuuacuuuuaugagcaucugccuuaauagaaaauguuacugaaaguca

SEQ ID NO: 174500 - RNA, 64 nt, Homo Sapiens
uugggauucuuuuuucuccugugguggauaaaucugccuuaaaaaucaauguaacuugggggcu

SEQ ID NO: 174501 - RNA, 64 nt, Homo Sapiens
ggagcuggcacugaaccaggcugcaagauuugacugccuuaaaaacacaaggcccucuaggccu

SEQ ID NO: 174502 - RNA, 64 nt, Homo Sapiens
ccagguggcccaggaguaccggucucaucuccauugccuuaaugaccgguguuggcucuagacu

SEQ ID NO: 174503 - RNA, 62 nt, Homo Sapiens
cugaggcucgacuccuucguacuaaauucccuccugccuuaauuucuuccuuccccagcucc

SEQ ID NO: 174504 - RNA, 64 nt, Homo Sapiens
cuuccuaccuagcuccuuguuggugagcuucuugugccuuaauccugugacccagccccuuaca

SEQ ID NO: 174505 - RNA, 64 nt, Homo Sapiens
gaaaccuggaauuguggggcaaucuauuaauagcugccuuaaagucaguaacuuacccuuaggg

SEQ ID NO: 174506 - RNA, 64 nt, Homo Sapiens
gguguuugaaaaagaagggggggagaauuccaggugccuuaauauaaaguuugaagcuucaucc

SEQ ID NO: 174507 - RNA, 64 nt, Homo Sapiens
ucaguucuugagguauauuauuuuaaucauuccaugccuuaauaugcuugcaauacaagaauau

SEQ ID NO: 174508 - RNA, 64 nt, Homo Sapiens
aacuaauauucugcaaaugucucuuggaacacacugccuuaaacagauauuucuauagcuguca

SEQ ID NO: 174509 - RNA, 64 nt, Homo Sapiens
uuuggauuuuuuuucccucaggucugaguagcauugccuuaaaucuuauccaguuagaacauug

SEQ ID NO: 174510 - RNA, 64 nt, Homo Sapiens
gagcuuucagugacccauuuuccugucuagacucugccuuaagcuaguggcaacugcuggggcc

SEQ ID NO: 174511 - RNA, 64 nt, Homo Sapiens
uaggcccggcuguggcuccaccuccagcucuccgugccuuaagggaaaagcgggacagcuccca

SEQ ID NO: 174512 - RNA, 64 nt, Homo Sapiens
gugaacugauaugcaggaaaaggaaagccugaaaugccuuaauucucagaugagaauuagcauc

SEQ ID NO: 174513 - RNA, 64 nt, Homo Sapiens
aaugauagaagauauauauguuuguuuuuuauuuugccuuaaguuuggguuauuauuuugcagu

SEQ ID NO: 174514 - RNA, 64 nt, Homo Sapiens
aguauuugcuuuaaauuucuagaaaugucagcuuugccuuaauguccaauuuucauuauucuug

SEQ ID NO: 174515 - RNA, 64 nt, Homo Sapiens
ugggaccaaccugaccuaacuacuuaagcuccccugccuuaacccacacugcagggaggagugg

SEQ ID NO: 174516 - RNA, 64 nt, Homo Sapiens
agacucuucauuuacuuuucgcuuucauaugaagugccuuaaguuuugugaaaauuuugaauua

SEQ ID NO: 174517 - RNA, 64 nt, Homo Sapiens
agcaauccucugucaaaaucaagaagauguguagugccuuaacaaauaguuaaucauuuaacca

SEQ ID NO: 174518 - RNA, 64 nt, Homo Sapiens
ugacaugaggcccauucuucccacuaguuuccccugccuuaaugugcaccuuccagggcuccgu

SEQ ID NO: 174519 - RNA, 64 nt, Homo Sapiens
cucagaugagcauuagcaucaggaaagccugaaaugccuuaauugugaacugauacgcaggaaa

SEQ ID NO: 174520 - RNA, 63 nt, Homo Sapiens
cugccuaacacaaaucugugauaacaacaggcugugccuuauuuugauaauuuucugauuccc

SEQ ID NO: 174521 - RNA, 63 nt, Homo Sapiens
cagacuuggguuuucucuuuggugguuucuaaagugccuuaucugcaaacaacuucuuuucuc

SEQ ID NO: 174522 - RNA, 63 nt, Homo Sapiens
cccccaggggacccugcccacuuccuggacuucgugccuuacugagucucuaagacuuuuucu

SEQ ID NO: 174523 - RNA, 63 nt, Homo Sapiens
uuuuuuuuuuuccuuucaacuuaguugacauacgugccuuaaaaaggaaaacuaguguugcua

SEQ ID NO: 174524 - RNA, 63 nt, Homo Sapiens
uuccuucccuuucuuccuccuucccuuauuguagugccuuauaugauaauguagugguuaaua

SEQ ID NO: 174525 - RNA, 63 nt, Homo Sapiens
cuuugccauuccuaccuugcauuuuuccugucagugccuuagccaaggcaaggagauaaggau

SEQ ID NO: 174526 - RNA, 63 nt, Homo Sapiens
uuucaucuuccaacucaaacucuuaaaacccaagugccuuagcaaauucuguuuuucuaggcc

SEQ ID NO: 174527 - RNA, 63 nt, Homo Sapiens
uucauugcacuuucccaccucuauaccuugccugugccuuaguguccucuuuuuuccaguuca

SEQ ID NO: 174528 - RNA, 63 nt, Homo Sapiens
cucuacuguccucauugacuuguuugaaccuuagugccuuacccuguccucuucccaguucuc

SEQ ID NO: 174529 - RNA, 63 nt, Homo Sapiens
gugaguucuaaaaggcaugcccacaucucuuucgugccuuaaggauagugagaugcacacuua

SEQ ID NO: 174530 - RNA, 63 nt, Homo Sapiens
uucaaaaacagagcccauucuuaagaucacuuggugccuuaaagacacgcauuccaaagugga

SEQ ID NO: 174531 - RNA, 63 nt, Homo Sapiens
gugugcagaaguuagaagggucuggcgggggcagugccuuacacaugcuugauucccacgcua

SEQ ID NO: 174532 - RNA, 63 nt, Homo Sapiens
cuuuuagagagguguuauacagggcgauuuuuggugccuuacuuuuaucuuaauuuuugccaa

SEQ ID NO: 174533 - RNA, 63 nt, Homo Sapiens
uaugcagccuuuuaccuaagaaauuuucugucagugccuuaucuuaugaagaaacagaaccuc

SEQ ID NO: 174534 - RNA, 63 nt, Homo Sapiens
agcaaggccuucucuccagacuaucguaaccuggugccuuaccaaguugugcuuuucuguuuu

SEQ ID NO: 174535 - RNA, 63 nt, Homo Sapiens
gucacugccuuaagggggcugauggcgccaccugugccuuacauccagguucaggcaucacua

SEQ ID NO: 174536 - RNA, 55 nt, Homo Sapiens
agaaagaauuccugucuuaaacuaagugccuuacuguuguuuaagcauuuuuuua

SEQ ID NO: 174537 - RNA, 63 nt, Homo Sapiens
uucuugaugauccucaaggaaauacaaccuagggugccuuaaaaauaacaacaacaaaaaacc

SEQ ID NO: 174538 - RNA, 63 nt, Homo Sapiens
gauugccauggacaccaguugcgaagggaaauagugccuuacuauauguggguugagcuaugc

SEQ ID NO: 174539 - RNA, 63 nt, Homo Sapiens
guggccucucacucccaccacucucuggucagugugccuuaggucagccuccucccuccaugc

SEQ ID NO: 174540 - RNA, 63 nt, Homo Sapiens
ugaaagcaacauguaucccugugaaaaguguuagugccuuaggcugcgcuggaagcauauccc

SEQ ID NO: 174541 - RNA, 63 nt, Homo Sapiens
cacuucagcuaugagccaaacugaggccuaucugugccuuaguggcagggagccaggaggcac

SEQ ID NO: 174542 - RNA, 63 nt, Homo Sapiens
aauccuaagcucagagaaagguaguuaauuucagugccuuacacaccacuccccaccccagcu

SEQ ID NO: 174543 - RNA, 63 nt, Homo Sapiens
aucauugugucucuuuuauccccuaugcuaagggugccuuagauaaaugucuauuuugaaauu

SEQ ID NO: 174544 - RNA, 63 nt, Homo Sapiens
uuuuagucuuuagaacucuaaagauuauaauaugugccuuaaguagcuuuuaauagugucaua

SEQ ID NO: 174545 - RNA, 63 nt, Homo Sapiens
uugcacuggaguucaagugcaauuaaaaacaaagugccuuauccauucuaaagagacugauag

SEQ ID NO: 174546 - RNA, 63 nt, Homo Sapiens
uugguuaugaguaaaaauuaucaggcucuauuugugccuuagccaaaagaccacuuuuaccac

SEQ ID NO: 174547 - RNA, 63 nt, Homo Sapiens
gucccaucugugggccucaucagagccaggguugugccuuauugccuuugacucccugaccuc

SEQ ID NO: 174548 - RNA, 63 nt, Homo Sapiens
aaaaauaaugaucucugucucuaagaaguuauugugccuuaugcaaucugaugucaaauagca

SEQ ID NO: 174549 - RNA, 63 nt, Homo Sapiens
cagagucaggagaccccaagagaugccucuucugugccuuaagcccacuccacuuuccuccac

SEQ ID NO: 174550 - RNA, 63 nt, Homo Sapiens
cauauuacuauauauuuuccaaaaguuugccaugugccuuaaauuuucuugcaauuuaaugcc

SEQ ID NO: 174551 - RNA, 63 nt, Homo Sapiens
uuauaccaaagauuacuaauggauuuuuuugaugugccuuaaagucagauauuugagaauagg

SEQ ID NO: 174552 - RNA, 58 nt, Homo Sapiens
uccuuuccaaguauuucacaagacaagagugccuuauuacuguaucgaacagaaauga

SEQ ID NO: 174553 - RNA, 63 nt, Homo Sapiens
guuuguaccaaaacaguccuucaacuuugcacugugccuuaaguaauuacuaacaaaagguac

SEQ ID NO: 174554 - RNA, 63 nt, Homo Sapiens
ccuugaauauguaaaugggauuaauuuuguccugugccuuauguggaaaggaacuucuuuggu

SEQ ID NO: 174555 - RNA, 63 nt, Homo Sapiens
auacgugcauguuuuccguacuuucagaauagagugccuuagcuaggccagaggcucguauug

SEQ ID NO: 174556 - RNA, 63 nt, Homo Sapiens
uuuacauuucuuuauacaaauaaugugcuuucagugccuuaguuacagcucccuuucuguuuc

SEQ ID NO: 174557 - RNA, 63 nt, Homo Sapiens
agguacagucaggggaaaauagaucuaggcagagugccuuagucagggaccacgggcgcugaa

SEQ ID NO: 174558 - RNA, 63 nt, Homo Sapiens
augugggugugaaaaugccuacaaaggguuuuagugccuuagaaguccuaagaagcccaaucu

SEQ ID NO: 174559 - RNA, 63 nt, Homo Sapiens
ugcacaguaucagaggagccuguuaaccucucugugccuuaguuucuuagcccaugaaagaga

SEQ ID NO: 174560 - RNA, 63 nt, Homo Sapiens
guuuuuucuucaguuaacaaaaucauaaauauggugccuuauaacaugaaaggaaaauuaguu

SEQ ID NO: 174561 - RNA, 63 nt, Homo Sapiens
ucauugcuuauguaguauuuuucuuuuggaaaugugccuuauguuaaacacuauguacuuuua

SEQ ID NO: 174562 - RNA, 63 nt, Homo Sapiens
gggccccagcagcccuauggugaccgccacacugugccuuaaugucugccgggggcccaggcu

SEQ ID NO: 174563 - RNA, 63 nt, Homo Sapiens
cuucucccgacccccagagccagggcagggcccgugccuuagaagggagaaggagccgugcgc

SEQ ID NO: 174564 - RNA, 63 nt, Homo Sapiens
caguguguacuuguguguguccccgcccuagcugugccuuaguccaaggggccuucugcccgc

SEQ ID NO: 174565 - RNA, 63 nt, Homo Sapiens
gguauucucagaacauuuuaguauuugcauucagugccuuacucauaauucauauuucaggug

SEQ ID NO: 174566 - RNA, 63 nt, Homo Sapiens
uugugauuuaaaagaaaucaguuuaauccaauggugccuuacuuaguaaaagccaggagaaau

SEQ ID NO: 174567 - RNA, 63 nt, Homo Sapiens
uaaaagggcauucuuaggacuuuccaaacaugagugccuuauuaauuuaguaguuacauccua

SEQ ID NO: 174568 - RNA, 63 nt, Homo Sapiens
gccauuucucuguguaauacaggcuuuagauuagugccuuauauugguuuugguuuggggcac

SEQ ID NO: 174569 - RNA, 63 nt, Homo Sapiens
cguggaggcugcuggaccuggucagagacugaugugccuuagcggcaaugguuagagcuuuuc

SEQ ID NO: 174570 - RNA, 63 nt, Homo Sapiens
aaucccuucuacuucacuccucaggggagugaagugccuuaagaaacaaagcccuguccuaau

SEQ ID NO: 174571 - RNA, 63 nt, Homo Sapiens
gcaagugaagaguuugccuguacucuuaucugggugccuuaaggagagagauuguguucuucc

SEQ ID NO: 174572 - RNA, 63 nt, Homo Sapiens
caaguggcauaaagcauauccauucagaaugaagugccuuaaauauagcaguagucuuuuuug

SEQ ID NO: 174573 - RNA, 63 nt, Homo Sapiens
ugaaggguugaagagugacaagcauugguaacagugccuuagaacugugucaguuagucugau

SEQ ID NO: 174574 - RNA, 63 nt, Homo Sapiens
acacugucuuuaauacccccagcccaggagcucgugccuuacaugcugggcccacauucugcc

SEQ ID NO: 174575 - RNA, 63 nt, Homo Sapiens
aagaagaaaaguauuuaaaagaaauaccagugagugccuuaaaguuggagaaguaacugccca

SEQ ID NO: 174576 - RNA, 63 nt, Homo Sapiens
gcuucauaugaggaggaugucacaguacagcaugugccuuaaugaggucagggagugcuggcu

SEQ ID NO: 174577 - RNA, 63 nt, Homo Sapiens
gcagguguguacaucucucaaacccuucucccugugccuuagagucuuggucuccccugugga

SEQ ID NO: 174578 - RNA, 63 nt, Homo Sapiens
gcauggcuggaauuuauagaggaaauaguucuggugccuuaacuuuaauuuuggagggggugg

SEQ ID NO: 174579 - RNA, 63 nt, Homo Sapiens
cucccaaguagcugggauuaucaagugauucuugugccuuagcgcaaccucugccuucuggau

SEQ ID NO: 174580 - RNA, 63 nt, Homo Sapiens
cuucuccacucugcacccuaguggcaguuacccgugccuuaguggucggcacuuugccacugu

SEQ ID NO: 174581 - RNA, 63 nt, Homo Sapiens
ccgaagccaggggaagaagccagaggagcaagggugccuuagauccagcaguccacuaucugc

SEQ ID NO: 174582 - RNA, 63 nt, Homo Sapiens
cuguuuuuucugauauggucuuucccaagaguggugccuuacuguuacugcaagcuaccuuaa

SEQ ID NO: 174583 - RNA, 63 nt, Homo Sapiens
aaugcuuuagaaucugaacucuuccagaacaccgugccuuagagccaacagaagcacauuugu

SEQ ID NO: 174584 - RNA, 63 nt, Homo Sapiens
cuuugcuuuuagucaaaccaaaauucauagcaggugccuuauuuucuguuuuaugguugugcu

SEQ ID NO: 174585 - RNA, 63 nt, Homo Sapiens
agcgugacaguucagcucucugugaaaugcucugugccuuagaaauauaaauguauguuggug

SEQ ID NO: 174586 - RNA, 63 nt, Homo Sapiens
gaugaucaugguucagaauaaaauguauuugaagugccuuaaauacuuaaauuuaguggucag

SEQ ID NO: 174587 - RNA, 63 nt, Homo Sapiens
cugacuaacuuaaaaaaauagauuguaauugaugugccuuaauuugcauaaaucauaaaugua

SEQ ID NO: 174588 - RNA, 63 nt, Homo Sapiens
cuuucacuggauaauguguguagauuuuuacaugugccuuauuugacaaugcuuaugucuugu

SEQ ID NO: 174589 - RNA, 63 nt, Homo Sapiens
ggaaaaaauggagugauguuguaaucuaaacaagugccuuauguuuauugcuaagaacuggug

SEQ ID NO: 174590 - RNA, 63 nt, Homo Sapiens
uuucauuuguugguacauauuacacaaaacauugugccuuaaaaugagucauacaucuuuuaa

SEQ ID NO: 174591 - RNA, 63 nt, Homo Sapiens
acugaucucucgugauugauaagaaccuuuugagugccuuacacaaugguuuucuuguguguu

SEQ ID NO: 174592 - RNA, 63 nt, Homo Sapiens
gcuguuaauucauuucccccaggacuagagacugugccuuauaguauaggaguucaccuucuu

SEQ ID NO: 174593 - RNA, 63 nt, Homo Sapiens
ggaaguuucugacuggaaaagcucuaucacagugugccuuaugaucacagaauccuuccaagu

SEQ ID NO: 174594 - RNA, 63 nt, Homo Sapiens
cuuacuaaauuuaaaucuuuaaaggcugcuuuagugccuuacgaggucuccaagagaaaauag

SEQ ID NO: 174595 - RNA, 63 nt, Homo Sapiens
auauguauucuauaaugauucuuuugagacuuagugccuuaaaaaguauaacaggugccuuca

SEQ ID NO: 174596 - RNA, 63 nt, Homo Sapiens
ucacuuaacauagacuugaaaucaauauuaauugugccuuauucuucccuuucccuaaaucaa

SEQ ID NO: 174597 - RNA, 63 nt, Homo Sapiens
aauaacauggaacuuacacaaaaggcuuuucaugugccuuacuuuuuuaaaaaggaguuuauu

SEQ ID NO: 174598 - RNA, 63 nt, Homo Sapiens
acaguuuaggaugcaauuacgaguguaaacugugugccuuauuuacacuuuauugucucccgc

SEQ ID NO: 174599 - RNA, 63 nt, Homo Sapiens
auuguuaaugguucuuacagaguaucuuuaaaagugccuuaggggaacccugucccuccuaac

SEQ ID NO: 174600 - RNA, 63 nt, Homo Sapiens
uuguggaaccaacacuaaucaaagcagccggaagugccuuaacggaggaaccacgcugccacc

SEQ ID NO: 174601 - RNA, 63 nt, Homo Sapiens
uuuaaccaauauuuucuucuuggucccagggcugugccuuaacaaaacauagcugcaggucuu

SEQ ID NO: 174602 - RNA, 63 nt, Homo Sapiens
ugagaauuucuaaaugauuuccuaauucugugggugccuuaaggaauugaguauugugggucc

SEQ ID NO: 174603 - RNA, 63 nt, Homo Sapiens
ccuugaguuguguacacuugcacauguaaauuugugccuuacaucugugaauagccuguuuuc

SEQ ID NO: 174604 - RNA, 63 nt, Homo Sapiens
gaggaagaugaauuuuuaaaaucuccaucaaacgugccuuaaagcuaaagcauuuugacagga

SEQ ID NO: 174605 - RNA, 63 nt, Homo Sapiens
cugcgcgggaggccacagcccgugccgauuccagugccuuaacuacuuaccggaucccuccau

SEQ ID NO: 174606 - RNA, 63 nt, Homo Sapiens
gggacgaugagacuuugaaacuaucucaugccagugccuuauuacccaggaagauuuuaaagg

SEQ ID NO: 174607 - RNA, 63 nt, Homo Sapiens
guuguaucuagaucuuugcucuguguuucaguugugccuuacccucuguaagauacugauucu

SEQ ID NO: 174608 - RNA, 63 nt, Homo Sapiens
cacaggguuccugagcucacugaaaagacuauugugccuuaggaaaagcauuugcuguguuuc

SEQ ID NO: 174609 - RNA, 63 nt, Homo Sapiens
cuugacaguauauuugaaacuguaaauauguuugugccuuaaaaggagagaagaaaguguaga

SEQ ID NO: 174610 - RNA, 63 nt, Homo Sapiens
guuuucuuccuuuuugugagauuuguggguuuugugccuuauaaauggaaauguaugaacaca

SEQ ID NO: 174611 - RNA, 63 nt, Homo Sapiens
guggaguguggggaagcugcugucucccaggaagugccuuacucaucccgcaaccagucagcg

SEQ ID NO: 174612 - RNA, 63 nt, Homo Sapiens
uaaaguauuuguuuuuauuuguaccauccacuugugccuuacuguauccugugucauguccaa

SEQ ID NO: 174613 - RNA, 63 nt, Homo Sapiens
guuuggcaaacagaauguucauacugauguguugugccuuaaagacaagacagcauuugugug

SEQ ID NO: 174614 - RNA, 63 nt, Homo Sapiens
ggcaaacaaggaaaggaaaggaaagaagaaaaggugccuuaguccuuuguugcacuuccauuu

SEQ ID NO: 174615 - RNA, 63 nt, Homo Sapiens
ugggcacuguacuuggaucuucccggcgugugugugccuuacacaggggugaacuguucacug

SEQ ID NO: 174616 - RNA, 63 nt, Homo Sapiens
accccugcggaggagcgcucccgucucccacaggugccuuaccgcguucccucccgcugcuuu

SEQ ID NO: 174617 - RNA, 63 nt, Homo Sapiens
acaugacauauugugguuaauuuuaaaacuacugugccuuaacguguuucuuaaacuuuugua

SEQ ID NO: 174618 - RNA, 63 nt, Homo Sapiens
ccagguuccugggcuucugcaugccaacucaaagugccuuagccacuucccgugcagacucag

SEQ ID NO: 174619 - RNA, 63 nt, Homo Sapiens
ggauuuggccuguccucaaggcuguuuuacuccgugccuuacuucacacauagccccccauca

SEQ ID NO: 174620 - RNA, 63 nt, Homo Sapiens
uguuuaaaaucucuggcuucuuaauguuuucaagugccuuaauuugcacauuuguacauauac

SEQ ID NO: 174621 - RNA, 63 nt, Homo Sapiens
agacagugaaagguaagcucaauauaaagaacagugccuuagaaagcaucuuaugucauugag

SEQ ID NO: 174622 - RNA, 63 nt, Homo Sapiens
ucagcccagcaggccaggcagacacaccccgcugugccuuaggaaggugugagaccggcuucc

SEQ ID NO: 174623 - RNA, 63 nt, Homo Sapiens
auuuaguuguuucuagacuauaaauguugcuaugugccuuauguugaaaaaauuuaaaaguaa

SEQ ID NO: 174624 - RNA, 63 nt, Homo Sapiens
uaagauaauucauacuggagaaaacucccagaagugccuuauugcacaggaaagcauuuauac

SEQ ID NO: 174625 - RNA, 63 nt, Homo Sapiens
gggcauuuccucuauucuguuacgucauuaacagugccuuacugugcaaggcaccaaaggaca

SEQ ID NO: 174626 - RNA, 63 nt, Homo Sapiens
acgagugaccacaguuuaaucuccaggccaagugugccuuagcgcuucccaaacaguaacuca

SEQ ID NO: 174627 - RNA, 63 nt, Homo Sapiens
aauguuguggccaagccacaaagucagagaagggugccuuaaaaugggaauaaaaauuugugc

SEQ ID NO: 174628 - RNA, 63 nt, Homo Sapiens
guaggaagguguuuccaaguuuauccugauccugugccuuaaauagcucguacauguggguuc

SEQ ID NO: 174629 - RNA, 63 nt, Homo Sapiens
cagaaguccuuuaucugugcucucugcccgccagugccuuacaauuugcaaacguguauagcc

SEQ ID NO: 174630 - RNA, 63 nt, Homo Sapiens
ccaguaaggaucuugcccucccugcaacaccgagugccuuagacagcugcugccugagaacug

SEQ ID NO: 174631 - RNA, 63 nt, Homo Sapiens
cugaucagagauuuacaacuguucauuauaguggugccuuaggcaaucuuuccaaaguaaauu

SEQ ID NO: 174632 - RNA, 63 nt, Homo Sapiens
uuuaaaggauaguaauuauucuuguuuauaacagugccuuaagguaugauguauuucugaugg

SEQ ID NO: 174633 - RNA, 63 nt, Homo Sapiens
uggaaauacuuuggcuuuuucauauaccuaguggugccuuaucauaauagcacuguuacauga

SEQ ID NO: 174634 - RNA, 63 nt, Homo Sapiens
uggugugugugugugugugucuauaauccaguggugccuuacagggcauuuguccccuccaug

SEQ ID NO: 174635 - RNA, 63 nt, Homo Sapiens
aaguauuccaaguuuacuccgacgcgaacucaggugccuuaaaccauaggaagagaucugcca

SEQ ID NO: 174636 - RNA, 63 nt, Homo Sapiens
uugguuaaaaaaaaaaaaaagaaauuucugguagugccuuagcuggccagaaucauuauccuu

SEQ ID NO: 174637 - RNA, 63 nt, Homo Sapiens
ugaguuuucgguauaaauauaaauucaugugccgugccuuaucgcaugaggcagcacgugcac

SEQ ID NO: 174638 - RNA, 63 nt, Homo Sapiens
aaauaugggaaugucuaacuacuagacuccauugugccuuacucuggaaauuaaaaaaaaaaa

SEQ ID NO: 174639 - RNA, 63 nt, Homo Sapiens
uacuuugguccucuauguauuuaaauguuugaagugccuuagacucuugccauauuuucaaaa

SEQ ID NO: 174640 - RNA, 63 nt, Homo Sapiens
gauguuacuuuuaguuuuaaaaugaaaucuuaggugccuuagggguuuuuuuuuuuuuuaagu

SEQ ID NO: 174641 - RNA, 63 nt, Homo Sapiens
cauagccuaagugcuauaucgaucgucccggaugugccuuaagaaccgugaccucaucagucg

SEQ ID NO: 174642 - RNA, 63 nt, Homo Sapiens
auggaaccuggacacccucagcucuccugcuuugugccuuaucuacaggagcaucgcccauug

SEQ ID NO: 174643 - RNA, 63 nt, Homo Sapiens
ggcuagagcuucuguauuuucaaagacugccacgugccuuaggaauacuguuuuaucuccaua

SEQ ID NO: 174644 - RNA, 63 nt, Homo Sapiens
ucuggauguccagcaccugagcguggaugcaccgugccuuaucaaagccagcaccacuuugcc

SEQ ID NO: 174645 - RNA, 63 nt, Homo Sapiens
ucuccauuacucucccugcccuucucuguuggggugccuuauccugagccaccuccucucccc

SEQ ID NO: 174646 - RNA, 63 nt, Homo Sapiens
ccuggcucugcccuucuuacugcaaaccaugcugugccuuagggcccuucucauagcuguucc

SEQ ID NO: 174647 - RNA, 63 nt, Homo Sapiens
agaaaucagacaaaugcccuugacuuuuccaaagugccuuaaacucuuucuguccgcagaucc

SEQ ID NO: 174648 - RNA, 63 nt, Homo Sapiens
ugcacagagguacugcccccguucaacguaagugugccuuaauuggugagcagccacugugca

SEQ ID NO: 174649 - RNA, 63 nt, Homo Sapiens
cauguuguucccuuugcucgccgucacacugcugugccuuaguccacagccccagcccugccc

SEQ ID NO: 174650 - RNA, 63 nt, Homo Sapiens
ugguuuucauaguuuaaguguuugaaugauacugugccuuaauuugcucuucugucuauaaau

SEQ ID NO: 174651 - RNA, 63 nt, Homo Sapiens
augugcuuaagauacaauagaauuucuuauuaugugccuuauugaauuacuguguauuuacuu

SEQ ID NO: 174652 - RNA, 63 nt, Homo Sapiens
gaugagaguacuaacuggaauuucacacuucaugugccuuacuaugaaauuuggggcccaaaa

SEQ ID NO: 174653 - RNA, 63 nt, Homo Sapiens
uccagagagucuuuuuuuuucuccaggucauaugugccuuaccccuuacaccacaaccagcuu

SEQ ID NO: 174654 - RNA, 63 nt, Homo Sapiens
gcaggucucuugugcccugugcuaggcugugaggugccuuaggggauuccucaaguaccauuu

SEQ ID NO: 174655 - RNA, 63 nt, Homo Sapiens
ggcagagaagcgaggcggauuccccccuugcuugugccuuaaaggagccacugagggauguuu

SEQ ID NO: 174656 - RNA, 63 nt, Homo Sapiens
cuccaucucaugucccuccccaucgcucgcugugugccuuaaaaggccagcaccucccuccuc

SEQ ID NO: 174657 - RNA, 63 nt, Homo Sapiens
acagugguagauuuaugauucacauccgaaagugugccuuaguuaucaauuuaacauuucucu

SEQ ID NO: 174658 - RNA, 63 nt, Homo Sapiens
aggguaauucauugacuuguuuuaguauuuugugugccuuagauuuccguuuuaagacaugua

SEQ ID NO: 174659 - RNA, 63 nt, Homo Sapiens
ugcuuuggggggugugcugacaacuuagcucaggugccuuacaucuuuucuaaucacaguguu

SEQ ID NO: 174660 - RNA, 63 nt, Homo Sapiens
aaaaaaaaauaauaaauaaaauuucuacgucaugugccuuaguuuugcauuuuguaccucaau

SEQ ID NO: 174661 - RNA, 63 nt, Homo Sapiens
ggguacuggggucuggucuugacgucgggguuagugccuuagaccuuuccagccagugucucu

SEQ ID NO: 174662 - RNA, 63 nt, Homo Sapiens
uaaaacauuucucgaucacuuugguaucuuuuugugccuuaucacagccuaguguuaacauuc

SEQ ID NO: 174663 - RNA, 63 nt, Homo Sapiens
agacuggaaguuuaaaaaugcugauuaaauacugugccuuaggagggugguaauauuggcauu

SEQ ID NO: 174664 - RNA, 63 nt, Homo Sapiens
ccugaaugucuguagccaaauaauuugugguaugugccuuaaagucagugacagggcuucuug

SEQ ID NO: 174665 - RNA, 63 nt, Homo Sapiens
cccuccccugggccgcugaggccccgcgcaccugugccuuaaucuucccuccccugugcugcc

SEQ ID NO: 174666 - RNA, 63 nt, Homo Sapiens
acccccuacacuucaguugagggaaaagcucaagugccuuaggcccguggaccacagucuugg

SEQ ID NO: 174667 - RNA, 63 nt, Homo Sapiens
ggacuucugccacagugacaauggaauuguguugugccuuacuucagagguggucucuucuuu

SEQ ID NO: 174668 - RNA, 63 nt, Homo Sapiens
cuuuugguugaaauugaacauacucuagugaaugugccuuaaaaaucaagacacuaguucaga

SEQ ID NO: 174669 - RNA, 63 nt, Homo Sapiens
ccuucagcuucuuacguuuucugagcauccauugugccuuaacauuuucugcuuguccuuugg

SEQ ID NO: 174670 - RNA, 63 nt, Homo Sapiens
aauuuggagaccagcuaugccugcccucugugggugccuuagcauugcgggaggguggugcuu

SEQ ID NO: 174671 - RNA, 63 nt, Homo Sapiens
gacuaauucuggcaccccuuguccgccucagcugugccuuaagcaguugugccuuggugccuu

SEQ ID NO: 174672 - RNA, 63 nt, Homo Sapiens
aacucaaugagaaucaugguuucaauuauuugggugccuuaaaugucuuaauauaucuuaggc

SEQ ID NO: 174673 - RNA, 63 nt, Homo Sapiens
ggcccccuacaaggggcccccagcccugaaugugugccuuaaagggugcugguucacucugcc

SEQ ID NO: 174674 - RNA, 63 nt, Homo Sapiens
auacaggacaaauaggcucuaguccucuuccuugugccuuaacggaaccccuuuaucccagga

SEQ ID NO: 174675 - RNA, 63 nt, Homo Sapiens
ccugaauccuagcccuuaccguggggcuagaaugugccuuagugguuugcacagcccuugugu

SEQ ID NO: 174676 - RNA, 63 nt, Homo Sapiens
cuaugagaccauucagaauauuauuugugcgaagugccuuaugaagccugaagagcuuauuac

SEQ ID NO: 174677 - RNA, 63 nt, Homo Sapiens
cacugcccccacccucagcccugaccgcaaaaggugccuuacaggcgauggaguguggcuggg

SEQ ID NO: 174678 - RNA, 63 nt, Homo Sapiens
gaagcucucaaaauauuuuacuuuuggaugcaggugccuuaaucccagcuguauuauuuugau

SEQ ID NO: 174679 - RNA, 63 nt, Homo Sapiens
auggauuguguuuuagauucauagaauaaugaugugccuuacauuuuuuuccugucuugggag

SEQ ID NO: 174680 - RNA, 63 nt, Homo Sapiens
ucccuuuccuaaucuggcuuuuacauuuauuuugugccuuaaagauuaacuacaaagauaaac

SEQ ID NO: 174681 - RNA, 63 nt, Homo Sapiens
cugcuuucguaucuccucaggcaaaaguggagggugccuuaugggcccuccucauagguuguc

SEQ ID NO: 174682 - RNA, 63 nt, Homo Sapiens
gaugcacacuauucuguaacagaaagcccuauugugccuuaccugugugcuuuugugggcacc

SEQ ID NO: 174683 - RNA, 63 nt, Homo Sapiens
uuccauuucuuuuuucccaaacccucaaacagagugccuuaaaaaauuguuuuaucaggauaa

SEQ ID NO: 174684 - RNA, 63 nt, Homo Sapiens
aaauaggaggguggcaagaacaguucuauccuggugccuuacgaauaaaaaacuggauucugg

SEQ ID NO: 174685 - RNA, 63 nt, Homo Sapiens
agccacugaacaucccuucucugcuccacaggagugccuuagacagccugacucuccacaaac

SEQ ID NO: 174686 - RNA, 63 nt, Homo Sapiens
gaucuuuguaucccccaugggacugagggucuugugccuuauauggcugucaggcgacuacaa

SEQ ID NO: 174687 - RNA, 63 nt, Homo Sapiens
uccugcccaggagagccagcccucccccugccagugccuuaccaaagcaccugccgaccucgu

SEQ ID NO: 174688 - RNA, 63 nt, Homo Sapiens
cuagagggucggggaggaggugccuccccggaagugccuuaacguaacaggaccccaaggacc

SEQ ID NO: 174689 - RNA, 63 nt, Homo Sapiens
gaccuaaauauccacucaguguggaggagaacugugccuuacuugaagaugggagauuccuaa

SEQ ID NO: 174690 - RNA, 63 nt, Homo Sapiens
uuugugugccaauuaaugccggauuaaguacucgugccuuauauugcuaaggggggaggguga

SEQ ID NO: 174691 - RNA, 63 nt, Homo Sapiens
acaaguucuuugcaugcuuuuuauuuuaauaaagugccuuauauuaaagggauguaagcacuu

SEQ ID NO: 174692 - RNA, 63 nt, Homo Sapiens
gcagcgugucuccuggcacgaggagcuugguaagugccuuacuucuucuuucccucuauccaa

SEQ ID NO: 174693 - RNA, 63 nt, Homo Sapiens
cucuguuacacuuuuuggaagacaaaguuaccagugccuuaaaaguuuuaaucucuaacagug

SEQ ID NO: 174694 - RNA, 63 nt, Homo Sapiens
augaaguuguuggaagcuauaaauaugcaagaugugccuuacagguuucaguguuguauauau

SEQ ID NO: 174695 - RNA, 63 nt, Homo Sapiens
auagcuugggaugagaugugucuucuaagcaaagugccuuaggguuccugccuaauuuuuaua

SEQ ID NO: 174696 - RNA, 63 nt, Homo Sapiens
ugagugugucaucaaucagaaccuuguaaauaagugccuuacgugauucuguuuuaaguccau

SEQ ID NO: 174697 - RNA, 63 nt, Homo Sapiens
agacuacagagucaaagcucucuaucagguuuugugccuuaagaggccaccaguuaaaugccg

SEQ ID NO: 174698 - RNA, 63 nt, Homo Sapiens
ggaauuugcguaacuaacacugaaaaccguaaagugccuuauaguguaccucacuguccaaua

SEQ ID NO: 174699 - RNA, 63 nt, Homo Sapiens
ggccccuauggcgccccugcugggccacugauugugccuuauaaccugccuuugccuggggga

SEQ ID NO: 174700 - RNA, 63 nt, Homo Sapiens
uauuuuagucucugugaagccuuuacucucuaggugccuuauaauguuucagggcucaacuuu

SEQ ID NO: 174701 - RNA, 63 nt, Homo Sapiens
aguggcagaggugagggucacaagggagucacagugccuuagacuggcgguacccacccagcc

SEQ ID NO: 174702 - RNA, 63 nt, Homo Sapiens
caaagagaaacucuauacagauaugguuuuacugugccuuacaggcaaccaauuauauacuca

SEQ ID NO: 174703 - RNA, 63 nt, Homo Sapiens
cagacuuuuuaguccaaaaucacacugagacaugugccuuaaaguguguguguuuuuaauauu

SEQ ID NO: 174704 - RNA, 63 nt, Homo Sapiens
ccgacacuuugucgacacugaaauaucgauuaagugccuuaaaaccucuuuagacauagcuau

SEQ ID NO: 174705 - RNA, 63 nt, Homo Sapiens
uuuggaggagggguaugaaguaucuuugacauggugccuuaggaaugacuuggguuuaacaag

SEQ ID NO: 174706 - RNA, 63 nt, Homo Sapiens
uggcuguauagcaaaguguuuuaauccacgguugugccuuauuguuccauuaaaauuguaucu

SEQ ID NO: 174707 - RNA, 63 nt, Homo Sapiens
ugugaacagaaguccuuaagcagaggaauuggugugccuuaaagauacaaucugggauaguuu

SEQ ID NO: 174708 - RNA, 63 nt, Homo Sapiens
augaugacucaaguguagacugaaguugagguagugccuuaugccauuaugucauauguugaa

SEQ ID NO: 174709 - RNA, 63 nt, Homo Sapiens
ccacaugugaguuuaccugaaucugugcauuuugugccuuauucaugagaaugauagaaguac

SEQ ID NO: 174710 - RNA, 63 nt, Homo Sapiens
uaacaguaugguacugcuucugugacaaauaucgugccuuaacaauguggcuguccuuuucca

SEQ ID NO: 174711 - RNA, 63 nt, Homo Sapiens
ucauuguuuuuaaaacuguuuuauaucuuaagagugccuuauuaaaguauagauguaugucuu

SEQ ID NO: 174712 - RNA, 63 nt, Homo Sapiens
caaccuuagccuauuauaguuucagagccaaaagugccuuauacugagaguuaggagaaauau

SEQ ID NO: 174713 - RNA, 63 nt, Homo Sapiens
gugaaucaagguagugccacggauaagcugcuggugccuuaguggugaugcuaaaguaauggu

SEQ ID NO: 174714 - RNA, 63 nt, Homo Sapiens
guaacuuguucuguaccucccuaccucaacuaugugccuuauguucugggccugguguggggg

SEQ ID NO: 174715 - RNA, 63 nt, Homo Sapiens
ugguggugguugugcccagcgcacuuuccgugggugccuuaugucucgccugccuucugagcu

SEQ ID NO: 174716 - RNA, 63 nt, Homo Sapiens
aaaaccaaauuguggcuauucugcuaucaaacugugccuuauuguguucuuaauuccuagcau

SEQ ID NO: 174717 - RNA, 63 nt, Homo Sapiens
guccuucuuaacagacucaagaucaccagccaugugccuuaguacccgugucuaugacgcaaa

SEQ ID NO: 174718 - RNA, 63 nt, Homo Sapiens
aaauuuguuuucauuuagauucucagaucaaaugugccuuaauauuauaccagaaaguuaaau

SEQ ID NO: 174719 - RNA, 63 nt, Homo Sapiens
gucaugagaguggagcccucaugaaugggaucagugccuuaugaaaggcccuagagagauacc

SEQ ID NO: 174720 - RNA, 63 nt, Homo Sapiens
guacaugcucggaggccuggagguguggugacugugccuuacucugcagggaggcccuuccca

SEQ ID NO: 174721 - RNA, 63 nt, Homo Sapiens
aucgccccuggacagaguucguccuucaccacugugccuuagaacacuugggggaccaaucau

SEQ ID NO: 174722 - RNA, 63 nt, Homo Sapiens
ucacuguuucagcugagucccuccccauuuucugugccuuauccacuugguacccauggccac

SEQ ID NO: 174723 - RNA, 63 nt, Homo Sapiens
uucuaggaucagaauuaguuugaaagcuucagcgugccuuaguguuucaaaugauuggaucuu

SEQ ID NO: 174724 - RNA, 63 nt, Homo Sapiens
cucaugggcugccuaggagccugugucacccuugugccuuagcaacugagcccucguggccac

SEQ ID NO: 174725 - RNA, 63 nt, Homo Sapiens
ccucucggcggccucaccuggccucacugcuucgugccuuagcucgggggucgggggagaacc

SEQ ID NO: 174726 - RNA, 63 nt, Homo Sapiens
gagugagaggcuguggggcagcggcucuguccugugccuuaccagcccuggggaggggggcau

SEQ ID NO: 174727 - RNA, 63 nt, Homo Sapiens
cugcuagucuguaagcuccuuaagaguaggguugugccuuauucaacugcauacauagcuccu

SEQ ID NO: 174728 - RNA, 63 nt, Homo Sapiens
ccuuauucaacugcauacauagcuccuagcacagugccuuauucgguaggcaucuaagcacau

SEQ ID NO: 174729 - RNA, 63 nt, Homo Sapiens
guacaggacauagcucucuccugcuaccagucugugccuuagaggucuguuaggccugccaaa

SEQ ID NO: 174730 - RNA, 63 nt, Homo Sapiens
acugggggcaccuuaagauuuugcaccuguaaagugccuuacaggguaacugugcugaaugcu

SEQ ID NO: 174731 - RNA, 63 nt, Homo Sapiens
gcagcugagcugcgcuggcucugggcagggagugugccuuaaugggaagcacacgggcuuugg

SEQ ID NO: 174732 - RNA, 63 nt, Homo Sapiens
ccagaagagcccuuaugaccccugggccgcgcugugccuuagugucuacuugcaggacccuuc

SEQ ID NO: 174733 - RNA, 63 nt, Homo Sapiens
cacaaagacaagaaaaaucagggcauuuugugagugccuuaagaucaaacuaacaagaucuga

SEQ ID NO: 174734 - RNA, 63 nt, Homo Sapiens
uaaaacacaccucucugcugcuuccagagucuugugccuuaaaaaauaaauacaaagcccauu

SEQ ID NO: 174735 - RNA, 63 nt, Homo Sapiens
uaacugcccuuccuucccuuugcugcgauuccugugccuuaugcccugccuucagcuggugcu

SEQ ID NO: 174736 - RNA, 63 nt, Homo Sapiens
cacuacaguacuaagacaaugacauuacggaaagugccuuagagguugguaguuaagcaaacu

SEQ ID NO: 174737 - RNA, 63 nt, Homo Sapiens
cauuaaaauuucuuuguuacccagccucucacugugccuuauguuugaggaugcuuaaugauu

SEQ ID NO: 174738 - RNA, 63 nt, Homo Sapiens
ucgaagggaccagaagugcuguuacugacucuggugccuuaucucccacagaacaacgggaac

SEQ ID NO: 174739 - RNA, 63 nt, Homo Sapiens
gggaaauagccuggggugucaucgguuucuucagugccuuacauuccgguccugagagcuugc

SEQ ID NO: 174740 - RNA, 63 nt, Homo Sapiens
agggcugggauacuucugauguuguuucugugggugccuuaucucugcuguuucagaggcuag

SEQ ID NO: 174741 - RNA, 63 nt, Homo Sapiens
aacgaaaaccugugcuugugggauuuguucucagugccuuagccacccuucacugaguucucu

SEQ ID NO: 174742 - RNA, 63 nt, Homo Sapiens
agcauauuucaacuguucuucauaaauguuuaugugccuuaaaagacuuuauguuaaaggauu

SEQ ID NO: 174743 - RNA, 63 nt, Homo Sapiens
cccuucuggcaccccugggguucaauacuggaagugccuuauuuaaccagaccaucagggcau

SEQ ID NO: 174744 - RNA, 63 nt, Homo Sapiens
guuuauucauugaaacacgguugaccugaacucgugccuuaggaauuaaugcccccuuaugga

SEQ ID NO: 174745 - RNA, 63 nt, Homo Sapiens
cauccuccuccagccuccuccagcccccaggcagugccuuaccuguggugcccagaaaagugc

SEQ ID NO: 174746 - RNA, 63 nt, Homo Sapiens
aggugggcgccccgaccacgacuuggcuuccuugugccuuaaaaaaccugccuuccugcagcc

SEQ ID NO: 174747 - RNA, 63 nt, Homo Sapiens
guggccuuuuaugagaggggacccgucaaaucugugccuuauggagggguccggcagcggcca

SEQ ID NO: 174748 - RNA, 63 nt, Homo Sapiens
cugcccagucuggccugcgcucccgccgcccuggugccuuagcccccggcacaggauggggca

SEQ ID NO: 174749 - RNA, 63 nt, Homo Sapiens
cagugcgcccucccucccucccaucuggggguagugccuuaugcuggguguuggagcagagug

SEQ ID NO: 174750 - RNA, 63 nt, Homo Sapiens
gggugugacuuggccccucuggcuugucuuucugugccuuacuccuccuccugcgucucccgu

SEQ ID NO: 174751 - RNA, 63 nt, Homo Sapiens
aaacuccucaccaggagagccaaagacaggguugugccuuaccccaggagccaccccuguacc

SEQ ID NO: 174752 - RNA, 63 nt, Homo Sapiens
ucggacuggggccuccccaccucccucucggcugugccuuacggagccccgauccaggccucc

SEQ ID NO: 174753 - RNA, 63 nt, Homo Sapiens
ucaggucagcugcuuggggcucccaggcugggugugccuuagccacaggcagggcugucaaua

SEQ ID NO: 174754 - RNA, 63 nt, Homo Sapiens
acacccccagcuggcccuccacccccaccucaagugccuuauucucacagcaagccccuuagu

SEQ ID NO: 174755 - RNA, 63 nt, Homo Sapiens
cccauugccaaagcaugccugcccacccucgcugugccuuagucaguguguacgugugugugu

SEQ ID NO: 174756 - RNA, 63 nt, Homo Sapiens
ccugucuagagaccccaccuucacccacaccgugugccuuacuccaagagggggaugucagcc

SEQ ID NO: 174757 - RNA, 63 nt, Homo Sapiens
cuaagccucccauccugugucucuacuguaaaugugccuuagcagccucggauuuccuggccc

SEQ ID NO: 174758 - RNA, 63 nt, Homo Sapiens
cgcucugugacacagucuacugaccuugauugugugccuuaacucauccccuuccuagcugua

SEQ ID NO: 174759 - RNA, 63 nt, Homo Sapiens
gaacccgccgcgugcccaggugacacaaaagacgugccuuaagggagccgcagcugcaaacuc

SEQ ID NO: 174760 - RNA, 63 nt, Homo Sapiens
gacauguuccugcugcagaugcauaagugaucugugccuuaacuuccugaaccacaaaccaua

SEQ ID NO: 174761 - RNA, 63 nt, Homo Sapiens
uaagucggggguggcaagggggggacgcgggcugugccuuacugccuuccgggccgggcggaa

SEQ ID NO: 174762 - RNA, 63 nt, Homo Sapiens
ucugugugugaucaguuucugagggcagggaccgugccuuauguacuagacugugagcuccuc

SEQ ID NO: 174763 - RNA, 63 nt, Homo Sapiens
gggcccucguccacccaaggcccaccuccacaggugccuuaaaccagcucccgccccucgccc

SEQ ID NO: 174764 - RNA, 63 nt, Homo Sapiens
uauacuuauuuauuucaggacuggggggcaucugugccuuauuagacaguccuuccgugaggc

SEQ ID NO: 174765 - RNA, 63 nt, Homo Sapiens
uucccgucagaagaaucagcaggacagaucguagugccuuauuccauuguccuccccuggcca

SEQ ID NO: 174766 - RNA, 63 nt, Homo Sapiens
aacugccuaaagucacagcacagauacugcccagugccuuaagaggagacaugaucucuacca

SEQ ID NO: 174767 - RNA, 63 nt, Homo Sapiens
aaagaccuacuugacgucauguggacagugcacgugccuuacgcuacaucuuguuuucuagga

SEQ ID NO: 174768 - RNA, 63 nt, Homo Sapiens
cuugcucaugggauguugcaaagaacacaaagugugccuuagacauucucaagucaucagcgu

SEQ ID NO: 174769 - RNA, 63 nt, Homo Sapiens
augucagauggcguggucugcagggggagcucugugccuuaguggcucuuggcaggacacuga

SEQ ID NO: 174770 - RNA, 63 nt, Homo Sapiens
gggaagcccagugaggcauuggcugcccugcuugugccuuagugcccacagcaggcuguacca

SEQ ID NO: 174771 - RNA, 63 nt, Homo Sapiens
ccuugggcugggggagggggcugcagccaccuggugccuuaguucuguguccgggccggccug

SEQ ID NO: 174772 - RNA, 63 nt, Homo Sapiens
uuggauccucuagaaacuaagggcccaaggacagugccuuaguguaaaacccuuuuuaggcaa

SEQ ID NO: 174773 - RNA, 63 nt, Homo Sapiens
cucccuauucagaaagcuccuuacucagcaggugugccuuaaccuacacaagaaauauuuguu

SEQ ID NO: 174774 - RNA, 63 nt, Homo Sapiens
gaagaagcagugacacucccugacgcgucucuagugccuuacuaaacguaucuuuccuuuaug

SEQ ID NO: 174775 - RNA, 63 nt, Homo Sapiens
caaggauugucuaauuucaauugugcaagacaugugccuuauaauuauuuuuagcuuaaaauu

SEQ ID NO: 174776 - RNA, 63 nt, Homo Sapiens
uuuagaaguguguucuuuaauagaggaauucgugugccuuagacauaaucuuacucugugaaa

SEQ ID NO: 174777 - RNA, 63 nt, Homo Sapiens
cccacacuugacugggcuguagagcacagaggagugccuuaucacucuaccauaucuuagcuc

SEQ ID NO: 174778 - RNA, 63 nt, Homo Sapiens
uuuuaaccaguuuccaauaacauaaagcuuggagugccuuaauaacuguaaccucaaggaaac

SEQ ID NO: 174779 - RNA, 63 nt, Homo Sapiens
gggccgcucuccagcucaccacagugucuccacgugccuuaccccuucuccuucaggccaagu

SEQ ID NO: 174780 - RNA, 63 nt, Homo Sapiens
cagcuuugaagaaacuaggaauaagccauucaagugccuuacaaacuuuuccaggugguguua

SEQ ID NO: 174781 - RNA, 63 nt, Homo Sapiens
uuacugaaugaauaggguuuggcucauuuguuugugccuuacucuuugaauaaagugaacaga

SEQ ID NO: 174782 - RNA, 63 nt, Homo Sapiens
ccacagccgaagaauccgugugcagaacacacagugccuuauggccagccaugagcgccuucc

SEQ ID NO: 174783 - RNA, 63 nt, Homo Sapiens
auguguugcagcugucaccauuauauaauaaaagugccuuagccucccacccuacccccuuuu

SEQ ID NO: 174784 - RNA, 63 nt, Homo Sapiens
aggugaguggucuuucgaagaugaauuauacaugugccuuacccccagaguccucacaccuga

SEQ ID NO: 174785 - RNA, 63 nt, Homo Sapiens
cuuccuaccuagcuccuuguuggugagcuucuugugccuuaauccugugacccagccccuuac

SEQ ID NO: 174786 - RNA, 63 nt, Homo Sapiens
aagggaaacaguugaaacuguuuaaaaauagaugugccuuauuuauugcaggcuuucuuuccc

SEQ ID NO: 174787 - RNA, 63 nt, Homo Sapiens
aguauuucuuuguuauacauuuaaagauuuaaagugccuuaucaaauaauauucaugaagagu

SEQ ID NO: 174788 - RNA, 63 nt, Homo Sapiens
gguguuugaaaaagaagggggggagaauuccaggugccuuaauauaaaguuugaagcuucauc

SEQ ID NO: 174789 - RNA, 63 nt, Homo Sapiens
ucuaaucauguuuucgucacaugcugaguaaaagugccuuacaauguaaaaauuguacaguac

SEQ ID NO: 174790 - RNA, 63 nt, Homo Sapiens
ucucucuuguggaauugcauucaaaccagaacagugccuuagaauggaugugcccaacugcuc

SEQ ID NO: 174791 - RNA, 63 nt, Homo Sapiens
uaggcccggcuguggcuccaccuccagcucuccgugccuuaagggaaaagcgggacagcuccc

SEQ ID NO: 174792 - RNA, 63 nt, Homo Sapiens
guccagugcccgcccuguggggccaaggcggccgugccuuacuacucugugucuucugccucc

SEQ ID NO: 174793 - RNA, 63 nt, Homo Sapiens
uagacucuucauuuacuuuugcuuucauaugaagugccuuaaguuugugaaaauuuugaauua

SEQ ID NO: 174794 - RNA, 63 nt, Homo Sapiens
aagcaauccucugucaaaauaagaagauguguagugccuuaacaauaguuaaucauuuaacca

SEQ ID NO: 174795 - RNA, 63 nt, Homo Sapiens
uaaggcaccaugaccaccuggugugaccucucugugccuuacugaggcaccuuucuagagauu

SEQ ID NO: 174796 - RNA, 64 nt, Homo Sapiens
gccaaguacugcgcaugcaagagacccuuuauuggccuuacagugggccauucauuucuauagg

SEQ ID NO: 174797 - RNA, 64 nt, Homo Sapiens
ucacacgggguuuccccacucuuucugauauauugccuuacagaccuaccucaaacacacuguu

SEQ ID NO: 174798 - RNA, 64 nt, Homo Sapiens
aaccaaaguggagcuggugcuucuugggagccucgccuuacaacuaauuccugccuuucgucca

SEQ ID NO: 174799 - RNA, 64 nt, Homo Sapiens
ccucugugagucucaucaucagcugagcgaugaugccuuacagguugcauagcacuggaacuuu

SEQ ID NO: 174800 - RNA, 64 nt, Homo Sapiens
aaguuuuucucacuaaaauauggggcaauuguuagccuuacauguuguguagacuuacuuuaag

SEQ ID NO: 174801 - RNA, 64 nt, Homo Sapiens
acuaacaaacacacaacugguguguaaaaggcaggccuuacauuagaagccaagccaauccuuu

SEQ ID NO: 174802 - RNA, 64 nt, Homo Sapiens
ugugcagaaguuagaagggucuggcgggggcagugccuuacacaugcuugauucccacgcuacc

SEQ ID NO: 174803 - RNA, 64 nt, Homo Sapiens
aaaugcaucccuuccuuucuuuccugcuuccuuugccuuacaauugaagcagcccgugguacca

SEQ ID NO: 174804 - RNA, 64 nt, Homo Sapiens
ucacugccuuaagggggcugauggcgccaccugugccuuacauccagguucaggcaucacuagc

SEQ ID NO: 174805 - RNA, 64 nt, Homo Sapiens
ugcccggccgucugucucuucugcagcgccacccgccuuacaccuagacucuucuccaugucag

SEQ ID NO: 174806 - RNA, 64 nt, Homo Sapiens
uccuaagcucagagaaaguuuaguuaauuucagugccuuacaaaaccacuccccaccccagcug

SEQ ID NO: 174807 - RNA, 64 nt, Homo Sapiens
aaauuguugugcuuagaauuuuuuuucagagaaggccuuacagauuaauaaguaauuccuucuc

SEQ ID NO: 174808 - RNA, 64 nt, Homo Sapiens
auaacuaauuauuuguuuucacucaucucauucagccuuacagcuugguccuucuaucacuaaa

SEQ ID NO: 174809 - RNA, 64 nt, Homo Sapiens
uuuuauuauaaaaauucucaccaaaagcuuucuggccuuacauaaggguaagauuccaacuugu

SEQ ID NO: 174810 - RNA, 64 nt, Homo Sapiens
uaagcuaauguagaaaaguuuaaaaauguagccugccuuacauaauaaugaaagaaaucauaca

SEQ ID NO: 174811 - RNA, 64 nt, Homo Sapiens
ggaaauaaggcuaacagagguugaccuaaaauuagccuuacaaaggagaaaggaccacauugcu

SEQ ID NO: 174812 - RNA, 64 nt, Homo Sapiens
uucacuuccuccagaagccuccuuacauuaaaaagccuuacaguuauccugcaagggacaggaa

SEQ ID NO: 174813 - RNA, 64 nt, Homo Sapiens
guggcuccccacacccugccauaggggcaguccugccuuacacauagaagcauucaugccugcu

SEQ ID NO: 174814 - RNA, 64 nt, Homo Sapiens
agcaaauagcgauucucuucauguaucuccuaaugccuuacacuacuugguuucugauuugcuc

SEQ ID NO: 174815 - RNA, 64 nt, Homo Sapiens
aagcucagccccucacaguggccucaagugugaugccuuacaaaagcaccacucagaugggcag

SEQ ID NO: 174816 - RNA, 64 nt, Homo Sapiens
gguucauguuugcaguuacuucacaaaagaaauugccuuacacuuucaaggaguaugucauaua

SEQ ID NO: 174817 - RNA, 64 nt, Homo Sapiens
uuuguaucuacauuuuuccccuaacugguuugaggccuuacaguuuacgagaaagggacuuguc

SEQ ID NO: 174818 - RNA, 64 nt, Homo Sapiens
ucucaaggaauucagcuguucaaaggaccaaccugccuuacacaguuucagucuacaguccauc

SEQ ID NO: 174819 - RNA, 64 nt, Homo Sapiens
uuuauuuuugagagugggguaagcaccccuaccugccuuacagagcagcccagguacccaggcc

SEQ ID NO: 174820 - RNA, 64 nt, Homo Sapiens
cagagagcuuucccaccaacuuuguaccuugauugccuuacaaaguuauuuguuuacaaacagc

SEQ ID NO: 174821 - RNA, 64 nt, Homo Sapiens
cagcauaaacucuaugguuaauucuuaaaauaaugccuuacagucuccauuaacucccuugccc

SEQ ID NO: 174822 - RNA, 64 nt, Homo Sapiens
guaggccuuauguugauugggaugcuccccuacagccuuacagguagaauagaaggugaguucu

SEQ ID NO: 174823 - RNA, 64 nt, Homo Sapiens
auccacaacuggggaccugcucagugcccccccugccuuacagcuacaugacagugcuguuuua

SEQ ID NO: 174824 - RNA, 64 nt, Homo Sapiens
cauguuuaggcaacuagucagaaaaccagcuauggccuuacagaaagggaaaaauuaacccauu

SEQ ID NO: 174825 - RNA, 64 nt, Homo Sapiens
cacugucuuuaauacccccagcccaggagcucgugccuuacaugcugggcccacauucugcccc

SEQ ID NO: 174826 - RNA, 64 nt, Homo Sapiens
uauguauucuuuugugccuggcuucuuucucucagccuuacauuugugagauuccucuguauug

SEQ ID NO: 174827 - RNA, 64 nt, Homo Sapiens
gggcgagggguuggugggaguaggggcuuacaaagccuuacacaacuaugggguggggugggug

SEQ ID NO: 174828 - RNA, 64 nt, Homo Sapiens
uugucaccuuuauagaagcagcauucuuugaacugccuuacauggcauuucguuugguuaguca

SEQ ID NO: 174829 - RNA, 64 nt, Homo Sapiens
agugccacggugacccaagauagggcaagagcaggccuuacagcuuuccaggcaggccuggcca

SEQ ID NO: 174830 - RNA, 64 nt, Homo Sapiens
uucauaacaacaagauuugugcuuuaaaaugucugccuuacaaauuagcaagguaauggauuuu

SEQ ID NO: 174831 - RNA, 64 nt, Homo Sapiens
cucacuaugaagguaaagggcuuacaaagacaaagccuuacaaaaacacagucuacucuuucug

SEQ ID NO: 174832 - RNA, 64 nt, Homo Sapiens
ucauaaauucucaucagauggucuagggagucgcgccuuacaaacccaaauuccuaccuaaggg

SEQ ID NO: 174833 - RNA, 64 nt, Homo Sapiens
cagcacagggccugggggguggcuaacgagagaggccuuacagugccggcaugccuccucuucc

SEQ ID NO: 174834 - RNA, 64 nt, Homo Sapiens
gagaagggauagggaaauccucucugcucauugggccuuacaugaugggugacacuuggagugg

SEQ ID NO: 174835 - RNA, 64 nt, Homo Sapiens
cuccaaaaaaaaacuuugcuuguauauuauuuuugccuuacaguggaucauucuaguaggaaag

SEQ ID NO: 174836 - RNA, 64 nt, Homo Sapiens
ucucucuaccucucagcacuaaugauggucaaaugccuuacaucuuuucugauaucucuaaaau

SEQ ID NO: 174837 - RNA, 64 nt, Homo Sapiens
aguguauuuuuucuuucuauguaauuuuagauucgccuuacaauguaaaucuucacauuggaga

SEQ ID NO: 174838 - RNA, 64 nt, Homo Sapiens
cugaucucucgugauugauaagaaccuuuugagugccuuacacaaugguuuucuuguguguuua

SEQ ID NO: 174839 - RNA, 64 nt, Homo Sapiens
cacacacaaauauauaauuucacuguuccaagaggccuuacacaguugguguccagguuugugg

SEQ ID NO: 174840 - RNA, 64 nt, Homo Sapiens
gaguacaaauaauacuuuaagaaaaacgauaauagccuuacacuagcuagaaaauuuuauguau

SEQ ID NO: 174841 - RNA, 64 nt, Homo Sapiens
caccucauguugcagaccauggaaagagaacacugccuuacagucuucucauaggaaugcuaga

SEQ ID NO: 174842 - RNA, 64 nt, Homo Sapiens
uccauauuuaaaacuagaaagugcucuguccuuugccuuacauugaaaucuaaggcaaaaccaa

SEQ ID NO: 174843 - RNA, 64 nt, Homo Sapiens
cucacuauaguccauaaugcuugaacugcuguuagccuuacauuguuuuugugucaucccuacu

SEQ ID NO: 174844 - RNA, 64 nt, Homo Sapiens
acuugaaagauauaaacagaccaacacaguaauugccuuacauguuuuagccauauaucauaaa

SEQ ID NO: 174845 - RNA, 64 nt, Homo Sapiens
uugaguuguguacacuuguaacauguaaauuugugccuuacacccugugaauagccuguuuucc

SEQ ID NO: 174846 - RNA, 64 nt, Homo Sapiens
uuucaauaacuuuuuuucuuaaugauugcaugaugccuuacaguaguuaauaauuagcuuauuc

SEQ ID NO: 174847 - RNA, 64 nt, Homo Sapiens
gucuaagugcuucucuugugcagcaugguucccagccuuacaguacccacacuggugguuauua

SEQ ID NO: 174848 - RNA, 64 nt, Homo Sapiens
uggaacauuuccagaacuuaccaaacagaucccugccuuacaaugagcauacccaugguggaau

SEQ ID NO: 174849 - RNA, 64 nt, Homo Sapiens
uuaauaaggauuuggaucucacaagacaccuuaggccuuacacaaguuguucagauucuuugcc

SEQ ID NO: 174850 - RNA, 64 nt, Homo Sapiens
uggggaggggggugagaagacaagaugaagaaaagccuuacauuucaguuucuucaucgguugg

SEQ ID NO: 174851 - RNA, 64 nt, Homo Sapiens
cuucaaacuuccugguuucaugauaucuugagacgccuuacaaaugauggaggauuccaaagag

SEQ ID NO: 174852 - RNA, 64 nt, Homo Sapiens
cugacauucacgugucagccacuuuggcacggaagccuuacaguguggggaaccaaaacuucgu

SEQ ID NO: 174853 - RNA, 64 nt, Homo Sapiens
ugaaggauuuaguagauucuguuagauuagggaggccuuacagacugacuuuacuuaaagagga

SEQ ID NO: 174854 - RNA, 64 nt, Homo Sapiens
gaagcacaugucuuuaaugucuucagacaaaaaagccuuacauuaauuuaauguuugcacucug

SEQ ID NO: 174855 - RNA, 63 nt, Homo Sapiens
ugcagagucuguuaaaguagauguugcacaccagccuuacagcugggagccuuugccauggua

SEQ ID NO: 174856 - RNA, 64 nt, Homo Sapiens
gggcacuguacuuggaucuucccggcgugugugugccuuacacaggggugaacuguucacugug

SEQ ID NO: 174857 - RNA, 64 nt, Homo Sapiens
ucagcccucccacuucugaauuccuaaauaacuugccuuacauaacagcugucagcccuccuca

SEQ ID NO: 174858 - RNA, 64 nt, Homo Sapiens
ucuccauuuugugguaaaaauccaaccucacuucgccuuacaggccacccccaccguccagcca

SEQ ID NO: 174859 - RNA, 64 nt, Homo Sapiens
uguuaaagaaauuuaccucuuuauaaauagguaagccuuacacuaacacuaacagaauaauucu

SEQ ID NO: 174860 - RNA, 64 nt, Homo Sapiens
uacacagcacuuuguaguuuaaugugaaacccaugccuuacauuuguguuuggagucagauuuc

SEQ ID NO: 174861 - RNA, 64 nt, Homo Sapiens
uuuaaaacagauuuuguauuuauuuuaaauugaagccuuacauuaauguaucaagucuuaauug

SEQ ID NO: 174862 - RNA, 64 nt, Homo Sapiens
uauuaaauauuuuacuucuuaccaacucucugcugccuuacaagaaauagcugagaguuucuaa

SEQ ID NO: 174863 - RNA, 64 nt, Homo Sapiens
uaggaguggaauuuuccauuuucuaauauacuaagccuuacagcuaucuuagaugcgaucugac

SEQ ID NO: 174864 - RNA, 64 nt, Homo Sapiens
gugcuagccucuuccuucaguguagacacuggaggccuuacagacaaaaggggaccaucaacau

SEQ ID NO: 174865 - RNA, 64 nt, Homo Sapiens
auggaguuaguauuugugagaaacugguuaccaugccuuacauaaaaauaauaccuucauuauc

SEQ ID NO: 174866 - RNA, 64 nt, Homo Sapiens
guuuaugucugaacaaauaacacagaucacaggggccuuacaaauggagaaauagaaccacaaa

SEQ ID NO: 174867 - RNA, 64 nt, Homo Sapiens
agaaguccuuuaucugugcucucugcccgccagugccuuacaauuugcaaacguguauagccuc

SEQ ID NO: 174868 - RNA, 64 nt, Homo Sapiens
ccugcuggggcaccauucuuaguauacagagguggccuuacacacaucuugcauggauggcagc

SEQ ID NO: 174869 - RNA, 64 nt, Homo Sapiens
cuuuucaguuacaagacccaucucccuagucucagccuuacaacaccacgggacuaaggaagag

SEQ ID NO: 174870 - RNA, 64 nt, Homo Sapiens
cuuguuuccacaugucugucucauucuucacugggccuuacagguuaguuuuaauuaacucuau

SEQ ID NO: 174871 - RNA, 64 nt, Homo Sapiens
auuaacucucuguuccaucauagaauguggccaggccuuacaauggagagccagaguuaaaacu

SEQ ID NO: 174872 - RNA, 64 nt, Homo Sapiens
ccgauagaacacgcccgcccucacugcuguucuugccuuacagccaccaugggaaagcugcaac

SEQ ID NO: 174873 - RNA, 64 nt, Homo Sapiens
gagggggugccugcuguggcacagagcugggaaggccuuacagaagaggugacauuucagcugg

SEQ ID NO: 174874 - RNA, 64 nt, Homo Sapiens
agagcacaaguuggccuacauuaccacuuugcaagccuuacaagguuauagucugcuuauuuaa

SEQ ID NO: 174875 - RNA, 64 nt, Homo Sapiens
gugugugugugugugugugcuauaauccaguggugccuuacaugggcauuuguccccuccaugc

SEQ ID NO: 174876 - RNA, 64 nt, Homo Sapiens
ugauauuugcagguauuauauucuaccccuuuuugccuuacaaguuuauauuuaugugucugua

SEQ ID NO: 174877 - RNA, 64 nt, Homo Sapiens
agguauugccugaaaaacaagugaugucugugcagccuuacacucugucuuuacagaagcaaau

SEQ ID NO: 174878 - RNA, 64 nt, Homo Sapiens
uguguuuuuauauuucaaggguuuaacccuuugagccuuacaucucauucacugucuuucucca

SEQ ID NO: 174879 - RNA, 64 nt, Homo Sapiens
acaggguucagcagguuccccaaaaggcugcccagccuuacagcagaugcugaaggcagagcag

SEQ ID NO: 174880 - RNA, 64 nt, Homo Sapiens
ggcuaccucuugcguucccccuagagauguccaggccuuacauuuaaucggcuuucucugcggu

SEQ ID NO: 174881 - RNA, 64 nt, Homo Sapiens
aguaguugucaccagggccucauuuuguaguugagccuuacaaugcuuaguaguucaucuucuu

SEQ ID NO: 174882 - RNA, 64 nt, Homo Sapiens
guuacugaaauaaacuguuugaggauuaauuguugccuuacaaucacugguuugcugacuuacu

SEQ ID NO: 174883 - RNA, 64 nt, Homo Sapiens
caggcugagguuuggguggugcaggguaaggugggccuuacagaccuugcacucugggaguggg

SEQ ID NO: 174884 - RNA, 64 nt, Homo Sapiens
cacagaagccaacuuuccacuuuaaauucucucagccuuacacuugaugguuggguguuuuucc

SEQ ID NO: 174885 - RNA, 64 nt, Homo Sapiens
cccugaguccuacacccagagugacuuugggugagccuuacagcgcuuuggcacucccagcuuu

SEQ ID NO: 174886 - RNA, 64 nt, Homo Sapiens
cuggcugacuaaauuuggggacagauucagucuugccuuacacaaaggggaucauaaaguuaga

SEQ ID NO: 174887 - RNA, 64 nt, Homo Sapiens
gcuuuggggggugugcugacaacuuagcucaggugccuuacaucuuuucuaaucacaguguugc

SEQ ID NO: 174888 - RNA, 64 nt, Homo Sapiens
aaugcuuagaaagcugucuugcacucugcuuuuugccuuacacuguggaaauggacaaguuuag

SEQ ID NO: 174889 - RNA, 64 nt, Homo Sapiens
uggauauuaacaguguaaacuuauuuguguaauggccuuacaugugaauuuuaacauugguuau

SEQ ID NO: 174890 - RNA, 64 nt, Homo Sapiens
ugcuaagaagcguggcauuccaaaaauccauuuugccuuacauauccuuuacaucaugagagau

SEQ ID NO: 174891 - RNA, 64 nt, Homo Sapiens
ugugccuagguguucuguuugauaggaaacaaaugccuuacagauaagcuagaaugggcugugu

SEQ ID NO: 174892 - RNA, 64 nt, Homo Sapiens
ucggcauauuuccucugggcuucuucuaguuucugccuuacaagcaaugcuguucuguaaauuu

SEQ ID NO: 174893 - RNA, 64 nt, Homo Sapiens
uaacccacuaaguaaccucuacaggcauuuaacugccuuacagacagaauauacauauguuaau

SEQ ID NO: 174894 - RNA, 64 nt, Homo Sapiens
uccuuucuggccucuggcuagucaguuuuucauagccuuacaguaucuggcuuuguacugagaa

SEQ ID NO: 174895 - RNA, 64 nt, Homo Sapiens
ugugccgugaaaagguucaaacaugucacaggcggccuuacaugcaguuggaggccaggguacc

SEQ ID NO: 174896 - RNA, 64 nt, Homo Sapiens
ucucacugccucucuggacaagacguuuuucucugccuuacacugcggccucgcuguuaccaga

SEQ ID NO: 174897 - RNA, 64 nt, Homo Sapiens
ucaggccacuggcccauugcuucuuaguuugugggccuuacaaagaaaaaagauguaaaaacca

SEQ ID NO: 174898 - RNA, 63 nt, Homo Sapiens
acccuaaagggagggaagguggacugagaaggggccuuacagaaagagaagaauggacucuga

SEQ ID NO: 174899 - RNA, 64 nt, Homo Sapiens
agcagaggcuggaagagaagaggugggcagaggggccuuacagcgagggaggcugcaggggggg

SEQ ID NO: 174900 - RNA, 64 nt, Homo Sapiens
ccuuccuacugcugagcaucguggggcagcugcugccuuacagcucauucaacugccuccaucu

SEQ ID NO: 174901 - RNA, 64 nt, Homo Sapiens
uauaacaucauaguguguaaauguucuucugaaagccuuacauuugaggucuugaguuuuuaua

SEQ ID NO: 174902 - RNA, 64 nt, Homo Sapiens
aauuaaggagacuuccuguaggccaccauauuuggccuuacaggaggaggggaagggaggaaug

SEQ ID NO: 174903 - RNA, 64 nt, Homo Sapiens
cugcccccacccucagccguugaccgcaaaaggugccuuacacagcgauggaguguggcugggc

SEQ ID NO: 174904 - RNA, 64 nt, Homo Sapiens
ggauuguguuuuagauucacuagaauaaugaugugccuuacaauuuuuuuccugucuugggaga

SEQ ID NO: 174905 - RNA, 64 nt, Homo Sapiens
uggaguacaauuucuuuuaauccagauuacaccugccuuacaaagcacccccuccuuguucccc

SEQ ID NO: 174906 - RNA, 64 nt, Homo Sapiens
ugcagucgcugcaaccuacccucucucugccucagccuuacacccaagcaguaggucugugcuc

SEQ ID NO: 174907 - RNA, 64 nt, Homo Sapiens
cuuucuuuguguguuccugauggaauucaccauagccuuacagcuuuucucagaagguaacuug

SEQ ID NO: 174908 - RNA, 64 nt, Homo Sapiens
uauaguuacuuaaucaaagauuuuuuucaaaccugccuuacauauaggcccacuuuaaaagcac

SEQ ID NO: 174909 - RNA, 64 nt, Homo Sapiens
auacagggauuacuggugugauacucccaccucugccuuacaaacaaccucuugggcccaagug

SEQ ID NO: 174910 - RNA, 64 nt, Homo Sapiens
uguuucaugaagagaaaggaauuuuagccuuagagccuuacacuggcccacaaaaauaacuauu

SEQ ID NO: 174911 - RNA, 64 nt, Homo Sapiens
gguucuaccagagaggaaaagggcccaaaugacagccuuacaaggcccuugagguccagcugug

SEQ ID NO: 174912 - RNA, 64 nt, Homo Sapiens
uuaacuagcugcugcauuauacacaauauccgcagccuuacaccaaaugccaagggggagagag

SEQ ID NO: 174913 - RNA, 64 nt, Homo Sapiens
uuguuuuguuugguuuuacauuuuaguuacugaagccuuacaagguuauguagagagauaccau

SEQ ID NO: 174914 - RNA, 64 nt, Homo Sapiens
aacggacgaagagccugccguguguuaaucauuugccuuacaagauguaccagacgguuuccag

SEQ ID NO: 174915 - RNA, 64 nt, Homo Sapiens
ugguuucuucauucuuuacugcacucagauuuaagccuuacaaagggaaagccucuggccguca

SEQ ID NO: 174916 - RNA, 64 nt, Homo Sapiens
gaaaaugucacauucuauuuuccaggccaugauggccuuacacuuuagccagaguuagguuguc

SEQ ID NO: 174917 - RNA, 64 nt, Homo Sapiens
uuuaauagacuuuuucuuauggugucuggaguaagccuuacaauaggggagugauuuaagcaau

SEQ ID NO: 174918 - RNA, 64 nt, Homo Sapiens
aucacauaagguccuuugcuuccugggcugaucugccuuacauaguauuaucuuugaaugaaau

SEQ ID NO: 174919 - RNA, 64 nt, Homo Sapiens
gaaguuguuggaagcuauuuaauaugcaagaugugccuuacaauguuucaguguuguauauaua

SEQ ID NO: 174920 - RNA, 64 nt, Homo Sapiens
aagccuuuauuguaagacucuuagauuguauuuugccuuacagagugaaucaaucaguauguuu

SEQ ID NO: 174921 - RNA, 64 nt, Homo Sapiens
gauuucugcagugauuugugcuaugcaagguacagccuuacaaagacggaacacagcuauuucc

SEQ ID NO: 174922 - RNA, 64 nt, Homo Sapiens
cgaugccauugauucugccagcggcuccuaaaccgccuuacagcugaguuagaagaugaggaga

SEQ ID NO: 174923 - RNA, 64 nt, Homo Sapiens
gcucucuuggguccguccccuuuucccagguacugccuuacaaagcuguggccaggaaguggcc

SEQ ID NO: 174924 - RNA, 64 nt, Homo Sapiens
caauggcaugacggugaccuguugacguaacuaagccuuacagcaaggcaugugccgcacgugc

SEQ ID NO: 174925 - RNA, 64 nt, Homo Sapiens
aaggugggcaagggauuauacaaucugcuuuccugccuuacauccccaucagagaggagcauuu

SEQ ID NO: 174926 - RNA, 64 nt, Homo Sapiens
aagagaaacucuauacagaauaugguuuuacugugccuuacacagcaaccaauuauauacucaa

SEQ ID NO: 174927 - RNA, 64 nt, Homo Sapiens
ccacacugcaggaagucaaaccauccccgagcaggccuuacagaugccaagcaccccuuuuauc

SEQ ID NO: 174928 - RNA, 64 nt, Homo Sapiens
aaaaaaaaaauuguuuagugaagcuacaaaaguagccuuacaaaaaauacaaagggaaaacaaa

SEQ ID NO: 174929 - RNA, 64 nt, Homo Sapiens
caaauguaaguuauauauauacuuuugaacguuggccuuacaauagagagcucaucucauuuuu

SEQ ID NO: 174930 - RNA, 64 nt, Homo Sapiens
ucaggaggaggcuuuucauuuguuuguacacuuagccuuacauucauaucagacgccuugguuc

SEQ ID NO: 174931 - RNA, 64 nt, Homo Sapiens
uggcuggaaagcagagccuccacacuguggccaggccuuacaucacacugugcagacccagucc

SEQ ID NO: 174932 - RNA, 64 nt, Homo Sapiens
auugcuaccugauuuguugaagauuuuuccucuugccuuacacauggagguuccaggaaaccuc

SEQ ID NO: 174933 - RNA, 64 nt, Homo Sapiens
ccccucucuucuccuugucccaccacauggacaugccuuacacuggcguccucuccugaguccc

SEQ ID NO: 174934 - RNA, 64 nt, Homo Sapiens
uuacaggcaucagaaaauaaaacuuauaguuguagccuuacaacacguuauccaauugcagguc

SEQ ID NO: 174935 - RNA, 64 nt, Homo Sapiens
caccccagguguccaugggguggggccagaggccgccuuacacaccacuuccagcuuuugaucu

SEQ ID NO: 174936 - RNA, 64 nt, Homo Sapiens
cugcccuggccgucacucccguuuccauucacuugccuuacagcccuuucucuuuuuccagcca

SEQ ID NO: 174937 - RNA, 64 nt, Homo Sapiens
ccacauccuuagagccaucaccuggcacgcaggcgccuuacauucuacgguagaacguggggua

SEQ ID NO: 174938 - RNA, 64 nt, Homo Sapiens
uuaagaauguggcauaaccuuuaacuauuuucaagccuuacacaauagcagagaauauaaacug

SEQ ID NO: 174939 - RNA, 64 nt, Homo Sapiens
cuuuacaggcuuggcuuugaaugacaaagaucuugccuuacagauccgucucuucccgucccug

SEQ ID NO: 174940 - RNA, 64 nt, Homo Sapiens
gugcuuuccuucagacggugcagggccugggccagccuuacaggucaguagacuagacucgacu

SEQ ID NO: 174941 - RNA, 64 nt, Homo Sapiens
ucucuaaaggacugguuaaaucaauucugauacagccuuacaauacaauaguaugcagcuaaaa

SEQ ID NO: 174942 - RNA, 64 nt, Homo Sapiens
cugggggcaccuuaagauuuugcaccuguaaagugccuuacaggguaacugugcugaaugcuuu

SEQ ID NO: 174943 - RNA, 64 nt, Homo Sapiens
aaacaucuggugccaagaucuacauuucaacccugccuuacacccagagcguccagaucugcca

SEQ ID NO: 174944 - RNA, 64 nt, Homo Sapiens
gaaauagccuggggugucugucgguuucuucagugccuuacagguccgguccugagagcuugca

SEQ ID NO: 174945 - RNA, 64 nt, Homo Sapiens
cccucugacaccccuccccccacucaagagaggggccuuacagugcagccggagggcuuuccca

SEQ ID NO: 174946 - RNA, 64 nt, Homo Sapiens
ccugcugacugcccagagacgcuacugccacuucgccuuacaucgcucugcucaggccccuuca

SEQ ID NO: 174947 - RNA, 64 nt, Homo Sapiens
uagcagugacacuuguugccgauaucuucuguccgccuuacauaaauauucaguuccaaaacaa

SEQ ID NO: 174948 - RNA, 64 nt, Homo Sapiens
ucugcugucaucagcccuguaauaucauaacauggccuuacauggaagacagagcuaauggaua

SEQ ID NO: 174949 - RNA, 64 nt, Homo Sapiens
cuuagaaauguacauaauguuuauauacacuuaugccuuacauuaaaguccaauaugagaaaua

SEQ ID NO: 174950 - RNA, 64 nt, Homo Sapiens
auuucauguuuccaauguaccugauuuuucaugagccuuacagacacacagagacacauacaca

SEQ ID NO: 174951 - RNA, 64 nt, Homo Sapiens
uuuucaucuucuaguuugucuauuuuaauaaauggccuuacauuaaaaaauuguaaagaaaugu

SEQ ID NO: 174952 - RNA, 64 nt, Homo Sapiens
gaacguuuccugggcugucacguacacuccugcugccuuacacagugcauuuuagaaucuucca

SEQ ID NO: 174953 - RNA, 64 nt, Homo Sapiens
gggcgugucgccgccucuggcaucgccuccgguugccuuacaccacgccuucaccugcagucgc

SEQ ID NO: 174954 - RNA, 64 nt, Homo Sapiens
ugucacuagcggaggucacuuuggagaagggugggccuuacauccagugugggugguguccuca

SEQ ID NO: 174955 - RNA, 64 nt, Homo Sapiens
guugaaacugggaaccuguuggcuaaccauuggggccuuacacuguuuuucaaaugguugcaac

SEQ ID NO: 174956 - RNA, 64 nt, Homo Sapiens
guaccugagaauaaucgaggucacccaguuuagagccuuacacucaaagaauuauauuaaagau

SEQ ID NO: 174957 - RNA, 64 nt, Homo Sapiens
ggaggacuugggggcagagcagcacaaagaaacagccuuacacugggcacauggaggagacguc

SEQ ID NO: 174958 - RNA, 64 nt, Homo Sapiens
cugauuucauuuuggaauucauuugccauccacagccuuacacuaggcacacacuuuagagucu

SEQ ID NO: 174959 - RNA, 64 nt, Homo Sapiens
accggacuucuguucaagcuuuuuaaagugcugagccuuacaaaccccugaaggaaagugaccc

SEQ ID NO: 174960 - RNA, 64 nt, Homo Sapiens
aauauuauuucuuuggacucaagcugaaauacaagccuuacauugccuuaugcuuuauuucuuu

SEQ ID NO: 174961 - RNA, 64 nt, Homo Sapiens
uuccuuacaaauaaaccaaccaacuuaccaaaaugccuuacacauggaaaaagaaguuacuguu

SEQ ID NO: 174962 - RNA, 64 nt, Homo Sapiens
gcucuaguuaugguuacuuuugaugaaaaacuuggccuuacaggaauuaugguuacuuuccuug

SEQ ID NO: 174963 - RNA, 64 nt, Homo Sapiens
gcucuaauuaugauuucccuucaugaaaacacuugccuuacaagcugguugguaaguguccuug

SEQ ID NO: 174964 - RNA, 64 nt, Homo Sapiens
ccgaggaggagcucuaggccgacgcccaccgcaggccuuacagucuucucuggacgcucccuug

SEQ ID NO: 174965 - RNA, 64 nt, Homo Sapiens
accguaacaauguuugucaugguauuauauuuuggccuuacaauauguguaugucugguaaaua

SEQ ID NO: 174966 - RNA, 64 nt, Homo Sapiens
aaaaaaaaaaagugaaaacaccaaugugugaaaugccuuacaaugcccacuggagaggcggggc

SEQ ID NO: 174967 - RNA, 64 nt, Homo Sapiens
uguggcugacucugagcccagggaagcagggccugccuuacagguauauggaauacaaaagcug

SEQ ID NO: 174968 - RNA, 64 nt, Homo Sapiens
gcuuugaagaaacuaggacuuaagccauucaagugccuuacacaacuuuuccaggugguguuaa

SEQ ID NO: 174969 - RNA, 64 nt, Homo Sapiens
cccuucuagcccuccucccaaaagguuggaugcugccuuacaucgcagauagcuucucucuggg

SEQ ID NO: 174970 - RNA, 64 nt, Homo Sapiens
uaauuaacugguuccaucaagacugugcacccaggccuuacaguccaaccuuuuucugugucug

SEQ ID NO: 174971 - RNA, 64 nt, Homo Sapiens
agcguagaaucuguguagacgaagggggcaucuggccuuacaccucguuagggaagagaaacag

SEQ ID NO: 174972 - RNA, 58 nt, Homo Sapiens
uuaagaacagcagccgcuaagacugcaagccuuacaccucaccaucucccucaugagu

SEQ ID NO: 174973 - RNA, 64 nt, Homo Sapiens
cuaaucauguuuucgucacaugcugaguaaaagugccuuacaauguaaaaauuguacaguacuu

SEQ ID NO: 174974 - RNA, 64 nt, Homo Sapiens
ucacucauuccauguggaacugacucaaacagcugccuuacaauaguauaugaugaacagugua

SEQ ID NO: 174975 - RNA, 64 nt, Homo Sapiens
aaccaaaucacaauaaaguugccuucacuacacugccuuacauagucuguuuaacuucugcagu

SEQ ID NO: 174976 - RNA, 64 nt, Homo Sapiens
cccagaggagccuuucucaguguguuucuaaauggccuuacacuugguagaagaaauugaaggg

SEQ ID NO: 174977 - RNA, 64 nt, Homo Sapiens
caaaaaagcaaaacuuguaaagacagauauuuaagaggcauaacuuuuuauagacaaaguaaaa

SEQ ID NO: 174978 - RNA, 64 nt, Homo Sapiens
aaugcaauaaacuguuacaguaacauugaaaaaugaggcauaaaaaacuccaaacuagaguacg

SEQ ID NO: 174979 - RNA, 64 nt, Homo Sapiens
cgugguauaaaugacuguagcuauguaacuaucggaggcauauaaaaccaaaaacccaaacacc

SEQ ID NO: 174980 - RNA, 64 nt, Homo Sapiens
gaguauaugccaagaacacuuguggaaguggucugaggcauauaaauuagcugaauagaaagaa

SEQ ID NO: 174981 - RNA, 64 nt, Homo Sapiens
aauugcuugagccugggaggcuacucagguggcugaggcauaaggcacacgccuguaauaccag

SEQ ID NO: 174982 - RNA, 64 nt, Homo Sapiens
aauuguuugagcccgggagacuacuugggaggcugaggcauaagccgcgugccuguaaucccag

SEQ ID NO: 174983 - RNA, 64 nt, Homo Sapiens
agucuguuugcugcauacacgucauugccagacagaggcauacagcauauuuucuuuucuuaca

SEQ ID NO: 174984 - RNA, 64 nt, Homo Sapiens
uucuuuucuuacagucauuguauauuuuuauuuggaggcauauuuucauuucgucauguaauug

SEQ ID NO: 174985 - RNA, 64 nt, Homo Sapiens
ggauuuauacagauucacuuguuuguuugggaaagaggcauaugugucauaaagccauuucuug

SEQ ID NO: 174986 - RNA, 55 nt, Homo Sapiens
cuccucccaccuuguaccucugaaugaggcauauuccaagaaauugauugaguaa

SEQ ID NO: 174987 - RNA, 64 nt, Homo Sapiens
gagaggaaguuaauuucagagccccuuagcuacugaggcauagguugggaccuuuucugccccu

SEQ ID NO: 174988 - RNA, 64 nt, Homo Sapiens
cagaaccagucacuauggagucaguccuggggcagaggcauaaaugaggugugucccuagggcu

SEQ ID NO: 174989 - RNA, 64 nt, Homo Sapiens
acccuggacuucagucgccuggcccaaccccaugauuauggaacgucucuucaccuuaacccaa

SEQ ID NO: 174990 - RNA, 64 nt, Homo Sapiens
gggcggugguuauuauaaggaauuggcucacgugauuauggaggcgguuaaaucccaagaucug

SEQ ID NO: 174991 - RNA, 64 nt, Homo Sapiens
uaguuuaagaagaagucaauaugcuuauuuaaauauuauggauggugggcagaucacuugaggu

SEQ ID NO: 174992 - RNA, 64 nt, Homo Sapiens
auaaauaaauaaauaaauaaauaaauaaauaaauauuauggauggugaagggaaugguauagaa

SEQ ID NO: 174993 - RNA, 64 nt, Homo Sapiens
uuucuucaaaucucccacaaguauauacuuuuaaauuauggaguauuuuaagucuacaaaaagg

SEQ ID NO: 174994 - RNA, 64 nt, Homo Sapiens
guuuuuaauuuuaacaucagaacugaaauaaaaaauuauggauacguguuuugaauugcaaacu

SEQ ID NO: 174995 - RNA, 64 nt, Homo Sapiens
ucucugucuuaggaauugcccuucuugugugcucauuauggaucgaauguaucucagcuugguu

SEQ ID NO: 174996 - RNA, 64 nt, Homo Sapiens
gcaaauugccaacuaauggcuccaggugugugguauuauggaaagaaauguaauuucuaaauac

SEQ ID NO: 174997 - RNA, 64 nt, Homo Sapiens
agguugugauggugguaagcaucaaauaguggguauuauggaggccauagagagcaaaacuaug

SEQ ID NO: 174998 - RNA, 64 nt, Homo Sapiens
uuggggaaagugguaaaauguaccaauuaguuaaauuauggaaauaauguuucaguucucuaau

SEQ ID NO: 174999 - RNA, 64 nt, Homo Sapiens
cagagaaaucuuacagaaaacaggggugggaaucucuuccgauagagucgcuauuucugguuaa

SEQ ID NO: 175000 - RNA, 64 nt, Homo Sapiens
guuuugcagagaaggcaguguuccucuauucccuucuuccgaauuaaaaauacccccucagagc

SEQ ID NO: 175001 - RNA, 64 nt, Homo Sapiens
gaaauugugugugcaagaaaacuaggcaauguacucuuccgauguuugugucacacaacacuga

SEQ ID NO: 175002 - RNA, 64 nt, Homo Sapiens
uucugcacccucugcuuguucccucauauucuguucuuccgacuccugcuaacacacaugcaac

SEQ ID NO: 175003 - RNA, 64 nt, Homo Sapiens
cuuuucucucagacacuggagccaggacguggccucuuccgauccucugucggcccugcuuccu

SEQ ID NO: 175004 - RNA, 64 nt, Homo Sapiens
aauccucuuccucugaggcuccucucaccuguacucuuccgaaagaccaggucuuggagcugag

SEQ ID NO: 175005 - RNA, 64 nt, Homo Sapiens
agcagccucagggaugcccucugugagcaaagugucuuccgauuaucggggaaccacauguuga

SEQ ID NO: 175006 - RNA, 64 nt, Homo Sapiens
aguuucaugccucugugccuucgcucaugcuguuucuuccgacuggaaugccuuccccugcucc

SEQ ID NO: 175007 - RNA, 64 nt, Homo Sapiens
uuuggaguuaugcugcguaugaaaggaugagucuucuuccgagaaauaaagcuuguuuguucuc

SEQ ID NO: 175008 - RNA, 64 nt, Homo Sapiens
ggaugugaggcacuguggggcccaggccuuggacucuuccgaaguucagcugaagaugccccuc

SEQ ID NO: 175009 - RNA, 64 nt, Homo Sapiens
aguccugucucccacuucccacucguuccccuccucuuccgagcugcuuugugggcuccaggcc

SEQ ID NO: 175010 - RNA, 64 nt, Homo Sapiens
agugacacagaggacuccuugcauuuuuugcugcucuuccgagggcugcuggaacccaggagug

SEQ ID NO: 175011 - RNA, 64 nt, Homo Sapiens
gaacugugcccaagggacucugauuauccaagcaucuuccgaagaguguuguggucaccuuaaa

SEQ ID NO: 175012 - RNA, 64 nt, Homo Sapiens
uaccugccauuuguucccgcagugccagccugauucuuccgaccguuggacagaggcugggggc

SEQ ID NO: 175013 - RNA, 64 nt, Homo Sapiens
gaucaugccucaggcaaaggcguggguccaucguucuuccgagaggguuuguguggcgacuaca

SEQ ID NO: 175014 - RNA, 64 nt, Homo Sapiens
caacuguauacugguguuuaauagagaaugauugucuuccgaguuuuuugguuccuuuuuuaac

SEQ ID NO: 175015 - RNA, 64 nt, Homo Sapiens
agcccccagcccuccccuccgggggaacaaggggucuuccgagcagggugcuucggcgggaggu

SEQ ID NO: 175016 - RNA, 64 nt, Homo Sapiens
cacaaaggauugucccuaauccuuggcccuggggucuuccgagugagcugguuuaauacucuga

SEQ ID NO: 175017 - RNA, 64 nt, Homo Sapiens
gauaggacuagcaccauuuuaagucccugucaccucuuccgacucuuucugagugccuucugug

SEQ ID NO: 175018 - RNA, 64 nt, Homo Sapiens
agcaauuugaaucuuaacuuaggcggaccuguucucuuccgacaagagcauucugaguguuuac

SEQ ID NO: 175019 - RNA, 64 nt, Homo Sapiens
aaggcauuaagggcuagagaagcauaacagcuugucuuccgaaauccugccucuuugcauauuc

SEQ ID NO: 175020 - RNA, 64 nt, Homo Sapiens
ccaccguuuaacaggaguccgccaagucgcuuuaucuuccgaggcuggguuucagugucgucuu

SEQ ID NO: 175021 - RNA, 64 nt, Homo Sapiens
uguccacagcagaugaggacgucaugggacugcaucuuccgacuugguuugucgugcugggaca

SEQ ID NO: 175022 - RNA, 64 nt, Homo Sapiens
gaugaaucucccacuccagccugguggcuacgaaucuuccgauguaugaaauccuugacuggac

SEQ ID NO: 175023 - RNA, 64 nt, Homo Sapiens
aacauuuaugaccuaagucaaaaaucuauauuugucuuccgaucugcugcauacuuugacaagg

SEQ ID NO: 175024 - RNA, 64 nt, Homo Sapiens
gccuuccuccucgggcagugucccccgcaggcccucuuccgagaaagggaggcgccuggcugua

SEQ ID NO: 175025 - RNA, 64 nt, Homo Sapiens
ccuucuugggggaaauagcacccuggaaucaacaucuuccgaguccugucugccccucacucug

SEQ ID NO: 175026 - RNA, 64 nt, Homo Sapiens
aguucagcagggacaaguuaugcaaauuguuuuuucuuccgaaugcaaauguggcucuagcacu

SEQ ID NO: 175027 - RNA, 64 nt, Homo Sapiens
gaugaugauugcgcagggagggguacguggcaccucuuccgaauggguuuucuauuugaacaug

SEQ ID NO: 175028 - RNA, 64 nt, Homo Sapiens
cauggaggaaaagccuucgaaagugucgcucaagucuuccgaccgccaaggcucggacgaggag

SEQ ID NO: 175029 - RNA, 64 nt, Homo Sapiens
ccaccugguugggguagagcaaaaggauggucacucuuccgaggucucccugaaaugaauguau

SEQ ID NO: 175030 - RNA, 64 nt, Homo Sapiens
gccugguuaaauaaggcaggguuuauaugcacuuucuuccgaucuguaccugagagguuugugg

SEQ ID NO: 175031 - RNA, 64 nt, Homo Sapiens
aauccacagugucccauuuuccgacuaggagacaucuuccgagaaacaggcgauaauuuuucag

SEQ ID NO: 175032 - RNA, 64 nt, Homo Sapiens
ugcccacaaacuugcuucuuagaauaugauccccucuuccgaguaaauuacaauuaaggaaaug

SEQ ID NO: 175033 - RNA, 64 nt, Homo Sapiens
aauacaagaucccguccuccgaauuucccagccaucuuccgaagguucuacguaauggagggaa

SEQ ID NO: 175034 - RNA, 64 nt, Homo Sapiens
gccuucugaagacagggcucuggugaagguugucucuuccgaggagugaagaacugccaagagu

SEQ ID NO: 175035 - RNA, 64 nt, Homo Sapiens
aacuuuucugaucaguuugcaguauuuuuucuagucuuccgagaaugcaugauuaagacaauaa

SEQ ID NO: 175036 - RNA, 64 nt, Homo Sapiens
ccuucuuucuacuuugucaagauauggcaugucaucuuccgagcugauaacaacccaaggcaau

SEQ ID NO: 175037 - RNA, 64 nt, Homo Sapiens
aacuaacaggaacaaaaugacuuguuggcuccagucuuccgacaugauauccucucaaaugcug

SEQ ID NO: 175038 - RNA, 64 nt, Homo Sapiens
ugggccuggcacacgccuguauucccacaccaggucuuccgaucaguggugucugugaagggug

SEQ ID NO: 175039 - RNA, 64 nt, Homo Sapiens
uugucuuaucucaaaccccuugccuggcuuuuuuucuuccgagcagaagcugcccagaaacugc

SEQ ID NO: 175040 - RNA, 64 nt, Homo Sapiens
ccucuuauucggcccaaggacuugaagcccggcaucuuccgaccugcccugcccccaccccugc

SEQ ID NO: 175041 - RNA, 64 nt, Homo Sapiens
ggcacaugguucuagccuggcaguuccccaggccucuuccgagaaccugaaguuacacugccag

SEQ ID NO: 175042 - RNA, 64 nt, Homo Sapiens
ugaccgcuacuggcgccucguggcuccaucaucuucuuccgagaggcgcccugccgaggcccga

SEQ ID NO: 175043 - RNA, 64 nt, Homo Sapiens
accaggccuuaucuccaagaaugcucagaccagcucuuccgaaacuggccucccacagacucaa

SEQ ID NO: 175044 - RNA, 64 nt, Homo Sapiens
cacugaugaucaaaauugaagggucuauguacguucuuccgaagccaaaggccaaccuugggcu

SEQ ID NO: 175045 - RNA, 64 nt, Homo Sapiens
uuagaaacaaaacaaaaagauaucucuuucuuuuucuuccgacaugaaaacaaugauuuuaaua

SEQ ID NO: 175046 - RNA, 64 nt, Homo Sapiens
aagcucaguauucaugauggugggggauggagugucuuccgagguucuugggggaaaaaaaauu

SEQ ID NO: 175047 - RNA, 64 nt, Homo Sapiens
ugcaaaucauuggagaauccauaaugaagagagaucuuccgaguguaauaaauguggcaaauuu

SEQ ID NO: 175048 - RNA, 64 nt, Homo Sapiens
cauucagcugacuguauccaucugcuucuuccguucuuccgaaacucucucuuccucaaugcac

SEQ ID NO: 175049 - RNA, 64 nt, Homo Sapiens
uccagugagcuuggaagaggaccaggagguggacucuuccgacccggggccucaguccacagcc

SEQ ID NO: 175050 - RNA, 64 nt, Homo Sapiens
gguacugaacauauauacuucugcuuggcauucuucuuccgacuuccguuaaacagagaaagag

SEQ ID NO: 175051 - RNA, 64 nt, Homo Sapiens
gcaccagaggugaagcugccguucccgacgugcaucuuccgaagcggaaaugcaagugccgaag

SEQ ID NO: 175052 - RNA, 64 nt, Homo Sapiens
uuccucccagggcugauguguugcuaagcaauaaucuuccgacccuuuagcugguaugcaagau

SEQ ID NO: 175053 - RNA, 64 nt, Homo Sapiens
aaagugcugaacugugaggaggcaggucuaaugcucuuccgaaugguggacaagcugucuggau

SEQ ID NO: 175054 - RNA, 64 nt, Homo Sapiens
auaagacuauagauaagugguagagguaaucaauucuuccgaaguguuuccuucgugaauaacu

SEQ ID NO: 175055 - RNA, 64 nt, Homo Sapiens
uuucccugccuauaccugugucuauccucaucagucauugcauuuguaucacugccuguggaaa

SEQ ID NO: 175056 - RNA, 64 nt, Homo Sapiens
uuucccuccaauauugguuccccuuguuuuccucucauugcaugcuguaacaauucaggguuuu

SEQ ID NO: 175057 - RNA, 64 nt, Homo Sapiens
uacuuuuuagguggcauuuuuggaaauaauuuauucauugcagaguggaucugcagugcuucac

SEQ ID NO: 175058 - RNA, 64 nt, Homo Sapiens
gaagggaaaggucucaaggacucuaaugcuguggucauugcacaccagcgcaugcaggacuggu

SEQ ID NO: 175059 - RNA, 64 nt, Homo Sapiens
caguguaaaccuuuuuaaugcaaauuuauuuuuuucauugcauauuuugcagauuuuauccaca

SEQ ID NO: 175060 - RNA, 64 nt, Homo Sapiens
ucauuuuuuacugucagaaaagauaccccuuuugucauugcaacuauuuuuuaaauccagaaau

SEQ ID NO: 175061 - RNA, 64 nt, Homo Sapiens
ugaggacuuguuuucuuuuuuagcagggcucccuucauugcaucuguauugauuagccuguaug

SEQ ID NO: 175062 - RNA, 64 nt, Homo Sapiens
uguaguuugagcacagauccgcagaauauuguccucauugcauggcagcaagucaauuguauua

SEQ ID NO: 175063 - RNA, 64 nt, Homo Sapiens
ggcaccugauacuucuguugcccuugugcuccagucauugcacaaggcagaaaacagcucuggc

SEQ ID NO: 175064 - RNA, 64 nt, Homo Sapiens
gaguuugaggcugcagugagccaucaucauggcaucauugcauuccagccugggcaacagagca

SEQ ID NO: 175065 - RNA, 64 nt, Homo Sapiens
agaaaguuuacacgacgucauuugguaacauccgucauugcagagcgcaaaggucucgaugccu

SEQ ID NO: 175066 - RNA, 64 nt, Homo Sapiens
gcgaacauccucuccuuucccccucugcaccagcucauugcaaacgcuugugagcgaggcccuc

SEQ ID NO: 175067 - RNA, 64 nt, Homo Sapiens
caacugaaauguggaugugacauccguuugccaaucauugcaaaagcagaaggcuuuuuuaacu

SEQ ID NO: 175068 - RNA, 64 nt, Homo Sapiens
auauauuuuuacugcuuucuaagguggaaaguguucauugcacaugaacugucaugauacgcuu

SEQ ID NO: 175069 - RNA, 64 nt, Homo Sapiens
ccccuguauauguggaucucgccuacaucccgaaucauugcaguggcaagacugcugaccuuga

SEQ ID NO: 175070 - RNA, 64 nt, Homo Sapiens
cggagccaccuccaacucuaacaauaaaccaaguucauugcagauaguguagugcugcuuaggc

SEQ ID NO: 175071 - RNA, 64 nt, Homo Sapiens
ucaauucagaaaauggacugaagucugaauaaggucauugcauuuaaaaagcauauaacuguac

SEQ ID NO: 175072 - RNA, 64 nt, Homo Sapiens
auuuuuucauaaucuauauuuaaacaaaauuacaucauugcaucaucuuuucuaaauucaucuc

SEQ ID NO: 175073 - RNA, 64 nt, Homo Sapiens
uucagaauuaaccugaaagugcagggguucugcuucauugcauuggucggaacacuuuaggagu

SEQ ID NO: 175074 - RNA, 64 nt, Homo Sapiens
uacgaagagaaaauuuucuauuuucaguuauuuuucauugcagaccaauauuacaacagcauug

SEQ ID NO: 175075 - RNA, 64 nt, Homo Sapiens
aggcuccuucacuuucucuccaugggauagggguuggggguacucccuagagcugcuaggcuug

SEQ ID NO: 175076 - RNA, 64 nt, Homo Sapiens
cagcaugacccaagcaaggggccugaggccucaguggggguagggcaaggagguaccucacagg

SEQ ID NO: 175077 - RNA, 64 nt, Homo Sapiens
agucacagcugcuuaguacacuuucuuuguacaguggggguaaaauuacagauuaaaaagcacc

SEQ ID NO: 175078 - RNA, 64 nt, Homo Sapiens
ggacaccuagauuuagcuaacuuacuaguuccuguggggguacaauccaugcccaaggcaacau

SEQ ID NO: 175079 - RNA, 64 nt, Homo Sapiens
cauguaugaacacacaugcugcauugcccuuuguuggggguaugguucaguucuguuacacagu

SEQ ID NO: 175080 - RNA, 64 nt, Homo Sapiens
uuuggcauguauaccuguaaacuaugcccaucccuggggguaauccacuguaggaaaaugauug

SEQ ID NO: 175081 - RNA, 64 nt, Homo Sapiens
ugcccucuguguacguaucuugcaugcauggguguggggguaugugugcuauguguguuaagcc

SEQ ID NO: 175082 - RNA, 64 nt, Homo Sapiens
aaucucaagaauugcgaaagaggcaaauuauuuguggggguaggaaagugaauccagggaacac

SEQ ID NO: 175083 - RNA, 64 nt, Homo Sapiens
gcagggccaggcuuuggcauaucuguucuaaaucuggggguaaagcaagaaccugaacauuuug

SEQ ID NO: 175084 - RNA, 64 nt, Homo Sapiens
cuuaacaccucauagaacacacuuugggaaacaguggggguaggaaaacucggccucaaguugc

SEQ ID NO: 175085 - RNA, 64 nt, Homo Sapiens
uuuugaagcucaggugucucacgucugggcugcaccaggcgaagagagaaauuaaagauuugag

SEQ ID NO: 175086 - RNA, 64 nt, Homo Sapiens
gagggccgagggucacccgucggccgccgccaccccaggcgaggccggaggaaggaucaucuga

SEQ ID NO: 175087 - RNA, 64 nt, Homo Sapiens
ccuguuuccugaguuugggacuguuggacccgcucuggaccaacuagauuagcucuggaccagc

SEQ ID NO: 175088 - RNA, 64 nt, Homo Sapiens
cuguuggacccgcucuggacaccuuagauuagcucuggaccagcugaaucaaagacauggaauu

SEQ ID NO: 175089 - RNA, 64 nt, Homo Sapiens
cacaaaaacuuaacaaaaguacuggggaggaauccuggaccaagucccccgccuuuaguucucc

SEQ ID NO: 175090 - RNA, 64 nt, Homo Sapiens
ccugguguguagcuaguaaggccuaaaguacagccuggaccacccuccaggagacuuucaugca

SEQ ID NO: 175091 - RNA, 64 nt, Homo Sapiens
ugagccccuucccugaggcugucuccugggaaugcuggaccagggggauuacuucccccaccca

SEQ ID NO: 175092 - RNA, 64 nt, Homo Sapiens
agagagggcaggugcccaccccacaggcccuuuccuggaccauggagccaggugaaaccugucu

SEQ ID NO: 175093 - RNA, 64 nt, Homo Sapiens
ucuccucugcuaaauuugcacucuccauaucaaucuggaccaucagaauuaaacuggaccaucu

SEQ ID NO: 175094 - RNA, 64 nt, Homo Sapiens
ucucuccauaucaaucuggaguaaaagaauuaaacuggaccaucggucuaccaguuacuaugga

SEQ ID NO: 175095 - RNA, 64 nt, Homo Sapiens
uuuaugcaguagaugcuuucuuccuccugcaguucuggaccauguggagcuacauggagaaauu

SEQ ID NO: 175096 - RNA, 64 nt, Homo Sapiens
ucuuccauccaggagugugcuacugaggggcuggcuggaccaaccugcuggcucaggcauguga

SEQ ID NO: 175097 - RNA, 64 nt, Homo Sapiens
uucucagccuacauucauuugcaagcuucaaucucuggaccaucugguguucacagguguuaga

SEQ ID NO: 175098 - RNA, 64 nt, Homo Sapiens
agugguggggcuugguuauccucuuguuuugugacuggaccacugcccaggugcuugaugauga

SEQ ID NO: 175099 - RNA, 64 nt, Homo Sapiens
cuaugcugaccucacucuugagcagcgcuuucagcuggaccacucaggccuggacagccucauc

SEQ ID NO: 175100 - RNA, 64 nt, Homo Sapiens
acacaaggugggcagggaggcaccauucaggaaccuggaccaaagcugacgaggcugggccaag

SEQ ID NO: 175101 - RNA, 64 nt, Homo Sapiens
gcccuucauuagccaaauugaaaaaagaaauucccuggaccagaugcugaaagagaaaagaggg

SEQ ID NO: 175102 - RNA, 64 nt, Homo Sapiens
ccuccaucucucagggagacaaagaaccuccuuccuggaccaaggaggugcugccaaguuuucu

SEQ ID NO: 175103 - RNA, 64 nt, Homo Sapiens
guaaggauuuggaauaaggauuugguccuguuuucuggaccaaauccuuacucuggcucugcuu

SEQ ID NO: 175104 - RNA, 64 nt, Homo Sapiens
cggggagagcgggcgggggagcucgcgccgaggacuggaccaucuguacagaccagcgggagug

SEQ ID NO: 175105 - RNA, 64 nt, Homo Sapiens
gagugcgcgcgcccgccucgcacagggccggggccuggaccaaaccacaugaacuggacugaga

SEQ ID NO: 175106 - RNA, 64 nt, Homo Sapiens
gauugauugugaccaguagcaucauaauugccgucuggaccauuagcuuugaggaauguggaaa

SEQ ID NO: 175107 - RNA, 64 nt, Homo Sapiens
gcaaguccauccuucaaaugcagaugcuccuccccuggaccauucauggagguguccugcuaag

SEQ ID NO: 175108 - RNA, 64 nt, Homo Sapiens; identical to SEQ ID NO: 21144

SEQ ID NO: 175109 - RNA, 64 nt, Homo Sapiens; identical to SEQ ID NO: 21145

SEQ ID NO: 175110 - RNA, 64 nt, Homo Sapiens; identical to SEQ ID NO: 21146

SEQ ID NO: 175111 - RNA, 64 nt, Homo Sapiens; identical to SEQ ID NO: 21147

SEQ ID NO: 175112 - RNA, 64 nt, Homo Sapiens; identical to SEQ ID NO: 21148

SEQ ID NO: 175113 - RNA, 64 nt, Homo Sapiens; identical to SEQ ID NO: 21149

SEQ ID NO: 175114 - RNA, 64 nt, Homo Sapiens
uguggaguuagguggaagccagauuuuaaaaguugccaaccaggagauuuaacagguacaguua

SEQ ID NO: 175115 - RNA, 64 nt, Homo Sapiens
cagagagagagagagagagagagagugucuucaugccaaccacagccuguuucugcugaguuuc

SEQ ID NO: 175116 - RNA, 64 nt, Homo Sapiens
cuguggcuacagguggagggaggcuugaggguuugccaaccacacuugcccucuaccuccugau

SEQ ID NO: 175117 - RNA, 64 nt, Homo Sapiens
cacuccacaaaggggagcauagugacacugucaggccaaccauggcaaggagagcccugggguc

SEQ ID NO: 175118 - RNA, 64 nt, Homo Sapiens
gaggaucagagcccauugcacaagaagagccgcugccaaccauccuuguccuccgauugcaaaa

SEQ ID NO: 175119 - RNA, 64 nt, Homo Sapiens
ugguugaccucucagcaagugcuauccaggcugggccaaccagacccacaauuaacugagccuc

SEQ ID NO: 175120 - RNA, 64 nt, Homo Sapiens
caaagugaaaauaagauacacaauaaucauugcucugugugauuacagauaggauuauccaucu

SEQ ID NO: 175121 - RNA, 64 nt, Homo Sapiens
aaauauuuuuuuaaacauauuugccuacauaauacugugugaauauuuucauuagauuaauuca

SEQ ID NO: 175122 - RNA, 64 nt, Homo Sapiens
uaccagugugguuuguguuugcauuagaaauuagcugugugaaauguaaauauuuauguaaacu

SEQ ID NO: 175123 - RNA, 64 nt, Homo Sapiens
aagcauuuauguuuauuuaugaagagaggaaugccugugugagccuguauguuagggugcucug

SEQ ID NO: 175124 - RNA, 64 nt, Homo Sapiens
ccggcaccccuugcuuccucccucuguugucugccugugugacacacaucaauggcaauaacuu

SEQ ID NO: 175125 - RNA, 64 nt, Homo Sapiens
uaucugcuacccugaaucaccuguccuggucuugcugugugaugggaacaugcuuguaaacugc

SEQ ID NO: 175126 - RNA, 64 nt, Homo Sapiens
guaguguguuggggguggggguccugggcacuggcugugugaagggaucuggcagggcaccaca

SEQ ID NO: 175127 - RNA, 64 nt, Homo Sapiens
cccuuauagccucaggcugcaguguccuucccagcugugugagaaaaugaaagccgacguccac

SEQ ID NO: 175128 - RNA, 64 nt, Homo Sapiens
uuuuggugguuaguaagagauuugccaaagagaacugugugaggcacucugauuggcagccugc

SEQ ID NO: 175129 - RNA, 64 nt, Homo Sapiens
gcaggaagcucugcccagaggccuguauccucaucugugugacgcagagacugcacacccccuu

SEQ ID NO: 175130 - RNA, 64 nt, Homo Sapiens
auggguuggugcuucuaacccauuaaucaaucaucugugugaaauuucccaaauaaacucuaaa

SEQ ID NO: 175131 - RNA, 64 nt, Homo Sapiens
aacuuucucuucauacuuuuccagugcccaaagucugugugauggaaggauggcaccuaaacca

SEQ ID NO: 175132 - RNA, 64 nt, Homo Sapiens
ucuguucuucuacuucacucuuccuguugaaaaacugugugauuuuuuuuuuuuuuuaaguaaa

SEQ ID NO: 175133 - RNA, 64 nt, Homo Sapiens
uucgcuggccccgcuguccgcaggggcuuccuaccugugugagaggucguagcgggagacagca

SEQ ID NO: 175134 - RNA, 64 nt, Homo Sapiens
guacacaugcaugcauacacacccauacaaacaucugugugagggcaguucuggagaugagcag

SEQ ID NO: 175135 - RNA, 64 nt, Homo Sapiens
guuguaauugucaauuuguuguuauaggucuuaccugugugaaagaaagaaaaagaaagaaaga

SEQ ID NO: 175136 - RNA, 64 nt, Homo Sapiens
ugugugcuguagugaccagcggcuccuaacgugucugugugaugaccaguuguccuccaaaaac

SEQ ID NO: 175137 - RNA, 64 nt, Homo Sapiens
caccuaugucugccguggcuccucggguggugcccugugugacaaagcccaacagcaaggguga

SEQ ID NO: 175138 - RNA, 64 nt, Homo Sapiens
cggcuuuguucucccagcuaaggccguggagcugcugugugacugugucaggccuggacaagga

SEQ ID NO: 175139 - RNA, 64 nt, Homo Sapiens
caaggugacucuuguacuuggcaagggaaguccacugugugauugucuguauucuuaauauaau

SEQ ID NO: 175140 - RNA, 64 nt, Homo Sapiens
gugugcaacuacuugugugaggugauaaguguaucugugugaguaugcgcagcguaugacuguu

SEQ ID NO: 175141 - RNA, 64 nt, Homo Sapiens
uaaucaacuauaaaagcuuagaccuuucuuugcacugugugacucuuuaccaaaagggucaaug

SEQ ID NO: 175142 - RNA, 64 nt, Homo Sapiens
cugggcgagucucuuccccuaugcuuccuccugccugugugacgcagguaugaaugagccagcc

SEQ ID NO: 175143 - RNA, 64 nt, Homo Sapiens
cuggacaaguacuaccuuccuagaccaggacuuccugugugaccgagccacggguccugggucc

SEQ ID NO: 175144 - RNA, 64 nt, Homo Sapiens
uauuucucauuugauauaauuuuucucuguuucacugugugaaaaaaagaagauauuucccaua

SEQ ID NO: 175145 - RNA, 64 nt, Homo Sapiens
uucuguaauguccccuucuuucuaggcucuguugcugugugaauccauuagauuuacaguaucg

SEQ ID NO: 175146 - RNA, 64 nt, Homo Sapiens
agucaugguuuggaagcaccauacagggagacagcugugugaauacaggcuguauggacacuug

SEQ ID NO: 175147 - RNA, 64 nt, Homo Sapiens
uguaauaauaaucaugaccacaaaccauaaaggacugugugauguaucaguaagagggugcuca

SEQ ID NO: 175148 - RNA, 64 nt, Homo Sapiens
auaccuguuuuccacugcuaaaacugaagcaccacugugugagcaacaggaagggagagcgcac

SEQ ID NO: 175149 - RNA, 64 nt, Homo Sapiens
ggguaaggaaacaaguuacagaaauuaccgcguucugugugaagggacugagggugugguguca

SEQ ID NO: 175150 - RNA, 64 nt, Homo Sapiens
gaggagcaucauuccuuccuuacccccuuucuagcugugugauguagaccaaagucguugcccc

SEQ ID NO: 175151 - RNA, 64 nt, Homo Sapiens
gaaccagucggaacuggguuccaguccagcugugcugugugagccugugcaagugacaugaccu

SEQ ID NO: 175152 - RNA, 64 nt, Homo Sapiens
aaacccucacggcuaagggcucugggaguugugucugugugaccugagagugauccaucuccug

SEQ ID NO: 175153 - RNA, 64 nt, Homo Sapiens
ugucugugugaccugagagugauccaucuccugccugugugagguagcagugggcacuuuucau

SEQ ID NO: 175154 - RNA, 64 nt, Homo Sapiens
ugucaaucauuuaagauuaaugggcaugcaauuaagucuccauuuaagauuaaugggcaugcaa

SEQ ID NO: 175155 - RNA, 64 nt, Homo Sapiens
aagucuccauuuaagauuaaugggcaugcaaugaagucuccagcagacaaucagauguuguugg

SEQ ID NO: 175156 - RNA, 64 nt, Homo Sapiens
uuucugguuuucuguccccaugggauaccaguucagucuccacagcccagggucgugcacucuc

SEQ ID NO: 175157 - RNA, 64 nt, Homo Sapiens
cuugacccccaccuccuacuucuugccucggugcagucuccacuucuuggccccauccauggac

SEQ ID NO: 175158 - RNA, 64 nt, Homo Sapiens
gugggccugucccagcccugggcgccaacagaguagucuccaugugguucucuagggacuugaa

SEQ ID NO: 175159 - RNA, 64 nt, Homo Sapiens
cccucacagcagccacgcccggagugugcugguuagucuccagauggcggcugggcuggugcag

SEQ ID NO: 175160 - RNA, 64 nt, Homo Sapiens
cauccagcaugagcagaugucggggagacugggaagucuccagcguuacugcucuccuucccuu

SEQ ID NO: 175161 - RNA, 64 nt, Homo Sapiens
guuucuagaaaaggcagacacugguugggaccaaagucuccauggcacaugacugaagacuggu

SEQ ID NO: 175162 - RNA, 64 nt, Homo Sapiens; identical to SEQ ID NO: 172974

SEQ ID NO: 175163 - RNA, 64 nt, Homo Sapiens; identical to SEQ ID NO: 172975

SEQ ID NO: 175164 - RNA, 64 nt, Homo Sapiens; identical to SEQ ID NO: 172976

SEQ ID NO: 175165 - RNA, 64 nt, Homo Sapiens; identical to SEQ ID NO: 172977

SEQ ID NO: 175166 - RNA, 64 nt, Homo Sapiens; identical to SEQ ID NO: 172978

SEQ ID NO: 175167 - RNA, 64 nt, Homo Sapiens; identical to SEQ ID NO: 172979

SEQ ID NO: 175168 - RNA, 64 nt, Homo Sapiens; identical to SEQ ID NO: 172980

SEQ ID NO: 175169 - RNA, 64 nt, Homo Sapiens; identical to SEQ ID NO: 172981

SEQ ID NO: 175170 - RNA, 64 nt, Homo Sapiens; identical to SEQ ID NO: 172982

SEQ ID NO: 175171 - RNA, 64 nt, Homo Sapiens; identical to SEQ ID NO: 172983

SEQ ID NO: 175172 - RNA, 64 nt, Homo Sapiens; identical to SEQ ID NO: 172984

SEQ ID NO: 175173 - RNA, 64 nt, Homo Sapiens; identical to SEQ ID NO: 172985

SEQ ID NO: 175174 - RNA, 64 nt, Homo Sapiens; identical to SEQ ID NO: 172986

SEQ ID NO: 175175 - RNA, 64 nt, Homo Sapiens; identical to SEQ ID NO: 172987

SEQ ID NO: 175176 - RNA, 64 nt, Homo Sapiens; identical to SEQ ID NO: 172988

SEQ ID NO: 175177 - RNA, 54 nt, Homo Sapiens; identical to SEQ ID NO: 172989

SEQ ID NO: 175178 - RNA, 64 nt, Homo Sapiens; identical to SEQ ID NO: 172990

SEQ ID NO: 175179 - RNA, 64 nt, Homo Sapiens; identical to SEQ ID NO: 172991

SEQ ID NO: 175180 - RNA, 64 nt, Homo Sapiens; identical to SEQ ID NO: 172992

SEQ ID NO: 175181 - RNA, 64 nt, Homo Sapiens; identical to SEQ ID NO: 172993

SEQ ID NO: 175182 - RNA, 64 nt, Homo Sapiens; identical to SEQ ID NO: 172994

SEQ ID NO: 175183 - RNA, 64 nt, Homo Sapiens; identical to SEQ ID NO: 172995

SEQ ID NO: 175184 - RNA, 64 nt, Homo Sapiens; identical to SEQ ID NO: 172996

SEQ ID NO: 175185 - RNA, 64 nt, Homo Sapiens; identical to SEQ ID NO: 172997

SEQ ID NO: 175186 - RNA, 64 nt, Homo Sapiens; identical to SEQ ID NO: 172998

SEQ ID NO: 175187 - RNA, 64 nt, Homo Sapiens; identical to SEQ ID NO: 172999

SEQ ID NO: 175188 - RNA, 64 nt, Homo Sapiens; identical to SEQ ID NO: 173000

SEQ ID NO: 175189 - RNA, 64 nt, Homo Sapiens; identical to SEQ ID NO: 173001

SEQ ID NO: 175190 - RNA, 64 nt, Homo Sapiens; identical to SEQ ID NO: 173002

SEQ ID NO: 175191 - RNA, 64 nt, Homo Sapiens; identical to SEQ ID NO: 173003

SEQ ID NO: 175192 - RNA, 64 nt, Homo Sapiens; identical to SEQ ID NO: 173004

SEQ ID NO: 175193 - RNA, 61 nt, Homo Sapiens; identical to SEQ ID NO: 173005

SEQ ID NO: 175194 - RNA, 64 nt, Homo Sapiens; identical to SEQ ID NO: 173006

SEQ ID NO: 175195 - RNA, 64 nt, Homo Sapiens; identical to SEQ ID NO: 173007

SEQ ID NO: 175196 - RNA, 64 nt, Homo Sapiens; identical to SEQ ID NO: 173008

SEQ ID NO: 175197 - RNA, 64 nt, Homo Sapiens; identical to SEQ ID NO: 173009

SEQ ID NO: 175198 - RNA, 64 nt, Homo Sapiens
acaugcuggccgaagauuucauccagaagucaacauccugcaauuauguugaaaagaguaguac

SEQ ID NO: 175199 - RNA, 64 nt, Homo Sapiens
uuuucaggugcucaaaaugcaaaacacaaaacaaauccugcauuuagauacaccucaacuaaau

SEQ ID NO: 175200 - RNA, 64 nt, Homo Sapiens
cagcaauaggguggcacagaagcucaucucagucauccugcaggcacaugagggggugcccucc

SEQ ID NO: 175201 - RNA, 64 nt, Homo Sapiens
caucuccuucaccccuauggugcucagcccugagauccugcacaagguggaguguacuggcuac

SEQ ID NO: 175202 - RNA, 64 nt, Homo Sapiens
aguacuccuauugccgccagagcaccuccgccagauccugcagaccugcagcgggaggaggagg

SEQ ID NO: 175203 - RNA, 64 nt, Homo Sapiens
gggaggaggaggagcaccucauaacuuccuacguauccugcagccuucagcaugccugaacuac

SEQ ID NO: 175204 - RNA, 64 nt, Homo Sapiens
ggcuuccagcuccuaaaacaccuggacauuccccauccugcaccggcacuguguuuguucagag

SEQ ID NO: 175205 - RNA, 64 nt, Homo Sapiens
cggcccgggugguccaugccugcggggugucuguauccugcaggaggacgccccuacagaccca

SEQ ID NO: 175206 - RNA, 64 nt, Homo Sapiens
gcagcuccccuccuggaauagaaucuuucuuuccauccugcauggcugagagccaggcuuccuu

SEQ ID NO: 175207 - RNA, 64 nt, Homo Sapiens
gcaggaggaaagucacugaugcccagauguuugcauccugcacagcuauagguccuuaaauaaa

SEQ ID NO: 175208 - RNA, 64 nt, Homo Sapiens
ccauaugcccagugccagcuagggcccaccgcccauccugcacacggggccgcugggcaggugc

SEQ ID NO: 175209 - RNA, 64 nt, Homo Sapiens
gcuuaaacaccauuuauaccacagguccagaugaauccugcagggccaaggucugggggugcug

SEQ ID NO: 175210 - RNA, 64 nt, Homo Sapiens
gcaugggacaggcccugccuagaagccgcucaacauccugcaauaucgaguggguggagaccag

SEQ ID NO: 175211 - RNA, 64 nt, Homo Sapiens
uuuuugucucgcggagcccccugaagaugcagugauccugcauccugccccagcgcggcuuccu

SEQ ID NO: 175212 - RNA, 64 nt, Homo Sapiens
gacaaccagaggcugaaagaugaaaauggugcccucaucagagucaucagcaaacuguccaagu

SEQ ID NO: 175213 - RNA, 64 nt, Homo Sapiens
gggugccaagagaaacagcaggauguugaauugaucaucagaugcccucuggaaugguuagcau

SEQ ID NO: 175214 - RNA, 64 nt, Homo Sapiens
aaacgaacuccgaugugcgcccauuguaaccaggucaucagaggaccauucuuaguggcacugg

SEQ ID NO: 175215 - RNA, 64 nt, Homo Sapiens
cuuauaaaguuaucuuacauuaaggaugucauuuucaucagaccuucuuucuacauauuauuca

SEQ ID NO: 175216 - RNA, 64 nt, Homo Sapiens
gauauucuauugauuuaaugugaccuguuuggucucaucagaagucuuaccauugggcauuuga

SEQ ID NO: 175217 - RNA, 64 nt, Homo Sapiens
caauaaagccaucuccuugugggccuuaccaucuucaucagauuuagacccuuaaaaaacaagu

SEQ ID NO: 175218 - RNA, 64 nt, Homo Sapiens
ucaaaugagcaaaacuaaggaugaaauguaauauucaucagaacaaggaucacugagaaaaaau

SEQ ID NO: 175219 - RNA, 64 nt, Homo Sapiens
uauauauaaacucuauauccuaauuuacuaauacucaucagaugucagccuuugcucuccauuu

SEQ ID NO: 175220 - RNA, 64 nt, Homo Sapiens
uuaaaauuuaaaguauaauuaguuuuuauaauuuucaucagauuuuuguuauauuuuuuggaag

SEQ ID NO: 175221 - RNA, 64 nt, Homo Sapiens
ccgauuugcaugugugaaagccuuaaaccaaaacucaucagagaauacaugcuugagagugauu

SEQ ID NO: 175222 - RNA, 64 nt, Homo Sapiens
uuaaauauaaugaauaugagaaaacucuuaguucucaucagauacuaaguuuuaagaauaaacu

SEQ ID NO: 175223 - RNA, 64 nt, Homo Sapiens
ccccagauggcuacagaccacagaagucaucagaucaucagagcccaggagaauuaucucagaa

SEQ ID NO: 175224 - RNA, 64 nt, Homo Sapiens
aucagagcccccagauggcuucucagaacagaagucaucagauccuaucuggccaggagaauua

SEQ ID NO: 175225 - RNA, 64 nt, Homo Sapiens
uuuuuuaguacaggcccaagaugaaacaggaaugucaucagagaucuaaaucauuuuuaaggga

SEQ ID NO: 175226 - RNA, 64 nt, Homo Sapiens
aacauacuuugaaaagaugccucuagucgccagcucaucagaaauaccuaaaagcccuuucuuc

SEQ ID NO: 175227 - RNA, 64 nt, Homo Sapiens
uuuguugacugucagguuaggugucccuuagucgucaucagaagcugaagccuuccuuuccaca

SEQ ID NO: 175228 - RNA, 64 nt, Homo Sapiens
gucaucagaagcugaagccuuccuuuccacacccucaucagauucaucuccacugauaaccggu

SEQ ID NO: 175229 - RNA, 64 nt, Homo Sapiens
uaccaaguaagccggcagaaagagcaauaaauauucaucagaggugauaguuucuaaaacauuu

SEQ ID NO: 175230 - RNA, 64 nt, Homo Sapiens
cagugaaaacuaaggauagauuuuuaagcccuuuucaucagaccuucauaaaaccucaagagca

SEQ ID NO: 175231 - RNA, 64 nt, Homo Sapiens
guuaauguaagguacauuugaucuuauucuguagucaucagaaugcuauauguuuauguauaua

SEQ ID NO: 175232 - RNA, 64 nt, Homo Sapiens
guacucuuuccccugccgucacugcauguaacaaucaucagauauuacgagcagaauaagggua

SEQ ID NO: 175233 - RNA, 64 nt, Homo Sapiens
ccauuucccaaacacuccgcuccauggucuccagucaucagagcaacucuaccugguauuauca

SEQ ID NO: 175234 - RNA, 64 nt, Homo Sapiens
gugcuggccaggugacuccuaguucuuggccacaucaucagaaagucaaaggucucacuccagg

SEQ ID NO: 175235 - RNA, 64 nt, Homo Sapiens
acagugguucaaguuaaaaaagcuuaagaguaccucaucagaauccaaacaaauucuuuuccac

SEQ ID NO: 175236 - RNA, 64 nt, Homo Sapiens
ugcaguugggugcuuaaccugguguugcaccuaaucaucagaggaucuuacaaccgacugaagg

SEQ ID NO: 175237 - RNA, 64 nt, Homo Sapiens
cacaagcugagccuccacguucagcagauacuguccaaggcagggguacggcugaccaggaaug

SEQ ID NO: 175238 - RNA, 64 nt, Homo Sapiens
uggcucacaccuguaaucccagcacuuugggaggccaaggcaggcaaucaccugaggucaggag

SEQ ID NO: 175239 - RNA, 64 nt, Homo Sapiens
cuccaggauccagauccauggggacauuaauaguccaaggcauucccucccccaccacuauuca

SEQ ID NO: 175240 - RNA, 64 nt, Homo Sapiens
acccugcaguuugagaucugaugcuuccugagggccaaggcauugcuguaagaaaaggucuaga

SEQ ID NO: 175241 - RNA, 64 nt, Homo Sapiens
uagaucgcuugagcccaggaaaugcuuugggaggccaaggcaggauggcguaaugggccugccc

SEQ ID NO: 175242 - RNA, 64 nt, Homo Sapiens
cuccagagccagccugggacacuaagcccucgaaccaaggcagcgaggagagugguuguugcca

SEQ ID NO: 175243 - RNA, 64 nt, Homo Sapiens
ugacucaugccuguaaucccaguacucugggaagccaaggcaggcagaucacuugaggucagga

SEQ ID NO: 175244 - RNA, 64 nt, Homo Sapiens
ccuuguuacugcuacuacacuuugcuccucuggcccaaggcaugaggagagaggcugugucaga

SEQ ID NO: 175245 - RNA, 64 nt, Homo Sapiens
uggcucagcagcaagaaaggucggggugucuuccccaaggcaugagaacaggcagcuguugagc

SEQ ID NO: 175246 - RNA, 64 nt, Homo Sapiens
ucaggucucuuugcugugccaaaguaucucagacccaaggcaccuggaagaacuuguuugcuug

SEQ ID NO: 175247 - RNA, 64 nt, Homo Sapiens
agcucuggcuuucguguuuuugguuuucuccuucccaaggcagcuggauugaaaaaacaaaaca

SEQ ID NO: 175248 - RNA, 64 nt, Homo Sapiens
uuuuccugaggucaucuguaaaauagucucauugccaaggcauccccagugccagcuggugaau

SEQ ID NO: 175249 - RNA, 64 nt, Homo Sapiens
ccagccugggugacagaguggagccaugauuaaaccaaggcacucaggcguucaaggcuacaga

SEQ ID NO: 175250 - RNA, 64 nt, Homo Sapiens
ggaauugcuugaguucagaaaacacuuugacaggccaaggcaggugguucauaucuguaauccu

SEQ ID NO: 175251 - RNA, 64 nt, Homo Sapiens
acuucccaacauuuaagaaaugucuguucaugucccaaggcauagaaaugguugcugagaaacu

SEQ ID NO: 175252 - RNA, 64 nt, Homo Sapiens
uggcuuugggacgugacaacgcucguuguaaaugccaaggcauucuugaggcacagcagccacu

SEQ ID NO: 175253 - RNA, 64 nt, Homo Sapiens
aagguacauggaugugcuuuggucaaggaauaggccaaggcagagauccaugccugcaugacuc

SEQ ID NO: 175254 - RNA, 64 nt, Homo Sapiens
cacagcuguguguggaagccacgggcucaagcagccaaggcagggcggacagugugagagagcu

SEQ ID NO: 175255 - RNA, 64 nt, Homo Sapiens
caaaaauagggaacauuuucccacccugaguuugccaaggcacaaccauggcaacccuugcauu

SEQ ID NO: 175256 - RNA, 64 nt, Homo Sapiens
aggggaaagccauuaaguggcaguggagacccccccaaggcaugccuggcuuccuuccuccacc

SEQ ID NO: 175257 - RNA, 64 nt, Homo Sapiens
auaagaaaaucuugcaauccaugggacucugcagccaaggcagggugcuuugaguuggacggga

SEQ ID NO: 175258 - RNA, 64 nt, Homo Sapiens
ccccagccccaagccugcgcuccuggagcacuuuccaaggcaucggcugcuguguggaugcuuu

SEQ ID NO: 175259 - RNA, 64 nt, Homo Sapiens
aaauguauaauggagaccaauuggauuuuuuuccccaaggcacaagguucauaaacuacaauau

SEQ ID NO: 175260 - RNA, 64 nt, Homo Sapiens
aggauuaccugaggccaggaagcacuuugggaagccaaggcagguagcucacgccuguaauccc

SEQ ID NO: 175261 - RNA, 64 nt, Homo Sapiens
guggcucaugcauguaauucuagcacuuuggaggccaaggcaggaggacugcuugagcccagga

SEQ ID NO: 175262 - RNA, 64 nt, Homo Sapiens
uagcuuaugccuguaaucucagcacuuugggaggccaaggcaggcagaucaugaggucaagaga

SEQ ID NO: 175263 - RNA, 64 nt, Homo Sapiens
gugaggcgugcuagaccugagcaguucuacccucccaaggcaccaguacucuaccauggggcau

SEQ ID NO: 175264 - RNA, 64 nt, Homo Sapiens
acucuguacuucucuaucugcacacacaaaaugcccaaggcacucacuggggaggaagcaagga

SEQ ID NO: 175265 - RNA, 64 nt, Homo Sapiens
uaguucaaugccucacgagauuugccaggggcauccaaggcaaacaaucccaaucuuucuauau

SEQ ID NO: 175266 - RNA, 64 nt, Homo Sapiens
guagcucaugccuguaacccuggcacuuaaggggccaaggcaggaggaucacuugaggccagug

SEQ ID NO: 175267 - RNA, 64 nt, Homo Sapiens
gugguagaauuuguaugcucuuagagcccaacagccaaggcagggucaagaagauaaguaauaa

SEQ ID NO: 175268 - RNA, 64 nt, Homo Sapiens
gcugggauuacgggcgugagccaccgugcucggcccaaggcaggagaaucucuugaagccagga

SEQ ID NO: 175269 - RNA, 64 nt, Homo Sapiens
ugggucaccuggggucaggaagcacuuugggaggccaaggcagguggcucacgccuguaaucuc

SEQ ID NO: 175270 - RNA, 64 nt, Homo Sapiens
auagugaggccccaucuuuagaguucaagaccagccaaggcaacagaggauaacuugaaacuag

SEQ ID NO: 175271 - RNA, 64 nt, Homo Sapiens
uggaucacgccuguaaucccagcacauugggaggccaaggcacauaggucacuugaggucaaga

SEQ ID NO: 175272 - RNA, 64 nt, Homo Sapiens
ucaagcgauuccucugccucagcacuuugggaggccaaggcaggcagauaacaaagucaggaga

SEQ ID NO: 175273 - RNA, 64 nt, Homo Sapiens
agauccagacaugccccucccccgcagacacaccccaaggcagcccaacccccaccccuucccc

SEQ ID NO: 175274 - RNA, 64 nt, Homo Sapiens
aguagaggaagggaccacccaagaaaacuaaaaaccaaggcaccuuaccagucugucuggggac

SEQ ID NO: 175275 - RNA, 64 nt, Homo Sapiens
gcagcaagcacaauaccauuaaaaagccucaagcccaaggcagaagaccuaucugcauuugagc

SEQ ID NO: 175276 - RNA, 64 nt, Homo Sapiens
cuuugucuaaugugggauuccugacucccuucguccaaggcaccggugugugugugucuugcac

SEQ ID NO: 175277 - RNA, 64 nt, Homo Sapiens
gcacugucuccugaggccagcguggaccugacagccaaggcagggggcaaaccugagauuucuc

SEQ ID NO: 175278 - RNA, 64 nt, Homo Sapiens
cugcagaacuuucccucuucgagucucacuagggccaaggcaggcccaccucuggucugguuaa

SEQ ID NO: 175279 - RNA, 64 nt, Homo Sapiens
uccaucaccauucaccccaggggacagccucgaccgagacaaggaggcccuuaaaugacagccu

SEQ ID NO: 175280 - RNA, 64 nt, Homo Sapiens
ugcccaguuaucagggagucuguccccgacucaucgagacaacaaagaugcaagaggggaaacc

SEQ ID NO: 175281 - RNA, 64 nt, Homo Sapiens
gagccacagaguacaaguuucucugaaaaaucaucgagacaaaauuaacacagcuaauuuuuuu

SEQ ID NO: 175282 - RNA, 64 nt, Homo Sapiens
agcccuuagcccuuccccucagccccaaguggaacgagacaagccaugugcuggccaccugcug

SEQ ID NO: 175283 - RNA, 64 nt, Homo Sapiens
gccgaggugggaagaucccuugagcccaggaguucgagacaagccuggguaacacggggagacc

SEQ ID NO: 175284 - RNA, 64 nt, Homo Sapiens
auaugcaagugcaaaagaauucaacaaauggcaccgagacaaugauagagaaaggagagucuuu

SEQ ID NO: 175285 - RNA, 64 nt, Homo Sapiens
aagccauaucaguuagacugcaauacuuuaaacacgagacaaaacaauccauauguuuagggaa

SEQ ID NO: 175286 - RNA, 64 nt, Homo Sapiens
gauccuuaaagaagguguggagauccugugauggcgagacaaaucacccuaggaaacauuucca

SEQ ID NO: 175287 - RNA, 64 nt, Homo Sapiens
gagauuucaguucagcgguugaggagaauugcggcgagacaagcauggaaaaucagugacaucu

SEQ ID NO: 175288 - RNA, 64 nt, Homo Sapiens
gcaggcaaaguccucugcaggccuggaaacccuccgagacaauuacuugcaugggguaacccag

SEQ ID NO: 175289 - RNA, 64 nt, Homo Sapiens
uuucuuaaaucccgaagaaaguagucuuucaguacgagacaaagggaccugacccacacugaau

SEQ ID NO: 175290 - RNA, 64 nt, Homo Sapiens
acuguaacugaacaggagcuaaacucuccgguuacgagacaaaguaaauaaaauucuuuugaug

SEQ ID NO: 175291 - RNA, 64 nt, Homo Sapiens
caugcagaugugcauguuaaagagauaaagugaucgagacaaggacugacuggguauagaagga

SEQ ID NO: 175292 - RNA, 64 nt, Homo Sapiens
caccuccgagcugaauaugaacugcacaggagcccgagacaauaaugagcagccguggcgcucg

SEQ ID NO: 175293 - RNA, 64 nt, Homo Sapiens
uuaaggagaaauuguaccuuauuuugccaaagcccgagacaacaacucauauccuuuaaacuaa

SEQ ID NO: 175294 - RNA, 64 nt, Homo Sapiens
ucauaauggucuuuuuuauuuuguuugauucauucgagacaacauguguguaugugugugugug

SEQ ID NO: 175295 - RNA, 64 nt, Homo Sapiens
gccaaggcagguggaucaccugaggucaggaguucgagacaagcguggccaauauggcaaagcc

SEQ ID NO: 175296 - RNA, 64 nt, Homo Sapiens
acauuguucaacucccuucucggggugggacagacgagacaacagcacacaggcagccagccgu

SEQ ID NO: 175297 - RNA, 64 nt, Homo Sapiens
agagagggauaucucaugaaggcucugggauccacgagacaaccuguauucccaagguuugcug

SEQ ID NO: 175298 - RNA, 64 nt, Homo Sapiens
caggggucuccugccugugccauccacuggggcucgagacaauuucccacucaccugugaggcc

SEQ ID NO: 175299 - RNA, 64 nt, Homo Sapiens
gaagucugaaggcuuugaauggaaucuaggcuaacgagacaaagggcuuacuugaucauuugau

SEQ ID NO: 175300 - RNA, 64 nt, Homo Sapiens
cucaggggagagugaaggccugcaggagggcaggcgagacaaggaggguguccagggcuaggga

SEQ ID NO: 175301 - RNA, 64 nt, Homo Sapiens
guaaaauggaccaaucagcaggauguggguggggcgagacaagagaauaaaagcaggcugccug

SEQ ID NO: 175302 - RNA, 64 nt, Homo Sapiens
uugcccggcucucccagaugccaccuggaccauccgagacaaguugccuaccuuaccacgguga

SEQ ID NO: 175303 - RNA, 64 nt, Homo Sapiens
acugcuaugcucaaggaccuggaaacccaugcuucgagacaacgugacuuuaaugggagggugg

SEQ ID NO: 175304 - RNA, 64 nt, Homo Sapiens
cugagaccagacucgagcaccccuguccuguaagcgagacaaaauggcguguguuauuuugggg

SEQ ID NO: 175305 - RNA, 64 nt, Homo Sapiens
ugcauguuuuuaucgaguacuaaggacauuucagcgagacaaaguuuggugcucagacaauauu

SEQ ID NO: 175306 - RNA, 64 nt, Homo Sapiens
ugguaggagagagacaggacagacccgcuuuucccgagacaaggaccccccaugucacggcagc

SEQ ID NO: 175307 - RNA, 64 nt, Homo Sapiens
ccgugagcgggagcgcagagagcggagccgggagcgagacaaggagcgagaacggcgacgcucc

SEQ ID NO: 175308 - RNA, 64 nt, Homo Sapiens
uugcaacacccgggcauguuauagcagcugugcacgagacaaucgcacguuaacucuaugccgg

SEQ ID NO: 175309 - RNA, 64 nt, Homo Sapiens
gugguggaggcaauuaugaggguagcauuucuuucgagacaaaacacccgucugggaaggcccc

SEQ ID NO: 175310 - RNA, 64 nt, Homo Sapiens
ggaaauagcgggguugcaggcagacauugagcugcgagacaaugggaauaaccuucguguccac

SEQ ID NO: 175311 - RNA, 64 nt, Homo Sapiens
ccucucaccaagcaguccuccaugugagcaaccccgagacaaaaaugcuaagugggaucaagag

SEQ ID NO: 175312 - RNA, 64 nt, Homo Sapiens
gacugucauaagcuagcacccgugguaagcgggacgagacaagcucccgaagcccgccagcuuc

SEQ ID NO: 175313 - RNA, 64 nt, Homo Sapiens
auauaucuauaguuuguaaaaagaacaaaacaaccgagacaaacccuugaugcuccuugcucgg

SEQ ID NO: 175314 - RNA, 64 nt, Homo Sapiens
uuggcgucuguguuguggagcuaaugauucaaugcgagacaagagaauguguugaugugcacag

SEQ ID NO: 175315 - RNA, 64 nt, Homo Sapiens
uccuuccucgacaacgugcggagucagaggaagccgagacaauaguaaacaaaaaugagagcuu

SEQ ID NO: 175316 - RNA, 64 nt, Homo Sapiens
agguuccccauguacauacaugcacauacucaaacaugcguacacacacacacauuuacacacg

SEQ ID NO: 175317 - RNA, 64 nt, Homo Sapiens
aaauuuugugguuccuucccuuuccucccccucccaugcguaagacguucuguguaaccuccau

SEQ ID NO: 175318 - RNA, 64 nt, Homo Sapiens
ucuuuggagaaaggucuauccugugcuuacgggccaugcguauucugaugcugagugucuuuuc

SEQ ID NO: 175319 - RNA, 64 nt, Homo Sapiens
cuuugcuauacaaaaguguuuuccacuaauuuugcaugcguauuuauaagaaaaaugugaauuu

SEQ ID NO: 175320 - RNA, 64 nt, Homo Sapiens
aacccuggaagaggcggccuaaggagauuccacacaugcguaucucuguugcuucuauuggccu

SEQ ID NO: 175321 - RNA, 64 nt, Homo Sapiens
ccagggauugauuaguccuccacugcccugggugcaugcguacacaauucccuggccaagccug

SEQ ID NO: 175322 - RNA, 64 nt, Homo Sapiens
uacguuugauaaaacuuacuggaacuaguacuaccaugcguauucccuguccaaagcaucacug

SEQ ID NO: 175323 - RNA, 54 nt, Homo Sapiens
uuuaagaaauuuuaucuuuuaugccaugcguaucguauagguuuaaagcccuaa

SEQ ID NO: 175324 - RNA, 64 nt, Homo Sapiens
gcauucugcggacccggucacgggcuugguuagucaugcguacaugugugccuuggggugcucu

SEQ ID NO: 175325 - RNA, 64 nt, Homo Sapiens
cucuugucuuaaauguacucugggaccaccucaacaugcguagcuuggcauuugaauaaagccc

SEQ ID NO: 175326 - RNA, 64 nt, Homo Sapiens
gagggagagggcagacucaggugggaagaugugccaugcguaaggcaucaacguguaucugugg

SEQ ID NO: 175327 - RNA, 64 nt, Homo Sapiens
auaacacagcuacuccucacugcaaaaacauauccaugcguagaaucaacaacuccagucaugg

SEQ ID NO: 175328 - RNA, 64 nt, Homo Sapiens
agccuucauaggcggucaugugugcaugugagcacaugcguauaugugcgucucucuuucuccc

SEQ ID NO: 175329 - RNA, 64 nt, Homo Sapiens
ugcagugccagacucugagccaagccacuggggccaugcguaugacuggugcagggaggcaagg

SEQ ID NO: 175330 - RNA, 64 nt, Homo Sapiens
cuacccaaguuuaauuuggucaggguuacucacccaugcguaagcauuaagaaauaagaauucc

SEQ ID NO: 175331 - RNA, 64 nt, Homo Sapiens
ggggacaagaugaaaccugcgccucgcugucccacaugcguauuacauuaaacaccaaauauaa

SEQ ID NO: 175332 - RNA, 64 nt, Homo Sapiens
ucagccauaugcuaguuuuuuuuucucuugccaacaugcguaaaaagggaagccaauuacaagu

SEQ ID NO: 175333 - RNA, 64 nt, Homo Sapiens
uauacauaacauacacacaauguauaaagaugcacaugcguacauguauguauaugcaugcaug

SEQ ID NO: 175334 - RNA, 64 nt, Homo Sapiens
cgacacucucuggaagcccucgcauggcaagucacaugcguaaacggcggcgcuuuaguuugag

SEQ ID NO: 175335 - RNA, 64 nt, Homo Sapiens
aauaugggccccuuauagagcugcaaaacacacacaugcguauagacauacauacauguacacc

SEQ ID NO: 175336 - RNA, 64 nt, Homo Sapiens
uuuuuuauuauaucaguugacauguaacuaguaccaugcguacuuaaauagaugguaauuuucu

SEQ ID NO: 175337 - RNA, 64 nt, Homo Sapiens
gggaagcguguugcaauccaugagugaugucugccaugcguacaggcauggagagugaggcgcc

SEQ ID NO: 175338 - RNA, 64 nt, Homo Sapiens
gccuccugcauucuccccucgaagcuuugagaaccaugcguauaaggccgccguuauauuugca

SEQ ID NO: 175339 - RNA, 64 nt, Homo Sapiens
uguguauagcagaacucugaaguacccauugaaacaugcguauuaucuccaugcggucccugga

SEQ ID NO: 175340 - RNA, 64 nt, Homo Sapiens
aggaacagacaucccuuucuaacugcacugccuacaugcguauuaagguccauucugccugugu

SEQ ID NO: 175341 - RNA, 64 nt, Homo Sapiens
aagcacauucuaacgcuacugagauaguuuauuacaugcguaagcuuaaugagcuuggaaucaa

SEQ ID NO: 175342 - RNA, 64 nt, Homo Sapiens
ccggcgggcuuugggaaugagggguucccuugaacaugcguaggcuggaaccccgucugagagg

SEQ ID NO: 175343 - RNA, 64 nt, Homo Sapiens
ucccacaaaugcagguguccuucuacuccugccucaugcguacggccugccugcagcaggcagc

SEQ ID NO: 175344 - RNA, 64 nt, Homo Sapiens
uugugaaaaauagcaacuauucauuuguucacaacaugcguauuuauagaguaguuagguacca

SEQ ID NO: 175345 - RNA, 64 nt, Homo Sapiens
cauccucgaaagugaaauguccuuuucuuugugccaugcguaaggugagucaaaccaaaccuca

SEQ ID NO: 175346 - RNA, 64 nt, Homo Sapiens
gaaauccugucucuacuaaaaauacaaaauuagccaugcguaguggugcaugccuguaauccca

SEQ ID NO: 175347 - RNA, 64 nt, Homo Sapiens
uuagaagguuucaggugggugaaaccuccuauuccaugcguaaggugccucgcugaagggagcu

SEQ ID NO: 175348 - RNA, 64 nt, Homo Sapiens; identical to SEQ ID NO: 118878

SEQ ID NO: 175349 - RNA, 64 nt, Homo Sapiens; identical to SEQ ID NO: 118879

SEQ ID NO: 175350 - RNA, 64 nt, Homo Sapiens; identical to SEQ ID NO: 118880

SEQ ID NO: 175351 - RNA, 64 nt, Homo Sapiens; identical to SEQ ID NO: 118881

SEQ ID NO: 175352 - RNA, 64 nt, Homo Sapiens; identical to SEQ ID NO: 118882

SEQ ID NO: 175353 - RNA, 64 nt, Homo Sapiens; identical to SEQ ID NO: 118883

SEQ ID NO: 175354 - RNA, 64 nt, Homo Sapiens; identical to SEQ ID NO: 118884

SEQ ID NO: 175355 - RNA, 64 nt, Homo Sapiens; identical to SEQ ID NO: 118885

SEQ ID NO: 175356 - RNA, 64 nt, Homo Sapiens; identical to SEQ ID NO: 118886

SEQ ID NO: 175357 - RNA, 64 nt, Homo Sapiens; identical to SEQ ID NO: 118887

SEQ ID NO: 175358 - RNA, 64 nt, Homo Sapiens; identical to SEQ ID NO: 118888

SEQ ID NO: 175359 - RNA, 64 nt, Homo Sapiens; identical to SEQ ID NO: 118889

SEQ ID NO: 175360 - RNA, 64 nt, Homo Sapiens; identical to SEQ ID NO: 118890

SEQ ID NO: 175361 - RNA, 56 nt, Homo Sapiens; identical to SEQ ID NO: 118891

SEQ ID NO: 175362 - RNA, 64 nt, Homo Sapiens
ugugaggccucaucuugaaccagaccuuaacgaccaaacccagaccaugccaaaguccagucug

SEQ ID NO: 175363 - RNA, 64 nt, Homo Sapiens
caggcugucaggaaacguguuuuauguuaagucacaaacccacuugacuucuggguacuggaau

SEQ ID NO: 175364 - RNA, 64 nt, Homo Sapiens
gccugucucuucucuuguuucugauugucuugaccaaacccacacgaaccuuggagagggaaug

SEQ ID NO: 175365 - RNA, 64 nt, Homo Sapiens
gcaucuuaccaacagcugguacuaggugaguugccaaacccaagcuugggcaauuugugcuaaa

SEQ ID NO: 175366 - RNA, 64 nt, Homo Sapiens
auccagaugaauauccgagaauuguaucacaaaacaaacccaauaccaguuaaggugaauaugu

SEQ ID NO: 175367 - RNA, 64 nt, Homo Sapiens
uguaaauaacauaugacuuccuucccaucccacacaaacccaaugcacuggcucauccgcccua

SEQ ID NO: 175368 - RNA, 64 nt, Homo Sapiens
guucagauucugccuguuuucaagauggcagucccaaacccaacaacuguuggccacacugaaa

SEQ ID NO: 175369 - RNA, 64 nt, Homo Sapiens
cggagggugucuccccaagccaggcacaccugcacaaacccagagccgacccucagcugccuuc

SEQ ID NO: 175370 - RNA, 64 nt, Homo Sapiens
accucagacaggaaagucggggucuaccuuagagcaaacccaguaccauuaggggccuugccaa

SEQ ID NO: 175371 - RNA, 64 nt, Homo Sapiens
cucaccugacagccgagggaccaaagcugauucacaaacccacguccaagagaaaugauccuau

SEQ ID NO: 175372 - RNA, 64 nt, Homo Sapiens
uccagcuccuaguagcuuucaaacuccuuuccugcaaacccauuccugaagggaagcccauucu

SEQ ID NO: 175373 - RNA, 64 nt, Homo Sapiens
cauaccagcuagaaucacuugcaaauccccuccccaaacccaccgaacccauccaauggauugu

SEQ ID NO: 175374 - RNA, 64 nt, Homo Sapiens
ggggugcacccaccuguuuucugaaacacacgagcaaacccagagguggauguuaugaacagcu

SEQ ID NO: 175375 - RNA, 64 nt, Homo Sapiens
uagaccaccagaggaggaugugugggauuguaggcaaacccaccuguggcaucacugaaaauaa

SEQ ID NO: 175376 - RNA, 64 nt, Homo Sapiens
auccccaacccauccucauccccaacuacagccccaaacccagccccagacuaauccacagcca

SEQ ID NO: 175377 - RNA, 64 nt, Homo Sapiens
auccccaacucauccucauccccaacugcagccccaaacccaacccagggccauccccaaaccc

SEQ ID NO: 175378 - RNA, 64 nt, Homo Sapiens
aacugcagccccaaacccaacccagggccauccccaaacccauccccaagccaaacucaacacc

SEQ ID NO: 175379 - RNA, 64 nt, Homo Sapiens
auaauguauguggaauauccguaugcuaauguugcaaacccaugcguccugcgggacagccagc

SEQ ID NO: 175380 - RNA, 54 nt, Homo Sapiens
cccuggacugauuuuccagugacucaaacccagacgccaggccuguccucuuag

SEQ ID NO: 175381 - RNA, 64 nt, Homo Sapiens
gucaucaucacauucagggcuauuuuuucccccacaaacccaagggcaggggccacucuuagcu

SEQ ID NO: 175382 - RNA, 64 nt, Homo Sapiens
gugugaagcaaggagcuuagauaagacacccccucaaacccauucccucuccaggagaccuacc

SEQ ID NO: 175383 - RNA, 64 nt, Homo Sapiens
cauacaggcagcgauggucuugauuuauaguuuguacaugcauuaugcugauggauaaccuaua

SEQ ID NO: 175384 - RNA, 64 nt, Homo Sapiens
uuauuaaaaugauuguaaaaggcuacugcagcuuuacaugcaaucacuaaucugggaagggaag

SEQ ID NO: 175385 - RNA, 64 nt, Homo Sapiens
cuuacuucguguccgacucuucugagcaccuacuuacaugcauuacugcaugcacuucuuacaa

SEQ ID NO: 175386 - RNA, 64 nt, Homo Sapiens
uauauccagauggcauguguuuacuuuauguuacuacaugcacuuggcugcauaaaugugguac

SEQ ID NO: 175387 - RNA, 64 nt, Homo Sapiens
uuauucauucagucgucaugaguugagugcuuacuacaugcaaggcacucugcuaguuauauuc

SEQ ID NO: 175388 - RNA, 64 nt, Homo Sapiens
uuaagugcuuuguguugaugccaugcuuaucaaauacaugcacaagcuaaacauaauuugaaug

SEQ ID NO: 175389 - RNA, 64 nt, Homo Sapiens
ugcuuguuuugaaaacucgagaugaugagggugguacaugcaguguguucucucuuuauuggcu

SEQ ID NO: 175390 - RNA, 64 nt, Homo Sapiens
aaucaaaacgaugguuugaaaaggaaaccuaugauacaugcaggagaagcaaaacccaagugau

SEQ ID NO: 175391 - RNA, 64 nt, Homo Sapiens
auuuuguuauucuguuaaaaaccacacacacucguacaugcagacaccuccaaugagauauagu

SEQ ID NO: 175392 - RNA, 64 nt, Homo Sapiens
auaguuugaagcuaauaccaucaggcucagaguuuacaugcauuuuuacuuaggaagugguaaa

SEQ ID NO: 175393 - RNA, 64 nt, Homo Sapiens
gcuuuaauccacuguguuaggucaaaacuucaaauacaugcauuuuucaauauaggguauauuu

SEQ ID NO: 175394 - RNA, 64 nt, Homo Sapiens
aucuauucauauuuuacauauauauauauauauauacaugcacacacaccgauacauuuaccuu

SEQ ID NO: 175395 - RNA, 64 nt, Homo Sapiens
ucagcucaaugucuuugaguguuaaauaagaauauacaugcacaaccauuaaagccacuuaaau

SEQ ID NO: 175396 - RNA, 64 nt, Homo Sapiens
uauaaaaccgccacagucuuuacauuuaagaucuuacaugcaguuguagguaggcccagagucu

SEQ ID NO: 175397 - RNA, 64 nt, Homo Sapiens
uuugguuaaacccaugagauaugguauucaggauuacaugcaugggcaauuccgcauuuaauuc

SEQ ID NO: 175398 - RNA, 64 nt, Homo Sapiens
ucagcguuuuuuuguuuuuacugcuuuaaaaaaauacaugcaucugugguugauauuucgaaag

SEQ ID NO: 175399 - RNA, 64 nt, Homo Sapiens
caaaauuauauggaacauuuucuguguguacauguacaugcauuuuucuagggagagaguccgu

SEQ ID NO: 175400 - RNA, 64 nt, Homo Sapiens
aaauacuuuuccuuaauuuuaauccacaguauguuacaugcauucuaccacuacauuuuggugc

SEQ ID NO: 175401 - RNA, 64 nt, Homo Sapiens
cucaugugcaaacccacucaagauagagagugaguacaugcacaacagauaaaccuagauaaag

SEQ ID NO: 175402 - RNA, 64 nt, Homo Sapiens
cacuuaggacaaaucugcaaggccuuccugcuguuacaugcagcccauguggacuuaggaaggu

SEQ ID NO: 175403 - RNA, 64 nt, Homo Sapiens; identical to SEQ ID NO: 166002

SEQ ID NO: 175404 - RNA, 64 nt, Homo Sapiens; identical to SEQ ID NO: 166003

SEQ ID NO: 175405 - RNA, 64 nt, Homo Sapiens; identical to SEQ ID NO: 166004

SEQ ID NO: 175406 - RNA, 64 nt, Homo Sapiens; identical to SEQ ID NO: 166005

SEQ ID NO: 175407 - RNA, 64 nt, Homo Sapiens; identical to SEQ ID NO: 166006

SEQ ID NO: 175408 - RNA, 64 nt, Homo Sapiens; identical to SEQ ID NO: 166007

SEQ ID NO: 175409 - RNA, 64 nt, Homo Sapiens; identical to SEQ ID NO: 166008

SEQ ID NO: 175410 - RNA, 64 nt, Homo Sapiens; identical to SEQ ID NO: 166009

SEQ ID NO: 175411 - RNA, 64 nt, Homo Sapiens; identical to SEQ ID NO: 166010

SEQ ID NO: 175412 - RNA, 60 nt, Homo Sapiens; identical to SEQ ID NO: 166011

SEQ ID NO: 175413 - RNA, 64 nt, Homo Sapiens; identical to SEQ ID NO: 166012

SEQ ID NO: 175414 - RNA, 64 nt, Homo Sapiens; identical to SEQ ID NO: 166013

SEQ ID NO: 175415 - RNA, 64 nt, Homo Sapiens; identical to SEQ ID NO: 166014

SEQ ID NO: 175416 - RNA, 64 nt, Homo Sapiens; identical to SEQ ID NO: 166015

SEQ ID NO: 175417 - RNA, 64 nt, Homo Sapiens; identical to SEQ ID NO: 166016

SEQ ID NO: 175418 - RNA, 64 nt, Homo Sapiens; identical to SEQ ID NO: 166017

SEQ ID NO: 175419 - RNA, 64 nt, Homo Sapiens; identical to SEQ ID NO: 166018

SEQ ID NO: 175420 - RNA, 64 nt, Homo Sapiens; identical to SEQ ID NO: 166019

SEQ ID NO: 175421 - RNA, 64 nt, Homo Sapiens; identical to SEQ ID NO: 166020

SEQ ID NO: 175422 - RNA, 64 nt, Homo Sapiens; identical to SEQ ID NO: 166021

SEQ ID NO: 175423 - RNA, 64 nt, Homo Sapiens; identical to SEQ ID NO: 166022

SEQ ID NO: 175424 - RNA, 64 nt, Homo Sapiens; identical to SEQ ID NO: 166023

SEQ ID NO: 175425 - RNA, 64 nt, Homo Sapiens; identical to SEQ ID NO: 166024

SEQ ID NO: 175426 - RNA, 64 nt, Homo Sapiens; identical to SEQ ID NO: 166025

SEQ ID NO: 175427 - RNA, 64 nt, Homo Sapiens; identical to SEQ ID NO: 166026

SEQ ID NO: 175428 - RNA, 64 nt, Homo Sapiens; identical to SEQ ID NO: 166027

SEQ ID NO: 175429 - RNA, 64 nt, Homo Sapiens; identical to SEQ ID NO: 166028

SEQ ID NO: 175430 - RNA, 64 nt, Homo Sapiens; identical to SEQ ID NO: 166029

SEQ ID NO: 175431 - RNA, 64 nt, Homo Sapiens; identical to SEQ ID NO: 166030

SEQ ID NO: 175432 - RNA, 64 nt, Homo Sapiens; identical to SEQ ID NO: 166031

SEQ ID NO: 175433 - RNA, 64 nt, Homo Sapiens; identical to SEQ ID NO: 166032

SEQ ID NO: 175434 - RNA, 64 nt, Homo Sapiens; identical to SEQ ID NO: 166033

SEQ ID NO: 175435 - RNA, 64 nt, Homo Sapiens; identical to SEQ ID NO: 166034

SEQ ID NO: 175436 - RNA, 64 nt, Homo Sapiens; identical to SEQ ID NO: 166035

SEQ ID NO: 175437 - RNA, 64 nt, Homo Sapiens; identical to SEQ ID NO: 166036

SEQ ID NO: 175438 - RNA, 64 nt, Homo Sapiens; identical to SEQ ID NO: 166037

SEQ ID NO: 175439 - RNA, 64 nt, Homo Sapiens; identical to SEQ ID NO: 166038

SEQ ID NO: 175440 - RNA, 64 nt, Homo Sapiens; identical to SEQ ID NO: 166039

SEQ ID NO: 175441 - RNA, 64 nt, Homo Sapiens; identical to SEQ ID NO: 166040

SEQ ID NO: 175442 - RNA, 64 nt, Homo Sapiens; identical to SEQ ID NO: 166041

SEQ ID NO: 175443 - RNA, 64 nt, Homo Sapiens; identical to SEQ ID NO: 166042

SEQ ID NO: 175444 - RNA, 64 nt, Homo Sapiens; identical to SEQ ID NO: 166043

SEQ ID NO: 175445 - RNA, 64 nt, Homo Sapiens; identical to SEQ ID NO: 166044

SEQ ID NO: 175446 - RNA, 64 nt, Homo Sapiens; identical to SEQ ID NO: 166045

SEQ ID NO: 175447 - RNA, 64 nt, Homo Sapiens; identical to SEQ ID NO: 166046

SEQ ID NO: 175448 - RNA, 51 nt, Homo Sapiens; identical to SEQ ID NO: 166047

SEQ ID NO: 175449 - RNA, 64 nt, Homo Sapiens; identical to SEQ ID NO: 166048

SEQ ID NO: 175450 - RNA, 64 nt, Homo Sapiens; identical to SEQ ID NO: 166049

SEQ ID NO: 175451 - RNA, 64 nt, Homo Sapiens; identical to SEQ ID NO: 166050

SEQ ID NO: 175452 - RNA, 64 nt, Homo Sapiens; identical to SEQ ID NO: 166051

SEQ ID NO: 175453 - RNA, 64 nt, Homo Sapiens; identical to SEQ ID NO: 166052

SEQ ID NO: 175454 - RNA, 64 nt, Homo Sapiens; identical to SEQ ID NO: 166053

SEQ ID NO: 175455 - RNA, 64 nt, Homo Sapiens; identical to SEQ ID NO: 166054

SEQ ID NO: 175456 - RNA, 64 nt, Homo Sapiens; identical to SEQ ID NO: 166055

SEQ ID NO: 175457 - RNA, 64 nt, Homo Sapiens; identical to SEQ ID NO: 166056

SEQ ID NO: 175458 - RNA, 64 nt, Homo Sapiens; identical to SEQ ID NO: 166057

SEQ ID NO: 175459 - RNA, 64 nt, Homo Sapiens; identical to SEQ ID NO: 166058

SEQ ID NO: 175460 - RNA, 64 nt, Homo Sapiens; identical to SEQ ID NO: 166059

SEQ ID NO: 175461 - RNA, 64 nt, Homo Sapiens; identical to SEQ ID NO: 166060

SEQ ID NO: 175462 - RNA, 64 nt, Homo Sapiens; identical to SEQ ID NO: 166061

SEQ ID NO: 175463 - RNA, 64 nt, Homo Sapiens; identical to SEQ ID NO: 166062

SEQ ID NO: 175464 - RNA, 64 nt, Homo Sapiens; identical to SEQ ID NO: 166063

SEQ ID NO: 175465 - RNA, 64 nt, Homo Sapiens; identical to SEQ ID NO: 166064

SEQ ID NO: 175466 - RNA, 64 nt, Homo Sapiens; identical to SEQ ID NO: 166065

SEQ ID NO: 175467 - RNA, 64 nt, Homo Sapiens; identical to SEQ ID NO: 166066

SEQ ID NO: 175468 - RNA, 64 nt, Homo Sapiens; identical to SEQ ID NO: 166067

SEQ ID NO: 175469 - RNA, 64 nt, Homo Sapiens; identical to SEQ ID NO: 166068

SEQ ID NO: 175470 - RNA, 64 nt, Homo Sapiens; identical to SEQ ID NO: 166069

SEQ ID NO: 175471 - RNA, 64 nt, Homo Sapiens; identical to SEQ ID NO: 166070

SEQ ID NO: 175472 - RNA, 64 nt, Homo Sapiens; identical to SEQ ID NO: 166071

SEQ ID NO: 175473 - RNA, 64 nt, Homo Sapiens; identical to SEQ ID NO: 166072

SEQ ID NO: 175474 - RNA, 64 nt, Homo Sapiens; identical to SEQ ID NO: 166073

SEQ ID NO: 175475 - RNA, 64 nt, Homo Sapiens; identical to SEQ ID NO: 166074

SEQ ID NO: 175476 - RNA, 64 nt, Homo Sapiens; identical to SEQ ID NO: 166075

SEQ ID NO: 175477 - RNA, 64 nt, Homo Sapiens; identical to SEQ ID NO: 166076

SEQ ID NO: 175478 - RNA, 64 nt, Homo Sapiens; identical to SEQ ID NO: 166077

SEQ ID NO: 175479 - RNA, 64 nt, Homo Sapiens
ggucagauggugguggugagaggccuuggggcuggggaaggagaguggacuuuggcucacucug

SEQ ID NO: 175480 - RNA, 64 nt, Homo Sapiens
gauagauggauggauggauggacggauggggugggggaaggaaggaaaggagggagaaaggagg

SEQ ID NO: 175481 - RNA, 64 nt, Homo Sapiens
cauugccuucacaccacuggguuugccagaaacagggaaggagggcguuaagggaaaaaaaaaa

SEQ ID NO: 175482 - RNA, 64 nt, Homo Sapiens
cagacaucgcccuggcccugcuggcccggguaucgggaaggaggagcgagggaaugacggaggu

SEQ ID NO: 175483 - RNA, 64 nt, Homo Sapiens
gggaggaggguucacaguguuuuugugggggcgggggaaggaagaggcagccccgcccccgcca

SEQ ID NO: 175484 - RNA, 64 nt, Homo Sapiens
gcucugucuucaacucuuuggcuagcaggcaugugggaaggaaggauauuuuaaagauuucuga

SEQ ID NO: 175485 - RNA, 64 nt, Homo Sapiens
uuaauacuuugaagucaugacagaaacugacuuggggaaggaaucuccuccucaaaaacugauu

SEQ ID NO: 175486 - RNA, 64 nt, Homo Sapiens
gcacuguuagcauuuaacuucuuguuaggauucagggaaggaacaguuggccaagaauuuuuuu

SEQ ID NO: 175487 - RNA, 64 nt, Homo Sapiens
cugguuuggacaaaaacccucaguagagacaagcgggaaggauaauuagcugaaagcuaugaug

SEQ ID NO: 175488 - RNA, 64 nt, Homo Sapiens
gaugagaucaauacuacugauccaucuguagccugggaaggagacaggacauuccuguacuaag

SEQ ID NO: 175489 - RNA, 64 nt, Homo Sapiens
cuagaaauagaaggcccagugguggaauauuagagggaaggaaacugacaacgugugaaaguua

SEQ ID NO: 175490 - RNA, 64 nt, Homo Sapiens
guuacaaaucacaguauaagauuuaagugccugggggaaggauacaauuuuuagaaauuacaua

SEQ ID NO: 175491 - RNA, 64 nt, Homo Sapiens
gugaggaaaaggugguaaauaggaaaccaugaaugggaaggauggcaauaaguagcaacuauac

SEQ ID NO: 175492 - RNA, 64 nt, Homo Sapiens
acucuccagcagaaugucugcuugugucuagauggggaaggagcagguucaucggguacuggga

SEQ ID NO: 175493 - RNA, 64 nt, Homo Sapiens
ucucaucaaccagggaagaggaacugagaucacagggaaggagauuggaggugauaccagcaca

SEQ ID NO: 175494 - RNA, 64 nt, Homo Sapiens
agcaggaaagauggaguuaccaguuacugaaauagggaaggaugggcuggguaaguauggaauu

SEQ ID NO: 175495 - RNA, 64 nt, Homo Sapiens
cguuugggaaacaagacuuuuccugcaauagccugggaaggaauaaaaggauagaguguuuggg

SEQ ID NO: 175496 - RNA, 64 nt, Homo Sapiens
aggauggccucugcuaagcucaaggcgugaggaugggaaggagggagguauucguaaggauggg

SEQ ID NO: 175497 - RNA, 64 nt, Homo Sapiens
ugaggaugggaaggagggagguauucguaaggaugggaaggagggagguauucgugcagcauau

SEQ ID NO: 175498 - RNA, 64 nt, Homo Sapiens
ccaacggcaauggcaugagaacucuuguuucuuggggaaggagaggagggaaaaggaccagggu

SEQ ID NO: 175499 - RNA, 64 nt, Homo Sapiens
cagugggcugcaguugcccaaccacaggaagaaagggaaggagguagagggaagaaacagaagc

SEQ ID NO: 175500 - RNA, 64 nt, Homo Sapiens
agcagagcuuauuuuucaccggagcaugaggcaagggaaggaaauucacauggggacaggggau

SEQ ID NO: 175501 - RNA, 64 nt, Homo Sapiens
gacuggaggccucaccguggucaagcaucuucaagggaaggacgcugcccaucgcggcugcggg

SEQ ID NO: 175502 - RNA, 64 nt, Homo Sapiens
cccuaacuagggcaagucaguauaaaacgauccugggaaggagcacaucaaacaaccuugugau

SEQ ID NO: 175503 - RNA, 64 nt, Homo Sapiens
aaaaaaaccacccccagcuuauauuguguaaaaagggaaggaaauuuuucaaauuggugucaua

SEQ ID NO: 175504 - RNA, 64 nt, Homo Sapiens
ucugguuccagagaauuugcucagauguggccaagggaaggagcguuuccugccuauggugaga

SEQ ID NO: 175505 - RNA, 64 nt, Homo Sapiens
acgaggacacucgcuugccgggccugggccuccugggaaggagggagcugcucagaaugccgca

SEQ ID NO: 175506 - RNA, 64 nt, Homo Sapiens
gccccacccagaccugaaugcuucugagagcaaagggaaggacugacgagagauguauauuuaa

SEQ ID NO: 175507 - RNA, 64 nt, Homo Sapiens
gugaguaucccugccaccaagagagcaaugggcagggaaggaaggggucugccgaccccagcuc

SEQ ID NO: 175508 - RNA, 64 nt, Homo Sapiens
uguacuuguggaaagguguguuugcguagccuuagggaaggaaggcaauugcuccuuaacagca

SEQ ID NO: 175509 - RNA, 64 nt, Homo Sapiens
gaccuuauuccaaagcacgauaaaucugggcuuagggaaggagauuugaggugucaaauacaaa

SEQ ID NO: 175510 - RNA, 64 nt, Homo Sapiens
gccguguggugcuuugcuagucuucccugcagcagggaaggaggggggucugcgguggcuccug

SEQ ID NO: 175511 - RNA, 64 nt, Homo Sapiens
ggacacagccuuauuacugcuggggugggauaaggggaaggagaagagggagaauggagcagga

SEQ ID NO: 175512 - RNA, 64 nt, Homo Sapiens
uguccccagagggaggagcaggcaggagagagaggggaaggagguaugaaucccaguccccagg

SEQ ID NO: 175513 - RNA, 64 nt, Homo Sapiens
aacuaauaaauggacuacaguagcucacguuacagggaaggaggguaggcagggaggcucugug

SEQ ID NO: 175514 - RNA, 64 nt, Homo Sapiens
uuaggauugaaguggcuggaaagagugaugccuggggaaggagauggaguuaugaggguacugu

SEQ ID NO: 175515 - RNA, 64 nt, Homo Sapiens
ggaacaugcuugcaguaucuucaaagggauccuggggaaggagggugacucauguuucccuguu

SEQ ID NO: 175516 - RNA, 64 nt, Homo Sapiens
aagccacucucacaagaaagcacauugugugugugggaaggacagcccagcauguauguaugca

SEQ ID NO: 175517 - RNA, 64 nt, Homo Sapiens
ucccaucagugaauccugaaaacaaacuuagaaagggaaggaaauuuuagaaaaggaaaacgug

SEQ ID NO: 175518 - RNA, 64 nt, Homo Sapiens
agucacugggagagguuaccuguucuccauaggagggaaggagcgguguguaggugguaaaacc

SEQ ID NO: 175519 - RNA, 64 nt, Homo Sapiens
aggcuggagcuccaugcacguaguccagaugccugggaaggaacaucucccuuccagcaucugc

SEQ ID NO: 175520 - RNA, 64 nt, Homo Sapiens
uacaguucugaccuuuuuuguccaguuucuuugggggaaggaagacaaagaagguaggaacgga

SEQ ID NO: 175521 - RNA, 64 nt, Homo Sapiens
cccaguguugcagggaggcacccauuuggcugaugggaaggaggggaggauuucaguuaggucu

SEQ ID NO: 175522 - RNA, 64 nt, Homo Sapiens
gaggauuucaguuaggucucagcugaccugaguggggaaggaagaggcaggggauuguaguagc

SEQ ID NO: 175523 - RNA, 64 nt, Homo Sapiens
ucggauggggcgcgccugcgcccucagaacgugugggaaggagggggcguggacaggacacggg

SEQ ID NO: 175524 - RNA, 64 nt, Homo Sapiens
ccgccagccuugcucagcuguggguugcccugcugggaaggagggaaucacguccaccuggguc

SEQ ID NO: 175525 - RNA, 64 nt, Homo Sapiens
gugugggugccaguccuccucaggagaaggggaagggaaggaggccacuuugagagggcugaag

SEQ ID NO: 175526 - RNA, 64 nt, Homo Sapiens
uuacuagaaucauuucauuauuucugcuuccugggggaaggaugcagaaggagucugaugcuca

SEQ ID NO: 175527 - RNA, 64 nt, Homo Sapiens
cuuaucugaucuuccucaaacuucagauagguuagggaaggacaaaggcccccagccaugaagg

SEQ ID NO: 175528 - RNA, 64 nt, Homo Sapiens
ccucucaaccaucccacuaaguuauagccaagaagggaaggagacacggggauuugggguucuc

SEQ ID NO: 175529 - RNA, 64 nt, Homo Sapiens
gaaucagcagguucucugcccucccuagggguuggggaaggacccaccccggucagcacagugc

SEQ ID NO: 175530 - RNA, 64 nt, Homo Sapiens
gccacuuuccagcuccacuuuuucaccaaaauuggggaaggagugggaaagugcuauuuccuau

SEQ ID NO: 175531 - RNA, 64 nt, Homo Sapiens
gggcaaaacacauaaaaugagggggggauuuaaagggaaggagucaaaucagugacccaaggga

SEQ ID NO: 175532 - RNA, 64 nt, Homo Sapiens
gugcuguggagggggcugcaagccccaugggccugggaaggagggccacgggaugggguggggg

SEQ ID NO: 175533 - RNA, 64 nt, Homo Sapiens
ggcuggggcggccaguuuugauuuccuggcgggugggaaggaauaggacaaagguagcaagagg

SEQ ID NO: 175534 - RNA, 64 nt, Homo Sapiens
agaaagcugggaaaggggauaaggaaaggugagugggaaggagcggaagaaaauggccaggggg

SEQ ID NO: 175535 - RNA, 64 nt, Homo Sapiens
ggugagugggaaggagcagaagaaaauggccagggggaaggaaaguuuuagacucugaugagga

SEQ ID NO: 175536 - RNA, 64 nt, Homo Sapiens
cugccuggcuggaggcccgagcucccuggagcccgggaaggagguccccuaagccagcacugcu

SEQ ID NO: 175537 - RNA, 64 nt, Homo Sapiens
ggaagcugggcguccucugggcucccucacuaaagggaaggaaacgcgcuggggucugggcugu

SEQ ID NO: 175538 - RNA, 64 nt, Homo Sapiens
agccccaggucauacagggcagggucccagaaaagggaaggaggacguucauuucauuuuaugg

SEQ ID NO: 175539 - RNA, 53 nt, Homo Sapiens
gccuacguucauuucauuuuaaggggaaggacuagaggggcaacgcccauuag

SEQ ID NO: 175540 - RNA, 64 nt, Homo Sapiens
cagggcccucccagcccauugcugccaagguggagggaaggauaaagccacuucuggcuucagc

SEQ ID NO: 175541 - RNA, 64 nt, Homo Sapiens
ggauaaagccacuucuggcuucagcccccaccaggggaaggaaggagggcacauuaacucccuc

SEQ ID NO: 175542 - RNA, 64 nt, Homo Sapiens
ugggguguuuucuugcugaccagccuaagggagugggaaggaaagcucugccuugcaucacccu

SEQ ID NO: 175543 - RNA, 64 nt, Homo Sapiens
auaaacagaauauuuauuacauuuccuagggaaggggaaggagacccugaaccacugugugccc

SEQ ID NO: 175544 - RNA, 64 nt, Homo Sapiens
gcucucgggugggggagccacgucagagagacccgggaaggaagggccuguggggagccgaggg

SEQ ID NO: 175545 - RNA, 64 nt, Homo Sapiens
agagagggagcaggcggagcggaggaggaauaaggggaaggaagaggggugguagucagaggag

SEQ ID NO: 175546 - RNA, 64 nt, Homo Sapiens
cagcggccgacaaagcagaacccagccccaggccgggaaggagcggcaggaaggaauggggggc

SEQ ID NO: 175547 - RNA, 64 nt, Homo Sapiens
aaugaggacagucccgucgugaggggaagaccuggggaaggaaggcaaggccaacagggcaggg

SEQ ID NO: 175548 - RNA, 64 nt, Homo Sapiens
uuacugucuaauauaggaaaccugcccuugagcagggaaggaacuggauggcugggcuaugggu

SEQ ID NO: 175549 - RNA, 64 nt, Homo Sapiens
guugacucuugaggacccccguuuccucuccugugggaaggagauuuucaggacagagugcaca

SEQ ID NO: 175550 - RNA, 64 nt, Homo Sapiens
ggauguuaaauuaacucacuaugguuuuucaccugggaaggaaacaaauuacguacuagagggc

SEQ ID NO: 175551 - RNA, 64 nt, Homo Sapiens
gagggcauugacugguuaaaaacuuguguaucccgggaaggaccugcgguacaggagucagcca

SEQ ID NO: 175552 - RNA, 64 nt, Homo Sapiens
gacaccuucugugcucauguuuggaaagcugaaagggaaggacagcugugcccuccugggagcu

SEQ ID NO: 175553 - RNA, 64 nt, Homo Sapiens
ggucccaugaccagcauuaugaaaaugcgagagugggaaggacacagugugagacuuccacuag

SEQ ID NO: 175554 - RNA, 64 nt, Homo Sapiens
gaaagucacucgacauuggucucuuguguugauagggaaggaaaucaggcauuccuauuucuuu

SEQ ID NO: 175555 - RNA, 64 nt, Homo Sapiens
agcgugggaugcuguagcccccgggguugggcaagggaaggaugguggcccuccagaggucaug

SEQ ID NO: 175556 - RNA, 64 nt, Homo Sapiens
caggugaggucugaggacagcaggccuucccuaggggaaggagcugggagugccaaggccccag

SEQ ID NO: 175557 - RNA, 64 nt, Homo Sapiens
aaaccagcaaaggaagcucucccaggaggugacugggaaggagaugaacuugcucugaacugca

SEQ ID NO: 175558 - RNA, 64 nt, Homo Sapiens
uagucuuucuccaagaagaaucagcuccucccuggggaaggaaccaggggugagguucuuggcc

SEQ ID NO: 175559 - RNA, 64 nt, Homo Sapiens
cagcagaguuggggcagcugcugagagcaggggagggaaggaggguggagaaacgcccuccagu

SEQ ID NO: 175560 - RNA, 64 nt, Homo Sapiens
acacugggaggaggagaggcccaccuucaggccugggaaggaagcucuuggggaggcagagaag

SEQ ID NO: 175561 - RNA, 64 nt, Homo Sapiens
uuacucuuuuagucaggauuucggucuuuucugcgggaaggaauuaagcuauguauuaggucca

SEQ ID NO: 175562 - RNA, 64 nt, Homo Sapiens
ugucacguggcucccccuagccgcacacuagugugggaaggaaaauauugagcuaggcacauua

SEQ ID NO: 175563 - RNA, 64 nt, Homo Sapiens
guccaccuaugucuuuguaucuacauucuugacggggaaggaacuuccucugggaaccuuuggg

SEQ ID NO: 175564 - RNA, 64 nt, Homo Sapiens
gagccaaaauguuucccgguguuugcugguuucagggaaggaguuugauauagcagauuaacca

SEQ ID NO: 175565 - RNA, 64 nt, Homo Sapiens
gggccuggcuuuccguuccucugaaaagcucucugggaaggaauuacgcaaacugcgccugcuc

SEQ ID NO: 175566 - RNA, 64 nt, Homo Sapiens
cacaucauaaaaaggaccaugcuucgcaggaagugggaaggacuggcucauuagcuggcuacau

SEQ ID NO: 175567 - RNA, 61 nt, Homo Sapiens
agccagaauaauuuuagaucugaucagguaguagcuaaaauuagaaaaaaacaaaauagau

SEQ ID NO: 175568 - RNA, 61 nt, Homo Sapiens
ugaaaugucagugucaaaauauuauagauuauagcuaaaauccagauuaauacucauuugg

SEQ ID NO: 175569 - RNA, 61 nt, Homo Sapiens
ucuuacauucagaaauguggcaaaaaaggcauagcuaaaggcuaaacauauggcuuuagua

SEQ ID NO: 175570 - RNA, 61 nt, Homo Sapiens
auuucuguuauuuuuaagcuuuuauuucuuguagcuaaaaauaaaacaucauaaaucuggu

SEQ ID NO: 175571 - RNA, 61 nt, Homo Sapiens
aauaucauuugaccuaagugaauguugauacuagcuaaagauuggguaaauugguugaauu

SEQ ID NO: 175572 - RNA, 61 nt, Homo Sapiens
ugguugaauuauuguauugaagcuugagcuguagcuaaaaguaauuuagguuuccccuaag

SEQ ID NO: 175573 - RNA, 64 nt, Homo Sapiens
ccauccccuguguauuuaaguuguuccauucuuuggccauuauaacuuuuuucugcaaauauuc

SEQ ID NO: 175574 - RNA, 64 nt, Homo Sapiens
cuuuuuucugcaaauauucuggugacuuaucuuuggccauuauaaacuguugauaauagaucau

SEQ ID NO: 175575 - RNA, 64 nt, Homo Sapiens; identical to SEQ ID NO: 70868

SEQ ID NO: 175576 - RNA, 64 nt, Homo Sapiens; identical to SEQ ID NO: 70869

SEQ ID NO: 175577 - RNA, 64 nt, Homo Sapiens; identical to SEQ ID NO: 70870

SEQ ID NO: 175578 - RNA, 64 nt, Homo Sapiens; identical to SEQ ID NO: 70871

SEQ ID NO: 175579 - RNA, 64 nt, Homo Sapiens; identical to SEQ ID NO: 70872

SEQ ID NO: 175580 - RNA, 62 nt, Homo Sapiens; identical to SEQ ID NO: 70873

SEQ ID NO: 175581 - RNA, 64 nt, Homo Sapiens; identical to SEQ ID NO: 70874

SEQ ID NO: 175582 - RNA, 64 nt, Homo Sapiens; identical to SEQ ID NO: 70875

SEQ ID NO: 175583 - RNA, 64 nt, Homo Sapiens; identical to SEQ ID NO: 70876

SEQ ID NO: 175584 - RNA, 64 nt, Homo Sapiens; identical to SEQ ID NO: 70877

SEQ ID NO: 175585 - RNA, 64 nt, Homo Sapiens; identical to SEQ ID NO: 70878

SEQ ID NO: 175586 - RNA, 64 nt, Homo Sapiens; identical to SEQ ID NO: 70879

SEQ ID NO: 175587 - RNA, 64 nt, Homo Sapiens; identical to SEQ ID NO: 172966

SEQ ID NO: 175588 - RNA, 64 nt, Homo Sapiens; identical to SEQ ID NO: 172967

SEQ ID NO: 175589 - RNA, 64 nt, Homo Sapiens; identical to SEQ ID NO: 172968

SEQ ID NO: 175590 - RNA, 64 nt, Homo Sapiens; identical to SEQ ID NO: 172969

SEQ ID NO: 175591 - RNA, 64 nt, Homo Sapiens; identical to SEQ ID NO: 172970

SEQ ID NO: 175592 - RNA, 64 nt, Homo Sapiens; identical to SEQ ID NO: 172971

SEQ ID NO: 175593 - RNA, 64 nt, Homo Sapiens; identical to SEQ ID NO: 172972

SEQ ID NO: 175594 - RNA, 64 nt, Homo Sapiens; identical to SEQ ID NO: 172973

SEQ ID NO: 175595 - RNA, 64 nt, Homo Sapiens
aauauuuuuuuaagaaaaaaagcaaaaacaauguauugcugauaaucaguuuggaccaguuucu

SEQ ID NO: 175596 - RNA, 64 nt, Homo Sapiens
uagauguuacuauaccuaccauuuauucagcuggauugcugaacacaguucuggauucauagaa

SEQ ID NO: 175597 - RNA, 64 nt, Homo Sapiens
cacaaucaguaacauccauacauacaaagacguaauugcugaccuagaauugcuauucucgaua

SEQ ID NO: 175598 - RNA, 64 nt, Homo Sapiens
acugcagccagggguugaaaaacucuugaaguccauugcugaaagaaagaaaaaaaaaacgccc

SEQ ID NO: 175599 - RNA, 64 nt, Homo Sapiens
ucaccagugauuauugguguaauuuguuaauaaaauugcugaggguuacccaauuagggaaaua

SEQ ID NO: 175600 - RNA, 64 nt, Homo Sapiens
uucuggaauauuugcaucuaaguuagaggccagcauugcugacaacacuggagggggcagccca

SEQ ID NO: 175601 - RNA, 64 nt, Homo Sapiens
uucuguauugauggacucauucuucuugccucccauugcugauucuguguuaguucaaagaauc

SEQ ID NO: 175602 - RNA, 64 nt, Homo Sapiens
ucuaaauaaugaugcccugaaaacacacucuuucauugcugaauugcauuggaagagagaaagg

SEQ ID NO: 175603 - RNA, 64 nt, Homo Sapiens
ugcuggagaucaucuuuaagggcaaaggaguuggauugcugaauuacaaugaaacaugucuuau

SEQ ID NO: 175604 - RNA, 64 nt, Homo Sapiens
ccacuucugugucuuucuaauggaaaugaguagaauugcugaaagucucuauguuaaaaccuau

SEQ ID NO: 175605 - RNA, 64 nt, Homo Sapiens
ucuugucugcacagaaagucccaguacaacuuccauugcugagaaaauccucagaggacuuucc

SEQ ID NO: 175606 - RNA, 64 nt, Homo Sapiens
aacugaaucugagguuuuauaaaucccucaaacgauugcugagagccugauuguggaaagaagu

SEQ ID NO: 175607 - RNA, 64 nt, Homo Sapiens
agaagccuugucucgugaauaacauaaaauugaaauugcugauguuauauaaaaauaaguagaa

SEQ ID NO: 175608 - RNA, 64 nt, Homo Sapiens
augcugcagcccugcugguuuaagauccauucucauugcugauauauagcaugacuguugaccu

SEQ ID NO: 175609 - RNA, 64 nt, Homo Sapiens
ucaaauugaugugaaaugccuccaaauuaggcauauugcugagcgguuuucuaaaauuaaaaug

SEQ ID NO: 175610 - RNA, 64 nt, Homo Sapiens
guugacuugagucuuguccugcaaagugcacugaauugcugaaagcuuaauuuagauccuuucu

SEQ ID NO: 175611 - RNA, 64 nt, Homo Sapiens
aaaauauugaccagcuaccccuuuauggaaaaagauugcugacuccugauaaagaauauaaagu

SEQ ID NO: 175612 - RNA, 64 nt, Homo Sapiens
uugguuguaauuuaacaagucaaauaaaauaaucauugcugagcacaaucacauguugaaacaa

SEQ ID NO: 175613 - RNA, 64 nt, Homo Sapiens
ucccucuucugccaguacucccccuguaccacccauugcugauggcacacccauccuuaagcua

SEQ ID NO: 175614 - RNA, 64 nt, Homo Sapiens
ggggggaggggagggaagucuugugaaaccgcugauugcugacuuuugugugaagaaucguguu

SEQ ID NO: 175615 - RNA, 64 nt, Homo Sapiens
acaaggacagacaguuuuuugaaaaaagaaauuuauugcugaucgcgagacucagucucaaaaa

SEQ ID NO: 175616 - RNA, 64 nt, Homo Sapiens
ggccaggugcggugguucguuagaaaagaaauuuauugcugauuuuaauaagaaaugggguaaa

SEQ ID NO: 175617 - RNA, 64 nt, Homo Sapiens
uauacuuguauguaaugauugccaagguaacagaauugcugacaucugucuaaaaaguuuugac

SEQ ID NO: 175618 - RNA, 64 nt, Homo Sapiens
uauuugauaugauuuuaaagucagaauaguacagauugcugaguauuauacuuuaggcuagauu

SEQ ID NO: 175619 - RNA, 64 nt, Homo Sapiens
cacuuugggccaaaagcucuaauggaacauuuuuaguggugauuuggggaaggaaaguuaauga

SEQ ID NO: 175620 - RNA, 64 nt, Homo Sapiens
ugggguagugcccaagccuggucguguugccaggaguggugacaagaaaugcagcuuacaucaa

SEQ ID NO: 175621 - RNA, 64 nt, Homo Sapiens
aacucaacuaaaacccacugaagcguuuuacaccaguggugauuuuuggguuccuaagaugcac

SEQ ID NO: 175622 - RNA, 64 nt, Homo Sapiens
ugauagcuccugucaucguggguagagggagcagaguggugaccguuaaacagggcuggcauca

SEQ ID NO: 175623 - RNA, 64 nt, Homo Sapiens
uaguuagguuuuuuaaaauagugaccuuuuaccaaguggugaguuccucucucauaaacauuug

SEQ ID NO: 175624 - RNA, 64 nt, Homo Sapiens
uuugguuagggugaucgcccccuuccaagaacaaaguggugauuuucuguuuaauguucauucu

SEQ ID NO: 175625 - RNA, 64 nt, Homo Sapiens
gccaucagacagagacuucacaaggacaugagacaguggugaugagccacaaucagaaaaagga

SEQ ID NO: 175626 - RNA, 64 nt, Homo Sapiens
gccauguagcaaguggggaagacagaugugaagcaguggugaagagucgggcacagagguagca

SEQ ID NO: 175627 - RNA, 64 nt, Homo Sapiens
augguucucaacuccuuaauuucucaagcuacaaaguggugaacccaggccaacucuagcuccu

SEQ ID NO: 175628 - RNA, 64 nt, Homo Sapiens
uagaauuaacucgugcuaagacugaggaagauagaguggugacuugaacaagcagaccaacaac

SEQ ID NO: 175629 - RNA, 64 nt, Homo Sapiens
ggacacauccccuuagaggaccugaguuugggagaguggugaguggaagggaggagcagcaaga

SEQ ID NO: 175630 - RNA, 64 nt, Homo Sapiens
uuuguggaccaauacuaagaauaacaagaagcccaguggugaggaaagugcguucucccagcac

SEQ ID NO: 175631 - RNA, 64 nt, Homo Sapiens
ugauguuaaacugauggaaauucuuuuucgccuuaguggugauuguuuaaacucucacagucuu

SEQ ID NO: 175632 - RNA, 64 nt, Homo Sapiens
uauauauuuucaaaagauagcuuaugucuaaaacaguggugaugaguaaggccaguugagcauu

SEQ ID NO: 175633 - RNA, 64 nt, Homo Sapiens
gauggaaagacuuaaagaugaauuugagaaaaauugaaagaaauuagauuaucagguucuguua

SEQ ID NO: 175634 - RNA, 64 nt, Homo Sapiens
uuacaagucuuucacagaaguuuggugguaauauugaaagaacuagcauugggcagaauguguc

SEQ ID NO: 175635 - RNA, 64 nt, Homo Sapiens
gguaauaaacaugaaaacugguuuguagcaguuuugaaagaauagaaugcauucaaauguaagg

SEQ ID NO: 175636 - RNA, 64 nt, Homo Sapiens
auucagaaagacaggagaauuaggagagagugagugaaagaagccaagggucaagaaugcagaa

SEQ ID NO: 175637 - RNA, 64 nt, Homo Sapiens
uuuguacagaaaugaaaauaaaauaugaaaauaaugaaagaaaugaaaagauagcuuuuaauug

SEQ ID NO: 175638 - RNA, 64 nt, Homo Sapiens
cuaagugguucauauuucuaaugaggaagauuaaugaaagaacauuguuauauucugcguggua

SEQ ID NO: 175639 - RNA, 64 nt, Homo Sapiens
uuacacuggcucguggacagaacaauuugaaaagugaaagaauuauuuugguaaaagauuuugc

SEQ ID NO: 175640 - RNA, 64 nt, Homo Sapiens
aauggaacgguugaaugaaauuuuacucuuucugugaaagaaaauccacagaguuguugccucc

SEQ ID NO: 175641 - RNA, 64 nt, Homo Sapiens
ucauaacuguuaauucucagccaucuuugaagcuugaaagaagagucuuugguauuuuguaaac

SEQ ID NO: 175642 - RNA, 64 nt, Homo Sapiens
cauuuuaaaacuuuuuuuuaacuaauaauagcuuugaaagaagaggcuuaauuuggggguggua

SEQ ID NO: 175643 - RNA, 64 nt, Homo Sapiens
uacucacugcugcaaauacuguauauucaggacuugaaagaaauggugaaugccuaugguggau

SEQ ID NO: 175644 - RNA, 64 nt, Homo Sapiens
uguuuuggauauaguauaagcagugucuguguuuugaaagaauagaacacaguuuguagugcca

SEQ ID NO: 175645 - RNA, 64 nt, Homo Sapiens
aaaagaaauuguucuuuuaauaauauuacuagaaugaaagaauauuuaauguucuaaguaguga

SEQ ID NO: 175646 - RNA, 64 nt, Homo Sapiens
uccuuuauauauccaaccacgaggcauucugaaaugaaagaaacgauauaauaaaaugagacug

SEQ ID NO: 175647 - RNA, 64 nt, Homo Sapiens
guagcaaacaguaugcaguaacuaaaaauauccuugaaagaauagaagcuagucuccugucuag

SEQ ID NO: 175648 - RNA, 64 nt, Homo Sapiens
acuucuuuuuacauuucagcagcaaauuaaagaaugaaagaaguuggggcuguauuaucagcac

SEQ ID NO: 175649 - RNA, 64 nt, Homo Sapiens
caguuuguuaguaccuauauacuuuguucucccaugaaagaauucuauugcucuagaauguauu

SEQ ID NO: 175650 - RNA, 64 nt, Homo Sapiens
agcuagcaaaugaguuuuagcagcuaauguguagugaaagaaugcagcaaaacuuccccaugaa

SEQ ID NO: 175651 - RNA, 64 nt, Homo Sapiens
cuguccaggagaacagaagggaaaaaaagauacuugaaagaaacugaaggaaauuuaaacaaag

SEQ ID NO: 175652 - RNA, 64 nt, Homo Sapiens
aagaaacugaaggaaauuuaaacaaagaaacacuugaaagaaacuggaaagaaaaauaauuuuu

SEQ ID NO: 175653 - RNA, 64 nt, Homo Sapiens
gugacuuccuuggaaaucaaauguaaaguuuaauugaaagaauguaaagcaaccaaaaagaaaa

SEQ ID NO: 175654 - RNA, 64 nt, Homo Sapiens
ucacuggugguuuuccgcauucuuuguacacccaugaaagaaaacuuuuaugcaaggucuugca

SEQ ID NO: 175655 - RNA, 64 nt, Homo Sapiens
gaccaugguuaagcaaccauauagaaagcuuuguugaaagaaaguauggcaucuuguaccacug

SEQ ID NO: 175656 - RNA, 64 nt, Homo Sapiens
uauuaucuauuacucuugagagcuggcuguccuuugaaagaaagaaguaauguucuuugaaaga

SEQ ID NO: 175657 - RNA, 64 nt, Homo Sapiens
uggcuguccuuugaaagaaagaaguaauguucuuugaaagaaagaaaaaucucuugcuguguca

SEQ ID NO: 175658 - RNA, 64 nt, Homo Sapiens
uuugaccaugauaauucaguuuauauucaccacaugaaagaaaaauggguaacagaagaacccu

SEQ ID NO: 175659 - RNA, 64 nt, Homo Sapiens
cuuaaaacagguuaauuuggauuguaacguucagugaaagaaauuucaacccuucauagccagc

SEQ ID NO: 175660 - RNA, 64 nt, Homo Sapiens
ugaaagcuagguauuuaucaacugcagauguuauugaaagaaaauaaaauucagucucaagagu

SEQ ID NO: 175661 - RNA, 64 nt, Homo Sapiens
uugggguuuaaagaaauggucugcauaaccugaaugaaagaagcaaaugacuauucucugaaga

SEQ ID NO: 175662 - RNA, 64 nt, Homo Sapiens
gugauuuauuaauuuuaaaacauucagaacuuguugaaagaaaaauuauaucugaaucaagauu

SEQ ID NO: 175663 - RNA, 64 nt, Homo Sapiens
aguucgaaagaagaagcaagcgcuggccuggccuugaaagaaccgaagucuuucccauucacuu

SEQ ID NO: 175664 - RNA, 64 nt, Homo Sapiens
ugauuuuaauggccacaucuaaucucauuucacaugaaagaagaaguauauuuuagaaauuugu

SEQ ID NO: 175665 - RNA, 64 nt, Homo Sapiens
cuauggauaacaauucuucauuuaccuaguauuaugaaagaaugaaggaguucaaacaaaugug

SEQ ID NO: 175666 - RNA, 64 nt, Homo Sapiens
uauaguagggggacuaaggaaaccuucggaucuaugaaagaaaagaaacguguucuuacaaaug

SEQ ID NO: 175667 - RNA, 64 nt, Homo Sapiens
gauauuaaugauaaucauuuguuauugaaaauauugaaagaacuaacuaaaagcaacuuuuuau

SEQ ID NO: 175668 - RNA, 64 nt, Homo Sapiens
uccaaauaaagcccaccuaguuauuuguauuugaugaaagaaaauaaaaauugagugaggguua

SEQ ID NO: 175669 - RNA, 64 nt, Homo Sapiens
ugcugggcauucaaaugugugaaguuuuucuaucugaaagaaggggacuguugaaacuacugcg

SEQ ID NO: 175670 - RNA, 64 nt, Homo Sapiens
gacacagaggugccagugauggacuggaucagcuugaaagaagcacaaagacuccgugaucaca

SEQ ID NO: 175671 - RNA, 64 nt, Homo Sapiens
aaucugagacauccugacucucgagcugggaagaugaaagaaacucuauuauauauuuggccua

SEQ ID NO: 175672 - RNA, 64 nt, Homo Sapiens
gaguccugggauuuguacuucaugaagacuuuugugaaagaauagguguccuuaugaacaacgu

SEQ ID NO: 175673 - RNA, 64 nt, Homo Sapiens
cugcugacuucaacguucacuuuaugcaccaaagugaaagaauucaguguauccguuauuuuaa

SEQ ID NO: 175674 - RNA, 64 nt, Homo Sapiens
auuaaaaagagugaggauggaguacucugccccuugaaagaaguaacaaaguaaucuacuguaa

SEQ ID NO: 175675 - RNA, 64 nt, Homo Sapiens
uaauggagaaucacuuuucuauuggggguggcugugaaagaaaagugaguggaugaaggugggu

SEQ ID NO: 175676 - RNA, 64 nt, Homo Sapiens
cagcauuuuaucauuccauggaaggagaaucuuuugaaagaaagcauugccuccuaccagaacu

SEQ ID NO: 175677 - RNA, 64 nt, Homo Sapiens
aucugggaaaccaacauugcgagaguagcuauuuugaaagaauaauucuccagaaguuaacauc

SEQ ID NO: 175678 - RNA, 64 nt, Homo Sapiens
aaacaggaguucagcggagcuugaaagaagaacaugaaagaaauaguuauaaaaggugaaucua

SEQ ID NO: 175679 - RNA, 64 nt, Homo Sapiens
acaugaaagaaauaaacaggaaaggugaaucuauugaaagaagaauaaacgauuuuaaguuaua

SEQ ID NO: 175680 - RNA, 64 nt, Homo Sapiens
aguuuaggucgaggacuggccuuuugucuguaggugaaagaacaauugauugcacuugauuaag

SEQ ID NO: 175681 - RNA, 64 nt, Homo Sapiens
gcuagaagccuaagaacuguucaacaagugcuccugaaagaaaccaguggcagagaauccaaac

SEQ ID NO: 175682 - RNA, 64 nt, Homo Sapiens
uugaaaggggaaagauuggagguaagagagaaaaugaaagaacaccucuggguccuucugucca

SEQ ID NO: 175683 - RNA, 64 nt, Homo Sapiens
uuucuucaccuucaauaugagaauucagcgaacuugaaagaaaaaucaucugugaguuccuuca

SEQ ID NO: 175684 - RNA, 64 nt, Homo Sapiens
ugauugccuacuuucacauuuauuuaaauuuuugugaaagaaaauacaguuuuaaaggcuauag

SEQ ID NO: 175685 - RNA, 64 nt, Homo Sapiens
uaauagacauauuuaguagguuaaacuacuccuuugaaagaauaaguuuugguucaaagucaau

SEQ ID NO: 175686 - RNA, 64 nt, Homo Sapiens
gcacaaagauuauauaugacaaucaguauugcaaugaaagaaaaacuaaaaacagaaaugauau

SEQ ID NO: 175687 - RNA, 64 nt, Homo Sapiens
gagguuuuucacuccaccaaaucuuacaaaucauugaaagaaauauauucuaacaguacgcacu

SEQ ID NO: 175688 - RNA, 64 nt, Homo Sapiens
uuaugucuagauaagacuucagacguccugggauugaaagaaugugugugaagggguagaauuu

SEQ ID NO: 175689 - RNA, 64 nt, Homo Sapiens
ccaaguagcagucagguucuuggugugaugggacugaaagaauuccagucagccagagccuugg

SEQ ID NO: 175690 - RNA, 64 nt, Homo Sapiens
aauuucuucacucucauuuucauaaugaguauuuugaaagaagaacuuacauugaaccuggugg

SEQ ID NO: 175691 - RNA, 64 nt, Homo Sapiens
cccuuugguuucauuguguucuuuuuuagauuuuugaaagaaaaguuucaaaucuugcaucuuc

SEQ ID NO: 175692 - RNA, 64 nt, Homo Sapiens
ggaaguuaucuuaaugccaccaaaaugucuuuauugaaagaaguaacaaauaaauagcaugcaa

SEQ ID NO: 175693 - RNA, 64 nt, Homo Sapiens
aaugaaaacuuuauacaaaaguaaacaauaaagaugaaagaaaagcuuaugaugccggaauucu

SEQ ID NO: 175694 - RNA, 64 nt, Homo Sapiens
uuuagcuauauuaggaaacugcuucuaccuagauugaaagaaauuugacucauaaacuuccaag

SEQ ID NO: 175695 - RNA, 64 nt, Homo Sapiens
accaauauaccacuuccuaaauauccaucuuuggugaaagaaaauagugugguaagaguaccca

SEQ ID NO: 175696 - RNA, 64 nt, Homo Sapiens
agugacaaaucuuuaaaguauuuuuguuguuacaugaaagaauggagguaaacuaccugauuuu

SEQ ID NO: 175697 - RNA, 64 nt, Homo Sapiens
gccuuaguugaacaguucuccacuuuuuuagacaugaaagaauuauauguuguguauaaaugua

SEQ ID NO: 175698 - RNA, 64 nt, Homo Sapiens
accauuauuguacagagguaacaauuaaaaugaaugaaagaaaauucaaaaaauuaauaugugu

SEQ ID NO: 175699 - RNA, 64 nt, Homo Sapiens
cagucccuugacuugaaguagaauauucugacucugaaagaagacucuugcagugugcucuacu

SEQ ID NO: 175700 - RNA, 64 nt, Homo Sapiens
gacagacauguucaucaucaacuucaagaagaaaugaaagaaggucaaagagagaaggucgggu

SEQ ID NO: 175701 - RNA, 64 nt, Homo Sapiens
augucgcuaugcacugcaaggcuaauugccaccaugaaagaagcuauggaccuuucucaggaca

SEQ ID NO: 175702 - RNA, 64 nt, Homo Sapiens
ccugaaagaugggcaaaagacgggaagcaagaugugaaagaagagcagccuaggcagaggcucc

SEQ ID NO: 175703 - RNA, 64 nt, Homo Sapiens
uccgcggcaggaggagccggugcucuggaagaccugaaagaagcccagguggccacagggcuaa

SEQ ID NO: 175704 - RNA, 64 nt, Homo Sapiens
agcaugaaauucugucagugccuuuuuuaauacaugaaagaauucuagagagaagccauauaca

SEQ ID NO: 175705 - RNA, 64 nt, Homo Sapiens
aagcuuucaaucauuuuaguuccuuucaaauacaugaaagaacucaucauggagaaaaccaaac

SEQ ID NO: 175706 - RNA, 64 nt, Homo Sapiens
gagccuuuagucauuuuaguuccacuugaagccaugaaagaacacacaaaagagaaagcucuug

SEQ ID NO: 175707 - RNA, 64 nt, Homo Sapiens
gaaauguggcuuuguuccaccucccauuugcuugugaaagaagaaaaagaauucagugauauuu

SEQ ID NO: 175708 - RNA, 64 nt, Homo Sapiens
cacacuggggagaaauacuaugccuaaguaugcaugaaagaauuaagcauuugcucuuuccuca

SEQ ID NO: 175709 - RNA, 64 nt, Homo Sapiens
cacacuggagagaaaccuuagguuuccagauacaugaaagaaccaaacauacauuacucuugca

SEQ ID NO: 175710 - RNA, 64 nt, Homo Sapiens
cacacuggagaaaaacccuagguuuucaagcacaugaaagaacuaaaccuacauaucuucugua

SEQ ID NO: 175711 - RNA, 64 nt, Homo Sapiens
cauaccgcaaagaagcuauguuccuucaaggacaugaaagaacuaagccuucacucauucccgu

SEQ ID NO: 175712 - RNA, 64 nt, Homo Sapiens
cacacucgagagaaaccuuaugccuucuacaacaugaaagaauuaagcauucucuuggcucacu

SEQ ID NO: 175713 - RNA, 64 nt, Homo Sapiens
cacacuggagagaagaaacuacacugcaaagucaugaaagaacuaaggcuuugauuguuccagu

SEQ ID NO: 175714 - RNA, 64 nt, Homo Sapiens
cguacuggggagaaacuguaucuuaucuaagacaugaaagaacaaagccuuucauuuuuacagu

SEQ ID NO: 175715 - RNA, 64 nt, Homo Sapiens
cacucuggagagaaacuauauuauuucguaugcaugaaagaacuaagcauuuuucuggcccagu

SEQ ID NO: 175716 - RNA, 64 nt, Homo Sapiens
cauuugugugggcaaucccaaccugccuggucccugaaagaaagacccaccaccuucccagguc

SEQ ID NO: 175717 - RNA, 64 nt, Homo Sapiens
agaauguauucaucugcuucugaaaguuuguaauugaaagaaaacuggaaaauaugcuacagaa

SEQ ID NO: 175718 - RNA, 64 nt, Homo Sapiens
uuaacuccuuuauuaaaaacguuuuauauaggauugaaagaaaaugaaguuuuuaauugcuauu

SEQ ID NO: 175719 - RNA, 64 nt, Homo Sapiens
cacguuucuguaacagagagucagcucuucagugugaaagaaaauuuauauuccuguuucuaaa

SEQ ID NO: 175720 - RNA, 64 nt, Homo Sapiens
ucauggauucccaagaugugagcuuuuuacauaaugaaagaacccagcaauucugucucuuaau

SEQ ID NO: 175721 - RNA, 64 nt, Homo Sapiens
acagaauuaccucugcuuaguaucucauuauaacugaaagaagguuuaucauuacaaauaccuu

SEQ ID NO: 175722 - RNA, 64 nt, Homo Sapiens
ccacaaauaugagugggaaauaaaucagcacauuugaaagaaaguguuaaaacugaaggccuca

SEQ ID NO: 175723 - RNA, 64 nt, Homo Sapiens
uuuugcaauucagggaagauuugggcauauuaaaugaaagaauaucuaauugggggagguguga

SEQ ID NO: 175724 - RNA, 64 nt, Homo Sapiens
uguuggacgagaaaacaauaacgauaaaagacagugaaagaaaauaacgauaaaagacagugaa

SEQ ID NO: 175725 - RNA, 64 nt, Homo Sapiens
aaagacagugaaagaaaauaacgauaaaagacagugaaagaaaauaacaauaaaagacaaggaa

SEQ ID NO: 175726 - RNA, 64 nt, Homo Sapiens
aacuaaacuaucaggccucuaagauauuucauugugaaagaagaaagguaucaguccagucuua

SEQ ID NO: 175727 - RNA, 64 nt, Homo Sapiens
uucaguccccauuauuaccuacaaucguauuugaugaaagaaaccaucuaauuugguaguuucc

SEQ ID NO: 175728 - RNA, 64 nt, Homo Sapiens
uuguagauuuaaaaacaagugccguacguuaagagaagagcagaucaugcuauugugacauuug

SEQ ID NO: 175729 - RNA, 64 nt, Homo Sapiens
aaccuaaaaugcugcugccccaaagcacaagagggaagagcaccgccggggccacaggacgucu

SEQ ID NO: 175730 - RNA, 64 nt, Homo Sapiens
cuggcaauggugauaauggauuaauuccucaaaggaagagcagaacaccugaaaaucagcaauu

SEQ ID NO: 175731 - RNA, 64 nt, Homo Sapiens
cuggcaauggugaugauggauuaauuccuccaaggaagagcagaacaccugaaagccagcaauu

SEQ ID NO: 175732 - RNA, 64 nt, Homo Sapiens
gcagaagaaaugacagcagaagcgaaauccuggugaagagcaaaggagacaaggaaacgggcac

SEQ ID NO: 175733 - RNA, 64 nt, Homo Sapiens
aguaaacacaaaaaacauaaaagaaaaaguuucagaagagcagaaaaagaaaaaagauagaaaa

SEQ ID NO: 175734 - RNA, 64 nt, Homo Sapiens
gcuguccuaggccaaccagaccuauaaggggcaggaagagcaaagaagaugaacugugagggcu

SEQ ID NO: 175735 - RNA, 64 nt, Homo Sapiens
gggucauggagcaggugggccgagaaccagaggagaagagcauagcccugguuacagacagcuu

SEQ ID NO: 175736 - RNA, 64 nt, Homo Sapiens
cuagugaccagcacugaccaccaucccaagcugggaagagcaauuggugaagaguguguguacu

SEQ ID NO: 175737 - RNA, 64 nt, Homo Sapiens
ucagugccugugugaagauggugucggcugaaaagaagagcaauggcgucaaguacuaaaugau

SEQ ID NO: 175738 - RNA, 64 nt, Homo Sapiens
gguggauuuaauuuuuuaacaauacuccccgacggaagagcaagguucugugcacauacuuuuc

SEQ ID NO: 175739 - RNA, 50 nt, Homo Sapiens
cuacuaaaaugugccuauaggaagagcaguagcuccuugaccagggauga

SEQ ID NO: 175740 - RNA, 64 nt, Homo Sapiens
aaacucuggauguuugugcguuuuuuuccauggugaagagcaauaauacccaucgggaagagac

SEQ ID NO: 175741 - RNA, 64 nt, Homo Sapiens
ccuucagcuuccccuccccgccucuguuggcugagaagagcaucgugggggaaagguggcugga

SEQ ID NO: 175742 - RNA, 64 nt, Homo Sapiens
gcuaggacuugucccagcauaugaacuguccucagaagagcaggcuauugugaguucucagagc

SEQ ID NO: 175743 - RNA, 64 nt, Homo Sapiens
ucaaaugagcauaguggggaguacccuauagggggaagagcaagccuucucugaaugacucagg

SEQ ID NO: 175744 - RNA, 64 nt, Homo Sapiens
caucucugacauaaccacaggcugcuguuuucaagaagagcaaucuguuuggauaagaaaaacc

SEQ ID NO: 175745 - RNA, 64 nt, Homo Sapiens
gaggucuuuuuucauuuaauacuggaaaaauauugaagagcauccauguucacuuauggcuggu

SEQ ID NO: 175746 - RNA, 64 nt, Homo Sapiens
uccuaacuucauagaaacuaugagcguucaauuugaagagcaguuagaaugaggccuugugaug

SEQ ID NO: 175747 - RNA, 64 nt, Homo Sapiens
gccaucacuggcccuccuagacgccaugucucccgaagagcauucuuuugguugcagugcagag

SEQ ID NO: 175748 - RNA, 64 nt, Homo Sapiens
ccucuguccccaggccuggcuccccgagggcucagaagagcagcuucggugugcagaucauccg

SEQ ID NO: 175749 - RNA, 64 nt, Homo Sapiens
gagaacgggcgucaggggugcacaguccacagcugaagagcaagguuucguggcagcacggccc

SEQ ID NO: 175750 - RNA, 64 nt, Homo Sapiens
acaagugugccuacugcgucaugggcuucacgcagaagagcaacaugaagcugcacaugaagcg

SEQ ID NO: 175751 - RNA, 64 nt, Homo Sapiens
caccuuuaagaauguuucugaaguuacguuuugugaagagcaaagcacuuggaaucuccguuuu

SEQ ID NO: 175752 - RNA, 64 nt, Homo Sapiens
gaaauacagagaacgccacaaagauacuccuugagaagagcaacuccaagacacauaauuguca

SEQ ID NO: 175753 - RNA, 64 nt, Homo Sapiens
ugcuuaacgaaauaaaagaggaugcaaagaaauggaagagcauuccaugcucauggguaggaag

SEQ ID NO: 175754 - RNA, 64 nt, Homo Sapiens
accauuuugauuuuuaaaguaugcuguagcauuucuuaauaacaucguugugauguucuuaagg

SEQ ID NO: 175755 - RNA, 64 nt, Homo Sapiens
uguaauuuuaugcaaguugacuauauaucuuguacuuaauaaauuauaggcucauuuuguucuc

SEQ ID NO: 175756 - RNA, 64 nt, Homo Sapiens
aggagggggagaucuacaauuugaauauguguuacuuaauaaggcuaggcuggccaucaguugc

SEQ ID NO: 175757 - RNA, 64 nt, Homo Sapiens
cuaaauuuuccuucuagaugguccuugagcaaaacuuaauaauuacuguuuuuuauuuccacug

SEQ ID NO: 175758 - RNA, 64 nt, Homo Sapiens
gaccucccuaccaagugaugaaaguguugaaaaacuuaauaacaaaugcuuguugggcaagaau

SEQ ID NO: 175759 - RNA, 64 nt, Homo Sapiens
aacccuauuguaguaaaaaagucuucuuuacuaucuuaauaaaacagauauugugagauucaca

SEQ ID NO: 175760 - RNA, 64 nt, Homo Sapiens
accuuaaaaccaaaaugaaacacaaaaauuaauccuuaauaaugauagcaagugaucuuucuuu

SEQ ID NO: 175761 - RNA, 64 nt, Homo Sapiens
uuuuuuaaaaaagcaccuuuuuuuguuguuuccccuuaauaaaagagguuucuaauuuauguuu

SEQ ID NO: 175762 - RNA, 64 nt, Homo Sapiens
accgcuaauauaaguaaaguuuguaaaauucauacuuaauaaacaauuuaggacagucaugucu

SEQ ID NO: 175763 - RNA, 64 nt, Homo Sapiens
ucaguguauaaaacauacugugugguauaacaggcuuaauaaauucuuuaaaaggagagaacug

SEQ ID NO: 175764 - RNA, 64 nt, Homo Sapiens
cauugaauuguaguaaagguguccugacuuuagucuuaauaaaaugacucaguaaguuggcaag

SEQ ID NO: 175765 - RNA, 64 nt, Homo Sapiens
ccuccacucucuggaaggagcaaaauagccuauccuuaauaaauaaggagagcuuugcagauaa

SEQ ID NO: 175766 - RNA, 64 nt, Homo Sapiens
agaauguggcaaagcauuuaauugguccucaaugcuuaauaaauauaauucaugcuggagagaa

SEQ ID NO: 175767 - RNA, 64 nt, Homo Sapiens
ucuccucacauuuuacuaacuagcaauguucauacuuaauaaaaacauuauaaauguaauuucu

SEQ ID NO: 175768 - RNA, 64 nt, Homo Sapiens
aauaaaauaaaaagcagcaaagagugccuagaaucuuaauaaugacacuuaguauuucccccac

SEQ ID NO: 175769 - RNA, 64 nt, Homo Sapiens
ucuucuuuaccuucucuaugauccccacgucagccuuaauaaaggggcauuuaauucugacuuu

SEQ ID NO: 175770 - RNA, 64 nt, Homo Sapiens
uguugcaauacucugacguuucaaagccaauacucuuaauaaaguuguuacuucagcuacugau

SEQ ID NO: 175771 - RNA, 64 nt, Homo Sapiens
aacaaaaaaguuugacuuuuuacuguggaaugugcuuaauaaaauauuauucaugacagcuuug

SEQ ID NO: 175772 - RNA, 64 nt, Homo Sapiens
acacugguuaacuuuuuccagaucucaugucuggcuuaauaagagauauuuguauuaucauauc

SEQ ID NO: 175773 - RNA, 64 nt, Homo Sapiens
uuucuuagccuccauaaucacaugagccaaucuccuuaauaaaugccugcucauagaucuguau

SEQ ID NO: 175774 - RNA, 64 nt, Homo Sapiens
caugacuuuguuuauuuaaaagucugccaauguacuuaauaaaaacauuuuggacagcacauga

SEQ ID NO: 175775 - RNA, 64 nt, Homo Sapiens
auucuuuuuuaaaaucugcuguuggagagcaaaacuuaauaauagagcugaagcacacggccau

SEQ ID NO: 175776 - RNA, 64 nt, Homo Sapiens
aucugcuggauucuuucauuucacuuucaucuugcuuaauaaauguugaccuguguuuguaauu

SEQ ID NO: 175777 - RNA, 64 nt, Homo Sapiens
guaugacacugaaaagauuuucauaacuuuauggcuuaauaaaucuccacaagagcugaggguu

SEQ ID NO: 175778 - RNA, 64 nt, Homo Sapiens
uuuggauuuaauuuuauaaauguaaccugaaauccuuaauaaaacauucuagaaauuugaagua

SEQ ID NO: 175779 - RNA, 64 nt, Homo Sapiens
uuacauugaauugauuuuuacuagauuuccugcucuuaauaaaagauugucauuagaggaaggu

SEQ ID NO: 175780 - RNA, 64 nt, Homo Sapiens
cugcucacauuuuacucaacacagagaguuccugcuuaauaaaagcauuauaagugcaauuacu

SEQ ID NO: 175781 - RNA, 64 nt, Homo Sapiens
auauacgaguauaaaugaaauucauuucuaaauucuuaauaaauauuuucucaugccaggugug

SEQ ID NO: 175782 - RNA, 64 nt, Homo Sapiens
aaagaaaaaaaaugggcgaagagaggguggaaaauaaaaggauucuuuuuucuuccuuucuguu

SEQ ID NO: 175783 - RNA, 64 nt, Homo Sapiens
agaaguagaaaggaagaaaaacucaaagaauucuuaaaaggauucauagcaacauaaugugucc

SEQ ID NO: 175784 - RNA, 64 nt, Homo Sapiens
auugaugauagaagaauaggaauauuauaauuuuuaaaaggacuuuuuuauuuuguauauguag

SEQ ID NO: 175785 - RNA, 64 nt, Homo Sapiens
uaaaagcuuuggauauguauaucuuaaaucuauuuaaaaggauaucuucccccaaagaguugaa

SEQ ID NO: 175786 - RNA, 64 nt, Homo Sapiens
uguacauuguguagaaaaaauuucuugauccauuuaaaaggaauucguucauguauauaagcua

SEQ ID NO: 175787 - RNA, 64 nt, Homo Sapiens
uagcuauagaacugcuuuguuuuccuuuccccuuuaaaaggaauguuuuccugcuuugguuacc

SEQ ID NO: 175788 - RNA, 64 nt, Homo Sapiens
ccuauucuuuucaguugaccuggcacaaaaaguauaaaaggagguauaggcuuuugacaaaagu

SEQ ID NO: 175789 - RNA, 64 nt, Homo Sapiens
cauuuaagcucacauggucaauuugagguuaagauaaaaggacuauauucccacuuuauaaaga

SEQ ID NO: 175790 - RNA, 64 nt, Homo Sapiens
auggucauagcucauuacucuaccaccaagaaccuaaaaggaauuagaauacagcagaauuggc

SEQ ID NO: 175791 - RNA, 64 nt, Homo Sapiens
agaucauuuggaagacuuuagacucuauuaauuuuaaaaggaauauuuauuagccauaugcaga

SEQ ID NO: 175792 - RNA, 64 nt, Homo Sapiens
agggccucugcucuccugggagacaaagcaauaauaaaaggaaguguuuguaaucccagcacuu

SEQ ID NO: 175793 - RNA, 64 nt, Homo Sapiens
aauaaacaaauaaauuuuaaaaauaaauaaauaauaaaaggaaguguuagacaauguaaugcca

SEQ ID NO: 175794 - RNA, 64 nt, Homo Sapiens
cuguauaagcaauugcccuuagauaauaaauuccuaaaaggaaaaaaauaagagaaguaauccc

SEQ ID NO: 175795 - RNA, 64 nt, Homo Sapiens
gagguuugaguucuggguaucaaauauuuauaaauaaaaggagauuauuaaaaaauaagugaua

SEQ ID NO: 175796 - RNA, 64 nt, Homo Sapiens
cauauuuuucuuaccaaaggagucuucagcccuauaaaaggauuccucuauaguguauuucucu

SEQ ID NO: 175797 - RNA, 64 nt, Homo Sapiens
auggggcauucaaguugugagcucagaauuacuuuaaaaggagguaacagccagccauuacacc

SEQ ID NO: 175798 - RNA, 64 nt, Homo Sapiens
ccugggcuggggguggggugggagaggucuuuuuuaaaaggaaguuacuguuauagagggucua

SEQ ID NO: 175799 - RNA, 64 nt, Homo Sapiens
aggagguuuaggucaagaagaagauggauugguguaaaaggaugggucugguuugcagagcuug

SEQ ID NO: 175800 - RNA, 64 nt, Homo Sapiens
uucuaacuccuuauugaagcuaaggggugcuuacuaaaaggaggcagccauauaggccuuuuaa

SEQ ID NO: 175801 - RNA, 64 nt, Homo Sapiens
cugucaccaugcagccgcugauaguucucugaacuaaaaggacuaauuguacuuugaggccaau

SEQ ID NO: 175802 - RNA, 64 nt, Homo Sapiens
ucuuauuugucuaaauugccccuuuuucuguuccuaaaaggaaggauaagagagaacauuccag

SEQ ID NO: 175803 - RNA, 64 nt, Homo Sapiens
uagacccuauaguguuaagagguauuuuaaacacuaaaaggacaaagcucuucccaauccuuau

SEQ ID NO: 175804 - RNA, 64 nt, Homo Sapiens
ugggagaggagggucugaaguuuacacaccuguguaaaaggauguccuuuugcauuaaaaggac

SEQ ID NO: 175805 - RNA, 64 nt, Homo Sapiens
uuacacaccuguguaaaaggaaauccuuuugcauuaaaaggacuucugucccuggagacucugg

SEQ ID NO: 175806 - RNA, 64 nt, Homo Sapiens
auucuauauauucuuuaauguaaauuccuuaugauaaaaggaugcuuuugagaaaacaaugaug

SEQ ID NO: 175807 - RNA, 64 nt, Homo Sapiens
uuagacauuuuauauguagcccauauuuauauuuuaaaaggaaaaucuuugauauaaagcacug

SEQ ID NO: 175808 - RNA, 64 nt, Homo Sapiens
uuucauucauauuuauccuccugucauuugacuuuaaaaggaagaugcacagggcuugagcuuu

SEQ ID NO: 175809 - RNA, 64 nt, Homo Sapiens
cuuagaugggcugugacacauacuaaaaaauaccuaaaaggaagcagguguuuucucuuggaca

SEQ ID NO: 175810 - RNA, 64 nt, Homo Sapiens
ugaaaucacaggugauagcauuagcaauaucagcuaaaaggauagaaaaaguuugggaagcucu

SEQ ID NO: 175811 - RNA, 64 nt, Homo Sapiens
aaaaugucuugcaaugugcuacuaggacguuuauuaaaaggaaauugaaagggaaacucagagu

SEQ ID NO: 175812 - RNA, 64 nt, Homo Sapiens
ugugauuggcaagacauguauuuaaacaauaaacuaaaaggaaauaaucuccacguacuaccau

SEQ ID NO: 175813 - RNA, 64 nt, Homo Sapiens
auuuuucuucaaaggcuuguuaaaccaaucauguuaaaaggaaauucuugguuuugguuuguug

SEQ ID NO: 175814 - RNA, 64 nt, Homo Sapiens
ggcagauuuugaaaucugaccagaggugagggauuaaaaggaaagugguaacuugaaggcagca

SEQ ID NO: 175815 - RNA, 64 nt, Homo Sapiens
cuuaguaaaguucucuuguaacuaucuugcugcuuaaaaggagaucuccaucccauguaccaca

SEQ ID NO: 175816 - RNA, 64 nt, Homo Sapiens
aagccaaaggauuuaagaguuuuguuguuguuaauaaaaggaauacuccuuuuccuuuuggauc

SEQ ID NO: 175817 - RNA, 64 nt, Homo Sapiens
aaaguuaguguaucaguaagaaacagaccuaguuuaaaaggaauaaucaacaauuuuauaaagg

SEQ ID NO: 175818 - RNA, 64 nt, Homo Sapiens
gcagagaggagagucuuacggagggcugggagcuuaaaaggaaaacaauguccuuacuuguaaa

SEQ ID NO: 175819 - RNA, 64 nt, Homo Sapiens
cuguuuaugauaccaaaaaaauuacaguuuuguuuaaaaggaaauguugauguuuucaacucca

SEQ ID NO: 175820 - RNA, 64 nt, Homo Sapiens
ggcagugccaaauaugagaguuuauuuaccuaauuaaaaggaaagaagaugaagauuauaacug

SEQ ID NO: 175821 - RNA, 64 nt, Homo Sapiens
ggaacuacugggaaauuaugaaauuaaggcucauuaaaaggaaaagcuuuuaauuagucaaacu

SEQ ID NO: 175822 - RNA, 64 nt, Homo Sapiens
uuacuguuauaugagaaacauuuuaguaauuuaauaaaaggauaauguuuauuuaaaaaaccug

SEQ ID NO: 175823 - RNA, 64 nt, Homo Sapiens
acuuuacagauaauggagcagaagccaacauuaguaaaaggaaucccaacuucuucccauagaa

SEQ ID NO: 175824 - RNA, 64 nt, Homo Sapiens
ggaaaagauucaaagcucuauguaggaguaaagauaaaaggauaagggagcugaggccauuccc

SEQ ID NO: 175825 - RNA, 64 nt, Homo Sapiens
agguaggagaccucuucuauugcagccaaggugcuaaaaggaaucaaaucuuccucuggagcuu

SEQ ID NO: 175826 - RNA, 64 nt, Homo Sapiens
uagcaagaaaaaaacagucaacuacagaaacucuuaaaaggaauaaaaacccaaaguuccuuau

SEQ ID NO: 175827 - RNA, 64 nt, Homo Sapiens
ggugaucacguuucguguucauacucaacguuaauaaaaggagagaguuuguagugaaauggca

SEQ ID NO: 175828 - RNA, 64 nt, Homo Sapiens
gauggucccucuaaugaaacguuaauggugucaauaaaaggauuuaccuauaagauuguuggga

SEQ ID NO: 175829 - RNA, 64 nt, Homo Sapiens
cuuugccauaauuuucagauucucuguuuaaugguaaaaggagaccccagccugacagugcuag

SEQ ID NO: 175830 - RNA, 64 nt, Homo Sapiens
gucugcaugcuauuuuaaucgcaaaaggaaacaauaaaaggaauauaccacagacacaguuaaa

SEQ ID NO: 175831 - RNA, 64 nt, Homo Sapiens
ggggcccaaauccucuggccucccauuugcugguuaaaaggauucugucuguuucauuggacug

SEQ ID NO: 175832 - RNA, 64 nt, Homo Sapiens
aaaugugucaugcuuuuuaaaaagccaucucaaguaaaaggaauagugguaccuugaaaaucca

SEQ ID NO: 175833 - RNA, 64 nt, Homo Sapiens
gucauuuggagaugugaagaaagggaauuucacuuaaaaggaaggauuugcuaugcagacaggg

SEQ ID NO: 175834 - RNA, 64 nt, Homo Sapiens
uguuuaagacaagugaauucuauagugguugccauaaaaggaaguucuagguauuuauaguaga

SEQ ID NO: 175835 - RNA, 64 nt, Homo Sapiens
uguguugcucacaaguggccagaacuccuauuccuaaaaggauuuugagauggaggaacacaua

SEQ ID NO: 175836 - RNA, 64 nt, Homo Sapiens
auagaggggaaccaggaaucaucacuacaguaaguaaaaggaccggcgcuccuucucuccuucc

SEQ ID NO: 175837 - RNA, 64 nt, Homo Sapiens
acuucauuuucucaagaaaugcaaacauucuuccuaaaaggaaguaacaugguaagccuuagca

SEQ ID NO: 175838 - RNA, 64 nt, Homo Sapiens
uuuaguaagcaaauuuauuaagguuguuuuccccuaaaaggaccggacuagaacuguauuuuua

SEQ ID NO: 175839 - RNA, 64 nt, Homo Sapiens
auaccuggugggugcauaguugaagauuacauuauaaaaggaauaauaguuugacagcucauuu

SEQ ID NO: 175840 - RNA, 64 nt, Homo Sapiens
cuuugaggaaaaaagccuuccaccaaaguaagccuaaaaggaauuuauaauuggagauccugaa

SEQ ID NO: 175841 - RNA, 64 nt, Homo Sapiens
caacaccuuuacauugcucaaucuguuguguugguaaaaggaaucaaauggaucacagaccuga

SEQ ID NO: 175842 - RNA, 62 nt, Homo Sapiens
gugcugcucugcucugcccacccuggguucugcauuccuaugggugacccaauuauucagac

SEQ ID NO: 175843 - RNA, 62 nt, Homo Sapiens
auauuuuugucuucuuccuuuccccucuuugccauuccuaccuugcauuuuuccugucagug

SEQ ID NO: 175844 - RNA, 62 nt, Homo Sapiens
gaacagagugaggacaggcuuaauagccguggcauuccuacacuguuagucauuauguuggg

SEQ ID NO: 175845 - RNA, 62 nt, Homo Sapiens
ugucaucagaugaccuugacgaaugaguauuccauuccuaggucacggguaaggaggauuag

SEQ ID NO: 175846 - RNA, 62 nt, Homo Sapiens
agaguaucacagccaggaugacccuugggucccauuccuaagacaugguuacuuuauuuucc

SEQ ID NO: 175847 - RNA, 62 nt, Homo Sapiens
gguggggcacccuuuucucgccgcaagaagcccauuccuauggaagucuagcaaagcaauac

SEQ ID NO: 175848 - RNA, 62 nt, Homo Sapiens
cuuggucucuauagcaguguuguggcccaagucauuccuaauccccauuccuacaauuucua

SEQ ID NO: 175849 - RNA, 62 nt, Homo Sapiens
auuucuauguggcccaagucucuuuuccuccccauuccuacaagugggucugguggugcugg

SEQ ID NO: 175850 - RNA, 64 nt, Homo Sapiens
cuuuauucugauuaugugaaaccauauucuauugcuaggggaagccaagaaccauucucuauac

SEQ ID NO: 175851 - RNA, 64 nt, Homo Sapiens
auguguauauaugguaacaaagcauagcaguucucuaggggagaggccuggcauugcacauggu

SEQ ID NO: 175852 - RNA, 64 nt, Homo Sapiens
cugggcugcgugcaugucgagagccuccagggaucuaggggagcuuuggcccuugguguuucug

SEQ ID NO: 175853 - RNA, 64 nt, Homo Sapiens
agcuugugcgugucaaaagacacauccccacucucuaggggauuauuaauuacccuccguuucc

SEQ ID NO: 175854 - RNA, 64 nt, Homo Sapiens
aauaucacaggcuaauagcgucuugacaucucuccuaggggaaguaugauagaaucucaucuaa

SEQ ID NO: 175855 - RNA, 64 nt, Homo Sapiens
gggugguccacgcacucgcuuauucagcgcuuugcuaggggauuuccugcuggcuagaccagcc

SEQ ID NO: 175856 - RNA, 64 nt, Homo Sapiens
uguaauaucuccuguuguuucuaugauauaggagcuaggggaaggggguuguuugccuucuuca

SEQ ID NO: 175857 - RNA, 64 nt, Homo Sapiens
ucuucuguccugucuuauacugcaacugugucuccuaggggacagauggccuucuuugucaucu

SEQ ID NO: 175858 - RNA, 64 nt, Homo Sapiens
gugagggcuccuauaccuuguccuuccugcuugccuaggggaagaggagaagaggguaaggggg

SEQ ID NO: 175859 - RNA, 64 nt, Homo Sapiens
accucacguucggacugccuucaucaagacaacucuaggggaccauuuugccuggggcuccuag

SEQ ID NO: 175860 - RNA, 64 nt, Homo Sapiens
gggagaagugagagggacaauauaggaauaaugccuaggggaaagagaaguguuguuagaaaca

SEQ ID NO: 175861 - RNA, 64 nt, Homo Sapiens
ugggaaagagugggugugugagcucugccaacugcuaggggaguguguaagaggcagccaaguc

SEQ ID NO: 175862 - RNA, 64 nt, Homo Sapiens
ucucauugaauuauaaaagccagcaggcuucaaacuaggggacaaagcaaaaagugaugauagu

SEQ ID NO: 175863 - RNA, 64 nt, Homo Sapiens
auuaauacaaugaugcuauuugcaauuccugcuccuaggggaggggagauaagaaacccucacu

SEQ ID NO: 175864 - RNA, 64 nt, Homo Sapiens
aacacuuuuuaaaaaguggaagugcuucugaaguacaguuuaaacccuagaucugaguuuucag

SEQ ID NO: 175865 - RNA, 64 nt, Homo Sapiens
ugguacuucauuuuucuuaauuaaaauauauguuacaguuuaucccuguuuugauacuucuaag

SEQ ID NO: 175866 - RNA, 64 nt, Homo Sapiens
aggcuugauagaaagagugcgaaaacuuuauuuaacaguuuagagaaguuuaaaugcuuguuug

SEQ ID NO: 175867 - RNA, 64 nt, Homo Sapiens
aagacauguauagaaaguauggaaaagaaaacagacaguuuaguucagaauggaaacgaacguu

SEQ ID NO: 175868 - RNA, 64 nt, Homo Sapiens
cccaaaguaccaguuuuccagaaaaccacauuuuacaguuuaugaugauuaauagcagcagcau

SEQ ID NO: 175869 - RNA, 64 nt, Homo Sapiens
ucuuuugcaagccuuugauuuuuuuuuuuuuguuacaguuuaguaauuuauauucaccagucac

SEQ ID NO: 175870 - RNA, 64 nt, Homo Sapiens
auguuugaccagaauuauaugacaagaacuggugacaguuuagugccucugcccauuguccaug

SEQ ID NO: 175871 - RNA, 64 nt, Homo Sapiens
uauuuuguucuguucugucacuguuaaugucauaacaguuuaguaaacucuaaaugcauggcaa

SEQ ID NO: 175872 - RNA, 64 nt, Homo Sapiens
uuuguacagauuaugcuuacaaaugccaaaaaggacaguuuaauagaacguugcaaauuuguua

SEQ ID NO: 175873 - RNA, 64 nt, Homo Sapiens
aaaaaagaaaaaaagaauguaaaauuuuaaaaauacaguuuaacagcuguaaaaguuuuacuau

SEQ ID NO: 175874 - RNA, 64 nt, Homo Sapiens
gaagagacuuucauucuuuaaauauuauugacuuacaguuuaaaaauaaauaaauaaaagcaua

SEQ ID NO: 175875 - RNA, 64 nt, Homo Sapiens
uuggaacaaugccaggauccaaacugauuaaguuacaguuuaagcacccuucaguauuaauaua

SEQ ID NO: 175876 - RNA, 64 nt, Homo Sapiens
gggaguugauuuauuaaguacaguauaccucucaacaguuuauaaauaauauguugaauuaugu

SEQ ID NO: 175877 - RNA, 64 nt, Homo Sapiens
agaccacacacaucguuuaauagcacgagugaccacaguuuaauacuccaggccaagugugccu

SEQ ID NO: 175878 - RNA, 64 nt, Homo Sapiens
uggggugggguuaaaguucaaguuauuaaaaagcacaguuuaaacuuuguuaaaaauaucugcc

SEQ ID NO: 175879 - RNA, 64 nt, Homo Sapiens
uauauauauaauucaguauuaucacaguuuaaugacaguuuauggugguaggaaguaucaugua

SEQ ID NO: 175880 - RNA, 64 nt, Homo Sapiens
gacaguuuauguauauauauaguaucauguaaucacaguuuaauucuaauaagcugugguagga

SEQ ID NO: 175881 - RNA, 55 nt, Homo Sapiens
caggacuuccagagucaugacaugaacaguuuaauugaacccauccacucugggc

SEQ ID NO: 175882 - RNA, 64 nt, Homo Sapiens
gaagaagaacaagaauuccacaugagaaguaaaaacaguuuacaguacucagcaaaagaacaug

SEQ ID NO: 175883 - RNA, 64 nt, Homo Sapiens
aaauagaaauagauauuuuuaaauaaaaccauucacaguuuacuuugucuugauaccuugguuu

SEQ ID NO: 175884 - RNA, 64 nt, Homo Sapiens
aaugcuaugacuuugaaauucacagaaagaaauaacaguuuagauuaggucuucagguauucag

SEQ ID NO: 175885 - RNA, 64 nt, Homo Sapiens
cuaucgcauuucuguaacauguaaauaauuuauuacaguuuacuguuaaacaaacuaggugcuu

SEQ ID NO: 175886 - RNA, 64 nt, Homo Sapiens
guugcuuaucuccaagauauuaaaacguuuucuaacaguuuacuuuuuaaauaucauguaaugu

SEQ ID NO: 175887 - RNA, 64 nt, Homo Sapiens
uucaugaauucacagauaaguacuuaaagaacagacaguuuacuuggccuaaaaauauuuugau

SEQ ID NO: 175888 - RNA, 64 nt, Homo Sapiens
ucuugccuagaugucgaugacugcaaguaauaauacaguuuauaaugaaacuaucuacaauucu

SEQ ID NO: 175889 - RNA, 64 nt, Homo Sapiens
gcaaaacauggguaugcuguauggccaaaggaauacaguuuauauuaguauugauagcuuacau

SEQ ID NO: 175890 - RNA, 64 nt, Homo Sapiens
aauauauuuaauuucuauuuucacuaauauuuucacaguuuauuaauuuuaaauuaauuuugaa

SEQ ID NO: 175891 - RNA, 64 nt, Homo Sapiens
ggcucugcuauaugguacaacuaaugcuagaccuacaguuuauguauacaguugauuuugaugu

SEQ ID NO: 175892 - RNA, 64 nt, Homo Sapiens
uugucuuuguguuucauaauuaguuuuuauaaaaacaguuuacauuaaacaucuuggaauucaa

SEQ ID NO: 175893 - RNA, 64 nt, Homo Sapiens
ucauguugcucugguuugugauaauaaaggcuuuacaguuuaagccacauuuaaucuuggggcu

SEQ ID NO: 175894 - RNA, 64 nt, Homo Sapiens
aaaauuacugagucauauucuguauggauauaccacaguuuauccauuuaucuuaauugauguc

SEQ ID NO: 175895 - RNA, 64 nt, Homo Sapiens
aaggugucuaguccagcucccauggaggguggggaagaagaagaagaacuucuagguccuaaac

SEQ ID NO: 175896 - RNA, 64 nt, Homo Sapiens
gugucuaguccagcucccauggaggguggggaagaagaagaagaacuucuagguccuaaacuag

SEQ ID NO: 175897 - RNA, 64 nt, Homo Sapiens
ucuaguccagcucccauggaggguggggaagaagaagaagaacuucuagguccuaaacuagaag

SEQ ID NO: 175898 - RNA, 64 nt, Homo Sapiens
gaagaagaacuucuagguccuaaacuagaagaggaagaagaagaggaaguaguugaaaaugaug

SEQ ID NO: 175899 - RNA, 64 nt, Homo Sapiens
cagagaacugucucguacuagaauucaaggaggaaagaagaagaaauaaaagaagcugcuccau

SEQ ID NO: 175900 - RNA, 64 nt, Homo Sapiens
agaacugucucguacuagaauucaaggaggaaagaagaagaaauaaaagaagcugcuccauuuu

SEQ ID NO: 175901 - RNA, 64 nt, Homo Sapiens
cauucuuugccugaguuuuaucugcuguugcaaaaagaagaaaaugccuuuguuuuuacuagug

SEQ ID NO: 175902 - RNA, 64 nt, Homo Sapiens
ggaagaaaagaaggggaagaagaucaaagaagaaaagaagaaggggaagaaaagaaggggaaga

SEQ ID NO: 175903 - RNA, 64 nt, Homo Sapiens
gaagaaggggaagaaaagaaggggaagaagaucaaagaagaaaaggggaaggggaagaaaagaa

SEQ ID NO: 175904 - RNA, 64 nt, Homo Sapiens
gacagcagcaucaagaggaggaagcaggaaaagcaagaagaaaacagagcaugcagugauggaa

SEQ ID NO: 175905 - RNA, 64 nt, Homo Sapiens
ggcgacaucaagaaggaaagucagaaaaagcaagaagaagaaaaagaacaugcugagcagaaca

SEQ ID NO: 175906 - RNA, 64 nt, Homo Sapiens
aaaggcgacaucaagaaggaacaucagaaaaagcaagaagaagacccagaacaugcugagcaga

SEQ ID NO: 175907 - RNA, 64 nt, Homo Sapiens
caaagaggagaaugaagauccagaaaggaaaauaaagaagaagggcuucggcgccaugcugagg

SEQ ID NO: 175908 - RNA, 64 nt, Homo Sapiens
gaagaagggcuucggcgccaugcugagauuuggaaagaagaaagaggauaaggguggaaaggcu

SEQ ID NO: 175909 - RNA, 64 nt, Homo Sapiens
ucuccccagaaggcauccaugcuuagggcccuuaaagaagaaaagaacucagcccuguugcaau

SEQ ID NO: 175910 - RNA, 64 nt, Homo Sapiens
cuauauauauauaucuuauuuauugcaagagguaaagaagaaaaucuauuuuuucuauaaguuu

SEQ ID NO: 175911 - RNA, 64 nt, Homo Sapiens
caucuacgaaagguaaaaaguaacuauauguuuuaagaagaaaaaaauauguaagcuaaacaua

SEQ ID NO: 175912 - RNA, 64 nt, Homo Sapiens
ugagcaguugaaaaaugcuaugucuccaagauugaagaagaaacuagguucuaucucuguagaa

SEQ ID NO: 175913 - RNA, 64 nt, Homo Sapiens
ucuagcuuguauccccacaucaugagaaagagggaagaagaagaagggaugaugugugguagag

SEQ ID NO: 175914 - RNA, 64 nt, Homo Sapiens
agcuuguauccccacaucaugagaaagagggaagaagaagaagggaugaugugugguagagaag

SEQ ID NO: 175915 - RNA, 64 nt, Homo Sapiens
aaaggaaaaagaaaccacaaauuggggaaaaaaaaagaagaaaaaccuguuuccgugugcaaaa

SEQ ID NO: 175916 - RNA, 64 nt, Homo Sapiens
ugacugugcuuguucguaacagaugcaaacaagaaagaagaacugggaagucuuugucccuagg

SEQ ID NO: 175917 - RNA, 64 nt, Homo Sapiens
cuuaaaguggucauauuauuauuaauuuugccaaaagaagaagaauuuauugaauauuuauacu

SEQ ID NO: 175918 - RNA, 64 nt, Homo Sapiens
aaaguggucauauuauuauuaauuuugccaaaagaagaagaauuuauugaauauuuauacuaua

SEQ ID NO: 175919 - RNA, 64 nt, Homo Sapiens
gccuuuuucucugcacuauuuauuuuuauuuuugaagaagaauaucaguauggcuugcugcuuu

SEQ ID NO: 175920 - RNA, 64 nt, Homo Sapiens
uaauuuguuuacaaaccuguuauuuauguccuaaaagaagaauguaaauugcucuauuuuaacu

SEQ ID NO: 175921 - RNA, 64 nt, Homo Sapiens
ugcauuuuaaacacaacucuuacagcuuaucuguaagaagaaaacuacauacgcauguauauau

SEQ ID NO: 175922 - RNA, 64 nt, Homo Sapiens
aguauuaacaucaauugaucguuauuccaaauucaagaagaagcugcauguaacuuuuaugaua

SEQ ID NO: 175923 - RNA, 64 nt, Homo Sapiens
acauguauaaaauaguuuuaagauccuuuucuuaaagaagaaaauuaaguuucacagacaucau

SEQ ID NO: 175924 - RNA, 64 nt, Homo Sapiens
acaguuaaauaagacauaccagggaggcagauggaagaagaaaauaaugagaggaggcagagag

SEQ ID NO: 175925 - RNA, 64 nt, Homo Sapiens
aaccaagcuuaggguauuuucucuaaaagaagaaaagaagaaaauguuggucaaaaucugcaaa

SEQ ID NO: 175926 - RNA, 64 nt, Homo Sapiens
gaagaaaaaaccaagcuuagucugcaaacucuaaaagaagaaaaaccaugucuguuggucaaaa

SEQ ID NO: 175927 - RNA, 64 nt, Homo Sapiens
aaguuucaguugugguagaaguccuguaaagaagaagaagaaaaucauuuuuagauuuuguuga

SEQ ID NO: 175928 - RNA, 64 nt, Homo Sapiens
aaaaaguuucaguugugguaugaguccuguaaagaagaagaagaaguucauuuuuagauuuugu

SEQ ID NO: 175929 - RNA, 64 nt, Homo Sapiens
agaaaaaaguuucaguuguguguugaguccuguaaagaagaagacauaguucauuuuuagauuu

SEQ ID NO: 175930 - RNA, 64 nt, Homo Sapiens
cagcgaugggucuccaggcaaguccccguccaaaaagaagaagaaguuccguaccccguccuuu

SEQ ID NO: 175931 - RNA, 64 nt, Homo Sapiens
cgaugggucuccaggcaaguccccguccaaaaagaagaagaaguuccguaccccguccuuucug

SEQ ID NO: 175932 - RNA, 64 nt, Homo Sapiens
gaaguuccguaccccguccuuucugaagaagagcaagaagaagagugacuccugaaagcccugc

SEQ ID NO: 175933 - RNA, 64 nt, Homo Sapiens
aucucaaaaaaaaaaaaaaaaaaaaaaaaaaaaaaagaagaagaaacccugagccauuaaugug

SEQ ID NO: 175934 - RNA, 64 nt, Homo Sapiens
ucaaaaaaaaaaaaaaaaaaaaaaaaaaaaaaagaagaagaaacccugagccauuaaugugucu

SEQ ID NO: 175935 - RNA, 64 nt, Homo Sapiens
uuuucaugcuuauuuuauucuuugucacagaugaaagaagaauaggacuaauuggggcuaagau

SEQ ID NO: 175936 - RNA, 64 nt, Homo Sapiens
ggaaaagagaugaaguggcaugaagggucgucggaagaagaacaagaagcuuuugaaaacagac

SEQ ID NO: 175937 - RNA, 64 nt, Homo Sapiens
acgaagacaacagguaaccacaaagcugcucuugaagaagaaaacagauaaaagaagcagaagc

SEQ ID NO: 175938 - RNA, 64 nt, Homo Sapiens
agcagaaagcagucucagguaaagcaaaaaaaagaagaagaaacggcugagaaaaagcaaaaga

SEQ ID NO: 175939 - RNA, 64 nt, Homo Sapiens
aacagcagaaagcagucucaagaaaagcaaaaaaaagaagaagaucaggcugagaaaaagcaaa

SEQ ID NO: 175940 - RNA, 64 nt, Homo Sapiens
uucccaaaauguugaaauaugauguuaaaaaaauaagaagaaugcuuaaucagauagauauucc

SEQ ID NO: 175941 - RNA, 64 nt, Homo Sapiens
cuaaaucuuuuauaggauuuauuuaaaauagcaaaagaagaaguuucaucauuuuuuacuuccu

SEQ ID NO: 175942 - RNA, 64 nt, Homo Sapiens
agcauugggauaucuccugaaaagguuuaugaaaaagaagaaucucaucucagugaagaauacu

SEQ ID NO: 175943 - RNA, 64 nt, Homo Sapiens
agagcaagaaggaaagauuuaaaaaaaaaagaagaagaagaagggcuccaggaucuuugacuga

SEQ ID NO: 175944 - RNA, 64 nt, Homo Sapiens
aggagagcaagaaggaaagaugaaaaaaaaaaagaagaagaagauaugcuccaggaucuuugac

SEQ ID NO: 175945 - RNA, 64 nt, Homo Sapiens
agaaggagagcaagaaggaagacugaaaaaaaaaaagaagaagaccauaugcuccaggaucuuu

SEQ ID NO: 175946 - RNA, 64 nt, Homo Sapiens
caaaagcaagggaccuucaugaugguaucuggguaagaagaaaggugccaaacagaguaugucc

SEQ ID NO: 175947 - RNA, 64 nt, Homo Sapiens
cucauucuuuagagaugcuaaaauucuucgcauaaagaagaagaaauuaaggaacauaaaucuu

SEQ ID NO: 175948 - RNA, 64 nt, Homo Sapiens
auucuuuagagaugcuaaaauucuucgcauaaagaagaagaaauuaaggaacauaaaucuuaau

SEQ ID NO: 175949 - RNA, 64 nt, Homo Sapiens
gugauaagcaaggaggguguaaguuuaggggacaaagaagaaagaaugaauaauacgagcagac

SEQ ID NO: 175950 - RNA, 64 nt, Homo Sapiens
uuuaaugaaaaaaaaaaacaaaaaaaacggauccaagaagaaaagagaauuuauuuccuucucc

SEQ ID NO: 175951 - RNA, 64 nt, Homo Sapiens
guacuguguuguaccuuuauuucuguauuucuaaaagaagaaaguucuuuccuagcaggguuug

SEQ ID NO: 175952 - RNA, 64 nt, Homo Sapiens
uuccauccccaaggcaaacaaggaaaggaaaggaaagaagaaaaggugccuuaguccuuuguug

SEQ ID NO: 175953 - RNA, 64 nt, Homo Sapiens
ccaugcagccacuuuggguuguguugaggcuaccaagaagaaauaaugcugaaucacaggaaug

SEQ ID NO: 175954 - RNA, 62 nt, Homo Sapiens
auuaacaaaagacagaaggcacgggugucagcaagaagaaaaaccccuucggccagucuuaa

SEQ ID NO: 175955 - RNA, 64 nt, Homo Sapiens
caccaggguuuaguuugcaugagagauuauuuacaagaagaacuagaucucuuucuaaagacag

SEQ ID NO: 175956 - RNA, 64 nt, Homo Sapiens
ugaagacuucaaaauauugaucuguuaccucaacaagaagaauuuaaccguaaagguuuauuuu

SEQ ID NO: 175957 - RNA, 64 nt, Homo Sapiens
agaaggaacagacaaagguugauugccaucaaagaagaagaaaauuucucuuuuaauauuuuau

SEQ ID NO: 175958 - RNA, 64 nt, Homo Sapiens
aaaagaaggaacagacaaaguaugauugccaucaaagaagaagacauuuucucuuuuaauauuu

SEQ ID NO: 175959 - RNA, 64 nt, Homo Sapiens
aaacgccuguauauccugguuaagagcgcccgagaagaagaauguacucauccugauaaucucu

SEQ ID NO: 175960 - RNA, 64 nt, Homo Sapiens
ggaaacuuaaauucuagccgugucagcuaaaaggaagaagaaaucccucaccuguggaauuugg

SEQ ID NO: 175961 - RNA, 64 nt, Homo Sapiens
ucaaccagcaggaaaguacauugagaaagaagagaagaagaaaaagacccuaugaaaaaauuag

SEQ ID NO: 175962 - RNA, 64 nt, Homo Sapiens
cgaacugggaaaauuucuucagaagucuugucucaagaagaaaaugugcuccagccugggcgac

SEQ ID NO: 175963 - RNA, 64 nt, Homo Sapiens
uuccuauaaaaguagcauuuuugguaaaguuucaaagaagaagaaacagagauggaagaguaaa

SEQ ID NO: 175964 - RNA, 64 nt, Homo Sapiens
cuauaaaaguagcauuuuugguaaaguuucaaagaagaagaaacagagauggaagaguaaagau

SEQ ID NO: 175965 - RNA, 64 nt, Homo Sapiens
gaagagagacaaagaucacuacagaccaaaacagaagaagaagaaaaaaaagaaaaagaaaucu

SEQ ID NO: 175966 - RNA, 64 nt, Homo Sapiens
gagagacaaagaucacuacagaccaaaacagaagaagaagaaaaaaaagaaaaagaaaucuaag

SEQ ID NO: 175967 - RNA, 64 nt, Homo Sapiens
gggagcucagaugaugaugauguuaguaguuuggaagaagaacaagaauuccacaugagaagua

SEQ ID NO: 175968 - RNA, 64 nt, Homo Sapiens
ccccuguaagaugucacuguuacaaugggggaagaagaagaaguaaacauaaaaggaggagaca

SEQ ID NO: 175969 - RNA, 64 nt, Homo Sapiens
aguccccuguaagaugucacacauacaaugggggaagaagaagagauaaacauaaaaggaggag

SEQ ID NO: 175970 - RNA, 64 nt, Homo Sapiens
uaaccuuaaucucuuguauuacuaagaauaaauaaagaagaaaaccauuagacugaauuuaacu

SEQ ID NO: 175971 - RNA, 64 nt, Homo Sapiens
ucuaugcuuaggccagucagaccauaugauugaaaagaagaaaguguaauauacaguuuuugua

SEQ ID NO: 175972 - RNA, 64 nt, Homo Sapiens
acaaaacaaaacaaacaaaugaaaaacguuuaaaaagaagaagaagaaaaaaaacaagaacaag

SEQ ID NO: 175973 - RNA, 64 nt, Homo Sapiens
aaacaaaacaaacaaaugaaaaacguuuaaaaagaagaagaagaaaaaaaacaagaacaagcag

SEQ ID NO: 175974 - RNA, 64 nt, Homo Sapiens
caaaacaaacaaaugaaaaacguuuaaaaagaagaagaagaaaaaaaacaagaacaagcagcaa

SEQ ID NO: 175975 - RNA, 64 nt, Homo Sapiens
aagaaagaaagcuucagaccgcuaguaaggcucaaagaagaagaaaaacaccaaaaccacaagg

SEQ ID NO: 175976 - RNA, 64 nt, Homo Sapiens
aaagaaagcuucagaccgcuaguaaggcucaaagaagaagaaaaacaccaaaaccacaagggaa

SEQ ID NO: 175977 - RNA, 64 nt, Homo Sapiens
guuuuuuguccccagagacaauugaucaccaugaaagaagaauaccuuuuguuuccaggaaaau

SEQ ID NO: 175978 - RNA, 64 nt, Homo Sapiens
uuuauuuucgugugagaugcguggcccacugacuaagaagaaagugcucuuuaaucaaacucug

SEQ ID NO: 175979 - RNA, 64 nt, Homo Sapiens
auuuugauguugguaugcuugcacgugagauaagaagaagaauacuuauuugggagaaauaggg

SEQ ID NO: 175980 - RNA, 64 nt, Homo Sapiens
auaauuuugauguugguaugggggcacgugagauaagaagaagaucacuuauuugggagaaaua

SEQ ID NO: 175981 - RNA, 64 nt, Homo Sapiens
aucucaaaaauaaaauaaaaaaagaaagaaagaaaagaagaagaaaagagaagaaggagaagga

SEQ ID NO: 175982 - RNA, 64 nt, Homo Sapiens
ucaaaaauaaaauaaaaaaagaaagaaagaaaagaagaagaaaagagaagaaggagaaggagau

SEQ ID NO: 175983 - RNA, 64 nt, Homo Sapiens
gaaggagaugaaggaggaggaggaggagaaggagaagaagaagaagaagaagaccacaaaagac

SEQ ID NO: 175984 - RNA, 64 nt, Homo Sapiens
ggagaugaaggaggaggaggaggagaaggagaagaagaagaagaagaagaccacaaaagacaug

SEQ ID NO: 175985 - RNA, 64 nt, Homo Sapiens
gaugaaggaggaggaggaggagaaggagaagaagaagaagaagaagaccacaaaagacaugacu

SEQ ID NO: 175986 - RNA, 64 nt, Homo Sapiens
gaaggaggaggaggaggagaaggagaagaagaagaagaagaagaccacaaaagacaugacuauc

SEQ ID NO: 175987 - RNA, 64 nt, Homo Sapiens
auaagagacuuuuugacucuauauccuugcaguuaagaagaaagcacuuuuuuguaauguuugu

SEQ ID NO: 175988 - RNA, 64 nt, Homo Sapiens
accaugaggggaacaagaaacuacuucuaacgggaagaagaaacacuacggucgauuaaaaaaa

SEQ ID NO: 175989 - RNA, 64 nt, Homo Sapiens
gcauaaccacaugacuuggaaugcuuaaaucagcaagaagaauaaugguggggucuuuauacuc

SEQ ID NO: 175990 - RNA, 64 nt, Homo Sapiens
aaaguguuuguaauauauucaugaggcuggaaguaagaagaauuaaaaauuuguccuaauuaca

SEQ ID NO: 175991 - RNA, 64 nt, Homo Sapiens
uuaacaggcaaugcuucucagaccacaaagcagaaagaagaagaaaagcuccugacuaaaucag

SEQ ID NO: 175992 - RNA, 64 nt, Homo Sapiens
acaggcaaugcuucucagaccacaaagcagaaagaagaagaaaagcuccugacuaaaucagggc

SEQ ID NO: 175993 - RNA, 64 nt, Homo Sapiens
agaagguagaguagaggccuggaagaagaaagagaagaagaaaaagaggauccugaacggaaaa

SEQ ID NO: 175994 - RNA, 64 nt, Homo Sapiens
agaagaagaaaaagaagguacugaacggaaaaggaagaagaaagaaagaaaaaagaagaggauc

SEQ ID NO: 175995 - RNA, 64 nt, Homo Sapiens
agaaaaaagaagaggauccuauucagaucacaagaagaagaaaauccuacagaaacaccaucug

SEQ ID NO: 175996 - RNA, 64 nt, Homo Sapiens
aaaagaaaaaagaagaggaucugauucagaucacaagaagaagagucuccuacagaaacaccau

SEQ ID NO: 175997 - RNA, 64 nt, Homo Sapiens
caauguacuguggucucuugccuaaauuccccugaagaagaaacuccguauggagcucuggacu

SEQ ID NO: 175998 - RNA, 62 nt, Homo Sapiens
agguacauuuguuuuugcuuauaaaguagaauauaagaagaauaguuucugaguuuuaccaa

SEQ ID NO: 175999 - RNA, 64 nt, Homo Sapiens
ugggaggaugugaauuguuacugccuucuucggaaagaagaaggagcccuuuugucucugcaaa

SEQ ID NO: 176000 - RNA, 64 nt, Homo Sapiens
cguugggagggggagaaaaggaaaagaaaaaaaaaagaagaagaagaagaaaagagaagaagaa

SEQ ID NO: 176001 - RNA, 64 nt, Homo Sapiens
ugggagggggagaaaaggaaaagaaaaaaaaaagaagaagaagaagaaaagagaagaagaaaaa

SEQ ID NO: 176002 - RNA, 64 nt, Homo Sapiens
gagggggagaaaaggaaaagaaaaaaaaaagaagaagaagaagaaaagagaagaagaaaaaaac

SEQ ID NO: 176003 - RNA, 64 nt, Homo Sapiens
ggggagaaaaggaaaagaaaaaaaaaagaagaagaagaagaaaagagaagaagaaaaaaacgaa

SEQ ID NO: 176004 - RNA, 64 nt, Homo Sapiens
aaagaaaaaaaaaagaagaagaagaagaaaagagaagaagaaaaaaacgaaaacagucaaccaa

SEQ ID NO: 176005 - RNA, 64 nt, Homo Sapiens
guuaauguauuaaugauguuauuaaauacuguucaagaagaacaaaguuuaugcagcuacuguc

SEQ ID NO: 176006 - RNA, 64 nt, Homo Sapiens
uaggaagcggacccgcuccagaaguccccacgagaagaagaagaagaggcggucccggucgcgg

SEQ ID NO: 176007 - RNA, 64 nt, Homo Sapiens
gaaacucuugccuuucagaaguccccacgagaagaagaagaagaggcggucccggucgcggacc

SEQ ID NO: 176008 - RNA, 64 nt, Homo Sapiens
guacuucuacagccauguccaaaaaacaaaaaagaagaagaaaaagguaagacucugucucaaa

SEQ ID NO: 176009 - RNA, 64 nt, Homo Sapiens
aaaguacuucuacagccaugaaaaaaaaacaaaaaagaagaagaaacagguaagacucugucuc

SEQ ID NO: 176010 - RNA, 64 nt, Homo Sapiens
gggcugcuuuguguggccauaauaguuaaaccaaaagaagaauacucagugaucaaagucuuca

SEQ ID NO: 176011 - RNA, 64 nt, Homo Sapiens
agucagcuggugaugugcuugauuuagcagcuaaaagaagaaugcauggaaaaacaacuuagag

SEQ ID NO: 176012 - RNA, 64 nt, Homo Sapiens
ugaaaguguaaugugcgauggcuauguagacauaaagaagaaacuuguaaauaucuuuuuucuu

SEQ ID NO: 176013 - RNA, 64 nt, Homo Sapiens
gaauuuucuggccuuucauggcaaugaaaauuuuaagaagaaagauuuaaaguauuuuaauuuu

SEQ ID NO: 176014 - RNA, 64 nt, Homo Sapiens
agaaacucagggaucacuggggggaaaaaaaaagaagaagaaaauaagcacagcaguaaacuau

SEQ ID NO: 176015 - RNA, 64 nt, Homo Sapiens
aaaagaaacucagggaucacuauggggaaaaaaaaagaagaagaaccuaagcacagcaguaaac

SEQ ID NO: 176016 - RNA, 64 nt, Homo Sapiens
cuccccucacugauggacaaggaggucugugccaaagaagaauccaauaagcacauauugagca

SEQ ID NO: 176017 - RNA, 64 nt, Homo Sapiens
ccucaguaaguaucuggaggaagaaaacaggugaaagaagaaguaaaaaccauuuaguauuagu

SEQ ID NO: 176018 - RNA, 64 nt, Homo Sapiens
uuauuauuauauguucuuucaaagacuuuugucuaagaagaauacagcuuuuaacuucauuuaa

SEQ ID NO: 176019 - RNA, 64 nt, Homo Sapiens
gaccgaagcugcugcguaagcaaagccgcuucugaagaagaaaggcaaauuacaggcaagacaa

SEQ ID NO: 176020 - RNA, 64 nt, Homo Sapiens
gacugauuuacaggacuucuccuaugugcgaagcaagaagaauuguccucagcaugcccuaugg

SEQ ID NO: 176021 - RNA, 64 nt, Homo Sapiens
agcucaacuaaaaguggcaucacaaggccagaaaaagaagaaggcacggaaacauagaaacaua

SEQ ID NO: 176022 - RNA, 64 nt, Homo Sapiens
gggccccauuuuuuaaaaaacucugggagagaggaagaagaaagcuggggucugggcacucugc

SEQ ID NO: 176023 - RNA, 64 nt, Homo Sapiens
ggugccuuuccuaauuugcagggcuacuucucccaagaagaaggugugugcgugcccuggugug

SEQ ID NO: 176024 - RNA, 64 nt, Homo Sapiens
guuauuuuuuuaaaggaaacaaacagacaacaaaaagaagaaaaaaaaaaagaaccuccuugga

SEQ ID NO: 176025 - RNA, 64 nt, Homo Sapiens
uaaaaauaaaaaaaauaaaaaaggaaaaaaaaaaaagaagaaacaagacaugccaccuuucccc

SEQ ID NO: 176026 - RNA, 64 nt, Homo Sapiens
ggacauuaaaauauugaaguguuuuuaaaaauuaaagaagaagaaaaguaaaagagcuuaccac

SEQ ID NO: 176027 - RNA, 64 nt, Homo Sapiens
cauuaaaauauugaaguguuuuuaaaaauuaaagaagaagaaaaguaaaagagcuuaccacugg

SEQ ID NO: 176028 - RNA, 64 nt, Homo Sapiens
aaguucugugcugucccguguugggcaacagacaaagaagaaucagacucaaagaacagguucu

SEQ ID NO: 176029 - RNA, 64 nt, Homo Sapiens
cacuaaaaacucaacuagcacaaugguguuccaaaagaagaaaguuaguaacuauuaugaaaua

SEQ ID NO: 176030 - RNA, 59 nt, Homo Sapiens
uggccaagacccagggauaaagggacaagaagaagaaggccuuggacaucaguaucuag

SEQ ID NO: 176031 - RNA, 56 nt, Homo Sapiens
agguggccaagacccagggaagggacaagaagaagaccuuggacaucaguaucuag

SEQ ID NO: 176032 - RNA, 64 nt, Homo Sapiens
aaaagagcccaaucucugauaacaucgauaugcuaagaagaacaaggugcccagcaucacguaa

SEQ ID NO: 176033 - RNA, 64 nt, Homo Sapiens
cacaucuugacacaguaccuugcugucaaagaugaagaagaaggaagacauuuaguacauuaau

SEQ ID NO: 176034 - RNA, 64 nt, Homo Sapiens
uuguccuuucauguaacuuuuuuauuuuaagaggaagaagaagaaaggggcacacacacacaau

SEQ ID NO: 176035 - RNA, 64 nt, Homo Sapiens
uccuuucauguaacuuuuuuauuuuaagaggaagaagaagaaaggggcacacacacacaauacc

SEQ ID NO: 176036 - RNA, 64 nt, Homo Sapiens
gacacaaaucucuaccucccagagagagaagaagaagaagaagagaaaaaaaaaaaaaagagag

SEQ ID NO: 176037 - RNA, 64 nt, Homo Sapiens
agagacacaaaucucuaccugagagagagagaagaagaagaagauuggaaaaaaaaaaaaaaga

SEQ ID NO: 176038 - RNA, 64 nt, Homo Sapiens
agaagagacacaaaucucuaagagagagagagagaagaagaagaugauuggaaaaaaaaaaaaa

SEQ ID NO: 176039 - RNA, 64 nt, Homo Sapiens
cuuauagagaaaaugaguauauaagacaauauacaagaagaaauaucagugaguuuuaaaucag

SEQ ID NO: 176040 - RNA, 64 nt, Homo Sapiens
aagaaaaggguaggcacuaaagggagaacacagaaagaagaauuucuaaaauauuggauuuacu

SEQ ID NO: 176041 - RNA, 64 nt, Homo Sapiens
acacacucaggaggaaaagaaaaaacaaaggcagaagaagaagaagaagaaauaaaaacccacc

SEQ ID NO: 176042 - RNA, 64 nt, Homo Sapiens
cacucaggaggaaaagaaaaaacaaaggcagaagaagaagaagaagaaauaaaaacccacccaa

SEQ ID NO: 176043 - RNA, 64 nt, Homo Sapiens
ucaggaggaaaagaaaaaacaaaggcagaagaagaagaagaagaaauaaaaacccacccaagca

SEQ ID NO: 176044 - RNA, 64 nt, Homo Sapiens
ggaggaaaagaaaaaacaaaggcagaagaagaagaagaagaaauaaaaacccacccaagcaaga

SEQ ID NO: 176045 - RNA, 64 nt, Homo Sapiens
uccagccaguucugcugcaaauguccuuccugggaagaagaagccacgcuggcauaucaggaag

SEQ ID NO: 176046 - RNA, 64 nt, Homo Sapiens
accagccacaggggcagguguguccuuccuggggaagaagaagcacagugacaccucaggaaga

SEQ ID NO: 176047 - RNA, 64 nt, Homo Sapiens
uggugccuggggcucugggguguccccugugaagaagaagaagauccccagaacauccagaguc

SEQ ID NO: 176048 - RNA, 64 nt, Homo Sapiens
agauggugccuggggcucuggucuguccccugugaagaagaagacucuccccagaacauccaga

SEQ ID NO: 176049 - RNA, 64 nt, Homo Sapiens
uuuuauaaacaaaauuacagacugucugaaauugaagaagaaugaacuaauaauagcauucaua

SEQ ID NO: 176050 - RNA, 64 nt, Homo Sapiens
ugugauggauuggacguugugacucuugccuuuuaagaagaaaaaaaagauaggacaaaguauu

SEQ ID NO: 176051 - RNA, 64 nt, Homo Sapiens
uucccuccucuuuuuguaggcagaacaguaucaaaagaagaaucggaagaugcuugugauuuua

SEQ ID NO: 176052 - RNA, 64 nt, Homo Sapiens
cuuuuccauuguuuuugcuucucuuaaaaaguuuaagaagaauaugaccucauuaaaugugcug

SEQ ID NO: 176053 - RNA, 64 nt, Homo Sapiens
caguaauugaacaaauccuaauaacugaucauagaagaagaaucagauauaaaccagaaauucu

SEQ ID NO: 176054 - RNA, 64 nt, Homo Sapiens
acugacugacuaggcauuaucagacaccugcagcaagaagaaauuuucccccuuggugguuuuu

SEQ ID NO: 176055 - RNA, 64 nt, Homo Sapiens
gaucauaaaucugacaaggauuauauuuucuaagaagaagaauaaaagagucauauuuuccaag

SEQ ID NO: 176056 - RNA, 64 nt, Homo Sapiens
auagaucauaaaucugacaaaaguuauauuuucuaagaagaagagugaaagagucauauuuucc

SEQ ID NO: 176057 - RNA, 64 nt, Homo Sapiens
aaaagaaagcaucaugaugaaagaagaaaacgaaaagaagaaacugcugaaauugaaaaagaaa

SEQ ID NO: 176058 - RNA, 64 nt, Homo Sapiens
cgaaaagaagaaacaaaagaaauugaaaaagaaaaagaagaaaaauugagaaguauguugcuga

SEQ ID NO: 176059 - RNA, 64 nt, Homo Sapiens
accagaaaauggcaaugauaggagacugacauagaagaagaaugcuucccuaggaaaaaggucg

SEQ ID NO: 176060 - RNA, 64 nt, Homo Sapiens
cuaggaaaaaggucgcuggcuuuggugcaagaggaagaagaauguuccacuggaagccugagca

SEQ ID NO: 176061 - RNA, 64 nt, Homo Sapiens
agaccccaucucaaaaaaaaaaaaaaaaaaaaaaaagaagaagaauacagucauguaucucuug

SEQ ID NO: 176062 - RNA, 64 nt, Homo Sapiens
ccccaucucaaaaaaaaaaaaaaaaaaaaaaaagaagaagaauacagucauguaucucuuggug

SEQ ID NO: 176063 - RNA, 64 nt, Homo Sapiens
auauuuuucaaauccuugaaucuuuuuuggguugaagaagaagaaagcauagcuuuagaauaga

SEQ ID NO: 176064 - RNA, 64 nt, Homo Sapiens
uuuuucaaauccuugaaucuuuuuuggguugaagaagaagaaagcauagcuuuagaauagagau

SEQ ID NO: 176065 - RNA, 64 nt, Homo Sapiens
gcugggguggagugggaagggagcauugcagccuaagaagaaggccagagagggaaaaggcagg

SEQ ID NO: 176066 - RNA, 64 nt, Homo Sapiens
cugccuggaggcuccucuaggcccugugagcacaaagaagaaagcugauuuuugucuuuuaauc

SEQ ID NO: 176067 - RNA, 64 nt, Homo Sapiens
uuuuuuuuuuauuugaccaaaaaaaaaaaggcccaagaagaagaaaaugaaaaauuugaagauu

SEQ ID NO: 176068 - RNA, 64 nt, Homo Sapiens
uuuuuuuauuugaccaaaaaaaaaaaggcccaagaagaagaaaaugaaaaauuugaagauuuga

SEQ ID NO: 176069 - RNA, 64 nt, Homo Sapiens
gcacacgaacaggugucuuacacuuaacaaaagcaagaagaaaauaacuuaaacggaugggauu

SEQ ID NO: 176070 - RNA, 64 nt, Homo Sapiens
guauuggggcaagucuuguucauggauauguuacaagaagaaguaauacucuaagagaauagga

SEQ ID NO: 176071 - RNA, 64 nt, Homo Sapiens
aaagaggggaagauaugggaacuugagacuuuaaaagaagaaacuuagugcuucuuaccuggua

SEQ ID NO: 176072 - RNA, 64 nt, Homo Sapiens
aacaacaaaaaagccuaaacugaaauuuaauugaaagaagaaacgaaagcuauuuaaaaaaacu

SEQ ID NO: 176073 - RNA, 64 nt, Homo Sapiens
uaagcacaggaaagagaaaauguacccuccgagaaagaagaacgaaaaagaaaaaaagccauga

SEQ ID NO: 176074 - RNA, 64 nt, Homo Sapiens
aagaguugcuuccuauuucaggacccugccaaaaaagaagaaagcuugccuuugguggggcuau

SEQ ID NO: 176075 - RNA, 64 nt, Homo Sapiens
uguggauuuaucugaucaccaaauaauaaauauuaagaagaaugggggaaaaaggauagaauau

SEQ ID NO: 176076 - RNA, 64 nt, Homo Sapiens
gugaaucaaucugaaauugauggaaaagggcagguugaaucaagaaaacugguuuuaaaaucag

SEQ ID NO: 176077 - RNA, 64 nt, Homo Sapiens
aauucccuuguuucaaaagacauuaaacuuguguuugaaucauguacauggguaaauaauuugu

SEQ ID NO: 176078 - RNA, 64 nt, Homo Sapiens
uagaaaugaaucuauauguuauacauaaauaggauugaaucaacgccauuauuuuguauuuuaa

SEQ ID NO: 176079 - RNA, 64 nt, Homo Sapiens
uaugaauugaugauauacagagguuuuaauucauuugaaucacuaucaaguaguaccaguuuua

SEQ ID NO: 176080 - RNA, 64 nt, Homo Sapiens
acucauugauuaaaauggaaauagaaaggaaaacuugaaucaaugaaacuuaucauaaggaaaa

SEQ ID NO: 176081 - RNA, 64 nt, Homo Sapiens
agacaccauggauuauauuccuuguuucuccccuuugaaucagcuuuggauacuaaaugacagc

SEQ ID NO: 176082 - RNA, 64 nt, Homo Sapiens
uaucaggugauacugcugcaguaaucauagcuguuugaaucaggaauaaucccaaucacauuuu

SEQ ID NO: 176083 - RNA, 64 nt, Homo Sapiens
gagaaaggagauugguaaggaagugugauacauauugaaucaggugucaagguaccauuugugc

SEQ ID NO: 176084 - RNA, 64 nt, Homo Sapiens
gcucacacugcugaugauuucucacuuucccaaauugaaucacuggccagaauuuaaaccuaua

SEQ ID NO: 176085 - RNA, 64 nt, Homo Sapiens
cuacaggccucacacacaauaucaaccucuguauuugaaucagccucaccaagcugcuguggcc

SEQ ID NO: 176086 - RNA, 64 nt, Homo Sapiens
aaauaaaagaauguggcuaugaaucaaaaauguauugaaucaucagguuauguggugacuauuu

SEQ ID NO: 176087 - RNA, 64 nt, Homo Sapiens
aauguauugaaucaucaaauuauguggugacuauuugaaucaaagcuuaauaucgugccuaggu

SEQ ID NO: 176088 - RNA, 64 nt, Homo Sapiens
uugugaaugucccccucaaaauauuuuuuuauuguugaaucauuaauaaggaaaugggggugaa

SEQ ID NO: 176089 - RNA, 62 nt, Homo Sapiens
uugauguggguuccgaacugaggaacacuugguugaaucaagcauccugccccucucguuga

SEQ ID NO: 176090 - RNA, 64 nt, Homo Sapiens
gauggauagaaauauauuuuugcuaguucuaggcuugaaucaugggcuccuuggcuuuccuagc

SEQ ID NO: 176091 - RNA, 64 nt, Homo Sapiens
gaaauuuuuugcucaccgccauguuuaaaugggguugaaucauagcgagccauuugcucuugcc

SEQ ID NO: 176092 - RNA, 64 nt, Homo Sapiens
uauuuucacucuugauaagcuuauaaaaucaugauugaaucagcuuuaaagcaucauaccauca

SEQ ID NO: 176093 - RNA, 64 nt, Homo Sapiens
uuaauuugcuugucaucacaaugaaguauguuuuuugaaucaucaauucuuucucauucuccau

SEQ ID NO: 176094 - RNA, 64 nt, Homo Sapiens
uuaaauguacagaaauaaaagacugcagauuauauugaaucauauauugauaagccauacauga

SEQ ID NO: 176095 - RNA, 63 nt, Homo Sapiens
gaacuagaaagaucugauuuaaguucucuaccauugaaucaguuaaacuucauguucaaguag

SEQ ID NO: 176096 - RNA, 64 nt, Homo Sapiens
agaugaaaugcacucuucucgaugaggccucgauuugaaucaauggggugggccacaggaaaug

SEQ ID NO: 176097 - RNA, 64 nt, Homo Sapiens
uggaccuuucuucccuucccuuggagguaucccuuugaaucaggccucucucuucucaucaguc

SEQ ID NO: 176098 - RNA, 64 nt, Homo Sapiens
aaagcagauggccuauuugaggaagagggugucugcccuucacaaacaccucucucuccccugc

SEQ ID NO: 176099 - RNA, 64 nt, Homo Sapiens
cccugcacuagcugucccaagcuuacauacagaggcccuucaggagggccuccugugccgcagg

SEQ ID NO: 176100 - RNA, 64 nt, Homo Sapiens
uuuacuacccuggagggacagcucugcccuugaggcccuucagaaauuugugcugauuuggucc

SEQ ID NO: 176101 - RNA, 64 nt, Homo Sapiens
ugacugcaguguagggaauaggucaccaggaggagcccuucauccuggcaggccggauugugga

SEQ ID NO: 176102 - RNA, 64 nt, Homo Sapiens
ggccuuucccaucuggagagaagcuuccagaccagcccuucacacaccacagccaggaggggcc

SEQ ID NO: 176103 - RNA, 64 nt, Homo Sapiens
ggccguuccugccuggagagaagcuuccagaccagcccuucacaccacagccaggagaggccuu

SEQ ID NO: 176104 - RNA, 64 nt, Homo Sapiens
agacuugcccuuguuacugcaucaaggugaacuugcccuucaauugcgagacucagcuuaucug

SEQ ID NO: 176105 - RNA, 64 nt, Homo Sapiens
aagaguuagcugccagcucucuucauucuauuucgcccuucacaucuagaagucagucaugacu

SEQ ID NO: 176106 - RNA, 64 nt, Homo Sapiens
guggccaagccuggcccuuaaacaacugcagaaagcccuucaacuucagaaggccucacucaag

SEQ ID NO: 176107 - RNA, 64 nt, Homo Sapiens
ccuggguucagccucucccacaauaagaguucuugcccuucauacccucuaccuggauggaugg

SEQ ID NO: 176108 - RNA, 64 nt, Homo Sapiens
aggacccuguucacugcugcuugacuuagaaagugcccuucaaacucugugucaucucagucau

SEQ ID NO: 176109 - RNA, 64 nt, Homo Sapiens
guagagaaccauguaaacauagguccauguuggugcccuucagauuuuccauguuaagaaggug

SEQ ID NO: 176110 - RNA, 64 nt, Homo Sapiens
auuucacaaagucagagcgauaggaaagcacccugcccuucaucuucauguucucccaaaugga

SEQ ID NO: 176111 - RNA, 64 nt, Homo Sapiens
ugcagauuucguuuccgucaacuuaaacauuguugcccuucaacaaggcucuugaauuaauaaa

SEQ ID NO: 176112 - RNA, 64 nt, Homo Sapiens
accuuaaaaaccuauacaacaauaagaggagugcgcccuucagcagcauguauacaaaaauugc

SEQ ID NO: 176113 - RNA, 64 nt, Homo Sapiens
ccaauaggaggagcacuucgagucgaguguaagggcccuucacaaaagcagaaggaacacuggc

SEQ ID NO: 176114 - RNA, 64 nt, Homo Sapiens
guacagaggcaaggaggaugccggcaaggccuucgccagcuagaagcgggacugaggcugccuc

SEQ ID NO: 176115 - RNA, 64 nt, Homo Sapiens
caaguagcugggauuacaggcaccuaccaccagggccagcuaauuuuuguauguuuaguagaaa

SEQ ID NO: 176116 - RNA, 64 nt, Homo Sapiens
gggcagggcuccacugaagccacccccaccccucgccagcuagcuccauagggaagccuguguc

SEQ ID NO: 176117 - RNA, 64 nt, Homo Sapiens
ggaugggggugggggggcgguucucgaggugugugccagcuacacguguguucuguaugggucc

SEQ ID NO: 176118 - RNA, 64 nt, Homo Sapiens
ccccagcuugcccuggccugugccugccucaggugccagcuagaugucucgcuccaccuggguc

SEQ ID NO: 176119 - RNA, 64 nt, Homo Sapiens
aauaccccagacccaacaaaccuccagccagaaagccagcuauuuugcauuugaaggaauugac

SEQ ID NO: 176120 - RNA, 64 nt, Homo Sapiens
uauucugugaaacuaaucauaagcugccuaggcagccagcuacaggcuugagcuuuaaauucau

SEQ ID NO: 176121 - RNA, 64 nt, Homo Sapiens
cuguggagaugaacauucuauccuugaugagcaugccagcuaugugguagggccagcccaccau

SEQ ID NO: 176122 - RNA, 64 nt, Homo Sapiens
ggaucaucuaagaaauguagcugaaacccaaggagccagcuagaaagaagcuuuugauuagaug

SEQ ID NO: 176123 - RNA, 64 nt, Homo Sapiens
auuuccuguguuuguccuggguucuggggcaucagccagcuaccccuugugggcaaaggcaggg

SEQ ID NO: 176124 - RNA, 64 nt, Homo Sapiens
aaagcagaaaguacugcauaguauaugagauauagccagcuagcuaaaguucagauuuuguuag

SEQ ID NO: 176125 - RNA, 64 nt, Homo Sapiens
agggaaaccgcagcuuccugcacucgguccagaggccagcuaggaagggagacaaguggggcug

SEQ ID NO: 176126 - RNA, 64 nt, Homo Sapiens
acccaaaucauuuuaaaauuaccugcaguugggagccagcuacaacauuggagauuagugacuc

SEQ ID NO: 176127 - RNA, 64 nt, Homo Sapiens
ucuaguaguagguuugggguaaaaauuauuauaggccagcuacauuuauuuuuuaaauuguugu

SEQ ID NO: 176128 - RNA, 64 nt, Homo Sapiens
ucugugaacugaggggagccaaagcuaacauccugccagcuaccacugcauugaagcugagcgc

SEQ ID NO: 176129 - RNA, 64 nt, Homo Sapiens
ucauuaggcaaugcuggaagcccuucugaaaagugccagcuauucucaguuacaccucccagug

SEQ ID NO: 176130 - RNA, 64 nt, Homo Sapiens
gcuuccacugucagcccucagagcuggagcuaaggccagcuagacuccuggaccuaaaggguau

SEQ ID NO: 176131 - RNA, 64 nt, Homo Sapiens
cuguauuuuauagucagccuuuugaccaccuggugccagcuauauaaggaauaaaguugauuca

SEQ ID NO: 176132 - RNA, 64 nt, Homo Sapiens
gcaaagcguugagucaucagguauuuagagccuagccagcuacccaguauccaugcugccauau

SEQ ID NO: 176133 - RNA, 64 nt, Homo Sapiens
ggcacuguccagcccuggauagggggggcagugggccagcuaccguaagcaaaggcuguuuuuu

SEQ ID NO: 176134 - RNA, 64 nt, Homo Sapiens
acagagauucagccaaagucaagaaacacuggaugccagcuagauuaucuguucugugcuuugg

SEQ ID NO: 176135 - RNA, 64 nt, Homo Sapiens
cagaggauuauguaaccccugcaguggaaacugagccagcuaacuuaaaaagcugccuuaguuu

SEQ ID NO: 176136 - RNA, 64 nt, Homo Sapiens
cuaagacuggagcuagacacaaugaaacaucagagccagcuaagagaaaagaaauauuuggagg

SEQ ID NO: 176137 - RNA, 64 nt, Homo Sapiens
ggaaggggcggcugcucagacagauuuagggcccgccagcuaggcuacacccaucaugcgccgc

SEQ ID NO: 176138 - RNA, 64 nt, Homo Sapiens
uaaaaaauauuuuuaaauauuuucagcuccagcagccagcuauuaagaaguacuucuuuuuaca

SEQ ID NO: 176139 - RNA, 64 nt, Homo Sapiens
uuccuuuuccugugcuuucugagccggguguuaggccagcuauugauagaagacuguacaauuu

SEQ ID NO: 176140 - RNA, 64 nt, Homo Sapiens
ccugugguucccugcuccgaaucccccuggcagggccagcuaggcaugucaggcuguugugggu

SEQ ID NO: 176141 - RNA, 64 nt, Homo Sapiens
gcuuuuauucaucaaaauaaacuuuuuuucaauugccagcuacugcuguccuauugagcaaaua

SEQ ID NO: 176142 - RNA, 64 nt, Homo Sapiens
aaagcaauaacguugugaugcccacaggccuggagccagcuagcgaccuugugccgcccagcug

SEQ ID NO: 176143 - RNA, 64 nt, Homo Sapiens
gguaaaacuuuuuauauuuuauacauuaacuucagccagcuauugauauaaauaaaacauuuuc

SEQ ID NO: 176144 - RNA, 64 nt, Homo Sapiens
uuuugagaauucaagauggcacugacacgggaaggccagcuacagguggacuccuggaauuuga

SEQ ID NO: 176145 - RNA, 64 nt, Homo Sapiens
uguagguuaagggcauggacugcuugaguucagugccagcuaugccacuuaccagcugugggac

SEQ ID NO: 176146 - RNA, 64 nt, Homo Sapiens
uuaccauaucacuguaaagaagaggggaaacccagccagcuacuuuuuuucaucacuuuuuauu

SEQ ID NO: 176147 - RNA, 64 nt, Homo Sapiens
aagaagugccaaguggacagccugaccucuugcugccagcuaaucagagcuuuggccauuacca

SEQ ID NO: 176148 - RNA, 64 nt, Homo Sapiens
ccuuccuggaagccuuccugcugcccaucccagugccagcuacucaguagagacauugcuguuc

SEQ ID NO: 176149 - RNA, 64 nt, Homo Sapiens
uuuuuauauuuuuuuguagagugugugccacccugccagcuaauccgaguagcuggggcuacag

SEQ ID NO: 176150 - RNA, 64 nt, Homo Sapiens
auuugguauauguuagcucuauuuucuacuaacagccagcuaaagaacuuacagaauuguugaa

SEQ ID NO: 176151 - RNA, 64 nt, Homo Sapiens
aucuuccuggucccuuuuugggaacagugaauuagccagcuagaugccguuuucuugcucaaag

SEQ ID NO: 176152 - RNA, 64 nt, Homo Sapiens
aauuacagcaugaugaauuuugcauggguggccagccagcuagcccauaacugauagaugcauu

SEQ ID NO: 176153 - RNA, 64 nt, Homo Sapiens
aaagggauaccauguagaauugugcaauagucuagccagcuagccuuaacaucuaagaaauuuu

SEQ ID NO: 176154 - RNA, 64 nt, Homo Sapiens
ccaaguagcugggauuacagacucaugccaccacgccagcuaauuuuuguauuuuuaguagaga

SEQ ID NO: 176155 - RNA, 64 nt, Homo Sapiens
aauauauugauagccaagucauggugccuaaaaugccagcuauugccaagaagaaaauaguuga

SEQ ID NO: 176156 - RNA, 64 nt, Homo Sapiens
cuaaaagaaaauggccuucugaucagagacuuuugccagcuacaccuaaacuaauuauaaggau

SEQ ID NO: 176157 - RNA, 57 nt, Homo Sapiens
uuuccacagagcaaugcuauaauggaugccagcuaauggucagcaggguucauuuaa

SEQ ID NO: 176158 - RNA, 64 nt, Homo Sapiens
cgggaggcugaggcaggagacaggcaccuauaaugccagcuacuaaaugagccgggugcaaugg

SEQ ID NO: 176159 - RNA, 64 nt, Homo Sapiens
ggaaauaaccuaccaauuguuuacuauguauguugccagcuaguguacuugcuuuguguccugg

SEQ ID NO: 176160 - RNA, 64 nt, Homo Sapiens
guuuauuuuguaaaaaagaaaugaaaaucugcuggccagcuauguccucuaggaaaugacagac

SEQ ID NO: 176161 - RNA, 64 nt, Homo Sapiens
gucccaugugcuaacuaucuuauauauaaugagagccagcuacguaaaaguagcugagaggccu

SEQ ID NO: 176162 - RNA, 64 nt, Homo Sapiens
gcauaaaggccuuuuuuggcuuuagacacuggcugccagcuauuuuuacuagaacacagaaagc

SEQ ID NO: 176163 - RNA, 64 nt, Homo Sapiens
acaccaucucuaggaaaauuuaauucugucccuggccagcuauuguucuuccacuucguuuucu

SEQ ID NO: 176164 - RNA, 64 nt, Homo Sapiens
cgggaggcugaggcaggagacacaugccuguaaugccagcuacuaaauuagccggacguggugg

SEQ ID NO: 176165 - RNA, 64 nt, Homo Sapiens
aaauugucacacaauggaaauacuguauucggaugccagcuaauguguauuuuuucaaaagaag

SEQ ID NO: 176166 - RNA, 64 nt, Homo Sapiens
cggaaggcugaggcaggagacgggugccuguauugccagcuacuaaauuagccgggcguggugg

SEQ ID NO: 176167 - RNA, 64 nt, Homo Sapiens
aguaauucuuccauaguugauagaauugaaagcugccagcuaacagguuugggacacuucuguu

SEQ ID NO: 176168 - RNA, 64 nt, Homo Sapiens
ccucaaggaaucauagcucucuuuuuucuguucagccagcuaccuuacugaggugguaaauuaa

SEQ ID NO: 176169 - RNA, 64 nt, Homo Sapiens
acuguccacacuuuggcagaccaaaggagaugcagccagcuaagccccaaguggcagcaacugg

SEQ ID NO: 176170 - RNA, 64 nt, Homo Sapiens
aacaauguuugggggaaaaaaaagaaaaaaucaugccagcuaaucaugucaaguucacugccug

SEQ ID NO: 176171 - RNA, 64 nt, Homo Sapiens
ccucucucccggagguugggugggccggcuucaugccagcuacuuccuccuccccacuuguccg

SEQ ID NO: 176172 - RNA, 64 nt, Homo Sapiens
uucauuaucugguuuuauuaagcagaugaaugcagccagcuauaugaagcacuuugcagugaau

SEQ ID NO: 176173 - RNA, 64 nt, Homo Sapiens
uucuuugauuagaagguaauacagcaaagggaaugccagcuaacuguuccuucucucgaacaaa

SEQ ID NO: 176174 - RNA, 64 nt, Homo Sapiens
aaaaugccuuaguuugagcaauuuaaguuguaaagccagcuaauccuuugaaagccaagauauu

SEQ ID NO: 176175 - RNA, 64 nt, Homo Sapiens
gauuuggggugauuaucguugagugaacccuaaugccagcuauacacaggagguguaccaccaa

SEQ ID NO: 176176 - RNA, 64 nt, Homo Sapiens
uuaaaaaaaauacagauuaccaauuucaagugcugccagcuaaaauaacuguuuuaacggguau

SEQ ID NO: 176177 - RNA, 64 nt, Homo Sapiens
gaagucacccagccauucccaguacugacagcaugccagcuaccgaaaggacagggugcuagug

SEQ ID NO: 176178 - RNA, 64 nt, Homo Sapiens
ccaucucaaaacagccuugagaacugguggcuaugccagcuauucguggcugauugaggguuug

SEQ ID NO: 176179 - RNA, 64 nt, Homo Sapiens
caggaggccgaggcaggagaugcgugccuguagugccagcuacuaaauuagcugggcauggugg

SEQ ID NO: 176180 - RNA, 64 nt, Homo Sapiens
uggucuuuuaccucugaucuuguccccaaccuaagccagcuagcugcgugcucccacucccucu

SEQ ID NO: 176181 - RNA, 64 nt, Homo Sapiens
auugugugccauuuaaaaacgaugaaaaugaugugccagcuaaauuggaaaaggcuuccccugu

SEQ ID NO: 176182 - RNA, 64 nt, Homo Sapiens
ggguaguccagaagaagcuguuucagggccuguugccagcuaugccuuugagaaccucgggauc

SEQ ID NO: 176183 - RNA, 64 nt, Homo Sapiens
ccgaucuuucccaaagguguugauuuacaaagaggccagcuaauagcagaaaucaugacccuga

SEQ ID NO: 176184 - RNA, 64 nt, Homo Sapiens
uaaggaaaacuacggcugcuggguugggauuucugccagcuagcugguacuggcuucuuguuuc

SEQ ID NO: 176185 - RNA, 64 nt, Homo Sapiens
aauacccucccagcaacaaaaccuaaucaguaaggccagcuagacccaauggcucaugccugua

SEQ ID NO: 176186 - RNA, 64 nt, Homo Sapiens
gagccucuggaacacuauggagauucccaaagaagccagcuacaucaaagacaggaccaacuuc

SEQ ID NO: 176187 - RNA, 64 nt, Homo Sapiens
ggccgccacgcaagugaagcggaugagcuacuuugccagcuagauccaagcaauucgugcagug

SEQ ID NO: 176188 - RNA, 64 nt, Homo Sapiens
ucuucgaguuuuucaaauugcuuucugcuucuuagccagcuaccccccagaaccaaaagggggc

SEQ ID NO: 176189 - RNA, 64 nt, Homo Sapiens
ugccaggcccgggcuggggcggcguuuaucaguggccagcuaccgcuucuccuaggaucccagu

SEQ ID NO: 176190 - RNA, 64 nt, Homo Sapiens
gaccucagugcaaggcuggugaacccugcagcgggccagcuauggugggaagccuggcauuugg

SEQ ID NO: 176191 - RNA, 64 nt, Homo Sapiens
uuuacuucucucaaagcuagaagccaagaaaauggccagcuagaaccaagauuuaaggggcugu

SEQ ID NO: 176192 - RNA, 64 nt, Homo Sapiens
guucuucccucacuccauccccgcuaccguccuggccagcuaccgucagagagaaccagagcuc

SEQ ID NO: 176193 - RNA, 64 nt, Homo Sapiens
cugugccagcccagugaaugcgugccccagcccagccagcuacccagccccucucugugugcag

SEQ ID NO: 176194 - RNA, 53 nt, Homo Sapiens
agcucagguauguauuuuagccagccagcuagcuagcaacccauugccaccac

SEQ ID NO: 176195 - RNA, 64 nt, Homo Sapiens
uuuugaguuuuagaauuagucauucuuuagagcagccagcuaguggcauuucuaggaaaacugu

SEQ ID NO: 176196 - RNA, 64 nt, Homo Sapiens
uuacccccaggcuggauuuuaaaaggacagugaagccagcuauuggaaggaaagugauucugug

SEQ ID NO: 176197 - RNA, 64 nt, Homo Sapiens
gauucagcaucuccaggaucagugaccaaagauggccagcuagaagauaccuggcauuuuggga

SEQ ID NO: 176198 - RNA, 64 nt, Homo Sapiens
cagcuuccuuccugaccaagucugccaaccaauggccagcuaugcgccucauccucauugcuuc

SEQ ID NO: 176199 - RNA, 64 nt, Homo Sapiens
aaaaauggggccuuagcuucuggcuuuuaauuuugccagcuaaggacauaaaacaaaaauaaac

SEQ ID NO: 176200 - RNA, 64 nt, Homo Sapiens
cugggucccacccuccgagccauggugccccccugccagcuauugacacagcugcgaagugccc

SEQ ID NO: 176201 - RNA, 64 nt, Homo Sapiens
cuuccucuuugaucuuuaaccccaagaagcaacagccagcuaaugcuuuauuaaaauuacccuc

SEQ ID NO: 176202 - RNA, 64 nt, Homo Sapiens
gccguguuugugacccccuccugcccagcaaccugccagcuacaggagcccccugcgucccaga

SEQ ID NO: 176203 - RNA, 64 nt, Homo Sapiens
aaauacugcuuucugccaucgguuaaguuucagugccagcuagauuuucucccucaaaaaaaua

SEQ ID NO: 176204 - RNA, 64 nt, Homo Sapiens
uaggaccauacgcaccuguguuggaaagacagaggccagcuauuuucccaaugaagugaagaug

SEQ ID NO: 176205 - RNA, 64 nt, Homo Sapiens
cuuaacauuuagcagaaagcgauuccaacucuuugccagcuaaucuagaguggauccuggcacu

SEQ ID NO: 176206 - RNA, 64 nt, Homo Sapiens
ugccugacaggcugugacucccuucccgccggaggccagcuaucgcaagugcucagggaaaugg

SEQ ID NO: 176207 - RNA, 64 nt, Homo Sapiens
agccugggccuuccccagccacgugccuggacucgccagcuaaaccuguuccugcaaaucauca

SEQ ID NO: 176208 - RNA, 64 nt, Homo Sapiens
guucauguguucuuuauaaauaaaggccacauaggccagcuagucucaggauuggaagagauuu

SEQ ID NO: 176209 - RNA, 64 nt, Homo Sapiens
ugcuuuugaauuuuauuuuuaggaaaauucugaagccagcuaucacagguuuguuagcuaauaa

SEQ ID NO: 176210 - RNA, 64 nt, Homo Sapiens
aaucuauaacucagaaauggucagauggucaggagccagcuaugcagcaguauaccaucuguuu

SEQ ID NO: 176211 - RNA, 64 nt, Homo Sapiens
gaacuuggacucauaauucgagcaugaggacuaugccagcuauaagcucagaggcuggggcuaa

SEQ ID NO: 176212 - RNA, 64 nt, Homo Sapiens
gauugaaaaaaaaaaacaaauguauuguaucagcgccagcuacacucuuuggccagguaaacau

SEQ ID NO: 176213 - RNA, 64 nt, Homo Sapiens
agccccucugcccccaugccgauguuuccccaaggccagcuacacaaagacaacacuuacccag

SEQ ID NO: 176214 - RNA, 64 nt, Homo Sapiens
ucuguugauacuauguauaaugcccuacagaggugccagcuauuguuuuuaaaaacuugcuuca

SEQ ID NO: 176215 - RNA, 64 nt, Homo Sapiens
uugaaugcacaaauucugucuaacuaguuuuucugccagcuaugauuuguucuaccuagcauuu

SEQ ID NO: 176216 - RNA, 64 nt, Homo Sapiens
ccaauguggugcuauuguuuccauuuauuguuuggccagcuaugauguagcacauuuugcuuuc

SEQ ID NO: 176217 - RNA, 64 nt, Homo Sapiens
aucuccccugccuuccuuuagagcuugacuucaugccagcuauauguccuguuccugccacaug

SEQ ID NO: 176218 - RNA, 64 nt, Homo Sapiens
caaagggaugcacaggcggcucgcaugccccagggccagcuaagaguuccaaagaucucagauu

SEQ ID NO: 176219 - RNA, 64 nt, Homo Sapiens
uucaucuuuuuaauaccauaguagcucacuauuagccagcuaagcuggaacauaauucuuuugu

SEQ ID NO: 176220 - RNA, 64 nt, Homo Sapiens
cuaagacuggaacuagacguaaugaaacaucagagccagcuaagagaaaagaaauauuuggagg

SEQ ID NO: 176221 - RNA, 64 nt, Homo Sapiens
ugcuggcaucgugucuuuccugugcucugaagaugccagcuacaucacuggggaaacaguggug

SEQ ID NO: 176222 - RNA, 64 nt, Homo Sapiens
ucuggcucuuguccaucugucuguguuucuuuuugccagcuauugacuaaucuuugcugaagcu

SEQ ID NO: 176223 - RNA, 64 nt, Homo Sapiens
agccugcaggcaccagccgggccauaugcccagugccagcuagggcccaccgcccauccugcac

SEQ ID NO: 176224 - RNA, 64 nt, Homo Sapiens
agaaaagaaauauuuggaggaaugaaacaucagagccagcuaagcuaagacuggaacuagacgu

SEQ ID NO: 176225 - RNA, 64 nt, Homo Sapiens
agggguuuaaauauuuaggauauauauauuauaggccagcuacaacuguauauaacaucuaaua

SEQ ID NO: 176226 - RNA, 64 nt, Homo Sapiens
guuggcuuuccaaaacaacauuucccuccaugcagccagcuauacacgucaucuggauuuugga

SEQ ID NO: 176227 - RNA, 64 nt, Homo Sapiens
ccacucggggcaggccagcaagcuccggauggaggccagcuaagagagccccaaagcaggaaga

SEQ ID NO: 176228 - RNA, 64 nt, Homo Sapiens
ugauauuagaggaagaaaggggcaugccauaaaggccagcuaugcaauaccuuuuuucuuagcu

SEQ ID NO: 176229 - RNA, 64 nt, Homo Sapiens
aggagccacuuaagagauuacaccgcauggucuugccagcuaccgccugaacuuccuuuuggag

SEQ ID NO: 176230 - RNA, 64 nt, Homo Sapiens
ugugucuccaagacagcuuaugaauaucuaaaaggccagcuaccugccuaggagccacuauaua

SEQ ID NO: 176231 - RNA, 64 nt, Homo Sapiens
cugggccuuuccuuuaugaaccuccauccucccagccagcuacaguagggccuccucaccccgu

SEQ ID NO: 176232 - RNA, 64 nt, Homo Sapiens
cgaguagcugggacuauaggcaugcgccaccauggccagcuaauuuuuguauuuuuaguagaga

SEQ ID NO: 176233 - RNA, 64 nt, Homo Sapiens
accagcugcacggaccagguucccgcaaaacauugccagcuagugaggcauaauuugcucaaag

SEQ ID NO: 176234 - RNA, 64 nt, Homo Sapiens
ggcaccccaugggacucaguggcucacauuuccugccagcuacaccacaggcagaugggagucg

SEQ ID NO: 176235 - RNA, 64 nt, Homo Sapiens
ugacuuuuagaguaacagauaggacaguggcuuugccagcuaagagugggauacagaagaagcc

SEQ ID NO: 176236 - RNA, 64 nt, Homo Sapiens
gauuuugcacuuuugcuccauucccgacccacaggccagcuacgaugcuugcaguccuacaggc

SEQ ID NO: 176237 - RNA, 64 nt, Homo Sapiens
guccggcagcuucugcccccugcagaaccggagagccagcuaagggguggggcugcggggguuc

SEQ ID NO: 176238 - RNA, 64 nt, Homo Sapiens
cuugcuugcccuccaaauguccuuucucagaggggccagcuaacccgugcagaaccagcacuaa

SEQ ID NO: 176239 - RNA, 51 nt, Homo Sapiens
agcagaaaaaggcgcaguagagccagcuacuggagucauuccguuuccacu

SEQ ID NO: 176240 - RNA, 64 nt, Homo Sapiens
ucgcuguaccuuugccacaugguacuguaugcuugccagcuagaaggagggucagggauuuuuu

SEQ ID NO: 176241 - RNA, 64 nt, Homo Sapiens
gugaugggauuugcauuuuauaucccagaccuuugccagcuacaucccuagacuccaggagcca

SEQ ID NO: 176242 - RNA, 64 nt, Homo Sapiens
ccagaggcugaggcaagagaggucugccuguaaugccagcuacuacuuagccaggcaugauggg

SEQ ID NO: 176243 - RNA, 64 nt, Homo Sapiens
gaguugagcuggccauguuuuuucagcuuuuggugccagcuacauguguaugguaaggaauucu

SEQ ID NO: 176244 - RNA, 64 nt, Homo Sapiens
ccucgggccgucagcaauacaugugcacgccccggccagcuaaggagcugugaguccacgucuc

SEQ ID NO: 176245 - RNA, 64 nt, Homo Sapiens
cauaguaagaaguccagccuuuucugcaugugacgccagcuaaggccaucguucugcacggggc

SEQ ID NO: 176246 - RNA, 64 nt, Homo Sapiens
guaaaagcuuuuuauuuuagggaggaggccacaggccagcuauuacuccauacuggggugggcu

SEQ ID NO: 176247 - RNA, 64 nt, Homo Sapiens
cagcaugcuuuuugaagauuaacucgacaauauggccagcuaaugaaauuaaaaaggauucuuc

SEQ ID NO: 176248 - RNA, 64 nt, Homo Sapiens
uuuuguauuuuuaguagagacgugugcccccacagccagcuaaucagguagcugggacuacaag

SEQ ID NO: 176249 - RNA, 64 nt, Homo Sapiens
aaaccacggccagcugcuugucuuuguauggcuugccagcuaacaauagugguuccaucuuuaa

SEQ ID NO: 176250 - RNA, 64 nt, Homo Sapiens
uggaauuacugccuuuauaagaagaagccaaagagccagcuagcucuuucaaccacaugagguu

SEQ ID NO: 176251 - RNA, 64 nt, Homo Sapiens
aauuagccaggagugguggcgggcgccugugguggccagcuacucaggaggcugaggcaggaga

SEQ ID NO: 176252 - RNA, 64 nt, Homo Sapiens
ccucagccagggagggcuuccuggaggagaaggagccagcuagacauggauaggagugcguuuu

SEQ ID NO: 176253 - RNA, 64 nt, Homo Sapiens
gacgaguacaacgagauaacugcuuuaagccuuagccagcuagugagacccagucacacgucuc

SEQ ID NO: 176254 - RNA, 64 nt, Homo Sapiens
ugggagggaggaauuacacaggcagcccacuugggccagcuacggcucuaauagggucaucucu

SEQ ID NO: 176255 - RNA, 64 nt, Homo Sapiens
gcacgugacgaguguggcugcuuugaauaaagucgccagcuagacucucacuuuucccucuccc

SEQ ID NO: 176256 - RNA, 64 nt, Homo Sapiens
agcaugaucuuuucucacuucuugggauuccaaagccagcuaacaaucccugucucuacgugaa

SEQ ID NO: 176257 - RNA, 64 nt, Homo Sapiens
ggagggagagaaaggagcugaaagucuagguuuggccagcuagguagacugacuugugagguau

SEQ ID NO: 176258 - RNA, 64 nt, Homo Sapiens
caggaggcugaggcaugagaugugugccuguaaugccagcuacuaaauuagcugggcauggugg

SEQ ID NO: 176259 - RNA, 64 nt, Homo Sapiens
ccacccugccugccugggccccucggauagcacagccagcuacuugcucugauuaggacagcga

SEQ ID NO: 176260 - RNA, 64 nt, Homo Sapiens
cccccagugcaccaccccauuuuuaacauugugagccagcuagaccaauuugauucaaaaauau

SEQ ID NO: 176261 - RNA, 64 nt, Homo Sapiens
gccaccuaaaaaucaucuggaagaacucuucaaugccagcuacucucaacagccgcuugaagcc

SEQ ID NO: 176262 - RNA, 64 nt, Homo Sapiens
gaacucuagucccaaagggguggccagagccaaagccagcuacuguccuguccucugcuuccug

SEQ ID NO: 176263 - RNA, 64 nt, Homo Sapiens
gcuuauuauuucaaaagaaguaguugccugcaaagccagcuaagcauguccugcuggaagugcc

SEQ ID NO: 176264 - RNA, 64 nt, Homo Sapiens
uuuuuuuuuuuuaaacauccacaguuaagguugggccagcuaccuuuggggcugacccccucca

SEQ ID NO: 176265 - RNA, 64 nt, Homo Sapiens
ucugcugacauuuuggauuaaccuuauguagguugccagcuaaugaauuguaauugauuucaau

SEQ ID NO: 176266 - RNA, 64 nt, Homo Sapiens
acuaguaggcaagccugggcauuucugcauuugugccagcuaacacuacaaaauagacuuaauu

SEQ ID NO: 176267 - RNA, 64 nt, Homo Sapiens
cugggccccuaaucccaggccccgagauaggaaagccagcuagucucuucucuucugugaucuc

SEQ ID NO: 176268 - RNA, 64 nt, Homo Sapiens
acaaagacgauaucuuuauggucguauaucaauagccagcuagacgaguuuucuaaucccuucu

SEQ ID NO: 176269 - RNA, 64 nt, Homo Sapiens
ucucuacugucacauuuuguuucuuaaaagcaaagccagcuaacaccuucauucaucccuaguu

SEQ ID NO: 176270 - RNA, 53 nt, Homo Sapiens
ccccuaucuccgagagcagcacggccagcuacuaagaacuaccgaguguguag

SEQ ID NO: 176271 - RNA, 64 nt, Homo Sapiens
ccuugagggaugguaccucuugucuccagauauugccagcuacccaaguugagacaaccaaaaa

SEQ ID NO: 176272 - RNA, 64 nt, Homo Sapiens
aguuugacucuccuuucugggccagauccugagggccagcuauggagcgacccugagcucuuca

SEQ ID NO: 176273 - RNA, 64 nt, Homo Sapiens; identical to SEQ ID NO: 78937

SEQ ID NO: 176274 - RNA, 64 nt, Homo Sapiens; identical to SEQ ID NO: 78938

SEQ ID NO: 176275 - RNA, 64 nt, Homo Sapiens; identical to SEQ ID NO: 78939

SEQ ID NO: 176276 - RNA, 64 nt, Homo Sapiens; identical to SEQ ID NO: 78940

SEQ ID NO: 176277 - RNA, 64 nt, Homo Sapiens; identical to SEQ ID NO: 78941

SEQ ID NO: 176278 - RNA, 64 nt, Homo Sapiens; identical to SEQ ID NO: 78942

SEQ ID NO: 176279 - RNA, 64 nt, Homo Sapiens; identical to SEQ ID NO: 78943

SEQ ID NO: 176280 - RNA, 64 nt, Homo Sapiens; identical to SEQ ID NO: 78944

SEQ ID NO: 176281 - RNA, 64 nt, Homo Sapiens; identical to SEQ ID NO: 78945

SEQ ID NO: 176282 - RNA, 64 nt, Homo Sapiens; identical to SEQ ID NO: 78946

SEQ ID NO: 176283 - RNA, 64 nt, Homo Sapiens; identical to SEQ ID NO: 78947

SEQ ID NO: 176284 - RNA, 64 nt, Homo Sapiens; identical to SEQ ID NO: 78948

SEQ ID NO: 176285 - RNA, 64 nt, Homo Sapiens; identical to SEQ ID NO: 78949

SEQ ID NO: 176286 - RNA, 64 nt, Homo Sapiens; identical to SEQ ID NO: 78950

SEQ ID NO: 176287 - RNA, 64 nt, Homo Sapiens; identical to SEQ ID NO: 78951

SEQ ID NO: 176288 - RNA, 64 nt, Homo Sapiens; identical to SEQ ID NO: 78952

SEQ ID NO: 176289 - RNA, 64 nt, Homo Sapiens; identical to SEQ ID NO: 78953

SEQ ID NO: 176290 - RNA, 64 nt, Homo Sapiens; identical to SEQ ID NO: 78954

SEQ ID NO: 176291 - RNA, 64 nt, Homo Sapiens; identical to SEQ ID NO: 78955

SEQ ID NO: 176292 - RNA, 64 nt, Homo Sapiens; identical to SEQ ID NO: 78956

SEQ ID NO: 176293 - RNA, 64 nt, Homo Sapiens; identical to SEQ ID NO: 78957

SEQ ID NO: 176294 - RNA, 64 nt, Homo Sapiens; identical to SEQ ID NO: 78958

SEQ ID NO: 176295 - RNA, 64 nt, Homo Sapiens; identical to SEQ ID NO: 78959

SEQ ID NO: 176296 - RNA, 64 nt, Homo Sapiens; identical to SEQ ID NO: 78960

SEQ ID NO: 176297 - RNA, 64 nt, Homo Sapiens; identical to SEQ ID NO: 78961

SEQ ID NO: 176298 - RNA, 64 nt, Homo Sapiens; identical to SEQ ID NO: 78962

SEQ ID NO: 176299 - RNA, 64 nt, Homo Sapiens; identical to SEQ ID NO: 78963

SEQ ID NO: 176300 - RNA, 64 nt, Homo Sapiens; identical to SEQ ID NO: 78964

SEQ ID NO: 176301 - RNA, 64 nt, Homo Sapiens; identical to SEQ ID NO: 78965

SEQ ID NO: 176302 - RNA, 64 nt, Homo Sapiens; identical to SEQ ID NO: 78966

SEQ ID NO: 176303 - RNA, 64 nt, Homo Sapiens; identical to SEQ ID NO: 78967

SEQ ID NO: 176304 - RNA, 64 nt, Homo Sapiens; identical to SEQ ID NO: 78968

SEQ ID NO: 176305 - RNA, 64 nt, Homo Sapiens; identical to SEQ ID NO: 78969

SEQ ID NO: 176306 - RNA, 64 nt, Homo Sapiens; identical to SEQ ID NO: 78970

SEQ ID NO: 176307 - RNA, 64 nt, Homo Sapiens; identical to SEQ ID NO: 78971

SEQ ID NO: 176308 - RNA, 64 nt, Homo Sapiens; identical to SEQ ID NO: 78972

SEQ ID NO: 176309 - RNA, 64 nt, Homo Sapiens; identical to SEQ ID NO: 78973

SEQ ID NO: 176310 - RNA, 64 nt, Homo Sapiens; identical to SEQ ID NO: 78974

SEQ ID NO: 176311 - RNA, 64 nt, Homo Sapiens; identical to SEQ ID NO: 78975

SEQ ID NO: 176312 - RNA, 64 nt, Homo Sapiens; identical to SEQ ID NO: 78976

SEQ ID NO: 176313 - RNA, 64 nt, Homo Sapiens; identical to SEQ ID NO: 78977

SEQ ID NO: 176314 - RNA, 64 nt, Homo Sapiens; identical to SEQ ID NO: 78978

SEQ ID NO: 176315 - RNA, 64 nt, Homo Sapiens; identical to SEQ ID NO: 78979

SEQ ID NO: 176316 - RNA, 64 nt, Homo Sapiens; identical to SEQ ID NO: 78980

SEQ ID NO: 176317 - RNA, 64 nt, Homo Sapiens; identical to SEQ ID NO: 78981

SEQ ID NO: 176318 - RNA, 64 nt, Homo Sapiens; identical to SEQ ID NO: 78982

SEQ ID NO: 176319 - RNA, 64 nt, Homo Sapiens; identical to SEQ ID NO: 78983

SEQ ID NO: 176320 - RNA, 64 nt, Homo Sapiens; identical to SEQ ID NO: 78984

SEQ ID NO: 176321 - RNA, 64 nt, Homo Sapiens; identical to SEQ ID NO: 78985

SEQ ID NO: 176322 - RNA, 64 nt, Homo Sapiens; identical to SEQ ID NO: 78986

SEQ ID NO: 176323 - RNA, 64 nt, Homo Sapiens; identical to SEQ ID NO: 78987

SEQ ID NO: 176324 - RNA, 64 nt, Homo Sapiens; identical to SEQ ID NO: 78988

SEQ ID NO: 176325 - RNA, 64 nt, Homo Sapiens; identical to SEQ ID NO: 78989

SEQ ID NO: 176326 - RNA, 64 nt, Homo Sapiens; identical to SEQ ID NO: 78990

SEQ ID NO: 176327 - RNA, 64 nt, Homo Sapiens; identical to SEQ ID NO: 78991

SEQ ID NO: 176328 - RNA, 64 nt, Homo Sapiens; identical to SEQ ID NO: 78992

SEQ ID NO: 176329 - RNA, 64 nt, Homo Sapiens; identical to SEQ ID NO: 78993

SEQ ID NO: 176330 - RNA, 64 nt, Homo Sapiens; identical to SEQ ID NO: 78994

SEQ ID NO: 176331 - RNA, 64 nt, Homo Sapiens; identical to SEQ ID NO: 78995

SEQ ID NO: 176332 - RNA, 64 nt, Homo Sapiens; identical to SEQ ID NO: 78996

SEQ ID NO: 176333 - RNA, 64 nt, Homo Sapiens; identical to SEQ ID NO: 78997

SEQ ID NO: 176334 - RNA, 64 nt, Homo Sapiens; identical to SEQ ID NO: 78998

SEQ ID NO: 176335 - RNA, 64 nt, Homo Sapiens; identical to SEQ ID NO: 78999

SEQ ID NO: 176336 - RNA, 64 nt, Homo Sapiens; identical to SEQ ID NO: 79000

SEQ ID NO: 176337 - RNA, 64 nt, Homo Sapiens; identical to SEQ ID NO: 79001

SEQ ID NO: 176338 - RNA, 64 nt, Homo Sapiens; identical to SEQ ID NO: 79002

SEQ ID NO: 176339 - RNA, 64 nt, Homo Sapiens; identical to SEQ ID NO: 79003

SEQ ID NO: 176340 - RNA, 64 nt, Homo Sapiens; identical to SEQ ID NO: 79004

SEQ ID NO: 176341 - RNA, 64 nt, Homo Sapiens; identical to SEQ ID NO: 79005

SEQ ID NO: 176342 - RNA, 64 nt, Homo Sapiens; identical to SEQ ID NO: 79006

SEQ ID NO: 176343 - RNA, 64 nt, Homo Sapiens; identical to SEQ ID NO: 79007

SEQ ID NO: 176344 - RNA, 64 nt, Homo Sapiens; identical to SEQ ID NO: 79008

SEQ ID NO: 176345 - RNA, 64 nt, Homo Sapiens; identical to SEQ ID NO: 79009

SEQ ID NO: 176346 - RNA, 64 nt, Homo Sapiens; identical to SEQ ID NO: 79010

SEQ ID NO: 176347 - RNA, 64 nt, Homo Sapiens; identical to SEQ ID NO: 79011

SEQ ID NO: 176348 - RNA, 64 nt, Homo Sapiens; identical to SEQ ID NO: 79012

SEQ ID NO: 176349 - RNA, 64 nt, Homo Sapiens; identical to SEQ ID NO: 79013

SEQ ID NO: 176350 - RNA, 64 nt, Homo Sapiens; identical to SEQ ID NO: 79014

SEQ ID NO: 176351 - RNA, 64 nt, Homo Sapiens; identical to SEQ ID NO: 79015

SEQ ID NO: 176352 - RNA, 64 nt, Homo Sapiens; identical to SEQ ID NO: 79016

SEQ ID NO: 176353 - RNA, 64 nt, Homo Sapiens; identical to SEQ ID NO: 79017

SEQ ID NO: 176354 - RNA, 64 nt, Homo Sapiens; identical to SEQ ID NO: 79018

SEQ ID NO: 176355 - RNA, 64 nt, Homo Sapiens; identical to SEQ ID NO: 79019

SEQ ID NO: 176356 - RNA, 64 nt, Homo Sapiens; identical to SEQ ID NO: 79020

SEQ ID NO: 176357 - RNA, 64 nt, Homo Sapiens; identical to SEQ ID NO: 79021

SEQ ID NO: 176358 - RNA, 64 nt, Homo Sapiens; identical to SEQ ID NO: 79022

SEQ ID NO: 176359 - RNA, 64 nt, Homo Sapiens; identical to SEQ ID NO: 79023

SEQ ID NO: 176360 - RNA, 64 nt, Homo Sapiens; identical to SEQ ID NO: 79024

SEQ ID NO: 176361 - RNA, 64 nt, Homo Sapiens; identical to SEQ ID NO: 79025

SEQ ID NO: 176362 - RNA, 64 nt, Homo Sapiens; identical to SEQ ID NO: 79026

SEQ ID NO: 176363 - RNA, 64 nt, Homo Sapiens; identical to SEQ ID NO: 79027

SEQ ID NO: 176364 - RNA, 64 nt, Homo Sapiens; identical to SEQ ID NO: 79028

SEQ ID NO: 176365 - RNA, 64 nt, Homo Sapiens; identical to SEQ ID NO: 79029

SEQ ID NO: 176366 - RNA, 64 nt, Homo Sapiens; identical to SEQ ID NO: 79030

SEQ ID NO: 176367 - RNA, 64 nt, Homo Sapiens; identical to SEQ ID NO: 79031

SEQ ID NO: 176368 - RNA, 64 nt, Homo Sapiens; identical to SEQ ID NO: 79032

SEQ ID NO: 176369 - RNA, 64 nt, Homo Sapiens; identical to SEQ ID NO: 79033

SEQ ID NO: 176370 - RNA, 64 nt, Homo Sapiens; identical to SEQ ID NO: 79034

SEQ ID NO: 176371 - RNA, 64 nt, Homo Sapiens; identical to SEQ ID NO: 79035

SEQ ID NO: 176372 - RNA, 64 nt, Homo Sapiens; identical to SEQ ID NO: 79036

SEQ ID NO: 176373 - RNA, 64 nt, Homo Sapiens; identical to SEQ ID NO: 79037

SEQ ID NO: 176374 - RNA, 64 nt, Homo Sapiens; identical to SEQ ID NO: 79038

SEQ ID NO: 176375 - RNA, 64 nt, Homo Sapiens; identical to SEQ ID NO: 79039

SEQ ID NO: 176376 - RNA, 64 nt, Homo Sapiens; identical to SEQ ID NO: 79040

SEQ ID NO: 176377 - RNA, 64 nt, Homo Sapiens; identical to SEQ ID NO: 79041

SEQ ID NO: 176378 - RNA, 64 nt, Homo Sapiens; identical to SEQ ID NO: 79042

SEQ ID NO: 176379 - RNA, 64 nt, Homo Sapiens; identical to SEQ ID NO: 79043

SEQ ID NO: 176380 - RNA, 64 nt, Homo Sapiens; identical to SEQ ID NO: 79044

SEQ ID NO: 176381 - RNA, 64 nt, Homo Sapiens; identical to SEQ ID NO: 79045

SEQ ID NO: 176382 - RNA, 64 nt, Homo Sapiens; identical to SEQ ID NO: 79046

SEQ ID NO: 176383 - RNA, 64 nt, Homo Sapiens; identical to SEQ ID NO: 79047

SEQ ID NO: 176384 - RNA, 64 nt, Homo Sapiens; identical to SEQ ID NO: 79048

SEQ ID NO: 176385 - RNA, 64 nt, Homo Sapiens; identical to SEQ ID NO: 79049

SEQ ID NO: 176386 - RNA, 64 nt, Homo Sapiens; identical to SEQ ID NO: 79050

SEQ ID NO: 176387 - RNA, 64 nt, Homo Sapiens; identical to SEQ ID NO: 172495

SEQ ID NO: 176388 - RNA, 64 nt, Homo Sapiens; identical to SEQ ID NO: 172496

SEQ ID NO: 176389 - RNA, 64 nt, Homo Sapiens; identical to SEQ ID NO: 78937

SEQ ID NO: 176390 - RNA, 64 nt, Homo Sapiens; identical to SEQ ID NO: 78938

SEQ ID NO: 176391 - RNA, 64 nt, Homo Sapiens; identical to SEQ ID NO: 78939

SEQ ID NO: 176392 - RNA, 64 nt, Homo Sapiens; identical to SEQ ID NO: 78940

SEQ ID NO: 176393 - RNA, 64 nt, Homo Sapiens; identical to SEQ ID NO: 78941

SEQ ID NO: 176394 - RNA, 64 nt, Homo Sapiens; identical to SEQ ID NO: 78942

SEQ ID NO: 176395 - RNA, 64 nt, Homo Sapiens; identical to SEQ ID NO: 78943

SEQ ID NO: 176396 - RNA, 64 nt, Homo Sapiens; identical to SEQ ID NO: 78944

SEQ ID NO: 176397 - RNA, 64 nt, Homo Sapiens; identical to SEQ ID NO: 78945

SEQ ID NO: 176398 - RNA, 64 nt, Homo Sapiens; identical to SEQ ID NO: 78946

SEQ ID NO: 176399 - RNA, 64 nt, Homo Sapiens; identical to SEQ ID NO: 78947

SEQ ID NO: 176400 - RNA, 64 nt, Homo Sapiens; identical to SEQ ID NO: 78948

SEQ ID NO: 176401 - RNA, 64 nt, Homo Sapiens; identical to SEQ ID NO: 78949

SEQ ID NO: 176402 - RNA, 64 nt, Homo Sapiens; identical to SEQ ID NO: 78950

SEQ ID NO: 176403 - RNA, 64 nt, Homo Sapiens; identical to SEQ ID NO: 78951

SEQ ID NO: 176404 - RNA, 64 nt, Homo Sapiens; identical to SEQ ID NO: 78952

SEQ ID NO: 176405 - RNA, 64 nt, Homo Sapiens; identical to SEQ ID NO: 78953

SEQ ID NO: 176406 - RNA, 64 nt, Homo Sapiens; identical to SEQ ID NO: 78954

SEQ ID NO: 176407 - RNA, 64 nt, Homo Sapiens; identical to SEQ ID NO: 78955

SEQ ID NO: 176408 - RNA, 64 nt, Homo Sapiens; identical to SEQ ID NO: 78956

SEQ ID NO: 176409 - RNA, 64 nt, Homo Sapiens; identical to SEQ ID NO: 78957

SEQ ID NO: 176410 - RNA, 64 nt, Homo Sapiens; identical to SEQ ID NO: 78958

SEQ ID NO: 176411 - RNA, 64 nt, Homo Sapiens; identical to SEQ ID NO: 78959

SEQ ID NO: 176412 - RNA, 64 nt, Homo Sapiens; identical to SEQ ID NO: 78960

SEQ ID NO: 176413 - RNA, 64 nt, Homo Sapiens; identical to SEQ ID NO: 78961

SEQ ID NO: 176414 - RNA, 64 nt, Homo Sapiens; identical to SEQ ID NO: 78962

SEQ ID NO: 176415 - RNA, 64 nt, Homo Sapiens; identical to SEQ ID NO: 78963

SEQ ID NO: 176416 - RNA, 64 nt, Homo Sapiens; identical to SEQ ID NO: 78964

SEQ ID NO: 176417 - RNA, 64 nt, Homo Sapiens; identical to SEQ ID NO: 78965

SEQ ID NO: 176418 - RNA, 64 nt, Homo Sapiens; identical to SEQ ID NO: 78966

SEQ ID NO: 176419 - RNA, 64 nt, Homo Sapiens; identical to SEQ ID NO: 78967

SEQ ID NO: 176420 - RNA, 64 nt, Homo Sapiens; identical to SEQ ID NO: 78968

SEQ ID NO: 176421 - RNA, 64 nt, Homo Sapiens; identical to SEQ ID NO: 78969

SEQ ID NO: 176422 - RNA, 64 nt, Homo Sapiens; identical to SEQ ID NO: 78970

SEQ ID NO: 176423 - RNA, 64 nt, Homo Sapiens; identical to SEQ ID NO: 78971

SEQ ID NO: 176424 - RNA, 64 nt, Homo Sapiens; identical to SEQ ID NO: 78972

SEQ ID NO: 176425 - RNA, 64 nt, Homo Sapiens; identical to SEQ ID NO: 78973

SEQ ID NO: 176426 - RNA, 64 nt, Homo Sapiens; identical to SEQ ID NO: 78974

SEQ ID NO: 176427 - RNA, 64 nt, Homo Sapiens; identical to SEQ ID NO: 78975

SEQ ID NO: 176428 - RNA, 64 nt, Homo Sapiens; identical to SEQ ID NO: 78976

SEQ ID NO: 176429 - RNA, 64 nt, Homo Sapiens; identical to SEQ ID NO: 78977

SEQ ID NO: 176430 - RNA, 64 nt, Homo Sapiens; identical to SEQ ID NO: 78978

SEQ ID NO: 176431 - RNA, 64 nt, Homo Sapiens; identical to SEQ ID NO: 78979

SEQ ID NO: 176432 - RNA, 64 nt, Homo Sapiens; identical to SEQ ID NO: 78980

SEQ ID NO: 176433 - RNA, 64 nt, Homo Sapiens; identical to SEQ ID NO: 78981

SEQ ID NO: 176434 - RNA, 64 nt, Homo Sapiens; identical to SEQ ID NO: 78982

SEQ ID NO: 176435 - RNA, 64 nt, Homo Sapiens; identical to SEQ ID NO: 78983

SEQ ID NO: 176436 - RNA, 64 nt, Homo Sapiens; identical to SEQ ID NO: 78984

SEQ ID NO: 176437 - RNA, 64 nt, Homo Sapiens; identical to SEQ ID NO: 78985

SEQ ID NO: 176438 - RNA, 64 nt, Homo Sapiens; identical to SEQ ID NO: 78986

SEQ ID NO: 176439 - RNA, 64 nt, Homo Sapiens; identical to SEQ ID NO: 78987

SEQ ID NO: 176440 - RNA, 64 nt, Homo Sapiens; identical to SEQ ID NO: 78988

SEQ ID NO: 176441 - RNA, 64 nt, Homo Sapiens; identical to SEQ ID NO: 78989

SEQ ID NO: 176442 - RNA, 64 nt, Homo Sapiens; identical to SEQ ID NO: 78990

SEQ ID NO: 176443 - RNA, 64 nt, Homo Sapiens; identical to SEQ ID NO: 78991

SEQ ID NO: 176444 - RNA, 64 nt, Homo Sapiens; identical to SEQ ID NO: 78992

SEQ ID NO: 176445 - RNA, 64 nt, Homo Sapiens; identical to SEQ ID NO: 78993

SEQ ID NO: 176446 - RNA, 64 nt, Homo Sapiens; identical to SEQ ID NO: 78994

SEQ ID NO: 176447 - RNA, 64 nt, Homo Sapiens; identical to SEQ ID NO: 78995

SEQ ID NO: 176448 - RNA, 64 nt, Homo Sapiens; identical to SEQ ID NO: 78996

SEQ ID NO: 176449 - RNA, 64 nt, Homo Sapiens; identical to SEQ ID NO: 78997

SEQ ID NO: 176450 - RNA, 64 nt, Homo Sapiens; identical to SEQ ID NO: 78998

SEQ ID NO: 176451 - RNA, 64 nt, Homo Sapiens; identical to SEQ ID NO: 78999

SEQ ID NO: 176452 - RNA, 64 nt, Homo Sapiens; identical to SEQ ID NO: 79000

SEQ ID NO: 176453 - RNA, 64 nt, Homo Sapiens; identical to SEQ ID NO: 79001

SEQ ID NO: 176454 - RNA, 64 nt, Homo Sapiens; identical to SEQ ID NO: 79002

SEQ ID NO: 176455 - RNA, 64 nt, Homo Sapiens; identical to SEQ ID NO: 79003

SEQ ID NO: 176456 - RNA, 64 nt, Homo Sapiens; identical to SEQ ID NO: 79004

SEQ ID NO: 176457 - RNA, 64 nt, Homo Sapiens; identical to SEQ ID NO: 79005

SEQ ID NO: 176458 - RNA, 64 nt, Homo Sapiens; identical to SEQ ID NO: 79006

SEQ ID NO: 176459 - RNA, 64 nt, Homo Sapiens; identical to SEQ ID NO: 79007

SEQ ID NO: 176460 - RNA, 64 nt, Homo Sapiens; identical to SEQ ID NO: 79008

SEQ ID NO: 176461 - RNA, 64 nt, Homo Sapiens; identical to SEQ ID NO: 79009

SEQ ID NO: 176462 - RNA, 64 nt, Homo Sapiens; identical to SEQ ID NO: 79010

SEQ ID NO: 176463 - RNA, 64 nt, Homo Sapiens; identical to SEQ ID NO: 79011

SEQ ID NO: 176464 - RNA, 64 nt, Homo Sapiens; identical to SEQ ID NO: 79012

SEQ ID NO: 176465 - RNA, 64 nt, Homo Sapiens; identical to SEQ ID NO: 79013

SEQ ID NO: 176466 - RNA, 64 nt, Homo Sapiens; identical to SEQ ID NO: 79014

SEQ ID NO: 176467 - RNA, 64 nt, Homo Sapiens; identical to SEQ ID NO: 79015

SEQ ID NO: 176468 - RNA, 64 nt, Homo Sapiens; identical to SEQ ID NO: 79016

SEQ ID NO: 176469 - RNA, 64 nt, Homo Sapiens; identical to SEQ ID NO: 79017

SEQ ID NO: 176470 - RNA, 64 nt, Homo Sapiens; identical to SEQ ID NO: 79018

SEQ ID NO: 176471 - RNA, 64 nt, Homo Sapiens; identical to SEQ ID NO: 79019

SEQ ID NO: 176472 - RNA, 64 nt, Homo Sapiens; identical to SEQ ID NO: 79020

SEQ ID NO: 176473 - RNA, 64 nt, Homo Sapiens; identical to SEQ ID NO: 79021

SEQ ID NO: 176474 - RNA, 64 nt, Homo Sapiens; identical to SEQ ID NO: 79022

SEQ ID NO: 176475 - RNA, 64 nt, Homo Sapiens; identical to SEQ ID NO: 79023

SEQ ID NO: 176476 - RNA, 64 nt, Homo Sapiens; identical to SEQ ID NO: 79024

SEQ ID NO: 176477 - RNA, 64 nt, Homo Sapiens; identical to SEQ ID NO: 79025

SEQ ID NO: 176478 - RNA, 64 nt, Homo Sapiens; identical to SEQ ID NO: 79026

SEQ ID NO: 176479 - RNA, 64 nt, Homo Sapiens; identical to SEQ ID NO: 79027

SEQ ID NO: 176480 - RNA, 64 nt, Homo Sapiens; identical to SEQ ID NO: 79028

SEQ ID NO: 176481 - RNA, 64 nt, Homo Sapiens; identical to SEQ ID NO: 79029

SEQ ID NO: 176482 - RNA, 64 nt, Homo Sapiens; identical to SEQ ID NO: 79030

SEQ ID NO: 176483 - RNA, 64 nt, Homo Sapiens; identical to SEQ ID NO: 79031

SEQ ID NO: 176484 - RNA, 64 nt, Homo Sapiens; identical to SEQ ID NO: 79032

SEQ ID NO: 176485 - RNA, 64 nt, Homo Sapiens; identical to SEQ ID NO: 79033

SEQ ID NO: 176486 - RNA, 64 nt, Homo Sapiens; identical to SEQ ID NO: 79034

SEQ ID NO: 176487 - RNA, 64 nt, Homo Sapiens; identical to SEQ ID NO: 79035

SEQ ID NO: 176488 - RNA, 64 nt, Homo Sapiens; identical to SEQ ID NO: 79036

SEQ ID NO: 176489 - RNA, 64 nt, Homo Sapiens; identical to SEQ ID NO: 79037

SEQ ID NO: 176490 - RNA, 64 nt, Homo Sapiens; identical to SEQ ID NO: 79038

SEQ ID NO: 176491 - RNA, 64 nt, Homo Sapiens; identical to SEQ ID NO: 79039

SEQ ID NO: 176492 - RNA, 64 nt, Homo Sapiens; identical to SEQ ID NO: 79040

SEQ ID NO: 176493 - RNA, 64 nt, Homo Sapiens; identical to SEQ ID NO: 79041

SEQ ID NO: 176494 - RNA, 64 nt, Homo Sapiens; identical to SEQ ID NO: 79042

SEQ ID NO: 176495 - RNA, 64 nt, Homo Sapiens; identical to SEQ ID NO: 79043

SEQ ID NO: 176496 - RNA, 64 nt, Homo Sapiens; identical to SEQ ID NO: 79044

SEQ ID NO: 176497 - RNA, 64 nt, Homo Sapiens; identical to SEQ ID NO: 79045

SEQ ID NO: 176498 - RNA, 64 nt, Homo Sapiens; identical to SEQ ID NO: 79046

SEQ ID NO: 176499 - RNA, 64 nt, Homo Sapiens; identical to SEQ ID NO: 79047

SEQ ID NO: 176500 - RNA, 64 nt, Homo Sapiens; identical to SEQ ID NO: 79048

SEQ ID NO: 176501 - RNA, 64 nt, Homo Sapiens; identical to SEQ ID NO: 79049

SEQ ID NO: 176502 - RNA, 64 nt, Homo Sapiens; identical to SEQ ID NO: 79050

SEQ ID NO: 176503 - RNA, 64 nt, Homo Sapiens; identical to SEQ ID NO: 172495

SEQ ID NO: 176504 - RNA, 64 nt, Homo Sapiens; identical to SEQ ID NO: 172496

SEQ ID NO: 176505 - RNA, 64 nt, Homo Sapiens; identical to SEQ ID NO: 78937

SEQ ID NO: 176506 - RNA, 64 nt, Homo Sapiens; identical to SEQ ID NO: 78938

SEQ ID NO: 176507 - RNA, 64 nt, Homo Sapiens; identical to SEQ ID NO: 78939

SEQ ID NO: 176508 - RNA, 64 nt, Homo Sapiens; identical to SEQ ID NO: 78940

SEQ ID NO: 176509 - RNA, 64 nt, Homo Sapiens; identical to SEQ ID NO: 78941

SEQ ID NO: 176510 - RNA, 64 nt, Homo Sapiens; identical to SEQ ID NO: 78942

SEQ ID NO: 176511 - RNA, 64 nt, Homo Sapiens; identical to SEQ ID NO: 78943

SEQ ID NO: 176512 - RNA, 64 nt, Homo Sapiens; identical to SEQ ID NO: 78944

SEQ ID NO: 176513 - RNA, 64 nt, Homo Sapiens; identical to SEQ ID NO: 78945

SEQ ID NO: 176514 - RNA, 64 nt, Homo Sapiens; identical to SEQ ID NO: 78946

SEQ ID NO: 176515 - RNA, 64 nt, Homo Sapiens; identical to SEQ ID NO: 78947

SEQ ID NO: 176516 - RNA, 64 nt, Homo Sapiens; identical to SEQ ID NO: 78948

SEQ ID NO: 176517 - RNA, 64 nt, Homo Sapiens; identical to SEQ ID NO: 78949

SEQ ID NO: 176518 - RNA, 64 nt, Homo Sapiens; identical to SEQ ID NO: 78950

SEQ ID NO: 176519 - RNA, 64 nt, Homo Sapiens; identical to SEQ ID NO: 78951

SEQ ID NO: 176520 - RNA, 64 nt, Homo Sapiens; identical to SEQ ID NO: 78952

SEQ ID NO: 176521 - RNA, 64 nt, Homo Sapiens; identical to SEQ ID NO: 78953

SEQ ID NO: 176522 - RNA, 64 nt, Homo Sapiens; identical to SEQ ID NO: 78954

SEQ ID NO: 176523 - RNA, 64 nt, Homo Sapiens; identical to SEQ ID NO: 78955

SEQ ID NO: 176524 - RNA, 64 nt, Homo Sapiens; identical to SEQ ID NO: 78956

SEQ ID NO: 176525 - RNA, 64 nt, Homo Sapiens; identical to SEQ ID NO: 78957

SEQ ID NO: 176526 - RNA, 64 nt, Homo Sapiens; identical to SEQ ID NO: 78958

SEQ ID NO: 176527 - RNA, 64 nt, Homo Sapiens; identical to SEQ ID NO: 78959

SEQ ID NO: 176528 - RNA, 64 nt, Homo Sapiens; identical to SEQ ID NO: 78960

SEQ ID NO: 176529 - RNA, 64 nt, Homo Sapiens; identical to SEQ ID NO: 78961

SEQ ID NO: 176530 - RNA, 64 nt, Homo Sapiens; identical to SEQ ID NO: 78962

SEQ ID NO: 176531 - RNA, 64 nt, Homo Sapiens; identical to SEQ ID NO: 78963

SEQ ID NO: 176532 - RNA, 64 nt, Homo Sapiens; identical to SEQ ID NO: 78964

SEQ ID NO: 176533 - RNA, 64 nt, Homo Sapiens; identical to SEQ ID NO: 78965

SEQ ID NO: 176534 - RNA, 64 nt, Homo Sapiens; identical to SEQ ID NO: 78966

SEQ ID NO: 176535 - RNA, 64 nt, Homo Sapiens; identical to SEQ ID NO: 78967

SEQ ID NO: 176536 - RNA, 64 nt, Homo Sapiens; identical to SEQ ID NO: 78968

SEQ ID NO: 176537 - RNA, 64 nt, Homo Sapiens; identical to SEQ ID NO: 78969

SEQ ID NO: 176538 - RNA, 64 nt, Homo Sapiens; identical to SEQ ID NO: 78970

SEQ ID NO: 176539 - RNA, 64 nt, Homo Sapiens; identical to SEQ ID NO: 78971

SEQ ID NO: 176540 - RNA, 64 nt, Homo Sapiens; identical to SEQ ID NO: 78972

SEQ ID NO: 176541 - RNA, 64 nt, Homo Sapiens; identical to SEQ ID NO: 78973

SEQ ID NO: 176542 - RNA, 64 nt, Homo Sapiens; identical to SEQ ID NO: 78974

SEQ ID NO: 176543 - RNA, 64 nt, Homo Sapiens; identical to SEQ ID NO: 78975

SEQ ID NO: 176544 - RNA, 64 nt, Homo Sapiens; identical to SEQ ID NO: 78976

SEQ ID NO: 176545 - RNA, 64 nt, Homo Sapiens; identical to SEQ ID NO: 78977

SEQ ID NO: 176546 - RNA, 64 nt, Homo Sapiens; identical to SEQ ID NO: 78978

SEQ ID NO: 176547 - RNA, 64 nt, Homo Sapiens; identical to SEQ ID NO: 78979

SEQ ID NO: 176548 - RNA, 64 nt, Homo Sapiens; identical to SEQ ID NO: 78980

SEQ ID NO: 176549 - RNA, 64 nt, Homo Sapiens; identical to SEQ ID NO: 78981

SEQ ID NO: 176550 - RNA, 64 nt, Homo Sapiens; identical to SEQ ID NO: 78982

SEQ ID NO: 176551 - RNA, 64 nt, Homo Sapiens; identical to SEQ ID NO: 78983

SEQ ID NO: 176552 - RNA, 64 nt, Homo Sapiens; identical to SEQ ID NO: 78984

SEQ ID NO: 176553 - RNA, 64 nt, Homo Sapiens; identical to SEQ ID NO: 78985

SEQ ID NO: 176554 - RNA, 64 nt, Homo Sapiens; identical to SEQ ID NO: 78986

SEQ ID NO: 176555 - RNA, 64 nt, Homo Sapiens; identical to SEQ ID NO: 78987

SEQ ID NO: 176556 - RNA, 64 nt, Homo Sapiens; identical to SEQ ID NO: 78988

SEQ ID NO: 176557 - RNA, 64 nt, Homo Sapiens; identical to SEQ ID NO: 78989

SEQ ID NO: 176558 - RNA, 64 nt, Homo Sapiens; identical to SEQ ID NO: 78990

SEQ ID NO: 176559 - RNA, 64 nt, Homo Sapiens; identical to SEQ ID NO: 78991

SEQ ID NO: 176560 - RNA, 64 nt, Homo Sapiens; identical to SEQ ID NO: 78992

SEQ ID NO: 176561 - RNA, 64 nt, Homo Sapiens; identical to SEQ ID NO: 78993

SEQ ID NO: 176562 - RNA, 64 nt, Homo Sapiens; identical to SEQ ID NO: 78994

SEQ ID NO: 176563 - RNA, 64 nt, Homo Sapiens; identical to SEQ ID NO: 78995

SEQ ID NO: 176564 - RNA, 64 nt, Homo Sapiens; identical to SEQ ID NO: 78996

SEQ ID NO: 176565 - RNA, 64 nt, Homo Sapiens; identical to SEQ ID NO: 78997

SEQ ID NO: 176566 - RNA, 64 nt, Homo Sapiens; identical to SEQ ID NO: 78998

SEQ ID NO: 176567 - RNA, 64 nt, Homo Sapiens; identical to SEQ ID NO: 78999

SEQ ID NO: 176568 - RNA, 64 nt, Homo Sapiens; identical to SEQ ID NO: 79000

SEQ ID NO: 176569 - RNA, 64 nt, Homo Sapiens; identical to SEQ ID NO: 79001

SEQ ID NO: 176570 - RNA, 64 nt, Homo Sapiens; identical to SEQ ID NO: 79002

SEQ ID NO: 176571 - RNA, 64 nt, Homo Sapiens; identical to SEQ ID NO: 79003

SEQ ID NO: 176572 - RNA, 64 nt, Homo Sapiens; identical to SEQ ID NO: 79004

SEQ ID NO: 176573 - RNA, 64 nt, Homo Sapiens; identical to SEQ ID NO: 79005

SEQ ID NO: 176574 - RNA, 64 nt, Homo Sapiens; identical to SEQ ID NO: 79006

SEQ ID NO: 176575 - RNA, 64 nt, Homo Sapiens; identical to SEQ ID NO: 79007

SEQ ID NO: 176576 - RNA, 64 nt, Homo Sapiens; identical to SEQ ID NO: 79008

SEQ ID NO: 176577 - RNA, 64 nt, Homo Sapiens; identical to SEQ ID NO: 79009

SEQ ID NO: 176578 - RNA, 64 nt, Homo Sapiens; identical to SEQ ID NO: 79010

SEQ ID NO: 176579 - RNA, 64 nt, Homo Sapiens; identical to SEQ ID NO: 79011

SEQ ID NO: 176580 - RNA, 64 nt, Homo Sapiens; identical to SEQ ID NO: 79012

SEQ ID NO: 176581 - RNA, 64 nt, Homo Sapiens; identical to SEQ ID NO: 79013

SEQ ID NO: 176582 - RNA, 64 nt, Homo Sapiens; identical to SEQ ID NO: 79014

SEQ ID NO: 176583 - RNA, 64 nt, Homo Sapiens; identical to SEQ ID NO: 79015

SEQ ID NO: 176584 - RNA, 64 nt, Homo Sapiens; identical to SEQ ID NO: 79016

SEQ ID NO: 176585 - RNA, 64 nt, Homo Sapiens; identical to SEQ ID NO: 79017

SEQ ID NO: 176586 - RNA, 64 nt, Homo Sapiens; identical to SEQ ID NO: 79018

SEQ ID NO: 176587 - RNA, 64 nt, Homo Sapiens; identical to SEQ ID NO: 79019

SEQ ID NO: 176588 - RNA, 64 nt, Homo Sapiens; identical to SEQ ID NO: 79020

SEQ ID NO: 176589 - RNA, 64 nt, Homo Sapiens; identical to SEQ ID NO: 79021

SEQ ID NO: 176590 - RNA, 64 nt, Homo Sapiens; identical to SEQ ID NO: 79022

SEQ ID NO: 176591 - RNA, 64 nt, Homo Sapiens; identical to SEQ ID NO: 79023

SEQ ID NO: 176592 - RNA, 64 nt, Homo Sapiens; identical to SEQ ID NO: 79024

SEQ ID NO: 176593 - RNA, 64 nt, Homo Sapiens; identical to SEQ ID NO: 79025

SEQ ID NO: 176594 - RNA, 64 nt, Homo Sapiens; identical to SEQ ID NO: 79026

SEQ ID NO: 176595 - RNA, 64 nt, Homo Sapiens; identical to SEQ ID NO: 79027

SEQ ID NO: 176596 - RNA, 64 nt, Homo Sapiens; identical to SEQ ID NO: 79028

SEQ ID NO: 176597 - RNA, 64 nt, Homo Sapiens; identical to SEQ ID NO: 79029

SEQ ID NO: 176598 - RNA, 64 nt, Homo Sapiens; identical to SEQ ID NO: 79030

SEQ ID NO: 176599 - RNA, 64 nt, Homo Sapiens; identical to SEQ ID NO: 79031

SEQ ID NO: 176600 - RNA, 64 nt, Homo Sapiens; identical to SEQ ID NO: 79032

SEQ ID NO: 176601 - RNA, 64 nt, Homo Sapiens; identical to SEQ ID NO: 79033

SEQ ID NO: 176602 - RNA, 64 nt, Homo Sapiens; identical to SEQ ID NO: 79034

SEQ ID NO: 176603 - RNA, 64 nt, Homo Sapiens; identical to SEQ ID NO: 79035

SEQ ID NO: 176604 - RNA, 64 nt, Homo Sapiens; identical to SEQ ID NO: 79036

SEQ ID NO: 176605 - RNA, 64 nt, Homo Sapiens; identical to SEQ ID NO: 79037

SEQ ID NO: 176606 - RNA, 64 nt, Homo Sapiens; identical to SEQ ID NO: 79038

SEQ ID NO: 176607 - RNA, 64 nt, Homo Sapiens; identical to SEQ ID NO: 79039

SEQ ID NO: 176608 - RNA, 64 nt, Homo Sapiens; identical to SEQ ID NO: 79040

SEQ ID NO: 176609 - RNA, 64 nt, Homo Sapiens; identical to SEQ ID NO: 79041

SEQ ID NO: 176610 - RNA, 64 nt, Homo Sapiens; identical to SEQ ID NO: 79042

SEQ ID NO: 176611 - RNA, 64 nt, Homo Sapiens; identical to SEQ ID NO: 79043

SEQ ID NO: 176612 - RNA, 64 nt, Homo Sapiens; identical to SEQ ID NO: 79044

SEQ ID NO: 176613 - RNA, 64 nt, Homo Sapiens; identical to SEQ ID NO: 79045

SEQ ID NO: 176614 - RNA, 64 nt, Homo Sapiens; identical to SEQ ID NO: 79046

SEQ ID NO: 176615 - RNA, 64 nt, Homo Sapiens; identical to SEQ ID NO: 79047

SEQ ID NO: 176616 - RNA, 64 nt, Homo Sapiens; identical to SEQ ID NO: 79048

SEQ ID NO: 176617 - RNA, 64 nt, Homo Sapiens; identical to SEQ ID NO: 79049

SEQ ID NO: 176618 - RNA, 64 nt, Homo Sapiens; identical to SEQ ID NO: 79050

SEQ ID NO: 176619 - RNA, 64 nt, Homo Sapiens; identical to SEQ ID NO: 172495

SEQ ID NO: 176620 - RNA, 64 nt, Homo Sapiens; identical to SEQ ID NO: 172496

SEQ ID NO: 176621 - RNA, 64 nt, Homo Sapiens; identical to SEQ ID NO: 78937

SEQ ID NO: 176622 - RNA, 64 nt, Homo Sapiens; identical to SEQ ID NO: 78938

SEQ ID NO: 176623 - RNA, 64 nt, Homo Sapiens; identical to SEQ ID NO: 78939

SEQ ID NO: 176624 - RNA, 64 nt, Homo Sapiens; identical to SEQ ID NO: 78940

SEQ ID NO: 176625 - RNA, 64 nt, Homo Sapiens; identical to SEQ ID NO: 78941

SEQ ID NO: 176626 - RNA, 64 nt, Homo Sapiens; identical to SEQ ID NO: 78942

SEQ ID NO: 176627 - RNA, 64 nt, Homo Sapiens; identical to SEQ ID NO: 78943

SEQ ID NO: 176628 - RNA, 64 nt, Homo Sapiens; identical to SEQ ID NO: 78944

SEQ ID NO: 176629 - RNA, 64 nt, Homo Sapiens; identical to SEQ ID NO: 78945

SEQ ID NO: 176630 - RNA, 64 nt, Homo Sapiens; identical to SEQ ID NO: 78946

SEQ ID NO: 176631 - RNA, 64 nt, Homo Sapiens; identical to SEQ ID NO: 78947

SEQ ID NO: 176632 - RNA, 64 nt, Homo Sapiens; identical to SEQ ID NO: 78948

SEQ ID NO: 176633 - RNA, 64 nt, Homo Sapiens; identical to SEQ ID NO: 78949

SEQ ID NO: 176634 - RNA, 64 nt, Homo Sapiens; identical to SEQ ID NO: 78950

SEQ ID NO: 176635 - RNA, 64 nt, Homo Sapiens; identical to SEQ ID NO: 78951

SEQ ID NO: 176636 - RNA, 64 nt, Homo Sapiens; identical to SEQ ID NO: 78952

SEQ ID NO: 176637 - RNA, 64 nt, Homo Sapiens; identical to SEQ ID NO: 78953

SEQ ID NO: 176638 - RNA, 64 nt, Homo Sapiens; identical to SEQ ID NO: 78954

SEQ ID NO: 176639 - RNA, 64 nt, Homo Sapiens; identical to SEQ ID NO: 78955

SEQ ID NO: 176640 - RNA, 64 nt, Homo Sapiens; identical to SEQ ID NO: 78956

SEQ ID NO: 176641 - RNA, 64 nt, Homo Sapiens; identical to SEQ ID NO: 78957

SEQ ID NO: 176642 - RNA, 64 nt, Homo Sapiens; identical to SEQ ID NO: 78958

SEQ ID NO: 176643 - RNA, 64 nt, Homo Sapiens; identical to SEQ ID NO: 78959

SEQ ID NO: 176644 - RNA, 64 nt, Homo Sapiens; identical to SEQ ID NO: 78960

SEQ ID NO: 176645 - RNA, 64 nt, Homo Sapiens; identical to SEQ ID NO: 78961

SEQ ID NO: 176646 - RNA, 64 nt, Homo Sapiens; identical to SEQ ID NO: 78962

SEQ ID NO: 176647 - RNA, 64 nt, Homo Sapiens; identical to SEQ ID NO: 78963

SEQ ID NO: 176648 - RNA, 64 nt, Homo Sapiens; identical to SEQ ID NO: 78964

SEQ ID NO: 176649 - RNA, 64 nt, Homo Sapiens; identical to SEQ ID NO: 78965

SEQ ID NO: 176650 - RNA, 64 nt, Homo Sapiens; identical to SEQ ID NO: 78966

SEQ ID NO: 176651 - RNA, 64 nt, Homo Sapiens; identical to SEQ ID NO: 78967

SEQ ID NO: 176652 - RNA, 64 nt, Homo Sapiens; identical to SEQ ID NO: 78968

SEQ ID NO: 176653 - RNA, 64 nt, Homo Sapiens; identical to SEQ ID NO: 78969

SEQ ID NO: 176654 - RNA, 64 nt, Homo Sapiens; identical to SEQ ID NO: 78970

SEQ ID NO: 176655 - RNA, 64 nt, Homo Sapiens; identical to SEQ ID NO: 78971

SEQ ID NO: 176656 - RNA, 64 nt, Homo Sapiens; identical to SEQ ID NO: 78972

SEQ ID NO: 176657 - RNA, 64 nt, Homo Sapiens; identical to SEQ ID NO: 78973

SEQ ID NO: 176658 - RNA, 64 nt, Homo Sapiens; identical to SEQ ID NO: 78974

SEQ ID NO: 176659 - RNA, 64 nt, Homo Sapiens; identical to SEQ ID NO: 78975

SEQ ID NO: 176660 - RNA, 64 nt, Homo Sapiens; identical to SEQ ID NO: 78976

SEQ ID NO: 176661 - RNA, 64 nt, Homo Sapiens; identical to SEQ ID NO: 78977

SEQ ID NO: 176662 - RNA, 64 nt, Homo Sapiens; identical to SEQ ID NO: 78978

SEQ ID NO: 176663 - RNA, 64 nt, Homo Sapiens; identical to SEQ ID NO: 78979

SEQ ID NO: 176664 - RNA, 64 nt, Homo Sapiens; identical to SEQ ID NO: 78980

SEQ ID NO: 176665 - RNA, 64 nt, Homo Sapiens; identical to SEQ ID NO: 78981

SEQ ID NO: 176666 - RNA, 64 nt, Homo Sapiens; identical to SEQ ID NO: 78982

SEQ ID NO: 176667 - RNA, 64 nt, Homo Sapiens; identical to SEQ ID NO: 78983

SEQ ID NO: 176668 - RNA, 64 nt, Homo Sapiens; identical to SEQ ID NO: 78984

SEQ ID NO: 176669 - RNA, 64 nt, Homo Sapiens; identical to SEQ ID NO: 78985

SEQ ID NO: 176670 - RNA, 64 nt, Homo Sapiens; identical to SEQ ID NO: 78986

SEQ ID NO: 176671 - RNA, 64 nt, Homo Sapiens; identical to SEQ ID NO: 78987

SEQ ID NO: 176672 - RNA, 64 nt, Homo Sapiens; identical to SEQ ID NO: 78988

SEQ ID NO: 176673 - RNA, 64 nt, Homo Sapiens; identical to SEQ ID NO: 78989

SEQ ID NO: 176674 - RNA, 64 nt, Homo Sapiens; identical to SEQ ID NO: 78990

SEQ ID NO: 176675 - RNA, 64 nt, Homo Sapiens; identical to SEQ ID NO: 78991

SEQ ID NO: 176676 - RNA, 64 nt, Homo Sapiens; identical to SEQ ID NO: 78992

SEQ ID NO: 176677 - RNA, 64 nt, Homo Sapiens; identical to SEQ ID NO: 78993

SEQ ID NO: 176678 - RNA, 64 nt, Homo Sapiens; identical to SEQ ID NO: 78994

SEQ ID NO: 176679 - RNA, 64 nt, Homo Sapiens; identical to SEQ ID NO: 78995

SEQ ID NO: 176680 - RNA, 64 nt, Homo Sapiens; identical to SEQ ID NO: 78996

SEQ ID NO: 176681 - RNA, 64 nt, Homo Sapiens; identical to SEQ ID NO: 78997

SEQ ID NO: 176682 - RNA, 64 nt, Homo Sapiens; identical to SEQ ID NO: 78998

SEQ ID NO: 176683 - RNA, 64 nt, Homo Sapiens; identical to SEQ ID NO: 78999

SEQ ID NO: 176684 - RNA, 64 nt, Homo Sapiens; identical to SEQ ID NO: 79000

SEQ ID NO: 176685 - RNA, 64 nt, Homo Sapiens; identical to SEQ ID NO: 79001

SEQ ID NO: 176686 - RNA, 64 nt, Homo Sapiens; identical to SEQ ID NO: 79002

SEQ ID NO: 176687 - RNA, 64 nt, Homo Sapiens; identical to SEQ ID NO: 79003

SEQ ID NO: 176688 - RNA, 64 nt, Homo Sapiens; identical to SEQ ID NO: 79004

SEQ ID NO: 176689 - RNA, 64 nt, Homo Sapiens; identical to SEQ ID NO: 79005

SEQ ID NO: 176690 - RNA, 64 nt, Homo Sapiens; identical to SEQ ID NO: 79006

SEQ ID NO: 176691 - RNA, 64 nt, Homo Sapiens; identical to SEQ ID NO: 79007

SEQ ID NO: 176692 - RNA, 64 nt, Homo Sapiens; identical to SEQ ID NO: 79008

SEQ ID NO: 176693 - RNA, 64 nt, Homo Sapiens; identical to SEQ ID NO: 79009

SEQ ID NO: 176694 - RNA, 64 nt, Homo Sapiens; identical to SEQ ID NO: 79010

SEQ ID NO: 176695 - RNA, 64 nt, Homo Sapiens; identical to SEQ ID NO: 79011

SEQ ID NO: 176696 - RNA, 64 nt, Homo Sapiens; identical to SEQ ID NO: 79012

SEQ ID NO: 176697 - RNA, 64 nt, Homo Sapiens; identical to SEQ ID NO: 79013

SEQ ID NO: 176698 - RNA, 64 nt, Homo Sapiens; identical to SEQ ID NO: 79014

SEQ ID NO: 176699 - RNA, 64 nt, Homo Sapiens; identical to SEQ ID NO: 79015

SEQ ID NO: 176700 - RNA, 64 nt, Homo Sapiens; identical to SEQ ID NO: 79016

SEQ ID NO: 176701 - RNA, 64 nt, Homo Sapiens; identical to SEQ ID NO: 79017

SEQ ID NO: 176702 - RNA, 64 nt, Homo Sapiens; identical to SEQ ID NO: 79018

SEQ ID NO: 176703 - RNA, 64 nt, Homo Sapiens; identical to SEQ ID NO: 79019

SEQ ID NO: 176704 - RNA, 64 nt, Homo Sapiens; identical to SEQ ID NO: 79020

SEQ ID NO: 176705 - RNA, 64 nt, Homo Sapiens; identical to SEQ ID NO: 79021

SEQ ID NO: 176706 - RNA, 64 nt, Homo Sapiens; identical to SEQ ID NO: 79022

SEQ ID NO: 176707 - RNA, 64 nt, Homo Sapiens; identical to SEQ ID NO: 79023

SEQ ID NO: 176708 - RNA, 64 nt, Homo Sapiens; identical to SEQ ID NO: 79024

SEQ ID NO: 176709 - RNA, 64 nt, Homo Sapiens; identical to SEQ ID NO: 79025

SEQ ID NO: 176710 - RNA, 64 nt, Homo Sapiens; identical to SEQ ID NO: 79026

SEQ ID NO: 176711 - RNA, 64 nt, Homo Sapiens; identical to SEQ ID NO: 79027

SEQ ID NO: 176712 - RNA, 64 nt, Homo Sapiens; identical to SEQ ID NO: 79028

SEQ ID NO: 176713 - RNA, 64 nt, Homo Sapiens; identical to SEQ ID NO: 79029

SEQ ID NO: 176714 - RNA, 64 nt, Homo Sapiens; identical to SEQ ID NO: 79030

SEQ ID NO: 176715 - RNA, 64 nt, Homo Sapiens; identical to SEQ ID NO: 79031

SEQ ID NO: 176716 - RNA, 64 nt, Homo Sapiens; identical to SEQ ID NO: 79032

SEQ ID NO: 176717 - RNA, 64 nt, Homo Sapiens; identical to SEQ ID NO: 79033

SEQ ID NO: 176718 - RNA, 64 nt, Homo Sapiens; identical to SEQ ID NO: 79034

SEQ ID NO: 176719 - RNA, 64 nt, Homo Sapiens; identical to SEQ ID NO: 79035

SEQ ID NO: 176720 - RNA, 64 nt, Homo Sapiens; identical to SEQ ID NO: 79036

SEQ ID NO: 176721 - RNA, 64 nt, Homo Sapiens; identical to SEQ ID NO: 79037

SEQ ID NO: 176722 - RNA, 64 nt, Homo Sapiens; identical to SEQ ID NO: 79038

SEQ ID NO: 176723 - RNA, 64 nt, Homo Sapiens; identical to SEQ ID NO: 79039

SEQ ID NO: 176724 - RNA, 64 nt, Homo Sapiens; identical to SEQ ID NO: 79040

SEQ ID NO: 176725 - RNA, 64 nt, Homo Sapiens; identical to SEQ ID NO: 79041

SEQ ID NO: 176726 - RNA, 64 nt, Homo Sapiens; identical to SEQ ID NO: 79042

SEQ ID NO: 176727 - RNA, 64 nt, Homo Sapiens; identical to SEQ ID NO: 79043

SEQ ID NO: 176728 - RNA, 64 nt, Homo Sapiens; identical to SEQ ID NO: 79044

SEQ ID NO: 176729 - RNA, 64 nt, Homo Sapiens; identical to SEQ ID NO: 79045

SEQ ID NO: 176730 - RNA, 64 nt, Homo Sapiens; identical to SEQ ID NO: 79046

SEQ ID NO: 176731 - RNA, 64 nt, Homo Sapiens; identical to SEQ ID NO: 79047

SEQ ID NO: 176732 - RNA, 64 nt, Homo Sapiens; identical to SEQ ID NO: 79048

SEQ ID NO: 176733 - RNA, 64 nt, Homo Sapiens; identical to SEQ ID NO: 79049

SEQ ID NO: 176734 - RNA, 64 nt, Homo Sapiens; identical to SEQ ID NO: 79050

SEQ ID NO: 176735 - RNA, 64 nt, Homo Sapiens; identical to SEQ ID NO: 172495

SEQ ID NO: 176736 - RNA, 64 nt, Homo Sapiens; identical to SEQ ID NO: 172496

SEQ ID NO: 176737 - RNA, 64 nt, Homo Sapiens; identical to SEQ ID NO: 78937

SEQ ID NO: 176738 - RNA, 64 nt, Homo Sapiens; identical to SEQ ID NO: 78938

SEQ ID NO: 176739 - RNA, 64 nt, Homo Sapiens; identical to SEQ ID NO: 78939

SEQ ID NO: 176740 - RNA, 64 nt, Homo Sapiens; identical to SEQ ID NO: 78940

SEQ ID NO: 176741 - RNA, 64 nt, Homo Sapiens; identical to SEQ ID NO: 78941

SEQ ID NO: 176742 - RNA, 64 nt, Homo Sapiens; identical to SEQ ID NO: 78942

SEQ ID NO: 176743 - RNA, 64 nt, Homo Sapiens; identical to SEQ ID NO: 78943

SEQ ID NO: 176744 - RNA, 64 nt, Homo Sapiens; identical to SEQ ID NO: 78944

SEQ ID NO: 176745 - RNA, 64 nt, Homo Sapiens; identical to SEQ ID NO: 78945

SEQ ID NO: 176746 - RNA, 64 nt, Homo Sapiens; identical to SEQ ID NO: 78946

SEQ ID NO: 176747 - RNA, 64 nt, Homo Sapiens; identical to SEQ ID NO: 78947

SEQ ID NO: 176748 - RNA, 64 nt, Homo Sapiens; identical to SEQ ID NO: 78948

SEQ ID NO: 176749 - RNA, 64 nt, Homo Sapiens; identical to SEQ ID NO: 78949

SEQ ID NO: 176750 - RNA, 64 nt, Homo Sapiens; identical to SEQ ID NO: 78950

SEQ ID NO: 176751 - RNA, 64 nt, Homo Sapiens; identical to SEQ ID NO: 78951

SEQ ID NO: 176752 - RNA, 64 nt, Homo Sapiens; identical to SEQ ID NO: 78952

SEQ ID NO: 176753 - RNA, 64 nt, Homo Sapiens; identical to SEQ ID NO: 78953

SEQ ID NO: 176754 - RNA, 64 nt, Homo Sapiens; identical to SEQ ID NO: 78954

SEQ ID NO: 176755 - RNA, 64 nt, Homo Sapiens; identical to SEQ ID NO: 78955

SEQ ID NO: 176756 - RNA, 64 nt, Homo Sapiens; identical to SEQ ID NO: 78956

SEQ ID NO: 176757 - RNA, 64 nt, Homo Sapiens; identical to SEQ ID NO: 78957

SEQ ID NO: 176758 - RNA, 64 nt, Homo Sapiens; identical to SEQ ID NO: 78958

SEQ ID NO: 176759 - RNA, 64 nt, Homo Sapiens; identical to SEQ ID NO: 78959

SEQ ID NO: 176760 - RNA, 64 nt, Homo Sapiens; identical to SEQ ID NO: 78960

SEQ ID NO: 176761 - RNA, 64 nt, Homo Sapiens; identical to SEQ ID NO: 78961

SEQ ID NO: 176762 - RNA, 64 nt, Homo Sapiens; identical to SEQ ID NO: 78962

SEQ ID NO: 176763 - RNA, 64 nt, Homo Sapiens; identical to SEQ ID NO: 78963

SEQ ID NO: 176764 - RNA, 64 nt, Homo Sapiens; identical to SEQ ID NO: 78964

SEQ ID NO: 176765 - RNA, 64 nt, Homo Sapiens; identical to SEQ ID NO: 78965

SEQ ID NO: 176766 - RNA, 64 nt, Homo Sapiens; identical to SEQ ID NO: 78966

SEQ ID NO: 176767 - RNA, 64 nt, Homo Sapiens; identical to SEQ ID NO: 78967

SEQ ID NO: 176768 - RNA, 64 nt, Homo Sapiens; identical to SEQ ID NO: 78968

SEQ ID NO: 176769 - RNA, 64 nt, Homo Sapiens; identical to SEQ ID NO: 78969

SEQ ID NO: 176770 - RNA, 64 nt, Homo Sapiens; identical to SEQ ID NO: 78970

SEQ ID NO: 176771 - RNA, 64 nt, Homo Sapiens; identical to SEQ ID NO: 78971

SEQ ID NO: 176772 - RNA, 64 nt, Homo Sapiens; identical to SEQ ID NO: 78972

SEQ ID NO: 176773 - RNA, 64 nt, Homo Sapiens; identical to SEQ ID NO: 78973

SEQ ID NO: 176774 - RNA, 64 nt, Homo Sapiens; identical to SEQ ID NO: 78974

SEQ ID NO: 176775 - RNA, 64 nt, Homo Sapiens; identical to SEQ ID NO: 78975

SEQ ID NO: 176776 - RNA, 64 nt, Homo Sapiens; identical to SEQ ID NO: 78976

SEQ ID NO: 176777 - RNA, 64 nt, Homo Sapiens; identical to SEQ ID NO: 78977

SEQ ID NO: 176778 - RNA, 64 nt, Homo Sapiens; identical to SEQ ID NO: 78978

SEQ ID NO: 176779 - RNA, 64 nt, Homo Sapiens; identical to SEQ ID NO: 78979

SEQ ID NO: 176780 - RNA, 64 nt, Homo Sapiens; identical to SEQ ID NO: 78980

SEQ ID NO: 176781 - RNA, 64 nt, Homo Sapiens; identical to SEQ ID NO: 78981

SEQ ID NO: 176782 - RNA, 64 nt, Homo Sapiens; identical to SEQ ID NO: 78982

SEQ ID NO: 176783 - RNA, 64 nt, Homo Sapiens; identical to SEQ ID NO: 78983

SEQ ID NO: 176784 - RNA, 64 nt, Homo Sapiens; identical to SEQ ID NO: 78984

SEQ ID NO: 176785 - RNA, 64 nt, Homo Sapiens; identical to SEQ ID NO: 78985

SEQ ID NO: 176786 - RNA, 64 nt, Homo Sapiens; identical to SEQ ID NO: 78986

SEQ ID NO: 176787 - RNA, 64 nt, Homo Sapiens; identical to SEQ ID NO: 78987

SEQ ID NO: 176788 - RNA, 64 nt, Homo Sapiens; identical to SEQ ID NO: 78988

SEQ ID NO: 176789 - RNA, 64 nt, Homo Sapiens; identical to SEQ ID NO: 78989

SEQ ID NO: 176790 - RNA, 64 nt, Homo Sapiens; identical to SEQ ID NO: 78990

SEQ ID NO: 176791 - RNA, 64 nt, Homo Sapiens; identical to SEQ ID NO: 78991

SEQ ID NO: 176792 - RNA, 64 nt, Homo Sapiens; identical to SEQ ID NO: 78992

SEQ ID NO: 176793 - RNA, 64 nt, Homo Sapiens; identical to SEQ ID NO: 78993

SEQ ID NO: 176794 - RNA, 64 nt, Homo Sapiens; identical to SEQ ID NO: 78994

SEQ ID NO: 176795 - RNA, 64 nt, Homo Sapiens; identical to SEQ ID NO: 78995

SEQ ID NO: 176796 - RNA, 64 nt, Homo Sapiens; identical to SEQ ID NO: 78996

SEQ ID NO: 176797 - RNA, 64 nt, Homo Sapiens; identical to SEQ ID NO: 78997

SEQ ID NO: 176798 - RNA, 64 nt, Homo Sapiens; identical to SEQ ID NO: 78998

SEQ ID NO: 176799 - RNA, 64 nt, Homo Sapiens; identical to SEQ ID NO: 78999

SEQ ID NO: 176800 - RNA, 64 nt, Homo Sapiens; identical to SEQ ID NO: 79000

SEQ ID NO: 176801 - RNA, 64 nt, Homo Sapiens; identical to SEQ ID NO: 79001

SEQ ID NO: 176802 - RNA, 64 nt, Homo Sapiens; identical to SEQ ID NO: 79002

SEQ ID NO: 176803 - RNA, 64 nt, Homo Sapiens; identical to SEQ ID NO: 79003

SEQ ID NO: 176804 - RNA, 64 nt, Homo Sapiens; identical to SEQ ID NO: 79004

SEQ ID NO: 176805 - RNA, 64 nt, Homo Sapiens; identical to SEQ ID NO: 79005

SEQ ID NO: 176806 - RNA, 64 nt, Homo Sapiens; identical to SEQ ID NO: 79006

SEQ ID NO: 176807 - RNA, 64 nt, Homo Sapiens; identical to SEQ ID NO: 79007

SEQ ID NO: 176808 - RNA, 64 nt, Homo Sapiens; identical to SEQ ID NO: 79008

SEQ ID NO: 176809 - RNA, 64 nt, Homo Sapiens; identical to SEQ ID NO: 79009

SEQ ID NO: 176810 - RNA, 64 nt, Homo Sapiens; identical to SEQ ID NO: 79010

SEQ ID NO: 176811 - RNA, 64 nt, Homo Sapiens; identical to SEQ ID NO: 79011

SEQ ID NO: 176812 - RNA, 64 nt, Homo Sapiens; identical to SEQ ID NO: 79012

SEQ ID NO: 176813 - RNA, 64 nt, Homo Sapiens; identical to SEQ ID NO: 79013

SEQ ID NO: 176814 - RNA, 64 nt, Homo Sapiens; identical to SEQ ID NO: 79014

SEQ ID NO: 176815 - RNA, 64 nt, Homo Sapiens; identical to SEQ ID NO: 79015

SEQ ID NO: 176816 - RNA, 64 nt, Homo Sapiens; identical to SEQ ID NO: 79016

SEQ ID NO: 176817 - RNA, 64 nt, Homo Sapiens; identical to SEQ ID NO: 79017

SEQ ID NO: 176818 - RNA, 64 nt, Homo Sapiens; identical to SEQ ID NO: 79018

SEQ ID NO: 176819 - RNA, 64 nt, Homo Sapiens; identical to SEQ ID NO: 79019

SEQ ID NO: 176820 - RNA, 64 nt, Homo Sapiens; identical to SEQ ID NO: 79020

SEQ ID NO: 176821 - RNA, 64 nt, Homo Sapiens; identical to SEQ ID NO: 79021

SEQ ID NO: 176822 - RNA, 64 nt, Homo Sapiens; identical to SEQ ID NO: 79022

SEQ ID NO: 176823 - RNA, 64 nt, Homo Sapiens; identical to SEQ ID NO: 79023

SEQ ID NO: 176824 - RNA, 64 nt, Homo Sapiens; identical to SEQ ID NO: 79024

SEQ ID NO: 176825 - RNA, 64 nt, Homo Sapiens; identical to SEQ ID NO: 79025

SEQ ID NO: 176826 - RNA, 64 nt, Homo Sapiens; identical to SEQ ID NO: 79026

SEQ ID NO: 176827 - RNA, 64 nt, Homo Sapiens; identical to SEQ ID NO: 79027

SEQ ID NO: 176828 - RNA, 64 nt, Homo Sapiens; identical to SEQ ID NO: 79028

SEQ ID NO: 176829 - RNA, 64 nt, Homo Sapiens; identical to SEQ ID NO: 79029

SEQ ID NO: 176830 - RNA, 64 nt, Homo Sapiens; identical to SEQ ID NO: 79030

SEQ ID NO: 176831 - RNA, 64 nt, Homo Sapiens; identical to SEQ ID NO: 79031

SEQ ID NO: 176832 - RNA, 64 nt, Homo Sapiens; identical to SEQ ID NO: 79032

SEQ ID NO: 176833 - RNA, 64 nt, Homo Sapiens; identical to SEQ ID NO: 79033

SEQ ID NO: 176834 - RNA, 64 nt, Homo Sapiens; identical to SEQ ID NO: 79034

SEQ ID NO: 176835 - RNA, 64 nt, Homo Sapiens; identical to SEQ ID NO: 79035

SEQ ID NO: 176836 - RNA, 64 nt, Homo Sapiens; identical to SEQ ID NO: 79036

SEQ ID NO: 176837 - RNA, 64 nt, Homo Sapiens; identical to SEQ ID NO: 79037

SEQ ID NO: 176838 - RNA, 64 nt, Homo Sapiens; identical to SEQ ID NO: 79038

SEQ ID NO: 176839 - RNA, 64 nt, Homo Sapiens; identical to SEQ ID NO: 79039

SEQ ID NO: 176840 - RNA, 64 nt, Homo Sapiens; identical to SEQ ID NO: 79040

SEQ ID NO: 176841 - RNA, 64 nt, Homo Sapiens; identical to SEQ ID NO: 79041

SEQ ID NO: 176842 - RNA, 64 nt, Homo Sapiens; identical to SEQ ID NO: 79042

SEQ ID NO: 176843 - RNA, 64 nt, Homo Sapiens; identical to SEQ ID NO: 79043

SEQ ID NO: 176844 - RNA, 64 nt, Homo Sapiens; identical to SEQ ID NO: 79044

SEQ ID NO: 176845 - RNA, 64 nt, Homo Sapiens; identical to SEQ ID NO: 79045

SEQ ID NO: 176846 - RNA, 64 nt, Homo Sapiens; identical to SEQ ID NO: 79046

SEQ ID NO: 176847 - RNA, 64 nt, Homo Sapiens; identical to SEQ ID NO: 79047

SEQ ID NO: 176848 - RNA, 64 nt, Homo Sapiens; identical to SEQ ID NO: 79048

SEQ ID NO: 176849 - RNA, 64 nt, Homo Sapiens; identical to SEQ ID NO: 79049

SEQ ID NO: 176850 - RNA, 64 nt, Homo Sapiens; identical to SEQ ID NO: 79050

SEQ ID NO: 176851 - RNA, 64 nt, Homo Sapiens; identical to SEQ ID NO: 172495

SEQ ID NO: 176852 - RNA, 64 nt, Homo Sapiens; identical to SEQ ID NO: 172496

SEQ ID NO: 176853 - RNA, 64 nt, Homo Sapiens; identical to SEQ ID NO: 78937

SEQ ID NO: 176854 - RNA, 64 nt, Homo Sapiens; identical to SEQ ID NO: 78938

SEQ ID NO: 176855 - RNA, 64 nt, Homo Sapiens; identical to SEQ ID NO: 78939

SEQ ID NO: 176856 - RNA, 64 nt, Homo Sapiens; identical to SEQ ID NO: 78940

SEQ ID NO: 176857 - RNA, 64 nt, Homo Sapiens; identical to SEQ ID NO: 78941

SEQ ID NO: 176858 - RNA, 64 nt, Homo Sapiens; identical to SEQ ID NO: 78942

SEQ ID NO: 176859 - RNA, 64 nt, Homo Sapiens; identical to SEQ ID NO: 78943

SEQ ID NO: 176860 - RNA, 64 nt, Homo Sapiens; identical to SEQ ID NO: 78944

SEQ ID NO: 176861 - RNA, 64 nt, Homo Sapiens; identical to SEQ ID NO: 78945

SEQ ID NO: 176862 - RNA, 64 nt, Homo Sapiens; identical to SEQ ID NO: 78946

SEQ ID NO: 176863 - RNA, 64 nt, Homo Sapiens; identical to SEQ ID NO: 78947

SEQ ID NO: 176864 - RNA, 64 nt, Homo Sapiens; identical to SEQ ID NO: 78948

SEQ ID NO: 176865 - RNA, 64 nt, Homo Sapiens; identical to SEQ ID NO: 78949

SEQ ID NO: 176866 - RNA, 64 nt, Homo Sapiens; identical to SEQ ID NO: 78950

SEQ ID NO: 176867 - RNA, 64 nt, Homo Sapiens; identical to SEQ ID NO: 78951

SEQ ID NO: 176868 - RNA, 64 nt, Homo Sapiens; identical to SEQ ID NO: 78952

SEQ ID NO: 176869 - RNA, 64 nt, Homo Sapiens; identical to SEQ ID NO: 78953

SEQ ID NO: 176870 - RNA, 64 nt, Homo Sapiens; identical to SEQ ID NO: 78954

SEQ ID NO: 176871 - RNA, 64 nt, Homo Sapiens; identical to SEQ ID NO: 78955

SEQ ID NO: 176872 - RNA, 64 nt, Homo Sapiens; identical to SEQ ID NO: 78956

SEQ ID NO: 176873 - RNA, 64 nt, Homo Sapiens; identical to SEQ ID NO: 78957

SEQ ID NO: 176874 - RNA, 64 nt, Homo Sapiens; identical to SEQ ID NO: 78958

SEQ ID NO: 176875 - RNA, 64 nt, Homo Sapiens; identical to SEQ ID NO: 78959

SEQ ID NO: 176876 - RNA, 64 nt, Homo Sapiens; identical to SEQ ID NO: 78960

SEQ ID NO: 176877 - RNA, 64 nt, Homo Sapiens; identical to SEQ ID NO: 78961

SEQ ID NO: 176878 - RNA, 64 nt, Homo Sapiens; identical to SEQ ID NO: 78962

SEQ ID NO: 176879 - RNA, 64 nt, Homo Sapiens; identical to SEQ ID NO: 78963

SEQ ID NO: 176880 - RNA, 64 nt, Homo Sapiens; identical to SEQ ID NO: 78964

SEQ ID NO: 176881 - RNA, 64 nt, Homo Sapiens; identical to SEQ ID NO: 78965

SEQ ID NO: 176882 - RNA, 64 nt, Homo Sapiens; identical to SEQ ID NO: 78966

SEQ ID NO: 176883 - RNA, 64 nt, Homo Sapiens; identical to SEQ ID NO: 78967

SEQ ID NO: 176884 - RNA, 64 nt, Homo Sapiens; identical to SEQ ID NO: 78968

SEQ ID NO: 176885 - RNA, 64 nt, Homo Sapiens; identical to SEQ ID NO: 78969

SEQ ID NO: 176886 - RNA, 64 nt, Homo Sapiens; identical to SEQ ID NO: 78970

SEQ ID NO: 176887 - RNA, 64 nt, Homo Sapiens; identical to SEQ ID NO: 78971

SEQ ID NO: 176888 - RNA, 64 nt, Homo Sapiens; identical to SEQ ID NO: 78972

SEQ ID NO: 176889 - RNA, 64 nt, Homo Sapiens; identical to SEQ ID NO: 78973

SEQ ID NO: 176890 - RNA, 64 nt, Homo Sapiens; identical to SEQ ID NO: 78974

SEQ ID NO: 176891 - RNA, 64 nt, Homo Sapiens; identical to SEQ ID NO: 78975

SEQ ID NO: 176892 - RNA, 64 nt, Homo Sapiens; identical to SEQ ID NO: 78976

SEQ ID NO: 176893 - RNA, 64 nt, Homo Sapiens; identical to SEQ ID NO: 78977

SEQ ID NO: 176894 - RNA, 64 nt, Homo Sapiens; identical to SEQ ID NO: 78978

SEQ ID NO: 176895 - RNA, 64 nt, Homo Sapiens; identical to SEQ ID NO: 78979

SEQ ID NO: 176896 - RNA, 64 nt, Homo Sapiens; identical to SEQ ID NO: 78980

SEQ ID NO: 176897 - RNA, 64 nt, Homo Sapiens; identical to SEQ ID NO: 78981

SEQ ID NO: 176898 - RNA, 64 nt, Homo Sapiens; identical to SEQ ID NO: 78982

SEQ ID NO: 176899 - RNA, 64 nt, Homo Sapiens; identical to SEQ ID NO: 78983

SEQ ID NO: 176900 - RNA, 64 nt, Homo Sapiens; identical to SEQ ID NO: 78984

SEQ ID NO: 176901 - RNA, 64 nt, Homo Sapiens; identical to SEQ ID NO: 78985

SEQ ID NO: 176902 - RNA, 64 nt, Homo Sapiens; identical to SEQ ID NO: 78986

SEQ ID NO: 176903 - RNA, 64 nt, Homo Sapiens; identical to SEQ ID NO: 78987

SEQ ID NO: 176904 - RNA, 64 nt, Homo Sapiens; identical to SEQ ID NO: 78988

SEQ ID NO: 176905 - RNA, 64 nt, Homo Sapiens; identical to SEQ ID NO: 78989

SEQ ID NO: 176906 - RNA, 64 nt, Homo Sapiens; identical to SEQ ID NO: 78990

SEQ ID NO: 176907 - RNA, 64 nt, Homo Sapiens; identical to SEQ ID NO: 78991

SEQ ID NO: 176908 - RNA, 64 nt, Homo Sapiens; identical to SEQ ID NO: 78992

SEQ ID NO: 176909 - RNA, 64 nt, Homo Sapiens; identical to SEQ ID NO: 78993

SEQ ID NO: 176910 - RNA, 64 nt, Homo Sapiens; identical to SEQ ID NO: 78994

SEQ ID NO: 176911 - RNA, 64 nt, Homo Sapiens; identical to SEQ ID NO: 78995

SEQ ID NO: 176912 - RNA, 64 nt, Homo Sapiens; identical to SEQ ID NO: 78996

SEQ ID NO: 176913 - RNA, 64 nt, Homo Sapiens; identical to SEQ ID NO: 78997

SEQ ID NO: 176914 - RNA, 64 nt, Homo Sapiens; identical to SEQ ID NO: 78998

SEQ ID NO: 176915 - RNA, 64 nt, Homo Sapiens; identical to SEQ ID NO: 78999

SEQ ID NO: 176916 - RNA, 64 nt, Homo Sapiens; identical to SEQ ID NO: 79000

SEQ ID NO: 176917 - RNA, 64 nt, Homo Sapiens; identical to SEQ ID NO: 79001

SEQ ID NO: 176918 - RNA, 64 nt, Homo Sapiens; identical to SEQ ID NO: 79002

SEQ ID NO: 176919 - RNA, 64 nt, Homo Sapiens; identical to SEQ ID NO: 79003

SEQ ID NO: 176920 - RNA, 64 nt, Homo Sapiens; identical to SEQ ID NO: 79004

SEQ ID NO: 176921 - RNA, 64 nt, Homo Sapiens; identical to SEQ ID NO: 79005

SEQ ID NO: 176922 - RNA, 64 nt, Homo Sapiens; identical to SEQ ID NO: 79006

SEQ ID NO: 176923 - RNA, 64 nt, Homo Sapiens; identical to SEQ ID NO: 79007

SEQ ID NO: 176924 - RNA, 64 nt, Homo Sapiens; identical to SEQ ID NO: 79008

SEQ ID NO: 176925 - RNA, 64 nt, Homo Sapiens; identical to SEQ ID NO: 79009

SEQ ID NO: 176926 - RNA, 64 nt, Homo Sapiens; identical to SEQ ID NO: 79010

SEQ ID NO: 176927 - RNA, 64 nt, Homo Sapiens; identical to SEQ ID NO: 79011

SEQ ID NO: 176928 - RNA, 64 nt, Homo Sapiens; identical to SEQ ID NO: 79012

SEQ ID NO: 176929 - RNA, 64 nt, Homo Sapiens; identical to SEQ ID NO: 79013

SEQ ID NO: 176930 - RNA, 64 nt, Homo Sapiens; identical to SEQ ID NO: 79014

SEQ ID NO: 176931 - RNA, 64 nt, Homo Sapiens; identical to SEQ ID NO: 79015

SEQ ID NO: 176932 - RNA, 64 nt, Homo Sapiens; identical to SEQ ID NO: 79016

SEQ ID NO: 176933 - RNA, 64 nt, Homo Sapiens; identical to SEQ ID NO: 79017

SEQ ID NO: 176934 - RNA, 64 nt, Homo Sapiens; identical to SEQ ID NO: 79018

SEQ ID NO: 176935 - RNA, 64 nt, Homo Sapiens; identical to SEQ ID NO: 79019

SEQ ID NO: 176936 - RNA, 64 nt, Homo Sapiens; identical to SEQ ID NO: 79020

SEQ ID NO: 176937 - RNA, 64 nt, Homo Sapiens; identical to SEQ ID NO: 79021

SEQ ID NO: 176938 - RNA, 64 nt, Homo Sapiens; identical to SEQ ID NO: 79022

SEQ ID NO: 176939 - RNA, 64 nt, Homo Sapiens; identical to SEQ ID NO: 79023

SEQ ID NO: 176940 - RNA, 64 nt, Homo Sapiens; identical to SEQ ID NO: 79024

SEQ ID NO: 176941 - RNA, 64 nt, Homo Sapiens; identical to SEQ ID NO: 79025

SEQ ID NO: 176942 - RNA, 64 nt, Homo Sapiens; identical to SEQ ID NO: 79026

SEQ ID NO: 176943 - RNA, 64 nt, Homo Sapiens; identical to SEQ ID NO: 79027

SEQ ID NO: 176944 - RNA, 64 nt, Homo Sapiens; identical to SEQ ID NO: 79028

SEQ ID NO: 176945 - RNA, 64 nt, Homo Sapiens; identical to SEQ ID NO: 79029

SEQ ID NO: 176946 - RNA, 64 nt, Homo Sapiens; identical to SEQ ID NO: 79030

SEQ ID NO: 176947 - RNA, 64 nt, Homo Sapiens; identical to SEQ ID NO: 79031

SEQ ID NO: 176948 - RNA, 64 nt, Homo Sapiens; identical to SEQ ID NO: 79032

SEQ ID NO: 176949 - RNA, 64 nt, Homo Sapiens; identical to SEQ ID NO: 79033

SEQ ID NO: 176950 - RNA, 64 nt, Homo Sapiens; identical to SEQ ID NO: 79034

SEQ ID NO: 176951 - RNA, 64 nt, Homo Sapiens; identical to SEQ ID NO: 79035

SEQ ID NO: 176952 - RNA, 64 nt, Homo Sapiens; identical to SEQ ID NO: 79036

SEQ ID NO: 176953 - RNA, 64 nt, Homo Sapiens; identical to SEQ ID NO: 79037

SEQ ID NO: 176954 - RNA, 64 nt, Homo Sapiens; identical to SEQ ID NO: 79038

SEQ ID NO: 176955 - RNA, 64 nt, Homo Sapiens; identical to SEQ ID NO: 79039

SEQ ID NO: 176956 - RNA, 64 nt, Homo Sapiens; identical to SEQ ID NO: 79040

SEQ ID NO: 176957 - RNA, 64 nt, Homo Sapiens; identical to SEQ ID NO: 79041

SEQ ID NO: 176958 - RNA, 64 nt, Homo Sapiens; identical to SEQ ID NO: 79042

SEQ ID NO: 176959 - RNA, 64 nt, Homo Sapiens; identical to SEQ ID NO: 79043

SEQ ID NO: 176960 - RNA, 64 nt, Homo Sapiens; identical to SEQ ID NO: 79044

SEQ ID NO: 176961 - RNA, 64 nt, Homo Sapiens; identical to SEQ ID NO: 79045

SEQ ID NO: 176962 - RNA, 64 nt, Homo Sapiens; identical to SEQ ID NO: 79046

SEQ ID NO: 176963 - RNA, 64 nt, Homo Sapiens; identical to SEQ ID NO: 79047

SEQ ID NO: 176964 - RNA, 64 nt, Homo Sapiens; identical to SEQ ID NO: 79048

SEQ ID NO: 176965 - RNA, 64 nt, Homo Sapiens; identical to SEQ ID NO: 79049

SEQ ID NO: 176966 - RNA, 64 nt, Homo Sapiens; identical to SEQ ID NO: 79050

SEQ ID NO: 176967 - RNA, 64 nt, Homo Sapiens; identical to SEQ ID NO: 172495

SEQ ID NO: 176968 - RNA, 64 nt, Homo Sapiens; identical to SEQ ID NO: 172496

SEQ ID NO: 176969 - RNA, 64 nt, Homo Sapiens; identical to SEQ ID NO: 78937

SEQ ID NO: 176970 - RNA, 64 nt, Homo Sapiens; identical to SEQ ID NO: 78938

SEQ ID NO: 176971 - RNA, 64 nt, Homo Sapiens; identical to SEQ ID NO: 78939

SEQ ID NO: 176972 - RNA, 64 nt, Homo Sapiens; identical to SEQ ID NO: 78940

SEQ ID NO: 176973 - RNA, 64 nt, Homo Sapiens; identical to SEQ ID NO: 78941

SEQ ID NO: 176974 - RNA, 64 nt, Homo Sapiens; identical to SEQ ID NO: 78942

SEQ ID NO: 176975 - RNA, 64 nt, Homo Sapiens; identical to SEQ ID NO: 78943

SEQ ID NO: 176976 - RNA, 64 nt, Homo Sapiens; identical to SEQ ID NO: 78944

SEQ ID NO: 176977 - RNA, 64 nt, Homo Sapiens; identical to SEQ ID NO: 78945

SEQ ID NO: 176978 - RNA, 64 nt, Homo Sapiens; identical to SEQ ID NO: 78946

SEQ ID NO: 176979 - RNA, 64 nt, Homo Sapiens; identical to SEQ ID NO: 78947

SEQ ID NO: 176980 - RNA, 64 nt, Homo Sapiens; identical to SEQ ID NO: 78948

SEQ ID NO: 176981 - RNA, 64 nt, Homo Sapiens; identical to SEQ ID NO: 78949

SEQ ID NO: 176982 - RNA, 64 nt, Homo Sapiens; identical to SEQ ID NO: 78950

SEQ ID NO: 176983 - RNA, 64 nt, Homo Sapiens; identical to SEQ ID NO: 78951

SEQ ID NO: 176984 - RNA, 64 nt, Homo Sapiens; identical to SEQ ID NO: 78952

SEQ ID NO: 176985 - RNA, 64 nt, Homo Sapiens; identical to SEQ ID NO: 78953

SEQ ID NO: 176986 - RNA, 64 nt, Homo Sapiens; identical to SEQ ID NO: 78954

SEQ ID NO: 176987 - RNA, 64 nt, Homo Sapiens; identical to SEQ ID NO: 78955

SEQ ID NO: 176988 - RNA, 64 nt, Homo Sapiens; identical to SEQ ID NO: 78956

SEQ ID NO: 176989 - RNA, 64 nt, Homo Sapiens; identical to SEQ ID NO: 78957

SEQ ID NO: 176990 - RNA, 64 nt, Homo Sapiens; identical to SEQ ID NO: 78958

SEQ ID NO: 176991 - RNA, 64 nt, Homo Sapiens; identical to SEQ ID NO: 78959

SEQ ID NO: 176992 - RNA, 64 nt, Homo Sapiens; identical to SEQ ID NO: 78960

SEQ ID NO: 176993 - RNA, 64 nt, Homo Sapiens; identical to SEQ ID NO: 78961

SEQ ID NO: 176994 - RNA, 64 nt, Homo Sapiens; identical to SEQ ID NO: 78962

SEQ ID NO: 176995 - RNA, 64 nt, Homo Sapiens; identical to SEQ ID NO: 78963

SEQ ID NO: 176996 - RNA, 64 nt, Homo Sapiens; identical to SEQ ID NO: 78964

SEQ ID NO: 176997 - RNA, 64 nt, Homo Sapiens; identical to SEQ ID NO: 78965

SEQ ID NO: 176998 - RNA, 64 nt, Homo Sapiens; identical to SEQ ID NO: 78966

SEQ ID NO: 176999 - RNA, 64 nt, Homo Sapiens; identical to SEQ ID NO: 78967

SEQ ID NO: 177000 - RNA, 64 nt, Homo Sapiens; identical to SEQ ID NO: 78968

SEQ ID NO: 177001 - RNA, 64 nt, Homo Sapiens; identical to SEQ ID NO: 78969

SEQ ID NO: 177002 - RNA, 64 nt, Homo Sapiens; identical to SEQ ID NO: 78970

SEQ ID NO: 177003 - RNA, 64 nt, Homo Sapiens; identical to SEQ ID NO: 78971

SEQ ID NO: 177004 - RNA, 64 nt, Homo Sapiens; identical to SEQ ID NO: 78972

SEQ ID NO: 177005 - RNA, 64 nt, Homo Sapiens; identical to SEQ ID NO: 78973

SEQ ID NO: 177006 - RNA, 64 nt, Homo Sapiens; identical to SEQ ID NO: 78974

SEQ ID NO: 177007 - RNA, 64 nt, Homo Sapiens; identical to SEQ ID NO: 78975

SEQ ID NO: 177008 - RNA, 64 nt, Homo Sapiens; identical to SEQ ID NO: 78976

SEQ ID NO: 177009 - RNA, 64 nt, Homo Sapiens; identical to SEQ ID NO: 78977

SEQ ID NO: 177010 - RNA, 64 nt, Homo Sapiens; identical to SEQ ID NO: 78978

SEQ ID NO: 177011 - RNA, 64 nt, Homo Sapiens; identical to SEQ ID NO: 78979

SEQ ID NO: 177012 - RNA, 64 nt, Homo Sapiens; identical to SEQ ID NO: 78980

SEQ ID NO: 177013 - RNA, 64 nt, Homo Sapiens; identical to SEQ ID NO: 78981

SEQ ID NO: 177014 - RNA, 64 nt, Homo Sapiens; identical to SEQ ID NO: 78982

SEQ ID NO: 177015 - RNA, 64 nt, Homo Sapiens; identical to SEQ ID NO: 78983

SEQ ID NO: 177016 - RNA, 64 nt, Homo Sapiens; identical to SEQ ID NO: 78984

SEQ ID NO: 177017 - RNA, 64 nt, Homo Sapiens; identical to SEQ ID NO: 78985

SEQ ID NO: 177018 - RNA, 64 nt, Homo Sapiens; identical to SEQ ID NO: 78986

SEQ ID NO: 177019 - RNA, 64 nt, Homo Sapiens; identical to SEQ ID NO: 78987

SEQ ID NO: 177020 - RNA, 64 nt, Homo Sapiens; identical to SEQ ID NO: 78988

SEQ ID NO: 177021 - RNA, 64 nt, Homo Sapiens; identical to SEQ ID NO: 78989

SEQ ID NO: 177022 - RNA, 64 nt, Homo Sapiens; identical to SEQ ID NO: 78990

SEQ ID NO: 177023 - RNA, 64 nt, Homo Sapiens; identical to SEQ ID NO: 78991

SEQ ID NO: 177024 - RNA, 64 nt, Homo Sapiens; identical to SEQ ID NO: 78992

SEQ ID NO: 177025 - RNA, 64 nt, Homo Sapiens; identical to SEQ ID NO: 78993

SEQ ID NO: 177026 - RNA, 64 nt, Homo Sapiens; identical to SEQ ID NO: 78994

SEQ ID NO: 177027 - RNA, 64 nt, Homo Sapiens; identical to SEQ ID NO: 78995

SEQ ID NO: 177028 - RNA, 64 nt, Homo Sapiens; identical to SEQ ID NO: 78996

SEQ ID NO: 177029 - RNA, 64 nt, Homo Sapiens; identical to SEQ ID NO: 78997

SEQ ID NO: 177030 - RNA, 64 nt, Homo Sapiens; identical to SEQ ID NO: 78998

SEQ ID NO: 177031 - RNA, 64 nt, Homo Sapiens; identical to SEQ ID NO: 78999

SEQ ID NO: 177032 - RNA, 64 nt, Homo Sapiens; identical to SEQ ID NO: 79000

SEQ ID NO: 177033 - RNA, 64 nt, Homo Sapiens; identical to SEQ ID NO: 79001

SEQ ID NO: 177034 - RNA, 64 nt, Homo Sapiens; identical to SEQ ID NO: 79002

SEQ ID NO: 177035 - RNA, 64 nt, Homo Sapiens; identical to SEQ ID NO: 79003

SEQ ID NO: 177036 - RNA, 64 nt, Homo Sapiens; identical to SEQ ID NO: 79004

SEQ ID NO: 177037 - RNA, 64 nt, Homo Sapiens; identical to SEQ ID NO: 79005

SEQ ID NO: 177038 - RNA, 64 nt, Homo Sapiens; identical to SEQ ID NO: 79006

SEQ ID NO: 177039 - RNA, 64 nt, Homo Sapiens; identical to SEQ ID NO: 79007

SEQ ID NO: 177040 - RNA, 64 nt, Homo Sapiens; identical to SEQ ID NO: 79008

SEQ ID NO: 177041 - RNA, 64 nt, Homo Sapiens; identical to SEQ ID NO: 79009

SEQ ID NO: 177042 - RNA, 64 nt, Homo Sapiens; identical to SEQ ID NO: 79010

SEQ ID NO: 177043 - RNA, 64 nt, Homo Sapiens; identical to SEQ ID NO: 79011

SEQ ID NO: 177044 - RNA, 64 nt, Homo Sapiens; identical to SEQ ID NO: 79012

SEQ ID NO: 177045 - RNA, 64 nt, Homo Sapiens; identical to SEQ ID NO: 79013

SEQ ID NO: 177046 - RNA, 64 nt, Homo Sapiens; identical to SEQ ID NO: 79014

SEQ ID NO: 177047 - RNA, 64 nt, Homo Sapiens; identical to SEQ ID NO: 79015

SEQ ID NO: 177048 - RNA, 64 nt, Homo Sapiens; identical to SEQ ID NO: 79016

SEQ ID NO: 177049 - RNA, 64 nt, Homo Sapiens; identical to SEQ ID NO: 79017

SEQ ID NO: 177050 - RNA, 64 nt, Homo Sapiens; identical to SEQ ID NO: 79018

SEQ ID NO: 177051 - RNA, 64 nt, Homo Sapiens; identical to SEQ ID NO: 79019

SEQ ID NO: 177052 - RNA, 64 nt, Homo Sapiens; identical to SEQ ID NO: 79020

SEQ ID NO: 177053 - RNA, 64 nt, Homo Sapiens; identical to SEQ ID NO: 79021

SEQ ID NO: 177054 - RNA, 64 nt, Homo Sapiens; identical to SEQ ID NO: 79022

SEQ ID NO: 177055 - RNA, 64 nt, Homo Sapiens; identical to SEQ ID NO: 79023

SEQ ID NO: 177056 - RNA, 64 nt, Homo Sapiens; identical to SEQ ID NO: 79024

SEQ ID NO: 177057 - RNA, 64 nt, Homo Sapiens; identical to SEQ ID NO: 79025

SEQ ID NO: 177058 - RNA, 64 nt, Homo Sapiens; identical to SEQ ID NO: 79026

SEQ ID NO: 177059 - RNA, 64 nt, Homo Sapiens; identical to SEQ ID NO: 79027

SEQ ID NO: 177060 - RNA, 64 nt, Homo Sapiens; identical to SEQ ID NO: 79028

SEQ ID NO: 177061 - RNA, 64 nt, Homo Sapiens; identical to SEQ ID NO: 79029

SEQ ID NO: 177062 - RNA, 64 nt, Homo Sapiens; identical to SEQ ID NO: 79030

SEQ ID NO: 177063 - RNA, 64 nt, Homo Sapiens; identical to SEQ ID NO: 79031

SEQ ID NO: 177064 - RNA, 64 nt, Homo Sapiens; identical to SEQ ID NO: 79032

SEQ ID NO: 177065 - RNA, 64 nt, Homo Sapiens; identical to SEQ ID NO: 79033

SEQ ID NO: 177066 - RNA, 64 nt, Homo Sapiens; identical to SEQ ID NO: 79034

SEQ ID NO: 177067 - RNA, 64 nt, Homo Sapiens; identical to SEQ ID NO: 79035

SEQ ID NO: 177068 - RNA, 64 nt, Homo Sapiens; identical to SEQ ID NO: 79036

SEQ ID NO: 177069 - RNA, 64 nt, Homo Sapiens; identical to SEQ ID NO: 79037

SEQ ID NO: 177070 - RNA, 64 nt, Homo Sapiens; identical to SEQ ID NO: 79038

SEQ ID NO: 177071 - RNA, 64 nt, Homo Sapiens; identical to SEQ ID NO: 79039

SEQ ID NO: 177072 - RNA, 64 nt, Homo Sapiens; identical to SEQ ID NO: 79040

SEQ ID NO: 177073 - RNA, 64 nt, Homo Sapiens; identical to SEQ ID NO: 79041

SEQ ID NO: 177074 - RNA, 64 nt, Homo Sapiens; identical to SEQ ID NO: 79042

SEQ ID NO: 177075 - RNA, 64 nt, Homo Sapiens; identical to SEQ ID NO: 79043

SEQ ID NO: 177076 - RNA, 64 nt, Homo Sapiens; identical to SEQ ID NO: 79044

SEQ ID NO: 177077 - RNA, 64 nt, Homo Sapiens; identical to SEQ ID NO: 79045

SEQ ID NO: 177078 - RNA, 64 nt, Homo Sapiens; identical to SEQ ID NO: 79046

SEQ ID NO: 177079 - RNA, 64 nt, Homo Sapiens; identical to SEQ ID NO: 79047

SEQ ID NO: 177080 - RNA, 64 nt, Homo Sapiens; identical to SEQ ID NO: 79048

SEQ ID NO: 177081 - RNA, 64 nt, Homo Sapiens; identical to SEQ ID NO: 79049

SEQ ID NO: 177082 - RNA, 64 nt, Homo Sapiens; identical to SEQ ID NO: 79050

SEQ ID NO: 177083 - RNA, 64 nt, Homo Sapiens; identical to SEQ ID NO: 172495

SEQ ID NO: 177084 - RNA, 64 nt, Homo Sapiens; identical to SEQ ID NO: 172496

SEQ ID NO: 177085 - RNA, 64 nt, Homo Sapiens; identical to SEQ ID NO: 78937

SEQ ID NO: 177086 - RNA, 64 nt, Homo Sapiens; identical to SEQ ID NO: 78938

SEQ ID NO: 177087 - RNA, 64 nt, Homo Sapiens; identical to SEQ ID NO: 78939

SEQ ID NO: 177088 - RNA, 64 nt, Homo Sapiens; identical to SEQ ID NO: 78940

SEQ ID NO: 177089 - RNA, 64 nt, Homo Sapiens; identical to SEQ ID NO: 78941

SEQ ID NO: 177090 - RNA, 64 nt, Homo Sapiens; identical to SEQ ID NO: 78942

SEQ ID NO: 177091 - RNA, 64 nt, Homo Sapiens; identical to SEQ ID NO: 78943

SEQ ID NO: 177092 - RNA, 64 nt, Homo Sapiens; identical to SEQ ID NO: 78944

SEQ ID NO: 177093 - RNA, 64 nt, Homo Sapiens; identical to SEQ ID NO: 78945

SEQ ID NO: 177094 - RNA, 64 nt, Homo Sapiens; identical to SEQ ID NO: 78946

SEQ ID NO: 177095 - RNA, 64 nt, Homo Sapiens; identical to SEQ ID NO: 78947

SEQ ID NO: 177096 - RNA, 64 nt, Homo Sapiens; identical to SEQ ID NO: 78948

SEQ ID NO: 177097 - RNA, 64 nt, Homo Sapiens; identical to SEQ ID NO: 78949

SEQ ID NO: 177098 - RNA, 64 nt, Homo Sapiens; identical to SEQ ID NO: 78950

SEQ ID NO: 177099 - RNA, 64 nt, Homo Sapiens; identical to SEQ ID NO: 78951

SEQ ID NO: 177100 - RNA, 64 nt, Homo Sapiens; identical to SEQ ID NO: 78952

SEQ ID NO: 177101 - RNA, 64 nt, Homo Sapiens; identical to SEQ ID NO: 78953

SEQ ID NO: 177102 - RNA, 64 nt, Homo Sapiens; identical to SEQ ID NO: 78954

SEQ ID NO: 177103 - RNA, 64 nt, Homo Sapiens; identical to SEQ ID NO: 78955

SEQ ID NO: 177104 - RNA, 64 nt, Homo Sapiens; identical to SEQ ID NO: 78956

SEQ ID NO: 177105 - RNA, 64 nt, Homo Sapiens; identical to SEQ ID NO: 78957

SEQ ID NO: 177106 - RNA, 64 nt, Homo Sapiens; identical to SEQ ID NO: 78958

SEQ ID NO: 177107 - RNA, 64 nt, Homo Sapiens; identical to SEQ ID NO: 78959

SEQ ID NO: 177108 - RNA, 64 nt, Homo Sapiens; identical to SEQ ID NO: 78960

SEQ ID NO: 177109 - RNA, 64 nt, Homo Sapiens; identical to SEQ ID NO: 78961

SEQ ID NO: 177110 - RNA, 64 nt, Homo Sapiens; identical to SEQ ID NO: 78962

SEQ ID NO: 177111 - RNA, 64 nt, Homo Sapiens; identical to SEQ ID NO: 78963

SEQ ID NO: 177112 - RNA, 64 nt, Homo Sapiens; identical to SEQ ID NO: 78964

SEQ ID NO: 177113 - RNA, 64 nt, Homo Sapiens; identical to SEQ ID NO: 78965

SEQ ID NO: 177114 - RNA, 64 nt, Homo Sapiens; identical to SEQ ID NO: 78966

SEQ ID NO: 177115 - RNA, 64 nt, Homo Sapiens; identical to SEQ ID NO: 78967

SEQ ID NO: 177116 - RNA, 64 nt, Homo Sapiens; identical to SEQ ID NO: 78968

SEQ ID NO: 177117 - RNA, 64 nt, Homo Sapiens; identical to SEQ ID NO: 78969

SEQ ID NO: 177118 - RNA, 64 nt, Homo Sapiens; identical to SEQ ID NO: 78970

SEQ ID NO: 177119 - RNA, 64 nt, Homo Sapiens; identical to SEQ ID NO: 78971

SEQ ID NO: 177120 - RNA, 64 nt, Homo Sapiens; identical to SEQ ID NO: 78972

SEQ ID NO: 177121 - RNA, 64 nt, Homo Sapiens; identical to SEQ ID NO: 78973

SEQ ID NO: 177122 - RNA, 64 nt, Homo Sapiens; identical to SEQ ID NO: 78974

SEQ ID NO: 177123 - RNA, 64 nt, Homo Sapiens; identical to SEQ ID NO: 78975

SEQ ID NO: 177124 - RNA, 64 nt, Homo Sapiens; identical to SEQ ID NO: 78976

SEQ ID NO: 177125 - RNA, 64 nt, Homo Sapiens; identical to SEQ ID NO: 78977

SEQ ID NO: 177126 - RNA, 64 nt, Homo Sapiens; identical to SEQ ID NO: 78978

SEQ ID NO: 177127 - RNA, 64 nt, Homo Sapiens; identical to SEQ ID NO: 78979

SEQ ID NO: 177128 - RNA, 64 nt, Homo Sapiens; identical to SEQ ID NO: 78980

SEQ ID NO: 177129 - RNA, 64 nt, Homo Sapiens; identical to SEQ ID NO: 78981

SEQ ID NO: 177130 - RNA, 64 nt, Homo Sapiens; identical to SEQ ID NO: 78982

SEQ ID NO: 177131 - RNA, 64 nt, Homo Sapiens; identical to SEQ ID NO: 78983

SEQ ID NO: 177132 - RNA, 64 nt, Homo Sapiens; identical to SEQ ID NO: 78984

SEQ ID NO: 177133 - RNA, 64 nt, Homo Sapiens; identical to SEQ ID NO: 78985

SEQ ID NO: 177134 - RNA, 64 nt, Homo Sapiens; identical to SEQ ID NO: 78986

SEQ ID NO: 177135 - RNA, 64 nt, Homo Sapiens; identical to SEQ ID NO: 78987

SEQ ID NO: 177136 - RNA, 64 nt, Homo Sapiens; identical to SEQ ID NO: 78988

SEQ ID NO: 177137 - RNA, 64 nt, Homo Sapiens; identical to SEQ ID NO: 78989

SEQ ID NO: 177138 - RNA, 64 nt, Homo Sapiens; identical to SEQ ID NO: 78990

SEQ ID NO: 177139 - RNA, 64 nt, Homo Sapiens; identical to SEQ ID NO: 78991

SEQ ID NO: 177140 - RNA, 64 nt, Homo Sapiens; identical to SEQ ID NO: 78992

SEQ ID NO: 177141 - RNA, 64 nt, Homo Sapiens; identical to SEQ ID NO: 78993

SEQ ID NO: 177142 - RNA, 64 nt, Homo Sapiens; identical to SEQ ID NO: 78994

SEQ ID NO: 177143 - RNA, 64 nt, Homo Sapiens; identical to SEQ ID NO: 78995

SEQ ID NO: 177144 - RNA, 64 nt, Homo Sapiens; identical to SEQ ID NO: 78996

SEQ ID NO: 177145 - RNA, 64 nt, Homo Sapiens; identical to SEQ ID NO: 78997

SEQ ID NO: 177146 - RNA, 64 nt, Homo Sapiens; identical to SEQ ID NO: 78998

SEQ ID NO: 177147 - RNA, 64 nt, Homo Sapiens; identical to SEQ ID NO: 78999

SEQ ID NO: 177148 - RNA, 64 nt, Homo Sapiens; identical to SEQ ID NO: 79000

SEQ ID NO: 177149 - RNA, 64 nt, Homo Sapiens; identical to SEQ ID NO: 79001

SEQ ID NO: 177150 - RNA, 64 nt, Homo Sapiens; identical to SEQ ID NO: 79002

SEQ ID NO: 177151 - RNA, 64 nt, Homo Sapiens; identical to SEQ ID NO: 79003

SEQ ID NO: 177152 - RNA, 64 nt, Homo Sapiens; identical to SEQ ID NO: 79004

SEQ ID NO: 177153 - RNA, 64 nt, Homo Sapiens; identical to SEQ ID NO: 79005

SEQ ID NO: 177154 - RNA, 64 nt, Homo Sapiens; identical to SEQ ID NO: 79006

SEQ ID NO: 177155 - RNA, 64 nt, Homo Sapiens; identical to SEQ ID NO: 79007

SEQ ID NO: 177156 - RNA, 64 nt, Homo Sapiens; identical to SEQ ID NO: 79008

SEQ ID NO: 177157 - RNA, 64 nt, Homo Sapiens; identical to SEQ ID NO: 79009

SEQ ID NO: 177158 - RNA, 64 nt, Homo Sapiens; identical to SEQ ID NO: 79010

SEQ ID NO: 177159 - RNA, 64 nt, Homo Sapiens; identical to SEQ ID NO: 79011

SEQ ID NO: 177160 - RNA, 64 nt, Homo Sapiens; identical to SEQ ID NO: 79012

SEQ ID NO: 177161 - RNA, 64 nt, Homo Sapiens; identical to SEQ ID NO: 79013

SEQ ID NO: 177162 - RNA, 64 nt, Homo Sapiens; identical to SEQ ID NO: 79014

SEQ ID NO: 177163 - RNA, 64 nt, Homo Sapiens; identical to SEQ ID NO: 79015

SEQ ID NO: 177164 - RNA, 64 nt, Homo Sapiens; identical to SEQ ID NO: 79016

SEQ ID NO: 177165 - RNA, 64 nt, Homo Sapiens; identical to SEQ ID NO: 79017

SEQ ID NO: 177166 - RNA, 64 nt, Homo Sapiens; identical to SEQ ID NO: 79018

SEQ ID NO: 177167 - RNA, 64 nt, Homo Sapiens; identical to SEQ ID NO: 79019

SEQ ID NO: 177168 - RNA, 64 nt, Homo Sapiens; identical to SEQ ID NO: 79020

SEQ ID NO: 177169 - RNA, 64 nt, Homo Sapiens; identical to SEQ ID NO: 79021

SEQ ID NO: 177170 - RNA, 64 nt, Homo Sapiens; identical to SEQ ID NO: 79022

SEQ ID NO: 177171 - RNA, 64 nt, Homo Sapiens; identical to SEQ ID NO: 79023

SEQ ID NO: 177172 - RNA, 64 nt, Homo Sapiens; identical to SEQ ID NO: 79024

SEQ ID NO: 177173 - RNA, 64 nt, Homo Sapiens; identical to SEQ ID NO: 79025

SEQ ID NO: 177174 - RNA, 64 nt, Homo Sapiens; identical to SEQ ID NO: 79026

SEQ ID NO: 177175 - RNA, 64 nt, Homo Sapiens; identical to SEQ ID NO: 79027

SEQ ID NO: 177176 - RNA, 64 nt, Homo Sapiens; identical to SEQ ID NO: 79028

SEQ ID NO: 177177 - RNA, 64 nt, Homo Sapiens; identical to SEQ ID NO: 79029

SEQ ID NO: 177178 - RNA, 64 nt, Homo Sapiens; identical to SEQ ID NO: 79030

SEQ ID NO: 177179 - RNA, 64 nt, Homo Sapiens; identical to SEQ ID NO: 79031

SEQ ID NO: 177180 - RNA, 64 nt, Homo Sapiens; identical to SEQ ID NO: 79032

SEQ ID NO: 177181 - RNA, 64 nt, Homo Sapiens; identical to SEQ ID NO: 79033

SEQ ID NO: 177182 - RNA, 64 nt, Homo Sapiens; identical to SEQ ID NO: 79034

SEQ ID NO: 177183 - RNA, 64 nt, Homo Sapiens; identical to SEQ ID NO: 79035

SEQ ID NO: 177184 - RNA, 64 nt, Homo Sapiens; identical to SEQ ID NO: 79036

SEQ ID NO: 177185 - RNA, 64 nt, Homo Sapiens; identical to SEQ ID NO: 79037

SEQ ID NO: 177186 - RNA, 64 nt, Homo Sapiens; identical to SEQ ID NO: 79038

SEQ ID NO: 177187 - RNA, 64 nt, Homo Sapiens; identical to SEQ ID NO: 79039

SEQ ID NO: 177188 - RNA, 64 nt, Homo Sapiens; identical to SEQ ID NO: 79040

SEQ ID NO: 177189 - RNA, 64 nt, Homo Sapiens; identical to SEQ ID NO: 79041

SEQ ID NO: 177190 - RNA, 64 nt, Homo Sapiens; identical to SEQ ID NO: 79042

SEQ ID NO: 177191 - RNA, 64 nt, Homo Sapiens; identical to SEQ ID NO: 79043

SEQ ID NO: 177192 - RNA, 64 nt, Homo Sapiens; identical to SEQ ID NO: 79044

SEQ ID NO: 177193 - RNA, 64 nt, Homo Sapiens; identical to SEQ ID NO: 79045

SEQ ID NO: 177194 - RNA, 64 nt, Homo Sapiens; identical to SEQ ID NO: 79046

SEQ ID NO: 177195 - RNA, 64 nt, Homo Sapiens; identical to SEQ ID NO: 79047

SEQ ID NO: 177196 - RNA, 64 nt, Homo Sapiens; identical to SEQ ID NO: 79048

SEQ ID NO: 177197 - RNA, 64 nt, Homo Sapiens; identical to SEQ ID NO: 79049

SEQ ID NO: 177198 - RNA, 64 nt, Homo Sapiens; identical to SEQ ID NO: 79050

SEQ ID NO: 177199 - RNA, 64 nt, Homo Sapiens; identical to SEQ ID NO: 172495

SEQ ID NO: 177200 - RNA, 64 nt, Homo Sapiens; identical to SEQ ID NO: 172496

SEQ ID NO: 177201 - RNA, 64 nt, Homo Sapiens; identical to SEQ ID NO: 78937

SEQ ID NO: 177202 - RNA, 64 nt, Homo Sapiens; identical to SEQ ID NO: 78938

SEQ ID NO: 177203 - RNA, 64 nt, Homo Sapiens; identical to SEQ ID NO: 78939

SEQ ID NO: 177204 - RNA, 64 nt, Homo Sapiens; identical to SEQ ID NO: 78940

SEQ ID NO: 177205 - RNA, 64 nt, Homo Sapiens; identical to SEQ ID NO: 78941

SEQ ID NO: 177206 - RNA, 64 nt, Homo Sapiens; identical to SEQ ID NO: 78942

SEQ ID NO: 177207 - RNA, 64 nt, Homo Sapiens; identical to SEQ ID NO: 78943

SEQ ID NO: 177208 - RNA, 64 nt, Homo Sapiens; identical to SEQ ID NO: 78944

SEQ ID NO: 177209 - RNA, 64 nt, Homo Sapiens; identical to SEQ ID NO: 78945

SEQ ID NO: 177210 - RNA, 64 nt, Homo Sapiens; identical to SEQ ID NO: 78946

SEQ ID NO: 177211 - RNA, 64 nt, Homo Sapiens; identical to SEQ ID NO: 78947

SEQ ID NO: 177212 - RNA, 64 nt, Homo Sapiens; identical to SEQ ID NO: 78948

SEQ ID NO: 177213 - RNA, 64 nt, Homo Sapiens; identical to SEQ ID NO: 78949

SEQ ID NO: 177214 - RNA, 64 nt, Homo Sapiens; identical to SEQ ID NO: 78950

SEQ ID NO: 177215 - RNA, 64 nt, Homo Sapiens; identical to SEQ ID NO: 78951

SEQ ID NO: 177216 - RNA, 64 nt, Homo Sapiens; identical to SEQ ID NO: 78952

SEQ ID NO: 177217 - RNA, 64 nt, Homo Sapiens; identical to SEQ ID NO: 78953

SEQ ID NO: 177218 - RNA, 64 nt, Homo Sapiens; identical to SEQ ID NO: 78954

SEQ ID NO: 177219 - RNA, 64 nt, Homo Sapiens; identical to SEQ ID NO: 78955

SEQ ID NO: 177220 - RNA, 64 nt, Homo Sapiens; identical to SEQ ID NO: 78956

SEQ ID NO: 177221 - RNA, 64 nt, Homo Sapiens; identical to SEQ ID NO: 78957

SEQ ID NO: 177222 - RNA, 64 nt, Homo Sapiens; identical to SEQ ID NO: 78958

SEQ ID NO: 177223 - RNA, 64 nt, Homo Sapiens; identical to SEQ ID NO: 78959

SEQ ID NO: 177224 - RNA, 64 nt, Homo Sapiens; identical to SEQ ID NO: 78960

SEQ ID NO: 177225 - RNA, 64 nt, Homo Sapiens; identical to SEQ ID NO: 78961

SEQ ID NO: 177226 - RNA, 64 nt, Homo Sapiens; identical to SEQ ID NO: 78962

SEQ ID NO: 177227 - RNA, 64 nt, Homo Sapiens; identical to SEQ ID NO: 78963

SEQ ID NO: 177228 - RNA, 64 nt, Homo Sapiens; identical to SEQ ID NO: 78964

SEQ ID NO: 177229 - RNA, 64 nt, Homo Sapiens; identical to SEQ ID NO: 78965

SEQ ID NO: 177230 - RNA, 64 nt, Homo Sapiens; identical to SEQ ID NO: 78966

SEQ ID NO: 177231 - RNA, 64 nt, Homo Sapiens; identical to SEQ ID NO: 78967

SEQ ID NO: 177232 - RNA, 64 nt, Homo Sapiens; identical to SEQ ID NO: 78968

SEQ ID NO: 177233 - RNA, 64 nt, Homo Sapiens; identical to SEQ ID NO: 78969

SEQ ID NO: 177234 - RNA, 64 nt, Homo Sapiens; identical to SEQ ID NO: 78970

SEQ ID NO: 177235 - RNA, 64 nt, Homo Sapiens; identical to SEQ ID NO: 78971

SEQ ID NO: 177236 - RNA, 64 nt, Homo Sapiens; identical to SEQ ID NO: 78972

SEQ ID NO: 177237 - RNA, 64 nt, Homo Sapiens; identical to SEQ ID NO: 78973

SEQ ID NO: 177238 - RNA, 64 nt, Homo Sapiens; identical to SEQ ID NO: 78974

SEQ ID NO: 177239 - RNA, 64 nt, Homo Sapiens; identical to SEQ ID NO: 78975

SEQ ID NO: 177240 - RNA, 64 nt, Homo Sapiens; identical to SEQ ID NO: 78976

SEQ ID NO: 177241 - RNA, 64 nt, Homo Sapiens; identical to SEQ ID NO: 78977

SEQ ID NO: 177242 - RNA, 64 nt, Homo Sapiens; identical to SEQ ID NO: 78978

SEQ ID NO: 177243 - RNA, 64 nt, Homo Sapiens; identical to SEQ ID NO: 78979

SEQ ID NO: 177244 - RNA, 64 nt, Homo Sapiens; identical to SEQ ID NO: 78980

SEQ ID NO: 177245 - RNA, 64 nt, Homo Sapiens; identical to SEQ ID NO: 78981

SEQ ID NO: 177246 - RNA, 64 nt, Homo Sapiens; identical to SEQ ID NO: 78982

SEQ ID NO: 177247 - RNA, 64 nt, Homo Sapiens; identical to SEQ ID NO: 78983

SEQ ID NO: 177248 - RNA, 64 nt, Homo Sapiens; identical to SEQ ID NO: 78984

SEQ ID NO: 177249 - RNA, 64 nt, Homo Sapiens; identical to SEQ ID NO: 78985

SEQ ID NO: 177250 - RNA, 64 nt, Homo Sapiens; identical to SEQ ID NO: 78986

SEQ ID NO: 177251 - RNA, 64 nt, Homo Sapiens; identical to SEQ ID NO: 78987

SEQ ID NO: 177252 - RNA, 64 nt, Homo Sapiens; identical to SEQ ID NO: 78988

SEQ ID NO: 177253 - RNA, 64 nt, Homo Sapiens; identical to SEQ ID NO: 78989

SEQ ID NO: 177254 - RNA, 64 nt, Homo Sapiens; identical to SEQ ID NO: 78990

SEQ ID NO: 177255 - RNA, 64 nt, Homo Sapiens; identical to SEQ ID NO: 78991

SEQ ID NO: 177256 - RNA, 64 nt, Homo Sapiens; identical to SEQ ID NO: 78992

SEQ ID NO: 177257 - RNA, 64 nt, Homo Sapiens; identical to SEQ ID NO: 78993

SEQ ID NO: 177258 - RNA, 64 nt, Homo Sapiens; identical to SEQ ID NO: 78994

SEQ ID NO: 177259 - RNA, 64 nt, Homo Sapiens; identical to SEQ ID NO: 78995

SEQ ID NO: 177260 - RNA, 64 nt, Homo Sapiens; identical to SEQ ID NO: 78996

SEQ ID NO: 177261 - RNA, 64 nt, Homo Sapiens; identical to SEQ ID NO: 78997

SEQ ID NO: 177262 - RNA, 64 nt, Homo Sapiens; identical to SEQ ID NO: 78998

SEQ ID NO: 177263 - RNA, 64 nt, Homo Sapiens; identical to SEQ ID NO: 78999

SEQ ID NO: 177264 - RNA, 64 nt, Homo Sapiens; identical to SEQ ID NO: 79000

SEQ ID NO: 177265 - RNA, 64 nt, Homo Sapiens; identical to SEQ ID NO: 79001

SEQ ID NO: 177266 - RNA, 64 nt, Homo Sapiens; identical to SEQ ID NO: 79002

SEQ ID NO: 177267 - RNA, 64 nt, Homo Sapiens; identical to SEQ ID NO: 79003

SEQ ID NO: 177268 - RNA, 64 nt, Homo Sapiens; identical to SEQ ID NO: 79004

SEQ ID NO: 177269 - RNA, 64 nt, Homo Sapiens; identical to SEQ ID NO: 79005

SEQ ID NO: 177270 - RNA, 64 nt, Homo Sapiens; identical to SEQ ID NO: 79006

SEQ ID NO: 177271 - RNA, 64 nt, Homo Sapiens; identical to SEQ ID NO: 79007

SEQ ID NO: 177272 - RNA, 64 nt, Homo Sapiens; identical to SEQ ID NO: 79008

SEQ ID NO: 177273 - RNA, 64 nt, Homo Sapiens; identical to SEQ ID NO: 79009

SEQ ID NO: 177274 - RNA, 64 nt, Homo Sapiens; identical to SEQ ID NO: 79010

SEQ ID NO: 177275 - RNA, 64 nt, Homo Sapiens; identical to SEQ ID NO: 79011

SEQ ID NO: 177276 - RNA, 64 nt, Homo Sapiens; identical to SEQ ID NO: 79012

SEQ ID NO: 177277 - RNA, 64 nt, Homo Sapiens; identical to SEQ ID NO: 79013

SEQ ID NO: 177278 - RNA, 64 nt, Homo Sapiens; identical to SEQ ID NO: 79014

SEQ ID NO: 177279 - RNA, 64 nt, Homo Sapiens; identical to SEQ ID NO: 79015

SEQ ID NO: 177280 - RNA, 64 nt, Homo Sapiens; identical to SEQ ID NO: 79016

SEQ ID NO: 177281 - RNA, 64 nt, Homo Sapiens; identical to SEQ ID NO: 79017

SEQ ID NO: 177282 - RNA, 64 nt, Homo Sapiens; identical to SEQ ID NO: 79018

SEQ ID NO: 177283 - RNA, 64 nt, Homo Sapiens; identical to SEQ ID NO: 79019

SEQ ID NO: 177284 - RNA, 64 nt, Homo Sapiens; identical to SEQ ID NO: 79020

SEQ ID NO: 177285 - RNA, 64 nt, Homo Sapiens; identical to SEQ ID NO: 79021

SEQ ID NO: 177286 - RNA, 64 nt, Homo Sapiens; identical to SEQ ID NO: 79022

SEQ ID NO: 177287 - RNA, 64 nt, Homo Sapiens; identical to SEQ ID NO: 79023

SEQ ID NO: 177288 - RNA, 64 nt, Homo Sapiens; identical to SEQ ID NO: 79024

SEQ ID NO: 177289 - RNA, 64 nt, Homo Sapiens; identical to SEQ ID NO: 79025

SEQ ID NO: 177290 - RNA, 64 nt, Homo Sapiens; identical to SEQ ID NO: 79026

SEQ ID NO: 177291 - RNA, 64 nt, Homo Sapiens; identical to SEQ ID NO: 79027

SEQ ID NO: 177292 - RNA, 64 nt, Homo Sapiens; identical to SEQ ID NO: 79028

SEQ ID NO: 177293 - RNA, 64 nt, Homo Sapiens; identical to SEQ ID NO: 79029

SEQ ID NO: 177294 - RNA, 64 nt, Homo Sapiens; identical to SEQ ID NO: 79030

SEQ ID NO: 177295 - RNA, 64 nt, Homo Sapiens; identical to SEQ ID NO: 79031

SEQ ID NO: 177296 - RNA, 64 nt, Homo Sapiens; identical to SEQ ID NO: 79032

SEQ ID NO: 177297 - RNA, 64 nt, Homo Sapiens; identical to SEQ ID NO: 79033

SEQ ID NO: 177298 - RNA, 64 nt, Homo Sapiens; identical to SEQ ID NO: 79034

SEQ ID NO: 177299 - RNA, 64 nt, Homo Sapiens; identical to SEQ ID NO: 79035

SEQ ID NO: 177300 - RNA, 64 nt, Homo Sapiens; identical to SEQ ID NO: 79036

SEQ ID NO: 177301 - RNA, 64 nt, Homo Sapiens; identical to SEQ ID NO: 79037

SEQ ID NO: 177302 - RNA, 64 nt, Homo Sapiens; identical to SEQ ID NO: 79038

SEQ ID NO: 177303 - RNA, 64 nt, Homo Sapiens; identical to SEQ ID NO: 79039

SEQ ID NO: 177304 - RNA, 64 nt, Homo Sapiens; identical to SEQ ID NO: 79040

SEQ ID NO: 177305 - RNA, 64 nt, Homo Sapiens; identical to SEQ ID NO: 79041

SEQ ID NO: 177306 - RNA, 64 nt, Homo Sapiens; identical to SEQ ID NO: 79042

SEQ ID NO: 177307 - RNA, 64 nt, Homo Sapiens; identical to SEQ ID NO: 79043

SEQ ID NO: 177308 - RNA, 64 nt, Homo Sapiens; identical to SEQ ID NO: 79044

SEQ ID NO: 177309 - RNA, 64 nt, Homo Sapiens; identical to SEQ ID NO: 79045

SEQ ID NO: 177310 - RNA, 64 nt, Homo Sapiens; identical to SEQ ID NO: 79046

SEQ ID NO: 177311 - RNA, 64 nt, Homo Sapiens; identical to SEQ ID NO: 79047

SEQ ID NO: 177312 - RNA, 64 nt, Homo Sapiens; identical to SEQ ID NO: 79048

SEQ ID NO: 177313 - RNA, 64 nt, Homo Sapiens; identical to SEQ ID NO: 79049

SEQ ID NO: 177314 - RNA, 64 nt, Homo Sapiens; identical to SEQ ID NO: 79050

SEQ ID NO: 177315 - RNA, 64 nt, Homo Sapiens; identical to SEQ ID NO: 172495

SEQ ID NO: 177316 - RNA, 64 nt, Homo Sapiens; identical to SEQ ID NO: 172496

SEQ ID NO: 177317 - RNA, 64 nt, Homo Sapiens; identical to SEQ ID NO: 78937

SEQ ID NO: 177318 - RNA, 64 nt, Homo Sapiens; identical to SEQ ID NO: 78938

SEQ ID NO: 177319 - RNA, 64 nt, Homo Sapiens; identical to SEQ ID NO: 78939

SEQ ID NO: 177320 - RNA, 64 nt, Homo Sapiens; identical to SEQ ID NO: 78940

SEQ ID NO: 177321 - RNA, 64 nt, Homo Sapiens; identical to SEQ ID NO: 78941

SEQ ID NO: 177322 - RNA, 64 nt, Homo Sapiens; identical to SEQ ID NO: 78942

SEQ ID NO: 177323 - RNA, 64 nt, Homo Sapiens; identical to SEQ ID NO: 78943

SEQ ID NO: 177324 - RNA, 64 nt, Homo Sapiens; identical to SEQ ID NO: 78944

SEQ ID NO: 177325 - RNA, 64 nt, Homo Sapiens; identical to SEQ ID NO: 78945

SEQ ID NO: 177326 - RNA, 64 nt, Homo Sapiens; identical to SEQ ID NO: 78946

SEQ ID NO: 177327 - RNA, 64 nt, Homo Sapiens; identical to SEQ ID NO: 78947

SEQ ID NO: 177328 - RNA, 64 nt, Homo Sapiens; identical to SEQ ID NO: 78948

SEQ ID NO: 177329 - RNA, 64 nt, Homo Sapiens; identical to SEQ ID NO: 78949

SEQ ID NO: 177330 - RNA, 64 nt, Homo Sapiens; identical to SEQ ID NO: 78950

SEQ ID NO: 177331 - RNA, 64 nt, Homo Sapiens; identical to SEQ ID NO: 78951

SEQ ID NO: 177332 - RNA, 64 nt, Homo Sapiens; identical to SEQ ID NO: 78952

SEQ ID NO: 177333 - RNA, 64 nt, Homo Sapiens; identical to SEQ ID NO: 78953

SEQ ID NO: 177334 - RNA, 64 nt, Homo Sapiens; identical to SEQ ID NO: 78954

SEQ ID NO: 177335 - RNA, 64 nt, Homo Sapiens; identical to SEQ ID NO: 78955

SEQ ID NO: 177336 - RNA, 64 nt, Homo Sapiens; identical to SEQ ID NO: 78956

SEQ ID NO: 177337 - RNA, 64 nt, Homo Sapiens; identical to SEQ ID NO: 78957

SEQ ID NO: 177338 - RNA, 64 nt, Homo Sapiens; identical to SEQ ID NO: 78958

SEQ ID NO: 177339 - RNA, 64 nt, Homo Sapiens; identical to SEQ ID NO: 78959

SEQ ID NO: 177340 - RNA, 64 nt, Homo Sapiens; identical to SEQ ID NO: 78960

SEQ ID NO: 177341 - RNA, 64 nt, Homo Sapiens; identical to SEQ ID NO: 78961

SEQ ID NO: 177342 - RNA, 64 nt, Homo Sapiens; identical to SEQ ID NO: 78962

SEQ ID NO: 177343 - RNA, 64 nt, Homo Sapiens; identical to SEQ ID NO: 78963

SEQ ID NO: 177344 - RNA, 64 nt, Homo Sapiens; identical to SEQ ID NO: 78964

SEQ ID NO: 177345 - RNA, 64 nt, Homo Sapiens; identical to SEQ ID NO: 78965

SEQ ID NO: 177346 - RNA, 64 nt, Homo Sapiens; identical to SEQ ID NO: 78966

SEQ ID NO: 177347 - RNA, 64 nt, Homo Sapiens; identical to SEQ ID NO: 78967

SEQ ID NO: 177348 - RNA, 64 nt, Homo Sapiens; identical to SEQ ID NO: 78968

SEQ ID NO: 177349 - RNA, 64 nt, Homo Sapiens; identical to SEQ ID NO: 78969

SEQ ID NO: 177350 - RNA, 64 nt, Homo Sapiens; identical to SEQ ID NO: 78970

SEQ ID NO: 177351 - RNA, 64 nt, Homo Sapiens; identical to SEQ ID NO: 78971

SEQ ID NO: 177352 - RNA, 64 nt, Homo Sapiens; identical to SEQ ID NO: 78972

SEQ ID NO: 177353 - RNA, 64 nt, Homo Sapiens; identical to SEQ ID NO: 78973

SEQ ID NO: 177354 - RNA, 64 nt, Homo Sapiens; identical to SEQ ID NO: 78974

SEQ ID NO: 177355 - RNA, 64 nt, Homo Sapiens; identical to SEQ ID NO: 78975

SEQ ID NO: 177356 - RNA, 64 nt, Homo Sapiens; identical to SEQ ID NO: 78976

SEQ ID NO: 177357 - RNA, 64 nt, Homo Sapiens; identical to SEQ ID NO: 78977

SEQ ID NO: 177358 - RNA, 64 nt, Homo Sapiens; identical to SEQ ID NO: 78978

SEQ ID NO: 177359 - RNA, 64 nt, Homo Sapiens; identical to SEQ ID NO: 78979

SEQ ID NO: 177360 - RNA, 64 nt, Homo Sapiens; identical to SEQ ID NO: 78980

SEQ ID NO: 177361 - RNA, 64 nt, Homo Sapiens; identical to SEQ ID NO: 78981

SEQ ID NO: 177362 - RNA, 64 nt, Homo Sapiens; identical to SEQ ID NO: 78982

SEQ ID NO: 177363 - RNA, 64 nt, Homo Sapiens; identical to SEQ ID NO: 78983

SEQ ID NO: 177364 - RNA, 64 nt, Homo Sapiens; identical to SEQ ID NO: 78984

SEQ ID NO: 177365 - RNA, 64 nt, Homo Sapiens; identical to SEQ ID NO: 78985

SEQ ID NO: 177366 - RNA, 64 nt, Homo Sapiens; identical to SEQ ID NO: 78986

SEQ ID NO: 177367 - RNA, 64 nt, Homo Sapiens; identical to SEQ ID NO: 78987

SEQ ID NO: 177368 - RNA, 64 nt, Homo Sapiens; identical to SEQ ID NO: 78988

SEQ ID NO: 177369 - RNA, 64 nt, Homo Sapiens; identical to SEQ ID NO: 78989

SEQ ID NO: 177370 - RNA, 64 nt, Homo Sapiens; identical to SEQ ID NO: 78990

SEQ ID NO: 177371 - RNA, 64 nt, Homo Sapiens; identical to SEQ ID NO: 78991

SEQ ID NO: 177372 - RNA, 64 nt, Homo Sapiens; identical to SEQ ID NO: 78992

SEQ ID NO: 177373 - RNA, 64 nt, Homo Sapiens; identical to SEQ ID NO: 78993

SEQ ID NO: 177374 - RNA, 64 nt, Homo Sapiens; identical to SEQ ID NO: 78994

SEQ ID NO: 177375 - RNA, 64 nt, Homo Sapiens; identical to SEQ ID NO: 78995

SEQ ID NO: 177376 - RNA, 64 nt, Homo Sapiens; identical to SEQ ID NO: 78996

SEQ ID NO: 177377 - RNA, 64 nt, Homo Sapiens; identical to SEQ ID NO: 78997

SEQ ID NO: 177378 - RNA, 64 nt, Homo Sapiens; identical to SEQ ID NO: 78998

SEQ ID NO: 177379 - RNA, 64 nt, Homo Sapiens; identical to SEQ ID NO: 78999

SEQ ID NO: 177380 - RNA, 64 nt, Homo Sapiens; identical to SEQ ID NO: 79000

SEQ ID NO: 177381 - RNA, 64 nt, Homo Sapiens; identical to SEQ ID NO: 79001

SEQ ID NO: 177382 - RNA, 64 nt, Homo Sapiens; identical to SEQ ID NO: 79002

SEQ ID NO: 177383 - RNA, 64 nt, Homo Sapiens; identical to SEQ ID NO: 79003

SEQ ID NO: 177384 - RNA, 64 nt, Homo Sapiens; identical to SEQ ID NO: 79004

SEQ ID NO: 177385 - RNA, 64 nt, Homo Sapiens; identical to SEQ ID NO: 79005

SEQ ID NO: 177386 - RNA, 64 nt, Homo Sapiens; identical to SEQ ID NO: 79006

SEQ ID NO: 177387 - RNA, 64 nt, Homo Sapiens; identical to SEQ ID NO: 79007

SEQ ID NO: 177388 - RNA, 64 nt, Homo Sapiens; identical to SEQ ID NO: 79008

SEQ ID NO: 177389 - RNA, 64 nt, Homo Sapiens; identical to SEQ ID NO: 79009

SEQ ID NO: 177390 - RNA, 64 nt, Homo Sapiens; identical to SEQ ID NO: 79010

SEQ ID NO: 177391 - RNA, 64 nt, Homo Sapiens; identical to SEQ ID NO: 79011

SEQ ID NO: 177392 - RNA, 64 nt, Homo Sapiens; identical to SEQ ID NO: 79012

SEQ ID NO: 177393 - RNA, 64 nt, Homo Sapiens; identical to SEQ ID NO: 79013

SEQ ID NO: 177394 - RNA, 64 nt, Homo Sapiens; identical to SEQ ID NO: 79014

SEQ ID NO: 177395 - RNA, 64 nt, Homo Sapiens; identical to SEQ ID NO: 79015

SEQ ID NO: 177396 - RNA, 64 nt, Homo Sapiens; identical to SEQ ID NO: 79016

SEQ ID NO: 177397 - RNA, 64 nt, Homo Sapiens; identical to SEQ ID NO: 79017

SEQ ID NO: 177398 - RNA, 64 nt, Homo Sapiens; identical to SEQ ID NO: 79018

SEQ ID NO: 177399 - RNA, 64 nt, Homo Sapiens; identical to SEQ ID NO: 79019

SEQ ID NO: 177400 - RNA, 64 nt, Homo Sapiens; identical to SEQ ID NO: 79020

SEQ ID NO: 177401 - RNA, 64 nt, Homo Sapiens; identical to SEQ ID NO: 79021

SEQ ID NO: 177402 - RNA, 64 nt, Homo Sapiens; identical to SEQ ID NO: 79022

SEQ ID NO: 177403 - RNA, 64 nt, Homo Sapiens; identical to SEQ ID NO: 79023

SEQ ID NO: 177404 - RNA, 64 nt, Homo Sapiens; identical to SEQ ID NO: 79024

SEQ ID NO: 177405 - RNA, 64 nt, Homo Sapiens; identical to SEQ ID NO: 79025

SEQ ID NO: 177406 - RNA, 64 nt, Homo Sapiens; identical to SEQ ID NO: 79026

SEQ ID NO: 177407 - RNA, 64 nt, Homo Sapiens; identical to SEQ ID NO: 79027

SEQ ID NO: 177408 - RNA, 64 nt, Homo Sapiens; identical to SEQ ID NO: 79028

SEQ ID NO: 177409 - RNA, 64 nt, Homo Sapiens; identical to SEQ ID NO: 79029

SEQ ID NO: 177410 - RNA, 64 nt, Homo Sapiens; identical to SEQ ID NO: 79030

SEQ ID NO: 177411 - RNA, 64 nt, Homo Sapiens; identical to SEQ ID NO: 79031

SEQ ID NO: 177412 - RNA, 64 nt, Homo Sapiens; identical to SEQ ID NO: 79032

SEQ ID NO: 177413 - RNA, 64 nt, Homo Sapiens; identical to SEQ ID NO: 79033

SEQ ID NO: 177414 - RNA, 64 nt, Homo Sapiens; identical to SEQ ID NO: 79034

SEQ ID NO: 177415 - RNA, 64 nt, Homo Sapiens; identical to SEQ ID NO: 79035

SEQ ID NO: 177416 - RNA, 64 nt, Homo Sapiens; identical to SEQ ID NO: 79036

SEQ ID NO: 177417 - RNA, 64 nt, Homo Sapiens; identical to SEQ ID NO: 79037

SEQ ID NO: 177418 - RNA, 64 nt, Homo Sapiens; identical to SEQ ID NO: 79038

SEQ ID NO: 177419 - RNA, 64 nt, Homo Sapiens; identical to SEQ ID NO: 79039

SEQ ID NO: 177420 - RNA, 64 nt, Homo Sapiens; identical to SEQ ID NO: 79040

SEQ ID NO: 177421 - RNA, 64 nt, Homo Sapiens; identical to SEQ ID NO: 79041

SEQ ID NO: 177422 - RNA, 64 nt, Homo Sapiens; identical to SEQ ID NO: 79042

SEQ ID NO: 177423 - RNA, 64 nt, Homo Sapiens; identical to SEQ ID NO: 79043

SEQ ID NO: 177424 - RNA, 64 nt, Homo Sapiens; identical to SEQ ID NO: 79044

SEQ ID NO: 177425 - RNA, 64 nt, Homo Sapiens; identical to SEQ ID NO: 79045

SEQ ID NO: 177426 - RNA, 64 nt, Homo Sapiens; identical to SEQ ID NO: 79046

SEQ ID NO: 177427 - RNA, 64 nt, Homo Sapiens; identical to SEQ ID NO: 79047

SEQ ID NO: 177428 - RNA, 64 nt, Homo Sapiens; identical to SEQ ID NO: 79048

SEQ ID NO: 177429 - RNA, 64 nt, Homo Sapiens; identical to SEQ ID NO: 79049

SEQ ID NO: 177430 - RNA, 64 nt, Homo Sapiens; identical to SEQ ID NO: 79050

SEQ ID NO: 177431 - RNA, 64 nt, Homo Sapiens; identical to SEQ ID NO: 172495

SEQ ID NO: 177432 - RNA, 64 nt, Homo Sapiens; identical to SEQ ID NO: 172496

SEQ ID NO: 177433 - RNA, 64 nt, Homo Sapiens; identical to SEQ ID NO: 78937

SEQ ID NO: 177434 - RNA, 64 nt, Homo Sapiens; identical to SEQ ID NO: 78938

SEQ ID NO: 177435 - RNA, 64 nt, Homo Sapiens; identical to SEQ ID NO: 78939

SEQ ID NO: 177436 - RNA, 64 nt, Homo Sapiens; identical to SEQ ID NO: 78940

SEQ ID NO: 177437 - RNA, 64 nt, Homo Sapiens; identical to SEQ ID NO: 78941

SEQ ID NO: 177438 - RNA, 64 nt, Homo Sapiens; identical to SEQ ID NO: 78942

SEQ ID NO: 177439 - RNA, 64 nt, Homo Sapiens; identical to SEQ ID NO: 78943

SEQ ID NO: 177440 - RNA, 64 nt, Homo Sapiens; identical to SEQ ID NO: 78944

SEQ ID NO: 177441 - RNA, 64 nt, Homo Sapiens; identical to SEQ ID NO: 78945

SEQ ID NO: 177442 - RNA, 64 nt, Homo Sapiens; identical to SEQ ID NO: 78946

SEQ ID NO: 177443 - RNA, 64 nt, Homo Sapiens; identical to SEQ ID NO: 78947

SEQ ID NO: 177444 - RNA, 64 nt, Homo Sapiens; identical to SEQ ID NO: 78948

SEQ ID NO: 177445 - RNA, 64 nt, Homo Sapiens; identical to SEQ ID NO: 78949

SEQ ID NO: 177446 - RNA, 64 nt, Homo Sapiens; identical to SEQ ID NO: 78950

SEQ ID NO: 177447 - RNA, 64 nt, Homo Sapiens; identical to SEQ ID NO: 78951

SEQ ID NO: 177448 - RNA, 64 nt, Homo Sapiens; identical to SEQ ID NO: 78952

SEQ ID NO: 177449 - RNA, 64 nt, Homo Sapiens; identical to SEQ ID NO: 78953

SEQ ID NO: 177450 - RNA, 64 nt, Homo Sapiens; identical to SEQ ID NO: 78954

SEQ ID NO: 177451 - RNA, 64 nt, Homo Sapiens; identical to SEQ ID NO: 78955

SEQ ID NO: 177452 - RNA, 64 nt, Homo Sapiens; identical to SEQ ID NO: 78956

SEQ ID NO: 177453 - RNA, 64 nt, Homo Sapiens; identical to SEQ ID NO: 78957

SEQ ID NO: 177454 - RNA, 64 nt, Homo Sapiens; identical to SEQ ID NO: 78958

SEQ ID NO: 177455 - RNA, 64 nt, Homo Sapiens; identical to SEQ ID NO: 78959

SEQ ID NO: 177456 - RNA, 64 nt, Homo Sapiens; identical to SEQ ID NO: 78960

SEQ ID NO: 177457 - RNA, 64 nt, Homo Sapiens; identical to SEQ ID NO: 78961

SEQ ID NO: 177458 - RNA, 64 nt, Homo Sapiens; identical to SEQ ID NO: 78962

SEQ ID NO: 177459 - RNA, 64 nt, Homo Sapiens; identical to SEQ ID NO: 78963

SEQ ID NO: 177460 - RNA, 64 nt, Homo Sapiens; identical to SEQ ID NO: 78964

SEQ ID NO: 177461 - RNA, 64 nt, Homo Sapiens; identical to SEQ ID NO: 78965

SEQ ID NO: 177462 - RNA, 64 nt, Homo Sapiens; identical to SEQ ID NO: 78966

SEQ ID NO: 177463 - RNA, 64 nt, Homo Sapiens; identical to SEQ ID NO: 78967

SEQ ID NO: 177464 - RNA, 64 nt, Homo Sapiens; identical to SEQ ID NO: 78968

SEQ ID NO: 177465 - RNA, 64 nt, Homo Sapiens; identical to SEQ ID NO: 78969

SEQ ID NO: 177466 - RNA, 64 nt, Homo Sapiens; identical to SEQ ID NO: 78970

SEQ ID NO: 177467 - RNA, 64 nt, Homo Sapiens; identical to SEQ ID NO: 78971

SEQ ID NO: 177468 - RNA, 64 nt, Homo Sapiens; identical to SEQ ID NO: 78972

SEQ ID NO: 177469 - RNA, 64 nt, Homo Sapiens; identical to SEQ ID NO: 78973

SEQ ID NO: 177470 - RNA, 64 nt, Homo Sapiens; identical to SEQ ID NO: 78974

SEQ ID NO: 177471 - RNA, 64 nt, Homo Sapiens; identical to SEQ ID NO: 78975

SEQ ID NO: 177472 - RNA, 64 nt, Homo Sapiens; identical to SEQ ID NO: 78976

SEQ ID NO: 177473 - RNA, 64 nt, Homo Sapiens; identical to SEQ ID NO: 78977

SEQ ID NO: 177474 - RNA, 64 nt, Homo Sapiens; identical to SEQ ID NO: 78978

SEQ ID NO: 177475 - RNA, 64 nt, Homo Sapiens; identical to SEQ ID NO: 78979

SEQ ID NO: 177476 - RNA, 64 nt, Homo Sapiens; identical to SEQ ID NO: 78980

SEQ ID NO: 177477 - RNA, 64 nt, Homo Sapiens; identical to SEQ ID NO: 78981

SEQ ID NO: 177478 - RNA, 64 nt, Homo Sapiens; identical to SEQ ID NO: 78982

SEQ ID NO: 177479 - RNA, 64 nt, Homo Sapiens; identical to SEQ ID NO: 78983

SEQ ID NO: 177480 - RNA, 64 nt, Homo Sapiens; identical to SEQ ID NO: 78984

SEQ ID NO: 177481 - RNA, 64 nt, Homo Sapiens; identical to SEQ ID NO: 78985

SEQ ID NO: 177482 - RNA, 64 nt, Homo Sapiens; identical to SEQ ID NO: 78986

SEQ ID NO: 177483 - RNA, 64 nt, Homo Sapiens; identical to SEQ ID NO: 78987

SEQ ID NO: 177484 - RNA, 64 nt, Homo Sapiens; identical to SEQ ID NO: 78988

SEQ ID NO: 177485 - RNA, 64 nt, Homo Sapiens; identical to SEQ ID NO: 78989

SEQ ID NO: 177486 - RNA, 64 nt, Homo Sapiens; identical to SEQ ID NO: 78990

SEQ ID NO: 177487 - RNA, 64 nt, Homo Sapiens; identical to SEQ ID NO: 78991

SEQ ID NO: 177488 - RNA, 64 nt, Homo Sapiens; identical to SEQ ID NO: 78992

SEQ ID NO: 177489 - RNA, 64 nt, Homo Sapiens; identical to SEQ ID NO: 78993

SEQ ID NO: 177490 - RNA, 64 nt, Homo Sapiens; identical to SEQ ID NO: 78994

SEQ ID NO: 177491 - RNA, 64 nt, Homo Sapiens; identical to SEQ ID NO: 78995

SEQ ID NO: 177492 - RNA, 64 nt, Homo Sapiens; identical to SEQ ID NO: 78996

SEQ ID NO: 177493 - RNA, 64 nt, Homo Sapiens; identical to SEQ ID NO: 78997

SEQ ID NO: 177494 - RNA, 64 nt, Homo Sapiens; identical to SEQ ID NO: 78998

SEQ ID NO: 177495 - RNA, 64 nt, Homo Sapiens; identical to SEQ ID NO: 78999

SEQ ID NO: 177496 - RNA, 64 nt, Homo Sapiens; identical to SEQ ID NO: 79000

SEQ ID NO: 177497 - RNA, 64 nt, Homo Sapiens; identical to SEQ ID NO: 79001

SEQ ID NO: 177498 - RNA, 64 nt, Homo Sapiens; identical to SEQ ID NO: 79002

SEQ ID NO: 177499 - RNA, 64 nt, Homo Sapiens; identical to SEQ ID NO: 79003

SEQ ID NO: 177500 - RNA, 64 nt, Homo Sapiens; identical to SEQ ID NO: 79004

SEQ ID NO: 177501 - RNA, 64 nt, Homo Sapiens; identical to SEQ ID NO: 79005

SEQ ID NO: 177502 - RNA, 64 nt, Homo Sapiens; identical to SEQ ID NO: 79006

SEQ ID NO: 177503 - RNA, 64 nt, Homo Sapiens; identical to SEQ ID NO: 79007

SEQ ID NO: 177504 - RNA, 64 nt, Homo Sapiens; identical to SEQ ID NO: 79008

SEQ ID NO: 177505 - RNA, 64 nt, Homo Sapiens; identical to SEQ ID NO: 79009

SEQ ID NO: 177506 - RNA, 64 nt, Homo Sapiens; identical to SEQ ID NO: 79010

SEQ ID NO: 177507 - RNA, 64 nt, Homo Sapiens; identical to SEQ ID NO: 79011

SEQ ID NO: 177508 - RNA, 64 nt, Homo Sapiens; identical to SEQ ID NO: 79012

SEQ ID NO: 177509 - RNA, 64 nt, Homo Sapiens; identical to SEQ ID NO: 79013

SEQ ID NO: 177510 - RNA, 64 nt, Homo Sapiens; identical to SEQ ID NO: 79014

SEQ ID NO: 177511 - RNA, 64 nt, Homo Sapiens; identical to SEQ ID NO: 79015

SEQ ID NO: 177512 - RNA, 64 nt, Homo Sapiens; identical to SEQ ID NO: 79016

SEQ ID NO: 177513 - RNA, 64 nt, Homo Sapiens; identical to SEQ ID NO: 79017

SEQ ID NO: 177514 - RNA, 64 nt, Homo Sapiens; identical to SEQ ID NO: 79018

SEQ ID NO: 177515 - RNA, 64 nt, Homo Sapiens; identical to SEQ ID NO: 79019

SEQ ID NO: 177516 - RNA, 64 nt, Homo Sapiens; identical to SEQ ID NO: 79020

SEQ ID NO: 177517 - RNA, 64 nt, Homo Sapiens; identical to SEQ ID NO: 79021

SEQ ID NO: 177518 - RNA, 64 nt, Homo Sapiens; identical to SEQ ID NO: 79022

SEQ ID NO: 177519 - RNA, 64 nt, Homo Sapiens; identical to SEQ ID NO: 79023

SEQ ID NO: 177520 - RNA, 64 nt, Homo Sapiens; identical to SEQ ID NO: 79024

SEQ ID NO: 177521 - RNA, 64 nt, Homo Sapiens; identical to SEQ ID NO: 79025

SEQ ID NO: 177522 - RNA, 64 nt, Homo Sapiens; identical to SEQ ID NO: 79026

SEQ ID NO: 177523 - RNA, 64 nt, Homo Sapiens; identical to SEQ ID NO: 79027

SEQ ID NO: 177524 - RNA, 64 nt, Homo Sapiens; identical to SEQ ID NO: 79028

SEQ ID NO: 177525 - RNA, 64 nt, Homo Sapiens; identical to SEQ ID NO: 79029

SEQ ID NO: 177526 - RNA, 64 nt, Homo Sapiens; identical to SEQ ID NO: 79030

SEQ ID NO: 177527 - RNA, 64 nt, Homo Sapiens; identical to SEQ ID NO: 79031

SEQ ID NO: 177528 - RNA, 64 nt, Homo Sapiens; identical to SEQ ID NO: 79032

SEQ ID NO: 177529 - RNA, 64 nt, Homo Sapiens; identical to SEQ ID NO: 79033

SEQ ID NO: 177530 - RNA, 64 nt, Homo Sapiens; identical to SEQ ID NO: 79034

SEQ ID NO: 177531 - RNA, 64 nt, Homo Sapiens; identical to SEQ ID NO: 79035

SEQ ID NO: 177532 - RNA, 64 nt, Homo Sapiens; identical to SEQ ID NO: 79036

SEQ ID NO: 177533 - RNA, 64 nt, Homo Sapiens; identical to SEQ ID NO: 79037

SEQ ID NO: 177534 - RNA, 64 nt, Homo Sapiens; identical to SEQ ID NO: 79038

SEQ ID NO: 177535 - RNA, 64 nt, Homo Sapiens; identical to SEQ ID NO: 79039

SEQ ID NO: 177536 - RNA, 64 nt, Homo Sapiens; identical to SEQ ID NO: 79040

SEQ ID NO: 177537 - RNA, 64 nt, Homo Sapiens; identical to SEQ ID NO: 79041

SEQ ID NO: 177538 - RNA, 64 nt, Homo Sapiens; identical to SEQ ID NO: 79042

SEQ ID NO: 177539 - RNA, 64 nt, Homo Sapiens; identical to SEQ ID NO: 79043

SEQ ID NO: 177540 - RNA, 64 nt, Homo Sapiens; identical to SEQ ID NO: 79044

SEQ ID NO: 177541 - RNA, 64 nt, Homo Sapiens; identical to SEQ ID NO: 79045

SEQ ID NO: 177542 - RNA, 64 nt, Homo Sapiens; identical to SEQ ID NO: 79046

SEQ ID NO: 177543 - RNA, 64 nt, Homo Sapiens; identical to SEQ ID NO: 79047

SEQ ID NO: 177544 - RNA, 64 nt, Homo Sapiens; identical to SEQ ID NO: 79048

SEQ ID NO: 177545 - RNA, 64 nt, Homo Sapiens; identical to SEQ ID NO: 79049

SEQ ID NO: 177546 - RNA, 64 nt, Homo Sapiens; identical to SEQ ID NO: 79050

SEQ ID NO: 177547 - RNA, 64 nt, Homo Sapiens; identical to SEQ ID NO: 172495

SEQ ID NO: 177548 - RNA, 64 nt, Homo Sapiens; identical to SEQ ID NO: 172496

SEQ ID NO: 177549 - RNA, 64 nt, Homo Sapiens; identical to SEQ ID NO: 78937

SEQ ID NO: 177550 - RNA, 64 nt, Homo Sapiens; identical to SEQ ID NO: 78938

SEQ ID NO: 177551 - RNA, 64 nt, Homo Sapiens; identical to SEQ ID NO: 78939

SEQ ID NO: 177552 - RNA, 64 nt, Homo Sapiens; identical to SEQ ID NO: 78940

SEQ ID NO: 177553 - RNA, 64 nt, Homo Sapiens; identical to SEQ ID NO: 78941

SEQ ID NO: 177554 - RNA, 64 nt, Homo Sapiens; identical to SEQ ID NO: 78942

SEQ ID NO: 177555 - RNA, 64 nt, Homo Sapiens; identical to SEQ ID NO: 78943

SEQ ID NO: 177556 - RNA, 64 nt, Homo Sapiens; identical to SEQ ID NO: 78944

SEQ ID NO: 177557 - RNA, 64 nt, Homo Sapiens; identical to SEQ ID NO: 78945

SEQ ID NO: 177558 - RNA, 64 nt, Homo Sapiens; identical to SEQ ID NO: 78946

SEQ ID NO: 177559 - RNA, 64 nt, Homo Sapiens; identical to SEQ ID NO: 78947

SEQ ID NO: 177560 - RNA, 64 nt, Homo Sapiens; identical to SEQ ID NO: 78948

SEQ ID NO: 177561 - RNA, 64 nt, Homo Sapiens; identical to SEQ ID NO: 78949

SEQ ID NO: 177562 - RNA, 64 nt, Homo Sapiens; identical to SEQ ID NO: 78950

SEQ ID NO: 177563 - RNA, 64 nt, Homo Sapiens; identical to SEQ ID NO: 78951

SEQ ID NO: 177564 - RNA, 64 nt, Homo Sapiens; identical to SEQ ID NO: 78952

SEQ ID NO: 177565 - RNA, 64 nt, Homo Sapiens; identical to SEQ ID NO: 78953

SEQ ID NO: 177566 - RNA, 64 nt, Homo Sapiens; identical to SEQ ID NO: 78954

SEQ ID NO: 177567 - RNA, 64 nt, Homo Sapiens; identical to SEQ ID NO: 78955

SEQ ID NO: 177568 - RNA, 64 nt, Homo Sapiens; identical to SEQ ID NO: 78956

SEQ ID NO: 177569 - RNA, 64 nt, Homo Sapiens; identical to SEQ ID NO: 78957

SEQ ID NO: 177570 - RNA, 64 nt, Homo Sapiens; identical to SEQ ID NO: 78958

SEQ ID NO: 177571 - RNA, 64 nt, Homo Sapiens; identical to SEQ ID NO: 78959

SEQ ID NO: 177572 - RNA, 64 nt, Homo Sapiens; identical to SEQ ID NO: 78960

SEQ ID NO: 177573 - RNA, 64 nt, Homo Sapiens; identical to SEQ ID NO: 78961

SEQ ID NO: 177574 - RNA, 64 nt, Homo Sapiens; identical to SEQ ID NO: 78962

SEQ ID NO: 177575 - RNA, 64 nt, Homo Sapiens; identical to SEQ ID NO: 78963

SEQ ID NO: 177576 - RNA, 64 nt, Homo Sapiens; identical to SEQ ID NO: 78964

SEQ ID NO: 177577 - RNA, 64 nt, Homo Sapiens; identical to SEQ ID NO: 78965

SEQ ID NO: 177578 - RNA, 64 nt, Homo Sapiens; identical to SEQ ID NO: 78966

SEQ ID NO: 177579 - RNA, 64 nt, Homo Sapiens; identical to SEQ ID NO: 78967

SEQ ID NO: 177580 - RNA, 64 nt, Homo Sapiens; identical to SEQ ID NO: 78968

SEQ ID NO: 177581 - RNA, 64 nt, Homo Sapiens; identical to SEQ ID NO: 78969

SEQ ID NO: 177582 - RNA, 64 nt, Homo Sapiens; identical to SEQ ID NO: 78970

SEQ ID NO: 177583 - RNA, 64 nt, Homo Sapiens; identical to SEQ ID NO: 78971

SEQ ID NO: 177584 - RNA, 64 nt, Homo Sapiens; identical to SEQ ID NO: 78972

SEQ ID NO: 177585 - RNA, 64 nt, Homo Sapiens; identical to SEQ ID NO: 78973

SEQ ID NO: 177586 - RNA, 64 nt, Homo Sapiens; identical to SEQ ID NO: 78974

SEQ ID NO: 177587 - RNA, 64 nt, Homo Sapiens; identical to SEQ ID NO: 78975

SEQ ID NO: 177588 - RNA, 64 nt, Homo Sapiens; identical to SEQ ID NO: 78976

SEQ ID NO: 177589 - RNA, 64 nt, Homo Sapiens; identical to SEQ ID NO: 78977

SEQ ID NO: 177590 - RNA, 64 nt, Homo Sapiens; identical to SEQ ID NO: 78978

SEQ ID NO: 177591 - RNA, 64 nt, Homo Sapiens; identical to SEQ ID NO: 78979

SEQ ID NO: 177592 - RNA, 64 nt, Homo Sapiens; identical to SEQ ID NO: 78980

SEQ ID NO: 177593 - RNA, 64 nt, Homo Sapiens; identical to SEQ ID NO: 78981

SEQ ID NO: 177594 - RNA, 64 nt, Homo Sapiens; identical to SEQ ID NO: 78982

SEQ ID NO: 177595 - RNA, 64 nt, Homo Sapiens; identical to SEQ ID NO: 78983

SEQ ID NO: 177596 - RNA, 64 nt, Homo Sapiens; identical to SEQ ID NO: 78984

SEQ ID NO: 177597 - RNA, 64 nt, Homo Sapiens; identical to SEQ ID NO: 78985

SEQ ID NO: 177598 - RNA, 64 nt, Homo Sapiens; identical to SEQ ID NO: 78986

SEQ ID NO: 177599 - RNA, 64 nt, Homo Sapiens; identical to SEQ ID NO: 78987

SEQ ID NO: 177600 - RNA, 64 nt, Homo Sapiens; identical to SEQ ID NO: 78988

SEQ ID NO: 177601 - RNA, 64 nt, Homo Sapiens; identical to SEQ ID NO: 78989

SEQ ID NO: 177602 - RNA, 64 nt, Homo Sapiens; identical to SEQ ID NO: 78990

SEQ ID NO: 177603 - RNA, 64 nt, Homo Sapiens; identical to SEQ ID NO: 78991

SEQ ID NO: 177604 - RNA, 64 nt, Homo Sapiens; identical to SEQ ID NO: 78992

SEQ ID NO: 177605 - RNA, 64 nt, Homo Sapiens; identical to SEQ ID NO: 78993

SEQ ID NO: 177606 - RNA, 64 nt, Homo Sapiens; identical to SEQ ID NO: 78994

SEQ ID NO: 177607 - RNA, 64 nt, Homo Sapiens; identical to SEQ ID NO: 78995

SEQ ID NO: 177608 - RNA, 64 nt, Homo Sapiens; identical to SEQ ID NO: 78996

SEQ ID NO: 177609 - RNA, 64 nt, Homo Sapiens; identical to SEQ ID NO: 78997

SEQ ID NO: 177610 - RNA, 64 nt, Homo Sapiens; identical to SEQ ID NO: 78998

SEQ ID NO: 177611 - RNA, 64 nt, Homo Sapiens; identical to SEQ ID NO: 78999

SEQ ID NO: 177612 - RNA, 64 nt, Homo Sapiens; identical to SEQ ID NO: 79000

SEQ ID NO: 177613 - RNA, 64 nt, Homo Sapiens; identical to SEQ ID NO: 79001

SEQ ID NO: 177614 - RNA, 64 nt, Homo Sapiens; identical to SEQ ID NO: 79002

SEQ ID NO: 177615 - RNA, 64 nt, Homo Sapiens; identical to SEQ ID NO: 79003

SEQ ID NO: 177616 - RNA, 64 nt, Homo Sapiens; identical to SEQ ID NO: 79004

SEQ ID NO: 177617 - RNA, 64 nt, Homo Sapiens; identical to SEQ ID NO: 79005

SEQ ID NO: 177618 - RNA, 64 nt, Homo Sapiens; identical to SEQ ID NO: 79006

SEQ ID NO: 177619 - RNA, 64 nt, Homo Sapiens; identical to SEQ ID NO: 79007

SEQ ID NO: 177620 - RNA, 64 nt, Homo Sapiens; identical to SEQ ID NO: 79008

SEQ ID NO: 177621 - RNA, 64 nt, Homo Sapiens; identical to SEQ ID NO: 79009

SEQ ID NO: 177622 - RNA, 64 nt, Homo Sapiens; identical to SEQ ID NO: 79010

SEQ ID NO: 177623 - RNA, 64 nt, Homo Sapiens; identical to SEQ ID NO: 79011

SEQ ID NO: 177624 - RNA, 64 nt, Homo Sapiens; identical to SEQ ID NO: 79012

SEQ ID NO: 177625 - RNA, 64 nt, Homo Sapiens; identical to SEQ ID NO: 79013

SEQ ID NO: 177626 - RNA, 64 nt, Homo Sapiens; identical to SEQ ID NO: 79014

SEQ ID NO: 177627 - RNA, 64 nt, Homo Sapiens; identical to SEQ ID NO: 79015

SEQ ID NO: 177628 - RNA, 64 nt, Homo Sapiens; identical to SEQ ID NO: 79016

SEQ ID NO: 177629 - RNA, 64 nt, Homo Sapiens; identical to SEQ ID NO: 79017

SEQ ID NO: 177630 - RNA, 64 nt, Homo Sapiens; identical to SEQ ID NO: 79018

SEQ ID NO: 177631 - RNA, 64 nt, Homo Sapiens; identical to SEQ ID NO: 79019

SEQ ID NO: 177632 - RNA, 64 nt, Homo Sapiens; identical to SEQ ID NO: 79020

SEQ ID NO: 177633 - RNA, 64 nt, Homo Sapiens; identical to SEQ ID NO: 79021

SEQ ID NO: 177634 - RNA, 64 nt, Homo Sapiens; identical to SEQ ID NO: 79022

SEQ ID NO: 177635 - RNA, 64 nt, Homo Sapiens; identical to SEQ ID NO: 79023

SEQ ID NO: 177636 - RNA, 64 nt, Homo Sapiens; identical to SEQ ID NO: 79024

SEQ ID NO: 177637 - RNA, 64 nt, Homo Sapiens; identical to SEQ ID NO: 79025

SEQ ID NO: 177638 - RNA, 64 nt, Homo Sapiens; identical to SEQ ID NO: 79026

SEQ ID NO: 177639 - RNA, 64 nt, Homo Sapiens; identical to SEQ ID NO: 79027

SEQ ID NO: 177640 - RNA, 64 nt, Homo Sapiens; identical to SEQ ID NO: 79028

SEQ ID NO: 177641 - RNA, 64 nt, Homo Sapiens; identical to SEQ ID NO: 79029

SEQ ID NO: 177642 - RNA, 64 nt, Homo Sapiens; identical to SEQ ID NO: 79030

SEQ ID NO: 177643 - RNA, 64 nt, Homo Sapiens; identical to SEQ ID NO: 79031

SEQ ID NO: 177644 - RNA, 64 nt, Homo Sapiens; identical to SEQ ID NO: 79032

SEQ ID NO: 177645 - RNA, 64 nt, Homo Sapiens; identical to SEQ ID NO: 79033

SEQ ID NO: 177646 - RNA, 64 nt, Homo Sapiens; identical to SEQ ID NO: 79034

SEQ ID NO: 177647 - RNA, 64 nt, Homo Sapiens; identical to SEQ ID NO: 79035

SEQ ID NO: 177648 - RNA, 64 nt, Homo Sapiens; identical to SEQ ID NO: 79036

SEQ ID NO: 177649 - RNA, 64 nt, Homo Sapiens; identical to SEQ ID NO: 79037

SEQ ID NO: 177650 - RNA, 64 nt, Homo Sapiens; identical to SEQ ID NO: 79038

SEQ ID NO: 177651 - RNA, 64 nt, Homo Sapiens; identical to SEQ ID NO: 79039

SEQ ID NO: 177652 - RNA, 64 nt, Homo Sapiens; identical to SEQ ID NO: 79040

SEQ ID NO: 177653 - RNA, 64 nt, Homo Sapiens; identical to SEQ ID NO: 79041

SEQ ID NO: 177654 - RNA, 64 nt, Homo Sapiens; identical to SEQ ID NO: 79042

SEQ ID NO: 177655 - RNA, 64 nt, Homo Sapiens; identical to SEQ ID NO: 79043

SEQ ID NO: 177656 - RNA, 64 nt, Homo Sapiens; identical to SEQ ID NO: 79044

SEQ ID NO: 177657 - RNA, 64 nt, Homo Sapiens; identical to SEQ ID NO: 79045

SEQ ID NO: 177658 - RNA, 64 nt, Homo Sapiens; identical to SEQ ID NO: 79046

SEQ ID NO: 177659 - RNA, 64 nt, Homo Sapiens; identical to SEQ ID NO: 79047

SEQ ID NO: 177660 - RNA, 64 nt, Homo Sapiens; identical to SEQ ID NO: 79048

SEQ ID NO: 177661 - RNA, 64 nt, Homo Sapiens; identical to SEQ ID NO: 79049

SEQ ID NO: 177662 - RNA, 64 nt, Homo Sapiens; identical to SEQ ID NO: 79050

SEQ ID NO: 177663 - RNA, 64 nt, Homo Sapiens; identical to SEQ ID NO: 172495

SEQ ID NO: 177664 - RNA, 64 nt, Homo Sapiens; identical to SEQ ID NO: 172496

SEQ ID NO: 177665 - RNA, 64 nt, Homo Sapiens; identical to SEQ ID NO: 78937

SEQ ID NO: 177666 - RNA, 64 nt, Homo Sapiens; identical to SEQ ID NO: 78938

SEQ ID NO: 177667 - RNA, 64 nt, Homo Sapiens; identical to SEQ ID NO: 78939

SEQ ID NO: 177668 - RNA, 64 nt, Homo Sapiens; identical to SEQ ID NO: 78940

SEQ ID NO: 177669 - RNA, 64 nt, Homo Sapiens; identical to SEQ ID NO: 78941

SEQ ID NO: 177670 - RNA, 64 nt, Homo Sapiens; identical to SEQ ID NO: 78942

SEQ ID NO: 177671 - RNA, 64 nt, Homo Sapiens; identical to SEQ ID NO: 78943

SEQ ID NO: 177672 - RNA, 64 nt, Homo Sapiens; identical to SEQ ID NO: 78944

SEQ ID NO: 177673 - RNA, 64 nt, Homo Sapiens; identical to SEQ ID NO: 78945

SEQ ID NO: 177674 - RNA, 64 nt, Homo Sapiens; identical to SEQ ID NO: 78946

SEQ ID NO: 177675 - RNA, 64 nt, Homo Sapiens; identical to SEQ ID NO: 78947

SEQ ID NO: 177676 - RNA, 64 nt, Homo Sapiens; identical to SEQ ID NO: 78948

SEQ ID NO: 177677 - RNA, 64 nt, Homo Sapiens; identical to SEQ ID NO: 78949

SEQ ID NO: 177678 - RNA, 64 nt, Homo Sapiens; identical to SEQ ID NO: 78950

SEQ ID NO: 177679 - RNA, 64 nt, Homo Sapiens; identical to SEQ ID NO: 78951

SEQ ID NO: 177680 - RNA, 64 nt, Homo Sapiens; identical to SEQ ID NO: 78952

SEQ ID NO: 177681 - RNA, 64 nt, Homo Sapiens; identical to SEQ ID NO: 78953

SEQ ID NO: 177682 - RNA, 64 nt, Homo Sapiens; identical to SEQ ID NO: 78954

SEQ ID NO: 177683 - RNA, 64 nt, Homo Sapiens; identical to SEQ ID NO: 78955

SEQ ID NO: 177684 - RNA, 64 nt, Homo Sapiens; identical to SEQ ID NO: 78956

SEQ ID NO: 177685 - RNA, 64 nt, Homo Sapiens; identical to SEQ ID NO: 78957

SEQ ID NO: 177686 - RNA, 64 nt, Homo Sapiens; identical to SEQ ID NO: 78958

SEQ ID NO: 177687 - RNA, 64 nt, Homo Sapiens; identical to SEQ ID NO: 78959

SEQ ID NO: 177688 - RNA, 64 nt, Homo Sapiens; identical to SEQ ID NO: 78960

SEQ ID NO: 177689 - RNA, 64 nt, Homo Sapiens; identical to SEQ ID NO: 78961

SEQ ID NO: 177690 - RNA, 64 nt, Homo Sapiens; identical to SEQ ID NO: 78962

SEQ ID NO: 177691 - RNA, 64 nt, Homo Sapiens; identical to SEQ ID NO: 78963

SEQ ID NO: 177692 - RNA, 64 nt, Homo Sapiens; identical to SEQ ID NO: 78964

SEQ ID NO: 177693 - RNA, 64 nt, Homo Sapiens; identical to SEQ ID NO: 78965

SEQ ID NO: 177694 - RNA, 64 nt, Homo Sapiens; identical to SEQ ID NO: 78966

SEQ ID NO: 177695 - RNA, 64 nt, Homo Sapiens; identical to SEQ ID NO: 78967

SEQ ID NO: 177696 - RNA, 64 nt, Homo Sapiens; identical to SEQ ID NO: 78968

SEQ ID NO: 177697 - RNA, 64 nt, Homo Sapiens; identical to SEQ ID NO: 78969

SEQ ID NO: 177698 - RNA, 64 nt, Homo Sapiens; identical to SEQ ID NO: 78970

SEQ ID NO: 177699 - RNA, 64 nt, Homo Sapiens; identical to SEQ ID NO: 78971

SEQ ID NO: 177700 - RNA, 64 nt, Homo Sapiens; identical to SEQ ID NO: 78972

SEQ ID NO: 177701 - RNA, 64 nt, Homo Sapiens; identical to SEQ ID NO: 78973

SEQ ID NO: 177702 - RNA, 64 nt, Homo Sapiens; identical to SEQ ID NO: 78974

SEQ ID NO: 177703 - RNA, 64 nt, Homo Sapiens; identical to SEQ ID NO: 78975

SEQ ID NO: 177704 - RNA, 64 nt, Homo Sapiens; identical to SEQ ID NO: 78976

SEQ ID NO: 177705 - RNA, 64 nt, Homo Sapiens; identical to SEQ ID NO: 78977

SEQ ID NO: 177706 - RNA, 64 nt, Homo Sapiens; identical to SEQ ID NO: 78978

SEQ ID NO: 177707 - RNA, 64 nt, Homo Sapiens; identical to SEQ ID NO: 78979

SEQ ID NO: 177708 - RNA, 64 nt, Homo Sapiens; identical to SEQ ID NO: 78980

SEQ ID NO: 177709 - RNA, 64 nt, Homo Sapiens; identical to SEQ ID NO: 78981

SEQ ID NO: 177710 - RNA, 64 nt, Homo Sapiens; identical to SEQ ID NO: 78982

SEQ ID NO: 177711 - RNA, 64 nt, Homo Sapiens; identical to SEQ ID NO: 78983

SEQ ID NO: 177712 - RNA, 64 nt, Homo Sapiens; identical to SEQ ID NO: 78984

SEQ ID NO: 177713 - RNA, 64 nt, Homo Sapiens; identical to SEQ ID NO: 78985

SEQ ID NO: 177714 - RNA, 64 nt, Homo Sapiens; identical to SEQ ID NO: 78986

SEQ ID NO: 177715 - RNA, 64 nt, Homo Sapiens; identical to SEQ ID NO: 78987

SEQ ID NO: 177716 - RNA, 64 nt, Homo Sapiens; identical to SEQ ID NO: 78988

SEQ ID NO: 177717 - RNA, 64 nt, Homo Sapiens; identical to SEQ ID NO: 78989

SEQ ID NO: 177718 - RNA, 64 nt, Homo Sapiens; identical to SEQ ID NO: 78990

SEQ ID NO: 177719 - RNA, 64 nt, Homo Sapiens; identical to SEQ ID NO: 78991

SEQ ID NO: 177720 - RNA, 64 nt, Homo Sapiens; identical to SEQ ID NO: 78992

SEQ ID NO: 177721 - RNA, 64 nt, Homo Sapiens; identical to SEQ ID NO: 78993

SEQ ID NO: 177722 - RNA, 64 nt, Homo Sapiens; identical to SEQ ID NO: 78994

SEQ ID NO: 177723 - RNA, 64 nt, Homo Sapiens; identical to SEQ ID NO: 78995

SEQ ID NO: 177724 - RNA, 64 nt, Homo Sapiens; identical to SEQ ID NO: 78996

SEQ ID NO: 177725 - RNA, 64 nt, Homo Sapiens; identical to SEQ ID NO: 78997

SEQ ID NO: 177726 - RNA, 64 nt, Homo Sapiens; identical to SEQ ID NO: 78998

SEQ ID NO: 177727 - RNA, 64 nt, Homo Sapiens; identical to SEQ ID NO: 78999

SEQ ID NO: 177728 - RNA, 64 nt, Homo Sapiens; identical to SEQ ID NO: 79000

SEQ ID NO: 177729 - RNA, 64 nt, Homo Sapiens; identical to SEQ ID NO: 79001

SEQ ID NO: 177730 - RNA, 64 nt, Homo Sapiens; identical to SEQ ID NO: 79002

SEQ ID NO: 177731 - RNA, 64 nt, Homo Sapiens; identical to SEQ ID NO: 79003

SEQ ID NO: 177732 - RNA, 64 nt, Homo Sapiens; identical to SEQ ID NO: 79004

SEQ ID NO: 177733 - RNA, 64 nt, Homo Sapiens; identical to SEQ ID NO: 79005

SEQ ID NO: 177734 - RNA, 64 nt, Homo Sapiens; identical to SEQ ID NO: 79006

SEQ ID NO: 177735 - RNA, 64 nt, Homo Sapiens; identical to SEQ ID NO: 79007

SEQ ID NO: 177736 - RNA, 64 nt, Homo Sapiens; identical to SEQ ID NO: 79008

SEQ ID NO: 177737 - RNA, 64 nt, Homo Sapiens; identical to SEQ ID NO: 79009

SEQ ID NO: 177738 - RNA, 64 nt, Homo Sapiens; identical to SEQ ID NO: 79010

SEQ ID NO: 177739 - RNA, 64 nt, Homo Sapiens; identical to SEQ ID NO: 79011

SEQ ID NO: 177740 - RNA, 64 nt, Homo Sapiens; identical to SEQ ID NO: 79012

SEQ ID NO: 177741 - RNA, 64 nt, Homo Sapiens; identical to SEQ ID NO: 79013

SEQ ID NO: 177742 - RNA, 64 nt, Homo Sapiens; identical to SEQ ID NO: 79014

SEQ ID NO: 177743 - RNA, 64 nt, Homo Sapiens; identical to SEQ ID NO: 79015

SEQ ID NO: 177744 - RNA, 64 nt, Homo Sapiens; identical to SEQ ID NO: 79016

SEQ ID NO: 177745 - RNA, 64 nt, Homo Sapiens; identical to SEQ ID NO: 79017

SEQ ID NO: 177746 - RNA, 64 nt, Homo Sapiens; identical to SEQ ID NO: 79018

SEQ ID NO: 177747 - RNA, 64 nt, Homo Sapiens; identical to SEQ ID NO: 79019

SEQ ID NO: 177748 - RNA, 64 nt, Homo Sapiens; identical to SEQ ID NO: 79020

SEQ ID NO: 177749 - RNA, 64 nt, Homo Sapiens; identical to SEQ ID NO: 79021

SEQ ID NO: 177750 - RNA, 64 nt, Homo Sapiens; identical to SEQ ID NO: 79022

SEQ ID NO: 177751 - RNA, 64 nt, Homo Sapiens; identical to SEQ ID NO: 79023

SEQ ID NO: 177752 - RNA, 64 nt, Homo Sapiens; identical to SEQ ID NO: 79024

SEQ ID NO: 177753 - RNA, 64 nt, Homo Sapiens; identical to SEQ ID NO: 79025

SEQ ID NO: 177754 - RNA, 64 nt, Homo Sapiens; identical to SEQ ID NO: 79026

SEQ ID NO: 177755 - RNA, 64 nt, Homo Sapiens; identical to SEQ ID NO: 79027

SEQ ID NO: 177756 - RNA, 64 nt, Homo Sapiens; identical to SEQ ID NO: 79028

SEQ ID NO: 177757 - RNA, 64 nt, Homo Sapiens; identical to SEQ ID NO: 79029

SEQ ID NO: 177758 - RNA, 64 nt, Homo Sapiens; identical to SEQ ID NO: 79030

SEQ ID NO: 177759 - RNA, 64 nt, Homo Sapiens; identical to SEQ ID NO: 79031

SEQ ID NO: 177760 - RNA, 64 nt, Homo Sapiens; identical to SEQ ID NO: 79032

SEQ ID NO: 177761 - RNA, 64 nt, Homo Sapiens; identical to SEQ ID NO: 79033

SEQ ID NO: 177762 - RNA, 64 nt, Homo Sapiens; identical to SEQ ID NO: 79034

SEQ ID NO: 177763 - RNA, 64 nt, Homo Sapiens; identical to SEQ ID NO: 79035

SEQ ID NO: 177764 - RNA, 64 nt, Homo Sapiens; identical to SEQ ID NO: 79036

SEQ ID NO: 177765 - RNA, 64 nt, Homo Sapiens; identical to SEQ ID NO: 79037

SEQ ID NO: 177766 - RNA, 64 nt, Homo Sapiens; identical to SEQ ID NO: 79038

SEQ ID NO: 177767 - RNA, 64 nt, Homo Sapiens; identical to SEQ ID NO: 79039

SEQ ID NO: 177768 - RNA, 64 nt, Homo Sapiens; identical to SEQ ID NO: 79040

SEQ ID NO: 177769 - RNA, 64 nt, Homo Sapiens; identical to SEQ ID NO: 79041

SEQ ID NO: 177770 - RNA, 64 nt, Homo Sapiens; identical to SEQ ID NO: 79042

SEQ ID NO: 177771 - RNA, 64 nt, Homo Sapiens; identical to SEQ ID NO: 79043

SEQ ID NO: 177772 - RNA, 64 nt, Homo Sapiens; identical to SEQ ID NO: 79044

SEQ ID NO: 177773 - RNA, 64 nt, Homo Sapiens; identical to SEQ ID NO: 79045

SEQ ID NO: 177774 - RNA, 64 nt, Homo Sapiens; identical to SEQ ID NO: 79046

SEQ ID NO: 177775 - RNA, 64 nt, Homo Sapiens; identical to SEQ ID NO: 79047

SEQ ID NO: 177776 - RNA, 64 nt, Homo Sapiens; identical to SEQ ID NO: 79048

SEQ ID NO: 177777 - RNA, 64 nt, Homo Sapiens; identical to SEQ ID NO: 79049

SEQ ID NO: 177778 - RNA, 64 nt, Homo Sapiens; identical to SEQ ID NO: 79050

SEQ ID NO: 177779 - RNA, 64 nt, Homo Sapiens; identical to SEQ ID NO: 172495

SEQ ID NO: 177780 - RNA, 64 nt, Homo Sapiens; identical to SEQ ID NO: 172496

SEQ ID NO: 177781 - RNA, 64 nt, Homo Sapiens; identical to SEQ ID NO: 78937

SEQ ID NO: 177782 - RNA, 64 nt, Homo Sapiens; identical to SEQ ID NO: 78938

SEQ ID NO: 177783 - RNA, 64 nt, Homo Sapiens; identical to SEQ ID NO: 78939

SEQ ID NO: 177784 - RNA, 64 nt, Homo Sapiens; identical to SEQ ID NO: 78940

SEQ ID NO: 177785 - RNA, 64 nt, Homo Sapiens; identical to SEQ ID NO: 78941

SEQ ID NO: 177786 - RNA, 64 nt, Homo Sapiens; identical to SEQ ID NO: 78942

SEQ ID NO: 177787 - RNA, 64 nt, Homo Sapiens; identical to SEQ ID NO: 78943

SEQ ID NO: 177788 - RNA, 64 nt, Homo Sapiens; identical to SEQ ID NO: 78944

SEQ ID NO: 177789 - RNA, 64 nt, Homo Sapiens; identical to SEQ ID NO: 78945

SEQ ID NO: 177790 - RNA, 64 nt, Homo Sapiens; identical to SEQ ID NO: 78946

SEQ ID NO: 177791 - RNA, 64 nt, Homo Sapiens; identical to SEQ ID NO: 78947

SEQ ID NO: 177792 - RNA, 64 nt, Homo Sapiens; identical to SEQ ID NO: 78948

SEQ ID NO: 177793 - RNA, 64 nt, Homo Sapiens; identical to SEQ ID NO: 78949

SEQ ID NO: 177794 - RNA, 64 nt, Homo Sapiens; identical to SEQ ID NO: 78950

SEQ ID NO: 177795 - RNA, 64 nt, Homo Sapiens; identical to SEQ ID NO: 78951

SEQ ID NO: 177796 - RNA, 64 nt, Homo Sapiens; identical to SEQ ID NO: 78952

SEQ ID NO: 177797 - RNA, 64 nt, Homo Sapiens; identical to SEQ ID NO: 78953

SEQ ID NO: 177798 - RNA, 64 nt, Homo Sapiens; identical to SEQ ID NO: 78954

SEQ ID NO: 177799 - RNA, 64 nt, Homo Sapiens; identical to SEQ ID NO: 78955

SEQ ID NO: 177800 - RNA, 64 nt, Homo Sapiens; identical to SEQ ID NO: 78956

SEQ ID NO: 177801 - RNA, 64 nt, Homo Sapiens; identical to SEQ ID NO: 78957

SEQ ID NO: 177802 - RNA, 64 nt, Homo Sapiens; identical to SEQ ID NO: 78958

SEQ ID NO: 177803 - RNA, 64 nt, Homo Sapiens; identical to SEQ ID NO: 78959

SEQ ID NO: 177804 - RNA, 64 nt, Homo Sapiens; identical to SEQ ID NO: 78960

SEQ ID NO: 177805 - RNA, 64 nt, Homo Sapiens; identical to SEQ ID NO: 78961

SEQ ID NO: 177806 - RNA, 64 nt, Homo Sapiens; identical to SEQ ID NO: 78962

SEQ ID NO: 177807 - RNA, 64 nt, Homo Sapiens; identical to SEQ ID NO: 78963

SEQ ID NO: 177808 - RNA, 64 nt, Homo Sapiens; identical to SEQ ID NO: 78964

SEQ ID NO: 177809 - RNA, 64 nt, Homo Sapiens; identical to SEQ ID NO: 78965

SEQ ID NO: 177810 - RNA, 64 nt, Homo Sapiens; identical to SEQ ID NO: 78966

SEQ ID NO: 177811 - RNA, 64 nt, Homo Sapiens; identical to SEQ ID NO: 78967

SEQ ID NO: 177812 - RNA, 64 nt, Homo Sapiens; identical to SEQ ID NO: 78968

SEQ ID NO: 177813 - RNA, 64 nt, Homo Sapiens; identical to SEQ ID NO: 78969

SEQ ID NO: 177814 - RNA, 64 nt, Homo Sapiens; identical to SEQ ID NO: 78970

SEQ ID NO: 177815 - RNA, 64 nt, Homo Sapiens; identical to SEQ ID NO: 78971

SEQ ID NO: 177816 - RNA, 64 nt, Homo Sapiens; identical to SEQ ID NO: 78972

SEQ ID NO: 177817 - RNA, 64 nt, Homo Sapiens; identical to SEQ ID NO: 78973

SEQ ID NO: 177818 - RNA, 64 nt, Homo Sapiens; identical to SEQ ID NO: 78974

SEQ ID NO: 177819 - RNA, 64 nt, Homo Sapiens; identical to SEQ ID NO: 78975

SEQ ID NO: 177820 - RNA, 64 nt, Homo Sapiens; identical to SEQ ID NO: 78976

SEQ ID NO: 177821 - RNA, 64 nt, Homo Sapiens; identical to SEQ ID NO: 78977

SEQ ID NO: 177822 - RNA, 64 nt, Homo Sapiens; identical to SEQ ID NO: 78978

SEQ ID NO: 177823 - RNA, 64 nt, Homo Sapiens; identical to SEQ ID NO: 78979

SEQ ID NO: 177824 - RNA, 64 nt, Homo Sapiens; identical to SEQ ID NO: 78980

SEQ ID NO: 177825 - RNA, 64 nt, Homo Sapiens; identical to SEQ ID NO: 78981

SEQ ID NO: 177826 - RNA, 64 nt, Homo Sapiens; identical to SEQ ID NO: 78982

SEQ ID NO: 177827 - RNA, 64 nt, Homo Sapiens; identical to SEQ ID NO: 78983

SEQ ID NO: 177828 - RNA, 64 nt, Homo Sapiens; identical to SEQ ID NO: 78984

SEQ ID NO: 177829 - RNA, 64 nt, Homo Sapiens; identical to SEQ ID NO: 78985

SEQ ID NO: 177830 - RNA, 64 nt, Homo Sapiens; identical to SEQ ID NO: 78986

SEQ ID NO: 177831 - RNA, 64 nt, Homo Sapiens; identical to SEQ ID NO: 78987

SEQ ID NO: 177832 - RNA, 64 nt, Homo Sapiens; identical to SEQ ID NO: 78988

SEQ ID NO: 177833 - RNA, 64 nt, Homo Sapiens; identical to SEQ ID NO: 78989

SEQ ID NO: 177834 - RNA, 64 nt, Homo Sapiens; identical to SEQ ID NO: 78990

SEQ ID NO: 177835 - RNA, 64 nt, Homo Sapiens; identical to SEQ ID NO: 78991

SEQ ID NO: 177836 - RNA, 64 nt, Homo Sapiens; identical to SEQ ID NO: 78992

SEQ ID NO: 177837 - RNA, 64 nt, Homo Sapiens; identical to SEQ ID NO: 78993

SEQ ID NO: 177838 - RNA, 64 nt, Homo Sapiens; identical to SEQ ID NO: 78994

SEQ ID NO: 177839 - RNA, 64 nt, Homo Sapiens; identical to SEQ ID NO: 78995

SEQ ID NO: 177840 - RNA, 64 nt, Homo Sapiens; identical to SEQ ID NO: 78996

SEQ ID NO: 177841 - RNA, 64 nt, Homo Sapiens; identical to SEQ ID NO: 78997

SEQ ID NO: 177842 - RNA, 64 nt, Homo Sapiens; identical to SEQ ID NO: 78998

SEQ ID NO: 177843 - RNA, 64 nt, Homo Sapiens; identical to SEQ ID NO: 78999

SEQ ID NO: 177844 - RNA, 64 nt, Homo Sapiens; identical to SEQ ID NO: 79000

SEQ ID NO: 177845 - RNA, 64 nt, Homo Sapiens; identical to SEQ ID NO: 79001

SEQ ID NO: 177846 - RNA, 64 nt, Homo Sapiens; identical to SEQ ID NO: 79002

SEQ ID NO: 177847 - RNA, 64 nt, Homo Sapiens; identical to SEQ ID NO: 79003

SEQ ID NO: 177848 - RNA, 64 nt, Homo Sapiens; identical to SEQ ID NO: 79004

SEQ ID NO: 177849 - RNA, 64 nt, Homo Sapiens; identical to SEQ ID NO: 79005

SEQ ID NO: 177850 - RNA, 64 nt, Homo Sapiens; identical to SEQ ID NO: 79006

SEQ ID NO: 177851 - RNA, 64 nt, Homo Sapiens; identical to SEQ ID NO: 79007

SEQ ID NO: 177852 - RNA, 64 nt, Homo Sapiens; identical to SEQ ID NO: 79008

SEQ ID NO: 177853 - RNA, 64 nt, Homo Sapiens; identical to SEQ ID NO: 79009

SEQ ID NO: 177854 - RNA, 64 nt, Homo Sapiens; identical to SEQ ID NO: 79010

SEQ ID NO: 177855 - RNA, 64 nt, Homo Sapiens; identical to SEQ ID NO: 79011

SEQ ID NO: 177856 - RNA, 64 nt, Homo Sapiens; identical to SEQ ID NO: 79012

SEQ ID NO: 177857 - RNA, 64 nt, Homo Sapiens; identical to SEQ ID NO: 79013

SEQ ID NO: 177858 - RNA, 64 nt, Homo Sapiens; identical to SEQ ID NO: 79014

SEQ ID NO: 177859 - RNA, 64 nt, Homo Sapiens; identical to SEQ ID NO: 79015

SEQ ID NO: 177860 - RNA, 64 nt, Homo Sapiens; identical to SEQ ID NO: 79016

SEQ ID NO: 177861 - RNA, 64 nt, Homo Sapiens; identical to SEQ ID NO: 79017

SEQ ID NO: 177862 - RNA, 64 nt, Homo Sapiens; identical to SEQ ID NO: 79018

SEQ ID NO: 177863 - RNA, 64 nt, Homo Sapiens; identical to SEQ ID NO: 79019

SEQ ID NO: 177864 - RNA, 64 nt, Homo Sapiens; identical to SEQ ID NO: 79020

SEQ ID NO: 177865 - RNA, 64 nt, Homo Sapiens; identical to SEQ ID NO: 79021

SEQ ID NO: 177866 - RNA, 64 nt, Homo Sapiens; identical to SEQ ID NO: 79022

SEQ ID NO: 177867 - RNA, 64 nt, Homo Sapiens; identical to SEQ ID NO: 79023

SEQ ID NO: 177868 - RNA, 64 nt, Homo Sapiens; identical to SEQ ID NO: 79024

SEQ ID NO: 177869 - RNA, 64 nt, Homo Sapiens; identical to SEQ ID NO: 79025

SEQ ID NO: 177870 - RNA, 64 nt, Homo Sapiens; identical to SEQ ID NO: 79026

SEQ ID NO: 177871 - RNA, 64 nt, Homo Sapiens; identical to SEQ ID NO: 79027

SEQ ID NO: 177872 - RNA, 64 nt, Homo Sapiens; identical to SEQ ID NO: 79028

SEQ ID NO: 177873 - RNA, 64 nt, Homo Sapiens; identical to SEQ ID NO: 79029

SEQ ID NO: 177874 - RNA, 64 nt, Homo Sapiens; identical to SEQ ID NO: 79030

SEQ ID NO: 177875 - RNA, 64 nt, Homo Sapiens; identical to SEQ ID NO: 79031

SEQ ID NO: 177876 - RNA, 64 nt, Homo Sapiens; identical to SEQ ID NO: 79032

SEQ ID NO: 177877 - RNA, 64 nt, Homo Sapiens; identical to SEQ ID NO: 79033

SEQ ID NO: 177878 - RNA, 64 nt, Homo Sapiens; identical to SEQ ID NO: 79034

SEQ ID NO: 177879 - RNA, 64 nt, Homo Sapiens; identical to SEQ ID NO: 79035

SEQ ID NO: 177880 - RNA, 64 nt, Homo Sapiens; identical to SEQ ID NO: 79036

SEQ ID NO: 177881 - RNA, 64 nt, Homo Sapiens; identical to SEQ ID NO: 79037

SEQ ID NO: 177882 - RNA, 64 nt, Homo Sapiens; identical to SEQ ID NO: 79038

SEQ ID NO: 177883 - RNA, 64 nt, Homo Sapiens; identical to SEQ ID NO: 79039

SEQ ID NO: 177884 - RNA, 64 nt, Homo Sapiens; identical to SEQ ID NO: 79040

SEQ ID NO: 177885 - RNA, 64 nt, Homo Sapiens; identical to SEQ ID NO: 79041

SEQ ID NO: 177886 - RNA, 64 nt, Homo Sapiens; identical to SEQ ID NO: 79042

SEQ ID NO: 177887 - RNA, 64 nt, Homo Sapiens; identical to SEQ ID NO: 79043

SEQ ID NO: 177888 - RNA, 64 nt, Homo Sapiens; identical to SEQ ID NO: 79044

SEQ ID NO: 177889 - RNA, 64 nt, Homo Sapiens; identical to SEQ ID NO: 79045

SEQ ID NO: 177890 - RNA, 64 nt, Homo Sapiens; identical to SEQ ID NO: 79046

SEQ ID NO: 177891 - RNA, 64 nt, Homo Sapiens; identical to SEQ ID NO: 79047

SEQ ID NO: 177892 - RNA, 64 nt, Homo Sapiens; identical to SEQ ID NO: 79048

SEQ ID NO: 177893 - RNA, 64 nt, Homo Sapiens; identical to SEQ ID NO: 79049

SEQ ID NO: 177894 - RNA, 64 nt, Homo Sapiens; identical to SEQ ID NO: 79050

SEQ ID NO: 177895 - RNA, 64 nt, Homo Sapiens; identical to SEQ ID NO: 172495

SEQ ID NO: 177896 - RNA, 64 nt, Homo Sapiens; identical to SEQ ID NO: 172496

SEQ ID NO: 177897 - RNA, 64 nt, Homo Sapiens; identical to SEQ ID NO: 78937

SEQ ID NO: 177898 - RNA, 64 nt, Homo Sapiens; identical to SEQ ID NO: 78938

SEQ ID NO: 177899 - RNA, 64 nt, Homo Sapiens; identical to SEQ ID NO: 78939

SEQ ID NO: 177900 - RNA, 64 nt, Homo Sapiens; identical to SEQ ID NO: 78940

SEQ ID NO: 177901 - RNA, 64 nt, Homo Sapiens; identical to SEQ ID NO: 78941

SEQ ID NO: 177902 - RNA, 64 nt, Homo Sapiens; identical to SEQ ID NO: 78942

SEQ ID NO: 177903 - RNA, 64 nt, Homo Sapiens; identical to SEQ ID NO: 78943

SEQ ID NO: 177904 - RNA, 64 nt, Homo Sapiens; identical to SEQ ID NO: 78944

SEQ ID NO: 177905 - RNA, 64 nt, Homo Sapiens; identical to SEQ ID NO: 78945

SEQ ID NO: 177906 - RNA, 64 nt, Homo Sapiens; identical to SEQ ID NO: 78946

SEQ ID NO: 177907 - RNA, 64 nt, Homo Sapiens; identical to SEQ ID NO: 78947

SEQ ID NO: 177908 - RNA, 64 nt, Homo Sapiens; identical to SEQ ID NO: 78948

SEQ ID NO: 177909 - RNA, 64 nt, Homo Sapiens; identical to SEQ ID NO: 78949

SEQ ID NO: 177910 - RNA, 64 nt, Homo Sapiens; identical to SEQ ID NO: 78950

SEQ ID NO: 177911 - RNA, 64 nt, Homo Sapiens; identical to SEQ ID NO: 78951

SEQ ID NO: 177912 - RNA, 64 nt, Homo Sapiens; identical to SEQ ID NO: 78952

SEQ ID NO: 177913 - RNA, 64 nt, Homo Sapiens; identical to SEQ ID NO: 78953

SEQ ID NO: 177914 - RNA, 64 nt, Homo Sapiens; identical to SEQ ID NO: 78954

SEQ ID NO: 177915 - RNA, 64 nt, Homo Sapiens; identical to SEQ ID NO: 78955

SEQ ID NO: 177916 - RNA, 64 nt, Homo Sapiens; identical to SEQ ID NO: 78956

SEQ ID NO: 177917 - RNA, 64 nt, Homo Sapiens; identical to SEQ ID NO: 78957

SEQ ID NO: 177918 - RNA, 64 nt, Homo Sapiens; identical to SEQ ID NO: 78958

SEQ ID NO: 177919 - RNA, 64 nt, Homo Sapiens; identical to SEQ ID NO: 78959

SEQ ID NO: 177920 - RNA, 64 nt, Homo Sapiens; identical to SEQ ID NO: 78960

SEQ ID NO: 177921 - RNA, 64 nt, Homo Sapiens; identical to SEQ ID NO: 78961

SEQ ID NO: 177922 - RNA, 64 nt, Homo Sapiens; identical to SEQ ID NO: 78962

SEQ ID NO: 177923 - RNA, 64 nt, Homo Sapiens; identical to SEQ ID NO: 78963

SEQ ID NO: 177924 - RNA, 64 nt, Homo Sapiens; identical to SEQ ID NO: 78964

SEQ ID NO: 177925 - RNA, 64 nt, Homo Sapiens; identical to SEQ ID NO: 78965

SEQ ID NO: 177926 - RNA, 64 nt, Homo Sapiens; identical to SEQ ID NO: 78966

SEQ ID NO: 177927 - RNA, 64 nt, Homo Sapiens; identical to SEQ ID NO: 78967

SEQ ID NO: 177928 - RNA, 64 nt, Homo Sapiens; identical to SEQ ID NO: 78968

SEQ ID NO: 177929 - RNA, 64 nt, Homo Sapiens; identical to SEQ ID NO: 78969

SEQ ID NO: 177930 - RNA, 64 nt, Homo Sapiens; identical to SEQ ID NO: 78970

SEQ ID NO: 177931 - RNA, 64 nt, Homo Sapiens; identical to SEQ ID NO: 78971

SEQ ID NO: 177932 - RNA, 64 nt, Homo Sapiens; identical to SEQ ID NO: 78972

SEQ ID NO: 177933 - RNA, 64 nt, Homo Sapiens; identical to SEQ ID NO: 78973

SEQ ID NO: 177934 - RNA, 64 nt, Homo Sapiens; identical to SEQ ID NO: 78974

SEQ ID NO: 177935 - RNA, 64 nt, Homo Sapiens; identical to SEQ ID NO: 78975

SEQ ID NO: 177936 - RNA, 64 nt, Homo Sapiens; identical to SEQ ID NO: 78976

SEQ ID NO: 177937 - RNA, 64 nt, Homo Sapiens; identical to SEQ ID NO: 78977

SEQ ID NO: 177938 - RNA, 64 nt, Homo Sapiens; identical to SEQ ID NO: 78978

SEQ ID NO: 177939 - RNA, 64 nt, Homo Sapiens; identical to SEQ ID NO: 78979

SEQ ID NO: 177940 - RNA, 64 nt, Homo Sapiens; identical to SEQ ID NO: 78980

SEQ ID NO: 177941 - RNA, 64 nt, Homo Sapiens; identical to SEQ ID NO: 78981

SEQ ID NO: 177942 - RNA, 64 nt, Homo Sapiens; identical to SEQ ID NO: 78982

SEQ ID NO: 177943 - RNA, 64 nt, Homo Sapiens; identical to SEQ ID NO: 78983

SEQ ID NO: 177944 - RNA, 64 nt, Homo Sapiens; identical to SEQ ID NO: 78984

SEQ ID NO: 177945 - RNA, 64 nt, Homo Sapiens; identical to SEQ ID NO: 78985

SEQ ID NO: 177946 - RNA, 64 nt, Homo Sapiens; identical to SEQ ID NO: 78986

SEQ ID NO: 177947 - RNA, 64 nt, Homo Sapiens; identical to SEQ ID NO: 78987

SEQ ID NO: 177948 - RNA, 64 nt, Homo Sapiens; identical to SEQ ID NO: 78988

SEQ ID NO: 177949 - RNA, 64 nt, Homo Sapiens; identical to SEQ ID NO: 78989

SEQ ID NO: 177950 - RNA, 64 nt, Homo Sapiens; identical to SEQ ID NO: 78990

SEQ ID NO: 177951 - RNA, 64 nt, Homo Sapiens; identical to SEQ ID NO: 78991

SEQ ID NO: 177952 - RNA, 64 nt, Homo Sapiens; identical to SEQ ID NO: 78992

SEQ ID NO: 177953 - RNA, 64 nt, Homo Sapiens; identical to SEQ ID NO: 78993

SEQ ID NO: 177954 - RNA, 64 nt, Homo Sapiens; identical to SEQ ID NO: 78994

SEQ ID NO: 177955 - RNA, 64 nt, Homo Sapiens; identical to SEQ ID NO: 78995

SEQ ID NO: 177956 - RNA, 64 nt, Homo Sapiens; identical to SEQ ID NO: 78996

SEQ ID NO: 177957 - RNA, 64 nt, Homo Sapiens; identical to SEQ ID NO: 78997

SEQ ID NO: 177958 - RNA, 64 nt, Homo Sapiens; identical to SEQ ID NO: 78998

SEQ ID NO: 177959 - RNA, 64 nt, Homo Sapiens; identical to SEQ ID NO: 78999

SEQ ID NO: 177960 - RNA, 64 nt, Homo Sapiens; identical to SEQ ID NO: 79000

SEQ ID NO: 177961 - RNA, 64 nt, Homo Sapiens; identical to SEQ ID NO: 79001

SEQ ID NO: 177962 - RNA, 64 nt, Homo Sapiens; identical to SEQ ID NO: 79002

SEQ ID NO: 177963 - RNA, 64 nt, Homo Sapiens; identical to SEQ ID NO: 79003

SEQ ID NO: 177964 - RNA, 64 nt, Homo Sapiens; identical to SEQ ID NO: 79004

SEQ ID NO: 177965 - RNA, 64 nt, Homo Sapiens; identical to SEQ ID NO: 79005

SEQ ID NO: 177966 - RNA, 64 nt, Homo Sapiens; identical to SEQ ID NO: 79006

SEQ ID NO: 177967 - RNA, 64 nt, Homo Sapiens; identical to SEQ ID NO: 79007

SEQ ID NO: 177968 - RNA, 64 nt, Homo Sapiens; identical to SEQ ID NO: 79008

SEQ ID NO: 177969 - RNA, 64 nt, Homo Sapiens; identical to SEQ ID NO: 79009

SEQ ID NO: 177970 - RNA, 64 nt, Homo Sapiens; identical to SEQ ID NO: 79010

SEQ ID NO: 177971 - RNA, 64 nt, Homo Sapiens; identical to SEQ ID NO: 79011

SEQ ID NO: 177972 - RNA, 64 nt, Homo Sapiens; identical to SEQ ID NO: 79012

SEQ ID NO: 177973 - RNA, 64 nt, Homo Sapiens; identical to SEQ ID NO: 79013

SEQ ID NO: 177974 - RNA, 64 nt, Homo Sapiens; identical to SEQ ID NO: 79014

SEQ ID NO: 177975 - RNA, 64 nt, Homo Sapiens; identical to SEQ ID NO: 79015

SEQ ID NO: 177976 - RNA, 64 nt, Homo Sapiens; identical to SEQ ID NO: 79016

SEQ ID NO: 177977 - RNA, 64 nt, Homo Sapiens; identical to SEQ ID NO: 79017

SEQ ID NO: 177978 - RNA, 64 nt, Homo Sapiens; identical to SEQ ID NO: 79018

SEQ ID NO: 177979 - RNA, 64 nt, Homo Sapiens; identical to SEQ ID NO: 79019

SEQ ID NO: 177980 - RNA, 64 nt, Homo Sapiens; identical to SEQ ID NO: 79020

SEQ ID NO: 177981 - RNA, 64 nt, Homo Sapiens; identical to SEQ ID NO: 79021

SEQ ID NO: 177982 - RNA, 64 nt, Homo Sapiens; identical to SEQ ID NO: 79022

SEQ ID NO: 177983 - RNA, 64 nt, Homo Sapiens; identical to SEQ ID NO: 79023

SEQ ID NO: 177984 - RNA, 64 nt, Homo Sapiens; identical to SEQ ID NO: 79024

SEQ ID NO: 177985 - RNA, 64 nt, Homo Sapiens; identical to SEQ ID NO: 79025

SEQ ID NO: 177986 - RNA, 64 nt, Homo Sapiens; identical to SEQ ID NO: 79026

SEQ ID NO: 177987 - RNA, 64 nt, Homo Sapiens; identical to SEQ ID NO: 79027

SEQ ID NO: 177988 - RNA, 64 nt, Homo Sapiens; identical to SEQ ID NO: 79028

SEQ ID NO: 177989 - RNA, 64 nt, Homo Sapiens; identical to SEQ ID NO: 79029

SEQ ID NO: 177990 - RNA, 64 nt, Homo Sapiens; identical to SEQ ID NO: 79030

SEQ ID NO: 177991 - RNA, 64 nt, Homo Sapiens; identical to SEQ ID NO: 79031

SEQ ID NO: 177992 - RNA, 64 nt, Homo Sapiens; identical to SEQ ID NO: 79032

SEQ ID NO: 177993 - RNA, 64 nt, Homo Sapiens; identical to SEQ ID NO: 79033

SEQ ID NO: 177994 - RNA, 64 nt, Homo Sapiens; identical to SEQ ID NO: 79034

SEQ ID NO: 177995 - RNA, 64 nt, Homo Sapiens; identical to SEQ ID NO: 79035

SEQ ID NO: 177996 - RNA, 64 nt, Homo Sapiens; identical to SEQ ID NO: 79036

SEQ ID NO: 177997 - RNA, 64 nt, Homo Sapiens; identical to SEQ ID NO: 79037

SEQ ID NO: 177998 - RNA, 64 nt, Homo Sapiens; identical to SEQ ID NO: 79038

SEQ ID NO: 177999 - RNA, 64 nt, Homo Sapiens; identical to SEQ ID NO: 79039

SEQ ID NO: 178000 - RNA, 64 nt, Homo Sapiens; identical to SEQ ID NO: 79040

SEQ ID NO: 178001 - RNA, 64 nt, Homo Sapiens; identical to SEQ ID NO: 79041

SEQ ID NO: 178002 - RNA, 64 nt, Homo Sapiens; identical to SEQ ID NO: 79042

SEQ ID NO: 178003 - RNA, 64 nt, Homo Sapiens; identical to SEQ ID NO: 79043

SEQ ID NO: 178004 - RNA, 64 nt, Homo Sapiens; identical to SEQ ID NO: 79044

SEQ ID NO: 178005 - RNA, 64 nt, Homo Sapiens; identical to SEQ ID NO: 79045

SEQ ID NO: 178006 - RNA, 64 nt, Homo Sapiens; identical to SEQ ID NO: 79046

SEQ ID NO: 178007 - RNA, 64 nt, Homo Sapiens; identical to SEQ ID NO: 79047

SEQ ID NO: 178008 - RNA, 64 nt, Homo Sapiens; identical to SEQ ID NO: 79048

SEQ ID NO: 178009 - RNA, 64 nt, Homo Sapiens; identical to SEQ ID NO: 79049

SEQ ID NO: 178010 - RNA, 64 nt, Homo Sapiens; identical to SEQ ID NO: 79050

SEQ ID NO: 178011 - RNA, 64 nt, Homo Sapiens; identical to SEQ ID NO: 172495

SEQ ID NO: 178012 - RNA, 64 nt, Homo Sapiens; identical to SEQ ID NO: 172496

SEQ ID NO: 178013 - RNA, 63 nt, Homo Sapiens; identical to SEQ ID NO: 57603

SEQ ID NO: 178014 - RNA, 64 nt, Homo Sapiens; identical to SEQ ID NO: 57604

SEQ ID NO: 178015 - RNA, 64 nt, Homo Sapiens; identical to SEQ ID NO: 57605

SEQ ID NO: 178016 - RNA, 64 nt, Homo Sapiens; identical to SEQ ID NO: 57606

SEQ ID NO: 178017 - RNA, 64 nt, Homo Sapiens; identical to SEQ ID NO: 57607

SEQ ID NO: 178018 - RNA, 64 nt, Homo Sapiens; identical to SEQ ID NO: 57608

SEQ ID NO: 178019 - RNA, 64 nt, Homo Sapiens; identical to SEQ ID NO: 57609

SEQ ID NO: 178020 - RNA, 64 nt, Homo Sapiens; identical to SEQ ID NO: 57610

SEQ ID NO: 178021 - RNA, 64 nt, Homo Sapiens; identical to SEQ ID NO: 57611

SEQ ID NO: 178022 - RNA, 64 nt, Homo Sapiens; identical to SEQ ID NO: 57612

SEQ ID NO: 178023 - RNA, 64 nt, Homo Sapiens; identical to SEQ ID NO: 57613

SEQ ID NO: 178024 - RNA, 64 nt, Homo Sapiens; identical to SEQ ID NO: 57614

SEQ ID NO: 178025 - RNA, 64 nt, Homo Sapiens
aucaaaacacugcagcaguuccuaaaugauucucacaagcaacccugagagagacagucuugug

SEQ ID NO: 178026 - RNA, 64 nt, Homo Sapiens
aucaaucuguaaaagguaaaaaugaaaaacaaaaacaagcaaacaaacaaaaaacaauggaaaa

SEQ ID NO: 178027 - RNA, 64 nt, Homo Sapiens
cacaugcuaaggcuuggagccgccucucugguugacaagcaaacagggaguggcagaacugggc

SEQ ID NO: 178028 - RNA, 64 nt, Homo Sapiens
auuauccaguugaucuggcauucucaguuauugaacaagcaagcuaauaaaaugguaaauuuuu

SEQ ID NO: 178029 - RNA, 64 nt, Homo Sapiens
uggcugcaagacuaaagagcacaugccacuaaccacaagcaagcucuuaaagauacuccaagcc

SEQ ID NO: 178030 - RNA, 64 nt, Homo Sapiens
ccaucuuaagagaugccucauuuuagaaccaccaacaagcaagcucccaagggauggugcccug

SEQ ID NO: 178031 - RNA, 64 nt, Homo Sapiens
ggccuauuccauucuggauuuugucaagcaguagacaagcaauuagacaagaacuuggaggcac

SEQ ID NO: 178032 - RNA, 64 nt, Homo Sapiens
caagcacgucuggaaacagauaagacaagcaaagacaagcaagguuggccugaaauagaguccu

SEQ ID NO: 178033 - RNA, 64 nt, Homo Sapiens
acaagcaaggcaagcacgucauagaguccuuaagacaagcaaagggaucaaguauuggccugaa

SEQ ID NO: 178034 - RNA, 64 nt, Homo Sapiens
uucauaagugaaggagaaauaaaauacuuuacagacaagcaaaugcugagagauuuugucacca

SEQ ID NO: 178035 - RNA, 64 nt, Homo Sapiens
uacaacuaucugaccuuugacaaaccugacaaaaacaagcaauggggaaaggauucccuauuua

SEQ ID NO: 178036 - RNA, 64 nt, Homo Sapiens
aucuaugcuggacucacagccaaauuaauacugaacaagcaaaagcuggaagcauuccccuuga

SEQ ID NO: 178037 - RNA, 64 nt, Homo Sapiens
uauaccuacaaccaugugauccucaacaaaacugacaagcaaugaaguaagaacuucauucaau

SEQ ID NO: 178038 - RNA, 64 nt, Homo Sapiens
agcugccuucauucaggcgguccucacaccucacaugucccaggucccuggaucuuccccccac

SEQ ID NO: 178039 - RNA, 64 nt, Homo Sapiens
aggcagcucuccccacacaggaaucacugcauggaugucccaggagccaugcugguggccuucu

SEQ ID NO: 178040 - RNA, 64 nt, Homo Sapiens
ucucucuucuagugucuaucuuuaucauaaccugaugucccaaacuugugacaaguucuuuugg

SEQ ID NO: 178041 - RNA, 64 nt, Homo Sapiens
aacugggaaaucuuacaaggaguugaaaagauuaaugucccaaccugaugagauuacggccuug

SEQ ID NO: 178042 - RNA, 64 nt, Homo Sapiens
acgggaauucuagacauacgcuugugucugaaccaugucccagcuggcaggggacacaguuguc

SEQ ID NO: 178043 - RNA, 64 nt, Homo Sapiens
cacaucccacacguguccgucacacaucccaggcaugucccagaaccaucccaggaggccugug

SEQ ID NO: 178044 - RNA, 64 nt, Homo Sapiens
uugacccacugaccacacagggcacuauagccugaugucccacagguggaaugagaugcuccuu

SEQ ID NO: 178045 - RNA, 64 nt, Homo Sapiens
gcccugugcaccguagagacgcucgagguacgguaugucccaucuaguaacagcaugcuacacu

SEQ ID NO: 178046 - RNA, 64 nt, Homo Sapiens
uuuugaugaaacuguauuugaaugaaguugauguaugucccaaguuuuuaagguacugaaaaga

SEQ ID NO: 178047 - RNA, 64 nt, Homo Sapiens
acugauguuuuuuuuuuaagaguauuucuuuguuaugucccagaguccagauaccauuucuccu

SEQ ID NO: 178048 - RNA, 62 nt, Homo Sapiens
ucccggccgggcgcgguggcucacgccuguaaucccagcacuuugggaggccgaggcgggca

SEQ ID NO: 178049 - RNA, 62 nt, Homo Sapiens
ugccagccaggcgugguggaucacgccuguaaucccagcacucugggaggccaaagcgggca

SEQ ID NO: 178050 - RNA, 62 nt, Homo Sapiens
ggcaggccaggugcaguggcucaugccuguaaucccagcauuuugguaggccgaggagggca

SEQ ID NO: 178051 - RNA, 62 nt, Homo Sapiens
acauggccaggcgcgguggcucacacccguaaucccagcacuuugcggggccgaggcagggg

SEQ ID NO: 178052 - RNA, 62 nt, Homo Sapiens
uugggaggccgaggcgggugucacgcuuguaaucccagcacugccaggccgagcguguuggc

SEQ ID NO: 178053 - RNA, 62 nt, Homo Sapiens
gggaggccgaggggggcggaucacgccuguaaucccagcacugauuggccaggcgcaguggc

SEQ ID NO: 178054 - RNA, 62 nt, Homo Sapiens
uugggaggccaaggugggcgucacgccuguaaucccagcacuggcaggcugggcgcgguggc

SEQ ID NO: 178055 - RNA, 62 nt, Homo Sapiens
acagcggagccuggacugacuccagcagucguucccagcagacuaacagaggaaacaaaugg

SEQ ID NO: 178056 - RNA, 62 nt, Homo Sapiens
agacacccacccucucacugcucccacccuccucccagcagcugggggcccagcagagccug

SEQ ID NO: 178057 - RNA, 62 nt, Homo Sapiens
uugagaggccgaggugagacucacaccuguaaucccagcacuuuuaggcugggcaugguggc

SEQ ID NO: 178058 - RNA, 62 nt, Homo Sapiens
uuggaaggcugaggcagaagucaugccuauaaucccagcacucgaggcugggcgcaguggcc

SEQ ID NO: 178059 - RNA, 62 nt, Homo Sapiens
uugggaggccgagacgggugcauugccuguaaucccagcacuccaguaguuaaaaaucaacu

SEQ ID NO: 178060 - RNA, 62 nt, Homo Sapiens
auuuauuaaauggggacuucgcuagccaguaaucccagcaccguuucaaucuucugcauaug

SEQ ID NO: 178061 - RNA, 62 nt, Homo Sapiens
cugggaggccaaggcagaugucaugccuguaaucccagcacugaaaucugcccgggcacacc

SEQ ID NO: 178062 - RNA, 62 nt, Homo Sapiens
uugggaggccgaggugggcaucacaccuguaaucccagcacuuuucauccgggcgcaguggc

SEQ ID NO: 178063 - RNA, 62 nt, Homo Sapiens
uugggaggccgagguggccaucacgccuguaaucccagcacuuuuaaaauuagccugguggc

SEQ ID NO: 178064 - RNA, 62 nt, Homo Sapiens
uugggaggcccaggugggcgucacgccuguaaucccagcacuauuaggccgggcaugguggc

SEQ ID NO: 178065 - RNA, 62 nt, Homo Sapiens
uuaggaggccgaggcaggcgucacaccuauaaucccagcacucucgggccaggcgcuguggc

SEQ ID NO: 178066 - RNA, 50 nt, Homo Sapiens
uugggaggccaaggcaggcgucccagcacugcuguggcucacgccuauaa

SEQ ID NO: 178067 - RNA, 62 nt, Homo Sapiens
cccuuuacuacaaagggcuauggcucuugccuucccagcaugaugcucuggggaggcggcuc

SEQ ID NO: 178068 - RNA, 62 nt, Homo Sapiens
cucuggggaggcggcucugguggugccccuccucccagcaugaugcucuagagaggcggcuc

SEQ ID NO: 178069 - RNA, 62 nt, Homo Sapiens
cucuagagaggcggcucugguggugcccauccucccagcaugacgcucuggggaggcggcuc

SEQ ID NO: 178070 - RNA, 62 nt, Homo Sapiens
cucuggggaggcggcucugguggugcccauccucccagcacgaugcucuagagaggcggcuc

SEQ ID NO: 178071 - RNA, 62 nt, Homo Sapiens
cucuagagaggcggcucuggcugguguccgucucccagcauggugcaguccuuggagaugua

SEQ ID NO: 178072 - RNA, 62 nt, Homo Sapiens
ugaaaggacaacacuaucuggggccucaccgcucccagcaacgggaggaaggggaaagggcu

SEQ ID NO: 178073 - RNA, 62 nt, Homo Sapiens
uuuggagaccuccaggauuaucgccauuccauucccagcagcgcccacuccugcgcuuuuca

SEQ ID NO: 178074 - RNA, 62 nt, Homo Sapiens
uugggaggcugaggcaggugucacaccuguaaucccagcacuccugagccagccgugguggc

SEQ ID NO: 178075 - RNA, 62 nt, Homo Sapiens
uggggaggccaaggcaggcgucaugccuguaaucccagcacuuuuuggccgggcaugguggc

SEQ ID NO: 178076 - RNA, 62 nt, Homo Sapiens
acacacuugucugugcuaugauguaugcaggaucccagcauugauacccaaugacaaacuau

SEQ ID NO: 178077 - RNA, 62 nt, Homo Sapiens
caaaccgugccuucuggcucugcgccccauauucccagcaucauagacauccaacagcacca

SEQ ID NO: 178078 - RNA, 62 nt, Homo Sapiens
gaccuagccagcgcaguggcucaugccuguaaucccagcacuuugggaggcugaggcgggcg

SEQ ID NO: 178079 - RNA, 62 nt, Homo Sapiens
cgugggcugggcaugguggcucaugccuguaaucccagcacucugggaggcugaggugggcg

SEQ ID NO: 178080 - RNA, 62 nt, Homo Sapiens
ucagcaggaggcugccggaacaacagcggcuuucccagcaaccccaaauucuggcugcgggu

SEQ ID NO: 178081 - RNA, 62 nt, Homo Sapiens
ucaggugacuggagcccgagggccugacagguucccagcagcugggccggccagccuugcac

SEQ ID NO: 178082 - RNA, 62 nt, Homo Sapiens
uugggaggccauggcgggugucacgccuguaaucccagcacucuuuggcugggcaugguggc

SEQ ID NO: 178083 - RNA, 62 nt, Homo Sapiens
uugggaggcugaggcaggcgucacgcuuguaaucccagcacugacuggcugggugcgguggc

SEQ ID NO: 178084 - RNA, 62 nt, Homo Sapiens
ugaaauggaagucagaagugagugaccuguuuucccagcaacucacccucuuccaucuccaa

SEQ ID NO: 178085 - RNA, 62 nt, Homo Sapiens
ucguggccgggcgcaguggcucacgccuguaaucccagcacuuugggaggccgaggugggug

SEQ ID NO: 178086 - RNA, 62 nt, Homo Sapiens
uaagggcugggggugguggcucaugccuguaaucccagcacuuugggaggccgaggcgggcg

SEQ ID NO: 178087 - RNA, 62 nt, Homo Sapiens
aauaggccaggcgcaguggcucacaccuguaaucccagcacguugggaggccaaggcgggca

SEQ ID NO: 178088 - RNA, 62 nt, Homo Sapiens
auaaggccagguguggugacucacacuuguaaucccagcaauuugggaggcugagacaggag

SEQ ID NO: 178089 - RNA, 62 nt, Homo Sapiens
aauaaauaaucgacucaaaaauaagucaugugucccagcauaaggcaucagguuguuagaug

SEQ ID NO: 178090 - RNA, 62 nt, Homo Sapiens
uugggaggccgagaugggugucacgccuauaaucccagcacuagagggccgggcgcggugac

SEQ ID NO: 178091 - RNA, 62 nt, Homo Sapiens
augggaggcugaggcaagcaucacaccuauaaucccagcacucuuuggccgggcacgguggc

SEQ ID NO: 178092 - RNA, 62 nt, Homo Sapiens
uugggaggccgaagugggugucacaccuguaaucccagcacuaaggggccgggugugguggc

SEQ ID NO: 178093 - RNA, 62 nt, Homo Sapiens
guaggcggccgaggugggugucaugccuguaaucccagcacuuucuaggccggugcgguggc

SEQ ID NO: 178094 - RNA, 62 nt, Homo Sapiens
augggaggccagggagggagucaugccuguaaucccagcacuuuugggccaggugcgguggc

SEQ ID NO: 178095 - RNA, 62 nt, Homo Sapiens
uugauuggauugacuuuuuugcauuaaauuuuucccagcaaaauaaaucauauggcgaguca

SEQ ID NO: 178096 - RNA, 62 nt, Homo Sapiens
uccaggccaggugugguggcucaugccuguaaucccagcacuuugagaggccgaggugggca

SEQ ID NO: 178097 - RNA, 62 nt, Homo Sapiens
uguaggcugagcgcgguggcucacgccuguaaucccagcacuuugggaggccaaggugggug

SEQ ID NO: 178098 - RNA, 62 nt, Homo Sapiens
agagggccaggugugguggcucacgccugugaucccagcacuuugggaggccaagacgggcg

SEQ ID NO: 178099 - RNA, 62 nt, Homo Sapiens
acauaugccggcgcaguggcucauguguguaaucccagcacucugggaggcugagacaggua

SEQ ID NO: 178100 - RNA, 62 nt, Homo Sapiens
aauuagccgggcgcgguggcucacaccuguaaucccagcacuuugggagguggaggcgggug

SEQ ID NO: 178101 - RNA, 62 nt, Homo Sapiens
ugcuucugggcccagcuaaggaagccaucuguucccagcagaggagagcugcugcgcugacc

SEQ ID NO: 178102 - RNA, 62 nt, Homo Sapiens
gagcugcugcgcugaccugcagagguugguggucccagcacagagcugugcccaugggcuug

SEQ ID NO: 178103 - RNA, 62 nt, Homo Sapiens
ugguggccgggcgcgguggcucaaaccuguaaucccagcacuuugggaggccgaggugggug

SEQ ID NO: 178104 - RNA, 62 nt, Homo Sapiens
gauuggccaggugcaguggcucacaccuguaaucccagcacuuugggaggccaaagugggug

SEQ ID NO: 178105 - RNA, 62 nt, Homo Sapiens
uugggaggcugaggcuggaggggcgccuguagucccagcagcaauuagcuuggcgugguggu

SEQ ID NO: 178106 - RNA, 62 nt, Homo Sapiens
uugggaggccgaggugggugucacgccuguaaucccagcacuuuuaguccaggcacaguggc

SEQ ID NO: 178107 - RNA, 62 nt, Homo Sapiens
caucucaggccacucauuaccuucgcucaugaucccagcagccauuuuucuuaacaccuucu

SEQ ID NO: 178108 - RNA, 62 nt, Homo Sapiens
aacuccugcacaaguuuuaacugaacaagaaaucccagcaaaaggcauuuuuuuuucuacuu

SEQ ID NO: 178109 - RNA, 62 nt, Homo Sapiens
uuggggggcugaggugggcgucaugccuguaaucccagcacuaagcggccgggcacgguggc

SEQ ID NO: 178110 - RNA, 62 nt, Homo Sapiens
gaggaauauuggcuggcaugcaaacuuucccuucccagcacacuauggucuugauacauccu

SEQ ID NO: 178111 - RNA, 62 nt, Homo Sapiens
aucuuauucugaauagcauuauggaacugaguucccagcaucauuuuuauagaaucauucau

SEQ ID NO: 178112 - RNA, 62 nt, Homo Sapiens
ucuguaaccuucagcauuuccgucugaucuaaucccagcacuuugugacuucucugauaaag

SEQ ID NO: 178113 - RNA, 62 nt, Homo Sapiens
agagucaaagggcuugcuugccccagcagaguucccagcagacagccauggcucuucccagc

SEQ ID NO: 178114 - RNA, 62 nt, Homo Sapiens
cagcagaguucccagcagacagccauggcucuucccagcagccugugcaaauucugaugaug

SEQ ID NO: 178115 - RNA, 62 nt, Homo Sapiens
uccaugaagaccacauccacacacgcaggaacucccagcaacacaagcuggaagcacauguu

SEQ ID NO: 178116 - RNA, 62 nt, Homo Sapiens
guuuggccgggugcgguggcucacgccuguaaucccagcacuuugggaggccaagguggggg

SEQ ID NO: 178117 - RNA, 62 nt, Homo Sapiens
auauggccgagcgugauggcucaccccuguaaucccagcacuuugugaggccaaggugggcg

SEQ ID NO: 178118 - RNA, 62 nt, Homo Sapiens
acagggcugggcacgguggcucacgccuguaaucccagcacuuugggagguugcggguggau

SEQ ID NO: 178119 - RNA, 62 nt, Homo Sapiens
uugggggccaaggaggguggucaugccuguaaucccagcacuaguuagcugggugugguggc

SEQ ID NO: 178120 - RNA, 62 nt, Homo Sapiens
uugggaggcugaggcgggcgucaugccuguaaucccagcacuuaauagccaggcaugguggc

SEQ ID NO: 178121 - RNA, 62 nt, Homo Sapiens
cugugcaaauucugaugaugagccauggcucuucccagcagccagcagaguucccagcagac

SEQ ID NO: 178122 - RNA, 62 nt, Homo Sapiens
cagccauggcucuucccagcccccagcagaguucccagcagaagagucaaagggcuugcuug

SEQ ID NO: 178123 - RNA, 62 nt, Homo Sapiens
uugggaggcaggggcgggugucacacguuuaaucccagcacuaagaggccagacaugguguc

SEQ ID NO: 178124 - RNA, 62 nt, Homo Sapiens
uugagaggcugaggugguagucacgccuguaaucccagcacuggguggccgggcacaguggc

SEQ ID NO: 178125 - RNA, 62 nt, Homo Sapiens
uugggaggccgaggcaggcgucacgccuguaaucccagcacugccuggcugggcgugguggc

SEQ ID NO: 178126 - RNA, 62 nt, Homo Sapiens
uugggaugcuaaggcaggcgucacacuuguaaucccagcacuucuagcccaggagcgguggc

SEQ ID NO: 178127 - RNA, 62 nt, Homo Sapiens
uugggaggccaaggugggcgucacacuuguaaucccagcacuucuaggcggggcgugguggc

SEQ ID NO: 178128 - RNA, 62 nt, Homo Sapiens
aagcugggugggguggcucacacccgacguaaucccagcacguugggaggccgaggcaggug

SEQ ID NO: 178129 - RNA, 62 nt, Homo Sapiens
uucaggccaggcacggugacucacgccuguaaucccagcacuuugggaggccgaggcgggug

SEQ ID NO: 178130 - RNA, 62 nt, Homo Sapiens
ccgcccacauccuccuuccccaggaccugagcucccagcaucugcagacgacccccgcagcc

SEQ ID NO: 178131 - RNA, 62 nt, Homo Sapiens
gaccaaaggccgcccccgccugcugggguuccucccagcaccccagcuugcuggcugcccuc

SEQ ID NO: 178132 - RNA, 62 nt, Homo Sapiens
gguugcugcucuggccagggaggcagccccacucccagcaagcagaagugauccucgagggu

SEQ ID NO: 178133 - RNA, 62 nt, Homo Sapiens
cugaaaacagaggggagggaggaaggaaggagucccagcaggagcacagcccugguuuccug

SEQ ID NO: 178134 - RNA, 62 nt, Homo Sapiens
agaccuucagcaguugaggcuggggcuaguggucccagcagcccagcccccacccuccuggc

SEQ ID NO: 178135 - RNA, 62 nt, Homo Sapiens
cuaccucccagggcaugcagucuggaagggggucccagcaguggagugccgggacccucaga

SEQ ID NO: 178136 - RNA, 62 nt, Homo Sapiens
ucaguccuuccuccaugcaguucacugugcuaucccagcauccaaaaucauucauaguucca

SEQ ID NO: 178137 - RNA, 62 nt, Homo Sapiens
uugagaggcugaggcgggaaucacaccgguaaucccagcacuuuugggucggaugcaggggc

SEQ ID NO: 178138 - RNA, 62 nt, Homo Sapiens
uugggaggcugaggcgggugucacgccuguaaucccagcacuguauggcuggacgcgguggc

SEQ ID NO: 178139 - RNA, 62 nt, Homo Sapiens
uugcaaggccgaggagggugucaugccuguaaucccagcacuuucaggccagucgugguggc

SEQ ID NO: 178140 - RNA, 62 nt, Homo Sapiens
ucacucuucaaacucccaaacacaugacuucuucccagcagcccuucccggccucuaaaguu

SEQ ID NO: 178141 - RNA, 62 nt, Homo Sapiens
cccagcagcccuucccggccucuaaaguuuggucccagcagcccuucccagccucuaaaguu

SEQ ID NO: 178142 - RNA, 62 nt, Homo Sapiens
gcacccagcaugugaccccacuccugaucaggucccagcaucuucccuucuuguucuguucc

SEQ ID NO: 178143 - RNA, 62 nt, Homo Sapiens
agcaucuucccuucuuguucuguuccuuaaggucccagcaccuuaccccaggacuuggucuu

SEQ ID NO: 178144 - RNA, 62 nt, Homo Sapiens
ucuguuaaaugagagaauagaguaugguugauucccagcauucagugguccugucaagcaac

SEQ ID NO: 178145 - RNA, 62 nt, Homo Sapiens
ccuuggccuggcgcgguggcucacaccuguaaucccagcacuuuuggaggccaaggugggug

SEQ ID NO: 178146 - RNA, 62 nt, Homo Sapiens
ccagggccggacacaguggcccaugccuguaaucccagcacuuuggggggccaaggcaggcu

SEQ ID NO: 178147 - RNA, 62 nt, Homo Sapiens
gaaaucucagcaugagcugcuauagaauacccucccagcaacaaaaccuaaucaguaaggcc

SEQ ID NO: 178148 - RNA, 62 nt, Homo Sapiens
uaggugccgucucuagucugugagggaggaacucccagcauccccauugcccacaaauggaa

SEQ ID NO: 178149 - RNA, 62 nt, Homo Sapiens
gugguggcauuggccgagggucuucgggugcuucccagcacaagcugcccuugcuguccugu

SEQ ID NO: 178150 - RNA, 62 nt, Homo Sapiens
ccugggugggggacacucagagugggagcacaucccagcagugcccauguagcaggagcaca

SEQ ID NO: 178151 - RNA, 62 nt, Homo Sapiens
cuggcgaccugacuagcagccugccguccacaucccagcacaccaccuccugcacugcacuu

SEQ ID NO: 178152 - RNA, 62 nt, Homo Sapiens
accauugaaaauaucucugugcuuuugcagcuucccagcacgagucccuccacugugaacaa

SEQ ID NO: 178153 - RNA, 62 nt, Homo Sapiens
gaucauucucaaaagcgagcuuaagggaggugucccagcacagccaguagugccuucaucag

SEQ ID NO: 178154 - RNA, 62 nt, Homo Sapiens
uggagagcuucaauugucaggugcucgcgcccucccagcacgcuucucuucugccaacuaac

SEQ ID NO: 178155 - RNA, 62 nt, Homo Sapiens
caggcagugucuugcugguggagggcauuguuucccagcacccugagcucuccugcagggug

SEQ ID NO: 178156 - RNA, 62 nt, Homo Sapiens
aacuuuugacuuagauggggcacauaguggcuucccagcaacaggccaggaugugcagucuc

SEQ ID NO: 178157 - RNA, 62 nt, Homo Sapiens
uuaaggccgggugggguggcacaugccuguaaucccagcacuuugggaggccaaggcuggug

SEQ ID NO: 178158 - RNA, 62 nt, Homo Sapiens
ugauggcugggugcaguggcucacgccuguaaucccagcacuuugggaggcuuaggcggcug

SEQ ID NO: 178159 - RNA, 62 nt, Homo Sapiens
ggcagaguagccaggguguggcccugccaucuucccagcagggccacucccggcacuccaug

SEQ ID NO: 178160 - RNA, 62 nt, Homo Sapiens
uuccuuuuugguacuuauuacugcuaaguauuucccagcacaugaaaccuuauuuuuuccca

SEQ ID NO: 178161 - RNA, 62 nt, Homo Sapiens
uuucagaggccaaggcgggcucacgccuguaaucccagcacuauagggcugggcgcgguugc

SEQ ID NO: 178162 - RNA, 62 nt, Homo Sapiens
uuuggaggcugaggcgggugucacaucuguaaucccagcacuuuuuggcauggugccauggc

SEQ ID NO: 178163 - RNA, 62 nt, Homo Sapiens
gcaaacugcuuuccagccugucccgaggaaguucccagcagacacagaaggagacccagaca

SEQ ID NO: 178164 - RNA, 62 nt, Homo Sapiens
ugugagcgucuguuggacuucaguccccagccucccagcaucgggugaggcucccaaccugg

SEQ ID NO: 178165 - RNA, 62 nt, Homo Sapiens
aggcuccagcuggagggaugcccuacuccauuucccagcaaaaccauaaugcagagugggcc

SEQ ID NO: 178166 - RNA, 62 nt, Homo Sapiens
uggcugguggagagauuuuuuggccaccugggucccagcacuuuaccugucaauaacaaugg

SEQ ID NO: 178167 - RNA, 62 nt, Homo Sapiens
gauaggccgggcaugguggcucaugccuguaaucccagcacuuugggaggccaggaguucga

SEQ ID NO: 178168 - RNA, 62 nt, Homo Sapiens
gucaggcugggcgcaguggcucacgccuguaaucccagcacuuugggagggauaggugggcg

SEQ ID NO: 178169 - RNA, 62 nt, Homo Sapiens
uggggaggaaccauaaacccagcccucacagcucccagcacagggccucccugagccagugg

SEQ ID NO: 178170 - RNA, 62 nt, Homo Sapiens
ucugggccaggcaagauggcucacgccugugaucccagcauuuugggaggccgaggcgggug

SEQ ID NO: 178171 - RNA, 62 nt, Homo Sapiens
uugcuuauguuuuuccuuuuuaucuucucucaucccagcauacugaguuauuuauuaauuag

SEQ ID NO: 178172 - RNA, 62 nt, Homo Sapiens
gccccucagucaugcugccuucugcugcucccucccagcaggauucacccucucauucccgg

SEQ ID NO: 178173 - RNA, 62 nt, Homo Sapiens
ucucuucuaauuuucaguauaaccaaaaauuaucccagcaugagcacgggcacgugcccuuc

SEQ ID NO: 178174 - RNA, 62 nt, Homo Sapiens
auugggccaggcacgguggcucacgccuguaaucccagcacuuugggaggccaaggccagcg

SEQ ID NO: 178175 - RNA, 62 nt, Homo Sapiens
auaugguuauauauaugggaugguuugguuggucccagcaaaguauaugaaaauuaaaguuc

SEQ ID NO: 178176 - RNA, 62 nt, Homo Sapiens
uugggaggcugaggcaggcgucaugccuguaaucccagcacucagcagucaggcacgguggc

SEQ ID NO: 178177 - RNA, 62 nt, Homo Sapiens
uugggaggccaaggcgggcgucaugccuguaaucccagcauuuguuggccaggcaugguggc

SEQ ID NO: 178178 - RNA, 62 nt, Homo Sapiens
uugggaggccaaggugggcgcacaccuuguaaucccagcacuuaaggccaggagcaguggcu

SEQ ID NO: 178179 - RNA, 62 nt, Homo Sapiens
auauggccaggcgggauggcucacgccuguaaucccagcacuuugggaggcugaggcgggca

SEQ ID NO: 178180 - RNA, 62 nt, Homo Sapiens
aauuagccgggcgugguggcuuacgccuguaaucccagcacuuugggaggccaaggugggcg

SEQ ID NO: 178181 - RNA, 62 nt, Homo Sapiens
aacuugccgggugcgguggcucaccccuguaaucccagcacuuugggaggccaaagcaggcg

SEQ ID NO: 178182 - RNA, 62 nt, Homo Sapiens
aauuagccagggguggugguaugcaccugcagucccagcaacaugggaggcugaacaggaga

SEQ ID NO: 178183 - RNA, 62 nt, Homo Sapiens
ugagaacuuggcucagggcuccugaggaccuuucccagcauuaccuucccuucccuugaaag

SEQ ID NO: 178184 - RNA, 62 nt, Homo Sapiens
uaaaggccaggugcaguggcccaugccuguaaucccagcacuuugggaggugggacaauugc

SEQ ID NO: 178185 - RNA, 62 nt, Homo Sapiens
uugagaggccugaggucggcucaugccuguaaucccagcacucacaggccgggucugguggc

SEQ ID NO: 178186 - RNA, 62 nt, Homo Sapiens
ucuuaaaacuuuguagucuuccucauuugcuaucccagcaucuugucaacacagaauucaag

SEQ ID NO: 178187 - RNA, 62 nt, Homo Sapiens
uugggaggccaaggcaagugucacgccuguaaucccagcaguggggggccaggugcaguggc

SEQ ID NO: 178188 - RNA, 62 nt, Homo Sapiens
uccauagcaguaggcuuaggaugaagaucuucucccagcaggccuuaucagaaaccaagcuu

SEQ ID NO: 178189 - RNA, 62 nt, Homo Sapiens
uauuugggcuggguauggagguucacugguaaucccagcacuuugggaggcccaggcagaag

SEQ ID NO: 178190 - RNA, 62 nt, Homo Sapiens
uuuuggcuaggcgugauggcucaggucuguaaucccagcacuuucgguggccggggugggug

SEQ ID NO: 178191 - RNA, 62 nt, Homo Sapiens
ucugucgcccaggcuggggugcaguggcgcgaucccagcacugcagccucaaccuccugggc

SEQ ID NO: 178192 - RNA, 62 nt, Homo Sapiens
ccucugcccugucccugcacaccuccacugccucccagcagaucuguggagacaaaacaagc

SEQ ID NO: 178193 - RNA, 62 nt, Homo Sapiens
ggcggggccggcagagaaggggcuguggcugcucccagcagaaucccagcaccccagccaca

SEQ ID NO: 178194 - RNA, 62 nt, Homo Sapiens
ccagccacaggcuguggcugaccaggaagaaaucccagcaccuuguacguuucucuuugaug

SEQ ID NO: 178195 - RNA, 62 nt, Homo Sapiens
ucuaggcugggugugguggcucacgccuauaaucccagcacuuugggaggcugaggugggug

SEQ ID NO: 178196 - RNA, 62 nt, Homo Sapiens
cacuggccaggcgagguggcucacaccuguaaucccagcacuuugggaggccaaggcgggug

SEQ ID NO: 178197 - RNA, 62 nt, Homo Sapiens
gaaauagcaguucagagagaggaagcucucugucccagcaccgagacucacuccuaagucuu

SEQ ID NO: 178198 - RNA, 62 nt, Homo Sapiens
aagauggaagccuaaagcccaagucgagcagcucccagcacugcugugcagaccuagagguc

SEQ ID NO: 178199 - RNA, 62 nt, Homo Sapiens
aaagaauuccccaggagaaaauggaaacacuaucccagcaaucugaauuccuuacuugggga

SEQ ID NO: 178200 - RNA, 62 nt, Homo Sapiens
auugggcugagugugguggcucaugccuguaaucccagcacuuugggaggcugagacaggcg

SEQ ID NO: 178201 - RNA, 62 nt, Homo Sapiens
aauuaaccaugcguggugguacacgucugucaucccagcagcucuuaaggcugaggcacaag

SEQ ID NO: 178202 - RNA, 62 nt, Homo Sapiens
uugggaggccgaggcaggcaucaagccuguaaucccagcacuaagaggccgggugcgguggc

SEQ ID NO: 178203 - RNA, 62 nt, Homo Sapiens
uugggaggcuaaggugggcgucacgccuguaaucccagcacuugcuggccagguaugguggc

SEQ ID NO: 178204 - RNA, 62 nt, Homo Sapiens
uugggaggcugaggugggagucgugccuguacucccagcacuauuuggccaagccugauggc

SEQ ID NO: 178205 - RNA, 62 nt, Homo Sapiens
uugggaggcugaggcaggcgucacgccuguaaucccagcacuccuuggccaggugcaguggc

SEQ ID NO: 178206 - RNA, 62 nt, Homo Sapiens
cccugggcugagaugagauguuuccuggccucucccagcaugagcaaagaagagaagugacu

SEQ ID NO: 178207 - RNA, 62 nt, Homo Sapiens
gagaggccgaucacuugaggucacgccuguaaucccagcacuagacgggccggcacgguggc

SEQ ID NO: 178208 - RNA, 62 nt, Homo Sapiens
uugggaggccaaggugggugucacaccuguaaucccagcauugaugggccaggugcgguggc

SEQ ID NO: 178209 - RNA, 62 nt, Homo Sapiens
uuaggaggccgaggcuggcaucacgccuguaaucccagcacuuagcagccaggugcaguggc

SEQ ID NO: 178210 - RNA, 62 nt, Homo Sapiens
acaaaggacauaagaaaaguaaaaaggcuaagucccagcaaucagcuucaucaaaacagaag

SEQ ID NO: 178211 - RNA, 62 nt, Homo Sapiens
cgaacagugccccuaacggaugaccuguguguucccagcacagcuuucuggcugcucuucau

SEQ ID NO: 178212 - RNA, 62 nt, Homo Sapiens
agugaguggagcugcucagguggccaccugugucccagcagcgggagagaaucaagcuccug

SEQ ID NO: 178213 - RNA, 62 nt, Homo Sapiens
uucccagguccugcacccuuggggauugacucucccagcaugcuuagaaacagaauuccuaa

SEQ ID NO: 178214 - RNA, 62 nt, Homo Sapiens
ucgggaggccgaggcgggugucacgccuguaaucccagcacuuggcggccgggugcaguggc

SEQ ID NO: 178215 - RNA, 62 nt, Homo Sapiens
gugaggccgggcgcaguggcucacgccuguaaucccagcacuuugggaggccgaggcgggug

SEQ ID NO: 178216 - RNA, 62 nt, Homo Sapiens
uuuggccagacacaggugccucacgccuguaaucccagcacuuugggaggcugagcuggauc

SEQ ID NO: 178217 - RNA, 62 nt, Homo Sapiens
ccuuggcugggcaugguggcucacgccuguaaucccagcacuuugggaggccgaggucagga

SEQ ID NO: 178218 - RNA, 62 nt, Homo Sapiens
uuagggccgagugcgguggcucacgccuauaaucccagcacuuugggaggccgaggcgggcg

SEQ ID NO: 178219 - RNA, 62 nt, Homo Sapiens
uugucuggcaaacaggagaugcuggauuucaaucccagcagggccucacuaguugagguauu

SEQ ID NO: 178220 - RNA, 62 nt, Homo Sapiens
cucuggcugggugugguggcucacaccuguaaucccagcacuuugggaggcugaggcaggag

SEQ ID NO: 178221 - RNA, 62 nt, Homo Sapiens
gagaggccaggccugguggcucacgccuguaaucccagcacuuuaagaggccaaggcggaug

SEQ ID NO: 178222 - RNA, 62 nt, Homo Sapiens
gagauagugggugugguggcucacaccugcaaucccagcacuuuggaaggccgaggugggca

SEQ ID NO: 178223 - RNA, 62 nt, Homo Sapiens
aaugggccaggugaaguggcucacaccuguaaucccagcacuguggaaagacaggaguucga

SEQ ID NO: 178224 - RNA, 62 nt, Homo Sapiens
ugcgggccaggcacaguggcucacaccuguaaucccagcacuaugggaggcccaggugagca

SEQ ID NO: 178225 - RNA, 62 nt, Homo Sapiens
ugaauuguuuauuugcagugaugcuucauauuucccagcacuguucaugguaucuuauuucc

SEQ ID NO: 178226 - RNA, 62 nt, Homo Sapiens
uauaggcugggugcgguggcucaugccuguaaucccagcacuuugggaggccaaggcaggug

SEQ ID NO: 178227 - RNA, 62 nt, Homo Sapiens
auggagccgggugcaguugccaacacuuguaaucccagcaguuugcgaggccgaggcaggug

SEQ ID NO: 178228 - RNA, 62 nt, Homo Sapiens
aggugagugggcaugguggcucaugccuguaaucccagcacuuuggaaggcugaggugggug

SEQ ID NO: 178229 - RNA, 62 nt, Homo Sapiens
caggggccgggcacggugccucacaccuguaaucccagcacuuagguaggccaaggugggug

SEQ ID NO: 178230 - RNA, 62 nt, Homo Sapiens
ucgggaggcugaggcaggaggggcaccuguagucccagcaacaauuagccaggcgugguggu

SEQ ID NO: 178231 - RNA, 62 nt, Homo Sapiens
uugggaggcccaggugggcgucacgccuguaaucccagcacucuuuggccgggugcgggggc

SEQ ID NO: 178232 - RNA, 62 nt, Homo Sapiens
uugggaggccauggcaggugucaugccuguaaucccagcacuaaguggccaggugcgguggc

SEQ ID NO: 178233 - RNA, 62 nt, Homo Sapiens
uugggaggacaaggugggugucacaccuguaaucccagcacuaauuuggccuggcacagggg

SEQ ID NO: 178234 - RNA, 62 nt, Homo Sapiens
uugggaggucggggggguggucaugucuguaaucccagcacuaauuagccaggcgcauuggc

SEQ ID NO: 178235 - RNA, 62 nt, Homo Sapiens
augggaggccgagacgggcgucaugccuguaaucccagcacugguuggccaggcacgguggu

SEQ ID NO: 178236 - RNA, 62 nt, Homo Sapiens
uugggaggccaaggugggcaucaugccuguaaucccagcacuaauagaccaggugcucuggc

SEQ ID NO: 178237 - RNA, 62 nt, Homo Sapiens
uugggaggccgaggcaagagucacaccuguaaucccagcacucacaggacaggugugguggc

SEQ ID NO: 178238 - RNA, 62 nt, Homo Sapiens
uugagaggccaagacagguaucacaccuguaaucccagcacuauugggccaggcgugguguc

SEQ ID NO: 178239 - RNA, 62 nt, Homo Sapiens
ucuuugcugggcauggugacucacgccuguaaucccagcacuuuggaagggugaggugggug

SEQ ID NO: 178240 - RNA, 62 nt, Homo Sapiens
ucucggcugggcgcgguggcgcaugccuguaaucccagcacuuugggaggccaaggugggug

SEQ ID NO: 178241 - RNA, 62 nt, Homo Sapiens
aucagggcugggcacagcgguuccgccuguaaucccagcacuuugggagguccaggcaggug

SEQ ID NO: 178242 - RNA, 62 nt, Homo Sapiens
uucuggccgggcgugguggcucaagccuguaaucccagcacuuugggaggccgaggugggcg

SEQ ID NO: 178243 - RNA, 62 nt, Homo Sapiens
uuugggccaggcacagucgcucauacuuguaaucccagcacuuugggaggccgaggcgggug

SEQ ID NO: 178244 - RNA, 62 nt, Homo Sapiens
aucaggcuaggcacaguggcucacacauggaaucccagcacuuugggaggccgaggugggag

SEQ ID NO: 178245 - RNA, 62 nt, Homo Sapiens
cuuggccugaguaaacuuggcuccuuugugugucccagcaccuccccagcacugaguccccc

SEQ ID NO: 178246 - RNA, 62 nt, Homo Sapiens
uugggaggcugagacaggcaucacgccuguaaucccagcacugagaggccgggcacgguggc

SEQ ID NO: 178247 - RNA, 62 nt, Homo Sapiens
uugggaggccgaggcaggugucacgccuguaaucccagcacuaccuggccaggcaugguggc

SEQ ID NO: 178248 - RNA, 62 nt, Homo Sapiens
uugggaggcugagguggguguuguuccuauagucccagcacuucugagcuggaugcaguggc

SEQ ID NO: 178249 - RNA, 62 nt, Homo Sapiens
ucuaggcuaggugcaguggcuuguuccuguagucccagcacucugggaaccuggguugggag

SEQ ID NO: 178250 - RNA, 62 nt, Homo Sapiens
aguuuaccuggcagagugugucaugccugcaaucccagcacuuugggaggccaaggcaggca

SEQ ID NO: 178251 - RNA, 64 nt, Homo Sapiens
uuaaaucacacuguccuauuccaggcuuugcuuuaaguugcacuggaaucuccuccauuauuac

SEQ ID NO: 178252 - RNA, 64 nt, Homo Sapiens
uuaagguggucucagccaauucccacuauaagucaaguugcagucacauagugguacugcauag

SEQ ID NO: 178253 - RNA, 64 nt, Homo Sapiens
auacacaauuuuuaaaaaucaagacuaauucaagaaguugcaggaguauaaaaauguacuaaca

SEQ ID NO: 178254 - RNA, 64 nt, Homo Sapiens
agaugguauagccgaauauaaaaggaacaaucagaaguugcaaauuauucauaagaaauugaga

SEQ ID NO: 178255 - RNA, 64 nt, Homo Sapiens
cucaagcucuuuuauaaugaugagcaagagauggaaguugcaacaggguaagagagggcaagag

SEQ ID NO: 178256 - RNA, 64 nt, Homo Sapiens
caguuuauuaacaacugaacuggcuaauguuucuaaguugcacacuguauaagaaugguguguu

SEQ ID NO: 178257 - RNA, 64 nt, Homo Sapiens
aucgcaaccccucuccuuccaguauaaccagcugaaguugcagauguuagauauuuuucauaaa

SEQ ID NO: 178258 - RNA, 64 nt, Homo Sapiens
accaagaauauccuuuaaaauuuaaaaggauggcaaguugcaucagaaagcuuuauuuugagau

SEQ ID NO: 178259 - RNA, 64 nt, Homo Sapiens
caauuuuuauccaguacuuuauagauucaacucuaaguugcaagcgaagucaaaacugaugaaa

SEQ ID NO: 178260 - RNA, 64 nt, Homo Sapiens
cccacaacaugugggaauuccagaagauaaauucaaguugcaauuucaguggggacauagccaa

SEQ ID NO: 178261 - RNA, 64 nt, Homo Sapiens
uagaaaucaagcauaaaucauuauguauaaacauaaguugcauuugcuuucuuugaguuuuaaa

SEQ ID NO: 178262 - RNA, 64 nt, Homo Sapiens
ugauuguauaagcaugcuuuguucuuaaaguuuaaaguugcacaccaccauguauucauccaga

SEQ ID NO: 178263 - RNA, 64 nt, Homo Sapiens
cucacaauguaacugcuuuagucauauuaaccugaaguugcaguuuagacacauguuguugggg

SEQ ID NO: 178264 - RNA, 64 nt, Homo Sapiens
uaaagacuauuuugaagauuugaauaaagugaugaaguugcauuacaccucacugcaaggauuc

SEQ ID NO: 178265 - RNA, 64 nt, Homo Sapiens
uuugguuuccccuuaugauuccuuuuuuuuuuucaaguugcauaucagucacuauauucuguuu

SEQ ID NO: 178266 - RNA, 64 nt, Homo Sapiens
uaauuuaaacugucuaguggaguagucuaggaaaaaguugcagguuugaccucauucuucauau

SEQ ID NO: 178267 - RNA, 64 nt, Homo Sapiens
uaccucaguaaaaaccuucaggccacaaagcaaaaaguugcauagccacaacgaagaucuaguu

SEQ ID NO: 178268 - RNA, 64 nt, Homo Sapiens
caacgaagaucuaguuggauauaguuuuugauuuaaguugcaguuauagccaauuuaggcuaau

SEQ ID NO: 178269 - RNA, 64 nt, Homo Sapiens
ugaccuugaacugaaucacuucaggugagguuccaaguugcaacugaacauauauacuugcccc

SEQ ID NO: 178270 - RNA, 64 nt, Homo Sapiens
guuuuccucuuggacauuguucaacaccugaagaaaguugcaguagaggucucuauuggauuuc

SEQ ID NO: 178271 - RNA, 64 nt, Homo Sapiens
gacaaaaauaccaaaauaaacaguaaaaggauuuaaguugcacuacuuuuuuuuuucugcaggu

SEQ ID NO: 178272 - RNA, 64 nt, Homo Sapiens
uuuucuuuccuucccuuaucuggggcacacuuggaaguugcaugaucagaaaacaacuuugucu

SEQ ID NO: 178273 - RNA, 64 nt, Homo Sapiens; identical to SEQ ID NO: 161467

SEQ ID NO: 178274 - RNA, 64 nt, Homo Sapiens; identical to SEQ ID NO: 161468

SEQ ID NO: 178275 - RNA, 64 nt, Homo Sapiens; identical to SEQ ID NO: 161469

SEQ ID NO: 178276 - RNA, 64 nt, Homo Sapiens; identical to SEQ ID NO: 161470

SEQ ID NO: 178277 - RNA, 64 nt, Homo Sapiens; identical to SEQ ID NO: 161471

SEQ ID NO: 178278 - RNA, 64 nt, Homo Sapiens; identical to SEQ ID NO: 161472

SEQ ID NO: 178279 - RNA, 64 nt, Homo Sapiens; identical to SEQ ID NO: 161473

SEQ ID NO: 178280 - RNA, 64 nt, Homo Sapiens; identical to SEQ ID NO: 161474

SEQ ID NO: 178281 - RNA, 64 nt, Homo Sapiens; identical to SEQ ID NO: 161475

SEQ ID NO: 178282 - RNA, 64 nt, Homo Sapiens; identical to SEQ ID NO: 161476

SEQ ID NO: 178283 - RNA, 64 nt, Homo Sapiens; identical to SEQ ID NO: 161477

SEQ ID NO: 178284 - RNA, 64 nt, Homo Sapiens; identical to SEQ ID NO: 161478

SEQ ID NO: 178285 - RNA, 64 nt, Homo Sapiens; identical to SEQ ID NO: 161479

SEQ ID NO: 178286 - RNA, 64 nt, Homo Sapiens; identical to SEQ ID NO: 161480

SEQ ID NO: 178287 - RNA, 64 nt, Homo Sapiens; identical to SEQ ID NO: 161481

SEQ ID NO: 178288 - RNA, 64 nt, Homo Sapiens; identical to SEQ ID NO: 161482

SEQ ID NO: 178289 - RNA, 64 nt, Homo Sapiens; identical to SEQ ID NO: 161483

SEQ ID NO: 178290 - RNA, 64 nt, Homo Sapiens; identical to SEQ ID NO: 161484

SEQ ID NO: 178291 - RNA, 64 nt, Homo Sapiens; identical to SEQ ID NO: 161485

SEQ ID NO: 178292 - RNA, 64 nt, Homo Sapiens; identical to SEQ ID NO: 161486

SEQ ID NO: 178293 - RNA, 64 nt, Homo Sapiens; identical to SEQ ID NO: 161487

SEQ ID NO: 178294 - RNA, 64 nt, Homo Sapiens; identical to SEQ ID NO: 161488

SEQ ID NO: 178295 - RNA, 64 nt, Homo Sapiens; identical to SEQ ID NO: 161489

SEQ ID NO: 178296 - RNA, 64 nt, Homo Sapiens; identical to SEQ ID NO: 161490

SEQ ID NO: 178297 - RNA, 64 nt, Homo Sapiens; identical to SEQ ID NO: 161491

SEQ ID NO: 178298 - RNA, 64 nt, Homo Sapiens; identical to SEQ ID NO: 161492

SEQ ID NO: 178299 - RNA, 64 nt, Homo Sapiens; identical to SEQ ID NO: 161493

SEQ ID NO: 178300 - RNA, 64 nt, Homo Sapiens; identical to SEQ ID NO: 161494

SEQ ID NO: 178301 - RNA, 64 nt, Homo Sapiens; identical to SEQ ID NO: 161495

SEQ ID NO: 178302 - RNA, 64 nt, Homo Sapiens; identical to SEQ ID NO: 161496

SEQ ID NO: 178303 - RNA, 64 nt, Homo Sapiens; identical to SEQ ID NO: 161497

SEQ ID NO: 178304 - RNA, 64 nt, Homo Sapiens
uccagcucccaaguuuuccucggugggaucugacgaccugaaagggcagggcuacauccuggcu

SEQ ID NO: 178305 - RNA, 64 nt, Homo Sapiens
ggguaagugacuugcccaagagugagauugccgagaccugaagaguggaaucccuucauucugc

SEQ ID NO: 178306 - RNA, 64 nt, Homo Sapiens
aaguggacagggaaggccucugacauuuauccaagaccugaaagaugggcaaaagacgggaagc

SEQ ID NO: 178307 - RNA, 64 nt, Homo Sapiens
aggcuccgcggcaggaggagccggugcucuggaagaccugaaagaagcccagguggccacaggg

SEQ ID NO: 178308 - RNA, 64 nt, Homo Sapiens
cggucagcaccagaagucaacugaguuaaggcaggaaaagaaauaagcccaaccaacuugccaa

SEQ ID NO: 178309 - RNA, 64 nt, Homo Sapiens
acuuaaaugaauuuaaaaugagccaaaggacccugaaaagaagacauguugauuucccacuccu

SEQ ID NO: 178310 - RNA, 64 nt, Homo Sapiens
gcauuucuuuuuaggcucugagacuaaaugagaggaaaagaaaagaaaaaaaaaaugauugucu

SEQ ID NO: 178311 - RNA, 64 nt, Homo Sapiens
ucuuuuuaggcucugagacuaaaugagaggaaaagaaaagaaaaaaaaaaugauugucuaacca

SEQ ID NO: 178312 - RNA, 64 nt, Homo Sapiens
agaaggaggcugggcagaacaagaaccaggccuggaaaagaaccggugggaagagagccuggaa

SEQ ID NO: 178313 - RNA, 64 nt, Homo Sapiens
aggccuggaaaagaaccagagggaagagagccuggaaaagaaccuucugucauuguucaaaggu

SEQ ID NO: 178314 - RNA, 64 nt, Homo Sapiens
gcccugcuucccugccuccugcugcagggagauggaaaagaagaccagcaguguuucugcagug

SEQ ID NO: 178315 - RNA, 64 nt, Homo Sapiens
ccaaaggaguguuguguggacuuugugucuuguugaaaagaaacgcugaaaugucuccacgucu

SEQ ID NO: 178316 - RNA, 64 nt, Homo Sapiens
uuucuacuaauuucagaccuccaaaaagagaaaagaaaagaaaacuaaaacacuucuacuaggg

SEQ ID NO: 178317 - RNA, 64 nt, Homo Sapiens
gaaaauuucuacuaauuucauagggccaaaaagagaaaagaaaaggaagcuaaaacacuucuac

SEQ ID NO: 178318 - RNA, 64 nt, Homo Sapiens
ggaagaagaucaaaacccacaagaagaaggggaagaaaagaaggggaagaagaucaaagaagaa

SEQ ID NO: 178319 - RNA, 64 nt, Homo Sapiens
aggggaagaaaagaaggggaagaagaucaaagaagaaaagaagaaggggaagaaaagaagggga

SEQ ID NO: 178320 - RNA, 64 nt, Homo Sapiens
ggaagaagaucaaagaagaaaaggggaaggggaagaaaagaagguuauugcagaaauugaaaag

SEQ ID NO: 178321 - RNA, 64 nt, Homo Sapiens
ggaaggggaagaaaagaaggacgugggagaaauugaaaagaaggacauguuggcuuuucucuug

SEQ ID NO: 178322 - RNA, 64 nt, Homo Sapiens
cuggagcugguggcuuaggcaaaaaaaaaagaaagaaaagaaagaagagcaaaacuccagcuca

SEQ ID NO: 178323 - RNA, 64 nt, Homo Sapiens
cuggaggcugggcgcaguggaccgcugcucuaaagaaaagaaaaugaagccaaaaggauuuaaa

SEQ ID NO: 178324 - RNA, 64 nt, Homo Sapiens
cuagcuaaggaagggaaaggcuauuaagggaaaggaaaagaacauuucuauucaccauccuuua

SEQ ID NO: 178325 - RNA, 64 nt, Homo Sapiens
uagauaggugcuuuuaacuguguugccuuaucuugaaaagaaucaacuauuuuaaagcugacuu

SEQ ID NO: 178326 - RNA, 64 nt, Homo Sapiens
cucccugaaaaagagaaaaaaaaaaggaaaaaaagaaaagaaaagugaaaagaaaaacucuuau

SEQ ID NO: 178327 - RNA, 64 nt, Homo Sapiens
gagaaaaaaaaaaggaaaaaaagaaaagaaaagugaaaagaaaaacucuuauuggccuaaguuc

SEQ ID NO: 178328 - RNA, 64 nt, Homo Sapiens
auauagagaaaacugguaaagaacauuccaguaggaaaagaaaagaacaaucuuccauuucugg

SEQ ID NO: 178329 - RNA, 64 nt, Homo Sapiens
gagaaaacugguaaagaacauuccaguaggaaaagaaaagaacaaucuuccauuucugggcuug

SEQ ID NO: 178330 - RNA, 64 nt, Homo Sapiens
gugagaaaacuaaaacuacaugaguuucauguuagaaaagaauuuuuaaacaaucuucagaugg

SEQ ID NO: 178331 - RNA, 64 nt, Homo Sapiens
aaauccccuugaugcuaccuuugaaauauaacuagaaaagaaugacuugccaccauauccacua

SEQ ID NO: 178332 - RNA, 64 nt, Homo Sapiens
ucccucccgccuccagguccauccaucccguccggaaaagaaggacccagagggaagaaggaac

SEQ ID NO: 178333 - RNA, 64 nt, Homo Sapiens
auguccgacauuauuuaauaaauaauuuuuaaaagaaaagaacgauaaaugaagccaacaugau

SEQ ID NO: 178334 - RNA, 64 nt, Homo Sapiens
cccagcccucuugcaagaggagaggcacgguagggaaaagaacugcugggugggggccuguuuc

SEQ ID NO: 178335 - RNA, 64 nt, Homo Sapiens
aguucuuugcagauuuggggcgaggggugauuuggaaaagaagaccuggguggaaagcgguuug

SEQ ID NO: 178336 - RNA, 64 nt, Homo Sapiens
agaaagacggguguuuuauuuggucuaauacccugaaaagaagugaugacuuguugcuuuucaa

SEQ ID NO: 178337 - RNA, 64 nt, Homo Sapiens
uaacauuauuuacaguagauaagugguuugagaugaaaagaacccgaguaaguagacaagaaua

SEQ ID NO: 178338 - RNA, 64 nt, Homo Sapiens
uuuuugugugugaauuaucauaauuuaaccaugugaaaagaauucaggagcaagagaaagaaga

SEQ ID NO: 178339 - RNA, 64 nt, Homo Sapiens
caaaaaacgaaugaaaauaacuaguuaaagaaaggaaaagaaaauuauuuaauaugcuuauaac

SEQ ID NO: 178340 - RNA, 64 nt, Homo Sapiens
aaagaugguuaaacauuuucaagagagaaacacugaaaagaaggguggggggaugguaagagaa

SEQ ID NO: 178341 - RNA, 64 nt, Homo Sapiens
ugcugcccaguuaaaggggcguaauauuaaguuagaaaagaaguuuacuagaaaauaguucagu

SEQ ID NO: 178342 - RNA, 64 nt, Homo Sapiens
augaaauaaaugaaggaagcgcaaguaccaggaugaaaagaacucuuaacggaaguuacaucag

SEQ ID NO: 178343 - RNA, 64 nt, Homo Sapiens
uuaguucacuauuauauaguggguuauauuaaaagaaaagaagaaaaauaucuaauuucucuug

SEQ ID NO: 178344 - RNA, 64 nt, Homo Sapiens
uggucauauuugaaauguauaaguccauaaaauagaaaagaacaagugaauuguugcuauuuaa

SEQ ID NO: 178345 - RNA, 64 nt, Homo Sapiens
ccuuugagguagaccaggauuucuaaucaaaagggaaaagaagauguugaagaauacaguuagg

SEQ ID NO: 178346 - RNA, 64 nt, Homo Sapiens
gaccuucuagaauuauaagucacaaagaguucuggaaaagaacuguuuacugcuugauaggaau

SEQ ID NO: 178347 - RNA, 64 nt, Homo Sapiens
augguucaaauuauaucuaauucaaaaaagaaaagaaaagaaacgugacagagugagacucugu

SEQ ID NO: 178348 - RNA, 64 nt, Homo Sapiens
gaaacaugguucaaauuauaucuguuucaaaaaagaaaagaaaagccuggugacagagugagac

SEQ ID NO: 178349 - RNA, 64 nt, Homo Sapiens
aaugauucuuuguaggcgccccuuuauuggugaagaaaagaaugcagaggaaagccaagaacag

SEQ ID NO: 178350 - RNA, 64 nt, Homo Sapiens
caguaaaugcauugaugucacuuucaaguuuacagaaaagaaagaaaaguuuuuuuuaaucugu

SEQ ID NO: 178351 - RNA, 64 nt, Homo Sapiens
ugccuugauguacauauauuuuccuaaagcacaagaaaagaaugagcagaucacauguaaauca

SEQ ID NO: 178352 - RNA, 64 nt, Homo Sapiens
caguuauuaaacacuguugauaaauugaccaugagaaaagaacauacuauuucuucaaggcaag

SEQ ID NO: 178353 - RNA, 64 nt, Homo Sapiens
ucuuaaucacggugccaaaauaaagguuaaacuugaaaagaaauuguagcuacuguuuuuaaug

SEQ ID NO: 178354 - RNA, 64 nt, Homo Sapiens
aaaaaacuuaaauauuuauucacagauugaagaagaaaagaaaggucugcucugagccuuaaaa

SEQ ID NO: 178355 - RNA, 64 nt, Homo Sapiens
aagcgauucuucugccucagccucccaaaugucagaaaagaaagcauacaugcuuaugcaugaa

SEQ ID NO: 178356 - RNA, 64 nt, Homo Sapiens
guuuuggaaggcuuuccacaaacuaaccuuggaugaaaagaaaaaauuccucuguaaguacugu

SEQ ID NO: 178357 - RNA, 64 nt, Homo Sapiens
aaaaaaaaaaaaaaagagagagagagaauaaauagaaaagaauguggcugggaauugugaauca

SEQ ID NO: 178358 - RNA, 64 nt, Homo Sapiens
ucagauuggccuguuauuugauuuccuccuuugggaaaagaauuauguagauaccacauggaga

SEQ ID NO: 178359 - RNA, 64 nt, Homo Sapiens
uguaucagucauccagagacacgugagcgccagcgaaaagaaacgaaaagaaacuaucucgguc

SEQ ID NO: 178360 - RNA, 64 nt, Homo Sapiens
uaucucggucacgugagcgcuugugagcgccaaggaaaagaaacuuagggccuuccuuuuugcc

SEQ ID NO: 178361 - RNA, 64 nt, Homo Sapiens
agauuuauaaccacuugagucgcuguuuuuaaaugaaaagaaugacuuacuaccuaacacugag

SEQ ID NO: 178362 - RNA, 64 nt, Homo Sapiens
cucugguauuauuaagacucaauauauuugauuggaaaagaacuccucaagccaguugauuuuu

SEQ ID NO: 178363 - RNA, 64 nt, Homo Sapiens
auaucuuuauaaagaaaucuuuggcuuugucagggaaaagaaaagaauucccaaacuuuucuuu

SEQ ID NO: 178364 - RNA, 64 nt, Homo Sapiens
agacagggauuuuuuuaaagggcuucaucauccugaaaagaagguuguuuguaaugucuagugg

SEQ ID NO: 178365 - RNA, 64 nt, Homo Sapiens
uuauuuucuuccuaguucugggguaauuuaaaaagaaaagaaauauaacagaauacgacagacu

SEQ ID NO: 178366 - RNA, 64 nt, Homo Sapiens
uacgaccuuucuuuauaacaaguauccggagaaggaaaagaacuagaguuauuuguguaaguag

SEQ ID NO: 178367 - RNA, 64 nt, Homo Sapiens
agagaugacaaaccauaacuuacagacuaagaaggaaaagaagaggcaacagauugaaaagacc

SEQ ID NO: 178368 - RNA, 64 nt, Homo Sapiens
agaaaaaaaucccuuguucucaaaaagaaaaaaagaaaagaaaaacucccugcccuucccccug

SEQ ID NO: 178369 - RNA, 64 nt, Homo Sapiens
auguccugcuugucuaguuuauccuggaaugccagaaaagaacuaauugauaaauauucuuauu

SEQ ID NO: 178370 - RNA, 64 nt, Homo Sapiens
uguguugacucagguuuggagucagaaccaauccgaaaagaaugguauuucucuucuuacgcca

SEQ ID NO: 178371 - RNA, 64 nt, Homo Sapiens
ucuuccauccauuguuggcacccccuugcaaaaggaaaagaacagcaaaagucaggagcaguaa

SEQ ID NO: 178372 - RNA, 64 nt, Homo Sapiens
agggaaaauaacaaccacccuuacugauaguugggaaaagaagauuggguuauuuugccauauc

SEQ ID NO: 178373 - RNA, 64 nt, Homo Sapiens
ugaucaucucagccaacaugcaucaguacugcaagaaaagaagucaaucagcagaggagagcau

SEQ ID NO: 178374 - RNA, 64 nt, Homo Sapiens
uuucuggaauuccuuguuagggaacuuuaaagaagaaaagaaaaacuugaauuguguugaauua

SEQ ID NO: 178375 - RNA, 64 nt, Homo Sapiens
uuuguagcagucuguaacuuaacuauaguauaaugaaaagaaugaccuauaauauagguguuuu

SEQ ID NO: 178376 - RNA, 64 nt, Homo Sapiens
aagaguaauccucuuucuugcugguguuucuaaagaaaagaaucagaaaucaaucuuucuacua

SEQ ID NO: 178377 - RNA, 64 nt, Homo Sapiens
aaauggaggaaauagucggaggugauggcaaauagaaaagaagcucuggccccaucgggucaca

SEQ ID NO: 178378 - RNA, 64 nt, Homo Sapiens
uuuaauaaauguaugugugguucauauuugagaagaaaagaacaggcucucacuagaguuacca

SEQ ID NO: 178379 - RNA, 64 nt, Homo Sapiens
acaguacuuuccagcagucaaugagcuguuggaagaaaagaauccuguaguugggccuaaauaa

SEQ ID NO: 178380 - RNA, 64 nt, Homo Sapiens
ugcaagacucgaauaaaaucgaagagaaaaaaaggaaaagaaguucggagaggccaagucuaau

SEQ ID NO: 178381 - RNA, 64 nt, Homo Sapiens
aaaaaacccuaaaaccaaaaauuuugccuuaccagaaaagaaaacaaaugauaucuaaagaucu

SEQ ID NO: 178382 - RNA, 64 nt, Homo Sapiens
uuuuuuuuuuuuugagacagacaggaagcucuuagaaaagaacuuuuagggagcagccacacau

SEQ ID NO: 178383 - RNA, 64 nt, Homo Sapiens
acauugaaacauuuguauugacaaguugucaaaugaaaagaauguaugacaaaugaaaagaaua

SEQ ID NO: 178384 - RNA, 64 nt, Homo Sapiens
acaaguugucaaaugaaaagcuuauaugacaaaugaaaagaauauuaguuaugagaaaucuuug

SEQ ID NO: 178385 - RNA, 64 nt, Homo Sapiens
aaagggaaaaaagaaaagcaaagaaaagaaaaaagaaaagaaaacacgacuuaauguauguugu

SEQ ID NO: 178386 - RNA, 64 nt, Homo Sapiens
aagaaaagaaaaaaagggaaaauguauguuguaagaaaagaaaauaacaucugauucacgacuu

SEQ ID NO: 178387 - RNA, 64 nt, Homo Sapiens
uguuacauagguugcaucacaagaacacggaugagaaaagaaugaaagguaauauuagcaguua

SEQ ID NO: 178388 - RNA, 64 nt, Homo Sapiens
cagccauguaagaggcuaacaagucaguguaucagaaaagaaagaucuuggugccuucuguuaa

SEQ ID NO: 178389 - RNA, 64 nt, Homo Sapiens
cacucugaggugcaacuuaacagggagggccugagaaaagaaugggagggggcuauuaauuauu

SEQ ID NO: 178390 - RNA, 64 nt, Homo Sapiens
ccaucaugauuaaugaaaacuaucuuuugaguuugaaaagaaauuaauuugcaguguuuggauu

SEQ ID NO: 178391 - RNA, 64 nt, Homo Sapiens
agugucuggaucaguaaaaucauuuuuuuuaauugaaaagaagugguggccaaacaacagucuu

SEQ ID NO: 178392 - RNA, 64 nt, Homo Sapiens
uuuuuuuuuaagcucaaaaucccuggcagcacaggaaaagaauugcucugugagccugaugccu

SEQ ID NO: 178393 - RNA, 64 nt, Homo Sapiens
aaauaguuggaaaauaagacugcuaaagguaaaagaaaagaaaauaaaaugaugcuguuuucuc

SEQ ID NO: 178394 - RNA, 64 nt, Homo Sapiens
aaaaaaaugcaaacuaugauaauaugucugcauugaaaagaacccccagagcacaggcuccagc

SEQ ID NO: 178395 - RNA, 64 nt, Homo Sapiens
gaauaaggucuaagagaauucgagcccuggcugugaaaagaaucucaacauagaagaaagaaga

SEQ ID NO: 178396 - RNA, 64 nt, Homo Sapiens
cuuacccaaaauuauuaauuuuauuaggcuuuuggaaaagaaaaaaaacuuuuugauguuuuag

SEQ ID NO: 178397 - RNA, 64 nt, Homo Sapiens
aacuucucaccauacgacaacagaucauauuccugaaaagaaauuuaaaucugaagcucuucua

SEQ ID NO: 178398 - RNA, 64 nt, Homo Sapiens
uaugaagcauuuaagaauaaugacuuucaguugggaaaagaauuuucaauggccagggaaacag

SEQ ID NO: 178399 - RNA, 64 nt, Homo Sapiens
caugauuuuucauugucacauaaaauaauuacaggaaaagaaugcgaauguuaugaaugaagag

SEQ ID NO: 178400 - RNA, 64 nt, Homo Sapiens
ccaauuaauuaaauaucacaaauuauucauaagagaaaagaauuuguacccuguugcucagaga

SEQ ID NO: 178401 - RNA, 64 nt, Homo Sapiens
uuuuaguccuaggccaguaguugugcuuuggguugaaaagaaguuagccuuuguggauuugggu

SEQ ID NO: 178402 - RNA, 64 nt, Homo Sapiens
gaaggguuugcagaggagagcuucucagagcacugaaaagaaagauuugaggcuuuucuauaua

SEQ ID NO: 178403 - RNA, 64 nt, Homo Sapiens
cauagggccaaguucaaaggaaaagaaaagaaaagaaaagaaauagagcaaaacuccgucucaa

SEQ ID NO: 178404 - RNA, 64 nt, Homo Sapiens
gaaaucauagggccaaguuccucaaaaaagaaaagaaaagaaaacaacaagagcaaaacuccgu

SEQ ID NO: 178405 - RNA, 64 nt, Homo Sapiens
gaaaagaaaucauagggccauccgucucaaaaaagaaaagaaaacugggcaacaagagcaaaac

SEQ ID NO: 178406 - RNA, 64 nt, Homo Sapiens
agcgaaauuaccuuacuuaauaaucuguauaugggaaaagaaaggacaaaacagacuauguaca

SEQ ID NO: 178407 - RNA, 64 nt, Homo Sapiens
ugaauuucauuauguaaacgaagaaauuuauaaugaaaagaagaauuaaggagaaauagaaaag

SEQ ID NO: 178408 - RNA, 64 nt, Homo Sapiens
aauuuauaaugaaaagaagaauuaaggagaaauagaaaagaagauuuaaugcccuaacucucuu

SEQ ID NO: 178409 - RNA, 64 nt, Homo Sapiens
uuugcccaguuuuuaauuacacugagauaauuuugaaaagaaauagaaauuaagcuacuauaua

SEQ ID NO: 178410 - RNA, 64 nt, Homo Sapiens
uaaaaugugaauaaauaaauguucugauaaaauagaaaagaaaguaaauuacagugauuuccau

SEQ ID NO: 178411 - RNA, 64 nt, Homo Sapiens
cuugggagacaucugucaaaccaggaauauucuugaaaagaacgugagcaggaaaaacugcugg

SEQ ID NO: 178412 - RNA, 64 nt, Homo Sapiens
uuuuuaaauaacucagguguaugagaagaaauuagaaaagaaaauuaacuuauguggacuguaa

SEQ ID NO: 178413 - RNA, 64 nt, Homo Sapiens
acuagacacaauaaaacaucagaaccagcuaagggaaaagaaauaucuggaguacauuaaaagu

SEQ ID NO: 178414 - RNA, 64 nt, Homo Sapiens
aaagaaauaucuggaguacauuaaaagugugaaagaaaagaaugauaaucuucuaaaggcuaua

SEQ ID NO: 178415 - RNA, 64 nt, Homo Sapiens
uuuaauugaacccauccacucugggcagguaagagaaaagaaaaagauaaggaaagaagagaga

SEQ ID NO: 178416 - RNA, 64 nt, Homo Sapiens
gaaaaaaauagcucaagacacaguuaaucgagaagaaaagaaauauguacagaaccauaaagaa

SEQ ID NO: 178417 - RNA, 64 nt, Homo Sapiens
uuuacaguacucagcaaaagaacauggaaugccugaaaagaauccagcugaagggaauacagua

SEQ ID NO: 178418 - RNA, 64 nt, Homo Sapiens
ugacacuuucugcuuuacagacugaacacuggaggaaaagaaaaaguauuuucgaagaggagca

SEQ ID NO: 178419 - RNA, 64 nt, Homo Sapiens
cauaaauaucgugucauauuaauggaccagaaaagaaaagaaacgaguacauuaaguaaaauaa

SEQ ID NO: 178420 - RNA, 64 nt, Homo Sapiens
gaaaccauaaauaucgugucaauaaaauggaccagaaaagaaaacuagugaguacauuaaguaa

SEQ ID NO: 178421 - RNA, 64 nt, Homo Sapiens
gcuaauguaaucauuuaucuaaaaaauaacaucugaaaagaaauaauaguuucaaaugaguuua

SEQ ID NO: 178422 - RNA, 64 nt, Homo Sapiens
aagucuaugcuuaggccaguguaaccauaugauugaaaagaagaguuuguaauauacaguuuuu

SEQ ID NO: 178423 - RNA, 64 nt, Homo Sapiens
auucuaacuggucaguauucagccuuucuugugagaaaagaauaagacaacuacagcccucauu

SEQ ID NO: 178424 - RNA, 64 nt, Homo Sapiens
agaagucauggguguaaucuacugaugauuuguggaaaagaaauaagauugaagagggccaaac

SEQ ID NO: 178425 - RNA, 64 nt, Homo Sapiens
auauuucaaauagaaacccaacuuucccuuguaggaaaagaaaauccuaauucuugcugaguug

SEQ ID NO: 178426 - RNA, 64 nt, Homo Sapiens
gcugcaaugccaccagagaaugacuugccuuugagaaaagaaggugguggccugaagacagggg

SEQ ID NO: 178427 - RNA, 64 nt, Homo Sapiens
uaccaagacauuaaaguagcauggcugcccaggagaaaagaagacauucuaauuccagucauuu

SEQ ID NO: 178428 - RNA, 64 nt, Homo Sapiens
gcaagaaggacagcaguaaaugaagaccauggaagaaaagaaggaaugccaaagaucgaggaaa

SEQ ID NO: 178429 - RNA, 64 nt, Homo Sapiens
ugcuaaguguagauuauugagguuuguuagugaggaaaagaauaagaguucagaagccuuuguu

SEQ ID NO: 178430 - RNA, 64 nt, Homo Sapiens
cuguucaucccuuccuauaaccucuagguaaaaagaaaagaaaaaaagaaauuucgagauauuu

SEQ ID NO: 178431 - RNA, 64 nt, Homo Sapiens
ucaccaggcaaagcuaaggaaggauauacuaguugaaaagaauaacccacuccucuucugggca

SEQ ID NO: 178432 - RNA, 64 nt, Homo Sapiens
acccucuuauuuuauaacuaaauaaauaaucacagaaaagaaugaucugaacaagaacagcuga

SEQ ID NO: 178433 - RNA, 64 nt, Homo Sapiens
gauaaacaaggaauauuuuguuuuaaguggaggggaaaagaagauuuuuucuuuuuuccuuuuu

SEQ ID NO: 178434 - RNA, 64 nt, Homo Sapiens
uacaauuagucacucaacauugcacaaguuuccagaaaagaaaauaacacaaaacugccaacuu

SEQ ID NO: 178435 - RNA, 64 nt, Homo Sapiens
cuuaagauauuucaaggaauaccuacuuuguccagaaaagaaguaacauggauggaaacugacc

SEQ ID NO: 178436 - RNA, 64 nt, Homo Sapiens
cauacucuuuccaugcauauacacaacaguaucugaaaagaauagagcuugagcugagagacag

SEQ ID NO: 178437 - RNA, 64 nt, Homo Sapiens
ccccccgcaaaaaaaaaaaagaaagaaagaaagagaaaagaaaagaaaagcaaccacagccagc

SEQ ID NO: 178438 - RNA, 64 nt, Homo Sapiens
cgcaaaaaaaaaaaagaaagaaagaaagagaaaagaaaagaaaagcaaccacagccagccuuag

SEQ ID NO: 178439 - RNA, 64 nt, Homo Sapiens
uuaaccccuucucgugccaucauaagucuccugggaaaagaaccacaagaaaagaaaugaagug

SEQ ID NO: 178440 - RNA, 64 nt, Homo Sapiens
gaagugcauaagucuccuggucacacuauaacaagaaaagaaauacagucacucacugccauuc

SEQ ID NO: 178441 - RNA, 64 nt, Homo Sapiens
aaguccagaaaucauauuacaagagaagagagaugaaaagaaacugugauaaaagcaagugaca

SEQ ID NO: 178442 - RNA, 64 nt, Homo Sapiens
uugaaccaaauauuagcuuuaaaauaaaauucaagaaaagaacgaaaauaugcaauggauguag

SEQ ID NO: 178443 - RNA, 64 nt, Homo Sapiens
ccacccacauuuuaauuuagaugcaaaaagaaaagaaaagaaaauuaauggcaugauuuuuuuu

SEQ ID NO: 178444 - RNA, 64 nt, Homo Sapiens
gaaaaccacccacauuuuaauuuuuaugcaaaaagaaaagaaaaacacauuaauggcaugauuu

SEQ ID NO: 178445 - RNA, 64 nt, Homo Sapiens
cuaaggggacaggugaauacuuuuaguaaauccagaaaagaagagccaaugauguauacaugua

SEQ ID NO: 178446 - RNA, 64 nt, Homo Sapiens
ugauuucauuuauaaaugaauuccauguauuuuggaaaagaaaauugucugccuugaauauugc

SEQ ID NO: 178447 - RNA, 64 nt, Homo Sapiens
ugugucauauuggugugcugucuuucuccuguuugaaaagaaauccauaugaugacacacagug

SEQ ID NO: 178448 - RNA, 64 nt, Homo Sapiens
agggagaaaaccucuuagcaauuguuucagagcagaaaagaaaacugcacaaagcaaccgccaa

SEQ ID NO: 178449 - RNA, 64 nt, Homo Sapiens
aauggaaacuauuggaugaaaugaggaaaaacaggaaaagaauucacuuuuuaaaugaagaaau

SEQ ID NO: 178450 - RNA, 64 nt, Homo Sapiens
uggcaagagcccaacucuacuaaaaauacaaaaagaaaagaaaacagccaagcuuggugguaug

SEQ ID NO: 178451 - RNA, 64 nt, Homo Sapiens
aagagaaggggagaaacccuaggggacaaggaaggaaaagaaagaaaaaauguuuucuggggaa

SEQ ID NO: 178452 - RNA, 64 nt, Homo Sapiens
aauauaccuuuuuuguuccaaagagaaaaaggcugaaaagaagguuuucuuuuuuuaacuggug

SEQ ID NO: 178453 - RNA, 64 nt, Homo Sapiens
uaaucugauauggaaggauauuuaacaagggcuagaaaagaauggaaggcuuaguagcucaguc

SEQ ID NO: 178454 - RNA, 64 nt, Homo Sapiens
cuguguguguguguguguguaauguuagaacagugaaaagaauugagacuaagccuagagaguc

SEQ ID NO: 178455 - RNA, 64 nt, Homo Sapiens
gaauagacuaucuagaacuuuucuaccuggaaaagaaaagaaaucagcaguuguuccagggagc

SEQ ID NO: 178456 - RNA, 64 nt, Homo Sapiens
gaaaugaauagacuaucuagggagcuucuaccuggaaaagaaaauauuccagcaguuguuccag

SEQ ID NO: 178457 - RNA, 64 nt, Homo Sapiens
aaaaaauagcaacucugguguaaagcacuaaacagaaaagaaaauaccuauaagaauuaagggg

SEQ ID NO: 178458 - RNA, 64 nt, Homo Sapiens
auucagucuugacggugaauuauguggugauaaugaaaagaaugccaaauuccacaauaagcaa

SEQ ID NO: 178459 - RNA, 64 nt, Homo Sapiens
cacuuccuugaaaauuuuauuccaauggaauacugaaaagaaauacacacauucacccuaagga

SEQ ID NO: 178460 - RNA, 64 nt, Homo Sapiens
aggagaaaaacaaagagauugaaaagagagaaaggaaaagaaaauuaugaauacaaagauaagu

SEQ ID NO: 178461 - RNA, 64 nt, Homo Sapiens
aaaaaauauauauauauauaaauaauguucuauagaaaagaaaaauugcuguugaucuuuuauc

SEQ ID NO: 178462 - RNA, 64 nt, Homo Sapiens
ugcugcauaggaaaacugagguaacguguuccuagaaaagaaaauuuccuuguccugguugaag

SEQ ID NO: 178463 - RNA, 64 nt, Homo Sapiens
caccuacucccugacacuguccaugaacuauagggaaaagaaaucacccauuuagguaucacua

SEQ ID NO: 178464 - RNA, 64 nt, Homo Sapiens
guguuccaacuguuuaaaauugaucagagaccacgaaaagaaauuugugcuucaccgaagaaaa

SEQ ID NO: 178465 - RNA, 64 nt, Homo Sapiens
auacaaaaaccaguuaauguuuuguagacccugggaaaagaauuuucagcaaaguacaaaaauu

SEQ ID NO: 178466 - RNA, 64 nt, Homo Sapiens
caaaccacacauuaguacuuauguugcacaaugagaaaagaaauuaguuucaaauuuaccucag

SEQ ID NO: 178467 - RNA, 64 nt, Homo Sapiens
gagacccccaucuuuacaaagaaaaaaaaaaggggaaaagaaaaucuuuuaaaucuuuggauuu

SEQ ID NO: 178468 - RNA, 64 nt, Homo Sapiens
uagauuauguuccauugcuaaugaauuugacuuagaaaagaauugccuuauuuuuaagagauug

SEQ ID NO: 178469 - RNA, 64 nt, Homo Sapiens
accaacugugaaagcuggcuuuaauuuuuaggaggaaaagaaaagccugcauguguucuuuauu

SEQ ID NO: 178470 - RNA, 64 nt, Homo Sapiens
uaaaacuuucuucaucuguuacaauguuuaaugugaaaagaaaucuguuagcugauugugguaa

SEQ ID NO: 178471 - RNA, 64 nt, Homo Sapiens
uaaaauguugggugaauucugagaggaaaaaauggaaaagaaacguuaauuacugggccaacuu

SEQ ID NO: 178472 - RNA, 64 nt, Homo Sapiens
auugaauauaagccaaaagccauuuugcauaucugaaaagaagcacaacaacccaaugaaauaa

SEQ ID NO: 178473 - RNA, 64 nt, Homo Sapiens
uugcagucagacauucgucaaaauccauguuauagaaaagaacucugaaucuuuccuguugaag

SEQ ID NO: 178474 - RNA, 64 nt, Homo Sapiens
ugauuuuuauuuuuccuuugguauuugcuacagugaaaagaaguuuggaaaguagauacauaaa

SEQ ID NO: 178475 - RNA, 64 nt, Homo Sapiens
auacauaaagacuugagaagggaauuguuuaagggaaaagaaaagaguaauaauuuuuuuuaaa

SEQ ID NO: 178476 - RNA, 64 nt, Homo Sapiens
uuuaggcauuaccucagggaaaagccuugacagugaaaagaaacuacuuaaucgcuaauagcua

SEQ ID NO: 178477 - RNA, 64 nt, Homo Sapiens
caagcugauauuuuaggugcucuaaagcaccuaagaaaagaacugcaaagucugagaaauagga

SEQ ID NO: 178478 - RNA, 64 nt, Homo Sapiens
ccaaaauucugaagucuggaaguuuuuccuucaagaaaagaaacugcauaaaaaauuuaaaacu

SEQ ID NO: 178479 - RNA, 64 nt, Homo Sapiens
uccuuuggaaggugacacugggaacaacgcauaggaaaagaaucaugccaccuccucuguucuu

SEQ ID NO: 178480 - RNA, 64 nt, Homo Sapiens
agaagagccuuaacauauauaaguagaguauauugaaaagaaaaaguuuauuuuuuaaaauucu

SEQ ID NO: 178481 - RNA, 64 nt, Homo Sapiens
acuggauacuuuuuuguuguaauaaucuucauaagaaaagaaacuaccaauacuguguuuuauu

SEQ ID NO: 178482 - RNA, 64 nt, Homo Sapiens
ggcucagaaaaauuaggaugauguaauuuuucaugaaaagaaagccaaacuucuguuuuauaau

SEQ ID NO: 178483 - RNA, 64 nt, Homo Sapiens
guuccuuucaguaguugccaucuuggccaugcaagaaaagaaaagaaggcauuuacucuauguc

SEQ ID NO: 178484 - RNA, 64 nt, Homo Sapiens
uuucaguaguugccaucuuggccaugcaagaaaagaaaagaaggcauuuacucuaugucggggg

SEQ ID NO: 178485 - RNA, 64 nt, Homo Sapiens
ugaauuucgaaagaaauaauuggcaagauaaugagaaaagaaaaaagucaugguaggugaggug

SEQ ID NO: 178486 - RNA, 64 nt, Homo Sapiens
uguagccaagcagaguuguagagggggauaaaaagaaaagaaauuggauguauuuacagcuguc

SEQ ID NO: 178487 - RNA, 64 nt, Homo Sapiens
uuuuaauucuucccuuggauuaauauuuucuacugaaaagaaaugaaaucucaguuccacuaug

SEQ ID NO: 178488 - RNA, 64 nt, Homo Sapiens
auugacuguuaauugauucaggguacccuuaaaagaaaagaaguuuucccauugugaaccuuaa

SEQ ID NO: 178489 - RNA, 64 nt, Homo Sapiens
cgagaaaaggagaaaggagcucugaaucugauaggaaaagaaggcugccuaaggaggaguuuuu

SEQ ID NO: 178490 - RNA, 64 nt, Homo Sapiens
cauucaaaacaaccauccugcucauaacaucuuugaaaagaaaaauauauaugugcaguauuuu

SEQ ID NO: 178491 - RNA, 64 nt, Homo Sapiens
aaugcauugcuuugcuuacaguauugacucaagggaaaagaacugucaguaucuguagauuaau

SEQ ID NO: 178492 - RNA, 64 nt, Homo Sapiens
aagcugauagucuugaauauuuuauuuuuuuaaugaaaagaaaaaacaagaaaguuauguuuca

SEQ ID NO: 178493 - RNA, 64 nt, Homo Sapiens
ugcugaaaucaauguauaaaucaccugaguacaugaaaagaaaaauauaaaagagugauuuucc

SEQ ID NO: 178494 - RNA, 64 nt, Homo Sapiens
ggugugggagagggauaccuaggagaagugacuggaaaagaacuagacugaagacaaacauggg

SEQ ID NO: 178495 - RNA, 64 nt, Homo Sapiens
auguuaugauuuuguagaaaaauaaauguuucuggaaaagaacuacacuuaaguagauuuuaag

SEQ ID NO: 178496 - RNA, 64 nt, Homo Sapiens
cauuuaccugccugucuguaaagacuucuuuuuagaaaagaaaggugaacagugaggugguagc

SEQ ID NO: 178497 - RNA, 64 nt, Homo Sapiens
uggcaggcaaacacaacucuagaguaaaguuuaugaaaagaaagugccuucgcaaauucucaaa

SEQ ID NO: 178498 - RNA, 64 nt, Homo Sapiens
uccuaucaugaauaaaagcuaucuccauaucccagaaaagaagaucccucaucccagaagaggc

SEQ ID NO: 178499 - RNA, 64 nt, Homo Sapiens
cgaaaagauccuguuuucagcuaaaauguggaaagaaaagaauguuguucuaagaugcauggaa

SEQ ID NO: 178500 - RNA, 64 nt, Homo Sapiens
uggggucuuggauaucaccuucuucuauguuuuugaaaagaaggggagacugaagugugcaggu

SEQ ID NO: 178501 - RNA, 64 nt, Homo Sapiens
aaugaagcaguguugucuauggaaguggggaguagaaaagaagauccccauugacagugaggag

SEQ ID NO: 178502 - RNA, 64 nt, Homo Sapiens
cauugccgagaguccuguuauugagguagaaacagaaaagaaagacguucuugauuuuggugac

SEQ ID NO: 178503 - RNA, 64 nt, Homo Sapiens
aacaaaggaauugaaacaggguuuucagaaaagagaaaagaaacaguaaaacuauuugcaacug

SEQ ID NO: 178504 - RNA, 64 nt, Homo Sapiens
agcuugagaguaaugucacucccugugauuauuugaaaagaauuccuguuagauuaaagcugca

SEQ ID NO: 178505 - RNA, 64 nt, Homo Sapiens
uuaguucuaccuugauuacaugaagucaggaaaagaaaagaaacgugggucugaaauucauaca

SEQ ID NO: 178506 - RNA, 64 nt, Homo Sapiens
gaaacuuaguucuaccuugaauacaugaagucaggaaaagaaaacugaggugggucugaaauuc

SEQ ID NO: 178507 - RNA, 64 nt, Homo Sapiens
acuaguucaguuuuauuccacacaggaaauauaggaaaagaaacauucagcuaaaauaguacuu

SEQ ID NO: 178508 - RNA, 64 nt, Homo Sapiens
gcaacaagagcaaaacuccgucucaaaauaaaaagaaaagaaaagaauggacaguguuugcaga

SEQ ID NO: 178509 - RNA, 64 nt, Homo Sapiens
aagagcaaaacuccgucucaaaauaaaaagaaaagaaaagaauggacaguguuugcagagaguu

SEQ ID NO: 178510 - RNA, 64 nt, Homo Sapiens
auauggauauccaauuguuucacacaauuuuuuugaaaagaauauccuuggcagggcacgguag

SEQ ID NO: 178511 - RNA, 64 nt, Homo Sapiens
caaaaaaaaaaaaaaaaaaaaggaaagaaagaaagaaaagaaaagaaaauccuuuuugcuuuaa

SEQ ID NO: 178512 - RNA, 64 nt, Homo Sapiens
aaaaaaaaaaaaaaaaggaaagaaagaaagaaaagaaaagaaaauccuuuuugcuuuaacuugc

SEQ ID NO: 178513 - RNA, 64 nt, Homo Sapiens
uuuuaggcagcaagaauuggagaacucacacugcgaaaagaaaaccuuggguggcagugauuug

SEQ ID NO: 178514 - RNA, 64 nt, Homo Sapiens
acuccaucuuaaaaaaaaaaaaaaaaaaaagaaagaaaagaaaauggaguucugagagcuagga

SEQ ID NO: 178515 - RNA, 64 nt, Homo Sapiens
agucuggcaacagagcaagacuccaucucaaaaagaaaagaaaagaagacucugaccuguacuc

SEQ ID NO: 178516 - RNA, 64 nt, Homo Sapiens
ggcaacagagcaagacuccaucucaaaaagaaaagaaaagaagacucugaccuguacucuugaa

SEQ ID NO: 178517 - RNA, 64 nt, Homo Sapiens
uggcucucaggguggcuucuaccugaagacgcaggaaaagaaucuuuccuagaaaauccuucag

SEQ ID NO: 178518 - RNA, 64 nt, Homo Sapiens
agagacaaauuacccagaaaccugucucaagaaagaaaagaaaaccugggcgacacagcgagac

SEQ ID NO: 178519 - RNA, 64 nt, Homo Sapiens
aaaaucucaucacuugaagcaaaaaaaaaaaaaagaaaagaaaagaaaagaaaaaaaaaagaca

SEQ ID NO: 178520 - RNA, 64 nt, Homo Sapiens
aaaaaagacaaaaaaaaaaaauuucaacgaaauggaaaagaaaaccuuccccauugcuguaaau

SEQ ID NO: 178521 - RNA, 64 nt, Homo Sapiens
uagaaauaauauucacuucuagugaaaagugugggaaaagaauaggaaagugucuaugauauau

SEQ ID NO: 178522 - RNA, 64 nt, Homo Sapiens
ggggaaagucuaugaacgacucaaauuuguucuggaaaagaaagcccucuguuaauuguguguc

SEQ ID NO: 178523 - RNA, 64 nt, Homo Sapiens
agccagaaaaaguuggugccaaaaaaaaagaaaagaaaagaaaaagagcaacacucugucucaa

SEQ ID NO: 178524 - RNA, 64 nt, Homo Sapiens
gaaaaagccagaaaaaguugcucaaaaaaaaaaagaaaagaaaagcagcagagcaacacucugu

SEQ ID NO: 178525 - RNA, 64 nt, Homo Sapiens
gaaaguuaaaaauguauaguaacugauugagggggaaaagaaugaucuuuauuaaugacaaggg

SEQ ID NO: 178526 - RNA, 64 nt, Homo Sapiens
accaacccaguucuguuugacuauguagcaucuugaaaagaaaaauuauaauaaagccccaaaa

SEQ ID NO: 178527 - RNA, 64 nt, Homo Sapiens
uucucagucauccuggcagccaaaaaugugccaggaaaagaaagaauguggagcacgcguggcu

SEQ ID NO: 178528 - RNA, 64 nt, Homo Sapiens
aguaauuuaccuguccaggaucaaaagaagccuagaaaagaagcaguaaucuaccucugccgau

SEQ ID NO: 178529 - RNA, 64 nt, Homo Sapiens
ugaacaaaagcagguuuuuauauguaaacagugagaaaagaaaggcuaaacacuauguaaaugu

SEQ ID NO: 178530 - RNA, 64 nt, Homo Sapiens
agcugaaaauggagaaagccaaugagaagaccaggaaaagaaagggaggcacguaggaacaagc

SEQ ID NO: 178531 - RNA, 64 nt, Homo Sapiens
uacgugaccaucggggcaggacuuagggaaaauagaaaagaaccuauuucucaaaccggccaac

SEQ ID NO: 178532 - RNA, 64 nt, Homo Sapiens
auuuagaaguaaaacacaaaacaaaaaagagagagaaaagaaaagaaaucacaauguauauaaa

SEQ ID NO: 178533 - RNA, 64 nt, Homo Sapiens
gaaguaaaacacaaaacaaaaaagagagagaaaagaaaagaaaucacaauguauauaaaacagu

SEQ ID NO: 178534 - RNA, 64 nt, Homo Sapiens
cuguuucuaccaaacauuucacccaccgaaaaaagaaaagaaauggugaaaugucacuccauug

SEQ ID NO: 178535 - RNA, 64 nt, Homo Sapiens
gcugaaauuaugucagugguccagauuggagauagaaaagaauacccaagugucaagaaccaca

SEQ ID NO: 178536 - RNA, 64 nt, Homo Sapiens
cugagaacuagaggagggaagaugccacuuugaagaaaagaacauaggccuggaagagacuguu

SEQ ID NO: 178537 - RNA, 64 nt, Homo Sapiens
aagcaguugccuuccggaggauacauugaaggaagaaaagaagguuaggaaagaagaccuguuu

SEQ ID NO: 178538 - RNA, 64 nt, Homo Sapiens
guccccagcacguccagggugggugcucccuugcccgacagaaccauccccacugugaggcugu

SEQ ID NO: 178539 - RNA, 64 nt, Homo Sapiens
agaggccccaauggggcggugaccccagccucgcccgacagagcccggggcgcaggcgggcgcc

SEQ ID NO: 178540 - RNA, 64 nt, Homo Sapiens
auccuucggaccucaccacgcgaaacuacgcccgccgacagaaacaucugcaaagauacagucu

SEQ ID NO: 178541 - RNA, 64 nt, Homo Sapiens
acaaguggagggggugucuggaagcugagcaggcccgacagagagaugaagccaucagaaggac

SEQ ID NO: 178542 - RNA, 64 nt, Homo Sapiens
acacggaaguucauacuugaaugcugaauuggccccgacagauuaaaugcguguuggggauugg

SEQ ID NO: 178543 - RNA, 64 nt, Homo Sapiens
ccuggggccguguccaaggugccaaugaugcgggccgacagagcgggccgcacugucugucugu

SEQ ID NO: 178544 - RNA, 64 nt, Homo Sapiens
uaucucagccugcagucagugagaaugaugaaacccgacagaagguucagcggaaaugggaugu

SEQ ID NO: 178545 - RNA, 64 nt, Homo Sapiens
gugggggggggggggcucuggccugcaugagaccccgacagaagagggggccagcgggagcagg

SEQ ID NO: 178546 - RNA, 64 nt, Homo Sapiens
gggugagccuccacaugggugcugaagcaagaaaccgacagauguugaggagaauggugugacc

SEQ ID NO: 178547 - RNA, 64 nt, Homo Sapiens
caaaagagggugcugccccuagccugggcccccaccgacagacugcagcugcguuacugugcug

SEQ ID NO: 178548 - RNA, 64 nt, Homo Sapiens
uugugcaccuaagcugcagagacacugaggacgcccgacagagccugcaguccugccaacguug

SEQ ID NO: 178549 - RNA, 64 nt, Homo Sapiens
aaaccucugcacccugaagguagccauacagaugccgacagauccacaaaggaacaauaaagcu

SEQ ID NO: 178550 - RNA, 64 nt, Homo Sapiens
uguucuaagagaagaauugcuucuuuauacagcuccgacagaagcaggaguccgaguuaaaccu

SEQ ID NO: 178551 - RNA, 53 nt, Homo Sapiens
ugcaacccaagcaggacugacgcccgacagacuccacccuaacagucucaagc

SEQ ID NO: 178552 - RNA, 64 nt, Homo Sapiens
uagggcagccuggugagaggggccuagcucgcugccgacagaagucacugccuaccucaggguc

SEQ ID NO: 178553 - RNA, 64 nt, Homo Sapiens
agaccauuuccacucauucccaguuaggagggauccgacagagaccugcuagacugagugacug

SEQ ID NO: 178554 - RNA, 64 nt, Homo Sapiens
auucacauccauaugccagggccagagcguuugaccgacagacaguuucagagcagagcuccug

SEQ ID NO: 178555 - RNA, 64 nt, Homo Sapiens
gaaagaaacacaaaaacaugacccucaggaaccaccgacagaaaccucugcccugaucgucaca

SEQ ID NO: 178556 - RNA, 64 nt, Homo Sapiens
uggacaaggagcuguguucauucaaugaguauggccgacagacagccaggcuuuucucaggagc

SEQ ID NO: 178557 - RNA, 64 nt, Homo Sapiens
aggaagcgugaaggccgagaagcaagaaagaaacccgacagagggaagaaaagagcuuucuucc

SEQ ID NO: 178558 - RNA, 64 nt, Homo Sapiens
uagacauuucaucauguaaaaucauugauuuguaccgacagaaauggauguagauuuuguuuuu

SEQ ID NO: 178559 - RNA, 64 nt, Homo Sapiens
cgcagcagaugcagacggugucagcagcugauccccgacagaaagucaugagcuaugccgacag

SEQ ID NO: 178560 - RNA, 64 nt, Homo Sapiens
acugucagcucugcuuucuaucugugcgagugcaccgacagaaauccacccacagagaaaugcc

SEQ ID NO: 178561 - RNA, 64 nt, Homo Sapiens
gugaagcaccaagcucaaagcguggacaggugugccgacagaaggaaccagcguguauaugagg

SEQ ID NO: 178562 - RNA, 64 nt, Homo Sapiens
gcauuccacccccaacaucguucaaaagaccccaccgacagaccgugccuuugucagcucuucu

SEQ ID NO: 178563 - RNA, 64 nt, Homo Sapiens
ucagugcccaccacgggcuggaugcacagaccgaccgacagacccccgccgcugacugcgccag

SEQ ID NO: 178564 - RNA, 64 nt, Homo Sapiens
cccccacccccacacgcacuuuaugagggagaccccgacagaggacgcuugagccagaaucuca

SEQ ID NO: 178565 - RNA, 60 nt, Homo Sapiens
cgggggccgaaccccaguagcggcuccuucccgacagagcugccucucgguggccagcag

SEQ ID NO: 178566 - RNA, 64 nt, Homo Sapiens
ucguggggcugacagguccaggcuguggcccaugccgacagauaagagcccuuaagucuguccu

SEQ ID NO: 178567 - RNA, 64 nt, Homo Sapiens
ggggcugaaucagcuccagguuggcaccucugccccgacagaauucugacccuggagcuugggg

SEQ ID NO: 178568 - RNA, 64 nt, Homo Sapiens
aggggauaaagaggaagcaauaaaaaaaaaacauccgacagagcagcucuggcuuugcagccug

SEQ ID NO: 178569 - RNA, 64 nt, Homo Sapiens
uugcuggagguagaggagcuauguggagcaaaggccgacagaggggaaggaauggaccugugag

SEQ ID NO: 178570 - RNA, 64 nt, Homo Sapiens
cauguaaucagagcauuagcugcagaaaaaccccccgacagagcccuggcggagaggcaggcgc

SEQ ID NO: 178571 - RNA, 64 nt, Homo Sapiens
ucccaccccggggucagccggccgugugcgucccccgacagacacugugaacggaagacagcag

SEQ ID NO: 178572 - RNA, 64 nt, Homo Sapiens
augagggcggagccacuccuuguaaauucagugcccgacagaugcucuggcacagaugcuuugu

SEQ ID NO: 178573 - RNA, 64 nt, Homo Sapiens
cuggaggaguuccggaaagcggguacaaguacuaccgacagaaguguaugagcccaauagccaa

SEQ ID NO: 178574 - RNA, 64 nt, Homo Sapiens
uguccaggaggagccuggccauggguccuugcccccgacagacagagcagcccccacccgggag

SEQ ID NO: 178575 - RNA, 64 nt, Homo Sapiens
gcagcugggacccagaacugagccugggagggauccgacagaaaagcucagggcgggucuucuc

SEQ ID NO: 178576 - RNA, 64 nt, Homo Sapiens
guggcacuccugguccugcuucccucaggcaaccccgacagacaccuccaccuccuuccccuuc

SEQ ID NO: 178577 - RNA, 64 nt, Homo Sapiens
ccgauuaaacccacaccuggcagcugcccugccaccgacagaccucaccaacacggccucccug

SEQ ID NO: 178578 - RNA, 64 nt, Homo Sapiens
cuuuauuugugcuguaucaggcuuugguguuuacccgacagaggugcaguaccguguggaaaau

SEQ ID NO: 178579 - RNA, 64 nt, Homo Sapiens
agauaaugccgggcaggccgggcacaguggcucacgccuguaauccaagcacuuggggaggccg

SEQ ID NO: 178580 - RNA, 64 nt, Homo Sapiens
ccucuugaaagauucaaccgggugugguggcucacgccuguaaucccagcacauugggaggcca

SEQ ID NO: 178581 - RNA, 64 nt, Homo Sapiens
uaauaaauguuuucaggccgggcacuguggcucacgccuguaaucccagcacuuugggagaccg

SEQ ID NO: 178582 - RNA, 64 nt, Homo Sapiens
aaaauacaaaaaauuagccgggcgugguggcgggcgccuguagucccagcuacucgggaggcug

SEQ ID NO: 178583 - RNA, 64 nt, Homo Sapiens
agaaaauagaaaauaggcuaggcacaguggcucacgccuguaaucucaacacuuugggaggcca

SEQ ID NO: 178584 - RNA, 64 nt, Homo Sapiens
uaaagucugaagcucggccaggugcgguggcucacgccuguaaucccaaaacuuuggaaggcug

SEQ ID NO: 178585 - RNA, 64 nt, Homo Sapiens
ggaaaaaggaaacuaggccaggcgugguggcucacgccuguaaucccaacacuuugggaggccg

SEQ ID NO: 178586 - RNA, 64 nt, Homo Sapiens
aaaauacaaaaaauuggccgggcgcagcggcucacgccuguaaucccagcacuuucggaggcag

SEQ ID NO: 178587 - RNA, 64 nt, Homo Sapiens
aaaaauacaaaaauuacccaggcauaguggcacacgccuguagucccaguuacuugggaggcug

SEQ ID NO: 178588 - RNA, 64 nt, Homo Sapiens
ggauaagaugcucccggccgggcgcgguggcucacgccuguaaucccagcacuuugggaggccg

SEQ ID NO: 178589 - RNA, 64 nt, Homo Sapiens
caaagucaucuugccagccaggcgugguggaucacgccuguaaucccagcacucugggaggcca

SEQ ID NO: 178590 - RNA, 64 nt, Homo Sapiens
cccagcuacuugggaggcuggccaugguggcgggcgccuguaauaauacaaaaaaaauuagcca

SEQ ID NO: 178591 - RNA, 64 nt, Homo Sapiens
cccagcacugggaggccgagggcgcaguggcucacgccuguaauuaauuggcagugauuggcca

SEQ ID NO: 178592 - RNA, 64 nt, Homo Sapiens
cccagcacuuugggaggccaggcgcgguggcucacgccuguaauaaaaagcccauggcaggcug

SEQ ID NO: 178593 - RNA, 64 nt, Homo Sapiens
cccagcuacuagggaggcugggcaugguggccggcgccuguaauaaaacaaaaacaauuagcug

SEQ ID NO: 178594 - RNA, 64 nt, Homo Sapiens
cccaccacuuuggaaagcuggacacaguggcucacgccuguaaucacauacaggaaacaggcgg

SEQ ID NO: 178595 - RNA, 64 nt, Homo Sapiens
cccagcuacuugggaggcugggccugguggcacacgccuguaguaaaauacaaaaaauuaccug

SEQ ID NO: 178596 - RNA, 64 nt, Homo Sapiens
cccagcacuuugggaggccgagccugguggcucacgccuguaauaaaacauuauuuuuaaaauu

SEQ ID NO: 178597 - RNA, 64 nt, Homo Sapiens
cccagcacuuugggaggcccggcaugguggcucacgccuguaauagauuaacaaaauuaggccg

SEQ ID NO: 178598 - RNA, 64 nt, Homo Sapiens
cccagcuacuugggaggcugggcgugguggcacacgccuguaaaaaauacguaaaaauuagcca

SEQ ID NO: 178599 - RNA, 64 nt, Homo Sapiens
cccagcacuuugggagggcaggcgcuguggcucacgccuguaauucuuagcaccccgcaggcug

SEQ ID NO: 178600 - RNA, 64 nt, Homo Sapiens
cccagcuacucaggaggcugggcaugguggcguacgccuguaguaaaauacaaaaaauuaucca

SEQ ID NO: 178601 - RNA, 64 nt, Homo Sapiens
cccagcuacucaggaggcugggcgugguggugggcgccuguaauuaaaaauacagaauuaguca

SEQ ID NO: 178602 - RNA, 64 nt, Homo Sapiens
cccagcuacuugggaggcugagcaugguggcaggcgccuguaguaaauacaaaaaaauuagcca

SEQ ID NO: 178603 - RNA, 64 nt, Homo Sapiens
cccagcacuuugggaggcugggcgugguugcucacgccuguaauaaaauuuugucugacagcug

SEQ ID NO: 178604 - RNA, 64 nt, Homo Sapiens
uaauuucucauuuggagccgggcgcaguggcucacgccuguaaucccagcacuuugggaggcca

SEQ ID NO: 178605 - RNA, 64 nt, Homo Sapiens
aaaaauacaaaaauuagccaggcgugguggcuggcgccuguaaucccagcuacucaggagguug

SEQ ID NO: 178606 - RNA, 64 nt, Homo Sapiens
cccagcuacuuggaaggcugggcaugguggcgggcgccuguaguaaauacaaaaaaauuagcca

SEQ ID NO: 178607 - RNA, 64 nt, Homo Sapiens
cucagcacuuugggaggccgggcgcgguggcucacgccuguaacaaaauuacuaaaauaggcug

SEQ ID NO: 178608 - RNA, 64 nt, Homo Sapiens
cucagcacuuugggaggcugggcuuaguggcucacgccuguaauauuuaaaaacuagagggcua

SEQ ID NO: 178609 - RNA, 64 nt, Homo Sapiens
cccaguacuuugggaggccgggcaugguggcucacgccuguaauauauaaaaugguguaggccg

SEQ ID NO: 178610 - RNA, 64 nt, Homo Sapiens
cagugacagccgcaacccuauuacagaaagaugccgccuguagcuuucaugccugaaaagcuuu

SEQ ID NO: 178611 - RNA, 64 nt, Homo Sapiens
cacaaaggcugccuuuccucugguccccgagugccgccuguacuugccagggggaggcucaggu

SEQ ID NO: 178612 - RNA, 64 nt, Homo Sapiens
aaaaaauugcuuguaggcugagcgcgguggcucacgccuguaaucccagcacuuugggaggcca

SEQ ID NO: 178613 - RNA, 64 nt, Homo Sapiens
aaaaauacaaaaauuagccggacgcaguggcacgcgccuguaaucccagcuacucaagaggcug

SEQ ID NO: 178614 - RNA, 64 nt, Homo Sapiens
cuugaaaguaauuuuggcuggucgcgguggcucacgccuguaaucccagcacuuugggaggccg

SEQ ID NO: 178615 - RNA, 64 nt, Homo Sapiens
aaaauacaaaaaauuagccgggcguaguggcgggcgccuguagucccagcuacuugggaggcug

SEQ ID NO: 178616 - RNA, 64 nt, Homo Sapiens
cccagcagcuugggaggcugggcgugguggugggcgccuguaguaaaauacaaaaaauuagcuu

SEQ ID NO: 178617 - RNA, 64 nt, Homo Sapiens
cccagcacuuugggaggccgggcacaguggcucacgccuguaaugaaagcauuguuuuagucca

SEQ ID NO: 178618 - RNA, 64 nt, Homo Sapiens
caaauuauguaacucggccggguacaauggcucacgccuguaauccuaacacuuugggaggccg

SEQ ID NO: 178619 - RNA, 64 nt, Homo Sapiens
auuacaaaaaaaauuauccaggcgugguggugcacgccuguaaucccagcuacucaggaggcua

SEQ ID NO: 178620 - RNA, 64 nt, Homo Sapiens
gaauaaguaauucuuggcugggcaugguggcucacgccuguaauuccagugcuuugggaggcca

SEQ ID NO: 178621 - RNA, 64 nt, Homo Sapiens
cagaagaugaugagggagcucaguggaauuguaccgccuguacuuuuuugaaccauccagccuu

SEQ ID NO: 178622 - RNA, 64 nt, Homo Sapiens
aaaugguuugggauaggcugggugccgugggucacgccuguaaucccagcacuuugggaggcug

SEQ ID NO: 178623 - RNA, 64 nt, Homo Sapiens
aaaaauacagaaauuagcugggugugguugcacacgccuguaaucccagcuacucaggaggcug

SEQ ID NO: 178624 - RNA, 64 nt, Homo Sapiens
cuagaaagcaacugaggccaggugcgguggcucacgccuguaaucccagcacuuugggaggccg

SEQ ID NO: 178625 - RNA, 64 nt, Homo Sapiens
agggagcucaaucuuggccgggcgccguggcucacgccuguaaucgcagcacuuugggaggccg

SEQ ID NO: 178626 - RNA, 64 nt, Homo Sapiens
aaaaaaaaaaaguuuggccgggugcgguggcucacgccuguaaucccagcacuuugggaggcca

SEQ ID NO: 178627 - RNA, 64 nt, Homo Sapiens
aaaaacacaaaaguuagcugagcgugguggcgggcgccuguagucccagccacucgggaggcug

SEQ ID NO: 178628 - RNA, 64 nt, Homo Sapiens
cccagcuacuugggaggcugggcgcgguggcgggcgccuguaguaaaauacaaaaaauuagccg

SEQ ID NO: 178629 - RNA, 64 nt, Homo Sapiens
cccagcacuuugggaggccgggcgcgguggcucacgccuguaauaaaaugaauugaccuggccg

SEQ ID NO: 178630 - RNA, 64 nt, Homo Sapiens
cucacuacacaggaggcugaaggcaugguggacucgccuguaauuaaaaauacacaaauuagcu

SEQ ID NO: 178631 - RNA, 64 nt, Homo Sapiens
ccuagcaguuugggaggcugggcacaguggcucacgccuguaauaauuaugccuuuuuugauca

SEQ ID NO: 178632 - RNA, 64 nt, Homo Sapiens
cccagcacuuugggaggccgggcgugguggcucacgccuguaauaaauuugaagugccuggcug

SEQ ID NO: 178633 - RNA, 64 nt, Homo Sapiens
accagcuacucagguggcuggguguguuggcacacgccuguaauaaaaauacaaaaauucacag

SEQ ID NO: 178634 - RNA, 64 nt, Homo Sapiens
cccagcuacucgggaggcugggugguggagcgcacgccuguaguuacaaaaauuagccgggcgu

SEQ ID NO: 178635 - RNA, 64 nt, Homo Sapiens
cccagcacuuugggaggccgggugcgguggcucacgccuguaauaaaauagaagcagcuggccg

SEQ ID NO: 178636 - RNA, 64 nt, Homo Sapiens
ccagcuacucgggaggcugaagugugguggcaggcgccuguaauaaaaauacaaaauuuagcug

SEQ ID NO: 178637 - RNA, 64 nt, Homo Sapiens
cccagcuacuugggaggcugggcgugguggcgggcgccuguaguaaauacaaaaaaauuagcca

SEQ ID NO: 178638 - RNA, 64 nt, Homo Sapiens
cucagcacuuugggaggccaugugagguggcucccgccuguaauccaggagucaagagaauuua

SEQ ID NO: 178639 - RNA, 64 nt, Homo Sapiens
cccagcauuuugggaggcugggugcaguggcucacgccuguaauuaaaaaaaucuaugcagcug

SEQ ID NO: 178640 - RNA, 64 nt, Homo Sapiens
cccagcuacucgggaggcugggcgugguggcaggcgccuguaguaaaauacaaaaaauuagcca

SEQ ID NO: 178641 - RNA, 64 nt, Homo Sapiens
ccuagcacuuugggaggcugggcgggguggcucacgccuguaauuaagaugaaaaacauggccg

SEQ ID NO: 178642 - RNA, 64 nt, Homo Sapiens
aaaagaaagugugauggcugggugcaguggcucacgccuguaaucccagcacuuugggaggcuu

SEQ ID NO: 178643 - RNA, 64 nt, Homo Sapiens
uaaagaacauuucuuggcugggcgcugcggcuugcgccuguaaucucagcacuuugggaggcug

SEQ ID NO: 178644 - RNA, 64 nt, Homo Sapiens
aaaaaaaaaaaauaaagccgggcgugguggcucacgccuguaaucccggcacuuugggaggcug

SEQ ID NO: 178645 - RNA, 64 nt, Homo Sapiens
acuacaaaaaaaauuagccaggcgugguggcgggcgccuguaaucccagcuacucaggaggcug

SEQ ID NO: 178646 - RNA, 64 nt, Homo Sapiens
agaaacagcuuugggggccgggcgugguggcucacgccuguaaucccagcacuuugggaggccg

SEQ ID NO: 178647 - RNA, 64 nt, Homo Sapiens
aauacaaaaaaaauuagcugagcgugguggcgggcgccuguaaucccagcuacuugggaggcug

SEQ ID NO: 178648 - RNA, 64 nt, Homo Sapiens
uuaagaaacuugaaaagcugggcacgguggcucacgccuguaaucccagcacuuugggaggcug

SEQ ID NO: 178649 - RNA, 64 nt, Homo Sapiens
aaaauacaaaaaauuagccaggcgugguggcacgcgccuguagucccagcuacucgggaggcug

SEQ ID NO: 178650 - RNA, 64 nt, Homo Sapiens
aagaaauauggauggggccggccacaguggcucacgccuguaaucccagaacucuggaaggcug

SEQ ID NO: 178651 - RNA, 64 nt, Homo Sapiens
uaaaaauacaaaauuagccaggcgugguggcguacgccuguaaucccagcuacucaggaggcag

SEQ ID NO: 178652 - RNA, 64 nt, Homo Sapiens
aaaaauggucaaaggggcugggcaugguggcucacgccuguaaucucagcacuuugggaggccg

SEQ ID NO: 178653 - RNA, 64 nt, Homo Sapiens
aaaauaugaaacauuagccaggugugguggcacgcgccuguaaucccagcuacucgggaggcug

SEQ ID NO: 178654 - RNA, 64 nt, Homo Sapiens
cccagcuacuugggaagcugggcgugguggcgggcgccuguaauaaaaaugcaaaaauuagccg

SEQ ID NO: 178655 - RNA, 64 nt, Homo Sapiens
cccagcacuuugggaggccugaugcgguggcucacgccuguaauaaugcacguagcugaggccg

SEQ ID NO: 178656 - RNA, 64 nt, Homo Sapiens
cccaucuucuugggaggcugggcaugguagcgcacgccuguaauuaaaaauauagaauuagcca

SEQ ID NO: 178657 - RNA, 64 nt, Homo Sapiens
uccagcuacucaggaggcugggcaugguggcgcacgccuguaguaaaauauaaaaaauuagcug

SEQ ID NO: 178658 - RNA, 64 nt, Homo Sapiens
cccagcacuuugggaggcugggcaccguggcucacgccuguaauaaauaagcacaugauggcug

SEQ ID NO: 178659 - RNA, 64 nt, Homo Sapiens
aagcgaaguaaaagaggccgggugcgguggcucacgccuguaaucccaacacuuuaggagucca

SEQ ID NO: 178660 - RNA, 64 nt, Homo Sapiens
auaacaauaauauauggccaggcgggauggcucacgccuguaaucccagcacuuugggaggcug

SEQ ID NO: 178661 - RNA, 64 nt, Homo Sapiens
aaaaauacaaaaauuagccgggcgugguggcuuacgccuguaaucccagcacuuugggaggcca

SEQ ID NO: 178662 - RNA, 64 nt, Homo Sapiens
cccagcuacccaggaggcugggcgugguggcaugcgccuguaauaaaaauacaaaaauuagcug

SEQ ID NO: 178663 - RNA, 64 nt, Homo Sapiens
ccuagcacuuugggaggccgggcgcgguggcucacgccuguaaugaagaaaaaaaugcaggcug

SEQ ID NO: 178664 - RNA, 64 nt, Homo Sapiens
cccagcuacucaggaagcuggacgugguggcaugcgccuguaauaaaaaaagaaaaauuagcca

SEQ ID NO: 178665 - RNA, 64 nt, Homo Sapiens
cccagcacuuugggaggcugggugcaguggcucacgccuguaauaaauuagccugguaaggccg

SEQ ID NO: 178666 - RNA, 64 nt, Homo Sapiens
ucaaagcuagaucucagcugggugcgauggcucacgccuguaaucccggcacuuugggaggcca

SEQ ID NO: 178667 - RNA, 64 nt, Homo Sapiens
aaaaauacaaaaacuagccaggaaugguggcgcgcgccuguaaucccaguuacuuaggaggcug

SEQ ID NO: 178668 - RNA, 64 nt, Homo Sapiens
cccagcugcucaggaggcugccgggcguggugggcgccuguaauucuacuaaaaauacaaaaag

SEQ ID NO: 178669 - RNA, 64 nt, Homo Sapiens
cccagcacuuugggaggcugggcgugguggcucacgccuguaaucaaaacucagaacguggccg

SEQ ID NO: 178670 - RNA, 64 nt, Homo Sapiens
cccagcuacucuggaggcugggcaugguggcaagcgccuguaguaaauacaaaaaaauuagcca

SEQ ID NO: 178671 - RNA, 64 nt, Homo Sapiens
cccagcacuuugggaggccgggcgcaguggcucacgccuguaauaauuuaaaaauuagcggccg

SEQ ID NO: 178672 - RNA, 64 nt, Homo Sapiens
uagaaaccauuuauuggccggacgcgguggcucacgccuguaaucgcagcacuuugggaggccg

SEQ ID NO: 178673 - RNA, 64 nt, Homo Sapiens
aaaauacaaaaaauuagccgggcgugguggcgggcgccuguagucccagcuacucuggaggcug

SEQ ID NO: 178674 - RNA, 64 nt, Homo Sapiens
uguaagcuuacccagcccggcgcacagugacucacgccuguaaucccagcacuuugggagggcg

SEQ ID NO: 178675 - RNA, 64 nt, Homo Sapiens
aaaaauacaaaaauuaacugggugugguggcgggcgccuguaaucccagcuacugagggggcug

SEQ ID NO: 178676 - RNA, 64 nt, Homo Sapiens
ugagaaggaagucugggcugggcaugguggcucacgccuguaacccuagcacuuuaggaaaucg

SEQ ID NO: 178677 - RNA, 64 nt, Homo Sapiens
aaaaauacaaaaauuagcugggcaugguggcacccgccuguaguccagcuacuugaggcugaga

SEQ ID NO: 178678 - RNA, 64 nt, Homo Sapiens
cccagcuacucgggaggcugggcgugguggcgggcgccuguaguaauacaaaaaaaauuagccg

SEQ ID NO: 178679 - RNA, 64 nt, Homo Sapiens
cccagcacuuugggaggccgggcacaguggcucacgccuguaauaaaaucuuaauuguuggcug

SEQ ID NO: 178680 - RNA, 64 nt, Homo Sapiens
aaaaaggcugaaggcagccgggcgcaguggcucacgccuguaaucccagcacuuugggaggcug

SEQ ID NO: 178681 - RNA, 64 nt, Homo Sapiens
aaauacaaaaaaauuagcugggcgugguggcacgcgccuguagucccagcugcucaggaggcug

SEQ ID NO: 178682 - RNA, 64 nt, Homo Sapiens
aaggaucuuggggagguggccgggugcaguggcucgccuguaaucccagcacuuugggaggccg

SEQ ID NO: 178683 - RNA, 64 nt, Homo Sapiens
aaaaagaaaaaaaauagccgggcgugguggcaggcgccuguaaucccagcuacuggggaggcug

SEQ ID NO: 178684 - RNA, 64 nt, Homo Sapiens
cacagcuacucgggagguugggcgugguggcggacgccuguauuaaauacaaaaaaauuagucg

SEQ ID NO: 178685 - RNA, 64 nt, Homo Sapiens
cccagcacuuugggaggcuagguaugguggcucacgccuguaauuaaagagguuuugcuggcca

SEQ ID NO: 178686 - RNA, 64 nt, Homo Sapiens
cccagcuacucgggaggcuaggcgugguggcccacgccuguaauaaaaauacaaaaauuagccg

SEQ ID NO: 178687 - RNA, 64 nt, Homo Sapiens
cccagcuacucgggaggcugggcgugguagcgggcgccuguaguaaaauacaaaaaauuagccg

SEQ ID NO: 178688 - RNA, 64 nt, Homo Sapiens
cccagcacuuugggaggccagacgugguggcucacgccuguaaucaaaaaccuuccccaggcug

SEQ ID NO: 178689 - RNA, 64 nt, Homo Sapiens
cccagguacuugggagccugggugcaguggcucacgccuguaguaguccuucacuacauggcca

SEQ ID NO: 178690 - RNA, 64 nt, Homo Sapiens
cccagcacuuugggaggcugggugcaguggcucacgccuguaaucacaagcugguccuuggcca

SEQ ID NO: 178691 - RNA, 64 nt, Homo Sapiens
cccagcuacucgggaggcugggugugguggugggcgccuguaguaaaguacaaaaaauuagcug

SEQ ID NO: 178692 - RNA, 64 nt, Homo Sapiens
cccagcacuuugggaggccgggcaugguggcucacgccuguaauuuaagaaacuuaagcagccg

SEQ ID NO: 178693 - RNA, 64 nt, Homo Sapiens
cccagcuacuugggaggcugggcaugguugcaggcgccuguaguaaaauacaaaaaauuagcug

SEQ ID NO: 178694 - RNA, 64 nt, Homo Sapiens
cccagcacuuugggaggccgggcgcgguggcucacgccuguaauuaagaaggagcucuuggccg

SEQ ID NO: 178695 - RNA, 64 nt, Homo Sapiens
aaacaugcacggugaggccgggcgcaguggcucacgccuguaaucccagcacuuugggaggccg

SEQ ID NO: 178696 - RNA, 64 nt, Homo Sapiens
uaaaaaaugaauuuggccagacacaggugccucacgccuguaaucccagcacuuugggaggcug

SEQ ID NO: 178697 - RNA, 64 nt, Homo Sapiens
cauaagauaaggagaggccaggccugguggcucacgccuguaaucccagcacuuuaagaggcca

SEQ ID NO: 178698 - RNA, 64 nt, Homo Sapiens
aaaaauacaaaaauuagcugggcuugguggcuggcgccuguaaucccagcuacucaggagacug

SEQ ID NO: 178699 - RNA, 64 nt, Homo Sapiens
aaaauaccaaaaagaggcugggcgugguggcucacgccuguaaucccagcacuuugggaggccg

SEQ ID NO: 178700 - RNA, 64 nt, Homo Sapiens
aaaaauacaaaaauuagccgggugugguggcgugcgccuguagucccagcuacucgggaggcug

SEQ ID NO: 178701 - RNA, 64 nt, Homo Sapiens
cccagcuacuugguaggcugggccugguggcgggcgccuguaguaaguacaaaaaaaauagccg

SEQ ID NO: 178702 - RNA, 64 nt, Homo Sapiens
cccagcacuuugggaggacgggcgcgguggcucacgccuguaauacuugauugacagccggcca

SEQ ID NO: 178703 - RNA, 64 nt, Homo Sapiens
cccagcuacucaggaggcugggcgugguggcgcgcgccuguaauaucucuacaaaaauuagcug

SEQ ID NO: 178704 - RNA, 64 nt, Homo Sapiens
cccagcacuuugggaggcugggcacgguggcucacgccuguaauuaaaacuuggcuguuggccg

SEQ ID NO: 178705 - RNA, 64 nt, Homo Sapiens
gccagcacuuugggaggccaggcacaguggcucacgccuguaauaagaaauucucuacuggccg

SEQ ID NO: 178706 - RNA, 64 nt, Homo Sapiens
cccagcuacucgggaggcugggugugguggugcacgccuguaauaaaaauacaaaaauuagcug

SEQ ID NO: 178707 - RNA, 64 nt, Homo Sapiens
cccagcacuuugggaggccgggcgugguggcucacgccuguaauaaaccuuacaaaggacgccg

SEQ ID NO: 178708 - RNA, 64 nt, Homo Sapiens
acuguuuuaaggaggggcugggcucgguggcucacgccuguaaucccagacuuugagaggccaa

SEQ ID NO: 178709 - RNA, 64 nt, Homo Sapiens
cuacaaaaaauacaaaaauuagccgggugggacacgccuguaaucccagcuacucaagaggcug

SEQ ID NO: 178710 - RNA, 64 nt, Homo Sapiens
cccagcuacucugaagacugggcgugguggcgggcgccuguaguaaaauacaaaaaauuagccg

SEQ ID NO: 178711 - RNA, 64 nt, Homo Sapiens
cucagcuacucaggaggcugggcgugguggugcacgccuguaguaaauuacaaaaaauuagcug

SEQ ID NO: 178712 - RNA, 64 nt, Homo Sapiens
uaaaaaaggaaaaauaggccgggcugguggcucacgccuguaaucccagcacuuuggcaggcug

SEQ ID NO: 178713 - RNA, 64 nt, Homo Sapiens
aaaaauaaaaaauuagcgaggcguggugggcgggcgccuguaaucccagcuacuugggaggcug

SEQ ID NO: 178714 - RNA, 64 nt, Homo Sapiens
uaaaaaaucagagugggccgggcgcgguggcucacgccuguaaucccagcacuuuggaggccaa

SEQ ID NO: 178715 - RNA, 64 nt, Homo Sapiens
aaaauacaaaaaauuagccaggcgugguggcgggcgccuguagucccagcuacucuggaggcug

SEQ ID NO: 178716 - RNA, 64 nt, Homo Sapiens
cucagcuacuagggaugcuggucuuguuggcgcacgccuguaauaaaaauacacaacuuagcca

SEQ ID NO: 178717 - RNA, 64 nt, Homo Sapiens
cccagcacuuugggaggccgggcgcgguggcucacgccuguaauugguaaauguuucccggcug

SEQ ID NO: 178718 - RNA, 64 nt, Homo Sapiens
aaugaaauaaaauggggcugggcucaguggcucacgccuguaaucccagcacuuugggaggcug

SEQ ID NO: 178719 - RNA, 64 nt, Homo Sapiens
aaaaaacagaaaauuagccgggcgugguggcgggcgccuguagucccagcuacucgggaggcug

SEQ ID NO: 178720 - RNA, 64 nt, Homo Sapiens
cccaguuacucgggaggcugggcgugguggugggcgccuguaaugaaauacaaaaaauuagcug

SEQ ID NO: 178721 - RNA, 64 nt, Homo Sapiens
cccagcacuuugggaggccgggcguggcggcucacgccuguaauaauaacuugcaucuaggcug

SEQ ID NO: 178722 - RNA, 64 nt, Homo Sapiens
cuuucuccacaggcaggcucauuucacuaagcuccuccuuuacuuucucucuccucuuugaugu

SEQ ID NO: 178723 - RNA, 64 nt, Homo Sapiens
cgcuguaagauuugucaaggcugacuacucacuucuccuuuaaauucuuuccuaccuugguccu

SEQ ID NO: 178724 - RNA, 64 nt, Homo Sapiens
cccugcguucuuaauauugggcuauggagagauccuccuuuacccucuugaaauuucuuagcca

SEQ ID NO: 178725 - RNA, 64 nt, Homo Sapiens
cugccaacauugaaaaauaaaaacagcagcuuuucuccuuuaccaccaccucuaccccuuucca

SEQ ID NO: 178726 - RNA, 64 nt, Homo Sapiens
guucaauccaaugauagaaacugucacccugcagcuccuuuacaacuggaauuccugccaacau

SEQ ID NO: 178727 - RNA, 52 nt, Homo Sapiens
ggaggaucaggaccagguggcccuccuuuaugcagaugaccuaucaguguga

SEQ ID NO: 178728 - RNA, 64 nt, Homo Sapiens
gagauaugcuucaaacagaaaaugcccaccccuccuccuuuacccagcauaaacucuaugguua

SEQ ID NO: 178729 - RNA, 64 nt, Homo Sapiens
gaaaauauaaaagguaguucugucucuauccugucuccuuuauucugcuacugcucucauucug

SEQ ID NO: 178730 - RNA, 64 nt, Homo Sapiens
cgaacccccuaaaugcaaaaaauacucuuuuuugcuccuuuacccccaccuggacccugggcua

SEQ ID NO: 178731 - RNA, 64 nt, Homo Sapiens
aauccacuucuucaagcuccaacacaaaugcugccuccuuuaggaugccugcucugugcucucc

SEQ ID NO: 178732 - RNA, 64 nt, Homo Sapiens
auauauauauauaauuuaaaggaaaaauaggugccuccuuuauaaacaguaauagcuacguuug

SEQ ID NO: 178733 - RNA, 64 nt, Homo Sapiens
cacagugaucuucaacuuaacaaacacuuacguucuccuuuauaaaaugcauaguaaaccacua

SEQ ID NO: 178734 - RNA, 64 nt, Homo Sapiens
uauuucaaaaugccuuuccuaugauugucauguccuccuuuaaggcuuuucccucaaauuuauu

SEQ ID NO: 178735 - RNA, 64 nt, Homo Sapiens
aagcaaguuacuuaaacucuugaguuuuagcuuucuccuuuacaaugcaugaaugccuaucccc

SEQ ID NO: 178736 - RNA, 64 nt, Homo Sapiens
caguuaaauaccuccucuaccuuuaccuaaguugcuccuuuauuuuuauuuuauuauuauuauu

SEQ ID NO: 178737 - RNA, 64 nt, Homo Sapiens
ugggauuacaggcaugagccaccaugcccagcugcuccuuuauuuuaaucccuaaauauaaucc

SEQ ID NO: 178738 - RNA, 64 nt, Homo Sapiens
auuuaacauuccauguaacuaaacaagggccuaucuccuuuaaauaacauuucggcauguaaua

SEQ ID NO: 178739 - RNA, 64 nt, Homo Sapiens
aauuuuuacuugaaaugaucgugguuaauuauugcuccuuuaauauauauauauaugcccccuu

SEQ ID NO: 178740 - RNA, 64 nt, Homo Sapiens
aagagugacauuaaacuuugaaaggacuucacugcuccuuuacgauauuccaaauaguuuuuua

SEQ ID NO: 178741 - RNA, 64 nt, Homo Sapiens
ugguuuuaguaaaaugagacuucuucaggagucacuccuuuacuguggacccauugcuuagugg

SEQ ID NO: 178742 - RNA, 64 nt, Homo Sapiens
augagaccagacaagaaaaggauuaaacggguggcuccuuuaauauuauuauuauuguuuuuga

SEQ ID NO: 178743 - RNA, 64 nt, Homo Sapiens
uccaugucuuccuaaagagcagaacuuggaguuucuccuuuauguagagaagaaguaacuuagg

SEQ ID NO: 178744 - RNA, 64 nt, Homo Sapiens; identical to SEQ ID NO: 119656

SEQ ID NO: 178745 - RNA, 64 nt, Homo Sapiens; identical to SEQ ID NO: 119657

SEQ ID NO: 178746 - RNA, 64 nt, Homo Sapiens; identical to SEQ ID NO: 119658

SEQ ID NO: 178747 - RNA, 64 nt, Homo Sapiens; identical to SEQ ID NO: 119659

SEQ ID NO: 178748 - RNA, 64 nt, Homo Sapiens; identical to SEQ ID NO: 119660

SEQ ID NO: 178749 - RNA, 64 nt, Homo Sapiens; identical to SEQ ID NO: 119661

SEQ ID NO: 178750 - RNA, 64 nt, Homo Sapiens; identical to SEQ ID NO: 119662

SEQ ID NO: 178751 - RNA, 64 nt, Homo Sapiens; identical to SEQ ID NO: 119663

SEQ ID NO: 178752 - RNA, 64 nt, Homo Sapiens; identical to SEQ ID NO: 119664

SEQ ID NO: 178753 - RNA, 64 nt, Homo Sapiens; identical to SEQ ID NO: 119665

SEQ ID NO: 178754 - RNA, 64 nt, Homo Sapiens; identical to SEQ ID NO: 119666

SEQ ID NO: 178755 - RNA, 64 nt, Homo Sapiens; identical to SEQ ID NO: 119667

SEQ ID NO: 178756 - RNA, 64 nt, Homo Sapiens; identical to SEQ ID NO: 119668

SEQ ID NO: 178757 - RNA, 64 nt, Homo Sapiens; identical to SEQ ID NO: 119669

SEQ ID NO: 178758 - RNA, 64 nt, Homo Sapiens; identical to SEQ ID NO: 119670

SEQ ID NO: 178759 - RNA, 64 nt, Homo Sapiens; identical to SEQ ID NO: 119671

SEQ ID NO: 178760 - RNA, 64 nt, Homo Sapiens; identical to SEQ ID NO: 119672

SEQ ID NO: 178761 - RNA, 64 nt, Homo Sapiens; identical to SEQ ID NO: 119673

SEQ ID NO: 178762 - RNA, 64 nt, Homo Sapiens; identical to SEQ ID NO: 119674

SEQ ID NO: 178763 - RNA, 64 nt, Homo Sapiens; identical to SEQ ID NO: 119675

SEQ ID NO: 178764 - RNA, 64 nt, Homo Sapiens; identical to SEQ ID NO: 119676

SEQ ID NO: 178765 - RNA, 64 nt, Homo Sapiens; identical to SEQ ID NO: 119677

SEQ ID NO: 178766 - RNA, 64 nt, Homo Sapiens; identical to SEQ ID NO: 119678

SEQ ID NO: 178767 - RNA, 64 nt, Homo Sapiens; identical to SEQ ID NO: 119679

SEQ ID NO: 178768 - RNA, 64 nt, Homo Sapiens
uggauuuuuaaauugcuuuuugaaccaccgcccccggcugcaguaagugcuggaauuauaggcg

SEQ ID NO: 178769 - RNA, 64 nt, Homo Sapiens
uucucacuucccuguuccaugcgccuggccaggccggcugcagugugacagggucugcggcacc

SEQ ID NO: 178770 - RNA, 64 nt, Homo Sapiens
ccgcugucucccaggugcuugcugggacucggggcggcugcaccuggcugucaccugggugugc

SEQ ID NO: 178771 - RNA, 64 nt, Homo Sapiens
gcuucagaggaguguugagugacaccugaggaugcggcugcacacacucagccaagggccgagu

SEQ ID NO: 178772 - RNA, 64 nt, Homo Sapiens
guuauuuacaucaaaaagcuuuuagaaaaugguacgagguaaccaauucuugucauggugaaau

SEQ ID NO: 178773 - RNA, 64 nt, Homo Sapiens
ugcucuaugagccuuuugccagccucagaauaggcgagguaaccuugaauuucagggcccugga

SEQ ID NO: 178774 - RNA, 64 nt, Homo Sapiens
ucugacccucagggccucucggaauguaguugcucgagguaaccgcuagagggugcgcaccugg

SEQ ID NO: 178775 - RNA, 64 nt, Homo Sapiens
gggacuuucuuaaaggccuagcucguuuccagaucgagguaagaggcuggggaaggcccucgga

SEQ ID NO: 178776 - RNA, 64 nt, Homo Sapiens
gagacaucugcagugugacaaccgaugaugaggccgagguaaaaauuuugcugacagauaacua

SEQ ID NO: 178777 - RNA, 64 nt, Homo Sapiens
cuuacagguccccaacagcgauacugcuguuucucgagguaagagauucagccauccaauuggu

SEQ ID NO: 178778 - RNA, 64 nt, Homo Sapiens
uggaauuccaauaaagaaauccagcuccuuguggcgagguaaagcucucucuuugucaugaaag

SEQ ID NO: 178779 - RNA, 64 nt, Homo Sapiens
guuuccccagugucauucaauaugcucuaaacgacgagguaaugcugaggcuauugcugaauaa

SEQ ID NO: 178780 - RNA, 64 nt, Homo Sapiens
uuacugguuugacuauaauucucuguuaucuuuacgagguaaaacugcaagcugacuagcaugu

SEQ ID NO: 178781 - RNA, 64 nt, Homo Sapiens
ccuuuucaaggaaaaacaacccucuucacuggcucgagguaaaccaguuacaccacgauuccuu

SEQ ID NO: 178782 - RNA, 64 nt, Homo Sapiens
aggcuccucuuguagaacugccucuuugaaauuucgagguaaucuacuuuggagacucugccug

SEQ ID NO: 178783 - RNA, 64 nt, Homo Sapiens
gauggcuuuuuggcuaggacuguucgaaagcaggcgagguaaauggacaguggacagccgccuc

SEQ ID NO: 178784 - RNA, 64 nt, Homo Sapiens
uuagggguuucugacauauauucuggauacuauccgagguaauuuugaaguuuaauauaaaugc

SEQ ID NO: 178785 - RNA, 64 nt, Homo Sapiens
ucagagcuccaucagcccggcccaucugccaggacgagguaaugugcugugggccaaagccaag

SEQ ID NO: 178786 - RNA, 64 nt, Homo Sapiens
ggggaaggaaccucccuccuuuugcuaggguccccgagguaaguccaaauuguggcuauugauu

SEQ ID NO: 178787 - RNA, 64 nt, Homo Sapiens
gcucucagugaccccgacugucuccugacuuagccgagguaaggucagugcagcagacagggcc

SEQ ID NO: 178788 - RNA, 64 nt, Homo Sapiens
aguuuuuuuuaauugguuguaauuucuagauuuucgagguaaggcaaagacacgucugcauuug

SEQ ID NO: 178789 - RNA, 64 nt, Homo Sapiens
uucucugaaucuuuaaugaaaucauuugccagagcgagguaaucaucugcauuuggcuacugca

SEQ ID NO: 178790 - RNA, 64 nt, Homo Sapiens
cagcagcaaugucaccuuguggaggaguggaggacgagguaacucugggcagggccugcaccag

SEQ ID NO: 178791 - RNA, 64 nt, Homo Sapiens
gauauugucagucuuuagggguugggcuggaugccgagguaaaaguucuuuuugcucuaaaaga

SEQ ID NO: 178792 - RNA, 64 nt, Homo Sapiens
gaacaccugucccccuaggccaaacucuggaguccgagguaacaaccacuguugccauggugac

SEQ ID NO: 178793 - RNA, 64 nt, Homo Sapiens
auuuuauggucaucugggacuucaagaaagcuuccgagguaagaucuugugaacucccaucacc

SEQ ID NO: 178794 - RNA, 64 nt, Homo Sapiens
cccugagcccaacccugaucuuucucugaaaaaacgagguaauugaugguucugcccacucugg

SEQ ID NO: 178795 - RNA, 64 nt, Homo Sapiens
caaagccccugggguaacaguccccaccgcuacccgagguaaaacaauaaaagcuaugugguug

SEQ ID NO: 178796 - RNA, 64 nt, Homo Sapiens
uuuauggaacucaguguuaggggaauaaagagggcgagguaaagaaaacgcagacauuuuuuag

SEQ ID NO: 178797 - RNA, 64 nt, Homo Sapiens; identical to SEQ ID NO: 131365

SEQ ID NO: 178798 - RNA, 64 nt, Homo Sapiens; identical to SEQ ID NO: 131366

SEQ ID NO: 178799 - RNA, 64 nt, Homo Sapiens; identical to SEQ ID NO: 131367

SEQ ID NO: 178800 - RNA, 64 nt, Homo Sapiens; identical to SEQ ID NO: 131368

SEQ ID NO: 178801 - RNA, 64 nt, Homo Sapiens; identical to SEQ ID NO: 131369

SEQ ID NO: 178802 - RNA, 64 nt, Homo Sapiens; identical to SEQ ID NO: 131370

SEQ ID NO: 178803 - RNA, 64 nt, Homo Sapiens; identical to SEQ ID NO: 131371

SEQ ID NO: 178804 - RNA, 64 nt, Homo Sapiens; identical to SEQ ID NO: 131372

SEQ ID NO: 178805 - RNA, 64 nt, Homo Sapiens; identical to SEQ ID NO: 131373

SEQ ID NO: 178806 - RNA, 64 nt, Homo Sapiens; identical to SEQ ID NO: 131374

SEQ ID NO: 178807 - RNA, 64 nt, Homo Sapiens; identical to SEQ ID NO: 131375

SEQ ID NO: 178808 - RNA, 64 nt, Homo Sapiens; identical to SEQ ID NO: 131376

SEQ ID NO: 178809 - RNA, 64 nt, Homo Sapiens; identical to SEQ ID NO: 131377

SEQ ID NO: 178810 - RNA, 64 nt, Homo Sapiens; identical to SEQ ID NO: 131378

SEQ ID NO: 178811 - RNA, 64 nt, Homo Sapiens; identical to SEQ ID NO: 131379

SEQ ID NO: 178812 - RNA, 64 nt, Homo Sapiens; identical to SEQ ID NO: 131380

SEQ ID NO: 178813 - RNA, 64 nt, Homo Sapiens; identical to SEQ ID NO: 131381

SEQ ID NO: 178814 - RNA, 64 nt, Homo Sapiens; identical to SEQ ID NO: 131382

SEQ ID NO: 178815 - RNA, 64 nt, Homo Sapiens
augugagauuugcugcuguugcaguauaaacacuagguauaauaggauuugaaauugcauuaca

SEQ ID NO: 178816 - RNA, 64 nt, Homo Sapiens
uuugcaauuauuaguugauucacaguacagaacaagguauaaaggaaaaaacccugcuagguag

SEQ ID NO: 178817 - RNA, 64 nt, Homo Sapiens
cuuuuaaauuauggaguauuuuaagucuacaaaaagguauaaauaauaauauaaugaauuccua

SEQ ID NO: 178818 - RNA, 64 nt, Homo Sapiens
acauuuagauuuagaguuuuuuuuuucuuucacaagguauaauaaggaaaggauccuacaauau

SEQ ID NO: 178819 - RNA, 64 nt, Homo Sapiens
uuaacuuucuuuuauaauccuuaaugugaggcuaagguauaaggagaaaggagauugguaagga

SEQ ID NO: 178820 - RNA, 64 nt, Homo Sapiens
aaauauuaaaaacugaguauuguaguuauuugcuagguauaaaaggugacucagaguagagagu

SEQ ID NO: 178821 - RNA, 64 nt, Homo Sapiens
uguagcuugauagugaaauaaggagcuugggcuaagguauaaaucaacacacugcuuccuuccu

SEQ ID NO: 178822 - RNA, 64 nt, Homo Sapiens
acuaaacagcugucuuucaggguaucauuuuuaaagguauaaggaacaaacuuuaauguauuga

SEQ ID NO: 178823 - RNA, 64 nt, Homo Sapiens
ggauaaaggcauugcuuaacuucuuauauaauuuagguauaaauucugugacaugcucuugagc

SEQ ID NO: 178824 - RNA, 64 nt, Homo Sapiens
uaaaauuuagaaauuguucauuaaaucccauuugagguauaagucacucaggaaguuaaaauau

SEQ ID NO: 178825 - RNA, 64 nt, Homo Sapiens
uccagaggacagcaggacacucucgcauacuuugccaaaugaggccugcucagaggaguaggag

SEQ ID NO: 178826 - RNA, 64 nt, Homo Sapiens
gccaaugcccaaaauaaggaguuccaauuuggggccaaaugaggaaggacacagacucugcccu

SEQ ID NO: 178827 - RNA, 64 nt, Homo Sapiens
agaaacacauuuucuggcuacugaacuucaaagcccaaaugaauacacacagaugugggguaca

SEQ ID NO: 178828 - RNA, 64 nt, Homo Sapiens
ccccacaguauagcgcauauacacucauaacuuuccaaaugaaacucccuguuugacuucacac

SEQ ID NO: 178829 - RNA, 64 nt, Homo Sapiens
aaucccaaacugcaagugccaccgcuuccuagagccaaaugagcaaguaucacacucagacacc

SEQ ID NO: 178830 - RNA, 64 nt, Homo Sapiens
uccagccucucgaaggcaucccucauaggugaguccaaaugaccucgggcagggagcggagauu

SEQ ID NO: 178831 - RNA, 64 nt, Homo Sapiens
uaauaaucuguggacugugccauuuuacaguguaccaaaugagaaugagguugaaauguaugca

SEQ ID NO: 178832 - RNA, 64 nt, Homo Sapiens
uauaauuuugccuuguauuaaauguuacaaaguuccaaaugaaucaguauuuuaaaaaauaaaa

SEQ ID NO: 178833 - RNA, 64 nt, Homo Sapiens
ucuggaaguuuugucuugggcaguaugggcugggccaaaugaaaugauuuuuauaauucuaaac

SEQ ID NO: 178834 - RNA, 64 nt, Homo Sapiens
aaaugaaaugauuuuuauaauucuaaacagguuaccaaaugaaaugucauggcuuuacuuuggu

SEQ ID NO: 178835 - RNA, 64 nt, Homo Sapiens
uucauugguggaacugacacuuuuaaaguacaagccaaaugauuucuuuauguggaagaauaga

SEQ ID NO: 178836 - RNA, 64 nt, Homo Sapiens
agaacaacagcaacaaaaggccaccagauggcuaccaaaugauacccacauucaauaugaagca

SEQ ID NO: 178837 - RNA, 64 nt, Homo Sapiens
gaaacccaacaaaugccuuucauauauacgagaaccaaaugaagucagaauuugccauuauugc

SEQ ID NO: 178838 - RNA, 64 nt, Homo Sapiens
uaugaauggugcagguugacucugauauucauucccaaaugacaguauggcagaguguuccaga

SEQ ID NO: 178839 - RNA, 64 nt, Homo Sapiens; identical to SEQ ID NO: 166398

SEQ ID NO: 178840 - RNA, 64 nt, Homo Sapiens; identical to SEQ ID NO: 166399

SEQ ID NO: 178841 - RNA, 64 nt, Homo Sapiens; identical to SEQ ID NO: 166400

SEQ ID NO: 178842 - RNA, 64 nt, Homo Sapiens; identical to SEQ ID NO: 166401

SEQ ID NO: 178843 - RNA, 64 nt, Homo Sapiens; identical to SEQ ID NO: 166402

SEQ ID NO: 178844 - RNA, 64 nt, Homo Sapiens; identical to SEQ ID NO: 166403

SEQ ID NO: 178845 - RNA, 64 nt, Homo Sapiens; identical to SEQ ID NO: 166404

SEQ ID NO: 178846 - RNA, 64 nt, Homo Sapiens; identical to SEQ ID NO: 166405

SEQ ID NO: 178847 - RNA, 64 nt, Homo Sapiens; identical to SEQ ID NO: 166406

SEQ ID NO: 178848 - RNA, 64 nt, Homo Sapiens; identical to SEQ ID NO: 166407

SEQ ID NO: 178849 - RNA, 64 nt, Homo Sapiens; identical to SEQ ID NO: 166408

SEQ ID NO: 178850 - RNA, 64 nt, Homo Sapiens; identical to SEQ ID NO: 166409

SEQ ID NO: 178851 - RNA, 64 nt, Homo Sapiens; identical to SEQ ID NO: 166410

SEQ ID NO: 178852 - RNA, 64 nt, Homo Sapiens; identical to SEQ ID NO: 166411

SEQ ID NO: 178853 - RNA, 64 nt, Homo Sapiens; identical to SEQ ID NO: 166412

SEQ ID NO: 178854 - RNA, 64 nt, Homo Sapiens; identical to SEQ ID NO: 166413

SEQ ID NO: 178855 - RNA, 64 nt, Homo Sapiens; identical to SEQ ID NO: 166414

SEQ ID NO: 178856 - RNA, 64 nt, Homo Sapiens; identical to SEQ ID NO: 166415

SEQ ID NO: 178857 - RNA, 64 nt, Homo Sapiens; identical to SEQ ID NO: 166416

SEQ ID NO: 178858 - RNA, 64 nt, Homo Sapiens; identical to SEQ ID NO: 166417

SEQ ID NO: 178859 - RNA, 64 nt, Homo Sapiens; identical to SEQ ID NO: 166418

SEQ ID NO: 178860 - RNA, 64 nt, Homo Sapiens; identical to SEQ ID NO: 166419

SEQ ID NO: 178861 - RNA, 64 nt, Homo Sapiens; identical to SEQ ID NO: 166420

SEQ ID NO: 178862 - RNA, 64 nt, Homo Sapiens; identical to SEQ ID NO: 166421

SEQ ID NO: 178863 - RNA, 64 nt, Homo Sapiens; identical to SEQ ID NO: 166422

SEQ ID NO: 178864 - RNA, 64 nt, Homo Sapiens; identical to SEQ ID NO: 166423

SEQ ID NO: 178865 - RNA, 64 nt, Homo Sapiens; identical to SEQ ID NO: 166424

SEQ ID NO: 178866 - RNA, 64 nt, Homo Sapiens; identical to SEQ ID NO: 166425

SEQ ID NO: 178867 - RNA, 64 nt, Homo Sapiens; identical to SEQ ID NO: 166426

SEQ ID NO: 178868 - RNA, 64 nt, Homo Sapiens; identical to SEQ ID NO: 166427

SEQ ID NO: 178869 - RNA, 64 nt, Homo Sapiens; identical to SEQ ID NO: 166426

SEQ ID NO: 178870 - RNA, 64 nt, Homo Sapiens; identical to SEQ ID NO: 166429

SEQ ID NO: 178871 - RNA, 64 nt, Homo Sapiens
guuugaggacaaacuccaaggucccuuaaaaagugccuuuuagaggcugggcaugguggcucac

SEQ ID NO: 178872 - RNA, 64 nt, Homo Sapiens
caagagggaaacuccgucucaaaaaaaaaaaagugccuuuuaggccggaugugguggcucaugc

SEQ ID NO: 178873 - RNA, 64 nt, Homo Sapiens
cuugaguuucuuuucauguacauaaaaagcaauagccuuuuaguauagauagcccugagccaaa

SEQ ID NO: 178874 - RNA, 64 nt, Homo Sapiens
caugucagacuuugagcugauccugaauaauaaagccuuuuaccuuaucugauguccuuuucug

SEQ ID NO: 178875 - RNA, 64 nt, Homo Sapiens
uuugguuccuccacuggaaucagagcuuuccuccgccuuuuaguccuucuggcucccaagcacc

SEQ ID NO: 178876 - RNA, 64 nt, Homo Sapiens
ucaccagguugcuugugaggucacaacauucugggccuuuuaacgcuguagaguccuuggcaaa

SEQ ID NO: 178877 - RNA, 64 nt, Homo Sapiens
auguuauuccacuacaaaaaccacaaguuaucuggccuuuuagaucuuuuuggaaucggaccug

SEQ ID NO: 178878 - RNA, 64 nt, Homo Sapiens
cugggcaguuuugcuugaucuuuugugacuuugagccuuuuaaguaguuugaaugauaagacuu

SEQ ID NO: 178879 - RNA, 64 nt, Homo Sapiens
gcucugugacaucuuugguuuauaggauuuuggagccuuuuaugaucuggaacuauuugagggg

SEQ ID NO: 178880 - RNA, 64 nt, Homo Sapiens
cauauccucuuaucaccucagacucagacacaaggccuuuuacauggaaauuuuacaaauuacu

SEQ ID NO: 178881 - RNA, 64 nt, Homo Sapiens
ggccucauacucuuuuuuccauuuucuacaagaagccuuuuaguauaugaaaauuauuacucuu

SEQ ID NO: 178882 - RNA, 64 nt, Homo Sapiens
ccacugcaccuggccucauguuuuuuaaauaauugccuuuuauauuuacccuuuuugucaucac

SEQ ID NO: 178883 - RNA, 64 nt, Homo Sapiens
aguuuuugucuuuucuguugucuucaaauuuuaugccuuuuauuuuuaauuuaaucccguucaa

SEQ ID NO: 178884 - RNA, 64 nt, Homo Sapiens
uguagaugguuaauuuacagauaaaaucccaagagccuuuuaaacaacaagguaccuaaaauag

SEQ ID NO: 178885 - RNA, 64 nt, Homo Sapiens
aguaccagaacuuagaaggaaagucacaaagcaugccuuuuaccagaauauugcuuugccuuuu

SEQ ID NO: 178886 - RNA, 64 nt, Homo Sapiens
cuguuacuggacaugaaaacuagguuaaugaaaggccuuuuauucugcauuggggacuucuaga

SEQ ID NO: 178887 - RNA, 64 nt, Homo Sapiens
aaugcuuauagagaaaaaaaccucuuuuggguaugccuuuuaaaguggggauggugauuaaaca

SEQ ID NO: 178888 - RNA, 64 nt, Homo Sapiens
auguuaucuuuaugaguuucuuuuaacaaauguugccuuuuauauaaaguuaaccacaguggcc

SEQ ID NO: 178889 - RNA, 64 nt, Homo Sapiens
aaauguugccuuuuauaaugaguuaaccacaguggccuuuuaacuauugacuccagugacauaa

SEQ ID NO: 178890 - RNA, 64 nt, Homo Sapiens
ugagcccuguggggugacgcuucagggcagagcugccuuuuaauuuuuauucucagagcaucag

SEQ ID NO: 178891 - RNA, 64 nt, Homo Sapiens
gugggcaaagcagaaaccugcggggagcggagacgccuuuuaucucuggaugccacagaccuga

SEQ ID NO: 178892 - RNA, 64 nt, Homo Sapiens
agggucaagcccugagcagcuucacuuccccugcgccuuuuauguccccaccuugaggccuugc

SEQ ID NO: 178893 - RNA, 64 nt, Homo Sapiens
caaaaccaaauuaacuuaccugccagauuaccaugccuuuuauauaauaggauaaguacucugu

SEQ ID NO: 178894 - RNA, 64 nt, Homo Sapiens
gauagguucuugauauucagauuuccugauaaaugccuuuuagaagcacuuggagugagcgaac

SEQ ID NO: 178895 - RNA, 64 nt, Homo Sapiens
ggguauuaaucccuuugucaaaaagaaucuauuggccuuuuacauguagcaguauuuuuauuag

SEQ ID NO: 178896 - RNA, 64 nt, Homo Sapiens
acacacucugagagugucucaccuccaucgcccagccuuuuauuccccagcccugugggccccc

SEQ ID NO: 178897 - RNA, 64 nt, Homo Sapiens
uauuguuauuauuaauuggcuuucuguauucuaugccuuuuauuuauaaagacacuaagaaaac

SEQ ID NO: 178898 - RNA, 64 nt, Homo Sapiens
ucccuuccuuccuuucuuccauucauccuuccuugccuuuuauuuuuauuuuuuguaauaucac

SEQ ID NO: 178899 - RNA, 64 nt, Homo Sapiens
aacaguuaaucccuaaggucuugacaaaacagaagaaaaacaagccuccucguccuagucuuuu

SEQ ID NO: 178900 - RNA, 64 nt, Homo Sapiens
auaaaaugcaacacuuggcauuuuuauguuuuaagaaaaacaguauuuuauuuauaauaaaauc

SEQ ID NO: 178901 - RNA, 64 nt, Homo Sapiens
uaagaucauuuuccugaaagccaaaccaaacaacgaaaaacaagaacaacuaauucagaaucaa

SEQ ID NO: 178902 - RNA, 64 nt, Homo Sapiens
uauaauaggacuugccuauuuucauuuuuaagaagaaaaacaccacucauuuuauaaaauauag

SEQ ID NO: 178903 - RNA, 64 nt, Homo Sapiens
acuugaaagauaacacaauuuuacaaauuuguuggaaaaacaugaauucauaaauucaggaagc

SEQ ID NO: 178904 - RNA, 64 nt, Homo Sapiens
aacaagcgaaacugaaacaaacagaugcucagaugaaaaacagauguuauccucagcacaaauu

SEQ ID NO: 178905 - RNA, 64 nt, Homo Sapiens
gaguauauguucagcaauguugaucucauaaaaggaaaaacaaaagauuuaaguauucuauaua

SEQ ID NO: 178906 - RNA, 64 nt, Homo Sapiens
cuguuaacuaaaaaugcugagaccccuuuuuauagaaaaacaaaaagacaucaagucuucuuaa

SEQ ID NO: 178907 - RNA, 64 nt, Homo Sapiens
acaaguuuauucuaucauuuuugacaaauuaacagaaaaacagaggaagaaaaaaggccuugaa

SEQ ID NO: 178908 - RNA, 64 nt, Homo Sapiens
cuuuggauuaacccucuauauauaacgugaggaggaaaaacaguuaucauguacaguuuuauuu

SEQ ID NO: 178909 - RNA, 64 nt, Homo Sapiens
acacaaaagagcagagcaccgccccuguuccaaugaaaaacagaugccgccgccucccugcagg

SEQ ID NO: 178910 - RNA, 64 nt, Homo Sapiens
auuagaaacacacuuaaaaauguagcagauugcagaaaaacaggggaaaaaaguaauuaugagg

SEQ ID NO: 178911 - RNA, 64 nt, Homo Sapiens
ggacauuaguuuuuaaaaagcauauucagauugggaaaaacaauaauacauacauguauggaaa

SEQ ID NO: 178912 - RNA, 64 nt, Homo Sapiens
uucuuuccuacauguaucucuuccauucccugaggaaaaacauuaggaaugucccacaaaacau

SEQ ID NO: 178913 - RNA, 64 nt, Homo Sapiens
uuuucccagaaaaucaguauuauuuuuuaaauaagaaaaacauuccuagaagaugauaauugug

SEQ ID NO: 178914 - RNA, 64 nt, Homo Sapiens
cuuggucugacuuguaccaauucuagcacccacugaaaaacaaguugaguagagaguguagagu

SEQ ID NO: 178915 - RNA, 64 nt, Homo Sapiens
agcgacaaaaaagucaagaaguacagacaaguuggaaaaacaacuuuuuuuguuguucuauuuu

SEQ ID NO: 178916 - RNA, 64 nt, Homo Sapiens
caaaacaauccccaucagguaaguuuaaaaaacagaaaaacagauacagaaaaauauauauuuu

SEQ ID NO: 178917 - RNA, 64 nt, Homo Sapiens
uauaaaauaguuuuaguagucuuuucuuaaagaagaaaaacauguuucacagacaucauagauc

SEQ ID NO: 178918 - RNA, 64 nt, Homo Sapiens
uaaauaagacauacccagucggcagauggaagaagaaaaacaguagaggaggcagagagaggga

SEQ ID NO: 178919 - RNA, 64 nt, Homo Sapiens
gagagagaauauuggagaugaaaaagaugacaaagaaaaacagaaaaauguuuauuuaaaaaaa

SEQ ID NO: 178920 - RNA, 64 nt, Homo Sapiens
cagaagaagcuaccucaggugauuuuuuuaacgagaaaaacacacccagggcguuaaauucaca

SEQ ID NO: 178921 - RNA, 64 nt, Homo Sapiens
aaacaaaaacaaaccuuuuguaaagcaaaaaaacgaaaaacaaaauuuuuguaguuuugguauu

SEQ ID NO: 178922 - RNA, 64 nt, Homo Sapiens
uuauaaacugauuuuuguaguggugguuguuuuggaaaaacaguuuugggggauuguuuuguuu

SEQ ID NO: 178923 - RNA, 64 nt, Homo Sapiens
aucuucaaaaaauauauuuuagucuguuauuuaagaaaaacauaacaucccaaaaucuuugaca

SEQ ID NO: 178924 - RNA, 64 nt, Homo Sapiens
cugaggcugggggccagagaagcuuuuacgcauggaaaaacacuaaucaugccaagguguaugu

SEQ ID NO: 178925 - RNA, 58 nt, Homo Sapiens
auuuauuauaucguacauaaguuaguaugaaaaacagacuaucaccuuuauugagaaa

SEQ ID NO: 178926 - RNA, 64 nt, Homo Sapiens
aauacauuccuuggauaucugacaacguguuucugaaaaacagauuuucauaaguaauaauaaa

SEQ ID NO: 178927 - RNA, 64 nt, Homo Sapiens
auaagguaccaaauaugaugcaauaaauuguuuugaaaaacaguugugugaauauuucaacuaa

SEQ ID NO: 178928 - RNA, 64 nt, Homo Sapiens
auucauccuauuaauuucaaaugauacugugggggaaaaacaggguuagaaaaacaaguggaaa

SEQ ID NO: 178929 - RNA, 64 nt, Homo Sapiens
uuucaaaugauacugugggggaaaaacaggguuagaaaaacaaguggaaaaaauggagugaugu

SEQ ID NO: 178930 - RNA, 64 nt, Homo Sapiens
ucaacucuuauccccaacaguuuucaaaaaaauugaaaaacaaacauucccccaugcuuuucug

SEQ ID NO: 178931 - RNA, 64 nt, Homo Sapiens
caacaaauuguguacaagaugauucaccugcugcgaaaaacauuuguccggagucuuuggguuu

SEQ ID NO: 178932 - RNA, 64 nt, Homo Sapiens
ucuugaaaacgguacauauuuuaguauuugugcagaaaaacaaguccuaaaguauuuguuuuua

SEQ ID NO: 178933 - RNA, 64 nt, Homo Sapiens
augguaugugccauuuguaaaauaaaauagagcagaaaaacacaaaaagagaacacugguucag

SEQ ID NO: 178934 - RNA, 64 nt, Homo Sapiens
uaaauuuagauuauguauuccuuuugaaacauaagaaaaacauuuaaaccuaugcugaaaauac

SEQ ID NO: 178935 - RNA, 64 nt, Homo Sapiens
aaacauuuaaaccuaugcugaaaauacgauaaaagaaaaacaacuccaauaugcuaaaaguuaa

SEQ ID NO: 178936 - RNA, 64 nt, Homo Sapiens
uaaccugguuaaagagaaaucuaugccauuuuaagaaaaacaauaaacuacuaaccagaggagu

SEQ ID NO: 178937 - RNA, 64 nt, Homo Sapiens
auuuuaaaaaaguuccaacaucaguaauaauguagaaaaacauuguuuauaauccugaugcauu

SEQ ID NO: 178938 - RNA, 64 nt, Homo Sapiens
aauccgugauuuuauaccagucaaaaguacaucagaaaaacaggagagaguuuggacaucucac

SEQ ID NO: 178939 - RNA, 64 nt, Homo Sapiens
cuugccaaauaaugaauucaugauaauuauguaggaaaaacaaucuaauuaaaaagcacucagg

SEQ ID NO: 178940 - RNA, 64 nt, Homo Sapiens
ccaagaaaaucacaucacuauaaaagaauauuuagaaaaacaucucaagccaugugcuuuagca

SEQ ID NO: 178941 - RNA, 64 nt, Homo Sapiens
uuuuagaaauuugguuucaacaacuauuuuuuaagaaaaacaagguuaugguuuaauguuacaa

SEQ ID NO: 178942 - RNA, 64 nt, Homo Sapiens
uaccuucccagugcuuugcaugauucuauagcuagaaaaacauuuccacaaggucuuaauaaaa

SEQ ID NO: 178943 - RNA, 64 nt, Homo Sapiens
aguacaucuaucuuuaugaaaaucaagauuuuaggaaaaacagagaauucuuguccauuuuugu

SEQ ID NO: 178944 - RNA, 64 nt, Homo Sapiens
uuucuaaauauucaacuauauaugaggaaaaaaagaaaaacauuuaaacaucuucaaaugguac

SEQ ID NO: 178945 - RNA, 60 nt, Homo Sapiens
agugcacggagaagccuuaaacacacccccgaaaaacacaagaccgacccaaaaucuaga

SEQ ID NO: 178946 - RNA, 64 nt, Homo Sapiens
uuuuugaaaggggacuccuuuacauuccaaaagggaaaaacaucacagcaauaguugcuauacg

SEQ ID NO: 178947 - RNA, 64 nt, Homo Sapiens
uaaagcuguuggagaagaggguaaaaaguacucagaaaaacaucuuuuaauaaaaauauucugu

SEQ ID NO: 178948 - RNA, 64 nt, Homo Sapiens
acaacagacuucauccuuaguuuuccuuuuuuaggaaaaacaaaaacauuuuucuuugguucuu

SEQ ID NO: 178949 - RNA, 64 nt, Homo Sapiens
ccucaucuagcuaugaauucugggaagucaaugugaaaaacauugcugcauucaugcaagacug

SEQ ID NO: 178950 - RNA, 64 nt, Homo Sapiens
ucugaaacuucuuaucaauuaccuaaaucucaacgaaaaacaauuuacugaagccgacuccccu

SEQ ID NO: 178951 - RNA, 64 nt, Homo Sapiens
aagcuucagaccgcuaguaaggcucaaagaagaagaaaaacaccaaaaccacaagggaaaagaa

SEQ ID NO: 178952 - RNA, 64 nt, Homo Sapiens
uggauaaguccuuuuuaagaaaaaaaaagaaaaugaaaaacaacacaaaaaaaauagaaaacuc

SEQ ID NO: 178953 - RNA, 64 nt, Homo Sapiens
gcucuauugcaauucccuauuauauucugcaucagaaaaacaaacaaaacaaaaacaacuuuaa

SEQ ID NO: 178954 - RNA, 64 nt, Homo Sapiens
agucaaccucagaaaguaacuaucuugaagguuugaaaaacaaccaaagaaagggagugaggac

SEQ ID NO: 178955 - RNA, 64 nt, Homo Sapiens
uauccauaaaaaaaaauagaugucuuuuauaguggaaaaacacauggggaaaaaaaucaucuau

SEQ ID NO: 178956 - RNA, 64 nt, Homo Sapiens
gaacuugcuacguuucaggugcuagggacuuaaugaaaaacaggacaaaacaauuccuuuuugu

SEQ ID NO: 178957 - RNA, 64 nt, Homo Sapiens
aguaacaaaguugagcuuucaacuugcuugcucagaaaaacauaccaaugagcuauccauagcu

SEQ ID NO: 178958 - RNA, 64 nt, Homo Sapiens
ccaaugagcuauccauagcuacuuuaagagcugagaaaaacauuuuccuacugccuguguugcu

SEQ ID NO: 178959 - RNA, 64 nt, Homo Sapiens
gaaaagccugaucccugucacauugcauacacaagaaaaacagauuuaggaauuguccuuauag

SEQ ID NO: 178960 - RNA, 64 nt, Homo Sapiens
ucucuaggagauucugccaauaaauuaggaagcagaaaaacaaauuuuuucuuugaagacuuuc

SEQ ID NO: 178961 - RNA, 64 nt, Homo Sapiens
uauggaacacaaaacauuuuuagagcaguuauuugaaaaacaguucauucagauucuuuguucg

SEQ ID NO: 178962 - RNA, 64 nt, Homo Sapiens
aguuugagagaauauuauauagcuauaggcacaagaaaaacaacaucauaccauaaugugucau

SEQ ID NO: 178963 - RNA, 64 nt, Homo Sapiens
aauugcccccagauuggccccuuugcaaagaaaggaaaaacacaggagcugucuggagcuccac

SEQ ID NO: 178964 - RNA, 64 nt, Homo Sapiens
aaaauuaauucuuagcaagcuguuugaauggggugaaaaacagcaucagggaacagggcagcuc

SEQ ID NO: 178965 - RNA, 64 nt, Homo Sapiens
cuuauaaaucaucccuuuucauuacagucagccagaaaaacauaugcacaguccugccucuuag

SEQ ID NO: 178966 - RNA, 64 nt, Homo Sapiens
gugacucaaaagccauggguacagcuagaguggagaaaaacagaccaagaaccagcccauugcu

SEQ ID NO: 178967 - RNA, 64 nt, Homo Sapiens
cccuacccagccugcugccucagcacagccaagggaaaaacaaaaaccccacaaaauaccccaa

SEQ ID NO: 178968 - RNA, 64 nt, Homo Sapiens
gagcaagauagacaaaagccaaucagcuuaaaaagaaaaacaaggaaggggaaaagaaaacucu

SEQ ID NO: 178969 - RNA, 64 nt, Homo Sapiens
ugaaagccacguuccuuacugaauucuucagguggaaaaacaucaccuggccccaugucucuca

SEQ ID NO: 178970 - RNA, 64 nt, Homo Sapiens
caaaaacagccucacagaagagagacccaaggaggaaaaacagaaggcacgaacccaccugcug

SEQ ID NO: 178971 - RNA, 64 nt, Homo Sapiens
uuuguagcaacucugaaguauuuacuuuaaaagggaaaaacaaaauuuccacaucgugagucau

SEQ ID NO: 178972 - RNA, 64 nt, Homo Sapiens
aaucaaaaacaguaacuauuaagucuuuguuuuugaaaaacaaaauaauggauuuuuaacagag

SEQ ID NO: 178973 - RNA, 64 nt, Homo Sapiens
aauaacaucuucaguuuuucuggaaagucuauaugaaaaacaaaaauucuauauuuuacauucu

SEQ ID NO: 178974 - RNA, 64 nt, Homo Sapiens
augauuccuucuuuucuaggauucuauucauuuugaaaaacacacguuuaauacuauaaauaau

SEQ ID NO: 178975 - RNA, 64 nt, Homo Sapiens
gagauuucuaccagugaaaggaaaagaaaaaggagaaaaacaaaauaagugaaaagagagaaag

SEQ ID NO: 178976 - RNA, 64 nt, Homo Sapiens
auaacuuucuugagugcaaaaugaggaagagagagaaaaacaauaggcagaauacuggcaagaa

SEQ ID NO: 178977 - RNA, 64 nt, Homo Sapiens
uauuaaaggcacaugaaaccaauacagaggaaaggaaaaacaagaaaaaaaaaauuguuuagug

SEQ ID NO: 178978 - RNA, 64 nt, Homo Sapiens
guaugaaagucauguuacaguugggaacagaauggaaaaacagucaaguauuacaggagaagga

SEQ ID NO: 178979 - RNA, 64 nt, Homo Sapiens
aagcgaugacugcugaaaggguuuagccuuuuaagaaaaacaguuuuucacccuuuaaucuuaa

SEQ ID NO: 178980 - RNA, 64 nt, Homo Sapiens
ucuuuacaccugauaaaauaguucuucccuagaagaaaaacaagaucaaauauauauccagacg

SEQ ID NO: 178981 - RNA, 64 nt, Homo Sapiens
aaaagguuaaucacaaaaccuuacauuuuaaaaagaaaaacagaggucucgcauucaagggcaa

SEQ ID NO: 178982 - RNA, 64 nt, Homo Sapiens
cuuaaaaaaaaaaaaaaaaaaaaaaagaaaaaaagaaaaacaggaaaaaggacuuuuuuuuucc

SEQ ID NO: 178983 - RNA, 64 nt, Homo Sapiens
aaagaaaaacaggaaaaaggacuuuuuuuuuccugaaaaacaaaaaccgaucugcauggacucc

SEQ ID NO: 178984 - RNA, 64 nt, Homo Sapiens
uuuaaaauucaaacaguuccauguuacugaaucugaaaaacaucugauuauccucaauuuccau

SEQ ID NO: 178985 - RNA, 64 nt, Homo Sapiens
auucuagaaauggcauuucuaaugaagagaaaaagaaaaacagcgucuacuuuaaaaaaauuca

SEQ ID NO: 178986 - RNA, 64 nt, Homo Sapiens
aaaaauuuauacuguacaaaaaccccacaagugugaaaaacauggcaaagccuuuaagaagccc

SEQ ID NO: 178987 - RNA, 64 nt, Homo Sapiens
uauauugaaaaauugugcaaauauaauaaauuuggaaaaacaauuuuucaaaaacuacagcuua

SEQ ID NO: 178988 - RNA, 64 nt, Homo Sapiens
agacucuucauucaguggcccacauuuuccuuaggaaaaacaugagcauccccagccacaacug

SEQ ID NO: 178989 - RNA, 64 nt, Homo Sapiens
aaucugcauccuuuucaaaaccuaaaaacaaaaagaaaaacaaauaaaacaaaaccaacucaga

SEQ ID NO: 178990 - RNA, 64 nt, Homo Sapiens
uguuaccaagaaauacuuaccaaagcuguucauagaaaaacaaacaaaauugaguuacuguaua

SEQ ID NO: 178991 - RNA, 64 nt, Homo Sapiens
auguuuucaguccauuaaaaauuauuuuaaauaggaaaaacaguuauuauuuuuauuuggcccc

SEQ ID NO: 178992 - RNA, 64 nt, Homo Sapiens
accagcagcugaucucuuccuggaggaagugaagcuggcuuaguuggcaauagagcugcuuggu

SEQ ID NO: 178993 - RNA, 64 nt, Homo Sapiens
ggccagaaacuagcucacucuacugcugcuucuccuggcuuacuaugcuauuuccaagaucucu

SEQ ID NO: 178994 - RNA, 64 nt, Homo Sapiens
agucuccuggaagcagagcaguuugaccuggcuccuggcuuaccagacuacccuuuagguugaa

SEQ ID NO: 178995 - RNA, 64 nt, Homo Sapiens
uuugaccucuagacacuaauuuuauccuuugaggcuggcuuaauuagggaugcugucauuaagg

SEQ ID NO: 178996 - RNA, 64 nt, Homo Sapiens
cuugcaagcauauuggugcccuccaugaccaccucuggcuuaggacuuggcccuguuaugagcu

SEQ ID NO: 178997 - RNA, 64 nt, Homo Sapiens
ugggacccaaaugggcacuuucuugucugagacucuggcuuauuccagguuggcugauguguug

SEQ ID NO: 178998 - RNA, 64 nt, Homo Sapiens
gaagugaugagauuauaggcgugagccaccgcgccuggcuuauacuuucuuaauaaaaaggaga

SEQ ID NO: 178999 - RNA, 64 nt, Homo Sapiens
ccucugagaucggugccacggauguugcacuuggcuggcuuauguccaccagacugauuucucc

SEQ ID NO: 179000 - RNA, 64 nt, Homo Sapiens
uugaagugugugugauggggaggcucagaaacuccuggcuuagauagcugcagauugacaggcg

SEQ ID NO: 179001 - RNA, 64 nt, Homo Sapiens
aggcacacaggaugcagccuucccccucccaggccuggcuuauuccaagaggcugagccaaugg

SEQ ID NO: 179002 - RNA, 64 nt, Homo Sapiens
agauccugggggagccccuccccccccugaaucccuggcuuagcuaccuuccugccugugcacc

SEQ ID NO: 179003 - RNA, 64 nt, Homo Sapiens
uuuuuuuccuccaguuuuuaacaagaucacauaacuggcuuauuuuuaacagcuuugucaaacu

SEQ ID NO: 179004 - RNA, 64 nt, Homo Sapiens
cauuuuauugaguuaaaugaguucuuaauaaucucuggcuuacaaguccuuaauuuaucaaaua

SEQ ID NO: 179005 - RNA, 64 nt, Homo Sapiens
augaaaaauaaaugaaguaucucuaggaaacagucuggcuuaacuauuuuugaaaauauaacug

SEQ ID NO: 179006 - RNA, 64 nt, Homo Sapiens
gagcagugcugaaggaggagauccagguuuaaaucuggcuuauuaacucaagccaauuuuaagg

SEQ ID NO: 179007 - RNA, 64 nt, Homo Sapiens
guccuguuucuugcuccuguucucagccuguuaucuggcuuauccaucaguuucugaaccaaca

SEQ ID NO: 179008 - RNA, 64 nt, Homo Sapiens
cuauuucuuuuucaccguuuuuaccuuuuguccucuggcuuauugccucagaguugcaagaugg

SEQ ID NO: 179009 - RNA, 64 nt, Homo Sapiens; identical to SEQ ID NO: 89670

SEQ ID NO: 179010 - RNA, 64 nt, Homo Sapiens; identical to SEQ ID NO: 89671

SEQ ID NO: 179011 - RNA, 64 nt, Homo Sapiens; identical to SEQ ID NO: 89672

SEQ ID NO: 179012 - RNA, 64 nt, Homo Sapiens; identical to SEQ ID NO: 89673

SEQ ID NO: 179013 - RNA, 64 nt, Homo Sapiens; identical to SEQ ID NO: 89674

SEQ ID NO: 179014 - RNA, 64 nt, Homo Sapiens; identical to SEQ ID NO: 89675

SEQ ID NO: 179015 - RNA, 64 nt, Homo Sapiens; identical to SEQ ID NO: 89676

SEQ ID NO: 179016 - RNA, 64 nt, Homo Sapiens; identical to SEQ ID NO: 89677

SEQ ID NO: 179017 - RNA, 64 nt, Homo Sapiens; identical to SEQ ID NO: 89678

SEQ ID NO: 179018 - RNA, 64 nt, Homo Sapiens; identical to SEQ ID NO: 89679

SEQ ID NO: 179019 - RNA, 64 nt, Homo Sapiens; identical to SEQ ID NO: 89680

SEQ ID NO: 179020 - RNA, 64 nt, Homo Sapiens; identical to SEQ ID NO: 89681

SEQ ID NO: 179021 - RNA, 64 nt, Homo Sapiens; identical to SEQ ID NO: 125939

SEQ ID NO: 179022 - RNA, 64 nt, Homo Sapiens; identical to SEQ ID NO: 125940

SEQ ID NO: 179023 - RNA, 64 nt, Homo Sapiens; identical to SEQ ID NO: 125941

SEQ ID NO: 179024 - RNA, 64 nt, Homo Sapiens; identical to SEQ ID NO: 125942

SEQ ID NO: 179025 - RNA, 64 nt, Homo Sapiens; identical to SEQ ID NO: 125943

SEQ ID NO: 179026 - RNA, 64 nt, Homo Sapiens; identical to SEQ ID NO: 125944

SEQ ID NO: 179027 - RNA, 64 nt, Homo Sapiens; identical to SEQ ID NO: 125945

SEQ ID NO: 179028 - RNA, 64 nt, Homo Sapiens; identical to SEQ ID NO: 125946

SEQ ID NO: 179029 - RNA, 64 nt, Homo Sapiens; identical to SEQ ID NO: 125947

SEQ ID NO: 179030 - RNA, 64 nt, Homo Sapiens; identical to SEQ ID NO: 125948

SEQ ID NO: 179031 - RNA, 64 nt, Homo Sapiens; identical to SEQ ID NO: 125949

SEQ ID NO: 179032 - RNA, 64 nt, Homo Sapiens; identical to SEQ ID NO: 125950

SEQ ID NO: 179033 - RNA, 64 nt, Homo Sapiens; identical to SEQ ID NO: 125951

SEQ ID NO: 179034 - RNA, 64 nt, Homo Sapiens; identical to SEQ ID NO: 125952

SEQ ID NO: 179035 - RNA, 64 nt, Homo Sapiens; identical to SEQ ID NO: 53591

SEQ ID NO: 179036 - RNA, 64 nt, Homo Sapiens; identical to SEQ ID NO: 53592

SEQ ID NO: 179037 - RNA, 64 nt, Homo Sapiens; identical to SEQ ID NO: 53593

SEQ ID NO: 179038 - RNA, 64 nt, Homo Sapiens; identical to SEQ ID NO: 53594

SEQ ID NO: 179039 - RNA, 64 nt, Homo Sapiens; identical to SEQ ID NO: 53595

SEQ ID NO: 179040 - RNA, 64 nt, Homo Sapiens; identical to SEQ ID NO: 53596

SEQ ID NO: 179041 - RNA, 64 nt, Homo Sapiens; identical to SEQ ID NO: 53597

SEQ ID NO: 179042 - RNA, 64 nt, Homo Sapiens; identical to SEQ ID NO: 53598

SEQ ID NO: 179043 - RNA, 64 nt, Homo Sapiens; identical to SEQ ID NO: 53599

SEQ ID NO: 179044 - RNA, 64 nt, Homo Sapiens; identical to SEQ ID NO: 53600

SEQ ID NO: 179045 - RNA, 64 nt, Homo Sapiens; identical to SEQ ID NO: 53601

SEQ ID NO: 179046 - RNA, 64 nt, Homo Sapiens; identical to SEQ ID NO: 53602

SEQ ID NO: 179047 - RNA, 64 nt, Homo Sapiens; identical to SEQ ID NO: 53603

SEQ ID NO: 179048 - RNA, 64 nt, Homo Sapiens; identical to SEQ ID NO: 53604

SEQ ID NO: 179049 - RNA, 64 nt, Homo Sapiens; identical to SEQ ID NO: 53605

SEQ ID NO: 179050 - RNA, 64 nt, Homo Sapiens; identical to SEQ ID NO: 53606

SEQ ID NO: 179051 - RNA, 64 nt, Homo Sapiens; identical to SEQ ID NO: 53607

SEQ ID NO: 179052 - RNA, 64 nt, Homo Sapiens; identical to SEQ ID NO: 53608

SEQ ID NO: 179053 - RNA, 64 nt, Homo Sapiens; identical to SEQ ID NO: 53609

SEQ ID NO: 179054 - RNA, 64 nt, Homo Sapiens; identical to SEQ ID NO: 53610

SEQ ID NO: 179055 - RNA, 64 nt, Homo Sapiens; identical to SEQ ID NO: 53611

SEQ ID NO: 179056 - RNA, 64 nt, Homo Sapiens; identical to SEQ ID NO: 53612

SEQ ID NO: 179057 - RNA, 64 nt, Homo Sapiens; identical to SEQ ID NO: 53613

SEQ ID NO: 179058 - RNA, 64 nt, Homo Sapiens; identical to SEQ ID NO: 53614

SEQ ID NO: 179059 - RNA, 64 nt, Homo Sapiens; identical to SEQ ID NO: 53615

SEQ ID NO: 179060 - RNA, 64 nt, Homo Sapiens; identical to SEQ ID NO: 53616

SEQ ID NO: 179061 - RNA, 64 nt, Homo Sapiens; identical to SEQ ID NO: 53617

SEQ ID NO: 179062 - RNA, 64 nt, Homo Sapiens; identical to SEQ ID NO: 53618

SEQ ID NO: 179063 - RNA, 64 nt, Homo Sapiens; identical to SEQ ID NO: 53619

SEQ ID NO: 179064 - RNA, 64 nt, Homo Sapiens; identical to SEQ ID NO: 53620

SEQ ID NO: 179065 - RNA, 64 nt, Homo Sapiens; identical to SEQ ID NO: 53621

SEQ ID NO: 179066 - RNA, 64 nt, Homo Sapiens; identical to SEQ ID NO: 53622

SEQ ID NO: 179067 - RNA, 64 nt, Homo Sapiens; identical to SEQ ID NO: 53623

SEQ ID NO: 179068 - RNA, 64 nt, Homo Sapiens; identical to SEQ ID NO: 53624

SEQ ID NO: 179069 - RNA, 64 nt, Homo Sapiens; identical to SEQ ID NO: 53625

SEQ ID NO: 179070 - RNA, 64 nt, Homo Sapiens; identical to SEQ ID NO: 81987

SEQ ID NO: 179071 - RNA, 64 nt, Homo Sapiens; identical to SEQ ID NO: 81988

SEQ ID NO: 179072 - RNA, 64 nt, Homo Sapiens; identical to SEQ ID NO: 81989

SEQ ID NO: 179073 - RNA, 64 nt, Homo Sapiens; identical to SEQ ID NO: 81990

SEQ ID NO: 179074 - RNA, 64 nt, Homo Sapiens; identical to SEQ ID NO: 81991

SEQ ID NO: 179075 - RNA, 64 nt, Homo Sapiens; identical to SEQ ID NO: 81992

SEQ ID NO: 179076 - RNA, 64 nt, Homo Sapiens; identical to SEQ ID NO: 81993

SEQ ID NO: 179077 - RNA, 64 nt, Homo Sapiens; identical to SEQ ID NO: 81994

SEQ ID NO: 179078 - RNA, 64 nt, Homo Sapiens; identical to SEQ ID NO: 81995

SEQ ID NO: 179079 - RNA, 64 nt, Homo Sapiens; identical to SEQ ID NO: 81996

SEQ ID NO: 179080 - RNA, 64 nt, Homo Sapiens; identical to SEQ ID NO: 81997

SEQ ID NO: 179081 - RNA, 64 nt, Homo Sapiens; identical to SEQ ID NO: 81998

SEQ ID NO: 179082 - RNA, 64 nt, Homo Sapiens; identical to SEQ ID NO: 81999

SEQ ID NO: 179083 - RNA, 64 nt, Homo Sapiens; identical to SEQ ID NO: 82000

SEQ ID NO: 179084 - RNA, 64 nt, Homo Sapiens; identical to SEQ ID NO: 82001

SEQ ID NO: 179085 - RNA, 64 nt, Homo Sapiens; identical to SEQ ID NO: 82002

SEQ ID NO: 179086 - RNA, 64 nt, Homo Sapiens; identical to SEQ ID NO: 82003

SEQ ID NO: 179087 - RNA, 64 nt, Homo Sapiens; identical to SEQ ID NO: 82004

SEQ ID NO: 179088 - RNA, 64 nt, Homo Sapiens; identical to SEQ ID NO: 82005

SEQ ID NO: 179089 - RNA, 64 nt, Homo Sapiens; identical to SEQ ID NO: 82006

SEQ ID NO: 179090 - RNA, 64 nt, Homo Sapiens; identical to SEQ ID NO: 82007

SEQ ID NO: 179091 - RNA, 64 nt, Homo Sapiens; identical to SEQ ID NO: 82008

SEQ ID NO: 179092 - RNA, 58 nt, Homo Sapiens; identical to SEQ ID NO: 82009

SEQ ID NO: 179093 - RNA, 64 nt, Homo Sapiens; identical to SEQ ID NO: 82010

SEQ ID NO: 179094 - RNA, 64 nt, Homo Sapiens; identical to SEQ ID NO: 82011

SEQ ID NO: 179095 - RNA, 64 nt, Homo Sapiens; identical to SEQ ID NO: 82012

SEQ ID NO: 179096 - RNA, 64 nt, Homo Sapiens; identical to SEQ ID NO: 82013

SEQ ID NO: 179097 - RNA, 64 nt, Homo Sapiens; identical to SEQ ID NO: 82014

SEQ ID NO: 179098 - RNA, 64 nt, Homo Sapiens; identical to SEQ ID NO: 82015

SEQ ID NO: 179099 - RNA, 64 nt, Homo Sapiens; identical to SEQ ID NO: 82016

SEQ ID NO: 179100 - RNA, 64 nt, Homo Sapiens
ucacuguaaucuccagcuccugggcucaagugauccucuagacucagccucuagaauagcuggg

SEQ ID NO: 179101 - RNA, 64 nt, Homo Sapiens
cagcuccugggcucaagugauccucuagacucagccucuagaauagcugggacuacaggcacau

SEQ ID NO: 179102 - RNA, 64 nt, Homo Sapiens
uuuugccauaauacaugccaggauaucguagucuccucuagauaacuuaugaaauccuauuggu

SEQ ID NO: 179103 - RNA, 64 nt, Homo Sapiens
gaauaauguagaaacauuuuucuuguuaauaauuccucuagauaauggcucaaaacagaauuua

SEQ ID NO: 179104 - RNA, 64 nt, Homo Sapiens; identical to SEQ ID NO: 109572

SEQ ID NO: 179105 - RNA, 64 nt, Homo Sapiens; identical to SEQ ID NO: 109573

SEQ ID NO: 179106 - RNA, 64 nt, Homo Sapiens; identical to SEQ ID NO: 109574

SEQ ID NO: 179107 - RNA, 64 nt, Homo Sapiens; identical to SEQ ID NO: 109575

SEQ ID NO: 179108 - RNA, 64 nt, Homo Sapiens; identical to SEQ ID NO: 109576

SEQ ID NO: 179109 - RNA, 64 nt, Homo Sapiens; identical to SEQ ID NO: 109577

SEQ ID NO: 179110 - RNA, 64 nt, Homo Sapiens; identical to SEQ ID NO: 109578

SEQ ID NO: 179111 - RNA, 64 nt, Homo Sapiens; identical to SEQ ID NO: 109579

SEQ ID NO: 179112 - RNA, 64 nt, Homo Sapiens; identical to SEQ ID NO: 109580

SEQ ID NO: 179113 - RNA, 64 nt, Homo Sapiens; identical to SEQ ID NO: 109581

SEQ ID NO: 179114 - RNA, 64 nt, Homo Sapiens; identical to SEQ ID NO: 109582

SEQ ID NO: 179115 - RNA, 64 nt, Homo Sapiens; identical to SEQ ID NO: 109583

SEQ ID NO: 179116 - RNA, 64 nt, Homo Sapiens; identical to SEQ ID NO: 109584

SEQ ID NO: 179117 - RNA, 64 nt, Homo Sapiens; identical to SEQ ID NO: 109585

SEQ ID NO: 179118 - RNA, 64 nt, Homo Sapiens
ccucaauagcuaagcuugacuccuacagucuacaugaauacaaaauuuauuacuaaaauguuuu

SEQ ID NO: 179119 - RNA, 64 nt, Homo Sapiens
aggaauuuaaccacauacauauauuccaguacacugaauacauguuggggagcggggauaguua

SEQ ID NO: 179120 - RNA, 64 nt, Homo Sapiens
uuaccuuugauuguugaaaaaagucacuaagaugugaauacagaauagacauugagagguuaua

SEQ ID NO: 179121 - RNA, 64 nt, Homo Sapiens
aagcuuugaagcaugcgcaagcaacaugaacaacugaauacagaaaguaacugaaagcagcaca

SEQ ID NO: 179122 - RNA, 64 nt, Homo Sapiens
gcgucucuuuuucauacauuaggauguaaaacucugaauacacguagaccagcuuaaugucuuc

SEQ ID NO: 179123 - RNA, 64 nt, Homo Sapiens
uuuacacacuaacauuagcacucucuguauaugaugaauacauuauugaccaguacuugauaau

SEQ ID NO: 179124 - RNA, 64 nt, Homo Sapiens
ugaccccaacauuucugcccugacagagggaagaugaauacacuugacaggcagaggguguucc

SEQ ID NO: 179125 - RNA, 64 nt, Homo Sapiens
auccgcagccugggaaccuuagcccucagcauccugaauacaucaagugauacccccacaggua

SEQ ID NO: 179126 - RNA, 64 nt, Homo Sapiens
uuaacaguuuguccuuaggaugcaaaugaaaaugugaauacauaccuuguuguacuguugguaa

SEQ ID NO: 179127 - RNA, 64 nt, Homo Sapiens
agcuauuuagccuuugauggaaucauaaauacagugaauacaauccuuugcauuguuaaggagg

SEQ ID NO: 179128 - RNA, 64 nt, Homo Sapiens
uuuaaggaucacauuuagacaucucaugggcugaugaauacagcugguaucuuuguggagcuuu

SEQ ID NO: 179129 - RNA, 64 nt, Homo Sapiens
aucuuugcacucuugugcuaguaugucuauagugugaauacauucauaaauuucuugaucaaag

SEQ ID NO: 179130 - RNA, 64 nt, Homo Sapiens
uugugggaaagcauucauaucugccaagauccuuugaauacaugcaagaacacacaauggagag

SEQ ID NO: 179131 - RNA, 64 nt, Homo Sapiens
guaugggaaagcguucagaccugacaagauucuuugaauacagauaaugaauguaaacaauuaa

SEQ ID NO: 179132 - RNA, 64 nt, Homo Sapiens
uugugggaaagcauucauaucugccaagaucguuugaauacaugcaaaacacacacuggagaga

SEQ ID NO: 179133 - RNA, 64 nt, Homo Sapiens
guaugggaaagccuucagaucggcuaggauucuuugaauacaaauaaugaauguaaacaauuaa

SEQ ID NO: 179134 - RNA, 64 nt, Homo Sapiens
cauuguucuaaagcccuuaaggacagaagcugugugaauacaaauacacaaaagaguucauacu

SEQ ID NO: 179135 - RNA, 64 nt, Homo Sapiens
aaagaguucauacuggacagguuccagcuccuucugaauacacaacauucugaagccuucgguu

SEQ ID NO: 179136 - RNA, 64 nt, Homo Sapiens
gacuaagaaaagucuucuguagagauaaauucugugaauacaaacauaugucugaaaaguauac

SEQ ID NO: 179137 - RNA, 64 nt, Homo Sapiens
aaauaagguagugccuuuagagagaucaauuugaugaauacagugaggugaaauaauuugcccu

SEQ ID NO: 179138 - RNA, 64 nt, Homo Sapiens
gaauguaaggaucccuucagggagagaagcccugugaauacaguaacacaugagcagucacuuu

SEQ ID NO: 179139 - RNA, 64 nt, Homo Sapiens
aaggccuuuacccacuguuacccuauugcugcaaugaauacagcaggguccauacaugagagaa

SEQ ID NO: 179140 - RNA, 64 nt, Homo Sapiens
uauaccuuauauucuuuaaggauucugagaaugcugaauacaaaagugccaggguuucugugau

SEQ ID NO: 179141 - RNA, 64 nt, Homo Sapiens
agaaagaguuggaucuuauuuauauguccaggagugaauacaacgugggugugaagugaauuuc

SEQ ID NO: 179142 - RNA, 64 nt, Homo Sapiens
uaauguacguaugcaaaguucaacucaauagguuauugaucaccaugaaguauugaucauuuuc

SEQ ID NO: 179143 - RNA, 64 nt, Homo Sapiens
guucaacucaauagguuauugaucaccaugaaguauugaucauuuucuaucucaaaaguguaag

SEQ ID NO: 179144 - RNA, 64 nt, Homo Sapiens
uaaaacuuggcaguuuuaucugcuucaaaaugccauugaucauuauuccuguauuuucucugaa

SEQ ID NO: 179145 - RNA, 64 nt, Homo Sapiens
cacccagcugccuuuguuucugcauuaaaccaauauugaucacacauaugacacaggcuagucc

SEQ ID NO: 179146 - RNA, 64 nt, Homo Sapiens
uaugauggauuccauggcugggucuguuuucucagauuaacaaagaauguaaagguucagaaaa

SEQ ID NO: 179147 - RNA, 64 nt, Homo Sapiens
auuguuggacaguccuaaaaaaauaguucaccuggauuaacaguauugacuauuaaaucugguu

SEQ ID NO: 179148 - RNA, 64 nt, Homo Sapiens
gugguggcuugagagccuugagugacauggugguggcacuuaugagcagacugcacaugagcag

SEQ ID NO: 179149 - RNA, 64 nt, Homo Sapiens
aggcaagaggacaggaucuccgaugccuccaccgggcacuuagaucaagagguuugugcuagcc

SEQ ID NO: 179150 - RNA, 64 nt, Homo Sapiens
gcugcguuguuaugaaaggaccccugcuguuguaggcacuuacaguucugcugccuuuguuucu

SEQ ID NO: 179151 - RNA, 64 nt, Homo Sapiens
ccuugguagaucuggguuuacuguggacuugccuggcacuuaaaccucuccgcgguggagcaaa

SEQ ID NO: 179152 - RNA, 64 nt, Homo Sapiens
accggcgggacccccagggaccgccuuccuucacggcacuuacaggcuccugggggugcuccug

SEQ ID NO: 179153 - RNA, 64 nt, Homo Sapiens
aagggaggggucucccucuccccuccuuccucagggcacuuacucccccgucccccgacccgca

SEQ ID NO: 179154 - RNA, 64 nt, Homo Sapiens
cacgugccuguagucccagcuacuugggaggcugaggcaggagaaucacuugaccccagguggu

SEQ ID NO: 179155 - RNA, 64 nt, Homo Sapiens
cgcauaacuauaaucccagcuacuugggaggcugaggcaggagaaucgcuugaacccgggaggc

SEQ ID NO: 179156 - RNA, 64 nt, Homo Sapiens
ugggcuccuguagucccagcuacuugggaggcugaggcaggagaaucgcuugaaccugggaggc

SEQ ID NO: 179157 - RNA, 64 nt, Homo Sapiens
cacaugccuguaauuccagcugcuugggagccugaggcaggagaacugcuugaacccaggaggc

SEQ ID NO: 179158 - RNA, 64 nt, Homo Sapiens
uaaagcacgccuuuaaauaagcaaaaacuuuaaaaggcaggaaagagaauucuuaggcaaauuc

SEQ ID NO: 179159 - RNA, 64 nt, Homo Sapiens
gcgcaggaggacaggcaccaccggaugccacaccaggcaggaggagguguggacagugauggua

SEQ ID NO: 179160 - RNA, 64 nt, Homo Sapiens
gggaaacaccagcuuuuggggugauagcacuuucaggcaggagcuaugguuccuuccucaggag

SEQ ID NO: 179161 - RNA, 64 nt, Homo Sapiens
cucaugccuguaaucccgacacuuugggaggccaaggcaggaggauggcuugaagccaguaguu

SEQ ID NO: 179162 - RNA, 64 nt, Homo Sapiens
ugcacaccuguaguccuagcuacuugggaggcugaggcaggaggaucccuugaguccaggaggu

SEQ ID NO: 179163 - RNA, 64 nt, Homo Sapiens
cacacgccuguagucccaguuacuugggaggcugaggcaggagaauugcuugaaccugggaggu

SEQ ID NO: 179164 - RNA, 64 nt, Homo Sapiens
caccugccuguaaucccagcuacuugggaggcugaggcaggagaaucgcuugaacccgggaggc

SEQ ID NO: 179165 - RNA, 64 nt, Homo Sapiens
ccaggcaugguggcccacgcacuucgggaggucgaggcaggaggaucacuugaguccagaaguu

SEQ ID NO: 179166 - RNA, 64 nt, Homo Sapiens
gcugcuugaggcaacucaucuuagguuggcaaaaaggcaggauggccgggcgcgguggcucacg

SEQ ID NO: 179167 - RNA, 64 nt, Homo Sapiens
agaacaaacucagaucucaucaggguagcagcagaggcaggaccagaaggcaaucaagagcuuc

SEQ ID NO: 179168 - RNA, 64 nt, Homo Sapiens
cacacgccuguaaucucagcuacucaggaggcugaggcaggagaauugcuugaaccugugagga

SEQ ID NO: 179169 - RNA, 64 nt, Homo Sapiens
auugcuugaaccggggaggcuacucgggaggcugaggcaggagacaggagccuguagucccagc

SEQ ID NO: 179170 - RNA, 64 nt, Homo Sapiens
auggcaugaaccugggaggcuacuugggaggcugaggcaggagacgggcgccuguaaucccagc

SEQ ID NO: 179171 - RNA, 64 nt, Homo Sapiens
auggcgugaauccgggaggcuacucagggggcugaggcaggagaugggcaccuguagucccagc

SEQ ID NO: 179172 - RNA, 64 nt, Homo Sapiens
auugcuagaaccuggggguguacucgagaggccaaggcaggagaugggugccuguaaucccagc

SEQ ID NO: 179173 - RNA, 64 nt, Homo Sapiens
gcaguggugcgaucaaggcccacucuuaucacccaggcaggaguuauuauuugagacagagucu

SEQ ID NO: 179174 - RNA, 64 nt, Homo Sapiens
auugcuugagcccaagagguuacuugggaggcugaggcaggagacacacgccuguagucccagc

SEQ ID NO: 179175 - RNA, 64 nt, Homo Sapiens
aucgcuugaaccugggagguuacuugggaggcugaggcaggagauggguaccuauaaucccagc

SEQ ID NO: 179176 - RNA, 64 nt, Homo Sapiens
gagaaauugaggaugccccucccuuguguauuuaaggcaggacaugagggagcgguaugcucua

SEQ ID NO: 179177 - RNA, 64 nt, Homo Sapiens
auugcuugaaccugggaggcuacucaggaggcugaggcaggagacaugugccuauagucccagc

SEQ ID NO: 179178 - RNA, 64 nt, Homo Sapiens
auugcuugaacccaggaggauacucaggaggcugaggcaggagacguacgccuguagucccagc

SEQ ID NO: 179179 - RNA, 64 nt, Homo Sapiens
aucgcuugaacccgggaggcuacucaggaggcugaggcaggagaugggcgccuguaaucccagc

SEQ ID NO: 179180 - RNA, 64 nt, Homo Sapiens
auuguuugagcgagggaaguuacuugggugguugaggcaggaggugugugccugcaguccuagc

SEQ ID NO: 179181 - RNA, 64 nt, Homo Sapiens
ccaaagaggcagugcccagcugcacugcccaguaaggcaggaagccaaggggcagauggccaga

SEQ ID NO: 179182 - RNA, 64 nt, Homo Sapiens
ccugcucugggccugacucaacccagucauguaaaggcaggagaccuggcagauugggguaucc

SEQ ID NO: 179183 - RNA, 64 nt, Homo Sapiens
aacgcgagugucugaagaccaacagauacccaagaggcaggaaacuccucuggaacugggauua

SEQ ID NO: 179184 - RNA, 64 nt, Homo Sapiens
aucacuugaacccgggaggcuacuugggaggcugaggcaggagacacgcaccaguaaucccagc

SEQ ID NO: 179185 - RNA, 64 nt, Homo Sapiens
aucgcuugaaccugggaggcuacucaggaggcugaggcaggagaugcaugccuguaauccaaga

SEQ ID NO: 179186 - RNA, 64 nt, Homo Sapiens
aacucuguguaccugugcccgugcaugugccagcaggcaggacaggacuccuuggguccuggca

SEQ ID NO: 179187 - RNA, 64 nt, Homo Sapiens
ggggcguuggggagccaaaggugaucuggaaggcaggcaggacggagagaccucguggcagcau

SEQ ID NO: 179188 - RNA, 64 nt, Homo Sapiens
aaggcaggcuucuggcuucccucaggucugcgccaggcaggaagauauagaaauaggggaggag

SEQ ID NO: 179189 - RNA, 64 nt, Homo Sapiens
caguccgugcaggcacacucacaggcaggaggaaaggcaggagcccugugaagggacacagaga

SEQ ID NO: 179190 - RNA, 64 nt, Homo Sapiens
aaaggcaggagccaguccgugggacacagagaacaggcaggaggacggggugucauccugugaa

SEQ ID NO: 179191 - RNA, 64 nt, Homo Sapiens
ugaacaaggugauaucuucauagugggcuauuacaggcaggaaaauguuuuaacugguuuacaa

SEQ ID NO: 179192 - RNA, 64 nt, Homo Sapiens
aaaauccaucaauacuugugucauucccuguaaaaggcaggagacaugugauuaugaucaggaa

SEQ ID NO: 179193 - RNA, 64 nt, Homo Sapiens
cacacaccuguagucccagauacuugggaggccaaggcaggaggauugcuugagaccuagcaau

SEQ ID NO: 179194 - RNA, 64 nt, Homo Sapiens
cacaugccaguaaccccagcuacuagggaggcugaggcaggagaaucacuugaacccgggaggc

SEQ ID NO: 179195 - RNA, 64 nt, Homo Sapiens
auugcuugaaccugggagguuacuugggaggcugaggcaggagacgcacaccuguaaucccagc

SEQ ID NO: 179196 - RNA, 64 nt, Homo Sapiens
gaagaagcacugcguggccugaggugacgaaggaaggcaggaauauucuuuuucuuaaaagaga

SEQ ID NO: 179197 - RNA, 64 nt, Homo Sapiens
auuacuugaacgcaggagaauacucagaaggccgaggcaggagacauaugccuguaaucccaac

SEQ ID NO: 179198 - RNA, 64 nt, Homo Sapiens
auccuugaggucaggaguucaccuuaggaggccgaggcaggaggcucacaccugcaaucccagc

SEQ ID NO: 179199 - RNA, 64 nt, Homo Sapiens
cucucuugagaauaggaguugcuuuacaaggcugaggcaggagguucaugccuauaaucccagu

SEQ ID NO: 179200 - RNA, 64 nt, Homo Sapiens
aaagcccagccacugucucagcacugaacuaaucaggcaggaaacucugguccaaguuguaugu

SEQ ID NO: 179201 - RNA, 64 nt, Homo Sapiens
gagaggcagggcaggacacgccagcgcugccuggaggcaggaagagaagcaccugcuccggcau

SEQ ID NO: 179202 - RNA, 64 nt, Homo Sapiens
caggacacagcagcuuucuuagccacgccugggaaggcaggacagggagaaucagggcucggga

SEQ ID NO: 179203 - RNA, 64 nt, Homo Sapiens
gugugugccuauagucccacuacuuguggggcuaaggcaggaggaucacuugagccccggaggu

SEQ ID NO: 179204 - RNA, 64 nt, Homo Sapiens
cucacaccuguaauccuugcauuuuggaaggcugaggcaggaggaucacuuuaggccuggugug

SEQ ID NO: 179205 - RNA, 64 nt, Homo Sapiens
acaagcagaggcccccucgaugggagggaguggcaggcaggagaagguggcgcugccaggugcc

SEQ ID NO: 179206 - RNA, 64 nt, Homo Sapiens
ugugugccuguaauuccagcuacucgggaggcugaggcaggaagaaucacuugaacccaggagg

SEQ ID NO: 179207 - RNA, 64 nt, Homo Sapiens
acugcuugagcccaggaguuuacucaagaggcugaggcaggagguacauaccugcgguuccagc

SEQ ID NO: 179208 - RNA, 64 nt, Homo Sapiens
augaucaucagaaacuaaaugcacccaaaaaaaaaggcaggaaaggacuaaaaccauuuuuuuu

SEQ ID NO: 179209 - RNA, 64 nt, Homo Sapiens
auugcuugaacccaggaagcuacucaggaggcugaggcaggagaugggcacccguaaucccagc

SEQ ID NO: 179210 - RNA, 64 nt, Homo Sapiens
aucgcuugaaccugggagguuacucaggaggcugaggcaggagacaguugccuguaauccuagc

SEQ ID NO: 179211 - RNA, 64 nt, Homo Sapiens
gcugcuggaaacugagaguuacuuugggaggcugaggcaggaagcuggcugggcacaguggcuc

SEQ ID NO: 179212 - RNA, 64 nt, Homo Sapiens
ugggucuuggggcagcuuuaugugggaccaagagaggcaggagcuauuuaaacagugguucuag

SEQ ID NO: 179213 - RNA, 64 nt, Homo Sapiens
ggcgugccuguagucccauguacuugggaggcugaggcaggaaaauucuugaacccaggagacg

SEQ ID NO: 179214 - RNA, 64 nt, Homo Sapiens
cccaagcuaccuccucacccugcaucuuggagggaggcaggaaauuucuuuugaaauaaagugc

SEQ ID NO: 179215 - RNA, 64 nt, Homo Sapiens
cgggcaccuguaaucccaguuacuugggaagcugaggcaggagaaucccuugaaccugggaggc

SEQ ID NO: 179216 - RNA, 64 nt, Homo Sapiens
uguguaccuguagucccagcuacccaggaagcuaaggcaggagaaucgcuugaauccaggaggc

SEQ ID NO: 179217 - RNA, 64 nt, Homo Sapiens
aucgcuugaacccgggaggcuacucgggaggcugaggcaggagacaggcaccuauaaugccagc

SEQ ID NO: 179218 - RNA, 64 nt, Homo Sapiens
gaggguuucagaauucacugauccuaacaaggaaaggcaggaaucccuaaggcugagggaaaga

SEQ ID NO: 179219 - RNA, 64 nt, Homo Sapiens
uccaugccuauaaucccggcuacucgggaggcugaggcaggagaaucaccugaacccgggaggc

SEQ ID NO: 179220 - RNA, 64 nt, Homo Sapiens
cgcaugccuguagucccaacuacuagggaggcugaggcaggagaaucacuugaacccaggaggu

SEQ ID NO: 179221 - RNA, 64 nt, Homo Sapiens
auugcuugaaccugggagacuacuagggaggcugaggcaggagaugcaugccuguaaucccagc

SEQ ID NO: 179222 - RNA, 64 nt, Homo Sapiens
aucgcuugaaccugggaggcuacuugagaggcugaggcaggagacaugugccuguagucuuagc

SEQ ID NO: 179223 - RNA, 64 nt, Homo Sapiens
uaguucccuaccaauaauuugaagccuuugcuuuaggcaggaggcauguggcuaugaauaggga

SEQ ID NO: 179224 - RNA, 64 nt, Homo Sapiens
uuaucugugccuagacccaaacugaaagugucucaggcaggaaguuccaagggauguauguuua

SEQ ID NO: 179225 - RNA, 64 nt, Homo Sapiens
guggauuaggcucuggcuucugugauggugcaagaggcaggauggucuccagacaccuucuugc

SEQ ID NO: 179226 - RNA, 64 nt, Homo Sapiens
ggugggcucagugaccccuuggaauggcugagggaggcaggagagccuggaaagauucgaagug

SEQ ID NO: 179227 - RNA, 64 nt, Homo Sapiens
cagagccaggggugaagggagaagcucuuggagcaggcaggaugcccaccgcugcuucagcugc

SEQ ID NO: 179228 - RNA, 64 nt, Homo Sapiens
ugucaguaccugagcuaguuuaccucaguuccgcaggcaggacagccgguccgggaacccugag

SEQ ID NO: 179229 - RNA, 64 nt, Homo Sapiens
cuuaugccuguaauugcagcacuuuuagaggcugaggcaggagaauugguugaacccaggaggc

SEQ ID NO: 179230 - RNA, 64 nt, Homo Sapiens
ugcaugccuguaaucccagcuacucgggaggcugaggcaggagaauugcuugaacucgggaggu

SEQ ID NO: 179231 - RNA, 64 nt, Homo Sapiens
uccccuuuucccacugaagguuuuagaagcuaggaggcaggaaaaugugacccagaugggggug

SEQ ID NO: 179232 - RNA, 64 nt, Homo Sapiens
uccuggcccuggccuuucacuccaguucugggugaggcaggagcugggagggguggggaggggg

SEQ ID NO: 179233 - RNA, 64 nt, Homo Sapiens
aagggagcaggcagcagcugccagcaagagccccaggcaggacauguacccuaggcacguggcu

SEQ ID NO: 179234 - RNA, 64 nt, Homo Sapiens
aucacuugaaccugggaggcuacucaggaggcugaggcaggagacgcaugccuauaaucccagg

SEQ ID NO: 179235 - RNA, 64 nt, Homo Sapiens
aucacagugaccuauaaugauacucaggaggcugaggcaggaggcgugcaugugcagucccagc

SEQ ID NO: 179236 - RNA, 57 nt, Homo Sapiens
aucacuuggagccaggaguugaggccaaggcaggaggcuguaaucccagcauuuuag

SEQ ID NO: 179237 - RNA, 64 nt, Homo Sapiens
aucacuugaacccuggaggcuacucuggaggcugaggcaggagaugcacaccuguaaucccagc

SEQ ID NO: 179238 - RNA, 64 nt, Homo Sapiens
ccuaccucgggccaacacucuggcuuucccacagaggcaggaguccagcaccuagacaagaucu

SEQ ID NO: 179239 - RNA, 64 nt, Homo Sapiens
uccacagcuccuccugcaccaugaagagaucucuaggcaggaaaggacacugcagaggaagaua

SEQ ID NO: 179240 - RNA, 64 nt, Homo Sapiens
cugcagaggaagauaaugaaacagcagauggccgaggcaggacaggcuugggggugaugcaggc

SEQ ID NO: 179241 - RNA, 64 nt, Homo Sapiens
auugcuugaacccaggaggcuacucgggaggcugaggcaggagacgcacgccuguagucccagc

SEQ ID NO: 179242 - RNA, 57 nt, Homo Sapiens
cguccucuucagcguagcucccgcagcaggcaggaggggccucaggcgaugacauag

SEQ ID NO: 179243 - RNA, 64 nt, Homo Sapiens
gccugggauugagcuaaccugaaacaaagguagcaggcaggaccuaaugaccagagguuaaauc

SEQ ID NO: 179244 - RNA, 64 nt, Homo Sapiens
caacauuggugucccuguccccagagggaggagcaggcaggagagagaggggaaggagguauga

SEQ ID NO: 179245 - RNA, 64 nt, Homo Sapiens
cacaugccuauaaucccagcuacuugggaggcuaaggcaggagaaucgcuugaacccgggaggc

SEQ ID NO: 179246 - RNA, 64 nt, Homo Sapiens
caugccuauaaaauuccagcacuuugggaggccaaggcaggaggaucacuugagccuaugaguu

SEQ ID NO: 179247 - RNA, 64 nt, Homo Sapiens
aucacuugaacccaggagguuacucgggaggcugaggcaggagagcaggcgccuguaauccagc

SEQ ID NO: 179248 - RNA, 64 nt, Homo Sapiens
auggcgggaaccugggaggcuacuugggaggcugaggcaggagacgggcgccuguagucccagc

SEQ ID NO: 179249 - RNA, 64 nt, Homo Sapiens
gucaagaguggggacacuuugcaggguucugacaaggcaggacaccugugcggugucacagauu

SEQ ID NO: 179250 - RNA, 64 nt, Homo Sapiens
cucacaccugaaaucccagcacuuugggaggccgaggcaggaagaucauugagcucaggaguuu

SEQ ID NO: 179251 - RNA, 64 nt, Homo Sapiens
ugugcgccuguaaucccagcuacucgggaggcugaggcaggacgauuacuugagcuugggaaau

SEQ ID NO: 179252 - RNA, 64 nt, Homo Sapiens
cgcauaccuguagucccagcuacuugggaggcugaggcaggagaaucacuugaacucgggaggc

SEQ ID NO: 179253 - RNA, 64 nt, Homo Sapiens
ugcgugccuguagucucagcuacucaggaggcugaggcaggagaaucgccugaacccgggcggc

SEQ ID NO: 179254 - RNA, 64 nt, Homo Sapiens
ccaaacaaccuugccagccuuggcugucaaaaggaggcaggagcaguucucaacacaccaagcc

SEQ ID NO: 179255 - RNA, 64 nt, Homo Sapiens
ccaaauagcaucuuuacagaggaagugggaucagaggcaggaaguguggaaaguugcuaagaag

SEQ ID NO: 179256 - RNA, 64 nt, Homo Sapiens
ugggcgccuguaaucccagcuacucagaaggcugaggcaggagaaucacuugaaccuaggaggc

SEQ ID NO: 179257 - RNA, 64 nt, Homo Sapiens
ugcauaccuauaguccuggcuauuugggaggcugaggcaggaggauugcuuuagcccuggaggu

SEQ ID NO: 179258 - RNA, 64 nt, Homo Sapiens
ugcaugccuguaaucccagcuacucgggaggcugaggcaggagaaucgcuugaacccaggaggc

SEQ ID NO: 179259 - RNA, 64 nt, Homo Sapiens
gaugccucuaaguucuugucgaauccagucugcuaggcaggaaaggaagcaacagagaaguggg

SEQ ID NO: 179260 - RNA, 64 nt, Homo Sapiens
aagaagucagacagagacagcucuagguuacaugaggcaggaauucugaagggcaguccuccuu

SEQ ID NO: 179261 - RNA, 64 nt, Homo Sapiens
auggcgugaacccgggagguuacucaugaggcugaggcaggagacaugugccuguauucccagc

SEQ ID NO: 179262 - RNA, 64 nt, Homo Sapiens
auccccugaggucaggaguuacuuugggaagcugaggcaggaggcucaugccuguaaucccagc

SEQ ID NO: 179263 - RNA, 64 nt, Homo Sapiens
guggggcuaacuguagaccacagagaggcagcugaggcaggacaggggcucccaucuucuuaca

SEQ ID NO: 179264 - RNA, 64 nt, Homo Sapiens
aucgcuugaaccugggagguuacucgggaggcugaggcaggagacacgugccuguaaucccagc

SEQ ID NO: 179265 - RNA, 64 nt, Homo Sapiens
caugcgcuuguagucucagcuacuccggaggcugaggcaggagaauugcuugaaccuggaaggc

SEQ ID NO: 179266 - RNA, 64 nt, Homo Sapiens
ugggugucuguaaucccagcuauucgggaggcugaggcaggagaaucgcuugaacccaggaggu

SEQ ID NO: 179267 - RNA, 64 nt, Homo Sapiens
ccugggcauguagucccagcuacucgggaggcugaggcaggagaaucgcuugaaccugggaggc

SEQ ID NO: 179268 - RNA, 64 nt, Homo Sapiens
ccucccaccuccccacacccauugagucauucacaggcaggagggagacugaucauuccucugg

SEQ ID NO: 179269 - RNA, 64 nt, Homo Sapiens
cucauucugacugugaacuaagcaagcuuugaggaggcaggagauuccgugggucccugugaca

SEQ ID NO: 179270 - RNA, 64 nt, Homo Sapiens
gggacuugcaugugcaaguuggguggaugcugggaggcaggaggcucaugcuccugucugccug

SEQ ID NO: 179271 - RNA, 64 nt, Homo Sapiens
gcucaugcauguaauucuagcacuuuggaggccaaggcaggaggacugcuugagcccaggaguu

SEQ ID NO: 179272 - RNA, 64 nt, Homo Sapiens
gcacgcaccucuacucccagcuacuaggaggcugaggcaggagaaucguuugaacccaggaggu

SEQ ID NO: 179273 - RNA, 64 nt, Homo Sapiens
aucacuggaaccugggaggugccacucggggcugaggcaggagguguucacaccuguagucccg

SEQ ID NO: 179274 - RNA, 64 nt, Homo Sapiens
aucacuugaguccagaaauuacuuugggaggccaaggcaggaggcucaccccuauaaucccagg

SEQ ID NO: 179275 - RNA, 64 nt, Homo Sapiens
aucacuugggcccaggaggucuuuugggagguccaggcaggaggucaugccuguaaucccaaca

SEQ ID NO: 179276 - RNA, 64 nt, Homo Sapiens
aucgcuugaaccggggagguuacccaggaggcugaggcaggagacacgcgccuguaaucccagc

SEQ ID NO: 179277 - RNA, 64 nt, Homo Sapiens
auuacuugaaccugggaggcuacuugggaggcugaggcaggagacgggcgccuguaaucccagc

SEQ ID NO: 179278 - RNA, 64 nt, Homo Sapiens
gguugagugauuuuccuaagaugaggaaauccguaggcaggagcagcucugcagggccccgcag

SEQ ID NO: 179279 - RNA, 64 nt, Homo Sapiens
auugcuugaggccaggaguugcuuugggaggcugaggcaggaggcucacaucuguaauaccagc

SEQ ID NO: 179280 - RNA, 64 nt, Homo Sapiens
auugcuugaaccuaggaggcuacucgggaggcugaggcaggagaugggcaccuguagucccagc

SEQ ID NO: 179281 - RNA, 64 nt, Homo Sapiens
gggggaucagggaagguggagagguuggugucagaggcaggagugggcagaggaaguacuuagg

SEQ ID NO: 179282 - RNA, 64 nt, Homo Sapiens
aggagaaagcagggcagaauugggacagugggucaggcaggacacaugaggaccguuccuagga

SEQ ID NO: 179283 - RNA, 64 nt, Homo Sapiens
aucgcuugagcccgggaagcuauuugggaggcugaggcaggagacgugugccuguaaucccagc

SEQ ID NO: 179284 - RNA, 64 nt, Homo Sapiens
cacaugugaggguccccagacagucccuggggggaggcaggagggagaaagggcucccaccugc

SEQ ID NO: 179285 - RNA, 64 nt, Homo Sapiens
gacguagcguagacaacagcagucauaaauaauuaggcaggaacuuaacccaaaucuaguucuu

SEQ ID NO: 179286 - RNA, 64 nt, Homo Sapiens
cccguaaaccauguagaaagcucccagcacugaaaggcaggaguguuagcaucucgcuuuaucc

SEQ ID NO: 179287 - RNA, 64 nt, Homo Sapiens
ugguggcguacgccuguaaucccagcuacucaggaggcaggagaaucgcuugagccugggaggc

SEQ ID NO: 179288 - RNA, 64 nt, Homo Sapiens
cucaugcucugaggaagucuuguucauucuucacaggcaggaacuuucuuuguucuagccccuc

SEQ ID NO: 179289 - RNA, 64 nt, Homo Sapiens
aggcacugaugcuagagggucucagggccagggcaggcaggagcggaggaagaagugguggagc

SEQ ID NO: 179290 - RNA, 64 nt, Homo Sapiens
aucacucgaacccaggaggcuacuugggaggcugaggcaggagacacgcaccugcagucccagc

SEQ ID NO: 179291 - RNA, 64 nt, Homo Sapiens
uuccuaauccuugcaacaaccccacuggguggcaaggcaggacccguaaagauggauuucuaaa

SEQ ID NO: 179292 - RNA, 64 nt, Homo Sapiens
aaucgccugaacccagaagguacuugggaggcugaggcaggagacaggcaccuguaaucccagc

SEQ ID NO: 179293 - RNA, 64 nt, Homo Sapiens
aucgcuugaaccugggaggcuacuggggaggcugaggcaggagaugcaugccuguaaucccagc

SEQ ID NO: 179294 - RNA, 64 nt, Homo Sapiens
auggcgugaacccgggaggcuacuuggaaggcugaggcaggagacgggcgccuguagucccagc

SEQ ID NO: 179295 - RNA, 64 nt, Homo Sapiens
auugcuuaaacgcaggagucacagaggaaggcugaggcaggaggccacccaaagugguagaauu

SEQ ID NO: 179296 - RNA, 64 nt, Homo Sapiens
aucgcuagaaacugggagguuucuugggaggcugaggcaggagacgcacgccuguaaucccauc

SEQ ID NO: 179297 - RNA, 64 nt, Homo Sapiens
aucgcuugaacccgggagguuacucaggaggcugaggcaggagacgcacgccuguaguuccagc

SEQ ID NO: 179298 - RNA, 64 nt, Homo Sapiens
cgguaggacugugccugugccuccuccagcugccaggcaggaguccuuugugcuggaaccuggg

SEQ ID NO: 179299 - RNA, 64 nt, Homo Sapiens
cccgccccuccugccggggguguggccucacugcaggcaggagcugacugaagccgcuuagugc

SEQ ID NO: 179300 - RNA, 64 nt, Homo Sapiens
caugugccuguagucccagcuacuugggaggcugaggcaggagaaucgcuugagcccaagaggu

SEQ ID NO: 179301 - RNA, 64 nt, Homo Sapiens
gaaauaaagagaaaagggaaccuuggagcugggaaggcaggaaaccggcuagaugaccaucaca

SEQ ID NO: 179302 - RNA, 64 nt, Homo Sapiens
aucgcuugaaccugggaggcaccucaggaggcugaggcaggagauggcaagugccuuuaauccc

SEQ ID NO: 179303 - RNA, 64 nt, Homo Sapiens
aucgcuugaaccugggaggcuacuugggaggcugaggcaggagacggaugccuguaaucccagc

SEQ ID NO: 179304 - RNA, 64 nt, Homo Sapiens
ugggucuuuaggguaggacaggcugugguaugagaggcaggagucuccacaaggcuucaugugg

SEQ ID NO: 179305 - RNA, 64 nt, Homo Sapiens
cgggugccuguaaucucagcuacuugagaggcugaggcaggagaaucgcuugaacuugggagca

SEQ ID NO: 179306 - RNA, 64 nt, Homo Sapiens
cgcaugcuuguaaucccagcuacucaggaggcagaggcaggagaaucacuugaacccgggaggu

SEQ ID NO: 179307 - RNA, 64 nt, Homo Sapiens
cuauuugagaugcacuuuuguacucaggaggccaaggcaggaggauugcuugagcccaggaguu

SEQ ID NO: 179308 - RNA, 64 nt, Homo Sapiens
agggcuggcgagggugggggcgggcaagggaugcaggcaggacagccaugagguggggcugcag

SEQ ID NO: 179309 - RNA, 64 nt, Homo Sapiens
ugaaagcaaacagugcugcucuuuauuccagacaaggcaggaaagucugaguugggagugacag

SEQ ID NO: 179310 - RNA, 64 nt, Homo Sapiens
gcccuccugaccccugguagcugagggggcccugaggcaggacccugcagccuaguggaaggug

SEQ ID NO: 179311 - RNA, 64 nt, Homo Sapiens
ggcuguguccggcccugcagagguuggcuuggccaggcaggaugccauucagaccccauuaaga

SEQ ID NO: 179312 - RNA, 64 nt, Homo Sapiens
guaaggggccagagccuuggaggacacuaagaggaggcaggaggagcaacucaaauccccaaga

SEQ ID NO: 179313 - RNA, 64 nt, Homo Sapiens
uucaaaagucuggcccacugugcaguggagcagaaggcaggaccaugaggccuccugccaugua

SEQ ID NO: 179314 - RNA, 64 nt, Homo Sapiens
uugcuaaguggccggaaaacaagccugagggaggaggcaggaguuggaguuaccuuaggccccu

SEQ ID NO: 179315 - RNA, 64 nt, Homo Sapiens
gugggugccuguaauccagcuacuugggagacugaggcaggagaauugcuugaacccaggaggc

SEQ ID NO: 179316 - RNA, 64 nt, Homo Sapiens
uaguccccuguagucccagcuacucgggaggcugaggcaggagaaucguuugaaccugggaggu

SEQ ID NO: 179317 - RNA, 64 nt, Homo Sapiens
auggggugaacccgggaggauacucgggagguugaggcaggagacggacgccuguauucacagc

SEQ ID NO: 179318 - RNA, 64 nt, Homo Sapiens
aucucuugaacccaggaggcuacuugggaggcugaggcaggagaugggcaccuguaaucccagc

SEQ ID NO: 179319 - RNA, 64 nt, Homo Sapiens
auuguuugaacccaggagguuacucgggaggcuaaggcaggaaacccacgccuguaaucccagc

SEQ ID NO: 179320 - RNA, 64 nt, Homo Sapiens
auggcgugaacccgggaggcuacucgggaggcugaggcaggagacgggcgccuguagucccagc

SEQ ID NO: 179321 - RNA, 64 nt, Homo Sapiens
auugcuugagcucaggaguuuacuugggagccugaggcaggaggcucacgccuguagucccagg

SEQ ID NO: 179322 - RNA, 64 nt, Homo Sapiens
ugccugauaaauauuuuuccguacauaccuccaaaggcaggacucuguucugaugucagugccu

SEQ ID NO: 179323 - RNA, 64 nt, Homo Sapiens
aucgccugaacccaggaggcuguaaucguagcugaggcaggagacaggcaugguggcacacacc

SEQ ID NO: 179324 - RNA, 64 nt, Homo Sapiens
aucgcuugaaccugggaggcuacucaagaggcugaggcaggagacaggcgccugaaaucccagc

SEQ ID NO: 179325 - RNA, 64 nt, Homo Sapiens
aucgcuugaacucaggagguuacucgggaggcugaggcaggagacuucaagggcccuccccagc

SEQ ID NO: 179326 - RNA, 64 nt, Homo Sapiens
auggccugaacccgggaggcuacuugggaggcugaggcaggagacaggcgccuguagucccagc

SEQ ID NO: 179327 - RNA, 64 nt, Homo Sapiens
cgggcaccuguagucccagcuacucgggaggcugaggcaggagaauggugugaacccgggaagc

SEQ ID NO: 179328 - RNA, 64 nt, Homo Sapiens
cacgugccugugaucccagcuacuugggaggcugaggcaggaggaucgccugagcccaggaggu

SEQ ID NO: 179329 - RNA, 64 nt, Homo Sapiens
gggacaucgaacuaagaccugaacuaugagaaauaggcaggaagaaguuguaccugacucauuu

SEQ ID NO: 179330 - RNA, 64 nt, Homo Sapiens
gccugggcgauagacucuuccucagcagccuggcaggcaggaaacagacauaggaccccagccc

SEQ ID NO: 179331 - RNA, 64 nt, Homo Sapiens
gggcgccugugguggccagcuacucaggaggcugaggcaggagaauggcgugaacccgggaggc

SEQ ID NO: 179332 - RNA, 64 nt, Homo Sapiens
cucacgcuugcaaucccagugcuuugggagacugaggcaggaggaucacuuaaggccaggaguu

SEQ ID NO: 179333 - RNA, 64 nt, Homo Sapiens
cacaugccuguaauccgagugcuuugggaggcugaggcaggaggaucacucgagcucaagaauu

SEQ ID NO: 179334 - RNA, 64 nt, Homo Sapiens
ccaguauucccagcuacucuggaggcugaggcggaggcaggauugcuugauaugagggagauug

SEQ ID NO: 179335 - RNA, 64 nt, Homo Sapiens
auugcuugaacuugggagguuacuugggaggcugaggcaggagaugggugccuguaauccuagc

SEQ ID NO: 179336 - RNA, 64 nt, Homo Sapiens
auugcuugaacccaugagguuacucgggaggcugaggcaggagaggugcgcuuguaaucccagc

SEQ ID NO: 179337 - RNA, 64 nt, Homo Sapiens
auugcuugaauccaagaggcuacuugggaggcugaggcaggagaugcaugccuguagucucagc

SEQ ID NO: 179338 - RNA, 64 nt, Homo Sapiens
gugcuugaacccaggaggcguacuugggaggcugaggcaggagacaggugccuguaaucccagc

SEQ ID NO: 179339 - RNA, 64 nt, Homo Sapiens
gauccugccuugauuuuacuuacuugaggaccaaaggcaggaaguuugggucuggaguucuggc

SEQ ID NO: 179340 - RNA, 64 nt, Homo Sapiens
gaauuugggucuggaguucugggccuggauucugaggcaggaagaugcagaaagaaacaggcug

SEQ ID NO: 179341 - RNA, 64 nt, Homo Sapiens
auugcuucaauccaggagguuacucaggaggcugaggcaggagacgugugccuauggucccagc

SEQ ID NO: 179342 - RNA, 64 nt, Homo Sapiens
aucgcuugagcucaggaguuacuuugggaggcagaggcaggaggcucacaccugucauccuagc

SEQ ID NO: 179343 - RNA, 64 nt, Homo Sapiens
auggcgugaaccugggaggcuacucgggaggcugaggcaggagacaggugccuguagucccagc

SEQ ID NO: 179344 - RNA, 64 nt, Homo Sapiens
augguuugaacacagggaugaacuuaggagccugaggcaggagaugugcaucuguagucucagc

SEQ ID NO: 179345 - RNA, 64 nt, Homo Sapiens
auugcuugagcucaggaguuacuuugggaggccaaggcaggaaggucacacuuguaaucccacu

SEQ ID NO: 179346 - RNA, 64 nt, Homo Sapiens
aaagcuucgauggagagcagggaagggggacccaaggcaggagguacaccagcuggacaaauug

SEQ ID NO: 179347 - RNA, 64 nt, Homo Sapiens
cagaguggcacuacugcccggccaguccaggcucaggcaggaaucggacgcuggggcccgggcu

SEQ ID NO: 179348 - RNA, 64 nt, Homo Sapiens
aucagcaacugcagugugaggacagcgucucgggaggcaggacccuagggagacccgggugugc

SEQ ID NO: 179349 - RNA, 64 nt, Homo Sapiens
ccugaugcaggagggugcgauagcggacguggccaggcaggaggggccggguucaggagcugag

SEQ ID NO: 179350 - RNA, 64 nt, Homo Sapiens
gcuugagcccaggaguuugauucuugggaggcugaggcaggauuugcacaccuguaguccuagc

SEQ ID NO: 179351 - RNA, 64 nt, Homo Sapiens
gagaagcacagcaauauacaagucuuccggagucaggcaggaaguugagagagacugagacagg

SEQ ID NO: 179352 - RNA, 64 nt, Homo Sapiens
caggugccaucuuggccaccugccuuuucuucugaggcaggaaaucaaagggucagugcgucag

SEQ ID NO: 179353 - RNA, 64 nt, Homo Sapiens
gcacugaccacaccccacaccacacuugacccucaggcaggaggugcugaaguugacuugaaaa

SEQ ID NO: 179354 - RNA, 64 nt, Homo Sapiens
cgcgcgccuguugucuuagcuacucaggaggcugaggcaggagaaucgcuugaaaacaggaggu

SEQ ID NO: 179355 - RNA, 64 nt, Homo Sapiens
uugcuacuggggauuacccauggauauccuuaauaggcaggaagucugggaauucugguggccu

SEQ ID NO: 179356 - RNA, 64 nt, Homo Sapiens
gaagaccuggcuuccgcgagagccuuguuccuggaggcaggagcgccccgccauccuggguacc

SEQ ID NO: 179357 - RNA, 64 nt, Homo Sapiens
cacaugccuguaaucccagcuacucgggaggcugaggcaggagaauugcuugaaccugggaggc

SEQ ID NO: 179358 - RNA, 64 nt, Homo Sapiens
cguaucucugucugacggaaugguggaugguggaaggcaggacaggaaacuucagaguacaaau

SEQ ID NO: 179359 - RNA, 64 nt, Homo Sapiens
uuggauuaauagagaaauuugggaaguggaacauaggcaggauuugcagcuggcccugaguaca

SEQ ID NO: 179360 - RNA, 64 nt, Homo Sapiens
auggcgugaacccaggaggcuacucugaagacugaggcaggagacgggcgccuguagucccagc

SEQ ID NO: 179361 - RNA, 64 nt, Homo Sapiens
aucgcuugaacccgggaggcuacucaggaggcugaggcaggagaugcacgccuguagucucagc

SEQ ID NO: 179362 - RNA, 64 nt, Homo Sapiens
agggguuaaugcagauggcagugcagcaaggagaaggcaggaacauuggagccugcaauaaggg

SEQ ID NO: 179363 - RNA, 64 nt, Homo Sapiens
cgggcgccuguaguuccagcuaacugggcggcugaggcaggagaauggcgugaaccugggaggu

SEQ ID NO: 179364 - RNA, 64 nt, Homo Sapiens
ugcaugccuguaaucccagcuauucggaaggcugaggcaggagaaucacuugaacccaggaggc

SEQ ID NO: 179365 - RNA, 64 nt, Homo Sapiens
aaucuagugugcagggcauucaccucagccccccaggcaggagccaagcacagcaggagcuucc

SEQ ID NO: 179366 - RNA, 64 nt, Homo Sapiens
cacaugacuguaaucccagcuacucaggaggcugaggcaggaggaucacuugaaccugggaggc

SEQ ID NO: 179367 - RNA, 64 nt, Homo Sapiens
cacaugccaguaauuccaucuacucgggaggcugaggcaggagaaucgucuaagcccgggaggu

SEQ ID NO: 179368 - RNA, 64 nt, Homo Sapiens
caggcaccuguagucccagauacucgggaggcuaaggcaggagaaucgcuugacgggaagcgga

SEQ ID NO: 179369 - RNA, 64 nt, Homo Sapiens
cgggggccuguaauccuagcuacuuggggugcugaggcaggagaaucaacugaacccgggaggc

SEQ ID NO: 179370 - RNA, 64 nt, Homo Sapiens
gcucauggccaaaugugcgcacucuacauaaaggaggcaggaguuccuauaggcuauuuaaugu

SEQ ID NO: 179371 - RNA, 64 nt, Homo Sapiens
uuucauuuacaucaaaguuaucucacaaaagagaaggcaggaaacguuuugugagugccuauuc

SEQ ID NO: 179372 - RNA, 64 nt, Homo Sapiens
aucgcuugaacccgggaggcuacucgggaggcugaggcaggagacgggcaccuguaauccuggc

SEQ ID NO: 179373 - RNA, 64 nt, Homo Sapiens
auugagccuaggaguucgagacuuugggaagcugaggcaggaagugcacuccuguaacccuggg

SEQ ID NO: 179374 - RNA, 64 nt, Homo Sapiens
gauccuccccuagagccuccccaggagcugggagaggcaggaagcccagggacaccuggagccc

SEQ ID NO: 179375 - RNA, 64 nt, Homo Sapiens
gacccuccccuagagucucuccaggagcugggagaggcaggaagcccagggaugccuggagucc

SEQ ID NO: 179376 - RNA, 64 nt, Homo Sapiens; identical to SEQ ID NO: 124726

SEQ ID NO: 179377 - RNA, 64 nt, Homo Sapiens; identical to SEQ ID NO: 124727

SEQ ID NO: 179378 - RNA, 64 nt, Homo Sapiens; identical to SEQ ID NO: 124728

SEQ ID NO: 179379 - RNA, 64 nt, Homo Sapiens; identical to SEQ ID NO: 124729

SEQ ID NO: 179380 - RNA, 64 nt, Homo Sapiens; identical to SEQ ID NO: 124730

SEQ ID NO: 179381 - RNA, 64 nt, Homo Sapiens; identical to SEQ ID NO: 124731

SEQ ID NO: 179382 - RNA, 64 nt, Homo Sapiens; identical to SEQ ID NO: 124732

SEQ ID NO: 179383 - RNA, 64 nt, Homo Sapiens; identical to SEQ ID NO: 124733

SEQ ID NO: 179384 - RNA, 64 nt, Homo Sapiens; identical to SEQ ID NO: 124734

SEQ ID NO: 179385 - RNA, 64 nt, Homo Sapiens; identical to SEQ ID NO: 124735

SEQ ID NO: 179386 - RNA, 64 nt, Homo Sapiens; identical to SEQ ID NO: 124736

SEQ ID NO: 179387 - RNA, 64 nt, Homo Sapiens; identical to SEQ ID NO: 124737

SEQ ID NO: 179388 - RNA, 64 nt, Homo Sapiens; identical to SEQ ID NO: 124738

SEQ ID NO: 179389 - RNA, 64 nt, Homo Sapiens; identical to SEQ ID NO: 124739

SEQ ID NO: 179390 - RNA, 64 nt, Homo Sapiens; identical to SEQ ID NO: 124740

SEQ ID NO: 179391 - RNA, 64 nt, Homo Sapiens; identical to SEQ ID NO: 124741

SEQ ID NO: 179392 - RNA, 64 nt, Homo Sapiens; identical to SEQ ID NO: 124742

SEQ ID NO: 179393 - RNA, 64 nt, Homo Sapiens; identical to SEQ ID NO: 124743

SEQ ID NO: 179394 - RNA, 64 nt, Homo Sapiens; identical to SEQ ID NO: 124744

SEQ ID NO: 179395 - RNA, 64 nt, Homo Sapiens; identical to SEQ ID NO: 124745

SEQ ID NO: 179396 - RNA, 64 nt, Homo Sapiens; identical to SEQ ID NO: 124746

SEQ ID NO: 179397 - RNA, 64 nt, Homo Sapiens; identical to SEQ ID NO: 124747

SEQ ID NO: 179398 - RNA, 64 nt, Homo Sapiens; identical to SEQ ID NO: 124748

SEQ ID NO: 179399 - RNA, 64 nt, Homo Sapiens; identical to SEQ ID NO: 124749

SEQ ID NO: 179400 - RNA, 64 nt, Homo Sapiens; identical to SEQ ID NO: 124750

SEQ ID NO: 179401 - RNA, 64 nt, Homo Sapiens; identical to SEQ ID NO: 124751

SEQ ID NO: 179402 - RNA, 60 nt, Homo Sapiens; identical to SEQ ID NO: 124752

SEQ ID NO: 179403 - RNA, 64 nt, Homo Sapiens; identical to SEQ ID NO: 124753

SEQ ID NO: 179404 - RNA, 64 nt, Homo Sapiens; identical to SEQ ID NO: 124754

SEQ ID NO: 179405 - RNA, 64 nt, Homo Sapiens; identical to SEQ ID NO: 124755

SEQ ID NO: 179406 - RNA, 64 nt, Homo Sapiens; identical to SEQ ID NO: 124756

SEQ ID NO: 179407 - RNA, 64 nt, Homo Sapiens; identical to SEQ ID NO: 124757

SEQ ID NO: 179408 - RNA, 64 nt, Homo Sapiens; identical to SEQ ID NO: 124758

SEQ ID NO: 179409 - RNA, 64 nt, Homo Sapiens; identical to SEQ ID NO: 124759

SEQ ID NO: 179410 - RNA, 64 nt, Homo Sapiens; identical to SEQ ID NO: 124760

SEQ ID NO: 179411 - RNA, 64 nt, Homo Sapiens; identical to SEQ ID NO: 124761

SEQ ID NO: 179412 - RNA, 64 nt, Homo Sapiens; identical to SEQ ID NO: 124762

SEQ ID NO: 179413 - RNA, 64 nt, Homo Sapiens; identical to SEQ ID NO: 124763

SEQ ID NO: 179414 - RNA, 64 nt, Homo Sapiens; identical to SEQ ID NO: 124764

SEQ ID NO: 179415 - RNA, 64 nt, Homo Sapiens; identical to SEQ ID NO: 124765

SEQ ID NO: 179416 - RNA, 64 nt, Homo Sapiens; identical to SEQ ID NO: 124766

SEQ ID NO: 179417 - RNA, 64 nt, Homo Sapiens; identical to SEQ ID NO: 124767

SEQ ID NO: 179418 - RNA, 64 nt, Homo Sapiens; identical to SEQ ID NO: 124768

SEQ ID NO: 179419 - RNA, 64 nt, Homo Sapiens; identical to SEQ ID NO: 124769

SEQ ID NO: 179420 - RNA, 64 nt, Homo Sapiens; identical to SEQ ID NO: 124770

SEQ ID NO: 179421 - RNA, 64 nt, Homo Sapiens; identical to SEQ ID NO: 124771

SEQ ID NO: 179422 - RNA, 64 nt, Homo Sapiens; identical to SEQ ID NO: 124772

SEQ ID NO: 179423 - RNA, 64 nt, Homo Sapiens; identical to SEQ ID NO: 124773

SEQ ID NO: 179424 - RNA, 64 nt, Homo Sapiens; identical to SEQ ID NO: 124774

SEQ ID NO: 179425 - RNA, 64 nt, Homo Sapiens; identical to SEQ ID NO: 124775

SEQ ID NO: 179426 - RNA, 64 nt, Homo Sapiens; identical to SEQ ID NO: 124776

SEQ ID NO: 179427 - RNA, 64 nt, Homo Sapiens; identical to SEQ ID NO: 124777

SEQ ID NO: 179428 - RNA, 64 nt, Homo Sapiens; identical to SEQ ID NO: 124778

SEQ ID NO: 179429 - RNA, 64 nt, Homo Sapiens; identical to SEQ ID NO: 124779

SEQ ID NO: 179430 - RNA, 64 nt, Homo Sapiens; identical to SEQ ID NO: 124780

SEQ ID NO: 179431 - RNA, 64 nt, Homo Sapiens; identical to SEQ ID NO: 124781

SEQ ID NO: 179432 - RNA, 64 nt, Homo Sapiens; identical to SEQ ID NO: 124782

SEQ ID NO: 179433 - RNA, 64 nt, Homo Sapiens; identical to SEQ ID NO: 124783

SEQ ID NO: 179434 - RNA, 64 nt, Homo Sapiens; identical to SEQ ID NO: 124784

SEQ ID NO: 179435 - RNA, 64 nt, Homo Sapiens; identical to SEQ ID NO: 124785

SEQ ID NO: 179436 - RNA, 64 nt, Homo Sapiens; identical to SEQ ID NO: 124786

SEQ ID NO: 179437 - RNA, 64 nt, Homo Sapiens; identical to SEQ ID NO: 124787

SEQ ID NO: 179438 - RNA, 64 nt, Homo Sapiens; identical to SEQ ID NO: 124788

SEQ ID NO: 179439 - RNA, 64 nt, Homo Sapiens; identical to SEQ ID NO: 124789

SEQ ID NO: 179440 - RNA, 64 nt, Homo Sapiens; identical to SEQ ID NO: 124790

SEQ ID NO: 179441 - RNA, 64 nt, Homo Sapiens; identical to SEQ ID NO: 124791

SEQ ID NO: 179442 - RNA, 64 nt, Homo Sapiens; identical to SEQ ID NO: 124792

SEQ ID NO: 179443 - RNA, 64 nt, Homo Sapiens; identical to SEQ ID NO: 124793

SEQ ID NO: 179444 - RNA, 64 nt, Homo Sapiens; identical to SEQ ID NO: 124794

SEQ ID NO: 179445 - RNA, 64 nt, Homo Sapiens; identical to SEQ ID NO: 124795

SEQ ID NO: 179446 - RNA, 64 nt, Homo Sapiens; identical to SEQ ID NO: 124796

SEQ ID NO: 179447 - RNA, 64 nt, Homo Sapiens; identical to SEQ ID NO: 124797

SEQ ID NO: 179448 - RNA, 64 nt, Homo Sapiens; identical to SEQ ID NO: 124798

SEQ ID NO: 179449 - RNA, 64 nt, Homo Sapiens; identical to SEQ ID NO: 124799

SEQ ID NO: 179450 - RNA, 64 nt, Homo Sapiens; identical to SEQ ID NO: 124800

SEQ ID NO: 179451 - RNA, 64 nt, Homo Sapiens; identical to SEQ ID NO: 124801

SEQ ID NO: 179452 - RNA, 64 nt, Homo Sapiens; identical to SEQ ID NO: 124802

SEQ ID NO: 179453 - RNA, 64 nt, Homo Sapiens; identical to SEQ ID NO: 124803

SEQ ID NO: 179454 - RNA, 64 nt, Homo Sapiens; identical to SEQ ID NO: 124804

SEQ ID NO: 179455 - RNA, 64 nt, Homo Sapiens; identical to SEQ ID NO: 124805

SEQ ID NO: 179456 - RNA, 64 nt, Homo Sapiens; identical to SEQ ID NO: 124806

SEQ ID NO: 179457 - RNA, 64 nt, Homo Sapiens; identical to SEQ ID NO: 124807

SEQ ID NO: 179458 - RNA, 64 nt, Homo Sapiens; identical to SEQ ID NO: 124808

SEQ ID NO: 179459 - RNA, 64 nt, Homo Sapiens; identical to SEQ ID NO: 124809

SEQ ID NO: 179460 - RNA, 64 nt, Homo Sapiens; identical to SEQ ID NO: 124810

SEQ ID NO: 179461 - RNA, 64 nt, Homo Sapiens; identical to SEQ ID NO: 124811

SEQ ID NO: 179462 - RNA, 64 nt, Homo Sapiens; identical to SEQ ID NO: 124812

SEQ ID NO: 179463 - RNA, 64 nt, Homo Sapiens
uaaucacauuugcaggaaauuuaaucuugaugauucuuauuaauugcuaucaauuucuuauuaa

SEQ ID NO: 179464 - RNA, 64 nt, Homo Sapiens
uaaucuugaugauucuuauuuccugcuaucaauuucuuauuaaucugucugggccuguuacuca

SEQ ID NO: 179465 - RNA, 64 nt, Homo Sapiens
uccccgcuccacaagacacccaaucccgaucggcucuuauuagcgugaucuggaaaucuaccac

SEQ ID NO: 179466 - RNA, 64 nt, Homo Sapiens
uccccgcuccacaagacacccaaucccgaucggcucuuauuagcgugcuuuggaaauccaccac

SEQ ID NO: 179467 - RNA, 64 nt, Homo Sapiens
uccccgcuccacaagacacccaaucccgaucggcucuuauuagcgggaucuggaaauccacgac

SEQ ID NO: 179468 - RNA, 64 nt, Homo Sapiens
aguuauccaugccaagucccauugucagaaauauucuuauuacucagucaaacacucuuugagc

SEQ ID NO: 179469 - RNA, 64 nt, Homo Sapiens
uuucuuguagcuaaaaauaaaacaucauaaaucuucuuauuaaaucaaucuugaaauagaaaau

SEQ ID NO: 179470 - RNA, 64 nt, Homo Sapiens
cuugugccaauaagagaaguauacaacccaucuaucuuauuaguagucuuagauuuuaagagua

SEQ ID NO: 179471 - RNA, 64 nt, Homo Sapiens
gaauaaccugguuaaacagacauuaaaauggaguucuuauuauacauuuguaauggauaacgug

SEQ ID NO: 179472 - RNA, 64 nt, Homo Sapiens
cgcuugauggauagagcgccuucaguguacuguuucuuauuaacuuuacuuuuuuuaaaucaac

SEQ ID NO: 179473 - RNA, 64 nt, Homo Sapiens
aauugacuuacugggaaacugaauaaaauaugccucuuauuaucauauugucuccugguuuuuu

SEQ ID NO: 179474 - RNA, 64 nt, Homo Sapiens
caccagaaaauggucauaucuuccaaauuauuugucuuauuaauuucucucacaagcuagcuua

SEQ ID NO: 179475 - RNA, 64 nt, Homo Sapiens
gguugggauugguccugucauuugggaggcuuuuucuuauuaaaaaaauuuugucaccuaagug

SEQ ID NO: 179476 - RNA, 64 nt, Homo Sapiens
augauuaauauauuuagaagguauaggaccagugucuuauuaaugaagauggacuguugaaauu

SEQ ID NO: 179477 - RNA, 64 nt, Homo Sapiens
cuuuuaguuguaugagucucuaaucuaauaguccucuuauuaugauacacuaaaagcaugcauc

SEQ ID NO: 179478 - RNA, 64 nt, Homo Sapiens
uccgauuggaacgcgccacaguggaucucugacuucuuauuaccucuccaauugcauggucucu

SEQ ID NO: 179479 - RNA, 64 nt, Homo Sapiens
acguuguuggccuccauugcgauguuaaaccacuucuuauuaccugccagaugggaugagaugg

SEQ ID NO: 179480 - RNA, 64 nt, Homo Sapiens
auuguggcgcuuuuguagaucacugagaagcuuaucuuauuaaccaauauaccacuuccuaaau

SEQ ID NO: 179481 - RNA, 64 nt, Homo Sapiens
ggucaaagaauggcuuucaguuaaaguuuugacuucuuauuauaaauaauauaaagaaugucuc

SEQ ID NO: 179482 - RNA, 64 nt, Homo Sapiens
uuuagcauuaaaacucaccaucaaauagauguaaucuuauuaauuacacauuuuguauuuuaau

SEQ ID NO: 179483 - RNA, 64 nt, Homo Sapiens
ucauagaauaacauguuauuuauugguauugacuucuuauuagacagagcucauaguauuuguu

SEQ ID NO: 179484 - RNA, 64 nt, Homo Sapiens
acauguaaagacuacaguuaauucugacacuguaucuuauuaaaauaggaugauuugcauuuug

SEQ ID NO: 179485 - RNA, 64 nt, Homo Sapiens
gauuucaggcaaagacuugcaggaagaugaugauaacggcgaugugaaucgucaaagguacggg

SEQ ID NO: 179486 - RNA, 64 nt, Homo Sapiens
ccauuugucuucaguuucuaguuugcacauccagaacggcgaaggcuggguguguauuccacua

SEQ ID NO: 179487 - RNA, 64 nt, Homo Sapiens
cuacuacuaagaauccccagggccagcagcucccaacggcgaugggcgcagagcacacccgcug

SEQ ID NO: 179488 - RNA, 64 nt, Homo Sapiens
uucuaguaaugauaguuuuucuauaaauaauaggaacggcgacagaacaccugaaaugcaugcu

SEQ ID NO: 179489 - RNA, 64 nt, Homo Sapiens
ucaccgagcccaagaguucaagacaauccuggccaacggcgaaacucugucucuacaaaaaaua

SEQ ID NO: 179490 - RNA, 64 nt, Homo Sapiens
uucgggcccuuuucuccagcagcuucuguuugaaaacggcgaccgccgggcgcgcacacacggc

SEQ ID NO: 179491 - RNA, 64 nt, Homo Sapiens
cagucugugccuuagaggucuguuaggccugccaaacggcgaccagcuccccuggagcgagggc

SEQ ID NO: 179492 - RNA, 64 nt, Homo Sapiens
agagagcggagccgggagcgagacaaggagcgagaacggcgacgcucccgcucccgggaccggc

SEQ ID NO: 179493 - RNA, 64 nt, Homo Sapiens
cuuauagccucccaucgugcccacgauagcuggcaacggcgacacuuccaacuucgaaacuuac

SEQ ID NO: 179494 - RNA, 64 nt, Homo Sapiens
aaagugcugggauuacaggugugagccaccacgcccggccgauuuggggcauuuuuauuuaaca

SEQ ID NO: 179495 - RNA, 64 nt, Homo Sapiens
caggcaaugggcacagccuuccuccccagaggacccggccgaccucagcgccuccugcaggcua

SEQ ID NO: 179496 - RNA, 64 nt, Homo Sapiens
gaccgcggcugccccaguugccugccgcccgccaccggccgaccgucccggaccccaccucuuc

SEQ ID NO: 179497 - RNA, 64 nt, Homo Sapiens
gagggaggcgggagucgggggaagacgcggcaggccggccgagggcaccccgaggaacauggca

SEQ ID NO: 179498 - RNA, 64 nt, Homo Sapiens
agugacuucagucugcucagaacgaauguggaggccggccgaaacugaugcugcccacaguccc

SEQ ID NO: 179499 - RNA, 64 nt, Homo Sapiens
gaaguacgcggagccagcgccgucggagaccgcgccggccgagcugaggacugcacgccgcugu

SEQ ID NO: 179500 - RNA, 64 nt, Homo Sapiens
aaaguguugggauuacaggcuugagccaccgcacccggccgagaauauguguuguuauuuauga

SEQ ID NO: 179501 - RNA, 64 nt, Homo Sapiens
aaggacggguuggggccgggcacauugggggucaccggccgauggagacaccaaccgacaggcc

SEQ ID NO: 179502 - RNA, 64 nt, Homo Sapiens
cacaccggggagagcugcucggacaggcccccucccggccgaagcugucccuuaaugcuggucc

SEQ ID NO: 179503 - RNA, 64 nt, Homo Sapiens
gcgccuuagcucgagucggaucuccgagcuaggcccggccgagaccguacaaaccaaguugccc

SEQ ID NO: 179504 - RNA, 64 nt, Homo Sapiens
uguuugaaaucuuuaagcaugugagccacugcgcccggccgaagaaagugcugggauuacaggc

SEQ ID NO: 179505 - RNA, 64 nt, Homo Sapiens
uagugucucuuuucaaggucugccagcagccuccccggccgaccugcggagcucugguuucaga

SEQ ID NO: 179506 - RNA, 64 nt, Homo Sapiens
caagcccugcaguguguccccgcucggggagggcccggccgagcgggcagggagagccaguccu

SEQ ID NO: 179507 - RNA, 64 nt, Homo Sapiens
ugcuugcccucauccuccugccagcucccugcgcccggccgacccugugucugcagccacagug

SEQ ID NO: 179508 - RNA, 64 nt, Homo Sapiens
gaggaaggccaggcucgggggagccuccuccagcccggccgacccggacucccggucaccugac

SEQ ID NO: 179509 - RNA, 64 nt, Homo Sapiens
cucaggaugcagagaagucaguucuuccuggggcccggccgaucagacagggaugaggcaagug

SEQ ID NO: 179510 - RNA, 64 nt, Homo Sapiens
aggagaaacucauugaaauccagcguccuccucaccggccgaaguacacacuugccucucgcua

SEQ ID NO: 179511 - RNA, 64 nt, Homo Sapiens
uuacaccuggaauguuaggaucgugcggccgcggccggccgagcugccuggcgggguuggcccu

SEQ ID NO: 179512 - RNA, 64 nt, Homo Sapiens
gcugcucgccgauccgugggaugcacugaaaggcccggccgacuucagcuccuucccccucgca

SEQ ID NO: 179513 - RNA, 64 nt, Homo Sapiens
aucccauccaugaacucgaugggccccuccugugccggccgagaggcacacacugccuucacga

SEQ ID NO: 179514 - RNA, 64 nt, Homo Sapiens
gaccgucuggggcucaggcuggugugggaugcagccggccgaugagaaaauaaagccauauuga

SEQ ID NO: 179515 - RNA, 64 nt, Homo Sapiens
ccgcggggccuccccacaagccccucccaaagcgccggccgacucgcugucucgcuggggacuc

SEQ ID NO: 179516 - RNA, 64 nt, Homo Sapiens
ugucgacugccuuauacacccgcccccgcgcuggccggccgaccuagugccuuguucucacccc

SEQ ID NO: 179517 - RNA, 64 nt, Homo Sapiens
cgccuuugcaggagaaaugucgggacaccagugcccggccgacgccucccuccgcugagugaca

SEQ ID NO: 179518 - RNA, 64 nt, Homo Sapiens
auaagaaguuuaaucaaagugccaccgugcccggccggccgagcugcugggauuacgggcugga

SEQ ID NO: 179519 - RNA, 64 nt, Homo Sapiens
aaagugcugggauuacaggugugagccaccgcgcccggccgagaaugacaucuuaaagccacca

SEQ ID NO: 179520 - RNA, 64 nt, Homo Sapiens
aaaucaaagcaaaccaauaccauugauaagaagaagauaaaaacaaaauauuuuggaguguuuu

SEQ ID NO: 179521 - RNA, 64 nt, Homo Sapiens
uuguaaagugcuauaaauguauuuuguuaaguacagauaaaagcuauugugugaguauauugug

SEQ ID NO: 179522 - RNA, 64 nt, Homo Sapiens
cauucuuuuaauucugggaauuccaugguaauacagauaaaauaaauccaguguuacuaguaau

SEQ ID NO: 179523 - RNA, 64 nt, Homo Sapiens
uuccagggugcacuuccagauugacaaggaacucagauaaaaauuugcaugcaauuguguagga

SEQ ID NO: 179524 - RNA, 64 nt, Homo Sapiens
ucccaguccuaugguaaugacuuaggaggaaugcagauaaaaguaccuuguaagauaaauauaa

SEQ ID NO: 179525 - RNA, 64 nt, Homo Sapiens
ucagggugaggugcuguguuucuuauuucauacgagauaaaacagagagaaguucucucuucuc

SEQ ID NO: 179526 - RNA, 64 nt, Homo Sapiens
ucagaagaccaccugugcccuuuucucucguggaagauaaaaccuggacucagggagcaaccac

SEQ ID NO: 179527 - RNA, 64 nt, Homo Sapiens
auuuuguuccuuuucaucauagaaaacauguuuaagauaaaauacaaacuuuaccuaccccaaa

SEQ ID NO: 179528 - RNA, 64 nt, Homo Sapiens
cuuugaaagaaauguacuguguacugacucauagagauaaaauugugagaaccacuaaguugga

SEQ ID NO: 179529 - RNA, 64 nt, Homo Sapiens
ugaugcuggcauggcaaucaaagccacccuucacagauaaaauauuuuauaguuuuccacaacc

SEQ ID NO: 179530 - RNA, 64 nt, Homo Sapiens
auuuauaauugaacaauuugcaauaauguacagaagauaaaaaaaauuuuguggcucccuaaug

SEQ ID NO: 179531 - RNA, 64 nt, Homo Sapiens
auguauuuucuuuauuucacuguaagagaauaaaagauaaaauaaaguagcuuugaauuuucuc

SEQ ID NO: 179532 - RNA, 64 nt, Homo Sapiens
ugcuugugucuugaauaauaaaaaaagucuuuucagauaaaaucgagaaagcuuucauauuuaa

SEQ ID NO: 179533 - RNA, 64 nt, Homo Sapiens
uugucuuguuuccaucacugacugaagaagaggaagauaaaagacagaaaacuauugucauuca

SEQ ID NO: 179534 - RNA, 64 nt, Homo Sapiens
cgggacugaaaacguuagagacacacugcauugcagauaaaaugcaggcagcacaauauggccu

SEQ ID NO: 179535 - RNA, 64 nt, Homo Sapiens
gugcgguucuaauucaugugcagugauauaguauagauaaaagaaugaguaaaagaaaauacaa

SEQ ID NO: 179536 - RNA, 64 nt, Homo Sapiens
uuuguuaccaauacgcuuuaaucuugucuuggaaagauaaaaugaccugcauucuaaauuagaa

SEQ ID NO: 179537 - RNA, 64 nt, Homo Sapiens
augaacauuggguucacaaggcauuggguaaguuagauaaaauagcauauacuuucucugcagg

SEQ ID NO: 179538 - RNA, 64 nt, Homo Sapiens
agccccuuuccuugcagguauuuuagauauacagagauaaaaauaguuuggguacugugcugau

SEQ ID NO: 179539 - RNA, 64 nt, Homo Sapiens
acaggguuggaaagaacuuuaaguuacaugacaaagauaaaaucugaugaaaugagucacagag

SEQ ID NO: 179540 - RNA, 64 nt, Homo Sapiens
aaaugauuuuuuuucuuaccuacagaguguaaagagauaaaaagaaguguucuucuacaaaucu

SEQ ID NO: 179541 - RNA, 64 nt, Homo Sapiens
cuaauuaaaaauuuaaaagguguugacugaagauagauaaaacuaugaacuaauucuuuacaaa

SEQ ID NO: 179542 - RNA, 64 nt, Homo Sapiens
acucgagcuacaaagaaagauguaaaauguucuaagauaaaaaauaaaagaaaacaccgacagc

SEQ ID NO: 179543 - RNA, 64 nt, Homo Sapiens
cauuaucuaugauuguuguaccauuucucuuuguagauaaaaagagacagggaggcugcagaag

SEQ ID NO: 179544 - RNA, 64 nt, Homo Sapiens
gagacuuagaagacagacugccaaagugcguuccagauaaaaauauauaggcugaaaucucuua

SEQ ID NO: 179545 - RNA, 64 nt, Homo Sapiens
cacaccugagggcugaaaacuuuagaauaaugcaagauaaaaauagcuuuggcucuggcugcuu

SEQ ID NO: 179546 - RNA, 64 nt, Homo Sapiens
acuguuaccagauaacaaacaaguaauuguaggaagauaaaaaacccgaagacacuccuucccc

SEQ ID NO: 179547 - RNA, 64 nt, Homo Sapiens
auuuuuucuggaacugaauucuuaaacauaaaacagauaaaaugcaucuuguuacuacaaaugu

SEQ ID NO: 179548 - RNA, 64 nt, Homo Sapiens
uaucacucuugaauuuuaucaucuauaaaaugagagauaaaaauaucucacugaauuguuacuu

SEQ ID NO: 179549 - RNA, 64 nt, Homo Sapiens
uguaguuuuaaccagacuuucucuuaaaaacauuagauaaaauaaaagauucaccggauggauu

SEQ ID NO: 179550 - RNA, 64 nt, Homo Sapiens
auucagaacauagcaaauaccuuugaaguauaaaagauaaaauucauuuuuagugaacccugua

SEQ ID NO: 179551 - RNA, 64 nt, Homo Sapiens
gagaccuauuagauguaagugcuaguagaauauaagauaaaagaggcugagaauuaccauacaa

SEQ ID NO: 179552 - RNA, 64 nt, Homo Sapiens
uguuucauuguucugucaauaauuguuaccaaagagauaaaaauaaaagcagaauguauaucau

SEQ ID NO: 179553 - RNA, 64 nt, Homo Sapiens
gacuccaucucaaaaaaaaaaaaaaaaaaaaaaaagauaaaaagucagaaaucugaaaagugga

SEQ ID NO: 179554 - RNA, 64 nt, Homo Sapiens
gggccugaugacauccaauacagaguucugguaaagauaaaauuugauacagguuuggugucau

SEQ ID NO: 179555 - RNA, 64 nt, Homo Sapiens
auaggaaaagauucaaagcucccuguaggaguaaagauaaaaggagaagggagcugaggccauu

SEQ ID NO: 179556 - RNA, 64 nt, Homo Sapiens
cgaauccccuaaacaaaaagaucuuaagauuacaagauaaaaaauaaaguugaggggagaggaa

SEQ ID NO: 179557 - RNA, 64 nt, Homo Sapiens
ggucuuggcugaaaaaaaaaaaugcuuuuaaaaaagauaaaaugaaaaggagagcucucuuuuu

SEQ ID NO: 179558 - RNA, 64 nt, Homo Sapiens
acccuguguggcucauucccacccaggaaacugaagauaaaagauuugggaaaacacaccaaga

SEQ ID NO: 179559 - RNA, 64 nt, Homo Sapiens
aauaaucuauacauguucaaauuagguagcauaaagauaaaagugaaauuuaguaguauaggcc

SEQ ID NO: 179560 - RNA, 64 nt, Homo Sapiens
gaauguuuaguguaguuaagacuaauuugacaacagauaaaacagucugucagcuauuacaaag

SEQ ID NO: 179561 - RNA, 64 nt, Homo Sapiens
aucuuuaccuuauuaauauuuaaauaagugaauaagauaaaaauauacuuauccucugaacaca

SEQ ID NO: 179562 - RNA, 64 nt, Homo Sapiens
auauuauuaaauaccuauauaaacgaaaugauaaagauaaaaccuuuuugugauuuaugcgauu

SEQ ID NO: 179563 - RNA, 64 nt, Homo Sapiens
agagauaaagacuacagaaggagagagcuagucuagauaaaaaaauggaagaaguaaggaaaag

SEQ ID NO: 179564 - RNA, 64 nt, Homo Sapiens
aauacgagugauagaaguagucaagaaguucuggagauaaaaaaaaaaugaugaaaagaguagu

SEQ ID NO: 179565 - RNA, 64 nt, Homo Sapiens
aguaaacgaaauuccccagagauuuuuuaauauuagauaaaacguuaacugcuggcaaaauguu

SEQ ID NO: 179566 - RNA, 64 nt, Homo Sapiens
ucuauuuaaagacuuuaacuugaagaauccucuaagauaaaacucuugacugaugagcuuucag

SEQ ID NO: 179567 - RNA, 64 nt, Homo Sapiens
ggucugauauaugcugcucuugguucuauaaacuagauaaaagcagugcuuugugaaaugcagu

SEQ ID NO: 179568 - RNA, 64 nt, Homo Sapiens
augaaaaugaugcauggccaaguucaguguuuacagauaaaacugcugugguucaagugcuucc

SEQ ID NO: 179569 - RNA, 64 nt, Homo Sapiens
cuauaccauaauaaaaucuaagauaaaacuugagagauaaaaagagaaaauuauuuauuguuac

SEQ ID NO: 179570 - RNA, 64 nt, Homo Sapiens
ugagagauaaaaagcuauacuuauuuauuguuacagauaaaacuucagaauugcucaaagaaaa

SEQ ID NO: 179571 - RNA, 64 nt, Homo Sapiens
acuuaaaaucaagagccaaggaguagugaguuguagauaaaaaaagaaugucagcuuuggagac

SEQ ID NO: 179572 - RNA, 64 nt, Homo Sapiens
ucucugagccuacaucuucuugucuguaaaauggagauaaaauggguuuaaugaggucuaccuu

SEQ ID NO: 179573 - RNA, 64 nt, Homo Sapiens
agucguauuauucacuuguaaaaaugauuguaacagauaaaaaauguaucugcagcaacucugc

SEQ ID NO: 179574 - RNA, 64 nt, Homo Sapiens
ucuacaugauuuucaaguuguaaugcagauggacagauaaaaaagauuuuacguuugucuuuug

SEQ ID NO: 179575 - RNA, 64 nt, Homo Sapiens
aauaaggcaauaaauguugauucaaaaaggaaugagauaaaaagaaucuuaggagauaaacaca

SEQ ID NO: 179576 - RNA, 64 nt, Homo Sapiens
uuaggagauaaacacauucacccaucuccaucacagauaaaaucacuuuuguauucacaggcau

SEQ ID NO: 179577 - RNA, 64 nt, Homo Sapiens
cauauaggugugcauuuuaauauuuuucuuuccaagauaaaauuuugaaacuuaaauuguguau

SEQ ID NO: 179578 - RNA, 64 nt, Homo Sapiens
aguaagaaaaaaaaagacguauuuuugcuuacucagauaaaagacaaccuguaaaaauauaaua

SEQ ID NO: 179579 - RNA, 64 nt, Homo Sapiens
agagugaaaaucuucucuucaaauaaucuuugauagauaaaaauggaagguaagauguuucuag

SEQ ID NO: 179580 - RNA, 64 nt, Homo Sapiens
uaaaaagacaacagucaaguugauuuugauuagaagauaaaaguacauaaugaaaauccauggc

SEQ ID NO: 179581 - RNA, 64 nt, Homo Sapiens; identical to SEQ ID NO: 128751

SEQ ID NO: 179582 - RNA, 64 nt, Homo Sapiens; identical to SEQ ID NO: 128752

SEQ ID NO: 179583 - RNA, 64 nt, Homo Sapiens; identical to SEQ ID NO: 128753

SEQ ID NO: 179584 - RNA, 64 nt, Homo Sapiens; identical to SEQ ID NO: 128754

SEQ ID NO: 179585 - RNA, 64 nt, Homo Sapiens; identical to SEQ ID NO: 128755

SEQ ID NO: 179586 - RNA, 64 nt, Homo Sapiens; identical to SEQ ID NO: 128756

SEQ ID NO: 179587 - RNA, 64 nt, Homo Sapiens; identical to SEQ ID NO: 128757

SEQ ID NO: 179588 - RNA, 64 nt, Homo Sapiens; identical to SEQ ID NO: 128758

SEQ ID NO: 179589 - RNA, 64 nt, Homo Sapiens; identical to SEQ ID NO: 128759

SEQ ID NO: 179590 - RNA, 64 nt, Homo Sapiens; identical to SEQ ID NO: 128760

SEQ ID NO: 179591 - RNA, 64 nt, Homo Sapiens; identical to SEQ ID NO: 128761

SEQ ID NO: 179592 - RNA, 64 nt, Homo Sapiens; identical to SEQ ID NO: 128762

SEQ ID NO: 179593 - RNA, 64 nt, Homo Sapiens; identical to SEQ ID NO: 128763

SEQ ID NO: 179594 - RNA, 64 nt, Homo Sapiens; identical to SEQ ID NO: 128764

SEQ ID NO: 179595 - RNA, 64 nt, Homo Sapiens; identical to SEQ ID NO: 128765

SEQ ID NO: 179596 - RNA, 64 nt, Homo Sapiens; identical to SEQ ID NO: 128766

SEQ ID NO: 179597 - RNA, 64 nt, Homo Sapiens; identical to SEQ ID NO: 128767

SEQ ID NO: 179598 - RNA, 64 nt, Homo Sapiens; identical to SEQ ID NO: 128768

SEQ ID NO: 179599 - RNA, 64 nt, Homo Sapiens; identical to SEQ ID NO: 128769

SEQ ID NO: 179600 - RNA, 64 nt, Homo Sapiens; identical to SEQ ID NO: 128770

SEQ ID NO: 179601 - RNA, 64 nt, Homo Sapiens; identical to SEQ ID NO: 128771

SEQ ID NO: 179602 - RNA, 64 nt, Homo Sapiens; identical to SEQ ID NO: 128772

SEQ ID NO: 179603 - RNA, 64 nt, Homo Sapiens; identical to SEQ ID NO: 128773

SEQ ID NO: 179604 - RNA, 64 nt, Homo Sapiens; identical to SEQ ID NO: 128774

SEQ ID NO: 179605 - RNA, 64 nt, Homo Sapiens; identical to SEQ ID NO: 128775

SEQ ID NO: 179606 - RNA, 64 nt, Homo Sapiens; identical to SEQ ID NO: 128776

SEQ ID NO: 179607 - RNA, 64 nt, Homo Sapiens; identical to SEQ ID NO: 128777

SEQ ID NO: 179608 - RNA, 64 nt, Homo Sapiens; identical to SEQ ID NO: 128778

SEQ ID NO: 179609 - RNA, 64 nt, Homo Sapiens; identical to SEQ ID NO: 128779

SEQ ID NO: 179610 - RNA, 64 nt, Homo Sapiens; identical to SEQ ID NO: 128780

SEQ ID NO: 179611 - RNA, 64 nt, Homo Sapiens; identical to SEQ ID NO: 128781

SEQ ID NO: 179612 - RNA, 64 nt, Homo Sapiens; identical to SEQ ID NO: 128782

SEQ ID NO: 179613 - RNA, 64 nt, Homo Sapiens; identical to SEQ ID NO: 128783

SEQ ID NO: 179614 - RNA, 64 nt, Homo Sapiens; identical to SEQ ID NO: 128784

SEQ ID NO: 179615 - RNA, 64 nt, Homo Sapiens; identical to SEQ ID NO: 128785

SEQ ID NO: 179616 - RNA, 64 nt, Homo Sapiens; identical to SEQ ID NO: 128786

SEQ ID NO: 179617 - RNA, 64 nt, Homo Sapiens; identical to SEQ ID NO: 128787

SEQ ID NO: 179618 - RNA, 64 nt, Homo Sapiens; identical to SEQ ID NO: 128788

SEQ ID NO: 179619 - RNA, 64 nt, Homo Sapiens; identical to SEQ ID NO: 128789

SEQ ID NO: 179620 - RNA, 64 nt, Homo Sapiens
ugggcacccuuguucauaccuggaugacagaaggagcaaccacauuuuuuaguagcacuuucuc

SEQ ID NO: 179621 - RNA, 64 nt, Homo Sapiens
uucuucauggaacucagcccuuuuacauccgaaaagcaaccaacaauuuuacauccgaacaaaa

SEQ ID NO: 179622 - RNA, 64 nt, Homo Sapiens
aaaucaaauguaaaguuuaauugaaagaauguaaagcaaccaaaaagaaaaaaaaaaagaaaga

SEQ ID NO: 179623 - RNA, 64 nt, Homo Sapiens
cuaaccuacggccacgggaacaggaccaugguuaagcaaccauauagaaagcuuuguugaaaga

SEQ ID NO: 179624 - RNA, 64 nt, Homo Sapiens
gagucuccugagucgaggaaucuguauuauuaauagcaaccagggccgggugucguggcucacg

SEQ ID NO: 179625 - RNA, 64 nt, Homo Sapiens
agugagacuccuucucaaaaguaaauaaauaaauagcaaccaguacuccaggugauuccagcau

SEQ ID NO: 179626 - RNA, 64 nt, Homo Sapiens
acgaaguugagaaggaaaacaugaaacuccauguagcaaccaggccugugauuuucuuuucuaa

SEQ ID NO: 179627 - RNA, 64 nt, Homo Sapiens
gucuguuaaucauuucucuauguggacucagucaagcaaccacagguaggcauuuggcauauuu

SEQ ID NO: 179628 - RNA, 64 nt, Homo Sapiens
aauuugugugugaaauauaacauugauugaauugcaguuacauuugguuaguaauauuucauua

SEQ ID NO: 179629 - RNA, 64 nt, Homo Sapiens
gugguuagcaacuaugaaacagaaauaggacacucaguuacaaacauuaucuccuuuaguuuuu

SEQ ID NO: 179630 - RNA, 64 nt, Homo Sapiens
auuuguguuuuuuguuguuauuguuuggguagagcaguuacaagaaacccuaaaacccuuggau

SEQ ID NO: 179631 - RNA, 64 nt, Homo Sapiens
acagccccuugcuagauauuaccacagauaaugacaguuacaugguagaacugcccaugccaca

SEQ ID NO: 179632 - RNA, 64 nt, Homo Sapiens
uagggguuaaagcagacagucacacugguuuggucaguuacaaaguaauuucuuugaucuggac

SEQ ID NO: 179633 - RNA, 64 nt, Homo Sapiens
cuuggugugauugcacagaauuuguauguauuuucaguuacaagauuguaaguaaauugccuga

SEQ ID NO: 179634 - RNA, 64 nt, Homo Sapiens
ugacagaaaaaaaaaaaaaaacuaaacugguugucaguuacaucuucauuuaucuuaaagaaag

SEQ ID NO: 179635 - RNA, 64 nt, Homo Sapiens
augagaaagauuuggaaaacagcauuuuaaaugucaguuacaauuucuggaagauguuuuaaga

SEQ ID NO: 179636 - RNA, 64 nt, Homo Sapiens
guuuucuguaucauagauucgguauguguaugugcaguuacacaucugagcucaucgugcuacu

SEQ ID NO: 179637 - RNA, 64 nt, Homo Sapiens
ccaaggucauuggagagaacuggaccuguccagacaguuacacuaggacugcucuccaaggaac

SEQ ID NO: 179638 - RNA, 64 nt, Homo Sapiens
uacuaagagcucguaguucaaaaacccauucuuucaguuacaucucucaaacuuacuugacaac

SEQ ID NO: 179639 - RNA, 64 nt, Homo Sapiens
gucuacaauacuagcacuacuccucgguaguugacaguuacauaucaaauacaguaacugacac

SEQ ID NO: 179640 - RNA, 64 nt, Homo Sapiens
uuugcuugcaguagauuuucuuuaaaagaaugggcaguuacaugcauacuucaaaaguauuuuc

SEQ ID NO: 179641 - RNA, 64 nt, Homo Sapiens
gaugcugauguucaguguaauuucuuugccuguucaguuacagaaaguggugcucaguuguaga

SEQ ID NO: 179642 - RNA, 64 nt, Homo Sapiens
gugcuacaugugugccucucacagcaguuggccacaguuacagggagagaacaauaucacaguc

SEQ ID NO: 179643 - RNA, 64 nt, Homo Sapiens
cagcacagguuggauagggguuaguguaggagaccaguuacagaauggccuggagucuucaacu

SEQ ID NO: 179644 - RNA, 64 nt, Homo Sapiens
cacagucaauuaaauuuuaaaagcagcaauugcacaguuacauacccuagacaguucugugaga

SEQ ID NO: 179645 - RNA, 64 nt, Homo Sapiens
aguuuuguauuauuuuuuuuuugcucuuccacagcaguuacauauggcuacauguccgagugag

SEQ ID NO: 179646 - RNA, 62 nt, Homo Sapiens
gcaggacuacccccuuaccauuuuaagaagguacuuuauacauuuauuuaauccuacuaaug

SEQ ID NO: 179647 - RNA, 62 nt, Homo Sapiens
uaugaaugauuagagaaaauuugagucaguguacuuuauagugugaauccugugagcuaaua

SEQ ID NO: 179648 - RNA, 62 nt, Homo Sapiens
cuggcugggcaguggaauuuugagcgaccuuuacuuuauacuuuucugugcuugacagauuu

SEQ ID NO: 179649 - RNA, 62 nt, Homo Sapiens
ugcuugacagauuuucagccaugaccauguucacuuuauaaucaaaacaaaaauaaaggucc

SEQ ID NO: 179650 - RNA, 62 nt, Homo Sapiens
auguauauaagacagguagugccugauuuacuacuuuauauaaaauaguaccuccuucaguu

SEQ ID NO: 179651 - RNA, 62 nt, Homo Sapiens
uacacuacaguuuacuuuucagaauacuaaagacuuuauaacugcaugaacuuggauuuuuu

SEQ ID NO: 179652 - RNA, 62 nt, Homo Sapiens
guauacagauuuugcacgccacgaccggcaugacuuuauauucuggagguugcauggacugu

SEQ ID NO: 179653 - RNA, 62 nt, Homo Sapiens
ccuuugagggaaacccugaucagcaagcgagcacuuuauaucugggggcacuggcugggagu

SEQ ID NO: 179654 - RNA, 62 nt, Homo Sapiens
guccauaauacaaaguaucauuacaguauagaacuuuauagaacuuuauauaaaugucuuga

SEQ ID NO: 179655 - RNA, 62 nt, Homo Sapiens
aaugucuugauuacaguauaucccaaagugucacuuuauauauagcuuaugaggccaaauaa

SEQ ID NO: 179656 - RNA, 62 nt, Homo Sapiens
uuaguucuuuuuuccaaacuugugcgcacauaacuuuauaugaugcaauuugcaugugcaca

SEQ ID NO: 179657 - RNA, 62 nt, Homo Sapiens
aauauuauuauuuaaguuaaggaagcagcauuacuuuauaugagugaauuaaagugaaucau

SEQ ID NO: 179658 - RNA, 62 nt, Homo Sapiens
gcaaaggggcugaaaaacugaauaaggaaacaacuuuauaagagaaacaguggucuucaauc

SEQ ID NO: 179659 - RNA, 62 nt, Homo Sapiens
uauucaccaauuucaggaaaaccaaccauagaacuuuauaauaggacaguuauaaccugacu

SEQ ID NO: 179660 - RNA, 62 nt, Homo Sapiens
aauggugagauguauguuuggcucugcuuuuaacuuuauaaauccagugaccucucucucug

SEQ ID NO: 179661 - RNA, 62 nt, Homo Sapiens
acagguccugauuucuagaacccgugacuguuacuuuauacagcaaaggaaacuuugcagau

SEQ ID NO: 179662 - RNA, 62 nt, Homo Sapiens
gcccaacuucagaaaauacuuguuuuucuaauacuuuauaggauuauugcacauuauaaaau

SEQ ID NO: 179663 - RNA, 62 nt, Homo Sapiens
uauucuucugaacuaagacaaagcaaaucaacacuuuauaguaagaugugcagagggcauaa

SEQ ID NO: 179664 - RNA, 62 nt, Homo Sapiens
aagagacuugaagcugggugugcguggccagaacuuuauaauauuacaguugcgagccacug

SEQ ID NO: 179665 - RNA, 62 nt, Homo Sapiens
uuuuuuuuuuuuuuuuuuuuagaugaaggggaacuuuauaguuaaaaucacauucaauuuuc

SEQ ID NO: 179666 - RNA, 62 nt, Homo Sapiens
auagcugugguuauguuauuuuuuauuuaaaaacuuuauauuaaagucauuuguaauguuau

SEQ ID NO: 179667 - RNA, 62 nt, Homo Sapiens
uuucaauucuuggauaaucaggcucuguuugcacuuuauauuuuagcagauacagucucuua

SEQ ID NO: 179668 - RNA, 62 nt, Homo Sapiens
ucaauuuuuaaaccuuugcuguuaaaugcaauacuuuauaaagaaugaacaaaauuacugga

SEQ ID NO: 179669 - RNA, 62 nt, Homo Sapiens
aacuggcagucguauguuaguuucacuugucuacuuuauaugucugaucaauuuggauacca

SEQ ID NO: 179670 - RNA, 62 nt, Homo Sapiens
aaaacaaaagguuugaggaaaucaggcauaugacuuuauacuuaacaucagaucuuuucuau

SEQ ID NO: 179671 - RNA, 62 nt, Homo Sapiens
ucuuuaugcuguuauuacaggagaagugacauacuuuauauauguuuauauuagcaaggucu

SEQ ID NO: 179672 - RNA, 62 nt, Homo Sapiens
uauauuagcaaggucuguuuuuaauaccauauacuuuauauuucuauacauuuauauuucua

SEQ ID NO: 179673 - RNA, 62 nt, Homo Sapiens
uauucucaagcagggcauguuuaacggcaagaacuuuauauuuacauguucuacccagcauu

SEQ ID NO: 179674 - RNA, 62 nt, Homo Sapiens
cuacaaaggagagagauguaaguaucacucuuacuuuauauuguaaaaacuguuaaauauuu

SEQ ID NO: 179675 - RNA, 62 nt, Homo Sapiens
gaguaacaaaaugucauuucugaaagaggcuuacuuuauaccaacuagugucagcauuuggg

SEQ ID NO: 179676 - RNA, 62 nt, Homo Sapiens
agcaguuugcaauacuaaaauauuuuuuauagacuuuauauuuuuccuuuugauaaagggau

SEQ ID NO: 179677 - RNA, 62 nt, Homo Sapiens
acuauauauaauuuucccaccacuaauaccacacuuuauauucaguucugugucuuacuuau

SEQ ID NO: 179678 - RNA, 62 nt, Homo Sapiens
acaauagucagaaaacauuuuagaaauugaugacuuuauaaugcaaccaggaguauugaaaa

SEQ ID NO: 179679 - RNA, 62 nt, Homo Sapiens
uggagagugucaaauacauacuuugaggauugacuuuauauaaggugcccuguagaacucug

SEQ ID NO: 179680 - RNA, 62 nt, Homo Sapiens
caaaaucagccuucugucuguaacaaaaauguacuuuauagagauggaggaaaaggucuaau

SEQ ID NO: 179681 - RNA, 62 nt, Homo Sapiens
uaauguguauaaucagagugccucuuauacauacuuuauagaauaaaggaacauuuugacag

SEQ ID NO: 179682 - RNA, 62 nt, Homo Sapiens
uuucacucuacaaugcauauucuaaugaagcuacuuuauauaaauuggagagcuuauaaaau

SEQ ID NO: 179683 - RNA, 62 nt, Homo Sapiens
caucaacaagaucaccagugauaugccagauuacuuuauaugaacaucuugaauuuaaccau

SEQ ID NO: 179684 - RNA, 62 nt, Homo Sapiens
uauuacuuaaaauuaaaugguuuaaaaugagaacuuuauauauacaucccuacuaauauaau

SEQ ID NO: 179685 - RNA, 62 nt, Homo Sapiens
aaucuugaguuuguucacuacccaaagucagaacuuuauaaaugggacauuuuaucuucugg

SEQ ID NO: 179686 - RNA, 62 nt, Homo Sapiens
aaguaguuuuugcauuuguuauagagaaccacacuuuauauauuuauauuuuauauugcuaa

SEQ ID NO: 179687 - RNA, 62 nt, Homo Sapiens
guaaagaagguagguauauuaaguaauauuucacuuuauauuauacaaaaaauuuucaucua

SEQ ID NO: 179688 - RNA, 62 nt, Homo Sapiens
uggugguuugaaguaucuugauuaagaagcugacuuuauauuaaauaacuaaauuucagaaa

SEQ ID NO: 179689 - RNA, 62 nt, Homo Sapiens
uuguaguuuauuuugugauuuuuuggaaucguacuuuauauuuccaaauuuaaauuuaaaug

SEQ ID NO: 179690 - RNA, 62 nt, Homo Sapiens
cgaacacuaguaccauugacucucguugaauaacuuuauauuuccauaauccugaauugugu

SEQ ID NO: 179691 - RNA, 62 nt, Homo Sapiens
aagagguauuuucuaauuaugcacagauaucuacuuuauacaaauacuuuauauggcuauuu

SEQ ID NO: 179692 - RNA, 62 nt, Homo Sapiens
uaauuaugcacagauaucuacuuuauacaaauacuuuauauggcuauuuuugagaaaacccu

SEQ ID NO: 179693 - RNA, 65 nt, Homo Sapiens
ccuguugauuggcucagucaguggugggaaagaucacacuacaugaaagaaucccucuguucacu

SEQ ID NO: 179694 - RNA, 65 nt, Homo Sapiens
aauuacuguugaugauuuuucugcacuaguuuucuacacuacaggaugcugaccagcagugaagg

SEQ ID NO: 179695 - RNA, 65 nt, Homo Sapiens
gggauguguaauaaccaugcugcacuuuuuuucauacacuacaagcuaguacauaaaucccguca

SEQ ID NO: 179696 - RNA, 61 nt, Homo Sapiens
ugccagcucucaccagauggucucagaauggacacuacaaaccuucacuucaguagauuag

SEQ ID NO: 179697 - RNA, 50 nt, Homo Sapiens
acuugccauggccgcuguaaacacuacauguugcuuuggcaacagcuaua

SEQ ID NO: 179698 - RNA, 65 nt, Homo Sapiens
uaugcaaauggucauuucagauguaugguguuuuuacacuacaaagaagucccccauguggauau

SEQ ID NO: 179699 - RNA, 65 nt, Homo Sapiens
guagucuaauaaaguguaaaaguuacauuuacacuacacuacacugacucccucucaaaaaaaaa

SEQ ID NO: 179700 - RNA, 65 nt, Homo Sapiens
acacuguagucuaauaaaguaaaaaaguuacauuuacacuacacuagcgagacucccucucaaaa

SEQ ID NO: 179701 - RNA, 64 nt, Homo Sapiens; identical to SEQ ID NO: 118786

SEQ ID NO: 179702 - RNA, 64 nt, Homo Sapiens; identical to SEQ ID NO: 118787

SEQ ID NO: 179703 - RNA, 64 nt, Homo Sapiens; identical to SEQ ID NO: 118788

SEQ ID NO: 179704 - RNA, 64 nt, Homo Sapiens; identical to SEQ ID NO: 118789

SEQ ID NO: 179705 - RNA, 64 nt, Homo Sapiens; identical to SEQ ID NO: 118790

SEQ ID NO: 179706 - RNA, 53 nt, Homo Sapiens; identical to SEQ ID NO: 118791

SEQ ID NO: 179707 - RNA, 64 nt, Homo Sapiens; identical to SEQ ID NO: 97849

SEQ ID NO: 179708 - RNA, 64 nt, Homo Sapiens; identical to SEQ ID NO: 97850

SEQ ID NO: 179709 - RNA, 64 nt, Homo Sapiens; identical to SEQ ID NO: 97851

SEQ ID NO: 179710 - RNA, 64 nt, Homo Sapiens; identical to SEQ ID NO: 97852

SEQ ID NO: 179711 - RNA, 64 nt, Homo Sapiens; identical to SEQ ID NO: 97853

SEQ ID NO: 179712 - RNA, 64 nt, Homo Sapiens; identical to SEQ ID NO: 97854

SEQ ID NO: 179713 - RNA, 64 nt, Homo Sapiens; identical to SEQ ID NO: 97855

SEQ ID NO: 179714 - RNA, 64 nt, Homo Sapiens; identical to SEQ ID NO: 97856

SEQ ID NO: 179715 - RNA, 64 nt, Homo Sapiens; identical to SEQ ID NO: 97857

SEQ ID NO: 179716 - RNA, 64 nt, Homo Sapiens; identical to SEQ ID NO: 97858

SEQ ID NO: 179717 - RNA, 64 nt, Homo Sapiens; identical to SEQ ID NO: 97859

SEQ ID NO: 179718 - RNA, 64 nt, Homo Sapiens; identical to SEQ ID NO: 97860

SEQ ID NO: 179719 - RNA, 64 nt, Homo Sapiens; identical to SEQ ID NO: 97861

SEQ ID NO: 179720 - RNA, 64 nt, Homo Sapiens; identical to SEQ ID NO: 97862

SEQ ID NO: 179721 - RNA, 64 nt, Homo Sapiens; identical to SEQ ID NO: 97863

SEQ ID NO: 179722 - RNA, 64 nt, Homo Sapiens; identical to SEQ ID NO: 97864

SEQ ID NO: 179723 - RNA, 64 nt, Homo Sapiens; identical to SEQ ID NO: 97865

SEQ ID NO: 179724 - RNA, 64 nt, Homo Sapiens; identical to SEQ ID NO: 97866

SEQ ID NO: 179725 - RNA, 64 nt, Homo Sapiens; identical to SEQ ID NO: 97867

SEQ ID NO: 179726 - RNA, 64 nt, Homo Sapiens; identical to SEQ ID NO: 97868

SEQ ID NO: 179727 - RNA, 64 nt, Homo Sapiens; identical to SEQ ID NO: 97869

SEQ ID NO: 179728 - RNA, 64 nt, Homo Sapiens; identical to SEQ ID NO: 97870

SEQ ID NO: 179729 - RNA, 64 nt, Homo Sapiens; identical to SEQ ID NO: 97871

SEQ ID NO: 179730 - RNA, 64 nt, Homo Sapiens; identical to SEQ ID NO: 97872

SEQ ID NO: 179731 - RNA, 64 nt, Homo Sapiens; identical to SEQ ID NO: 97873

SEQ ID NO: 179732 - RNA, 64 nt, Homo Sapiens; identical to SEQ ID NO: 97874

SEQ ID NO: 179733 - RNA, 64 nt, Homo Sapiens; identical to SEQ ID NO: 97875

SEQ ID NO: 179734 - RNA, 64 nt, Homo Sapiens; identical to SEQ ID NO: 97876

SEQ ID NO: 179735 - RNA, 64 nt, Homo Sapiens; identical to SEQ ID NO: 97877

SEQ ID NO: 179736 - RNA, 64 nt, Homo Sapiens; identical to SEQ ID NO: 97878

SEQ ID NO: 179737 - RNA, 64 nt, Homo Sapiens; identical to SEQ ID NO: 97879

SEQ ID NO: 179738 - RNA, 64 nt, Homo Sapiens; identical to SEQ ID NO: 97880

SEQ ID NO: 179739 - RNA, 64 nt, Homo Sapiens; identical to SEQ ID NO: 97881

SEQ ID NO: 179740 - RNA, 64 nt, Homo Sapiens; identical to SEQ ID NO: 97882

SEQ ID NO: 179741 - RNA, 64 nt, Homo Sapiens; identical to SEQ ID NO: 97883

SEQ ID NO: 179742 - RNA, 64 nt, Homo Sapiens; identical to SEQ ID NO: 97884

SEQ ID NO: 179743 - RNA, 64 nt, Homo Sapiens; identical to SEQ ID NO: 97885

SEQ ID NO: 179744 - RNA, 64 nt, Homo Sapiens; identical to SEQ ID NO: 97886

SEQ ID NO: 179745 - RNA, 64 nt, Homo Sapiens; identical to SEQ ID NO: 97887

SEQ ID NO: 179746 - RNA, 64 nt, Homo Sapiens; identical to SEQ ID NO: 97888

SEQ ID NO: 179747 - RNA, 64 nt, Homo Sapiens; identical to SEQ ID NO: 97889

SEQ ID NO: 179748 - RNA, 64 nt, Homo Sapiens; identical to SEQ ID NO: 97890

SEQ ID NO: 179749 - RNA, 64 nt, Homo Sapiens; identical to SEQ ID NO: 97891

SEQ ID NO: 179750 - RNA, 64 nt, Homo Sapiens; identical to SEQ ID NO: 97892

SEQ ID NO: 179751 - RNA, 64 nt, Homo Sapiens; identical to SEQ ID NO: 97893

SEQ ID NO: 179752 - RNA, 64 nt, Homo Sapiens; identical to SEQ ID NO: 97894

SEQ ID NO: 179753 - RNA, 64 nt, Homo Sapiens; identical to SEQ ID NO: 97895

SEQ ID NO: 179754 - RNA, 64 nt, Homo Sapiens; identical to SEQ ID NO: 97896

SEQ ID NO: 179755 - RNA, 64 nt, Homo Sapiens; identical to SEQ ID NO: 97897

SEQ ID NO: 179756 - RNA, 64 nt, Homo Sapiens; identical to SEQ ID NO: 97898

SEQ ID NO: 179757 - RNA, 64 nt, Homo Sapiens; identical to SEQ ID NO: 97899

SEQ ID NO: 179758 - RNA, 64 nt, Homo Sapiens; identical to SEQ ID NO: 97900

SEQ ID NO: 179759 - RNA, 64 nt, Homo Sapiens; identical to SEQ ID NO: 97901

SEQ ID NO: 179760 - RNA, 64 nt, Homo Sapiens; identical to SEQ ID NO: 97902

SEQ ID NO: 179761 - RNA, 64 nt, Homo Sapiens; identical to SEQ ID NO: 97903

SEQ ID NO: 179762 - RNA, 64 nt, Homo Sapiens; identical to SEQ ID NO: 97904

SEQ ID NO: 179763 - RNA, 64 nt, Homo Sapiens; identical to SEQ ID NO: 97905

SEQ ID NO: 179764 - RNA, 64 nt, Homo Sapiens; identical to SEQ ID NO: 97906

SEQ ID NO: 179765 - RNA, 64 nt, Homo Sapiens; identical to SEQ ID NO: 97907

SEQ ID NO: 179766 - RNA, 64 nt, Homo Sapiens; identical to SEQ ID NO: 97908

SEQ ID NO: 179767 - RNA, 64 nt, Homo Sapiens; identical to SEQ ID NO: 97909

SEQ ID NO: 179768 - RNA, 64 nt, Homo Sapiens; identical to SEQ ID NO: 97910

SEQ ID NO: 179769 - RNA, 64 nt, Homo Sapiens; identical to SEQ ID NO: 97911

SEQ ID NO: 179770 - RNA, 64 nt, Homo Sapiens; identical to SEQ ID NO: 97912

SEQ ID NO: 179771 - RNA, 64 nt, Homo Sapiens; identical to SEQ ID NO: 97913

SEQ ID NO: 179772 - RNA, 64 nt, Homo Sapiens; identical to SEQ ID NO: 97914

SEQ ID NO: 179773 - RNA, 64 nt, Homo Sapiens; identical to SEQ ID NO: 97915

SEQ ID NO: 179774 - RNA, 64 nt, Homo Sapiens; identical to SEQ ID NO: 97916

SEQ ID NO: 179775 - RNA, 64 nt, Homo Sapiens; identical to SEQ ID NO: 97917

SEQ ID NO: 179776 - RNA, 64 nt, Homo Sapiens; identical to SEQ ID NO: 97918

SEQ ID NO: 179777 - RNA, 64 nt, Homo Sapiens; identical to SEQ ID NO: 97919

SEQ ID NO: 179778 - RNA, 64 nt, Homo Sapiens; identical to SEQ ID NO: 97920

SEQ ID NO: 179779 - RNA, 64 nt, Homo Sapiens; identical to SEQ ID NO: 97921

SEQ ID NO: 179780 - RNA, 64 nt, Homo Sapiens; identical to SEQ ID NO: 97922

SEQ ID NO: 179781 - RNA, 64 nt, Homo Sapiens; identical to SEQ ID NO: 97923

SEQ ID NO: 179782 - RNA, 64 nt, Homo Sapiens; identical to SEQ ID NO: 97924

SEQ ID NO: 179783 - RNA, 64 nt, Homo Sapiens; identical to SEQ ID NO: 97925

SEQ ID NO: 179784 - RNA, 64 nt, Homo Sapiens; identical to SEQ ID NO: 97926

SEQ ID NO: 179785 - RNA, 64 nt, Homo Sapiens; identical to SEQ ID NO: 97927

SEQ ID NO: 179786 - RNA, 64 nt, Homo Sapiens; identical to SEQ ID NO: 97928

SEQ ID NO: 179787 - RNA, 64 nt, Homo Sapiens; identical to SEQ ID NO: 97929

SEQ ID NO: 179788 - RNA, 64 nt, Homo Sapiens; identical to SEQ ID NO: 97930

SEQ ID NO: 179789 - RNA, 64 nt, Homo Sapiens; identical to SEQ ID NO: 97931

SEQ ID NO: 179790 - RNA, 64 nt, Homo Sapiens; identical to SEQ ID NO: 97932

SEQ ID NO: 179791 - RNA, 64 nt, Homo Sapiens; identical to SEQ ID NO: 97933

SEQ ID NO: 179792 - RNA, 64 nt, Homo Sapiens; identical to SEQ ID NO: 97934

SEQ ID NO: 179793 - RNA, 64 nt, Homo Sapiens; identical to SEQ ID NO: 97935

SEQ ID NO: 179794 - RNA, 64 nt, Homo Sapiens; identical to SEQ ID NO: 97936

SEQ ID NO: 179795 - RNA, 64 nt, Homo Sapiens; identical to SEQ ID NO: 97937

SEQ ID NO: 179796 - RNA, 64 nt, Homo Sapiens; identical to SEQ ID NO: 97938

SEQ ID NO: 179797 - RNA, 64 nt, Homo Sapiens; identical to SEQ ID NO: 97939

SEQ ID NO: 179798 - RNA, 64 nt, Homo Sapiens; identical to SEQ ID NO: 97940

SEQ ID NO: 179799 - RNA, 64 nt, Homo Sapiens; identical to SEQ ID NO: 97941

SEQ ID NO: 179800 - RNA, 64 nt, Homo Sapiens; identical to SEQ ID NO: 97942

SEQ ID NO: 179801 - RNA, 64 nt, Homo Sapiens; identical to SEQ ID NO: 97943

SEQ ID NO: 179802 - RNA, 64 nt, Homo Sapiens; identical to SEQ ID NO: 97944

SEQ ID NO: 179803 - RNA, 64 nt, Homo Sapiens; identical to SEQ ID NO: 97945

SEQ ID NO: 179804 - RNA, 64 nt, Homo Sapiens; identical to SEQ ID NO: 97946

SEQ ID NO: 179805 - RNA, 64 nt, Homo Sapiens; identical to SEQ ID NO: 97947

SEQ ID NO: 179806 - RNA, 64 nt, Homo Sapiens; identical to SEQ ID NO: 97948

SEQ ID NO: 179807 - RNA, 64 nt, Homo Sapiens; identical to SEQ ID NO: 97949

SEQ ID NO: 179808 - RNA, 64 nt, Homo Sapiens; identical to SEQ ID NO: 97950

SEQ ID NO: 179809 - RNA, 64 nt, Homo Sapiens; identical to SEQ ID NO: 97951

SEQ ID NO: 179810 - RNA, 64 nt, Homo Sapiens; identical to SEQ ID NO: 97952

SEQ ID NO: 179811 - RNA, 64 nt, Homo Sapiens; identical to SEQ ID NO: 97953

SEQ ID NO: 179812 - RNA, 64 nt, Homo Sapiens; identical to SEQ ID NO: 97954

SEQ ID NO: 179813 - RNA, 64 nt, Homo Sapiens; identical to SEQ ID NO: 97955

SEQ ID NO: 179814 - RNA, 64 nt, Homo Sapiens; identical to SEQ ID NO: 97956

SEQ ID NO: 179815 - RNA, 64 nt, Homo Sapiens
uccacagcccuagcugccagcaaugcuguccucacagaggcauagucgcccccagcuggguugu

SEQ ID NO: 179816 - RNA, 64 nt, Homo Sapiens
gcaggaucaugccuucugugucuggaagaggcggcagaggcaacaguguuuaggauuuggguua

SEQ ID NO: 179817 - RNA, 64 nt, Homo Sapiens
ugcgugagugugguggugugaccuucaggcugcacagaggcaaggacccagauguggcagcaug

SEQ ID NO: 179818 - RNA, 64 nt, Homo Sapiens
gccauccgugcggccuuggccacaucccuauuaacagaggcagcuccacuucagacagggacaa

SEQ ID NO: 179819 - RNA, 64 nt, Homo Sapiens
ucugucauuuucccuuccuaccccaacccugagccagaggcaucugacagcccuuucccagagg

SEQ ID NO: 179820 - RNA, 64 nt, Homo Sapiens
gggcagagcugggcggcauccacagccagagaggcagaggcaagagcagagccaggcugugccc

SEQ ID NO: 179821 - RNA, 64 nt, Homo Sapiens
ccacuuaaaggagaaaaauauuugggacuagcagcagaggcaguaagagaugugaaccuuggug

SEQ ID NO: 179822 - RNA, 64 nt, Homo Sapiens
caacgagaugagaagacugugauccucauguacucagaggcacuucccuccuaagucaaagacc

SEQ ID NO: 179823 - RNA, 64 nt, Homo Sapiens
cuuucccauucacuucucuagaaagcugccaagacagaggcagaaagaaauggaugauaguucu

SEQ ID NO: 179824 - RNA, 64 nt, Homo Sapiens
guuauuuauguacauagggacaaauuccacucagcagaggcaaugaauuuugaaguaacgaaug

SEQ ID NO: 179825 - RNA, 64 nt, Homo Sapiens
auuacugcauuguuugucacagaggaacuaaaaccagaggcauucugcuaauaaaugucaucca

SEQ ID NO: 179826 - RNA, 64 nt, Homo Sapiens
uccacagaaggggggcugccacucaaaaagauggcagaggcaaacuacaaaccauuagaaaaua

SEQ ID NO: 179827 - RNA, 64 nt, Homo Sapiens
agaggaccguggagcguuucugccugccugcgugcagaggcaggcacccaggagccccccaggc

SEQ ID NO: 179828 - RNA, 64 nt, Homo Sapiens
ugcuggcuuucaagcgugguuuuuugcuaagagccagaggcaggucuucuggaguucucagggg

SEQ ID NO: 179829 - RNA, 64 nt, Homo Sapiens
cgcacaggugggugauguccuuggcugcugccgucagaggcagcccccugcacagggaggggcu

SEQ ID NO: 179830 - RNA, 64 nt, Homo Sapiens
gccugaaccucgggcuccugcaggccccucuguccagaggcagggagcacccacccugguucuc

SEQ ID NO: 179831 - RNA, 64 nt, Homo Sapiens
gccacagcugugagggccaagggaccauggcccgcagaggcacuauugcucaggguggggggcu

SEQ ID NO: 179832 - RNA, 64 nt, Homo Sapiens
aaccuuugcggguggggcguuacugccaaaacuccagaggcaaaguggaccuggcaaccacaag

SEQ ID NO: 179833 - RNA, 64 nt, Homo Sapiens
cccuggaacauugggccugaguggagaugggagacagaggcaggccagaagguucucucugcac

SEQ ID NO: 179834 - RNA, 64 nt, Homo Sapiens
ggccuguggcagcgccgcuggacccuaggaggcucagaggcaguggugugggagcccugucugc

SEQ ID NO: 179835 - RNA, 64 nt, Homo Sapiens
guugaagaggcugacuuggcccacugcuaagcggcagaggcagggccagccauccugucgcaag

SEQ ID NO: 179836 - RNA, 64 nt, Homo Sapiens
ugcugcacacacaagcaucuuucacccagcaccacagaggcaccgcccccccugucgucugcuc

SEQ ID NO: 179837 - RNA, 64 nt, Homo Sapiens
gccuuugucugucuaucugggcucauuuaacccucagaggcagcuggggguuggaaggaugggg

SEQ ID NO: 179838 - RNA, 53 nt, Homo Sapiens; identical to SEQ ID NO: 86549

SEQ ID NO: 179839 - RNA, 64 nt, Homo Sapiens
ucucugcuggccuacagcuugucuguuucucaagcagaggcaggaagagcuagucuuagcauuu

SEQ ID NO: 179840 - RNA, 64 nt, Homo Sapiens
ccaaagggggagucccucgucucuugugacucagcagaggcaguggccacguucagggaggggc

SEQ ID NO: 179841 - RNA, 64 nt, Homo Sapiens
augccccccagcuacuguaugcccccgacccccgcagaggcagaaugaacccauagggagcuga

SEQ ID NO: 179842 - RNA, 64 nt, Homo Sapiens
agugggggaucagggaagguagggagguuggugucagaggcaggggagggcagaggaaguacuu

SEQ ID NO: 179843 - RNA, 64 nt, Homo Sapiens
gggcagugcaggggacucugaggcacaggcugggcagaggcacaacugaggggaacccugggac

SEQ ID NO: 179844 - RNA, 64 nt, Homo Sapiens
agaugaaggacaaaaggaaggcugcuguggggugcagaggcagagcugaggccauggcaggaca

SEQ ID NO: 179845 - RNA, 64 nt, Homo Sapiens
cucaggaccagagaagggaaaugacuucuccaggcagaggcagaucugagucuagaacccaggc

SEQ ID NO: 179846 - RNA, 64 nt, Homo Sapiens
gucagagaacagagaucacacacaccaaaccagacagaggcagggcagcauggagacagguaga

SEQ ID NO: 179847 - RNA, 64 nt, Homo Sapiens
uggcuccggggggaguggggcccugcgcuagaggcagaggcaguucuuuguucaagcguuccuc

SEQ ID NO: 179848 - RNA, 64 nt, Homo Sapiens
uucuuuguucaagcguuccucuggggaccggcagcagaggcaccguguucucucagcccuggau

SEQ ID NO: 179849 - RNA, 64 nt, Homo Sapiens
caguagcaagaaagcagagcaaaacaaacagaggcagaggcagguaagacaaaaaaaaaaaaaa

SEQ ID NO: 179850 - RNA, 64 nt, Homo Sapiens
ggcaggcaguagcaagaaagaaaaaaaaaacaaacagaggcagaaaaauguaagacaaaaaaaa

SEQ ID NO: 179851 - RNA, 64 nt, Homo Sapiens
gccagacuuuuccgucguuuccuccaagcuugcacagaggcaagguccacagcggcgacccagg

SEQ ID NO: 179852 - RNA, 64 nt, Homo Sapiens
gaggugggccccggcccuggcugggaguccccaucagaggcagugcacagcggagccauggggg

SEQ ID NO: 179853 - RNA, 64 nt, Homo Sapiens
ccuggcuccgcuguguggauggggagaucggggccagaggcagaacccuggugaggaagcucca

SEQ ID NO: 179854 - RNA, 64 nt, Homo Sapiens
acucgcuucucugugacugauguuaggcugggcccagaggcacagccggggccugccuagcacu

SEQ ID NO: 179855 - RNA, 64 nt, Homo Sapiens
gaugugucaaaggcuuuuggagugaccaaaagcacagaggcagcggguggggcgccuggguggu

SEQ ID NO: 179856 - RNA, 64 nt, Homo Sapiens
ugguccccaaggucgcugccacccuugcccggggcagaggcagaagcccacauaugcugugacg

SEQ ID NO: 179857 - RNA, 64 nt, Homo Sapiens
aggaucgcuugagcucaggaagcacuuugggaggcagaggcagguggcucacaccugucauccu

SEQ ID NO: 179858 - RNA, 64 nt, Homo Sapiens
cuccuggcaucgagugggugauuuuugguuggggcagaggcaugaucaggcaaggucuggagac

SEQ ID NO: 179859 - RNA, 64 nt, Homo Sapiens
aguuccuuuaaagcacaucucucagcaggagugacagaggcagaauggcacugagaugcaucca

SEQ ID NO: 179860 - RNA, 64 nt, Homo Sapiens
caacagacuuauacacuaagauuuaagaaucuuccagaggcaguaacccuuaaaguacaguguu

SEQ ID NO: 179861 - RNA, 64 nt, Homo Sapiens
cccagccucagaacccaggagucccucagaaucccagaggcagugccugcagggguggagggca

SEQ ID NO: 179862 - RNA, 64 nt, Homo Sapiens
ccgugggucucugucucaguggcucaggcaagcacagaggcagcggaaagacucuuaauuaaga

SEQ ID NO: 179863 - RNA, 64 nt, Homo Sapiens
guaauaaagcacuucagggccuggaaacuaagcucagaggcaaggcugcuucuaagaggcuaac

SEQ ID NO: 179864 - RNA, 64 nt, Homo Sapiens
ccugggaugccccaguuucuuuuggccacaggagcagaggcagaagagaaggaucugcuccgcc

SEQ ID NO: 179865 - RNA, 64 nt, Homo Sapiens
acuaggaucagggacagaucgaugauggaccccucagaggcaagaggucugggggacagacaag

SEQ ID NO: 179866 - RNA, 64 nt, Homo Sapiens
aggcagccaggcagggugggcuacccagcugggccagaggcacggcagcuaugcaaaucccuac

SEQ ID NO: 179867 - RNA, 64 nt, Homo Sapiens
cuggagugaugcggccacaaaggacacguggagacagaggcagaagacacagacacagagcagg

SEQ ID NO: 179868 - RNA, 64 nt, Homo Sapiens
gacugaagugaugcugccccaggccacauaaagacagaggcagaagacacagacacaaagcagg

SEQ ID NO: 179869 - RNA, 64 nt, Homo Sapiens
ggugaggaagggucuccaggccucccaggcacugcagaggcaccaagggucuccaggcuuuauu

SEQ ID NO: 179870 - RNA, 64 nt, Homo Sapiens; identical to SEQ ID NO: 155489

SEQ ID NO: 179871 - RNA, 64 nt, Homo Sapiens; identical to SEQ ID NO: 155490

SEQ ID NO: 179872 - RNA, 64 nt, Homo Sapiens; identical to SEQ ID NO: 155491

SEQ ID NO: 179873 - RNA, 64 nt, Homo Sapiens; identical to SEQ ID NO: 155492

SEQ ID NO: 179874 - RNA, 64 nt, Homo Sapiens; identical to SEQ ID NO: 155493

SEQ ID NO: 179875 - RNA, 64 nt, Homo Sapiens; identical to SEQ ID NO: 155494

SEQ ID NO: 179876 - RNA, 64 nt, Homo Sapiens; identical to SEQ ID NO: 155495

SEQ ID NO: 179877 - RNA, 64 nt, Homo Sapiens; identical to SEQ ID NO: 155496

SEQ ID NO: 179878 - RNA, 64 nt, Homo Sapiens; identical to SEQ ID NO: 155497

SEQ ID NO: 179879 - RNA, 64 nt, Homo Sapiens; identical to SEQ ID NO: 155498

SEQ ID NO: 179880 - RNA, 64 nt, Homo Sapiens; identical to SEQ ID NO: 155499

SEQ ID NO: 179881 - RNA, 64 nt, Homo Sapiens; identical to SEQ ID NO: 155500

SEQ ID NO: 179882 - RNA, 64 nt, Homo Sapiens; identical to SEQ ID NO: 155501

SEQ ID NO: 179883 - RNA, 64 nt, Homo Sapiens; identical to SEQ ID NO: 155502

SEQ ID NO: 179884 - RNA, 64 nt, Homo Sapiens; identical to SEQ ID NO: 155503

SEQ ID NO: 179885 - RNA, 64 nt, Homo Sapiens; identical to SEQ ID NO: 155504

SEQ ID NO: 179886 - RNA, 64 nt, Homo Sapiens; identical to SEQ ID NO: 155505

SEQ ID NO: 179887 - RNA, 64 nt, Homo Sapiens; identical to SEQ ID NO: 155506

SEQ ID NO: 179888 - RNA, 64 nt, Homo Sapiens; identical to SEQ ID NO: 155507

SEQ ID NO: 179889 - RNA, 64 nt, Homo Sapiens; identical to SEQ ID NO: 155508

SEQ ID NO: 179890 - RNA, 64 nt, Homo Sapiens; identical to SEQ ID NO: 155509

SEQ ID NO: 179891 - RNA, 64 nt, Homo Sapiens; identical to SEQ ID NO: 155510

SEQ ID NO: 179892 - RNA, 64 nt, Homo Sapiens; identical to SEQ ID NO: 155511

SEQ ID NO: 179893 - RNA, 64 nt, Homo Sapiens; identical to SEQ ID NO: 155512

SEQ ID NO: 179894 - RNA, 64 nt, Homo Sapiens; identical to SEQ ID NO: 155513

SEQ ID NO: 179895 - RNA, 61 nt, Homo Sapiens; identical to SEQ ID NO: 155514

SEQ ID NO: 179896 - RNA, 64 nt, Homo Sapiens; identical to SEQ ID NO: 155515

SEQ ID NO: 179897 - RNA, 64 nt, Homo Sapiens; identical to SEQ ID NO: 155516

SEQ ID NO: 179898 - RNA, 64 nt, Homo Sapiens; identical to SEQ ID NO: 155517

SEQ ID NO: 179899 - RNA, 64 nt, Homo Sapiens; identical to SEQ ID NO: 155518

SEQ ID NO: 179900 - RNA, 64 nt, Homo Sapiens; identical to SEQ ID NO: 155519

SEQ ID NO: 179901 - RNA, 64 nt, Homo Sapiens; identical to SEQ ID NO: 155520

SEQ ID NO: 179902 - RNA, 64 nt, Homo Sapiens; identical to SEQ ID NO: 155521

SEQ ID NO: 179903 - RNA, 64 nt, Homo Sapiens; identical to SEQ ID NO: 73323

SEQ ID NO: 179904 - RNA, 64 nt, Homo Sapiens; identical to SEQ ID NO: 73324

SEQ ID NO: 179905 - RNA, 64 nt, Homo Sapiens; identical to SEQ ID NO: 73325

SEQ ID NO: 179906 - RNA, 64 nt, Homo Sapiens; identical to SEQ ID NO: 73326

SEQ ID NO: 179907 - RNA, 64 nt, Homo Sapiens; identical to SEQ ID NO: 73327

SEQ ID NO: 179908 - RNA, 64 nt, Homo Sapiens; identical to SEQ ID NO: 73328

SEQ ID NO: 179909 - RNA, 64 nt, Homo Sapiens; identical to SEQ ID NO: 73329

SEQ ID NO: 179910 - RNA, 64 nt, Homo Sapiens; identical to SEQ ID NO: 73330

SEQ ID NO: 179911 - RNA, 64 nt, Homo Sapiens; identical to SEQ ID NO: 73331

SEQ ID NO: 179912 - RNA, 64 nt, Homo Sapiens; identical to SEQ ID NO: 73332

SEQ ID NO: 179913 - RNA, 64 nt, Homo Sapiens; identical to SEQ ID NO: 73333

SEQ ID NO: 179914 - RNA, 64 nt, Homo Sapiens; identical to SEQ ID NO: 73334

SEQ ID NO: 179915 - RNA, 64 nt, Homo Sapiens; identical to SEQ ID NO: 73335

SEQ ID NO: 179916 - RNA, 64 nt, Homo Sapiens; identical to SEQ ID NO: 73336

SEQ ID NO: 179917 - RNA, 64 nt, Homo Sapiens; identical to SEQ ID NO: 73337

SEQ ID NO: 179918 - RNA, 64 nt, Homo Sapiens; identical to SEQ ID NO: 73338

SEQ ID NO: 179919 - RNA, 64 nt, Homo Sapiens; identical to SEQ ID NO: 73339

SEQ ID NO: 179920 - RNA, 64 nt, Homo Sapiens; identical to SEQ ID NO: 73340

SEQ ID NO: 179921 - RNA, 64 nt, Homo Sapiens; identical to SEQ ID NO: 73341

SEQ ID NO: 179922 - RNA, 64 nt, Homo Sapiens; identical to SEQ ID NO: 73342

SEQ ID NO: 179923 - RNA, 64 nt, Homo Sapiens; identical to SEQ ID NO: 73343

SEQ ID NO: 179924 - RNA, 64 nt, Homo Sapiens; identical to SEQ ID NO: 73344

SEQ ID NO: 179925 - RNA, 64 nt, Homo Sapiens
aauauagccgcugccauaguuuucuaacuugaacagccaugaauguuucaugucucccuuuuuu

SEQ ID NO: 179926 - RNA, 64 nt, Homo Sapiens
ggauugcuugagccugggaagcugaggcugcaguagccaugacugcaccacugcauuccagccu

SEQ ID NO: 179927 - RNA, 64 nt, Homo Sapiens
ccuccuacacuauugaccaggcccagaaggaaccagccaugagguucggcacccaggucuccgg

SEQ ID NO: 179928 - RNA, 64 nt, Homo Sapiens
cugguccccaggccccuccaguucaucggaauucagccaugaaacugacucaucagugagcagg

SEQ ID NO: 179929 - RNA, 64 nt, Homo Sapiens
gaccuucguuaagugauaauuguccuggccucucagccaugaccguuaugaggaaauauccccc

SEQ ID NO: 179930 - RNA, 64 nt, Homo Sapiens
ugaggugggagccugggaggucaaggcugcagugagccaugaucaugccacugcacuccauccu

SEQ ID NO: 179931 - RNA, 64 nt, Homo Sapiens
cuucacccucccugccuaagcagggugggggcagagccaugacauuuuugguuuaaaggagccu

SEQ ID NO: 179932 - RNA, 64 nt, Homo Sapiens
ggucauauaguugggccauggggcaauuguuggcagccaugacugacggccccuugugcaagcu

SEQ ID NO: 179933 - RNA, 64 nt, Homo Sapiens
uuguucuaaagaugucuuaacugcuuagaaauguagccaugaugccuuuguuauguuguuauga

SEQ ID NO: 179934 - RNA, 64 nt, Homo Sapiens
ccccuggcacuaguaccagcagagggacaaacacagccaugaacgucagugacagagaacacag

SEQ ID NO: 179935 - RNA, 64 nt, Homo Sapiens
cuuugagacuauucaucaagaaugaggauauaguagccaugacauagcuugagcuauagccuuu

SEQ ID NO: 179936 - RNA, 64 nt, Homo Sapiens
uugaagagguucugauuuucuuguaaccugggaaagccaugaccuugugcccgauucuuucaga

SEQ ID NO: 179937 - RNA, 64 nt, Homo Sapiens
gcagagcaauugaguauucuuuuuuaaauuauuaagccaugauuuacaaaaacauuacuuucug

SEQ ID NO: 179938 - RNA, 64 nt, Homo Sapiens
gucaggaucauagaaaagaagacaaagcuugcucagccaugagauggccagguauccaguuuug

SEQ ID NO: 179939 - RNA, 64 nt, Homo Sapiens
caccaugaccaacguguuucggugcugggauuacagccaugagccagccguauuggccucccaa

SEQ ID NO: 179940 - RNA, 64 nt, Homo Sapiens
augccauuguacuccagcauucgaggcugcagggagccaugaucgauggcuugagccuaggagu

SEQ ID NO: 179941 - RNA, 64 nt, Homo Sapiens
ccuccuucuggccucccuuggauggguuacauggagccaugaaauauuuuuuuccaguagcaac

SEQ ID NO: 179942 - RNA, 64 nt, Homo Sapiens
uuaaucacauucugcaagguuugcuggcucugggagccaugauuauaacacauuggcagacuuu

SEQ ID NO: 179943 - RNA, 64 nt, Homo Sapiens
acagcuugcuugcauuuagucaugguuuguguguagccaugaacgggugcuauaugcagacuuc

SEQ ID NO: 179944 - RNA, 64 nt, Homo Sapiens
uguauuuauauuguauaucauacuuucaacuguagacaauuaugaugcuaauuuauuguuucuu

SEQ ID NO: 179945 - RNA, 64 nt, Homo Sapiens
aacgguucuaucaugcauguguaauguggauggagacaauuauaagauuugacuauaacuauuu

SEQ ID NO: 179946 - RNA, 64 nt, Homo Sapiens
uuugggacugauucucaguggagggcuuagaucauacaaaaaucuuuauuggguccguguguuc

SEQ ID NO: 179947 - RNA, 64 nt, Homo Sapiens
gcuuuuaaacuggugucuuuggaaggaagguagauacaaaaagauugugguaaaaacugggguc

SEQ ID NO: 179948 - RNA, 64 nt, Homo Sapiens
uuauuuguuuuugagauggagucucuacuaaaaauacaaaaaauuagccaggcauggugccgca

SEQ ID NO: 179949 - RNA, 64 nt, Homo Sapiens
ggccaauauggugaaaccccaucucuacuaagaauacaaaaaauuagcugagcauggugguggg

SEQ ID NO: 179950 - RNA, 64 nt, Homo Sapiens
gaccagccgggccaacauggugaaaccccaucucuacaaaaaauacaaaaauuagccuggcaua

SEQ ID NO: 179951 - RNA, 64 nt, Homo Sapiens
ggccaacauggugaaaccccaucucuacaaaaaauacaaaaauuagccuggcauauggcgggua

SEQ ID NO: 179952 - RNA, 64 nt, Homo Sapiens
ugagaugcgccugggcaacauagaaaccugugucuacaaaaaauuuaaaaauuagccaaguaug

SEQ ID NO: 179953 - RNA, 64 nt, Homo Sapiens
ggcuaacacggugaaacuccaucucuacuaaaaauacaaaaaauuggccgggcgcagcggcuca

SEQ ID NO: 179954 - RNA, 64 nt, Homo Sapiens
ggccaacauggugacaccccgucucuacuaaaaauacaaaaauuacccaggcauaguggcacac

SEQ ID NO: 179955 - RNA, 64 nt, Homo Sapiens
ucugucucaaaaaaacaaaacaaacaaacaaaaauacaaaaaauuagccgggcgugguggcacc

SEQ ID NO: 179956 - RNA, 64 nt, Homo Sapiens
gggcaacauggugaaacccccgucucuacuaaaauacaaaaaaauuagccaggcauaguggcgc

SEQ ID NO: 179957 - RNA, 64 nt, Homo Sapiens
ggccaacauagugaaaccccuuguuuacucaaaauacaaaaauuggcugggugcggugguacau

SEQ ID NO: 179958 - RNA, 64 nt, Homo Sapiens
cagccuggccaacaugacccaucuuuacuaaaaauacaaaaauuagccaggcgugguggugugc

SEQ ID NO: 179959 - RNA, 64 nt, Homo Sapiens
aauuuguaaacccugucucucauauuuguaaaacuacaaaaauuagcuuggcaugguggugugc

SEQ ID NO: 179960 - RNA, 64 nt, Homo Sapiens
ccacacccggcuaauuuuuuguguuuuuacaaaauacaaaaaaguagagacaggauuucacugu

SEQ ID NO: 179961 - RNA, 64 nt, Homo Sapiens
uggugauaaguuccaaauauguuaagggcuuuaauacaaaaagcaaaaauugucaguguuugga

SEQ ID NO: 179962 - RNA, 64 nt, Homo Sapiens
uagcugggcgugguggcaggguuuuuacuaaaaguacaaaaaacuggcuaacacagugaaacgu

SEQ ID NO: 179963 - RNA, 64 nt, Homo Sapiens
auuagccagccaugguggcggucucuacuaaaaauacaaaaaaaggcuaacauggugaaacccu

SEQ ID NO: 179964 - RNA, 64 nt, Homo Sapiens
uuagccaggcguggucguggucuacuaaaaaaaauacaaaaaaagaacacggugaaaccccguc

SEQ ID NO: 179965 - RNA, 64 nt, Homo Sapiens
agccuggcaugguggugggaaucucuacuaaaaauacaaaaauugaccaacauggcgaaacccc

SEQ ID NO: 179966 - RNA, 64 nt, Homo Sapiens
agcuaaagcugccacagaaguguagcaaagccaauacaaaaaucuuuguucuuuuacagaauuc

SEQ ID NO: 179967 - RNA, 64 nt, Homo Sapiens
agccaggcaugguggugcauguguuuacaaaaaauacaaaaauugggcaauguggcaaaaccgc

SEQ ID NO: 179968 - RNA, 64 nt, Homo Sapiens
acaaaaauuagccaggcaugcaaaaccgcguguuuacaaaaaaugacuagccugggcaaugugg

SEQ ID NO: 179969 - RNA, 64 nt, Homo Sapiens
agccgggcgugguccuagcugucucuacaaaaaauacaaaaauugggcaacguggcgaaacccu

SEQ ID NO: 179970 - RNA, 64 nt, Homo Sapiens
acaaaaauuagccgggcgugcgaaacccugucucuacaaaaaauuacuagccugggcaacgugg

SEQ ID NO: 179971 - RNA, 64 nt, Homo Sapiens
agucgggcgugauggcaggcaccucuacaaaaaguacaaaaauugggcaacauggcaaaaaccc

SEQ ID NO: 179972 - RNA, 64 nt, Homo Sapiens
acaaaaauuagucgggcgugcaaaaacccaccucuacaaaaagugaccagccugggcaacaugg

SEQ ID NO: 179973 - RNA, 64 nt, Homo Sapiens
agccaggcgugguggcgggcguaucugcuaaaaauacaaaaauuggcuaacauggugaaacccu

SEQ ID NO: 179974 - RNA, 64 nt, Homo Sapiens
ggcugggcgugguggcacuccaucucuacuaaaauacaaaaauuugaccaacaugguaaaaccc

SEQ ID NO: 179975 - RNA, 64 nt, Homo Sapiens
uaccugggccugguggcacacaguuuuguaaaaauacaaaaaauauggugaaaccccaucucua

SEQ ID NO: 179976 - RNA, 64 nt, Homo Sapiens
uuuuccauuuccguuauuauaaauggaauuuauauacaaaaauauuuaauuuuacuuaauuaag

SEQ ID NO: 179977 - RNA, 64 nt, Homo Sapiens
agccgggugugguggugggugccucuacuaaaaauacaaaaauuggccaacauggugaaaccug

SEQ ID NO: 179978 - RNA, 64 nt, Homo Sapiens
acuucaugaaauauaguuugaagaaaaauuauuuuacaaaaauucuuuacugugucuguagcua

SEQ ID NO: 179979 - RNA, 64 nt, Homo Sapiens
uguaaauauugcuuuauuacuauuuuuguucuuauacaaaaacauuaacaacuuuuuaaggaaa

SEQ ID NO: 179980 - RNA, 64 nt, Homo Sapiens
guucaaccuaaaacaaucuguauagauauaacuguacaaaaauuuaaguaaauuaguaauguac

SEQ ID NO: 179981 - RNA, 64 nt, Homo Sapiens
uagccgagcacgguggugcaaucucuacuaaaaauacaaaaaauggcuaacauggugaaacccc

SEQ ID NO: 179982 - RNA, 64 nt, Homo Sapiens
auuaucaggccaaaauuuguucugaagauuguguuacaaaaaauuucaguaacacaucucauga

SEQ ID NO: 179983 - RNA, 64 nt, Homo Sapiens
auuggaguucaauuagugguacaguauucuaauuuacaaaaagagaugaggcaaugaugccacc

SEQ ID NO: 179984 - RNA, 64 nt, Homo Sapiens
aauagcggauagagcuacagguguucaguaagacuacaaaaacauuuugccuauuucgcuaaca

SEQ ID NO: 179985 - RNA, 64 nt, Homo Sapiens
uguuauuuuacaucccuauggcuauugccaaggcuacaaaaaaggaaagcuauauuuguaugca

SEQ ID NO: 179986 - RNA, 64 nt, Homo Sapiens
gaccagccugggcaacauggugaaaccccaucucuacaaaaaauuuuuaaaaaguuggccaggc

SEQ ID NO: 179987 - RNA, 64 nt, Homo Sapiens
ggccaacauggugaaacccugucuuuacuaaaaauacaaaaauuagccaggcaugguggcgugu

SEQ ID NO: 179988 - RNA, 64 nt, Homo Sapiens
uaauaggguaguucuggagagaugguaugcagcauacaaaaauauauuaaaaauauaaacaaug

SEQ ID NO: 179989 - RNA, 64 nt, Homo Sapiens
aaauaugcuaaauguuagcaagaugauuuuuaaguacaaaaaaguuuaagauugcaaggaagga

SEQ ID NO: 179990 - RNA, 64 nt, Homo Sapiens
gaguucuagacuagccugggcgagacuucaucucuacaaaaaaagcaacaacgacaaaaaaaau

SEQ ID NO: 179991 - RNA, 64 nt, Homo Sapiens
guccaaucugggcaacauggggaaaccccagcucuacaaaaaaaauuagccuggugugguggca

SEQ ID NO: 179992 - RNA, 64 nt, Homo Sapiens
acacuagaaagcaaugacuaacauuuaauuuguuuacaaaaauguuuauugucuucaguacaaa

SEQ ID NO: 179993 - RNA, 64 nt, Homo Sapiens
uuaauuuguuuacaaaaauguuuauugucuucaguacaaaaaguuaaaaccaugauuggauuca

SEQ ID NO: 179994 - RNA, 64 nt, Homo Sapiens
gaaaacacaaaaguaacuuguuuaucucagucuguacaaaaacaguaaggaggcagaaagccaa

SEQ ID NO: 179995 - RNA, 64 nt, Homo Sapiens
uaucaguguuggauuuaguuccaacuacuugauuuacaaaaauguacauuuagagguuaaaaga

SEQ ID NO: 179996 - RNA, 64 nt, Homo Sapiens
ggccaacauggugaaacccuguugcuacuaaaaauacaaaaauuggcuggguguggugucacau

SEQ ID NO: 179997 - RNA, 64 nt, Homo Sapiens
ugaauaaucucaauuauauugaacacauugagacuacaaaaauaaauuaaagagacaaccaagg

SEQ ID NO: 179998 - RNA, 64 nt, Homo Sapiens
augcacaacagaaauaucuagauucuuacuaacauacaaaaauaauguaaauggaaauacaaag

SEQ ID NO: 179999 - RNA, 64 nt, Homo Sapiens
agccagguguggagguacaugucucuacuaaaaauacaaaaauuggccaacauggugaaacccu

SEQ ID NO: 180000 - RNA, 64 nt, Homo Sapiens
uagccaggcgugguggcacggucucuacuaaaaauacaaaaaauggcuaacauggugaaacccc

SEQ ID NO: 180001 - RNA, 64 nt, Homo Sapiens
agccgggagugguggugcguaccucuauuaaaaauacaaaaauucgccaacaaggugaaacccc

SEQ ID NO: 180002 - RNA, 64 nt, Homo Sapiens
aggccggguacaguggcucaaucucuacuaaaaauacaaaaauuggccaauaugaugaaacccc

SEQ ID NO: 180003 - RNA, 64 nt, Homo Sapiens
gaaugaguuaaaccauuuaaacacauuugaaacauacaaaaauagaaaugugaaagcauuuggu

SEQ ID NO: 180004 - RNA, 64 nt, Homo Sapiens
ggccaacauagugaaaccccaucucuacugaaaauacaaaaauuagcugggugugguggcacgu

SEQ ID NO: 180005 - RNA, 64 nt, Homo Sapiens
ugaccaacauggugaaaccccaucucuacuaaaauacaaaaauuauccgggcaugggggcacac

SEQ ID NO: 180006 - RNA, 64 nt, Homo Sapiens
cugaaaaaauaaaguucaucccaacuuucaagucuacaaaaacauaauccaaaucuaauaacau

SEQ ID NO: 180007 - RNA, 64 nt, Homo Sapiens
gaccagccuggccaacauggugaaaccccgucucuacaaaaauacaaaaauuagccaggcguga

SEQ ID NO: 180008 - RNA, 64 nt, Homo Sapiens
uggccaacauggugaaaccccgucucuacaaaaauacaaaaauuagccaggcgugauggcaggu

SEQ ID NO: 180009 - RNA, 64 nt, Homo Sapiens
gacuaacauggugaaaucccgucucuacuaaaaauacaaaaaaaaaaaaaaaaaaaagccaggc

SEQ ID NO: 180010 - RNA, 64 nt, Homo Sapiens
ggccaacauggugaaauccugccucuacuaaaaauacaaaaaaaaaaaaaaauuagcugggcau

SEQ ID NO: 180011 - RNA, 64 nt, Homo Sapiens
ucacagucugagcaacauggcaaaacccugugucuacaaaaaauaaaaaauuagcugggcauga

SEQ ID NO: 180012 - RNA, 64 nt, Homo Sapiens
ggaagaaaagcaauuauuucauuucagauagaaauacaaaaaaaaaaaaaauacuuuucuuaga

SEQ ID NO: 180013 - RNA, 64 nt, Homo Sapiens
gaccagccugggcaacauagugagacuccgucucuacaaaaaauaaauuuagcugggcauggug

SEQ ID NO: 180014 - RNA, 64 nt, Homo Sapiens
ccuggauacaauuaaccauuuuauauuugccaccuacaaaaaaacacccaauaucuucucuugu

SEQ ID NO: 180015 - RNA, 64 nt, Homo Sapiens
ggucaacauggugaaauccugucucuacuaaaaauacaaaaauuagcugggcaugguggcacau

SEQ ID NO: 180016 - RNA, 64 nt, Homo Sapiens
guauauacuuuuaaauuauggaguauuuuaagucuacaaaaagguauaaauaauaauauaauga

SEQ ID NO: 180017 - RNA, 64 nt, Homo Sapiens
caccagccugggcaacauagugagaccuugucucuacaaaaaauaaaauaaaauaaaaaccaaa

SEQ ID NO: 180018 - RNA, 64 nt, Homo Sapiens
agaugggugugguguuucgcgucucuacaaaaaguacaaaaauugggcaacauggcaagaccuu

SEQ ID NO: 180019 - RNA, 64 nt, Homo Sapiens
acaaaaauuagaugggugugcaagaccuugucucuacaaaaagugaccagccugggcaacaugg

SEQ ID NO: 180020 - RNA, 64 nt, Homo Sapiens
uuauaauuacuauacuugugaaaugaacucacaguacaaaaauuguucucaagaauuauaagag

SEQ ID NO: 180021 - RNA, 64 nt, Homo Sapiens
uggcaaauucaauaaacucaaaaccacuguuauguacaaaaaaacaaggggaacuugggaccag

SEQ ID NO: 180022 - RNA, 64 nt, Homo Sapiens
uuagcugggagugguggcauauuucuacuaaaaauacaaaaaaaggccaacauggcgaaacccc

SEQ ID NO: 180023 - RNA, 64 nt, Homo Sapiens
ugccccaacuacaguuugcaggaccagaccucucuacaaaaaauggucucugacggugggucca

SEQ ID NO: 180024 - RNA, 64 nt, Homo Sapiens
aaaaaaaaagaaaucaagcacuauauauguuccuuacaaaaaaaaaaaggggaauucucuuuuc

SEQ ID NO: 180025 - RNA, 64 nt, Homo Sapiens
augaaguacuuuuuuuauuuuuugguuuuuauuauacaaaaaccuuaguuuaaaaugucacuuu

SEQ ID NO: 180026 - RNA, 64 nt, Homo Sapiens
auuugcccauuccuauucuacuuguuauucauuauacaaaaaguugaaaguugccuuugagaag

SEQ ID NO: 180027 - RNA, 64 nt, Homo Sapiens
uucugaaaaauuaccugggcggagacccuaucccuacaaaaaaugaucagccuaggcaacauag

SEQ ID NO: 180028 - RNA, 64 nt, Homo Sapiens
uugguuuagcauugaugggcuauuuuuguagaaauacaaaaaguuuuguagcucuaugugcauc

SEQ ID NO: 180029 - RNA, 64 nt, Homo Sapiens
acuuuccguacauuaguggucaaaacccugucucuacaaaaaaugaccagccugggcaacauag

SEQ ID NO: 180030 - RNA, 64 nt, Homo Sapiens
uguacacaaauauuuauagcaaggggcuggucaauacaaaaacugccuuguguaguuaaaaauu

SEQ ID NO: 180031 - RNA, 64 nt, Homo Sapiens
gagcaauguggugaaaccccaucucuacuaaaaauacaaaaauuaucugggcuugguggcgggc

SEQ ID NO: 180032 - RNA, 64 nt, Homo Sapiens
uggguguauaccuauguuaaugaaacaacagaaguacaaaaaagaauaucagauacaaaaauca

SEQ ID NO: 180033 - RNA, 64 nt, Homo Sapiens
augaaacaacagaaguacaaaaaagaauaucagauacaaaaaucaaucgugaagaaaaucuguu

SEQ ID NO: 180034 - RNA, 64 nt, Homo Sapiens
gaccaccuuggcgaacacggugaaaccccgucucuacaaaaaauacaaaaauuagccaggcgug

SEQ ID NO: 180035 - RNA, 64 nt, Homo Sapiens
ggcgaacacggugaaaccccgucucuacaaaaaauacaaaaauuagccaggcgugguggcacgu

SEQ ID NO: 180036 - RNA, 64 nt, Homo Sapiens
uaccgacccacguccugcugucucugugugguccuacaaaaacuguccauucccaccccuuugc

SEQ ID NO: 180037 - RNA, 64 nt, Homo Sapiens
ggccaacauggugaaaccccaucucuacuaaaaauacaaaaauuagccggacgcaguggcacgc

SEQ ID NO: 180038 - RNA, 64 nt, Homo Sapiens
ggccaacauggugaaacccugucucuacuaaaaauacaaaaaugagcugggcaugguggggcgu

SEQ ID NO: 180039 - RNA, 64 nt, Homo Sapiens
ggagagguuuuuuuuuuuaauuuuucccccuuuauacaaaaaaaaaagaacauuuccaaaacua

SEQ ID NO: 180040 - RNA, 64 nt, Homo Sapiens
ggccaacaugaugaaaccuugucuuuacuaaaaauacaaaaauuagcugggcaugguggcaggc

SEQ ID NO: 180041 - RNA, 64 nt, Homo Sapiens
ggccagcaugguaaaacccugucuccacuaaaaauacaaaaauuagccaggcaugguggcgggc

SEQ ID NO: 180042 - RNA, 64 nt, Homo Sapiens
ggccaacauggugaaacccugucucuacuaaaaauacaaaaauuagcugggugugguggugugu

SEQ ID NO: 180043 - RNA, 64 nt, Homo Sapiens
agccuauaaauguguuucacuaccaauuaugguauacaaaaauaaguauugagggggcaaaaau

SEQ ID NO: 180044 - RNA, 64 nt, Homo Sapiens
aauuuguauucaauauuguccauaagaaaaccaauacaaaaaacgggucacuuugaauugugca

SEQ ID NO: 180045 - RNA, 64 nt, Homo Sapiens
agccaggcgugguggcgcaugucucuacuaaaaguacaaaaauugaccaacauggugaaacccu

SEQ ID NO: 180046 - RNA, 64 nt, Homo Sapiens
uuuuuguagacuguaguuuaaaugaaugcauuuuuacaaaaaccugcauuuauuuauuaucaga

SEQ ID NO: 180047 - RNA, 64 nt, Homo Sapiens
aggaugaucucauuuggaaauccuuaauuucaucuacaaaaacuguuuucccaaauaggucaca

SEQ ID NO: 180048 - RNA, 64 nt, Homo Sapiens
gggcaacauggcgaaaccccauuucuacuaaaaauacaaaaauuagcuggggcgaggggauagg

SEQ ID NO: 180049 - RNA, 64 nt, Homo Sapiens
gaccagccugggcaacauggugaaacccugucgguacaaaaaaauacaaaaauuugccuguuua

SEQ ID NO: 180050 - RNA, 64 nt, Homo Sapiens
ggcaacauggugaaacccugucgguacaaaaaaauacaaaaauuugccuguuuaugguggugug

SEQ ID NO: 180051 - RNA, 64 nt, Homo Sapiens
ggccaacauggugaaacuucaucucuacuaaaaauacaaaaacuagccaggugugguucuccau

SEQ ID NO: 180052 - RNA, 64 nt, Homo Sapiens
ggucuacauggugaaaccccaucucaacuaaaaauacaaaaaauacaaaaaauuagccgggcgc

SEQ ID NO: 180053 - RNA, 64 nt, Homo Sapiens
ggugaaaccccaucucaacuaaaaauacaaaaaauacaaaaaauuagccgggcgcgguggcuca

SEQ ID NO: 180054 - RNA, 64 nt, Homo Sapiens
ggccaacauggugaaacccugucucuauuaaaaauacaaaaauuagcugggcgugguggcgcau

SEQ ID NO: 180055 - RNA, 64 nt, Homo Sapiens
gaccagccuggccaauauggugaaacccugucucuacaaaaaauacaaaaauuagcugggcaug

SEQ ID NO: 180056 - RNA, 64 nt, Homo Sapiens
ggccaauauggugaaacccugucucuacaaaaaauacaaaaauuagcugggcaugguggugcgu

SEQ ID NO: 180057 - RNA, 64 nt, Homo Sapiens
ugugugguaguauuuuguuggaagagaauguuuauacaaaaaaugaaauucuuccaacagcaga

SEQ ID NO: 180058 - RNA, 64 nt, Homo Sapiens
ggcuaacacugugaaaccccgucucuacuaaaaauacaaaaaauuagcggggcaugguggcacg

SEQ ID NO: 180059 - RNA, 64 nt, Homo Sapiens
aguucuuuaagcauuauuuuaaacacuauauugauacaaaaauaucuugcuuacucuaaacuuu

SEQ ID NO: 180060 - RNA, 64 nt, Homo Sapiens
ggcuaacauggugaaacccugccucuacuaaaaauacaaaaaaaaacaaaauuagccgggcgug

SEQ ID NO: 180061 - RNA, 64 nt, Homo Sapiens
gaccagccuggucaacaugucaaaacccuguaccuacaaaaaaauacaaaaguuaaccaagccu

SEQ ID NO: 180062 - RNA, 64 nt, Homo Sapiens
uuagccgggcgugguggugcgucucuacuaaaaauacaaaaauagaccaacauggagaaacccc

SEQ ID NO: 180063 - RNA, 64 nt, Homo Sapiens
gaaagguugaaucuguggcgauguucuguaaaguuacaaaaauaguuuccacauguaacugguu

SEQ ID NO: 180064 - RNA, 64 nt, Homo Sapiens
agcugggugugguggcauguaacucuacuaaaaauacaaaaauuggcccacauggugagacccc

SEQ ID NO: 180065 - RNA, 64 nt, Homo Sapiens
uugguuuaaguuauggaguuucacugauaguuuuuacaaaaagcgaugcacgcacauuuguuuu

SEQ ID NO: 180066 - RNA, 64 nt, Homo Sapiens
agccaggugugauggugggugucucuacuaaaaauacaaaaauuggccaauguggugaaacccu

SEQ ID NO: 180067 - RNA, 64 nt, Homo Sapiens
auuucccugagaaagggaauuaugaaauuuuuaauacaaaaaauaauccauuuaggugcugagu

SEQ ID NO: 180068 - RNA, 64 nt, Homo Sapiens
gaccaauauggugaaaccccaucucuacuaaaauuacaaaaaaaauuauccaggcgugguggug

SEQ ID NO: 180069 - RNA, 64 nt, Homo Sapiens
ggccaacauggugaaaccccaucucuacuaaaaauacaaaaaauuagcugggcaugcacuugua

SEQ ID NO: 180070 - RNA, 64 nt, Homo Sapiens
uggcaugguggaauaaccaaaauguguaucauucuacaaaaaaauaggccuggacuauuuaagg

SEQ ID NO: 180071 - RNA, 64 nt, Homo Sapiens
ggcuaacauagugagacccuguuucuacuaaaaauacaaaaauaagccaggugugguggugcau

SEQ ID NO: 180072 - RNA, 64 nt, Homo Sapiens
ggccaacauggcaaaacuccgucucugcaaaaaauacaaaaaugagcccgguauguuggcauau

SEQ ID NO: 180073 - RNA, 64 nt, Homo Sapiens
aaaacguuugugcaucugucacucucguguaguuuacaaaaaucgugucucuuauucaguaaga

SEQ ID NO: 180074 - RNA, 64 nt, Homo Sapiens
cauuaguagcuguccuggcccacuuaaacaagguuacaaaaaaucagagucggaagcagccaaa

SEQ ID NO: 180075 - RNA, 64 nt, Homo Sapiens
aauauaugaacauuagaaaaauagcaacuuguguuacaaaaauacaaacacauguuaggaaggu

SEQ ID NO: 180076 - RNA, 64 nt, Homo Sapiens
uggccaacauggcgaaaccccucucuacuaaaaauacaaaaauuugccaggcgugguggcgggu

SEQ ID NO: 180077 - RNA, 64 nt, Homo Sapiens
uuaaaaauuauccagguguacgagacugcaucucuacaaaaaaugacuagccugggcaacauag

SEQ ID NO: 180078 - RNA, 64 nt, Homo Sapiens
agccgggcgugguggugggccucuacuaaaauaguacaaaaauuccaacaugguuaaaccccgu

SEQ ID NO: 180079 - RNA, 64 nt, Homo Sapiens
acaauauaauuuucacaugaccuagaacaaaauguacaaaaagauugaaagugaaaauuauguu

SEQ ID NO: 180080 - RNA, 64 nt, Homo Sapiens
uuuuucauacaaaugguuaaucugcuuuuuauuuuacaaaaauaucaaauguuuuucuucugga

SEQ ID NO: 180081 - RNA, 64 nt, Homo Sapiens
agcugggugugguggcgggcugucucuacaaaaauacaaaaauuuggccaacauggugaaaccc

SEQ ID NO: 180082 - RNA, 64 nt, Homo Sapiens
caaaaauuagcuggguguggugaaacccugucucuacaaaaauagaccagccuggccaacaugg

SEQ ID NO: 180083 - RNA, 64 nt, Homo Sapiens
agcugggcaugguggggcaugucucuacuaaaaauacaaaaauuggccaacauggugaaacccc

SEQ ID NO: 180084 - RNA, 64 nt, Homo Sapiens
cacaggguguguuggcacacaucucuacuaaaaauacaaaaauuggccaacauggcaaaauccc

SEQ ID NO: 180085 - RNA, 64 nt, Homo Sapiens
uagcugggcaugguggugcgcaucucuauuaaaauacaaaaaauugggcaacacggugaaaccc

SEQ ID NO: 180086 - RNA, 64 nt, Homo Sapiens
aacucaagauggauuaaagauuccuuaugccauauacaaaaauuaaagauugaaaauggacgcc

SEQ ID NO: 180087 - RNA, 64 nt, Homo Sapiens
gaccauccugggcaacauggcgaaacccuaucucuacaaaaaauacaaaaauuagccagacaug

SEQ ID NO: 180088 - RNA, 64 nt, Homo Sapiens
gggcaacauggcgaaacccuaucucuacaaaaaauacaaaaauuagccagacaugguggcacau

SEQ ID NO: 180089 - RNA, 64 nt, Homo Sapiens
aacuggaugugaugguguguucuuuacaaaaaaauacaaaaauuaccaacaucgugaaaugccg

SEQ ID NO: 180090 - RNA, 64 nt, Homo Sapiens
uacaaaaauuaacuggauguugaaaugccgucuuuacaaaaaaagaccagccugaccaacaucg

SEQ ID NO: 180091 - RNA, 64 nt, Homo Sapiens
aaugucaauuuauggaguuuaaauauccccuucuuacaaaaagaaaggacucaaguguagaaga

SEQ ID NO: 180092 - RNA, 64 nt, Homo Sapiens
auuuuggaauaagcauuguuaaagaacuacuagcuacaaaaaauuauuuucuuuaccuccaagg

SEQ ID NO: 180093 - RNA, 64 nt, Homo Sapiens
guacaagauaaguuccaccucuuuauaaaacauguacaaaaauuacuaugcauuaaaucuugaa

SEQ ID NO: 180094 - RNA, 64 nt, Homo Sapiens
aaacccuuauacucaccugcuaagguuguuaauguacaaaaaaauaacuuaauauacuagaugu

SEQ ID NO: 180095 - RNA, 64 nt, Homo Sapiens
aaauaaaauaauaaaaaaaguuccaaacucauauuacaaaaacauuuuggauaaagaauacuau

SEQ ID NO: 180096 - RNA, 64 nt, Homo Sapiens
aaauuaaucauagucaccugguaagggaaauauauacaaaaagaaauuggcaaaacuauuauau

SEQ ID NO: 180097 - RNA, 64 nt, Homo Sapiens
aguacuaguuuugcuuuaaaaugcuauguaaauauacaaaaaaacuagaaagaaauauauauaa

SEQ ID NO: 180098 - RNA, 64 nt, Homo Sapiens
ggcuaaugcguugaaacuccgucucuacuaaaaauacaaaaaauuagcugggcguggugguggg

SEQ ID NO: 180099 - RNA, 64 nt, Homo Sapiens
uggccaacauggugaaacccuucucuacugaaaauacaaaaauuagccaggugugguggcgcau

SEQ ID NO: 180100 - RNA, 64 nt, Homo Sapiens
ggcuaauauggugaaaccucgucucuacuaaaaauacaaaaauuagcugggcaugguggugcgu

SEQ ID NO: 180101 - RNA, 64 nt, Homo Sapiens
acuaaagguaaagauguuuacagauuacuuuucuuacaaaaaaaaucuagaagacacuguguuu

SEQ ID NO: 180102 - RNA, 64 nt, Homo Sapiens
aauaaacaaaucguaucaguguuugugaauaaaauacaaaaaugauuguuaaugauuggugcuc

SEQ ID NO: 180103 - RNA, 64 nt, Homo Sapiens
cuuuuaaggacuugagauaacuaauuuguuuauauacaaaaauuaauguuacuguguuacuuaa

SEQ ID NO: 180104 - RNA, 64 nt, Homo Sapiens
cugagauacccgauucuauauguaaaagcuaauauacaaaaaagcagauuaaauuacaugauaa

SEQ ID NO: 180105 - RNA, 64 nt, Homo Sapiens
ggccaacauggggaaaccccgucucuacuaaaaauacaaaaauuagccgggcaugguggugggc

SEQ ID NO: 180106 - RNA, 64 nt, Homo Sapiens
ggccaauguggugaaaccccaucucuacuaaaaauacaaaaauuagcugggcgugguggugcau

SEQ ID NO: 180107 - RNA, 64 nt, Homo Sapiens
guugauaagacaaguuuagaauugguuuacuuaauacaaaaaaaaaaaaaagaauuucaaaaaa

SEQ ID NO: 180108 - RNA, 64 nt, Homo Sapiens
accuguaguuucauuaccuuuuugaauaaugucauacaaaaaauguauuuguuuuuuugugcug

SEQ ID NO: 180109 - RNA, 64 nt, Homo Sapiens
ggccaacacggugaaaccccgccucuacuaaaaauacaaaaaauagccgggugugguggugggc

SEQ ID NO: 180110 - RNA, 64 nt, Homo Sapiens
acaaaacauagugaaaccccgucucuacuaaaaauacaaaaauuagcugggcgugguggugggu

SEQ ID NO: 180111 - RNA, 64 nt, Homo Sapiens
ggucaacauggugaaacccccuaucuacuaaaaauacaaaaaauuagcugggcaugguggcaug

SEQ ID NO: 180112 - RNA, 64 nt, Homo Sapiens
caggagaacuuacucaaguugguaaagaacauacuacaaaaaacccuacagcuaacauuauccu

SEQ ID NO: 180113 - RNA, 64 nt, Homo Sapiens
ggccaacaugaugaaacccugucucuacuaaaaauacaaaaauuagccgggcaugguggugcac

SEQ ID NO: 180114 - RNA, 64 nt, Homo Sapiens
gagaccagccugggcaacauggcacaauugucucuacaaaaaauacaaaaauuagccaggcaug

SEQ ID NO: 180115 - RNA, 64 nt, Homo Sapiens
cugggcaacauggcacaauugucucuacaaaaaauacaaaaauuagccaggcaugguggcaugc

SEQ ID NO: 180116 - RNA, 64 nt, Homo Sapiens
gaagaaugaaacuagacccccaucucuuagcauauacaaaaaucaaaauuaauuaaaaaguuaa

SEQ ID NO: 180117 - RNA, 64 nt, Homo Sapiens
ggccgacauggugaaacucagucucuauugaaaauacaaaaauuagcucagugugguggcacac

SEQ ID NO: 180118 - RNA, 64 nt, Homo Sapiens
ggccaacauggugaaaccuugucucuacuaaaacuacaaaaaaaauuagccaggcgugguggcg

SEQ ID NO: 180119 - RNA, 64 nt, Homo Sapiens
gaguuuugagaccagccugggaaacaucugucucuacaaaaaaauacaaaaauuagcugggcau

SEQ ID NO: 180120 - RNA, 64 nt, Homo Sapiens
accagccugggaaacaucugucucuacaaaaaaauacaaaaauuagcugggcauaguggugcau

SEQ ID NO: 180121 - RNA, 64 nt, Homo Sapiens
aauagccagguguggggugcaaaauaaauuuaaauacaaaaaaacucugccucaaaaaaaaauu

SEQ ID NO: 180122 - RNA, 64 nt, Homo Sapiens
uagggcugggcgcgguugcuugucucuacuaaaauacaaaaaaauggccaacguggugaaacgc

SEQ ID NO: 180123 - RNA, 64 nt, Homo Sapiens
ccuacaucuagcaucauccuugauaaagaacuacuacaaaaaacacaggagaacuuacucaauu

SEQ ID NO: 180124 - RNA, 64 nt, Homo Sapiens
uagccgggcgugguggcauggcgguggcuaaaaauacaaaaaguauaaccuuccaagaccaggc

SEQ ID NO: 180125 - RNA, 64 nt, Homo Sapiens
ggccaacaaggugaaacccugucucuacuaaaaauacaaaaaauuagccaggcaugguggugcg

SEQ ID NO: 180126 - RNA, 64 nt, Homo Sapiens
caaagaauuguuaaauguucuuaaauguucucacuacaaaaaaagaaaaaagauaacuacguga

SEQ ID NO: 180127 - RNA, 64 nt, Homo Sapiens
aggaguucgugaccagccugggcaacccugucucuacaaaaaauacaaaaauuaaccaggcaug

SEQ ID NO: 180128 - RNA, 64 nt, Homo Sapiens
ugaccagccugggcaacccugucucuacaaaaaauacaaaaauuaaccaggcaugguggcaugc

SEQ ID NO: 180129 - RNA, 64 nt, Homo Sapiens
ggccaacauggugaaacccugucucuacuaaaaauacaaaaauagcugggcaugguggcacgca

SEQ ID NO: 180130 - RNA, 64 nt, Homo Sapiens
ggguaauauggcaagagcccaacucuacuaaaaauacaaaaagaaaagaaaacagccaagcuug

SEQ ID NO: 180131 - RNA, 64 nt, Homo Sapiens
caaaaaagaaaagaaauuuacaaaaaagugucuuuacaaaaaaacugggcuaaaucuacuguuu

SEQ ID NO: 180132 - RNA, 64 nt, Homo Sapiens
aaacaaucaaaaaaaaagacaacauuuacagaguuacaaaaaacuacaagagacucaaaucuaa

SEQ ID NO: 180133 - RNA, 64 nt, Homo Sapiens
agccgggugugguggugggcgucucuacuaaaaauacaaaaauuggccaauauggugaaacccu

SEQ ID NO: 180134 - RNA, 64 nt, Homo Sapiens
cacuuuugggcugggcgcagagaaaauaauuuuuuacaaaaaguuauuuaucuucuuuuagugu

SEQ ID NO: 180135 - RNA, 64 nt, Homo Sapiens
uauaaagaauaccaugaugacaacauuuaaggcauacaaaaacacuuaaaacguuuuuauugug

SEQ ID NO: 180136 - RNA, 64 nt, Homo Sapiens
aguaaaccuugauuucugcuucaaguaccaggaguacaaaaauaacuaugcacuaggcauggua

SEQ ID NO: 180137 - RNA, 64 nt, Homo Sapiens
ggcuaacaaggcgaaauccugucuguacuaaaaauacaaaaaucagccagacaugguggcaugc

SEQ ID NO: 180138 - RNA, 64 nt, Homo Sapiens
cgccaacauggugaaaccguaucucuaauaaaaauacaaaaauuagcugggcauggugcgggca

SEQ ID NO: 180139 - RNA, 64 nt, Homo Sapiens
cccaaagcauauaaucucuauuuuaaaaaaaugcuacaaaaagcaaugggaucuguacaacuga

SEQ ID NO: 180140 - RNA, 64 nt, Homo Sapiens
agcugggcgugguggcacguaucucuacuaaaaauacaaaaauuggccaacauggugaaacccc

SEQ ID NO: 180141 - RNA, 64 nt, Homo Sapiens
uuaaaaaauuagccaggcaucaagaccccaucucuacaaaaaaagaccgacaugggcaacauga

SEQ ID NO: 180142 - RNA, 64 nt, Homo Sapiens
gaagcaagccagacaugguguuugaauuuuagaauacaaaaagaagggauuugauacuuaggcc

SEQ ID NO: 180143 - RNA, 64 nt, Homo Sapiens
auuuggauguuuuccagcauuuagccaaauuccauacaaaaagagguuugagcacuggguucuu

SEQ ID NO: 180144 - RNA, 64 nt, Homo Sapiens
uuuuuuguaacaguuauuuuucccauuacaaaaauacaaaaauauaccauuguuauagguaaaa

SEQ ID NO: 180145 - RNA, 64 nt, Homo Sapiens
caaaaauauuuuuuguaacaagguaaaaucccauuacaaaaauaugagcuuuuaccauuguuau

SEQ ID NO: 180146 - RNA, 64 nt, Homo Sapiens
uaguuguggucaaguaguuuugaaagcagucaguuacaaaaaggggaauuaaacacaaagaacu

SEQ ID NO: 180147 - RNA, 64 nt, Homo Sapiens
uagccaggcgugguggugggucucuacuaaaaaauacaaaaaaugcuaacagggugaaacccug

SEQ ID NO: 180148 - RNA, 64 nt, Homo Sapiens
ugugaaguucauuuaaaaaaacaauuugaaagaauacaaaaauagcuucuuuuauauauagcaa

SEQ ID NO: 180149 - RNA, 64 nt, Homo Sapiens
cuuuaaaaaaaauggcagcaaaauaaaaaaccccuacaaaaaaaaaaaagaaaaaaaacacaaa

SEQ ID NO: 180150 - RNA, 64 nt, Homo Sapiens
accacucuugaacuuugagguguauaaacaauuguacaaaaaaagauuuuaccuuuguugaauu

SEQ ID NO: 180151 - RNA, 64 nt, Homo Sapiens
agggcuuuuauuuuccauuugaggggagagacuuuacaaaaaugaaauacggggcgggcucugg

SEQ ID NO: 180152 - RNA, 64 nt, Homo Sapiens
gcuuggccaaggugauaaaacccgucucuacuaauacaaaaaaaauuagcuggguauguuggug

SEQ ID NO: 180153 - RNA, 64 nt, Homo Sapiens
ggccaacauggcgaaaccccaucucuacuaaaaauacaaaaauuagccgggcgugguggcuuac

SEQ ID NO: 180154 - RNA, 64 nt, Homo Sapiens
cuuaauuuugauuuaaaaacaaaaaaucguaaaauacaaaaaccaguuaauguuuuguagaccc

SEQ ID NO: 180155 - RNA, 64 nt, Homo Sapiens
uuuguagacccugggaaaagaauuuucagcaaaguacaaaaauuuaaagcauuccuuuaauuuu

SEQ ID NO: 180156 - RNA, 64 nt, Homo Sapiens
ggcauaccuuauauuuguaucauucuuuaaaguuuacaaaaaaaaaccuuauguuuuuauguaa

SEQ ID NO: 180157 - RNA, 64 nt, Homo Sapiens
guuuaaaaauaggaccauguaugagacacuuuuuuacaaaaagugccguauauacauauguaac

SEQ ID NO: 180158 - RNA, 64 nt, Homo Sapiens
aaaaauaugucugggcauggcaaaaccccaucucuacaaaaauagaccagccugggcaacauag

SEQ ID NO: 180159 - RNA, 64 nt, Homo Sapiens
agcugggcgugguggcaugcgucucuacuaaaaauacaaaaauuggccaacauggugaaacccc

SEQ ID NO: 180160 - RNA, 64 nt, Homo Sapiens
uguuuuuacaucauaaugcauuguacaaaaucuguacaaaaaucaaagguuauuacgaauuuug

SEQ ID NO: 180161 - RNA, 64 nt, Homo Sapiens
aaaaaaguuuucuccauugaaaguuuaaguauucuacaaaaaaauguguauuaauguucuuuaa

SEQ ID NO: 180162 - RNA, 64 nt, Homo Sapiens
cauucuccaaagauaguauuaguugauuuauaaauacaaaaauaugaaugagacaguuuuuaaa

SEQ ID NO: 180163 - RNA, 64 nt, Homo Sapiens
uagcuggguguaacggcggagucucuacuaaaaauacaaaaacuggccaacaugguaaaacgcc

SEQ ID NO: 180164 - RNA, 64 nt, Homo Sapiens
gaccagccugggcaacauggcaaaaccccaucucuacaaaaaauacaaaaaguaggccgggcac

SEQ ID NO: 180165 - RNA, 64 nt, Homo Sapiens
gggcaacauggcaaaaccccaucucuacaaaaaauacaaaaaguaggccgggcacggugguuca

SEQ ID NO: 180166 - RNA, 64 nt, Homo Sapiens
ggccaacaugguggaacccaaucucuacuaaaaauacaaaaaaacuagccggauaugguggcgg

SEQ ID NO: 180167 - RNA, 64 nt, Homo Sapiens
ggccaacauggugcaaccucgucuuuacuaaaaauacaaaaacaaaaauuagccagggguggug

SEQ ID NO: 180168 - RNA, 64 nt, Homo Sapiens
auguauaauuaucuauuuguuuuggacuauauguuacaaaaauuuaaaacauaagauccucucu

SEQ ID NO: 180169 - RNA, 64 nt, Homo Sapiens
uuagccggguaugaugguguaucucuacaaaaaauacaaaaaaagggcaacauggugaagcccc

SEQ ID NO: 180170 - RNA, 64 nt, Homo Sapiens
acaaaaaaauuagccggguaugaagccccaucucuacaaaaaaugaccagccugggcaacaugg

SEQ ID NO: 180171 - RNA, 64 nt, Homo Sapiens
auacgaucacucaguguguguuuaauccuuuauauacaaaaaaaaauguauuaaauuggaauuu

SEQ ID NO: 180172 - RNA, 64 nt, Homo Sapiens
aaaaaauuguuuagugaauauacaaaaguagccuuacaaaaaaaacaaagggaaaacaaaaagc

SEQ ID NO: 180173 - RNA, 64 nt, Homo Sapiens
agcuggguguggugguaugugucucuauuaaaaauacaaaaauuggccaacauagugaaacccc

SEQ ID NO: 180174 - RNA, 64 nt, Homo Sapiens
cgggcguggugggcgccugugucucuacuaaaaauacaaaaagcggccaacauggcaaaacccc

SEQ ID NO: 180175 - RNA, 64 nt, Homo Sapiens
uaaaaaucagccaggcgucgagagacccugucucuacaaaaauaugaccagccuggucuuuugu

SEQ ID NO: 180176 - RNA, 64 nt, Homo Sapiens
gugguacguugguuccugcccugccaacaauuuguacaaaaaauaucuucugucccuuuaagaa

SEQ ID NO: 180177 - RNA, 64 nt, Homo Sapiens
aauagaaaaugguaauaguucccacuuuuuuuguuacaaaaaguuuuuccuauuacaaaaaacu

SEQ ID NO: 180178 - RNA, 64 nt, Homo Sapiens
ucccacuuuuuuuguuacaaacauuuuuuccuauuacaaaaaacaguuaguuaaaaaaaaacaa

SEQ ID NO: 180179 - RNA, 64 nt, Homo Sapiens
uagccagguguagggguagggucuguacaaaaaauacaaaaaaugggcaacauggcaaaacgca

SEQ ID NO: 180180 - RNA, 64 nt, Homo Sapiens
acaaaaaauuagccaggugucaaaacgcagucuguacaaaaaaugaccagccugggcaacaugg

SEQ ID NO: 180181 - RNA, 64 nt, Homo Sapiens
agcugggcaugguggcaugcgucucuacaaaaaauacaaaaauuggccaacauggugaaacccc

SEQ ID NO: 180182 - RNA, 64 nt, Homo Sapiens
acaaaaauuagcugggcaugugaaaccccgucucuacaaaaaaugaccagccuggccaacaugg

SEQ ID NO: 180183 - RNA, 64 nt, Homo Sapiens
cuguugcaccacucuaguuuaauucagugcaaguuacaaaaauuucuaacauuuguauaaauag

SEQ ID NO: 180184 - RNA, 64 nt, Homo Sapiens
gaaauguauaaacaugucaauuauucuauauuauuacaaaaacgucagugauauaaagcauauu

SEQ ID NO: 180185 - RNA, 64 nt, Homo Sapiens
gacuagccugggcaacauagcgagaccucgucucuacaaaaaaaaauuaaaaagggggcuuugg

SEQ ID NO: 180186 - RNA, 64 nt, Homo Sapiens
uggccaacauggugaaaccccgucucuacuaaaauacaaaaaauuagcugggcaugguggcgca

SEQ ID NO: 180187 - RNA, 64 nt, Homo Sapiens
gaccaacuuggugaaaucccaucucuacuaaaaauacaaaaauuagcugggugcaguggcgcau

SEQ ID NO: 180188 - RNA, 64 nt, Homo Sapiens
aagacaauccuggccaacggcgaaacucugucucuacaaaaaauauacaggcguguuagcaugu

SEQ ID NO: 180189 - RNA, 64 nt, Homo Sapiens
ggccagccugggcaacauggcaaaaccccauuucuacaaaaaauacaaaaauuagcugggcaug

SEQ ID NO: 180190 - RNA, 64 nt, Homo Sapiens
gggcaacauggcaaaaccccauuucuacaaaaaauacaaaaauuagcugggcaugguggcaccc

SEQ ID NO: 180191 - RNA, 64 nt, Homo Sapiens
uugaaaggcauugugggucugucuuuaaaguguuuacaaaaaaaaauuauauaaaaaaaaaguc

SEQ ID NO: 180192 - RNA, 64 nt, Homo Sapiens
augcaagauagguuucuguauuuauauauuaaaauacaaaaaaaaacuuauaaaauguuuaaaa

SEQ ID NO: 180193 - RNA, 64 nt, Homo Sapiens
agcugggcgugguggcgugcgucucuauuaaaaauacaaaaauuggcaaacauggugaaacccc

SEQ ID NO: 180194 - RNA, 64 nt, Homo Sapiens
agcuggacguguagucccagcaucuuuacaaaaauacaaaaauuaaggcaacauagugaggccc

SEQ ID NO: 180195 - RNA, 64 nt, Homo Sapiens
caaaaauuagcuggacguguugaggccccaucuuuacaaaaauagaccagccaaggcaacauag

SEQ ID NO: 180196 - RNA, 64 nt, Homo Sapiens
agccgggcaugguggaaugugucucuccuaaaaauacaaaaauuggccaguauggugaaacccu

SEQ ID NO: 180197 - RNA, 64 nt, Homo Sapiens
agccaggcaggguggugcaugucucuacaaaaaauacaaaaauucagccuggggaacacauccu

SEQ ID NO: 180198 - RNA, 64 nt, Homo Sapiens
acaaaaauuagccaggcaggacacauccugucucuacaaaaaauggucgagaccagccugggga

SEQ ID NO: 180199 - RNA, 64 nt, Homo Sapiens
gucuaacacggugaaaccccaucucuacuaaaaauacaaaaaaauuagucggacaugguggcag

SEQ ID NO: 180200 - RNA, 64 nt, Homo Sapiens
ggccaacauggugaaaccccaucucuacuaaaaauacaaaaauuagcuaggcgggguagugcau

SEQ ID NO: 180201 - RNA, 64 nt, Homo Sapiens
uuuuuuuaguucaccgagcaugagaccguaucacuacaaaaaagaaccagccugggcaauauag

SEQ ID NO: 180202 - RNA, 64 nt, Homo Sapiens
uuagucgggcgugguggcgggucucuacuaaaaauacaaaaaaaggcuaacacggugaaacccc

SEQ ID NO: 180203 - RNA, 64 nt, Homo Sapiens
uagccaggcgugguggugggaucuuuacuaaaaauacaaaaaacggccaacauggugaaacccc

SEQ ID NO: 180204 - RNA, 64 nt, Homo Sapiens
agccgggcgugguggcccacaaaaaaaaaaaaaauacaaaaauugacuccgucucaaaaaaaaa

SEQ ID NO: 180205 - RNA, 64 nt, Homo Sapiens
uagccgggcgugguagcgggaucucuacuaaaaauacaaaaaauggccaacaugaugaaacccc

SEQ ID NO: 180206 - RNA, 64 nt, Homo Sapiens
uuccccaggcuggacguggucacacagcagcaguuacaaaaaccuugaagggcccagauucuac

SEQ ID NO: 180207 - RNA, 64 nt, Homo Sapiens
ugaguauucuuuuuuaaauuauuaagccaugauuuacaaaaacauuacuuucuguaauucacaa

SEQ ID NO: 180208 - RNA, 64 nt, Homo Sapiens
gcagccugugaaucuccacaaaguguuaccaguuuacaaaaauaagucuuuuugccuuaaguca

SEQ ID NO: 180209 - RNA, 64 nt, Homo Sapiens
gaccagccugggcagcauggugaaacccuguaucuacaaaaaauacaaaaauuagccaggcaug

SEQ ID NO: 180210 - RNA, 64 nt, Homo Sapiens
gggcagcauggugaaacccuguaucuacaaaaaauacaaaaauuagccaggcaugguggugggu

SEQ ID NO: 180211 - RNA, 64 nt, Homo Sapiens
gcuauaucaagggcuggcaccaggaggauguucuuacaaaaauagauuuaacuaacccaaaguc

SEQ ID NO: 180212 - RNA, 64 nt, Homo Sapiens
gauuuaaaaaauccuaccgacuuggaaauaguuuuacaaaaaugagugaaagggcuuaaaauuu

SEQ ID NO: 180213 - RNA, 64 nt, Homo Sapiens
ggccaacauggugaaaccucaucucuacuaaaaauacaaaaauuagccaggcgugguggcaggu

SEQ ID NO: 180214 - RNA, 64 nt, Homo Sapiens
ggugaacauggcgaaaccccgucucuaauaaaaauacaaaaauuagccgggcaugguggugcau

SEQ ID NO: 180215 - RNA, 64 nt, Homo Sapiens
uggcuaacacgugaaaccccgucucuacuaaaaauacaaaaaauuagccgggcgugguggcggg

SEQ ID NO: 180216 - RNA, 64 nt, Homo Sapiens
accaggccugagcaacaaagcgagaucccaucucuacaaaaaccaaaaaguuaaaaaucagcug

SEQ ID NO: 180217 - RNA, 64 nt, Homo Sapiens
gagcaacaugguaaaaccccaucucuaccaaaaauacaaaaauuagcugggcuugguggcuggc

SEQ ID NO: 180218 - RNA, 64 nt, Homo Sapiens
ggcuaacauggugaaauccuaucucuaccaaaaauacaaaaauuagccaggcgugguggugggc

SEQ ID NO: 180219 - RNA, 64 nt, Homo Sapiens
ggccaacauggugaaacccugucucuacuaaaaauacaaaaauuaucugggugugguggcacgu

SEQ ID NO: 180220 - RNA, 64 nt, Homo Sapiens
gagugagacuccgucucaaaaaaaauuuauacuguacaaaaaccccacaagugugaaaaacaug

SEQ ID NO: 180221 - RNA, 64 nt, Homo Sapiens
aacuucaaaaaaguuucaggauacaaaaucuguguacaaaaauuaguugcauuucuauacacca

SEQ ID NO: 180222 - RNA, 64 nt, Homo Sapiens
ggauauugaaacuggaccccuauccuucacgauauacaaaaaucaacucaagauggauuaaaga

SEQ ID NO: 180223 - RNA, 64 nt, Homo Sapiens
ccuugaacgcccauuagugcuauguuauagaaccuacaaaaaagaaauggaacaaauguagugg

SEQ ID NO: 180224 - RNA, 64 nt, Homo Sapiens
gcagaacucgcguuagaaacacagauauuuguuuuacaaaaagggagauuuuuccuuuguuaaa

SEQ ID NO: 180225 - RNA, 64 nt, Homo Sapiens
aaccagccuggguaacauggcaaaauccugucuuuacaaaaaauacaaaaauuagccuagcaug

SEQ ID NO: 180226 - RNA, 64 nt, Homo Sapiens
ggguaacauggcaaaauccugucuuuacaaaaaauacaaaaauuagccuagcaugguggcgcau

SEQ ID NO: 180227 - RNA, 64 nt, Homo Sapiens
ggcuaauauggugaaacccugucucuacuaaaaauacaaaaaaauuagcuaggcaugguggcgg

SEQ ID NO: 180228 - RNA, 64 nt, Homo Sapiens
cacagaaucuuauauugaacaaaauuugaacauauacaaaaauauuaaaacuuucuaucaugaa

SEQ ID NO: 180229 - RNA, 64 nt, Homo Sapiens
uagcaacagagcgcgauuccaucucuacuaaaaauacaaaaaauggccaacauggugaaaccuc

SEQ ID NO: 180230 - RNA, 64 nt, Homo Sapiens
acccgauuaaaagauucugucugacaauuccuaauacaaaaaugauucaaaauauguuaaauuu

SEQ ID NO: 180231 - RNA, 64 nt, Homo Sapiens
aaauccaacuaaagaccagauacuuuauaucauauacaaaaauaggagaaaaauuuuagcuuuc

SEQ ID NO: 180232 - RNA, 64 nt, Homo Sapiens
caagaagauacaggaauucuauagugagcauucauacaaaaaucauaaaucaagcaguaguaag

SEQ ID NO: 180233 - RNA, 64 nt, Homo Sapiens
agccgggcaugguggugcacaucucuacuaaaaauacaaaaauuggccaacaugaugaaacccu

SEQ ID NO: 180234 - RNA, 64 nt, Homo Sapiens
aaaaaaaauuagccaggcgcaucucuacuaaaaauacaaaaaccggcuaacacggugaaacccc

SEQ ID NO: 180235 - RNA, 64 nt, Homo Sapiens
uuagccgggugcgguggcgggucucuacuaaaaauacaaaaaaaggcuaacacggugaaacccc

SEQ ID NO: 180236 - RNA, 64 nt, Homo Sapiens
agcugagugugguggcacauaucucuacaaaaaauacaaaaauugggcaacauggugagacccc

SEQ ID NO: 180237 - RNA, 64 nt, Homo Sapiens
acaaaaauuagcugagugugugagaccccaucucuacaaaaaaugaccagccugggcaacaugg

SEQ ID NO: 180238 - RNA, 64 nt, Homo Sapiens
uagccaggcgugguugugggaucucuacuaaaaauacaaaaaauggcuaacacggugaaacccc

SEQ ID NO: 180239 - RNA, 64 nt, Homo Sapiens
acauaaauuagcugggcauugaaaccaccuucucuacaaaaaauaccagccugggcagaauggu

SEQ ID NO: 180240 - RNA, 64 nt, Homo Sapiens
uagccgggcaugguagcaggcuaaaaaaaaaaauuacaaaaaauguggagaaaccccgucucua

SEQ ID NO: 180241 - RNA, 64 nt, Homo Sapiens
acuugacgucauaaccuuaauaauuauugauuuguacaaaaaucucuuuuuucaaucaucacag

SEQ ID NO: 180242 - RNA, 64 nt, Homo Sapiens
gaccagccuagccaacauggugaaaccccgucucuacaaaaaauacaaaaauuagccggguggg

SEQ ID NO: 180243 - RNA, 64 nt, Homo Sapiens
agccaacauggugaaaccccgucucuacaaaaaauacaaaaauuagccgggugggacacgccug

SEQ ID NO: 180244 - RNA, 64 nt, Homo Sapiens
uagccggguuccaucaccugguuucuacaaaaaauacaaaaaaugggcaacauggugaaaccca

SEQ ID NO: 180245 - RNA, 64 nt, Homo Sapiens
acaaaaaauuagccggguucugaaacccaguuucuacaaaaaaugaccagccugggcaacaugg

SEQ ID NO: 180246 - RNA, 64 nt, Homo Sapiens
aagccugggcacuguggcucucuaguagcugcauuacaaaaaagauauauguaauuaaaauguu

SEQ ID NO: 180247 - RNA, 64 nt, Homo Sapiens
cugcuuuuuugccucacaauuaugcugugaauuuuacaaaaauuuauuuucuuuuuugauaauu

SEQ ID NO: 180248 - RNA, 64 nt, Homo Sapiens
gaauggaaacuuggaaauacucguuuuuauaaacuacaaaaacuuuuuguuguuuaucaggaaa

SEQ ID NO: 180249 - RNA, 64 nt, Homo Sapiens
uuuaaagaaauauuuugaaucugccaaguacauuuacaaaaacacggaugcugguauuuuaaca

SEQ ID NO: 180250 - RNA, 64 nt, Homo Sapiens
ggcuaacauggugaaacccugucucuacuaaaaauacaaaaaauuagccggguguggugguggg

SEQ ID NO: 180251 - RNA, 64 nt, Homo Sapiens
uagccgggcgugguggcggggucuccacuaaaaauacaaaaaaucuggcuaacagugaaacccu

SEQ ID NO: 180252 - RNA, 64 nt, Homo Sapiens
uagcugggcgugguggugcaaugucugcuaaaauuacaaaaaauggcuaauacagugaaacccc

SEQ ID NO: 180253 - RNA, 64 nt, Homo Sapiens
gaccagccuggacaacauggugaaaccccaucucuacaaaaaauacaaaaauuagccaugcaug

SEQ ID NO: 180254 - RNA, 64 nt, Homo Sapiens
ggacaacauggugaaaccccaucucuacaaaaaauacaaaaauuagccaugcaugguggcucau

SEQ ID NO: 180255 - RNA, 64 nt, Homo Sapiens
gaccagccugggccacaugacaaagccccaucucuacaaaaaaauuacaaaaaaaaaaaaaaca

SEQ ID NO: 180256 - RNA, 64 nt, Homo Sapiens
gccacaugacaaagccccaucucuacaaaaaaauuacaaaaaaaaaaaaaacaggugugguggc

SEQ ID NO: 180257 - RNA, 64 nt, Homo Sapiens
ggccaacguggugaaacacugucucuacuaaaaauacaaaaaugagcugggugugaugauacau

SEQ ID NO: 180258 - RNA, 64 nt, Homo Sapiens
ggcuaacacggugaaaccccgucuuuacuaaaaauacaaaaaaaauuagcugggcgugguggcg

SEQ ID NO: 180259 - RNA, 64 nt, Homo Sapiens
accagccugggaaauauagugaaacuccugucccuacaaaaaauacaaaaauuagccgggugug

SEQ ID NO: 180260 - RNA, 64 nt, Homo Sapiens
ggaaauauagugaaacuccugucccuacaaaaaauacaaaaauuagccgggugugguagugcau

SEQ ID NO: 180261 - RNA, 64 nt, Homo Sapiens
gaaaucugcacuaauuuaccauuuuuuuuaagaauacaaaaacaggcauuuuugcuucaauuuu

SEQ ID NO: 180262 - RNA, 64 nt, Homo Sapiens
uuuucgaucuucucacucuuggaaaagaaaaauguacaaaaagaaggaaaggccaaaaaaaaga

SEQ ID NO: 180263 - RNA, 64 nt, Homo Sapiens
gaccagccuggccaacauggugaaaccccaccucuacaaaaaauacaaaaauuagccgggcgug

SEQ ID NO: 180264 - RNA, 64 nt, Homo Sapiens
ggccaacauggugaaaccccaccucuacaaaaaauacaaaaauuagccgggcgugguggcaggc

SEQ ID NO: 180265 - RNA, 64 nt, Homo Sapiens
aggugugguggcgggcaccucaucucuacuaaaauacaaaaauuggccaacauggcaaaacccc

SEQ ID NO: 180266 - RNA, 64 nt, Homo Sapiens
uuagccgggcaugguggcacucaucucuacaaaauacaaaaaaacugggaaacguggugagacc

SEQ ID NO: 180267 - RNA, 64 nt, Homo Sapiens
aguugaaugagguaaaauggaaagacacauuucuuacaaaaaaggaagucuuauaaaaauuuaa

SEQ ID NO: 180268 - RNA, 64 nt, Homo Sapiens
guguugcucucuucacaguaucauaacaguaucuuacaaaaaacgguaauuugccaggaauucu

SEQ ID NO: 180269 - RNA, 64 nt, Homo Sapiens
cccuucuugguggauuagacauugauucaaauguuacaaaaaaaguaaguaagaaagaaggcaa

SEQ ID NO: 180270 - RNA, 64 nt, Homo Sapiens
uuauaagaaaacuacauguacgucuaugcaauuguacaaaaaaguaacaauggcagguuuuaca

SEQ ID NO: 180271 - RNA, 64 nt, Homo Sapiens
agcugggcguaguggcgcguaucucuacuaaaaauacaaaaauuggccaacauggugaaacccc

SEQ ID NO: 180272 - RNA, 64 nt, Homo Sapiens
agccgggcgugguggugcgucaucucuacuaaaauacaaaaauuuggccaacauagcaaaaccu

SEQ ID NO: 180273 - RNA, 64 nt, Homo Sapiens
cagacacuuaacaaaaagcaaugugacagaugaguacaaaaauguuuuuaauguucgguuaaaa

SEQ ID NO: 180274 - RNA, 64 nt, Homo Sapiens
agccaggacugauggcaugugucucuacuaaaaauacaaaaauuggccaacauggcgaaacccc

SEQ ID NO: 180275 - RNA, 64 nt, Homo Sapiens; identical to SEQ ID NO: 53771

SEQ ID NO: 180276 - RNA, 64 nt, Homo Sapiens; identical to SEQ ID NO: 53772

SEQ ID NO: 180277 - RNA, 64 nt, Homo Sapiens; identical to SEQ ID NO: 53773

SEQ ID NO: 180278 - RNA, 64 nt, Homo Sapiens; identical to SEQ ID NO: 53774

SEQ ID NO: 180279 - RNA, 64 nt, Homo Sapiens; identical to SEQ ID NO: 53775

SEQ ID NO: 180280 - RNA, 64 nt, Homo Sapiens; identical to SEQ ID NO: 53776

SEQ ID NO: 180281 - RNA, 64 nt, Homo Sapiens; identical to SEQ ID NO: 53777

SEQ ID NO: 180282 - RNA, 64 nt, Homo Sapiens; identical to SEQ ID NO: 53778

SEQ ID NO: 180283 - RNA, 64 nt, Homo Sapiens; identical to SEQ ID NO: 53779

SEQ ID NO: 180284 - RNA, 64 nt, Homo Sapiens; identical to SEQ ID NO: 53780

SEQ ID NO: 180285 - RNA, 64 nt, Homo Sapiens; identical to SEQ ID NO: 53781

SEQ ID NO: 180286 - RNA, 64 nt, Homo Sapiens; identical to SEQ ID NO: 53782

SEQ ID NO: 180287 - RNA, 64 nt, Homo Sapiens; identical to SEQ ID NO: 53783

SEQ ID NO: 180288 - RNA, 64 nt, Homo Sapiens; identical to SEQ ID NO: 53784

SEQ ID NO: 180289 - RNA, 64 nt, Homo Sapiens; identical to SEQ ID NO: 53785

SEQ ID NO: 180290 - RNA, 64 nt, Homo Sapiens; identical to SEQ ID NO: 53786

SEQ ID NO: 180291 - RNA, 64 nt, Homo Sapiens; identical to SEQ ID NO: 53787

SEQ ID NO: 180292 - RNA, 64 nt, Homo Sapiens; identical to SEQ ID NO: 53788

SEQ ID NO: 180293 - RNA, 64 nt, Homo Sapiens; identical to SEQ ID NO: 53789

SEQ ID NO: 180294 - RNA, 64 nt, Homo Sapiens; identical to SEQ ID NO: 53790

SEQ ID NO: 180295 - RNA, 64 nt, Homo Sapiens; identical to SEQ ID NO: 53791

SEQ ID NO: 180296 - RNA, 64 nt, Homo Sapiens; identical to SEQ ID NO: 53792

SEQ ID NO: 180297 - RNA, 64 nt, Homo Sapiens; identical to SEQ ID NO: 53793

SEQ ID NO: 180298 - RNA, 64 nt, Homo Sapiens; identical to SEQ ID NO: 53794

SEQ ID NO: 180299 - RNA, 64 nt, Homo Sapiens; identical to SEQ ID NO: 53795

SEQ ID NO: 180300 - RNA, 64 nt, Homo Sapiens; identical to SEQ ID NO: 53796

SEQ ID NO: 180301 - RNA, 64 nt, Homo Sapiens; identical to SEQ ID NO: 53797

SEQ ID NO: 180302 - RNA, 64 nt, Homo Sapiens; identical to SEQ ID NO: 53798

SEQ ID NO: 180303 - RNA, 64 nt, Homo Sapiens; identical to SEQ ID NO: 53799

SEQ ID NO: 180304 - RNA, 64 nt, Homo Sapiens; identical to SEQ ID NO: 53800

SEQ ID NO: 180305 - RNA, 64 nt, Homo Sapiens; identical to SEQ ID NO: 53801

SEQ ID NO: 180306 - RNA, 64 nt, Homo Sapiens; identical to SEQ ID NO: 53802

SEQ ID NO: 180307 - RNA, 64 nt, Homo Sapiens; identical to SEQ ID NO: 53803

SEQ ID NO: 180308 - RNA, 64 nt, Homo Sapiens; identical to SEQ ID NO: 53804

SEQ ID NO: 180309 - RNA, 64 nt, Homo Sapiens; identical to SEQ ID NO: 53805

SEQ ID NO: 180310 - RNA, 64 nt, Homo Sapiens; identical to SEQ ID NO: 53806

SEQ ID NO: 180311 - RNA, 64 nt, Homo Sapiens; identical to SEQ ID NO: 53807

SEQ ID NO: 180312 - RNA, 64 nt, Homo Sapiens; identical to SEQ ID NO: 53808

SEQ ID NO: 180313 - RNA, 64 nt, Homo Sapiens; identical to SEQ ID NO: 53809

SEQ ID NO: 180314 - RNA, 64 nt, Homo Sapiens; identical to SEQ ID NO: 53810

SEQ ID NO: 180315 - RNA, 64 nt, Homo Sapiens; identical to SEQ ID NO: 53811

SEQ ID NO: 180316 - RNA, 64 nt, Homo Sapiens; identical to SEQ ID NO: 53812

SEQ ID NO: 180317 - RNA, 64 nt, Homo Sapiens; identical to SEQ ID NO: 53813

SEQ ID NO: 180318 - RNA, 64 nt, Homo Sapiens; identical to SEQ ID NO: 53814

SEQ ID NO: 180319 - RNA, 64 nt, Homo Sapiens; identical to SEQ ID NO: 53815

SEQ ID NO: 180320 - RNA, 64 nt, Homo Sapiens
uucgacccagagcagcacccaucccccaaucccagauccgcaugggcgucucuccaccagccag

SEQ ID NO: 180321 - RNA, 64 nt, Homo Sapiens
aaggugcgcacaggugcuucuggaagaaacgccugauccgcaucaccugucugggaucaacucc

SEQ ID NO: 180322 - RNA, 64 nt, Homo Sapiens
ucugucucccccagccagacaccugcaucccuggcuccucuauuacucaggggcauucaugccu

SEQ ID NO: 180323 - RNA, 64 nt, Homo Sapiens
ccuuuauuacugccuucuuuucaaaagcacaacucuccucuaacccuccccucccccuucccuu

SEQ ID NO: 180324 - RNA, 64 nt, Homo Sapiens
ucucucuguguaauuuaccaugaggcaaugcucccuccucuaucgauaaagauaaucuuaaagc

SEQ ID NO: 180325 - RNA, 64 nt, Homo Sapiens
agaaggcacuugccauuaaugugacuccuaaauccuccucuaaagaauucugcagcuagggauu

SEQ ID NO: 180326 - RNA, 64 nt, Homo Sapiens
gggggcaucaucaaaaacuuuggaguccccucaccuccucuaagguugggcagggugacccuga

SEQ ID NO: 180327 - RNA, 64 nt, Homo Sapiens
uucuaccucaggcagcucaagcagcgaccgcccccuccucuagcugugggggugagggucccau

SEQ ID NO: 180328 - RNA, 64 nt, Homo Sapiens
augcaaaaaaauuuugacuugaacuuuauuuacacuccucuauccauauguauacugguuuaug

SEQ ID NO: 180329 - RNA, 64 nt, Homo Sapiens
ccuuuuagggaauaauauucgugcuuuuucuccccuccucuauuugaaaagagcaaucagaauu

SEQ ID NO: 180330 - RNA, 64 nt, Homo Sapiens
ggaagacaaaacuucccuuuuguuuuacuccucacuccucuauuuuuguuuuacucacuucuuu

SEQ ID NO: 180331 - RNA, 64 nt, Homo Sapiens
uuacuccucacuccuguauauuuugguuuacuuacuccucuauuucagaaauugaaaaagaucc

SEQ ID NO: 180332 - RNA, 64 nt, Homo Sapiens
ccgcccugggcuggugaaggcacgcccuuucacccuccucuaccggaagaagcgggcucugagc

SEQ ID NO: 180333 - RNA, 64 nt, Homo Sapiens
ccgaggagucccuaccacccauaguaaaacucuacuccucuacuuuauuugccuccuagucaua

SEQ ID NO: 180334 - RNA, 64 nt, Homo Sapiens
ccaaaggaaucauggauuagacccaagggcugagcuccucuagggcaggaccugcacccugugu

SEQ ID NO: 180335 - RNA, 64 nt, Homo Sapiens
ugauuagucugcauuuuacuaguucacuggaucccuccucuaggggccuggggacuuucacuga

SEQ ID NO: 180336 - RNA, 64 nt, Homo Sapiens
ccaggccaagggucuacaauucuccaacgaauagcuccucuacccaagauucuauggagguugg

SEQ ID NO: 180337 - RNA, 64 nt, Homo Sapiens
ugucuuccucaacgacuucuuccucgacaucuuccuccucuacugguaaccaaggcaaucaggc

SEQ ID NO: 180338 - RNA, 64 nt, Homo Sapiens
caguguuucaaacuuuggucgagagcuuuuuucccuccucuauuugcuuuccauugccuggaaa

SEQ ID NO: 180339 - RNA, 64 nt, Homo Sapiens
caauuaaagagaaaggggaaucauuccuuaauuucuccucuaugaauguccugaaauccacuug

SEQ ID NO: 180340 - RNA, 50 nt, Homo Sapiens; identical to SEQ ID NO: 172653

SEQ ID NO: 180341 - RNA, 64 nt, Homo Sapiens; identical to SEQ ID NO: 172654

SEQ ID NO: 180342 - RNA, 64 nt, Homo Sapiens; identical to SEQ ID NO: 172655

SEQ ID NO: 180343 - RNA, 64 nt, Homo Sapiens; identical to SEQ ID NO: 172656

SEQ ID NO: 180344 - RNA, 64 nt, Homo Sapiens; identical to SEQ ID NO: 172657

SEQ ID NO: 180345 - RNA, 64 nt, Homo Sapiens; identical to SEQ ID NO: 172658

SEQ ID NO: 180346 - RNA, 64 nt, Homo Sapiens; identical to SEQ ID NO: 172659

SEQ ID NO: 180347 - RNA, 64 nt, Homo Sapiens; identical to SEQ ID NO: 172660

SEQ ID NO: 180348 - RNA, 64 nt, Homo Sapiens; identical to SEQ ID NO: 172661

SEQ ID NO: 180349 - RNA, 64 nt, Homo Sapiens; identical to SEQ ID NO: 172662

SEQ ID NO: 180350 - RNA, 64 nt, Homo Sapiens; identical to SEQ ID NO: 172663

SEQ ID NO: 180351 - RNA, 64 nt, Homo Sapiens; identical to SEQ ID NO: 172664

SEQ ID NO: 180352 - RNA, 64 nt, Homo Sapiens; identical to SEQ ID NO: 172665

SEQ ID NO: 180353 - RNA, 64 nt, Homo Sapiens; identical to SEQ ID NO: 172666

SEQ ID NO: 180354 - RNA, 64 nt, Homo Sapiens; identical to SEQ ID NO: 172667

SEQ ID NO: 180355 - RNA, 64 nt, Homo Sapiens; identical to SEQ ID NO: 172668

SEQ ID NO: 180356 - RNA, 64 nt, Homo Sapiens; identical to SEQ ID NO: 172669

SEQ ID NO: 180357 - RNA, 64 nt, Homo Sapiens; identical to SEQ ID NO: 172670

SEQ ID NO: 180358 - RNA, 64 nt, Homo Sapiens; identical to SEQ ID NO: 172671

SEQ ID NO: 180359 - RNA, 64 nt, Homo Sapiens; identical to SEQ ID NO: 172672

SEQ ID NO: 180360 - RNA, 64 nt, Homo Sapiens; identical to SEQ ID NO: 172673

SEQ ID NO: 180361 - RNA, 64 nt, Homo Sapiens; identical to SEQ ID NO: 172674

SEQ ID NO: 180362 - RNA, 64 nt, Homo Sapiens; identical to SEQ ID NO: 172675

SEQ ID NO: 180363 - RNA, 64 nt, Homo Sapiens; identical to SEQ ID NO: 172676

SEQ ID NO: 180364 - RNA, 64 nt, Homo Sapiens; identical to SEQ ID NO: 172677

SEQ ID NO: 180365 - RNA, 64 nt, Homo Sapiens; identical to SEQ ID NO: 172678

SEQ ID NO: 180366 - RNA, 64 nt, Homo Sapiens; identical to SEQ ID NO: 172679

SEQ ID NO: 180367 - RNA, 64 nt, Homo Sapiens; identical to SEQ ID NO: 172680

SEQ ID NO: 180368 - RNA, 64 nt, Homo Sapiens; identical to SEQ ID NO: 117070

SEQ ID NO: 180369 - RNA, 64 nt, Homo Sapiens; identical to SEQ ID NO: 117071

SEQ ID NO: 180370 - RNA, 64 nt, Homo Sapiens; identical to SEQ ID NO: 117072

SEQ ID NO: 180371 - RNA, 64 nt, Homo Sapiens; identical to SEQ ID NO: 117073

SEQ ID NO: 180372 - RNA, 64 nt, Homo Sapiens; identical to SEQ ID NO: 117074

SEQ ID NO: 180373 - RNA, 64 nt, Homo Sapiens; identical to SEQ ID NO: 117075

SEQ ID NO: 180374 - RNA, 64 nt, Homo Sapiens; identical to SEQ ID NO: 117076

SEQ ID NO: 180375 - RNA, 64 nt, Homo Sapiens; identical to SEQ ID NO: 117077

SEQ ID NO: 180376 - RNA, 64 nt, Homo Sapiens; identical to SEQ ID NO: 117078

SEQ ID NO: 180377 - RNA, 64 nt, Homo Sapiens; identical to SEQ ID NO: 117079

SEQ ID NO: 180378 - RNA, 64 nt, Homo Sapiens; identical to SEQ ID NO: 117080

SEQ ID NO: 180379 - RNA, 64 nt, Homo Sapiens; identical to SEQ ID NO: 117081

SEQ ID NO: 180380 - RNA, 64 nt, Homo Sapiens; identical to SEQ ID NO: 117082

SEQ ID NO: 180381 - RNA, 64 nt, Homo Sapiens; identical to SEQ ID NO: 117083

SEQ ID NO: 180382 - RNA, 64 nt, Homo Sapiens; identical to SEQ ID NO: 117084

SEQ ID NO: 180383 - RNA, 64 nt, Homo Sapiens; identical to SEQ ID NO: 117085

SEQ ID NO: 180384 - RNA, 64 nt, Homo Sapiens; identical to SEQ ID NO: 117086

SEQ ID NO: 180385 - RNA, 64 nt, Homo Sapiens; identical to SEQ ID NO: 117087

SEQ ID NO: 180386 - RNA, 64 nt, Homo Sapiens; identical to SEQ ID NO: 117088

SEQ ID NO: 180387 - RNA, 64 nt, Homo Sapiens; identical to SEQ ID NO: 117089

SEQ ID NO: 180388 - RNA, 64 nt, Homo Sapiens; identical to SEQ ID NO: 117090

SEQ ID NO: 180389 - RNA, 64 nt, Homo Sapiens; identical to SEQ ID NO: 117091

SEQ ID NO: 180390 - RNA, 64 nt, Homo Sapiens; identical to SEQ ID NO: 117092

SEQ ID NO: 180391 - RNA, 64 nt, Homo Sapiens; identical to SEQ ID NO: 117093

SEQ ID NO: 180392 - RNA, 64 nt, Homo Sapiens; identical to SEQ ID NO: 117094

SEQ ID NO: 180393 - RNA, 64 nt, Homo Sapiens; identical to SEQ ID NO: 117095

SEQ ID NO: 180394 - RNA, 64 nt, Homo Sapiens; identical to SEQ ID NO: 117096

SEQ ID NO: 180395 - RNA, 64 nt, Homo Sapiens; identical to SEQ ID NO: 117097

SEQ ID NO: 180396 - RNA, 64 nt, Homo Sapiens; identical to SEQ ID NO: 117098

SEQ ID NO: 180397 - RNA, 64 nt, Homo Sapiens; identical to SEQ ID NO: 117099

SEQ ID NO: 180398 - RNA, 64 nt, Homo Sapiens; identical to SEQ ID NO: 117100

SEQ ID NO: 180399 - RNA, 64 nt, Homo Sapiens; identical to SEQ ID NO: 117101

SEQ ID NO: 180400 - RNA, 64 nt, Homo Sapiens; identical to SEQ ID NO: 117102

SEQ ID NO: 180401 - RNA, 64 nt, Homo Sapiens; identical to SEQ ID NO: 117103

SEQ ID NO: 180402 - RNA, 64 nt, Homo Sapiens; identical to SEQ ID NO: 117104

SEQ ID NO: 180403 - RNA, 64 nt, Homo Sapiens; identical to SEQ ID NO: 117105

SEQ ID NO: 180404 - RNA, 64 nt, Homo Sapiens; identical to SEQ ID NO: 117106

SEQ ID NO: 180405 - RNA, 64 nt, Homo Sapiens; identical to SEQ ID NO: 117107

SEQ ID NO: 180406 - RNA, 64 nt, Homo Sapiens; identical to SEQ ID NO: 117108

SEQ ID NO: 180407 - RNA, 64 nt, Homo Sapiens; identical to SEQ ID NO: 117109

SEQ ID NO: 180408 - RNA, 64 nt, Homo Sapiens; identical to SEQ ID NO: 117110

SEQ ID NO: 180409 - RNA, 64 nt, Homo Sapiens; identical to SEQ ID NO: 117111

SEQ ID NO: 180410 - RNA, 64 nt, Homo Sapiens; identical to SEQ ID NO: 117112

SEQ ID NO: 180411 - RNA, 64 nt, Homo Sapiens; identical to SEQ ID NO: 117113

SEQ ID NO: 180412 - RNA, 64 nt, Homo Sapiens; identical to SEQ ID NO: 117114

SEQ ID NO: 180413 - RNA, 64 nt, Homo Sapiens; identical to SEQ ID NO: 117115

SEQ ID NO: 180414 - RNA, 64 nt, Homo Sapiens; identical to SEQ ID NO: 117116

SEQ ID NO: 180415 - RNA, 64 nt, Homo Sapiens; identical to SEQ ID NO: 117117

SEQ ID NO: 180416 - RNA, 64 nt, Homo Sapiens; identical to SEQ ID NO: 117118

SEQ ID NO: 180417 - RNA, 64 nt, Homo Sapiens; identical to SEQ ID NO: 117119

SEQ ID NO: 180418 - RNA, 64 nt, Homo Sapiens; identical to SEQ ID NO: 117120

SEQ ID NO: 180419 - RNA, 64 nt, Homo Sapiens; identical to SEQ ID NO: 117121

SEQ ID NO: 180420 - RNA, 64 nt, Homo Sapiens; identical to SEQ ID NO: 117122

SEQ ID NO: 180421 - RNA, 64 nt, Homo Sapiens; identical to SEQ ID NO: 117123

SEQ ID NO: 180422 - RNA, 64 nt, Homo Sapiens; identical to SEQ ID NO: 117124

SEQ ID NO: 180423 - RNA, 64 nt, Homo Sapiens; identical to SEQ ID NO: 117125

SEQ ID NO: 180424 - RNA, 64 nt, Homo Sapiens; identical to SEQ ID NO: 117126

SEQ ID NO: 180425 - RNA, 64 nt, Homo Sapiens; identical to SEQ ID NO: 117127

SEQ ID NO: 180426 - RNA, 64 nt, Homo Sapiens; identical to SEQ ID NO: 117128

SEQ ID NO: 180427 - RNA, 64 nt, Homo Sapiens; identical to SEQ ID NO: 117129

SEQ ID NO: 180428 - RNA, 64 nt, Homo Sapiens; identical to SEQ ID NO: 117130

SEQ ID NO: 180429 - RNA, 64 nt, Homo Sapiens; identical to SEQ ID NO: 117131

SEQ ID NO: 180430 - RNA, 64 nt, Homo Sapiens; identical to SEQ ID NO: 117132

SEQ ID NO: 180431 - RNA, 64 nt, Homo Sapiens; identical to SEQ ID NO: 117133

SEQ ID NO: 180432 - RNA, 64 nt, Homo Sapiens; identical to SEQ ID NO: 117134

SEQ ID NO: 180433 - RNA, 64 nt, Homo Sapiens; identical to SEQ ID NO: 117135

SEQ ID NO: 180434 - RNA, 64 nt, Homo Sapiens; identical to SEQ ID NO: 117136

SEQ ID NO: 180435 - RNA, 64 nt, Homo Sapiens; identical to SEQ ID NO: 117137

SEQ ID NO: 180436 - RNA, 64 nt, Homo Sapiens; identical to SEQ ID NO: 117138

SEQ ID NO: 180437 - RNA, 64 nt, Homo Sapiens; identical to SEQ ID NO: 117139

SEQ ID NO: 180438 - RNA, 64 nt, Homo Sapiens; identical to SEQ ID NO: 117140

SEQ ID NO: 180439 - RNA, 64 nt, Homo Sapiens; identical to SEQ ID NO: 117141

SEQ ID NO: 180440 - RNA, 64 nt, Homo Sapiens; identical to SEQ ID NO: 117142

SEQ ID NO: 180441 - RNA, 64 nt, Homo Sapiens; identical to SEQ ID NO: 117143

SEQ ID NO: 180442 - RNA, 64 nt, Homo Sapiens; identical to SEQ ID NO: 117144

SEQ ID NO: 180443 - RNA, 64 nt, Homo Sapiens; identical to SEQ ID NO: 117145

SEQ ID NO: 180444 - RNA, 64 nt, Homo Sapiens; identical to SEQ ID NO: 117146

SEQ ID NO: 180445 - RNA, 64 nt, Homo Sapiens; identical to SEQ ID NO: 117147

SEQ ID NO: 180446 - RNA, 64 nt, Homo Sapiens; identical to SEQ ID NO: 117148

SEQ ID NO: 180447 - RNA, 64 nt, Homo Sapiens; identical to SEQ ID NO: 117149

SEQ ID NO: 180448 - RNA, 64 nt, Homo Sapiens; identical to SEQ ID NO: 117150

SEQ ID NO: 180449 - RNA, 64 nt, Homo Sapiens; identical to SEQ ID NO: 117151

SEQ ID NO: 180450 - RNA, 64 nt, Homo Sapiens; identical to SEQ ID NO: 117152

SEQ ID NO: 180451 - RNA, 64 nt, Homo Sapiens; identical to SEQ ID NO: 117153

SEQ ID NO: 180452 - RNA, 64 nt, Homo Sapiens; identical to SEQ ID NO: 117154

SEQ ID NO: 180453 - RNA, 64 nt, Homo Sapiens; identical to SEQ ID NO: 117155

SEQ ID NO: 180454 - RNA, 64 nt, Homo Sapiens; identical to SEQ ID NO: 117156

SEQ ID NO: 180455 - RNA, 64 nt, Homo Sapiens; identical to SEQ ID NO: 117157

SEQ ID NO: 180456 - RNA, 64 nt, Homo Sapiens; identical to SEQ ID NO: 117158

SEQ ID NO: 180457 - RNA, 64 nt, Homo Sapiens; identical to SEQ ID NO: 117159

SEQ ID NO: 180458 - RNA, 64 nt, Homo Sapiens; identical to SEQ ID NO: 117160

SEQ ID NO: 180459 - RNA, 64 nt, Homo Sapiens; identical to SEQ ID NO: 117161

SEQ ID NO: 180460 - RNA, 64 nt, Homo Sapiens; identical to SEQ ID NO: 117162

SEQ ID NO: 180461 - RNA, 64 nt, Homo Sapiens; identical to SEQ ID NO: 117163

SEQ ID NO: 180462 - RNA, 64 nt, Homo Sapiens; identical to SEQ ID NO: 117164

SEQ ID NO: 180463 - RNA, 64 nt, Homo Sapiens; identical to SEQ ID NO: 117165

SEQ ID NO: 180464 - RNA, 64 nt, Homo Sapiens; identical to SEQ ID NO: 117166

SEQ ID NO: 180465 - RNA, 64 nt, Homo Sapiens; identical to SEQ ID NO: 117167

SEQ ID NO: 180466 - RNA, 64 nt, Homo Sapiens; identical to SEQ ID NO: 117168

SEQ ID NO: 180467 - RNA, 64 nt, Homo Sapiens; identical to SEQ ID NO: 117169

SEQ ID NO: 180468 - RNA, 64 nt, Homo Sapiens; identical to SEQ ID NO: 117170

SEQ ID NO: 180469 - RNA, 64 nt, Homo Sapiens; identical to SEQ ID NO: 117171

SEQ ID NO: 180470 - RNA, 64 nt, Homo Sapiens; identical to SEQ ID NO: 117172

SEQ ID NO: 180471 - RNA, 64 nt, Homo Sapiens; identical to SEQ ID NO: 117173

SEQ ID NO: 180472 - RNA, 64 nt, Homo Sapiens; identical to SEQ ID NO: 117174

SEQ ID NO: 180473 - RNA, 64 nt, Homo Sapiens; identical to SEQ ID NO: 117175

SEQ ID NO: 180474 - RNA, 64 nt, Homo Sapiens; identical to SEQ ID NO: 117176

SEQ ID NO: 180475 - RNA, 64 nt, Homo Sapiens; identical to SEQ ID NO: 117177

SEQ ID NO: 180476 - RNA, 64 nt, Homo Sapiens; identical to SEQ ID NO: 117178

SEQ ID NO: 180477 - RNA, 64 nt, Homo Sapiens; identical to SEQ ID NO: 117179

SEQ ID NO: 180478 - RNA, 64 nt, Homo Sapiens; identical to SEQ ID NO: 117180

SEQ ID NO: 180479 - RNA, 64 nt, Homo Sapiens; identical to SEQ ID NO: 117181

SEQ ID NO: 180480 - RNA, 64 nt, Homo Sapiens; identical to SEQ ID NO: 117182

SEQ ID NO: 180481 - RNA, 64 nt, Homo Sapiens; identical to SEQ ID NO: 117183

SEQ ID NO: 180482 - RNA, 64 nt, Homo Sapiens; identical to SEQ ID NO: 117184

SEQ ID NO: 180483 - RNA, 64 nt, Homo Sapiens; identical to SEQ ID NO: 117185

SEQ ID NO: 180484 - RNA, 64 nt, Homo Sapiens
cacagcugugugggaccacaguacuauaaugaguuauugugaccccaguggucucucugggugg

SEQ ID NO: 180485 - RNA, 64 nt, Homo Sapiens
guuguaacauuuuaaaaauguugcuacuguucuuuauugugaauuuuauuucuacugugcuuua

SEQ ID NO: 180486 - RNA, 64 nt, Homo Sapiens
caaaugacucucaucaucaacaaauuguauuccuuauugugaaauuaauacccucaggcuccau

SEQ ID NO: 180487 - RNA, 64 nt, Homo Sapiens
gaagacaggaauguaaaacuacuagaucauaugguauugugauuuucuuuccccugcuaggaaa

SEQ ID NO: 180488 - RNA, 64 nt, Homo Sapiens
uuucuaggaaauauucauuaaacauaaaaaugaguauugugaacuaaauuugaauauaaauuga

SEQ ID NO: 180489 - RNA, 64 nt, Homo Sapiens
cuaagaauauuaagauaauuauugcccaaggaaauauugugaucaauuuucagaucacuuucaa

SEQ ID NO: 180490 - RNA, 64 nt, Homo Sapiens
auuaauguuaauuuaaaucuguaaauaauugcuuuauugugaugugauacagaacaaaguguuc

SEQ ID NO: 180491 - RNA, 64 nt, Homo Sapiens
uucaacuuuuuucagguaauagaagugaauaauuuauugugaaauaauucauuuuauaaaugua

SEQ ID NO: 180492 - RNA, 64 nt, Homo Sapiens
uaagacaacuauaaugaauguguuuuuaguagcuuauugugaagacaaucuuauuccagaagac

SEQ ID NO: 180493 - RNA, 64 nt, Homo Sapiens
aaauaaaaagacggcuguaucccaucuuguugccuauugugauauaacauauuccaaaaccaga

SEQ ID NO: 180494 - RNA, 64 nt, Homo Sapiens
acuaaaaugaggccaagguucuaccauuuuccuuuauugugaucuuguuaugaugaguaugcac

SEQ ID NO: 180495 - RNA, 64 nt, Homo Sapiens
augauugcauucucauugaguucuuuuugaacaauauugugaaagcacuacaauguuuaucuuu

SEQ ID NO: 180496 - RNA, 64 nt, Homo Sapiens
acacauuuagucaguuuggguuuaugccagcuuauauugugagaaauagagaauuuuauuuauu

SEQ ID NO: 180497 - RNA, 64 nt, Homo Sapiens
auagagaauuuuauuuauuuuacauuauuguugcuauugugauaccuuaaaccauuauuaugug

SEQ ID NO: 180498 - RNA, 64 nt, Homo Sapiens
aauuugaguguuuccacagggauugcauucuauuuauugugaauugcugccaucaacuuuguaa

SEQ ID NO: 180499 - RNA, 64 nt, Homo Sapiens
uacugcuuaauuacggaaagcucagagauguauauauugugaauucuauugaaacaacaagugc

SEQ ID NO: 180500 - RNA, 64 nt, Homo Sapiens
aaauugcacaaucucuggcuauuuuggcuugaaauauugugacuuuuuaauauaagaacacuga

SEQ ID NO: 180501 - RNA, 64 nt, Homo Sapiens
uugggaccuuuagcccauaguagcuguuauuuauuauugugaugugaaugugucucuguaaaca

SEQ ID NO: 180502 - RNA, 64 nt, Homo Sapiens
uguugcaugcaaacacuucucuuuauucugcauuuauugugauuuuuggaaacagguaucaacc

SEQ ID NO: 180503 - RNA, 64 nt, Homo Sapiens
uuugaagcucucuaauuugugguacgauauugcuuauugugacuuuggcauguauuuuugcuag

SEQ ID NO: 180504 - RNA, 64 nt, Homo Sapiens
uuguauauguuuugucccaggcguuuuugcuuaguauugugauauuuauuucuuuggguguaaa

SEQ ID NO: 180505 - RNA, 64 nt, Homo Sapiens
uaauuccucugaaagauaagcccaguacuaucaguauugugaaaggaauguacuuuuaacaauu

SEQ ID NO: 180506 - RNA, 64 nt, Homo Sapiens; identical to SEQ ID NO: 104428

SEQ ID NO: 180507 - RNA, 64 nt, Homo Sapiens; identical to SEQ ID NO: 104429

SEQ ID NO: 180508 - RNA, 64 nt, Homo Sapiens; identical to SEQ ID NO: 104430

SEQ ID NO: 180509 - RNA, 64 nt, Homo Sapiens; identical to SEQ ID NO: 104431

SEQ ID NO: 180510 - RNA, 64 nt, Homo Sapiens; identical to SEQ ID NO: 104432

SEQ ID NO: 180511 - RNA, 64 nt, Homo Sapiens; identical to SEQ ID NO: 104433

SEQ ID NO: 180512 - RNA, 64 nt, Homo Sapiens; identical to SEQ ID NO: 104434

SEQ ID NO: 180513 - RNA, 64 nt, Homo Sapiens; identical to SEQ ID NO: 104435

SEQ ID NO: 180514 - RNA, 64 nt, Homo Sapiens; identical to SEQ ID NO: 104436

SEQ ID NO: 180515 - RNA, 64 nt, Homo Sapiens; identical to SEQ ID NO: 104437

SEQ ID NO: 180516 - RNA, 64 nt, Homo Sapiens; identical to SEQ ID NO: 104438

SEQ ID NO: 180517 - RNA, 64 nt, Homo Sapiens; identical to SEQ ID NO: 104439

SEQ ID NO: 180518 - RNA, 64 nt, Homo Sapiens; identical to SEQ ID NO: 104440

SEQ ID NO: 180519 - RNA, 64 nt, Homo Sapiens; identical to SEQ ID NO: 104441

SEQ ID NO: 180520 - RNA, 64 nt, Homo Sapiens; identical to SEQ ID NO: 104442

SEQ ID NO: 180521 - RNA, 64 nt, Homo Sapiens; identical to SEQ ID NO: 104443

SEQ ID NO: 180522 - RNA, 64 nt, Homo Sapiens; identical to SEQ ID NO: 104444

SEQ ID NO: 180523 - RNA, 64 nt, Homo Sapiens; identical to SEQ ID NO: 104445

SEQ ID NO: 180524 - RNA, 64 nt, Homo Sapiens; identical to SEQ ID NO: 104446

SEQ ID NO: 180525 - RNA, 64 nt, Homo Sapiens; identical to SEQ ID NO: 104447

SEQ ID NO: 180526 - RNA, 64 nt, Homo Sapiens; identical to SEQ ID NO: 104448

SEQ ID NO: 180527 - RNA, 64 nt, Homo Sapiens; identical to SEQ ID NO: 104449

SEQ ID NO: 180528 - RNA, 64 nt, Homo Sapiens; identical to SEQ ID NO: 104450

SEQ ID NO: 180529 - RNA, 64 nt, Homo Sapiens; identical to SEQ ID NO: 104451

SEQ ID NO: 180530 - RNA, 64 nt, Homo Sapiens
agugaugaaaugucagauuuccuaccauaucacucucauauaucuuauaagcuugaguuuucuu

SEQ ID NO: 180531 - RNA, 64 nt, Homo Sapiens
uaauaaaaccaaucugaguuguuaaccaaaguagcucauauaaaaaauauugaaaacugaggca

SEQ ID NO: 180532 - RNA, 64 nt, Homo Sapiens; identical to SEQ ID NO: 74460

SEQ ID NO: 180533 - RNA, 64 nt, Homo Sapiens; identical to SEQ ID NO: 74461

SEQ ID NO: 180534 - RNA, 64 nt, Homo Sapiens; identical to SEQ ID NO: 74462

SEQ ID NO: 180535 - RNA, 64 nt, Homo Sapiens; identical to SEQ ID NO: 74463

SEQ ID NO: 180536 - RNA, 64 nt, Homo Sapiens; identical to SEQ ID NO: 74464

SEQ ID NO: 180537 - RNA, 64 nt, Homo Sapiens; identical to SEQ ID NO: 74465

SEQ ID NO: 180538 - RNA, 64 nt, Homo Sapiens; identical to SEQ ID NO: 74466

SEQ ID NO: 180539 - RNA, 64 nt, Homo Sapiens; identical to SEQ ID NO: 74467

SEQ ID NO: 180540 - RNA, 64 nt, Homo Sapiens; identical to SEQ ID NO: 74468

SEQ ID NO: 180541 - RNA, 64 nt, Homo Sapiens; identical to SEQ ID NO: 74469

SEQ ID NO: 180542 - RNA, 64 nt, Homo Sapiens; identical to SEQ ID NO: 74470

SEQ ID NO: 180543 - RNA, 64 nt, Homo Sapiens; identical to SEQ ID NO: 74471

SEQ ID NO: 180544 - RNA, 64 nt, Homo Sapiens; identical to SEQ ID NO: 74472

SEQ ID NO: 180545 - RNA, 64 nt, Homo Sapiens; identical to SEQ ID NO: 74473

SEQ ID NO: 180546 - RNA, 64 nt, Homo Sapiens; identical to SEQ ID NO: 74474

SEQ ID NO: 180547 - RNA, 64 nt, Homo Sapiens; identical to SEQ ID NO: 74475

SEQ ID NO: 180548 - RNA, 64 nt, Homo Sapiens; identical to SEQ ID NO: 74476

SEQ ID NO: 180549 - RNA, 64 nt, Homo Sapiens; identical to SEQ ID NO: 74477

SEQ ID NO: 180550 - RNA, 64 nt, Homo Sapiens; identical to SEQ ID NO: 74478

SEQ ID NO: 180551 - RNA, 64 nt, Homo Sapiens; identical to SEQ ID NO: 74479

SEQ ID NO: 180552 - RNA, 64 nt, Homo Sapiens; identical to SEQ ID NO: 74480

SEQ ID NO: 180553 - RNA, 64 nt, Homo Sapiens; identical to SEQ ID NO: 74481

SEQ ID NO: 180554 - RNA, 64 nt, Homo Sapiens; identical to SEQ ID NO: 74482

SEQ ID NO: 180555 - RNA, 64 nt, Homo Sapiens; identical to SEQ ID NO: 74483

SEQ ID NO: 180556 - RNA, 64 nt, Homo Sapiens; identical to SEQ ID NO: 74484

SEQ ID NO: 180557 - RNA, 64 nt, Homo Sapiens; identical to SEQ ID NO: 74485

SEQ ID NO: 180558 - RNA, 64 nt, Homo Sapiens; identical to SEQ ID NO: 74486

SEQ ID NO: 180559 - RNA, 64 nt, Homo Sapiens; identical to SEQ ID NO: 74487

SEQ ID NO: 180560 - RNA, 64 nt, Homo Sapiens; identical to SEQ ID NO: 74488

SEQ ID NO: 180561 - RNA, 64 nt, Homo Sapiens; identical to SEQ ID NO: 74489

SEQ ID NO: 180562 - RNA, 64 nt, Homo Sapiens; identical to SEQ ID NO: 74490

SEQ ID NO: 180563 - RNA, 64 nt, Homo Sapiens; identical to SEQ ID NO: 74491

SEQ ID NO: 180564 - RNA, 64 nt, Homo Sapiens; identical to SEQ ID NO: 74492

SEQ ID NO: 180565 - RNA, 64 nt, Homo Sapiens; identical to SEQ ID NO: 74493

SEQ ID NO: 180566 - RNA, 64 nt, Homo Sapiens; identical to SEQ ID NO: 74494

SEQ ID NO: 180567 - RNA, 64 nt, Homo Sapiens; identical to SEQ ID NO: 74495

SEQ ID NO: 180568 - RNA, 64 nt, Homo Sapiens; identical to SEQ ID NO: 74496

SEQ ID NO: 180569 - RNA, 64 nt, Homo Sapiens; identical to SEQ ID NO: 74497

SEQ ID NO: 180570 - RNA, 64 nt, Homo Sapiens; identical to SEQ ID NO: 74498

SEQ ID NO: 180571 - RNA, 64 nt, Homo Sapiens; identical to SEQ ID NO: 74499

SEQ ID NO: 180572 - RNA, 61 nt, Homo Sapiens; identical to SEQ ID NO: 74500

SEQ ID NO: 180573 - RNA, 64 nt, Homo Sapiens; identical to SEQ ID NO: 74501

SEQ ID NO: 180574 - RNA, 64 nt, Homo Sapiens; identical to SEQ ID NO: 74502

SEQ ID NO: 180575 - RNA, 64 nt, Homo Sapiens; identical to SEQ ID NO: 74503

SEQ ID NO: 180576 - RNA, 64 nt, Homo Sapiens; identical to SEQ ID NO: 74504

SEQ ID NO: 180577 - RNA, 64 nt, Homo Sapiens; identical to SEQ ID NO: 74505

SEQ ID NO: 180578 - RNA, 64 nt, Homo Sapiens; identical to SEQ ID NO: 74506

SEQ ID NO: 180579 - RNA, 64 nt, Homo Sapiens; identical to SEQ ID NO: 74507

SEQ ID NO: 180580 - RNA, 64 nt, Homo Sapiens; identical to SEQ ID NO: 74508

SEQ ID NO: 180581 - RNA, 64 nt, Homo Sapiens; identical to SEQ ID NO: 74509

SEQ ID NO: 180582 - RNA, 64 nt, Homo Sapiens; identical to SEQ ID NO: 74510

SEQ ID NO: 180583 - RNA, 64 nt, Homo Sapiens; identical to SEQ ID NO: 74511

SEQ ID NO: 180584 - RNA, 64 nt, Homo Sapiens
ugucuuauuaacaucugaaaauccuaauuuugucucuacugauauuuuauugcauuacuucaaa

SEQ ID NO: 180585 - RNA, 64 nt, Homo Sapiens
agagguuauauuaaagcaaaaaacucauuugugaucuacugaaagagaaaaaaaaguaguuugu

SEQ ID NO: 180586 - RNA, 64 nt, Homo Sapiens
aaugccccugcagguugcaugcugaguguuuguuucuacugauccuaucacuucccacaaugag

SEQ ID NO: 180587 - RNA, 64 nt, Homo Sapiens
gcuagauaaacgugugccugccuggguugugacuucuacugacccauacuaacugguuuggaug

SEQ ID NO: 180588 - RNA, 64 nt, Homo Sapiens
ucuuucucauuagguaggcuuaucaggguuuucaucuacugacuacugacucugcuaugugauu

SEQ ID NO: 180589 - RNA, 64 nt, Homo Sapiens
guggauaacaaauauauuugaauauuuuucagccucuacugauagagucugacaacauauucaa

SEQ ID NO: 180590 - RNA, 64 nt, Homo Sapiens
gaaguguugccuucauaauccaauccaaagcaauucuacugacacucugaaguaaacauauuua

SEQ ID NO: 180591 - RNA, 64 nt, Homo Sapiens
cuggugaugggguggggccgauuccaagggccuuucuacugaauagaacugaaccuuguaggaa

SEQ ID NO: 180592 - RNA, 64 nt, Homo Sapiens
aagaccagccuagccaacaugacgaaaccccaucucuacugaaaauagaaaaaaaaaauuagcc

SEQ ID NO: 180593 - RNA, 64 nt, Homo Sapiens
aaacaaugauuguauggguacucaaaguauaauuucuacugaaugcauaucacuugugcacugu

SEQ ID NO: 180594 - RNA, 64 nt, Homo Sapiens
gauuuuuuuuuaaaucaggaagcugguuacuggcucuacugagaguuggagcccugauguucug

SEQ ID NO: 180595 - RNA, 64 nt, Homo Sapiens
aagaccauccuggcuaacauggugaaaccccgucucuacugaaaauacaaaaaauuagccgggu

SEQ ID NO: 180596 - RNA, 64 nt, Homo Sapiens
aauuguguuggcuucaggccuuugguauucugucucuacugaauaaauacaaaugguuccagcc

SEQ ID NO: 180597 - RNA, 64 nt, Homo Sapiens
ucucacuugaauucuggcauuauuuuuaguggccucuacugauaauaccuacccuagaguacau

SEQ ID NO: 180598 - RNA, 64 nt, Homo Sapiens
aguaggcaagggaaucuguuuacucccucuucccucuacugaauaauuuucccucuacugaaua

SEQ ID NO: 180599 - RNA, 64 nt, Homo Sapiens
uuacucccucuucccucuacugaauaauuuucccucuacugaauaauuuucccucuaagaauug

SEQ ID NO: 180600 - RNA, 64 nt, Homo Sapiens; identical to SEQ ID NO: 104428

SEQ ID NO: 180601 - RNA, 64 nt, Homo Sapiens; identical to SEQ ID NO: 104429

SEQ ID NO: 180602 - RNA, 64 nt, Homo Sapiens; identical to SEQ ID NO: 104430

SEQ ID NO: 180603 - RNA, 64 nt, Homo Sapiens; identical to SEQ ID NO: 104431

SEQ ID NO: 180604 - RNA, 64 nt, Homo Sapiens; identical to SEQ ID NO: 104432

SEQ ID NO: 180605 - RNA, 64 nt, Homo Sapiens; identical to SEQ ID NO: 104433

SEQ ID NO: 180606 - RNA, 64 nt, Homo Sapiens; identical to SEQ ID NO: 104434

SEQ ID NO: 180607 - RNA, 64 nt, Homo Sapiens; identical to SEQ ID NO: 104435

SEQ ID NO: 180608 - RNA, 64 nt, Homo Sapiens; identical to SEQ ID NO: 104436

SEQ ID NO: 180609 - RNA, 64 nt, Homo Sapiens; identical to SEQ ID NO: 104437

SEQ ID NO: 180610 - RNA, 64 nt, Homo Sapiens; identical to SEQ ID NO: 104438

SEQ ID NO: 180611 - RNA, 64 nt, Homo Sapiens; identical to SEQ ID NO: 104439

SEQ ID NO: 180612 - RNA, 64 nt, Homo Sapiens; identical to SEQ ID NO: 104440

SEQ ID NO: 180613 - RNA, 64 nt, Homo Sapiens; identical to SEQ ID NO: 104441

SEQ ID NO: 180614 - RNA, 64 nt, Homo Sapiens; identical to SEQ ID NO: 104442

SEQ ID NO: 180615 - RNA, 64 nt, Homo Sapiens; identical to SEQ ID NO: 104443

SEQ ID NO: 180616 - RNA, 64 nt, Homo Sapiens; identical to SEQ ID NO: 104444

SEQ ID NO: 180617 - RNA, 64 nt, Homo Sapiens; identical to SEQ ID NO: 104445

SEQ ID NO: 180618 - RNA, 64 nt, Homo Sapiens; identical to SEQ ID NO: 104446

SEQ ID NO: 180619 - RNA, 64 nt, Homo Sapiens; identical to SEQ ID NO: 104447

SEQ ID NO: 180620 - RNA, 64 nt, Homo Sapiens; identical to SEQ ID NO: 104448

SEQ ID NO: 180621 - RNA, 64 nt, Homo Sapiens; identical to SEQ ID NO: 104449

SEQ ID NO: 180622 - RNA, 64 nt, Homo Sapiens; identical to SEQ ID NO: 104450

SEQ ID NO: 180623 - RNA, 64 nt, Homo Sapiens; identical to SEQ ID NO: 104451

SEQ ID NO: 180624 - RNA, 64 nt, Homo Sapiens
cuucuugcugcuuagugucuguacuagaggguaagggaaucaaaggagacauaaaccaaaauag

SEQ ID NO: 180625 - RNA, 64 nt, Homo Sapiens
cagaucugaauuuaagaacauuuccuuuuucugugggaaucacaagaguuuauccacuaaaaaa

SEQ ID NO: 180626 - RNA, 64 nt, Homo Sapiens
gguacaugucgcuccggucaccaccagguaacacgggaaucacagucagacaccaagguuuaug

SEQ ID NO: 180627 - RNA, 64 nt, Homo Sapiens
ucuuaaagcuaaaaaugaacccuuggauuaaaacgggaaucacaaagagcuauuuaaugacaca

SEQ ID NO: 180628 - RNA, 64 nt, Homo Sapiens
ccaggacacauuauuguucugauagaugcucacagggaaucaagcuucucgcccacuccacggc

SEQ ID NO: 180629 - RNA, 64 nt, Homo Sapiens
aggaucuccugggccuuggagcaccucacgcugggggaaucaaucccugagggacucagaaucu

SEQ ID NO: 180630 - RNA, 64 nt, Homo Sapiens
aaaaugccaagccuuuucucagaugcuauuuagagggaaucagaaaacccagauuccuguguac

SEQ ID NO: 180631 - RNA, 64 nt, Homo Sapiens
uaauuuaaaucauuaagauuaguaggggguauaggggaaucauugauuuuuaaaacuuuuuugg

SEQ ID NO: 180632 - RNA, 64 nt, Homo Sapiens
aguuuuuaaaagggcagaagauuuuggcacaugaaagccugacagaauaugugcaguuuucaac

SEQ ID NO: 180633 - RNA, 64 nt, Homo Sapiens
auuuuaggccaguuuaccaacaauuauaaauaaaaagccugauuaaaugacaacuuuaaaaagg

SEQ ID NO: 180634 - RNA, 64 nt, Homo Sapiens
uuucucauuuaguaaaaguugucuaauugauaugaagccugacugauuuuuuuuuuccuuacag

SEQ ID NO: 180635 - RNA, 64 nt, Homo Sapiens
aaaucaaagcugccccugagaagagacuuaauccaagccugauuguacuaguggcaucacuuag

SEQ ID NO: 180636 - RNA, 53 nt, Homo Sapiens
acuaucugcaguaccagugagccaagccugaugggcagcacagacacagacac

SEQ ID NO: 180637 - RNA, 64 nt, Homo Sapiens
agggggaaaauugccucugaauaaugaaugaugaaagccugacgccgugccccuccuggcccau

SEQ ID NO: 180638 - RNA, 64 nt, Homo Sapiens
augauuuuaauaauucucacuuaacuaauuuuguaagccugagaucaauaagaaauguucagga

SEQ ID NO: 180639 - RNA, 64 nt, Homo Sapiens
uuugaaauuuuuuuuuuguuuguuuguuuaaaucaagccugaggcuggugaacaguagcuacac

SEQ ID NO: 180640 - RNA, 64 nt, Homo Sapiens
gcugggacauggugggcaucagggacuuugugcuaagccugaugaaaugugcuccuucaaucuc

SEQ ID NO: 180641 - RNA, 64 nt, Homo Sapiens
ucagacuuuguuuuuugaaaucgauugggaucgaaagccugaaauaaauauucauacuuuccau

SEQ ID NO: 180642 - RNA, 64 nt, Homo Sapiens
auuuccgaaaaguagucuucucugaggcugggccaagccugagggaaauggggcccuaggaggg

SEQ ID NO: 180643 - RNA, 64 nt, Homo Sapiens
gccuggaggcuucagaggugaauuuaugcuugggaagccugaucccaaaccugaagggaaggga

SEQ ID NO: 180644 - RNA, 64 nt, Homo Sapiens
uccuacuaauuuaaacuaagacaguuuaaaaaggaagccugaaaaagacucauacuacaaauaa

SEQ ID NO: 180645 - RNA, 64 nt, Homo Sapiens
ugugguccuuggccgccuccugcuccugcucugcaagccugaaacuggcuugucuggagccagg

SEQ ID NO: 180646 - RNA, 64 nt, Homo Sapiens; identical to SEQ ID NO: 138555

SEQ ID NO: 180647 - RNA, 64 nt, Homo Sapiens; identical to SEQ ID NO: 138556

SEQ ID NO: 180648 - RNA, 64 nt, Homo Sapiens; identical to SEQ ID NO: 138557

SEQ ID NO: 180649 - RNA, 64 nt, Homo Sapiens; identical to SEQ ID NO: 138558

SEQ ID NO: 180650 - RNA, 64 nt, Homo Sapiens; identical to SEQ ID NO: 138559

SEQ ID NO: 180651 - RNA, 64 nt, Homo Sapiens; identical to SEQ ID NO: 138560

SEQ ID NO: 180652 - RNA, 64 nt, Homo Sapiens; identical to SEQ ID NO: 138561

SEQ ID NO: 180653 - RNA, 64 nt, Homo Sapiens; identical to SEQ ID NO: 138562

SEQ ID NO: 180654 - RNA, 64 nt, Homo Sapiens; identical to SEQ ID NO: 138563

SEQ ID NO: 180655 - RNA, 64 nt, Homo Sapiens; identical to SEQ ID NO: 138564

SEQ ID NO: 180656 - RNA, 64 nt, Homo Sapiens; identical to SEQ ID NO: 138565

SEQ ID NO: 180657 - RNA, 64 nt, Homo Sapiens; identical to SEQ ID NO: 138566

SEQ ID NO: 180658 - RNA, 64 nt, Homo Sapiens; identical to SEQ ID NO: 138567

SEQ ID NO: 180659 - RNA, 64 nt, Homo Sapiens; identical to SEQ ID NO: 138568

SEQ ID NO: 180660 - RNA, 64 nt, Homo Sapiens; identical to SEQ ID NO: 138569

SEQ ID NO: 180661 - RNA, 64 nt, Homo Sapiens; identical to SEQ ID NO: 138570

SEQ ID NO: 180662 - RNA, 64 nt, Homo Sapiens; identical to SEQ ID NO: 138571

SEQ ID NO: 180663 - RNA, 64 nt, Homo Sapiens; identical to SEQ ID NO: 138572

SEQ ID NO: 180664 - RNA, 55 nt, Homo Sapiens; identical to SEQ ID NO: 138573

SEQ ID NO: 180665 - RNA, 64 nt, Homo Sapiens; identical to SEQ ID NO: 138574

SEQ ID NO: 180666 - RNA, 64 nt, Homo Sapiens; identical to SEQ ID NO: 138575

SEQ ID NO: 180667 - RNA, 64 nt, Homo Sapiens; identical to SEQ ID NO: 138576

SEQ ID NO: 180668 - RNA, 64 nt, Homo Sapiens; identical to SEQ ID NO: 138577

SEQ ID NO: 180669 - RNA, 64 nt, Homo Sapiens; identical to SEQ ID NO: 138578

SEQ ID NO: 180670 - RNA, 64 nt, Homo Sapiens; identical to SEQ ID NO: 138579

SEQ ID NO: 180671 - RNA, 64 nt, Homo Sapiens; identical to SEQ ID NO: 138580

SEQ ID NO: 180672 - RNA, 64 nt, Homo Sapiens; identical to SEQ ID NO: 138581

SEQ ID NO: 180673 - RNA, 64 nt, Homo Sapiens; identical to SEQ ID NO: 138582

SEQ ID NO: 180674 - RNA, 64 nt, Homo Sapiens; identical to SEQ ID NO: 138583

SEQ ID NO: 180675 - RNA, 64 nt, Homo Sapiens; identical to SEQ ID NO: 138584

SEQ ID NO: 180676 - RNA, 64 nt, Homo Sapiens
agcuuuggugggcagcagcagcucaugaauggcaagcugacagcuucuccugcuguuuccuucc

SEQ ID NO: 180677 - RNA, 64 nt, Homo Sapiens
ugaguggguacggccagccacucagcccauuggcagcugacaacgcagacacgcucuacggagg

SEQ ID NO: 180678 - RNA, 64 nt, Homo Sapiens
aucaaagucauaguagguaaaugcuuuaugggacagcugacaccuuuuagacccuaccagguau

SEQ ID NO: 180679 - RNA, 64 nt, Homo Sapiens
aagaucaggcugaaacugcagucagauuuaugacagcugacaguuuuucagaggucgcacacag

SEQ ID NO: 180680 - RNA, 64 nt, Homo Sapiens
cauggcaucaccuccaccauacuccaucaguuagagcugacacaaaccugccuggguuuaaggg

SEQ ID NO: 180681 - RNA, 64 nt, Homo Sapiens
uugaggcuuagcuuugcucugccaacuucuucagagcugacacaggaugaaggcaaugccaucc

SEQ ID NO: 180682 - RNA, 64 nt, Homo Sapiens
gguguucccagccccaccagagccccgugccgggagcugacagcuuucacgcuuaaggcacgug

SEQ ID NO: 180683 - RNA, 64 nt, Homo Sapiens
ugcccacaucugcugguuuggggcuucaguggggagcugacagcugugagcacaccacuguccc

SEQ ID NO: 180684 - RNA, 64 nt, Homo Sapiens
uuucugugccuuuuccuuucccagaaguaauagcagcugacaaccguccaguuguggcagcucu

SEQ ID NO: 180685 - RNA, 64 nt, Homo Sapiens
caucaacaggggagcuaaagaugcuacaccuugaagcugacaguuucuuccugagugccauggg

SEQ ID NO: 180686 - RNA, 64 nt, Homo Sapiens
cacgugggcccaccccgggcagcagagaaggcccagcugacagggggugaggugugggucuggg

SEQ ID NO: 180687 - RNA, 64 nt, Homo Sapiens
cgugugagccagaaaccagggcuucccuacccccagcugacacuggaccccaacauguaugcuc

SEQ ID NO: 180688 - RNA, 64 nt, Homo Sapiens
ucgcccuuacucuuggagguaauaaacaguuaaaagcugacagucuguguaaauaugucuuuau

SEQ ID NO: 180689 - RNA, 64 nt, Homo Sapiens
acccuugaaggucacuuagcucacagaauguuagagcugacagggagguuguuuuugccaagaa

SEQ ID NO: 180690 - RNA, 60 nt, Homo Sapiens
cuuacauuuagugcaaauugacaaacuuuaucucccuauuauuaacauaaaauaccagaa

SEQ ID NO: 180691 - RNA, 60 nt, Homo Sapiens
aaaacagcaggaaauuuuuauccuaaauuuucucccuaucgucuuuauauuuuaucuuca

SEQ ID NO: 180692 - RNA, 60 nt, Homo Sapiens
cuugcuuagccaagagauacugaaacauacucucccuacacucucaaaacagcagaacaa

SEQ ID NO: 180693 - RNA, 60 nt, Homo Sapiens
augccaaaguggcauuauguugcaguggaaucucccuagggagaggcaguagagucaggc

SEQ ID NO: 180694 - RNA, 60 nt, Homo Sapiens
aucauuauuuugauauccauuacccucaccucucccuaguucauaaauaggucuauagca

SEQ ID NO: 180695 - RNA, 60 nt, Homo Sapiens
agccagggacacuguguggaguucgcacacucucccuaugucuccgggugcuccaguuuc

SEQ ID NO: 180696 - RNA, 60 nt, Homo Sapiens
ccugccuuagauuccucaaucauacucaggucucccuacuccaacccuaccaugcuccau

SEQ ID NO: 180697 - RNA, 60 nt, Homo Sapiens
ccugaaaugcugugagcuugagacagcuuaucucccuaacccucaacuauugacugcugc

SEQ ID NO: 180698 - RNA, 60 nt, Homo Sapiens
gagcugccucccugcugccgagccugugccucucccuaaacaucugucucuugcuaccua

SEQ ID NO: 180699 - RNA, 60 nt, Homo Sapiens
cucccagccaaccuagugcccccccauccuucucccuacauugagagaggcugugaccac

SEQ ID NO: 180700 - RNA, 64 nt, Homo Sapiens
cuacucuuuauuucauggagucguaucaacgcuaugaacgcaaggcugugauauggaaccagaa

SEQ ID NO: 180701 - RNA, 64 nt, Homo Sapiens
gggauuacaggcaugagccagcaugccuggccugugaacgcagaauucuuauaagguguuuaga

SEQ ID NO: 180702 - RNA, 64 nt, Homo Sapiens
aaccauacuucgacauuuccucugccacaaaaaaugaacgcauuuuaaguuaggagucaugaau

SEQ ID NO: 180703 - RNA, 64 nt, Homo Sapiens
gggaaugagccucagggaggagugagcaccuaaaugaacgcaguaaaccuucauggaccaacag

SEQ ID NO: 180704 - RNA, 64 nt, Homo Sapiens
uuggaugucuuugaggacagcuguuucagcugccugaacgcagucuugucacugggaaagaagc

SEQ ID NO: 180705 - RNA, 64 nt, Homo Sapiens
uugcuaguuaugacagagagggcuagaauuuuauugaacgcaacaaucuaguuaccaccagcuu

SEQ ID NO: 180706 - RNA, 64 nt, Homo Sapiens
gcccgcccgcccgcauagcacuugcagaccugccugaacgcacaugacauagcacuugccgauc

SEQ ID NO: 180707 - RNA, 64 nt, Homo Sapiens
aggcucgaccacagaauaaugccagucaccacccugaacgcacaaucuccagugcaggaucuaa

SEQ ID NO: 180708 - RNA, 64 nt, Homo Sapiens
gaguccugggucccuggccuccaaagcuggaaugugaacgcaugccacgguggucugacccuca

SEQ ID NO: 180709 - RNA, 64 nt, Homo Sapiens
agaaucacugcagcccaggagcaggagaauuacuugaacgcaggcaacuacucagaaggccgag

SEQ ID NO: 180710 - RNA, 64 nt, Homo Sapiens
cucuuugcuaggucaaaaaagaauuucaauuacgugaacgcaucaagcacacaaauuggugaca

SEQ ID NO: 180711 - RNA, 64 nt, Homo Sapiens
uuauuguagagaaaaaaaaauauguguacacauaugaacgcacaacaugcacauucauccucac

SEQ ID NO: 180712 - RNA, 64 nt, Homo Sapiens
ucuagggugugggcugaguucuucuguaaagagaugaacgcaaugccaauaaaauugaacaaga

SEQ ID NO: 180713 - RNA, 64 nt, Homo Sapiens
ugcagcguccgagggccaccggagggcuggcagcugaacgcacuaaaguguuucugggagguca

SEQ ID NO: 180714 - RNA, 64 nt, Homo Sapiens
ccugagauuuggccacucacacuauagauccacaugaacgcacgacccucaaauuaaaacuaga

SEQ ID NO: 180715 - RNA, 64 nt, Homo Sapiens
caagcuugauucaccuucaguguggugcuguaugugaacgcaugacuguguacgagagcguggu

SEQ ID NO: 180716 - RNA, 64 nt, Homo Sapiens
agaaccaggagcuucagauccuaagucaagugggugaacgcagugcccuugggagggccgaggc

SEQ ID NO: 180717 - RNA, 64 nt, Homo Sapiens
acccucuggccuaggcuggccugucuuugcuaccugaacgcaccgaaggcgggacagagcccac

SEQ ID NO: 180718 - RNA, 64 nt, Homo Sapiens
acuugccaaacuguuggaaucacuuaaucucaggugaacgcaucuguuacugacugccuaaaau

SEQ ID NO: 180719 - RNA, 64 nt, Homo Sapiens
uagaacagacugaauuaauaaaugagaagcgacaugaacgcagccuuaauucuucugagucuuu

SEQ ID NO: 180720 - RNA, 64 nt, Homo Sapiens
uaaaaagggaccacugacgugcuugcagugggggugaacgcacacauucugaccaugagacgcg

SEQ ID NO: 180721 - RNA, 64 nt, Homo Sapiens
gcaaucucaacaguguauugaaggucaccaucagugaacgcaauuugccuuaaaggcaagaggg

SEQ ID NO: 180722 - RNA, 64 nt, Homo Sapiens
uuugggaucguccugugcgagaucaucgggcgggugaacgcagacccugacuaccugccccgca

SEQ ID NO: 180723 - RNA, 64 nt, Homo Sapiens
aaagaaagaacugucucuaccagggucaagagcaugaacgcaucaauagaaagaacucggggaa

SEQ ID NO: 180724 - RNA, 64 nt, Homo Sapiens
ugugauaugcacguggccgacaugcugguuaaggugaacgcacuuaucaaggaucgggaagguu

SEQ ID NO: 180725 - RNA, 64 nt, Homo Sapiens
gacacauuuguagucauuguaucacggauuacaaugaacgcagugcagagccccaaagcucagg

SEQ ID NO: 180726 - RNA, 64 nt, Homo Sapiens
uuggugcuagauucugcaggaaaccccagcagugugaacgcaucccaacauagguuaagagcaa

SEQ ID NO: 180727 - RNA, 64 nt, Homo Sapiens
auccgggaccuucagacccauucagcgucauccuugaacgcaggccaugugagaaagagagagu

SEQ ID NO: 180728 - RNA, 64 nt, Homo Sapiens
uuaccaaaacuuaugcuaaauauacuuuccaguaugaacgcacaggagagucccaucagcaggc

SEQ ID NO: 180729 - RNA, 64 nt, Homo Sapiens
ugggcuucgugguuuccugugacccuuuuacaacugaacgcaucgcccugcccucucuucucug

SEQ ID NO: 180730 - RNA, 64 nt, Homo Sapiens
gaucuguuugacuuuguuauugugucugggggaaugaacgcacacauugguuuuuuucuacuug

SEQ ID NO: 180731 - RNA, 64 nt, Homo Sapiens
aguccguuuauggaggcaauuccauauccuuucuugaacgcacauucagcuuaccccagagagc

SEQ ID NO: 180732 - RNA, 64 nt, Homo Sapiens
uguuauugaaggaaagacacgcuccugaaccuucugaacgcauuuuugagaaaaacuaaaucau

SEQ ID NO: 180733 - RNA, 64 nt, Homo Sapiens
uuauaaaagcaaaagcucugugagaagcugggcaugaacgcacuggggugcuaugacaugcaag

SEQ ID NO: 180734 - RNA, 64 nt, Homo Sapiens
uuaaagaaaucccuaaaaaaaaaaauuauccaauugaacgcacauagcucaaucacacuggaaa

SEQ ID NO: 180735 - RNA, 64 nt, Homo Sapiens
uugacagcacgcuuuacuuauagggauuuuguuuugaacgcauauucauaagcuaauaccacug

SEQ ID NO: 180736 - RNA, 64 nt, Homo Sapiens
ccgcgugaacugggaugcaaguugcuaaccgaugugaacgcaaaaugccuuguucauuauuccu

SEQ ID NO: 180737 - RNA, 64 nt, Homo Sapiens
cugcagcuguguagucuuuggaagagguagccccugaacgcagagccuaagagaagcaagucgg

SEQ ID NO: 180738 - RNA, 64 nt, Homo Sapiens
ugaacaacuugguaacaucccuagacuccacucaugaacgcagaauuauuaccugcuguuugcu

SEQ ID NO: 180739 - RNA, 64 nt, Homo Sapiens
agaaaggguggaaaucaaccccuuuuggauaugcugaacgcagaggcccaucaacuguauuggg

SEQ ID NO: 180740 - RNA, 64 nt, Homo Sapiens
aucugacaugguucucagcagaacauuucauucuugaacgcagcuuugauagaacaguuuugag

SEQ ID NO: 180741 - RNA, 64 nt, Homo Sapiens
acgaaagcggaaggggcuuuagcccggaaguacaugaacgcaguaaggcugacucugagaacca

SEQ ID NO: 180742 - RNA, 64 nt, Homo Sapiens
gagcaaaauaaaauuuucuugugugugagcuccuugaacgcacggcaugcauaugcaugugcau

SEQ ID NO: 180743 - RNA, 64 nt, Homo Sapiens
cuauuuagggacacaccugggugagccagcgucaugaacgcauggaccuggggccaaaaauaaa

SEQ ID NO: 180744 - RNA, 64 nt, Homo Sapiens
ugguaagguguguacucagguguguggaugcgugugaacgcauggaguggaccugugcugugag

SEQ ID NO: 180745 - RNA, 64 nt, Homo Sapiens
uucugcccuucccagcaccuugugcccuugccagugaacgcaggguuugccauugcuaccaagc

SEQ ID NO: 180746 - RNA, 64 nt, Homo Sapiens
gggaacaauucuauuuuggagaauucagaagauaugaacgcauuccagcuuggagaacaccuca

SEQ ID NO: 180747 - RNA, 64 nt, Homo Sapiens
cagcuacucaggaggcugaggugggaggaugacuugaacgcaggaggcugaggcugcagugagu

SEQ ID NO: 180748 - RNA, 64 nt, Homo Sapiens
gacaaggcgggagguucgggggccuuccggcaggugaacgcagggcuggagaguauuuggugcc

SEQ ID NO: 180749 - RNA, 64 nt, Homo Sapiens
agacccucagaacuugaccuggaaguccagacacugaacgcaggccucaaaacugcugcggccu

SEQ ID NO: 180750 - RNA, 64 nt, Homo Sapiens
ggaaagcaugguggugcccugggccgucccugugugaacgcaggcaaaagcagcccaguccccc

SEQ ID NO: 180751 - RNA, 59 nt, Homo Sapiens
agaggauccacaacaguugaagagccuuuugaacgcaguagcccgcucguaucuauggu

SEQ ID NO: 180752 - RNA, 64 nt, Homo Sapiens
uuuuaugggcguuuccaggagggaaucccuggggugaacgcauggccacaugugcuuuucugcc

SEQ ID NO: 180753 - RNA, 64 nt, Homo Sapiens
ccaucuucaugucaucaaaguaugacaggugccuugaacgcagcaugucgaggcuaccugcaga

SEQ ID NO: 180754 - RNA, 64 nt, Homo Sapiens
gcuaaaugcauauuuuuaagugcuaagcacaaaaugaacgcaaagugcauucuugagcuuuuuc

SEQ ID NO: 180755 - RNA, 64 nt, Homo Sapiens
gccucgcucgagagaagcagaugagggaggaggcugaacgcacgagggaugaguuggagaggag

SEQ ID NO: 180756 - RNA, 64 nt, Homo Sapiens
acccuggacucugcuaguguuuugugcuuguggcugaacgcaucgcucuuuagaaaaagcaguc

SEQ ID NO: 180757 - RNA, 64 nt, Homo Sapiens
aacuuccaaucuuacuuugucucuuggagauuguugaacgcagcuugucuaggaaggggauggg

SEQ ID NO: 180758 - RNA, 64 nt, Homo Sapiens
augugaaaugauuugaugauuugggaaauaagauugaacgcaauuuacuuguuugaauuugcug

SEQ ID NO: 180759 - RNA, 64 nt, Homo Sapiens; identical to SEQ ID NO: 138795

SEQ ID NO: 180760 - RNA, 64 nt, Homo Sapiens; identical to SEQ ID NO: 138796

SEQ ID NO: 180761 - RNA, 64 nt, Homo Sapiens; identical to SEQ ID NO: 138797

SEQ ID NO: 180762 - RNA, 64 nt, Homo Sapiens; identical to SEQ ID NO: 138798

SEQ ID NO: 180763 - RNA, 64 nt, Homo Sapiens; identical to SEQ ID NO: 138799

SEQ ID NO: 180764 - RNA, 64 nt, Homo Sapiens; identical to SEQ ID NO: 138800

SEQ ID NO: 180765 - RNA, 64 nt, Homo Sapiens; identical to SEQ ID NO: 138801

SEQ ID NO: 180766 - RNA, 64 nt, Homo Sapiens; identical to SEQ ID NO: 138802

SEQ ID NO: 180767 - RNA, 64 nt, Homo Sapiens; identical to SEQ ID NO: 138803

SEQ ID NO: 180768 - RNA, 64 nt, Homo Sapiens; identical to SEQ ID NO: 138804

SEQ ID NO: 180769 - RNA, 64 nt, Homo Sapiens; identical to SEQ ID NO: 138805

SEQ ID NO: 180770 - RNA, 64 nt, Homo Sapiens; identical to SEQ ID NO: 138806

SEQ ID NO: 180771 - RNA, 64 nt, Homo Sapiens; identical to SEQ ID NO: 138807

SEQ ID NO: 180772 - RNA, 64 nt, Homo Sapiens; identical to SEQ ID NO: 138808

SEQ ID NO: 180773 - RNA, 64 nt, Homo Sapiens
ccccagcaaggaucuucccacuuccugcucccuguguucccacccuccaguguuggcacaggcc

SEQ ID NO: 180774 - RNA, 64 nt, Homo Sapiens
gcacauccuguuguguuuaagucaccagauauuuuguucccaucaguuuagcccagagauagac

SEQ ID NO: 180775 - RNA, 64 nt, Homo Sapiens
uaacuccaggccuugcuuuuauuagugaguguccuguucccagugcccgguuauuuaugauuaa

SEQ ID NO: 180776 - RNA, 64 nt, Homo Sapiens
uggauuuucaguaaccaacuuggaaagcuguauuuguucccaugauucagcaaacaaugaguac

SEQ ID NO: 180777 - RNA, 64 nt, Homo Sapiens
auuacagggaaugcuuagaagaguauucuuacacuguucccagucaguucauagucaugauagu

SEQ ID NO: 180778 - RNA, 64 nt, Homo Sapiens
uagguucuaagugccaucaacuaugugugauuucuguucccaacguggagauuucuaaaauauu

SEQ ID NO: 180779 - RNA, 64 nt, Homo Sapiens
ccaaagagagucacuuuugaaggacugugcugguuguucccagagacugagcaagcgcuucagg

SEQ ID NO: 180780 - RNA, 64 nt, Homo Sapiens
uggugaggugagauuguggcgcuuugguuguauguguucccaagccuaaagauuuuaccuccca

SEQ ID NO: 180781 - RNA, 64 nt, Homo Sapiens
acaauuaugggauacucuagucuacuuauacuuguguucccaucugucugccauccucugaagg

SEQ ID NO: 180782 - RNA, 64 nt, Homo Sapiens
caaucuaaguucugccacaaguacccguggugucuguucccacaacaauggcccuuucacaagc

SEQ ID NO: 180783 - RNA, 64 nt, Homo Sapiens
gcagagaguuucugugagucgacuuuccucucuuuguucccaggauuagcagguuucuugcaaa

SEQ ID NO: 180784 - RNA, 64 nt, Homo Sapiens
ugugucucccaagccugcuaaccuccacccuguuuguucccacauucagauggaacccccaacc

SEQ ID NO: 180785 - RNA, 64 nt, Homo Sapiens
uccucaucuggcacuaugcaccgccccccuccccuguucccacuccaaguggaaaaauacuuuc

SEQ ID NO: 180786 - RNA, 64 nt, Homo Sapiens
cuuccucucucucgaggccagggcuuuucccuacuguucccacgcccucuccugcgagacccag

SEQ ID NO: 180787 - RNA, 64 nt, Homo Sapiens
aagacugaggcaggccaggggucugccaguaacauguucccauguacagacacgguccccacac

SEQ ID NO: 180788 - RNA, 64 nt, Homo Sapiens
gucagugcuucugggcccagcuaaggaagccaucuguucccagcagaggagagcugcugcgcug

SEQ ID NO: 180789 - RNA, 64 nt, Homo Sapiens
aggccccuggaggucaagcuuggccuuugccuccuguucccaucccccagcccuggcuccuagg

SEQ ID NO: 180790 - RNA, 64 nt, Homo Sapiens
gaggugcagggccuucucugaccccugccugagcuguucccagggcuggagcagguguacccug

SEQ ID NO: 180791 - RNA, 64 nt, Homo Sapiens
aaagacauaaucuucuuuuuuccaguucuaccgauguucccacaguuugcuaaggauaaugguc

SEQ ID NO: 180792 - RNA, 64 nt, Homo Sapiens
uuugcuaaggauaauggucuaguauuugguuuucuguucccaugacuuauaagugaggacaugc

SEQ ID NO: 180793 - RNA, 64 nt, Homo Sapiens
cuaggcaaguucucugaggcagaaggggguucccuguucccagagucugcagccaucagcaagg

SEQ ID NO: 180794 - RNA, 64 nt, Homo Sapiens
uggccucgaccagcuuagagguuucucacaccucuguucccagggccccgcucagggcccagca

SEQ ID NO: 180795 - RNA, 64 nt, Homo Sapiens
acauuuuccuguaagcacucagauuuggggggccuguucccagccucauugccuguuuauggcc

SEQ ID NO: 180796 - RNA, 64 nt, Homo Sapiens
gauccugcagagcaugucagccaagguucucuucuguucccaugauuguuaaaaagaugcuccu

SEQ ID NO: 180797 - RNA, 64 nt, Homo Sapiens
ugccuaguuagugugguuggcaaauuuaggagcuuguucccauugccaaauggauuuagaaauu

SEQ ID NO: 180798 - RNA, 64 nt, Homo Sapiens
augaagaggacucauaaguaaauuccuaacauuuuguucccauuaccagaagcaaagcugcugc

SEQ ID NO: 180799 - RNA, 64 nt, Homo Sapiens
acuggguugcuauccuuuuggauagcaaccacugguuugcaaccguugcuauccucuugcuggg

SEQ ID NO: 180800 - RNA, 64 nt, Homo Sapiens
agugaaacuaguguauauuccaggaaaaagcaagguuugcaaaguugggugcugacuucaggga

SEQ ID NO: 180801 - RNA, 64 nt, Homo Sapiens
uuuaugagauauuccuguauccauaccccagcuuguuugcaauuuauaaaccuccccuucaaaa

SEQ ID NO: 180802 - RNA, 64 nt, Homo Sapiens
gauuauaaaaaauguuuuccauuugaacuuuacaguuugcaaaagugcuuuuauacauuuucua

SEQ ID NO: 180803 - RNA, 64 nt, Homo Sapiens
gcuacagccaaauggcaucucacuuuuuaaagacguuugcaauuauuaguugauucacaguaca

SEQ ID NO: 180804 - RNA, 64 nt, Homo Sapiens
uuguuagaucaaccuccaacugcacaaacaauauguuugcaaacagacacuucccugcauuaac

SEQ ID NO: 180805 - RNA, 64 nt, Homo Sapiens
uagaaaaagauucucaucacaauuauauuagucuguuugcaaagugggaggaaaacucaguaag

SEQ ID NO: 180806 - RNA, 64 nt, Homo Sapiens
ugguguguuuucagcccccucacagcacuuuguaguuugcaaauaaacccaugccuuacauuua

SEQ ID NO: 180807 - RNA, 64 nt, Homo Sapiens
ccagccuguagacuuccaguccuauuuuucuuugguuugcaacaugacauaaagugcccuucca

SEQ ID NO: 180808 - RNA, 64 nt, Homo Sapiens
uuuaaaaucuuccuacacacaucuagacguucaaguuugcaaaucaguuuuuagcaagaaaaca

SEQ ID NO: 180809 - RNA, 64 nt, Homo Sapiens
ggguaacaugacucuuguuggauuguuauuuuuuguuugcaauggggaauuuauaagaagcauc

SEQ ID NO: 180810 - RNA, 64 nt, Homo Sapiens
uuguauguuucauugccaaagagacugcaucagaguuugcaauuaacaguauaugccaaucacu

SEQ ID NO: 180811 - RNA, 64 nt, Homo Sapiens
aacagaccuuaaacauacagccauccaggccuugguuugcaagccugaccaguacauuuuauaa

SEQ ID NO: 180812 - RNA, 64 nt, Homo Sapiens
gguucaugaggucucuuaucaaaaauauuacucaguuugcaagacugcauuguaacuuuaacau

SEQ ID NO: 180813 - RNA, 64 nt, Homo Sapiens
cuauagauauucauauaaaacaagugcacgugaaguuugcaaaaugcuuuaaggccuuccuuuc

SEQ ID NO: 180814 - RNA, 64 nt, Homo Sapiens; identical to SEQ ID NO: 172311

SEQ ID NO: 180815 - RNA, 64 nt, Homo Sapiens; identical to SEQ ID NO: 172312

SEQ ID NO: 180816 - RNA, 64 nt, Homo Sapiens; identical to SEQ ID NO: 172313

SEQ ID NO: 180817 - RNA, 64 nt, Homo Sapiens; identical to SEQ ID NO: 172314

SEQ ID NO: 180818 - RNA, 64 nt, Homo Sapiens; identical to SEQ ID NO: 172315

SEQ ID NO: 180819 - RNA, 64 nt, Homo Sapiens; identical to SEQ ID NO: 172316

SEQ ID NO: 180820 - RNA, 64 nt, Homo Sapiens; identical to SEQ ID NO: 172317

SEQ ID NO: 180821 - RNA, 64 nt, Homo Sapiens; identical to SEQ ID NO: 172318

SEQ ID NO: 180822 - RNA, 64 nt, Homo Sapiens
aaugagaguuccuuugcuuuaaccauuccuggaugccugcaaaguaaggaauaaugcaguuuuu

SEQ ID NO: 180823 - RNA, 64 nt, Homo Sapiens
auauaacuugaauaucugguacuaguuuuuucacgccugcaaucuuggagucuagguugccuug

SEQ ID NO: 180824 - RNA, 64 nt, Homo Sapiens
cuuccccgaggcccacucggccuggccuuccucugccugcaagugagcagggaugggcugggga

SEQ ID NO: 180825 - RNA, 64 nt, Homo Sapiens
auuuccucugggcaggacucucuggccuucuguggccugcaaugccaggccaugugccccucug

SEQ ID NO: 180826 - RNA, 64 nt, Homo Sapiens
gaaggaccuugcacugccuaccgagcucccucaugccugcaauuuaaauaccgagguguguucu

SEQ ID NO: 180827 - RNA, 64 nt, Homo Sapiens
ccagcauauggaugcccuccccuuggagggcccagccugcaaaccccaucugauaccacacaug

SEQ ID NO: 180828 - RNA, 64 nt, Homo Sapiens
ugagccagugcuuuaauggccgguuugaaaauaugccugcaaucugauacuauccaguuacugc

SEQ ID NO: 180829 - RNA, 60 nt, Homo Sapiens
uuugaauuuuaaaucuaaauugguuguccugccugcaauagucgaagagcaucccaguaa

SEQ ID NO: 180830 - RNA, 64 nt, Homo Sapiens
gcugccugcccacacagguucugcccguaaacacgccugcaaacaacacgccugcaaacgcugc

SEQ ID NO: 180831 - RNA, 64 nt, Homo Sapiens
gcugccugcccguaaacacgcugccgguaaacacgccugcaaacaacacgccugcaaacgcugc

SEQ ID NO: 180832 - RNA, 64 nt, Homo Sapiens
gcugccugccgguaaacacgcugcauguaaacacgccugcaaacggucucacauggugcuacgc

SEQ ID NO: 180833 - RNA, 64 nt, Homo Sapiens
agccauuucuuguugugccccuuuccaagauacagccugcaagugguagcaagaagugauuaga

SEQ ID NO: 180834 - RNA, 64 nt, Homo Sapiens
gcuucaguuuuacucugcugcaaaaugaaggcgggccugcaagccgacuacaccuacggaggcu

SEQ ID NO: 180835 - RNA, 64 nt, Homo Sapiens
gaaccaacagacccuaugcuucucuguggguguggccugcaaaguuugcuuuuagugcuggccc

SEQ ID NO: 180836 - RNA, 64 nt, Homo Sapiens
agccuguagcauggcaaaucgcuggccuuccccagccugcaaggggcuccagcccaaugcccca

SEQ ID NO: 180837 - RNA, 64 nt, Homo Sapiens
gaaguggaccuugacuuccucuuccuucugauucugccugaauagcugagagguuccagcaaaa

SEQ ID NO: 180838 - RNA, 64 nt, Homo Sapiens
cuuccuccccagcucacgcugcuguauucugugcugccugaacugaagaaauaaaauccagaau

SEQ ID NO: 180839 - RNA, 64 nt, Homo Sapiens
ccaaagcuagagcuucuagagucucuuacugaagugccugaaacacauaggaacaagggggaaa

SEQ ID NO: 180840 - RNA, 64 nt, Homo Sapiens
uccuggggaaacauggcuugcaaaggaaaacaggugccugaauuucauaagccaggaaaugaaa

SEQ ID NO: 180841 - RNA, 64 nt, Homo Sapiens
ggaaauacaucagaucugcaacacagaaaugcucugccugaaauuuccaccaugccuaggacuc

SEQ ID NO: 180842 - RNA, 64 nt, Homo Sapiens
accauauucuguugacagccagcucacaguuucuugccugaagcuuggugcacccuccagugag

SEQ ID NO: 180843 - RNA, 64 nt, Homo Sapiens
acaagccuucccguccuugccccauaccacguugugccugaagaagaaaaccagguuucuucuc

SEQ ID NO: 180844 - RNA, 64 nt, Homo Sapiens
aaugagauuuuauuaucccucauggauccucuggugccugaagaagagaaucaaagccuuguca

SEQ ID NO: 180845 - RNA, 64 nt, Homo Sapiens
cugaaugacagacaaucuuauguagcaaagauuaugccugaaaaggaaaauuauucagggcagc

SEQ ID NO: 180846 - RNA, 64 nt, Homo Sapiens
gaaaaauuucuauucuuuuuuuugcauccaauugugccugaacuuuuaaaauauguaaaugcug

SEQ ID NO: 180847 - RNA, 64 nt, Homo Sapiens
uagccaugguuucauucuuaucaguccaacccuuugccugaaacauugaaucuuguuaaaccac

SEQ ID NO: 180848 - RNA, 64 nt, Homo Sapiens
gcccagccgucaccagacaacagaauaaucaaucugccugaaaaucccuccuccuuguccuaca

SEQ ID NO: 180849 - RNA, 64 nt, Homo Sapiens
aggucuguauuucuauuugaugucacuuuccuuuugccugaaggacuuuuucugcuggugauaa

SEQ ID NO: 180850 - RNA, 64 nt, Homo Sapiens
ugcuggugauaaacucuuucaguguuuguauauaugccugaaaaaguauuuugccuucauuuuu

SEQ ID NO: 180851 - RNA, 64 nt, Homo Sapiens
ucauuuaauuuguucaucugagaauuuuuuuuuuugccugaaaacccauuaaaagaaaacgugc

SEQ ID NO: 180852 - RNA, 64 nt, Homo Sapiens
augaauggacuuuaacaauuguuguuacaaacugugccugaaucuuauuauuuaaaucacuuca

SEQ ID NO: 180853 - RNA, 64 nt, Homo Sapiens; identical to SEQ ID NO: 147168

SEQ ID NO: 180854 - RNA, 64 nt, Homo Sapiens; identical to SEQ ID NO: 147169

SEQ ID NO: 180855 - RNA, 64 nt, Homo Sapiens; identical to SEQ ID NO: 147170

SEQ ID NO: 180856 - RNA, 64 nt, Homo Sapiens; identical to SEQ ID NO: 147171

SEQ ID NO: 180857 - RNA, 64 nt, Homo Sapiens; identical to SEQ ID NO: 147172

SEQ ID NO: 180858 - RNA, 64 nt, Homo Sapiens; identical to SEQ ID NO: 147173

SEQ ID NO: 180859 - RNA, 64 nt, Homo Sapiens; identical to SEQ ID NO: 147174

SEQ ID NO: 180860 - RNA, 64 nt, Homo Sapiens; identical to SEQ ID NO: 147175

SEQ ID NO: 180861 - RNA, 64 nt, Homo Sapiens; identical to SEQ ID NO: 147176

SEQ ID NO: 180862 - RNA, 64 nt, Homo Sapiens; identical to SEQ ID NO: 147177

SEQ ID NO: 180863 - RNA, 64 nt, Homo Sapiens; identical to SEQ ID NO: 147178

SEQ ID NO: 180864 - RNA, 64 nt, Homo Sapiens; identical to SEQ ID NO: 147179

SEQ ID NO: 180865 - RNA, 64 nt, Homo Sapiens
cauaagucugauucuauuucuaugacuuugaauuuagaaucacuuaaagcuuuuauaaagaauc

SEQ ID NO: 180866 - RNA, 64 nt, Homo Sapiens
uaugaaagcucuaaauuuaaaauaaauuuagagauagaaucaugguacauuauuguuucaguau

SEQ ID NO: 180867 - RNA, 64 nt, Homo Sapiens
cuaguuaugcuccuuuauauuauaaguaagggaauagaaucaauaagacaguuucugcccaaag

SEQ ID NO: 180868 - RNA, 64 nt, Homo Sapiens
auugguuuuguuuucaauuuuuauucacucuucauagaaucacaauuaccuuuauauaucauau

SEQ ID NO: 180869 - RNA, 64 nt, Homo Sapiens
auagaaccuuuagauacuccucucaaauuuucuauagaaucaaggaagaggcaauucauuaaac

SEQ ID NO: 180870 - RNA, 64 nt, Homo Sapiens
ugggaaagggguugggugggaauaaaauacuggguagaaucaaaaaacucagucuuccaacugc

SEQ ID NO: 180871 - RNA, 64 nt, Homo Sapiens
uauuuuaaaugagacaaucacaaucauauuauuuuagaaucauucauuuacuauuuaaaugaga

SEQ ID NO: 180872 - RNA, 64 nt, Homo Sapiens
uacuauuuaaaugagacaaugauauacauuauuuuagaaucauuuucuuuggugaggcaagaag

SEQ ID NO: 180873 - RNA, 64 nt, Homo Sapiens
cuaucacagggagauaggcacaggcuguuaucuuuagaaucaaguccugguuucugaguaaagg

SEQ ID NO: 180874 - RNA, 64 nt, Homo Sapiens
uucguauugcccuuuuaaaauacuuuuuauguauuagaaucauacuaaauucuugcugcccuca

SEQ ID NO: 180875 - RNA, 64 nt, Homo Sapiens
gaaauguucuacaucucugaaccuucugauaacccccaaauacaauuuuguuuuuaaauuaugc

SEQ ID NO: 180876 - RNA, 64 nt, Homo Sapiens
gguagaguaagugugauauagcuuguauguaaaacccaaauaaauuaaaaucaaagugcagauu

SEQ ID NO: 180877 - RNA, 64 nt, Homo Sapiens
uuagcacacaguuaaauuauauuuacauccuagacccaaauaaauaggauuguguguauauuug

SEQ ID NO: 180878 - RNA, 64 nt, Homo Sapiens
acaguuguuucacaauuauuauguagauaugaugcccaaauaucauuuuuaguauaucuugucg

SEQ ID NO: 180879 - RNA, 64 nt, Homo Sapiens
uccauggagucacaggcacacuaugacuucugcucccaaauacauaugaccauauguaaauacc

SEQ ID NO: 180880 - RNA, 64 nt, Homo Sapiens
auuaaaaacacaugaaaugaauaacaaaacaagacccaaauagaguuuauuuuauucucagagu

SEQ ID NO: 180881 - RNA, 64 nt, Homo Sapiens
uuuguguguaaacuguuuggcccuggauguuucucccaaauaaauuccucucuuguccccuagu

SEQ ID NO: 180882 - RNA, 64 nt, Homo Sapiens
ugcgcugcuaccgaugccucaaccacuuccauuccccaaauaccugucaauugggaacccccuc

SEQ ID NO: 180883 - RNA, 64 nt, Homo Sapiens
gcucuaacuugaagccacauccuacagauggcagcccaaauagcacaugggcaauuggcaccau

SEQ ID NO: 180884 - RNA, 64 nt, Homo Sapiens
acgaaaaacuuugccucugaugcucagccccacccccaaauagcacacaagcuuguuaacccca

SEQ ID NO: 180885 - RNA, 64 nt, Homo Sapiens
uaagauguaguucauguuuuucuguagcacugggcccaaauauucuuuguaaagaaaaucgcug

SEQ ID NO: 180886 - RNA, 64 nt, Homo Sapiens
ugcugggauuacaggcgugagccaccaugcccggcccaaauauuuuuuauucaggaugguauaa

SEQ ID NO: 180887 - RNA, 64 nt, Homo Sapiens
aaacaaagcaccaauuagcagagaauuuuuaucacccaaauaagguguccacuguuuaauucca

SEQ ID NO: 180888 - RNA, 64 nt, Homo Sapiens
acuuuauuauuagcuugggauuaaacuuaucuuucccaaauauauuuucauguaauguuaagag

SEQ ID NO: 180889 - RNA, 64 nt, Homo Sapiens; identical to SEQ ID NO: 87044

SEQ ID NO: 180890 - RNA, 64 nt, Homo Sapiens; identical to SEQ ID NO: 87045

SEQ ID NO: 180891 - RNA, 64 nt, Homo Sapiens
gccagauggggccucuguuucggagacgggaccgggccgcuagaugggcauggggugggccucu

SEQ ID NO: 180892 - RNA, 64 nt, Homo Sapiens
gaugucgaaaucuuuauuccugguuaggaaggugggccgcuacccuucuuucccuuuagaaaac

SEQ ID NO: 180893 - RNA, 64 nt, Homo Sapiens
accaggcuacucuuauuuuaggaguugcuuggguggccgcuaaccaaguggaaacuaggagcag

SEQ ID NO: 180894 - RNA, 64 nt, Homo Sapiens
uugcugauggguaguaccuggcaccaacucaccuggccgcuaagaauucacccgaagcgcuucu

SEQ ID NO: 180895 - RNA, 64 nt, Homo Sapiens
aguucugggauuaaaugcgugagccaccaugcccggccgcuauugcucuuuuuaacuucauuug

SEQ ID NO: 180896 - RNA, 60 nt, Homo Sapiens
agcucagccucugccugugacccgccgcccggccgcuagacugacuucgcgcagcggugg

SEQ ID NO: 180897 - RNA, 64 nt, Homo Sapiens
gcuguugccaugucaucugacuguggccccaucuggccgcuagcacgcuuccugcucagagcag

SEQ ID NO: 180898 - RNA, 64 nt, Homo Sapiens
gcuaagguaggagccagagagcccaaucccucuuggccgcuaagaguccaguggaccacagagg

SEQ ID NO: 180899 - RNA, 64 nt, Homo Sapiens
gcgagggcuccgaggaugccacgggggcaccuucggccgcuacugguggcuggcugcaagugug

SEQ ID NO: 180900 - RNA, 64 nt, Homo Sapiens
uggccuaggacauuaggauuccuuccacggcuccggccgcuaggacccugccaggucccgcgca

SEQ ID NO: 180901 - RNA, 64 nt, Homo Sapiens
ugguggcgcugggccacgcgacaaggucauccggggccgcuaccucccgugugucaccagugcc

SEQ ID NO: 180902 - RNA, 64 nt, Homo Sapiens
acgagcccugccuuggcuguggagaagcacuccaggccgcuagcagaugggacuggcauuccag

SEQ ID NO: 180903 - RNA, 64 nt, Homo Sapiens
guaaaagccugggcucccuccuuugcuguucuggggccgcuauuaaacuuuauucggaaccuuc

SEQ ID NO: 180904 - RNA, 64 nt, Homo Sapiens
ggccugaggaugagcuggaacccguugaggaugaggccgcuagauaccuguucagugucccggg

SEQ ID NO: 180905 - RNA, 64 nt, Homo Sapiens
caggguagcacugggaacaggagccugggaaggaggccgcuaugaccccuccugcgcugcccca

SEQ ID NO: 180906 - RNA, 64 nt, Homo Sapiens
gucagaugcaaucugugggccgccccucuccccuggccgcuaagcagccuccauugauuuccgc

SEQ ID NO: 180907 - RNA, 64 nt, Homo Sapiens
caugguagaggcuagaggaacgagagaugguggaggccgcuaagauuggagagagcagugacug

SEQ ID NO: 180908 - RNA, 64 nt, Homo Sapiens
gugcuuccacguuuucugcuucgagugcgugcggggccgcuaugaggcccgccagaggaagugc

SEQ ID NO: 180909 - RNA, 64 nt, Homo Sapiens
cucccugagcuuucuggcuuugaggccugggcagggccgcuagcuaggggugcagggucagugc

SEQ ID NO: 180910 - RNA, 64 nt, Homo Sapiens
cucucccaggucucagcucuggguggggagcaguggccgcuaccgacagcgcaugucccgcucu

SEQ ID NO: 180911 - RNA, 64 nt, Homo Sapiens
uguuuccaggcuuccugugugauccuggcccuccggccgcuagagagaggauugggaaacccca

SEQ ID NO: 180912 - RNA, 64 nt, Homo Sapiens
cucugugccgcggagguccaggaggaaacggggcggccgcuaggccucaagucccgaccgugga

SEQ ID NO: 180913 - RNA, 64 nt, Homo Sapiens
auccacuugucugugucugggaagggauggccaaggccgcuaggguccuuaccccucaggauca

SEQ ID NO: 180914 - RNA, 65 nt, Homo Sapiens
aaaugacacugaguugggcaaaacccaggacaucuccuggcuaagccucugcuuccguacuaugg

SEQ ID NO: 180915 - RNA, 65 nt, Homo Sapiens
gugggcagaucauaaggucgggagauuaagaccauccuggcuaacacggugaaaccccgucucua

SEQ ID NO: 180916 - RNA, 65 nt, Homo Sapiens
acacuccuaagcaguauuauuuuaaaauccuuuacccuggcuaccuccccuacccggguuccccu

SEQ ID NO: 180917 - RNA, 65 nt, Homo Sapiens
ggagaagugucagacacuagagagccccuucugguccuggcuagggcaaauuuuagacaacuauu

SEQ ID NO: 180918 - RNA, 65 nt, Homo Sapiens
cugcugaggucgcuguggagcacccucgcuccucuccuggcuacuagcucuggcccugcaccuac

SEQ ID NO: 180919 - RNA, 65 nt, Homo Sapiens
ugagagcucuuguuauucagagcuccaagacuagaccuggcuaacaaacauaggagacaaaguua

SEQ ID NO: 180920 - RNA, 65 nt, Homo Sapiens
ucucaaguagcugggacuacaggugcaccaccacaccuggcuaauuuuuguauuuuuuguaaaga

SEQ ID NO: 180921 - RNA, 65 nt, Homo Sapiens
cugaguagcugugauuacaggcaugcgccaccaugccuggcuaauuucauauuuuuuaguagaga

SEQ ID NO: 180922 - RNA, 65 nt, Homo Sapiens
aucagaaugaacuguguaccugauuuguucucugaccuggcuagguagggagggggugguuaucg

SEQ ID NO: 180923 - RNA, 65 nt, Homo Sapiens
gcuacaaagucccacgucccuguccucagugugacccuggcuagugguaaggcugccgacucaag

SEQ ID NO: 180924 - RNA, 65 nt, Homo Sapiens
acucuaguagauuuugaauccugccucugccauuuccuggcuaugaggugucuugagaaauuuac

SEQ ID NO: 180925 - RNA, 65 nt, Homo Sapiens
gccccaagcuucccucggagaagugagaggcucucccuggcuagauccucaucucaauagcaccu

SEQ ID NO: 180926 - RNA, 65 nt, Homo Sapiens
caggcaaucaccugaggucaggaguucaagaccagccuggcuaacaugugaaacuaauaauaaua

SEQ ID NO: 180927 - RNA, 65 nt, Homo Sapiens
ugucaguguucuaaguuucaggcauuuuuauuuuuccuggcuaaacguuggugaaaguuauaacc

SEQ ID NO: 180928 - RNA, 65 nt, Homo Sapiens
aggagaagcacaugguugcccuuuuguccuugcucccuggcuagggaaagcugcuaguggucagc

SEQ ID NO: 180929 - RNA, 65 nt, Homo Sapiens
uugucacaacccucuguuucucuuugacuaagugcccuggcuacaggaauuacacaguucucuuu

SEQ ID NO: 180930 - RNA, 65 nt, Homo Sapiens
gaggcgggcggaucacgaggucagaucaagaacauccuggcuaacacggugaaacuccaucucua

SEQ ID NO: 180931 - RNA, 65 nt, Homo Sapiens
cugaguagcugggacuacaggugugcaccaccacaccuggcuaauucuucuuaaaauuuuuuugu

SEQ ID NO: 180932 - RNA, 65 nt, Homo Sapiens
guaaggauggacuggauauuaccaucauccaccauccuggcuaccagauggaaccuucucuucuu

SEQ ID NO: 180933 - RNA, 65 nt, Homo Sapiens
cucccuuccugcuaauguguaaaauacauacuugcccuggcuaccucaccgggcuguuauugcug

SEQ ID NO: 180934 - RNA, 65 nt, Homo Sapiens
uggcgugcuguugcaaaguuuucacgucauuguuuccuggcuaguucauuucauuaaguggcuac

SEQ ID NO: 180935 - RNA, 65 nt, Homo Sapiens
ccccauagcugggacuaggggugcaugccagcauaccuggcuacguugacucuuaaaaucuaugu

SEQ ID NO: 180936 - RNA, 65 nt, Homo Sapiens
guggacagaucacgaggucaggaguucgagaccauccuggcuaacacggugaaacccaaucucua

SEQ ID NO: 180937 - RNA, 65 nt, Homo Sapiens
augagaacugccaggugacgcccucgcugcuccuaccuggcuacuaaacaucgacuucgguucac

SEQ ID NO: 180938 - RNA, 65 nt, Homo Sapiens
acccagaggaaggaggcacugcugaauggcuauggccuggcuaagaaggugauuagucaguaggg

SEQ ID NO: 180939 - RNA, 65 nt, Homo Sapiens
cacggguggcaggaauucagaggcuggccuugugcccuggcuaccugucuccauucuaaccugac

SEQ ID NO: 180940 - RNA, 65 nt, Homo Sapiens
uuuugagauuuugagccauggaacuuacuuguucaccuggcuaagaacucauggccacuguggaa

SEQ ID NO: 180941 - RNA, 65 nt, Homo Sapiens
uuuuuuguauuuuuaguagagcgugugucaccacgccuggcuaauccgaguagcugggauuacag

SEQ ID NO: 180942 - RNA, 65 nt, Homo Sapiens
cuuacuguacgaggcuuuguuuaaaguggcuaacaccuggcuacuaguuuugaucauauuuucua

SEQ ID NO: 180943 - RNA, 65 nt, Homo Sapiens
ccgagacccaggaggcgcucgguaacagcuggaccccuggcuaccucugcaccguccaguuggug

SEQ ID NO: 180944 - RNA, 65 nt, Homo Sapiens
acagugaaacguguuuuuacggagaucgagaccauccuggcuaacgcggguggaucacgagguca

SEQ ID NO: 180945 - RNA, 65 nt, Homo Sapiens
auggugaaacccugucucuaggagaucgagaccauccuggcuaacgggggcggaucgugaaguca

SEQ ID NO: 180946 - RNA, 65 nt, Homo Sapiens
uuuuguauuuuuaguagagagugccugccaccacgccuggcuaaucugaguaccugggauuacag

SEQ ID NO: 180947 - RNA, 65 nt, Homo Sapiens
acgguaaaacccugucucuaggagaucgagacuauccuggcuaacgcaggcggcucacgagguca

SEQ ID NO: 180948 - RNA, 65 nt, Homo Sapiens
uuguuaugagguuuuguuaucccagaggcugggucccuggcuaccucccaauaaaggaaugggga

SEQ ID NO: 180949 - RNA, 65 nt, Homo Sapiens
uuuuuuguauuuuuaguagagcacccgccaccacaccuggcuaauccaaguagcugggauuacag

SEQ ID NO: 180950 - RNA, 65 nt, Homo Sapiens
uuucuguauuuuuaguagaggcaugcaccaccaugccuggcuaauccgaguagcugggguuacag

SEQ ID NO: 180951 - RNA, 65 nt, Homo Sapiens
uuuuuuguguguuuuuaguagcguccgccaccaugccuggcuaauucgaguagcugggauuauag

SEQ ID NO: 180952 - RNA, 65 nt, Homo Sapiens
gaacccagcuacugacaugcgggguucauuauaccccuggcuagaaaagagagaccaagaucaga

SEQ ID NO: 180953 - RNA, 65 nt, Homo Sapiens
uuuuacuuuuuuuuuuuuuugugugagccaccacaccuggcuaauccgaguagggaggaccacag

SEQ ID NO: 180954 - RNA, 65 nt, Homo Sapiens
acccaaacauaugcacauucaaucagagaccaggcccuggcuaaguucuaggguaugggaaaucc

SEQ ID NO: 180955 - RNA, 65 nt, Homo Sapiens
uuuguauuuuuaguagagacgcaugugccacaacgccuggcuaauccagguagcugggauuacag

SEQ ID NO: 180956 - RNA, 65 nt, Homo Sapiens
aaggugaaaccccgucucuaggagaucgagaccauccuggcuaacgcggguggaucaugagguca

SEQ ID NO: 180957 - RNA, 65 nt, Homo Sapiens
aauaaucacgaggguugggucuuccuuagcuucacccuggcuagaauccuaccaccuacugcuac

SEQ ID NO: 180958 - RNA, 65 nt, Homo Sapiens
aaauuauugaaccaaaaugauaaauaugacuuuauccuggcuauaggacagaaaauuauaaauua

SEQ ID NO: 180959 - RNA, 65 nt, Homo Sapiens
acggugaaaccccgucucuaggagaucgagaccauccuggcuaacacggguggaucacgagguca

SEQ ID NO: 180960 - RNA, 65 nt, Homo Sapiens
uuuuuguauuuuuaguagaggugcgcaccaccacgccuggcuaauccgaguaccugggacuauau

SEQ ID NO: 180961 - RNA, 65 nt, Homo Sapiens
auggugaaacccuguaucugggaguucuagaccagccuggcuaaccagaugaucaccugagguca

SEQ ID NO: 180962 - RNA, 65 nt, Homo Sapiens
uuuuguauuuuuuaguagagaugugcaucaccaugccuggcuaauccgaguagcuaggauuacag

SEQ ID NO: 180963 - RNA, 65 nt, Homo Sapiens
gggcgagacucugucucaaagccacugcacuccagccuggcuacauugcagugagccgagaucac

SEQ ID NO: 180964 - RNA, 65 nt, Homo Sapiens
ucugcucauuauuucagaggcuuccuuucugcuagccuggcuaaacuccugcacagccccguccu

SEQ ID NO: 180965 - RNA, 65 nt, Homo Sapiens
acccagaacacuguccagaucuacaauuccagaauccuggcuaugguuauagcaaugcacagaua

SEQ ID NO: 180966 - RNA, 65 nt, Homo Sapiens
auggugaaaccccaucucuaggaguuaaagagcagccuggcuaacggcauaucaacuugaggcca

SEQ ID NO: 180967 - RNA, 65 nt, Homo Sapiens
cccugccugaauaaaguaaucacgcuguggcccugccuggcuagucugacuccccccaucccugc

SEQ ID NO: 180968 - RNA, 65 nt, Homo Sapiens
uuuuguguuuuuaguagagagugcgugccaccaugccuggcuaaucugaguagcugggauuacgg

SEQ ID NO: 180969 - RNA, 65 nt, Homo Sapiens
gcuuuuuacugcagaaugaagagcaccagcugcagccuggcuacuugcuuacagccgggcuucug

SEQ ID NO: 180970 - RNA, 65 nt, Homo Sapiens
aagggugaugguacuggaccccugaaggaacccauccuggcuagacugacuuuuccuaaugcuua

SEQ ID NO: 180971 - RNA, 65 nt, Homo Sapiens
ugcaugcuguuccuuuucuuugcauuggaaucaagccuggcuacccuugaagccaauucaguagg

SEQ ID NO: 180972 - RNA, 65 nt, Homo Sapiens
uuuuuguauuuuuaguagaggcgccugccagcacgccuggcuaauccaaguagcugggacuacag

SEQ ID NO: 180973 - RNA, 65 nt, Homo Sapiens
acagugaaaccccgucuccaggagaucaagaccauccuggcuaaccugaggugggcggcucacga

SEQ ID NO: 180974 - RNA, 65 nt, Homo Sapiens
uuuuuguauuuuuaguagagggcaccgccaccacgccuggcuaaucccgaguagcugggacugca

SEQ ID NO: 180975 - RNA, 65 nt, Homo Sapiens
uuccacuccuuugguuaauauuuaaaaagugcaacccuggcuaaaaaauaaaaguauauacaacu

SEQ ID NO: 180976 - RNA, 65 nt, Homo Sapiens
gcaggcggaucacgaggucaggagaucgagaccauccuggcuaacacggugaaaccccgucucua

SEQ ID NO: 180977 - RNA, 65 nt, Homo Sapiens
aaccacaugccuuuaaaacuaaacuguaauaauuaccuggcuaauuucagcuaagccuucaucau

SEQ ID NO: 180978 - RNA, 65 nt, Homo Sapiens
ccaacuagcugggauuacaggcacaagccaccaugccuggcuaaaauucuuuuguauuuuuacua

SEQ ID NO: 180979 - RNA, 65 nt, Homo Sapiens
ccuaguagcugggacuacagguaugcaccaccaugccuggcuaauuuuuuguauuuuuuguagag

SEQ ID NO: 180980 - RNA, 65 nt, Homo Sapiens
ccgaguagcugggacuacaggugugugccacuaugccuggcuaauuuuuguauuuuuuguagaga

SEQ ID NO: 180981 - RNA, 65 nt, Homo Sapiens
gcgggcggaucacgaggucaggagaucgagaccauccuggcuaacacggugaaaccccaucucua

SEQ ID NO: 180982 - RNA, 65 nt, Homo Sapiens
gaauguagcccucuccaaaucaaggaucuuuuggaccuggcuaauggaguguuugaaaacugaca

SEQ ID NO: 180983 - RNA, 65 nt, Homo Sapiens
uguuuuagaaguagauacaggcacugcucugaaaaccuggcuagccaaggauauucucagaaugu

SEQ ID NO: 180984 - RNA, 65 nt, Homo Sapiens
ccgaguagcugggacuacaggggcccgccaccacaccuggcuaauuuuuuaaaaauauuuuuagu

SEQ ID NO: 180985 - RNA, 65 nt, Homo Sapiens
cugaguagcugggauuacaggcacgcaccaccauaccuggcuaauuuuuguauuuugaguagaga

SEQ ID NO: 180986 - RNA, 65 nt, Homo Sapiens
ccuaguagcugggauuacaggcacacaccaccauaccuggcuaauuuuuguauuuuugguagaca

SEQ ID NO: 180987 - RNA, 65 nt, Homo Sapiens
gugggcggaucacgaggucaggagauggagaccauccuggcuaacacggugaaaccccuuaucua

SEQ ID NO: 180988 - RNA, 65 nt, Homo Sapiens
ccgaguagcugggacuacaggcgcccgccaccacgccuggcuaauuuuuuauauuuuuaguagag

SEQ ID NO: 180989 - RNA, 65 nt, Homo Sapiens
uggucaaaaagcuccuuggguuccucuacagccucccuggcuacaggcugcucauguuggggcuc

SEQ ID NO: 180990 - RNA, 65 nt, Homo Sapiens
gcuuauuagaaaauguccucuuggggguggcugcuccuggcuaauuaccugggaauaaaauguac

SEQ ID NO: 180991 - RNA, 65 nt, Homo Sapiens
acggugaaaccccgucucuaggagaucgagaccauccuggcuaacgcaggcggaucaugagauca

SEQ ID NO: 180992 - RNA, 65 nt, Homo Sapiens
acggugaaacccagccucuagaagaucgagaccauccuggcuaacgugggcagaucaugagguca

SEQ ID NO: 180993 - RNA, 65 nt, Homo Sapiens
uuauauuaauggggagaggguucuuccccccaaccccuggcuauuugaauaaaaccauagggagc

SEQ ID NO: 180994 - RNA, 65 nt, Homo Sapiens
acuugcugugaccuuauacaggucccacagcuuuuccuggcuaccuggaugugacucaaaugagg

SEQ ID NO: 180995 - RNA, 65 nt, Homo Sapiens
acagugaaacccugucucucggaguucgagaccauccuggcuaacgcggacagaucacgagguca

SEQ ID NO: 180996 - RNA, 65 nt, Homo Sapiens
caggguggcuucacccaucaugccccugagguucuccuggcuaguucagguguuaaggaagggga

SEQ ID NO: 180997 - RNA, 65 nt, Homo Sapiens
uuugcguuuauagucagguuuugcagauaagguccccuggcuaggcucugccuccugauccuguc

SEQ ID NO: 180998 - RNA, 65 nt, Homo Sapiens
ucacuccucugcugguagcaaccucuucugcaccgccuggcuaccacgcaggugugagaggagag

SEQ ID NO: 180999 - RNA, 65 nt, Homo Sapiens
gucacaggucaguacugcagcuccugcauugcugcccuggcuaugaacaucgacauuucugccuu

SEQ ID NO: 181000 - RNA, 65 nt, Homo Sapiens
auggugaaaccccgucucuaggagauggagaccauccuggcuaacgcaggcggaucacgagguca

SEQ ID NO: 181001 - RNA, 65 nt, Homo Sapiens
gagauaccgaagccuacuguccugggggucccucaccuggcuaggcggugcgggcagggagaaug

SEQ ID NO: 181002 - RNA, 65 nt, Homo Sapiens
agaucuggauuuuacccacucacuccaucaaagucccuggcuauaguucucaguuucuucaccau

SEQ ID NO: 181003 - RNA, 65 nt, Homo Sapiens
uuuuguauuuuuaguggagagugcacaccaccacgccuggcuaauccaaguagcugggacuaugg

SEQ ID NO: 181004 - RNA, 65 nt, Homo Sapiens
gugccucaacgguucggcucgagcccucgggagggccuggcuacuccguaaaccuagagcuucug

SEQ ID NO: 181005 - RNA, 65 nt, Homo Sapiens
ccgaguagcugggauuacaggugagcaccacuguaccuggcuagcuacuucuuuguuagaggauu

SEQ ID NO: 181006 - RNA, 65 nt, Homo Sapiens
cugaguagaugggacuguaggcaccugccacuaugccuggcuaauuuuuguguuuuuaguagaga

SEQ ID NO: 181007 - RNA, 65 nt, Homo Sapiens
aaagagcugagguucuugguggugucucccauuccccuggcuaauuucagacagcuguggucaag

SEQ ID NO: 181008 - RNA, 65 nt, Homo Sapiens
ccaaguagccaggacuauaggcaccugccaccaugccuggcuaauuuuuguauuuuuuuucuuuc

SEQ ID NO: 181009 - RNA, 65 nt, Homo Sapiens
ccaaguagcuaggacuacaggagcacaccaccacaccuggcuaauuuuuguauuuuuuguggaga

SEQ ID NO: 181010 - RNA, 65 nt, Homo Sapiens
ccaaguagcugggacuacaggugcccgccaccaugccuggcuaauauuuuuuauuuuuaguagag

SEQ ID NO: 181011 - RNA, 65 nt, Homo Sapiens
ggagcucuuggcuucagccagcccccagccagaguccuggcuaggacagugaccugaucuccucc

SEQ ID NO: 181012 - RNA, 65 nt, Homo Sapiens
cuccuugccucuccuggaaggugucuucucuauggccuggcuagagcugcaaaaaagggacacac

SEQ ID NO: 181013 - RNA, 65 nt, Homo Sapiens
gagagcuccaccguauuagcuccauuagcuuggagccuggcuagcaacacucacugucaguuagg

SEQ ID NO: 181014 - RNA, 65 nt, Homo Sapiens
ucugaguaacuggaacuacaggugugcacuccucgccuggcuaauuuuuuauuuuuuguacaggc

SEQ ID NO: 181015 - RNA, 65 nt, Homo Sapiens
guggguggaucacgaggucaggagaucgagaccauccuggcuaacacagugaaaccccgucucua

SEQ ID NO: 181016 - RNA, 65 nt, Homo Sapiens
ccgaguagcugggacuacaggcgcccgccaccaugccuggcuaauuuuuuauauuuuuaguagag

SEQ ID NO: 181017 - RNA, 65 nt, Homo Sapiens
ccgaguagcugggauuacaggugccugccaccaugccuggcuaauuuuuguauuuuuaguagagg

SEQ ID NO: 181018 - RNA, 65 nt, Homo Sapiens
cugaguagcuaggacuacagaugcucgccaccacaccuggcuaauuuuuuuuuuuugagacugag

SEQ ID NO: 181019 - RNA, 65 nt, Homo Sapiens
cugaguagcugggauuacaggcgugugccaccaugccuggcuaacuuuuguauuuuuaguagaga

SEQ ID NO: 181020 - RNA, 65 nt, Homo Sapiens
uuuacccugccccugccuugauuagacuccuagcaccuggcuaguuucuaacauguuuugugcag

SEQ ID NO: 181021 - RNA, 65 nt, Homo Sapiens
uuccugggugcgccuccaccucccuucugauguuuccuggcuaugguggggugggaaccucaguu

SEQ ID NO: 181022 - RNA, 65 nt, Homo Sapiens
uucaugugcugcuugaagagcuccuauuuuguacuccuggcuagaaugcuguggaacaaauacaa

SEQ ID NO: 181023 - RNA, 65 nt, Homo Sapiens
cugaauuacacuagaaaucagcugcaggugguagcccuggcuagaauagcaauugaagaaccacu

SEQ ID NO: 181024 - RNA, 65 nt, Homo Sapiens
cgaaaauuucuagaaaaagaaaaugaaacauuccaccuggcuacaggcuguugguuuuaccgacc

SEQ ID NO: 181025 - RNA, 65 nt, Homo Sapiens
uaacuaacuaacuuuuuguagcacccaccaccacgccuggcuaacccgaauggcugggacuacag

SEQ ID NO: 181026 - RNA, 65 nt, Homo Sapiens
uuuuuguuguugucguugaggccugcaccaccacaccuggcuaaaccugacuagcugggauugca

SEQ ID NO: 181027 - RNA, 65 nt, Homo Sapiens
uuaaacaaguucauacauuuuccuaccacugccuuccuggcuaucauuccuaucccuuguguuua

SEQ ID NO: 181028 - RNA, 65 nt, Homo Sapiens
uauuugauccuuuuaaauucaaaacauuuugcuuuccuggcuaauguguuauauauaauauguua

SEQ ID NO: 181029 - RNA, 65 nt, Homo Sapiens
guuucuauuuuuaguagagaaggcgugccaccaugccuggcuaauucccagguagcuaggauuac

SEQ ID NO: 181030 - RNA, 65 nt, Homo Sapiens
auggugaaaccccaucucuaggagauugagaccuuccuggcuaacgugggcaaaucaugagguca

SEQ ID NO: 181031 - RNA, 65 nt, Homo Sapiens
acagugaaaccccaucucuaggaggucgagaucauccuggcuaacgcaggcggaucacgagguca

SEQ ID NO: 181032 - RNA, 65 nt, Homo Sapiens
ugauggcagagccagagcuuaucacuuaaaugucaccuggcuaaccugagacuuaagggaacuga

SEQ ID NO: 181033 - RNA, 65 nt, Homo Sapiens
uuuuguauuuuuauuauagagcacacacuaccacgccuggcuaauccgaguagcugggauuacag

SEQ ID NO: 181034 - RNA, 65 nt, Homo Sapiens
uauagaguguacgacuguauuaacacggaggccugccuggcuacuuuuuuaacauauuguuaagu

SEQ ID NO: 181035 - RNA, 65 nt, Homo Sapiens
ccgaguagcugggauuccaggcgcccgccaccacgccuggcuaauuuuuuguauuuuuaguagag

SEQ ID NO: 181036 - RNA, 65 nt, Homo Sapiens
cucugagacagcaguaucacaggccagauguuguuccuggcuagauguuuacauuuguaagaaau

SEQ ID NO: 181037 - RNA, 65 nt, Homo Sapiens
cccaguagcugggacuacagacgugugccaccacgccuggcuaaaucuuuuuuguauuuuauuuu

SEQ ID NO: 181038 - RNA, 65 nt, Homo Sapiens
ccucccaaguagcugggauuacaggcagcaccacaccuggcuaauuuucauauuuuuaguagaga

SEQ ID NO: 181039 - RNA, 65 nt, Homo Sapiens
gagggaggaucacaaggucaggagaucgagaccauccuggcuaacacggugaaaccccaucucua

SEQ ID NO: 181040 - RNA, 65 nt, Homo Sapiens
cugaguagcugggacuauaggccuguaccgucaugccuggcuaauuuuuguauuuuuguagagac

SEQ ID NO: 181041 - RNA, 65 nt, Homo Sapiens
ccaaguagcugggauuacaggugccugccaccaugccuggcuaauuuuuuuguauuuuuaguaga

SEQ ID NO: 181042 - RNA, 65 nt, Homo Sapiens
gcccugaccacagcaucuucggcccuguggucggaccuggcuacauccacguccacacaguggcc

SEQ ID NO: 181043 - RNA, 63 nt, Homo Sapiens
gaaagaagaugccagaugacgaucuaagaguuaccuggcuacauucagcaggcugaugaauaa

SEQ ID NO: 181044 - RNA, 65 nt, Homo Sapiens
uuuuuguauuuuuaguagaggcacccgccacagugccuggcuaauccaaguagcugggacuacag

SEQ ID NO: 181045 - RNA, 65 nt, Homo Sapiens
auuacuuugaacauuaaugucugcagaaaauucuaccuggcuacaaaggcauauacuuugucuuu

SEQ ID NO: 181046 - RNA, 65 nt, Homo Sapiens
ccauguuggcuagccucuggaggugcuggcucuuuccuggcuacuccagaccauugucucagagc

SEQ ID NO: 181047 - RNA, 65 nt, Homo Sapiens
caccaccucaguguuguuccuuugggcgucuuguaccuggcuacgcguaagauaaacuggaaaua

SEQ ID NO: 181048 - RNA, 65 nt, Homo Sapiens
cuaauucccuguucuccugcgcuuaugccccuaccccuggcuaucgcugcaccugcuauuccuuu

SEQ ID NO: 181049 - RNA, 65 nt, Homo Sapiens
uuuuuuuuuccuguauuguugcauguacugcuaugccuggcuaauccaagcagcugggacuacag

SEQ ID NO: 181050 - RNA, 65 nt, Homo Sapiens
guuccauuuccgucauggugaagcaaaugaauuggccuggcuaccacuguggucgcgugcuacag

SEQ ID NO: 181051 - RNA, 65 nt, Homo Sapiens
augaauagcugggauuacaggugcccaccaccaugccuggcuaguuuuuguauuuuuaguagagg

SEQ ID NO: 181052 - RNA, 65 nt, Homo Sapiens
cugaguagcugggauuacaggugugccccaccacgccuggcuaauuuuuguaguuuuaguagaga

SEQ ID NO: 181053 - RNA, 65 nt, Homo Sapiens
gcggguggaucacgaggucaggagaucgagaccauccuggcuaacacggugaaacccgucucuac

SEQ ID NO: 181054 - RNA, 65 nt, Homo Sapiens
aagggcggaucacgaggucaggagauggagaccauccuggcuaacacggugagaccccgucuccg

SEQ ID NO: 181055 - RNA, 65 nt, Homo Sapiens
ccaucccugcccugcccacgugguauugcugggcuccuggcuagaugcaagcaagguggacaaga

SEQ ID NO: 181056 - RNA, 65 nt, Homo Sapiens
cugaguagcugggauuacaagcacgugucaccacgccuggcuaauuuuuguauuuuuaguauaga

SEQ ID NO: 181057 - RNA, 65 nt, Homo Sapiens
uuaagccucuggcccucagaggcuccucccuaucuccuggcuaguuaccacuaggcuaccagguc

SEQ ID NO: 181058 - RNA, 65 nt, Homo Sapiens
ugcgaucuggggagccccaucucgauauuuccaauccuggcuacuuuucuuagagaaaauaaguc

SEQ ID NO: 181059 - RNA, 65 nt, Homo Sapiens
ccaaguagcuuggacuauaggugcaugccaccaugccuggcuaaucuuuugcagcgaugagauuu

SEQ ID NO: 181060 - RNA, 65 nt, Homo Sapiens
gcgggcggaucacgaggucaggagauugagaccauccuggcuacgacggugaaaccccgucucua

SEQ ID NO: 181061 - RNA, 65 nt, Homo Sapiens
ggguggaucaccugaagucaggaguucgagaccauccuggcuaacacugugaaaccccgucucua

SEQ ID NO: 181062 - RNA, 65 nt, Homo Sapiens
agacccaggaagggcagcuccagccagaggaccuuccuggcuaugcaggugcacagcucuuaggc

SEQ ID NO: 181063 - RNA, 65 nt, Homo Sapiens
uguccagcugcuaagaucccuucaucugcacaagcccuggcuagauaugugugaauguguggcau

SEQ ID NO: 181064 - RNA, 65 nt, Homo Sapiens
uuugcaguaauuuuucuuuuuaucauuuuguuuguccuggcuaaacuuggaguuugaguauagua

SEQ ID NO: 181065 - RNA, 65 nt, Homo Sapiens
aguccagauccacagcuucucuugaagaaugaccaccuggcuacgccggcucuucgguggcaaca

SEQ ID NO: 181066 - RNA, 65 nt, Homo Sapiens
gugggcggaucacgaggucaggagaucgagaccauccuggcuaacagggugaaaccccaucgcua

SEQ ID NO: 181067 - RNA, 65 nt, Homo Sapiens
uuuuguguuuuuuguagagaaugcacaccaccacaccuggcuaaucugaguagcugggacuacag

SEQ ID NO: 181068 - RNA, 65 nt, Homo Sapiens
uuuaguauuuuuuguuacaggugugcgccaguacgccuggcuaguccaaguagcugggauuacag

SEQ ID NO: 181069 - RNA, 65 nt, Homo Sapiens
uuuuguauuuuucguagagagcauacaccaccacgccuggcuaugcccaaguagcuggauuacag

SEQ ID NO: 181070 - RNA, 65 nt, Homo Sapiens
uuuuuguauuuuuaguggaggcgccugccaccacgccuggcuaaucggaguagcugggacugcag

SEQ ID NO: 181071 - RNA, 65 nt, Homo Sapiens
aaacaagcguuuauuugaaucuaauugagccugugccuggcuagacuuggcuagaguuugaaaaa

SEQ ID NO: 181072 - RNA, 65 nt, Homo Sapiens
acggugaaaccccgucucuaggagaucgagaccauccuggcuaacgcgggcggaucacaagguca

SEQ ID NO: 181073 - RNA, 65 nt, Homo Sapiens
gcguuuucuaugaaaucuacguaaggacuugauaaccuggcuacagggggguaguuuacuuuguu

SEQ ID NO: 181074 - RNA, 65 nt, Homo Sapiens
acagugaaacccugucucuaggagauugagaccauccuggcuaacguggguggaucacaagguug

SEQ ID NO: 181075 - RNA, 65 nt, Homo Sapiens
uuuuguuuuucguagagauggugccugccacuaugccuggcuaauccaaguagcuaggauuacaa

SEQ ID NO: 181076 - RNA, 65 nt, Homo Sapiens
uuuguauuuuuaguagagacgcauaguccagcacgccuggcuaauccgaguaguugggauuagag

SEQ ID NO: 181077 - RNA, 65 nt, Homo Sapiens
ccauguagcugcaacuauaggugugugccacuacaccuggcuaauguuuuuaguuuuuuagagau

SEQ ID NO: 181078 - RNA, 65 nt, Homo Sapiens
uuaaccguuucaggaccacguuuauagcuucaggaccuggcuacguaauuauacuuaaaauaucc

SEQ ID NO: 181079 - RNA, 65 nt, Homo Sapiens
cugagcagcugggacuacaggcacacaccaccacaccuggcuaaguuuuguauuuuuuguagaga

SEQ ID NO: 181080 - RNA, 65 nt, Homo Sapiens
gggaaagcccugcuuugcuccaggcuccaagaucuccuggcuaagucagcaagugagaaaaugug

SEQ ID NO: 181081 - RNA, 65 nt, Homo Sapiens
agcugauuuuuuccaaagucuaaagacugagcucaccuggcuagauuguuguguguuuuguugaa

SEQ ID NO: 181082 - RNA, 65 nt, Homo Sapiens
gcaggcagaucacgacaucaggagaucgagaccauccuggcuaacacggugaaaccccgucucua

SEQ ID NO: 181083 - RNA, 65 nt, Homo Sapiens
gagggcggaucacaaggucaggagaucaagaccauccuggcuaacacggugaaaccccgucucua

SEQ ID NO: 181084 - RNA, 65 nt, Homo Sapiens
uaauuugugcaguugggagauguucagccuuagucccuggcuaauugccuguucuuuuccagccu

SEQ ID NO: 181085 - RNA, 65 nt, Homo Sapiens
gaguagcugggacuacaguuucgugugccaccaugccuggcuaauuuuuagaauuuuuuguaggg

SEQ ID NO: 181086 - RNA, 65 nt, Homo Sapiens
agcaauaaccaccucccuggaggccagcugagaugccuggcuacuuggcaccagggacuuccuga

SEQ ID NO: 181087 - RNA, 65 nt, Homo Sapiens
agagauaagaacuuguucuuccaaguuuccuuguuccuggcuacuauaggccugaagccugaagc

SEQ ID NO: 181088 - RNA, 65 nt, Homo Sapiens
cuaaguaccugguacuacaggcgcgugccaccacaccuggcuaauuuuugcauuuuuuguagaga

SEQ ID NO: 181089 - RNA, 65 nt, Homo Sapiens
ccaaagugcugggauuacaggcaugagccacugcaccuggcuauauuuacauuuaauagaaacau

SEQ ID NO: 181090 - RNA, 65 nt, Homo Sapiens
cuuugaauuguauuuacauucacugucaguaaagaccuggcuacgcuuugagaaaucaggaucuc

SEQ ID NO: 181091 - RNA, 65 nt, Homo Sapiens
aagauacuugaagccaaauguuugcaguauagguuccuggcuacuguuuaugcugugauuucacu

SEQ ID NO: 181092 - RNA, 65 nt, Homo Sapiens
agaagaacaaauauggcuaauuguuaauaagguccccuggcuaugguuuuuguucuuauaacaga

SEQ ID NO: 181093 - RNA, 65 nt, Homo Sapiens
uaaucaaauuucaauuuaaaccaaauuagucgaaaccuggcuaaguuuagccaguaggacuguua

SEQ ID NO: 181094 - RNA, 65 nt, Homo Sapiens
aggcauaucauuugaggucaggaguuuaagaccagccuggcuaacauagugagacccuguuucua

SEQ ID NO: 181095 - RNA, 65 nt, Homo Sapiens
agggagacccuucgcaggcacugugcuguucccuuccuggcuaauucugucacgcuugaaccccu

SEQ ID NO: 181096 - RNA, 65 nt, Homo Sapiens
uuuuguaguauuaguagagagcgugugccaccaugccuggcuaauccgaguagcugggauuagag

SEQ ID NO: 181097 - RNA, 65 nt, Homo Sapiens
auuuuguauuuuuuaguagagcguccuccaccaugccuggcuaauccaaguagcucggacuacag

SEQ ID NO: 181098 - RNA, 65 nt, Homo Sapiens
acggugaaaccccgucucuaagagauccagaccauccuggcuaacgcaggcggaucacgagguca

SEQ ID NO: 181099 - RNA, 65 nt, Homo Sapiens
gggaagauacagaaccauccgcagacaaagggcucccuggcuacuugcgugccaggcaacagugg

SEQ ID NO: 181100 - RNA, 65 nt, Homo Sapiens
auggugaaaccccaucucuaggagaucaaaaccauccuggcuaacgcagguagaucaugagguca

SEQ ID NO: 181101 - RNA, 65 nt, Homo Sapiens
uaacuuacauuuguggggaauggccucucgacagcccuggcuaacuaaaccuaccccagcaacug

SEQ ID NO: 181102 - RNA, 65 nt, Homo Sapiens
uuuucuauuuuuaguagagagcaccugccacugcgccuggcuaauccgaguagcugggauuacag

SEQ ID NO: 181103 - RNA, 65 nt, Homo Sapiens
uuuguauuuuuaguagagaugcaccugccaccacgccuggcuaauccgaguagcuggaauuacag

SEQ ID NO: 181104 - RNA, 65 nt, Homo Sapiens
auuuuagugguaauuccuagagauuaggagaggguccuggcuaggacugcccauauauucuaucu

SEQ ID NO: 181105 - RNA, 65 nt, Homo Sapiens
ucagggggaauggggaaaaggaagagugucacacuccuggcuaucccuuacccuuuuucauaggg

SEQ ID NO: 181106 - RNA, 65 nt, Homo Sapiens
cugaguagcugggaccacagguucacauaaccaugccuggcuaauuuauuuuuacuuuuauuuua

SEQ ID NO: 181107 - RNA, 65 nt, Homo Sapiens
cugaguagcugggacuacaagugugcaccaccaugccuggcuaauuuuuugaauuuuuguaguga

SEQ ID NO: 181108 - RNA, 65 nt, Homo Sapiens
cucccuaguagcugggauuacaggcaugugccacaccuggcuaauuuuugugguuuuaguagaga

SEQ ID NO: 181109 - RNA, 65 nt, Homo Sapiens
ccaaguagcugggauuacaggcaugcaccaccacaccuggcuaguuuuuguauuuuuaguagaga

SEQ ID NO: 181110 - RNA, 65 nt, Homo Sapiens
ccgagcagcugggacuacaggcgcccgccaccacgccuggcuaacuuuuuuguauuuuuaguaga

SEQ ID NO: 181111 - RNA, 65 nt, Homo Sapiens
gcggguggaucacgaggucaggagaucgagaccauccuggcuaacaugguaaaaccccgucucua

SEQ ID NO: 181112 - RNA, 65 nt, Homo Sapiens
uugaguagcuugguuuauaggcgcaugccaccaugccuggcuaauuuuguguuuuuaguagagac

SEQ ID NO: 181113 - RNA, 65 nt, Homo Sapiens
auuauucuagccuaggugaaucccuaauugaaacaccuggcuaacacuuuagacacauaaauuaa

SEQ ID NO: 181114 - RNA, 65 nt, Homo Sapiens
ugucucggcauaccccucuccucuucccaccuccuccuggcuauguucugcagccucccagagua

SEQ ID NO: 181115 - RNA, 54 nt, Homo Sapiens
agacccagguaaaagacccacuuuccuggcuaaaggauugccaauaaaaaauag

SEQ ID NO: 181116 - RNA, 65 nt, Homo Sapiens
uuuuguauuuuuaguggagagcacccgccaccacgccuggcuaaucugaguagcugggauuacag

SEQ ID NO: 181117 - RNA, 65 nt, Homo Sapiens
ugugcagaugaucgcaccaucagcaauggcaaauaccuggcuaccauaucuugcauggacuuuag

SEQ ID NO: 181118 - RNA, 65 nt, Homo Sapiens
guuuuguauuuuuaguagaucaggcucccaccacaccuggcuagucuccuguguaacugggauua

SEQ ID NO: 181119 - RNA, 65 nt, Homo Sapiens
uuuuguauuaguagagaugagcgugcgccaccaugccuggcuaauccgagcagcugggacuacag

SEQ ID NO: 181120 - RNA, 65 nt, Homo Sapiens; identical to SEQ ID NO: 180956

SEQ ID NO: 181121 - RNA, 65 nt, Homo Sapiens
uuuuuguauuuuuaguagaggcaccugccaccaugccuggcuaauccaaguaguugggauuacag

SEQ ID NO: 181122 - RNA, 65 nt, Homo Sapiens
gccagugcccauuuucagcccccgguuccuacucaccuggcuaggcaccucucugcccuucccug

SEQ ID NO: 181123 - RNA, 65 nt, Homo Sapiens
gaacauggaagccccuaggguagguggucccuugcccuggcuacagaagucagacuguggucaag

SEQ ID NO: 181124 - RNA, 65 nt, Homo Sapiens
uuuuguauuuuuaauagagagcacccaccaccacgccuggcuaauccagguagcugggauuacag

SEQ ID NO: 181125 - RNA, 65 nt, Homo Sapiens
uuuuuguauuuuuaguagaggcgcccgccaacacgccuggcuaauucccauagcugggacuacag

SEQ ID NO: 181126 - RNA, 65 nt, Homo Sapiens
gcgggcggaucaugaggucaggagaucgagaccauccuggcuaacacggugaaaacccaugucua

SEQ ID NO: 181127 - RNA, 65 nt, Homo Sapiens
guuguuuguuuugagagagagucuugcucugucucccuggcuagggugugguggugugaucuugg

SEQ ID NO: 181128 - RNA, 65 nt, Homo Sapiens
auaugugacugucaugagauccuacuuaguaugauccuggcuagaaugauaauuaaaaguauuua

SEQ ID NO: 181129 - RNA, 65 nt, Homo Sapiens
aucucccucagucugcccccagcccccaaacuccuccuggcuagacuguaggaagggacuuuugu

SEQ ID NO: 181130 - RNA, 65 nt, Homo Sapiens
ggucaagaggccaggccuggcacauuuuggaguguccuggcuaccagcucucaccuacacccacg

SEQ ID NO: 181131 - RNA, 65 nt, Homo Sapiens
cagaguaaguaggaccacaggcaugcacaagcaugccuggcuaauuuuuaaauuuuuuuuuuuua

SEQ ID NO: 181132 - RNA, 65 nt, Homo Sapiens
aaagaaaggguauuuuugagcaaauaaugugauuuccuggcuauuuuguugggggcuuaagauuu

SEQ ID NO: 181133 - RNA, 65 nt, Homo Sapiens
uuuuuguauuuuuuguagagcaggugggcaccaugccuggcuacucgaguagcugggacuacugg

SEQ ID NO: 181134 - RNA, 65 nt, Homo Sapiens
acggugaaacccugucucuaggagaucgagaccauccuggcuaacgcagguggaucacgagguca

SEQ ID NO: 181135 - RNA, 65 nt, Homo Sapiens
ucccagccugugguuacaguccaaggagaccaaguccuggcuacaccaaacaucagaccugucuu

SEQ ID NO: 181136 - RNA, 65 nt, Homo Sapiens
uuuucauuuuuuuuguaggggugcgcgccaccgugccuggcuaacccaacuagcugggacuacag

SEQ ID NO: 181137 - RNA, 65 nt, Homo Sapiens
uuuuguauuuuuaguagagagcacccgccaccacgccuggcuaaucggaguagcugggauugcag

SEQ ID NO: 181138 - RNA, 65 nt, Homo Sapiens
acggugaaaccccgucucuaggagaucgagaccauccuggcuaacgcgggcggaucaugagguca

SEQ ID NO: 181139 - RNA, 65 nt, Homo Sapiens
auagaaucucaucuaaucuuuuucucauuuuuuucccuggcuauggaauuagaauguuucuggua

SEQ ID NO: 181140 - RNA, 65 nt, Homo Sapiens
auggugaaaccccgucucuaggagaucaggaccauccuggcuaacgcggguagaucacaagguca

SEQ ID NO: 181141 - RNA, 65 nt, Homo Sapiens
agucuagugcaaaagauuaaucuugcuuuguuuucccuggcuaacuucgguuccagacacugguu

SEQ ID NO: 181142 - RNA, 65 nt, Homo Sapiens
uguucuagguuuaugaauuuuuuggcacucuaaagccuggcuaauuuauuguguuuaauuucuuc

SEQ ID NO: 181143 - RNA, 65 nt, Homo Sapiens
uuuuuuuuauauuuugaguagcaccugccaccacgccuggcuaaccugaguagcugggacuacag

SEQ ID NO: 181144 - RNA, 65 nt, Homo Sapiens
auggugaaaccccgucucuaggagaucgagaccauccuggcuaacgcgggcggaucacgagguca

SEQ ID NO: 181145 - RNA, 65 nt, Homo Sapiens
augagauucugcagacucuacuugaccuuuucuucccuggcuacagcaaaggacgaugaucugcc

SEQ ID NO: 181146 - RNA, 65 nt, Homo Sapiens
acggguggaucacaaggucaggagaucgagaccauccuggcuaaugcguugaaacuccgucucua

SEQ ID NO: 181147 - RNA, 65 nt, Homo Sapiens
gugaguggauuacaaggucaggaguuccagaccagccuggcuaauauggugaaaccucgucucua

SEQ ID NO: 181148 - RNA, 65 nt, Homo Sapiens
cugaguagcugggauuauagguacaugccaucacaccuggcuaauuuuuguauuuuuaguagaga

SEQ ID NO: 181149 - RNA, 65 nt, Homo Sapiens
aaaauuagccaggcaugguggugcauaccuauaguccuggcuauuugggaggcugaggcaggagg

SEQ ID NO: 181150 - RNA, 65 nt, Homo Sapiens
cuugugggucugugucaccuccaucucagucuuggccuggcuaugaggggaggaggaaugggaga

SEQ ID NO: 181151 - RNA, 65 nt, Homo Sapiens
caguauuugggagacuuugacuauuuauucagacuccuggcuauguauugcacauuggcaagugc

SEQ ID NO: 181152 - RNA, 65 nt, Homo Sapiens
augggaugggcugggaucuucucugugaauccaccccuggcuacccccacccuggcuaccccaac

SEQ ID NO: 181153 - RNA, 65 nt, Homo Sapiens
aucuucucugugaauccaccccuggcuacccccacccuggcuaccccaacggcaucccaaggcca

SEQ ID NO: 181154 - RNA, 65 nt, Homo Sapiens
ccuaguagcugggacuacaggcacccacuaccacgccuggcuaauucuuuguauuuuuaguagag

SEQ ID NO: 181155 - RNA, 65 nt, Homo Sapiens
uucuguauuuuuaguagagagugcacaccaccaugccuggcuaauccgaguagcugggaguacag

SEQ ID NO: 181156 - RNA, 65 nt, Homo Sapiens
cacccccaccauuccuacacgccucgggagcggccccuggcuaugugggcuccacugggccccug

SEQ ID NO: 181157 - RNA, 65 nt, Homo Sapiens
gcuacacuggucuucccuacaauccugcacugccaccuggcuauacagcccagcagcccuucgug

SEQ ID NO: 181158 - RNA, 65 nt, Homo Sapiens
auggugaaacauggugaaacggagaucgagaccgcccuggcuaacgcgggcggaucacgagguca

SEQ ID NO: 181159 - RNA, 65 nt, Homo Sapiens
uuuguauuuuuaguagagaugugugcaccacuaugccuggcuaauccggguagcugggacuacag

SEQ ID NO: 181160 - RNA, 65 nt, Homo Sapiens
auggcaauacccuaucucuaaggaguuccagacugccuggcuaaccagggggauuacuucagccc

SEQ ID NO: 181161 - RNA, 65 nt, Homo Sapiens
uuugucucaugucuucuaaaaugcgugccaccaagccuggcuaaucugaguaucugggacuacag

SEQ ID NO: 181162 - RNA, 65 nt, Homo Sapiens
caggaggccgaggcagaagagcgcauggcuguaauccuggcuacuaaaauuagccgggcguggua

SEQ ID NO: 181163 - RNA, 65 nt, Homo Sapiens
uuuuuuuuuuuuuguauuuugcgcccgccaucacgccuggcuaaucugaguagcugggacuacag

SEQ ID NO: 181164 - RNA, 65 nt, Homo Sapiens
acccguggccgucaaggacuacagaucccuaccugccuggcuaagaagaaggagugguaacaguc

SEQ ID NO: 181165 - RNA, 65 nt, Homo Sapiens
gcgggcggaucacgaggucaggagaucgagaccguccuggcuaacaccgugaaaccccaucucua

SEQ ID NO: 181166 - RNA, 65 nt, Homo Sapiens
aaaauuagccgggcaugguggugcacaucgguaguccuggcuacuagagagguugaggugggagg

SEQ ID NO: 181167 - RNA, 65 nt, Homo Sapiens
ccgaguagcugggauuaccggcacccaccaccacgccuggcuaauuuuucaauuuucuuuuucag

SEQ ID NO: 181168 - RNA, 65 nt, Homo Sapiens
ggcaguuuugccucaggugcugaacauuucucagcccuggcuaaaagggagcagcacagggagag

SEQ ID NO: 181169 - RNA, 65 nt, Homo Sapiens
gugggcggaucacgaggucuggaguuugagaccauccuggcuaacacagugaaaucccgucucua

SEQ ID NO: 181170 - RNA, 65 nt, Homo Sapiens
ucaagcagcgggaacuacaggugugcacuaccacaccuggcuauuuuuuuuuuuuuuuuuuuuuu

SEQ ID NO: 181171 - RNA, 65 nt, Homo Sapiens
caaguagcugggauuacagggcaccugccaccacgccuggcuaauuuuuguauuuuaguggagac

SEQ ID NO: 181172 - RNA, 65 nt, Homo Sapiens
ucugggcagcugcagcccugagccaggacauguggccuggcuagugcagcauggaguggauuuua

SEQ ID NO: 181173 - RNA, 65 nt, Homo Sapiens
gcucacaaaagguuaauggauggggguuaccuagcccuggcuaauuccccuuccauucccaacuc

SEQ ID NO: 181174 - RNA, 65 nt, Homo Sapiens
ccgaguagcuaggauuacaggugcaugccaccacaccuggcuaauuuuuguauuuuaguagagau

SEQ ID NO: 181175 - RNA, 65 nt, Homo Sapiens
gcgaguggaucacgaggucaggagaucgagaccauccuggcuaacacggugaaaccccgucucua

SEQ ID NO: 181176 - RNA, 65 nt, Homo Sapiens
guggugaaaccccgucucuuggagaucgagaccauccuggcuaacgcgggaggaucaugagguca

SEQ ID NO: 181177 - RNA, 65 nt, Homo Sapiens
uuuuuuuauuuuuaguagaggcgcccgccaccaugccuggcuaauccaaguagcugggauuacug

SEQ ID NO: 181178 - RNA, 65 nt, Homo Sapiens
uuuuguauuuuuuaaauagagcacgugccaccaugccuggcuaauccaaguagcugggacuacag

SEQ ID NO: 181179 - RNA, 65 nt, Homo Sapiens
uuuuguauuuuuagcagacagugcacaccaccacaccuggcuaauccuaguagcugggauuacag

SEQ ID NO: 181180 - RNA, 65 nt, Homo Sapiens
acggugaaaccccauuuccaggagaucgagaccauccuggcuaacgcgggcggaucacgagguca

SEQ ID NO: 181181 - RNA, 65 nt, Homo Sapiens
ggagagaccccuugcauggguguaucuauucuauaccuggcuaugucccucuucauccgcagcag

SEQ ID NO: 181182 - RNA, 65 nt, Homo Sapiens
cuguuguuuucaucuaccucucuucuauagaugccccuggcuaccgcccaggcagcucuguaaca

SEQ ID NO: 181183 - RNA, 65 nt, Homo Sapiens
agaauguauuuuuguggaugcaaaguguucuaaaaccuggcuaaaauaaggaauuuucuauguuu

SEQ ID NO: 181184 - RNA, 65 nt, Homo Sapiens
gaaaagaaagacacuugagauuugagcuuuugagaccuggcuaugacuccaucaguagguuuaga

SEQ ID NO: 181185 - RNA, 65 nt, Homo Sapiens
uuuguauuuuuaguagagaagcacaagucaccaugccuggcuaauccgaguagcugggacuacag

SEQ ID NO: 181186 - RNA, 65 nt, Homo Sapiens
acgauuuguuccacuuccuuggagaggcagagacgccuggcuacgugggcggauuucggguuucc

SEQ ID NO: 181187 - RNA, 65 nt, Homo Sapiens
caggggagauuccagccagacacccgccccccggcccuggcuaagaaguugcuuccuguugccag

SEQ ID NO: 181188 - RNA, 65 nt, Homo Sapiens
auucggccucugggccugugugucugugagcucaaccuggcuaaaggcagagucacucccaaaug

SEQ ID NO: 181189 - RNA, 65 nt, Homo Sapiens
gcggguggaucacgaggucaggagaucgagaccauccuggcuaacauggugaaaccccgucucua

SEQ ID NO: 181190 - RNA, 65 nt, Homo Sapiens
cugaguagcugggaucacaggugcacaccaccacgccuggcuaauuuuuuuauuuuuauuuuuag

SEQ ID NO: 181191 - RNA, 65 nt, Homo Sapiens
ccaaagugcugggauuacaaguuugagccacugcaccuggcuaacuugcccuauuuuaaagucaa

SEQ ID NO: 181192 - RNA, 65 nt, Homo Sapiens
ccgaguagcugggauuacaggcgaccgccaccacgccuggcuacuuuuuguauuuuuaguagaga

SEQ ID NO: 181193 - RNA, 65 nt, Homo Sapiens
aggcggaucaccugaaaucaggaguucaagaucagccuggcuaacauggcgaaaccccgucucua

SEQ ID NO: 181194 - RNA, 65 nt, Homo Sapiens
guaauccucuuccuccauuaugcaguacacggacaccuggcuacagaccaggacguggcuugugu

SEQ ID NO: 181195 - RNA, 65 nt, Homo Sapiens
ccgaguagcugggaccacaggcaugcacaaccacgccuggcuaauuuuuguauuuuuuauaaaga

SEQ ID NO: 181196 - RNA, 65 nt, Homo Sapiens
ccagguagcugguacuacaggcacggaccaccacgccuggcuaauuuuuguauuuuuucuaggga

SEQ ID NO: 181197 - RNA, 65 nt, Homo Sapiens
ccgaguagcugggacuacaggugcacgccaccacgccuggcuaauuuuuuguauuuuaguagaga

SEQ ID NO: 181198 - RNA, 65 nt, Homo Sapiens
gcggguggaucaagaggucaggagaucgagaccauccuggcuaagucggucucuaauaaaaauac

SEQ ID NO: 181199 - RNA, 65 nt, Homo Sapiens
gcggguggaucaugaggucaggagaucgagaccauccuggcuaacacggugaaaccccgucucua

SEQ ID NO: 181200 - RNA, 65 nt, Homo Sapiens
gcaggcagaucacggggucaggagaucaagaccauccuggcuaacauggugaaaccccgucucua

SEQ ID NO: 181201 - RNA, 65 nt, Homo Sapiens
uuuguauuuucaguagagacgugcccaccaccaccccuggcuaaaccaaguagcugggauuacag

SEQ ID NO: 181202 - RNA, 65 nt, Homo Sapiens
acggugaaaacccaucucuaggagaucaagaccauccuggcuaacgcgggcggaucaccagguca

SEQ ID NO: 181203 - RNA, 65 nt, Homo Sapiens
uccuaauaauaucccacuggccacggccuuucuagccuggcuaugccuccuaccuccaaagcuuc

SEQ ID NO: 181204 - RNA, 65 nt, Homo Sapiens
ggcugggccuggccagcagggucccugaaaaagcaccuggcuaagucaggccccagcucuacuug

SEQ ID NO: 181205 - RNA, 65 nt, Homo Sapiens
aggcccucggggcagggauaucugcucucaggagaccuggcuaugauacugagcuuccucuucac

SEQ ID NO: 181206 - RNA, 65 nt, Homo Sapiens
aggccgacagcuacauccucggauuagcaagcccaccuggcuaccaagcuuaagguagaggugca

SEQ ID NO: 181207 - RNA, 65 nt, Homo Sapiens
auagaggggcucugggagacaauuagcuugagcaaccuggcuaagauccuguugggaaagaauaa

SEQ ID NO: 181208 - RNA, 65 nt, Homo Sapiens
uuuuuguauuuuuaguacaggcacaugccaccaugccuggcuaauccgaguagcugggacuacag

SEQ ID NO: 181209 - RNA, 65 nt, Homo Sapiens
uuuuguacuuuuaguagagagugcccaccaacaugccuggcuaaucuggguagcugggauuacag

SEQ ID NO: 181210 - RNA, 65 nt, Homo Sapiens
acggugaaaccccgucucuaggagaucgagaccauccuggcuaacgcgggcagaucacgaaguca

SEQ ID NO: 181211 - RNA, 65 nt, Homo Sapiens
uuuuuuugauuuuuaguagagcgccuaucaccaugccuggcuaauccgaguagcugggacuacag

SEQ ID NO: 181212 - RNA, 65 nt, Homo Sapiens
ggugaggguaagcuguuaauaaucuugaagaaacgccuggcuagaguaaggacuggaaacacuag

SEQ ID NO: 181213 - RNA, 65 nt, Homo Sapiens
uuuuguauuuuuaguagagagugcaugccaccaugccuggcuaauccgaguagcugggauuacag

SEQ ID NO: 181214 - RNA, 65 nt, Homo Sapiens
uuuuguauuuuuaauagagagcaugcaccaccacaccuggcuaauccgaauagcuggaauuacgg

SEQ ID NO: 181215 - RNA, 65 nt, Homo Sapiens
ccugaaccuuucacuuuccaaaaaggaggggccugccuggcuagcccugcacgcucugcggggag

SEQ ID NO: 181216 - RNA, 65 nt, Homo Sapiens
gcuucgggugugugugucuggggauggaaaacgggccuggcuagaaaaugagagaaugguacuua

SEQ ID NO: 181217 - RNA, 65 nt, Homo Sapiens
acggugaaacccugucucuaucaggacgagaccauccuggcuaacgaggcgggcggaucacaaag

SEQ ID NO: 181218 - RNA, 65 nt, Homo Sapiens
uuuuguauuuuauguagagagcaugcaccaccaugccuggcuaauccagguaacugggacuacag

SEQ ID NO: 181219 - RNA, 65 nt, Homo Sapiens
uuuuguauuuuuaguacagagugugcaccaccacgccuggcuaaauccaguagcugggauuacag

SEQ ID NO: 181220 - RNA, 65 nt, Homo Sapiens
cugggauggaggggaguguugggcaugugaucacgccuggcuaauaaggcuuuaguguauuuauu

SEQ ID NO: 181221 - RNA, 65 nt, Homo Sapiens
gugggagaaucacaaggucaggagacugagaccauccuggcuaacaccaugaugggcuaacaccc

SEQ ID NO: 181222 - RNA, 65 nt, Homo Sapiens
aaauaaaugaauugagaauuuaguccauagaggucccuggcuaccaaacacauucuccuuugaau

SEQ ID NO: 181223 - RNA, 65 nt, Homo Sapiens
ccaaguaggugggacuccaggcaugcaccaccaugccuggcuaauuuuugcauuuuuaguagaga

SEQ ID NO: 181224 - RNA, 65 nt, Homo Sapiens
ccaagcagcugggacuacagguaccugccaccacgccuggcuaauuuuguuuuuguauuuuuagu

SEQ ID NO: 181225 - RNA, 65 nt, Homo Sapiens
caccagcagagacagaaacagcaauagccaggacuccuggcuaaaacgggggaagugagaggaaa

SEQ ID NO: 181226 - RNA, 65 nt, Homo Sapiens
cuguguaacuguggcuauucugugucccuacacuaccuggcuacccccuuccauggccccagcuc

SEQ ID NO: 181227 - RNA, 65 nt, Homo Sapiens
gcggguggaucacgaggucaggagauggagaccauccuggcuaacauggugaaaccccgucucua

SEQ ID NO: 181228 - RNA, 65 nt, Homo Sapiens
ccaauuagcuuggccuacagucaucugccaccacaccuggcuaauuuuuuguacuuuuaguagag

SEQ ID NO: 181229 - RNA, 65 nt, Homo Sapiens
ccgaguaguugggauuacaggcgccugccuccaugccuggcuaauuuuguauuuuuaguagagac

SEQ ID NO: 181230 - RNA, 65 nt, Homo Sapiens
acacucaagcaauccugaggaauacugagggagggccuggcuacugucucucugcacucugcugc

SEQ ID NO: 181231 - RNA, 65 nt, Homo Sapiens
ccgugcagcugggauugcaggugcgugccaccaugccuggcuaauuucugguauuuuguagagac

SEQ ID NO: 181232 - RNA, 65 nt, Homo Sapiens
ucaaguagcugggauuacaagcaccagccaccaugccuggcuaauuuuguauuuuuaguagagac

SEQ ID NO: 181233 - RNA, 65 nt, Homo Sapiens
guguuuuuaaggccagccacuugucccuguugaggccuggcuauggaacuaaauacaguguuggu

SEQ ID NO: 181234 - RNA, 65 nt, Homo Sapiens
gccuugacgacaagaccaccaacguguccuuguacccuggcuacaacuucagguaacuccaaggc

SEQ ID NO: 181235 - RNA, 65 nt, Homo Sapiens
aggcagaucaccugaggucgggaguuggagacccgccuggcuaacaaggcgaaauccugucugua

SEQ ID NO: 181236 - RNA, 65 nt, Homo Sapiens
gccucgauacacgggacguugagcacaacguaucuccuggcuacaauuucaggugggcgugagcu

SEQ ID NO: 181237 - RNA, 65 nt, Homo Sapiens
gcccacugcuaguuugacuuuuuauaauugaaccuccuggcuaugcccugagaucagcgcuauuu

SEQ ID NO: 181238 - RNA, 65 nt, Homo Sapiens
accgugaaaccccgucucuaggagauugagacccuccuggcuaacgcaggcggaucacaagguca

SEQ ID NO: 181239 - RNA, 65 nt, Homo Sapiens
ugggaccuaagccuaggcccgaagggaggaggggcccuggcuauuaccugacaguauuagggagu

SEQ ID NO: 181240 - RNA, 65 nt, Homo Sapiens
acccugcuuuguucuuucccuggcaaucucaguccccuggcuaugcaaugaaguuuucagaucag

SEQ ID NO: 181241 - RNA, 65 nt, Homo Sapiens
ucuuuaauuuuuucguagagcuacagaugugcacaccuggcuaagagccugcccaguaacuggua

SEQ ID NO: 181242 - RNA, 65 nt, Homo Sapiens
auggugaaaccucgucucuaggagauccagaccauccuggcuaacgcagguggaucacgagguca

SEQ ID NO: 181243 - RNA, 65 nt, Homo Sapiens
acggugaaacccugucucuaggagaucgagaccauccuggcuaacacaggcagaucacgagguca

SEQ ID NO: 181244 - RNA, 65 nt, Homo Sapiens
ccgaguagcugggauuauaggcacccaccaccacaccuggcuaauuuuuguauuuuuaguggaga

SEQ ID NO: 181245 - RNA, 65 nt, Homo Sapiens
agacucaagaaacugauccuggagaucgagaccauccuggcuaacauggugaaaccccgucucua

SEQ ID NO: 181246 - RNA, 65 nt, Homo Sapiens
agucuauuuauauuuucuacaucuaauuuuagaagccuggcuacaauacugcacaaacuugguua

SEQ ID NO: 181247 - RNA, 65 nt, Homo Sapiens
aagugguuuuucaucuuuccucccuccucccacagccuggcuauacagugcauccuugaacuguc

SEQ ID NO: 181248 - RNA, 65 nt, Homo Sapiens
ccaccacccuggagucuagaccaacacacaaagauccuggcuaacccuggccuauuuagauuccu

SEQ ID NO: 181249 - RNA, 65 nt, Homo Sapiens
cugaguagcugggauuacagguaugugccaccaugccuggcuaauuuuguauuuuuaguagagac

SEQ ID NO: 181250 - RNA, 65 nt, Homo Sapiens
ccaaguagcugggacuacgggcacaugccacugcaccuggcuaauuuuuauauuuuugguagaga

SEQ ID NO: 181251 - RNA, 65 nt, Homo Sapiens
uacucaguaaagguguuuccugcaccugcugucagccuggcuaugccgccaccggccccgcccau

SEQ ID NO: 181252 - RNA, 65 nt, Homo Sapiens
gaggugcucaaccccagcucggguccucuagucugccuggcuaccaugcuucucacucuccugca

SEQ ID NO: 181253 - RNA, 65 nt, Homo Sapiens
auagugaaacccugucucuaggagaucaagaccauccuggcuaacgugggcagaucacgagguca

SEQ ID NO: 181254 - RNA, 62 nt, Homo Sapiens
cucuccuuccucccccuuuuggaccaccauucccuggcuacucggggcagccccagcccuga

SEQ ID NO: 181255 - RNA, 65 nt, Homo Sapiens
uuuuguauuuucaguagaaggugcacaccaccaugccuggcuaaucugaguagcugggaauauag

SEQ ID NO: 181256 - RNA, 65 nt, Homo Sapiens
ugcucaugaaggacuugauugugucagcaugguugccuggcuaccugccuucccacccagaaacc

SEQ ID NO: 181257 - RNA, 65 nt, Homo Sapiens
acuuugcguauaaagggaaaucauacaauagcuuaccuggcuaaauuuauaaaguuugcuuuuaa

SEQ ID NO: 181258 - RNA, 65 nt, Homo Sapiens
uuuuguauuuuuaauagagugcauguggcaccaugccuggcuaaucugaguagcugggaguacag

SEQ ID NO: 181259 - RNA, 65 nt, Homo Sapiens
acucaugagcagcagcaacaacugaauguccugguccuggcuagcagcagcaccguggugaugca

SEQ ID NO: 181260 - RNA, 65 nt, Homo Sapiens
gcgggcggaucacaaggucaggagaucgagaccauccuggcuaacacagugaaaccccgucucua

SEQ ID NO: 181261 - RNA, 65 nt, Homo Sapiens
ccaagaagcugagauuacagaugaccaccaccacuccuggcuaauuuuuuguauuuaguagagac

SEQ ID NO: 181262 - RNA, 65 nt, Homo Sapiens
uggccaguggugccaggugccacccagggcuacugccuggcuaucuggccuggccucugggcugg

SEQ ID NO: 181263 - RNA, 65 nt, Homo Sapiens
ccaaguagcugagacuacaggcacacaccaccacgccuggcuaauuuuuguauuuuuaguagaga

SEQ ID NO: 181264 - RNA, 65 nt, Homo Sapiens
uuuuguauuuuuaguagagagugccugccaucacgccuggcuaaucugaguagcugggauuacag

SEQ ID NO: 181265 - RNA, 65 nt, Homo Sapiens
agggaaauagcuccuugggaccugaaacuccagauccuggcuaagcucagcacugccaggccugc

SEQ ID NO: 181266 - RNA, 65 nt, Homo Sapiens
ucgucuuggcuccaccucuguggcuccuuucuacuccuggcuaugccuggcaccccugccccacc

SEQ ID NO: 181267 - RNA, 65 nt, Homo Sapiens
acagugaaaccccaucucuaggagaucgagaccauccuggcuaacgagggcggaucacgagguca

SEQ ID NO: 181268 - RNA, 65 nt, Homo Sapiens
acgguaaaacccugucucuaggagaucaagacuauccuggcuaacgcaggcggaucacaagguca

SEQ ID NO: 181269 - RNA, 65 nt, Homo Sapiens
acggugaaacccugucucuaggagaucaaggccauccuggcuaacgcgggccgaucacgagguca

SEQ ID NO: 181270 - RNA, 65 nt, Homo Sapiens
cccagauagcugggccacaggcgugugccaccacaccuggcuaacuuuuuuuuuuuuuuuuuuuu

SEQ ID NO: 181271 - RNA, 65 nt, Homo Sapiens
cccaguagcugggacuacaggcgccugccaacaugccuggcuaauuuuuuuuuuuuguauuuuua

SEQ ID NO: 181272 - RNA, 65 nt, Homo Sapiens
gcccuggacucaucuugggaagggccaugggagguccuggcuagaguucugcccaaccuugacca

SEQ ID NO: 181273 - RNA, 65 nt, Homo Sapiens
cugaguagcugggauuacaggcgugcaccacaacgccuggcuaaguuuuuguauuuuuaguagag

SEQ ID NO: 181274 - RNA, 65 nt, Homo Sapiens
cagaguagcuggaauuacaggcacacaccaccacgccuggcuaauuuuuguauuuuuaguagagc

SEQ ID NO: 181275 - RNA, 65 nt, Homo Sapiens
cucagacagugcaucaccgggcacccagaggcuugccuggcuauuccuguucuggugugugugga

SEQ ID NO: 181276 - RNA, 65 nt, Homo Sapiens
cuucucccuccagccaccugcugccacgggcaggcccuggcuauagcuuauacaguaucuccccu

SEQ ID NO: 181277 - RNA, 65 nt, Homo Sapiens
agggccacugcuccauugcucugggggcugggaugccuggcuaagcaggggcugacaggguggca

SEQ ID NO: 181278 - RNA, 65 nt, Homo Sapiens
ggcacaaagcuugugccuugacuggacccguagccccuggcuaggucgaaacagcccuccaccuc

SEQ ID NO: 181279 - RNA, 65 nt, Homo Sapiens
ucucccuccuccugccauccuccccucccgcccuuccuggcuaccuccucugacaugcggucaga

SEQ ID NO: 181280 - RNA, 65 nt, Homo Sapiens
gcagggcuccagggacuccagccacaaccugggcuccuggcuacaccaccuccucugucccccau

SEQ ID NO: 181281 - RNA, 65 nt, Homo Sapiens
acggugaaaccccgucuuuaggagagcgagaccauccuggcuaacgcgggcggaucaugagguua

SEQ ID NO: 181282 - RNA, 65 nt, Homo Sapiens
agcuacuugaccuuugauguggggccaccacuuuuccuggcuagauuggugcuggcuaggcugag

SEQ ID NO: 181283 - RNA, 65 nt, Homo Sapiens
ccucuuuccucucugcugcuaaacaaaaaaaauucccuggcuauuuguauuuuaaagaagaaaaa

SEQ ID NO: 181284 - RNA, 65 nt, Homo Sapiens
uuucuuuucuucuuucuuucgugcaugcaaccacaccuggcuaauccaaagugcugggacuacag

SEQ ID NO: 181285 - RNA, 65 nt, Homo Sapiens
gagccaaggaaaugccauggccgcuuugcccuugaccuggcuagguaauuccuaggacagcacgc

SEQ ID NO: 181286 - RNA, 65 nt, Homo Sapiens
uuaauuucucacuggggagagcagggguggcagauccuggcuagaucugccucuguuuugcuggu

SEQ ID NO: 181287 - RNA, 65 nt, Homo Sapiens
ccuuccucccuucagucaguguccccaggguccagccuggcuagaguuagaaggcagaccuagcc

SEQ ID NO: 181288 - RNA, 65 nt, Homo Sapiens
gcgggcggaucacgaggucaggagaucgagaccauccuggcuaacguggugaaaccccaucucua

SEQ ID NO: 181289 - RNA, 65 nt, Homo Sapiens
ugggcuccgcugugcccgcccugggcugggcccuuccuggcuaggacuguggaggggagcugcug

SEQ ID NO: 181290 - RNA, 65 nt, Homo Sapiens
ccccgaaccuuguaaucgugugcuggcguggcagcccuggcuaaguuaauccccaccgcuuucag

SEQ ID NO: 181291 - RNA, 65 nt, Homo Sapiens
uuagaaguaaauauauucaagacaaacgagaaaauccuggcuacccaagucgaguauauacagga

SEQ ID NO: 181292 - RNA, 65 nt, Homo Sapiens
ccgaguagcugggauuacaggcacgcaccaccacaccuggcuaauuuuuguacuuuuaguagaga

SEQ ID NO: 181293 - RNA, 65 nt, Homo Sapiens
cacuuugggaggccgaggcgggcggaucagaccauccuggcuaacacggugaaaccccaccucua

SEQ ID NO: 181294 - RNA, 65 nt, Homo Sapiens
guggccagaucccaaggucagaagaucgagaccauccuggcuaacauggugaaaccccaucucua

SEQ ID NO: 181295 - RNA, 65 nt, Homo Sapiens
cgaaguagcugggacuauagguguguaccaucacaccuggcuaauuuuuguauuuuuuguagaca

SEQ ID NO: 181296 - RNA, 65 nt, Homo Sapiens
cugagcagcugggacuacaggcgccugccaucaugccuggcuaauuuuuguauuuuuaguagaga

SEQ ID NO: 181297 - RNA, 65 nt, Homo Sapiens
uuuuguauuuuuaguagagagcacccgccaccguaccuggcuaauccgaguagcugggauuacag

SEQ ID NO: 181298 - RNA, 65 nt, Homo Sapiens
acggugaaaccccgucucuaggagauccagaccauccuggcuaacgcaggcagaucacgagguca

SEQ ID NO: 181299 - RNA, 65 nt, Homo Sapiens
acggugaaaccccgucucuaggagaucaagaccauccuggcuaacgugggcggaucacgagguag

SEQ ID NO: 181300 - RNA, 65 nt, Homo Sapiens
auggugaaaccccgucucugggagaucgagaccauccuggcuaacgugggcagaucacgagguca

SEQ ID NO: 181301 - RNA, 65 nt, Homo Sapiens
acacaaggucagaugauaaacagucgcgcuuacgaccuggcuagagggguugcagggcaacagua

SEQ ID NO: 181302 - RNA, 65 nt, Homo Sapiens
uuuuguauuuuuaguagagagcgucggccaccacaccuggcuaaucugaguagcugggauuacag

SEQ ID NO: 181303 - RNA, 65 nt, Homo Sapiens
uuuuguauuuuugguagagagcuugcgccaccacaccuggcuaaucugaguagcugggacuacag

SEQ ID NO: 181304 - RNA, 65 nt, Homo Sapiens
acggugaaaccccgucucuaggagaucaagaccauccuggcuaaccgaggcggaucauaagguca

SEQ ID NO: 181305 - RNA, 65 nt, Homo Sapiens
uuuuuaaauuuuuuuuuauagugggcagcaccacaccuggcuaauccaaguagcugggaccacag

SEQ ID NO: 181306 - RNA, 65 nt, Homo Sapiens
guuuaaauuuuauguagagagcacaggccaccaaaccuggcuaaucugaguagcugggacuacag

SEQ ID NO: 181307 - RNA, 65 nt, Homo Sapiens
acggugaaacccugucuccaggagaucgagaccauccuggcuaacgcuggcagaucacaagguca

SEQ ID NO: 181308 - RNA, 65 nt, Homo Sapiens
gcagacacacugacaccucccaacaucgugccuauccuggcuaagaaggcccugcaucagcgggu

SEQ ID NO: 181309 - RNA, 65 nt, Homo Sapiens
acggugaaacaccgucucuauucaaaguucuccauccuggcuaacacuauuuucucuguaaaguu

SEQ ID NO: 181310 - RNA, 65 nt, Homo Sapiens
aaauuuuuuguuguuaauaugcuccugccaccacgccuggcuaggccgaguagcugggauuacag

SEQ ID NO: 181311 - RNA, 65 nt, Homo Sapiens
guuucuucucaucagagcacccgauccuugcucuaccuggcuagagugguugaggcagggccauc

SEQ ID NO: 181312 - RNA, 65 nt, Homo Sapiens
gugaugaguuagcuucugcuaacaaaguacacaaaccuggcuacguaugcuguagcgugucugga

SEQ ID NO: 181313 - RNA, 65 nt, Homo Sapiens
acggcgaaaccccgucucuaggagaucgagaccauccuggcuaacgcggguggaucaugagauca

SEQ ID NO: 181314 - RNA, 65 nt, Homo Sapiens
uuuguauuuucaguagagacgcaugcaccaucacaccuggcuaauccgaguagcugggauugcag

SEQ ID NO: 181315 - RNA, 65 nt, Homo Sapiens
ggcccacgcuccaugccaguggcucacgcucugcuccuggcuaccccagagggaguugucacgcu

SEQ ID NO: 181316 - RNA, 65 nt, Homo Sapiens
guagcugggauuacagacaggcaugugcuauuacaccuggcuaauuuuuaaaguuuuuuuuguaa

SEQ ID NO: 181317 - RNA, 65 nt, Homo Sapiens
cugagcagcugggauuacaggugcaugccaccaugccuggcuaauuuugguauuuuuaguagaga

SEQ ID NO: 181318 - RNA, 65 nt, Homo Sapiens
uuuuuauuuuccuuuuuguaggguaugccaccacaccuggcuaaucugcguagcugggaccacag

SEQ ID NO: 181319 - RNA, 65 nt, Homo Sapiens
uuuuuguauuuuuaguagaggugcccaccaccacgccuggcuaguccgaguagcugggacuacag

SEQ ID NO: 181320 - RNA, 65 nt, Homo Sapiens
uuuuuguauuuuuaguaaaggcacccaccaccacaccuggcuaaucugaguagcugggauuacag

SEQ ID NO: 181321 - RNA, 65 nt, Homo Sapiens
augcugcugggccacaccccagugcguccaccugcccuggcuagcccccaccggugcauccgccc

SEQ ID NO: 181322 - RNA, 65 nt, Homo Sapiens
uuugugucauuuauucaaguaaaaaacuugcugguccuggcuauuauucuaugaagcccacccag

SEQ ID NO: 181323 - RNA, 65 nt, Homo Sapiens
acggugaaaccccgucucuaggagaucaagaccauccuggcuaacgcggguggaucacgagguca

SEQ ID NO: 181324 - RNA, 65 nt, Homo Sapiens
ccauggccugcugggcuuggcucggcgcccccaccccuggcuaccuugugggaauaaacagacaa

SEQ ID NO: 181325 - RNA, 65 nt, Homo Sapiens
ugaacaaggcuggcaguaaguggacaagcugcuccccuggcuaaggcccugcccugcccucagcc

SEQ ID NO: 181326 - RNA, 65 nt, Homo Sapiens
gcggguggaucaugaggucaggagaucgagaccauccuggcuaacacagugaaacccugucucua

SEQ ID NO: 181327 - RNA, 65 nt, Homo Sapiens
gcaggcggaucacgaggucaggagaucaagaccauccuggcuauggugaaaccccgucucuacua

SEQ ID NO: 181328 - RNA, 65 nt, Homo Sapiens
gaacagacccaaauucaauggcaugaccaagaacaccuggcuaccauuuuguuuucuccugcccu

SEQ ID NO: 181329 - RNA, 65 nt, Homo Sapiens
gcggguggaucaugaggucaggagaucgagaccauccuggcuaacacgugaaaccccgucucuac

SEQ ID NO: 181330 - RNA, 65 nt, Homo Sapiens
uuuuaagggccaaagcuugaccccauuggccauugccuggcuaaugagaaccccugguucucaga

SEQ ID NO: 181331 - RNA, 65 nt, Homo Sapiens
cuucuugcaagcaagggcaggccauuuccuccgguccuggcuaguaugaauaugagaagucacug

SEQ ID NO: 181332 - RNA, 65 nt, Homo Sapiens
gggcagaucaucugaggccaggaguucaagaccagccuggcuaacauggugaaauccuaucucua

SEQ ID NO: 181333 - RNA, 65 nt, Homo Sapiens
aaaauuagcugggugugguggugcaugccugugauccuggcuacuucagaggcugagguggaagg

SEQ ID NO: 181334 - RNA, 65 nt, Homo Sapiens
uggaggagcugguaucacaggcgucccccaccacgccuggcuaaauuuuguauuuuuaggugguc

SEQ ID NO: 181335 - RNA, 65 nt, Homo Sapiens
ccaaguagcugggauuacaggcauguacuaccaugccuggcuaauuuucuuguaguuuuaguagg

SEQ ID NO: 181336 - RNA, 65 nt, Homo Sapiens
gcgggcagaucacgaggucaggagaucgagaccauccuggcuaacacggugaaaccccgucucua

SEQ ID NO: 181337 - RNA, 65 nt, Homo Sapiens
ucccagugcugggauuauaggugugagccacugcgccuggcuaaguuauuauuauuuuuuugaga

SEQ ID NO: 181338 - RNA, 65 nt, Homo Sapiens
gcaggcagauaacaaagucaggagauugagaccguccuggcuaacacggugaaaccucgucucua

SEQ ID NO: 181339 - RNA, 65 nt, Homo Sapiens
cccaguagcugggauuacagacaugcaccaccacaccuggcuaauuuuuguauuuuuaguagaga

SEQ ID NO: 181340 - RNA, 65 nt, Homo Sapiens
ucccuaguaauggauuacaggcgcccgccaccacgccuggcuaauuuuuguauuuuuaguagaga

SEQ ID NO: 181341 - RNA, 65 nt, Homo Sapiens
ccaaguagcugggacuacaggcacccgccacuacgccuggcuaauuuuuuguauuuuuaguagag

SEQ ID NO: 181342 - RNA, 65 nt, Homo Sapiens
ccgaguagcugggacuacaggugccugccaccacgccuggcuaauuuuuuuguauuuuuaguaga

SEQ ID NO: 181343 - RNA, 65 nt, Homo Sapiens
guggguggaucacgaggucaggagauugagaccauccuggcuaauauggugaaacccugucucua

SEQ ID NO: 181344 - RNA, 65 nt, Homo Sapiens
aggaaacucggagacaaucuaauuuccccuuuuccccuggcuacccuguaacguaccaacguacc

SEQ ID NO: 181345 - RNA, 65 nt, Homo Sapiens
ugggggccuucaugugcccugcacccaggugugggccuggcuagccuagggcaguggucacugug

SEQ ID NO: 181346 - RNA, 65 nt, Homo Sapiens
acggugaaaccccgucucuaggagauggagaccauccuggcuaacgcaggcggaucaugagguca

SEQ ID NO: 181347 - RNA, 65 nt, Homo Sapiens
auggcaaaaccccaucucuaggaguucgagaccagccuggcuaacaggcggaucaccugagguca

SEQ ID NO: 181348 - RNA, 65 nt, Homo Sapiens
uuuguaauuuuaguagagaugcaugcgccaccacgccuggcuaauccaagaagcugggauuacag

SEQ ID NO: 181349 - RNA, 65 nt, Homo Sapiens
uuuguauuuuuaguagagaugugugagccaccacgccuggcuaauccaaagugcuaggauuacag

SEQ ID NO: 181350 - RNA, 65 nt, Homo Sapiens; identical to SEQ ID NO: 181144

SEQ ID NO: 181351 - RNA, 65 nt, Homo Sapiens
ggaaccauuucacugccggacagggacggacccagccuggcuaaggguugcaacaggauggaauu

SEQ ID NO: 181352 - RNA, 65 nt, Homo Sapiens
aucaugucugaauuauguauuguuauuuaauuuuuccuggcuaagcccucauccaugcugugcug

SEQ ID NO: 181353 - RNA, 65 nt, Homo Sapiens
uuuuguacuuuuuguagaaaaugugagccaccaugccuggcuaauccgaguagcugggaccacaa

SEQ ID NO: 181354 - RNA, 65 nt, Homo Sapiens
acggugaaaccccaucucuaggagacugagaccauccuggcuaacacgggcggaucacgagguca

SEQ ID NO: 181355 - RNA, 65 nt, Homo Sapiens
uuuuguauuuuuaguagagagcacaggccauuaugccuggcuaaucugaguagaugggacuacag

SEQ ID NO: 181356 - RNA, 65 nt, Homo Sapiens
acggugaaaccccgucucuaggagauccagaccauccuggcuaacgugggcaaauuacgagguca

SEQ ID NO: 181357 - RNA, 65 nt, Homo Sapiens
auggugaaaccccaucucuagaaguucaagagcacccuggcuaacgaguggaucaccuaagguca

SEQ ID NO: 181358 - RNA, 65 nt, Homo Sapiens
acggugaaaccccaucucuaggagaucgagaccguccuggcuaacacgggcccaugacaagguca

SEQ ID NO: 181359 - RNA, 65 nt, Homo Sapiens
auggcgaauccucguuuugaaguauuugagaacagccuggcuaacgggcagaucaccugagauca

SEQ ID NO: 181360 - RNA, 65 nt, Homo Sapiens
acggugaaaccccaucucuaggagaucgagaaaauccuggcuaacgcaagagcaucacgagguca

SEQ ID NO: 181361 - RNA, 65 nt, Homo Sapiens
guggagaaaccccgucucuaggagaucgagaccauccuggcuaacgcgggcagaucgcgagguca

SEQ ID NO: 181362 - RNA, 65 nt, Homo Sapiens
uuuuucuauuuuuaguagaggugccugccaccaugccuggcuaaucaaaguagcuaggauuacag

SEQ ID NO: 181363 - RNA, 65 nt, Homo Sapiens
uuuaaaauuuuuuguaaggaacuugcgucacuacaccuggcuaauccaagcagcugggaugacag

SEQ ID NO: 181364 - RNA, 65 nt, Homo Sapiens
gaugcaggaacuccuggacuccuuggugggcuggcccuggcuagcccuugggccucggagaugau

SEQ ID NO: 181365 - RNA, 65 nt, Homo Sapiens
guguguuugccagcucaggagcugucuccucucuaccuggcuaguaagaggugggacaguaaugg

SEQ ID NO: 181366 - RNA, 65 nt, Homo Sapiens
augacuuuuggcaucauucagagccagguuugaauccuggcuauaaaacucaagggacucuuucc

SEQ ID NO: 181367 - RNA, 65 nt, Homo Sapiens
gcgcuugcaccacuuccgucccauccuugcggguaccuggcuaugcgggggugccuaaggagccu

SEQ ID NO: 181368 - RNA, 65 nt, Homo Sapiens
cugaguagcugggauuacaggcgcacgccaccacgccuggcuaauuuuuguauuuuuaguacaga

SEQ ID NO: 181369 - RNA, 65 nt, Homo Sapiens
aagggaaaugacgaccaagagaagaagcuuaaaguccuggcuaauuguguggucauuggaaaacu

SEQ ID NO: 181370 - RNA, 65 nt, Homo Sapiens
gcugguggaucacaaggucaggagauugagaccauccuggcuaacacagugaaaccccgucucua

SEQ ID NO: 181371 - RNA, 65 nt, Homo Sapiens
gagauugaccaagcaagaucgcuuggaccugggugccuggcuaugguuugaggagggagacagau

SEQ ID NO: 181372 - RNA, 65 nt, Homo Sapiens
uuuuguauuuuuaguagagagcaugugccaccacgccuggcuaauccaaguagugugaacuaaag

SEQ ID NO: 181373 - RNA, 65 nt, Homo Sapiens
gagggagggagccucaaauccauggcacaagugacccuggcuaaggcacgggcuggaggaggagg

SEQ ID NO: 181374 - RNA, 65 nt, Homo Sapiens
uuuuuuguauuuuuaguagagcguacaccaccaugccuggcuaaucagaauagcugggauuacag

SEQ ID NO: 181375 - RNA, 65 nt, Homo Sapiens
ccaaauggcacuaaggaggccgccuuccagccuucccuggcuagcagcccagccuuauccagcag

SEQ ID NO: 181376 - RNA, 65 nt, Homo Sapiens
uuuuuguauuuuuaguagaggugcacaccaccacaccuggcuaauccgaguagcugggacuacag

SEQ ID NO: 181377 - RNA, 65 nt, Homo Sapiens
auggugaaaccccgucucuaggaaauccagaccguccuggcuaacgcgggcggaucaauagguca

SEQ ID NO: 181378 - RNA, 65 nt, Homo Sapiens
acggugaaaccccgucucuaggagaucgacaccauccuggcuaacgcagguggaucacgagguca

SEQ ID NO: 181379 - RNA, 65 nt, Homo Sapiens
agaagaauuugugagcaacuucccgacaguaaggcccuggcuagaccucaggauggucccugccu

SEQ ID NO: 181380 - RNA, 65 nt, Homo Sapiens
ccaaguagcugggauuacaggcaugagcuaccacgccuggcuaauuuuuuguauuuuuaguagag

SEQ ID NO: 181381 - RNA, 65 nt, Homo Sapiens
ccuaguagcuggaauuacaggcaugagccaccacgccuggcuaauuuuuguauuuuuaguagaga

SEQ ID NO: 181382 - RNA, 65 nt, Homo Sapiens
gcgagcagaucacgaggucaggagaccgagaccauccuggcuaacauggugaaacccugucucua

SEQ ID NO: 181383 - RNA, 65 nt, Homo Sapiens
uuuuuuguauuuuuuguggagcacaggccaccacaccuggcuaauccaaauagcugggacuacag

SEQ ID NO: 181384 - RNA, 65 nt, Homo Sapiens
ugaguagaaugcauuauaccuuuuuuuuuucuuccccuggcuacuaggcgagguaccuaccacuu

SEQ ID NO: 181385 - RNA, 65 nt, Homo Sapiens
ucuauuuaguagaaauggaggcacgcgccaccacaccuggcuaauccaaguagcugggauuacag

SEQ ID NO: 181386 - RNA, 65 nt, Homo Sapiens
agugaaacccugucuccacuggagaucgcgaccauccuggcuaacgcgggcggaucaugagguca

SEQ ID NO: 181387 - RNA, 65 nt, Homo Sapiens
acagugaaaccccaugucugggaaauugagaccauccuggcuaaugcagguagaucacaagguca

SEQ ID NO: 181388 - RNA, 65 nt, Homo Sapiens
agcgccuucuccaccggggcggcuccugccccgccccuggcuagccaccccuaaguccccaccug

SEQ ID NO: 181389 - RNA, 65 nt, Homo Sapiens
cuaggacaucaccuugcugucucuuccuuucggagccuggcuagucaguuaggagggacagacag

SEQ ID NO: 181390 - RNA, 65 nt, Homo Sapiens
cagugugugguuaguaggaaaaggacccgccaugcccuggcuagaugucuacugugccucaggau

SEQ ID NO: 181391 - RNA, 65 nt, Homo Sapiens
gggaggagucacugagagcucugucacugcucuccccuggcuacuaugcucagggccaccugaga

SEQ ID NO: 181392 - RNA, 65 nt, Homo Sapiens
cuaugaaccagccccacagccccaggccccugucaccuggcuaugcccacucaucccacccgucu

SEQ ID NO: 181393 - RNA, 65 nt, Homo Sapiens
ccaaguagcugggauuacaggcaugcaccaccaugccuggcuaauuuuguauuuuuaguagagau

SEQ ID NO: 181394 - RNA, 65 nt, Homo Sapiens
ccgaguagcugggacuacaggcgugugccaccaugccuggcuaauuuuuguauuuuuaguagaga

SEQ ID NO: 181395 - RNA, 65 nt, Homo Sapiens
agcaaacuaaacaauaaaggacagcucucuucucuccuggcuaaagcugcucuccugguucagaa

SEQ ID NO: 181396 - RNA, 65 nt, Homo Sapiens
gcgggcggaucacgaggucaggagaucgagaccauccuggcuaacacagugaaaccccgucucua

SEQ ID NO: 181397 - RNA, 65 nt, Homo Sapiens
gcggguggaucacgaggucaggagaucgagaccauccuggcuaacacggugaaacccugucucua

SEQ ID NO: 181398 - RNA, 65 nt, Homo Sapiens
aaaaugagcugggugugaugauacaugccuguaauccuggcuacuugggaggcugaggcaugaga

SEQ ID NO: 181399 - RNA, 65 nt, Homo Sapiens
ggugggcggaucacgaggucaggagauugagaccuccuggcuaacacggugaaaccccgucuuua

SEQ ID NO: 181400 - RNA, 65 nt, Homo Sapiens
ggggagacagagucuggguuccagggcugcugucuccuggcuaauaaucuccagccagcuggagg

SEQ ID NO: 181401 - RNA, 65 nt, Homo Sapiens
ggggagacagagucuggguuccagggcugcuuucuccuggcuaauaauaaauauccagccagcug

SEQ ID NO: 181402 - RNA, 65 nt, Homo Sapiens
uuuuuguauuuuuaguacaggugcgugccaccaugccuggcuaaucugaguagcugggacuacag

SEQ ID NO: 181403 - RNA, 65 nt, Homo Sapiens
ggugccacuggagcuagaacaagggccccagcugaccuggcuaugcagcaccugcugggguggga

SEQ ID NO: 181404 - RNA, 65 nt, Homo Sapiens
gcaauauuuacuaguagaggccccaguucaugaggccuggcuauuccccugcaaaugggacagcc

SEQ ID NO: 181405 - RNA, 65 nt, Homo Sapiens
uuuuguauuuuuaguagagagcgccugcuaccaugccuggcuaauccuaguggcugggauuacag

SEQ ID NO: 181406 - RNA, 65 nt, Homo Sapiens
gucucucagucauuccccugggucuggccguuggcccuggcuaaugugacauggccucugggugg

SEQ ID NO: 181407 - RNA, 65 nt, Homo Sapiens
ugggaggcugaggauggagggugcaugccugugguccuggcuacuaaacuuagcugggcauggug

SEQ ID NO: 181408 - RNA, 65 nt, Homo Sapiens
cugaguagcugggaauacaggcaugcgccacuacaccuggcuaauuuuuguauuuuuaguugaga

SEQ ID NO: 181409 - RNA, 65 nt, Homo Sapiens
gccugcuggggauuacucgaucaaaaccuuccuucccuggcuacuucccuuccucccggggccuu

SEQ ID NO: 181410 - RNA, 65 nt, Homo Sapiens
uggcaacagucuuacugaagaacauucccagugccccuggcuaggggcagagggcacugccaggc

SEQ ID NO: 181411 - RNA, 65 nt, Homo Sapiens
ucaauggcugaauaguuccuuaaaucagacaagcuccuggcuaucuucauaaccagcagugagua

SEQ ID NO: 181412 - RNA, 65 nt, Homo Sapiens
gcagguggaucacgaggucaggagaucgagaccauccuggcuaacacggugaaaccccgucucua

SEQ ID NO: 181413 - RNA, 65 nt, Homo Sapiens
aguugucucuuuaucaugguuuaccagguagagugccuggcuauuacuauauaaugaagcccacu

SEQ ID NO: 181414 - RNA, 65 nt, Homo Sapiens
cgggaggcugaggcaggagagcgggcaccuguaauccuggcuacuuacaaaaauuagguguggug

SEQ ID NO: 181415 - RNA, 65 nt, Homo Sapiens
gauugauguugcaucaauuucugugaaugacaggcccuggcuauugcgugugguggagugauugu

SEQ ID NO: 181416 - RNA, 65 nt, Homo Sapiens
uuuuguguuuuuaguagagagcaugcaccaccacaccuggcuaauccgaguagcugggauuacag

SEQ ID NO: 181417 - RNA, 65 nt, Homo Sapiens
uuuuguauuuuuaguagagagcgugcaccaccacaccuggcuaauccgaguagcugagauuauag

SEQ ID NO: 181418 - RNA, 65 nt, Homo Sapiens
uccccccuagcacgugagucaccaaaggcaaaaagccuggcuaccgcaguucuccaucuagucac

SEQ ID NO: 181419 - RNA, 65 nt, Homo Sapiens
uuuuguauuuuuaguagagggcgccagccaccaugccuggcuaaucugaguagcugggacuacag

SEQ ID NO: 181420 - RNA, 65 nt, Homo Sapiens
uuucgcauuaggaccagucuacuucccuaggaagcccuggcuaccgucuugcuaucauuguuccu

SEQ ID NO: 181421 - RNA, 65 nt, Homo Sapiens
aagucagagguagccaauguuucucaccuauguucccuggcuaaguuuaggcgucuucggauauc

SEQ ID NO: 181422 - RNA, 65 nt, Homo Sapiens
aagacacgaagcgaccuaccauguccagcacacagccuggcuauauuggggagggaagagccuug

SEQ ID NO: 181423 - RNA, 65 nt, Homo Sapiens
agaauuucauaugggcagaagaauacaccuggcacccuggcuaccauugacagcaucuggauuau

SEQ ID NO: 181424 - RNA, 64 nt, Homo Sapiens
uacucaguaaggcagugcaguacucaguaacacaauacaguacucaggcagugcaguacucagu

SEQ ID NO: 181425 - RNA, 64 nt, Homo Sapiens
aguguaguacucaguaacagugaaguacucaguaauacaguacaguauucaguaaggcagugaa

SEQ ID NO: 181426 - RNA, 64 nt, Homo Sapiens
uauucaguaaggcagugaaguacucaguaauacaauacaguacucaguuaggcagugcaguacu

SEQ ID NO: 181427 - RNA, 64 nt, Homo Sapiens
ugcaguacucaguaacacagugcaguacucaguaauacaguacaguacucaguaaggcaguaug

SEQ ID NO: 181428 - RNA, 64 nt, Homo Sapiens
caauuguaacacaaugguaauguuacuguauugaauacaguaggggguacaaaucuguacaaca

SEQ ID NO: 181429 - RNA, 64 nt, Homo Sapiens
cauugcauuuuaaaaucuucuguaguuaucauuuauacaguaauuccauccuugagagaguggg

SEQ ID NO: 181430 - RNA, 64 nt, Homo Sapiens
gcuguaaaauaaguagauagcugcuguuaauauaauacaguacauuuuggggggcauaugugug

SEQ ID NO: 181431 - RNA, 64 nt, Homo Sapiens
acuggugugauaucuuguaugaaugaucauuuaaauacaguacauuacuguagaagcuaaauug

SEQ ID NO: 181432 - RNA, 64 nt, Homo Sapiens
uuagauauaguuucuuaauaggauagauacccacauacaguauaauauaucccauucagguuuc

SEQ ID NO: 181433 - RNA, 64 nt, Homo Sapiens
ucuggaaagaaagccugccaggaaauaaauucaaauacaguaugagcugcggggauauuuuugu

SEQ ID NO: 181434 - RNA, 64 nt, Homo Sapiens
ggcaguaaccgauuuuaaugacuagcuuuuaaaaauacaguacaaagacuuuguaaaugugauu

SEQ ID NO: 181435 - RNA, 64 nt, Homo Sapiens
guuuguguuucuguguuucauauucagugauuuaauacaguaucauggcugagguggauggggc

SEQ ID NO: 181436 - RNA, 64 nt, Homo Sapiens
uauguagaaagauacauuaagggugaaaauagcaauacaguagauuugaauaccuugauguuuu

SEQ ID NO: 181437 - RNA, 64 nt, Homo Sapiens
uuaaaugugcaaauacuguauucaagugaaaaaaauacaguauuuguagauaaccauagcuacu

SEQ ID NO: 181438 - RNA, 64 nt, Homo Sapiens
cuccccuuaucuguaagagagaagcugaaauguaauacaguagucaaauuaguaaaguuuuaug

SEQ ID NO: 181439 - RNA, 64 nt, Homo Sapiens
uuugcacaaccucucacaaaugccauuuuuguaaauacaguaguaacuguugaauucacuuuug

SEQ ID NO: 181440 - RNA, 64 nt, Homo Sapiens
auauauauaguuaugcauacauacacacacacacauacaguauauucuuuccucaaaaggguua

SEQ ID NO: 181441 - RNA, 64 nt, Homo Sapiens
auagggaccuagaagcuuaacacuauuuaaguaaauacaguagaagcucacaaauagauuucuu

SEQ ID NO: 181442 - RNA, 64 nt, Homo Sapiens
cacaaacacacauaagaauacacucuggagaaagaccuuauaaauguaagacaugugggaaagg

SEQ ID NO: 181443 - RNA, 64 nt, Homo Sapiens
cacaaacacacguaagaaugcacucuguagaaagaccuuauaaauguaagauaugugggaaagg

SEQ ID NO: 181444 - RNA, 64 nt, Homo Sapiens; identical to SEQ ID NO: 99247

SEQ ID NO: 181445 - RNA, 64 nt, Homo Sapiens; identical to SEQ ID NO: 99248

SEQ ID NO: 181446 - RNA, 64 nt, Homo Sapiens; identical to SEQ ID NO: 99249

SEQ ID NO: 181447 - RNA, 64 nt, Homo Sapiens; identical to SEQ ID NO: 99250

SEQ ID NO: 181448 - RNA, 64 nt, Homo Sapiens; identical to SEQ ID NO: 99251

SEQ ID NO: 181449 - RNA, 64 nt, Homo Sapiens; identical to SEQ ID NO: 99252

SEQ ID NO: 181450 - RNA, 64 nt, Homo Sapiens; identical to SEQ ID NO: 99253

SEQ ID NO: 181451 - RNA, 64 nt, Homo Sapiens; identical to SEQ ID NO: 99254

SEQ ID NO: 181452 - RNA, 64 nt, Homo Sapiens; identical to SEQ ID NO: 99255

SEQ ID NO: 181453 - RNA, 64 nt, Homo Sapiens; identical to SEQ ID NO: 99256

SEQ ID NO: 181454 - RNA, 64 nt, Homo Sapiens; identical to SEQ ID NO: 99257

SEQ ID NO: 181455 - RNA, 64 nt, Homo Sapiens; identical to SEQ ID NO: 99258

SEQ ID NO: 181456 - RNA, 64 nt, Homo Sapiens; identical to SEQ ID NO: 99259

SEQ ID NO: 181457 - RNA, 64 nt, Homo Sapiens; identical to SEQ ID NO: 99260

SEQ ID NO: 181458 - RNA, 64 nt, Homo Sapiens; identical to SEQ ID NO: 99261

SEQ ID NO: 181459 - RNA, 64 nt, Homo Sapiens; identical to SEQ ID NO: 99262

SEQ ID NO: 181460 - RNA, 64 nt, Homo Sapiens; identical to SEQ ID NO: 99263

SEQ ID NO: 181461 - RNA, 64 nt, Homo Sapiens; identical to SEQ ID NO: 99264

SEQ ID NO: 181462 - RNA, 64 nt, Homo Sapiens; identical to SEQ ID NO: 99265

SEQ ID NO: 181463 - RNA, 64 nt, Homo Sapiens; identical to SEQ ID NO: 99266

SEQ ID NO: 181464 - RNA, 64 nt, Homo Sapiens; identical to SEQ ID NO: 99267

SEQ ID NO: 181465 - RNA, 64 nt, Homo Sapiens; identical to SEQ ID NO: 99268

SEQ ID NO: 181466 - RNA, 64 nt, Homo Sapiens; identical to SEQ ID NO: 99269

SEQ ID NO: 181467 - RNA, 64 nt, Homo Sapiens; identical to SEQ ID NO: 99270

SEQ ID NO: 181468 - RNA, 64 nt, Homo Sapiens; identical to SEQ ID NO: 99271

SEQ ID NO: 181469 - RNA, 61 nt, Homo Sapiens
agcccccuuccagucaugaaacuucauuuguuuuauccauaucccugaggacuguguagac

SEQ ID NO: 181470 - RNA, 61 nt, Homo Sapiens
acugaaauugcauggaucaaguaagcauaguuuuauccagggagaaaaauaaaaggaagcc

SEQ ID NO: 181471 - RNA, 61 nt, Homo Sapiens
caggaagauucuauauccuguguccucuccuuuuauccaagaaaguaugagaaacacaguu

SEQ ID NO: 181472 - RNA, 61 nt, Homo Sapiens
aagguagcggccacaugguucuaccuggguuuuuauccacaucugcauuccaaacagcauc

SEQ ID NO: 181473 - RNA, 61 nt, Homo Sapiens
aacuccauuccagucucugcauguaaucaguuuuauccacagaaacauuuucauuuuagga

SEQ ID NO: 181474 - RNA, 61 nt, Homo Sapiens
ucuuacagacugcauguaguuggguauaauuuuuauccagucuaaaaauaucugucuuuua

SEQ ID NO: 181475 - RNA, 61 nt, Homo Sapiens
ucuguucauuugaucguuucgugacucgacguuuauccacuaugcguauggucucagccaa

SEQ ID NO: 181476 - RNA, 61 nt, Homo Sapiens
ccuccaaggucaggaugggacuccccacagcuuuauccaaguggcuggaccaugaggcugu

SEQ ID NO: 181477 - RNA, 61 nt, Homo Sapiens
gggagcaaggagaaaaaugggaagaaccaguuuuauccaucuuaaaacgccaggcaccucu

SEQ ID NO: 181478 - RNA, 61 nt, Homo Sapiens
ccaacauguauccaaauuaagcccccuuaccuuuauccagacccuuucacaaacaaguucu

SEQ ID NO: 181479 - RNA, 61 nt, Homo Sapiens
cugcagucccaauuuaaaaaugcagaacugcuuuauccaagaaugcugaaaaauacuguuc

SEQ ID NO: 181480 - RNA, 61 nt, Homo Sapiens
uucauuguuaaguagaauauguauguugcauuuuauccauaagaaauaaagagaaaaaaac

SEQ ID NO: 181481 - RNA, 61 nt, Homo Sapiens
cauuaguacguguggcagaaguuuauuuauuuuuauccaguauagaauucaauuauaugau

SEQ ID NO: 181482 - RNA, 61 nt, Homo Sapiens
uauagaauucaauuauaugauuauaucacaauuuauccauucugcuguugauggacuuuua

SEQ ID NO: 181483 - RNA, 61 nt, Homo Sapiens
cuugcccauugccugucucucgccaauuccguuuauccaaaaagguacauguuuuuguauu

SEQ ID NO: 181484 - RNA, 61 nt, Homo Sapiens
aauaaauaaauaaauaaguuaaaauuaauucuuuauccagagucgggugcuuuagaauuua

SEQ ID NO: 181485 - RNA, 61 nt, Homo Sapiens
uuaacucauguaauccucaucuuuuauccauuuuauccauuuuuaaauaauuuacucucua

SEQ ID NO: 181486 - RNA, 61 nt, Homo Sapiens
uuauccauuuuaacucauguuacucucuacuuuuauccauuuugauaaaguuuaaauaauu

SEQ ID NO: 181487 - RNA, 61 nt, Homo Sapiens
auucuaggaauuuucagcaaucauuuaaaguuuuauccaauaaagucaguuauucauguuu

SEQ ID NO: 181488 - RNA, 61 nt, Homo Sapiens
auucuaggaauuuucagcaauuauuuaaaguuuuauccagucaaagacacaguuguucaug

SEQ ID NO: 181489 - RNA, 64 nt, Homo Sapiens
uucaguaguuauugccaauauuguuguuggucaauggcuugaagauaaacuuucuaauaauuau

SEQ ID NO: 181490 - RNA, 64 nt, Homo Sapiens
uuagauaaauacuuauacuuugcaaagucaaaaauggcuugauuuuuggaaacaauauagaggu

SEQ ID NO: 181491 - RNA, 64 nt, Homo Sapiens
ugagugcaacuguggcuuagcuaauauugcaauguggcuugaauguagguagcauccuuugaug

SEQ ID NO: 181492 - RNA, 64 nt, Homo Sapiens
ucacaaugaaauuauauuuucuuuguaaagaaaguggcuugaaaucuuuuuuguucaaagauua

SEQ ID NO: 181493 - RNA, 64 nt, Homo Sapiens
ggacuggcaggcggggccucaagccugcagccacuggcuugauugggcccuggacguugagccc

SEQ ID NO: 181494 - RNA, 64 nt, Homo Sapiens
aagggcuccacugcugacaagguuugagaacugcuggcuugaggugagaaccccuuuaaccucu

SEQ ID NO: 181495 - RNA, 64 nt, Homo Sapiens
ggggugcuuccaagaggcaugagagugccuacucuggcuugagcacuucuauaugcaaggugaa

SEQ ID NO: 181496 - RNA, 64 nt, Homo Sapiens
aauuggcucuuucuaaaucaugugacguuuugacuggcuugagauucagaugcauaauuuuuaa

SEQ ID NO: 181497 - RNA, 64 nt, Homo Sapiens
ucagucaaucuggugcagauuaucauuuuuauuguggcuugagcagaaaccuuuuucuacuuac

SEQ ID NO: 181498 - RNA, 64 nt, Homo Sapiens
uuuaaccauuuauuacauaaggaccugcaagauguggcuugaauuuggcagaucuugacaggcu

SEQ ID NO: 181499 - RNA, 64 nt, Homo Sapiens
ugugugaaaggaggguuuugccucuucuugagcauggcuugaguugguaaggaaagcuguaacu

SEQ ID NO: 181500 - RNA, 64 nt, Homo Sapiens
ugcuaccccuaagaucgagcuuguuuucagugacuggcuugagucauaggaggaggagucuggu

SEQ ID NO: 181501 - RNA, 64 nt, Homo Sapiens
gcuuaaacuauugacuugguacugaacagugaaguggcuugauuucauuucaugauguaaagaa

SEQ ID NO: 181502 - RNA, 64 nt, Homo Sapiens; identical to SEQ ID NO: 181501

SEQ ID NO: 181503 - RNA, 64 nt, Homo Sapiens
gcagaaggacaaccuccgcaugucugaagggucuuggcuugauuauccugggcucagcugcccc

SEQ ID NO: 181504 - RNA, 64 nt, Homo Sapiens
gguguaccuggagaggggguuuuggccaggcugguggcuugaugucuggacagaaagaugcccg

SEQ ID NO: 181505 - RNA, 64 nt, Homo Sapiens
accuagaaguaaugauauacaguuuucuuccuaguggcuugaaaaucuggacuuccucaauuau

SEQ ID NO: 181506 - RNA, 64 nt, Homo Sapiens
gagugccuggcuauuacuauauaaugaagcccacuggcuugacuuguaaguucaaccuaaacca

SEQ ID NO: 181507 - RNA, 64 nt, Homo Sapiens; identical to SEQ ID NO: 48749

SEQ ID NO: 181508 - RNA, 64 nt, Homo Sapiens; identical to SEQ ID NO: 48750

SEQ ID NO: 181509 - RNA, 64 nt, Homo Sapiens; identical to SEQ ID NO: 48751

SEQ ID NO: 181510 - RNA, 64 nt, Homo Sapiens; identical to SEQ ID NO: 48752

SEQ ID NO: 181511 - RNA, 64 nt, Homo Sapiens; identical to SEQ ID NO: 48753

SEQ ID NO: 181512 - RNA, 64 nt, Homo Sapiens; identical to SEQ ID NO: 48754

SEQ ID NO: 181513 - RNA, 64 nt, Homo Sapiens; identical to SEQ ID NO: 48755

SEQ ID NO: 181514 - RNA, 64 nt, Homo Sapiens; identical to SEQ ID NO: 48756

SEQ ID NO: 181515 - RNA, 64 nt, Homo Sapiens; identical to SEQ ID NO: 48757

SEQ ID NO: 181516 - RNA, 64 nt, Homo Sapiens; identical to SEQ ID NO: 48758

SEQ ID NO: 181517 - RNA, 64 nt, Homo Sapiens
ggagacaagacuuggagacucagcgaugucaggccagggccauggccacacuggcccacacauu

SEQ ID NO: 181518 - RNA, 64 nt, Homo Sapiens
gagaauuucuaugaagcccacucacuugccauuccagggccaaaggaccggagguuugcauauc

SEQ ID NO: 181519 - RNA, 64 nt, Homo Sapiens
uccucacagcagucacaggcccuaaccaugggcucagggccaggaugcucauuccaugacucug

SEQ ID NO: 181520 - RNA, 64 nt, Homo Sapiens
auucaggccucugaggagccgccccacugcccuccagggccaggcagggaccacauccacccca

SEQ ID NO: 181521 - RNA, 64 nt, Homo Sapiens
augccuggaugccuggguaggccucccugagcuccagggccagacugcuccgacucucagggcu

SEQ ID NO: 181522 - RNA, 64 nt, Homo Sapiens
uaggccugugguucccugcuggguaucccccuggcagggccagcgcgccaugucaggcuguugu

SEQ ID NO: 181523 - RNA, 64 nt, Homo Sapiens
cagauggaggccucugggaguggagccacagggccagggccaugccacagccagggcagccugc

SEQ ID NO: 181524 - RNA, 64 nt, Homo Sapiens
gccaugcagauggaggccucgccugcuggagccacagggccaggggcuacccacagccagggca

SEQ ID NO: 181525 - RNA, 64 nt, Homo Sapiens
gaacaaaacaaaguaugcagagacagagcauuugcagggccaccuggaggcuggggugcugggg

SEQ ID NO: 181526 - RNA, 64 nt, Homo Sapiens
cucuggcagggccugagcuggggcaggccucccucagggccaggggcgauggcaccccggggac

SEQ ID NO: 181527 - RNA, 64 nt, Homo Sapiens
uagauccuggcucggaccacugcaagggccgaggcagggccagaccagagcauccuggguacag

SEQ ID NO: 181528 - RNA, 64 nt, Homo Sapiens
guguccuuguccacucgcaccccucgccgcccaccagggccaugcucugugacuugggcugauc

SEQ ID NO: 181529 - RNA, 64 nt, Homo Sapiens
aggcgcggccucccgaggaggggcccgguggcggcagggccaggcugguccgagcugaggacuc

SEQ ID NO: 181530 - RNA, 64 nt, Homo Sapiens
ucgcccaggaaggccuaggcuaggacguuggccucagggccaggaaggacagacuggccgggca

SEQ ID NO: 181531 - RNA, 64 nt, Homo Sapiens
ggaauccucaaacuucccucagaggaggaggacccagggccaaacccucgucugggaauucgag

SEQ ID NO: 181532 - RNA, 64 nt, Homo Sapiens
gcaggcaggagcaggcacugaagugguggagccucagggccagguagguccuggguggaggaag

SEQ ID NO: 181533 - RNA, 64 nt, Homo Sapiens
gucuaugcguuccaucuccaguaggcagcagggucagggccaaagggguggcagguaccacagu

SEQ ID NO: 181534 - RNA, 64 nt, Homo Sapiens
cccuccagcuggucccaugucugaugcuaacagccagggccaguccaauuuggaagccauccag

SEQ ID NO: 181535 - RNA, 64 nt, Homo Sapiens
gagcacaaagacacgaagucaugggccuggggcccagggccaggguggggcccaggccacuggc

SEQ ID NO: 181536 - RNA, 64 nt, Homo Sapiens
acgacugacucucucccagcugcucugggagucucagggccaagccuguaucucuucacucugc

SEQ ID NO: 181537 - RNA, 64 nt, Homo Sapiens
acaccauuuauaccacagguccagaugaauccugcagggccaaggucugggggugcuggaggcc

SEQ ID NO: 181538 - RNA, 64 nt, Homo Sapiens
uccaucccugagcucucggcuccuccuccgucuucagggccagggcguagcgucugcucucucg

SEQ ID NO: 181539 - RNA, 64 nt, Homo Sapiens
uuuauuucccugacccugccuucugccaugaccccagggccacuagucucuuccccuguuuuua

SEQ ID NO: 181540 - RNA, 64 nt, Homo Sapiens
uaauagucugaaggaagaggcugugagggcaguucagggccagggcccacagggcaucugcuga

SEQ ID NO: 181541 - RNA, 64 nt, Homo Sapiens
aaguagaggcugggaacucucuuucugccugugucagggccaggagugaacauauuccuaggcc

SEQ ID NO: 181542 - RNA, 64 nt, Homo Sapiens
gaguagucauuuugcccauuguaccaucggucagcagggccacuuagauauccuuggcacaucc

SEQ ID NO: 181543 - RNA, 64 nt, Homo Sapiens
ccugacuuagccgagguaaggucagugcagcagacagggccagacugggguguggggggcugag

SEQ ID NO: 181544 - RNA, 64 nt, Homo Sapiens
caagcaccuugaaugggaggggccucacagagggcagggccaggguccagcagggguggggggu

SEQ ID NO: 181545 - RNA, 64 nt, Homo Sapiens
cagcagagguagaggguccugugauaacuuggcccagggccacaagggccaaggguccagagaa

SEQ ID NO: 181546 - RNA, 64 nt, Homo Sapiens
gguccagagaagugauaacuagagcagagaacuacagggccaaguaggccccugagagcuggac

SEQ ID NO: 181547 - RNA, 64 nt, Homo Sapiens
cacugugacgucggccgaccgugucccagccacgcagggccaucgccaugccugcucccugucu

SEQ ID NO: 181548 - RNA, 64 nt, Homo Sapiens
gcaggggacugucucagaagaauuccacagggaccagggccaccucccccuccugcugugcugg

SEQ ID NO: 181549 - RNA, 53 nt, Homo Sapiens
augcagagacucuguacugaggccagggccagggccaggggacucugugaguc

SEQ ID NO: 181550 - RNA, 59 nt, Homo Sapiens
augcagagacucuguacugaggccagggccagggccaggggacucugugagucuggcuc

SEQ ID NO: 181551 - RNA, 64 nt, Homo Sapiens
guuggagaauucugauuccuccccucacuggggacagggccagucgcugguaugggggcucgga

SEQ ID NO: 181552 - RNA, 64 nt, Homo Sapiens
cggcagcacacucaucccgcccccugcaugcacccagggccaccagacgaggcugcauccugag

SEQ ID NO: 181553 - RNA, 64 nt, Homo Sapiens
gaaauggcgaagccagccaccaggucgcuggugacagggccaggguuaugcaggaagguggugc

SEQ ID NO: 181554 - RNA, 64 nt, Homo Sapiens
gugacaagggguccucgucugccccccaaugcuccagggccaguccuaaggagcugagggucug

SEQ ID NO: 181555 - RNA, 64 nt, Homo Sapiens
gucccaguccucggccacccccagcucuggaucccagggccagcugcccucuggcucuggcugu

SEQ ID NO: 181556 - RNA, 64 nt, Homo Sapiens
cucuggcuguggcucccgccuguccggcagggcccagggccagcgucgggcacagggcagcucc

SEQ ID NO: 181557 - RNA, 64 nt, Homo Sapiens
cacgucuucgugcauucgccaacacgugcccucacagggccagcguccuccuucccugcgcaag

SEQ ID NO: 181558 - RNA, 64 nt, Homo Sapiens
cuucagaggcuccuccugggacugggaaccgccgcagggccaggcggacggcgugagguuugug

SEQ ID NO: 181559 - RNA, 64 nt, Homo Sapiens
aggcccgucugccagggcgccggccacaauccugcagggccaaggacuggacuccaggcaaguc

SEQ ID NO: 181560 - RNA, 64 nt, Homo Sapiens
ccccaggggcgucgaccuggcccagcuggguccccagggccagcacauggaauaaaauagccag

SEQ ID NO: 181561 - RNA, 64 nt, Homo Sapiens
ggguccccagggccagcacauggaauaaaauagccagggccacacucagcccagcucuguccug

SEQ ID NO: 181562 - RNA, 64 nt, Homo Sapiens
auggggcccccucccucucccggggugcagacggcagggccaguguguuuaguggggaaaggga

SEQ ID NO: 181563 - RNA, 64 nt, Homo Sapiens
ccacaggaagggcugagcugucagaggccaucugcagggccaaggcagggggcuaggggaggac

SEQ ID NO: 181564 - RNA, 64 nt, Homo Sapiens
uggguucauauuuacagauacuccucucugcggccagggccaggccagccccaguuucccauug

SEQ ID NO: 181565 - RNA, 64 nt, Homo Sapiens
guccccuuggugaagccguggggugggccagccccagggccaggagugaaggaacagaggcagg

SEQ ID NO: 181566 - RNA, 64 nt, Homo Sapiens
acaggcuguagaaggggaugaguggcuuccccuucagggccacagucccccaugcaacaggccc

SEQ ID NO: 181567 - RNA, 64 nt, Homo Sapiens
cccagcaguuucccuguccugccaaugcaugcuucagggccacagccagcgggcagggaaaugg

SEQ ID NO: 181568 - RNA, 64 nt, Homo Sapiens
gggcagggaaaugggccaaugcaugagaugcaaccagggccagcaggagggagagggagucuga

SEQ ID NO: 181569 - RNA, 62 nt, Homo Sapiens
ccauuuguggaaaguggagaguucuucccaagcuggcagaggucaggacacaggucauggag

SEQ ID NO: 181570 - RNA, 62 nt, Homo Sapiens
gcaggcgaagggcaggaggacagaggucucuccuggcagaaaaccucauagccagcucuaca

SEQ ID NO: 181571 - RNA, 62 nt, Homo Sapiens
caaauaaacccagugucaggcuccccgucuuccuggcagacaccauuuacgauucucacuga

SEQ ID NO: 181572 - RNA, 62 nt, Homo Sapiens
cuuugagaauggggagaaacucuauaguucuccuggcagagcgagaccugggacucuguauu

SEQ ID NO: 181573 - RNA, 62 nt, Homo Sapiens
cagggagaauggggagagggaccuccuugugucuggcagagaccuguggaccuggccucccc

SEQ ID NO: 181574 - RNA, 62 nt, Homo Sapiens
ccgccccugggguuggcagccucaguuggccccuggcagaggaacaaggacacagacauucc

SEQ ID NO: 181575 - RNA, 62 nt, Homo Sapiens
gguuuucuuucuccaugccaguucaguuccuucuggcagagaccuuccuuaggacuuccaga

SEQ ID NO: 181576 - RNA, 62 nt, Homo Sapiens
uagggggcugcuuugggcuuggcgggucugggcuggcagaggacccuccucuagaauuuagu

SEQ ID NO: 181577 - RNA, 62 nt, Homo Sapiens
auuuucaaaagcaauucuucggugcuguguagcuggcagaaaguucuguccaguaaacgcag

SEQ ID NO: 181578 - RNA, 62 nt, Homo Sapiens
uggaagaaauagcaggagagaggacccauuagcuggcagacccagggggaagaaaggagggc

SEQ ID NO: 181579 - RNA, 62 nt, Homo Sapiens
agcaggauccucuuggccuuacuagacgugaccuggcagauuuucagucccucuccccaaag

SEQ ID NO: 181580 - RNA, 62 nt, Homo Sapiens
aagaggccaucagaaggacgugcccucagggacuggcagagcaggcaaccuuguguucucug

SEQ ID NO: 181581 - RNA, 62 nt, Homo Sapiens
gagcaugcccgagagccuggacagcccaaccucuggcagaccagggguuaccagccucacag

SEQ ID NO: 181582 - RNA, 62 nt, Homo Sapiens
uauuuaauucaccagcaguaauccuuuaauaacuggcagagcacuuuauucuucuggugagc

SEQ ID NO: 181583 - RNA, 62 nt, Homo Sapiens
ugccccauggugggcaggcagaugaugaaguacuggcagauuugcaggcugggaaggcuaga

SEQ ID NO: 181584 - RNA, 62 nt, Homo Sapiens
ccacccuucucuccuuuccucauccuaagugccuggcagaugaaggaguuuucaggagcuuu

SEQ ID NO: 181585 - RNA, 62 nt, Homo Sapiens
gcccggccccuggggggagggcugcggccgggcuggcagaggaguuggcgagggacacgaag

SEQ ID NO: 181586 - RNA, 62 nt, Homo Sapiens
guccuggugccccagacggggggcccugggcucuggcagaugguuccacaagugccucugga

SEQ ID NO: 181587 - RNA, 62 nt, Homo Sapiens
gcucuccuugccucccaagggcucagaugcugcuggcagaguugucucgggagcggggugag

SEQ ID NO: 181588 - RNA, 62 nt, Homo Sapiens
ugugcccucuugcccccaggaagggcagcuggcuggcagacaaggugaagaggcugaugcgg

SEQ ID NO: 181589 - RNA, 62 nt, Homo Sapiens
gcccugugugggaccacacugucaucucgcugcuggcagaaaagccugaucccaggaggccc

SEQ ID NO: 181590 - RNA, 62 nt, Homo Sapiens
ggcacagccuggcagggaccucguccccaagccuggcagaaugagagggguugaggucccga

SEQ ID NO: 181591 - RNA, 62 nt, Homo Sapiens
cauagaccauggccuguuagugguccuuggggcuggcagacccuauagcugcugcuuuuucu

SEQ ID NO: 181592 - RNA, 62 nt, Homo Sapiens
aaaaguggucccgcuaccauagauccuuacagcuggcagaguucccaccagcuguuucagau

SEQ ID NO: 181593 - RNA, 62 nt, Homo Sapiens
augaggagacagaauagagugauaggaagcgucuggcagauacuccuuuugccacugcugug

SEQ ID NO: 181594 - RNA, 62 nt, Homo Sapiens
cugcccagacagccgcagugaggaugagcguccuggcagagacgcaguugucucugggcgcu

SEQ ID NO: 181595 - RNA, 62 nt, Homo Sapiens
uugugcccccuggagcagugggcgcacuguuccuggcagauagccccagcauuguguuguga

SEQ ID NO: 181596 - RNA, 62 nt, Homo Sapiens
uuuccagaaggaggucacuucauaggaacaaucuggcagaagggaugaucagagaacuuggg

SEQ ID NO: 181597 - RNA, 62 nt, Homo Sapiens
ccgagggugccuggccagucaaaugggggcugcuggcagacccccagggcaucgcuaaaccc

SEQ ID NO: 181598 - RNA, 62 nt, Homo Sapiens
ugggagcuccugucgaccgagcagagagagcgcuggcagaucgacgcuggcuggcucgacug

SEQ ID NO: 181599 - RNA, 62 nt, Homo Sapiens
gagcgcuggcagaucugggauggcuggcucgacuggcagagaaguccgcgccugggggacgc

SEQ ID NO: 181600 - RNA, 56 nt, Homo Sapiens; identical to SEQ ID NO: 44915

SEQ ID NO: 181601 - RNA, 64 nt, Homo Sapiens; identical to SEQ ID NO: 44916

SEQ ID NO: 181602 - RNA, 64 nt, Homo Sapiens; identical to SEQ ID NO: 44917

SEQ ID NO: 181603 - RNA, 64 nt, Homo Sapiens; identical to SEQ ID NO: 44918

SEQ ID NO: 181604 - RNA, 64 nt, Homo Sapiens; identical to SEQ ID NO: 44919

SEQ ID NO: 181605 - RNA, 64 nt, Homo Sapiens; identical to SEQ ID NO: 44920

SEQ ID NO: 181606 - RNA, 64 nt, Homo Sapiens; identical to SEQ ID NO: 44921

SEQ ID NO: 181607 - RNA, 64 nt, Homo Sapiens; identical to SEQ ID NO: 44922

SEQ ID NO: 181608 - RNA, 64 nt, Homo Sapiens; identical to SEQ ID NO: 44923

SEQ ID NO: 181609 - RNA, 64 nt, Homo Sapiens; identical to SEQ ID NO: 44924

SEQ ID NO: 181610 - RNA, 64 nt, Homo Sapiens; identical to SEQ ID NO: 44925

SEQ ID NO: 181611 - RNA, 64 nt, Homo Sapiens; identical to SEQ ID NO: 44926

SEQ ID NO: 181612 - RNA, 64 nt, Homo Sapiens; identical to SEQ ID NO: 44927

SEQ ID NO: 181613 - RNA, 64 nt, Homo Sapiens; identical to SEQ ID NO: 44928

SEQ ID NO: 181614 - RNA, 64 nt, Homo Sapiens; identical to SEQ ID NO: 44929

SEQ ID NO: 181615 - RNA, 64 nt, Homo Sapiens; identical to SEQ ID NO: 44930

SEQ ID NO: 181616 - RNA, 64 nt, Homo Sapiens; identical to SEQ ID NO: 44931

SEQ ID NO: 181617 - RNA, 64 nt, Homo Sapiens; identical to SEQ ID NO: 44932

SEQ ID NO: 181618 - RNA, 64 nt, Homo Sapiens; identical to SEQ ID NO: 44933

SEQ ID NO: 181619 - RNA, 64 nt, Homo Sapiens; identical to SEQ ID NO: 45477

SEQ ID NO: 181620 - RNA, 64 nt, Homo Sapiens; identical to SEQ ID NO: 45478

SEQ ID NO: 181621 - RNA, 64 nt, Homo Sapiens; identical to SEQ ID NO: 45479

SEQ ID NO: 181622 - RNA, 64 nt, Homo Sapiens; identical to SEQ ID NO: 45480

SEQ ID NO: 181623 - RNA, 64 nt, Homo Sapiens; identical to SEQ ID NO: 45481

SEQ ID NO: 181624 - RNA, 64 nt, Homo Sapiens; identical to SEQ ID NO: 45482

SEQ ID NO: 181625 - RNA, 64 nt, Homo Sapiens; identical to SEQ ID NO: 45483

SEQ ID NO: 181626 - RNA, 64 nt, Homo Sapiens; identical to SEQ ID NO: 45484

SEQ ID NO: 181627 - RNA, 64 nt, Homo Sapiens; identical to SEQ ID NO: 45485

SEQ ID NO: 181628 - RNA, 64 nt, Homo Sapiens; identical to SEQ ID NO: 45486

SEQ ID NO: 181629 - RNA, 64 nt, Homo Sapiens; identical to SEQ ID NO: 45487

SEQ ID NO: 181630 - RNA, 56 nt, Homo Sapiens; identical to SEQ ID NO: 45488

SEQ ID NO: 181631 - RNA, 64 nt, Homo Sapiens; identical to SEQ ID NO: 45489

SEQ ID NO: 181632 - RNA, 64 nt, Homo Sapiens; identical to SEQ ID NO: 45490

SEQ ID NO: 181633 - RNA, 64 nt, Homo Sapiens; identical to SEQ ID NO: 45491

SEQ ID NO: 181634 - RNA, 64 nt, Homo Sapiens; identical to SEQ ID NO: 45492

SEQ ID NO: 181635 - RNA, 64 nt, Homo Sapiens; identical to SEQ ID NO: 45493

SEQ ID NO: 181636 - RNA, 64 nt, Homo Sapiens; identical to SEQ ID NO: 45494

SEQ ID NO: 181637 - RNA, 64 nt, Homo Sapiens; identical to SEQ ID NO: 45495

SEQ ID NO: 181638 - RNA, 64 nt, Homo Sapiens; identical to SEQ ID NO: 45496

SEQ ID NO: 181639 - RNA, 64 nt, Homo Sapiens; identical to SEQ ID NO: 45497

SEQ ID NO: 181640 - RNA, 64 nt, Homo Sapiens; identical to SEQ ID NO: 45498

SEQ ID NO: 181641 - RNA, 64 nt, Homo Sapiens; identical to SEQ ID NO: 45499

SEQ ID NO: 181642 - RNA, 64 nt, Homo Sapiens; identical to SEQ ID NO: 45500

SEQ ID NO: 181643 - RNA, 64 nt, Homo Sapiens; identical to SEQ ID NO: 45501

SEQ ID NO: 181644 - RNA, 64 nt, Homo Sapiens; identical to SEQ ID NO: 45502

SEQ ID NO: 181645 - RNA, 64 nt, Homo Sapiens; identical to SEQ ID NO: 45503

SEQ ID NO: 181646 - RNA, 64 nt, Homo Sapiens; identical to SEQ ID NO: 45504

SEQ ID NO: 181647 - RNA, 64 nt, Homo Sapiens; identical to SEQ ID NO: 45505

SEQ ID NO: 181648 - RNA, 64 nt, Homo Sapiens; identical to SEQ ID NO: 45506

SEQ ID NO: 181649 - RNA, 64 nt, Homo Sapiens; identical to SEQ ID NO: 45507

SEQ ID NO: 181650 - RNA, 64 nt, Homo Sapiens; identical to SEQ ID NO: 45508

SEQ ID NO: 181651 - RNA, 64 nt, Homo Sapiens; identical to SEQ ID NO: 45509

SEQ ID NO: 181652 - RNA, 64 nt, Homo Sapiens; identical to SEQ ID NO: 45510

SEQ ID NO: 181653 - RNA, 64 nt, Homo Sapiens; identical to SEQ ID NO: 45511

SEQ ID NO: 181654 - RNA, 64 nt, Homo Sapiens; identical to SEQ ID NO: 45512

SEQ ID NO: 181655 - RNA, 64 nt, Homo Sapiens; identical to SEQ ID NO: 45513

SEQ ID NO: 181656 - RNA, 64 nt, Homo Sapiens; identical to SEQ ID NO: 45514

SEQ ID NO: 181657 - RNA, 64 nt, Homo Sapiens; identical to SEQ ID NO: 45515

SEQ ID NO: 181658 - RNA, 64 nt, Homo Sapiens; identical to SEQ ID NO: 45516

SEQ ID NO: 181659 - RNA, 64 nt, Homo Sapiens; identical to SEQ ID NO: 45517

SEQ ID NO: 181660 - RNA, 64 nt, Homo Sapiens; identical to SEQ ID NO: 45518

SEQ ID NO: 181661 - RNA, 64 nt, Homo Sapiens; identical to SEQ ID NO: 45519

SEQ ID NO: 181662 - RNA, 64 nt, Homo Sapiens; identical to SEQ ID NO: 45520

SEQ ID NO: 181663 - RNA, 64 nt, Homo Sapiens; identical to SEQ ID NO: 45521

SEQ ID NO: 181664 - RNA, 64 nt, Homo Sapiens; identical to SEQ ID NO: 45522

SEQ ID NO: 181665 - RNA, 64 nt, Homo Sapiens; identical to SEQ ID NO: 45523

SEQ ID NO: 181666 - RNA, 64 nt, Homo Sapiens; identical to SEQ ID NO: 45524

SEQ ID NO: 181667 - RNA, 64 nt, Homo Sapiens; identical to SEQ ID NO: 45525

SEQ ID NO: 181668 - RNA, 64 nt, Homo Sapiens; identical to SEQ ID NO: 45526

SEQ ID NO: 181669 - RNA, 64 nt, Homo Sapiens; identical to SEQ ID NO: 45527

SEQ ID NO: 181670 - RNA, 64 nt, Homo Sapiens; identical to SEQ ID NO: 45528

SEQ ID NO: 181671 - RNA, 64 nt, Homo Sapiens; identical to SEQ ID NO: 45529

SEQ ID NO: 181672 - RNA, 64 nt, Homo Sapiens; identical to SEQ ID NO: 45530

SEQ ID NO: 181673 - RNA, 64 nt, Homo Sapiens; identical to SEQ ID NO: 45531

SEQ ID NO: 181674 - RNA, 64 nt, Homo Sapiens; identical to SEQ ID NO: 45532

SEQ ID NO: 181675 - RNA, 64 nt, Homo Sapiens; identical to SEQ ID NO: 45533

SEQ ID NO: 181676 - RNA, 64 nt, Homo Sapiens; identical to SEQ ID NO: 45534

SEQ ID NO: 181677 - RNA, 64 nt, Homo Sapiens; identical to SEQ ID NO: 45535

SEQ ID NO: 181678 - RNA, 64 nt, Homo Sapiens; identical to SEQ ID NO: 45536

SEQ ID NO: 181679 - RNA, 64 nt, Homo Sapiens; identical to SEQ ID NO: 45537

SEQ ID NO: 181680 - RNA, 64 nt, Homo Sapiens; identical to SEQ ID NO: 45538

SEQ ID NO: 181681 - RNA, 64 nt, Homo Sapiens; identical to SEQ ID NO: 45539

SEQ ID NO: 181682 - RNA, 64 nt, Homo Sapiens; identical to SEQ ID NO: 45540

SEQ ID NO: 181683 - RNA, 64 nt, Homo Sapiens; identical to SEQ ID NO: 45541

SEQ ID NO: 181684 - RNA, 64 nt, Homo Sapiens; identical to SEQ ID NO: 45542

SEQ ID NO: 181685 - RNA, 64 nt, Homo Sapiens; identical to SEQ ID NO: 45543

SEQ ID NO: 181686 - RNA, 64 nt, Homo Sapiens; identical to SEQ ID NO: 45544

SEQ ID NO: 181687 - RNA, 64 nt, Homo Sapiens; identical to SEQ ID NO: 45545

SEQ ID NO: 181688 - RNA, 64 nt, Homo Sapiens; identical to SEQ ID NO: 45546

SEQ ID NO: 181689 - RNA, 64 nt, Homo Sapiens; identical to SEQ ID NO: 45547

SEQ ID NO: 181690 - RNA, 64 nt, Homo Sapiens; identical to SEQ ID NO: 45548

SEQ ID NO: 181691 - RNA, 64 nt, Homo Sapiens; identical to SEQ ID NO: 45549

SEQ ID NO: 181692 - RNA, 64 nt, Homo Sapiens; identical to SEQ ID NO: 45550

SEQ ID NO: 181693 - RNA, 64 nt, Homo Sapiens; identical to SEQ ID NO: 45551

SEQ ID NO: 181694 - RNA, 64 nt, Homo Sapiens; identical to SEQ ID NO: 45552

SEQ ID NO: 181695 - RNA, 64 nt, Homo Sapiens; identical to SEQ ID NO: 45553

SEQ ID NO: 181696 - RNA, 64 nt, Homo Sapiens; identical to SEQ ID NO: 45554

SEQ ID NO: 181697 - RNA, 64 nt, Homo Sapiens; identical to SEQ ID NO: 45555

SEQ ID NO: 181698 - RNA, 64 nt, Homo Sapiens; identical to SEQ ID NO: 45556

SEQ ID NO: 181699 - RNA, 64 nt, Homo Sapiens; identical to SEQ ID NO: 45557

SEQ ID NO: 181700 - RNA, 64 nt, Homo Sapiens; identical to SEQ ID NO: 45558

SEQ ID NO: 181701 - RNA, 64 nt, Homo Sapiens; identical to SEQ ID NO: 45559

SEQ ID NO: 181702 - RNA, 64 nt, Homo Sapiens; identical to SEQ ID NO: 45560

SEQ ID NO: 181703 - RNA, 64 nt, Homo Sapiens; identical to SEQ ID NO: 45561

SEQ ID NO: 181704 - RNA, 64 nt, Homo Sapiens; identical to SEQ ID NO: 45562

SEQ ID NO: 181705 - RNA, 64 nt, Homo Sapiens; identical to SEQ ID NO: 45563

SEQ ID NO: 181706 - RNA, 64 nt, Homo Sapiens; identical to SEQ ID NO: 45564

SEQ ID NO: 181707 - RNA, 64 nt, Homo Sapiens; identical to SEQ ID NO: 45565

SEQ ID NO: 181708 - RNA, 64 nt, Homo Sapiens; identical to SEQ ID NO: 45566

SEQ ID NO: 181709 - RNA, 64 nt, Homo Sapiens; identical to SEQ ID NO: 45567

SEQ ID NO: 181710 - RNA, 64 nt, Homo Sapiens; identical to SEQ ID NO: 45568

SEQ ID NO: 181711 - RNA, 64 nt, Homo Sapiens; identical to SEQ ID NO: 45569

SEQ ID NO: 181712 - RNA, 64 nt, Homo Sapiens; identical to SEQ ID NO: 45570

SEQ ID NO: 181713 - RNA, 64 nt, Homo Sapiens; identical to SEQ ID NO: 45571

SEQ ID NO: 181714 - RNA, 64 nt, Homo Sapiens; identical to SEQ ID NO: 45572

SEQ ID NO: 181715 - RNA, 64 nt, Homo Sapiens; identical to SEQ ID NO: 45573

SEQ ID NO: 181716 - RNA, 64 nt, Homo Sapiens; identical to SEQ ID NO: 45574

SEQ ID NO: 181717 - RNA, 64 nt, Homo Sapiens; identical to SEQ ID NO: 45575

SEQ ID NO: 181718 - RNA, 64 nt, Homo Sapiens; identical to SEQ ID NO: 45576

SEQ ID NO: 181719 - RNA, 64 nt, Homo Sapiens; identical to SEQ ID NO: 45577

SEQ ID NO: 181720 - RNA, 64 nt, Homo Sapiens; identical to SEQ ID NO: 45578

SEQ ID NO: 181721 - RNA, 64 nt, Homo Sapiens; identical to SEQ ID NO: 45579

SEQ ID NO: 181722 - RNA, 64 nt, Homo Sapiens; identical to SEQ ID NO: 45580

SEQ ID NO: 181723 - RNA, 64 nt, Homo Sapiens; identical to SEQ ID NO: 45581

SEQ ID NO: 181724 - RNA, 64 nt, Homo Sapiens; identical to SEQ ID NO: 45582

SEQ ID NO: 181725 - RNA, 64 nt, Homo Sapiens; identical to SEQ ID NO: 45583

SEQ ID NO: 181726 - RNA, 64 nt, Homo Sapiens; identical to SEQ ID NO: 45584

SEQ ID NO: 181727 - RNA, 64 nt, Homo Sapiens; identical to SEQ ID NO: 45585

SEQ ID NO: 181728 - RNA, 64 nt, Homo Sapiens; identical to SEQ ID NO: 45586

SEQ ID NO: 181729 - RNA, 64 nt, Homo Sapiens; identical to SEQ ID NO: 45587

SEQ ID NO: 181730 - RNA, 64 nt, Homo Sapiens; identical to SEQ ID NO: 45588

SEQ ID NO: 181731 - RNA, 64 nt, Homo Sapiens; identical to SEQ ID NO: 45589

SEQ ID NO: 181732 - RNA, 64 nt, Homo Sapiens; identical to SEQ ID NO: 45590

SEQ ID NO: 181733 - RNA, 64 nt, Homo Sapiens; identical to SEQ ID NO: 45591

SEQ ID NO: 181734 - RNA, 64 nt, Homo Sapiens; identical to SEQ ID NO: 45592

SEQ ID NO: 181735 - RNA, 64 nt, Homo Sapiens; identical to SEQ ID NO: 45593

SEQ ID NO: 181736 - RNA, 64 nt, Homo Sapiens; identical to SEQ ID NO: 45594

SEQ ID NO: 181737 - RNA, 64 nt, Homo Sapiens; identical to SEQ ID NO: 45595

SEQ ID NO: 181738 - RNA, 64 nt, Homo Sapiens; identical to SEQ ID NO: 45596

SEQ ID NO: 181739 - RNA, 64 nt, Homo Sapiens; identical to SEQ ID NO: 45597

SEQ ID NO: 181740 - RNA, 64 nt, Homo Sapiens; identical to SEQ ID NO: 45598

SEQ ID NO: 181741 - RNA, 64 nt, Homo Sapiens; identical to SEQ ID NO: 45599

SEQ ID NO: 181742 - RNA, 64 nt, Homo Sapiens; identical to SEQ ID NO: 45600

SEQ ID NO: 181743 - RNA, 64 nt, Homo Sapiens; identical to SEQ ID NO: 45601

SEQ ID NO: 181744 - RNA, 64 nt, Homo Sapiens; identical to SEQ ID NO: 45602

SEQ ID NO: 181745 - RNA, 64 nt, Homo Sapiens; identical to SEQ ID NO: 45603

SEQ ID NO: 181746 - RNA, 64 nt, Homo Sapiens; identical to SEQ ID NO: 45604

SEQ ID NO: 181747 - RNA, 64 nt, Homo Sapiens; identical to SEQ ID NO: 45605

SEQ ID NO: 181748 - RNA, 64 nt, Homo Sapiens; identical to SEQ ID NO: 45606

SEQ ID NO: 181749 - RNA, 64 nt, Homo Sapiens; identical to SEQ ID NO: 45607

SEQ ID NO: 181750 - RNA, 64 nt, Homo Sapiens; identical to SEQ ID NO: 45608

SEQ ID NO: 181751 - RNA, 64 nt, Homo Sapiens; identical to SEQ ID NO: 45609

SEQ ID NO: 181752 - RNA, 64 nt, Homo Sapiens; identical to SEQ ID NO: 45610

SEQ ID NO: 181753 - RNA, 64 nt, Homo Sapiens; identical to SEQ ID NO: 45611

SEQ ID NO: 181754 - RNA, 64 nt, Homo Sapiens; identical to SEQ ID NO: 45612

SEQ ID NO: 181755 - RNA, 64 nt, Homo Sapiens; identical to SEQ ID NO: 45613

SEQ ID NO: 181756 - RNA, 64 nt, Homo Sapiens; identical to SEQ ID NO: 45614

SEQ ID NO: 181757 - RNA, 64 nt, Homo Sapiens; identical to SEQ ID NO: 45615

SEQ ID NO: 181758 - RNA, 64 nt, Homo Sapiens; identical to SEQ ID NO: 45616

SEQ ID NO: 181759 - RNA, 64 nt, Homo Sapiens; identical to SEQ ID NO: 45617

SEQ ID NO: 181760 - RNA, 64 nt, Homo Sapiens; identical to SEQ ID NO: 45618

SEQ ID NO: 181761 - RNA, 64 nt, Homo Sapiens; identical to SEQ ID NO: 45619

SEQ ID NO: 181762 - RNA, 64 nt, Homo Sapiens; identical to SEQ ID NO: 45620

SEQ ID NO: 181763 - RNA, 64 nt, Homo Sapiens; identical to SEQ ID NO: 45621

SEQ ID NO: 181764 - RNA, 64 nt, Homo Sapiens; identical to SEQ ID NO: 45622

SEQ ID NO: 181765 - RNA, 64 nt, Homo Sapiens; identical to SEQ ID NO: 45623

SEQ ID NO: 181766 - RNA, 64 nt, Homo Sapiens; identical to SEQ ID NO: 45624

SEQ ID NO: 181767 - RNA, 64 nt, Homo Sapiens; identical to SEQ ID NO: 45625

SEQ ID NO: 181768 - RNA, 64 nt, Homo Sapiens; identical to SEQ ID NO: 45626

SEQ ID NO: 181769 - RNA, 64 nt, Homo Sapiens; identical to SEQ ID NO: 45627

SEQ ID NO: 181770 - RNA, 64 nt, Homo Sapiens; identical to SEQ ID NO: 45628

SEQ ID NO: 181771 - RNA, 64 nt, Homo Sapiens; identical to SEQ ID NO: 45629

SEQ ID NO: 181772 - RNA, 64 nt, Homo Sapiens; identical to SEQ ID NO: 45630

SEQ ID NO: 181773 - RNA, 64 nt, Homo Sapiens; identical to SEQ ID NO: 45631

SEQ ID NO: 181774 - RNA, 64 nt, Homo Sapiens; identical to SEQ ID NO: 45632

SEQ ID NO: 181775 - RNA, 64 nt, Homo Sapiens; identical to SEQ ID NO: 45633

SEQ ID NO: 181776 - RNA, 64 nt, Homo Sapiens; identical to SEQ ID NO: 45634

SEQ ID NO: 181777 - RNA, 64 nt, Homo Sapiens; identical to SEQ ID NO: 45635

SEQ ID NO: 181778 - RNA, 64 nt, Homo Sapiens; identical to SEQ ID NO: 45636

SEQ ID NO: 181779 - RNA, 64 nt, Homo Sapiens; identical to SEQ ID NO: 45637

SEQ ID NO: 181780 - RNA, 64 nt, Homo Sapiens; identical to SEQ ID NO: 45638

SEQ ID NO: 181781 - RNA, 64 nt, Homo Sapiens; identical to SEQ ID NO: 45639

SEQ ID NO: 181782 - RNA, 64 nt, Homo Sapiens; identical to SEQ ID NO: 45640

SEQ ID NO: 181783 - RNA, 64 nt, Homo Sapiens; identical to SEQ ID NO: 45641

SEQ ID NO: 181784 - RNA, 64 nt, Homo Sapiens; identical to SEQ ID NO: 45642

SEQ ID NO: 181785 - RNA, 64 nt, Homo Sapiens; identical to SEQ ID NO: 45643

SEQ ID NO: 181786 - RNA, 64 nt, Homo Sapiens; identical to SEQ ID NO: 45644

SEQ ID NO: 181787 - RNA, 64 nt, Homo Sapiens; identical to SEQ ID NO: 45645

SEQ ID NO: 181788 - RNA, 64 nt, Homo Sapiens; identical to SEQ ID NO: 45646

SEQ ID NO: 181789 - RNA, 64 nt, Homo Sapiens; identical to SEQ ID NO: 45647

SEQ ID NO: 181790 - RNA, 64 nt, Homo Sapiens; identical to SEQ ID NO: 45648

SEQ ID NO: 181791 - RNA, 64 nt, Homo Sapiens; identical to SEQ ID NO: 45649

SEQ ID NO: 181792 - RNA, 64 nt, Homo Sapiens; identical to SEQ ID NO: 45650

SEQ ID NO: 181793 - RNA, 64 nt, Homo Sapiens; identical to SEQ ID NO: 45651

SEQ ID NO: 181794 - RNA, 64 nt, Homo Sapiens; identical to SEQ ID NO: 45652

SEQ ID NO: 181795 - RNA, 64 nt, Homo Sapiens; identical to SEQ ID NO: 45653

SEQ ID NO: 181796 - RNA, 64 nt, Homo Sapiens; identical to SEQ ID NO: 45654

SEQ ID NO: 181797 - RNA, 64 nt, Homo Sapiens; identical to SEQ ID NO: 45655

SEQ ID NO: 181798 - RNA, 64 nt, Homo Sapiens; identical to SEQ ID NO: 48032

SEQ ID NO: 181799 - RNA, 64 nt, Homo Sapiens; identical to SEQ ID NO: 48033

SEQ ID NO: 181800 - RNA, 64 nt, Homo Sapiens; identical to SEQ ID NO: 48034

SEQ ID NO: 181801 - RNA, 64 nt, Homo Sapiens; identical to SEQ ID NO: 48035

SEQ ID NO: 181802 - RNA, 64 nt, Homo Sapiens; identical to SEQ ID NO: 48036

SEQ ID NO: 181803 - RNA, 64 nt, Homo Sapiens; identical to SEQ ID NO: 48037

SEQ ID NO: 181804 - RNA, 64 nt, Homo Sapiens; identical to SEQ ID NO: 48038

SEQ ID NO: 181805 - RNA, 64 nt, Homo Sapiens; identical to SEQ ID NO: 48039

SEQ ID NO: 181806 - RNA, 64 nt, Homo Sapiens; identical to SEQ ID NO: 48040

SEQ ID NO: 181807 - RNA, 64 nt, Homo Sapiens; identical to SEQ ID NO: 48041

SEQ ID NO: 181808 - RNA, 64 nt, Homo Sapiens; identical to SEQ ID NO: 48042

SEQ ID NO: 181809 - RNA, 64 nt, Homo Sapiens; identical to SEQ ID NO: 48043

SEQ ID NO: 181810 - RNA, 64 nt, Homo Sapiens; identical to SEQ ID NO: 48044

SEQ ID NO: 181811 - RNA, 64 nt, Homo Sapiens; identical to SEQ ID NO: 48045

SEQ ID NO: 181812 - RNA, 64 nt, Homo Sapiens; identical to SEQ ID NO: 48046

SEQ ID NO: 181813 - RNA, 64 nt, Homo Sapiens; identical to SEQ ID NO: 48047

SEQ ID NO: 181814 - RNA, 64 nt, Homo Sapiens
aauguuaacuacauauugucuggaaaccugucauuguauucagauaauuagaugauuauauauu

SEQ ID NO: 181815 - RNA, 64 nt, Homo Sapiens
aauuagaugauuauauauuguuguuacuuuuucuuguauucaugaaaacuguuuuuacuaaguu

SEQ ID NO: 181816 - RNA, 64 nt, Homo Sapiens
cuuuuuagugaacauuuuuuuucauguagagggauguauucagcccccucuucugagcugugua

SEQ ID NO: 181817 - RNA, 64 nt, Homo Sapiens
uagagggauguauucagccuccucuucugagcuguguauucauggccuccccaccuccauuucc

SEQ ID NO: 181818 - RNA, 64 nt, Homo Sapiens
auuaugugcaaaauaauucuggcuaacuguaaaauguauucaauuuuaggauuuuuuuuuuuug

SEQ ID NO: 181819 - RNA, 64 nt, Homo Sapiens
uauuucauuguaaacguuauugugccaaauguacuguauucaaaaggaugugaauguguauugu

SEQ ID NO: 181820 - RNA, 64 nt, Homo Sapiens
uaaaauauggaaagcagagcaguacauauucaaauguauucagaaagucaaaagauuaccuauc

SEQ ID NO: 181821 - RNA, 64 nt, Homo Sapiens
uuugaaacucugaugcuauauauacaugguauaauguauucagacuuugauuacuacuuauuua

SEQ ID NO: 181822 - RNA, 64 nt, Homo Sapiens
gaagucagaugugguaacugacucuaccagacuguguauucauugguaauuaucauuuuagaag

SEQ ID NO: 181823 - RNA, 64 nt, Homo Sapiens
cguccagaccuuguucacacaauauugucauuccuguauucaccucauccaaucuaaccacauc

SEQ ID NO: 181824 - RNA, 64 nt, Homo Sapiens
acuaaaaguauguuuauacugugaauuaauauaauguauucacauuauucuuuaauaaucuguu

SEQ ID NO: 181825 - RNA, 64 nt, Homo Sapiens
uaguugucaugccuauguuuagaccauaucuuaauguauucacaaagaauuaucaacuuugaug

SEQ ID NO: 181826 - RNA, 64 nt, Homo Sapiens
uauuaccaagagaagaagcaaccccauggguaaauguauucacaggggcaggugaaauacuucu

SEQ ID NO: 181827 - RNA, 64 nt, Homo Sapiens
uuuguuuguagauguuuguccuuuuguaugcccauguauucaugacagaaaacuuguccacgug

SEQ ID NO: 181828 - RNA, 64 nt, Homo Sapiens
uguacuguuuaacugaggguccuuaacauuauuuuguauucacguauuucuucuccaugaaugg

SEQ ID NO: 181829 - RNA, 64 nt, Homo Sapiens
ugauuauucugacccuuccuccuaauaaggacucuguauucacucaguugacauaagauuuagu

SEQ ID NO: 181830 - RNA, 64 nt, Homo Sapiens
uuucuuuuguaaagagaccacuggugcaucgaaauguauucaccacugacuuagccuaaacaac

SEQ ID NO: 181831 - RNA, 64 nt, Homo Sapiens
uuaccagaaaaugaguuugugguucauccagaaguguauucauaccuuagacugaaaaacuguu

SEQ ID NO: 181832 - RNA, 64 nt, Homo Sapiens
auuauugugaaauguacaguagauuauuguuaauuguauucacccuaauaaucuaugaaacacu

SEQ ID NO: 181833 - RNA, 64 nt, Homo Sapiens
acuaggucuuacuucuucuaucuaacagaauauuuguauucauaauggcuuuuuaucuaccuuc

SEQ ID NO: 181834 - RNA, 64 nt, Homo Sapiens
caaaaugcauguaguaaagacaucuuaugaaaacuguauucauggaauuugauuuagcaugcuc

SEQ ID NO: 181835 - RNA, 64 nt, Homo Sapiens
ccguuauuucccucaguguagauugcucuuaaaauguauucaguuauuuaguggcccccacagg

SEQ ID NO: 181836 - RNA, 64 nt, Homo Sapiens
ucugguuuauuaucuuaaucuguggcugacuucuuguauucaacauugugguuuuagaaucuuc

SEQ ID NO: 181837 - RNA, 64 nt, Homo Sapiens
auuaaugaaacugaagguuugccugccccacuuuuguauucaaaaaguacacuguucacguuua

SEQ ID NO: 181838 - RNA, 64 nt, Homo Sapiens
auuauuaacauguccugggggaaaauuaucaaauuguauucaucaaaguuuuuauugaauguau

SEQ ID NO: 181839 - RNA, 64 nt, Homo Sapiens
uaaucaugugccaaagccagccugguaaauacuguguauucaagaugucucccucaauggaacu

SEQ ID NO: 181840 - RNA, 64 nt, Homo Sapiens
ugaaccuuugcacauuuuuuaagugguuaaaacuuguauucaugguaaucuccagugaacuuuu

SEQ ID NO: 181841 - RNA, 64 nt, Homo Sapiens
ccucauccaggcaguuugaugguguaaagguaaauguauucaccaaauuccauguguuugcuga

SEQ ID NO: 181842 - RNA, 64 nt, Homo Sapiens
acaaguguguuaauuaauaaccuggcacauaguauguauucaaauucuaguagcuagcagagag

SEQ ID NO: 181843 - RNA, 64 nt, Homo Sapiens
gcuuacuagacgaacaaucuacaucagaucacucuguauucaaaugcagaauaaaagggugagg

SEQ ID NO: 181844 - RNA, 64 nt, Homo Sapiens
uuaagcaucuaaauaaauugcuuuauuuucccuuuguauucauuaguauguauaauuuugugau

SEQ ID NO: 181845 - RNA, 64 nt, Homo Sapiens
cugaauaguugaaauguauagcgauuuuuuuucauguauucauuuauaguagacuuugggaaaa

SEQ ID NO: 181846 - RNA, 64 nt, Homo Sapiens
uauuauguguaccuuggagucauccucuuggucuuguauucauauugugggacagugggaauag

SEQ ID NO: 181847 - RNA, 64 nt, Homo Sapiens
uaguaaugagaaauuuuauaaauguguauuucuguguauucacauacauauauauauacacaca

SEQ ID NO: 181848 - RNA, 64 nt, Homo Sapiens
aaguucucuauuuauauuucauuuaucacucuucuguauucacucagcaaccaugcccuuaguc

SEQ ID NO: 181849 - RNA, 64 nt, Homo Sapiens
caaacauuacucuuuggacaguuuggacaguaucuguauucagauuuuacaacauggaguaaag

SEQ ID NO: 181850 - RNA, 64 nt, Homo Sapiens
uccaagaaaugugccuacugaaaucaaauuaauuuguauucaauguguacuucaagacugcuaa

SEQ ID NO: 181851 - RNA, 64 nt, Homo Sapiens
agacacauaccgaacacccuuauucauucauuuauguauucaucccuucauucacucauuugug

SEQ ID NO: 181852 - RNA, 64 nt, Homo Sapiens
cauuuauguauucaucagaccauucacucauuuguguauucauucaguuaccugaaacugccuu

SEQ ID NO: 181853 - RNA, 64 nt, Homo Sapiens
uucacaugugugugcacacugauagacuguuucguagggauauaauaauuuaagccuaugagaa

SEQ ID NO: 181854 - RNA, 64 nt, Homo Sapiens
gaagaaugcuagcaucucugccagcaggaauacuuagggauaagauuucuccaauugggacucc

SEQ ID NO: 181855 - RNA, 64 nt, Homo Sapiens
gcucacuagcuguggaggucacuuggcacauggcuagggauacuggcaguauguuuaaguccag

SEQ ID NO: 181856 - RNA, 64 nt, Homo Sapiens
cagggggcuccugcucuccugugggaugcugcucuagggauacuuucaccaguuucuguuccuu

SEQ ID NO: 181857 - RNA, 64 nt, Homo Sapiens
aaauguaguauaguacuugaaacagucacuaucauagggauaauuggugcauccuguguaaaug

SEQ ID NO: 181858 - RNA, 64 nt, Homo Sapiens
auggaagcugagcuugacaccuggugcuuuuaaguagggauaaagucauccucucacugcaagc

SEQ ID NO: 181859 - RNA, 64 nt, Homo Sapiens
uuuuccugcuaacccaaaauguuauuuguaaucaaauguguagugauuacacuugaauugugua

SEQ ID NO: 181860 - RNA, 64 nt, Homo Sapiens
auuuuccagcauaaaaauccaccugugucugcugaauguguauguaugugcucacuguggcuuu

SEQ ID NO: 181861 - RNA, 64 nt, Homo Sapiens
ccccguggaccaacauaauauuaucuuuuguuaaaauguguauauaacuggauuacauagauuu

SEQ ID NO: 181862 - RNA, 64 nt, Homo Sapiens
aaaacuaccugugagcauggcugaaacuauuuacaauguguaucaguauucuucuuccugaaua

SEQ ID NO: 181863 - RNA, 64 nt, Homo Sapiens
gcuacacaccuaacuuauggaugacuuggugucuaauguguaguauggauaaauauugguuggg

SEQ ID NO: 181864 - RNA, 64 nt, Homo Sapiens
augggguaaaagggguagggugacucuucccucaaauguguacuuugccaauuugcacauuaaa

SEQ ID NO: 181865 - RNA, 64 nt, Homo Sapiens
uuguuacauuauauuuuuacauauauucccauguaauguguacagucuuugcaguuccaccaag

SEQ ID NO: 181866 - RNA, 64 nt, Homo Sapiens
gcucauccaaggauuaaaucuggucagcagguggaauguguauaaaaugcuacuuaacaaagua

SEQ ID NO: 181867 - RNA, 64 nt, Homo Sapiens
uuggaaggauuauauaagaugaacaguugugauaaauguguagauuagagggaugugaaugggc

SEQ ID NO: 181868 - RNA, 64 nt, Homo Sapiens
caguagagaggaacuguuuggaacuuagauuuccaauguguauauucuaauggagaaagcaaga

SEQ ID NO: 181869 - RNA, 64 nt, Homo Sapiens
uugcuguugagcugggcuacuguauacaguguacaauguguauuucuucaaccauauauuuuaa

SEQ ID NO: 181870 - RNA, 64 nt, Homo Sapiens
augguuucccauuugguuuuauauguguuaaauaaauguguaaaguaaccaccaaauguuauua

SEQ ID NO: 181871 - RNA, 64 nt, Homo Sapiens
uuaguggauuguuagggauuuucuguauuggaguaauguguagaaaaauccuuguuauaucuau

SEQ ID NO: 181872 - RNA, 64 nt, Homo Sapiens
aaaguuccuacacugauuuuugcuucaauucagcaauguguauaaugucugguggguuauguuu

SEQ ID NO: 181873 - RNA, 64 nt, Homo Sapiens
uauugcucuuugugaauuugugcuuaagucaaugaauguguaguaucuccuucugacaagcauu

SEQ ID NO: 181874 - RNA, 64 nt, Homo Sapiens
gcaaauaaaucccuaggauguaaucaggacuucaaauguguaauuaaauuuuuuuaaaaaaaau

SEQ ID NO: 181875 - RNA, 64 nt, Homo Sapiens
cguuauuucuaaugauguaauugcagaaucuuaaaauguguacugcaucuucauuuugcuagcu

SEQ ID NO: 181876 - RNA, 64 nt, Homo Sapiens
auauauguacuaaacauaugagauguagcauuucaauguguaagacauggcauuucaggguaua

SEQ ID NO: 181877 - RNA, 64 nt, Homo Sapiens
uuguaccaucauuuuauuauaauccucaagagaaaauguguaauucaaaagauuaauguguauu

SEQ ID NO: 181878 - RNA, 64 nt, Homo Sapiens
aauccucaagagaaaauguguaauucaaaagauuaauguguauuaaaacacauuauguaucuua

SEQ ID NO: 181879 - RNA, 64 nt, Homo Sapiens
gagaccccagucuacuauuaaaagugacuaccuuaauguguauauuaagugauagcucacuugu

SEQ ID NO: 181880 - RNA, 64 nt, Homo Sapiens
uuauuaacauuucuaugaaauauugacuggaguuaauguguaaguguacacuguagcacggugu

SEQ ID NO: 181881 - RNA, 64 nt, Homo Sapiens
caauguguguguauaugaugaucagucaaggggaaauguguaugguuuaucuacaaagaugcga

SEQ ID NO: 181882 - RNA, 64 nt, Homo Sapiens
uuaaaugaguuuuuaaagcaaccuaccucugaaaaauguguagagcaacaagaggauaauuccg

SEQ ID NO: 181883 - RNA, 64 nt, Homo Sapiens
gucaaguuuaaagcagggcacauuguugcagcaaaauguguauuugacaaauuauacuugcaau

SEQ ID NO: 181884 - RNA, 64 nt, Homo Sapiens
gccgaccaagaucccucccugcaagacagaugggaauguguauaauaacuagguauuugagaag

SEQ ID NO: 181885 - RNA, 64 nt, Homo Sapiens
guuaaauguacaagauacaugaaauauuaaagaaaauguguaacuuuuuguguaaauacaucuu

SEQ ID NO: 181886 - RNA, 64 nt, Homo Sapiens
uuaaauuuagagagaaugccgcucuguuuaaagcaauguguaaagaugaguuuuuuuaagcaug

SEQ ID NO: 181887 - RNA, 64 nt, Homo Sapiens
gaacugagauuuaaaucuaauaaacaaguuaauaaauguguauguuuuguuguggguuugguag

SEQ ID NO: 181888 - RNA, 64 nt, Homo Sapiens
ucccuucaaacacaaagauugcugugaaaacgaaaauguguagacgcacucucaaaaacugcac

SEQ ID NO: 181889 - RNA, 64 nt, Homo Sapiens
ccgccacaucagcaccauccgagagcuuauuaguaauguguagauucucaugucccagccagac

SEQ ID NO: 181890 - RNA, 64 nt, Homo Sapiens
cuggcaaguuuggccagacugacuucaaaaaauuaauguguauccagggacauuuuaaaaaccu

SEQ ID NO: 181891 - RNA, 64 nt, Homo Sapiens
ggcaacagcgagacuccaucucaaaaaaaaaggaaauguguaucaagaacaugauuauccagcg

SEQ ID NO: 181892 - RNA, 64 nt, Homo Sapiens
uuguacuaccuaaaagucccagugcaugucucugaauguguaagcuauauaaaugcuauuuaua

SEQ ID NO: 181893 - RNA, 64 nt, Homo Sapiens
aagagaauggugguuucagagaucucucuucccaaauguguaaauauucuauaccagauaaguu

SEQ ID NO: 181894 - RNA, 64 nt, Homo Sapiens
aaacgaaguucaaagauuagagguaauuuuuuguaauguguauugagaagauaagguuuauggc

SEQ ID NO: 181895 - RNA, 64 nt, Homo Sapiens
cuaaaauauaccagcgaauugauuuuuaaaugaaaauguguaauagaucauuuuuauccuaggu

SEQ ID NO: 181896 - RNA, 64 nt, Homo Sapiens
uaauccucacaacaacccaauuucuuaauauuucaauguguauugcuuacugugugcuaggcau

SEQ ID NO: 181897 - RNA, 64 nt, Homo Sapiens
ucauuguuucuuguggaauuagagggaaaauguuaauguguauuaacuuacauucaagggacau

SEQ ID NO: 181898 - RNA, 64 nt, Homo Sapiens
uacccgagacugggaagaaaguuuucacgcugcugauaaagacaccaauuuacuguauuagucc

SEQ ID NO: 181899 - RNA, 64 nt, Homo Sapiens
uacccgagacugggaagaaaguauuaaugcugcugauaaagacgucaagcaucuguauuagucu

SEQ ID NO: 181900 - RNA, 64 nt, Homo Sapiens
cucuggugcuucaaauucuggguuuuccguaguagauaaagacuuuucugagaccacagaauca

SEQ ID NO: 181901 - RNA, 64 nt, Homo Sapiens
aauaugugacuauuauugggagaaacucaauacagauaaagauacuguucuaaaaauguuuaaa

SEQ ID NO: 181902 - RNA, 64 nt, Homo Sapiens
auaucugguuguauuagucuguuuucacgcugcugauaaagacauaccugagaccaggaagaaa

SEQ ID NO: 181903 - RNA, 64 nt, Homo Sapiens
gcaguuuacuguauuagucuguuuucacacugcugauaaagacauuccucaagauugugaagaa

SEQ ID NO: 181904 - RNA, 64 nt, Homo Sapiens
uaauuugaggacugggcugucuuggggcucagaagauaaagaacuauuugagcagaugugugug

SEQ ID NO: 181905 - RNA, 64 nt, Homo Sapiens
acagugaggcauaucauguguuuuuauuaaaaaugauaaagauguguuucuucucaucuaaagg

SEQ ID NO: 181906 - RNA, 64 nt, Homo Sapiens
agaaacaaugugaaauaauguggaaauuaauacugauaaagacuaucaguaucugauacaaaag

SEQ ID NO: 181907 - RNA, 64 nt, Homo Sapiens
aaugaguucuguguuuauauuauguuucuguucagauaaagauuagauuaucuaaagccaucuc

SEQ ID NO: 181908 - RNA, 64 nt, Homo Sapiens
uaauuuuaauccuucccuaucugaguucccccuggauaaagaguacagcucuugucagaaagcc

SEQ ID NO: 181909 - RNA, 64 nt, Homo Sapiens
gaaguagcuaguagcaaugugccuugauugauuagauaaagauuucuaguaggcagcaaaagac

SEQ ID NO: 181910 - RNA, 64 nt, Homo Sapiens
cuaagaauaguggggcccagccgaugugguaggugauaaagaggcaucuuuucuagagacacau

SEQ ID NO: 181911 - RNA, 64 nt, Homo Sapiens
ccccacuucccugcagaaucaaucugagggaggggauaaagaggaagcaauaaaaaaaaaacau

SEQ ID NO: 181912 - RNA, 64 nt, Homo Sapiens
cuacuaguucuuccagcccucauugagguaacaagauaaagacaaauccacuucuuuggccaaa

SEQ ID NO: 181913 - RNA, 64 nt, Homo Sapiens
aguacuggaaguccuaagcuuagugaucaggcaagauaaagauaugaaaggcauauauaaauag

SEQ ID NO: 181914 - RNA, 64 nt, Homo Sapiens
ggaaucaacguaaaugcccaucagcaguagaccagauaaagaaaauuugguacauauacaccau

SEQ ID NO: 181915 - RNA, 64 nt, Homo Sapiens
auccuggccaacauggugaaucacgaggucaagagauaaagaccgggaggcugaggcaggggga

SEQ ID NO: 181916 - RNA, 64 nt, Homo Sapiens
agccuuuauguggaguucacccuugaguguaagggauaaagauaaauucauacugguuagaaag

SEQ ID NO: 181917 - RNA, 64 nt, Homo Sapiens
auauauucaaaaaauauuggauguaauuccucuggauaaagauauaauaccuucuuagccauua

SEQ ID NO: 181918 - RNA, 64 nt, Homo Sapiens
auuucuacaauuacaguucccuuucuuguucuuggauaaagaaauuguaugggaaccaagguua

SEQ ID NO: 181919 - RNA, 64 nt, Homo Sapiens
uguccuggaaagcaaaccccgauuuucccaaauuuuguacaaucaggaaguaauuauuuacaac

SEQ ID NO: 181920 - RNA, 64 nt, Homo Sapiens
aguaaagaguauccuaaagacuuucauaucguuauuguacaaaaauagguagaauaaaaaauuc

SEQ ID NO: 181921 - RNA, 64 nt, Homo Sapiens
uauaaaauaaucauauugcuguuuuuaguccucauuguacaaaaccuuuuuuuucugaaggcuu

SEQ ID NO: 181922 - RNA, 64 nt, Homo Sapiens
aaaaugcacuuaaaccuguucaugugauagucaguuguacaaaguaauuaauugccaguuuuua

SEQ ID NO: 181923 - RNA, 64 nt, Homo Sapiens
guaagcaaaggcucugaaauaauuauguaauauauuguacaaauaggaucugcaaacaaugaag

SEQ ID NO: 181924 - RNA, 64 nt, Homo Sapiens
uaauuguuuuuuaaagcaaggaaccuauuuucauuuguacaaggauuuauuuaugaaaaaauau

SEQ ID NO: 181925 - RNA, 64 nt, Homo Sapiens
acuaaagguaagacugguuguuacuuuuguuuuguuguacaauuaguacuuuauagucacaugu

SEQ ID NO: 181926 - RNA, 64 nt, Homo Sapiens
uuguaaugaaguuccugugaacaucauuaugguuuuguacaaauaggaaccucugaugucauuc

SEQ ID NO: 181927 - RNA, 64 nt, Homo Sapiens
ccgaacgcugcuccaugcacaggaaaagggcauuuuguacaauggggacuucccgggaacgcuu

SEQ ID NO: 181928 - RNA, 64 nt, Homo Sapiens
uccaaaccuaccuuauagagcacaauauuaaguguuguacaauuacugugagaacugugaauau

SEQ ID NO: 181929 - RNA, 64 nt, Homo Sapiens
uagauuuuaaggcuaacuucguacaacagaacacuuguacaaaaauaagcuuagcacuugaguu

SEQ ID NO: 181930 - RNA, 64 nt, Homo Sapiens
gaacacuuguacaaaauagagcuuagcacuugaguuguacaacaaaacagaaaugcugagauaa

SEQ ID NO: 181931 - RNA, 64 nt, Homo Sapiens
cauuuuuuugaaaaaauacuuuuugacaguauuuuuguacaaaaguugaaagcuuuuuaggaaa

SEQ ID NO: 181932 - RNA, 64 nt, Homo Sapiens
ugguuuuaaaaaaaauugcuaguaaacuauaaacuuguacaaauguuugagaacuuggaaacaa

SEQ ID NO: 181933 - RNA, 64 nt, Homo Sapiens
ugaaaauuaugucgggacauaguuguuuguguuauuguacaauuauaaaacauggccuuaacaa

SEQ ID NO: 181934 - RNA, 64 nt, Homo Sapiens
aagauuguguaagauauauuuuuaacuuguauuuuuguacaaacaugauugcuuuauguuuaua

SEQ ID NO: 181935 - RNA, 64 nt, Homo Sapiens
uguguacacagcuuuuacaaaucaauaaagaugauuguacaagaguauuuucagacuaauugga

SEQ ID NO: 181936 - RNA, 64 nt, Homo Sapiens
cuguaugauuagaaguuuuuacguccuuccuuuuuuguacaaaucuguauuguauuaauuucug

SEQ ID NO: 181937 - RNA, 64 nt, Homo Sapiens
acagcuuguaauguuguauacacauuuauucuguuuguacaaagguuuuccauucuauggagag

SEQ ID NO: 181938 - RNA, 64 nt, Homo Sapiens
gaggaacauggcagccucuagcucauacuugucguuguacaauugagaucaagugaauuggccc

SEQ ID NO: 181939 - RNA, 64 nt, Homo Sapiens
acaggcaugaggagugccuauuuuguacaauauuuuguacaaagccucuuuuuuccugggaaua

SEQ ID NO: 181940 - RNA, 64 nt, Homo Sapiens
uuuuguacaaagacaggcauuuccugggaauauuuuguacaauagcccuucuuuucccucuuuu

SEQ ID NO: 181941 - RNA, 64 nt, Homo Sapiens
aaaaccacucuugaacuuugauuuguauaaacaauuguacaaaaugcgauuuuaccuuuguuga

SEQ ID NO: 181942 - RNA, 64 nt, Homo Sapiens
uguuuaaaaguuauuuaugcaugcagaacuauuuuuguacaaauguuuuguuacaucuuacauu

SEQ ID NO: 181943 - RNA, 64 nt, Homo Sapiens
ugaauuauauaaugcuuaaauggaaauuuacuuuuuguacaaauuacuaaccaaagcuuguauu

SEQ ID NO: 181944 - RNA, 64 nt, Homo Sapiens
auuaccugugcuagucaaguguaaaaagcucugauuguacaagaauauccccuccuucuaaaua

SEQ ID NO: 181945 - RNA, 64 nt, Homo Sapiens
ucuauauaauaagguacgcccgaaaagaaauauauuguacaaaucuguggguaaaauaugcaaa

SEQ ID NO: 181946 - RNA, 64 nt, Homo Sapiens
agacacuguuccuaacgagaccagagcauaccuguuguacaaaccgcuguaaagaaauccuguu

SEQ ID NO: 181947 - RNA, 64 nt, Homo Sapiens
aaauugcgauguauauuuucauuuuucucaccuauuguacaaagucuauucuucuauacugcag

SEQ ID NO: 181948 - RNA, 64 nt, Homo Sapiens
uggcaaacacuggcuggaacuugcuggacuucuguuguacaaguuccugcacucuacccaccua

SEQ ID NO: 181949 - RNA, 64 nt, Homo Sapiens
gaaugaaaaagugacuucauucaaaauaugaguuuuguacaauguauuagcuauuagauuuuuc

SEQ ID NO: 181950 - RNA, 64 nt, Homo Sapiens
ucaugaucagcuucucccuugugcugucauaauguuguacaagaauuggauacguaauaccuua

SEQ ID NO: 181951 - RNA, 64 nt, Homo Sapiens
cuguauuuauuaaugcauauauuuccccugcuuguuguacaaguaaguuacucuuuuccuuuaa

SEQ ID NO: 181952 - RNA, 64 nt, Homo Sapiens
aacugguccuguaauuguugcuagacuuuauguguuguacaacuaaacauugcuguuugaacag

SEQ ID NO: 181953 - RNA, 64 nt, Homo Sapiens; identical to SEQ ID NO: 122412

SEQ ID NO: 181954 - RNA, 64 nt, Homo Sapiens; identical to SEQ ID NO: 122413

SEQ ID NO: 181955 - RNA, 64 nt, Homo Sapiens; identical to SEQ ID NO: 122453

SEQ ID NO: 181956 - RNA, 64 nt, Homo Sapiens; identical to SEQ ID NO: 122454

SEQ ID NO: 181957 - RNA, 64 nt, Homo Sapiens; identical to SEQ ID NO: 122460

SEQ ID NO: 181958 - RNA, 64 nt, Homo Sapiens; identical to SEQ ID NO: 122461

SEQ ID NO: 181959 - RNA, 64 nt, Homo Sapiens; identical to SEQ ID NO: 122467

SEQ ID NO: 181960 - RNA, 64 nt, Homo Sapiens; identical to SEQ ID NO: 122468

SEQ ID NO: 181961 - RNA, 64 nt, Homo Sapiens; identical to SEQ ID NO: 122481

SEQ ID NO: 181962 - RNA, 64 nt, Homo Sapiens; identical to SEQ ID NO: 122482

SEQ ID NO: 181963 - RNA, 64 nt, Homo Sapiens; identical to SEQ ID NO: 122498

SEQ ID NO: 181964 - RNA, 64 nt, Homo Sapiens; identical to SEQ ID NO: 122499

SEQ ID NO: 181965 - RNA, 64 nt, Homo Sapiens; identical to SEQ ID NO: 122513

SEQ ID NO: 181966 - RNA, 64 nt, Homo Sapiens; identical to SEQ ID NO: 122514

SEQ ID NO: 181967 - RNA, 64 nt, Homo Sapiens; identical to SEQ ID NO: 122517

SEQ ID NO: 181968 - RNA, 64 nt, Homo Sapiens; identical to SEQ ID NO: 122518

SEQ ID NO: 181969 - RNA, 64 nt, Homo Sapiens; identical to SEQ ID NO: 122606

SEQ ID NO: 181970 - RNA, 64 nt, Homo Sapiens; identical to SEQ ID NO: 122607

SEQ ID NO: 181971 - RNA, 64 nt, Homo Sapiens; identical to SEQ ID NO: 122654

SEQ ID NO: 181972 - RNA, 64 nt, Homo Sapiens; identical to SEQ ID NO: 122655

SEQ ID NO: 181973 - RNA, 64 nt, Homo Sapiens; identical to SEQ ID NO: 122669

SEQ ID NO: 181974 - RNA, 64 nt, Homo Sapiens; identical to SEQ ID NO: 122670

SEQ ID NO: 181975 - RNA, 64 nt, Homo Sapiens; identical to SEQ ID NO: 122677

SEQ ID NO: 181976 - RNA, 64 nt, Homo Sapiens; identical to SEQ ID NO: 122678

SEQ ID NO: 181977 - RNA, 64 nt, Homo Sapiens; identical to SEQ ID NO: 122684

SEQ ID NO: 181978 - RNA, 64 nt, Homo Sapiens; identical to SEQ ID NO: 122685

SEQ ID NO: 181979 - RNA, 64 nt, Homo Sapiens; identical to SEQ ID NO: 122691

SEQ ID NO: 181980 - RNA, 64 nt, Homo Sapiens; identical to SEQ ID NO: 122692

SEQ ID NO: 181981 - RNA, 64 nt, Homo Sapiens; identical to SEQ ID NO: 122693

SEQ ID NO: 181982 - RNA, 64 nt, Homo Sapiens; identical to SEQ ID NO: 122709

SEQ ID NO: 181983 - RNA, 64 nt, Homo Sapiens; identical to SEQ ID NO: 122710

SEQ ID NO: 181984 - RNA, 64 nt, Homo Sapiens; identical to SEQ ID NO: 122711

SEQ ID NO: 181985 - RNA, 64 nt, Homo Sapiens; identical to SEQ ID NO: 122718

SEQ ID NO: 181986 - RNA, 64 nt, Homo Sapiens; identical to SEQ ID NO: 122719

SEQ ID NO: 181987 - RNA, 64 nt, Homo Sapiens; identical to SEQ ID NO: 122734

SEQ ID NO: 181988 - RNA, 64 nt, Homo Sapiens; identical to SEQ ID NO: 122735

SEQ ID NO: 181989 - RNA, 64 nt, Homo Sapiens; identical to SEQ ID NO: 122742

SEQ ID NO: 181990 - RNA, 64 nt, Homo Sapiens; identical to SEQ ID NO: 122743

SEQ ID NO: 181991 - RNA, 64 nt, Homo Sapiens; identical to SEQ ID NO: 122744

SEQ ID NO: 181992 - RNA, 64 nt, Homo Sapiens; identical to SEQ ID NO: 122746

SEQ ID NO: 181993 - RNA, 64 nt, Homo Sapiens; identical to SEQ ID NO: 122747

SEQ ID NO: 181994 - RNA, 64 nt, Homo Sapiens; identical to SEQ ID NO: 122749

SEQ ID NO: 181995 - RNA, 64 nt, Homo Sapiens; identical to SEQ ID NO: 122750

SEQ ID NO: 181996 - RNA, 64 nt, Homo Sapiens; identical to SEQ ID NO: 122801

SEQ ID NO: 181997 - RNA, 64 nt, Homo Sapiens; identical to SEQ ID NO: 122802

SEQ ID NO: 181998 - RNA, 64 nt, Homo Sapiens; identical to SEQ ID NO: 122837

SEQ ID NO: 181999 - RNA, 64 nt, Homo Sapiens; identical to SEQ ID NO: 122838

SEQ ID NO: 182000 - RNA, 64 nt, Homo Sapiens; identical to SEQ ID NO: 122842

SEQ ID NO: 182001 - RNA, 64 nt, Homo Sapiens; identical to SEQ ID NO: 122843

SEQ ID NO: 182002 - RNA, 64 nt, Homo Sapiens; identical to SEQ ID NO: 122853

SEQ ID NO: 182003 - RNA, 64 nt, Homo Sapiens; identical to SEQ ID NO: 122854

SEQ ID NO: 182004 - RNA, 64 nt, Homo Sapiens; identical to SEQ ID NO: 122861

SEQ ID NO: 182005 - RNA, 64 nt, Homo Sapiens; identical to SEQ ID NO: 122862

SEQ ID NO: 182006 - RNA, 64 nt, Homo Sapiens; identical to SEQ ID NO: 122909

SEQ ID NO: 182007 - RNA, 64 nt, Homo Sapiens; identical to SEQ ID NO: 122910

SEQ ID NO: 182008 - RNA, 64 nt, Homo Sapiens; identical to SEQ ID NO: 122911

SEQ ID NO: 182009 - RNA, 64 nt, Homo Sapiens; identical to SEQ ID NO: 122931

SEQ ID NO: 182010 - RNA, 64 nt, Homo Sapiens; identical to SEQ ID NO: 122932

SEQ ID NO: 182011 - RNA, 64 nt, Homo Sapiens; identical to SEQ ID NO: 122949

SEQ ID NO: 182012 - RNA, 64 nt, Homo Sapiens; identical to SEQ ID NO: 122950

SEQ ID NO: 182013 - RNA, 64 nt, Homo Sapiens; identical to SEQ ID NO: 122967

SEQ ID NO: 182014 - RNA, 64 nt, Homo Sapiens; identical to SEQ ID NO: 122968

SEQ ID NO: 182015 - RNA, 64 nt, Homo Sapiens; identical to SEQ ID NO: 122972

SEQ ID NO: 182016 - RNA, 64 nt, Homo Sapiens; identical to SEQ ID NO: 122973

SEQ ID NO: 182017 - RNA, 64 nt, Homo Sapiens; identical to SEQ ID NO: 122977

SEQ ID NO: 182018 - RNA, 64 nt, Homo Sapiens; identical to SEQ ID NO: 122978

SEQ ID NO: 182019 - RNA, 64 nt, Homo Sapiens
auagccugaacuuaaaaaguucugguauguugcaagcuuucaagugagagacaacauagcaaua

SEQ ID NO: 182020 - RNA, 64 nt, Homo Sapiens
ucauuuguguuuuuuaauuaguguaccaguuuaaagcuuucacugaaauauaggugugaacagu

SEQ ID NO: 182021 - RNA, 64 nt, Homo Sapiens
aacuuugagaacuuggcuauaaaaaagaucaaagagcuuucagaaaccuauuucgcucccagaa

SEQ ID NO: 182022 - RNA, 64 nt, Homo Sapiens
ccaaaugucacaggagcuguaaauugcaaucuaaagcuuucauaaugaagcuacuucuacauga

SEQ ID NO: 182023 - RNA, 64 nt, Homo Sapiens
uauucuggucucaauggcuucauguucucgucuuagcuuucauccaucagaacaccaacagauu

SEQ ID NO: 182024 - RNA, 64 nt, Homo Sapiens
ugagcucacuggaaauucauacuguaagagcuacagcuuucaaaaagaacagaaucuguccuuc

SEQ ID NO: 182025 - RNA, 64 nt, Homo Sapiens
aauuguuuuaaccauuuccuuuucuaaacucucuagcuuucaacuuuacuuaaacauugugugg

SEQ ID NO: 182026 - RNA, 64 nt, Homo Sapiens
uuaguguguucuucugccucuucccccuugauucagcuuucagagguacuauggcaguuuugcc

SEQ ID NO: 182027 - RNA, 64 nt, Homo Sapiens
uuuacuguaauuuagucuuagguuuaaacuguggagcuuucauggauaugguugauuuauauug

SEQ ID NO: 182028 - RNA, 64 nt, Homo Sapiens
aguuaauauucuuuguuuuaaaaaucuugcuuucagcuuucaggcauuggugauguuuuuuaaa

SEQ ID NO: 182029 - RNA, 64 nt, Homo Sapiens
ucaacacaaauagcugcagcuggauuuacuuguaagcuuucagaacagugcucauuccuaacag

SEQ ID NO: 182030 - RNA, 64 nt, Homo Sapiens
uacagaaguauugauacaaccuuacauuuaaaagagcuuucaggaaaacaauaaaaagaaaacc

SEQ ID NO: 182031 - RNA, 64 nt, Homo Sapiens
uucuguuuauucaguuuuuugcuuucacucuuaaagcuuucauuucuuaacuaggaaacuaaaa

SEQ ID NO: 182032 - RNA, 64 nt, Homo Sapiens
cuuaaagcuuucauuuucugacuaggaaacuaaaagcuuucacucauucucaagaaaagucuua

SEQ ID NO: 182033 - RNA, 64 nt, Homo Sapiens
gugccugaaucuuauuauuuaaaucacuucaguuagcuuucaguguauguuuaauaauauacau

SEQ ID NO: 182034 - RNA, 64 nt, Homo Sapiens
ucucaaaagcuaauauugauucuucuguuccaucagcuuucauuguuaaguagaauauguaugu

SEQ ID NO: 182035 - RNA, 64 nt, Homo Sapiens
cugauagagucauuaauugcagagaaguucuggaagcuuucaaccuccuggugcuccaggucag

SEQ ID NO: 182036 - RNA, 64 nt, Homo Sapiens
agcugacaagucccagaagcagucccugacccccagcuuucagagcccagccaccagcuugggg

SEQ ID NO: 182037 - RNA, 64 nt, Homo Sapiens
ggcuuuuuuguuuguuuguuuguuuguuuguuuaagcuuucaggugcuucauuagcuuucaguu

SEQ ID NO: 182038 - RNA, 64 nt, Homo Sapiens
uuguuuguuuguuuaagcuuucaggugcuucauuagcuuucaguuccuuugguagugugggcau

SEQ ID NO: 182039 - RNA, 64 nt, Homo Sapiens
gccaaagaggccaugcugagauuuuuuauucuccagcuuucagucaggcuuauuuuuuuuacug

SEQ ID NO: 182040 - RNA, 63 nt, Homo Sapiens
agccccagcccccacacuccggccucugggucaagcuuucaucgccuguucccaguucccuga

SEQ ID NO: 182041 - RNA, 64 nt, Homo Sapiens
gcuguuugcugggugucccaauacagaggaacggcuguuccaaguaaccauagccccaucuaua

SEQ ID NO: 182042 - RNA, 53 nt, Homo Sapiens
uguacugccccauccuugaacgccuguuccacuccaucaguggacagaaauaa

SEQ ID NO: 182043 - RNA, 64 nt, Homo Sapiens
cucugccuguuacccaguuccugagcccuccaaacuguuccagcccacauuuuccuguuuucuu

SEQ ID NO: 182044 - RNA, 64 nt, Homo Sapiens
ugggagaaauuggccaaaauuugauuaaagacggcuguuccaaauaccaacagggguacaggua

SEQ ID NO: 182045 - RNA, 64 nt, Homo Sapiens
agaucaccggggccgccgcgggccgucugcacuucuguuccagguuuuucuggcauuuucuguu

SEQ ID NO: 182046 - RNA, 64 nt, Homo Sapiens
ucugcacuucuguuccagguuuuucuggcauuuucuguuccagguuucuuccacccacgagcac

SEQ ID NO: 182047 - RNA, 64 nt, Homo Sapiens
uccucccaaccucugaaguguggaucuggggcgacuguuccagguaccccaaacagaaggcaca

SEQ ID NO: 182048 - RNA, 64 nt, Homo Sapiens
guaguugauucucaguagagcagccccugauguucuguuccaccaacugaggcgcacacccaug

SEQ ID NO: 182049 - RNA, 64 nt, Homo Sapiens
gcagaaaccgcaccccgagagaaaaucccauccucuguuccaaggccccugucugcucuaugcu

SEQ ID NO: 182050 - RNA, 64 nt, Homo Sapiens
aagagacuuacccaggcucacacagcagcucagccuguuccaggcgcuggucagugcguguucu

SEQ ID NO: 182051 - RNA, 64 nt, Homo Sapiens
ugauuccauccaccuuucccugcucugguuguuucuguuccaaaggaggggggaaauacaguuc

SEQ ID NO: 182052 - RNA, 64 nt, Homo Sapiens
uucaguuucauaaaaggagaaugguaacugcuuucuguuccaaauuuuacuuuuguuuauuuuu

SEQ ID NO: 182053 - RNA, 64 nt, Homo Sapiens
uguagaccuugaugauuguguauguaaaauguuucuguuccaguuaucaucuucaggucuuuug

SEQ ID NO: 182054 - RNA, 64 nt, Homo Sapiens
aguuauaauccacuugcccucuuaaaaaguugcacuguuccagucuuccaucugaagccccacu

SEQ ID NO: 182055 - RNA, 64 nt, Homo Sapiens
cuucauccuuccuggcuguuguaccgagcucugucuguuccagccuucccccagggccuguccu

SEQ ID NO: 182056 - RNA, 64 nt, Homo Sapiens
ggcugggaaaaacuaagcuguggugcaaggacuucuguuccaaacagggauucucugcuggugc

SEQ ID NO: 182057 - RNA, 64 nt, Homo Sapiens
gaggcucccucuuaacacggcacuuagacacgugcuguuccaccuucccucaugcuguuccacc

SEQ ID NO: 182058 - RNA, 64 nt, Homo Sapiens
cacuuagacacgugcuguuccaccuucccucaugcuguuccaccuccccucagacuagcuuuca

SEQ ID NO: 182059 - RNA, 64 nt, Homo Sapiens
gaggcucucucuuaacacggcacuuagacacgugcuguuccaccuucccucgugcuguuccacc

SEQ ID NO: 182060 - RNA, 64 nt, Homo Sapiens
cacuuagacacgugcuguuccaccuucccucgugcuguuccaccuuuccucagacuauuuuuca

SEQ ID NO: 182061 - RNA, 64 nt, Homo Sapiens
gaggcucccucuuaacacggcacuuacacacuugcuguuccaccuucccucaugcuguuccacc

SEQ ID NO: 182062 - RNA, 64 nt, Homo Sapiens
cacuuacacacuugcuguuccaccuucccucaugcuguuccaccuccccucagacuaucuuuca

SEQ ID NO: 182063 - RNA, 64 nt, Homo Sapiens
ccagcuugaauuggugccacuuucauaucuccugcuguuccaucgccauacugagccugaggua

SEQ ID NO: 182064 - RNA, 64 nt, Homo Sapiens
uggcagggcuccuuacugcacuuccuacaugugccuguuccagaauggccucaggucauuuugc

SEQ ID NO: 182065 - RNA, 64 nt, Homo Sapiens
gagacuccgucucuuaaaauauuugcccaaacauugaaccuaaauuugaccaugccccuagaaa

SEQ ID NO: 182066 - RNA, 64 nt, Homo Sapiens
cuguaaauaacuugcaaggaugaaagauggaggaugaaccuauagauuuaaagagacuuaagag

SEQ ID NO: 182067 - RNA, 64 nt, Homo Sapiens
cauuaagcucuguugucaugaacaacuggaauguaaaccacaguauuuuggagugcagaacauu

SEQ ID NO: 182068 - RNA, 64 nt, Homo Sapiens
agguguuguaaagagcugcuaguagguucgcuuuaaaccacaugagcuuaaccaagaauauguu

SEQ ID NO: 182069 - RNA, 64 nt, Homo Sapiens
aaagcaauuuaaucaauugcaaagcaauuauauaaaaccacaaagaauguacugaaccuacuaa

SEQ ID NO: 182070 - RNA, 64 nt, Homo Sapiens
caaagugguuuuuuaaaauuacauaacuaaaaauaaaccacacuguggauacaucuuauaaaac

SEQ ID NO: 182071 - RNA, 64 nt, Homo Sapiens
aaagaauauuccauuuuccuuuccuugugguugaaaaccacagucaguggagagauguuuggaa

SEQ ID NO: 182072 - RNA, 64 nt, Homo Sapiens
gguugaaaaccacagucaguggagagauguuuggaaaccacagucaguggagccugggugguac

SEQ ID NO: 182073 - RNA, 64 nt, Homo Sapiens
uaguaccaaacuccauucauccuaguagauucgcaaaccacagagcaguauauguucuaagacc

SEQ ID NO: 182074 - RNA, 64 nt, Homo Sapiens
auccuugaucagagaaggggagugaauaucaucaaaaccacagcuaccaagcucucccuuauca

SEQ ID NO: 182075 - RNA, 64 nt, Homo Sapiens
augacagcccacuugucaaauauguaauucaccgaaaccacaccaaguccugcuacuguagagu

SEQ ID NO: 182076 - RNA, 64 nt, Homo Sapiens
ccucugaaauguggcuagguguagaaugauguugaaaccacaggcuaaaauguagaucuggaag

SEQ ID NO: 182077 - RNA, 64 nt, Homo Sapiens
acugcagaaguggcuccuuuucauaaacuccccuaaaccacacacaggagagagcgacgggccu

SEQ ID NO: 182078 - RNA, 64 nt, Homo Sapiens
aaaauaaauaagaauaacucagaaacucaaaaggaaaccacaaauucagcuaauaauagcauuu

SEQ ID NO: 182079 - RNA, 64 nt, Homo Sapiens
guugccaggcaggcaccugggcuuucuggaauccaaaccacagucuuaggggcuugguaguuug

SEQ ID NO: 182080 - RNA, 64 nt, Homo Sapiens
ucugguugugauuuauauuuuaaagcuuggugcuaaaccacaauauguauagcauauggagugc

SEQ ID NO: 182081 - RNA, 64 nt, Homo Sapiens
cauugaaucucuuaugccaguuuucauaaaacccaaaccacauaugaaaaaauccauuaagggu

SEQ ID NO: 182082 - RNA, 64 nt, Homo Sapiens
accaguuguugagggguauacuagaagcagaaugaaaccacauuuuuugguuugauaauaugca

SEQ ID NO: 182083 - RNA, 64 nt, Homo Sapiens
guccauuccaggaccuucauuugcauaagguaucaaaccacaucagccucugauuggccauggg

SEQ ID NO: 182084 - RNA, 64 nt, Homo Sapiens
guucauuccaggacauucauuugcauaaggagucaaaccacaccagucuuggauuggcugugag

SEQ ID NO: 182085 - RNA, 64 nt, Homo Sapiens
uggacagauccugucauuguuuaagcugagcaaaaaaccacacaaaaguuguguaagagaugag

SEQ ID NO: 182086 - RNA, 64 nt, Homo Sapiens
gaagagggaacuuucuggaguuuuugagaaugccaaaccacauuuuuaucacacuucuuuggaa

SEQ ID NO: 182087 - RNA, 64 nt, Homo Sapiens
uuuucauuucuagugcuucgaaaaagagcacuauaaaccacauggaaauaaggaaauaggggaa

SEQ ID NO: 182088 - RNA, 64 nt, Homo Sapiens
ucaugacuuuuugacugugcgauaauuaaaaagaaaaccacagaugugugaucacaagacuaaa

SEQ ID NO: 182089 - RNA, 64 nt, Homo Sapiens
aauuuaaauggagccuuucaaacacuugaccaaaaaaccacauucauuauuacaaaacaaaaug

SEQ ID NO: 182090 - RNA, 64 nt, Homo Sapiens
uuauagaauccacccaagaacaaagguuuuauucaaaccacaaauuaauacuaauggaauguuu

SEQ ID NO: 182091 - RNA, 64 nt, Homo Sapiens
ugauagagauucaaaagacuuuguugaauaaaaaaaaccacauuuguagaaaagugcuugucag

SEQ ID NO: 182092 - RNA, 64 nt, Homo Sapiens
aucaacaccaacaaguuucuugguugacaggaagaaaccacaccuugcuucccucccaucaguc

SEQ ID NO: 182093 - RNA, 64 nt, Homo Sapiens
aacaauuucucuggagacaauuuuugucuuugggaaaccacaggcauuguuuaaaaccaucacu

SEQ ID NO: 182094 - RNA, 64 nt, Homo Sapiens
caguaaauguuuauuaauagauguucaguccaacaaaccacacauagaaauacacguaugguua

SEQ ID NO: 182095 - RNA, 64 nt, Homo Sapiens
acuuccugggaccuuuuguauugaaugaaucaacaaaccacaauauugucauuugggcuuucug

SEQ ID NO: 182096 - RNA, 64 nt, Homo Sapiens
guacuuuuuuuuacuuuggcuuuuuggacuauguaaaccacauuccgaaggcauuuuccacuag

SEQ ID NO: 182097 - RNA, 64 nt, Homo Sapiens
uuuugugcccauuguuuuaaauaugcuuuuguugaaaccacagcaagcacaacauuaugauuua

SEQ ID NO: 182098 - RNA, 64 nt, Homo Sapiens
acauacuucuuuucuuucauauggacacgcaaagaaaccacagccagauguuguuuucagguua

SEQ ID NO: 182099 - RNA, 64 nt, Homo Sapiens
auaaucaacacuguucucucagggcagccccuuuguggcccagggcuggggaagugaacuaccc

SEQ ID NO: 182100 - RNA, 64 nt, Homo Sapiens
accauggcacccuuagaguguggagugggcagagguggcccaggugcagacgugagaugaacac

SEQ ID NO: 182101 - RNA, 64 nt, Homo Sapiens
gaggagggggccucucauggcccuucccuggccuguggcccagccuggcuggccugcagguguc

SEQ ID NO: 182102 - RNA, 64 nt, Homo Sapiens
gcuggacuguggaccccgaugggccagaguccuuguggcccacagcauagcacuggggacagag

SEQ ID NO: 182103 - RNA, 64 nt, Homo Sapiens
gucacacagcuaguuugaguaguggggaaggggaguggcccaagaugaagaagcugaagcccag

SEQ ID NO: 182104 - RNA, 64 nt, Homo Sapiens
agugacccccgccaggggagcuguguguugauggguggcccauggcgccauggugugucagugu

SEQ ID NO: 182105 - RNA, 64 nt, Homo Sapiens
gugaccagacaguccugagacccagaaggcccagguggcccaagugcucuugguggcccagcuu

SEQ ID NO: 182106 - RNA, 64 nt, Homo Sapiens
gacccagaaggcccagguggcccaagugcucuugguggcccagcuuggccagcacacacuuucc

SEQ ID NO: 182107 - RNA, 64 nt, Homo Sapiens
cugauccucgaggccuccugcuccagagcguaccguggcccagacccugcagugcaagcugcug

SEQ ID NO: 182108 - RNA, 64 nt, Homo Sapiens
ugguauccccaaggccucgucuccagagcauaccguggcccaggcccugcggugcaagcugcug

SEQ ID NO: 182109 - RNA, 64 nt, Homo Sapiens
gcgucccaaaguaggccucgcgauguggcccaaaguggcccaaacggccccaagcugccuuccu

SEQ ID NO: 182110 - RNA, 64 nt, Homo Sapiens
guggcccaaagcgucccaaacugccuuccucgauguggcccaaacggcgccucccggccccaag

SEQ ID NO: 182111 - RNA, 64 nt, Homo Sapiens
gcccuccccuggcccucauggcauugcuguggggguggcccacuuccuucccccugugcugaca

SEQ ID NO: 182112 - RNA, 64 nt, Homo Sapiens
cccagccugguggacauggauccucuugguaaguguggcccacauuggaggcaacagacggugg

SEQ ID NO: 182113 - RNA, 64 nt, Homo Sapiens
agucgggugacucauuuuucuguguagagacucgguggcccaggcaggaggugaaagcagccau

SEQ ID NO: 182114 - RNA, 64 nt, Homo Sapiens
ugacugggucuucaaugacaggcuuggacuagcuguggcccagacaucggcccugcccagaauu

SEQ ID NO: 182115 - RNA, 59 nt, Homo Sapiens
agaccuaccgcagcuccuagcccguugcgguggcccaucccgcauacccaucuucucgg

SEQ ID NO: 182116 - RNA, 64 nt, Homo Sapiens
agcuggguuaucaugguuggcuuagguaccucagguggcccaggagguccccccuccauaagga

SEQ ID NO: 182117 - RNA, 64 nt, Homo Sapiens
gaagccaaaagauuggauacauucuucuuccaacguggcccagauuuacauguggcccaacaca

SEQ ID NO: 182118 - RNA, 64 nt, Homo Sapiens
acaauucuucuuccaacgugaguggauuuuacauguggcccaaccaucggcuaucguuagugcu

SEQ ID NO: 182119 - RNA, 64 nt, Homo Sapiens
gaagccaaaagaugggacacauucuucuuccaauguggcccagguuuauguguggcccaagaua

SEQ ID NO: 182120 - RNA, 64 nt, Homo Sapiens
auaauucuucuuccaaugugaguguauuuuauguguggcccaaguuuucucgucagcuaucguu

SEQ ID NO: 182121 - RNA, 64 nt, Homo Sapiens
gcuuuggcuggaaucauuuugccgagacuaauguguggcccacagcauaagggaugaaaacuug

SEQ ID NO: 182122 - RNA, 64 nt, Homo Sapiens
auagggcuggggcagcucccgaaaguucuagacuguggcccagagcagguugugagcuggaaaa

SEQ ID NO: 182123 - RNA, 64 nt, Homo Sapiens
gugccugucacucagcauucgaguggggcucagcguggcccaugaugaccccagccagaugagc

SEQ ID NO: 182124 - RNA, 64 nt, Homo Sapiens
cuuguaaccugaacuucugugugguggcaguacuguggcccaccaguguaaucucccuggauua

SEQ ID NO: 182125 - RNA, 64 nt, Homo Sapiens
uuuggagaacagggaaagccuggaggcuucccagguggcccagcgugguguccugucagcuucc

SEQ ID NO: 182126 - RNA, 64 nt, Homo Sapiens
cgcugcuuugugcuaaaagccaccucugguaacaguggcccagaauuuuguaaauguauaaacu

SEQ ID NO: 182127 - RNA, 64 nt, Homo Sapiens
ggcuaugcuugccuccggcuggccaucaggucuuguggcccaaauuuccagaccagcauccagu

SEQ ID NO: 182128 - RNA, 64 nt, Homo Sapiens
ugccaggaccaccccaccuccauucagaagacugguggcccacgcugacccgggacucacucuu

SEQ ID NO: 182129 - RNA, 64 nt, Homo Sapiens
ggaaggcuccucuggggccccuucucugugggggguggcccaagauguuggcucagagcuauag

SEQ ID NO: 182130 - RNA, 64 nt, Homo Sapiens
gcuggcaggucaaccucgcgcugaggucaucggcguggcccaagccugugguuguuaguggggc

SEQ ID NO: 182131 - RNA, 64 nt, Homo Sapiens
gcuguuggugggacccguggauggcuguguugguguggcccaugccaaagugccggugagaccc

SEQ ID NO: 182132 - RNA, 64 nt, Homo Sapiens
uugggcucaggcugggugcucugccaugggcugaguggcccagauauucuucuguccaucuuug

SEQ ID NO: 182133 - RNA, 64 nt, Homo Sapiens
acuuuaguuacuugaugagcuggcuguggccaggguggcccaccugcccuucccuguuccuuuc

SEQ ID NO: 182134 - RNA, 64 nt, Homo Sapiens
aggugagccugcuguucugcagcuccgaggcacuguggcccagcgaugcuggaugugcugcagg

SEQ ID NO: 182135 - RNA, 64 nt, Homo Sapiens
gccugcagcaaaacguccuaguauggcagcaaauguggcccaugccacccccagguaugucucu

SEQ ID NO: 182136 - RNA, 64 nt, Homo Sapiens
acacggcugaccucauacaucaagccaauaccguguggcccaagacccccaccauaaaucacau

SEQ ID NO: 182137 - RNA, 64 nt, Homo Sapiens
ccauaaaucacaucauuagcaugaaccacccagaguggcccaagacucccagaucagcuaccag

SEQ ID NO: 182138 - RNA, 64 nt, Homo Sapiens
cggcaucgccaggcacuggcugggguggggaaagguggcccaguggagccgguggccaggaagg

SEQ ID NO: 182139 - RNA, 64 nt, Homo Sapiens
gcaggcgggcgagugcgugagugcacgccagcgcguggcccauguaugaggagugaaggggccc

SEQ ID NO: 182140 - RNA, 64 nt, Homo Sapiens
aggccccccugucacccauggguaagaggagugcguggcccaccccugggcgucaucugguccu

SEQ ID NO: 182141 - RNA, 64 nt, Homo Sapiens
aggggcuccaugccagccgacugccagucaucgaguggcccaacgcacagaggccuccuguggc

SEQ ID NO: 182142 - RNA, 64 nt, Homo Sapiens
aaggcagccacacgccccuccuggaagggugugugcgugugagugugugcgagugugugggcug

SEQ ID NO: 182143 - RNA, 64 nt, Homo Sapiens
uagccugccucuucucuacucuagggaaaaaccagcgugugacuacucccccaggugguuaugg

SEQ ID NO: 182144 - RNA, 64 nt, Homo Sapiens
uaagauagaacacaaaacuugaaagaaguuuuaugcgugugacaguguauggggcugcaguugg

SEQ ID NO: 182145 - RNA, 64 nt, Homo Sapiens
cagaggcgagacgcagcuuuccagccgcacagaugcgugugaccugugacgcggcacauacacc

SEQ ID NO: 182146 - RNA, 64 nt, Homo Sapiens
caggagaccuagguuucagccagucaugguuguggcgugugaguuggaauuaagggagcugagc

SEQ ID NO: 182147 - RNA, 64 nt, Homo Sapiens
guguguguagauuuauaguuauggacauguaugugcgugugagugaggaaaagcuuucuuaaaa

SEQ ID NO: 182148 - RNA, 64 nt, Homo Sapiens
aauuuagcaaauuaaguuauugugugauguuugugcgugugaugaggagaguagcuucuuugug

SEQ ID NO: 182149 - RNA, 64 nt, Homo Sapiens
aacaccuccucccgaaaaaucaggcagccuccgggcgugugaagggucccaugacggcggggcc

SEQ ID NO: 182150 - RNA, 64 nt, Homo Sapiens
uugaaccaugagacauuccucuuuuuaugggauugcgugugaaugugcagagaugcugcauauc

SEQ ID NO: 182151 - RNA, 64 nt, Homo Sapiens
aauggcuucauuuugaagaacaaacucaaucucagcgugugaccuggagucuuaacacuuccag

SEQ ID NO: 182152 - RNA, 64 nt, Homo Sapiens
gucuauuaaaacugugaauguauguagcaauccugcgugugaaggcaaauaaacucuuuaacag

SEQ ID NO: 182153 - RNA, 64 nt, Homo Sapiens
aguacucuauaaauuuuuguguauguguguaugugcgugugauuaccagagaacuacuaaaaaa

SEQ ID NO: 182154 - RNA, 64 nt, Homo Sapiens
ggugcagagacgggggacuggcaucugugagcaugcgugugacagcagggcugaggcuccaugu

SEQ ID NO: 182155 - RNA, 64 nt, Homo Sapiens
gugccugacaucucacgcaccaacacaggacccugcgugugagccccccugcugggucaggagc

SEQ ID NO: 182156 - RNA, 64 nt, Homo Sapiens
gaauauuucuccuggcucuaaccauggauuugaggcgugugaagacugcagcuugaaggagcca

SEQ ID NO: 182157 - RNA, 64 nt, Homo Sapiens
cugccgggugguggugacugagcaggugugggcagcgugugaggcucaccuccccgcccugggc

SEQ ID NO: 182158 - RNA, 64 nt, Homo Sapiens
auaggggauggaugaguggguauuucuucccuaagcgugugaaacuuauuguaaaugaauagaa

SEQ ID NO: 182159 - RNA, 64 nt, Homo Sapiens
gggccaggcccagcccaucuguguguguguaugugcgugugaugcuaccucuccucccgucccu

SEQ ID NO: 182160 - RNA, 64 nt, Homo Sapiens
ggcagaacuaacgugcggaaaaccuggcuggaccgcgugugaaaccagcccugugcccccgcug

SEQ ID NO: 182161 - RNA, 64 nt, Homo Sapiens
guucacaucacucugcagacagcaaugugacucagcgugugacuuguagcagcaguacgagggc

SEQ ID NO: 182162 - RNA, 57 nt, Homo Sapiens
accgcaacaaagccccaaaggaagcuggcgugugaaacggcugccaaaaagaaguag

SEQ ID NO: 182163 - RNA, 64 nt, Homo Sapiens
uucaauaaacguggcugcuggccagaggacgugagcgugugacgggcgccuuggcgccaccugu

SEQ ID NO: 182164 - RNA, 64 nt, Homo Sapiens
gugcuagggguuaggcuuuugagcuugaacgccugcgugugaacagaugaaaaauccuucagua

SEQ ID NO: 182165 - RNA, 64 nt, Homo Sapiens
cuggaucaccuaacagucagaggucaguaucucagcgugugaauuauagaggaaauacagagag

SEQ ID NO: 182166 - RNA, 64 nt, Homo Sapiens
uccuugguaaacccaaaggcuuauucuguugccugcgugugaauguuugguagagcuauaucau

SEQ ID NO: 182167 - RNA, 64 nt, Homo Sapiens
uuuaacauuaauauuuuauuuuauuuucacgggagcgugugauaagguuaauuaagaauguugg

SEQ ID NO: 182168 - RNA, 62 nt, Homo Sapiens
uggucugcugaccucagacacaaccuugcguggcgugugaacuuuaugacuuggaucuauag

SEQ ID NO: 182169 - RNA, 64 nt, Homo Sapiens
gagggagacaggaacggcucagagcuuguggaaagcgugugaguaggcaggugcagggaagugc

SEQ ID NO: 182170 - RNA, 64 nt, Homo Sapiens
agaaccgacccaccccgcgcggggaggcgcgagugcgugugagaauuaauuuugguugguguug

SEQ ID NO: 182171 - RNA, 64 nt, Homo Sapiens
caccuacugagggaaaggaaaagccccuggaaaugcgugugaccugugaagugguguauuguca

SEQ ID NO: 182172 - RNA, 64 nt, Homo Sapiens
agcaaacgggagaaauuuauuuuuaugaaauacugcgugugauaguuaacgcacuuggaguaau

SEQ ID NO: 182173 - RNA, 64 nt, Homo Sapiens
aaggagaaccaaaaccaauaggcuuugucagccagcgugugagaucauuagguagcucuggcug

SEQ ID NO: 182174 - RNA, 64 nt, Homo Sapiens
guuggcacuaggcccacggcggaggagguagcuagcgugugagggacuuuccacuccaagcaca

SEQ ID NO: 182175 - RNA, 64 nt, Homo Sapiens
ucaugguuccugcaugcuguugauucauuuugcugcgugugaaaagagugaggaagaagcagaa

SEQ ID NO: 182176 - RNA, 64 nt, Homo Sapiens
acgugugugaguucaccaugucuuguuuggcugugcgugugaacggugucguugugugcggucc

SEQ ID NO: 182177 - RNA, 64 nt, Homo Sapiens
gaggggcuggaugcguucgaguguauggcgugcugcgugugauguucuguucgugccccaggcg

SEQ ID NO: 182178 - RNA, 64 nt, Homo Sapiens
gccgcucugcacacagggccgaaugcugcugugcgcgugugagguucccuugcccagcucuguu

SEQ ID NO: 182179 - RNA, 64 nt, Homo Sapiens
uuguuuuucuaaauguucaaauauuucauuuugugcgugugaaagggaaaacacuuugacggau

SEQ ID NO: 182180 - RNA, 64 nt, Homo Sapiens
guuacagaaagagguucuggugggagagaaaggugcgugugagacaggagaauugucuuaagca

SEQ ID NO: 182181 - RNA, 64 nt, Homo Sapiens
acaaaaucguguguccguggaaccaguccuagccgcgugugacagucuugcauucuguuugucu

SEQ ID NO: 182182 - RNA, 64 nt, Homo Sapiens
ccuuuuuuauuuuucuuuucauaaacccaaugcugcgugugaggucucuugcccugucucucaa

SEQ ID NO: 182183 - RNA, 64 nt, Homo Sapiens
agacugaaggggccgcugcaccaagcccaucagggcgugugagcauccugggagguggcccuuc

SEQ ID NO: 182184 - RNA, 64 nt, Homo Sapiens
gaaucagugaccggccagguccccgagagcuacagcgugugaugcucccucuccaccuccccgc

SEQ ID NO: 182185 - RNA, 64 nt, Homo Sapiens
ccacggaaggcuuggucccagauucccuuccggugcgugugaaguuggagggagggcugaccca

SEQ ID NO: 182186 - RNA, 64 nt, Homo Sapiens
cgaucagcccugucuccuccccuggaccggcugggcgugugaugcugugagccucuggcccuuu

SEQ ID NO: 182187 - RNA, 64 nt, Homo Sapiens
gcacuuugcaccuccuaucccgcggacccgggccgcgugugagcagauccccacagcucucggc

SEQ ID NO: 182188 - RNA, 64 nt, Homo Sapiens
cagcguaacggagggugaagucuagggaagcagugcgugugaaauuccauaccaagugcuuugc

SEQ ID NO: 182189 - RNA, 64 nt, Homo Sapiens
ucaucaaggcggcagcauaauuugaagggcaauugcgugugaaaauugaugugacuugauuuac

SEQ ID NO: 182190 - RNA, 64 nt, Homo Sapiens
cguugugccugguucgugccaugcccuuacacgugcgugugagugugugugugugucuguaggu

SEQ ID NO: 182191 - RNA, 64 nt, Homo Sapiens
ugaacagacggagaagaugucagaacuggcugcugcgugugaaccauagcugccuaugcccccg

SEQ ID NO: 182192 - RNA, 64 nt, Homo Sapiens
ggacgccauccgaagacagcuccuaagggggcaggcgugugagucacgucucuccccagugggc

SEQ ID NO: 182193 - RNA, 64 nt, Homo Sapiens
cugggcucuguggcucugugcuugcgugcacggugcgugugacgucagucucgugcacgucugu

SEQ ID NO: 182194 - RNA, 64 nt, Homo Sapiens
cugccaggcugucagcgccucaaggguagggucugcgugugauuugucucugagcccccugugc

SEQ ID NO: 182195 - RNA, 64 nt, Homo Sapiens
caaugggcagugcccaccccgcccacuggcaucugcgugugagggcuaggccgcccugccacac

SEQ ID NO: 182196 - RNA, 64 nt, Homo Sapiens
ggaacucagguuuacacaaacagaaggaaaucaugcgugugaucauacucaggaccccaagaua

SEQ ID NO: 182197 - RNA, 64 nt, Homo Sapiens
agccauucauguguuccaaacccacucaggguuggcgugugaugccacccuuccugccuccugc

SEQ ID NO: 182198 - RNA, 64 nt, Homo Sapiens
aaaaguuugcuuuggugagugagaaaaggcuggggcgugugauccauccccucacguuucagaa

SEQ ID NO: 182199 - RNA, 64 nt, Homo Sapiens
cucuguaaacaaggcccuucugaccggacucagugcgugugauggugagugcaaugaggaaggg

SEQ ID NO: 182200 - RNA, 64 nt, Homo Sapiens
cccauguuuggagcauuuguagccuuauucucuugcgugugaaucucuuacccugaaaaaaagc

SEQ ID NO: 182201 - RNA, 64 nt, Homo Sapiens
ugugugaugcaccagagcaccccagcgugcgugugcgugugaugugcucgagacguguggacac

SEQ ID NO: 182202 - RNA, 64 nt, Homo Sapiens
ucuccagggaggccguccgaaacgugcaugggcggcgugugacacggagcugccagucgucuug

SEQ ID NO: 182203 - RNA, 64 nt, Homo Sapiens
agaggccaaaucgucuaaggacguugcugaacaagcgugugaaaucauuucagaucaaggauaa

SEQ ID NO: 182204 - RNA, 64 nt, Homo Sapiens
cauucugacauuucagauccauggagcaugaccagcgugugacuagcaggauugcuuucauugu

SEQ ID NO: 182205 - RNA, 64 nt, Homo Sapiens
uccacagcuaccucuucuauagccuugggaacaugcgugugaccuggggaggagcaggagccug

SEQ ID NO: 182206 - RNA, 64 nt, Homo Sapiens
ucuacagcuaccucuucuauagccuugggaacaugcgugugaccuggggaggagcaggagccug

SEQ ID NO: 182207 - RNA, 64 nt, Homo Sapiens
gcaugugguaagguguguacgugaguguguggaugcgugugaacugggagaguggaccugugcu

SEQ ID NO: 182208 - RNA, 64 nt, Homo Sapiens
uuuccagccaugcgauauuccgacaucaaagcuggcgugugacccugcccacauuccugccacc

SEQ ID NO: 182209 - RNA, 64 nt, Homo Sapiens
aaaguaaagaacaggauuccuaugagaauuaauagcgugugaacuugugguagagaggugaagg

SEQ ID NO: 182210 - RNA, 64 nt, Homo Sapiens
ggccucaaggggacucugcuccacguggggccaggcgugugacugacgcuguccgacgaaggcg

SEQ ID NO: 182211 - RNA, 64 nt, Homo Sapiens
gugccaugugcguggcacgcauaugagugugugugcgugugaacggcuuuggguccugcugguu

SEQ ID NO: 182212 - RNA, 64 nt, Homo Sapiens
acacuaagaggugaacauguaugagugugugcacgcgugugagugugcaugugugugugugcaa

SEQ ID NO: 182213 - RNA, 64 nt, Homo Sapiens
ucucccuccuccaagccccuguacauaaccuggagcgugugaccuucagagcuuuucacuuuau

SEQ ID NO: 182214 - RNA, 64 nt, Homo Sapiens
gggcggugggaggcccgccucaggucagggcccagcgugugauguaggggccggggcaggccag

SEQ ID NO: 182215 - RNA, 64 nt, Homo Sapiens
ccucgggcuggacaccgaaaccucccuucuuaaagcgugugagguugggugauagccguuccuu

SEQ ID NO: 182216 - RNA, 64 nt, Homo Sapiens
cccuuuggucuggguuguguggcuuuugggggaugcgugugagggggcuauguguuuuuuaauu

SEQ ID NO: 182217 - RNA, 64 nt, Homo Sapiens
ugaacgcugaucaguauuuuacuuuaauucgagcgcgugugaaccgugugaauucucacauuag

SEQ ID NO: 182218 - RNA, 64 nt, Homo Sapiens
guagacagaggggugaagaauguguauagagugagcgugugauucuaaaaggugggacugagga

SEQ ID NO: 182219 - RNA, 64 nt, Homo Sapiens
cggugguggcggcagcugucucaugucggaggcugcgugugagcgcucuugaagcacuuucuuu

SEQ ID NO: 182220 - RNA, 64 nt, Homo Sapiens
aacccacccacuggaagaucgagaccaagagaaggcgugugagcgacguacaacagguucugcg

SEQ ID NO: 182221 - RNA, 64 nt, Homo Sapiens
aguucauucucucacccccuuauguugguguuuggcgugugacagcaguucuacagagcucugu

SEQ ID NO: 182222 - RNA, 64 nt, Homo Sapiens
cgucggagccuguuccuggcgagaucauugcugugcgugugaaggaagagcaucuagacguggc

SEQ ID NO: 182223 - RNA, 64 nt, Homo Sapiens
cagcgggggaagggaagagcaaacucuggaagcagcgugugaaaucauuuauuccuugcuggac

SEQ ID NO: 182224 - RNA, 64 nt, Homo Sapiens
cugugggcgcccaaggccagacaugugauguggugcgugugaauccguguucauaugucagggc

SEQ ID NO: 182225 - RNA, 64 nt, Homo Sapiens
cauggugcugagguuacauguguguguguacagugcgugugauucccauguccaaagugcuguc

SEQ ID NO: 182226 - RNA, 64 nt, Homo Sapiens
caccacgcccggccaugaaaugcugggauuacaggcgugugagcgauccacccaccucaggaag

SEQ ID NO: 182227 - RNA, 64 nt, Homo Sapiens; identical to SEQ ID NO: 56439

SEQ ID NO: 182228 - RNA, 64 nt, Homo Sapiens; identical to SEQ ID NO: 56440

SEQ ID NO: 182229 - RNA, 64 nt, Homo Sapiens; identical to SEQ ID NO: 56441

SEQ ID NO: 182230 - RNA, 64 nt, Homo Sapiens; identical to SEQ ID NO: 56442

SEQ ID NO: 182231 - RNA, 64 nt, Homo Sapiens; identical to SEQ ID NO: 56443

SEQ ID NO: 182232 - RNA, 64 nt, Homo Sapiens; identical to SEQ ID NO: 56444

SEQ ID NO: 182233 - RNA, 64 nt, Homo Sapiens; identical to SEQ ID NO: 56445

SEQ ID NO: 182234 - RNA, 64 nt, Homo Sapiens; identical to SEQ ID NO: 56446

SEQ ID NO: 182235 - RNA, 64 nt, Homo Sapiens; identical to SEQ ID NO: 56447

SEQ ID NO: 182236 - RNA, 64 nt, Homo Sapiens; identical to SEQ ID NO: 56448

SEQ ID NO: 182237 - RNA, 64 nt, Homo Sapiens; identical to SEQ ID NO: 56449

SEQ ID NO: 182238 - RNA, 64 nt, Homo Sapiens; identical to SEQ ID NO: 56450

SEQ ID NO: 182239 - RNA, 64 nt, Homo Sapiens; identical to SEQ ID NO: 56451

SEQ ID NO: 182240 - RNA, 64 nt, Homo Sapiens; identical to SEQ ID NO: 56452

SEQ ID NO: 182241 - RNA, 64 nt, Homo Sapiens; identical to SEQ ID NO: 56453

SEQ ID NO: 182242 - RNA, 64 nt, Homo Sapiens; identical to SEQ ID NO: 56454

SEQ ID NO: 182243 - RNA, 64 nt, Homo Sapiens; identical to SEQ ID NO: 56455

SEQ ID NO: 182244 - RNA, 64 nt, Homo Sapiens; identical to SEQ ID NO: 56456

SEQ ID NO: 182245 - RNA, 64 nt, Homo Sapiens; identical to SEQ ID NO: 56457

SEQ ID NO: 182246 - RNA, 64 nt, Homo Sapiens; identical to SEQ ID NO: 56458

SEQ ID NO: 182247 - RNA, 64 nt, Homo Sapiens; identical to SEQ ID NO: 56459

SEQ ID NO: 182248 - RNA, 64 nt, Homo Sapiens; identical to SEQ ID NO: 56460

SEQ ID NO: 182249 - RNA, 64 nt, Homo Sapiens; identical to SEQ ID NO: 56461

SEQ ID NO: 182250 - RNA, 64 nt, Homo Sapiens; identical to SEQ ID NO: 56462

SEQ ID NO: 182251 - RNA, 64 nt, Homo Sapiens; identical to SEQ ID NO: 56463

SEQ ID NO: 182252 - RNA, 64 nt, Homo Sapiens; identical to SEQ ID NO: 56464

SEQ ID NO: 182253 - RNA, 64 nt, Homo Sapiens; identical to SEQ ID NO: 56465

SEQ ID NO: 182254 - RNA, 64 nt, Homo Sapiens; identical to SEQ ID NO: 56466

SEQ ID NO: 182255 - RNA, 64 nt, Homo Sapiens; identical to SEQ ID NO: 56467

SEQ ID NO: 182256 - RNA, 50 nt, Homo Sapiens; identical to SEQ ID NO: 56468

SEQ ID NO: 182257 - RNA, 64 nt, Homo Sapiens; identical to SEQ ID NO: 56469

SEQ ID NO: 182258 - RNA, 64 nt, Homo Sapiens; identical to SEQ ID NO: 56470

SEQ ID NO: 182259 - RNA, 64 nt, Homo Sapiens; identical to SEQ ID NO: 56471

SEQ ID NO: 182260 - RNA, 64 nt, Homo Sapiens; identical to SEQ ID NO: 56472

SEQ ID NO: 182261 - RNA, 64 nt, Homo Sapiens; identical to SEQ ID NO: 56473

SEQ ID NO: 182262 - RNA, 64 nt, Homo Sapiens; identical to SEQ ID NO: 56474

SEQ ID NO: 182263 - RNA, 64 nt, Homo Sapiens; identical to SEQ ID NO: 56475

SEQ ID NO: 182264 - RNA, 64 nt, Homo Sapiens; identical to SEQ ID NO: 56476

SEQ ID NO: 182265 - RNA, 64 nt, Homo Sapiens; identical to SEQ ID NO: 56477

SEQ ID NO: 182266 - RNA, 64 nt, Homo Sapiens; identical to SEQ ID NO: 56478

SEQ ID NO: 182267 - RNA, 64 nt, Homo Sapiens; identical to SEQ ID NO: 56479

SEQ ID NO: 182268 - RNA, 64 nt, Homo Sapiens; identical to SEQ ID NO: 56480

SEQ ID NO: 182269 - RNA, 64 nt, Homo Sapiens; identical to SEQ ID NO: 56481

SEQ ID NO: 182270 - RNA, 64 nt, Homo Sapiens; identical to SEQ ID NO: 56482

SEQ ID NO: 182271 - RNA, 64 nt, Homo Sapiens; identical to SEQ ID NO: 56483

SEQ ID NO: 182272 - RNA, 64 nt, Homo Sapiens; identical to SEQ ID NO: 56484

SEQ ID NO: 182273 - RNA, 64 nt, Homo Sapiens; identical to SEQ ID NO: 56485

SEQ ID NO: 182274 - RNA, 64 nt, Homo Sapiens; identical to SEQ ID NO: 56486

SEQ ID NO: 182275 - RNA, 64 nt, Homo Sapiens; identical to SEQ ID NO: 56487

SEQ ID NO: 182276 - RNA, 64 nt, Homo Sapiens; identical to SEQ ID NO: 56488

SEQ ID NO: 182277 - RNA, 64 nt, Homo Sapiens; identical to SEQ ID NO: 56489

SEQ ID NO: 182278 - RNA, 64 nt, Homo Sapiens; identical to SEQ ID NO: 56490

SEQ ID NO: 182279 - RNA, 64 nt, Homo Sapiens; identical to SEQ ID NO: 56491

SEQ ID NO: 182280 - RNA, 64 nt, Homo Sapiens; identical to SEQ ID NO: 56492

SEQ ID NO: 182281 - RNA, 64 nt, Homo Sapiens; identical to SEQ ID NO: 56493

SEQ ID NO: 182282 - RNA, 64 nt, Homo Sapiens; identical to SEQ ID NO: 56494

SEQ ID NO: 182283 - RNA, 64 nt, Homo Sapiens; identical to SEQ ID NO: 56495

SEQ ID NO: 182284 - RNA, 64 nt, Homo Sapiens; identical to SEQ ID NO: 56496

SEQ ID NO: 182285 - RNA, 64 nt, Homo Sapiens; identical to SEQ ID NO: 56497

SEQ ID NO: 182286 - RNA, 64 nt, Homo Sapiens; identical to SEQ ID NO: 56498

SEQ ID NO: 182287 - RNA, 64 nt, Homo Sapiens; identical to SEQ ID NO: 56499

SEQ ID NO: 182288 - RNA, 64 nt, Homo Sapiens; identical to SEQ ID NO: 56500

SEQ ID NO: 182289 - RNA, 64 nt, Homo Sapiens; identical to SEQ ID NO: 56501

SEQ ID NO: 182290 - RNA, 64 nt, Homo Sapiens; identical to SEQ ID NO: 56502

SEQ ID NO: 182291 - RNA, 64 nt, Homo Sapiens; identical to SEQ ID NO: 56503

SEQ ID NO: 182292 - RNA, 64 nt, Homo Sapiens; identical to SEQ ID NO: 56504

SEQ ID NO: 182293 - RNA, 64 nt, Homo Sapiens; identical to SEQ ID NO: 56505

SEQ ID NO: 182294 - RNA, 64 nt, Homo Sapiens; identical to SEQ ID NO: 56506

SEQ ID NO: 182295 - RNA, 64 nt, Homo Sapiens; identical to SEQ ID NO: 56507

SEQ ID NO: 182296 - RNA, 64 nt, Homo Sapiens; identical to SEQ ID NO: 56508

SEQ ID NO: 182297 - RNA, 64 nt, Homo Sapiens; identical to SEQ ID NO: 56509

SEQ ID NO: 182298 - RNA, 64 nt, Homo Sapiens; identical to SEQ ID NO: 56510

SEQ ID NO: 182299 - RNA, 64 nt, Homo Sapiens; identical to SEQ ID NO: 56511

SEQ ID NO: 182300 - RNA, 64 nt, Homo Sapiens; identical to SEQ ID NO: 56512

SEQ ID NO: 182301 - RNA, 64 nt, Homo Sapiens; identical to SEQ ID NO: 56513

SEQ ID NO: 182302 - RNA, 64 nt, Homo Sapiens; identical to SEQ ID NO: 56514

SEQ ID NO: 182303 - RNA, 64 nt, Homo Sapiens; identical to SEQ ID NO: 56515

SEQ ID NO: 182304 - RNA, 64 nt, Homo Sapiens; identical to SEQ ID NO: 56516

SEQ ID NO: 182305 - RNA, 64 nt, Homo Sapiens; identical to SEQ ID NO: 56517

SEQ ID NO: 182306 - RNA, 64 nt, Homo Sapiens; identical to SEQ ID NO: 56518

SEQ ID NO: 182307 - RNA, 64 nt, Homo Sapiens; identical to SEQ ID NO: 56519

SEQ ID NO: 182308 - RNA, 64 nt, Homo Sapiens; identical to SEQ ID NO: 56520

SEQ ID NO: 182309 - RNA, 64 nt, Homo Sapiens; identical to SEQ ID NO: 56521

SEQ ID NO: 182310 - RNA, 64 nt, Homo Sapiens; identical to SEQ ID NO: 56522

SEQ ID NO: 182311 - RNA, 64 nt, Homo Sapiens; identical to SEQ ID NO: 56523

SEQ ID NO: 182312 - RNA, 64 nt, Homo Sapiens; identical to SEQ ID NO: 56524

SEQ ID NO: 182313 - RNA, 64 nt, Homo Sapiens; identical to SEQ ID NO: 56525

SEQ ID NO: 182314 - RNA, 64 nt, Homo Sapiens; identical to SEQ ID NO: 56526

SEQ ID NO: 182315 - RNA, 64 nt, Homo Sapiens; identical to SEQ ID NO: 56527

SEQ ID NO: 182316 - RNA, 64 nt, Homo Sapiens; identical to SEQ ID NO: 56528

SEQ ID NO: 182317 - RNA, 64 nt, Homo Sapiens; identical to SEQ ID NO: 56529

SEQ ID NO: 182318 - RNA, 64 nt, Homo Sapiens; identical to SEQ ID NO: 56530

SEQ ID NO: 182319 - RNA, 64 nt, Homo Sapiens; identical to SEQ ID NO: 56531

SEQ ID NO: 182320 - RNA, 64 nt, Homo Sapiens; identical to SEQ ID NO: 56532

SEQ ID NO: 182321 - RNA, 64 nt, Homo Sapiens; identical to SEQ ID NO: 56533

SEQ ID NO: 182322 - RNA, 64 nt, Homo Sapiens; identical to SEQ ID NO: 56534

SEQ ID NO: 182323 - RNA, 59 nt, Homo Sapiens; identical to SEQ ID NO: 56535

SEQ ID NO: 182324 - RNA, 64 nt, Homo Sapiens; identical to SEQ ID NO: 56536

SEQ ID NO: 182325 - RNA, 64 nt, Homo Sapiens; identical to SEQ ID NO: 56537

SEQ ID NO: 182326 - RNA, 64 nt, Homo Sapiens; identical to SEQ ID NO: 56538

SEQ ID NO: 182327 - RNA, 64 nt, Homo Sapiens; identical to SEQ ID NO: 56539

SEQ ID NO: 182328 - RNA, 64 nt, Homo Sapiens; identical to SEQ ID NO: 56540

SEQ ID NO: 182329 - RNA, 64 nt, Homo Sapiens; identical to SEQ ID NO: 56541

SEQ ID NO: 182330 - RNA, 64 nt, Homo Sapiens; identical to SEQ ID NO: 56542

SEQ ID NO: 182331 - RNA, 64 nt, Homo Sapiens; identical to SEQ ID NO: 56543

SEQ ID NO: 182332 - RNA, 64 nt, Homo Sapiens; identical to SEQ ID NO: 56544

SEQ ID NO: 182333 - RNA, 64 nt, Homo Sapiens; identical to SEQ ID NO: 56545

SEQ ID NO: 182334 - RNA, 64 nt, Homo Sapiens; identical to SEQ ID NO: 56546

SEQ ID NO: 182335 - RNA, 64 nt, Homo Sapiens; identical to SEQ ID NO: 56547

SEQ ID NO: 182336 - RNA, 64 nt, Homo Sapiens; identical to SEQ ID NO: 56548

SEQ ID NO: 182337 - RNA, 64 nt, Homo Sapiens; identical to SEQ ID NO: 56549

SEQ ID NO: 182338 - RNA, 64 nt, Homo Sapiens; identical to SEQ ID NO: 56550

SEQ ID NO: 182339 - RNA, 64 nt, Homo Sapiens; identical to SEQ ID NO: 56551

SEQ ID NO: 182340 - RNA, 64 nt, Homo Sapiens; identical to SEQ ID NO: 56552

SEQ ID NO: 182341 - RNA, 64 nt, Homo Sapiens; identical to SEQ ID NO: 56553

SEQ ID NO: 182342 - RNA, 64 nt, Homo Sapiens; identical to SEQ ID NO: 56554

SEQ ID NO: 182343 - RNA, 64 nt, Homo Sapiens; identical to SEQ ID NO: 56555

SEQ ID NO: 182344 - RNA, 64 nt, Homo Sapiens; identical to SEQ ID NO: 56556

SEQ ID NO: 182345 - RNA, 62 nt, Homo Sapiens; identical to SEQ ID NO: 56557

SEQ ID NO: 182346 - RNA, 58 nt, Homo Sapiens; identical to SEQ ID NO: 56558

SEQ ID NO: 182347 - RNA, 64 nt, Homo Sapiens; identical to SEQ ID NO: 56559

SEQ ID NO: 182348 - RNA, 64 nt, Homo Sapiens; identical to SEQ ID NO: 56560

SEQ ID NO: 182349 - RNA, 64 nt, Homo Sapiens; identical to SEQ ID NO: 56561

SEQ ID NO: 182350 - RNA, 64 nt, Homo Sapiens; identical to SEQ ID NO: 56562

SEQ ID NO: 182351 - RNA, 64 nt, Homo Sapiens; identical to SEQ ID NO: 56563

SEQ ID NO: 182352 - RNA, 64 nt, Homo Sapiens; identical to SEQ ID NO: 56564

SEQ ID NO: 182353 - RNA, 64 nt, Homo Sapiens; identical to SEQ ID NO: 56565

SEQ ID NO: 182354 - RNA, 64 nt, Homo Sapiens; identical to SEQ ID NO: 56566

SEQ ID NO: 182355 - RNA, 64 nt, Homo Sapiens; identical to SEQ ID NO: 56567

SEQ ID NO: 182356 - RNA, 64 nt, Homo Sapiens; identical to SEQ ID NO: 56568

SEQ ID NO: 182357 - RNA, 64 nt, Homo Sapiens; identical to SEQ ID NO: 56569

SEQ ID NO: 182358 - RNA, 64 nt, Homo Sapiens; identical to SEQ ID NO: 56570

SEQ ID NO: 182359 - RNA, 64 nt, Homo Sapiens; identical to SEQ ID NO: 56571

SEQ ID NO: 182360 - RNA, 64 nt, Homo Sapiens; identical to SEQ ID NO: 56572

SEQ ID NO: 182361 - RNA, 64 nt, Homo Sapiens; identical to SEQ ID NO: 56573

SEQ ID NO: 182362 - RNA, 64 nt, Homo Sapiens; identical to SEQ ID NO: 56574

SEQ ID NO: 182363 - RNA, 64 nt, Homo Sapiens; identical to SEQ ID NO: 56575

SEQ ID NO: 182364 - RNA, 64 nt, Homo Sapiens; identical to SEQ ID NO: 56576

SEQ ID NO: 182365 - RNA, 64 nt, Homo Sapiens; identical to SEQ ID NO: 56577

SEQ ID NO: 182366 - RNA, 64 nt, Homo Sapiens; identical to SEQ ID NO: 56578

SEQ ID NO: 182367 - RNA, 64 nt, Homo Sapiens; identical to SEQ ID NO: 56579

SEQ ID NO: 182368 - RNA, 64 nt, Homo Sapiens; identical to SEQ ID NO: 56580

SEQ ID NO: 182369 - RNA, 64 nt, Homo Sapiens; identical to SEQ ID NO: 56581

SEQ ID NO: 182370 - RNA, 64 nt, Homo Sapiens; identical to SEQ ID NO: 56582

SEQ ID NO: 182371 - RNA, 64 nt, Homo Sapiens
ugggguuuucugugcccaugacuugggggcugcacccccacagcacccccacaauguaggaaaa

SEQ ID NO: 182372 - RNA, 64 nt, Homo Sapiens
gugcccaugacuugggggcugcacccccacagcacccccacaauguaggaaaagaccucaggga

SEQ ID NO: 182373 - RNA, 64 nt, Homo Sapiens
ugggccuccucaccaacggcagugccaaaaucagcccccacaucaaggugguguucucugugcu

SEQ ID NO: 182374 - RNA, 64 nt, Homo Sapiens
uuucacuguucuucagagcuuucuggcucucuuucccccacaaaauucgacauauuuaaaaauc

SEQ ID NO: 182375 - RNA, 64 nt, Homo Sapiens
gcuggccuccccuagaggguuggccuccaugguacccccacaggucuccccaccaccaccucug

SEQ ID NO: 182376 - RNA, 64 nt, Homo Sapiens
ccucccagccuggaccuaauggaacuacaagcuccccccacauuccugagaaaagacugagcca

SEQ ID NO: 182377 - RNA, 64 nt, Homo Sapiens
cagcagccccucagggcuucccaaggauguccagcccccacacccacacguuaacauaaugagu

SEQ ID NO: 182378 - RNA, 64 nt, Homo Sapiens
aaggacucgccuugcaaccgacaggccauucccacccccacacacaaccuccccuguuuucaca

SEQ ID NO: 182379 - RNA, 64 nt, Homo Sapiens
accaccuuggauggugucaguggauguucggggacccccacaucucucuuuuuuccuuccagcc

SEQ ID NO: 182380 - RNA, 64 nt, Homo Sapiens
ccggugagcgacagggcccagugcuacauacaggcccccacagcgaggcggccccacgugggcu

SEQ ID NO: 182381 - RNA, 64 nt, Homo Sapiens
agcguguacuaccccaggacggaugcaugcagggcccccacaggcaggagcguguacuacccca

SEQ ID NO: 182382 - RNA, 64 nt, Homo Sapiens
agcguguacuaccccaggauggacgcaugcagggcccccacaggcaggagcguguacuacccca

SEQ ID NO: 182383 - RNA, 64 nt, Homo Sapiens
agcguguacuaccccaggacggacgcaugcagggcccccacagggcguguccuauccccggacc

SEQ ID NO: 182384 - RNA, 64 nt, Homo Sapiens
agcguguccuauccccggacggacgcaugcagggcccccacaggcuggagcguguacuacccca

SEQ ID NO: 182385 - RNA, 64 nt, Homo Sapiens
agcguguacuaccccaggacgaacgcaugcagggcccccacaggcaggagcguguacuacccca

SEQ ID NO: 182386 - RNA, 64 nt, Homo Sapiens
agcguguacuaccccagaacggacgcaugcagggcccccacaggcaggagcauguccuaucccu

SEQ ID NO: 182387 - RNA, 64 nt, Homo Sapiens
agcauguccuaucccuggacggacgcaugcagggcccccacaggcaggagcguguccuaucccc

SEQ ID NO: 182388 - RNA, 64 nt, Homo Sapiens
agcguguccuauccccggacggacgcaugcagggcccccacagggaggagcguguccuaucccc

SEQ ID NO: 182389 - RNA, 64 nt, Homo Sapiens
ccaucacuucugguguuaacuccacauuccuacacccccacaacgaccugugucaaaacuuaca

SEQ ID NO: 182390 - RNA, 64 nt, Homo Sapiens
cacacacacacacacaugcauaccccaucccccacccccacacaaugagccaaaagcacauacc

SEQ ID NO: 182391 - RNA, 64 nt, Homo Sapiens
cuacaacaggucggacccacucuuccuucacuuucccccacaccgcggggacucaccuucauuc

SEQ ID NO: 182392 - RNA, 64 nt, Homo Sapiens
uaucuucacucucugccuucaaugccccaaccuucccccacagcguaauccuguggccaacacc

SEQ ID NO: 182393 - RNA, 64 nt, Homo Sapiens
ggcugccugcucuucacagcuccaucucuuucaacccccacaggacucugagccaucuucuucc

SEQ ID NO: 182394 - RNA, 64 nt, Homo Sapiens
cuggcgccagggcucacagccucagcccccacagcccccacagccuccuccaggcccccggacg

SEQ ID NO: 182395 - RNA, 64 nt, Homo Sapiens
ccccacagccuggcgccaggccccggacgcucagcccccacagcacggcugcccuccuccaggc

SEQ ID NO: 182396 - RNA, 64 nt, Homo Sapiens
cacuccugagaccccuggccgcuuuccagcucaccccccacacucacagugcugucugaucugu

SEQ ID NO: 182397 - RNA, 64 nt, Homo Sapiens
gcugucugaucugugcuuucgcccucgggcccagcccccacagucuuccccaugggaagacgag

SEQ ID NO: 182398 - RNA, 64 nt, Homo Sapiens
gcagugccucugccagucacugucaucguugugucccccacaacuguccucuugcuagcucggc

SEQ ID NO: 182399 - RNA, 64 nt, Homo Sapiens
cugccagugggggauguuucuggaggcagcuggucccccacaccgcguccugcugagccugccc

SEQ ID NO: 182400 - RNA, 64 nt, Homo Sapiens
gggcguggguggggaaggggcucugggaccagaccccccacacuacugcgucuuuguuucuauc

SEQ ID NO: 182401 - RNA, 64 nt, Homo Sapiens
cagauaaguggcucuuacccagcucucagugacucccccacaaaacagcaacagccuccaccgc

SEQ ID NO: 182402 - RNA, 64 nt, Homo Sapiens
gagaccuccgguccgagacccugccuggguucaccccccacaacccagacccagaaccgcucuc

SEQ ID NO: 182403 - RNA, 64 nt, Homo Sapiens
uacacauccaagcucacaaauaaacucucaucuucccccacagaggaauauuuuccagagucuc

SEQ ID NO: 182404 - RNA, 64 nt, Homo Sapiens
gcccaagaccaaaucccucagacaaagguggagucccccacacuagcuaccaagacugucccua

SEQ ID NO: 182405 - RNA, 64 nt, Homo Sapiens
ucucagccccacuaaugcaguggggcuggaggggcccccacaucccccuucaggugcacuauaa

SEQ ID NO: 182406 - RNA, 64 nt, Homo Sapiens
cucaggccgagauccgugaguguccaggccuucucccccacacccacacccugcccugaggggc

SEQ ID NO: 182407 - RNA, 64 nt, Homo Sapiens
uggacgcucgcucuggugggcuggaaccaccccacccccacaccgagccccacagaggcagguc

SEQ ID NO: 182408 - RNA, 64 nt, Homo Sapiens
cagaugcauaggccugccuuguggcccaggaguccccccacacacagguuuggaggagccccga

SEQ ID NO: 182409 - RNA, 64 nt, Homo Sapiens
aaggaaaaaaugaaugagguccgcugcugcccaccccccacaaaccacgagccaccacugccuc

SEQ ID NO: 182410 - RNA, 64 nt, Homo Sapiens
ugcagcccgggcugccuccaucccggugagcugccccccacacggucccccacuccugccugcu

SEQ ID NO: 182411 - RNA, 64 nt, Homo Sapiens
gccuccagagcuagcugagggcccaccugccccucccccacagauaccgaauccugacugcaag

SEQ ID NO: 182412 - RNA, 64 nt, Homo Sapiens
cuguggccguggucuuagcccagguggcgccaggcccccacagugacauucccagaacuaccgc

SEQ ID NO: 182413 - RNA, 64 nt, Homo Sapiens
ccagcuccggggaaggggcuaguaccagccccaucccccacaguacugggccccguuucuagga

SEQ ID NO: 182414 - RNA, 64 nt, Homo Sapiens
cagcagaagccucuuucuccucucugcccccugccccccacaccacaccuguaggggaccuguc

SEQ ID NO: 182415 - RNA, 64 nt, Homo Sapiens
gguggggaagggagggucucuugauuccuaaccgcccccacauacugcuccaccgcugaacuuc

SEQ ID NO: 182416 - RNA, 64 nt, Homo Sapiens
cuggggcaggggcugugcacagacggaccccccacccccacacgcacuuuaugagggagacccc

SEQ ID NO: 182417 - RNA, 64 nt, Homo Sapiens
aaggucaguuuucccccagagcccgggucccugucccccacagggcaggcggggucccuggagc

SEQ ID NO: 182418 - RNA, 64 nt, Homo Sapiens
uuccuucuagggagcacccucccaccccccaccccccccacacacaccaucuuuccaucccagg

SEQ ID NO: 182419 - RNA, 64 nt, Homo Sapiens
ccacagggauccccaggaugcccacuucccuccacccccacaccccagccgugucccuaacccc

SEQ ID NO: 182420 - RNA, 64 nt, Homo Sapiens
cauccgcuggcuuggccagcagacugagcugggacccccacagcuguacagucucgcccuugga

SEQ ID NO: 182421 - RNA, 64 nt, Homo Sapiens
aaggcuguacagucucgcccacccugcccccaaccccccacagccaacagggccccgggaggga

SEQ ID NO: 182422 - RNA, 64 nt, Homo Sapiens
caggccuauucgcugcacuuccugccaaacuuugcccccacaagccuggucaucagccaggcag

SEQ ID NO: 182423 - RNA, 64 nt, Homo Sapiens
cagggaaacagggccagcacagaggggccuuccucccccacagagcccccaugacauagucugc

SEQ ID NO: 182424 - RNA, 64 nt, Homo Sapiens
caugcagaacucccaggucaggugccucccccaacccccacaccaguguccucugauccugucc

SEQ ID NO: 182425 - RNA, 64 nt, Homo Sapiens
cagggacccccauaaaggaccagcugggcucggucccccacaguagagaaggggaggaggacuc

SEQ ID NO: 182426 - RNA, 64 nt, Homo Sapiens
cucugaccagcagccuaugacaccugaccacacgcccccacaggcuugcucacagcugauuggg

SEQ ID NO: 182427 - RNA, 64 nt, Homo Sapiens
guggaugccugcugcaucuuuaagggcacagauccccccacaaacuuuaaugcuggggcccaag

SEQ ID NO: 182428 - RNA, 64 nt, Homo Sapiens
uaaccaggcccugauguaggucugucugcaccggcccccacauccaggguaucggggugcgagg

SEQ ID NO: 182429 - RNA, 64 nt, Homo Sapiens
cuugcucggcgcucugacuugcaccccgccgcuucccccacacgcaucugggagugggugaaca

SEQ ID NO: 182430 - RNA, 64 nt, Homo Sapiens; identical to SEQ ID NO: 86201

SEQ ID NO: 182431 - RNA, 64 nt, Homo Sapiens; identical to SEQ ID NO: 86202

SEQ ID NO: 182432 - RNA, 64 nt, Homo Sapiens; identical to SEQ ID NO: 86203

SEQ ID NO: 182433 - RNA, 64 nt, Homo Sapiens; identical to SEQ ID NO: 86204

SEQ ID NO: 182434 - RNA, 64 nt, Homo Sapiens; identical to SEQ ID NO: 86205

SEQ ID NO: 182435 - RNA, 64 nt, Homo Sapiens; identical to SEQ ID NO: 86206

SEQ ID NO: 182436 - RNA, 64 nt, Homo Sapiens; identical to SEQ ID NO: 86207

SEQ ID NO: 182437 - RNA, 64 nt, Homo Sapiens; identical to SEQ ID NO: 86208

SEQ ID NO: 182438 - RNA, 64 nt, Homo Sapiens; identical to SEQ ID NO: 86209

SEQ ID NO: 182439 - RNA, 64 nt, Homo Sapiens; identical to SEQ ID NO: 86210

SEQ ID NO: 182440 - RNA, 64 nt, Homo Sapiens; identical to SEQ ID NO: 86211

SEQ ID NO: 182441 - RNA, 64 nt, Homo Sapiens; identical to SEQ ID NO: 86212

SEQ ID NO: 182442 - RNA, 64 nt, Homo Sapiens; identical to SEQ ID NO: 86213

SEQ ID NO: 182443 - RNA, 64 nt, Homo Sapiens; identical to SEQ ID NO: 86214

SEQ ID NO: 182444 - RNA, 64 nt, Homo Sapiens; identical to SEQ ID NO: 86215

SEQ ID NO: 182445 - RNA, 64 nt, Homo Sapiens; identical to SEQ ID NO: 86216

SEQ ID NO: 182446 - RNA, 64 nt, Homo Sapiens; identical to SEQ ID NO: 86217

SEQ ID NO: 182447 - RNA, 64 nt, Homo Sapiens; identical to SEQ ID NO: 86218

SEQ ID NO: 182448 - RNA, 64 nt, Homo Sapiens; identical to SEQ ID NO: 86219

SEQ ID NO: 182449 - RNA, 64 nt, Homo Sapiens; identical to SEQ ID NO: 86220

SEQ ID NO: 182450 - RNA, 64 nt, Homo Sapiens; identical to SEQ ID NO: 86221

SEQ ID NO: 182451 - RNA, 64 nt, Homo Sapiens; identical to SEQ ID NO: 86222

SEQ ID NO: 182452 - RNA, 64 nt, Homo Sapiens; identical to SEQ ID NO: 86223

SEQ ID NO: 182453 - RNA, 64 nt, Homo Sapiens; identical to SEQ ID NO: 86224

SEQ ID NO: 182454 - RNA, 64 nt, Homo Sapiens; identical to SEQ ID NO: 86225

SEQ ID NO: 182455 - RNA, 64 nt, Homo Sapiens; identical to SEQ ID NO: 86226

SEQ ID NO: 182456 - RNA, 64 nt, Homo Sapiens; identical to SEQ ID NO: 86227

SEQ ID NO: 182457 - RNA, 64 nt, Homo Sapiens; identical to SEQ ID NO: 86228

SEQ ID NO: 182458 - RNA, 64 nt, Homo Sapiens; identical to SEQ ID NO: 86229

SEQ ID NO: 182459 - RNA, 64 nt, Homo Sapiens; identical to SEQ ID NO: 86230

SEQ ID NO: 182460 - RNA, 64 nt, Homo Sapiens; identical to SEQ ID NO: 86231

SEQ ID NO: 182461 - RNA, 64 nt, Homo Sapiens; identical to SEQ ID NO: 86232

SEQ ID NO: 182462 - RNA, 64 nt, Homo Sapiens; identical to SEQ ID NO: 86233

SEQ ID NO: 182463 - RNA, 64 nt, Homo Sapiens; identical to SEQ ID NO: 86234

SEQ ID NO: 182464 - RNA, 64 nt, Homo Sapiens; identical to SEQ ID NO: 86235

SEQ ID NO: 182465 - RNA, 64 nt, Homo Sapiens; identical to SEQ ID NO: 86236

SEQ ID NO: 182466 - RNA, 64 nt, Homo Sapiens; identical to SEQ ID NO: 86237

SEQ ID NO: 182467 - RNA, 64 nt, Homo Sapiens; identical to SEQ ID NO: 86238

SEQ ID NO: 182468 - RNA, 64 nt, Homo Sapiens; identical to SEQ ID NO: 86239

SEQ ID NO: 182469 - RNA, 64 nt, Homo Sapiens; identical to SEQ ID NO: 86240

SEQ ID NO: 182470 - RNA, 64 nt, Homo Sapiens; identical to SEQ ID NO: 86241

SEQ ID NO: 182471 - RNA, 64 nt, Homo Sapiens; identical to SEQ ID NO: 86242

SEQ ID NO: 182472 - RNA, 64 nt, Homo Sapiens; identical to SEQ ID NO: 86243

SEQ ID NO: 182473 - RNA, 64 nt, Homo Sapiens; identical to SEQ ID NO: 86244

SEQ ID NO: 182474 - RNA, 64 nt, Homo Sapiens; identical to SEQ ID NO: 86245

SEQ ID NO: 182475 - RNA, 64 nt, Homo Sapiens; identical to SEQ ID NO: 86246

SEQ ID NO: 182476 - RNA, 64 nt, Homo Sapiens; identical to SEQ ID NO: 86247

SEQ ID NO: 182477 - RNA, 64 nt, Homo Sapiens; identical to SEQ ID NO: 86248

SEQ ID NO: 182478 - RNA, 64 nt, Homo Sapiens; identical to SEQ ID NO: 86249

SEQ ID NO: 182479 - RNA, 64 nt, Homo Sapiens; identical to SEQ ID NO: 86250

SEQ ID NO: 182480 - RNA, 64 nt, Homo Sapiens; identical to SEQ ID NO: 86251

SEQ ID NO: 182481 - RNA, 64 nt, Homo Sapiens; identical to SEQ ID NO: 86252

SEQ ID NO: 182482 - RNA, 64 nt, Homo Sapiens; identical to SEQ ID NO: 86253

SEQ ID NO: 182483 - RNA, 64 nt, Homo Sapiens; identical to SEQ ID NO: 86254

SEQ ID NO: 182484 - RNA, 64 nt, Homo Sapiens; identical to SEQ ID NO: 86255

SEQ ID NO: 182485 - RNA, 64 nt, Homo Sapiens; identical to SEQ ID NO: 86256

SEQ ID NO: 182486 - RNA, 55 nt, Homo Sapiens; identical to SEQ ID NO: 86257

SEQ ID NO: 182487 - RNA, 64 nt, Homo Sapiens; identical to SEQ ID NO: 86258

SEQ ID NO: 182488 - RNA, 64 nt, Homo Sapiens; identical to SEQ ID NO: 86259

SEQ ID NO: 182489 - RNA, 64 nt, Homo Sapiens; identical to SEQ ID NO: 86260

SEQ ID NO: 182490 - RNA, 64 nt, Homo Sapiens; identical to SEQ ID NO: 86261

SEQ ID NO: 182491 - RNA, 64 nt, Homo Sapiens; identical to SEQ ID NO: 86262

SEQ ID NO: 182492 - RNA, 64 nt, Homo Sapiens; identical to SEQ ID NO: 86263

SEQ ID NO: 182493 - RNA, 64 nt, Homo Sapiens; identical to SEQ ID NO: 86264

SEQ ID NO: 182494 - RNA, 64 nt, Homo Sapiens; identical to SEQ ID NO: 86265

SEQ ID NO: 182495 - RNA, 64 nt, Homo Sapiens; identical to SEQ ID NO: 86266

SEQ ID NO: 182496 - RNA, 64 nt, Homo Sapiens; identical to SEQ ID NO: 86267

SEQ ID NO: 182497 - RNA, 64 nt, Homo Sapiens; identical to SEQ ID NO: 86268

SEQ ID NO: 182498 - RNA, 64 nt, Homo Sapiens; identical to SEQ ID NO: 86269

SEQ ID NO: 182499 - RNA, 64 nt, Homo Sapiens; identical to SEQ ID NO: 86270

SEQ ID NO: 182500 - RNA, 64 nt, Homo Sapiens; identical to SEQ ID NO: 86271

SEQ ID NO: 182501 - RNA, 64 nt, Homo Sapiens; identical to SEQ ID NO: 86272

SEQ ID NO: 182502 - RNA, 64 nt, Homo Sapiens; identical to SEQ ID NO: 86273

SEQ ID NO: 182503 - RNA, 64 nt, Homo Sapiens; identical to SEQ ID NO: 86274

SEQ ID NO: 182504 - RNA, 64 nt, Homo Sapiens; identical to SEQ ID NO: 86275

SEQ ID NO: 182505 - RNA, 64 nt, Homo Sapiens; identical to SEQ ID NO: 86276

SEQ ID NO: 182506 - RNA, 64 nt, Homo Sapiens; identical to SEQ ID NO: 86277

SEQ ID NO: 182507 - RNA, 64 nt, Homo Sapiens; identical to SEQ ID NO: 86278

SEQ ID NO: 182508 - RNA, 64 nt, Homo Sapiens
uuuuauaaggaauuuuguacuaaccagguggcaucuaccccauguggaugggggccgagugagg

SEQ ID NO: 182509 - RNA, 64 nt, Homo Sapiens
caccaagugcgccacauggcaacaacuaccugcccuaccccaucccuucgauuuccucaaagac

SEQ ID NO: 182510 - RNA, 64 nt, Homo Sapiens
gaccuuaaacagaaacaguaguuggcuccaagagcuaccccagauccuaccccaucuauucucu

SEQ ID NO: 182511 - RNA, 64 nt, Homo Sapiens
uauucucuguuggcuccaagcaggaucccuauuccuaccccaucaaaauccaaagggauagggc

SEQ ID NO: 182512 - RNA, 64 nt, Homo Sapiens
auuugugcuggguaaaagaggagagcugugcuuucuaccccaaaguuguugguaauggagccgg

SEQ ID NO: 182513 - RNA, 64 nt, Homo Sapiens
agaaaacauguuuaagauaaaauacaaacuuuaccuaccccaaauucauaaaguacauuuagug

SEQ ID NO: 182514 - RNA, 64 nt, Homo Sapiens
aggggcccuccccagugccguggcugcucuggggcuaccccaggugaacagagguggugagaug

SEQ ID NO: 182515 - RNA, 64 nt, Homo Sapiens
gaucucugggcugauuucugguuggggucugcuccuaccccaccccauuuaacaaugugaagug

SEQ ID NO: 182516 - RNA, 64 nt, Homo Sapiens
acgcaugcagggcccccaugcacaggagcguguacuaccccaggcaggaugcaugcagggcccc

SEQ ID NO: 182517 - RNA, 64 nt, Homo Sapiens
augcaugcagggcccccacacacaggagcguguacuaccccaggcaggacgcaugcagggcccc

SEQ ID NO: 182518 - RNA, 64 nt, Homo Sapiens
acgcaugcagggcccccacacacaggagcguguacuaccccaggccggacgcaugcagggcccc

SEQ ID NO: 182519 - RNA, 64 nt, Homo Sapiens
acgcaugcagggcccccacacacuggagcguguacuaccccaggcaggacgcaugcagggcccc

SEQ ID NO: 182520 - RNA, 64 nt, Homo Sapiens
acgcaugcagggcccccacucacaggagcguguacuaccccaggcagaacgcaugcagggcccc

SEQ ID NO: 182521 - RNA, 64 nt, Homo Sapiens
acgcaugcagggcccccacacacaggagcguguacuaccccagacuggacgcaugcagggcccc

SEQ ID NO: 182522 - RNA, 64 nt, Homo Sapiens
cugacugucuaccgacaaagacacacacacaccccuaccccacaguguauacacacacacacac

SEQ ID NO: 182523 - RNA, 64 nt, Homo Sapiens
ugaaacuggaagugcaugagcugagucagaagagcuaccccaggcucuaaugagagggcauggc

SEQ ID NO: 182524 - RNA, 64 nt, Homo Sapiens
uaaaaggugcuccuuugccucagcaagcucucuccuaccccaggcugcguggaggaagcccacc

SEQ ID NO: 182525 - RNA, 64 nt, Homo Sapiens
gagagcacagcagaggacgacugguucaggaccucuaccccagcaccugcuugcccucauccuc

SEQ ID NO: 182526 - RNA, 64 nt, Homo Sapiens
aggugggaauaccacucccuccggacuauagacacuaccccaucaacuggaugcacugucgucc

SEQ ID NO: 182527 - RNA, 64 nt, Homo Sapiens
ccaaucaaggguuuguuuacacugacuucagcagcuaccccaaaagugggacgagcuagcccga

SEQ ID NO: 182528 - RNA, 64 nt, Homo Sapiens
ccuggauccacaggggcuaugcauugcuagccuucuaccccaucugccccucccugcucuggga

SEQ ID NO: 182529 - RNA, 64 nt, Homo Sapiens
gagcacuucuuuuugagggacagcaaggagcaugcuaccccagugccacggugacuguccugga

SEQ ID NO: 182530 - RNA, 64 nt, Homo Sapiens
cucugaaaagacugggggauaugaaaucuucccccuaccccacuuaaugcguuggauaugauuu

SEQ ID NO: 182531 - RNA, 64 nt, Homo Sapiens
cucagaggaggaaucguggaaaacaagagcaaaacuaccccacaccccuauuucaugucugaaa

SEQ ID NO: 182532 - RNA, 64 nt, Homo Sapiens
gugggugugggccucugaauaaaccauaccuaaccuaccccaguccgggggccuguggcuaagu

SEQ ID NO: 182533 - RNA, 64 nt, Homo Sapiens
acuuuuaacucuuccaggacccacggggccagggcuaccccagaucccucaucucuaacugccc

SEQ ID NO: 182534 - RNA, 64 nt, Homo Sapiens
caagaacagcagguaugugggcaaggcccacagacuaccccacuaggaauggccuuucuacaaa

SEQ ID NO: 182535 - RNA, 64 nt, Homo Sapiens
gccagucgucuucugccacagaaguuacuagagucuaccccaucaugcucccauaccccuguag

SEQ ID NO: 182536 - RNA, 64 nt, Homo Sapiens
ucaguggaaaauccagcacaccaagcaccagucuucuucugaggcaaaagaaaaguguugucau

SEQ ID NO: 182537 - RNA, 64 nt, Homo Sapiens
caucauuuuuauuggaagaguauuaacuggugccucuucugaaacacaccaacccauauuccuc

SEQ ID NO: 182538 - RNA, 64 nt, Homo Sapiens
cagugucuucucagaaaccaccaaccuugaagugucuucugagaaaccaccaggcuugaaggua

SEQ ID NO: 182539 - RNA, 64 nt, Homo Sapiens
agaaaacaaggauggagaaaaaucuaggacagugucuucugagaaaccaccaggcuugaaggua

SEQ ID NO: 182540 - RNA, 64 nt, Homo Sapiens
ccuccaaacuguuccagccuacauuuuccuguuuucuucugagcaggaaguuccaaacuuuccc

SEQ ID NO: 182541 - RNA, 64 nt, Homo Sapiens
acuaggcggagguuuccaaaggcauuuccauacaucuucugaaaaacguuugccugggcauuga

SEQ ID NO: 182542 - RNA, 64 nt, Homo Sapiens
ccuugggcaacuccuuucccuaugagaagcuggcucuucugaguccagggccaacgccaacugg

SEQ ID NO: 182543 - RNA, 64 nt, Homo Sapiens
guuugauguacucugggagaguaauucuaucuccucuucugauaguuggggaaacugaggccuu

SEQ ID NO: 182544 - RNA, 64 nt, Homo Sapiens
acuuuuugugaaaaugguggucauucaacuugaaucuucugaggcccaaaguuuaaaaauaugc

SEQ ID NO: 182545 - RNA, 64 nt, Homo Sapiens
acuccaaagggaaauuucagagcggcaccugccaucuucugaaacuguuuuagagcauagaaga

SEQ ID NO: 182546 - RNA, 64 nt, Homo Sapiens
agauugaaaugaagagaaauagccagcaggugauucuucugaauccuuuagugugaugguuucc

SEQ ID NO: 182547 - RNA, 64 nt, Homo Sapiens
agucaugaaccacaaaucacugugauuaaaauuuucuucugaucguaauccacgaaugcauuca

SEQ ID NO: 182548 - RNA, 64 nt, Homo Sapiens
accagauccauauaaggugaaugugaaaugggagucuucugagggugauuuguacuuuccaugu

SEQ ID NO: 182549 - RNA, 64 nt, Homo Sapiens
uuaugagaaaacuccgaagaggugugagcaggauucuucugaaugacugucuggaugguucauu

SEQ ID NO: 182550 - RNA, 64 nt, Homo Sapiens
ugaacugugccgacuccacaaaacgauuauguacucuucugagauagaagaugcuguucuucug

SEQ ID NO: 182551 - RNA, 64 nt, Homo Sapiens
cgauuauguacucuucugagauagaagaugcuguucuucugagagauacguuacucucuccuug

SEQ ID NO: 182552 - RNA, 64 nt, Homo Sapiens
ugccaugccggaaugugggccuaguguugccagaucuucugauuuuucgaaagaaacuagaaug

SEQ ID NO: 182553 - RNA, 64 nt, Homo Sapiens
gaaagaaacuagaaugcuggauucuuaagugauaucuucugauuuuuuaaaugauagcaccuaa

SEQ ID NO: 182554 - RNA, 64 nt, Homo Sapiens
cugcugcucacugucauagcguuuggguuucuucucuucugauuugaccgcugagccaggcugg

SEQ ID NO: 182555 - RNA, 64 nt, Homo Sapiens
ucuaagaagacugcagcaaguggaaaccugguucucuucugacacgaagccccagugcucugcc

SEQ ID NO: 182556 - RNA, 64 nt, Homo Sapiens
ucagauaacucaguacagauugaccugcaucaagucuucugaucgugcuaaugugaauuuuaaa

SEQ ID NO: 182557 - RNA, 64 nt, Homo Sapiens
uaagacaugucaauauucuucacuuuauaguuauucuucugaacagggcauaaaagcaaaucaa

SEQ ID NO: 182558 - RNA, 64 nt, Homo Sapiens
ucccagcaaugacucaggcacauccugcuauuuaucuucugaguaaccgacaaaguuacgaggc

SEQ ID NO: 182559 - RNA, 64 nt, Homo Sapiens
uuuuucugccagugucuuguaaggcuuggaguuuucuucugaggcuuucuccuuuccuucucca

SEQ ID NO: 182560 - RNA, 64 nt, Homo Sapiens
guucaauuuuuuucauugaacuaucucaggaauuucuucugaauaguggcccaugucacaaacc

SEQ ID NO: 182561 - RNA, 64 nt, Homo Sapiens
agaucacuuucucaguuuucauaaguauuaugucucuucugagcuauuucaucuauuuuuggca

SEQ ID NO: 182562 - RNA, 64 nt, Homo Sapiens
aagauugaaguauuuugcuggaauaaguucaaauucuucugaacucaaacugaggaauuucacc

SEQ ID NO: 182563 - RNA, 64 nt, Homo Sapiens
guggaaauuuuuaguacauauauuuuaaucaggaucuucugauauugaguuuuauguauuucuu

SEQ ID NO: 182564 - RNA, 64 nt, Homo Sapiens
ugaaacaaauaaucacauuggugggacccauagaucuucugaaaggagacacguguggcgggca

SEQ ID NO: 182565 - RNA, 64 nt, Homo Sapiens
cucaccaaacugaggccagauuuauugcugggagucuucugaacugaucauccaagaaauacuu

SEQ ID NO: 182566 - RNA, 64 nt, Homo Sapiens
ucucaaaugaguggaggccuccagggucccugaaucuucugaaagugcucccccucccuaagcu

SEQ ID NO: 182567 - RNA, 64 nt, Homo Sapiens
aggaaguuccaaacuuucccacauuuuccugucuucuucugagcccuucaaacuguuccaaccu

SEQ ID NO: 182568 - RNA, 64 nt, Homo Sapiens
uagguuuucccuguaguucuuccuuuauagcuuuucuucugauaaccaugacuucaggagcuuu

SEQ ID NO: 182569 - RNA, 64 nt, Homo Sapiens
cuggagccugaauacauuuugcuuggaaagucucucuucugaaccuuagugaauuuugucuccu

SEQ ID NO: 182570 - RNA, 64 nt, Homo Sapiens
gcaggagcagugauaguuggccacguaucaacaaucuucugacauuggcagcaacucuccuggg

SEQ ID NO: 182571 - RNA, 64 nt, Homo Sapiens
uaaggauuuuagaugauaaggcuacaauucagaaucuucugaaccaucuauguaaugaaugggg

SEQ ID NO: 182572 - RNA, 64 nt, Homo Sapiens
cccugcuuacauugaaaagucuuuuucccuuagcucuucugacuggauuuuucuacaaaaacua

SEQ ID NO: 182573 - RNA, 64 nt, Homo Sapiens
uguaauacauaucacaaaaaggucucaacaccuuucuucugaacgggaggugaaacgguacgau

SEQ ID NO: 182574 - RNA, 64 nt, Homo Sapiens
cacgccuguggcucaucggcaaaccugcacccucucuucugaguaccacacaggaaaagcagcg

SEQ ID NO: 182575 - RNA, 64 nt, Homo Sapiens
uccaucucucuccaucgggccucgggacccuuucucuucugaaucugcuucccugcaguuuaga

SEQ ID NO: 182576 - RNA, 64 nt, Homo Sapiens
ugggguaagacuucgagagagccugauccuggggucuucugagacuccaccaggagccggagag

SEQ ID NO: 182577 - RNA, 64 nt, Homo Sapiens
uguuguauaucuuaagcauuuggaauuuuuuuuaucuucugaaaucauauaaaaagaaugucau

SEQ ID NO: 182578 - RNA, 64 nt, Homo Sapiens
ugcauggugucucggugcauggggaaaggcaaggucuucugagcucaucuuaacuggugaggca

SEQ ID NO: 182579 - RNA, 64 nt, Homo Sapiens
caaauaggacucaaaguuggauauuugggauuuuucuucugacaguauaauuuauugaguuacu

SEQ ID NO: 182580 - RNA, 64 nt, Homo Sapiens
augaaaaucuacuuguuuaggcuuuuauuuauacucuucugauuuauauuuuuuauuauaauua

SEQ ID NO: 182581 - RNA, 64 nt, Homo Sapiens
cacccuucauugaucagaaaugaguucucucuucucuucugagcuguacuauuaaacucuuuuc

SEQ ID NO: 182582 - RNA, 64 nt, Homo Sapiens
ccauuaucuuucacauacagguaucaucuuggacucuucugagucacuuaggguaggaacuucg

SEQ ID NO: 182583 - RNA, 64 nt, Homo Sapiens; identical to SEQ ID NO: 182579

SEQ ID NO: 182584 - RNA, 64 nt, Homo Sapiens
augaaaaucuacuuguuuagacuuuuauuuauacucuucugauuuauauuuuuuauuauaauua

SEQ ID NO: 182585 - RNA, 64 nt, Homo Sapiens
gacagcaagaauucuuauuucccaagacuauuguaacacauaaaagaccaacagauuuucccaa

SEQ ID NO: 182586 - RNA, 64 nt, Homo Sapiens
uauauguucacuuauuuguggaacaugacacccgaacacauacaacauaaaccuaaaagcauuu

SEQ ID NO: 182587 - RNA, 64 nt, Homo Sapiens
caguguucaguauuauugaaauaugggcaucugcaacacauacccccuauuauuucuaccucuu

SEQ ID NO: 182588 - RNA, 64 nt, Homo Sapiens
uucagaucugaaguagacgauaggaauguggaagaacacauacauagugcuuaagaaauacauu

SEQ ID NO: 182589 - RNA, 64 nt, Homo Sapiens
cagauuucuggugguuucugcccugcagaugucuaacacauaagccaggacauucugcugugag

SEQ ID NO: 182590 - RNA, 64 nt, Homo Sapiens
ugcaaugaaaaaaauggauacauuaggagcuucaaacacauauaauuucucaagaaauuuccag

SEQ ID NO: 182591 - RNA, 64 nt, Homo Sapiens
aaagccacugcuuuuaacaucccauuguacauuuaacacauaaaugguguuaacaucccauugu

SEQ ID NO: 182592 - RNA, 64 nt, Homo Sapiens
cacauaaaugguguuaacaucccauuguacauuuaacacauaaauggccauugucuuugucuca

SEQ ID NO: 182593 - RNA, 64 nt, Homo Sapiens
aucuguuguuuguuuccuauaagaugcuuugcugaacacauagcaaaauucaugugacggauga

SEQ ID NO: 182594 - RNA, 64 nt, Homo Sapiens
ucacacaagccaaccaugucaugccagaguacaaaacacauaguucuuuccccgccccgaaugu

SEQ ID NO: 182595 - RNA, 64 nt, Homo Sapiens
cagccaguagauugucugucagugaccuucuguaguaauaaaguuuuugccacuguaaauaaaa

SEQ ID NO: 182596 - RNA, 64 nt, Homo Sapiens
uguuaacuuuuuauauuaaugacuauugaaagugguaauaaaaauuuauauuauaggcuucaau

SEQ ID NO: 182597 - RNA, 64 nt, Homo Sapiens
cguuuggccaggcaccaugguuaauguaauauuuguaauaaaaauaacaguugugagcuuuagu

SEQ ID NO: 182598 - RNA, 64 nt, Homo Sapiens
cccaaaacuaucauguugauuuugauaaauuuuaguaauaaauucaacuucauuccuugccugc

SEQ ID NO: 182599 - RNA, 64 nt, Homo Sapiens
aaaauugaccucaaaagaaaaggagaggacaaguguaauaaaucuguuauuacugaggaaaggg

SEQ ID NO: 182600 - RNA, 64 nt, Homo Sapiens
ccaauacaaguuacauacauaucauauucuaaaaguaauaaauucuaagauuuccuuuggcaau

SEQ ID NO: 182601 - RNA, 64 nt, Homo Sapiens
uuggcuccugucucuagcccaaaacuuagaaaugguaauaaaucaggaaaacaauagaacucau

SEQ ID NO: 182602 - RNA, 64 nt, Homo Sapiens
uaggaaaacaauagaacucauacagcuaacgcugguaauaaaggcuuuuuucuagaauccucau

SEQ ID NO: 182603 - RNA, 64 nt, Homo Sapiens
gguguuauuccaagggaauauugccaaugcuacaguaauaaaugaaugucacuucuggauauag

SEQ ID NO: 182604 - RNA, 64 nt, Homo Sapiens
gcaaaguagaucaugcauagagugugauguauguguaauaaauauguuucacacaaacaaggcc

SEQ ID NO: 182605 - RNA, 64 nt, Homo Sapiens
uguggaaguaauuggaucuguaauaaacugaacaguaauaaaacaauuaggcuugucagguuag

SEQ ID NO: 182606 - RNA, 64 nt, Homo Sapiens
gaacaguaauaaaacuguggggcuugucagguuaguaauaaacuagugaaauguuacccaauua

SEQ ID NO: 182607 - RNA, 64 nt, Homo Sapiens
ugcacaacauaaaauguuuauuucaaaaguaaauguaauaaaaacuaaccuucuaacaacuauc

SEQ ID NO: 182608 - RNA, 64 nt, Homo Sapiens
acuacuguugauguaguuuuggaauuuccaacuaguaauaaacagacauucauuugugugcccu

SEQ ID NO: 182609 - RNA, 64 nt, Homo Sapiens
guugaguuuguccauugcuagggagagacuuccaguaauaaaauuuacuauucuagaugcuucu

SEQ ID NO: 182610 - RNA, 64 nt, Homo Sapiens
auaaucuugguuauaagggaguuaaaacaaugcuguaauaaauaaagugcuucaugugaucaaa

SEQ ID NO: 182611 - RNA, 64 nt, Homo Sapiens
gcucagauuuuacucaacauuagagaguuaguacguaauaaaagcauuauaaaugcaauuuuug

SEQ ID NO: 182612 - RNA, 64 nt, Homo Sapiens
uaguaguauaucauuuuacuauuuguacuuuuauguaauaaaaugcaauguguuuaaaaauuuu

SEQ ID NO: 182613 - RNA, 64 nt, Homo Sapiens
cagggaauuuguauuggagaaaaacccugcaaauguaauaaauauggaaaaacauuuuuucaaa

SEQ ID NO: 182614 - RNA, 64 nt, Homo Sapiens
aaauuaauuaucauuuuguugauugugcuuuuauguaauaaaaugcaguacuuuaaaacauuua

SEQ ID NO: 182615 - RNA, 64 nt, Homo Sapiens
uuuuuaaaaucuccuuucuauucuagaaacaaauguaauaaauacaauuuuuauuuucuaugau

SEQ ID NO: 182616 - RNA, 64 nt, Homo Sapiens
uuauuuguauuuuuaaguuugauuucaaaucuuuguaauaaaaauuaguucagacucauauaug

SEQ ID NO: 182617 - RNA, 64 nt, Homo Sapiens
cugauugcauuuccucucauuaacaauuggguguguaauaaaaagcauuguacuucaucuuaaa

SEQ ID NO: 182618 - RNA, 64 nt, Homo Sapiens
gagacagggacucuuuuuggaucucuauugacaaguaauaaaagucuggcccucauaacuuguu

SEQ ID NO: 182619 - RNA, 64 nt, Homo Sapiens
aaggauggcauaaaauaaucauuuuugaaccuguguaauaaagcuugaaagcagggaaaagaau

SEQ ID NO: 182620 - RNA, 64 nt, Homo Sapiens
gcauuauugggugccuuuguuuguaaaccaaaaaguaauaaaugaaucccuauauuuccauuau

SEQ ID NO: 182621 - RNA, 64 nt, Homo Sapiens
uucccugggaaaaccuucagcugcuuuauuuuuaguaauaaauuucucuugucaauucuguuua

SEQ ID NO: 182622 - RNA, 64 nt, Homo Sapiens
uugaggacaacacaaaugggauugguacuuuauaguaauaaaucugaccagcagagggagggau

SEQ ID NO: 182623 - RNA, 64 nt, Homo Sapiens
auuaguaguuuaaacaauuuuuuuauuuguauuaguaauaaaacaaucuguauaaaugugaaau

SEQ ID NO: 182624 - RNA, 64 nt, Homo Sapiens
ucugcaccuaauccccauaauacugcuguauaagguaauaaaacuguuuuauuguaaucauaaa

SEQ ID NO: 182625 - RNA, 64 nt, Homo Sapiens
cugcauuuaagcaguaccaagacugaaaaaaaagguaauaaaugaaauguuuugaaauauacuu

SEQ ID NO: 182626 - RNA, 64 nt, Homo Sapiens
cuggauucuaaguaguugccaucuugaauccuuuguaauaaagccauacuuuugugugugugug

SEQ ID NO: 182627 - RNA, 64 nt, Homo Sapiens
aauauuaacuugguuucuugagauguggggagauguaauaaaacaugcguaaaguaauauuuac

SEQ ID NO: 182628 - RNA, 64 nt, Homo Sapiens
ugcuggauaaauauuaguccuuacggauauuuuaguaauaaauagcaucugcucuuuuuuuuuu

SEQ ID NO: 182629 - RNA, 64 nt, Homo Sapiens
ugaaagaccaacauuuuaacauuuuaaugggaggguaauaaagaagugagucccgguuuguuuc

SEQ ID NO: 182630 - RNA, 64 nt, Homo Sapiens
aaucuaaucaaagaauauuaauggaaaaaauguuguaauaaaauugcacaggaaaugacuggua

SEQ ID NO: 182631 - RNA, 64 nt, Homo Sapiens
caccaguacuaaaaaaacuguugucaaagaggauguaauaaauuguaguaauaaauaugaccac

SEQ ID NO: 182632 - RNA, 64 nt, Homo Sapiens
aaaacuguugucaaagaggauguaauaaauuguaguaauaaauaugaccacaagccauaaauga

SEQ ID NO: 182633 - RNA, 64 nt, Homo Sapiens
aggaaaugacagaugugacuuuggaaccaaacuuguaauaaaaggaauuccaaauggacaagca

SEQ ID NO: 182634 - RNA, 64 nt, Homo Sapiens
guuugucauguauugacuuuaauauuguauuuugguaauaaauuuuuuguuaaaaaaaacuugg

SEQ ID NO: 182635 - RNA, 64 nt, Homo Sapiens
gcaguacauuuuuaaauuuuauuuguacuuuuauguaauaaaauaauuaguacguuauuuuacu

SEQ ID NO: 182636 - RNA, 64 nt, Homo Sapiens
ugaaaaaaaaguuuuccaaaaaaacccugcaaauguaauaaauucagggaauucagauuggaga

SEQ ID NO: 182637 - RNA, 64 nt, Homo Sapiens
ucucaaggaauuugcauucuagaaaguagaagauguaauaaauguacugugggacauguuaaua

SEQ ID NO: 182638 - RNA, 64 nt, Homo Sapiens
auggaagaauucaaauauaaauaaaaaauugugaguaauaaaaugaacucacaguuucaacaau

SEQ ID NO: 182639 - RNA, 64 nt, Homo Sapiens
gguggcaucuucaccugaauucuucaaugccaggguaauaaaccaaaauaguccuaaucaguau

SEQ ID NO: 182640 - RNA, 64 nt, Homo Sapiens
uuaaaaaggucaucuuagauuuaucuuaguaaauguaauaaauuauuuuuuagaucuugaaauu

SEQ ID NO: 182641 - RNA, 64 nt, Homo Sapiens
gaugauggauuuuauuucacucacacuccaguuuguaauaaaaugccaaauucugucagcuauc

SEQ ID NO: 182642 - RNA, 64 nt, Homo Sapiens
cuuucuaagaugcugcgaucccguucugcugcccguaauaaaaaugcucucagacacugguuag

SEQ ID NO: 182643 - RNA, 64 nt, Homo Sapiens
aaauuuauacaaaguuucaguuuuaguauuuacaguaauaaauauuaagguguuuucaauguga

SEQ ID NO: 182644 - RNA, 64 nt, Homo Sapiens
uaauauucuguuuuauacuaguguccguuugccaguaauaaauuauuucaaaggaaauaaauca

SEQ ID NO: 182645 - RNA, 64 nt, Homo Sapiens; identical to SEQ ID NO: 45886

SEQ ID NO: 182646 - RNA, 64 nt, Homo Sapiens; identical to SEQ ID NO: 45887

SEQ ID NO: 182647 - RNA, 64 nt, Homo Sapiens; identical to SEQ ID NO: 45888

SEQ ID NO: 182648 - RNA, 64 nt, Homo Sapiens; identical to SEQ ID NO: 45889

SEQ ID NO: 182649 - RNA, 64 nt, Homo Sapiens; identical to SEQ ID NO: 45890

SEQ ID NO: 182650 - RNA, 64 nt, Homo Sapiens; identical to SEQ ID NO: 45891

SEQ ID NO: 182651 - RNA, 64 nt, Homo Sapiens; identical to SEQ ID NO: 45892

SEQ ID NO: 182652 - RNA, 64 nt, Homo Sapiens; identical to SEQ ID NO: 45893

SEQ ID NO: 182653 - RNA, 64 nt, Homo Sapiens; identical to SEQ ID NO: 45894

SEQ ID NO: 182654 - RNA, 64 nt, Homo Sapiens; identical to SEQ ID NO: 45895

SEQ ID NO: 182655 - RNA, 64 nt, Homo Sapiens; identical to SEQ ID NO: 45896

SEQ ID NO: 182656 - RNA, 64 nt, Homo Sapiens; identical to SEQ ID NO: 45897

SEQ ID NO: 182657 - RNA, 64 nt, Homo Sapiens; identical to SEQ ID NO: 45898

SEQ ID NO: 182658 - RNA, 64 nt, Homo Sapiens; identical to SEQ ID NO: 45899

SEQ ID NO: 182659 - RNA, 64 nt, Homo Sapiens; identical to SEQ ID NO: 45900

SEQ ID NO: 182660 - RNA, 64 nt, Homo Sapiens; identical to SEQ ID NO: 45901

SEQ ID NO: 182661 - RNA, 64 nt, Homo Sapiens; identical to SEQ ID NO: 45902

SEQ ID NO: 182662 - RNA, 64 nt, Homo Sapiens; identical to SEQ ID NO: 45903

SEQ ID NO: 182663 - RNA, 64 nt, Homo Sapiens; identical to SEQ ID NO: 45904

SEQ ID NO: 182664 - RNA, 64 nt, Homo Sapiens; identical to SEQ ID NO: 45905

SEQ ID NO: 182665 - RNA, 64 nt, Homo Sapiens; identical to SEQ ID NO: 45906

SEQ ID NO: 182666 - RNA, 64 nt, Homo Sapiens; identical to SEQ ID NO: 45907

SEQ ID NO: 182667 - RNA, 64 nt, Homo Sapiens; identical to SEQ ID NO: 45908

SEQ ID NO: 182668 - RNA, 64 nt, Homo Sapiens; identical to SEQ ID NO: 45909

SEQ ID NO: 182669 - RNA, 64 nt, Homo Sapiens; identical to SEQ ID NO: 45910

SEQ ID NO: 182670 - RNA, 64 nt, Homo Sapiens; identical to SEQ ID NO: 45911

SEQ ID NO: 182671 - RNA, 64 nt, Homo Sapiens; identical to SEQ ID NO: 45912

SEQ ID NO: 182672 - RNA, 64 nt, Homo Sapiens; identical to SEQ ID NO: 45913

SEQ ID NO: 182673 - RNA, 64 nt, Homo Sapiens; identical to SEQ ID NO: 45914

SEQ ID NO: 182674 - RNA, 64 nt, Homo Sapiens; identical to SEQ ID NO: 45915

SEQ ID NO: 182675 - RNA, 64 nt, Homo Sapiens; identical to SEQ ID NO: 45916

SEQ ID NO: 182676 - RNA, 64 nt, Homo Sapiens; identical to SEQ ID NO: 45917

SEQ ID NO: 182677 - RNA, 64 nt, Homo Sapiens; identical to SEQ ID NO: 45918

SEQ ID NO: 182678 - RNA, 64 nt, Homo Sapiens; identical to SEQ ID NO: 45919

SEQ ID NO: 182679 - RNA, 64 nt, Homo Sapiens; identical to SEQ ID NO: 45920

SEQ ID NO: 182680 - RNA, 64 nt, Homo Sapiens; identical to SEQ ID NO: 45921

SEQ ID NO: 182681 - RNA, 64 nt, Homo Sapiens; identical to SEQ ID NO: 45922

SEQ ID NO: 182682 - RNA, 64 nt, Homo Sapiens; identical to SEQ ID NO: 45923

SEQ ID NO: 182683 - RNA, 64 nt, Homo Sapiens; identical to SEQ ID NO: 45924

SEQ ID NO: 182684 - RNA, 64 nt, Homo Sapiens; identical to SEQ ID NO: 45925

SEQ ID NO: 182685 - RNA, 64 nt, Homo Sapiens; identical to SEQ ID NO: 45926

SEQ ID NO: 182686 - RNA, 64 nt, Homo Sapiens; identical to SEQ ID NO: 45927

SEQ ID NO: 182687 - RNA, 64 nt, Homo Sapiens; identical to SEQ ID NO: 45928

SEQ ID NO: 182688 - RNA, 64 nt, Homo Sapiens; identical to SEQ ID NO: 45929

SEQ ID NO: 182689 - RNA, 64 nt, Homo Sapiens; identical to SEQ ID NO: 45930

SEQ ID NO: 182690 - RNA, 64 nt, Homo Sapiens; identical to SEQ ID NO: 45931

SEQ ID NO: 182691 - RNA, 64 nt, Homo Sapiens; identical to SEQ ID NO: 45932

SEQ ID NO: 182692 - RNA, 64 nt, Homo Sapiens; identical to SEQ ID NO: 45933

SEQ ID NO: 182693 - RNA, 64 nt, Homo Sapiens; identical to SEQ ID NO: 45934

SEQ ID NO: 182694 - RNA, 64 nt, Homo Sapiens; identical to SEQ ID NO: 45935

SEQ ID NO: 182695 - RNA, 64 nt, Homo Sapiens; identical to SEQ ID NO: 45936

SEQ ID NO: 182696 - RNA, 64 nt, Homo Sapiens; identical to SEQ ID NO: 45937

SEQ ID NO: 182697 - RNA, 64 nt, Homo Sapiens; identical to SEQ ID NO: 45938

SEQ ID NO: 182698 - RNA, 64 nt, Homo Sapiens; identical to SEQ ID NO: 45939

SEQ ID NO: 182699 - RNA, 64 nt, Homo Sapiens; identical to SEQ ID NO: 45940

SEQ ID NO: 182700 - RNA, 64 nt, Homo Sapiens; identical to SEQ ID NO: 45941

SEQ ID NO: 182701 - RNA, 64 nt, Homo Sapiens; identical to SEQ ID NO: 45942

SEQ ID NO: 182702 - RNA, 64 nt, Homo Sapiens; identical to SEQ ID NO: 45943

SEQ ID NO: 182703 - RNA, 64 nt, Homo Sapiens; identical to SEQ ID NO: 45944

SEQ ID NO: 182704 - RNA, 64 nt, Homo Sapiens; identical to SEQ ID NO: 45945

SEQ ID NO: 182705 - RNA, 64 nt, Homo Sapiens; identical to SEQ ID NO: 45946

SEQ ID NO: 182706 - RNA, 64 nt, Homo Sapiens; identical to SEQ ID NO: 45947

SEQ ID NO: 182707 - RNA, 64 nt, Homo Sapiens; identical to SEQ ID NO: 45948

SEQ ID NO: 182708 - RNA, 64 nt, Homo Sapiens; identical to SEQ ID NO: 45949

SEQ ID NO: 182709 - RNA, 64 nt, Homo Sapiens; identical to SEQ ID NO: 45950

SEQ ID NO: 182710 - RNA, 64 nt, Homo Sapiens; identical to SEQ ID NO: 45951

SEQ ID NO: 182711 - RNA, 64 nt, Homo Sapiens; identical to SEQ ID NO: 45952

SEQ ID NO: 182712 - RNA, 64 nt, Homo Sapiens; identical to SEQ ID NO: 45953

SEQ ID NO: 182713 - RNA, 64 nt, Homo Sapiens; identical to SEQ ID NO: 45954

SEQ ID NO: 182714 - RNA, 64 nt, Homo Sapiens; identical to SEQ ID NO: 45955

SEQ ID NO: 182715 - RNA, 64 nt, Homo Sapiens; identical to SEQ ID NO: 45956

SEQ ID NO: 182716 - RNA, 64 nt, Homo Sapiens; identical to SEQ ID NO: 45957

SEQ ID NO: 182717 - RNA, 64 nt, Homo Sapiens; identical to SEQ ID NO: 45958

SEQ ID NO: 182718 - RNA, 64 nt, Homo Sapiens; identical to SEQ ID NO: 45959

SEQ ID NO: 182719 - RNA, 64 nt, Homo Sapiens; identical to SEQ ID NO: 45960

SEQ ID NO: 182720 - RNA, 64 nt, Homo Sapiens; identical to SEQ ID NO: 45961

SEQ ID NO: 182721 - RNA, 64 nt, Homo Sapiens; identical to SEQ ID NO: 45962

SEQ ID NO: 182722 - RNA, 64 nt, Homo Sapiens; identical to SEQ ID NO: 45963

SEQ ID NO: 182723 - RNA, 64 nt, Homo Sapiens; identical to SEQ ID NO: 45964

SEQ ID NO: 182724 - RNA, 64 nt, Homo Sapiens; identical to SEQ ID NO: 45965

SEQ ID NO: 182725 - RNA, 64 nt, Homo Sapiens; identical to SEQ ID NO: 45966

SEQ ID NO: 182726 - RNA, 64 nt, Homo Sapiens; identical to SEQ ID NO: 45967

SEQ ID NO: 182727 - RNA, 64 nt, Homo Sapiens; identical to SEQ ID NO: 45968

SEQ ID NO: 182728 - RNA, 64 nt, Homo Sapiens; identical to SEQ ID NO: 45969

SEQ ID NO: 182729 - RNA, 64 nt, Homo Sapiens; identical to SEQ ID NO: 45970

SEQ ID NO: 182730 - RNA, 64 nt, Homo Sapiens; identical to SEQ ID NO: 45971

SEQ ID NO: 182731 - RNA, 64 nt, Homo Sapiens; identical to SEQ ID NO: 45972

SEQ ID NO: 182732 - RNA, 64 nt, Homo Sapiens; identical to SEQ ID NO: 45973

SEQ ID NO: 182733 - RNA, 64 nt, Homo Sapiens; identical to SEQ ID NO: 45974

SEQ ID NO: 182734 - RNA, 64 nt, Homo Sapiens; identical to SEQ ID NO: 45975

SEQ ID NO: 182735 - RNA, 64 nt, Homo Sapiens; identical to SEQ ID NO: 45976

SEQ ID NO: 182736 - RNA, 64 nt, Homo Sapiens; identical to SEQ ID NO: 45977

SEQ ID NO: 182737 - RNA, 64 nt, Homo Sapiens; identical to SEQ ID NO: 45978

SEQ ID NO: 182738 - RNA, 64 nt, Homo Sapiens; identical to SEQ ID NO: 45979

SEQ ID NO: 182739 - RNA, 64 nt, Homo Sapiens; identical to SEQ ID NO: 45980

SEQ ID NO: 182740 - RNA, 64 nt, Homo Sapiens; identical to SEQ ID NO: 45981

SEQ ID NO: 182741 - RNA, 64 nt, Homo Sapiens; identical to SEQ ID NO: 45982

SEQ ID NO: 182742 - RNA, 64 nt, Homo Sapiens; identical to SEQ ID NO: 45983

SEQ ID NO: 182743 - RNA, 64 nt, Homo Sapiens; identical to SEQ ID NO: 45984

SEQ ID NO: 182744 - RNA, 64 nt, Homo Sapiens; identical to SEQ ID NO: 45985

SEQ ID NO: 182745 - RNA, 64 nt, Homo Sapiens; identical to SEQ ID NO: 45986

SEQ ID NO: 182746 - RNA, 64 nt, Homo Sapiens; identical to SEQ ID NO: 45987

SEQ ID NO: 182747 - RNA, 64 nt, Homo Sapiens; identical to SEQ ID NO: 45988

SEQ ID NO: 182748 - RNA, 64 nt, Homo Sapiens; identical to SEQ ID NO: 45989

SEQ ID NO: 182749 - RNA, 64 nt, Homo Sapiens; identical to SEQ ID NO: 45990

SEQ ID NO: 182750 - RNA, 64 nt, Homo Sapiens; identical to SEQ ID NO: 45991

SEQ ID NO: 182751 - RNA, 64 nt, Homo Sapiens; identical to SEQ ID NO: 45992

SEQ ID NO: 182752 - RNA, 64 nt, Homo Sapiens; identical to SEQ ID NO: 45993

SEQ ID NO: 182753 - RNA, 64 nt, Homo Sapiens; identical to SEQ ID NO: 45994

SEQ ID NO: 182754 - RNA, 64 nt, Homo Sapiens; identical to SEQ ID NO: 45995

SEQ ID NO: 182755 - RNA, 64 nt, Homo Sapiens; identical to SEQ ID NO: 45996

SEQ ID NO: 182756 - RNA, 64 nt, Homo Sapiens; identical to SEQ ID NO: 45997

SEQ ID NO: 182757 - RNA, 64 nt, Homo Sapiens; identical to SEQ ID NO: 45998

SEQ ID NO: 182758 - RNA, 64 nt, Homo Sapiens; identical to SEQ ID NO: 45999

SEQ ID NO: 182759 - RNA, 64 nt, Homo Sapiens; identical to SEQ ID NO: 46000

SEQ ID NO: 182760 - RNA, 64 nt, Homo Sapiens; identical to SEQ ID NO: 46001

SEQ ID NO: 182761 - RNA, 64 nt, Homo Sapiens; identical to SEQ ID NO: 46002

SEQ ID NO: 182762 - RNA, 64 nt, Homo Sapiens; identical to SEQ ID NO: 46003

SEQ ID NO: 182763 - RNA, 64 nt, Homo Sapiens; identical to SEQ ID NO: 46004

SEQ ID NO: 182764 - RNA, 64 nt, Homo Sapiens; identical to SEQ ID NO: 46005

SEQ ID NO: 182765 - RNA, 62 nt, Homo Sapiens; identical to SEQ ID NO: 46006

SEQ ID NO: 182766 - RNA, 64 nt, Homo Sapiens; identical to SEQ ID NO: 46007

SEQ ID NO: 182767 - RNA, 64 nt, Homo Sapiens; identical to SEQ ID NO: 46008

SEQ ID NO: 182768 - RNA, 64 nt, Homo Sapiens; identical to SEQ ID NO: 46009

SEQ ID NO: 182769 - RNA, 64 nt, Homo Sapiens; identical to SEQ ID NO: 46010

SEQ ID NO: 182770 - RNA, 64 nt, Homo Sapiens; identical to SEQ ID NO: 46011

SEQ ID NO: 182771 - RNA, 64 nt, Homo Sapiens; identical to SEQ ID NO: 46012

SEQ ID NO: 182772 - RNA, 64 nt, Homo Sapiens
uugaaggguuauuuuuaauguauuuugguaauacauuuauuauuauauuuacauguacaguguu

SEQ ID NO: 182773 - RNA, 64 nt, Homo Sapiens
gcuuuacucccaaccauugaguuauuuauaauguauuuauuaggggaggguaccuugagucuau

SEQ ID NO: 182774 - RNA, 64 nt, Homo Sapiens
ggggaauccugucagguguuugguuauauugacuauuuauuaauaguauuagaacucauucccu

SEQ ID NO: 182775 - RNA, 64 nt, Homo Sapiens
aaaguauauuguuuuagaguacucaaauuguauuauuuauuaauuuuuuuguuugcaaaaucuu

SEQ ID NO: 182776 - RNA, 64 nt, Homo Sapiens
auuugagacagagucucacugggauuugguuuacauuuauuauuuuuuuaaggggaugaauggu

SEQ ID NO: 182777 - RNA, 64 nt, Homo Sapiens
cacuuuucaugcuuaaagcuuuuuuauauaaagcauuuauuaaaacacucugcaaguagaacua

SEQ ID NO: 182778 - RNA, 64 nt, Homo Sapiens
uaccugcuguaugucaaggcgucuuuugguaagcauuuauuaagccuauuuuuguccuuuuuca

SEQ ID NO: 182779 - RNA, 64 nt, Homo Sapiens
uuuagugugguuugaaauuaaaagcgaguucuauauuuauuaugguauacuguagauuuuuaac

SEQ ID NO: 182780 - RNA, 64 nt, Homo Sapiens
aaacguaaugacauaaaaggaguacauuuauuacauuuauuaaggguugggguugggagugguu

SEQ ID NO: 182781 - RNA, 64 nt, Homo Sapiens
uuuauuaagaaacguaaugaggagugguuaguacauuuauuacauacacuggggguugggguug

SEQ ID NO: 182782 - RNA, 64 nt, Homo Sapiens
uucaccuguuuuuaagcuguuaauuuuuuucaauauuuauuauuuagaaagaagcccaauauua

SEQ ID NO: 182783 - RNA, 64 nt, Homo Sapiens
ucugauaccucaacccccaucucucuuauagaauauuuauuacccuugagaaaccuuauuguac

SEQ ID NO: 182784 - RNA, 64 nt, Homo Sapiens
uuggacagagguugcugaacuuuaaaaaaaauuaauuuauuauuauaaugaccuaauuuauuaa

SEQ ID NO: 182785 - RNA, 64 nt, Homo Sapiens
uuaaaaaaaauuaauuuauuauuauaaugaccuaauuuauuaaucugaagauuaaccauuuuuu

SEQ ID NO: 182786 - RNA, 64 nt, Homo Sapiens
gguguucuagcuguuugcaucaaaggaaaaaaagauuuauuaucaaggggcaauauuuuuaucu

SEQ ID NO: 182787 - RNA, 64 nt, Homo Sapiens
ggaauuucauuugagcaauuucuauaggauauguauuuauuauugauuguuauuuaauuuuuuu

SEQ ID NO: 182788 - RNA, 64 nt, Homo Sapiens
gguacagagugauugucacauaagguacuugaagauuuauuaguuuaauucuauuuuuacagua

SEQ ID NO: 182789 - RNA, 64 nt, Homo Sapiens
cagcuagaggcagcuuuuuaaauaaugcaaguguauuuauuagcauuaaaauuaacaucucagu

SEQ ID NO: 182790 - RNA, 64 nt, Homo Sapiens
augcugacauauauguauauuaaaauaauugccuauuuauuaaucuacaaauagacaacguugg

SEQ ID NO: 182791 - RNA, 64 nt, Homo Sapiens
ugauucauguuaaauguguuuguauacacaugucauuuauuauuauuacuuuaagauagguauu

SEQ ID NO: 182792 - RNA, 64 nt, Homo Sapiens
uaaauuccaauaauaaaccaaauguauuuagaguauuuauuaguaaaugcaaggugauguuagu

SEQ ID NO: 182793 - RNA, 64 nt, Homo Sapiens
uuuuauaaagguagugaaaaaaugaaaauuugcuauuuauuaaaaaacauuaaauuucauucca

SEQ ID NO: 182794 - RNA, 64 nt, Homo Sapiens
aaagauuuauguaauagguauauauuuaguggccauuuauuaucaaugguaacacaauggagua

SEQ ID NO: 182795 - RNA, 64 nt, Homo Sapiens
aaaauuuuccaagguuagauuccaauaaauaucuauuuauuauuaaauauuaaaauaucuauuu

SEQ ID NO: 182796 - RNA, 64 nt, Homo Sapiens
aaauaucuauuuauuauuaaauauuaaaauaucuauuuauuauuaaaaccauuuauaaggcuuu

SEQ ID NO: 182797 - RNA, 64 nt, Homo Sapiens
gcuuaugugcccuguucaaacuaugggagucacuauuuauuauuacuugaaauuuuaucuuuua

SEQ ID NO: 182798 - RNA, 64 nt, Homo Sapiens
acaacgugguacuauuugccaagaaaauaauaugauuuauuagcgguuugacagaggggaacag

SEQ ID NO: 182799 - RNA, 64 nt, Homo Sapiens
agacuuuuaaggaggguggagagaaauuuuggugauuuauuagacauuccauccuguuggugca

SEQ ID NO: 182800 - RNA, 64 nt, Homo Sapiens
auguaugucucagaagauggaguacuguugauacauuuauuagauugacccuucguugacuauc

SEQ ID NO: 182801 - RNA, 64 nt, Homo Sapiens
ucaguaauaaacgugccaucucuaucucuuaaacauuuauuacaacaauuguuuuaaaauagaa

SEQ ID NO: 182802 - RNA, 64 nt, Homo Sapiens
uauaaauguaauaaggaauaucuugcucuuuaaaauuuauuaggauuuuuaugaguaauuuuua

SEQ ID NO: 182803 - RNA, 64 nt, Homo Sapiens
uaacaauguaaaaccaucuuagaaaucaucuguaauuuauuagcaguuuuagacauggcaaaau

SEQ ID NO: 182804 - RNA, 64 nt, Homo Sapiens
aaugcugcagguacauuaauaaaaaucacagaguauuuauuaccuaaugcacuucagagaaauu

SEQ ID NO: 182805 - RNA, 64 nt, Homo Sapiens
agguugaauauuuguuucuuuauacauuucaccaauuuauuaacugauaagccauuuuuaucug

SEQ ID NO: 182806 - RNA, 64 nt, Homo Sapiens
caaaaacugagaauuccuuauuugacauuaauguauuuauuaaaaaccauuucuaaguagauuu

SEQ ID NO: 182807 - RNA, 64 nt, Homo Sapiens
auuccuguugaaguucuuuugaaguccuaucucuauuuauuauauuugaaaguugucagccacc

SEQ ID NO: 182808 - RNA, 64 nt, Homo Sapiens
cuuuucuuauauggaaaaucacugaugucauaucauuuauuauccucacagcagcuggcauuca

SEQ ID NO: 182809 - RNA, 64 nt, Homo Sapiens
uuuuuacucugaugugcaauacauuuguuauuaaauuuauuauuuaagaugguagcacuagucu

SEQ ID NO: 182810 - RNA, 64 nt, Homo Sapiens
aaauaauuauggggaaauacauguuuguuauuaaauuuauuauuaaagauaguagcacuagucu

SEQ ID NO: 182811 - RNA, 64 nt, Homo Sapiens
aaaaauauuucaguuggaagaccucuugaagcuaauuuauuagaauuaaaauuaucuuugaaac

SEQ ID NO: 182812 - RNA, 64 nt, Homo Sapiens
gcauuugaauauugguaccuuuuguuauauauguauuuauuagacuauaguuacuuuuuucacu

SEQ ID NO: 182813 - RNA, 64 nt, Homo Sapiens
uauaucaacaguaguucaaguguaaugcacugcuauuuauuauaaugacuguauuugaauauuu

SEQ ID NO: 182814 - RNA, 64 nt, Homo Sapiens
uucaagggaauauugaaagguaaucuuaauucauauuuauuaaugcuacagaaguuuugugcau

SEQ ID NO: 182815 - RNA, 64 nt, Homo Sapiens
guucucccagagcgcagucaccuauguuucuuuuauuuauuaaacuagguuuguauuguacaug

SEQ ID NO: 182816 - RNA, 64 nt, Homo Sapiens
acaaaaguguuagguucccaugauuucucauuucauuuauuaauaguuaaugcugaauuuuuuu

SEQ ID NO: 182817 - RNA, 64 nt, Homo Sapiens
aaaaugucuuuuuuuuuauggcccaaagagcaguauuuauuaucuaaacuuuuuauuuauuaca

SEQ ID NO: 182818 - RNA, 64 nt, Homo Sapiens
gcccaaagagcaguauuuauuuaauaaacuuuuuauuuauuacacuggaaaagugcauuccuug

SEQ ID NO: 182819 - RNA, 64 nt, Homo Sapiens
augauuguaaaauagcuugucagcuuuacaugcaauuuauuaaaugggaagggaagggcuacug

SEQ ID NO: 182820 - RNA, 64 nt, Homo Sapiens
uaauauaucccagaaauuaggaguagauggugaaauuuauuaguaucacuuuucagugauggga

SEQ ID NO: 182821 - RNA, 64 nt, Homo Sapiens
uucauugcuuacuguaaagagaaauuucccuuuaauuuauuacacuuauccuuuuugcucuuua

SEQ ID NO: 182822 - RNA, 64 nt, Homo Sapiens
gcuuugucccauuucuuaucgaaucuucugacacauuuauuauauuaggcugucucacuugugu

SEQ ID NO: 182823 - RNA, 64 nt, Homo Sapiens
auggcauuugagauugaaacuaagaaauguuuuaauuuauuaccuuuacaacauuuauuuacau

SEQ ID NO: 182824 - RNA, 64 nt, Homo Sapiens
acauuuauuuacauuacauacauacauuuacaacauuuauuaauuuauauuaaaauagcaugaa

SEQ ID NO: 182825 - RNA, 64 nt, Homo Sapiens
ccagcucccucuauuuauguuugcacuugugauuauuuauuauuuauuuauuauuuauuuauuu

SEQ ID NO: 182826 - RNA, 64 nt, Homo Sapiens
uauuuauguuugcacuugugauuauuuauuauuuauuuauuauuuauuuauuuacagaugaaug

SEQ ID NO: 182827 - RNA, 64 nt, Homo Sapiens
auuucaacuaugaagauuuacauuucacuuucuaauuuauuaaacaucugugugccuuuuuauc

SEQ ID NO: 182828 - RNA, 64 nt, Homo Sapiens
aaaaaguauauuuaaugccuuuacaauaccuuuaauuuauuaggaucucagaaucauuguuuac

SEQ ID NO: 182829 - RNA, 64 nt, Homo Sapiens
uguacucacauacuauagaaauauauacauuuuaauuuauuauguaucuaucuauauuuaauaa

SEQ ID NO: 182830 - RNA, 64 nt, Homo Sapiens
uaaguuugaacgauguaaaagcccuuccuugagcauuuauuauugugcaauugguucuaccaag

SEQ ID NO: 182831 - RNA, 64 nt, Homo Sapiens
uucuucuugcuuuuuugguggaguucaggauuucauuuauuaauuuuuauuucuuagguuuuua

SEQ ID NO: 182832 - RNA, 64 nt, Homo Sapiens
acuuuaaaucaaauguagcauuuggcaauuuauaauuuauuacuucgugaauuacauuaaguua

SEQ ID NO: 182833 - RNA, 64 nt, Homo Sapiens
aaccaguguuucuggaugaggauaacuaugauauauuuauuaauuuuauuuuuuauauauucuu

SEQ ID NO: 182834 - RNA, 64 nt, Homo Sapiens
gaauuaucccaaguacuccauccuuguaacaaggauuuauuaguugcaggcuguggugccguuu

SEQ ID NO: 182835 - RNA, 64 nt, Homo Sapiens
ggaaguaauguuaccuauccuugauaccaugaccauuuauuagauguuuugcuauauaaauuac

SEQ ID NO: 182836 - RNA, 64 nt, Homo Sapiens
gucaagaaaaaaaaacccuuguauaaauuauuuuauuuauuauuguaauuagaucuucacaaag

SEQ ID NO: 182837 - RNA, 64 nt, Homo Sapiens
caggucuaucuuuaauuuguuauaucaucuaucaauuuauuaagucaacuaauauaucuauguc

SEQ ID NO: 182838 - RNA, 64 nt, Homo Sapiens
ugauuaucagguuguuagaucagucuuuggugauauuuauuauacccaaaaugcauuuagaaaa

SEQ ID NO: 182839 - RNA, 64 nt, Homo Sapiens
uuucugcuuuuuucuagucauuauaaucuguaguauuuauuacaaccauauuuuacacauguau

SEQ ID NO: 182840 - RNA, 64 nt, Homo Sapiens
ucagaaauuucccaugaaacacauuuuaaaugcaauuuauuauuuacaguuggaguucaaugua

SEQ ID NO: 182841 - RNA, 64 nt, Homo Sapiens
uggcggcugcacaugacaucaaauuguuuccugaauuuauuaaggaguguaaauaaagccuugu

SEQ ID NO: 182842 - RNA, 64 nt, Homo Sapiens
uuugcagcguauuucacuuuuucuguuauuuucaauuuauuacaacuugacagcuccaagcucu

SEQ ID NO: 182843 - RNA, 64 nt, Homo Sapiens
uuguaccuuaagcauuucccauacugaguuuaaaauuuauuaauauuuauuaaauguauuuucc

SEQ ID NO: 182844 - RNA, 64 nt, Homo Sapiens
uguauuuuccauacugaguuugguuuuugcuuuaauuuauuaaacuuggaucuccucagaucuu

SEQ ID NO: 182845 - RNA, 64 nt, Homo Sapiens
auaauuugcuaugacuucaguuaccaaccuacauauuuauuacuuuuaauuuaaaagaaaucuc

SEQ ID NO: 182846 - RNA, 64 nt, Homo Sapiens
aaucaaagaguuuuuuaucucauuuuuauaauuuauuuauuacuuauauguaaaauaaauguga

SEQ ID NO: 182847 - RNA, 64 nt, Homo Sapiens
uaaagcauuuuggaaaugggaagggaguaccaggauuuauuaaguauucacugcuaauuuaaaa

SEQ ID NO: 182848 - RNA, 64 nt, Homo Sapiens
aaaguguguuccaaaggcauuuaugaaaaauuacauuuauuaaaacuuauguauuuaaauuuua

SEQ ID NO: 182849 - RNA, 64 nt, Homo Sapiens
agaccaguggucuggaaacaguauaggucucaauauuuauuaugauaaauuccaucuaucagua

SEQ ID NO: 182850 - RNA, 64 nt, Homo Sapiens
uugugauuguuuuauuauugauguuguauuuguuauuuauuaaaguauaugauuauggccuaca

SEQ ID NO: 182851 - RNA, 64 nt, Homo Sapiens
guuuuguaaguaacaauaugcagcugugcauccaauuuauuauaagacaccagacugaaguaaa

SEQ ID NO: 182852 - RNA, 64 nt, Homo Sapiens
aauguuucauuguaucacaucuaugauagauugcauuuauuaaagaauauaaaaacuugcaguu

SEQ ID NO: 182853 - RNA, 64 nt, Homo Sapiens
uucaauacuuugguucuuagcagguugcacauuuauuuauuauguaucucuuuuuccaggccuc

SEQ ID NO: 182854 - RNA, 64 nt, Homo Sapiens
uuuuaaguacuuugcugaaugugugugauuugcuauuuauuaaaugauuaugaaaaauguaucu

SEQ ID NO: 182855 - RNA, 64 nt, Homo Sapiens
uuguaacuuuacaguuaaacuuggagcaauauccauuuauuauuuaagggagauuguauacaag

SEQ ID NO: 182856 - RNA, 64 nt, Homo Sapiens
ugauuuauuuuucucuguuacaucucuauuuuuuauuuauuacaaugauuuucucccuucuuuu

SEQ ID NO: 182857 - RNA, 64 nt, Homo Sapiens
uccuuuguuauuauauauuuacuacacauguugaauuuauuauuguuuauuuccaaggcaugua

SEQ ID NO: 182858 - RNA, 64 nt, Homo Sapiens
aauuacaaauauacaaaguuauuuaucuuagcacauuuauuaugugugacugcaucugauuuau

SEQ ID NO: 182859 - RNA, 64 nt, Homo Sapiens
ggaguguuguuguuucuaaacauauauuuaugucauuuauuaaguacaguucacuuaaauaaca

SEQ ID NO: 182860 - RNA, 64 nt, Homo Sapiens
cagaguuucagcuuucuucacuuaauuuggaucuauuuauuaguaaaaaacuguuguagaaauu

SEQ ID NO: 182861 - RNA, 64 nt, Homo Sapiens
gcauacagauauucuaagucuacauaacugaucuauuuauuaucuauucaacacacugccuuau

SEQ ID NO: 182862 - RNA, 64 nt, Homo Sapiens
aggccacugucuccuuuuauauauuauuauaauuauuuauuaugaagaccagugaauuacgaua

SEQ ID NO: 182863 - RNA, 64 nt, Homo Sapiens
aagcuaagcaauggaaaugcuauacguuuuugacauuuauuaaaugguaccaauaaaguauuuu

SEQ ID NO: 182864 - RNA, 64 nt, Homo Sapiens
ugauaauaaaacaauucguacuccccaaugguggauuuauuacuauuaaagaaaccagggaaaa

SEQ ID NO: 182865 - RNA, 64 nt, Homo Sapiens
accuccuaauaucauuuugugacuguaaacaauuauuuauuagcaaacaauugaucccagaagg

SEQ ID NO: 182866 - RNA, 64 nt, Homo Sapiens
aauggaagcugucuugaauuuuuuaccugcuacuauuuauuaaauugggaucuuacuaaaugca

SEQ ID NO: 182867 - RNA, 64 nt, Homo Sapiens
aaugccuuaucuuuacccuuggaaaacuaaauccauuuauuauaaaauggaugugaauauaugu

SEQ ID NO: 182868 - RNA, 64 nt, Homo Sapiens
cacacagaaguuggcugcgucaaguagaggcgacauuuauuaagugaaaaucauggaguuggga

SEQ ID NO: 182869 - RNA, 64 nt, Homo Sapiens
agagauauauacaccacaaagaaucuaauaagaaauuuauuauggagauauagcccuuaaaaug

SEQ ID NO: 182870 - RNA, 64 nt, Homo Sapiens
guuuacuaacacacuuaauguuuauauaccuaauauuuauuaugccauaucugaauuuauuaaa

SEQ ID NO: 182871 - RNA, 64 nt, Homo Sapiens
uuuauauaccuaauauuuauuaugccauaucugaauuuauuaaaaacaacacagaaaucuccug

SEQ ID NO: 182872 - RNA, 64 nt, Homo Sapiens
ccagaacagaaagaccuuacuauugcauaguagaauuuauuacuuaacacauuuucagaauaau

SEQ ID NO: 182873 - RNA, 64 nt, Homo Sapiens
auuuuuaacuuuaaacauauagguggcauuucuuauuuauuaacuucuuuaaaguuggacagga

SEQ ID NO: 182874 - RNA, 64 nt, Homo Sapiens
cacucaagaguucggaaaccagcucuuuuguaagauuuauuauucugaaagcucugacacguag

SEQ ID NO: 182875 - RNA, 64 nt, Homo Sapiens
gcagauauuggaaaaauauuuugugaaaagcuguauuuauuauaaauacuagggccaugacaua

SEQ ID NO: 182876 - RNA, 64 nt, Homo Sapiens
ugcuucuaaaacauauuucauguaaacauuguacauuuauuauuguaauauauacuauuaugca

SEQ ID NO: 182877 - RNA, 64 nt, Homo Sapiens
uccuguuaaaaaaaggaaaaaauucuaauuaaaaauuuauuaguuuuuuuuuaugugucuuggc

SEQ ID NO: 182878 - RNA, 64 nt, Homo Sapiens
uuaaugagaaugccucaggauauuuaguacauacauuuauuauuauagaaaauguaauacaauu

SEQ ID NO: 182879 - RNA, 64 nt, Homo Sapiens
aauguauuuugcuuuggguaaauugaagccaauuauuuauuacaagaauuaggguaagaacagu

SEQ ID NO: 182880 - RNA, 64 nt, Homo Sapiens
auuauuauuuuuuugguaaacuagcauuugcuguauuuauuaaaaugauaaccuagcuagauuu

SEQ ID NO: 182881 - RNA, 64 nt, Homo Sapiens
gucagagauuuguagacagucauuguauauugcaauuuauuacucucuguaugacuccuguaug

SEQ ID NO: 182882 - RNA, 64 nt, Homo Sapiens
uacagcuauauggaccuuauaaaauugauuucuuauuuauuauuagacauuacuacuaaaaggu

SEQ ID NO: 182883 - RNA, 64 nt, Homo Sapiens
auucagggacauuuuuccauuuccaaaaaauaaaauuuauuaugcuuuauaaccucuucuguau

SEQ ID NO: 182884 - RNA, 64 nt, Homo Sapiens
uucuaguuaugugcccuauaauuuguuuaacuugauuuauuaaagguacaguauuacaaagaua

SEQ ID NO: 182885 - RNA, 64 nt, Homo Sapiens
cuuuugcauguauuuguguguuuguuucccauuuauuuauuaccguugauuacuaaaacuauac

SEQ ID NO: 182886 - RNA, 64 nt, Homo Sapiens
aauguuuacaccuguauaaguuuuauugcuuauaauuuauuaagaacauacuaaauuuuuuuua

SEQ ID NO: 182887 - RNA, 64 nt, Homo Sapiens
caacuguuucccugcugaaugguaccugcccucuauuuauuagcacucuucagugacuccugcu

SEQ ID NO: 182888 - RNA, 64 nt, Homo Sapiens
gucacacucuucagugacuccacccggcucguguauuuauuacccuuggaggagagagaccccg

SEQ ID NO: 182889 - RNA, 64 nt, Homo Sapiens
uaugcauuaggugaugggacuuuuaaagguuugaauuuauuaggacacgaacuaaaaauaaaag

SEQ ID NO: 182890 - RNA, 64 nt, Homo Sapiens
gaauuacaagaaguaaaacaagugcaacuaaaucauuuauuaguuguuuuuugaaagcaguuuu

SEQ ID NO: 182891 - RNA, 64 nt, Homo Sapiens
acuucuguuaaauuugauguaacauauggucccaauuuauuaauccuguuuucuacuugagucu

SEQ ID NO: 182892 - RNA, 64 nt, Homo Sapiens
uucuacuuuagugauauacccauguauauauaccauuuauuauguuaagcuauaaauguguuaa

SEQ ID NO: 182893 - RNA, 64 nt, Homo Sapiens
ccauuuuucaauaagguauauauuuaauaauuauauuuauuaaaguauuuaaagucuuaacauu

SEQ ID NO: 182894 - RNA, 64 nt, Homo Sapiens
gugguuugaauaaaguagauaggugaaaagucuuauuuauuaaaaauucaaagguauuucauuu

SEQ ID NO: 182895 - RNA, 64 nt, Homo Sapiens
uagaaugaaugaggguacugucacagaagaguguauuuauuaugaaggauucagaauuuugcag

SEQ ID NO: 182896 - RNA, 64 nt, Homo Sapiens
auuucuuaugccuuuuaaaaauaauuuguauuaaauuuauuacuccaaagaguuguuauaaugc

SEQ ID NO: 182897 - RNA, 64 nt, Homo Sapiens
uuguagaccugccuuaugcaugcuacucgcagcuauuuauuauuguaaacuacaauauauuuag

SEQ ID NO: 182898 - RNA, 64 nt, Homo Sapiens
uaaauuuaucaagaauaaaacaaaugucauaagaauuuauuauaucguacauacaauuuggaau

SEQ ID NO: 182899 - RNA, 64 nt, Homo Sapiens
ucaagccaauucguacauacgcccuuauguuuauauuuauuaugcuacugccaauguuuaaauu

SEQ ID NO: 182900 - RNA, 64 nt, Homo Sapiens
aagaucuauagagagagauacuuguccaaauaaaauuuauuaauacuguuguggcacaaguucu

SEQ ID NO: 182901 - RNA, 64 nt, Homo Sapiens
cguauaauguaugucuggugaugaccugaaggaaauuuauuagacugauuuuuucaugcugguc

SEQ ID NO: 182902 - RNA, 64 nt, Homo Sapiens
ucugucaugugcaaaugguuguccuccaguuuguauuuauuaauuccaaagauacuaaaaaaau

SEQ ID NO: 182903 - RNA, 64 nt, Homo Sapiens
agaguuggauaaauuuucauaugauaauuucccuauuuauuagaaguaacuucaaauguguauu

SEQ ID NO: 182904 - RNA, 64 nt, Homo Sapiens
uguauccccagcuauguaugucagauuucucuguauuuauuaugcuuuuauuucuuaauuaucu

SEQ ID NO: 182905 - RNA, 64 nt, Homo Sapiens
guacauucuguggcuuauagcugcuuuguauugaauuuauuacugcuaaaagaaaauguauucu

SEQ ID NO: 182906 - RNA, 64 nt, Homo Sapiens
aaucaaagaacacucaaaauugauuuuuaaagguauuuauuagacaucagaacuauuuugcaca

SEQ ID NO: 182907 - RNA, 64 nt, Homo Sapiens
aucauauugucauuuguuuuuuuaaauuauacauauuuauuagcuauauugauagagguucaug

SEQ ID NO: 182908 - RNA, 64 nt, Homo Sapiens
uucagauaccuuaaaaguuacuuuauuuaaaagcauuuauuaaucuuagucugaaaucaaaaua

SEQ ID NO: 182909 - RNA, 64 nt, Homo Sapiens
ugcacccauaauuuucuaguaauagccacgaccaauuuauuaacagucagggccuauccuugcc

SEQ ID NO: 182910 - RNA, 64 nt, Homo Sapiens
uuauguuaacguuugcuauuuauuuaacauuuuuauuuauuaauuuuauacuauuucaacuaga

SEQ ID NO: 182911 - RNA, 64 nt, Homo Sapiens
uuucaggcacggauaacagcaaauggaauucuguauuuauuauuauuuaaguguagcgcagaug

SEQ ID NO: 182912 - RNA, 64 nt, Homo Sapiens
uuuuuuuguaugaaaacauguuuugaaaaguaauauuuauuaaaguguuguucuuggcaauaaa

SEQ ID NO: 182913 - RNA, 64 nt, Homo Sapiens
uuaauaaucaagagccuuaaacuguguauauuugauuuauuaacauaauucuuuuuuauuaauc

SEQ ID NO: 182914 - RNA, 64 nt, Homo Sapiens
guauucaauuugauucuaugacugaaguacuggaauuuauuauguggcuaaagugcucuauuua

SEQ ID NO: 182915 - RNA, 64 nt, Homo Sapiens
aguacuggaauuuauuauguggcuaaagugcucuauuuauuaagaacuauauuuaauaccacca

SEQ ID NO: 182916 - RNA, 64 nt, Homo Sapiens
cuuucgguuguaaauuuaauuguacauaugguugauuuauuauuuuuaaaaauacagacuaacu

SEQ ID NO: 182917 - RNA, 64 nt, Homo Sapiens
uuucucucuuaccuucuggaagagggaauguuucauuuauuacuguuugauuuucuuguaucug

SEQ ID NO: 182918 - RNA, 64 nt, Homo Sapiens
ccuaauuguguuugguuucauauuagacaauguuauuuauuagcaagcaucagacugguaucaa

SEQ ID NO: 182919 - RNA, 64 nt, Homo Sapiens
ccuaauuguguuugauuucacccaccuguaaguuauuuauuagcuaagggauauguuacaguac

SEQ ID NO: 182920 - RNA, 64 nt, Homo Sapiens
ugaaaaaacaaucccaugguuuuuauucauuuguauuuauuaaacucuugacaaaauaaaguau

SEQ ID NO: 182921 - RNA, 64 nt, Homo Sapiens
acaaaaucauucuuugcaacuggaugcacugggaauuuauuagcucuaggguuuuuguacauuu

SEQ ID NO: 182922 - RNA, 64 nt, Homo Sapiens
uaaacauuuuuuuaaaaagcgucuccgggcccuuauuuauuauugagaguuuaccaagagagau

SEQ ID NO: 182923 - RNA, 64 nt, Homo Sapiens
auauccuauuuauauuaacucuggcaugauuucuauuuauuaugaagcgugcugugcgucugac

SEQ ID NO: 182924 - RNA, 64 nt, Homo Sapiens
uuauccacuacagguuuuaugagacuuccuauuaauuuauuaaauuuauuaaauguuggcuaau

SEQ ID NO: 182925 - RNA, 64 nt, Homo Sapiens
acagguuuuaugagacuuccuauuaauuuauuaaauuuauuaaauguuggcuaauaugucacau

SEQ ID NO: 182926 - RNA, 64 nt, Homo Sapiens
uuuuaaaaaauaacaugccuacaacauucacaaaauuuauuacuguauaggauuuuuaaaaaug

SEQ ID NO: 182927 - RNA, 64 nt, Homo Sapiens
uucacucaguagguguuacaucaugucuuugaacauuuauuaggacauuuauuaggaaucuaaa

SEQ ID NO: 182928 - RNA, 64 nt, Homo Sapiens
aaucuaaaucaugucuuugaucauguucauauacauuuauuaggauuauaugaacuguuuuaua

SEQ ID NO: 182929 - RNA, 64 nt, Homo Sapiens
ugcucaguguuucauauucauuuauuaagcacguauuuauuaacggauaacaaagaaccuaaca

SEQ ID NO: 182930 - RNA, 64 nt, Homo Sapiens
cacguauuuauuaacugcucacaaagaaccuaacauuuauuaaggugaugaacuggcagggaua

SEQ ID NO: 182931 - RNA, 64 nt, Homo Sapiens; identical to SEQ ID NO: 143348

SEQ ID NO: 182932 - RNA, 64 nt, Homo Sapiens; identical to SEQ ID NO: 143349

SEQ ID NO: 182933 - RNA, 64 nt, Homo Sapiens; identical to SEQ ID NO: 143350

SEQ ID NO: 182934 - RNA, 64 nt, Homo Sapiens; identical to SEQ ID NO: 143351

SEQ ID NO: 182935 - RNA, 64 nt, Homo Sapiens; identical to SEQ ID NO: 143352

SEQ ID NO: 182936 - RNA, 64 nt, Homo Sapiens; identical to SEQ ID NO: 143353

SEQ ID NO: 182937 - RNA, 64 nt, Homo Sapiens; identical to SEQ ID NO: 143354

SEQ ID NO: 182938 - RNA, 64 nt, Homo Sapiens; identical to SEQ ID NO: 143355

SEQ ID NO: 182939 - RNA, 64 nt, Homo Sapiens; identical to SEQ ID NO: 143356

SEQ ID NO: 182940 - RNA, 64 nt, Homo Sapiens; identical to SEQ ID NO: 143357

SEQ ID NO: 182941 - RNA, 64 nt, Homo Sapiens; identical to SEQ ID NO: 143358

SEQ ID NO: 182942 - RNA, 64 nt, Homo Sapiens; identical to SEQ ID NO: 143359

SEQ ID NO: 182943 - RNA, 64 nt, Homo Sapiens; identical to SEQ ID NO: 143360

SEQ ID NO: 182944 - RNA, 64 nt, Homo Sapiens; identical to SEQ ID NO: 143361

SEQ ID NO: 182945 - RNA, 64 nt, Homo Sapiens; identical to SEQ ID NO: 143362

SEQ ID NO: 182946 - RNA, 64 nt, Homo Sapiens; identical to SEQ ID NO: 143363

SEQ ID NO: 182947 - RNA, 64 nt, Homo Sapiens; identical to SEQ ID NO: 143364

SEQ ID NO: 182948 - RNA, 64 nt, Homo Sapiens; identical to SEQ ID NO: 143365

SEQ ID NO: 182949 - RNA, 64 nt, Homo Sapiens
uacggggaggagggggggaucaucaggaagcccagaacacuaacaagcgguucucccaucuacc

SEQ ID NO: 182950 - RNA, 64 nt, Homo Sapiens
aaaggaauagcaaucauuaaaaucuugggccagagaacacuauuuuuacauaacaguuucuuaa

SEQ ID NO: 182951 - RNA, 64 nt, Homo Sapiens
uggugacuguuuggggccugguauuuuaauagaugaacacuacuuuuuuaauuuuuuauuuuuu

SEQ ID NO: 182952 - RNA, 64 nt, Homo Sapiens
auuuuuuauuuuuuuaacccuacccuuaacccaugaacacuauuuuuaauuaaaguaucugaug

SEQ ID NO: 182953 - RNA, 64 nt, Homo Sapiens
auuaauugugucuguaucucaaacaauuccucaugaacacuaaguuugcccaguuguguuuuaa

SEQ ID NO: 182954 - RNA, 64 nt, Homo Sapiens
uauauccuaugcauaguauguagccauagaacuugaacacuaacaagucaucuaccuuugauau

SEQ ID NO: 182955 - RNA, 64 nt, Homo Sapiens; identical to SEQ ID NO: 124053

SEQ ID NO: 182956 - RNA, 64 nt, Homo Sapiens; identical to SEQ ID NO: 124054

SEQ ID NO: 182957 - RNA, 64 nt, Homo Sapiens; identical to SEQ ID NO: 124055

SEQ ID NO: 182958 - RNA, 64 nt, Homo Sapiens; identical to SEQ ID NO: 124056

SEQ ID NO: 182959 - RNA, 64 nt, Homo Sapiens; identical to SEQ ID NO: 124057

SEQ ID NO: 182960 - RNA, 64 nt, Homo Sapiens; identical to SEQ ID NO: 124058

SEQ ID NO: 182961 - RNA, 64 nt, Homo Sapiens; identical to SEQ ID NO: 124059

SEQ ID NO: 182962 - RNA, 64 nt, Homo Sapiens; identical to SEQ ID NO: 124060

SEQ ID NO: 182963 - RNA, 64 nt, Homo Sapiens; identical to SEQ ID NO: 124061

SEQ ID NO: 182964 - RNA, 64 nt, Homo Sapiens; identical to SEQ ID NO: 124062

SEQ ID NO: 182965 - RNA, 64 nt, Homo Sapiens; identical to SEQ ID NO: 124063

SEQ ID NO: 182966 - RNA, 64 nt, Homo Sapiens; identical to SEQ ID NO: 124064

SEQ ID NO: 182967 - RNA, 64 nt, Homo Sapiens; identical to SEQ ID NO: 124065

SEQ ID NO: 182968 - RNA, 64 nt, Homo Sapiens; identical to SEQ ID NO: 124066

SEQ ID NO: 182969 - RNA, 64 nt, Homo Sapiens; identical to SEQ ID NO: 124067

SEQ ID NO: 182970 - RNA, 64 nt, Homo Sapiens; identical to SEQ ID NO: 124068

SEQ ID NO: 182971 - RNA, 64 nt, Homo Sapiens; identical to SEQ ID NO: 124069

SEQ ID NO: 182972 - RNA, 64 nt, Homo Sapiens; identical to SEQ ID NO: 124070

SEQ ID NO: 182973 - RNA, 64 nt, Homo Sapiens; identical to SEQ ID NO: 124071

SEQ ID NO: 182974 - RNA, 64 nt, Homo Sapiens; identical to SEQ ID NO: 124072

SEQ ID NO: 182975 - RNA, 64 nt, Homo Sapiens; identical to SEQ ID NO: 124073

SEQ ID NO: 182976 - RNA, 64 nt, Homo Sapiens; identical to SEQ ID NO: 124074

SEQ ID NO: 182977 - RNA, 64 nt, Homo Sapiens; identical to SEQ ID NO: 124075

SEQ ID NO: 182978 - RNA, 64 nt, Homo Sapiens; identical to SEQ ID NO: 124076

SEQ ID NO: 182979 - RNA, 64 nt, Homo Sapiens; identical to SEQ ID NO: 124077

SEQ ID NO: 182980 - RNA, 64 nt, Homo Sapiens; identical to SEQ ID NO: 124078

SEQ ID NO: 182981 - RNA, 64 nt, Homo Sapiens; identical to SEQ ID NO: 124079

SEQ ID NO: 182982 - RNA, 64 nt, Homo Sapiens; identical to SEQ ID NO: 124080

SEQ ID NO: 182983 - RNA, 64 nt, Homo Sapiens; identical to SEQ ID NO: 124081

SEQ ID NO: 182984 - RNA, 64 nt, Homo Sapiens; identical to SEQ ID NO: 124082

SEQ ID NO: 182985 - RNA, 64 nt, Homo Sapiens; identical to SEQ ID NO: 124083

SEQ ID NO: 182986 - RNA, 64 nt, Homo Sapiens
gaccuucuguaguaauaaaguuuuugccacuguaaauaaaaacaguauccguagcuaucaggau

SEQ ID NO: 182987 - RNA, 64 nt, Homo Sapiens
uuaacuuuuuauauuaaugacuauugaaagugguaauaaaaauuuauauuauaggcuucaaugu

SEQ ID NO: 182988 - RNA, 64 nt, Homo Sapiens
cuggcagccaauaaaaucaucauaagcccuuuguaauaaaaagcuaguuuccugagugaacaag

SEQ ID NO: 182989 - RNA, 64 nt, Homo Sapiens
uucuguaugcuucuauuccaaaucauucauuaccaauaaaaacgaaauaccacccuuuccauuu

SEQ ID NO: 182990 - RNA, 64 nt, Homo Sapiens
acacaauuucuaacugccuguuuuuguauaauuuaauaaaaaccuuuuaaacauuacugcuuuu

SEQ ID NO: 182991 - RNA, 64 nt, Homo Sapiens
cugacauuugggugaugucuucacauggaaauauaauaaaaauaaaaaucuaguuuaauacugc

SEQ ID NO: 182992 - RNA, 64 nt, Homo Sapiens
uuugggugaugucuucacauggaaauauaauaaaaauaaaaaucuaguuuaauacugcauuauu

SEQ ID NO: 182993 - RNA, 64 nt, Homo Sapiens
uuaggaaggucaaaaaaaaggaaaaaagaaaaauaauaaaaaauaauaaaaauccuuaggauaa

SEQ ID NO: 182994 - RNA, 64 nt, Homo Sapiens
caaaaaaaaggaaaaaagaaaaauaauaaaaaauaauaaaaauccuuaggauaacuugaggcca

SEQ ID NO: 182995 - RNA, 64 nt, Homo Sapiens
ugucaaaaauucccaacacuagaaaaucauguagaauaaaaauuuuaaaucucacuucacuuag

SEQ ID NO: 182996 - RNA, 64 nt, Homo Sapiens
aucauuccuauauuguuauugauuuuuuucacuuaauaaaaauucaccuuauuccuuaucauug

SEQ ID NO: 182997 - RNA, 64 nt, Homo Sapiens
uuuuugcauauaaaccaaaaaauaacuuguuaucaauaaaaacuugcauccaacaugaauuucc

SEQ ID NO: 182998 - RNA, 64 nt, Homo Sapiens
auuguaacaauccaaacaauaccucacgauauaaaauaaaaaugaaaguauccuccucauuuuc

SEQ ID NO: 182999 - RNA, 64 nt, Homo Sapiens
cacuucucuccucaacuguaauucuauuuuuaauaauaaaaauggcauacuguagggucuucag

SEQ ID NO: 183000 - RNA, 64 nt, Homo Sapiens
gagauaauacacaggugauaaacaguuucgagaaaauaaaaauuggcuagaaucucaaguuaug

SEQ ID NO: 183001 - RNA, 64 nt, Homo Sapiens
uuagaaaacccuuacacuuuggcuaugaacaaauaauaaaaauuauucuuuaaaguaaugucuu

SEQ ID NO: 183002 - RNA, 64 nt, Homo Sapiens
gggcaggggaagggggauauagaggucacaaggaaauaaaaaucaucuuucaucuuuaauuuua

SEQ ID NO: 183003 - RNA, 64 nt, Homo Sapiens
uuggcagguuaaauuaaaccagaagaggugacuuaauaaaaaagggaaugacauuuaggguaua

SEQ ID NO: 183004 - RNA, 64 nt, Homo Sapiens
auuguuugcgcuagaauagaaaugauuucuuuucaauaaaaagaaagaaggacucuaccauguc

SEQ ID NO: 183005 - RNA, 64 nt, Homo Sapiens
aaaucuagaaaccauuaguuugagaucucucaaaaauaaaaauaaaaauugcuuucagagagua

SEQ ID NO: 183006 - RNA, 64 nt, Homo Sapiens
agaaaccauuaguuugagaucucucaaaaauaaaaauaaaaauugcuuucagagaguagcccau

SEQ ID NO: 183007 - RNA, 64 nt, Homo Sapiens
uucucacgugaaauauaaaaagcaagucuugcccaauaaaaacgcuacauuguguguauuuuuu

SEQ ID NO: 183008 - RNA, 64 nt, Homo Sapiens
cuggccaacauggugaaacccugucucuacugaaaauaaaaaaaacuagcugggcaugguggca

SEQ ID NO: 183009 - RNA, 64 nt, Homo Sapiens
ugauucauuuuagaucucuggggaagaaaaaggaaauaaaaaccaucucaauaauuaagguaaa

SEQ ID NO: 183010 - RNA, 64 nt, Homo Sapiens
acuuaugguccaaaaaagugacccaauggcaacaaauaaaaauugaaaugcaguuguucuccuu

SEQ ID NO: 183011 - RNA, 64 nt, Homo Sapiens
gccuaggagacaaaacgagacuucauuuaaaaaaaauaaaaauaaaaauaaaaauaaagucauc

SEQ ID NO: 183012 - RNA, 64 nt, Homo Sapiens
gagacaaaacgagacuucauuuaaaaaaaauaaaaauaaaaauaaaaauaaagucaucuugcca

SEQ ID NO: 183013 - RNA, 64 nt, Homo Sapiens
aaacgagacuucauuuaaaaaaaauaaaaauaaaaauaaaaauaaagucaucuugccacccacc

SEQ ID NO: 183014 - RNA, 64 nt, Homo Sapiens
caagaucuguaauguuauuuccacuuauaaaggaaauaaaaaaugaaaaacauuauuuggauau

SEQ ID NO: 183015 - RNA, 64 nt, Homo Sapiens
aaaaaugaaaaacauuauuuggauaucaaaagcaaauaaaaacccaauucagucucuucuaagc

SEQ ID NO: 183016 - RNA, 64 nt, Homo Sapiens
aaguuggagcaauugucuguguuugaaaagaugaaauaaaaauaauaaucaagggcaaagcuuu

SEQ ID NO: 183017 - RNA, 64 nt, Homo Sapiens
acaguucucuuguauuuauuuaucaauuaaaucaaauaaaaaugauuaugucaaugcguuuuca

SEQ ID NO: 183018 - RNA, 64 nt, Homo Sapiens
guuauuaggaaacagaaggcaaaaagauugucaaaauaaaaacaauaauucaaguaacaaugcc

SEQ ID NO: 183019 - RNA, 64 nt, Homo Sapiens
cuguuuuugacaauuuuuuuaucaagaaagagcaaauaaaaagcagugguaaugauccaaagua

SEQ ID NO: 183020 - RNA, 64 nt, Homo Sapiens
gugguacggucuaaaagcagucuuguuuccuggaaauaaaaaguugggauauuaacuuguuuuu

SEQ ID NO: 183021 - RNA, 64 nt, Homo Sapiens
uucccacugucuuuaaguugaaacuguuaagcugaauaaaaacuuaagcugcaaauugauaacu

SEQ ID NO: 183022 - RNA, 64 nt, Homo Sapiens
aaaugaaggaaauaaugauuagcaaacaugcuauaauaaaaacauuucugcuugcuguaaauua

SEQ ID NO: 183023 - RNA, 64 nt, Homo Sapiens
uagcaucuuuaaaaaucucacaauuucauuucagaauaaaaagccaaaagugacuugacauguc

SEQ ID NO: 183024 - RNA, 64 nt, Homo Sapiens
caaaugaaaaggcacauccucuuuuuaaauguaaaauaaaaagauccacuuagagcaauaacca

SEQ ID NO: 183025 - RNA, 64 nt, Homo Sapiens
agccacaaaacuaaaaggccaaauucugcaaaaaaauaaaaauaggaggcugcacuacaaaccc

SEQ ID NO: 183026 - RNA, 64 nt, Homo Sapiens
gcauuuaaaucagcccuguuacuaugaccaagccaauaaaaaggagccuuggcaccuguuggag

SEQ ID NO: 183027 - RNA, 64 nt, Homo Sapiens
caauauaacuuucuuugggucacauagaaucaucaauaaaaacucuaucacacucuguuaaaaa

SEQ ID NO: 183028 - RNA, 64 nt, Homo Sapiens
uuuuauaccugugucagacuuguacaaugcugauaauaaaaacuuucauaaaaucuaugaauac

SEQ ID NO: 183029 - RNA, 64 nt, Homo Sapiens
aaaggaagacucuaugaagaagccaucuggaggaaauaaaaaaaguaagucaauuaauaaaaag

SEQ ID NO: 183030 - RNA, 64 nt, Homo Sapiens
gccaucuggaggaaauaaaaauuguaagucaauuaauaaaaagacagcaaacugaccugccccu

SEQ ID NO: 183031 - RNA, 64 nt, Homo Sapiens
acgacauuuuaagauauuucucugcugcaauuuaaauaaaaauuguuuuuuuuccguaacauug

SEQ ID NO: 183032 - RNA, 64 nt, Homo Sapiens
uuucucuuaacaguauuuccuuucugguuuaaaaaauaaaaaggucacaugagcuuuaguuugu

SEQ ID NO: 183033 - RNA, 64 nt, Homo Sapiens
aauaaaauauaguacuuuccaguuccauuuccuaaauaaaaacuaaauauugggauaaagugaa

SEQ ID NO: 183034 - RNA, 64 nt, Homo Sapiens
aagucuaccucugaagaaaagaagaacucauugaaauaaaaacaaaaguguucuagcucgagug

SEQ ID NO: 183035 - RNA, 64 nt, Homo Sapiens
uuggcuugccuguguaaugcccauuuucuggcugaauaaaaagucauuaaacugaaucagaaau

SEQ ID NO: 183036 - RNA, 64 nt, Homo Sapiens
auccauccuacaucuucccuuugguaguggcaggaauaaaaaaauguguguagauuuauaguuu

SEQ ID NO: 183037 - RNA, 64 nt, Homo Sapiens
uauauaguauguucucuccucauaaagcaauaauaauaaaaaccucaaagugguaacccaaauu

SEQ ID NO: 183038 - RNA, 64 nt, Homo Sapiens
uuuaaaaucauguacuaauacauuaaaagaguacaauaaaaaugccucaccuccaauauaaaca

SEQ ID NO: 183039 - RNA, 64 nt, Homo Sapiens
gaauuuuuuacccauacaaaccuacauuaguaaaaauaaaaauggaaggaaacauauguucucc

SEQ ID NO: 183040 - RNA, 64 nt, Homo Sapiens
uggguucuuagucuuuagcuaguauugaaaguagaauaaaaacaguuuuauccacaacuuuuca

SEQ ID NO: 183041 - RNA, 64 nt, Homo Sapiens
aaacuauccaggagugguggcuugucuccacaaaaauaaaaaagccuggacaacauagugagac

SEQ ID NO: 183042 - RNA, 64 nt, Homo Sapiens
aauuugguucuaauagaacuucucaaaaaauaaaaauaaaaauaggugacagagcaagacucug

SEQ ID NO: 183043 - RNA, 64 nt, Homo Sapiens
aaaauaaauuugguucuaauacucugucucaaaaaauaaaaauaagccugggugacagagcaag

SEQ ID NO: 183044 - RNA, 64 nt, Homo Sapiens
ggcauguagccaauguuuccacauuacucuuugaaauaaaaauuugauaacuauuauuugugca

SEQ ID NO: 183045 - RNA, 64 nt, Homo Sapiens
auuuuaaaaaguauugacacuuuuaucuauuguaaauaaaaagcaauauuguauuuccuuacug

SEQ ID NO: 183046 - RNA, 64 nt, Homo Sapiens
auaaaaacccauccccuaucccuauaguuacaaaaauaaaaacugcuauuguuauaguagcugc

SEQ ID NO: 183047 - RNA, 64 nt, Homo Sapiens
uucauugguaacuguauguauuacuuuaagcuugaauaaaaaucuucuuaacuaaaauuacuuu

SEQ ID NO: 183048 - RNA, 64 nt, Homo Sapiens
uuagucuuaaggguaacagagugaauaccuuccaaauaaaaagcuaaauauuccuccuugucau

SEQ ID NO: 183049 - RNA, 64 nt, Homo Sapiens
uccauaacagacuuugacucuaugaccuaugaagaauaaaaagauaaucugaagguguuugagu

SEQ ID NO: 183050 - RNA, 64 nt, Homo Sapiens
gaaagauuucuuagguuuugaaagaauacauuaaaauaaaaaacuugccccuacuagguaagaa

SEQ ID NO: 183051 - RNA, 64 nt, Homo Sapiens
ucucuuccaaucaugacuuuggaacucccugaauaauaaaaaugagaguugagauaaauagggg

SEQ ID NO: 183052 - RNA, 64 nt, Homo Sapiens
ggagcaucuguauuuuuauguuaaaagcccacaaaauaaaaauaaaaaguaacugagaugaauu

SEQ ID NO: 183053 - RNA, 64 nt, Homo Sapiens
ucuguauuuuuauguuaaaagcccacaaaauaaaaauaaaaaguaacugagaugaauuuaccuu

SEQ ID NO: 183054 - RNA, 64 nt, Homo Sapiens
auaaaugaggcaaauccgaagaaaaggaaaaucgaauaaaaaauagucccacaaaauaccuuuu

SEQ ID NO: 183055 - RNA, 64 nt, Homo Sapiens
uuuaaauuuuuuuuguuuguugaaugacaaaggcaauaaaaauaaauuugacuuuagcuuuuuu

SEQ ID NO: 183056 - RNA, 64 nt, Homo Sapiens
agcgagaccuugucucuaaaaauaauaguaauaaaauaaaaauaacguuuuaugacuauuuauu

SEQ ID NO: 183057 - RNA, 64 nt, Homo Sapiens
ugaaucuguuuugagaauccucuccauuuucccaaauaaaaaccuaucacaacagugacuauau

SEQ ID NO: 183058 - RNA, 64 nt, Homo Sapiens
agcaaaaucuuguaguuuuuaaucuuaaacacugaauaaaaaaacuuuccccuaaauuggaaug

SEQ ID NO: 183059 - RNA, 64 nt, Homo Sapiens
aggaccuagaguaccuauaggacaaaaaguauagaauaaaaauaugccuuuagucauuugguuu

SEQ ID NO: 183060 - RNA, 64 nt, Homo Sapiens
gaccccuuaccccaacuuuaugaguaaugcuuggaauaaaaacucuuaaggcaacucacugauu

SEQ ID NO: 183061 - RNA, 64 nt, Homo Sapiens
auuugaaauacuaccauauuugugauuuauugagaauaaaaauccauuuugaaauguaaaauuu

SEQ ID NO: 183062 - RNA, 64 nt, Homo Sapiens
aaauauuuuuagcagaacagauggguuuuguaaaaauaaaaaaauguuaugaaauaaaaaaaag

SEQ ID NO: 183063 - RNA, 64 nt, Homo Sapiens
agauggguuuuguaaaaauaaauuuuuguuaugaaauaaaaaaaggaaguacagacguacuuua

SEQ ID NO: 183064 - RNA, 64 nt, Homo Sapiens
cucaaaauacauugguuuauagccuuauaaaccaaauaaaaauuccagaggucauggaacagaa

SEQ ID NO: 183065 - RNA, 64 nt, Homo Sapiens
gaagaccagaagucuuugagggcucauuggccuaaauaaaaagaugagcuuaggauagagagug

SEQ ID NO: 183066 - RNA, 64 nt, Homo Sapiens
gaaaauugcaaaaaaaaaaagaugagcuuaaaaaaauaaaaauacacuaacacuaaccauaguu

SEQ ID NO: 183067 - RNA, 64 nt, Homo Sapiens
aaaugauaaagugaacuugcacuucaagcaacacaauaaaaagucauacuugcauuacauaggu

SEQ ID NO: 183068 - RNA, 64 nt, Homo Sapiens
auaguuuacuuuguauuauauaugaaaauuucacaauaaaaaucagaauauucaauuuuccauc

SEQ ID NO: 183069 - RNA, 64 nt, Homo Sapiens
cuucugcccacacuggcauuuuuuaauugugaggaauaaaaaauccuaggggguuuuguuuggu

SEQ ID NO: 183070 - RNA, 64 nt, Homo Sapiens
aaaaaguuugauugagacaauuuaaauuuaaaaaaauaaaaacaucucugagagaaaagggugu

SEQ ID NO: 183071 - RNA, 64 nt, Homo Sapiens
gcugcaguagcuguggccucuaaauaaauaaauaaauaaaaagcagagcaagacuccaucucag

SEQ ID NO: 183072 - RNA, 64 nt, Homo Sapiens
uaucccaacagugacuauauucuccauuuucccaaauaaaaaccugaaucuguuuugagaaucc

SEQ ID NO: 183073 - RNA, 64 nt, Homo Sapiens
acguuuuaugacuauuuauuaaaauaauaauaguaauaaaaauaagagcgagaccuugucucua

SEQ ID NO: 183074 - RNA, 64 nt, Homo Sapiens
caauuccuuauugucugaauuguuuugcccugcaaauaaaaagaaucaccacagauaaagauuu

SEQ ID NO: 183075 - RNA, 64 nt, Homo Sapiens
acagcuuuagcacaauuuuauuaaagucauuaaaaauaaaaauguaaaaucuugucuagcacag

SEQ ID NO: 183076 - RNA, 64 nt, Homo Sapiens
agaccaacuuuuaguuagcuaagcagauggugauaauaaaaagcccaacauuguuuagaauuuc

SEQ ID NO: 183077 - RNA, 64 nt, Homo Sapiens
aacaauaacauguuuaucuucccagaacaccaaaaauaaaaacacuuuugucuuuuaaaauaau

SEQ ID NO: 183078 - RNA, 64 nt, Homo Sapiens
cucaauuuuaauuuuucaucacuguugucuuucuaauaaaaaaguagcaagggguaaauuaugu

SEQ ID NO: 183079 - RNA, 64 nt, Homo Sapiens
ucuccacuuuuuuauugaaugacaauuaccugggaauaaaaauaagagaagaaagacuguaugu

SEQ ID NO: 183080 - RNA, 64 nt, Homo Sapiens
gauggccuaaguaaaauuuaaauucaaaggugaaaauaaaaaauauaucucuaauuuacuuuga

SEQ ID NO: 183081 - RNA, 64 nt, Homo Sapiens
cuagcgacagucuuucuuacguuguugaugaugaaauaaaaauggagaaagaaacugcauguuu

SEQ ID NO: 183082 - RNA, 64 nt, Homo Sapiens
agaaucauaauuuucaagaguuccgucucccuaaaauaaaaaccuucauuucacuuuaaagucu

SEQ ID NO: 183083 - RNA, 64 nt, Homo Sapiens
uacaguaaaguuuaaaaaauucuucuauuuaaaaaauaaaaaaauauguauuauuuucuauagc

SEQ ID NO: 183084 - RNA, 64 nt, Homo Sapiens
uguuuaaaguuaauaauugugacaaccuuuguguaauaaaaauuagagaaguauccaauuaugu

SEQ ID NO: 183085 - RNA, 64 nt, Homo Sapiens
auuuguacauuccugauacuauuuuguauuuuugaauaaaaaacuccaugccuacagauaauuu

SEQ ID NO: 183086 - RNA, 64 nt, Homo Sapiens
aaaaaagacgaacuauuggaauaaaaauaaaaaaaauaaaaaaaauuaucacacaaagagacca

SEQ ID NO: 183087 - RNA, 64 nt, Homo Sapiens
auaaaaaaaaaaaaagacgaaagagaccaauaaaaauaaaaaaaguguaggucauuaucacaca

SEQ ID NO: 183088 - RNA, 64 nt, Homo Sapiens
aaaaaaauaaaaaaaaaaaacacacaaagagaccaauaaaaauaguccauguguaggucauuau

SEQ ID NO: 183089 - RNA, 64 nt, Homo Sapiens
cacagagucagaagcugccaccuuagagaacugaaauaaaaauagaaguucuuacgcuuuuuug

SEQ ID NO: 183090 - RNA, 64 nt, Homo Sapiens
gguacagaugcuuucgacaauuuaaagaaagcuaaauaaaaauguagacauggcuggcgcagug

SEQ ID NO: 183091 - RNA, 64 nt, Homo Sapiens
agcacuuggaaaaugcacuuguccuguuuuguaaaauaaaaagguauuaaauguguauuucugc

SEQ ID NO: 183092 - RNA, 64 nt, Homo Sapiens
auuuaaaguaaucuauaguaauuucuuuuuauauaauaaaaauauauuuguaaagucgacagac

SEQ ID NO: 183093 - RNA, 64 nt, Homo Sapiens
gaaaggaauucaaaagaauuuagauuaaaaguuaaauaaaaaguaggcacaguagugcugaauu

SEQ ID NO: 183094 - RNA, 64 nt, Homo Sapiens
uuauuaacacuuguauuuuauuauugagcauaucaauaaaaauauuaaaaaauaacagauuguu

SEQ ID NO: 183095 - RNA, 64 nt, Homo Sapiens
ggaggcaggacaacacugagacugggauauguccaauaaaaacuaugacuuuuccccuugcaga

SEQ ID NO: 183096 - RNA, 64 nt, Homo Sapiens
aagaacaccagagaucagaaauucaaaaacucagaauaaaaaugaaaaagcuacaagcauauau

SEQ ID NO: 183097 - RNA, 64 nt, Homo Sapiens
cucaacugugucugauguuucuucucauguaagaaauaaaaaauaaaaauaaaauaaaauauau

SEQ ID NO: 183098 - RNA, 64 nt, Homo Sapiens
gugucugauguuucuucucauguaagaaauaaaaaauaaaaauaaaauaaaauauauugguaug

SEQ ID NO: 183099 - RNA, 64 nt, Homo Sapiens
aauaaaauauauugguauguaacuacaggaaaaaaauaaaaaauauauaguggacaguaaccuu

SEQ ID NO: 183100 - RNA, 64 nt, Homo Sapiens
aaaaaagauguuauacaaccaucaaaguggcaaaaauaaaaaaaaucaaguauuggcaaagaug

SEQ ID NO: 183101 - RNA, 64 nt, Homo Sapiens
auagaaugagugaaucaccugugguauauuuauaaauaaaaauauuaaauagaagguaaaacaa

SEQ ID NO: 183102 - RNA, 64 nt, Homo Sapiens
cauaaggucucacacuuuucuuauaaugcaauagaauaaaaaugacaacaaaguaaaaggguau

SEQ ID NO: 183103 - RNA, 64 nt, Homo Sapiens
caaaucuaauaacauaguuguaaaugagagcaacaauaaaaaguagacaugggcugggugcagu

SEQ ID NO: 183104 - RNA, 64 nt, Homo Sapiens
agccuggguaacacggggagacccgucuuuaguaaauaaaaauaaauuuauuaauaaaacuaaa

SEQ ID NO: 183105 - RNA, 64 nt, Homo Sapiens
aaaauaaauuuauuaauaaaacuaaaaauuuaauaauaaaaaguggacauuguuuuuuaaaaug

SEQ ID NO: 183106 - RNA, 64 nt, Homo Sapiens
augguaaugaaaauggaaugcagcuacugcagcuaauaaaaaauuuuagauagcaauuguuaca

SEQ ID NO: 183107 - RNA, 64 nt, Homo Sapiens
uuuuccucccuuucucauguuuuuauaaauagguaauaaaaaauguuuugccugccaauugaau

SEQ ID NO: 183108 - RNA, 64 nt, Homo Sapiens
aacugggaaacagcuuguguacuaaaguaaugagaauaaaaauguuggcccaaaauuacuuuua

SEQ ID NO: 183109 - RNA, 64 nt, Homo Sapiens
ucuguuuacuauaguguagcuacuggcuucauuuaauaaaaauaaaugauuuugaaauuaaaua

SEQ ID NO: 183110 - RNA, 64 nt, Homo Sapiens
uuauucuuaauucugaauuuugacauuuucacacaauaaaaauaauuuauaucaauauucuguu

SEQ ID NO: 183111 - RNA, 64 nt, Homo Sapiens
cauaauaagagguguaaaaacuaucacaggaagaaauaaaaacagauuuuugaaggugagauga

SEQ ID NO: 183112 - RNA, 64 nt, Homo Sapiens
uggacaacagagcaagacucugucucaaaaaaaaaauaaaaaauaaaaaauaaaaaauaaaaga

SEQ ID NO: 183113 - RNA, 64 nt, Homo Sapiens
cagagcaagacucugucucaaaaaaaaaauaaaaaauaaaaaauaaaaaauaaaagaaacauaa

SEQ ID NO: 183114 - RNA, 64 nt, Homo Sapiens
agacucugucucaaaaaaaaaauaaaaaauaaaaaauaaaaaauaaaagaaacauaagauaagu

SEQ ID NO: 183115 - RNA, 64 nt, Homo Sapiens
cugagcaacauggcaaaacccugugucuacaaaaaauaaaaaauuagcugggcaugacggccag

SEQ ID NO: 183116 - RNA, 64 nt, Homo Sapiens
acaaaagucaagauuuuauuaccaaacuuauagaaauaaaaauuauuagaaagaaauacuauga

SEQ ID NO: 183117 - RNA, 64 nt, Homo Sapiens
gugacagugaugacugaagaaauauuuagcuauaaauaaaaauuuauacagcauguauaauuua

SEQ ID NO: 183118 - RNA, 64 nt, Homo Sapiens
uuuauacagcauguauaauuuauuuuguauuaacaauaaaaauuccuaagacugagggaaauau

SEQ ID NO: 183119 - RNA, 64 nt, Homo Sapiens
auauuucuuaggaaguauaggcuacuggacuuagaauaaaaaguccccaaacccaaacaaaugg

SEQ ID NO: 183120 - RNA, 64 nt, Homo Sapiens
ugugccuauacauucauuugcuuuguacuauaaaaauaaaaaugauuucuuaaguuaaugacau

SEQ ID NO: 183121 - RNA, 64 nt, Homo Sapiens
guaauuuuauaaaauccaccuccuccaaaaaagcaauaaaaaaaaaacaaacuauaauaagcuu

SEQ ID NO: 183122 - RNA, 64 nt, Homo Sapiens
guccuauuuucauuuaaacacuuuauuuuugaguaauaaaaauauguaccacaauaaauuauug

SEQ ID NO: 183123 - RNA, 64 nt, Homo Sapiens
auugauuaauuaacugggccuuuauacuuaacuaaauaaaaaacuaagcagauaugaguuaaau

SEQ ID NO: 183124 - RNA, 64 nt, Homo Sapiens
aguugccauuguggaagaaauuauuugguacauuaauaaaaaaaguugguaaaacaugguuuua

SEQ ID NO: 183125 - RNA, 64 nt, Homo Sapiens
ccuauuuugggguauaaacaugguguuuuucagaaauaaaaauuauuucauuaaccuuuacuau

SEQ ID NO: 183126 - RNA, 64 nt, Homo Sapiens
accauguaccagaauuuuacuaggcacaaccaugaauaaaaauacaauucucuugcaccauuaa

SEQ ID NO: 183127 - RNA, 64 nt, Homo Sapiens
ccaaacaggaaagaacuaugucugaaauauaaaaaauaaaaauaaaaaaacaacuaugaauaug

SEQ ID NO: 183128 - RNA, 64 nt, Homo Sapiens
aggaaagaacuaugucugaaauauaaaaaauaaaaauaaaaaaacaacuaugaauaugcacaag

SEQ ID NO: 183129 - RNA, 64 nt, Homo Sapiens
uuuuucuaguuuuuaauuuuaacaucagaacugaaauaaaaaauuauggauacguguuuugaau

SEQ ID NO: 183130 - RNA, 64 nt, Homo Sapiens
uagugagaccuugucucuacaaaaaauaaaauaaaauaaaaaccaaauuagccagacauggugg

SEQ ID NO: 183131 - RNA, 64 nt, Homo Sapiens
aacaaaaaaaauucaacagaaaugaacuuuaaaaaauaaaaauauugagaauguacuaaaaacc

SEQ ID NO: 183132 - RNA, 64 nt, Homo Sapiens
uggacaagaacgagugucggacuaggauggcuacaauaaaaagaugagauuccaguuuacaauc

SEQ ID NO: 183133 - RNA, 64 nt, Homo Sapiens
agugcaaagagaguuuuucuagccuuacuuguuuaauaaaaaucuaaaaauauguuccacuacc

SEQ ID NO: 183134 - RNA, 64 nt, Homo Sapiens
uguuccacuaccagccuuacauguuuaugcauuaaauaaaaauauucucuaauaagggacuuau

SEQ ID NO: 183135 - RNA, 64 nt, Homo Sapiens
uuuggccaggcaccauggcuaauguaauauuuguaauaaaaacgacaguugugagcuuuaguuu

SEQ ID NO: 183136 - RNA, 64 nt, Homo Sapiens
aaccguaaccucacacauuaucauguugauuaaaaauaaaaaguguaauaaauucccaaaacua

SEQ ID NO: 183137 - RNA, 64 nt, Homo Sapiens
guaucugccuucuggcucaucuccccccacacaaaauaaaaacauaguacugugccgcuucccc

SEQ ID NO: 183138 - RNA, 64 nt, Homo Sapiens
acuaaggacgaaaaaacccuauauccuguaauuuaauaaaaaaaauacuuaguaaucgaaaacc

SEQ ID NO: 183139 - RNA, 64 nt, Homo Sapiens
augguccgcuuucuauugagaguccuugugguugaauaaaaaggguggagucuucuuuagugcc

SEQ ID NO: 183140 - RNA, 64 nt, Homo Sapiens
gauaauaaugugaaggaagauuguacccgaucauaauaaaaaugaaacccacgcgaaugggcac

SEQ ID NO: 183141 - RNA, 64 nt, Homo Sapiens
uaaucagaagcuaaaguaaaaaaguaaaaauaaaaauaaaaaagaaaauaauaauaauaauaau

SEQ ID NO: 183142 - RNA, 64 nt, Homo Sapiens
aaaaaguaaucagaagcuaaaauaauaaaguaaaaauaaaaauaaucucaaaaauaauaauaau

SEQ ID NO: 183143 - RNA, 64 nt, Homo Sapiens
cagguuuuuuuccugauuugagagagcuguuugcaauaaaaagugcacaguuugaugaagggcu

SEQ ID NO: 183144 - RNA, 64 nt, Homo Sapiens
uaauacauacaauuauucaauucuauucucuauuaauaaaaaauaauuucucuaauacugaccu

SEQ ID NO: 183145 - RNA, 64 nt, Homo Sapiens
cuguguucuaaacaauucuccaauaaaugcaaaaaauaaaaaguauguuauguauauuuuacca

SEQ ID NO: 183146 - RNA, 64 nt, Homo Sapiens
uuuucuuuuuaacauguuucgucuagguuuuuuaaauaaaaaucacccccauuuuaauuacuau

SEQ ID NO: 183147 - RNA, 64 nt, Homo Sapiens
ccuaaagcaguucuuaaaggccacuuaaagccaaaauaaaaauuaugucuagauguaagugauu

SEQ ID NO: 183148 - RNA, 64 nt, Homo Sapiens
agguaauagcauauaaauggacaucauuauaauuaauaaaaaguauuuuggacauacauaagaa

SEQ ID NO: 183149 - RNA, 64 nt, Homo Sapiens
agaaaaaaaaaucuuuucaaaauuuacuuugucaaauaaaaauuuguuuuucagagauuuacca

SEQ ID NO: 183150 - RNA, 64 nt, Homo Sapiens
aauauuuuguggcaaugaagaaaacacuacggaaaauaaaaaauaagauaaagccuuaugagcu

SEQ ID NO: 183151 - RNA, 64 nt, Homo Sapiens
aucuguagaagacauuuugggaaacacugucuuaaauaaaaacucaauguuuaguuguuuuuuu

SEQ ID NO: 183152 - RNA, 64 nt, Homo Sapiens
guauaaaacugucuuuuaagaauuauccuuucaaaauaaaaauguuauuguuucacuaguuuau

SEQ ID NO: 183153 - RNA, 64 nt, Homo Sapiens
aaacuuugagaaauuauuucugaguugaccaauaaauaaaaauaccacuuucuuuaaaaaagcc

SEQ ID NO: 183154 - RNA, 64 nt, Homo Sapiens
cuuccuacuuaggcaguucagagagaacaauucuaauaaaaacacuccucuccuauuaacaaaa

SEQ ID NO: 183155 - RNA, 64 nt, Homo Sapiens
uuuaucaucuaauggcuguaaacuguaguacuagaauaaaaaaaauggaaaaucagcuuuuccu

SEQ ID NO: 183156 - RNA, 64 nt, Homo Sapiens
uucuccucuaucuuagagggguauucuucuugaaaauaaaaaauauugaaaugcuguauuuuua

SEQ ID NO: 183157 - RNA, 64 nt, Homo Sapiens
caucaucuguuuguaaucauuaucucacuuuguaaauaaaaacacaccuuaaaacaugaacaag

SEQ ID NO: 183158 - RNA, 64 nt, Homo Sapiens
uguggcgaaacuccaucucuacaaaaaaugcaaaaauaaaaaauauaguacucaaguauucuug

SEQ ID NO: 183159 - RNA, 64 nt, Homo Sapiens
aacuagaauuuguaaugcaaauggagcucagucuaauaaaaaagagguuuugguauuaaaaguu

SEQ ID NO: 183160 - RNA, 64 nt, Homo Sapiens
uuauuaauguguaauacugagcacuuuacuucuuaauaaaaacuugauauaguagcagauguga

SEQ ID NO: 183161 - RNA, 64 nt, Homo Sapiens
acguguuucugaaaaacagauuuucauaaguaauaauaaaaauaauaauaaaaaaguuuuggua

SEQ ID NO: 183162 - RNA, 64 nt, Homo Sapiens
aaaacagauuuucauaaguaauaauaaaaauaauaauaaaaaaguuuugguaugguaagccuuu

SEQ ID NO: 183163 - RNA, 64 nt, Homo Sapiens
aggguuuuaaaaguaucuucggaaaauaaauaaaaauaaaaacucauucuaguaacuggccacu

SEQ ID NO: 183164 - RNA, 64 nt, Homo Sapiens
aaaacuaggguuuuaaaagugccacuggaaaauaaauaaaaauauaaaaacauucuaguaacug

SEQ ID NO: 183165 - RNA, 64 nt, Homo Sapiens
uucuaguaacuggccacugguauaacaugcaaaaaauaaaaacacaaaccacagagaaaauauu

SEQ ID NO: 183166 - RNA, 64 nt, Homo Sapiens
cuauuaagagcaauaaauuauguuguagaauaauaauaaaaagaucugaauuuugaguaucuuc

SEQ ID NO: 183167 - RNA, 64 nt, Homo Sapiens
cuaugaaaugaaagaacuugaguagauagaaagcaauaaaaauauuuuuggcuucuuauuucua

SEQ ID NO: 183168 - RNA, 64 nt, Homo Sapiens
ucagaaaaaccuccauuuugcuucugcuaaauuuaauaaaaacuuguuguucuugaugacauug

SEQ ID NO: 183169 - RNA, 64 nt, Homo Sapiens
aaaagcaagucuagcaauugacuugauuguugauaauaaaaacauuuccaagaguguaccauua

SEQ ID NO: 183170 - RNA, 64 nt, Homo Sapiens
aaaaaguuggaaggcagaaagacaaaaaaguaaaaauaaaaacaugacuuguuuagaaaaaaaa

SEQ ID NO: 183171 - RNA, 64 nt, Homo Sapiens
uaaaacuacauuuagacuucuuucuaaaaauaagaauaaaaaggauggcguacaaaucuuauua

SEQ ID NO: 183172 - RNA, 64 nt, Homo Sapiens
aaaguaguaauaaagaauaauucauuuaaggauaaauaaaaaauggauguuuugaaagugagca

SEQ ID NO: 183173 - RNA, 64 nt, Homo Sapiens
uugaggaacauugcuuguauguugcagucccuaaaauaaaaauaucuuuauguuuuaugaaagu

SEQ ID NO: 183174 - RNA, 64 nt, Homo Sapiens
acauauuggugaagaugcggcugucucaaaauaaaauaaaaauagccugggugacagagugaga

SEQ ID NO: 183175 - RNA, 64 nt, Homo Sapiens
auaaauuauaaaugcaauuagaaaugcacaugguaauaaaaaguaaaauuucacuaaauuuaga

SEQ ID NO: 183176 - RNA, 64 nt, Homo Sapiens
auaacacaaauaauuauucuaagguucaauauguaauaaaaaacucaaaccaacaaacucucuu

SEQ ID NO: 183177 - RNA, 64 nt, Homo Sapiens
uaacauaaucuauucaucuaaagaaaucuauuacaauaaaaauaguugacuuuguauauauaua

SEQ ID NO: 183178 - RNA, 64 nt, Homo Sapiens
uuuuuacuggaaaaaaaucaaaaagauuucccacaauaaaaagauguuuuaaauaaaaauaaag

SEQ ID NO: 183179 - RNA, 64 nt, Homo Sapiens
aagaaaagauuucccacaauuauaaaauguuuuaaauaaaaauaaauacccacaaaacuuaaaa

SEQ ID NO: 183180 - RNA, 64 nt, Homo Sapiens
cuucacuauguagcauaccugccaacaaaauaaaaauaaaaaguauguugaaaccaacugaacu

SEQ ID NO: 183181 - RNA, 64 nt, Homo Sapiens
aaaagucuucacuauguagcugaacugccaacaaaauaaaaauacaauaaauguugaaaccaac

SEQ ID NO: 183182 - RNA, 64 nt, Homo Sapiens
cuucuguauucuucagauaaauuaaauaaaaagaaauaaaaauacagcauuuguauuuugcauc

SEQ ID NO: 183183 - RNA, 64 nt, Homo Sapiens
aauaaaaauacuucuguauuauuuugcaucauuaaauaaaaagauauaucaagccagcauuugu

SEQ ID NO: 183184 - RNA, 64 nt, Homo Sapiens
auaguacucuuuguagcaaaaaagguggugaggcaauaaaaaucuugugaaguggaaauguucu

SEQ ID NO: 183185 - RNA, 64 nt, Homo Sapiens
gauacuggugcagucauuauuuaaauuaggaauaaauaaaaauggucagguaguugcaauugaa

SEQ ID NO: 183186 - RNA, 64 nt, Homo Sapiens
uuuauagaucuuuuaguuucaacucagcuuuuacaauaaaaaggauuuguauugcauugaguuu

SEQ ID NO: 183187 - RNA, 64 nt, Homo Sapiens
uaacaucagauauuguucaacuagacuaggauuuaauaaaaauugugaaagcuuacuggccuaa

SEQ ID NO: 183188 - RNA, 64 nt, Homo Sapiens
uuaauuuugugauauuccuuauuucauuucuacuaauaaaaauagacauguuuuguuugcauuu

SEQ ID NO: 183189 - RNA, 64 nt, Homo Sapiens
cauagauucaaacaaucuuuuauucaaagauugaaauaaaaaguaucgggugccaacugugauu

SEQ ID NO: 183190 - RNA, 64 nt, Homo Sapiens
aaacuauggguuauuuuuauuaaauguauuuuaaaauaaaaauuuaauucugguuuuucugauu

SEQ ID NO: 183191 - RNA, 64 nt, Homo Sapiens
aaauguagaauugaaaaugcauuagggaaaacuuaauaaaaauuauuaccaguuauuuggaaga

SEQ ID NO: 183192 - RNA, 64 nt, Homo Sapiens
gcucaagauacuuauugaaaacauccucaauugcaauaaaaacauuauaacaugaaaaagagug

SEQ ID NO: 183193 - RNA, 64 nt, Homo Sapiens
gucuucgagauguagaaauaaggaauauucugaaaauaaaaauuauacaguaguaaagauaauu

SEQ ID NO: 183194 - RNA, 64 nt, Homo Sapiens
caggagugcccugcauuguuuucuuuuaauuagaaauaaaaaguauuagucuaaaugugguucu

SEQ ID NO: 183195 - RNA, 64 nt, Homo Sapiens
ucacagaaaugauauucugcaagaauuucuuuuaaauaaaaaguuugggggugcaauauaagaa

SEQ ID NO: 183196 - RNA, 64 nt, Homo Sapiens
uugagacagacugaauauaucuaaaauuuccagcaauaaaaaaaaaagcauuuaacuugcacca

SEQ ID NO: 183197 - RNA, 64 nt, Homo Sapiens
cuacgccaagcucugaagggcacacuacacuauuaauaaaaauggaaucauuaaauacucucuu

SEQ ID NO: 183198 - RNA, 64 nt, Homo Sapiens
aauuauccuucuguucuuagaucuguaucuucauaauaaaaaauuuugcccaaguccuguuucc

SEQ ID NO: 183199 - RNA, 64 nt, Homo Sapiens
gagccuacuucuagcuguauuuuuuguaugcuuaaauaaaaauaaaaauucauaaccaaagaga

SEQ ID NO: 183200 - RNA, 64 nt, Homo Sapiens
acuucuagcuguauuuuuuguaugcuuaaauaaaaauaaaaauucauaaccaaagagaauccca

SEQ ID NO: 183201 - RNA, 64 nt, Homo Sapiens
auguaacuuaaaucuagacaccaucaaagcauaaaauaaaaauaaaaagcguugcugaaucugg

SEQ ID NO: 183202 - RNA, 64 nt, Homo Sapiens
cuuaaaucuagacaccaucaaagcauaaaauaaaaauaaaaagcguugcugaaucugggucgaa

SEQ ID NO: 183203 - RNA, 64 nt, Homo Sapiens
auuauacuuuguacuuuugcccaaacguguaaauaauaaaaaaguuuuggcuuuuuucuuuaga

SEQ ID NO: 183204 - RNA, 64 nt, Homo Sapiens
cuuuuccguuccuuuuauuuaagucuuuuuauuuaauaaaaaaguuagcuauuucacuuaacgc

SEQ ID NO: 183205 - RNA, 64 nt, Homo Sapiens
aaaaacuuagagcacaauaaugacaacucuaaaaaauaaaaaaacuucgugucauugugauauu

SEQ ID NO: 183206 - RNA, 64 nt, Homo Sapiens
aaagaccaguaacuuuguuucuucuaguguuaggaauaaaaaaacauuugaugagcaaaaucua

SEQ ID NO: 183207 - RNA, 64 nt, Homo Sapiens
agcaauaugucauuaacaaauuaauaaugaauaaaauaaaaagccccacagagugccuagaauc

SEQ ID NO: 183208 - RNA, 64 nt, Homo Sapiens
augucuuuauaacucugauccuuagauccuuugaaauaaaaauuccccugagaucuagcugaug

SEQ ID NO: 183209 - RNA, 64 nt, Homo Sapiens
uagagaucacucuuggcugaaaaaauucugguuaaauaaaaaauaaaauauuuauuauauuggu

SEQ ID NO: 183210 - RNA, 64 nt, Homo Sapiens
guguuguauugcuugugagacaauaacugugaaaaauaaaaaagauuuaauauuugacugauuu

SEQ ID NO: 183211 - RNA, 64 nt, Homo Sapiens
ugugcucuuuacuguuuuuccaguguugugaguaaauaaaaaugaaaaguuuacauuaauuauu

SEQ ID NO: 183212 - RNA, 64 nt, Homo Sapiens
gagcaaguaauagauuuucuuguuaaguugcugaaauaaaaaguucagccugugcuguaguuaa

SEQ ID NO: 183213 - RNA, 64 nt, Homo Sapiens
augaaguacgugugugugugcagucugagaaaugaauaaaaagcguuuuguuucuuagggaaaa

SEQ ID NO: 183214 - RNA, 64 nt, Homo Sapiens
uguugaauuuucguauuguuucauauauuuaacaaauaaaaauaaggaauauauuuaauuauau

SEQ ID NO: 183215 - RNA, 64 nt, Homo Sapiens
aaaaaaaaauuauuaggcugcaacucuacaaaaaaauaaaaauugguuagcaaggcaagauccc

SEQ ID NO: 183216 - RNA, 64 nt, Homo Sapiens
uacuaguacagauuuuguuuaaaauguuaagugcaauaaaaacaaugucuuaauuuugaguuug

SEQ ID NO: 183217 - RNA, 64 nt, Homo Sapiens
ggaucuuuuacauuauagaauuauugaaacaggaaauaaaaaagacauaucaaaaaaaaccugu

SEQ ID NO: 183218 - RNA, 64 nt, Homo Sapiens
aaguuauauaguagguaguuugcaagauacuuucaauaaaaagucagaaagcauccaucaugaa

SEQ ID NO: 183219 - RNA, 64 nt, Homo Sapiens
augggaggcaaagaaaggaauuucagcagggcagaauaaaaaccugccuuugcuuuguucauaa

SEQ ID NO: 183220 - RNA, 64 nt, Homo Sapiens
cguaagcaggaagaccucuuaauggcauagcaccaauaaaaaaaugacuccuaguuguguuugg

SEQ ID NO: 183221 - RNA, 64 nt, Homo Sapiens
gcaagagggcaaggcauuuuuuaacacuuuuuaaaauaaaaauuuauaccacaacuuuaggcua

SEQ ID NO: 183222 - RNA, 64 nt, Homo Sapiens
ugcccuucuccgguuguguguacaguauguguggaauaaaaaagggaaacuguuuucacaagcu

SEQ ID NO: 183223 - RNA, 64 nt, Homo Sapiens
guuuacuuuucagguuuguacuacaagguuuaauaauaaaaacaaaguuuuuuggacauuuguc

SEQ ID NO: 183224 - RNA, 64 nt, Homo Sapiens
gggaagaaauacauuuccuaauguauuuauagaaaauaaaaauauuuuuaugugccuuuuuauu

SEQ ID NO: 183225 - RNA, 64 nt, Homo Sapiens
auuaugaucuugacaggugcacuuuacuggggagaauaaaaaggaccauacgguaaagcuggua

SEQ ID NO: 183226 - RNA, 64 nt, Homo Sapiens
aauuauugcuuuaauuagagcagcacauugcuaaaauaaaaaauacaccuuaauuuuuaagaaa

SEQ ID NO: 183227 - RNA, 64 nt, Homo Sapiens
uuuaauucuuaaauauugaggccccauugugaguaauaaaaaauacgacauaaguagaagacua

SEQ ID NO: 183228 - RNA, 64 nt, Homo Sapiens
agccuuaagucaaucucagaagguagcauaaacaaauaaaaauuaacuguauggcaugaucagu

SEQ ID NO: 183229 - RNA, 64 nt, Homo Sapiens
ggaauuguauuauuguguguauauauaauuuguaaauaaaaaguauggagaugauacgguguua

SEQ ID NO: 183230 - RNA, 64 nt, Homo Sapiens
gcuuuacuaaaagaacauaagucaagggaggaugaauaaaaacagcaaaaccaaauaaagugga

SEQ ID NO: 183231 - RNA, 64 nt, Homo Sapiens
aaguuaaaagguuguacucauuguauuuacaaagaauaaaaauauauugaauuuaaaugaacuc

SEQ ID NO: 183232 - RNA, 64 nt, Homo Sapiens
ccaauggguaagcccaugauguagccacuaguacaauaaaaaucugaaguaaaaugaggcauaa

SEQ ID NO: 183233 - RNA, 64 nt, Homo Sapiens
ggccuaaguagccauuggcaugucuagaugaacaaauaaaaauaaagauaauuucuuuaaaaua

SEQ ID NO: 183234 - RNA, 64 nt, Homo Sapiens
uagagaagacaguauuggcaaucaugacaccuguaauaaaaacuugaauccaaagucaaaacuu

SEQ ID NO: 183235 - RNA, 64 nt, Homo Sapiens
aagaaccacuugaaaucggaucauuuuauuuaaaaauaaaaaauguuaaugccaguuggccuac

SEQ ID NO: 183236 - RNA, 64 nt, Homo Sapiens
uugccccauuaacagauuucuguaaauguacagaaauaaaaacgaccuuuggggaaaauuugua

SEQ ID NO: 183237 - RNA, 64 nt, Homo Sapiens
ugguccaacgaagacacugcccaccucaaaugacaauaaaaaaccuggucaugaucucugaucu

SEQ ID NO: 183238 - RNA, 64 nt, Homo Sapiens
uaucuugaaaaacuaguggaaaaauccauauauuaauaaaaaccugucuugagcaccagaaaau

SEQ ID NO: 183239 - RNA, 64 nt, Homo Sapiens
aaaucccuaaaaacucucuaaguuucacuucaaaaauaaaaaaaugcuauaaguauguacauac

SEQ ID NO: 183240 - RNA, 64 nt, Homo Sapiens
gaauuauguggucagugcauguauaacuguguaaaauaaaaaagaauguguauuuagaauauuu

SEQ ID NO: 183241 - RNA, 64 nt, Homo Sapiens
uuuauuccauuugcuuguuuugcaauacuuuaaaaauaaaaaauuuacaaaccugugggccugu

SEQ ID NO: 183242 - RNA, 64 nt, Homo Sapiens
ucuguuucucugcaguuucacuugauaauuuaaaaauaaaaauauuuucugucuugugaaugca

SEQ ID NO: 183243 - RNA, 64 nt, Homo Sapiens
uauuuggcucuuaucccugcgugaaauaucuucuaauaaaaauaugcccagauguauacccagu

SEQ ID NO: 183244 - RNA, 64 nt, Homo Sapiens
aaaaaaaaacaaaaaaaaaaaaacaaaagaaaaaaauaaaaauacgguggcaauauuauguaac

SEQ ID NO: 183245 - RNA, 64 nt, Homo Sapiens
cauuauguguaacagauugauuuucucagcacaaaauaaaaagcaucuguauuaauguaaagau

SEQ ID NO: 183246 - RNA, 64 nt, Homo Sapiens
acccacguagguacuacugaauccaacugccaacaauaaaaagacuuuuauuuaguagaggcua

SEQ ID NO: 183247 - RNA, 64 nt, Homo Sapiens
uguugcauguauauauuaaguagccgauacucuaaauaaaaauaccacuguuacagauaaaugg

SEQ ID NO: 183248 - RNA, 64 nt, Homo Sapiens
uuauggaaaaugucaaccuuuguaagaaaaccaaaauaaaaauugaaaaauaaaaaccauaaac

SEQ ID NO: 183249 - RNA, 64 nt, Homo Sapiens
aaccuuuguaagaaaaccaaaauaaaaauugaaaaauaaaaaccauaaacauuugcaccacuug

SEQ ID NO: 183250 - RNA, 64 nt, Homo Sapiens
gauaacagagcgagacccugucucaaaaaaauaaaauaaaaaauaaaaacacccuugccugcgc

SEQ ID NO: 183251 - RNA, 64 nt, Homo Sapiens
gagcgagacccugucucaaaaaaauaaaauaaaaaauaaaaacacccuugccugcgcuccauuc

SEQ ID NO: 183252 - RNA, 64 nt, Homo Sapiens
gcaacaauuuaugaauugaauuaucuugguugaaaauaaaaagaucacuuucucaguuuucaua

SEQ ID NO: 183253 - RNA, 64 nt, Homo Sapiens
cuuugcccagaaagaagaugggggaggaggcaguaauaaaaagauugaaguauuuugcuggaau

SEQ ID NO: 183254 - RNA, 64 nt, Homo Sapiens
ucaugcauguccuguaaagguuacaagccugcacaauaaaaauguuuaacgguuaaacagucag

SEQ ID NO: 183255 - RNA, 64 nt, Homo Sapiens
cugggaucaaacuggccugcagaacaccuuuagaaauaaaaauauaacaaucagaggaacuaua

SEQ ID NO: 183256 - RNA, 64 nt, Homo Sapiens
uaugccaaagauuuucuugggcuggauaacuaaaaauaaaaauagacagucuagagacucugga

SEQ ID NO: 183257 - RNA, 64 nt, Homo Sapiens
acaguuucaaaugguaucacauuuuaaauugauaaauaaaaagcaaugaaagcaucaacagaua

SEQ ID NO: 183258 - RNA, 64 nt, Homo Sapiens
ugcucucacugucagcucucaccauuuuauacaaaauaaaaagcaaagccaguauuguuaaaau

SEQ ID NO: 183259 - RNA, 64 nt, Homo Sapiens
cuuagacuuuagggagaaaaguguaaaacuacaaaauaaaaacucaauugaaauguaaaugucu

SEQ ID NO: 183260 - RNA, 64 nt, Homo Sapiens
auuaaacagaagagcacccugcacaguuacacuuaauaaaaaaaacccuauauaaaaaucauug

SEQ ID NO: 183261 - RNA, 64 nt, Homo Sapiens
aagcauugcaaaugcuuuagaugauuuuugucugaauaaaaaaaauuuguuacguaaaguuaaa

SEQ ID NO: 183262 - RNA, 64 nt, Homo Sapiens
auccuugaaacaagugagcuagauuuuuuucaucaauaaaaauuauuaucuuuucauaucugca

SEQ ID NO: 183263 - RNA, 64 nt, Homo Sapiens
uuaucuuuucauaucugcaagaaaaugucauaggaauaaaaaaaaaaagaaaaucguaaaaaca

SEQ ID NO: 183264 - RNA, 64 nt, Homo Sapiens
acugaaauuaacauccagugugcaucaagcauacaauaaaaaaacccuuggaauugucucuaaa

SEQ ID NO: 183265 - RNA, 64 nt, Homo Sapiens
aaagaaaaucauucuguuucuggcagggaauaauaauaaaaaaauguuagauggaaaaugcuau

SEQ ID NO: 183266 - RNA, 64 nt, Homo Sapiens
gaaagcaaguggauuacacagauguuuucaccuaaauaaaaauuuaaaauaugaaauuuuguaa

SEQ ID NO: 183267 - RNA, 64 nt, Homo Sapiens
auguuaauccuuguaucauaaaacaaauaacugaaauaaaaaacuacaucaaguucauuugcag

SEQ ID NO: 183268 - RNA, 64 nt, Homo Sapiens
aagguaacuucucagaaagaucacucacuguggaaauaaaaacuuauaacacagucuuuaauuu

SEQ ID NO: 183269 - RNA, 64 nt, Homo Sapiens
aaagcuuuagaaggcaugagucagcauuguguuaaauaaaaaugauucaccuaagaauagaauc

SEQ ID NO: 183270 - RNA, 64 nt, Homo Sapiens
accuaaucuuaaaaauacaaccauggcaaaggguaauaaaaagguuuagcuuucauaagaaauc

SEQ ID NO: 183271 - RNA, 64 nt, Homo Sapiens
auauuuauuuauccacaucuuaaauugaauauugaauaaaaaauaaacauaggcuaauauagau

SEQ ID NO: 183272 - RNA, 64 nt, Homo Sapiens
uauguggaagguaaauauaucucaucuugguaucaauaaaaacucacaccagaguucuauuuac

SEQ ID NO: 183273 - RNA, 64 nt, Homo Sapiens
ucuuuacaaaaguauuauugauauuaagcaaaucaauaaaaaccaguauucuauaguaagcuuu

SEQ ID NO: 183274 - RNA, 64 nt, Homo Sapiens
ggaauuauuuugauggcucucaaccacaaucauuaauaaaaauauuaacauuucucaauaauuu

SEQ ID NO: 183275 - RNA, 64 nt, Homo Sapiens
cuuaaaaaguauacauggccuugaacuuuucaagaauaaaaaaguagucuaucuuuguauaucu

SEQ ID NO: 183276 - RNA, 64 nt, Homo Sapiens
auaaaaaagagaagauauuuaccuauuuuacuacaauaaaaaguaauggcaaauuguauguuau

SEQ ID NO: 183277 - RNA, 64 nt, Homo Sapiens
ggacuuugguuuaaaguagcgucagcuuuacaauaauaaaaaaaugcuuaaaucagaguaaaau

SEQ ID NO: 183278 - RNA, 64 nt, Homo Sapiens
auuuguauuuuuaaguuuuuuuucaaaucuuuguaauaaaaauuaguucagacucauauaugga

SEQ ID NO: 183279 - RNA, 64 nt, Homo Sapiens
auggcaacauaauucacuuuuggaaauaauuuguaauaaaaaucuugcuuauuuuuucuguuuu

SEQ ID NO: 183280 - RNA, 64 nt, Homo Sapiens
ccaaauggacuauuuguuccaggcauuaaaugacaauaaaaauuauuuguaccuauaaagcaua

SEQ ID NO: 183281 - RNA, 64 nt, Homo Sapiens
uauuugcucauaacuacuucaacagcuugcaggcaauaaaaaucauauucuccugcuccaguau

SEQ ID NO: 183282 - RNA, 64 nt, Homo Sapiens
cuuguauuucuuuaaaaaguguuuguuuuggccaaauaaaaauguccuuguaauuacauucauu

SEQ ID NO: 183283 - RNA, 64 nt, Homo Sapiens
uaucacuguauaccacuggaacucuaagcacaaaaauaaaaacugccacccuagaucagcugaa

SEQ ID NO: 183284 - RNA, 64 nt, Homo Sapiens
ugugcaagucagagaaggguauuuauaauaugggaauaaaaauuuuuucagaacuuguuuacuc

SEQ ID NO: 183285 - RNA, 64 nt, Homo Sapiens
agccugggcaacggugagacccugccucaaaaaaaauaaaaauaaaaauaaaacacuuuaauua

SEQ ID NO: 183286 - RNA, 64 nt, Homo Sapiens
ggcaacggugagacccugccucaaaaaaaauaaaaauaaaaauaaaacacuuuaauuagaaucu

SEQ ID NO: 183287 - RNA, 64 nt, Homo Sapiens
aaaaggcaaggcacaacaaaaaaauauccugggcaauaaaaaaaauauuuuaaaccagcuuugg

SEQ ID NO: 183288 - RNA, 64 nt, Homo Sapiens
acuagcaaucuauaaagugcaccaggucaacuugaauaaaaacacuaugacagacagguuugcc

SEQ ID NO: 183289 - RNA, 64 nt, Homo Sapiens
gcauggggguuaagcugauguuaaaacaguuugcaauaaaaaaaaaugaaucagcuuaagucau

SEQ ID NO: 183290 - RNA, 64 nt, Homo Sapiens
caccauuugguccucuuuaaucuuugaggguuucaauaaaaauuguucacucauaucuguguuc

SEQ ID NO: 183291 - RNA, 64 nt, Homo Sapiens
uauuucaaagcucuuuuccuaacugguuaaguaaaauaaaaaauugagcuuucuagaauauuug

SEQ ID NO: 183292 - RNA, 64 nt, Homo Sapiens
aaaaagagagaguaacuacagaagaacuuuaaaaaauaaaaaauaagcuuaccuuggauucuug

SEQ ID NO: 183293 - RNA, 64 nt, Homo Sapiens
uuuuguuuuucacaaagcucuuauuaugaagcaaaauaaaaauucuaguuucuuguaugauuuu

SEQ ID NO: 183294 - RNA, 64 nt, Homo Sapiens
uguaggagugaagacaggaucccgugcuuaaaaaaauaaaaaauaaaaaaauaaaaaaaaaaua

SEQ ID NO: 183295 - RNA, 64 nt, Homo Sapiens
gugaagacaggaucccgugcuuaaaaaaauaaaaaauaaaaaaauaaaaaaaaaauaagacuuu

SEQ ID NO: 183296 - RNA, 64 nt, Homo Sapiens
aggaucccgugcuuaaaaaaauaaaaaauaaaaaaauaaaaaaaaaauaagacuuuaacugcag

SEQ ID NO: 183297 - RNA, 64 nt, Homo Sapiens
ugcuucucgggaaagcaaagaagcugcuuuaaaaaauaaaaaggggacuaaaaauuuguuuugu

SEQ ID NO: 183298 - RNA, 64 nt, Homo Sapiens
ugcucaacaagcucagaaauuaaauauuuuuaauaauaaaaaucuguucugguuauaaaccuug

SEQ ID NO: 183299 - RNA, 64 nt, Homo Sapiens
uaaaaccccauuuuccuaaagaacaaaguaguaaaauaaaaaaaaauuuaaaaaauuaaaaaau

SEQ ID NO: 183300 - RNA, 64 nt, Homo Sapiens
guaguaaaauaaaaaaaaauuuaaaaaauuaaaaaauaaaaaaaagaggucacuaaaagaccaa

SEQ ID NO: 183301 - RNA, 64 nt, Homo Sapiens
gucaauuauuuucaaaugucuaaauuccuuuggaaauaaaaauaucaguuuuacuuugaaauug

SEQ ID NO: 183302 - RNA, 64 nt, Homo Sapiens
cuauaauuuggguauggguuguauaguauuggaaaauaaaaaugauaugcacagucuauuuuuu

SEQ ID NO: 183303 - RNA, 64 nt, Homo Sapiens
aacucaucauuuucuacuugggauguaaugcauuaauaaaaaucggguuggugauaacucuuga

SEQ ID NO: 183304 - RNA, 64 nt, Homo Sapiens
caaacuuuguauguacguuuccuaacaagauuucaauaaaaaucaaagcagaauuuguuugaua

SEQ ID NO: 183305 - RNA, 64 nt, Homo Sapiens
agacauugaaggaccaauuucauuucacgaggacaauaaaaauaacaucuuaacuguauaugaa

SEQ ID NO: 183306 - RNA, 64 nt, Homo Sapiens
ccuuaaacagugcacggauuaaaauucuugcuuuaauaaaaauuggaaacguaauuuggauuau

SEQ ID NO: 183307 - RNA, 64 nt, Homo Sapiens
ggaaaggaaacuuugaaccucaaaauauaaaauaaauaaaaaaaauuauggaaaaaaaacauug

SEQ ID NO: 183308 - RNA, 64 nt, Homo Sapiens
uggugcuuaauuaaccaugauaagaaaaauguauaauaaaaauguaauauccucuuagggaaca

SEQ ID NO: 183309 - RNA, 64 nt, Homo Sapiens
uuuauuguguacucuguucgauucaguguuuaaaaauaaaaauauuuuauaugaaagauguaca

SEQ ID NO: 183310 - RNA, 64 nt, Homo Sapiens
ugacagagcaagacuccaucucaaaaaaaaaauaaauaaaaaaaaaugcagcugcaggagugag

SEQ ID NO: 183311 - RNA, 64 nt, Homo Sapiens
ccuggcucacaggaagugcucagauauguuaaguaauaaaaaguuaauguggugggugcagugg

SEQ ID NO: 183312 - RNA, 64 nt, Homo Sapiens
gacuguuucagugugagucagaaugugaaaaaggaauaaaaaauacuguugggcucaaacuaaa

SEQ ID NO: 183313 - RNA, 64 nt, Homo Sapiens
aaaagcacauguauugacaacaguuuuauaauuuaauaaaaaggaauacauugcaauccguaau

SEQ ID NO: 183314 - RNA, 64 nt, Homo Sapiens
aagauuuacaucuuucuuacuaaggaaaagaguuaauaaaaauuguucuuuauuuuacaggcag

SEQ ID NO: 183315 - RNA, 64 nt, Homo Sapiens
ucgauugaauuggaccuuuucaguuguucagaaaaauaaaaauaauuucucauauuaaauacag

SEQ ID NO: 183316 - RNA, 64 nt, Homo Sapiens
uaaucaggcuauacauaaguauuguauuuauuugaauaaaaauaaaaagagcaacccauaaucc

SEQ ID NO: 183317 - RNA, 64 nt, Homo Sapiens
ggcuauacauaaguauuguauuuauuugaauaaaaauaaaaagagcaacccauaauccuagucc

SEQ ID NO: 183318 - RNA, 64 nt, Homo Sapiens
ucuuguuuauuaacucuccuuuauucuauauggaaauaaaaaggaggcagucauguuagcaaau

SEQ ID NO: 183319 - RNA, 64 nt, Homo Sapiens
uuuuugucgugucuauaaaggaagaacaaaacaaaauaaaaacagagcccuagagaaaugcugu

SEQ ID NO: 183320 - RNA, 64 nt, Homo Sapiens
uuguguuuuuuucuggaacuacuucaagugagaaaauaaaaaaaaauggugacaaagcuguaca

SEQ ID NO: 183321 - RNA, 64 nt, Homo Sapiens
auagagauaauagaagacaaagagauuaaaaggaaauaaaaaugcaugauuaaaaacuaagaau

SEQ ID NO: 183322 - RNA, 64 nt, Homo Sapiens
aaaaggaaauaaaaaugcaugauuaaaaacuaagaauaaaaaaccuauuuuuauguuuccuaaa

SEQ ID NO: 183323 - RNA, 64 nt, Homo Sapiens
uuucuaccauuacugaacauuaggacaaacacaaaauaaaaaacaaaacacagacaacggugcu

SEQ ID NO: 183324 - RNA, 64 nt, Homo Sapiens
ucugaccauuucuuguucuguuuccaaugaaaucaauaaaaaaaaagaaguacuuuaaaugggg

SEQ ID NO: 183325 - RNA, 64 nt, Homo Sapiens
auuuacaugauagguuaacauaaacagguguaccaauaaaaagauagcaaucaaucauaauuag

SEQ ID NO: 183326 - RNA, 64 nt, Homo Sapiens
agaagaaaaaagagaaacccccaucucccccgccaauaaaaaagauaaauaacaaguuauagua

SEQ ID NO: 183327 - RNA, 64 nt, Homo Sapiens
uguacaugugauuaaaagaaugaauucaguaauaaauaaaaaugacauauucugcaucccucac

SEQ ID NO: 183328 - RNA, 64 nt, Homo Sapiens
ggaaaaauguguuuacuauaaacaaagcuguuuuaauaaaaaaauaguauguaaauuauauuuc

SEQ ID NO: 183329 - RNA, 64 nt, Homo Sapiens
accuugcaugauucuuguuaugaauauaaagcuuaauaaaaacauguaauauuuagcuguaaac

SEQ ID NO: 183330 - RNA, 64 nt, Homo Sapiens
gacaaauucggauguaugaucaaguccuauccuaaauaaaaaaagccuucugaaaugugacccc

SEQ ID NO: 183331 - RNA, 64 nt, Homo Sapiens
uucuguguaaaaaguacucauuagaacugauuuuaauaaaaauacccuaaucugcauaaaugaa

SEQ ID NO: 183332 - RNA, 64 nt, Homo Sapiens
aaggaaaugcauuaaauagaacuccaucucuauaaauaaaaaaaagccugggcaacauagcgag

SEQ ID NO: 183333 - RNA, 64 nt, Homo Sapiens
acuuuaguuugcuaaccaaccuguacaucccauaaauaaaaaauuccguaagacccaauaguua

SEQ ID NO: 183334 - RNA, 64 nt, Homo Sapiens
gaaacacaacucuacuaguauaauaaaaguaaaaaauaaaaauaaucuguauuaaaaauaaaau

SEQ ID NO: 183335 - RNA, 64 nt, Homo Sapiens
cuuuuugacagcuuuuugagaccucuuaagaaaaaauaaaaaguaaaaaaugaaaggaaucuuu

SEQ ID NO: 183336 - RNA, 64 nt, Homo Sapiens
gguuucugcuguauuaaugacaauuauucaugaaaauaaaaaaugaaauauuuuguauacuacu

SEQ ID NO: 183337 - RNA, 64 nt, Homo Sapiens
gaacccuuccugagcuuuaugguccuaaaagcaaaauaaaaacuauucgaaugaaaagacaaga

SEQ ID NO: 183338 - RNA, 64 nt, Homo Sapiens
aucaacuuugaagacacaaaaguuaauuggaagaaauaaaaacugugaacgaagaauaccuuuc

SEQ ID NO: 183339 - RNA, 64 nt, Homo Sapiens
gauacuuaaaauaaauggcuaaaaugcacuuuuuaauaaaaacuaccuagaucauaaauuaauc

SEQ ID NO: 183340 - RNA, 64 nt, Homo Sapiens
cuuuuaaaauuuuguuuguuauaauggugaaggaaauaaaaagggauauuuguauuguaaaaca

SEQ ID NO: 183341 - RNA, 64 nt, Homo Sapiens
auagacacagaaagguuuggugcaccgauauucaaauaaaaaugucugaaaucuuucuaccugu

SEQ ID NO: 183342 - RNA, 64 nt, Homo Sapiens
ugcauauauuuaagguguacauugaguuaugacaaauaaaaaaucaguuguuuucuuuuuuuaa

SEQ ID NO: 183343 - RNA, 64 nt, Homo Sapiens
acagcaaucucugauucuguaagaugucaaauugaauaaaaaucuuacuaguuucauucuaauc

SEQ ID NO: 183344 - RNA, 64 nt, Homo Sapiens
uauuuuaaccuauuugggaauuauucuaacauuuaauaaaaauguuugugaauuguguauaaau

SEQ ID NO: 183345 - RNA, 64 nt, Homo Sapiens
uuuaggagaauuugagaaguuugcuucugaaaguaauaaaaaauguugauaccuugcaauagua

SEQ ID NO: 183346 - RNA, 64 nt, Homo Sapiens
gauuauacugaguaguagaaagaagcuaauuugaaauaaaaauuauuuguauaauuaagaaagc

SEQ ID NO: 183347 - RNA, 64 nt, Homo Sapiens
cuguagguauuugucuuaagauuuuuggcuguuuaauaaaaauguaacuuuaacgguuucuuau

SEQ ID NO: 183348 - RNA, 64 nt, Homo Sapiens
guacacauaagugugugugucucaggaaguaggaaauaaaaauggaagcuauuaugaccucaaa

SEQ ID NO: 183349 - RNA, 64 nt, Homo Sapiens
gauguaaacuugauuauuuuauugcuaauuuaaaaauaaaaaugacuuuguauugauugugaaa

SEQ ID NO: 183350 - RNA, 64 nt, Homo Sapiens
cuugacuuuaacaucagcauuauaaaaagugucaaauaaaaaauuaccaucauuaucauuaaaa

SEQ ID NO: 183351 - RNA, 64 nt, Homo Sapiens
acuacuuugucgguugcucugaggguuaaaugaaaauaaaaagaaaaugugaaacagcaccaca

SEQ ID NO: 183352 - RNA, 64 nt, Homo Sapiens
ccggccuacaagaacaaaacuccaucucaaaauaaauaaaaaaauaaauaaaaauaaaaauaga

SEQ ID NO: 183353 - RNA, 64 nt, Homo Sapiens
aacaaaacuccaucucaaaauaaauaaaaaaauaaauaaaaauaaaaauagacuauauauaguc

SEQ ID NO: 183354 - RNA, 64 nt, Homo Sapiens
acuccaucucaaaauaaauaaaaaaauaaauaaaaauaaaaauagacuauauauagucuuugaa

SEQ ID NO: 183355 - RNA, 64 nt, Homo Sapiens
gaauucauuuauuuuaaauaaaugaauaaaauaaaauaaaaaagaauauucagucguuggcaca

SEQ ID NO: 183356 - RNA, 64 nt, Homo Sapiens
aauuuccuuaggagugcagagggcucauugggaaaauaaaaauaauaaaaauaaauaaaacuuc

SEQ ID NO: 183357 - RNA, 64 nt, Homo Sapiens
aggagugcagagggcucauugggaaaauaaaaauaauaaaaauaaauaaaacuuccuaaaagaa

SEQ ID NO: 183358 - RNA, 64 nt, Homo Sapiens
agcaagacuccgucucacaaaaaugaauaaauaaaauaaaaauaaaaauguuacuuuuuaaaaa

SEQ ID NO: 183359 - RNA, 64 nt, Homo Sapiens
acuccgucucacaaaaaugaauaaauaaaauaaaaauaaaaauguuacuuuuuaaaaaguaacu

SEQ ID NO: 183360 - RNA, 64 nt, Homo Sapiens
aaauuuugucaauuucauguaauuuacccuuugcaauaaaaaugauucauuaaauauauaacua

SEQ ID NO: 183361 - RNA, 64 nt, Homo Sapiens
uguaacaagccugcacauguaccccagaaucuaaaauaaaaauaaaaagaaaaacaaagaaugu

SEQ ID NO: 183362 - RNA, 64 nt, Homo Sapiens
aagccugcacauguaccccagaaucuaaaauaaaaauaaaaagaaaaacaaagaauguacucua

SEQ ID NO: 183363 - RNA, 64 nt, Homo Sapiens
gccaucagagcaaauuuggggguuucucaaauaaaauaaaaauaaaaacaaauacuguguuuca

SEQ ID NO: 183364 - RNA, 64 nt, Homo Sapiens
agagcaaauuuggggguuucucaaauaaaauaaaaauaaaaacaaauacuguguuucagaagcg

SEQ ID NO: 183365 - RNA, 64 nt, Homo Sapiens
agaggcaagaggcuggauuuugaauuuucuuuuuaauaaaaaggcaccuauaaaacaggucaau

SEQ ID NO: 183366 - RNA, 64 nt, Homo Sapiens
gagacccccggaacaagccuaaaaauuguuucaaaauaaaaaccaagaagaugucuucacauau

SEQ ID NO: 183367 - RNA, 64 nt, Homo Sapiens
aaacaacaacaaaaacaaaaaaagaagaaaacuaaauaaaaauaaaaauaaaaauaagauccac

SEQ ID NO: 183368 - RNA, 64 nt, Homo Sapiens
caacaaaaacaaaaaaagaagaaaacuaaauaaaaauaaaaauaaaaauaagauccacuucucu

SEQ ID NO: 183369 - RNA, 63 nt, Homo Sapiens
aaacaaaaaaagaagaaaacuaaauaaaaauaaaaauaaaaauaagauccacuucucucugcc

SEQ ID NO: 183370 - RNA, 64 nt, Homo Sapiens
aguaaccuuauauuuaaaagaugauuuugcaaaaaauaaaaaauaaaaaauaugccuucuggag

SEQ ID NO: 183371 - RNA, 64 nt, Homo Sapiens
uuauauuuaaaagaugauuuugcaaaaaauaaaaaauaaaaaauaugccuucuggagugauguc

SEQ ID NO: 183372 - RNA, 64 nt, Homo Sapiens
gaaucuuuguauaucaaaauuacauugucaguguaauaaaaacaauuguaaauagucuuuguug

SEQ ID NO: 183373 - RNA, 64 nt, Homo Sapiens
gaagaagaaagaauaaagcugauaauauguuauuaauaaaaauaguugaacucugguuaaacaa

SEQ ID NO: 183374 - RNA, 64 nt, Homo Sapiens
uuccaacagggucagcugccaccuugcagugguaaauaaaaaauugugacacuuuggagcaaaa

SEQ ID NO: 183375 - RNA, 64 nt, Homo Sapiens
uuucaguagucuuugcaucaaugucaaacugccaaauaaaaauagaauuuuaaauuauccagag

SEQ ID NO: 183376 - RNA, 64 nt, Homo Sapiens
caaccucaagcugucacccuuauacaaauaaaaaaauaaaaaccugcuaccacagagauuguac

SEQ ID NO: 183377 - RNA, 64 nt, Homo Sapiens
uaaaaacccaaccucaagcugauuguacuauacaaauaaaaaaauauauuucugcuaccacaga

SEQ ID NO: 183378 - RNA, 64 nt, Homo Sapiens
ugagucacagcuuuuguucuauaauaguuuaugaaauaaaaacaaaaucuauucacuuuaacuu

SEQ ID NO: 183379 - RNA, 64 nt, Homo Sapiens
uccagucaauuauuccucaaaacuacuuuaaagaaauaaaaaaugucuuaacuugaccugggau

SEQ ID NO: 183380 - RNA, 64 nt, Homo Sapiens
uuaaaaauuaagagauauacuuuauuuuuaagggaauaaaaauucuucuauucaaaaucuuuuu

SEQ ID NO: 183381 - RNA, 64 nt, Homo Sapiens
aagaaaauguagauuagaaaagagguagagcagaaauaaaaaggaaucaugugagaacucagga

SEQ ID NO: 183382 - RNA, 64 nt, Homo Sapiens
uguauucuccuaacugaaauaaacugaaaauaaaaauaaaaauaagagugagacuccaucucaa

SEQ ID NO: 183383 - RNA, 64 nt, Homo Sapiens
aaaauauguauucuccuaacucucaaaaacugaaaauaaaaauaggugacagagugagacucca

SEQ ID NO: 183384 - RNA, 64 nt, Homo Sapiens
ucucagcaacaguggaauucauauaaccuaugccaauaaaaaugacacacacacacacacaaac

SEQ ID NO: 183385 - RNA, 64 nt, Homo Sapiens
uguucaauggaugaauuucucauaauaggugcucaauaaaaaugcuggaacagugucuggugca

SEQ ID NO: 183386 - RNA, 64 nt, Homo Sapiens
cauucccaggaaaauacgaaaaucccaugagauaaauaaaaauauaggugaugggcagaucuuu

SEQ ID NO: 183387 - RNA, 64 nt, Homo Sapiens
aaaaauauaggugaugggcagaucuuuucuuuaaaauaaaaaagcaaaaacucuugugguaccu

SEQ ID NO: 183388 - RNA, 64 nt, Homo Sapiens
uaaaauccugcuauaggagaaaaaaagagaaaaaaauaaaaaucaaaaaaaaaaaaaagaaaga

SEQ ID NO: 183389 - RNA, 64 nt, Homo Sapiens
ccaaguacuuuguauuguauacgugagucauaauaauaaaaagaagaagaaaaauaauagaagc

SEQ ID NO: 183390 - RNA, 64 nt, Homo Sapiens
cuaagcugagaaguagauuguuacccaguaaugaaauaaaaaauaaaaauaaaaggauuuuuuu

SEQ ID NO: 183391 - RNA, 64 nt, Homo Sapiens
gagaaguagauuguuacccaguaaugaaauaaaaaauaaaaauaaaaggauuuuuuucucuauu

SEQ ID NO: 183392 - RNA, 64 nt, Homo Sapiens
ggcagcuaaauuuuucaguuccaugugccucccaaauaaaaaacagaaaauaaguaguuuuugu

SEQ ID NO: 183393 - RNA, 64 nt, Homo Sapiens
aagaauccugacuuuuuuauauuuggaaacaucaaauaaaaauggaaaaaaugaucauggcuuu

SEQ ID NO: 183394 - RNA, 64 nt, Homo Sapiens
uaucaugcuauacaggugcaacucaauccccguuaauaaaaaccaauguagguauaggcauucu

SEQ ID NO: 183395 - RNA, 64 nt, Homo Sapiens
uuuacugcuguuacuauuugauuagaauguauuaaauaaaaaaaaccugauuucuacaaguugc

SEQ ID NO: 183396 - RNA, 64 nt, Homo Sapiens
ugguggugaggaggaagaacaaauaauagaagaaaauaaaaaugagauagaagaaaaguaagaa

SEQ ID NO: 183397 - RNA, 64 nt, Homo Sapiens
uuuguuuauaccagucuuaaagauccagguucugaauaaaaaaauuaauugauacaauugaugu

SEQ ID NO: 183398 - RNA, 64 nt, Homo Sapiens
acuuauugugaaaguugugcuguuuucuaaguaaaauaaaaaauaaaaaauuagcaauuuauga

SEQ ID NO: 183399 - RNA, 64 nt, Homo Sapiens
gugaaaguugugcuguuuucuaaguaaaauaaaaaauaaaaaauuagcaauuuaugauagccag

SEQ ID NO: 183400 - RNA, 64 nt, Homo Sapiens
ccuuugagccuauacuauacuguguauguguggaaauaaaaauguauuguacuuuuggagaauu

SEQ ID NO: 183401 - RNA, 64 nt, Homo Sapiens
acaguugugcaagauaugaaugguuucacacucaaauaaaaaauauugaaacgaccugcuuucu

SEQ ID NO: 183402 - RNA, 64 nt, Homo Sapiens
uuucgacacuggacuggaagaacaagucuauaaaaauaaaaauggacaauuaacaguggugagu

SEQ ID NO: 183403 - RNA, 64 nt, Homo Sapiens
guuggagaacgaaugaauacaaauuuuauuguaaaauaaaaauguauauaaagcauaugagcac

SEQ ID NO: 183404 - RNA, 64 nt, Homo Sapiens
acugucaugcucaugcaugaauagaauuuagucaaauaaaaaauuuuggucauuugguacugac

SEQ ID NO: 183405 - RNA, 64 nt, Homo Sapiens
uauggaugaaaguauucaucacaauauuauuuauaauaaaaaauugcaaauguuauaaaugaac

SEQ ID NO: 183406 - RNA, 64 nt, Homo Sapiens
aaaugugaacacugaauuuauuuuaaaaaauaauaauaaaaauuuaaaaaaauuaaaaauaaaa

SEQ ID NO: 183407 - RNA, 64 nt, Homo Sapiens
uaaaaaauaauaauaaaaauuuaaaaaaauuaaaaauaaaaaaaaccacagaaaacaacuuuac

SEQ ID NO: 183408 - RNA, 64 nt, Homo Sapiens
auuaugggaggggaacauuaugucggaauauaagaauaaaaagguguaguacuacuuaaaagca

SEQ ID NO: 183409 - RNA, 64 nt, Homo Sapiens
aaauuuaucucagcuucuguuuucuucuguuuaaaauaaaaauaaaaauguaaccccuuuuucc

SEQ ID NO: 183410 - RNA, 64 nt, Homo Sapiens
cugaauguacacgacauuauguucuuuguuuuaaaauaaaaauugauuuucuauuguuacucug

SEQ ID NO: 183411 - RNA, 64 nt, Homo Sapiens
cacguagcugaggccggauguccuggagccuuugaauaaaaaugguucucacuguucccucugc

SEQ ID NO: 183412 - RNA, 64 nt, Homo Sapiens
gaaggaaauugagauuagaguaauuuugccaaauaauaaaaacaaauauuuauuuuuuuaagcg

SEQ ID NO: 183413 - RNA, 64 nt, Homo Sapiens
auccuuuugauaaauuuaaaugcuuuaaaauaaaaauaaaaacagucugauccauauuuaauaa

SEQ ID NO: 183414 - RNA, 64 nt, Homo Sapiens
aaaacaauccuuuugauaaauaauaaugcuuuaaaauaaaaauauuucaagucugauccauauu

SEQ ID NO: 183415 - RNA, 64 nt, Homo Sapiens
agaaaaauuaauacuaucaugaagagcuaauuuuaauaaaaauagauuuguuaguaacaaucuu

SEQ ID NO: 183416 - RNA, 64 nt, Homo Sapiens
aagauuuguuaguaacaaucugccccagcacaguaauaaaaaucgaacuuagugauuaaaaucu

SEQ ID NO: 183417 - RNA, 64 nt, Homo Sapiens
aauaaauaaauaaaauuaaauaaaaaaaaauaaaaauaaaaauagggaauaaagugcuaaagug

SEQ ID NO: 183418 - RNA, 64 nt, Homo Sapiens
aaaauaaauaaauaaauaaaaaaguguaaaaaaaaauaaaaauaacuucagggaauaaagugcu

SEQ ID NO: 183419 - RNA, 64 nt, Homo Sapiens
aauuguuuucauuaccucagucucaaaaaauaaaaauaaaaaaaggugacagagcgagaccaug

SEQ ID NO: 183420 - RNA, 64 nt, Homo Sapiens
aaaaaaaauuguuuucauuaaccaugucucaaaaaauaaaaauaagccugggugacagagcgag

SEQ ID NO: 183421 - RNA, 64 nt, Homo Sapiens
accacauuugauagagauuccuugucaguuguugaauaaaaaaaagugcagcuguagaaaagug

SEQ ID NO: 183422 - RNA, 64 nt, Homo Sapiens
caacccacccccugcccuuugaaagcagguuuaaaauaaaaagaugacaagaguauuugguagg

SEQ ID NO: 183423 - RNA, 64 nt, Homo Sapiens
aauucauuuaagaagagaugcuuuauaaaauagcaauaaaaaauauuuuuaggaaaauauuaag

SEQ ID NO: 183424 - RNA, 64 nt, Homo Sapiens
uaccuuuuucagguuucaauucccuaucaaaacaaauaaaaauacugaacuaaaacugaugggu

SEQ ID NO: 183425 - RNA, 64 nt, Homo Sapiens
uugaaugcuuucuaacaaaauuuuggauuuucuaaauaaaaauaucuuuauauuugauuguguu

SEQ ID NO: 183426 - RNA, 64 nt, Homo Sapiens
acacauuuguguauguuuaauuacauucuuauacaauaaaaaggauuaacacuaaagaaaacaa

SEQ ID NO: 183427 - RNA, 64 nt, Homo Sapiens
guaugagucuucuguaauucaauuuccaggaaaaaauaaaaagauaguaaagcuuuucuuuuuu

SEQ ID NO: 183428 - RNA, 64 nt, Homo Sapiens
aauuuugccugccauuuucaaaguaauugccuacaauaaaaagauaaagccaaauuuccaguuu

SEQ ID NO: 183429 - RNA, 64 nt, Homo Sapiens
acuuagcuaggcauguugccaaauaaaaaauaaaaauaaaaaaaguuagaccucaucucuacaa

SEQ ID NO: 183430 - RNA, 64 nt, Homo Sapiens
aaaaaaacuuagcuaggcaucuacaaaaauaaaaaauaaaaauaaacauaguuagaccucaucu

SEQ ID NO: 183431 - RNA, 64 nt, Homo Sapiens
aaaaauaaaaaaaacuuagccucaucucuacaaaaauaaaaaaugccuggaaacauaguuagac

SEQ ID NO: 183432 - RNA, 64 nt, Homo Sapiens
auucuguuucuuucguuagauaaauuaaccuagcaauaaaaaaugacuauuauuaucuuuguaa

SEQ ID NO: 183433 - RNA, 64 nt, Homo Sapiens
ugaauaccacaaaagauguuuccagacaucaagcaauaaaaaaaggucuaguuucgguaacugu

SEQ ID NO: 183434 - RNA, 64 nt, Homo Sapiens
guuuuaaaaacugaucaaguaaaaaaauuuaaaaaauaaaaaaauaauauaaaauaaaaacuua

SEQ ID NO: 183435 - RNA, 64 nt, Homo Sapiens
uaaaaaaaauuuaaaaaauauguagauaauauaaaauaaaaacuuaagggaaaaacuuuuacuu

SEQ ID NO: 183436 - RNA, 64 nt, Homo Sapiens
gaugaaaaaaaaaaaggcuuguguauuuucuuacaauaaaaaauauuauucacacuuucaaacu

SEQ ID NO: 183437 - RNA, 64 nt, Homo Sapiens
acaaaguuuuauuaaagauuauuuauucaucaggaauaaaaaaauuuuauuuuauuuuuuuggu

SEQ ID NO: 183438 - RNA, 64 nt, Homo Sapiens
agacaccaucucaaaaaauacauauaauaauauaaauaaaaauaucuuuuuugaaaauaauuua

SEQ ID NO: 183439 - RNA, 64 nt, Homo Sapiens
auuuaccaguugaagauguucgcuuucagaauauaauaaaaauagucaaaaacuuuguguuucu

SEQ ID NO: 183440 - RNA, 64 nt, Homo Sapiens
gcagugaacuuaaagcaaagaccucuuaguaaaaaauaaaaaaaaauaaaaaauaaaaauaaaa

SEQ ID NO: 183441 - RNA, 64 nt, Homo Sapiens
uaaagcaaagaccucuuaguaaaaaauaaaaaaaaauaaaaaauaaaaauaaaaaaaguuaaau

SEQ ID NO: 183442 - RNA, 64 nt, Homo Sapiens
aagaccucuuaguaaaaaauaaaaaaaaauaaaaaauaaaaauaaaaaaaguuaaauuuauuua

SEQ ID NO: 183443 - RNA, 64 nt, Homo Sapiens
ucuuaguaaaaaauaaaaaaaaauaaaaaauaaaaauaaaaaaaguuaaauuuauuuauagaaa

SEQ ID NO: 183444 - RNA, 64 nt, Homo Sapiens
gagaaacuaugggaaaaaaaauugcaaaaucuaaaauaaaaaaugcaaaaucuaaaauaaaaaa

SEQ ID NO: 183445 - RNA, 64 nt, Homo Sapiens
uugcaaaaucuaaaauaaaaaaugcaaaaucuaaaauaaaaaauggaaaggaaacuuugaaccu

SEQ ID NO: 183446 - RNA, 64 nt, Homo Sapiens
ggaaacaugguuuggauuauaaaauucuugcuuuaauaaaaauuucuuaaacagugaaaaaaag

SEQ ID NO: 183447 - RNA, 64 nt, Homo Sapiens
cuuccggagucuuugaagcugaaaauauaaaacaaauaaaaaauaaaaaaauaaaaacccacaa

SEQ ID NO: 183448 - RNA, 64 nt, Homo Sapiens
agucuuugaagcugaaaauauaaaacaaauaaaaaauaaaaaaauaaaaacccacaaaaauguu

SEQ ID NO: 183449 - RNA, 64 nt, Homo Sapiens
aagcugaaaauauaaaacaaauaaaaaauaaaaaaauaaaaacccacaaaaauguugaaccaaa

SEQ ID NO: 183450 - RNA, 64 nt, Homo Sapiens
agcaguaaaauuauauacugauaugaaaaaaaagaauaaaaaguccuaauaucauaguuguaca

SEQ ID NO: 183451 - RNA, 64 nt, Homo Sapiens
aaaugauagugcauuuuggucuuccuguaaacuaaauaaaaaaagcaaccuguacuuacagauu

SEQ ID NO: 183452 - RNA, 64 nt, Homo Sapiens
uacaggucacuuuaaaagcaguauuaaugauuauaauaaaaagucacugcuaccuucuuugauu

SEQ ID NO: 183453 - RNA, 64 nt, Homo Sapiens
aaauaaaagcacugcuaccuaacugcuugaugacaauaaaaaguuuugcugaaaauuccuagaa

SEQ ID NO: 183454 - RNA, 64 nt, Homo Sapiens
uuaauuauuauuucuugccaaaaaguuuuguuuuaauaaaaaauucuuaauaacucccaaugua

SEQ ID NO: 183455 - RNA, 64 nt, Homo Sapiens
caaauaaauauuucauuuuuacaacauaaagcacaauaaaaaugaagagaacaacauaaagcaa

SEQ ID NO: 183456 - RNA, 64 nt, Homo Sapiens
ucucacacucagugugucccuccuucacaaauugaauaaaaaacaacauuuuguucuaaaacug

SEQ ID NO: 183457 - RNA, 64 nt, Homo Sapiens
ggugcagauaaaaugucaaauuuuugauuuuuguaauaaaaauuuauuguaaugaauuuuuacu

SEQ ID NO: 183458 - RNA, 64 nt, Homo Sapiens
caaucuggcaacagagcgagaccuugucuuuaaaaauaaaaauaaaaacaucuuuacaacauuc

SEQ ID NO: 183459 - RNA, 64 nt, Homo Sapiens
ggcaacagagcgagaccuugucuuuaaaaauaaaaauaaaaacaucuuuacaacauuccuguuu

SEQ ID NO: 183460 - RNA, 64 nt, Homo Sapiens
uuuagucaucagagauacuuuccuaaaaaggaaaaauaaaaaacaaaauggugccacuuugggu

SEQ ID NO: 183461 - RNA, 64 nt, Homo Sapiens
uuuugagaugucauacuguacacuguauuguaaaaauaaaaaguaaaauuauauuucaaauuuu

SEQ ID NO: 183462 - RNA, 64 nt, Homo Sapiens
acauacauuguaucuuuguuuuaugguaauaaguaauaaaaauguagacuucauauuuuguaca

SEQ ID NO: 183463 - RNA, 64 nt, Homo Sapiens
acuucauauuuuguacaaaauguccuauguacagaauaaaaaaguucauagaaacagcaaauau

SEQ ID NO: 183464 - RNA, 64 nt, Homo Sapiens
uaaaggauuguugauaacccgggaaaaaaauaaaaauaaaaaauuauauugguucgaaauccca

SEQ ID NO: 183465 - RNA, 64 nt, Homo Sapiens
aaaaauuaaaggauuguugaaucccagggaaaaaaauaaaaauauaggaguauauugguucgaa

SEQ ID NO: 183466 - RNA, 64 nt, Homo Sapiens
aaauaaggaauccuuuuaaaauaaaaaauaaaaaaauaaaaacagccagaccuugucucaaaaa

SEQ ID NO: 183467 - RNA, 64 nt, Homo Sapiens
uaaaaacaaaauaaggaauccucaaaaaauaaaaaauaaaaaaagagagagagccagaccuugu

SEQ ID NO: 183468 - RNA, 64 nt, Homo Sapiens
aaaaaaauaaaaacaaaauaaccuugucucaaaaaauaaaaaauccugagagagagagagccag

SEQ ID NO: 183469 - RNA, 64 nt, Homo Sapiens
uauuuuauccuucuugguggacuauaagacuauaaauaaaaacuaaguuaaggcuucccccuuu

SEQ ID NO: 183470 - RNA, 64 nt, Homo Sapiens
auguuguacauacugccgaauuccauuccauggaaauaaaaaguuagucucaguucguguuuga

SEQ ID NO: 183471 - RNA, 64 nt, Homo Sapiens
gucugucuccaucgucucaucggggcaggccagcaauaaaaacuuggaggccagcuaagccacu

SEQ ID NO: 183472 - RNA, 64 nt, Homo Sapiens
aagaauuaaaaguuugauuauuuucauuuaccagaauaaaaacuuucuuuuugauuauuuuuug

SEQ ID NO: 183473 - RNA, 64 nt, Homo Sapiens
cuuuuugauuauuuuuuguuaacugucaaugacaaauaaaaauuguuuuacuuaauuuauauug

SEQ ID NO: 183474 - RNA, 64 nt, Homo Sapiens
augaaauauggugaggucacuauuugggcucugaaauaaaaauuuuugccugaguguauuuuac

SEQ ID NO: 183475 - RNA, 64 nt, Homo Sapiens
cugguugcagcacauucacacccuaaagcaguaaaauaaaaaacguguugagauuuacguggaa

SEQ ID NO: 183476 - RNA, 64 nt, Homo Sapiens
aaauaaaauggauagaaaaauccauuaauaacugaauaaaaaauucaaaggaucuuuuguccau

SEQ ID NO: 183477 - RNA, 64 nt, Homo Sapiens
caaucuccugcuaauagguauauguggaccuauaaauaaaaaucugguuauuuccuugaagcuu

SEQ ID NO: 183478 - RNA, 64 nt, Homo Sapiens
aaacccuuacauuuaaaagauagguaaauaaaacaauaaaaagauucucaguuucuuagaaucc

SEQ ID NO: 183479 - RNA, 64 nt, Homo Sapiens
aaaaaaaaacaaaaacaaacuuagugaauuuggaaauaaaaagaggauuuaauguaccuuuuug

SEQ ID NO: 183480 - RNA, 64 nt, Homo Sapiens
ggcaugcaguuuuuuuuuuauuuuuuuguccugaaauaaaaaguuuacuuuuucauuccuuccu

SEQ ID NO: 183481 - RNA, 64 nt, Homo Sapiens
caguauaacaguuauuuaaaauaaaaauaauacaaauaaaaauagaucaaaaauauuagaaaaa

SEQ ID NO: 183482 - RNA, 64 nt, Homo Sapiens
auacaaauaaaaauacaguaaaaauauuagaaaaaauaaaaauaauuaaaccaauugcagauca

SEQ ID NO: 183483 - RNA, 64 nt, Homo Sapiens
cacaccuggaaguguaugugugucuuuuugugaaaauaaaaaucguauguggggaagacauugu

SEQ ID NO: 183484 - RNA, 64 nt, Homo Sapiens
ugucucuagauacagaugcacuuacuggagcgagaauaaaaagucucuucaaggcgagaugauc

SEQ ID NO: 183485 - RNA, 64 nt, Homo Sapiens
auuuuuauuuuuuaguuuguuuuccaaaaaacuaaauaaaaaucuugccaauuauuuuguuaua

SEQ ID NO: 183486 - RNA, 64 nt, Homo Sapiens
guaaaauuuggccgggcacauaggggaaaaagcaaauaaaaauaacuauccauguagucaaauc

SEQ ID NO: 183487 - RNA, 64 nt, Homo Sapiens
gaaaaaaacuauuuccuauaugaaaacuugaaauaauaaaaagaucaauaauuauggauuuuua

SEQ ID NO: 183488 - RNA, 64 nt, Homo Sapiens
uuacgaacuuucucuguaacagagucaauaauucaauaaaaaagccgacgaaccgacacgcggc

SEQ ID NO: 183489 - RNA, 64 nt, Homo Sapiens
uauggcacaccuuuuguuuaguuuucuaugauuuaauaaaaauagaaaagauuuguauacaaau

SEQ ID NO: 183490 - RNA, 64 nt, Homo Sapiens
auucuuaaaguugaggguuaugguugauguaaguaauaaaaaacuuaacuaucuuuuaaauucg

SEQ ID NO: 183491 - RNA, 64 nt, Homo Sapiens
ucauuuuagcaacucuaaaaaaaaaaaaaauacaaauaaaaaggaaaaaaaauuacauuuuuua

SEQ ID NO: 183492 - RNA, 64 nt, Homo Sapiens
uuuugugguugaucuagacagaugcuagauaaugaauaaaaacugguuuagggccauauccaga

SEQ ID NO: 183493 - RNA, 64 nt, Homo Sapiens
gacuuuuauauuaugggagggaaaaaauaacauuaauaaaaaggugauaaaaaagcacuguuuc

SEQ ID NO: 183494 - RNA, 64 nt, Homo Sapiens
ucuauuuuuuucuuuuuuuccaaaaaaagaaaguaauaaaaacuuaaauucuuuguaccaguua

SEQ ID NO: 183495 - RNA, 64 nt, Homo Sapiens
gguauccgucacgggucuuccuguuuuguauuuaaauaaaaacaacagcagcaggcugucccug

SEQ ID NO: 183496 - RNA, 64 nt, Homo Sapiens
cgcauggagauucucuagcuguuagguagaccuaaauaaaaaguucucaauagauuccucuuuu

SEQ ID NO: 183497 - RNA, 64 nt, Homo Sapiens
cuggaguagugauaaacaccuuaaucauaaaaugaauaaaaacaaaaaaaccauggggcuuguc

SEQ ID NO: 183498 - RNA, 64 nt, Homo Sapiens
ugggcaacacagcgagacuccgucucaaggaaaaaauaaaaauaaaaagcgggcacgggcccgu

SEQ ID NO: 183499 - RNA, 64 nt, Homo Sapiens
acacagcgagacuccgucucaaggaaaaaauaaaaauaaaaagcgggcacgggcccgugacauc

SEQ ID NO: 183500 - RNA, 64 nt, Homo Sapiens
aagaaaacaaaauauaagggaaaaauaugagaaaaauaaaaauaaaaagagaauaauaggccag

SEQ ID NO: 183501 - RNA, 64 nt, Homo Sapiens
acaaaauauaagggaaaaauaugagaaaaauaaaaauaaaaagagaauaauaggccaggcacug

SEQ ID NO: 183502 - RNA, 64 nt, Homo Sapiens
gccuauguccguucaucccugagaggucugaaagaauaaaaauaaauucuaaaaaaagccucug

SEQ ID NO: 183503 - RNA, 64 nt, Homo Sapiens
gcacucuggugcgggaagaagcagaagcaaaaaaaauaaaaauaaaaaaauaaauaaaaauaaa

SEQ ID NO: 183504 - RNA, 64 nt, Homo Sapiens
uggugcgggaagaagcagaagcaaaaaaaauaaaaauaaaaaaauaaauaaaaauaaaaaaaau

SEQ ID NO: 183505 - RNA, 64 nt, Homo Sapiens
aagcagaagcaaaaaaaauaaaaauaaaaaaauaaauaaaaauaaaaaaaauaaaaaaggaaaa

SEQ ID NO: 183506 - RNA, 64 nt, Homo Sapiens
aagcaaaaaaaauaaaaauaaaaaaauaaauaaaaauaaaaaaaauaaaaaaggaaaaaaaaaa

SEQ ID NO: 183507 - RNA, 64 nt, Homo Sapiens
aaauaaaaauaaaaaaauaaauaaaaauaaaaaaaauaaaaaaggaaaaaaaaaaaagaagaaa

SEQ ID NO: 183508 - RNA, 64 nt, Homo Sapiens
aaacucuauugguguguuguaaaacaauaauaauaauaaaaagcuagcuauuuguuuuuauugu

SEQ ID NO: 183509 - RNA, 64 nt, Homo Sapiens
aacuuuuguaucuuuuauccggcuuuauuaaagaaauaaaaaagugggagaguaaaccuugaag

SEQ ID NO: 183510 - RNA, 64 nt, Homo Sapiens
auuugaaagagaaugacucuuuuauugucauuucaauaaaaaaugaucacuguucuuuuuuuau

SEQ ID NO: 183511 - RNA, 64 nt, Homo Sapiens
auuagagcaaaggaguuugcaucaaauuugggggaauaaaaaauaaaaauacugauaaauucgg

SEQ ID NO: 183512 - RNA, 64 nt, Homo Sapiens
uacuuucacauacuuuuuauaaaauuugcucuguaauaaaaaucuaaagcauugaauugauaga

SEQ ID NO: 183513 - RNA, 64 nt, Homo Sapiens
ccucuccagccuuaaguauuauaaauuuaucaagaauaaaaaugaugucauaagaauuuauuau

SEQ ID NO: 183514 - RNA, 64 nt, Homo Sapiens
gacccaacucagcucugacuaagcccugauccacaauaaaaaugcugaccggugcuuauccucu

SEQ ID NO: 183515 - RNA, 64 nt, Homo Sapiens
ccuuagguaaauaagucauuccccacuuuugagaaauaaaaaaguagaaaccagcccuuuuucc

SEQ ID NO: 183516 - RNA, 64 nt, Homo Sapiens
uaaaagggaaauuugaacaacaaaaaccaaaaaaaauaaaaauaaaaaacuucaaaaguugaca

SEQ ID NO: 183517 - RNA, 64 nt, Homo Sapiens
ggaaauuugaacaacaaaaaccaaaaaaaauaaaaauaaaaaacuucaaaaguugacaagaagg

SEQ ID NO: 183518 - RNA, 64 nt, Homo Sapiens
uggacaacacagugagaccucaucucuaucaaaaaauaaaaauuagcuagaugugguggcauga

SEQ ID NO: 183519 - RNA, 64 nt, Homo Sapiens
uugggcaacagagcaagacccugucuccgaaacaaauaaaaaauacuguaauaaaaguacuuau

SEQ ID NO: 183520 - RNA, 64 nt, Homo Sapiens
ugaaaaaggaaaaucagcaauucagcaaaaaauaaauaaaaaauaaaaauguaaauaugauagu

SEQ ID NO: 183521 - RNA, 64 nt, Homo Sapiens
ggaaaaucagcaauucagcaaaaaauaaauaaaaaauaaaaauguaaauaugauaguaauaaaa

SEQ ID NO: 183522 - RNA, 64 nt, Homo Sapiens
agaacccugaaauuuauauaggugagacaauagaaauaaaaagaucuucagccaggccuuucug

SEQ ID NO: 183523 - RNA, 64 nt, Homo Sapiens
guuuuaaaaaaauaauuaaaaaacaguuggcguuaauaaaaaugucaaugugaaacugaugucc

SEQ ID NO: 183524 - RNA, 64 nt, Homo Sapiens
caaaauagugagagacccuguaucugaaaguaauaauaaaaauaaaaaauauaaaugaggucuc

SEQ ID NO: 183525 - RNA, 64 nt, Homo Sapiens
agugagagacccuguaucugaaaguaauaauaaaaauaaaaaauauaaaugaggucucguugau

SEQ ID NO: 183526 - RNA, 64 nt, Homo Sapiens
gccugggcaacaaagcaagacucugucucaaaaaaauaaaaauaaaaaaaaaaucuuaguucca

SEQ ID NO: 183527 - RNA, 64 nt, Homo Sapiens
gcaacaaagcaagacucugucucaaaaaaauaaaaauaaaaaaaaaaucuuaguuccauggaau

SEQ ID NO: 183528 - RNA, 64 nt, Homo Sapiens
gcaagaaagggagaccuaagggugaacaguggccaauaaaaacccuagagaacaaacauccauu

SEQ ID NO: 183529 - RNA, 64 nt, Homo Sapiens
uuuuggguugguuguucugucuuuuuuuuaauuaaauaaaaacauuuuuaaaauguucucuucu

SEQ ID NO: 183530 - RNA, 64 nt, Homo Sapiens
aacggggaaugaaggcaggaaggaggcuggaauaaauaaaaauaaaaauagacaaguaagacag

SEQ ID NO: 183531 - RNA, 64 nt, Homo Sapiens
gaaugaaggcaggaaggaggcuggaauaaauaaaaauaaaaauagacaaguaagacagcauaaa

SEQ ID NO: 183532 - RNA, 64 nt, Homo Sapiens
acuaacauuacagacauguaaucuuuguuaaaaaaauaaaaaguaaguauaauaaaaagcaaug

SEQ ID NO: 183533 - RNA, 64 nt, Homo Sapiens
aaugaucuuuguuaaaaaaaauuugauaaaguauaauaaaaagcuacuuuuguuacuagauuga

SEQ ID NO: 183534 - RNA, 64 nt, Homo Sapiens
uaaaaaaguucagugugugugccauaggaaucaaaauaaaaaacgaauguagauaccuugucca

SEQ ID NO: 183535 - RNA, 64 nt, Homo Sapiens
aaauuggcauuaaaaguauaaaauaucacaucacaauaaaaaucuuuauuuuuagcauacuguu

SEQ ID NO: 183536 - RNA, 64 nt, Homo Sapiens
uugaaguuuugguaaaaauucuuuuuucuuuuuuaauaaaaaauuagguuauuacuuuuuuuau

SEQ ID NO: 183537 - RNA, 64 nt, Homo Sapiens
ucuuugguugucccuauuaacaaaaaaguauuuuaauaaaaaauugaaaugagugagucauauu

SEQ ID NO: 183538 - RNA, 64 nt, Homo Sapiens
gaugcuccaugaggaaaaucccuguccacauuggaauaaaaaagacauuuuuguuacaaaguuu

SEQ ID NO: 183539 - RNA, 64 nt, Homo Sapiens
auguacauauugacaaauauucauuuauucaacaaauaaaaaguauguacaaaacaugauacag

SEQ ID NO: 183540 - RNA, 64 nt, Homo Sapiens
uuauguacuaauucaacuguaggggaaaacuuuaaauaaaaacuguaaaugaagcuugcuugga

SEQ ID NO: 183541 - RNA, 64 nt, Homo Sapiens
aaugggagauuguuuucaggcaaauuuaauccauaauaaaaaaaguuagaugauaugucugacc

SEQ ID NO: 183542 - RNA, 64 nt, Homo Sapiens
ccugggcgacagagcaagacucugucucaaaaaaaauaaaaaauaaucagggcacaguggcuca

SEQ ID NO: 183543 - RNA, 64 nt, Homo Sapiens
accagccuggugaacauggcgaaaccccgucucuaauaaaaauacaaaaauuagccgggcaugg

SEQ ID NO: 183544 - RNA, 64 nt, Homo Sapiens
cagccugggcaacaagagcaaaacuccgucucaaaauaaaaagaaaagaaaagaauggacagug

SEQ ID NO: 183545 - RNA, 64 nt, Homo Sapiens
gggggacagagcacgacccugucuccaaaaauaaaauaaaaauaaaaauaaauauuggcggggg

SEQ ID NO: 183546 - RNA, 64 nt, Homo Sapiens
cagagcacgacccugucuccaaaaauaaaauaaaaauaaaaauaaauauuggcgggggaacccu

SEQ ID NO: 183547 - RNA, 64 nt, Homo Sapiens
acguggcuuaguccaucagcaucuuauucuggguaauaaaaaauaaaaauaaacggauaccugu

SEQ ID NO: 183548 - RNA, 64 nt, Homo Sapiens
uuaguccaucagcaucuuauucuggguaauaaaaaauaaaaauaaacggauaccuguuuuccac

SEQ ID NO: 183549 - RNA, 64 nt, Homo Sapiens
auauuuaugaacuauauuucucauugcacucuguaauaaaaagcaguuaguuguuacuuaccua

SEQ ID NO: 183550 - RNA, 64 nt, Homo Sapiens
auggauauuuguauuuuuuauacuuuuguguaauaauaaaaauacugcuguaaauauucuuguu

SEQ ID NO: 183551 - RNA, 64 nt, Homo Sapiens
cugggcgacagagugagacucccucucaaaagaaaauaaaaauaaaaauaaacuggccaggugc

SEQ ID NO: 183552 - RNA, 64 nt, Homo Sapiens
gacagagugagacucccucucaaaagaaaauaaaaauaaaaauaaacuggccaggugcgguggc

SEQ ID NO: 183553 - RNA, 64 nt, Homo Sapiens
cugggcaagagagagagacuuugucucuauuaaaaauaaaaaugauuggccgagcaugguggug

SEQ ID NO: 183554 - RNA, 64 nt, Homo Sapiens
ugggaccacaggcugcaccauaagacccacucacaauaaaaaaauaaaaggccgagccgggcau

SEQ ID NO: 183555 - RNA, 64 nt, Homo Sapiens
aaaggccgagccgggcaugguugcucacucccguaauaaaaaaauaaaagaacaggcugagccg

SEQ ID NO: 183556 - RNA, 64 nt, Homo Sapiens
cuaggcaacauaguaagaccucaucucuacuaaaaauaaaaaaaaacagccagguguguuaguc

SEQ ID NO: 183557 - RNA, 64 nt, Homo Sapiens
caaucaaguugcugcagccuaugcacuggcccagaauaaaaaacguggugauucugcuaaagcu

SEQ ID NO: 183558 - RNA, 64 nt, Homo Sapiens
cuaagggcucaggaaccaguucaaaaaaauaaaaaauaaaaaauugacagaaugagacucugug

SEQ ID NO: 183559 - RNA, 64 nt, Homo Sapiens
aaaaaaucuaagggcucaggcucugugucaaaaaaauaaaaaaugccugggugacagaaugaga

SEQ ID NO: 183560 - RNA, 64 nt, Homo Sapiens
auauaucagacaucgacauguucuauguuuuuauaauaaaaauaugaauuauguaugaaaauua

SEQ ID NO: 183561 - RNA, 64 nt, Homo Sapiens
aaggacaggaggaagacagguaaauguaucuuauaauaaaaaggcuuuucuucuauggggucua

SEQ ID NO: 183562 - RNA, 64 nt, Homo Sapiens
agaaauaaaauuacaggagcgagcaaaaauuaguaauaaaaauaagcuacagugacagauuuua

SEQ ID NO: 183563 - RNA, 64 nt, Homo Sapiens
agaaauagcuacagugacagucuaaauguuuguuaauaaaaauaacguacuaccuaaaaggaug

SEQ ID NO: 183564 - RNA, 64 nt, Homo Sapiens
cugaaaugaucaaauaacuacaaaugaucuguugaauaaaaauaguugagcugauauauguuaa

SEQ ID NO: 183565 - RNA, 64 nt, Homo Sapiens
uuuuaugugcuuucaucacaaauccaaaggaaagaauaaaaauuucuuaacacaacccagcggu

SEQ ID NO: 183566 - RNA, 64 nt, Homo Sapiens
cccuaauguucuuccuuuuacauccuggaacaacaauaaaaacauuuuuuuaaacuugucuacu

SEQ ID NO: 183567 - RNA, 64 nt, Homo Sapiens
uuuuuuuuuuuuuuuuuacugcauguuacauugaaauaaaaacaaaguaaaaugagcaauugcc

SEQ ID NO: 183568 - RNA, 64 nt, Homo Sapiens
auagauuuuaaugggaaaauuauaauucagauuaaauaaaaaacaauucccuuuucccuguugu

SEQ ID NO: 183569 - RNA, 64 nt, Homo Sapiens
ucccacugcugggccucuaucuccaugacaacaaaauaaaaacagagguugcuugacucauuac

SEQ ID NO: 183570 - RNA, 64 nt, Homo Sapiens
aauguuugccuuuuccccauaaacugcauuugcaaauaaaaauaugagcacuaacuauuggcag

SEQ ID NO: 183571 - RNA, 64 nt, Homo Sapiens
aucuaaauccagaaaauggcuauaaauaugugagaauaaaaacaguaaaauauuaaagcauuaa

SEQ ID NO: 183572 - RNA, 64 nt, Homo Sapiens
cauuuuuuucaagcagggagauaaaaaaaauaaaaauaaaaaaaauccccucaaaaaaauaaaa

SEQ ID NO: 183573 - RNA, 64 nt, Homo Sapiens
aaaaaacauuuuuuucaagcauaaaaauaaaaaaaauaaaaauaugugcaauccccucaaaaaa

SEQ ID NO: 183574 - RNA, 64 nt, Homo Sapiens
auaaaaauaaaaaaacauuucucaaaaaaauaaaaauaaaaaaagaaauaaacugugcaauccc

SEQ ID NO: 183575 - RNA, 64 nt, Homo Sapiens
aaaaaaauaaaaauaaaaaaaauccccucaaaaaaauaaaaauauguuuggaaauaaacugugc

SEQ ID NO: 183576 - RNA, 64 nt, Homo Sapiens
auuguuuccagcuuuaucaaagacauguuugaaaaauaaaaagcauccaagugagagcugguga

SEQ ID NO: 183577 - RNA, 64 nt, Homo Sapiens
ugucaaauacagacaaaggauuugagauguucucaauaaaaagaaaauguuucacuacucuggu

SEQ ID NO: 183578 - RNA, 64 nt, Homo Sapiens
acaaagggcacauauacgugacucagauugacuaaauaaaaaguaaacccaagaagggcacuaa

SEQ ID NO: 183579 - RNA, 64 nt, Homo Sapiens
aaccuagugcugauucacagaaggauaauuauccaauaaaaaaaaacuguuaaacaacucuuua

SEQ ID NO: 183580 - RNA, 64 nt, Homo Sapiens
cugggccuuacuuguuuuuuaaaaugucuuagaaaauaaaaauuauuuaugcccuuauauccca

SEQ ID NO: 183581 - RNA, 64 nt, Homo Sapiens
cacagguaauuuaguaucuuuagugaaugcagaaaauaaaaauaaaucaauggauauccuucag

SEQ ID NO: 183582 - RNA, 64 nt, Homo Sapiens
cuuaugaaauagagaguguccuaaauaucacugaaauaaaaaguaggaaaaagaagcuugaauu

SEQ ID NO: 183583 - RNA, 64 nt, Homo Sapiens
uguaauaaauuauuuuuuagaucuugaaauuuauaauaaaaauacuuuaccuacccugaucacc

SEQ ID NO: 183584 - RNA, 64 nt, Homo Sapiens
guuuuauauuguuuugacugccuuuuuuuguagaaauaaaaauugaccuuagaauuuaucguca

SEQ ID NO: 183585 - RNA, 64 nt, Homo Sapiens
uucuaagaugcugcgaucccguucugcugcccguaauaaaaaugcucucagacacugguuaguc

SEQ ID NO: 183586 - RNA, 64 nt, Homo Sapiens
aucaaacuuaaaacuguguugcaaagcauuuugaaauaaaaaaagaacaguaauucauuuaauu

SEQ ID NO: 183587 - RNA, 64 nt, Homo Sapiens
gcaggcuggaaugaucucaguccuucugccuacaaauaaaaaguugccccucaaccuaucccgu

SEQ ID NO: 183588 - RNA, 64 nt, Homo Sapiens
aaagcuggaaaauuacuuaaaacaggaaagugucaauaaaaaaacuugagcaacaccaacauau

SEQ ID NO: 183589 - RNA, 64 nt, Homo Sapiens
gagcugcugaauuugugccccuggauuggaagcaaauaaaaaaaaaaaacaacacauaaacuaa

SEQ ID NO: 183590 - RNA, 64 nt, Homo Sapiens
ccuaauuauguaaaaagaauauaauaccuguggaaauaaaaaugaauuccaaguguauacuugc

SEQ ID NO: 183591 - RNA, 64 nt, Homo Sapiens
ccaccaaaaccuauggaaauuuaaaaaaaacaaaaauaaaaagcaaaacaaaaaucccaaaaug

SEQ ID NO: 183592 - RNA, 64 nt, Homo Sapiens
guuggauuuuuguguaugucuuauuuauguauguaauaaaaaaauggucauuuaaagucaauau

SEQ ID NO: 183593 - RNA, 64 nt, Homo Sapiens
auguguuucucuuauggauugcuauuaaugggcuaauaaaaaacgguguuauuggaagaaaaau

SEQ ID NO: 183594 - RNA, 64 nt, Homo Sapiens
aaagugauuucacggaugugucuauguggaaaaaaauaaaaauauuguaguugacaugaaguca

SEQ ID NO: 183595 - RNA, 64 nt, Homo Sapiens
gaaaugguguuaaucugaaauagaguugccuaagaauaaaaauuguuucacuggaaagugucaa

SEQ ID NO: 183596 - RNA, 64 nt, Homo Sapiens
gaaaaaaguauucuucagaguugaaauuuuccauaauaaaaauucucuauacuuuuguauaugu

SEQ ID NO: 183597 - RNA, 64 nt, Homo Sapiens
uaacuucuugauuuauuguuguuacauaauuugaaauaaaaauauauugauuguguccccaguu

SEQ ID NO: 183598 - RNA, 64 nt, Homo Sapiens
ucagagugucucauguuuaaugcaaaauaaaaagaauaaaaauugauauuucguguucuuucac

SEQ ID NO: 183599 - RNA, 64 nt, Homo Sapiens
auaaaaauuucagagugucuuucuuucacugcaaaauaaaaagauuuugaaaagauauuucgug

SEQ ID NO: 183600 - RNA, 64 nt, Homo Sapiens
aaguauauaauucaaugguuaccauuuuaauuauaauaaaaauaauuaauauaaaguaaaauuc

SEQ ID NO: 183601 - RNA, 64 nt, Homo Sapiens
cucugacgaugauuguguuuacuggauuuaucuuaauaaaaagauaugugaauacacaaauuuu

SEQ ID NO: 183602 - RNA, 64 nt, Homo Sapiens
agccaaaguugaucagaaugguguaugcuuccugaauaaaaaggaaaauguauaaaaagaauua

SEQ ID NO: 183603 - RNA, 64 nt, Homo Sapiens
cagucuuaauuccagauuuauugauauugacuacaauaaaaaucaucugcaacaauauguaaag

SEQ ID NO: 183604 - RNA, 64 nt, Homo Sapiens
cccagggagggaagugugagcaagccccagcagcccucaacaggcucggcgcccaccacccccu

SEQ ID NO: 183605 - RNA, 64 nt, Homo Sapiens
caagugugaccccacugccagacuucugugggccccucaacagcgauauggugcagagaagcug

SEQ ID NO: 183606 - RNA, 64 nt, Homo Sapiens
aaucuccgauaugauaaguuaaagccauugauggccucaacagaaguugacuccagaggacaug

SEQ ID NO: 183607 - RNA, 64 nt, Homo Sapiens
ccagggcucagguacaagcccugcuggaacucauccucaacaagaucaaggagacaaacacaag

SEQ ID NO: 183608 - RNA, 64 nt, Homo Sapiens
uucugcccauagacggggaugacucagcacuaccccucaacagagaugacuuugaugacucugc

SEQ ID NO: 183609 - RNA, 64 nt, Homo Sapiens
cacuaccccuuaacagggaugacuccgcacugccccucaacagggaugacucagcagagaugac

SEQ ID NO: 183610 - RNA, 64 nt, Homo Sapiens
agggaugacucagcagggaugacucagcaccgccccucaacaggcaugacucugcagagaugac

SEQ ID NO: 183611 - RNA, 64 nt, Homo Sapiens
aacagggaugacucagggauggcuuaguacugccccucaacagggaugacucagcagggaugac

SEQ ID NO: 183612 - RNA, 64 nt, Homo Sapiens; identical to SEQ ID NO: 183610

SEQ ID NO: 183613 - RNA, 64 nt, Homo Sapiens
uacugccccucagcagggaugacucagcacugccccucaacagggaugacucagcagggaugac

SEQ ID NO: 183614 - RNA, 64 nt, Homo Sapiens
uacugccccucagcagggaugacucagcaccgccccucaacagggaugacucagcacugccccu

SEQ ID NO: 183615 - RNA, 64 nt, Homo Sapiens
caccgccccucaacagggaugacucagcacugccccucaacagggaugacucagcagggaugac

SEQ ID NO: 183616 - RNA, 64 nt, Homo Sapiens
agggaugacucagcagggaugacucagcaccaccccucaacagggaugacucagcagggaugac

SEQ ID NO: 183617 - RNA, 64 nt, Homo Sapiens
agggaugacucagcagggaugacucagcacugccccucaacagggaugacugcagggaugacuc

SEQ ID NO: 183618 - RNA, 64 nt, Homo Sapiens; identical to SEQ ID NO: 183610

SEQ ID NO: 183619 - RNA, 64 nt, Homo Sapiens
agggauggcucagcagggaugacucagcauugccccucaacagggaugacucagcagacucagc

SEQ ID NO: 183620 - RNA, 64 nt, Homo Sapiens
ucagcagacucagcagggaugacucagcacugccccucaacagacaugacucagcagggaugac

SEQ ID NO: 183621 - RNA, 64 nt, Homo Sapiens
ggaggcccagccaggccuccaagcaccaugaugaccucaacaguaguuaaucagaauaaagcgg

SEQ ID NO: 183622 - RNA, 64 nt, Homo Sapiens
gagaaaccccgucucuauuagaguucgagaccagccucaacaugggcggaucaccugaggucag

SEQ ID NO: 183623 - RNA, 64 nt, Homo Sapiens
uuaauaaaauucaacaucccuucauuuuaaaaacccucaacaaauuacacauugagggaacaua

SEQ ID NO: 183624 - RNA, 64 nt, Homo Sapiens
cagaaauaaaggcauauaccuacaaccaugugauccucaacaaaacugacaagcaaugaaguaa

SEQ ID NO: 183625 - RNA, 64 nt, Homo Sapiens; identical to SEQ ID NO: 173401

SEQ ID NO: 183626 - RNA, 64 nt, Homo Sapiens; identical to SEQ ID NO: 173402

SEQ ID NO: 183627 - RNA, 64 nt, Homo Sapiens; identical to SEQ ID NO: 173403

SEQ ID NO: 183628 - RNA, 64 nt, Homo Sapiens; identical to SEQ ID NO: 173404

SEQ ID NO: 183629 - RNA, 64 nt, Homo Sapiens
augccccuguuccuuuguugcgggugguuuugguaaggcagagcccucugcugagaauguagua

SEQ ID NO: 183630 - RNA, 64 nt, Homo Sapiens
gcuuccagaccuguggaacgaagaggauggggaaaaggcagagggcacugagugucccuuuaaa

SEQ ID NO: 183631 - RNA, 64 nt, Homo Sapiens
cuauuucuuuuuccugaaauucgugauugcaacaaaggcagagggggcggggcgggggagggga

SEQ ID NO: 183632 - RNA, 64 nt, Homo Sapiens
gcagagggcacccgggcgguaguccgggacgcgcaaggcagagcccugacgcuccggguccccg

SEQ ID NO: 183633 - RNA, 64 nt, Homo Sapiens
ccacaugcaagucucccugaggguucugccccuaaaggcagacugccucaugcccgcuagcugu

SEQ ID NO: 183634 - RNA, 64 nt, Homo Sapiens
ucaugcaccuauagucccagcugcucaggaggcuaaggcagaaagaccauucaagcccaggagu

SEQ ID NO: 183635 - RNA, 64 nt, Homo Sapiens
gagagcgcugagaagacuguaucaggaaaggagaaaggcagaggagugcugaucgugucucagc

SEQ ID NO: 183636 - RNA, 64 nt, Homo Sapiens
uaacgugcggaaacauuugauggaccgcgugugaaaggcagaacgugcccccgcugaaccuggc

SEQ ID NO: 183637 - RNA, 64 nt, Homo Sapiens
aagcaggggagacagguuuaaggaggaaaugggcaaggcagaguagacuuccucugguuuccuc

SEQ ID NO: 183638 - RNA, 64 nt, Homo Sapiens
caacuucuggccgacgagaaauggccgaggagacaaggcagaagagcaggccauucuggaugcc

SEQ ID NO: 183639 - RNA, 64 nt, Homo Sapiens
uuggucaucuuucugugaaauuguguuuccagauaaggcagauugauauagacaguacuuuaac

SEQ ID NO: 183640 - RNA, 64 nt, Homo Sapiens
guuuauugugaauauguaauauuagaggcuaauaaaggcagaauaauggaucacucuugauuua

SEQ ID NO: 183641 - RNA, 64 nt, Homo Sapiens
gggugaggagaccuagcaugaaccuaagacacagaaggcagacuuguuuggaaaauagcgaauu

SEQ ID NO: 183642 - RNA, 64 nt, Homo Sapiens
ggucccuaguggguauauuucuugccacuaagagaaggcagagaucaagguuguugauggggaa

SEQ ID NO: 183643 - RNA, 64 nt, Homo Sapiens
gacagcuuaauaaaugccagggaaucugaccuggaaggcagaugggagggggcuggucuggcug

SEQ ID NO: 183644 - RNA, 64 nt, Homo Sapiens
uacuuauauacagucuuucaagagagauacaaacaaggcagaaacauuuaaacuaguauuaaag

SEQ ID NO: 183645 - RNA, 64 nt, Homo Sapiens
uugaaagcucccauuuaaaaagagaagccugaaaaaggcagagucuggggcucugggguagaug

SEQ ID NO: 183646 - RNA, 64 nt, Homo Sapiens
auuaaaccaucucaucgucuggguggggggagaaaaggcagauagacaggaagcugcugggugg

SEQ ID NO: 183647 - RNA, 64 nt, Homo Sapiens
ggagaucauuuaguugggucggaaaagaguaucaaaggcagaaacaaggaugaaagacaaagaa

SEQ ID NO: 183648 - RNA, 64 nt, Homo Sapiens
cacaaccacucaccaguccugaucaaagcuaggaaaggcagaaaacaaagacagggaauagugg

SEQ ID NO: 183649 - RNA, 64 nt, Homo Sapiens
uuuaucuaaaucacuggaaaggcuggaggagcagaaggcagaggccaccacuggacuauugguu

SEQ ID NO: 183650 - RNA, 64 nt, Homo Sapiens
ggugguaaaagaggguugcauuucuugcagccagaaggcagagaaagugaagaccaaguccaga

SEQ ID NO: 183651 - RNA, 64 nt, Homo Sapiens
cagggcuccucuagccucaugacccggguaaguaaaggcagacccgagggcuagggcuagagca

SEQ ID NO: 183652 - RNA, 64 nt, Homo Sapiens
cuccucuggugggagggugcagguuucucacaccaaggcagauggggcccugagagggaaggag

SEQ ID NO: 183653 - RNA, 64 nt, Homo Sapiens
cccuggauucaaauccgccaagaaagaaagaaaaaaggcagaagcaaaaaaaaaaaaagaaaaa

SEQ ID NO: 183654 - RNA, 64 nt, Homo Sapiens
uugcagugagccaagaucacucgccugaacccagaaggcagaggggaggcugaggcaggagaaa

SEQ ID NO: 183655 - RNA, 64 nt, Homo Sapiens
auguggaugaauucaggcacggaggcugccuaugaaggcagaagugcuggaacuggagccaagg

SEQ ID NO: 183656 - RNA, 64 nt, Homo Sapiens
acuggcaagaaaugaggaagauaaauguuaugaaaaggcagaauugaccagauaucuuguuggc

SEQ ID NO: 183657 - RNA, 64 nt, Homo Sapiens
cauucuccuggcugcugggacuggccuggagggcaaggcagaugucucuccaagugcaucuagc

SEQ ID NO: 183658 - RNA, 64 nt, Homo Sapiens
agaugggacugucaaaguuguugggaugucaccaaaggcagagccagagaauacugaccucacc

SEQ ID NO: 183659 - RNA, 64 nt, Homo Sapiens
uuuaaaucucuggucacuuuaagacccuaaauaaaaggcagacagcuccacucaaaaacuaagg

SEQ ID NO: 183660 - RNA, 64 nt, Homo Sapiens
cacuaacagugcucaugugccuuccagacgguucaaggcagaggccacugugcucaguguaguc

SEQ ID NO: 183661 - RNA, 64 nt, Homo Sapiens
auaacuggggucaucgggaaaggcaaagaaacugaaggcagaguccuaacguugcaucuuauuc

SEQ ID NO: 183662 - RNA, 64 nt, Homo Sapiens
uugucuuuccugaaugacuuucuaacugugcagaaaggcagaaaagucaucauauguauauguc

SEQ ID NO: 183663 - RNA, 64 nt, Homo Sapiens
gucacaaagcaccuauguguagaagcuaggguucaaggcagaucugugauuccagaagcuguuc

SEQ ID NO: 183664 - RNA, 64 nt, Homo Sapiens
cuuagauucauugucuauggguacauuuuauaaaaaggcagauucuaguucagugucauaagga

SEQ ID NO: 183665 - RNA, 64 nt, Homo Sapiens
cugagggggcugggcgagcuggccaaagguggcuaaggcagaggaccuaaguuuggacucucgg

SEQ ID NO: 183666 - RNA, 64 nt, Homo Sapiens
aggcagaagggauggaauuuagcuaaaggccaccaaggcagaacgcccagggcuccggaggugc

SEQ ID NO: 183667 - RNA, 64 nt, Homo Sapiens
gccucaguucuuccuuccacagggauuuucaggaaaggcagaagcucguggaggaugggcaucu

SEQ ID NO: 183668 - RNA, 64 nt, Homo Sapiens
uggggagggucagcugccugcaugacuuuucuggaaggcagagccucgaaaauaggcagaccgu

SEQ ID NO: 183669 - RNA, 64 nt, Homo Sapiens
cagcagagaaugccaugcggccuguguaagaauuaaggcagauuuauaugcacugaugaggaaa

SEQ ID NO: 183670 - RNA, 64 nt, Homo Sapiens
uuaaaggaguaugaggugggugacccaggacagagaacgcuacuggauccugggagguucagca

SEQ ID NO: 183671 - RNA, 64 nt, Homo Sapiens
aauuucucauacuuagaaacaagaccaaaggaaggaacgcuaaccuuguggugagggguguggg

SEQ ID NO: 183672 - RNA, 64 nt, Homo Sapiens
gcaguaguugauguugugugguguaauauugugagaacgcuacuuuccuaaaugguauuuucaa

SEQ ID NO: 183673 - RNA, 64 nt, Homo Sapiens
gggaaaaugcauuuucuucaagaauuuuaguccugaacgcuacguuagaagcaaagauuucagu

SEQ ID NO: 183674 - RNA, 64 nt, Homo Sapiens
uaaugcugcaaacuuaauguucuuaugcaaaauggaacgcuaaugaaacacagcuuacaaucgc

SEQ ID NO: 183675 - RNA, 64 nt, Homo Sapiens
ugaggacucugguugaaggaucaaaggauaaaaugaacgcuauuacuuuauauaaaaggaugac

SEQ ID NO: 183676 - RNA, 64 nt, Homo Sapiens
gggugggggccggggcuggcccugggacccccaggaacgcuaagacacaggcuccaguaggggc

SEQ ID NO: 183677 - RNA, 64 nt, Homo Sapiens
acaguuagcuccucagaaaggugaaugugagcaagaacgcuacaguucgagguaugacauucua

SEQ ID NO: 183678 - RNA, 64 nt, Homo Sapiens
uagauuuaacccuaagguaagaugcugggguauagaacgcuaagaauuuucccccaaggacucu

SEQ ID NO: 183679 - RNA, 64 nt, Homo Sapiens
ugggaagcuauuuuuuucagaauugcacauaguagaacgcuaucuugaauauuauuccucaaaa

SEQ ID NO: 183680 - RNA, 64 nt, Homo Sapiens
gguuuguccuuagacaaucuugacuaaacaacuugaacgcuaguuguacucacagagaacuaau

SEQ ID NO: 183681 - RNA, 64 nt, Homo Sapiens
uauuaagaauuuugaaaugguuuuguuuuacagagaacgcuagaacaauaaaacuguugucagc

SEQ ID NO: 183682 - RNA, 64 nt, Homo Sapiens
aaacccccaaaugccccaaaauccaaaccuuccugaacgcuaugacaccaugaguggaaaauuc

SEQ ID NO: 183683 - RNA, 64 nt, Homo Sapiens
uucuaagcagccagcagugaccgcgcccggccgugaacgcuauugggauuacaggcuugagcua

SEQ ID NO: 183684 - RNA, 64 nt, Homo Sapiens
ugugguguucgcuaucucuugugucaaaucuggugaacgcuacgcuuacauauauugucuuugu

SEQ ID NO: 183685 - RNA, 64 nt, Homo Sapiens
ugaugccacacauucucucucaauuucagcuucggaacgcuaugaaaauaauacaugauuaaag

SEQ ID NO: 183686 - RNA, 64 nt, Homo Sapiens
cgacagggugucuuaugcaaaggcugacuugccugaacgcuaagaacaugacuucugucugagc

SEQ ID NO: 183687 - RNA, 64 nt, Homo Sapiens
aaguuucagacaagcagagacuucaccucccagugaacgcuaaguuacggucagccuuauuccc

SEQ ID NO: 183688 - RNA, 64 nt, Homo Sapiens
aaugauuuuuuuuuuuuuuuaauaaacugacagagaacgcuacuuuuacuugauuucuuuccac

SEQ ID NO: 183689 - RNA, 64 nt, Homo Sapiens
caagaaauauuuguuuuacucugcccucaaucuagaacgcuacaguuuauuuuaccauugacug

SEQ ID NO: 183690 - RNA, 64 nt, Homo Sapiens
aacaugaacugaacgguuaaaagcacagucuauggaacgcuaauggagucagccccuaaagcug

SEQ ID NO: 183691 - RNA, 64 nt, Homo Sapiens
gaaccaccuuuuccagccagaguucccaaagcuggaacgcuagcugccugcucuuccuuaagau

SEQ ID NO: 183692 - RNA, 64 nt, Homo Sapiens
uuggggcugguuugguuuuugacaccugaaaugcgaacgcuaugugcuaaauuugucaccguau

SEQ ID NO: 183693 - RNA, 64 nt, Homo Sapiens
uuggaacucagagagguggcuauugcauugcgcagaacgcuacagagcccaugcucuucccaga

SEQ ID NO: 183694 - RNA, 64 nt, Homo Sapiens
ccuucgaccccagcgggcuaccugaaccaaggcgucucuuuaaguggggcgcccgaagucauuu

SEQ ID NO: 183695 - RNA, 64 nt, Homo Sapiens
uaaugguugcuaagaagaauaaguccuucuguuuucucuuuaacauuuaaaauaucucaaugca

SEQ ID NO: 183696 - RNA, 64 nt, Homo Sapiens
augcugcugaaauuguagagacauagacacauugucucuuuaaaccauuuuguuuuuucauugu

SEQ ID NO: 183697 - RNA, 64 nt, Homo Sapiens
auuguacaguuaaacuguauuacguaccacggauucucuuuaaucauguugcagaaaaagguua

SEQ ID NO: 183698 - RNA, 64 nt, Homo Sapiens
auccauaguuaggcccacugugccucuccuuuuuucucuuuauuuucaugcuuuuuaucagugu

SEQ ID NO: 183699 - RNA, 64 nt, Homo Sapiens
uuaaguuuuuugaaccuguuuccccaacaugaagucucuuuaugguuagagaagaccaaaaaac

SEQ ID NO: 183700 - RNA, 64 nt, Homo Sapiens
cagccugcggcggggggaggggggccucuuuagcucucuuuaucuuucucucucacucauguau

SEQ ID NO: 183701 - RNA, 64 nt, Homo Sapiens
caccuuauucucuacuuuaaacaaaucauaacuuucucuuuaagccucugcuauaaauucuccu

SEQ ID NO: 183702 - RNA, 64 nt, Homo Sapiens
uauuacauuuuaaccuauauuuguguucauuuuuucucuuuauggguuuucuucuguuugacau

SEQ ID NO: 183703 - RNA, 64 nt, Homo Sapiens
uuuaaaaaugaaaucuuaauuacaaauaaauaugucucuuuauuuaccaaaaaaagagaguuau

SEQ ID NO: 183704 - RNA, 64 nt, Homo Sapiens
ucagauuuguaauggcucccuugggccaguuccuucucuuuaaaguccuccugcuugggcauca

SEQ ID NO: 183705 - RNA, 64 nt, Homo Sapiens
gcugccugccuuuugaggcauccauccauuguguucucuuuaauggguucgcucuuggaucuca

SEQ ID NO: 183706 - RNA, 64 nt, Homo Sapiens
auaauucuagugggaauauaaugugacaggaacuucucuuuauauacgcuaccaauuuaugagc

SEQ ID NO: 183707 - RNA, 64 nt, Homo Sapiens
uccucuuuucugcaauacccaacgaaacaccuuuucucuuuauuauucagaaauguccuaacau

SEQ ID NO: 183708 - RNA, 64 nt, Homo Sapiens
guucuguuugaaacuaauacgcagcuucaacuuuucucuuuagucucugccuuaaacacacauu

SEQ ID NO: 183709 - RNA, 64 nt, Homo Sapiens
ccuccccuucguguuuccccacaguaccggauucucucuuuaacgaucuaaauccacuccuucc

SEQ ID NO: 183710 - RNA, 64 nt, Homo Sapiens
auggucugucacuccuaucauuaccuugcacccaucucuuuagauggccucagcaccucacucg

SEQ ID NO: 183711 - RNA, 64 nt, Homo Sapiens
cacauugaaauguauacagauguacuagcuaaagucucuuuaugugucaguauuaagaguaaua

SEQ ID NO: 183712 - RNA, 64 nt, Homo Sapiens
uccaauggugugcguuuuaagcccagcccuuuuaucucuuuaucacuucaagaugaucauucug

SEQ ID NO: 183713 - RNA, 64 nt, Homo Sapiens
cuccugcuuaggccgugucuacuaacuuccuuugucucuuuaucggcuggcugccucugccucu

SEQ ID NO: 183714 - RNA, 64 nt, Homo Sapiens
aaaaaacagaaagaaaaauauagaagaguauauaucucuuuaaagggcaagggugggagguuuu

SEQ ID NO: 183715 - RNA, 64 nt, Homo Sapiens
cuuuuccaccuuucacauccgauauauagguagaucucuuuagugcauuggggucuucagaguc

SEQ ID NO: 183716 - RNA, 64 nt, Homo Sapiens
acaagaguuagauucccccugaagugccagaaugucucuuuagaguucuucuacuggcugugau

SEQ ID NO: 183717 - RNA, 64 nt, Homo Sapiens
accaauugauaaccaaucaccagugaaaauguugucucuuuacauauggauguguguauaugua

SEQ ID NO: 183718 - RNA, 64 nt, Homo Sapiens
cccaggaacauucuuagcucggacucuugaagaaucucuuuagauuuuguuggcaaaagccuua

SEQ ID NO: 183719 - RNA, 64 nt, Homo Sapiens
acaggagaucaucuguccauuuuagaaccauuaaucucuuuauccauugcugaacgacugugac

SEQ ID NO: 183720 - RNA, 64 nt, Homo Sapiens
uuaguuauauaaauuuuauuguuuuagguuaguaucucuuuacuaaauugucagucuauaagau

SEQ ID NO: 183721 - RNA, 64 nt, Homo Sapiens
aaaguuuuaauguuuuaacuuggggaaaaauacaucucuuuaauguuuagcaugcuugucaacc

SEQ ID NO: 183722 - RNA, 64 nt, Homo Sapiens
cuucugaaagaauuuucuauuuuuaaaaaauguaucucuuuagccuuuucugcuggagauuaua

SEQ ID NO: 183723 - RNA, 64 nt, Homo Sapiens
uagcauacaauuuauguuaguagacaucuuuaaaucucuuuaaugagugaauccaugcaagccc

SEQ ID NO: 183724 - RNA, 64 nt, Homo Sapiens
uuuuccuuuuccuucuuaagccaaguucauuuuuucucuuuacuaauuuguacugaaguguuga

SEQ ID NO: 183725 - RNA, 64 nt, Homo Sapiens
ucucuccaccuucuccaucuaagaaaaaugaauuucucuuuacuaaugcaccugacagaaaaaa

SEQ ID NO: 183726 - RNA, 64 nt, Homo Sapiens
gacauuccauuguagaaaaauggggccucuggugucucuuuaccaggggcagugccucucugcg

SEQ ID NO: 183727 - RNA, 64 nt, Homo Sapiens
gccccuggcuucuuccucccuuucccgcuucugcucucuuuauggacuggucagaggguaggug

SEQ ID NO: 183728 - RNA, 64 nt, Homo Sapiens
gccuugguuggguauuugauuuauccagaaugcuucucuuuagggaacaaggauguuuuuaaug

SEQ ID NO: 183729 - RNA, 64 nt, Homo Sapiens
uacuuuguuuuuauucuguuaaugcauucuuucuucucuuuacuuccuuucuuaccaguacacu

SEQ ID NO: 183730 - RNA, 64 nt, Homo Sapiens
ucucuccucuuuauuucucucuggccuauucuggucucuuuaacacaggcauuagccaccaugc

SEQ ID NO: 183731 - RNA, 64 nt, Homo Sapiens
uuuuuauuuuuguauuuuuucucuucuauucuggucucuuuauuucaggacucaguccugggcu

SEQ ID NO: 183732 - RNA, 64 nt, Homo Sapiens
aauuaagcugaugacuuugcagugacucaaguugucucuuuaucaugguuuaccagguagagug

SEQ ID NO: 183733 - RNA, 64 nt, Homo Sapiens
ggccuuauucucauaauuaaaaucuaauucauuuucucuuuaguguuaguagacuccaacaaca

SEQ ID NO: 183734 - RNA, 64 nt, Homo Sapiens
uacucaggcagcauauauuacaugcucuaaucggucucuuuauauaagacaacaccacaggccg

SEQ ID NO: 183735 - RNA, 64 nt, Homo Sapiens
cucauguguuuuggggaaaguugugugguagccaucucuuuagacaaaugucauacauuccaca

SEQ ID NO: 183736 - RNA, 64 nt, Homo Sapiens
gugauucuugacggugacucuuguauguaauccuguggcuuaacuacuucucccuccuugucca

SEQ ID NO: 183737 - RNA, 64 nt, Homo Sapiens
ucucuguuugugauaucacuuuaauuuuucuuggguggcuuagagacuaagggaggagacaucu

SEQ ID NO: 183738 - RNA, 64 nt, Homo Sapiens
uuauuagaaaacaaacugcuugacccaggaacaaguggcuuagcuuaaguaaacuuggcuuugc

SEQ ID NO: 183739 - RNA, 64 nt, Homo Sapiens
cagaucccugauccuuccagcuggucugcuaugaguggcuuaucccgcaugagcaggagcgugc

SEQ ID NO: 183740 - RNA, 64 nt, Homo Sapiens
caugauugaaaggaagcagucuuggccaggcacgguggcuuacaccuguaacccuggcauuuug

SEQ ID NO: 183741 - RNA, 64 nt, Homo Sapiens
agaguaauuguauaguuauugagaccuauaguguguggcuuagaugaaagggagaguaaauuuu

SEQ ID NO: 183742 - RNA, 64 nt, Homo Sapiens
aaauaagcaaguucccacguuggaaaaauacauuguggcuuagcuggcaaauuuaugcuauucc

SEQ ID NO: 183743 - RNA, 64 nt, Homo Sapiens
uaaaacaauuuuagccuuucuaugucuugguauaguggcuuaaauuuuauauuggugaaaucaa

SEQ ID NO: 183744 - RNA, 64 nt, Homo Sapiens
ccuguaaucccugcacuuuguggggccgagugugguggcuuauggcuguuguaaaagagaccuc

SEQ ID NO: 183745 - RNA, 64 nt, Homo Sapiens
ccuguaaucccagcacuuuguggggccgggcgcgguggcuuaugcauucuuuaugaaagaauuu

SEQ ID NO: 183746 - RNA, 64 nt, Homo Sapiens
auacuuauugggguauaaugacgugccccacacuguggcuuaggccgcauuuugugcuugaauu

SEQ ID NO: 183747 - RNA, 64 nt, Homo Sapiens
ggaaagaaauggucuaucaaaccaggagaguacuguggcuuagaguucagggugccuuucuccu

SEQ ID NO: 183748 - RNA, 64 nt, Homo Sapiens
guuugagcugcuauaauaaagcaccauagacuugguggcuuauaaacaacagaaauuuauuccu

SEQ ID NO: 183749 - RNA, 64 nt, Homo Sapiens
ccugagggcaacaggguuugcugcacuucuuuuaguggcuuaaggauuuuguucuguaggggag

SEQ ID NO: 183750 - RNA, 64 nt, Homo Sapiens
aaacuuucugggccuccauccuaggaccugggcagacccacauggccugggcucugaaugccca

SEQ ID NO: 183751 - RNA, 64 nt, Homo Sapiens
cagggaggccaguucugcagggugucagcuccaggacccacagggccagaaccagcugggagaa

SEQ ID NO: 183752 - RNA, 64 nt, Homo Sapiens
ggacaagaaguugucaaagaauucccaacgccaggacccacaucccuuugguauugauuucaca

SEQ ID NO: 183753 - RNA, 64 nt, Homo Sapiens
aauuccacacaaccaaacagucugccuuaaaagugacccacauuuuuccauagcuccucacuuu

SEQ ID NO: 183754 - RNA, 64 nt, Homo Sapiens
ugccucaagcaaacaggguagggccugggguucagacccacagcucauacggcuagcgaguggc

SEQ ID NO: 183755 - RNA, 64 nt, Homo Sapiens
cucucacucacuucuccaccgguugcaggaccgagacccacaucuccaccugggaggcauuugg

SEQ ID NO: 183756 - RNA, 64 nt, Homo Sapiens
uggguggggggcacccucaccgugcacacacacagacccacauggcggggaugcucccacgcca

SEQ ID NO: 183757 - RNA, 64 nt, Homo Sapiens
cugcagugacaagaagggcacacggggucaaaaugacccacacgugggucagggggcuccgggu

SEQ ID NO: 183758 - RNA, 64 nt, Homo Sapiens
agcuuccugaggcugggggucuccuuggaugugggacccacagcugagcaugggcaggggcuuu

SEQ ID NO: 183759 - RNA, 64 nt, Homo Sapiens
ucuaagaggagaggcagagcuuggucacugcugagacccacaggccuggagguagggggcuguc

SEQ ID NO: 183760 - RNA, 64 nt, Homo Sapiens
ucgagaccauccuggcuaacggggcggaucgugaagucaggagaccagcacugggaggccgagg

SEQ ID NO: 183761 - RNA, 64 nt, Homo Sapiens
gcagcaggagaggcgcacagacuccccaaaagagagucaggagaaacggauacugccucauugc

SEQ ID NO: 183762 - RNA, 64 nt, Homo Sapiens
auuuaacuuaccuguauaucguccuuucagcuguagucaggauuuacuucagauggccacuuua

SEQ ID NO: 183763 - RNA, 64 nt, Homo Sapiens
ugacacagggcuaagacuuggugcaagaucacauagucaggaggucagagaggaagcaucccuu

SEQ ID NO: 183764 - RNA, 64 nt, Homo Sapiens
aaugguggagccuggggcccccuuccugcagagcagucaggagauuucagaaaugagugagagg

SEQ ID NO: 183765 - RNA, 64 nt, Homo Sapiens
cagaaaauuugagcuuaguugcuaggaauaguuuagucaggacuucucaugauuuuuggcucua

SEQ ID NO: 183766 - RNA, 64 nt, Homo Sapiens
aagcaguggcaagggacggagaggucccaacaggagucaggaagagguuugauuauaaccaaga

SEQ ID NO: 183767 - RNA, 64 nt, Homo Sapiens
uaauuccuguuuucauggguccuguagauguuugagucaggaagguaaggcggggagugacuga

SEQ ID NO: 183768 - RNA, 64 nt, Homo Sapiens
uugaucuaagucaagagaagaagaggagcuggcuagucaggaacuuauucauuaaccaccaaac

SEQ ID NO: 183769 - RNA, 64 nt, Homo Sapiens
uugucuucuaaugaaauaaagauugaagagguugagucaggacugagcuggugaagaaaucuug

SEQ ID NO: 183770 - RNA, 64 nt, Homo Sapiens
agaaaagaaacuuaguucuaaaauucauacaugaagucaggaaagaaggucugaggugggucug

SEQ ID NO: 183771 - RNA, 64 nt, Homo Sapiens
gaacaaacuucaauuaaaugaaaugcagacauacagucaggaaagaacaaauucugacuugcag

SEQ ID NO: 183772 - RNA, 64 nt, Homo Sapiens
accgugggcuuccugcccuccucccucgacuccaagucaggaaucucgggccccuccguucugu

SEQ ID NO: 183773 - RNA, 64 nt, Homo Sapiens
gcaguuuauucuacuccaagcaguccugccccuuagucaggaauuuuacugcugaggcuucauu

SEQ ID NO: 183774 - RNA, 64 nt, Homo Sapiens
ugucuaaccauugggaagguagaggcuggcagggaagacaaaucugcuacaaguccaugggaag

SEQ ID NO: 183775 - RNA, 64 nt, Homo Sapiens
uuccaacugaucuauccauauuccuuaaguacuaaagacaaaauagagggcuucuuuuucucuc

SEQ ID NO: 183776 - RNA, 64 nt, Homo Sapiens
uauaggaagaagcaaagucuuaccacugagccguaagacaaaugaugugucucuacagcuaccu

SEQ ID NO: 183777 - RNA, 64 nt, Homo Sapiens
aaaguggaagugguauucccuuuuuuuaaagaaaaagacaaaagcaccccugccuuuuuuuuuu

SEQ ID NO: 183778 - RNA, 64 nt, Homo Sapiens
ugauuuucguucauuauaauuuucacaauuccccaagacaaaaggagcuagugauuucaaaagg

SEQ ID NO: 183779 - RNA, 64 nt, Homo Sapiens
ccaagguguaugcucucaaguaaauaaaugaauaaagacaaaaggcacaaaaugaaugaauaaa

SEQ ID NO: 183780 - RNA, 64 nt, Homo Sapiens
cuguuucuugagaagagaaugcuauuuaaagacaaagacaaauuuuauuacaucuuucacauug

SEQ ID NO: 183781 - RNA, 64 nt, Homo Sapiens
caaauucuguuucuugagaaacauuggcuauuuaaagacaaagauguauuuuauuacaucuuuc

SEQ ID NO: 183782 - RNA, 64 nt, Homo Sapiens
auuauucagugaauuacuaauguaauuauggcuaaagacaaaccguauaugcaagugguaugug

SEQ ID NO: 183783 - RNA, 64 nt, Homo Sapiens
ugaacccauacaugaucagcauuuguuauguuccaagacaaagauugacugccaaacuuuuucc

SEQ ID NO: 183784 - RNA, 64 nt, Homo Sapiens
cacuguggcgcugaaucagauuuaauaaugaguuaagacaaagccccuaccuaugggcuagugu

SEQ ID NO: 183785 - RNA, 64 nt, Homo Sapiens
gauucuucugaauccuuuagugugaugguuucccaagacaaacauuuguccuaauagcuuucuc

SEQ ID NO: 183786 - RNA, 64 nt, Homo Sapiens
aaaggaggggcuaggggagaacauaaggaaaaaaaagacaaauuaacccagaaagguuuaaaaa

SEQ ID NO: 183787 - RNA, 64 nt, Homo Sapiens
aguaaaaauaaaaacaaaaauuguuuagaaaaaaaagacaaaaagccucaaccaacuuagugac

SEQ ID NO: 183788 - RNA, 64 nt, Homo Sapiens
auaugacagccguggugguuugacuauuuucaaaaagacaaaaaucaucucauccuaauuaagg

SEQ ID NO: 183789 - RNA, 64 nt, Homo Sapiens
accacagcaaaaaaaaaaauaauacuauuugcauaagacaaaauuuacuucauuaauacuucac

SEQ ID NO: 183790 - RNA, 64 nt, Homo Sapiens
ucaggcaaguggcucaguagugacgagacugcacaagacaaagcgaaccuagcauaacuuugug

SEQ ID NO: 183791 - RNA, 64 nt, Homo Sapiens
cauuacuucucaguauuaccuaugaaacauuuuuaagacaaagggaagauuaacaauauuaaaa

SEQ ID NO: 183792 - RNA, 64 nt, Homo Sapiens
caguuccuucagauucuacgauaagaacugauacaagacaaaaauuuaguuuuaccuguaauua

SEQ ID NO: 183793 - RNA, 64 nt, Homo Sapiens
aauaacaaacaaacagccacggaaggccuuuaggaagacaaauaaaauaauggccaguuguuua

SEQ ID NO: 183794 - RNA, 64 nt, Homo Sapiens
aauauccagaaaggaacaaaucuggaagccagaaaagacaaagauggaaagugugcauuggaca

SEQ ID NO: 183795 - RNA, 64 nt, Homo Sapiens
uuuaaacauuuuaaagaaccuauauucagcaucuaagacaaauaagaugacaguucucuuuguc

SEQ ID NO: 183796 - RNA, 64 nt, Homo Sapiens
cacccacacgcagucuuugcagauggaagacaaaaagacaaacaugauuuaaauguaaaccaaa

SEQ ID NO: 183797 - RNA, 64 nt, Homo Sapiens
gacaaacacacccacacgcaaaaccaaaagauggaagacaaaaauuuugagaugauuuaaaugu

SEQ ID NO: 183798 - RNA, 64 nt, Homo Sapiens
gugaccaaaaaaaagcaugagggauuacuagagaaagacaaaauuuuuuaagggauguugcaaa

SEQ ID NO: 183799 - RNA, 64 nt, Homo Sapiens
ugcucuauguccuaguaacuggggguggggagaaaagacaaaugacagaagcaaaggagagcuu

SEQ ID NO: 183800 - RNA, 64 nt, Homo Sapiens
uuuuuuucaagaauugaaaucauaucaaguagcuaagacaaaaguacaguugaaaacagauucu

SEQ ID NO: 183801 - RNA, 64 nt, Homo Sapiens
aacccucaacguuuuaucuuauuuccaguccccuaagacaaagugggaauuugcccuuuuaaua

SEQ ID NO: 183802 - RNA, 64 nt, Homo Sapiens
guggguucgggaggucucuaugagcaaggaauacaagacaaaacuuccucaaugcauugacuau

SEQ ID NO: 183803 - RNA, 64 nt, Homo Sapiens
accuauaguagucuguguuuaaagugaauuuuuaaagacaaagcauucuaaaugaacucaauau

SEQ ID NO: 183804 - RNA, 64 nt, Homo Sapiens
acagauugucucagagaaaaaaggauaauaggacaagacaaauuagagcgaaauuaccuuacuu

SEQ ID NO: 183805 - RNA, 64 nt, Homo Sapiens
agacuauguacauaaucuguccaguguuaggguaaagacaaaacgggggacacuagaaugaaaa

SEQ ID NO: 183806 - RNA, 64 nt, Homo Sapiens
uuuaauuugcuaaauauuuugcucacuuauuacaaagacaaacgucauagaugcauacaaauga

SEQ ID NO: 183807 - RNA, 64 nt, Homo Sapiens
gcgcccacuaguggggaaucacggaaggaauaagaagacaaauguuugcgguaaggugagcugc

SEQ ID NO: 183808 - RNA, 64 nt, Homo Sapiens
auagucgaauguucuuuucuuuaccuuuacaauuaagacaaaauguuuaauaagaauagcaaaa

SEQ ID NO: 183809 - RNA, 64 nt, Homo Sapiens
auacaaagaggaaaggggaaaaaugacucagaacaagacaaaagcucugacuguuuaaaguuau

SEQ ID NO: 183810 - RNA, 64 nt, Homo Sapiens
cuguccagccggguggcaccaaccaaggauguggaagacaaaucuggaaagccuggagucccca

SEQ ID NO: 183811 - RNA, 64 nt, Homo Sapiens
cugcagugaaaauuuuggaccaguucuuggcacaaagacaaaagucugaacuccccugugaaug

SEQ ID NO: 183812 - RNA, 64 nt, Homo Sapiens
cggauguaugaucucucuagauccuaaauaaaaaaagacaaauuaaaugugacccccaaguccu

SEQ ID NO: 183813 - RNA, 64 nt, Homo Sapiens
uuuucuuuucuugauuuuuuuauaguagauuuuaaagacaaaaucaucuccuuacagucacuaa

SEQ ID NO: 183814 - RNA, 64 nt, Homo Sapiens
gguucacuaauaaauucugaguaaauuaguggugaagacaaaauauaacuuguuuuagugagcc

SEQ ID NO: 183815 - RNA, 64 nt, Homo Sapiens
agugagccacugaggaaagaauaugcuuauuacaaagacaaaauguggugcagaaacuaucuug

SEQ ID NO: 183816 - RNA, 64 nt, Homo Sapiens
cagcaccaacauguaaccggcauguuuccagcagaagacaaaaagacaaacaugaaagucuaga

SEQ ID NO: 183817 - RNA, 64 nt, Homo Sapiens
acauguaaccggcauguuuccagcagaagacaaaaagacaaacaugaaagucuagaaauaaaac

SEQ ID NO: 183818 - RNA, 64 nt, Homo Sapiens
aaaaaaaaaaaaacaaacagguaagaaaaaauguaagacaaaaaucuuuucucaaaagauugcu

SEQ ID NO: 183819 - RNA, 64 nt, Homo Sapiens
caaaaccugagcaguuccuauaaaaugaagugucaagacaaaggaucaguagaaaccaagauuu

SEQ ID NO: 183820 - RNA, 64 nt, Homo Sapiens
uccuuguugaaguuuuuuuauuauuacagccuuaaagacaaaaauagaaauaaauguuaccuaa

SEQ ID NO: 183821 - RNA, 64 nt, Homo Sapiens
guguaauuauguaaauacaaagaaaaagaagucaaagacaaagugagcaaagaugguaaaaaga

SEQ ID NO: 183822 - RNA, 64 nt, Homo Sapiens
uauauaacuuaauguuaagugucuugaggcauaaaagacaaaauguggcuuauuuuaggaucug

SEQ ID NO: 183823 - RNA, 64 nt, Homo Sapiens
cuuuuugucuagguuuucuuucugcucuuuauugaagacaaacacucaccaaaaagaaaaauaa

SEQ ID NO: 183824 - RNA, 64 nt, Homo Sapiens
ccaccacuccuggagucccaaugacuucucuggaaagacaaagagguuaucacaaaaauuccuc

SEQ ID NO: 183825 - RNA, 64 nt, Homo Sapiens
aagaaacaaaaaacaaacaaacaaacaaaaauagaagacaaaagaaagacauaugaaaggaauu

SEQ ID NO: 183826 - RNA, 64 nt, Homo Sapiens
gccaggccccgggaguggggaccaagauguacauaagacaaagcuacugccuucuagagacaac

SEQ ID NO: 183827 - RNA, 64 nt, Homo Sapiens
ugccuucuagagacaaccggcagugaccucacugaagacaaaaacugcccuagccagguacuga

SEQ ID NO: 183828 - RNA, 64 nt, Homo Sapiens
accccuauuuuccucuuaauaauacguuugggugaagacaaauuaguguuuaguaauugcauca

SEQ ID NO: 183829 - RNA, 64 nt, Homo Sapiens
auuuggauuuacuuuuacagaauauugaaaagauaagacaaauuauaaauaaguucuaaaacau

SEQ ID NO: 183830 - RNA, 52 nt, Homo Sapiens
guaugaacugcauguuuuaaagaagacaaaugcaaaccaaagcaacuuagua

SEQ ID NO: 183831 - RNA, 64 nt, Homo Sapiens
gccagugcgagacugaacuugugcagccuuagccaagacaaagcaguguuuuucagcagacggc

SEQ ID NO: 183832 - RNA, 64 nt, Homo Sapiens
cauuauuucugcauugaucaaaaguuucuuuuuuaagacaaauagauucauugucccuuucuug

SEQ ID NO: 183833 - RNA, 64 nt, Homo Sapiens
uuaaaauaugaaaugaugcauuucuucagaaaugaagacaaaauagaaucagcacucaggucuu

SEQ ID NO: 183834 - RNA, 64 nt, Homo Sapiens
aagaacaccccugccgacucccagcccggccaaaaagacaaaacacauagacgcacacacucag

SEQ ID NO: 183835 - RNA, 64 nt, Homo Sapiens
agaagaagaagaaauaaaaacccacccaagcaagaagacaaaagguaaagacgcaacguuucca

SEQ ID NO: 183836 - RNA, 64 nt, Homo Sapiens
aaaaaaaaaaacccaacaagaaaagacaaaacaaaagacaaaaauguaaaaaaaaaaaaaaaaa

SEQ ID NO: 183837 - RNA, 64 nt, Homo Sapiens
aaaagacaaaaaaaaaaaaaaaaaaaaaaaaaaaaagacaaaacgugauaaaaaacuguaaaaa

SEQ ID NO: 183838 - RNA, 64 nt, Homo Sapiens
aaaaaaaagaaaauauuuugaaaaaacacaaaaaaagacaaaaaggauucuugaacuugaaaaa

SEQ ID NO: 183839 - RNA, 64 nt, Homo Sapiens; identical to SEQ ID NO: 98813

SEQ ID NO: 183840 - RNA, 64 nt, Homo Sapiens; identical to SEQ ID NO: 98814

SEQ ID NO: 183841 - RNA, 64 nt, Homo Sapiens; identical to SEQ ID NO: 98815

SEQ ID NO: 183842 - RNA, 64 nt, Homo Sapiens; identical to SEQ ID NO: 98816

SEQ ID NO: 183843 - RNA, 64 nt, Homo Sapiens; identical to SEQ ID NO: 98817

SEQ ID NO: 183844 - RNA, 64 nt, Homo Sapiens; identical to SEQ ID NO: 98818

SEQ ID NO: 183845 - RNA, 64 nt, Homo Sapiens; identical to SEQ ID NO: 98819

SEQ ID NO: 183846 - RNA, 64 nt, Homo Sapiens; identical to SEQ ID NO: 98820

SEQ ID NO: 183847 - RNA, 64 nt, Homo Sapiens; identical to SEQ ID NO: 98821

SEQ ID NO: 183848 - RNA, 64 nt, Homo Sapiens; identical to SEQ ID NO: 98822

SEQ ID NO: 183849 - RNA, 64 nt, Homo Sapiens; identical to SEQ ID NO: 98823

SEQ ID NO: 183850 - RNA, 64 nt, Homo Sapiens; identical to SEQ ID NO: 98824

SEQ ID NO: 183851 - RNA, 64 nt, Homo Sapiens; identical to SEQ ID NO: 98825

SEQ ID NO: 183852 - RNA, 64 nt, Homo Sapiens; identical to SEQ ID NO: 98826

SEQ ID NO: 183853 - RNA, 64 nt, Homo Sapiens; identical to SEQ ID NO: 98827

SEQ ID NO: 183854 - RNA, 64 nt, Homo Sapiens; identical to SEQ ID NO: 98828

SEQ ID NO: 183855 - RNA, 64 nt, Homo Sapiens; identical to SEQ ID NO: 98829

SEQ ID NO: 183856 - RNA, 64 nt, Homo Sapiens; identical to SEQ ID NO: 98830

SEQ ID NO: 183857 - RNA, 64 nt, Homo Sapiens; identical to SEQ ID NO: 98831

SEQ ID NO: 183858 - RNA, 64 nt, Homo Sapiens; identical to SEQ ID NO: 98832

SEQ ID NO: 183859 - RNA, 64 nt, Homo Sapiens; identical to SEQ ID NO: 98833

SEQ ID NO: 183860 - RNA, 64 nt, Homo Sapiens; identical to SEQ ID NO: 98834

SEQ ID NO: 183861 - RNA, 64 nt, Homo Sapiens; identical to SEQ ID NO: 98835

SEQ ID NO: 183862 - RNA, 64 nt, Homo Sapiens; identical to SEQ ID NO: 98836

SEQ ID NO: 183863 - RNA, 64 nt, Homo Sapiens; identical to SEQ ID NO: 98837

SEQ ID NO: 183864 - RNA, 64 nt, Homo Sapiens; identical to SEQ ID NO: 98838

SEQ ID NO: 183865 - RNA, 64 nt, Homo Sapiens; identical to SEQ ID NO: 98839

SEQ ID NO: 183866 - RNA, 64 nt, Homo Sapiens; identical to SEQ ID NO: 98840

SEQ ID NO: 183867 - RNA, 64 nt, Homo Sapiens; identical to SEQ ID NO: 98841

SEQ ID NO: 183868 - RNA, 64 nt, Homo Sapiens; identical to SEQ ID NO: 98842

SEQ ID NO: 183869 - RNA, 64 nt, Homo Sapiens; identical to SEQ ID NO: 98843

SEQ ID NO: 183870 - RNA, 64 nt, Homo Sapiens; identical to SEQ ID NO: 98844

SEQ ID NO: 183871 - RNA, 64 nt, Homo Sapiens; identical to SEQ ID NO: 98845

SEQ ID NO: 183872 - RNA, 64 nt, Homo Sapiens; identical to SEQ ID NO: 98846

SEQ ID NO: 183873 - RNA, 64 nt, Homo Sapiens; identical to SEQ ID NO: 98847

SEQ ID NO: 183874 - RNA, 64 nt, Homo Sapiens; identical to SEQ ID NO: 98848

SEQ ID NO: 183875 - RNA, 64 nt, Homo Sapiens; identical to SEQ ID NO: 98849

SEQ ID NO: 183876 - RNA, 64 nt, Homo Sapiens; identical to SEQ ID NO: 98850

SEQ ID NO: 183877 - RNA, 64 nt, Homo Sapiens; identical to SEQ ID NO: 98851

SEQ ID NO: 183878 - RNA, 64 nt, Homo Sapiens; identical to SEQ ID NO: 98852

SEQ ID NO: 183879 - RNA, 64 nt, Homo Sapiens; identical to SEQ ID NO: 98853

SEQ ID NO: 183880 - RNA, 64 nt, Homo Sapiens; identical to SEQ ID NO: 98854

SEQ ID NO: 183881 - RNA, 64 nt, Homo Sapiens; identical to SEQ ID NO: 98855

SEQ ID NO: 183882 - RNA, 64 nt, Homo Sapiens; identical to SEQ ID NO: 98856

SEQ ID NO: 183883 - RNA, 64 nt, Homo Sapiens; identical to SEQ ID NO: 98857

SEQ ID NO: 183884 - RNA, 64 nt, Homo Sapiens; identical to SEQ ID NO: 98858

SEQ ID NO: 183885 - RNA, 64 nt, Homo Sapiens; identical to SEQ ID NO: 98859

SEQ ID NO: 183886 - RNA, 64 nt, Homo Sapiens; identical to SEQ ID NO: 98860

SEQ ID NO: 183887 - RNA, 64 nt, Homo Sapiens; identical to SEQ ID NO: 98861

SEQ ID NO: 183888 - RNA, 64 nt, Homo Sapiens; identical to SEQ ID NO: 98862

SEQ ID NO: 183889 - RNA, 64 nt, Homo Sapiens; identical to SEQ ID NO: 98863

SEQ ID NO: 183890 - RNA, 64 nt, Homo Sapiens; identical to SEQ ID NO: 98864

SEQ ID NO: 183891 - RNA, 64 nt, Homo Sapiens; identical to SEQ ID NO: 98865

SEQ ID NO: 183892 - RNA, 64 nt, Homo Sapiens; identical to SEQ ID NO: 98866

SEQ ID NO: 183893 - RNA, 64 nt, Homo Sapiens; identical to SEQ ID NO: 98867

SEQ ID NO: 183894 - RNA, 64 nt, Homo Sapiens; identical to SEQ ID NO: 98868

SEQ ID NO: 183895 - RNA, 64 nt, Homo Sapiens; identical to SEQ ID NO: 98869

SEQ ID NO: 183896 - RNA, 64 nt, Homo Sapiens; identical to SEQ ID NO: 98870

SEQ ID NO: 183897 - RNA, 64 nt, Homo Sapiens; identical to SEQ ID NO: 98871

SEQ ID NO: 183898 - RNA, 64 nt, Homo Sapiens; identical to SEQ ID NO: 98872

SEQ ID NO: 183899 - RNA, 64 nt, Homo Sapiens; identical to SEQ ID NO: 98873

SEQ ID NO: 183900 - RNA, 64 nt, Homo Sapiens; identical to SEQ ID NO: 98874

SEQ ID NO: 183901 - RNA, 64 nt, Homo Sapiens; identical to SEQ ID NO: 98875

SEQ ID NO: 183902 - RNA, 64 nt, Homo Sapiens; identical to SEQ ID NO: 98876

SEQ ID NO: 183903 - RNA, 64 nt, Homo Sapiens; identical to SEQ ID NO: 98877

SEQ ID NO: 183904 - RNA, 64 nt, Homo Sapiens; identical to SEQ ID NO: 98878

SEQ ID NO: 183905 - RNA, 64 nt, Homo Sapiens; identical to SEQ ID NO: 98879

SEQ ID NO: 183906 - RNA, 64 nt, Homo Sapiens; identical to SEQ ID NO: 98880

SEQ ID NO: 183907 - RNA, 64 nt, Homo Sapiens; identical to SEQ ID NO: 98881

SEQ ID NO: 183908 - RNA, 64 nt, Homo Sapiens; identical to SEQ ID NO: 98882

SEQ ID NO: 183909 - RNA, 64 nt, Homo Sapiens; identical to SEQ ID NO: 98883

SEQ ID NO: 183910 - RNA, 64 nt, Homo Sapiens; identical to SEQ ID NO: 98884

SEQ ID NO: 183911 - RNA, 64 nt, Homo Sapiens; identical to SEQ ID NO: 98885

SEQ ID NO: 183912 - RNA, 64 nt, Homo Sapiens; identical to SEQ ID NO: 98886

SEQ ID NO: 183913 - RNA, 64 nt, Homo Sapiens; identical to SEQ ID NO: 98887

SEQ ID NO: 183914 - RNA, 64 nt, Homo Sapiens; identical to SEQ ID NO: 98888

SEQ ID NO: 183915 - RNA, 64 nt, Homo Sapiens; identical to SEQ ID NO: 98889

SEQ ID NO: 183916 - RNA, 64 nt, Homo Sapiens; identical to SEQ ID NO: 98890

SEQ ID NO: 183917 - RNA, 64 nt, Homo Sapiens; identical to SEQ ID NO: 98891

SEQ ID NO: 183918 - RNA, 64 nt, Homo Sapiens; identical to SEQ ID NO: 98892

SEQ ID NO: 183919 - RNA, 64 nt, Homo Sapiens; identical to SEQ ID NO: 98893

SEQ ID NO: 183920 - RNA, 64 nt, Homo Sapiens; identical to SEQ ID NO: 98894

SEQ ID NO: 183921 - RNA, 64 nt, Homo Sapiens; identical to SEQ ID NO: 98895

SEQ ID NO: 183922 - RNA, 64 nt, Homo Sapiens; identical to SEQ ID NO: 98896

SEQ ID NO: 183923 - RNA, 64 nt, Homo Sapiens; identical to SEQ ID NO: 98897

SEQ ID NO: 183924 - RNA, 64 nt, Homo Sapiens; identical to SEQ ID NO: 98898

SEQ ID NO: 183925 - RNA, 64 nt, Homo Sapiens; identical to SEQ ID NO: 98899

SEQ ID NO: 183926 - RNA, 64 nt, Homo Sapiens; identical to SEQ ID NO: 98900

SEQ ID NO: 183927 - RNA, 64 nt, Homo Sapiens; identical to SEQ ID NO: 98901

SEQ ID NO: 183928 - RNA, 64 nt, Homo Sapiens; identical to SEQ ID NO: 98902

SEQ ID NO: 183929 - RNA, 64 nt, Homo Sapiens; identical to SEQ ID NO: 98903

SEQ ID NO: 183930 - RNA, 64 nt, Homo Sapiens; identical to SEQ ID NO: 98904

SEQ ID NO: 183931 - RNA, 64 nt, Homo Sapiens; identical to SEQ ID NO: 98905

SEQ ID NO: 183932 - RNA, 64 nt, Homo Sapiens; identical to SEQ ID NO: 98906

SEQ ID NO: 183933 - RNA, 64 nt, Homo Sapiens; identical to SEQ ID NO: 98907

SEQ ID NO: 183934 - RNA, 64 nt, Homo Sapiens; identical to SEQ ID NO: 98908

SEQ ID NO: 183935 - RNA, 64 nt, Homo Sapiens; identical to SEQ ID NO: 98909

SEQ ID NO: 183936 - RNA, 64 nt, Homo Sapiens; identical to SEQ ID NO: 98910

SEQ ID NO: 183937 - RNA, 64 nt, Homo Sapiens; identical to SEQ ID NO: 98911

SEQ ID NO: 183938 - RNA, 64 nt, Homo Sapiens; identical to SEQ ID NO: 98912

SEQ ID NO: 183939 - RNA, 64 nt, Homo Sapiens
gugccauagucacauggccuaugcacauauggacucugcacaugaaucccacccacaugugaca

SEQ ID NO: 183940 - RNA, 64 nt, Homo Sapiens
ugugucuguacacguguccuguaguugcguggacucugcacaugucuuguacauguguagccug

SEQ ID NO: 183941 - RNA, 64 nt, Homo Sapiens
aacaccaaaauguaggauuuuguaguauuucuagucugcacaauucugugccugacacuuuacc

SEQ ID NO: 183942 - RNA, 64 nt, Homo Sapiens
ggcagcaaggauuaccccaaugaugaacggcccaucugcacagcugcagaaaccagcugucugc

SEQ ID NO: 183943 - RNA, 64 nt, Homo Sapiens
gagcaaggguucacaugcaugugauuaaauuuagucugcacaguuuuuauuacuauuuaaacaa

SEQ ID NO: 183944 - RNA, 64 nt, Homo Sapiens
auccauaaaagauuguauuuucccucuuuuguagucugcacaagucauauauaugguaauaauu

SEQ ID NO: 183945 - RNA, 64 nt, Homo Sapiens
gccagaaaucacuuuuauauugucacaugggcccucugcacagaguccgauggcuccucccggg

SEQ ID NO: 183946 - RNA, 64 nt, Homo Sapiens
caccucugccuucuuccucuguugccaugugaucucugcacacgcuagcucuccuucgccuucu

SEQ ID NO: 183947 - RNA, 64 nt, Homo Sapiens
auuuccuugcucugggaacaccagaaccuuugauucugcacaaguuccgaagugaaccauucca

SEQ ID NO: 183948 - RNA, 64 nt, Homo Sapiens
cucucugugccaugaagauagagucugacucaucucugcacaacucugcuguuacucagccccu

SEQ ID NO: 183949 - RNA, 64 nt, Homo Sapiens
agaggcuacguuuuggaagugggaaggcaauuucucugcacacauuuuacauugugaaugcugu

SEQ ID NO: 183950 - RNA, 64 nt, Homo Sapiens
aauaaguccaucugucacuuauucagacguuuuuucugcacaaugcggagaauucuuagcauac

SEQ ID NO: 183951 - RNA, 64 nt, Homo Sapiens
aaaguugaugccaucaaaccuugacaccgggugcucugcacacccacgcggauguugcaccuca

SEQ ID NO: 183952 - RNA, 64 nt, Homo Sapiens
aacaaacuccuaguccuuuagaaauaacagauucucugcacaaaaccacccauucauucauuua

SEQ ID NO: 183953 - RNA, 64 nt, Homo Sapiens
ugagcagcucgcucacuccccaauguccaggaugucugcacaaccucaagaaaggccugaauga

SEQ ID NO: 183954 - RNA, 64 nt, Homo Sapiens
caucacuggcugugaccccucugaagaaacugccucugcacacaugggaagaggcaaggagcuu

SEQ ID NO: 183955 - RNA, 64 nt, Homo Sapiens
cucacugacaaauagaccuuucagccugugagccucugcacaaagcagaggcugugggcuguca

SEQ ID NO: 183956 - RNA, 64 nt, Homo Sapiens
uuuuuuuuuuugucauugucugaccaaaauuccuucugcacaugaggccaguauaggcaacguc

SEQ ID NO: 183957 - RNA, 64 nt, Homo Sapiens
auagcaccuuuuguauaaacaaugugauauugcuucugcacauccaaaaauucugggucuuuuc

SEQ ID NO: 183958 - RNA, 64 nt, Homo Sapiens
ugaaucugaugcucugcugaauaauuucauuaccucugcacaugccugucaaauaugaaauugg

SEQ ID NO: 183959 - RNA, 64 nt, Homo Sapiens
gccucuccacuucaugauuuucagcuaacuugcuucugcacagacccccuuucccuauaagggc

SEQ ID NO: 183960 - RNA, 64 nt, Homo Sapiens
ugggugcuauggcauccugggcaggugcuuccuuucugcacaaggguugggugaccaugauguc

SEQ ID NO: 183961 - RNA, 64 nt, Homo Sapiens
aaggacccccauacagccuggcgaugcuguuccaucugcacauguucgucugcacagcugugag

SEQ ID NO: 183962 - RNA, 64 nt, Homo Sapiens
ugugaggcgaugcuguuccaaccacaucuguucgucugcacagccgcauuguucguggcaguag

SEQ ID NO: 183963 - RNA, 64 nt, Homo Sapiens
gugcaucucuggccuaccgcaguggccccggcugucugcacauuuuuuguagacacauuagagu

SEQ ID NO: 183964 - RNA, 64 nt, Homo Sapiens
gucuuguucaaguucagacgaagcuacucuggcaucugcacauuuccguguuacagcagcugcc

SEQ ID NO: 183965 - RNA, 64 nt, Homo Sapiens
aaauccucagcaaaauacuaguaaaccaaauccaucugcacaucaaaaagcuaauccaacauua

SEQ ID NO: 183966 - RNA, 64 nt, Homo Sapiens
auugacaagugggaccuaauuaaacuaaauaacuucugcacagcaaaagaagcuauuugcagac

SEQ ID NO: 183967 - RNA, 64 nt, Homo Sapiens
ccauaggugugacaauccgagcaguggagucauucagcgggagcacugcgcgcuauccccucac

SEQ ID NO: 183968 - RNA, 64 nt, Homo Sapiens
agccccguggagcuggacugaggaggaggcugcacagcgggagagcagcugguccagaccagcc

SEQ ID NO: 183969 - RNA, 64 nt, Homo Sapiens
caaccuaugguauaaugguugacuggguuucucuguauaguacuggcaugguacggagauguuu

SEQ ID NO: 183970 - RNA, 64 nt, Homo Sapiens
uuuuauuuucuuuuguaaauguuuagguuuuuuuguauaguaaagugauaauuucuggaauuag

SEQ ID NO: 183971 - RNA, 64 nt, Homo Sapiens
aucuguauacuaacuagggccaagauggguaccaguauaguaauagauggugauauuuuccuua

SEQ ID NO: 183972 - RNA, 64 nt, Homo Sapiens
ucaugccaguaaaauuuuuuucacacaaccauaaguauaguauuggcuuuaagauuuaaaaguu

SEQ ID NO: 183973 - RNA, 64 nt, Homo Sapiens
uuuguaaacugcuuggcaaaacucuauuacguuuguauaguaaguccgagccuccggagaauua

SEQ ID NO: 183974 - RNA, 64 nt, Homo Sapiens
uaacauuuucuaguauuuuugugaucucuuuucaguauaguaguucugccauggugaggugagc

SEQ ID NO: 183975 - RNA, 64 nt, Homo Sapiens
guguguuuccuguaguuugauccgaaggaaaagaguauaguagccugagaaucaggagauggga

SEQ ID NO: 183976 - RNA, 64 nt, Homo Sapiens
auaggucagaagacgauggaacuguccuggguuaguauaguaaucuuacaguaggauccuuagg

SEQ ID NO: 183977 - RNA, 64 nt, Homo Sapiens
uuguguuggguucuuuuuuuuuuuuaaaugaaaaguauaguauguggcacuuuuuaaagaacaa

SEQ ID NO: 183978 - RNA, 64 nt, Homo Sapiens
cauuuuguuuguccuggcuaaacuuggaguuugaguauaguaaauuaugauccuuaaauauuug

SEQ ID NO: 183979 - RNA, 64 nt, Homo Sapiens
uuucuuguacauuacuuccacaggagacgauuuuguauaguauugggugugaggugcaguuguc

SEQ ID NO: 183980 - RNA, 64 nt, Homo Sapiens
aauuucguaaauucucucaauccggccgucaauuguauaguacccucccaaucuuuuuuguuag

SEQ ID NO: 183981 - RNA, 64 nt, Homo Sapiens
guauaguuauuguguagcacauaugguuugcacuguauaguagcuuuuaaagaaaauagucaca

SEQ ID NO: 183982 - RNA, 64 nt, Homo Sapiens
cuguauguuaaaugaagauggcaauuuuuuucuuguauaguacuuguauuuucuuucgcugaug

SEQ ID NO: 183983 - RNA, 64 nt, Homo Sapiens
agacauuugacccuuagcuccaguuuucuucugauguuuccaucuuccagaaucccucaaaaaa

SEQ ID NO: 183984 - RNA, 64 nt, Homo Sapiens
gugguguaacuuaguucuugaugaucccacuuccuguuuccaucugcuugggauauaccagagu

SEQ ID NO: 183985 - RNA, 64 nt, Homo Sapiens
aguuucuuguguuuuuuuuuuuccccacaaaguguguuuccacuuggagcaccauuuugaccca

SEQ ID NO: 183986 - RNA, 64 nt, Homo Sapiens
aauaacauggcacacagaacaauggaaaaaaguuuguuuccauuggaaaauuauaucauuuugg

SEQ ID NO: 183987 - RNA, 64 nt, Homo Sapiens
auuucucugugaccaaaauuaagcaugaaaaaaauguuuccauugccauauuugauucacuagu

SEQ ID NO: 183988 - RNA, 64 nt, Homo Sapiens
ccucuuugucauacugcacauauaaaacgucuuuuguuuccaacaagaggauuuucuuuuucau

SEQ ID NO: 183989 - RNA, 64 nt, Homo Sapiens
acuuaaggagacucuaaugauucugaguuuaauguguuuccaacuuuucuacaagguccacuau

SEQ ID NO: 183990 - RNA, 64 nt, Homo Sapiens
cacccuugcugugcccuuuacaaauuucagaucguguuuccaaacgaugccacggauugcaggc

SEQ ID NO: 183991 - RNA, 64 nt, Homo Sapiens
aguauuucugagauacaauaauaacuucauuaaauguuuccacaaagcugaaucuuguaaaauu

SEQ ID NO: 183992 - RNA, 64 nt, Homo Sapiens
gcuuuuauauagugugcuugggagguuuuuagaauguuuccauuacaaauauuuugcauuuuua

SEQ ID NO: 183993 - RNA, 64 nt, Homo Sapiens
acuacuuugauauuuuaacucagagccagcauguuguuuccauacuuuggcaagcuggauuucu

SEQ ID NO: 183994 - RNA, 64 nt, Homo Sapiens
uaccaggaaauuccuucagaaaguaugcuuugccuguuuccacuaugcccugaaaagaguaaca

SEQ ID NO: 183995 - RNA, 64 nt, Homo Sapiens
aaccaguguaguaggauaggggagagcaggaggcuguuuccaaaaagaggaaaggguugugcaa

SEQ ID NO: 183996 - RNA, 64 nt, Homo Sapiens
acacuaccuuggauuuugcauauuuuaccaauauuguuuccauuaugcuuauagccacaacauc

SEQ ID NO: 183997 - RNA, 64 nt, Homo Sapiens
cuccugugaauuuuaacuuggacugaccuuaagauguuuccauuucaggaugggcaugugaagu

SEQ ID NO: 183998 - RNA, 64 nt, Homo Sapiens
acugagaagccagugaucugcaagcauuugcucuuguuuccacaucaccucugggauauuucag

SEQ ID NO: 183999 - RNA, 64 nt, Homo Sapiens
uguuuccacaucaccucugggauauuucagcuguuguuuccaaauggcaaaucaucaacuaaaa

SEQ ID NO: 184000 - RNA, 64 nt, Homo Sapiens
aaucuaaucuguugugcuuuuguuggacuuggcauguuuccaugaacugcacuauuauaaacua

SEQ ID NO: 184001 - RNA, 64 nt, Homo Sapiens
agagguauuuauuuuuucacuuguaaaaaaauaauguuuccacguaaagaacucuguuauaucc

SEQ ID NO: 184002 - RNA, 64 nt, Homo Sapiens
aguuuucuuucgucuuguauacccuuuguccuuuuguuuccauucugcuuauccuucuuuccuu

SEQ ID NO: 184003 - RNA, 64 nt, Homo Sapiens
gcucacccuuggcauccaucguucacccaugacauguuuccaugucuuugacacauucggaacc

SEQ ID NO: 184004 - RNA, 64 nt, Homo Sapiens
uuuuuccucugaaguaaguugcauguuugaggcauguuuccaaauauuaucaaaauauccugaa

SEQ ID NO: 184005 - RNA, 64 nt, Homo Sapiens
aacugugugccaagugugacuuuguacaguuuuauguuuccacucuccuguauguguagccacu

SEQ ID NO: 184006 - RNA, 64 nt, Homo Sapiens
uaaggcagauuuuggucaucaguacuuuaacuuguguuuccagagauucauaagggauauagac

SEQ ID NO: 184007 - RNA, 64 nt, Homo Sapiens
augaaaauucucuuacuuaacaugaaagucuuaauguuuccaacguucuuuguaauuuuaauuc

SEQ ID NO: 184008 - RNA, 64 nt, Homo Sapiens
acccuuucauugcagcgaucugcacacguguggguguuuccauaggacauugucaggcacggau

SEQ ID NO: 184009 - RNA, 64 nt, Homo Sapiens
gcccugcccguugacuaacuaugcucugugguuuuguuuccagagaacucagauugcacagagc

SEQ ID NO: 184010 - RNA, 64 nt, Homo Sapiens
aaccauaugggcaguguacaaaauaugaaacaacuguuuccacacuugcaccugaucaagagca

SEQ ID NO: 184011 - RNA, 64 nt, Homo Sapiens
uuguuuugcagagaaauguuuuucauuucccguguguuuccauuuccuucugaaauucugauuu

SEQ ID NO: 184012 - RNA, 64 nt, Homo Sapiens
auauuaaauggaagguuugcuguuuugaucuaguuguuuccaguggagcaguuuuaugaaauau

SEQ ID NO: 184013 - RNA, 64 nt, Homo Sapiens
agaaaacuaggaauugaguauuuuguguacgguauguuuccauccucccuccccuuccuccucc

SEQ ID NO: 184014 - RNA, 64 nt, Homo Sapiens
aaauuacauaacguucaguucuccacgagccugcuguuuccaggucucacugucccccguuugc

SEQ ID NO: 184015 - RNA, 64 nt, Homo Sapiens
caguuccuuacucuccucuuuucuccaguauuccuguuuccaucauguaacuguuucccuuuga

SEQ ID NO: 184016 - RNA, 64 nt, Homo Sapiens
ucagcuuuccugcaagaagacugccaccuccccguguuuccaagagaguccuuuuugccccucc

SEQ ID NO: 184017 - RNA, 64 nt, Homo Sapiens
cucugcccagcagucucuuaggaaccccccagccuguuuccauugcaauggugaaaagagauua

SEQ ID NO: 184018 - RNA, 64 nt, Homo Sapiens
ggaaucauguuggauagucagacucugccccuucuguuuccauaucaauaagccagcaaaccag

SEQ ID NO: 184019 - RNA, 64 nt, Homo Sapiens
ggucaaagccgguugcagaggagaaucuggcuccuguuuccaugccccucacuaucucuagagu

SEQ ID NO: 184020 - RNA, 64 nt, Homo Sapiens
cacccugggauccuuuuuacaacaaaucuuuaucuguuuccacccauucuguccuaaugguuag

SEQ ID NO: 184021 - RNA, 64 nt, Homo Sapiens
uaaccuuuuaacuaaaagauguuauacuauauucuguuuccaaguuuugcauuuuuauaacuug

SEQ ID NO: 184022 - RNA, 64 nt, Homo Sapiens
cggcgccgugcucccgcugcucacccaaagaaguuguuuccauuuuaaaccggucuuuuggggc

SEQ ID NO: 184023 - RNA, 64 nt, Homo Sapiens
cccguugacguuuauuuuacguaaaauaaacuguuguuuccaaugcaaucaacucuguauuaua

SEQ ID NO: 184024 - RNA, 64 nt, Homo Sapiens
augaaaaugcucuaguguugugaugcacugcugauguuuccaauucagguacaaguauguuuua

SEQ ID NO: 184025 - RNA, 64 nt, Homo Sapiens
auuagaaauaaucaugucucagaugaguaaugucuguuuccaggguucagaaaaggcaaacuca

SEQ ID NO: 184026 - RNA, 64 nt, Homo Sapiens
aggcagguaaaccaaucaaaaacagaguuuucuguguuuccaugauaguguugaagccuaauga

SEQ ID NO: 184027 - RNA, 64 nt, Homo Sapiens
agaaugacagucuuauauuuaaggcaccagucauuguuuccauuuuuuuuuuaauucuucccuu

SEQ ID NO: 184028 - RNA, 64 nt, Homo Sapiens
uuuucaugguuuuuguuuguuuuguuuuuguuuuuguuuccauuguuaccguugcuauggcccu

SEQ ID NO: 184029 - RNA, 64 nt, Homo Sapiens
uagagagacuguguuucaacucucuuuucauugcuguuuccagaagaguggagagugugguuuc

SEQ ID NO: 184030 - RNA, 64 nt, Homo Sapiens
gccuguuuaaguagguuguaaaaguuguuguuuuuguuuccauaugacaugugaugauuuucag

SEQ ID NO: 184031 - RNA, 64 nt, Homo Sapiens
ccauaggcaauaauuucuuaaauauuaauaagacuguuuccacaguuaaugccaaaaagugguu

SEQ ID NO: 184032 - RNA, 64 nt, Homo Sapiens
guuguuuuuaucaucaugugcaauauuacugauuuguuuccaugcugauuguguggaaccagua

SEQ ID NO: 184033 - RNA, 64 nt, Homo Sapiens
acuuuuuauuaugaccauuagaaacuauuuugaauguuuccaacuggcucaauuggcugggaaa

SEQ ID NO: 184034 - RNA, 64 nt, Homo Sapiens; identical to SEQ ID NO: 45025

SEQ ID NO: 184035 - RNA, 64 nt, Homo Sapiens; identical to SEQ ID NO: 45026

SEQ ID NO: 184036 - RNA, 64 nt, Homo Sapiens; identical to SEQ ID NO: 45027

SEQ ID NO: 184037 - RNA, 64 nt, Homo Sapiens; identical to SEQ ID NO: 45028

SEQ ID NO: 184038 - RNA, 64 nt, Homo Sapiens; identical to SEQ ID NO: 45029

SEQ ID NO: 184039 - RNA, 64 nt, Homo Sapiens; identical to SEQ ID NO: 45030

SEQ ID NO: 184040 - RNA, 64 nt, Homo Sapiens; identical to SEQ ID NO: 45031

SEQ ID NO: 184041 - RNA, 64 nt, Homo Sapiens; identical to SEQ ID NO: 45032

SEQ ID NO: 184042 - RNA, 64 nt, Homo Sapiens; identical to SEQ ID NO: 45033

SEQ ID NO: 184043 - RNA, 64 nt, Homo Sapiens; identical to SEQ ID NO: 45034

SEQ ID NO: 184044 - RNA, 64 nt, Homo Sapiens; identical to SEQ ID NO: 45035

SEQ ID NO: 184045 - RNA, 64 nt, Homo Sapiens; identical to SEQ ID NO: 45036

SEQ ID NO: 184046 - RNA, 64 nt, Homo Sapiens; identical to SEQ ID NO: 45037

SEQ ID NO: 184047 - RNA, 64 nt, Homo Sapiens; identical to SEQ ID NO: 45038

SEQ ID NO: 184048 - RNA, 64 nt, Homo Sapiens; identical to SEQ ID NO: 45039

SEQ ID NO: 184049 - RNA, 64 nt, Homo Sapiens; identical to SEQ ID NO: 45040

SEQ ID NO: 184050 - RNA, 64 nt, Homo Sapiens; identical to SEQ ID NO: 45041

SEQ ID NO: 184051 - RNA, 64 nt, Homo Sapiens; identical to SEQ ID NO: 45042

SEQ ID NO: 184052 - RNA, 64 nt, Homo Sapiens; identical to SEQ ID NO: 45043

SEQ ID NO: 184053 - RNA, 64 nt, Homo Sapiens; identical to SEQ ID NO: 45044

SEQ ID NO: 184054 - RNA, 64 nt, Homo Sapiens; identical to SEQ ID NO: 45045

SEQ ID NO: 184055 - RNA, 64 nt, Homo Sapiens; identical to SEQ ID NO: 45046

SEQ ID NO: 184056 - RNA, 64 nt, Homo Sapiens; identical to SEQ ID NO: 45047

SEQ ID NO: 184057 - RNA, 64 nt, Homo Sapiens; identical to SEQ ID NO: 45048

SEQ ID NO: 184058 - RNA, 64 nt, Homo Sapiens; identical to SEQ ID NO: 45049

SEQ ID NO: 184059 - RNA, 64 nt, Homo Sapiens; identical to SEQ ID NO: 45050

SEQ ID NO: 184060 - RNA, 64 nt, Homo Sapiens; identical to SEQ ID NO: 45051

SEQ ID NO: 184061 - RNA, 64 nt, Homo Sapiens; identical to SEQ ID NO: 45052

SEQ ID NO: 184062 - RNA, 64 nt, Homo Sapiens; identical to SEQ ID NO: 45053

SEQ ID NO: 184063 - RNA, 64 nt, Homo Sapiens; identical to SEQ ID NO: 45054

SEQ ID NO: 184064 - RNA, 64 nt, Homo Sapiens; identical to SEQ ID NO: 45055

SEQ ID NO: 184065 - RNA, 64 nt, Homo Sapiens; identical to SEQ ID NO: 45056

SEQ ID NO: 184066 - RNA, 64 nt, Homo Sapiens; identical to SEQ ID NO: 45057

SEQ ID NO: 184067 - RNA, 64 nt, Homo Sapiens; identical to SEQ ID NO: 45058

SEQ ID NO: 184068 - RNA, 64 nt, Homo Sapiens; identical to SEQ ID NO: 45059

SEQ ID NO: 184069 - RNA, 64 nt, Homo Sapiens; identical to SEQ ID NO: 45060

SEQ ID NO: 184070 - RNA, 64 nt, Homo Sapiens; identical to SEQ ID NO: 45061

SEQ ID NO: 184071 - RNA, 64 nt, Homo Sapiens; identical to SEQ ID NO: 45062

SEQ ID NO: 184072 - RNA, 64 nt, Homo Sapiens; identical to SEQ ID NO: 45063

SEQ ID NO: 184073 - RNA, 64 nt, Homo Sapiens; identical to SEQ ID NO: 45064

SEQ ID NO: 184074 - RNA, 64 nt, Homo Sapiens; identical to SEQ ID NO: 45065

SEQ ID NO: 184075 - RNA, 64 nt, Homo Sapiens; identical to SEQ ID NO: 45066

SEQ ID NO: 184076 - RNA, 64 nt, Homo Sapiens
uauuaaucucacuuagcgaaagugacggaugagcaguaaguaaguaaguguggggauuuaaacu

SEQ ID NO: 184077 - RNA, 64 nt, Homo Sapiens
aaucucacuuagcgaaagugacggaugagcaguaaguaaguaaguguggggauuuaaacuugag

SEQ ID NO: 184078 - RNA, 64 nt, Homo Sapiens
uguguaguucuuugagauaguugcuuaugcauauaguaaguauuacauucuuagaguagagcag

SEQ ID NO: 184079 - RNA, 64 nt, Homo Sapiens
uuuauuaguagcuugaaagagcuuaaucauaugcaguaaguauuuuuauuaccaauaaauuuaa

SEQ ID NO: 184080 - RNA, 64 nt, Homo Sapiens
ccaugccucgaaaauaagucgccaggcauggccuaguaaguacagacccaaacaaguucuuugg

SEQ ID NO: 184081 - RNA, 64 nt, Homo Sapiens
agaguugggauuggaauucagcucaacaucauauaguaaguagcucagagaaguuaagaaacuu

SEQ ID NO: 184082 - RNA, 64 nt, Homo Sapiens
ugacccuaaacuugcaggcaagguuagcugcuuuaguaaguagaauuuuguggucuuuuuguuu

SEQ ID NO: 184083 - RNA, 64 nt, Homo Sapiens
cuggggaaaagagcaaguagccugucuuccuuuaaguaaguagccuguaauggauguacuacuu

SEQ ID NO: 184084 - RNA, 64 nt, Homo Sapiens
uuucuuaauauuguccaauguauuaccuaagcuuaguaaguagucugcccuuaacccuugccuc

SEQ ID NO: 184085 - RNA, 64 nt, Homo Sapiens
aaaaggcuaaaggcuaugcgugguuggguugaccaguaaguagauuguugcuuggcaacaguac

SEQ ID NO: 184086 - RNA, 64 nt, Homo Sapiens
guauaguuuuguuaucuaagcaauuuuuguuuuaaguaaguaaguguacuagaaugcgaagccg

SEQ ID NO: 184087 - RNA, 64 nt, Homo Sapiens
aaaugaucauauguuugcucccuggucuuuuuuaaguaaguaaguaaguaucuuaguagauuuu

SEQ ID NO: 184088 - RNA, 64 nt, Homo Sapiens
gaucauauguuugcucccuggucuuuuuuaaguaaguaaguaaguaucuuaguagauuuuuccu

SEQ ID NO: 184089 - RNA, 64 nt, Homo Sapiens
auauguuugcucccuggucuuuuuuaaguaaguaaguaaguaucuuaguagauuuuuccuuuga

SEQ ID NO: 184090 - RNA, 64 nt, Homo Sapiens
uuucauucuaaaaucagagguacuaagaaguuuaaguaaguaagcaagggguuacuuuacaucc

SEQ ID NO: 184091 - RNA, 64 nt, Homo Sapiens
aaagaaggcaaauugauucacacacagguuuguaaguaaguaagcauuucucugcgaguaguuc

SEQ ID NO: 184092 - RNA, 64 nt, Homo Sapiens; identical to SEQ ID NO: 94711

SEQ ID NO: 184093 - RNA, 64 nt, Homo Sapiens; identical to SEQ ID NO: 94712

SEQ ID NO: 184094 - RNA, 64 nt, Homo Sapiens
ccucacgcugcuaggaaauggcucccugaucuaucaggugcaagugguagggacaagcagugag

SEQ ID NO: 184095 - RNA, 64 nt, Homo Sapiens
caccaaggguagccccagaggggagcuccgagggcaggugcacauagccaaccaaugugagguu

SEQ ID NO: 184096 - RNA, 64 nt, Homo Sapiens
gauuggugcugccccucaugccaucagggaccuccaggugcaugcccaaccuguuccggucucc

SEQ ID NO: 184097 - RNA, 64 nt, Homo Sapiens
cucaccccacuguaggcugagcugacucugaccgcaggugcacuaagacccaaccaggcgcugg

SEQ ID NO: 184098 - RNA, 64 nt, Homo Sapiens
ggugggcaaagccuaguagagaaccagugcaccucaggugcacuuacauaugguggggcugagg

SEQ ID NO: 184099 - RNA, 64 nt, Homo Sapiens
gcuguaaaauacccuaaucacauuaugaucuugacaggugcacuuuacuggggagaauaaaaag

SEQ ID NO: 184100 - RNA, 64 nt, Homo Sapiens
acuucccagggucuugggaugggagaguggggaucaggugcaguuggcucuuaacccucaaggg

SEQ ID NO: 184101 - RNA, 64 nt, Homo Sapiens
uugaagaaacuuagacuucacccaccagcuggcacaggugcacagauucauaaauucccacacg

SEQ ID NO: 184102 - RNA, 64 nt, Homo Sapiens
ggcucacgccuguaaucccauuaugaaaaaaggccaggugcagugguaacuuaugguauaaaag

SEQ ID NO: 184103 - RNA, 64 nt, Homo Sapiens
ugaggugaagaucacugucacuaacggggguagacaggugcagauagcaagcauagaccccugu

SEQ ID NO: 184104 - RNA, 64 nt, Homo Sapiens
cccuggagauggauuguaagacuacauggggaaacaggugcaaagaagcgggaugcuauuaaaa

SEQ ID NO: 184105 - RNA, 64 nt, Homo Sapiens
ugagccagggcuggcucuguggcugggucuggggcaggugcauugggggacagugggcuguugu

SEQ ID NO: 184106 - RNA, 64 nt, Homo Sapiens
cuguuccaucaccugcggugugccucaggaucaccaggugcaggcccccacccucggagaugcu

SEQ ID NO: 184107 - RNA, 64 nt, Homo Sapiens
cccucuccauuccccaggcuccacccgugcugcucaggugcaaauggacuugagagcaucuaug

SEQ ID NO: 184108 - RNA, 64 nt, Homo Sapiens
cuggggagaaagaggggccugaugagacuccacucaggugcacacaucaccaggugcaucugca

SEQ ID NO: 184109 - RNA, 64 nt, Homo Sapiens
gccugaugagacuccacucaggugcacacaucaccaggugcaucugcaggcaccgggcuggcug

SEQ ID NO: 184110 - RNA, 64 nt, Homo Sapiens
ggcucacgccuguagucccacuucacuacauggccaggugcaguaaggucuugcuuagaaaguc

SEQ ID NO: 184111 - RNA, 64 nt, Homo Sapiens
ggcucacgccuguaaucccaagcugguccuuggccaggugcaguccagguucccuagacucaca

SEQ ID NO: 184112 - RNA, 64 nt, Homo Sapiens
cuaccaugcccaguccauuuaguagcugggacuacaggugcaugaacccugccucagcuaacca

SEQ ID NO: 184113 - RNA, 64 nt, Homo Sapiens
uauagcacacuacagccuccgcaguggcuauucacaggugcaguuauguugcccaggcuagagu

SEQ ID NO: 184114 - RNA, 64 nt, Homo Sapiens
ucagacucuuggcuacaguggcuuacugaguuaucaggugcagggcacucucuaacguccacua

SEQ ID NO: 184115 - RNA, 64 nt, Homo Sapiens
cuacuggaaauguagcacuuugagcuuuugaugccaggugcaaugcaggacccuaagaugaagc

SEQ ID NO: 184116 - RNA, 64 nt, Homo Sapiens
ccaccacaccuggcuaauuuaguagcugggacuacaggugcacauuucccaccucagccucccg

SEQ ID NO: 184117 - RNA, 64 nt, Homo Sapiens
gcucacacccccaccugcauagacagcaagagcccaggugcacuaauuagacuaacaaagcucc

SEQ ID NO: 184118 - RNA, 64 nt, Homo Sapiens
gagagcccugccaccgucuucagccuguagaauccaggugcacaggugcagccguggcccaugg

SEQ ID NO: 184119 - RNA, 64 nt, Homo Sapiens
guuuuacagacacccggucagccccuggccugagcaggugcagagugguguguucggcccagag

SEQ ID NO: 184120 - RNA, 64 nt, Homo Sapiens
gcgggccagaagcccccucagcagggcgggccuccaggugcagggccaagcaggaacuccaggu

SEQ ID NO: 184121 - RNA, 64 nt, Homo Sapiens
gcgggccuccaggugcagggccaagcaggaacuccaggugcaggcugggucugcccacccgugg

SEQ ID NO: 184122 - RNA, 64 nt, Homo Sapiens; identical to SEQ ID NO: 39347

SEQ ID NO: 184123 - RNA, 64 nt, Homo Sapiens; identical to SEQ ID NO: 39348

SEQ ID NO: 184124 - RNA, 64 nt, Homo Sapiens; identical to SEQ ID NO: 39349

SEQ ID NO: 184125 - RNA, 64 nt, Homo Sapiens; identical to SEQ ID NO: 39350

SEQ ID NO: 184126 - RNA, 64 nt, Homo Sapiens; identical to SEQ ID NO: 39351

SEQ ID NO: 184127 - RNA, 64 nt, Homo Sapiens; identical to SEQ ID NO: 39352

SEQ ID NO: 184128 - RNA, 64 nt, Homo Sapiens; identical to SEQ ID NO: 39353

SEQ ID NO: 184129 - RNA, 64 nt, Homo Sapiens; identical to SEQ ID NO: 39354

SEQ ID NO: 184130 - RNA, 64 nt, Homo Sapiens; identical to SEQ ID NO: 39355

SEQ ID NO: 184131 - RNA, 64 nt, Homo Sapiens; identical to SEQ ID NO: 39356

SEQ ID NO: 184132 - RNA, 64 nt, Homo Sapiens; identical to SEQ ID NO: 39357

SEQ ID NO: 184133 - RNA, 64 nt, Homo Sapiens; identical to SEQ ID NO: 39358

SEQ ID NO: 184134 - RNA, 64 nt, Homo Sapiens; identical to SEQ ID NO: 39359

SEQ ID NO: 184135 - RNA, 64 nt, Homo Sapiens; identical to SEQ ID NO: 39360

SEQ ID NO: 184136 - RNA, 64 nt, Homo Sapiens; identical to SEQ ID NO: 39361

SEQ ID NO: 184137 - RNA, 64 nt, Homo Sapiens; identical to SEQ ID NO: 39362

SEQ ID NO: 184138 - RNA, 64 nt, Homo Sapiens; identical to SEQ ID NO: 39363

SEQ ID NO: 184139 - RNA, 64 nt, Homo Sapiens; identical to SEQ ID NO: 39364

SEQ ID NO: 184140 - RNA, 64 nt, Homo Sapiens; identical to SEQ ID NO: 39365

SEQ ID NO: 184141 - RNA, 64 nt, Homo Sapiens; identical to SEQ ID NO: 39366

SEQ ID NO: 184142 - RNA, 64 nt, Homo Sapiens; identical to SEQ ID NO: 39367

SEQ ID NO: 184143 - RNA, 64 nt, Homo Sapiens; identical to SEQ ID NO: 39368

SEQ ID NO: 184144 - RNA, 64 nt, Homo Sapiens; identical to SEQ ID NO: 39369

SEQ ID NO: 184145 - RNA, 64 nt, Homo Sapiens; identical to SEQ ID NO: 39370

SEQ ID NO: 184146 - RNA, 64 nt, Homo Sapiens; identical to SEQ ID NO: 39371

SEQ ID NO: 184147 - RNA, 64 nt, Homo Sapiens; identical to SEQ ID NO: 39372

SEQ ID NO: 184148 - RNA, 64 nt, Homo Sapiens; identical to SEQ ID NO: 39373

SEQ ID NO: 184149 - RNA, 64 nt, Homo Sapiens; identical to SEQ ID NO: 39374

SEQ ID NO: 184150 - RNA, 64 nt, Homo Sapiens; identical to SEQ ID NO: 39375

SEQ ID NO: 184151 - RNA, 64 nt, Homo Sapiens; identical to SEQ ID NO: 39376

SEQ ID NO: 184152 - RNA, 64 nt, Homo Sapiens; identical to SEQ ID NO: 39377

SEQ ID NO: 184153 - RNA, 64 nt, Homo Sapiens; identical to SEQ ID NO: 39378

SEQ ID NO: 184154 - RNA, 64 nt, Homo Sapiens; identical to SEQ ID NO: 39379

SEQ ID NO: 184155 - RNA, 64 nt, Homo Sapiens; identical to SEQ ID NO: 39380

SEQ ID NO: 184156 - RNA, 64 nt, Homo Sapiens; identical to SEQ ID NO: 39381

SEQ ID NO: 184157 - RNA, 64 nt, Homo Sapiens; identical to SEQ ID NO: 39382

SEQ ID NO: 184158 - RNA, 64 nt, Homo Sapiens; identical to SEQ ID NO: 39383

SEQ ID NO: 184159 - RNA, 64 nt, Homo Sapiens; identical to SEQ ID NO: 39384

SEQ ID NO: 184160 - RNA, 64 nt, Homo Sapiens; identical to SEQ ID NO: 39385

SEQ ID NO: 184161 - RNA, 64 nt, Homo Sapiens; identical to SEQ ID NO: 39386

SEQ ID NO: 184162 - RNA, 64 nt, Homo Sapiens; identical to SEQ ID NO: 39387

SEQ ID NO: 184163 - RNA, 64 nt, Homo Sapiens; identical to SEQ ID NO: 39388

SEQ ID NO: 184164 - RNA, 64 nt, Homo Sapiens; identical to SEQ ID NO: 39389

SEQ ID NO: 184165 - RNA, 64 nt, Homo Sapiens; identical to SEQ ID NO: 39390

SEQ ID NO: 184166 - RNA, 64 nt, Homo Sapiens; identical to SEQ ID NO: 39391

SEQ ID NO: 184167 - RNA, 64 nt, Homo Sapiens; identical to SEQ ID NO: 39392

SEQ ID NO: 184168 - RNA, 64 nt, Homo Sapiens; identical to SEQ ID NO: 39393

SEQ ID NO: 184169 - RNA, 64 nt, Homo Sapiens; identical to SEQ ID NO: 39394

SEQ ID NO: 184170 - RNA, 64 nt, Homo Sapiens; identical to SEQ ID NO: 39395

SEQ ID NO: 184171 - RNA, 64 nt, Homo Sapiens; identical to SEQ ID NO: 39396

SEQ ID NO: 184172 - RNA, 64 nt, Homo Sapiens; identical to SEQ ID NO: 39397

SEQ ID NO: 184173 - RNA, 64 nt, Homo Sapiens; identical to SEQ ID NO: 39398

SEQ ID NO: 184174 - RNA, 64 nt, Homo Sapiens; identical to SEQ ID NO: 39399

SEQ ID NO: 184175 - RNA, 64 nt, Homo Sapiens; identical to SEQ ID NO: 39400

SEQ ID NO: 184176 - RNA, 64 nt, Homo Sapiens; identical to SEQ ID NO: 39401

SEQ ID NO: 184177 - RNA, 64 nt, Homo Sapiens; identical to SEQ ID NO: 39402

SEQ ID NO: 184178 - RNA, 64 nt, Homo Sapiens; identical to SEQ ID NO: 39403

SEQ ID NO: 184179 - RNA, 64 nt, Homo Sapiens; identical to SEQ ID NO: 39404

SEQ ID NO: 184180 - RNA, 64 nt, Homo Sapiens; identical to SEQ ID NO: 39405

SEQ ID NO: 184181 - RNA, 64 nt, Homo Sapiens; identical to SEQ ID NO: 39406

SEQ ID NO: 184182 - RNA, 64 nt, Homo Sapiens; identical to SEQ ID NO: 39407

SEQ ID NO: 184183 - RNA, 64 nt, Homo Sapiens; identical to SEQ ID NO: 39408

SEQ ID NO: 184184 - RNA, 64 nt, Homo Sapiens; identical to SEQ ID NO: 39409

SEQ ID NO: 184185 - RNA, 64 nt, Homo Sapiens; identical to SEQ ID NO: 39410

SEQ ID NO: 184186 - RNA, 64 nt, Homo Sapiens; identical to SEQ ID NO: 39411

SEQ ID NO: 184187 - RNA, 64 nt, Homo Sapiens; identical to SEQ ID NO: 39412

SEQ ID NO: 184188 - RNA, 64 nt, Homo Sapiens; identical to SEQ ID NO: 39413

SEQ ID NO: 184189 - RNA, 64 nt, Homo Sapiens; identical to SEQ ID NO: 39414

SEQ ID NO: 184190 - RNA, 64 nt, Homo Sapiens; identical to SEQ ID NO: 39415

SEQ ID NO: 184191 - RNA, 64 nt, Homo Sapiens; identical to SEQ ID NO: 39416

SEQ ID NO: 184192 - RNA, 64 nt, Homo Sapiens; identical to SEQ ID NO: 39417

SEQ ID NO: 184193 - RNA, 64 nt, Homo Sapiens; identical to SEQ ID NO: 39418

SEQ ID NO: 184194 - RNA, 64 nt, Homo Sapiens; identical to SEQ ID NO: 39419

SEQ ID NO: 184195 - RNA, 64 nt, Homo Sapiens; identical to SEQ ID NO: 39420

SEQ ID NO: 184196 - RNA, 64 nt, Homo Sapiens; identical to SEQ ID NO: 39421

SEQ ID NO: 184197 - RNA, 64 nt, Homo Sapiens; identical to SEQ ID NO: 39422

SEQ ID NO: 184198 - RNA, 64 nt, Homo Sapiens; identical to SEQ ID NO: 39423

SEQ ID NO: 184199 - RNA, 64 nt, Homo Sapiens; identical to SEQ ID NO: 39424

SEQ ID NO: 184200 - RNA, 64 nt, Homo Sapiens; identical to SEQ ID NO: 39425

SEQ ID NO: 184201 - RNA, 64 nt, Homo Sapiens; identical to SEQ ID NO: 39426

SEQ ID NO: 184202 - RNA, 64 nt, Homo Sapiens; identical to SEQ ID NO: 39427

SEQ ID NO: 184203 - RNA, 64 nt, Homo Sapiens; identical to SEQ ID NO: 39428

SEQ ID NO: 184204 - RNA, 64 nt, Homo Sapiens; identical to SEQ ID NO: 39429

SEQ ID NO: 184205 - RNA, 64 nt, Homo Sapiens; identical to SEQ ID NO: 39430

SEQ ID NO: 184206 - RNA, 64 nt, Homo Sapiens; identical to SEQ ID NO: 39431

SEQ ID NO: 184207 - RNA, 64 nt, Homo Sapiens; identical to SEQ ID NO: 39432

SEQ ID NO: 184208 - RNA, 64 nt, Homo Sapiens; identical to SEQ ID NO: 39433

SEQ ID NO: 184209 - RNA, 64 nt, Homo Sapiens; identical to SEQ ID NO: 39434

SEQ ID NO: 184210 - RNA, 64 nt, Homo Sapiens; identical to SEQ ID NO: 39435

SEQ ID NO: 184211 - RNA, 64 nt, Homo Sapiens; identical to SEQ ID NO: 39436

SEQ ID NO: 184212 - RNA, 64 nt, Homo Sapiens; identical to SEQ ID NO: 39437

SEQ ID NO: 184213 - RNA, 64 nt, Homo Sapiens; identical to SEQ ID NO: 39438

SEQ ID NO: 184214 - RNA, 64 nt, Homo Sapiens; identical to SEQ ID NO: 39439

SEQ ID NO: 184215 - RNA, 64 nt, Homo Sapiens; identical to SEQ ID NO: 39440

SEQ ID NO: 184216 - RNA, 64 nt, Homo Sapiens; identical to SEQ ID NO: 39441

SEQ ID NO: 184217 - RNA, 64 nt, Homo Sapiens; identical to SEQ ID NO: 39442

SEQ ID NO: 184218 - RNA, 64 nt, Homo Sapiens; identical to SEQ ID NO: 39443

SEQ ID NO: 184219 - RNA, 64 nt, Homo Sapiens; identical to SEQ ID NO: 39444

SEQ ID NO: 184220 - RNA, 64 nt, Homo Sapiens; identical to SEQ ID NO: 39445

SEQ ID NO: 184221 - RNA, 64 nt, Homo Sapiens; identical to SEQ ID NO: 39446

SEQ ID NO: 184222 - RNA, 64 nt, Homo Sapiens; identical to SEQ ID NO: 39447

SEQ ID NO: 184223 - RNA, 64 nt, Homo Sapiens; identical to SEQ ID NO: 39448

SEQ ID NO: 184224 - RNA, 64 nt, Homo Sapiens; identical to SEQ ID NO: 39449

SEQ ID NO: 184225 - RNA, 64 nt, Homo Sapiens; identical to SEQ ID NO: 39450

SEQ ID NO: 184226 - RNA, 64 nt, Homo Sapiens; identical to SEQ ID NO: 39451

SEQ ID NO: 184227 - RNA, 64 nt, Homo Sapiens; identical to SEQ ID NO: 39452

SEQ ID NO: 184228 - RNA, 64 nt, Homo Sapiens; identical to SEQ ID NO: 39453

SEQ ID NO: 184229 - RNA, 64 nt, Homo Sapiens; identical to SEQ ID NO: 39454

SEQ ID NO: 184230 - RNA, 64 nt, Homo Sapiens; identical to SEQ ID NO: 39455

SEQ ID NO: 184231 - RNA, 64 nt, Homo Sapiens; identical to SEQ ID NO: 39456

SEQ ID NO: 184232 - RNA, 64 nt, Homo Sapiens; identical to SEQ ID NO: 39457

SEQ ID NO: 184233 - RNA, 64 nt, Homo Sapiens; identical to SEQ ID NO: 39458

SEQ ID NO: 184234 - RNA, 64 nt, Homo Sapiens; identical to SEQ ID NO: 39459

SEQ ID NO: 184235 - RNA, 64 nt, Homo Sapiens; identical to SEQ ID NO: 39460

SEQ ID NO: 184236 - RNA, 64 nt, Homo Sapiens; identical to SEQ ID NO: 39461

SEQ ID NO: 184237 - RNA, 64 nt, Homo Sapiens; identical to SEQ ID NO: 39462

SEQ ID NO: 184238 - RNA, 64 nt, Homo Sapiens; identical to SEQ ID NO: 39463

SEQ ID NO: 184239 - RNA, 64 nt, Homo Sapiens; identical to SEQ ID NO: 39464

SEQ ID NO: 184240 - RNA, 64 nt, Homo Sapiens; identical to SEQ ID NO: 39465

SEQ ID NO: 184241 - RNA, 64 nt, Homo Sapiens; identical to SEQ ID NO: 39466

SEQ ID NO: 184242 - RNA, 64 nt, Homo Sapiens; identical to SEQ ID NO: 39467

SEQ ID NO: 184243 - RNA, 64 nt, Homo Sapiens; identical to SEQ ID NO: 39468

SEQ ID NO: 184244 - RNA, 64 nt, Homo Sapiens; identical to SEQ ID NO: 39469

SEQ ID NO: 184245 - RNA, 64 nt, Homo Sapiens; identical to SEQ ID NO: 39470

SEQ ID NO: 184246 - RNA, 64 nt, Homo Sapiens; identical to SEQ ID NO: 39471

SEQ ID NO: 184247 - RNA, 64 nt, Homo Sapiens; identical to SEQ ID NO: 39472

SEQ ID NO: 184248 - RNA, 64 nt, Homo Sapiens; identical to SEQ ID NO: 39473

SEQ ID NO: 184249 - RNA, 64 nt, Homo Sapiens; identical to SEQ ID NO: 39474

SEQ ID NO: 184250 - RNA, 64 nt, Homo Sapiens; identical to SEQ ID NO: 39475

SEQ ID NO: 184251 - RNA, 64 nt, Homo Sapiens; identical to SEQ ID NO: 39476

SEQ ID NO: 184252 - RNA, 64 nt, Homo Sapiens; identical to SEQ ID NO: 39477

SEQ ID NO: 184253 - RNA, 64 nt, Homo Sapiens; identical to SEQ ID NO: 39478

SEQ ID NO: 184254 - RNA, 64 nt, Homo Sapiens; identical to SEQ ID NO: 39479

SEQ ID NO: 184255 - RNA, 64 nt, Homo Sapiens; identical to SEQ ID NO: 39480

SEQ ID NO: 184256 - RNA, 64 nt, Homo Sapiens; identical to SEQ ID NO: 39481

SEQ ID NO: 184257 - RNA, 64 nt, Homo Sapiens; identical to SEQ ID NO: 39482

SEQ ID NO: 184258 - RNA, 64 nt, Homo Sapiens; identical to SEQ ID NO: 39483

SEQ ID NO: 184259 - RNA, 64 nt, Homo Sapiens; identical to SEQ ID NO: 39484

SEQ ID NO: 184260 - RNA, 64 nt, Homo Sapiens; identical to SEQ ID NO: 39485

SEQ ID NO: 184261 - RNA, 64 nt, Homo Sapiens; identical to SEQ ID NO: 39486

SEQ ID NO: 184262 - RNA, 64 nt, Homo Sapiens; identical to SEQ ID NO: 39487

SEQ ID NO: 184263 - RNA, 64 nt, Homo Sapiens; identical to SEQ ID NO: 39488

SEQ ID NO: 184264 - RNA, 64 nt, Homo Sapiens; identical to SEQ ID NO: 39489

SEQ ID NO: 184265 - RNA, 64 nt, Homo Sapiens; identical to SEQ ID NO: 39490

SEQ ID NO: 184266 - RNA, 64 nt, Homo Sapiens; identical to SEQ ID NO: 39491

SEQ ID NO: 184267 - RNA, 64 nt, Homo Sapiens; identical to SEQ ID NO: 39492

SEQ ID NO: 184268 - RNA, 64 nt, Homo Sapiens; identical to SEQ ID NO: 39493

SEQ ID NO: 184269 - RNA, 64 nt, Homo Sapiens; identical to SEQ ID NO: 39494

SEQ ID NO: 184270 - RNA, 64 nt, Homo Sapiens; identical to SEQ ID NO: 39495

SEQ ID NO: 184271 - RNA, 64 nt, Homo Sapiens; identical to SEQ ID NO: 39496

SEQ ID NO: 184272 - RNA, 64 nt, Homo Sapiens; identical to SEQ ID NO: 39497

SEQ ID NO: 184273 - RNA, 64 nt, Homo Sapiens; identical to SEQ ID NO: 39498

SEQ ID NO: 184274 - RNA, 64 nt, Homo Sapiens; identical to SEQ ID NO: 39499

SEQ ID NO: 184275 - RNA, 64 nt, Homo Sapiens; identical to SEQ ID NO: 39500

SEQ ID NO: 184276 - RNA, 64 nt, Homo Sapiens; identical to SEQ ID NO: 39501

SEQ ID NO: 184277 - RNA, 64 nt, Homo Sapiens; identical to SEQ ID NO: 39502

SEQ ID NO: 184278 - RNA, 64 nt, Homo Sapiens; identical to SEQ ID NO: 39503

SEQ ID NO: 184279 - RNA, 64 nt, Homo Sapiens; identical to SEQ ID NO: 39504

SEQ ID NO: 184280 - RNA, 64 nt, Homo Sapiens; identical to SEQ ID NO: 39505

SEQ ID NO: 184281 - RNA, 64 nt, Homo Sapiens; identical to SEQ ID NO: 39506

SEQ ID NO: 184282 - RNA, 64 nt, Homo Sapiens; identical to SEQ ID NO: 39507

SEQ ID NO: 184283 - RNA, 64 nt, Homo Sapiens; identical to SEQ ID NO: 39508

SEQ ID NO: 184284 - RNA, 64 nt, Homo Sapiens; identical to SEQ ID NO: 39509

SEQ ID NO: 184285 - RNA, 64 nt, Homo Sapiens; identical to SEQ ID NO: 39510

SEQ ID NO: 184286 - RNA, 64 nt, Homo Sapiens; identical to SEQ ID NO: 39511

SEQ ID NO: 184287 - RNA, 64 nt, Homo Sapiens; identical to SEQ ID NO: 39512

SEQ ID NO: 184288 - RNA, 64 nt, Homo Sapiens; identical to SEQ ID NO: 39513

SEQ ID NO: 184289 - RNA, 64 nt, Homo Sapiens; identical to SEQ ID NO: 39514

SEQ ID NO: 184290 - RNA, 64 nt, Homo Sapiens; identical to SEQ ID NO: 39515

SEQ ID NO: 184291 - RNA, 64 nt, Homo Sapiens; identical to SEQ ID NO: 39516

SEQ ID NO: 184292 - RNA, 64 nt, Homo Sapiens; identical to SEQ ID NO: 39517

SEQ ID NO: 184293 - RNA, 64 nt, Homo Sapiens; identical to SEQ ID NO: 39518

SEQ ID NO: 184294 - RNA, 64 nt, Homo Sapiens; identical to SEQ ID NO: 39519

SEQ ID NO: 184295 - RNA, 64 nt, Homo Sapiens; identical to SEQ ID NO: 39520

SEQ ID NO: 184296 - RNA, 64 nt, Homo Sapiens; identical to SEQ ID NO: 39521

SEQ ID NO: 184297 - RNA, 64 nt, Homo Sapiens; identical to SEQ ID NO: 39522

SEQ ID NO: 184298 - RNA, 64 nt, Homo Sapiens; identical to SEQ ID NO: 39523

SEQ ID NO: 184299 - RNA, 64 nt, Homo Sapiens; identical to SEQ ID NO: 39524

SEQ ID NO: 184300 - RNA, 64 nt, Homo Sapiens; identical to SEQ ID NO: 39525

SEQ ID NO: 184301 - RNA, 64 nt, Homo Sapiens; identical to SEQ ID NO: 39526

SEQ ID NO: 184302 - RNA, 64 nt, Homo Sapiens; identical to SEQ ID NO: 39527

SEQ ID NO: 184303 - RNA, 64 nt, Homo Sapiens; identical to SEQ ID NO: 39528

SEQ ID NO: 184304 - RNA, 64 nt, Homo Sapiens; identical to SEQ ID NO: 39529

SEQ ID NO: 184305 - RNA, 64 nt, Homo Sapiens; identical to SEQ ID NO: 39530

SEQ ID NO: 184306 - RNA, 64 nt, Homo Sapiens; identical to SEQ ID NO: 39531

SEQ ID NO: 184307 - RNA, 64 nt, Homo Sapiens; identical to SEQ ID NO: 39532

SEQ ID NO: 184308 - RNA, 64 nt, Homo Sapiens; identical to SEQ ID NO: 39533

SEQ ID NO: 184309 - RNA, 64 nt, Homo Sapiens; identical to SEQ ID NO: 39534

SEQ ID NO: 184310 - RNA, 64 nt, Homo Sapiens; identical to SEQ ID NO: 39535

SEQ ID NO: 184311 - RNA, 64 nt, Homo Sapiens; identical to SEQ ID NO: 39536

SEQ ID NO: 184312 - RNA, 64 nt, Homo Sapiens; identical to SEQ ID NO: 39537

SEQ ID NO: 184313 - RNA, 64 nt, Homo Sapiens; identical to SEQ ID NO: 39538

SEQ ID NO: 184314 - RNA, 64 nt, Homo Sapiens; identical to SEQ ID NO: 39539

SEQ ID NO: 184315 - RNA, 64 nt, Homo Sapiens; identical to SEQ ID NO: 39540

SEQ ID NO: 184316 - RNA, 64 nt, Homo Sapiens; identical to SEQ ID NO: 39541

SEQ ID NO: 184317 - RNA, 64 nt, Homo Sapiens; identical to SEQ ID NO: 39542

SEQ ID NO: 184318 - RNA, 64 nt, Homo Sapiens; identical to SEQ ID NO: 39543

SEQ ID NO: 184319 - RNA, 64 nt, Homo Sapiens; identical to SEQ ID NO: 39544

SEQ ID NO: 184320 - RNA, 64 nt, Homo Sapiens; identical to SEQ ID NO: 39545

SEQ ID NO: 184321 - RNA, 64 nt, Homo Sapiens; identical to SEQ ID NO: 39546

SEQ ID NO: 184322 - RNA, 64 nt, Homo Sapiens; identical to SEQ ID NO: 39547

SEQ ID NO: 184323 - RNA, 64 nt, Homo Sapiens; identical to SEQ ID NO: 39548

SEQ ID NO: 184324 - RNA, 64 nt, Homo Sapiens; identical to SEQ ID NO: 39549

SEQ ID NO: 184325 - RNA, 64 nt, Homo Sapiens; identical to SEQ ID NO: 39550

SEQ ID NO: 184326 - RNA, 64 nt, Homo Sapiens; identical to SEQ ID NO: 39551

SEQ ID NO: 184327 - RNA, 64 nt, Homo Sapiens; identical to SEQ ID NO: 39552

SEQ ID NO: 184328 - RNA, 64 nt, Homo Sapiens; identical to SEQ ID NO: 39553

SEQ ID NO: 184329 - RNA, 64 nt, Homo Sapiens; identical to SEQ ID NO: 39554

SEQ ID NO: 184330 - RNA, 64 nt, Homo Sapiens; identical to SEQ ID NO: 39555

SEQ ID NO: 184331 - RNA, 64 nt, Homo Sapiens; identical to SEQ ID NO: 39556

SEQ ID NO: 184332 - RNA, 64 nt, Homo Sapiens; identical to SEQ ID NO: 39557

SEQ ID NO: 184333 - RNA, 64 nt, Homo Sapiens; identical to SEQ ID NO: 39558

SEQ ID NO: 184334 - RNA, 64 nt, Homo Sapiens; identical to SEQ ID NO: 39559

SEQ ID NO: 184335 - RNA, 64 nt, Homo Sapiens; identical to SEQ ID NO: 39560

SEQ ID NO: 184336 - RNA, 64 nt, Homo Sapiens; identical to SEQ ID NO: 39561

SEQ ID NO: 184337 - RNA, 64 nt, Homo Sapiens; identical to SEQ ID NO: 39562

SEQ ID NO: 184338 - RNA, 64 nt, Homo Sapiens; identical to SEQ ID NO: 39563

SEQ ID NO: 184339 - RNA, 64 nt, Homo Sapiens; identical to SEQ ID NO: 39564

SEQ ID NO: 184340 - RNA, 64 nt, Homo Sapiens; identical to SEQ ID NO: 39565

SEQ ID NO: 184341 - RNA, 64 nt, Homo Sapiens; identical to SEQ ID NO: 39566

SEQ ID NO: 184342 - RNA, 64 nt, Homo Sapiens; identical to SEQ ID NO: 39567

SEQ ID NO: 184343 - RNA, 64 nt, Homo Sapiens; identical to SEQ ID NO: 39568

SEQ ID NO: 184344 - RNA, 64 nt, Homo Sapiens; identical to SEQ ID NO: 39569

SEQ ID NO: 184345 - RNA, 64 nt, Homo Sapiens; identical to SEQ ID NO: 39570

SEQ ID NO: 184346 - RNA, 64 nt, Homo Sapiens; identical to SEQ ID NO: 39571

SEQ ID NO: 184347 - RNA, 64 nt, Homo Sapiens; identical to SEQ ID NO: 39572

SEQ ID NO: 184348 - RNA, 64 nt, Homo Sapiens; identical to SEQ ID NO: 39573

SEQ ID NO: 184349 - RNA, 64 nt, Homo Sapiens; identical to SEQ ID NO: 39574

SEQ ID NO: 184350 - RNA, 64 nt, Homo Sapiens; identical to SEQ ID NO: 39575

SEQ ID NO: 184351 - RNA, 64 nt, Homo Sapiens; identical to SEQ ID NO: 39576

SEQ ID NO: 184352 - RNA, 64 nt, Homo Sapiens; identical to SEQ ID NO: 39577

SEQ ID NO: 184353 - RNA, 64 nt, Homo Sapiens; identical to SEQ ID NO: 39578

SEQ ID NO: 184354 - RNA, 64 nt, Homo Sapiens; identical to SEQ ID NO: 39579

SEQ ID NO: 184355 - RNA, 64 nt, Homo Sapiens; identical to SEQ ID NO: 39580

SEQ ID NO: 184356 - RNA, 64 nt, Homo Sapiens; identical to SEQ ID NO: 39581

SEQ ID NO: 184357 - RNA, 64 nt, Homo Sapiens; identical to SEQ ID NO: 39582

SEQ ID NO: 184358 - RNA, 64 nt, Homo Sapiens; identical to SEQ ID NO: 39583

SEQ ID NO: 184359 - RNA, 64 nt, Homo Sapiens; identical to SEQ ID NO: 39584

SEQ ID NO: 184360 - RNA, 64 nt, Homo Sapiens; identical to SEQ ID NO: 39585

SEQ ID NO: 184361 - RNA, 64 nt, Homo Sapiens; identical to SEQ ID NO: 39586

SEQ ID NO: 184362 - RNA, 64 nt, Homo Sapiens; identical to SEQ ID NO: 39587

SEQ ID NO: 184363 - RNA, 64 nt, Homo Sapiens; identical to SEQ ID NO: 39588

SEQ ID NO: 184364 - RNA, 64 nt, Homo Sapiens; identical to SEQ ID NO: 39589

SEQ ID NO: 184365 - RNA, 64 nt, Homo Sapiens; identical to SEQ ID NO: 39590

SEQ ID NO: 184366 - RNA, 64 nt, Homo Sapiens; identical to SEQ ID NO: 39591

SEQ ID NO: 184367 - RNA, 64 nt, Homo Sapiens; identical to SEQ ID NO: 39592

SEQ ID NO: 184368 - RNA, 64 nt, Homo Sapiens; identical to SEQ ID NO: 39593

SEQ ID NO: 184369 - RNA, 64 nt, Homo Sapiens; identical to SEQ ID NO: 39594

SEQ ID NO: 184370 - RNA, 64 nt, Homo Sapiens; identical to SEQ ID NO: 39595

SEQ ID NO: 184371 - RNA, 64 nt, Homo Sapiens; identical to SEQ ID NO: 39596

SEQ ID NO: 184372 - RNA, 64 nt, Homo Sapiens; identical to SEQ ID NO: 39597

SEQ ID NO: 184373 - RNA, 64 nt, Homo Sapiens; identical to SEQ ID NO: 39598

SEQ ID NO: 184374 - RNA, 64 nt, Homo Sapiens; identical to SEQ ID NO: 39599

SEQ ID NO: 184375 - RNA, 64 nt, Homo Sapiens; identical to SEQ ID NO: 39600

SEQ ID NO: 184376 - RNA, 64 nt, Homo Sapiens; identical to SEQ ID NO: 39601

SEQ ID NO: 184377 - RNA, 64 nt, Homo Sapiens; identical to SEQ ID NO: 39602

SEQ ID NO: 184378 - RNA, 64 nt, Homo Sapiens; identical to SEQ ID NO: 39603

SEQ ID NO: 184379 - RNA, 64 nt, Homo Sapiens; identical to SEQ ID NO: 39604

SEQ ID NO: 184380 - RNA, 64 nt, Homo Sapiens; identical to SEQ ID NO: 39605

SEQ ID NO: 184381 - RNA, 64 nt, Homo Sapiens; identical to SEQ ID NO: 39606

SEQ ID NO: 184382 - RNA, 64 nt, Homo Sapiens; identical to SEQ ID NO: 39607

SEQ ID NO: 184383 - RNA, 64 nt, Homo Sapiens; identical to SEQ ID NO: 39608

SEQ ID NO: 184384 - RNA, 64 nt, Homo Sapiens; identical to SEQ ID NO: 39609

SEQ ID NO: 184385 - RNA, 64 nt, Homo Sapiens; identical to SEQ ID NO: 39610

SEQ ID NO: 184386 - RNA, 64 nt, Homo Sapiens; identical to SEQ ID NO: 39611

SEQ ID NO: 184387 - RNA, 64 nt, Homo Sapiens; identical to SEQ ID NO: 39612

SEQ ID NO: 184388 - RNA, 64 nt, Homo Sapiens; identical to SEQ ID NO: 39613

SEQ ID NO: 184389 - RNA, 64 nt, Homo Sapiens; identical to SEQ ID NO: 39614

SEQ ID NO: 184390 - RNA, 64 nt, Homo Sapiens; identical to SEQ ID NO: 39615

SEQ ID NO: 184391 - RNA, 64 nt, Homo Sapiens; identical to SEQ ID NO: 39616

SEQ ID NO: 184392 - RNA, 64 nt, Homo Sapiens; identical to SEQ ID NO: 39617

SEQ ID NO: 184393 - RNA, 64 nt, Homo Sapiens; identical to SEQ ID NO: 39618

SEQ ID NO: 184394 - RNA, 64 nt, Homo Sapiens; identical to SEQ ID NO: 39619

SEQ ID NO: 184395 - RNA, 64 nt, Homo Sapiens; identical to SEQ ID NO: 39620

SEQ ID NO: 184396 - RNA, 64 nt, Homo Sapiens; identical to SEQ ID NO: 39621

SEQ ID NO: 184397 - RNA, 64 nt, Homo Sapiens; identical to SEQ ID NO: 39622

SEQ ID NO: 184398 - RNA, 64 nt, Homo Sapiens; identical to SEQ ID NO: 39623

SEQ ID NO: 184399 - RNA, 64 nt, Homo Sapiens; identical to SEQ ID NO: 39624

SEQ ID NO: 184400 - RNA, 64 nt, Homo Sapiens; identical to SEQ ID NO: 39625

SEQ ID NO: 184401 - RNA, 64 nt, Homo Sapiens; identical to SEQ ID NO: 39626

SEQ ID NO: 184402 - RNA, 64 nt, Homo Sapiens; identical to SEQ ID NO: 39627

SEQ ID NO: 184403 - RNA, 64 nt, Homo Sapiens; identical to SEQ ID NO: 39628

SEQ ID NO: 184404 - RNA, 64 nt, Homo Sapiens; identical to SEQ ID NO: 39629

SEQ ID NO: 184405 - RNA, 64 nt, Homo Sapiens; identical to SEQ ID NO: 39630

SEQ ID NO: 184406 - RNA, 64 nt, Homo Sapiens; identical to SEQ ID NO: 39631

SEQ ID NO: 184407 - RNA, 64 nt, Homo Sapiens; identical to SEQ ID NO: 39632

SEQ ID NO: 184408 - RNA, 64 nt, Homo Sapiens; identical to SEQ ID NO: 39633

SEQ ID NO: 184409 - RNA, 64 nt, Homo Sapiens; identical to SEQ ID NO: 39634

SEQ ID NO: 184410 - RNA, 64 nt, Homo Sapiens; identical to SEQ ID NO: 39635

SEQ ID NO: 184411 - RNA, 64 nt, Homo Sapiens; identical to SEQ ID NO: 39636

SEQ ID NO: 184412 - RNA, 64 nt, Homo Sapiens; identical to SEQ ID NO: 39637

SEQ ID NO: 184413 - RNA, 64 nt, Homo Sapiens; identical to SEQ ID NO: 39638

SEQ ID NO: 184414 - RNA, 64 nt, Homo Sapiens; identical to SEQ ID NO: 39639

SEQ ID NO: 184415 - RNA, 64 nt, Homo Sapiens; identical to SEQ ID NO: 39640

SEQ ID NO: 184416 - RNA, 64 nt, Homo Sapiens; identical to SEQ ID NO: 39641

SEQ ID NO: 184417 - RNA, 64 nt, Homo Sapiens; identical to SEQ ID NO: 39642

SEQ ID NO: 184418 - RNA, 64 nt, Homo Sapiens; identical to SEQ ID NO: 39643

SEQ ID NO: 184419 - RNA, 64 nt, Homo Sapiens; identical to SEQ ID NO: 39644

SEQ ID NO: 184420 - RNA, 64 nt, Homo Sapiens; identical to SEQ ID NO: 39645

SEQ ID NO: 184421 - RNA, 64 nt, Homo Sapiens; identical to SEQ ID NO: 39646

SEQ ID NO: 184422 - RNA, 64 nt, Homo Sapiens; identical to SEQ ID NO: 39647

SEQ ID NO: 184423 - RNA, 64 nt, Homo Sapiens; identical to SEQ ID NO: 39648

SEQ ID NO: 184424 - RNA, 64 nt, Homo Sapiens; identical to SEQ ID NO: 39649

SEQ ID NO: 184425 - RNA, 64 nt, Homo Sapiens; identical to SEQ ID NO: 39650

SEQ ID NO: 184426 - RNA, 64 nt, Homo Sapiens; identical to SEQ ID NO: 39651

SEQ ID NO: 184427 - RNA, 64 nt, Homo Sapiens; identical to SEQ ID NO: 39652

SEQ ID NO: 184428 - RNA, 64 nt, Homo Sapiens; identical to SEQ ID NO: 39653

SEQ ID NO: 184429 - RNA, 64 nt, Homo Sapiens; identical to SEQ ID NO: 39654

SEQ ID NO: 184430 - RNA, 64 nt, Homo Sapiens; identical to SEQ ID NO: 39655

SEQ ID NO: 184431 - RNA, 64 nt, Homo Sapiens; identical to SEQ ID NO: 39656

SEQ ID NO: 184432 - RNA, 64 nt, Homo Sapiens; identical to SEQ ID NO: 39657

SEQ ID NO: 184433 - RNA, 64 nt, Homo Sapiens; identical to SEQ ID NO: 39658

SEQ ID NO: 184434 - RNA, 64 nt, Homo Sapiens; identical to SEQ ID NO: 39659

SEQ ID NO: 184435 - RNA, 64 nt, Homo Sapiens; identical to SEQ ID NO: 39660

SEQ ID NO: 184436 - RNA, 64 nt, Homo Sapiens; identical to SEQ ID NO: 39661

SEQ ID NO: 184437 - RNA, 64 nt, Homo Sapiens; identical to SEQ ID NO: 39662

SEQ ID NO: 184438 - RNA, 64 nt, Homo Sapiens; identical to SEQ ID NO: 39663

SEQ ID NO: 184439 - RNA, 64 nt, Homo Sapiens; identical to SEQ ID NO: 39664

SEQ ID NO: 184440 - RNA, 64 nt, Homo Sapiens; identical to SEQ ID NO: 39665

SEQ ID NO: 184441 - RNA, 64 nt, Homo Sapiens; identical to SEQ ID NO: 39666

SEQ ID NO: 184442 - RNA, 64 nt, Homo Sapiens; identical to SEQ ID NO: 39667

SEQ ID NO: 184443 - RNA, 64 nt, Homo Sapiens; identical to SEQ ID NO: 39668

SEQ ID NO: 184444 - RNA, 64 nt, Homo Sapiens; identical to SEQ ID NO: 39669

SEQ ID NO: 184445 - RNA, 64 nt, Homo Sapiens; identical to SEQ ID NO: 39670

SEQ ID NO: 184446 - RNA, 64 nt, Homo Sapiens; identical to SEQ ID NO: 39671

SEQ ID NO: 184447 - RNA, 64 nt, Homo Sapiens; identical to SEQ ID NO: 39672

SEQ ID NO: 184448 - RNA, 64 nt, Homo Sapiens; identical to SEQ ID NO: 39673

SEQ ID NO: 184449 - RNA, 64 nt, Homo Sapiens; identical to SEQ ID NO: 39674

SEQ ID NO: 184450 - RNA, 64 nt, Homo Sapiens; identical to SEQ ID NO: 39675

SEQ ID NO: 184451 - RNA, 64 nt, Homo Sapiens; identical to SEQ ID NO: 39676

SEQ ID NO: 184452 - RNA, 64 nt, Homo Sapiens; identical to SEQ ID NO: 39677

SEQ ID NO: 184453 - RNA, 64 nt, Homo Sapiens; identical to SEQ ID NO: 39678

SEQ ID NO: 184454 - RNA, 64 nt, Homo Sapiens; identical to SEQ ID NO: 39679

SEQ ID NO: 184455 - RNA, 64 nt, Homo Sapiens; identical to SEQ ID NO: 39680

SEQ ID NO: 184456 - RNA, 64 nt, Homo Sapiens; identical to SEQ ID NO: 39681

SEQ ID NO: 184457 - RNA, 64 nt, Homo Sapiens; identical to SEQ ID NO: 39682

SEQ ID NO: 184458 - RNA, 64 nt, Homo Sapiens; identical to SEQ ID NO: 39683

SEQ ID NO: 184459 - RNA, 64 nt, Homo Sapiens; identical to SEQ ID NO: 39684

SEQ ID NO: 184460 - RNA, 64 nt, Homo Sapiens; identical to SEQ ID NO: 39685

SEQ ID NO: 184461 - RNA, 64 nt, Homo Sapiens; identical to SEQ ID NO: 39686

SEQ ID NO: 184462 - RNA, 64 nt, Homo Sapiens; identical to SEQ ID NO: 39687

SEQ ID NO: 184463 - RNA, 64 nt, Homo Sapiens; identical to SEQ ID NO: 39688

SEQ ID NO: 184464 - RNA, 64 nt, Homo Sapiens; identical to SEQ ID NO: 39689

SEQ ID NO: 184465 - RNA, 64 nt, Homo Sapiens; identical to SEQ ID NO: 39690

SEQ ID NO: 184466 - RNA, 64 nt, Homo Sapiens; identical to SEQ ID NO: 39691

SEQ ID NO: 184467 - RNA, 64 nt, Homo Sapiens; identical to SEQ ID NO: 39692

SEQ ID NO: 184468 - RNA, 64 nt, Homo Sapiens; identical to SEQ ID NO: 39693

SEQ ID NO: 184469 - RNA, 64 nt, Homo Sapiens; identical to SEQ ID NO: 39694

SEQ ID NO: 184470 - RNA, 64 nt, Homo Sapiens; identical to SEQ ID NO: 39695

SEQ ID NO: 184471 - RNA, 64 nt, Homo Sapiens; identical to SEQ ID NO: 39696

SEQ ID NO: 184472 - RNA, 64 nt, Homo Sapiens; identical to SEQ ID NO: 39697

SEQ ID NO: 184473 - RNA, 64 nt, Homo Sapiens; identical to SEQ ID NO: 39698

SEQ ID NO: 184474 - RNA, 64 nt, Homo Sapiens; identical to SEQ ID NO: 39699

SEQ ID NO: 184475 - RNA, 64 nt, Homo Sapiens; identical to SEQ ID NO: 39700

SEQ ID NO: 184476 - RNA, 64 nt, Homo Sapiens; identical to SEQ ID NO: 39701

SEQ ID NO: 184477 - RNA, 64 nt, Homo Sapiens; identical to SEQ ID NO: 39702

SEQ ID NO: 184478 - RNA, 64 nt, Homo Sapiens; identical to SEQ ID NO: 39703

SEQ ID NO: 184479 - RNA, 64 nt, Homo Sapiens; identical to SEQ ID NO: 39704

SEQ ID NO: 184480 - RNA, 64 nt, Homo Sapiens; identical to SEQ ID NO: 39705

SEQ ID NO: 184481 - RNA, 64 nt, Homo Sapiens; identical to SEQ ID NO: 39706

SEQ ID NO: 184482 - RNA, 64 nt, Homo Sapiens; identical to SEQ ID NO: 39707

SEQ ID NO: 184483 - RNA, 64 nt, Homo Sapiens; identical to SEQ ID NO: 39708

SEQ ID NO: 184484 - RNA, 64 nt, Homo Sapiens; identical to SEQ ID NO: 39709

SEQ ID NO: 184485 - RNA, 64 nt, Homo Sapiens; identical to SEQ ID NO: 39710

SEQ ID NO: 184486 - RNA, 64 nt, Homo Sapiens; identical to SEQ ID NO: 39711

SEQ ID NO: 184487 - RNA, 64 nt, Homo Sapiens; identical to SEQ ID NO: 39712

SEQ ID NO: 184488 - RNA, 64 nt, Homo Sapiens; identical to SEQ ID NO: 39713

SEQ ID NO: 184489 - RNA, 64 nt, Homo Sapiens; identical to SEQ ID NO: 39714

SEQ ID NO: 184490 - RNA, 64 nt, Homo Sapiens; identical to SEQ ID NO: 39715

SEQ ID NO: 184491 - RNA, 64 nt, Homo Sapiens; identical to SEQ ID NO: 39716

SEQ ID NO: 184492 - RNA, 64 nt, Homo Sapiens; identical to SEQ ID NO: 39717

SEQ ID NO: 184493 - RNA, 64 nt, Homo Sapiens; identical to SEQ ID NO: 39718

SEQ ID NO: 184494 - RNA, 64 nt, Homo Sapiens; identical to SEQ ID NO: 39719

SEQ ID NO: 184495 - RNA, 64 nt, Homo Sapiens; identical to SEQ ID NO: 39720

SEQ ID NO: 184496 - RNA, 64 nt, Homo Sapiens; identical to SEQ ID NO: 39721

SEQ ID NO: 184497 - RNA, 64 nt, Homo Sapiens; identical to SEQ ID NO: 39722

SEQ ID NO: 184498 - RNA, 64 nt, Homo Sapiens; identical to SEQ ID NO: 39723

SEQ ID NO: 184499 - RNA, 64 nt, Homo Sapiens; identical to SEQ ID NO: 39724

SEQ ID NO: 184500 - RNA, 64 nt, Homo Sapiens; identical to SEQ ID NO: 39725

SEQ ID NO: 184501 - RNA, 64 nt, Homo Sapiens; identical to SEQ ID NO: 39726

SEQ ID NO: 184502 - RNA, 64 nt, Homo Sapiens; identical to SEQ ID NO: 39727

SEQ ID NO: 184503 - RNA, 64 nt, Homo Sapiens; identical to SEQ ID NO: 39728

SEQ ID NO: 184504 - RNA, 64 nt, Homo Sapiens; identical to SEQ ID NO: 39729

SEQ ID NO: 184505 - RNA, 64 nt, Homo Sapiens; identical to SEQ ID NO: 39730

SEQ ID NO: 184506 - RNA, 64 nt, Homo Sapiens; identical to SEQ ID NO: 39731

SEQ ID NO: 184507 - RNA, 64 nt, Homo Sapiens; identical to SEQ ID NO: 39732

SEQ ID NO: 184508 - RNA, 64 nt, Homo Sapiens; identical to SEQ ID NO: 39733

SEQ ID NO: 184509 - RNA, 64 nt, Homo Sapiens; identical to SEQ ID NO: 39734

SEQ ID NO: 184510 - RNA, 64 nt, Homo Sapiens; identical to SEQ ID NO: 39735

SEQ ID NO: 184511 - RNA, 64 nt, Homo Sapiens; identical to SEQ ID NO: 39736

SEQ ID NO: 184512 - RNA, 64 nt, Homo Sapiens; identical to SEQ ID NO: 39737

SEQ ID NO: 184513 - RNA, 64 nt, Homo Sapiens; identical to SEQ ID NO: 39738

SEQ ID NO: 184514 - RNA, 64 nt, Homo Sapiens; identical to SEQ ID NO: 39739

SEQ ID NO: 184515 - RNA, 64 nt, Homo Sapiens; identical to SEQ ID NO: 39740

SEQ ID NO: 184516 - RNA, 64 nt, Homo Sapiens; identical to SEQ ID NO: 39741

SEQ ID NO: 184517 - RNA, 64 nt, Homo Sapiens; identical to SEQ ID NO: 39742

SEQ ID NO: 184518 - RNA, 64 nt, Homo Sapiens; identical to SEQ ID NO: 39743

SEQ ID NO: 184519 - RNA, 64 nt, Homo Sapiens; identical to SEQ ID NO: 39744

SEQ ID NO: 184520 - RNA, 64 nt, Homo Sapiens; identical to SEQ ID NO: 39745

SEQ ID NO: 184521 - RNA, 64 nt, Homo Sapiens; identical to SEQ ID NO: 39746

SEQ ID NO: 184522 - RNA, 64 nt, Homo Sapiens; identical to SEQ ID NO: 39747

SEQ ID NO: 184523 - RNA, 64 nt, Homo Sapiens; identical to SEQ ID NO: 39748

SEQ ID NO: 184524 - RNA, 64 nt, Homo Sapiens; identical to SEQ ID NO: 39749

SEQ ID NO: 184525 - RNA, 64 nt, Homo Sapiens; identical to SEQ ID NO: 39750

SEQ ID NO: 184526 - RNA, 64 nt, Homo Sapiens; identical to SEQ ID NO: 39751

SEQ ID NO: 184527 - RNA, 64 nt, Homo Sapiens; identical to SEQ ID NO: 39752

SEQ ID NO: 184528 - RNA, 64 nt, Homo Sapiens; identical to SEQ ID NO: 39753

SEQ ID NO: 184529 - RNA, 64 nt, Homo Sapiens; identical to SEQ ID NO: 39754

SEQ ID NO: 184530 - RNA, 64 nt, Homo Sapiens; identical to SEQ ID NO: 39755

SEQ ID NO: 184531 - RNA, 64 nt, Homo Sapiens; identical to SEQ ID NO: 39756

SEQ ID NO: 184532 - RNA, 64 nt, Homo Sapiens; identical to SEQ ID NO: 39757

SEQ ID NO: 184533 - RNA, 64 nt, Homo Sapiens; identical to SEQ ID NO: 39758

SEQ ID NO: 184534 - RNA, 64 nt, Homo Sapiens; identical to SEQ ID NO: 39759

SEQ ID NO: 184535 - RNA, 64 nt, Homo Sapiens; identical to SEQ ID NO: 39760

SEQ ID NO: 184536 - RNA, 64 nt, Homo Sapiens; identical to SEQ ID NO: 39761

SEQ ID NO: 184537 - RNA, 64 nt, Homo Sapiens; identical to SEQ ID NO: 39762

SEQ ID NO: 184538 - RNA, 64 nt, Homo Sapiens; identical to SEQ ID NO: 39763

SEQ ID NO: 184539 - RNA, 64 nt, Homo Sapiens; identical to SEQ ID NO: 39764

SEQ ID NO: 184540 - RNA, 64 nt, Homo Sapiens; identical to SEQ ID NO: 39765

SEQ ID NO: 184541 - RNA, 64 nt, Homo Sapiens; identical to SEQ ID NO: 39766

SEQ ID NO: 184542 - RNA, 64 nt, Homo Sapiens; identical to SEQ ID NO: 39767

SEQ ID NO: 184543 - RNA, 64 nt, Homo Sapiens; identical to SEQ ID NO: 39768

SEQ ID NO: 184544 - RNA, 64 nt, Homo Sapiens; identical to SEQ ID NO: 39769

SEQ ID NO: 184545 - RNA, 64 nt, Homo Sapiens; identical to SEQ ID NO: 39770

SEQ ID NO: 184546 - RNA, 64 nt, Homo Sapiens; identical to SEQ ID NO: 39771

SEQ ID NO: 184547 - RNA, 64 nt, Homo Sapiens; identical to SEQ ID NO: 39772

SEQ ID NO: 184548 - RNA, 64 nt, Homo Sapiens; identical to SEQ ID NO: 39773

SEQ ID NO: 184549 - RNA, 64 nt, Homo Sapiens; identical to SEQ ID NO: 39774

SEQ ID NO: 184550 - RNA, 64 nt, Homo Sapiens; identical to SEQ ID NO: 39775

SEQ ID NO: 184551 - RNA, 64 nt, Homo Sapiens; identical to SEQ ID NO: 39776

SEQ ID NO: 184552 - RNA, 64 nt, Homo Sapiens; identical to SEQ ID NO: 39777

SEQ ID NO: 184553 - RNA, 64 nt, Homo Sapiens; identical to SEQ ID NO: 39778

SEQ ID NO: 184554 - RNA, 64 nt, Homo Sapiens; identical to SEQ ID NO: 39779

SEQ ID NO: 184555 - RNA, 64 nt, Homo Sapiens; identical to SEQ ID NO: 39780

SEQ ID NO: 184556 - RNA, 64 nt, Homo Sapiens; identical to SEQ ID NO: 39781

SEQ ID NO: 184557 - RNA, 64 nt, Homo Sapiens; identical to SEQ ID NO: 39782

SEQ ID NO: 184558 - RNA, 64 nt, Homo Sapiens; identical to SEQ ID NO: 39783

SEQ ID NO: 184559 - RNA, 64 nt, Homo Sapiens; identical to SEQ ID NO: 39784

SEQ ID NO: 184560 - RNA, 64 nt, Homo Sapiens; identical to SEQ ID NO: 39785

SEQ ID NO: 184561 - RNA, 64 nt, Homo Sapiens; identical to SEQ ID NO: 39786

SEQ ID NO: 184562 - RNA, 64 nt, Homo Sapiens; identical to SEQ ID NO: 39787

SEQ ID NO: 184563 - RNA, 64 nt, Homo Sapiens; identical to SEQ ID NO: 39788

SEQ ID NO: 184564 - RNA, 64 nt, Homo Sapiens; identical to SEQ ID NO: 39789

SEQ ID NO: 184565 - RNA, 64 nt, Homo Sapiens; identical to SEQ ID NO: 39790

SEQ ID NO: 184566 - RNA, 64 nt, Homo Sapiens; identical to SEQ ID NO: 39791

SEQ ID NO: 184567 - RNA, 64 nt, Homo Sapiens; identical to SEQ ID NO: 39792

SEQ ID NO: 184568 - RNA, 64 nt, Homo Sapiens; identical to SEQ ID NO: 39793

SEQ ID NO: 184569 - RNA, 64 nt, Homo Sapiens; identical to SEQ ID NO: 39794

SEQ ID NO: 184570 - RNA, 64 nt, Homo Sapiens; identical to SEQ ID NO: 39795

SEQ ID NO: 184571 - RNA, 64 nt, Homo Sapiens; identical to SEQ ID NO: 39796

SEQ ID NO: 184572 - RNA, 64 nt, Homo Sapiens; identical to SEQ ID NO: 39797

SEQ ID NO: 184573 - RNA, 64 nt, Homo Sapiens; identical to SEQ ID NO: 39798

SEQ ID NO: 184574 - RNA, 64 nt, Homo Sapiens; identical to SEQ ID NO: 39799

SEQ ID NO: 184575 - RNA, 64 nt, Homo Sapiens; identical to SEQ ID NO: 39800

SEQ ID NO: 184576 - RNA, 64 nt, Homo Sapiens; identical to SEQ ID NO: 39801

SEQ ID NO: 184577 - RNA, 64 nt, Homo Sapiens; identical to SEQ ID NO: 39802

SEQ ID NO: 184578 - RNA, 64 nt, Homo Sapiens; identical to SEQ ID NO: 39803

SEQ ID NO: 184579 - RNA, 64 nt, Homo Sapiens; identical to SEQ ID NO: 39804

SEQ ID NO: 184580 - RNA, 64 nt, Homo Sapiens; identical to SEQ ID NO: 39805

SEQ ID NO: 184581 - RNA, 64 nt, Homo Sapiens; identical to SEQ ID NO: 39806

SEQ ID NO: 184582 - RNA, 64 nt, Homo Sapiens; identical to SEQ ID NO: 39807

SEQ ID NO: 184583 - RNA, 64 nt, Homo Sapiens; identical to SEQ ID NO: 39808

SEQ ID NO: 184584 - RNA, 64 nt, Homo Sapiens; identical to SEQ ID NO: 39809

SEQ ID NO: 184585 - RNA, 64 nt, Homo Sapiens; identical to SEQ ID NO: 39810

SEQ ID NO: 184586 - RNA, 64 nt, Homo Sapiens; identical to SEQ ID NO: 39811

SEQ ID NO: 184587 - RNA, 64 nt, Homo Sapiens; identical to SEQ ID NO: 39812

SEQ ID NO: 184588 - RNA, 64 nt, Homo Sapiens; identical to SEQ ID NO: 39813

SEQ ID NO: 184589 - RNA, 64 nt, Homo Sapiens; identical to SEQ ID NO: 39814

SEQ ID NO: 184590 - RNA, 64 nt, Homo Sapiens; identical to SEQ ID NO: 39815

SEQ ID NO: 184591 - RNA, 64 nt, Homo Sapiens; identical to SEQ ID NO: 39816

SEQ ID NO: 184592 - RNA, 64 nt, Homo Sapiens; identical to SEQ ID NO: 39817

SEQ ID NO: 184593 - RNA, 64 nt, Homo Sapiens; identical to SEQ ID NO: 39818

SEQ ID NO: 184594 - RNA, 64 nt, Homo Sapiens; identical to SEQ ID NO: 39819

SEQ ID NO: 184595 - RNA, 64 nt, Homo Sapiens; identical to SEQ ID NO: 39820

SEQ ID NO: 184596 - RNA, 64 nt, Homo Sapiens; identical to SEQ ID NO: 39821

SEQ ID NO: 184597 - RNA, 64 nt, Homo Sapiens; identical to SEQ ID NO: 39822

SEQ ID NO: 184598 - RNA, 64 nt, Homo Sapiens; identical to SEQ ID NO: 39823

SEQ ID NO: 184599 - RNA, 64 nt, Homo Sapiens; identical to SEQ ID NO: 39824

SEQ ID NO: 184600 - RNA, 64 nt, Homo Sapiens; identical to SEQ ID NO: 39825

SEQ ID NO: 184601 - RNA, 64 nt, Homo Sapiens; identical to SEQ ID NO: 39826

SEQ ID NO: 184602 - RNA, 64 nt, Homo Sapiens; identical to SEQ ID NO: 39827

SEQ ID NO: 184603 - RNA, 64 nt, Homo Sapiens; identical to SEQ ID NO: 39828

SEQ ID NO: 184604 - RNA, 64 nt, Homo Sapiens; identical to SEQ ID NO: 39829

SEQ ID NO: 184605 - RNA, 64 nt, Homo Sapiens; identical to SEQ ID NO: 39830

SEQ ID NO: 184606 - RNA, 64 nt, Homo Sapiens; identical to SEQ ID NO: 39831

SEQ ID NO: 184607 - RNA, 64 nt, Homo Sapiens; identical to SEQ ID NO: 39832

SEQ ID NO: 184608 - RNA, 64 nt, Homo Sapiens; identical to SEQ ID NO: 39833

SEQ ID NO: 184609 - RNA, 64 nt, Homo Sapiens; identical to SEQ ID NO: 39834

SEQ ID NO: 184610 - RNA, 64 nt, Homo Sapiens; identical to SEQ ID NO: 39835

SEQ ID NO: 184611 - RNA, 64 nt, Homo Sapiens; identical to SEQ ID NO: 39836

SEQ ID NO: 184612 - RNA, 64 nt, Homo Sapiens; identical to SEQ ID NO: 39837

SEQ ID NO: 184613 - RNA, 64 nt, Homo Sapiens; identical to SEQ ID NO: 39838

SEQ ID NO: 184614 - RNA, 64 nt, Homo Sapiens; identical to SEQ ID NO: 39839

SEQ ID NO: 184615 - RNA, 64 nt, Homo Sapiens; identical to SEQ ID NO: 39840

SEQ ID NO: 184616 - RNA, 64 nt, Homo Sapiens; identical to SEQ ID NO: 39841

SEQ ID NO: 184617 - RNA, 64 nt, Homo Sapiens; identical to SEQ ID NO: 39842

SEQ ID NO: 184618 - RNA, 64 nt, Homo Sapiens; identical to SEQ ID NO: 39843

SEQ ID NO: 184619 - RNA, 64 nt, Homo Sapiens; identical to SEQ ID NO: 39844

SEQ ID NO: 184620 - RNA, 64 nt, Homo Sapiens; identical to SEQ ID NO: 39845

SEQ ID NO: 184621 - RNA, 64 nt, Homo Sapiens; identical to SEQ ID NO: 39846

SEQ ID NO: 184622 - RNA, 64 nt, Homo Sapiens; identical to SEQ ID NO: 39847

SEQ ID NO: 184623 - RNA, 64 nt, Homo Sapiens; identical to SEQ ID NO: 39848

SEQ ID NO: 184624 - RNA, 64 nt, Homo Sapiens; identical to SEQ ID NO: 39849

SEQ ID NO: 184625 - RNA, 64 nt, Homo Sapiens; identical to SEQ ID NO: 39850

SEQ ID NO: 184626 - RNA, 64 nt, Homo Sapiens; identical to SEQ ID NO: 39851

SEQ ID NO: 184627 - RNA, 64 nt, Homo Sapiens; identical to SEQ ID NO: 39852

SEQ ID NO: 184628 - RNA, 64 nt, Homo Sapiens; identical to SEQ ID NO: 39853

SEQ ID NO: 184629 - RNA, 64 nt, Homo Sapiens; identical to SEQ ID NO: 39854

SEQ ID NO: 184630 - RNA, 64 nt, Homo Sapiens; identical to SEQ ID NO: 39855

SEQ ID NO: 184631 - RNA, 64 nt, Homo Sapiens; identical to SEQ ID NO: 39856

SEQ ID NO: 184632 - RNA, 64 nt, Homo Sapiens; identical to SEQ ID NO: 39857

SEQ ID NO: 184633 - RNA, 64 nt, Homo Sapiens; identical to SEQ ID NO: 39858

SEQ ID NO: 184634 - RNA, 64 nt, Homo Sapiens; identical to SEQ ID NO: 39859

SEQ ID NO: 184635 - RNA, 64 nt, Homo Sapiens; identical to SEQ ID NO: 39860

SEQ ID NO: 184636 - RNA, 64 nt, Homo Sapiens; identical to SEQ ID NO: 39861

SEQ ID NO: 184637 - RNA, 64 nt, Homo Sapiens; identical to SEQ ID NO: 39862

SEQ ID NO: 184638 - RNA, 64 nt, Homo Sapiens; identical to SEQ ID NO: 39863

SEQ ID NO: 184639 - RNA, 64 nt, Homo Sapiens; identical to SEQ ID NO: 39864

SEQ ID NO: 184640 - RNA, 64 nt, Homo Sapiens; identical to SEQ ID NO: 39865

SEQ ID NO: 184641 - RNA, 64 nt, Homo Sapiens; identical to SEQ ID NO: 39866

SEQ ID NO: 184642 - RNA, 64 nt, Homo Sapiens; identical to SEQ ID NO: 39867

SEQ ID NO: 184643 - RNA, 64 nt, Homo Sapiens; identical to SEQ ID NO: 39868

SEQ ID NO: 184644 - RNA, 64 nt, Homo Sapiens; identical to SEQ ID NO: 39869

SEQ ID NO: 184645 - RNA, 64 nt, Homo Sapiens; identical to SEQ ID NO: 39870

SEQ ID NO: 184646 - RNA, 64 nt, Homo Sapiens; identical to SEQ ID NO: 39871

SEQ ID NO: 184647 - RNA, 64 nt, Homo Sapiens; identical to SEQ ID NO: 39872

SEQ ID NO: 184648 - RNA, 64 nt, Homo Sapiens; identical to SEQ ID NO: 39873

SEQ ID NO: 184649 - RNA, 64 nt, Homo Sapiens; identical to SEQ ID NO: 39874

SEQ ID NO: 184650 - RNA, 64 nt, Homo Sapiens; identical to SEQ ID NO: 39875

SEQ ID NO: 184651 - RNA, 64 nt, Homo Sapiens; identical to SEQ ID NO: 39876

SEQ ID NO: 184652 - RNA, 64 nt, Homo Sapiens; identical to SEQ ID NO: 39877

SEQ ID NO: 184653 - RNA, 64 nt, Homo Sapiens; identical to SEQ ID NO: 39878

SEQ ID NO: 184654 - RNA, 64 nt, Homo Sapiens; identical to SEQ ID NO: 39879

SEQ ID NO: 184655 - RNA, 64 nt, Homo Sapiens; identical to SEQ ID NO: 39880

SEQ ID NO: 184656 - RNA, 64 nt, Homo Sapiens; identical to SEQ ID NO: 39881

SEQ ID NO: 184657 - RNA, 64 nt, Homo Sapiens; identical to SEQ ID NO: 39882

SEQ ID NO: 184658 - RNA, 64 nt, Homo Sapiens; identical to SEQ ID NO: 39883

SEQ ID NO: 184659 - RNA, 64 nt, Homo Sapiens; identical to SEQ ID NO: 39884

SEQ ID NO: 184660 - RNA, 64 nt, Homo Sapiens; identical to SEQ ID NO: 39885

SEQ ID NO: 184661 - RNA, 64 nt, Homo Sapiens; identical to SEQ ID NO: 39886

SEQ ID NO: 184662 - RNA, 64 nt, Homo Sapiens; identical to SEQ ID NO: 39887

SEQ ID NO: 184663 - RNA, 64 nt, Homo Sapiens; identical to SEQ ID NO: 39888

SEQ ID NO: 184664 - RNA, 64 nt, Homo Sapiens; identical to SEQ ID NO: 39889

SEQ ID NO: 184665 - RNA, 64 nt, Homo Sapiens; identical to SEQ ID NO: 39890

SEQ ID NO: 184666 - RNA, 64 nt, Homo Sapiens; identical to SEQ ID NO: 39891

SEQ ID NO: 184667 - RNA, 64 nt, Homo Sapiens; identical to SEQ ID NO: 39892

SEQ ID NO: 184668 - RNA, 64 nt, Homo Sapiens; identical to SEQ ID NO: 39893

SEQ ID NO: 184669 - RNA, 64 nt, Homo Sapiens; identical to SEQ ID NO: 39894

SEQ ID NO: 184670 - RNA, 64 nt, Homo Sapiens; identical to SEQ ID NO: 39895

SEQ ID NO: 184671 - RNA, 64 nt, Homo Sapiens; identical to SEQ ID NO: 39896

SEQ ID NO: 184672 - RNA, 64 nt, Homo Sapiens; identical to SEQ ID NO: 39897

SEQ ID NO: 184673 - RNA, 64 nt, Homo Sapiens; identical to SEQ ID NO: 39898

SEQ ID NO: 184674 - RNA, 64 nt, Homo Sapiens; identical to SEQ ID NO: 39899

SEQ ID NO: 184675 - RNA, 64 nt, Homo Sapiens; identical to SEQ ID NO: 39900

SEQ ID NO: 184676 - RNA, 64 nt, Homo Sapiens; identical to SEQ ID NO: 39901

SEQ ID NO: 184677 - RNA, 64 nt, Homo Sapiens; identical to SEQ ID NO: 39902

SEQ ID NO: 184678 - RNA, 64 nt, Homo Sapiens; identical to SEQ ID NO: 39903

SEQ ID NO: 184679 - RNA, 64 nt, Homo Sapiens; identical to SEQ ID NO: 39904

SEQ ID NO: 184680 - RNA, 64 nt, Homo Sapiens; identical to SEQ ID NO: 39905

SEQ ID NO: 184681 - RNA, 64 nt, Homo Sapiens; identical to SEQ ID NO: 39906

SEQ ID NO: 184682 - RNA, 64 nt, Homo Sapiens; identical to SEQ ID NO: 39907

SEQ ID NO: 184683 - RNA, 64 nt, Homo Sapiens; identical to SEQ ID NO: 39908

SEQ ID NO: 184684 - RNA, 64 nt, Homo Sapiens; identical to SEQ ID NO: 39909

SEQ ID NO: 184685 - RNA, 64 nt, Homo Sapiens; identical to SEQ ID NO: 39910

SEQ ID NO: 184686 - RNA, 64 nt, Homo Sapiens; identical to SEQ ID NO: 39911

SEQ ID NO: 184687 - RNA, 64 nt, Homo Sapiens; identical to SEQ ID NO: 39912

SEQ ID NO: 184688 - RNA, 64 nt, Homo Sapiens; identical to SEQ ID NO: 39913

SEQ ID NO: 184689 - RNA, 64 nt, Homo Sapiens; identical to SEQ ID NO: 39914

SEQ ID NO: 184690 - RNA, 64 nt, Homo Sapiens; identical to SEQ ID NO: 39915

SEQ ID NO: 184691 - RNA, 64 nt, Homo Sapiens; identical to SEQ ID NO: 39916

SEQ ID NO: 184692 - RNA, 64 nt, Homo Sapiens; identical to SEQ ID NO: 39917

SEQ ID NO: 184693 - RNA, 64 nt, Homo Sapiens; identical to SEQ ID NO: 39918

SEQ ID NO: 184694 - RNA, 64 nt, Homo Sapiens; identical to SEQ ID NO: 39919

SEQ ID NO: 184695 - RNA, 64 nt, Homo Sapiens; identical to SEQ ID NO: 39920

SEQ ID NO: 184696 - RNA, 64 nt, Homo Sapiens; identical to SEQ ID NO: 39921

SEQ ID NO: 184697 - RNA, 64 nt, Homo Sapiens; identical to SEQ ID NO: 39922

SEQ ID NO: 184698 - RNA, 64 nt, Homo Sapiens; identical to SEQ ID NO: 39923

SEQ ID NO: 184699 - RNA, 64 nt, Homo Sapiens; identical to SEQ ID NO: 39924

SEQ ID NO: 184700 - RNA, 64 nt, Homo Sapiens; identical to SEQ ID NO: 39925

SEQ ID NO: 184701 - RNA, 64 nt, Homo Sapiens; identical to SEQ ID NO: 39926

SEQ ID NO: 184702 - RNA, 64 nt, Homo Sapiens; identical to SEQ ID NO: 39927

SEQ ID NO: 184703 - RNA, 64 nt, Homo Sapiens; identical to SEQ ID NO: 39928

SEQ ID NO: 184704 - RNA, 64 nt, Homo Sapiens; identical to SEQ ID NO: 39929

SEQ ID NO: 184705 - RNA, 64 nt, Homo Sapiens; identical to SEQ ID NO: 39930

SEQ ID NO: 184706 - RNA, 64 nt, Homo Sapiens; identical to SEQ ID NO: 39931

SEQ ID NO: 184707 - RNA, 64 nt, Homo Sapiens; identical to SEQ ID NO: 39932

SEQ ID NO: 184708 - RNA, 64 nt, Homo Sapiens; identical to SEQ ID NO: 39933

SEQ ID NO: 184709 - RNA, 64 nt, Homo Sapiens; identical to SEQ ID NO: 39934

SEQ ID NO: 184710 - RNA, 64 nt, Homo Sapiens; identical to SEQ ID NO: 39935

SEQ ID NO: 184711 - RNA, 64 nt, Homo Sapiens; identical to SEQ ID NO: 39936

SEQ ID NO: 184712 - RNA, 64 nt, Homo Sapiens; identical to SEQ ID NO: 39937

SEQ ID NO: 184713 - RNA, 64 nt, Homo Sapiens; identical to SEQ ID NO: 39938

SEQ ID NO: 184714 - RNA, 64 nt, Homo Sapiens; identical to SEQ ID NO: 39939

SEQ ID NO: 184715 - RNA, 64 nt, Homo Sapiens; identical to SEQ ID NO: 39940

SEQ ID NO: 184716 - RNA, 64 nt, Homo Sapiens; identical to SEQ ID NO: 39941

SEQ ID NO: 184717 - RNA, 64 nt, Homo Sapiens; identical to SEQ ID NO: 39942

SEQ ID NO: 184718 - RNA, 64 nt, Homo Sapiens; identical to SEQ ID NO: 39943

SEQ ID NO: 184719 - RNA, 64 nt, Homo Sapiens; identical to SEQ ID NO: 39944

SEQ ID NO: 184720 - RNA, 64 nt, Homo Sapiens; identical to SEQ ID NO: 39945

SEQ ID NO: 184721 - RNA, 64 nt, Homo Sapiens; identical to SEQ ID NO: 39946

SEQ ID NO: 184722 - RNA, 64 nt, Homo Sapiens; identical to SEQ ID NO: 39947

SEQ ID NO: 184723 - RNA, 64 nt, Homo Sapiens; identical to SEQ ID NO: 39948

SEQ ID NO: 184724 - RNA, 64 nt, Homo Sapiens; identical to SEQ ID NO: 39949

SEQ ID NO: 184725 - RNA, 64 nt, Homo Sapiens; identical to SEQ ID NO: 39950

SEQ ID NO: 184726 - RNA, 64 nt, Homo Sapiens; identical to SEQ ID NO: 39951

SEQ ID NO: 184727 - RNA, 64 nt, Homo Sapiens; identical to SEQ ID NO: 39952

SEQ ID NO: 184728 - RNA, 64 nt, Homo Sapiens; identical to SEQ ID NO: 39953

SEQ ID NO: 184729 - RNA, 64 nt, Homo Sapiens; identical to SEQ ID NO: 39954

SEQ ID NO: 184730 - RNA, 64 nt, Homo Sapiens; identical to SEQ ID NO: 39955

SEQ ID NO: 184731 - RNA, 64 nt, Homo Sapiens; identical to SEQ ID NO: 39956

SEQ ID NO: 184732 - RNA, 64 nt, Homo Sapiens; identical to SEQ ID NO: 39957

SEQ ID NO: 184733 - RNA, 64 nt, Homo Sapiens; identical to SEQ ID NO: 39958

SEQ ID NO: 184734 - RNA, 64 nt, Homo Sapiens; identical to SEQ ID NO: 39959

SEQ ID NO: 184735 - RNA, 64 nt, Homo Sapiens; identical to SEQ ID NO: 39960

SEQ ID NO: 184736 - RNA, 64 nt, Homo Sapiens; identical to SEQ ID NO: 39961

SEQ ID NO: 184737 - RNA, 64 nt, Homo Sapiens; identical to SEQ ID NO: 39962

SEQ ID NO: 184738 - RNA, 64 nt, Homo Sapiens; identical to SEQ ID NO: 39963

SEQ ID NO: 184739 - RNA, 64 nt, Homo Sapiens; identical to SEQ ID NO: 39964

SEQ ID NO: 184740 - RNA, 64 nt, Homo Sapiens; identical to SEQ ID NO: 39965

SEQ ID NO: 184741 - RNA, 64 nt, Homo Sapiens; identical to SEQ ID NO: 39966

SEQ ID NO: 184742 - RNA, 64 nt, Homo Sapiens; identical to SEQ ID NO: 39967

SEQ ID NO: 184743 - RNA, 64 nt, Homo Sapiens; identical to SEQ ID NO: 39968

SEQ ID NO: 184744 - RNA, 64 nt, Homo Sapiens; identical to SEQ ID NO: 39969

SEQ ID NO: 184745 - RNA, 64 nt, Homo Sapiens; identical to SEQ ID NO: 39970

SEQ ID NO: 184746 - RNA, 64 nt, Homo Sapiens; identical to SEQ ID NO: 39971

SEQ ID NO: 184747 - RNA, 64 nt, Homo Sapiens; identical to SEQ ID NO: 39972

SEQ ID NO: 184748 - RNA, 64 nt, Homo Sapiens; identical to SEQ ID NO: 39973

SEQ ID NO: 184749 - RNA, 64 nt, Homo Sapiens; identical to SEQ ID NO: 39974

SEQ ID NO: 184750 - RNA, 64 nt, Homo Sapiens; identical to SEQ ID NO: 39975

SEQ ID NO: 184751 - RNA, 64 nt, Homo Sapiens; identical to SEQ ID NO: 39976

SEQ ID NO: 184752 - RNA, 64 nt, Homo Sapiens; identical to SEQ ID NO: 39977

SEQ ID NO: 184753 - RNA, 64 nt, Homo Sapiens; identical to SEQ ID NO: 39978

SEQ ID NO: 184754 - RNA, 64 nt, Homo Sapiens; identical to SEQ ID NO: 39979

SEQ ID NO: 184755 - RNA, 64 nt, Homo Sapiens; identical to SEQ ID NO: 39980

SEQ ID NO: 184756 - RNA, 64 nt, Homo Sapiens; identical to SEQ ID NO: 39981

SEQ ID NO: 184757 - RNA, 64 nt, Homo Sapiens; identical to SEQ ID NO: 39982

SEQ ID NO: 184758 - RNA, 64 nt, Homo Sapiens; identical to SEQ ID NO: 39983

SEQ ID NO: 184759 - RNA, 64 nt, Homo Sapiens; identical to SEQ ID NO: 39984

SEQ ID NO: 184760 - RNA, 64 nt, Homo Sapiens; identical to SEQ ID NO: 39985

SEQ ID NO: 184761 - RNA, 64 nt, Homo Sapiens; identical to SEQ ID NO: 39986

SEQ ID NO: 184762 - RNA, 64 nt, Homo Sapiens; identical to SEQ ID NO: 39987

SEQ ID NO: 184763 - RNA, 64 nt, Homo Sapiens; identical to SEQ ID NO: 39988

SEQ ID NO: 184764 - RNA, 64 nt, Homo Sapiens; identical to SEQ ID NO: 39989

SEQ ID NO: 184765 - RNA, 64 nt, Homo Sapiens; identical to SEQ ID NO: 39990

SEQ ID NO: 184766 - RNA, 64 nt, Homo Sapiens; identical to SEQ ID NO: 39991

SEQ ID NO: 184767 - RNA, 64 nt, Homo Sapiens; identical to SEQ ID NO: 39992

SEQ ID NO: 184768 - RNA, 64 nt, Homo Sapiens; identical to SEQ ID NO: 39993

SEQ ID NO: 184769 - RNA, 64 nt, Homo Sapiens; identical to SEQ ID NO: 39994

SEQ ID NO: 184770 - RNA, 64 nt, Homo Sapiens; identical to SEQ ID NO: 39995

SEQ ID NO: 184771 - RNA, 64 nt, Homo Sapiens; identical to SEQ ID NO: 39996

SEQ ID NO: 184772 - RNA, 64 nt, Homo Sapiens; identical to SEQ ID NO: 39997

SEQ ID NO: 184773 - RNA, 64 nt, Homo Sapiens; identical to SEQ ID NO: 39998

SEQ ID NO: 184774 - RNA, 64 nt, Homo Sapiens; identical to SEQ ID NO: 39999

SEQ ID NO: 184775 - RNA, 64 nt, Homo Sapiens; identical to SEQ ID NO: 40000

SEQ ID NO: 184776 - RNA, 64 nt, Homo Sapiens; identical to SEQ ID NO: 40001

SEQ ID NO: 184777 - RNA, 64 nt, Homo Sapiens; identical to SEQ ID NO: 40002

SEQ ID NO: 184778 - RNA, 64 nt, Homo Sapiens; identical to SEQ ID NO: 40003

SEQ ID NO: 184779 - RNA, 64 nt, Homo Sapiens; identical to SEQ ID NO: 40004

SEQ ID NO: 184780 - RNA, 64 nt, Homo Sapiens; identical to SEQ ID NO: 40005

SEQ ID NO: 184781 - RNA, 64 nt, Homo Sapiens; identical to SEQ ID NO: 40006

SEQ ID NO: 184782 - RNA, 64 nt, Homo Sapiens; identical to SEQ ID NO: 40007

SEQ ID NO: 184783 - RNA, 64 nt, Homo Sapiens; identical to SEQ ID NO: 40008

SEQ ID NO: 184784 - RNA, 64 nt, Homo Sapiens; identical to SEQ ID NO: 40009

SEQ ID NO: 184785 - RNA, 64 nt, Homo Sapiens; identical to SEQ ID NO: 40010

SEQ ID NO: 184786 - RNA, 64 nt, Homo Sapiens; identical to SEQ ID NO: 40011

SEQ ID NO: 184787 - RNA, 64 nt, Homo Sapiens; identical to SEQ ID NO: 40012

SEQ ID NO: 184788 - RNA, 64 nt, Homo Sapiens; identical to SEQ ID NO: 40013

SEQ ID NO: 184789 - RNA, 64 nt, Homo Sapiens; identical to SEQ ID NO: 40014

SEQ ID NO: 184790 - RNA, 64 nt, Homo Sapiens; identical to SEQ ID NO: 40015

SEQ ID NO: 184791 - RNA, 64 nt, Homo Sapiens; identical to SEQ ID NO: 40016

SEQ ID NO: 184792 - RNA, 64 nt, Homo Sapiens; identical to SEQ ID NO: 40017

SEQ ID NO: 184793 - RNA, 64 nt, Homo Sapiens; identical to SEQ ID NO: 40018

SEQ ID NO: 184794 - RNA, 64 nt, Homo Sapiens; identical to SEQ ID NO: 40019

SEQ ID NO: 184795 - RNA, 64 nt, Homo Sapiens; identical to SEQ ID NO: 40020

SEQ ID NO: 184796 - RNA, 64 nt, Homo Sapiens; identical to SEQ ID NO: 40021

SEQ ID NO: 184797 - RNA, 64 nt, Homo Sapiens; identical to SEQ ID NO: 40022

SEQ ID NO: 184798 - RNA, 64 nt, Homo Sapiens; identical to SEQ ID NO: 40023

SEQ ID NO: 184799 - RNA, 64 nt, Homo Sapiens; identical to SEQ ID NO: 40024

SEQ ID NO: 184800 - RNA, 64 nt, Homo Sapiens; identical to SEQ ID NO: 40025

SEQ ID NO: 184801 - RNA, 64 nt, Homo Sapiens; identical to SEQ ID NO: 40026

SEQ ID NO: 184802 - RNA, 64 nt, Homo Sapiens; identical to SEQ ID NO: 40027

SEQ ID NO: 184803 - RNA, 64 nt, Homo Sapiens; identical to SEQ ID NO: 40028

SEQ ID NO: 184804 - RNA, 64 nt, Homo Sapiens; identical to SEQ ID NO: 40029

SEQ ID NO: 184805 - RNA, 64 nt, Homo Sapiens; identical to SEQ ID NO: 40030

SEQ ID NO: 184806 - RNA, 64 nt, Homo Sapiens; identical to SEQ ID NO: 40031

SEQ ID NO: 184807 - RNA, 64 nt, Homo Sapiens; identical to SEQ ID NO: 40032

SEQ ID NO: 184808 - RNA, 64 nt, Homo Sapiens; identical to SEQ ID NO: 40033

SEQ ID NO: 184809 - RNA, 64 nt, Homo Sapiens; identical to SEQ ID NO: 40034

SEQ ID NO: 184810 - RNA, 64 nt, Homo Sapiens; identical to SEQ ID NO: 40035

SEQ ID NO: 184811 - RNA, 64 nt, Homo Sapiens; identical to SEQ ID NO: 40036

SEQ ID NO: 184812 - RNA, 64 nt, Homo Sapiens; identical to SEQ ID NO: 40037

SEQ ID NO: 184813 - RNA, 64 nt, Homo Sapiens; identical to SEQ ID NO: 40038

SEQ ID NO: 184814 - RNA, 64 nt, Homo Sapiens; identical to SEQ ID NO: 40039

SEQ ID NO: 184815 - RNA, 64 nt, Homo Sapiens; identical to SEQ ID NO: 40040

SEQ ID NO: 184816 - RNA, 64 nt, Homo Sapiens; identical to SEQ ID NO: 40041

SEQ ID NO: 184817 - RNA, 64 nt, Homo Sapiens; identical to SEQ ID NO: 40042

SEQ ID NO: 184818 - RNA, 64 nt, Homo Sapiens; identical to SEQ ID NO: 40043

SEQ ID NO: 184819 - RNA, 64 nt, Homo Sapiens; identical to SEQ ID NO: 40044

SEQ ID NO: 184820 - RNA, 64 nt, Homo Sapiens; identical to SEQ ID NO: 40045

SEQ ID NO: 184821 - RNA, 64 nt, Homo Sapiens; identical to SEQ ID NO: 40046

SEQ ID NO: 184822 - RNA, 64 nt, Homo Sapiens; identical to SEQ ID NO: 40047

SEQ ID NO: 184823 - RNA, 64 nt, Homo Sapiens; identical to SEQ ID NO: 40048

SEQ ID NO: 184824 - RNA, 64 nt, Homo Sapiens; identical to SEQ ID NO: 40049

SEQ ID NO: 184825 - RNA, 64 nt, Homo Sapiens; identical to SEQ ID NO: 40050

SEQ ID NO: 184826 - RNA, 64 nt, Homo Sapiens; identical to SEQ ID NO: 40051

SEQ ID NO: 184827 - RNA, 64 nt, Homo Sapiens; identical to SEQ ID NO: 40052

SEQ ID NO: 184828 - RNA, 64 nt, Homo Sapiens; identical to SEQ ID NO: 40053

SEQ ID NO: 184829 - RNA, 64 nt, Homo Sapiens; identical to SEQ ID NO: 40054

SEQ ID NO: 184830 - RNA, 64 nt, Homo Sapiens; identical to SEQ ID NO: 40055

SEQ ID NO: 184831 - RNA, 64 nt, Homo Sapiens; identical to SEQ ID NO: 40056

SEQ ID NO: 184832 - RNA, 64 nt, Homo Sapiens; identical to SEQ ID NO: 40057

SEQ ID NO: 184833 - RNA, 64 nt, Homo Sapiens; identical to SEQ ID NO: 40058

SEQ ID NO: 184834 - RNA, 64 nt, Homo Sapiens; identical to SEQ ID NO: 40059

SEQ ID NO: 184835 - RNA, 64 nt, Homo Sapiens; identical to SEQ ID NO: 40060

SEQ ID NO: 184836 - RNA, 64 nt, Homo Sapiens; identical to SEQ ID NO: 40061

SEQ ID NO: 184837 - RNA, 64 nt, Homo Sapiens; identical to SEQ ID NO: 40062

SEQ ID NO: 184838 - RNA, 64 nt, Homo Sapiens; identical to SEQ ID NO: 40063

SEQ ID NO: 184839 - RNA, 64 nt, Homo Sapiens; identical to SEQ ID NO: 40064

SEQ ID NO: 184840 - RNA, 64 nt, Homo Sapiens; identical to SEQ ID NO: 40065

SEQ ID NO: 184841 - RNA, 64 nt, Homo Sapiens; identical to SEQ ID NO: 40066

SEQ ID NO: 184842 - RNA, 64 nt, Homo Sapiens; identical to SEQ ID NO: 40067

SEQ ID NO: 184843 - RNA, 64 nt, Homo Sapiens; identical to SEQ ID NO: 40068

SEQ ID NO: 184844 - RNA, 64 nt, Homo Sapiens; identical to SEQ ID NO: 40069

SEQ ID NO: 184845 - RNA, 64 nt, Homo Sapiens; identical to SEQ ID NO: 40070

SEQ ID NO: 184846 - RNA, 64 nt, Homo Sapiens; identical to SEQ ID NO: 40071

SEQ ID NO: 184847 - RNA, 64 nt, Homo Sapiens; identical to SEQ ID NO: 40072

SEQ ID NO: 184848 - RNA, 64 nt, Homo Sapiens; identical to SEQ ID NO: 40073

SEQ ID NO: 184849 - RNA, 64 nt, Homo Sapiens; identical to SEQ ID NO: 40074

SEQ ID NO: 184850 - RNA, 64 nt, Homo Sapiens; identical to SEQ ID NO: 40075

SEQ ID NO: 184851 - RNA, 64 nt, Homo Sapiens; identical to SEQ ID NO: 40076

SEQ ID NO: 184852 - RNA, 64 nt, Homo Sapiens; identical to SEQ ID NO: 40077

SEQ ID NO: 184853 - RNA, 64 nt, Homo Sapiens; identical to SEQ ID NO: 40078

SEQ ID NO: 184854 - RNA, 64 nt, Homo Sapiens; identical to SEQ ID NO: 40079

SEQ ID NO: 184855 - RNA, 64 nt, Homo Sapiens; identical to SEQ ID NO: 40080

SEQ ID NO: 184856 - RNA, 64 nt, Homo Sapiens; identical to SEQ ID NO: 40081

SEQ ID NO: 184857 - RNA, 64 nt, Homo Sapiens; identical to SEQ ID NO: 40082

SEQ ID NO: 184858 - RNA, 64 nt, Homo Sapiens; identical to SEQ ID NO: 40083

SEQ ID NO: 184859 - RNA, 64 nt, Homo Sapiens; identical to SEQ ID NO: 40084

SEQ ID NO: 184860 - RNA, 64 nt, Homo Sapiens; identical to SEQ ID NO: 40085

SEQ ID NO: 184861 - RNA, 64 nt, Homo Sapiens; identical to SEQ ID NO: 40086

SEQ ID NO: 184862 - RNA, 64 nt, Homo Sapiens; identical to SEQ ID NO: 40087

SEQ ID NO: 184863 - RNA, 64 nt, Homo Sapiens; identical to SEQ ID NO: 40088

SEQ ID NO: 184864 - RNA, 64 nt, Homo Sapiens; identical to SEQ ID NO: 40089

SEQ ID NO: 184865 - RNA, 64 nt, Homo Sapiens; identical to SEQ ID NO: 40090

SEQ ID NO: 184866 - RNA, 64 nt, Homo Sapiens; identical to SEQ ID NO: 40091

SEQ ID NO: 184867 - RNA, 64 nt, Homo Sapiens; identical to SEQ ID NO: 40092

SEQ ID NO: 184868 - RNA, 64 nt, Homo Sapiens; identical to SEQ ID NO: 40093

SEQ ID NO: 184869 - RNA, 64 nt, Homo Sapiens; identical to SEQ ID NO: 40094

SEQ ID NO: 184870 - RNA, 64 nt, Homo Sapiens; identical to SEQ ID NO: 40095

SEQ ID NO: 184871 - RNA, 64 nt, Homo Sapiens; identical to SEQ ID NO: 40096

SEQ ID NO: 184872 - RNA, 64 nt, Homo Sapiens; identical to SEQ ID NO: 40097

SEQ ID NO: 184873 - RNA, 64 nt, Homo Sapiens; identical to SEQ ID NO: 40098

SEQ ID NO: 184874 - RNA, 64 nt, Homo Sapiens; identical to SEQ ID NO: 40099

SEQ ID NO: 184875 - RNA, 64 nt, Homo Sapiens; identical to SEQ ID NO: 40100

SEQ ID NO: 184876 - RNA, 64 nt, Homo Sapiens; identical to SEQ ID NO: 40101

SEQ ID NO: 184877 - RNA, 64 nt, Homo Sapiens; identical to SEQ ID NO: 40102

SEQ ID NO: 184878 - RNA, 64 nt, Homo Sapiens; identical to SEQ ID NO: 40103

SEQ ID NO: 184879 - RNA, 64 nt, Homo Sapiens; identical to SEQ ID NO: 40104

SEQ ID NO: 184880 - RNA, 64 nt, Homo Sapiens; identical to SEQ ID NO: 40105

SEQ ID NO: 184881 - RNA, 64 nt, Homo Sapiens; identical to SEQ ID NO: 40106

SEQ ID NO: 184882 - RNA, 64 nt, Homo Sapiens; identical to SEQ ID NO: 40107

SEQ ID NO: 184883 - RNA, 64 nt, Homo Sapiens; identical to SEQ ID NO: 40108

SEQ ID NO: 184884 - RNA, 64 nt, Homo Sapiens; identical to SEQ ID NO: 40109

SEQ ID NO: 184885 - RNA, 64 nt, Homo Sapiens; identical to SEQ ID NO: 40110

SEQ ID NO: 184886 - RNA, 64 nt, Homo Sapiens; identical to SEQ ID NO: 40111

SEQ ID NO: 184887 - RNA, 64 nt, Homo Sapiens; identical to SEQ ID NO: 40112

SEQ ID NO: 184888 - RNA, 64 nt, Homo Sapiens; identical to SEQ ID NO: 40113

SEQ ID NO: 184889 - RNA, 64 nt, Homo Sapiens; identical to SEQ ID NO: 40114

SEQ ID NO: 184890 - RNA, 64 nt, Homo Sapiens; identical to SEQ ID NO: 40115

SEQ ID NO: 184891 - RNA, 64 nt, Homo Sapiens; identical to SEQ ID NO: 40116

SEQ ID NO: 184892 - RNA, 64 nt, Homo Sapiens; identical to SEQ ID NO: 40117

SEQ ID NO: 184893 - RNA, 64 nt, Homo Sapiens; identical to SEQ ID NO: 40118

SEQ ID NO: 184894 - RNA, 64 nt, Homo Sapiens; identical to SEQ ID NO: 40119

SEQ ID NO: 184895 - RNA, 64 nt, Homo Sapiens; identical to SEQ ID NO: 40120

SEQ ID NO: 184896 - RNA, 64 nt, Homo Sapiens; identical to SEQ ID NO: 40121

SEQ ID NO: 184897 - RNA, 64 nt, Homo Sapiens; identical to SEQ ID NO: 40122

SEQ ID NO: 184898 - RNA, 64 nt, Homo Sapiens; identical to SEQ ID NO: 40123

SEQ ID NO: 184899 - RNA, 64 nt, Homo Sapiens; identical to SEQ ID NO: 40124

SEQ ID NO: 184900 - RNA, 64 nt, Homo Sapiens; identical to SEQ ID NO: 40125

SEQ ID NO: 184901 - RNA, 64 nt, Homo Sapiens; identical to SEQ ID NO: 40126

SEQ ID NO: 184902 - RNA, 64 nt, Homo Sapiens; identical to SEQ ID NO: 40127

SEQ ID NO: 184903 - RNA, 64 nt, Homo Sapiens; identical to SEQ ID NO: 40128

SEQ ID NO: 184904 - RNA, 64 nt, Homo Sapiens; identical to SEQ ID NO: 40129

SEQ ID NO: 184905 - RNA, 64 nt, Homo Sapiens; identical to SEQ ID NO: 40130

SEQ ID NO: 184906 - RNA, 64 nt, Homo Sapiens; identical to SEQ ID NO: 40131

SEQ ID NO: 184907 - RNA, 64 nt, Homo Sapiens; identical to SEQ ID NO: 40132

SEQ ID NO: 184908 - RNA, 64 nt, Homo Sapiens; identical to SEQ ID NO: 40133

SEQ ID NO: 184909 - RNA, 64 nt, Homo Sapiens; identical to SEQ ID NO: 40134

SEQ ID NO: 184910 - RNA, 64 nt, Homo Sapiens; identical to SEQ ID NO: 40135

SEQ ID NO: 184911 - RNA, 64 nt, Homo Sapiens; identical to SEQ ID NO: 40136

SEQ ID NO: 184912 - RNA, 64 nt, Homo Sapiens; identical to SEQ ID NO: 40137

SEQ ID NO: 184913 - RNA, 64 nt, Homo Sapiens; identical to SEQ ID NO: 40138

SEQ ID NO: 184914 - RNA, 64 nt, Homo Sapiens; identical to SEQ ID NO: 40139

SEQ ID NO: 184915 - RNA, 64 nt, Homo Sapiens; identical to SEQ ID NO: 40140

SEQ ID NO: 184916 - RNA, 64 nt, Homo Sapiens; identical to SEQ ID NO: 40141

SEQ ID NO: 184917 - RNA, 64 nt, Homo Sapiens; identical to SEQ ID NO: 40142

SEQ ID NO: 184918 - RNA, 64 nt, Homo Sapiens; identical to SEQ ID NO: 40143

SEQ ID NO: 184919 - RNA, 64 nt, Homo Sapiens; identical to SEQ ID NO: 40144

SEQ ID NO: 184920 - RNA, 64 nt, Homo Sapiens; identical to SEQ ID NO: 40145

SEQ ID NO: 184921 - RNA, 64 nt, Homo Sapiens; identical to SEQ ID NO: 40146

SEQ ID NO: 184922 - RNA, 64 nt, Homo Sapiens; identical to SEQ ID NO: 40147

SEQ ID NO: 184923 - RNA, 64 nt, Homo Sapiens; identical to SEQ ID NO: 40148

SEQ ID NO: 184924 - RNA, 64 nt, Homo Sapiens; identical to SEQ ID NO: 40149

SEQ ID NO: 184925 - RNA, 64 nt, Homo Sapiens; identical to SEQ ID NO: 40150

SEQ ID NO: 184926 - RNA, 64 nt, Homo Sapiens; identical to SEQ ID NO: 40151

SEQ ID NO: 184927 - RNA, 64 nt, Homo Sapiens; identical to SEQ ID NO: 40152

SEQ ID NO: 184928 - RNA, 64 nt, Homo Sapiens; identical to SEQ ID NO: 40153

SEQ ID NO: 184929 - RNA, 64 nt, Homo Sapiens; identical to SEQ ID NO: 40154

SEQ ID NO: 184930 - RNA, 64 nt, Homo Sapiens; identical to SEQ ID NO: 40155

SEQ ID NO: 184931 - RNA, 64 nt, Homo Sapiens; identical to SEQ ID NO: 40156

SEQ ID NO: 184932 - RNA, 64 nt, Homo Sapiens; identical to SEQ ID NO: 40157

SEQ ID NO: 184933 - RNA, 64 nt, Homo Sapiens; identical to SEQ ID NO: 40158

SEQ ID NO: 184934 - RNA, 64 nt, Homo Sapiens; identical to SEQ ID NO: 40159

SEQ ID NO: 184935 - RNA, 64 nt, Homo Sapiens; identical to SEQ ID NO: 40160

SEQ ID NO: 184936 - RNA, 64 nt, Homo Sapiens; identical to SEQ ID NO: 40161

SEQ ID NO: 184937 - RNA, 64 nt, Homo Sapiens; identical to SEQ ID NO: 40162

SEQ ID NO: 184938 - RNA, 64 nt, Homo Sapiens; identical to SEQ ID NO: 40163

SEQ ID NO: 184939 - RNA, 64 nt, Homo Sapiens; identical to SEQ ID NO: 40164

SEQ ID NO: 184940 - RNA, 64 nt, Homo Sapiens; identical to SEQ ID NO: 40165

SEQ ID NO: 184941 - RNA, 64 nt, Homo Sapiens; identical to SEQ ID NO: 40166

SEQ ID NO: 184942 - RNA, 64 nt, Homo Sapiens; identical to SEQ ID NO: 40167

SEQ ID NO: 184943 - RNA, 64 nt, Homo Sapiens; identical to SEQ ID NO: 40168

SEQ ID NO: 184944 - RNA, 64 nt, Homo Sapiens; identical to SEQ ID NO: 40169

SEQ ID NO: 184945 - RNA, 64 nt, Homo Sapiens; identical to SEQ ID NO: 40170

SEQ ID NO: 184946 - RNA, 64 nt, Homo Sapiens; identical to SEQ ID NO: 40171

SEQ ID NO: 184947 - RNA, 64 nt, Homo Sapiens; identical to SEQ ID NO: 40172

SEQ ID NO: 184948 - RNA, 64 nt, Homo Sapiens; identical to SEQ ID NO: 40173

SEQ ID NO: 184949 - RNA, 64 nt, Homo Sapiens; identical to SEQ ID NO: 40174

SEQ ID NO: 184950 - RNA, 64 nt, Homo Sapiens; identical to SEQ ID NO: 40175

SEQ ID NO: 184951 - RNA, 64 nt, Homo Sapiens; identical to SEQ ID NO: 40176

SEQ ID NO: 184952 - RNA, 64 nt, Homo Sapiens; identical to SEQ ID NO: 40177

SEQ ID NO: 184953 - RNA, 64 nt, Homo Sapiens; identical to SEQ ID NO: 40178

SEQ ID NO: 184954 - RNA, 64 nt, Homo Sapiens; identical to SEQ ID NO: 40179

SEQ ID NO: 184955 - RNA, 64 nt, Homo Sapiens; identical to SEQ ID NO: 40180

SEQ ID NO: 184956 - RNA, 64 nt, Homo Sapiens; identical to SEQ ID NO: 40181

SEQ ID NO: 184957 - RNA, 64 nt, Homo Sapiens; identical to SEQ ID NO: 40182

SEQ ID NO: 184958 - RNA, 64 nt, Homo Sapiens; identical to SEQ ID NO: 40183

SEQ ID NO: 184959 - RNA, 64 nt, Homo Sapiens; identical to SEQ ID NO: 40184

SEQ ID NO: 184960 - RNA, 64 nt, Homo Sapiens; identical to SEQ ID NO: 40185

SEQ ID NO: 184961 - RNA, 64 nt, Homo Sapiens; identical to SEQ ID NO: 40186

SEQ ID NO: 184962 - RNA, 64 nt, Homo Sapiens; identical to SEQ ID NO: 40187

SEQ ID NO: 184963 - RNA, 64 nt, Homo Sapiens; identical to SEQ ID NO: 40188

SEQ ID NO: 184964 - RNA, 64 nt, Homo Sapiens; identical to SEQ ID NO: 40189

SEQ ID NO: 184965 - RNA, 64 nt, Homo Sapiens; identical to SEQ ID NO: 40190

SEQ ID NO: 184966 - RNA, 64 nt, Homo Sapiens; identical to SEQ ID NO: 40191

SEQ ID NO: 184967 - RNA, 64 nt, Homo Sapiens; identical to SEQ ID NO: 40192

SEQ ID NO: 184968 - RNA, 64 nt, Homo Sapiens; identical to SEQ ID NO: 40193

SEQ ID NO: 184969 - RNA, 64 nt, Homo Sapiens; identical to SEQ ID NO: 40194

SEQ ID NO: 184970 - RNA, 64 nt, Homo Sapiens; identical to SEQ ID NO: 40195

SEQ ID NO: 184971 - RNA, 64 nt, Homo Sapiens; identical to SEQ ID NO: 40196

SEQ ID NO: 184972 - RNA, 64 nt, Homo Sapiens; identical to SEQ ID NO: 40197

SEQ ID NO: 184973 - RNA, 64 nt, Homo Sapiens; identical to SEQ ID NO: 40198

SEQ ID NO: 184974 - RNA, 64 nt, Homo Sapiens; identical to SEQ ID NO: 40199

SEQ ID NO: 184975 - RNA, 64 nt, Homo Sapiens; identical to SEQ ID NO: 40200

SEQ ID NO: 184976 - RNA, 64 nt, Homo Sapiens; identical to SEQ ID NO: 40201

SEQ ID NO: 184977 - RNA, 64 nt, Homo Sapiens; identical to SEQ ID NO: 40202

SEQ ID NO: 184978 - RNA, 64 nt, Homo Sapiens; identical to SEQ ID NO: 40203

SEQ ID NO: 184979 - RNA, 64 nt, Homo Sapiens; identical to SEQ ID NO: 40204

SEQ ID NO: 184980 - RNA, 64 nt, Homo Sapiens; identical to SEQ ID NO: 40205

SEQ ID NO: 184981 - RNA, 64 nt, Homo Sapiens; identical to SEQ ID NO: 40206

SEQ ID NO: 184982 - RNA, 64 nt, Homo Sapiens; identical to SEQ ID NO: 40207

SEQ ID NO: 184983 - RNA, 64 nt, Homo Sapiens; identical to SEQ ID NO: 40208

SEQ ID NO: 184984 - RNA, 64 nt, Homo Sapiens; identical to SEQ ID NO: 40209

SEQ ID NO: 184985 - RNA, 64 nt, Homo Sapiens; identical to SEQ ID NO: 40210

SEQ ID NO: 184986 - RNA, 64 nt, Homo Sapiens; identical to SEQ ID NO: 40211

SEQ ID NO: 184987 - RNA, 64 nt, Homo Sapiens; identical to SEQ ID NO: 40212

SEQ ID NO: 184988 - RNA, 64 nt, Homo Sapiens; identical to SEQ ID NO: 40213

SEQ ID NO: 184989 - RNA, 64 nt, Homo Sapiens; identical to SEQ ID NO: 40214

SEQ ID NO: 184990 - RNA, 64 nt, Homo Sapiens; identical to SEQ ID NO: 40215

SEQ ID NO: 184991 - RNA, 64 nt, Homo Sapiens; identical to SEQ ID NO: 40216

SEQ ID NO: 184992 - RNA, 64 nt, Homo Sapiens; identical to SEQ ID NO: 40217

SEQ ID NO: 184993 - RNA, 64 nt, Homo Sapiens; identical to SEQ ID NO: 40218

SEQ ID NO: 184994 - RNA, 64 nt, Homo Sapiens; identical to SEQ ID NO: 40219

SEQ ID NO: 184995 - RNA, 64 nt, Homo Sapiens; identical to SEQ ID NO: 40220

SEQ ID NO: 184996 - RNA, 64 nt, Homo Sapiens; identical to SEQ ID NO: 40221

SEQ ID NO: 184997 - RNA, 64 nt, Homo Sapiens; identical to SEQ ID NO: 40222

SEQ ID NO: 184998 - RNA, 64 nt, Homo Sapiens; identical to SEQ ID NO: 40223

SEQ ID NO: 184999 - RNA, 64 nt, Homo Sapiens; identical to SEQ ID NO: 40224

SEQ ID NO: 185000 - RNA, 64 nt, Homo Sapiens; identical to SEQ ID NO: 40225

SEQ ID NO: 185001 - RNA, 64 nt, Homo Sapiens; identical to SEQ ID NO: 40226

SEQ ID NO: 185002 - RNA, 64 nt, Homo Sapiens; identical to SEQ ID NO: 40227

SEQ ID NO: 185003 - RNA, 64 nt, Homo Sapiens; identical to SEQ ID NO: 40228

SEQ ID NO: 185004 - RNA, 64 nt, Homo Sapiens; identical to SEQ ID NO: 40229

SEQ ID NO: 185005 - RNA, 64 nt, Homo Sapiens; identical to SEQ ID NO: 40230

SEQ ID NO: 185006 - RNA, 64 nt, Homo Sapiens; identical to SEQ ID NO: 40231

SEQ ID NO: 185007 - RNA, 64 nt, Homo Sapiens; identical to SEQ ID NO: 40232

SEQ ID NO: 185008 - RNA, 64 nt, Homo Sapiens; identical to SEQ ID NO: 40233

SEQ ID NO: 185009 - RNA, 64 nt, Homo Sapiens; identical to SEQ ID NO: 40234

SEQ ID NO: 185010 - RNA, 64 nt, Homo Sapiens; identical to SEQ ID NO: 40235

SEQ ID NO: 185011 - RNA, 64 nt, Homo Sapiens; identical to SEQ ID NO: 40236

SEQ ID NO: 185012 - RNA, 64 nt, Homo Sapiens; identical to SEQ ID NO: 40237

SEQ ID NO: 185013 - RNA, 64 nt, Homo Sapiens; identical to SEQ ID NO: 40238

SEQ ID NO: 185014 - RNA, 64 nt, Homo Sapiens; identical to SEQ ID NO: 40239

SEQ ID NO: 185015 - RNA, 64 nt, Homo Sapiens; identical to SEQ ID NO: 40240

SEQ ID NO: 185016 - RNA, 64 nt, Homo Sapiens; identical to SEQ ID NO: 40241

SEQ ID NO: 185017 - RNA, 64 nt, Homo Sapiens; identical to SEQ ID NO: 40242

SEQ ID NO: 185018 - RNA, 64 nt, Homo Sapiens; identical to SEQ ID NO: 40243

SEQ ID NO: 185019 - RNA, 64 nt, Homo Sapiens; identical to SEQ ID NO: 40244

SEQ ID NO: 185020 - RNA, 64 nt, Homo Sapiens; identical to SEQ ID NO: 40245

SEQ ID NO: 185021 - RNA, 64 nt, Homo Sapiens; identical to SEQ ID NO: 40246

SEQ ID NO: 185022 - RNA, 64 nt, Homo Sapiens; identical to SEQ ID NO: 40247

SEQ ID NO: 185023 - RNA, 64 nt, Homo Sapiens; identical to SEQ ID NO: 40248

SEQ ID NO: 185024 - RNA, 64 nt, Homo Sapiens; identical to SEQ ID NO: 40249

SEQ ID NO: 185025 - RNA, 64 nt, Homo Sapiens; identical to SEQ ID NO: 40250

SEQ ID NO: 185026 - RNA, 64 nt, Homo Sapiens; identical to SEQ ID NO: 40251

SEQ ID NO: 185027 - RNA, 64 nt, Homo Sapiens; identical to SEQ ID NO: 40252

SEQ ID NO: 185028 - RNA, 64 nt, Homo Sapiens; identical to SEQ ID NO: 40253

SEQ ID NO: 185029 - RNA, 64 nt, Homo Sapiens; identical to SEQ ID NO: 40254

SEQ ID NO: 185030 - RNA, 64 nt, Homo Sapiens; identical to SEQ ID NO: 40255

SEQ ID NO: 185031 - RNA, 64 nt, Homo Sapiens; identical to SEQ ID NO: 40256

SEQ ID NO: 185032 - RNA, 64 nt, Homo Sapiens; identical to SEQ ID NO: 40257

SEQ ID NO: 185033 - RNA, 64 nt, Homo Sapiens; identical to SEQ ID NO: 40258

SEQ ID NO: 185034 - RNA, 64 nt, Homo Sapiens; identical to SEQ ID NO: 40259

SEQ ID NO: 185035 - RNA, 64 nt, Homo Sapiens; identical to SEQ ID NO: 40260

SEQ ID NO: 185036 - RNA, 64 nt, Homo Sapiens; identical to SEQ ID NO: 40261

SEQ ID NO: 185037 - RNA, 64 nt, Homo Sapiens; identical to SEQ ID NO: 40262

SEQ ID NO: 185038 - RNA, 64 nt, Homo Sapiens; identical to SEQ ID NO: 40263

SEQ ID NO: 185039 - RNA, 64 nt, Homo Sapiens; identical to SEQ ID NO: 40264

SEQ ID NO: 185040 - RNA, 64 nt, Homo Sapiens; identical to SEQ ID NO: 40265

SEQ ID NO: 185041 - RNA, 64 nt, Homo Sapiens; identical to SEQ ID NO: 40266

SEQ ID NO: 185042 - RNA, 64 nt, Homo Sapiens; identical to SEQ ID NO: 40267

SEQ ID NO: 185043 - RNA, 64 nt, Homo Sapiens; identical to SEQ ID NO: 40268

SEQ ID NO: 185044 - RNA, 64 nt, Homo Sapiens; identical to SEQ ID NO: 40269

SEQ ID NO: 185045 - RNA, 64 nt, Homo Sapiens; identical to SEQ ID NO: 40270

SEQ ID NO: 185046 - RNA, 64 nt, Homo Sapiens; identical to SEQ ID NO: 40271

SEQ ID NO: 185047 - RNA, 64 nt, Homo Sapiens; identical to SEQ ID NO: 40272

SEQ ID NO: 185048 - RNA, 64 nt, Homo Sapiens; identical to SEQ ID NO: 40273

SEQ ID NO: 185049 - RNA, 64 nt, Homo Sapiens; identical to SEQ ID NO: 40274

SEQ ID NO: 185050 - RNA, 64 nt, Homo Sapiens; identical to SEQ ID NO: 40275

SEQ ID NO: 185051 - RNA, 64 nt, Homo Sapiens; identical to SEQ ID NO: 40276

SEQ ID NO: 185052 - RNA, 64 nt, Homo Sapiens; identical to SEQ ID NO: 40277

SEQ ID NO: 185053 - RNA, 64 nt, Homo Sapiens; identical to SEQ ID NO: 40278

SEQ ID NO: 185054 - RNA, 64 nt, Homo Sapiens; identical to SEQ ID NO: 40279

SEQ ID NO: 185055 - RNA, 64 nt, Homo Sapiens; identical to SEQ ID NO: 40280

SEQ ID NO: 185056 - RNA, 64 nt, Homo Sapiens; identical to SEQ ID NO: 40281

SEQ ID NO: 185057 - RNA, 64 nt, Homo Sapiens; identical to SEQ ID NO: 40282

SEQ ID NO: 185058 - RNA, 64 nt, Homo Sapiens; identical to SEQ ID NO: 40283

SEQ ID NO: 185059 - RNA, 64 nt, Homo Sapiens; identical to SEQ ID NO: 40284

SEQ ID NO: 185060 - RNA, 64 nt, Homo Sapiens; identical to SEQ ID NO: 40285

SEQ ID NO: 185061 - RNA, 64 nt, Homo Sapiens; identical to SEQ ID NO: 40286

SEQ ID NO: 185062 - RNA, 64 nt, Homo Sapiens; identical to SEQ ID NO: 40287

SEQ ID NO: 185063 - RNA, 64 nt, Homo Sapiens; identical to SEQ ID NO: 40288

SEQ ID NO: 185064 - RNA, 64 nt, Homo Sapiens; identical to SEQ ID NO: 40289

SEQ ID NO: 185065 - RNA, 64 nt, Homo Sapiens; identical to SEQ ID NO: 40290

SEQ ID NO: 185066 - RNA, 64 nt, Homo Sapiens; identical to SEQ ID NO: 40291

SEQ ID NO: 185067 - RNA, 64 nt, Homo Sapiens; identical to SEQ ID NO: 40292

SEQ ID NO: 185068 - RNA, 64 nt, Homo Sapiens; identical to SEQ ID NO: 40293

SEQ ID NO: 185069 - RNA, 64 nt, Homo Sapiens; identical to SEQ ID NO: 40294

SEQ ID NO: 185070 - RNA, 64 nt, Homo Sapiens; identical to SEQ ID NO: 40295

SEQ ID NO: 185071 - RNA, 64 nt, Homo Sapiens; identical to SEQ ID NO: 40296

SEQ ID NO: 185072 - RNA, 64 nt, Homo Sapiens; identical to SEQ ID NO: 40297

SEQ ID NO: 185073 - RNA, 64 nt, Homo Sapiens; identical to SEQ ID NO: 40298

SEQ ID NO: 185074 - RNA, 64 nt, Homo Sapiens; identical to SEQ ID NO: 40299

SEQ ID NO: 185075 - RNA, 64 nt, Homo Sapiens; identical to SEQ ID NO: 40300

SEQ ID NO: 185076 - RNA, 64 nt, Homo Sapiens; identical to SEQ ID NO: 40301

SEQ ID NO: 185077 - RNA, 64 nt, Homo Sapiens; identical to SEQ ID NO: 40302

SEQ ID NO: 185078 - RNA, 64 nt, Homo Sapiens; identical to SEQ ID NO: 40303

SEQ ID NO: 185079 - RNA, 64 nt, Homo Sapiens; identical to SEQ ID NO: 40304

SEQ ID NO: 185080 - RNA, 64 nt, Homo Sapiens; identical to SEQ ID NO: 40305

SEQ ID NO: 185081 - RNA, 64 nt, Homo Sapiens; identical to SEQ ID NO: 40306

SEQ ID NO: 185082 - RNA, 64 nt, Homo Sapiens; identical to SEQ ID NO: 40307

SEQ ID NO: 185083 - RNA, 64 nt, Homo Sapiens; identical to SEQ ID NO: 40308

SEQ ID NO: 185084 - RNA, 64 nt, Homo Sapiens; identical to SEQ ID NO: 40309

SEQ ID NO: 185085 - RNA, 64 nt, Homo Sapiens; identical to SEQ ID NO: 40310

SEQ ID NO: 185086 - RNA, 64 nt, Homo Sapiens; identical to SEQ ID NO: 40311

SEQ ID NO: 185087 - RNA, 64 nt, Homo Sapiens; identical to SEQ ID NO: 40312

SEQ ID NO: 185088 - RNA, 64 nt, Homo Sapiens; identical to SEQ ID NO: 40313

SEQ ID NO: 185089 - RNA, 64 nt, Homo Sapiens; identical to SEQ ID NO: 40314

SEQ ID NO: 185090 - RNA, 64 nt, Homo Sapiens; identical to SEQ ID NO: 40315

SEQ ID NO: 185091 - RNA, 64 nt, Homo Sapiens; identical to SEQ ID NO: 40316

SEQ ID NO: 185092 - RNA, 64 nt, Homo Sapiens; identical to SEQ ID NO: 40317

SEQ ID NO: 185093 - RNA, 64 nt, Homo Sapiens; identical to SEQ ID NO: 40318

SEQ ID NO: 185094 - RNA, 64 nt, Homo Sapiens; identical to SEQ ID NO: 40319

SEQ ID NO: 185095 - RNA, 64 nt, Homo Sapiens; identical to SEQ ID NO: 40320

SEQ ID NO: 185096 - RNA, 64 nt, Homo Sapiens; identical to SEQ ID NO: 40321

SEQ ID NO: 185097 - RNA, 64 nt, Homo Sapiens; identical to SEQ ID NO: 40322

SEQ ID NO: 185098 - RNA, 64 nt, Homo Sapiens; identical to SEQ ID NO: 40323

SEQ ID NO: 185099 - RNA, 64 nt, Homo Sapiens; identical to SEQ ID NO: 40324

SEQ ID NO: 185100 - RNA, 64 nt, Homo Sapiens; identical to SEQ ID NO: 40325

SEQ ID NO: 185101 - RNA, 64 nt, Homo Sapiens; identical to SEQ ID NO: 40326

SEQ ID NO: 185102 - RNA, 64 nt, Homo Sapiens; identical to SEQ ID NO: 40327

SEQ ID NO: 185103 - RNA, 64 nt, Homo Sapiens; identical to SEQ ID NO: 40328

SEQ ID NO: 185104 - RNA, 64 nt, Homo Sapiens; identical to SEQ ID NO: 40329

SEQ ID NO: 185105 - RNA, 64 nt, Homo Sapiens; identical to SEQ ID NO: 40330

SEQ ID NO: 185106 - RNA, 64 nt, Homo Sapiens; identical to SEQ ID NO: 40331

SEQ ID NO: 185107 - RNA, 64 nt, Homo Sapiens; identical to SEQ ID NO: 40332

SEQ ID NO: 185108 - RNA, 64 nt, Homo Sapiens; identical to SEQ ID NO: 40333

SEQ ID NO: 185109 - RNA, 64 nt, Homo Sapiens; identical to SEQ ID NO: 40334

SEQ ID NO: 185110 - RNA, 64 nt, Homo Sapiens; identical to SEQ ID NO: 40335

SEQ ID NO: 185111 - RNA, 64 nt, Homo Sapiens; identical to SEQ ID NO: 40336

SEQ ID NO: 185112 - RNA, 64 nt, Homo Sapiens; identical to SEQ ID NO: 40337

SEQ ID NO: 185113 - RNA, 64 nt, Homo Sapiens; identical to SEQ ID NO: 40338

SEQ ID NO: 185114 - RNA, 64 nt, Homo Sapiens; identical to SEQ ID NO: 40339

SEQ ID NO: 185115 - RNA, 64 nt, Homo Sapiens; identical to SEQ ID NO: 40340

SEQ ID NO: 185116 - RNA, 64 nt, Homo Sapiens; identical to SEQ ID NO: 40341

SEQ ID NO: 185117 - RNA, 64 nt, Homo Sapiens; identical to SEQ ID NO: 40342

SEQ ID NO: 185118 - RNA, 64 nt, Homo Sapiens; identical to SEQ ID NO: 40343

SEQ ID NO: 185119 - RNA, 64 nt, Homo Sapiens; identical to SEQ ID NO: 40344

SEQ ID NO: 185120 - RNA, 64 nt, Homo Sapiens; identical to SEQ ID NO: 40345

SEQ ID NO: 185121 - RNA, 64 nt, Homo Sapiens; identical to SEQ ID NO: 40346

SEQ ID NO: 185122 - RNA, 64 nt, Homo Sapiens; identical to SEQ ID NO: 40347

SEQ ID NO: 185123 - RNA, 64 nt, Homo Sapiens; identical to SEQ ID NO: 40348

SEQ ID NO: 185124 - RNA, 64 nt, Homo Sapiens; identical to SEQ ID NO: 40349

SEQ ID NO: 185125 - RNA, 64 nt, Homo Sapiens; identical to SEQ ID NO: 40350

SEQ ID NO: 185126 - RNA, 64 nt, Homo Sapiens; identical to SEQ ID NO: 40351

SEQ ID NO: 185127 - RNA, 64 nt, Homo Sapiens; identical to SEQ ID NO: 40352

SEQ ID NO: 185128 - RNA, 64 nt, Homo Sapiens; identical to SEQ ID NO: 40353

SEQ ID NO: 185129 - RNA, 64 nt, Homo Sapiens; identical to SEQ ID NO: 40354

SEQ ID NO: 185130 - RNA, 64 nt, Homo Sapiens; identical to SEQ ID NO: 40355

SEQ ID NO: 185131 - RNA, 64 nt, Homo Sapiens; identical to SEQ ID NO: 40356

SEQ ID NO: 185132 - RNA, 64 nt, Homo Sapiens; identical to SEQ ID NO: 40357

SEQ ID NO: 185133 - RNA, 64 nt, Homo Sapiens; identical to SEQ ID NO: 40358

SEQ ID NO: 185134 - RNA, 64 nt, Homo Sapiens; identical to SEQ ID NO: 40359

SEQ ID NO: 185135 - RNA, 64 nt, Homo Sapiens; identical to SEQ ID NO: 40360

SEQ ID NO: 185136 - RNA, 64 nt, Homo Sapiens; identical to SEQ ID NO: 40361

SEQ ID NO: 185137 - RNA, 64 nt, Homo Sapiens; identical to SEQ ID NO: 40362

SEQ ID NO: 185138 - RNA, 64 nt, Homo Sapiens; identical to SEQ ID NO: 40363

SEQ ID NO: 185139 - RNA, 64 nt, Homo Sapiens; identical to SEQ ID NO: 40364

SEQ ID NO: 185140 - RNA, 64 nt, Homo Sapiens; identical to SEQ ID NO: 40365

SEQ ID NO: 185141 - RNA, 64 nt, Homo Sapiens; identical to SEQ ID NO: 40366

SEQ ID NO: 185142 - RNA, 64 nt, Homo Sapiens; identical to SEQ ID NO: 40367

SEQ ID NO: 185143 - RNA, 64 nt, Homo Sapiens; identical to SEQ ID NO: 40368

SEQ ID NO: 185144 - RNA, 64 nt, Homo Sapiens; identical to SEQ ID NO: 40369

SEQ ID NO: 185145 - RNA, 64 nt, Homo Sapiens; identical to SEQ ID NO: 40370

SEQ ID NO: 185146 - RNA, 64 nt, Homo Sapiens; identical to SEQ ID NO: 40371

SEQ ID NO: 185147 - RNA, 64 nt, Homo Sapiens; identical to SEQ ID NO: 40372

SEQ ID NO: 185148 - RNA, 64 nt, Homo Sapiens; identical to SEQ ID NO: 40373

SEQ ID NO: 185149 - RNA, 64 nt, Homo Sapiens; identical to SEQ ID NO: 40374

SEQ ID NO: 185150 - RNA, 64 nt, Homo Sapiens; identical to SEQ ID NO: 40375

SEQ ID NO: 185151 - RNA, 64 nt, Homo Sapiens; identical to SEQ ID NO: 40376

SEQ ID NO: 185152 - RNA, 64 nt, Homo Sapiens; identical to SEQ ID NO: 40377

SEQ ID NO: 185153 - RNA, 64 nt, Homo Sapiens; identical to SEQ ID NO: 40378

SEQ ID NO: 185154 - RNA, 64 nt, Homo Sapiens; identical to SEQ ID NO: 40379

SEQ ID NO: 185155 - RNA, 64 nt, Homo Sapiens; identical to SEQ ID NO: 40380

SEQ ID NO: 185156 - RNA, 64 nt, Homo Sapiens; identical to SEQ ID NO: 40381

SEQ ID NO: 185157 - RNA, 64 nt, Homo Sapiens; identical to SEQ ID NO: 40382

SEQ ID NO: 185158 - RNA, 64 nt, Homo Sapiens; identical to SEQ ID NO: 40383

SEQ ID NO: 185159 - RNA, 64 nt, Homo Sapiens; identical to SEQ ID NO: 40384

SEQ ID NO: 185160 - RNA, 64 nt, Homo Sapiens; identical to SEQ ID NO: 40385

SEQ ID NO: 185161 - RNA, 64 nt, Homo Sapiens; identical to SEQ ID NO: 40386

SEQ ID NO: 185162 - RNA, 64 nt, Homo Sapiens; identical to SEQ ID NO: 40387

SEQ ID NO: 185163 - RNA, 64 nt, Homo Sapiens; identical to SEQ ID NO: 40388

SEQ ID NO: 185164 - RNA, 64 nt, Homo Sapiens; identical to SEQ ID NO: 40389

SEQ ID NO: 185165 - RNA, 64 nt, Homo Sapiens; identical to SEQ ID NO: 40390

SEQ ID NO: 185166 - RNA, 64 nt, Homo Sapiens; identical to SEQ ID NO: 40391

SEQ ID NO: 185167 - RNA, 64 nt, Homo Sapiens; identical to SEQ ID NO: 40392

SEQ ID NO: 185168 - RNA, 64 nt, Homo Sapiens; identical to SEQ ID NO: 40393

SEQ ID NO: 185169 - RNA, 64 nt, Homo Sapiens; identical to SEQ ID NO: 40394

SEQ ID NO: 185170 - RNA, 64 nt, Homo Sapiens; identical to SEQ ID NO: 40395

SEQ ID NO: 185171 - RNA, 64 nt, Homo Sapiens; identical to SEQ ID NO: 40396

SEQ ID NO: 185172 - RNA, 64 nt, Homo Sapiens; identical to SEQ ID NO: 40397

SEQ ID NO: 185173 - RNA, 64 nt, Homo Sapiens; identical to SEQ ID NO: 40398

SEQ ID NO: 185174 - RNA, 64 nt, Homo Sapiens; identical to SEQ ID NO: 40399

SEQ ID NO: 185175 - RNA, 64 nt, Homo Sapiens; identical to SEQ ID NO: 40400

SEQ ID NO: 185176 - RNA, 64 nt, Homo Sapiens; identical to SEQ ID NO: 40401

SEQ ID NO: 185177 - RNA, 64 nt, Homo Sapiens; identical to SEQ ID NO: 40402

SEQ ID NO: 185178 - RNA, 64 nt, Homo Sapiens; identical to SEQ ID NO: 40403

SEQ ID NO: 185179 - RNA, 64 nt, Homo Sapiens; identical to SEQ ID NO: 40404

SEQ ID NO: 185180 - RNA, 64 nt, Homo Sapiens; identical to SEQ ID NO: 40405

SEQ ID NO: 185181 - RNA, 64 nt, Homo Sapiens; identical to SEQ ID NO: 40406

SEQ ID NO: 185182 - RNA, 64 nt, Homo Sapiens; identical to SEQ ID NO: 40407

SEQ ID NO: 185183 - RNA, 64 nt, Homo Sapiens; identical to SEQ ID NO: 40408

SEQ ID NO: 185184 - RNA, 64 nt, Homo Sapiens; identical to SEQ ID NO: 40409

SEQ ID NO: 185185 - RNA, 64 nt, Homo Sapiens; identical to SEQ ID NO: 40410

SEQ ID NO: 185186 - RNA, 64 nt, Homo Sapiens; identical to SEQ ID NO: 40411

SEQ ID NO: 185187 - RNA, 64 nt, Homo Sapiens; identical to SEQ ID NO: 40412

SEQ ID NO: 185188 - RNA, 64 nt, Homo Sapiens; identical to SEQ ID NO: 40413

SEQ ID NO: 185189 - RNA, 64 nt, Homo Sapiens; identical to SEQ ID NO: 40414

SEQ ID NO: 185190 - RNA, 64 nt, Homo Sapiens; identical to SEQ ID NO: 40415

SEQ ID NO: 185191 - RNA, 64 nt, Homo Sapiens; identical to SEQ ID NO: 40416

SEQ ID NO: 185192 - RNA, 64 nt, Homo Sapiens; identical to SEQ ID NO: 40417

SEQ ID NO: 185193 - RNA, 64 nt, Homo Sapiens; identical to SEQ ID NO: 40418

SEQ ID NO: 185194 - RNA, 64 nt, Homo Sapiens; identical to SEQ ID NO: 40419

SEQ ID NO: 185195 - RNA, 64 nt, Homo Sapiens; identical to SEQ ID NO: 40420

SEQ ID NO: 185196 - RNA, 64 nt, Homo Sapiens; identical to SEQ ID NO: 40421

SEQ ID NO: 185197 - RNA, 64 nt, Homo Sapiens; identical to SEQ ID NO: 40422

SEQ ID NO: 185198 - RNA, 64 nt, Homo Sapiens; identical to SEQ ID NO: 40423

SEQ ID NO: 185199 - RNA, 64 nt, Homo Sapiens; identical to SEQ ID NO: 40424

SEQ ID NO: 185200 - RNA, 64 nt, Homo Sapiens; identical to SEQ ID NO: 40425

SEQ ID NO: 185201 - RNA, 64 nt, Homo Sapiens; identical to SEQ ID NO: 40426

SEQ ID NO: 185202 - RNA, 64 nt, Homo Sapiens; identical to SEQ ID NO: 40427

SEQ ID NO: 185203 - RNA, 64 nt, Homo Sapiens; identical to SEQ ID NO: 40428

SEQ ID NO: 185204 - RNA, 64 nt, Homo Sapiens; identical to SEQ ID NO: 40429

SEQ ID NO: 185205 - RNA, 64 nt, Homo Sapiens; identical to SEQ ID NO: 40430

SEQ ID NO: 185206 - RNA, 64 nt, Homo Sapiens; identical to SEQ ID NO: 40431

SEQ ID NO: 185207 - RNA, 64 nt, Homo Sapiens; identical to SEQ ID NO: 40432

SEQ ID NO: 185208 - RNA, 64 nt, Homo Sapiens; identical to SEQ ID NO: 40433

SEQ ID NO: 185209 - RNA, 64 nt, Homo Sapiens; identical to SEQ ID NO: 40434

SEQ ID NO: 185210 - RNA, 64 nt, Homo Sapiens; identical to SEQ ID NO: 40435

SEQ ID NO: 185211 - RNA, 64 nt, Homo Sapiens; identical to SEQ ID NO: 40436

SEQ ID NO: 185212 - RNA, 64 nt, Homo Sapiens; identical to SEQ ID NO: 40437

SEQ ID NO: 185213 - RNA, 64 nt, Homo Sapiens; identical to SEQ ID NO: 40438

SEQ ID NO: 185214 - RNA, 64 nt, Homo Sapiens; identical to SEQ ID NO: 40439

SEQ ID NO: 185215 - RNA, 64 nt, Homo Sapiens; identical to SEQ ID NO: 40440

SEQ ID NO: 185216 - RNA, 64 nt, Homo Sapiens; identical to SEQ ID NO: 40441

SEQ ID NO: 185217 - RNA, 64 nt, Homo Sapiens; identical to SEQ ID NO: 40442

SEQ ID NO: 185218 - RNA, 64 nt, Homo Sapiens; identical to SEQ ID NO: 40443

SEQ ID NO: 185219 - RNA, 64 nt, Homo Sapiens; identical to SEQ ID NO: 40444

SEQ ID NO: 185220 - RNA, 64 nt, Homo Sapiens; identical to SEQ ID NO: 40445

SEQ ID NO: 185221 - RNA, 64 nt, Homo Sapiens; identical to SEQ ID NO: 40446

SEQ ID NO: 185222 - RNA, 64 nt, Homo Sapiens; identical to SEQ ID NO: 40447

SEQ ID NO: 185223 - RNA, 64 nt, Homo Sapiens; identical to SEQ ID NO: 40448

SEQ ID NO: 185224 - RNA, 64 nt, Homo Sapiens; identical to SEQ ID NO: 40449

SEQ ID NO: 185225 - RNA, 64 nt, Homo Sapiens; identical to SEQ ID NO: 40450

SEQ ID NO: 185226 - RNA, 64 nt, Homo Sapiens; identical to SEQ ID NO: 40451

SEQ ID NO: 185227 - RNA, 64 nt, Homo Sapiens; identical to SEQ ID NO: 40452

SEQ ID NO: 185228 - RNA, 64 nt, Homo Sapiens; identical to SEQ ID NO: 40453

SEQ ID NO: 185229 - RNA, 64 nt, Homo Sapiens; identical to SEQ ID NO: 40454

SEQ ID NO: 185230 - RNA, 64 nt, Homo Sapiens; identical to SEQ ID NO: 40455

SEQ ID NO: 185231 - RNA, 64 nt, Homo Sapiens; identical to SEQ ID NO: 40456

SEQ ID NO: 185232 - RNA, 64 nt, Homo Sapiens; identical to SEQ ID NO: 40457

SEQ ID NO: 185233 - RNA, 64 nt, Homo Sapiens; identical to SEQ ID NO: 40458

SEQ ID NO: 185234 - RNA, 64 nt, Homo Sapiens; identical to SEQ ID NO: 40459

SEQ ID NO: 185235 - RNA, 64 nt, Homo Sapiens; identical to SEQ ID NO: 40460

SEQ ID NO: 185236 - RNA, 64 nt, Homo Sapiens; identical to SEQ ID NO: 40461

SEQ ID NO: 185237 - RNA, 64 nt, Homo Sapiens; identical to SEQ ID NO: 40462

SEQ ID NO: 185238 - RNA, 64 nt, Homo Sapiens; identical to SEQ ID NO: 40463

SEQ ID NO: 185239 - RNA, 64 nt, Homo Sapiens; identical to SEQ ID NO: 40464

SEQ ID NO: 185240 - RNA, 64 nt, Homo Sapiens; identical to SEQ ID NO: 40465

SEQ ID NO: 185241 - RNA, 64 nt, Homo Sapiens; identical to SEQ ID NO: 40466

SEQ ID NO: 185242 - RNA, 64 nt, Homo Sapiens; identical to SEQ ID NO: 40467

SEQ ID NO: 185243 - RNA, 64 nt, Homo Sapiens; identical to SEQ ID NO: 40468

SEQ ID NO: 185244 - RNA, 64 nt, Homo Sapiens; identical to SEQ ID NO: 40469

SEQ ID NO: 185245 - RNA, 64 nt, Homo Sapiens; identical to SEQ ID NO: 40470

SEQ ID NO: 185246 - RNA, 64 nt, Homo Sapiens; identical to SEQ ID NO: 40471

SEQ ID NO: 185247 - RNA, 64 nt, Homo Sapiens; identical to SEQ ID NO: 40472

SEQ ID NO: 185248 - RNA, 64 nt, Homo Sapiens; identical to SEQ ID NO: 40473

SEQ ID NO: 185249 - RNA, 64 nt, Homo Sapiens; identical to SEQ ID NO: 40474

SEQ ID NO: 185250 - RNA, 64 nt, Homo Sapiens; identical to SEQ ID NO: 40475

SEQ ID NO: 185251 - RNA, 64 nt, Homo Sapiens; identical to SEQ ID NO: 40476

SEQ ID NO: 185252 - RNA, 64 nt, Homo Sapiens; identical to SEQ ID NO: 40477

SEQ ID NO: 185253 - RNA, 64 nt, Homo Sapiens; identical to SEQ ID NO: 40478

SEQ ID NO: 185254 - RNA, 64 nt, Homo Sapiens; identical to SEQ ID NO: 40479

SEQ ID NO: 185255 - RNA, 64 nt, Homo Sapiens; identical to SEQ ID NO: 40480

SEQ ID NO: 185256 - RNA, 64 nt, Homo Sapiens; identical to SEQ ID NO: 40481

SEQ ID NO: 185257 - RNA, 64 nt, Homo Sapiens; identical to SEQ ID NO: 40482

SEQ ID NO: 185258 - RNA, 64 nt, Homo Sapiens; identical to SEQ ID NO: 40483

SEQ ID NO: 185259 - RNA, 64 nt, Homo Sapiens; identical to SEQ ID NO: 40484

SEQ ID NO: 185260 - RNA, 64 nt, Homo Sapiens; identical to SEQ ID NO: 40485

SEQ ID NO: 185261 - RNA, 64 nt, Homo Sapiens; identical to SEQ ID NO: 40486

SEQ ID NO: 185262 - RNA, 64 nt, Homo Sapiens; identical to SEQ ID NO: 40487

SEQ ID NO: 185263 - RNA, 64 nt, Homo Sapiens; identical to SEQ ID NO: 40488

SEQ ID NO: 185264 - RNA, 64 nt, Homo Sapiens; identical to SEQ ID NO: 40489

SEQ ID NO: 185265 - RNA, 64 nt, Homo Sapiens; identical to SEQ ID NO: 40490

SEQ ID NO: 185266 - RNA, 64 nt, Homo Sapiens; identical to SEQ ID NO: 40491

SEQ ID NO: 185267 - RNA, 64 nt, Homo Sapiens; identical to SEQ ID NO: 40492

SEQ ID NO: 185268 - RNA, 64 nt, Homo Sapiens; identical to SEQ ID NO: 40493

SEQ ID NO: 185269 - RNA, 64 nt, Homo Sapiens; identical to SEQ ID NO: 40494

SEQ ID NO: 185270 - RNA, 64 nt, Homo Sapiens; identical to SEQ ID NO: 40495

SEQ ID NO: 185271 - RNA, 64 nt, Homo Sapiens; identical to SEQ ID NO: 40496

SEQ ID NO: 185272 - RNA, 64 nt, Homo Sapiens; identical to SEQ ID NO: 40497

SEQ ID NO: 185273 - RNA, 64 nt, Homo Sapiens; identical to SEQ ID NO: 40498

SEQ ID NO: 185274 - RNA, 64 nt, Homo Sapiens; identical to SEQ ID NO: 40499

SEQ ID NO: 185275 - RNA, 64 nt, Homo Sapiens; identical to SEQ ID NO: 40500

SEQ ID NO: 185276 - RNA, 64 nt, Homo Sapiens; identical to SEQ ID NO: 40501

SEQ ID NO: 185277 - RNA, 64 nt, Homo Sapiens; identical to SEQ ID NO: 40502

SEQ ID NO: 185278 - RNA, 64 nt, Homo Sapiens; identical to SEQ ID NO: 40503

SEQ ID NO: 185279 - RNA, 64 nt, Homo Sapiens; identical to SEQ ID NO: 40504

SEQ ID NO: 185280 - RNA, 64 nt, Homo Sapiens; identical to SEQ ID NO: 40505

SEQ ID NO: 185281 - RNA, 64 nt, Homo Sapiens; identical to SEQ ID NO: 40506

SEQ ID NO: 185282 - RNA, 64 nt, Homo Sapiens; identical to SEQ ID NO: 40507

SEQ ID NO: 185283 - RNA, 64 nt, Homo Sapiens; identical to SEQ ID NO: 40508

SEQ ID NO: 185284 - RNA, 64 nt, Homo Sapiens; identical to SEQ ID NO: 40509

SEQ ID NO: 185285 - RNA, 64 nt, Homo Sapiens; identical to SEQ ID NO: 40510

SEQ ID NO: 185286 - RNA, 64 nt, Homo Sapiens; identical to SEQ ID NO: 40511

SEQ ID NO: 185287 - RNA, 64 nt, Homo Sapiens; identical to SEQ ID NO: 40512

SEQ ID NO: 185288 - RNA, 64 nt, Homo Sapiens; identical to SEQ ID NO: 40513

SEQ ID NO: 185289 - RNA, 64 nt, Homo Sapiens; identical to SEQ ID NO: 40514

SEQ ID NO: 185290 - RNA, 64 nt, Homo Sapiens; identical to SEQ ID NO: 40515

SEQ ID NO: 185291 - RNA, 64 nt, Homo Sapiens; identical to SEQ ID NO: 40516

SEQ ID NO: 185292 - RNA, 64 nt, Homo Sapiens; identical to SEQ ID NO: 40517

SEQ ID NO: 185293 - RNA, 64 nt, Homo Sapiens; identical to SEQ ID NO: 40518

SEQ ID NO: 185294 - RNA, 64 nt, Homo Sapiens; identical to SEQ ID NO: 40519

SEQ ID NO: 185295 - RNA, 64 nt, Homo Sapiens; identical to SEQ ID NO: 40520

SEQ ID NO: 185296 - RNA, 64 nt, Homo Sapiens; identical to SEQ ID NO: 40521

SEQ ID NO: 185297 - RNA, 64 nt, Homo Sapiens; identical to SEQ ID NO: 40522

SEQ ID NO: 185298 - RNA, 64 nt, Homo Sapiens; identical to SEQ ID NO: 40523

SEQ ID NO: 185299 - RNA, 64 nt, Homo Sapiens; identical to SEQ ID NO: 40524

SEQ ID NO: 185300 - RNA, 64 nt, Homo Sapiens; identical to SEQ ID NO: 40525

SEQ ID NO: 185301 - RNA, 64 nt, Homo Sapiens; identical to SEQ ID NO: 40526

SEQ ID NO: 185302 - RNA, 64 nt, Homo Sapiens; identical to SEQ ID NO: 40527

SEQ ID NO: 185303 - RNA, 64 nt, Homo Sapiens; identical to SEQ ID NO: 40528

SEQ ID NO: 185304 - RNA, 64 nt, Homo Sapiens; identical to SEQ ID NO: 40529

SEQ ID NO: 185305 - RNA, 64 nt, Homo Sapiens; identical to SEQ ID NO: 40530

SEQ ID NO: 185306 - RNA, 64 nt, Homo Sapiens; identical to SEQ ID NO: 40531

SEQ ID NO: 185307 - RNA, 64 nt, Homo Sapiens; identical to SEQ ID NO: 40532

SEQ ID NO: 185308 - RNA, 64 nt, Homo Sapiens; identical to SEQ ID NO: 40533

SEQ ID NO: 185309 - RNA, 64 nt, Homo Sapiens; identical to SEQ ID NO: 40534

SEQ ID NO: 185310 - RNA, 64 nt, Homo Sapiens; identical to SEQ ID NO: 40535

SEQ ID NO: 185311 - RNA, 64 nt, Homo Sapiens; identical to SEQ ID NO: 40536

SEQ ID NO: 185312 - RNA, 64 nt, Homo Sapiens; identical to SEQ ID NO: 40537

SEQ ID NO: 185313 - RNA, 64 nt, Homo Sapiens; identical to SEQ ID NO: 40538

SEQ ID NO: 185314 - RNA, 64 nt, Homo Sapiens; identical to SEQ ID NO: 40539

SEQ ID NO: 185315 - RNA, 64 nt, Homo Sapiens; identical to SEQ ID NO: 40540

SEQ ID NO: 185316 - RNA, 64 nt, Homo Sapiens; identical to SEQ ID NO: 40541

SEQ ID NO: 185317 - RNA, 64 nt, Homo Sapiens; identical to SEQ ID NO: 40542

SEQ ID NO: 185318 - RNA, 64 nt, Homo Sapiens; identical to SEQ ID NO: 40543

SEQ ID NO: 185319 - RNA, 64 nt, Homo Sapiens; identical to SEQ ID NO: 40544

SEQ ID NO: 185320 - RNA, 64 nt, Homo Sapiens; identical to SEQ ID NO: 40545

SEQ ID NO: 185321 - RNA, 64 nt, Homo Sapiens; identical to SEQ ID NO: 40546

SEQ ID NO: 185322 - RNA, 64 nt, Homo Sapiens; identical to SEQ ID NO: 40547

SEQ ID NO: 185323 - RNA, 64 nt, Homo Sapiens; identical to SEQ ID NO: 40548

SEQ ID NO: 185324 - RNA, 64 nt, Homo Sapiens; identical to SEQ ID NO: 40549

SEQ ID NO: 185325 - RNA, 64 nt, Homo Sapiens; identical to SEQ ID NO: 40550

SEQ ID NO: 185326 - RNA, 64 nt, Homo Sapiens; identical to SEQ ID NO: 40551

SEQ ID NO: 185327 - RNA, 64 nt, Homo Sapiens; identical to SEQ ID NO: 40552

SEQ ID NO: 185328 - RNA, 64 nt, Homo Sapiens; identical to SEQ ID NO: 40553

SEQ ID NO: 185329 - RNA, 64 nt, Homo Sapiens; identical to SEQ ID NO: 40554

SEQ ID NO: 185330 - RNA, 64 nt, Homo Sapiens; identical to SEQ ID NO: 40555

SEQ ID NO: 185331 - RNA, 64 nt, Homo Sapiens; identical to SEQ ID NO: 40556

SEQ ID NO: 185332 - RNA, 64 nt, Homo Sapiens; identical to SEQ ID NO: 40557

SEQ ID NO: 185333 - RNA, 64 nt, Homo Sapiens; identical to SEQ ID NO: 40558

SEQ ID NO: 185334 - RNA, 64 nt, Homo Sapiens; identical to SEQ ID NO: 40559

SEQ ID NO: 185335 - RNA, 64 nt, Homo Sapiens; identical to SEQ ID NO: 40560

SEQ ID NO: 185336 - RNA, 64 nt, Homo Sapiens; identical to SEQ ID NO: 40561

SEQ ID NO: 185337 - RNA, 64 nt, Homo Sapiens; identical to SEQ ID NO: 40562

SEQ ID NO: 185338 - RNA, 64 nt, Homo Sapiens; identical to SEQ ID NO: 40563

SEQ ID NO: 185339 - RNA, 64 nt, Homo Sapiens; identical to SEQ ID NO: 40564

SEQ ID NO: 185340 - RNA, 64 nt, Homo Sapiens; identical to SEQ ID NO: 40565

SEQ ID NO: 185341 - RNA, 64 nt, Homo Sapiens; identical to SEQ ID NO: 40566

SEQ ID NO: 185342 - RNA, 64 nt, Homo Sapiens; identical to SEQ ID NO: 40567

SEQ ID NO: 185343 - RNA, 64 nt, Homo Sapiens; identical to SEQ ID NO: 40568

SEQ ID NO: 185344 - RNA, 64 nt, Homo Sapiens; identical to SEQ ID NO: 40569

SEQ ID NO: 185345 - RNA, 64 nt, Homo Sapiens; identical to SEQ ID NO: 40570

SEQ ID NO: 185346 - RNA, 64 nt, Homo Sapiens; identical to SEQ ID NO: 40571

SEQ ID NO: 185347 - RNA, 64 nt, Homo Sapiens; identical to SEQ ID NO: 40572

SEQ ID NO: 185348 - RNA, 64 nt, Homo Sapiens; identical to SEQ ID NO: 40573

SEQ ID NO: 185349 - RNA, 64 nt, Homo Sapiens; identical to SEQ ID NO: 40574

SEQ ID NO: 185350 - RNA, 64 nt, Homo Sapiens; identical to SEQ ID NO: 40575

SEQ ID NO: 185351 - RNA, 64 nt, Homo Sapiens; identical to SEQ ID NO: 40576

SEQ ID NO: 185352 - RNA, 64 nt, Homo Sapiens; identical to SEQ ID NO: 40577

SEQ ID NO: 185353 - RNA, 64 nt, Homo Sapiens; identical to SEQ ID NO: 40578

SEQ ID NO: 185354 - RNA, 64 nt, Homo Sapiens; identical to SEQ ID NO: 40579

SEQ ID NO: 185355 - RNA, 64 nt, Homo Sapiens; identical to SEQ ID NO: 40580

SEQ ID NO: 185356 - RNA, 64 nt, Homo Sapiens; identical to SEQ ID NO: 40581

SEQ ID NO: 185357 - RNA, 64 nt, Homo Sapiens; identical to SEQ ID NO: 40582

SEQ ID NO: 185358 - RNA, 64 nt, Homo Sapiens; identical to SEQ ID NO: 40583

SEQ ID NO: 185359 - RNA, 64 nt, Homo Sapiens; identical to SEQ ID NO: 40584

SEQ ID NO: 185360 - RNA, 64 nt, Homo Sapiens; identical to SEQ ID NO: 40585

SEQ ID NO: 185361 - RNA, 64 nt, Homo Sapiens; identical to SEQ ID NO: 40586

SEQ ID NO: 185362 - RNA, 64 nt, Homo Sapiens; identical to SEQ ID NO: 40587

SEQ ID NO: 185363 - RNA, 64 nt, Homo Sapiens; identical to SEQ ID NO: 40588

SEQ ID NO: 185364 - RNA, 64 nt, Homo Sapiens; identical to SEQ ID NO: 40589

SEQ ID NO: 185365 - RNA, 64 nt, Homo Sapiens; identical to SEQ ID NO: 40590

SEQ ID NO: 185366 - RNA, 64 nt, Homo Sapiens; identical to SEQ ID NO: 40591

SEQ ID NO: 185367 - RNA, 64 nt, Homo Sapiens; identical to SEQ ID NO: 40592

SEQ ID NO: 185368 - RNA, 64 nt, Homo Sapiens; identical to SEQ ID NO: 40593

SEQ ID NO: 185369 - RNA, 64 nt, Homo Sapiens; identical to SEQ ID NO: 40594

SEQ ID NO: 185370 - RNA, 64 nt, Homo Sapiens; identical to SEQ ID NO: 40595

SEQ ID NO: 185371 - RNA, 64 nt, Homo Sapiens; identical to SEQ ID NO: 40596

SEQ ID NO: 185372 - RNA, 64 nt, Homo Sapiens; identical to SEQ ID NO: 40597

SEQ ID NO: 185373 - RNA, 64 nt, Homo Sapiens; identical to SEQ ID NO: 40598

SEQ ID NO: 185374 - RNA, 64 nt, Homo Sapiens; identical to SEQ ID NO: 40599

SEQ ID NO: 185375 - RNA, 64 nt, Homo Sapiens; identical to SEQ ID NO: 40600

SEQ ID NO: 185376 - RNA, 64 nt, Homo Sapiens; identical to SEQ ID NO: 40601

SEQ ID NO: 185377 - RNA, 64 nt, Homo Sapiens; identical to SEQ ID NO: 40602

SEQ ID NO: 185378 - RNA, 64 nt, Homo Sapiens; identical to SEQ ID NO: 40603

SEQ ID NO: 185379 - RNA, 64 nt, Homo Sapiens; identical to SEQ ID NO: 40604

SEQ ID NO: 185380 - RNA, 64 nt, Homo Sapiens; identical to SEQ ID NO: 40605

SEQ ID NO: 185381 - RNA, 64 nt, Homo Sapiens; identical to SEQ ID NO: 40606

SEQ ID NO: 185382 - RNA, 64 nt, Homo Sapiens; identical to SEQ ID NO: 40607

SEQ ID NO: 185383 - RNA, 64 nt, Homo Sapiens; identical to SEQ ID NO: 40608

SEQ ID NO: 185384 - RNA, 64 nt, Homo Sapiens; identical to SEQ ID NO: 40609

SEQ ID NO: 185385 - RNA, 64 nt, Homo Sapiens; identical to SEQ ID NO: 40610

SEQ ID NO: 185386 - RNA, 64 nt, Homo Sapiens; identical to SEQ ID NO: 40611

SEQ ID NO: 185387 - RNA, 64 nt, Homo Sapiens; identical to SEQ ID NO: 40612

SEQ ID NO: 185388 - RNA, 64 nt, Homo Sapiens; identical to SEQ ID NO: 40613

SEQ ID NO: 185389 - RNA, 64 nt, Homo Sapiens; identical to SEQ ID NO: 40614

SEQ ID NO: 185390 - RNA, 64 nt, Homo Sapiens; identical to SEQ ID NO: 40615

SEQ ID NO: 185391 - RNA, 64 nt, Homo Sapiens; identical to SEQ ID NO: 40616

SEQ ID NO: 185392 - RNA, 64 nt, Homo Sapiens; identical to SEQ ID NO: 40617

SEQ ID NO: 185393 - RNA, 64 nt, Homo Sapiens; identical to SEQ ID NO: 40618

SEQ ID NO: 185394 - RNA, 64 nt, Homo Sapiens; identical to SEQ ID NO: 40619

SEQ ID NO: 185395 - RNA, 64 nt, Homo Sapiens; identical to SEQ ID NO: 40620

SEQ ID NO: 185396 - RNA, 64 nt, Homo Sapiens; identical to SEQ ID NO: 40621

SEQ ID NO: 185397 - RNA, 64 nt, Homo Sapiens; identical to SEQ ID NO: 40622

SEQ ID NO: 185398 - RNA, 64 nt, Homo Sapiens; identical to SEQ ID NO: 40623

SEQ ID NO: 185399 - RNA, 64 nt, Homo Sapiens; identical to SEQ ID NO: 40624

SEQ ID NO: 185400 - RNA, 64 nt, Homo Sapiens; identical to SEQ ID NO: 40625

SEQ ID NO: 185401 - RNA, 64 nt, Homo Sapiens; identical to SEQ ID NO: 40626

SEQ ID NO: 185402 - RNA, 64 nt, Homo Sapiens; identical to SEQ ID NO: 40627

SEQ ID NO: 185403 - RNA, 64 nt, Homo Sapiens; identical to SEQ ID NO: 40628

SEQ ID NO: 185404 - RNA, 64 nt, Homo Sapiens; identical to SEQ ID NO: 40629

SEQ ID NO: 185405 - RNA, 64 nt, Homo Sapiens; identical to SEQ ID NO: 40630

SEQ ID NO: 185406 - RNA, 64 nt, Homo Sapiens; identical to SEQ ID NO: 40631

SEQ ID NO: 185407 - RNA, 64 nt, Homo Sapiens; identical to SEQ ID NO: 40632

SEQ ID NO: 185408 - RNA, 64 nt, Homo Sapiens; identical to SEQ ID NO: 40633

SEQ ID NO: 185409 - RNA, 64 nt, Homo Sapiens; identical to SEQ ID NO: 40634

SEQ ID NO: 185410 - RNA, 64 nt, Homo Sapiens; identical to SEQ ID NO: 40635

SEQ ID NO: 185411 - RNA, 64 nt, Homo Sapiens; identical to SEQ ID NO: 40636

SEQ ID NO: 185412 - RNA, 64 nt, Homo Sapiens; identical to SEQ ID NO: 40637

SEQ ID NO: 185413 - RNA, 64 nt, Homo Sapiens; identical to SEQ ID NO: 40638

SEQ ID NO: 185414 - RNA, 64 nt, Homo Sapiens; identical to SEQ ID NO: 40639

SEQ ID NO: 185415 - RNA, 64 nt, Homo Sapiens; identical to SEQ ID NO: 40640

SEQ ID NO: 185416 - RNA, 64 nt, Homo Sapiens; identical to SEQ ID NO: 40641

SEQ ID NO: 185417 - RNA, 64 nt, Homo Sapiens; identical to SEQ ID NO: 40642

SEQ ID NO: 185418 - RNA, 64 nt, Homo Sapiens; identical to SEQ ID NO: 40643

SEQ ID NO: 185419 - RNA, 64 nt, Homo Sapiens; identical to SEQ ID NO: 40644

SEQ ID NO: 185420 - RNA, 64 nt, Homo Sapiens; identical to SEQ ID NO: 40645

SEQ ID NO: 185421 - RNA, 64 nt, Homo Sapiens; identical to SEQ ID NO: 40646

SEQ ID NO: 185422 - RNA, 64 nt, Homo Sapiens; identical to SEQ ID NO: 40647

SEQ ID NO: 185423 - RNA, 64 nt, Homo Sapiens; identical to SEQ ID NO: 40648

SEQ ID NO: 185424 - RNA, 64 nt, Homo Sapiens; identical to SEQ ID NO: 40649

SEQ ID NO: 185425 - RNA, 64 nt, Homo Sapiens; identical to SEQ ID NO: 40650

SEQ ID NO: 185426 - RNA, 64 nt, Homo Sapiens; identical to SEQ ID NO: 40651

SEQ ID NO: 185427 - RNA, 64 nt, Homo Sapiens; identical to SEQ ID NO: 40652

SEQ ID NO: 185428 - RNA, 64 nt, Homo Sapiens; identical to SEQ ID NO: 40653

SEQ ID NO: 185429 - RNA, 64 nt, Homo Sapiens; identical to SEQ ID NO: 40654

SEQ ID NO: 185430 - RNA, 64 nt, Homo Sapiens; identical to SEQ ID NO: 40655

SEQ ID NO: 185431 - RNA, 64 nt, Homo Sapiens; identical to SEQ ID NO: 40656

SEQ ID NO: 185432 - RNA, 64 nt, Homo Sapiens; identical to SEQ ID NO: 40657

SEQ ID NO: 185433 - RNA, 64 nt, Homo Sapiens; identical to SEQ ID NO: 40658

SEQ ID NO: 185434 - RNA, 64 nt, Homo Sapiens; identical to SEQ ID NO: 40659

SEQ ID NO: 185435 - RNA, 64 nt, Homo Sapiens; identical to SEQ ID NO: 40660

SEQ ID NO: 185436 - RNA, 64 nt, Homo Sapiens; identical to SEQ ID NO: 40661

SEQ ID NO: 185437 - RNA, 64 nt, Homo Sapiens; identical to SEQ ID NO: 40662

SEQ ID NO: 185438 - RNA, 64 nt, Homo Sapiens; identical to SEQ ID NO: 40663

SEQ ID NO: 185439 - RNA, 64 nt, Homo Sapiens; identical to SEQ ID NO: 40664

SEQ ID NO: 185440 - RNA, 64 nt, Homo Sapiens; identical to SEQ ID NO: 40665

SEQ ID NO: 185441 - RNA, 64 nt, Homo Sapiens; identical to SEQ ID NO: 40666

SEQ ID NO: 185442 - RNA, 64 nt, Homo Sapiens; identical to SEQ ID NO: 40667

SEQ ID NO: 185443 - RNA, 64 nt, Homo Sapiens; identical to SEQ ID NO: 40668

SEQ ID NO: 185444 - RNA, 64 nt, Homo Sapiens; identical to SEQ ID NO: 40669

SEQ ID NO: 185445 - RNA, 64 nt, Homo Sapiens; identical to SEQ ID NO: 40670

SEQ ID NO: 185446 - RNA, 64 nt, Homo Sapiens; identical to SEQ ID NO: 40671

SEQ ID NO: 185447 - RNA, 64 nt, Homo Sapiens; identical to SEQ ID NO: 40672

SEQ ID NO: 185448 - RNA, 64 nt, Homo Sapiens; identical to SEQ ID NO: 40673

SEQ ID NO: 185449 - RNA, 64 nt, Homo Sapiens; identical to SEQ ID NO: 40674

SEQ ID NO: 185450 - RNA, 64 nt, Homo Sapiens; identical to SEQ ID NO: 40675

SEQ ID NO: 185451 - RNA, 64 nt, Homo Sapiens; identical to SEQ ID NO: 40676

SEQ ID NO: 185452 - RNA, 64 nt, Homo Sapiens; identical to SEQ ID NO: 40677

SEQ ID NO: 185453 - RNA, 64 nt, Homo Sapiens; identical to SEQ ID NO: 40678

SEQ ID NO: 185454 - RNA, 64 nt, Homo Sapiens; identical to SEQ ID NO: 40679

SEQ ID NO: 185455 - RNA, 64 nt, Homo Sapiens; identical to SEQ ID NO: 40680

SEQ ID NO: 185456 - RNA, 64 nt, Homo Sapiens; identical to SEQ ID NO: 40681

SEQ ID NO: 185457 - RNA, 64 nt, Homo Sapiens; identical to SEQ ID NO: 40682

SEQ ID NO: 185458 - RNA, 64 nt, Homo Sapiens; identical to SEQ ID NO: 40683

SEQ ID NO: 185459 - RNA, 64 nt, Homo Sapiens; identical to SEQ ID NO: 40684

SEQ ID NO: 185460 - RNA, 64 nt, Homo Sapiens; identical to SEQ ID NO: 40685

SEQ ID NO: 185461 - RNA, 64 nt, Homo Sapiens; identical to SEQ ID NO: 40686

SEQ ID NO: 185462 - RNA, 64 nt, Homo Sapiens; identical to SEQ ID NO: 40687

SEQ ID NO: 185463 - RNA, 64 nt, Homo Sapiens; identical to SEQ ID NO: 40688

SEQ ID NO: 185464 - RNA, 64 nt, Homo Sapiens; identical to SEQ ID NO: 40689

SEQ ID NO: 185465 - RNA, 64 nt, Homo Sapiens; identical to SEQ ID NO: 40690

SEQ ID NO: 185466 - RNA, 64 nt, Homo Sapiens; identical to SEQ ID NO: 40691

SEQ ID NO: 185467 - RNA, 64 nt, Homo Sapiens; identical to SEQ ID NO: 40692

SEQ ID NO: 185468 - RNA, 64 nt, Homo Sapiens; identical to SEQ ID NO: 40693

SEQ ID NO: 185469 - RNA, 64 nt, Homo Sapiens; identical to SEQ ID NO: 40694

SEQ ID NO: 185470 - RNA, 64 nt, Homo Sapiens; identical to SEQ ID NO: 40695

SEQ ID NO: 185471 - RNA, 64 nt, Homo Sapiens; identical to SEQ ID NO: 40696

SEQ ID NO: 185472 - RNA, 64 nt, Homo Sapiens; identical to SEQ ID NO: 40697

SEQ ID NO: 185473 - RNA, 64 nt, Homo Sapiens; identical to SEQ ID NO: 40698

SEQ ID NO: 185474 - RNA, 64 nt, Homo Sapiens; identical to SEQ ID NO: 40699

SEQ ID NO: 185475 - RNA, 64 nt, Homo Sapiens; identical to SEQ ID NO: 40700

SEQ ID NO: 185476 - RNA, 64 nt, Homo Sapiens; identical to SEQ ID NO: 40701

SEQ ID NO: 185477 - RNA, 64 nt, Homo Sapiens; identical to SEQ ID NO: 40702

SEQ ID NO: 185478 - RNA, 64 nt, Homo Sapiens; identical to SEQ ID NO: 40703

SEQ ID NO: 185479 - RNA, 64 nt, Homo Sapiens; identical to SEQ ID NO: 40704

SEQ ID NO: 185480 - RNA, 64 nt, Homo Sapiens; identical to SEQ ID NO: 40705

SEQ ID NO: 185481 - RNA, 64 nt, Homo Sapiens; identical to SEQ ID NO: 40706

SEQ ID NO: 185482 - RNA, 64 nt, Homo Sapiens; identical to SEQ ID NO: 40707

SEQ ID NO: 185483 - RNA, 64 nt, Homo Sapiens; identical to SEQ ID NO: 40708

SEQ ID NO: 185484 - RNA, 64 nt, Homo Sapiens; identical to SEQ ID NO: 40709

SEQ ID NO: 185485 - RNA, 64 nt, Homo Sapiens; identical to SEQ ID NO: 40710

SEQ ID NO: 185486 - RNA, 64 nt, Homo Sapiens; identical to SEQ ID NO: 40711

SEQ ID NO: 185487 - RNA, 64 nt, Homo Sapiens; identical to SEQ ID NO: 40712

SEQ ID NO: 185488 - RNA, 64 nt, Homo Sapiens; identical to SEQ ID NO: 40713

SEQ ID NO: 185489 - RNA, 64 nt, Homo Sapiens; identical to SEQ ID NO: 40714

SEQ ID NO: 185490 - RNA, 64 nt, Homo Sapiens; identical to SEQ ID NO: 40715

SEQ ID NO: 185491 - RNA, 64 nt, Homo Sapiens; identical to SEQ ID NO: 40716

SEQ ID NO: 185492 - RNA, 64 nt, Homo Sapiens; identical to SEQ ID NO: 40717

SEQ ID NO: 185493 - RNA, 64 nt, Homo Sapiens; identical to SEQ ID NO: 40718

SEQ ID NO: 185494 - RNA, 64 nt, Homo Sapiens; identical to SEQ ID NO: 40719

SEQ ID NO: 185495 - RNA, 64 nt, Homo Sapiens; identical to SEQ ID NO: 40720

SEQ ID NO: 185496 - RNA, 64 nt, Homo Sapiens; identical to SEQ ID NO: 40721

SEQ ID NO: 185497 - RNA, 64 nt, Homo Sapiens; identical to SEQ ID NO: 40722

SEQ ID NO: 185498 - RNA, 64 nt, Homo Sapiens; identical to SEQ ID NO: 40723

SEQ ID NO: 185499 - RNA, 64 nt, Homo Sapiens; identical to SEQ ID NO: 40724

SEQ ID NO: 185500 - RNA, 64 nt, Homo Sapiens; identical to SEQ ID NO: 40725

SEQ ID NO: 185501 - RNA, 64 nt, Homo Sapiens; identical to SEQ ID NO: 40726

SEQ ID NO: 185502 - RNA, 64 nt, Homo Sapiens; identical to SEQ ID NO: 40727

SEQ ID NO: 185503 - RNA, 64 nt, Homo Sapiens; identical to SEQ ID NO: 40728

SEQ ID NO: 185504 - RNA, 64 nt, Homo Sapiens; identical to SEQ ID NO: 40729

SEQ ID NO: 185505 - RNA, 64 nt, Homo Sapiens; identical to SEQ ID NO: 40730

SEQ ID NO: 185506 - RNA, 64 nt, Homo Sapiens; identical to SEQ ID NO: 40731

SEQ ID NO: 185507 - RNA, 64 nt, Homo Sapiens; identical to SEQ ID NO: 40732

SEQ ID NO: 185508 - RNA, 64 nt, Homo Sapiens; identical to SEQ ID NO: 40733

SEQ ID NO: 185509 - RNA, 64 nt, Homo Sapiens; identical to SEQ ID NO: 40734

SEQ ID NO: 185510 - RNA, 64 nt, Homo Sapiens; identical to SEQ ID NO: 40735

SEQ ID NO: 185511 - RNA, 64 nt, Homo Sapiens; identical to SEQ ID NO: 40736

SEQ ID NO: 185512 - RNA, 64 nt, Homo Sapiens; identical to SEQ ID NO: 40737

SEQ ID NO: 185513 - RNA, 64 nt, Homo Sapiens; identical to SEQ ID NO: 40738

SEQ ID NO: 185514 - RNA, 64 nt, Homo Sapiens; identical to SEQ ID NO: 40739

SEQ ID NO: 185515 - RNA, 64 nt, Homo Sapiens; identical to SEQ ID NO: 40740

SEQ ID NO: 185516 - RNA, 64 nt, Homo Sapiens; identical to SEQ ID NO: 40741

SEQ ID NO: 185517 - RNA, 64 nt, Homo Sapiens; identical to SEQ ID NO: 40742

SEQ ID NO: 185518 - RNA, 64 nt, Homo Sapiens; identical to SEQ ID NO: 40743

SEQ ID NO: 185519 - RNA, 64 nt, Homo Sapiens; identical to SEQ ID NO: 40744

SEQ ID NO: 185520 - RNA, 64 nt, Homo Sapiens; identical to SEQ ID NO: 40745

SEQ ID NO: 185521 - RNA, 64 nt, Homo Sapiens; identical to SEQ ID NO: 40746

SEQ ID NO: 185522 - RNA, 64 nt, Homo Sapiens; identical to SEQ ID NO: 40747

SEQ ID NO: 185523 - RNA, 64 nt, Homo Sapiens; identical to SEQ ID NO: 40748

SEQ ID NO: 185524 - RNA, 64 nt, Homo Sapiens; identical to SEQ ID NO: 40749

SEQ ID NO: 185525 - RNA, 64 nt, Homo Sapiens; identical to SEQ ID NO: 40750

SEQ ID NO: 185526 - RNA, 64 nt, Homo Sapiens; identical to SEQ ID NO: 40751

SEQ ID NO: 185527 - RNA, 64 nt, Homo Sapiens; identical to SEQ ID NO: 40752

SEQ ID NO: 185528 - RNA, 64 nt, Homo Sapiens; identical to SEQ ID NO: 40753

SEQ ID NO: 185529 - RNA, 64 nt, Homo Sapiens; identical to SEQ ID NO: 40754

SEQ ID NO: 185530 - RNA, 64 nt, Homo Sapiens; identical to SEQ ID NO: 40755

SEQ ID NO: 185531 - RNA, 64 nt, Homo Sapiens; identical to SEQ ID NO: 40756

SEQ ID NO: 185532 - RNA, 64 nt, Homo Sapiens; identical to SEQ ID NO: 40757

SEQ ID NO: 185533 - RNA, 64 nt, Homo Sapiens; identical to SEQ ID NO: 40758

SEQ ID NO: 185534 - RNA, 64 nt, Homo Sapiens; identical to SEQ ID NO: 40759

SEQ ID NO: 185535 - RNA, 64 nt, Homo Sapiens; identical to SEQ ID NO: 40760

SEQ ID NO: 185536 - RNA, 64 nt, Homo Sapiens; identical to SEQ ID NO: 40761

SEQ ID NO: 185537 - RNA, 64 nt, Homo Sapiens; identical to SEQ ID NO: 40762

SEQ ID NO: 185538 - RNA, 64 nt, Homo Sapiens; identical to SEQ ID NO: 40763

SEQ ID NO: 185539 - RNA, 64 nt, Homo Sapiens; identical to SEQ ID NO: 40764

SEQ ID NO: 185540 - RNA, 64 nt, Homo Sapiens; identical to SEQ ID NO: 40765

SEQ ID NO: 185541 - RNA, 64 nt, Homo Sapiens; identical to SEQ ID NO: 40766

SEQ ID NO: 185542 - RNA, 64 nt, Homo Sapiens; identical to SEQ ID NO: 40767

SEQ ID NO: 185543 - RNA, 64 nt, Homo Sapiens; identical to SEQ ID NO: 40768

SEQ ID NO: 185544 - RNA, 64 nt, Homo Sapiens; identical to SEQ ID NO: 40769

SEQ ID NO: 185545 - RNA, 64 nt, Homo Sapiens; identical to SEQ ID NO: 40770

SEQ ID NO: 185546 - RNA, 64 nt, Homo Sapiens; identical to SEQ ID NO: 40771

SEQ ID NO: 185547 - RNA, 64 nt, Homo Sapiens; identical to SEQ ID NO: 40772

SEQ ID NO: 185548 - RNA, 64 nt, Homo Sapiens; identical to SEQ ID NO: 40773

SEQ ID NO: 185549 - RNA, 64 nt, Homo Sapiens; identical to SEQ ID NO: 40774

SEQ ID NO: 185550 - RNA, 64 nt, Homo Sapiens; identical to SEQ ID NO: 40775

SEQ ID NO: 185551 - RNA, 64 nt, Homo Sapiens; identical to SEQ ID NO: 40776

SEQ ID NO: 185552 - RNA, 64 nt, Homo Sapiens; identical to SEQ ID NO: 40777

SEQ ID NO: 185553 - RNA, 64 nt, Homo Sapiens; identical to SEQ ID NO: 40778

SEQ ID NO: 185554 - RNA, 64 nt, Homo Sapiens; identical to SEQ ID NO: 40779

SEQ ID NO: 185555 - RNA, 64 nt, Homo Sapiens; identical to SEQ ID NO: 40780

SEQ ID NO: 185556 - RNA, 64 nt, Homo Sapiens; identical to SEQ ID NO: 40781

SEQ ID NO: 185557 - RNA, 64 nt, Homo Sapiens; identical to SEQ ID NO: 40782

SEQ ID NO: 185558 - RNA, 64 nt, Homo Sapiens; identical to SEQ ID NO: 40783

SEQ ID NO: 185559 - RNA, 64 nt, Homo Sapiens; identical to SEQ ID NO: 40784

SEQ ID NO: 185560 - RNA, 64 nt, Homo Sapiens; identical to SEQ ID NO: 40785

SEQ ID NO: 185561 - RNA, 64 nt, Homo Sapiens; identical to SEQ ID NO: 40786

SEQ ID NO: 185562 - RNA, 64 nt, Homo Sapiens; identical to SEQ ID NO: 40787

SEQ ID NO: 185563 - RNA, 64 nt, Homo Sapiens; identical to SEQ ID NO: 40788

SEQ ID NO: 185564 - RNA, 64 nt, Homo Sapiens; identical to SEQ ID NO: 40789

SEQ ID NO: 185565 - RNA, 64 nt, Homo Sapiens; identical to SEQ ID NO: 40790

SEQ ID NO: 185566 - RNA, 64 nt, Homo Sapiens; identical to SEQ ID NO: 40791

SEQ ID NO: 185567 - RNA, 64 nt, Homo Sapiens; identical to SEQ ID NO: 40792

SEQ ID NO: 185568 - RNA, 64 nt, Homo Sapiens; identical to SEQ ID NO: 40793

SEQ ID NO: 185569 - RNA, 64 nt, Homo Sapiens; identical to SEQ ID NO: 40794

SEQ ID NO: 185570 - RNA, 64 nt, Homo Sapiens; identical to SEQ ID NO: 40795

SEQ ID NO: 185571 - RNA, 64 nt, Homo Sapiens; identical to SEQ ID NO: 40796

SEQ ID NO: 185572 - RNA, 64 nt, Homo Sapiens; identical to SEQ ID NO: 40797

SEQ ID NO: 185573 - RNA, 64 nt, Homo Sapiens; identical to SEQ ID NO: 40798

SEQ ID NO: 185574 - RNA, 64 nt, Homo Sapiens; identical to SEQ ID NO: 40799

SEQ ID NO: 185575 - RNA, 64 nt, Homo Sapiens; identical to SEQ ID NO: 40800

SEQ ID NO: 185576 - RNA, 64 nt, Homo Sapiens; identical to SEQ ID NO: 40801

SEQ ID NO: 185577 - RNA, 64 nt, Homo Sapiens; identical to SEQ ID NO: 40802

SEQ ID NO: 185578 - RNA, 64 nt, Homo Sapiens; identical to SEQ ID NO: 40803

SEQ ID NO: 185579 - RNA, 64 nt, Homo Sapiens; identical to SEQ ID NO: 40804

SEQ ID NO: 185580 - RNA, 64 nt, Homo Sapiens; identical to SEQ ID NO: 40805

SEQ ID NO: 185581 - RNA, 64 nt, Homo Sapiens; identical to SEQ ID NO: 40806

SEQ ID NO: 185582 - RNA, 64 nt, Homo Sapiens; identical to SEQ ID NO: 40807

SEQ ID NO: 185583 - RNA, 64 nt, Homo Sapiens; identical to SEQ ID NO: 40808

SEQ ID NO: 185584 - RNA, 64 nt, Homo Sapiens; identical to SEQ ID NO: 40809

SEQ ID NO: 185585 - RNA, 64 nt, Homo Sapiens; identical to SEQ ID NO: 40810

SEQ ID NO: 185586 - RNA, 64 nt, Homo Sapiens; identical to SEQ ID NO: 40811

SEQ ID NO: 185587 - RNA, 64 nt, Homo Sapiens; identical to SEQ ID NO: 40812

SEQ ID NO: 185588 - RNA, 64 nt, Homo Sapiens; identical to SEQ ID NO: 40813

SEQ ID NO: 185589 - RNA, 64 nt, Homo Sapiens; identical to SEQ ID NO: 40814

SEQ ID NO: 185590 - RNA, 64 nt, Homo Sapiens; identical to SEQ ID NO: 40815

SEQ ID NO: 185591 - RNA, 64 nt, Homo Sapiens; identical to SEQ ID NO: 40816

SEQ ID NO: 185592 - RNA, 64 nt, Homo Sapiens; identical to SEQ ID NO: 40817

SEQ ID NO: 185593 - RNA, 64 nt, Homo Sapiens; identical to SEQ ID NO: 40818

SEQ ID NO: 185594 - RNA, 64 nt, Homo Sapiens; identical to SEQ ID NO: 40819

SEQ ID NO: 185595 - RNA, 64 nt, Homo Sapiens; identical to SEQ ID NO: 40820

SEQ ID NO: 185596 - RNA, 64 nt, Homo Sapiens; identical to SEQ ID NO: 40821

SEQ ID NO: 185597 - RNA, 64 nt, Homo Sapiens; identical to SEQ ID NO: 40822

SEQ ID NO: 185598 - RNA, 64 nt, Homo Sapiens; identical to SEQ ID NO: 40823

SEQ ID NO: 185599 - RNA, 64 nt, Homo Sapiens; identical to SEQ ID NO: 40824

SEQ ID NO: 185600 - RNA, 64 nt, Homo Sapiens; identical to SEQ ID NO: 40825

SEQ ID NO: 185601 - RNA, 64 nt, Homo Sapiens; identical to SEQ ID NO: 40826

SEQ ID NO: 185602 - RNA, 64 nt, Homo Sapiens; identical to SEQ ID NO: 40827

SEQ ID NO: 185603 - RNA, 64 nt, Homo Sapiens; identical to SEQ ID NO: 40828

SEQ ID NO: 185604 - RNA, 64 nt, Homo Sapiens; identical to SEQ ID NO: 40829

SEQ ID NO: 185605 - RNA, 64 nt, Homo Sapiens; identical to SEQ ID NO: 40830

SEQ ID NO: 185606 - RNA, 64 nt, Homo Sapiens; identical to SEQ ID NO: 40831

SEQ ID NO: 185607 - RNA, 64 nt, Homo Sapiens; identical to SEQ ID NO: 40832

SEQ ID NO: 185608 - RNA, 64 nt, Homo Sapiens; identical to SEQ ID NO: 40833

SEQ ID NO: 185609 - RNA, 64 nt, Homo Sapiens; identical to SEQ ID NO: 40834

SEQ ID NO: 185610 - RNA, 64 nt, Homo Sapiens; identical to SEQ ID NO: 40835

SEQ ID NO: 185611 - RNA, 64 nt, Homo Sapiens; identical to SEQ ID NO: 40836

SEQ ID NO: 185612 - RNA, 64 nt, Homo Sapiens; identical to SEQ ID NO: 40837

SEQ ID NO: 185613 - RNA, 64 nt, Homo Sapiens; identical to SEQ ID NO: 40838

SEQ ID NO: 185614 - RNA, 64 nt, Homo Sapiens; identical to SEQ ID NO: 40839

SEQ ID NO: 185615 - RNA, 64 nt, Homo Sapiens; identical to SEQ ID NO: 40840

SEQ ID NO: 185616 - RNA, 64 nt, Homo Sapiens; identical to SEQ ID NO: 40841

SEQ ID NO: 185617 - RNA, 64 nt, Homo Sapiens; identical to SEQ ID NO: 40842

SEQ ID NO: 185618 - RNA, 64 nt, Homo Sapiens; identical to SEQ ID NO: 40843

SEQ ID NO: 185619 - RNA, 64 nt, Homo Sapiens; identical to SEQ ID NO: 40844

SEQ ID NO: 185620 - RNA, 64 nt, Homo Sapiens; identical to SEQ ID NO: 40845

SEQ ID NO: 185621 - RNA, 64 nt, Homo Sapiens; identical to SEQ ID NO: 40846

SEQ ID NO: 185622 - RNA, 64 nt, Homo Sapiens; identical to SEQ ID NO: 40847

SEQ ID NO: 185623 - RNA, 64 nt, Homo Sapiens; identical to SEQ ID NO: 40848

SEQ ID NO: 185624 - RNA, 64 nt, Homo Sapiens; identical to SEQ ID NO: 40849

SEQ ID NO: 185625 - RNA, 64 nt, Homo Sapiens; identical to SEQ ID NO: 40850

SEQ ID NO: 185626 - RNA, 64 nt, Homo Sapiens; identical to SEQ ID NO: 40851

SEQ ID NO: 185627 - RNA, 64 nt, Homo Sapiens; identical to SEQ ID NO: 40852

SEQ ID NO: 185628 - RNA, 64 nt, Homo Sapiens; identical to SEQ ID NO: 40853

SEQ ID NO: 185629 - RNA, 64 nt, Homo Sapiens; identical to SEQ ID NO: 40854

SEQ ID NO: 185630 - RNA, 64 nt, Homo Sapiens; identical to SEQ ID NO: 40855

SEQ ID NO: 185631 - RNA, 64 nt, Homo Sapiens; identical to SEQ ID NO: 40856

SEQ ID NO: 185632 - RNA, 64 nt, Homo Sapiens; identical to SEQ ID NO: 40857

SEQ ID NO: 185633 - RNA, 64 nt, Homo Sapiens; identical to SEQ ID NO: 40858

SEQ ID NO: 185634 - RNA, 64 nt, Homo Sapiens; identical to SEQ ID NO: 40859

SEQ ID NO: 185635 - RNA, 64 nt, Homo Sapiens; identical to SEQ ID NO: 40860

SEQ ID NO: 185636 - RNA, 64 nt, Homo Sapiens; identical to SEQ ID NO: 40861

SEQ ID NO: 185637 - RNA, 64 nt, Homo Sapiens; identical to SEQ ID NO: 40862

SEQ ID NO: 185638 - RNA, 64 nt, Homo Sapiens; identical to SEQ ID NO: 40863

SEQ ID NO: 185639 - RNA, 64 nt, Homo Sapiens; identical to SEQ ID NO: 40864

SEQ ID NO: 185640 - RNA, 64 nt, Homo Sapiens; identical to SEQ ID NO: 40865

SEQ ID NO: 185641 - RNA, 64 nt, Homo Sapiens; identical to SEQ ID NO: 40866

SEQ ID NO: 185642 - RNA, 64 nt, Homo Sapiens; identical to SEQ ID NO: 40867

SEQ ID NO: 185643 - RNA, 64 nt, Homo Sapiens; identical to SEQ ID NO: 40868

SEQ ID NO: 185644 - RNA, 64 nt, Homo Sapiens; identical to SEQ ID NO: 40869

SEQ ID NO: 185645 - RNA, 64 nt, Homo Sapiens; identical to SEQ ID NO: 40870

SEQ ID NO: 185646 - RNA, 64 nt, Homo Sapiens; identical to SEQ ID NO: 40871

SEQ ID NO: 185647 - RNA, 64 nt, Homo Sapiens; identical to SEQ ID NO: 40872

SEQ ID NO: 185648 - RNA, 64 nt, Homo Sapiens; identical to SEQ ID NO: 40873

SEQ ID NO: 185649 - RNA, 64 nt, Homo Sapiens; identical to SEQ ID NO: 40874

SEQ ID NO: 185650 - RNA, 64 nt, Homo Sapiens; identical to SEQ ID NO: 40875

SEQ ID NO: 185651 - RNA, 64 nt, Homo Sapiens; identical to SEQ ID NO: 40876

SEQ ID NO: 185652 - RNA, 64 nt, Homo Sapiens; identical to SEQ ID NO: 40877

SEQ ID NO: 185653 - RNA, 64 nt, Homo Sapiens; identical to SEQ ID NO: 40878

SEQ ID NO: 185654 - RNA, 64 nt, Homo Sapiens; identical to SEQ ID NO: 40879

SEQ ID NO: 185655 - RNA, 64 nt, Homo Sapiens; identical to SEQ ID NO: 40880

SEQ ID NO: 185656 - RNA, 64 nt, Homo Sapiens; identical to SEQ ID NO: 40881

SEQ ID NO: 185657 - RNA, 64 nt, Homo Sapiens; identical to SEQ ID NO: 40882

SEQ ID NO: 185658 - RNA, 64 nt, Homo Sapiens; identical to SEQ ID NO: 40883

SEQ ID NO: 185659 - RNA, 64 nt, Homo Sapiens; identical to SEQ ID NO: 40884

SEQ ID NO: 185660 - RNA, 64 nt, Homo Sapiens; identical to SEQ ID NO: 40885

SEQ ID NO: 185661 - RNA, 64 nt, Homo Sapiens; identical to SEQ ID NO: 40886

SEQ ID NO: 185662 - RNA, 64 nt, Homo Sapiens; identical to SEQ ID NO: 40887

SEQ ID NO: 185663 - RNA, 64 nt, Homo Sapiens; identical to SEQ ID NO: 40888

SEQ ID NO: 185664 - RNA, 64 nt, Homo Sapiens; identical to SEQ ID NO: 40889

SEQ ID NO: 185665 - RNA, 64 nt, Homo Sapiens; identical to SEQ ID NO: 40890

SEQ ID NO: 185666 - RNA, 64 nt, Homo Sapiens; identical to SEQ ID NO: 40891

SEQ ID NO: 185667 - RNA, 64 nt, Homo Sapiens; identical to SEQ ID NO: 40892

SEQ ID NO: 185668 - RNA, 64 nt, Homo Sapiens; identical to SEQ ID NO: 40893

SEQ ID NO: 185669 - RNA, 64 nt, Homo Sapiens; identical to SEQ ID NO: 40894

SEQ ID NO: 185670 - RNA, 64 nt, Homo Sapiens; identical to SEQ ID NO: 40895

SEQ ID NO: 185671 - RNA, 64 nt, Homo Sapiens; identical to SEQ ID NO: 40896

SEQ ID NO: 185672 - RNA, 64 nt, Homo Sapiens; identical to SEQ ID NO: 40897

SEQ ID NO: 185673 - RNA, 64 nt, Homo Sapiens; identical to SEQ ID NO: 40898

SEQ ID NO: 185674 - RNA, 64 nt, Homo Sapiens; identical to SEQ ID NO: 40899

SEQ ID NO: 185675 - RNA, 64 nt, Homo Sapiens; identical to SEQ ID NO: 40900

SEQ ID NO: 185676 - RNA, 64 nt, Homo Sapiens; identical to SEQ ID NO: 40901

SEQ ID NO: 185677 - RNA, 64 nt, Homo Sapiens; identical to SEQ ID NO: 40902

SEQ ID NO: 185678 - RNA, 64 nt, Homo Sapiens; identical to SEQ ID NO: 40903

SEQ ID NO: 185679 - RNA, 64 nt, Homo Sapiens; identical to SEQ ID NO: 40904

SEQ ID NO: 185680 - RNA, 64 nt, Homo Sapiens; identical to SEQ ID NO: 40905

SEQ ID NO: 185681 - RNA, 64 nt, Homo Sapiens; identical to SEQ ID NO: 40906

SEQ ID NO: 185682 - RNA, 64 nt, Homo Sapiens; identical to SEQ ID NO: 40907

SEQ ID NO: 185683 - RNA, 64 nt, Homo Sapiens; identical to SEQ ID NO: 40908

SEQ ID NO: 185684 - RNA, 64 nt, Homo Sapiens; identical to SEQ ID NO: 40909

SEQ ID NO: 185685 - RNA, 64 nt, Homo Sapiens; identical to SEQ ID NO: 40910

SEQ ID NO: 185686 - RNA, 64 nt, Homo Sapiens; identical to SEQ ID NO: 40911

SEQ ID NO: 185687 - RNA, 64 nt, Homo Sapiens; identical to SEQ ID NO: 40912

SEQ ID NO: 185688 - RNA, 64 nt, Homo Sapiens; identical to SEQ ID NO: 40913

SEQ ID NO: 185689 - RNA, 64 nt, Homo Sapiens; identical to SEQ ID NO: 40914

SEQ ID NO: 185690 - RNA, 64 nt, Homo Sapiens; identical to SEQ ID NO: 40915

SEQ ID NO: 185691 - RNA, 64 nt, Homo Sapiens; identical to SEQ ID NO: 40916

SEQ ID NO: 185692 - RNA, 64 nt, Homo Sapiens; identical to SEQ ID NO: 40917

SEQ ID NO: 185693 - RNA, 64 nt, Homo Sapiens; identical to SEQ ID NO: 40918

SEQ ID NO: 185694 - RNA, 64 nt, Homo Sapiens; identical to SEQ ID NO: 40919

SEQ ID NO: 185695 - RNA, 64 nt, Homo Sapiens; identical to SEQ ID NO: 40920

SEQ ID NO: 185696 - RNA, 64 nt, Homo Sapiens; identical to SEQ ID NO: 40921

SEQ ID NO: 185697 - RNA, 64 nt, Homo Sapiens; identical to SEQ ID NO: 40922

SEQ ID NO: 185698 - RNA, 64 nt, Homo Sapiens; identical to SEQ ID NO: 40923

SEQ ID NO: 185699 - RNA, 64 nt, Homo Sapiens; identical to SEQ ID NO: 40924

SEQ ID NO: 185700 - RNA, 64 nt, Homo Sapiens; identical to SEQ ID NO: 40925

SEQ ID NO: 185701 - RNA, 64 nt, Homo Sapiens; identical to SEQ ID NO: 40926

SEQ ID NO: 185702 - RNA, 64 nt, Homo Sapiens; identical to SEQ ID NO: 40927

SEQ ID NO: 185703 - RNA, 64 nt, Homo Sapiens; identical to SEQ ID NO: 40928

SEQ ID NO: 185704 - RNA, 64 nt, Homo Sapiens; identical to SEQ ID NO: 40929

SEQ ID NO: 185705 - RNA, 64 nt, Homo Sapiens; identical to SEQ ID NO: 40930

SEQ ID NO: 185706 - RNA, 64 nt, Homo Sapiens; identical to SEQ ID NO: 40931

SEQ ID NO: 185707 - RNA, 64 nt, Homo Sapiens; identical to SEQ ID NO: 40932

SEQ ID NO: 185708 - RNA, 64 nt, Homo Sapiens; identical to SEQ ID NO: 40933

SEQ ID NO: 185709 - RNA, 64 nt, Homo Sapiens; identical to SEQ ID NO: 40934

SEQ ID NO: 185710 - RNA, 64 nt, Homo Sapiens; identical to SEQ ID NO: 40935

SEQ ID NO: 185711 - RNA, 64 nt, Homo Sapiens; identical to SEQ ID NO: 40936

SEQ ID NO: 185712 - RNA, 64 nt, Homo Sapiens; identical to SEQ ID NO: 40937

SEQ ID NO: 185713 - RNA, 64 nt, Homo Sapiens; identical to SEQ ID NO: 40938

SEQ ID NO: 185714 - RNA, 64 nt, Homo Sapiens; identical to SEQ ID NO: 40939

SEQ ID NO: 185715 - RNA, 64 nt, Homo Sapiens; identical to SEQ ID NO: 40940

SEQ ID NO: 185716 - RNA, 64 nt, Homo Sapiens; identical to SEQ ID NO: 40941

SEQ ID NO: 185717 - RNA, 64 nt, Homo Sapiens; identical to SEQ ID NO: 40942

SEQ ID NO: 185718 - RNA, 64 nt, Homo Sapiens; identical to SEQ ID NO: 40943

SEQ ID NO: 185719 - RNA, 64 nt, Homo Sapiens; identical to SEQ ID NO: 40944

SEQ ID NO: 185720 - RNA, 64 nt, Homo Sapiens; identical to SEQ ID NO: 40945

SEQ ID NO: 185721 - RNA, 64 nt, Homo Sapiens; identical to SEQ ID NO: 40946

SEQ ID NO: 185722 - RNA, 64 nt, Homo Sapiens; identical to SEQ ID NO: 40947

SEQ ID NO: 185723 - RNA, 64 nt, Homo Sapiens; identical to SEQ ID NO: 40948

SEQ ID NO: 185724 - RNA, 64 nt, Homo Sapiens; identical to SEQ ID NO: 40949

SEQ ID NO: 185725 - RNA, 64 nt, Homo Sapiens; identical to SEQ ID NO: 40950

SEQ ID NO: 185726 - RNA, 64 nt, Homo Sapiens; identical to SEQ ID NO: 40951

SEQ ID NO: 185727 - RNA, 64 nt, Homo Sapiens; identical to SEQ ID NO: 40952

SEQ ID NO: 185728 - RNA, 64 nt, Homo Sapiens; identical to SEQ ID NO: 40953

SEQ ID NO: 185729 - RNA, 64 nt, Homo Sapiens; identical to SEQ ID NO: 40954

SEQ ID NO: 185730 - RNA, 64 nt, Homo Sapiens; identical to SEQ ID NO: 40955

SEQ ID NO: 185731 - RNA, 64 nt, Homo Sapiens; identical to SEQ ID NO: 40956

SEQ ID NO: 185732 - RNA, 64 nt, Homo Sapiens; identical to SEQ ID NO: 40957

SEQ ID NO: 185733 - RNA, 64 nt, Homo Sapiens; identical to SEQ ID NO: 40958

SEQ ID NO: 185734 - RNA, 64 nt, Homo Sapiens; identical to SEQ ID NO: 40959

SEQ ID NO: 185735 - RNA, 64 nt, Homo Sapiens; identical to SEQ ID NO: 40960

SEQ ID NO: 185736 - RNA, 64 nt, Homo Sapiens; identical to SEQ ID NO: 40961

SEQ ID NO: 185737 - RNA, 64 nt, Homo Sapiens; identical to SEQ ID NO: 40962

SEQ ID NO: 185738 - RNA, 64 nt, Homo Sapiens; identical to SEQ ID NO: 40963

SEQ ID NO: 185739 - RNA, 64 nt, Homo Sapiens; identical to SEQ ID NO: 40964

SEQ ID NO: 185740 - RNA, 64 nt, Homo Sapiens; identical to SEQ ID NO: 40965

SEQ ID NO: 185741 - RNA, 64 nt, Homo Sapiens; identical to SEQ ID NO: 40966

SEQ ID NO: 185742 - RNA, 64 nt, Homo Sapiens; identical to SEQ ID NO: 40967

SEQ ID NO: 185743 - RNA, 64 nt, Homo Sapiens; identical to SEQ ID NO: 40968

SEQ ID NO: 185744 - RNA, 64 nt, Homo Sapiens; identical to SEQ ID NO: 40969

SEQ ID NO: 185745 - RNA, 64 nt, Homo Sapiens; identical to SEQ ID NO: 40970

SEQ ID NO: 185746 - RNA, 64 nt, Homo Sapiens; identical to SEQ ID NO: 40971

SEQ ID NO: 185747 - RNA, 64 nt, Homo Sapiens; identical to SEQ ID NO: 40972

SEQ ID NO: 185748 - RNA, 64 nt, Homo Sapiens; identical to SEQ ID NO: 40973

SEQ ID NO: 185749 - RNA, 64 nt, Homo Sapiens; identical to SEQ ID NO: 40974

SEQ ID NO: 185750 - RNA, 64 nt, Homo Sapiens; identical to SEQ ID NO: 40975

SEQ ID NO: 185751 - RNA, 64 nt, Homo Sapiens; identical to SEQ ID NO: 40976

SEQ ID NO: 185752 - RNA, 64 nt, Homo Sapiens; identical to SEQ ID NO: 40977

SEQ ID NO: 185753 - RNA, 64 nt, Homo Sapiens; identical to SEQ ID NO: 40978

SEQ ID NO: 185754 - RNA, 64 nt, Homo Sapiens; identical to SEQ ID NO: 40979

SEQ ID NO: 185755 - RNA, 64 nt, Homo Sapiens; identical to SEQ ID NO: 40980

SEQ ID NO: 185756 - RNA, 64 nt, Homo Sapiens; identical to SEQ ID NO: 40981

SEQ ID NO: 185757 - RNA, 64 nt, Homo Sapiens; identical to SEQ ID NO: 40982

SEQ ID NO: 185758 - RNA, 64 nt, Homo Sapiens; identical to SEQ ID NO: 40983

SEQ ID NO: 185759 - RNA, 64 nt, Homo Sapiens; identical to SEQ ID NO: 40984

SEQ ID NO: 185760 - RNA, 64 nt, Homo Sapiens; identical to SEQ ID NO: 40985

SEQ ID NO: 185761 - RNA, 64 nt, Homo Sapiens; identical to SEQ ID NO: 40986

SEQ ID NO: 185762 - RNA, 64 nt, Homo Sapiens; identical to SEQ ID NO: 40987

SEQ ID NO: 185763 - RNA, 64 nt, Homo Sapiens; identical to SEQ ID NO: 40988

SEQ ID NO: 185764 - RNA, 64 nt, Homo Sapiens; identical to SEQ ID NO: 40989

SEQ ID NO: 185765 - RNA, 64 nt, Homo Sapiens; identical to SEQ ID NO: 40990

SEQ ID NO: 185766 - RNA, 64 nt, Homo Sapiens; identical to SEQ ID NO: 40991

SEQ ID NO: 185767 - RNA, 64 nt, Homo Sapiens; identical to SEQ ID NO: 40992

SEQ ID NO: 185768 - RNA, 64 nt, Homo Sapiens; identical to SEQ ID NO: 40993

SEQ ID NO: 185769 - RNA, 64 nt, Homo Sapiens; identical to SEQ ID NO: 40994

SEQ ID NO: 185770 - RNA, 64 nt, Homo Sapiens; identical to SEQ ID NO: 40995

SEQ ID NO: 185771 - RNA, 64 nt, Homo Sapiens; identical to SEQ ID NO: 40996

SEQ ID NO: 185772 - RNA, 64 nt, Homo Sapiens; identical to SEQ ID NO: 40997

SEQ ID NO: 185773 - RNA, 64 nt, Homo Sapiens; identical to SEQ ID NO: 40998

SEQ ID NO: 185774 - RNA, 64 nt, Homo Sapiens; identical to SEQ ID NO: 40999

SEQ ID NO: 185775 - RNA, 64 nt, Homo Sapiens; identical to SEQ ID NO: 41000

SEQ ID NO: 185776 - RNA, 64 nt, Homo Sapiens; identical to SEQ ID NO: 41001

SEQ ID NO: 185777 - RNA, 64 nt, Homo Sapiens; identical to SEQ ID NO: 41002

SEQ ID NO: 185778 - RNA, 64 nt, Homo Sapiens; identical to SEQ ID NO: 41003

SEQ ID NO: 185779 - RNA, 64 nt, Homo Sapiens; identical to SEQ ID NO: 41004

SEQ ID NO: 185780 - RNA, 64 nt, Homo Sapiens; identical to SEQ ID NO: 41005

SEQ ID NO: 185781 - RNA, 64 nt, Homo Sapiens; identical to SEQ ID NO: 41006

SEQ ID NO: 185782 - RNA, 63 nt, Homo Sapiens; identical to SEQ ID NO: 41007

SEQ ID NO: 185783 - RNA, 64 nt, Homo Sapiens; identical to SEQ ID NO: 41008

SEQ ID NO: 185784 - RNA, 64 nt, Homo Sapiens; identical to SEQ ID NO: 41009

SEQ ID NO: 185785 - RNA, 64 nt, Homo Sapiens; identical to SEQ ID NO: 41010

SEQ ID NO: 185786 - RNA, 64 nt, Homo Sapiens; identical to SEQ ID NO: 41011

SEQ ID NO: 185787 - RNA, 64 nt, Homo Sapiens; identical to SEQ ID NO: 41012

SEQ ID NO: 185788 - RNA, 64 nt, Homo Sapiens; identical to SEQ ID NO: 41013

SEQ ID NO: 185789 - RNA, 64 nt, Homo Sapiens; identical to SEQ ID NO: 41014

SEQ ID NO: 185790 - RNA, 64 nt, Homo Sapiens; identical to SEQ ID NO: 41015

SEQ ID NO: 185791 - RNA, 64 nt, Homo Sapiens; identical to SEQ ID NO: 41016

SEQ ID NO: 185792 - RNA, 64 nt, Homo Sapiens; identical to SEQ ID NO: 41017

SEQ ID NO: 185793 - RNA, 64 nt, Homo Sapiens; identical to SEQ ID NO: 41018

SEQ ID NO: 185794 - RNA, 64 nt, Homo Sapiens; identical to SEQ ID NO: 41019

SEQ ID NO: 185795 - RNA, 64 nt, Homo Sapiens; identical to SEQ ID NO: 41020

SEQ ID NO: 185796 - RNA, 64 nt, Homo Sapiens; identical to SEQ ID NO: 41021

SEQ ID NO: 185797 - RNA, 64 nt, Homo Sapiens; identical to SEQ ID NO: 41022

SEQ ID NO: 185798 - RNA, 64 nt, Homo Sapiens; identical to SEQ ID NO: 41023

SEQ ID NO: 185799 - RNA, 64 nt, Homo Sapiens; identical to SEQ ID NO: 41024

SEQ ID NO: 185800 - RNA, 64 nt, Homo Sapiens; identical to SEQ ID NO: 41025

SEQ ID NO: 185801 - RNA, 64 nt, Homo Sapiens; identical to SEQ ID NO: 41026

SEQ ID NO: 185802 - RNA, 64 nt, Homo Sapiens; identical to SEQ ID NO: 41027

SEQ ID NO: 185803 - RNA, 64 nt, Homo Sapiens; identical to SEQ ID NO: 41028

SEQ ID NO: 185804 - RNA, 64 nt, Homo Sapiens; identical to SEQ ID NO: 41029

SEQ ID NO: 185805 - RNA, 64 nt, Homo Sapiens; identical to SEQ ID NO: 41030

SEQ ID NO: 185806 - RNA, 64 nt, Homo Sapiens; identical to SEQ ID NO: 41031

SEQ ID NO: 185807 - RNA, 64 nt, Homo Sapiens; identical to SEQ ID NO: 41032

SEQ ID NO: 185808 - RNA, 64 nt, Homo Sapiens; identical to SEQ ID NO: 41033

SEQ ID NO: 185809 - RNA, 64 nt, Homo Sapiens; identical to SEQ ID NO: 41034

SEQ ID NO: 185810 - RNA, 64 nt, Homo Sapiens; identical to SEQ ID NO: 41035

SEQ ID NO: 185811 - RNA, 64 nt, Homo Sapiens; identical to SEQ ID NO: 41036

SEQ ID NO: 185812 - RNA, 64 nt, Homo Sapiens; identical to SEQ ID NO: 41037

SEQ ID NO: 185813 - RNA, 64 nt, Homo Sapiens; identical to SEQ ID NO: 41038

SEQ ID NO: 185814 - RNA, 64 nt, Homo Sapiens; identical to SEQ ID NO: 41039

SEQ ID NO: 185815 - RNA, 64 nt, Homo Sapiens; identical to SEQ ID NO: 41040

SEQ ID NO: 185816 - RNA, 64 nt, Homo Sapiens; identical to SEQ ID NO: 41041

SEQ ID NO: 185817 - RNA, 64 nt, Homo Sapiens; identical to SEQ ID NO: 41042

SEQ ID NO: 185818 - RNA, 64 nt, Homo Sapiens; identical to SEQ ID NO: 41043

SEQ ID NO: 185819 - RNA, 64 nt, Homo Sapiens; identical to SEQ ID NO: 41044

SEQ ID NO: 185820 - RNA, 64 nt, Homo Sapiens; identical to SEQ ID NO: 41045

SEQ ID NO: 185821 - RNA, 64 nt, Homo Sapiens; identical to SEQ ID NO: 41046

SEQ ID NO: 185822 - RNA, 64 nt, Homo Sapiens; identical to SEQ ID NO: 41047

SEQ ID NO: 185823 - RNA, 64 nt, Homo Sapiens; identical to SEQ ID NO: 41048

SEQ ID NO: 185824 - RNA, 64 nt, Homo Sapiens; identical to SEQ ID NO: 41049

SEQ ID NO: 185825 - RNA, 64 nt, Homo Sapiens; identical to SEQ ID NO: 41050

SEQ ID NO: 185826 - RNA, 64 nt, Homo Sapiens; identical to SEQ ID NO: 41051

SEQ ID NO: 185827 - RNA, 64 nt, Homo Sapiens; identical to SEQ ID NO: 41052

SEQ ID NO: 185828 - RNA, 64 nt, Homo Sapiens; identical to SEQ ID NO: 41053

SEQ ID NO: 185829 - RNA, 64 nt, Homo Sapiens; identical to SEQ ID NO: 41054

SEQ ID NO: 185830 - RNA, 64 nt, Homo Sapiens; identical to SEQ ID NO: 41055

SEQ ID NO: 185831 - RNA, 64 nt, Homo Sapiens; identical to SEQ ID NO: 41056

SEQ ID NO: 185832 - RNA, 64 nt, Homo Sapiens; identical to SEQ ID NO: 41057

SEQ ID NO: 185833 - RNA, 64 nt, Homo Sapiens; identical to SEQ ID NO: 41058

SEQ ID NO: 185834 - RNA, 64 nt, Homo Sapiens; identical to SEQ ID NO: 41059

SEQ ID NO: 185835 - RNA, 64 nt, Homo Sapiens; identical to SEQ ID NO: 41060

SEQ ID NO: 185836 - RNA, 64 nt, Homo Sapiens; identical to SEQ ID NO: 41061

SEQ ID NO: 185837 - RNA, 64 nt, Homo Sapiens; identical to SEQ ID NO: 41062

SEQ ID NO: 185838 - RNA, 64 nt, Homo Sapiens; identical to SEQ ID NO: 41063

SEQ ID NO: 185839 - RNA, 64 nt, Homo Sapiens; identical to SEQ ID NO: 41064

SEQ ID NO: 185840 - RNA, 64 nt, Homo Sapiens; identical to SEQ ID NO: 41065

SEQ ID NO: 185841 - RNA, 64 nt, Homo Sapiens; identical to SEQ ID NO: 41066

SEQ ID NO: 185842 - RNA, 64 nt, Homo Sapiens; identical to SEQ ID NO: 41067

SEQ ID NO: 185843 - RNA, 64 nt, Homo Sapiens; identical to SEQ ID NO: 41068

SEQ ID NO: 185844 - RNA, 64 nt, Homo Sapiens; identical to SEQ ID NO: 41069

SEQ ID NO: 185845 - RNA, 64 nt, Homo Sapiens; identical to SEQ ID NO: 41070

SEQ ID NO: 185846 - RNA, 64 nt, Homo Sapiens; identical to SEQ ID NO: 41071

SEQ ID NO: 185847 - RNA, 64 nt, Homo Sapiens; identical to SEQ ID NO: 41072

SEQ ID NO: 185848 - RNA, 64 nt, Homo Sapiens; identical to SEQ ID NO: 41073

SEQ ID NO: 185849 - RNA, 64 nt, Homo Sapiens; identical to SEQ ID NO: 41074

SEQ ID NO: 185850 - RNA, 64 nt, Homo Sapiens; identical to SEQ ID NO: 41075

SEQ ID NO: 185851 - RNA, 64 nt, Homo Sapiens; identical to SEQ ID NO: 41076

SEQ ID NO: 185852 - RNA, 64 nt, Homo Sapiens; identical to SEQ ID NO: 41077

SEQ ID NO: 185853 - RNA, 64 nt, Homo Sapiens; identical to SEQ ID NO: 41078

SEQ ID NO: 185854 - RNA, 64 nt, Homo Sapiens; identical to SEQ ID NO: 41079

SEQ ID NO: 185855 - RNA, 64 nt, Homo Sapiens; identical to SEQ ID NO: 41080

SEQ ID NO: 185856 - RNA, 64 nt, Homo Sapiens; identical to SEQ ID NO: 41081

SEQ ID NO: 185857 - RNA, 64 nt, Homo Sapiens; identical to SEQ ID NO: 41082

SEQ ID NO: 185858 - RNA, 64 nt, Homo Sapiens; identical to SEQ ID NO: 41083

SEQ ID NO: 185859 - RNA, 64 nt, Homo Sapiens; identical to SEQ ID NO: 41084

SEQ ID NO: 185860 - RNA, 64 nt, Homo Sapiens; identical to SEQ ID NO: 41085

SEQ ID NO: 185861 - RNA, 64 nt, Homo Sapiens; identical to SEQ ID NO: 41086

SEQ ID NO: 185862 - RNA, 64 nt, Homo Sapiens; identical to SEQ ID NO: 41087

SEQ ID NO: 185863 - RNA, 64 nt, Homo Sapiens; identical to SEQ ID NO: 41088

SEQ ID NO: 185864 - RNA, 64 nt, Homo Sapiens; identical to SEQ ID NO: 41089

SEQ ID NO: 185865 - RNA, 64 nt, Homo Sapiens; identical to SEQ ID NO: 41090

SEQ ID NO: 185866 - RNA, 64 nt, Homo Sapiens; identical to SEQ ID NO: 41091

SEQ ID NO: 185867 - RNA, 64 nt, Homo Sapiens; identical to SEQ ID NO: 41092

SEQ ID NO: 185868 - RNA, 64 nt, Homo Sapiens; identical to SEQ ID NO: 41093

SEQ ID NO: 185869 - RNA, 64 nt, Homo Sapiens; identical to SEQ ID NO: 41094

SEQ ID NO: 185870 - RNA, 64 nt, Homo Sapiens; identical to SEQ ID NO: 41095

SEQ ID NO: 185871 - RNA, 64 nt, Homo Sapiens; identical to SEQ ID NO: 41096

SEQ ID NO: 185872 - RNA, 64 nt, Homo Sapiens; identical to SEQ ID NO: 41097

SEQ ID NO: 185873 - RNA, 64 nt, Homo Sapiens; identical to SEQ ID NO: 41098

SEQ ID NO: 185874 - RNA, 64 nt, Homo Sapiens; identical to SEQ ID NO: 41099

SEQ ID NO: 185875 - RNA, 64 nt, Homo Sapiens; identical to SEQ ID NO: 41100

SEQ ID NO: 185876 - RNA, 64 nt, Homo Sapiens; identical to SEQ ID NO: 41101

SEQ ID NO: 185877 - RNA, 64 nt, Homo Sapiens; identical to SEQ ID NO: 41102

SEQ ID NO: 185878 - RNA, 64 nt, Homo Sapiens; identical to SEQ ID NO: 41103

SEQ ID NO: 185879 - RNA, 64 nt, Homo Sapiens; identical to SEQ ID NO: 41104

SEQ ID NO: 185880 - RNA, 64 nt, Homo Sapiens; identical to SEQ ID NO: 41105

SEQ ID NO: 185881 - RNA, 64 nt, Homo Sapiens; identical to SEQ ID NO: 41106

SEQ ID NO: 185882 - RNA, 64 nt, Homo Sapiens; identical to SEQ ID NO: 41107

SEQ ID NO: 185883 - RNA, 64 nt, Homo Sapiens; identical to SEQ ID NO: 41108

SEQ ID NO: 185884 - RNA, 64 nt, Homo Sapiens; identical to SEQ ID NO: 41109

SEQ ID NO: 185885 - RNA, 64 nt, Homo Sapiens; identical to SEQ ID NO: 41110

SEQ ID NO: 185886 - RNA, 64 nt, Homo Sapiens; identical to SEQ ID NO: 41111

SEQ ID NO: 185887 - RNA, 64 nt, Homo Sapiens; identical to SEQ ID NO: 41112

SEQ ID NO: 185888 - RNA, 64 nt, Homo Sapiens; identical to SEQ ID NO: 41113

SEQ ID NO: 185889 - RNA, 64 nt, Homo Sapiens; identical to SEQ ID NO: 41114

SEQ ID NO: 185890 - RNA, 64 nt, Homo Sapiens; identical to SEQ ID NO: 41115

SEQ ID NO: 185891 - RNA, 64 nt, Homo Sapiens; identical to SEQ ID NO: 41116

SEQ ID NO: 185892 - RNA, 64 nt, Homo Sapiens; identical to SEQ ID NO: 41117

SEQ ID NO: 185893 - RNA, 64 nt, Homo Sapiens; identical to SEQ ID NO: 41118

SEQ ID NO: 185894 - RNA, 64 nt, Homo Sapiens; identical to SEQ ID NO: 41119

SEQ ID NO: 185895 - RNA, 64 nt, Homo Sapiens; identical to SEQ ID NO: 41120

SEQ ID NO: 185896 - RNA, 64 nt, Homo Sapiens; identical to SEQ ID NO: 41121

SEQ ID NO: 185897 - RNA, 64 nt, Homo Sapiens; identical to SEQ ID NO: 41122

SEQ ID NO: 185898 - RNA, 64 nt, Homo Sapiens; identical to SEQ ID NO: 41123

SEQ ID NO: 185899 - RNA, 64 nt, Homo Sapiens; identical to SEQ ID NO: 41124

SEQ ID NO: 185900 - RNA, 64 nt, Homo Sapiens; identical to SEQ ID NO: 41125

SEQ ID NO: 185901 - RNA, 64 nt, Homo Sapiens; identical to SEQ ID NO: 41126

SEQ ID NO: 185902 - RNA, 64 nt, Homo Sapiens; identical to SEQ ID NO: 41127

SEQ ID NO: 185903 - RNA, 64 nt, Homo Sapiens; identical to SEQ ID NO: 41128

SEQ ID NO: 185904 - RNA, 64 nt, Homo Sapiens; identical to SEQ ID NO: 41129

SEQ ID NO: 185905 - RNA, 64 nt, Homo Sapiens; identical to SEQ ID NO: 41130

SEQ ID NO: 185906 - RNA, 64 nt, Homo Sapiens; identical to SEQ ID NO: 41131

SEQ ID NO: 185907 - RNA, 64 nt, Homo Sapiens; identical to SEQ ID NO: 41132

SEQ ID NO: 185908 - RNA, 64 nt, Homo Sapiens; identical to SEQ ID NO: 41133

SEQ ID NO: 185909 - RNA, 64 nt, Homo Sapiens; identical to SEQ ID NO: 41134

SEQ ID NO: 185910 - RNA, 64 nt, Homo Sapiens; identical to SEQ ID NO: 41135

SEQ ID NO: 185911 - RNA, 64 nt, Homo Sapiens; identical to SEQ ID NO: 41136

SEQ ID NO: 185912 - RNA, 64 nt, Homo Sapiens; identical to SEQ ID NO: 41137

SEQ ID NO: 185913 - RNA, 64 nt, Homo Sapiens; identical to SEQ ID NO: 41138

SEQ ID NO: 185914 - RNA, 64 nt, Homo Sapiens; identical to SEQ ID NO: 41139

SEQ ID NO: 185915 - RNA, 64 nt, Homo Sapiens; identical to SEQ ID NO: 41140

SEQ ID NO: 185916 - RNA, 64 nt, Homo Sapiens; identical to SEQ ID NO: 41141

SEQ ID NO: 185917 - RNA, 64 nt, Homo Sapiens; identical to SEQ ID NO: 41142

SEQ ID NO: 185918 - RNA, 64 nt, Homo Sapiens; identical to SEQ ID NO: 41143

SEQ ID NO: 185919 - RNA, 64 nt, Homo Sapiens; identical to SEQ ID NO: 41144

SEQ ID NO: 185920 - RNA, 64 nt, Homo Sapiens; identical to SEQ ID NO: 41145

SEQ ID NO: 185921 - RNA, 64 nt, Homo Sapiens; identical to SEQ ID NO: 41146

SEQ ID NO: 185922 - RNA, 64 nt, Homo Sapiens; identical to SEQ ID NO: 41147

SEQ ID NO: 185923 - RNA, 64 nt, Homo Sapiens; identical to SEQ ID NO: 41148

SEQ ID NO: 185924 - RNA, 64 nt, Homo Sapiens; identical to SEQ ID NO: 41149

SEQ ID NO: 185925 - RNA, 64 nt, Homo Sapiens; identical to SEQ ID NO: 41150

SEQ ID NO: 185926 - RNA, 64 nt, Homo Sapiens; identical to SEQ ID NO: 41151

SEQ ID NO: 185927 - RNA, 64 nt, Homo Sapiens; identical to SEQ ID NO: 41152

SEQ ID NO: 185928 - RNA, 64 nt, Homo Sapiens; identical to SEQ ID NO: 41153

SEQ ID NO: 185929 - RNA, 64 nt, Homo Sapiens; identical to SEQ ID NO: 41154

SEQ ID NO: 185930 - RNA, 64 nt, Homo Sapiens; identical to SEQ ID NO: 41155

SEQ ID NO: 185931 - RNA, 64 nt, Homo Sapiens; identical to SEQ ID NO: 41156

SEQ ID NO: 185932 - RNA, 64 nt, Homo Sapiens; identical to SEQ ID NO: 41157

SEQ ID NO: 185933 - RNA, 64 nt, Homo Sapiens; identical to SEQ ID NO: 41158

SEQ ID NO: 185934 - RNA, 64 nt, Homo Sapiens; identical to SEQ ID NO: 41159

SEQ ID NO: 185935 - RNA, 64 nt, Homo Sapiens; identical to SEQ ID NO: 41160

SEQ ID NO: 185936 - RNA, 64 nt, Homo Sapiens; identical to SEQ ID NO: 41161

SEQ ID NO: 185937 - RNA, 64 nt, Homo Sapiens; identical to SEQ ID NO: 41162

SEQ ID NO: 185938 - RNA, 64 nt, Homo Sapiens; identical to SEQ ID NO: 41163

SEQ ID NO: 185939 - RNA, 64 nt, Homo Sapiens; identical to SEQ ID NO: 41164

SEQ ID NO: 185940 - RNA, 64 nt, Homo Sapiens; identical to SEQ ID NO: 41165

SEQ ID NO: 185941 - RNA, 64 nt, Homo Sapiens; identical to SEQ ID NO: 41166

SEQ ID NO: 185942 - RNA, 64 nt, Homo Sapiens; identical to SEQ ID NO: 41167

SEQ ID NO: 185943 - RNA, 64 nt, Homo Sapiens; identical to SEQ ID NO: 41168

SEQ ID NO: 185944 - RNA, 64 nt, Homo Sapiens; identical to SEQ ID NO: 41169

SEQ ID NO: 185945 - RNA, 64 nt, Homo Sapiens; identical to SEQ ID NO: 41170

SEQ ID NO: 185946 - RNA, 64 nt, Homo Sapiens; identical to SEQ ID NO: 41171

SEQ ID NO: 185947 - RNA, 64 nt, Homo Sapiens; identical to SEQ ID NO: 41172

SEQ ID NO: 185948 - RNA, 64 nt, Homo Sapiens; identical to SEQ ID NO: 41173

SEQ ID NO: 185949 - RNA, 64 nt, Homo Sapiens; identical to SEQ ID NO: 41174

SEQ ID NO: 185950 - RNA, 64 nt, Homo Sapiens; identical to SEQ ID NO: 41175

SEQ ID NO: 185951 - RNA, 64 nt, Homo Sapiens; identical to SEQ ID NO: 41176

SEQ ID NO: 185952 - RNA, 64 nt, Homo Sapiens; identical to SEQ ID NO: 41177

SEQ ID NO: 185953 - RNA, 64 nt, Homo Sapiens; identical to SEQ ID NO: 41178

SEQ ID NO: 185954 - RNA, 64 nt, Homo Sapiens; identical to SEQ ID NO: 41179

SEQ ID NO: 185955 - RNA, 64 nt, Homo Sapiens; identical to SEQ ID NO: 41180

SEQ ID NO: 185956 - RNA, 64 nt, Homo Sapiens; identical to SEQ ID NO: 41181

SEQ ID NO: 185957 - RNA, 64 nt, Homo Sapiens; identical to SEQ ID NO: 41182

SEQ ID NO: 185958 - RNA, 64 nt, Homo Sapiens; identical to SEQ ID NO: 41183

SEQ ID NO: 185959 - RNA, 64 nt, Homo Sapiens; identical to SEQ ID NO: 41184

SEQ ID NO: 185960 - RNA, 64 nt, Homo Sapiens; identical to SEQ ID NO: 41185

SEQ ID NO: 185961 - RNA, 64 nt, Homo Sapiens; identical to SEQ ID NO: 41186

SEQ ID NO: 185962 - RNA, 64 nt, Homo Sapiens; identical to SEQ ID NO: 41187

SEQ ID NO: 185963 - RNA, 64 nt, Homo Sapiens; identical to SEQ ID NO: 41188

SEQ ID NO: 185964 - RNA, 64 nt, Homo Sapiens; identical to SEQ ID NO: 41189

SEQ ID NO: 185965 - RNA, 64 nt, Homo Sapiens; identical to SEQ ID NO: 41190

SEQ ID NO: 185966 - RNA, 64 nt, Homo Sapiens; identical to SEQ ID NO: 41191

SEQ ID NO: 185967 - RNA, 64 nt, Homo Sapiens; identical to SEQ ID NO: 41192

SEQ ID NO: 185968 - RNA, 64 nt, Homo Sapiens; identical to SEQ ID NO: 41193

SEQ ID NO: 185969 - RNA, 64 nt, Homo Sapiens; identical to SEQ ID NO: 41194

SEQ ID NO: 185970 - RNA, 64 nt, Homo Sapiens; identical to SEQ ID NO: 41195

SEQ ID NO: 185971 - RNA, 64 nt, Homo Sapiens; identical to SEQ ID NO: 41196

SEQ ID NO: 185972 - RNA, 64 nt, Homo Sapiens; identical to SEQ ID NO: 41197

SEQ ID NO: 185973 - RNA, 64 nt, Homo Sapiens; identical to SEQ ID NO: 41198

SEQ ID NO: 185974 - RNA, 64 nt, Homo Sapiens; identical to SEQ ID NO: 41199

SEQ ID NO: 185975 - RNA, 64 nt, Homo Sapiens; identical to SEQ ID NO: 41200

SEQ ID NO: 185976 - RNA, 64 nt, Homo Sapiens; identical to SEQ ID NO: 41201

SEQ ID NO: 185977 - RNA, 64 nt, Homo Sapiens; identical to SEQ ID NO: 41202

SEQ ID NO: 185978 - RNA, 64 nt, Homo Sapiens; identical to SEQ ID NO: 41203

SEQ ID NO: 185979 - RNA, 64 nt, Homo Sapiens; identical to SEQ ID NO: 41204

SEQ ID NO: 185980 - RNA, 64 nt, Homo Sapiens; identical to SEQ ID NO: 41205

SEQ ID NO: 185981 - RNA, 64 nt, Homo Sapiens; identical to SEQ ID NO: 41206

SEQ ID NO: 185982 - RNA, 64 nt, Homo Sapiens; identical to SEQ ID NO: 41207

SEQ ID NO: 185983 - RNA, 64 nt, Homo Sapiens; identical to SEQ ID NO: 41208

SEQ ID NO: 185984 - RNA, 64 nt, Homo Sapiens; identical to SEQ ID NO: 41209

SEQ ID NO: 185985 - RNA, 64 nt, Homo Sapiens; identical to SEQ ID NO: 41210

SEQ ID NO: 185986 - RNA, 64 nt, Homo Sapiens; identical to SEQ ID NO: 41211

SEQ ID NO: 185987 - RNA, 64 nt, Homo Sapiens; identical to SEQ ID NO: 41212

SEQ ID NO: 185988 - RNA, 64 nt, Homo Sapiens; identical to SEQ ID NO: 41213

SEQ ID NO: 185989 - RNA, 64 nt, Homo Sapiens; identical to SEQ ID NO: 41214

SEQ ID NO: 185990 - RNA, 64 nt, Homo Sapiens; identical to SEQ ID NO: 41215

SEQ ID NO: 185991 - RNA, 64 nt, Homo Sapiens; identical to SEQ ID NO: 41216

SEQ ID NO: 185992 - RNA, 64 nt, Homo Sapiens; identical to SEQ ID NO: 41217

SEQ ID NO: 185993 - RNA, 64 nt, Homo Sapiens; identical to SEQ ID NO: 41218

SEQ ID NO: 185994 - RNA, 64 nt, Homo Sapiens; identical to SEQ ID NO: 41219

SEQ ID NO: 185995 - RNA, 64 nt, Homo Sapiens; identical to SEQ ID NO: 41220

SEQ ID NO: 185996 - RNA, 64 nt, Homo Sapiens; identical to SEQ ID NO: 41221

SEQ ID NO: 185997 - RNA, 64 nt, Homo Sapiens; identical to SEQ ID NO: 41222

SEQ ID NO: 185998 - RNA, 64 nt, Homo Sapiens; identical to SEQ ID NO: 41223

SEQ ID NO: 185999 - RNA, 64 nt, Homo Sapiens; identical to SEQ ID NO: 41224

SEQ ID NO: 186000 - RNA, 64 nt, Homo Sapiens; identical to SEQ ID NO: 41225

SEQ ID NO: 186001 - RNA, 64 nt, Homo Sapiens; identical to SEQ ID NO: 41226

SEQ ID NO: 186002 - RNA, 64 nt, Homo Sapiens; identical to SEQ ID NO: 41227

SEQ ID NO: 186003 - RNA, 64 nt, Homo Sapiens; identical to SEQ ID NO: 41228

SEQ ID NO: 186004 - RNA, 64 nt, Homo Sapiens; identical to SEQ ID NO: 41229

SEQ ID NO: 186005 - RNA, 64 nt, Homo Sapiens; identical to SEQ ID NO: 41230

SEQ ID NO: 186006 - RNA, 64 nt, Homo Sapiens; identical to SEQ ID NO: 41231

SEQ ID NO: 186007 - RNA, 64 nt, Homo Sapiens; identical to SEQ ID NO: 41232

SEQ ID NO: 186008 - RNA, 64 nt, Homo Sapiens; identical to SEQ ID NO: 41233

SEQ ID NO: 186009 - RNA, 64 nt, Homo Sapiens; identical to SEQ ID NO: 41234

SEQ ID NO: 186010 - RNA, 64 nt, Homo Sapiens; identical to SEQ ID NO: 41235

SEQ ID NO: 186011 - RNA, 62 nt, Homo Sapiens; identical to SEQ ID NO: 41236

SEQ ID NO: 186012 - RNA, 60 nt, Homo Sapiens; identical to SEQ ID NO: 41237

SEQ ID NO: 186013 - RNA, 58 nt, Homo Sapiens; identical to SEQ ID NO: 41238

SEQ ID NO: 186014 - RNA, 56 nt, Homo Sapiens; identical to SEQ ID NO: 41239

SEQ ID NO: 186015 - RNA, 54 nt, Homo Sapiens; identical to SEQ ID NO: 41240

SEQ ID NO: 186016 - RNA, 64 nt, Homo Sapiens; identical to SEQ ID NO: 41241

SEQ ID NO: 186017 - RNA, 64 nt, Homo Sapiens; identical to SEQ ID NO: 41242

SEQ ID NO: 186018 - RNA, 64 nt, Homo Sapiens; identical to SEQ ID NO: 41243

SEQ ID NO: 186019 - RNA, 64 nt, Homo Sapiens; identical to SEQ ID NO: 41244

SEQ ID NO: 186020 - RNA, 64 nt, Homo Sapiens; identical to SEQ ID NO: 41245

SEQ ID NO: 186021 - RNA, 64 nt, Homo Sapiens; identical to SEQ ID NO: 41246

SEQ ID NO: 186022 - RNA, 64 nt, Homo Sapiens; identical to SEQ ID NO: 41247

SEQ ID NO: 186023 - RNA, 64 nt, Homo Sapiens; identical to SEQ ID NO: 41248

SEQ ID NO: 186024 - RNA, 64 nt, Homo Sapiens; identical to SEQ ID NO: 41249

SEQ ID NO: 186025 - RNA, 64 nt, Homo Sapiens; identical to SEQ ID NO: 41250

SEQ ID NO: 186026 - RNA, 64 nt, Homo Sapiens; identical to SEQ ID NO: 41251

SEQ ID NO: 186027 - RNA, 64 nt, Homo Sapiens; identical to SEQ ID NO: 41252

SEQ ID NO: 186028 - RNA, 64 nt, Homo Sapiens; identical to SEQ ID NO: 41253

SEQ ID NO: 186029 - RNA, 64 nt, Homo Sapiens; identical to SEQ ID NO: 41254

SEQ ID NO: 186030 - RNA, 64 nt, Homo Sapiens; identical to SEQ ID NO: 41255

SEQ ID NO: 186031 - RNA, 64 nt, Homo Sapiens; identical to SEQ ID NO: 41256

SEQ ID NO: 186032 - RNA, 64 nt, Homo Sapiens; identical to SEQ ID NO: 41257

SEQ ID NO: 186033 - RNA, 64 nt, Homo Sapiens; identical to SEQ ID NO: 41258

SEQ ID NO: 186034 - RNA, 64 nt, Homo Sapiens; identical to SEQ ID NO: 41259

SEQ ID NO: 186035 - RNA, 64 nt, Homo Sapiens; identical to SEQ ID NO: 41260

SEQ ID NO: 186036 - RNA, 64 nt, Homo Sapiens; identical to SEQ ID NO: 41261

SEQ ID NO: 186037 - RNA, 64 nt, Homo Sapiens; identical to SEQ ID NO: 41262

SEQ ID NO: 186038 - RNA, 64 nt, Homo Sapiens; identical to SEQ ID NO: 41263

SEQ ID NO: 186039 - RNA, 64 nt, Homo Sapiens; identical to SEQ ID NO: 41264

SEQ ID NO: 186040 - RNA, 64 nt, Homo Sapiens; identical to SEQ ID NO: 41265

SEQ ID NO: 186041 - RNA, 64 nt, Homo Sapiens; identical to SEQ ID NO: 41266

SEQ ID NO: 186042 - RNA, 64 nt, Homo Sapiens; identical to SEQ ID NO: 41267

SEQ ID NO: 186043 - RNA, 64 nt, Homo Sapiens; identical to SEQ ID NO: 41268

SEQ ID NO: 186044 - RNA, 64 nt, Homo Sapiens; identical to SEQ ID NO: 41269

SEQ ID NO: 186045 - RNA, 64 nt, Homo Sapiens; identical to SEQ ID NO: 41270

SEQ ID NO: 186046 - RNA, 64 nt, Homo Sapiens; identical to SEQ ID NO: 41271

SEQ ID NO: 186047 - RNA, 64 nt, Homo Sapiens; identical to SEQ ID NO: 41272

SEQ ID NO: 186048 - RNA, 64 nt, Homo Sapiens; identical to SEQ ID NO: 41273

SEQ ID NO: 186049 - RNA, 64 nt, Homo Sapiens; identical to SEQ ID NO: 41274

SEQ ID NO: 186050 - RNA, 64 nt, Homo Sapiens; identical to SEQ ID NO: 41275

SEQ ID NO: 186051 - RNA, 64 nt, Homo Sapiens; identical to SEQ ID NO: 41276

SEQ ID NO: 186052 - RNA, 64 nt, Homo Sapiens; identical to SEQ ID NO: 41277

SEQ ID NO: 186053 - RNA, 64 nt, Homo Sapiens; identical to SEQ ID NO: 41278

SEQ ID NO: 186054 - RNA, 64 nt, Homo Sapiens; identical to SEQ ID NO: 41279

SEQ ID NO: 186055 - RNA, 64 nt, Homo Sapiens; identical to SEQ ID NO: 41280

SEQ ID NO: 186056 - RNA, 64 nt, Homo Sapiens; identical to SEQ ID NO: 41281

SEQ ID NO: 186057 - RNA, 64 nt, Homo Sapiens; identical to SEQ ID NO: 41282

SEQ ID NO: 186058 - RNA, 64 nt, Homo Sapiens; identical to SEQ ID NO: 41283

SEQ ID NO: 186059 - RNA, 64 nt, Homo Sapiens; identical to SEQ ID NO: 41284

SEQ ID NO: 186060 - RNA, 64 nt, Homo Sapiens; identical to SEQ ID NO: 41285

SEQ ID NO: 186061 - RNA, 64 nt, Homo Sapiens; identical to SEQ ID NO: 41286

SEQ ID NO: 186062 - RNA, 64 nt, Homo Sapiens; identical to SEQ ID NO: 41287

SEQ ID NO: 186063 - RNA, 64 nt, Homo Sapiens; identical to SEQ ID NO: 41288

SEQ ID NO: 186064 - RNA, 64 nt, Homo Sapiens; identical to SEQ ID NO: 41289

SEQ ID NO: 186065 - RNA, 64 nt, Homo Sapiens; identical to SEQ ID NO: 41290

SEQ ID NO: 186066 - RNA, 64 nt, Homo Sapiens; identical to SEQ ID NO: 41291

SEQ ID NO: 186067 - RNA, 64 nt, Homo Sapiens; identical to SEQ ID NO: 41292

SEQ ID NO: 186068 - RNA, 64 nt, Homo Sapiens; identical to SEQ ID NO: 41293

SEQ ID NO: 186069 - RNA, 64 nt, Homo Sapiens; identical to SEQ ID NO: 41294

SEQ ID NO: 186070 - RNA, 64 nt, Homo Sapiens; identical to SEQ ID NO: 41295

SEQ ID NO: 186071 - RNA, 64 nt, Homo Sapiens; identical to SEQ ID NO: 41296

SEQ ID NO: 186072 - RNA, 64 nt, Homo Sapiens; identical to SEQ ID NO: 41297

SEQ ID NO: 186073 - RNA, 64 nt, Homo Sapiens; identical to SEQ ID NO: 41298

SEQ ID NO: 186074 - RNA, 64 nt, Homo Sapiens; identical to SEQ ID NO: 41299

SEQ ID NO: 186075 - RNA, 64 nt, Homo Sapiens; identical to SEQ ID NO: 41300

SEQ ID NO: 186076 - RNA, 64 nt, Homo Sapiens; identical to SEQ ID NO: 41301

SEQ ID NO: 186077 - RNA, 64 nt, Homo Sapiens; identical to SEQ ID NO: 41302

SEQ ID NO: 186078 - RNA, 64 nt, Homo Sapiens; identical to SEQ ID NO: 41303

SEQ ID NO: 186079 - RNA, 64 nt, Homo Sapiens; identical to SEQ ID NO: 41304

SEQ ID NO: 186080 - RNA, 64 nt, Homo Sapiens; identical to SEQ ID NO: 41305

SEQ ID NO: 186081 - RNA, 64 nt, Homo Sapiens; identical to SEQ ID NO: 41306

SEQ ID NO: 186082 - RNA, 64 nt, Homo Sapiens; identical to SEQ ID NO: 41307

SEQ ID NO: 186083 - RNA, 64 nt, Homo Sapiens; identical to SEQ ID NO: 41308

SEQ ID NO: 186084 - RNA, 64 nt, Homo Sapiens; identical to SEQ ID NO: 41309

SEQ ID NO: 186085 - RNA, 64 nt, Homo Sapiens; identical to SEQ ID NO: 41310

SEQ ID NO: 186086 - RNA, 64 nt, Homo Sapiens; identical to SEQ ID NO: 41311

SEQ ID NO: 186087 - RNA, 64 nt, Homo Sapiens; identical to SEQ ID NO: 41312

SEQ ID NO: 186088 - RNA, 64 nt, Homo Sapiens; identical to SEQ ID NO: 41313

SEQ ID NO: 186089 - RNA, 64 nt, Homo Sapiens; identical to SEQ ID NO: 41314

SEQ ID NO: 186090 - RNA, 64 nt, Homo Sapiens; identical to SEQ ID NO: 41315

SEQ ID NO: 186091 - RNA, 64 nt, Homo Sapiens; identical to SEQ ID NO: 41316

SEQ ID NO: 186092 - RNA, 64 nt, Homo Sapiens; identical to SEQ ID NO: 41317

SEQ ID NO: 186093 - RNA, 64 nt, Homo Sapiens; identical to SEQ ID NO: 41318

SEQ ID NO: 186094 - RNA, 64 nt, Homo Sapiens; identical to SEQ ID NO: 41319

SEQ ID NO: 186095 - RNA, 64 nt, Homo Sapiens; identical to SEQ ID NO: 41320

SEQ ID NO: 186096 - RNA, 64 nt, Homo Sapiens; identical to SEQ ID NO: 41321

SEQ ID NO: 186097 - RNA, 64 nt, Homo Sapiens; identical to SEQ ID NO: 41322

SEQ ID NO: 186098 - RNA, 64 nt, Homo Sapiens; identical to SEQ ID NO: 41323

SEQ ID NO: 186099 - RNA, 64 nt, Homo Sapiens; identical to SEQ ID NO: 41324

SEQ ID NO: 186100 - RNA, 64 nt, Homo Sapiens; identical to SEQ ID NO: 41325

SEQ ID NO: 186101 - RNA, 64 nt, Homo Sapiens; identical to SEQ ID NO: 41326

SEQ ID NO: 186102 - RNA, 64 nt, Homo Sapiens; identical to SEQ ID NO: 41327

SEQ ID NO: 186103 - RNA, 64 nt, Homo Sapiens; identical to SEQ ID NO: 41328

SEQ ID NO: 186104 - RNA, 64 nt, Homo Sapiens; identical to SEQ ID NO: 41329

SEQ ID NO: 186105 - RNA, 64 nt, Homo Sapiens; identical to SEQ ID NO: 41330

SEQ ID NO: 186106 - RNA, 64 nt, Homo Sapiens; identical to SEQ ID NO: 41331

SEQ ID NO: 186107 - RNA, 64 nt, Homo Sapiens; identical to SEQ ID NO: 41332

SEQ ID NO: 186108 - RNA, 64 nt, Homo Sapiens; identical to SEQ ID NO: 41333

SEQ ID NO: 186109 - RNA, 64 nt, Homo Sapiens; identical to SEQ ID NO: 41334

SEQ ID NO: 186110 - RNA, 64 nt, Homo Sapiens; identical to SEQ ID NO: 41335

SEQ ID NO: 186111 - RNA, 64 nt, Homo Sapiens; identical to SEQ ID NO: 41336

SEQ ID NO: 186112 - RNA, 64 nt, Homo Sapiens; identical to SEQ ID NO: 41337

SEQ ID NO: 186113 - RNA, 64 nt, Homo Sapiens; identical to SEQ ID NO: 41338

SEQ ID NO: 186114 - RNA, 64 nt, Homo Sapiens; identical to SEQ ID NO: 41339

SEQ ID NO: 186115 - RNA, 64 nt, Homo Sapiens; identical to SEQ ID NO: 41340

SEQ ID NO: 186116 - RNA, 64 nt, Homo Sapiens; identical to SEQ ID NO: 41341

SEQ ID NO: 186117 - RNA, 64 nt, Homo Sapiens; identical to SEQ ID NO: 41342

SEQ ID NO: 186118 - RNA, 64 nt, Homo Sapiens; identical to SEQ ID NO: 41343

SEQ ID NO: 186119 - RNA, 64 nt, Homo Sapiens; identical to SEQ ID NO: 41344

SEQ ID NO: 186120 - RNA, 64 nt, Homo Sapiens; identical to SEQ ID NO: 41345

SEQ ID NO: 186121 - RNA, 64 nt, Homo Sapiens; identical to SEQ ID NO: 41346

SEQ ID NO: 186122 - RNA, 64 nt, Homo Sapiens; identical to SEQ ID NO: 41347

SEQ ID NO: 186123 - RNA, 64 nt, Homo Sapiens; identical to SEQ ID NO: 41348

SEQ ID NO: 186124 - RNA, 64 nt, Homo Sapiens; identical to SEQ ID NO: 41349

SEQ ID NO: 186125 - RNA, 64 nt, Homo Sapiens; identical to SEQ ID NO: 41350

SEQ ID NO: 186126 - RNA, 64 nt, Homo Sapiens; identical to SEQ ID NO: 41351

SEQ ID NO: 186127 - RNA, 64 nt, Homo Sapiens; identical to SEQ ID NO: 41352

SEQ ID NO: 186128 - RNA, 64 nt, Homo Sapiens; identical to SEQ ID NO: 41353

SEQ ID NO: 186129 - RNA, 64 nt, Homo Sapiens; identical to SEQ ID NO: 41354

SEQ ID NO: 186130 - RNA, 64 nt, Homo Sapiens; identical to SEQ ID NO: 41355

SEQ ID NO: 186131 - RNA, 64 nt, Homo Sapiens; identical to SEQ ID NO: 41356

SEQ ID NO: 186132 - RNA, 64 nt, Homo Sapiens; identical to SEQ ID NO: 41357

SEQ ID NO: 186133 - RNA, 64 nt, Homo Sapiens; identical to SEQ ID NO: 41358

SEQ ID NO: 186134 - RNA, 64 nt, Homo Sapiens; identical to SEQ ID NO: 41359

SEQ ID NO: 186135 - RNA, 64 nt, Homo Sapiens; identical to SEQ ID NO: 41360

SEQ ID NO: 186136 - RNA, 64 nt, Homo Sapiens; identical to SEQ ID NO: 41361

SEQ ID NO: 186137 - RNA, 64 nt, Homo Sapiens; identical to SEQ ID NO: 41362

SEQ ID NO: 186138 - RNA, 64 nt, Homo Sapiens; identical to SEQ ID NO: 41363

SEQ ID NO: 186139 - RNA, 64 nt, Homo Sapiens; identical to SEQ ID NO: 41364

SEQ ID NO: 186140 - RNA, 64 nt, Homo Sapiens; identical to SEQ ID NO: 41365

SEQ ID NO: 186141 - RNA, 64 nt, Homo Sapiens; identical to SEQ ID NO: 41366

SEQ ID NO: 186142 - RNA, 64 nt, Homo Sapiens; identical to SEQ ID NO: 41367

SEQ ID NO: 186143 - RNA, 64 nt, Homo Sapiens; identical to SEQ ID NO: 41368

SEQ ID NO: 186144 - RNA, 64 nt, Homo Sapiens; identical to SEQ ID NO: 41369

SEQ ID NO: 186145 - RNA, 64 nt, Homo Sapiens; identical to SEQ ID NO: 41370

SEQ ID NO: 186146 - RNA, 64 nt, Homo Sapiens; identical to SEQ ID NO: 41371

SEQ ID NO: 186147 - RNA, 64 nt, Homo Sapiens; identical to SEQ ID NO: 41372

SEQ ID NO: 186148 - RNA, 64 nt, Homo Sapiens; identical to SEQ ID NO: 41373

SEQ ID NO: 186149 - RNA, 64 nt, Homo Sapiens; identical to SEQ ID NO: 41374

SEQ ID NO: 186150 - RNA, 64 nt, Homo Sapiens; identical to SEQ ID NO: 41375

SEQ ID NO: 186151 - RNA, 64 nt, Homo Sapiens; identical to SEQ ID NO: 41376

SEQ ID NO: 186152 - RNA, 64 nt, Homo Sapiens; identical to SEQ ID NO: 41377

SEQ ID NO: 186153 - RNA, 64 nt, Homo Sapiens; identical to SEQ ID NO: 41378

SEQ ID NO: 186154 - RNA, 64 nt, Homo Sapiens; identical to SEQ ID NO: 41379

SEQ ID NO: 186155 - RNA, 64 nt, Homo Sapiens; identical to SEQ ID NO: 41380

SEQ ID NO: 186156 - RNA, 64 nt, Homo Sapiens; identical to SEQ ID NO: 41381

SEQ ID NO: 186157 - RNA, 64 nt, Homo Sapiens; identical to SEQ ID NO: 41382

SEQ ID NO: 186158 - RNA, 64 nt, Homo Sapiens; identical to SEQ ID NO: 41383

SEQ ID NO: 186159 - RNA, 64 nt, Homo Sapiens; identical to SEQ ID NO: 41384

SEQ ID NO: 186160 - RNA, 64 nt, Homo Sapiens; identical to SEQ ID NO: 41385

SEQ ID NO: 186161 - RNA, 64 nt, Homo Sapiens; identical to SEQ ID NO: 41386

SEQ ID NO: 186162 - RNA, 64 nt, Homo Sapiens; identical to SEQ ID NO: 41387

SEQ ID NO: 186163 - RNA, 64 nt, Homo Sapiens; identical to SEQ ID NO: 41388

SEQ ID NO: 186164 - RNA, 64 nt, Homo Sapiens; identical to SEQ ID NO: 41389

SEQ ID NO: 186165 - RNA, 64 nt, Homo Sapiens; identical to SEQ ID NO: 41390

SEQ ID NO: 186166 - RNA, 64 nt, Homo Sapiens; identical to SEQ ID NO: 41391

SEQ ID NO: 186167 - RNA, 64 nt, Homo Sapiens; identical to SEQ ID NO: 41392

SEQ ID NO: 186168 - RNA, 64 nt, Homo Sapiens; identical to SEQ ID NO: 41393

SEQ ID NO: 186169 - RNA, 64 nt, Homo Sapiens; identical to SEQ ID NO: 41394

SEQ ID NO: 186170 - RNA, 64 nt, Homo Sapiens; identical to SEQ ID NO: 41395

SEQ ID NO: 186171 - RNA, 64 nt, Homo Sapiens; identical to SEQ ID NO: 41396

SEQ ID NO: 186172 - RNA, 64 nt, Homo Sapiens; identical to SEQ ID NO: 41397

SEQ ID NO: 186173 - RNA, 64 nt, Homo Sapiens; identical to SEQ ID NO: 41398

SEQ ID NO: 186174 - RNA, 64 nt, Homo Sapiens; identical to SEQ ID NO: 41399

SEQ ID NO: 186175 - RNA, 64 nt, Homo Sapiens; identical to SEQ ID NO: 41400

SEQ ID NO: 186176 - RNA, 64 nt, Homo Sapiens; identical to SEQ ID NO: 41401

SEQ ID NO: 186177 - RNA, 64 nt, Homo Sapiens; identical to SEQ ID NO: 41402

SEQ ID NO: 186178 - RNA, 64 nt, Homo Sapiens; identical to SEQ ID NO: 41403

SEQ ID NO: 186179 - RNA, 64 nt, Homo Sapiens; identical to SEQ ID NO: 41404

SEQ ID NO: 186180 - RNA, 64 nt, Homo Sapiens; identical to SEQ ID NO: 41405

SEQ ID NO: 186181 - RNA, 64 nt, Homo Sapiens; identical to SEQ ID NO: 41406

SEQ ID NO: 186182 - RNA, 64 nt, Homo Sapiens; identical to SEQ ID NO: 41407

SEQ ID NO: 186183 - RNA, 64 nt, Homo Sapiens; identical to SEQ ID NO: 41408

SEQ ID NO: 186184 - RNA, 64 nt, Homo Sapiens; identical to SEQ ID NO: 41409

SEQ ID NO: 186185 - RNA, 64 nt, Homo Sapiens; identical to SEQ ID NO: 41410

SEQ ID NO: 186186 - RNA, 64 nt, Homo Sapiens; identical to SEQ ID NO: 41411

SEQ ID NO: 186187 - RNA, 64 nt, Homo Sapiens; identical to SEQ ID NO: 41412

SEQ ID NO: 186188 - RNA, 64 nt, Homo Sapiens; identical to SEQ ID NO: 41413

SEQ ID NO: 186189 - RNA, 64 nt, Homo Sapiens; identical to SEQ ID NO: 41414

SEQ ID NO: 186190 - RNA, 64 nt, Homo Sapiens; identical to SEQ ID NO: 41415

SEQ ID NO: 186191 - RNA, 64 nt, Homo Sapiens; identical to SEQ ID NO: 41416

SEQ ID NO: 186192 - RNA, 64 nt, Homo Sapiens; identical to SEQ ID NO: 41417

SEQ ID NO: 186193 - RNA, 64 nt, Homo Sapiens; identical to SEQ ID NO: 41418

SEQ ID NO: 186194 - RNA, 64 nt, Homo Sapiens; identical to SEQ ID NO: 41419

SEQ ID NO: 186195 - RNA, 64 nt, Homo Sapiens; identical to SEQ ID NO: 41420

SEQ ID NO: 186196 - RNA, 64 nt, Homo Sapiens; identical to SEQ ID NO: 41421

SEQ ID NO: 186197 - RNA, 64 nt, Homo Sapiens; identical to SEQ ID NO: 41422

SEQ ID NO: 186198 - RNA, 64 nt, Homo Sapiens; identical to SEQ ID NO: 41423

SEQ ID NO: 186199 - RNA, 64 nt, Homo Sapiens; identical to SEQ ID NO: 41424

SEQ ID NO: 186200 - RNA, 64 nt, Homo Sapiens; identical to SEQ ID NO: 41425

SEQ ID NO: 186201 - RNA, 64 nt, Homo Sapiens; identical to SEQ ID NO: 41426

SEQ ID NO: 186202 - RNA, 64 nt, Homo Sapiens; identical to SEQ ID NO: 41427

SEQ ID NO: 186203 - RNA, 64 nt, Homo Sapiens; identical to SEQ ID NO: 41428

SEQ ID NO: 186204 - RNA, 64 nt, Homo Sapiens; identical to SEQ ID NO: 41429

SEQ ID NO: 186205 - RNA, 64 nt, Homo Sapiens; identical to SEQ ID NO: 41430

SEQ ID NO: 186206 - RNA, 64 nt, Homo Sapiens; identical to SEQ ID NO: 41431

SEQ ID NO: 186207 - RNA, 64 nt, Homo Sapiens; identical to SEQ ID NO: 41432

SEQ ID NO: 186208 - RNA, 64 nt, Homo Sapiens; identical to SEQ ID NO: 41433

SEQ ID NO: 186209 - RNA, 64 nt, Homo Sapiens; identical to SEQ ID NO: 41434

SEQ ID NO: 186210 - RNA, 64 nt, Homo Sapiens; identical to SEQ ID NO: 41435

SEQ ID NO: 186211 - RNA, 64 nt, Homo Sapiens; identical to SEQ ID NO: 41436

SEQ ID NO: 186212 - RNA, 64 nt, Homo Sapiens; identical to SEQ ID NO: 41437

SEQ ID NO: 186213 - RNA, 64 nt, Homo Sapiens; identical to SEQ ID NO: 41438

SEQ ID NO: 186214 - RNA, 64 nt, Homo Sapiens; identical to SEQ ID NO: 41439

SEQ ID NO: 186215 - RNA, 64 nt, Homo Sapiens; identical to SEQ ID NO: 41440

SEQ ID NO: 186216 - RNA, 64 nt, Homo Sapiens; identical to SEQ ID NO: 41441

SEQ ID NO: 186217 - RNA, 64 nt, Homo Sapiens; identical to SEQ ID NO: 41442

SEQ ID NO: 186218 - RNA, 64 nt, Homo Sapiens; identical to SEQ ID NO: 41443

SEQ ID NO: 186219 - RNA, 64 nt, Homo Sapiens; identical to SEQ ID NO: 41444

SEQ ID NO: 186220 - RNA, 64 nt, Homo Sapiens; identical to SEQ ID NO: 41445

SEQ ID NO: 186221 - RNA, 64 nt, Homo Sapiens; identical to SEQ ID NO: 41446

SEQ ID NO: 186222 - RNA, 64 nt, Homo Sapiens; identical to SEQ ID NO: 41447

SEQ ID NO: 186223 - RNA, 64 nt, Homo Sapiens; identical to SEQ ID NO: 41448

SEQ ID NO: 186224 - RNA, 64 nt, Homo Sapiens; identical to SEQ ID NO: 41449

SEQ ID NO: 186225 - RNA, 64 nt, Homo Sapiens; identical to SEQ ID NO: 41450

SEQ ID NO: 186226 - RNA, 64 nt, Homo Sapiens; identical to SEQ ID NO: 41451

SEQ ID NO: 186227 - RNA, 64 nt, Homo Sapiens; identical to SEQ ID NO: 41452

SEQ ID NO: 186228 - RNA, 64 nt, Homo Sapiens; identical to SEQ ID NO: 41453

SEQ ID NO: 186229 - RNA, 64 nt, Homo Sapiens; identical to SEQ ID NO: 41454

SEQ ID NO: 186230 - RNA, 64 nt, Homo Sapiens; identical to SEQ ID NO: 41455

SEQ ID NO: 186231 - RNA, 64 nt, Homo Sapiens; identical to SEQ ID NO: 41456

SEQ ID NO: 186232 - RNA, 64 nt, Homo Sapiens; identical to SEQ ID NO: 41457

SEQ ID NO: 186233 - RNA, 64 nt, Homo Sapiens; identical to SEQ ID NO: 41458

SEQ ID NO: 186234 - RNA, 64 nt, Homo Sapiens; identical to SEQ ID NO: 41459

SEQ ID NO: 186235 - RNA, 64 nt, Homo Sapiens; identical to SEQ ID NO: 41460

SEQ ID NO: 186236 - RNA, 64 nt, Homo Sapiens; identical to SEQ ID NO: 41461

SEQ ID NO: 186237 - RNA, 64 nt, Homo Sapiens; identical to SEQ ID NO: 41462

SEQ ID NO: 186238 - RNA, 64 nt, Homo Sapiens; identical to SEQ ID NO: 41463

SEQ ID NO: 186239 - RNA, 64 nt, Homo Sapiens; identical to SEQ ID NO: 41464

SEQ ID NO: 186240 - RNA, 64 nt, Homo Sapiens; identical to SEQ ID NO: 41465

SEQ ID NO: 186241 - RNA, 64 nt, Homo Sapiens; identical to SEQ ID NO: 41466

SEQ ID NO: 186242 - RNA, 64 nt, Homo Sapiens; identical to SEQ ID NO: 41467

SEQ ID NO: 186243 - RNA, 64 nt, Homo Sapiens; identical to SEQ ID NO: 41468

SEQ ID NO: 186244 - RNA, 64 nt, Homo Sapiens; identical to SEQ ID NO: 41469

SEQ ID NO: 186245 - RNA, 64 nt, Homo Sapiens; identical to SEQ ID NO: 41470

SEQ ID NO: 186246 - RNA, 64 nt, Homo Sapiens; identical to SEQ ID NO: 41471

SEQ ID NO: 186247 - RNA, 64 nt, Homo Sapiens; identical to SEQ ID NO: 41472

SEQ ID NO: 186248 - RNA, 64 nt, Homo Sapiens; identical to SEQ ID NO: 41473

SEQ ID NO: 186249 - RNA, 64 nt, Homo Sapiens; identical to SEQ ID NO: 41474

SEQ ID NO: 186250 - RNA, 64 nt, Homo Sapiens; identical to SEQ ID NO: 41475

SEQ ID NO: 186251 - RNA, 64 nt, Homo Sapiens; identical to SEQ ID NO: 41476

SEQ ID NO: 186252 - RNA, 64 nt, Homo Sapiens; identical to SEQ ID NO: 41477

SEQ ID NO: 186253 - RNA, 64 nt, Homo Sapiens; identical to SEQ ID NO: 41478

SEQ ID NO: 186254 - RNA, 64 nt, Homo Sapiens; identical to SEQ ID NO: 41479

SEQ ID NO: 186255 - RNA, 64 nt, Homo Sapiens; identical to SEQ ID NO: 41480

SEQ ID NO: 186256 - RNA, 64 nt, Homo Sapiens; identical to SEQ ID NO: 41481

SEQ ID NO: 186257 - RNA, 64 nt, Homo Sapiens; identical to SEQ ID NO: 41482

SEQ ID NO: 186258 - RNA, 64 nt, Homo Sapiens; identical to SEQ ID NO: 41483

SEQ ID NO: 186259 - RNA, 64 nt, Homo Sapiens; identical to SEQ ID NO: 41484

SEQ ID NO: 186260 - RNA, 64 nt, Homo Sapiens; identical to SEQ ID NO: 41485

SEQ ID NO: 186261 - RNA, 64 nt, Homo Sapiens; identical to SEQ ID NO: 41486

SEQ ID NO: 186262 - RNA, 64 nt, Homo Sapiens; identical to SEQ ID NO: 41487

SEQ ID NO: 186263 - RNA, 64 nt, Homo Sapiens; identical to SEQ ID NO: 41488

SEQ ID NO: 186264 - RNA, 64 nt, Homo Sapiens; identical to SEQ ID NO: 41489

SEQ ID NO: 186265 - RNA, 64 nt, Homo Sapiens; identical to SEQ ID NO: 41490

SEQ ID NO: 186266 - RNA, 64 nt, Homo Sapiens; identical to SEQ ID NO: 41491

SEQ ID NO: 186267 - RNA, 64 nt, Homo Sapiens; identical to SEQ ID NO: 41492

SEQ ID NO: 186268 - RNA, 64 nt, Homo Sapiens; identical to SEQ ID NO: 41493

SEQ ID NO: 186269 - RNA, 64 nt, Homo Sapiens; identical to SEQ ID NO: 41494

SEQ ID NO: 186270 - RNA, 64 nt, Homo Sapiens; identical to SEQ ID NO: 41495

SEQ ID NO: 186271 - RNA, 64 nt, Homo Sapiens; identical to SEQ ID NO: 41496

SEQ ID NO: 186272 - RNA, 64 nt, Homo Sapiens; identical to SEQ ID NO: 41497

SEQ ID NO: 186273 - RNA, 64 nt, Homo Sapiens; identical to SEQ ID NO: 41498

SEQ ID NO: 186274 - RNA, 64 nt, Homo Sapiens; identical to SEQ ID NO: 41499

SEQ ID NO: 186275 - RNA, 64 nt, Homo Sapiens; identical to SEQ ID NO: 41500

SEQ ID NO: 186276 - RNA, 64 nt, Homo Sapiens; identical to SEQ ID NO: 41501

SEQ ID NO: 186277 - RNA, 64 nt, Homo Sapiens; identical to SEQ ID NO: 41502

SEQ ID NO: 186278 - RNA, 64 nt, Homo Sapiens; identical to SEQ ID NO: 41503

SEQ ID NO: 186279 - RNA, 64 nt, Homo Sapiens; identical to SEQ ID NO: 41504

SEQ ID NO: 186280 - RNA, 64 nt, Homo Sapiens; identical to SEQ ID NO: 41505

SEQ ID NO: 186281 - RNA, 64 nt, Homo Sapiens; identical to SEQ ID NO: 41506

SEQ ID NO: 186282 - RNA, 64 nt, Homo Sapiens; identical to SEQ ID NO: 41507

SEQ ID NO: 186283 - RNA, 64 nt, Homo Sapiens; identical to SEQ ID NO: 41508

SEQ ID NO: 186284 - RNA, 64 nt, Homo Sapiens; identical to SEQ ID NO: 41509

SEQ ID NO: 186285 - RNA, 64 nt, Homo Sapiens; identical to SEQ ID NO: 41510

SEQ ID NO: 186286 - RNA, 64 nt, Homo Sapiens; identical to SEQ ID NO: 41511

SEQ ID NO: 186287 - RNA, 64 nt, Homo Sapiens; identical to SEQ ID NO: 41512

SEQ ID NO: 186288 - RNA, 64 nt, Homo Sapiens; identical to SEQ ID NO: 41513

SEQ ID NO: 186289 - RNA, 64 nt, Homo Sapiens; identical to SEQ ID NO: 41514

SEQ ID NO: 186290 - RNA, 64 nt, Homo Sapiens; identical to SEQ ID NO: 41515

SEQ ID NO: 186291 - RNA, 64 nt, Homo Sapiens; identical to SEQ ID NO: 41516

SEQ ID NO: 186292 - RNA, 64 nt, Homo Sapiens; identical to SEQ ID NO: 41517

SEQ ID NO: 186293 - RNA, 64 nt, Homo Sapiens; identical to SEQ ID NO: 41518

SEQ ID NO: 186294 - RNA, 64 nt, Homo Sapiens; identical to SEQ ID NO: 41519

SEQ ID NO: 186295 - RNA, 64 nt, Homo Sapiens; identical to SEQ ID NO: 41520

SEQ ID NO: 186296 - RNA, 64 nt, Homo Sapiens; identical to SEQ ID NO: 41521

SEQ ID NO: 186297 - RNA, 64 nt, Homo Sapiens; identical to SEQ ID NO: 41522

SEQ ID NO: 186298 - RNA, 64 nt, Homo Sapiens; identical to SEQ ID NO: 41523

SEQ ID NO: 186299 - RNA, 64 nt, Homo Sapiens; identical to SEQ ID NO: 41524

SEQ ID NO: 186300 - RNA, 64 nt, Homo Sapiens; identical to SEQ ID NO: 41525

SEQ ID NO: 186301 - RNA, 64 nt, Homo Sapiens; identical to SEQ ID NO: 41526

SEQ ID NO: 186302 - RNA, 64 nt, Homo Sapiens; identical to SEQ ID NO: 41527

SEQ ID NO: 186303 - RNA, 64 nt, Homo Sapiens; identical to SEQ ID NO: 41528

SEQ ID NO: 186304 - RNA, 64 nt, Homo Sapiens; identical to SEQ ID NO: 41529

SEQ ID NO: 186305 - RNA, 64 nt, Homo Sapiens; identical to SEQ ID NO: 41530

SEQ ID NO: 186306 - RNA, 64 nt, Homo Sapiens; identical to SEQ ID NO: 41531

SEQ ID NO: 186307 - RNA, 64 nt, Homo Sapiens; identical to SEQ ID NO: 41532

SEQ ID NO: 186308 - RNA, 64 nt, Homo Sapiens; identical to SEQ ID NO: 41533

SEQ ID NO: 186309 - RNA, 64 nt, Homo Sapiens; identical to SEQ ID NO: 41534

SEQ ID NO: 186310 - RNA, 64 nt, Homo Sapiens; identical to SEQ ID NO: 41535

SEQ ID NO: 186311 - RNA, 64 nt, Homo Sapiens; identical to SEQ ID NO: 41536

SEQ ID NO: 186312 - RNA, 64 nt, Homo Sapiens; identical to SEQ ID NO: 41537

SEQ ID NO: 186313 - RNA, 64 nt, Homo Sapiens; identical to SEQ ID NO: 41538

SEQ ID NO: 186314 - RNA, 64 nt, Homo Sapiens; identical to SEQ ID NO: 41539

SEQ ID NO: 186315 - RNA, 64 nt, Homo Sapiens; identical to SEQ ID NO: 41540

SEQ ID NO: 186316 - RNA, 64 nt, Homo Sapiens; identical to SEQ ID NO: 41541

SEQ ID NO: 186317 - RNA, 64 nt, Homo Sapiens; identical to SEQ ID NO: 41542

SEQ ID NO: 186318 - RNA, 64 nt, Homo Sapiens; identical to SEQ ID NO: 41543

SEQ ID NO: 186319 - RNA, 64 nt, Homo Sapiens; identical to SEQ ID NO: 41544

SEQ ID NO: 186320 - RNA, 64 nt, Homo Sapiens; identical to SEQ ID NO: 41545

SEQ ID NO: 186321 - RNA, 64 nt, Homo Sapiens; identical to SEQ ID NO: 41546

SEQ ID NO: 186322 - RNA, 64 nt, Homo Sapiens; identical to SEQ ID NO: 41547

SEQ ID NO: 186323 - RNA, 64 nt, Homo Sapiens; identical to SEQ ID NO: 41548

SEQ ID NO: 186324 - RNA, 64 nt, Homo Sapiens; identical to SEQ ID NO: 41549

SEQ ID NO: 186325 - RNA, 64 nt, Homo Sapiens; identical to SEQ ID NO: 41550

SEQ ID NO: 186326 - RNA, 64 nt, Homo Sapiens; identical to SEQ ID NO: 41551

SEQ ID NO: 186327 - RNA, 64 nt, Homo Sapiens; identical to SEQ ID NO: 41552

SEQ ID NO: 186328 - RNA, 64 nt, Homo Sapiens; identical to SEQ ID NO: 41553

SEQ ID NO: 186329 - RNA, 64 nt, Homo Sapiens; identical to SEQ ID NO: 41554

SEQ ID NO: 186330 - RNA, 64 nt, Homo Sapiens; identical to SEQ ID NO: 41555

SEQ ID NO: 186331 - RNA, 64 nt, Homo Sapiens; identical to SEQ ID NO: 41556

SEQ ID NO: 186332 - RNA, 64 nt, Homo Sapiens; identical to SEQ ID NO: 41557

SEQ ID NO: 186333 - RNA, 64 nt, Homo Sapiens; identical to SEQ ID NO: 41558

SEQ ID NO: 186334 - RNA, 64 nt, Homo Sapiens; identical to SEQ ID NO: 41559

SEQ ID NO: 186335 - RNA, 64 nt, Homo Sapiens; identical to SEQ ID NO: 41560

SEQ ID NO: 186336 - RNA, 64 nt, Homo Sapiens; identical to SEQ ID NO: 41561

SEQ ID NO: 186337 - RNA, 64 nt, Homo Sapiens; identical to SEQ ID NO: 41562

SEQ ID NO: 186338 - RNA, 64 nt, Homo Sapiens; identical to SEQ ID NO: 41563

SEQ ID NO: 186339 - RNA, 64 nt, Homo Sapiens; identical to SEQ ID NO: 41564

SEQ ID NO: 186340 - RNA, 64 nt, Homo Sapiens; identical to SEQ ID NO: 41565

SEQ ID NO: 186341 - RNA, 64 nt, Homo Sapiens; identical to SEQ ID NO: 41566

SEQ ID NO: 186342 - RNA, 64 nt, Homo Sapiens; identical to SEQ ID NO: 41567

SEQ ID NO: 186343 - RNA, 64 nt, Homo Sapiens; identical to SEQ ID NO: 41568

SEQ ID NO: 186344 - RNA, 64 nt, Homo Sapiens; identical to SEQ ID NO: 41569

SEQ ID NO: 186345 - RNA, 64 nt, Homo Sapiens; identical to SEQ ID NO: 41570

SEQ ID NO: 186346 - RNA, 64 nt, Homo Sapiens; identical to SEQ ID NO: 41571

SEQ ID NO: 186347 - RNA, 64 nt, Homo Sapiens; identical to SEQ ID NO: 41572

SEQ ID NO: 186348 - RNA, 64 nt, Homo Sapiens; identical to SEQ ID NO: 41573

SEQ ID NO: 186349 - RNA, 64 nt, Homo Sapiens; identical to SEQ ID NO: 41574

SEQ ID NO: 186350 - RNA, 64 nt, Homo Sapiens; identical to SEQ ID NO: 41575

SEQ ID NO: 186351 - RNA, 64 nt, Homo Sapiens; identical to SEQ ID NO: 41576

SEQ ID NO: 186352 - RNA, 64 nt, Homo Sapiens; identical to SEQ ID NO: 41577

SEQ ID NO: 186353 - RNA, 64 nt, Homo Sapiens; identical to SEQ ID NO: 41578

SEQ ID NO: 186354 - RNA, 64 nt, Homo Sapiens; identical to SEQ ID NO: 41579

SEQ ID NO: 186355 - RNA, 64 nt, Homo Sapiens; identical to SEQ ID NO: 41580

SEQ ID NO: 186356 - RNA, 64 nt, Homo Sapiens; identical to SEQ ID NO: 41581

SEQ ID NO: 186357 - RNA, 64 nt, Homo Sapiens; identical to SEQ ID NO: 41582

SEQ ID NO: 186358 - RNA, 64 nt, Homo Sapiens; identical to SEQ ID NO: 41583

SEQ ID NO: 186359 - RNA, 64 nt, Homo Sapiens; identical to SEQ ID NO: 41584

SEQ ID NO: 186360 - RNA, 64 nt, Homo Sapiens; identical to SEQ ID NO: 41585

SEQ ID NO: 186361 - RNA, 64 nt, Homo Sapiens; identical to SEQ ID NO: 41586

SEQ ID NO: 186362 - RNA, 64 nt, Homo Sapiens; identical to SEQ ID NO: 41587

SEQ ID NO: 186363 - RNA, 64 nt, Homo Sapiens; identical to SEQ ID NO: 41588

SEQ ID NO: 186364 - RNA, 64 nt, Homo Sapiens; identical to SEQ ID NO: 41589

SEQ ID NO: 186365 - RNA, 64 nt, Homo Sapiens; identical to SEQ ID NO: 41590

SEQ ID NO: 186366 - RNA, 64 nt, Homo Sapiens; identical to SEQ ID NO: 41591

SEQ ID NO: 186367 - RNA, 64 nt, Homo Sapiens; identical to SEQ ID NO: 41592

SEQ ID NO: 186368 - RNA, 64 nt, Homo Sapiens; identical to SEQ ID NO: 41593

SEQ ID NO: 186369 - RNA, 64 nt, Homo Sapiens; identical to SEQ ID NO: 41594

SEQ ID NO: 186370 - RNA, 64 nt, Homo Sapiens; identical to SEQ ID NO: 41595

SEQ ID NO: 186371 - RNA, 64 nt, Homo Sapiens; identical to SEQ ID NO: 41596

SEQ ID NO: 186372 - RNA, 64 nt, Homo Sapiens; identical to SEQ ID NO: 41597

SEQ ID NO: 186373 - RNA, 64 nt, Homo Sapiens; identical to SEQ ID NO: 41598

SEQ ID NO: 186374 - RNA, 64 nt, Homo Sapiens; identical to SEQ ID NO: 41599

SEQ ID NO: 186375 - RNA, 64 nt, Homo Sapiens; identical to SEQ ID NO: 41600

SEQ ID NO: 186376 - RNA, 64 nt, Homo Sapiens; identical to SEQ ID NO: 41601

SEQ ID NO: 186377 - RNA, 64 nt, Homo Sapiens; identical to SEQ ID NO: 41602

SEQ ID NO: 186378 - RNA, 64 nt, Homo Sapiens; identical to SEQ ID NO: 41603

SEQ ID NO: 186379 - RNA, 64 nt, Homo Sapiens; identical to SEQ ID NO: 41604

SEQ ID NO: 186380 - RNA, 64 nt, Homo Sapiens; identical to SEQ ID NO: 41605

SEQ ID NO: 186381 - RNA, 64 nt, Homo Sapiens; identical to SEQ ID NO: 41606

SEQ ID NO: 186382 - RNA, 64 nt, Homo Sapiens; identical to SEQ ID NO: 41607

SEQ ID NO: 186383 - RNA, 64 nt, Homo Sapiens; identical to SEQ ID NO: 41608

SEQ ID NO: 186384 - RNA, 64 nt, Homo Sapiens; identical to SEQ ID NO: 41609

SEQ ID NO: 186385 - RNA, 64 nt, Homo Sapiens; identical to SEQ ID NO: 41610

SEQ ID NO: 186386 - RNA, 64 nt, Homo Sapiens; identical to SEQ ID NO: 41611

SEQ ID NO: 186387 - RNA, 64 nt, Homo Sapiens; identical to SEQ ID NO: 41612

SEQ ID NO: 186388 - RNA, 64 nt, Homo Sapiens; identical to SEQ ID NO: 41613

SEQ ID NO: 186389 - RNA, 64 nt, Homo Sapiens; identical to SEQ ID NO: 41614

SEQ ID NO: 186390 - RNA, 64 nt, Homo Sapiens; identical to SEQ ID NO: 41615

SEQ ID NO: 186391 - RNA, 64 nt, Homo Sapiens; identical to SEQ ID NO: 41616

SEQ ID NO: 186392 - RNA, 64 nt, Homo Sapiens; identical to SEQ ID NO: 41617

SEQ ID NO: 186393 - RNA, 64 nt, Homo Sapiens; identical to SEQ ID NO: 41618

SEQ ID NO: 186394 - RNA, 64 nt, Homo Sapiens; identical to SEQ ID NO: 41619

SEQ ID NO: 186395 - RNA, 64 nt, Homo Sapiens; identical to SEQ ID NO: 41620

SEQ ID NO: 186396 - RNA, 64 nt, Homo Sapiens; identical to SEQ ID NO: 41621

SEQ ID NO: 186397 - RNA, 63 nt, Homo Sapiens; identical to SEQ ID NO: 41622

SEQ ID NO: 186398 - RNA, 64 nt, Homo Sapiens; identical to SEQ ID NO: 41623

SEQ ID NO: 186399 - RNA, 64 nt, Homo Sapiens; identical to SEQ ID NO: 41624

SEQ ID NO: 186400 - RNA, 64 nt, Homo Sapiens; identical to SEQ ID NO: 41625

SEQ ID NO: 186401 - RNA, 64 nt, Homo Sapiens; identical to SEQ ID NO: 41626

SEQ ID NO: 186402 - RNA, 64 nt, Homo Sapiens; identical to SEQ ID NO: 41627

SEQ ID NO: 186403 - RNA, 64 nt, Homo Sapiens; identical to SEQ ID NO: 41628

SEQ ID NO: 186404 - RNA, 64 nt, Homo Sapiens; identical to SEQ ID NO: 41629

SEQ ID NO: 186405 - RNA, 64 nt, Homo Sapiens; identical to SEQ ID NO: 41630

SEQ ID NO: 186406 - RNA, 64 nt, Homo Sapiens; identical to SEQ ID NO: 41631

SEQ ID NO: 186407 - RNA, 64 nt, Homo Sapiens; identical to SEQ ID NO: 41632

SEQ ID NO: 186408 - RNA, 64 nt, Homo Sapiens; identical to SEQ ID NO: 41633

SEQ ID NO: 186409 - RNA, 64 nt, Homo Sapiens; identical to SEQ ID NO: 41634

SEQ ID NO: 186410 - RNA, 64 nt, Homo Sapiens; identical to SEQ ID NO: 41635

SEQ ID NO: 186411 - RNA, 64 nt, Homo Sapiens; identical to SEQ ID NO: 41636

SEQ ID NO: 186412 - RNA, 64 nt, Homo Sapiens; identical to SEQ ID NO: 41637

SEQ ID NO: 186413 - RNA, 64 nt, Homo Sapiens; identical to SEQ ID NO: 41638

SEQ ID NO: 186414 - RNA, 64 nt, Homo Sapiens; identical to SEQ ID NO: 41639

SEQ ID NO: 186415 - RNA, 64 nt, Homo Sapiens; identical to SEQ ID NO: 41640

SEQ ID NO: 186416 - RNA, 64 nt, Homo Sapiens; identical to SEQ ID NO: 41641

SEQ ID NO: 186417 - RNA, 64 nt, Homo Sapiens; identical to SEQ ID NO: 41642

SEQ ID NO: 186418 - RNA, 64 nt, Homo Sapiens; identical to SEQ ID NO: 41643

SEQ ID NO: 186419 - RNA, 64 nt, Homo Sapiens; identical to SEQ ID NO: 41644

SEQ ID NO: 186420 - RNA, 64 nt, Homo Sapiens; identical to SEQ ID NO: 41645

SEQ ID NO: 186421 - RNA, 64 nt, Homo Sapiens; identical to SEQ ID NO: 41646

SEQ ID NO: 186422 - RNA, 64 nt, Homo Sapiens; identical to SEQ ID NO: 41647

SEQ ID NO: 186423 - RNA, 64 nt, Homo Sapiens; identical to SEQ ID NO: 41648

SEQ ID NO: 186424 - RNA, 64 nt, Homo Sapiens; identical to SEQ ID NO: 41649

SEQ ID NO: 186425 - RNA, 64 nt, Homo Sapiens; identical to SEQ ID NO: 41650

SEQ ID NO: 186426 - RNA, 64 nt, Homo Sapiens; identical to SEQ ID NO: 41651

SEQ ID NO: 186427 - RNA, 64 nt, Homo Sapiens; identical to SEQ ID NO: 41652

SEQ ID NO: 186428 - RNA, 64 nt, Homo Sapiens; identical to SEQ ID NO: 41653

SEQ ID NO: 186429 - RNA, 64 nt, Homo Sapiens; identical to SEQ ID NO: 41654

SEQ ID NO: 186430 - RNA, 64 nt, Homo Sapiens; identical to SEQ ID NO: 41655

SEQ ID NO: 186431 - RNA, 64 nt, Homo Sapiens; identical to SEQ ID NO: 41656

SEQ ID NO: 186432 - RNA, 64 nt, Homo Sapiens; identical to SEQ ID NO: 41657

SEQ ID NO: 186433 - RNA, 64 nt, Homo Sapiens; identical to SEQ ID NO: 41658

SEQ ID NO: 186434 - RNA, 64 nt, Homo Sapiens; identical to SEQ ID NO: 41659

SEQ ID NO: 186435 - RNA, 64 nt, Homo Sapiens; identical to SEQ ID NO: 41660

SEQ ID NO: 186436 - RNA, 64 nt, Homo Sapiens; identical to SEQ ID NO: 41661

SEQ ID NO: 186437 - RNA, 64 nt, Homo Sapiens; identical to SEQ ID NO: 41662

SEQ ID NO: 186438 - RNA, 64 nt, Homo Sapiens; identical to SEQ ID NO: 41663

SEQ ID NO: 186439 - RNA, 64 nt, Homo Sapiens; identical to SEQ ID NO: 41664

SEQ ID NO: 186440 - RNA, 64 nt, Homo Sapiens; identical to SEQ ID NO: 41665

SEQ ID NO: 186441 - RNA, 64 nt, Homo Sapiens; identical to SEQ ID NO: 41666

SEQ ID NO: 186442 - RNA, 64 nt, Homo Sapiens; identical to SEQ ID NO: 41667

SEQ ID NO: 186443 - RNA, 64 nt, Homo Sapiens; identical to SEQ ID NO: 41668

SEQ ID NO: 186444 - RNA, 64 nt, Homo Sapiens; identical to SEQ ID NO: 41669

SEQ ID NO: 186445 - RNA, 64 nt, Homo Sapiens; identical to SEQ ID NO: 41670

SEQ ID NO: 186446 - RNA, 64 nt, Homo Sapiens; identical to SEQ ID NO: 41671

SEQ ID NO: 186447 - RNA, 64 nt, Homo Sapiens; identical to SEQ ID NO: 41672

SEQ ID NO: 186448 - RNA, 64 nt, Homo Sapiens; identical to SEQ ID NO: 41673

SEQ ID NO: 186449 - RNA, 64 nt, Homo Sapiens; identical to SEQ ID NO: 41674

SEQ ID NO: 186450 - RNA, 64 nt, Homo Sapiens; identical to SEQ ID NO: 41675

SEQ ID NO: 186451 - RNA, 64 nt, Homo Sapiens; identical to SEQ ID NO: 41676

SEQ ID NO: 186452 - RNA, 64 nt, Homo Sapiens; identical to SEQ ID NO: 41677

SEQ ID NO: 186453 - RNA, 64 nt, Homo Sapiens; identical to SEQ ID NO: 41678

SEQ ID NO: 186454 - RNA, 64 nt, Homo Sapiens; identical to SEQ ID NO: 41679

SEQ ID NO: 186455 - RNA, 64 nt, Homo Sapiens; identical to SEQ ID NO: 41680

SEQ ID NO: 186456 - RNA, 64 nt, Homo Sapiens; identical to SEQ ID NO: 41681

SEQ ID NO: 186457 - RNA, 64 nt, Homo Sapiens; identical to SEQ ID NO: 41682

SEQ ID NO: 186458 - RNA, 64 nt, Homo Sapiens; identical to SEQ ID NO: 41683

SEQ ID NO: 186459 - RNA, 64 nt, Homo Sapiens; identical to SEQ ID NO: 41684

SEQ ID NO: 186460 - RNA, 64 nt, Homo Sapiens; identical to SEQ ID NO: 41685

SEQ ID NO: 186461 - RNA, 64 nt, Homo Sapiens; identical to SEQ ID NO: 41686

SEQ ID NO: 186462 - RNA, 64 nt, Homo Sapiens; identical to SEQ ID NO: 41687

SEQ ID NO: 186463 - RNA, 64 nt, Homo Sapiens; identical to SEQ ID NO: 41688

SEQ ID NO: 186464 - RNA, 64 nt, Homo Sapiens; identical to SEQ ID NO: 41689

SEQ ID NO: 186465 - RNA, 64 nt, Homo Sapiens; identical to SEQ ID NO: 41690

SEQ ID NO: 186466 - RNA, 64 nt, Homo Sapiens; identical to SEQ ID NO: 41691

SEQ ID NO: 186467 - RNA, 64 nt, Homo Sapiens; identical to SEQ ID NO: 41692

SEQ ID NO: 186468 - RNA, 64 nt, Homo Sapiens; identical to SEQ ID NO: 41693

SEQ ID NO: 186469 - RNA, 64 nt, Homo Sapiens; identical to SEQ ID NO: 41694

SEQ ID NO: 186470 - RNA, 64 nt, Homo Sapiens; identical to SEQ ID NO: 41695

SEQ ID NO: 186471 - RNA, 64 nt, Homo Sapiens; identical to SEQ ID NO: 41696

SEQ ID NO: 186472 - RNA, 64 nt, Homo Sapiens; identical to SEQ ID NO: 41697

SEQ ID NO: 186473 - RNA, 64 nt, Homo Sapiens; identical to SEQ ID NO: 41698

SEQ ID NO: 186474 - RNA, 64 nt, Homo Sapiens; identical to SEQ ID NO: 41699

SEQ ID NO: 186475 - RNA, 64 nt, Homo Sapiens; identical to SEQ ID NO: 41700

SEQ ID NO: 186476 - RNA, 64 nt, Homo Sapiens; identical to SEQ ID NO: 41701

SEQ ID NO: 186477 - RNA, 64 nt, Homo Sapiens; identical to SEQ ID NO: 41702

SEQ ID NO: 186478 - RNA, 64 nt, Homo Sapiens; identical to SEQ ID NO: 41703

SEQ ID NO: 186479 - RNA, 64 nt, Homo Sapiens; identical to SEQ ID NO: 41704

SEQ ID NO: 186480 - RNA, 64 nt, Homo Sapiens; identical to SEQ ID NO: 41705

SEQ ID NO: 186481 - RNA, 64 nt, Homo Sapiens; identical to SEQ ID NO: 41706

SEQ ID NO: 186482 - RNA, 64 nt, Homo Sapiens; identical to SEQ ID NO: 41707

SEQ ID NO: 186483 - RNA, 64 nt, Homo Sapiens; identical to SEQ ID NO: 41708

SEQ ID NO: 186484 - RNA, 64 nt, Homo Sapiens; identical to SEQ ID NO: 41709

SEQ ID NO: 186485 - RNA, 64 nt, Homo Sapiens; identical to SEQ ID NO: 41710

SEQ ID NO: 186486 - RNA, 64 nt, Homo Sapiens; identical to SEQ ID NO: 41711

SEQ ID NO: 186487 - RNA, 64 nt, Homo Sapiens; identical to SEQ ID NO: 41712

SEQ ID NO: 186488 - RNA, 64 nt, Homo Sapiens; identical to SEQ ID NO: 41713

SEQ ID NO: 186489 - RNA, 64 nt, Homo Sapiens; identical to SEQ ID NO: 41714

SEQ ID NO: 186490 - RNA, 64 nt, Homo Sapiens; identical to SEQ ID NO: 41715

SEQ ID NO: 186491 - RNA, 64 nt, Homo Sapiens; identical to SEQ ID NO: 41716

SEQ ID NO: 186492 - RNA, 64 nt, Homo Sapiens; identical to SEQ ID NO: 41717

SEQ ID NO: 186493 - RNA, 64 nt, Homo Sapiens; identical to SEQ ID NO: 41718

SEQ ID NO: 186494 - RNA, 64 nt, Homo Sapiens; identical to SEQ ID NO: 41719

SEQ ID NO: 186495 - RNA, 64 nt, Homo Sapiens; identical to SEQ ID NO: 41720

SEQ ID NO: 186496 - RNA, 64 nt, Homo Sapiens; identical to SEQ ID NO: 41721

SEQ ID NO: 186497 - RNA, 64 nt, Homo Sapiens; identical to SEQ ID NO: 41722

SEQ ID NO: 186498 - RNA, 64 nt, Homo Sapiens; identical to SEQ ID NO: 41723

SEQ ID NO: 186499 - RNA, 64 nt, Homo Sapiens; identical to SEQ ID NO: 41724

SEQ ID NO: 186500 - RNA, 64 nt, Homo Sapiens; identical to SEQ ID NO: 41725

SEQ ID NO: 186501 - RNA, 64 nt, Homo Sapiens; identical to SEQ ID NO: 41726

SEQ ID NO: 186502 - RNA, 64 nt, Homo Sapiens; identical to SEQ ID NO: 41727

SEQ ID NO: 186503 - RNA, 64 nt, Homo Sapiens; identical to SEQ ID NO: 41728

SEQ ID NO: 186504 - RNA, 64 nt, Homo Sapiens; identical to SEQ ID NO: 41729

SEQ ID NO: 186505 - RNA, 64 nt, Homo Sapiens; identical to SEQ ID NO: 41730

SEQ ID NO: 186506 - RNA, 64 nt, Homo Sapiens; identical to SEQ ID NO: 41731

SEQ ID NO: 186507 - RNA, 64 nt, Homo Sapiens; identical to SEQ ID NO: 41732

SEQ ID NO: 186508 - RNA, 64 nt, Homo Sapiens; identical to SEQ ID NO: 41733

SEQ ID NO: 186509 - RNA, 64 nt, Homo Sapiens; identical to SEQ ID NO: 41734

SEQ ID NO: 186510 - RNA, 64 nt, Homo Sapiens; identical to SEQ ID NO: 41735

SEQ ID NO: 186511 - RNA, 64 nt, Homo Sapiens; identical to SEQ ID NO: 41736

SEQ ID NO: 186512 - RNA, 64 nt, Homo Sapiens; identical to SEQ ID NO: 41737

SEQ ID NO: 186513 - RNA, 64 nt, Homo Sapiens; identical to SEQ ID NO: 41738

SEQ ID NO: 186514 - RNA, 64 nt, Homo Sapiens; identical to SEQ ID NO: 41739

SEQ ID NO: 186515 - RNA, 64 nt, Homo Sapiens; identical to SEQ ID NO: 41740

SEQ ID NO: 186516 - RNA, 64 nt, Homo Sapiens; identical to SEQ ID NO: 41741

SEQ ID NO: 186517 - RNA, 64 nt, Homo Sapiens; identical to SEQ ID NO: 41742

SEQ ID NO: 186518 - RNA, 64 nt, Homo Sapiens; identical to SEQ ID NO: 41743

SEQ ID NO: 186519 - RNA, 64 nt, Homo Sapiens; identical to SEQ ID NO: 41744

SEQ ID NO: 186520 - RNA, 64 nt, Homo Sapiens; identical to SEQ ID NO: 41745

SEQ ID NO: 186521 - RNA, 64 nt, Homo Sapiens; identical to SEQ ID NO: 41746

SEQ ID NO: 186522 - RNA, 64 nt, Homo Sapiens; identical to SEQ ID NO: 41747

SEQ ID NO: 186523 - RNA, 64 nt, Homo Sapiens; identical to SEQ ID NO: 41748

SEQ ID NO: 186524 - RNA, 64 nt, Homo Sapiens; identical to SEQ ID NO: 41749

SEQ ID NO: 186525 - RNA, 64 nt, Homo Sapiens; identical to SEQ ID NO: 41750

SEQ ID NO: 186526 - RNA, 64 nt, Homo Sapiens; identical to SEQ ID NO: 41751

SEQ ID NO: 186527 - RNA, 64 nt, Homo Sapiens; identical to SEQ ID NO: 41752

SEQ ID NO: 186528 - RNA, 64 nt, Homo Sapiens; identical to SEQ ID NO: 41753

SEQ ID NO: 186529 - RNA, 64 nt, Homo Sapiens; identical to SEQ ID NO: 41754

SEQ ID NO: 186530 - RNA, 64 nt, Homo Sapiens; identical to SEQ ID NO: 41755

SEQ ID NO: 186531 - RNA, 64 nt, Homo Sapiens; identical to SEQ ID NO: 41756

SEQ ID NO: 186532 - RNA, 64 nt, Homo Sapiens; identical to SEQ ID NO: 41757

SEQ ID NO: 186533 - RNA, 64 nt, Homo Sapiens; identical to SEQ ID NO: 41758

SEQ ID NO: 186534 - RNA, 64 nt, Homo Sapiens; identical to SEQ ID NO: 41759

SEQ ID NO: 186535 - RNA, 64 nt, Homo Sapiens; identical to SEQ ID NO: 41760

SEQ ID NO: 186536 - RNA, 64 nt, Homo Sapiens; identical to SEQ ID NO: 41761

SEQ ID NO: 186537 - RNA, 64 nt, Homo Sapiens; identical to SEQ ID NO: 41762

SEQ ID NO: 186538 - RNA, 64 nt, Homo Sapiens; identical to SEQ ID NO: 41763

SEQ ID NO: 186539 - RNA, 64 nt, Homo Sapiens; identical to SEQ ID NO: 41764

SEQ ID NO: 186540 - RNA, 64 nt, Homo Sapiens; identical to SEQ ID NO: 41765

SEQ ID NO: 186541 - RNA, 64 nt, Homo Sapiens; identical to SEQ ID NO: 41766

SEQ ID NO: 186542 - RNA, 64 nt, Homo Sapiens; identical to SEQ ID NO: 41767

SEQ ID NO: 186543 - RNA, 64 nt, Homo Sapiens; identical to SEQ ID NO: 41768

SEQ ID NO: 186544 - RNA, 64 nt, Homo Sapiens; identical to SEQ ID NO: 41769

SEQ ID NO: 186545 - RNA, 64 nt, Homo Sapiens; identical to SEQ ID NO: 41770

SEQ ID NO: 186546 - RNA, 64 nt, Homo Sapiens; identical to SEQ ID NO: 41771

SEQ ID NO: 186547 - RNA, 64 nt, Homo Sapiens; identical to SEQ ID NO: 41772

SEQ ID NO: 186548 - RNA, 64 nt, Homo Sapiens; identical to SEQ ID NO: 41773

SEQ ID NO: 186549 - RNA, 64 nt, Homo Sapiens; identical to SEQ ID NO: 41774

SEQ ID NO: 186550 - RNA, 64 nt, Homo Sapiens; identical to SEQ ID NO: 41775

SEQ ID NO: 186551 - RNA, 64 nt, Homo Sapiens; identical to SEQ ID NO: 41776

SEQ ID NO: 186552 - RNA, 64 nt, Homo Sapiens; identical to SEQ ID NO: 41777

SEQ ID NO: 186553 - RNA, 64 nt, Homo Sapiens; identical to SEQ ID NO: 41778

SEQ ID NO: 186554 - RNA, 64 nt, Homo Sapiens; identical to SEQ ID NO: 41779

SEQ ID NO: 186555 - RNA, 64 nt, Homo Sapiens; identical to SEQ ID NO: 41780

SEQ ID NO: 186556 - RNA, 64 nt, Homo Sapiens; identical to SEQ ID NO: 41781

SEQ ID NO: 186557 - RNA, 64 nt, Homo Sapiens; identical to SEQ ID NO: 41782

SEQ ID NO: 186558 - RNA, 64 nt, Homo Sapiens; identical to SEQ ID NO: 41783

SEQ ID NO: 186559 - RNA, 64 nt, Homo Sapiens; identical to SEQ ID NO: 41784

SEQ ID NO: 186560 - RNA, 64 nt, Homo Sapiens; identical to SEQ ID NO: 41785

SEQ ID NO: 186561 - RNA, 64 nt, Homo Sapiens; identical to SEQ ID NO: 41786

SEQ ID NO: 186562 - RNA, 64 nt, Homo Sapiens; identical to SEQ ID NO: 41787

SEQ ID NO: 186563 - RNA, 64 nt, Homo Sapiens; identical to SEQ ID NO: 41788

SEQ ID NO: 186564 - RNA, 64 nt, Homo Sapiens; identical to SEQ ID NO: 41789

SEQ ID NO: 186565 - RNA, 64 nt, Homo Sapiens; identical to SEQ ID NO: 41790

SEQ ID NO: 186566 - RNA, 64 nt, Homo Sapiens; identical to SEQ ID NO: 41791

SEQ ID NO: 186567 - RNA, 64 nt, Homo Sapiens; identical to SEQ ID NO: 41792

SEQ ID NO: 186568 - RNA, 64 nt, Homo Sapiens; identical to SEQ ID NO: 41793

SEQ ID NO: 186569 - RNA, 64 nt, Homo Sapiens; identical to SEQ ID NO: 41794

SEQ ID NO: 186570 - RNA, 64 nt, Homo Sapiens; identical to SEQ ID NO: 41795

SEQ ID NO: 186571 - RNA, 64 nt, Homo Sapiens; identical to SEQ ID NO: 41796

SEQ ID NO: 186572 - RNA, 64 nt, Homo Sapiens; identical to SEQ ID NO: 41797

SEQ ID NO: 186573 - RNA, 64 nt, Homo Sapiens; identical to SEQ ID NO: 41798

SEQ ID NO: 186574 - RNA, 64 nt, Homo Sapiens; identical to SEQ ID NO: 41799

SEQ ID NO: 186575 - RNA, 64 nt, Homo Sapiens; identical to SEQ ID NO: 41800

SEQ ID NO: 186576 - RNA, 64 nt, Homo Sapiens; identical to SEQ ID NO: 41801

SEQ ID NO: 186577 - RNA, 64 nt, Homo Sapiens; identical to SEQ ID NO: 41802

SEQ ID NO: 186578 - RNA, 64 nt, Homo Sapiens; identical to SEQ ID NO: 41803

SEQ ID NO: 186579 - RNA, 64 nt, Homo Sapiens; identical to SEQ ID NO: 41804

SEQ ID NO: 186580 - RNA, 64 nt, Homo Sapiens; identical to SEQ ID NO: 41805

SEQ ID NO: 186581 - RNA, 64 nt, Homo Sapiens; identical to SEQ ID NO: 41806

SEQ ID NO: 186582 - RNA, 64 nt, Homo Sapiens; identical to SEQ ID NO: 41807

SEQ ID NO: 186583 - RNA, 64 nt, Homo Sapiens; identical to SEQ ID NO: 41808

SEQ ID NO: 186584 - RNA, 64 nt, Homo Sapiens; identical to SEQ ID NO: 41809

SEQ ID NO: 186585 - RNA, 64 nt, Homo Sapiens; identical to SEQ ID NO: 41810

SEQ ID NO: 186586 - RNA, 64 nt, Homo Sapiens; identical to SEQ ID NO: 41811

SEQ ID NO: 186587 - RNA, 64 nt, Homo Sapiens; identical to SEQ ID NO: 41812

SEQ ID NO: 186588 - RNA, 64 nt, Homo Sapiens; identical to SEQ ID NO: 41813

SEQ ID NO: 186589 - RNA, 64 nt, Homo Sapiens; identical to SEQ ID NO: 41814

SEQ ID NO: 186590 - RNA, 64 nt, Homo Sapiens; identical to SEQ ID NO: 41815

SEQ ID NO: 186591 - RNA, 64 nt, Homo Sapiens; identical to SEQ ID NO: 41816

SEQ ID NO: 186592 - RNA, 64 nt, Homo Sapiens; identical to SEQ ID NO: 41817

SEQ ID NO: 186593 - RNA, 64 nt, Homo Sapiens; identical to SEQ ID NO: 41818

SEQ ID NO: 186594 - RNA, 64 nt, Homo Sapiens; identical to SEQ ID NO: 41819

SEQ ID NO: 186595 - RNA, 64 nt, Homo Sapiens; identical to SEQ ID NO: 41820

SEQ ID NO: 186596 - RNA, 64 nt, Homo Sapiens; identical to SEQ ID NO: 41821

SEQ ID NO: 186597 - RNA, 64 nt, Homo Sapiens; identical to SEQ ID NO: 41822

SEQ ID NO: 186598 - RNA, 64 nt, Homo Sapiens; identical to SEQ ID NO: 41823

SEQ ID NO: 186599 - RNA, 64 nt, Homo Sapiens; identical to SEQ ID NO: 41824

SEQ ID NO: 186600 - RNA, 64 nt, Homo Sapiens; identical to SEQ ID NO: 41825

SEQ ID NO: 186601 - RNA, 64 nt, Homo Sapiens; identical to SEQ ID NO: 41826

SEQ ID NO: 186602 - RNA, 64 nt, Homo Sapiens; identical to SEQ ID NO: 41827

SEQ ID NO: 186603 - RNA, 64 nt, Homo Sapiens; identical to SEQ ID NO: 41828

SEQ ID NO: 186604 - RNA, 64 nt, Homo Sapiens; identical to SEQ ID NO: 41829

SEQ ID NO: 186605 - RNA, 64 nt, Homo Sapiens; identical to SEQ ID NO: 41830

SEQ ID NO: 186606 - RNA, 64 nt, Homo Sapiens; identical to SEQ ID NO: 41831

SEQ ID NO: 186607 - RNA, 64 nt, Homo Sapiens; identical to SEQ ID NO: 41832

SEQ ID NO: 186608 - RNA, 64 nt, Homo Sapiens; identical to SEQ ID NO: 41833

SEQ ID NO: 186609 - RNA, 64 nt, Homo Sapiens; identical to SEQ ID NO: 41834

SEQ ID NO: 186610 - RNA, 64 nt, Homo Sapiens; identical to SEQ ID NO: 41835

SEQ ID NO: 186611 - RNA, 64 nt, Homo Sapiens; identical to SEQ ID NO: 41836

SEQ ID NO: 186612 - RNA, 64 nt, Homo Sapiens; identical to SEQ ID NO: 41837

SEQ ID NO: 186613 - RNA, 64 nt, Homo Sapiens; identical to SEQ ID NO: 41838

SEQ ID NO: 186614 - RNA, 64 nt, Homo Sapiens; identical to SEQ ID NO: 41839

SEQ ID NO: 186615 - RNA, 64 nt, Homo Sapiens; identical to SEQ ID NO: 41840

SEQ ID NO: 186616 - RNA, 64 nt, Homo Sapiens; identical to SEQ ID NO: 41841

SEQ ID NO: 186617 - RNA, 64 nt, Homo Sapiens; identical to SEQ ID NO: 41842

SEQ ID NO: 186618 - RNA, 64 nt, Homo Sapiens; identical to SEQ ID NO: 41843

SEQ ID NO: 186619 - RNA, 64 nt, Homo Sapiens; identical to SEQ ID NO: 41844

SEQ ID NO: 186620 - RNA, 64 nt, Homo Sapiens; identical to SEQ ID NO: 41845

SEQ ID NO: 186621 - RNA, 64 nt, Homo Sapiens; identical to SEQ ID NO: 41846

SEQ ID NO: 186622 - RNA, 64 nt, Homo Sapiens; identical to SEQ ID NO: 41847

SEQ ID NO: 186623 - RNA, 64 nt, Homo Sapiens; identical to SEQ ID NO: 41848

SEQ ID NO: 186624 - RNA, 64 nt, Homo Sapiens; identical to SEQ ID NO: 41849

SEQ ID NO: 186625 - RNA, 64 nt, Homo Sapiens; identical to SEQ ID NO: 41850

SEQ ID NO: 186626 - RNA, 64 nt, Homo Sapiens; identical to SEQ ID NO: 41851

SEQ ID NO: 186627 - RNA, 64 nt, Homo Sapiens; identical to SEQ ID NO: 41852

SEQ ID NO: 186628 - RNA, 64 nt, Homo Sapiens; identical to SEQ ID NO: 41853

SEQ ID NO: 186629 - RNA, 64 nt, Homo Sapiens; identical to SEQ ID NO: 41854

SEQ ID NO: 186630 - RNA, 64 nt, Homo Sapiens; identical to SEQ ID NO: 41855

SEQ ID NO: 186631 - RNA, 64 nt, Homo Sapiens; identical to SEQ ID NO: 41856

SEQ ID NO: 186632 - RNA, 64 nt, Homo Sapiens; identical to SEQ ID NO: 41857

SEQ ID NO: 186633 - RNA, 64 nt, Homo Sapiens; identical to SEQ ID NO: 41858

SEQ ID NO: 186634 - RNA, 64 nt, Homo Sapiens; identical to SEQ ID NO: 41859

SEQ ID NO: 186635 - RNA, 64 nt, Homo Sapiens; identical to SEQ ID NO: 41860

SEQ ID NO: 186636 - RNA, 64 nt, Homo Sapiens; identical to SEQ ID NO: 41861

SEQ ID NO: 186637 - RNA, 64 nt, Homo Sapiens; identical to SEQ ID NO: 41862

SEQ ID NO: 186638 - RNA, 64 nt, Homo Sapiens; identical to SEQ ID NO: 41863

SEQ ID NO: 186639 - RNA, 64 nt, Homo Sapiens; identical to SEQ ID NO: 41864

SEQ ID NO: 186640 - RNA, 64 nt, Homo Sapiens; identical to SEQ ID NO: 41865

SEQ ID NO: 186641 - RNA, 64 nt, Homo Sapiens; identical to SEQ ID NO: 41866

SEQ ID NO: 186642 - RNA, 64 nt, Homo Sapiens; identical to SEQ ID NO: 41867

SEQ ID NO: 186643 - RNA, 64 nt, Homo Sapiens; identical to SEQ ID NO: 41868

SEQ ID NO: 186644 - RNA, 64 nt, Homo Sapiens; identical to SEQ ID NO: 41869

SEQ ID NO: 186645 - RNA, 64 nt, Homo Sapiens; identical to SEQ ID NO: 41870

SEQ ID NO: 186646 - RNA, 64 nt, Homo Sapiens; identical to SEQ ID NO: 41871

SEQ ID NO: 186647 - RNA, 64 nt, Homo Sapiens; identical to SEQ ID NO: 41872

SEQ ID NO: 186648 - RNA, 64 nt, Homo Sapiens; identical to SEQ ID NO: 41873

SEQ ID NO: 186649 - RNA, 64 nt, Homo Sapiens; identical to SEQ ID NO: 41874

SEQ ID NO: 186650 - RNA, 64 nt, Homo Sapiens; identical to SEQ ID NO: 41875

SEQ ID NO: 186651 - RNA, 64 nt, Homo Sapiens; identical to SEQ ID NO: 41876

SEQ ID NO: 186652 - RNA, 64 nt, Homo Sapiens; identical to SEQ ID NO: 41877

SEQ ID NO: 186653 - RNA, 64 nt, Homo Sapiens; identical to SEQ ID NO: 41878

SEQ ID NO: 186654 - RNA, 64 nt, Homo Sapiens; identical to SEQ ID NO: 41879

SEQ ID NO: 186655 - RNA, 64 nt, Homo Sapiens; identical to SEQ ID NO: 41880

SEQ ID NO: 186656 - RNA, 64 nt, Homo Sapiens; identical to SEQ ID NO: 41881

SEQ ID NO: 186657 - RNA, 64 nt, Homo Sapiens; identical to SEQ ID NO: 41882

SEQ ID NO: 186658 - RNA, 64 nt, Homo Sapiens; identical to SEQ ID NO: 41883

SEQ ID NO: 186659 - RNA, 64 nt, Homo Sapiens; identical to SEQ ID NO: 41884

SEQ ID NO: 186660 - RNA, 64 nt, Homo Sapiens; identical to SEQ ID NO: 41885

SEQ ID NO: 186661 - RNA, 64 nt, Homo Sapiens; identical to SEQ ID NO: 41886

SEQ ID NO: 186662 - RNA, 64 nt, Homo Sapiens; identical to SEQ ID NO: 41887

SEQ ID NO: 186663 - RNA, 64 nt, Homo Sapiens; identical to SEQ ID NO: 41888

SEQ ID NO: 186664 - RNA, 64 nt, Homo Sapiens; identical to SEQ ID NO: 41889

SEQ ID NO: 186665 - RNA, 64 nt, Homo Sapiens; identical to SEQ ID NO: 41890

SEQ ID NO: 186666 - RNA, 64 nt, Homo Sapiens; identical to SEQ ID NO: 41891

SEQ ID NO: 186667 - RNA, 64 nt, Homo Sapiens; identical to SEQ ID NO: 41892

SEQ ID NO: 186668 - RNA, 64 nt, Homo Sapiens; identical to SEQ ID NO: 41893

SEQ ID NO: 186669 - RNA, 64 nt, Homo Sapiens; identical to SEQ ID NO: 41894

SEQ ID NO: 186670 - RNA, 64 nt, Homo Sapiens; identical to SEQ ID NO: 41895

SEQ ID NO: 186671 - RNA, 64 nt, Homo Sapiens; identical to SEQ ID NO: 41896

SEQ ID NO: 186672 - RNA, 64 nt, Homo Sapiens; identical to SEQ ID NO: 41897

SEQ ID NO: 186673 - RNA, 64 nt, Homo Sapiens; identical to SEQ ID NO: 41898

SEQ ID NO: 186674 - RNA, 64 nt, Homo Sapiens; identical to SEQ ID NO: 41899

SEQ ID NO: 186675 - RNA, 64 nt, Homo Sapiens; identical to SEQ ID NO: 41900

SEQ ID NO: 186676 - RNA, 64 nt, Homo Sapiens; identical to SEQ ID NO: 41901

SEQ ID NO: 186677 - RNA, 64 nt, Homo Sapiens; identical to SEQ ID NO: 41902

SEQ ID NO: 186678 - RNA, 64 nt, Homo Sapiens; identical to SEQ ID NO: 41903

SEQ ID NO: 186679 - RNA, 64 nt, Homo Sapiens; identical to SEQ ID NO: 41904

SEQ ID NO: 186680 - RNA, 64 nt, Homo Sapiens; identical to SEQ ID NO: 41905

SEQ ID NO: 186681 - RNA, 64 nt, Homo Sapiens; identical to SEQ ID NO: 41906

SEQ ID NO: 186682 - RNA, 64 nt, Homo Sapiens; identical to SEQ ID NO: 41907

SEQ ID NO: 186683 - RNA, 64 nt, Homo Sapiens; identical to SEQ ID NO: 41908

SEQ ID NO: 186684 - RNA, 64 nt, Homo Sapiens; identical to SEQ ID NO: 41909

SEQ ID NO: 186685 - RNA, 64 nt, Homo Sapiens; identical to SEQ ID NO: 41910

SEQ ID NO: 186686 - RNA, 64 nt, Homo Sapiens; identical to SEQ ID NO: 41911

SEQ ID NO: 186687 - RNA, 64 nt, Homo Sapiens; identical to SEQ ID NO: 41912

SEQ ID NO: 186688 - RNA, 64 nt, Homo Sapiens; identical to SEQ ID NO: 41913

SEQ ID NO: 186689 - RNA, 64 nt, Homo Sapiens; identical to SEQ ID NO: 41914

SEQ ID NO: 186690 - RNA, 64 nt, Homo Sapiens; identical to SEQ ID NO: 41915

SEQ ID NO: 186691 - RNA, 64 nt, Homo Sapiens; identical to SEQ ID NO: 41916

SEQ ID NO: 186692 - RNA, 64 nt, Homo Sapiens; identical to SEQ ID NO: 41917

SEQ ID NO: 186693 - RNA, 64 nt, Homo Sapiens; identical to SEQ ID NO: 41918

SEQ ID NO: 186694 - RNA, 64 nt, Homo Sapiens; identical to SEQ ID NO: 41919

SEQ ID NO: 186695 - RNA, 64 nt, Homo Sapiens; identical to SEQ ID NO: 41920

SEQ ID NO: 186696 - RNA, 64 nt, Homo Sapiens; identical to SEQ ID NO: 41921

SEQ ID NO: 186697 - RNA, 64 nt, Homo Sapiens; identical to SEQ ID NO: 41922

SEQ ID NO: 186698 - RNA, 64 nt, Homo Sapiens; identical to SEQ ID NO: 41923

SEQ ID NO: 186699 - RNA, 64 nt, Homo Sapiens; identical to SEQ ID NO: 41924

SEQ ID NO: 186700 - RNA, 64 nt, Homo Sapiens; identical to SEQ ID NO: 41925

SEQ ID NO: 186701 - RNA, 64 nt, Homo Sapiens; identical to SEQ ID NO: 41926

SEQ ID NO: 186702 - RNA, 64 nt, Homo Sapiens; identical to SEQ ID NO: 41927

SEQ ID NO: 186703 - RNA, 64 nt, Homo Sapiens; identical to SEQ ID NO: 41928

SEQ ID NO: 186704 - RNA, 64 nt, Homo Sapiens; identical to SEQ ID NO: 41929

SEQ ID NO: 186705 - RNA, 64 nt, Homo Sapiens; identical to SEQ ID NO: 41930

SEQ ID NO: 186706 - RNA, 64 nt, Homo Sapiens; identical to SEQ ID NO: 41931

SEQ ID NO: 186707 - RNA, 64 nt, Homo Sapiens; identical to SEQ ID NO: 41932

SEQ ID NO: 186708 - RNA, 64 nt, Homo Sapiens; identical to SEQ ID NO: 41933

SEQ ID NO: 186709 - RNA, 64 nt, Homo Sapiens; identical to SEQ ID NO: 41934

SEQ ID NO: 186710 - RNA, 64 nt, Homo Sapiens; identical to SEQ ID NO: 41935

SEQ ID NO: 186711 - RNA, 64 nt, Homo Sapiens; identical to SEQ ID NO: 41936

SEQ ID NO: 186712 - RNA, 64 nt, Homo Sapiens; identical to SEQ ID NO: 41937

SEQ ID NO: 186713 - RNA, 64 nt, Homo Sapiens; identical to SEQ ID NO: 41938

SEQ ID NO: 186714 - RNA, 64 nt, Homo Sapiens; identical to SEQ ID NO: 41939

SEQ ID NO: 186715 - RNA, 64 nt, Homo Sapiens; identical to SEQ ID NO: 41940

SEQ ID NO: 186716 - RNA, 64 nt, Homo Sapiens; identical to SEQ ID NO: 41941

SEQ ID NO: 186717 - RNA, 64 nt, Homo Sapiens; identical to SEQ ID NO: 41942

SEQ ID NO: 186718 - RNA, 64 nt, Homo Sapiens; identical to SEQ ID NO: 41943

SEQ ID NO: 186719 - RNA, 64 nt, Homo Sapiens; identical to SEQ ID NO: 41944

SEQ ID NO: 186720 - RNA, 64 nt, Homo Sapiens; identical to SEQ ID NO: 41945

SEQ ID NO: 186721 - RNA, 64 nt, Homo Sapiens; identical to SEQ ID NO: 41946

SEQ ID NO: 186722 - RNA, 64 nt, Homo Sapiens; identical to SEQ ID NO: 41947

SEQ ID NO: 186723 - RNA, 64 nt, Homo Sapiens; identical to SEQ ID NO: 41948

SEQ ID NO: 186724 - RNA, 64 nt, Homo Sapiens; identical to SEQ ID NO: 41949

SEQ ID NO: 186725 - RNA, 64 nt, Homo Sapiens; identical to SEQ ID NO: 41950

SEQ ID NO: 186726 - RNA, 64 nt, Homo Sapiens; identical to SEQ ID NO: 41951

SEQ ID NO: 186727 - RNA, 64 nt, Homo Sapiens; identical to SEQ ID NO: 41952

SEQ ID NO: 186728 - RNA, 64 nt, Homo Sapiens; identical to SEQ ID NO: 41953

SEQ ID NO: 186729 - RNA, 64 nt, Homo Sapiens; identical to SEQ ID NO: 41954

SEQ ID NO: 186730 - RNA, 64 nt, Homo Sapiens; identical to SEQ ID NO: 41955

SEQ ID NO: 186731 - RNA, 64 nt, Homo Sapiens; identical to SEQ ID NO: 41956

SEQ ID NO: 186732 - RNA, 64 nt, Homo Sapiens; identical to SEQ ID NO: 41957

SEQ ID NO: 186733 - RNA, 64 nt, Homo Sapiens; identical to SEQ ID NO: 41958

SEQ ID NO: 186734 - RNA, 64 nt, Homo Sapiens; identical to SEQ ID NO: 41959

SEQ ID NO: 186735 - RNA, 64 nt, Homo Sapiens; identical to SEQ ID NO: 41960

SEQ ID NO: 186736 - RNA, 64 nt, Homo Sapiens; identical to SEQ ID NO: 41961

SEQ ID NO: 186737 - RNA, 64 nt, Homo Sapiens; identical to SEQ ID NO: 41962

SEQ ID NO: 186738 - RNA, 64 nt, Homo Sapiens; identical to SEQ ID NO: 41963

SEQ ID NO: 186739 - RNA, 64 nt, Homo Sapiens; identical to SEQ ID NO: 41964

SEQ ID NO: 186740 - RNA, 64 nt, Homo Sapiens; identical to SEQ ID NO: 41965

SEQ ID NO: 186741 - RNA, 64 nt, Homo Sapiens; identical to SEQ ID NO: 41966

SEQ ID NO: 186742 - RNA, 64 nt, Homo Sapiens; identical to SEQ ID NO: 41967

SEQ ID NO: 186743 - RNA, 64 nt, Homo Sapiens; identical to SEQ ID NO: 41968

SEQ ID NO: 186744 - RNA, 64 nt, Homo Sapiens; identical to SEQ ID NO: 41969

SEQ ID NO: 186745 - RNA, 64 nt, Homo Sapiens; identical to SEQ ID NO: 41970

SEQ ID NO: 186746 - RNA, 64 nt, Homo Sapiens; identical to SEQ ID NO: 41971

SEQ ID NO: 186747 - RNA, 64 nt, Homo Sapiens; identical to SEQ ID NO: 41972

SEQ ID NO: 186748 - RNA, 64 nt, Homo Sapiens; identical to SEQ ID NO: 41973

SEQ ID NO: 186749 - RNA, 64 nt, Homo Sapiens; identical to SEQ ID NO: 41974

SEQ ID NO: 186750 - RNA, 64 nt, Homo Sapiens; identical to SEQ ID NO: 41975

SEQ ID NO: 186751 - RNA, 64 nt, Homo Sapiens; identical to SEQ ID NO: 41976

SEQ ID NO: 186752 - RNA, 64 nt, Homo Sapiens; identical to SEQ ID NO: 41977

SEQ ID NO: 186753 - RNA, 64 nt, Homo Sapiens; identical to SEQ ID NO: 41978

SEQ ID NO: 186754 - RNA, 64 nt, Homo Sapiens; identical to SEQ ID NO: 41979

SEQ ID NO: 186755 - RNA, 64 nt, Homo Sapiens; identical to SEQ ID NO: 41980

SEQ ID NO: 186756 - RNA, 64 nt, Homo Sapiens; identical to SEQ ID NO: 41981

SEQ ID NO: 186757 - RNA, 64 nt, Homo Sapiens; identical to SEQ ID NO: 41982

SEQ ID NO: 186758 - RNA, 64 nt, Homo Sapiens; identical to SEQ ID NO: 41983

SEQ ID NO: 186759 - RNA, 64 nt, Homo Sapiens; identical to SEQ ID NO: 41984

SEQ ID NO: 186760 - RNA, 64 nt, Homo Sapiens; identical to SEQ ID NO: 41985

SEQ ID NO: 186761 - RNA, 64 nt, Homo Sapiens; identical to SEQ ID NO: 41986

SEQ ID NO: 186762 - RNA, 64 nt, Homo Sapiens; identical to SEQ ID NO: 41987

SEQ ID NO: 186763 - RNA, 64 nt, Homo Sapiens; identical to SEQ ID NO: 41988

SEQ ID NO: 186764 - RNA, 64 nt, Homo Sapiens; identical to SEQ ID NO: 41989

SEQ ID NO: 186765 - RNA, 64 nt, Homo Sapiens; identical to SEQ ID NO: 41990

SEQ ID NO: 186766 - RNA, 64 nt, Homo Sapiens; identical to SEQ ID NO: 41991

SEQ ID NO: 186767 - RNA, 64 nt, Homo Sapiens; identical to SEQ ID NO: 41992

SEQ ID NO: 186768 - RNA, 64 nt, Homo Sapiens; identical to SEQ ID NO: 41993

SEQ ID NO: 186769 - RNA, 64 nt, Homo Sapiens; identical to SEQ ID NO: 41994

SEQ ID NO: 186770 - RNA, 64 nt, Homo Sapiens; identical to SEQ ID NO: 41995

SEQ ID NO: 186771 - RNA, 64 nt, Homo Sapiens; identical to SEQ ID NO: 41996

SEQ ID NO: 186772 - RNA, 64 nt, Homo Sapiens; identical to SEQ ID NO: 41997

SEQ ID NO: 186773 - RNA, 64 nt, Homo Sapiens; identical to SEQ ID NO: 41998

SEQ ID NO: 186774 - RNA, 64 nt, Homo Sapiens; identical to SEQ ID NO: 41999

SEQ ID NO: 186775 - RNA, 64 nt, Homo Sapiens; identical to SEQ ID NO: 42000

SEQ ID NO: 186776 - RNA, 64 nt, Homo Sapiens; identical to SEQ ID NO: 42001

SEQ ID NO: 186777 - RNA, 64 nt, Homo Sapiens; identical to SEQ ID NO: 42002

SEQ ID NO: 186778 - RNA, 64 nt, Homo Sapiens; identical to SEQ ID NO: 42003

SEQ ID NO: 186779 - RNA, 64 nt, Homo Sapiens; identical to SEQ ID NO: 42004

SEQ ID NO: 186780 - RNA, 64 nt, Homo Sapiens; identical to SEQ ID NO: 42005

SEQ ID NO: 186781 - RNA, 64 nt, Homo Sapiens; identical to SEQ ID NO: 42006

SEQ ID NO: 186782 - RNA, 64 nt, Homo Sapiens; identical to SEQ ID NO: 42007

SEQ ID NO: 186783 - RNA, 64 nt, Homo Sapiens; identical to SEQ ID NO: 42008

SEQ ID NO: 186784 - RNA, 64 nt, Homo Sapiens; identical to SEQ ID NO: 42009

SEQ ID NO: 186785 - RNA, 64 nt, Homo Sapiens; identical to SEQ ID NO: 42010

SEQ ID NO: 186786 - RNA, 64 nt, Homo Sapiens; identical to SEQ ID NO: 42011

SEQ ID NO: 186787 - RNA, 64 nt, Homo Sapiens; identical to SEQ ID NO: 42012

SEQ ID NO: 186788 - RNA, 64 nt, Homo Sapiens; identical to SEQ ID NO: 42013

SEQ ID NO: 186789 - RNA, 64 nt, Homo Sapiens; identical to SEQ ID NO: 42014

SEQ ID NO: 186790 - RNA, 64 nt, Homo Sapiens; identical to SEQ ID NO: 42015

SEQ ID NO: 186791 - RNA, 64 nt, Homo Sapiens; identical to SEQ ID NO: 42016

SEQ ID NO: 186792 - RNA, 64 nt, Homo Sapiens; identical to SEQ ID NO: 42017

SEQ ID NO: 186793 - RNA, 64 nt, Homo Sapiens; identical to SEQ ID NO: 42018

SEQ ID NO: 186794 - RNA, 64 nt, Homo Sapiens; identical to SEQ ID NO: 42019

SEQ ID NO: 186795 - RNA, 64 nt, Homo Sapiens; identical to SEQ ID NO: 42020

SEQ ID NO: 186796 - RNA, 64 nt, Homo Sapiens; identical to SEQ ID NO: 42021

SEQ ID NO: 186797 - RNA, 64 nt, Homo Sapiens; identical to SEQ ID NO: 42022

SEQ ID NO: 186798 - RNA, 64 nt, Homo Sapiens; identical to SEQ ID NO: 42023

SEQ ID NO: 186799 - RNA, 64 nt, Homo Sapiens; identical to SEQ ID NO: 42024

SEQ ID NO: 186800 - RNA, 64 nt, Homo Sapiens; identical to SEQ ID NO: 42025

SEQ ID NO: 186801 - RNA, 64 nt, Homo Sapiens; identical to SEQ ID NO: 42026

SEQ ID NO: 186802 - RNA, 64 nt, Homo Sapiens; identical to SEQ ID NO: 42027

SEQ ID NO: 186803 - RNA, 64 nt, Homo Sapiens; identical to SEQ ID NO: 42028

SEQ ID NO: 186804 - RNA, 64 nt, Homo Sapiens; identical to SEQ ID NO: 42029

SEQ ID NO: 186805 - RNA, 64 nt, Homo Sapiens; identical to SEQ ID NO: 42030

SEQ ID NO: 186806 - RNA, 64 nt, Homo Sapiens; identical to SEQ ID NO: 42031

SEQ ID NO: 186807 - RNA, 64 nt, Homo Sapiens; identical to SEQ ID NO: 42032

SEQ ID NO: 186808 - RNA, 64 nt, Homo Sapiens; identical to SEQ ID NO: 42033

SEQ ID NO: 186809 - RNA, 64 nt, Homo Sapiens; identical to SEQ ID NO: 42034

SEQ ID NO: 186810 - RNA, 64 nt, Homo Sapiens; identical to SEQ ID NO: 42035

SEQ ID NO: 186811 - RNA, 64 nt, Homo Sapiens; identical to SEQ ID NO: 42036

SEQ ID NO: 186812 - RNA, 64 nt, Homo Sapiens; identical to SEQ ID NO: 42037

SEQ ID NO: 186813 - RNA, 64 nt, Homo Sapiens; identical to SEQ ID NO: 42038

SEQ ID NO: 186814 - RNA, 64 nt, Homo Sapiens; identical to SEQ ID NO: 42039

SEQ ID NO: 186815 - RNA, 64 nt, Homo Sapiens; identical to SEQ ID NO: 42040

SEQ ID NO: 186816 - RNA, 64 nt, Homo Sapiens; identical to SEQ ID NO: 42041

SEQ ID NO: 186817 - RNA, 64 nt, Homo Sapiens; identical to SEQ ID NO: 42042

SEQ ID NO: 186818 - RNA, 64 nt, Homo Sapiens; identical to SEQ ID NO: 42043

SEQ ID NO: 186819 - RNA, 64 nt, Homo Sapiens; identical to SEQ ID NO: 42044

SEQ ID NO: 186820 - RNA, 64 nt, Homo Sapiens; identical to SEQ ID NO: 42045

SEQ ID NO: 186821 - RNA, 64 nt, Homo Sapiens; identical to SEQ ID NO: 42046

SEQ ID NO: 186822 - RNA, 64 nt, Homo Sapiens; identical to SEQ ID NO: 42047

SEQ ID NO: 186823 - RNA, 64 nt, Homo Sapiens; identical to SEQ ID NO: 42048

SEQ ID NO: 186824 - RNA, 64 nt, Homo Sapiens; identical to SEQ ID NO: 42049

SEQ ID NO: 186825 - RNA, 64 nt, Homo Sapiens; identical to SEQ ID NO: 42050

SEQ ID NO: 186826 - RNA, 64 nt, Homo Sapiens; identical to SEQ ID NO: 42051

SEQ ID NO: 186827 - RNA, 64 nt, Homo Sapiens; identical to SEQ ID NO: 42052

SEQ ID NO: 186828 - RNA, 64 nt, Homo Sapiens; identical to SEQ ID NO: 42053

SEQ ID NO: 186829 - RNA, 64 nt, Homo Sapiens; identical to SEQ ID NO: 42054

SEQ ID NO: 186830 - RNA, 64 nt, Homo Sapiens; identical to SEQ ID NO: 42055

SEQ ID NO: 186831 - RNA, 64 nt, Homo Sapiens; identical to SEQ ID NO: 42056

SEQ ID NO: 186832 - RNA, 64 nt, Homo Sapiens; identical to SEQ ID NO: 42057

SEQ ID NO: 186833 - RNA, 64 nt, Homo Sapiens; identical to SEQ ID NO: 42058

SEQ ID NO: 186834 - RNA, 64 nt, Homo Sapiens; identical to SEQ ID NO: 42059

SEQ ID NO: 186835 - RNA, 64 nt, Homo Sapiens; identical to SEQ ID NO: 42060

SEQ ID NO: 186836 - RNA, 64 nt, Homo Sapiens; identical to SEQ ID NO: 42061

SEQ ID NO: 186837 - RNA, 64 nt, Homo Sapiens; identical to SEQ ID NO: 42062

SEQ ID NO: 186838 - RNA, 64 nt, Homo Sapiens; identical to SEQ ID NO: 42063

SEQ ID NO: 186839 - RNA, 64 nt, Homo Sapiens; identical to SEQ ID NO: 42064

SEQ ID NO: 186840 - RNA, 64 nt, Homo Sapiens; identical to SEQ ID NO: 42065

SEQ ID NO: 186841 - RNA, 64 nt, Homo Sapiens; identical to SEQ ID NO: 42066

SEQ ID NO: 186842 - RNA, 64 nt, Homo Sapiens; identical to SEQ ID NO: 42067

SEQ ID NO: 186843 - RNA, 64 nt, Homo Sapiens; identical to SEQ ID NO: 42068

SEQ ID NO: 186844 - RNA, 64 nt, Homo Sapiens; identical to SEQ ID NO: 42069

SEQ ID NO: 186845 - RNA, 64 nt, Homo Sapiens; identical to SEQ ID NO: 42070

SEQ ID NO: 186846 - RNA, 64 nt, Homo Sapiens; identical to SEQ ID NO: 42071

SEQ ID NO: 186847 - RNA, 64 nt, Homo Sapiens; identical to SEQ ID NO: 42072

SEQ ID NO: 186848 - RNA, 64 nt, Homo Sapiens; identical to SEQ ID NO: 42073

SEQ ID NO: 186849 - RNA, 64 nt, Homo Sapiens; identical to SEQ ID NO: 42074

SEQ ID NO: 186850 - RNA, 64 nt, Homo Sapiens; identical to SEQ ID NO: 42075

SEQ ID NO: 186851 - RNA, 64 nt, Homo Sapiens; identical to SEQ ID NO: 42076

SEQ ID NO: 186852 - RNA, 64 nt, Homo Sapiens; identical to SEQ ID NO: 42077

SEQ ID NO: 186853 - RNA, 64 nt, Homo Sapiens; identical to SEQ ID NO: 42078

SEQ ID NO: 186854 - RNA, 64 nt, Homo Sapiens; identical to SEQ ID NO: 42079

SEQ ID NO: 186855 - RNA, 64 nt, Homo Sapiens; identical to SEQ ID NO: 42080

SEQ ID NO: 186856 - RNA, 64 nt, Homo Sapiens; identical to SEQ ID NO: 42081

SEQ ID NO: 186857 - RNA, 64 nt, Homo Sapiens; identical to SEQ ID NO: 42082

SEQ ID NO: 186858 - RNA, 64 nt, Homo Sapiens; identical to SEQ ID NO: 42083

SEQ ID NO: 186859 - RNA, 64 nt, Homo Sapiens; identical to SEQ ID NO: 42084

SEQ ID NO: 186860 - RNA, 64 nt, Homo Sapiens; identical to SEQ ID NO: 42085

SEQ ID NO: 186861 - RNA, 64 nt, Homo Sapiens; identical to SEQ ID NO: 42086

SEQ ID NO: 186862 - RNA, 64 nt, Homo Sapiens; identical to SEQ ID NO: 42087

SEQ ID NO: 186863 - RNA, 64 nt, Homo Sapiens; identical to SEQ ID NO: 42088

SEQ ID NO: 186864 - RNA, 64 nt, Homo Sapiens; identical to SEQ ID NO: 42089

SEQ ID NO: 186865 - RNA, 64 nt, Homo Sapiens; identical to SEQ ID NO: 42090

SEQ ID NO: 186866 - RNA, 64 nt, Homo Sapiens; identical to SEQ ID NO: 42091

SEQ ID NO: 186867 - RNA, 64 nt, Homo Sapiens; identical to SEQ ID NO: 42092

SEQ ID NO: 186868 - RNA, 64 nt, Homo Sapiens; identical to SEQ ID NO: 42093

SEQ ID NO: 186869 - RNA, 64 nt, Homo Sapiens; identical to SEQ ID NO: 42094

SEQ ID NO: 186870 - RNA, 64 nt, Homo Sapiens; identical to SEQ ID NO: 42095

SEQ ID NO: 186871 - RNA, 64 nt, Homo Sapiens; identical to SEQ ID NO: 42096

SEQ ID NO: 186872 - RNA, 64 nt, Homo Sapiens; identical to SEQ ID NO: 42097

SEQ ID NO: 186873 - RNA, 64 nt, Homo Sapiens; identical to SEQ ID NO: 42098

SEQ ID NO: 186874 - RNA, 64 nt, Homo Sapiens; identical to SEQ ID NO: 42099

SEQ ID NO: 186875 - RNA, 64 nt, Homo Sapiens; identical to SEQ ID NO: 42100

SEQ ID NO: 186876 - RNA, 64 nt, Homo Sapiens; identical to SEQ ID NO: 42101

SEQ ID NO: 186877 - RNA, 64 nt, Homo Sapiens; identical to SEQ ID NO: 42102

SEQ ID NO: 186878 - RNA, 64 nt, Homo Sapiens; identical to SEQ ID NO: 42103

SEQ ID NO: 186879 - RNA, 64 nt, Homo Sapiens; identical to SEQ ID NO: 42104

SEQ ID NO: 186880 - RNA, 64 nt, Homo Sapiens; identical to SEQ ID NO: 42105

SEQ ID NO: 186881 - RNA, 64 nt, Homo Sapiens; identical to SEQ ID NO: 42106

SEQ ID NO: 186882 - RNA, 64 nt, Homo Sapiens; identical to SEQ ID NO: 42107

SEQ ID NO: 186883 - RNA, 64 nt, Homo Sapiens; identical to SEQ ID NO: 42108

SEQ ID NO: 186884 - RNA, 64 nt, Homo Sapiens; identical to SEQ ID NO: 42109

SEQ ID NO: 186885 - RNA, 64 nt, Homo Sapiens; identical to SEQ ID NO: 42110

SEQ ID NO: 186886 - RNA, 64 nt, Homo Sapiens; identical to SEQ ID NO: 42111

SEQ ID NO: 186887 - RNA, 64 nt, Homo Sapiens; identical to SEQ ID NO: 42112

SEQ ID NO: 186888 - RNA, 64 nt, Homo Sapiens; identical to SEQ ID NO: 42113

SEQ ID NO: 186889 - RNA, 64 nt, Homo Sapiens; identical to SEQ ID NO: 42114

SEQ ID NO: 186890 - RNA, 64 nt, Homo Sapiens; identical to SEQ ID NO: 42115

SEQ ID NO: 186891 - RNA, 64 nt, Homo Sapiens; identical to SEQ ID NO: 42116

SEQ ID NO: 186892 - RNA, 64 nt, Homo Sapiens; identical to SEQ ID NO: 42117

SEQ ID NO: 186893 - RNA, 64 nt, Homo Sapiens; identical to SEQ ID NO: 42118

SEQ ID NO: 186894 - RNA, 64 nt, Homo Sapiens; identical to SEQ ID NO: 42119

SEQ ID NO: 186895 - RNA, 64 nt, Homo Sapiens; identical to SEQ ID NO: 42120

SEQ ID NO: 186896 - RNA, 64 nt, Homo Sapiens; identical to SEQ ID NO: 42121

SEQ ID NO: 186897 - RNA, 64 nt, Homo Sapiens; identical to SEQ ID NO: 42122

SEQ ID NO: 186898 - RNA, 64 nt, Homo Sapiens; identical to SEQ ID NO: 42123

SEQ ID NO: 186899 - RNA, 64 nt, Homo Sapiens; identical to SEQ ID NO: 42124

SEQ ID NO: 186900 - RNA, 64 nt, Homo Sapiens; identical to SEQ ID NO: 42125

SEQ ID NO: 186901 - RNA, 64 nt, Homo Sapiens; identical to SEQ ID NO: 42126

SEQ ID NO: 186902 - RNA, 64 nt, Homo Sapiens; identical to SEQ ID NO: 42127

SEQ ID NO: 186903 - RNA, 64 nt, Homo Sapiens; identical to SEQ ID NO: 42128

SEQ ID NO: 186904 - RNA, 64 nt, Homo Sapiens; identical to SEQ ID NO: 42129

SEQ ID NO: 186905 - RNA, 64 nt, Homo Sapiens; identical to SEQ ID NO: 42130

SEQ ID NO: 186906 - RNA, 64 nt, Homo Sapiens; identical to SEQ ID NO: 42131

SEQ ID NO: 186907 - RNA, 64 nt, Homo Sapiens; identical to SEQ ID NO: 42132

SEQ ID NO: 186908 - RNA, 64 nt, Homo Sapiens; identical to SEQ ID NO: 42133

SEQ ID NO: 186909 - RNA, 64 nt, Homo Sapiens; identical to SEQ ID NO: 42134

SEQ ID NO: 186910 - RNA, 64 nt, Homo Sapiens; identical to SEQ ID NO: 42135

SEQ ID NO: 186911 - RNA, 64 nt, Homo Sapiens; identical to SEQ ID NO: 42136

SEQ ID NO: 186912 - RNA, 64 nt, Homo Sapiens; identical to SEQ ID NO: 42137

SEQ ID NO: 186913 - RNA, 64 nt, Homo Sapiens; identical to SEQ ID NO: 42138

SEQ ID NO: 186914 - RNA, 64 nt, Homo Sapiens; identical to SEQ ID NO: 42139

SEQ ID NO: 186915 - RNA, 64 nt, Homo Sapiens; identical to SEQ ID NO: 42140

SEQ ID NO: 186916 - RNA, 64 nt, Homo Sapiens; identical to SEQ ID NO: 42141

SEQ ID NO: 186917 - RNA, 64 nt, Homo Sapiens; identical to SEQ ID NO: 42142

SEQ ID NO: 186918 - RNA, 64 nt, Homo Sapiens; identical to SEQ ID NO: 42143

SEQ ID NO: 186919 - RNA, 64 nt, Homo Sapiens; identical to SEQ ID NO: 42144

SEQ ID NO: 186920 - RNA, 64 nt, Homo Sapiens; identical to SEQ ID NO: 42145

SEQ ID NO: 186921 - RNA, 64 nt, Homo Sapiens; identical to SEQ ID NO: 42146

SEQ ID NO: 186922 - RNA, 64 nt, Homo Sapiens; identical to SEQ ID NO: 42147

SEQ ID NO: 186923 - RNA, 64 nt, Homo Sapiens; identical to SEQ ID NO: 42148

SEQ ID NO: 186924 - RNA, 64 nt, Homo Sapiens; identical to SEQ ID NO: 42149

SEQ ID NO: 186925 - RNA, 64 nt, Homo Sapiens; identical to SEQ ID NO: 42150

SEQ ID NO: 186926 - RNA, 64 nt, Homo Sapiens; identical to SEQ ID NO: 42151

SEQ ID NO: 186927 - RNA, 64 nt, Homo Sapiens; identical to SEQ ID NO: 42152

SEQ ID NO: 186928 - RNA, 64 nt, Homo Sapiens; identical to SEQ ID NO: 42153

SEQ ID NO: 186929 - RNA, 64 nt, Homo Sapiens; identical to SEQ ID NO: 42154

SEQ ID NO: 186930 - RNA, 64 nt, Homo Sapiens; identical to SEQ ID NO: 42155

SEQ ID NO: 186931 - RNA, 64 nt, Homo Sapiens; identical to SEQ ID NO: 42156

SEQ ID NO: 186932 - RNA, 64 nt, Homo Sapiens; identical to SEQ ID NO: 42157

SEQ ID NO: 186933 - RNA, 64 nt, Homo Sapiens; identical to SEQ ID NO: 42158

SEQ ID NO: 186934 - RNA, 64 nt, Homo Sapiens; identical to SEQ ID NO: 42159

SEQ ID NO: 186935 - RNA, 64 nt, Homo Sapiens; identical to SEQ ID NO: 42160

SEQ ID NO: 186936 - RNA, 64 nt, Homo Sapiens; identical to SEQ ID NO: 42161

SEQ ID NO: 186937 - RNA, 64 nt, Homo Sapiens; identical to SEQ ID NO: 42162

SEQ ID NO: 186938 - RNA, 64 nt, Homo Sapiens; identical to SEQ ID NO: 42163

SEQ ID NO: 186939 - RNA, 64 nt, Homo Sapiens; identical to SEQ ID NO: 42164

SEQ ID NO: 186940 - RNA, 64 nt, Homo Sapiens; identical to SEQ ID NO: 42165

SEQ ID NO: 186941 - RNA, 64 nt, Homo Sapiens; identical to SEQ ID NO: 42166

SEQ ID NO: 186942 - RNA, 64 nt, Homo Sapiens; identical to SEQ ID NO: 42167

SEQ ID NO: 186943 - RNA, 64 nt, Homo Sapiens; identical to SEQ ID NO: 42168

SEQ ID NO: 186944 - RNA, 64 nt, Homo Sapiens; identical to SEQ ID NO: 42169

SEQ ID NO: 186945 - RNA, 64 nt, Homo Sapiens; identical to SEQ ID NO: 42170

SEQ ID NO: 186946 - RNA, 64 nt, Homo Sapiens; identical to SEQ ID NO: 42171

SEQ ID NO: 186947 - RNA, 64 nt, Homo Sapiens; identical to SEQ ID NO: 42172

SEQ ID NO: 186948 - RNA, 64 nt, Homo Sapiens; identical to SEQ ID NO: 42173

SEQ ID NO: 186949 - RNA, 64 nt, Homo Sapiens; identical to SEQ ID NO: 42174

SEQ ID NO: 186950 - RNA, 64 nt, Homo Sapiens; identical to SEQ ID NO: 42175

SEQ ID NO: 186951 - RNA, 64 nt, Homo Sapiens; identical to SEQ ID NO: 42176

SEQ ID NO: 186952 - RNA, 64 nt, Homo Sapiens; identical to SEQ ID NO: 42177

SEQ ID NO: 186953 - RNA, 64 nt, Homo Sapiens; identical to SEQ ID NO: 42178

SEQ ID NO: 186954 - RNA, 64 nt, Homo Sapiens; identical to SEQ ID NO: 42179

SEQ ID NO: 186955 - RNA, 64 nt, Homo Sapiens; identical to SEQ ID NO: 42180

SEQ ID NO: 186956 - RNA, 64 nt, Homo Sapiens; identical to SEQ ID NO: 42181

SEQ ID NO: 186957 - RNA, 64 nt, Homo Sapiens; identical to SEQ ID NO: 42182

SEQ ID NO: 186958 - RNA, 64 nt, Homo Sapiens; identical to SEQ ID NO: 42183

SEQ ID NO: 186959 - RNA, 64 nt, Homo Sapiens; identical to SEQ ID NO: 42184

SEQ ID NO: 186960 - RNA, 64 nt, Homo Sapiens; identical to SEQ ID NO: 42185

SEQ ID NO: 186961 - RNA, 64 nt, Homo Sapiens; identical to SEQ ID NO: 42186

SEQ ID NO: 186962 - RNA, 64 nt, Homo Sapiens; identical to SEQ ID NO: 42187

SEQ ID NO: 186963 - RNA, 64 nt, Homo Sapiens; identical to SEQ ID NO: 42188

SEQ ID NO: 186964 - RNA, 64 nt, Homo Sapiens; identical to SEQ ID NO: 42189

SEQ ID NO: 186965 - RNA, 64 nt, Homo Sapiens; identical to SEQ ID NO: 42190

SEQ ID NO: 186966 - RNA, 64 nt, Homo Sapiens; identical to SEQ ID NO: 42191

SEQ ID NO: 186967 - RNA, 64 nt, Homo Sapiens; identical to SEQ ID NO: 42192

SEQ ID NO: 186968 - RNA, 64 nt, Homo Sapiens; identical to SEQ ID NO: 42193

SEQ ID NO: 186969 - RNA, 64 nt, Homo Sapiens; identical to SEQ ID NO: 42194

SEQ ID NO: 186970 - RNA, 64 nt, Homo Sapiens; identical to SEQ ID NO: 42195

SEQ ID NO: 186971 - RNA, 64 nt, Homo Sapiens; identical to SEQ ID NO: 42196

SEQ ID NO: 186972 - RNA, 64 nt, Homo Sapiens; identical to SEQ ID NO: 42197

SEQ ID NO: 186973 - RNA, 64 nt, Homo Sapiens; identical to SEQ ID NO: 42198

SEQ ID NO: 186974 - RNA, 64 nt, Homo Sapiens; identical to SEQ ID NO: 42199

SEQ ID NO: 186975 - RNA, 64 nt, Homo Sapiens; identical to SEQ ID NO: 42200

SEQ ID NO: 186976 - RNA, 64 nt, Homo Sapiens; identical to SEQ ID NO: 42201

SEQ ID NO: 186977 - RNA, 64 nt, Homo Sapiens; identical to SEQ ID NO: 42202

SEQ ID NO: 186978 - RNA, 64 nt, Homo Sapiens; identical to SEQ ID NO: 42203

SEQ ID NO: 186979 - RNA, 64 nt, Homo Sapiens; identical to SEQ ID NO: 42204

SEQ ID NO: 186980 - RNA, 64 nt, Homo Sapiens; identical to SEQ ID NO: 42205

SEQ ID NO: 186981 - RNA, 64 nt, Homo Sapiens; identical to SEQ ID NO: 42206

SEQ ID NO: 186982 - RNA, 64 nt, Homo Sapiens; identical to SEQ ID NO: 42207

SEQ ID NO: 186983 - RNA, 64 nt, Homo Sapiens; identical to SEQ ID NO: 42208

SEQ ID NO: 186984 - RNA, 64 nt, Homo Sapiens; identical to SEQ ID NO: 42209

SEQ ID NO: 186985 - RNA, 64 nt, Homo Sapiens; identical to SEQ ID NO: 42210

SEQ ID NO: 186986 - RNA, 64 nt, Homo Sapiens; identical to SEQ ID NO: 42211

SEQ ID NO: 186987 - RNA, 64 nt, Homo Sapiens; identical to SEQ ID NO: 42212

SEQ ID NO: 186988 - RNA, 64 nt, Homo Sapiens; identical to SEQ ID NO: 42213

SEQ ID NO: 186989 - RNA, 64 nt, Homo Sapiens; identical to SEQ ID NO: 42214

SEQ ID NO: 186990 - RNA, 64 nt, Homo Sapiens; identical to SEQ ID NO: 42215

SEQ ID NO: 186991 - RNA, 64 nt, Homo Sapiens; identical to SEQ ID NO: 42216

SEQ ID NO: 186992 - RNA, 64 nt, Homo Sapiens; identical to SEQ ID NO: 42217

SEQ ID NO: 186993 - RNA, 64 nt, Homo Sapiens; identical to SEQ ID NO: 42218

SEQ ID NO: 186994 - RNA, 64 nt, Homo Sapiens; identical to SEQ ID NO: 42219

SEQ ID NO: 186995 - RNA, 64 nt, Homo Sapiens; identical to SEQ ID NO: 42220

SEQ ID NO: 186996 - RNA, 64 nt, Homo Sapiens; identical to SEQ ID NO: 42221

SEQ ID NO: 186997 - RNA, 64 nt, Homo Sapiens; identical to SEQ ID NO: 42222

SEQ ID NO: 186998 - RNA, 64 nt, Homo Sapiens; identical to SEQ ID NO: 42223

SEQ ID NO: 186999 - RNA, 64 nt, Homo Sapiens; identical to SEQ ID NO: 42224

SEQ ID NO: 187000 - RNA, 64 nt, Homo Sapiens; identical to SEQ ID NO: 42225

SEQ ID NO: 187001 - RNA, 64 nt, Homo Sapiens; identical to SEQ ID NO: 42226

SEQ ID NO: 187002 - RNA, 64 nt, Homo Sapiens; identical to SEQ ID NO: 42227

SEQ ID NO: 187003 - RNA, 64 nt, Homo Sapiens; identical to SEQ ID NO: 42228

SEQ ID NO: 187004 - RNA, 64 nt, Homo Sapiens; identical to SEQ ID NO: 42229

SEQ ID NO: 187005 - RNA, 64 nt, Homo Sapiens; identical to SEQ ID NO: 42230

SEQ ID NO: 187006 - RNA, 64 nt, Homo Sapiens; identical to SEQ ID NO: 42231

SEQ ID NO: 187007 - RNA, 64 nt, Homo Sapiens; identical to SEQ ID NO: 42232

SEQ ID NO: 187008 - RNA, 64 nt, Homo Sapiens; identical to SEQ ID NO: 42233

SEQ ID NO: 187009 - RNA, 64 nt, Homo Sapiens; identical to SEQ ID NO: 42234

SEQ ID NO: 187010 - RNA, 64 nt, Homo Sapiens; identical to SEQ ID NO: 42235

SEQ ID NO: 187011 - RNA, 64 nt, Homo Sapiens
aggauuugagaauaguuucaucucagcccccauuagagagaaguuggggugaauucuggaaaaa

SEQ ID NO: 187012 - RNA, 64 nt, Homo Sapiens
ggagaaccacaaugcacauuagcauauuagucugagagagaacuuauaguaaggaaacucacuu

SEQ ID NO: 187013 - RNA, 64 nt, Homo Sapiens
aaagaaaaaugaagaaaaguggaggaagaaagggagagagaagaaugaaauaaaaagaagagag

SEQ ID NO: 187014 - RNA, 64 nt, Homo Sapiens
acuguuaugaaaaacagaaggaagggggauaaagagagagaaggucccuagggucugcuuuaga

SEQ ID NO: 187015 - RNA, 64 nt, Homo Sapiens
guacgggguuugugacuggagaggcuagugccucagagagaacuguaaccaagauggaugcaaa

SEQ ID NO: 187016 - RNA, 64 nt, Homo Sapiens
gaguuuugacgucuuuuuaccuguuuuauaaaccagagagaaauuuuggaaaacaguuuuuauu

SEQ ID NO: 187017 - RNA, 56 nt, Homo Sapiens
uaccaucugauaacucuugaagauacagagagaaauccaucuuuucccaggucucc

SEQ ID NO: 187018 - RNA, 64 nt, Homo Sapiens
uaaauuuuguauuuuccauccaacagcaguguguagagagaauauuaugcagaugccguuaauu

SEQ ID NO: 187019 - RNA, 64 nt, Homo Sapiens
uguguguguguguguguguguguguguggcagagagagagaaagagagagagagagagaaauuc

SEQ ID NO: 187020 - RNA, 64 nt, Homo Sapiens
uguguguguggcagagagagagaaagagagagagagagagaaauucuguuaaaaucuauucugu

SEQ ID NO: 187021 - RNA, 64 nt, Homo Sapiens
uauuugcugacaaccauuaauguguuucuaccggagagagaaugcuuuaaucagaaacccucau

SEQ ID NO: 187022 - RNA, 64 nt, Homo Sapiens
acugaaaagaaggaaagauggaugguaagagaaaagagagaaacaugugugugugggguggggg

SEQ ID NO: 187023 - RNA, 64 nt, Homo Sapiens
aaaaaagugugacauuacagcaaaaaaaaaaaaaagagagaaacugcaaauuauuuguaugcuu

SEQ ID NO: 187024 - RNA, 64 nt, Homo Sapiens
agaccaugcugcauacauucagaaaaagagagagagagagaaaaguuuccaguuccguucugag

SEQ ID NO: 187025 - RNA, 64 nt, Homo Sapiens
aauaaaccuucggagaacgucacuaagcuuuuccagagagaagacccuagaugaaguuggaaaa

SEQ ID NO: 187026 - RNA, 64 nt, Homo Sapiens
caagucaacaaagaacuuaccuuggaggauagagagagagaagggaccaauuaugaggacugac

SEQ ID NO: 187027 - RNA, 64 nt, Homo Sapiens
agguugacuuuuugcacuucuguauauagucaaaagagagaaaccuguauaauaguaagaucuu

SEQ ID NO: 187028 - RNA, 64 nt, Homo Sapiens
aaaacuacugcauguuuaaaacuucaacaaaaaaagagagaaagaacuauacuaagaacauaua

SEQ ID NO: 187029 - RNA, 64 nt, Homo Sapiens
aagaggaaguguucacuuuuuaguuaaauguagaagagagaagaguuuuuuuuaaacaugauuc

SEQ ID NO: 187030 - RNA, 64 nt, Homo Sapiens
auauacauuauaaaagcagaauaugaaaaacagaagagagaaaaauagcauuuagaaguuuugg

SEQ ID NO: 187031 - RNA, 64 nt, Homo Sapiens
aucuaguaaaaaaggaguugcaauagccaaguauagagagaauagugaaaaauuaaucuugccc

SEQ ID NO: 187032 - RNA, 64 nt, Homo Sapiens
uuggaauuacuuuaauugauggaguaguggugguagagagaaauuaauaacaaaaagagugaaa

SEQ ID NO: 187033 - RNA, 64 nt, Homo Sapiens
ccaaagaaaaaggcuaugagaugagcugaguuauagagagaaagggagaggcauguacggugug

SEQ ID NO: 187034 - RNA, 64 nt, Homo Sapiens
uccuauccauggauaggucuagucauaacacuuuagagagaaugucagagcaggagggaggcaa

SEQ ID NO: 187035 - RNA, 64 nt, Homo Sapiens
uucaauaauguucaacugaaucucacagaugaggagagagaagaaacggaagaggaaguuuauu

SEQ ID NO: 187036 - RNA, 64 nt, Homo Sapiens
gguggaauggaggaguuguuuggggagggaaaggagagagaaggaaaggagugagguauuuccc

SEQ ID NO: 187037 - RNA, 64 nt, Homo Sapiens
cacucaauauguggaaugacgaauacugaauagaagagagaaauaugggucccucucuguggaa

SEQ ID NO: 187038 - RNA, 64 nt, Homo Sapiens
ucagagggccuuaccaugacucucucaaaggcguagagagaauugucagaaacuaaaugcugag

SEQ ID NO: 187039 - RNA, 64 nt, Homo Sapiens
gagagugagagcacaaagauaacgcaggagagagagagagaaagaaugagaaagaaaaggaaug

SEQ ID NO: 187040 - RNA, 64 nt, Homo Sapiens
agauguaaugacagagaguucuggugagauacccagagagaaaaagagagagcaggguggggua

SEQ ID NO: 187041 - RNA, 64 nt, Homo Sapiens
agggcccaggaucccaugccugggaggagcugccagagagaagcaaaaaggcggcuguggaucg

SEQ ID NO: 187042 - RNA, 64 nt, Homo Sapiens
ucgagacaccaucccagguguguguaagagagagagagagaacagggaggauacagaaguauug

SEQ ID NO: 187043 - RNA, 64 nt, Homo Sapiens
gaaacacacucuuucauugcguaguugcauuggaagagagaaagcaauguuaagggguuguugu

SEQ ID NO: 187044 - RNA, 64 nt, Homo Sapiens
uggacucugaaucccuuuuuugggacaacuaagaagagagaaugggaagugaggacuguccugc

SEQ ID NO: 187045 - RNA, 64 nt, Homo Sapiens
gccucacagugauggguucagagaagcuggaaagagagagaaggauuucuugaguuuuuaguuu

SEQ ID NO: 187046 - RNA, 64 nt, Homo Sapiens
guuaugauuaaaugggcucccccugauuguguucagagagaaaguuuuguuuaauuugcucuuu

SEQ ID NO: 187047 - RNA, 64 nt, Homo Sapiens
ccauggcugcucaggaaggaugagcuguggaaugagagagaaaaacccaguccugcagugucug

SEQ ID NO: 187048 - RNA, 64 nt, Homo Sapiens
uucagauccucagauugcacuguggugaccugacagagagaacacacugaagaugaguuugacc

SEQ ID NO: 187049 - RNA, 64 nt, Homo Sapiens
aaacauguaggaaaaaauauaaggaaagagaggaagagagaagcuacacacacacgagagacag

SEQ ID NO: 187050 - RNA, 64 nt, Homo Sapiens
accacuguggcuagauauauuguaauaacaaaagagagagaaguuuauacacuaugagguaaaa

SEQ ID NO: 187051 - RNA, 64 nt, Homo Sapiens
uuaacaacuuacugaacauaagaaaauuuacacuagagagaaagccuacaaaugugaagaaugu

SEQ ID NO: 187052 - RNA, 64 nt, Homo Sapiens
cucaaaccuuacuaaacacaagaagauucauacuagagagaaacccuacaaaugugaagaaugu

SEQ ID NO: 187053 - RNA, 64 nt, Homo Sapiens
cucagcccuuacuagacaucagagaauccauacuagagagaagcccuacaaauguaaagaaugu

SEQ ID NO: 187054 - RNA, 64 nt, Homo Sapiens
cucagccauugcucagcaucagauaauucacaccagagagaaacccucugaaugugacgaauga

SEQ ID NO: 187055 - RNA, 64 nt, Homo Sapiens
caguuuccaaggauauguuuagaaagacgaagggagagagaaaggaaagaagagggagggagag

SEQ ID NO: 187056 - RNA, 64 nt, Homo Sapiens
acgaagggagagagaaagcaaagaagagggagggagagagaaagaguacugaagagaaauggga

SEQ ID NO: 187057 - RNA, 64 nt, Homo Sapiens
guuaucuuaguaccuauggauuaguaucauaugaagagagaacagaaucauagccauaagccug

SEQ ID NO: 187058 - RNA, 64 nt, Homo Sapiens
ucauaacaaauccgacuaccagaggggugaggggagagagaaauuucuucagcuaaauacuuua

SEQ ID NO: 187059 - RNA, 64 nt, Homo Sapiens
agaugaaguuugccaggaggcuuuuuguagaaggagagagaagaugaauuuccagguacuugga

SEQ ID NO: 187060 - RNA, 64 nt, Homo Sapiens
aacaaaggucuggaguuuacucaguaaguugcccagagagaagguagcguuacuucuccugugg

SEQ ID NO: 187061 - RNA, 64 nt, Homo Sapiens
uccauccccgcuaccguccuggccagcuaccgucagagagaaccagagcuccaagucuuuaauu

SEQ ID NO: 187062 - RNA, 64 nt, Homo Sapiens
aaccugcuaucaggaaaucuacaugugugcacagagagagaaaaguagaacaguucuuugcauu

SEQ ID NO: 187063 - RNA, 64 nt, Homo Sapiens
cccucgucuaaagaggcagcugagugagagacacagagagaaggagaaagagggagggagagag

SEQ ID NO: 187064 - RNA, 64 nt, Homo Sapiens
agagacacagagagaaggagaaagagggagggagagagagaaagagagagaaagagagagagag

SEQ ID NO: 187065 - RNA, 64 nt, Homo Sapiens
agagaaggagaaagagggagggagagagagaaagagagagaaagagagagagagagagagagag

SEQ ID NO: 187066 - RNA, 64 nt, Homo Sapiens
agagaaagagagagaaagagagagagagagagagagagagaaagcugaacgugcacucugacaa

SEQ ID NO: 187067 - RNA, 64 nt, Homo Sapiens
cagucccucuaucccuucuccuguccaggggcccagagagaaacacaccuaccccuggccuugc

SEQ ID NO: 187068 - RNA, 64 nt, Homo Sapiens
cuccucuuuccguggcuggggguagacuuaauaaagagagaaauucaagaacugcuugcuuuau

SEQ ID NO: 187069 - RNA, 64 nt, Homo Sapiens
cucccuguuuccugggcuagucuuggaccccacgagagagaaucguuccucagccucaugguga

SEQ ID NO: 187070 - RNA, 64 nt, Homo Sapiens
ugcaucuccguaaaugugcucugcuccucagcugagagagaaaaaaauaaacuguauuuggcug

SEQ ID NO: 187071 - RNA, 64 nt, Homo Sapiens
gcuaaccuuguagcaugugauguguguguaugagagagagaaauguguguguguguguguacuc

SEQ ID NO: 187072 - RNA, 64 nt, Homo Sapiens
agagagagacuguguguguggcugagcaagagagagagagaauguccuggagggguguuguaug

SEQ ID NO: 187073 - RNA, 64 nt, Homo Sapiens
aguucggggauauauuaagauauuuuuguacauaagagagaaagagagagaaaaauuuauagaa

SEQ ID NO: 187074 - RNA, 64 nt, Homo Sapiens
uauauuaagauauuuuuguacauaagagagaaagagagagaaaaauuuauagaaguuuuguaca

SEQ ID NO: 187075 - RNA, 64 nt, Homo Sapiens
uugacugcacauuaaaaaaaccuagaagaaaaaaagagagaaacuuuacuggcaugguaucauu

SEQ ID NO: 187076 - RNA, 64 nt, Homo Sapiens
cucugaacucugcuaaggacagggccuuggucagagagagaaugacucaacuuugaggaaagac

SEQ ID NO: 187077 - RNA, 64 nt, Homo Sapiens
uccccaaaauagcugcccuuaaagaguuguuagcagagagaaaaauaacagugaaugugcuccu

SEQ ID NO: 187078 - RNA, 64 nt, Homo Sapiens
uaaguauacacucagcaauaauuagaaaaaaaggagagagaaaagugauuuaaacaggguggau

SEQ ID NO: 187079 - RNA, 64 nt, Homo Sapiens
ccacugcgcccagccacugccaucaucuuuaggaagagagaagugaccaugccugaaccaguca

SEQ ID NO: 187080 - RNA, 64 nt, Homo Sapiens
gccuggcugggauccucaggaccugaggcuccacagagagaaauuccuggaaucuggaccccau

SEQ ID NO: 187081 - RNA, 64 nt, Homo Sapiens
auaccuuuauggaguaaacggacuaguuuaauauagagagaaaaaaagaggcuaaauaaaauga

SEQ ID NO: 187082 - RNA, 64 nt, Homo Sapiens
guuaaugaacaugagguaguuaguaaauagagagagagagaagaccccacccaagacauuuuaa

SEQ ID NO: 187083 - RNA, 64 nt, Homo Sapiens
acauuccucucugucaacaugccccggggggcacagagagaacaugaauguccaccagacacca

SEQ ID NO: 187084 - RNA, 57 nt, Homo Sapiens
agaagaacacgcagcugaaggaucaacagagagaaggcuggaagaacaaugcaguga

SEQ ID NO: 187085 - RNA, 64 nt, Homo Sapiens
agagagagagaugcuguugaagagagugagagagagagagaaagccagagagugagagagagaa

SEQ ID NO: 187086 - RNA, 64 nt, Homo Sapiens
agagugagagagagagagaaagccagagagugagagagagaaagagaguaaccaguuuccagag

SEQ ID NO: 187087 - RNA, 64 nt, Homo Sapiens
aaugcaguugcauugauucaagagagagagaaagagagagaaugugaaugggcagaggugagag

SEQ ID NO: 187088 - RNA, 64 nt, Homo Sapiens
agagagaaugaaugcaguuggaggugagagagagagagagaaagcagugccuuuugaaugggca

SEQ ID NO: 187089 - RNA, 64 nt, Homo Sapiens
uccuuuuacaaaguuauuaagcccuuuauuuaaaagagagaaguccuauuugugugguuauaua

SEQ ID NO: 187090 - RNA, 64 nt, Homo Sapiens
agcaggcacgcugggccucggagagaguugcgggagagagaaggggugcugugggaacggacua

SEQ ID NO: 187091 - RNA, 64 nt, Homo Sapiens
cagugugaauguuuccccucugaccugacccuguagagagaacacgcccgaacaugaagaaaaa

SEQ ID NO: 187092 - RNA, 64 nt, Homo Sapiens
aucaucaaggcaccguagguauuuccaguauuaaagagagaauccugcuuuccuaaggacuccc

SEQ ID NO: 187093 - RNA, 64 nt, Homo Sapiens
aguugaaaugaaggaaaaaauguuaagggcagccagagagaaaggucggguuacccacaaaggg

SEQ ID NO: 187094 - RNA, 64 nt, Homo Sapiens
aauugauagaccgcuagcaagacuaaugaagaaaagagagaagaaucaaauagaugcaauaaaa

SEQ ID NO: 187095 - RNA, 64 nt, Homo Sapiens
ccugcgggacagagugagacccugucugaaagaaagagagaaagaaagaaagaaagagagagaa

SEQ ID NO: 187096 - RNA, 64 nt, Homo Sapiens
ugucugaaagaaagagagaaagaaagaaagaaagagagagaaagaaagaaagaaagaaagggaa

SEQ ID NO: 187097 - RNA, 64 nt, Homo Sapiens
aaggaaggaaggaaaaagaaagagaaagagagagagagagaaagaaaaagaaagaaaaguaaga

SEQ ID NO: 187098 - RNA, 64 nt, Homo Sapiens
uccacaaauuccaaugucacagggauggggggagagagagaaaaccccagggucuggugauggc

SEQ ID NO: 187099 - RNA, 64 nt, Homo Sapiens
aaaaucacccaccaccccccagagagagacagagagagagaaaaagaaaacagaaacccgagaa

SEQ ID NO: 187100 - RNA, 64 nt, Homo Sapiens
uuuaaagcuggguguccgggggacagaguacaaaagagagaaauagccaacuugagaaauaaag

SEQ ID NO: 187101 - RNA, 64 nt, Homo Sapiens
cuuuuguauguaaagaauuuugugaacuccuaccagagagaaacucuguauuccucaccccacc

SEQ ID NO: 187102 - RNA, 64 nt, Homo Sapiens
ggcccaagagagacagcacaaaagagagagagagagagagaaggcagcagagagagagagagag

SEQ ID NO: 187103 - RNA, 64 nt, Homo Sapiens
agagagagagagagagaaggcagcagagagagagagagagaaagccucccacccccuccccggg

SEQ ID NO: 187104 - RNA, 64 nt, Homo Sapiens
auauauuauauauuauauaguagagagaauggagagagagaaacuaaagauacagagagucaaa

SEQ ID NO: 187105 - RNA, 64 nt, Homo Sapiens
gagagagagaaacauauauuacagagagucaaauagagagaauguugccuccuagaauaaagau

SEQ ID NO: 187106 - RNA, 64 nt, Homo Sapiens
guccaggaaggggcggggagggauuaaaggcaaaagagagaagaaggcaaugacugcgcagagu

SEQ ID NO: 187107 - RNA, 64 nt, Homo Sapiens
cggccagguaggaugaacacccaaggaaauauugagagagaagucuuccucuuaggauguuuca

SEQ ID NO: 187108 - RNA, 64 nt, Homo Sapiens
uccucuccggaucugucgauuuggagaccuuccgagagagaaccaagggugcagucagcuuaaa

SEQ ID NO: 187109 - RNA, 64 nt, Homo Sapiens
uucauauuuagaaguaaaacacaaaacaaaaaagagagagaaaagaaaagaaaucacaauguau

SEQ ID NO: 187110 - RNA, 64 nt, Homo Sapiens
aaacguagaaauuuauuauuuggagcuguaauccagagagaaggaugagauuuugcccagcaca

SEQ ID NO: 187111 - RNA, 64 nt, Homo Sapiens
aaagucuccagaccaggaauagagaaggaaagagagagagaaagcauagaagagggaaggaaag

SEQ ID NO: 187112 - RNA, 64 nt, Homo Sapiens
aaagagagagagaaagaaaggaagagggaaggaaagagagaaggccuacccgcucagcaacaua

SEQ ID NO: 187113 - RNA, 64 nt, Homo Sapiens
cugcaugauuggcauuaguuaccacagccugcccagagagaaacuaucuucucccaacauuuac

SEQ ID NO: 187114 - RNA, 64 nt, Homo Sapiens
caaaauguuacaaccgcuguaaaaugacggagagagagagaaagaaucccagacauuaacggua

SEQ ID NO: 187115 - RNA, 64 nt, Homo Sapiens
ugccgaguuccuuaaaucucagcugggauccuggaccugggaggccccugugagggccagcucu

SEQ ID NO: 187116 - RNA, 64 nt, Homo Sapiens
cugggaggccccugugagggccagcucuggaaaaaccugggaguugaugccggaggcuguggaa

SEQ ID NO: 187117 - RNA, 64 nt, Homo Sapiens
uagagguugcagugagcugaggagaaucgcuugaaccugggagucuacuugggagacugaggca

SEQ ID NO: 187118 - RNA, 64 nt, Homo Sapiens
uuuguuaaaauuuuuuaaaaggcuggucgggaauaccugggaagagucagugguucccaaaucu

SEQ ID NO: 187119 - RNA, 64 nt, Homo Sapiens
guucaagcaauucugcugcaucagccucccgaguaccugggauuacaggcaugugccaccacgc

SEQ ID NO: 187120 - RNA, 64 nt, Homo Sapiens
uauuuauugaguaccuacugugugcuaggcauugaccugggaacuagagauacuucacagaaua

SEQ ID NO: 187121 - RNA, 64 nt, Homo Sapiens
auuuaaaacuccagaugcccagcgcauuccaaccaccugggagcauucaguguccccaccuugc

SEQ ID NO: 187122 - RNA, 64 nt, Homo Sapiens
agucaucagucagggugcguuacaacucagggccaccugggauccccacucacagucaccgucu

SEQ ID NO: 187123 - RNA, 64 nt, Homo Sapiens
uuggccggagaugucuuuuuagacacaaacacucaccugggacgauuugcacagauaucuuuga

SEQ ID NO: 187124 - RNA, 64 nt, Homo Sapiens
uccaacauaugaugaaaaccugaagcugagauggaccugggaacgaugaugccagccuugagca

SEQ ID NO: 187125 - RNA, 64 nt, Homo Sapiens
gacaucaccacugcccuauggcaacagaugcagaaccugggaaucgggaggcucagaaacaaca

SEQ ID NO: 187126 - RNA, 64 nt, Homo Sapiens
ugccccccaugagccaggaccugaagauggacuuaccugggacccccagaggagaugggggcuu

SEQ ID NO: 187127 - RNA, 64 nt, Homo Sapiens
uucaucuuucugccuccaccgaugggacuggaggaccugggaaucuggagcagggcuggggaau

SEQ ID NO: 187128 - RNA, 64 nt, Homo Sapiens
cggagguugcggugagcugcggagaauugcuugaaccugggagacuacuagggaggcugaggca

SEQ ID NO: 187129 - RNA, 64 nt, Homo Sapiens
cagagguugcagugagcugaggagaaucgcuugaaccugggaggcuacuugagaggcugaggca

SEQ ID NO: 187130 - RNA, 64 nt, Homo Sapiens
aggguggcuaagucccaccauaacagcuaaggggaccugggagaugauggcucauuuccaccca

SEQ ID NO: 187131 - RNA, 64 nt, Homo Sapiens
ccaggauuuccagagcgcacauccacaggccuggaccugggaugaagaugaaugaagaacaugg

SEQ ID NO: 187132 - RNA, 64 nt, Homo Sapiens
uugggcaugguggcaugcaccuguagucccagcuaccugggaggcugaggcaggagaauugcuu

SEQ ID NO: 187133 - RNA, 64 nt, Homo Sapiens
cuaccugggaggcugaggcaggagaauugcuugaaccugggaggcagagguugcagugagccaa

SEQ ID NO: 187134 - RNA, 64 nt, Homo Sapiens
uguucuuccugccuuucugcuuguuguuguuuuaaccugggaaguguuguuguuguugucauug

SEQ ID NO: 187135 - RNA, 64 nt, Homo Sapiens
acaggcacgcaccaccaugcuuagccucccaaguaccugggacugcucaggugauccucacacc

SEQ ID NO: 187136 - RNA, 64 nt, Homo Sapiens
agaugacacaaggcacuccuggagcuauugagccaccugggaugucacaaacccaccucuguug

SEQ ID NO: 187137 - RNA, 64 nt, Homo Sapiens
cagaagccucugcaccuacuaccucggggaggauaccugggagaggucagcauuauccugccag

SEQ ID NO: 187138 - RNA, 64 nt, Homo Sapiens
guaaaaccuccacgugacuguuuggugcaucuugaccugggaagacgccucaugggaacgaacu

SEQ ID NO: 187139 - RNA, 64 nt, Homo Sapiens
uucucuguguucuguguauuugucugaauuaaugaccugggauauaaagcuaugcuagcuuuca

SEQ ID NO: 187140 - RNA, 64 nt, Homo Sapiens
cagggccuaggcugauagucagagccuguggcacaccugggaugggccagggcccugggugggg

SEQ ID NO: 187141 - RNA, 64 nt, Homo Sapiens
gggccccuagaaaugcugccuuugugugugggguaccugggaaaggguguggcugaggcaguca

SEQ ID NO: 187142 - RNA, 64 nt, Homo Sapiens
aaugaaaaaaaaaaauaaaguugcugccucauugaccugggaaaugucucacuuuuuguuaaug

SEQ ID NO: 187143 - RNA, 64 nt, Homo Sapiens
cagagagagaaggagaaggaaacucagcaagccaaccugggaauaaagcugaugggagugagag

SEQ ID NO: 187144 - RNA, 64 nt, Homo Sapiens
cacucggguccucuugagcaguggagcaagggagaccugggagcgugggagccaggaucagcgc

SEQ ID NO: 187145 - RNA, 64 nt, Homo Sapiens
cuauuugggaggcugaggcaggagaaucacuugaaccugggaggcggagguugcagugagccga

SEQ ID NO: 187146 - RNA, 64 nt, Homo Sapiens
gcagguuggccccugaacuggagagcauccuggcaccugggagcgggagcacagugaagacccu

SEQ ID NO: 187147 - RNA, 64 nt, Homo Sapiens
acagugaagacccugagagcgggagcacccuggcaccugggagcgggagcacagugaagaccau

SEQ ID NO: 187148 - RNA, 64 nt, Homo Sapiens
cagagguugcagugagccggggagaaucgcuugaaccugggaggcuacuggggaggcugaggca

SEQ ID NO: 187149 - RNA, 64 nt, Homo Sapiens
cauccuugauacuuucucuuccaccaagcuaggaaccugggagucucucucucaauuacuggga

SEQ ID NO: 187150 - RNA, 64 nt, Homo Sapiens
cagagguugcagugagccaaggagaaucgcuugaaccugggaggcaccucaggaggcugaggca

SEQ ID NO: 187151 - RNA, 64 nt, Homo Sapiens
cggaaguugcagugagccgaggagaaucgcuugaaccugggaggcuacuugggaggcugaggca

SEQ ID NO: 187152 - RNA, 64 nt, Homo Sapiens
gcuucuuccagguaugggcacagauacgaagcaaaccugggauucauugaugucucuagaccug

SEQ ID NO: 187153 - RNA, 64 nt, Homo Sapiens
ccaagagccaguggcugagcuccuugagggaugaaccugggagcugagcccucagguccccagc

SEQ ID NO: 187154 - RNA, 64 nt, Homo Sapiens
aggccccccuacagucacugccacacugguggggaccugggacccagacccggaaccagcccag

SEQ ID NO: 187155 - RNA, 64 nt, Homo Sapiens
caugaggacagaaggcaggagacuuuggucaguuaccugggaauucugggcugccaggaaacga

SEQ ID NO: 187156 - RNA, 64 nt, Homo Sapiens
guggccaggccgugcccuugucccuuccccgaugaccugggaugcuuaccugggagcacacuuu

SEQ ID NO: 187157 - RNA, 64 nt, Homo Sapiens
acacuuuucccuuccccgauguuugacccugcuuaccugggagcaagugaggcucuugggggug

SEQ ID NO: 187158 - RNA, 64 nt, Homo Sapiens
cagaggcugcagugagccaaugagaauugcuugaaccugggaggcuacucaggauccugaggca

SEQ ID NO: 187159 - RNA, 64 nt, Homo Sapiens
ucaggcacgcgccacuacacucagccuugugaauaccugggacugcuuaagcgauccuccuccc

SEQ ID NO: 187160 - RNA, 64 nt, Homo Sapiens
cuacucaggagacugaggcagaaggaucgcuugaaccugggaggcagagguugcagugagccga

SEQ ID NO: 187161 - RNA, 64 nt, Homo Sapiens
cuacuggggaggcugagucaggagaaucgcuugaaccugggaggcggagguugcggucagcuga

SEQ ID NO: 187162 - RNA, 64 nt, Homo Sapiens
gagggugagcugaagcaggguggggcguaaccucaccugggaagugcaaggagucggggaucuc

SEQ ID NO: 187163 - RNA, 64 nt, Homo Sapiens
gaauucucccugccagcacagcagucugaagucaaccugggaugaucaagcuugguggggggag

SEQ ID NO: 187164 - RNA, 64 nt, Homo Sapiens
cgguugcagugagccaagauggagaauggcuugaaccugggaagcuacucgggaggcagaggca

SEQ ID NO: 187165 - RNA, 64 nt, Homo Sapiens
accagcugcggcgcauggagacagcgagcugggcaccugggagcugacagugaugaggaggugg

SEQ ID NO: 187166 - RNA, 64 nt, Homo Sapiens
cagcagccucccagaagcucucuucugcuucaaaaccugggaucucuggcauuacccuauuggg

SEQ ID NO: 187167 - RNA, 64 nt, Homo Sapiens
ccguggguaaguccugccauucaagacuggagacaccugggaaauaaaaagagcagggcacugc

SEQ ID NO: 187168 - RNA, 64 nt, Homo Sapiens
uuucaccaguuugacucacccuugcucagaguuuaccugggagaaaagucaucuucucuuuuuu

SEQ ID NO: 187169 - RNA, 64 nt, Homo Sapiens
gcuuccagaauccucgcagacccggcugcugggcaccugggagaugccacaugccguucccaug

SEQ ID NO: 187170 - RNA, 64 nt, Homo Sapiens
ugcacacagcugcucagcaccacuuucauucuggaccugggaccuuaggagccgggugacagca

SEQ ID NO: 187171 - RNA, 64 nt, Homo Sapiens
aaauaaacacgacauauuuaaagaagguucuuucaccugggagcaaaugaacaauagcuaagug

SEQ ID NO: 187172 - RNA, 64 nt, Homo Sapiens
auggcccuccugccacuucagcacaccuugccccaccugggaccaucacacgugaagcaccagg

SEQ ID NO: 187173 - RNA, 64 nt, Homo Sapiens
uacgaauggacaggaaagggagccagagcuguauaccugggacaggccagggagccuuuagugc

SEQ ID NO: 187174 - RNA, 64 nt, Homo Sapiens
cauggagccuaccucugucugagacaggugccuaaccugggaccuguggucaugugagucuggg

SEQ ID NO: 187175 - RNA, 64 nt, Homo Sapiens
ucagccugguuucugggugcuagauccagcccaaaccugggaaggccagccuuguacagucugc

SEQ ID NO: 187176 - RNA, 64 nt, Homo Sapiens
auauaucccugauaaauauuaaucuuuaauuaaaaccugggauugggagugugguuucuuuuug

SEQ ID NO: 187177 - RNA, 64 nt, Homo Sapiens
gagauuuaaacucugaauuuuugcacagcacugaaccugggaaaaguauuuggaauuagaaccc

SEQ ID NO: 187178 - RNA, 64 nt, Homo Sapiens
ggccugcugcagaugagccagggccggagcugaucgcucucacuccuccacugccuggcucagc

SEQ ID NO: 187179 - RNA, 64 nt, Homo Sapiens
gaagcacguggugagggugggcgccugggcuccgcgcucucagaggaccccgggagcagaagac

SEQ ID NO: 187180 - RNA, 61 nt, Homo Sapiens
auucccuagaagagaacccucuacuuuuuguaagcacuacugacucucgcuguauuuaaga

SEQ ID NO: 187181 - RNA, 61 nt, Homo Sapiens
acuuuacauuguaucuaaguuaaucuuuauaaagcacuagaauuuuuggucaaaagucaaa

SEQ ID NO: 187182 - RNA, 61 nt, Homo Sapiens
ggcagaaagcucuuagacaauggacuauccaaagcacuauuuaaauucugccucuuccuac

SEQ ID NO: 187183 - RNA, 61 nt, Homo Sapiens
uagucuccccgccucauucccacccccaacaaagcacuaucauuuucauuuggaaugggua

SEQ ID NO: 187184 - RNA, 61 nt, Homo Sapiens
uauugaucuuuuuaucaugauccucccuaucaagcacuaaaaaguugaaccauuauacuuu

SEQ ID NO: 187185 - RNA, 61 nt, Homo Sapiens
acugauccuuaguaacauguuaacauuuaugaagcacuauauauugauuugcaaaaucuuu

SEQ ID NO: 187186 - RNA, 61 nt, Homo Sapiens
ccaauguaauuggcugcgucuggcuaauucuaagcacuaaagucuacaucuaagcuauaga

SEQ ID NO: 187187 - RNA, 61 nt, Homo Sapiens
cuuagguucauugugccucaguuccucucaaaagcacuaaaucuaagugcaaacaaguauu

SEQ ID NO: 187188 - RNA, 61 nt, Homo Sapiens
cuuuuugguaauauguuacaauuaaaaugacaagcacuauaucacaaucucuguuuguaug

SEQ ID NO: 187189 - RNA, 61 nt, Homo Sapiens
agacaaagcguauuaaacagcacaggcacccaagcacuaccuuccagugagagaaaccaac

SEQ ID NO: 187190 - RNA, 61 nt, Homo Sapiens
ucuuccuuuuccacuuaggcgcucuggccccaagcacuauuccagagcugaucucucaucc

SEQ ID NO: 187191 - RNA, 61 nt, Homo Sapiens
uucuuguuuguuaguccuuuuguaaaugguaaagcacuauagagaauguaugugaaagauu

SEQ ID NO: 187192 - RNA, 61 nt, Homo Sapiens
ccuugccuugcuguuuguccgcuuaucuuagaagcacuacauguuuggggucuuuguggua

SEQ ID NO: 187193 - RNA, 61 nt, Homo Sapiens
gucuugggguugagcccuagcuugcuguguaaagcacuauugggucuuuguaggaguugcu

SEQ ID NO: 187194 - RNA, 61 nt, Homo Sapiens
ggaggcaacuguggcauugcuaccaacagugaagcacuacacacaaugaauuguccuuaau

SEQ ID NO: 187195 - RNA, 61 nt, Homo Sapiens
cugaguuuccucuuauaggugauggaaacaaaagcacuagaaaggaauguauagauguuug

SEQ ID NO: 187196 - RNA, 61 nt, Homo Sapiens
aaaaaaaagaguuuaaguggcuugucaugaaaagcacuaaauuuacaaggccuaucauguc

SEQ ID NO: 187197 - RNA, 61 nt, Homo Sapiens
auaaagauuauauaaagaccagugagacaaaaagcacuagugcacccacaaauaaaugaca

SEQ ID NO: 187198 - RNA, 61 nt, Homo Sapiens
aaugccagugaccuguguaaaguguuaagagaagcacuaagcgaauucauuaauuuacugu

SEQ ID NO: 187199 - RNA, 61 nt, Homo Sapiens
uauaaauauguuguuacugcagagcaaaaugaagcacuaggagcagaucugcuuuuuuucc

SEQ ID NO: 187200 - RNA, 61 nt, Homo Sapiens
agccuuagauuccuuuccuccaucaguacucaagcacuauauguucgcugcaguuguuccc

SEQ ID NO: 187201 - RNA, 61 nt, Homo Sapiens
uuccccagagcuugccagguaaauugucucuaagcacuacccucucuucaaccuucaucuc

SEQ ID NO: 187202 - RNA, 61 nt, Homo Sapiens
uuauauuuaaaaauuguuucaaauaucagacaagcacuauuuacugcacaguggcacaaaa

SEQ ID NO: 187203 - RNA, 61 nt, Homo Sapiens
aucuguaguuuuuuguuuuuguuuuuuuuuaaagcacuacaucuguuuucacuaauuguua

SEQ ID NO: 187204 - RNA, 61 nt, Homo Sapiens
aaccaguuagcugcuauauaaacacuauaccaagcacuaggcuuagaggaaaagaugucag

SEQ ID NO: 187205 - RNA, 61 nt, Homo Sapiens
aauaagguauauuuuuuagaaucaacuuuguaagcacuauaaaaucuuuaauaaguuauaa

SEQ ID NO: 187206 - RNA, 61 nt, Homo Sapiens
uaguuuucuguccugcaauauguauauaauuaagcacuaauuuguacugcuuagcauaaaa

SEQ ID NO: 187207 - RNA, 61 nt, Homo Sapiens
uacuucguggagcccagcgagcaucccgggcaagcacuaccaggcugugggucugcaccuc

SEQ ID NO: 187208 - RNA, 61 nt, Homo Sapiens
uguauccauuuaaacuaaccuuuuaucaauaaagcacuauuguuuagauauuaaaugagua

SEQ ID NO: 187209 - RNA, 61 nt, Homo Sapiens
aaaaacaaauauuuuguaccugcuuuugcagaagcacuaauuaugguuaacuucacgcagc

SEQ ID NO: 187210 - RNA, 61 nt, Homo Sapiens
uuauuuauagauauaucuaguuguuaccuuaaagcacuauuuuuaagucagccaaagaaua

SEQ ID NO: 187211 - RNA, 61 nt, Homo Sapiens
ugaauacgcaagaaggugagggagcgcaagcaagcacuauagcccggcaggagagccugca

SEQ ID NO: 187212 - RNA, 61 nt, Homo Sapiens
uuaaaacaucugcuuuuuaaaaguuggaauaaagcacuaugaaggaaguucauucaaggau

SEQ ID NO: 187213 - RNA, 61 nt, Homo Sapiens
cagucaguccccugggggaacauugugugauaagcacuaaguuaaaacuucacuaauauag

SEQ ID NO: 187214 - RNA, 61 nt, Homo Sapiens
gauacaagugucaguuucuuaguucucauuuaagcacuaguggaauuuuuuuuuuuugaua

SEQ ID NO: 187215 - RNA, 61 nt, Homo Sapiens
uuguuguuaauugggacuuucuguuaaugaaaagcacuauucccaagauuaauaguguucu

SEQ ID NO: 187216 - RNA, 61 nt, Homo Sapiens
ggacuuuagcugugaccucucuaacacagagaagcacuaacuuagauccucauucuuaaua

SEQ ID NO: 187217 - RNA, 61 nt, Homo Sapiens
aagaucugucaaucaagcaguagugugaaaaaagcacuauaagaaaaugcaucaucaguuu

SEQ ID NO: 187218 - RNA, 61 nt, Homo Sapiens
cugggguuggaagugugacuucuuacacauaaagcacuaccuaaguaauucucucucuguu

SEQ ID NO: 187219 - RNA, 61 nt, Homo Sapiens
uugaguucuguagagccuucugaugucucuaaagcacuaccgauucuuuggaguugucaca

SEQ ID NO: 187220 - RNA, 61 nt, Homo Sapiens
aauuuguccauuuaaaaaugucagaaauugaaagcacuaugcaagagggcuuuauuacacc

SEQ ID NO: 187221 - RNA, 61 nt, Homo Sapiens
uggcagggugaucaguccaaucuaaaggaagaagcacuaaaaagguggggccaguugcgau

SEQ ID NO: 187222 - RNA, 61 nt, Homo Sapiens
accccuggguagggaaagaacagucaagggaaagcacuagaaacccccaccccuucaggau

SEQ ID NO: 187223 - RNA, 61 nt, Homo Sapiens
uucuagucauuaacucaacgucaaguagugaaagcacuauaagaagaaaacagguuaacaa

SEQ ID NO: 187224 - RNA, 61 nt, Homo Sapiens
gaauuugcuguacacacugagcugggcucagaagcacuauaccaggggcagguaaagcccu

SEQ ID NO: 187225 - RNA, 61 nt, Homo Sapiens
uaguuuaaaaugucacuuuuuugaaagcaaaaagcacuaauugaauugugagcaaaagauc

SEQ ID NO: 187226 - RNA, 61 nt, Homo Sapiens
ucccaacaugaaauuauauuacucagauuuaaagcacuaucauuaaucuuucaaucuaauu

SEQ ID NO: 187227 - RNA, 61 nt, Homo Sapiens
guauacaggaggaugugaauagguuauaugcaagcacuaugcccuuuuauauaagugacuu

SEQ ID NO: 187228 - RNA, 61 nt, Homo Sapiens
guuauuauacuacuaauaauagagcacuuguaagcacuaaguuaucuuuauccaacauuuc

SEQ ID NO: 187229 - RNA, 61 nt, Homo Sapiens
auugacuuggagcaccuggaggauguaccagaagcacuagaccaggacgaccuccagcgcg

SEQ ID NO: 187230 - RNA, 61 nt, Homo Sapiens
uucaggaagcauguuguguuuguuauaacucaagcacuagcugaacuugcuguuaacacag

SEQ ID NO: 187231 - RNA, 61 nt, Homo Sapiens
cgacuaaccccuauugggguucaaguggaacaagcacuacaucuagaaagaucacuaaugg

SEQ ID NO: 187232 - RNA, 61 nt, Homo Sapiens
uuggcucuuucugcucacuaugccucacuucaagcacuaaucucccaucucuccucccuaa

SEQ ID NO: 187233 - RNA, 54 nt, Homo Sapiens
uagagaggaugaagcauuagcuugaagcacuacaggaggaaugcaccacggcag

SEQ ID NO: 187234 - RNA, 61 nt, Homo Sapiens
uucuguaaccuuuugaaaucuaguuacuaauaagcacuacuguaauuuagcacaguuuaac

SEQ ID NO: 187235 - RNA, 61 nt, Homo Sapiens
uucuaaagguguugucacuguauaaaacagaaagcacuaggauacaaaugaagcuuaauua

SEQ ID NO: 187236 - RNA, 61 nt, Homo Sapiens
gagcuauggcugcuuuuguagccuuuccaagaagcacuaaccugaaauaagauuagauaau

SEQ ID NO: 187237 - RNA, 61 nt, Homo Sapiens
uuccuaaagccacuauuguguuuucucuaagaagcacuacaugccaccagaauugugcacu

SEQ ID NO: 187238 - RNA, 61 nt, Homo Sapiens
uuugggcugugagcauuuagaacgagccuggaagcacuacagagcaucccacaggaccaca

SEQ ID NO: 187239 - RNA, 61 nt, Homo Sapiens
uaaacugacuuuauccucaggauucuacuuuaagcacuacauuccauuccagaauaucugg

SEQ ID NO: 187240 - RNA, 61 nt, Homo Sapiens
cuaagccaugaagaacuccauuuuguauagaaagcacuaccguaaaaaaccaaaaaggacu

SEQ ID NO: 187241 - RNA, 61 nt, Homo Sapiens
uccugcccuuuuugugugguggaauaaagaaaagcacuaaagguagugaauguguaguugg

SEQ ID NO: 187242 - RNA, 61 nt, Homo Sapiens
agacuucuguuuguucguucugauuugcuggaagcacuacaagcucuuuuuuccuuucugc

SEQ ID NO: 187243 - RNA, 61 nt, Homo Sapiens
uuagcuguuuucauuuaaugaugguuccuguaagcacuaaguguuuauacacagggagugu

SEQ ID NO: 187244 - RNA, 61 nt, Homo Sapiens
auauccagcuaaauggugcaaaaagauaccuaagcacuagaccuguucgugugguauauga

SEQ ID NO: 187245 - RNA, 61 nt, Homo Sapiens
cauauacgugaaaauuauuugaaaacauauaaagcacuauacagauucgaaacuccauuga

SEQ ID NO: 187246 - RNA, 61 nt, Homo Sapiens
uaguuaagaguggggucaccccuuuaacuccaagcacuacauuuuggcggcugccggccuc

SEQ ID NO: 187247 - RNA, 61 nt, Homo Sapiens
cuaauucuggggauagaaugauaaaagacucaagcacuaaaaauauacauugccgaaucuc

SEQ ID NO: 187248 - RNA, 61 nt, Homo Sapiens
uuuauguuuaaguauuuagaaaaaggugaaaaagcacuauuaucaguucugccuagguaaa

SEQ ID NO: 187249 - RNA, 61 nt, Homo Sapiens
aagcaaaaauuuuaacuguuuucuaauugucaagcacuauuuucauuaaaagugucuaaug

SEQ ID NO: 187250 - RNA, 61 nt, Homo Sapiens
acuucucaaaaauuguacaucuguguaacuaaagcacuaacaaaaacaugaauaguccuuc

SEQ ID NO: 187251 - RNA, 61 nt, Homo Sapiens
gcugccauuaaugaauuguuccuggaaucagaagcacuagugugaugggcugggguggguc

SEQ ID NO: 187252 - RNA, 61 nt, Homo Sapiens
cuucccagcuucccgccgccuagggcucuccaagcacuagcgcccugaaauggccuguccc

SEQ ID NO: 187253 - RNA, 61 nt, Homo Sapiens
acaccuagacuggaaauguguccucccuucaaagcacuaccgagcagagugauuucuugcu

SEQ ID NO: 187254 - RNA, 61 nt, Homo Sapiens
uuuucacagacaauaacuguugcaccuuuuaaagcacuacguuuagcaacacagguaaaaa

SEQ ID NO: 187255 - RNA, 61 nt, Homo Sapiens
agcuuuuuuuccauauugguaaaagaagccaaagcacuacuucucaagaauuacuggcuuu

SEQ ID NO: 187256 - RNA, 61 nt, Homo Sapiens
cauuuauugaaaaaaaaaaaaaaugcccccaaagcacuaugcuggucaugaacugcuucaa

SEQ ID NO: 187257 - RNA, 61 nt, Homo Sapiens
caaauacaucucucccuucuugaaaucccuaaagcacuaucgcacuccuaaaugcauuucu

SEQ ID NO: 187258 - RNA, 61 nt, Homo Sapiens
cauucuuuuuucuauuaagccauugaaagagaagcacuaagacugcuucuaggcuuuauuu

SEQ ID NO: 187259 - RNA, 61 nt, Homo Sapiens
uuuauuucuuuuuuuuuuaauugggggaaauaagcacuauuaacagauucagcacuacaag

SEQ ID NO: 187260 - RNA, 61 nt, Homo Sapiens
caguaacgcuacaaugaucacaauuauuacgaagcacuaaucgugauucucagugugauuc

SEQ ID NO: 187261 - RNA, 61 nt, Homo Sapiens
uccaaaauuauggcugaauaaauugagauugaagcacuaauauauauacauguaauaugaa

SEQ ID NO: 187262 - RNA, 61 nt, Homo Sapiens
acccuuguuaguuauuuuaggagacagucucaagcacuaaaaaguggcuaauucaauuuau

SEQ ID NO: 187263 - RNA, 61 nt, Homo Sapiens
auggcagauaugguauggaucguaaaauuuuaagcacuaaaaauuuuuucauaaccuuuca

SEQ ID NO: 187264 - RNA, 61 nt, Homo Sapiens
aaucuucuaaaggcuauacaauugaaugaggaagcacuaacaaaagcaguaguucaguaca

SEQ ID NO: 187265 - RNA, 61 nt, Homo Sapiens
ucaggcuaauuaguggauuaagcaauaaugaaagcacuaaguuugguuuugcuuuugugag

SEQ ID NO: 187266 - RNA, 61 nt, Homo Sapiens
gggcaauggaugcauuucccaaaacgugugaaagcacuaacagcuuauauugcugaaugag

SEQ ID NO: 187267 - RNA, 61 nt, Homo Sapiens
agcucuuuuggggguguaguaauaaugaagaaagcacuaggacuacuuacucugauggacc

SEQ ID NO: 187268 - RNA, 61 nt, Homo Sapiens
ucauaguccguguucaaaguucuaugucuucaagcacuauauguccauagagaagagguuu

SEQ ID NO: 187269 - RNA, 61 nt, Homo Sapiens
uuauucuguuuaaaauguacagcaaguguggaagcacuacuuuuaaauagaaaucacaaau

SEQ ID NO: 187270 - RNA, 61 nt, Homo Sapiens
aacuuaucuauggugauuaccuaaaguuccaaagcacuaaagaguacaaacugauucaguu

SEQ ID NO: 187271 - RNA, 61 nt, Homo Sapiens
acuuuaaauacuauuauuuggcuuagugcacaagcacuaucuauaucaaggucucagauga

SEQ ID NO: 187272 - RNA, 61 nt, Homo Sapiens
ggacucaccucuggagccuauggcuuuaagcaagcacuacugcacuuuacagaauuacccc

SEQ ID NO: 187273 - RNA, 61 nt, Homo Sapiens
aggguuuagcuguggcgcaguuuucagggccaagcacuauaagagcuuucuggguuaacgc

SEQ ID NO: 187274 - RNA, 61 nt, Homo Sapiens
aauaccauuuuuaagcaguaaaaagaugugaaagcacuaaauacaaauuccagauaucuac

SEQ ID NO: 187275 - RNA, 61 nt, Homo Sapiens
cugcaggaauccugagaaaagacagaguuuuaagcacuaugagacuuuaaaacucuggcug

SEQ ID NO: 187276 - RNA, 61 nt, Homo Sapiens
aucauggucaaguucccaacgcccagccagaaagcacuacaucuucccgaugagggaagga

SEQ ID NO: 187277 - RNA, 61 nt, Homo Sapiens
auauuguucccauauauuuacauagaagaugaagcacuauagauauguauuccaaaaaagu

SEQ ID NO: 187278 - RNA, 61 nt, Homo Sapiens
agaccaggcaacuuaccacuggagugagucaaagcacuaauagccucuguguaggugguag

SEQ ID NO: 187279 - RNA, 61 nt, Homo Sapiens
uuuauaacuuuuugaaacaacuggauuuuucaagcacuaaauuaguccuucuacuuaccug

SEQ ID NO: 187280 - RNA, 61 nt, Homo Sapiens
aggugggaggaggccugcacuuucucgcugaaagcacuaagcugcguaaugagacucaccu

SEQ ID NO: 187281 - RNA, 61 nt, Homo Sapiens
auguaauaaagugaugaacuuuauuuuaagaaagcacuaaguugauaugauauuacuguau

SEQ ID NO: 187282 - RNA, 61 nt, Homo Sapiens
cugcuaguuacaguguaggcguuaacuaguuaagcacuaugaaagggaagcagcauuucuu

SEQ ID NO: 187283 - RNA, 61 nt, Homo Sapiens
acuuuugguuucucgcauugccucucagacuaagcacuaaaaagcaaagcaaaacagaacu

SEQ ID NO: 187284 - RNA, 61 nt, Homo Sapiens
augccuuucaaacauugagacugcuagaaccaagcacuaccaguaucuccauccuuaacug

SEQ ID NO: 187285 - RNA, 61 nt, Homo Sapiens
cucucucuuuuuuugaguguagauuauuuuaaagcacuaauugcauuacauugguaacugc

SEQ ID NO: 187286 - RNA, 61 nt, Homo Sapiens
acuuuaauacaggcagugcucaaacuagaauaagcacuaauuaaaggaauuguuggggguc

SEQ ID NO: 187287 - RNA, 61 nt, Homo Sapiens
aaacacucguuuguuguuuuuaccagaaggaaagcacuaagucauuuaguugauauaaucc

SEQ ID NO: 187288 - RNA, 61 nt, Homo Sapiens
auaaaauucgucuuguuagaaccacuuuucaaagcacuacuaccaaucgguaaucugaucc

SEQ ID NO: 187289 - RNA, 61 nt, Homo Sapiens
aacuaaacaucuucaccagguggaucuuggaaagcacuagacaaauugacuucuccugagg

SEQ ID NO: 187290 - RNA, 61 nt, Homo Sapiens
gggcaaugggauuaaaccaaccaacauuggaaagcacuagaaaauggaggcaacauuuugg

SEQ ID NO: 187291 - RNA, 61 nt, Homo Sapiens
cccacuaaguuaaagacuucggaccaagcugaagcacuaauaauaauggggaaaauauuug

SEQ ID NO: 187292 - RNA, 61 nt, Homo Sapiens
cagggaguuuauuggaggaucaaagaacugaaagcacuagagcagccuuggggacugcuag

SEQ ID NO: 187293 - RNA, 61 nt, Homo Sapiens
accaaguggaaaggcaaguuggucuuauagaaagcacuacugcacuuaguagcuaugugau

SEQ ID NO: 187294 - RNA, 61 nt, Homo Sapiens
gggacgaaugacgaugcccauccacuaccugaagcacuaggacacucuugcagggccaggc

SEQ ID NO: 187295 - RNA, 61 nt, Homo Sapiens
agcacauugauuuggaguuucagaucuuccaaagcacuauuuguuguaauaacuuuucuaa

SEQ ID NO: 187296 - RNA, 61 nt, Homo Sapiens
gcccccggcucaagugcugcuccuuguccacaagcacuaugggcucuccuuggccucgccg

SEQ ID NO: 187297 - RNA, 61 nt, Homo Sapiens
augauucuaggcuguuaaauucugcugauggaagcacuaggacgccuuuuuuagcaagccu

SEQ ID NO: 187298 - RNA, 61 nt, Homo Sapiens
gacacaagaaucaaucagacuuucugggguuaagcacuaaguuaauggcugcugucuccag

SEQ ID NO: 187299 - RNA, 61 nt, Homo Sapiens
uuuuaaauucagcauuagugcugacuaggaaaagcacuacauuuugccagggaacaguuca

SEQ ID NO: 187300 - RNA, 61 nt, Homo Sapiens
aggcaguauauuacagaaacuuacaaacuccaagcacuaaaaagaagaaagggaagacaau

SEQ ID NO: 187301 - RNA, 61 nt, Homo Sapiens
uugguuuacuacuucaguaauaccaacuauaaagcacuaugcaauuuucugugaugaugua

SEQ ID NO: 187302 - RNA, 61 nt, Homo Sapiens
cauauccuuuaaacuaaauuaauauuuuuuaaagcacuacuggcauggagacuguggaggg

SEQ ID NO: 187303 - RNA, 61 nt, Homo Sapiens
uucucccuccucugucucaaacugcgcaggcaagcacuaugcaagcccaggcccucugcug

SEQ ID NO: 187304 - RNA, 61 nt, Homo Sapiens
cuauuuuuaaacauacuagucugcugauagaaagcacuauacauccuauuguuucuuucuu

SEQ ID NO: 187305 - RNA, 61 nt, Homo Sapiens
aagcauuguauuuuuuuuaacaaaucuaaaaaagcacuaugaacuacagguguuugacuuu

SEQ ID NO: 187306 - RNA, 61 nt, Homo Sapiens
cccugguacugccuggugccugccacaaaauaagcacuaacaaaaguguauuguuuaaaaa

SEQ ID NO: 187307 - RNA, 61 nt, Homo Sapiens
aagauuuugaauuauuauccagcagggcuggaagcacuagaugcagcaugagcacaacuau

SEQ ID NO: 187308 - RNA, 61 nt, Homo Sapiens
uuaaacaaaugauuuccacaaacagaucaggaagcacuagguuggcagagacacuuugucu

SEQ ID NO: 187309 - RNA, 61 nt, Homo Sapiens
uucuuuuaucuuuuuugcucuuaagaauacaaagcacuacagaucuaucaacaucacccca

SEQ ID NO: 187310 - RNA, 61 nt, Homo Sapiens
guuugucauuuauguaagucccaccuuuguaaagcacuaguuagaagauggagaacuccag

SEQ ID NO: 187311 - RNA, 61 nt, Homo Sapiens
cagaaaagaaaaaaaaaauaauuaagggguaaagcacuaaauuagaccguuaccuauaaga

SEQ ID NO: 187312 - RNA, 61 nt, Homo Sapiens
acuggucaguuuugugugauuucauaaauucaagcacuaccaauguucuguuuaauggcca

SEQ ID NO: 187313 - RNA, 61 nt, Homo Sapiens
acuuacuucauuguaacuaucuuaucuuuuuaagcacuaaagauuauccacauaaucaaag

SEQ ID NO: 187314 - RNA, 61 nt, Homo Sapiens
agagaugcgcgauacagguccuuugaggcccaagcacuagucaguuaggugaugagcacug

SEQ ID NO: 187315 - RNA, 61 nt, Homo Sapiens
cccagcagagucccggugccuucugaaugugaagcacuacauaugcaaagcauccaggcgg

SEQ ID NO: 187316 - RNA, 61 nt, Homo Sapiens
cagguaaaacacuggcccaaauuuauaauguaagcacuauccacuaagggcaaaaaccaau

SEQ ID NO: 187317 - RNA, 61 nt, Homo Sapiens
aagcgcuuaacguauauuuacuaccccucugaagcacuauucagcguauuagaguaaaagu

SEQ ID NO: 187318 - RNA, 61 nt, Homo Sapiens
auaauguguuaauauugcuauuaccuagguuaagcacuauugucugugcuaguaagaaaaa

SEQ ID NO: 187319 - RNA, 61 nt, Homo Sapiens
uguucagaaaguuuguuuuaaaguuuauuuuaagcacuaucguaccaaauauuucauauuu

SEQ ID NO: 187320 - RNA, 61 nt, Homo Sapiens
ccagagcagaaugaugccuugggauucacagaagcacuacuaaagccuuuguacaguuccu

SEQ ID NO: 187321 - RNA, 61 nt, Homo Sapiens
ccaaggcuauggaguagcucaauauaaagcaaagcacuauuaaauuacugcuuucucuaga

SEQ ID NO: 187322 - RNA, 61 nt, Homo Sapiens
ugagaaggaacugauacuuaguauaacuauaaagcacuagcggucucuuaaccuggcacca

SEQ ID NO: 187323 - RNA, 61 nt, Homo Sapiens
aaagcucuugauagaauguucuucuugguaaaagcacuaaaaaugcagcucucacuaacaa

SEQ ID NO: 187324 - RNA, 61 nt, Homo Sapiens
uuaaauugaagagucuacauucagaacauaaaagcacuagguauacaaguuugaaauauga

SEQ ID NO: 187325 - RNA, 61 nt, Homo Sapiens
ucuuaugaagcagcauuaugcaaggggaaaaaagcacuaugucuguguauguauguauaua

SEQ ID NO: 187326 - RNA, 61 nt, Homo Sapiens
auguaugugaucgucaauguucccuugcagcaagcacuacaaaaacaacugguuauaugcc

SEQ ID NO: 187327 - RNA, 61 nt, Homo Sapiens
ucuuugauccaguaguuucccaaaauuauaaaagcacuaacgacaauauggcaauguccuu

SEQ ID NO: 187328 - RNA, 61 nt, Homo Sapiens
ugugacagaugcagaucuuagaggacuuacaaagcacuauauugguaauucuuacaauggc

SEQ ID NO: 187329 - RNA, 61 nt, Homo Sapiens
gggaggaacaaauuuaaucauuucuucuguuaagcacuaaucaguauagugcaacuccugg

SEQ ID NO: 187330 - RNA, 61 nt, Homo Sapiens
ccuccuucaggaacacggggagcagaggccaaagcacuaaggggagggcgcauacccgaga

SEQ ID NO: 187331 - RNA, 61 nt, Homo Sapiens
cuuaucucagagugaagauacugcggcugaaaagcacuaguuugauauaaaauuaaaauga

SEQ ID NO: 187332 - RNA, 61 nt, Homo Sapiens
auuucauccucgaugggaauucuugcuagguaagcacuaauaacucggcaucuugacgaua

SEQ ID NO: 187333 - RNA, 61 nt, Homo Sapiens
cacacuauauuuuaauugaauucaaacuaucaagcacuacuuagaaacuggaaaacauaua

SEQ ID NO: 187334 - RNA, 61 nt, Homo Sapiens
gauguaccucuccccacuccccuugcuugagaagcacuacucaaaaauuuaccagaccuua

SEQ ID NO: 187335 - RNA, 61 nt, Homo Sapiens
cauuuagauaugccaaaagaauuaaaaucaaaagcacuaagaaauacauaguugugugaug

SEQ ID NO: 187336 - RNA, 61 nt, Homo Sapiens
ucuuuuaagagcugugaaugaaacuuuuucuaagcacuauucuauugcacacaaacagaaa

SEQ ID NO: 187337 - RNA, 61 nt, Homo Sapiens
uagggauggacauuaaaucuuguguguuuuaaagcacuagacaccaugccuggccuguaug

SEQ ID NO: 187338 - RNA, 61 nt, Homo Sapiens
cuuuguauuaccaaagcaaguuuguauaaauaagcacuauuacaaucuuucaccaaguaaa

SEQ ID NO: 187339 - RNA, 61 nt, Homo Sapiens
auuuauucuuccgcugucuguacucuucuugaagcacuauuuuaccuauccucucaaucac

SEQ ID NO: 187340 - RNA, 61 nt, Homo Sapiens
cccugcuucugguuugcugaagauuuucuagaagcacuauuuacacaaauaugcaaaugug

SEQ ID NO: 187341 - RNA, 61 nt, Homo Sapiens
uugaugacucugccccucagcagggcuuacuaagcacuaccccuuaacagggaugacuccg

SEQ ID NO: 187342 - RNA, 61 nt, Homo Sapiens
aacucaacuagcaggaagcgccaaaagaagaaagcacuaaauuaugaaauacaaugguguu

SEQ ID NO: 187343 - RNA, 61 nt, Homo Sapiens
gacuguaggagaaaagaaagugccaccuacaaagcacuagaguuaaacuccucuacuuaug

SEQ ID NO: 187344 - RNA, 61 nt, Homo Sapiens; identical to SEQ ID NO: 187343

SEQ ID NO: 187345 - RNA, 61 nt, Homo Sapiens
ccuuguuggguaacucagccauggagaugccaagcacuagccaggaggugaguuccucuuu

SEQ ID NO: 187346 - RNA, 61 nt, Homo Sapiens
aaacccacaggugcugcugcuuauaucugugaagcacuagcuuauucuaggaaugccugau

SEQ ID NO: 187347 - RNA, 61 nt, Homo Sapiens
cccucaaacgagaacaaaaaguauucccugcaagcacuaugaauggaccuuacuacucucu

SEQ ID NO: 187348 - RNA, 61 nt, Homo Sapiens
aagaaagacuguaagcuccaugauuagcauaaagcacuaaccaugucuccaugugacccga

SEQ ID NO: 187349 - RNA, 61 nt, Homo Sapiens
uugccaagagaggaugcaucuggggagagcaaagcacuaaggaauucagcaucagccugca

SEQ ID NO: 187350 - RNA, 61 nt, Homo Sapiens
cuauagaugccucuuaggacggcucccacauaagcacuaguuggagcugugccgaggcuug

SEQ ID NO: 187351 - RNA, 61 nt, Homo Sapiens
aauacucugcagugauuagacagccauaagaaagcacuauucuuugcucccugcaagaaau

SEQ ID NO: 187352 - RNA, 61 nt, Homo Sapiens
acguugaucuuaaccuuuuuccccugucuucaagcacuaaauuuuacauguaacugaaguu

SEQ ID NO: 187353 - RNA, 61 nt, Homo Sapiens
aaaucucaauauagagauuuagcugaaguguaagcacuagguggaaguugucauccguaaa

SEQ ID NO: 187354 - RNA, 61 nt, Homo Sapiens
agcaccuuucucaaggacaauuucccucuacaagcacuaggcauacugcacggacguagcg

SEQ ID NO: 187355 - RNA, 61 nt, Homo Sapiens
uuuugauaauaauauuguuuuucuuucuacaaagcacuagagaaugcacagauauacuuug

SEQ ID NO: 187356 - RNA, 61 nt, Homo Sapiens
gguuauuacuuuuuuuauaaccagauuuuuaaagcacuagguuuuaaaucaguggguauca

SEQ ID NO: 187357 - RNA, 61 nt, Homo Sapiens
ugaauucuuugggccuagaauauacuugagaaagcacuaguggcuuguguucagggagagg

SEQ ID NO: 187358 - RNA, 61 nt, Homo Sapiens
gaauuugcaaauucagaacauaaauucucauaagcacuauaaaacaauauaaaagccaaua

SEQ ID NO: 187359 - RNA, 61 nt, Homo Sapiens
cccagaaggagugauuuuucuaucggcacaaaagcacuauauggacugguaaugguuacag

SEQ ID NO: 187360 - RNA, 61 nt, Homo Sapiens
accaggccugcccuaaaagagcuccugaaggaagcacuaaacauggaaaggaacaacugau

SEQ ID NO: 187361 - RNA, 61 nt, Homo Sapiens
aacugaccaaagucacacugccaggaacuggaagcacuaggauuugacagcauauccaaau

SEQ ID NO: 187362 - RNA, 61 nt, Homo Sapiens
ccuuccacccccaggcacugcccugcauuucaagcacuacgccuucugcugacugccagau

SEQ ID NO: 187363 - RNA, 61 nt, Homo Sapiens
ucucccuuaauaaacucacagauucuaggauaagcacuagagaucauaggcagcaagggcu

SEQ ID NO: 187364 - RNA, 61 nt, Homo Sapiens
gccauaaauguuugcauaaugacauagcuuuaagcacuacaugauuuuaaucugcucacau

SEQ ID NO: 187365 - RNA, 61 nt, Homo Sapiens
uguuuuaaaugcuuucuacuugugguucaagaagcacuagauuuaguaagaaacucuaccu

SEQ ID NO: 187366 - RNA, 61 nt, Homo Sapiens
caagaagaugacugaguucuagagaccccacaagcacuauggacgaagcgugggaccccag

SEQ ID NO: 187367 - RNA, 61 nt, Homo Sapiens
uggccuaaaaaagcuacuacaauguauuaggaagcacuaaaauuuauucagauauggcucu

SEQ ID NO: 187368 - RNA, 61 nt, Homo Sapiens
gccuuauaugcagggaaggccgcucccaaaaaagcacuaugcaaguggauggauauucuag

SEQ ID NO: 187369 - RNA, 61 nt, Homo Sapiens
ucuuaaauaccucacugucuuggccauggggaagcacuauggccucagcugggggaaagac

SEQ ID NO: 187370 - RNA, 61 nt, Homo Sapiens
aguugccucauagccugcugguccuguaagcaagcacuaagcuccacagugccaguuccuu

SEQ ID NO: 187371 - RNA, 61 nt, Homo Sapiens
gaagagauaauuacaaucaggcuaccaaaggaagcacuaacuuuggugcuuucaaguuggc

SEQ ID NO: 187372 - RNA, 61 nt, Homo Sapiens
uugaaauuuaugugaauuauuuugauuguagaagcacuauaauaugugcugaaacuaaauu

SEQ ID NO: 187373 - RNA, 61 nt, Homo Sapiens
auuuuugaagcuguauacugugugcuaaaacaagcacuaaacaaagagugaaggauuuaug

SEQ ID NO: 187374 - RNA, 61 nt, Homo Sapiens
agauucugagaucuucccauucuaggccuacaagcacuacuugcuguagcugagacuuguc

SEQ ID NO: 187375 - RNA, 61 nt, Homo Sapiens
guguauuuuguuuccuuauagccauuaaagaaagcacuaaggaugaugggagcuccaaauc

SEQ ID NO: 187376 - RNA, 61 nt, Homo Sapiens
ccuaaugaaagcuauauacuugugcuaucuaaagcacuacuuuguaaagaugacuacccaa

SEQ ID NO: 187377 - RNA, 61 nt, Homo Sapiens
accugccauagugaguuuaaucauuucuacuaagcacuaggacauaggggaaaaaacgagg

SEQ ID NO: 187378 - RNA, 61 nt, Homo Sapiens
aaaagaaaugauugucuuuucaauaaauaucaagcacuaaaaaaagcauuggcauuauuuu

SEQ ID NO: 187379 - RNA, 61 nt, Homo Sapiens
aaacuggcuuauacuguaaucuacaacuaauaagcacuaauuuagaguucagcuauauugu

SEQ ID NO: 187380 - RNA, 61 nt, Homo Sapiens
gugaauacuuacauagugcuuacuauaugcuaagcacuauuuuuagcauguuauuuauauu

SEQ ID NO: 187381 - RNA, 62 nt, Homo Sapiens
gauucccuagaagagaacccucuacuuuuuguaagcacuacugacucucgcuguauuuaaga

SEQ ID NO: 187382 - RNA, 62 nt, Homo Sapiens
gacuuuacauuguaucuaaguuaaucuuuauaaagcacuagaauuuuuggucaaaagucaaa

SEQ ID NO: 187383 - RNA, 62 nt, Homo Sapiens
gggcagaaagcucuuagacaauggacuauccaaagcacuauuuaaauucugccucuuccuac

SEQ ID NO: 187384 - RNA, 62 nt, Homo Sapiens
uuagucuccccgccucauucccacccccaacaaagcacuaucauuuucauuuggaaugggua

SEQ ID NO: 187385 - RNA, 62 nt, Homo Sapiens
auauugaucuuuuuaucaugauccucccuaucaagcacuaaaaaguugaaccauuauacuuu

SEQ ID NO: 187386 - RNA, 62 nt, Homo Sapiens
cacugauccuuaguaacauguuaacauuuaugaagcacuauauauugauuugcaaaaucuuu

SEQ ID NO: 187387 - RNA, 62 nt, Homo Sapiens
uccaauguaauuggcugcgucuggcuaauucuaagcacuaaagucuacaucuaagcuauaga

SEQ ID NO: 187388 - RNA, 62 nt, Homo Sapiens
acuuagguucauugugccucaguuccucucaaaagcacuaaaucuaagugcaaacaaguauu

SEQ ID NO: 187389 - RNA, 62 nt, Homo Sapiens
gcuuuuugguaauauguuacaauuaaaaugacaagcacuauaucacaaucucuguuuguaug

SEQ ID NO: 187390 - RNA, 62 nt, Homo Sapiens
agacaaagcguauuaaacagccacaggcacccaagcacuaccguuccagugagagaaaccaa

SEQ ID NO: 187391 - RNA, 62 nt, Homo Sapiens
ucuuccuuuuccacuuaggccgcucuggccccaagcacuauucccagagcugaucucucauc

SEQ ID NO: 187392 - RNA, 62 nt, Homo Sapiens
uucuuguuuguuaguccuuuuuguaaaugguaaagcacuauaugagaauguaugugaaagau

SEQ ID NO: 187393 - RNA, 62 nt, Homo Sapiens
ccuugccuugcuguuuguccagcuuaucuuagaagcacuacaauguuuggggucuuuguggu

SEQ ID NO: 187394 - RNA, 62 nt, Homo Sapiens
gucuugggguugagcccuagucuugcuguguaaagcacuauuagggucuuuguaggaguugc

SEQ ID NO: 187395 - RNA, 62 nt, Homo Sapiens
ggaggcaacuguggcauugcuuaccaacagugaagcacuacaccacaaugaauuguccuuaa

SEQ ID NO: 187396 - RNA, 62 nt, Homo Sapiens
cugaguuuccucuuauagguggauggaaacaaaagcacuagaaaaggaauguauagauguuu

SEQ ID NO: 187397 - RNA, 62 nt, Homo Sapiens
aaaaaaaagaguuuaaguggccuugucaugaaaagcacuaaaauuuacaaggccuaucaugu

SEQ ID NO: 187398 - RNA, 62 nt, Homo Sapiens
auaaagauuauauaaagaccaagugagacaaaaagcacuaguggcacccacaaauaaaugac

SEQ ID NO: 187399 - RNA, 62 nt, Homo Sapiens
aaugccagugaccuguguaauaguguuaagagaagcacuaagccgaauucauuaauuuacug

SEQ ID NO: 187400 - RNA, 62 nt, Homo Sapiens
uauaaauauguuguuacugccagagcaaaaugaagcacuagggagcagaucugcuuuuuuuc

SEQ ID NO: 187401 - RNA, 62 nt, Homo Sapiens
agccuuagauuccuuuccucccaucaguacucaagcacuauacuguucgcugcaguuguucc

SEQ ID NO: 187402 - RNA, 62 nt, Homo Sapiens
uuccccagagcuugccaggucaaauugucucuaagcacuaccucucucuucaaccuucaucu

SEQ ID NO: 187403 - RNA, 62 nt, Homo Sapiens
uuauauuuaaaaauuguuucaaaauaucagacaagcacuauuauacugcacaguggcacaaa

SEQ ID NO: 187404 - RNA, 62 nt, Homo Sapiens
uaucuguaguuuuuuguuuuuguuuuuuuuuaaagcacuacaucuguuuucacuaauuguua

SEQ ID NO: 187405 - RNA, 62 nt, Homo Sapiens
aaaccaguuagcugcuauauaaacacuauaccaagcacuaggcuuagaggaaaagaugucag

SEQ ID NO: 187406 - RNA, 62 nt, Homo Sapiens
aaauaagguauauuuuuuagaaucaacuuuguaagcacuauaaaaucuuuaauaaguuauaa

SEQ ID NO: 187407 - RNA, 62 nt, Homo Sapiens
cuaguuuucuguccugcaauauguauauaauuaagcacuaauuuguacugcuuagcauaaaa

SEQ ID NO: 187408 - RNA, 62 nt, Homo Sapiens
auacuucguggagcccagcgagcaucccgggcaagcacuaccaggcugugggucugcaccuc

SEQ ID NO: 187409 - RNA, 62 nt, Homo Sapiens
uuguauccauuuaaacuaaccuuuuaucaauaaagcacuauuguuuagauauuaaaugagua

SEQ ID NO: 187410 - RNA, 62 nt, Homo Sapiens
aaaaacaaauauuuuguacccugcuuuugcagaagcacuaauguaugguuaacuucacgcag

SEQ ID NO: 187411 - RNA, 62 nt, Homo Sapiens
uuauuuauagauauaucuagauuguuaccuuaaagcacuauuauuuaagucagccaaagaau

SEQ ID NO: 187412 - RNA, 62 nt, Homo Sapiens
ugaauacgcaagaaggugagaggagcgcaagcaagcacuauaggcccggcaggagagccugc

SEQ ID NO: 187413 - RNA, 62 nt, Homo Sapiens
uuaaaacaucugcuuuuuaauaaguuggaauaaagcacuauggaaggaaguucauucaagga

SEQ ID NO: 187414 - RNA, 62 nt, Homo Sapiens
cagucaguccccugggggaagcauugugugauaagcacuaaguuuaaaacuucacuaauaua

SEQ ID NO: 187415 - RNA, 62 nt, Homo Sapiens
agauacaagugucaguuucuuaguucucauuuaagcacuaguggaauuuuuuuuuuuugaua

SEQ ID NO: 187416 - RNA, 62 nt, Homo Sapiens
auuguuguuaauugggacuuucuguuaaugaaaagcacuauucccaagauuaauaguguucu

SEQ ID NO: 187417 - RNA, 62 nt, Homo Sapiens
aggacuuuagcugugaccucucuaacacagagaagcacuaacuuagauccucauucuuaaua

SEQ ID NO: 187418 - RNA, 62 nt, Homo Sapiens
aaagaucugucaaucaagcaguagugugaaaaaagcacuauaagaaaaugcaucaucaguuu

SEQ ID NO: 187419 - RNA, 62 nt, Homo Sapiens
ucugggguuggaagugugacuucuuacacauaaagcacuaccuaaguaauucucucucuguu

SEQ ID NO: 187420 - RNA, 62 nt, Homo Sapiens
guugaguucuguagagccuucugaugucucuaaagcacuaccgauucuuuggaguugucaca

SEQ ID NO: 187421 - RNA, 62 nt, Homo Sapiens
aauuuguccauuuaaaaaugcucagaaauugaaagcacuaugccaagagggcuuuauuacac

SEQ ID NO: 187422 - RNA, 62 nt, Homo Sapiens
uggcagggugaucaguccaauucuaaaggaagaagcacuaaacaagguggggccaguugcga

SEQ ID NO: 187423 - RNA, 62 nt, Homo Sapiens
accccuggguagggaaagaaucagucaagggaaagcacuagauaacccccaccccuucagga

SEQ ID NO: 187424 - RNA, 62 nt, Homo Sapiens
uucuagucauuaacucaacgaucaaguagugaaagcacuauacagaagaaaacagguuaaca

SEQ ID NO: 187425 - RNA, 62 nt, Homo Sapiens
gaauuugcuguacacacugaugcugggcucagaagcacuauauccaggggcagguaaagccc

SEQ ID NO: 187426 - RNA, 62 nt, Homo Sapiens
uaguuuaaaaugucacuuuucuugaaagcaaaaagcacuaaugugaauugugagcaaaagau

SEQ ID NO: 187427 - RNA, 62 nt, Homo Sapiens
aucccaacaugaaauuauauuacucagauuuaaagcacuaucauuaaucuuucaaucuaauu

SEQ ID NO: 187428 - RNA, 62 nt, Homo Sapiens
aguauacaggaggaugugaauagguuauaugcaagcacuaugcccuuuuauauaagugacuu

SEQ ID NO: 187429 - RNA, 62 nt, Homo Sapiens
uguuauuauacuacuaauaauagagcacuuguaagcacuaaguuaucuuuauccaacauuuc

SEQ ID NO: 187430 - RNA, 62 nt, Homo Sapiens
cauugacuuggagcaccuggaggauguaccagaagcacuagaccaggacgaccuccagcgcg

SEQ ID NO: 187431 - RNA, 62 nt, Homo Sapiens
uucaggaagcauguuguguuguguuauaacucaagcacuagccugaacuugcuguuaacaca

SEQ ID NO: 187432 - RNA, 62 nt, Homo Sapiens
cgacuaaccccuauuggggugucaaguggaacaagcacuacauucuagaaagaucacuaaug

SEQ ID NO: 187433 - RNA, 62 nt, Homo Sapiens
uuggcucuuucugcucacuaaugccucacuucaagcacuaaugcucccaucucuccucccua

SEQ ID NO: 187434 - RNA, 54 nt, Homo Sapiens; identical to SEQ ID NO: 187233

SEQ ID NO: 187435 - RNA, 62 nt, Homo Sapiens
uuucuguaaccuuuugaaaucuaguuacuaauaagcacuacuguaauuuagcacaguuuaac

SEQ ID NO: 187436 - RNA, 62 nt, Homo Sapiens
auucuaaagguguugucacuguauaaaacagaaagcacuaggauacaaaugaagcuuaauua

SEQ ID NO: 187437 - RNA, 62 nt, Homo Sapiens
ugagcuauggcugcuuuuguagccuuuccaagaagcacuaaccugaaauaagauuagauaau

SEQ ID NO: 187438 - RNA, 62 nt, Homo Sapiens
auuccuaaagccacuauuguguuuucucuaagaagcacuacaugccaccagaauugugcacu

SEQ ID NO: 187439 - RNA, 62 nt, Homo Sapiens
cuuugggcugugagcauuuagaacgagccuggaagcacuacagagcaucccacaggaccaca

SEQ ID NO: 187440 - RNA, 62 nt, Homo Sapiens
uaaacugacuuuauccucagggauucuacuuuaagcacuacauuuccauuccagaauaucug

SEQ ID NO: 187441 - RNA, 62 nt, Homo Sapiens
cuaagccaugaagaacuccauuuuuguauagaaagcacuaccuguaaaaaaccaaaaaggac

SEQ ID NO: 187442 - RNA, 62 nt, Homo Sapiens
uccugcccuuuuuguguggugggaauaaagaaaagcacuaaaugguagugaauguguaguug

SEQ ID NO: 187443 - RNA, 62 nt, Homo Sapiens
agacuucuguuuguucguuccugauuugcuggaagcacuacagagcucuuuuuuccuuucug

SEQ ID NO: 187444 - RNA, 62 nt, Homo Sapiens
uuagcuguuuucauuuaauguaugguuccuguaagcacuaagauguuuauacacagggagug

SEQ ID NO: 187445 - RNA, 62 nt, Homo Sapiens
auauccagcuaaauggugcaaaaaagauaccuaagcacuagaaccuguucgugugguauaug

SEQ ID NO: 187446 - RNA, 62 nt, Homo Sapiens
ucauauacgugaaaauuauuugaaaacauauaaagcacuauacagauucgaaacuccauuga

SEQ ID NO: 187447 - RNA, 62 nt, Homo Sapiens
guaguuaagaguggggucaccccuuuaacuccaagcacuacauuuuggcggcugccggccuc

SEQ ID NO: 187448 - RNA, 62 nt, Homo Sapiens
gcuaauucuggggauagaaugauaaaagacucaagcacuaaaaauauacauugccgaaucuc

SEQ ID NO: 187449 - RNA, 62 nt, Homo Sapiens
auuuauguuuaaguauuuagaaaaaggugaaaaagcacuauuaucaguucugccuagguaaa

SEQ ID NO: 187450 - RNA, 62 nt, Homo Sapiens
aaagcaaaaauuuuaacuguuuucuaauugucaagcacuauuuucauuaaaagugucuaaug

SEQ ID NO: 187451 - RNA, 62 nt, Homo Sapiens
aacuucucaaaaauuguacaucuguguaacuaaagcacuaacaaaaacaugaauaguccuuc

SEQ ID NO: 187452 - RNA, 62 nt, Homo Sapiens
gcugccauuaaugaauuguucccuggaaucagaagcacuaguggugaugggcuggggugggu

SEQ ID NO: 187453 - RNA, 62 nt, Homo Sapiens
cuucccagcuucccgccgcccuagggcucuccaagcacuagcggcccugaaauggccugucc

SEQ ID NO: 187454 - RNA, 62 nt, Homo Sapiens
acaccuagacuggaaauguguuccucccuucaaagcacuaccggagcagagugauuucuugc

SEQ ID NO: 187455 - RNA, 62 nt, Homo Sapiens
uuuucacagacaauaacuguaugcaccuuuuaaagcacuacgauuuagcaacacagguaaaa

SEQ ID NO: 187456 - RNA, 62 nt, Homo Sapiens
agcuuuuuuuccauauugguuaaaagaagccaaagcacuacuuucucaagaauuacuggcuu

SEQ ID NO: 187457 - RNA, 62 nt, Homo Sapiens
ucauuuauugaaaaaaaaaaaaaaugcccccaaagcacuaugcuggucaugaacugcuucaa

SEQ ID NO: 187458 - RNA, 62 nt, Homo Sapiens
ccaaauacaucucucccuucuugaaaucccuaaagcacuaucgcacuccuaaaugcauuucu

SEQ ID NO: 187459 - RNA, 62 nt, Homo Sapiens
ucauucuuuuuucuauuaagccauugaaagagaagcacuaagacugcuucuaggcuuuauuu

SEQ ID NO: 187460 - RNA, 62 nt, Homo Sapiens
uuuuauuucuuuuuuuuuuaauugggggaaauaagcacuauuaacagauucagcacuacaag

SEQ ID NO: 187461 - RNA, 62 nt, Homo Sapiens
caguaacgcuacaaugaucaccaauuauuacgaagcacuaauacgugauucucagugugauu

SEQ ID NO: 187462 - RNA, 62 nt, Homo Sapiens
uccaaaauuauggcugaauaaaauugagauugaagcacuaauaauauauacauguaauauga

SEQ ID NO: 187463 - RNA, 62 nt, Homo Sapiens
uacccuuguuaguuauuuuaggagacagucucaagcacuaaaaaguggcuaauucaauuuau

SEQ ID NO: 187464 - RNA, 62 nt, Homo Sapiens
uauggcagauaugguauggaucguaaaauuuuaagcacuaaaaauuuuuucauaaccuuuca

SEQ ID NO: 187465 - RNA, 62 nt, Homo Sapiens
uaaucuucuaaaggcuauacaauugaaugaggaagcacuaacaaaagcaguaguucaguaca

SEQ ID NO: 187466 - RNA, 62 nt, Homo Sapiens
uucaggcuaauuaguggauuaagcaauaaugaaagcacuaaguuugguuuugcuuuugugag

SEQ ID NO: 187467 - RNA, 62 nt, Homo Sapiens
ggggcaauggaugcauuucccaaaacgugugaaagcacuaacagcuuauauugcugaaugag

SEQ ID NO: 187468 - RNA, 62 nt, Homo Sapiens
agcucuuuuggggguguagucaauaaugaagaaagcacuaggaacuacuuacucugauggac

SEQ ID NO: 187469 - RNA, 62 nt, Homo Sapiens
ucauaguccguguucaaaguuucuaugucuucaagcacuauaauguccauagagaagagguu

SEQ ID NO: 187470 - RNA, 62 nt, Homo Sapiens
uuauucuguuuaaaauguacuagcaaguguggaagcacuacuuuuuaaauagaaaucacaaa

SEQ ID NO: 187471 - RNA, 62 nt, Homo Sapiens
aacuuaucuauggugauuacucuaaaguuccaaagcacuaaaugaguacaaacugauucagu

SEQ ID NO: 187472 - RNA, 62 nt, Homo Sapiens
acuuuaaauacuauuauuugagcuuagugcacaagcacuaucuuauaucaaggucucagaug

SEQ ID NO: 187473 - RNA, 62 nt, Homo Sapiens
uggacucaccucuggagccuauggcuuuaagcaagcacuacugcacuuuacagaauuacccc

SEQ ID NO: 187474 - RNA, 62 nt, Homo Sapiens
aggguuuagcuguggcgcagcuuuucagggccaagcacuauaaagagcuuucuggguuaacg

SEQ ID NO: 187475 - RNA, 62 nt, Homo Sapiens
aauaccauuuuuaagcaguacaaaagaugugaaagcacuaaauuacaaauuccagauaucua

SEQ ID NO: 187476 - RNA, 62 nt, Homo Sapiens
cugcaggaauccugagaaaaggacagaguuuuaagcacuaugaagacuuuaaaacucuggcu

SEQ ID NO: 187477 - RNA, 62 nt, Homo Sapiens
aucauggucaaguucccaacagcccagccagaaagcacuacagucuucccgaugagggaagg

SEQ ID NO: 187478 - RNA, 62 nt, Homo Sapiens
auauuguucccauauauuuaucauagaagaugaagcacuauaugauauguauuccaaaaaag

SEQ ID NO: 187479 - RNA, 62 nt, Homo Sapiens
agaccaggcaacuuaccacugggagugagucaaagcacuaauaagccucuguguagguggua

SEQ ID NO: 187480 - RNA, 62 nt, Homo Sapiens
uuuauaacuuuuugaaacaagcuggauuuuucaagcacuaaaguuaguccuucuacuuaccu

SEQ ID NO: 187481 - RNA, 62 nt, Homo Sapiens
aggugggaggaggccugcacuuuucucgcugaaagcacuaagucugcguaaugagacucacc

SEQ ID NO: 187482 - RNA, 62 nt, Homo Sapiens
auguaauaaagugaugaacuuuuauuuuaagaaagcacuaaguuugauaugauauuacugua

SEQ ID NO: 187483 - RNA, 62 nt, Homo Sapiens
cugcuaguuacaguguaggcuguuaacuaguuaagcacuaugcaaagggaagcagcauuucu

SEQ ID NO: 187484 - RNA, 62 nt, Homo Sapiens
gacuuuugguuucucgcauugccucucagacuaagcacuaaaaagcaaagcaaaacagaacu

SEQ ID NO: 187485 - RNA, 62 nt, Homo Sapiens
aaugccuuucaaacauugagacugcuagaaccaagcacuaccaguaucuccauccuuaacug

SEQ ID NO: 187486 - RNA, 62 nt, Homo Sapiens
ucucucucuuuuuuugaguguagauuauuuuaaagcacuaauugcauuacauugguaacugc

SEQ ID NO: 187487 - RNA, 62 nt, Homo Sapiens
gacuuuaauacaggcagugcucaaacuagaauaagcacuaauuaaaggaauuguuggggguc

SEQ ID NO: 187488 - RNA, 62 nt, Homo Sapiens
aaacacucguuuguuguuuucuaccagaaggaaagcacuaaguucauuuaguugauauaauc

SEQ ID NO: 187489 - RNA, 62 nt, Homo Sapiens
auaaaauucgucuuguuagacaccacuuuucaaagcacuacuaaccaaucgguaaucugauc

SEQ ID NO: 187490 - RNA, 62 nt, Homo Sapiens
aacuaaacaucuucaccaggguggaucuuggaaagcacuagaacaaauugacuucuccugag

SEQ ID NO: 187491 - RNA, 62 nt, Homo Sapiens
gggcaaugggauuaaaccaagccaacauuggaaagcacuagaaaaauggaggcaacauuuug

SEQ ID NO: 187492 - RNA, 62 nt, Homo Sapiens
cccacuaaguuaaagacuucgggaccaagcugaagcacuaaucaauaauggggaaaauauuu

SEQ ID NO: 187493 - RNA, 62 nt, Homo Sapiens
ucagggaguuuauuggaggaucaaagaacugaaagcacuagagcagccuuggggacugcuag

SEQ ID NO: 187494 - RNA, 62 nt, Homo Sapiens
aaccaaguggaaaggcaaguuggucuuauagaaagcacuacugcacuuaguagcuaugugau

SEQ ID NO: 187495 - RNA, 62 nt, Homo Sapiens
ugggacgaaugacgaugcccauccacuaccugaagcacuaggacacucuugcagggccaggc

SEQ ID NO: 187496 - RNA, 62 nt, Homo Sapiens
gagcacauugauuuggaguuucagaucuuccaaagcacuauuuguuguaauaacuuuucuaa

SEQ ID NO: 187497 - RNA, 62 nt, Homo Sapiens
gcccccggcucaagugcugcguccuuguccacaagcacuauguggcucuccuuggccucgcc

SEQ ID NO: 187498 - RNA, 62 nt, Homo Sapiens
augauucuaggcuguuaaauuucugcugauggaagcacuaggcacgccuuuuuuagcaagcc

SEQ ID NO: 187499 - RNA, 62 nt, Homo Sapiens
gacacaagaaucaaucagacguuucugggguuaagcacuaagauuaauggcugcugucucca

SEQ ID NO: 187500 - RNA, 62 nt, Homo Sapiens
uuuuaaauucagcauuagugacugacuaggaaaagcacuacaauuuugccagggaacaguuc

SEQ ID NO: 187501 - RNA, 62 nt, Homo Sapiens
aggcaguauauuacagaaacuuuacaaacuccaagcacuaaaaaagaagaaagggaagacaa

SEQ ID NO: 187502 - RNA, 62 nt, Homo Sapiens
uugguuuacuacuucaguaaauaccaacuauaaagcacuaugucaauuuucugugaugaugu

SEQ ID NO: 187503 - RNA, 62 nt, Homo Sapiens
cauauccuuuaaacuaaauugaauauuuuuuaaagcacuacuuggcauggagacuguggagg

SEQ ID NO: 187504 - RNA, 62 nt, Homo Sapiens
cuucucccuccucugucucaaacugcgcaggcaagcacuaugcaagcccaggcccucugcug

SEQ ID NO: 187505 - RNA, 62 nt, Homo Sapiens
acuauuuuuaaacauacuagucugcugauagaaagcacuauacauccuauuguuucuuucuu

SEQ ID NO: 187506 - RNA, 62 nt, Homo Sapiens
uaagcauuguauuuuuuuuaacaaaucuaaaaaagcacuaugaacuacagguguuugacuuu

SEQ ID NO: 187507 - RNA, 62 nt, Homo Sapiens
acccugguacugccuggugccugccacaaaauaagcacuaacaaaaguguauuguuuaaaaa

SEQ ID NO: 187508 - RNA, 62 nt, Homo Sapiens
gaagauuuugaauuauuauccagcagggcuggaagcacuagaugcagcaugagcacaacuau

SEQ ID NO: 187509 - RNA, 62 nt, Homo Sapiens
guuaaacaaaugauuuccacaaacagaucaggaagcacuagguuggcagagacacuuugucu

SEQ ID NO: 187510 - RNA, 62 nt, Homo Sapiens
uucuuuuaucuuuuuugcucauuaagaauacaaagcacuacaugaucuaucaacaucacccc

SEQ ID NO: 187511 - RNA, 62 nt, Homo Sapiens
guuugucauuuauguaagucgccaccuuuguaaagcacuaguuuagaagauggagaacucca

SEQ ID NO: 187512 - RNA, 62 nt, Homo Sapiens
cagaaaagaaaaaaaaaauaaauuaagggguaaagcacuaaaauuagaccguuaccuauaag

SEQ ID NO: 187513 - RNA, 62 nt, Homo Sapiens
acuggucaguuuugugugauauucauaaauucaagcacuaccaaauguucuguuuaauggcc

SEQ ID NO: 187514 - RNA, 62 nt, Homo Sapiens
acuuacuucauuguaacuaugcuuaucuuuuuaagcacuaaaggauuauccacauaaucaaa

SEQ ID NO: 187515 - RNA, 62 nt, Homo Sapiens
agagaugcgcgauacaggucgcuuugaggcccaagcacuagugcaguuaggugaugagcacu

SEQ ID NO: 187516 - RNA, 62 nt, Homo Sapiens
cccagcagagucccggugccguucugaaugugaagcacuacacuaugcaaagcauccaggcg

SEQ ID NO: 187517 - RNA, 62 nt, Homo Sapiens
cagguaaaacacuggcccaauauuuauaauguaagcacuaucgcacuaagggcaaaaaccaa

SEQ ID NO: 187518 - RNA, 62 nt, Homo Sapiens
aagcgcuuaacguauauuuaucuaccccucugaagcacuauugcagcguauuagaguaaaag

SEQ ID NO: 187519 - RNA, 62 nt, Homo Sapiens
gauaauguguuaauauugcuauuaccuagguuaagcacuauugucugugcuaguaagaaaaa

SEQ ID NO: 187520 - RNA, 62 nt, Homo Sapiens
uuguucagaaaguuuguuuuaaaguuuauuuuaagcacuaucguaccaaauauuucauauuu

SEQ ID NO: 187521 - RNA, 62 nt, Homo Sapiens
ccagagcagaaugaugccuuugggauucacagaagcacuacugaaagccuuuguacaguucc

SEQ ID NO: 187522 - RNA, 62 nt, Homo Sapiens
ccaaggcuauggaguagcucaaauauaaagcaaagcacuauugaaauuacugcuuucucuag

SEQ ID NO: 187523 - RNA, 62 nt, Homo Sapiens
ugagaaggaacugauacuuaaguauaacuauaaagcacuagcaggucucuuaaccuggcacc

SEQ ID NO: 187524 - RNA, 62 nt, Homo Sapiens
aaagcucuugauagaauguuacuucuugguaaaagcacuaaagaaugcagcucucacuaaca

SEQ ID NO: 187525 - RNA, 62 nt, Homo Sapiens
auuaaauugaagagucuacauucagaacauaaaagcacuagguauacaaguuugaaauauga

SEQ ID NO: 187526 - RNA, 62 nt, Homo Sapiens
uucuuaugaagcagcauuaugcaaggggaaaaaagcacuaugucuguguauguauguauaua

SEQ ID NO: 187527 - RNA, 62 nt, Homo Sapiens
auguaugugaucgucaaugucucccuugcagcaagcacuacacaaaacaacugguuauaugc

SEQ ID NO: 187528 - RNA, 62 nt, Homo Sapiens
ucuuugauccaguaguuuccucaaaauuauaaaagcacuaacggacaauauggcaauguccu

SEQ ID NO: 187529 - RNA, 62 nt, Homo Sapiens
augugacagaugcagaucuuagaggacuuacaaagcacuauauugguaauucuuacaauggc

SEQ ID NO: 187530 - RNA, 62 nt, Homo Sapiens
ugggaggaacaaauuuaaucauuucuucuguuaagcacuaaucaguauagugcaacuccugg

SEQ ID NO: 187531 - RNA, 62 nt, Homo Sapiens
uccuccuucaggaacacggggagcagaggccaaagcacuaaggggagggcgcauacccgaga

SEQ ID NO: 187532 - RNA, 62 nt, Homo Sapiens
gcuuaucucagagugaagauacugcggcugaaaagcacuaguuugauauaaaauuaaaauga

SEQ ID NO: 187533 - RNA, 62 nt, Homo Sapiens
uauuucauccucgaugggaauucuugcuagguaagcacuaauaacucggcaucuugacgaua

SEQ ID NO: 187534 - RNA, 62 nt, Homo Sapiens
acacacuauauuuuaauugaauucaaacuaucaagcacuacuuagaaacuggaaaacauaua

SEQ ID NO: 187535 - RNA, 62 nt, Homo Sapiens
ggauguaccucuccccacuccccuugcuugagaagcacuacucaaaaauuuaccagaccuua

SEQ ID NO: 187536 - RNA, 62 nt, Homo Sapiens
acauuuagauaugccaaaagaauuaaaaucaaaagcacuaagaaauacauaguugugugaug

SEQ ID NO: 187537 - RNA, 62 nt, Homo Sapiens
uucuuuuaagagcugugaaugaaacuuuuucuaagcacuauucuauugcacacaaacagaaa

SEQ ID NO: 187538 - RNA, 62 nt, Homo Sapiens
uagggauggacauuaaaucuguguguguuuuaaagcacuagaccaccaugccuggccuguau

SEQ ID NO: 187539 - RNA, 62 nt, Homo Sapiens
cuuuguauuaccaaagcaagauuuguauaaauaagcacuauuuacaaucuuucaccaaguaa

SEQ ID NO: 187540 - RNA, 62 nt, Homo Sapiens
auuuauucuuccgcugucugcuacucuucuugaagcacuauuuuuaccuauccucucaauca

SEQ ID NO: 187541 - RNA, 62 nt, Homo Sapiens
ucccugcuucugguuugcugaagauuuucuagaagcacuauuuacacaaauaugcaaaugug

SEQ ID NO: 187542 - RNA, 62 nt, Homo Sapiens
uuugaugacucugccccucagcagggcuuacuaagcacuaccccuuaacagggaugacuccg

SEQ ID NO: 187543 - RNA, 62 nt, Homo Sapiens
aacucaacuagcaggaagcguccaaaagaagaaagcacuaaaauuaugaaauacaauggugu

SEQ ID NO: 187544 - RNA, 62 nt, Homo Sapiens
gacuguaggagaaaagaaaggugccaccuacaaagcacuagaaguuaaacuccucuacuuau

SEQ ID NO: 187545 - RNA, 62 nt, Homo Sapiens; identical to SEQ ID NO: 187544

SEQ ID NO: 187546 - RNA, 62 nt, Homo Sapiens
uccuuguuggguaacucagccauggagaugccaagcacuagccaggaggugaguuccucuuu

SEQ ID NO: 187547 - RNA, 62 nt, Homo Sapiens
aaaacccacaggugcugcugcuuauaucugugaagcacuagcuuauucuaggaaugccugau

SEQ ID NO: 187548 - RNA, 62 nt, Homo Sapiens
ccccucaaacgagaacaaaaaguauucccugcaagcacuaugaauggaccuuacuacucucu

SEQ ID NO: 187549 - RNA, 62 nt, Homo Sapiens
aaagaaagacuguaagcuccaugauuagcauaaagcacuaaccaugucuccaugugacccga

SEQ ID NO: 187550 - RNA, 62 nt, Homo Sapiens
auugccaagagaggaugcaucuggggagagcaaagcacuaaggaauucagcaucagccugca

SEQ ID NO: 187551 - RNA, 62 nt, Homo Sapiens
cuauagaugccucuuaggacgggcucccacauaagcacuaguauggagcugugccgaggcuu

SEQ ID NO: 187552 - RNA, 62 nt, Homo Sapiens
aauacucugcagugauuagaucagccauaagaaagcacuauuucuuugcucccugcaagaaa

SEQ ID NO: 187553 - RNA, 62 nt, Homo Sapiens
acguugaucuuaaccuuuuuuccccugucuucaagcacuaaaauuuuacauguaacugaagu

SEQ ID NO: 187554 - RNA, 62 nt, Homo Sapiens
aaaucucaauauagagauuuaagcugaaguguaagcacuaggauggaaguugucauccguaa

SEQ ID NO: 187555 - RNA, 62 nt, Homo Sapiens
agcaccuuucucaaggacaaguuucccucuacaagcacuaggccauacugcacggacguagc

SEQ ID NO: 187556 - RNA, 62 nt, Homo Sapiens
auuuugauaauaauauuguuuuucuuucuacaaagcacuagagaaugcacagauauacuuug

SEQ ID NO: 187557 - RNA, 62 nt, Homo Sapiens
agguuauuacuuuuuuuauaaccagauuuuuaaagcacuagguuuuaaaucaguggguauca

SEQ ID NO: 187558 - RNA, 62 nt, Homo Sapiens
uugaauucuuugggccuagaauauacuugagaaagcacuaguggcuuguguucagggagagg

SEQ ID NO: 187559 - RNA, 62 nt, Homo Sapiens
gaauuugcaaauucagaacaauaaauucucauaagcacuauacaaacaauauaaaagccaau

SEQ ID NO: 187560 - RNA, 62 nt, Homo Sapiens
ccccagaaggagugauuuuucuaucggcacaaaagcacuauauggacugguaaugguuacag

SEQ ID NO: 187561 - RNA, 62 nt, Homo Sapiens
caccaggccugcccuaaaagagcuccugaaggaagcacuaaacauggaaaggaacaacugau

SEQ ID NO: 187562 - RNA, 62 nt, Homo Sapiens
uaacugaccaaagucacacugccaggaacuggaagcacuaggauuugacagcauauccaaau

SEQ ID NO: 187563 - RNA, 62 nt, Homo Sapiens
ccuuccacccccaggcacugucccugcauuucaagcacuacguccuucugcugacugccaga

SEQ ID NO: 187564 - RNA, 62 nt, Homo Sapiens
ucucccuuaauaaacucacaugauucuaggauaagcacuagaagaucauaggcagcaagggc

SEQ ID NO: 187565 - RNA, 62 nt, Homo Sapiens
ugccauaaauguuugcauaaugacauagcuuuaagcacuacaugauuuuaaucugcucacau

SEQ ID NO: 187566 - RNA, 62 nt, Homo Sapiens
auguuuuaaaugcuuucuacuugugguucaagaagcacuagauuuaguaagaaacucuaccu

SEQ ID NO: 187567 - RNA, 62 nt, Homo Sapiens
acaagaagaugacugaguucuagagaccccacaagcacuauggacgaagcgugggaccccag

SEQ ID NO: 187568 - RNA, 62 nt, Homo Sapiens
uggccuaaaaaagcuacuacuaauguauuaggaagcacuaaacauuuauucagauauggcuc

SEQ ID NO: 187569 - RNA, 62 nt, Homo Sapiens
gccuuauaugcagggaaggcgcgcucccaaaaaagcacuaugucaaguggauggauauucua

SEQ ID NO: 187570 - RNA, 62 nt, Homo Sapiens
uucuuaaauaccucacugucuuggccauggggaagcacuauggccucagcugggggaaagac

SEQ ID NO: 187571 - RNA, 62 nt, Homo Sapiens
caguugccucauagccugcugguccuguaagcaagcacuaagcuccacagugccaguuccuu

SEQ ID NO: 187572 - RNA, 62 nt, Homo Sapiens
agaagagauaauuacaaucaggcuaccaaaggaagcacuaacuuuggugcuuucaaguuggc

SEQ ID NO: 187573 - RNA, 62 nt, Homo Sapiens
auugaaauuuaugugaauuauuuugauuguagaagcacuauaauaugugcugaaacuaaauu

SEQ ID NO: 187574 - RNA, 62 nt, Homo Sapiens
gauuuuugaagcuguauacugugugcuaaaacaagcacuaaacaaagagugaaggauuuaug

SEQ ID NO: 187575 - RNA, 62 nt, Homo Sapiens
uagauucugagaucuucccauucuaggccuacaagcacuacuugcuguagcugagacuuguc

SEQ ID NO: 187576 - RNA, 62 nt, Homo Sapiens
uguguauuuuguuuccuuauagccauuaaagaaagcacuaaggaugaugggagcuccaaauc

SEQ ID NO: 187577 - RNA, 62 nt, Homo Sapiens
gccuaaugaaagcuauauacuugugcuaucuaaagcacuacuuuguaaagaugacuacccaa

SEQ ID NO: 187578 - RNA, 62 nt, Homo Sapiens
accugccauagugaguuuaagucauuucuacuaagcacuaggaacauaggggaaaaaacgag

SEQ ID NO: 187579 - RNA, 62 nt, Homo Sapiens
aaaagaaaugauugucuuuuucaauaaauaucaagcacuaaaaaaaagcauuggcauuauuu

SEQ ID NO: 187580 - RNA, 62 nt, Homo Sapiens
aaaacuggcuuauacuguaaucuacaacuaauaagcacuaauuuagaguucagcuauauugu

SEQ ID NO: 187581 - RNA, 62 nt, Homo Sapiens
agugaauacuuacauagugcuuacuauaugcuaagcacuauuuuuagcauguuauuuauauu

SEQ ID NO: 187582 - RNA, 63 nt, Homo Sapiens
ugauucccuagaagagaacccucuacuuuuuguaagcacuacugacucucgcuguauuuaaga

SEQ ID NO: 187583 - RNA, 63 nt, Homo Sapiens
agacuuuacauuguaucuaaguuaaucuuuauaaagcacuagaauuuuuggucaaaagucaaa

SEQ ID NO: 187584 - RNA, 63 nt, Homo Sapiens
ugggcagaaagcucuuagacaauggacuauccaaagcacuauuuaaauucugccucuuccuac

SEQ ID NO: 187585 - RNA, 63 nt, Homo Sapiens
uuuagucuccccgccucauucccacccccaacaaagcacuaucauuuucauuuggaaugggua

SEQ ID NO: 187586 - RNA, 63 nt, Homo Sapiens
cauauugaucuuuuuaucaugauccucccuaucaagcacuaaaaaguugaaccauuauacuuu

SEQ ID NO: 187587 - RNA, 63 nt, Homo Sapiens
ucacugauccuuaguaacauguuaacauuuaugaagcacuauauauugauuugcaaaaucuuu

SEQ ID NO: 187588 - RNA, 63 nt, Homo Sapiens
auccaauguaauuggcugcgucuggcuaauucuaagcacuaaagucuacaucuaagcuauaga

SEQ ID NO: 187589 - RNA, 63 nt, Homo Sapiens
cacuuagguucauugugccucaguuccucucaaaagcacuaaaucuaagugcaaacaaguauu

SEQ ID NO: 187590 - RNA, 63 nt, Homo Sapiens
agcuuuuugguaauauguuacaauuaaaaugacaagcacuauaucacaaucucuguuuguaug

SEQ ID NO: 187591 - RNA, 63 nt, Homo Sapiens
agacaaagcguauuaaacagaccacaggcacccaagcacuaccgguuccagugagagaaacca

SEQ ID NO: 187592 - RNA, 63 nt, Homo Sapiens
ucuuccuuuuccacuuaggcccgcucuggccccaagcacuauugcccagagcugaucucucau

SEQ ID NO: 187593 - RNA, 63 nt, Homo Sapiens
uucuuguuuguuaguccuuuuuuguaaaugguaaagcacuauaaugagaauguaugugaaaga

SEQ ID NO: 187594 - RNA, 63 nt, Homo Sapiens
ccuugccuugcuguuuguccuagcuuaucuuagaagcacuacagauguuuggggucuuugugg

SEQ ID NO: 187595 - RNA, 63 nt, Homo Sapiens
gucuugggguugagcccuagcucuugcuguguaaagcacuauugagggucuuuguaggaguug

SEQ ID NO: 187596 - RNA, 63 nt, Homo Sapiens
ggaggcaacuguggcauugcauuaccaacagugaagcacuacaaccacaaugaauuguccuua

SEQ ID NO: 187597 - RNA, 63 nt, Homo Sapiens
cugaguuuccucuuauagguuggauggaaacaaaagcacuagauaaaggaauguauagauguu

SEQ ID NO: 187598 - RNA, 63 nt, Homo Sapiens
aaaaaaaagaguuuaagugguccuugucaugaaaagcacuaaaaauuuacaaggccuaucaug

SEQ ID NO: 187599 - RNA, 63 nt, Homo Sapiens
auaaagauuauauaaagacccaagugagacaaaaagcacuaguaggcacccacaaauaaauga

SEQ ID NO: 187600 - RNA, 63 nt, Homo Sapiens
aaugccagugaccuguguaaguaguguuaagagaagcacuaaggccgaauucauuaauuuacu

SEQ ID NO: 187601 - RNA, 63 nt, Homo Sapiens
uauaaauauguuguuacugcccagagcaaaaugaagcacuaggagagcagaucugcuuuuuuu

SEQ ID NO: 187602 - RNA, 63 nt, Homo Sapiens
agccuuagauuccuuuccuccccaucaguacucaagcacuauagcuguucgcugcaguuguuc

SEQ ID NO: 187603 - RNA, 63 nt, Homo Sapiens
uuccccagagcuugccagguucaaauugucucuaagcacuaccgucucucuucaaccuucauc

SEQ ID NO: 187604 - RNA, 63 nt, Homo Sapiens
uuauauuuaaaaauuguuucaaaaauaucagacaagcacuauuuauacugcacaguggcacaa

SEQ ID NO: 187605 - RNA, 63 nt, Homo Sapiens
auaucuguaguuuuuuguuuuuguuuuuuuuuaaagcacuacaucuguuuucacuaauuguua

SEQ ID NO: 187606 - RNA, 63 nt, Homo Sapiens
aaaaccaguuagcugcuauauaaacacuauaccaagcacuaggcuuagaggaaaagaugucag

SEQ ID NO: 187607 - RNA, 63 nt, Homo Sapiens
caaauaagguauauuuuuuagaaucaacuuuguaagcacuauaaaaucuuuaauaaguuauaa

SEQ ID NO: 187608 - RNA, 63 nt, Homo Sapiens
ucuaguuuucuguccugcaauauguauauaauuaagcacuaauuuguacugcuuagcauaaaa

SEQ ID NO: 187609 - RNA, 63 nt, Homo Sapiens
cauacuucguggagcccagcgagcaucccgggcaagcacuaccaggcugugggucugcaccuc

SEQ ID NO: 187610 - RNA, 63 nt, Homo Sapiens
uuuguauccauuuaaacuaaccuuuuaucaauaaagcacuauuguuuagauauuaaaugagua

SEQ ID NO: 187611 - RNA, 63 nt, Homo Sapiens
aaaaacaaauauuuuguaccgcugcuuuugcagaagcacuaauaguaugguuaacuucacgca

SEQ ID NO: 187612 - RNA, 63 nt, Homo Sapiens
uuauuuauagauauaucuaguauuguuaccuuaaagcacuauucauuuaagucagccaaagaa

SEQ ID NO: 187613 - RNA, 63 nt, Homo Sapiens
ugaauacgcaagaaggugagcaggagcgcaagcaagcacuauagggcccggcaggagagccug

SEQ ID NO: 187614 - RNA, 63 nt, Homo Sapiens
uuaaaacaucugcuuuuuaaauaaguuggaauaaagcacuaugugaaggaaguucauucaagg

SEQ ID NO: 187615 - RNA, 63 nt, Homo Sapiens
cagucaguccccugggggaaagcauugugugauaagcacuaaguuuuaaaacuucacuaauau

SEQ ID NO: 187616 - RNA, 63 nt, Homo Sapiens
cagauacaagugucaguuucuuaguucucauuuaagcacuaguggaauuuuuuuuuuuugaua

SEQ ID NO: 187617 - RNA, 63 nt, Homo Sapiens
uauuguuguuaauugggacuuucuguuaaugaaaagcacuauucccaagauuaauaguguucu

SEQ ID NO: 187618 - RNA, 63 nt, Homo Sapiens
uaggacuuuagcugugaccucucuaacacagagaagcacuaacuuagauccucauucuuaaua

SEQ ID NO: 187619 - RNA, 63 nt, Homo Sapiens
gaaagaucugucaaucaagcaguagugugaaaaaagcacuauaagaaaaugcaucaucaguuu

SEQ ID NO: 187620 - RNA, 63 nt, Homo Sapiens
uucugggguuggaagugugacuucuuacacauaaagcacuaccuaaguaauucucucucuguu

SEQ ID NO: 187621 - RNA, 63 nt, Homo Sapiens
uguugaguucuguagagccuucugaugucucuaaagcacuaccgauucuuuggaguugucaca

SEQ ID NO: 187622 - RNA, 63 nt, Homo Sapiens
aauuuguccauuuaaaaaugccucagaaauugaaagcacuaugcccaagagggcuuuauuaca

SEQ ID NO: 187623 - RNA, 63 nt, Homo Sapiens
uggcagggugaucaguccaaauucuaaaggaagaagcacuaaaccaagguggggccaguugcg

SEQ ID NO: 187624 - RNA, 63 nt, Homo Sapiens
accccuggguagggaaagaaaucagucaagggaaagcacuagaguaacccccaccccuucagg

SEQ ID NO: 187625 - RNA, 63 nt, Homo Sapiens
uucuagucauuaacucaacgaaucaaguagugaaagcacuauaucagaagaaaacagguuaac

SEQ ID NO: 187626 - RNA, 63 nt, Homo Sapiens
gaauuugcuguacacacugacugcugggcucagaagcacuauacuccaggggcagguaaagcc

SEQ ID NO: 187627 - RNA, 63 nt, Homo Sapiens
uaguuuaaaaugucacuuuuucuugaaagcaaaaagcacuaauagugaauugugagcaaaaga

SEQ ID NO: 187628 - RNA, 63 nt, Homo Sapiens
aaucccaacaugaaauuauauuacucagauuuaaagcacuaucauuaaucuuucaaucuaauu

SEQ ID NO: 187629 - RNA, 63 nt, Homo Sapiens
aaguauacaggaggaugugaauagguuauaugcaagcacuaugcccuuuuauauaagugacuu

SEQ ID NO: 187630 - RNA, 63 nt, Homo Sapiens
uuguuauuauacuacuaauaauagagcacuuguaagcacuaaguuaucuuuauccaacauuuc

SEQ ID NO: 187631 - RNA, 63 nt, Homo Sapiens
gcauugacuuggagcaccuggaggauguaccagaagcacuagaccaggacgaccuccagcgcg

SEQ ID NO: 187632 - RNA, 63 nt, Homo Sapiens
uucaggaagcauguuguguuaguguuauaacucaagcacuagcucugaacuugcuguuaacac

SEQ ID NO: 187633 - RNA, 63 nt, Homo Sapiens
cgacuaaccccuauugggguggucaaguggaacaagcacuacaguucuagaaagaucacuaau

SEQ ID NO: 187634 - RNA, 63 nt, Homo Sapiens
uuggcucuuucugcucacuaaaugccucacuucaagcacuaauagcucccaucucuccucccu

SEQ ID NO: 187635 - RNA, 54 nt, Homo Sapiens; identical to SEQ ID NO: 187233

SEQ ID NO: 187636 - RNA, 63 nt, Homo Sapiens
uuuucuguaaccuuuugaaaucuaguuacuaauaagcacuacuguaauuuagcacaguuuaac

SEQ ID NO: 187637 - RNA, 63 nt, Homo Sapiens
gauucuaaagguguugucacuguauaaaacagaaagcacuaggauacaaaugaagcuuaauua

SEQ ID NO: 187638 - RNA, 63 nt, Homo Sapiens
cugagcuauggcugcuuuuguagccuuuccaagaagcacuaaccugaaauaagauuagauaau

SEQ ID NO: 187639 - RNA, 63 nt, Homo Sapiens
uauuccuaaagccacuauuguguuuucucuaagaagcacuacaugccaccagaauugugcacu

SEQ ID NO: 187640 - RNA, 63 nt, Homo Sapiens
acuuugggcugugagcauuuagaacgagccuggaagcacuacagagcaucccacaggaccaca

SEQ ID NO: 187641 - RNA, 63 nt, Homo Sapiens
uaaacugacuuuauccucaggggauucuacuuuaagcacuacaauuuccauuccagaauaucu

SEQ ID NO: 187642 - RNA, 63 nt, Homo Sapiens
cuaagccaugaagaacuccacuuuuuguauagaaagcacuacccuguaaaaaaccaaaaagga

SEQ ID NO: 187643 - RNA, 63 nt, Homo Sapiens
uccugcccuuuuugugugguggggaauaaagaaaagcacuaaacugguagugaauguguaguu

SEQ ID NO: 187644 - RNA, 63 nt, Homo Sapiens
agacuucuguuuguucguucgcugauuugcuggaagcacuacaagagcucuuuuuuccuuucu

SEQ ID NO: 187645 - RNA, 63 nt, Homo Sapiens
uuagcuguuuucauuuaaugguaugguuccuguaagcacuaagcauguuuauacacagggagu

SEQ ID NO: 187646 - RNA, 63 nt, Homo Sapiens
auauccagcuaaauggugcagaaaaagauaccuaagcacuagaaaccuguucgugugguauau

SEQ ID NO: 187647 - RNA, 63 nt, Homo Sapiens
aucauauacgugaaaauuauuugaaaacauauaaagcacuauacagauucgaaacuccauuga

SEQ ID NO: 187648 - RNA, 63 nt, Homo Sapiens
gguaguuaagaguggggucaccccuuuaacuccaagcacuacauuuuggcggcugccggccuc

SEQ ID NO: 187649 - RNA, 63 nt, Homo Sapiens
agcuaauucuggggauagaaugauaaaagacucaagcacuaaaaauauacauugccgaaucuc

SEQ ID NO: 187650 - RNA, 63 nt, Homo Sapiens
uauuuauguuuaaguauuuagaaaaaggugaaaaagcacuauuaucaguucugccuagguaaa

SEQ ID NO: 187651 - RNA, 63 nt, Homo Sapiens
uaaagcaaaaauuuuaacuguuuucuaauugucaagcacuauuuucauuaaaagugucuaaug

SEQ ID NO: 187652 - RNA, 63 nt, Homo Sapiens
aaacuucucaaaaauuguacaucuguguaacuaaagcacuaacaaaaacaugaauaguccuuc

SEQ ID NO: 187653 - RNA, 63 nt, Homo Sapiens
gcugccauuaaugaauuguuucccuggaaucagaagcacuagugggugaugggcugggguggg

SEQ ID NO: 187654 - RNA, 63 nt, Homo Sapiens
cuucccagcuucccgccgccccuagggcucuccaagcacuagcgggcccugaaauggccuguc

SEQ ID NO: 187655 - RNA, 63 nt, Homo Sapiens
acaccuagacuggaaaugugcuuccucccuucaaagcacuaccgggagcagagugauuucuug

SEQ ID NO: 187656 - RNA, 63 nt, Homo Sapiens
uuuucacagacaauaacuguaaugcaccuuuuaaagcacuacggauuuagcaacacagguaaa

SEQ ID NO: 187657 - RNA, 63 nt, Homo Sapiens
agcuuuuuuuccauauugguuuaaaagaagccaaagcacuacuuuucucaagaauuacuggcu

SEQ ID NO: 187658 - RNA, 63 nt, Homo Sapiens
uucauuuauugaaaaaaaaaaaaaaugcccccaaagcacuaugcuggucaugaacugcuucaa

SEQ ID NO: 187659 - RNA, 63 nt, Homo Sapiens
uccaaauacaucucucccuucuugaaaucccuaaagcacuaucgcacuccuaaaugcauuucu

SEQ ID NO: 187660 - RNA, 63 nt, Homo Sapiens
cucauucuuuuuucuauuaagccauugaaagagaagcacuaagacugcuucuaggcuuuauuu

SEQ ID NO: 187661 - RNA, 63 nt, Homo Sapiens
uuuuuauuucuuuuuuuuuuaauugggggaaauaagcacuauuaacagauucagcacuacaag

SEQ ID NO: 187662 - RNA, 63 nt, Homo Sapiens
caguaacgcuacaaugaucauccaauuauuacgaagcacuaauaacgugauucucagugugau

SEQ ID NO: 187663 - RNA, 63 nt, Homo Sapiens
uccaaaauuauggcugaauaaaaauugagauugaagcacuaauuaauauauacauguaauaug

SEQ ID NO: 187664 - RNA, 63 nt, Homo Sapiens
cuacccuuguuaguuauuuuaggagacagucucaagcacuaaaaaguggcuaauucaauuuau

SEQ ID NO: 187665 - RNA, 63 nt, Homo Sapiens
cuauggcagauaugguauggaucguaaaauuuuaagcacuaaaaauuuuuucauaaccuuuca

SEQ ID NO: 187666 - RNA, 63 nt, Homo Sapiens
auaaucuucuaaaggcuauacaauugaaugaggaagcacuaacaaaagcaguaguucaguaca

SEQ ID NO: 187667 - RNA, 63 nt, Homo Sapiens
uuucaggcuaauuaguggauuaagcaauaaugaaagcacuaaguuugguuuugcuuuugugag

SEQ ID NO: 187668 - RNA, 63 nt, Homo Sapiens
uggggcaauggaugcauuucccaaaacgugugaaagcacuaacagcuuauauugcugaaugag

SEQ ID NO: 187669 - RNA, 63 nt, Homo Sapiens
agcucuuuuggggguguaguccaauaaugaagaaagcacuaggaaacuacuuacucugaugga

SEQ ID NO: 187670 - RNA, 63 nt, Homo Sapiens
ucauaguccguguucaaaguuuucuaugucuucaagcacuauacauguccauagagaagaggu

SEQ ID NO: 187671 - RNA, 63 nt, Homo Sapiens
uuauucuguuuaaaauguacauagcaaguguggaagcacuacuuuuuuaaauagaaaucacaa

SEQ ID NO: 187672 - RNA, 63 nt, Homo Sapiens
aacuuaucuauggugauuacuucuaaaguuccaaagcacuaaaaugaguacaaacugauucag

SEQ ID NO: 187673 - RNA, 63 nt, Homo Sapiens
acuuuaaauacuauuauuuggagcuuagugcacaagcacuaucauuauaucaaggucucagau

SEQ ID NO: 187674 - RNA, 63 nt, Homo Sapiens
cuggacucaccucuggagccuauggcuuuaagcaagcacuacugcacuuuacagaauuacccc

SEQ ID NO: 187675 - RNA, 63 nt, Homo Sapiens
aggguuuagcuguggcgcaggcuuuucagggccaagcacuauaaaagagcuuucuggguuaac

SEQ ID NO: 187676 - RNA, 63 nt, Homo Sapiens
aauaccauuuuuaagcaguaacaaaagaugugaaagcacuaaacuuacaaauuccagauaucu

SEQ ID NO: 187677 - RNA, 63 nt, Homo Sapiens
cugcaggaauccugagaaaauggacagaguuuuaagcacuaugaaagacuuuaaaacucuggc

SEQ ID NO: 187678 - RNA, 63 nt, Homo Sapiens
aucauggucaaguucccaacgagcccagccagaaagcacuacaugucuucccgaugagggaag

SEQ ID NO: 187679 - RNA, 63 nt, Homo Sapiens
auauuguucccauauauuuagucauagaagaugaagcacuauagugauauguauuccaaaaaa

SEQ ID NO: 187680 - RNA, 63 nt, Homo Sapiens
agaccaggcaacuuaccacuagggagugagucaaagcacuaauaaagccucuguguagguggu

SEQ ID NO: 187681 - RNA, 63 nt, Homo Sapiens
uuuauaacuuuuugaaacaaugcuggauuuuucaagcacuaaauguuaguccuucuacuuacc

SEQ ID NO: 187682 - RNA, 63 nt, Homo Sapiens
aggugggaggaggccugcaccuuuucucgcugaaagcacuaaguucugcguaaugagacucac

SEQ ID NO: 187683 - RNA, 63 nt, Homo Sapiens
auguaauaaagugaugaacuauuuauuuuaagaaagcacuaagguuugauaugauauuacugu

SEQ ID NO: 187684 - RNA, 63 nt, Homo Sapiens
cugcuaguuacaguguaggcuuguuaacuaguuaagcacuaugucaaagggaagcagcauuuc

SEQ ID NO: 187685 - RNA, 63 nt, Homo Sapiens
agacuuuugguuucucgcauugccucucagacuaagcacuaaaaagcaaagcaaaacagaacu

SEQ ID NO: 187686 - RNA, 63 nt, Homo Sapiens
gaaugccuuucaaacauugagacugcuagaaccaagcacuaccaguaucuccauccuuaacug

SEQ ID NO: 187687 - RNA, 63 nt, Homo Sapiens
uucucucucuuuuuuugaguguagauuauuuuaaagcacuaauugcauuacauugguaacugc

SEQ ID NO: 187688 - RNA, 63 nt, Homo Sapiens
ugacuuuaauacaggcagugcucaaacuagaauaagcacuaauuaaaggaauuguuggggguc

SEQ ID NO: 187689 - RNA, 63 nt, Homo Sapiens
aaacacucguuuguuguuuuccuaccagaaggaaagcacuaagauucauuuaguugauauaau

SEQ ID NO: 187690 - RNA, 63 nt, Homo Sapiens
auaaaauucgucuuguuagaccaccacuuuucaaagcacuacuaaaccaaucgguaaucugau

SEQ ID NO: 187691 - RNA, 63 nt, Homo Sapiens
aacuaaacaucuucaccagggguggaucuuggaaagcacuagagacaaauugacuucuccuga

SEQ ID NO: 187692 - RNA, 63 nt, Homo Sapiens
gggcaaugggauuaaaccaaggccaacauuggaaagcacuagauaaaauggaggcaacauuuu

SEQ ID NO: 187693 - RNA, 63 nt, Homo Sapiens
cccacuaaguuaaagacuucugggaccaagcugaagcacuaauacaauaauggggaaaauauu

SEQ ID NO: 187694 - RNA, 63 nt, Homo Sapiens
uucagggaguuuauuggaggaucaaagaacugaaagcacuagagcagccuuggggacugcuag

SEQ ID NO: 187695 - RNA, 63 nt, Homo Sapiens
caaccaaguggaaaggcaaguuggucuuauagaaagcacuacugcacuuaguagcuaugugau

SEQ ID NO: 187696 - RNA, 63 nt, Homo Sapiens
gugggacgaaugacgaugcccauccacuaccugaagcacuaggacacucuugcagggccaggc

SEQ ID NO: 187697 - RNA, 63 nt, Homo Sapiens
ggagcacauugauuuggaguuucagaucuuccaaagcacuauuuguuguaauaacuuuucuaa

SEQ ID NO: 187698 - RNA, 63 nt, Homo Sapiens
gcccccggcucaagugcugccguccuuguccacaagcacuaugcuggcucuccuuggccucgc

SEQ ID NO: 187699 - RNA, 63 nt, Homo Sapiens
augauucuaggcuguuaaaucuucugcugauggaagcacuaggucacgccuuuuuuagcaagc

SEQ ID NO: 187700 - RNA, 63 nt, Homo Sapiens
gacacaagaaucaaucagacaguuucugggguuaagcacuaaguauuaauggcugcugucucc

SEQ ID NO: 187701 - RNA, 63 nt, Homo Sapiens
uuuuaaauucagcauuagugcacugacuaggaaaagcacuacagauuuugccagggaacaguu

SEQ ID NO: 187702 - RNA, 63 nt, Homo Sapiens
aggcaguauauuacagaaacauuuacaaacuccaagcacuaaauaaagaagaaagggaagaca

SEQ ID NO: 187703 - RNA, 63 nt, Homo Sapiens
uugguuuacuacuucaguaauauaccaacuauaaagcacuaugaucaauuuucugugaugaug

SEQ ID NO: 187704 - RNA, 63 nt, Homo Sapiens
cauauccuuuaaacuaaauuggaauauuuuuuaaagcacuacuguggcauggagacuguggag

SEQ ID NO: 187705 - RNA, 63 nt, Homo Sapiens
ccuucucccuccucugucucaaacugcgcaggcaagcacuaugcaagcccaggcccucugcug

SEQ ID NO: 187706 - RNA, 63 nt, Homo Sapiens
gacuauuuuuaaacauacuagucugcugauagaaagcacuauacauccuauuguuucuuucuu

SEQ ID NO: 187707 - RNA, 63 nt, Homo Sapiens
cuaagcauuguauuuuuuuuaacaaaucuaaaaaagcacuaugaacuacagguguuugacuuu

SEQ ID NO: 187708 - RNA, 63 nt, Homo Sapiens
cacccugguacugccuggugccugccacaaaauaagcacuaacaaaaguguauuguuuaaaaa

SEQ ID NO: 187709 - RNA, 63 nt, Homo Sapiens
agaagauuuugaauuauuauccagcagggcuggaagcacuagaugcagcaugagcacaacuau

SEQ ID NO: 187710 - RNA, 63 nt, Homo Sapiens
uguuaaacaaaugauuuccacaaacagaucaggaagcacuagguuggcagagacacuuugucu

SEQ ID NO: 187711 - RNA, 63 nt, Homo Sapiens
uucuuuuaucuuuuuugcuccauuaagaauacaaagcacuacacugaucuaucaacaucaccc

SEQ ID NO: 187712 - RNA, 63 nt, Homo Sapiens
guuugucauuuauguaagucagccaccuuuguaaagcacuaguuuuagaagauggagaacucc

SEQ ID NO: 187713 - RNA, 63 nt, Homo Sapiens
cagaaaagaaaaaaaaaauagaauuaagggguaaagcacuaaauauuagaccguuaccuauaa

SEQ ID NO: 187714 - RNA, 63 nt, Homo Sapiens
acuggucaguuuugugugaucauucauaaauucaagcacuaccuaaauguucuguuuaauggc

SEQ ID NO: 187715 - RNA, 63 nt, Homo Sapiens
acuuacuucauuguaacuauagcuuaucuuuuuaagcacuaaauggauuauccacauaaucaa

SEQ ID NO: 187716 - RNA, 63 nt, Homo Sapiens
agagaugcgcgauacaggucugcuuugaggcccaagcacuaguugcaguuaggugaugagcac

SEQ ID NO: 187717 - RNA, 63 nt, Homo Sapiens
cccagcagagucccggugccgguucugaaugugaagcacuacaacuaugcaaagcauccaggc

SEQ ID NO: 187718 - RNA, 63 nt, Homo Sapiens
cagguaaaacacuggcccaaauauuuauaauguaagcacuaucagcacuaagggcaaaaacca

SEQ ID NO: 187719 - RNA, 63 nt, Homo Sapiens
aagcgcuuaacguauauuuagucuaccccucugaagcacuauuugcagcguauuagaguaaaa

SEQ ID NO: 187720 - RNA, 63 nt, Homo Sapiens
agauaauguguuaauauugcuauuaccuagguuaagcacuauugucugugcuaguaagaaaaa

SEQ ID NO: 187721 - RNA, 63 nt, Homo Sapiens
uuuguucagaaaguuuguuuuaaaguuuauuuuaagcacuaucguaccaaauauuucauauuu

SEQ ID NO: 187722 - RNA, 63 nt, Homo Sapiens
ccagagcagaaugaugccuucugggauucacagaagcacuacuggaaagccuuuguacaguuc

SEQ ID NO: 187723 - RNA, 63 nt, Homo Sapiens
ccaaggcuauggaguagcucgaaauauaaagcaaagcacuauuggaaauuacugcuuucucua

SEQ ID NO: 187724 - RNA, 63 nt, Homo Sapiens
ugagaaggaacugauacuuacaguauaacuauaaagcacuagcuaggucucuuaaccuggcac

SEQ ID NO: 187725 - RNA, 63 nt, Homo Sapiens
aaagcucuugauagaauguuaacuucuugguaaaagcacuaaaugaaugcagcucucacuaac

SEQ ID NO: 187726 - RNA, 63 nt, Homo Sapiens
cauuaaauugaagagucuacauucagaacauaaaagcacuagguauacaaguuugaaauauga

SEQ ID NO: 187727 - RNA, 63 nt, Homo Sapiens
guucuuaugaagcagcauuaugcaaggggaaaaaagcacuaugucuguguauguauguauaua

SEQ ID NO: 187728 - RNA, 63 nt, Homo Sapiens
auguaugugaucgucaauguccucccuugcagcaagcacuacaccaaaacaacugguuauaug

SEQ ID NO: 187729 - RNA, 63 nt, Homo Sapiens
ucuuugauccaguaguuuccuucaaaauuauaaaagcacuaacaggacaauauggcaaugucc

SEQ ID NO: 187730 - RNA, 63 nt, Homo Sapiens
aaugugacagaugcagaucuuagaggacuuacaaagcacuauauugguaauucuuacaauggc

SEQ ID NO: 187731 - RNA, 63 nt, Homo Sapiens
cugggaggaacaaauuuaaucauuucuucuguuaagcacuaaucaguauagugcaacuccugg

SEQ ID NO: 187732 - RNA, 63 nt, Homo Sapiens
auccuccuucaggaacacggggagcagaggccaaagcacuaaggggagggcgcauacccgaga

SEQ ID NO: 187733 - RNA, 63 nt, Homo Sapiens
ugcuuaucucagagugaagauacugcggcugaaaagcacuaguuugauauaaaauuaaaauga

SEQ ID NO: 187734 - RNA, 63 nt, Homo Sapiens
uuauuucauccucgaugggaauucuugcuagguaagcacuaauaacucggcaucuugacgaua

SEQ ID NO: 187735 - RNA, 63 nt, Homo Sapiens
uacacacuauauuuuaauugaauucaaacuaucaagcacuacuuagaaacuggaaaacauaua

SEQ ID NO: 187736 - RNA, 63 nt, Homo Sapiens
gggauguaccucuccccacuccccuugcuugagaagcacuacucaaaaauuuaccagaccuua

SEQ ID NO: 187737 - RNA, 63 nt, Homo Sapiens
gacauuuagauaugccaaaagaauuaaaaucaaaagcacuaagaaauacauaguugugugaug

SEQ ID NO: 187738 - RNA, 63 nt, Homo Sapiens
uuucuuuuaagagcugugaaugaaacuuuuucuaagcacuauucuauugcacacaaacagaaa

SEQ ID NO: 187739 - RNA, 63 nt, Homo Sapiens
uagggauggacauuaaaucuuguguguguuuuaaagcacuagagccaccaugccuggccugua

SEQ ID NO: 187740 - RNA, 63 nt, Homo Sapiens
cuuuguauuaccaaagcaagaauuuguauaaauaagcacuauuguacaaucuuucaccaagua

SEQ ID NO: 187741 - RNA, 63 nt, Homo Sapiens
auuuauucuuccgcugucugacuacucuucuugaagcacuauucuuuaccuauccucucaauc

SEQ ID NO: 187742 - RNA, 63 nt, Homo Sapiens
uucccugcuucugguuugcugaagauuuucuagaagcacuauuuacacaaauaugcaaaugug

SEQ ID NO: 187743 - RNA, 63 nt, Homo Sapiens
cuuugaugacucugccccucagcagggcuuacuaagcacuaccccuuaacagggaugacuccg

SEQ ID NO: 187744 - RNA, 63 nt, Homo Sapiens
aacucaacuagcaggaagcguuccaaaagaagaaagcacuaaauauuaugaaauacaauggug

SEQ ID NO: 187745 - RNA, 63 nt, Homo Sapiens
gacuguaggagaaaagaaagugugccaccuacaaagcacuagaaaguuaaacuccucuacuua

SEQ ID NO: 187746 - RNA, 63 nt, Homo Sapiens; identical to SEQ ID NO: 187745

SEQ ID NO: 187747 - RNA, 63 nt, Homo Sapiens
cuccuuguuggguaacucagccauggagaugccaagcacuagccaggaggugaguuccucuuu

SEQ ID NO: 187748 - RNA, 63 nt, Homo Sapiens
aaaaacccacaggugcugcugcuuauaucugugaagcacuagcuuauucuaggaaugccugau

SEQ ID NO: 187749 - RNA, 63 nt, Homo Sapiens
uccccucaaacgagaacaaaaaguauucccugcaagcacuaugaauggaccuuacuacucucu

SEQ ID NO: 187750 - RNA, 63 nt, Homo Sapiens
caaagaaagacuguaagcuccaugauuagcauaaagcacuaaccaugucuccaugugacccga

SEQ ID NO: 187751 - RNA, 63 nt, Homo Sapiens
cauugccaagagaggaugcaucuggggagagcaaagcacuaaggaauucagcaucagccugca

SEQ ID NO: 187752 - RNA, 63 nt, Homo Sapiens
cuauagaugccucuuaggacugggcucccacauaagcacuaguuauggagcugugccgaggcu

SEQ ID NO: 187753 - RNA, 63 nt, Homo Sapiens
aauacucugcagugauuagaaucagccauaagaaagcacuauuaucuuugcucccugcaagaa

SEQ ID NO: 187754 - RNA, 63 nt, Homo Sapiens
acguugaucuuaaccuuuuuuuccccugucuucaagcacuaaagauuuuacauguaacugaag

SEQ ID NO: 187755 - RNA, 63 nt, Homo Sapiens
aaaucucaauauagagauuuaaagcugaaguguaagcacuaggaauggaaguugucauccgua

SEQ ID NO: 187756 - RNA, 63 nt, Homo Sapiens
agcaccuuucucaaggacaacguuucccucuacaagcacuagggccauacugcacggacguag

SEQ ID NO: 187757 - RNA, 63 nt, Homo Sapiens
uauuuugauaauaauauuguuuuucuuucuacaaagcacuagagaaugcacagauauacuuug

SEQ ID NO: 187758 - RNA, 63 nt, Homo Sapiens
uagguuauuacuuuuuuuauaaccagauuuuuaaagcacuagguuuuaaaucaguggguauca

SEQ ID NO: 187759 - RNA, 63 nt, Homo Sapiens
guugaauucuuugggccuagaauauacuugagaaagcacuaguggcuuguguucagggagagg

SEQ ID NO: 187760 - RNA, 63 nt, Homo Sapiens
gaauuugcaaauucagaacauauaaauucucauaagcacuauaucaaacaauauaaaagccaa

SEQ ID NO: 187761 - RNA, 63 nt, Homo Sapiens
uccccagaaggagugauuuuucuaucggcacaaaagcacuauauggacugguaaugguuacag

SEQ ID NO: 187762 - RNA, 63 nt, Homo Sapiens
ccaccaggccugcccuaaaagagcuccugaaggaagcacuaaacauggaaaggaacaacugau

SEQ ID NO: 187763 - RNA, 63 nt, Homo Sapiens
guaacugaccaaagucacacugccaggaacuggaagcacuaggauuugacagcauauccaaau

SEQ ID NO: 187764 - RNA, 63 nt, Homo Sapiens
ccuuccacccccaggcacugaucccugcauuucaagcacuacgauccuucugcugacugccag

SEQ ID NO: 187765 - RNA, 63 nt, Homo Sapiens
ucucccuuaauaaacucacacugauucuaggauaagcacuagaaagaucauaggcagcaaggg

SEQ ID NO: 187766 - RNA, 63 nt, Homo Sapiens
uugccauaaauguuugcauaaugacauagcuuuaagcacuacaugauuuuaaucugcucacau

SEQ ID NO: 187767 - RNA, 63 nt, Homo Sapiens
cauguuuuaaaugcuuucuacuugugguucaagaagcacuagauuuaguaagaaacucuaccu

SEQ ID NO: 187768 - RNA, 63 nt, Homo Sapiens
cacaagaagaugacugaguucuagagaccccacaagcacuauggacgaagcgugggaccccag

SEQ ID NO: 187769 - RNA, 63 nt, Homo Sapiens
uggccuaaaaaagcuacuaccuaauguauuaggaagcacuaaaacauuuauucagauauggcu

SEQ ID NO: 187770 - RNA, 63 nt, Homo Sapiens
gccuuauaugcagggaaggcagcgcucccaaaaaagcacuauggucaaguggauggauauucu

SEQ ID NO: 187771 - RNA, 63 nt, Homo Sapiens
auucuuaaauaccucacugucuuggccauggggaagcacuauggccucagcugggggaaagac

SEQ ID NO: 187772 - RNA, 63 nt, Homo Sapiens
ucaguugccucauagccugcugguccuguaagcaagcacuaagcuccacagugccaguuccuu

SEQ ID NO: 187773 - RNA, 63 nt, Homo Sapiens
gagaagagauaauuacaaucaggcuaccaaaggaagcacuaacuuuggugcuuucaaguuggc

SEQ ID NO: 187774 - RNA, 63 nt, Homo Sapiens
aauugaaauuuaugugaauuauuuugauuguagaagcacuauaauaugugcugaaacuaaauu

SEQ ID NO: 187775 - RNA, 63 nt, Homo Sapiens
ggauuuuugaagcuguauacugugugcuaaaacaagcacuaaacaaagagugaaggauuuaug

SEQ ID NO: 187776 - RNA, 63 nt, Homo Sapiens
cuagauucugagaucuucccauucuaggccuacaagcacuacuugcuguagcugagacuuguc

SEQ ID NO: 187777 - RNA, 63 nt, Homo Sapiens
uuguguauuuuguuuccuuauagccauuaaagaaagcacuaaggaugaugggagcuccaaauc

SEQ ID NO: 187778 - RNA, 63 nt, Homo Sapiens
ggccuaaugaaagcuauauacuugugcuaucuaaagcacuacuuuguaaagaugacuacccaa

SEQ ID NO: 187779 - RNA, 63 nt, Homo Sapiens
accugccauagugaguuuaaggucauuucuacuaagcacuaggaaacauaggggaaaaaacga

SEQ ID NO: 187780 - RNA, 63 nt, Homo Sapiens
aaaagaaaugauugucuuuuuucaauaaauaucaagcacuaaagaaaaagcauuggcauuauu

SEQ ID NO: 187781 - RNA, 63 nt, Homo Sapiens
caaaacuggcuuauacuguaaucuacaacuaauaagcacuaauuuagaguucagcuauauugu

SEQ ID NO: 187782 - RNA, 63 nt, Homo Sapiens
uagugaauacuuacauagugcuuacuauaugcuaagcacuauuuuuagcauguuauuuauauu

SEQ ID NO: 187783 - RNA, 64 nt, Homo Sapiens
cugauucccuagaagagaacccucuacuuuuuguaagcacuacugacucucgcuguauuuaaga

SEQ ID NO: 187784 - RNA, 64 nt, Homo Sapiens
uagacuuuacauuguaucuaaguuaaucuuuauaaagcacuagaauuuuuggucaaaagucaaa

SEQ ID NO: 187785 - RNA, 64 nt, Homo Sapiens
uugggcagaaagcucuuagacaauggacuauccaaagcacuauuuaaauucugccucuuccuac

SEQ ID NO: 187786 - RNA, 64 nt, Homo Sapiens
auuuagucuccccgccucauucccacccccaacaaagcacuaucauuuucauuuggaaugggua

SEQ ID NO: 187787 - RNA, 64 nt, Homo Sapiens
ucauauugaucuuuuuaucaugauccucccuaucaagcacuaaaaaguugaaccauuauacuuu

SEQ ID NO: 187788 - RNA, 64 nt, Homo Sapiens
uucacugauccuuaguaacauguuaacauuuaugaagcacuauauauugauuugcaaaaucuuu

SEQ ID NO: 187789 - RNA, 64 nt, Homo Sapiens
gauccaauguaauuggcugcgucuggcuaauucuaagcacuaaagucuacaucuaagcuauaga

SEQ ID NO: 187790 - RNA, 64 nt, Homo Sapiens
gcacuuagguucauugugccucaguuccucucaaaagcacuaaaucuaagugcaaacaaguauu

SEQ ID NO: 187791 - RNA, 64 nt, Homo Sapiens
aagcuuuuugguaauauguuacaauuaaaaugacaagcacuauaucacaaucucuguuuguaug

SEQ ID NO: 187792 - RNA, 64 nt, Homo Sapiens
agacaaagcguauuaaacagaaccacaggcacccaagcacuaccugguuccagugagagaaacc

SEQ ID NO: 187793 - RNA, 64 nt, Homo Sapiens
ucuuccuuuuccacuuaggcuccgcucuggccccaagcacuauuggcccagagcugaucucuca

SEQ ID NO: 187794 - RNA, 64 nt, Homo Sapiens
uucuuguuuguuaguccuuuauuuguaaaugguaaagcacuauaaaugagaauguaugugaaag

SEQ ID NO: 187795 - RNA, 64 nt, Homo Sapiens
ccuugccuugcuguuuguccguagcuuaucuuagaagcacuacaugauguuuggggucuuugug

SEQ ID NO: 187796 - RNA, 64 nt, Homo Sapiens
gucuugggguugagcccuaggcucuugcuguguaaagcacuauuugagggucuuuguaggaguu

SEQ ID NO: 187797 - RNA, 64 nt, Homo Sapiens
ggaggcaacuguggcauugcaauuaccaacagugaagcacuacaaaccacaaugaauuguccuu

SEQ ID NO: 187798 - RNA, 64 nt, Homo Sapiens
cugaguuuccucuuauagguuuggauggaaacaaaagcacuagaauaaaggaauguauagaugu

SEQ ID NO: 187799 - RNA, 64 nt, Homo Sapiens
aaaaaaaagaguuuaaguggguccuugucaugaaaagcacuaaaaaauuuacaaggccuaucau

SEQ ID NO: 187800 - RNA, 64 nt, Homo Sapiens
auaaagauuauauaaagaccacaagugagacaaaaagcacuaguaaggcacccacaaauaaaug

SEQ ID NO: 187801 - RNA, 64 nt, Homo Sapiens
aaugccagugaccuguguaauguaguguuaagagaagcacuaagcgccgaauucauuaauuuac

SEQ ID NO: 187802 - RNA, 64 nt, Homo Sapiens
uauaaauauguuguuacugcuccagagcaaaaugaagcacuaggcagagcagaucugcuuuuuu

SEQ ID NO: 187803 - RNA, 64 nt, Homo Sapiens
agccuuagauuccuuuccucccccaucaguacucaagcacuauaugcuguucgcugcaguuguu

SEQ ID NO: 187804 - RNA, 64 nt, Homo Sapiens
uuccccagagcuugccaggucucaaauugucucuaagcacuaccugucucucuucaaccuucau

SEQ ID NO: 187805 - RNA, 64 nt, Homo Sapiens
uuauauuuaaaaauuguuucaaaaaauaucagacaagcacuauuuuauacugcacaguggcaca

SEQ ID NO: 187806 - RNA, 64 nt, Homo Sapiens
uauaucuguaguuuuuuguuuuuguuuuuuuuuaaagcacuacaucuguuuucacuaauuguua

SEQ ID NO: 187807 - RNA, 64 nt, Homo Sapiens
aaaaaccaguuagcugcuauauaaacacuauaccaagcacuaggcuuagaggaaaagaugucag

SEQ ID NO: 187808 - RNA, 64 nt, Homo Sapiens
acaaauaagguauauuuuuuagaaucaacuuuguaagcacuauaaaaucuuuaauaaguuauaa

SEQ ID NO: 187809 - RNA, 64 nt, Homo Sapiens
uucuaguuuucuguccugcaauauguauauaauuaagcacuaauuuguacugcuuagcauaaaa

SEQ ID NO: 187810 - RNA, 64 nt, Homo Sapiens
ucauacuucguggagcccagcgagcaucccgggcaagcacuaccaggcugugggucugcaccuc

SEQ ID NO: 187811 - RNA, 64 nt, Homo Sapiens
uuuuguauccauuuaaacuaaccuuuuaucaauaaagcacuauuguuuagauauuaaaugagua

SEQ ID NO: 187812 - RNA, 64 nt, Homo Sapiens
aaaaacaaauauuuuguaccagcugcuuuugcagaagcacuaaugaguaugguuaacuucacgc

SEQ ID NO: 187813 - RNA, 64 nt, Homo Sapiens
uuauuuauagauauaucuagauauuguuaccuuaaagcacuauugcauuuaagucagccaaaga

SEQ ID NO: 187814 - RNA, 64 nt, Homo Sapiens
ugaauacgcaagaaggugaggcaggagcgcaagcaagcacuauaugggcccggcaggagagccu

SEQ ID NO: 187815 - RNA, 64 nt, Homo Sapiens
uuaaaacaucugcuuuuuaagauaaguuggaauaaagcacuauguugaaggaaguucauucaag

SEQ ID NO: 187816 - RNA, 64 nt, Homo Sapiens
cagucaguccccugggggaauagcauugugugauaagcacuaagcuuuuaaaacuucacuaaua

SEQ ID NO: 187817 - RNA, 64 nt, Homo Sapiens
acagauacaagugucaguuucuuaguucucauuuaagcacuaguggaauuuuuuuuuuuugaua

SEQ ID NO: 187818 - RNA, 64 nt, Homo Sapiens
uuauuguuguuaauugggacuuucuguuaaugaaaagcacuauucccaagauuaauaguguucu

SEQ ID NO: 187819 - RNA, 64 nt, Homo Sapiens
cuaggacuuuagcugugaccucucuaacacagagaagcacuaacuuagauccucauucuuaaua

SEQ ID NO: 187820 - RNA, 64 nt, Homo Sapiens
agaaagaucugucaaucaagcaguagugugaaaaaagcacuauaagaaaaugcaucaucaguuu

SEQ ID NO: 187821 - RNA, 64 nt, Homo Sapiens
cuucugggguuggaagugugacuucuuacacauaaagcacuaccuaaguaauucucucucuguu

SEQ ID NO: 187822 - RNA, 64 nt, Homo Sapiens
uuguugaguucuguagagccuucugaugucucuaaagcacuaccgauucuuuggaguugucaca

SEQ ID NO: 187823 - RNA, 64 nt, Homo Sapiens
aauuuguccauuuaaaaaugaccucagaaauugaaagcacuaugucccaagagggcuuuauuac

SEQ ID NO: 187824 - RNA, 64 nt, Homo Sapiens
uggcagggugaucaguccaagauucuaaaggaagaagcacuaaauccaagguggggccaguugc

SEQ ID NO: 187825 - RNA, 64 nt, Homo Sapiens
accccuggguagggaaagaagaucagucaagggaaagcacuagaaguaacccccaccccuucag

SEQ ID NO: 187826 - RNA, 64 nt, Homo Sapiens
uucuagucauuaacucaacgcaaucaaguagugaaagcacuauaaucagaagaaaacagguuaa

SEQ ID NO: 187827 - RNA, 64 nt, Homo Sapiens
gaauuugcuguacacacugaccugcugggcucagaagcacuauaucuccaggggcagguaaagc

SEQ ID NO: 187828 - RNA, 64 nt, Homo Sapiens
uaguuuaaaaugucacuuuuaucuugaaagcaaaaagcacuaaucagugaauugugagcaaaag

SEQ ID NO: 187829 - RNA, 64 nt, Homo Sapiens
caaucccaacaugaaauuauauuacucagauuuaaagcacuaucauuaaucuuucaaucuaauu

SEQ ID NO: 187830 - RNA, 64 nt, Homo Sapiens
uaaguauacaggaggaugugaauagguuauaugcaagcacuaugcccuuuuauauaagugacuu

SEQ ID NO: 187831 - RNA, 64 nt, Homo Sapiens
auuguuauuauacuacuaauaauagagcacuuguaagcacuaaguuaucuuuauccaacauuuc

SEQ ID NO: 187832 - RNA, 64 nt, Homo Sapiens
cgcauugacuuggagcaccuggaggauguaccagaagcacuagaccaggacgaccuccagcgcg

SEQ ID NO: 187833 - RNA, 64 nt, Homo Sapiens
uucaggaagcauguuguguucaguguuauaacucaagcacuagcaucugaacuugcuguuaaca

SEQ ID NO: 187834 - RNA, 64 nt, Homo Sapiens
cgacuaaccccuauugggguuggucaaguggaacaagcacuacauguucuagaaagaucacuaa

SEQ ID NO: 187835 - RNA, 64 nt, Homo Sapiens
uuggcucuuucugcucacuauaaugccucacuucaagcacuaaucagcucccaucucuccuccc

SEQ ID NO: 187836 - RNA, 54 nt, Homo Sapiens; identical to SEQ ID NO: 187233

SEQ ID NO: 187837 - RNA, 64 nt, Homo Sapiens
auuuucuguaaccuuuugaaaucuaguuacuaauaagcacuacuguaauuuagcacaguuuaac

SEQ ID NO: 187838 - RNA, 64 nt, Homo Sapiens
ggauucuaaagguguugucacuguauaaaacagaaagcacuaggauacaaaugaagcuuaauua

SEQ ID NO: 187839 - RNA, 64 nt, Homo Sapiens
ucugagcuauggcugcuuuuguagccuuuccaagaagcacuaaccugaaauaagauuagauaau

SEQ ID NO: 187840 - RNA, 64 nt, Homo Sapiens
auauuccuaaagccacuauuguguuuucucuaagaagcacuacaugccaccagaauugugcacu

SEQ ID NO: 187841 - RNA, 64 nt, Homo Sapiens
gacuuugggcugugagcauuuagaacgagccuggaagcacuacagagcaucccacaggaccaca

SEQ ID NO: 187842 - RNA, 64 nt, Homo Sapiens
uaaacugacuuuauccucagugggauucuacuuuaagcacuacauauuuccauuccagaauauc

SEQ ID NO: 187843 - RNA, 64 nt, Homo Sapiens
cuaagccaugaagaacuccaacuuuuuguauagaaagcacuaccccuguaaaaaaccaaaaagg

SEQ ID NO: 187844 - RNA, 64 nt, Homo Sapiens
uccugcccuuuuugugugguuggggaauaaagaaaagcacuaaaccugguagugaauguguagu

SEQ ID NO: 187845 - RNA, 64 nt, Homo Sapiens
agacuucuguuuguucguucugcugauuugcuggaagcacuacauagagcucuuuuuuccuuuc

SEQ ID NO: 187846 - RNA, 64 nt, Homo Sapiens
uuagcuguuuucauuuaauguguaugguuccuguaagcacuaaggcauguuuauacacagggag

SEQ ID NO: 187847 - RNA, 64 nt, Homo Sapiens
auauccagcuaaauggugcaugaaaaagauaccuaagcacuagauaaccuguucgugugguaua

SEQ ID NO: 187848 - RNA, 64 nt, Homo Sapiens
gaucauauacgugaaaauuauuugaaaacauauaaagcacuauacagauucgaaacuccauuga

SEQ ID NO: 187849 - RNA, 64 nt, Homo Sapiens
ggguaguuaagaguggggucaccccuuuaacuccaagcacuacauuuuggcggcugccggccuc

SEQ ID NO: 187850 - RNA, 64 nt, Homo Sapiens
aagcuaauucuggggauagaaugauaaaagacucaagcacuaaaaauauacauugccgaaucuc

SEQ ID NO: 187851 - RNA, 64 nt, Homo Sapiens
cuauuuauguuuaaguauuuagaaaaaggugaaaaagcacuauuaucaguucugccuagguaaa

SEQ ID NO: 187852 - RNA, 64 nt, Homo Sapiens
cuaaagcaaaaauuuuaacuguuuucuaauugucaagcacuauuuucauuaaaagugucuaaug

SEQ ID NO: 187853 - RNA, 64 nt, Homo Sapiens
uaaacuucucaaaaauuguacaucuguguaacuaaagcacuaacaaaaacaugaauaguccuuc

SEQ ID NO: 187854 - RNA, 64 nt, Homo Sapiens
gcugccauuaaugaauuguugucccuggaaucagaagcacuaguggggugaugggcuggggugg

SEQ ID NO: 187855 - RNA, 64 nt, Homo Sapiens
cuucccagcuucccgccgcccccuagggcucuccaagcacuagcagggcccugaaauggccugu

SEQ ID NO: 187856 - RNA, 64 nt, Homo Sapiens
acaccuagacuggaaauguggcuuccucccuucaaagcacuaccggggagcagagugauuucuu

SEQ ID NO: 187857 - RNA, 64 nt, Homo Sapiens
uuuucacagacaauaacuguaaaugcaccuuuuaaagcacuacgugauuuagcaacacagguaa

SEQ ID NO: 187858 - RNA, 64 nt, Homo Sapiens
agcuuuuuuuccauauugguuuuaaaagaagccaaagcacuacuauuucucaagaauuacuggc

SEQ ID NO: 187859 - RNA, 64 nt, Homo Sapiens
uuucauuuauugaaaaaaaaaaaaaaugcccccaaagcacuaugcuggucaugaacugcuucaa

SEQ ID NO: 187860 - RNA, 64 nt, Homo Sapiens
cuccaaauacaucucucccuucuugaaaucccuaaagcacuaucgcacuccuaaaugcauuucu

SEQ ID NO: 187861 - RNA, 64 nt, Homo Sapiens
acucauucuuuuuucuauuaagccauugaaagagaagcacuaagacugcuucuaggcuuuauuu

SEQ ID NO: 187862 - RNA, 64 nt, Homo Sapiens
auuuuuauuucuuuuuuuuuuaauugggggaaauaagcacuauuaacagauucagcacuacaag

SEQ ID NO: 187863 - RNA, 64 nt, Homo Sapiens
caguaacgcuacaaugaucauuccaauuauuacgaagcacuaauaaacgugauucucaguguga

SEQ ID NO: 187864 - RNA, 64 nt, Homo Sapiens
uccaaaauuauggcugaauagaaaauugagauugaagcacuaauuuaauauauacauguaauau

SEQ ID NO: 187865 - RNA, 64 nt, Homo Sapiens
ccuacccuuguuaguuauuuuaggagacagucucaagcacuaaaaaguggcuaauucaauuuau

SEQ ID NO: 187866 - RNA, 64 nt, Homo Sapiens
acuauggcagauaugguauggaucguaaaauuuuaagcacuaaaaauuuuuucauaaccuuuca

SEQ ID NO: 187867 - RNA, 64 nt, Homo Sapiens
gauaaucuucuaaaggcuauacaauugaaugaggaagcacuaacaaaagcaguaguucaguaca

SEQ ID NO: 187868 - RNA, 64 nt, Homo Sapiens
uuuucaggcuaauuaguggauuaagcaauaaugaaagcacuaaguuugguuuugcuuuugugag

SEQ ID NO: 187869 - RNA, 64 nt, Homo Sapiens
auggggcaauggaugcauuucccaaaacgugugaaagcacuaacagcuuauauugcugaaugag

SEQ ID NO: 187870 - RNA, 64 nt, Homo Sapiens
agcucuuuuggggguguaguaccaauaaugaagaaagcacuaggaaaacuacuuacucugaugg

SEQ ID NO: 187871 - RNA, 64 nt, Homo Sapiens
ucauaguccguguucaaaguuuuucuaugucuucaagcacuauagcauguccauagagaagagg

SEQ ID NO: 187872 - RNA, 64 nt, Homo Sapiens
uuauucuguuuaaaauguacaauagcaaguguggaagcacuacuauuuuuaaauagaaaucaca

SEQ ID NO: 187873 - RNA, 64 nt, Homo Sapiens
aacuuaucuauggugauuacguucuaaaguuccaaagcacuaaaaaugaguacaaacugauuca

SEQ ID NO: 187874 - RNA, 64 nt, Homo Sapiens
acuuuaaauacuauuauuugugagcuuagugcacaagcacuaucaauuauaucaaggucucaga

SEQ ID NO: 187875 - RNA, 64 nt, Homo Sapiens
ucuggacucaccucuggagccuauggcuuuaagcaagcacuacugcacuuuacagaauuacccc

SEQ ID NO: 187876 - RNA, 64 nt, Homo Sapiens
aggguuuagcuguggcgcagcgcuuuucagggccaagcacuauacaaagagcuuucuggguuaa

SEQ ID NO: 187877 - RNA, 64 nt, Homo Sapiens
aauaccauuuuuaagcaguauacaaaagaugugaaagcacuaaaucuuacaaauuccagauauc

SEQ ID NO: 187878 - RNA, 64 nt, Homo Sapiens
cugcaggaauccugagaaaacuggacagaguuuuaagcacuaugcaaagacuuuaaaacucugg

SEQ ID NO: 187879 - RNA, 64 nt, Homo Sapiens
aucauggucaaguucccaacggagcccagccagaaagcacuacacugucuucccgaugagggaa

SEQ ID NO: 187880 - RNA, 64 nt, Homo Sapiens
auauuguucccauauauuuaagucauagaagaugaagcacuauaagugauauguauuccaaaaa

SEQ ID NO: 187881 - RNA, 64 nt, Homo Sapiens
agaccaggcaacuuaccacuuagggagugagucaaagcacuaaucaaagccucuguguaggugg

SEQ ID NO: 187882 - RNA, 64 nt, Homo Sapiens
uuuauaacuuuuugaaacaacugcuggauuuuucaagcacuaaacuguuaguccuucuacuuac

SEQ ID NO: 187883 - RNA, 64 nt, Homo Sapiens
aggugggaggaggccugcacccuuuucucgcugaaagcacuaagguucugcguaaugagacuca

SEQ ID NO: 187884 - RNA, 64 nt, Homo Sapiens
auguaauaaagugaugaacuuauuuauuuuaagaaagcacuaaguguuugauaugauauuacug

SEQ ID NO: 187885 - RNA, 64 nt, Homo Sapiens
cugcuaguuacaguguaggccuuguuaacuaguuaagcacuauguucaaagggaagcagcauuu

SEQ ID NO: 187886 - RNA, 64 nt, Homo Sapiens
aagacuuuugguuucucgcauugccucucagacuaagcacuaaaaagcaaagcaaaacagaacu

SEQ ID NO: 187887 - RNA, 64 nt, Homo Sapiens
ugaaugccuuucaaacauugagacugcuagaaccaagcacuaccaguaucuccauccuuaacug

SEQ ID NO: 187888 - RNA, 64 nt, Homo Sapiens
uuucucucucuuuuuuugaguguagauuauuuuaaagcacuaauugcauuacauugguaacugc

SEQ ID NO: 187889 - RNA, 64 nt, Homo Sapiens
cugacuuuaauacaggcagugcucaaacuagaauaagcacuaauuaaaggaauuguuggggguc

SEQ ID NO: 187890 - RNA, 64 nt, Homo Sapiens
aaacacucguuuguuguuuuuccuaccagaaggaaagcacuaagcauucauuuaguugauauaa

SEQ ID NO: 187891 - RNA, 64 nt, Homo Sapiens
auaaaauucgucuuguuagauccaccacuuuucaaagcacuacugaaaccaaucgguaaucuga

SEQ ID NO: 187892 - RNA, 63 nt, Homo Sapiens; identical to SEQ ID NO: 187691

SEQ ID NO: 187893 - RNA, 64 nt, Homo Sapiens
gggcaaugggauuaaaccaauggccaacauuggaaagcacuagauuaaaauggaggcaacauuu

SEQ ID NO: 187894 - RNA, 64 nt, Homo Sapiens
cccacuaaguuaaagacuucuugggaccaagcugaagcacuaauaacaauaauggggaaaauau

SEQ ID NO: 187895 - RNA, 64 nt, Homo Sapiens
uuucagggaguuuauuggaggaucaaagaacugaaagcacuagagcagccuuggggacugcuag

SEQ ID NO: 187896 - RNA, 64 nt, Homo Sapiens
ccaaccaaguggaaaggcaaguuggucuuauagaaagcacuacugcacuuaguagcuaugugau

SEQ ID NO: 187897 - RNA, 64 nt, Homo Sapiens
ggugggacgaaugacgaugcccauccacuaccugaagcacuaggacacucuugcagggccaggc

SEQ ID NO: 187898 - RNA, 64 nt, Homo Sapiens
uggagcacauugauuuggaguuucagaucuuccaaagcacuauuuguuguaauaacuuuucuaa

SEQ ID NO: 187899 - RNA, 64 nt, Homo Sapiens
gcccccggcucaagugcugcccguccuuguccacaagcacuauggcuggcucuccuuggccucg

SEQ ID NO: 187900 - RNA, 64 nt, Homo Sapiens
augauucuaggcuguuaaauccuucugcugauggaagcacuaggcucacgccuuuuuuagcaag

SEQ ID NO: 187901 - RNA, 64 nt, Homo Sapiens
gacacaagaaucaaucagaccaguuucugggguuaagcacuaaguuauuaauggcugcugucuc

SEQ ID NO: 187902 - RNA, 64 nt, Homo Sapiens
uuuuaaauucagcauuagugucacugacuaggaaaagcacuacaggauuuugccagggaacagu

SEQ ID NO: 187903 - RNA, 64 nt, Homo Sapiens
aggcaguauauuacagaaacaauuuacaaacuccaagcacuaaacuaaagaagaaagggaagac

SEQ ID NO: 187904 - RNA, 64 nt, Homo Sapiens
uugguuuacuacuucaguaaguauaccaacuauaaagcacuauguaucaauuuucugugaugau

SEQ ID NO: 187905 - RNA, 64 nt, Homo Sapiens
cauauccuuuaaacuaaauugggaauauuuuuuaaagcacuacugguggcauggagacugugga

SEQ ID NO: 187906 - RNA, 64 nt, Homo Sapiens
uccuucucccuccucugucucaaacugcgcaggcaagcacuaugcaagcccaggcccucugcug

SEQ ID NO: 187907 - RNA, 64 nt, Homo Sapiens
agacuauuuuuaaacauacuagucugcugauagaaagcacuauacauccuauuguuucuuucuu

SEQ ID NO: 187908 - RNA, 64 nt, Homo Sapiens
acuaagcauuguauuuuuuuuaacaaaucuaaaaaagcacuaugaacuacagguguuugacuuu

SEQ ID NO: 187909 - RNA, 64 nt, Homo Sapiens
ccacccugguacugccuggugccugccacaaaauaagcacuaacaaaaguguauuguuuaaaaa

SEQ ID NO: 187910 - RNA, 64 nt, Homo Sapiens
cagaagauuuugaauuauuauccagcagggcuggaagcacuagaugcagcaugagcacaacuau

SEQ ID NO: 187911 - RNA, 64 nt, Homo Sapiens
uuguuaaacaaaugauuuccacaaacagaucaggaagcacuagguuggcagagacacuuugucu

SEQ ID NO: 187912 - RNA, 64 nt, Homo Sapiens
uucuuuuaucuuuuuugcucccauuaagaauacaaagcacuacagcugaucuaucaacaucacc

SEQ ID NO: 187913 - RNA, 64 nt, Homo Sapiens
guuugucauuuauguaaguccagccaccuuuguaaagcacuaguuuuuagaagauggagaacuc

SEQ ID NO: 187914 - RNA, 64 nt, Homo Sapiens
cagaaaagaaaaaaaaaauaagaauuaagggguaaagcacuaaaguauuagaccguuaccuaua

SEQ ID NO: 187915 - RNA, 64 nt, Homo Sapiens
acuggucaguuuugugugauccauucauaaauucaagcacuaccuuaaauguucuguuuaaugg

SEQ ID NO: 187916 - RNA, 64 nt, Homo Sapiens
acuuacuucauuguaacuauaagcuuaucuuuuuaagcacuaaaauggauuauccacauaauca

SEQ ID NO: 187917 - RNA, 64 nt, Homo Sapiens
agagaugcgcgauacagguccugcuuugaggcccaagcacuagugugcaguuaggugaugagca

SEQ ID NO: 187918 - RNA, 64 nt, Homo Sapiens
cccagcagagucccggugcccgguucugaaugugaagcacuacaaacuaugcaaagcauccagg

SEQ ID NO: 187919 - RNA, 64 nt, Homo Sapiens
cagguaaaacacuggcccaaaauauuuauaauguaagcacuaucuagcacuaagggcaaaaacc

SEQ ID NO: 187920 - RNA, 64 nt, Homo Sapiens
aagcgcuuaacguauauuuaagucuaccccucugaagcacuauucugcagcguauuagaguaaa

SEQ ID NO: 187921 - RNA, 64 nt, Homo Sapiens
uagauaauguguuaauauugcuauuaccuagguuaagcacuauugucugugcuaguaagaaaaa

SEQ ID NO: 187922 - RNA, 64 nt, Homo Sapiens
uuuuguucagaaaguuuguuuuaaaguuuauuuuaagcacuaucguaccaaauauuucauauuu

SEQ ID NO: 187923 - RNA, 64 nt, Homo Sapiens
ccagagcagaaugaugccuuccugggauucacagaagcacuacucggaaagccuuuguacaguu

SEQ ID NO: 187924 - RNA, 64 nt, Homo Sapiens
ccaaggcuauggaguagcucagaaauauaaagcaaagcacuauuuggaaauuacugcuuucucu

SEQ ID NO: 187925 - RNA, 64 nt, Homo Sapiens
ugagaaggaacugauacuuaccaguauaacuauaaagcacuagcauaggucucuuaaccuggca

SEQ ID NO: 187926 - RNA, 64 nt, Homo Sapiens
aaagcucuugauagaauguucaacuucuugguaaaagcacuaaacugaaugcagcucucacuaa

SEQ ID NO: 187927 - RNA, 64 nt, Homo Sapiens
ucauuaaauugaagagucuacauucagaacauaaaagcacuagguauacaaguuugaaauauga

SEQ ID NO: 187928 - RNA, 64 nt, Homo Sapiens
uguucuuaugaagcagcauuaugcaaggggaaaaaagcacuaugucuguguauguauguauaua

SEQ ID NO: 187929 - RNA, 64 nt, Homo Sapiens
auguaugugaucgucaaugugccucccuugcagcaagcacuacagccaaaacaacugguuauau

SEQ ID NO: 187930 - RNA, 64 nt, Homo Sapiens
ucuuugauccaguaguuucccuucaaaauuauaaaagcacuaacgaggacaauauggcaauguc

SEQ ID NO: 187931 - RNA, 64 nt, Homo Sapiens
aaaugugacagaugcagaucuuagaggacuuacaaagcacuauauugguaauucuuacaauggc

SEQ ID NO: 187932 - RNA, 64 nt, Homo Sapiens
ucugggaggaacaaauuuaaucauuucuucuguuaagcacuaaucaguauagugcaacuccugg

SEQ ID NO: 187933 - RNA, 64 nt, Homo Sapiens
cauccuccuucaggaacacggggagcagaggccaaagcacuaaggggagggcgcauacccgaga

SEQ ID NO: 187934 - RNA, 64 nt, Homo Sapiens
cugcuuaucucagagugaagauacugcggcugaaaagcacuaguuugauauaaaauuaaaauga

SEQ ID NO: 187935 - RNA, 64 nt, Homo Sapiens
uuuauuucauccucgaugggaauucuugcuagguaagcacuaauaacucggcaucuugacgaua

SEQ ID NO: 187936 - RNA, 64 nt, Homo Sapiens
uuacacacuauauuuuaauugaauucaaacuaucaagcacuacuuagaaacuggaaaacauaua

SEQ ID NO: 187937 - RNA, 64 nt, Homo Sapiens
ugggauguaccucuccccacuccccuugcuugagaagcacuacucaaaaauuuaccagaccuua

SEQ ID NO: 187938 - RNA, 64 nt, Homo Sapiens
ugacauuuagauaugccaaaagaauuaaaaucaaaagcacuaagaaauacauaguugugugaug

SEQ ID NO: 187939 - RNA, 64 nt, Homo Sapiens
cuuucuuuuaagagcugugaaugaaacuuuuucuaagcacuauucuauugcacacaaacagaaa

SEQ ID NO: 187940 - RNA, 64 nt, Homo Sapiens
uagggauggacauuaaaucuauguguguguuuuaaagcacuagaagccaccaugccuggccugu

SEQ ID NO: 187941 - RNA, 64 nt, Homo Sapiens
cuuuguauuaccaaagcaagaaauuuguauaaauaagcacuauugguacaaucuuucaccaagu

SEQ ID NO: 187942 - RNA, 64 nt, Homo Sapiens
auuuauucuuccgcugucugcacuacucuucuugaagcacuauuucuuuaccuauccucucaau

SEQ ID NO: 187943 - RNA, 64 nt, Homo Sapiens
uuucccugcuucugguuugcugaagauuuucuagaagcacuauuuacacaaauaugcaaaugug

SEQ ID NO: 187944 - RNA, 64 nt, Homo Sapiens
acuuugaugacucugccccucagcagggcuuacuaagcacuaccccuuaacagggaugacuccg

SEQ ID NO: 187945 - RNA, 64 nt, Homo Sapiens
aacucaacuagcaggaagcgguuccaaaagaagaaagcacuaaacuauuaugaaauacaauggu

SEQ ID NO: 187946 - RNA, 64 nt, Homo Sapiens
gacuguaggagaaaagaaagaugugccaccuacaaagcacuagagaaguuaaacuccucuacuu

SEQ ID NO: 187947 - RNA, 64 nt, Homo Sapiens; identical to SEQ ID NO: 187946

SEQ ID NO: 187948 - RNA, 64 nt, Homo Sapiens
acuccuuguuggguaacucagccauggagaugccaagcacuagccaggaggugaguuccucuuu

SEQ ID NO: 187949 - RNA, 64 nt, Homo Sapiens
uaaaaacccacaggugcugcugcuuauaucugugaagcacuagcuuauucuaggaaugccugau

SEQ ID NO: 187950 - RNA, 64 nt, Homo Sapiens
auccccucaaacgagaacaaaaaguauucccugcaagcacuaugaauggaccuuacuacucucu

SEQ ID NO: 187951 - RNA, 64 nt, Homo Sapiens
ucaaagaaagacuguaagcuccaugauuagcauaaagcacuaaccaugucuccaugugacccga

SEQ ID NO: 187952 - RNA, 64 nt, Homo Sapiens
ccauugccaagagaggaugcaucuggggagagcaaagcacuaaggaauucagcaucagccugca

SEQ ID NO: 187953 - RNA, 64 nt, Homo Sapiens
cuauagaugccucuuaggacuugggcucccacauaagcacuaguguauggagcugugccgaggc

SEQ ID NO: 187954 - RNA, 64 nt, Homo Sapiens
aauacucugcagugauuagaaaucagccauaagaaagcacuauuuaucuuugcucccugcaaga

SEQ ID NO: 187955 - RNA, 64 nt, Homo Sapiens
acguugaucuuaaccuuuuuguuccccugucuucaagcacuaaaggauuuuacauguaacugaa

SEQ ID NO: 187956 - RNA, 64 nt, Homo Sapiens
aaaucucaauauagagauuuaaaagcugaaguguaagcacuagggaauggaaguugucauccgu

SEQ ID NO: 187957 - RNA, 64 nt, Homo Sapiens
agcaccuuucucaaggacaagcguuucccucuacaagcacuaggagccauacugcacggacgua

SEQ ID NO: 187958 - RNA, 64 nt, Homo Sapiens
auauuuugauaauaauauuguuuuucuuucuacaaagcacuagagaaugcacagauauacuuug

SEQ ID NO: 187959 - RNA, 64 nt, Homo Sapiens
uuagguuauuacuuuuuuuauaaccagauuuuuaaagcacuagguuuuaaaucaguggguauca

SEQ ID NO: 187960 - RNA, 64 nt, Homo Sapiens
uguugaauucuuugggccuagaauauacuugagaaagcacuaguggcuuguguucagggagagg

SEQ ID NO: 187961 - RNA, 64 nt, Homo Sapiens
gaauuugcaaauucagaacaauauaaauucucauaagcacuauaaucaaacaauauaaaagcca

SEQ ID NO: 187962 - RNA, 64 nt, Homo Sapiens
uuccccagaaggagugauuuuucuaucggcacaaaagcacuauauggacugguaaugguuacag

SEQ ID NO: 187963 - RNA, 64 nt, Homo Sapiens
accaccaggccugcccuaaaagagcuccugaaggaagcacuaaacauggaaaggaacaacugau

SEQ ID NO: 187964 - RNA, 64 nt, Homo Sapiens
uguaacugaccaaagucacacugccaggaacuggaagcacuaggauuugacagcauauccaaau

SEQ ID NO: 187965 - RNA, 64 nt, Homo Sapiens
ccuuccacccccaggcacuggaucccugcauuucaagcacuacggauccuucugcugacugcca

SEQ ID NO: 187966 - RNA, 64 nt, Homo Sapiens
ucucccuuaauaaacucacagcugauucuaggauaagcacuagagaagaucauaggcagcaagg

SEQ ID NO: 187967 - RNA, 64 nt, Homo Sapiens
guugccauaaauguuugcauaaugacauagcuuuaagcacuacaugauuuuaaucugcucacau

SEQ ID NO: 187968 - RNA, 64 nt, Homo Sapiens
ucauguuuuaaaugcuuucuacuugugguucaagaagcacuagauuuaguaagaaacucuaccu

SEQ ID NO: 187969 - RNA, 64 nt, Homo Sapiens
ccacaagaagaugacugaguucuagagaccccacaagcacuauggacgaagcgugggaccccag

SEQ ID NO: 187970 - RNA, 64 nt, Homo Sapiens
uggccuaaaaaagcuacuacucuaauguauuaggaagcacuaaaaacauuuauucagauauggc

SEQ ID NO: 187971 - RNA, 64 nt, Homo Sapiens
gccuuauaugcagggaaggcuagcgcucccaaaaaagcacuaugugucaaguggauggauauuc

SEQ ID NO: 187972 - RNA, 64 nt, Homo Sapiens
cauucuuaaauaccucacugucuuggccauggggaagcacuauggccucagcugggggaaagac

SEQ ID NO: 187973 - RNA, 64 nt, Homo Sapiens
gucaguugccucauagccugcugguccuguaagcaagcacuaagcuccacagugccaguuccuu

SEQ ID NO: 187974 - RNA, 64 nt, Homo Sapiens
cgagaagagauaauuacaaucaggcuaccaaaggaagcacuaacuuuggugcuuucaaguuggc

SEQ ID NO: 187975 - RNA, 64 nt, Homo Sapiens
caauugaaauuuaugugaauuauuuugauuguagaagcacuauaauaugugcugaaacuaaauu

SEQ ID NO: 187976 - RNA, 64 nt, Homo Sapiens
gggauuuuugaagcuguauacugugugcuaaaacaagcacuaaacaaagagugaaggauuuaug

SEQ ID NO: 187977 - RNA, 64 nt, Homo Sapiens
ccuagauucugagaucuucccauucuaggccuacaagcacuacuugcuguagcugagacuuguc

SEQ ID NO: 187978 - RNA, 64 nt, Homo Sapiens
guuguguauuuuguuuccuuauagccauuaaagaaagcacuaaggaugaugggagcuccaaauc

SEQ ID NO: 187979 - RNA, 64 nt, Homo Sapiens
uggccuaaugaaagcuauauacuugugcuaucuaaagcacuacuuuguaaagaugacuacccaa

SEQ ID NO: 187980 - RNA, 64 nt, Homo Sapiens
accugccauagugaguuuaaaggucauuucuacuaagcacuaggaaaacauaggggaaaaaacg

SEQ ID NO: 187981 - RNA, 64 nt, Homo Sapiens
aaaagaaaugauugucuuuuuuucaauaaauaucaagcacuaaaggaaaaagcauuggcauuau

SEQ ID NO: 187982 - RNA, 64 nt, Homo Sapiens
ucaaaacuggcuuauacuguaaucuacaacuaauaagcacuaauuuagaguucagcuauauugu

SEQ ID NO: 187983 - RNA, 64 nt, Homo Sapiens
auagugaauacuuacauagugcuuacuauaugcuaagcacuauuuuuagcauguuauuuauauu

SEQ ID NO: 187984 - RNA, 65 nt, Homo Sapiens; identical to SEQ ID NO: 65694

SEQ ID NO: 187985 - RNA, 65 nt, Homo Sapiens; identical to SEQ ID NO: 65695

SEQ ID NO: 187986 - RNA, 65 nt, Homo Sapiens; identical to SEQ ID NO: 65696

SEQ ID NO: 187987 - RNA, 65 nt, Homo Sapiens; identical to SEQ ID NO: 65697

SEQ ID NO: 187988 - RNA, 65 nt, Homo Sapiens; identical to SEQ ID NO: 65698

SEQ ID NO: 187989 - RNA, 65 nt, Homo Sapiens; identical to SEQ ID NO: 65699

SEQ ID NO: 187990 - RNA, 65 nt, Homo Sapiens; identical to SEQ ID NO: 65700

SEQ ID NO: 187991 - RNA, 65 nt, Homo Sapiens; identical to SEQ ID NO: 65701

SEQ ID NO: 187992 - RNA, 65 nt, Homo Sapiens; identical to SEQ ID NO: 65702

SEQ ID NO: 187993 - RNA, 65 nt, Homo Sapiens; identical to SEQ ID NO: 65703

SEQ ID NO: 187994 - RNA, 65 nt, Homo Sapiens; identical to SEQ ID NO: 65704

SEQ ID NO: 187995 - RNA, 65 nt, Homo Sapiens; identical to SEQ ID NO: 65705

SEQ ID NO: 187996 - RNA, 65 nt, Homo Sapiens; identical to SEQ ID NO: 65706

SEQ ID NO: 187997 - RNA, 65 nt, Homo Sapiens; identical to SEQ ID NO: 65707

SEQ ID NO: 187998 - RNA, 65 nt, Homo Sapiens; identical to SEQ ID NO: 65708

SEQ ID NO: 187999 - RNA, 65 nt, Homo Sapiens; identical to SEQ ID NO: 65709

SEQ ID NO: 188000 - RNA, 65 nt, Homo Sapiens; identical to SEQ ID NO: 65710

SEQ ID NO: 188001 - RNA, 65 nt, Homo Sapiens; identical to SEQ ID NO: 65711

SEQ ID NO: 188002 - RNA, 65 nt, Homo Sapiens; identical to SEQ ID NO: 65712

SEQ ID NO: 188003 - RNA, 65 nt, Homo Sapiens; identical to SEQ ID NO: 65713

SEQ ID NO: 188004 - RNA, 65 nt, Homo Sapiens; identical to SEQ ID NO: 65714

SEQ ID NO: 188005 - RNA, 65 nt, Homo Sapiens; identical to SEQ ID NO: 65715

SEQ ID NO: 188006 - RNA, 65 nt, Homo Sapiens; identical to SEQ ID NO: 65716

SEQ ID NO: 188007 - RNA, 65 nt, Homo Sapiens; identical to SEQ ID NO: 65717

SEQ ID NO: 188008 - RNA, 65 nt, Homo Sapiens; identical to SEQ ID NO: 65718

SEQ ID NO: 188009 - RNA, 65 nt, Homo Sapiens; identical to SEQ ID NO: 65719

SEQ ID NO: 188010 - RNA, 65 nt, Homo Sapiens; identical to SEQ ID NO: 65720

SEQ ID NO: 188011 - RNA, 65 nt, Homo Sapiens; identical to SEQ ID NO: 65721

SEQ ID NO: 188012 - RNA, 65 nt, Homo Sapiens; identical to SEQ ID NO: 65722

SEQ ID NO: 188013 - RNA, 65 nt, Homo Sapiens; identical to SEQ ID NO: 65723

SEQ ID NO: 188014 - RNA, 65 nt, Homo Sapiens; identical to SEQ ID NO: 65724

SEQ ID NO: 188015 - RNA, 65 nt, Homo Sapiens; identical to SEQ ID NO: 65725

SEQ ID NO: 188016 - RNA, 65 nt, Homo Sapiens; identical to SEQ ID NO: 65726

SEQ ID NO: 188017 - RNA, 65 nt, Homo Sapiens; identical to SEQ ID NO: 65727

SEQ ID NO: 188018 - RNA, 65 nt, Homo Sapiens; identical to SEQ ID NO: 65728

SEQ ID NO: 188019 - RNA, 65 nt, Homo Sapiens; identical to SEQ ID NO: 65729

SEQ ID NO: 188020 - RNA, 65 nt, Homo Sapiens; identical to SEQ ID NO: 65730

SEQ ID NO: 188021 - RNA, 65 nt, Homo Sapiens; identical to SEQ ID NO: 65731

SEQ ID NO: 188022 - RNA, 65 nt, Homo Sapiens; identical to SEQ ID NO: 65732

SEQ ID NO: 188023 - RNA, 65 nt, Homo Sapiens; identical to SEQ ID NO: 65733

SEQ ID NO: 188024 - RNA, 65 nt, Homo Sapiens; identical to SEQ ID NO: 65734

SEQ ID NO: 188025 - RNA, 65 nt, Homo Sapiens; identical to SEQ ID NO: 65735

SEQ ID NO: 188026 - RNA, 65 nt, Homo Sapiens; identical to SEQ ID NO: 65736

SEQ ID NO: 188027 - RNA, 65 nt, Homo Sapiens; identical to SEQ ID NO: 65737

SEQ ID NO: 188028 - RNA, 65 nt, Homo Sapiens; identical to SEQ ID NO: 65738

SEQ ID NO: 188029 - RNA, 65 nt, Homo Sapiens; identical to SEQ ID NO: 65739

SEQ ID NO: 188030 - RNA, 65 nt, Homo Sapiens; identical to SEQ ID NO: 65740

SEQ ID NO: 188031 - RNA, 65 nt, Homo Sapiens; identical to SEQ ID NO: 65741

SEQ ID NO: 188032 - RNA, 65 nt, Homo Sapiens; identical to SEQ ID NO: 65742

SEQ ID NO: 188033 - RNA, 65 nt, Homo Sapiens; identical to SEQ ID NO: 65743

SEQ ID NO: 188034 - RNA, 65 nt, Homo Sapiens; identical to SEQ ID NO: 65744

SEQ ID NO: 188035 - RNA, 65 nt, Homo Sapiens; identical to SEQ ID NO: 65745

SEQ ID NO: 188036 - RNA, 65 nt, Homo Sapiens; identical to SEQ ID NO: 65746

SEQ ID NO: 188037 - RNA, 65 nt, Homo Sapiens; identical to SEQ ID NO: 65747

SEQ ID NO: 188038 - RNA, 65 nt, Homo Sapiens; identical to SEQ ID NO: 65748

SEQ ID NO: 188039 - RNA, 65 nt, Homo Sapiens; identical to SEQ ID NO: 65749

SEQ ID NO: 188040 - RNA, 65 nt, Homo Sapiens; identical to SEQ ID NO: 65750

SEQ ID NO: 188041 - RNA, 65 nt, Homo Sapiens; identical to SEQ ID NO: 65751

SEQ ID NO: 188042 - RNA, 65 nt, Homo Sapiens; identical to SEQ ID NO: 65752

SEQ ID NO: 188043 - RNA, 65 nt, Homo Sapiens; identical to SEQ ID NO: 65753

SEQ ID NO: 188044 - RNA, 65 nt, Homo Sapiens; identical to SEQ ID NO: 65754

SEQ ID NO: 188045 - RNA, 65 nt, Homo Sapiens; identical to SEQ ID NO: 65755

SEQ ID NO: 188046 - RNA, 65 nt, Homo Sapiens; identical to SEQ ID NO: 65756

SEQ ID NO: 188047 - RNA, 65 nt, Homo Sapiens; identical to SEQ ID NO: 65757

SEQ ID NO: 188048 - RNA, 65 nt, Homo Sapiens; identical to SEQ ID NO: 65758

SEQ ID NO: 188049 - RNA, 65 nt, Homo Sapiens; identical to SEQ ID NO: 65759

SEQ ID NO: 188050 - RNA, 65 nt, Homo Sapiens; identical to SEQ ID NO: 65760

SEQ ID NO: 188051 - RNA, 65 nt, Homo Sapiens; identical to SEQ ID NO: 65761

SEQ ID NO: 188052 - RNA, 65 nt, Homo Sapiens; identical to SEQ ID NO: 65762

SEQ ID NO: 188053 - RNA, 65 nt, Homo Sapiens; identical to SEQ ID NO: 65763

SEQ ID NO: 188054 - RNA, 65 nt, Homo Sapiens; identical to SEQ ID NO: 65764

SEQ ID NO: 188055 - RNA, 65 nt, Homo Sapiens; identical to SEQ ID NO: 65765

SEQ ID NO: 188056 - RNA, 65 nt, Homo Sapiens; identical to SEQ ID NO: 65766

SEQ ID NO: 188057 - RNA, 65 nt, Homo Sapiens; identical to SEQ ID NO: 65767

SEQ ID NO: 188058 - RNA, 65 nt, Homo Sapiens; identical to SEQ ID NO: 65768

SEQ ID NO: 188059 - RNA, 65 nt, Homo Sapiens; identical to SEQ ID NO: 65769

SEQ ID NO: 188060 - RNA, 65 nt, Homo Sapiens; identical to SEQ ID NO: 65770

SEQ ID NO: 188061 - RNA, 65 nt, Homo Sapiens; identical to SEQ ID NO: 65771

SEQ ID NO: 188062 - RNA, 65 nt, Homo Sapiens; identical to SEQ ID NO: 65772

SEQ ID NO: 188063 - RNA, 65 nt, Homo Sapiens; identical to SEQ ID NO: 65773

SEQ ID NO: 188064 - RNA, 65 nt, Homo Sapiens; identical to SEQ ID NO: 65774

SEQ ID NO: 188065 - RNA, 65 nt, Homo Sapiens; identical to SEQ ID NO: 65775

SEQ ID NO: 188066 - RNA, 65 nt, Homo Sapiens; identical to SEQ ID NO: 65776

SEQ ID NO: 188067 - RNA, 65 nt, Homo Sapiens; identical to SEQ ID NO: 65777

SEQ ID NO: 188068 - RNA, 65 nt, Homo Sapiens; identical to SEQ ID NO: 65778

SEQ ID NO: 188069 - RNA, 65 nt, Homo Sapiens; identical to SEQ ID NO: 65779

SEQ ID NO: 188070 - RNA, 65 nt, Homo Sapiens; identical to SEQ ID NO: 65780

SEQ ID NO: 188071 - RNA, 65 nt, Homo Sapiens; identical to SEQ ID NO: 65781

SEQ ID NO: 188072 - RNA, 65 nt, Homo Sapiens; identical to SEQ ID NO: 65782

SEQ ID NO: 188073 - RNA, 65 nt, Homo Sapiens; identical to SEQ ID NO: 65783

SEQ ID NO: 188074 - RNA, 65 nt, Homo Sapiens; identical to SEQ ID NO: 65784

SEQ ID NO: 188075 - RNA, 65 nt, Homo Sapiens; identical to SEQ ID NO: 65785

SEQ ID NO: 188076 - RNA, 65 nt, Homo Sapiens; identical to SEQ ID NO: 65786

SEQ ID NO: 188077 - RNA, 65 nt, Homo Sapiens; identical to SEQ ID NO: 65787

SEQ ID NO: 188078 - RNA, 65 nt, Homo Sapiens; identical to SEQ ID NO: 65788

SEQ ID NO: 188079 - RNA, 65 nt, Homo Sapiens; identical to SEQ ID NO: 65789

SEQ ID NO: 188080 - RNA, 65 nt, Homo Sapiens; identical to SEQ ID NO: 65790

SEQ ID NO: 188081 - RNA, 65 nt, Homo Sapiens; identical to SEQ ID NO: 65791

SEQ ID NO: 188082 - RNA, 65 nt, Homo Sapiens; identical to SEQ ID NO: 65792

SEQ ID NO: 188083 - RNA, 65 nt, Homo Sapiens; identical to SEQ ID NO: 65793

SEQ ID NO: 188084 - RNA, 65 nt, Homo Sapiens; identical to SEQ ID NO: 65794

SEQ ID NO: 188085 - RNA, 65 nt, Homo Sapiens; identical to SEQ ID NO: 65795

SEQ ID NO: 188086 - RNA, 65 nt, Homo Sapiens; identical to SEQ ID NO: 65796

SEQ ID NO: 188087 - RNA, 65 nt, Homo Sapiens; identical to SEQ ID NO: 65797

SEQ ID NO: 188088 - RNA, 65 nt, Homo Sapiens; identical to SEQ ID NO: 65798

SEQ ID NO: 188089 - RNA, 65 nt, Homo Sapiens; identical to SEQ ID NO: 65799

SEQ ID NO: 188090 - RNA, 65 nt, Homo Sapiens; identical to SEQ ID NO: 65800

SEQ ID NO: 188091 - RNA, 65 nt, Homo Sapiens; identical to SEQ ID NO: 65801

SEQ ID NO: 188092 - RNA, 65 nt, Homo Sapiens; identical to SEQ ID NO: 65802

SEQ ID NO: 188093 - RNA, 65 nt, Homo Sapiens; identical to SEQ ID NO: 65803

SEQ ID NO: 188094 - RNA, 65 nt, Homo Sapiens; identical to SEQ ID NO: 65804

SEQ ID NO: 188095 - RNA, 65 nt, Homo Sapiens; identical to SEQ ID NO: 65805

SEQ ID NO: 188096 - RNA, 65 nt, Homo Sapiens; identical to SEQ ID NO: 65806

SEQ ID NO: 188097 - RNA, 65 nt, Homo Sapiens; identical to SEQ ID NO: 65807

SEQ ID NO: 188098 - RNA, 65 nt, Homo Sapiens; identical to SEQ ID NO: 65808

SEQ ID NO: 188099 - RNA, 65 nt, Homo Sapiens; identical to SEQ ID NO: 65809

SEQ ID NO: 188100 - RNA, 65 nt, Homo Sapiens; identical to SEQ ID NO: 65810

SEQ ID NO: 188101 - RNA, 65 nt, Homo Sapiens; identical to SEQ ID NO: 65811

SEQ ID NO: 188102 - RNA, 65 nt, Homo Sapiens; identical to SEQ ID NO: 65812

SEQ ID NO: 188103 - RNA, 65 nt, Homo Sapiens; identical to SEQ ID NO: 65813

SEQ ID NO: 188104 - RNA, 65 nt, Homo Sapiens; identical to SEQ ID NO: 65814

SEQ ID NO: 188105 - RNA, 65 nt, Homo Sapiens; identical to SEQ ID NO: 65815

SEQ ID NO: 188106 - RNA, 65 nt, Homo Sapiens; identical to SEQ ID NO: 65816

SEQ ID NO: 188107 - RNA, 65 nt, Homo Sapiens; identical to SEQ ID NO: 65817

SEQ ID NO: 188108 - RNA, 65 nt, Homo Sapiens; identical to SEQ ID NO: 65818

SEQ ID NO: 188109 - RNA, 65 nt, Homo Sapiens; identical to SEQ ID NO: 65819

SEQ ID NO: 188110 - RNA, 65 nt, Homo Sapiens; identical to SEQ ID NO: 65820

SEQ ID NO: 188111 - RNA, 65 nt, Homo Sapiens; identical to SEQ ID NO: 65821

SEQ ID NO: 188112 - RNA, 65 nt, Homo Sapiens; identical to SEQ ID NO: 65822

SEQ ID NO: 188113 - RNA, 65 nt, Homo Sapiens; identical to SEQ ID NO: 65823

SEQ ID NO: 188114 - RNA, 65 nt, Homo Sapiens; identical to SEQ ID NO: 65824

SEQ ID NO: 188115 - RNA, 65 nt, Homo Sapiens; identical to SEQ ID NO: 65825

SEQ ID NO: 188116 - RNA, 65 nt, Homo Sapiens; identical to SEQ ID NO: 65826

SEQ ID NO: 188117 - RNA, 65 nt, Homo Sapiens; identical to SEQ ID NO: 65827

SEQ ID NO: 188118 - RNA, 65 nt, Homo Sapiens; identical to SEQ ID NO: 65828

SEQ ID NO: 188119 - RNA, 65 nt, Homo Sapiens; identical to SEQ ID NO: 65829

SEQ ID NO: 188120 - RNA, 65 nt, Homo Sapiens; identical to SEQ ID NO: 65830

SEQ ID NO: 188121 - RNA, 65 nt, Homo Sapiens; identical to SEQ ID NO: 65831

SEQ ID NO: 188122 - RNA, 56 nt, Homo Sapiens; identical to SEQ ID NO: 61369

SEQ ID NO: 188123 - RNA, 65 nt, Homo Sapiens; identical to SEQ ID NO: 65833

SEQ ID NO: 188124 - RNA, 65 nt, Homo Sapiens; identical to SEQ ID NO: 65834

SEQ ID NO: 188125 - RNA, 65 nt, Homo Sapiens; identical to SEQ ID NO: 65835

SEQ ID NO: 188126 - RNA, 65 nt, Homo Sapiens; identical to SEQ ID NO: 65836

SEQ ID NO: 188127 - RNA, 65 nt, Homo Sapiens; identical to SEQ ID NO: 65837

SEQ ID NO: 188128 - RNA, 65 nt, Homo Sapiens; identical to SEQ ID NO: 65838

SEQ ID NO: 188129 - RNA, 65 nt, Homo Sapiens; identical to SEQ ID NO: 65839

SEQ ID NO: 188130 - RNA, 65 nt, Homo Sapiens; identical to SEQ ID NO: 65840

SEQ ID NO: 188131 - RNA, 65 nt, Homo Sapiens; identical to SEQ ID NO: 65841

SEQ ID NO: 188132 - RNA, 65 nt, Homo Sapiens; identical to SEQ ID NO: 65842

SEQ ID NO: 188133 - RNA, 65 nt, Homo Sapiens; identical to SEQ ID NO: 65843

SEQ ID NO: 188134 - RNA, 65 nt, Homo Sapiens; identical to SEQ ID NO: 65844

SEQ ID NO: 188135 - RNA, 65 nt, Homo Sapiens; identical to SEQ ID NO: 65845

SEQ ID NO: 188136 - RNA, 65 nt, Homo Sapiens; identical to SEQ ID NO: 65846

SEQ ID NO: 188137 - RNA, 65 nt, Homo Sapiens; identical to SEQ ID NO: 65847

SEQ ID NO: 188138 - RNA, 65 nt, Homo Sapiens; identical to SEQ ID NO: 65848

SEQ ID NO: 188139 - RNA, 65 nt, Homo Sapiens; identical to SEQ ID NO: 65849

SEQ ID NO: 188140 - RNA, 65 nt, Homo Sapiens; identical to SEQ ID NO: 65850

SEQ ID NO: 188141 - RNA, 65 nt, Homo Sapiens; identical to SEQ ID NO: 65851

SEQ ID NO: 188142 - RNA, 65 nt, Homo Sapiens; identical to SEQ ID NO: 65852

SEQ ID NO: 188143 - RNA, 65 nt, Homo Sapiens; identical to SEQ ID NO: 65853

SEQ ID NO: 188144 - RNA, 65 nt, Homo Sapiens; identical to SEQ ID NO: 65854

SEQ ID NO: 188145 - RNA, 65 nt, Homo Sapiens; identical to SEQ ID NO: 65855

SEQ ID NO: 188146 - RNA, 65 nt, Homo Sapiens; identical to SEQ ID NO: 65856

SEQ ID NO: 188147 - RNA, 65 nt, Homo Sapiens; identical to SEQ ID NO: 65857

SEQ ID NO: 188148 - RNA, 65 nt, Homo Sapiens; identical to SEQ ID NO: 65858

SEQ ID NO: 188149 - RNA, 65 nt, Homo Sapiens; identical to SEQ ID NO: 65859

SEQ ID NO: 188150 - RNA, 65 nt, Homo Sapiens; identical to SEQ ID NO: 65860

SEQ ID NO: 188151 - RNA, 65 nt, Homo Sapiens; identical to SEQ ID NO: 65861

SEQ ID NO: 188152 - RNA, 65 nt, Homo Sapiens; identical to SEQ ID NO: 65862

SEQ ID NO: 188153 - RNA, 65 nt, Homo Sapiens; identical to SEQ ID NO: 65863

SEQ ID NO: 188154 - RNA, 65 nt, Homo Sapiens; identical to SEQ ID NO: 65864

SEQ ID NO: 188155 - RNA, 65 nt, Homo Sapiens; identical to SEQ ID NO: 65865

SEQ ID NO: 188156 - RNA, 65 nt, Homo Sapiens; identical to SEQ ID NO: 65866

SEQ ID NO: 188157 - RNA, 65 nt, Homo Sapiens; identical to SEQ ID NO: 65867

SEQ ID NO: 188158 - RNA, 65 nt, Homo Sapiens; identical to SEQ ID NO: 65868

SEQ ID NO: 188159 - RNA, 65 nt, Homo Sapiens; identical to SEQ ID NO: 65869

SEQ ID NO: 188160 - RNA, 65 nt, Homo Sapiens; identical to SEQ ID NO: 65870

SEQ ID NO: 188161 - RNA, 65 nt, Homo Sapiens; identical to SEQ ID NO: 65871

SEQ ID NO: 188162 - RNA, 65 nt, Homo Sapiens; identical to SEQ ID NO: 65872

SEQ ID NO: 188163 - RNA, 65 nt, Homo Sapiens; identical to SEQ ID NO: 65873

SEQ ID NO: 188164 - RNA, 65 nt, Homo Sapiens; identical to SEQ ID NO: 65874

SEQ ID NO: 188165 - RNA, 65 nt, Homo Sapiens; identical to SEQ ID NO: 65875

SEQ ID NO: 188166 - RNA, 65 nt, Homo Sapiens; identical to SEQ ID NO: 65876

SEQ ID NO: 188167 - RNA, 65 nt, Homo Sapiens; identical to SEQ ID NO: 65877

SEQ ID NO: 188168 - RNA, 65 nt, Homo Sapiens; identical to SEQ ID NO: 65878

SEQ ID NO: 188169 - RNA, 65 nt, Homo Sapiens; identical to SEQ ID NO: 65879

SEQ ID NO: 188170 - RNA, 65 nt, Homo Sapiens; identical to SEQ ID NO: 65880

SEQ ID NO: 188171 - RNA, 65 nt, Homo Sapiens; identical to SEQ ID NO: 65881

SEQ ID NO: 188172 - RNA, 65 nt, Homo Sapiens; identical to SEQ ID NO: 65882

SEQ ID NO: 188173 - RNA, 65 nt, Homo Sapiens; identical to SEQ ID NO: 65883

SEQ ID NO: 188174 - RNA, 65 nt, Homo Sapiens; identical to SEQ ID NO: 65884

SEQ ID NO: 188175 - RNA, 65 nt, Homo Sapiens; identical to SEQ ID NO: 65885

SEQ ID NO: 188176 - RNA, 65 nt, Homo Sapiens; identical to SEQ ID NO: 65886

SEQ ID NO: 188177 - RNA, 65 nt, Homo Sapiens; identical to SEQ ID NO: 65887

SEQ ID NO: 188178 - RNA, 65 nt, Homo Sapiens; identical to SEQ ID NO: 65888

SEQ ID NO: 188179 - RNA, 65 nt, Homo Sapiens; identical to SEQ ID NO: 65889

SEQ ID NO: 188180 - RNA, 65 nt, Homo Sapiens; identical to SEQ ID NO: 65890

SEQ ID NO: 188181 - RNA, 65 nt, Homo Sapiens; identical to SEQ ID NO: 65891

SEQ ID NO: 188182 - RNA, 65 nt, Homo Sapiens; identical to SEQ ID NO: 65892

SEQ ID NO: 188183 - RNA, 65 nt, Homo Sapiens; identical to SEQ ID NO: 65893

SEQ ID NO: 188184 - RNA, 65 nt, Homo Sapiens; identical to SEQ ID NO: 65894

SEQ ID NO: 188185 - RNA, 65 nt, Homo Sapiens; identical to SEQ ID NO: 65895

SEQ ID NO: 188186 - RNA, 65 nt, Homo Sapiens; identical to SEQ ID NO: 65896

SEQ ID NO: 188187 - RNA, 65 nt, Homo Sapiens; identical to SEQ ID NO: 65897

SEQ ID NO: 188188 - RNA, 65 nt, Homo Sapiens; identical to SEQ ID NO: 65898

SEQ ID NO: 188189 - RNA, 65 nt, Homo Sapiens; identical to SEQ ID NO: 65899

SEQ ID NO: 188190 - RNA, 65 nt, Homo Sapiens; identical to SEQ ID NO: 65900

SEQ ID NO: 188191 - RNA, 65 nt, Homo Sapiens; identical to SEQ ID NO: 65901

SEQ ID NO: 188192 - RNA, 65 nt, Homo Sapiens; identical to SEQ ID NO: 65902

SEQ ID NO: 188193 - RNA, 65 nt, Homo Sapiens; identical to SEQ ID NO: 65903

SEQ ID NO: 188194 - RNA, 65 nt, Homo Sapiens; identical to SEQ ID NO: 65904

SEQ ID NO: 188195 - RNA, 65 nt, Homo Sapiens; identical to SEQ ID NO: 65905

SEQ ID NO: 188196 - RNA, 65 nt, Homo Sapiens; identical to SEQ ID NO: 65906

SEQ ID NO: 188197 - RNA, 65 nt, Homo Sapiens; identical to SEQ ID NO: 65907

SEQ ID NO: 188198 - RNA, 65 nt, Homo Sapiens; identical to SEQ ID NO: 65908

SEQ ID NO: 188199 - RNA, 65 nt, Homo Sapiens; identical to SEQ ID NO: 65909

SEQ ID NO: 188200 - RNA, 65 nt, Homo Sapiens; identical to SEQ ID NO: 65910

SEQ ID NO: 188201 - RNA, 65 nt, Homo Sapiens; identical to SEQ ID NO: 65911

SEQ ID NO: 188202 - RNA, 65 nt, Homo Sapiens; identical to SEQ ID NO: 65912

SEQ ID NO: 188203 - RNA, 65 nt, Homo Sapiens; identical to SEQ ID NO: 65913

SEQ ID NO: 188204 - RNA, 65 nt, Homo Sapiens; identical to SEQ ID NO: 65914

SEQ ID NO: 188205 - RNA, 65 nt, Homo Sapiens; identical to SEQ ID NO: 65915

SEQ ID NO: 188206 - RNA, 65 nt, Homo Sapiens; identical to SEQ ID NO: 65916

SEQ ID NO: 188207 - RNA, 65 nt, Homo Sapiens; identical to SEQ ID NO: 65917

SEQ ID NO: 188208 - RNA, 65 nt, Homo Sapiens; identical to SEQ ID NO: 65918

SEQ ID NO: 188209 - RNA, 65 nt, Homo Sapiens; identical to SEQ ID NO: 65919

SEQ ID NO: 188210 - RNA, 65 nt, Homo Sapiens; identical to SEQ ID NO: 65920

SEQ ID NO: 188211 - RNA, 65 nt, Homo Sapiens; identical to SEQ ID NO: 65921

SEQ ID NO: 188212 - RNA, 65 nt, Homo Sapiens; identical to SEQ ID NO: 65922

SEQ ID NO: 188213 - RNA, 65 nt, Homo Sapiens; identical to SEQ ID NO: 65923

SEQ ID NO: 188214 - RNA, 60 nt, Homo Sapiens; identical to SEQ ID NO: 65087

SEQ ID NO: 188215 - RNA, 65 nt, Homo Sapiens; identical to SEQ ID NO: 65925

SEQ ID NO: 188216 - RNA, 65 nt, Homo Sapiens; identical to SEQ ID NO: 65926

SEQ ID NO: 188217 - RNA, 65 nt, Homo Sapiens; identical to SEQ ID NO: 65927

SEQ ID NO: 188218 - RNA, 65 nt, Homo Sapiens; identical to SEQ ID NO: 65928

SEQ ID NO: 188219 - RNA, 65 nt, Homo Sapiens; identical to SEQ ID NO: 65929

SEQ ID NO: 188220 - RNA, 65 nt, Homo Sapiens; identical to SEQ ID NO: 65930

SEQ ID NO: 188221 - RNA, 51 nt, Homo Sapiens; identical to SEQ ID NO: 65094

SEQ ID NO: 188222 - RNA, 65 nt, Homo Sapiens; identical to SEQ ID NO: 65932

SEQ ID NO: 188223 - RNA, 65 nt, Homo Sapiens; identical to SEQ ID NO: 65933

SEQ ID NO: 188224 - RNA, 65 nt, Homo Sapiens; identical to SEQ ID NO: 65934

SEQ ID NO: 188225 - RNA, 65 nt, Homo Sapiens; identical to SEQ ID NO: 65935

SEQ ID NO: 188226 - RNA, 65 nt, Homo Sapiens; identical to SEQ ID NO: 65936

SEQ ID NO: 188227 - RNA, 65 nt, Homo Sapiens; identical to SEQ ID NO: 65937

SEQ ID NO: 188228 - RNA, 65 nt, Homo Sapiens; identical to SEQ ID NO: 65938

SEQ ID NO: 188229 - RNA, 65 nt, Homo Sapiens; identical to SEQ ID NO: 65939

SEQ ID NO: 188230 - RNA, 65 nt, Homo Sapiens; identical to SEQ ID NO: 65940

SEQ ID NO: 188231 - RNA, 65 nt, Homo Sapiens; identical to SEQ ID NO: 65941

SEQ ID NO: 188232 - RNA, 65 nt, Homo Sapiens; identical to SEQ ID NO: 65942

SEQ ID NO: 188233 - RNA, 65 nt, Homo Sapiens; identical to SEQ ID NO: 65943

SEQ ID NO: 188234 - RNA, 65 nt, Homo Sapiens; identical to SEQ ID NO: 65944

SEQ ID NO: 188235 - RNA, 65 nt, Homo Sapiens; identical to SEQ ID NO: 65945

SEQ ID NO: 188236 - RNA, 65 nt, Homo Sapiens; identical to SEQ ID NO: 65946

SEQ ID NO: 188237 - RNA, 65 nt, Homo Sapiens; identical to SEQ ID NO: 65947

SEQ ID NO: 188238 - RNA, 65 nt, Homo Sapiens; identical to SEQ ID NO: 65948

SEQ ID NO: 188239 - RNA, 65 nt, Homo Sapiens; identical to SEQ ID NO: 65949

SEQ ID NO: 188240 - RNA, 65 nt, Homo Sapiens; identical to SEQ ID NO: 65950

SEQ ID NO: 188241 - RNA, 65 nt, Homo Sapiens; identical to SEQ ID NO: 65951

SEQ ID NO: 188242 - RNA, 65 nt, Homo Sapiens; identical to SEQ ID NO: 65952

SEQ ID NO: 188243 - RNA, 65 nt, Homo Sapiens; identical to SEQ ID NO: 65953

SEQ ID NO: 188244 - RNA, 65 nt, Homo Sapiens; identical to SEQ ID NO: 65954

SEQ ID NO: 188245 - RNA, 65 nt, Homo Sapiens; identical to SEQ ID NO: 65955

SEQ ID NO: 188246 - RNA, 65 nt, Homo Sapiens; identical to SEQ ID NO: 65956

SEQ ID NO: 188247 - RNA, 65 nt, Homo Sapiens; identical to SEQ ID NO: 65957

SEQ ID NO: 188248 - RNA, 65 nt, Homo Sapiens; identical to SEQ ID NO: 65958

SEQ ID NO: 188249 - RNA, 65 nt, Homo Sapiens; identical to SEQ ID NO: 65959

SEQ ID NO: 188250 - RNA, 65 nt, Homo Sapiens; identical to SEQ ID NO: 65960

SEQ ID NO: 188251 - RNA, 65 nt, Homo Sapiens; identical to SEQ ID NO: 65961

SEQ ID NO: 188252 - RNA, 65 nt, Homo Sapiens; identical to SEQ ID NO: 65962

SEQ ID NO: 188253 - RNA, 65 nt, Homo Sapiens; identical to SEQ ID NO: 65963

SEQ ID NO: 188254 - RNA, 65 nt, Homo Sapiens; identical to SEQ ID NO: 65964

SEQ ID NO: 188255 - RNA, 65 nt, Homo Sapiens; identical to SEQ ID NO: 65965

SEQ ID NO: 188256 - RNA, 65 nt, Homo Sapiens; identical to SEQ ID NO: 65966

SEQ ID NO: 188257 - RNA, 65 nt, Homo Sapiens; identical to SEQ ID NO: 65967

SEQ ID NO: 188258 - RNA, 65 nt, Homo Sapiens; identical to SEQ ID NO: 65968

SEQ ID NO: 188259 - RNA, 65 nt, Homo Sapiens; identical to SEQ ID NO: 65969

SEQ ID NO: 188260 - RNA, 65 nt, Homo Sapiens; identical to SEQ ID NO: 65970

SEQ ID NO: 188261 - RNA, 65 nt, Homo Sapiens; identical to SEQ ID NO: 65971

SEQ ID NO: 188262 - RNA, 65 nt, Homo Sapiens; identical to SEQ ID NO: 65972

SEQ ID NO: 188263 - RNA, 64 nt, Homo Sapiens
uugaagcggaagcagccugugcggaaacgccagugacacguacacaccacguccuggucuuugu

SEQ ID NO: 188264 - RNA, 64 nt, Homo Sapiens
gaagcagcaguccugccccaaccucaaguguauugacacguaaagacugaagaaacaagaagaa

SEQ ID NO: 188265 - RNA, 64 nt, Homo Sapiens
uugaacaaacacucuuaacuccuaauuguucuuugacacguaguaauucugugacauacuuuuu

SEQ ID NO: 188266 - RNA, 64 nt, Homo Sapiens
ugggaauguuuuuagcugguggcaauaaauaccagacacguacaaaauccagcuaugaauauag

SEQ ID NO: 188267 - RNA, 64 nt, Homo Sapiens
gagcagauaaagaauucacuuccaggcugugagggacacguaugugggggcagccgaugccugg

SEQ ID NO: 188268 - RNA, 64 nt, Homo Sapiens
ccugauugaucuucugagagcucgaaugcugcuggacacguaccccuuucuauuauuacuuugu

SEQ ID NO: 188269 - RNA, 64 nt, Homo Sapiens
gguggcugaugucgccacagagcauccaccccgugacacguaguugcucuguuuucucuuccuc

SEQ ID NO: 188270 - RNA, 64 nt, Homo Sapiens
aguuguucuuaauuuuuuuccuaagugaauacaggacacguauucucucauuugcccucuuuuu

SEQ ID NO: 188271 - RNA, 64 nt, Homo Sapiens
cuggaacugaguaccauucacuagaaucaaaugugacacguaggacauuuuggugaaaaugugc

SEQ ID NO: 188272 - RNA, 64 nt, Homo Sapiens
acaacuaguuaaguauaaaaugccaaauaaaagugacacguacaaugugguuuauaaaaauaag

SEQ ID NO: 188273 - RNA, 64 nt, Homo Sapiens
accaaagcuacucucucugcugcuuagaacuguggacacguauggaaagacuggacccccauug

SEQ ID NO: 188274 - RNA, 64 nt, Homo Sapiens
gcaccugucucucucugagaacacggugugucucgacacguaccacguacguggaaacacaaga

SEQ ID NO: 188275 - RNA, 64 nt, Homo Sapiens
cgguaccacuaagguuuuggaaaaccuuuuagaggacacguaggaaaaguuuauauguaggaua

SEQ ID NO: 188276 - RNA, 64 nt, Homo Sapiens
agcuuagacuaaggccauuaucagugucacuggcgacacguagcuuuucauuuaguuugauuau

SEQ ID NO: 188277 - RNA, 64 nt, Homo Sapiens
uauuuaacugaaacaaguuuucaugacaugcacggacacguacagugguaagaaggauauuuaa

SEQ ID NO: 188278 - RNA, 64 nt, Homo Sapiens
gcucuuuuguaagauuuauuagucugaaagcucugacacguagaaccucaugucuguucucaua

SEQ ID NO: 188279 - RNA, 64 nt, Homo Sapiens
ucgggacagcccugcugucagaugaaaacagaaugacacguaaaauccaggauuuuuuuuuucu

SEQ ID NO: 188280 - RNA, 64 nt, Homo Sapiens
uuuuguauuuuggcugcuagagugcagcauuugugacacguauuugaaauuugaaauuuccuuc

SEQ ID NO: 188281 - RNA, 64 nt, Homo Sapiens
accagaccaaccucaauccccugccacacacacagacacguaauaccgacugcccgccccuccc

SEQ ID NO: 188282 - RNA, 64 nt, Homo Sapiens
cuucaccggcuccuuuugcugacaccaagacacagacacguacuuuugcugugaggagcuagau

SEQ ID NO: 188283 - RNA, 64 nt, Homo Sapiens
uuguauuacaauuuuuauuuuaggaacuuauucagacacguaaauguuguuuaauucuguaggu

SEQ ID NO: 188284 - RNA, 64 nt, Homo Sapiens
cuggggugaggagugucugcuugcuggggccgcagacacguaggggagaccacccucugggucc

SEQ ID NO: 188285 - RNA, 64 nt, Homo Sapiens
cuaugucagacacuacaugaaggcagauccucuggacacguaacagggguagcuagcgugugcc

SEQ ID NO: 188286 - RNA, 64 nt, Homo Sapiens
cuaaggugugucagggucuacauccagaaauaaagacacguacauuaaguuuuuucuuuuauau

SEQ ID NO: 188287 - RNA, 64 nt, Homo Sapiens
uucgaugcccauuaguuuuauauaacauuuauuugacacguacugacuucuaucugagaagaac

SEQ ID NO: 188288 - RNA, 64 nt, Homo Sapiens
aauaauguuuuaccaucucuucaccagucaaguugacacguaaaauuaaccaucacauugguaa

SEQ ID NO: 188289 - RNA, 64 nt, Homo Sapiens
acaccugucauugagccaagaaaguccaguuuaugacacguauguacuagugaacaccguccuc

SEQ ID NO: 188290 - RNA, 64 nt, Homo Sapiens
ucugucugacggaaaacagaaugguggaaggcaggacacguaucuucagaguacaaauuggugg

SEQ ID NO: 188291 - RNA, 64 nt, Homo Sapiens
cuuuaaaaguguucuuuaacauuuaaauaaugcugacacguacuaauugugaaaugcauuauug

SEQ ID NO: 188292 - RNA, 64 nt, Homo Sapiens
guuccggggcccccucagccaggugggaaugacggacacguacuauccaaguguaugggauuaa

SEQ ID NO: 188293 - RNA, 64 nt, Homo Sapiens
gggcagugaggaaacgggguuuaggggccggucagacacguaggcuuuggggaccagaggaaca

SEQ ID NO: 188294 - RNA, 64 nt, Homo Sapiens
aggaacucggaagguagaacaggggcaggagacagacacguaacaugggagccaggaaagauuu

SEQ ID NO: 188295 - RNA, 64 nt, Homo Sapiens
auacuuugaaagcaaaaauacaaucaaacacauugacacguauauaaagauccacgcguggcug

SEQ ID NO: 188296 - RNA, 64 nt, Homo Sapiens
auagaacagccuggcuuauuuuggaccauuguccaugccucaggcugcaucaaugcaagccugg

SEQ ID NO: 188297 - RNA, 64 nt, Homo Sapiens
acguucugggagaaaacuuacacaaagccgguaaaugccucaauagaaauggugccauugaagc

SEQ ID NO: 188298 - RNA, 64 nt, Homo Sapiens
cccaucucugcuccuguuuguaggggccuccccuaugccucagcccuccuccucagggcagcgc

SEQ ID NO: 188299 - RNA, 64 nt, Homo Sapiens
cccaggcaaccccacugcuccucccagacaccaaaugccucaucccacacaccucucgaggcac

SEQ ID NO: 188300 - RNA, 64 nt, Homo Sapiens
uaaaaaaaaaauuaaaugucauuaaacugccaugaugccucaguaugcaauuaaauaccucacu

SEQ ID NO: 188301 - RNA, 64 nt, Homo Sapiens
aauuagccuucgaaagaaaacugacucaggcagaaugccucauaccuuccacuuagcaauagcc

SEQ ID NO: 188302 - RNA, 64 nt, Homo Sapiens
cauaggagauaaaacccccacugagaugccucucaugccucagcugggacccaccguguagaca

SEQ ID NO: 188303 - RNA, 64 nt, Homo Sapiens
acuaacauucuuguaggagugguuagagaagcugaugccucauuucuacauucugucauuagcu

SEQ ID NO: 188304 - RNA, 64 nt, Homo Sapiens
cuaaauuuaugaccugcugaccaaguaguuugcccauggcaaacugucauauuucauguuggga

SEQ ID NO: 188305 - RNA, 64 nt, Homo Sapiens
aaaugugugucaccaucaggcuaugagucuccugcauggcaacaaagcaagauugaaauuugaa

SEQ ID NO: 188306 - RNA, 64 nt, Homo Sapiens
ugugucuuucucuggacaaccaagaaguuaggcucauggcaacgacacauauucacauggcgcu

SEQ ID NO: 188307 - RNA, 64 nt, Homo Sapiens
gcccuggggauuuccgauucuagauccaacuggccauggcaaaaccuuccuacaaucaggaaga

SEQ ID NO: 188308 - RNA, 64 nt, Homo Sapiens
uaauucacuuuccaucuuuuuuuguaauaaaaaucauggcaacauuuucuguuuuuggaaauaa

SEQ ID NO: 188309 - RNA, 64 nt, Homo Sapiens
uuuguauauaaaugaacaaaaacuuaaaaauauccauggcaagccagucugcugguuaaaugga

SEQ ID NO: 188310 - RNA, 64 nt, Homo Sapiens
guaaucuuuacaagcauagcuggcugugagucaucauggcaagggccccugguuaagggagauc

SEQ ID NO: 188311 - RNA, 64 nt, Homo Sapiens
ggggcugguuuuucauuucccaguuggggcuguucauggcaagucugcccgaaugaaauccgaa

SEQ ID NO: 188312 - RNA, 64 nt, Homo Sapiens
ccccuuauuuacuaaaaauaagcagccuggccaacauggcaaaaccugaggucaggaguucgag

SEQ ID NO: 188313 - RNA, 64 nt, Homo Sapiens
acauauauauacauauauauguauauauagaacacauggcaagagcaggaaaugggaagacuac

SEQ ID NO: 188314 - RNA, 64 nt, Homo Sapiens
uuauuuuuaaacacccuuaaagacagauauaucucauggcaaauuugguauccuguuacagccu

SEQ ID NO: 188315 - RNA, 64 nt, Homo Sapiens
uguucacaggcuuucacagcaaggguaccuauuucauggcaaaauaggcaguuuuaaaagaaua

SEQ ID NO: 188316 - RNA, 64 nt, Homo Sapiens
cuugagcccaggaguuugagaccagccugggcaacauggcaaaaccccaucucuacaaaaaaua

SEQ ID NO: 188317 - RNA, 64 nt, Homo Sapiens
cuugagcccaggaguuugaaaccagccuggguaacauggcaaaauccugucuuuacaaaaaaua

SEQ ID NO: 188318 - RNA, 64 nt, Homo Sapiens
ccugaagucagaaguuugagaccagccuggcaaacauggcaaaacugucucuauuaaaaauaca

SEQ ID NO: 188319 - RNA, 64 nt, Homo Sapiens
gcuacaacagguacggcagcgcaaggcccugcuacauggcaacuggccagccucagccucuaug

SEQ ID NO: 188320 - RNA, 64 nt, Homo Sapiens
ccagcaacuugaccaggaucggauguuugagaugcauggcaagagcuucucugcuaccaugggu

SEQ ID NO: 188321 - RNA, 64 nt, Homo Sapiens
guggguuccuccuucugcaauggcuggucgucaucauggcaacaacccuggcagccccaccagc

SEQ ID NO: 188322 - RNA, 61 nt, Homo Sapiens
uacccaggucagauugacgggaccagaagggaacaucgacuucuaauccagcuuucuuguu

SEQ ID NO: 188323 - RNA, 61 nt, Homo Sapiens
auaaauuuagaaacguaucacccauacguccaacaucgaaagaaaaccaguguuaugacuu

SEQ ID NO: 188324 - RNA, 61 nt, Homo Sapiens
ugacgcccucgcugcuccuaccuggcuacuaaacaucgacuucgguucacuucacggaugu

SEQ ID NO: 188325 - RNA, 61 nt, Homo Sapiens
caaacauuguucuucuccguguccuggguacaacaucgaauaauauuucuuggccuccuuu

SEQ ID NO: 188326 - RNA, 61 nt, Homo Sapiens
gugaaaagaucuauuggaaagccauguauucaacaucgaguguuuuauucaucugcaaaga

SEQ ID NO: 188327 - RNA, 61 nt, Homo Sapiens
ccagggagaaagugauccuuaccuccacagcaacaucgaaauuuuuuaauggaacaugaaa

SEQ ID NO: 188328 - RNA, 61 nt, Homo Sapiens
uaaucauaggaucccauuaaauaagugugcuaacaucgaauauagagaaaacugguaaaga

SEQ ID NO: 188329 - RNA, 61 nt, Homo Sapiens
ccuacuaauaauuauuagaaauacauuuaaaaacaucgaguaccucaagucaguuugccuu

SEQ ID NO: 188330 - RNA, 61 nt, Homo Sapiens
caaaguggaacuuuggauuguuuuuacagacaacaucgaguaauggcuuguaaaugugaau

SEQ ID NO: 188331 - RNA, 61 nt, Homo Sapiens
uaacgaaugguacguuuaaaaucagaaacaaaacaucgaacaaaacccuauuuaagagacu

SEQ ID NO: 188332 - RNA, 61 nt, Homo Sapiens
ggcuuaugccaaauggaagauuuaaaaaacaaacaucgaaaugauuuguauauuucacugg

SEQ ID NO: 188333 - RNA, 61 nt, Homo Sapiens
aguuauuuuguagcguacauauagcuuucauaacaucgaaaguucuuguacucuacaaaau

SEQ ID NO: 188334 - RNA, 61 nt, Homo Sapiens
auugcuguuuagcuugacuguuuuccucaagaacaucgaucugaaggauucauaaggagcu

SEQ ID NO: 188335 - RNA, 61 nt, Homo Sapiens
gcucgguuugcuauauagggaauauauaaggaacaucgaaauuguauacaaagauuuguac

SEQ ID NO: 188336 - RNA, 61 nt, Homo Sapiens
ggaguuucuggaagaggaaagccaugcguggaacaucgaagccucagagagugggagacug

SEQ ID NO: 188337 - RNA, 61 nt, Homo Sapiens
aucuauacuccuauuggaguggaugcugaugaacaucgaacauaucuacuucauuagagca

SEQ ID NO: 188338 - RNA, 61 nt, Homo Sapiens
aggacagucugcauuacucaucaagcccacuaacaucgaggcagaccuucaccugacugga

SEQ ID NO: 188339 - RNA, 61 nt, Homo Sapiens
aaaacucgacaccacauuucaggcuuuacccaacaucgaaauaauggagagaaaauuguug

SEQ ID NO: 188340 - RNA, 61 nt, Homo Sapiens
uaacuagugauuccuucagaaggcaacggauaacaucgagagucucgcuaagaaaugaaaa

SEQ ID NO: 188341 - RNA, 61 nt, Homo Sapiens
ucuacuacucucuagccuuaggccuuuucuaaacaucgacucuuucagauuuugaacaagc

SEQ ID NO: 188342 - RNA, 61 nt, Homo Sapiens
aacuuaaauauuauggaaaaaaaaauaucuaaacaucgaaaaaacuugugcuucaccgaag

SEQ ID NO: 188343 - RNA, 61 nt, Homo Sapiens
guccaaucuuguucgaucacuagaugauucuaacaucgaaauaaaccucuuuuuauauggc

SEQ ID NO: 188344 - RNA, 61 nt, Homo Sapiens
cugguuauaaguaaaaccauugugaaagguaaacaucgaaaagcugucaaauaagacauuc

SEQ ID NO: 188345 - RNA, 61 nt, Homo Sapiens
cucgugucccccucgcaggccucauucuuugaacaucgacucugaaguuugauacagauag

SEQ ID NO: 188346 - RNA, 61 nt, Homo Sapiens
ccuucccacccaucgcuguguguuaguucccaacaucgaauguguacaacuuaaguugguc

SEQ ID NO: 188347 - RNA, 61 nt, Homo Sapiens
guuuugcuguaaauaauaacuucuuuuuuaaaacaucgauaaggguauaaacacuauuugu

SEQ ID NO: 188348 - RNA, 61 nt, Homo Sapiens
gcuguuagugaccugcuguccaccccuccucaacaucgagcucuguuguaaauacgucgca

SEQ ID NO: 188349 - RNA, 61 nt, Homo Sapiens
uaacuggaaauuaggugggagugaacauugaaacaucgacggguaguugagaacuuaaaaa

SEQ ID NO: 188350 - RNA, 61 nt, Homo Sapiens
guugggggagggguugguccucuauuuauuuaacaucgaggcacccccuucccccaccacu

SEQ ID NO: 188351 - RNA, 61 nt, Homo Sapiens
accaaaacagaacagaaagguguggugcuggaacaucgaugaaggagcccuacuuacugag

SEQ ID NO: 188352 - RNA, 61 nt, Homo Sapiens
aaauuugugcuucaccgaagaaaaauaucuaaacaucgagaaacuaugggaaaaaaaauug

SEQ ID NO: 188353 - RNA, 61 nt, Homo Sapiens
cauuaccaugcgguacgcagacaaacacaugaacaucgacuuugacaguuucaucugcugc

SEQ ID NO: 188354 - RNA, 61 nt, Homo Sapiens
aggagauccaacccaggggacuggcaacuauaacaucgaagacuuugccgaccugggcaug

SEQ ID NO: 188355 - RNA, 61 nt, Homo Sapiens
ggcuuuaaaacaacuguuuauccucucugucaacaucgagagggcacagagagaacaacau

SEQ ID NO: 188356 - RNA, 61 nt, Homo Sapiens
agguuagccuggccacaggcccgucucccacaacaucgagguuggaucaacagcuuuuucu

SEQ ID NO: 188357 - RNA, 61 nt, Homo Sapiens
ugcuaagaagaacaaaaagagcaucacguaaaacaucgauauuagguccccgaggugccca

SEQ ID NO: 188358 - RNA, 61 nt, Homo Sapiens
ccaugcuuuguuugauuugucucagauuccuaacaucgagccuuuccccuuucuaaauacc

SEQ ID NO: 188359 - RNA, 61 nt, Homo Sapiens
uuuaaaacgucuuagagccuuuuaucugcagaacaucgauauguauaucauucuacagaau

SEQ ID NO: 188360 - RNA, 61 nt, Homo Sapiens
gauagaaacgcuuaagcaguugccuuuuuuaaacaucgauacgagaccucugaauuuguau

SEQ ID NO: 188361 - RNA, 61 nt, Homo Sapiens
gaucuucccugagggccggcccgugguagccaacaucgagccacucuuugaccgguugcuc

SEQ ID NO: 188362 - RNA, 61 nt, Homo Sapiens
gugugccacccucccuguaagucuauuuaaaaacaucgacgauacauugaaaugugugaac

SEQ ID NO: 188363 - RNA, 61 nt, Homo Sapiens
guggggacagcccucgcccucaucuggccugaacaucgacuuugggggccucagugcagga

SEQ ID NO: 188364 - RNA, 61 nt, Homo Sapiens
agggacaaauggauagagaagaaaagggucaaacaucgagauuacauggauguuaaauuau

SEQ ID NO: 188365 - RNA, 59 nt, Homo Sapiens
ucgggcccccgcugcccugacacccccugagcccccaucugcugaacccugacugguaa

SEQ ID NO: 188366 - RNA, 64 nt, Homo Sapiens
aggcccggcccccucuggcuuggagagcauuccaagcccccaccccaccccuagaacugccauu

SEQ ID NO: 188367 - RNA, 64 nt, Homo Sapiens
cgauugagaagccaaucagugaacccuuuggcaaagcccccauccacaccuggcacuccccucu

SEQ ID NO: 188368 - RNA, 64 nt, Homo Sapiens
gggaccaauuuaguguccuuccaccugugagccaagcccccauuugaggacaucuaucguauuc

SEQ ID NO: 188369 - RNA, 64 nt, Homo Sapiens
agagagggaaggagggaggaggcaucuucccugaagcccccaaucuggccccccccuccccaga

SEQ ID NO: 188370 - RNA, 64 nt, Homo Sapiens
ugguuguccccgccaggccggggaagguuggagcagcccccagggaggggggcacuagguguca

SEQ ID NO: 188371 - RNA, 64 nt, Homo Sapiens
aggggucucugcccagcacacaggguccagccugagcccccacccugcccucgggggccucucc

SEQ ID NO: 188372 - RNA, 64 nt, Homo Sapiens
cagucagcagccccugcagagcugcgugcacaggagcccccaggcugcagaaccagcugcaaca

SEQ ID NO: 188373 - RNA, 64 nt, Homo Sapiens
ucccaucugggauagggaccggagucauaggaaaagcccccaucuuccagcugggggauggggg

SEQ ID NO: 188374 - RNA, 64 nt, Homo Sapiens
caccccagaccccagguggaucagcccagguucuagcccccacguacaacagcuccaggacauc

SEQ ID NO: 188375 - RNA, 64 nt, Homo Sapiens
aagccugcuccccucucugggaagacucgaguccagcccccaggcccaccccaucugaggcaga

SEQ ID NO: 188376 - RNA, 64 nt, Homo Sapiens
ucacccaucuguagcucccucccgaggccuggggagcccccagccuucuggcugcccccaaugc

SEQ ID NO: 188377 - RNA, 64 nt, Homo Sapiens
cucucccagucucucccugcaguccugcagcagcagcccccacccccaagcuuggugcugagcc

SEQ ID NO: 188378 - RNA, 64 nt, Homo Sapiens
ucuccuccagccccugcacacucccacccaggacagcccccagcccaacuaggaaagggccaug

SEQ ID NO: 188379 - RNA, 64 nt, Homo Sapiens
cagccaagaauuucgggcuguuugacuuucugugagcccccagcgaggggaggcccagccuccg

SEQ ID NO: 188380 - RNA, 64 nt, Homo Sapiens
uucagcagccccucagggcuucccaaggauguccagcccccacacccacacguuaacauaauga

SEQ ID NO: 188381 - RNA, 64 nt, Homo Sapiens
gaucugggguggucagggcugcauagacugcuagagcccccagggagguguagauaaucuagag

SEQ ID NO: 188382 - RNA, 64 nt, Homo Sapiens
aucucccacccacccagcuagggggcccacuagcagcccccagcgggguggucaggaugggcug

SEQ ID NO: 188383 - RNA, 64 nt, Homo Sapiens
cccgucaccccgcucuucccuuugggggacgcccagcccccaccaaaggaaacaaagcaauagg

SEQ ID NO: 188384 - RNA, 64 nt, Homo Sapiens
ccgauauaagccauagccccgacgagcagagcgcagcccccacgcuccgcggaggccccugagg

SEQ ID NO: 188385 - RNA, 64 nt, Homo Sapiens
uagccauccaugggagagagcuugacaucaccugagcccccaccugggaucuagaucuuuccuc

SEQ ID NO: 188386 - RNA, 64 nt, Homo Sapiens
ugggucucagaggagcugggucucuccuagccucagcccccagcgggacuccugagaacacggu

SEQ ID NO: 188387 - RNA, 64 nt, Homo Sapiens
cugugugcggugcccaggcccuaggagcucccccagcccccagguccuccugaccacuccccuc

SEQ ID NO: 188388 - RNA, 64 nt, Homo Sapiens
ccccucugaugcugucugcagcucagucccugccagcccccaggagcgccuccagggccccgcc

SEQ ID NO: 188389 - RNA, 64 nt, Homo Sapiens
cuggggcaucuggcuggugccugcugccauggccagcccccacucucacccugcacaggggguc

SEQ ID NO: 188390 - RNA, 64 nt, Homo Sapiens
agcccccacucucacccugcacagggggucuugcagcccccaggcccacagccucguugggagg

SEQ ID NO: 188391 - RNA, 64 nt, Homo Sapiens
ucggucacaucaggcccgcuagguccagagagcgagcccccaaugcccggccaggcuaagccgc

SEQ ID NO: 188392 - RNA, 64 nt, Homo Sapiens
augcccggccaggcuaagccgcagagacccucucagcccccaccucagguuagggcucugcccg

SEQ ID NO: 188393 - RNA, 64 nt, Homo Sapiens
uucuagauugggaaacgaaguuucuguuguuugaagcccccaacaagccaccguguccagccag

SEQ ID NO: 188394 - RNA, 52 nt, Homo Sapiens
agagcugggguugaagaggcggagcccccagcacaacucccccagccgcuga

SEQ ID NO: 188395 - RNA, 62 nt, Homo Sapiens
uggccccugacuccaugugggauccagcccccagcccccagcgacccagguugaggaaguga

SEQ ID NO: 188396 - RNA, 55 nt, Homo Sapiens
ccccagcuggccccugacucgauccagcccccagcgacccagguugaggaaguga

SEQ ID NO: 188397 - RNA, 64 nt, Homo Sapiens
gccugcggggcagugauguccccagcccaagaggagcccccacugcugcccaccaagcccugcc

SEQ ID NO: 188398 - RNA, 64 nt, Homo Sapiens
caagucccuucucuagggugucucuccucaaagcagcccccaagcaguguguccaaccagcugu

SEQ ID NO: 188399 - RNA, 64 nt, Homo Sapiens
ccgagggaggacccugagggccgcgaagcauccgagcccccagcugggaaggggcaggccggug

SEQ ID NO: 188400 - RNA, 64 nt, Homo Sapiens
aaucugcuucucggaucucccucagucugcccccagcccccaaacuccuccuggcuagacugua

SEQ ID NO: 188401 - RNA, 64 nt, Homo Sapiens
uauggacaggcugggacagaucauuugcacccauagcccccaucuggucccuaccugggcaguc

SEQ ID NO: 188402 - RNA, 64 nt, Homo Sapiens
cuuggccuuaccuuucuacugaauuagaggcgugagcccccaugcucagacucccaaagcggug

SEQ ID NO: 188403 - RNA, 64 nt, Homo Sapiens
gccuggcgccagggcucacacgcucagcccccacagcccccacacccuccuccaggcccccgga

SEQ ID NO: 188404 - RNA, 64 nt, Homo Sapiens
gcccccacagccuggcgccagcccccggacgcucagcccccacaugacggcugcccuccuccag

SEQ ID NO: 188405 - RNA, 64 nt, Homo Sapiens
ugagggcggcugcaggagaggaaggggcucccacagcccccacugaugccgcugcaggccccug

SEQ ID NO: 188406 - RNA, 64 nt, Homo Sapiens
uaaggaugaaagcaaaggagggccuugaggaagcagcccccaggccuggcagccacgcagcggc

SEQ ID NO: 188407 - RNA, 64 nt, Homo Sapiens
agaaacagcuguuacucuacggauuuguagaacaagcccccaugcgaguguugagcccaagggg

SEQ ID NO: 188408 - RNA, 64 nt, Homo Sapiens
uccugugccuccaucagcuagcaggagcacacccagcccccacacagcucagcuuccccaacac

SEQ ID NO: 188409 - RNA, 64 nt, Homo Sapiens
cugccuuucgcccuacugaguugccuguuuccgaagcccccacaaggauugcagggguccagcc

SEQ ID NO: 188410 - RNA, 64 nt, Homo Sapiens
gcuuccuucuggccccucuggccccacuucccucagcccccaggccacccacaggccaugucca

SEQ ID NO: 188411 - RNA, 64 nt, Homo Sapiens
gagcccccuuccccaucagagaaucugaggggagagcccccagacuuacccucccaguuggcca

SEQ ID NO: 188412 - RNA, 64 nt, Homo Sapiens
agagggggucaguguuuccuugacaaugucaucuagcccccaggaugagguccaugcagcucuu

SEQ ID NO: 188413 - RNA, 64 nt, Homo Sapiens
uaccuuugcuuagggcugggcugaggcaugcagcagcccccagcguggacggugccagcugagg

SEQ ID NO: 188414 - RNA, 64 nt, Homo Sapiens
cccacagcccugagagauggaggagcuggcagaaagcccccagccuucuuaaaaaucagcuuua

SEQ ID NO: 188415 - RNA, 64 nt, Homo Sapiens
cugggcacuaggugggcccugugcuggcaucgacagcccccacuggcccaggcagggcuggggu

SEQ ID NO: 188416 - RNA, 64 nt, Homo Sapiens
uuccaggcgccuucgcccugccgcccagugagccagcccccacccccgccugccccgcggaaga

SEQ ID NO: 188417 - RNA, 64 nt, Homo Sapiens
uccacucuggaugggccuguguggccguggucuuagcccccagugcgccaggcccccacagucu

SEQ ID NO: 188418 - RNA, 64 nt, Homo Sapiens
ccagggcccuguaagcugugggcugccagcucacagcccccacccaggugagcuguguccucua

SEQ ID NO: 188419 - RNA, 64 nt, Homo Sapiens
uccacgccuguugccaugugacaguaggggcaguagcccccagcauggggagcccaccgccuac

SEQ ID NO: 188420 - RNA, 64 nt, Homo Sapiens
guguguugaaauccugucauuuauaccucucccaagcccccauuuuccuccugagucuggguaa

SEQ ID NO: 188421 - RNA, 64 nt, Homo Sapiens
uguucauuaaagaggcaacuacaaggaaccucagagcccccauuugccauuacugcaucauaau

SEQ ID NO: 188422 - RNA, 64 nt, Homo Sapiens
ucuuugccagaugaugggaaucuacuugaucuccagcccccaggccuggaacucuuccagccuu

SEQ ID NO: 188423 - RNA, 64 nt, Homo Sapiens
uugggagaggggaguggauugagcccuuccucucagcccccauguucaucacugcugucugcua

SEQ ID NO: 188424 - RNA, 64 nt, Homo Sapiens
aguauguuuuugugucuuaagggugagaggcaucagcccccacaccuggaagauguggggugcu

SEQ ID NO: 188425 - RNA, 64 nt, Homo Sapiens
cugccuggugugcagcuaacaccaaggcuuuguuagcccccaccuuuuccuccuacuggucucc

SEQ ID NO: 188426 - RNA, 64 nt, Homo Sapiens
uauauauauauauauauguauaugucuguaccccagcccccaccuuucagauucugcucuuggc

SEQ ID NO: 188427 - RNA, 64 nt, Homo Sapiens
cuuguggugcuagauguguguuuagagcuaaaccagcccccacccccacccuccaccugccccu

SEQ ID NO: 188428 - RNA, 64 nt, Homo Sapiens
agggcccuccgagguggagcaccccuacucccggagcccccagcccgcuuccuuucucagcuga

SEQ ID NO: 188429 - RNA, 64 nt, Homo Sapiens
agggcccuccgagguggaacgaaccccuacccggagcccccagcggccgcuuccuuucucagcu

SEQ ID NO: 188430 - RNA, 64 nt, Homo Sapiens
guccacagcagucugagcuggcaggucauggagcagcccccaaagagcuguggcuggggggaug

SEQ ID NO: 188431 - RNA, 64 nt, Homo Sapiens
cgugcugcuuacacuccagguguggaccggccgcagcccccacugaccugcccauguccagagg

SEQ ID NO: 188432 - RNA, 64 nt, Homo Sapiens
ccuccacaagccuaguccauccugccugagcuccagcccccagcccccacugugcccagacaug

SEQ ID NO: 188433 - RNA, 64 nt, Homo Sapiens
aagccuaguccauccugccugagcuccagcccccagcccccacugugcccagacaugugugcuc

SEQ ID NO: 188434 - RNA, 64 nt, Homo Sapiens
ggccuuaagcuuuccaggggccggggcaguggggagcccccaucccuucacaccgccaccaacu

SEQ ID NO: 188435 - RNA, 64 nt, Homo Sapiens
cccacaggccaacccuggcacaggucaugucugcagcccccagaauguucuggacaugcaccac

SEQ ID NO: 188436 - RNA, 64 nt, Homo Sapiens
ucgcucacuucgcucgcuccgcgucccccaugccagcccccaacgcagggcgcccggcgaagcc

SEQ ID NO: 188437 - RNA, 64 nt, Homo Sapiens
ccggaggaaauccugaagcugacccucaccuccgagcccccacucccaccccagccgcacaguu

SEQ ID NO: 188438 - RNA, 64 nt, Homo Sapiens
aucuccuggggcccccaugggggagcauggccucagcccccagccuugggaagcagcuccugcu

SEQ ID NO: 188439 - RNA, 64 nt, Homo Sapiens
ccuggcaggcaugcgcugggggcugcaguauuauagcccccaggugcaaggugcuagaccaaug

SEQ ID NO: 188440 - RNA, 64 nt, Homo Sapiens
uggcacugucuuccuggccggggccugaaaccuuagcccccagccggccugagugggggauauu

SEQ ID NO: 188441 - RNA, 64 nt, Homo Sapiens
cgugaagugccaacgcccuccccacccugggccgagcccccaccccucccugggcccccaagug

SEQ ID NO: 188442 - RNA, 64 nt, Homo Sapiens
gugagagcucagaguuucugggguccucauuaggagcccccaucccuguguuccccaagaauuc

SEQ ID NO: 188443 - RNA, 64 nt, Homo Sapiens
uacggggggaccgggugagccagugacccccuguagcccccagcuucaggccucagugucugcc

SEQ ID NO: 188444 - RNA, 64 nt, Homo Sapiens
aagcucggucacuugagugugcgaccucccuuccagcccccagaaagcugagcacagaccagca

SEQ ID NO: 188445 - RNA, 64 nt, Homo Sapiens
cccuucuugaaacgagagccuguaacucccuuacagcccccagagcccuccuccacucccuuuu

SEQ ID NO: 188446 - RNA, 64 nt, Homo Sapiens
cuggccauggguccuugcccccgacagacagagcagcccccacccgggagccuugauggggguc

SEQ ID NO: 188447 - RNA, 64 nt, Homo Sapiens
agucccucccaccacccucgccgcaggcagcugcagcccccagaggggaccacaagcccaaaaa

SEQ ID NO: 188448 - RNA, 64 nt, Homo Sapiens
agggccagcacagaggggccuuccucccccacagagcccccaugacauagucugcucugggcgg

SEQ ID NO: 188449 - RNA, 64 nt, Homo Sapiens
cacaccuaagcgucguggagccaguggucuggggagcccccaggcuuucccuccuugucuggcc

SEQ ID NO: 188450 - RNA, 64 nt, Homo Sapiens
ccgaagccaucugccaaauuugccaaccuucccuagcccccaaacuccgagccugcuaccuggu

SEQ ID NO: 188451 - RNA, 64 nt, Homo Sapiens
uuggaaggaggaagggcugaccuggguucucuccagcccccaggugcgccgggucacccgugcc

SEQ ID NO: 188452 - RNA, 64 nt, Homo Sapiens
cggcuggcccgggccaugggcugcgcaaaucaccagcccccaacccagggaggaacuggccccu

SEQ ID NO: 188453 - RNA, 64 nt, Homo Sapiens
aggccagggggguggggggccgcccucaucaggcagcccccagcccccugaggcccuguccauc

SEQ ID NO: 188454 - RNA, 64 nt, Homo Sapiens
gggaucuggggcuuccuggccuggccagagcuggagcccccacaggguaaggaagagagagugg

SEQ ID NO: 188455 - RNA, 64 nt, Homo Sapiens
ggcggggacagggccagauuacgcaggccuggggagcccccaguccugucccaguuuaucagga

SEQ ID NO: 188456 - RNA, 64 nt, Homo Sapiens
augccccucaaccuaucccgcaagagguggcgagagcccccaucaccuguuccagaggugcaga

SEQ ID NO: 188457 - RNA, 64 nt, Homo Sapiens
agcggcuggagggaugccacaccccucacagggcagcccccaacuacaucuucccugcuuacuc

SEQ ID NO: 188458 - RNA, 64 nt, Homo Sapiens
ccacacugaggccaggucuaccccccaucauaccagcccccaggaccacuaccccacggccagc

SEQ ID NO: 188459 - RNA, 59 nt, Homo Sapiens
agcccacugugcuugcaaaguccugagugugucacuaacaggcugcugucacuagcccc

SEQ ID NO: 188460 - RNA, 59 nt, Homo Sapiens
cccuccugagugugucacuagaaggcugcugucacuagcgucugugcacucucucugug

SEQ ID NO: 188461 - RNA, 59 nt, Homo Sapiens
aaggacaucucuagcauuucgcaagaaugugucacuaguuccagagaacuuguucuuca

SEQ ID NO: 188462 - RNA, 59 nt, Homo Sapiens
uucuccuuaaagcuccagccgggcuucagugucacuauuauacuugugauauagucaug

SEQ ID NO: 188463 - RNA, 59 nt, Homo Sapiens
cucucuugccuucagacagacuacaggucugucacuaugagaaacagccugggcugggg

SEQ ID NO: 188464 - RNA, 59 nt, Homo Sapiens
gugaauguuguauacgauuguaaggcuuaugucacuaaagauuuuuauucugauuuuuu

SEQ ID NO: 188465 - RNA, 59 nt, Homo Sapiens
cuuaggagaaaaugauucuguaauuccagugucacuaauuuauauuguucuuuccucug

SEQ ID NO: 188466 - RNA, 59 nt, Homo Sapiens
cccgucacuacagccucaccucccaccccugucacuacggccucaccucccaccccugu

SEQ ID NO: 188467 - RNA, 59 nt, Homo Sapiens
ccugucacuacggccucaccucccaccccugucacuacagccucaccuccuacagccuu

SEQ ID NO: 188468 - RNA, 59 nt, Homo Sapiens
caaauugugcugcacaugaggaaauaggcugucacuaucacauuguccugaaaacagca

SEQ ID NO: 188469 - RNA, 59 nt, Homo Sapiens
ucuuuuccuagagcuggucaccacuaggcugucacuauaaauuccuugaauauaaguaa

SEQ ID NO: 188470 - RNA, 59 nt, Homo Sapiens
guaggcucacuggauuggucgagggggcuugucacuauuuacucucaaagccaugugug

SEQ ID NO: 188471 - RNA, 59 nt, Homo Sapiens
guccguggcuacaauucaaaaaagauucaugucacuacucugugcaccagugugacagg

SEQ ID NO: 188472 - RNA, 64 nt, Homo Sapiens; identical to SEQ ID NO: 183969

SEQ ID NO: 188473 - RNA, 64 nt, Homo Sapiens; identical to SEQ ID NO: 183970

SEQ ID NO: 188474 - RNA, 64 nt, Homo Sapiens; identical to SEQ ID NO: 183971

SEQ ID NO: 188475 - RNA, 64 nt, Homo Sapiens; identical to SEQ ID NO: 183972

SEQ ID NO: 188476 - RNA, 64 nt, Homo Sapiens; identical to SEQ ID NO: 183973

SEQ ID NO: 188477 - RNA, 64 nt, Homo Sapiens; identical to SEQ ID NO: 183974

SEQ ID NO: 188478 - RNA, 64 nt, Homo Sapiens; identical to SEQ ID NO: 183975

SEQ ID NO: 188479 - RNA, 64 nt, Homo Sapiens; identical to SEQ ID NO: 183976

SEQ ID NO: 188480 - RNA, 64 nt, Homo Sapiens; identical to SEQ ID NO: 183977

SEQ ID NO: 188481 - RNA, 64 nt, Homo Sapiens; identical to SEQ ID NO: 183978

SEQ ID NO: 188482 - RNA, 64 nt, Homo Sapiens; identical to SEQ ID NO: 183979

SEQ ID NO: 188483 - RNA, 64 nt, Homo Sapiens; identical to SEQ ID NO: 183980

SEQ ID NO: 188484 - RNA, 64 nt, Homo Sapiens; identical to SEQ ID NO: 183981

SEQ ID NO: 188485 - RNA, 64 nt, Homo Sapiens; identical to SEQ ID NO: 183982

SEQ ID NO: 188486 - RNA, 64 nt, Homo Sapiens
ugugggcugaccaggaccucugacccuggagcuucuaccaaagacacagcugggucuggacccc

SEQ ID NO: 188487 - RNA, 64 nt, Homo Sapiens
ugggucauugcggucuuagauuauguuucucuugcuaccaaacagucauguauuaacucucuuu

SEQ ID NO: 188488 - RNA, 64 nt, Homo Sapiens
cugcucaguagucaucucuguaaaucugcaauuucuaccaaaaugugugaucguagaucucaaa

SEQ ID NO: 188489 - RNA, 64 nt, Homo Sapiens
uuuccccuugcagcuacacuuacuuucucccugacuaccaaauggagugacgguugaagaauca

SEQ ID NO: 188490 - RNA, 64 nt, Homo Sapiens
acaccagccugagcaacaugguaaaaccccaucucuaccaaaaauacaaaaauuagcugggcuu

SEQ ID NO: 188491 - RNA, 64 nt, Homo Sapiens
agaccagccuggcuaacauggugaaauccuaucucuaccaaaaauacaaaaauuagccaggcgu

SEQ ID NO: 188492 - RNA, 64 nt, Homo Sapiens
uguucuguuuuuaaaccaacaaacauguuacuauucauuggacagauaucauuuuauguauaaa

SEQ ID NO: 188493 - RNA, 64 nt, Homo Sapiens
agggguagcccucaaaaauagauuuaucauuuacucauuggaauuuucuucaaguguuaaaggu

SEQ ID NO: 188494 - RNA, 64 nt, Homo Sapiens
ggcucuguauaaaaaacuucuggaccaaaagccaucauuggaagauuuaaaagaacucaguccu

SEQ ID NO: 188495 - RNA, 64 nt, Homo Sapiens
agacauuucuacccugaagaacuaaugacagcaaucauuggaaauacugauuaugacuggaaac

SEQ ID NO: 188496 - RNA, 64 nt, Homo Sapiens
uguucaaaaaggaaaaaauucagaagaucugaaaucauuggaccaaaugacaaaaagccuuuuc

SEQ ID NO: 188497 - RNA, 64 nt, Homo Sapiens
ugaaacugguaauaaaacugauuuuauagaaccaucauuggaaauuuaucagaaauuauacuau

SEQ ID NO: 188498 - RNA, 64 nt, Homo Sapiens
uggaaagagaugugaucauggauuaaacaccagcucauuggaaacucauuggaugagaucagaa

SEQ ID NO: 188499 - RNA, 64 nt, Homo Sapiens
gugaucauggauuaaacaccagcucauuggaaacucauuggaugagaucagaaaacguucauga

SEQ ID NO: 188500 - RNA, 64 nt, Homo Sapiens
ugaacacugacuuuugcauaauuuuuaaguaucuucauuggagacacagguccuuauugccauu

SEQ ID NO: 188501 - RNA, 64 nt, Homo Sapiens
uucuuuguaauuuuaauuccuccauauaugugguucauuggaagaucugcugagaugacuuucu

SEQ ID NO: 188502 - RNA, 64 nt, Homo Sapiens
gccuuacuuggguuugcaccuauggcaaaagcauucauuggagaaauuguauauuugucuuacg

SEQ ID NO: 188503 - RNA, 64 nt, Homo Sapiens
ucagaaaacccacccuggggacaguaugaacaucucauuggacccagugucaguugugcugcag

SEQ ID NO: 188504 - RNA, 64 nt, Homo Sapiens
uagggaaagggacagauuuuuugauauuuauuaaucauuggauuauuuuaaaaugcaaaauaca

SEQ ID NO: 188505 - RNA, 64 nt, Homo Sapiens
uguaaaacuugaagccauaauacaucauguuucuucauuggauuuuaaauaccuuucagguagu

SEQ ID NO: 188506 - RNA, 64 nt, Homo Sapiens
gagaauugcacagaaaguccgggaguggguaggaucauuggagagucuguguauucaugacuuu

SEQ ID NO: 188507 - RNA, 64 nt, Homo Sapiens
gauacuuaaugcugugaaacuuugcagacugauuucauuggaugaaauagccuuuaaggguuuc

SEQ ID NO: 188508 - RNA, 64 nt, Homo Sapiens
gauacucuauaaauguguggagacacaaaaggacucauuggaaaguucucucagcuccuugcac

SEQ ID NO: 188509 - RNA, 64 nt, Homo Sapiens
ucaaagacaugaaaggacucagccuuuguuuauuucauuggauuaaaugcaagauaugugggaa

SEQ ID NO: 188510 - RNA, 64 nt, Homo Sapiens
gcccccuugacacauccaggagaugucuuuacuagagcugaaagagcuccuuggauguggagac

SEQ ID NO: 188511 - RNA, 64 nt, Homo Sapiens
cacuuguccaaggucucacgacuugaggcucugagagcugaaaaccccacuuucuggaugacag

SEQ ID NO: 188512 - RNA, 64 nt, Homo Sapiens
cugguuuucaaggccucuguaaauucauuccauagagcugaaauaaagacgggacauaagggga

SEQ ID NO: 188513 - RNA, 64 nt, Homo Sapiens
acacaccuggucugccccuagcaagagaaacuuggagcugaagcggccgcauuuugcugcuaaa

SEQ ID NO: 188514 - RNA, 64 nt, Homo Sapiens
aggugguggccguggguuccugaugucggugcaggagcugaaggugaguggagugcugccaaga

SEQ ID NO: 188515 - RNA, 64 nt, Homo Sapiens
gcucacccccaggauguguacccgguuguaguaggagcugaaauccaugcugagcuguaccagg

SEQ ID NO: 188516 - RNA, 64 nt, Homo Sapiens
uaagauagcuguuguacuuuaccagcaauguugagagcugaacuagguuuugguuccaaacuca

SEQ ID NO: 188517 - RNA, 64 nt, Homo Sapiens
agauggccuuaugaaacucugggcuugguacaaugagcugaauucaaagaaucuagugugcuca

SEQ ID NO: 188518 - RNA, 64 nt, Homo Sapiens
uguuugccacuucauuucauuuccuugaguaaaugagcugaaguguaaagcaaagaauagcaga

SEQ ID NO: 188519 - RNA, 64 nt, Homo Sapiens
cuagccacauucccaaggucccaaggagaaggaagagcugaaauucaucuccuagugacagugc

SEQ ID NO: 188520 - RNA, 64 nt, Homo Sapiens
gaucugagucccaggagcugcccagaguugcugggagcugaaaaaucacauccuggccuggcac

SEQ ID NO: 188521 - RNA, 64 nt, Homo Sapiens
uaucauucauucuuagcucuuaauuguucauuuugagcugaaaugcugcauuuuaauuuuaacc

SEQ ID NO: 188522 - RNA, 64 nt, Homo Sapiens
aagucucagcacauuccaaggagugguagaaacagagcugaagguguccccauuguagauuagu

SEQ ID NO: 188523 - RNA, 64 nt, Homo Sapiens
cuucuuuagcucaucuguggugucagaauccuuggagcugaagagagaaaucaaaagagcauga

SEQ ID NO: 188524 - RNA, 64 nt, Homo Sapiens
agagaauaaaaugccaaucccugcccauggucuugagcugaaugauggggagccagcagaguuc

SEQ ID NO: 188525 - RNA, 64 nt, Homo Sapiens
aaauuguuuacugccaauuguggacauccaugaagagcugaaggugugcggguugucauuuucc

SEQ ID NO: 188526 - RNA, 64 nt, Homo Sapiens
acccugacauucaugauccauuuuuucugaccaggagcugaaagcucacucugacaugacagua

SEQ ID NO: 188527 - RNA, 64 nt, Homo Sapiens
gagaaaugauaaugcuuccaaagauuaaaagugagagcugaaaauacuaaggaaaauaacugaa

SEQ ID NO: 188528 - RNA, 64 nt, Homo Sapiens
cgagcagcgggccgagccacgcagcggcuucgaggagcugaacaacgagaacaagagcacacug

SEQ ID NO: 188529 - RNA, 64 nt, Homo Sapiens
caagagcacacugcaguuggagcagcaaguaaaggagcugaagaagucgggugagcugaaagag

SEQ ID NO: 188530 - RNA, 64 nt, Homo Sapiens
gagcagcaaguaaaggagcugaagaagucggguggagcugaagagccaagaggcuccgagucug

SEQ ID NO: 188531 - RNA, 64 nt, Homo Sapiens
ccgcccaugcuggauaggaccugggaugcugcuggagcugaaucggaugccaccaaggcucggu

SEQ ID NO: 188532 - RNA, 64 nt, Homo Sapiens
auguagguaccagcucaaccccacgcaaguuccugagcugaacauggagcaaggggagggugac

SEQ ID NO: 188533 - RNA, 64 nt, Homo Sapiens
acugguuagacagugggugcagcccacggagggugagcugaagcaggguggggcguaaccucac

SEQ ID NO: 188534 - RNA, 64 nt, Homo Sapiens
aaccaguuuagagaagaacauaaaugaccugauggagcugaaaaacacagcaugagaacuucgu

SEQ ID NO: 188535 - RNA, 64 nt, Homo Sapiens; identical to SEQ ID NO: 21812

SEQ ID NO: 188536 - RNA, 64 nt, Homo Sapiens; identical to SEQ ID NO: 21813

SEQ ID NO: 188537 - RNA, 64 nt, Homo Sapiens; identical to SEQ ID NO: 21814

SEQ ID NO: 188538 - RNA, 64 nt, Homo Sapiens; identical to SEQ ID NO: 21815

SEQ ID NO: 188539 - RNA, 64 nt, Homo Sapiens; identical to SEQ ID NO: 21816

SEQ ID NO: 188540 - RNA, 64 nt, Homo Sapiens; identical to SEQ ID NO: 21817

SEQ ID NO: 188541 - RNA, 64 nt, Homo Sapiens; identical to SEQ ID NO: 21818

SEQ ID NO: 188542 - RNA, 64 nt, Homo Sapiens; identical to SEQ ID NO: 21819

SEQ ID NO: 188543 - RNA, 64 nt, Homo Sapiens; identical to SEQ ID NO: 21820

SEQ ID NO: 188544 - RNA, 64 nt, Homo Sapiens; identical to SEQ ID NO: 21821

SEQ ID NO: 188545 - RNA, 64 nt, Homo Sapiens; identical to SEQ ID NO: 21822

SEQ ID NO: 188546 - RNA, 64 nt, Homo Sapiens; identical to SEQ ID NO: 21823

SEQ ID NO: 188547 - RNA, 64 nt, Homo Sapiens; identical to SEQ ID NO: 21824

SEQ ID NO: 188548 - RNA, 64 nt, Homo Sapiens; identical to SEQ ID NO: 21825

SEQ ID NO: 188549 - RNA, 64 nt, Homo Sapiens; identical to SEQ ID NO: 21826

SEQ ID NO: 188550 - RNA, 64 nt, Homo Sapiens; identical to SEQ ID NO: 21827

SEQ ID NO: 188551 - RNA, 64 nt, Homo Sapiens; identical to SEQ ID NO: 21828

SEQ ID NO: 188552 - RNA, 64 nt, Homo Sapiens; identical to SEQ ID NO: 21829

SEQ ID NO: 188553 - RNA, 64 nt, Homo Sapiens; identical to SEQ ID NO: 21830

SEQ ID NO: 188554 - RNA, 64 nt, Homo Sapiens; identical to SEQ ID NO: 21831

SEQ ID NO: 188555 - RNA, 50 nt, Homo Sapiens; identical to SEQ ID NO: 21832

SEQ ID NO: 188556 - RNA, 64 nt, Homo Sapiens; identical to SEQ ID NO: 21833

SEQ ID NO: 188557 - RNA, 64 nt, Homo Sapiens; identical to SEQ ID NO: 21834

SEQ ID NO: 188558 - RNA, 64 nt, Homo Sapiens; identical to SEQ ID NO: 21835

SEQ ID NO: 188559 - RNA, 64 nt, Homo Sapiens; identical to SEQ ID NO: 21836

SEQ ID NO: 188560 - RNA, 64 nt, Homo Sapiens; identical to SEQ ID NO: 21837

SEQ ID NO: 188561 - RNA, 64 nt, Homo Sapiens; identical to SEQ ID NO: 21838

SEQ ID NO: 188562 - RNA, 64 nt, Homo Sapiens; identical to SEQ ID NO: 21839

SEQ ID NO: 188563 - RNA, 64 nt, Homo Sapiens; identical to SEQ ID NO: 21840

SEQ ID NO: 188564 - RNA, 64 nt, Homo Sapiens; identical to SEQ ID NO: 21841

SEQ ID NO: 188565 - RNA, 64 nt, Homo Sapiens; identical to SEQ ID NO: 21842

SEQ ID NO: 188566 - RNA, 64 nt, Homo Sapiens; identical to SEQ ID NO: 21843

SEQ ID NO: 188567 - RNA, 64 nt, Homo Sapiens; identical to SEQ ID NO: 21844

SEQ ID NO: 188568 - RNA, 64 nt, Homo Sapiens; identical to SEQ ID NO: 21845

SEQ ID NO: 188569 - RNA, 64 nt, Homo Sapiens; identical to SEQ ID NO: 21846

SEQ ID NO: 188570 - RNA, 64 nt, Homo Sapiens; identical to SEQ ID NO: 21847

SEQ ID NO: 188571 - RNA, 64 nt, Homo Sapiens; identical to SEQ ID NO: 21848

SEQ ID NO: 188572 - RNA, 64 nt, Homo Sapiens; identical to SEQ ID NO: 21849

SEQ ID NO: 188573 - RNA, 64 nt, Homo Sapiens; identical to SEQ ID NO: 21850

SEQ ID NO: 188574 - RNA, 64 nt, Homo Sapiens; identical to SEQ ID NO: 21851

SEQ ID NO: 188575 - RNA, 64 nt, Homo Sapiens; identical to SEQ ID NO: 21852

SEQ ID NO: 188576 - RNA, 64 nt, Homo Sapiens; identical to SEQ ID NO: 21853

SEQ ID NO: 188577 - RNA, 64 nt, Homo Sapiens; identical to SEQ ID NO: 21854

SEQ ID NO: 188578 - RNA, 64 nt, Homo Sapiens; identical to SEQ ID NO: 21855

SEQ ID NO: 188579 - RNA, 64 nt, Homo Sapiens; identical to SEQ ID NO: 21856

SEQ ID NO: 188580 - RNA, 64 nt, Homo Sapiens; identical to SEQ ID NO: 21857

SEQ ID NO: 188581 - RNA, 64 nt, Homo Sapiens; identical to SEQ ID NO: 21858

SEQ ID NO: 188582 - RNA, 64 nt, Homo Sapiens; identical to SEQ ID NO: 21859

SEQ ID NO: 188583 - RNA, 64 nt, Homo Sapiens; identical to SEQ ID NO: 21860

SEQ ID NO: 188584 - RNA, 64 nt, Homo Sapiens; identical to SEQ ID NO: 21861

SEQ ID NO: 188585 - RNA, 64 nt, Homo Sapiens; identical to SEQ ID NO: 21862

SEQ ID NO: 188586 - RNA, 64 nt, Homo Sapiens; identical to SEQ ID NO: 21863

SEQ ID NO: 188587 - RNA, 64 nt, Homo Sapiens; identical to SEQ ID NO: 21864

SEQ ID NO: 188588 - RNA, 64 nt, Homo Sapiens; identical to SEQ ID NO: 21865

SEQ ID NO: 188589 - RNA, 64 nt, Homo Sapiens; identical to SEQ ID NO: 21866

SEQ ID NO: 188590 - RNA, 64 nt, Homo Sapiens; identical to SEQ ID NO: 21867

SEQ ID NO: 188591 - RNA, 64 nt, Homo Sapiens; identical to SEQ ID NO: 21868

SEQ ID NO: 188592 - RNA, 64 nt, Homo Sapiens; identical to SEQ ID NO: 21869

SEQ ID NO: 188593 - RNA, 64 nt, Homo Sapiens; identical to SEQ ID NO: 21870

SEQ ID NO: 188594 - RNA, 64 nt, Homo Sapiens; identical to SEQ ID NO: 21871

SEQ ID NO: 188595 - RNA, 64 nt, Homo Sapiens; identical to SEQ ID NO: 21872

SEQ ID NO: 188596 - RNA, 64 nt, Homo Sapiens; identical to SEQ ID NO: 21873

SEQ ID NO: 188597 - RNA, 64 nt, Homo Sapiens; identical to SEQ ID NO: 21874

SEQ ID NO: 188598 - RNA, 63 nt, Homo Sapiens
gcaucggaauauauuuggagcacacccuaguaaccucuugagauuaaauuacauagucuuaau

SEQ ID NO: 188599 - RNA, 63 nt, Homo Sapiens
gccccagcuucacugcuuggaagcaugucccucccucuugaguuggcucugauuugaaaucgg

SEQ ID NO: 188600 - RNA, 63 nt, Homo Sapiens
gcuuaaaugaucaaggagggugauugagagcagccucuugaaugugaaaaccucuuucggaaa

SEQ ID NO: 188601 - RNA, 63 nt, Homo Sapiens
aacugacuuccugaacucccguucagaaaagcaccucuugaagguguacucugaguccucauu

SEQ ID NO: 188602 - RNA, 63 nt, Homo Sapiens
ggagaggcaacauacuccaagugcccccagaugccucuugauaugugauccagaaagauuuuu

SEQ ID NO: 188603 - RNA, 63 nt, Homo Sapiens
cagcacaggaaggugaggccuccauuccucugcccucuugagcaaugaaaaggcauugccauc

SEQ ID NO: 188604 - RNA, 63 nt, Homo Sapiens
agaagcaguggccuuauugcaucccaaaccacgccucuugaccaggcugccucccuuguggca

SEQ ID NO: 188605 - RNA, 63 nt, Homo Sapiens
gaaggacggggggcgguaggggucuugaugaaaccucuugaacgaagcacaguuugucccauc

SEQ ID NO: 188606 - RNA, 64 nt, Homo Sapiens
aagacaagggcccugcagggaggcacuucagauaccacacgaguucuaugucuggaccuguguu

SEQ ID NO: 188607 - RNA, 64 nt, Homo Sapiens
cuuguggggcugugaauucuacuccuccccuuuuccacacgaacuuuuauggcucuucugggaa

SEQ ID NO: 188608 - RNA, 64 nt, Homo Sapiens
aagcugaucaagaaaguuaacaacaacauagaaaccacacgauuguuccacugucuggaagcac

SEQ ID NO: 188609 - RNA, 64 nt, Homo Sapiens
ggucggaguuaccugaucacuuaaaugcagauguccacacgagguguuccuggaagacccagag

SEQ ID NO: 188610 - RNA, 64 nt, Homo Sapiens
agcugugcucccagcagaggcccggggaccugugccacacgacccaggggacgcccaugccagg

SEQ ID NO: 188611 - RNA, 64 nt, Homo Sapiens
ggggcagaaggcagagccugugucccagggggacccacacgaagucaccagcccauagguccag

SEQ ID NO: 188612 - RNA, 64 nt, Homo Sapiens
ccccucgcucuggugauuauuucuugcagaaucaccacacgagaccaucccggcagucaugguu

SEQ ID NO: 188613 - RNA, 64 nt, Homo Sapiens
acuaagcucugauuuuuuuagccggcacccaccuccacacgaggggcgugugggagacccugug

SEQ ID NO: 188614 - RNA, 64 nt, Homo Sapiens
gagggggacugcaccuuagagugacaucacucacccacacgaagccaaacagccuguccugcaa

SEQ ID NO: 188615 - RNA, 64 nt, Homo Sapiens
gccuggugccggugaggggggccagagucgggggccacacgaggggcacuagggcagguuccgu

SEQ ID NO: 188616 - RNA, 64 nt, Homo Sapiens
gacaugcauucuguuucuuccagaguucugucugccacacgaaagagaauauuugcuuacuuga

SEQ ID NO: 188617 - RNA, 64 nt, Homo Sapiens
gcgugcaccacccuaagcggcuaggcugacagggccacacgacauagcugaaauuuguucugua

SEQ ID NO: 188618 - RNA, 64 nt, Homo Sapiens
caggggguagccccuggauucaggcacacgaccaccacacgagcacgugccacgcaugccucgu

SEQ ID NO: 188619 - RNA, 64 nt, Homo Sapiens
ugcuacccccaguuucugcuggagucugccagguccacacgaagccauguaaagcuggcuuucu

SEQ ID NO: 188620 - RNA, 64 nt, Homo Sapiens
aaagaaauuugccuugucccccaacuaagucuacccacacgaaaaaaaguuuuaaggacuuggg

SEQ ID NO: 188621 - RNA, 64 nt, Homo Sapiens
cgggcagcuucacaagccauaagccaugcgacucccacacgacacuaaaucacuuuucucgcag

SEQ ID NO: 188622 - RNA, 64 nt, Homo Sapiens
ugagcuggaaaaucucucuuaggagguaccugggccacacgacaagagguggaaguuacagaag

SEQ ID NO: 188623 - RNA, 64 nt, Homo Sapiens
cguuggcuagauuaaccuucucuguccgagugugccacacgagaaccugaaggggaaggaaaua

SEQ ID NO: 188624 - RNA, 64 nt, Homo Sapiens
ugccagcugggcacgucaggaccuccccacacacccacacgaugccacaggucagggggcugug

SEQ ID NO: 188625 - RNA, 64 nt, Homo Sapiens
cccgucagggcaccuuuuccucagagcaauccggccacacgaauagaaggcugucgugaaucac

SEQ ID NO: 188626 - RNA, 64 nt, Homo Sapiens
ggacuugaguguugcauuuguuuugugggcauuuccacacgaagccuacucacacccucacugg

SEQ ID NO: 188627 - RNA, 64 nt, Homo Sapiens
ggaaggacaaguaagagugaggccacaguucccaccacacgagggcuuuuguauuguucuacuu

SEQ ID NO: 188628 - RNA, 64 nt, Homo Sapiens
ccuagagaaugcugcagucuggaguuuggggucuccacacgauguaguaggagccguuagggga

SEQ ID NO: 188629 - RNA, 64 nt, Homo Sapiens
uuuucacagagugaaaggacccuuuauguauuauccacacgaugcccccggcaccugacucugc

SEQ ID NO: 188630 - RNA, 64 nt, Homo Sapiens
ugucagagagaaaugaaagcuguuuuguguuuccccacacgauucaggaucucucaauguucag

SEQ ID NO: 188631 - RNA, 64 nt, Homo Sapiens
augcuuggaugagucagcuguccauccucaaguuccacacgaaguguccagggcacuuugcagc

SEQ ID NO: 188632 - RNA, 64 nt, Homo Sapiens
guaaaaaaauccacauuaaugauuauucucuaucccacacgaauaauguguuuguuucccaugg

SEQ ID NO: 188633 - RNA, 64 nt, Homo Sapiens
cuguuuuguuaaaucugguggguaccuggaucuuccacacgagugggauucuggccuucagaga

SEQ ID NO: 188634 - RNA, 64 nt, Homo Sapiens
aauuugugcgcugaacuucaccacacccaccgccccacacgagaaaggaagagcaagaacaugg

SEQ ID NO: 188635 - RNA, 64 nt, Homo Sapiens
gcuccaggcucugggcuggugaggccagagggggccacacgagacacacaucucacaucauggg

SEQ ID NO: 188636 - RNA, 64 nt, Homo Sapiens
ccucaacugggggagugaggagucucacugugaaccacacgaaagcccgcugccaaucuaagcc

SEQ ID NO: 188637 - RNA, 64 nt, Homo Sapiens
auuauguuggccuugaacgguagcugggcuggggccacacgacucaugccgcagaggaugcgcc

SEQ ID NO: 188638 - RNA, 64 nt, Homo Sapiens
accgaggaaucguaugugggaacguccccgagaaccacacgagcgugcugcucagugcugacug

SEQ ID NO: 188639 - RNA, 64 nt, Homo Sapiens
ggcucgaggggcucagggccucaggcacccguccccacacgagggccccgugggugggccuggc

SEQ ID NO: 188640 - RNA, 64 nt, Homo Sapiens
uccuaucucccuugaaaaguuagaagacuucuuuccacacgauuaaacccaaagccacuaguau

SEQ ID NO: 188641 - RNA, 64 nt, Homo Sapiens
acaaauaauauuacucuaugaugauugcuuccacccacacgacugcaacauacaggugccuugg

SEQ ID NO: 188642 - RNA, 64 nt, Homo Sapiens
ccccucuucccucaggaggccuguguggggcaccccacacgacaaaaccugcuggugcugaguc

SEQ ID NO: 188643 - RNA, 64 nt, Homo Sapiens
cuccuggaccuuuccagccuguaucaggcuguggccacacgagaggacagcgcgagcucaggag

SEQ ID NO: 188644 - RNA, 64 nt, Homo Sapiens
ccuugcgcugcagugggggcuccugagugcagccccacacgacugagccacccagacccucaca

SEQ ID NO: 188645 - RNA, 64 nt, Homo Sapiens
agcccagcgacuuccaaguccucucacagaagaaccacacgauuggguaucacucacaguuugc

SEQ ID NO: 188646 - RNA, 64 nt, Homo Sapiens
cggggcuucagccgggcauggagaugacauucuuccacacgagaggaggaggcagcagacacug

SEQ ID NO: 188647 - RNA, 64 nt, Homo Sapiens
aagccaaacgccguggccucggaaagguguguggccacacgaagguccccaccuguacaacaac

SEQ ID NO: 188648 - RNA, 64 nt, Homo Sapiens
ugcggcugccagccucgggcccaccguacacuucccacacgagcggaaggagugagguguguuc

SEQ ID NO: 188649 - RNA, 64 nt, Homo Sapiens
accccacacacacucaaggggucgaaaacaaaccccacacgagggcucucaccuccuucuccua

SEQ ID NO: 188650 - RNA, 64 nt, Homo Sapiens
cuccgcgggugcuucgcggacaaggugcagccaaccacacgagcaauacugugcuggagaguga

SEQ ID NO: 188651 - RNA, 64 nt, Homo Sapiens
acucccccacccugaccgugcugaacagacccccccacacgagagaaaauaaaggagcaauaaa

SEQ ID NO: 188652 - RNA, 64 nt, Homo Sapiens
ccuggccaaucaaggcuugcccagcugggaggccccacacgaaagacucuuaccauuuuauuaa

SEQ ID NO: 188653 - RNA, 64 nt, Homo Sapiens
uggccuccagggacgggagagauugugucaugugccacacgagaccaacguggaaaagucugaa

SEQ ID NO: 188654 - RNA, 64 nt, Homo Sapiens
uagggcaguggucacugugggaucccauccaguuccacacgaaccugcaagucuccuacccugg

SEQ ID NO: 188655 - RNA, 64 nt, Homo Sapiens
gccuuuauauuucacaggcuguaaauugaacuucccacacgauuagcuuuauuauggcuuguga

SEQ ID NO: 188656 - RNA, 64 nt, Homo Sapiens
ccugugcuuuugguguaaauugcagacuguucacccacacgagccacccagcaucggcuuugac

SEQ ID NO: 188657 - RNA, 64 nt, Homo Sapiens
caacugcuguauuuaacauccugcaguacuguauccacacgagcuucacagaguggaucuuucu

SEQ ID NO: 188658 - RNA, 64 nt, Homo Sapiens
cucccgauguucccacccgcaugaucccuucccgccacacgaugcuccguuuucuuccguugug

SEQ ID NO: 188659 - RNA, 54 nt, Homo Sapiens
aauucacaaaggucuguucugccaccacacgagcaaggaacugaaagagauuga

SEQ ID NO: 188660 - RNA, 64 nt, Homo Sapiens
ccuguggcggucagggcaggggucccgagcagcaggacuggagguccuuggcccacagcagaua

SEQ ID NO: 188661 - RNA, 64 nt, Homo Sapiens
cagugcccucugcagaccccuucugccuggagggggacuggacccuuggaaggcguggggagag

SEQ ID NO: 188662 - RNA, 64 nt, Homo Sapiens
uaaauuguuuuuuguucccaucaguuucaggccaggacuggagaggccacauuaccaaguagaa

SEQ ID NO: 188663 - RNA, 64 nt, Homo Sapiens
ggcgugcagccaggguagcugaaguuugggucugggacuggagauuggccauuaggccuccuga

SEQ ID NO: 188664 - RNA, 64 nt, Homo Sapiens
acauuucuuuacucagacuaaauagcauucaguaggacuggacuggaccccagguuuccuuuac

SEQ ID NO: 188665 - RNA, 64 nt, Homo Sapiens
ucuuuacucagacuaaauagcauucaguaggacuggacuggaccccagguuuccuuuacaugag

SEQ ID NO: 188666 - RNA, 64 nt, Homo Sapiens
gagcucugagcacgccccacgcauggugcaggagggacuggacagaucugaggaaggccguaaa

SEQ ID NO: 188667 - RNA, 64 nt, Homo Sapiens
uggcuguuccaccagagcagagggaaucauugcuggacuggauuucuucuggagggaagcacca

SEQ ID NO: 188668 - RNA, 64 nt, Homo Sapiens
cuggggacauccguggcaaaugguggcgauuagcggacuggagugcgauuagcggacuggaguc

SEQ ID NO: 188669 - RNA, 64 nt, Homo Sapiens
cugguggcgauuagcggacucaguggcgauuagcggacuggaguagccuccucuucaaaauuca

SEQ ID NO: 188670 - RNA, 64 nt, Homo Sapiens
cauuucuuuacauuugcauuaagggaacauguucggacuggaaaaagaucugguuuuuugguca

SEQ ID NO: 188671 - RNA, 64 nt, Homo Sapiens
cuuagcaaacaauuguaaguuuuuuugaaagacuggacuggaauuuccaaaggggcacccacau

SEQ ID NO: 188672 - RNA, 64 nt, Homo Sapiens
agcaucggaauauauuuggagcacacccuaguaaccucuugagauuaaauuacauagucuuaau

SEQ ID NO: 188673 - RNA, 64 nt, Homo Sapiens
ggccccagcuucacugcuuggaagcaugucccucccucuugaguuggcucugauuugaaaucgg

SEQ ID NO: 188674 - RNA, 64 nt, Homo Sapiens
gcuuaaaugaucaaggagggaugauugagagcagccucuugaauagugaaaaccucuuucggaa

SEQ ID NO: 188675 - RNA, 64 nt, Homo Sapiens
aacugacuuccugaacucccuguucagaaaagcaccucuugaagaguguacucugaguccucau

SEQ ID NO: 188676 - RNA, 64 nt, Homo Sapiens
ggagaggcaacauacuccaaugugcccccagaugccucuugauacugugauccagaaagauuuu

SEQ ID NO: 188677 - RNA, 64 nt, Homo Sapiens
cagcacaggaaggugaggcccuccauuccucugcccucuugagcgaaugaaaaggcauugccau

SEQ ID NO: 188678 - RNA, 64 nt, Homo Sapiens
aagaagcaguggccuuauugcaucccaaaccacgccucuugaccaggcugccucccuuguggca

SEQ ID NO: 188679 - RNA, 64 nt, Homo Sapiens
ugaaggacggggggcgguaggggucuugaugaaaccucuugaacgaagcacaguuugucccauc

SEQ ID NO: 188680 - RNA, 64 nt, Homo Sapiens
uuaaaaagacacaaaauuaugaaguggagagguacucuaggaauccuggacuuaaauugugauu

SEQ ID NO: 188681 - RNA, 64 nt, Homo Sapiens
gauguauauuggagaagggugagacuuuauuguccucuaggaugauauuggaaaucaugacugu

SEQ ID NO: 188682 - RNA, 64 nt, Homo Sapiens
uuuuauaguuuuaagaggaaccccaaauguaugucucuaggacauuuucucaaaagcaucuuuc

SEQ ID NO: 188683 - RNA, 64 nt, Homo Sapiens
aucacuugugcuuagcuuagauauuuaaaagauacucuaggauguggcacaaaccuguguuuau

SEQ ID NO: 188684 - RNA, 64 nt, Homo Sapiens
ccgucgcugccugcuggguccccaccagggcucccucuaggaaugcgccauggcugcuaugaca

SEQ ID NO: 188685 - RNA, 64 nt, Homo Sapiens
ucucuggaugcucugaggcagaugggcuugggggcucuaggaggaggcagggacuccagggugu

SEQ ID NO: 188686 - RNA, 64 nt, Homo Sapiens
caaaugccucuucccucuggucaugccucacuaucucuaggagcuccauccuguggcuuccaga

SEQ ID NO: 188687 - RNA, 64 nt, Homo Sapiens
gcaguuucugcucuuuuucaucaggggggauagucucuaggauuuuucagugaggacccuuggg

SEQ ID NO: 188688 - RNA, 64 nt, Homo Sapiens; identical to SEQ ID NO: 76961

SEQ ID NO: 188689 - RNA, 64 nt, Homo Sapiens; identical to SEQ ID NO: 76962

SEQ ID NO: 188690 - RNA, 64 nt, Homo Sapiens; identical to SEQ ID NO: 76963

SEQ ID NO: 188691 - RNA, 64 nt, Homo Sapiens; identical to SEQ ID NO: 76964

SEQ ID NO: 188692 - RNA, 64 nt, Homo Sapiens; identical to SEQ ID NO: 76965

SEQ ID NO: 188693 - RNA, 64 nt, Homo Sapiens; identical to SEQ ID NO: 76966

SEQ ID NO: 188694 - RNA, 64 nt, Homo Sapiens; identical to SEQ ID NO: 76967

SEQ ID NO: 188695 - RNA, 64 nt, Homo Sapiens; identical to SEQ ID NO: 76968

SEQ ID NO: 188696 - RNA, 64 nt, Homo Sapiens; identical to SEQ ID NO: 76969

SEQ ID NO: 188697 - RNA, 64 nt, Homo Sapiens; identical to SEQ ID NO: 76970

SEQ ID NO: 188698 - RNA, 64 nt, Homo Sapiens; identical to SEQ ID NO: 76971

SEQ ID NO: 188699 - RNA, 64 nt, Homo Sapiens; identical to SEQ ID NO: 76972

SEQ ID NO: 188700 - RNA, 64 nt, Homo Sapiens; identical to SEQ ID NO: 76973

SEQ ID NO: 188701 - RNA, 64 nt, Homo Sapiens; identical to SEQ ID NO: 76974

SEQ ID NO: 188702 - RNA, 64 nt, Homo Sapiens; identical to SEQ ID NO: 76975

SEQ ID NO: 188703 - RNA, 64 nt, Homo Sapiens; identical to SEQ ID NO: 76976

SEQ ID NO: 188704 - RNA, 64 nt, Homo Sapiens; identical to SEQ ID NO: 76977

SEQ ID NO: 188705 - RNA, 64 nt, Homo Sapiens; identical to SEQ ID NO: 76978

SEQ ID NO: 188706 - RNA, 64 nt, Homo Sapiens; identical to SEQ ID NO: 76979

SEQ ID NO: 188707 - RNA, 64 nt, Homo Sapiens; identical to SEQ ID NO: 76980

SEQ ID NO: 188708 - RNA, 64 nt, Homo Sapiens; identical to SEQ ID NO: 76981

SEQ ID NO: 188709 - RNA, 64 nt, Homo Sapiens; identical to SEQ ID NO: 76982

SEQ ID NO: 188710 - RNA, 64 nt, Homo Sapiens; identical to SEQ ID NO: 76983

SEQ ID NO: 188711 - RNA, 64 nt, Homo Sapiens; identical to SEQ ID NO: 76984

SEQ ID NO: 188712 - RNA, 64 nt, Homo Sapiens; identical to SEQ ID NO: 76985

SEQ ID NO: 188713 - RNA, 64 nt, Homo Sapiens; identical to SEQ ID NO: 76986

SEQ ID NO: 188714 - RNA, 64 nt, Homo Sapiens; identical to SEQ ID NO: 76987

SEQ ID NO: 188715 - RNA, 64 nt, Homo Sapiens; identical to SEQ ID NO: 76988

SEQ ID NO: 188716 - RNA, 64 nt, Homo Sapiens; identical to SEQ ID NO: 76989

SEQ ID NO: 188717 - RNA, 64 nt, Homo Sapiens; identical to SEQ ID NO: 76990

SEQ ID NO: 188718 - RNA, 64 nt, Homo Sapiens; identical to SEQ ID NO: 76991

SEQ ID NO: 188719 - RNA, 64 nt, Homo Sapiens; identical to SEQ ID NO: 76992

SEQ ID NO: 188720 - RNA, 64 nt, Homo Sapiens; identical to SEQ ID NO: 76993

SEQ ID NO: 188721 - RNA, 64 nt, Homo Sapiens; identical to SEQ ID NO: 76994

SEQ ID NO: 188722 - RNA, 64 nt, Homo Sapiens; identical to SEQ ID NO: 76995

SEQ ID NO: 188723 - RNA, 64 nt, Homo Sapiens; identical to SEQ ID NO: 76996

SEQ ID NO: 188724 - RNA, 64 nt, Homo Sapiens; identical to SEQ ID NO: 76997

SEQ ID NO: 188725 - RNA, 64 nt, Homo Sapiens; identical to SEQ ID NO: 76998

SEQ ID NO: 188726 - RNA, 64 nt, Homo Sapiens; identical to SEQ ID NO: 76999

SEQ ID NO: 188727 - RNA, 64 nt, Homo Sapiens; identical to SEQ ID NO: 77000

SEQ ID NO: 188728 - RNA, 64 nt, Homo Sapiens; identical to SEQ ID NO: 77001

SEQ ID NO: 188729 - RNA, 64 nt, Homo Sapiens; identical to SEQ ID NO: 77002

SEQ ID NO: 188730 - RNA, 64 nt, Homo Sapiens; identical to SEQ ID NO: 77003

SEQ ID NO: 188731 - RNA, 64 nt, Homo Sapiens; identical to SEQ ID NO: 77004

SEQ ID NO: 188732 - RNA, 64 nt, Homo Sapiens; identical to SEQ ID NO: 77005

SEQ ID NO: 188733 - RNA, 64 nt, Homo Sapiens; identical to SEQ ID NO: 77006

SEQ ID NO: 188734 - RNA, 64 nt, Homo Sapiens; identical to SEQ ID NO: 77007

SEQ ID NO: 188735 - RNA, 64 nt, Homo Sapiens; identical to SEQ ID NO: 77008

SEQ ID NO: 188736 - RNA, 64 nt, Homo Sapiens; identical to SEQ ID NO: 77009

SEQ ID NO: 188737 - RNA, 64 nt, Homo Sapiens; identical to SEQ ID NO: 77010

SEQ ID NO: 188738 - RNA, 64 nt, Homo Sapiens; identical to SEQ ID NO: 77011

SEQ ID NO: 188739 - RNA, 64 nt, Homo Sapiens; identical to SEQ ID NO: 77012

SEQ ID NO: 188740 - RNA, 64 nt, Homo Sapiens; identical to SEQ ID NO: 77013

SEQ ID NO: 188741 - RNA, 64 nt, Homo Sapiens; identical to SEQ ID NO: 77014

SEQ ID NO: 188742 - RNA, 64 nt, Homo Sapiens; identical to SEQ ID NO: 77015

SEQ ID NO: 188743 - RNA, 64 nt, Homo Sapiens; identical to SEQ ID NO: 77016

SEQ ID NO: 188744 - RNA, 64 nt, Homo Sapiens; identical to SEQ ID NO: 77017

SEQ ID NO: 188745 - RNA, 64 nt, Homo Sapiens; identical to SEQ ID NO: 77018

SEQ ID NO: 188746 - RNA, 64 nt, Homo Sapiens; identical to SEQ ID NO: 77019

SEQ ID NO: 188747 - RNA, 64 nt, Homo Sapiens; identical to SEQ ID NO: 154420

SEQ ID NO: 188748 - RNA, 64 nt, Homo Sapiens; identical to SEQ ID NO: 154421

SEQ ID NO: 188749 - RNA, 64 nt, Homo Sapiens; identical to SEQ ID NO: 154422

SEQ ID NO: 188750 - RNA, 64 nt, Homo Sapiens; identical to SEQ ID NO: 154423

SEQ ID NO: 188751 - RNA, 64 nt, Homo Sapiens; identical to SEQ ID NO: 154424

SEQ ID NO: 188752 - RNA, 64 nt, Homo Sapiens; identical to SEQ ID NO: 154425

SEQ ID NO: 188753 - RNA, 64 nt, Homo Sapiens; identical to SEQ ID NO: 154426

SEQ ID NO: 188754 - RNA, 64 nt, Homo Sapiens; identical to SEQ ID NO: 154427

SEQ ID NO: 188755 - RNA, 64 nt, Homo Sapiens; identical to SEQ ID NO: 154428

SEQ ID NO: 188756 - RNA, 64 nt, Homo Sapiens; identical to SEQ ID NO: 154429

SEQ ID NO: 188757 - RNA, 64 nt, Homo Sapiens; identical to SEQ ID NO: 154430

SEQ ID NO: 188758 - RNA, 64 nt, Homo Sapiens; identical to SEQ ID NO: 154431

SEQ ID NO: 188759 - RNA, 64 nt, Homo Sapiens; identical to SEQ ID NO: 154432

SEQ ID NO: 188760 - RNA, 64 nt, Homo Sapiens
aaugcucauuuucugguuuggcauggugaguguugggguugacauuuagaacuuuaagucucac

SEQ ID NO: 188761 - RNA, 64 nt, Homo Sapiens
ggcagcagagagagaggacagagggguaagaugagggguugagggaagguucuucaugauccac

SEQ ID NO: 188762 - RNA, 64 nt, Homo Sapiens
gaaccgaaaaaucgcgaguguuucgcggguaacugggguugagggccaaaauauuuggaaugaa

SEQ ID NO: 188763 - RNA, 64 nt, Homo Sapiens
uaccaaacaugcggugccaugaagggacccuuuggggguugaauaggaguuaaccccugcgcuc

SEQ ID NO: 188764 - RNA, 64 nt, Homo Sapiens
ucugucugguuuuguugccaugaggacugggacugggguugagugaugccuccugacugcacac

SEQ ID NO: 188765 - RNA, 64 nt, Homo Sapiens
acuaacuggcuccugacaggauggccugaggccugggguugaccaugaacuaccugcaguggug

SEQ ID NO: 188766 - RNA, 64 nt, Homo Sapiens
ugcuagucucuaugagguccuuauugcacuuauugggguugaagcucuucagaggagcuggaac

SEQ ID NO: 188767 - RNA, 64 nt, Homo Sapiens
cccacuuccauuggucuccaggccccaauaaucugggguugaaacuuugaggaaaugccaguga

SEQ ID NO: 188768 - RNA, 64 nt, Homo Sapiens
augugaauuaggaccuggucgcugaauuuuucugcuaguucaaaagguuuacugaaauugauuu

SEQ ID NO: 188769 - RNA, 64 nt, Homo Sapiens
gaaacugacuggaagcacaugcccagagcugugccuaguucauaaguguguagaaauuugugcu

SEQ ID NO: 188770 - RNA, 64 nt, Homo Sapiens
aucuuuuauguaaauuacaacacugagcccagcccuaguucagucuaggauuacaggcauaagc

SEQ ID NO: 188771 - RNA, 64 nt, Homo Sapiens
aucuuuuuuuuuuuuuuuuuuggaugucaagugccuaguucaguaaagggccaaguggacaucu

SEQ ID NO: 188772 - RNA, 64 nt, Homo Sapiens
acuccaaauuauuggggacccuuagggugguuaucuaguucaguauuacuucugucagaagugu

SEQ ID NO: 188773 - RNA, 64 nt, Homo Sapiens
cugaccaauggcagaggacuugcuagacucuggccuaguucaaguggugcaccaugcacuuucc

SEQ ID NO: 188774 - RNA, 64 nt, Homo Sapiens
aacguuagagcuggaaggaaucuuaacuauuaaucuaguucaaugcccuuauuuuacagauggg

SEQ ID NO: 188775 - RNA, 64 nt, Homo Sapiens
cagaauugagacuggaauauaggccuucugacuccuaguucaguauucuuaccccuguaccaca

SEQ ID NO: 188776 - RNA, 63 nt, Homo Sapiens
cugcuguucccagugauauuugggaucugacugaagccagaggcucuguaaaaucagaccaua

SEQ ID NO: 188777 - RNA, 63 nt, Homo Sapiens
gucuuaaaaguuguuuuuaaaugacaauaaaacaagccagaaugucuuuugugcuggaguguc

SEQ ID NO: 188778 - RNA, 63 nt, Homo Sapiens
accacucaacccccaccuggaaggggcaaagaaaagccagaguuccauguuuguacuccugug

SEQ ID NO: 188779 - RNA, 63 nt, Homo Sapiens
aaccuucccucucuccuuggugaagaacaucccaagccagaaagaaguuaacuacaguguuuu

SEQ ID NO: 188780 - RNA, 63 nt, Homo Sapiens
gggaggggagggcuggcugcuggaagaaggaagaagccagacugguuagacaguacucuuaac

SEQ ID NO: 188781 - RNA, 63 nt, Homo Sapiens
cccaccuggccugcccacagaagauaggggaagaagccagaacucuuauaacaccucccaaga

SEQ ID NO: 188782 - RNA, 63 nt, Homo Sapiens
cuuauaacaccucccaagaacuguguuacguugaagccagaguccuccuuggcuggcaugguu

SEQ ID NO: 188783 - RNA, 63 nt, Homo Sapiens
aaaaugugcaugacaacacuagagguaugggcgaagccagaaagaagggaaguuuuggcugaa

SEQ ID NO: 188784 - RNA, 63 nt, Homo Sapiens
ccuugccuuuaaccuuuucugcagugaucuaagaagccagauucaucugcacaaauacguggu

SEQ ID NO: 188785 - RNA, 63 nt, Homo Sapiens
agggaaaagacacacaagucgcguggguuggagaagccagagccauuccaccuccccuccccc

SEQ ID NO: 188786 - RNA, 63 nt, Homo Sapiens
accuccccucccccagcaucucucagagaugugaagccagauccucauggcagcgaggcccuc

SEQ ID NO: 188787 - RNA, 63 nt, Homo Sapiens
aguuuuauacagacaaaaccaaagugugguaaaaagccagaguaacacuaagcugugaugaag

SEQ ID NO: 188788 - RNA, 63 nt, Homo Sapiens
ggaaaaagauuccaugucagacuucgcugcugcaagccagacagaggcaaccugaccagaaac

SEQ ID NO: 188789 - RNA, 63 nt, Homo Sapiens
uuaucuagugauaugaccucacugucuugaccaaagccagaauagaaggcaggauuccugaau

SEQ ID NO: 188790 - RNA, 63 nt, Homo Sapiens
gaauaauaugcagagaugcauauuaggaaugugaagccagaaugggucaguuguagcugcugc

SEQ ID NO: 188791 - RNA, 63 nt, Homo Sapiens
uagcaggcuguuccauguucucuuuucagaagcaagccagaccuuuucuuuuuugcuuucuug

SEQ ID NO: 188792 - RNA, 63 nt, Homo Sapiens
cccaagcaggacgaaaaagaucagagcgccaggaagccagagccuagaggucaggacggcucc

SEQ ID NO: 188793 - RNA, 63 nt, Homo Sapiens
ucuugaaagacuucagccauagagcccagugggaagccagagggauuucugaaacuugaacuc

SEQ ID NO: 188794 - RNA, 61 nt, Homo Sapiens
acugcaguggauuucugaaaaggacucuggaaagccagaagguaaugugaagggucccuaa

SEQ ID NO: 188795 - RNA, 63 nt, Homo Sapiens
ggcucccuccucuucacauuccccccgaccccaaagccagagaaagccagauggcaccagcug

SEQ ID NO: 188796 - RNA, 63 nt, Homo Sapiens
ucuucacauuccccccgaccccaaagccagagaaagccagauggcaccagcugcuccggaugu

SEQ ID NO: 188797 - RNA, 63 nt, Homo Sapiens
gugcaagcacccgucuacccgucucgcccaccaaagccagaaaaccaaaguucucaggccaag

SEQ ID NO: 188798 - RNA, 63 nt, Homo Sapiens
ucaugccacaggccuggcugguucugagucagcaagccagagggccuucuggagagccucugg

SEQ ID NO: 188799 - RNA, 63 nt, Homo Sapiens
ucauuuugugccacccauuugcaucagucuaacaagccagaacaaaaccugcagcaaagagaa

SEQ ID NO: 188800 - RNA, 63 nt, Homo Sapiens
guuuguucaaaaccugcagccccucaccccuguaagccagacacacccauugucaggugcucu

SEQ ID NO: 188801 - RNA, 63 nt, Homo Sapiens
guaguuaacauuuauguucccuacucccuacguaagccagacuuuggcaacagugauaguuga

SEQ ID NO: 188802 - RNA, 63 nt, Homo Sapiens
aucuucauuuuacaggcagaccugucuaacuacaagccagacuuggguuuucuccuguaguuu

SEQ ID NO: 188803 - RNA, 63 nt, Homo Sapiens
uguguuuccuucauguguuagauauuggcaacaaagccagagguguaauguugguuauaugaa

SEQ ID NO: 188804 - RNA, 63 nt, Homo Sapiens
uagaucuuggaaggagagauccauugaguccagaagccagaucagcaaauggaggaaccucgg

SEQ ID NO: 188805 - RNA, 63 nt, Homo Sapiens
uuauuuagccauucaccuagagaguaaguguugaagccagagccaccuccaacucuggagccu

SEQ ID NO: 188806 - RNA, 63 nt, Homo Sapiens
ugggauguggcgggacaggguugcuggguacagaagccagacuucuuuuacaaguaacucuag

SEQ ID NO: 188807 - RNA, 63 nt, Homo Sapiens
aggaucauggucaugugagcuucuggucaccggaagccagaaauacucagcugccauguugau

SEQ ID NO: 188808 - RNA, 63 nt, Homo Sapiens
ugugaagagauccuggcauuucugguccaacccaagccagagaaccauuaagaaggggccuuc

SEQ ID NO: 188809 - RNA, 63 nt, Homo Sapiens
gcucaccccuuucccccgccaaauaagaaacgcaagccagaccacgaugauuguagaaguccc

SEQ ID NO: 188810 - RNA, 63 nt, Homo Sapiens
acuagagccaaaaacuuguuauaaaagugcagaaagccagaggaagaugaacuugaagauuac

SEQ ID NO: 188811 - RNA, 63 nt, Homo Sapiens
acuagauccaaagacuuguuaucaaaguacagaaagccagaggaagaugaacuugaagauuac

SEQ ID NO: 188812 - RNA, 63 nt, Homo Sapiens
acuagaggccaagacuuguuaucaaugugcagaaagccagaggaaaaugagugugcagauuac

SEQ ID NO: 188813 - RNA, 64 nt, Homo Sapiens
uaucugucuguuagcaaugauuauuacaucaucagaucagcaugugcuauacucccugcaagaa

SEQ ID NO: 188814 - RNA, 64 nt, Homo Sapiens
uuucuuuaaguaccuggggaauacagcucucagugaucagcagggaguuuauuugaggacauca

SEQ ID NO: 188815 - RNA, 64 nt, Homo Sapiens
uuguuuuuuuuuuuuuuaauuauuucucuuagcagaucagcaaucccucuagggaccuaaauac

SEQ ID NO: 188816 - RNA, 64 nt, Homo Sapiens
ccuaugauuuauuuccuucaugaauuugucacuggaucagcagcuguggaaauaaagcuuguga

SEQ ID NO: 188817 - RNA, 64 nt, Homo Sapiens
aaaucuauuaaauuuuucucuuaggaaaaauguauaauaagauagcagcuauugacuuuguaau

SEQ ID NO: 188818 - RNA, 64 nt, Homo Sapiens
ugauacaagacaaaaacaguguuuuaccuguaauuaauaagaacacuuuuuuuucaaaauuuua

SEQ ID NO: 188819 - RNA, 64 nt, Homo Sapiens
auucauuaaauacugauuuuagcuguccaaaaaauaauaagagcagaacaacuugauaucauuc

SEQ ID NO: 188820 - RNA, 64 nt, Homo Sapiens
ugggaaaauauuuuaauaaacuuaauaaauacuuuaauaagauaagcucuacagggacagaaug

SEQ ID NO: 188821 - RNA, 64 nt, Homo Sapiens
agcaauaauuuucuaaagcucugaaauaauaagauaauaagaaauacucgauguguaaugaaac

SEQ ID NO: 188822 - RNA, 64 nt, Homo Sapiens
auaagaaaagcaauaauuuuaaugaaaccugaaauaauaagauaugcauggguacucgaugugu

SEQ ID NO: 188823 - RNA, 64 nt, Homo Sapiens
gcagcuauguaaaugaccuaauugauagcagguguaauaagacuaucgucuuccuacacauagg

SEQ ID NO: 188824 - RNA, 64 nt, Homo Sapiens
aacauugugaugauuauuauuuaaaaccauuauuuaauaagaguaaaaauaugugaaucuggau

SEQ ID NO: 188825 - RNA, 64 nt, Homo Sapiens
guuuccacaccauaggcaauaaagugguuaauauuaauaagacuguuaaugugguuaaugccaa

SEQ ID NO: 188826 - RNA, 64 nt, Homo Sapiens
uaguauauuuucugacuacaacuugcugcuguuuuaauaagauguauuuuacuggaaauuaaga

SEQ ID NO: 188827 - RNA, 64 nt, Homo Sapiens
gagaccuaaugagaaauaguuacucaguuguaaaaauuuugauuuauucucuuucuucugaccu

SEQ ID NO: 188828 - RNA, 64 nt, Homo Sapiens
uuuauauucucaacauacaauguuaagaaccaucaauuuugacuuuuacuaaguuguuaaauaa

SEQ ID NO: 188829 - RNA, 64 nt, Homo Sapiens
uucuaagguugaucaucuuauaccacgaaucguuaauuuugacaguucuacugauccguaaaug

SEQ ID NO: 188830 - RNA, 64 nt, Homo Sapiens
auacaucaguuggugcauaaucgaaaaaaauaggaauuuugaacacuguucuuccuucuacauu

SEQ ID NO: 188831 - RNA, 64 nt, Homo Sapiens
uaagaucuauauaggcccccgacuaauuccucugaauuuugauguaacuaaaauaguguuaucu

SEQ ID NO: 188832 - RNA, 64 nt, Homo Sapiens
cauaggguagcuuacguaguaccaaugauuuaguaauuuugagggaaaaaaaccaaaacuuuau

SEQ ID NO: 188833 - RNA, 64 nt, Homo Sapiens
ucugggaacuugguucagauucuagaugugguuaaauuuugacuacuuuggaaagaauuuugag

SEQ ID NO: 188834 - RNA, 64 nt, Homo Sapiens
cuagaugugguuaaauuuugucuacuuuggaaagaauuuugagugaaacagcuuuggucaacau

SEQ ID NO: 188835 - RNA, 64 nt, Homo Sapiens
acagcagaaugaauaaaagauggugaaggcuguuaauuuugagucaauucuaccccugacauuu

SEQ ID NO: 188836 - RNA, 64 nt, Homo Sapiens
aucagcuguuuuucuuaauuucagccagacuauuaauuuugagccauuauguaauauaugccau

SEQ ID NO: 188837 - RNA, 64 nt, Homo Sapiens
uuuugucauucuguguuaaaucauuucaggguuuaauuuugaaauaaaagauuaauauaaaaug

SEQ ID NO: 188838 - RNA, 64 nt, Homo Sapiens
guaagcagugaguuauuacccacaauuuaaagcaaauuuugaaugaaucuuuaaguuagguauc

SEQ ID NO: 188839 - RNA, 64 nt, Homo Sapiens
guguauuuuugaagaguguuauguccuuaguuuuaauuuugaguaaagaaaaggcuaaaaucau

SEQ ID NO: 188840 - RNA, 64 nt, Homo Sapiens
agagauaaaaauagccaaagauaggagacgucugaauuuugaaugauaaacagugauguuuuaa

SEQ ID NO: 188841 - RNA, 64 nt, Homo Sapiens
aacccuggguauagucuuaaaauucugcacaauaaauuuugagaaagaauuguuccucuuugua

SEQ ID NO: 188842 - RNA, 64 nt, Homo Sapiens
accaucugaggucuucuggauucuuugugggguuaauuuugauuugaugucaucuguuugcccu

SEQ ID NO: 188843 - RNA, 64 nt, Homo Sapiens
cuggugcuaaauaacagucuuuauuauauuaucuaauuuugacuaaagaaauacuuuugaagua

SEQ ID NO: 188844 - RNA, 64 nt, Homo Sapiens
agccaugacuuuaacugaaguguucacauucacuaauuuugauagauugcuguccuuaauaauu

SEQ ID NO: 188845 - RNA, 64 nt, Homo Sapiens
aucuucuguuguagaauaauagucuuucuuucugaauuuugaguaacgccaaacuaaaguuuac

SEQ ID NO: 188846 - RNA, 64 nt, Homo Sapiens
gcugcauucauuuaucaccaaggccaaugcagcuaauuuugauaguaagauggauuucaccccc

SEQ ID NO: 188847 - RNA, 64 nt, Homo Sapiens
uggccuuacuuugauuuuuaaagaccugugggucaauuuugaaccauggcagcauggaggaggc

SEQ ID NO: 188848 - RNA, 64 nt, Homo Sapiens
gcucuuuaagcccacaugcagcaggccaagauaaaauuuugacagucucgcauauuauauuaua

SEQ ID NO: 188849 - RNA, 64 nt, Homo Sapiens
acauuguuaacauuaaaaaaagcacuacugguaaaauuuugaagugaccaccuacugugugcac

SEQ ID NO: 188850 - RNA, 64 nt, Homo Sapiens
cauauguuaagugauagaagccuuauaagguuaaaauuuugauccuuugaaaauggcuguuuua

SEQ ID NO: 188851 - RNA, 64 nt, Homo Sapiens
uuucugugcauugaacuuugugaaaaugcuguauaauuuugacuuacuaguauuuuugaacaau

SEQ ID NO: 188852 - RNA, 64 nt, Homo Sapiens
auaaaauuuuauguauuuaccacguacaacaugaaauuuugaaacauguauacauucuggaaug

SEQ ID NO: 188853 - RNA, 64 nt, Homo Sapiens
uugaaaauguuaagugcaauuauuaauaugucuuaauuuugaguuuuuaaauauuucuggcuuu

SEQ ID NO: 188854 - RNA, 64 nt, Homo Sapiens
cauuugaaaaagccaaagugauuaaagcaacaauaauuuugaaguagauuuuuaaacaaaugaa

SEQ ID NO: 188855 - RNA, 64 nt, Homo Sapiens
ggcuguguuuuaccucuaaaacauuguauuccacaauuuugaaucaaccuuauucuguguguag

SEQ ID NO: 188856 - RNA, 64 nt, Homo Sapiens
gggaaggaaguaacugcaaaaucaaaggaggcaaaauuuugacaaaaauauauauauauugaaa

SEQ ID NO: 188857 - RNA, 64 nt, Homo Sapiens
agacuuuaauaguguuacuuggauagcuuauaugaauuuugagaauuuuauaugaauuuugaga

SEQ ID NO: 188858 - RNA, 64 nt, Homo Sapiens
ggauagcuuauaugaauuuugagaauuuuauaugaauuuugagaaagcaaguucaaaagaacuc

SEQ ID NO: 188859 - RNA, 64 nt, Homo Sapiens
uuauaauucugcuauuuuaaagugguuagcaaucaauuuugaauaauuuaauucugguauugug

SEQ ID NO: 188860 - RNA, 64 nt, Homo Sapiens
uuuuauuuagaaaugaauuguucaacuuauuguaaauuuugagacaugucugcauucauuuaca

SEQ ID NO: 188861 - RNA, 64 nt, Homo Sapiens
cucuauggcuuuaaggccuugcuuacugccugcaaauuuugagaaauuuaaaaauaagcauucu

SEQ ID NO: 188862 - RNA, 64 nt, Homo Sapiens
uuaccucuuguauaagcauguuguacuaaaaaaaaauuuugaaacauuuuguauauuggagauc

SEQ ID NO: 188863 - RNA, 64 nt, Homo Sapiens
caguaaaaucacccuuuuuagugucuagucugugaauuuugacaaaugcaugguuuuguaacca

SEQ ID NO: 188864 - RNA, 64 nt, Homo Sapiens
ccuagacucuguaaaaauaaaauccauagggugaaauuuugagaugguagaccaaaaagaacca

SEQ ID NO: 188865 - RNA, 64 nt, Homo Sapiens
gcauuuccagaguggccauguagggcccaacuuuaauuuugaauaaauacaaaguaacccugac

SEQ ID NO: 188866 - RNA, 64 nt, Homo Sapiens
cauguuugacagaaacagcagcuaugaagccuugaauuuugaaaaaaagacaagaaggugcaaa

SEQ ID NO: 188867 - RNA, 64 nt, Homo Sapiens
aaguuaugguuauuuuuuuuuuuaguuuuucauuaauuuugaucaauuguaucuuacuaggaga

SEQ ID NO: 188868 - RNA, 64 nt, Homo Sapiens
cacuguaaaauagcuucugcaacaagggaaguuaaauuuugagacuuuuuuccccaaaggauac

SEQ ID NO: 188869 - RNA, 64 nt, Homo Sapiens
uguguguauauaugcauacacuuuuuuauauuaaaauuuugaggcuauacagccacugugcccu

SEQ ID NO: 188870 - RNA, 64 nt, Homo Sapiens
uuacauaauguugacaucucauacuucaugaaguaauuuugacucaugcagucgugugugugug

SEQ ID NO: 188871 - RNA, 64 nt, Homo Sapiens
aauuaaagacugguuucuauaguaugaaugucuuaauuuugaguuauaugauguuuauuugaau

SEQ ID NO: 188872 - RNA, 64 nt, Homo Sapiens
cacugcucaauuaacaaaccuacauggagaccuuaauuuugacuuaacaaauaguuuauguacu

SEQ ID NO: 188873 - RNA, 64 nt, Homo Sapiens
aacaguuagugguuuucacuauuuauaaaaaauuaauuuugaacuuuuuguuaaauuuuuaagu

SEQ ID NO: 188874 - RNA, 64 nt, Homo Sapiens
aagucuuauuuauucauauugaacaaaauuuccuaauuuugagauccuaauguugaauuuugau

SEQ ID NO: 188875 - RNA, 64 nt, Homo Sapiens
aacaaaauuuccuaauuuugugcuccuaauguugaauuuugauguauuuugcuaguuuuugacu

SEQ ID NO: 188876 - RNA, 64 nt, Homo Sapiens
uguuuuucuuugcaaaacccauaagcuguaacagaauuuugaauaguccuacaaaagacaaugu

SEQ ID NO: 188877 - RNA, 64 nt, Homo Sapiens
cuugcucucuuaaagaaagcuugaaacacaaaacaauuuugaaugauaaauuuauuuuuaaauu

SEQ ID NO: 188878 - RNA, 64 nt, Homo Sapiens
cacaaaacaauuuugaaucuuaaauuuauuuuuaaauuuugaaaucuuuagaaaauuuaggaga

SEQ ID NO: 188879 - RNA, 64 nt, Homo Sapiens
auggacaggcugaccucaguguuuacaaauucagaauuuugauagggguagauauggagaaaga

SEQ ID NO: 188880 - RNA, 64 nt, Homo Sapiens
gaauggguacuuucuauuuuguuucuaaacgagcaauuuugaggaugaaaugggaagauaucau

SEQ ID NO: 188881 - RNA, 64 nt, Homo Sapiens
ucuuguuuuuaaacaaucucuugaaggcaauuccaauuuugagaaucacuaucuucaaauuacc

SEQ ID NO: 188882 - RNA, 64 nt, Homo Sapiens
aaaagauuaaaugaaugagaagaaaugauucauaaauuuugaacuaacaguaauaacuucuuga

SEQ ID NO: 188883 - RNA, 64 nt, Homo Sapiens
gaaacauauaauggaagaugcagaugauaaaacuaauuuugaacuuuuuaauuuauauaaauua

SEQ ID NO: 188884 - RNA, 64 nt, Homo Sapiens
gaaauguguagcagcaaauuauauuggggauuagaauuuugaauuaauagcucuccuacuauua

SEQ ID NO: 188885 - RNA, 64 nt, Homo Sapiens
uauuaaggucuugccaagcuagguaguuguuaauaauuuugaaauaacaugaacuugccccuag

SEQ ID NO: 188886 - RNA, 64 nt, Homo Sapiens
aaccacaaagcuacaaacugaaaaaaaauaucugaauuuugaaauuauguagaaggggaacaaa

SEQ ID NO: 188887 - RNA, 64 nt, Homo Sapiens
uaauaacugccacauguggggagugaaugucauuaauuuugaaggaucugugguaguauaacau

SEQ ID NO: 188888 - RNA, 64 nt, Homo Sapiens
uguguaugugaucuacauagcaccuguccuauaaaauuuugaauaaaaguguuuggagacuuuu

SEQ ID NO: 188889 - RNA, 64 nt, Homo Sapiens
cuacacacaaaaagcauacuuaauuaucuugccaaauuuugaaacaugucaguaucauguucuc

SEQ ID NO: 188890 - RNA, 64 nt, Homo Sapiens
cacuaauauuuucacaguuucucaauuuuaaauuaauuuugaaucauagaagucauuuuagacu

SEQ ID NO: 188891 - RNA, 64 nt, Homo Sapiens
gaaaccugacaauauuuuugcucucuucaaaaguaauuuugacugaucucauuuucaguuuaag

SEQ ID NO: 188892 - RNA, 64 nt, Homo Sapiens
gauaaccaggauauuaucuaauggugaauuguagaauuuugaucuucuuauucacugaguuucu

SEQ ID NO: 188893 - RNA, 64 nt, Homo Sapiens
aaauuuaggaaaguuccuacggggaaaaaauuuuaauuuugaaauccuaauucucacauguuuu

SEQ ID NO: 188894 - RNA, 64 nt, Homo Sapiens
aaguaugaauuuguuuuauugagaagaaugaacaaauuuugauaguaccaacagaauuauuugu

SEQ ID NO: 188895 - RNA, 64 nt, Homo Sapiens
cauaguguguugagguucaucauagcagggaaugaauuuugaaacuaagcaacuucguguuuua

SEQ ID NO: 188896 - RNA, 64 nt, Homo Sapiens
uucucucuauauuuacauuuuaauauaauauacaaauuuugaauaaaagaucaugggcaaugca

SEQ ID NO: 188897 - RNA, 64 nt, Homo Sapiens
aagaaauugauacaacaaugaacaggaaguaggaaauuuugaugauucuuagagcuuucuaaag

SEQ ID NO: 188898 - RNA, 64 nt, Homo Sapiens
ugagugccacugauuuucuaaauuuccagaggcaaauuuugaauagaccaggagcacuacagag

SEQ ID NO: 188899 - RNA, 64 nt, Homo Sapiens
guauaaaagaaaaagaucaaauagaagaaauagaaauuuugaauuccagagaaauuuuaaaaua

SEQ ID NO: 188900 - RNA, 64 nt, Homo Sapiens
uaugcuacucaccaauuuauaugauuuuuuucucaauuuugaauuuucaacauguauguauaug

SEQ ID NO: 188901 - RNA, 64 nt, Homo Sapiens
aauaguggaauucuuuuaaaugagaauagaugaaaauuuugauguaguuugaaaucaacagucu

SEQ ID NO: 188902 - RNA, 64 nt, Homo Sapiens
gaauacagaaaacaaacuuugccuucaaaauaagaauuuugaaaauagcuuauaugcccagaag

SEQ ID NO: 188903 - RNA, 64 nt, Homo Sapiens
ggccacaaaaaaucuugauauaacuccuaguuauaauuuugaugcaaccaaguuauuuuuuaua

SEQ ID NO: 188904 - RNA, 64 nt, Homo Sapiens
uggaauuuuuuuaaaaaguauuuuguaacugaggaauuuugauaauuuggggauuuuguuuucc

SEQ ID NO: 188905 - RNA, 64 nt, Homo Sapiens
auguagaaagcucuuuauucuuaggauuguaauuaauuuugaaagauauucauguaaauauauu

SEQ ID NO: 188906 - RNA, 64 nt, Homo Sapiens
caaaaacauuuauaaugccgaagauuucaaauaaaauuuugaacuuugucuaagcaaggaauau

SEQ ID NO: 188907 - RNA, 64 nt, Homo Sapiens
uuaacauuaguguaacaaauaaccauauggcacuaauuuugauuuuaggacaaaaaacaaagcu

SEQ ID NO: 188908 - RNA, 64 nt, Homo Sapiens
uuuuggagcauuuuggauuuuguuggcauucagaaauuuugaaaauuuuccacuucuagcguca

SEQ ID NO: 188909 - RNA, 64 nt, Homo Sapiens
aagaaaaugagucacuguguaacaugcuguaaguaauuuugaguguauggaaaggauggcaggg

SEQ ID NO: 188910 - RNA, 64 nt, Homo Sapiens
uguuuuccaagcucagaaaguuuuaacuacacacaauuuugacauagacucuuuccucagaggc

SEQ ID NO: 188911 - RNA, 64 nt, Homo Sapiens
aagauguuuucauuaauaguccaacucucuaguuaauuuugauguacaaaguuucagagaacua

SEQ ID NO: 188912 - RNA, 64 nt, Homo Sapiens; identical to SEQ ID NO: 95596

SEQ ID NO: 188913 - RNA, 64 nt, Homo Sapiens; identical to SEQ ID NO: 95597

SEQ ID NO: 188914 - RNA, 64 nt, Homo Sapiens; identical to SEQ ID NO: 95598

SEQ ID NO: 188915 - RNA, 64 nt, Homo Sapiens; identical to SEQ ID NO: 95599

SEQ ID NO: 188916 - RNA, 64 nt, Homo Sapiens; identical to SEQ ID NO: 95600

SEQ ID NO: 188917 - RNA, 64 nt, Homo Sapiens; identical to SEQ ID NO: 95601

SEQ ID NO: 188918 - RNA, 64 nt, Homo Sapiens; identical to SEQ ID NO: 95602

SEQ ID NO: 188919 - RNA, 64 nt, Homo Sapiens; identical to SEQ ID NO: 95603

SEQ ID NO: 188920 - RNA, 64 nt, Homo Sapiens; identical to SEQ ID NO: 95604

SEQ ID NO: 188921 - RNA, 64 nt, Homo Sapiens; identical to SEQ ID NO: 95605

SEQ ID NO: 188922 - RNA, 64 nt, Homo Sapiens
cacagugaaagggauuccucccacgccagaucugcacaacgaggcaagacaggacccaccugug

SEQ ID NO: 188923 - RNA, 64 nt, Homo Sapiens
cuaagugcuggaauacauuaucucauugaauuaucacaacgaccuuuucaaguaggcauuauca

SEQ ID NO: 188924 - RNA, 64 nt, Homo Sapiens
cgcuaaacauccuauaaugcacagggcaguaccccacaacgaaaaauaaucuggcccaaaaugu

SEQ ID NO: 188925 - RNA, 64 nt, Homo Sapiens
uuuagauggaaggaauccaggcaacauucuucaccacaacgaagaaacagauaaaagauaccca

SEQ ID NO: 188926 - RNA, 64 nt, Homo Sapiens
aacaaaaaacuguucuggacugcaaaucugcacacacaacgaacaguugcauuucagagaguuc

SEQ ID NO: 188927 - RNA, 64 nt, Homo Sapiens
acucgaagaugacugcaaagcauucuauuguuuacacaacgauuaauuuaauguaauuucauuc

SEQ ID NO: 188928 - RNA, 64 nt, Homo Sapiens
aacaacaaauggaguugugcccgucucuacaaagcacaacgaaacugggcaacauagcaagacc

SEQ ID NO: 188929 - RNA, 64 nt, Homo Sapiens
cgauacccagccagagucuacucacugucacaagcacaacgaguuuauaugagaaagcacugag

SEQ ID NO: 188930 - RNA, 64 nt, Homo Sapiens
gaaaugcuccguaugauuuggcucagcgcaccuccacaacgaauuuagaauucgcauuuugcca

SEQ ID NO: 188931 - RNA, 64 nt, Homo Sapiens
uacaaugauccuggaaauugcaguaacaaaagcacacaacgauuauaguaacuauaagauacaa

SEQ ID NO: 188932 - RNA, 64 nt, Homo Sapiens
uuauuuucuuacccaauuucguuccccagccgcccacaacgacuccacgggggacugacgccag

SEQ ID NO: 188933 - RNA, 64 nt, Homo Sapiens
aacuugaguguuucccugccugcagaggcaccugcacaacgacagcucaagccagggaaugcau

SEQ ID NO: 188934 - RNA, 64 nt, Homo Sapiens
aaagaguugauuauuucaacaguauugguuaagucacaacgacgaagugcugagaagguuaugg

SEQ ID NO: 188935 - RNA, 64 nt, Homo Sapiens
cuguagccaacggcagucacacuucacagcuggccacaacgagcggggcuucagcccgccgcag

SEQ ID NO: 188936 - RNA, 64 nt, Homo Sapiens
aaccuucaggccacaaagcaaaaaguugcauagccacaacgaagaucuaguuggauauaguuuu

SEQ ID NO: 188937 - RNA, 64 nt, Homo Sapiens
gcaagccuuaugucuugggaccaucacaacuuuucacaacgaugaaaaaaaaaauuauucugua

SEQ ID NO: 188938 - RNA, 64 nt, Homo Sapiens
caccaucaagagagcuguguguucucucuggucccacaacgaugacucugccucuugucagccc

SEQ ID NO: 188939 - RNA, 60 nt, Homo Sapiens
acgcacugcucaagaacuaccacaaaaucgcacaacgaugcaguccuacagcaaguuuga

SEQ ID NO: 188940 - RNA, 64 nt, Homo Sapiens
gcugcuaagucggcuccagcacacaggagccccccacaacgaagaguuagugcccccaaacguc

SEQ ID NO: 188941 - RNA, 64 nt, Homo Sapiens
uuuuuuuucuuugagacagaauagucuggcuuggcacaacgaugaguaccagauggcuuaaaua

SEQ ID NO: 188942 - RNA, 64 nt, Homo Sapiens
accccagcccuguccagguggagacaaaauguggcacaacgagaaccagauugaccaagcgcca

SEQ ID NO: 188943 - RNA, 64 nt, Homo Sapiens
guccuucgggguggccaagcaggccauccucauccacaacgagcgccggguggacuggcuguuc

SEQ ID NO: 188944 - RNA, 64 nt, Homo Sapiens
cuguggcuucucacagcuguggucuccccugccucacaacgacuccuuucucuuguguggcggg

SEQ ID NO: 188945 - RNA, 64 nt, Homo Sapiens
cugagaaaacgagccuguuucagaggaacaucgucacaacgaauacuucuggaagcuuaacaaa

SEQ ID NO: 188946 - RNA, 64 nt, Homo Sapiens
uacauaaaaauuguuucuauaaauuguagaacauagaugcuacaguauuuuuuauuuaauuaua

SEQ ID NO: 188947 - RNA, 64 nt, Homo Sapiens
aacaacugagauguuaaaauagucauacgucuuuagaugcuauuaaaguuucauuagucauauu

SEQ ID NO: 188948 - RNA, 64 nt, Homo Sapiens
cuuuuugucuuuuaaguagcagucacuuugcuuaagaugcuaauagaaaacugugguuaaagau

SEQ ID NO: 188949 - RNA, 64 nt, Homo Sapiens
gcaaucauuuacuucuacugagugcugcauuuuaagaugcuagaugagaagaguaguugguuuu

SEQ ID NO: 188950 - RNA, 64 nt, Homo Sapiens
uaggugcuuuuauguauaacuuuaaugauuuauaagaugcuaaaugaauuguuuuuguaccuaa

SEQ ID NO: 188951 - RNA, 64 nt, Homo Sapiens
ucccaugucugugaagacuugauccaggagaacaagaugcuagucaaugcaaaccuguugagaa

SEQ ID NO: 188952 - RNA, 64 nt, Homo Sapiens
ugcucauugaaacaaucagcguauuuguauaguuagaugcuaaaaucacaaugauaucuuugcu

SEQ ID NO: 188953 - RNA, 64 nt, Homo Sapiens
uauggauuuacaagguuguuucugccagauaggaagaugcuagugauaaugcauuuguaaaggg

SEQ ID NO: 188954 - RNA, 64 nt, Homo Sapiens
cuauuugccaaacuuggucuugguauuuccugaaagaugcuaaugaguagauaaguggagcuca

SEQ ID NO: 188955 - RNA, 64 nt, Homo Sapiens
caggaacuguuaacucagggguucuuaacuugggguccaucaccccaggggguccauaguugga

SEQ ID NO: 188956 - RNA, 64 nt, Homo Sapiens
gacagguuuuuaaucauaaguggucuuuucaaauguccaucaauugauggggaaggcuggcacc

SEQ ID NO: 188957 - RNA, 64 nt, Homo Sapiens
uccuggauggauuccacugucccuaggaacaccuguccaucaccauugaauguugcccagccac

SEQ ID NO: 188958 - RNA, 64 nt, Homo Sapiens
augaaguuggccaagccauagagagccaugacagguccaucagcagaaggcucccuaagaccuu

SEQ ID NO: 188959 - RNA, 64 nt, Homo Sapiens; identical to SEQ ID NO: 68831

SEQ ID NO: 188960 - RNA, 64 nt, Homo Sapiens; identical to SEQ ID NO: 68832

SEQ ID NO: 188961 - RNA, 64 nt, Homo Sapiens; identical to SEQ ID NO: 68833

SEQ ID NO: 188962 - RNA, 64 nt, Homo Sapiens; identical to SEQ ID NO: 68834

SEQ ID NO: 188963 - RNA, 64 nt, Homo Sapiens; identical to SEQ ID NO: 68835

SEQ ID NO: 188964 - RNA, 64 nt, Homo Sapiens; identical to SEQ ID NO: 68836

SEQ ID NO: 188965 - RNA, 64 nt, Homo Sapiens; identical to SEQ ID NO: 68837

SEQ ID NO: 188966 - RNA, 64 nt, Homo Sapiens; identical to SEQ ID NO: 68838

SEQ ID NO: 188967 - RNA, 64 nt, Homo Sapiens; identical to SEQ ID NO: 68839

SEQ ID NO: 188968 - RNA, 64 nt, Homo Sapiens; identical to SEQ ID NO: 68840

SEQ ID NO: 188969 - RNA, 64 nt, Homo Sapiens; identical to SEQ ID NO: 68841

SEQ ID NO: 188970 - RNA, 64 nt, Homo Sapiens; identical to SEQ ID NO: 68842

SEQ ID NO: 188971 - RNA, 64 nt, Homo Sapiens; identical to SEQ ID NO: 68843

SEQ ID NO: 188972 - RNA, 64 nt, Homo Sapiens; identical to SEQ ID NO: 68844

SEQ ID NO: 188973 - RNA, 64 nt, Homo Sapiens; identical to SEQ ID NO: 68845

SEQ ID NO: 188974 - RNA, 64 nt, Homo Sapiens; identical to SEQ ID NO: 68846

SEQ ID NO: 188975 - RNA, 64 nt, Homo Sapiens; identical to SEQ ID NO: 68847

SEQ ID NO: 188976 - RNA, 64 nt, Homo Sapiens; identical to SEQ ID NO: 68848

SEQ ID NO: 188977 - RNA, 64 nt, Homo Sapiens; identical to SEQ ID NO: 68849

SEQ ID NO: 188978 - RNA, 64 nt, Homo Sapiens; identical to SEQ ID NO: 68850

SEQ ID NO: 188979 - RNA, 64 nt, Homo Sapiens; identical to SEQ ID NO: 68851

SEQ ID NO: 188980 - RNA, 64 nt, Homo Sapiens; identical to SEQ ID NO: 68852

SEQ ID NO: 188981 - RNA, 64 nt, Homo Sapiens; identical to SEQ ID NO: 68853

SEQ ID NO: 188982 - RNA, 64 nt, Homo Sapiens; identical to SEQ ID NO: 68854

SEQ ID NO: 188983 - RNA, 64 nt, Homo Sapiens; identical to SEQ ID NO: 68855

SEQ ID NO: 188984 - RNA, 64 nt, Homo Sapiens; identical to SEQ ID NO: 68856

SEQ ID NO: 188985 - RNA, 64 nt, Homo Sapiens; identical to SEQ ID NO: 68857

SEQ ID NO: 188986 - RNA, 64 nt, Homo Sapiens; identical to SEQ ID NO: 68858

SEQ ID NO: 188987 - RNA, 64 nt, Homo Sapiens; identical to SEQ ID NO: 68859

SEQ ID NO: 188988 - RNA, 64 nt, Homo Sapiens; identical to SEQ ID NO: 68860

SEQ ID NO: 188989 - RNA, 64 nt, Homo Sapiens; identical to SEQ ID NO: 68861

SEQ ID NO: 188990 - RNA, 64 nt, Homo Sapiens; identical to SEQ ID NO: 68862

SEQ ID NO: 188991 - RNA, 64 nt, Homo Sapiens; identical to SEQ ID NO: 68863

SEQ ID NO: 188992 - RNA, 64 nt, Homo Sapiens; identical to SEQ ID NO: 68864

SEQ ID NO: 188993 - RNA, 64 nt, Homo Sapiens; identical to SEQ ID NO: 68865

SEQ ID NO: 188994 - RNA, 64 nt, Homo Sapiens; identical to SEQ ID NO: 68866

SEQ ID NO: 188995 - RNA, 64 nt, Homo Sapiens; identical to SEQ ID NO: 68867

SEQ ID NO: 188996 - RNA, 64 nt, Homo Sapiens; identical to SEQ ID NO: 68868

SEQ ID NO: 188997 - RNA, 64 nt, Homo Sapiens; identical to SEQ ID NO: 68869

SEQ ID NO: 188998 - RNA, 64 nt, Homo Sapiens; identical to SEQ ID NO: 68870

SEQ ID NO: 188999 - RNA, 64 nt, Homo Sapiens; identical to SEQ ID NO: 68871

SEQ ID NO: 189000 - RNA, 64 nt, Homo Sapiens; identical to SEQ ID NO: 68872

SEQ ID NO: 189001 - RNA, 64 nt, Homo Sapiens; identical to SEQ ID NO: 68873

SEQ ID NO: 189002 - RNA, 64 nt, Homo Sapiens; identical to SEQ ID NO: 68874

SEQ ID NO: 189003 - RNA, 64 nt, Homo Sapiens; identical to SEQ ID NO: 68875

SEQ ID NO: 189004 - RNA, 64 nt, Homo Sapiens; identical to SEQ ID NO: 68876

SEQ ID NO: 189005 - RNA, 64 nt, Homo Sapiens; identical to SEQ ID NO: 68877

SEQ ID NO: 189006 - RNA, 64 nt, Homo Sapiens; identical to SEQ ID NO: 68877

SEQ ID NO: 189007 - RNA, 64 nt, Homo Sapiens; identical to SEQ ID NO: 68879

SEQ ID NO: 189008 - RNA, 64 nt, Homo Sapiens; identical to SEQ ID NO: 68880

SEQ ID NO: 189009 - RNA, 64 nt, Homo Sapiens; identical to SEQ ID NO: 68881

SEQ ID NO: 189010 - RNA, 64 nt, Homo Sapiens; identical to SEQ ID NO: 68882

SEQ ID NO: 189011 - RNA, 64 nt, Homo Sapiens; identical to SEQ ID NO: 68883

SEQ ID NO: 189012 - RNA, 64 nt, Homo Sapiens; identical to SEQ ID NO: 68884

SEQ ID NO: 189013 - RNA, 64 nt, Homo Sapiens; identical to SEQ ID NO: 68885

SEQ ID NO: 189014 - RNA, 64 nt, Homo Sapiens; identical to SEQ ID NO: 68886

SEQ ID NO: 189015 - RNA, 64 nt, Homo Sapiens; identical to SEQ ID NO: 68887

SEQ ID NO: 189016 - RNA, 64 nt, Homo Sapiens; identical to SEQ ID NO: 68888

SEQ ID NO: 189017 - RNA, 64 nt, Homo Sapiens; identical to SEQ ID NO: 68889

SEQ ID NO: 189018 - RNA, 64 nt, Homo Sapiens; identical to SEQ ID NO: 68890

SEQ ID NO: 189019 - RNA, 64 nt, Homo Sapiens; identical to SEQ ID NO: 68891

SEQ ID NO: 189020 - RNA, 64 nt, Homo Sapiens; identical to SEQ ID NO: 68892

SEQ ID NO: 189021 - RNA, 64 nt, Homo Sapiens; identical to SEQ ID NO: 68893

SEQ ID NO: 189022 - RNA, 64 nt, Homo Sapiens; identical to SEQ ID NO: 68894

SEQ ID NO: 189023 - RNA, 64 nt, Homo Sapiens; identical to SEQ ID NO: 68895

SEQ ID NO: 189024 - RNA, 64 nt, Homo Sapiens; identical to SEQ ID NO: 68896

SEQ ID NO: 189025 - RNA, 64 nt, Homo Sapiens; identical to SEQ ID NO: 68897

SEQ ID NO: 189026 - RNA, 64 nt, Homo Sapiens; identical to SEQ ID NO: 68898

SEQ ID NO: 189027 - RNA, 64 nt, Homo Sapiens; identical to SEQ ID NO: 68899

SEQ ID NO: 189028 - RNA, 64 nt, Homo Sapiens; identical to SEQ ID NO: 68900

SEQ ID NO: 189029 - RNA, 64 nt, Homo Sapiens; identical to SEQ ID NO: 68901

SEQ ID NO: 189030 - RNA, 64 nt, Homo Sapiens; identical to SEQ ID NO: 68902

SEQ ID NO: 189031 - RNA, 64 nt, Homo Sapiens; identical to SEQ ID NO: 68903

SEQ ID NO: 189032 - RNA, 64 nt, Homo Sapiens; identical to SEQ ID NO: 68904

SEQ ID NO: 189033 - RNA, 64 nt, Homo Sapiens; identical to SEQ ID NO: 68905

SEQ ID NO: 189034 - RNA, 64 nt, Homo Sapiens; identical to SEQ ID NO: 68906

SEQ ID NO: 189035 - RNA, 64 nt, Homo Sapiens; identical to SEQ ID NO: 68907

SEQ ID NO: 189036 - RNA, 64 nt, Homo Sapiens; identical to SEQ ID NO: 68908

SEQ ID NO: 189037 - RNA, 64 nt, Homo Sapiens; identical to SEQ ID NO: 68909

SEQ ID NO: 189038 - RNA, 64 nt, Homo Sapiens; identical to SEQ ID NO: 68910

SEQ ID NO: 189039 - RNA, 64 nt, Homo Sapiens; identical to SEQ ID NO: 68911

SEQ ID NO: 189040 - RNA, 64 nt, Homo Sapiens; identical to SEQ ID NO: 68912

SEQ ID NO: 189041 - RNA, 64 nt, Homo Sapiens; identical to SEQ ID NO: 68913

SEQ ID NO: 189042 - RNA, 64 nt, Homo Sapiens; identical to SEQ ID NO: 68914

SEQ ID NO: 189043 - RNA, 64 nt, Homo Sapiens; identical to SEQ ID NO: 68915

SEQ ID NO: 189044 - RNA, 64 nt, Homo Sapiens; identical to SEQ ID NO: 68916

SEQ ID NO: 189045 - RNA, 64 nt, Homo Sapiens; identical to SEQ ID NO: 68917

SEQ ID NO: 189046 - RNA, 64 nt, Homo Sapiens; identical to SEQ ID NO: 68918

SEQ ID NO: 189047 - RNA, 64 nt, Homo Sapiens; identical to SEQ ID NO: 68919

SEQ ID NO: 189048 - RNA, 64 nt, Homo Sapiens; identical to SEQ ID NO: 68920

SEQ ID NO: 189049 - RNA, 64 nt, Homo Sapiens; identical to SEQ ID NO: 68921

SEQ ID NO: 189050 - RNA, 64 nt, Homo Sapiens; identical to SEQ ID NO: 68922

SEQ ID NO: 189051 - RNA, 64 nt, Homo Sapiens; identical to SEQ ID NO: 68923

SEQ ID NO: 189052 - RNA, 64 nt, Homo Sapiens; identical to SEQ ID NO: 68924

SEQ ID NO: 189053 - RNA, 64 nt, Homo Sapiens; identical to SEQ ID NO: 68925

SEQ ID NO: 189054 - RNA, 64 nt, Homo Sapiens; identical to SEQ ID NO: 68926

SEQ ID NO: 189055 - RNA, 64 nt, Homo Sapiens; identical to SEQ ID NO: 68927

SEQ ID NO: 189056 - RNA, 64 nt, Homo Sapiens; identical to SEQ ID NO: 68928

SEQ ID NO: 189057 - RNA, 64 nt, Homo Sapiens; identical to SEQ ID NO: 68929

SEQ ID NO: 189058 - RNA, 64 nt, Homo Sapiens; identical to SEQ ID NO: 68930

SEQ ID NO: 189059 - RNA, 64 nt, Homo Sapiens; identical to SEQ ID NO: 68931

SEQ ID NO: 189060 - RNA, 64 nt, Homo Sapiens; identical to SEQ ID NO: 68932

SEQ ID NO: 189061 - RNA, 64 nt, Homo Sapiens; identical to SEQ ID NO: 68933

SEQ ID NO: 189062 - RNA, 64 nt, Homo Sapiens; identical to SEQ ID NO: 68934

SEQ ID NO: 189063 - RNA, 64 nt, Homo Sapiens; identical to SEQ ID NO: 68935

SEQ ID NO: 189064 - RNA, 64 nt, Homo Sapiens; identical to SEQ ID NO: 141401

SEQ ID NO: 189065 - RNA, 64 nt, Homo Sapiens; identical to SEQ ID NO: 141402

SEQ ID NO: 189066 - RNA, 64 nt, Homo Sapiens
guguuucucgggcuucugucacuuccuuugaaagcuguauaauaugugagauuuauuuaauagg

SEQ ID NO: 189067 - RNA, 64 nt, Homo Sapiens
uuuugugguuuuuguuuuguccauuuuaugaguucuguauaauuuucucuuuuucauucauaua

SEQ ID NO: 189068 - RNA, 64 nt, Homo Sapiens
aacaaucuuagacauuuaucaccauuguacccugcuguauaauagcccuguuggcauuagcacu

SEQ ID NO: 189069 - RNA, 64 nt, Homo Sapiens
uuuaaaaauguuaaagaacuuaaauacuguaacacuguauaacauuuugaaacauuugccaaac

SEQ ID NO: 189070 - RNA, 64 nt, Homo Sapiens
aaugcauuguaguguaauauuuaugcauacuauacuguauaacauguuauucaaaagggauugc

SEQ ID NO: 189071 - RNA, 64 nt, Homo Sapiens
uuugcacuucuguauauagucaaaagagagaaaccuguauaauaguaagaucuuauuuugaaua

SEQ ID NO: 189072 - RNA, 64 nt, Homo Sapiens
guguauuucuuuuuuaugagucuguauaaaauuucuguauaaagcaaucaauuuuaaagcuaca

SEQ ID NO: 189073 - RNA, 64 nt, Homo Sapiens
uuucuguauaaagguguauuuuuuaaagcuacaucuguauaaaauuccuuugguuuacaaucaa

SEQ ID NO: 189074 - RNA, 64 nt, Homo Sapiens
ggccauuuacugaguguuucuauugaaauuaaagcuguauaaugaacugaacuugaagaaaaua

SEQ ID NO: 189075 - RNA, 64 nt, Homo Sapiens
guauuucaaagaaucguguuauaauacaacauuccuguauaaugguaacagagaagaaaccuaa

SEQ ID NO: 189076 - RNA, 64 nt, Homo Sapiens
ccaccuugccaagcuuucuuguauaaucucucuccuguauaaccccucagaccaacucucuccu

SEQ ID NO: 189077 - RNA, 64 nt, Homo Sapiens
ucucuccuguauaaccccacagaccaacucucuccuguauaaucccuugaacuguucuggccuc

SEQ ID NO: 189078 - RNA, 64 nt, Homo Sapiens
ugauaccaacaacaaauaaaaguguucuagaguucuguauaaaaguuuuaaauccguaugaccc

SEQ ID NO: 189079 - RNA, 64 nt, Homo Sapiens
ggaaaacuguuaaggaggucgccaauuaaugguccuguauaaguuuaucauacaacagaaaaug

SEQ ID NO: 189080 - RNA, 64 nt, Homo Sapiens
aaaacacauguaaaaugcuuuuuaacagcugauacuguauaagacaaagccaagaugcaaaauu

SEQ ID NO: 189081 - RNA, 64 nt, Homo Sapiens
ucucauuaagaucugaaucuugguucuaagcauucuguauaauaugugauugcuuguccuagcu

SEQ ID NO: 189082 - RNA, 64 nt, Homo Sapiens
aaugagcguuaacacaguaauguaaaccuaaugucuguauaaauugauguaaaacagaauauuc

SEQ ID NO: 189083 - RNA, 64 nt, Homo Sapiens
aagccuaacauuggugcaaauuuagagacagggacuguauaaacaugcacaguuugcuauuugc

SEQ ID NO: 189084 - RNA, 64 nt, Homo Sapiens
agggcaucucuauuagaucuacucuuacaguagucuguauaauaucuagcugucuggcuguaua

SEQ ID NO: 189085 - RNA, 64 nt, Homo Sapiens
cuuacaguagucuguauaaucucuagcugucuggcuguauaacuagaggacugaacagcucuuc

SEQ ID NO: 189086 - RNA, 64 nt, Homo Sapiens
gugaaauuuuuauuuguauuauugaaaagcaaaucuguauaaauaauaaauaaguaaauacauu

SEQ ID NO: 189087 - RNA, 64 nt, Homo Sapiens
uaauaaaacucugcaccuaaaaucauaaauacugcuguauaaggauuuuuguauguuuuauugu

SEQ ID NO: 189088 - RNA, 64 nt, Homo Sapiens
ccuagucaaacaaggaagcuguaggugaggagaucuguauaauauucuaauuuaaguaaguuug

SEQ ID NO: 189089 - RNA, 64 nt, Homo Sapiens
auucugggauuugagaggaucuaaaacuauuuuucuguauaaauauuauuugccaaaaguuugu

SEQ ID NO: 189090 - RNA, 64 nt, Homo Sapiens
aguauuaguaauuguauauguacugaaauaugaacuguauaaaauaaauaaaauaguguugaug

SEQ ID NO: 189091 - RNA, 64 nt, Homo Sapiens
cuuguugacaaugcacugaccaccuuguaaaugacuguauaaaaaauuaacuauuaaccacauu

SEQ ID NO: 189092 - RNA, 64 nt, Homo Sapiens
uggguuucaguuuuugaaucuuguauuuauuuuucuguauaaugaaauuaauaucuagacuuga

SEQ ID NO: 189093 - RNA, 64 nt, Homo Sapiens
ccgagaggaaagugccgucuuucauagcuggucucuguauaaagaguauguagcaacaacuguu

SEQ ID NO: 189094 - RNA, 64 nt, Homo Sapiens
ugucaccccaagucuuccagcugguggaucugggcccagcaaagacuguucuccucccgaggga

SEQ ID NO: 189095 - RNA, 64 nt, Homo Sapiens
acccgcggggcaccucccuggccacacgccuguucccagcaagugcugaaacucacuagaccgu

SEQ ID NO: 189096 - RNA, 64 nt, Homo Sapiens
caaguagcugggaugacaggcgcacaccaccacgcccagcaaauuuuuuguauuuuuaguagaa

SEQ ID NO: 189097 - RNA, 64 nt, Homo Sapiens
uuucaggcucuuagaagccauagauuuggacaagcccagcaagauggguguccuuccaggccuc

SEQ ID NO: 189098 - RNA, 64 nt, Homo Sapiens
caggccgagcgcagacuguuuaggacucagcagacccagcaagaggcaucugcccuuuccccag

SEQ ID NO: 189099 - RNA, 64 nt, Homo Sapiens
agcaagaggcaucugcccuuuccccagccaccuccccagcaagcaaccugaaaucucagcagau

SEQ ID NO: 189100 - RNA, 64 nt, Homo Sapiens
uaggagugaucagaaccagugcuuauuaagaucacccagcaaguaggauggagaagggcaacuu

SEQ ID NO: 189101 - RNA, 64 nt, Homo Sapiens
gcauugcaucuuugcugaaucauugccucagcaccccagcaagaucuugaagaagaugucaugg

SEQ ID NO: 189102 - RNA, 64 nt, Homo Sapiens
cacaggauccuauucucaccaggaaggggguccacccagcaaagagugggcugcaucugggauu

SEQ ID NO: 189103 - RNA, 64 nt, Homo Sapiens
uuccaugaagaccacauccacacacgcaggaacucccagcaacacaagcuggaagcacauguuu

SEQ ID NO: 189104 - RNA, 64 nt, Homo Sapiens
ggggaugguugguccccuacaaacugggacaguacccagcaaguacauggaacuuucaaugcua

SEQ ID NO: 189105 - RNA, 64 nt, Homo Sapiens
ggcagaggccacaggccuggccuccucaugcccacccagcaagggccccccuaccuuaggccac

SEQ ID NO: 189106 - RNA, 64 nt, Homo Sapiens
aacaaaaacagcuucaacugauuucugguuguggcccagcaauuguuucucucccaucauccgg

SEQ ID NO: 189107 - RNA, 64 nt, Homo Sapiens
gcauauugaaauuuguuaaacccacccuccccgccccagcaacuguaaaacuaauuagugccca

SEQ ID NO: 189108 - RNA, 64 nt, Homo Sapiens
acugggaggccagacggcacgaggucuccaaggccccagcaaagccauggcuucuaccccuagu

SEQ ID NO: 189109 - RNA, 64 nt, Homo Sapiens
ggacccagccuuugggccuccccagccagagcagcccagcaacaguguguccuguggucauaaa

SEQ ID NO: 189110 - RNA, 64 nt, Homo Sapiens
guagcuccggggcuuccuggccccagcaaggguacccagcaaggaaacugggauggcccagguc

SEQ ID NO: 189111 - RNA, 64 nt, Homo Sapiens
guacccagcaaggguagcucgauggcccaggucccccagcaaggggccgcucugcacaaacugg

SEQ ID NO: 189112 - RNA, 64 nt, Homo Sapiens
uguaaguucuugauugggugguucagagaauuuacccagcaaaagaugacaggcuggcagcuau

SEQ ID NO: 189113 - RNA, 64 nt, Homo Sapiens
uucagcaggugaguaggaagugcaacuggacaaccccagcaagguggcuguguacuagccaaaa

SEQ ID NO: 189114 - RNA, 64 nt, Homo Sapiens
aggagugaccacaaagccugaaaacacuuugccacccagcaaagaacuggcacaauugguuugg

SEQ ID NO: 189115 - RNA, 64 nt, Homo Sapiens
caggguaaggugcuggggcugccagaggaccugccccagcaagauuuuugucaagagcgagacu

SEQ ID NO: 189116 - RNA, 64 nt, Homo Sapiens
cucuaacaccuccuagaggccccuggcccccaaccccagcaaaucaaaacuggggucccagcaa

SEQ ID NO: 189117 - RNA, 64 nt, Homo Sapiens
cuggcccccaaccccagcaacccaaaacuggggucccagcaacccaaucucuuacagcucccuc

SEQ ID NO: 189118 - RNA, 64 nt, Homo Sapiens
aaaacggacucaucucuggcccccucccuguuuccccagcaauuggggggagcuauuuccaagg

SEQ ID NO: 189119 - RNA, 64 nt, Homo Sapiens
aacuguucuagggaaaguggguucuucacaggaucccagcaaugagcugcugcccuccacagcg

SEQ ID NO: 189120 - RNA, 64 nt, Homo Sapiens
cagagugagacuccaucucgcacugcacuccagccugggagagagcagugagcugagaucacac

SEQ ID NO: 189121 - RNA, 64 nt, Homo Sapiens
gcaaacugccacaucucagccugcccaacucuuacugggagauuucccuggauccagaucuucu

SEQ ID NO: 189122 - RNA, 64 nt, Homo Sapiens
aggaguagcaaaaauaugguuaaggcauuuauugcugggagaauuuugcauacauuuaaguaau

SEQ ID NO: 189123 - RNA, 64 nt, Homo Sapiens
cguaauauaauucuggugaaaaucuuaaccuagucugggagauggguacuacauccugucauuu

SEQ ID NO: 189124 - RNA, 64 nt, Homo Sapiens
acaaaugguccuuucacaugugcuuuauuagacucugggagagaaaaguaaccaagugcuucag

SEQ ID NO: 189125 - RNA, 64 nt, Homo Sapiens
cuuccucauccccucauugcaacaaaaccuuaaacugggagaaccuuaguccccucucuuuccu

SEQ ID NO: 189126 - RNA, 64 nt, Homo Sapiens
cccugaauuugaguguguuccugucuucuucaaccugggagagaccuuauacuuuauugcuuuu

SEQ ID NO: 189127 - RNA, 64 nt, Homo Sapiens
caauucaaguugagauuuguaacacgugggaauucugggagauaucccccugggucugucccac

SEQ ID NO: 189128 - RNA, 64 nt, Homo Sapiens
cuaccaagaaaccaacccaauuauucauguauuacugggagauguguaucaugguuucaguaug

SEQ ID NO: 189129 - RNA, 64 nt, Homo Sapiens
cuaggaaggcuugguaggaggcaagcuccugaggcugggagagacuuuguuccuuucuggcuga

SEQ ID NO: 189130 - RNA, 64 nt, Homo Sapiens
aguaugguccaauaggcagcauccucugcugcagcugggagagcugaguuccagggcugugucc

SEQ ID NO: 189131 - RNA, 64 nt, Homo Sapiens
agacaggaguguaggagucccuguuugauguacucugggagaguaauucuaucuccucuucuga

SEQ ID NO: 189132 - RNA, 64 nt, Homo Sapiens
guuuaaaaacaaaaaauccacucccgaagacuggcugggagaagagcacuucucuaaucaugcc

SEQ ID NO: 189133 - RNA, 64 nt, Homo Sapiens
uacgcaucaacuguggaggugugaccuaauuccccugggagacaaaacauugcucuugaguuaa

SEQ ID NO: 189134 - RNA, 64 nt, Homo Sapiens
aagcugcaaggcuuucuuaagguuucgaguguugcugggagaaaucugcugcauguuguggguu

SEQ ID NO: 189135 - RNA, 64 nt, Homo Sapiens
ccuuaagccuccaggccagcagcaucagcaucaccugggagauuguuaggaaugcagauucuca

SEQ ID NO: 189136 - RNA, 64 nt, Homo Sapiens
uucaggacaggagugaacuccuucuggaccugcacugggagaaaccuuucugccacaucucgcc

SEQ ID NO: 189137 - RNA, 64 nt, Homo Sapiens
ccaaggcugaagagucagguacccagugacaguacugggagaaaugagcauuaaaguuccuaag

SEQ ID NO: 189138 - RNA, 64 nt, Homo Sapiens
ccagguugaucuaccgacaccuuccacuucuuuccugggagagacugcuggcuucauuggugau

SEQ ID NO: 189139 - RNA, 64 nt, Homo Sapiens
gccuuaagcugugaucaugccacugcauuccagccugggagagagagaggaccugucuguugaa

SEQ ID NO: 189140 - RNA, 64 nt, Homo Sapiens
gggccugcccuucucugcuggagagucaaauggccugggagaggcgucuuuucaaauggccugg

SEQ ID NO: 189141 - RNA, 64 nt, Homo Sapiens
caaauggccugggagaggggucuuuucaaauggccugggagaguugguaugugaagaugcaccg

SEQ ID NO: 189142 - RNA, 64 nt, Homo Sapiens
cuuggccuguuagauuguuccucccuaacccacccugggagacacugagccugugcucagccuc

SEQ ID NO: 189143 - RNA, 64 nt, Homo Sapiens
uguggugggaauaugggcugcugaacuaggaguccugggagagcgucccuggacuggugggaac

SEQ ID NO: 189144 - RNA, 64 nt, Homo Sapiens
uuacucaccccggagucuuuuugcugugggguuccugggagagcucuguguucaaggucacggu

SEQ ID NO: 189145 - RNA, 64 nt, Homo Sapiens
uauggcagcuacuugcaucgggaccugggauaaacugggagaaccccgggccauccaagcccaa

SEQ ID NO: 189146 - RNA, 64 nt, Homo Sapiens
uuuuuuggagucuuuguugcuauauuuuguggggcugggagagagagauuagauuauuuugaca

SEQ ID NO: 189147 - RNA, 64 nt, Homo Sapiens
gaaacuguaguugagauacagcuauuuaauauuucugggagaugugcaucccucuucuuugugg

SEQ ID NO: 189148 - RNA, 64 nt, Homo Sapiens
cacgcgguauggggagggcugagcucagugccuccugggagacuugucccguguacagugaccc

SEQ ID NO: 189149 - RNA, 64 nt, Homo Sapiens
acuugggaugcugaggugggaggaucacuugaaccugggagacacaggcugcagugggcccuga

SEQ ID NO: 189150 - RNA, 64 nt, Homo Sapiens
ccugcaagcauuuguugaugcccuugcaggcccacugggagaaagaugccucaggcaggucuca

SEQ ID NO: 189151 - RNA, 64 nt, Homo Sapiens
ccaggagacacauggcuggacaaggcuuugcagccugggagaccccgacuuucucuaacccagu

SEQ ID NO: 189152 - RNA, 64 nt, Homo Sapiens
aggcugcuugaaaauaucuuuaucuaauauauaucugggagaaaaauuggacucgauuuccuua

SEQ ID NO: 189153 - RNA, 64 nt, Homo Sapiens
gaacgagacuccuaaucaaacacugcacuccagccugggagacagcagugagccgagaucacac

SEQ ID NO: 189154 - RNA, 64 nt, Homo Sapiens
agaaccucaaacuaggaggagaucauuuuagacacugggagaaggcaucuacucuaggcauauu

SEQ ID NO: 189155 - RNA, 64 nt, Homo Sapiens
ccauucuccaguuucagaagucugccuuaggcugcugggagaugagggauagguaugaccuaug

SEQ ID NO: 189156 - RNA, 64 nt, Homo Sapiens
cuuaguccccucucuuuccuaacaaaaccuuaaacugggagaaccuuccucauccccucauugg

SEQ ID NO: 189157 - RNA, 64 nt, Homo Sapiens
aaauuaaccaagugcuucagugcuuuauuagacucugggagagaacaaauggcucuuucacaug

SEQ ID NO: 189158 - RNA, 64 nt, Homo Sapiens
aacuuuuuuuaacgcaaaaaaacaaagcucacaucugggagauuuacauaauuuguuggugacu

SEQ ID NO: 189159 - RNA, 64 nt, Homo Sapiens
gcauucuaaauuauauauagcuuauaaacuugcucugggagaaugccauuacuauucuauaaac

SEQ ID NO: 189160 - RNA, 64 nt, Homo Sapiens
cucagcauauacucuucuccagaccaagugacaacugggagagccacgggcaccaggaccccua

SEQ ID NO: 189161 - RNA, 64 nt, Homo Sapiens
uacuuucgccuccaaggacuaguuugcccauuaacugggagaggccaggugaggcccuuucucc

SEQ ID NO: 189162 - RNA, 64 nt, Homo Sapiens
gacagcugcuuggagacccgugccuuccagauggcugggagaugccucuguggggaugaaaugg

SEQ ID NO: 189163 - RNA, 64 nt, Homo Sapiens
aguggggugggauucagagugcuuagucugcucacugggagaagaagaguuccugcgcaugcaa

SEQ ID NO: 189164 - RNA, 64 nt, Homo Sapiens
aauugaggggacggcaggcccggcugcccuggaacugggagacagggagaauccccugccgggg

SEQ ID NO: 189165 - RNA, 64 nt, Homo Sapiens
acugagggggcugaggcaugagaaucacuugaaccugggagacagagguugcaaugaaccgaga

SEQ ID NO: 189166 - RNA, 64 nt, Homo Sapiens
ggaauugcagccacugggcaguugggguggcuuccugggagaugagccgcgaccagguccuggg

SEQ ID NO: 189167 - RNA, 64 nt, Homo Sapiens
cauuccaaauaaagaauaggccccugccuggcuccugggagauaaccucuaagccauuagaaua

SEQ ID NO: 189168 - RNA, 64 nt, Homo Sapiens
ucugugcacacaucauuguagccacacaucauugcugggagaauuaagcauuauccugaagacu

SEQ ID NO: 189169 - RNA, 64 nt, Homo Sapiens
ggaagcacugcuaacauuuugagagaaauaagcacugggagauuuccucgcaagaccgcucugg

SEQ ID NO: 189170 - RNA, 64 nt, Homo Sapiens
aauaagcacugggagauuggcucgcaagaccgcucugggagagaaggacucuucucacgaccuc

SEQ ID NO: 189171 - RNA, 64 nt, Homo Sapiens
ucugagaaccuuguggggugucgggaugggggugcugggagacacagaccugauacaguauguc

SEQ ID NO: 189172 - RNA, 64 nt, Homo Sapiens
uaaaaucuuuauugagugccuaccggugcaggcgcugggagagacaauagcuuugaggagcuca

SEQ ID NO: 189173 - RNA, 64 nt, Homo Sapiens
ucaccaguuugacucaccauugcucagaguuuaccugggagauuagucaucuucucuuuuuucu

SEQ ID NO: 189174 - RNA, 64 nt, Homo Sapiens
uuccagaauccucgcagacacggcugcugggcaccugggagagcccacaugccguucccaugcc

SEQ ID NO: 189175 - RNA, 64 nt, Homo Sapiens
gaggucaucccggggccauggacgcagggagacccugggagaguuccucggccagagcucccag

SEQ ID NO: 189176 - RNA, 64 nt, Homo Sapiens
cugggacccucggggcaggauugaggaccuccaccugggagauggggagcuggugggggcaucc

SEQ ID NO: 189177 - RNA, 64 nt, Homo Sapiens
agcuggagaagaacgaggaggcggcccugcuauccugggagaucuaccugaaggagaacuaccu

SEQ ID NO: 189178 - RNA, 64 nt, Homo Sapiens
ucacgcgcuuccccgugcccaacgagaaggugcccugggagacggaguuccugaucuaugaccc

SEQ ID NO: 189179 - RNA, 64 nt, Homo Sapiens
uuuugagacggcgacagaaccugacccguggagacugggagagcccagcaggcaccuguauugc

SEQ ID NO: 189180 - RNA, 64 nt, Homo Sapiens
ugcuuuccagugguagcccuuuugccauggaggucugggagagagagcagagggcggcagggcu

SEQ ID NO: 189181 - RNA, 64 nt, Homo Sapiens
uugucguccuggacaccacaggggcaccugcaggcugggagaccagguccucugugcaugggcc

SEQ ID NO: 189182 - RNA, 64 nt, Homo Sapiens
uuccaggccugggguuagcagccugugcccccggcugggagaucagacccgguguugguccugc

SEQ ID NO: 189183 - RNA, 64 nt, Homo Sapiens
caggaaggauccuccccuagggagcccccaggagcugggagaggccacaagcccagggacaccu

SEQ ID NO: 189184 - RNA, 64 nt, Homo Sapiens
caggaaggacccuccccuagggaguccccaggagcugggagaggccccaagcccagggaugccu

SEQ ID NO: 189185 - RNA, 64 nt, Homo Sapiens
aaacacauuuacuggccuccucuaaugacuuuggggaaaagaugauucugggucuuucccuuga

SEQ ID NO: 189186 - RNA, 64 nt, Homo Sapiens
aaaaacaaaaacaagcaaacaaacaaaaaacaauggaaaagaugaagcuggagagagaggaacc

SEQ ID NO: 189187 - RNA, 64 nt, Homo Sapiens
cagaaggaggcugggcagaaaaagaaccaggccuggaaaagaacaggugggaagagagccugga

SEQ ID NO: 189188 - RNA, 64 nt, Homo Sapiens
caggccuggaaaagaaccagugggaagagagccuggaaaagaaccuucugucauuguucaaagg

SEQ ID NO: 189189 - RNA, 64 nt, Homo Sapiens
auggggugggggugggggugggaagagguuuuagggaaaagaaauuaccugaucauuuucuuua

SEQ ID NO: 189190 - RNA, 64 nt, Homo Sapiens
uuccccugaaccccuaaaaauccuccuuucacgaggaaaagaccccagucagccacagagaccc

SEQ ID NO: 189191 - RNA, 64 nt, Homo Sapiens
ccccagcccucuugcaagaggagaggcacgguagggaaaagaacugcugggugggggccuguuu

SEQ ID NO: 189192 - RNA, 64 nt, Homo Sapiens
aaguucuuugcagauuuggggcgaggggugauuuggaaaagaagaccuggguggaaagcgguuu

SEQ ID NO: 189193 - RNA, 64 nt, Homo Sapiens
acaaaaaacgaaugaaaauaccuaguuaaagaaaggaaaagaaacuuauuuaauaugcuuauaa

SEQ ID NO: 189194 - RNA, 64 nt, Homo Sapiens
guggagaugaggucaguugucuuggaagcuguuuggaaaagacaagucagaaucagaagauagu

SEQ ID NO: 189195 - RNA, 64 nt, Homo Sapiens
aagaccagaaauucccuuuuuugaaggugauaagggaaaagauauuucaguguaaaguguguga

SEQ ID NO: 189196 - RNA, 64 nt, Homo Sapiens
ugcuguggaugaacgaugaaugucaaugucagaaggaaaagagaauuuuggccaucaaaaucca

SEQ ID NO: 189197 - RNA, 64 nt, Homo Sapiens
ucaacccagcagcugaaaagcuucaagagaucuaggaaaagacauuuucauguuaaugagaauu

SEQ ID NO: 189198 - RNA, 64 nt, Homo Sapiens
uuuccuucauccuugugacauuucauuucaguaaggaaaagauaacaaagugcaauuaucagca

SEQ ID NO: 189199 - RNA, 64 nt, Homo Sapiens
uggaauccuccuucuagcugaaggugauugaaaaggaaaagagugagugaacagaaccauagcu

SEQ ID NO: 189200 - RNA, 64 nt, Homo Sapiens
accuuugagguagaccaggauuucuaaucaaaagggaaaagaagauguugaagaauacaguuag

SEQ ID NO: 189201 - RNA, 64 nt, Homo Sapiens
ggaccuucuagaauuauaagucacaaagaguucuggaaaagaacuguuuacugcuugauaggaa

SEQ ID NO: 189202 - RNA, 64 nt, Homo Sapiens
ucggcuguuaggccauucuccagaaugaauuaauggaaaagaacaaugagggauaaauagaaag

SEQ ID NO: 189203 - RNA, 64 nt, Homo Sapiens
cugucggguuuuuccauucaccaagggcccacugggaaaagauaaguuaaguugcagcauaaau

SEQ ID NO: 189204 - RNA, 64 nt, Homo Sapiens
uucauauuuuagagguguuaauaaaauccucaucggaaaagauccaaagugcaaggauuugauu

SEQ ID NO: 189205 - RNA, 64 nt, Homo Sapiens
auuauaaacauaauuuccuagacugaaaguuuuuggaaaagaugcagggucugagucaggccuu

SEQ ID NO: 189206 - RNA, 64 nt, Homo Sapiens
cagggaggaaugaagagagcacucucuaugugugggaaaagaggugcuuccuguaaugaaaucc

SEQ ID NO: 189207 - RNA, 64 nt, Homo Sapiens
uaucaaguaaauacugaaacaaguaagagggaaaggaaaagagguauccugacugaaauagaca

SEQ ID NO: 189208 - RNA, 64 nt, Homo Sapiens
uuuucaaauagaaaaacaacaaaacccaugaaauggaaaagagaguuccaaaaaagaagaccug

SEQ ID NO: 189209 - RNA, 64 nt, Homo Sapiens
uauuuaccaacuuuacucauuuucccauuuuagaggaaaagagguugccugcuuccuaucaaag

SEQ ID NO: 189210 - RNA, 64 nt, Homo Sapiens
cucuuccauccauuguuggcacccccuugcaaaaggaaaagaacagcaaaagucaggagcagua

SEQ ID NO: 189211 - RNA, 64 nt, Homo Sapiens
cagggaaaauaacaaccacccuuacugauaguugggaaaagaagauuggguuauuuugccauau

SEQ ID NO: 189212 - RNA, 64 nt, Homo Sapiens
acaauggugagucccggcccauacaaaagguuuaggaaaagaaaaagacacaucaaacaggccu

SEQ ID NO: 189213 - RNA, 64 nt, Homo Sapiens
cacauaaacucgcuucugagagccagcagauagaggaaaagacauagguugcaguaccagccac

SEQ ID NO: 189214 - RNA, 50 nt, Homo Sapiens
ugccucccccaggugacuaaggaaaagagcagaagcuccuugguuuaacc

SEQ ID NO: 189215 - RNA, 64 nt, Homo Sapiens
aguaaaauugaacuuugaugggggauucaguucuggaaaagaauuugguauuuuccagucugcu

SEQ ID NO: 189216 - RNA, 64 nt, Homo Sapiens
cacaagaaagcaggaacguggagaaauuggagcaggaaaagaaauuaucaaagcaauagaaaua

SEQ ID NO: 189217 - RNA, 64 nt, Homo Sapiens
uaaugcuauuagcaauuuccauauacuauauuguggaaaagacugaagaauacaauucugagaa

SEQ ID NO: 189218 - RNA, 64 nt, Homo Sapiens
uucuguguuuugaauuuuuauuuucuaaugcaguggaaaagaaacagaucauccuaaaugagga

SEQ ID NO: 189219 - RNA, 64 nt, Homo Sapiens
uuaaucccuucugucuuucuguucucacaaagauggaaaagauacaagagcuugccggaaauaa

SEQ ID NO: 189220 - RNA, 64 nt, Homo Sapiens
uuucagagaaaagcccuauacguguagugaauguggaaaagacuucagauugaauucacaucuu

SEQ ID NO: 189221 - RNA, 64 nt, Homo Sapiens
ucaccagacagaaagccuuugauugugauguaugggaaaagaacuccagucagagagcacaucu

SEQ ID NO: 189222 - RNA, 64 nt, Homo Sapiens
ugaugaaaauauuuaaaggcaugcaauguagaggggaaaagagaaccaaagcgaauuuuaaaag

SEQ ID NO: 189223 - RNA, 64 nt, Homo Sapiens
ucuaugauuccagguggcauugcaaauccuugugggaaaagaaagcuuugagguggaagagggc

SEQ ID NO: 189224 - RNA, 64 nt, Homo Sapiens
aggacaaaaguccucaacuuagcaucugauaauaggaaaagaaaaaaagguagaauagggcuga

SEQ ID NO: 189225 - RNA, 64 nt, Homo Sapiens
ucagauuggaacuucuuguucucaagcacuugcuggaaaagauaugacacuuaucagaaucuuc

SEQ ID NO: 189226 - RNA, 64 nt, Homo Sapiens
aggaauggagagaggacucaacugggacccacguggaaaagaccgagcaggccacagaggcucg

SEQ ID NO: 189227 - RNA, 64 nt, Homo Sapiens
agccacccaaagccuagccgcuguucuagggaacggaaaagaguucauggccaagcgucuaacc

SEQ ID NO: 189228 - RNA, 64 nt, Homo Sapiens
agauaaacaaggaauauuuuuuuuuaaguggaggggaaaagaaguuuuuuucuuuuuuccuuuu

SEQ ID NO: 189229 - RNA, 64 nt, Homo Sapiens
guuugcuggcuagcucuauucuguuagauaugcaggaaaagauaauuuuuacaguuacauccag

SEQ ID NO: 189230 - RNA, 64 nt, Homo Sapiens
uucgcuuuucaaguaggaagaaucaaucauaggaggaaaagaaaaaaagagcaugauuuuaaaa

SEQ ID NO: 189231 - RNA, 64 nt, Homo Sapiens
augauuuuaaaaaaucaaucuuauguugauguauggaaaagagcauuuaguauccaaagacugu

SEQ ID NO: 189232 - RNA, 64 nt, Homo Sapiens
caaagcucuaauagagucacaagauaaaaggauaggaaaagauuggccauucccuguaggagua

SEQ ID NO: 189233 - RNA, 64 nt, Homo Sapiens
aucaaaggcagaaaggagauugaaagacaaagaaggaaaagaguugugaggugauaggcaagga

SEQ ID NO: 189234 - RNA, 64 nt, Homo Sapiens
caauaugcuuuacacucauucuucaaaggauuuuggaaaagaaauucuuucuuuacuccuuugg

SEQ ID NO: 189235 - RNA, 64 nt, Homo Sapiens
uugccaggauggggcacagcagcucagguuugggggaaaagacccgaauccagagugcagggga

SEQ ID NO: 189236 - RNA, 64 nt, Homo Sapiens
acagagggagcuucacugagacucagagggaaaaggaaaagagccucaaacauuuuuaggaggu

SEQ ID NO: 189237 - RNA, 64 nt, Homo Sapiens
uaaaaacuugaaguuccucaggccuguaacuucuggaaaagaugauuauucaaaauaauguuuu

SEQ ID NO: 189238 - RNA, 64 nt, Homo Sapiens
uaccaacugugaaagcuggcuuuaauuuuuaggaggaaaagaaaagccugcauguguucuuuau

SEQ ID NO: 189239 - RNA, 64 nt, Homo Sapiens
ccuguccuucaaaagaguuugaaaugucauuuugggaaaagagagccagucaagcuaguaggcu

SEQ ID NO: 189240 - RNA, 64 nt, Homo Sapiens
aagaaaugccagcuguuuaaucacaccuaccccuggaaaagagguaaaccuuuugaacaguuga

SEQ ID NO: 189241 - RNA, 64 nt, Homo Sapiens
uaauuugguuuguggacugggcaugguggcuuauggaaaagaggugagccuuugugaagaacau

SEQ ID NO: 189242 - RNA, 64 nt, Homo Sapiens
cuaagaacugguuuguuuaaagguuuaaauuguuggaaaagagcauuugccuucuuuaaugaau

SEQ ID NO: 189243 - RNA, 64 nt, Homo Sapiens
ccuucuugagugauaccuauuacggaugaguucuggaaaagacccagcuaugauucauaaaaac

SEQ ID NO: 189244 - RNA, 64 nt, Homo Sapiens
uuuucagaaaaacguggagugcuaggggcagccuggaaaagauggggaaccugcuagugaacua

SEQ ID NO: 189245 - RNA, 64 nt, Homo Sapiens
agaaacuuaguucuaccuugcauacaugaagucaggaaaagaaaucugaggugggucugaaauu

SEQ ID NO: 189246 - RNA, 64 nt, Homo Sapiens
cacuaguucaguuuuauuccucacaggaaauauaggaaaagaaauauucagcuaaaauaguacu

SEQ ID NO: 189247 - RNA, 64 nt, Homo Sapiens
uuacaagaaaacucccugugggugcaaugagucuggaaaagaccauugagucuucuagaagaaa

SEQ ID NO: 189248 - RNA, 64 nt, Homo Sapiens
aaguucuguucaucaaaugaugcuguuaagauagggaaaagacaagaaacaggacuggaagaag

SEQ ID NO: 189249 - RNA, 64 nt, Homo Sapiens
auagaaauaauauucacuucuagugaaaagugugggaaaagaauaggaaagugucuaugauaua

SEQ ID NO: 189250 - RNA, 64 nt, Homo Sapiens
gggggaaagucuaugaacgacucaaauuuguucuggaaaagaaagcccucuguuaauugugugu

SEQ ID NO: 189251 - RNA, 64 nt, Homo Sapiens
ucuguguuugguaaccccuauaaacuggggcagaggaaaagaaugaugguucaaggccauacuu

SEQ ID NO: 189252 - RNA, 64 nt, Homo Sapiens
gggaagguagauaacuuuuaggaccuugaugugaggaaaagauaaaauuuaaacaauaaauuug

SEQ ID NO: 189253 - RNA, 64 nt, Homo Sapiens
agaaaguuaaaaauguauaguaacugauugagggggaaaagaaugaucuuuauuaaugacaagg

SEQ ID NO: 189254 - RNA, 64 nt, Homo Sapiens
uuucucagucauccuggcagccaaaaaugugccaggaaaagaaagaauguggagcacgcguggc

SEQ ID NO: 189255 - RNA, 64 nt, Homo Sapiens
uagaacacgguuacagcugguucuguagaaagagggaaaagaugauugugacaauucagagcau

SEQ ID NO: 189256 - RNA, 64 nt, Homo Sapiens
uucacugugcaaagccccaguagucggauuccggggaaaagaacaaguaucuaguuuugaugac

SEQ ID NO: 189257 - RNA, 64 nt, Homo Sapiens
uuugaaauauauggucuaauguuuaagcagaauuggaaaagacuaagaucgguuaacaaauaac

SEQ ID NO: 189258 - RNA, 64 nt, Homo Sapiens
ccuuacaaaugauugcuuuuaaaauuuuaagcuaggaaaagaaaucuauagaaaguguucuguu

SEQ ID NO: 189259 - RNA, 64 nt, Homo Sapiens
cccaauauucucagacagcccaugggugauuuuugcuccucaggggcuucuggacacacauacc

SEQ ID NO: 189260 - RNA, 64 nt, Homo Sapiens
ccugagugcccaccuguccuaagagaugcagcaugcuccucacuggggaauugcaucugcagga

SEQ ID NO: 189261 - RNA, 64 nt, Homo Sapiens
gagagagagaaucagaccuggguggaacucuccugcuccucaggaacuaugggagccucagacu

SEQ ID NO: 189262 - RNA, 64 nt, Homo Sapiens
accauuguucagaagaccucccugugagagaguugcuccucagggucccucaggaccaaagaac

SEQ ID NO: 189263 - RNA, 56 nt, Homo Sapiens
uccggaccauucacugcuaagcacaggcuccucacucuucuccaucaggcauuaaa

SEQ ID NO: 189264 - RNA, 64 nt, Homo Sapiens
uguuugggcuccaaacuaaccaucucggagcugggcuccucauuuacugccaaacccucagcuu

SEQ ID NO: 189265 - RNA, 64 nt, Homo Sapiens
gcgagcaaagcugcacccacugccgcauucugcugcuccucacaucgauucugggaggagaggc

SEQ ID NO: 189266 - RNA, 64 nt, Homo Sapiens
uuuguggcucugacuggugugcccucucagccaggcuccucagcugaaggagggcagaccacac

SEQ ID NO: 189267 - RNA, 64 nt, Homo Sapiens
caccccggcgucucuggcccuuucuuauucuuuggcuccucauccaccgugaugagaagcgcug

SEQ ID NO: 189268 - RNA, 64 nt, Homo Sapiens
ugaaaaagggaugggggaaauggagauggcacgggcuccucagagcgugguagccgacugugag

SEQ ID NO: 189269 - RNA, 64 nt, Homo Sapiens
acgcauccacagcaguggcacccgcggcucaggggcuccucacagcccgggcuggugggagcca

SEQ ID NO: 189270 - RNA, 64 nt, Homo Sapiens
gggaggaacuuggucugggaggaagagagaacucgcuccucaaccaccccagacacuggagugu

SEQ ID NO: 189271 - RNA, 64 nt, Homo Sapiens
ugcugaguuuccagccuuuuguaugauguuggaugcuccucacaccugccgauagcuauccccu

SEQ ID NO: 189272 - RNA, 64 nt, Homo Sapiens
uaagaggugcagagaugaggccuucccuccucuugcuccucaaguauuccuacaucccuuucuc

SEQ ID NO: 189273 - RNA, 64 nt, Homo Sapiens
cccucuguucucuccccucacauccuccugcccagcuccucacauacccacacauuccagggcu

SEQ ID NO: 189274 - RNA, 64 nt, Homo Sapiens
ccccaggaucuggguuagguggccgcuccucccugcuccucaugggaagaugucucagagccuu

SEQ ID NO: 189275 - RNA, 64 nt, Homo Sapiens
gcuacaagguagggaguucugagggaagccgcgugcuccucaggagagagcuguuuagguuuuc

SEQ ID NO: 189276 - RNA, 64 nt, Homo Sapiens
gccuagcuccugcugagacccagguccuauggcagcuccucauuagauuaaaggagaccacuuc

SEQ ID NO: 189277 - RNA, 64 nt, Homo Sapiens
uucggagagggcgccccgccgcgcagagaccagagcuccucagugccaguuuggccccuggguc

SEQ ID NO: 189278 - RNA, 64 nt, Homo Sapiens
cuuaugcaaguuggggccaggauaggggaggggugcuccucaagaggaagaaaccgagaggccc

SEQ ID NO: 189279 - RNA, 64 nt, Homo Sapiens
acaaagauucuccacuuggccaaacuuuagccaagcuccucaaccuucucccaggcccaaucug

SEQ ID NO: 189280 - RNA, 64 nt, Homo Sapiens
cccccauaucuguucaaccucaguaucugaucaggcuccucagccuccaccaucccccagguga

SEQ ID NO: 189281 - RNA, 64 nt, Homo Sapiens
uguguguucaugugugcccuguaugaauguggcuggcucccauauccccugggcugcccccugc

SEQ ID NO: 189282 - RNA, 64 nt, Homo Sapiens
agggggcacgugcacuggucacgagaaaacccugggcucccacuggggcucagcccagccuccu

SEQ ID NO: 189283 - RNA, 64 nt, Homo Sapiens
cugggaggugaggaagaagcuggcuagaggagggggcucccaccuaccuuuuauuuaagccagu

SEQ ID NO: 189284 - RNA, 64 nt, Homo Sapiens
aggagacaaagccuaaguuuggggauuggaguggggcucccagucugaaagaucuaggaggaac

SEQ ID NO: 189285 - RNA, 64 nt, Homo Sapiens
ccuucaguguugaccuaaguccucgccgggccauggcucccagccaagaaauaaguacacacua

SEQ ID NO: 189286 - RNA, 64 nt, Homo Sapiens
accgaggcccucccaaagaggcccgcccugcccgggcucccacaccgucagguacuccugccag

SEQ ID NO: 189287 - RNA, 64 nt, Homo Sapiens
ggccagcgccccucagccucugccacugugaaccggcucccacccucaaggugcggggagaaga

SEQ ID NO: 189288 - RNA, 64 nt, Homo Sapiens
cacccagagcuuuccuccgcuaggagcuccuucuggcucccaagcucacuucccauacccaguc

SEQ ID NO: 189289 - RNA, 64 nt, Homo Sapiens
ccucccucacuucccauaccucagccccacaggaggcucccaggugauggaguuccuucuggug

SEQ ID NO: 189290 - RNA, 64 nt, Homo Sapiens
ucauuuccucucucucucuuuggcaggugggauuggcucccagggcccuuucuccccugcagac

SEQ ID NO: 189291 - RNA, 64 nt, Homo Sapiens
gggaacagugcuggcuguggggggagaggccauuggcucccagaaagacaaggugaugagagau

SEQ ID NO: 189292 - RNA, 64 nt, Homo Sapiens
accccugaacaauggaggccuuucuuucccgcuaggcucccagccuccuucccgcuacagaauc

SEQ ID NO: 189293 - RNA, 64 nt, Homo Sapiens
cgcacaagccugcaacccccagagcucuuugacaggcucccaggccucccaguccuggacaagc

SEQ ID NO: 189294 - RNA, 64 nt, Homo Sapiens
cucuggccuggcugccuggccguggcuucucuuuggcucccaaagagaaggacaguguugggag

SEQ ID NO: 189295 - RNA, 64 nt, Homo Sapiens
acaguguugggaguaucugccguggcuucucuuuggcucccaaagagaaggacaguguugggag

SEQ ID NO: 189296 - RNA, 64 nt, Homo Sapiens
cuaagggagacaggccuuucggccgugggacccaggcucccagcacacacggaggccagacaca

SEQ ID NO: 189297 - RNA, 64 nt, Homo Sapiens
ggucuucacugcccagggguguggaauccaguguggcucccacaagucuguucucaaagcagaa

SEQ ID NO: 189298 - RNA, 64 nt, Homo Sapiens
ggaagugaagcccgcuguguucauagcaggagagggcucccagacacaggcccguccucggaag

SEQ ID NO: 189299 - RNA, 64 nt, Homo Sapiens
uuccgugagccacaaauaccagaaacugaggcgaggcucccagcagccgguagggaaagguguu

SEQ ID NO: 189300 - RNA, 64 nt, Homo Sapiens
uugauuggauaaaugcuuauaggcugggccagguggcucccaccuguagucccagcacuuuggg

SEQ ID NO: 189301 - RNA, 64 nt, Homo Sapiens
uugauacaaaugggaauucacucacuggaaucguggcucccaaaaagaugcuuuaauugugugg

SEQ ID NO: 189302 - RNA, 64 nt, Homo Sapiens
ucugucaccuagccaggagggaaaacacccacucggcucccauccagcuccaaagcgaaucuuu

SEQ ID NO: 189303 - RNA, 64 nt, Homo Sapiens
uuggccccuggaggugagcugcggcggggcucauggcucccaucaccuggcuggaguggccgga

SEQ ID NO: 189304 - RNA, 64 nt, Homo Sapiens
uguaccccaucccccauacuacuccccaaacccaggcucccauagaccucacuguacagagcug

SEQ ID NO: 189305 - RNA, 64 nt, Homo Sapiens
aggaccugaugaccucacuguuguccccagugaaggcucccacaccugaaauggggcuucugug

SEQ ID NO: 189306 - RNA, 64 nt, Homo Sapiens
gucugcccagcccucucccacccagugucugcccggcucccaguaagcaagagccagcccggcu

SEQ ID NO: 189307 - RNA, 64 nt, Homo Sapiens
gucugcccggcucccagugugcaagagccagcccggcucccagucccagggcucugggccugaa

SEQ ID NO: 189308 - RNA, 64 nt, Homo Sapiens
guccugggggcugcugcacuugagguccuguccuggcucccaggugagguugugcugccugugg

SEQ ID NO: 189309 - RNA, 64 nt, Homo Sapiens
gccccugcaccugcuucucaccucccugcugccaggcucccacugucccgggugccccccaugc

SEQ ID NO: 189310 - RNA, 64 nt, Homo Sapiens
gccuucuaaggagccaaggacgaacgcuucccugggcucccacucaauuaggcugcacuggggc

SEQ ID NO: 189311 - RNA, 64 nt, Homo Sapiens
augccccccaguggcugcaggagcuggagggccuggcucccaccggaggaaggcgcgccgcccc

SEQ ID NO: 189312 - RNA, 64 nt, Homo Sapiens
agggucagcccaugcaccuggcaguguuccuggaggcucccauccucgguggugccuucucaag

SEQ ID NO: 189313 - RNA, 64 nt, Homo Sapiens
gagggugcgccugccgccaggacacgugagcacuggcucccacgacagccgccucugacgcauu

SEQ ID NO: 189314 - RNA, 64 nt, Homo Sapiens
ccucugccacugacugcagggacacgggcagccuggcucccaggacacgacuuguaaugaaagu

SEQ ID NO: 189315 - RNA, 64 nt, Homo Sapiens
gggcacccucccacccggcugcauacccgggcagggcucccacagagacaaggagggcacaggu

SEQ ID NO: 189316 - RNA, 64 nt, Homo Sapiens
gucacccauguugagccgcuccugauggcugacgggcucccagacccucaccucggacauggug

SEQ ID NO: 189317 - RNA, 64 nt, Homo Sapiens
cucccugggcaggguggaugccacaggccccucuggcucccaggugcugcuucuccacaggugc

SEQ ID NO: 189318 - RNA, 64 nt, Homo Sapiens
cgugggccaccuucccugcaaugggugcacacgcggcucccauccagcccucucagcguggggc

SEQ ID NO: 189319 - RNA, 64 nt, Homo Sapiens
uagaggaugcucuuggccggcuggagcaagaccuggcucccaccagagggacgugugugugccu

SEQ ID NO: 189320 - RNA, 50 nt, Homo Sapiens
aggaggaggccggcuacugaggcucccagcacgcucucuccccacaucgu

SEQ ID NO: 189321 - RNA, 64 nt, Homo Sapiens
gaaaggggaccgggccgugauguuaaauaucuccggcucccaagugacuggauuugccuaggac

SEQ ID NO: 189322 - RNA, 64 nt, Homo Sapiens
agaaaugaacacagagauaucaucuugcauacagggcucccaauaggggaaauguggcucucuc

SEQ ID NO: 189323 - RNA, 64 nt, Homo Sapiens
ccucuuaaccguccuugcucccccaucaugauaaggcucccaccaaagaugucagaacaagacu

SEQ ID NO: 189324 - RNA, 62 nt, Homo Sapiens
gcuacaagugacgacaaagauucuguuucaaauauagccacagaaauaaaggagggaccaau

SEQ ID NO: 189325 - RNA, 62 nt, Homo Sapiens
gcuacaagugacgagaaagauucuguuucaaauauagccacagaaauaaagaagggacaaca

SEQ ID NO: 189326 - RNA, 62 nt, Homo Sapiens
gcuacaacugacgaggaagacucuguuucgaauauagccacagaaauaaaggauggagaaaa

SEQ ID NO: 189327 - RNA, 62 nt, Homo Sapiens
gcuacaagugacgaggaagguucuguuuugaguauagccagagaaaacaaggauggagaaaa

SEQ ID NO: 189328 - RNA, 62 nt, Homo Sapiens
gguacaagugacgaggaagauucuguuuuggguauagccagagaaaacaaggauggagaaaa

SEQ ID NO: 189329 - RNA, 62 nt, Homo Sapiens
gcuacaagugaugagaaagauucuguuuugaauauagccagaggaaaaaaggauggagaaaa

SEQ ID NO: 189330 - RNA, 62 nt, Homo Sapiens
uuaaaagucacugugcauuuccaguguuaagcuauagccauggaacguauuguuguauuccu

SEQ ID NO: 189331 - RNA, 62 nt, Homo Sapiens
guccuacuaacuacucaguacccaacgcauguuauagccaggcggagaguucacgaacugug

SEQ ID NO: 189332 - RNA, 62 nt, Homo Sapiens
uugcuaaugaaaauacaauacauauaaaaauguauagccauguuauuuucuaguauaaauuc

SEQ ID NO: 189333 - RNA, 62 nt, Homo Sapiens
uguuuguuguaaaugguuucaaaaauacaaauuauagccaaucaaaacauugcuuugguugg

SEQ ID NO: 189334 - RNA, 62 nt, Homo Sapiens
uauuuuuucaaguaauaccaguacuguuuaacuauagccagaacuggcuaaaauuuuuauau

SEQ ID NO: 189335 - RNA, 62 nt, Homo Sapiens
aaugcacagauaaauagaaguacagugaggucuauagccauuuuauuaaaauagcuuaaaag

SEQ ID NO: 189336 - RNA, 64 nt, Homo Sapiens
gagaggcaaaaauucuaaaguagcccacuggaguugcaaggaauagaaaacuggaucaagauuc

SEQ ID NO: 189337 - RNA, 64 nt, Homo Sapiens
uuucuuuuaaauucugaacugaagacauucuuucugcaaggaaaaaauuaagaggggccaagag

SEQ ID NO: 189338 - RNA, 64 nt, Homo Sapiens
gaaaauaacugugccccaagaagugcuccagauuugcaaggaauagccccaagagaauaccaag

SEQ ID NO: 189339 - RNA, 64 nt, Homo Sapiens
aagacaagcaggcuguucccuggaaaaaaucuaaugcaaggagggcuaguucacagcaaauuca

SEQ ID NO: 189340 - RNA, 64 nt, Homo Sapiens
cccagguuccccucuggugucaugucaggcauuuugcaaggaaaagccacuuggggaaagaugg

SEQ ID NO: 189341 - RNA, 63 nt, Homo Sapiens
auuuccauuggcccucgggugagcugaggguuuuugcaaggaaguugugguggccaagugugg

SEQ ID NO: 189342 - RNA, 64 nt, Homo Sapiens
uaauuuuuaaguugaaucccucaaacuuugaaagugcaaggauugacucauuuugaauugaguu

SEQ ID NO: 189343 - RNA, 64 nt, Homo Sapiens
uccugccuucagacugaagauagagcugcucugcugcaaggauucuuuuauuuuugugaaauuc

SEQ ID NO: 189344 - RNA, 64 nt, Homo Sapiens
cuuuccgcccucccuuggauuaagcugacugaguugcaaggaccaaauaagcaauaagaggcuc

SEQ ID NO: 189345 - RNA, 64 nt, Homo Sapiens
ucuguuccaaaggcugggaaucugcuggugcuggugcaaggacuagucugcuuuucagggauuc

SEQ ID NO: 189346 - RNA, 64 nt, Homo Sapiens
ugaagcaggguggggcguaaccucaccugggaagugcaaggagucggggaucucccuccccuag

SEQ ID NO: 189347 - RNA, 64 nt, Homo Sapiens
cuccucugagcuaaaggagcauguucuaacccaaugcaaggaagcuaagaaccuugaaaaaagg

SEQ ID NO: 189348 - RNA, 64 nt, Homo Sapiens
uaaugagaagcccaggaaaucuguuuggggaagaugcaaggaaguuaccucauagaugugggcu

SEQ ID NO: 189349 - RNA, 64 nt, Homo Sapiens
cuguagcauggcaaaucugcggccuuccccagccugcaaggagcuccagcccaaugccccagcu

SEQ ID NO: 189350 - RNA, 64 nt, Homo Sapiens; identical to SEQ ID NO: 154084

SEQ ID NO: 189351 - RNA, 64 nt, Homo Sapiens; identical to SEQ ID NO: 154085

SEQ ID NO: 189352 - RNA, 64 nt, Homo Sapiens; identical to SEQ ID NO: 154086

SEQ ID NO: 189353 - RNA, 64 nt, Homo Sapiens; identical to SEQ ID NO: 154087

SEQ ID NO: 189354 - RNA, 64 nt, Homo Sapiens; identical to SEQ ID NO: 154088

SEQ ID NO: 189355 - RNA, 64 nt, Homo Sapiens; identical to SEQ ID NO: 154089

SEQ ID NO: 189356 - RNA, 64 nt, Homo Sapiens; identical to SEQ ID NO: 154090

SEQ ID NO: 189357 - RNA, 64 nt, Homo Sapiens; identical to SEQ ID NO: 154091

SEQ ID NO: 189358 - RNA, 64 nt, Homo Sapiens; identical to SEQ ID NO: 154092

SEQ ID NO: 189359 - RNA, 64 nt, Homo Sapiens; identical to SEQ ID NO: 154093

SEQ ID NO: 189360 - RNA, 64 nt, Homo Sapiens; identical to SEQ ID NO: 154094

SEQ ID NO: 189361 - RNA, 64 nt, Homo Sapiens; identical to SEQ ID NO: 154095

SEQ ID NO: 189362 - RNA, 64 nt, Homo Sapiens; identical to SEQ ID NO: 154096

SEQ ID NO: 189363 - RNA, 64 nt, Homo Sapiens; identical to SEQ ID NO: 154097

SEQ ID NO: 189364 - RNA, 64 nt, Homo Sapiens; identical to SEQ ID NO: 154098

SEQ ID NO: 189365 - RNA, 64 nt, Homo Sapiens; identical to SEQ ID NO: 154099

SEQ ID NO: 189366 - RNA, 64 nt, Homo Sapiens; identical to SEQ ID NO: 154100

SEQ ID NO: 189367 - RNA, 64 nt, Homo Sapiens; identical to SEQ ID NO: 154101

SEQ ID NO: 189368 - RNA, 64 nt, Homo Sapiens; identical to SEQ ID NO: 154102

SEQ ID NO: 189369 - RNA, 64 nt, Homo Sapiens; identical to SEQ ID NO: 154103

SEQ ID NO: 189370 - RNA, 64 nt, Homo Sapiens; identical to SEQ ID NO: 154104

SEQ ID NO: 189371 - RNA, 64 nt, Homo Sapiens; identical to SEQ ID NO: 154105

SEQ ID NO: 189372 - RNA, 64 nt, Homo Sapiens; identical to SEQ ID NO: 154106

SEQ ID NO: 189373 - RNA, 64 nt, Homo Sapiens; identical to SEQ ID NO: 154107

SEQ ID NO: 189374 - RNA, 51 nt, Homo Sapiens; identical to SEQ ID NO: 154108

SEQ ID NO: 189375 - RNA, 64 nt, Homo Sapiens; identical to SEQ ID NO: 154109

SEQ ID NO: 189376 - RNA, 64 nt, Homo Sapiens; identical to SEQ ID NO: 154110

SEQ ID NO: 189377 - RNA, 64 nt, Homo Sapiens; identical to SEQ ID NO: 154111

SEQ ID NO: 189378 - RNA, 64 nt, Homo Sapiens; identical to SEQ ID NO: 154112

SEQ ID NO: 189379 - RNA, 64 nt, Homo Sapiens; identical to SEQ ID NO: 154113

SEQ ID NO: 189380 - RNA, 64 nt, Homo Sapiens; identical to SEQ ID NO: 154114

SEQ ID NO: 189381 - RNA, 64 nt, Homo Sapiens; identical to SEQ ID NO: 154115

SEQ ID NO: 189382 - RNA, 64 nt, Homo Sapiens; identical to SEQ ID NO: 154116

SEQ ID NO: 189383 - RNA, 64 nt, Homo Sapiens; identical to SEQ ID NO: 154117

SEQ ID NO: 189384 - RNA, 64 nt, Homo Sapiens; identical to SEQ ID NO: 154118

SEQ ID NO: 189385 - RNA, 64 nt, Homo Sapiens; identical to SEQ ID NO: 154118

SEQ ID NO: 189386 - RNA, 64 nt, Homo Sapiens; identical to SEQ ID NO: 154120

SEQ ID NO: 189387 - RNA, 64 nt, Homo Sapiens; identical to SEQ ID NO: 154121

SEQ ID NO: 189388 - RNA, 64 nt, Homo Sapiens; identical to SEQ ID NO: 154122

SEQ ID NO: 189389 - RNA, 64 nt, Homo Sapiens; identical to SEQ ID NO: 154123

SEQ ID NO: 189390 - RNA, 64 nt, Homo Sapiens; identical to SEQ ID NO: 154124

SEQ ID NO: 189391 - RNA, 64 nt, Homo Sapiens; identical to SEQ ID NO: 154125

SEQ ID NO: 189392 - RNA, 64 nt, Homo Sapiens; identical to SEQ ID NO: 154126

SEQ ID NO: 189393 - RNA, 64 nt, Homo Sapiens; identical to SEQ ID NO: 154127

SEQ ID NO: 189394 - RNA, 64 nt, Homo Sapiens; identical to SEQ ID NO: 154128

SEQ ID NO: 189395 - RNA, 64 nt, Homo Sapiens; identical to SEQ ID NO: 154129

SEQ ID NO: 189396 - RNA, 64 nt, Homo Sapiens; identical to SEQ ID NO: 154130

SEQ ID NO: 189397 - RNA, 64 nt, Homo Sapiens; identical to SEQ ID NO: 154131

SEQ ID NO: 189398 - RNA, 64 nt, Homo Sapiens; identical to SEQ ID NO: 154132

SEQ ID NO: 189399 - RNA, 64 nt, Homo Sapiens; identical to SEQ ID NO: 154133

SEQ ID NO: 189400 - RNA, 64 nt, Homo Sapiens; identical to SEQ ID NO: 154134

SEQ ID NO: 189401 - RNA, 57 nt, Homo Sapiens; identical to SEQ ID NO: 154135

SEQ ID NO: 189402 - RNA, 64 nt, Homo Sapiens; identical to SEQ ID NO: 154136

SEQ ID NO: 189403 - RNA, 64 nt, Homo Sapiens; identical to SEQ ID NO: 154137

SEQ ID NO: 189404 - RNA, 64 nt, Homo Sapiens; identical to SEQ ID NO: 154138

SEQ ID NO: 189405 - RNA, 64 nt, Homo Sapiens; identical to SEQ ID NO: 154139

SEQ ID NO: 189406 - RNA, 64 nt, Homo Sapiens; identical to SEQ ID NO: 154140

SEQ ID NO: 189407 - RNA, 64 nt, Homo Sapiens; identical to SEQ ID NO: 154141

SEQ ID NO: 189408 - RNA, 64 nt, Homo Sapiens; identical to SEQ ID NO: 154142

SEQ ID NO: 189409 - RNA, 64 nt, Homo Sapiens; identical to SEQ ID NO: 154143

SEQ ID NO: 189410 - RNA, 64 nt, Homo Sapiens; identical to SEQ ID NO: 154144

SEQ ID NO: 189411 - RNA, 64 nt, Homo Sapiens; identical to SEQ ID NO: 154145

SEQ ID NO: 189412 - RNA, 64 nt, Homo Sapiens; identical to SEQ ID NO: 154146

SEQ ID NO: 189413 - RNA, 64 nt, Homo Sapiens; identical to SEQ ID NO: 154147

SEQ ID NO: 189414 - RNA, 64 nt, Homo Sapiens; identical to SEQ ID NO: 154148

SEQ ID NO: 189415 - RNA, 64 nt, Homo Sapiens; identical to SEQ ID NO: 154149

SEQ ID NO: 189416 - RNA, 64 nt, Homo Sapiens; identical to SEQ ID NO: 154150

SEQ ID NO: 189417 - RNA, 64 nt, Homo Sapiens; identical to SEQ ID NO: 154151

SEQ ID NO: 189418 - RNA, 64 nt, Homo Sapiens; identical to SEQ ID NO: 154152

SEQ ID NO: 189419 - RNA, 64 nt, Homo Sapiens; identical to SEQ ID NO: 154153

SEQ ID NO: 189420 - RNA, 64 nt, Homo Sapiens; identical to SEQ ID NO: 154154

SEQ ID NO: 189421 - RNA, 64 nt, Homo Sapiens; identical to SEQ ID NO: 154155

SEQ ID NO: 189422 - RNA, 64 nt, Homo Sapiens; identical to SEQ ID NO: 154156

SEQ ID NO: 189423 - RNA, 64 nt, Homo Sapiens; identical to SEQ ID NO: 154157

SEQ ID NO: 189424 - RNA, 64 nt, Homo Sapiens; identical to SEQ ID NO: 154158

SEQ ID NO: 189425 - RNA, 64 nt, Homo Sapiens; identical to SEQ ID NO: 154159

SEQ ID NO: 189426 - RNA, 64 nt, Homo Sapiens; identical to SEQ ID NO: 154160

SEQ ID NO: 189427 - RNA, 64 nt, Homo Sapiens; identical to SEQ ID NO: 154161

SEQ ID NO: 189428 - RNA, 64 nt, Homo Sapiens; identical to SEQ ID NO: 154162

SEQ ID NO: 189429 - RNA, 64 nt, Homo Sapiens; identical to SEQ ID NO: 154163

SEQ ID NO: 189430 - RNA, 64 nt, Homo Sapiens; identical to SEQ ID NO: 154164

SEQ ID NO: 189431 - RNA, 63 nt, Homo Sapiens; identical to SEQ ID NO: 154165

SEQ ID NO: 189432 - RNA, 64 nt, Homo Sapiens; identical to SEQ ID NO: 154166

SEQ ID NO: 189433 - RNA, 50 nt, Homo Sapiens; identical to SEQ ID NO: 154167

SEQ ID NO: 189434 - RNA, 64 nt, Homo Sapiens; identical to SEQ ID NO: 154168

SEQ ID NO: 189435 - RNA, 64 nt, Homo Sapiens; identical to SEQ ID NO: 154169

SEQ ID NO: 189436 - RNA, 64 nt, Homo Sapiens; identical to SEQ ID NO: 154170

SEQ ID NO: 189437 - RNA, 64 nt, Homo Sapiens; identical to SEQ ID NO: 154171

SEQ ID NO: 189438 - RNA, 64 nt, Homo Sapiens; identical to SEQ ID NO: 154172

SEQ ID NO: 189439 - RNA, 64 nt, Homo Sapiens; identical to SEQ ID NO: 154173

SEQ ID NO: 189440 - RNA, 64 nt, Homo Sapiens; identical to SEQ ID NO: 154174

SEQ ID NO: 189441 - RNA, 64 nt, Homo Sapiens; identical to SEQ ID NO: 154175

SEQ ID NO: 189442 - RNA, 64 nt, Homo Sapiens; identical to SEQ ID NO: 154176

SEQ ID NO: 189443 - RNA, 64 nt, Homo Sapiens; identical to SEQ ID NO: 154177

SEQ ID NO: 189444 - RNA, 64 nt, Homo Sapiens; identical to SEQ ID NO: 154178

SEQ ID NO: 189445 - RNA, 64 nt, Homo Sapiens; identical to SEQ ID NO: 154179

SEQ ID NO: 189446 - RNA, 64 nt, Homo Sapiens; identical to SEQ ID NO: 154180

SEQ ID NO: 189447 - RNA, 64 nt, Homo Sapiens; identical to SEQ ID NO: 154181

SEQ ID NO: 189448 - RNA, 64 nt, Homo Sapiens; identical to SEQ ID NO: 154182

SEQ ID NO: 189449 - RNA, 64 nt, Homo Sapiens; identical to SEQ ID NO: 154183

SEQ ID NO: 189450 - RNA, 64 nt, Homo Sapiens; identical to SEQ ID NO: 154184

SEQ ID NO: 189451 - RNA, 64 nt, Homo Sapiens; identical to SEQ ID NO: 154185

SEQ ID NO: 189452 - RNA, 64 nt, Homo Sapiens; identical to SEQ ID NO: 154186

SEQ ID NO: 189453 - RNA, 64 nt, Homo Sapiens; identical to SEQ ID NO: 154187

SEQ ID NO: 189454 - RNA, 64 nt, Homo Sapiens; identical to SEQ ID NO: 154188

SEQ ID NO: 189455 - RNA, 64 nt, Homo Sapiens; identical to SEQ ID NO: 154189

SEQ ID NO: 189456 - RNA, 64 nt, Homo Sapiens; identical to SEQ ID NO: 154190

SEQ ID NO: 189457 - RNA, 64 nt, Homo Sapiens; identical to SEQ ID NO: 154191

SEQ ID NO: 189458 - RNA, 64 nt, Homo Sapiens; identical to SEQ ID NO: 154192

SEQ ID NO: 189459 - RNA, 64 nt, Homo Sapiens; identical to SEQ ID NO: 154193

SEQ ID NO: 189460 - RNA, 64 nt, Homo Sapiens; identical to SEQ ID NO: 154194

SEQ ID NO: 189461 - RNA, 64 nt, Homo Sapiens; identical to SEQ ID NO: 154195

SEQ ID NO: 189462 - RNA, 64 nt, Homo Sapiens; identical to SEQ ID NO: 154196

SEQ ID NO: 189463 - RNA, 64 nt, Homo Sapiens; identical to SEQ ID NO: 154197

SEQ ID NO: 189464 - RNA, 64 nt, Homo Sapiens; identical to SEQ ID NO: 154198

SEQ ID NO: 189465 - RNA, 64 nt, Homo Sapiens; identical to SEQ ID NO: 154199

SEQ ID NO: 189466 - RNA, 64 nt, Homo Sapiens; identical to SEQ ID NO: 154200

SEQ ID NO: 189467 - RNA, 64 nt, Homo Sapiens; identical to SEQ ID NO: 154201

SEQ ID NO: 189468 - RNA, 64 nt, Homo Sapiens; identical to SEQ ID NO: 154202

SEQ ID NO: 189469 - RNA, 64 nt, Homo Sapiens; identical to SEQ ID NO: 154203

SEQ ID NO: 189470 - RNA, 64 nt, Homo Sapiens; identical to SEQ ID NO: 154204

SEQ ID NO: 189471 - RNA, 64 nt, Homo Sapiens; identical to SEQ ID NO: 154205

SEQ ID NO: 189472 - RNA, 64 nt, Homo Sapiens; identical to SEQ ID NO: 154206

SEQ ID NO: 189473 - RNA, 64 nt, Homo Sapiens; identical to SEQ ID NO: 154207

SEQ ID NO: 189474 - RNA, 59 nt, Homo Sapiens; identical to SEQ ID NO: 154208

SEQ ID NO: 189475 - RNA, 64 nt, Homo Sapiens; identical to SEQ ID NO: 154209

SEQ ID NO: 189476 - RNA, 64 nt, Homo Sapiens; identical to SEQ ID NO: 154210

SEQ ID NO: 189477 - RNA, 64 nt, Homo Sapiens; identical to SEQ ID NO: 154211

SEQ ID NO: 189478 - RNA, 64 nt, Homo Sapiens; identical to SEQ ID NO: 154212

SEQ ID NO: 189479 - RNA, 64 nt, Homo Sapiens; identical to SEQ ID NO: 154213

SEQ ID NO: 189480 - RNA, 64 nt, Homo Sapiens; identical to SEQ ID NO: 154214

SEQ ID NO: 189481 - RNA, 64 nt, Homo Sapiens; identical to SEQ ID NO: 154215

SEQ ID NO: 189482 - RNA, 64 nt, Homo Sapiens; identical to SEQ ID NO: 154216

SEQ ID NO: 189483 - RNA, 64 nt, Homo Sapiens; identical to SEQ ID NO: 154217

SEQ ID NO: 189484 - RNA, 64 nt, Homo Sapiens; identical to SEQ ID NO: 154218

SEQ ID NO: 189485 - RNA, 64 nt, Homo Sapiens; identical to SEQ ID NO: 154219

SEQ ID NO: 189486 - RNA, 64 nt, Homo Sapiens; identical to SEQ ID NO: 154220

SEQ ID NO: 189487 - RNA, 61 nt, Homo Sapiens; identical to SEQ ID NO: 154221

SEQ ID NO: 189488 - RNA, 64 nt, Homo Sapiens; identical to SEQ ID NO: 154222

SEQ ID NO: 189489 - RNA, 64 nt, Homo Sapiens; identical to SEQ ID NO: 154223

SEQ ID NO: 189490 - RNA, 64 nt, Homo Sapiens; identical to SEQ ID NO: 154224

SEQ ID NO: 189491 - RNA, 64 nt, Homo Sapiens; identical to SEQ ID NO: 154225

SEQ ID NO: 189492 - RNA, 64 nt, Homo Sapiens; identical to SEQ ID NO: 154226

SEQ ID NO: 189493 - RNA, 64 nt, Homo Sapiens; identical to SEQ ID NO: 154227

SEQ ID NO: 189494 - RNA, 64 nt, Homo Sapiens; identical to SEQ ID NO: 154228

SEQ ID NO: 189495 - RNA, 64 nt, Homo Sapiens; identical to SEQ ID NO: 154229

SEQ ID NO: 189496 - RNA, 64 nt, Homo Sapiens; identical to SEQ ID NO: 154230

SEQ ID NO: 189497 - RNA, 64 nt, Homo Sapiens; identical to SEQ ID NO: 154231

SEQ ID NO: 189498 - RNA, 64 nt, Homo Sapiens; identical to SEQ ID NO: 154232

SEQ ID NO: 189499 - RNA, 64 nt, Homo Sapiens; identical to SEQ ID NO: 154233

SEQ ID NO: 189500 - RNA, 64 nt, Homo Sapiens; identical to SEQ ID NO: 154234

SEQ ID NO: 189501 - RNA, 64 nt, Homo Sapiens; identical to SEQ ID NO: 154235

SEQ ID NO: 189502 - RNA, 64 nt, Homo Sapiens; identical to SEQ ID NO: 154236

SEQ ID NO: 189503 - RNA, 64 nt, Homo Sapiens; identical to SEQ ID NO: 154237

SEQ ID NO: 189504 - RNA, 62 nt, Homo Sapiens; identical to SEQ ID NO: 154238

SEQ ID NO: 189505 - RNA, 64 nt, Homo Sapiens; identical to SEQ ID NO: 154239

SEQ ID NO: 189506 - RNA, 62 nt, Homo Sapiens; identical to SEQ ID NO: 154240

SEQ ID NO: 189507 - RNA, 64 nt, Homo Sapiens; identical to SEQ ID NO: 154241

SEQ ID NO: 189508 - RNA, 64 nt, Homo Sapiens; identical to SEQ ID NO: 154242

SEQ ID NO: 189509 - RNA, 64 nt, Homo Sapiens; identical to SEQ ID NO: 154243

SEQ ID NO: 189510 - RNA, 64 nt, Homo Sapiens; identical to SEQ ID NO: 154244

SEQ ID NO: 189511 - RNA, 64 nt, Homo Sapiens; identical to SEQ ID NO: 154245

SEQ ID NO: 189512 - RNA, 64 nt, Homo Sapiens; identical to SEQ ID NO: 154246

SEQ ID NO: 189513 - RNA, 64 nt, Homo Sapiens; identical to SEQ ID NO: 154247

SEQ ID NO: 189514 - RNA, 64 nt, Homo Sapiens; identical to SEQ ID NO: 154248

SEQ ID NO: 189515 - RNA, 64 nt, Homo Sapiens; identical to SEQ ID NO: 154249

SEQ ID NO: 189516 - RNA, 64 nt, Homo Sapiens
gccaggcaggcagcuugagggaaagacaucacauggcauccaggcagcagugccuucccuuuau

SEQ ID NO: 189517 - RNA, 64 nt, Homo Sapiens
auguugcuuaauugucuucuaaaucuccccagaaggcauccauccuuagggcccuuaaagaaga

SEQ ID NO: 189518 - RNA, 64 nt, Homo Sapiens
ucugugcucucaccagacaauaugcuaacgcugguccucuuagcccucuuaagggacucuaaua

SEQ ID NO: 189519 - RNA, 64 nt, Homo Sapiens
ugacugcuuauuuauguguaaaacuccauguuaguccucuuagauuucuuuuucauuuugugaa

SEQ ID NO: 189520 - RNA, 64 nt, Homo Sapiens
uccucuauguaggaaguugucaaaagggguuuguuccucuuauugaguuuuaauagauucuguc

SEQ ID NO: 189521 - RNA, 64 nt, Homo Sapiens
aagauuuuuuuauuuuaugucugauuauugagcuuccucuuaaaccuuaaaugcaauacagccu

SEQ ID NO: 189522 - RNA, 64 nt, Homo Sapiens
gauaaauuguaucauauuuaaguuccacugcuguuccucuuaccuugauuaaaugccuaugcau

SEQ ID NO: 189523 - RNA, 64 nt, Homo Sapiens
cauuucuuuaucaaggaugguauuuagauuuuuuuccucuuaaccuuuuuucaaaaacuauuuu

SEQ ID NO: 189524 - RNA, 64 nt, Homo Sapiens
aauuaaaaaaaaaauaauauaauaauaauucuuguccucuuauuuuacacucauaaugagaaau

SEQ ID NO: 189525 - RNA, 64 nt, Homo Sapiens
agggccacauguagacagcuaggccagugcuuuuuccucuuaggguuucuuugcagaaagaaac

SEQ ID NO: 189526 - RNA, 64 nt, Homo Sapiens
gucucaaaauaaaaccagaaccauaaugcuucuuuccucuuaaugaaaaagcccucuucaaucc

SEQ ID NO: 189527 - RNA, 64 nt, Homo Sapiens
ugugccccuuccccaugcucagugcauucauucauccucuuauacugacaccuuuucagguugg

SEQ ID NO: 189528 - RNA, 64 nt, Homo Sapiens
gaauuauuacaugagacuggcagauagcuauuaauccucuuacagauuugagaaaguugauucu

SEQ ID NO: 189529 - RNA, 64 nt, Homo Sapiens
ugcaccuucuccuucauuguuuucuuuaaaucuguccucuuaaaaagcuucuuaagagcucagu

SEQ ID NO: 189530 - RNA, 64 nt, Homo Sapiens
guaacaaauagacagcaagaaagguuuugcaccauccucuuacggccuagagaguugacaaguu

SEQ ID NO: 189531 - RNA, 64 nt, Homo Sapiens
aggaggcccccgagcuggcuguucuaacuuagaaggaagagaagacuggaugggccugcuuggg

SEQ ID NO: 189532 - RNA, 64 nt, Homo Sapiens
gaguaacuauuuccuaaaguauucuaaaagaguaggaagagagaaaugguagccugcugcuucu

SEQ ID NO: 189533 - RNA, 64 nt, Homo Sapiens
ucgaaggacucauuacaacaaacagggaaguaaaggaagagacacauccucucauacucccuga

SEQ ID NO: 189534 - RNA, 64 nt, Homo Sapiens
acucccugagacucugagaacaguggacgcagagggaagagaugaucauuggaagcaaucaguu

SEQ ID NO: 189535 - RNA, 64 nt, Homo Sapiens
caugucugaguuggaugggacucagugugguagaggaagagaaguacccaaagcccugccaauu

SEQ ID NO: 189536 - RNA, 64 nt, Homo Sapiens
gcuggcugcccaagggaaugggauaugaggggauggaagagaggagagguaaugcaccccugaa

SEQ ID NO: 189537 - RNA, 64 nt, Homo Sapiens
agugacugagcugagaaguauuucggaauuguggggaagagaaguuuaaagaacuucaacauag

SEQ ID NO: 189538 - RNA, 64 nt, Homo Sapiens
gaaguaacccaaaguacuacuuggaagagagggaggaagagaaggaagccuuaucucagucuau

SEQ ID NO: 189539 - RNA, 64 nt, Homo Sapiens
gaggaagagaaggaaguaacaucucagucuauuuggaagagaggccaugguucugagaagccuu

SEQ ID NO: 189540 - RNA, 64 nt, Homo Sapiens
gaggaggaaaggaaggagagaaggcaaggagguaggaagagaggaugaauugaggaagugaaag

SEQ ID NO: 189541 - RNA, 64 nt, Homo Sapiens
ggaagggagaagggagaggaagaaaggaaaaaaaggaagagagaaaaggagaaaagggaaaagc

SEQ ID NO: 189542 - RNA, 64 nt, Homo Sapiens
ugcuuccaaaagauuaaaaguuaauguugaaaauggaagagacucggauggugaccuauaacca

SEQ ID NO: 189543 - RNA, 64 nt, Homo Sapiens
auaugccaauuuuuaaacuaagggaauuuaaucuggaagagaacagcauaaauuaaaaggucca

SEQ ID NO: 189544 - RNA, 64 nt, Homo Sapiens
aaggcuagaggaggagacuccacuaaugaugccaggaagagaguauagcagacauccuuuugaa

SEQ ID NO: 189545 - RNA, 64 nt, Homo Sapiens
guaaauaauucuagaaugaggccaguaaagugggggaagagaugucccacaaggaaaaagugau

SEQ ID NO: 189546 - RNA, 64 nt, Homo Sapiens
ggaaccuuucuuugacagccagggcacauggggaggaagagacuccugacccaccuggcaaagc

SEQ ID NO: 189547 - RNA, 64 nt, Homo Sapiens
ggaaggaaguguuuguguaggaggaagaacgagaggaagagaaggaugaacagagaagggaaga

SEQ ID NO: 189548 - RNA, 64 nt, Homo Sapiens
aagaacgagaggaagagaaggaugaacagagaagggaagagagguuucuuuuugaggcaaguug

SEQ ID NO: 189549 - RNA, 64 nt, Homo Sapiens
uuaguuguuauuuaacuugaguuuugugggauggggaagagauuauauaaaauauauaugugga

SEQ ID NO: 189550 - RNA, 64 nt, Homo Sapiens
aaagaucuucauggcuguuuaccagguggugcuuggaagagaugcccggcagccagcgagguac

SEQ ID NO: 189551 - RNA, 64 nt, Homo Sapiens
accgauaugagaauggggaaaugaaaccaggaagggaagagagcuaguaugggguauguuaaug

SEQ ID NO: 189552 - RNA, 64 nt, Homo Sapiens
agagagagagaagggaggaugagaacgaauggggggaagagauaaacuuuaugcauaacauuag

SEQ ID NO: 189553 - RNA, 64 nt, Homo Sapiens
uagaaucccagucaccuuuauauaucauauuauuggaagagauucaucuucauaaucuccaguu

SEQ ID NO: 189554 - RNA, 64 nt, Homo Sapiens
gaaucacaauuaccuuuauauaucauauguuauuggaagagauuccucaguaaucuccaaucuc

SEQ ID NO: 189555 - RNA, 64 nt, Homo Sapiens
cucucugaaagcagaaaaaggcacugauauaaagggaagagaaggaggcucaccggagggaaga

SEQ ID NO: 189556 - RNA, 64 nt, Homo Sapiens
ugauauaaagggaagagaaggaggcucaccggagggaagagaacauagugaagauucccgccuu

SEQ ID NO: 189557 - RNA, 64 nt, Homo Sapiens
gcaucuccugaggacuugcuucuccugccucuggggaagagagggaagagaaagcacagagcag

SEQ ID NO: 189558 - RNA, 64 nt, Homo Sapiens
gaggacuugcuucuccugccucuggggaagagagggaagagaaagcacagagcagagaagcaga

SEQ ID NO: 189559 - RNA, 64 nt, Homo Sapiens
guccgccagaucugcaggcuguuucucugguaacggaagagaccucuaaaucauuagggcagca

SEQ ID NO: 189560 - RNA, 53 nt, Homo Sapiens
augccauuuucucccuugaguuuggaagagacaaucugaucugccuccuuuag

SEQ ID NO: 189561 - RNA, 64 nt, Homo Sapiens
uccauacugaaagaagagcaugccaacagcuuggggaagagaauaaaugcaaaugaacuagaca

SEQ ID NO: 189562 - RNA, 64 nt, Homo Sapiens
aacucauuuaauauucugaccaucaaaauccuggggaagagaaugcaaacuauacacggucguc

SEQ ID NO: 189563 - RNA, 63 nt, Homo Sapiens
gcccucagagugcucuguaggagcuguagacugggaagagaggccaggcgugguggcucacuc

SEQ ID NO: 189564 - RNA, 64 nt, Homo Sapiens
cuagacccugucucaaaaaaaaaaaaaaagacugggaagagagcuagagggacuaggagauaau

SEQ ID NO: 189565 - RNA, 64 nt, Homo Sapiens
accauuuuaucucagguuaguugacugacauacuggaagagaaccauugcuugucuuugagaaa

SEQ ID NO: 189566 - RNA, 64 nt, Homo Sapiens
ccucagcccuucaaaucucaccugguguacggugggaagagauuaucuuguguacagcccacac

SEQ ID NO: 189567 - RNA, 64 nt, Homo Sapiens
uaccccugggcuuggauuccgcuacagaaaacagggaagagacaccuauggguuuaagcagagg

SEQ ID NO: 189568 - RNA, 64 nt, Homo Sapiens
ggaaaacuuauacagcuucagggaaagucaaucaggaagagaauaccugcccaggauuuaguaa

SEQ ID NO: 189569 - RNA, 64 nt, Homo Sapiens
uauacccuaagcagauagcaguuccauuccaggaggaagagaucucccucucugugcucaagga

SEQ ID NO: 189570 - RNA, 64 nt, Homo Sapiens
uggugcugcagaaguguaccguuuaguguagaagggaagagaauggacguugcuguacugucuu

SEQ ID NO: 189571 - RNA, 64 nt, Homo Sapiens
uucucauugugggaaucugacauaguucagcugaggaagagaaucagcugauccucauggucug

SEQ ID NO: 189572 - RNA, 64 nt, Homo Sapiens
cuauauugaaaaucauuuacauuggccuauauuuggaagagagauagucuuuuguuuuuaauaa

SEQ ID NO: 189573 - RNA, 64 nt, Homo Sapiens
agcagacaugauggggagagccuucuaauaagagggaagagacugcuuggaagcaugaagggag

SEQ ID NO: 189574 - RNA, 64 nt, Homo Sapiens
ggcuagaugaccaucacacagcaaaggagggaguggaagagagaugagaaaauugagagcuauu

SEQ ID NO: 189575 - RNA, 64 nt, Homo Sapiens
aagccacugcgcccagccacugccaucaucuuuaggaagagagaagugaccaugccugaaccag

SEQ ID NO: 189576 - RNA, 64 nt, Homo Sapiens
uaacauucaugauuagggucucagaagguaaggaggaagagaguggaauggaaaaaguauucaa

SEQ ID NO: 189577 - RNA, 64 nt, Homo Sapiens
aaaaacaauuccaaaugugaaacuagaaugagagggaagagauagcauggcaugcagcacacac

SEQ ID NO: 189578 - RNA, 64 nt, Homo Sapiens
ucgugacaauguacgccuuucccucagaauucagggaagagacugucgccugccuuccuccguu

SEQ ID NO: 189579 - RNA, 64 nt, Homo Sapiens
gguguuuuuuaaagcaaugugaguccacugaggaggaagagacccugggauuucacccucuggg

SEQ ID NO: 189580 - RNA, 64 nt, Homo Sapiens
caagccccaacaggccccugucauuccacuucauggaagagacggagccuucugaaaugagauc

SEQ ID NO: 189581 - RNA, 64 nt, Homo Sapiens
caggcuucuauccugcuaacccaguaacccagugggaagagauuuacuuauuccaauaauucca

SEQ ID NO: 189582 - RNA, 64 nt, Homo Sapiens
gugcaugcuaggaugauggggcuugaugcaguagggaagagacgauguaaaaauaauaaacaau

SEQ ID NO: 189583 - RNA, 64 nt, Homo Sapiens
gcugagccaggguuuaagucacguuuauuuccgaggaagagaauggaagagaaugcccaaagga

SEQ ID NO: 189584 - RNA, 64 nt, Homo Sapiens
gcccaaaggaacguuuauuugacgagacuugauuggaagagaauggugucuuuaacguagauga

SEQ ID NO: 189585 - RNA, 64 nt, Homo Sapiens
caccugaccagccccuccccacaagaugcaacuaggaagagacaggauggaaagggagggaaag

SEQ ID NO: 189586 - RNA, 64 nt, Homo Sapiens
gggagcaggcggagcgagagaggaauaaggggaaggaagagagaugguagucagaggagggagg

SEQ ID NO: 189587 - RNA, 64 nt, Homo Sapiens
cccagcucugggaacugaauaugagaaagggagaggaagagaaggaaagggcagaggaagagac

SEQ ID NO: 189588 - RNA, 64 nt, Homo Sapiens
ugagaaagggagaggaagagggagaaagggcagaggaagagacagaagaggaagagugagggau

SEQ ID NO: 189589 - RNA, 64 nt, Homo Sapiens
ccacauacuauaaagaucuagaaaaagguggaaaggaagagaaguauauuauuauauguuaaga

SEQ ID NO: 189590 - RNA, 64 nt, Homo Sapiens
accggccaccuguccagcaugcaguuaucacuggggaagagagguuuaagugggagaagggugg

SEQ ID NO: 189591 - RNA, 64 nt, Homo Sapiens
uacuaagagaauaucucuuggugucauaucuaggggaagagaauuaacuagaauuaaauuuaau

SEQ ID NO: 189592 - RNA, 64 nt, Homo Sapiens
uccaaaggaagucaaggaagaaaaagcauggaaaggaagagaacugauuccuacugaaaauuca

SEQ ID NO: 189593 - RNA, 64 nt, Homo Sapiens
gcgagggcaccagcaguuguggguggggagcaagggaagagagaaacucuucagcgaauccuuc

SEQ ID NO: 189594 - RNA, 64 nt, Homo Sapiens
gccuuuugacugaguggcagaaggaaacugcucaggaagagaaacaggugacugaugggaaggu

SEQ ID NO: 189595 - RNA, 64 nt, Homo Sapiens
agagucuauuaugagcugguucagggaagagaagggaagagagauggggagugagaugaguaau

SEQ ID NO: 189596 - RNA, 64 nt, Homo Sapiens
ggaagagagaagagucuauugaugaguaauucagggaagagaagacauacaagauggggaguga

SEQ ID NO: 189597 - RNA, 64 nt, Homo Sapiens
uucccaaacuaucagccuugauuaauuucuaguaggaagagaauaauuacauuugcgggggggg

SEQ ID NO: 189598 - RNA, 64 nt, Homo Sapiens
uguauuuuguuugggaaaaaaacuaucaaaaugaggaagagaauuuccccuauuuaugcacuag

SEQ ID NO: 189599 - RNA, 59 nt, Homo Sapiens; identical to SEQ ID NO: 188365

SEQ ID NO: 189600 - RNA, 64 nt, Homo Sapiens; identical to SEQ ID NO: 188366

SEQ ID NO: 189601 - RNA, 64 nt, Homo Sapiens; identical to SEQ ID NO: 188367

SEQ ID NO: 189602 - RNA, 64 nt, Homo Sapiens; identical to SEQ ID NO: 188368

SEQ ID NO: 189603 - RNA, 64 nt, Homo Sapiens; identical to SEQ ID NO: 188369

SEQ ID NO: 189604 - RNA, 64 nt, Homo Sapiens; identical to SEQ ID NO: 188370

SEQ ID NO: 189605 - RNA, 64 nt, Homo Sapiens; identical to SEQ ID NO: 188371

SEQ ID NO: 189606 - RNA, 64 nt, Homo Sapiens; identical to SEQ ID NO: 188372

SEQ ID NO: 189607 - RNA, 64 nt, Homo Sapiens; identical to SEQ ID NO: 188373

SEQ ID NO: 189608 - RNA, 64 nt, Homo Sapiens; identical to SEQ ID NO: 188374

SEQ ID NO: 189609 - RNA, 64 nt, Homo Sapiens; identical to SEQ ID NO: 188375

SEQ ID NO: 189610 - RNA, 64 nt, Homo Sapiens; identical to SEQ ID NO: 188376

SEQ ID NO: 189611 - RNA, 64 nt, Homo Sapiens; identical to SEQ ID NO: 188377

SEQ ID NO: 189612 - RNA, 64 nt, Homo Sapiens; identical to SEQ ID NO: 188378

SEQ ID NO: 189613 - RNA, 64 nt, Homo Sapiens; identical to SEQ ID NO: 188379

SEQ ID NO: 189614 - RNA, 64 nt, Homo Sapiens; identical to SEQ ID NO: 188380

SEQ ID NO: 189615 - RNA, 64 nt, Homo Sapiens; identical to SEQ ID NO: 188381

SEQ ID NO: 189616 - RNA, 64 nt, Homo Sapiens; identical to SEQ ID NO: 188382

SEQ ID NO: 189617 - RNA, 64 nt, Homo Sapiens; identical to SEQ ID NO: 188383

SEQ ID NO: 189618 - RNA, 64 nt, Homo Sapiens; identical to SEQ ID NO: 188384

SEQ ID NO: 189619 - RNA, 64 nt, Homo Sapiens; identical to SEQ ID NO: 188385

SEQ ID NO: 189620 - RNA, 64 nt, Homo Sapiens; identical to SEQ ID NO: 188386

SEQ ID NO: 189621 - RNA, 64 nt, Homo Sapiens; identical to SEQ ID NO: 188387

SEQ ID NO: 189622 - RNA, 64 nt, Homo Sapiens; identical to SEQ ID NO: 188388

SEQ ID NO: 189623 - RNA, 64 nt, Homo Sapiens; identical to SEQ ID NO: 188389

SEQ ID NO: 189624 - RNA, 64 nt, Homo Sapiens; identical to SEQ ID NO: 188390

SEQ ID NO: 189625 - RNA, 64 nt, Homo Sapiens; identical to SEQ ID NO: 188391

SEQ ID NO: 189626 - RNA, 64 nt, Homo Sapiens; identical to SEQ ID NO: 188392

SEQ ID NO: 189627 - RNA, 64 nt, Homo Sapiens; identical to SEQ ID NO: 188393

SEQ ID NO: 189628 - RNA, 52 nt, Homo Sapiens; identical to SEQ ID NO: 188394

SEQ ID NO: 189629 - RNA, 62 nt, Homo Sapiens; identical to SEQ ID NO: 188395

SEQ ID NO: 189630 - RNA, 55 nt, Homo Sapiens; identical to SEQ ID NO: 188396

SEQ ID NO: 189631 - RNA, 64 nt, Homo Sapiens; identical to SEQ ID NO: 188397

SEQ ID NO: 189632 - RNA, 64 nt, Homo Sapiens; identical to SEQ ID NO: 188398

SEQ ID NO: 189633 - RNA, 64 nt, Homo Sapiens; identical to SEQ ID NO: 188399

SEQ ID NO: 189634 - RNA, 64 nt, Homo Sapiens; identical to SEQ ID NO: 188400

SEQ ID NO: 189635 - RNA, 64 nt, Homo Sapiens; identical to SEQ ID NO: 188401

SEQ ID NO: 189636 - RNA, 64 nt, Homo Sapiens; identical to SEQ ID NO: 188402

SEQ ID NO: 189637 - RNA, 64 nt, Homo Sapiens; identical to SEQ ID NO: 188403

SEQ ID NO: 189638 - RNA, 64 nt, Homo Sapiens; identical to SEQ ID NO: 188404

SEQ ID NO: 189639 - RNA, 64 nt, Homo Sapiens; identical to SEQ ID NO: 188405

SEQ ID NO: 189640 - RNA, 64 nt, Homo Sapiens; identical to SEQ ID NO: 188406

SEQ ID NO: 189641 - RNA, 64 nt, Homo Sapiens; identical to SEQ ID NO: 188407

SEQ ID NO: 189642 - RNA, 64 nt, Homo Sapiens; identical to SEQ ID NO: 188408

SEQ ID NO: 189643 - RNA, 64 nt, Homo Sapiens; identical to SEQ ID NO: 188409

SEQ ID NO: 189644 - RNA, 64 nt, Homo Sapiens; identical to SEQ ID NO: 188410

SEQ ID NO: 189645 - RNA, 64 nt, Homo Sapiens; identical to SEQ ID NO: 188411

SEQ ID NO: 189646 - RNA, 64 nt, Homo Sapiens; identical to SEQ ID NO: 188412

SEQ ID NO: 189647 - RNA, 64 nt, Homo Sapiens; identical to SEQ ID NO: 188413

SEQ ID NO: 189648 - RNA, 64 nt, Homo Sapiens; identical to SEQ ID NO: 188414

SEQ ID NO: 189649 - RNA, 64 nt, Homo Sapiens; identical to SEQ ID NO: 188415

SEQ ID NO: 189650 - RNA, 64 nt, Homo Sapiens; identical to SEQ ID NO: 188416

SEQ ID NO: 189651 - RNA, 64 nt, Homo Sapiens; identical to SEQ ID NO: 188417

SEQ ID NO: 189652 - RNA, 64 nt, Homo Sapiens; identical to SEQ ID NO: 188418

SEQ ID NO: 189653 - RNA, 64 nt, Homo Sapiens; identical to SEQ ID NO: 188419

SEQ ID NO: 189654 - RNA, 64 nt, Homo Sapiens; identical to SEQ ID NO: 188420

SEQ ID NO: 189655 - RNA, 64 nt, Homo Sapiens; identical to SEQ ID NO: 188421

SEQ ID NO: 189656 - RNA, 64 nt, Homo Sapiens; identical to SEQ ID NO: 188422

SEQ ID NO: 189657 - RNA, 64 nt, Homo Sapiens; identical to SEQ ID NO: 188423

SEQ ID NO: 189658 - RNA, 64 nt, Homo Sapiens; identical to SEQ ID NO: 188424

SEQ ID NO: 189659 - RNA, 64 nt, Homo Sapiens; identical to SEQ ID NO: 188425

SEQ ID NO: 189660 - RNA, 64 nt, Homo Sapiens; identical to SEQ ID NO: 188426

SEQ ID NO: 189661 - RNA, 64 nt, Homo Sapiens; identical to SEQ ID NO: 188427

SEQ ID NO: 189662 - RNA, 64 nt, Homo Sapiens; identical to SEQ ID NO: 188428

SEQ ID NO: 189663 - RNA, 64 nt, Homo Sapiens; identical to SEQ ID NO: 188429

SEQ ID NO: 189664 - RNA, 64 nt, Homo Sapiens; identical to SEQ ID NO: 188430

SEQ ID NO: 189665 - RNA, 64 nt, Homo Sapiens; identical to SEQ ID NO: 188431

SEQ ID NO: 189666 - RNA, 64 nt, Homo Sapiens; identical to SEQ ID NO: 188432

SEQ ID NO: 189667 - RNA, 64 nt, Homo Sapiens; identical to SEQ ID NO: 188433

SEQ ID NO: 189668 - RNA, 64 nt, Homo Sapiens; identical to SEQ ID NO: 188434

SEQ ID NO: 189669 - RNA, 64 nt, Homo Sapiens; identical to SEQ ID NO: 188435

SEQ ID NO: 189670 - RNA, 64 nt, Homo Sapiens; identical to SEQ ID NO: 188436

SEQ ID NO: 189671 - RNA, 64 nt, Homo Sapiens; identical to SEQ ID NO: 188437

SEQ ID NO: 189672 - RNA, 64 nt, Homo Sapiens; identical to SEQ ID NO: 188438

SEQ ID NO: 189673 - RNA, 64 nt, Homo Sapiens; identical to SEQ ID NO: 188439

SEQ ID NO: 189674 - RNA, 64 nt, Homo Sapiens; identical to SEQ ID NO: 188440

SEQ ID NO: 189675 - RNA, 64 nt, Homo Sapiens; identical to SEQ ID NO: 188441

SEQ ID NO: 189676 - RNA, 64 nt, Homo Sapiens; identical to SEQ ID NO: 188442

SEQ ID NO: 189677 - RNA, 64 nt, Homo Sapiens; identical to SEQ ID NO: 188443

SEQ ID NO: 189678 - RNA, 64 nt, Homo Sapiens; identical to SEQ ID NO: 188444

SEQ ID NO: 189679 - RNA, 64 nt, Homo Sapiens; identical to SEQ ID NO: 188445

SEQ ID NO: 189680 - RNA, 64 nt, Homo Sapiens; identical to SEQ ID NO: 188446

SEQ ID NO: 189681 - RNA, 64 nt, Homo Sapiens; identical to SEQ ID NO: 188447

SEQ ID NO: 189682 - RNA, 64 nt, Homo Sapiens; identical to SEQ ID NO: 188448

SEQ ID NO: 189683 - RNA, 64 nt, Homo Sapiens; identical to SEQ ID NO: 188449

SEQ ID NO: 189684 - RNA, 64 nt, Homo Sapiens; identical to SEQ ID NO: 188450

SEQ ID NO: 189685 - RNA, 64 nt, Homo Sapiens; identical to SEQ ID NO: 188451

SEQ ID NO: 189686 - RNA, 64 nt, Homo Sapiens; identical to SEQ ID NO: 188452

SEQ ID NO: 189687 - RNA, 64 nt, Homo Sapiens; identical to SEQ ID NO: 188453

SEQ ID NO: 189688 - RNA, 64 nt, Homo Sapiens; identical to SEQ ID NO: 188454

SEQ ID NO: 189689 - RNA, 64 nt, Homo Sapiens; identical to SEQ ID NO: 188455

SEQ ID NO: 189690 - RNA, 64 nt, Homo Sapiens; identical to SEQ ID NO: 188456

SEQ ID NO: 189691 - RNA, 64 nt, Homo Sapiens; identical to SEQ ID NO: 188457

SEQ ID NO: 189692 - RNA, 64 nt, Homo Sapiens; identical to SEQ ID NO: 188458

SEQ ID NO: 189693 - RNA, 64 nt, Homo Sapiens
caggucagcuuccggcucuuagagcggcaagcagagcggcaaggguccaucaaggcagagcggc

SEQ ID NO: 189694 - RNA, 64 nt, Homo Sapiens
agagcggcaaggcaggucagaggcagagcggcagagcggcaagcguguccauaggaguccauca

SEQ ID NO: 189695 - RNA, 64 nt, Homo Sapiens
uugagugguauuuucuuuucccacagagugcuucaggacacauucacuugaagccucccgacuu

SEQ ID NO: 189696 - RNA, 64 nt, Homo Sapiens
cucaugcccccgucuugccacucagauucagugcaggacacaagcuagaccucccaggcuaagc

SEQ ID NO: 189697 - RNA, 64 nt, Homo Sapiens
agcuuucuuuggaaaucuccggaaggcaggacacaggacacagcggcucgggaagccacgccug

SEQ ID NO: 189698 - RNA, 64 nt, Homo Sapiens
acacagcagcuuucuuuggaacgccugggaaggcaggacacagggaaucagggcucgggaagcc

SEQ ID NO: 189699 - RNA, 64 nt, Homo Sapiens
ggugcaagccccauucacggauuaacaaaaccaaaggacacaagucuuccccuccuguaagagu

SEQ ID NO: 189700 - RNA, 64 nt, Homo Sapiens
gaaaagcagccuuuuucacccggccuggcuggccaggacacacuugaguccaucgugugagccu

SEQ ID NO: 189701 - RNA, 64 nt, Homo Sapiens
aauagguucugucgggaggauugggggugacaccaggacacaggggagagagggacagguucug

SEQ ID NO: 189702 - RNA, 64 nt, Homo Sapiens
gacagguucuaucaugggugucaugggugacacgaggacacaggggacacagggacagguucug

SEQ ID NO: 189703 - RNA, 64 nt, Homo Sapiens
gacagguucugucaugggugucgggggugacaccaggacacaggggacacagggacagguucug

SEQ ID NO: 189704 - RNA, 64 nt, Homo Sapiens
gacagguucugucgggggugucaggggugacaccaggacacaggggagagagggacagguucug

SEQ ID NO: 189705 - RNA, 64 nt, Homo Sapiens
caggcggcccgcccuugccucacuccacacugccaggacacaccugagcagagcccauccagga

SEQ ID NO: 189706 - RNA, 64 nt, Homo Sapiens
augaaugaaaugcaguguagggagaggagauggcaggacacagcaaacaggacacauuugccug

SEQ ID NO: 189707 - RNA, 64 nt, Homo Sapiens
guguagggagaggagauggcaggacacagcaaacaggacacauuugccugcuucucucuugccu

SEQ ID NO: 189708 - RNA, 64 nt, Homo Sapiens
cacacacacacacacaccacucuacaugacauucaggacacacaugacgcuccucccagaucgc

SEQ ID NO: 189709 - RNA, 64 nt, Homo Sapiens
agcagcaagaagcggggagagaucugucggaaccaggacacaaaugccucuugcaaugacagcu

SEQ ID NO: 189710 - RNA, 64 nt, Homo Sapiens
uaaauccuugaagacacaucuaucuacaacuaauaggacacaugcuacauaaguucucuggaaa

SEQ ID NO: 189711 - RNA, 64 nt, Homo Sapiens
uuuuccuucauauuuuuucugucugauuucauucaggacacauugaaguuuguaauuacugaaa

SEQ ID NO: 189712 - RNA, 64 nt, Homo Sapiens
uguguauguuuaaaauuacucuuauacaauaaaaaggacacauucuaaagaaaacaauuacauu

SEQ ID NO: 189713 - RNA, 64 nt, Homo Sapiens
ucauauuccccauugcucucccauuaauagguuuaggacacaagucugacaugaaaugugguua

SEQ ID NO: 189714 - RNA, 64 nt, Homo Sapiens
ugaguaggccagguaggcgauuggaagagugagcaggacacagaggggaggggaauguuuuggc

SEQ ID NO: 189715 - RNA, 64 nt, Homo Sapiens
uauggagcacacucuucacccuacccucuaccacaggacacauaucccuguuagcauuccccgg

SEQ ID NO: 189716 - RNA, 64 nt, Homo Sapiens
gacuccgucccuguccccgacugugccacgugguaggacacauaggacacaggaauuccugggu

SEQ ID NO: 189717 - RNA, 64 nt, Homo Sapiens
ccuguccccgacugugccacgugguaggacacauaggacacaggaauuccuggguccuugccca

SEQ ID NO: 189718 - RNA, 64 nt, Homo Sapiens
uccuggguccuugcccaugacugugccaugugguaggacacaggacacaggaauuccuggaaag

SEQ ID NO: 189719 - RNA, 64 nt, Homo Sapiens
uccuugcccaugacugugccaugugguaggacacaggacacaggaauuccuggaaagugguggc

SEQ ID NO: 189720 - RNA, 64 nt, Homo Sapiens
ggccaacuuggcaggacuuggccagcagcugcccaggacacagugcaggccagagcgggcuuga

SEQ ID NO: 189721 - RNA, 64 nt, Homo Sapiens
uggccugcagcuucauuugcgagagcgccgaggcaggacacagagcacagcugugcuggaagug

SEQ ID NO: 189722 - RNA, 64 nt, Homo Sapiens
ggggagacgccccagucugcuccucauucaccagaggacacacacuuuagccggaagucagucc

SEQ ID NO: 189723 - RNA, 64 nt, Homo Sapiens
caggggagaagccuuaugucuccucagucaccagaggacacacacuuuagccggaagucagacc

SEQ ID NO: 189724 - RNA, 64 nt, Homo Sapiens
caggggggaagcccuacgucuuauuacacaccaaaggacacacauuucagugauaagucagaug

SEQ ID NO: 189725 - RNA, 64 nt, Homo Sapiens
cuucagaucugccucacaccuucaaauucaugaaaggacacaaacacacauaagaauacacucu

SEQ ID NO: 189726 - RNA, 64 nt, Homo Sapiens
cuucagaucugccaagaaccuucgaauucaugaaaggacacaaacacacguaagaaugcacucu

SEQ ID NO: 189727 - RNA, 64 nt, Homo Sapiens
uuuuaaauuuaaaccauugagacuucagaagagcaggacacaaugcuguggacaggcaccaauu

SEQ ID NO: 189728 - RNA, 64 nt, Homo Sapiens
gggaaucuggggguuucuucuggaacggggcgugaggacacaaggaggccucugggccacgccu

SEQ ID NO: 189729 - RNA, 64 nt, Homo Sapiens
cagggagaagaccucuguggucuuguacuaaaggaggacacacuuagcaauaaguuaaaccuca

SEQ ID NO: 189730 - RNA, 64 nt, Homo Sapiens
uaggagagaaguuuauguguugagcaugcacaaaaggacacacucuguagccaucagucagccu

SEQ ID NO: 189731 - RNA, 64 nt, Homo Sapiens
gcuccucccuuccaaaagauuuuucugcucugugaggacacaauuuuguccuguggcccuucua

SEQ ID NO: 189732 - RNA, 64 nt, Homo Sapiens
caggagaguaacuuugcuuuucaccauccaucagaggacacacucuucaucuugaaguuauauc

SEQ ID NO: 189733 - RNA, 64 nt, Homo Sapiens
ccucuucccuuugcccuucuccuccaauacauaaaggacacagacaaggaacuugcugaaaggc

SEQ ID NO: 189734 - RNA, 64 nt, Homo Sapiens
auacccacauggggacauaagcuaauuuuuuuacaggacacagaauucuguucaaugcuguuaa

SEQ ID NO: 189735 - RNA, 64 nt, Homo Sapiens
cacagcuccuuggugguuucaucuccucugugggaggacacaucucugcagccucaagaguuag

SEQ ID NO: 189736 - RNA, 64 nt, Homo Sapiens
uauggagccuccugggacaagccucaggaugaaaaggacacagaaggccagaugagaaaggucu

SEQ ID NO: 189737 - RNA, 64 nt, Homo Sapiens
auugugaagcacagaugagcucuuucacacuccaaggacacagcucauccuaugcuuuuggaca

SEQ ID NO: 189738 - RNA, 64 nt, Homo Sapiens
ugagaucagcagaauccagacuauaagaaacuacaggacacaugaccuaguuucuucuguaaau

SEQ ID NO: 189739 - RNA, 64 nt, Homo Sapiens; identical to SEQ ID NO: 93637

SEQ ID NO: 189740 - RNA, 64 nt, Homo Sapiens; identical to SEQ ID NO: 93638

SEQ ID NO: 189741 - RNA, 64 nt, Homo Sapiens; identical to SEQ ID NO: 93639

SEQ ID NO: 189742 - RNA, 64 nt, Homo Sapiens; identical to SEQ ID NO: 93640

SEQ ID NO: 189743 - RNA, 64 nt, Homo Sapiens; identical to SEQ ID NO: 93641

SEQ ID NO: 189744 - RNA, 64 nt, Homo Sapiens; identical to SEQ ID NO: 93642

SEQ ID NO: 189745 - RNA, 64 nt, Homo Sapiens
uaccccaacucugcccuucucccauccaagagaaaccagcaaaaugauaaagaagcuaaccugc

SEQ ID NO: 189746 - RNA, 64 nt, Homo Sapiens
ugugaggauugauccacuuuuaaauuucucuucuaccagcaacuugggaaaaauuaaauauggg

SEQ ID NO: 189747 - RNA, 64 nt, Homo Sapiens
caucugucuuuucacccacggagggcacagaaccaccagcaaagccggcggcuggacuggcgcc

SEQ ID NO: 189748 - RNA, 64 nt, Homo Sapiens
gcucaggacccagugcccaugguuccucacuccuaccagcaagcagcaccaucccgcaggcuuc

SEQ ID NO: 189749 - RNA, 64 nt, Homo Sapiens
caaaaaacaacuagaggucaccuuucuacuuacuaccagcaaugcuuuuagaugaaaacaaaag

SEQ ID NO: 189750 - RNA, 55 nt, Homo Sapiens
uacaucucgccugguacaggaaaggaccagcaaaagcagaacuggaccaggauga

SEQ ID NO: 189751 - RNA, 64 nt, Homo Sapiens
aaccaggggaacugguuaugaauaugugaaugcaaccagcaaauuuauccuugaaggugugaug

SEQ ID NO: 189752 - RNA, 64 nt, Homo Sapiens
gggacuggcagaagcccaggcccucucuacuuuuaccagcaacugaucaugucuuucagaaucc

SEQ ID NO: 189753 - RNA, 64 nt, Homo Sapiens
uucugccaggccucgagcaucccacccuacagagaccagcaagguuuaauguugcuucacuuau

SEQ ID NO: 189754 - RNA, 64 nt, Homo Sapiens
uucugccaggccccaagcaucccauccuucagagaccagcaagguuuacuguugcuucauuuau

SEQ ID NO: 189755 - RNA, 64 nt, Homo Sapiens
uuuucaguuaaagcccuaucuccaggcugcaauaaccagcaaggacccaguuuucaauaaaccu

SEQ ID NO: 189756 - RNA, 64 nt, Homo Sapiens
aaacuuacuacuagccugcagagacccuuuuccuaccagcaaccguuuaaggagggugagauaa

SEQ ID NO: 189757 - RNA, 64 nt, Homo Sapiens
aacaaacuaaauugugauuuuuuaaugugaguauauacacuaaguugguauauguucuuuauau

SEQ ID NO: 189758 - RNA, 64 nt, Homo Sapiens
aauuuauguagauaauguacauauugcugaagacauacacuaaguauuuuuucugugaaacuuc

SEQ ID NO: 189759 - RNA, 64 nt, Homo Sapiens
uugauuguacucuccagaaauguuauuucuaauaauacacuaucucugaccaagcuucuauuaa

SEQ ID NO: 189760 - RNA, 64 nt, Homo Sapiens
caaccacaaaguguaaaggcacuguucaaaucugauacacuauuuagucguguagaaacuagcc

SEQ ID NO: 189761 - RNA, 64 nt, Homo Sapiens
agcaugcaucuaaucuaauacaugacuguucuuuauacacuaaauaagaaagagcagaguuauu

SEQ ID NO: 189762 - RNA, 64 nt, Homo Sapiens
guuaaaaucauuugcaaagcacauaauuaauucaauacacuacugagaaaugauggaauaauag

SEQ ID NO: 189763 - RNA, 64 nt, Homo Sapiens
auaaagauuuauuuucaugccuuauugguggguaauaacugaaaaacugugaaccuaacuuucu

SEQ ID NO: 189764 - RNA, 64 nt, Homo Sapiens
uacauuuucagcuauauuuaauuagguucaaauuauaacugauuccuugcuccuugcauggcuc

SEQ ID NO: 189765 - RNA, 64 nt, Homo Sapiens
uacagcaaaaggcagagaauagugagacucaauaauaacugaacgcuguucaaauuaaguagaa

SEQ ID NO: 189766 - RNA, 64 nt, Homo Sapiens
auuuucacccucucuagcuguuguugcccugaugauaacugaugaugaacuaggagaaagcaau

SEQ ID NO: 189767 - RNA, 64 nt, Homo Sapiens
augugcagaacaagcauucccacuuuuccucaagauaacugaccaaguguuuucuuagaaccaa

SEQ ID NO: 189768 - RNA, 64 nt, Homo Sapiens
auaagcuggaaguuuguuguaguaugccucaaauauaacugacuguauacuauagugguaacuu

SEQ ID NO: 189769 - RNA, 64 nt, Homo Sapiens
cuguuugucuuccuuugguauuuaauauuuauuaauaacugaaauguccagauccauuuagaaa

SEQ ID NO: 189770 - RNA, 64 nt, Homo Sapiens
auuuccaauugcauauaauagauaccaaagugcgauaacugaacuuuuuuuuuuuucugaaaag

SEQ ID NO: 189771 - RNA, 64 nt, Homo Sapiens
agacuauguagugaaauguaacugccauuaaauaauaacugaaaagaauccacuggaggucauu

SEQ ID NO: 189772 - RNA, 64 nt, Homo Sapiens
uaaaaaacauguuaauccuuauuugcagaaacaaauaacugaaauacauggauacaucaaguuc

SEQ ID NO: 189773 - RNA, 64 nt, Homo Sapiens
ccaagaauuugcauuuuuaacaaauuccuaggugauaacugauaauguugguucagggaacaca

SEQ ID NO: 189774 - RNA, 64 nt, Homo Sapiens
aagauguggauuuacaggaagaacccugguuugaauaacugaucugaaauuaguaguuaccugu

SEQ ID NO: 189775 - RNA, 64 nt, Homo Sapiens
gugcugaccaagcaaagaaacgaggacugcuacuauaacugagaucaggcugacauaaaguuua

SEQ ID NO: 189776 - RNA, 64 nt, Homo Sapiens
cagagaaaaauuaguccuucugggaagcuuccuuauaacugauguuuuuguuccuguucauaga

SEQ ID NO: 189777 - RNA, 64 nt, Homo Sapiens
uacuuuacuuuuucucauaugaguugugccuuuuauaacugaaaagcauuacaugacuauuggu

SEQ ID NO: 189778 - RNA, 64 nt, Homo Sapiens
uuuuaagacugugucuguauaugcaaauaaaaaaauaacugauuuaagucuuuccuuugguucu

SEQ ID NO: 189779 - RNA, 64 nt, Homo Sapiens
caugugaaacaguaucauccguguuucagcauacauaacugaaguaaagauguauaggcaucug

SEQ ID NO: 189780 - RNA, 64 nt, Homo Sapiens
guaacaacagaaaccccaguugggaguuuaacaaauaacugacuaccacucacucaugcauuuu

SEQ ID NO: 189781 - RNA, 64 nt, Homo Sapiens
aaguuuuuaguuuucaguguucagguuauagaauauaacugaccauaaaaauuaccugcaggua

SEQ ID NO: 189782 - RNA, 64 nt, Homo Sapiens
gguagaucaguacuuucagccuaguuuaaaauguauaacugaguuuacaagggggaggaagucc

SEQ ID NO: 189783 - RNA, 64 nt, Homo Sapiens
aaauaagaauaguccuacaaauuauucucuguauauaacugaggucaccauacuuuaucuaauu

SEQ ID NO: 189784 - RNA, 64 nt, Homo Sapiens; identical to SEQ ID NO: 80857

SEQ ID NO: 189785 - RNA, 64 nt, Homo Sapiens; identical to SEQ ID NO: 80858

SEQ ID NO: 189786 - RNA, 64 nt, Homo Sapiens; identical to SEQ ID NO: 80859

SEQ ID NO: 189787 - RNA, 64 nt, Homo Sapiens; identical to SEQ ID NO: 80860

SEQ ID NO: 189788 - RNA, 64 nt, Homo Sapiens; identical to SEQ ID NO: 80861

SEQ ID NO: 189789 - RNA, 64 nt, Homo Sapiens; identical to SEQ ID NO: 80862

SEQ ID NO: 189790 - RNA, 64 nt, Homo Sapiens; identical to SEQ ID NO: 80863

SEQ ID NO: 189791 - RNA, 64 nt, Homo Sapiens; identical to SEQ ID NO: 80864

SEQ ID NO: 189792 - RNA, 64 nt, Homo Sapiens; identical to SEQ ID NO: 80865

SEQ ID NO: 189793 - RNA, 64 nt, Homo Sapiens; identical to SEQ ID NO: 80866

SEQ ID NO: 189794 - RNA, 64 nt, Homo Sapiens; identical to SEQ ID NO: 80867

SEQ ID NO: 189795 - RNA, 64 nt, Homo Sapiens; identical to SEQ ID NO: 80868

SEQ ID NO: 189796 - RNA, 64 nt, Homo Sapiens; identical to SEQ ID NO: 80869

SEQ ID NO: 189797 - RNA, 64 nt, Homo Sapiens; identical to SEQ ID NO: 80870

SEQ ID NO: 189798 - RNA, 64 nt, Homo Sapiens; identical to SEQ ID NO: 80871

SEQ ID NO: 189799 - RNA, 64 nt, Homo Sapiens; identical to SEQ ID NO: 80872

SEQ ID NO: 189800 - RNA, 64 nt, Homo Sapiens; identical to SEQ ID NO: 80873

SEQ ID NO: 189801 - RNA, 64 nt, Homo Sapiens; identical to SEQ ID NO: 80874

SEQ ID NO: 189802 - RNA, 64 nt, Homo Sapiens; identical to SEQ ID NO: 80875

SEQ ID NO: 189803 - RNA, 64 nt, Homo Sapiens; identical to SEQ ID NO: 80876

SEQ ID NO: 189804 - RNA, 64 nt, Homo Sapiens; identical to SEQ ID NO: 80877

SEQ ID NO: 189805 - RNA, 64 nt, Homo Sapiens; identical to SEQ ID NO: 80878

SEQ ID NO: 189806 - RNA, 64 nt, Homo Sapiens; identical to SEQ ID NO: 80879

SEQ ID NO: 189807 - RNA, 64 nt, Homo Sapiens; identical to SEQ ID NO: 80880

SEQ ID NO: 189808 - RNA, 64 nt, Homo Sapiens; identical to SEQ ID NO: 80881

SEQ ID NO: 189809 - RNA, 64 nt, Homo Sapiens; identical to SEQ ID NO: 80882

SEQ ID NO: 189810 - RNA, 59 nt, Homo Sapiens; identical to SEQ ID NO: 80883

SEQ ID NO: 189811 - RNA, 64 nt, Homo Sapiens; identical to SEQ ID NO: 80884

SEQ ID NO: 189812 - RNA, 64 nt, Homo Sapiens; identical to SEQ ID NO: 80885

SEQ ID NO: 189813 - RNA, 64 nt, Homo Sapiens; identical to SEQ ID NO: 80886

SEQ ID NO: 189814 - RNA, 64 nt, Homo Sapiens; identical to SEQ ID NO: 80887

SEQ ID NO: 189815 - RNA, 64 nt, Homo Sapiens; identical to SEQ ID NO: 80888

SEQ ID NO: 189816 - RNA, 64 nt, Homo Sapiens; identical to SEQ ID NO: 80889

SEQ ID NO: 189817 - RNA, 64 nt, Homo Sapiens; identical to SEQ ID NO: 80890

SEQ ID NO: 189818 - RNA, 64 nt, Homo Sapiens; identical to SEQ ID NO: 80891

SEQ ID NO: 189819 - RNA, 64 nt, Homo Sapiens; identical to SEQ ID NO: 80892

SEQ ID NO: 189820 - RNA, 64 nt, Homo Sapiens; identical to SEQ ID NO: 80893

SEQ ID NO: 189821 - RNA, 64 nt, Homo Sapiens; identical to SEQ ID NO: 80894

SEQ ID NO: 189822 - RNA, 64 nt, Homo Sapiens; identical to SEQ ID NO: 80895

SEQ ID NO: 189823 - RNA, 64 nt, Homo Sapiens; identical to SEQ ID NO: 80896

SEQ ID NO: 189824 - RNA, 64 nt, Homo Sapiens; identical to SEQ ID NO: 80897

SEQ ID NO: 189825 - RNA, 64 nt, Homo Sapiens; identical to SEQ ID NO: 80898

SEQ ID NO: 189826 - RNA, 64 nt, Homo Sapiens; identical to SEQ ID NO: 80899

SEQ ID NO: 189827 - RNA, 64 nt, Homo Sapiens; identical to SEQ ID NO: 80900

SEQ ID NO: 189828 - RNA, 64 nt, Homo Sapiens; identical to SEQ ID NO: 80901

SEQ ID NO: 189829 - RNA, 64 nt, Homo Sapiens; identical to SEQ ID NO: 80902

SEQ ID NO: 189830 - RNA, 64 nt, Homo Sapiens; identical to SEQ ID NO: 80903

SEQ ID NO: 189831 - RNA, 64 nt, Homo Sapiens; identical to SEQ ID NO: 80904

SEQ ID NO: 189832 - RNA, 64 nt, Homo Sapiens; identical to SEQ ID NO: 80905

SEQ ID NO: 189833 - RNA, 64 nt, Homo Sapiens
cuucauuauccaccccaucccccacuucugcaaccccagguaucgaugccccagggauucccac

SEQ ID NO: 189834 - RNA, 64 nt, Homo Sapiens
gcggaggcugcuggugugagauuucuaacaagcucccagguaagauagaucugggagauccugc

SEQ ID NO: 189835 - RNA, 64 nt, Homo Sapiens
gggggaaaaagggcaggguggcucaggcuuuaggcccagguacuggggaggccugaggagcccu

SEQ ID NO: 189836 - RNA, 64 nt, Homo Sapiens
caccucccaggcucaagagauccucccacagccucccagguagcugggacuacaggcgugcacc

SEQ ID NO: 189837 - RNA, 64 nt, Homo Sapiens
uagcagaggcugucaguccucacuccacagcccucccagguaccaccuccccugccugagcccu

SEQ ID NO: 189838 - RNA, 64 nt, Homo Sapiens
ggcaggauggagggcugagcgccagugggcucagcccagguaggacagggccaggcuggcaggg

SEQ ID NO: 189839 - RNA, 64 nt, Homo Sapiens
uaugugaugagcaaugaggaccuauuucauuguccccagguaagcuucuagggaauagcaaaga

SEQ ID NO: 189840 - RNA, 64 nt, Homo Sapiens
auacgcucuuugcuguguagagcgucugcagccacccagguagcagaauccgccagcacuuggu

SEQ ID NO: 189841 - RNA, 64 nt, Homo Sapiens
aaugucaaugagacuaaaguaaguaauuaaagaugucaaucagauauuuugccaggcuggugca

SEQ ID NO: 189842 - RNA, 64 nt, Homo Sapiens
ccucaccuggcucauuuggcaaaaaucuucuugcgucaaucaaguugaccacauucccaacuag

SEQ ID NO: 189843 - RNA, 64 nt, Homo Sapiens
uuauuuucuacaaagugguagucugcucccacccucaguagaauucuuaaggagccauccuuaa

SEQ ID NO: 189844 - RNA, 64 nt, Homo Sapiens
gaggcaagguuacagguugaaagggaaaaugcugucaguagaugggguggcuuaugggggagaa

SEQ ID NO: 189845 - RNA, 64 nt, Homo Sapiens
ucuaagcccaccuaauuguagcuugaacuaguagucaguagaaaucuaccaggcauauucaugc

SEQ ID NO: 189846 - RNA, 64 nt, Homo Sapiens
guaauauugaagacaaaauagaguucacuccaaaucaguagagauuuaauauguaaaagugaaa

SEQ ID NO: 189847 - RNA, 64 nt, Homo Sapiens
cccaguugcuggcagagacuuggggugaguggagucaccccacuauagcaagucugggaaaucc

SEQ ID NO: 189848 - RNA, 64 nt, Homo Sapiens
acacgcagacucaugcacgcaccagcaccuguagucaccccaccugcccucccuggcagccagg

SEQ ID NO: 189849 - RNA, 64 nt, Homo Sapiens
cagugggaaacacagaugcuaaacuccuggaucuucaccccaucuuaccagaaagaccaaaauu

SEQ ID NO: 189850 - RNA, 64 nt, Homo Sapiens
cgaggcucucuacuggcacagcuucacaucugccucaccccaagguucccucgacucuuucaaa

SEQ ID NO: 189851 - RNA, 64 nt, Homo Sapiens
uggcaggcguaucagagcacauuagugaugcccuucaccccagggaggugucuguucccaacua

SEQ ID NO: 189852 - RNA, 64 nt, Homo Sapiens
uugcaguauuucugccucccuuucuuucugccuuucaccccacuaaauguauguuauugaaugc

SEQ ID NO: 189853 - RNA, 64 nt, Homo Sapiens
ggggacucuuccuggguucuggcuccugcauagcucaccccaccucaucaugagccucaacugc

SEQ ID NO: 189854 - RNA, 64 nt, Homo Sapiens
caaccuaugucacugacucagaugcagggucugcucaccccaacacaugccuucccuccccagc

SEQ ID NO: 189855 - RNA, 64 nt, Homo Sapiens
aggacccuugaagaugcuuuuggcucaccucauuucaccccacgcucugcuggcuggcagagga

SEQ ID NO: 189856 - RNA, 64 nt, Homo Sapiens
cucauuuggugacgucuuacuggugaucaucuccucaccccaucucccaccuuguggaauaaau

SEQ ID NO: 189857 - RNA, 64 nt, Homo Sapiens
gugggccacaucuucugccccuucucagccucccucaccccagccccuuccccuagacccacug

SEQ ID NO: 189858 - RNA, 64 nt, Homo Sapiens
cuccaucccgacuccaucucccccaccaggcuggucaccccaggccagcgucuguugaaggaug

SEQ ID NO: 189859 - RNA, 64 nt, Homo Sapiens
accucacugagccuugaccuagggaaaccccuggucaccccagauggccccggccaccuucccc

SEQ ID NO: 189860 - RNA, 64 nt, Homo Sapiens
cccaggggccaggcucucccccucccgggcagcuucaccccacaugagucuggcucagcagccc

SEQ ID NO: 189861 - RNA, 64 nt, Homo Sapiens
aacuccccuuguacccccuuuuucaacauuuccaucaccccagaccaggucaagacauagaaug

SEQ ID NO: 189862 - RNA, 64 nt, Homo Sapiens
ucaagccauggcaggcguggauaaagaccacuccucaccccagcgucaggaucucccaaagaag

SEQ ID NO: 189863 - RNA, 64 nt, Homo Sapiens
cuuccccuccuucucccuuugcacaucugcauuuucaccccaccacaucuuuuacauucugcaa

SEQ ID NO: 189864 - RNA, 64 nt, Homo Sapiens
ccacacccuggaggauuucaccuaaaaggaaaucucaccccaucccucuuggugaaccuuagua

SEQ ID NO: 189865 - RNA, 64 nt, Homo Sapiens
ucccgcccggaggagaggcaagcugugggucugaucaccccaagucuccagggggcacccuuug

SEQ ID NO: 189866 - RNA, 64 nt, Homo Sapiens
cacugugagggcuucuccagcuuggaggcugaaaucaccccaggggccucgucucaagcccccc

SEQ ID NO: 189867 - RNA, 64 nt, Homo Sapiens
gugcuuuuuggagcuaagccugggaugaccaaauucaccccagcuccuucauucacagggcugg

SEQ ID NO: 189868 - RNA, 64 nt, Homo Sapiens
ucccuucugagccaucugcugcucucucauuucaucaccccaacugucccuuguuuuugaucaa

SEQ ID NO: 189869 - RNA, 60 nt, Homo Sapiens
gcagaaacuauucaguuuuuugcucugaguaacugacaaaaacaacuguuacaguuuuau

SEQ ID NO: 189870 - RNA, 60 nt, Homo Sapiens
auauuuuaaaaauauauaaauacaucguaaaacugacaaacuguggugaauggaugaacg

SEQ ID NO: 189871 - RNA, 60 nt, Homo Sapiens
agaggcgucugcugucucaugacaaaccauaacugacaaggaaggaaaagaagaagagau

SEQ ID NO: 189872 - RNA, 60 nt, Homo Sapiens
gucuaaaugagcacauguauugcuuugacaaacugacaaaauguauuacuuggaaaguuc

SEQ ID NO: 189873 - RNA, 60 nt, Homo Sapiens
ccaaauuaauuggcuuugugaauuaccuguaacugacagaauuauguuuuauuacuuucc

SEQ ID NO: 189874 - RNA, 60 nt, Homo Sapiens
uaccuuuuaaaauuugcacauuccuuacuuaacugacaguaguuuaguuucuucuggacu

SEQ ID NO: 189875 - RNA, 60 nt, Homo Sapiens
aaaaaaguaacuuaaaaacaucauugguggaacugacacaaaguacaagccaaaugauuu

SEQ ID NO: 189876 - RNA, 60 nt, Homo Sapiens
ggucugggcgucugcaccuggggccuagggaacugacacgugggaagcgcagugagccgg

SEQ ID NO: 189877 - RNA, 60 nt, Homo Sapiens
augguuuaaauaccccacagcaaauagaguaacugacaaaccaccaaaaacugaaacccc

SEQ ID NO: 189878 - RNA, 60 nt, Homo Sapiens
cagaccccaaccucccugacuuccuucaguaacugacaguguagcauuguucuugauuag

SEQ ID NO: 189879 - RNA, 60 nt, Homo Sapiens
acccaaaaucacacagcucagaagcagcagaacugacauugggacccagguccauuggag

SEQ ID NO: 189880 - RNA, 64 nt, Homo Sapiens; identical to SEQ ID NO: 189847

SEQ ID NO: 189881 - RNA, 64 nt, Homo Sapiens; identical to SEQ ID NO: 189848

SEQ ID NO: 189882 - RNA, 64 nt, Homo Sapiens; identical to SEQ ID NO: 189849

SEQ ID NO: 189883 - RNA, 64 nt, Homo Sapiens; identical to SEQ ID NO: 189850

SEQ ID NO: 189884 - RNA, 64 nt, Homo Sapiens; identical to SEQ ID NO: 189851

SEQ ID NO: 189885 - RNA, 64 nt, Homo Sapiens; identical to SEQ ID NO: 189852

SEQ ID NO: 189886 - RNA, 64 nt, Homo Sapiens; identical to SEQ ID NO: 189853

SEQ ID NO: 189887 - RNA, 64 nt, Homo Sapiens; identical to SEQ ID NO: 189854

SEQ ID NO: 189888 - RNA, 64 nt, Homo Sapiens; identical to SEQ ID NO: 189855

SEQ ID NO: 189889 - RNA, 64 nt, Homo Sapiens; identical to SEQ ID NO: 189856

SEQ ID NO: 189890 - RNA, 64 nt, Homo Sapiens; identical to SEQ ID NO: 189857

SEQ ID NO: 189891 - RNA, 64 nt, Homo Sapiens; identical to SEQ ID NO: 189858

SEQ ID NO: 189892 - RNA, 64 nt, Homo Sapiens; identical to SEQ ID NO: 189859

SEQ ID NO: 189893 - RNA, 64 nt, Homo Sapiens; identical to SEQ ID NO: 189860

SEQ ID NO: 189894 - RNA, 64 nt, Homo Sapiens; identical to SEQ ID NO: 189861

SEQ ID NO: 189895 - RNA, 64 nt, Homo Sapiens; identical to SEQ ID NO: 189862

SEQ ID NO: 189896 - RNA, 64 nt, Homo Sapiens; identical to SEQ ID NO: 189863

SEQ ID NO: 189897 - RNA, 64 nt, Homo Sapiens; identical to SEQ ID NO: 189864

SEQ ID NO: 189898 - RNA, 64 nt, Homo Sapiens; identical to SEQ ID NO: 189865

SEQ ID NO: 189899 - RNA, 64 nt, Homo Sapiens; identical to SEQ ID NO: 189866

SEQ ID NO: 189900 - RNA, 64 nt, Homo Sapiens; identical to SEQ ID NO: 189867

SEQ ID NO: 189901 - RNA, 64 nt, Homo Sapiens; identical to SEQ ID NO: 189868

SEQ ID NO: 189902 - RNA, 60 nt, Homo Sapiens; identical to SEQ ID NO: 189869

SEQ ID NO: 189903 - RNA, 60 nt, Homo Sapiens; identical to SEQ ID NO: 189870

SEQ ID NO: 189904 - RNA, 60 nt, Homo Sapiens; identical to SEQ ID NO: 189871

SEQ ID NO: 189905 - RNA, 60 nt, Homo Sapiens; identical to SEQ ID NO: 189872

SEQ ID NO: 189906 - RNA, 60 nt, Homo Sapiens; identical to SEQ ID NO: 189873

SEQ ID NO: 189907 - RNA, 60 nt, Homo Sapiens; identical to SEQ ID NO: 189874

SEQ ID NO: 189908 - RNA, 60 nt, Homo Sapiens; identical to SEQ ID NO: 189875

SEQ ID NO: 189909 - RNA, 60 nt, Homo Sapiens; identical to SEQ ID NO: 189876

SEQ ID NO: 189910 - RNA, 60 nt, Homo Sapiens; identical to SEQ ID NO: 189877

SEQ ID NO: 189911 - RNA, 60 nt, Homo Sapiens; identical to SEQ ID NO: 189878

SEQ ID NO: 189912 - RNA, 60 nt, Homo Sapiens; identical to SEQ ID NO: 189879

SEQ ID NO: 189913 - RNA, 64 nt, Homo Sapiens; identical to SEQ ID NO: 189847

SEQ ID NO: 189914 - RNA, 64 nt, Homo Sapiens; identical to SEQ ID NO: 189848

SEQ ID NO: 189915 - RNA, 64 nt, Homo Sapiens; identical to SEQ ID NO: 189849

SEQ ID NO: 189916 - RNA, 64 nt, Homo Sapiens; identical to SEQ ID NO: 189850

SEQ ID NO: 189917 - RNA, 64 nt, Homo Sapiens; identical to SEQ ID NO: 189851

SEQ ID NO: 189918 - RNA, 64 nt, Homo Sapiens; identical to SEQ ID NO: 189852

SEQ ID NO: 189919 - RNA, 64 nt, Homo Sapiens; identical to SEQ ID NO: 189853

SEQ ID NO: 189920 - RNA, 64 nt, Homo Sapiens; identical to SEQ ID NO: 189854

SEQ ID NO: 189921 - RNA, 64 nt, Homo Sapiens; identical to SEQ ID NO: 189855

SEQ ID NO: 189922 - RNA, 64 nt, Homo Sapiens; identical to SEQ ID NO: 189856

SEQ ID NO: 189923 - RNA, 64 nt, Homo Sapiens; identical to SEQ ID NO: 189857

SEQ ID NO: 189924 - RNA, 64 nt, Homo Sapiens; identical to SEQ ID NO: 189858

SEQ ID NO: 189925 - RNA, 64 nt, Homo Sapiens; identical to SEQ ID NO: 189859

SEQ ID NO: 189926 - RNA, 64 nt, Homo Sapiens; identical to SEQ ID NO: 189860

SEQ ID NO: 189927 - RNA, 64 nt, Homo Sapiens; identical to SEQ ID NO: 189861

SEQ ID NO: 189928 - RNA, 64 nt, Homo Sapiens; identical to SEQ ID NO: 189862

SEQ ID NO: 189929 - RNA, 64 nt, Homo Sapiens; identical to SEQ ID NO: 189863

SEQ ID NO: 189930 - RNA, 64 nt, Homo Sapiens; identical to SEQ ID NO: 189864

SEQ ID NO: 189931 - RNA, 64 nt, Homo Sapiens; identical to SEQ ID NO: 189865

SEQ ID NO: 189932 - RNA, 64 nt, Homo Sapiens; identical to SEQ ID NO: 189866

SEQ ID NO: 189933 - RNA, 64 nt, Homo Sapiens; identical to SEQ ID NO: 189867

SEQ ID NO: 189934 - RNA, 64 nt, Homo Sapiens; identical to SEQ ID NO: 189868

SEQ ID NO: 189935 - RNA, 60 nt, Homo Sapiens; identical to SEQ ID NO: 189869

SEQ ID NO: 189936 - RNA, 60 nt, Homo Sapiens; identical to SEQ ID NO: 189870

SEQ ID NO: 189937 - RNA, 60 nt, Homo Sapiens; identical to SEQ ID NO: 189871

SEQ ID NO: 189938 - RNA, 60 nt, Homo Sapiens; identical to SEQ ID NO: 189872

SEQ ID NO: 189939 - RNA, 60 nt, Homo Sapiens; identical to SEQ ID NO: 189873

SEQ ID NO: 189940 - RNA, 60 nt, Homo Sapiens; identical to SEQ ID NO: 189874

SEQ ID NO: 189941 - RNA, 60 nt, Homo Sapiens; identical to SEQ ID NO: 189875

SEQ ID NO: 189942 - RNA, 60 nt, Homo Sapiens; identical to SEQ ID NO: 189876

SEQ ID NO: 189943 - RNA, 60 nt, Homo Sapiens; identical to SEQ ID NO: 189877

SEQ ID NO: 189944 - RNA, 60 nt, Homo Sapiens; identical to SEQ ID NO: 189878

SEQ ID NO: 189945 - RNA, 60 nt, Homo Sapiens; identical to SEQ ID NO: 189879

SEQ ID NO: 189946 - RNA, 64 nt, Homo Sapiens
cugaugaagcaggcagagcucagaggaucuuggcaucacccaccaaaguuagcugaaagcaggg

SEQ ID NO: 189947 - RNA, 64 nt, Homo Sapiens
cagccuuuucagcaucucacccauuagcagccccaucacccagugaucagucgccucaguaaag

SEQ ID NO: 189948 - RNA, 64 nt, Homo Sapiens
aaacaauucugcaaaaaaaggaugaauuuccuccaucacccagauuuauacuuagagucagacg

SEQ ID NO: 189949 - RNA, 64 nt, Homo Sapiens
guauuucgcuguccugaaacuuucagugaaagagaucacccaacaucaauaacuugucauaaua

SEQ ID NO: 189950 - RNA, 64 nt, Homo Sapiens
cuggagugcaguggugcaaucugagucuugcucuaucacccagguuauuaguauuauuuugaga

SEQ ID NO: 189951 - RNA, 64 nt, Homo Sapiens
gaauaggaccaccucugccuccaguaaaagugucaucacccaguguguaaauaaguucaucacc

SEQ ID NO: 189952 - RNA, 64 nt, Homo Sapiens
cuagagugcaguggcacaaaugggucucacucucaucacccaggucucuuucuucuuuauuucu

SEQ ID NO: 189953 - RNA, 64 nt, Homo Sapiens
cuucaguggugauuucugagauuuuggugcacccaucacccaaggguagucuuuuuuauccauc

SEQ ID NO: 189954 - RNA, 64 nt, Homo Sapiens
ucuuuuuuuuuuuuuugagacugagucucauucuaucacccaggcuggaguggagugguaugau

SEQ ID NO: 189955 - RNA, 64 nt, Homo Sapiens; identical to SEQ ID NO: 75208

SEQ ID NO: 189956 - RNA, 64 nt, Homo Sapiens; identical to SEQ ID NO: 75209

SEQ ID NO: 189957 - RNA, 64 nt, Homo Sapiens; identical to SEQ ID NO: 75210

SEQ ID NO: 189958 - RNA, 64 nt, Homo Sapiens; identical to SEQ ID NO: 75211

SEQ ID NO: 189959 - RNA, 64 nt, Homo Sapiens; identical to SEQ ID NO: 75212

SEQ ID NO: 189960 - RNA, 64 nt, Homo Sapiens; identical to SEQ ID NO: 75213

SEQ ID NO: 189961 - RNA, 64 nt, Homo Sapiens; identical to SEQ ID NO: 75214

SEQ ID NO: 189962 - RNA, 64 nt, Homo Sapiens; identical to SEQ ID NO: 75215

SEQ ID NO: 189963 - RNA, 64 nt, Homo Sapiens; identical to SEQ ID NO: 75216

SEQ ID NO: 189964 - RNA, 64 nt, Homo Sapiens; identical to SEQ ID NO: 75217

SEQ ID NO: 189965 - RNA, 64 nt, Homo Sapiens; identical to SEQ ID NO: 75218

SEQ ID NO: 189966 - RNA, 64 nt, Homo Sapiens; identical to SEQ ID NO: 75219

SEQ ID NO: 189967 - RNA, 64 nt, Homo Sapiens; identical to SEQ ID NO: 75220

SEQ ID NO: 189968 - RNA, 64 nt, Homo Sapiens; identical to SEQ ID NO: 75221

SEQ ID NO: 189969 - RNA, 64 nt, Homo Sapiens; identical to SEQ ID NO: 75222

SEQ ID NO: 189970 - RNA, 60 nt, Homo Sapiens; identical to SEQ ID NO: 75223

SEQ ID NO: 189971 - RNA, 64 nt, Homo Sapiens; identical to SEQ ID NO: 75224

SEQ ID NO: 189972 - RNA, 64 nt, Homo Sapiens; identical to SEQ ID NO: 75225

SEQ ID NO: 189973 - RNA, 64 nt, Homo Sapiens; identical to SEQ ID NO: 75226

SEQ ID NO: 189974 - RNA, 64 nt, Homo Sapiens; identical to SEQ ID NO: 75227

SEQ ID NO: 189975 - RNA, 64 nt, Homo Sapiens; identical to SEQ ID NO: 75228

SEQ ID NO: 189976 - RNA, 64 nt, Homo Sapiens; identical to SEQ ID NO: 75229

SEQ ID NO: 189977 - RNA, 64 nt, Homo Sapiens; identical to SEQ ID NO: 75230

SEQ ID NO: 189978 - RNA, 64 nt, Homo Sapiens; identical to SEQ ID NO: 75231

SEQ ID NO: 189979 - RNA, 64 nt, Homo Sapiens; identical to SEQ ID NO: 75232

SEQ ID NO: 189980 - RNA, 64 nt, Homo Sapiens; identical to SEQ ID NO: 75233

SEQ ID NO: 189981 - RNA, 64 nt, Homo Sapiens; identical to SEQ ID NO: 75234

SEQ ID NO: 189982 - RNA, 64 nt, Homo Sapiens; identical to SEQ ID NO: 75235

SEQ ID NO: 189983 - RNA, 64 nt, Homo Sapiens; identical to SEQ ID NO: 75236

SEQ ID NO: 189984 - RNA, 64 nt, Homo Sapiens; identical to SEQ ID NO: 75237

SEQ ID NO: 189985 - RNA, 64 nt, Homo Sapiens; identical to SEQ ID NO: 75238

SEQ ID NO: 189986 - RNA, 64 nt, Homo Sapiens; identical to SEQ ID NO: 75239

SEQ ID NO: 189987 - RNA, 64 nt, Homo Sapiens; identical to SEQ ID NO: 75240

SEQ ID NO: 189988 - RNA, 64 nt, Homo Sapiens; identical to SEQ ID NO: 75241

SEQ ID NO: 189989 - RNA, 64 nt, Homo Sapiens; identical to SEQ ID NO: 75242

SEQ ID NO: 189990 - RNA, 64 nt, Homo Sapiens; identical to SEQ ID NO: 75243

SEQ ID NO: 189991 - RNA, 64 nt, Homo Sapiens; identical to SEQ ID NO: 75244

SEQ ID NO: 189992 - RNA, 64 nt, Homo Sapiens; identical to SEQ ID NO: 75245

SEQ ID NO: 189993 - RNA, 64 nt, Homo Sapiens; identical to SEQ ID NO: 75246

SEQ ID NO: 189994 - RNA, 64 nt, Homo Sapiens
cucuccuuauuacacaagcacagccgcccagugugcacaucaugugcagacaccuuggaaaccu

SEQ ID NO: 189995 - RNA, 64 nt, Homo Sapiens
agcccgaggcccagaugggggcugaacagguagggcacaucaguuaaugccagugaggucagcu

SEQ ID NO: 189996 - RNA, 64 nt, Homo Sapiens
cuuuaaggcauacuuuuacccaguuuuauagauugcacaucauucuacccaagagaaaaugcua

SEQ ID NO: 189997 - RNA, 64 nt, Homo Sapiens
agaggaaaggccagccaagccacuuaaagauuaugcacaucagcaaaaagguacuuagaggucg

SEQ ID NO: 189998 - RNA, 64 nt, Homo Sapiens
gcuuugaaaauauuuugggugauacuuucauuuugcacaucaugcacaucaugguauucagggg

SEQ ID NO: 189999 - RNA, 64 nt, Homo Sapiens
auauuuugggugauacuuucauuuugcacaucaugcacaucaugguauucaggggcuagaguga

SEQ ID NO: 190000 - RNA, 64 nt, Homo Sapiens
gguggaggcugcagugaacagagacagugccacugcacaucagccugagugacagagagacuuu

SEQ ID NO: 190001 - RNA, 64 nt, Homo Sapiens
gguugaugcugggcuguacugguugcuaaauauugcacaucauuuuaaaacuauuugagaugca

SEQ ID NO: 190002 - RNA, 64 nt, Homo Sapiens
ggagaauccacagugaagagaugcuacaaccauugcacaucauuuugucacaaaguuuucagua

SEQ ID NO: 190003 - RNA, 64 nt, Homo Sapiens
auagacuucauacuggagagaaaaagcaaccuuugcacaucaccauguggcaagguuuuuaauc

SEQ ID NO: 190004 - RNA, 64 nt, Homo Sapiens; identical to SEQ ID NO: 93869

SEQ ID NO: 190005 - RNA, 64 nt, Homo Sapiens; identical to SEQ ID NO: 93870

SEQ ID NO: 190006 - RNA, 64 nt, Homo Sapiens; identical to SEQ ID NO: 93871

SEQ ID NO: 190007 - RNA, 64 nt, Homo Sapiens; identical to SEQ ID NO: 93872

SEQ ID NO: 190008 - RNA, 64 nt, Homo Sapiens; identical to SEQ ID NO: 93873

SEQ ID NO: 190009 - RNA, 64 nt, Homo Sapiens; identical to SEQ ID NO: 93874

SEQ ID NO: 190010 - RNA, 64 nt, Homo Sapiens; identical to SEQ ID NO: 93875

SEQ ID NO: 190011 - RNA, 64 nt, Homo Sapiens; identical to SEQ ID NO: 93876

SEQ ID NO: 190012 - RNA, 64 nt, Homo Sapiens; identical to SEQ ID NO: 93877

SEQ ID NO: 190013 - RNA, 64 nt, Homo Sapiens; identical to SEQ ID NO: 93878

SEQ ID NO: 190014 - RNA, 64 nt, Homo Sapiens; identical to SEQ ID NO: 93879

SEQ ID NO: 190015 - RNA, 64 nt, Homo Sapiens; identical to SEQ ID NO: 93880

SEQ ID NO: 190016 - RNA, 64 nt, Homo Sapiens; identical to SEQ ID NO: 93881

SEQ ID NO: 190017 - RNA, 64 nt, Homo Sapiens; identical to SEQ ID NO: 93882

SEQ ID NO: 190018 - RNA, 64 nt, Homo Sapiens; identical to SEQ ID NO: 93883

SEQ ID NO: 190019 - RNA, 64 nt, Homo Sapiens; identical to SEQ ID NO: 93884

SEQ ID NO: 190020 - RNA, 64 nt, Homo Sapiens; identical to SEQ ID NO: 93885

SEQ ID NO: 190021 - RNA, 64 nt, Homo Sapiens; identical to SEQ ID NO: 93886

SEQ ID NO: 190022 - RNA, 64 nt, Homo Sapiens; identical to SEQ ID NO: 93887

SEQ ID NO: 190023 - RNA, 64 nt, Homo Sapiens; identical to SEQ ID NO: 93888

SEQ ID NO: 190024 - RNA, 64 nt, Homo Sapiens; identical to SEQ ID NO: 93889

SEQ ID NO: 190025 - RNA, 64 nt, Homo Sapiens; identical to SEQ ID NO: 93890

SEQ ID NO: 190026 - RNA, 64 nt, Homo Sapiens; identical to SEQ ID NO: 93891

SEQ ID NO: 190027 - RNA, 64 nt, Homo Sapiens; identical to SEQ ID NO: 93892

SEQ ID NO: 190028 - RNA, 64 nt, Homo Sapiens; identical to SEQ ID NO: 93893

SEQ ID NO: 190029 - RNA, 64 nt, Homo Sapiens; identical to SEQ ID NO: 93894

SEQ ID NO: 190030 - RNA, 64 nt, Homo Sapiens; identical to SEQ ID NO: 93895

SEQ ID NO: 190031 - RNA, 64 nt, Homo Sapiens; identical to SEQ ID NO: 93896

SEQ ID NO: 190032 - RNA, 64 nt, Homo Sapiens; identical to SEQ ID NO: 93897

SEQ ID NO: 190033 - RNA, 64 nt, Homo Sapiens; identical to SEQ ID NO: 93898

SEQ ID NO: 190034 - RNA, 64 nt, Homo Sapiens; identical to SEQ ID NO: 93899

SEQ ID NO: 190035 - RNA, 64 nt, Homo Sapiens; identical to SEQ ID NO: 93900

SEQ ID NO: 190036 - RNA, 64 nt, Homo Sapiens; identical to SEQ ID NO: 93901

SEQ ID NO: 190037 - RNA, 64 nt, Homo Sapiens; identical to SEQ ID NO: 93902

SEQ ID NO: 190038 - RNA, 64 nt, Homo Sapiens; identical to SEQ ID NO: 93903

SEQ ID NO: 190039 - RNA, 64 nt, Homo Sapiens; identical to SEQ ID NO: 93904

SEQ ID NO: 190040 - RNA, 64 nt, Homo Sapiens; identical to SEQ ID NO: 93905

SEQ ID NO: 190041 - RNA, 64 nt, Homo Sapiens; identical to SEQ ID NO: 93906

SEQ ID NO: 190042 - RNA, 64 nt, Homo Sapiens; identical to SEQ ID NO: 93907

SEQ ID NO: 190043 - RNA, 64 nt, Homo Sapiens; identical to SEQ ID NO: 93908

SEQ ID NO: 190044 - RNA, 64 nt, Homo Sapiens; identical to SEQ ID NO: 93909

SEQ ID NO: 190045 - RNA, 64 nt, Homo Sapiens; identical to SEQ ID NO: 93910

SEQ ID NO: 190046 - RNA, 64 nt, Homo Sapiens; identical to SEQ ID NO: 93911

SEQ ID NO: 190047 - RNA, 64 nt, Homo Sapiens; identical to SEQ ID NO: 93912

SEQ ID NO: 190048 - RNA, 64 nt, Homo Sapiens; identical to SEQ ID NO: 93913

SEQ ID NO: 190049 - RNA, 64 nt, Homo Sapiens; identical to SEQ ID NO: 93914

SEQ ID NO: 190050 - RNA, 64 nt, Homo Sapiens; identical to SEQ ID NO: 93915

SEQ ID NO: 190051 - RNA, 64 nt, Homo Sapiens; identical to SEQ ID NO: 93916

SEQ ID NO: 190052 - RNA, 64 nt, Homo Sapiens; identical to SEQ ID NO: 93917

SEQ ID NO: 190053 - RNA, 64 nt, Homo Sapiens; identical to SEQ ID NO: 93918

SEQ ID NO: 190054 - RNA, 64 nt, Homo Sapiens; identical to SEQ ID NO: 93919

SEQ ID NO: 190055 - RNA, 64 nt, Homo Sapiens; identical to SEQ ID NO: 93920

SEQ ID NO: 190056 - RNA, 64 nt, Homo Sapiens; identical to SEQ ID NO: 93921

SEQ ID NO: 190057 - RNA, 64 nt, Homo Sapiens; identical to SEQ ID NO: 93922

SEQ ID NO: 190058 - RNA, 64 nt, Homo Sapiens; identical to SEQ ID NO: 93923

SEQ ID NO: 190059 - RNA, 64 nt, Homo Sapiens; identical to SEQ ID NO: 93924

SEQ ID NO: 190060 - RNA, 64 nt, Homo Sapiens; identical to SEQ ID NO: 93925

SEQ ID NO: 190061 - RNA, 64 nt, Homo Sapiens; identical to SEQ ID NO: 93926

SEQ ID NO: 190062 - RNA, 64 nt, Homo Sapiens; identical to SEQ ID NO: 93927

SEQ ID NO: 190063 - RNA, 64 nt, Homo Sapiens; identical to SEQ ID NO: 93928

SEQ ID NO: 190064 - RNA, 64 nt, Homo Sapiens; identical to SEQ ID NO: 93929

SEQ ID NO: 190065 - RNA, 64 nt, Homo Sapiens; identical to SEQ ID NO: 93930

SEQ ID NO: 190066 - RNA, 64 nt, Homo Sapiens; identical to SEQ ID NO: 93931

SEQ ID NO: 190067 - RNA, 64 nt, Homo Sapiens; identical to SEQ ID NO: 93932

SEQ ID NO: 190068 - RNA, 64 nt, Homo Sapiens; identical to SEQ ID NO: 93933

SEQ ID NO: 190069 - RNA, 64 nt, Homo Sapiens; identical to SEQ ID NO: 93934

SEQ ID NO: 190070 - RNA, 64 nt, Homo Sapiens; identical to SEQ ID NO: 93935

SEQ ID NO: 190071 - RNA, 64 nt, Homo Sapiens; identical to SEQ ID NO: 93936

SEQ ID NO: 190072 - RNA, 64 nt, Homo Sapiens; identical to SEQ ID NO: 93937

SEQ ID NO: 190073 - RNA, 64 nt, Homo Sapiens; identical to SEQ ID NO: 93938

SEQ ID NO: 190074 - RNA, 64 nt, Homo Sapiens; identical to SEQ ID NO: 93939

SEQ ID NO: 190075 - RNA, 64 nt, Homo Sapiens; identical to SEQ ID NO: 48511

SEQ ID NO: 190076 - RNA, 64 nt, Homo Sapiens; identical to SEQ ID NO: 48512

SEQ ID NO: 190077 - RNA, 64 nt, Homo Sapiens; identical to SEQ ID NO: 48513

SEQ ID NO: 190078 - RNA, 64 nt, Homo Sapiens; identical to SEQ ID NO: 48514

SEQ ID NO: 190079 - RNA, 64 nt, Homo Sapiens; identical to SEQ ID NO: 48515

SEQ ID NO: 190080 - RNA, 64 nt, Homo Sapiens; identical to SEQ ID NO: 48516

SEQ ID NO: 190081 - RNA, 64 nt, Homo Sapiens; identical to SEQ ID NO: 48517

SEQ ID NO: 190082 - RNA, 64 nt, Homo Sapiens; identical to SEQ ID NO: 48518

SEQ ID NO: 190083 - RNA, 64 nt, Homo Sapiens; identical to SEQ ID NO: 48519

SEQ ID NO: 190084 - RNA, 64 nt, Homo Sapiens; identical to SEQ ID NO: 48520

SEQ ID NO: 190085 - RNA, 64 nt, Homo Sapiens; identical to SEQ ID NO: 48521

SEQ ID NO: 190086 - RNA, 64 nt, Homo Sapiens; identical to SEQ ID NO: 48522

SEQ ID NO: 190087 - RNA, 64 nt, Homo Sapiens; identical to SEQ ID NO: 48523

SEQ ID NO: 190088 - RNA, 64 nt, Homo Sapiens; identical to SEQ ID NO: 48524

SEQ ID NO: 190089 - RNA, 64 nt, Homo Sapiens; identical to SEQ ID NO: 48525

SEQ ID NO: 190090 - RNA, 64 nt, Homo Sapiens; identical to SEQ ID NO: 48526

SEQ ID NO: 190091 - RNA, 64 nt, Homo Sapiens; identical to SEQ ID NO: 48527

SEQ ID NO: 190092 - RNA, 64 nt, Homo Sapiens; identical to SEQ ID NO: 48528

SEQ ID NO: 190093 - RNA, 64 nt, Homo Sapiens
uccuucgucgaucccuaauuggccaggccugacccucuuggaccuuucuucuuugccgacaacc

SEQ ID NO: 190094 - RNA, 64 nt, Homo Sapiens
ccaguccagccuccuggcuguugacuucccauugcucuuggagccaccaaucaaagagauucaa

SEQ ID NO: 190095 - RNA, 64 nt, Homo Sapiens
cugucaggaacuccucacugaaugugcugggaaccucuuggagcucuaccagacucuaccucug

SEQ ID NO: 190096 - RNA, 64 nt, Homo Sapiens
cagggcccaggagaacaaaggaguucugugcugucucuuggagguuccuggaugugcccucucu

SEQ ID NO: 190097 - RNA, 64 nt, Homo Sapiens
gacugaucuuuccaaaauauuggaaaggagcucacucuuggaaaggguuuccuguccagcuucu

SEQ ID NO: 190098 - RNA, 64 nt, Homo Sapiens
uuguuuuuucagauccacaucccauuuugcuucucucuuggauucucuuauugcacacccccag

SEQ ID NO: 190099 - RNA, 64 nt, Homo Sapiens
uuuuuugcauagcaauuaaaaugugcaagauccucucuuggagcaagagaacuccaguguugcu

SEQ ID NO: 190100 - RNA, 64 nt, Homo Sapiens
ucauccauccauuguguucuuuauuugggguucgcucuuggaucaauauguaguaaacucucau

SEQ ID NO: 190101 - RNA, 64 nt, Homo Sapiens
guuucaggccugugcaugugucauucuuauggugcucuuggagaucuagaugagguaaagggaa

SEQ ID NO: 190102 - RNA, 64 nt, Homo Sapiens
ugcugagcaugaucccuauuuacaaaugaccuugcucuuggauugaagaagucagagcaaugga

SEQ ID NO: 190103 - RNA, 64 nt, Homo Sapiens
aagcuaugaagucaccuggagaaaaggaacguugcucuuggacagcaagcaaaccauuucucuc

SEQ ID NO: 190104 - RNA, 64 nt, Homo Sapiens
agaaauagagacgugucaacagaugcauucauuucucuuggaauguguauuguuuuuauuuugc

SEQ ID NO: 190105 - RNA, 64 nt, Homo Sapiens
uuaaaggacagggcauugauacuggggacugugacucuuggagagagcugggcaaacagguccc

SEQ ID NO: 190106 - RNA, 64 nt, Homo Sapiens
cagguucacggggcuguuucuaugguuguaggcccucuuggagccagggcccaccaugucgggg

SEQ ID NO: 190107 - RNA, 64 nt, Homo Sapiens
uaaaggaguccuggguaaaauucaggguccauuucucuuggaugaucagcuaggagaccaguua

SEQ ID NO: 190108 - RNA, 64 nt, Homo Sapiens
gaauuuugugcuuuuuauugucauaagcccccugcucuuggacuaauacuuuaauuugugcauu

SEQ ID NO: 190109 - RNA, 64 nt, Homo Sapiens
uacagagaaagguuuuagacuccaguuuaccuuucucuuggagaaacucaaugcuaaucccacc

SEQ ID NO: 190110 - RNA, 64 nt, Homo Sapiens
uauuuuaguucuuuaaauauauaggcagaugcuucucuuggaauccagaucaucuggcugaagc

SEQ ID NO: 190111 - RNA, 64 nt, Homo Sapiens
acuaccuagauccccagcuucuucucccuccagacucuuggauggcuguggaaguaacaaauuu

SEQ ID NO: 190112 - RNA, 64 nt, Homo Sapiens
gagucugcgggcuucucugacccagaaaaagaaacucuuggagggcaacggcccugccccaagc

SEQ ID NO: 190113 - RNA, 64 nt, Homo Sapiens
aacaagaauuuggaaacaggaauaacugucuguacucuuggagugagguuuugcauuuuaggua

SEQ ID NO: 190114 - RNA, 64 nt, Homo Sapiens
aucccgcauggguucgaggucugugggaauugcacucuuggaagacuuccuugagcaaguggag

SEQ ID NO: 190115 - RNA, 64 nt, Homo Sapiens
augugacgagacuuuugaaaaaauggugaacacacucuuggagagguaaauaguaaauaaggcc

SEQ ID NO: 190116 - RNA, 64 nt, Homo Sapiens
cuaccuuguauugugauauuaacuggcaaagauccucuuggagaaaccuuucccagguacaguu

SEQ ID NO: 190117 - RNA, 64 nt, Homo Sapiens
auuuuuggcuuuauauaaaaacacagugaauaaccucuuggaguaaucuucuagcacuuuguaa

SEQ ID NO: 190118 - RNA, 64 nt, Homo Sapiens
cacagaggguuucaccuugggagaauggggaggccucuuggagaccagaaccuccuucucuuug

SEQ ID NO: 190119 - RNA, 64 nt, Homo Sapiens
uccacccugggcugcuaccgcuucuauuuaaggauguagagaguaauccauagggaccauggug

SEQ ID NO: 190120 - RNA, 64 nt, Homo Sapiens
ccgauacuucuuggugugcaagaggaaggguaccuguagagagcuucuuuuuguuucuaccugg

SEQ ID NO: 190121 - RNA, 64 nt, Homo Sapiens
uccaaauuuaaagaaaaaaacaaaucaggagugguguagagacaaauagaucuauuuaguccua

SEQ ID NO: 190122 - RNA, 64 nt, Homo Sapiens
uaauauggaauuagcagcuaaaauuuucaagguguguagagaaaaaggguaccaguaauacacu

SEQ ID NO: 190123 - RNA, 64 nt, Homo Sapiens
cauuuuggaaggacuuuugaggaaugaugugauguguagagaauagaaagauuuagauauaugc

SEQ ID NO: 190124 - RNA, 64 nt, Homo Sapiens
auuguucucacuaaaguucuaaaauaauagcaaguguagagaagagccguugcuuugaaaauac

SEQ ID NO: 190125 - RNA, 64 nt, Homo Sapiens
cccagacagggucauggggcucagaccagcccacuguagagaaucacucugaggcuccaacuuc

SEQ ID NO: 190126 - RNA, 64 nt, Homo Sapiens
aauauuuauuuucuuguauuagaaaagauuccuuuguagagaaaaaauguauuuuucauuaacg

SEQ ID NO: 190127 - RNA, 64 nt, Homo Sapiens
guggaauuggcacuguggacgugguuguagagauuguagagaggcaccaagauggcgagccagu

SEQ ID NO: 190128 - RNA, 64 nt, Homo Sapiens
guagagaggguggaauuggccgagccagugugguuguagagauugccaggaaacaccaagaugg

SEQ ID NO: 190129 - RNA, 64 nt, Homo Sapiens
uuauuacaaagugauuuucugcuuuuuuaccuuauguagagauccuuuugggggccuauuuugu

SEQ ID NO: 190130 - RNA, 64 nt, Homo Sapiens
ggguuucaccauguuggcuguuuuuuguauuuuuuguagagauggugccugcccccauggcuaa

SEQ ID NO: 190131 - RNA, 64 nt, Homo Sapiens
cugcauuaacccagaaauaccucgcuucuaucugugcacuuagcugggaacuuacccacuguaa

SEQ ID NO: 190132 - RNA, 64 nt, Homo Sapiens
gcguccuggcuccaguuggaacacuuuccugagaugcacuuacuucucagcuucugcgaucaga

SEQ ID NO: 190133 - RNA, 64 nt, Homo Sapiens
caagggcccaaaugcauaaguuucuuugcacuguugcacuuacuuaauacaaauaaauguuuuu

SEQ ID NO: 190134 - RNA, 64 nt, Homo Sapiens
acuacuguucaguuuuuuaaaaguuuugaaaugcugcacuuacauuuaaaaaaacaacaacaac

SEQ ID NO: 190135 - RNA, 64 nt, Homo Sapiens
ucaccauuucccccugcucccccacagccgguucugcacuuaucaccgagucgccccuggaagc

SEQ ID NO: 190136 - RNA, 64 nt, Homo Sapiens
uugaccaagaaauuggguuucuuuucccucagccugcacuuacucuucuauuaagaccagaaaa

SEQ ID NO: 190137 - RNA, 64 nt, Homo Sapiens
cauccuucuucucuguguuuucugguuuaaaagcugcacuuauauuuuagccuuauuauuuucu

SEQ ID NO: 190138 - RNA, 64 nt, Homo Sapiens
aaugaaaugaugucauaagcgaucacuuccuauaugcacuuauucucaagaagaacaucuuuau

SEQ ID NO: 190139 - RNA, 64 nt, Homo Sapiens
ugaaaauuguuuuauuucaggcauguucccuuugugcacuuagguucauugugccucaguuccu

SEQ ID NO: 190140 - RNA, 64 nt, Homo Sapiens
aucucuguaaaauaauuggaaugaaaauacuucuugcacuuaaacacugcacaugccguacuuu

SEQ ID NO: 190141 - RNA, 64 nt, Homo Sapiens
uuuucuuuagugggggaggguaagaaaagcaguuugcacuuaaaaagaaaaaaaaaaaacgggu

SEQ ID NO: 190142 - RNA, 64 nt, Homo Sapiens
aaaagcauuuugcacaguguuuguuuuccugucuugcacuuacaaauaaggucuaugggaguag

SEQ ID NO: 190143 - RNA, 64 nt, Homo Sapiens
ucccuugugcuggccagauggucacuuagcagauugcacuuaagaggaagacagucuuagcacu

SEQ ID NO: 190144 - RNA, 64 nt, Homo Sapiens
ccucaugguucuaguaaacggcuagaaugcuaauugcacuuaggucugaggggcuguccagucu

SEQ ID NO: 190145 - RNA, 64 nt, Homo Sapiens
uuuuuggggggugggaauguuuagaaguugauuuugcacuuauuacuuguuugagcucuugagc

SEQ ID NO: 190146 - RNA, 64 nt, Homo Sapiens
ggucuguuucucagcaucauugaugcaguguggcugcacuuaaggugaggcugacacgucugug

SEQ ID NO: 190147 - RNA, 64 nt, Homo Sapiens
gcauggucagaccacgucacgaguaauugcuguuugcacuuacugccaguauucuaagacauuu

SEQ ID NO: 190148 - RNA, 64 nt, Homo Sapiens
ccuguuucuaaauuauauauuuguacaaagaaaaugcacuuaaauuuuuacaugugauagucag

SEQ ID NO: 190149 - RNA, 64 nt, Homo Sapiens
cccaccaccuggggacccccgguggguuugaaucugcacuuaucgguucagccagucagugacu

SEQ ID NO: 190150 - RNA, 64 nt, Homo Sapiens
cggaggagggcgcagggugggcagaaguuuugaaugcacuuaaccaugacuaggaguguuaggg

SEQ ID NO: 190151 - RNA, 64 nt, Homo Sapiens
guccccuuuuuaguuuuuuuuuucuuuuuuaucuugcacuuauuuaauuucauacuauuuagau

SEQ ID NO: 190152 - RNA, 64 nt, Homo Sapiens
guugcuuucaguaacauuuuuugauuucauuccaugcacuuagacguagcagcuuagauuaacg

SEQ ID NO: 190153 - RNA, 64 nt, Homo Sapiens
uuuuggagcaaauugacaugaaaucaacacuuucugcacuuaucccuccuugggcucuucccgc

SEQ ID NO: 190154 - RNA, 64 nt, Homo Sapiens
ggcuguugagggccacuuuuuugcuaaagcacuuugcacuuaauagugcaggugacagcaggac

SEQ ID NO: 190155 - RNA, 64 nt, Homo Sapiens
cauagauuuaaguaaacagauguauuuugcacagugcacuuaugucuauuuuaacaauccuccu

SEQ ID NO: 190156 - RNA, 64 nt, Homo Sapiens
aaucacgucuuuuguuaugcuaguaucagucagaugcacuuagagugaagaaacacuguaauua

SEQ ID NO: 190157 - RNA, 64 nt, Homo Sapiens
gaaaacaguucuuguggccuucuauuaaauaguuugcacuuaagccuugccaguguucugagcu

SEQ ID NO: 190158 - RNA, 64 nt, Homo Sapiens
uucuuacugccaucauuauuuguuaaagauauuuugcacuuaauuuugugggaaaaauauugcu

SEQ ID NO: 190159 - RNA, 64 nt, Homo Sapiens
acacgguucuaauuaagugugaagguauagcuauugcacuuaugccaucuccaaaauuucuuaa

SEQ ID NO: 190160 - RNA, 64 nt, Homo Sapiens
accccacccaucacauggcuggcuggcugcugggugcacuuacccuccuuggcuugguuacuuc

SEQ ID NO: 190161 - RNA, 64 nt, Homo Sapiens
cugcacaggccucagcuuugaagaacggagucuuugcacuuacacacacucuuccuguucugcc

SEQ ID NO: 190162 - RNA, 64 nt, Homo Sapiens
guuugcagcggaucacuggacaucaaagauucauugcacuuaugaacaaggaaccuucuuuuca

SEQ ID NO: 190163 - RNA, 64 nt, Homo Sapiens
aagggagaauuuuagacuuaauuuuuaacucuauugcacuuaaagauuuuaguuagguuaccac

SEQ ID NO: 190164 - RNA, 64 nt, Homo Sapiens
uuacaucuaaauuacaacccuuaauugccacgugugcacuuacuacucuccaguaugucuuauu

SEQ ID NO: 190165 - RNA, 64 nt, Homo Sapiens
auacaaauuuaguuuaaguguuugaacaacuauaugcacuuacgguuguguguuuaaaaugucu

SEQ ID NO: 190166 - RNA, 64 nt, Homo Sapiens
cguaaaaagauauuucuaauuuacuguugcccauugcacuuacauaccaccaccaagaaagccu

SEQ ID NO: 190167 - RNA, 64 nt, Homo Sapiens
uguuuaaaauuuuugugcaauucauauauuaaauugcacuuacuugcauacgcucauauucuag

SEQ ID NO: 190168 - RNA, 64 nt, Homo Sapiens
uuguccuauauauccguacggccagucgacuauuugcacuuaccggucauuguccccacaaugu

SEQ ID NO: 190169 - RNA, 64 nt, Homo Sapiens
ugcuuauuugacaacguuuccagcccagggcuccugcacuuacucugcagaggccagaggcccc

SEQ ID NO: 190170 - RNA, 64 nt, Homo Sapiens
aaaucauguaaauaugucacauuugugacaaguuugcacuuacaagucaagcaagacuuuguga

SEQ ID NO: 190171 - RNA, 64 nt, Homo Sapiens
acacccuucaacaaaaucuacauauggauaaaguugcacuuauaaaaaugccuuaaaaggaaug

SEQ ID NO: 190172 - RNA, 64 nt, Homo Sapiens
uaugccaaaaaaaguuugaacagguuaucaaguuugcacuuaacauggagaguugugacaagua

SEQ ID NO: 190173 - RNA, 64 nt, Homo Sapiens
ugaaaaccuuuucagugaugaaguccuugguguuugcacuuaaaggccugauggagugagaaga

SEQ ID NO: 190174 - RNA, 64 nt, Homo Sapiens
aguuuuuacaaaacugcuuuuuauuuauuacuugugcacuuaguuuuauacacaacuuugcaaa

SEQ ID NO: 190175 - RNA, 64 nt, Homo Sapiens
gugauuguacauauuguacaugcuuugcacagcuugcacuuacaugaauuaguguucuagacuc

SEQ ID NO: 190176 - RNA, 64 nt, Homo Sapiens
uaucaaucauuuuccuuuuucuagguagucagucugcacuuaaauaagucuuuuuuuuuuuugu

SEQ ID NO: 190177 - RNA, 64 nt, Homo Sapiens
ggaaguuacaucaggcaagugccuucauuauccuugcacuuaacuuauaaucacaggagacucu

SEQ ID NO: 190178 - RNA, 64 nt, Homo Sapiens
cuguaauuuuauuuguucuuucagaaauguaguuugcacuuaaguaugucuaccuggcagauac

SEQ ID NO: 190179 - RNA, 64 nt, Homo Sapiens
aucccaccuuuccucaaaugacaugaagaaauacugcacuuacaccuaugaaguaaagaacugc

SEQ ID NO: 190180 - RNA, 64 nt, Homo Sapiens
auuggcuugcuucaguuguuguagugccauaaucugcacuuagcaagagaucuguuauuuucag

SEQ ID NO: 190181 - RNA, 64 nt, Homo Sapiens
caucuucuagccuuaugaccuguauucuaccacuugcacuuacuagcauacaauuugagcaugc

SEQ ID NO: 190182 - RNA, 64 nt, Homo Sapiens
aauaauugagaagaaaaacugugcuuuguuuccgugcacuuaaaugagcgugacacucauuuua

SEQ ID NO: 190183 - RNA, 64 nt, Homo Sapiens
aucaggguaauuguauugagaacucaaauauacgugcacuuacaugugugguucguacucaagu

SEQ ID NO: 190184 - RNA, 64 nt, Homo Sapiens
ucuuauaaauggagcacuuagaaauuuguuguucugcacuuaaccuagagagagaaaaaaugcu

SEQ ID NO: 190185 - RNA, 64 nt, Homo Sapiens
uuacaauuaaaaccucauuuuuuuuuuccauuuuugcacuuaacagugaugaauacuuuuacgu

SEQ ID NO: 190186 - RNA, 64 nt, Homo Sapiens
auaauuucuuaauuuaaaaugauagcacuucucuugcacuuaagaauggcauccauaagauucu

SEQ ID NO: 190187 - RNA, 64 nt, Homo Sapiens
cugugauuccacuggcggaggauucuuggaagcuugcacuuaguuuccccugacuucaccccau

SEQ ID NO: 190188 - RNA, 64 nt, Homo Sapiens
aaauuagaagcggauuuggaaaugcaaacuaacgugcacuuagauauccaagugggugagcuua

SEQ ID NO: 190189 - RNA, 64 nt, Homo Sapiens
auuuaauuaaaaaggcaaaaccugaaccaccuucugcacuuaaagaagucuaacaguacaaaua

SEQ ID NO: 190190 - RNA, 64 nt, Homo Sapiens
guauccagccuucacuccagcugguuaaaaauguugcacuuaucagcaacccuaccacuuucau

SEQ ID NO: 190191 - RNA, 64 nt, Homo Sapiens
uuauucaagaaaaugaacaugcucuucaaaaagaugcacuuaguauuaaguugaaacuugaaca

SEQ ID NO: 190192 - RNA, 64 nt, Homo Sapiens
ggcucuauaaauuaaguuugugcuuuccuugaaaugcacuuauucuuauuacaagcauuuuaua

SEQ ID NO: 190193 - RNA, 64 nt, Homo Sapiens
uuuaaaauguaauuuaaaugaaagaaaauugaguugcacuuauugaccauuuuuuaauuuacuu

SEQ ID NO: 190194 - RNA, 64 nt, Homo Sapiens
aaaaguggacagcuucugcccagcaacgaacaccugcacuuagagaggaggagcacaagauccu

SEQ ID NO: 190195 - RNA, 64 nt, Homo Sapiens
ugacucauguguccucuuaguugucugaguuaaaugcacuuauguauuucauuaggaucuaaag

SEQ ID NO: 190196 - RNA, 64 nt, Homo Sapiens
cguaugucuugcaugcuuagacauuucacucaguugcacuuagugauuaaaauuuaaaaaaaaa

SEQ ID NO: 190197 - RNA, 64 nt, Homo Sapiens
agaaccacccacaccucucuccuguugguuauugugcacuuaaagaauuuuuccaggagggaga

SEQ ID NO: 190198 - RNA, 64 nt, Homo Sapiens
acuuugguuccacaucugucagaugcuugaaauaugcacuuagcgcuuuaaacauauucagaac

SEQ ID NO: 190199 - RNA, 64 nt, Homo Sapiens
acccuuaugcgcuaauuuugguguuuacuucccaugcacuuaauauuuuaaguguaacauaacu

SEQ ID NO: 190200 - RNA, 64 nt, Homo Sapiens
caacacagucugcugcuauauagugggggaagcgugcacuuauuucuaaacauggguuuuuaac

SEQ ID NO: 190201 - RNA, 64 nt, Homo Sapiens
gcuuucauugucuucaucuuccugccauacuuugugcacuuauugcucuccuucugagucagga

SEQ ID NO: 190202 - RNA, 64 nt, Homo Sapiens
uugcagccagucacuguguaaagccucucugaugugcacuuaagaguggguugcuuucucacaa

SEQ ID NO: 190203 - RNA, 64 nt, Homo Sapiens
gaaggcaucagucccuauguauuugcaguucaccugcacuuaaggcacucuguuauuuagacuc

SEQ ID NO: 190204 - RNA, 64 nt, Homo Sapiens
gcagaaugaaaccacauuuuuugguuugauaauaugcacuuauugacucccacucauuguuaug

SEQ ID NO: 190205 - RNA, 64 nt, Homo Sapiens
guugcaauuuagcuugcuuucaagcuucaccccuugcacuuaacauaagcuauuuuuggcauug

SEQ ID NO: 190206 - RNA, 64 nt, Homo Sapiens
uuuaauaauguauauucuuucaugcuuuuuucugugcacuuaccuaagugugaauauguaaagg

SEQ ID NO: 190207 - RNA, 64 nt, Homo Sapiens
uuaguagguucuguuacaguuuuucuuuugaucgugcacuuauagucuucauuuaauuccucau

SEQ ID NO: 190208 - RNA, 64 nt, Homo Sapiens
uguauuuguggaaauugguauuaucucuguuuuaugcacuuacauuuaucccuuacauuuuguu

SEQ ID NO: 190209 - RNA, 64 nt, Homo Sapiens
aaaauaauuuguuuuugcaaccuauggcuuguuuugcacuuaaucagagcuaauauauuuauug

SEQ ID NO: 190210 - RNA, 64 nt, Homo Sapiens
uauuuugaccacaagggggaugacauuucacagaugcacuuacaaaacaccggcauaagaaauu

SEQ ID NO: 190211 - RNA, 64 nt, Homo Sapiens
gcaauuuucaaauguacucaaugcugucuagucaugcacuuaaaacauaugcaaucacucguuu

SEQ ID NO: 190212 - RNA, 64 nt, Homo Sapiens
uuucaguaguagucuugacuguucuugauagaacugcacuuaauacgcgugcaguucauuucua

SEQ ID NO: 190213 - RNA, 64 nt, Homo Sapiens
uuuuguauaauuuguguuucuuuuuauuuuugauugcacuuaaaaaccguuuauuuaacauaua

SEQ ID NO: 190214 - RNA, 64 nt, Homo Sapiens
ggaugccucauagacgaugagcccuggccacagcugcacuuacaggaauugauugcauaugcaa

SEQ ID NO: 190215 - RNA, 64 nt, Homo Sapiens
ccauuguuuaaauuuacaacguuuuacaauacauugcacuuaauauacaauuauugaaugaagc

SEQ ID NO: 190216 - RNA, 64 nt, Homo Sapiens
uuaggaagugacuugaauguacaaagauacuugaugcacuuauuuuuuaaugugagacagcaag

SEQ ID NO: 190217 - RNA, 64 nt, Homo Sapiens
uuacuguguuauuuaaaugcuaagccaaaguaucugcacuuagguauaccucuuuaugccaaua

SEQ ID NO: 190218 - RNA, 64 nt, Homo Sapiens
acaaaaagacaaaugauuguaggauccauggaagugcacuuaggcuugcugugguggaggccau

SEQ ID NO: 190219 - RNA, 64 nt, Homo Sapiens
gguggagaguggcaggaagcaagcauguuugcugugcacuuaggaaaggcuggugagccagagg

SEQ ID NO: 190220 - RNA, 64 nt, Homo Sapiens
aagcuaaauuugucccuuuuuuauuguuauuaauugcacuuaacauuuuuaguuauacuggaua

SEQ ID NO: 190221 - RNA, 64 nt, Homo Sapiens
aaauuguguucuuaaaauauuguguaagaaucacugcacuuagcuguuggaauguuguuaaaug

SEQ ID NO: 190222 - RNA, 64 nt, Homo Sapiens
uguaaaaauuggguaaauuuacuacugaggggagugcacuuauuuauuuaacuuacuuaucugg

SEQ ID NO: 190223 - RNA, 64 nt, Homo Sapiens
ccagcucugcccuuggggggaacagaagagcuggugcacuuaaucaagaucuggggcugcagag

SEQ ID NO: 190224 - RNA, 64 nt, Homo Sapiens
cguacucaagggagcgcgccugccuggugaauucugcacuuacagggccguggggucucagggg

SEQ ID NO: 190225 - RNA, 64 nt, Homo Sapiens
acacuuugcuuguauuuuaaaaggaggauauauuugcacuuauguauacuuuuacaguuugcca

SEQ ID NO: 190226 - RNA, 64 nt, Homo Sapiens
ugauuaaauaauacauuuauaaucuacaacuguuugcacuuacagcuuuuuuuguaaauauaaa

SEQ ID NO: 190227 - RNA, 64 nt, Homo Sapiens
cccccaugauguaaguuuaccuauguaacaaaccugcacuuauacccaugaacuuaaaaugaaa

SEQ ID NO: 190228 - RNA, 64 nt, Homo Sapiens
ggcaaagccuaguagagaaccagugcaccucaggugcacuuacauaugguggggcugaggcaaa

SEQ ID NO: 190229 - RNA, 64 nt, Homo Sapiens
caucaaacaaaaaauaaaucucgaagaaaaaaaaugcacuuacaugugcuuauuuggcuuuucu

SEQ ID NO: 190230 - RNA, 64 nt, Homo Sapiens
uguggcacuucaaaaggcagcaccacugggcgccugcacuuauuugaaaauggaacuuugggag

SEQ ID NO: 190231 - RNA, 64 nt, Homo Sapiens
gcaauuuucucuuggugcuaccugauggaauuccugcacuuaaaguucuggcugacuaaacaag

SEQ ID NO: 190232 - RNA, 64 nt, Homo Sapiens
cugggagggcaaaaaaaaaaaaaaaguuuuuaugugcacuuaaauuuggggacaauuuuaugua

SEQ ID NO: 190233 - RNA, 64 nt, Homo Sapiens
ggaaggcuucugacgcuuguggccagacugcaauugcacuuauguguuaugcuacuaauauuug

SEQ ID NO: 190234 - RNA, 54 nt, Homo Sapiens
gugcacucggccauuucccuagggugcacuuaccgcagguucucaucgccauaa

SEQ ID NO: 190235 - RNA, 64 nt, Homo Sapiens
auuagcuugcuuaaggcauaguugugguuuuuagugcacuuaauaggucauagauucuugagcu

SEQ ID NO: 190236 - RNA, 64 nt, Homo Sapiens
aaaucaucccagcuaaguucgacacaggaucagcugcacuuaagccacaugcacacagaacucu

SEQ ID NO: 190237 - RNA, 64 nt, Homo Sapiens
aaccaucuauugaauacacauuacugguuuaauuugcacuuauuaagcuacauugacgagacac

SEQ ID NO: 190238 - RNA, 64 nt, Homo Sapiens
cauuaguuaaaaaaagauaaagaguaucuuauucugcacuuaugguaaacaagauauuuaaacu

SEQ ID NO: 190239 - RNA, 64 nt, Homo Sapiens
uugauuugaauuaauuuugguuaaaaauaaacucugcacuuauuugucauagcuaugacauuug

SEQ ID NO: 190240 - RNA, 64 nt, Homo Sapiens
gcaaauaccaauaauuaagaacuuggucucgucuugcacuuaguccgagggcaggaguggcuca

SEQ ID NO: 190241 - RNA, 64 nt, Homo Sapiens
uagaaccucauuuuuaaagacaccacugaaacccugcacuuagcuguucacauggucaaaauuu

SEQ ID NO: 190242 - RNA, 64 nt, Homo Sapiens
uuuuuuuuccuauuuuucuucuuuuugcuuuuuuugcacuuaucagaaauauuugaugugugca

SEQ ID NO: 190243 - RNA, 64 nt, Homo Sapiens
cugauuuagaagagacucuuugcugaaauugaauugcacuuauacauguaaauugucaacaugu

SEQ ID NO: 190244 - RNA, 64 nt, Homo Sapiens
aguuuuucauuuuaaaaaguccauaccuuauauaugcacuuaauuuguuggggcuuuacauacu

SEQ ID NO: 190245 - RNA, 64 nt, Homo Sapiens
caauuccaccagggccagagcagcuccaccacugugcacuuagccaugauggcaacagaaacca

SEQ ID NO: 190246 - RNA, 64 nt, Homo Sapiens
auucuucaaccagaaaaaccuauuguucuaaaagugcacuuaagagaugggauuacaaguggac

SEQ ID NO: 190247 - RNA, 64 nt, Homo Sapiens
uugucaucauaaucuuuauggugggggcagacuuugcacuuacugcagugcaacacuugcacuu

SEQ ID NO: 190248 - RNA, 64 nt, Homo Sapiens
augaauguucuuuucaaaaaauaaaguagaaaaaugcacuuacuaagaacaugaaaaaaaauga

SEQ ID NO: 190249 - RNA, 64 nt, Homo Sapiens
gauaaacuauaauuguagaaagggguaauuucugugcacuuacaacaagcugaguguucauguu

SEQ ID NO: 190250 - RNA, 64 nt, Homo Sapiens
aucauugaaaaaguccauagccaaaaccugacugugcacuuacuauaggacccugaccugccug

SEQ ID NO: 190251 - RNA, 64 nt, Homo Sapiens
cugauuuuuaaaccugguuuacagguauuacuucugcacuuaccaaauaaugccagauggaaau

SEQ ID NO: 190252 - RNA, 64 nt, Homo Sapiens
aaaauauuuaaaaacugaaaaggaaucuaguauuugcacuuagccuugccuuaaaacuggagag

SEQ ID NO: 190253 - RNA, 64 nt, Homo Sapiens
acuaauguccguguugguauguaauuaauucaacugcacuuaacccuggaauacaguuuucagu

SEQ ID NO: 190254 - RNA, 64 nt, Homo Sapiens
aaaugauuugaacaaauaaaccagguguuucuuaugcacuuauaguauuuuggcauauuauucu

SEQ ID NO: 190255 - RNA, 64 nt, Homo Sapiens
accugacaguaugaccgaucugucuucucuuuucugcacuuaaugugccucagccuagauguuu

SEQ ID NO: 190256 - RNA, 64 nt, Homo Sapiens
uccccuguuucuguuuaacuagagugacaaacucugcacuuaaggcccauccccucccagaaau

SEQ ID NO: 190257 - RNA, 64 nt, Homo Sapiens
ccuuuugcuaauaaaaguguucuuucucccaugcugcacuuacuugaggggaaggaggagcccc

SEQ ID NO: 190258 - RNA, 64 nt, Homo Sapiens
aagggauauuguaaaugaaaacagcccucgacuuugcacuuaaacccccaccgugguucuuuuc

SEQ ID NO: 190259 - RNA, 64 nt, Homo Sapiens
ugguugacuuaauauauuugcuuuuuuucucaccugcacuuagaggaaauuugaacaaguugga

SEQ ID NO: 190260 - RNA, 64 nt, Homo Sapiens
ccucauuuagagaggaaaaguaaccaucacugguugcacuuaugauuucaugugcggggaucau

SEQ ID NO: 190261 - RNA, 64 nt, Homo Sapiens
acugucaagguacuugcuugugucugaacucuagugcacuuaugauuuuguagaccaugugaaa

SEQ ID NO: 190262 - RNA, 64 nt, Homo Sapiens
uuuguuguuuuguuugcuuugggaucuuguuggaugcacuuagauauggaaaauggaagccaaa

SEQ ID NO: 190263 - RNA, 64 nt, Homo Sapiens
uugucucuaaauugauguucacccauuucaauauugcacuuauuaauggucuuuauuuuucuag

SEQ ID NO: 190264 - RNA, 64 nt, Homo Sapiens
cuguuuuguaagaaucacuguuacauucuucuuuugcacuuaaaguugcauugccuacuguuau

SEQ ID NO: 190265 - RNA, 64 nt, Homo Sapiens
aggcuguuuacauggguugcaaaacuuuaggaaaugcacuuauuuauaaugauguaaacaugga

SEQ ID NO: 190266 - RNA, 64 nt, Homo Sapiens
uuuaauuuauauguuaguuacauugaaaacuccuugcacuuagaacucucuugaauuuaggaau

SEQ ID NO: 190267 - RNA, 64 nt, Homo Sapiens
aagugcuaaauuuuaaaagcaggugaauuauuuaugcacuuaggaaauauuuuuaacauuacug

SEQ ID NO: 190268 - RNA, 64 nt, Homo Sapiens
aacugcguucuggcuaacaccucccagugcugggugcacuuaaccuccucucaagccacauuuc

SEQ ID NO: 190269 - RNA, 64 nt, Homo Sapiens
cuuacacuaaaaauccuugcauuuuaaagagagaugcacuuaagaauagagugaacugcucaua

SEQ ID NO: 190270 - RNA, 64 nt, Homo Sapiens
auuguugcugcauuaguguaauguggugugguuuugcacuuaaaagagguauucauaugcucua

SEQ ID NO: 190271 - RNA, 61 nt, Homo Sapiens
auuuugacguccaggacuaagaagaucaugaugcacuuagauaaaagaaugauuagguaua

SEQ ID NO: 190272 - RNA, 64 nt, Homo Sapiens
cguguuucuagguugaccuuguguuuuagaaauuugcacuuaauggaauuugcauuucagagau

SEQ ID NO: 190273 - RNA, 64 nt, Homo Sapiens
gaaaaaugucacuacugcaacauuaggaauguccugcacuuaauagaauuauuuuucaccgcua

SEQ ID NO: 190274 - RNA, 63 nt, Homo Sapiens
ugaguuuucggagaccaagaaauuaaaauacaauugcacuuacuguuuacuuguaaauguuau

SEQ ID NO: 190275 - RNA, 64 nt, Homo Sapiens
ucuacugcuuuguacgaauucuaaguauucuuguugcacuuaauuagccuguauauccucagaa

SEQ ID NO: 190276 - RNA, 64 nt, Homo Sapiens
uucucauucuauggccauugagaaaaaauucaaaugcacuuaugagagccuauagccagaacuc

SEQ ID NO: 190277 - RNA, 64 nt, Homo Sapiens
caguaaauuaucuugggauauuuuagaagauagaugcacuuauguaagaaauauuccaaauguc

SEQ ID NO: 190278 - RNA, 64 nt, Homo Sapiens
uguaaccaguggugauuuggauagugaugcaaaaugcacuuaugugggaguauuauaucccugu

SEQ ID NO: 190279 - RNA, 64 nt, Homo Sapiens
uaaguuuaaaucaaauacaguuuccauaauucacugcacuuaaaauucaaaccuuuaaguuagc

SEQ ID NO: 190280 - RNA, 64 nt, Homo Sapiens
gacuccuguuguugaaguucagcugcauacaguuugcacuuaugugcuaaaauuccugaaguuc

SEQ ID NO: 190281 - RNA, 64 nt, Homo Sapiens
uuuugaauuuuaaaaugaugacuuaaacucaaguugcacuuacauagagguauggagcagugca

SEQ ID NO: 190282 - RNA, 64 nt, Homo Sapiens
cugacagucccuucaguggugucccaaaaggugaugcacuuaaguuuucauucugagcauguuu

SEQ ID NO: 190283 - RNA, 64 nt, Homo Sapiens
ccaaaaacuugcugaaacacuugauauugcacagugcacuuauuuuguggccaaagcauggccu

SEQ ID NO: 190284 - RNA, 64 nt, Homo Sapiens
acaguaagcguuuuuuuucuuugaagauuuaugaugcacuuauucaauagcugucagccguucc

SEQ ID NO: 190285 - RNA, 64 nt, Homo Sapiens
uaaagucuacaccaauggaauuagaugagugcuaugcacuuaauuuuaaaauaaaacuaguuuu

SEQ ID NO: 190286 - RNA, 64 nt, Homo Sapiens
aggacaggagacuccaagcgcuaguauugcacgcugcacuuaauggacuggacucuugccaugg

SEQ ID NO: 190287 - RNA, 64 nt, Homo Sapiens
gaacccauuugagggguggggggguguuaauuuaugcacuuauaagguguuuucuguguaacca

SEQ ID NO: 190288 - RNA, 64 nt, Homo Sapiens
cuggcugcagcagaacacguugagggagucuuggugcacuuaggucacuguaagguucuagggc

SEQ ID NO: 190289 - RNA, 64 nt, Homo Sapiens
aucaaaguaguucaacaugcugacuaucuauauuugcacuuaaacugcaagugacaaucagagg

SEQ ID NO: 190290 - RNA, 64 nt, Homo Sapiens
uuuuuuuuuuuuuuuuuaguucuccaagaguaguugcacuuaacuuuugacuccccuuauuccc

SEQ ID NO: 190291 - RNA, 64 nt, Homo Sapiens
ccgcagcugcuauagauagcaaguaucuguuaugugcacuuaaggagguuaucagaauuaauaa

SEQ ID NO: 190292 - RNA, 64 nt, Homo Sapiens
auuuuccuaauaaaguucugugaaaaaauguauaugcacuuauacuacuuugaagucauaccaa

SEQ ID NO: 190293 - RNA, 64 nt, Homo Sapiens
uucagaaacuuagagaguuguuugaacuggagcaugcacuuauuugugguguuguucugauugu

SEQ ID NO: 190294 - RNA, 64 nt, Homo Sapiens
uuagucuuuauguauuugcuugauuuuacugaaaugcacuuauaucauaaauguacuucaccag

SEQ ID NO: 190295 - RNA, 64 nt, Homo Sapiens
uggaaaggcaaguuggucuuauagaaagcacuacugcacuuaguagcuaugugauuuugagcaa

SEQ ID NO: 190296 - RNA, 64 nt, Homo Sapiens
aguuaagaagccaaagcuacuugaucaugcaaaaugcacuuauauauuuguuacacuguauugc

SEQ ID NO: 190297 - RNA, 64 nt, Homo Sapiens
uaugguuuaucuccagcaacauuucucuaguacuugcacuuauuaucuuuugucuaauuuaacc

SEQ ID NO: 190298 - RNA, 64 nt, Homo Sapiens
uuuuacucccaguagcaagggauucuaaguuaguugcacuuacaugauuauuguuauuuaaaac

SEQ ID NO: 190299 - RNA, 64 nt, Homo Sapiens
ccgacuuacuugcuagucucuaugagguccuuauugcacuuauugggguugaagcucuucagag

SEQ ID NO: 190300 - RNA, 64 nt, Homo Sapiens
acucccuucuucccuguguggggcucaagccuggugcacuuaguauagaagagcuaacguacuc

SEQ ID NO: 190301 - RNA, 64 nt, Homo Sapiens
ggggcagaagcucugccuaaaaugaagugaaagcugcacuuaacccuuugugauaaugaugaca

SEQ ID NO: 190302 - RNA, 64 nt, Homo Sapiens
cuuggcagacccuugacucccagaagugucuccuugcacuuagcggaacuucuuuauuucaaaa

SEQ ID NO: 190303 - RNA, 64 nt, Homo Sapiens
aagcucccaggccgagaagcggguacugagagucugcacuuaacugauccaggaggccggggcc

SEQ ID NO: 190304 - RNA, 64 nt, Homo Sapiens
ccucagguaagugcauaggcaucacucucuuuguugcacuuagcaauguaugaaggaugacccc

SEQ ID NO: 190305 - RNA, 64 nt, Homo Sapiens
aaacauuuaugcgguaggcucagaugucguaauuugcacuuagguaccaggugucaggaaacag

SEQ ID NO: 190306 - RNA, 64 nt, Homo Sapiens
auauauaaauagacuauauguucaauauuaucacugcacuuauaaaaaaagaaugauaugugag

SEQ ID NO: 190307 - RNA, 64 nt, Homo Sapiens
aaaaucacuugguaaggauuauaaacuuaauuacugcacuuaaaaugaaacauuacuuuuuuua

SEQ ID NO: 190308 - RNA, 64 nt, Homo Sapiens
aguucagcguuguaugucucucucuacacuguggugcacuuaacuuguggaauuuuuauacuaa

SEQ ID NO: 190309 - RNA, 64 nt, Homo Sapiens
accagugaaaaugaaaggaaguuucaguauuagaugcacuuaaguuagccuccaccacccuuuc

SEQ ID NO: 190310 - RNA, 64 nt, Homo Sapiens
guuuuauauuugucgacgccaggucagucauuuuugcacuuaauuguauaugagauaacuagau

SEQ ID NO: 190311 - RNA, 64 nt, Homo Sapiens
aaauauaaaugaagauauuuuaccaugaagagauugcacuuauccuugagaacagucuaaauau

SEQ ID NO: 190312 - RNA, 64 nt, Homo Sapiens
aaauauaaaugaagauauuuuaccaugaagagauugcacuuauccuugagaacagucuaaugau

SEQ ID NO: 190313 - RNA, 64 nt, Homo Sapiens
guagucuccuuauaguugaagauaaaauguugagugcacuuauuuuagaauauccuagacauaa

SEQ ID NO: 190314 - RNA, 64 nt, Homo Sapiens
ccuuaacuguauuaacguucgaauguauauuguuugcacuuaauagccucgcuagucaagcugu

SEQ ID NO: 190315 - RNA, 64 nt, Homo Sapiens
auuauuugguugaauuuguuuuuccuuguuuuacugcacuuaauaacaggaaaagucaucccua

SEQ ID NO: 190316 - RNA, 64 nt, Homo Sapiens
auuugucauaugauggcacuugccuuacgacugcugcacuuaccgcucccaagugccuaggcca

SEQ ID NO: 190317 - RNA, 64 nt, Homo Sapiens
uuacaaccuaguaauaauguucuauaauuugcccugcacuuauuuugaauguuuauacuuuuau

SEQ ID NO: 190318 - RNA, 64 nt, Homo Sapiens
gaaguauuuuuagaauaagauacaugaagcuucaugcacuuaaaaggccaagaauauugcaaaa

SEQ ID NO: 190319 - RNA, 64 nt, Homo Sapiens
uuuaugacugccggggggguuucuuuuuguguuaugcacuuaauauuuucucuauuuuccccug

SEQ ID NO: 190320 - RNA, 64 nt, Homo Sapiens
uggaggcuuggaugggaauaugcugauuuuguucugcacuuaaaggcuucuccuccuggagggc

SEQ ID NO: 190321 - RNA, 64 nt, Homo Sapiens
ugaacagcccaaaagcauuaagagaugguaaagcugcacuuacugauaauuauaacuuaauguu

SEQ ID NO: 190322 - RNA, 64 nt, Homo Sapiens
aaggaaaaucaggccuguugccaaaugacaguagugcacuuaaaagcagcuccccaccccagag

SEQ ID NO: 190323 - RNA, 64 nt, Homo Sapiens
acgcaccuauuucucaauaggauguuguaaguauugcacuuaauuuuggucauuugacaucaga

SEQ ID NO: 190324 - RNA, 64 nt, Homo Sapiens
augagaaucaaauggaaacauaucauucuggaggugcacuuacucuucuacaauguggccggau

SEQ ID NO: 190325 - RNA, 64 nt, Homo Sapiens
auauuaaaacgacuccccaauuauuuugcagaauugcacuuaauauugaaauguacuguauagg

SEQ ID NO: 190326 - RNA, 64 nt, Homo Sapiens
cagacgcugcaaucacagauuuuaaaaaauuguuugcacuuaaaaauaguugaaugcuggugga

SEQ ID NO: 190327 - RNA, 64 nt, Homo Sapiens
uaaacugauuuuauuugggagaaacaaggaagggugcacuuaacuagcaaccuaagcaugauuu

SEQ ID NO: 190328 - RNA, 64 nt, Homo Sapiens
gcuagcucugcuuuuuaugcauuuucuucagauuugcacuuacugcagcuuauuggacacaugg

SEQ ID NO: 190329 - RNA, 64 nt, Homo Sapiens
cuuagauuugugaagggagagcuuuuuagaagccugcacuuaagauccuauuguacucucuucu

SEQ ID NO: 190330 - RNA, 64 nt, Homo Sapiens
uacuugauacugaaugcauaggacucuggauauuugcacuuauguuccuaauggauucaauuac

SEQ ID NO: 190331 - RNA, 64 nt, Homo Sapiens
acagugguacgauuucuagcccguggcuuuaaaaugcacuuaaaguccuguccuugccuuuuau

SEQ ID NO: 190332 - RNA, 64 nt, Homo Sapiens
aauuaucccagcuauuagauagaagggauguuacugcacuuauguguaaucagaucuuuauuua

SEQ ID NO: 190333 - RNA, 64 nt, Homo Sapiens
caaaccuagaugggacaccuugaacaucauggagugcacuuauauguaaggugacuuuauugug

SEQ ID NO: 190334 - RNA, 64 nt, Homo Sapiens
auagaguuuuuauuaauuacaaagcaugugaaagugcacuuaaguguuuguuuauuauaaacaa

SEQ ID NO: 190335 - RNA, 64 nt, Homo Sapiens
guccuguccuugccuuuuauccguggcuuuaaaaugcacuuaaaacagugguacgauuucucgc

SEQ ID NO: 190336 - RNA, 64 nt, Homo Sapiens
aagggccagguuccaaauuacuccaacuuccuccugcacuuaaauacuucaugcauggcuucuc

SEQ ID NO: 190337 - RNA, 64 nt, Homo Sapiens
uguauggguccauauguacgugugugugugugugugcacuuaugcaguccuuucugucauucug

SEQ ID NO: 190338 - RNA, 64 nt, Homo Sapiens
uaauggucuucaauuuaauuggaaaaauaucucaugcacuuaaacaugcauucaagaagcuagg

SEQ ID NO: 190339 - RNA, 64 nt, Homo Sapiens
agccuuguaaauaaugacauggaagacccugugcugcacuuaaaauauugcugcuugauuauuu

SEQ ID NO: 190340 - RNA, 61 nt, Homo Sapiens
auucuaguaaugaagacugauucccagacucugcacuuaaaauaugaacugauuuuggauu

SEQ ID NO: 190341 - RNA, 64 nt, Homo Sapiens
uacuuuauuacagagcuccuugguuuuuuacuucugcacuuaaauuuuuuuaaauaacaugaug

SEQ ID NO: 190342 - RNA, 64 nt, Homo Sapiens
uuuuuuuuuaauuuucaggucaaguuuuuuauacugcacuuauuugucaaaauaaagauucuca

SEQ ID NO: 190343 - RNA, 64 nt, Homo Sapiens
caguggcugaaauccagcauuuuuacauaggagaugcacuuagccucuaagccucguuuuacuc

SEQ ID NO: 190344 - RNA, 64 nt, Homo Sapiens
ucuuuggauggaggggagggccuuuguuaccuuuugcacuuauucuuucugugggugcuuugac

SEQ ID NO: 190345 - RNA, 64 nt, Homo Sapiens
uggaucccucugucuggggugggaugccuuacuuugcacuuaauuuaauaagggcauucucgga

SEQ ID NO: 190346 - RNA, 64 nt, Homo Sapiens
cucgaaguuaguaaauccuuagcuuucguccccuugcacuuagaaggaaugucugacaggcuua

SEQ ID NO: 190347 - RNA, 64 nt, Homo Sapiens
gaaaggucacuggcccgggccugcuuccaggcagugcacuuagaagugcagaucacgaaugcac

SEQ ID NO: 190348 - RNA, 64 nt, Homo Sapiens
agggauuguagguagauaacauccaaucacuguuugcacuuaucugaaaucuucccucuuggcu

SEQ ID NO: 190349 - RNA, 64 nt, Homo Sapiens
aucauggcucuccacucagacugugccuggccccugcacuuacaacuuccugccgcucuguggc

SEQ ID NO: 190350 - RNA, 64 nt, Homo Sapiens
cauugaaaaguaaauguuuuauuaguucauugccugcacuuacugaucggaagagagaaagaac

SEQ ID NO: 190351 - RNA, 64 nt, Homo Sapiens
auugggcuguuuucucaacaaauggaaugccauuugcacuuacacaagacuuuccccauacucu

SEQ ID NO: 190352 - RNA, 64 nt, Homo Sapiens
agcugggagcagcacaaggacccagccuuuguucugcacuuaauaaaugguuuugcuacugcua

SEQ ID NO: 190353 - RNA, 64 nt, Homo Sapiens
agugccgggaaggaacugccgggacucaccgagcugcacuuaacuguucucuuucuggcuauuu

SEQ ID NO: 190354 - RNA, 64 nt, Homo Sapiens
uauugcggggagacagcucuuugaggguuggggcugcacuuauugcugagccugaaucugacuc

SEQ ID NO: 190355 - RNA, 64 nt, Homo Sapiens
gucuggagagcuuuggauaacaaauccuuguuuuugcacuuauugaaucaaacaguccugaauu

SEQ ID NO: 190356 - RNA, 64 nt, Homo Sapiens
aauaugaaauagaaacuuuucucucucaacuuccugcacuuaacuguuuucacuggauuuuuau

SEQ ID NO: 190357 - RNA, 64 nt, Homo Sapiens
cucaauccagccccggagaaaucuccagguguacugcacuuacccaagaagggggcucccuggg

SEQ ID NO: 190358 - RNA, 64 nt, Homo Sapiens
aauggaacccaaacagaagagcugucuauuucugugcacuuaacaggguuucaguacaaaugcu

SEQ ID NO: 190359 - RNA, 64 nt, Homo Sapiens
caaauaguauguggggauuuugacuguaccauguugcacuuaauucguguaaagagauuacaca

SEQ ID NO: 190360 - RNA, 64 nt, Homo Sapiens
uaugaaccugcccugcucccuuucaagaccucugugcacuuauuaagaacagauaaucccugua

SEQ ID NO: 190361 - RNA, 64 nt, Homo Sapiens
cugcgugggacaagggcuguuucaucaugcucccugcacuuagggugccgacuggcugccugac

SEQ ID NO: 190362 - RNA, 64 nt, Homo Sapiens
uaauuaacaaaauguucuuccuuuaguuugcuuuugcacuuaaaauauauauaauugacuuuuu

SEQ ID NO: 190363 - RNA, 64 nt, Homo Sapiens
guauaaguaugcguuacaggguuugauacuuuccugcacuuagguuuguccuauucuucauuua

SEQ ID NO: 190364 - RNA, 64 nt, Homo Sapiens
guuagcauaauuuuagaugccugugaaauaguacugcacuuacauaaagugagacauugugaaa

SEQ ID NO: 190365 - RNA, 64 nt, Homo Sapiens
ucauaauacauguaguauuuugugucuggcgucuugcacuuagcaugguguucuugagguucau

SEQ ID NO: 190366 - RNA, 64 nt, Homo Sapiens
caaaacuauuguguaaaacauauguacaugaaauugcacuuaacuacauccuuaaacaaaguag

SEQ ID NO: 190367 - RNA, 63 nt, Homo Sapiens
augugaaaauauccuggaaauaaauacauguuucugcacuuagagccagggaccugccgcguu

SEQ ID NO: 190368 - RNA, 64 nt, Homo Sapiens
aagccccagcgagauuuuccggugaauacgggauugcacuuacucuuucaucacggaaacagac

SEQ ID NO: 190369 - RNA, 64 nt, Homo Sapiens
gauaagcccccgcggggcggagauuucuaccuucugcacuuacuccccaucagaagaucgaguu

SEQ ID NO: 190370 - RNA, 64 nt, Homo Sapiens
agguuuauuucaccugaauauaauuccuaacugaugcacuuaguauaugucaguuuuuauaaau

SEQ ID NO: 190371 - RNA, 64 nt, Homo Sapiens
ggaaucucuaacaugcucuguuuacaucgauaaaugcacuuaaggaaaacaaacaaauuaaagc

SEQ ID NO: 190372 - RNA, 64 nt, Homo Sapiens
uugacucauauguuuuaacaugauuuuaacaaacugcacuuauuaagaaauguguuugcccugu

SEQ ID NO: 190373 - RNA, 64 nt, Homo Sapiens
aucacugugacucuagaguggccagacucagagcugcacuuaguagggguuccucaaaggaagg

SEQ ID NO: 190374 - RNA, 64 nt, Homo Sapiens
uaauucacccaugaaagagacccagugguuacugugcacuuaggaaaaccuucagccacaucuu

SEQ ID NO: 190375 - RNA, 64 nt, Homo Sapiens
gaauucacccaugagagagacccagugguugcuaugcacuuaggaaaacuuucagccacaucuu

SEQ ID NO: 190376 - RNA, 64 nt, Homo Sapiens
uaaacaaucagaccacauuuauugcuacucuugcugcacuuauggaagacagccuacauggucc

SEQ ID NO: 190377 - RNA, 58 nt, Homo Sapiens
aaaacaugggaagauauggugagccccaugcacuuaaaaaagaauucacuccagauag

SEQ ID NO: 190378 - RNA, 64 nt, Homo Sapiens
uguauacaaauacaguauuuuccaugguucugccugcacuuacuuuguaaugccacgguugaga

SEQ ID NO: 190379 - RNA, 64 nt, Homo Sapiens
gcuuuucccguugaugucuugaugcuccuaucugugcacuuaccguagguagggacacgugucc

SEQ ID NO: 190380 - RNA, 64 nt, Homo Sapiens
ucauuaccacggaagauauaagccaagcaucacuugcacuuaaaaagaaaugaaugugaaagaa

SEQ ID NO: 190381 - RNA, 64 nt, Homo Sapiens
ucgaauuugaagagauugcuacagggcucauuuuugcacuuaucuuggggaguaccuguccaag

SEQ ID NO: 190382 - RNA, 64 nt, Homo Sapiens
gggugagcgcgggugucgagaccuaccuccagugugcacuuaggccugcaguaacuaucuauac

SEQ ID NO: 190383 - RNA, 64 nt, Homo Sapiens
aaggaagcacaugugcaccuuuccuuuacacuaaugcacuuaggauguuucugcaucaugucua

SEQ ID NO: 190384 - RNA, 64 nt, Homo Sapiens
ggcucagcgaccuuuccucucaaaugcggaagcgugcacuuacaguucagaccguucuccugua

SEQ ID NO: 190385 - RNA, 64 nt, Homo Sapiens
auuauauucuauaaacauuagguugauaaccauaugcacuuaacuauauuuucuggauucugga

SEQ ID NO: 190386 - RNA, 64 nt, Homo Sapiens
aagcaaaucuauuagaaaaaacagcaaacugcacugcacuuauaauauguagaauguuaaaagc

SEQ ID NO: 190387 - RNA, 64 nt, Homo Sapiens
ggacuucgguguccucggcucugaaggcgcucucugcacuuagaugcugucagcccucaacgua

SEQ ID NO: 190388 - RNA, 64 nt, Homo Sapiens
gucgguguggaaugucacucacauccggggacugugcacuuacaauugagggugaugacaagag

SEQ ID NO: 190389 - RNA, 64 nt, Homo Sapiens
cucuccucucuucuccuaucgugagggagguaggugcacuuaccagggagaccagcaguuaacg

SEQ ID NO: 190390 - RNA, 64 nt, Homo Sapiens
ggccuugcucacagcugauuagcccucaggcaccugcacuuacaccagcuaacucugaccuggg

SEQ ID NO: 190391 - RNA, 64 nt, Homo Sapiens
ugugagagucuucaaacuuuacaggauccugagcugcacuuaccuaagacuuucugcugcacuc

SEQ ID NO: 190392 - RNA, 64 nt, Homo Sapiens
accuucuugauagcucccuggacgagugcugguaugcacuuagggcuuaugugugugggcuugg

SEQ ID NO: 190393 - RNA, 64 nt, Homo Sapiens
aaugcuggucagucugaaaaggugaagcuggcugugcacuuacccccaucuuucucccucgggg

SEQ ID NO: 190394 - RNA, 64 nt, Homo Sapiens
guccccuuucccugucccagccccaucuguggguugcacuuacaaacccccacccaccuucaga

SEQ ID NO: 190395 - RNA, 64 nt, Homo Sapiens
uuagaaaacuauugaaagaaaucacaggggaaacugcacuuagacugacagaauugaacaccaa

SEQ ID NO: 190396 - RNA, 64 nt, Homo Sapiens
uaaaauuuaggagagaacauguguagaaacuucuugcacuuauuaaaauguaugcaauuccuga

SEQ ID NO: 190397 - RNA, 64 nt, Homo Sapiens
aauuagcaugcugcuuuuuguuaugagcuuucuuugcacuuaaaaauuuuaaaagucuauuuua

SEQ ID NO: 190398 - RNA, 64 nt, Homo Sapiens
uuaucaauaaagaggcaaauacccuuaucuccucugcacuuaugcugcccaugccgcucaggcu

SEQ ID NO: 190399 - RNA, 64 nt, Homo Sapiens
cuuauaaaauaacuugcaucccuagauaacgaagugcacuuacaaaugccaguguguccuagaa

SEQ ID NO: 190400 - RNA, 67 nt, Homo Sapiens
cuccugcauuaacccagaaauaccucgcuucuaucugugcacuuagcugggaacuuacccacuguaa

SEQ ID NO: 190401 - RNA, 67 nt, Homo Sapiens
acagcguccuggcuccaguuggaacacuuuccugagaugcacuuacuucucagcuucugcgaucaga

SEQ ID NO: 190402 - RNA, 67 nt, Homo Sapiens
aagcaagggcccaaaugcauaaguuucuuugcacuguugcacuuacuuaauacaaauaaauguuuuu

SEQ ID NO: 190403 - RNA, 67 nt, Homo Sapiens
acuacuacuguucaguuuuuuaaaaguuuugaaaugcugcacuuacauuuaaaaaaacaacaacaac

SEQ ID NO: 190404 - RNA, 67 nt, Homo Sapiens
ggcucaccauuucccccugcucccccacagccgguucugcacuuaucaccgagucgccccuggaagc

SEQ ID NO: 190405 - RNA, 67 nt, Homo Sapiens
cccuugaccaagaaauuggguuucuuuucccucagccugcacuuacucuucuauuaagaccagaaaa

SEQ ID NO: 190406 - RNA, 67 nt, Homo Sapiens
acucauccuucuucucuguguuuucugguuuaaaagcugcacuuauauuuuagccuuauuauuuucu

SEQ ID NO: 190407 - RNA, 67 nt, Homo Sapiens
aucaaugaaaugaugucauaagcgaucacuuccuauaugcacuuauucucaagaagaacaucuuuau

SEQ ID NO: 190408 - RNA, 67 nt, Homo Sapiens
cauugaaaauuguuuuauuucaggcauguucccuuugugcacuuagguucauugugccucaguuccu

SEQ ID NO: 190409 - RNA, 67 nt, Homo Sapiens
agcaucucuguaaaauaauuggaaugaaaauacuucuugcacuuaaacacugcacaugccguacuuu

SEQ ID NO: 190410 - RNA, 67 nt, Homo Sapiens
gucuuuucuuuagugggggaggguaagaaaagcaguuugcacuuaaaaagaaaaaaaaaaaacgggu

SEQ ID NO: 190411 - RNA, 67 nt, Homo Sapiens
ggcaaaagcauuuugcacaguguuuguuuuccugucuugcacuuacaaauaaggucuaugggaguag

SEQ ID NO: 190412 - RNA, 67 nt, Homo Sapiens
ucccuugugcuggccagaugacugucacuuagcagauugcacuuaagagcaggaagacagucuuagc

SEQ ID NO: 190413 - RNA, 67 nt, Homo Sapiens
ccucaugguucuaguaaacgucugcuagaaugcuaauugcacuuagggacucugaggggcuguccag

SEQ ID NO: 190414 - RNA, 67 nt, Homo Sapiens
uuuuuggggggugggaauguagcuuagaaguugauuuugcacuuauuuugacuuguuugagcucuug

SEQ ID NO: 190415 - RNA, 67 nt, Homo Sapiens
ggucuguuucucagcaucaugugugaugcaguguggcugcacuuaagugugugaggcugacacgucu

SEQ ID NO: 190416 - RNA, 67 nt, Homo Sapiens
gcauggucagaccacgucacuuugaguaauugcuguuugcacuuacucuugccaguauucuaagaca

SEQ ID NO: 190417 - RNA, 67 nt, Homo Sapiens
ccuguuucuaaauuauauaucaguuguacaaagaaaaugcacuuaaacaguuuuuacaugugauagu

SEQ ID NO: 190418 - RNA, 67 nt, Homo Sapiens
cccaccaccuggggacccccacugguggguuugaaucugcacuuauccuggguucagccagucagug

SEQ ID NO: 190419 - RNA, 67 nt, Homo Sapiens
cggaggagggcgcaggguggggggcagaaguuuugaaugcacuuaacggacaugacuaggaguguua

SEQ ID NO: 190420 - RNA, 67 nt, Homo Sapiens
guccccuuuuuaguuuuuuugauuuucuuuuuuaucuugcacuuauuaacuaauuucauacuauuua

SEQ ID NO: 190421 - RNA, 67 nt, Homo Sapiens
guugcuuucaguaacauuuuacguugauuucauuccaugcacuuagauuccguagcagcuuagauua

SEQ ID NO: 190422 - RNA, 67 nt, Homo Sapiens
uuuuggagcaaauugacaugcgcaaaucaacacuuucugcacuuaucuucccuccuugggcucuucc

SEQ ID NO: 190423 - RNA, 67 nt, Homo Sapiens
ggcuguugagggccacuuuugacuugcuaaagcacuuugcacuuaauuugagugcaggugacagcag

SEQ ID NO: 190424 - RNA, 67 nt, Homo Sapiens
ucucauagauuuaaguaaacagauguauuuugcacagugcacuuaugucuauuuuaacaauccuccu

SEQ ID NO: 190425 - RNA, 67 nt, Homo Sapiens
ugcaaucacgucuuuuguuaugcuaguaucagucagaugcacuuagagugaagaaacacuguaauua

SEQ ID NO: 190426 - RNA, 67 nt, Homo Sapiens
uaggaaaacaguucuuguggccuucuauuaaauaguuugcacuuaagccuugccaguguucugagcu

SEQ ID NO: 190427 - RNA, 67 nt, Homo Sapiens
uauuucuuacugccaucauuauuuguuaaagauauuuugcacuuaauuuugugggaaaaauauugcu

SEQ ID NO: 190428 - RNA, 67 nt, Homo Sapiens
aacacacgguucuaauuaagugugaagguauagcuauugcacuuaugccaucuccaaaauuucuuaa

SEQ ID NO: 190429 - RNA, 67 nt, Homo Sapiens
ggcaccccacccaucacauggcuggcuggcugcugggugcacuuacccuccuuggcuugguuacuuc

SEQ ID NO: 190430 - RNA, 67 nt, Homo Sapiens
ccucugcacaggccucagcuuugaagaacggagucuuugcacuuacacacacucuuccuguucugcc

SEQ ID NO: 190431 - RNA, 67 nt, Homo Sapiens
auuguuugcagcggaucacuggacaucaaagauucauugcacuuaugaacaaggaaccuucuuuuca

SEQ ID NO: 190432 - RNA, 67 nt, Homo Sapiens
ugaaagggagaauuuuagacuuaauuuuuaacucuauugcacuuaaagauuuuaguuagguuaccac

SEQ ID NO: 190433 - RNA, 67 nt, Homo Sapiens
guguuacaucuaaauuacaacccuuaauugccacgugugcacuuacuacucuccaguaugucuuauu

SEQ ID NO: 190434 - RNA, 67 nt, Homo Sapiens
caaauacaaauuuaguuuaaguguuugaacaacuauaugcacuuacgguuguguguuuaaaaugucu

SEQ ID NO: 190435 - RNA, 67 nt, Homo Sapiens
uuacguaaaaagauauuucuaauuuacuguugcccauugcacuuacauaccaccaccaagaaagccu

SEQ ID NO: 190436 - RNA, 67 nt, Homo Sapiens
acuuguuuaaaauuuuugugcaauucauauauuaaauugcacuuacuugcauacgcucauauucuag

SEQ ID NO: 190437 - RNA, 67 nt, Homo Sapiens
uuguccuauauauccguacgugugccagucgacuauuugcacuuacccagggucauuguccccacaa

SEQ ID NO: 190438 - RNA, 67 nt, Homo Sapiens
ugcuuauuugacaacguuucccccagcccagggcuccugcacuuacucggcugcagaggccagaggc

SEQ ID NO: 190439 - RNA, 67 nt, Homo Sapiens
aaaucauguaaauaugucacugaauuugugacaaguuugcacuuacacuaagucaagcaagacuuug

SEQ ID NO: 190440 - RNA, 67 nt, Homo Sapiens
acacccuucaacaaaaucuaaugcauauggauaaaguugcacuuauaaugaaaaugccuuaaaagga

SEQ ID NO: 190441 - RNA, 67 nt, Homo Sapiens
uaugccaaaaaaaguuugaaguacagguuaucaaguuugcacuuaacacaauggagaguugugacaa

SEQ ID NO: 190442 - RNA, 67 nt, Homo Sapiens
ugaaaaccuuuucagugaugagaaaguccuugguguuugcacuuaaaaaaggccugauggagugaga

SEQ ID NO: 190443 - RNA, 67 nt, Homo Sapiens
aguuuuuacaaaacugcuuuaaauuauuuauuacuugugcacuuaguuuguuuauacacaacuuugc

SEQ ID NO: 190444 - RNA, 67 nt, Homo Sapiens
gugauuguacauauuguacacucugcuuugcacagcuugcacuuacagcaugaauuaguguucuaga

SEQ ID NO: 190445 - RNA, 67 nt, Homo Sapiens
uaucaaucauuuuccuuuuuugucuagguagucagucugcacuuaaauuuuaagucuuuuuuuuuuu

SEQ ID NO: 190446 - RNA, 67 nt, Homo Sapiens
ggaaguuacaucaggcaaguucugccuucauuauccuugcacuuaacucauuauaaucacaggagac

SEQ ID NO: 190447 - RNA, 67 nt, Homo Sapiens
cuguaauuuuauuuguucuuuacucagaaauguaguuugcacuuaagggguaugucuaccuggcaga

SEQ ID NO: 190448 - RNA, 67 nt, Homo Sapiens
aucccaccuuuccucaaaugugcacaugaagaaauacugcacuuacaaccccuaugaaguaaagaac

SEQ ID NO: 190449 - RNA, 67 nt, Homo Sapiens
auuggcuugcuucaguuguucagguagugccauaaucugcacuuagcuuaaagagaucuguuauuuu

SEQ ID NO: 190450 - RNA, 67 nt, Homo Sapiens
caucuucuagccuuaugaccugcuguauucuaccacuugcacuuacuccaagcauacaauuugagca

SEQ ID NO: 190451 - RNA, 67 nt, Homo Sapiens
aauaauugagaagaaaaacuuuagugcuuuguuuccgugcacuuaaaucaugagcgugacacucauu

SEQ ID NO: 190452 - RNA, 67 nt, Homo Sapiens
cccaucaggguaauuguauugagaacucaaauauacgugcacuuacaugugugguucguacucaagu

SEQ ID NO: 190453 - RNA, 67 nt, Homo Sapiens
accucuuauaaauggagcacuuagaaauuuguuguucugcacuuaaccuagagagagaaaaaaugcu

SEQ ID NO: 190454 - RNA, 67 nt, Homo Sapiens
auauuacaauuaaaaccucauuuuuuuuuuccauuuuugcacuuaacagugaugaauacuuuuacgu

SEQ ID NO: 190455 - RNA, 67 nt, Homo Sapiens
aaaauaauuucuuaauuuaaaaugauagcacuucucuugcacuuaagaauggcauccauaagauucu

SEQ ID NO: 190456 - RNA, 67 nt, Homo Sapiens
ccucugugauuccacuggcggaggauucuuggaagcuugcacuuaguuuccccugacuucaccccau

SEQ ID NO: 190457 - RNA, 67 nt, Homo Sapiens
uccaaauuagaagcggauuuggaaaugcaaacuaacgugcacuuagauauccaagugggugagcuua

SEQ ID NO: 190458 - RNA, 67 nt, Homo Sapiens
guuauuuaauuaaaaaggcaaaaccugaaccaccuucugcacuuaaagaagucuaacaguacaaaua

SEQ ID NO: 190459 - RNA, 67 nt, Homo Sapiens
aguguauccagccuucacuccagcugguuaaaaauguugcacuuaucagcaacccuaccacuuucau

SEQ ID NO: 190460 - RNA, 67 nt, Homo Sapiens
aaguuauucaagaaaaugaacaugcucuucaaaaagaugcacuuaguauuaaguugaaacuugaaca

SEQ ID NO: 190461 - RNA, 67 nt, Homo Sapiens
acuggcucuauaaauuaaguuugugcuuuccuugaaaugcacuuauucuuauuacaagcauuuuaua

SEQ ID NO: 190462 - RNA, 67 nt, Homo Sapiens
uuguuuaaaauguaauuuaaaugaaagaaaauugaguugcacuuauugaccauuuuuuaauuuacuu

SEQ ID NO: 190463 - RNA, 67 nt, Homo Sapiens
aaaaguggacagcuucugccccucagcaacgaacaccugcacuuagaagggaggaggagcacaagau

SEQ ID NO: 190464 - RNA, 67 nt, Homo Sapiens
ugacucauguguccucuuagaaguugucugaguuaaaugcacuuauguaguauuucauuaggaucua

SEQ ID NO: 190465 - RNA, 67 nt, Homo Sapiens
cguaugucuugcaugcuuagaaaacauuucacucaguugcacuuaguaaugauuaaaauuuaaaaaa

SEQ ID NO: 190466 - RNA, 67 nt, Homo Sapiens
agaaccacccacaccucucuagaccuguugguuauugugcacuuaaaugagaauuuuuccaggaggg

SEQ ID NO: 190467 - RNA, 67 nt, Homo Sapiens
acuuugguuccacaucugucaacagaugcuugaaauaugcacuuagcguggcuuuaaacauauucag

SEQ ID NO: 190468 - RNA, 67 nt, Homo Sapiens
acccuuaugcgcuaauuuugacuguguuuacuucccaugcacuuaauguaauuuuaaguguaacaua

SEQ ID NO: 190469 - RNA, 67 nt, Homo Sapiens
gggcaacacagucugcugcuauauagugggggaagcgugcacuuauuucuaaacauggguuuuuaac

SEQ ID NO: 190470 - RNA, 67 nt, Homo Sapiens
cuugcuuucauugucuucaucuuccugccauacuuugugcacuuauugcucuccuucugagucagga

SEQ ID NO: 190471 - RNA, 67 nt, Homo Sapiens
ugcuugcagccagucacuguguaaagccucucugaugugcacuuaagaguggguugcuuucucacaa

SEQ ID NO: 190472 - RNA, 67 nt, Homo Sapiens
guggaaggcaucagucccuauguauuugcaguucaccugcacuuaaggcacucuguuauuuagacuc

SEQ ID NO: 190473 - RNA, 67 nt, Homo Sapiens
gaagcagaaugaaaccacauuuuuugguuugauaauaugcacuuauugacucccacucauuguuaug

SEQ ID NO: 190474 - RNA, 67 nt, Homo Sapiens
guuguugcaauuuagcuugcuuucaagcuucaccccuugcacuuaacauaagcuauuuuuggcauug

SEQ ID NO: 190475 - RNA, 67 nt, Homo Sapiens
gaauuuaauaauguauauucuuucaugcuuuuuucugugcacuuaccuaagugugaauauguaaagg

SEQ ID NO: 190476 - RNA, 67 nt, Homo Sapiens
ugauuaguagguucuguuacaguuuuucuuuugaucgugcacuuauagucuucauuuaauuccucau

SEQ ID NO: 190477 - RNA, 67 nt, Homo Sapiens
aguuguauuuguggaaauugguauuaucucuguuuuaugcacuuacauuuaucccuuacauuuuguu

SEQ ID NO: 190478 - RNA, 67 nt, Homo Sapiens
aaaauaauuuguuuuugcaauugccuauggcuuguuuugcacuuaauuaccagagcuaauauauuua

SEQ ID NO: 190479 - RNA, 67 nt, Homo Sapiens
uauuuugaccacaagggggaauuugacauuucacagaugcacuuacaccaaaacaccggcauaagaa

SEQ ID NO: 190480 - RNA, 67 nt, Homo Sapiens
gcaauuuucaaauguacucauuuaugcugucuagucaugcacuuaaaaguacauaugcaaucacucg

SEQ ID NO: 190481 - RNA, 67 nt, Homo Sapiens
uuucaguaguagucuugacucuaguucuugauagaacugcacuuaauacuacgcgugcaguucauuu

SEQ ID NO: 190482 - RNA, 67 nt, Homo Sapiens
uuuuguauaauuuguguuucauauuuuuauuuuugauugcacuuaaacauaaccguuuauuuaacau

SEQ ID NO: 190483 - RNA, 67 nt, Homo Sapiens
ggaugccucauagacgaugacaagcccuggccacagcugcacuuacaucaggaauugauugcauaug

SEQ ID NO: 190484 - RNA, 67 nt, Homo Sapiens
ccauuguuuaaauuuacaacagcguuuuacaauacauugcacuuaauacgauacaauuauugaauga

SEQ ID NO: 190485 - RNA, 67 nt, Homo Sapiens
gccuuaggaagugacuugaauguacaaagauacuugaugcacuuauuuuuuaaugugagacagcaag

SEQ ID NO: 190486 - RNA, 67 nt, Homo Sapiens
cauuuacuguguuauuuaaaugcuaagccaaaguaucugcacuuagguauaccucuuuaugccaaua

SEQ ID NO: 190487 - RNA, 67 nt, Homo Sapiens
gucacaaaaagacaaaugauuguaggauccauggaagugcacuuaggcuugcugugguggaggccau

SEQ ID NO: 190488 - RNA, 67 nt, Homo Sapiens
gaggguggagaguggcaggaagcaagcauguuugcugugcacuuaggaaaggcuggugagccagagg

SEQ ID NO: 190489 - RNA, 67 nt, Homo Sapiens
auaaagcuaaauuugucccuuuuuuauuguuauuaauugcacuuaacauuuuuaguuauacuggaua

SEQ ID NO: 190490 - RNA, 67 nt, Homo Sapiens
uuaaaauuguguucuuaaaauauuguguaagaaucacugcacuuagcuguuggaauguuguuaaaug

SEQ ID NO: 190491 - RNA, 67 nt, Homo Sapiens
gaauguaaaaauuggguaaauuuacuacugaggggagugcacuuauuuauuuaacuuacuuaucugg

SEQ ID NO: 190492 - RNA, 67 nt, Homo Sapiens
ccagcucugcccuugggggggagaacagaagagcuggugcacuuaaucagcaagaucuggggcugca

SEQ ID NO: 190493 - RNA, 67 nt, Homo Sapiens
cguacucaagggagcgcgccgggugccuggugaauucugcacuuacacuggggccguggggucucag

SEQ ID NO: 190494 - RNA, 67 nt, Homo Sapiens
cucacacuuugcuuguauuuuaaaaggaggauauauuugcacuuauguauacuuuuacaguuugcca

SEQ ID NO: 190495 - RNA, 67 nt, Homo Sapiens
aacugauuaaauaauacauuuauaaucuacaacuguuugcacuuacagcuuuuuuuguaaauauaaa

SEQ ID NO: 190496 - RNA, 67 nt, Homo Sapiens
gaacccccaugauguaaguuuaccuauguaacaaaccugcacuuauacccaugaacuuaaaaugaaa

SEQ ID NO: 190497 - RNA, 67 nt, Homo Sapiens
gugggcaaagccuaguagagaaccagugcaccucaggugcacuuacauaugguggggcugaggcaaa

SEQ ID NO: 190498 - RNA, 67 nt, Homo Sapiens
auucaucaaacaaaaaauaaaucucgaagaaaaaaaaugcacuuacaugugcuuauuuggcuuuucu

SEQ ID NO: 190499 - RNA, 67 nt, Homo Sapiens
acauguggcacuucaaaaggcagcaccacugggcgccugcacuuauuugaaaauggaacuuugggag

SEQ ID NO: 190500 - RNA, 67 nt, Homo Sapiens
uaugcaauuuucucuuggugcuaccugauggaauuccugcacuuaaaguucuggcugacuaaacaag

SEQ ID NO: 190501 - RNA, 67 nt, Homo Sapiens
aaucugggagggcaaaaaaaaaaaaaaaguuuuuaugugcacuuaaauuuggggacaauuuuaugua

SEQ ID NO: 190502 - RNA, 67 nt, Homo Sapiens
cacggaaggcuucugacgcuuguggccagacugcaauugcacuuauguguuaugcuacuaauauuug

SEQ ID NO: 190503 - RNA, 54 nt, Homo Sapiens; identical to SEQ ID NO: 190234

SEQ ID NO: 190504 - RNA, 67 nt, Homo Sapiens
auuagcuugcuuaaggcauagcuguugugguuuuuagugcacuuaauauaaggucauagauucuuga

SEQ ID NO: 190505 - RNA, 67 nt, Homo Sapiens
aaaucaucccagcuaaguucucugacacaggaucagcugcacuuaaguccccacaugcacacagaac

SEQ ID NO: 190506 - RNA, 67 nt, Homo Sapiens
aaccaucuauugaauacacacacuuacugguuuaauuugcacuuauuccaaagcuacauugacgaga

SEQ ID NO: 190507 - RNA, 67 nt, Homo Sapiens
cauuaguuaaaaaaagauaaacuagaguaucuuauucugcacuuaugauuguaaacaagauauuuaa

SEQ ID NO: 190508 - RNA, 67 nt, Homo Sapiens
uugauuugaauuaauuuugguuguuaaaaauaaacucugcacuuauuaggugucauagcuaugacau

SEQ ID NO: 190509 - RNA, 67 nt, Homo Sapiens
gcaaauaccaauaauuaagaucaacuuggucucgucuugcacuuagugagccgagggcaggaguggc

SEQ ID NO: 190510 - RNA, 67 nt, Homo Sapiens
uagaaccucauuuuuaaagauuucaccacugaaacccugcacuuagcauguguucacauggucaaaa

SEQ ID NO: 190511 - RNA, 67 nt, Homo Sapiens
gaauuuuuuuuccuauuuuucuucuuuuugcuuuuuuugcacuuaucagaaauauuugaugugugca

SEQ ID NO: 190512 - RNA, 67 nt, Homo Sapiens
gaacugauuuagaagagacucuuugcugaaauugaauugcacuuauacauguaaauugucaacaugu

SEQ ID NO: 190513 - RNA, 67 nt, Homo Sapiens
ugcaguuuuucauuuuaaaaaguccauaccuuauauaugcacuuaauuuguuggggcuuuacauacu

SEQ ID NO: 190514 - RNA, 67 nt, Homo Sapiens
uuucaauuccaccagggccagagcagcuccaccacugugcacuuagccaugauggcaacagaaacca

SEQ ID NO: 190515 - RNA, 67 nt, Homo Sapiens
ccaauucuucaaccagaaaaaccuauuguucuaaaagugcacuuaagagaugggauuacaaguggac

SEQ ID NO: 190516 - RNA, 67 nt, Homo Sapiens
auuuugucaucauaaucuuuauggugggggcagacuuugcacuuacugcagugcaacacuugcacuu

SEQ ID NO: 190517 - RNA, 67 nt, Homo Sapiens
aaaaugaauguucuuuucaaaaaauaaaguagaaaaaugcacuuacuaagaacaugaaaaaaaauga

SEQ ID NO: 190518 - RNA, 67 nt, Homo Sapiens
caugauaaacuauaauuguagaaagggguaauuucugugcacuuacaacaagcugaguguucauguu

SEQ ID NO: 190519 - RNA, 67 nt, Homo Sapiens
cuuaucauugaaaaaguccauagccaaaaccugacugugcacuuacuauaggacccugaccugccug

SEQ ID NO: 190520 - RNA, 67 nt, Homo Sapiens
uuucugauuuuuaaaccugguuuacagguauuacuucugcacuuaccaaauaaugccagauggaaau

SEQ ID NO: 190521 - RNA, 67 nt, Homo Sapiens
aaaauauuuaaaaacugaaagagaggaaucuaguauuugcacuuagcuuacuugccuuaaaacugga

SEQ ID NO: 190522 - RNA, 67 nt, Homo Sapiens
acuaauguccguguugguauaguguaauuaauucaacugcacuuaacaguccuggaauacaguuuuc

SEQ ID NO: 190523 - RNA, 67 nt, Homo Sapiens
aaaugauuugaacaaauaaaucuccagguguuucuuaugcacuuauauuaguauuuuggcauauuau

SEQ ID NO: 190524 - RNA, 67 nt, Homo Sapiens
accugacaguaugaccgaucuuuugucuucucuuuucugcacuuaaucaugugccucagccuagaug

SEQ ID NO: 190525 - RNA, 67 nt, Homo Sapiens
uccccuguuucuguuuaacuaauagagugacaaacucugcacuuaaggcagcccauccccucccaga

SEQ ID NO: 190526 - RNA, 67 nt, Homo Sapiens
ccuuuugcuaauaaaagugucccucuuucucccaugcugcacuuacucuuugaggggaaggaggagc

SEQ ID NO: 190527 - RNA, 67 nt, Homo Sapiens
aagggauauuguaaaugaaauucacagcccucgacuuugcacuuaaagaccccccaccgugguucuu

SEQ ID NO: 190528 - RNA, 67 nt, Homo Sapiens
aauugguugacuuaauauauuugcuuuuuuucucaccugcacuuagaggaaauuugaacaaguugga

SEQ ID NO: 190529 - RNA, 67 nt, Homo Sapiens
cugccucauuuagagaggaaaaguaaccaucacugguugcacuuaugauuucaugugcggggaucau

SEQ ID NO: 190530 - RNA, 67 nt, Homo Sapiens
uauacugucaagguacuugcuugugucugaacucuagugcacuuaugauuuuguagaccaugugaaa

SEQ ID NO: 190531 - RNA, 67 nt, Homo Sapiens
uguuuuguuguuuuguuugcuuugggaucuuguuggaugcacuuagauauggaaaauggaagccaaa

SEQ ID NO: 190532 - RNA, 67 nt, Homo Sapiens
uacuugucucuaaauugauguucacccauuucaauauugcacuuauuaauggucuuuauuuuucuag

SEQ ID NO: 190533 - RNA, 67 nt, Homo Sapiens
gcacuguuuuguaagaaucacuguuacauucuucuuuugcacuuaaaguugcauugccuacuguuau

SEQ ID NO: 190534 - RNA, 67 nt, Homo Sapiens
aggcuguuuacauggguugcggaaaaacuuuaggaaaugcacuuauuuuguauaaugauguaaacau

SEQ ID NO: 190535 - RNA, 67 nt, Homo Sapiens
uuuaauuuauauguuaguuaaaucauugaaaacuccuugcacuuagaaacacucucuugaauuuagg

SEQ ID NO: 190536 - RNA, 67 nt, Homo Sapiens
aagugcuaaauuuuaaaagccugaggugaauuauuuaugcacuuaggucuaaauauuuuuaacauua

SEQ ID NO: 190537 - RNA, 67 nt, Homo Sapiens
aacugcguucuggcuaacacuuccucccagugcugggugcacuuaacccgcuccucucaagccacau

SEQ ID NO: 190538 - RNA, 67 nt, Homo Sapiens
auucuuacacuaaaaauccuugcauuuuaaagagagaugcacuuaagaauagagugaacugcucaua

SEQ ID NO: 190539 - RNA, 67 nt, Homo Sapiens
ugcauuguugcugcauuaguguaauguggugugguuuugcacuuaaaagagguauucauaugcucua

SEQ ID NO: 190540 - RNA, 61 nt, Homo Sapiens; identical to SEQ ID NO: 190271

SEQ ID NO: 190541 - RNA, 67 nt, Homo Sapiens
aaacguguuucuagguugaccuuguguuuuagaaauuugcacuuaauggaauuugcauuucagagau

SEQ ID NO: 190542 - RNA, 67 nt, Homo Sapiens
uaagaaaaaugucacuacugcaacauuaggaauguccugcacuuaauagaauuauuuuucaccgcua

SEQ ID NO: 190543 - RNA, 66 nt, Homo Sapiens
agcugaguuuucggagaccaagaaauuaaaauacaauugcacuuacuguuuacuuguaaauguuau

SEQ ID NO: 190544 - RNA, 67 nt, Homo Sapiens
cagucuacugcuuuguacgaauucuaaguauucuuguugcacuuaauuagccuguauauccucagaa

SEQ ID NO: 190545 - RNA, 67 nt, Homo Sapiens
uucucauucuauggccauugcucagaaaaaauucaaaugcacuuauggucagagccuauagccagaa

SEQ ID NO: 190546 - RNA, 67 nt, Homo Sapiens
caguaaauuaucuugggauagucuuuuagaagauagaugcacuuauggacuaagaaauauuccaaau

SEQ ID NO: 190547 - RNA, 67 nt, Homo Sapiens
uguaaccaguggugauuugguguauagugaugcaaaaugcacuuaugugaugggaguauuauauccc

SEQ ID NO: 190548 - RNA, 67 nt, Homo Sapiens
uaaguuuaaaucaaauacagagcuuuccauaauucacugcacuuaaaauuauucaaaccuuuaaguu

SEQ ID NO: 190549 - RNA, 67 nt, Homo Sapiens
gacuccuguuguugaaguucuucagcugcauacaguuugcacuuaugggaugcuaaaauuccugaag

SEQ ID NO: 190550 - RNA, 67 nt, Homo Sapiens
uuuugaauuuuaaaaugauggcaacuuaaacucaaguugcacuuacauauuagagguauggagcagu

SEQ ID NO: 190551 - RNA, 67 nt, Homo Sapiens
cugacagucccuucagugguuuugucccaaaaggugaugcacuuaaguauuuuucauucugagcaug

SEQ ID NO: 190552 - RNA, 67 nt, Homo Sapiens
auuccaaaaacuugcugaaacacuugauauugcacagugcacuuauuuuguggccaaagcauggccu

SEQ ID NO: 190553 - RNA, 67 nt, Homo Sapiens
ucuacaguaagcguuuuuuuucuuugaagauuuaugaugcacuuauucaauagcugucagccguucc

SEQ ID NO: 190554 - RNA, 67 nt, Homo Sapiens
ugcuaaagucuacaccaauggaauuagaugagugcuaugcacuuaauuuuaaaauaaaacuaguuuu

SEQ ID NO: 190555 - RNA, 67 nt, Homo Sapiens
augaggacaggagacuccaagcgcuaguauugcacgcugcacuuaauggacuggacucuugccaugg

SEQ ID NO: 190556 - RNA, 67 nt, Homo Sapiens
ccagaacccauuugagggguggggggguguuaauuuaugcacuuauaagguguuuucuguguaacca

SEQ ID NO: 190557 - RNA, 67 nt, Homo Sapiens
ucacuggcugcagcagaacacguugagggagucuuggugcacuuaggucacuguaagguucuagggc

SEQ ID NO: 190558 - RNA, 67 nt, Homo Sapiens
aucaaaguaguucaacaugcaggugacuaucuauauuugcacuuaaacuacugcaagugacaaucag

SEQ ID NO: 190559 - RNA, 67 nt, Homo Sapiens
uuuuuuuuuuuuuuuuuagucccucuccaagaguaguugcacuuaacuucuuuugacuccccuuauu

SEQ ID NO: 190560 - RNA, 67 nt, Homo Sapiens
ccgcagcugcuauagauagcuaaaaguaucuguuaugugcacuuaagcaggagguuaucagaauuaa

SEQ ID NO: 190561 - RNA, 67 nt, Homo Sapiens
auuuuccuaauaaaguucugcaaugaaaaaauguauaugcacuuauauuucuacuuugaagucauac

SEQ ID NO: 190562 - RNA, 67 nt, Homo Sapiens
uucagaaacuuagagaguuguguuuugaacuggagcaugcacuuauuuguugugguguuguucugau

SEQ ID NO: 190563 - RNA, 67 nt, Homo Sapiens
uuagucuuuauguauuugcucagugauuuuacugaaaugcacuuauaugaucauaaauguacuucac

SEQ ID NO: 190564 - RNA, 67 nt, Homo Sapiens
aaguggaaaggcaaguuggucuuauagaaagcacuacugcacuuaguagcuaugugauuuugagcaa

SEQ ID NO: 190565 - RNA, 67 nt, Homo Sapiens
aaaaguuaagaagccaaagcuacuugaucaugcaaaaugcacuuauauauuuguuacacuguauugc

SEQ ID NO: 190566 - RNA, 67 nt, Homo Sapiens
uuuuaugguuuaucuccagcaacauuucucuaguacuugcacuuauuaucuuuugucuaauuuaacc

SEQ ID NO: 190567 - RNA, 67 nt, Homo Sapiens
gguuuuuacucccaguagcaagggauucuaaguuaguugcacuuacaugauuauuguuauuuaaaac

SEQ ID NO: 190568 - RNA, 67 nt, Homo Sapiens
uacccgacuuacuugcuagucucuaugagguccuuauugcacuuauugggguugaagcucuucagag

SEQ ID NO: 190569 - RNA, 67 nt, Homo Sapiens
cccacucccuucuucccuguguggggcucaagccuggugcacuuaguauagaagagcuaacguacuc

SEQ ID NO: 190570 - RNA, 67 nt, Homo Sapiens
acuggggcagaagcucugccuaaaaugaagugaaagcugcacuuaacccuuugugauaaugaugaca

SEQ ID NO: 190571 - RNA, 67 nt, Homo Sapiens
cuuggcagacccuugacuccaaacagaagugucuccuugcacuuagcuguggaacuucuuuauuuca

SEQ ID NO: 190572 - RNA, 67 nt, Homo Sapiens
aagcucccaggccgagaagcgccggguacugagagucugcacuuaacgucugauccaggaggccggg

SEQ ID NO: 190573 - RNA, 67 nt, Homo Sapiens
ccucagguaagugcauaggccccaucacucucuuuguugcacuuagccagaauguaugaaggaugac

SEQ ID NO: 190574 - RNA, 67 nt, Homo Sapiens
uacaaacauuuaugcgguaggcucagaugucguaauuugcacuuagguaccaggugucaggaaacag

SEQ ID NO: 190575 - RNA, 67 nt, Homo Sapiens
uggauauauaaauagacuauauguucaauauuaucacugcacuuauaaaaaaagaaugauaugugag

SEQ ID NO: 190576 - RNA, 67 nt, Homo Sapiens
guaaaaaucacuugguaaggauuauaaacuuaauuacugcacuuaaaaugaaacauuacuuuuuuua

SEQ ID NO: 190577 - RNA, 67 nt, Homo Sapiens
ggaaguucagcguuguaugucucucucuacacuguggugcacuuaacuuguggaauuuuuauacuaa

SEQ ID NO: 190578 - RNA, 67 nt, Homo Sapiens
ggaaccagugaaaaugaaaggaaguuucaguauuagaugcacuuaaguuagccuccaccacccuuuc

SEQ ID NO: 190579 - RNA, 67 nt, Homo Sapiens
uaaguuuuauauuugucgacgccaggucagucauuuuugcacuuaauuguauaugagauaacuagau

SEQ ID NO: 190580 - RNA, 67 nt, Homo Sapiens
acaaaauauaaaugaagauauuuuaccaugaagagauugcacuuauccuugagaacagucuaaauau

SEQ ID NO: 190581 - RNA, 67 nt, Homo Sapiens
ucuaaauauaaaugaagauauuuuaccaugaagagauugcacuuauccuugagaacagucuaaugau

SEQ ID NO: 190582 - RNA, 67 nt, Homo Sapiens
uugguagucuccuuauaguugaagauaaaauguugagugcacuuauuuuagaauauccuagacauaa

SEQ ID NO: 190583 - RNA, 67 nt, Homo Sapiens
ccuuaacuguauuaacguucugugaauguauauuguuugcacuuaauuguagccucgcuagucaagc

SEQ ID NO: 190584 - RNA, 67 nt, Homo Sapiens
auuauuugguugaauuuguucuauuuccuuguuuuacugcacuuaauucuaacaggaaaagucaucc

SEQ ID NO: 190585 - RNA, 67 nt, Homo Sapiens
auuugucauaugauggcacuccaugccuuacgacugcugcacuuaccugggcucccaagugccuagg

SEQ ID NO: 190586 - RNA, 67 nt, Homo Sapiens
uuacaaccuaguaauaauguuauucuauaauuugcccugcacuuauugacuugaauguuuauacuuu

SEQ ID NO: 190587 - RNA, 67 nt, Homo Sapiens
gaaguauuuuuagaauaagaaaauacaugaagcuucaugcacuuaaauugaggccaagaauauugca

SEQ ID NO: 190588 - RNA, 67 nt, Homo Sapiens
uuuaugacugccgggggggucuguucuuuuuguguuaugcacuuaauaauauuuucucuauuuuccc

SEQ ID NO: 190589 - RNA, 67 nt, Homo Sapiens
ugauggaggcuuggaugggaauaugcugauuuuguucugcacuuaaaggcuucuccuccuggagggc

SEQ ID NO: 190590 - RNA, 67 nt, Homo Sapiens
ugaacagcccaaaagcauuaguuagagaugguaaagcugcacuuacugaugauaauuauaacuuaau

SEQ ID NO: 190591 - RNA, 67 nt, Homo Sapiens
aaggaaaaucaggccuguuggagccaaaugacaguagugcacuuaaacccagcagcuccccacccca

SEQ ID NO: 190592 - RNA, 67 nt, Homo Sapiens
acgcaccuauuucucaauagagagauguuguaaguauugcacuuaauaauuuuggucauuugacauc

SEQ ID NO: 190593 - RNA, 67 nt, Homo Sapiens
ucaaugagaaucaaauggaaacauaucauucuggaggugcacuuacucuucuacaauguggccggau

SEQ ID NO: 190594 - RNA, 67 nt, Homo Sapiens
uaaauauuaaaacgacuccccaauuauuuugcagaauugcacuuaauauugaaauguacuguauagg

SEQ ID NO: 190595 - RNA, 67 nt, Homo Sapiens
agacagacgcugcaaucacagauuuuaaaaaauuguuugcacuuaaaaauaguugaaugcuggugga

SEQ ID NO: 190596 - RNA, 67 nt, Homo Sapiens
uaauaaacugauuuuauuugggagaaacaaggaagggugcacuuaacuagcaaccuaagcaugauuu

SEQ ID NO: 190597 - RNA, 67 nt, Homo Sapiens
gcuagcucugcuuuuuaugcuggauuuucuucagauuugcacuuacuauggcagcuuauuggacaca

SEQ ID NO: 190598 - RNA, 67 nt, Homo Sapiens
cuuagauuugugaagggagaucugcuuuuuagaagccugcacuuaagcucauccuauuguacucucu

SEQ ID NO: 190599 - RNA, 67 nt, Homo Sapiens
uacuugauacugaaugcauauacggacucuggauauuugcacuuauguaguuccuaauggauucaau

SEQ ID NO: 190600 - RNA, 67 nt, Homo Sapiens
uuaacagugguacgauuucuagcccguggcuuuaaaaugcacuuaaaguccuguccuugccuuuuau

SEQ ID NO: 190601 - RNA, 67 nt, Homo Sapiens
uuaaauuaucccagcuauuagauagaagggauguuacugcacuuauguguaaucagaucuuuauuua

SEQ ID NO: 190602 - RNA, 67 nt, Homo Sapiens
caaaccuagaugggacaccugugugaacaucauggagugcacuuauacauuguaaggugacuuuauu

SEQ ID NO: 190603 - RNA, 67 nt, Homo Sapiens
auagaguuuuuauuaauuaccaaaaagcaugugaaagugcacuuaaguguuguuuguuuauuauaaa

SEQ ID NO: 190604 - RNA, 67 nt, Homo Sapiens
guccuguccuugccuuuuaucgcccguggcuuuaaaaugcacuuaaauuaacagugguacgauuucu

SEQ ID NO: 190605 - RNA, 67 nt, Homo Sapiens
aagggccagguuccaaauuacuccuccaacuuccuccugcacuuaaauuuuacuucaugcauggcuu

SEQ ID NO: 190606 - RNA, 67 nt, Homo Sapiens
uguauggguccauauguacgcugugugugugugugugugcacuuauguuccaguccuuucugucauu

SEQ ID NO: 190607 - RNA, 67 nt, Homo Sapiens
uaauggucuucaauuuaauuaggggaaaaauaucucaugcacuuaaauaacaugcauucaagaagcu

SEQ ID NO: 190608 - RNA, 67 nt, Homo Sapiens
ucaagccuuguaaauaaugacauggaagacccugugcugcacuuaaaauauugcugcuugauuauuu

SEQ ID NO: 190609 - RNA, 61 nt, Homo Sapiens; identical to SEQ ID NO: 190340

SEQ ID NO: 190610 - RNA, 67 nt, Homo Sapiens
uguuacuuuauuacagagcuccuugguuuuuuacuucugcacuuaaauuuuuuuaaauaacaugaug

SEQ ID NO: 190611 - RNA, 67 nt, Homo Sapiens
uuuuuuuuuuuuaauuuucaggucaaguuuuuuauacugcacuuauuugucaaaauaaagauucuca

SEQ ID NO: 190612 - RNA, 67 nt, Homo Sapiens
acacaguggcugaaauccagcauuuuuacauaggagaugcacuuagccucuaagccucguuuuacuc

SEQ ID NO: 190613 - RNA, 67 nt, Homo Sapiens
guuucuuuggauggaggggagggccuuuguuaccuuuugcacuuauucuuucugugggugcuuugac

SEQ ID NO: 190614 - RNA, 67 nt, Homo Sapiens
auguggaucccucugucuggggugggaugccuuacuuugcacuuaauuuaauaagggcauucucgga

SEQ ID NO: 190615 - RNA, 67 nt, Homo Sapiens
cucgaaguuaguaaauccuuuuaagcuuucguccccuugcacuuagaaaaaggaaugucugacaggc

SEQ ID NO: 190616 - RNA, 67 nt, Homo Sapiens
gaaaggucacuggcccgggccaccugcuuccaggcagugcacuuagagagagugcagaucacgaaug

SEQ ID NO: 190617 - RNA, 67 nt, Homo Sapiens
uaaagggauuguagguagauaacauccaaucacuguuugcacuuaucugaaaucuucccucuuggcu

SEQ ID NO: 190618 - RNA, 67 nt, Homo Sapiens
gccaucauggcucuccacucagacugugccuggccccugcacuuacaacuuccugccgcucuguggc

SEQ ID NO: 190619 - RNA, 67 nt, Homo Sapiens
uuacauugaaaaguaaauguuuuauuaguucauugccugcacuuacugaucggaagagagaaagaac

SEQ ID NO: 190620 - RNA, 67 nt, Homo Sapiens
uucauugggcuguuuucucaacaaauggaaugccauuugcacuuacacaagacuuuccccauacucu

SEQ ID NO: 190621 - RNA, 67 nt, Homo Sapiens
aagagcugggagcagcacaaggacccagccuuuguucugcacuuaauaaaugguuuugcuacugcua

SEQ ID NO: 190622 - RNA, 67 nt, Homo Sapiens
gccagugccgggaaggaacugccgggacucaccgagcugcacuuaacuguucucuuucuggcuauuu

SEQ ID NO: 190623 - RNA, 67 nt, Homo Sapiens
uauugcggggagacagcucucucuugaggguuggggcugcacuuauuccagcugagccugaaucuga

SEQ ID NO: 190624 - RNA, 67 nt, Homo Sapiens
gucuggagagcuuuggauaaauucaaauccuuguuuuugcacuuauuuuggaaucaaacaguccuga

SEQ ID NO: 190625 - RNA, 67 nt, Homo Sapiens
aauaugaaauagaaacuuuuuaucucucucaacuuccugcacuuaacauguguuuucacuggauuuu

SEQ ID NO: 190626 - RNA, 67 nt, Homo Sapiens
cucaauccagccccggagaagggaucuccagguguacugcacuuaccucucaagaagggggcucccu

SEQ ID NO: 190627 - RNA, 67 nt, Homo Sapiens
aauggaacccaaacagaagagcugcugucuauuucugugcacuuaacgugaggguuucaguacaaau

SEQ ID NO: 190628 - RNA, 67 nt, Homo Sapiens
caaauaguauguggggauuuacaugacuguaccauguugcacuuaaucuaucguguaaagagauuac

SEQ ID NO: 190629 - RNA, 67 nt, Homo Sapiens
uaugaaccugcccugcucccguauuucaagaccucugugcacuuauugagaagaacagauaaucccu

SEQ ID NO: 190630 - RNA, 67 nt, Homo Sapiens
cugcgugggacaagggcugugacuucaucaugcucccugcacuuaggugggugccgacuggcugccu

SEQ ID NO: 190631 - RNA, 67 nt, Homo Sapiens
uccuaauuaacaaaauguucuuccuuuaguuugcuuuugcacuuaaaauauauauaauugacuuuuu

SEQ ID NO: 190632 - RNA, 67 nt, Homo Sapiens
ucaguauaaguaugcguuacaggguuugauacuuuccugcacuuagguuuguccuauucuucauuua

SEQ ID NO: 190633 - RNA, 67 nt, Homo Sapiens
aaaguuagcauaauuuuagaugccugugaaauaguacugcacuuacauaaagugagacauugugaaa

SEQ ID NO: 190634 - RNA, 67 nt, Homo Sapiens
gaaucauaauacauguaguauuuugugucuggcgucuugcacuuagcaugguguucuugagguucau

SEQ ID NO: 190635 - RNA, 67 nt, Homo Sapiens
caaaacuauuguguaaaacauaguauguacaugaaauugcacuuaacaaguacauccuuaaacaaag

SEQ ID NO: 190636 - RNA, 66 nt, Homo Sapiens
guuaugugaaaauauccuggaaauaaauacauguuucugcacuuagagccagggaccugccgcguu

SEQ ID NO: 190637 - RNA, 67 nt, Homo Sapiens
gagaagccccagcgagauuuuccggugaauacgggauugcacuuacucuuucaucacggaaacagac

SEQ ID NO: 190638 - RNA, 67 nt, Homo Sapiens
acagauaagcccccgcggggcggagauuucuaccuucugcacuuacuccccaucagaagaucgaguu

SEQ ID NO: 190639 - RNA, 67 nt, Homo Sapiens
gggagguuuauuucaccugaauauaauuccuaacugaugcacuuaguauaugucaguuuuuauaaau

SEQ ID NO: 190640 - RNA, 67 nt, Homo Sapiens
ccgggaaucucuaacaugcucuguuuacaucgauaaaugcacuuaaggaaaacaaacaaauuaaagc

SEQ ID NO: 190641 - RNA, 67 nt, Homo Sapiens
cccuugacucauauguuuuaacaugauuuuaacaaacugcacuuauuaagaaauguguuugcccugu

SEQ ID NO: 190642 - RNA, 67 nt, Homo Sapiens
ccaaucacugugacucuagaguggccagacucagagcugcacuuaguagggguuccucaaaggaagg

SEQ ID NO: 190643 - RNA, 67 nt, Homo Sapiens
ugauaauucacccaugaaagagacccagugguuacugugcacuuaggaaaaccuucagccacaucuu

SEQ ID NO: 190644 - RNA, 67 nt, Homo Sapiens
ugagaauucacccaugagagagacccagugguugcuaugcacuuaggaaaacuuucagccacaucuu

SEQ ID NO: 190645 - RNA, 67 nt, Homo Sapiens
uaaacaaucagaccacauuuuccauugcuacucuugcugcacuuauguuagaagacagccuacaugg

SEQ ID NO: 190646 - RNA, 58 nt, Homo Sapiens; identical to SEQ ID NO: 190377

SEQ ID NO: 190647 - RNA, 67 nt, Homo Sapiens
cuguguauacaaauacaguauuuuccaugguucugccugcacuuacuuuguaaugccacgguugaga

SEQ ID NO: 190648 - RNA, 67 nt, Homo Sapiens
ucggcuuuucccguugaugucuugaugcuccuaucugugcacuuaccguagguagggacacgugucc

SEQ ID NO: 190649 - RNA, 67 nt, Homo Sapiens
ucauuaccacggaagauauagaaagccaagcaucacuugcacuuaaagaaaagaaaugaaugugaaa

SEQ ID NO: 190650 - RNA, 67 nt, Homo Sapiens
ucgaauuugaagagauugcuaagacagggcucauuuuugcacuuaucuuuuuggggaguaccugucc

SEQ ID NO: 190651 - RNA, 67 nt, Homo Sapiens
gggugagcgcgggugucgaguacaccuaccuccagugugcacuuagguucccugcaguaacuaucua

SEQ ID NO: 190652 - RNA, 67 nt, Homo Sapiens
uugaaggaagcacaugugcaccuuuccuuuacacuaaugcacuuaggauguuucugcaucaugucua

SEQ ID NO: 190653 - RNA, 67 nt, Homo Sapiens
uccggcucagcgaccuuuccucucaaaugcggaagcgugcacuuacaguucagaccguucuccugua

SEQ ID NO: 190654 - RNA, 67 nt, Homo Sapiens
auuauauucuauaaacauuaggagguugauaaccauaugcacuuaacaacuauauuuucuggauucu

SEQ ID NO: 190655 - RNA, 67 nt, Homo Sapiens
aagcaaaucuauuagaaaaaagcacagcaaacugcacugcacuuauacgaauauguagaauguuaaa

SEQ ID NO: 190656 - RNA, 67 nt, Homo Sapiens
ucuggacuucgguguccucggcucugaaggcgcucucugcacuuagaugcugucagcccucaacgua

SEQ ID NO: 190657 - RNA, 67 nt, Homo Sapiens
gucgguguggaaugucacucgagacauccggggacugugcacuuacacucauugagggugaugacaa

SEQ ID NO: 190658 - RNA, 67 nt, Homo Sapiens
cucuccucucuucuccuaucacggugagggagguaggugcacuuaccuggagggagaccagcaguua

SEQ ID NO: 190659 - RNA, 67 nt, Homo Sapiens
ggccuugcucacagcugauugggagcccucaggcaccugcacuuacagucccagcuaacucugaccu

SEQ ID NO: 190660 - RNA, 67 nt, Homo Sapiens
ugugagagucuucaaacuuucucacaggauccugagcugcacuuaccucuuaagacuuucugcugca

SEQ ID NO: 190661 - RNA, 67 nt, Homo Sapiens
accuucuugauagcucccugugggacgagugcugguaugcacuuaggggugcuuaugugugugggcu

SEQ ID NO: 190662 - RNA, 67 nt, Homo Sapiens
gugaaugcuggucagucugaaaaggugaagcuggcugugcacuuacccccaucuuucucccucgggg

SEQ ID NO: 190663 - RNA, 67 nt, Homo Sapiens
ggaguccccuuucccugucccagccccaucuguggguugcacuuacaaacccccacccaccuucaga

SEQ ID NO: 190664 - RNA, 67 nt, Homo Sapiens
auuuuagaaaacuauugaaagaaaucacaggggaaacugcacuuagacugacagaauugaacaccaa

SEQ ID NO: 190665 - RNA, 67 nt, Homo Sapiens
uaaaauuuaggagagaacauugaguguagaaacuucuugcacuuauuauaaaaauguaugcaauucc

SEQ ID NO: 190666 - RNA, 67 nt, Homo Sapiens
aauuagcaugcugcuuuuuguuauuaugagcuuucuuugcacuuaaauguaauuuuaaaagucuauu

SEQ ID NO: 190667 - RNA, 67 nt, Homo Sapiens
uuaucaauaaagaggcaaaugcuacccuuaucuccucugcacuuauggggcugcccaugccgcucag

SEQ ID NO: 190668 - RNA, 67 nt, Homo Sapiens
cuuauaaaauaacuugcaucgaaccuagauaacgaagugcacuuacaagaaaugccaguguguccua

SEQ ID NO: 190669 - RNA, 64 nt, Homo Sapiens; identical to SEQ ID NO: 104928

SEQ ID NO: 190670 - RNA, 64 nt, Homo Sapiens; identical to SEQ ID NO: 104929

SEQ ID NO: 190671 - RNA, 64 nt, Homo Sapiens; identical to SEQ ID NO: 104930

SEQ ID NO: 190672 - RNA, 64 nt, Homo Sapiens; identical to SEQ ID NO: 104931

SEQ ID NO: 190673 - RNA, 64 nt, Homo Sapiens; identical to SEQ ID NO: 104932

SEQ ID NO: 190674 - RNA, 64 nt, Homo Sapiens; identical to SEQ ID NO: 104933

SEQ ID NO: 190675 - RNA, 64 nt, Homo Sapiens; identical to SEQ ID NO: 104934

SEQ ID NO: 190676 - RNA, 64 nt, Homo Sapiens; identical to SEQ ID NO: 104935

SEQ ID NO: 190677 - RNA, 64 nt, Homo Sapiens; identical to SEQ ID NO: 104936

SEQ ID NO: 190678 - RNA, 64 nt, Homo Sapiens; identical to SEQ ID NO: 104937

SEQ ID NO: 190679 - RNA, 64 nt, Homo Sapiens; identical to SEQ ID NO: 104938

SEQ ID NO: 190680 - RNA, 64 nt, Homo Sapiens; identical to SEQ ID NO: 104939

SEQ ID NO: 190681 - RNA, 64 nt, Homo Sapiens; identical to SEQ ID NO: 104940

SEQ ID NO: 190682 - RNA, 64 nt, Homo Sapiens; identical to SEQ ID NO: 104941

SEQ ID NO: 190683 - RNA, 64 nt, Homo Sapiens; identical to SEQ ID NO: 104942

SEQ ID NO: 190684 - RNA, 64 nt, Homo Sapiens; identical to SEQ ID NO: 104943

SEQ ID NO: 190685 - RNA, 64 nt, Homo Sapiens; identical to SEQ ID NO: 104944

SEQ ID NO: 190686 - RNA, 64 nt, Homo Sapiens; identical to SEQ ID NO: 104945

SEQ ID NO: 190687 - RNA, 64 nt, Homo Sapiens; identical to SEQ ID NO: 104946

SEQ ID NO: 190688 - RNA, 64 nt, Homo Sapiens; identical to SEQ ID NO: 104947

SEQ ID NO: 190689 - RNA, 64 nt, Homo Sapiens; identical to SEQ ID NO: 104948

SEQ ID NO: 190690 - RNA, 64 nt, Homo Sapiens; identical to SEQ ID NO: 104949

SEQ ID NO: 190691 - RNA, 63 nt, Homo Sapiens
cuugguguagggggagaggggaaaggggucuggcccaucgaggggccccuucugccagggccu

SEQ ID NO: 190692 - RNA, 63 nt, Homo Sapiens
uuuuuuguuuuuuggcucuuucaaagguaauggcccaucgaugagcauuuuuaacauacucca

SEQ ID NO: 190693 - RNA, 63 nt, Homo Sapiens
acuguuuccccuacaucuuuugagccacagucgcccaucgaauaagcaaauuuguuuuugaga

SEQ ID NO: 190694 - RNA, 63 nt, Homo Sapiens
agagauuuuagcauugccuuggcauaacaagggcccaucgauucccuacuaaugagaggcagg

SEQ ID NO: 190695 - RNA, 63 nt, Homo Sapiens
uauaaugaugacucuuggcaggugguauuuuaacccaucgauccuuuuacaaugaguuccuua

SEQ ID NO: 190696 - RNA, 63 nt, Homo Sapiens
aaaugaagccucuuuggggugaagccuggacaucccaucgaaugaaaggacacuaguacagcg

SEQ ID NO: 190697 - RNA, 63 nt, Homo Sapiens
uucacugaacauuggcuuuccacagcacucagucccaucgacgugcaugucucacucacccuc

SEQ ID NO: 190698 - RNA, 63 nt, Homo Sapiens
ucuguccuggggacguggagagcgugcccgcugcccaucgacggaaaagcuugggcggugccc

SEQ ID NO: 190699 - RNA, 63 nt, Homo Sapiens
ugccaagaagggcuauggaaggcaccaugacugcccaucgagacuaugugcccuacauggcaa

SEQ ID NO: 190700 - RNA, 63 nt, Homo Sapiens
ccaguaagugucuccucccucggagacaagccccccaucgaucaaugcugagaaugagagcgg

SEQ ID NO: 190701 - RNA, 63 nt, Homo Sapiens
ugccacgugggugucacgugcccuugccauccucccaucgaugaggccugcagucucauccug

SEQ ID NO: 190702 - RNA, 63 nt, Homo Sapiens
gacuggucgcacucgcagcugcuggacuugggccccaucgacgcgcucaacuucuucugugag

SEQ ID NO: 190703 - RNA, 63 nt, Homo Sapiens
uugaaucucaugccacugcagucccagcugagucccaucgauggcacccggugagugaggaca

SEQ ID NO: 190704 - RNA, 63 nt, Homo Sapiens
ugaaauuaaacagauuagaagucccagaaugaccccaucgagagacaguggcaacugaaaaca

SEQ ID NO: 190705 - RNA, 63 nt, Homo Sapiens
agcaagcccagccccagggccccgcaagcuggucccaucgacccacagccaccuccccaccuc

SEQ ID NO: 190706 - RNA, 63 nt, Homo Sapiens
caaugucaucacucaauauugcgaagcacaugccccaucgagccuacugggcagagcagcaga

SEQ ID NO: 190707 - RNA, 63 nt, Homo Sapiens
aaacaggcuucuggcaguagcuuugguuccuaucccaucgaaauuccccaaagcccugggcca

SEQ ID NO: 190708 - RNA, 63 nt, Homo Sapiens
uauuuuugauaauuuuucaucaauuaguauagacccaucgauaaauguaaauauaaacaguca

SEQ ID NO: 190709 - RNA, 63 nt, Homo Sapiens
ucuagggggacucuggaccggcucaggccuuuucccaucgacguacugagccugcggugcaug

SEQ ID NO: 190710 - RNA, 63 nt, Homo Sapiens
uagaaauggcuguugcguauuuuuacugcgggucccaucgacugacuaaucaucuucuuagca

SEQ ID NO: 190711 - RNA, 63 nt, Homo Sapiens
agggagggcagacggaggcccuggaucaggccccccaucgaggaguggcgcucccugucagag

SEQ ID NO: 190712 - RNA, 63 nt, Homo Sapiens
auuucaccuguuuacuuaggguaucuacccagacccaucgauucugaguucgggagaugauuu

SEQ ID NO: 190713 - RNA, 63 nt, Homo Sapiens
aggagcgccgcccccugcuccacagcgcccagucccaucgaccacccaagggcugaggagugc

SEQ ID NO: 190714 - RNA, 63 nt, Homo Sapiens
gaaccuuguauaauuaacuuucaguuaugauuucccaucgacauuuucuuugcccuguuugua

SEQ ID NO: 190715 - RNA, 63 nt, Homo Sapiens
cggguccaguacccaaccuugucccggcacaggcccaucgagccagccugaguggacagcagu

SEQ ID NO: 190716 - RNA, 63 nt, Homo Sapiens
ggguuccaggaccuggaacaucagugagugggucccaucgacaaauaacuuuuucaagcaaua

SEQ ID NO: 190717 - RNA, 63 nt, Homo Sapiens
aaaggggauagaaagcuccuuccucuauguccucccaucgagaucuguucuggggauggagcu

SEQ ID NO: 190718 - RNA, 63 nt, Homo Sapiens
ugggcccugcccacacaacaaggacccucugaccccaucgacccugcaugaaaauaaccucca

SEQ ID NO: 190719 - RNA, 63 nt, Homo Sapiens
ccagccaccccuucccugugccuuucuccuccacccaucgaaaggcaccguggguguaagaug

SEQ ID NO: 190720 - RNA, 63 nt, Homo Sapiens
ccagggguuaggucugcaggcccgucugcgguccccaucgagcaucaaggggacgcugugugu

SEQ ID NO: 190721 - RNA, 63 nt, Homo Sapiens
ugaaggaucacuggguugcaagauccagagauccccaucgaaccaacuccagaaggucauucc

SEQ ID NO: 190722 - RNA, 63 nt, Homo Sapiens
cucuggggcugaucacuuaguuugucagugucccccaucgacuggcaccaacuuugugauugg

SEQ ID NO: 190723 - RNA, 63 nt, Homo Sapiens
aggaggcccgucagccaugguggcugucuccgccccaucgagggggacccucgggagaccccg

SEQ ID NO: 190724 - RNA, 63 nt, Homo Sapiens
ccaggcccaacucugcuagcuucccagaccacccccaucgagugcggagagagugggagugcu

SEQ ID NO: 190725 - RNA, 63 nt, Homo Sapiens
aggccccucgggggcagcacgccuucugcccgccccaucgaggcccggccagcgcccacccca

SEQ ID NO: 190726 - RNA, 63 nt, Homo Sapiens
cccaugcaacccacgcucggcgccccggcccgucccaucgaggcgcccccgccccacccaucg

SEQ ID NO: 190727 - RNA, 64 nt, Homo Sapiens; identical to SEQ ID NO: 88035

SEQ ID NO: 190728 - RNA, 64 nt, Homo Sapiens; identical to SEQ ID NO: 88036

SEQ ID NO: 190729 - RNA, 64 nt, Homo Sapiens; identical to SEQ ID NO: 88037

SEQ ID NO: 190730 - RNA, 64 nt, Homo Sapiens; identical to SEQ ID NO: 88038

SEQ ID NO: 190731 - RNA, 64 nt, Homo Sapiens; identical to SEQ ID NO: 88039

SEQ ID NO: 190732 - RNA, 64 nt, Homo Sapiens; identical to SEQ ID NO: 88040

SEQ ID NO: 190733 - RNA, 64 nt, Homo Sapiens; identical to SEQ ID NO: 88041

SEQ ID NO: 190734 - RNA, 64 nt, Homo Sapiens; identical to SEQ ID NO: 88042

SEQ ID NO: 190735 - RNA, 64 nt, Homo Sapiens; identical to SEQ ID NO: 88043

SEQ ID NO: 190736 - RNA, 64 nt, Homo Sapiens; identical to SEQ ID NO: 88044

SEQ ID NO: 190737 - RNA, 64 nt, Homo Sapiens; identical to SEQ ID NO: 88045

SEQ ID NO: 190738 - RNA, 64 nt, Homo Sapiens; identical to SEQ ID NO: 88046

SEQ ID NO: 190739 - RNA, 64 nt, Homo Sapiens; identical to SEQ ID NO: 88047

SEQ ID NO: 190740 - RNA, 64 nt, Homo Sapiens; identical to SEQ ID NO: 88048

SEQ ID NO: 190741 - RNA, 64 nt, Homo Sapiens; identical to SEQ ID NO: 88049

SEQ ID NO: 190742 - RNA, 64 nt, Homo Sapiens; identical to SEQ ID NO: 88050

SEQ ID NO: 190743 - RNA, 64 nt, Homo Sapiens; identical to SEQ ID NO: 88051

SEQ ID NO: 190744 - RNA, 64 nt, Homo Sapiens; identical to SEQ ID NO: 88052

SEQ ID NO: 190745 - RNA, 64 nt, Homo Sapiens; identical to SEQ ID NO: 88053

SEQ ID NO: 190746 - RNA, 64 nt, Homo Sapiens; identical to SEQ ID NO: 88054

SEQ ID NO: 190747 - RNA, 64 nt, Homo Sapiens; identical to SEQ ID NO: 88055

SEQ ID NO: 190748 - RNA, 64 nt, Homo Sapiens; identical to SEQ ID NO: 88056

SEQ ID NO: 190749 - RNA, 64 nt, Homo Sapiens; identical to SEQ ID NO: 88057

SEQ ID NO: 190750 - RNA, 64 nt, Homo Sapiens; identical to SEQ ID NO: 88058

SEQ ID NO: 190751 - RNA, 64 nt, Homo Sapiens; identical to SEQ ID NO: 88059

SEQ ID NO: 190752 - RNA, 64 nt, Homo Sapiens; identical to SEQ ID NO: 88060

SEQ ID NO: 190753 - RNA, 64 nt, Homo Sapiens; identical to SEQ ID NO: 88061

SEQ ID NO: 190754 - RNA, 64 nt, Homo Sapiens; identical to SEQ ID NO: 88062

SEQ ID NO: 190755 - RNA, 64 nt, Homo Sapiens; identical to SEQ ID NO: 88063

SEQ ID NO: 190756 - RNA, 64 nt, Homo Sapiens; identical to SEQ ID NO: 88064

SEQ ID NO: 190757 - RNA, 64 nt, Homo Sapiens; identical to SEQ ID NO: 88065

SEQ ID NO: 190758 - RNA, 64 nt, Homo Sapiens; identical to SEQ ID NO: 88066

SEQ ID NO: 190759 - RNA, 64 nt, Homo Sapiens; identical to SEQ ID NO: 88067

SEQ ID NO: 190760 - RNA, 64 nt, Homo Sapiens; identical to SEQ ID NO: 88068

SEQ ID NO: 190761 - RNA, 64 nt, Homo Sapiens; identical to SEQ ID NO: 88069

SEQ ID NO: 190762 - RNA, 64 nt, Homo Sapiens; identical to SEQ ID NO: 88070

SEQ ID NO: 190763 - RNA, 64 nt, Homo Sapiens; identical to SEQ ID NO: 88071

SEQ ID NO: 190764 - RNA, 64 nt, Homo Sapiens; identical to SEQ ID NO: 88072

SEQ ID NO: 190765 - RNA, 64 nt, Homo Sapiens; identical to SEQ ID NO: 88073

SEQ ID NO: 190766 - RNA, 64 nt, Homo Sapiens; identical to SEQ ID NO: 88074

SEQ ID NO: 190767 - RNA, 64 nt, Homo Sapiens; identical to SEQ ID NO: 88075

SEQ ID NO: 190768 - RNA, 64 nt, Homo Sapiens; identical to SEQ ID NO: 88076

SEQ ID NO: 190769 - RNA, 64 nt, Homo Sapiens; identical to SEQ ID NO: 88077

SEQ ID NO: 190770 - RNA, 64 nt, Homo Sapiens; identical to SEQ ID NO: 88078

SEQ ID NO: 190771 - RNA, 64 nt, Homo Sapiens; identical to SEQ ID NO: 88079

SEQ ID NO: 190772 - RNA, 64 nt, Homo Sapiens; identical to SEQ ID NO: 88080

SEQ ID NO: 190773 - RNA, 64 nt, Homo Sapiens; identical to SEQ ID NO: 88081

SEQ ID NO: 190774 - RNA, 64 nt, Homo Sapiens; identical to SEQ ID NO: 88082

SEQ ID NO: 190775 - RNA, 64 nt, Homo Sapiens; identical to SEQ ID NO: 88083

SEQ ID NO: 190776 - RNA, 64 nt, Homo Sapiens; identical to SEQ ID NO: 88084

SEQ ID NO: 190777 - RNA, 64 nt, Homo Sapiens; identical to SEQ ID NO: 88085

SEQ ID NO: 190778 - RNA, 64 nt, Homo Sapiens; identical to SEQ ID NO: 88086

SEQ ID NO: 190779 - RNA, 64 nt, Homo Sapiens; identical to SEQ ID NO: 88087

SEQ ID NO: 190780 - RNA, 64 nt, Homo Sapiens; identical to SEQ ID NO: 88088

SEQ ID NO: 190781 - RNA, 64 nt, Homo Sapiens; identical to SEQ ID NO: 88089

SEQ ID NO: 190782 - RNA, 64 nt, Homo Sapiens; identical to SEQ ID NO: 88090

SEQ ID NO: 190783 - RNA, 64 nt, Homo Sapiens; identical to SEQ ID NO: 88091

SEQ ID NO: 190784 - RNA, 64 nt, Homo Sapiens; identical to SEQ ID NO: 88092

SEQ ID NO: 190785 - RNA, 64 nt, Homo Sapiens; identical to SEQ ID NO: 88093

SEQ ID NO: 190786 - RNA, 64 nt, Homo Sapiens; identical to SEQ ID NO: 88094

SEQ ID NO: 190787 - RNA, 64 nt, Homo Sapiens; identical to SEQ ID NO: 88095

SEQ ID NO: 190788 - RNA, 64 nt, Homo Sapiens; identical to SEQ ID NO: 88096

SEQ ID NO: 190789 - RNA, 64 nt, Homo Sapiens; identical to SEQ ID NO: 88097

SEQ ID NO: 190790 - RNA, 64 nt, Homo Sapiens; identical to SEQ ID NO: 88098

SEQ ID NO: 190791 - RNA, 64 nt, Homo Sapiens; identical to SEQ ID NO: 88099

SEQ ID NO: 190792 - RNA, 64 nt, Homo Sapiens; identical to SEQ ID NO: 88100

SEQ ID NO: 190793 - RNA, 64 nt, Homo Sapiens; identical to SEQ ID NO: 88101

SEQ ID NO: 190794 - RNA, 64 nt, Homo Sapiens; identical to SEQ ID NO: 88102

SEQ ID NO: 190795 - RNA, 64 nt, Homo Sapiens; identical to SEQ ID NO: 88103

SEQ ID NO: 190796 - RNA, 64 nt, Homo Sapiens; identical to SEQ ID NO: 88104

SEQ ID NO: 190797 - RNA, 64 nt, Homo Sapiens; identical to SEQ ID NO: 88105
